United States Patent 9,878,056 (MODIFIED POLYNUCLEOTIDES FOR THE PRODUCTION OF COSMETIC PROTEINS AND PEPTIDES) - sequence listing, part 3

SEQ ID NO: 2553 - DNA, 5031 bp, Artificial Sequence
  Description of Artificial Sequence: Synthetic coding sequence
atggaaagatgttctcgctgtcatcgactgttgctgctcttgcctctggtgcttgggcttagtgctgcacctggttgggccggcgcccctccggtcgacgtgttgagagctctcagatttccatctctaccagacggcgtccggagagctaagggtatctgtccagcggacgtggcctatagagtggcacgcccagctcagttgagcgctccgacacgacagctcttcccgggcggttttcctaaggacttctcactgctaacagtcgtgcggactaggcctgggctacaagctcccctcctgaccctgtatagcgcacagggagtgaggcaactgggcctcgaactgggaagacccgtgcgcttcctttacgaggaccagaccggccgtcctcaaccaccctcccaacctgtgtttcgcggcctgagtcttgcagatggaaagtggcatcgtgtggctgttgcagtgaagggacagtccgtgaccctgatcgttgactgtaaaaaaagagtcacaaggcccttgccgcgctcggcgaggcctgtgttagacacacacggagtgattatctttggtgccagaatcttagatgaagaggtctttgaaggcgacgtgcaagaattagcgatcgttccaggagtgcaggcagcatacgagtcctgtgagcagaaggaattggagtgcgagggtggacagagggagcggcctcagaaccagcagccccatcgagcccagaggtccccacaacagcagccttccaggttacatcggccacagaaccaggagccacagtcacaacccacggagtcgttgtactacgattatgaaccaccctattatgacgtgatgactacgggtactactccagattatcaagaccccacacctggcgaagaagaggagatccttgagtcgagtctgcttcctccgttagaggaggctgctcacgggccacgaggcctcaaaggcgagaagggcgaacctgcggttctggagcctggtatgttggttgagggccccccggggcccgaggggcctgctggcttgattgggccccccggtattcaagggaatccaggtcctgtgggggaccccggcgaacgcggcccacccgggcgggccggactcccagggagcgacggagctccagggccaccagggacttcgttgatgctcccattccggttcggatctggcgggggtgataagggacccgtcgttgctgcccaggaggcccaggcacaggccatcctccaacaggctagactggccctgcggggaccccccgggccaatggggtacacgggtagaccgggccctctaggacaaccgggaagccccgggttgaagggcgaatctggcgacttgggcccgcagggaccccgcggccctcagggattgaccgggccaccaggcaaagccggacggagaggccgggcaggtgcagatggagctaggggaatgcccggtgacccgggagtaaaaggggatcggggatttgatggactgcccgggcttcccggcgagaagggtcatcgcggtgacaccggagcccagggcttgccaggacccccaggcgaggacggcgaaagaggggacgacggggagattggaccccgtggattgccaggtgaaagcggccctaggggactcctcggtcctaaaggcccacctggcataccgggacccccaggagtcagaggtatggacggaccacagggccctaaaggaagtcttggaccgcagggtgagcctggaccacccggacagcagggaacccccggcacacagggactccccgggcctcagggcgccatcgggcctcatggggaaaagggccctcagggcaagccaggcttgcctggcatgccaggtagtgatggcccccctggccaccctggaaaagaaggccctcccggaactaaagggaaccagggcccatccggccctcaggggcctctcggctatcctggtccaaggggagtcaagggggtggacggcatccggggcctgaaagggcacaaaggagaaaaaggcgaggacgggttccctggatttaagggtgatatcggagtaaaaggtgatcgtggtgaagtgggtgtgccaggctcccggggagaagatggtccagagggccctaaaggaaggacgggtccaaccggcgacccggggcctccgggcctgatgggcgagaaaggtaagctaggggtgccgggacttcccggataccctgggcgccaggggccgaaagggtccttaggcttccccggctttccaggcgcctcaggagagaaaggagctagaggactgagtggtaagtccggaccacgaggtgaacgtggcccaacggggccaaggggtcagagaggcccccgcggagcgaccggcaagtcaggggccaaaggtaccagtggcggtgacgggccgcatggccctccaggcgaacggggactgccgggtccccaaggcccaaacgggttccctggccccaaaggtccacccgggccgccagggaaagatggcctgcccggccacccagggcagaggggagaggttggctttcagggtaaaacaggaccacccggcccccccggtgtggtcgggccccagggagccgctggtgaaacggggcctatgggcgaacgcgggcatcccgggccaccgggaccccctggagaacagggcctgcctggcacagccgggaaagagggaacaaaaggcgaccctgggccccctggagctccaggaaaagacggcccggcaggattgcgcgggtttcccggagagagagggctaccaggaactgccggcggaccaggtctgaagggtaatgagggcccctccggcccacctggacccgccggtagcccaggcgagcgtggtgccgccggatctggagggccaatcggtccccccggtcgcccagggcctcaaggtcctcctggggccgctggagaaaagggtgtgcctggtgaaaaggggccaatcggcccaaccggacgcgacggggtgcaaggaccagtgggactgcccggacctgccggacctccaggtgtggcaggggaagacggcgacaaaggagaggtcggagaccctggtcagaaagggaccaagggcaataaaggtgagcacggtcctccgggcccgcctgggcctattggccccgtaggccaacctggcgcggcgggcgctgacggtgagcctggagctcgcggcccacaaggccacttcggcgcaaagggtgacgaggggacccgggggtttaatggcccacccgggcccattggactgcagggactgcctggcccatcaggggaaaaaggggagacaggtgacgttgggcccatgggaccgccaggaccacccggtcccagaggacccgctgggcccaacggagctgacggtccacagggaccacccggaggggtgggcaacctgggacccccgggagagaaaggtgaaccgggagagagtggctcccctgggattcagggggaacccggggtcaagggccctcggggagagaggggggaaaaaggcgagagtgggcaaccaggagaaccaggccccccaggcccgaaggggcccacgggcgacgacggccctaaggggaaccctggtccagtggggttcccgggggaccccgggccccctggggagggtggcccgcgaggacaagatggcgcgaaaggggatagaggagaagacggcgaacctgggcagccgggcagcccgggtcctactggcgaaaatggccctcccggcccattaggcaaacgaggaccagctgggagccccggctcagaggggaggcagggcggtaaaggcgctaaaggcgaccccggggctatcggtgccccagggaagacgggtccggtagggcctgcagggcccgcaggcaaaccgggccccgacggcttgcgggggttgccaggctcagtgggacagcagggcaggcctggggccacaggccaggcagggcctcccggtccagtaggtcctccaggtctgccggggttgaggggggatgccggcgccaagggcgaaaagggacatcctggactcatcggacttatagggccaccaggagagcagggtgaaaaaggcgaccggggacttcccggaccccagggctctccaggacaaaaaggggaaatggggatccccggcgctagtgggcctatcgggcctggtggccctcctggactcccagggcccgcgggccctaagggggccaaaggggcaacggggcctggtgggcccaaaggtgagaagggagtgcaggggcccccaggtcacccagggccacctggtgaggttatacagcctctaccaattcaaatgccaaaaaagaccaggcggtccgtggatggtagccgactcatgcaagaagatgaagccattcctactgggggggccccagggtctcccggaggtctggaagagatattcgggagcctggatagtctgcgtgaggagatcgagcaaatgcgtcggcccacaggaacacaggattcaccggcgcgaacttgtcaggatctcaaactctgccatccagaactaccggacggggagtactgggttgatcccaaccaaggctgcgccagagatgcgtttcgggtgttctgtaatttcactgctggtggcgagacttgcgtgaccccgcgagacgatgtgactcagttctcctacgttgattcggaaggatctcccgttggcgtcgtgcagctgacctttctgcgactgctgtctgtgtcggctcaccaggacgtgagctatccatgcagtggcgctgctagagatggacctctccgtctcaggggcgccaacgaagacgaactgtctccggaaaccagcccttacgtgaaggaattccgtgatggctgccagacccaacagggccgaactgtgttggaagtgcgaacccctgtattagaacaactacccgttctggacgcctcatttagtgatctgggggccccgcctcggagagggggggtcctgcttgggccagtctgttttatgggctag

SEQ ID NO: 2554 - DNA, 1875 bp, Artificial Sequence
  Description of Artificial Sequence: Synthetic coding sequence
atggagaggtgctctcgatgccacagactccttttgttgctcccactggtcctgggcctgtctgctgcccccggctgggccggcgctcccccagttgatgtactcagagctcttaggtttccctcactgcctgacggcgtccggcgggccaagggtatctgtcccgcagacgttgcctaccgagttgctagaccagcacagctctctgccccgacacgtcagctgttcccaggcggctttcctaaggatttcagcttgctaaccgtggtccggactagacccggcctgcaggctcccctgctgaccctttatagcgctcagggcgtgcgccaattgggcctggaactggggaggccagtgagattcctttacgaggatcagaccggacggccacagccgccttctcaacccgtctttcggggactaagccttgccgacggaaaatggcaccgcgtggctgtggcagtaaagggacagtcagtgaccctaatcgtcgactgtaagaagcgggttacaagaccactgccccgcagcgcccggcctgtcttggacacccacggcgttatcatcttcggcgcaaggattctggacgaagaagttttcgaaggagacgtgcaggagctggcaattgttccaggtgtgcaggcggcatacgagagttgtgaacagaaagagctggagtgcgaagggggtcagcgggagaggcctcagaatcaacagccacacagagctcagcgatccccccagcagcagccgtcgcgactacataggccccagaatcaggagccccagtctcagccgacagagtccctttattatgattacaagccaccttattatgacgtcatgactaccggcaccaccccagattatcaagacccaacccccggggaagaagaagagattctggagtcaagcctgctcccccctttggaagaggagcagacggacctgcaggtgccgcccacggcagaccggtttcaggccgaggagtatggagagggtggaaccgatccgccagagggcccctacgattatacatacgggtatggtgacgactatcgggaggaaactgaactgggccctgcactgagcgctgagacagctcactcaggcgccgccgcccacggtcctcgcggcttgaaaggcgagaagggggagccggctgtgttggaaccaggaatgttggtagaggggccacctggtccagaggggcctgctgggctaataggaccccctggcatccagggtaacccgggaccagtgggcgaccccggggagcggggcccccctggtagagcgggattgcccggctctgacggcgcgcccggccctcctggtacttcacttatgctgccattccggttcggtagcgggggtggcgataaaggacctgttgtggccgcccaggaagcccaagcacaggctatccttcaacaggccagactcgcactgcgtggaccaccaggacctatggggtacacggggcgccctggtccactcggccagcccggaagtccggggttgaaaggggaaagcggagacctgggcccccaggggccccgcggaccacaaggtctcacagggccaccagggaaggccgggagacgggggcgagctggggctgatggggcacggggcatgccaggagacccgggagttaaaggcgatagaggcttcgatgggttgcccgggctgccaggagagaaggggcatagaggggatactggcgcgcagggcctgcctggcccccccggtgaagatggcgagcgcggcgacgacggcgaaatagggcctaggggtctaccaggggaatcaggccccagaggtttgctcgggcccaagggaccgcccggtataccaggtccgccatag

SEQ ID NO: 2555 - DNA, 4953 bp, Artificial Sequence
  Description of Artificial Sequence: Synthetic coding sequence
atggagagatgctctaggtgtcatcgactgctgctgctattgcccctggtcctcggcctaagcgctgcaccaggttgggctggggcacccccagtggatgttcttagggcactccgctttccctcattacccgatggtgtgcgcagggctaagggaatctgccctgccgacgtggcctaccgtgttgcccggcccgcccagttgtccgcgccaactcgacaattgttccccggaggtttcccgaaagacttctctttgctaacagttgtccgcacaaggccaggccttcaggcccccctcctgaccctctattctgcgcagggcgtgaggcagttagggctagagctggggcctcctgtcagattcttgtatgaggaccagactggacgccctcagcctcccagccagcccgtgttcagagggctgagccttgccgatggcaaatggcatagagtggccgtggctgtcaaaggacagagcgtgaccctgattgtagactgcaaaaagcgcgtgactcggcccctgccacgatctgcccgcccagttctagacacccatggggtgataattttcggcgctcgtattttagacgaagaagtgttcgaaggggacgtgcaagagctggctattgtgcctggcgtgcaggctgcttacgaaagttgtgagcagaaagagctcgaatgtgaggggggtcagagggagcgcccccagaaccagcagccgcaccgggcgcagcggtccccgcagcaacaaccgtctcggctgcatagaccacagaaccaggagcctcagtctcaggatcccactcctggtgaagaagaagaaattctcgagtcctcactgcttccacctctagaagaggcagcccacggcccgcgcggcctgaaaggtgaaaagggcgagccagctgtgctagagcctgggatgctcgtggagggccccccagggccagaaggcccagccggactgataggtcctcccggcatccaaggaaatcctgggcctgtgggcgatccaggggagagggggccccccggtcgcgcaggccttcccggctccgatggcgctccggggcctcccgggacatcccttatgctccccttccgcttcggaagcggcggaggggacaaggggcccgtggttgccgcgcaggaggcccaggctcaggcaattcttcagcaggctagactcgcgctgcggggaccgccaggccctatgggttataccggccggcccgggcctcttggccaacccggctcccctggcctgaaaggcgagtcaggggatctggggcctcaaggccctagaggaccacagggtttaacagggccccccggaaaagcagggcggcgtggcagagccggggcggacggagcaagagggatgcctggcgacccgggggtgaaaggggataggggcttcgacgggttgccagggctgcctggtgagaagggccaccgtggcgatacaggagcgcagggactccccggaccaccaggcgaagatggggagcgtggcgacgacggcgagattggccctaggggcctccctggggagtcaggtcctcggggccttctcggacctaagggtcccccaggcatccccgggcctccgggagtgcgaggtatggacggacctcagggccccaagggaagcctgggcccacagggtgagccggggccccccggtcagcagggaaccccagggactcaagggctgccagggccacaaggcgcgattgggcctcacggggagaagggccctcagggaaagcccggcctaccgggaatgcctggcagtgacggaccaccaggacaccccggtaaagagggtcctcctggcaccaagggaaatcagggtcctagcggcccgcagggcccactaggatatcctgggcctaggggcgtgaaaggcgtagacggcatccgcggcctgaagggccacaagggtgagaaaggggaggatggattccccgggttcaaaggcgatatcggcgtgaagggagacaggggtgaggttggggttcctgggtcacgcggcgaagacgggccagagggaccgaaaggtcgtacgggtcccaccggagatccaggcccacccggcctgatgggagaaaagggcaaactaggcgttcctgggctgcccggttatcctggccggcagggaccaaaaggaagccttggttttcccggtttccctggcgccagtggagagaagggcgccaggggactgagcggcaagagtggtccacgcggggaaaggggtcctactggacctcggggccagaggggaccacggggagcaacagggaagagcggagccaaggggacaagcggcggcgacggtccccatgggcctcctggtgaacgtgggttaccaggcccccagggccctaatggatttcctggccctaagggacctcccggaccacccgggaaagacggcttgcccggtcaccccggccaacgtggtgaggtagggtttcaaggcaagaccggcccccccggtccacctggagttgtcggcccgcagggtgccgccggggaaactggacccatgggagagagaggccacccagggccccctgggccgcctggagagcaggggctacccggtactgctggcaaggagggtaccaagggtgatccaggccctccaggagcccctggtaaagacggccccgccggtctgcgcgggttcccaggtgaaagggggctaccagggacggctggcggacctggactcaaagggaacgaggggccttctggccctcctggcccagcaggcagccctggggaacggggagcagccggatctgggggacctatcggcccacccggacggccaggccctcagggacctcctggagctgccggcgaaaaaggggtgcctggtgagaaggggccaatcgggccaaccggcagggacggagttcagggccccgtgggtctgcccgggcccgctggtcctccaggcgttgccggtgaagatggcgacaagggtgaagttggcgatcccggtcaaaaggggacaaagggaaacaagggagaacacggtccacctggcccccccggcccaatcgggccagtcggccagcccggtgccgccggtgcggatggggagcccggagcgagagggcctcaaggccacttcggcgcaaaaggagacgagggtacaaggggtttcaacggccctccgggcccgattggcctgcagggactgcctggccccagtggagagaaaggcgagacaggcgacgtgggacctatgggaccacctgggcctcccggccctaggggtcctgcggggccaaatggagcagacggcccacaaggaccgccaggaggggtgggtaacctgggacctcccggcgagaaaggagaacctggcgaatccggcagcccagggatccagggcgaacctggcgtgaagggacccaggggagaacgaggtgaaaaaggtgagtcagggcagcctggcgagccaggaccccctggtcccaagggaccaacaggagacgacgggcctaaggggaatcccggtcccgttgggtttcccggcgaccctggacctccaggagaaggcgggcccaggggtcaggacggggccaagggcgaccgtggagaggatggtgagcccggtcagcctgggtcacccggacctaccggcgaaaatgggccccccggacctttgggcaagcgcggacccgccggaagtcccgggagcgaaggccggcagggaggcaagggcgctaagggggacccgggcgccatcggtgccccgggcaaaaccggccccgtgggccccgcggggcccgccggcaaaccaggtccagatggcctccgggggctgccagggtccgtggggcagcagggccggcccggcgctacgggacaagcaggccctcctgggccagtgggcccacccggcctgcctggtctgagaggggatgcgggcgccaagggcgaaaagggccaccccggcctcatcggactaattggtccacccggcgaacagggggaaaagggcgatcggggactgcctgggcctcaagggtcccccggccagaagggcgaaatgggaattcccggagcatccggccctattggacccggaggcccccctggattgcccggacccgccggtcccaaaggcgccaaaggggcaacgggccctggaggaccgaagggagagaaaggcgtgcaggggccaccaggacacccagggccccccggagaggtaatacagccacttccaattcagatgcctaaaaaaactcgccggagcgtggacggaagtcgcctgatgcaggaagacgaggccatccctacggggggggctcccgggtcacctggcggcctcgaggagattttcggctcattggattccctgcgggaggaaatcgagcagatgcgtcggccaacaggcacacaggacagtcccgcacgaacatgtcaggacctgaagttatgtcacccagaactacctgatggtgaatactgggttgacccgaaccagggctgcgccagagatgccttccgcgtgttctgtaacttcaccgccggcggtgagacctgtgtgactccacgagacgacgtcacacagttctcttacgtggattcagaaggctcccctgtgggcgtagttcagttaacatttctgaggttactgtccgtgtcggcacaccaagatgtgtcatatccttgttccggggccgctcgggacggccccctgcgtctgcgcggcgccaacgaggacgagttgtccccagagacttccccatacgttaaggaattccgggacggctgtcagacacaacaggggagaaccgtgctggaagtaagaactcccgtgttggaacagcttcccgtgttggacgccagcttttctgacctgggcgctcccccacgccgggggggcgtgctgctaggcccggtctgcttcatgggctag

SEQ ID NO: 2556 - DNA, 1002 bp, Artificial Sequence
  Description of Artificial Sequence: Synthetic coding sequence
tagaatcagtctccgcaggctcatcgttccacagttccgcatactgcggggctgggccagctgtgcttgcttggcttcgggatggattggagggcatctgaagcttggatggttcccagggcacccaaaggggcctgggaccctagggaatcgcaggacttactcgataatcgggctccccttggccctagggtttttccaggacctcgagtaccctccgcattgatggaaagacgggtgctgaaggggtcccaggggagtcctgcttgtttaggccctccgggcgaggtgatccagcctctgcctattcaaatgcctaaaaagacccgtaggtctgtggacggtagtcgtctcatgcaggaggacgaagccattccaactgggggggcaccaggatccccagggggactcgaagagatcttcggctctctggactccctgagggaggagatcgagcagatgcggagacctactggcactcaggattctcctgcgcggacctgtcaggatctgaaactgtgccacccggaacttccagacggggagtattgggtagacccaaaccagggctgcgcgagggacgccttcagagtcttttgtaactttactgccggaggcgagacatgcgtcacacctagggatgacgtcacacagttcagctatgtcgattcagagggaagtcccgtgggcgttgtacagttgacctttctgaggttactctcagtgtcagctcaccaagatgttagctatccctgtagcggcgccgcccgtgacggacccctcagactgcggggggccaatgaagacgaactcagcccggaaacttctccttacgtgaaagaattcagagatggttgtcagacgcagcaaggccggacagttctggaagtccgcacacccgtcttggagcagctgccagtgctcgatgccagtttcagcgatttaggtgctccgccacgacggggcggagttctgctcggcccggtctgttttatgggctag

SEQ ID NO: 2557 - DNA, 792 bp, Artificial Sequence
  Description of Artificial Sequence: Synthetic coding sequence
taagctccacccgttgacgtgcttcgagcactgcgtttccctagtttacccgacggggtccggcgagcaaaaggtatctgcccagctgatgtggcgtatagggtggctcggccagcccagctttcagctccaaccaggcagcttttccccgggggatttcccaaggacttctccctgttaactgttgtgagaactaggcctggcctccaggctccactgctaaccctgtattctgcccagggcgttagacagctgggcttggagcttggaaggcctgtacgcttcctttacgaggaccagacaggccgaccgcaacctccctctcaacctgtgttcaggggtctgagtctagcagacggaaagtggcatcgggtagcggtggccgtgaagggccaatctgtaactcttatcgtggactgcaaaaaacgagtgacgcggccactcccaagatcagcccgtcctgtccttgacacacacggcgttattatctttggtgcccggatactagacgaagaggtcttcgagggggacgtgcaggagctggccattgttcccggcgtacaggcagcctatgaaagttgcgagcaaaaggagctcgagtgtgagggcggccaaagggaaagaccgcagaaccagcagccacaccgcgctcagaggagtcctcagcagcaacctagccgcctacatcgacctcaaaatcaggaaccccaatcacaagtgcgagaactgggtgagccaccgtcagctgcgcacccgagggagggccgccatcccggaatttctccaccctag

SEQ ID NO: 2558 - DNA, 873 bp, Artificial Sequence
  Description of Artificial Sequence: Synthetic coding sequence
atggagcgttgctctaggtgtcacagactgcttctgttgctccccctagttttgggactaagtgccgcgccaggttgggccggagctcctccagtagatgttcttagggcactgcggtttccgagcttaccggacggcgtgaggcgagcaaagggcatctgtccagctgacgtggcctatagggtggctaggcccgcacagcttagcgcccccacgcgccagctgtttccaggaggctttccaaaagacttttccttgttaaccgtcgtgcgcacacgcccaggcttgcaggcgccactgcttaccctctatagcgcccagggagtgagacagctcggactcgaactcggcccgccggtcagattcctttacgaggaccaaacaggacgcccacaacctccaagtcaacccgtttttcgtggtctaagcctggccgacggcaagtggcatcgggtcgccgttgccgtgaaaggacaaagcgtgaccctgatcgtggactgcaaaaaaagggtaactagaccgctgcctcgtagcgcccgacctgtgttggatacacatggcgtgattatcttcggggcacgaatccttgacgaagaagtcttcgaaggggatgtccaggaactcgccattgttcccggtgtgcaagctgcttacgaatcatgtgagcagaaggaactcgagtgcgaggggggacagcgggagaggccacagaaccagcagccacatcgcgcccaacgttcgcctcagcagcagcctagcagactccatcggcctcaaaatcaggaaccgcagagccaggtgcgggagctcggagaacctccatccgctgcacatccgcgcgaaggcaggcatccaggtatctcaccaccctag

SEQ ID NO: 2559 - DNA, 1875 bp, Artificial Sequence
  Description of Artificial Sequence: Synthetic coding sequence
atggagaggtgcagccgctgccacagactcctgcttctgcttcctctcgtcttgggcctctctgctgctcctggttgggcgggggctcctccagtggacgttctccgagcattaaggtttccctctctcccagatggggttcggagagctaagggcatttgtcctgcggatgtcgcatatcgagtggcgaggccagcacaactgagcgcccctacccggcagctgttccctggcggattccccaaggatttttcacttcttacagtggtcaggactcgccccggactccaggcccctttactcaccctgtactcggctcagggcgtcagacagctcggactggaactcggacgccccgtcagatttctctatgaggaccagactgggcggcctcaacctccaagtcagccagtcttccgcggattgagcctagcagacgggaagtggcatagggtcgctgtcgccgttaaaggccagtctgtgacccttattgtagactgcaagaaacgtgtgacccgacctctcccaaggtctgccaggcccgtcctcgatactcacggcgtgattattttcggcgcccgcatactggacgaagaagttttcgagggtgacgtgcaggagctggctattgtcccaggagtacaggctgcctacgagagttgcgaacaaaaggaactggagtgcgagggggggcagcgcgaacggcctcaaaaccaacagccccaccgggcacagagaagccctcagcagcaaccgtccagattacacaggcctcagaatcaggagcctcagagtcagcctacggagagtctgtactacgactacgagcctccttactatgacgtcatgaccactgggactactcctgactatcaggatcctacccccggcgaagaagaggaaatcctggaatcgagcctgctcccacctttggaggaggaacaaaccgacctgcaagtgcccccgacagctgataggttccaagccgaggagtacggagagggggggaccgacccgcccgagggcccgtacgattacacatacggctacggcgacgactatcgcgaggaaaccgagctgggcccagctcttagcgcagaaaccgctcatagtggggccgcagcccacggaccccggggcctgaaaggagagaagggtgaaccggctgttcttgagcctggaatgctcgttgagggaccacccggccccgagggccctgcagggctgattgggccaccaggtatccaaggcaacccggggcccgtgggggatcctggggaacgggggccaccaggcagggccggccttcccggcagcgatggagcccccgggcctccaggaactagtctgatgttaccatttcgatttgggtctggcggcggggataaagggcctgttgtggctgcacaggaggctcaggctcaggctatcctacagcaagcacggttggccttgcgaggccctcctggacccatgggctatacaggccgcccaggcccactgggacagcccgggagccctggactgaaaggcgaatcaggtgatttaggaccccagggacccaggggtccccagggattgaccgggccaccgggtaaagctgggcgccggggccgcgccggcgcagatggggcaaggggaatgcccggcgatcctggggtcaagggtgacagaggcttcgacgggcttccgggccttcccggggagaagggtcacagaggagacacaggagcccaggggctgcctgggccccctggagaggatggggagcgcggcgacgacggcgagatcggacctaggggcctgcccggtgaaagtggtcctaggggactgttaggccccaagggcccgcctgggattcccggtccaccttag

SEQ ID NO: 2560 - DNA, 873 bp, Artificial Sequence
  Description of Artificial Sequence: Synthetic coding sequence
atggagaggtgtagcaggtgccacaggctgctcctgctgctgccccttgtgctgggtttaagcgccgcgccgggatgggctggcgcgcccccagtagacgtgctcagagccctgcgctttcccagcctacctgatggtgtgagacgcgccaaaggaatctgcccggccgacgttgcctacagagtggccagaccagcccagttaagtgcccctacccgccagctgttccccggtggtttccccaaggatttctcattactgacagtggttaggaccaggcctgggctgcaagcaccattactgacactgtattcagctcagggtgtgcggcaacttgggctcgagttgggtcggcctgtgcggttcctatacgaggatcagaccggtagacctcaacccccatcccagccagtgtttaggggcttgtctttggcagatggtaagtggcaccgggttgctgttgctgtcaagggccagtccgttaccttgatcgtagactgtaagaagagggtgactcgacctctgcctcgctctgctcggcctgtgctggatacccacggcgtgattatattcggagcgcgcatcctggacgaagaagtgttcgagggggatgtgcaggagctcgccattgttcccggcgtccaagcagcctatgagagctgtgagcaaaaggaactcgaatgcgaaggagggcagcgtgagagaccccaaaaccaacaacctcatagggctcagcgcagccctcagcaacagccgtcccggctgcaccggccacagaaccaggagccccagtcccaggtgcgggaactcggagaacctccgtctgcagctcacccgcgagagggccgacacccgggtatatctcccccgtag

SEQ ID NO: 2561 - DNA, 1002 bp, Artificial Sequence
  Description of Artificial Sequence: Synthetic coding sequence
taaaaccagtctccgcaggcacaccgcagtacagtcccccacactgctggcctggggcagctatgcttgctggggttcgggatggactggagagccagcgaagcctggatggtgccgagggcccccaaaggcgcttgggaccctagggagtcccaggacctgctggataaccgggcccctttgggcccccgggtgttccctggtccaagggtcccatctgcactcatggaaagaagagtcctaaagggaagtcagggcagccccgcctgtctcggacctccgggcgaggtgattcagcccctcccaattcagatgccaaagaaaactcgccgatcggttgacggcagccgcctgatgcaggaggacgaggcgatcccaaccgggggggctccaggatctcctggcgggctggaggagatcttcggttcactggacagcctgcgggaagagatcgaacaaatgcgccgccctaccggcactcaggactcccccgcgagaacgtgccaggacttgaagctttgccatccagaattgcccgacggggaatattgggtggatccaaaccaggggtgcgcccgcgacgcgttcagggtcttttgtaactttaccgcaggcggtgagacctgtgtgaccccaagggatgacgtgacccagtttagctacgtagattccgagggcagccctgtcggcgtcgttcagctaacattcttaagactgttatccgttagcgctcatcaagatgtcagttatccttgttcaggggcagcccgcgacggtcccctgagattgcgcggtgcaaacgaagacgagctgtctcccgaaaccagtccatacgtgaaggaatttagagatgggtgtcaaacacaacagggaaggactgtactggaagtgcgaacacccgtcctagagcagctgcctgtgctcgacgcaagcttttccgatctgggcgccccaccacggcggggcggggtcctgctgggcccagtgtgcttcatggggtag

SEQ ID NO: 2562 - DNA, 4872 bp, Artificial Sequence
  Description of Artificial Sequence: Synthetic coding sequence
taagcgcccccagtggatgttctgagagcactccgattccccagtctgcctgatggtgtgaggagagccaaggggatctgcccggcagacgtcgcctatcgcgtggcccggcccgctcagttatccgcacctacacggcaactgttcccaggcggattccccaaggatttctccttgctgacagtcgtgaggactcgtcccggcctgcaggcacctcttcttaccctctacagcgcacaaggggtgagacagttaggccttgaactgggaagaccagtgaggttcttgtatgaggaccagacaggaagaccccagccgccatcacagcctgtctttcgcggtctgagcctcgcagacggaaagtggcacagagtcgcagtggccgtcaagggacagtccgtgaccctcatcgtcgactgcaagaagcgagtaacccggcctctaccaaggtccgcaagacccgtgcttgatacccacggggtcattatttttggcgccagaatcctcgatgaagaagtttttgaaggagacgtgcaagagctggccatcgtacctggcgtgcaggcagcttatgaatcttgcgagcaaaaagagctcgagtgcgaaggcgggcagcgcgaacggccgcagaatcagcagccacaccgcgcccagcggtctcctcagcaacagccaagccgcttacataggccacagaatcaggagcctcagtcacaggatccaacccccggggaggaggaagaaatcctagaatcctccttgctgcctcccttggaagaggcagcccacggccctcgaggactcaagggcgaaaagggagagccggccgtccttgagccaggtatgctggttgagggtccccctgggcccgaaggccccgcaggccttatcggccctccaggaatacagggcaaccccggtccggtgggtgaccctggcgagcggggcccaccgggtcgggccgggctgccaggctctgacggagcaccaggtccaccggggacaagccttatgctcccatttagatttggatctggcggcggcgacaaggggccggtggttgccgcccaagaggcgcaggctcaagctattctgcagcaggctcgactagccctgcgaggcccacctgggcctatgggctatacaggtagaccaggcccactcgggcagccggggagccctgggctaaagggcgaatcaggcgacctaggcccccaggggccgcggggcccccaagggcttaccgggccacccggtaaagctggaagaaggggacgcgctggcgccgatggcgcaagaggcatgcctggggaccccggtgttaaaggggatcgtggctttgacgggctgcctggccttcccggcgagaaaggccatcgcggcgatacaggcgcccagggattaccagggccgccgggagaggacggtgaaagaggggatgacggggagataggtccacgtgggctccctggcgagtctggccctcgcgggctcctggggcctaaagggccacctgggattccagggcctccgggcgtgcgagggatggacggtccgcaagggcctaaggggtcacttggcccacagggagaaccggggccgccaggacagcaggggacccctggaactcagggcctcccaggaccccagggagcgattggaccacatggcgaaaaggggcctcagggcaagccgggtttgcccggcatgcccggcagtgatggcccacccggccatccgggaaaggaggggccccccggaaccaaagggaaccagggaccctccgggccccagggccctctaggttacccaggtccgcgaggggtgaaaggagtggatgggatccgggggttaaaaggccacaagggggaaaagggtgaggacgggttccccgggtttaagggagatatcggagtcaaaggagatcggggagaggtgggagtccccggttctcgcggcgaggacggaccagaaggaccaaaaggtcggacaggaccgacgggcgatcccggccctcctggtcttatgggggagaagggtaaactcggtgtccctggcttaccaggctatcccgggaggcagggaccaaaagggtctctgggttttccgggattcccaggagcctccggtgaaaagggcgccaggggactgtcagggaaatcgggcccgagaggagagagggggccgaccggaccacggggccaaaggggcccgcgtggtgccacaggaaaatcaggggcaaaggggaccagcggcggcgacggaccccacggcccccccggcgaaagaggactgcccggaccccaagggcctaacggatttcccggacctaaaggccctccaggcccccctggcaaggatgggctgccagggcaccctgggcagcgcggggaagttggattccagggcaagaccgggcctcccgggccgccaggcgtcgtcggaccccagggggcagccggagagacgggtcctatgggtgaacgaggacaccccggaccacctggaccaccaggcgaacagggtctccccggtaccgctggcaaagaaggcaccaaaggcgatcccggaccacctggcgcaccaggaaaagacgggcctgctggcctcagagggttccctggcgagagaggcctgccaggtacagcagggggtcctggcctgaagggcaacgagggcccaagcggccctccggggcccgccggaagcccaggtgaaaggggtgcagccgggtccggggggcccatcggaccaccgggaaggccaggcccccaaggtccccccggggctgccggggagaagggagttccaggggaaaaggggcccattggtccaacgggtagagacggagttcagggccccgttgggttacctggcccagccggaccaccaggggttgctggtgaggatggcgataagggtgaagtgggagatcctggtcagaaagggaccaaaggcaacaagggagaacacgggcccccagggccccctggacctataggacctgtcgggcaacctggagccgccggggcagatggagaacccggggcaaggggacctcaggggcatttcggcgccaagggagacgagggtactcggggatttaatgggccgccaggaccgatcggcctacaggggttaccaggaccctcgggcgagaagggagaaaccggggatgtaggccctatggggccgcctggcccacccggcccacgaggccccgccgggcctaatggggccgatggcccacaagggccacccgggggcgttggcaaccttggtccgccaggagagaagggggagccgggagaaagcgggagccctgggatccagggtgagcccggcgtcaaggggcctcgaggtgaacgtggggaaaaaggcgagtccggacagccgggcgagcccggtccaccgggaccaaagggtcccactggcgatgacgggcctaaaggcaatcctggcccggtcggctttcctggggatcctggaccacctggtgagggagggcctagaggacaagacggggctaaaggcgaccggggggaagatggtgaacctggccagccgggatctccaggaccaactggggagaacggaccccccggaccactgggcaaaaggggaccggcgggatctcccgggagtgaagggcgccagggcggaaaaggcgctaaaggcgacccaggcgcgatcggggcccctggcaaaacggggcctgtagggccagctggccccgcaggaaagccagggcccgacggcctgcgcggtctcccaggcagcgtaggccagcaggggaggcctggagccaccggccaggctggcccaccggggcctgttgggccacccgggctgcctggcctccgtggtgatgccggcgctaaaggcgagaagggtcaccccggcctgattgggcttatcggtccaccaggggagcagggggaaaaaggagatagagggcttccaggcccccaaggcagtccaggccagaagggcgaaatggggatacccggcgcttccggtcctataggcccaggcggccctcctggcctgcccggcccagccggcccgaagggcgccaagggtgccaccggcccggggggccccaaaggggaaaaaggggttcaaggcccccctgggcaccccggaccacccggggaagtcatacagcccctgcccatccagatgcccaagaaaactcgtcggagcgtagatggcagtaggctgatgcaggaggacgaagccatccctaccggtggagcccccggctcacccgggggcctggaggagatattcggctctctggactccctgagggaagaaattgagcagatgcgtagaccaaccggaacgcaagatagcccagctcggacgtgtcaggatctaaaactgtgtcatcctgagctgcctgacggagagtattgggtggacccaaatcagggttgtgctagggacgcttttagagtgttttgcaacttcactgcagggggggaaacctgcgtcacgcctcgcgacgacgtgactcagttctcatacgtggattccgaagggtcacctgtgggggtggtgcagctaaccttcctgcgactcctatcagtgtccgctcatcaggacgtttcatacccatgctctggagccgctcgcgatggccctctgcggctgagaggggccaacgaggatgagctgagtcctgagaccagcccgtatgtgaaggagttccgcgacggatgccaaacacaacaggggcggacagtgctcgaggtgcgaacaccagtgctggagcaattacctgtactagatgcttccttttctgatcttggggctcctccacgacgaggaggagtcctcttgggcccagtgtgcttcatggggtag

SEQ ID NO: 2563 - DNA, 4953 bp, Artificial Sequence
  Description of Artificial Sequence: Synthetic coding sequence
atggaacgctgctctagatgccatagattactgttattattgcctctcgtcttgggtcttagtgctgcacccggctgggccggagctcctccagtcgacgtgctgcgcgccctgcggtttccctctctgcccgatggagttaggcgcgccaaaggtatctgccctgccgacgtggcgtaccgggtggcgcgaccagctcagcttagtgcccctactcgacagctcttcccgggtggctttccaaaagatttttctctactaaccgtggtgagaactaggcccggactccaggcaccactgctgaccctctatagcgctcaaggcgtgcggcagttggggctcgaattaggaagacccgtccggtttctttatgaagatcagacagggcgccctcagccgccgagtcagcccgtgtttagggggctgtctctggcggacgggaaatggcacagggtggccgtcgctgtgaaaggacagtccgtgacgttaattgtggattgcaaaaagcgagtcacccgccccttgcccagaagtgcccggccagtgcttgacactcacggagtgattatcttcggcgcccgcatattggatgaagaggtcttcgagggcgacgtgcaagagttggcaatcgttcctggggtgcaggccgcttatgagagttgcgagcaaaaggaattggagtgcgagggcggtcagcgggagaggccacagaaccagcaaccccatagagcgcagaggtctccacagcagcagccctcaaggctccacaggccacagaaccaagaaccccagtcacaagacccaacccctggagaggaagaagagattctggaatcaagcctgctgcctccgttagaggaggctgctcacggcccccgtggcctgaagggagagaagggggaaccggctgtactagaacctggaatgctcgtggaagggccaccaggcccagagggtccagctggtctgatcggaccccctggaatacagggaaatccgggcccagtcggtgatccgggcgagcggggtccccctggacgagcaggactgcctgggtctgacggagctccgggccctcctggtacatctctcatgttacccttcaggttcggatctggcgggggcgacaagggtccagtcgtcgcagcacaggaagcacaggcccaagccatccttcagcaggccagactggccctgcgaggccctcccgggccaatggggtacacaggacggcccggaccccttggccagccggggtcccctggactgaagggggaatccggggatctagggccacagggaccacggggtccccagggacttacagggccccccggcaaagcggggcggaggggtcgcgcaggggccgacggcgccagagggatgcctggcgatccgggcgtgaaaggcgataggggctttgacgggctgcccggcttacccggggaaaaaggacatcggggggacactggagctcaaggcctccccggcccccccggggaagatggcgagcggggcgatgacggggaaattggcccccggggcctgcctggggagtccggtcctcgaggtctcctggggccgaagggccctcccggcattccaggccctcctggcgtgcgcggcatggatggcccacagggacccaaagggtctctgggaccccagggggagccaggacctcctggacaacagggaacccccgggactcagggattacccggcccccagggagctattggtccacatggagaaaagggcccacagggtaagcccggactgcccggaatgcccgggtcggacggcccgcccggacatccggggaaggaggggccacctgggacaaagggcaatcagggcccaagcggaccccaggggcccctcgggtaccccggtccacgcggggtcaagggtgttgatggcatccggggcctcaaaggacacaaaggcgaaaaaggcgaggatggctttccgggatttaagggggacataggcgtgaaaggagaccgaggcgaagtcggggtgcccgggtctaggggagaagatggtcccgaaggaccaaaaggccgcacaggccccaccggtgaccctggcccaccagggctgatgggtgagaaggggaagctaggggtgccaggccttcccggatatcctggacgtcagggcccgaagggcagcttgggtttcccaggattcccaggagcatctggtgagaaaggagctcgcggtctctccgggaagtcaggacctaggggagagcgggggcccacgggcccacggggccagcgtggcccccgtggagccactggcaagtcgggcgcaaaggggaccagtgggggcgacgggccccacggccctcctggagagcgtggcctgcccggccctcaggggccaaacgggttccctggccctaaggggccacccggccctccaggaaaagacggtctacccggacatcccggtcagcggggcgaggtgggatttcaagggaagacgggacctcccggaccacctggcgtggttgggccccaaggggccgccggggagaccggacctatgggagagcgcggccacccgggacctcctgggccccctggggagcagggccttcccgggaccgccggcaaggaaggcaccaagggagacccgggtcctccaggcgcacctgggaaggacggccctgccgggctgagagggtttcccggagagagaggcctcccagggaccgccggcggtcctggccttaaaggaaatgagggcccatcaggaccaccaggtcctgcgggatcccccggtgaacggggcgccgcagggtccggcggccccattggcccccctgggcgaccaggccctcagggcccaccgggggctgcaggcgaaaaaggtgtgccgggtgagaagggtcctataggaccaaccggccgggatggtgtccagggccctgtaggcctgccaggccctgctgggccccccggcgtcgctggtgaggacggcgataaaggcgaggtgggcgatccaggacagaaggggacaaagggcaataaaggtgagcacggccccccaggaccccctggccccatcggcccagtgggccagcccggggccgccggcgctgacggcgaacccggtgctaggggtccacaagggcactttggagcaaaaggggacgaaggcactcgtggttttaacggtccccctggacccatcggactgcagggattaccaggaccatctggagaaaaaggtgagaccggagatgttggacctatgggtccacctggaccccctgggcctcgaggtcccgcagggcccaatggagccgacggtccccaggggccacctggcggagtgggaaacttgggccctcccggcgagaaaggagagcctggcgagtcaggatcccccggtattcagggcgagcccggtgtgaaggggccccgcggcgaacgaggagagaagggcgagtccggccaaccaggtgagccgggcccaccaggaccgaaaggtccaaccggggacgacggacctaaagggaatcctggacccgtcggcttcccaggcgatcctgggccacctggagagggagggcctcgcggacaggacggggctaagggtgatcgcggcgaggacggggaacccggccagcctgggtctcctggaccgacaggcgagaacggaccgcctgggccgctgggaaaaagaggcccagccggtagcccaggctccgaaggcagacagggagggaagggagcaaaaggggatcctggcgccatcggagctcctggcaagactggtcccgtgggccctgccgggcccgccggtaaacccggccccgatggcctgcggggcctgcctgggtctgtgggacagcaaggccgacctggggctacaggccaggccggtcctcccggcccagtcggcccacctggtctgccaggtttgcgaggcgatgcaggggccaagggggaaaagggccatcctggtctgattggactcatcggccctccaggagagcagggagagaagggcgacagaggactccctggtccccagggctcccccgggcaaaagggagaaatggggatccctggcgcctccggtccgataggcccgggcggcccccccggcctgccaggaccggcaggccctaagggcgccaagggcgcaaccgggcctggtgggcctaaaggtgaaaaaggcgtgcagggcccccctggtcaccccgggcccccaggagaggttatacagcctttaccgattcagatgcccaagaagactagacgatcagtggatggatcacggctgatgcaggaagatgaggccatcccaactggcggagctcccggcagccccggcggtctcgaggagatcttcggctccttggatagcctcagagaagagattgagcagatgagacggcctacaggaacacaggactccccagcaaggacctgccaggacctcaagctgtgccatccggagttacccgatggggaatactgggtggatcctaatcaagggtgcgcccgcgatgcctttcgggttttttgtaacttcaccgccggtggggaaacgtgcgtgactccaagagatgacgtgactcagttcagttacgtcgactctgagggttcccctgtcggcgtggttcagctgaccttcttgcggctgctatctgtttccgctcaccaggacgtgtcctatccttgctctggggccgcccgagacggcccgctcaggctgagaggagcgaatgaggatgaactgagtccagagactagcccttacgtgaaagaatttcgggatggttgtcaaactcagcagggcagaacagtgctcgaggtgcggacacccgtgctcgaacagcttcccgtgttagatgccagcttttcagacctgggcgcgccaccccggcgcggaggggtgcttctgggcccggtgtgcttcatgggctag

SEQ ID NO: 2564 - DNA, 873 bp, Artificial Sequence
  Description of Artificial Sequence: Synthetic coding sequence
atggagcgctgttcccggtgccaccgtttgctgctccttctacccctagtgctgggtttatctgccgcgccaggatgggccggtgcacctcccgttgatgtgctgagagcccttaggtttccatccttgcctgatggagtccggcgcgctaagggaatatgtccggctgatgtcgcctacagagttgcccggccagctcagctgtcagcccccacaaggcagctgtttcccggcggtttcccaaaagatttctccctgctgacagttgtgaggacccgcccagggctgcaagctcctttactgactctgtatagcgcccagggggttaggcagttggggctagagctgggccggccggtccggtttctctacgaagatcagaccggacgccctcagcccccttcccaaccggtgttccgcggtttgagcttggcagacggcaaatggcaccgtgtcgcggtggctgttaaaggtcaatcagtcactttgattgtagactgcaagaaaagggtgactcgtccactaccacggtccgccaggcctgtgctggatactcatggtgtcataatattcggcgcacgcattctggacgaggaggtgtttgagggggacgtccaggagctcgccatagttccgggggtacaggccgcctatgagagctgcgagcagaaggagcttgagtgtgaaggcggccagcgtgaaaggccgcagaatcaacagcctcatcgcgcacagagatcaccccagcagcagccttctaggctgcacaggccacagaatcaggagccacagtcgcaggtgcgcgagctcggggaacctccttcagcagcccacccacgtgagggccgacatccaggaatttcccccccttag

SEQ ID NO: 2565 - DNA, 1794 bp, Artificial Sequence
  Description of Artificial Sequence: Synthetic coding sequence
tgagccccccccgttgacgtccttagggctttgcgcttccctagcctgcccgacggtgttcggcgcgccaagggtatctgtccagcagacgtggcatatcgagtagcccgacctgcacagctgagtgctcccacccgccaactgttcccagggggctttcccaaggatttttctcttctgacggttgtgagaactcgcccgggacttcaagcaccactgcttacattatattctgcccagggcgtacggcagctgggtctggagcttggccgaccggtgaggtttctgtacgaggatcagacaggccgcccacagcccccatctcagcctgtgttccgcggactgagtctggcagacggtaaatggcaccgcgtagctgtggccgtcaaaggacagtccgtcactcttatcgtggactgtaagaaacgtgtgaccagacctcttccccgatccgcacgccctgttctggacacacatggcgtgatcattttcggagcacgaatcctcgacgaagaagtcttcgagggggacgtgcaggaattggcaattgtgcctggggtccaagctgcgtacgagtcctgtgagcaaaaagagttggagtgtgagggtggacagcgggaaagacctcagaatcagcagcctcaccgagcccagcgctctcctcaacagcagccctctagacttcaccggccacagaaccaggaaccacagtctcagccaacagaaagcttatactacgattataaacctccttactatgatgtgatgactaccggcaccacacctgactatcaggacccgactccaggtgaggaagaggagatcctggaatcctccctgctcccccctctggaggaagaacagaccgacttacaggtgcctccgacggccgacaggttccaagcagaggaatacggggagggcgggaccgaccctcctgaggggccatacgactatacatacggctatggggacgactacagggaggagaccgaattgggacctgccctctccgccgagactgcgcacagcggagccgccgcccatgggcccaggggcctgaaaggcgagaagggagagcccgcggtcctcgagccagggatgctagtcgaggggcctcccggcccagaggggcctgcgggattgataggtccgcccgggatccagggcaatcctggccccgttggcgaccccggggagcgggggcccccagggagagcaggcttgccaggaagcgacggcgcgcccgggccccccgggacgtctctgatgcttcctttccgctttggatccgggggcggggacaagggccctgttgtggccgcccaggaggcccaggctcaagctatcttgcagcaggctcgcctcgctctacgcggacctcccggacccatgggatacacagggagacctggtcctctgggacagccagggagccctggactgaaaggggagagcggtgatctggggcctcagggcccgcggggcccacagggactcactgggcccccaggaaaggcaggacggagaggtagggccggagccgatggagctcgaggtatgccgggggaccctggcgtcaagggcgatcgtgggttcgatggcttgccagggctgcctggagaaaaaggccatcgaggagatactggtgctcagggattgccaggccccccaggagaggacggggaacgaggcgacgatggagaaattggtcctaggggacttcccggagagagcggtcctagggggctcctgggccctaagggtccaccgggcattcctggccccccctag

SEQ ID NO: 2566 - DNA, 4953 bp, Artificial Sequence
  Description of Artificial Sequence: Synthetic coding sequence
atggaaagatgtagtagatgccatagactcttattgctacttccacttgtgctgggcttatctgctgcccctggctgggctggggctccgcccgtggacgtgctgcgggcccttcgcttcccctcactgccagatggagtgcgccgcgcgaagggtatctgtccagccgacgtcgcttaccgggtcgctcggccagctcagctttctgcacctacgagacagttattcccaggcggatttcccaaggacttctcactactcacagttgtgcggacaagaccgggactgcaagcgccactgttaacgctgtactctgcgcagggcgtccggcagttaggtctcgagctcggtcggcccgtgcgattcctctacgaggatcagactggtagaccacagccgcctagccagccagtttttcgaggcctgtccctggccgacggcaaatggcacagggtcgccgtggccgtcaaaggacagtccgtgacactaattgttgactgtaaaaagagggtgactcggccccttccccggagcgctcgccccgttctagacacacacggcgtgattatattcggcgcccgcatcttggacgaagaagtgtttgaaggcgacgtgcaggagctggccatagttccgggggttcaggcagcatatgaatcctgtgagcaaaaagagctcgagtgtgaaggaggacaacgggagcggccccaaaaccaacaaccccaccgtgcccagcgatccccccagcaacaaccaagtcggttacaccgcccccagaaccaagagcctcagtcccaagatcccacgcccggcgaagaggaggagatcctggaaagctcacttctcccccctcttgaggaggccgcacatggcccccgtggcttaaagggggagaagggcgaacccgccgtgttggagcccgggatgttagtcgaaggcccgcccggtcccgagggccccgccggattgatcgggcctccggggattcagggtaatccgggccctgtaggcgatccaggggaaagaggccccccagggcgggccggcctgccggggtccgatggcgcaccggggccccccggtacgtccctaatgcttccttttagattcgggtctggcggcggagacaagggccctgtagtggccgcccaagaagcacaagcccaggctatccttcagcaagcacgtctggctttgaggggacctcccgggccaatggggtacactggacggccaggacctctggggcaacctggaagccctgggctgaaaggggaaagtggcgatctgggcccccagggccccagagggccgcaaggcttaactggcccgccaggaaaggctggtcggagaggtagagccggcgcagacggggcgcgtggtatgcctggcgaccccggtgtcaagggcgataggggatttgacggcctcccggggcttccaggagagaagggtcaccgaggagatacaggggctcagggcctgccaggacctcctggggaagacggcgagcgaggcgatgacggtgaaatcgggccaagaggcctccctggagaatctggccctcggggcctcctgggacctaaaggacccccggggataccaggtcctcctggggtcagggggatggacggccctcaaggccctaaaggatctcttggaccccaaggtgaacccgggccacccggtcagcagggcactcctggaacccaaggactgccaggcccgcaaggggctatcggccctcacggggagaaaggcccccagggcaagcccggcttgccagggatgccgggtagtgacggcccccccggtcatcccgggaaggaaggccctcctggaacaaaaggaaatcagggcccatctggcccgcagggcccccttggctacccgggcccacgcggcgtgaaaggagtggatggaattcggggactgaaaggacataaaggagagaaaggcgaggacggcttccccggatttaagggggatattggggtgaaaggggatcgaggtgaagtcggtgtccccggctcccgtggggaagatggtcccgaaggccctaagggccgtaccggccccaccggggacccaggaccgccgggcctgatgggcgaaaagggcaagctcggcgtccctggtctccctggatacccgggtaggcagggacctaaaggttccttgggctttccggggtttccaggggcaagcggggaaaaaggagcaagaggtctcagcgggaagtccgggccacggggcgaacgcggcccgaccggtccgagagggcagaggggaccacggggagctactggcaaatccggcgccaagggaacgtccggaggagacgggccccatggacctcctggcgagaggggtctgcccggcccacagggaccaaacgggttcccaggaccaaaaggaccgcccggtccaccaggtaaagacgggctgcccggtcaccctggtcagaggggggaggtcggttttcagggcaagactgggcctcccggtccccctggcgtcgttggaccgcagggagccgctggcgagacaggccccatgggcgagagagggcaccccggaccaccaggcccacctggtgagcagggactcccaggtaccgccgggaaagagggcacgaagggtgacccaggaccccccggcgccccagggaaagacggccccgctggccttcgcggatttcccggtgaacgcgggttgcccgggacggccgggggacccggactgaaaggaaatgaagggccctcaggccctccagggccagctggaagtcctggcgagaggggagcggctggaagcggagggcctatagggccgcccgggaggccaggcccacagggaccccctggggctgcaggggagaagggagtgcccggagagaaaggcccaatcggcccaactggacgagacggtgtgcaaggacccgtgggcctgcctgggcccgccggcccacccggagtggccggggaagacggcgataagggggaggttggggaccccgggcaaaagggtaccaaagggaacaagggcgagcacggacctccagggcccccaggtcctatcggcccagtgggtcagccgggggctgcgggagccgatggggagccaggcgcccgcggaccgcaagggcacttcggagccaaaggagacgaggggaccagaggatttaacgggccaccaggaccaatcggtctacagggattgcctgggccctccggagaaaaaggagagaccggagacgttggccctatggggcctccaggcccccctgggccgaggggccccgctggtcccaacggagctgatggccctcagggccctcctggaggcgtgggaaatttggggcccccgggcgaaaaaggggaaccaggtgaatctggatctcccggaattcagggagaaccaggcgttaagggtccccgcggggagcgtggagaaaagggagagtcaggtcagccaggagaacccggccccccaggaccaaagggccctacgggtgatgatggccctaagggcaaccccgggccagtgggtttccccggagaccccggtccacctggagagggaggacctaggggccaagatggagctaaaggcgacaggggcgaggacggagagcccggtcagccagggtcccctggtcctacaggggagaatgggccccctggtccccttgggaaaagagggccagcaggtagccctggcagcgaaggacgtcaaggtggaaagggcgctaagggtgacccgggcgctatcggcgctcctggaaaaacggggcccgtgggccctgccgggcctgccggaaaacctggaccagacggcttacgaggactgcccgggtccgtggggcagcaggggcggccgggcgcaacaggccaggcaggtccacctgggcctgtgggtccacctgggctgcctggcctgcgaggcgacgctggcgcaaagggagagaaaggtcatccaggactgatcgggttgatcggtcccccaggagaacagggtgaaaagggcgatagaggcttgccaggcccgcagggatcccccggacaaaaaggagagatgggcattccaggggcctctggccccatcggacccgggggtcctccaggtctgcctggccccgccggtcctaaaggagctaagggcgctacgggccctggcggccccaaaggcgagaaaggcgtgcagggccctcctggacatcctgggcctccaggcgaggttatccagccgctgccaattcagatgcctaagaagacccgcagatccgttgacgggtcacgactgatgcaagaggatgaagccatacctacaggaggggctccaggcagtcccgggggtctcgaggagatttttggcagtttggattccctcagagaggaaattgagcagatgaggcggcctactggtacccaggacagccctgcccggacctgccaggacctcaagctgtgtcatcccgaattaccggatggtgagtattgggtggacccaaatcagggatgcgctcgcgacgcattccgtgtcttttgcaactttaccgccggaggggaaacttgcgtcaccccaagggacgatgtcacccaattctcttacgtggacagcgagggaagcccagtaggagtagtgcagctcacttttctccgcctgctgagcgtgagtgctcaccaggacgtgagctatccatgtagtggagcagcacgagatgggcccctgcgcttgcgtggagccaacgaagacgaacttagccctgagacgtccccatacgtaaaagaattccgcgacggttgccaaacccagcaaggccggaccgtattggaagtccgtacaccagtgttggagcaactacctgtgctcgacgcctctttttccgatttaggcgctccccccagacggggcggtgtactcctaggacccgtttgtttcatgggttag

SEQ ID NO: 2567 - DNA, 1875 bp, Artificial Sequence
  Description of Artificial Sequence: Synthetic coding sequence
atggagagatgctcccgatgtcaccggctcttgttgctgttgcctctcgtattaggacttagtgccgctccgggatgggcaggggctcccccagtggacgtgctcagagcccttcggttcccttctctaccagatggcgtccgaagggcaaaagggatctgcccagcagacgtggcctatagggtagccagacctgcccagctttccgcccctaccaggcagttattccctggcggtttccccaaagacttcagcctgctgaccgtagtccgaaccagaccgggcttgcaggccccgctgttgaccctttatagtgcccagggggtgagacaattagggttagagctggggagaccagtgcgctttctctacgaagatcagacagggcgtccgcagccaccttcacagccagtctttcgaggcctgtccttggcagacggcaagtggcatcgtgtggccgtggctgtgaagggtcaatccgtgactctgatcgtggactgtaaaaaacgagtgacaagaccgctgccgcgctcggctaggcccgtgctggacacacatggagtgattatcttcggcgcccgtatcctggatgaagaggtgttcgaaggagacgtgcaagagctggctatagtgccgggagtgcaggctgcgtatgaaagctgcgagcagaaagaattagagtgcgagggcggccaaagggaaagaccacaaaaccagcagccccacagagcacaacgaagccctcagcagcagccctcccgtctacacaggcctcagaaccaagaaccacaaagccagcccacagagtctctctactacgattacgagcctccgtactatgatgtcatgacaaccggaaccacacctgactatcaggaccctacacccggagaagaggaggagatcctcgaaagctcgcttctgcctcctctcgaggaggaacagaccgacctgcaggtgccacctactgcagaccgttttcaggctgaggaatacggggagggcggcactgatccaccagagggtccatatgattatacatacggatacggcgatgactatcgggaagagaccgaactggggccggcgttatccgccgaaaccgctcattctggtgccgccgcccacggacctcgtggccttaaaggggagaagggcgagccagccgtcctggaacctgggatgttagtcgaaggcccaccaggcccagagggtccggctggcctgatcggtcctcctgggatccaaggaaatcccggccccgtgggcgatcctggagagagggggccccctggacgcgccggcctgccaggttctgacggcgctccaggtccaccaggcacatctctcatgttaccctttcgcttcggttcaggcggcggagataagggccctgtggtggccgcccaggaggcgcaggctcaggccattctgcagcaggccagactcgctctacgagggccccccggccccatggggtatacggggaggcctggccctttggggcaaccgggctcccctgggctcaagggcgaatcaggtgatctgggcccacagggacctcggggtcctcagggtctaacggggcccccaggcaaggcaggccgaagaggtagggcaggggctgatggggcccgcgggatgcctggcgatccaggggtgaagggcgataggggtttcgatggcttgccaggtctgcccggtgaaaagggacatcgtggggacacaggagcacagggacttcccgggcctcctggagaagatggcgaacgaggggacgacggcgagatcggtccaagggggctgcccggcgaatcaggccccagaggtctgttgggcccaaaaggcccgcccgggattcccggacctccttag

SEQ ID NO: 2568 - DNA, 1875 bp, Artificial Sequence
  Description of Artificial Sequence: Synthetic coding sequence
atggagagatgctcccgatgccacaggttgcttctgctgcttcccttggttctaggactgtccgctgctccaggatgggccggcgcacctccagtggacgtcttacgcgccctccggttcccatccctgcccgacggtgtgcgtagagccaagggcatctgtcctgctgatgtggcctatagagtggcccgccccgcccagcttagtgctcccactcgtcaactgtttccaggcggatttccaaaggatttctctttgctgacagtggttaggacccgcccagggttacaggctcccctattgacactttactcagcacagggagtgcggcagctgggactagagctcgggcctccagtgaggtttctctatgaagaccagactggtaggcctcagcctcccagccaacccgtgttccggggtctttctctggccgatgggaagtggcatcgtgttgcggtggccgtcaaaggccaatccgtgaccctcattgtggactgtaaaaagcgggtgacacgaccactgccccgtagtgctcggccagtgctggatactcatggggtgataattttcggcgctagaattctggatgaagaagtcttcgaaggggacgtgcaagagttagccatcgttcccggcgttcaagcagcatacgagagctgcgagcaaaaagaacttgaatgcgagggcgggcaacgggagaggccccagaatcagcagccacatcgagcccagaggagtccccagcagcagccatctaggcttcaccgtcctcaaaatcaagaaccacagagccagccaactgagtcactgtactatgattacaagcctccatactatgacgtgatgacaacaggcactacccctgactaccaggaccccactccgggggaagaggaggaaatcctggagtcgagcctcttacctcccctcgaggaggaacagaccgatttacaagtgcctcctaccgccgacaggttccaagcagaagagtacggggagggcggcaccgatccacccgaaggaccctatgactacacctatggctacggcgatgattaccgtgaggagaccgagctcggccccgctcttagcgccgagactgcccacagcggagcggccgcccacggaccaagaggcctgaagggcgaaaagggcgagcccgcagtgctggagccaggcatgctcgttgaaggaccacccgggccagagggaccagccggtttgatcggaccaccaggcatacaaggaaatcccggacccgttggagatcctggagagcggggccctcctggccgggcaggattaccaggctccgacggtgccccggggccccccggaacatcgctgatgctcccttttcggttcggatccggaggaggtgacaaagggcctgttgtcgccgcacaggaggcgcaggcccaagccatattgcagcaggctcgactggctttaaggggacccccaggaccgatgggatacaccggcagacccggccctctgggccagcccgggtcacccggacttaagggtgaatctggagatctggggcctcaaggacctcggggcccccaggggctgaccggtccacccggcaaagcagggaggcgtggccgggcgggcgccgacggagcccgcggcatgccgggcgatcccggcgttaagggagacagaggattcgacggcctccccggcctgcctggggaaaagggccaccgcggggacacaggcgcacagggtctgcctggccccccaggagaggacggcgagagaggggacgacggcgaaatcggacctcgaggactgcctggtgaatccggccctagagggctactgggacccaaaggccctcctggtatccccggaccaccatag

SEQ ID NO: 2569 - DNA, 1875 bp, Artificial Sequence
  Description of Artificial Sequence: Synthetic coding sequence
atggaaagatgttctcgctgccataggctcctgttgctattacccctggtcctgggtcttagcgccgccccaggctgggcaggcgcacctccagtggatgtactcagagcgctgagatttccttccctgccagatggagttaggcgtgctaagggcatctgtcctgcagatgtggcctaccgtgttgcgcggccagctcaactcagcgcgcccacgcgtcagttatttcctggggggttcccaaaagacttctccttactgacggtggtaaggaccagaccaggcttgcaggcccctctccttaccctgtactcggctcagggcgtgcgacagctcggactggaacttggcaggcccgtgcgcttcctgtacgaagaccaaaccggtcgaccacagccgcctagtcagcccgtgttcaggggcctgagcctagcggacggcaagtggcatagagttgcggttgctgtgaaaggacagagcgtgactctgatcgtggactgtaaaaagcgagtgacccgccccttgcctcgcagcgcccggcctgtattggacacccatggtgttatcatttttggggcacgcattctcgacgaagaggtttttgagggcgatgtgcaggaattagccatagtgccaggcgtgcaagcagcttacgagtcttgtgaacagaaggagttggaatgcgagggaggccagcgcgagaggccacagaaccagcaaccgcaccgcgctcaacgttctccccagcaacagccgtcaaggctgcatcgaccccagaaccaagagccgcagtcccaacccaccgagtctctttattatgactacaaacccccatattatgatgtgatgacaaccggaaccactcccgactatcaggatcccacccctggagaagaagaagagatcctggaaagctctctgctgccccctctggaggaggaacagacagacttgcaggtgccaccaaccgctgacaggttccaagccgaggaatatggcgagggcgggactgacccaccagaggggccctatgactacacatatggatatggggatgattatcgtgaagaaaccgaactgggtccagccctcagtgccgaaaccgctcactcaggggcggccgcccacggcccaagaggcctgaagggagagaaaggggagccagcggtcttagagccaggcatgcttgtggagggtccccccggaccggagggccctgctggcctgatcggaccacccggcatccagggcaacccgggtcccgtcggtgatccgggagagcggggcccaccaggccgtgcaggcctacccggcagtgacggagcacccgggcctcctggtacatccttaatgctgccattccggtttggatccgggggtggtgataaaggccccgtggtcgctgcgcaggaggcacaggcacaagcgattcttcagcaggccagactggcattgagaggcccccccggtccgatgggctatacgggccgtcccggccccctgggccagcctggttctccggggcttaaaggcgagagcggcgatttgggaccgcaaggacctcgtggccctcagggtctaaccgggccgccaggaaaggccggaagaaggggtagggcaggggcagatggggctcggggtatgcccggagaccctggggtgaaaggagatagggggtttgatggcctgccgggtttgcctggagagaaaggccaccgtggcgacacgggagctcaaggactgcccggcccccccggggaggacggcgagcggggagacgacggcgagatcggcccgagaggactgccaggtgagagtggaccgagggggcttctggggcctaagggccctcccggcatccccggaccgccgtag

SEQ ID NO: 2570 - DNA, 873 bp, Artificial Sequence
  Description of Artificial Sequence: Synthetic coding sequence
atggaacggtgctccaggtgtcatagacttctcctgctcttacctttggtcctgggcctgtctgcagctccgggctgggccggagccccacccgtggacgtgttgcgtgccctccggtttcctagcctacctgatggcgttcggagggctaaaggtatttgtcccgccgatgtcgcctatcgagtagcccggcctgcccagctgtcggcgccaaccagacaactgtttcccggtgggtttcccaaagatttctcacttttgaccgtggtcaggacacggcctggcctccaagccccactgttgactctgtattcagcccagggcgttcgtcaactcggcttggaacttggtcgccccgtgcgattcctgtatgaagatcagaccggtcgcccacagccgccaagtcaacctgtgttccgcggcctttccctggctgatgggaaatggcaccgagtcgcggttgccgtgaaaggacagagcgtgactcttatagttgactgtaagaaaagggtgacccggcctctgccaaggtctgcgcgccctgtgctagatacacatggcgttatcatcttcggcgcaaggattctggacgaggaggtgttcgagggcgacgtacaggaactcgctattgtcccaggtgtgcaagccgcctatgagtcttgcgagcagaaagagctagaatgcgaaggcggacaaagggagaggccacaaaaccagcagccccaccgggcgcaacggtcacctcagcagcagccatctagattgcaccgcccccagaatcaggaaccccagagccaggtgcgggagctgggggaaccaccaagcgctgcgcacccgagagaaggccgccaccctgggatatcccccccttag

SEQ ID NO: 2571 - DNA, 1875 bp, Artificial Sequence
  Description of Artificial Sequence: Synthetic coding sequence
atggagcggtgctctcggtgccaccgtcttctattgctgctacctctggttctggggttgtctgcagcacctggttgggcaggagctccaccagtcgatgtgcttagagctctgcgatttccatctctacctgacggcgtgcgaagagcaaagggcatatgccccgctgatgttgcctatagagtggcccgcccagctcagctgagcgctccgactcggcaactcttccccggcggattccctaaggatttttccttgctgacagtggttagaacacgccctggactgcaggcccctttgctaactctctattcagcacagggcgtgcggcagctgggactcgagctcggccggcccgtgagattcctgtatgaggatcagactggaagacctcaaccccctagccaacccgtcttcaggggactttccctcgctgatggtaagtggcacagagtcgccgtggcagttaagggccaatctgtcacattgattgtggactgcaaaaagagagtgacccggccacttcctaggagtgcccgccccgttctcgatactcacggcgtcatcatctttggcgcccggattttggacgaagaggttttcgaaggcgacgtacaggaactggctattgtgccaggcgttcaggccgcatacgagtcatgtgagcaaaaagagttggaatgtgaaggcgggcagagggagcgtcctcaaaatcagcagccacatcgcgcccaacggtccccccaacagcaaccctctcgcctccatcgcccccagaatcaggagcctcagtcacagcccaccgagtcactgtactatgattacgagcccccatattacgatgtgatgactactggcacgacccccgactatcaagatcccacaccaggtgaggaggaggaaattttagaaagctcgctactgccccccctcgaggaagagcagaccgatctgcaggtgccacccactgcggaccgctttcaggctgaagaatatggcgaggggggtacagaccctccggagggaccgtatgattatacgtatggatatggcgacgattaccgcgaggagaccgaactcggcccagcactgagcgccgaaaccgctcacagtggcgctgcagcccacggaccccgcggactcaagggggaaaagggcgagcccgcagtgttggaaccaggcatgctcgtggagggacccccaggacctgaagggccagctggactgattgggcctcctggaatccagggcaaccctggtcctgtgggcgatcctggcgaacgggggccgcccggaagggctggactcccaggatctgatggagcaccaggcccgcccggtacaagcctcatgttaccttttcgctttggcagcgggggaggagacaagggccctgtggtggcagcacaggaagctcaagctcaggccattctccagcaggcccgtcttgccctcaggggtccacccggacctatggggtatacagggcgtccaggaccgctcggccagcccggaagtcctggactgaaaggggaaagtggagacctggggccacagggcccccgtggacctcaggggctcacagggcctcctggaaaggcaggccgacgtgggcgggcaggcgctgatggagctaggggcatgccaggtgaccctggcgtaaagggcgaccgcggttttgatggcctcccaggtctgccaggcgagaaaggacaccgaggggataccggcgcacagggcctgccaggcccccccggagaagatggggaacgtggtgacgacggagaaattggcccgagagggctgcctggcgagtcaggcccgagagggctgctgggcccaaaaggaccacctggtattccaggccctccctag

SEQ ID NO: 2572 - DNA, 5070 bp, Artificial Sequence
  Description of Artificial Sequence: Synthetic coding sequence
atggagcgttgctccaggtgccacagacttctgctacttctgcccctggttctgggattgtcagctgctcccggatgggcaggggcaccgccagtggatgttctgagggcactgagatttccgtcactccctgacggtgtgcggagggcaaagggaatttgtccagctgacgtagcctatcgcgtggctcgtccagcccagctcagtgctccgacgcggcagctttttccgggagggtttcccaaagacttttctttgttgacagtagtccgtacacggcccgggctacaggcgcccttgctgaccctgtacagtgcacagggggtgcggcagctcgggttggagctggggccgccagtcagattcctctacgaggaccagaccggccgacctcagccccccagccaacccgtcttccgaggcttaagtctcgccgacggcaagtggcaccgggtggcggtggctgtaaaaggccagagcgtgaccctgatagtggattgcaagaagcgtgtcaccagacctctgcccaggtctgcccgcccagtcctggatacgcacggcgtgatcatttttggcgcgcgcatcctggatgaggaagtgtttgagggcgacgtgcaggaacttgccattgttcccggggtgcaggcagcgtatgagagttgtgagcagaaggagcttgagtgtgagggcggccagagggagaggcctcagaatcaacaaccacatagagcccagcgtagcccccagcaacagccctctaggttacatcgaccacagaaccaagagcctcagtcccaggagcagacagatctgcaagttccccccactgcagaccgcttccaggccgaggaatacggagagggcggtacggacccgcctgagggtccctatgattacacctatgggtatggagatgattatagggaagagacagagttgggccctgccctgtccgcggagaccgcccattccggagccgccgctcatgggccccggggcttgaagggtgaaaaaggcgagcccgctgtgctggaaccaggaatgctcgtggaaggccctcccggccctgagggcccagctgggctgataggcccccctggtatccagggtaacccaggaccagtaggcgaccccggagagcgagggcctcccggccgggccggcctgccaggatcagatggcgcccctggccctcccggtactagtcttatgctacctttccggtttggaagtggaggtggcgacaagggccctgtcgtcgcagctcaggaagcccaagcccaggcaatcctccaacaggcaaggctagcattacgcgggcctcctggacctatgggttacacagggcgccctggtccattaggccaaccaggaagcccaggcttaaaaggagaaagcggagacctcggcccccaaggtccacggggacctcaaggccttactggccctccagggaaggccggtagacgcggacgagcaggagcggacggagcacggggaatgccaggagacccaggtgtaaagggtgatcgagggttcgacggtttacctggactgcccggagaaaaggggcatcgtggtgacaccggcgcacaggggctcccggggccgccaggggaagatggcgagaggggcgatgatggtgaaatcggccccagaggcttgcctggcgagagcggaccccgaggcctcttggggccaaaggggcccccaggaattcccgggcctcccggagtgcgaggtatggatggcccccaggggcctaagggatctctgggtccgcagggtgaacctgggcctcctggacagcagggcacgcctgggacccaggggctaccagggccccaaggggccatcggcccccacggagagaagggcccacaaggcaaacccggattgccaggaatgccaggttctgacgggccacccggacatcccgggaaagaaggcccgccgggcaccaaggggaaccagggtccatccggcccacaagggccgctagggtaccctggccctcgcggggttaagggggtggatgggattaggggcctgaaggggcataagggtgagaaaggagaggatggctttccagggttcaagggggatattggggtaaagggagacaggggagaagtcggtgttcccgggtcaaggggggaggatggccctgaaggtccaaagggcaggactggcccgactggtgacccaggcccacccgggttaatgggggagaaagggaaattgggtgtgccggggttgcccggttaccccggtcgacagggccccaaaggctccctgggtttccctgggtttcccggggcatcgggcgagaagggagcgcgaggattaagcggaaaaagcggcccccgtggtgaaagagggcccaccggcccacgcggacagagaggtccccggggtgctaccggaaaaagcggtgcgaaggggactagcggcggggatggcccgcacggcccgcccggcgagcgggggctgccgggaccccagggcccaaacggattccctggcccaaaaggccctcccggacctcccgggaaggatggactccctggccaccccgggcagcggggggaggtcggttttcaaggaaagacaggccctcctggcccgccgggcgtggtggggcctcagggcgctgcgggtgagactggaccaatgggagagagaggacatccaggccctcctggccccccaggagagcagggcctgcccggtaccgcgggtaaagaggggactaaaggagaccccgggccccccggtgctccagggaaagacggccctgctggtctgcgcggctttccgggggagaggggactccccggcactgccggcggtcctggcctgaagggcaatgaaggcccatctggtccacccggaccagccggtagcccaggcgaacgtggagccgccggatcaggaggtcccataggccctcctggtcgccccgggccccaggggccccccggtgccgctggtgagaagggagtgccaggcgaaaagggacccattggtccaactggcagagatggagtgcagggccccgtcggattgcccggccccgcaggccctccaggcgttgctggggaggatggagacaagggcgaggtgggtgaccccggtcagaaaggcaccaagggtaacaagggcgaacacggtccacccggcccaccgggtcccattggcccagtagggcaacccggagccgcgggagcggatggagaacccggagcccgggggcctcagggtcatttcggagccaagggtgacgagggcacaagagggtttaatggcccccctggacccatcggccttcaggggctccccgggccatcgggggagaaaggggagacaggcgatgttgggcccatgggccctccaggtcccccaggacctaggggcccagctggacctaacggtgcagacgggcctcagggcccaccaggaggtgtgggtaacctcggtcccccaggcgagaagggtgaacccggcgaatccggatcaccgggcattcagggagagcctggcgtcaaaggtccccggggagagcgcggagagaagggggagtccggccaacccggagagccaggtccaccaggaccaaaaggccctacaggggacgacgggcccaagggcaaccccggtcctgtaggttttcccggtgatcctggaccacctggcgagggcggcccaaggggtcaggatggagccaaaggtgaccgcggagaagacggagagcctgggcaacctgggtcacctggccccaccggcgagaacgggccacctggccctctcggaaagcgaggccccgctggttctccaggcagtgagggacgccagggcgggaagggagccaaaggcgatcctggagccatcggcgcacctggcaagaccggacctgttggacccgccgggcctgcaggaaaacctgggccggacggactccgcggactcccaggcagcgtgggccagcaaggacggccgggcgctacaggccaggctgggccccccggcccggtcggcccacctggcttgcccggtctgagaggagacgcgggtgccaaaggcgaaaagggtcacccaggcctcatcggcctgataggccctcccggcgagcaaggcgaaaaaggagatcgaggactgccagggcctcagggatccccaggacagaagggggaaatggggattcccggagcgtccggtccaattggacccggcgggcctcctgggcttcccggtcccgctgggcccaagggcgctaagggggcaactgggcctggaggccccaagggcgagaaaggcgtgcagggaccacctggacaccccggacctccaggggaggtaattcagccactgcctattcagatgcctaaaaagactaggcgttctgtggacggaagcaggctaatgcaggaagatgaagctattccgacgggaggggcccccgggagccccggcggcctggaggaaatatttggctctttggatagcttgagggaagagatagagcagatgcggaggcctaccggcacacaggattcacccgcccggacgtgccaggatctcaaactttgccaccccgagctacctgatggggaatactgggtcgatccgaaccaggggtgtgctcgggacgcgttccgggtattctgcaatttcactgctggcggagagacttgcgtgacgccacgagacgacgtcacccagtttagctatgtcgattcagagggcagtcccgtgggagtggttcagcttacgttcctgcgacttctgagcgtctccgctcaccaggacgtgtcctacccctgcagcggagctgcacgggacgggccgctcagactgagaggagccaacgaggacgagctgagcccagagacatccccctacgttaaggagtttagagatgggtgtcagacccagcaaggacggaccgtgctcgaggtcaggacccctgtgttggagcagctccccgtgctcgatgcctccttttcggatctaggcgcaccaccccggcgaggcggagtgcttctgggacccgtttgttttatgggctag

SEQ ID NO: 2573 - DNA, 5133 bp, Artificial Sequence
  Description of Artificial Sequence: Synthetic coding sequence
atggagcgctgtagccgttgtcatcggctactcctgctgcttcctctagtgctgggactgtcagccgctccagggtgggctggggctccgccagtcgacgtgctccgcgctctccggttcccttctctgccagacggggtaaggcgtgcgaagggcatttgccctgctgacgtcgcataccgcgttgcccgtccggcacagctctccgccccgacaaggcaactgttccccggaggcttccccaaagacttttcactgttaaccgtagtgcgcactcggcccgggctacaggctccactattgactctgtacagtgcccagggagtgcggcagctgggcctggagctgggtccaccagtgcgatttctctatgaagatcaaacaggacgaccacagcccccctctcagcccgttttcagagggctttctcttgcagacggtaaatggcacagggtggccgtcgcagtgaaggggcagagtgtgacactgattgtggattgcaagaaaagggtcacccggcctctgccaagatcagcacgacccgtccttgacacgcacggcgtgatcatttttggcgcacggatattagacgaggaagttttcgagggcgatgtacaggagctggccatcgtccctggcgttcaggcggcttatgaatcgtgtgagcagaaggaactggagtgtgaggggggacagcgcgaacgcccacaaaaccagcagccacatcgggcccagagatcaccacagcagcagcccagtcggctgcaccgtccgcaaaaccaggagccccagagccaggatcctacacctggtgaggaagaagagatactggaatcttctctgcttccacccctcgaagaggagcagactgatctgcaggttcctcctactgcggacagattccaggctgaagagtatggcgaaggtggaacagacccccccgaggggccatacgattacacttatggctatggagacgattacagggaggagactgaacttggaccagccctttccgccgagaccgctcactctggagcagccgcccatgggcctagggggttgaagggagagaagggtgagccggctgtgctcgaaccagggatgcttgtggaggggccacctgggccagaggggccagctgggctgatcgggccacctgggattcaaggcaatccaggtccagtcggagaccctggtgagaggggccctccaggcagagccgggctgcccgggagtgatggagcaccggggccccctggcacgtctcttatgctgccttttaggtttgggagcggcggaggtgataagggaccggtggtggcagcccaggaagcacaagcacaggctattctgcaacaggcccggctggccctgcgcggacccccaggacctatgggctatacagggaggcccggacccttgggacaaccgggtagtccaggcctcaaaggagagtctggtgacctaggcccgcagggccctcgcggcccacaagggctcaccggacctcctggcaaggctgggagacgcggacgggccggcgctgatggtgccagagggatgccaggcgaccccggtgtcaagggtgacagaggcttcgatggtctccccggactgcccggtgaaaagggccacagaggggacactggggcccaggggctgcctggcccccctggagaggatggagagagaggagatgatggcgagatcgggccccgcgggcttccgggagagagcggtccaagaggcttgctgggccccaaagggccccccggtattcccggtccgccaggcgtgcgcggtatggacggccctcagggcccgaagggctcgctgggcccgcagggggaaccaggcccacccggacagcaggggacacccggaacccagggacttcctggtccccagggggctattggccctcacggggagaagggaccacagggaaagcctggtctgcctggtatgcccgggtcagatgggccacccgggcaccccggaaaggagggcccgccaggtactaagggcaatcaggggccttccggtccacagggtcctctaggataccccggacctaggggggtgaaaggtgtagatggcatccgcgggctcaagggacataaaggcgaaaaaggggaagatggatttccaggctttaaaggtgatattggcgttaagggtgatcgaggcgaagtgggagtaccaggatcacggggcgaagacggacccgaaggtcccaagggaagaacgggtcccacaggtgacccaggacctcccggcctgatgggcgagaagggaaagttgggagtccctggactaccaggatatccgggaagacagggccctaaaggcagcctggggtttcctggattcccaggcgcgagtggcgagaagggcgcaagaggattaagcggaaagtctggcccccgcggcgaacgaggacctaccggaccccgtggtcagcgaggccccagaggcgctaccggcaagtctggcgcaaaaggaacatccgggggcgatgggccccacggccctcccggggaacgcgggctgccaggcccccaggggcccaacggcttccctggacccaagggtccacccggaccaccaggcaaggatggccttcctgggcaccccgggcagagaggagaggttggtttccaagggaaaacgggcccgccgggtcccccaggggtggtcggtcctcagggtgcagccggcgagactggcccgatgggagaaagggggcatcctggtccgcctggcccaccgggggaacagggactgcccggaacagctggaaaagagggcacgaaaggcgatcccgggccccccggggccccagggaaggacggtcctgcagggctcaggggctttccaggggagagagggctacccgggacagcagggggccccggcctgaaggggaatgaggggccctccgggccacctggcccagccgggtcacctggcgagcgcggagccgcaggtagtggagggcctataggcccccctgggagaccaggcccccaggggccccctggcgccgccggggagaagggcgtcccaggtgaaaagggcccgattggaccaaccggacgtgatggtgtacaagggccggttggcctgcccggccctgctggcccccccggcgtagccggcgaggatggcgataagggcgaggtgggggaccctggtcagaaggggacgaagggaaacaaaggagagcatggacctcctggccctccaggaccgattggacccgtcgggcagccaggcgcagctggagcggatggcgaaccgggtgcccgcggcccccaggggcattttggcgcaaaaggggacgaggggacacgtggcttcaatggcccaccagggccgatcggactgcagggactgcccgggccaagcggcgaaaaaggcgagactggagacgttgggcctatgggtccccctgggccacctgggccccgagggccagcaggcccaaatggtgccgacggcccccagggccccccaggcggggtggggaacctgggaccacctggcgaaaaaggggagcccggtgagtctggctcccccggaatccagggagagcctggcgtcaagggccccagaggagaaagaggagagaaaggcgaatctggacagcctggtgagccgggtcccccaggcccgaaaggcccaacaggagatgacggcccaaaaggcaatcccggacccgttggctttcccggcgacccagggcctcctggagagggaggccccaggggacaggacggggccaaaggggataggggggaagacggagaacctggacagcccggcagtcccgggccgaccggcgagaatgggccccctgggccactcggcaagcgcggccctgcagggagtccaggaagcgaaggccgccaaggcgggaagggggcgaagggagatcccggagcgatcggggcccccggcaagacggggccggtagggcccgccggtcccgctggaaaacccggccccgatggactgcggggcctgcctggttcggtcggccagcaagggagacccggggctacagggcaggcaggcccccccgggcccgttggtcccccaggacttcccgggctccgtggtgacgccggggctaaaggggagaagggacaccccgggctcatcggattgattggtcctccaggcgaacagggagaaaaaggagatcgcggtttgccaggaccccagggaagcccgggacagaaaggtgagatggggattcccggggcctcaggaccaatcggaccgggtggaccacctggactgcctggccccgcaggccctaagggggccaagggagctacaggccccggcggccctaaaggcgagaaaggggtccagggaccacccggccaccccggcccccctggagaagttatccagccccttcctatccagatgcccaagaagactcggaggtcggtggatgggtcaaggttgatgcaggaggacgaggccatcccaactggtggcgcgcccggcagtcctggaggccttgaggagatttttggttctcttgactccctcagagaagaaattgaacagatgcgacgcccgacaggaacacaggacagtccagcaaggacttgccaggacctgaagctttgtcacccagagctgccagatggggagtattgggtcgatccgaatcaagggtgcgcacgcgatgcttttagagtcttttgcaattttacggctggaggtgagacctgcgtgacccccagagacgacgtgacccaattttcttacgtggattcagagggctcccctgttggggtcgtgcagttgacttttctgaggctcctcagtgtgagtgcccatcaagatgtcagttatccgtgtagcggagccgctcgagacggcccactccggctgcggggtgctaacgaagatgagctctcacccgaaaccagtccctacgttaaagagtttagagacgggtgtcagactcagcagggaaggaccgtcctcgaggtccgcactcccgttttggagcagctgcctgtactggatgcaagtttttctgatttgggagctccccccagacgcggcggagttctgctggggcccgtgtgttttatgggctag

SEQ ID NO: 2574 - DNA, 4968 bp, Artificial Sequence
  Description of Artificial Sequence: Synthetic coding sequence
atggagcgttgttctcgctgccatcgtttgctcctgctcctgcccttggtgcttgggctgagtgccgctcccgggtgggccggcgccccccccgtggacgtgctccgtgcactcagatttcccagtctgcctgatggagtgaggcgagccaagggaatctgtcccgctgacgtcgcctatcgggtggcacggcccgcccaactcagcgcacccacacgtcagcttttccctggcggattcccgaaggatttctccctcctcaccgtagtgcggactcgaccgggactgcaggcccctcttctaactctttattcagcccagggtgttagacagctggggcttgagctggggaggccagtcagatttttgtacgaggatcagaccgggcgcccgcagccgccatcccagcccgtgttccggggcttatccctcgcagacggcaagtggcatagggtcgcggtggccgttaagggacagtcggtgacgcttattgtggattgtaagaaacgtgttacaaggcctctgcctaggagtgccaggccagtcctggacactcatggggtcatcatcttcggagcgagaattctcgacgaagaggtgttcgaaggagacgtgcaggagctcgcaattgttccaggagtgcaggcagcctacgagtcatgcgaacagaaagagctcgaatgtgaaggcgggcagcgggaacgcccgcaaaaccagcagccccacagagcacagcgaagcccacagcagcagccctcacgcctgcaccggccccaaaatcaggagccccagagccaacccaccgaatccctttactacgattacgaaccaccatattatgacgtcatgacaaccggcacaaccccagactaccaggcagcccacgggcccagggggttgaagggggaaaaaggggagccagcagtcctcgaacctggcatgctggttgaaggcccacccggaccggaaggtcccgcagggctgatcggaccacctggtatccagggaaatccaggccctgtgggtgacccgggcgagcggggccctccggggagggcaggtttgccaggaagtgacggagcccccgggccacctggaacgtccctaatgctgcccttcaggtttggatccggaggcggcgataaaggccccgtggttgctgcgcaggaggcccaggcacaggcaatcctgcagcaagcaagactggcactccgcggcccacccggccccatgggctataccgggcgacctggccccctggggcaacctgggagtcccggtctgaagggcgaatctggagatctgggaccgcagggccctcgaggcccccagggactgacggggcctccaggaaaggccgggaggagagggcgggctggagccgacggagcgaggggcatgcctggtgatcctggcgtgaaaggagaccggggattcgatggactcccggggctgcctggagaaaaaggccaccggggggatactggagctcagggtctgcctggtccgcctggggaggacggggagaggggagacgacggagagatcggcccccgaggactaccgggcgagagcgggccccgcgggttattgggaccgaaagggccccctggaattccagggcctcccggtgtgagaggcatggatggtccacaaggccccaaagggagcttaggccctcagggcgaacccggccctcccggacagcagggcacgccaggaacccagggcttgcccgggccgcagggcgcaatcggtcctcacggcgagaaaggtcctcagggaaaacctggtctgcctggaatgcctggctccgatggccccccaggtcatccaggaaaagagggccctcccggaacaaaagggaatcaggggcctagcggtccacaaggaccgctgggctatcccggcccgaggggtgtcaagggggttgatgggattcgggggctgaagggccacaagggggaaaaaggagaggacgggtttcccggattcaagggagatatcggcgtgaagggagacaggggtgaagtgggggtgccggggtcgcggggagaggacgggcctgagggccccaaagggagaacaggtcctactggcgaccccgggccaccaggcctgatgggtgagaaggggaagctaggggttcccggcctccctggttatcctgggcggcaagggccaaagggaagcttaggcttccctggattcccgggcgccagcggcgagaagggagcccggggtctgtctggcaagtccggtccccgtggagaacgcggccccacggggccaagggggcaacgaggaccacgtggagctactggcaagagtggtgctaaaggcacctccggcggggatggccctcacggtcccccaggggagcgaggcctccctggccctcaagggcctaatgggttcccaggccccaaggggcccctcggtcctcctgggaaagatggcctgcccggacatccaggacagagaggcgaggtgggctttcaggggaagactggtccacctgggccaccaggcgtcgtgggaccacagggggccgccggggagaccggtccaatgggagaacgggggcaccctgggcccccagggccaccaggggagcagggcctgccagggaccgccgggaaggaaggcaccaaaggggatccaggacctcccggcgcacctggaaaggatggccccgcaggactcagaggattcccaggagaacgggggctgccaggaaccgcgggggggccaggcttgaaaggcaacgaagggccgagcggtcccccaggcccggcaggttcccctggagagaggggcgccgcgggcagtggaggtccgatcgggccacccggcagaccaggcccccaaggcccacctggcgctgcgggagaaaagggggtccccggggagaaaggcccaatagggcctacaggcagagatggcgtccagggacccgtgggactgccaggcccggctggccccccaggcgtggccggcgaggatggggataagggagaggttggggaccccggacaaaaaggcaccaaggggaataagggcgaacacggacctcccggcccccctgggccgatcggaccagttggtcagcccggggcagcgggtgctgacggtgagcctggggctcgaggaccacagggacactttggtgccaagggggacgaggggactcgtggcttcaacggtcctcctggaccaatcggattgcagggcctcccaggaccctctggagagaaaggagaaaccggggacgtgggacctatggggccccctggcccacccggcccccgcggccctgcagggcctaatggtgccgacggtcctcaaggacctcccggtggcgtgggtaaccttggaccacccggcgagaagggagagcctggcgagtctggttctcctggcatccagggtgagcctggcgtgaagggacctcgaggggagagaggagagaagggggaatctggacagcccggagagcccggaccaccaggccccaaaggtcctacgggcgatgacggcccaaaagggaacccgggacctgtgggattccctggagatcctggccctccgggcgaagggggcccaaggggacaggatggcgccaaaggtgatcgcggagaagatggggagcctggacagcccgggtcaccaggcccaactggcgagaatggcccaccgggccctctgggcaagcgagggcctgctggctctcctggttctgaaggacgccaaggtgggaagggggccaaaggtgacccaggggctataggcgctcctggtaagacgggtcccgtcggacccgccggccctgccgggaagcctgggcccgatgggcttcgtggcctgccaggttcagttggccagcagggccgacctggtgctaccggacaggctggacccccgggtcccgtgggacctccgggattgccagggctcagaggcgatgccggtgccaaaggagagaagggacacccggggctgatcgggctgatcgggccaccaggtgagcagggagagaaaggagaccggggacttcccggaccacaggggagtcccggtcaaaaaggcgaaatggggattccaggcgcgagtgggccaatcggtcctggcgggccgccggggttgccagggcctgcaggtccgaaaggtgccaagggggcgacaggccccggcggaccaaaaggggagaagggtgtccagggccctcccgggcatcctggacctcctggagaggtgattcagcccctgcccatccagatgcccaaaaagacacggaggtccgtcgacggttcccggctgatgcaggaagacgaagccatccccactggcggcgctccggggtcacctggagggctggaagaaatttttggatccttggactcgcttcgggaagagattgaacagatgaggagaccgacaggcacacaagattcccccgctcgaacatgccaagatctgaagctgtgtcaccctgagcttccagacggtgagtattgggtagatcctaaccaaggatgcgccagagacgcatttagagtgttttgcaatttcacagcaggcggcgagacctgtgtgacgcctagggacgacgtcactcagttttcatatgtggactctgagggctcccccgtcggggtcgtgcagctgacctttctgcgtctgctgagtgtttcggcccatcaggacgtcagttacccctgcagcggtgctgcacgagatggccccctgcgccttcgtggcgccaatgaggatgagctcagcccagaaacatcgccctacgtgaaggagttcagggacggctgtcaaacacagcaggggaggacggtcctagaagtcagaaccccggtcctggaacaactccctgtgctggacgccagtttttccgatcttggggcaccgccacgtagggggggtgtgctgttgggaccagtatgcttcatgggatag

SEQ ID NO: 2575 - DNA, 4968 bp, Artificial Sequence
  Description of Artificial Sequence: Synthetic coding sequence
atggagaggtgtagccgctgccatcggctattgttattactgccactagtgctcggattatctgcagctccaggttgggccggcgctcctcctgtagacgtgctacgggccctgaggtttccaagtctgccggacggggttcgtcgagccaaggggatttgtccagccgacgtggcctatcgcgtcgcacggccggctcagctgtccgcccccacaaggcagctatttcctggagggtttcctaaagacttctctctgttgaccgtggttagaactcggcctggactccaagccccactcctgacactttattccgcacagggggtgagacaactcggactggaactgggtaggcccgtgcggtttctctatgaggatcaaactggaagacctcaacccccttcccagcccgtgtttagaggactcagcctcgccgacgggaagtggcaccgtgtggctgtggctgtgaaaggacagtcagtcaccctcattgttgattgcaagaagagagtcacaagaccattaccgagatctgcaagacctgtgctggatacgcacggagttattattttcggcgcacgcattttggatgaggaagttttcgagggcgatgtacaagaacttgccattgtcccaggtgtgcaagctgcctatgaaagctgcgagcaaaaagaactggaatgcgaaggaggacagcgcgaacggccacagaatcagcagccgcatcgcgcacagaggtcaccccagcagcaaccaagccgcttgcaccggcctcaaaatcaggagcctcagtcccaacctaccgaatctctgtattacgattacaagccaccatattatgacgtgatgaccacaggaactacacccgactaccaggccgctcacgggccgaggggcttaaaaggggagaagggggagcccgccgtgctggagcccggaatgctggtggagggaccccctggaccagaaggacccgccgggttgatcggccccccaggcatccagggcaacccagggccagtgggcgaccctggtgaaagaggaccacctggccgtgccggactgccgggctccgacggtgcgcccggcccgcctggcacaagtctgatgctacccttcaggtttggttctgggggaggcgataaaggcccggtagtggcagcacaggaggcccaggcacaggcaattctgcaacaggccagactagctcttcggggaccccctggccccatgggatacactggtaggccaggccccctaggccagcctggttctcccggccttaaaggagagagtggagacttaggtcctcaaggcccgagaggtccgcaagggctgactggcccccccggcaaagccggtcgaagagggagagctggggctgacggcgcaaggggaatgccaggagatcctggggtcaagggtgacagggggttcgatggtctgcccgggctgcctggcgagaagggccaccgaggagatactggcgcccagggcttgcccgggccccccggcgaggacggcgagcggggcgatgacggcgaaatcggcccgcgcggcttacctggtgagtccggtccccgggggcttcttggaccaaaaggtccacctggaatccccggtccacccggcgttaggggaatggacgggcctcagggccccaaggggtccttaggacctcagggagagcctggccctccaggccagcagggaacccccggcacacagggacttcctggtccgcaaggtgccatcggcccacatggagaaaagggtccacagggcaagcccggtctcccaggcatgcccgggagcgatggcccaccagggcacccgggcaaggagggccctccaggtactaaaggaaatcagggaccttcaggcccccagggaccacttggatatcccggtccacggggtgttaaaggggtggatgggatcagagggctgaaagggcacaaaggagagaagggcgaggacggctttcccggatttaagggcgacattggcgtcaagggcgatcgaggagaagtgggagtccctggatcaagaggagaggacggcccagaaggacccaagggtcggacgggacccacaggcgacccaggaccccccggactcatgggtgagaaaggcaaattaggcgtcccaggcttaccaggctaccccggccgacagggaccaaaggggagcctcggatttcctggatttcctggagctagtggggaaaagggggcacgcggactatcaggaaaaagtgggccacgaggagaacgcggtcctactgggcctagaggacaacgcggtccacggggagcgacgggtaaatctggtgccaaagggacttccgggggtgacggaccacatggtcctcctggggaacggggactgccagggccccaggggccaaacggattccccggcccaaagggaccccccggaccgccagggaaagacggactacctggccacccgggacagagaggggaggtgggctttcaagggaagacagggcccccagggcctccaggagtggtgggcccacaaggcgcagccggagagaccggcccaatgggtgaaagagggcaccccggaccacctggacctcctggcgaacaaggactgccggggacagcagggaaagaaggaacaaaaggtgaccccggccctcctggggcacccggaaaggatggtccagcaggattacgcgggttcccaggcgagagaggtcttccaggcaccgccggaggcccaggcctcaaaggcaatgaagggcctagtggccccccaggtccagccggctcgccgggcgaaagaggtgccgctggaagtggaggtccaatcggtcctcccggacggcctggtccccagggtccacctggggctgccggagagaaaggggtcccaggcgagaagggccctataggtcctaccggcagggatggcgtgcagggcccagtcggtctgcctggccccgccggtccacctggtgtggctggggaggacggcgataaaggtgaagtcggcgaccctggtcagaagggcacgaaggggaacaagggtgagcacggcccccctgggccacctggaccaataggacccgtcggtcagccaggtgcagccggcgcagacggcgagcccggtgctcggggacctcaaggtcattttggcgctaaaggtgacgagggcacaagaggctttaatgggcctccgggccccattgggctgcaggggcttcctggtcccagtggggagaaaggcgagaccggcgatgtcgggccgatgggtcctcccggccccccagggccccgaggcccagcaggcccaaatggagctgacggtccacaggggcctcccggcggtgtcggaaacctagggccccctggagagaaaggtgagccaggcgaaagcggaagtccaggtatccagggcgagccaggagtgaaaggaccccgaggtgagcggggcgaaaagggggagtccggccaacccggcgaacccgggcctcctggccctaaagggcctaccggcgatgacggcccaaagggaaaccccggtccagtcggatttccaggcgaccccggaccacctggagaaggcggcccccggggccaggatggagctaagggcgacaggggggaggatggcgaacccggtcagcccgggtctcctggacccaccggagagaacggccccccagggcccctgggcaagagaggacccgctggctcgcccgggagtgaggggaggcaaggtgggaagggggccaaaggtgatcccggcgctataggagcccctggaaaaactgggccagttgggcctgccggaccagctgggaagcctgggccagatggcctcaggggactgcccgggtccgtcggccaacagggcagacccggggctaccggccaggctggcccccctgggcctgtcggcccgcctgggctgcctggcctgagaggggacgctggagctaagggggagaaaggacacccggggctgattggcttaatcggcccacccggcgagcaaggagaaaagggcgaccgcggcttgccgggcccacagggaagtcctgggcagaagggcgaaatgggaatccccggcgcaagcggacccatcggccctggcggacctcccggcctgccgggcccggccggcccgaagggcgcaaagggtgctactggcccaggtggacccaaaggcgagaaaggcgtgcaaggtcctccaggtcacccaggaccaccaggggaggtgatccagcctctaccgattcagatgcctaagaaaaccagaaggtcagtagatgggtcgcgtctcatgcaggaggacgaggccatcccaacagggggggccccaggatcccccggcgggctcgaggagattttcgggagtttagactctctccgtgaggaaattgaacagatgcgaagaccgacaggcacccaggacagccccgcgaggacctgccaggatctgaagctctgccaccctgagttgcccgacggtgagtactgggtagacccgaatcaagggtgcgctcgtgacgccttccgcgtgttttgcaatttcaccgcgggcggagagacgtgtgtcactccaagggacgatgtcacacaattttcttatgtcgatagcgaggggtcacccgtgggggtggtgcagctcaccttcctgaggttgctatcagtgtctgcccatcaggacgtatcctatccatgctcaggggctgcaagagatggccccctgagactgaggggtgccaatgaagacgagctttctcccgaaacatccccctacgttaaagagtttcgggatggttgccaaacccagcagggcagaacagtcctcgaggttcgcacccccgttcttgagcaactgccagtgctggacgctagcttttcggatctcggtgctccacctcggcgcggcggggtgcttctaggtccagtgtgcttcatgggatag

SEQ ID NO: 2576 - DNA, 5031 bp, Artificial Sequence
  Description of Artificial Sequence: Synthetic coding sequence
atggagagatgctcacggtgtcaccgcctgttactgttactaccgctagtcctgggattgagcgctgccccaggctgggcgggtgcacccccagttgacgtgctcagggcactgcgttttccttcactaccggacggcgtgagacgggcaaaaggcatttgtcccgctgatgtggcttacagagtcgctaggcccgcccagctgagcgcacctactagacagttatttcccggcggattcccaaaggatttttctctgcttactgtggtgcgtacccgccctggcctgcaggcaccactgctgacgctgtacagtgctcagggggtcagacagctcggattagagctgggacctcctgtcagattcttatatgaagaccagaccggtaggccacagcctccatcccagcccgtgtttagaggcctgtcacttgcagatggtaagtggcatagagtggccgtagctgtgaaagggcagtcagtgactctgatcgtggactgcaagaaaagggtgactcgtcccctcccccgaagcgcacgaccagttctggacacccatggcgtaattatatttggggcgcgcattctagacgaagaagtatttgagggagatgtacaggagctagcgatagtgcccggtgtgcaagcagcttatgagagctgcgaacagaaggagttggaatgcgaaggcggacaaagagagcggccacagaaccagcaacctcacagagcccagcgaagtccccagcagcagcctagccgccttcatcggccccagaatcaggagccccaaagtcagcccaccgaatcactgtactatgattataagccaccttattatgacgtgatgacaacagggaccactcccgactatcaggatcctacacccggagaagaggaagagattctagaaagttctctgcttccacctctcgaagaggcagctcatgggcctcgcggtctgaagggtgaaaaaggagaacctgccgttctggaaccagggatgctggtcgagggtccgcctgggccggagggacccgccggtctcatcggcccaccaggtattcaggggaatccaggccccgtgggtgacccaggggaaagaggtccgccggggagagctggccttccaggctccgatggcgcacccggaccaccgggtaccagcttgatgctgccatttaggttcggttctggcggcggtgacaagggaccggtggtggccgcacaggaggcccaggcacaggcaatccttcaacaagcacggctcgcccttcggggtcccccgggacctatgggctacactggaaggcccggacctcttgggcagcccggaagccctggcctgaagggagagtccggcgacttagggccccagggccctcgcggacctcaaggtctgacaggccctccgggtaaggctggacgtaggggccgggcaggggcggacggggctcggggaatgccaggggatcctggggtgaagggcgaccggggctttgacggattgccagggctccctggtgaaaaaggtcatcgaggtgatactggcgctcaaggacttcctggcccgcctggcgaagatggggaacgaggcgatgatggtgagatcggccccagggggcttccaggcgagtccgggcccagaggactcttggggcccaaaggtccaccagggatcccaggcccgccaggcgttcgcggcatggatggtccacagggtcctaaggggtccctggggcctcagggagagccagggcccccaggccagcaaggcacccctggcactcagggactgccaggcccccagggcgcgattggtccgcacggcgagaaaggaccccaggggaagcccgggctgccaggcatgcccgggagtgacggccctcctgggcaccccggcaaggaagggccaccgggaaccaaggggaaccaggggccgagcggcccacagggcccgcttggatatcctgggccccggggagttaaaggcgtcgacgggatccgcggcctgaagggtcataagggcgagaagggcgaagatggcttcccggggtttaaaggcgacatcggggtgaaaggcgaccgaggagaggtcggggttccaggaagtaggggtgaggatggcccagaaggacctaagggacggacaggcccaacaggagaccctggaccccccggactgatgggcgaaaagggaaagctgggcgtccctggtctgcccggctaccccggccgccaaggccccaaggggtctctgggttttcccggatttcccggcgcctccggagaaaagggcgcacgagggttgtccgggaagagcgggccaagaggggaacggggccctaccggcccacgaggtcaacggggccctaggggcgccacgggtaagtccggcgccaaagggacatctggaggagacggtccgcatggccctcccggagagcgcggattgcccgggccacagggtccaaatggcttccctggccccaagggacccccgggcccacccggaaaggatggcctgcctggacatccgggacaacgaggcgaggtgggatttcagggtaagaccggacccccgggccctcccggggtggtcggcccgcagggtgccgccggagagactggcccaatgggggaacgaggacaccctggccccccgggtccgccaggggagcagggcctgccgggaactgctgggaaagaaggcactaagggggaccccgggcccccaggggctcctggaaaggacggccccgccggcctgagaggattccccggtgaaagggggctgcctgggaccgctggcggcccaggcctgaagggaaatgagggcccatccgggccccctggccccgctggaagcccaggggagcgcggggcggccggttctggcggccccatcggaccaccaggccgccccgggccacagggaccccctggcgcagccggtgagaaaggcgtgccgggagaaaaagggccgattgggccgaccggaagggacggcgtccagggaccagtggggctacccgggccagcaggcccgcccggcgtggccggcgaggacggcgacaaaggcgaagtcggtgaccctggccagaagggcacaaagggcaataaaggtgaacatggacctccaggtccacctggacccatcggtcccgtagggcagcccggcgccgccggagcagacggcgaaccaggggccagaggaccccagggccatttcggagcgaaaggagacgaaggcactcggggctttaatggaccccctggccctataggactgcagggacttcccggaccttctggagaaaaaggcgaaacgggcgatgtcgggcctatgggcccacctgggccacctgggcctcgagggcccgccggaccgaatggagcggatggacctcagggtccgccaggcggcgtggggaacctggggcctccaggggaaaaaggagaaccgggagagtcagggagccccggcatccagggtgagcctggtgtgaaagggccgcggggcgaaagaggcgaaaaaggtgaaagcggtcaaccaggagagccaggcccacctggccctaaaggcccgaccggcgatgatgggccgaaggggaatcccggacctgtggggttccccggagatcccggacccccaggagaaggcggaccgcgcggccaggatggtgccaagggtgacagaggggaagacggagaacccgggcaaccggggtcacctggcccgaccggggagaacgggccccctggccccctgggtaagcgcgggcccgctggctcccccggctctgagggtcggcaggggggaaaaggtgccaaaggagatcctggcgctattggcgcccctggcaaaacaggacccgtaggaccggcgggtcccgccggaaaacctggacccgatggcctcaggggccttccagggtccgtggggcagcaggggcgacccggggctacaggacaggccgggcctccgggccccgtcggaccccctggactgccaggtttacggggcgatgccggcgctaagggggaaaaggggcacccagggctgattgggctcataggaccccctggagagcaaggcgagaaaggggatcgcgggcttcccggtccccagggtagccctggacagaaaggtgaaatgggtatacctggagcatccggaccaattggcccgggcgggcctcctggactgcctggacccgccggccccaagggtgctaaaggagccacaggcccaggaggacctaaaggggaaaagggggtgcaggggccgccaggacatcctgggccaccgggagaggtgatacagcctctgcctatccaaatgcctaaaaagacccgtaggagcgtggacggcagccgactgatgcaggaagatgaagcgatccccaccggaggtgccccaggtagccccggcggtctggaagaaatcttcggctctctcgactccctgagagaggaaatcgagcagatgcggcgccctaccggcacgcaagacagccccgcccgtacgtgccaggacttaaagctctgtcacccagaacttccagacggggagtactgggtggaccctaaccagggatgtgctcgggatgcttttagagtgttctgcaactttacagcgggcggagagacatgtgtgaccccaagggacgatgttacccaattttcctatgtggactctgaaggctcccctgtgggcgtggtgcaactcacctttctgcgcctcctgtcagtctctgcacatcaggacgtgtcatatccttgcagtggcgccgccagggacggcccattgcgcttgagaggagctaacgaggacgaactctctcccgagacctccccatatgtcaaggaattcagggatgggtgccagacccagcagggaagaaccgtcttggaggttaggacccccgtgcttgaacagctgcctgtgctggatgcctccttctccgatctgggagcgccaccacgccgaggaggagttctgctgggccctgtatgttttatggggtag

SEQ ID NO: 2577 - DNA, 5031 bp, Artificial Sequence
  Description of Artificial Sequence: Synthetic coding sequence
atggaaagatgctcgagatgtcatagactgctgctgttgctgcccctcgtcctcggcttgtcagcagcaccgggatgggccggcgcgcctccagttgacgtactcagagcccttagattccctagtctccctgacggcgtgcgccgagctaagggaatctgccccgcagatgtcgcttaccgtgtggcgaggcctgcacagctttctgcacccacccggcagctcttccccggaggctttcccaaggacttcagcttgttgacagtggtgagaacgcggccgggcctgcaggccccactgcttacactgtacagcgcacagggggtgcggcagctggggttggagctgggaagaccagtgagattcctttacgaggaccagaccggacgtccccaacctccatcacaacccgtgttccgggggctgagcttggccgacgggaagtggcatcgggttgcggttgccgtgaaaggacagtctgttacgctgattgtcgactgcaaaaagagagtcaccagacccctgccacgtagcgctaggccagtgttggatacccacggtgtaattattttcggggcccgcatactggacgaagaggtgtttgagggggatgtgcaggaactggctattgttccgggggtccaggccgcatatgaaagctgtgaacagaaggagcttgagtgtgagggcggtcaaagggagcgaccacagaatcagcagccacacagggcgcagcgcagcccccaacaacagccatctagactgcacagaccacagaaccaggagcctcaaagtcagccaacggaaagcctgtattatgattacaagcctccgtactacgacgtgatgaccaccggcactacccctgactaccaggaccccacccccggtgaggaggaggaaatactcgagagttccttgctcccccccctggaggaggccgcccatggcccccggggactgaaaggtgagaaaggggagcccgccgtgttagaaccgggaatgttggtggaaggtcccccaggaccggaagggcctgccggtttaattgggccacctggcattcaaggcaaccccggccccgttggagatccgggcgagcgcggtcctccaggaagggcaggcctgccagggtctgacggcgcaccaggacccccagggacctctctgatgctcccttttcggttcgggtcggggggcggggataaaggtccggtggtggcggcccaagaggcccaggctcaagccatactgcaacaggccagactggccctgcgtggtcctcctgggccaatggggtatacagggagaccaggccccctaggacagccagggtctccgggcctgaagggagaatctggggatctcggaccacagggccccagggggccccagggcctgactggccctcctggcaaagcagggagaagagggcgggctggggcagacggcgctagaggcatgcccggagatcctggagtaaaaggcgaccgtggtttcgatggtctgccaggcttgcctggggaaaagggacatagaggggacactggggcccaagggttacctgggcctcccggagaagatggagaaagaggagatgatggagaaattggcccacgaggcctgcccggggaaagcggacctcgcggcctgcttggtccaaaaggcccccctggaatccccgggcccccgggcgtgcgggggatggacggaccacagggcccaaagggatccctgggaccccaaggggagcccgggccacccgggcaacaaggaactccaggtactcagggtctccctgggcctcagggggccatcggaccccacggtgaaaaaggaccccagggcaagcccgggctcccagggatgccaggttccgatggaccgcccggccaccccggcaaagagggcccaccaggaacgaaaggcaatcagggcccgtccggcccccagggaccacttggctatcccggtcctcgtggtgtgaagggcgtggacggcatccgcggactgaagggccataagggggaaaaaggcgaggatgggtttcccggatttaagggtgacatcggcgttaagggcgaccgcggagaggttggagtgccaggctcccgaggtgaagatggtccagaggggcctaagggcagaactgggccgaccggggatcccggccctcccggtcttatgggcgaaaagggaaagctcggcgtcccagggttgcctggataccccggacggcagggaccaaagggaagcttggggttccccggatttccaggcgcctccggtgaaaagggggccagggggcttagtggcaagagtggtccccgcggcgagcgagggccaactggtccccgcggccagcgaggtccaagaggggcaactggcaaatcaggggccaaagggacctctggtggagacggcccgcatggccccccaggggagcgcggactgcctggtccgcaaggcccaaatggatttccggggcctaaaggcccccccggacctcccggtaaggatggtctgcccggccaccctggccagaggggggaggttgggttccagggtaagacaggccctccagggccaccgggtgtggtcggacctcagggcgccgccggggaaaccggtccaatgggagaacgggggcatccaggcccccctggaccccccggggaacagggcttacccggcacagcagggaaggagggaacaaaaggtgatccaggccctccaggggcgcccggtaaagatgggcccgcaggcctcaggggcttccctggcgagagggggttaccagggaccgccggcggtccaggactcaagggcaatgaggggccttccggcccaccaggaccagccgggtctccaggagaaagaggggctgcaggtagcggtggaccaattggcccaccaggtcgaccaggcccccagggccccccaggggctgccggcgagaagggcgttccaggggagaaagggccaatcgggcccaccggccgggacggggtccagggtccagtgggtttgcctggtcctgcagggcccccgggggtggccggcgaggatggagataagggcgaagtcggcgacccaggacaaaaggggacaaaaggtaataaaggcgagcacgggcctcccggacctcccggacccattggccctgttggtcagccaggcgctgccggggctgatggggaacccggggccaggggtcctcaaggacatttcggagccaagggggacgaaggcacacgtggattcaacggtcctcctggacctattgggctgcagggtctgcccggtccaagcggagagaaaggtgaaactggggatgtcggaccgatgggccccccaggccctccagggccccggggaccagccggtccaaacggcgcagacggaccccagggaccgcctggcggcgttggtaatctgggtcctcccggagaaaagggtgaaccaggggaaagtggttctcctggaattcagggcgagcctggcgtgaagggccccaggggtgagcgtggcgagaagggagagagcgggcagcccggggaacctggacctccaggcccaaaggggcctaccggcgacgacgggccgaaagggaatcctggcccagtcggctttccaggcgacccaggtccacctggcgagggcgggcccagggggcaggacggagccaaaggcgatagaggagaggatggagaaccagggcaaccaggcagcccaggacccaccggcgagaatggaccacctggccctcttggtaagagggggcccgcaggtagccctggtagtgagggtagacaggggggaaagggcgccaagggggaccccggggctatcggagcccccggaaaaactggaccagtaggtcctgccggcccagctggaaagccaggtcctgacggcctgaggggcctccccggatccgtaggacagcaaggcaggccaggtgctacaggtcaggccggacctcctggaccagtgggaccaccgggcctccctggactgcgtggggatgcaggggctaagggagagaagggacatccggggctcatcgggctcatcggccccccaggagaacagggggagaagggagatcggggactccccgggccccagggctctcctggccagaaaggcgagatgggcatccccggagctagcgggccgattgggccgggggggccacccggtctgccggggcccgccggccccaagggcgccaagggggccaccggaccagggggcccaaaaggtgaaaagggtgtacagggcccgccagggcatccaggacctcccggcgaggtgattcagcccctaccaattcagatgccaaagaagacaaggcgcagcgtcgacggcagccggctgatgcaggaagatgaagcaatccccactggaggcgccccaggaagccctgggggactcgaagagatttttggaagcctcgacagcttacgcgaagagatcgagcaaatgagaaggccaacaggaactcaagacagccctgcccggacctgtcaggacctgaaattatgccaccctgagctacccgatggggagtattgggtggaccccaaccagggatgtgcgcgggatgcctttagagttttctgtaactttaccgcggggggggagacttgcgtgacacccagggacgatgtgacgcagttcagttacgtggattcagagggctcacccgtgggcgtcgtgcaactcacctttctgcggctcctgtccgtgagtgctcaccaggatgtgtcatacccatgttccggcgctgcaagagacggtcccctccgcctacgtggcgcgaacgaggacgagctcagtcctgaaactagcccttacgttaaggagtttcgtgatgggtgccagacccagcaggggcggaccgtactcgaggttcggacccccgtcttggagcagttacccgtgctggatgcatctttcagcgatctaggagctccgcctcgccggggaggggtgttgctaggacccgtctgctttatgggctag

SEQ ID NO: 2578 - DNA, 5031 bp, Artificial Sequence
  Description of Artificial Sequence: Synthetic coding sequence
atggagcgctgttccaggtgccaccggctgctactcctgctgcctcttgtgcttggtctctccgccgcgcccgggtgggccggtgcgccgcctgttgacgtgcttagagccctgagattcccatccctcccagatggcgtccgtcgcgccaagggcatatgcccagcagacgtcgcctatcgagttgctcgaccagctcaactgtccgccccaactaggcaactatttcctggcggcttccccaaagatttcagcctcctaacagtagttcggacacggcctggtttgcaggcccctctgctgaccttgtacagcgcccaaggagtccgacaactgggacttgagctgggtcggcctgtgcgattcctttacgaagatcaaactggtagacctcagccccctagccagcccgtctttaggggactgtcactggccgacggtaagtggcacagagtcgcagttgccgtcaagggacagtcggtgacactgatcgtggattgcaagaagcgggttaccaggcccttacctcgatccgcccggcccgtcttggatacgcacggggtaattatatttggcgctcgtatcctcgacgaagaggtgttcgaaggcgacgtgcaagagctggccatagttcctggagtccaagcagcttacgagagctgcgaacaaaaggagttagaatgtgaaggcggccagcgtgaaagacctcaaaaccaacaaccccacagggcccagcgatcgcctcagcagcagcccagccgcctccaccgacctcagaaccaggaacctcagagccagccaacagaaagcctctattatgactatgaaccaccgtactatgacgttatgactaccggtacgacgcccgactaccaagatcccacacccggtgaggaggaggagatactcgagtcatcactgctccctccactagaagaagccgctcatggaccgcgtgggttaaagggtgaaaagggggagcctgcagtcctggagccaggaatgctagtggagggtccccctggcccggaaggacccgccggtctcatcggtcccccaggaatccagggcaaccccgggcctgttggcgaccccggtgaaagaggtccaccagggcgggctggattgcctggctctgatggcgcgccaggacctcctggaactagcttaatgctcccttttcgattcggctccggaggaggagataagggtcctgtggtggctgcacaagaagcccaggcacaagccatccttcagcaggctagattggctctgcgcggccccccaggaccaatggggtatactggtcgtccaggaccattagggcaacctggatcacctggcttgaaaggggagtcaggtgatttggggcctcaagggcctcgcgggccccagggactaactgggcctccaggaaaggccggaaggaggggtcgggccggagctgatggcgctcgcggtatgccgggcgatcccggagttaagggagatagagggtttgacggactgcctgggttgcctggcgaaaagggtcacagaggcgacactggcgcccagggtcttccagggccacctggagaggatggggagaggggcgacgacggtgagatcggcccccgcggtctacccggcgaaagtggcccaaggggcttgctgggaccaaagggcccccccggaataccaggcccgccaggcgtccgcgggatggatggacctcaggggcctaaaggatcgcttggcccacaaggggagcctggaccacccggacagcagggaacacccgggacgcagggcctcccgggccctcagggggcaattggcccacatggggaaaagggcccccagggtaaacctggcctgcctgggatgcccggtagcgacggaccccccggccaccctggtaaggaaggtcctccgggaactaagggaaaccaaggcccttctggtcctcaagggcccctaggataccccggcccccgcggggtcaaaggcgtcgatggcatccggggccttaagggtcataagggagaaaaaggcgaggatggatttccaggctttaagggagatatcggagttaaaggcgatcgcggcgaagttggcgtgcctgggtcaagaggtgaagacggtccagaaggacctaaaggccgcacaggcccaacgggagacccaggtcctcccggactgatgggggagaaaggtaaactcggtgtgccggggcttccagggtatccggggcgccaaggccccaaaggctcattgggatttcctgggtttcctggcgctagcggtgagaaaggcgcaaggggcctgtcagggaaatccgggcccagaggagaacgtggccccactggccccagaggacagcgagggccgagaggggcaacaggaaagtcaggtgcaaaaggtactagtggtggcgatggtcctcatggcccacccggagaacgtggcttacccggtccccaggggccaaacggtttccccggcccaaagggtccgcctggaccaccgggtaaagacgggcttcccggccatcctggccagaggggcgaggttggtttccaaggcaaaaccgggcctcccgggcctccaggggtcgtgggcccacaaggcgctgcaggcgagaccgggcctatgggagagcggggccaccccggaccccccggacccccaggggaacagggactgcctggaaccgccggaaaggagggaaccaagggcgacccaggccccccaggagccccaggtaaagacgggcccgccgggttgagaggcttcccgggggagaggggactgccaggcaccgccggcgggccaggactaaaaggtaatgaagggccctctgggcctcccgggcctgccggaagccctggcgaacgaggggccgctggatcagggggcccgatcggtccaccggggcgacctggcccccagggccctccaggcgcagctggagagaaaggagtgcctggcgagaaggggcccatcggcccaactgggcgcgatggtgtccagggccccgttggccttccaggccctgccgggccaccaggcgttgctggcgaggacggggataaaggtgaggtgggagaccccggacagaagggtactaagggtaacaaaggagagcacggtccccccggtcccccaggccccattggccccgtaggtcagcccggagccgctggagccgacggggagccaggggcacgggggccccagggacacttcggcgccaaaggcgacgaagggacacggggtttcaacggtcccccaggacccatcggccttcaaggcctccccggccccagtggagagaagggcgaaaccggcgatgtgggccccatgggcccaccagggccccccggaccccggggtcctgcaggtcctaatggagcagacggtccacagggcccacctgggggcgtcggcaatctcggtcctccaggtgagaagggggagccgggtgagtcaggcagccctggaatccagggcgaacccggggtgaagggacctaggggcgagaggggcgagaagggagagagtggacagccaggtgaaccaggaccacccggtcccaaagggcctaccggggacgatggaccaaaaggtaacccagggccggtcggattcccgggggacccagggcctcccggcgaaggaggccccaggggccaggatggtgccaagggggatagaggggaggatggcgagccggggcaacctgggagtccgggccctaccggcgagaatgggccccctggccccctcggcaagaggggacccgcgggctcaccagggagtgagggcaggcaaggcggcaagggtgccaagggcgacccaggcgctatcggagcacctggaaagacaggtcccgtggggccagcggggcctgctggcaagcccggccctgacggtctgagaggactgccaggatccgtcggccaacagggacgaccaggggcaacaggtcaagccggtcccccaggacccgtgggacctcccggactgccaggtctgcgcggtgacgcgggggctaaaggcgaaaaaggacaccccgggctgattggtctgatcggaccaccaggggaacaaggcgaaaagggagatagagggctgccaggaccccagggttctccaggccagaagggggaaatggggatccctggcgccagcggtcccattgggcccggagggccccccggactgccaggaccagccggccctaaaggagccaagggcgcgactggacccggcgggccgaaaggagagaagggagtacaggggcctcctgggcatcctggtccacccggcgaagttattcagccgttacccattcagatgccaaaaaagacccgtagaagcgtcgatggttcccgactgatgcaggaggatgaagcaatacccaccggaggtgctcctgggagtcctggtggcttagaggaaatattcggatccctggacagcttacgtgaggaaatcgagcagatgcggaggccaacgggaacacaggactcgccagcacgcacttgtcaggatctgaagctgtgccaccctgaactccctgacggagaatattgggtggacccaaatcagggatgtgcccgagacgcatttcgggtgttctgcaatttcactgccggaggggagacatgtgtgactccgagagatgacgtgactcagttcagctacgtggattctgaaggcagtcccgtaggtgtggtccagctcacgtttctgcggcttctgtcggtgtcagctcatcaggatgtgtcatacccatgctctggagccgctcgggacgggcccttaaggctgaggggcgctaatgaggacgaattgagtcctgaaacttctccgtatgtaaaggaatttagggacggatgccagacacagcagggaagaacagtactggaagtgcgtactccagttctggaacagctgcctgtgctggatgcctcatttagcgacctcggagctcccccaagaagaggaggcgtgctgctgggccccgtgtgctttatgggctag

SEQ ID NO: 2579 - DNA, 5148 bp, Artificial Sequence
  Description of Artificial Sequence: Synthetic coding sequence
atggaacggtgctccaggtgccatcgactcttgctgttgctgcccctcgtgctcggcctctccgctgctcccggttgggctggagcacctccagtggatgtgctgcgagccttgaggtttccgagcttgcctgatggcgtgaggagggccaaaggaatctgccccgctgatgtcgcctatcgggtagctcgccctgcacagctttctgccccaacacgccagctttttcccggggggttcccaaaggactttagcctcttgacagtggtgcgcactcgacctggtttacaggcgccgcttctgacgctttacagcgctcagggcgtcaggcagctgggtcttgaacttgggagaccagtacggttcctttacgaagaccagaccggaagaccccaacctcccagtcaacctgtgttccgaggtctgtccctggctgacggtaaatggcatagggtggccgtggccgtaaaaggccagagcgtaaccctgatcgtcgattgcaagaagcgggtgacccgacccctcccacgcagcgccagacccgtgctagatactcacggtgtgataatcttcggggcccgaatcttggatgaagaagtgttcgaaggagatgttcaagaactcgccatcgtgccgggcgtgcaagcagcctatgaatcgtgtgagcaaaaagagttggagtgtgagggtggacagagggaacgtcctcagaaccagcagccacaccgagctcaacgctcaccccaacagcaaccctcccgactgcacagaccacagaatcaagagccacagtcccagcccactgagtctctgtactatgattacgagcctccctactatgacgtgatgacaactggtaccaccccagactatcaggaacagactgacctgcaggtgccgcctactgccgatcgatttcaggcagaagagtatggtgagggaggcacagacccacccgaaggaccctatgattacacctatggctatggggatgattacagagaggagacggaactcgggcccgccctgtctgctgagaccgcccactctggcgctgcggctcacgggccaaggggtctgaaaggtgaaaagggcgagcccgcagttctagaacctggtatgttggttgaagggcccccgggacccgaggggcccgccggattgatcggcccacccgggattcagggcaacccagggcccgtaggcgatcccggcgagcggggtcccccaggcagggccggtctccccggttctgacggcgcacccgggccgcctggtacgagtctaatgctgcccttccgcttcggcagcggaggtggggacaaagggcctgtagtggccgcgcaggaagcgcaggctcaggccattctgcaacaggctcgcctcgccctgcgggggcccccgggacctatgggctacaccggcagaccgggccctctgggacagccaggtagtcctgggctgaagggggagagcggggatctcggccctcagggaccacggggccctcagggcttaactggacctcctgggaaagccgggaggaggggcagagcaggggccgacggtgcgaggggcatgccaggcgaccccggcgtgaagggagataggggcttcgacggcctgcctggtctgcccggagagaaaggtcaccgcggagatacgggggctcagggcctgcccggcccacctggggaggacggagaacgcggggacgatggtgagatcggcccccgcggacttccaggagaaagcggacctcggggcctattaggccccaagggaccacccgggatccccggaccgccaggtgtgcggggaatggacggtccccagggtcccaaagggtccttgggcccccagggagagcccgggccacctgggcaacagggcacccccgggacccagggtctgccaggtccacagggagccattgggccacacggagagaaaggccctcagggtaagccaggcctgcctggcatgcccgggtctgatggaccaccagggcaccccgggaaagagggcccgccgggtaccaaagggaatcaaggtccaagcgggccccaaggccctcttggataccccggcccacgaggtgtgaaaggagtcgatgggataaggggtcttaaaggacacaagggcgagaaaggcgaggacggcttcccaggtttcaagggagatatcggcgtcaaaggtgaccgcggcgaggtaggagtgcccggatcccgcggagaagatggcccagaaggcccaaagggccggactggccctaccggggaccctggacctcctgggttgatgggggagaaaggcaagttgggggtgcctggtctcccaggataccccggacggcagggccctaagggctcgttaggcttccccgggttcccaggggcctcgggagaaaagggggccaggggcctctcaggcaaatcaggcccacgaggtgaaagggggccgacagggccaagaggacagcgaggaccgcggggcgccaccggaaagagtggggcaaaaggaacttcgggaggcgacgggccgcatggaccccctggggagcggggcttaccaggcccccagggacctaatggttttcccggtccaaagggccctctgggccctcctggaaaagatggactgcccggacaccctggccagagaggggaagtggggtttcagggaaagacaggacctcctgggccgcctggagttgtggggcctcagggggcagccggcgaaactggccccatgggtgaacgtggacatcccggcccccccggccctccaggagaacagggattgcccggtacagccggcaaagaagggaccaaaggcgatccggggcccccgggggccccggggaaggacggcccagctggcctgcgtggcttccccggcgagcgggggctacccgggactgcaggcggcccaggtctgaaaggcaacgaaggccctagtgggccccctgggccggcaggatcacccggggaacgcggggccgctgggtctggcggccccattggccccccggggcggcccggaccgcaaggcccgccgggagccgctggagaaaagggggtgcctggagaaaaagggccaattgggccaaccggtcgggacggggtgcaggggcccgtcgggctccctggtcctgccggacctcccggggtggccggggaggacggggacaaaggcgaggtgggagaccctggccaaaaaggcacgaaaggtaataagggtgaacatgggcctcccggaccccccggacccatagggccagttggccaaccaggtgccgccggcgccgacggcgaaccaggggcgcgggggccccagggacactttggagcaaagggggatgagggaactagaggcttcaacggccccccgggtcctattggactacaggggctccccgggccctcaggagagaagggggaaaccggcgacgtgggtcccatgggtccgccgggccctcctgggccgagaggaccagccggacccaatggtgccgacgggccgcaaggccccccggggggagttggcaacctgggcccacctggtgaaaagggagagccaggcgaatctggctctcccggcatccagggcgaacctggggttaaggggccaaggggggagcgcggcgagaaaggagaaagcggccagccgggagagcccggccccccaggccccaaaggcccaactggtgatgacggcccaaaagggaatcccggccccgttgggtttccaggcgatcctgggccaccgggggaggggggtcctaggggacaggacggagcaaagggagatagaggagaggacggggaaccaggtcaaccgggcagtcctggaccaaccggagaaaacgggccaccgggccctctgggtaagcgtggcccagccggctctccgggcagcgaagggaggcaaggaggaaagggagctaagggagatccgggcgcaattggagcaccaggcaaaacaggcccagtcggtcccgccggccccgctggcaaacctggcccagacggtctccggggcctgcctggaagcgtgggacagcagggccgccctggggctaccggtcaggccgggccccctggacccgtcggccctcccggattaccaggactgcggggcgacgccggcgcgaagggcgagaagggtcacccaggactgatcggcttgatagggccaccgggtgagcagggggagaaaggtgatcgtgggctcccaggcccccagggctcaccaggccaaaaaggcgaaatgggtattcctggagctagcgggcctatagggcccggaggcccccccgggctgccaggaccagcgggacccaaaggtgctaagggggccacaggcccaggtggcccgaagggagagaaaggagtgcaggggccgcccggacaccctggccctcccggcgaggtcatccagcctcttcctatccagatgccaaagaaaacgaggaggtcagttgacggaagccgcctaatgcaggaagatgaagcaattccaacgggaggcgctccgggaagcccaggcggactggaagaaatatttggcagcctggacagtctaagggaagagatcgagcagatgcgccggccgactggtactcaggattcgcctgcgaggacatgccaggacctaaaactgtgccatcccgaacttcccgatggcgaatattgggttgaccctaatcagggctgcgcgagggacgctttcagagtgttctgtaattttacggcgggcggagagacgtgtgtgactccgagggatgatgttactcagttttcctacgtcgatagcgaggggagcccagttggtgtggtacagctgacattccttcgacttctgagcgtatcagcgcaccaagatgtgtcctatccctgctccggagcagctcgcgacggccctctgcgcctacgcggagctaatgaagatgaactgagccccgaaacctccccttacgtgaaagagtttagagacgggtgtcagacccagcagggcagaactgtgctggaagtccgcacacctgtcctggaacagctgccagtgctggatgctagtttcagcgaccttggtgccccccctcgccgtggaggagttttactgggcccggtatgcttcatgggttag

SEQ ID NO: 2580 - DNA, 4809 bp, Artificial Sequence
  Description of Artificial Sequence: Synthetic coding sequence
ggagcaccccccgtcgacgttctccgagctcttagattcccgagcctgcccgacggcgtgaggcgggccaaggggatctgtccagcagatgtggcctaccgcgtcgcgcgccctgcacagctaagcgcgcctacgagacagctgttccctggcggattcccaaaggacttctcacttctgaccgtggtgcggacccgacccggattacaggcaccactgctcaccctctatagtgctcagggggtgagacagctcggcctggagctgggacggcctgtgcgctttctctatgaggaccagaccggtcgcccccagcctccatcccagcccgttttccggggcttgtcactcgctgatgggaagtggcatagagtcgctgtggctgtgaagggccaaagcgtcacactgatcgtcgactgtaagaagcgagtgactagaccactccccaggtctgcccgacctgtgctggacacacacggagtgataatcttcggtgcacggatattagacgaagaagttttcgagggcgacgtgcaagaactggcaattgtaccaggggtgcaagccgcatatgaaagttgtgaacagaaagagcttgagtgtgagggtggacagagagagcggcctcagaatcagcagcctcacagagcacagaggtctccacagcagcagccttctcgtctgcatagaccgcagaatcaggaacctcaatcccaagctgctcatggcccaaggggcctgaagggggagaagggcgagccggctgtgctggagcccggtatgttagtggaggggcctcccggtcctgaagggccggcaggactgatcggcccacccggcatccagggcaatcctggccccgtgggtgatccgggagaaaggggcccccctggcagggcaggactccctggaagtgacggagccccaggcccgccgggcacatcgttaatgcttcctttccggtttgggtccggtggcggggataaagggccagtcgtcgctgcccaggaagcacaggcccaggcaattttgcaacaggccagactcgcgctgcgcggcccacctggaccaatgggctatactgggcgccccgggcctctgggacagccgggttcaccagggttgaaaggcgagtctggcgacttagggccgcaaggccccagggggcctcaggggctgaccggaccacccggcaaggcgggccgcagaggccgggcaggtgccgatggtgcgaggggcatgcccggagatcccggtgtgaagggagatcgtgggtttgatggactgcctggcctgccaggtgaaaagggccacagaggagacaccggcgcccaggggctcccaggcccccccggggaggatggcgagaggggcgatgatggggagataggacccagaggtttgccgggggaaagcggtccaagaggccttttaggacccaagggacctccgggtatccctggcccacccggcgtgcgcggaatggatggtccacagggccccaaaggatccctcggcccccaaggcgaacccggccctcccgggcaacaggggactcctggaacacagggtctgccaggaccccagggtgccatcgggccccatggtgaaaagggaccacagggcaaacctgggctgccgggaatgccaggctcagacggcccaccgggtcatccaggcaaagaaggtccccccggcacaaagggcaatcagggaccaagcggccctcagggacctctaggatatcccggtcctcgtggagtaaaaggggtggatggaattcgtggcctcaaggggcataaaggagaaaagggtgaggatggtttccccggattcaagggagacattggcgtaaaaggagacaggggagaggtgggcgttcccggctctcgaggggaagacggaccagaagggccaaaggggcgcacaggacccaccggggatcctgggccaccgggtctgatgggagagaaggggaaactgggggttcccggccttcccggctatcccgggcgacagggcccaaaaggctcattgggttttcctggattcccaggagcctctggtgagaagggagctcggggcttgagtggaaaaagtggaccacgcggtgaacgaggcccaaccggcccacgggggcagagaggtcctcggggtgcaaccggtaaaagcggggccaagggcacatcaggcggcgatgggccccatgggccaccaggtgagagagggctgccaggaccacagggaccaaatggctttccagggcctaaaggccctcctgggcccccaggcaaagacggcctgcctggacaccccggacagcggggcgaagtagggttccagggcaaaacaggacccccgggccctccgggagttgtcggccctcaaggtgccgcaggtgagacaggaccaatgggagagcgaggccatcctggtccccccggaccccctggagagcagggcctgcccggcactgcaggaaaagaaggcacaaagggtgacccaggaccccctggagcccccgggaaggatggtccggctggactgaggggtttcccgggagaaagagggctccccggaactgctgggggccctgggctcaagggtaatgaaggtccatccggccctcccggcccagccggttccccgggcgagcgaggcgccgccgggtccggcgggccaattgggcccccaggtcgtcctggaccgcagggcccaccgggagcggctggcgagaaaggcgtacctggcgagaagggccctataggaccaaccggtagagacggagttcagggccccgtgggactcccaggcccagccggcccgccaggggtcgcgggcgaagatggagataagggggaggttggagaccctggtcaaaagggaacaaaaggcaataaaggtgagcacggcccaccgggaccgccagggccaatcgggccggtcggtcagcctggcgccgctggtgcagatggagagccaggggctcggggcccccagggccacttcggggccaaaggagatgaaggcacccggggattcaatggcccccctggaccaatcgggcttcaggggctgccaggaccaagtggcgaaaaaggcgaaaccggtgatgtgggcccaatgggccctcctggtccccctggcccaagggggccagctgggcccaacggcgctgacggcccccaaggcccacccggaggagtcggcaacctgggacccccaggagagaagggggagccaggcgagtccggctctccaggaatacaaggcgagcccggcgtaaagggaccccggggggagagaggcgaaaaaggggagtccggacagcctggcgagcccggaccaccaggtccaaagggaccaactggcgatgatggaccaaaggggaacccaggaccagtgggtttccctggagatcccggaccacctggcgagggaggccccagaggccaggacggagcgaagggcgacaggggcgaggacggagaacccggccagccaggcagcccagggccaaccggcgagaatgggccgccaggccccctcggaaaacgcgggcctgccggaagccccgggtctgaggggcggcagggtgggaagggagcaaaaggtgacccaggcgccattggcgctcctggcaagaccgggccagtcggcccagccggccctgcaggtaaacctgggccagacggcctgcgcggcctccctggtagcgtggggcagcagggtagacctggagcaacagggcaggctgggccacccggcccagtgggcccgcctggcctgcccggactgaggggcgacgcaggcgccaaaggggagaaggggcatcccggattgattgggttgattggaccccccggcgagcaaggcgagaagggggacagggggctccctgggccccagggcagcccagggcagaagggagagatgggcatccctggcgcttctggtccgatcggccctggcgggccacccgggcttcctgggcctgcaggcccaaagggagctaaaggcgctacaggcccagggggcccgaagggggaaaagggcgttcaaggaccaccaggacatccgggacctcctggcgaggttattcagcctttgccgatacagatgcctaagaagacacggaggtctgtggacggctccagactgatgcaggaggatgaagccatcccgacaggtggagctccgggaagtccagggggtctcgaggaaatctttggctccctggactcgctaagggaggagattgaacagatgcgtcggccgactggtacccaggatagcccagcgcgaacatgtcaggacctcaagttatgccatcctgaactgcccgacggggaatattgggtggatcccaatcagggttgcgcccgggatgcattcagagtcttctgcaatttcaccgccggtggagagacgtgcgtgacaccccgcgatgacgtgacccaatttagctatgtggattctgagggcagtccagtcggggttgtgcagctaactttcttgcggttactgtccgtatctgcccaccaggatgtatcatacccctgctccggggccgcccgcgatggtcctctcaggctgagaggggccaatgaagatgagctgtcgcctgaaacgagcccttatgttaaggagttccgagatggctgtcagacccagcaaggacgcacagtgctcgaagtccgaacgcctgtccttgagcagctcccagtcttggatgccagtttctccgatttgggcgcaccccctaggagaggcggcgtactcctgggtccagtgtgttttatgggatag

SEQ ID NO: 2581 - DNA, 5052 bp, Artificial Sequence
  Description of Artificial Sequence: Synthetic coding sequence
ggcgcaccaccagtggatgttctccgagccctgcgctttccttcactgcccgacggagtgcggagggcaaaagggatctgccccgctgacgtagcctatcgggtcgcccggcctgcgcagctgtcggcacctactcggcagctctttccgggcggattcccaaaggacttttcgcttctgacagttgtccgaactcgaccaggattgcaggcccctctgctgaccttgtactctgctcagggagttagacagctgggccttgagctgggtaggcccgtacgatttctgtatgaggatcagaccgggcgaccccagcctccttcccagcctgtcttcaggggcctgagcttagcagacggcaagtggcatagggtggccgtagccgtcaaaggacagtctgttactctgatcgtggactgtaagaagagagttactcgacctcttccccggtccgccaggccagttctggatacccacggcgtgataatctttggagccagaatcttggacgaagaggtttttgaaggtgatgtccaggagttagcaatcgtgccgggagtacaagccgcgtacgaatcctgcgagcagaaggagcttgaatgtgaggggggccagcgagaaaggccacagaaccagcagccacatcgggcccagagatccccgcaacagcagcctagtagactacaccgccctcagaaccaggaacctcagtcccaagatcctacccccggagaggaagaagagatactcgagtcgagcctacttcccccactcgaagaagagcagactgatcttcaagtgccaccaacagccgacagattccaagccgaggagtacggcgaaggcggtacagacccaccagagggtccatatgattatacttacggatacggcgatgattaccgggaggagacagagctaggccctgctctgagtgctgagacagcacatagtggtgcggcagcacacggacccagaggcctgaaaggggagaagggcgaacctgccgtgctggaacccggaatgttggtggagggacccccgggaccagaggggccggctggcttgattggccccccgggtattcagggaaatcccggacccgtgggcgaccccggtgaacgggggccacccggacgggccggacttcctggctccgacggggcaccagggccccctgggacaagcctgatgctccctttcagatttggaagcggcggcggggacaagggaccagtggtcgccgctcaggaagcccaggcccaggccatcttacaacaagctcggctcgcattgagaggtccaccagggccaatgggctacacaggcagaccaggtcccctcggccagcctggatcccccggtctcaagggcgaatcaggggacctggggccacagggccctagggggcctcaggggttgaccgggccccccggaaaagctggcaggagaggcagggccggggctgatggggctcgcgggatgccgggcgaccctggcgtcaagggagacagggggttcgatggactccccggcttgcccggtgagaaaggccataggggtgacacaggggcccaggggctgccgggaccccctggagaagatggcgagaggggagacgacggggagattggacctcggggactaccaggggagagtggaccaagagggctcttgggaccaaaggggcctccagggatccccggccctcctggggttcggggtatggatggacctcaaggtcccaaggggtcactggggccacagggcgagcccgggcccccgggccagcaggggacccctgggacccagggactgccaggaccgcagggagccatagggcctcacggggagaagggcccccagggcaaaccaggactgcctgggatgcctggaagcgacgggcctccaggacaccccggcaaagaaggacctccggggactaaagggaatcagggcccttcgggccctcaaggaccactggggtacccaggcccccgaggagttaagggtgtagatggaatcaggggtctcaaagggcacaaaggcgaaaaaggtgaagacgggtttccggggttcaaaggagacattggagtgaagggtgatcgtggggaagtgggcgtgccaggctccaggggcgaggatggccccgaaggtcctaaggggcgtaccggccctaccggtgaccctgggccccctggcttgatgggggagaagggtaagttgggggtgcctggcctgccaggttatcccggcagacaaggaccaaagggaagtcttgggtttcccgggttccctggcgcctctggagaaaagggggcacgcgggctgagcggaaagagcggtccacgcggagaaagaggacccactggaccacgcggccagaggggacctaggggggccactggcaagagtggggcaaaggggacatccgggggagacggccctcatgggccacccggcgaacgcggcttgccgggcccacagggtccaaatggttttcccggtcctaagggaccccctggtccaccgggtaaggacgggctgcccgggcacccggggcagagaggggaagttgggtttcagggcaaaaccggacctcccggtccacctggcgtggtaggcccccagggggctgcaggggagacgggtccgatgggggagcggggccatcccgggccccctgggccccctggtgagcagggcctgcctggtacagcaggaaaggaaggtaccaaaggtgatccgggcccccccggtgcaccaggcaaagatgggcccgcagggcttcgcgggttccccggcgagagagggctgccaggcactgccggcgggccaggcctcaagggaaacgagggcccctccggccctcctggacccgccggaagccctggcgagcggggagcagctggttccggggggccaataggtcccccaggcaggccaggcccgcagggtcctccaggcgcagctggagagaaaggcgtgccgggggaaaaagggccaataggcccaactggccgtgatggagtccagggaccagtgggcctccccggcccggccggtccccccggggtggcaggtgaagatggcgataaaggcgaagtcggcgatccagggcagaaaggcacaaagggcaataagggagagcacggtcctcccgggcctcccggacctattggccctgttgggcaacccggggcagccggtgctgacggtgaaccgggggcacgcggcccgcaggggcacttcggggctaagggagacgagggcactcgcggcttcaatggcccaccaggacctattggcctccaggggctgcccggcccgtccggagaaaagggagaaactggcgatgtgggccctatgggaccccctggtccaccaggaccgcggggtcccgccggtccgaacggggctgacggcccccagggaccaccgggaggggtgggcaatctggggcccccaggcgagaaaggtgagcccggtgagtcgggctcccctgggatccagggggaacctggcgtgaagggaccccggggggagcgcggcgagaagggagagtccggccaacctggtgaacctgggccaccaggacccaaaggccccaccggagatgacggtccaaagggtaatccaggccccgtcgggttcccgggcgatcctgggccacccggggaggggggtcctcgagggcaggatggtgctaagggagatcgcggagaggacggagaacccggtcagcctggctctccagggccaaccggggaaaatggaccccccggcccgctcggcaagaggggtccagctgggagtccgggttcagagggtcgacaggggggcaagggggcaaaaggggaccccggagccatcggagcacctggtaaaacaggccctgtaggccctgctgggcccgcaggtaaacctggccccgacggcttgagaggcctgcctggaagcgttgggcaacaaggccgtcctggcgccaccggtcaggccggacctcccggtcccgttggaccaccagggctgccaggcctcaggggtgatgccggtgctaaaggcgaaaaggggcaccccggattgattggactgattggacccccgggcgaacagggagagaagggagacagaggcttgcctggcccccaaggctcgccagggcagaaaggagagatggggattcctggtgcctcaggacctattggcccagggggtccccccggcttaccaggacctgccgggcctaagggagccaagggagccacaggaccaggagggccaaagggtgagaaaggagttcaaggcccccctggccaccctgggccccctggggaggtcattcagccgctccctatccagatgccaaaaaagacgaggcgatcagtagacggctctcgactgatgcaggaagatgaagctattcctacagggggggcgccagggtctcctggtggcctagaagagatattcgggagcttggactcacttagggaagagatcgagcagatgcgcaggccaaccggtacccaggactctccagcccggacttgccaggacttaaaactctgtcaccctgagttacctgacggagaatactgggtagatcctaatcagggatgtgcacgggatgcctttcgtgttttctgcaactttaccgcaggtggagaaacttgcgtgaccccaagggatgatgtcacccagttctcatacgtggatagcgagggcagccccgttggcgtcgtccaacttacttttttgcgactcctcagcgtgagtgcccaccaggatgtctcatatccatgctcaggggctgccagggatggaccccttagacttcgaggagccaatgaagatgagctgtctccagaaaccagcccatatgtgaaggagtttagagacgggtgtcagacccagcaagggcggactgttctcgaggtgcggacacccgtgctggagcaactgccagtgctggatgcaagcttcagtgatctgggggcaccacctcggagagggggagtactgctgggaccagtgtgtttcatgggctag

SEQ ID NO: 2582 - DNA, 5133 bp, Artificial Sequence
  Description of Artificial Sequence: Synthetic coding sequence
atggaacgctgctcccggtgccatcgactcctcctactcctgccccttgtcctgggcctgtctgctgccccggggtgggcaggggcaccccccgtggatgtgctccgagctttaaggttcccctccttacccgacggggtgcgacgggccaaggggatctgtcctgccgatgtcgcataccgcgtcgccagaccagcgcaactgtctgctccgacccggcaactgtttcccggcggcttccccaaagacttcagcctgctcaccgtggtccggacacgtcctggcctgcaggcgcccctactgacactttatagcgcacagggtgttaggcagctgggtcttgagcttggtagacccgttagattcctgtacgaggatcagaccggtaggcctcagccaccctcacagccggtctttagggggctgtcactggcagatggcaaatggcatagggttgctgtcgctgttaaggggcaaagcgtgaccctgatcgttgattgcaaaaaaagagtcacgcgccctctgccccgttctgctcgcccagtgctcgatacacatggagtcattattttcggagcccgcattctggacgaggaagtgtttgaaggagatgttcaggagttagcaattgtgcccggtgtgcaggcagcctacgaatcgtgcgagcagaaggaattagagtgtgaggggggccaacgagagcggcctcagaatcagcaaccgcacagagcacaacgaagcccacagcagcaaccctctcggctccaccgaccgcagaaccaggaacctcaaagtcaagaccccacaccaggcgaggaggaggaaatacttgagtcatcactactaccgccactggaggaagagcagaccgacttgcaagtgccaccaacagctgataggttccaggccgaggagtacggggaggggggtaccgaccctcctgaggggccctacgattacacctatggctacggagatgactacagagaggagacagagctgggccccgctctctcagccgagacagcacacagcggagctgcagcacacgggccacggggtttaaaaggggaaaagggagaacccgctgtgctcgagcccggaatgctggtcgagggaccaccaggtcccgagggccctgctggactcattggacccccaggcatacagggtaatcccgggcccgtcggtgaccccggggaaaggggaccccccggacgcgccggattgcctggctctgacggagctcccggtccgccaggcacgagcctgatgttgcccttccgatttgggagcggtggaggcgacaagggccctgtggtcgctgcacaggaggcccaggcccaagctattctgcagcaagcaaggctcgctctgcgaggacctcctggacctatgggatacaccggacggcccggaccactgggccagccgggctcgcctggcttgaagggtgagagcggcgacctgggtccacaaggaccaagaggaccgcaagggctgaccggccccccaggaaaagccggtcgcagaggaagagcaggggctgatggagcccgcggcatgcccggggatcctggcgttaagggggacagggggttcgacgggctgcctggtctgcctggagaaaaagggcataggggagatactggggcccagggtttgcccggccccccaggcgaagacggcgagcggggggacgatggtgaaatcggacctcgcgggctccccggcgaatcagggccgcggggcctgctgggccccaaaggcccacccggcatccctggccctcctggggtacgggggatggatggcccccaaggccctaagggatcactgggcccgcagggggagcccggcccaccaggacagcagggcacccctggtactcaaggcctcccaggaccacagggcgcaattggacctcacggagagaaaggaccccaggggaagccagggctcccgggtatgcccggctctgacggtccccccgggcatcctggaaaggagggaccaccaggaactaaaggcaatcagggccctagtggtccacagggtccactggggtatccgggcccacgcggtgttaaaggggtcgacgggattcgggggttgaaaggacacaagggggaaaaaggcgaagatggcttccctggttttaagggggacataggcgtgaaaggagaccgcggcgaggtgggggtccccggatccaggggagaagacgggcccgagggccccaagggtcggactggtccgaccggtgatccaggtccccccggactcatgggcgaaaaggggaaacttggcgtgcctggcttacctgggtatcccggcaggcaagggccaaaaggttctctggggttccctggctttcctggagcctctggagaaaagggcgcccggggcctttccgggaaatccggccctcggggggaacggggcccaacgggacccagaggacagcgaggccctcggggcgcgactggaaagagcggcgctaaggggactagtggcggggacgggcctcacggcccccccggcgagagaggtctacctggacctcaaggccctaatggatttcccggcccgaaaggaccacctggaccccccggtaaggatggcctgcctggccaccctgggcagcggggagaggtcggcttccaaggaaaaacaggaccacctgggccacccggcgtggtcggaccccagggggctgccggggagaccggccccatgggcgagcgagggcacccaggcccgccgggaccccccggcgagcaaggactgcctggcaccgctgggaaggaaggtactaagggcgaccccggccctccgggtgcaccggggaaagacgggccggcggggctgagaggcttccccggcgaacggggattgcccggaacagccgggggaccagggctgaagggaaatgagggcccatccggccccccaggacccgctgggagtcctggtgaacggggagccgccggctctggagggccaattgggcctcctggccggccgggaccccaggggcctcccggcgctgctggcgagaaaggcgtgcccggcgaaaaggggccaatcgggcccaccgggcgtgacggagtgcaggggcctgtcggcttgccagggccagctggaccccccggggtggcgggcgaggacggcgacaagggcgaggttggcgatccgggccagaaaggaacaaaaggtaacaagggagaacatggcccgcccgggccaccaggaccgattggaccggttggacagcccggagccgcgggcgctgacggcgaaccaggagccagaggaccccaaggccacttcggcgccaagggcgatgaaggcacaaggggatttaacggccctcccggtcccatcggactacaggggcttcccggaccctcaggtgagaagggagagaccggcgacgttggtccgatggggccgcctggaccccccggccctaggggaccagccgggccaaacggagctgacggccctcagggcccgcctggtggcgtagggaatctgggcccacctggcgagaagggtgagcctggggagagcggctctccaggaatccaaggggagcccggtgtcaaaggtcctcgcggcgagcgaggggagaagggagagtctggccaaccaggggaacctggaccacctggcccaaaggggcctacaggcgatgacggtccgaaaggcaaccctgggccggtgggttttccaggagatccaggcccgccaggtgagggcgggcccaggggccaggacggtgccaaaggggatcggggagaagatggagaacccggacagcccggctcacccggccctacaggggaaaacggacccccaggacctttaggtaagcgtgggccagcgggaagccccggatcagagggcagacaggggggaaagggggcaaagggcgaccccggcgcgataggcgcccccggcaagacgggaccagtgggtccagcaggacccgcaggtaagccaggccccgatggattaagaggactgcctggttcggtcggccagcagggcaggccaggggctactggacaggctggcccgcctggccctgtcggcccacctggcctccccggactccggggagatgccggggctaagggagaaaagggccatcccggactgatcggcctaatcggacctcccggtgagcaaggcgagaaaggagatcgaggccttccaggcccacaggggtcccctggacagaagggagaaatgggcattcctggagctagcggccccattggcccaggggggccccctgggctccccggccccgccgggcccaagggcgcgaagggcgcgacgggacctggcggacccaaaggcgagaagggagttcaaggccccccagggcatcctggcccaccgggcgaggtgatccaaccactgcctattcaaatgcccaaaaagacacgaaggtcggtcgatggctccaggctaatgcaggaggatgaagccattccaacgggcggggcacctggatcgcccggcggtctggaggagatcttcggaagtctggacagcctccgagaggagatcgaacagatgaggaggcctaccggaacgcaggatagccccgccaggacatgccaagatctcaagttatgccacccggagttgccagatggtgagtattgggtcgacccaaaccagggatgtgctagggatgccttcagagtgttctgtaacttcactgccggtggagagacgtgcgtcacacctcgggatgacgtgacccagttttcctatgtcgattccgagggcagcccggttggagtggtgcagcttactttcctacgtctgctttctgttagtgcacaccaggacgtcagctacccctgcagtggcgccgcaagggatggccctctgcggctgagaggggccaatgaggacgagttgagtcctgaaaccagtccctatgtgaaagagttccgggatggttgccagacacaacagggcaggaccgtgcttgaggtccgcacccctgtcctcgagcagttacccgttcttgatgcctcattctctgatcttggggctccaccgcggcgtgggggtgtcctgctgggccccgtttgcttcatgggttag

SEQ ID NO: 2583 - DNA, 5133 bp, Artificial Sequence
  Description of Artificial Sequence: Synthetic coding sequence
atggagcgatgttcacggtgccacaggctgctgttacttctgcccctagtcctggggctctccgctgcccctgggtgggcaggtgcgccacctgtcgatgtcctgcgggctctgaggtttcctagcctgcccgatggtgttcgacgcgcgaagggtatatgcccagccgatgtggcctatcgtgttgccagaccggcacagttatccgcccctacccgtcaacttttccctggcggattccccaaagacttttctctgctgactgtcgtgagaacccgtccaggtctgcaagctccactgctgaccctgtattcagctcagggagtaagacaactgggcttagagctcggacgtccagttcggtttctttatgaggatcagacaggacgtccgcagccgccgtcacagcccgtgtttcggggactctcccttgcggacggtaaatggcatagagtggcagtggcagttaaaggccagagtgttacactcatcgtcgactgcaagaaaagagttaccagacctttgcctcgctcggcgagacctgtcctcgacacccatggggtgatcatctttggcgcccgtatcctggatgaggaagtgttcgagggggatgttcaagagctggcgatagtcccaggagtgcaagccgcctatgaatcctgcgaacagaaagaactggagtgcgaaggtggccaacgcgagaggccgcaaaaccagcaaccccaccgagctcagcgttccccccagcaacaaccctctagattgcatagacctcagaaccaagagccacagagtcaagatcctaccccaggcgaggaggaagaaatcttggagtccagcctgttgccgcctctcgaggaagagcagactgatcttcaggtgccaccaacagccgacagatttcaagcagaggagtatggggagggaggtacagacccaccagagggaccatacgactacacctacgggtatggtgacgattatagggaggagaccgagctcggacccgcgttgtcagccgaaacagcccacagtggagcggcggcccacggaccccggggcctgaagggggaaaaaggcgaacccgcggtgcttgagcccggtatgcttgtcgagggcccccctgggcccgaggggcctgccgggctgatcggtccaccaggcatccaggggaacccgggtcctgtgggcgatccaggcgagaggggtcccccaggaagagctggactcccaggaagcgacggtgctccgggtccgccggggacttccctgatgttgcctttccggttcggtagtggagggggcgataaaggtcccgtggtggctgctcaggaggctcaggcgcaggcaatcttacagcaggcgcggctggcccttcggggcccacccggacctatgggatacactggccgccccggtcccttgggacagcccggaagccccggcctgaagggggaatcaggagacctcgggcctcaaggccctaggggtccacaggggctgactggaccgcctggcaaggctggcagacgcggtagggcaggcgcagacggagccagaggcatgccaggcgaccccggggtgaaaggtgatcgtggctttgacggtttacccgggctgccaggggagaaaggtcacagaggcgacactggggcccagggactcccagggccaccgggggaagatggtgaaaggggggatgacggcgagatcggcccaaggggccttcccggtgagagtggacctcggggcttgctgggacctaaaggacctccaggaattccagggccgccaggagtaaggggcatggacgggcctcagggcccgaagggctctctcggcccccagggggagccggggccaccaggacaacagggcacgcctggaacgcagggtctgccgggccctcagggagcaattggcccccatggagagaaaggcccacagggcaagcccgggctgccggggatgcccggcagcgatgggcctcctggccacccaggcaaagagggccctcccgggactaagggaaatcagggtccttcgggacctcagggccccctcggatatccaggtccccggggtgtcaagggcgtggacggcattcgcggcttaaaggggcacaaaggggagaaaggagaggacggcttccccgggtttaaaggcgacattggcgtgaagggcgataggggagaagtcggcgtgccaggcagccggggggaagacggtcctgaaggcccgaagggccggaccggtcctactggggatcctggccccccgggcctgatgggtgaaaagggaaaactgggggtgcctggcctgcccggatatccagggcgccaagggccaaagggaagtttgggatttccaggctttcccggcgcctctggagagaagggggcccggggcctcagtggaaagtcaggccccagaggagaacgcggtcctacaggcccgagaggacaacggggtccgagaggcgctacaggaaaatctggtgccaaaggtacatccgggggcgacggtccccatggaccccccggcgaacgcggattacctggaccgcagggccctaacggatttcccggacccaaaggaccacccggtcccccagggaaggacggcctgccagggcacccaggccagcgaggcgaggtgggttttcagggcaaaacaggtccaccgggtcctcccggagtagtgggcccccaaggcgctgcaggggaaacaggacccatgggagagcggggtcaccccgggccccctgggccacccggtgagcagggcttacctggcacagccggtaaagagggtactaaaggggatcccggccctcccggtgccccggggaaagatggtcctgccggtctgcggggcttccctggcgagagggggctaccggggaccgccgggggacccggtttgaagggcaacgagggccccagcggtcctccgggtccagcaggctctcccggcgaaagaggagccgccggaagcggtgggcccattggccccccaggcaggcccggaccccaggggccgcctggggctgcaggagaaaagggcgttcctggggagaaaggaccaattggacccaccgggcgtgatggtgttcagggccccgtcggccttcctgggcccgccggacctcccggtgtggccggtgaggatggcgacaaaggggaggtcggcgacccaggccagaagggtacgaaaggtaacaaaggcgaacacggccctcctggccctcccgggcccatagggcccgtgggccaacctggcgcggcaggggccgacggcgagcccggagctcgcggtcctcagggacactttggcgcaaagggggacgagggtaccaggggattcaacggacctcccgggcctattggtctgcaggggctacccggtccttccggcgagaagggcgagacaggtgatgtggggccaatgggaccccccgggcctcctggacctcggggcccagctggacccaacggcgcagatggaccacaggggcctccagggggcgtcggcaacctcggaccccccggcgaaaaaggcgaacccggggagagtggctccccgggaattcagggcgagccaggtgtgaaaggacctcgcggggaacgaggcgaaaagggtgaaagtggccagcccggcgaaccgggccccccaggccccaagggccccacgggagacgatgggccaaaagggaaccctggtcccgtgggcttcccaggagatcccgggccccccggagaaggaggccctaggggtcaagacggggccaaaggtgacaggggcgaagacggggagcccggccagcccgggagcccagggcccaccggcgagaacggacctcctggaccactcggaaagagaggacccgccggctcacccgggagtgagggaaggcagggcgggaaaggggctaagggtgatcctggagcaataggcgcccccggcaaaactggaccagttgggccagccggcccagccggaaagcccggtccagacggcttaaggggcctgcccggcagtgtcgggcagcagggtagacctggcgcgacaggccaggccgggccaccaggcccagtcggccctccgggtctacctggcttgaggggagacgctggcgcaaagggggaaaaggggcatcctgggttgatcgggctgatcggccctcctggcgagcagggagaaaagggtgatcgcggattgccaggaccccagggcagtcctggacagaaaggcgagatgggcataccaggcgctagcggtccaatcgggcccggtggacccccgggcctgcctggaccagcggggcctaagggagcgaagggagctactgggccaggcggacccaaaggcgaaaaaggagttcaggggcctcccggacatccggggccacccggcgaagtgatccaaccactgccaatccaaatgccaaagaaaacgaggcgcagtgtggatggaagccggctaatgcaggaggacgaagccatccccacaggcggagcccctggaagtcctggtggactggaggaaatttttggcagtctggacagcctccgtgaagagatcgagcagatgcgccgccccacgggaacccaagatagcccggcacgcacatgccaagatctaaagttgtgccacccggagctgcctgacggggaatattgggtcgaccctaatcaggggtgtgcaagggacgcctttagagtcttctgcaatttcaccgctgggggtgagacttgtgtgacaccgcgtgatgacgttacccagtttagttacgtagactccgaaggctcaccggttggagtcgtgcaactgacattcttacgcttattgagcgtgagtgcccaccaagacgtgagctatccttgctcgggcgccgcacgcgatggaccgctgcggctgcgaggagccaacgaggacgagttatcacccgagacttccccttacgtaaaagagttcagagacgggtgccaaacccagcagggaaggacagttttggaggtccggacacctgtgctggaacagctgccagttctagatgcctccttcagtgatttgggggcgcctcccaggagagggggcgtactcctggggcctgtatgtttcatgggatag

SEQ ID NO: 2584 - DNA, 5031 bp, Artificial Sequence
  Description of Artificial Sequence: Synthetic coding sequence
atggagcgttgttccagatgtcaccgccttcttcttttgctcccattagtgcttggattgagcgcagcccccggctgggccggggctcctccggtcgacgtgcttagggcactcaggttcccaagtctccccgacggcgttagaagggccaaagggatttgtcccgctgatgtggcctatcgcgtagccagacctgcccagttaagtgcgcccactcggcagttgttcccaggcggcttcccaaaggatttttctcttctcacggtggtcagaacgcgcccaggactgcaggctcccttactaactctctacagtgctcagggcgtgcgccagctgggactggaactgggacgccctgttcgatttttgtatgaggaccagactgggcgcccgcaacctccaagccaaccagttttcaggggcttgtctctggccgacggcaaatggcatcgagtcgccgtggcagtcaaggggcaaagtgtgacattgattgtggactgcaaaaagcgcgtgactaggcctctgccccggagtgctcgcccagtgttggacacccacggcgtgatcattttcggcgcccggatcctcgatgaggaagtctttgaaggcgacgtccaggagctggccatagtgcctggagtgcaagccgcctacgagtcatgcgagcagaaggaactcgagtgtgaaggtggacaaagagaaagaccacaaaaccaacaacctcacagagcccagcggagcccacagcagcagccatccaggctacacagaccacagaaccaggaacctcagagccagccgaccgagagcctctattacgattacgagcctccatactatgatgtgatgaccacagggacaacccccgactaccaggaccccactcccggggaagaggaagaaatactcgagtccagtttgctgccccctctggaggaggctgcccatggtcccaggggcctgaagggggagaagggggaacctgctgtcctggagccaggcatgctcgtggaggggcctcctgggccagaaggtcctgccggcctgattgggccaccaggcattcagggaaaccccgggccggtgggtgaccccggggaacgcgggcccccgggacgggcaggcctcccagggtcagacggggcacccggcccgccaggaacttcacttatgctgcccttccgtttcgggagcgggggtggcgacaaaggtccagtggttgcggcccaggaagcccaggcccaagcaatactgcaacaggctaggctggccctccgcgggcctcccggacccatgggctacactggtcggccagggcccctaggccagccgggttcaccaggtctgaaaggagagagtggcgatcttgggccgcaggggcctcggggccctcagggcctcacgggcccacccggaaaagccggccgccggggaagggctggcgccgacggagcgaggggaatgccaggtgaccctggcgtgaaaggcgatcgaggattcgatggcctgcccggattacctggggagaagggccacagaggagacacaggcgcccaggggttgccaggaccccctggtgaggacggagaacgcggcgatgacggagagatcgggccgagagggctgccaggggagtccggaccaagggggctgttgggaccaaaagggccccctggtatcccaggacctcctggtgtacgggggatggatggtccgcagggccctaagggaagtttgggcccccagggggaacccggcccacccgggcagcaaggtacccccgggacccaggggcttccaggaccgcaaggagcaattggtccacacggcgagaaggggcctcagggcaagcctggtttgccggggatgcccggtagcgacggcccgcccggacatcccggcaaagaggggccacctgggactaaagggaaccaaggtccctctggtccccaaggacccctcggatatcccggcccacgcggcgtgaagggtgtggacgggatcaggggcctaaagggtcacaaaggcgaaaaaggcgaggatggttttccgggttttaaaggggacattggtgtgaaaggcgacaggggggaggtcggggtgccaggtagtagaggcgaagatggacctgaaggacccaagggtcggactggcccaacaggggacccagggccacctggcctgatgggtgaaaagggaaagctgggcgtgccaggtcttcctggatatccagggagacagggtccaaaggggagcttggggttccctgggtttcccggtgcttcgggcgaaaaaggagcaagggggttaagcggcaaatcgggcccacgaggagagcgcgggcctacagggccacgggggcagagaggccccaggggagccaccggaaagtctggtgctaaagggaccagcggaggagatggcccacacggacccccaggagaacgcgggttaccagggcctcaaggccctaacggattccctggtcctaagggccctctgggacctccgggcaaggacgggctcccggggcaccccggacagcgcggagaggttggatttcagggtaagaccggcccacctggaccgcctggagtcgtcggtccccagggcgcggctggcgagaccggacccatgggcgaacgtggacatcctgggcccccggggccgcctggggagcagggacttcccggaaccgcgggaaaagaaggtacaaaaggagaccctgggcctccaggggccccagggaaggatgggcctgccggactaagaggatttccaggggaacgtggtcttcctggtacagcaggaggacctggattgaaaggaaacgaagggcctagcggcccacctggccccgccggctccccgggggaaagaggggctgcaggatcagggggacctattggcccaccgggaagacccggaccccaaggtccccccggcgcagctggcgaaaaaggggttccaggtgaaaaggggccgatcggacccaccggcagagatggggtgcaggggcctgtcggcctgccaggcccagctggaccccccggcgtggccggcgaggacggagataaaggcgaggtcggagaccccggccagaagggaactaagggaaacaagggggaacatggccctcccggccccccgggcccaataggccctgtgggccagccaggagcagccggagcagacggagaaccgggagccagagggccccagggacacttcggcgctaagggggatgaggggaccaggggctttaatggacctccggggccaattggcctccaggggctgccaggcccaagtggtgaaaagggagagaccggtgatgtgggacccatggggccgccagggccccctggacctcgtgggcccgcaggtccgaacggggccgacggacctcagggccccccagggggcgtggggaacctgggaccacctggagagaagggcgaacccggcgagtcagggtctccaggcatccagggcgaacccggagtgaaggggccaaggggagagcggggcgaaaagggagaatctggtcagccgggagaacctgggccccctggcccaaaagggccaactggagacgatggccccaaaggtaaccccggccccgtgggattcccaggggaccctggaccacccggagaggggggcccccggggacaggatggagcaaagggcgataggggtgaggacggcgaaccaggacagcctggttctcccggcccgacgggcgagaatggccctcctggaccattgggcaaacgggggccggccggcagcccaggatcagaaggccggcagggggggaagggagctaagggtgatcctggagccatcggtgccccaggcaagaccggccccgttgggcctgcaggcccggcaggcaagccaggaccagacggactccgggggctccctggatcagtgggccaacagggtagacccggcgccaccgggcaggcgggcccacccggccccgtcggcccccccggcctgcccggcttacgcggggacgccggcgctaagggcgagaaaggccatcccggccttattgggctgatcggcccccctggagaacagggagagaagggggacaggggacttcctggcccgcagggaagtcctggtcagaaaggcgagatggggattcccggcgcgagcgggcccatcggtccaggaggccctcctgggctaccaggtccagccgggcccaagggtgccaagggagcgaccgggccagggggaccaaagggggagaagggggtgcaaggcccccccggccatcccggaccacccggtgaggtcatccagcccttacccatacaaatgccaaagaagacacggagatctgttgacgggagtcgcttgatgcaggaagacgaagcaatccctacaggcggggctcctggatccccagggggccttgaggaaattttcggatcgcttgactccctccgcgaggaaatcgagcagatgagacggcctacaggcactcaggactcgcccgctcgaacctgccaggatttgaagctgtgtcatcctgaattgcccgacggcgaatactgggtggatcctaaccaaggctgtgcacgcgacgcttttcgcgttttctgcaactttacagccgggggcgaaacatgtgtgacccctcgggatgatgtcacccagttctcatacgtcgacagcgaggggtctcccgtgggggtagtccaactcacctttctcaggttactctccgtaagtgcgcatcaagatgtctcatacccttgctcaggagctgccagggacggtcccctgcgtctgcgcggggccaatgaggacgagctgagccccgagacatccccctacgtgaaggaatttagggatggatgccagacccagcaggggagaacggttctcgaggtgcggacaccagtcctcgaacagctcccagtgttggacgcatcattttcggacctgggggctcctccccgcagagggggtgtgcttctcgggccagtatgtttcatgggttag

SEQ ID NO: 2585 - DNA, 921 bp, Artificial Sequence
  Description of Artificial Sequence: Synthetic coding sequence
atggactggcgggcgagtgaggcttggatggtcccgcgggctcctaagggagcctgggatcctcgcgagagccaggacctgctcgacaatcgggcacccttaggacctcgggtttttcccgggcctcgggttcccagcgccttgatggagaggagagtgctgaaaggtagccagggctcacctgcctgtcctggcccacccggagaggttatccagcccctgccaatccaaatgcccaagaagaccaggcggtccgttgacgggagccggctgatgcaagaggacgaggccattcctaccggcggggctcccgggtcccccgggggactggaggaaattttcggaagcctcgattcactgcgcgaggagattgagcagatgagaaggcccacagggacacaagactcccccgctcgcacctgtcaggacctgaaactgtgccaccccgaactgccagacggggagtactgggtcgaccctaatcaaggatgtgctagggacgcgtttcgtgtcttctgtaactttaccgcgggcggggagacatgtgttacccccagggacgatgtgactcagttctcctacgtggactctgaggggtccccagtgggcgttgtccaactgacctttctgaggctgttaagtgtgtctgctcatcaggacgtgtcttacccttgtagtggtgcagcacgggatggacccctgcgactgagaggcgcaaacgaagacgagctgagccccgagacttcaccgtatgttaaggaatttcgggatggctgccaaacgcaacaaggtcgtaccgtcctggaagttcgaactcctgtgctggagcagctacctgttttggacgcgtcattctccgatctgggcgcccccccacgtcgtgggggcgtcttgctggggccggtgtgctttatgggctag

SEQ ID NO: 2586 - DNA, 5070 bp, Artificial Sequence
  Description of Artificial Sequence: Synthetic coding sequence
atggagcgctgtagccgatgtcatcggttactgctattgctgccactggtgctcggcctgagcgcggcacccggttgggcgggagcaccgcctgtagatgtgctgcgagccctgcggtttcccagtctcccggacggcgtccgaagagctaagggcatctgccctgctgacgtcgcttaccgggtggcacgtccagcgcagttgtcggcccccaccaggcagttgttccccggcggttttcccaaggatttttctctattgaccgtggtgcgcacacggcccggactccaagccccactactcacattgtattccgcgcagggagtgcggcaactgggactggagctcggtcgcccagtgaggttcttgtacgaagatcaaaccggccggcctcagcccccctcacagccagttttccgcggactttctttagctgacggaaaatggcaccgcgtggctgtagctgttaaagggcagtcagtgaccctgatcgtcgactgtaaaaaacgggtcactcggccgcttcccaggtccgcacgcccggtgttagacacacatggtgtaatcatcttcggcgcgagaattcttgatgaagaagtctttgaaggggacgtccaagaattggcaatagtgcccggtgtgcaggctgcttatgagtcctgcgagcaaaaggagctggagtgcgagggcgggcagcgggaacggccccaaaaccagcagcctcacagggcccagcgctctccacagcagcagccttcacgcctgcatcgcccacaaaatcaggagccacagtctcaggaacagactgatctgcaggtgccacccactgccgacagattccaggcagaggaatatggggaaggcggcacagacccacctgagggaccttatgattacacctatggatacggcgacgactacagggaagaaactgagctggggcccgctctgtccgcagaaaccgcccatagcggggccgctgcccacgggcccaggggactgaagggggaaaagggggaacctgcggtgctggagcctggtatgttggtggagggcccaccagggcccgaaggcccagccggcctaattgggcctccaggcatacagggcaacccgggaccagtgggtgaccccggcgagcggggaccaccaggtagggcagggttgcctggaagtgacggcgctccggggccaccaggtaccagcctcatgctccccttccggtttggtagtggaggcggggacaaaggccctgtagtggccgcgcaggaagcccaagcccaagctatactgcagcaagccaggctggcactccgaggtccacctgggcctatggggtacacaggccgccccggccccctcggacaacctggatcgcctgggctcaagggggagtctggggacctgggaccccagggacccagggggccacagggacttaccggcccgcctggaaaagcaggaagacgtgggagagccggcgccgacggcgccaggggaatgccaggggaccccggggttaaaggggacagaggcttcgacggcctgcctggattaccgggggaaaaagggcatcgaggcgataccggcgcccaagggctccccggtccaccaggggaggatggcgagcggggggatgatggcgagattgggccacgcggtctgcctggtgagagtggtcccagaggcctactgggccccaaggggccacccggaatacctgggccacctggtgtgagaggaatggacggaccccaaggacctaaaggtagcctgggaccccagggtgagccgggcccaccaggacagcagggtacacctggtacccaggggctccctggaccgcagggcgcgatcggcccccacggcgagaaagggcctcaaggcaagcccgggctgcctggaatgcctgggtcagacggaccaccagggcatcccggaaaggagggacctccagggacaaagggaaatcagggaccctcgggccctcaagggcctctaggctaccctggccctcgtggggtaaaaggcgttgacggtatcaggggtttgaaagggcataaaggagaaaaaggtgaagatggctttcctgggtttaagggcgacattggcgttaaaggagatcgcggggaagtgggcgtgcctgggagccggggagaagacgggcccgaaggtcctaaaggaaggactggccctacaggggaccctggcccaccggggctcatgggagaaaagggaaaactcggtgtgcctgggctgccggggtatccaggccggcaaggcccgaagggttccttgggattccctggatttcccggagctagcggcgagaaaggcgcccggggactgtctggcaaaagcggccctagaggcgaaagaggcccaactggtcctcggggtcagcggggccctaggggggccactggtaagagcggtgcaaagggcacgtccggcggtgacgggcctcatggcccccctggggagagaggactccctggtccccagggccctaacgggtttcctgggcctaaaggtccactagggccacccggcaaggacggtctgcccggtcacccagggcaacggggcgaggtgggattccaaggaaagacgggccctccgggtccgccaggagtcgtgggtccgcaaggagcagcaggcgaaacaggtccaatgggcgagagggggcaccccggtcctccaggcccacctggcgaacagggcctgcccggcactgcaggcaaagagggcacaaagggcgatcccggcccaccaggcgcacctggtaaagatgggccagcgggacttaggggtttccctggggagaggggtctccctggcactgctggtggaccagggctaaagggtaacgaaggaccatctggccccccgggcccggccggctctcccggggagcgcggcgcggctgggagcggaggacccatcggaccccctgggcggcccgggccacaagggccccccggcgccgcaggtgagaagggagtcccaggtgaaaaaggccccataggtccgacgggcagagatggggtgcaaggcccagtgggcctcccaggccccgccggccctcccggagtggctggtgaagacggagataagggagaagtcggcgacccggggcaaaagggcactaaaggcaataaaggggagcacgggccccccggtcccccagggcctattggccccgtaggccagcccggagcagctggcgcggatggcgaacctggggccagggggcctcagggtcatttcggcgccaagggagatgaagggactagaggattcaatgggccccccgggccaattggacttcaaggtctcccggggccatctggtgagaaaggagagaccggtgatgtgggccccatggggccacctggccctcccggtccacgcgggccggctgggcctaatggggcagatggtcctcaaggcccgcccggtggggttggtaatctcggaccccccggtgaaaagggcgaacccggggagagtggcagccccggcatccaaggtgagcccggagtcaaggggccaagaggtgagaggggcgagaagggggagagtgggcagcccggcgagccaggaccaccaggtcccaaagggcccacgggggatgatggtcctaaggggaatccagggcccgtcggtttcccaggcgatcccgggccaccgggtgaaggcggcccccgcggacaggatggtgctaaaggcgaccgcggggaagatggagaaccgggacagcccgggtctccgggtcctacgggagagaacggcccgcctggacccctggggaagcgaggtccagctggctccccagggagtgagggtcgtcaaggggggaagggagccaaaggagatcctggtgccatcggagctccgggcaagaccggcccagtcggacctgccggccccgccggcaagcctggccctgatggccttcgcggtctgccgggctcggtcggtcagcaaggtagacctggagccacaggccaggcaggccctccagggcctgtgggcccacctggcttgccggggctaaggggcgatgcgggtgctaagggcgagaaggggcaccccggtttgattgggctgataggacctccaggcgagcaaggggagaaaggcgaccgcgggctgccaggcccacaggggtctcctggccagaaaggtgaaatgggtattcctggagcgagcggccccatcgggccgggggggcctccgggcttgccaggacctgccggcccaaagggtgctaaaggcgccaccggaccagggggacccaagggggagaagggcgtgcagggccctccgggtcacccaggcccaccaggggaggtgattcagcctctgcccattcaaatgcccaaaaagacgcgacgctctgtagacgggtcacggttgatgcaggaagacgaggccattcccacagggggcgccccgggatctccaggaggcctcgaggagatctttggctctctggattctctgagagaagaaattgagcaaatgaggcggccaactggcactcaagattcaccagctcgtacctgtcaggacttgaagctttgccatcctgaattacccgacggcgagtattgggtggatcccaaccagggatgcgctcgagatgcattccgggttttttgtaatttcactgctgggggagaaacatgcgtgaccccaagggatgatgttacgcaattttcatacgttgatagcgaaggctcaccagtcggagtcgtgcagcttactttcttgaggcttctatcggtgtctgctcatcaggatgtctcctacccatgctctggtgcagccagagacggccctctgcggctccgcggcgccaatgaggatgagctgtctcccgaaacttccccctatgtgaaggaattcagggatgggtgccaaacacagcagggaaggactgtgctcgaggtgcggacccctgtgctggagcaacttccagttctggatgcttctttctctgacttgggcgcacctcctaggcgcggcggcgtcctccttggaccagtctgttttatgggctag

SEQ ID NO: 2587 - DNA, 4890 bp, Artificial Sequence
  Description of Artificial Sequence: Synthetic coding sequence
atggaaagatgcagcagatgtcataggctgctgctgcttctgcccctggtgctgggacttagcgccgcgccagggtgggccggggccccacctgtggacgtgctcagagccctgagattcccatccttgcctgacggcgtccgacgggcaaagggcatttgtccagccgatgtggcctaccgcgtggcgcgacccgcccagttgtcagccccaactaggcaactgttcccaggaggatttcctaaagattttagtcttcttactgtcgtacgaacccggccaggcctgcaggcacctctgttaacgctttactccgctcagggggtgagacagctgggcctggaacttgggaggccagttaggtttctgtacgaggaccaaacaggccgcccccagccgcccagtcagcctgtgtttagaggtttgtccctagccgatgggaaatggcatagggtcgccgttgccgttaagggccagtctgtgacacttatcgtggactgcaaaaaacgcgtgaccagacctctcccccgctcagcacggccagttttggatacgcacggcgtaattatatttggggctcgcatcctggatgaagaggtcttcgagggagacgtccaagagctcgccattgtgccaggcgtccaggccgcgtatgagtcatgcgagcagaaggaactggaatgtgagggagggcagcgcgagcgacctcagaatcagcagccacatcgagcccagcggtctccacaacagcagcccagtagattgcatcgaccacaaaaccaggaaccccagtcccaggctgctcacggtccccgcggcctgaaaggcgagaagggggaaccggctgtcctggagcctggaatgttggtcgaaggccctccaggaccagaaggtccagccggtctgattggcccgcctggaatccaaggaaatccaggacccgttggtgaccctggcgaacggggcccaccaggtcgggccggtcttccggggagcgacggcgcccctggccctcctggcacatccctcatgctgccattccggttcggaagcggaggaggcgataaagggccggtggtcgccgcccaggaagctcaggctcaggcaatcctgcagcaggcacgtctggccctgcgaggccctcctgggcctatgggatataccgggcgccccggtcctctgggacagccaggctccccggggcttaagggcgagtcgggggatctgggccctcagggccctaggggtccgcagggcctcacagggcctcctggaaaagccggcaggcggggaagagcgggcgccgatggcgccaggggcatgcccggcgaccctggggtgaaaggtgacaggggattcgacggactgcctggactgccaggtgagaaaggccatagaggtgacacaggggcccaaggcctgcctggaccaccgggggaggatggcgagaggggagatgatggagagattggacctcgtggtctgccgggggaatcaggccctcgcgggttattaggcccaaagggaccccccggtattccaggcccgccaggcgtacgcgggatggatggaccgcagggtcccaaaggatctcttgggcctcagggggaacctggaccccccgggcagcaggggacaccagggactcagggccttcctggaccacaaggggccatcgggccacatggcgaaaaaggcccacagggtaagcccggtctccccggcatgccagggtccgacggcccccccggccacccaggcaaagaaggaccacccggaactaagggcaatcagggcccatctggacctcagggcccgttgggataccctgggccaagaggcgtgaagggagtcgatggaatcagaggactgaagggacacaagggcgagaagggagaagacggattccccgggttcaagggcgatattggcgtaaaaggcgaccgtggcgaagtgggcgtgcctggtagcagaggagaagatggaccagaagggccgaaggggcggaccggcccgaccggcgatcctggacctccagggctgatgggggaaaagggcaaactgggcgtgcccgggctaccaggttatccagggcgtcagggccctaaaggaagcttgggattccccggattcccgggagcgagcggtgagaaaggggcccgtggactgagcggaaagtcagggcctcggggcgagcgaggtccaaccggaccgcggggtcagaggggcccacgcggggcgaccggtaaaagcggggccaaaggaacatctgggggagacgggccacatgggcccccaggagaacggggcctcccaggaccccaaggcccaaatggctttcctggcccaaaaggccctcccggcccgccagggaaagacggtcttccaggccaccctggacagcgaggagaagttggtttccagggcaagaccggcccaccaggccctcctggtgttgtgggcccccagggagctgccggtgagacaggcccaatgggggagcgcggacatccggggcccccaggcccacctggtgagcagggattgcccggtaccgcaggaaaagagggtaccaaaggcgaccccggaccccctggggcgcccggcaaagatggacccgccggactgagaggtttcccaggagagcgcggactgcccgggaccgccgggggtccggggttgaaaggaaatgagggcccctccggaccccctgggcccgctgggtccccaggggagagaggagccgccggaagcggaggaccaattgggcctcccggtcgacctggcccccaagggcccccaggcgcggctggggagaaaggagtgccaggcgagaagggaccgatcggtcctactggcagagacggcgtgcaaggcccagttggcttgccaggcccggctggccctcctggagtggccggagaggacggtgataaaggggaggtgggggatcccggtcagaagggcactaaggggaacaagggagagcatggcccccccggcccccctggtcccataggcccagttgggcaaccaggggccgcaggcgccgatggggaacccggagctcgtggcccccagggccactttggcgcaaagggagatgagggcacgcgaggcttcaatggcccccccggacctattgggctgcagggtctccctgggccttcaggggaaaagggggagactggcgacgtcggccccatggggccacctgggcctcccggcccccgcggcccagccggccctaacggggccgatggacctcagggtccacctggaggagtggggaacctgggtccacccggggaaaagggtgagccaggagagtcagggagtccaggaattcagggagaaccaggcgtgaaaggcccaaggggagagagaggagaaaagggggagtcagggcagccaggggagccaggacctccaggccctaagggtccgacaggcgacgatggtccaaaaggcaatcctggccctgtggggtttcctggtgaccccggtcctccgggggagggaggccctagaggacaggatggagcaaaaggggatcgcggcgaagacggggaaccaggccagcccggtagccccggacccacaggtgaaaatggcccccccgggccgctgggcaaaaggggtcccgctgggagtcccggttcggaggggcggcagggaggaaagggggcaaagggagaccctggtgcgattggtgcgcccggaaagacgggacctgtgggtccagccggcccagctggaaagcctggacccgacgggcttcggggactccctggcagtgtgggacagcaggggcgtccaggtgccaccggacaggcagggccgcccggccccgtcggcccccctggactgccgggtttgcgaggagacgcgggagccaagggcgaaaaagggcatcctggcctgatcggactcatcgggcctcctggagagcagggagagaaaggtgaccggggactcccaggacctcaggggtctccaggccagaagggtgagatgggtatacctggagcttccggtcccatagggcctggcgggccccccggcctgcccggccctgccggccccaaaggagctaaaggcgctacaggaccaggaggccctaagggggaaaagggcgtgcaggggcctccgggacatcccgggccacccggtgaagtcatccagccactccctattcagatgcccaagaagactcgccggtccgtggatgggtcccgactgatgcaggaagatgaagccattcctacgggaggcgccccaggcagccccggcgggctggaagaaatcttcggaagcctggatagcttgagagaagagatcgaacaaatgcgccgacctactgggacccaggacagccccgcgcgcacatgtcaggaccttaaattgtgtcatccagaactgccagatggcgagtattgggttgaccctaaccaaggttgtgcgcgggatgcgttcagagtgttctgtaactttacagccggtggcgagacatgtgtcacaccccgggatgatgtgactcagttttcctatgtcgattcggaaggcagcccagtcggtgtggtacagttaacattcctgaggctcctctctgtgtctgcccaccaggatgtgtcctacccatgctctggggccgcgcgcgacgggcccctgcgtctgcggggggccaacgaagacgaactgtcaccagaaacttcgccttacgttaaggagtttcgggacggatgccagacgcagcagggtcggacggtgctggaagtcaggaccccagtcttggaacagctccccgtgttagacgcttcattctcagacttgggagcaccacctcgtagaggcggtgtccttttagggcctgtgtgtttcatgggttag

SEQ ID NO: 2588 - DNA, 5211 bp, Artificial Sequence
  Description of Artificial Sequence: Synthetic coding sequence
atggagagatgcagtagatgccaccgactgttgctgctcttgcccctcgtgctgggccttagcgccgcacccgggtgggctggcgccccaccagtggacgttttgcgcgctttgcggttcccctctctgccggatggggtgcgccgggccaaggggatctgtcccgcggatgtggcctaccgcgttgccagacctgctcagctgagcgcccctacccggcagctgttccccgggggctttccaaaagacttttccctgctgactgtcgtccgcacacgaccaggcctacaagctccacttctcaccctatacagtgcacagggagtgcgccagctgggcttagagctcggcagacccgtgcgctttctgtacgaggaccagaccggccggccccaacctccgtcccaaccagtctttcggggtttgtccttagccgacggtaagtggcaccgggtggccgtggccgtcaaggggcagagtgttactctgattgtggactgcaagaaaagggtgacccggcctcttccaagatctgcgcgcccagtcctggatacacatggggtcataatctttggcgcccggatactcgatgaagaggttttcgagggtgacgtacaggaactcgccatagtgcccggtgtgcaggcagcctatgaaagctgcgaacagaaagaactggaatgtgagggcggccaacgtgagagacctcagaaccagcagccccaccgggcacagcggagcccacaacagcaaccttcacgactccatcggcctcagaatcaggaaccgcaatcgcaacccactgaatctctgtactacgactacgaacctccctactacgatgtgatgaccacaggaactacaccggactatcaggatccgactcccggggaggaagaagagattctagagagcagtctgttgcctccgttggaggaggagcaaactgatctccaggtacctcccacagctgatcgcttccaggctgaggagtatggagaggggggaaccgatcccccagaaggaccttatgattatacctatggatacggcgacgattacagggaagaaaccgagctggggcctgctttgtcagctgagaccgcccactctggggccgcagcacacgggccgaggggcctcaagggcgagaagggtgagccagccgtcttggagcctggcatgcttgtcgagggaccgccgggtcccgaaggtccggccgggctcatcggcccaccagggatccaggggaaccccgggcctgtgggcgaccctggagaaagggggcctccagggcgtgcgggtctgcccggatccgacggggcccccgggccccctgggacaagccttatgctgcccttcagattcggatcagggggaggcgataaaggccctgtggtggccgcgcaggaagctcaggcacaagcaatcctccagcaggctagactggctctgagaggcccccctggccctatgggctacacgggacgccccggccctcttgggcaacccggcagcccagggctgaagggcgagagtggcgacctcggtccgcaggggccacgagggccacagggtctgactggccccccaggtaaagcagggcgtagggggagagctggagcagacggagctagaggaatgccgggggaccctggggtgaagggtgaccgcgggtttgacggactgccaggcttgcctggggagaaagggcacagaggagacacaggagcacaggggctccccgggccaccgggagaagacggcgagcggggggacgacggtgaaatcggacctcggggattacctggagaatccggacctcgcggacttctcggcccaaaagggcccccggggatccccggccccccaggcgtacgaggcatggacgggccacagggccctaagggctctctcgggccacaaggagagcccggccccccgggtcagcaggggacccccggaacccaggggcttcctggaccacaaggagcgatcgggcctcatggcgagaagggccctcagggcaaacccggtctgcccgggatgcccgggtctgacggtcctcctggtcatcccgggaaagaaggccctccagggactaagggcaatcagggcccttcagggccgcaggggcccttgggctatccgggtccgcgtggcgtcaagggggtcgacggaattcgcgggcttaaggggcacaaaggagagaagggagaagacgggtttccgggattcaaaggcgatatcggcgtgaagggggacagaggagaggttggggtgcccggcagcaggggcgaggatggacctgaagggccaaaggggagaaccggaccaaccggcgatcctgggcctcctggcttgatgggcgagaagggtaagctgggcgtgcccggactccccggatatccagggagacaggggccgaaaggtagccttggcttccccggattccctggagcatctggggagaaaggcgcccgcggcctgagcggcaagtctggaccgcggggggaaaggggcccaactggacccagaggccaacgtggacccagaggcgccactgggaaaagcggcgctaaaggtacatctggtggggatgggccccacggccctcccggcgaaagaggcctgcctgggcctcagggccctaacggcttccctgggccgaaggggccactgggtcccccagggaaagacggcctgcccggacacccgggacagcggggagaagtcggttttcagggcaagacagggccaccaggacctcctggcgtggtcgggcctcagggcgctgccggcgagacgggtcctatgggagaacgcggtcatccaggaccccctggcccgccaggagaacagggactgcccggaaccgccggtaaggagggcacaaaaggggatcccggccccccaggagcccccggcaaggacggaccagcggggcttagggggtttccaggagagagaggcctgccgggcaccgccgggggaccagggctgaaaggcaatgaggggccgtccgggccccctggaccagcgggatctcccggtgaaagaggggccgcaggctcaggcggcccaatcggtcccccaggtcgcccaggccctcagggacctcctggagcggccggcgaaaagggcgttccgggtgaaaaaggtcccatcggcccgactgggcgcgatggtgtgcaggggcccgtaggattaccaggcccagctggcccacccggcgttgctggcgaggacggtgataagggcgaggtgggcgaccccggccagaaggggacaaaaggcaataaaggggagcacggaccccctgggccacctgggccaatcggccccgtcgggcagcctggagccgccggcgcagatggagagcctggggcaagaggaccgcaaggccacttcggagccaaaggcgacgagggaactcgtggcttcaatgggccaccagggcctattgggctccaaggcctgccggggccatcaggggagaagggcgagaccggggatgttggtccaatgggacctcccggacccccaggccctaggggtcccgccggcccaaatggcgctgatgggcctcagggcccccctggcggtgttgggaacttgggcccaccaggcgagaaaggggagccaggagaatcaggtagtcccgggattcagggcgagcctggtgtgaaggggccacgtggtgagcgcggagaaaagggcgagtctgggcagcccggggagcctgggcctccaggccccaaaggtcccaccggagacgatgggcccaaagggaatcccggtccagttggatttccaggggatccaggacctcctggcgagggcgggccaagaggccaggatggagcaaagggagaccggggcgaggacggcgagccaggccagcccggttcacctggacctacaggagagaacggacctcctggcccactgggaaaacgcgggcccgccggaagccccgggtccgagggccgtcagggtggcaagggagcaaagggcgaccccggcgctatcggtgccccgggcaaaacaggacctgttgggccggccggcccggccgggaaacccggccccgatggactgcgtggactcccaggatcagtgggtcaacagggaaggcccggtgcgaccggccaggcaggcccgcccggtccagttggaccccctggtttgccaggactgaggggggatgccggcgccaagggtgaaaagggacacccagggctgatcggactcatcgggccccccggggaacagggagagaagggtgaccgcggtctgccaggccctcaaggctcacccggccagaagggtgaaatggggatccctggcgctagcggacctatcggacctgggggtccacctggtctcccagggcccgccggcccgaaaggagcaaagggggcaacagggcccggaggtcctaaaggcgagaagggtgttcagggtcctcctggccacccaggccctccaggagaggttatccagcctctccccatccagatgcctaaaaaaaccagacggtctgtggacggtagtagactaatgcaagaagacgaggctataccgaccggaggggctcccggaagcccaggcgggctggaagagatcttcggatcactagattcacttagagaggaaattgaacagatgaggcgcccaaccggaacacaggattccccggccaggacctgtcaggacctcaaactctgtcatcccgaactacctgacggagagtactgggtcgatccaaatcagggttgcgcccgcgacgcctttcgggtgttttgcaacttcactgcggggggcgagacgtgcgtgacccctcgagatgacgtgactcagttttcctacgtcgattcggaaggatcccctgtgggagtagtgcaactgacgtttctcagactcctgtccgtgtcggctcaccaggacgtgagctatccatgcagcggtgccgcaagggatggaccccttaggttgcgaggagctaatgaagatgaactcagtccagaaacttccccctacgtgaaggaatttagggatgggtgtcaaactcagcagggtcggactgtgctggaagttagaaccccggttctggaacagctacctgtcctagacgcttccttctccgatctaggggctccgccccgtcgcggaggggtattattgggacctgtgtgttttatgggttag

SEQ ID NO: 2589 - DNA, 5211 bp, Artificial Sequence
  Description of Artificial Sequence: Synthetic coding sequence
atggagcggtgtagcaggtgtcacaggctcttactcctgctccccctggtgctggggctgtccgcggctccaggttgggctggcgcgccgcctgtggacgtgttgcgggctttgcggttcccctcgcttcccgatggggtaaggagagctaaggggatctgccctgcagatgtggcatatcgagtggcccgacccgcccagctcagcgctccaacgaggcagttatttcctggcggcttcccgaaagacttctctcttctaactgttgttcgcacccggccaggacttcaagccccacttctcactttatactccgcccagggcgtccgccagcttgggctggagcttggacggccagtgcggtttctgtacgaggatcagaccggacggcctcaacctccctcccagcctgtgtttcggggactgtccctggccgacggaaaatggcacagagtggctgtggcggtgaaaggccagagcgtgaccctgattgtggactgcaagaagagagtcacccggcccctcccaagatccgcccggccagtgctggacacacatggggtgatcatcttcggggcacggatcttagacgaggaggtctttgagggtgatgtgcaagaactggctatcgtgcccggagtgcaggccgcatacgagtcatgtgagcagaaagagcttgaatgcgaggggggtcagagagagcggccgcagaatcagcagccacatcgggcacagcgcagccctcagcagcagccttcacgactgcacagaccacagaatcaggagccacaaagccagccaacagagtcgctctactatgattataaacctccctattacgacgtgatgactacaggcacaacccccgattatcaggatcctacacccggagaggaggaagaaatcctggagtccagcctcttgccacccttggaggaggaacaaacagacctgcaagtgccccccactgcggataggtttcaggctgaagagtatggcgaaggaggcacagaccctcccgaggggccttatgactatacatatggatatggcgatgattatcgcgaggaaaccgagctggggcccgcacttagtgccgagaccgctcatagtggtgccgccgcccatggaccccgtgggcttaaaggggagaagggggaaccagccgtattggaacctggcatgttggtggaaggtccgcctggcccagagggtcctgccggcttaatcgggcctccaggaattcaggggaaccccgggcccgtcggggaccctggagaacggggtccgcccggacgagcgggtctgccgggcagcgatggagcccctggtccaccgggcacatctctgatgttgcctttccgctttggcagcggaggaggcgacaaagggcccgtcgtggccgctcaggaggcccaggcccaagcaatcctccagcaagcgcgactggctctgcgggggccccctgggcccatgggctataccggcagacctggcccgctggggcagcctgggagccctgggcttaagggagaatcgggcgacctgggcccacaagggcctagaggaccccagggccttaccgggcccccgggtaaggctgggagaaggggtcgcgccggcgctgacggagctcgcggaatgcccggagatccaggggtgaaaggcgatcgaggctttgatgggctccccggattgcctggcgagaaaggccatcgcggagatactggagcgcagggcttaccgggacccccgggcgaggatggggaaagaggtgacgatggggaaattggcccaaggggattgcccggtgaaagcggcccaagaggtcttctcggacctaagggaccaccggggatcccaggtccgccgggcgtccgtgggatggatggtccccaaggccccaaaggatcattggggccccagggggaacctgggccccctggacagcagggaactcctggcactcagggccttcctggccctcagggcgcaatcgggcctcatggggaaaaagggccccaaggcaaacctggccttcccggcatgccagggtccgacgggcctccgggtcatccaggaaaagaaggtcctccgggtaccaaaggcaaccagggcccttccggcccgcaggggcccctcggctatcccggaccaaggggagtgaaaggagttgacggtattcggggtctgaagggtcataaaggagagaagggcgaggacggctttccgggttttaagggcgatatcggggtgaaaggcgatcgtggtgaggtgggggtgccaggatccaggggtgaggatggtccagaaggacccaaagggaggaccggaccaactggggaccctggaccacctggcctgatgggagaaaagggtaaattaggggtgcctggcctcccaggatacccagggcggcagggtcccaaggggagcctgggcttccccgggtttccgggtgcatccggagaaaagggcgccagaggcctgagcggcaagtccggtcccaggggggagagagggccaaccgggcccaggggccaacggggccctcgcggggctacgggcaagtccggcgctaaaggaacatctgggggcgacggtccacatggcccaccaggcgaacgcggattgccagggccacagggcccgaatgggttcccaggaccaaaaggccctcccggcccaccgggcaaggacggactgccagggcacccaggacagagaggtgaagtggggttccagggaaaaacagggccacccggcccgccaggtgtggtggggccacagggtgctgccggagagacaggtcctatgggtgagcgcggtcacccgggtccacctggccccccaggcgagcaggggctgccgggtaccgccggaaaggaaggcaccaagggcgatccgggcccaccaggcgctcccggaaaagatggacctgccggccttcgaggcttcccaggagaacgcggactacccggcaccgctggtggtcctggacttaagggtaacgagggtccttccggaccccccggaccggcaggatcccccggagagcggggcgctgctgggtcaggcgggcctatcggtccccccggaagacccggacctcaggggcctcccggtgcagctggggagaaaggtgtgccaggcgagaagggcccaattggtcctactgggcgggatggggtgcagggacccgtgggtctcccagggcccgccggaccccctggcgtggctggggaggacggcgacaagggagaagtcggagacccaggacaaaagggaactaaaggcaacaaaggagagcatggccctcctggtcctcctggcccgatcggcccagttgggcaacctggcgcagctggggccgacggggagcctggagctcggggaccacagggtcattttggagctaagggggatgagggaacacgaggcttcaacgggcctcccggtcctattggcctccagggcttgcctggcccttccggggaaaagggcgaaacaggcgatgtgggacccatgggtcctccagggcccccgggacctagaggcccggcaggacccaacggcgccgacggcccccagggcccgccggggggagtcggcaacttgggaccccctggagagaagggagagcccggggagtccggtagtcccggaattcaaggcgagcccggggtaaagggacctagaggagagaggggggagaagggggaaagcggccaaccaggcgagccaggcccacccggtccaaagggccccaccggggacgatggaccaaaaggcaaccctggacccgtagggttcccaggtgaccccggacccccaggcgagggaggtccaaggggccaggacggtgcgaagggcgataggggcgaagacggggagcctgggcaacccgggtcccctggccctacaggagaaaacggaccacctggcccactggggaagaggggacctgctgggagccccggctccgagggtcgccaaggaggaaagggcgctaagggagaccccggggcgattggggcccccggtaaaacaggcccagtggggccggctgggcccgcgggcaagcctggtccggacggccttagaggcctgcctggaagtgtcggacagcaaggcaggcctggtgccacaggccaggctgggcctccggggcccgttgggcctccaggcctcccaggccttagaggagacgctggcgctaaaggagaaaaagggcacccagggctcatagggctgatcggccctcctggcgagcagggcgagaaaggggatagggggctgccgggccctcaagggagccccggtcagaaaggcgagatgggcattcccggcgcctccgggcctatcgggcccggcgggccgcccgggctacccggaccagctggcccgaaaggtgccaaaggagcaaccgggccaggcggcccgaagggcgagaagggtgtccaggggccacctggacaccccgggccaccaggtgaagtgatacagcctcttcccatccagatgccaaaaaaaacgagaagaagcgtagatggctcgcgcctgatgcaggaggacgaggccatacccactggaggcgccccaggatcgcccgggggactggaggaaatattcgggtccctagattcccttcgcgaagagattgagcagatgagacgccccacaggaacacaggattctcccgctcgcacctgccaggacctgaagctctgccatccggaattaccagatggggaatactgggttgaccctaaccagggctgcgccagggacgcgtttcgagtcttctgtaacttcacagccggtggcgaaacttgcgtaacccccagggacgacgtgacgcagttttcgtatgtcgactcagagggatctcctgtgggggtggtgcagctgactttcttgcgcctcctgtcagtgtccgcacaccaggatgtgtcatatccgtgcagtggagctgctagagacggacctctgcgacttaggggcgcgaacgaggacgagctgagtcccgagacaagcccctacgtgaaggagtttcgcgacggctgtcagacacaacagggcaggactgtgctcgaggtgagaacgccagttcttgagcagcttcctgtcctagatgcctccttcagtgacctcggtgcgcccccacgcagagggggcgtgctgttaggacccgtttgctttatgggttag

SEQ ID NO: 2590 - DNA, 5211 bp, Artificial Sequence
  Description of Artificial Sequence: Synthetic coding sequence
atggaacggtgctctagatgccatagacttctcctcctgctaccgctggttctcggcttatctgccgctccgggctgggctggtgccccaccagtcgacgtcctcagagccctgcgcttcccatcactgccagacggcgtaagaagggccaaaggaatctgccccgccgatgtcgcttacagagtggcgaggccggctcaactgtcagcccccacgagacagcttttccccgggggttttcctaaggatttcagtctcctcaccgttgtcaggacaagacccgggctgcaggcaccactgctcactctgtacagcgcccagggtgtgagacaattggggttggagctgggtcgacccgtgaggttcttatacgaagatcaaactggccgcccccagcccccctcccagcccgtattccgtggcctgtcgcttgccgacggcaagtggcaccgggttgccgtggctgttaaaggacagagcgtcacactaatcgtagactgcaagaaaagagttacacggccgcttcccagatccgctcgcccagtgctcgatactcacggagtcataattttcggggctcgcattttagatgaggaggtctttgaaggtgacgtgcaggagctggcaatcgttcccggcgtgcaggccgcctacgaatcatgcgaacagaaagaactggaatgtgaaggagggcagagagaaagaccccagaaccagcagccacatcgtgcccagagaagcccgcaacagcagccatccagactgcaccgccctcagaaccaggaacctcaatcccagcctactgagagtctctattacgactataagcccccatattacgatgtgatgacaacaggcactactccagattatcaggaccctacacccggcgaggaggaagaaatactggaatctagcctgctcccgcctctcgaggaagaacagaccgacctgcaggtaccccctactgccgatcggttccaggcggaggagtacggcgagggcgggactgaccccccagagggaccttacgattatacatacggctatggcgatgactatagggaagagacagagctggggcctgctctgtcagcggagaccgcccatagcggggccgctgcccacggaccacgaggactgaagggtgagaaaggcgagccagccgtcctcgagcccggtatgctggtggaaggacccccggggcctgaggggcctgccggtctgatcgggccccccggaattcagggcaatccaggaccagtgggagatccgggcgaaagagggccacctgggcgggcggggctgccagggtcagatggggcccccgggccacctggcacttccttgatgctgccattcaggtttggaagtggaggcggtgacaaggggcccgtcgtggctgcccaggaggcacaggcacaagctatactccagcaagctagacttgcactgagaggcccaccagggcctatgggttacacaggcaggcccgggccactggggcagcccggctcaccggggctcaagggcgagagtggtgatcttggcccacaggggccccgggggcctcagggcctcactggaccacccggcaaggccgggcggcgaggacgcgctggagccgacggagcacgggggatgcccggggaccctggagtgaagggcgatcgcggatttgatgggctccccgggctccccggagagaaaggccatcgtggtgataccggagctcaagggctgcccgggcctcccggggaggacggggaacggggtgatgacggggaaataggccctaggggcctccccggcgagtcagggcctaggggtcttctcggccccaaaggccccccaggcattccaggacccccaggcgtcagaggcatggacggacctcaggggccgaagggatccctgggaccacagggggaacccggccccccaggtcagcaggggacccctgggacgcagggactcccgggcccacagggtgctatcggcccgcatggggagaaaggcccacaaggcaaacctggattgcccggcatgccggggtccgatgggccgcctgggcaccccggcaaggaaggtccccctggcaccaagggcaatcagggcccttccggaccacaaggcccactggggtaccccgggcccaggggagtgaagggggtggatggtatcagaggactcaaagggcataaaggcgaaaaaggagaggacgggttccctggatttaagggggatatcggtgtcaaaggtgatagaggggaggtgggagtgcccggaagccgaggtgaagatgggccagaaggccctaagggccgtaccggacccacaggcgatccagggcctcctggattgatgggagaaaaaggcaaactgggagtccccggcttacccggctaccctgggagacaaggacctaagggctcactggggttcccggggtttccgggggcctcgggggagaagggcgcaagggggctgagcgggaaaagtggccctcgcggagagcgtggaccgaccgggccccgcggtcagagaggcccacgcggtgctactggcaagtcaggggcaaaaggtacctcaggtggggatggtcctcacggcccccctggagagcgcggactgcccgggcctcagggccctaacggcttccccgggcccaaaggtccgcccgggccccctggcaaagatgggttaccgggacacccagggcaacggggcgaggtgggcttccaaggcaaaacaggccccccagggccaccgggggtcgttggtccacagggggcagctggagagacaggccccatgggggaacgcggtcatcccgggcctcctgggccacccggtgagcagggcctgccggggaccgctggtaaggagggcacaaagggggaccctggtcctccaggtgcgcctggcaaggacgggcctgccggtctgcggggctttccaggagaacgaggacttccgggtacagccggaggaccaggcttaaagggcaacgagggccccagcggccctcctggacctgcaggaagcccgggagagaggggagctgccggctcaggtgggccgatcggcccccctggccgaccagggccccagggccctccgggcgctgcaggcgagaaaggcgtccctggcgagaaagggccaatagggcctacagggagggacggggtgcagggcccagtgggactacccggccccgcagggccccccggggtcgctggggaggacggagacaaaggggaggttggggacccaggtcagaaaggcactaaaggaaataagggcgagcacggcccacctggacccccgggccccattggacctgtgggtcaaccaggtgccgccggcgccgatggcgaacctggagcacggggaccacagggccatttcggagctaaaggagatgagggaacgcgtggtttcaatggccctccagggcccatcgggcttcagggtttgcccggtccctccggcgagaaaggcgaaactggggacgtcgggccaatgggtcctccagggcctcctggcccaaggggccccgccggacccaacggcgctgacggccctcagggcccacccggaggggtgggaaatctgggaccccctggcgagaagggcgagcctggcgaatcaggctcccctggtatacagggggagcctggagtaaagggtcccaggggcgagcgaggcgaaaaaggggaatccggccaaccaggtgaacccggccctcccggccccaaaggtcctacgggggatgatggcccaaaagggaacccaggcccagtaggtttccccggggatcctggcccccctggtgaagggggcccgcgcggccaagacggcgccaaaggtgatcggggagaggacggcgagcccggtcaacctgggagtccaggccccaccggcgaaaatgggcctccaggccctctgggtaagcgaggccccgctggctctcctggttccgaagggcgccagggtggcaagggagccaaaggcgatcctggcgctataggggccccagggaagacagggccagtgggcccggcagggccggcaggcaagcctggtcctgacggactccggggccttcctggcagcgtggggcagcagggaaggcctggcgccaccggtcaggcaggccctcccgggcccgtaggcccgccaggcctccccggcctgaggggagatgccggtgccaaaggtgagaagggacaccccggactgatagggctaattgggcccccaggtgagcagggggaaaagggtgatagagggctccccggtccacagggcagccctgggcaaaagggagagatggggatacctggagccagcggtcccatcggccccgggggccccccaggcctcccgggacctgccggcccaaagggcgctaagggggccactgggcctggcgggccaaaaggcgagaaaggagtgcaggggcctcccggtcacccaggcccccccggcgaagtgatacagccccttcccattcagatgccaaagaaaaccagaagatcggttgatggatctaggcttatgcaggaggatgaggccattcccacaggaggagcacctggttcacccgggggactggaggaaatttttggctccctggattcgctgcgcgaggagatcgagcagatgaggcggcctacagggacccaagacagccccgccagaacctgtcaggatctcaagctatgtcatccggaactgcctgacggcgaatactgggtggatccgaatcagggttgtgccagagatgcttttcgcgttttctgcaactttacagccggcggcgagacctgcgtcactcctcgggatgacgtcacacagttcagctacgttgatagtgagggttccccagtcggagtcgtgcaactaaccttcctccggctgttatctgtttcggcgcaccaagacgtgtcatacccatgcagtggggctgcacgggacggaccgctgcgactgcggggagccaacgaggacgagctgtcaccagaaacctcaccctatgtgaaggagttcagggatggttgccaaacacaacaggggaggacggtgctggaagtgaggacaccagtattagagcagctgcctgtgctggatgcgagtttcagtgatctcggcgcccctccgcggcgaggtggcgtgttgctggggcctgtctgcttcatgggctag

SEQ ID NO: 2591 - DNA, 5070 bp, Artificial Sequence
  Description of Artificial Sequence: Synthetic coding sequence
atggagaggtgtagccgctgccatcgactgctgctgcttctgcctctggtcctcgggttgtccgcagcccccgggtgggccggggccccacctgtggatgtattacgcgctttacgtttcccgtcattgccggacggcgttagacgcgcaaaagggatttgccctgccgatgttgcttaccgggtcgcaaggcccgcccagttaagcgctcccaccaggcagctctttccaggtggcttccctaaagatttctcccttctgactgtggtacggactaggcccggcttgcaggcccccctcctcacactctacagtgcacaaggggtccgccagctgggtctggagctaggtagaccagttagatttttgtacgaggaccagaccgggcgacctcagcctccttctcagcccgtattcagggggctgagcttagctgatgggaagtggcatcgagttgctgtagcagtcaaaggccagagcgtgacacttatcgtagactgcaaaaagagagtgactagaccactgccccggagcgcccggcccgtgctcgacacgcacggcgtgatcatattcggggcaaggatcttggatgaagaagttttcgaaggggacgtgcaggaactggcaatcgtgcctggcgtacaggcagcgtacgagagctgtgaacaaaaggagctggaatgtgagggaggccaacgcgaacgcccacagaaccagcagcctcatcgcgctcagcgctctccgcaacaacagccaagcaggctgcacagaccccagaatcaggaacctcagtctcaggaacaaaccgaccttcaggtgccacccacagctgacaggttccaggcggaggaatatggcgaggggggaactgatcccccggagggcccttatgattatacttacggttatggagacgattaccgggaagagactgagctaggaccagccctgagcgctgagacggcccactctggggccgccgctcacggccccaggggccttaaaggcgagaagggcgagcccgctgtgctggaacctggcatgctggtggagggcccgccgggtccagaaggtccagcaggactcatagggccacccggtattcaggggaatccaggtcctgtgggggatcccggcgagaggggcccccctggccgggccggcttgccgggtagcgacggcgcccctggcccccccggaacctctctgatgctgccatttagattcggctctgggggcggcgacaagggccctgttgtcgccgcccaggaagcgcaggctcaggctattcttcaacaggctcgccttgcacttcgggggccaccagggccaatggggtataccggtcgccccggcccgctgggccagcctgggtcaccaggcctgaagggagagtctggtgatctgggaccccagggcccccgcggtcctcagggccttacgggacctcccggcaaggccggccgccgggggagggctggggccgatggggccaggggcatgcctggtgacccaggggtgaagggtgacagagggtttgatggcttacctggtctgccgggagaaaagggccacaggggcgatacgggagcccagggcctgcccggacctcccggggaggatggggagcggggagatgacggagagatcggaccgcgcggcctgcccggcgaaagcggaccacggggactgcttgggcctaaaggccctccagggatccctggaccgcccggcgtcaggggtatggacggaccccagggccctaagggcagtctgggacctcagggggagccaggcccacctgggcagcagggtacaccaggaacccaggggttgccagggccccagggcgccattggcccccatggggaaaagggtccacagggcaagcccggtcttccagggatgccaggttcggacggcccacccggccatccagggaaagaagggccacccgggactaaaggaaaccagggaccctcaggccctcagggtccgctgggatatcctggacctaggggcgtgaagggggtagacggaatccgaggcttaaagggtcacaaaggcgaaaagggcgaagacgggttccccgggtttaagggcgacatcggagtcaagggggaccgcggcgaagtgggagtccctggcagtcgtggcgaagacgggcctgaaggccccaaaggtcgcaccgggcctaccggtgaccccggcccgccggggctgatgggggagaaaggaaagctgggcgtacccggtctccctggttaccccgggcgacagggcccaaagggatccctgggatttccaggtttccccggggcatctggagagaagggggcgcgggggctctctggcaagagcggcccacgcggcgaaaggggtcctacgggtccccgcggccagcgtggcccaaggggagcaacaggaaagtccggagctaaggggaccagcggaggagatggtccccacggacccccaggcgagcgtggattaccaggccctcagggacctaacggctttccagggcctaaggggccacctgggccaccaggcaaagacggattgcctggccacccgggacagagaggtgaggtaggatttcaaggaaagaccggtcctccagggcctccaggcgttgttggcccccagggcgctgcaggtgaaactggcccaatgggcgagagaggacaccccgggccgcctggcccccctggagagcaaggtttacctggaaccgcggggaaagaaggtactaaaggggacccaggacctcccggcgctccaggcaaagacggcccagcagggctgagaggatttccaggcgaacgaggtctgccaggaacagccggcggacccggactgaagggtaacgaaggccccagtgggcctcccggcccagccggttcaccaggcgagaggggcgccgccggatcaggcggcccaattggccctcctggacgtccagggccccagggcccgccgggggccgctggagagaaaggcgtcccaggcgaaaagggccccatcggtcctacaggacgcgatggtgtgcagggaccggtagggctgccaggccccgctggcccgcctggcgtggcaggagaagatggtgacaagggagaggtgggtgatccgggacagaagggaactaaaggaaataagggcgagcacggccctccgggaccacccggaccaattggcccagtggggcagccaggcgctgcaggcgccgatggggagcccggtgctcgcggcccacagggacatttcggggcaaagggagatgagggcacccgcgggttcaacggacctcccggcccaattggactgcagggtttgcctggccccagcggcgagaagggcgagaccggggacgtgggacccatgggacccccagggccacccgggccccggggaccagccggccctaatggcgccgacggaccgcagggcccgcctggaggcgttggaaacttgggtccacccggagagaagggggagcccggcgagagcggctcaccgggaatccagggcgaacccggagtcaagggccctcgtggcgaaaggggtgagaagggtgaatccggccaaccaggcgagccagggccccctggtcccaagggacccaccggggacgacggacccaaggggaatcctggccccgtaggcttcccaggagatcctggaccaccaggagagggtggcccccgaggacaggatggggccaagggagaccgaggggaagacggggagccaggtcagccgggcagcccgggccctacaggcgagaatgggccccctgggcccttgggaaaaagaggtcctgcagggagccctgggtcagaaggccgccagggcgggaaaggcgctaaaggagaccctggggcaatcggcgctccagggaagacaggtccagtgggcccagcgggccctgcgggcaagcccggccctgacggcctgaggggattgcccgggtcagtgggccagcagggcagacccggagctaccggccaggcaggtcctccaggtcctgtggggccgcccgggctgccagggctgaggggggatgctggtgcaaagggcgagaaaggtcacccaggcttgatcggcctgattggcccgccaggagaacagggggagaagggagatcgcgggttgcccggcccccaagggtcccctggccagaagggagagatgggcatcccaggggcctcgggccctatcggtcctggaggcccaccaggacttcctggccccgctggccccaagggcgctaaaggcgctaccgggcccggaggcccaaagggcgagaagggcgtccagggtcctccaggtcacccaggcccccctggcgaagttattcaaccgctgcccattcaaatgcctaagaaaacgcgaagatccgtggacggctccagactgatgcaagaagacgaagcaatcccgacaggcggagcacccggctctccagggggcctggaggagatcttcggttcgctcgactcactgagggaggaaattgagcaaatgcgaagacctacaggaactcaagacagtcccgcacgtacttgtcaggaccttaaactgtgccatcccgagctgcccgatggcgaatactgggtagacccgaaccagggatgcgctcgagatgccttcagagtgttctgtaattttaccgcagggggagagacatgcgttaccccacgagatgatgtaacccagttctcttacgttgacagtgagggttctcccgtgggagtggtgcagctcacgtttttacggctgctatccgtctccgcccaccaggatgtctcatatccctgcagcggcgcagcccgcgatggccctctcagactcagaggcgcgaacgaagacgaactctcgcctgagacgtcaccctacgtcaaggagttccgtgatgggtgccagacccaacaggggagaactgtgctcgaggtgcggaccccggttttagagcaactccccgtcttggacgcctcattttctgatctcggagcccctccaaggcgggggggtgtgctcctagggccagtgtgcttcatgggctag

SEQ ID NO: 2592 - DNA, 921 bp, Artificial Sequence
  Description of Artificial Sequence: Synthetic coding sequence
atggattggagagcctctgaggcctggatggtgcctcgcgccccgaaaggagcctgggatccgagagagtctcaggacctccttgacaatcgtgcacctctgggacctcgagtgtttccagggcctcgcgtcccatccgcgctaatggaaagacgagtactgaaggggagccaggggagtcccgcttgcccaggcccgccgggtgaggtgatccagccgctgcctatccagatgcccaaaaaaactcgacgcagcgtagatggcagccgcctaatgcaggaggacgaagccattccaactgggggcgctcccgggagccccggaggtcttgaggaaattttcggatctcttgactcccttcgagaggagattgaacagatgcgcaggcccacggggacccaggacagccctgcaagaacctgtcaagatttgaagctctgtcaccccgaactgcccgatggggagtattgggtggaccctaatcagggctgcgctcgtgatgcttttcgcgttttttgcaatttcacggccgggggcgagacttgtgtgacccctcgtgatgatgtgactcagtttagttatgtggatagtgaggggagccccgtgggggtggtccagctgacctttctgcgcctcctaagcgtctctgcacatcaggacgtctcttatccatgttcaggtgccgcccgcgatgggccactgcgccttaggggggcaaatgaagacgaattgagccccgaaactagcccctacgtgaaggaatttcgggacggttgccaaacccaacaaggacgaaccgtgctggaagttagaactccagtcctggaacagctgccagtgttggacgcctcgttttcggatcttggggccccaccccgcaggggaggggtgctgctcggccctgtgtgttttatgggctag

SEQ ID NO: 2593 - DNA, 5133 bp, Artificial Sequence
  Description of Artificial Sequence: Synthetic coding sequence
atggagcgttgttcgcggtgtcaccgcttacttctccttctaccactcgttctagggttgtccgcagctccgggctgggccggcgcccctccagttgatgtcttaagggcgctcagattccccagcttgccagacggagtcagaagggctaagggcatatgccctgctgatgtcgcttaccgggtggccagaccggcccagttaagcgcccccacaagacaactgtttcctgggggttttcctaaggatttctccctcttaacagtcgtcagaaccagacctggacttcaagcgccactgttgactctatactccgcacagggagtcaggcagctcggcctagaactgggccgcccagtgcgcttcctgtatgaggaccagaccggcaggccacagccccctagccagcctgtcttcaggggcctgagtttagctgatggcaagtggcaccgggtggccgtggccgtgaaggggcaatccgttaccctcatagtcgactgcaagaagcgcgtgacaaggcccctgccgaggagtgccagacctgtcctcgacactcacggcgttatcattttcggcgcgcggatcctggacgaggaagttttcgagggcgacgtgcaggagctggccatagtgcccggtgtccaggccgcatatgaatcatgtgagcagaaggagctagaatgtgaggggggccagcgagagcggccacagaaccagcagccacaccgggcccagcgctccccccaacagcagccgtctcgtctgcaccgcccacaaaaccaggagcctcagagccaggacccaacgccaggtgaggaagaagagatattggagtcgagtcttctaccccctctcgaggaggagcagaccgatctccaagttcccccaaccgctgatcgattccaggctgaggagtacggggagggcggcaccgaccctccagaaggaccttatgactatacctatgggtacggggacgactatagagaagagaccgagttagggcccgcactctccgcagagaccgcacactctggcgccgctgctcacggaccccgaggactcaagggcgaaaagggcgagcccgcggttcttgaaccaggaatgctggtcgagggcccgcctggccccgagggccctgccggtcttataggcccacctgggatccagggaaatcctgggcccgtgggcgatccaggagagagaggacccccaggaagggcgggtctccctggctctgatggggccccaggtccaccaggcacgagcctgatgctccccttccgctttggcagtggcgggggggacaagggtcccgtagtggccgcccaagaggcccaggcccaggccatcctgcagcaggcacgtcttgccttaagggggcccccaggtcccatgggctataccggcagacctggtcccctgggacagccagggtctcccggtctcaaaggcgaatctggggacctgggcccgcagggcccaagggggccacaaggacttactggccctccgggaaaagctggccgccgaggacgcgccggcgctgacggtgcccgtggaatgccgggagatccaggagtgaaaggtgatcggggtttcgacggtctccctggacttccgggcgaaaagggccataggggcgacacgggtgcacagggattgccaggccccccaggcgaggacggggagcgcggcgatgatggagaaattggacctaggggtcttcccggtgaatccggtccacggggtctgttagggcccaaaggtccaccaggtattccagggcctccaggcgtccgggggatggatggaccgcaggggcccaaggggagccttggcccgcagggcgaacccggccctcccggtcaacagggcactcctggcacccaaggactccctggaccccagggcgccatcgggcctcacggagagaaaggtccccagggcaagcctggactgccaggtatgccgggaagcgacgggccaccgggacaccccggcaaggaggggcctcccggcacaaaaggcaatcagggtccatcaggccctcagggaccgctcgggtatcctggcccccgcggggttaagggggtagatgggatccggggactaaaaggacataaaggagagaaaggagaggatggctttcctggatttaagggagacatcggagtcaaaggtgatcgaggagaggtgggagtgccgggcagtcggggagaagatggtcccgaggggcctaaagggcgtacaggcccaacaggcgatccaggcccacctggacttatgggtgagaagggcaagctcggtgtgccagggctgcctggctaccccggccgtcagggccctaagggctcccttggattcccaggcttccccggggccagcggagaaaagggggcacgcggtctgagcggcaagagcgggcctcgcggagaacgcgggcccaccggccccagaggccagaggggacccagaggcgccaccggaaaaagtggcgcgaaagggacgagtggcggagacggcccgcacgggccccctggcgaacgtggacttcccggccctcagggcccaaacgggttccctgggcctaaaggcccacttggtccacctgggaaggacggtctccccgggcatcctgggcagcgtggcgaggtcggttttcagggaaaaaccggtcctccggggccacccggcgtagttgggccgcagggggctgcaggagagaccggccctatgggggagcgtggccaccccggcccacctgggcctccgggtgagcagggactacccgggactgctggcaaggagggcacaaaaggggatccagggcctcccggcgcccccggaaaggatgggccagctggtttgcggggctttcccggcgaaaggggcttgcctggcaccgctggcggacctggcctgaagggcaatgaaggtccttccggtcctcccggacccgccgggagtccaggagaacggggagccgcagggtcagggggcccaataggccccccgggccgaccaggaccccagggtccgccgggcgcagccggggaaaagggggtccctggggagaaaggtccaatcggtccaactggaagagacggagtgcaggggccagtaggactgccgggaccggcgggacccccgggggtagccggcgaagatggagataagggcgaggtgggcgaccccggtcagaagggtacaaaaggaaataagggcgaacatggccctcctgggccgcctggaccgattggccctgtgggccagcccggcgcagccggtgctgacggcgaacccggggcccgtggaccccagggccacttcggcgccaagggagacgagggcacgagaggttttaacgggcccccgggccctatcggtttgcagggattacctggtccgagcggtgaaaagggcgagaccggcgacgtcggacctatgggacccccaggcccccccgggcctagaggaccagctgggccaaacggtgctgatggtccacagggccctcctgggggggtcggcaaccttggtccaccaggtgaaaagggtgaaccgggcgagtctggtagccccgggattcagggcgagccgggcgtgaagggtcctcgcggagaacggggtgagaagggggagagcggacagcccggggaaccggggcctcctggcccaaagggccctaccggagacgacgggcccaagggaaacccagggccagtggggtttccgggagacccaggccccccaggcgaggggggtccacggggacaagatggtgcaaagggggatcggggtgaagatggagaacctgggcagccaggatcacccggacctactggtgaaaacggacctcccggcccattgggcaagaggggcccagccggctcacctggttctgagggaagacaaggaggcaagggggccaagggggatccaggtgcgatcggggcccccggcaagaccggacccgttggtcctgcagggccggccggcaagcccgggccagacggacttcggggcttgccaggttcagtggggcaacaggggcgacccggcgctacaggtcaggctggtcctccaggtccagtcgggccgcctggtcttcccggactacggggtgacgccggggccaaaggggaaaaaggccacccggggctcattgggctgattgggccccctggcgagcagggtgagaaaggggatcgaggactgcctgggccgcaggggtctcctggacagaagggcgagatgggcattcccggtgcatccggaccaatcggccccggagggcctcccgggctgcctggccccgcgggacctaagggggctaaaggcgctactggacctggaggacccaaaggcgaaaaaggagtacagggtccccccggccacccggggcctcctggggaggtgattcagccccttccaattcaaatgccaaaaaagacacgccgttctgttgacggaagcaggctgatgcaagaggacgaagctatacctacgggaggcgcacccggctcacctggcggtttggaggaaattttcgggtccctcgactctctgagagaagagatcgaacagatgcggagacccacaggcacccaggatagtccggcccgcacctgtcaggatctgaagctgtgtcacccagagctccccgacggagagtattgggtggaccctaaccagggttgcgcccgtgacgcttttcgggtgttttgcaacttcacagctgggggtgagacttgcgtgacaccccgcgatgacgttacacaattctcttatgtcgatagtgagggtagccccgtcggcgtggtccaactcaccttcttgcgcctactgagcgtctctgctcatcaggacgtctcctacccgtgctcaggcgcagcccgagacggccctctgcgccttcgcggcgcgaatgaggacgagctttctccagagactagcccctatgtgaaggaattcagggatggatgtcagacgcagcaagggaggaccgtcttagaggtgcgcactcccgttctagaacagctccctgtgctagatgcctcttttagcgatctgggagcccccccccgaagagggggtgtactgctcggcccagtttgttttatgggctag

SEQ ID NO: 2594 - DNA, 5070 bp, Artificial Sequence
  Description of Artificial Sequence: Synthetic coding sequence
atggagaggtgctccagatgtcatcgtttactgctattactccctctggtactgggcctatctgctgcacccgggtgggcgggcgccccgcctgtggacgtccttcgtgctctgcgttttccctctctgccagacggcgtgcgacgggccaaaggaatctgccctgccgacgtggcttatagagtggcacgcccggctcagttatcagcccccaccagacagctcttccctggcggttttccaaaggatttctctttgctgacagtggtgaggacaaggcctggactgcaagccccattgctgaccctgtattccgctcagggcgttaggcagctcggcctcgagctggggcggcctgtccgatttctctacgaggatcagaccggaagaccccaaccaccaagtcagcccgttttccgcgggttgagcttggcggacggcaagtggcaccgcgtggcagttgcggttaaagggcagtccgtaacccttatcgtcgactgtaaaaagcgggtcacacgacctctgccacgctccgcaagacccgtgttggacacacatggcgttataatcttcggagcaagaatacttgatgaagaagtgttcgaaggggacgtccaggagttagcgatagtgccaggggtccaagcagcttacgaatcttgtgaacaaaaagagttagaatgtgagggcggtcagagagagcggccacaaaatcagcagccccacagagctcagaggagtccccagcagcagccttctcgcctacatcggccacagaaccaggaaccacaaagccaggaacagaccgacttgcaagtgccccctactgccgatcgtttccaggccgaagagtacggagagggcggtaccgatccccccgaaggcccgtatgattacacctacggttacggggacgactatcgagaggaaacagagctcggaccagctctgagtgcagagaccgcccacagtggcgctgctgctcacggcccacggggtttaaagggcgagaagggagagccagctgttctcgaacccggtatgttagttgaaggtccacccgggccagaaggccccgctggcctgataggcccaccagggatccagggaaatcccgggcccgtcggcgacccaggggagcgcggacctcctggacgggcaggcctgcctggttcggacggtgctcccgggcctcctgggactagcctgatgctgccattccggtttggcagtggcggtggcgacaagggaccggtcgtggcagctcaggaagcccaggctcaggccattctgcaacaggccaggttggctctgcggggtccaccagggcccatgggctatacaggtcgacctggaccgttaggacagccaggtagcccgggcctgaaaggcgagagcggcgatctgggaccacaaggaccccgcggccctcagggtttgacagggcctcccggcaaggctgggagacggggccgcgcaggcgccgacggagctagaggcatgccgggggatcccggggtcaaaggagatcggggtttcgatggtctccccgggttgcctggagagaaagggcacaggggcgataccggagctcaggggcttcctgggcctcccggagaagacggcgaacgaggagatgacggggagatcggaccccgcggcctgcccggcgaaagtggccctaggggcctccttgggccgaaagggccccctggtatccctggcccccccggcgtgcgtggcatggatggcccccaagggcccaagggctctctcgggccccaaggggaaccaggtcctcccggacaacaaggaacccctggtactcagggcctgcctggaccacagggtgcgattggaccacatggcgagaaaggacctcaaggaaagccgggtctcccaggtatgcctggctctgatggacctcccggacaccccggtaaagagggcccaccaggaacaaagggcaatcagggccctagcggcccgcagggacccctgggctaccccggcccccgcggggtgaagggcgtggatgggatacgcggtctgaagggccacaagggagaaaagggggaagacgggtttcctggtttcaagggagatattggtgtgaagggcgataggggggaggtgggcgttccagggagccgcggggaagacggacctgaggggcccaagggccgcactggacctactggtgaccctggcccccctggcctgatgggggaaaagggaaaactgggggtccctggcctgccaggatatcccgggcgccaagggcctaagggatcgctcgggtttccgggcttccccggagccagcggggaaaaaggcgcccgcggactgagcgggaaatctgggcccagaggtgagcgcggtcccactggcccaaggggtcagcgggggcctcgtggggctacgggcaaatcaggcgctaagggaacttcaggaggagacggacctcacggtccccctggggaacgaggactgcccgggcctcaggggccaaacggcttcccaggcccgaaaggtccaccaggtcctccaggaaaggacgggctgcccggccacccaggacagcggggcgaggtaggatttcaaggcaaaactgggcctcctggcccccccggcgtggtgggccctcaaggggccgcgggcgagaccggtcctatgggggaaagggggcacccaggaccgcctggtccacccggtgagcagggcctccccgggaccgcgggtaaagagggaactaagggggacccaggaccccccggggcaccagggaaggacggtccagctggtctgcgcggatttcctggggagagaggactcccgggtactgccggcgggcctggcttaaaaggcaatgaaggcccaagcgggccacctggccctgcgggtagtcctggtgagaggggcgctgccggcagcggcgggcccatcggcccacctgggcgcccggggcctcagggacctccaggtgctgccggagagaaaggggttcccggagagaagggcccaatcggacccactgggagagacggtgtccaggggcccgtgggcctacctggcccagccgggcctcctggggtggccggcgaggatggagataaaggagaagtcggggatcccggccaaaaaggtaccaaaggaaacaagggtgaacacggaccgcctgggccccccggaccgattggccccgtcggccagcctggggcagccggggccgatggcgagcctggtgctagagggcctcagggacactttggtgccaaaggagacgaggggactcgggggtttaacggacccccagggccaataggtctgcagggcctacccggaccctcaggagaaaagggcgaaaccggcgatgtggggcccatgggtcctcctggcccaccaggacctagagggccagcgggtcctaacggagctgatgggcctcaagggccaccggggggagtcggcaatttggggccacctggggagaagggcgagccaggagaaagtgggagcccagggattcaaggagagccaggcgtcaagggtccgcgtggcgaacgaggtgagaaaggggagtctgggcagccaggcgagccagggccaccgggaccaaagggccctacgggcgacgacgggccaaaagggaatccaggccccgttggattcccaggcgaccctggaccaccgggagaggggggcccgaggggacaggacggcgccaagggtgacaggggggaagacggcgaacccggacagcccggctccccagggccgaccggcgagaacggccccccgggcccactggggaagcggggtccagccggtagtcctggttccgaagggcgtcaaggcggaaagggtgcgaaaggcgatccaggagccattggggctccaggaaaaactggtcctgtgggtcccgccggccccgccgggaagccgggcccagatggcttacgtggcctgcccggcagcgtgggtcaacagggtagacctggagcaacagggcaagctggcccaccaggcccagtaggaccaccgggcctgcccggtttaagaggggacgccggtgctaagggggagaaaggccatcccggcctgatcggactaatcggtccaccaggagagcagggagagaaaggggatcggggcctcccggggcctcagggatccccaggacagaagggagaaatgggaattcctggtgcttcaggaccaataggtcctggtgggccgccgggcctacctgggcccgctggaccaaagggtgccaaaggagctacaggtcctggaggccctaaaggtgaaaaaggagttcagggtcccccagggcaccccgggccccctggagaagtgatccagccactgcctattcagatgcccaagaagacacggcgtagcgtggatgggagtagacttatgcaggaggatgaagcaattcccacggggggtgcccctggctcccccggggggctcgaggaaattttcgggtccctggacagtctccgagaagagatcgaacagatgcggaggcccaccgggacccaggactctcctgctcggacctgtcaggatcttaaattgtgtcatccagagctacccgacggtgagtactgggtagaccctaaccagggttgtgcaagagacgcgtttcgagtgttttgtaattttacggccggcggtgagacgtgcgtgactccccgagatgacgtgactcagtttagctacgtagattccgaggggtctcccgtgggagtggttcaacttacgtttctgaggttgctgagcgttagtgcacaccaggatgttagttatccctgcagtggggctgctcgcgatggacctttacggcttcgaggagcaaatgaggacgagctgtcacccgaaacaagcccatacgttaaagaattccgagatggatgtcagacacagcaaggccggacagtgctcgaagtgcgtacccccgtgttggaacagttgcccgtcctggatgccagcttcagcgacctgggagcacccccgcgcagaggcggggtcctcctggggcctgtgtgttttatggggtag

SEQ ID NO: 2595 - DNA, 4890 bp, Artificial Sequence
  Description of Artificial Sequence: Synthetic coding sequence
atggagcgttgctcgcggtgccataggctgctcttgctgctgcccctggttctagggctgagtgccgcccctggatgggctggcgcccccccagtggacgtgttgagggccttacggttcccgtctctgcccgacggagtcaggagagccaaggggatctgccccgctgacgttgcctaccgcgtggccaggcctgcccagctgtccgctcctactaggcagttattcccaggaggctttcccaaggacttctccctcttaaccgtagtcaggacccgcccaggtctccaggcccctctgttgaccctgtatagtgcacagggagtgcggcagctggggctcgagctgggccggcccgtgagatttttatacgaagatcagactggtagaccccagcctccttcgcagcctgtgttccggggcctgtctctggcggatggcaaatggcacagagtcgccgtcgccgtgaaaggacagagcgttaccctgatcgtcgattgcaaaaagagggtgactaggcccctaccgagatccgcccgccccgtgctggacacgcatggtgtgatcattttcggagctcgcattctcgatgaagaggtcttcgagggcgatgttcaggagctcgctattgtccctggcgtgcaagcagcatacgagtcttgtgagcagaaagaactggaatgcgaaggaggtcagagagagaggccccagaaccagcagccacatcgcgcacaaagatctccccagcagcagcctagccgactgcaccggcctcagaatcaggaacctcagagccaggccgcgcatggccctcgtggcttgaagggagagaagggcgaaccagccgttctggaacctggcatgctggtggaagggcctcccggccctgaggggcctgcggggctgattggcccgccaggcatacagggtaatcctggccctgtaggagaccccggagagcgaggcccccctggtcgggctggcctgcctggctccgatggggcgcctggcccacctgggacgtcgctgatgctcccgtttcgcttcggatctggcggcggcgacaagggacccgtggtagctgcccaggaagctcaggcccaggcaatactgcaacaggctcggttagcgctccgcggccctcccggacctatggggtacacaggccgccccggtccactaggtcagcctggcagccctggcctcaaaggggagagcggtgatcttggtcctcagggccctcgggggccccagggactcactggcccgcctggaaaggcagggcgccgcggcagggcgggcgccgacggggcaaggggcatgccgggagatccaggggtgaagggcgatcggggcttcgacggtctgccgggcctgcctggagaaaaggggcacagaggcgacacgggtgcccagggcctccccggaccccccggcgaagatggagaaaggggggacgatggagaaatcggacctcggggtttacccggtgagtccggacctcgcggactgcttggaccaaagggaccccctggcattcccggaccaccaggcgtccgtggaatggatgggccacagggtccaaagggctccttgggaccccagggtgagccgggaccgccggggcaacagggaacaccagggacacagggcctgcccggccctcaaggcgctatcgggccacacggcgaaaaggggccccaaggtaaacctgggttgccagggatgcccggcagcgacggccctcctggacatccgggaaaagaggggccgccaggtaccaaaggcaatcagggccccagcggaccgcagggacccctaggatatccaggcccccgcggtgtaaaaggagtggatgggattagagggctcaaaggacacaagggcgagaagggggaggacggattcccagggtttaaaggtgacattggagtcaaaggggaccgaggggaagtcggcgtgcctggcagtagaggggaggacggccctgaagggcctaagggtcggactggaccgaccggagacccaggaccaccaggcctaatgggggagaaagggaaactcggagtaccaggtctccccggctaccccgggcggcagggtcctaagggatctctgggctttcccggttttcccggagcatcaggggaaaagggggcccggggcctgagtggcaagagcggaccacgaggcgaaaggggtccgaccggacccagggggcagagggggcctcgtggggccactggcaaatcgggcgccaaaggtacctcggggggagatgggcctcatggaccgcccggcgagagaggcttgccaggcccccagggtcctaacggattccctgggccaaaagggccacccgggcccccaggtaaagatggattgcctggacaccctgggcagagaggggaggtaggtttccagggtaagaccggacctcctggaccccctggcgtggtagggcctcagggcgccgctggtgagacagggcctatgggagaacgcggccaccccggaccacccggtccccctggcgagcaaggtctgcccgggacagccggcaaggaaggaaccaagggcgatcctggccccccaggcgcccctgggaaggacgggccagcaggcctgagaggattccccggggagagggggttgccgggaacagccggcgggccagggctgaaaggaaatgaagggccctccggtccaccagggcccgccgggtcccctggggagagaggggcagctggctctggaggccccatcggcccacccggaaggccgggcccccagggtcctcctggtgctgcaggcgagaaaggcgtgccaggggagaaagggcctatcggccctaccgggcgtgacggggttcaaggccccgttggtttgcccggacccgcgggccccccaggggttgctggggaggatggggataagggcgaagtgggagatccgggacaaaagggtacgaagggtaacaagggtgagcatggccctcccggccctccggggccaataggtccagttgggcaaccaggcgctgcaggcgcagatggcgaacccggagcacgcggccctcaagggcatttcggcgctaagggggacgaaggcacaagagggttcaacggccctccagggcctattgggctgcaggggttaccaggccccagcggcgagaaaggagagactggcgacgtcggtccgatgggccctcctgggccaccgggacctcggggcccggctggcccaaatggtgccgatggaccgcagggccctccaggtggagtcgggaacttgggtcccccaggggagaagggtgaaccaggggagtcaggcagccccggtattcaaggggaaccgggggtaaagggcccccggggggaaagaggcgaaaagggggaatccggtcagcccggagagccaggtcctccaggccccaagggacccacgggagacgacggccccaaaggcaatccaggtccggtggggtttccaggcgacccaggcccacccggggaaggcggaccgcggggtcaggacggagcaaagggcgaccgcggcgaggatggggaacccgggcaacctgggtccccgggccctaccggcgagaatggacctcccggcccccttggcaaaaggggcccagccggtagtccaggcagcgaaggccggcaggggggcaaaggcgcaaagggcgacccgggggctatcggagctcctggaaagacgggcccagtgggaccagctggccctgccgggaaaccaggccctgacggtcttcggggccttcccggatccgtggggcagcaaggtaggcctggtgccacgggccaggcaggcccccctggtccagtgggaccaccaggcctgcctggacttcgaggtgatgcaggtgccaagggagaaaagggccatccaggcctgattggcctgataggtccaccaggggagcagggagagaaaggtgacagaggcctgcctggaccccagggctccccaggacaaaaaggcgaaatgggtattcccggagcgtccggacctattggtcctgggggtcctccaggactccccggaccagcaggcccgaaaggtgccaaaggggcaacgggccccggcggccctaagggggagaaaggggtacagggcccgcccgggcaccccggaccgcccggggaggtgattcagccactgccgattcagatgcctaagaaaactcgccggagtgtggacggctctagattgatgcaggaagacgaggccatccctaccggcggcgcaccaggaagccccggcggactggaagaaatcttcggaagtcttgacagtttgagggaggagatcgagcagatgcggcgccctacagggacacaggattcaccggctcggacgtgccaggatctgaagctttgccaccccgaattgccagatggagagtactgggtcgacccaaaccagggatgcgctagagatgcatttagagttttctgtaactttacagccggcggtgagacatgtgtcaccccccgtgacgacgtaactcagttttcttacgttgactccgaagggtccccagtaggtgtggttcagctcacctttctgcgcctcctgtccgtttccgcacatcaagatgtaagctatccttgttcaggtgccgcgcgtgatggaccccttcgtctcagaggagctaacgaggatgagctgtcacccgagacaagcccctacgtgaaggaatttcgggatggttgtcaaactcagcagggcaggactgtgttggaggtccgcacacccgtcctggaacagttacccgtgcttgatgcatcattcagtgatctaggcgctccgccccgacggggcggcgtgctgttgggccccgtctgtttcatgggatag

SEQ ID NO: 2596 - DNA, 921 bp, Artificial Sequence
  Description of Artificial Sequence: Synthetic coding sequence
atggactggcgggcctcagaggcttggatggtgccccgggctccaaagggtgcgtgggaccccagagagagccaagaccttttggacaaccgcgcccctcttggtccccgcgtattcccaggtccaagagtgcctagcgctctgatggaaaggcgtgttctaaaagggtcccaagggtcaccggcatgtccaggaccccctggcgaggtgatccagcctctgcctatacagatgcccaagaagacaaggcgctcagtggacggctcacggctgatgcaggaggatgaagcaatccctactgggggagctccagggagccctggcggtctcgaagagatctttggcagcctggattcgctgagagaggagatcgagcagatgcgacgacccacaggcactcaggactctccagctagaacatgccaggacctaaagctgtgccatccagaactccctgatggagagtactgggtggaccctaaccagggctgcgcaagggatgcctttcgtgtcttttgcaatttcacagccggcggggaaacttgcgtgactcccagagatgatgtaactcagtttagctacgtggacagtgaagggtcccccgtgggtgtggtacagctgaccttcctgcggttactgtcagtctctgctcaccaggacgtttcctatccctgctcaggcgctgcccgggatggccctttgcggctacggggcgcaaacgaggatgaactgagtcctgaaacaagtccatatgttaaagagttccgtgacggatgtcagactcagcaggggcgcactgtgctggaggttcgcactccggtcctggaacagctccccgtgctagacgccagctttagcgacctcggcgcaccaccaaggaggggcggagtgctgctggggccagtttgtttcatgggctag

SEQ ID NO: 2597 - DNA, 4968 bp, Artificial Sequence
  Description of Artificial Sequence: Synthetic coding sequence
atggagcgatgctcccgctgtcaccggctgcttttgctgctgccactggtattaggactgagcgccgcccccggctgggccggtgccccccccgttgacgtcctgcgagccctgagatttcctagccttccagacggggtacgcagggcaaaaggcatctgccctgcagacgttgcctatcgggttgctcggcccgcacagctcagcgctcccacccggcagttgtttccaggggggttccccaaggacttctctctgctaactgtcgtgcgcacaaggccaggccttcaagcgcccctcttgaccttatattcagcccagggcgtgaggcaattagggctcgagctggggccccccgtgagatttctgtacgaggaccagactggcagacctcaaccgcccagtcagccagtgttccgcggattgtcactggccgacggcaagtggcaccgggtggccgtggcagtaaaaggccagagcgtgactctcatcgtggactgtaaaaagcgggtgacgagaccgctgcctcggtcagctcgcccagtgctggacacccacggcgtaatcatcttcggcgccagaattctggacgaggaggtttttgagggggatgtacaggaacttgctatcgtgcccggtgtgcaagccgcttatgaatcctgcgagcaaaaagagctggagtgcgagggaggccagcgcgagcgcccccagaatcaacagccgcatagagcacagcgaagtccacaacagcagcctagcaggcttcaccggccccagaaccaagaaccccagtcgcagccaacggaatccctgtactacgactacaaacctccttattatgacgtgatgactacaggcacgactcctgactaccaggccgctcacgggcccagagggcttaagggggagaagggagaacctgctgtactcgaaccaggcatgttggtcgaggggccaccgggcccagaagggcctgccggactgatcggcccaccaggaatccagggtaacccaggccctgtgggggacccgggggagaggggtccgcccggtcgcgccgggctgcctgggagcgacggcgctcctggcccacctggcacctccttgatgttgcctttccgattcggaagcggtggtggcgacaaggggcccgtcgtcgcagcccaggaagctcaggcccaggcaatccttcaacaggctaggttagccctgaggggcccacctggcccgatggggtacactggccgtccaggcccgctcggccagccaggcagcccgggcctcaagggagaatctggagatctggggcctcagggccctcgaggtcctcagggtcttactgggccccccggaaaagctggacgccgcgggcgtgcaggagccgacggagcacggggtatgcctggggaccccggcgtgaaaggtgaccggggatttgacggcctccctgggttgccgggtgaaaagggtcatcgcggtgacactggtgcccagggactacccggtccacccggagaagacggggagagaggggacgacggtgaaattgggccccggggcttgcccggtgagtcgggtccacggggcctgctaggtcccaagggtccgcccggcatccccggccctccgggagttcgcggtatggacgggccccagggccccaagggctctctgggcccacagggggaacccggacctccaggccaacaaggcacaccaggaacccagggccttccagggccccagggagccatcgggccccatggggagaaagggccacagggtaaaccaggcctcccgggcatgcctggaagcgatggtcctccaggtcaccccggaaaagaggggccccccgggacaaagggtaatcagggacctagcgggcctcagggacctctgggctaccccgggcctcgcggcgttaagggcgtagatggcattaggggattaaagggccataaaggcgagaaaggagaggacggctttccagggtttaagggcgacattggggtgaagggcgaccggggcgaagtgggcgtgcccggaagtaggggagaagatggtcctgaggggcccaaaggtcgcacaggccccactggtgaccctgggcctcccggcttgatgggcgaaaagggcaaactgggcgtgccaggactacccggctatcccggcagacagggccccaaaggtagtctggggttccccgggttcccaggcgcatctggcgaaaagggagcccgtgggctctctgggaagtcgggcccgcgaggagagcgaggacctactggcccacgagggcagagaggtcccagaggagctacgggtaagtccggagccaagggaacctcagggggtgacggcccccatggaccacctggcgagagggggctcccaggccctcagggcccaaacgggtttccaggaccgaaggggcctcccggtccaccgggcaaagacggcctgcccggtcatccgggacagcgcggggaggtcggttttcagggcaagaccggccccccaggcccccccggggttgtcgggcctcagggagcagcgggtgaaacaggaccaatgggagaaagggggcaccccggccctcctgggccccccggggagcagggccttcctggtactgcaggtaaagagggaaccaagggggaccccggaccacccggcgcccctggaaaggacggaccagccggcctacgcggctttccaggcgagcgagggttaccaggcacagcaggtgggccgggccttaaagggaacgaggggccttcagggcctccagggcctgcagggtcaccaggcgagcgcggtgcagccggctccggtggccctataggcccacccggccggcctggcccacaaggaccaccaggcgcagccggcgagaaaggtgtccccggtgagaaagggcccatcggtcctacagggcgggacggagtgcaagggcctgtaggtctcccaggacctgcaggcccacccggggtagcaggggaagacggagacaaaggtgaagtgggcgatcccggtcagaaagggacgaagggaaataagggggagcacggtcccccagggcctcccggccccatcggtcctgtgggtcaaccaggcgccgcaggagcagacggggaacctggagcgcgtgggcctcaggggcacttcggcgccaaaggtgatgaaggcactcggggattcaatggcccgcccggacccatcggactgcagggcttacccggcccctccggcgaaaagggcgagacaggcgatgtcggacccatgggccctcctggaccaccgggccccagagggcccgccggccccaacggagccgatggtccacagggtcccccgggcggggttggaaaccttgggccacccggcgaaaagggtgagcccggggagagtgggtctccagggatccagggcgagccaggtgtcaagggtcccagaggcgagaggggggagaagggagagagtggccagcctggagagccgggacccccaggccctaaaggaccaaccggcgacgacggccccaaggggaatcccgggcctgtggggttcccaggggatcccggtcctccaggagagggtggtccaagggggcaggacggtgcaaaaggagatagaggcgaggacggcgagcccgggcagcccggatcaccaggccctacaggggaaaatgggcccccaggaccactcgggaaacggggccccgctggctcaccgggatctgagggccgccagggaggtaagggagcaaagggcgacccaggggctataggcgcacccggaaaaactggccccgtgggacccgcgggtcccgcagggaagcctggacctgatggactgcggggcttaccaggtagcgtggggcagcaaggtcggcctggggctacggggcaggcaggtccacccggccccgtggggccacccgggcttccgggtctgcgcggagatgccggggcaaagggtgaaaaagggcaccccggcttaattgggctgattggtccgcctggcgagcagggggagaaaggggatcgcggtctgcccggcccccagggaagtcccgggcagaagggggaaatgggaataccaggggcgtccgggccaattgggcctggcggaccacccggtctgccggggcctgcagggcccaaaggtgccaaaggagccaccggccctggagggccaaaaggagagaagggggtacagggacctcctggccacccgggccctccaggtgaagtgatacagccccttcccattcagatgccgaagaaaactagaaggagtgtggatgggagccggctcatgcaggaggatgaggccatccctactgggggcgcgcccggtagtcccggcgggttagaagaaattttcggcagcctggattctctgcgtgaggaaattgaacaaatgcggaggccaaccggaactcaggactccccagctcggacatgccaagacctaaagctgtgccaccctgaactgcctgacggagaatactgggtcgaccccaaccagggatgcgcgagagacgctttcagggtgttctgcaatttcaccgcgggaggcgagacgtgcgtgactccaagagatgacgtgacacagttttcttacgtagatagcgaggggagcccagtgggcgtggttcagctgacattcctacgattactctccgtgtcggcacatcaagatgtgtcctacccctgttcaggggcagcaagggacggccctctgcgcctgaggggtgctaacgaagatgagctgagccctgagaccagtccttacgtgaaagaattcagggatggatgccagacccagcagggccgcacagtgttggaggtccggacccccgttctggaacagctacctgtacttgacgcttctttcagcgacctcggtgcgccccctaggcgcggcggcgtgctgttaggcccggtttgttttatggggtag

SEQ ID NO: 2598 - DNA, 5211 bp, Artificial Sequence
  Description of Artificial Sequence: Synthetic coding sequence
atggagcgttgctcgcgatgccatcgtctcctgctgctcttgccactagtgctggggctctccgctgcacctggctgggccggggcacctccagttgatgtgcttcgggctctccggttcccgtctctgcccgatggtgtccggagggccaaggggatatgccctgcagacgtcgcatatagggtggctagaccagcccaactcagcgctcctacccgacagctattccctggtggctttcccaaggatttttcccttctgacggtcgtgagaacccgccccggacttcaggctcctctgctgacactgtattccgcccagggggtacggcagttggggctggaactggggcctcccgtgcgattcctgtacgaagatcagaccggtaggccgcagcctccttcccagccagtgttcaggggcctatccttggctgacgggaaatggcaccgtgtggcagtggccgttaagggtcaatccgtgacactgatcgtggattgtaaaaagagagtgacacggcccctgccacgaagtgcccgacccgtgcttgacacccacggcgtgattatttttggcgcaagaatcttggatgaagaagtgttcgaaggggacgtgcaggagctagccatagtgccaggggtccaggcagcctatgagagctgcgagcagaaggaactggaatgcgagggaggacagagggagcggccccaaaaccagcagccgcatagggcccaacgctcccctcagcagcaaccaagtcggctacacagaccacagaaccaagagccccagagccagcccactgagtcactttactacgactataagcctccctactacgacgttatgactacgggtacaacccccgactaccaggatccaacccccggagaagaagaggaaatcctggaatcttcactgctgcctcctctggaggaagaacagacagacctacaagtcccacctaccgccgacagatttcaggctgaagaatacggtgagggtgggacagatcctccagaaggcccatacgattacacctatggttacggagacgactatcgagaggagactgagcttggcccagccctgtccgcggagacagctcattcaggtgctgccgcccatggcccccgggggttgaagggtgagaaaggggagcccgcagtcctggagcccggcatgcttgtagagggccctcccgggcctgaaggacccgcgggactgatcggtccaccagggatccaaggcaatccgggaccagtcggagaccctggagagcgaggtccaccaggacgcgctggtctgcccggttctgacggcgccccaggccctcctggaaccagtctcatgttacccttccggttcggctcgggtggaggggacaagggccctgtcgtggcagcccaggaggcacaggcgcaagccatcttgcaacaagcacggctggctttgcgcggaccccctggtcccatgggctatacaggcaggcctggtcctctcggccagccagggagtcccggtcttaaaggtgaaagtggagacctgggtcctcagggcccccgcgggcctcagggactaactggtcctcctggcaaggccggtcggagaggccgcgccggagcagacggcgctcgtggaatgcctggagatccaggcgtgaaaggcgacaggggctttgatggtctgcccggcctccctggtgaaaaaggacacagaggcgacaccggtgcacagggcctgcctggtccacctggtgaggacggcgaacggggtgacgatggagaaataggtcctagaggtttacccggtgaatccggacctcgaggccttttagggcctaaaggacctcccggcatcccagggccaccaggggttcgagggatggacggaccacagggccccaaaggatcactgggtccacagggagaacccgggccaccaggccagcaagggacccctgggactcagggtttgcccggcccccagggcgctattggcccacatggcgaaaaaggaccgcagggcaaacctggcctcccaggcatgcctggatctgacggacccccgggacatcccgggaaagaaggaccccccggcactaagggcaaccagggtccatccggaccgcaggggcccttgggttatcccggaccccggggggtgaaaggggtggatggcatccgagggctgaagggacacaagggagagaaaggagaggatggatttcccggctttaagggggacatcggggtaaagggagacagaggagaggttggggtcccagggtccagaggtgaagacggcccagagggccccaaagggcgcaccggcccgacaggagatcctggtccccccggattgatgggcgagaaggggaaacttggagtaccgggtctaccgggctatcccggacggcaggggcccaaaggatcactgggtttccctggattccctggagcctccggcgagaagggtgctcgaggattgtcaggaaaatccggtccaaggggggagaggggtcctacgggacccagaggccagaggggtccccggggtgccactgggaaaagcggcgcaaaaggaacatctggcggagatggaccgcatggtcctccgggtgagcggggattgcctggaccacagggacccaatggattccccgggcccaagggcccccccggcccacccgggaaggacggtcttcccggccatcccggtcagcgcggcgaagtgggtttccagggcaagactggaccacccggacccccaggggtggtcgggcctcagggcgctgcaggcgaaactggcccaatgggtgagaggggtcatccaggaccccccggtccccctggagagcagggcttgccaggaaccgctgggaaagaggggacaaaaggcgacccagggccacctggggcgccagggaaagacggtccggccgggctgaggggctttccaggtgagaggggcctgccggggacagcaggaggccccggcctgaagggaaacgagggcccctcaggacccccaggccccgctggctccccaggtgaacggggggcagctgggagcggaggacccatcggccctccaggaagaccggggccccaagggcctcccggggccgctggggaaaaaggcgtacccggcgaaaaagggccgattggacctacagggagagacggagttcagggccccgtgggcctgccagggcccgcgggccctcctggggttgctggagaggatggagataagggtgaagttggagaccccggacagaagggaaccaaagggaataagggggagcacgggccgccgggccctccagggcctatcggccccgtcggccaaccaggggctgccggtgcagatggggagcccggagcaaggggcccccagggtcacttcggggctaaaggcgacgaggggactcgcggcttcaacggaccacctggaccaatcgggctgcagggcctccccggaccatctggtgagaaaggcgaaacaggtgacgtggggccaatgggacctcccggcccacccgggccgcgcgggcctgcagggcctaacggcgctgacgggcctcagggaccccctggaggtgttggtaacctgggtcccccgggcgagaaaggggagcctggcgaaagcggatctcccggtatacagggcgagccaggagtcaagggaccccgcggcgagagaggcgagaaaggtgaaagtggtcagcccggggagcccggccctccggggccgaagggcccaaccggcgatgacggcccaaagggcaacccaggcccggtcgggtttcccggggacccagggccccccggagaggggggcccgcggggacaggacggggccaaaggagaccgcggcgaggatggcgagcccggccagccaggatcccctggacccactggggagaacgggccccccggcccattgggaaagcgcggaccagcagggagccccggctccgagggaaggcagggtggcaaaggggctaagggagaccccggtgcaattggggcgccgggtaaaaccggacctgtaggtcccgctggcccagccggcaagcctggtcccgatggactccgagggctccctggaagtgttggtcagcaaggcaggccaggggctacaggccaagctggcccacccgggcctgtgggcccgccaggcctgcccggtctcaggggtgatgccggtgccaaaggcgagaaggggcaccccggcctgatcggtctcatcggcccccccggcgagcagggggagaaaggcgacagagggttacctggccctcaagggtcccccggtcagaaaggagagatgggaatcccaggggcttcaggcccaatcggtcccgggggtcctccaggcctgcctggacctgcaggccccaagggagccaagggtgcgacgggaccggggggacccaagggggaaaagggcgttcagggaccacccggccaccccggcccaccaggggaggttattcaaccactgcctattcagatgccaaagaaaactcggaggagtgtcgatggcagccggcttatgcaggaggacgaagctatccctacaggcggggcacctggcagcccaggcggacttgaggagatctttggaagcctggactccctcagggaagaaatcgagcagatgaggcgcccgacagggacccaggatagccccgcaagaacctgtcaggatctcaagctgtgccaccctgaattgccagacggggaatactgggtcgaccctaaccaggggtgcgcccgtgatgcatttcgtgtgttctgcaactttactgcggggggggagacatgtgtgacacctcgggacgatgttacccagttttcctacgttgactctgagggttcccccgttggagtggttcagttaaccttccttcgtcttctgtccgtgtccgcccatcaggacgtttcctatccctgctccggcgcagccagagatggacctcttaggctgcgaggcgcgaacgaggacgaactcagtcccgagacttccccctacgtgaaggagtttagagacggatgccaaactcagcagggacggacggtgctggaggtgcggaccccagtgctggagcagctgcccgtgctggacgcttcttttagtgacctgggagctcccccccggaggggaggagtgctcctgggaccagtatgtttcatggggtag

SEQ ID NO: 2599 - DNA, 5148 bp, Artificial Sequence
  Description of Artificial Sequence: Synthetic coding sequence
atggaacgctgctctcgatgtcataggttgctgttgctgctgcccctggttctgggcctgagtgccgctcctggttgggcaggtgcgcccccggtggatgtcctgagggcactgcggtttccttcactcccagacggggtcaggcgtgcgaaaggcatttgccctgccgacgtggcttatcgcgtggcccgcccagctcaactctctgcacccactcgccagctattcccaggcggattccccaaagacttcagcctcctcaccgtggtgcggacccggcctggccttcaagcacccctgctgacactgtattcagcccagggtgtccgtcaacttgggctcgagctgggacgaccagtgcgatttctctacgaggaccagacgggacggccccagcccccctctcagccagtcttcagaggattgtccctcgccgatggcaagtggcatcgcgtggccgtggcagttaagggacaatctgttacgctgattgtggactgcaaaaagcgggtaacacggcctcttccccgcagcgcccggccggtgctcgacacgcacggagttataattttcggcgccaggattcttgacgaggaagtgtttgagggcgacgtacaggagctggctatcgtaccaggagtacaagcagcatatgagtcatgtgagcaaaaggagctcgagtgcgaaggaggtcagcgggagagaccccagaatcagcagccccacagagcccagagatctcctcagcaacaaccaagtcgattgcacaggcctcagaatcaggagccgcagagccagccaaccgagtcgctctactacgattacgaaccaccctattacgacgtgatgactacaggcactacccccgattaccaagagcagaccgacctgcaggtcccaccaaccgctgataggttccaggcggaggagtacggagaaggcggtactgacccccccgaagggccgtacgattacacgtacgggtatggcgacgactaccgcgaagagaccgagctgggtcccgccctctccgccgaaaccgcccatagcggagccgccgcacatgggcccagagggctcaagggagagaaaggggagcccgccgtgctagaaccaggaatgctcgtggaaggaccaccgggccctgagggacctgccggcctcataggtcctcctggcatccaagggaaccctggccccgttggggacccaggcgaacggggccctccagggagagccggcctgcccggctcagacggagcccccggacctccaggaaccagcttaatgctgccctttcgctttggatccggaggcggagacaaaggaccagtcgtcgccgctcaggaggctcaggcccaggccatacttcagcaggctaggttagcactccggggccctcccggcccaatgggctatacgggccgaccaggaccgttgggccaacccggatctcccggactgaagggtgagtctggagatctgggcccccagggaccacggggaccccaaggactgactgggcccccagggaaggcaggtaggcggggtagagccggggctgatggagctcggggcatgcctggcgaccccggtgttaagggcgatagggggttcgatgggctgcctgggctccctggagagaaaggccataggggagataccggtgcgcaaggtcttccagggccccccggtgaggacggggagcgtggggacgacggtgaaatcgggccgcgtggactcccgggcgagagtggcccgagagggctgctggggcccaaaggccctccaggtattcccgggccgcctggggtgcggggtatggacggaccccagggtccaaaaggctcattggggcctcaaggggaaccaggtccacccggccagcagggaaccccaggaacccaaggtctgcctggtccccagggcgctattgggcctcacggtgagaagggtcctcaggggaagcctgggctgccagggatgccagggtccgacggcccacccggacacccagggaaagaagggcctccagggacgaagggtaatcaggggccttccggtccacagggccctttggggtatccagggcctcggggggtgaagggggtggacggaatcagaggtttaaagggtcataaaggggagaaaggtgaggatggctttccaggatttaagggggacattggggtcaaaggcgacagaggggaagtgggggttccaggaagtcggggcgaagacggtccagaagggcccaagggacggacaggccccacgggtgacccgggtccccccggcttaatgggggagaaggggaaactgggagtgcccggtctcccgggttatcccgggaggcagggcccaaaaggatccttggggtttccgggcttccccggggcgtcaggcgagaaaggcgccagagggctgagcgggaaatcagggccacgaggcgagagagggcctacgggtccccggggtcagcggggcccgagaggagccaccggtaagagtggagccaagggcaccagcggcggggacggcccccatggaccccctggtgagcggggacttccagggccccagggtccaaatgggtttccaggaccaaaggggcccccgggtccgcctggcaaagatgggctgccaggccaccctggccagaggggagaagtgggtttccagggcaagaccggcccccctgggccccctggtgtcgtcgggcctcagggcgcggcaggggaaacgggccctatgggagaaaggggacaccccggacctcctgggccacccggtgagcaggggttacctggcaccgccggaaaggagggcaccaagggggatcccgggccccccggcgctccaggcaaggacgggccggcggggttacgaggttttcccggggaacgggggctccctggaacagctggcggtcccgggcttaagggcaatgagggcccatcgggccccccaggccccgccggtagcccaggtgagcgcggggctgctggatcaggtggacctataggaccacccgggaggccaggacctcagggcccacccggggcagcgggggaaaaaggcgtacctggcgaaaagggccccatcggccctaccggcagagacggcgtgcagggacccgtgggcctgcccgggccggctgggcccccaggagttgccggcgaagatggtgataaaggggaagttggagatcccggccagaaagggacaaagggaaataaaggcgaacatggacctcctggccccccgggacctatcggtccggtgggccagccgggggccgctggggcagatggcgaaccgggcgccagagggccgcagggccattttggggccaaaggggatgagggaaccaggggattcaacggccctccaggacctattggattgcagggccttccgggcccttccggcgagaagggagagaccggagatgtggggccaatgggcccgcccggccccccaggtcctcggggacctgcgggcccgaatggagctgacggacctcaaggccctccaggtggcgtgggcaacttgggtccccccggagagaaaggcgagcccggggaatccggctcaccgggcatacagggcgagccaggggtgaagggcccccgtggagaaaggggggagaagggtgagtccggtcagccaggagaaccggggccaccaggcccaaagggaccgaccggcgatgacggccctaaaggcaaccccggccccgtgggatttcccggcgatcccggaccacctggagaaggtggcccccggggccaggacggagcgaagggcgaccgtggggaagacggggagccagggcagcctggttctccagggccaacgggtgagaatggccctcccggccctcttggaaagcggggccccgcaggatctccaggaagcgaaggccgccagggaggcaaaggcgctaagggagatccgggtgcgatcggcgcacccggcaagaccggtcccgtggggcccgctgggccagcgggtaagccaggacccgacggactacgcggtcttcctggctcagtcggccaacaagggcggccaggtgctaccggccaggccgggccccccggtccggtaggcccacctggtctccctggcctcagaggcgacgctggagcaaaaggcgagaaggggcatcctgggctaattggtctgataggcccaccgggcgagcagggagaaaaaggggacagaggccttccaggcccacagggaagccccggtcaaaagggcgagatgggcatcccgggggccagtgggcccatcggtccgggcggccctcccggcctcccggggcctgcaggtccaaagggggcaaagggcgccaccggtccgggtgggcccaagggcgaaaaaggcgtccagggccctccagggcaccctggacctccaggagaggtcattcaaccacttccaatacagatgccaaaaaaaacccgtcgcagcgttgatgggtcgaggcttatgcaggaggacgaagccattccaactgggggagccccgggcagtcctggcggtttagaagagatctttggctcacttgatagcctccgcgaagaaattgagcagatgaggcgccccactggcacgcaagactcacccgcccgcacttgccaagaccttaagctgtgccaccctgagctgccggacggtgaatactgggttgatcctaaccagggctgcgctcgggatgcattccgagtgttctgtaactttacggccggtggtgagacgtgcgtgacaccacgggacgacgtcacccaattctcttacgtggatagtgaagggtcgccagtgggagtggttcaactgacctttctgcggttgttgagcgtaagtgcccatcaggatgtgtcctacccatgcagcggggccgcgagagatggccctctgagactgcgaggcgcaaacgaagatgagctgtctcctgagacatccccctacgtcaaggaattccgtgacggatgccagactcagcaggggcgaaccgtactggaggtgcgcaccccagtgcttgagcagctgccagtcttggacgcttcattttccgatctcggagcaccaccaagacggggcggcgttttactcggacctgtgtgctttatgggctag

SEQ ID NO: 2600 - DNA, 4890 bp, Artificial Sequence
  Description of Artificial Sequence: Synthetic coding sequence
atggaacggtgtagcagatgccatcggttattgcttcttttgccattggtcctcgggctgagcgcagcacccggctgggccggtgcccctcccgtggatgtcctcagagcgctccgatttccctccctgcctgatggcgtgcgcagagccaagggaatttgccctgccgacgtcgcctatcgcgtggcgagaccagcccagttgtctgccccaacccgccagctctttccaggggggttcccaaaggatttctctctcctgactgtcgttagaacccggcccgggctgcaggcccccctgctgacactctacagcgcccagggagttaggcagctcggcctagaactcggacgtcccgtccgattcttgtacgaggaccagacgggacggccacagccaccgtcccaaccagtgtttagaggcctcagcttggccgatgggaagtggcaccgggtcgctgtagccgtgaaagggcagtccgtcacactgatcgtggattgtaagaagcgcgtaacaagacctctccctagaagcgcaagaccggtcctggatacgcacggagttatcatcttcggggccaggatactcgacgaggaagtctttgagggggacgtgcaggagctggccatagtccctggggtgcaggccgcctatgagtcttgtgaacaaaaggagctggagtgcgaaggcggccagcgcgagcgtcctcagaatcagcaaccccaccgcgctcaaaggagccctcagcagcagcccagcaggctccatcggcctcaaaaccaggagccccaaagccaagcagcccacggccctagaggtctcaaaggagagaaaggtgagcctgcggtactggagcccggtatgctggtggaaggaccacctggaccagaaggtccagccggactgattggcccacctgggatccaaggcaaccccggtcctgtaggcgatcctggagagcgtgggccaccgggtcgcgcagggcttccagggtccgacggcgccccaggtcctcctggcactagtctcatgctgccttttcggttcggcagcgggggcggggacaaaggcccagttgtggccgcccaggaggcacaagcccaggccatactgcagcaagctcggcttgcgctgcgggggcccccgggacccatgggctatactggtcgtcccggcccgctgggacagcccggtagtcctggactgaagggcgagtccggagacctgggaccacagggaccaagggggccacaggggctgacggggccacctgggaaagcgggacggcgaggcagggctggcgctgatggagccaggggtatgccaggcgacccaggggtgaagggtgacaggggcttcgatgggctgccaggactgcccggagaaaaaggtcataggggcgacacaggcgctcaagggctccccggtccgcctggtgaagacggcgagcggggcgatgatggtgaaatcgggcctcgtggacttcccggggaaagtggcccacgtgggttactgggtcccaagggcccccctggaatccccgggcctcctggcgtgcgtgggatggatggaccacagggcccaaagggcagtctcgggccacagggcgagcctgggccgcctggccagcaaggcacacccggcacccagggcctccctggaccgcaaggcgccataggaccccatggggagaaaggtccccaaggtaaaccgggacttccgggcatgccaggaagcgatggcccgcctggacacccaggcaaagaaggacctcctgggaccaagggcaaccaaggcccatccggtccccagggccctctcggataccccgggccaaggggtgtgaaaggtgttgatggaatcagagggctgaagggacataaaggagagaagggggaggatggatttcccggatttaagggggacatcggagtcaagggggatcgcggcgaagttggggtacccgggagcagaggtgaggatggacctgaggggcccaagggcagaactgggcctactggggatccaggcccacctgggctgatgggtgagaagggaaagctcggtgtgcctggcttacctgggtaccccggtcgccagggacccaaggggagtctggggtttccaggcttccccggcgcctcgggggaaaaaggggctagagggctatctgggaagagtgggccccgaggggagcgcggacctacaggccctcggggacagcgaggaccccgcggagccacgggcaagtctggcgcgaagggaacctctggcggcgacgggccacatggcccccctggagagcggggactccccggtccccaagggccaaacggatttccaggcccaaagggaccattaggtcctcctgggaaagacggtctacctggacaccccggacagaggggcgaggtgggatttcaagggaaaaccggaccaccggggccacccggcgtggtggggcctcagggggctgctggagagaccgggccaatgggggaacggggtcaccctggccctcccggccctcctggtgaacagggcctgcccggtacggccggtaaagagggtaccaagggtgatcctggccctccaggagccccaggcaaggatggaccggccggtttgcgcggtttcccaggagaacgcgggctgccggggaccgccggtgggcccgggctcaaaggcaatgagggtccatcgggccccccgggaccagcaggctccccaggagaacggggcgctgcagggagcggcggtcctattggcccgccagggagacctggacctcaaggaccccccggtgccgctggggaaaagggtgtccctggcgagaaggggcccattggaccaactgggcgcgacggggtgcagggaccagtggggcttccaggacctgctgggccacctggagtggcaggagaagacggagataagggggaagtgggggacccagggcagaaagggactaagggcaacaagggagagcacgggcctcccggaccacctggccccatcggcccagtgggtcagcctggtgccgctggagcagatggggagcctggagcaaggggtccccagggtcattttggcgctaaaggcgacgaaggcacaagaggcttcaacggacccccaggaccaataggtcttcagggcctccccgggccttccggggagaagggcgaaactggggacgtggggccaatgggcccccccggcccaccaggaccgagaggtcccgcaggaccaaacggggctgacggaccacaggggccgcccgggggggtaggtaatctgggaccccccggagaaaaaggtgaacctggggagtccgggtcccccggaatccagggtgagccaggtgtgaaaggcccacggggcgaacgtggtgagaagggagagtccggacagccaggggagcctggtcctccggggcccaagggtcccaccggtgacgacgggccgaagggaaatccgggaccagtcggattcccaggagaccccggaccgccgggggaaggaggtcctcggggccaggatggagcgaagggggatcggggtgaggatggtgaaccgggtcagcccggcagcccaggaccaacaggagagaatggccctcccggaccactcggcaaaaggggccccgccgggtcgcctggctcagagggacggcagggcggaaaaggggcgaagggagatccgggggccatcggggcaccaggaaagactggccccgtgggacctgctggaccagcgggaaagcctggacccgatggactcagaggtctgccgggttcagtcggtcagcaggggagacccggagctacaggtcaagcgggtccaccaggtcccgtgggaccccctgggctgccggggctgcgcggggacgcgggggctaagggtgagaaaggacaccccggattaatcggcctgattggcccacccggggaacagggtgaaaagggggatcgcggattgcccggtccacagggtagcccaggccaaaaaggagagatgggcatacctggcgccagcggcccaattggccccggggggccacctggattgccagggcccgcggggccgaagggcgctaaaggagctacaggccccggcgggcctaagggcgaaaaaggagtgcagggcccccctgggcaccctggccctccaggagaagttattcagcccctgcccattcagatgccaaagaaaactagacgtagcgtagacggaagcagactcatgcaagaggacgaagcaatcccaacaggcggtgcccctggctcccccggcggcctagaagagatattcggttctttagactccctgcgcgaagagattgagcaaatgcgcaggccaactggcacgcaggactcccccgcacgcacatgtcaggatctcaaactatgccacccagaattgccagatggcgagtattgggtggaccccaaccagggatgcgcccgcgatgccttccgtgtcttttgtaacttcaccgctggaggagaaacttgcgtgacccctagggatgatgtgactcagttttcttacgtagattccgaaggttcacccgtcggtgtggtccagctgaccttcttgagattgctttccgtgagtgcacaccaggacgtgagttacccctgcagcggggctgccagggacggcccactgcgattgcgcggcgcaaatgaggatgagctgtcccccgaaacctcaccatatgtaaaggaatttagggacggttgccagacccagcaaggccgcaccgtgcttgaggtgcgcacacccgtccttgaacagctgccggttctcgacgcaagttttagcgacttgggggccccacccagaaggggcggggtcttgctcggccctgtctgcttcatggggtag

SEQ ID NO: 2601 - DNA, 921 bp, Artificial Sequence
  Description of Artificial Sequence: Synthetic coding sequence
atggactggagagcctccgaggcatggatggtgcccagagccccaaaaggggcttgggatccccgcgaatctcaggacctgttagataatagggcccctctcggcccacgtgtatttcccggccccagagtgccgagtgctctcatggaacggcgtgtactgaagggctctcaaggatcacccgcttgccccggacctcctggagaggtgatccagcctctgcccatccaaatgccaaagaagacccgacggtcagtggatgggtcacggctcatgcaagaagacgaggccatccctacaggcggggcacctggttccccaggcggtctggaggagatctttgggtcactagactccttgcgggaggagattgaacaaatgcgaaggccaaccggcacccaagattcacctgcgcggacatgtcaggatctgaaactatgtcacccggaactgcccgacggggagtactgggtcgatccaaaccagggatgtgcccgggatgccttcagggtgttttgcaactttactgccggcggagagacatgcgtgactccgagagatgatgtaacccaatttagttatgttgattcagagggaagccccgttggggtggttcaattaacattcctgagattgctctcagtgtcagcccaccaggatgttagttatccgtgcagcggggccgctagggatggccccctgagactgcggggggccaatgaagacgaattatctcccgagacatctccttatgtgaaagagtttcgagatgggtgccagacacagcaggggcgcaccgtgctggaagttcgaacacccgtccttgagcagctgcccgtgttagacgcctcattttctgacctgggggcacctcctaggaggggcggcgtcctcctaggacccgtttgtttcatgggctag

SEQ ID NO: 2602 - DNA, 4968 bp, Artificial Sequence
  Description of Artificial Sequence: Synthetic coding sequence
atggaaaggtgcagtcgctgtcatcggctcctactgctactgcctctggtgctaggtctgagcgctgcgcctgggtgggctggtgccccgcctgtggatgtgctccgtgccctgagattcccaagtctgcccgacggagtgcggagagctaagggaatctgtcctgcggatgtggcctatcgggtcgccaggcctgctcagctgtctgctcctacccgccaactgtttcctggcggtttcccaaaagacttttctttgcttactgtcgtccgcacccggcctgggctgcaagcacccctgcttaccttgtattctgcacaaggggtccggcagctcggcctggaactcggtcgccctgtgcgctttctgtatgaagaccagaccgggcggccccagcctcctagccagcctgtattcagaggtctgtcactggcagatggaaagtggcacagggtggctgtcgccgttaaggggcaatccgttaccttgatcgtagactgcaagaaacgtgtgactaggcccctccctcgcagcgccaggcccgtgctcgatacgcacggggttatcatattcggagcaaggattctggatgaggaggtgttcgagggggatgtgcaggagctggcgatagtacctggagtacaggccgcatatgagagttgcgagcagaaggagctggaatgtgaaggcggccagcgggaacggccgcagaaccagcagccacatagagcccaaaggtccccacagcaacaaccgtcccgcctgcatagaccgcagaaccaggaaccacaaagccagcccacggagtccctgtactacgactatgaacctccatattatgatgttatgaccacgggcactacccccgactaccaggccgcacacggacctcgtggccttaagggcgaaaagggggaacctgcagtactggagccaggaatgcttgtcgaagggcctcccggacccgaaggtcctgcggggttgatcggtccaccaggaatccaggggaacccgggccctgtgggtgatccgggtgagagagggccgcctggcagggctggcctgcccggttctgatggcgctccgggcccacctggcacaagtctgatgctgccgtttcgttttggatctggcggcggggataaaggccccgtggttgctgctcaagaggcccaggcgcaggccatcctacagcaggctcgcttagccttaagagggcccccgggccctatgggatacacaggaaggccaggccctctgggtcagcctggctcccctggcctaaaaggcgaatcaggcgacctggggccacagggaccgcggggtccccagggcttgaccgggccccctggaaaggctggtcgcagggggcgtgcaggcgctgacggcgcacgtggaatgcccggcgacccaggtgtgaaaggcgacagaggtttcgatggtttgcctggactgccaggagagaagggtcaccggggagatactggcgctcaggggctccccggccctccgggggaggatggagaaagaggcgatgacggggaaataggaccacggggcttgccaggagagtctggcccaaggggcctgctcggccccaagggacccccaggcattcccgggccacccggcgtgcggggcatggatggaccccagggtcccaagggatcactggggccacaaggtgagcccggcccccccggccagcaaggaacgccgggcactcagggattgcccggtccccagggagcaattggtccccatggggagaaaggcccccagggcaaacccggtctcccaggcatgccaggcagcgatgggccccctggtcacccgggtaaggaaggtccgccaggcactaagggcaatcaaggtccatctggtcctcagggccctctcggttatcccggacctcgcggagttaagggggtcgatggtatacgaggcctcaaggggcataagggcgaaaagggggaggacggcttcccaggtttcaagggcgacatcggtgtgaaaggagaccgaggtgaggtgggcgttcctgggtccagaggagaagacggacctgagggccctaagggacgaactgggcctacaggagaccccggaccccctgggctgatgggggagaagggcaagctcggtgtgccaggactccctggttatcctgggcgccaggggccaaagggctcactcggctttccaggctttcccggtgcttcaggtgaaaaaggggcgcgcgggctgagtgggaagtcaggaccccggggggaaaggggccctactggtccacggggtcagcgcggtccacggggggcaaccggtaaaagcggcgcgaaggggacctcaggtggggacggaccccatggtccccctggggaacgtggcttacccggaccccagggcccgaatggctttcctggccctaagggtcctcctggcccgcctggtaaggacgggctcccaggacacccaggacagaggggagaagtgggctttcaaggcaagaccggaccaccgggaccaccaggagtggtggggccccagggcgcagccggggaaaccgggcccatgggtgaacgcggacacccagggccccccggtccccctggcgaacaaggactgcctgggaccgcggggaaagaaggcacaaagggtgacccaggccccccaggagcccctggtaaagacggacctgccggactaaggggcttcccaggggaacggggcctgcccggcacagccgggggtccgggattaaagggaaacgaaggaccgtctggtccaccaggccctgcaggctcacccggtgagaggggagccgccggtagtggcggccccataggccctccagggcggccgggccctcaaggaccaccaggagccgccggggaaaagggggttcccggcgagaaagggcccattggcccaaccggccgcgatggagtccagggccctgtcggactgcctggccccgccgggcccccaggcgtagctggtgaagatggggataaaggtgaggtaggggaccctgggcagaagggtacaaagggcaacaaaggagaacacggtcctccaggtccccctgggccgatcgggcctgtggggcaacccggcgcggccggtgctgatggcgagcctggcgcccggggaccccagggacatttcggtgctaaaggcgacgaaggcaccagaggctttaacgggcctccgggacctatcggtctgcaggggttgcccggcccttctggggaaaaaggggagactggggacgtgggccctatgggccccccgggcccccccggacccagaggaccagcaggtcccaacggtgccgatggcccccagggcccacccgggggagtcgggaatctcggcccacctggcgaaaagggtgaaccaggggaatccggcagcccaggcatacagggggagcccggggttaagggcccccgcggagagcgcggcgagaagggcgaaagcggacagcccggagagcccggaccccctggtccaaaaggtcccacgggagacgatggccctaagggtaatcccgggccagttgggtttccaggagaccctggaccgccaggcgaaggagggccccgggggcaggacggcgcgaagggtgaccgaggcgaggacggcgagccagggcagcccggtagtcccgggcctacaggggagaatggaccacctgggcctttaggaaagagggggcccgccgggtccccgggctcggagggaagacagggtggcaagggcgctaagggagatcccggagcgatcggcgccccaggaaagacgggtcctgtggggccagcaggccccgcaggtaaaccaggccccgatggcctgcgtggactccccggcagtgtgggtcagcagggcagacctggcgccacaggtcaggccgggccacccggcccagtcggacctcctggtcttcccgggctacgcggcgatgctggagctaaaggtgaaaaaggccatcccggcctgatcggcctgatcggccctccaggagagcaaggagagaaaggagaccgcggtctgcctggaccccagggcagccccgggcagaagggtgaaatgggaattcctggggccagcggccctattggacccggcgggcctcctggacttcctgggcctgcgggccccaagggagctaagggggcaactggaccaggtggacccaagggggagaaaggcgttcagggcccgcccggccaccccggccctccaggtgaggtgatccagcccttaccaattcagatgcccaagaagactcgcaggtcagtggatggatcacgtcttatgcaagaagacgaggccatcccgaccggcggggccccgggaagtcctggtggtttggaggaaatattcgggtccttggattccttaagagaggagatcgaacagatgcgaagacccactgggacccaggattcccctgcccgtacctgtcaggatctgaaactgtgccatcctgagctgccagacggggaatactgggtggacccgaaccaggggtgcgcaagagacgcattccgcgttttttgtaacttcaccgctggcggggaaacatgcgtgaccccacgcgacgatgtgactcagtttagctacgtggatagcgagggttctccagtcggcgtggtgcagcttacatttctcaggctgttgtcagtttctgcccatcaggacgtgtcatacccatgtagtggggccgcgcgcgacggccccctccgtctgcggggggctaatgaagatgaactaagcccggagactagtccttacgtgaaggaatttagggacggatgccaaacccagcaaggcagaacggtcttagaagtgcggactcccgtgctcgagcagttaccggtgttggatgcaagcttctctgatcttggcgcacctcctaggagggggggagtgctcttgggtcctgtatgcttcatggggtag

SEQ ID NO: 2603 - DNA, 921 bp, Artificial Sequence
  Description of Artificial Sequence: Synthetic coding sequence
atggattggagggctagcgaggcctggatggtgccacgcgctccaaagggcgcctgggatcctcgtgaatcccaggacctcctcgataaccgcgccccactgggcccccgcgtgtttcccgggccccgggtcccttccgcgctgatggaacgccgcgtcttgaaaggctcgcagggctcaccagcctgtcctggacccccaggtgaggttatccagcctcttcccatccagatgccgaagaaaacacgtagaagtgtggatgggagtaggttgatgcaagaggacgaggccattcccaccggaggcgctcctggctcccctggcggactggaggaaatctttggctcattggatagcctgagagaggagatcgagcagatgagacggccaacaggcacacaggacagtcccgcgcgtacttgtcaggacctaaagctatgccatccggagctacccgatggcgagtactgggtagatccaaaccaggggtgtgcccgcgacgcgttccgcgtcttctgtaacttcacggccggaggtgagacctgcgtgacaccccgagacgacgtcacgcagttcagctatgtggactcggaaggctcccccgtaggagttgtgcagcttactttcttgaggcttcttagcgtcagcgcacaccaggatgtgtcatatccttgctctggagctgctcgtgacggacctctgcggctaagaggtgccaatgaggatgaattgtcaccagagaccagcccctacgtcaaggagttccgggatggctgccagactcagcagggtaggactgttctggaagttaggaccccagtgctggagcaattaccagtgctagacgctagcttctcggatctcggagcccctcctcgaaggggaggtgttttacttggacccgtgtgttttatggggtag

SEQ ID NO: 2604 - DNA, 5211 bp, Artificial Sequence
  Description of Artificial Sequence: Synthetic coding sequence
atggaacgctgttcacgctgccatcggctgctgctattgctgcccctggtgcttggactgtcagccgctccagggtgggccggtgcaccccctgtcgacgtcctgcgtgcattgagatttccgagccttcctgatggcgtgcgccgggcaaagggaatctgtccagcggatgttgcctaccgagtggctcgccccgcccaactctcggctcctacgcggcagctcttccccggaggatttcctaaggacttttctctactgaccgtcgttcgcacaaggcccgggttacaggctccacttctgactctgtactcggctcagggcgtccgccagctcggattagagctcggaaggccagtgcgcttcctgtacgaagatcaaaccgggcgtccgcagcccccttcacaacctgtgtttcgaggtctctcactggcggatggtaaatggcacagagtcgccgtcgctgtgaagggccagtccgtcaccctgatagtcgattgcaaaaagagagtgactagaccactgcctcgtagtgcccgccctgtattagacacacatggcgtgattatttttggagctcggattctggacgaggaagtgtttgaaggggacgtgcaggagctggctattgtacctggtgtccaggccgcgtatgaatcttgtgaacaaaaggagttagagtgcgaaggcggccagagagagcgccctcagaaccagcagcctcaccgcgcccagcggtctccccaacagcaaccgtcacggctgcaccgcccacagaaccaggaaccccagtctcagcctaccgagtccctttattacgactatgagccaccctactacgatgtcatgacaacaggcactactccagattaccaggacccaactcccggcgaagaagaggagatcctcgagagttcactgctcccaccccttgaggaagagcagactgacctgcaggttccccctaccgcagatagatttcaggcggaagagtatggcgaaggcggaacagacccaccagaaggaccctacgactacacatatgggtacggggatgattacagggaagaaacagagcttgggcccgcgctgtccgcagaaaccgctcactcaggcgccgccgcacacggcccacgcggcttgaaaggtgagaaaggcgaacccgcggtgcttgaaccaggcatgctggtggaggggcctccaggacccgaagggcctgctgggttgatcggcccccccgggattcaggggaacccaggtccagtgggagacccaggagaaaggggacccccagggagagcaggcctgcctggtagcgacggcgctccaggaccccccggaacaagcctgatgcttccgtttcggttcgggagcggcggcggagataagggacccgtcgtagctgcccaggaggcacaagcccaggccatcctccagcaggctcgactcgccctcagaggtcctccaggcccaatgggttatactggtaggcctgggccactggggcagccgggctctcccgggctgaagggtgaatccggggacctggggcctcagggtccccgagggccacagggcctcacgggcccaccaggcaaggctggacgcaggggccgtgcaggggccgacggggcgcgaggaatgccaggagaccctggcgtgaaaggggaccgcggatttgacggtctccctgggctccctggcgaaaaggggcacaggggtgacactggagcccagggcctgcccggcccaccaggagaggacggtgagagaggcgatgatggagaaattggaccccgcggcttgcccggtgaatctggacctcgggggcttctcggaccaaagggaccgccaggaatcccaggcccacccggtgtgcgtggaatggatggcccccagggcccaaaaggttctctgggtccccagggggaaccaggcccacccgggcagcagggcactccaggcacacagggcctaccgggaccccagggggctattgggcctcatggagaaaagggtcctcagggcaagccaggcctccccggaatgccaggcagtgacgggccgccaggccacccgggcaaggaagggccccccggcactaaaggcaaccagggtccaagcggcccccagggccctctcggatatcctggtccaagaggggtgaagggtgttgatggcatcagaggtctcaagggccataagggggagaagggagaggacggctttcccggattcaaaggggacataggagtcaagggggatcgtggggaagtgggagtaccagggtctcgcggggaggatggtcccgagggtcctaagggcaggactgggcccactggagacccagggcctccagggttaatgggcgagaagggtaaattaggggttcccgggctgccgggctacccgggaagacagggtccgaaaggcagcttggggttcccgggcttccctggggcctcaggcgaaaaaggcgcaagaggcctgagtgggaaaagtggtccaagaggtgaacggggccccaccggcccacggggccagcgtggtccccgaggcgccacaggcaaatccggggccaaaggcacctctggcggtgacggcccacatggacctcctggggagaggggactgcctggccctcagggtccgaacggcttccccgggccaaagggaccgcccggccctccaggcaaagatggtcttcccgggcatcccggccaaaggggcgaggtgggattccaaggaaaaacagggccacctggtcctcccggagtggtgggaccccagggcgcagccggcgaaaccggcccaatgggagaaagagggcacccagggccccctggacctcccggcgagcaaggcctgccggggactgcagggaaggaaggaacgaaaggcgatccgggccccccaggcgcgcctgggaaggacggacccgcaggtcttcggggcttccccggtgaaagggggctccccggcaccgccggtggtcccgggctgaaagggaacgagggcccaagcggcccccccggcccagcgggctccccaggtgagcggggcgcggccgggagtggcggaccgatcggtccccctggccgacccggccctcagggcccccccggcgctgctggcgagaagggggtgcctggcgaaaagggccccataggtcctactgggagggacggcgtccagggacccgtggggcttcccggtccagcggggccacccggagttgcgggagaggatggtgacaaaggagaggtgggcgatcctggccagaaagggaccaagggaaacaagggcgagcacgggcccccagggccccccggcccgatcggcccagttggtcagccaggcgccgctggtgccgacggcgagccaggcgctcgcgggcctcaggggcatttcggcgcaaaaggtgatgaaggcactcggggcttcaacgggcctccaggtcccattggactccaggggctgcctggcccgtctggagagaaaggggaaactggggatgtcggtcccatgggcccgccgggccctcctggccctcgaggcccggccggaccgaacggagccgacggcccccagggcccacccggcggtgtgggaaacctgggcccgcccggcgaaaagggggaaccaggcgagagcgggtctccggggatccagggcgagccaggggtgaaaggcccaaggggagagcggggagagaaaggggagtctggtcagcctggcgaaccgggtccacccgggcctaaggggcctacaggcgatgatggcccaaaaggcaaccccgggccagttggtttcccaggggacccaggcccccccggggaaggcgggcctaggggccaagacggcgccaagggcgatcggggggaggacggagagcctggacagcctgggtcccccgggccgactggcgaaaacggaccacccggaccactggggaagagagggcctgctggcagcccggggtcggaggggcgccaaggcggaaagggggcgaaaggggaccctggtgctatcggtgctcccggaaagaccgggccagtgggacccgccggccctgctggcaagccaggtcctgacggcttgaggggcttacccggaagcgttggccagcaaggccgcccaggtgccaccggccaggcgggaccacccgggcctgttggaccccctgggctcccagggctcaggggagacgccggggcaaaaggggagaagggtcatcccggactcattggcctgattggaccccctggtgagcagggtgagaaaggcgatcggggattgcctggaccacaaggcagcccggggcagaagggggagatgggtataccaggcgcttccggcccgattggcccaggcggtcctcctggattaccgggacctgccggacctaaaggggctaaaggggccactggtcctggtggacccaaaggtgaaaaaggagtccagggtccccccggccaccctgggccccccggggaggttattcagcctctgccgattcagatgcctaaaaaaacccgtaggtctgtcgacggctcacggctgatgcaggaggatgaagcaatccctacaggcggcgcccctggcagcccaggagggctcgaagagattttcggaagcctggacagcctcagggaagaaattgagcagatgcgacgcccgactggaactcaagacagtccagctcgaacctgtcaggacttgaagttgtgtcaccctgaattgccagatggcgagtactgggttgaccctaaccagggctgcgcccgggatgccttccgcgtcttctgtaactttacagccggaggcgagacctgcgttacaccaagagatgacgttacccagtttagctacgtggatagcgagggttcaccagtgggtgttgtacagctcacttttctgcggctgctgtcggtgtctgcacaccaagatgtgagctatccctgcagcggggcggccagagatggtccactgagacttagaggcgccaatgaagatgagcttagccctgagacttcaccatatgtcaaggagtttagagacggttgtcaaactcagcaagggcggactgtactggaagtcagaactcccgtattggagcagcttcctgtgctggatgccagtttctctgacctgggcgcccccccaagacgcgggggcgtgctgctgggcccggtctgtttcatgggttag

SEQ ID NO: 2605 - DNA, 921 bp, Artificial Sequence
  Description of Artificial Sequence: Synthetic coding sequence
atggattggagagcatcagaggcttggatggtgcccagagctccgaagggggcctgggacccacgggagagccaggaccttcttgacaacagggctcccctgggccctagagttttccccgggccgagggttcccagcgccctgatggagcggagggtcctaaaggggagtcaaggcagcccggcgtgcccggggcccccaggcgaggtgattcagccactaccaattcagatgccaaaaaagacacggcggtctgtggatgggagcagactcatgcaggaggatgaggcaattcctacagggggagctccggggtctcccgggggtctggaggaaatctttggtagtctcgactctctgcgagaagaaatcgagcagatgagacggccaaccggtacacaggatagcccagcacggacgtgccaggatctgaaactatgccaccctgaactgcctgacggggagtactgggtggaccccaatcaggggtgcgcgcgcgacgcttttagggtgttttgcaatttcacggcggggggagaaacatgcgtgaccccaagagatgacgtgactcagtttagctatgtggatagtgagggctcaccagtgggcgtggtccagctcaccttcctgcgcctcctgtcagtgtcggcccaccaggatgtatcttacccctgcagtggcgccgcaagagatggaccccttaggctcagaggtgcaaacgaggacgagctaagccctgagacatctccatacgtgaaggagttccgggacggatgccagacccaacaggggcggaccgttctcgaagtgcgcacacctgtgctggagcagctgcccgtgttggatgcaagtttcagcgatctgggagcacctccacggcgcggtggcgtattactgggccccgtgtgcttcatggggtag

SEQ ID NO: 2606 - DNA, 5070 bp, Artificial Sequence
  Description of Artificial Sequence: Synthetic coding sequence
atggagaggtgtagtaggtgccaccgactactgctactgctccctctggtcctgggcctctccgccgcccctggctgggcgggagcaccacctgtggacgttcttagggcactgcgatttccgagtctgcctgatggcgtccggagagctaaggggatttgtcccgccgacgtggcttacagagttgccagacctgcacagcttagcgccccaacaagacagttatttcccggcggcttcccaaaggacttctctctactgactgtggtcagaacacgacctggactgcaagcccctttactcactctttattctgctcagggcgtgcgccagcttggactggagctgggtcgcccagtgcgtttcctatatgaagatcagactggaaggccccaaccaccctctcagccagtctttcgcggtctcagcctcgcagatgggaagtggcatagggtggcggtagctgtgaaagggcaaagcgtcactttgatagtggattgtaagaagcgggtgactaggccactgccacggtccgcgaggcccgtactggatacccacggcgtcatcattttcggcgctaggatcctggacgaggaagtgttcgagggcgatgtgcaggaactcgccatcgtgccaggagttcaggcagcgtacgaaagttgcgagcagaaagaactggagtgcgaagggggtcagagggaaaggccccagaaccagcagccccatagagcacagcgctcaccacagcaacagccctctcgactgcatcggccgcagaaccaggaaccccagagtcaagaacagacagacctgcaagttcccccaaccgcagacagattccaagcagaggaatacggcgaaggcggtaccgacccccctgaaggcccatatgattatacctatggatatggcgatgattacagggaagaaacagagttgggacccgctttgtcagccgagactgcacatagtggggctgccgctcacggccctagaggcttaaaaggagaaaagggagagcctgcggtgctcgagccaggaatgctggtggaagggccacctggtccggagggccctgctggcctcattgggcctcctgggatccagggtaatcctggacccgtaggagatccaggcgaacgagggccacccgggagagcaggcctgcccggttcagacggggcgcctggcccccctggtacatccctgatgttaccgtttcgtttcgggagcggagggggagacaaggggccagtggtcgctgcacaggaggcgcaggcacaggccattctccagcaggcccgtctggccctgcggggaccacctgggcctatgggatacaccggcagaccaggccctcttgggcagcctggctcacccgggctgaagggagaaagcggcgacctcggcccgcagggtccaagaggtccccaagggttaacaggacctccgggcaaggcggggaggagagggcgtgcaggggccgatggagctcgcggaatgcctggtgacccaggtgtgaaaggcgatcgggggtttgacggtctgccagggcttccaggcgagaagggacataggggggatacaggtgctcagggtctcccgggaccccccggagaggatggtgaacgtggagatgacggggaaatcgggcctaggggcctgcccggggagagcggcccaagggggctgctcggccccaaggggccgcctggtatccccggaccaccgggggtacggggtatggacggaccccagggtcccaagggcagcctgggtccccagggggagccgggccctccgggtcaacaaggcacacctggtacccaaggactccccgggccacagggagcgattggcccgcacggtgaaaaggggccccagggcaagcctgggctcccaggaatgcccggatccgatgggcctcccggacaccctgggaaggaaggccccccgggtactaaaggtaaccagggcccctccgggcctcaaggaccgctgggttatcccggtccaaggggcgtcaaaggggtcgacggtatcaggggcctgaaaggccacaagggcgaaaagggagaagacgggttcccgggttttaagggcgacattggtgtaaaaggagaccggggggaagtgggggtgcccggcagcagaggcgaggatggacctgaaggacccaaaggaagaaccgggccaactggagatccaggaccacccggactgatgggcgagaagggaaagctgggggtccctggtctgcccgggtatcccggccgccaggggcccaaaggaagtcttggatttccaggctttccaggggcttcaggagagaagggcgcccgcggcctgtcgggcaaaagcggacccaggggagaaagaggcccaacgggtcctcgcggacagcgggggccaaggggggctacgggaaaaagcggagccaagggcaccagtgggggcgatggtccccatggtcccccaggagaacgtggcctgcctgggccgcagggaccgaatggcttccctgggcccaagggcccaccaggcccacctgggaaggacggcttgcccggacacccggggcagcgcggagaagtggggtttcagggaaaaacagggccacccgggccacccggcgtggtcggacctcaaggggcagccggcgaaaccggccccatgggtgagcgcggccacccaggcccgccgggcccacctggcgagcaagggctgcccggcacggcagggaaggagggtacgaagggcgatcccggtcctcctggcgctccaggcaaggatgggcccgccgggctccgaggctttcctggagagagaggcttgcctggtaccgcagggggtccaggcctcaaaggtaatgagggtccaagcgggccacccggcccggcagggtcacctggggagaggggggcagcaggatccggggggcccatcggtccacctggtcgccctgggcctcaaggccctcccggcgctgccggggagaagggcgtgcccggcgagaaagggcctatcggacccacgggtcgggacggtgttcaaggccctgtaggcttgccagggcctgcgggacctccaggggtggcaggcgaagacggcgacaagggggaggtgggcgatccaggccagaaagggacaaagggcaacaagggagaacatggccctcctggacccccaggcccaattggtcctgtgggacagccaggagccgctggcgcagatggagagccaggtgcccgtggtcctcaggggcattttggtgccaagggggatgagggcactcgaggcttcaatggacctcccggtccgattggactccaagggttacccggacctagcggcgaaaagggagagacaggcgacgtgggcccaatgggtcctcctggcccccctggacctagaggccctgctggtcccaacggcgccgatggaccccagggacctccaggcggagttggaaacttaggccccccaggggaaaaaggtgagcctggtgagtctgggagccccgggatccagggcgaacccggcgttaagggaccaaggggggaaaggggcgaaaagggcgagagcggtcagcccggggaacctggtccccccgggccaaagggtcctacaggtgatgatggcccaaagggaaatcctgggccggtggggttccctggcgacccaggtccgcccggggaagggggccctagaggccaggacggagcaaagggcgatcgaggagaggatggagagccgggacagccaggttcaccgggccctacgggcgagaacggcccacctggtcccttaggcaagagaggcccggcggggtcacctgggagtgagggccggcagggggggaagggagccaaaggcgacccgggcgccatcggagcccctggaaagacaggcccagtagggcctgccggtcccgcaggcaagccgggccctgacgggctcaggggcctgccgggctccgttggccagcaaggtaggccaggcgcgacggggcaagccggaccgcccggaccagttggcccacccggactgcccgggctacgcggagacgccggagctaagggcgagaagggtcaccctggcttgataggcctgattggaccgcctggggagcagggagagaagggtgaccgcggccttcccggaccccaggggtcccccggccagaagggcgagatgggtatccctggcgcaagcgggcccataggaccaggaggtcctcccgggctgcctggccccgccggcccaaagggggcaaaaggtgcaactggtccaggaggacccaaaggcgaaaagggcgtccaagggccccctggtcatccagggcccccgggtgaggttattcagccgctgccaatccaaatgcctaaaaagacccgaagatcagtcgatgggtccaggctgatgcaggaagacgaagcaatcccgacgggcggcgcgcctggaagtcccggtggactggaagaaatcttcgggagtctggattctctccgagaggagatagaacaaatgcgcagacctacagggacacaggatagccccgcccggacctgtcaggacttaaaactgtgccatccggaactgcctgacggtgaatactgggttgatccaaaccagggatgtgcccgggatgcctttcgcgtcttttgtaattttacagccggcggagagacttgcgttactccccgagacgatgttacccaatttagttacgttgattctgaaggcagccctgtgggcgtcgtacaactaaccttcttgcgactcctgagcgttagcgcacatcaggacgtgtcttatccatgtagcggcgccgcacgtgacggccccctgaggttgagaggagcgaacgaggatgaactgtcccctgagacgtctccttacgtgaaggagtttcgggacggttgtcaaacacagcaaggccgcaccgtcctggaagttcgcactcctgtgctggagcagctacccgtcctcgacgcatccttttctgatctgggcgctccaccaagaaggggcggtgtgcttctggggccagtttgttttatggggtag

SEQ ID NO: 2607 - DNA, 4890 bp, Artificial Sequence
  Description of Artificial Sequence: Synthetic coding sequence
atggagcggtgctcacgatgccatcggctgctcttactgctgccactggtactgggcctgtcagccgccccgggctgggctggggcgccaccggttgatgtgctcagagccctgcgcttcccctcactgccagatggggtgaggagggctaaaggcatctgtcctgcagacgttgcttacagggtcgcccggcccgctcagctgtctgctcctacaaggcaacttttccctgggggcttcccaaaggatttttctctgctgacagtggtgcgcactcgacccgggctccaggccccactgctgaccctgtattccgcccagggggtgcggcagctggggctcgaacttggaccacccgtgagattcctctacgaggatcagaccgggaggccccagcccccgtcccagccggtgttccgcgggctgagcctggcagatgggaagtggcatcgggtggccgtggccgtgaaggggcagtctgttacactcattgtggactgtaaaaaacgtgtcacccgacctctcccccgtagtgctcgccccgtcctggatacacacggtgtaataatctttggcgcccggatcctcgacgaagaggtgtttgagggcgacgttcaggagcttgccatcgtgccgggggtccaggctgcctacgaaagttgtgagcagaaggagctggagtgtgagggcggccaacgagagaggccgcagaatcagcagccccatagagcgcagaggagcccacagcagcagccgagcagactacacagacctcagaatcaggagcctcagagtcaggccgcacatggtccccggggcctgaaaggtgaaaaaggagaacccgctgtcctcgagcctggcatgttggttgaaggcccacccgggcctgagggccctgccgggcttattggaccccccggcattcagggcaatccaggacccgtaggggaccccggagagcgcggtccaccaggccgtgctggtctgcccggaagtgacggcgcacccgggcctccgggaactagtctgatgctccccttcaggttcggttctggaggcggggacaagggaccagtcgttgcagcgcaggaagcccaggctcaggctattctccagcaagctcgcctggccctgcgcgggccgcccggccctatgggctacaccggaagacctggcccactgggacagcctggctccccaggcctgaaaggtgaatccggtgatctcggcccacagggcccgaggggcccccagggcctgaccggccctccaggcaaagcaggtaggcggggaagggctggcgccgatggcgctcgcggcatgcctggagaccccggagttaagggcgatcgcggttttgacggtctgcctggcttgcctggcgagaagggacatcggggggacacaggcgcccagggcctcccaggaccacctggagaagatggcgagagaggggatgatggcgagatcggaccccgcggactgccaggcgaatccggaccacgggggctgctgggccccaaaggcccgccggggatcccaggaccccccggagttagaggaatggacgggcctcaaggaccaaaaggatcgctgggccctcagggggagccgggtccaccgggccaacagggtacccccggcacgcagggactacctggtccacaaggagccatcgggcctcacggagaaaagggaccacaggggaagcccgggctgcctggcatgccaggatccgacggcccccctggacaccctggcaaagaagggcctcctgggacgaagggtaatcagggcccctcaggtccgcagggcccactcggatatccaggtcctagaggggtgaagggagtggacggaatccggggactgaagggccataagggcgaaaaaggggaggatggctttccggggttcaaaggagatataggcgtcaaaggcgatcgcggtgaggttggcgtccctgggtcaaggggcgaggatggccctgaggggccaaagggcagaacgggtcccacaggcgatcctggccccccgggactgatgggcgaaaaaggcaaactaggtgtgcccggcctgccagggtacccagggcggcagggccccaagggatcccttggcttcccaggattccctggggccagcggagagaagggagctagaggcttaagtgggaaatccggtcctagaggtgaaagaggtcccacaggaccacgcggacaaagaggcccacggggcgccacaggaaagtccggtgcaaaaggcacaagtggtggcgacggaccgcatggcccgccaggcgaacgcggactgcctggccctcagggacctaacggattccctgggcctaagggccccccaggaccgccggggaaggatgggctccctggccaccctgggcagcggggagaggtgggcttccagggaaagacgggacctcctggcccacccggggttgtgggccctcagggagctgccggggaaaccggaccaatgggagaacggggacaccccggtccgccaggccctcccggtgagcagggcttgccgggcactgcagggaaagaaggaacgaaaggcgatcctggacccccaggcgcccctggaaaagacggtccagccggactgcgaggctttcccggagagaggggactgcccgggaccgctggcggcccaggtctcaagggcaacgaaggcccgtctggcccgccggggccggcgggttcacctggtgagcgaggggccgcaggaagtggggggcccataggaccaccaggccgccccggcccccagggcccgcccggagccgccggcgagaagggggtccccggggaaaaaggccctatagggccaactgggcgagatggggtgcagggtcctgtgggcctaccaggccccgctgggccccctggggtcgctggggaggatggtgacaaaggtgaggtgggcgaccccggacaaaagggtacgaagggtaacaagggcgaacatggacccccgggtcctcctggcccaattgggccggtgggccagcctggggccgctggagccgacggggagcctggtgcgcgtgggccacagggacatttcggtgccaagggggacgagggaactcgcggctttaatgggccaccaggaccaataggcctgcaggggcttcccggcccgtccggcgaaaagggggaaaccggtgacgttggcccgatgggacctccaggccctccagggccacgaggccctgcagggccgaatggtgccgacggcccgcaggggcccccggggggcgtgggaaacctggggccacctggagagaagggcgagcctggcgagtctggctccccggggatccaaggtgagcctggggtgaagggtccccggggcgagcggggcgagaaaggggagtccggccaaccaggtgaaccaggacctcctggacctaagggacccactggagatgacggccctaaaggtaatccggggccagtcggctttccaggagatcccggcccccccggtgagggaggtcctaggggccaggacggggcaaagggagatagaggcgaagatggcgagccaggccagcctgggtcccccggccccactggagaaaatggaccaccaggacccctgggcaaacgaggcccggcagggagtcccggtagcgagggcaggcaaggtggtaaaggtgcaaaaggagaccctggcgcaatcggagcccctggcaagacaggccccgttggaccagccggacctgctgggaaacccggacccgatggcctacgaggtctcccgggatcagtcggccagcaaggtcgtcctggcgcaacaggtcaagccgggccccccggaccagttggacctcctgggctgccaggtctgcgcggggacgccggagccaagggcgagaaaggacacccggggctgattgggttgatcggaccacctggggaacagggcgagaaaggggatcggggtctgcccgggccccaggggtctccgggccagaagggtgagatgggcatacctggcgcatcaggtcctattggtcctggcggccctcccggcctgcctggcccagctggaccaaaaggagccaagggagcaactggacctggaggtccaaagggagaaaagggcgtgcaaggaccccccggccatccaggtcctcctggggaagttatacagcccctgccaatccagatgccaaagaaaactcgacggagtgtggacggaagcagattgatgcaagaagacgaggccatcccaactgggggagccccgggcagtccggggggtctggaggagatcttcgggtccttagattcgctgagggaggaaattgaacagatgcggaggccgaccggaacccaggatagcccagcccgcacctgccaggacttaaaattgtgtcacccagagctccctgacggtgagtactgggtcgaccccaatcagggatgcgcaagagacgcattcagagtcttttgtaatttcactgccggcggtgaaacttgtgtaaccccccgtgatgacgtgacccagtttagctacgtagattccgagggcagccccgtcggagttgtgcaacttaccttcttgagactgctaagtgtctcggcacaccaagacgtgagctacccttgctctggtgctgcccgtgacgggcctcttcgtctgcgcggcgcaaatgaggacgagttgtcaccagagactagcccctatgtgaaagagttcagagacggctgccaaacacagcaggggaggacagtcttagaggtccggacgccggtgcttgaacaactgcccgtgctcgacgcgtccttttctgatctgggggcaccgccgcgtaggggcggcgtacttctcggccccgtttgcttcatgggttag

SEQ ID NO: 2608 - DNA, 4890 bp, Artificial Sequence
  Description of Artificial Sequence: Synthetic coding sequence
atggagcgatgctcccgctgtcaccgtctgctgctcctcctgccacttgtgcttggactgagcgccgcccctgggtgggcaggcgcccccccagtggacgtgctcagggctcttagatttcccagtctcccagacggagttagaagggctaagggcatttgccccgctgacgtagcgtaccgtgtagccagaccagcacagctcagcgcccctactcgtcagctgttcccgggcgggttccccaaagacttttccctcttaactgtggtgcgaaccaggcccgggctccaggcccctcttctgaccctgtactcggcgcaaggggtcaggcagctgggactggagctgggacggccggtgaggttcctgtatgaggatcagaccggcaggccccagcccccctctcagcctgtgttccggggcctatctcttgcggatgggaagtggcaccgcgtcgccgttgcggtcaagggtcaatctgtgaccctcatagttgactgtaaaaagagagtaaccagaccactcccacgttccgcccgcccggttcttgacacgcatggagtcattatatttggcgcccgcatcctggacgaggaggtcttcgagggggacgtgcaagagctggctatcgttcccggggtgcaggccgcttatgagtcatgtgagcaaaaggaattagaatgtgaaggcggtcagagggaacggccccaaaaccagcagccccaccgggcgcaacgctccccacagcaacagccatcccggttacaccgcccgcagaatcaggagcctcagagccaggccgctcatggcccgaggggcttaaaaggcgaaaagggcgagcccgctgttctagaacctgggatgctggtggagggtccacctggccccgagggtcccgcgggactgataggccctcccgggatccagggcaatcccggcccggtcggagaccctggagagcggggaccccccggtagagctggcctgccaggatcagacggggcaccaggcccaccaggcacaagtctgatgctgccctttaggttcggtagcggcggaggagataaagggcctgtcgttgcagctcaggaggcacaggctcaggccattcttcagcaggcgcgcttggccctgaggggaccccctggcccaatggggtatactgggcgcccaggtccgctcggtcagcctgggtcccctggcctgaagggggaaagtggggacctgggtccacagggaccacgcggacctcaggggctgaccggcccgcccggaaaagccggtcggaggggaagagctggtgcggacggagcccgcgggatgccaggagacccaggggtgaagggggataggggtttcgatggcctgcccggactaccaggggagaaggggcaccgaggggacacaggcgcacagggccttcccggacccccaggtgaggatggcgagcgcggcgacgacggtgaaatcggcccacgtggactgcccggggagagtggcccccgtgggctcctcgggcccaagggccctcccggaatccccggccccccaggagtgcgaggtatggacggcccccaggggcccaaaggaagcctgggcccgcagggagaaccggggccccccggccaacagggaactcctgggactcagggactcccaggcccccagggcgccatcggccctcatggagaaaaaggcccacaggggaagccggggttacccgggatgccaggatcagatggacccccgggccacccgggtaaggaggggccgcccggaactaagggaaatcagggacccagcggacctcagggacccctgggctatccgggccctcggggggttaaaggtgtagacggtattaggggactgaagggacacaagggcgaaaagggcgaagacggtttccctggtttcaaaggggatatcggagtaaagggggacaggggggaagtcggagttccaggtagccggggagaggacggccctgagggtcctaaaggtaggacaggaccgactggggacccaggcccaccaggacttatgggggagaagggaaagctcggggtgccaggcctacccgggtacccgggtaggcagggtcctaaggggtctctcggcttcccaggtttcccgggggcctccggcgagaagggtgcaaggggtctgtccgggaagtccggccccagaggcgaacgggggccaactggccctcgcgggcagaggggacctcgaggtgccaccggcaagtccggagcaaagggtacctccggaggagatggtccacacggaccccctggagagagaggcctgcctggtcctcaaggccctaacggcttccccgggcctaagggtcccccgggccccccgggaaaagacggtcttccaggccatccgggtcaaagaggggaagtggggttccagggcaagacgggacctccaggacccccaggagtcgtgggaccccaaggggccgccggagagaccgggcccatgggcgagaggggtcatccagggcccccaggaccaccgggggagcagggcctccccggtaccgccggaaaggaaggaaccaagggcgaccctggcccaccgggcgctcctgggaaggatggaccagccggcctccgaggatttcccggcgagcggggacttccaggtactgccggaggtcctggcctaaaaggtaacgaaggacccagcggccctccaggcccagctggcagcccaggagaacgaggggccgccggatcaggagggcccatcggcccaccaggaagaccaggaccgcaaggcccccctggtgcagccggtgagaagggggtgccgggagaaaagggcccgatagggcccacaggacgcgatggtgtacaggggcctgtgggcctgcccggccctgcaggtccacctggtgttgccggagaagacggagataagggtgaagtgggcgatccgggtcagaagggcacaaagggaaataagggggaacacggcccaccgggtcctcccggcccaatcggccccgtcggccaaccgggagccgcgggagctgatggggagccaggagcccgagggccccagggccactttggtgcaaaaggtgacgaggggaccagggggtttaatggacctcctgggcctataggactacagggcctccccggaccatcaggggagaagggcgaaaccggggacgtcggacccatggggcctcccggacccccggggccccgtgggcccgccggaccaaatggcgcagatgggccccagggaccacccggaggcgttgggaacttggggccgcctggcgagaaaggcgagcctggagaatcaggctcccccggcattcagggcgagcccggcgtcaagggacctaggggggaacgaggcgagaagggggagtctggccagccaggcgagcccgggccgcctggtccaaagggtccaaccggtgacgatggccccaagggaaatcccggtcctgtggggttccccggtgatccaggcccgcccggcgaggggggacctagaggccaagatggagctaagggcgacagaggggaggacggtgagcctgggcagccgggatcccctggccccaccggggaaaatggtcccccgggtccccttggaaagaggggtccagccggctcccctggatctgaagggaggcagggcggcaaaggagccaagggagacccgggcgctattggcgcccccggtaagaccggacctgttggaccagcagggccagccggaaaacccggtccagatggactgcgtgggttacctgggagtgtggggcagcaaggccggcctggggccaccgggcaagcagggccacctggtcccgtcggcccaccagggcttcctggcttgaggggcgatgccggcgccaagggagagaagggacaccctgggttaattgggttgatcggtcctcccggcgagcagggggagaaaggtgacaggggcctcccaggcccacaggggtccccagggcagaaaggagagatggggataccaggagcttcgggccctattgggcccggcggaccaccaggtctgccagggccagccggacctaaaggtgctaaaggtgccaccggccctggcggccccaaaggtgaaaaaggggtgcagggaccacccgggcaccccgggcctccaggagaggtgattcaaccattgccgatacaaatgcccaagaagacacgcaggagcgtggacggctccaggctaatgcaggaggatgaagccatacctaccgggggagcgcccggtagtccgggcgggctggaggagatttttgggagtttggactcgctccgggaggagattgaacagatgcggagaccaacgggcacacaggattcccctgctcgtacatgtcaagacctgaaactttgccatccggagttacccgacggcgaatattgggtggacccgaaccaaggatgcgcccgagatgcctttcgagtcttctgtaactttacggccggtggcgagacttgcgtgacaccccgggacgatgtcacacagttttcctacgtggatagtgagggtagccccgtcggagtagttcagcttacattcctacggcttttgtctgtgtccgcccaccaggacgtgtcatacccgtgttccggggccgcccgcgacggccccctacggctccggggggcaaatgaagatgagctttcacctgagacgagcccgtacgtcaaggagtttcgggatggttgtcagacacagcagggaaggactgtgcttgaggtgcgcactccagtgctggagcaactacccgtgcttgatgcgtccttcagtgacctgggcgcgccaccacgacgtgggggggtgctattgggaccagtatgtttcatgggatag

SEQ ID NO: 2609 - DNA, 5133 bp, Artificial Sequence
  Description of Artificial Sequence: Synthetic coding sequence
atggagaggtgtagtaggtgtcatagacttctgcttctgctgcctcttgttttgggactctccgcagctccaggttgggccggagcccctcccgtcgatgtgctgcgagctctgaggttcccgtcactccctgatggagtgaggcgcgccaagggaatctgtccagcggatgttgcttaccgcgtggcccgaccagctcagctctccgcccccaccagacagctctttcctggtggattcccgaaagacttctctctgctgactgtagtcagaacccgccccgggttgcaggctcctctgttaaccctgtactctgcccagggagtgcggcagctcggtttggaactgggaagaccagtgcgctttttatatgaagatcagactggacgcccacagcccccttctcaacccgtctttcgcggtctatccctggctgatgggaaatggcaccgtgtggcggtggccgtaaagggccagtctgtgactttaatcgtggattgtaagaaaagagtaactcgccctctgcctcgctctgctaggccagtgcttgatacacatggggttatcatatttggcgcaagaattttggacgaggaggttttcgaaggcgatgtgcaggagttagccatagtgcccggcgtgcaggccgcctatgagagttgtgaacagaaagagcttgaatgcgaaggaggccagagggaaaggccccagaaccaacagccccatcgcgcacagaggtcccctcagcaacagcctagtcggctgcaccgcccacagaaccaagaaccccagtcacaagacccaacccctggtgaggaagaggaaatcttggagtccagtctgctgcccccattagaggaagaacagaccgacttacaggtgccccccaccgcggatcgattccaggcagaggagtacggagagggcggcaccgacccgccagaagggccatacgactacacgtacggatacggagatgactatagggaagagaccgaattgggacctgccctgtctgcagagactgcccattctggcgccgccgcgcatggacctagaggtcttaagggagaaaaaggagaacccgccgtgctggaaccagggatgctggttgaaggcccacccggtcccgagggaccagccggactgatcggccctcctgggatccaaggtaatcccggccccgtcggcgaccccggtgaaaggggcccccctggtcgagctgggttgcccggcagcgatggagccccaggccccccgggaaccagcctcatgttaccattccgctttggcagcggtgggggcgacaagggccctgtagtggccgcccaggaggcacaggcccaggcgatactccagcaagcacggctggcgctcagaggtccacccggccccatgggctacacgggtagacctggccctttggggcagccaggctcccctggcctaaagggagaatccggagacctgggccctcaggggcctagaggaccccagggtcttacaggcccacccgggaaggcgggacggaggggaagagcgggagcggacggagctcgcggcatgccaggcgacccaggcgtgaaaggcgatcggggctttgacggactgccaggcctgcccggtgagaagggccacaggggagataccggtgcgcagggtttgcctggaccccccggggaggacggtgaacgtggcgacgatggtgaaatagggccccgcgggttaccaggagaatctggaccacgtgggctgctgggccccaaaggccccccaggaataccaggccccccaggcgtacgaggaatggatggtccacagggtcctaagggatccctgggcccacaaggggagcccggaccacccgggcagcagggcacgcccggcactcagggcctgccgggaccgcagggtgccatagggccacacggcgagaaggggccccagggtaagcctggtttgcccggaatgcccggcagcgacggacctcccggccacccaggaaaagaaggccccccggggacaaaggggaaccaggggcctagcggtcctcagggcccgttgggataccccggtccccgcggggtgaaaggagtagatggcattaggggcctgaagggacataagggggaaaaaggagaagatggcttccctgggtttaaaggagacatcggcgtcaagggcgaccgaggggaagtcggggtccctggcagtagaggggaggatggtcctgagggacccaaagggcgtacagggccgacaggggacccaggacctcccggactcatgggcgagaagggtaaattaggcgttcctggactacccggctatcccggcaggcagggaccaaaggggtcactcggcttcccggggtttcctggggcctctggggaaaagggggcccgagggctgtctggcaagagcggcccccgaggtgagagaggacctaccggcccgaggggccagaggggaccacggggagcgacaggaaagtcaggtgccaagggcacctccggaggggacggaccccacggaccccctggcgagcggggcttaccgggcccccagggacccaatgggtttccggggcctaagggtcctcctggccccccaggtaaggatggcctgcctgggcacccaggacagagaggagaggtaggcttccaagggaagacaggacctccaggaccacccggtgttgtggggccccagggggccgccggcgaaacggggcctatgggtgaacgtggtcaccccgggccaccggggcccccgggtgagcaaggactgccaggcacggctgggaaagaagggacgaagggagacccagggccccccggcgctcctgggaaagacggacctgctgggctccgggggttccccggcgagcgcggattgccagggaccgcggggggccccggactgaaggggaacgagggaccgtcaggtccaccagggccggccgggtcacccggcgagcgcggcgccgcaggtagcggaggaccgattggcccccctggccgccctggacctcaggggccccctggtgctgcaggcgaaaagggcgtgccaggggaaaaaggacccatcggcccgacaggcagggatggggtgcaagggcctgttggtctgcctggaccggcaggtcctcctggagtggctggggaagacggggacaaaggggaggttggggacccaggccagaagggcactaagggcaacaagggggaacatggaccccccggcccccccggcccaatcggtcctgtggggcagcccggcgctgcaggcgctgacggtgaaccgggagccaggggtcctcaggggcactttggtgctaagggtgatgaggggaccaggggattcaacggacctcctggtcccattggcctccaaggactgccgggtcctagtggcgagaagggagagacgggggacgtaggtcccatgggcccccccggcccaccgggccccagaggccctgctggacctaacggagccgacggcccgcagggcccccctggcggtgtgggcaatctcggccctccaggagaaaaaggagaaccgggtgagagcggctctcctggtattcagggtgaaccgggggtgaagggcccccgcggcgaacgcggcgagaaaggggagtctgggcaacccggagaaccgggacctccaggaccaaagggaccaaccggggacgacgggcctaaggggaaccccggaccggtgggttttccaggtgatcccggaccacccggggagggaggccctaggggccaagatggtgcgaaaggcgatcgaggcgaggatggcgaaccagggcaacctggctccccaggacccaccggcgaaaacggcccccctggtcctttggggaaaaggggccctgccggctcgcctgggagtgaggggcgccagggaggcaaaggagctaagggggaccccggtgcaataggcgcccccggaaagaccggcccagtgggtcccgcaggtcccgccggcaaacctggtccagatggccttaggggtctcccaggttctgtggggcagcagggtaggccgggcgcgaccggacaggccggtcccccgggcccagttggtcctcccggactgccagggctccgcggcgatgcaggcgccaagggagagaaagggcaccccggtctgatcggcttgatcggcccccctggcgagcagggtgaaaagggagatcgagggttgccagggccccaagggagtccaggtcagaagggcgagatgggaatacccggagccagcggccccattggcccgggaggaccgcccggtctgcccggccccgcaggaccgaagggcgctaagggcgccacagggcctggcggccctaaaggcgagaagggagtacagggcccccctggacatcctgggcctcccggcgaagtgatccagcccttgccaattcagatgcccaagaagacccggagaagtgtggatggcagcagactcatgcaagaggacgaagcaatacccaccggaggagcccccggttctcctggtggactggaggagatctttgggtctctagactctctacgtgaggagatcgaacagatgcgccgaccaactggcactcaggacagcccagcacggacatgtcaggatcttaaactctgtcacccagaactgcccgatggggagtactgggtggacccaaatcaaggttgcgcccgagatgcctttcgcgtgttctgtaacttcacagccggaggcgagacctgcgtgacaccacgggacgatgtaactcagtttagctacgtggatagcgaggggtctcccgtgggagtggtccagctcactttcctgcgtttactctcggtatcagctcatcaagacgtctcttacccttgctctggtgcagcccgagacggcccacttaggcttcgaggagccaacgaggacgagctaagcccagaaactagcccttatgttaaagaatttcgggatgggtgccagactcagcaggggcgcactgtcctcgaagttcggacgcctgtgctagagcaactaccagttctggatgcgtcattcagcgacctgggtgcccctcccaggaggggcggggtgctcctgggccccgtttgctttatgggctag

SEQ ID NO: 2610 - DNA, 5148 bp, Artificial Sequence
  Description of Artificial Sequence: Synthetic coding sequence
atggaaagatgctcgaggtgccataggttgctgttgctgttaccccttgtcctggggctctcggccgcccccggctgggccggtgcgccccctgttgatgttctgcgggcactgcggtttccaagcctgcccgacggagttcgacgggccaagggtatttgtcccgccgacgtggcctatagagtggcccgacctgcacaactgtcagccccaacccggcagttgtttccaggcggcttcccaaaggatttctcactgctgacggtggttcggacacgcccaggtcttcaagcaccgctcttgacactttattctgcccagggggtgcgtcaacttgggctcgagctggggaggcctgtgcgattcttgtacgaagaccagacaggcaggccccagcctccttcacagcccgtattcagaggcctcagtctggctgacggtaagtggcaccgcgtcgctgtggcggtgaagggacagtcagtgacattgatcgtcgactgtaaaaagcgcgtaacccgacccctgccacgctctgcaaggcctgtgctggacactcacggcgttattatatttggagcaagaatccttgatgaggaggtgtttgaaggagatgtccaagagttggccatagtgccaggtgttcaggccgcctatgaatcttgtgagcagaaggagctggagtgcgagggcggacagcgagaacgcccacagaatcagcagccccatcgcgcccaacggagcccccaacagcaaccaagtaggctccacagacctcagaaccaagagccccagtcccagcctaccgagagtttgtattacgactacaaacccccctactatgacgtgatgactacaggaacaactcccgattatcaggagcaaactgacttgcaggtaccccctaccgcagatcgcttccaagcggaggaatatggtgaaggcggaaccgacccccctgagggcccttatgattacacctacggctacggtgacgactaccgggaggaaacagagctgggcccggccctgagtgccgaaacagcccacagcggtgccgcggcacacggtccacgaggcctcaaaggggaaaagggtgagcctgcggtgctggagccaggcatgttggtcgagggacccccaggtccggagggcccagccggcctcatcggaccacccggaatccagggaaatccgggccctgtgggcgatcccggtgaaagggggccaccaggcagagccggccttccgggatccgacggtgcccccgggcctccggggacgtctcttatgctgccattccgctttggctcaggaggcggggacaagggacctgtggtggccgcacaagaagctcaggcacaggcgattctgcagcaagcaagactggcactgagaggacctcccggtccgatggggtatactgggcgtccgggccctcttggacagccaggcagtccaggcttaaagggagagtccggcgacctcgggcctcaggggcctagagggccacaaggacttactgggcctcctggcaaagcaggcagaagaggacgtgccggagccgacggcgccagagggatgcctggagacccgggagtgaagggtgatagggggttcgacgggttgcccggactgcctggcgagaaaggccaccgcggagacaccggcgcgcaggggttgccaggcccccctggcgaagatggcgagcggggtgacgatggagaaattggaccacgggggctgcctggagagtccggaccccgtggactcttgggccccaaggggcctcctgggatacctggccctcccggtgtccggggcatggacgggccccagggaccaaaaggatcattgggaccacagggtgagcctggtccccccggccagcaaggcacgccgggaacccagggcctccccggccctcagggtgccatagggcctcacggggagaaaggtccgcagggaaagccgggactgcctggcatgcccggaagtgatggtcctcctggccatcctggaaaagagggaccccctggcactaagggaaatcagggtccttctggaccacaaggccccttaggctatcctggccctaggggagtgaagggagttgacgggattagaggtctgaagggacataagggggaaaagggcgaggacggctttccaggcttcaaaggcgacattggcgtgaaaggggatagaggggaggtcggggtgccagggtcgcgaggggaggacggccccgagggtcccaaaggaagaactggtccgacaggtgaccccggaccgcccggcctcatgggcgagaagggaaagctcggtgtccccggattgccaggctatccgggtcgtcaaggcccgaagggtagcctgggcttcccgggcttccccggcgcttccggtgaaaaaggggccaggggactctctggcaagtcaggtcccagaggggaaaggggccctacagggccaaggggccagagaggccccagaggggccacgggaaaatctggcgccaaaggtacttccggaggagatggccctcatggcccaccgggagaacgcgggttgccgggcccgcagggtcctaatggcttcccaggcccgaaaggccctcctggcccccctggcaaggatgggcttcccggccatccaggtcagagaggcgaggtaggctttcagggaaagaccggacccccggggcctccaggtgtcgtggggccccaaggcgcagccggggagactggtcccatgggggaacggggtcatccaggcccccctggccctcccggagagcagggactgcccggcaccgcgggcaaggaggggaccaagggggatcccggccccccaggcgctcccggaaaggatggacctgctggcctgcggggcttccccggcgagagaggtctgcccgggacagcaggcgggcctggtttaaaagggaacgaaggcccatccggcccgccaggaccagcgggaagtccaggagaacggggcgcggccggcagcggcggtcccatcggaccacccggtaggcctggccctcaggggccgcccggagcagcaggggagaaaggagtgcccggggaaaaggggccaatcggccccacagggagagatggagttcagggacctgttgggttgcccgggcccgccggtccccctggcgtggcgggcgaagacggggacaagggtgaggtgggagatcccggacagaaaggcacgaaaggtaacaagggtgagcacggccctcctggacctcctggaccgattggtccggtcggtcagccgggcgctgcaggcgccgacggagagcctggtgcccgaggtccccagggtcacttcggggccaagggggacgaaggcacccgcgggtttaacggtccccccggccctattggcctgcaagggcttcctggccccagtggggaaaaaggggagaccggggatgtggggccaatgggccctcctggcccccccgggcctcgcggccctgcagggcctaacggagcagatggcccacagggtccaccagggggggttgggaacctcggccctcccggcgaaaaaggtgagccaggcgagtccggaagtcccgggatacagggcgaacctggggttaaaggaccgagaggcgaaaggggcgaaaaaggtgagtcggggcagcccggcgagcccggccctcccgggcccaaaggcccaaccggagacgatggaccaaaaggaaaccccggcccagttggtttccccggggaccctggtccccctggcgaaggaggtcccaggggacaagacggggcaaaaggagacagaggtgaggacggggaaccgggccagccagggagtcctggccctacaggagaaaatggcccaccggggcctctaggtaaacgcggtcccgctggcagtcctggctccgagggtcgccagggagggaaaggggcgaaaggtgaccctggcgccatcggcgccccaggaaagaccggtcccgtgggaccggcagggccagccggtaagccggggcctgacggtttgagggggctacccggttctgtagggcagcagggcagacctggagcgaccggccaggccggtcctcctggtccggtcggcccacccgggctgccgggtctacgcggtgacgcaggagcgaagggtgagaaaggacatcccggactgattggcctgattgggccgcccggggaacagggagagaagggagaccgaggactgcccggacctcagggcagtcccggccagaagggtgaaatgggcatccctggtgcgagcgggcctatagggcccggaggcccacccggattgcccggccctgctgggccaaaaggagctaaaggcgctacaggcccagggggcccgaaaggcgaaaagggagtgcagggccctccaggacatcctggccctcccggagaggtaattcagccactgcctatacaaatgcccaaaaaaaccagacgcagcgtcgacggtagtaggctcatgcaagaagatgaggctattcctacaggaggagcccctggctctccggggggtctggaggaaattttcggctccctggacagtttgcgggaggagatcgagcaaatgcgccgacctactggaacccaagatagtcccgcccgcacttgccaggacctcaaactgtgccacccagagttacccgacggcgagtactgggttgatcccaaccagggatgcgctcgggatgcctttagggtcttctgcaacttcacagctggtggggagacgtgcgtcaccccaagagatgatgtcacccagttcagctacgtggacagcgaggggtccccagtcggcgtcgtacagctgactttcctccggctgctcagtgttagcgctcatcaggacgtgtcctatccttgttctggcgccgcccgtgatggtcctctgagacttcgcggagctaatgaggatgagctgagtcccgaaaccagtccctatgttaaggaattccgcgacgggtgccagacccagcagggccgtactgtgctggaggtgagaacaccggtgttagaacaactgcctgtcctcgacgcctccttttcagacctgggggcacccccccggcgcgggggagtactgctcggtcccgtctgcttcatgggttag

SEQ ID NO: 2611 - DNA, 5148 bp, Artificial Sequence
  Description of Artificial Sequence: Synthetic coding sequence
atggagcgatgcagcagatgtcataggctcctgcttcttctaccccttgtcttgggactgtctgcagccccagggtgggcaggcgcgcctcccgttgacgtgttgcgggcccttcggtttcctagtctgcctgatggcgttcggcgggccaagggcatatgccccgctgacgtcgcttatagggtagcacgacccgcacagttaagcgcccccacaagacaactatttccagggggctttccaaaggatttctccttgctaacggtggttaggacgcgacctggcttgcaggccccgctcctgaccctttactctgcacaaggggtccggcagttggggttggagctgggaccaccggtccgatttctgtatgaggaccagaccggtcggccgcagccaccttcccagccggtgtttcgcgggctatccttggcagatggaaagtggcacagagtggccgtggcagtgaagggccagtccgtcaccctgattgttgattgtaaaaaacgtgtgaccaggcctctacccaggagcgcgcggccggtactcgatacacacggggtgatcatttttggagctaggattcttgatgaggaggtgtttgagggtgacgtccaagaactcgccattgttcctggggtacaagctgcttacgaaagctgcgagcagaaggagctggaatgcgagggaggacaacgagaaaggcctcagaatcagcagccccaccgcgcacagcgaagccctcagcagcagccctctagactgcatagaccacagaatcaggaaccacagagccagcccacagagagcctgtattacgattacaagcccccctattacgatgtgatgacaactggtaccacaccagattaccaggaacagaccgatctccaggtgccacctaccgccgatcgttttcaagctgaggagtacggcgaagggggcactgaccctccagaggggccctacgattatacatacggatatggggatgattatagagaggagacagagctggggccggcactctcggccgaaaccgcacattctggggccgcggctcatgggccgagaggactgaaaggagagaaaggtgaacccgccgtgctcgaaccggggatgctggtggaaggcccccctggacctgagggacctgccgggctgatcggacccccagggatacagggaaaccccgggccggtcggtgatcctggcgagcggggcccccccggccgcgcaggtctgccaggcagcgacggtgctccaggaccacctggcacctcactcatgcttccttttagattcgggtcaggaggcggagacaaaggtcccgttgtggctgctcaagaggctcaagcacaagccatactacagcaggcgagattggcactgcggggccccccagggcctatgggctacaccgggcgtccaggacctctggggcagccaggttcgcctggcctcaaaggggaatcgggtgacctcggcccacagggcccacgggggcctcaggggctcacaggccctccgggcaaggctggccgccgagggagggcaggcgccgacggtgccagaggaatgccaggtgatcctggcgtcaaaggagatagaggttttgacggtcttccagggctccctggtgagaaaggacatcggggagatacaggcgcccagggactgcccggtccccctggtgaagacggagaacgaggcgatgacggagagataggaccacgcggactcccaggagaaagcgggcctcggggtctcctcggacccaaaggtccacccggaataccaggacccccgggcgtacggggcatggacggtccccaagggcccaagggtagcctggggcctcagggagagcccggaccgcctggacagcaggggactccgggcacacaggggctccccgggccacagggtgccatcggcccccatggcgaaaaaggcccccaggggaagccaggtctcccagggatgcccggttcagacggacctccggggcaccccggtaaggagggtccgcctggaaccaagggaaaccagggccccagcgggccccagggccccctcggatacccagggcctagaggcgttaagggcgtagacgggattcgaggtctgaaaggccataaaggtgaaaaaggagaggacgggtttcctggttttaagggcgatattggcgtcaagggagaccgcggagaggtcggggttcctgggtcaagaggtgaagacggaccggaggggcctaaaggccggacagggcctaccggcgacccgggaccgcctggtctcatgggtgagaagggaaagttgggggttcccgggctgcctggctaccctggacgacaaggacctaaaggcagtttaggcttcccgggattcccgggtgctagcggagaaaagggcgcgcggggcttatccggaaagagtggaccgcgcggggagcggggccccaccggccctaggggccaacgaggccctaggggagctaccggcaagagcggagccaagggcacctcagggggcgacggcccccacggcccccctggggaaagagggttacccggcccccaggggccaaatgggttccccggacccaagggacctcctggccctcccggcaaggatggcttgcccggccacccaggacaaagaggcgaggtgggctttcagggaaagaccggtcctccaggaccgcctggcgtggtgggcccccaaggggcagctggcgagaccggccctatgggtgagcgtggccatccaggccccccagggcccccaggagagcaagggctgccgggcaccgcaggcaaggaagggaccaagggtgatccagggccccccggcgcaccagggaaagatggcccagccggcctgagaggattccctggtgaaagggggctgccgggtactgctggcggcccaggacttaagggcaacgaaggcccgtctgggcctccagggccagcgggttcccccggtgagagaggcgctgcaggctcaggtggcccaataggcccacccggccgcccggggcctcagggccctcctggagccgctggcgagaagggcgtgcccggtgagaaagggccaatcgggccaacgggcagagacggtgtgcagggacctgttggcctacccggcccagcaggacctccaggcgtggcgggggaggacggggacaaaggcgaagtgggcgatcctggtcaaaagggaaccaaaggaaacaagggtgaacacggaccaccaggacccccagggccgattggtcccgttggacaaccaggtgcagctggggctgacggtgagcccggcgctcgcggcccacagggacacttcggagccaaaggtgacgaggggacacgtggatttaatggcccgccgggtcctatcggactgcagggcctcccgggaccttcgggtgagaagggagaaactggagatgtggggcccatggggccccctggccctcccggaccacggggtccggccggaccgaatggcgcggatggcccacaagggcccccggggggggtcgggaatctcggcccaccgggagagaaaggtgaaccaggtgagtcagggtctcctggaatacagggtgaacctggggtgaagggccctcgcggggagcgcggcgaaaagggagagtccgggcagcccggagaacctggtccacccggaccaaaaggccctacaggagacgatgggcctaaagggaatccagggcccgtggggtttcccggggaccccgggcctccaggcgagggcggtccccgcggtcaggacggagcaaagggcgatcgaggtgaagatggtgaacctggacaaccaggctctccaggccctacaggcgagaacggaccccccgggcctctagggaagagaggcccagccggcagccctggatccgaggggcgacagggcggaaagggagcaaagggcgatcccggcgccatcggcgccccaggcaaaacaggccctgtggggccagcaggtcccgccggcaagccagggccagatggcctgcggggactgccaggcagtgtgggccagcaaggcaggcccggagctaccggccaggccggcccgccaggacccgtcggccccccaggcctgcctggtcttcggggtgatgccggggccaagggcgaaaaggggcatcccggcctgattggactaatcggtcctccaggagagcagggggaaaaaggcgatcgaggcttacctggacctcagggtagccctggtcaaaagggggagatggggattccaggagcctctggcccaatcggaccaggaggtccacccggcctgccagggcctgccggacccaagggggccaagggtgcgaccggccctggaggacccaagggggaaaaaggtgtccaagggccaccaggtcatccaggtccacccggtgaggtaatccaacccttgcccattcagatgcctaagaaaaccaggaggtccgtcgatgggagcaggttaatgcaagaagacgaagccattccaacaggtggggctcccggtagccccggtggcctggaagaaattttcggatctctggacagcttaagagaggaaatcgagcaaatgcgcaggcccacagggacccaagactccccagctcgcacctgccaggatttgaagctgtgtcaccccgaattgccggatggggaatactgggtcgacccgaaccagggttgtgccagggatgcgttccgcgttttctgcaacttcaccgcgggaggagagacctgtgtgacacctagagatgatgtgacccagttcagctatgtggattctgaaggctcaccagtaggggtggtgcagcttacgttcttaaggctgctctcggtgtcagcccatcaagatgtctcatacccttgttcaggcgccgcccgtgatggtccactccgcctccgcggcgccaatgaggacgaactgtctccggaaaccagcccctatgtgaaagagttcagagacggctgtcagacccagcaggggcgaactgttctggaggtccggactcccgtgctggagcagcttccagtcctggacgctagcttcagcgacctgggagcaccccctagacgaggtggagtgttgctaggtcctgtgtgcttcatgggctag

SEQ ID NO: 2612 - DNA, 5031 bp, Artificial Sequence
  Description of Artificial Sequence: Synthetic coding sequence
atggagcggtgctcccggtgccatagactactcctgctccttccactcgttttaggcctcagtgctgccccaggctgggcaggtgccccaccagttgatgtgctgcgcgccctccgctttcctagtctccccgatggagtgagaagggcaaaaggcatatgcccagccgacgtggcctatcgcgtagccagacctgctcagcttagtgcacctaccaggcagctgttccctggtggcttccccaaagatttctcgcttctgactgtggtgcgaacaagacccggccttcaagcaccactcttgacattatattccgcacaaggtgtgaggcagctcggccttgaactgggtagaccagtccggtttctgtacgaggatcagaccggccgacctcagccccctagccagccggtatttagaggcctgtccttggctgatgggaagtggcatagagtagctgtggctgtcaaagggcagtctgttacacttatagtcgactgtaaaaagagggtcacccgaccactgccccggtcagcgcgccccgtgctagatactcacggcgttatcatcttcggcgccaggattctggatgaggaagtgttcgagggggatgtgcaggagctagcaattgtgcctggagtccaggccgcctatgaatcatgtgagcagaaggaattagaatgcgaaggtggacaaagggagagacctcagaaccagcaaccccacagagcccagcgctccccccagcagcagccgagccggctgcaccggccacagaaccaggagccccagtctcagcctacagagagtctgtattatgattacaaacctccttattatgatgtgatgaccaccggcaccacgcctgactaccaggaccccaccccaggggaggaggaggaaattctcgagagctctctgctgccccctttggaggaagcggcccacggcccccggggcctgaagggagaaaagggagagccagccgtcctggagccaggaatgcttgtggaaggtccccctggccctgaaggtcctgctgggctaatcggtccccctggcatccagggtaacccaggaccggtgggcgatccaggggagcgcggaccccccgggcgtgccgggctgccagggagcgatggcgctcctggcccacctgggacctctctgatgttacccttcaggttcgggagcggaggcggcgataaaggccccgttgtagccgcacaggaagcgcaggctcaggccatactacagcaggctagactcgctcttcgagggccgcccgggcctatggggtatacaggacgtccaggtcctttgggacagcctgggtctccgggcctgaaaggggaaagtggtgatctgggaccccagggacctcgtggccctcaaggtcttacagggccgcctggcaaagccggcagaagagggcgggctggcgctgacggcgctcgaggaatgccgggtgatcctggtgtgaaaggcgatagagggtttgacggcctgcctggcctccccggagaaaaaggccaccgcggagacaccggagcccagggtttacccggaccgccgggtgaagacggggagcgcggggacgatggcgagatcgggccacgcggactccctggcgaaagcggcccccggggcttgctggggcccaaaggcccacccggtattccaggcccgccaggagtgcggggcatggacgggcctcaagggcccaaaggttcgcttgggcctcagggggaacccggccctcccggtcagcaaggcacacccggcacccaggggctgcctggcccacagggagcaatcggacctcatggtgaaaaaggtcctcaggggaaacctgggctgcccgggatgccggggagtgatgggcctccaggacaccctgggaaggaagggcctccaggtacgaagggcaatcaaggtcccagcggacctcagggaccactgggctacccaggcccaagaggcgtcaaaggcgtcgatggcattagaggcttgaagggccacaagggtgagaaaggtgaagatggattccctggctttaagggtgacattggggttaagggcgatagaggggaagtgggggtgccaggatctcggggagaggatggaccagagggacctaagggcagaacgggtcccactggcgaccctggacctccagggctgatgggggaaaaaggaaagctcggagtacctggcctgcccggatatcccggccggcagggcccaaaagggagcctggggttccccggcttcccgggagccagtggcgaaaaaggcgctcgcggcctgtctggcaagagcggcccacggggcgagaggggccctaccggccccagaggacagcggggaccccgaggagcaaccgggaaaagtggcgctaagggcacaagcggaggagatggcccacacggcccgccaggggaaaggggattacctgggccccagggtcccaatgggtttcctggaccaaagggtcccccaggcccgccaggcaaagacgggctgcccgggcatcctggacagcgaggcgaagtgggtttccagggaaagaccggcccaccaggcccccccggggtggttggaccacagggagccgcgggggaaaccggcccaatgggagagcgtggtcatcctggtcccccaggtccgcccggcgagcaagggttgcccggcactgccggtaaggagggaactaagggagaccccggcccacccggagcaccagggaaggatggccctgctggattgagagggtttccaggagaacgcggattgccggggacagctggcgggccaggtctcaaggggaacgagggaccatccggcccacctggtccagcagggagccccggggaacgcggcgctgcgggttccggcgggccgatcggcccaccgggaagacctggccctcagggacctcccggagccgctggagaaaaaggagtgcctggagagaagggtcccattggaccaactggaagggacggcgtgcagggccctgtcggactgcccggccccgccggcccccccggagtggcaggagaggacggggacaagggagaggttggagatccaggccagaaaggaactaagggcaataaaggagaacacggcccccccggtccacccggccccatcggaccagtcggacagccaggcgccgcgggggccgacggcgaacctggtgccagaggtccccagggacatttcggggctaaaggcgatgagggaaccagaggattcaacggccctccgggcccaatcggcttgcagggtttgccgggcccttctggagaaaaaggtgaaacaggcgacgtcgggcctatggggcctccaggcccacctggcccgcgagggcctgccggacccaacggggccgatggccctcaaggcccccctggaggcgtggggaatctcggacctccaggggagaagggagagcctggcgagagcggatccccagggatacaaggcgaacccggggtgaaggggccacgcggggaacgaggcgagaagggagaaagcgggcagcctggcgaaccgggaccacccgggccaaaaggtccgaccggcgacgacggccctaaaggcaatcctggacccgttggcttccccggagatcccggaccgccaggtgagggcggaccacggggccaggatggagcgaagggggacaggggtgaagatggcgagcccggacagccgggatcaccgggacctactggcgaaaacgggcctccagggcctttgggaaaaaggggacccgccggctctcctggatccgagggccgacaaggcggtaagggtgccaagggtgacccaggggcaataggggcccccggcaaaactgggcctgtaggcccagcagggccagctgggaagcccggcccagacggcctgagagggttgcctggatcagtgggccaacaggggaggccgggagcgaccggtcaagccggccctccaggtcctgtgggacctcccggcttgccaggtctgagaggggatgcaggtgccaagggtgaaaaaggccatcctgggcttattggcctgatcggccctcctggcgaacaaggcgagaagggggatcgaggactgcctggtccccagggatcacccggccagaagggcgaaatggggatccccggcgccagtggcccaatcggccctggcgggccacctgggttgcccgggcccgcagggcctaaaggtgcaaaaggagccactggccccgggggcccgaaaggcgaaaaaggggtgcaaggcccccccggccacccgggaccccctggagaagtgatccagcccttgcctattcagatgcctaaaaagacaaggcgaagtgtggatggctcaagattaatgcaagaagacgaagccatccctacaggcggagctcctgggagccccgggggactggaagaaatcttcggatcacttgattctcttagagaggagattgagcagatgcgacgccctaccggtactcaggactctccagcgcggacctgccaggatcttaaattatgtcaccccgagctccctgatggagaatactgggttgacccaaatcagggttgtgcacgcgacgccttcagagtattctgcaattttaccgccggaggcgagacctgtgtcacacctcgcgacgacgtgacgcaattttcttacgtagatagcgaagggtcaccggtcggagtggttcagctgaccttcctcaggctcttgtcggtctccgcccaccaggatgtgagttacccatgctcaggtgccgcgcgggatggtcctcttaggctaagaggggctaacgaggacgagctctcgccggagacctccccttacgtgaaagaatttagagacggatgtcaaacacaacagggtcgaactgtccttgaagtaagaacaccagtgctcgaacagctccccgtcctggatgcctccttttctgacttgggcgccccgccacggagaggcggtgtcctattggggcccgtgtgttttatggggtag

SEQ ID NO: 2613 - DNA, 4968 bp, Artificial Sequence
  Description of Artificial Sequence: Synthetic coding sequence
atggaaagatgtagtagatgccatcgactgctcttgttgctccccctggtacttggcctgtccgccgcgccaggatgggctggggccccaccagtcgacgtgcttcgggctcttcgcttccctagcctccctgacggtgttcgcagagcaaaagggatatgcccagctgatgtggcctatagagtggctcgccccgctcaactcagtgcgccaacgaggcagctgtttcctggcggttttccgaaggactttagccttttaacagtggtcaggacccgcccaggattgcaggcacctctcctcaccctgtacagcgcgcagggtgtgaggcagctgggtctcgagctggggcgtccggtccggttcctctacgaagaccaaaccggccggccacagccccctagccagccagttttccgtggtctatcactcgcggatggcaaatggcaccgcgtggcagtggcggtaaagggccagagcgtgacgctgatcgtggactgcaagaagagagtgaccagacctctacctaggtcggcccgcccagtgctcgatacgcacggcgtcatcatttttggtgccaggatcctggacgaagaagtcttcgaaggtgacgttcaagaactggcaattgtgcccggagtgcaggccgcctacgaaagctgcgagcaaaaagaactggagtgcgaagggggccagcgggagagaccacagaaccaacagcctcatcgcgcccagcgatctccacagcagcaaccgtcacgccttcatcgcccacaaaatcaagaaccgcagtctcaaccaaccgagtccctgtattacgattataagcctccctattatgacgtaatgacaaccggaactactccagattatcaagcagcccatggccccagggggcttaagggagaaaaaggcgagcctgctgtgctggaaccggggatgctcgtcgaaggacctccagggcccgagggacccgctggccttatcggccctccaggcattcagggcaatcccggtcccgtcggagatcctggtgagcgaggcccacccggccgggccggattgccaggcagcgatggagcccctggtcctcccgggaccagtctgatgttaccgttcaggtttggaagtgggggcggagataaaggccctgtggtcgcggcccaggaggcccaggcacaggccattctgcagcaggctcggctcgcgctgaggggacccccgggtcccatgggctacactggtcgtcccggccccctgggccagccaggctctcctgggttgaaaggagaatccggcgacttaggtccacagggaccaaggggcccccagggtctaactgggccccctggaaaggctgggcgccgcgggagggctggcgcggatggagcacgaggtatgcctggagaccccggcgtgaagggggatcggggattcgacgggcttcccggcttgccgggggagaaagggcacagaggcgacacaggggcccagggattgcctggcccacctggtgaggacggcgaaagaggcgatgatggggagatcgggcccagaggcctgcccggggagtcgggacctagagggctgctgggacctaaaggccctccaggcatccccggtcccccaggggtgagggggatggatggacctcagggccccaaggggtctctaggccctcagggcgaacccggtccacccgggcagcaagggacccctggaacacaggggctgccaggccctcaaggagccattgggccgcacggagagaagggccctcagggaaaaccgggactgcccggtatgcccggatctgatggacctcctgggcatcccggtaaagaaggaccacctggtacaaagggaaaccagggtccttcaggccctcagggccccctcgggtatcctgggcctcggggggtaaagggggtggacggaatacgaggcctcaaaggacataaaggtgagaagggggaggatggtttccctggtttcaagggagacattggagtcaaaggagaccgaggggaagtcggggtgcctggcagccgaggcgaggacggtccagagggtccgaaaggcagaacggggcctacgggggacccaggacctcccggcttgatgggcgaaaaaggcaagctcggcgttccaggactacctggttaccccgggcgccagggacctaaaggcagcttaggatttccgggcttccccggtgccagtggagagaagggggcccgaggtttgtcaggcaaatccggaccccgcggcgagaggggacctaccggcccacgcggacaacgcggcccgagaggcgccacaggcaagtcgggtgccaaaggcaccagcggcggtgacgggcctcacggacctccgggcgagcggggtctccccggccctcaggggccaaacggattccccggtccaaaagggccaccaggccccccggggaaggatggcctcccaggccaccccggccagcgcggagaagttggattccagggcaaaaccgggcctcccggaccaccgggtgtcgtcggcccccaaggcgccgctggcgagaccggccccatgggggagaggggacacccagggccgcctggaccccctggagagcagggacttcccggcacagctgggaaagaggggacgaaaggcgaccccgggcctcccggcgctccgggcaaagacgggcccgccgggcttcgaggattccctggagaacgggggctacccggcacagccggcggccccggccttaaggggaacgaaggaccgagtggcccacccggacccgctgggagtcccggggagcgaggggcagcagggagtggggggccaattgggccacctggtagaccaggccctcagggtcccccgggcgccgccggcgaaaagggtgtccctggggaaaaaggccccattggccctacaggccgagatggcgtgcaggggccggtgggcctgcccggcccagctggtccgcccggcgtggctggagaagacggggacaagggggaagtgggagaccctggccagaagggaaccaagggcaataagggagaacacgggcccccaggtccccccgggccaatcggtcccgtcggacagcctggcgccgctggagccgatggtgagcccggagctagaggaccccaagggcattttggagccaaaggagacgagggcactagaggctttaacggccccccaggaccgattgggcttcagggtctacccggcccatctggggagaagggagaaaccggtgatgtgggaccaatgggccctccagggcctcccggccctcgtgggcccgctggccctaatggcgcagatggtccccagggtccacctggcggcgtggggaacctgggccctcccggcgaaaagggagaacctggcgaatcaggcagtccagggatccaaggcgaacctggtgtcaaaggtccccggggcgaacgcggcgagaagggcgaatctggacaacctggggagccgggccccccaggcccgaaagggccaacaggagacgacggaccaaaaggaaaccccggtccagtcgggttcccaggcgatccaggtccacccggagaggggggacccaggggccaggacggagcaaaaggggatcgcggggaggatggcgaacccgggcagcctggatcgcctggaccgaccggtgaaaacgggcctcccggccctctgggtaagcggggccctgctggaagtcccggatctgagggcaggcagggaggcaaaggcgccaagggagacccaggtgccataggtgctcccgggaagactggaccagtaggccccgccggccccgctggcaaaccagggcctgatggactccgagggctgcctgggagcgtgggacagcagggtagacctggtgcaaccgggcaggccgggccccccggcccagtggggccaccaggactccccgggctgcgtggggacgctggcgccaaaggagagaagggacacccaggcttgatcgggctgatcggaccgccaggggaacagggcgaaaaaggggatagaggacttccagggccacagggttccccaggacaaaaaggagaaatggggattcctggggctagtggacctattggcccaggtgggccacctgggctacccggccctgcaggccccaaaggcgccaaaggcgccactgggcctggaggaccaaagggggagaaaggtgtgcagggcccacccggccatcccggccctccaggagaagtgatccagccactgccaatacagatgcccaaaaaaacaagacggagcgtggacggctcccgcctgatgcaggaagacgaggccattccaaccggaggagccccgggatcccctggcggcctggaagagatattcgggagtttagacagtctgagggaagaaatcgaacagatgcgtaggccaaccggaacacaagatagccctgctcggacatgccaggacttaaagctgtgccatcccgagttgcccgacggcgaatattgggtggacccaaatcaggggtgtgcacgggacgcatttagggtgttctgtaattttactgctggtggggagacgtgcgtgacccctcgcgacgacgtgacccagttcagttatgtcgattcagaaggatcaccggtcggcgtcgttcagctaacctttttacggctgctaagcgtatctgcccatcaagacgtcagctacccttgtagcggcgcagcaagagatggtccactgaggctgcgcggcgctaacgaagacgaattgagtccagaaacttctccctatgtaaaggagtttagggacggatgccagacccagcagggcaggacagtccttgaagtcaggactcccgtcttggagcaattgccagtcttggacgcgtctttttcagacttgggcgcacccccgcgtcggggtggagtactcctgggcccagtgtgctttatgggttag

SEQ ID NO: 2614 - DNA, 5148 bp, Artificial Sequence
  Description of Artificial Sequence: Synthetic coding sequence
atggagagatgcagccggtgtcatcggctcctgcttctgctccctttggtgctcggcctgagtgcggcgccgggatgggccggagctcctccggtggatgtgctgcgggctctacggtttccgtcactccccgatggagtgcggcgcgccaaaggtatctgccccgccgacgtggcttatagggtggccaggcctgctcaattgagtgccccgacccgccagctcttccctggcggattccccaaggacttcagtctgttaaccgtcgtaaggactaggcccggtttgcaggccccgctgctgacactgtactcggcacaaggggtcaggcagctggggttggagttgggtagacccgtgcggtttttgtacgaggaccaaaccggaaggcctcagccacctagtcagcctgtttttagaggcctgagcctagccgatggaaagtggcatagagtcgctgtcgcggtgaagggccaaagcgtcaccctcatcgtcgactgtaagaaacgggtgacccgccctttaccccggtccgctcggcctgttttggatacccacggggtgataatcttcggagcgcgaatccttgacgaggaagtgtttgagggcgacgtccaggaactggcaattgtccccggtgtgcaggctgcctacgagagttgtgagcagaaggaactagagtgcgaaggaggccaacgggaaaggccgcagaatcagcaaccacatcgagctcagcgttctccacagcagcagccatctcgcctccacagaccccagaatcaggagccacaaagccagcctaccgaatccctatactacgattataaaccaccttattatgatgtcatgaccactgggaccacacctgattatcaggagcagacagatttgcaggttcctccaacagccgaccgttttcaggcggaagagtacggggaaggagggacggatccaccggaaggtccgtatgactacacatatggctacggtgacgactatcgagaggaaactgaacttggcccagccctgagcgccgaaacagctcacagcggcgctgcagctcatggtcccaggggtctcaagggggagaagggggaaccagctgttctagaacccggcatgttggtggagggtccacccggcccagaaggtcccgctggcctcataggccctcccggtatccaaggaaatcccggccctgtcggtgatcctggtgagaggggaccccctggtagagccggactgcccggcagcgatggggcacccgggccccccggaacaagtttgatgttaccctttagatttgggagcggaggtggggacaagggccccgtcgtagccgcccaggaggcacaagctcaggcaattctgcagcaggctcgactggctctgcgagggcctcctggccctatgggttacacaggccgacctgggccccttggccagcccggatcacccggtttgaaaggtgagagcggcgacttgggaccccagggccctcggggtccccagggacttacaggcccccctggcaaagccgggcggcggggaagggccggggcggatggcgctcgcggtatgcctggagatcccggtgtgaagggtgaccggggcttcgacggtctgccaggtctaccgggtgaaaagggccacagaggggataccggggcgcagggcctgcccggaccacctggagaggatggcgaacgtggggacgacggggaaattggcccccgagggctcccaggagaaagcggaccaagaggactgctgggaccaaaagggccgcctggcatacccgggcccccaggcgtgagaggtatggacggaccacagggccccaaaggctctttaggcccgcagggcgaaccggggccaccagggcagcaaggaactcccgggacgcagggtttaccaggacctcagggcgccataggaccacacggcgaaaagggcccccagggcaaaccaggtctgccgggcatgccaggttctgacgggccccctggacatccgggaaaggaggggcctccaggtactaaaggtaatcaaggcccaagcggcccacagggcccgctgggctaccccgggcccagaggagtcaaaggcgtagatgggatacgaggcctcaaagggcacaaaggggagaagggtgaggacggctttccaggatttaagggagacatcggcgtgaaaggtgacaggggcgaggtgggcgtgccaggcagccgcggggaagacggaccagaggggcccaaagggcggactggccccacaggtgacccgggcccacccgggttgatgggtgagaagggtaagctgggtgtgccgggacttcccgggtatccaggcagacaggggcctaaaggatctctaggattcccaggattccccggcgcctcaggcgagaaaggggctcgaggattgagcggaaagagcggcccgcggggagaaagagggcccactggacctagggggcaaaggggccctagaggagctactggtaagagcggggccaaaggaacatccggcggcgatgggcctcacggaccccctggagagcgcggtctgcccgggcctcagggccccaatggattccctggcccaaagggtccgcctggtcctcctggaaaggatggcctgccaggccatccggggcagaggggagaagtcggtttccagggcaagactggccctccaggcccacccggtgtagttggtccacaaggagccgccggcgaaacaggacccatgggagaacgagggcatccaggacctccagggccaccaggcgagcaggggctgcctggcaccgctggcaaagaagggacaaagggcgatcccggccctccaggagctcccgggaaagatgggccagctgggttacgaggcttccccggcgaaaggggcctgcctggtactgctggcggcccaggactcaaaggtaatgaggggcccagcggtccacccggccccgccggttctcccggggagcggggggcggcaggatcggggggtccgatcggtccccccggtagaccagggccccagggcccccccggagctgccggagagaagggcgtgccgggggagaagggcccgatcggccccaccggtagagatggagtgcagggccctgtaggcttaccaggaccagccgggcctccaggagtggcgggcgaggacggggataagggcgaggtcggcgatcctggtcagaaaggcacaaagggcaataaaggtgagcacgggcctcccggtccacccggacccatcggacccgtcggacagcctggagcggcgggggctgacggtgagcccggcgcccgtggaccccaagggcactttggggccaaaggggacgaggggactcgcggctttaatggacctcccgggccaataggcctgcaaggtctgcctggaccgtctggggaaaagggcgaaaccggagacgtaggccctatgggtcctccaggaccccccgggcccagagggccggcagggcctaatggcgctgacgggccacaggggccccctggaggggtcggcaatctgggtccccctggtgagaagggcgagcctggcgaatctgggagccctggtattcaaggtgaacctggagttaaaggtcccagaggagagaggggagaaaagggtgagagcgggcagccaggcgagcctgggcccccgggtccaaagggcccaacaggcgatgatgggcctaaaggaaatccaggccctgtgggattccctggcgaccccggacctcctggggagggcggcccaagaggtcaggacggcgcgaaaggagacagaggggaggacggagagccaggacagcctggctcccctggtcctaccggcgagaatggcccccccggccctcttgggaaaagggggcccgcagggagccccgggtccgagggtcgccaaggcggcaaaggcgccaagggtgacccgggggccatcggggcacccggcaaaacaggccccgtgggcccagcaggccctgcgggcaagcccggtcccgacggtttgcggggattgcccggctctgtaggccaacagggtcggcctggggctactgggcaagctgggccccctgggccggtgggtccacccggtttgccgggcctgcgtggtgacgcaggagccaaaggagaaaaaggccacccaggcctaatcggtttaattggaccgcccggcgaacagggagaaaaaggagaccgtggcctgccgggcccgcagggctctccagggcaaaagggcgagatgggcattccaggcgccagtggccctattggccctggaggaccacctgggctacctgggcccgcaggaccaaagggagctaaaggagcgacggggccaggggggcccaaaggggagaagggagttcagggcccccccggccaccctggacctcctggagaagtgatccaaccccttccaatccagatgcccaagaaaaccaggcggagcgttgacgggtctcgtcttatgcaagaggatgaagcgatcccaaccggaggtgcccccggttctcccggcggcctcgaagagatatttggatctctcgactccctgcgcgaggaaattgagcaaatgagacggccgacaggcactcaggattcccctgctcggacctgccaggatcttaagctgtgccaccctgaactaccggacggcgagtactgggtggatcctaaccagggttgtgcccgagatgctttccgcgtgttctgtaattttacagcaggtggagaaacctgtgtaacgcccagagacgatgtgacacagtttagttacgtggactccgaaggatctccggtgggtgtagtccagctcactttcttgaggctcctcagcgtaagtgcccaccaagatgtatcatatccatgttcaggcgccgcaagggacgggcctttaaggttaaggggagccaacgaggatgaacttagtccagaaactagtccctacgtgaaggaattcagggatgggtgccagacccagcagggacgcacagtgctggaagttcgcaccccggtcctggagcagctgccagtcttggacgcttcgtttagcgatttaggggcaccgcctcgtagaggcggcgtgctcctaggcccagtttgctttatggggtag

SEQ ID NO: 2615 - DNA, 9192 bp, Artificial Sequence
  Description of Artificial Sequence: Synthetic coding sequence
atgcggtcgagacttccacctgcattagcggctctgggggcggctcttctcctgtcctctattgaggcagaagtggatccaccaagtgatttaaattttaagatcatcgatgaaaatacggttcacatgagctgggctaagcctgtagatccaatcgttggttatcgaataaccgtcgatccaactaccgacggacccacaaaggaatttactctgtccgcctccacaaccgagaccctgcttagcgaattggttccggaaactgagtacgtagtcactatcacatcctatgacgaggttgaggaatccgtgcccgtgattggacaactgaccatccagaccgggtccagcaccaagcctgtggagaaaaaacctgggaaaaccgaaatacaaaagtgcagcgtctctgcttggacagatctggtgttcttggtggacggttcgtggtccgtagggagaaacaacttcaaatatattctggattttatcgctgcattggtgtccgcctttgatattggggaagagaaaacccgagtaggagtcgtgcagtactcatcggatacgagaactgagtttaatcttaatcagtactatcagagggatgagttgttggccgctatcaagaagatcccatataaaggcggaaacactatgacaggtgacgctatcgattatcttgtaaagaatacattcactgagtccgcaggagcacgcgtgggctttccaaaggtagctatcattatcaccgacggaaagagtcaggatgaagtggaaattcctgcccgagagttgcggaatgtaggtgtggaggtcttcagtctagggattaaggcagcggatgccaaagaactaaaacagatcgcctctacgcctagcctcaaccacgtattcaacgtcgctaactttgatgcaattgtcgacatccagaacgagatcattagccaggtgtgttccggcgtggatgagcaactcggggaattagtatccggtgaagaagtcgtcgagccccccagcaacctgattgctatggaagtctctagcaagtacgtaaaactgaactggaatccatctcctagtcctgtgacaggatacaaagtgattctaacccccatgacagccgggtctagacagcatgctctatcagtcggcccccaaactactactctttcagtgcgggacctctcagccgacacggaataccagatctcagtcagcgccatgaagggcatgactagttctgagcctatatcaattatggagaagactcagcctatgaaggtacaagttgagtgtagccgcggtgtggacatcaaggctgacattgtgttcctcgtggatggcagctacagtatcggcatcgctaattttgtgaaagtcagggcctttcttgaggtgttagtgaaatccttcgagatcagccccaacagggtccagatcagtctcgtacagtacagccgcgacccacacacagagttcacccttaaaaaattcacaaaagtggaagacatcatcgaagcaatcaatacctttccttacaggggcgggagtacaaacaccggaaaggcaatgacctacgtgagggagaagatctttgtgccgtctaaaggatcccgcagcaacgtgcccaaagtgatgatactgattactgatggaaagtcatcagacgcattcagagacccggcaatcaagctcagaaattcagatgtcgagatctttgcagtgggggttaaggacgcagtgcgatcagaattggaggcaattgcctcaccccctgccgaaacacacgtgttcacagtggaggattttgatgcttttcaacgcatctcctttgagctcacacagtctatctgcctgcgcatcgaacaagagctagctgcaataaagaagaaagcttatgtgcctcctaaagatctgtcattctccgaggtgacttcttacggattcaagacaaactggtcacccgcgggggaaaacgtctttagttaccatatcacatataaggaggccgcaggggacgacgaggtcaccgtcgtggaaccagcctcatccaccagcgttgtcctgtcgtccctgaaaccagagaccctttacctcgtgaatgtcacagccgaatacgaggacggcttctcaattcctctcgcaggggaagaaactaccgaggaggtaaaaggagcacccaggaatctcaaggtcaccgatgagaccacagattcctttaagatcacatggactcaagcccctgggcgggtactgcgatacagaatcatttacaggccagtggccggcggcgagtccagagaagttacaacgccgcctaaccagcgtagaaggacattggagaatctgattccagatacaaaatacgaagtaagcgtgattcccgagtactttagtggcccaggtaccccgctgacaggaaacgccgctacagaagaggtccggggcaacccccgcgaccttagggtgagcgaccccaccaccagcaccatgaagttatcatggtcaggagctccgggtaaagtaaagcagtacctcgtgacctacaccccagtcgccgggggcgagacccaggaggtgaccgttagaggcgacaccaccaacaccgtcctgcagggattgaaggagggcactcagtacgctctgtcagtgaccgctctgtacgcaagcggggctggggacgccttattcggagagggaacgactctcgaagagagaggctctccacaggatctcgttactaaagacattactgacacatccattggcgcatattggacatctgcacctgggatggtaaggggttacagggtctcctggaagtctttatacgacgatgttgatactggagaaaagaatttaccagaagatgccatccatacaatgattgagaacttgcagccagagacaaagtatcggatctctgtcttcgcaacctattcctcgggggagggcgagccactgaccggagacgcaaccacagagcttagccaggattcaaaaactctgaaagttgacgaagaaacagagaatacaatgcgcgtgacctggaaacctgcaccaggcaaagtggtcaattatcgtgtggtataccgcccacatggtagaggaaagcagatggttgccaaagtaccacccaccgtgactagcactgtcctcaaaagacttcagccccaaacgacctacgacatcactgtgctccctatttacaagatgggtgagggaaaacttaggcaggggtctggtaccaccgcatccagattcaagtccccacgcaacctgaagacttctgatcctaccatgtcttcctttagggttacttgggaaccagctccaggtgaagtgaaggggtacaaagtgacctttcatcctacgggagacgaccggagactcggcgaattggtagtgggaccttatgataataccgtggtgctcgaggagctgagagctggcactacgtataaagttaatgtgttcggcatgtttgacggcggtgagagctcacctttagttggacaggagatgacaaccctgagtgacacaaccgtgatgcctatcttgtccagcggcatggagtgcctcacgagagccgaagcggacatcgtgctgctcgtggatgggtcttggagtattgggcgcgctaatttcagaaccgttcggtcattcatctccaggattgtcgaggtgtttgacatcgggccaaaaagggtgcagattgcgctggctcagtactctggggatcctcggacagagtggcagctgaacgcgcacagggacaagaagagtctcttgcaggcagtagccaatctcccctacaagggcggtaacacgctcactggcatggcactgaacttcatcaggcaacagaactttagaactcaagcagggatgaggcctcgggcgaggaaaatcggggtgctcattaccgacgggaagagccaggatgatgtggaggccccttcaaagaagttaaaagatgaaggggtcgaactgttcgctatcggaatcaagaatgccgacgaagtcgagctcaagatgattgctactgaccccgacgacactcatgcatataacgttgcagactttgaatccctaagcaggatcgtcgacgatctcaccattaacctgtgtaattccgtgaaaggcccaggggatcttgaggccccgtccaaccttgttattagtgagcgcactcacagatcattcagagtgtcgtggacaccaccaagcgatagtgttgacaggtataaggttgagtactacccagttagcggaggtaaaagacaggagttctatgtgtccaggatggaaacgtcgaccgtgctgaaggaccttaagcctgagactgaatatgtggtcaacgtgtactcggtggtggaggacgagtactctgaaccacttaaggggaccgagaaaactttacctgtacccgtcgtctcgctcaacatttacgatgtcggcccgactacaatgcatgtgcaatggcaaccagtcggaggcgccacgggctacattctctcctataagccggtcaaggatactgagcccacgcgacctaaagaagtgagactcggtccaactgtgaacgatatgcagttaactgatctggtgccgaacaccgaatacgctgtgacagtccaggcagtgctgcacgacctgaccagcgagccagtgaccgtgcgcgaagtgactctgccactgccccgtccccaggatcttaaattgagggacgtgacacatagcactatgaatgtcttctgggaacctgtcccagggaaggtgagaaaatatatcgtgcgctacaagaccccagaggaagacgtaaaagaagttgaggtggacaggtctgaaaccagcacatctctgaaggatctcttcagccagactctatatacggtgtctgtttcagcggtgcacgacgagggggaatcaccacccgtgaccgcacaggagactaccaggccagtgcctgcgccgacaaacttgaagattacagaagtcacttcagaaggctttcgtggcacatgggatcacggagcttcggatgtatcactttataggattacatgggctccgttcggatccagtgataagatggagacgatcctgaacggcgatgagaacaccctggtatttgagaacctcaatccaaacacaatctatgaggtcagcattaccgcaatctaccccgacgagagtgagagcgatgatcttattgggtccgagaggactctgcctatactgaccactcaggccccaaagtcaggaccccgcaatctgcaggtgtacaacgcgacaagtaactccctgactgtgaaatgggaccctgctagcgggagagtgcagaaataccgcataacctatcaaccaagtactggcgagggcaatgagcagacaacaaccatcggcgggcgacagaactcagttgtcctacagaagctgaagcctgataccccatatacgattaccgtgagtagcctctaccctgacggagaaggcggtcggatgacaggccggggtaagaccaaaccactgaataccgttagaaatctgcgggtctacgacccctccactagcaccctcaatgtacgctgggatcacgccgaaggtaatcctagacaatataagctgttctacgcacctgccgctggaggacctgaggagctggttccaatcccaggaaacacaaattacgcgatcctccgcaatctccagcccgacacatcttatacagtgacagtggtacccgtatataccgaaggtgacgggggtagaacttcagacactggccgtactctcatgagaggactcgcccgaaatgtacaggtctacaatccaactccgaacagtcttgatgtccgatgggatccagccccgggcccagtcctgcagtacagagtggtgtacagcccagtggatggcactaggccgtccgaatccattgtcgtgcccgggaacacgcgaatggtgcatctggaacgcctaatccccgacacactgtacagcgttaatcttgtcgcactatatagtgatggcgaaggcaatcccagcccggcccagggacgaaccctgccccgcagtggaccccgcaacttacgagtgttcggcgagactacaaactctctcagcgtggcttgggaccacgccgatggtcccgtgcaacagtacaggatcatctatagtcccacagttggcgacccgattgacgaatacacgactgtgcccggacgcagaaacaatgtaattctgcaacccctgcaacctgataccccctacaagataaccgttatcgccgtgtatgaggatggtgatggaggccatctcacaggaaacggcagaaccgtggggttgctccccccccaaaatatacatattagcgatgaatggtatactcggtttagggtgtcatgggacccatctccaagcccagtgctgggctacaaaatcgtgtataaacctgtgggcagcaacgagcccatggaggccttcgtcggggagatgacaagctataccctgcataacctgaatccaagcacaacctatgatgtcaacgtatatgcacagtacgactcaggtctatcggtgcctcttactgatcagggcaccaccctttatttaaatgttaccgacttgaagacctatcagatcggctgggataccttctgtgttaagtggtccccacacagggcagccaccagctaccgcctgaagttgtcgccagccgacggcaccagaggccaggagattaccgtgcgagggtcagagacaagccactgtttcaccgggctctcccctgacaccgactacggggtgaccgtctttgtccagactccaaatctcgagggacccggggtgtctgtgaaggaacacacaacagtgaaacctaccgaagctcccactgagcccccgaccccgcctcccccccccactattccacccgctcgagacgtgtgtaaaggcgcaaaagcagatatcgtgtttctgacggatgccagttggtccataggtgatgataacttcaataaggttgtgaagtttatatttaatactgtcggcggatttgacgagatctcacctgctggtatccaggtctcatttgtgcagtattcagatgaagtgaaaagcgaatttaagctgaatacctataacgataaggccctggccctcggagctctgcagaatatccgataccggggtggcaataccagaacaggcaaggccctcactttcatcaaggaaaaggtgctgacctgggaatctggtatgcggaagaatgtccccaaggtcctcgtcgtcgtgacagatgggcgcagccaagacgaagtgaagaaggctgcattggttattcagcagtcaggcttcagcgtcttcgtggtgggagtggctgatgttgactataatgaactggctaacatcgcttcaaagccttcggagagacacgtgtttatcgttgacgactttgagtctttcgagaagattgaggataacctcatcacgtttgtttgcgaaactgctacctcgagttgccccttgatttatttagacggctacaccagcccaggatttaagatgctagaagcctacaatcttaccgaaaagaatttcgcctccgtgcaaggcgtgtcacttgagagcgggagttttcccagttactcagcttaccgtatccagaagaacgctttcgttaaccagcccaccgccgatctccatcccaacggattgccaccctcgtacaccataattctgctgttccgtctcctccccgagacaccaagtgatccttttgcaatctggcaaattacggacagggactacaagccacaggtgggcgtgatagcagaccccagctcaaaaactctctctttcttcaataaagacacccgcggcgaagtgcagactgtaacattcgacacagaggaggttaagaccctgttttacgggtcttttcacaaggtccatattgtggtgacgagtaagtctgtcaagatctacatcgattgttatgaaataattgagaaagatatcaaagaggccggtaacattactacggatggctacgaaatacttggcaaactactgaagggtgagagaaaatcagccgcctttcagatccagtccttcgatatcgtgtgttcccccgtgtggacctcaagagacagatgctgtgatattccctcacggagagacgagggaaaatgtcctgcttttcccaattcctgtacatgtacccaggactctgtaggcccccccggcccgcctggacccgctggaggacccggtgcaaaaggcccccgtggcgagaggggtataagcggtgccatcggaccaccaggcccgcgcggcgatattggacctcccgggccccaaggcccaccaggcccacagggacccaatggcctgtctattcctggtgaacagggtcgacaggggatgaagggcgatgccggggaacctggactgccaggcaggacagggacaccaggacttcccggccctcctggaccaatgggtccccccggggatcgaggctttactggcaaggatggggctatgggcccgagaggaccccccggaccccccggttcacccggcagtccgggcgtaacagggccatcaggaaaacccggtaaaccaggggatcacggaagaccaggcccaagtgggttgaagggggaaaagggagatcgaggagatatcgcctcacaaaatatgatgcgcgctgtagcgcgccaggtgtgcgaacagctaataagcgggcaaatgaataggttcaaccagatgttaaaccagataccaaatgattatcagtctagtcgaaatcagcccggaccaccaggtcctcctggaccgcccggctcggccggtgcaagaggagaacccggacctggtggacggcccggattccctggtacaccaggtatgcagggcccgccaggagagagaggcttgcctggggagaagggtgaacgcgggaccggatcctcgggcccacggggactgcctggcccacccggccctcagggagaatcaagaactggcccacccgggtcaacgggctcgagagggcctcccggaccgccggggaggccaggaaactcaggcatccggggccctcccggcccacccggatattgcgactcctcacagtgtgcgagtatcccgtacaatggacagggttatccaggcagtggctag

SEQ ID NO: 2616 - DNA, 5700 bp, Artificial Sequence
  Description of Artificial Sequence: Synthetic coding sequence
atgaggagtcggctccccccagcactcgccgccctgggagcagccctgcttctcagctccatcgaagctgaaggaatggaatgcctcaccagggccgaagccgatatagttttgctggtggacgggagctggtcaataggtagggccaactttcggaccgtgaggagtttcatctccaggatcgtggaggtgtttgacatcggccccaaaagggtgcagatcgccctggcccagtacagtggagatccacggacagagtggcagctgaatgcacaccgggacaaaaagtctctcctccaggcagtggcaaacttgccatacaagggcgggaacacccttacgggcatggccctgaattttatcaggcagcaaaattttcgaacacaggctggcatgaggccccgagcaagaaagattggggtgctaataaccgatgggaaaagccaggacgacgtcgaagcaccctccaagaagttaaaagatgagggggttgaactgtttgcaatcggcatcaaaaacgccgatgaggtggagcttaaaatgatcgcgactgatcccgatgacacccacgcctacaatgtggcggatttcgaaagtctgagtcgaatcgtcgacgatctcactatcaacctgtgtaactcagtgaaaggtccgggtgacctggaggccccatctaatctggtcatttctgaacggacgcatcgctcgttccgcgtgtcatggaccccaccatcagactctgttgatcgatataaagttgaatactatcccgttagcggtggcaagcgccaggagttctatgtcagcagaatggagacctccaccgtcctcaaagatctgaaacctgagaccgagtacgtggtgaacgtttatagtgtcgtagaggacgagtattccgagccactaaagggcaccgagaaaacacttcctgtgcccgtcgtgtctctgaacatttatgacgttggacctacaaccatgcacgttcagtggcagccagtgggcggggctaccgggtatatcctttcgtacaagccagtgaaggataccgaacccactcggccgaaagaagtgagactggggccaaccgttaatgacatgcagctgaccgacctagtaccaaacacagagtatgccgtcaccgtccaagctgttctgcacgaccttacaagcgaacctgtaaccgtgagagaggtcacgctgcctcttcctagaccgcaggacctcaagctgcgtgacgttactcacagtacgatgaacgttttttgggagcccgtcccagggaaggttcgcaaatacatcgtaagatacaaaactccagaggaggacgtgaaggaagttgaggtcgaccgctccgagacctcaaccagtctcaaggacctcttctcccagaccctgtatactgtgtccgtatccgcagtccatgacgagggggagtccccaccggtgacagctcaagaaacaacccggccagtcccagccccaactaatctgaagatcactgaagtgacatcagagggctttcgcggtacatgggaccacggagcctctgacgtgagcctctaccgtattacttgggcccctttcgggagcagtgacaaaatggagactattctcaacggagatgagaacaccttggtgtttgaaaatttaaatccaaatactatttatgaagtgtcaattactgccatatatccagacgagtcggagtcagacgaccttatagggagtgagcgcactcttcctatattgacaacccaggcccccaagtccgggccgcggaatctccaggtttataatgccacaagcaattccctgaccgttaagtgggaccccgctagtgggagagtccaaaagtatcgcataacgtaccagccctcaacaggggaaggtaacgaacagaccaccactatcggcggccgccagaattccgttgtgctgcaaaagctcaaacctgatacaccctacacaatcactgtgagtagcttataccctgatggagaggggggccgcatgacaggccgagggaagactaaaccactcaacacagtacggaacttgcgcgtgtatgacccaagcacttccactttaaacgtgcggtgggaccacgcggaggggaacccccggcaatacaagcttttttacgctccagcagctggaggacctgaggaactggtgcccatccccgggaataccaactacgctatcctcaggaacctccagccagacacatcatataccgttactgtggtgccagtttacactgaaggtgacgggggccggacttctgatacagggcggaccctgatgcggggcctggcaagaaacgttcaagtctacaatccaactcctaactccttggacgtaaggtgggatcccgcacccggtcccgttctacagtacagagttgtgtacagccccgtggacggcactaggcctagtgagtcaattgtagtaccaggcaacactaggatggtccacctagaacggttaatcccagacacactgtactccgtgaacctggtggcactgtattccgatggggaggggaatccctccccagctcagggtcgcacacttccgcgatctgggcctcggaatctgagagtcttcggcgaaactacaaacagcctgtccgtcgcctgggatcatgcagatggcccagtgcagcaatatagaatcatttacagcccaacagttggagaccctatcgatgagtatacaaccgtcccagggcgccgaaataacgttatcttgcagcctctgcaacctgataccccttacaagataactgtgatcgcagtgtacgaagacggagatggagggcaccttaccggcaatggcagaacagtaggcttgctccccccacagaatattcacatctccgacgagtggtatacacgatttagggtatcttgggatccttctcccagtcccgtgcttggatataaaatcgtgtataaacccgtaggatccaacgaaccaatggaggctttcgttggcgagatgacaagctatactttgcataacctgaatccttctaccacctacgacgtcaacgtgtatgcacaatacgactcgggcctgtcagttccactaactgatcagggcactactctgtatttgaatgtgaccgatctcaagacctaccaaatcggctgggacacattttgcgtgaaatggagcccacacagggcagcaaccagctacagactgaagctctctccggccgatggcacacgcggtcaagaaatcaccgtgagaggctcagaaacgagtcactgtttcacaggactctctcccgacaccgattatggcgtcaccgtctttgtgcaaacccccaacctagagggtcccggagtctctgtcaaagagcatactaccgtaaagccaacagaagccccgacagagcctcccactcccccacctccacccactatccctcccgccagggacgtctgtaagggggccaaggcagatatagttttcctgaccgacgcgtcctggtctataggagacgacaacttcaataaggtggtcaagttcatattcaatacagtgggcgggtttgacgagatttcaccagcagggatccaggttagcttcgtacagtacagcgatgaggttaagtccgaattcaagctgaacacttataatgataaagctcttgcacttggagctctgcagaatattaggtacagaggtggtaacacccgaactggcaaagcattgacctttattaaagaaaaggtcttgacttgggaatcggggatgcgtaagaatgtgcccaaggtgcttgtggtggtaaccgacggaaggtcccaggatgaggtgaagaaggctgctttagtgatacagcaatctggatttagtgtgttcgtcgttggcgtggctgacgtggactacaacgagctagcaaacattgcatctaagccatctgagaggcatgttttcattgtggacgattttgagtcctttgagaagattgaagacaaccttatcaccttcgtctgtgagaccgcgactagctcgtgcccgttaatctatctagacggctataccagccctggcttcaaaatgctggaagcctacaatctgacagagaaaaacttcgcctccgtccagggggtttcactggagtccggctccttcccaagctattccgcctaccggattcagaaaaacgcctttgtcaatcagcctaccgccgacctgcaccccaatggcctgcctccgtcctataccattatactgctgtttaggctgctgcccgagacccccagtgatccatttgctatctggcaaattaccgacagagattacaaaccacaagtaggcgtcatcgctgacccatcatcaaagaccctgtcattcttcaataaagatactcgcggcgaagtccagacagtgacattcgacaccgaagaggttaagactctattctacggcagctttcacaaggtgcatattgtggtcaccagcaaatcagtcaaaatttacatcgactgctacgaaataatagagaaggatatcaaagaggccggcaatataacaacggacggatatgaaattctcggtaagctactgaagggtgagagaaagtctgctgcctttcaaatccagtcctttgatattgtctgtagccctgtctggacctcaagggacagatgttgtgatattccctctcgaagggatgaaggcaagtgcccagcctttcctaatagttgcacgtgcacccaggactctgttggaccaccaggacccccgggccctgccggtggtcctggtgccaaaggccccagaggcgagcggggtatctcaggcgccatcggaccccctggaccacgcggggacatcgggccccccggtccccagggacctccaggtccgcagggcccaaacggcctgtctatccccggagagcaggggagacagggaatgaaaggcgacgctggcgagcctggactgcctggcaggacaggtaccccggggctgcctggccctcccggaccgatgggaccccctggtgatcggggcttcaccggaaaagacggcgcaatgggaccacgaggtccgcctgggcctccgggtagcccaggcagccctggagtgactggacccagtggaaagccgggtaagcctggcgatcacggacggcctggcccctccggcctgaagggcgagaagggcgaccgcggcgacattgcaagccaaaacatgatgagagctgtggctcgccaggtttgcgagcagctcatttcaggtcagatgaatcggttcaatcagatgctgaaccaaatccccaacgactaccagtcaagtcggaatcagcctgggcctcccggcccacccggacctcccgggtcggcaggagccaggggagagcctggcccagggggtcgacctggctttccaggcacccctgggatgcaaggccctcctggtgagcggggccttcctggcgagaagggcgaacgaggaacagggagtagcggccctcgaggccttcccggaccacccggcccacaaggagaatctcggaccggtccaccgggtagcactgggtcaagggggcctcccgggccacctggcaggccagggaactccggcattcggggcccccccggccctccagggtactgtgactctagccagtgcgctagtatcccctataatgggcagggataccctggttccggctag

SEQ ID NO: 2617 - DNA, 8964 bp, Artificial Sequence
  Description of Artificial Sequence: Synthetic coding sequence
atgcggtcccgattaccccccgctctggccgcattgggggccgctctgttactttcttcaatcgaagctgaagtggatcccccaagtgacctcaattttaaaatcattgacgagaacactgtccatatgtcctgggcgaaaccagtggatcccatcgttggctacagaatcacagttgaccctacaacagatggacccaccaaggaatttacgcttagtgcctcaacaaccgagaccctgctatccgagctagttcctgagaccgagtatgttgttacaataacctcatatgatgaagtcgaagaatctgtgcccgtcatcggccagctgaccatccagacaggctccagcacgaagcccgttgaaaagaagcctggaaagaccgagattcaaaagtgctccgttagtgcctggaccgatttagttttccttgtggacggaagttggtcagtcgggcgtaacaacttcaagtacatactggatttcatcgcggcccttgtctcagcgtttgacattggtgaggaaaagactcgggtcggcgtggtgcagtactcctctgacactagaactgaatttaaccttaaccagtattatcagagagatgagctgctagccgcaataaagaagattccatacaaaggcgggaatacaatgactggggatgcaatagactacttggtcaagaatacatttaccgaaagcgccggagctagggttggtttccccaaagtggctatcattataaccgacgggaagagccaagatgaagtggagatcccagcccgtgagctccgtaatgtcggggtggaagtgttctctctcggcatcaaagcagccgacgctaaggagttaaaacagattgcttcaaccccttccctgaaccatgtgttcaacgtcgcgaatttcgatgccattgtggacattcagaacgaaattatttcccaggtgtgctccggtgtggatgagcagctgggtgagctcgtgagtggcgaggaggtcgtcgagcccccttccaatctcatcgccatggaggtctccagtaaatacgtcaagcttaactggaatccttcccctagtcctgtgaccggatataaagtgatactgacacctatgaccgccggaagtcggcaacatgctttatccgtcggccctcagaccaccacactgtccgtgcgtgacttatctgccgacaccgagtatcagatctctgtttcagcgatgaaaggcatgacttcttcggagccaatctctatcatggaaaagacgcagcccatgaaggtccaggtggaatgttcaaggggtgtagacatcaaggcagacatcgtgttcctggtcgatggctcttactctatcggtatcgcgaattttgtcaaggtgcgcgctttcctggaagtgctagtcaagtctttcgagatatctccgaacagggttcagatcagcctagttcagtactccagagatccccatacagagttcactcttaagaagttcaccaaggtagaggatattatcgaagccataaacaccttcccttaccgcgggggttctacaaataccggtaaggccatgacttatgtccgtgaaaaaattttcgtgccttccaaaggaagtaggtcaaatgtacctaaggtgatgatcctgatcaccgacggcaagagctccgacgcgttccgggacccagccatcaagctgcggaatagtgacgtcgagatttttgcagtgggggttaaagacgccgtgaggtccgaattagaagctatagcttctccgccggcagagacccacgttttcaccgtcgaagatttcgacgcctttcagaggatctcttttgagctaactcagagcatttgtctccgcatagagcaggaattggccgccataaaaaaaaaagcctacgtgcctcctaaggacctgtcgttttctgaggtgaccagctatggcttcaaaactaactggtcacccgcaggtgaaaacgtattttcgtatcacattacctacaaggaggcggccggagacgacgaggtgacagtggtcgaaccggccagcagtaccagtgtggtgctgagcagcctgaaaccggaaacactttaccttgtgaatgtgacagccgaatatgaagacggcttttctattccactggcaggcgaggagacaactgaggaggtcaagggcgcccctcgtaacctgaaggtgaccgatgagacaacagactcttttaagattacttggacccaggcacctggtagggtcctgaggtacagaatcatctaccgccccgtagctggaggggagtcacgtgaagtcacgacaccaccaaaccagcgccgaaggaccttggagaatttgatccccgacactaagtacgaggtctccgtgattcctgagtacttctccggtcctggaacacccctaacgggcaacgctgctacggaggaagtgaggggcaaccctcgagaccttcgggtttccgaccctaccaccagcacaatgaagctctcttggtctggtgctcccggcaaagtgaagcagtacctggtcacctacacccccgtcgcaggaggcgagacacaagaagtcacagtgagaggcgatactacaaacaccgtactccagggactaaaggagggcacgcagtacgcccttagcgtaaccgcactatacgcttctggcgctggggacgcactgtttggcgaagggacaactcttgaggaaagaggatcgcctcaagacctggttacaaaagacattaccgacacatccataggtgcctactggaccagcgctccaggaatggtcaggggctaccgggtcagttggaagtctctgtatgatgacgttgataccggggaaaaaaacctgcctgaagacgccatccatactatgattgaaaacctgcaacccgagacaaaatacaggatttccgtgttcgctacatattcatccggagagggtgaaccccttacaggagacgccacaaccgaactgtctcaagactccaaaacactcaaagtcgacgaggaaacagagaacactatgcgggtcacatggaaacccgccccaggcaaagtcgttaattatcgcgtagtgtaccgacctcacggtagagggaaacagatggtggccaaagtcccacccacagtcacctccacagtgttgaagcgtttgcagccccagactacatacgacatcaccgtgctgccgatttacaaaatgggggagggaaagctgcgccaaggctcaggaacgaccgcctcacgtttcaaatcacctaggaatctgaagacctctgatcctacaatgtcttcattcagggtgacttgggagcccgcacctggtgaggttaagggttataaggtgacttttcacccaactggagatgacaggcggcttggagagctggttgtcgggccctacgacaacactgtcgtgcttgaggaattacgtgccggcactacttataaggtgaatgtctttggcatgttcgatggcggtgagagttcacccttggtcggccaggagatgaccaccttgtcagacacgactgttatgcccatattgtcttctggaatggagtgtcttacccgagcggaggcagatatcgtgctgctggttgatggatcttggtcgatagggcgggctaactttcggacagtccgcagttttatttctcggattgtcgaggtcttcgacatcggacccaaacgagtccaaattgcactggcgcagtacagtggtgaccctcggactgaatggcaactgaatgcccatcgagacaagaagtctctcctgcaggccgttgctaacctgccctacaagggtggtaatacactgacagggatggctctgaattttatcagacaacagaatttccgcacgcaggccggcatgaggcctcgcgcacgcaagatcggcgttttgataacagacgggaaatctcaagatgatgtggaggcacctagcaagaaacttaaggacgagggggtggagttgtttgctattggaatcaaaaatgccgatgaagtcgagctgaagatgatagccactgaccctgacgacacacatgcctataacgtggccgactttgagagtctgtctcggattgtcgatgatttaacaatcaatctatgtaattcagtcaaaggcccgggggatctggaggcacctagtaacttggtgatctccgaacgtactcatcgcagcttcagagtcagttggacacctccgtcggattccgttgaccggtataaagtggagtactatccagtgagcggcggcaaaaggcaagagttctacgtttccaggatggaaactagtacagtcctgaaggatttgaaacccgagacggaatacgtggtgaatgtttactctgtggtggaggatgaatattcagaacctttgaagggaaccgagaagactctacccgtccccgttgtaagcctgaatatatatgacgtaggtccgacaacaatgcatgtgcagtggcagcctgtggggggggctaccgggtatatacttagctacaaacccgtcaaggatacagagcctactagacctaaggaagtgaggctgggccctactgtgaatgacatgcagctgaccgatctcgttcccaacacggagtatgccgtgaccgtgcaggcagtgttacatgacctgactagcgagccagtgaccgtgcgtgaggtgacattgcccctcccacgcccacaagacctgaagctgcgggacgtaacccactcaacaatgaacgttttttgggaaccggtcccggggaaagttaggaaatacatagtgcggtataagacccctgaagaggacgtgaaggaagtggaggtagaccgcagcgagacctcgacaagcctcaaggacctcttttcccagactttgtatactgtctcagttagcgctgtccacgacgaaggggaaagtccacccgtgacagcacaggagacgacaaggcccgtgcctgccccaacgaaccttaaaatcacggaggtgacatctgaaggcttcaggggaacctgggaccacggagccagcgacgtgagtttgtaccggatcacttgggccccctttgggagtagcgataagatggagaccatcctgaatggtgatgaaaataccctggtatttgaaaacctgaaccccaacaccatatacgaagtttcgataacagctatctacccggatgagtcagagtctgacgatctgatcggcagtgaaagaaccctgccaatcctgactacacaggcgcccaagtcaggtccccggaatctgcaggtgtacaacgccacctctaactcattaactgtgaagtgggaccccgcatctggcagagttcagaagtaccgtataacctatcaaccctctacaggagaagggaacgagcagacgactactattggaggtcgccagaacagcgtggtcctgcagaaattgaagccagacaccccatatacaataaccgtctcttctttgtatcccgatggagaaggggggcggatgactggaagaggaaaaaccaagcccttaaatactgttaggaatctgcgagtatacgacccatccacgtctacccttaacgtacgctgggatcacgccgagggaaacccgagacagtataaactgttttacgcaccagccgccggcgggcctgaggagctggttccaattcctgggaacaccaactatgctatcctgcggaacttgcagccagataccagttataccgtgacagttgtacccgtatatacagaaggtgatggcggtcggactagcgacaccggaagaactcttatgcgcggtctcgctagaaatgtgcaggtgtacaatcccacacctaactccctcgatgtgaggtgggaccctgctccagggcccgtactgcaatacagggtggtctatagccccgtggacggcactcggccctccgaaagtatcgttgtgcctgggaacacccggatggttcacctggaacggcttattcccgacaccctgtacagcgtcaacttagtggcactctatagtgatggggaaggtaatccgagccccgcacaggggagaaccctgcccagaagcgggcctcggaacctgagagtgtttggggagactacgaacagcttgtctgtggcgtgggatcacgccgatggaccagtgcaacagtaccgtatcatctacagtccgacagtgggagaccccattgatgaatacacaaccgtgccaggacgccggaataacgttatactccaacccctccagccagatactccatacaagataacagtgattgcggtatatgaagacggcgacgggggtcacctgacggggaatggccgaaccgtggggttgctaccaccacagaatatccatatttcagacgaatggtacactcgattccgggtcagctgggatccctcgccgtctcccgtgctgggctataagatcgtatacaagcccgtaggatctaacgaacccatggaggccttcgtgggtgagatgacaagctacacgctccataacctgaatccctccaccacgtatgacgtcaacgtctacgctcagtatgacagtggccttagcgttcctttgaccgaccagggtaccacattataccttaatgtgacagatcttaagacttatcagattggttgggacactttttgtgttaaatggtcaccacacagggccgctacctcgtatagactgaaactgtccccagcggacggtacccgtggtcaggagattaccgtgcgtggaagtgagacttcgcactgcttcactgggctaagcccagatactgactacggtgtaaccgtgtttgtccagacccccaacttagagggccctggggtgtctgtgaaggagcatactactgtgaaaccaactgaggccccaacagaaccccccacacctccaccgcctcccacaattccccccgccagggatgtctgcaagggggccaaggccgacattgtcttcctgacagacgcttcctggtcaatcggggatgataatttcaataaagtggtgaaattcatctttaacaccgtcggagggttcgacgagatctccccagccggaatccaggtgtccttcgttcagtactctgatgaagtgaagagcgagtttaaactaaatacatacaacgacaaagcgctagccctgggagcgttgcaaaacatcagataccgtggtggaaacaccagaaccgggaaagccctgacctttattaaagaaaaggtgctcacctgggagtccggaatgagaaagaacgtccccaaggtactggttgtcgtaacagacggacgatcacaggacgaagtcaagaaggccgctttagttatccagcagagtggcttttccgtgttcgtggtcggcgtcgctgatgtcgactacaatgagctggcaaatattgcatccaaaccctcagagcgccatgtgttcatcgtggacgactttgaaagctttgagaagatcgaggataacctgatcacttttgtgtgcgagactgctacctcttcctgccctctcatttaccttgacggatatacatcccctggcttcaagatgctcgaggcatacaacctgaccgaaaaaaacttcgcctctgtgcaaggggtcagccttgaatccggaagctttccaagctactccgcttatcgaatacagaagaatgctttcgttaatcagcctactgcagacctgcaccctaacggcttgcccccatcctacactatcatcctgctgtttagactgttgccagagacacccagcgatccattcgctatatggcagattaccgacagagactacaaaccccaggttggtgttatcgcggacccatcttccaagaccctgtcctttttcaataaggacactcgtggtgaggtgcaaacggtgacgttcgacacggaggaagtcaagacccttttctacggtagctttcataaacgtgacgaaggtaaatgccccgccttccccaactcttgcacttgcactcaggactcagttgggccacctgggccccctggacccgcgggtggtccaggagccaagggcccccgcggagagcgcggcatttctggagcgatcggaccaccgggcccccgaggcgacatcggtcctccaggcccacaggggccgccaggaccacagggacctaacgggctgtctattcccggcgaacaagggaggcaggggatgaagggcgacgctggcgagcccggtctccccggacggactggcactcccggcttaccaggtcctcccgggcctatgggaccaccgggggatcggggctttaccggaaaagatggtgctatggggcctcgcgggccacccgggcccccaggcagtcccggatcccctggcgtgacgggtccatctgggaaacccggcaagccgggcgaccacggaagacccggaccaagtggccttaaaggcgagaagggtgatagaggtgatattgcctctcagaatatgatgagggctgtagctagacaggtctgcgagcagttgatcagtggacagatgaatcggttcaatcagatgctaaaccagattcctaacgattatcaatcgtcacggaaccagcctgggccccccggccctccaggcccaccaggctcagcaggcgcccgcggcgagcctggtccagggggccggcccggattccctggcacaccaggcatgcagggacctcctggggagcgcggtcttcccggggagaagggggagagggggaccggaagttctggacctagaggtttacccggaccccctggaccacagggtgaatcaaggactggaccacctggttccactggctctaggggccctcctggcccccctggacggccaggaaacagcggaattaggggccctccagggccccctggctattgtgactccagtcaatgtgcctccataccctataacggacaggggtatcccggctctgggtag

SEQ ID NO: 2618 - DNA, 2088 bp, Artificial Sequence
  Description of Artificial Sequence: Synthetic coding sequence
atggtcgccgaaaggacccataaggcagctgccacaggggccagaggacctggtgaattgggtgcacccggcactgtggccctggtggctgctagagcggagcgcggcgccaggttgcccagcccgggatcatgtgggctcttgacactagcgttatgtagcttagcactgagtttattagcacacttccgaacagccgagctccaggctcgcgtcttgcgccttgaggccgaaagaggggaacagcagatggagacggctatcctcggcagagtgaaccaactgctggatgaaaaatggaagctgcacagtcggcggcgccgagaggctccaaagacctctcccgggtgtaattgcccgccgggcccaccaggacccacaggccgtcccggtcttccaggagacaaaggcgccatcggtatgccgggcagagtgggcagcccaggcgacgcaggcctctcaattattgggccccgtggacctccaggacagcccggcaccaggggctttccagggtttccaggccctattgggcttgatggcaaaccgggtcatccaggcccaaaaggcgacatgggcctgaccgggccaccaggacaacccggcccacaaggtcagaagggagagaaaggacagtgcggcgaatacccacatagagagtgtctgtcctctatgccagctgcccttagaagcagccagattattgctctgaaaggggagcagtcacaggcctcgatacagggcccacctggtccccctggcccaccaggcccatccggaccattaggacatcccggactccctgggcctatgggtcccccaggactgcctgggcctccaggtcctaaaggcgacccgggcattcagggctatcacggacgcaagggtgagaggggaatgcccggtatgcccggaaagcacggagccaagggcgctccagggattgcagtagccggcatgaaaggggagcctggcattccaggaactaagggtgaaaagggcgcagaggggtctcctgggctccctgggcttttgggccagaagggcgagaagggagatgcagggaattccataggcggagggaggggtgagcccggcccaccaggactaccgggaccccctggccctaagggcgaagccggtgtagacggccaagtgggcccacctggccagcccggagacaaaggcgagagaggagccgccggagaacagggcccggacgggcctaagggctccaaaggggagccaggaaaaggtgagatggtggattataatggaaacatcaatgaggctctccaagagattcgaaccctggcactaatggggcccccaggactgcctggtcagattggaccacccggggccccaggcattcccggacagaagggggaaattggcctgccaggcccacccgggcatgatggcgagaaggggcctcggggcaagcctggcgacatgggccctcccggaccccagggccctccaggtaaggacggccctccgggagtgaaaggcgagaacggccacccgggaagccctggtgagaagggagagaagggggagactggacaggctggctcccctggggagaaaggggaggccggggagaagggcaatcccggggccgaggtccccggattgcccgggcctgaaggcccgcctgggccacctggacttcagggcgtaccaggtcccaagggagaggctggattggatggggccaagggagaaaagggctttcagggggagaaaggagatcgcggcccgctggggctccccggggctagcggtctcgatggcaggcctggtcctccaggaacccccgggccaattggggtgcccggaccagccggccctaagggcgagaggggatcgaaaggcgaccctgggatgacagggccaactggcgcagccgggctgccaggcttacatggccctcccggggacaagggcaaccgtggcgaaagagggaagaagggctcgaggggcccgaaaggcgataagggagaccagggcgcgccaggcctggatgctccctgccccctcggcgaggatggccttccagtgcagggatgctggaataagtag

SEQ ID NO: 2619 - DNA, 2154 bp, Artificial Sequence
  Description of Artificial Sequence: Synthetic coding sequence
atggtggccgagagaacccataaagcagcagccacgggcgccaggggccccggagaactgggcgcacctggcacagtggccctagtggccgcccgcgccgagaggggtgctcgcctccctagcccgggttcatgcgggctgctcacattagctctatgctcccttgctctgagcttactcgcacactttcgtactgccgaactgcaggcacgggtactcagactggaagccgaaaggggggagcagcaaatggaaacagccattctggggcgcgtgaatcaattactagacgaaaaatggaagctccacagccggcgtagaagggaagctccaaagacctcgcctggctgtaattgtcccccagcctttcagggacctactggacgcccaggccttcccggagacaagggtgccattggaatgccaggccgcgtcggtagccctggcgatgctggcttgtccatcatcggccccagaggaccgcctggccagcctggaacccgcggcttccctggctttcccgggcctattgggctggatggaaagcccggtcacccaggaccaaagggtgatatgggtctgaccggaccccctggtcaacccgggccacaaggacagaagggagaaaagggtcagtgcggagagtacccccacagggagtgtctcagtagcatgccagcagctttgcggtcaagccaaataatagcacttaaactgctgcctcttctgaattcagtgaggctggcccccccaccagtcattaagagacgcacgtttcaaggtgaacagtcccaggcatccattcagggacctcccggacccccaggcccccccggaccaagcggaccgctcggtcacccagggcttcccgggcccatggggccacctgggttgcccgggccccccgggccaaaaggggatcctggaatccagggctatcacgggcgcaaaggggagcgcggcatgcccggaatgcctggaaagcacggcgcaaagggcgcccctggcatcgccgtggcagggatgaaaggggaacccggtatccccgggaccaagggggagaaaggggccgagggttccccaggcctgcccggcctactgggacagaagggtgagaagggggacgctgggaactctattggtggcgggcgaggggagccaggaccacccggactccccggaccaccaggacccaaaggggaagcaggggtcgacggacaggtggggcccccaggacagccaggcgacaagggtgaaagaggtgcagcaggcgaacaggggcctgacgggccaaaagggagcaaaggtgagccaggcaaaggtgaaatggttgactacaatgggaacattaacgaagctctgcaggagattcgaaccctagcgctgatgggacccccaggcttgcctggacagatcggaccacccggggcacccggcatcccagggcaaaagggagagatcggccttccagggcctccaggtcacgatggagagaaaggaccacggggcaagcctggcgacatgggaccacctgggccccagggaccccctggaaaggacggccccccaggagtgaaaggggagaacggccacccaggatcgcccggagaaaagggagagaagggcgaaacagggcaggctggctcaccgggggaaaaaggcgaggcgggcgaaaaggggaaccccggtgcagaagtgcctggcttaccagggccagaaggccctcccggccctccgggtcttcagggagtccccggccctaagggtgaggctggacttgatggagccaaaggcgaaaagggctttcaaggcgagaaaggggacagaggaccactcgggcttccgggtgcttctggcctggacggtcgaccaggaccaccaggcactcccggccccatcggggtgcctggccctgcgggccccaagggcgagcgagggtccaagggagacccaggtatgaccggaccgactggggctgccggtctgcctggtttgcacggtccgcctggtgacaaagggaatcgaggcgagcgcggtaaaaagggcagccgggggcccaaaggcgataagggtgatcagggagcacccggccttgacgccccctgtcccctcggtgaggacggtctgcccgtgcagggctgttggaacaaatag

SEQ ID NO: 2620 - DNA, 2052 bp, Artificial Sequence
  Description of Artificial Sequence: Synthetic coding sequence
atggtggccgagcggacacataaggcagcggcaactggggctaggggacccggcgagttgggggctccggggacggtggcactggtggccgcccgagcagagaggggtgctcggctcccaagccccggttcttgcggtctgttaacgctggcactatgtagcttggcactgtctttgcttgcccattttcggaccgccgaactccaggccagggtcctgagactcgaggccgaacggggtgagcaacaaatggaaactgcaatcctcggtagggttaatcagcttttggatgaaaagtggaagctccactcaagacgcagaagggaggcacctaaaacgagtcctggatgcaattgtcctcctggtccacctggccctaccgggcgcccaggcttgcctggagacaaaggcgccattgggatgcccggccgcgtgggcagtcctggtgacgccggactgtcaataatcggccctagaggtcctcccggccaaccaggaacccgggggtttccaggattccccggtcccataggattggatggaaaaccaggacaccctgggcccaagggggatatgggtcttacaggcccaccaggacaaccagggccccaggggcagaagggagagaagggccagtgcggagagtaccctcatagggaatgtctgtccagtatgcccgccgccctgcgctctagccagattattgccctgaagggagagcaatcacaggcctctatccagggccccccaggccccccggggcctcccgggcccagcggccctctgggccatcctggcttgcctggacctatggggcctcccggtctcccaggtccccccggacctaagggagatccaggcattcaaggttatcatggacgcaagggtgaacgcggcatgcccggaatgccaggcaagcacggtgccaagggggcgcccggtattgccgtcgcaggtatgaagggcgagccagggatccctgggaccaagggcgagaagggggccgaggggtcccctggccttcccggcttgttgggccagaagggcgagaagggcgacgcaggaaattccattggcgggggcagaggggagccagggccccccggcctcccaggtccacccggtcctaagggagaggccggtgtagacggacaagtgggccccccaggccagcctggcgacaaaggagagagaggagccgcaggtgagcaaggccccgatggacccaagggttctaagggcgaaccgggaaagggcgagatggtcgattacaatggaaatatcaacgaggccttgcaagagatacgcactcttgcactaatggggccacccgggctcccgggacaaattggcccaccaggagcacccggcataccagggcaaaagggggaaatcggattgcccggaccacccggccatgatggggaaaagggcccacgcggaaagcccggcgatatgggacccccaggacctcaggggccacccggtaaggacgggcctcccggagtcaagggcgagaatggtcaccccggcagccctggcgaaaagggagaaaaaggcgaaactggccaggcagggtcgccgggggagaaaggcgaagctggagagaaagggaaccccggtgccgaagtgccagggctgcctggtcccgagggaccgcccggcccccctggcctacaaggcgtgcccggcccaaaaggcgaagctggattggatggggccaaaggagagaagggcttccaaggggagaagggagacaggggccctctgggcctgcctggcaccccaggtcctatcggagtgcctggccctgccggccctaagggagaacggggcagtaagggcgacccaggtatgacgggccccaccggggcagctggattacctggcctgcacggtccaccaggagacaaaggaaaccgtggagaaagaggtaaaaaaggatctcggggtccaaaaggagacaagggcgaccaaggggctcccgggctagacgcaccatgtcccttaggagaagatggtctcccggtccagggttgttggaacaagtag

SEQ ID NO: 2621 - DNA, 2067 bp, Artificial Sequence
  Description of Artificial Sequence: Synthetic coding sequence
atggttgccgagcgtactcataaagccgccgcgacgggtgctaggggccccggcgagttgggtgcaccaggaactgtcgccctggttgctgcgagggccgaacgtggtgcaaggctaccctcccctgggtcctgcggactgttgactctggcactttgttctttagctttaagcctgctggcccacttccggactgccgagctacaggccagagtgctgcgacttgaagcagaacgcggcgaacagcagatggagaccgcaatactgggtagggttaaccagctgctcgacgaaaagtggaaactgcactcgaggagacggcgggaagcccctaagacctccccaggatgtaattgtccacctgccttccagggtcctactggacgacctggactgcctggccagcctgggacgcgaggatttccagggtttcctgggcctatcggcctcgatggcaagcctggccaccctgggccgaagggcgacatgggcctgactggtcctcctggtcaaccaggtcctcaagggcagaaaggagagaagggacagtgtggtgagtatcctcaccgggagtgcctcagttctatgccagcagctcttcgcagttcccagatcatcgctctgaagctgctcccgcttcttaacagcgtacggttggctccacctcctgtgataaagaggaggacttttcagggagaacaaagtcaggcatcaatccagggaccacccggcccacctggccctcccggcccctctgggcccctcggccacccaggacttccaggccccatgggccctccgggcctgccaggcccgccgggtccaaagggcgacccaggcattcagggataccacggccgtaagggggagaggggtatgcccggcatgccgggcaaacacggtgcaaaaggagcaccgggcatcgctgtggcgggtatgaagggcgagcctggaatcccgggtacgaaaggcgagaaaggggcggagggctctcctggattacccgggcttttgggacagaaaggggaaaagggagacgccgggaattcgatcgggggagggcgcggcgagccaggaccgccagggctccccggaccccctggcccaaagggcgaggcgggtgtggatgggcaggtggggccccccggtcagcccggcgacaaaggcgaaagaggagcagccggagagcaggggcctgacggacccaaaggatcaaagggagaacccggaaagggcgaaatggtagattataatggtaacattaatgaagccctgcaggaaatccggacgttagcgcttatgggccccccgggtctgcccgggcagatcggaccaccaggagctcctgggatccctggacagaagggggagattgggctgcctggacctcctggtcacgacggggaaaaaggcccccgtggtaaacccggggacatgggccccccaggaccgcagggacctcctggaaaggatggccctcctggggtgaagggggaaaatggacatcctggttccccaggggagaaaggtgaaaagggagagaccggccaggctggttcacctggtgaaaagggggaggctggagagaaggggaacccgggcgctgaggttcctggcctccctggaccagagggcccgccgggtccacctggcctccaaggcgtgcccggaccaaaaggagaagctggactcgatggagccaagggggagaaaggatttcagggggaaaaaggcgaccgcggacctctggggcttcctggcgcctcaggcttagatggacggcctggacccccagggactccagggcctattggtgttccgggccccgcgggaccgaagggagaacgcggatccaagggtgaccccggcatgaccggtccaactggggctgctggccttcctggacttcatgggccaccgggcgacaagggcaataggggagaacgaggcaaaaaggggagtagggggcccaagggcgacaagggcgaccaaggagcacctggactggacgccccttgcccactaggggaggacgggctccccgtgcagggctgctggaataaatag

SEQ ID NO: 2622 - DNA, 2088 bp, Artificial Sequence
  Description of Artificial Sequence: Synthetic coding sequence
atggtggctgagcgcacccacaaggccgctgcaaccggggctaggggccctggtgaattgggtgcgcctggtacagttgctctggtggccgcaagagctgaaaggggcgcccggctcccctccccaggatcgtgcggcctgttgacattggccctttgtagtttggctctgtcactactggcccactttcgaacggcagagctacaggctagggtactgagactggaggcggagcgcggggaacagcagatggagacagctatcctcggacgcgtcaatcaactgttggacgagaagtggaagcttcacagcaggaggaggcgggaagctcccaaaaccagccccgggtgtaattgtccgcctgctttccagggtccgaccggacgtccaggccttcctggcgacaagggtgcaatcggcatgccgggtcgggtgggttcgccaggcgatgccggactgtcaattatcggacccagaggtcccccagggcagccaggtacgcgtggattcccaggctttccaggccccatcggcttggacggcaaaccagggcacccaggcccaaagggggatatgggtttgacgggacctccaggccaaccaggtcctcaggggcagaagggcgaaaagggccagtgcggcgagtatcctcacagagagtgcctttcctcaatgcccgccgcactgcggagctctcagattatcgcgctaaaaggtgagcagagccaagccagtatccagggtcccccagggccccctggacccccagggccaagcggccccctgggccacccagggctgccaggccctatggggccacctggattgccgggaccccctggaccaaagggagatcccggaatacaagggtaccatggtcgtaagggagagcgtgggatgcctggcatgcctgggaagcacggtgccaagggagcaccaggaatagctgtagcgggcatgaagggcgaaccaggaatcccggggactaagggggaaaaaggagcagaaggtagccccggtttgcccgggttgctcgggcagaagggtgaaaagggggacgctggcaactctattggcgggggaaggggcgaacccggccctcctggcctgcctgggcccccaggacctaagggcgaagcgggagtcgacgggcaggttggcccacctggccagcccggagataaaggagagcgcggcgcagccggtgaacaaggacccgatggccccaaaggatccaagggagaaccaggcaaaggagagatggtggactacaatggcaacataaacgaggccttgcaggagattaggaccctcgccttgatgggcccaccaggtctgcccgggcaaatcggtcccccgggcgcaccaggtattcctgggcagaaaggggagattggattgcctggcccacctggacatgacggagagaaaggaccacgaggaaagcccggcgacatggggcctcccgggccccaagggcctcccggcaaggatggccctcctggagtgaaaggcgaaaatggccatcctggttcccctggggaaaaaggcgagaagggcgaaactggtcaggctgggagccctggcgaaaaaggggaggccggggagaagggcaatccaggcgccgaagtgcccggcctgcctggccctgaggggcctccaggccctcccgggttgcagggtgtgcccggccccaagggggaagccggactggacggtgctaagggcgagaaaggatttcagggagagaagggtgacagaggccccctgggtttgccgggtgcatccggcttggacgggaggccgggcccaccagggacccccggtcccattggggtgcccggtccagccggcccgaaaggcgagcgcggctctaagggagaccccggaatgacgggccccactggggctgcagggctaccggggttgcatggtccccctggtgataaggggaatagaggcgaaaggggtaaaaaaggaagccgagggcccaagggagataaaggggaccagggtgccccaggtctggacgccccctgtccgttgggtgaggacggcttgcccgtgcagggctgttggaataagtag

SEQ ID NO: 2623 - DNA, 2097 bp, Artificial Sequence
  Description of Artificial Sequence: Synthetic coding sequence
atggtcgccgagcgtacccacaaagctgctgctaccggcgccaggggccccggggagctcggagcccccgggacggtggccctggtagcagccagagccgagcgcggagcacgtttaccctcccccggcagctgtggactactcacactggcattgtgcagtctggcactctcactactcgcacactttcgaacagctgagctgcaagcccgtgtgctccgtctcgaggcagaaagaggtgagcagcagatggaaacagccatcctgggacgggtaaaccaactgctcgacgagaagtggaagctgcattcaagaaggaggagggaagcccctaagacatctcccggatgtaattgcccccccgcctttcaaggtcccactggccggcccggactgcccggcgacaaaggcgcaataggaatgccaggaagagtcggttccccgggcgacgccggactaagcatcataggtccaaggggccctcccgggcagcccggaacaaggggtttccctgggttccctggtccaattggtctcgacgggaagcccgggcatcctgggcccaaaggtgacatgggactgaccggcccacctggccagcccggaccccagggccagaagggcgagaagggtcagtgtggtgagtacccacaccgtctccttcctctcttaaattccgtgcgcttggctcctccacccgttataaaaagaaggacatttcagggagagcaatcgcaggccagcattcagggtcctccgggtcctcccggacctcctggaccttccggaccacttgggcaccccggtctgccgggcccaatgggcccacccgggcttcctggacctcccggacccaaaggcgaccctggtatccaaggctatcatggtcgcaaaggtgagaggggaatgcccggtatgcctgggaaacatggcgctaagggcgctcctgggattgcggtggctgggatgaagggcgagcccggaatcccgggtaccaagggagaaaaaggggcagaaggttctcccggtctgccaggcctgctcggccaaaagggcgaaaagggggacgctgggaatagcatcgggggcgggaggggtgaacccggacccccaggcctccccggtccccccggccctaaaggggaggctggcgtggatgggcaggtaggaccgcccgggcagccaggggacaaaggggagcggggggccgcaggcgagcagggacccgacggtcccaagggaagtaagggggaaccaggtaaaggcgagatggtcgactataacggcaatataaacgaggctctacaagaaattagaactctggccctgatgggtccacccggtttgcctggccagattggaccgcctggagcccccggaatcccaggccagaagggtgaaataggacttcccggcccgccaggtcatgacggagagaagggcccgcggggcaaaccgggcgatatgggcccaccaggaccccagggcccacctgggaaggacggcccgcccggcgtgaaaggggaaaacggccaccctggctcccctggtgagaaaggagagaagggagagacagggcaggcaggcagtccaggggagaagggcgaagctggcgaaaaggggaatcccggcgcagaggtcccaggactccccgggcctgagggaccccccgggccccctggccttcagggtgtacccggaccgaaaggagaggctgggcttgatggtgcaaagggggaaaaaggttttcagggcgaaaagggggatcgaggaccactgggtctgccaggagcctcaggcctggacggacgtccaggtccccctggcaccccggggcctatcggagtgcccgggcccgctggccctaaaggcgagaggggatctaaaggagatccggggatgacaggccctacaggagccgccggcctcccagggctacatgggccaccaggcgacaaggggaatcgaggggaacggggcaaaaagggctcacgcggccctaaaggcgataagggcgaccaaggggccccgggactggacgccccgtgtcctttgggcgaggatgggctacccgttcaagggtgttggaataaatag

SEQ ID NO: 2624 - DNA, 1938 bp, Artificial Sequence
  Description of Artificial Sequence: Synthetic coding sequence
atggttgccgaacgcacacataaggccgcggctacaggggcaagaggccctggtgaacttggcgctcccggcactgtggcactcgtcgctgctcgagccgaaaggggggcgcggctgccatcacctggctcctgtggcctcttgactctcgccctttgttctctggcgctttctctcctggcccactttagaaccgctgagctgcaggctagagttctcaggttagaggctgaaagaggcgaacagcagatggaaaccgctatcctgggccgggtgaatcagctgctggacgaaaaatggaaactacatagccgccggaggcgggaagcaccgaagacatctccaggatgtaattgcccgcccggtccgccaggccaacctggaactagaggatttcccgggttcccgggcccaataggcttggacggcaaaccggggcatcccggcccaaagggggacatgggactgaccggaccccctggacagcccgggcctcagggtcagaaaggcgaaaaggggcaatgcggagaatatccccacagactacttcctctcctgaacagcgttcgtcttgctcctccacccgtgatcaaaagaagaactttccagggcgagcagtctcaggccagcatccaagggccccctggcccgccagggcccccaggcccgtccggacccctgggacatcccgggctccctgggcccatggggccaccgggccttcctggccccccggggcccaagggtgaccccgggattcagggttatcatggtcgcaagggggagagaggaatgccaggcatgccgggtaagcatggggccaagggcgcccctggcatcgcagtcgcaggcatgaaaggcgagcctggcatccctggtacaaagggggaaaagggcgcggagggtagcccaggtctgccaggcctgctaggccaaaaaggcgaaaaaggagatgccgggaatagtattggcggaggcagaggggagcctgggcctcctggcttgcccggcccacccgggccaaaaggagaggctggggttgacggccaggtggggccaccaggccagcctggggacaagggagaacgcggcgccgccggagagcagggccctgatggtcctaaggggtccaagggcgaaccaggaaagggtgagatggtcgattataacggaaacatcaacgaagctctgcaacccagccgcggcccggccctgaggggtcctcccgggctgcccggacagatcggaccaccaggcgccccgggtatcccaggacagaagggtgaaattggactccccgggccccctggtcatgacggagagaaaggcccccggggtaagcccggcgacatgggtcctcctggccctcagggcccccctgggaaagatggccccccaggggtcaagggcgaaaacggccacccaggttcccctggtgaaaaaggagaaaagggcgaaaccggacaagcgggcagtcccgtgcctgggctgcccggtccggaggggcctccaggaccaccggggttgcaaggagtgcccggccccaaaggagaggccggccttgacggggcaaagggcgagaaaggattccaaggagagaagggcgatagaggaccactcggtcttcccggtgcgtccggactcgacggccggcccggcccacctggcacccctggccccatcggagtgcccggccccgccgggcccaagggcgagcgcggctccaaaggcgaccccggcatgaccggacccacaggcgcggctggtctcccaggcctgcatggtccgcctggtgataagggcaatagaggggagaggggcaaaaaaggatcccgaggcccgaagggcgacaagggggaccagggcgccccaggactggacgctccgtgcccactcggagaagatgggttgcctgtacagggctgctggaacaaatag

SEQ ID NO: 2625 - DNA, 2109 bp, Artificial Sequence
  Description of Artificial Sequence: Synthetic coding sequence
atggtagcggagcgcacacacaaggcagcggcaacaggcgctcgcgggccgggcgaactcggcgccccaggcacagtggccctggttgcggcaagggcggagaggggcgcacggttaccaagccccgggagctgtggattactgaccctggccctatgttctcttgctctgagtctgctcgctcatttcagaactgcagagctgcaagctcgagtgctgcggctagaagcagagcggggagagcagcagatggagactgccatcctgggtagagtaaatcagcttctagacgagaagtggaagcttcactctcgacgtaggcgagaggcgcccaaaacatccccgggctgtaactgtccacctgcatttcaaggacctacaggccgccccggtctccccggggataaaggcgcaatagggatgccagggcgggtaggtagtcctggggatgctggcttatctattattggcccgcgggggcctcctggtcagcccgggactagaggatttccaggatttcccggtccgatcggactggatgggaaaccaggtcacccaggccccaaaggagatatggggctgactggccctccagggcagcccggaccacaagggcagaagggggagaaaggccaatgcggagaatacccacacagagaatgtctctctagtatgcccgctgcgctgagatccagtcagattatcgcgctgaaactgttgcccttgctgaacagcgtgcgcctggctcctcctccagtcattaaaagaaggacattccagggcgagcaatcccaggcctcgattcaaggcccccccggtccacctggaccaccaggaccttccgggcccttgggtcaccctggactcccaggtccgatggggcctcctggcctgcctggtcccccaggaccgaaaggcgaccctggcatccagggctatcacggccggaagggagaacggggcatgcccggtatgcctggaaaacacggcgccaaaggtgcacctggaattgctgtagccggaatgaagggagagccagggatcccggggactaaaggggaaaaaggcgccgaaggttctcctggactgcctggcctgctaggtcagaaaggagagaaaggagatgcgggaaattcaatcggtggcgggcgtggagagccgggacccccaggactgcccggcccgcctggacctaaaggcgaagccggcgtcgatggccaggtgggacctcctgggcagccaggtgacaagggagagagaggggccgcaggggagcagggccccgacggccccaaaggcagcaaaggcgagcctggaaaaggggaaatggttgactacaatggtaatataaacgaagccctgcaggagatcagaactttagccctgatgggccctccagggttgccaggtcaaatcgggcccccgggcgcgccaggcatacccggccaaaagggtgagattgggctgcccgggcctcccggccacgacggcgagaaaggaccacgtggtaagcctggggacatgggaccaccagggccccaggggcctccaggcaaggacggccctccaggcgtcaagggggagaacggacaccccggctcccccggggaaaagggcgagaagggcgagaccggccaagccggcagccccgtgcctggcttgcctggccctgaggggccacccggacctcctgggctgcaaggggttcctggtcctaagggtgaggcaggactagacggagctaaaggcgaaaagggctttcagggagaaaaaggggatagaggcccactggggttacccggagcaagtggacttgacggccgcccaggtccacctggcacccctggacccattggtgtgcccggcccagctggtccaaagggagagagaggatcaaaaggcgatccaggaatgactgggccgaccggagcggccggcctgccagggttgcacggaccacccggagataaaggtaatcgtggcgagcggggcaaaaagggatcaaggggcccaaagggcgacaaaggagaccagggggcacccgggttagatgctccatgtcctttaggcgaggatggactcccagttcaggggtgttggaataaatag

SEQ ID NO: 2626 - DNA, 2112 bp, Artificial Sequence
  Description of Artificial Sequence: Synthetic coding sequence
atggtcgctgaacggactcataaggccgcagctacaggggcgcgcggacccggcgagctgggcgcacccggcacggtggccctggtggctgctagggcagagagaggcgcaaggctccccagcccaggttcttgcggactgttaactctggcactgtgttcccttgctctgagtctactagctcatttccgcaccgcagagctccaagcaagagtgctgcggctggaggctgaaagaggggagcagcaaatggaaacagccattctaggaagagtgaatcagctgttggatgaaaagtggaagctgcattctaggcgccggagagaggcacctaagacaagtccgggctgtaactgcccgccgggacctccaggccctaccggaaggccagggctacccggcgacaaaggtgccataggcatgccgggccgggtcggatcacccggcgacgctggtctctccattattggcccccgcgggccccccgggcaacccggaactaggggcttcccaggatttcccggccccattggcctggatgggaaaccgggccatcctggaccaaagggtgacatggggttgaccggacctccaggccagcccggcccccagggacagaaaggtgagaagggccagtgcggggagtatccacaccgggaatgtctgtcttccatgcctgcggccttgcgctcaagccagatcatcgcactcaaactgcttcccctgcttaactcagtccggctcgcccccccaccagtaatcaagagacggacctttcagggcgagcagtcacaagcttcgatccagggccccccaggaccccccgggccaccaggcccctcgggccctttaggccaccccggtttgcctgggcccatgggcccccccgggctgcctggaccacctggtccaaaaggtgaccccggaatacaagggtaccacggaaggaaaggtgaaaggggaatgccgggtatgcctggcaagcatggtgccaaaggggcccccggtatcgccgtcgctgggatgaagggcgagcccggcattccaggaacaaagggggaaaagggagccgaggggtcccccgggcttcccgggctccttggccagaagggagagaagggagacgctgggaacagtatcgggggagggcgcggcgagccagggccccccgggttgccaggcccacccggacccaagggagaggccggcgtggacggtcaggtcggcccacctggacagcctggcgacaaaggcgagcgcggtgcggcaggagagcagggacccgacgggccgaaaggaagtaagggtgaaccaggcaaaggagagatggtggattacaatggaaacataaatgaggcactccagccctctcgcggccccgctctccgggggccgccaggcctgccaggacagatcgggcctccgggagccccgggtatcccaggacaaaagggagagatcgggctccctggcccacccgggcacgatggcgaaaaaggaccacgcggcaagccaggcgatatgggcccaccaggaccccaaggccctccaggcaaggacgggccaccaggagttaagggcgagaacgggcacccaggatcccccggtgagaaaggggaaaagggcgaaaccggacaagcagggagccccggggaaaaaggggaggccggcgagaaaggcaaccccggagcggagggcttgcaaggcgtccccgggccaaagggagaagcaggcctggacggcgctaaaggcgaaaaaggtttccagggggaaaaaggcgaccggggcccgttgggcctcccaggtgcgagcggcctggatggacggccaggcccaccaggaacccctggccccatcggcgtaccaggtcctgccggacccaaaggcgagagggggtcaaagggcgaccccgggatgacaggcccaaccggggcagccggtctccccggtctccacgggcctcccggcgacaagggaaacagaggagaaaggggaaagaagggcagtcgcggcccgaaaggtgacaaaggagatcagggcgctccagggctggatgcaccctgtccgctaggagaggacgggttgcctgtgcagggatgttggaacaagtag

SEQ ID NO: 2627 - DNA, 2076 bp, Artificial Sequence
  Description of Artificial Sequence: Synthetic coding sequence
atggtggcggagagaacacacaaggctgcggccactggagcgcgaggccccggtgaactgggtgccccagggactgtcgcactggtggctgcgcgggcagagcgtggtgcgagactaccatcaccggggtcatgcggactccttacacttgctctgtgcagtctcgcacttagtctgctcgcccattttcgcacagccgaactgcaggctcgggttcttcggttagaagctgagcgcggtgagcaacagatggaaacggctattcttgggcgagtgaatcagttgttggacgaaaagtggaaacttcacagtaggcgccgaagagaggcacctaaaacatcccccggctgtaattgcccccccgggccccccgggcctaccggacggcctgggctccccggggacaaaggtgccattgggatgccgggacgggtgggaagccccggagatgctggactctctataattggtccccggggacccccaggacagcctggaacgagaggcttcccaggtttccccggccctattgggcttgacggaaaacccggacatccaggccctaaaggagatatgggactcaccggcccaccgggtcagccgggtccgcagggccagaagggagagaaggggcagtgcggagaatacccacaccgcgagtgcctgagctctatgcccgcagcattgaggtctagccagatcatcgctctcaagttacttcctctcctgaacagcgtccgcctggctcccccgccagtaatcaaacgcagaaccttccagggcgagcagtctcaggcgtcaatccaggggccacccggaccgcccggaccgcctggaccatctgggcctctggggcatcccgggcttcctgggcccatgggtcccccaggactgccgggacctcctggcccgaaaggcgaccccgggattcagggataccacggcaggaagggcgagagaggaatgccaggcatgcccggcaaacatggtgccaagggcgccccaggcatcgccgttgcgggcatgaagggcgaacccggaatccccgggactaaaggcgaaaaaggcgcggaaggatcgccgggcttaccagggcttctgggccagaagggagaaaagggtgacgcggggaattcaatcggcggaggtaggggtgagccaggacctcctggactgcccgggcccccaggcccgaaaggagaggcaggggtggacggacaggtggggccccctggtcaaccaggcgacaaaggagaaaggggagccgcaggagagcagggtccagacgggcccaaaggcagtaagggagaacccggtaagggcgaaatggtcgactacaacggcaacattaacgaagcgctgcagccatcaagaggacccgcacttagaggtccccccgggttaccggggcagattgggccaccaggcgcccccgggatacccggacaaaaaggcgaaatcgggctgcccggtcctcctggacacgatggggagaagggaccccgggggaagcctggtgatatgggcccaccggggccccagggccctcccggcaaagacggacccccaggtgtgaagggagaaaatggccatcccggctcgcctggggaaaagggcgagaaaggcgagacaggtcaggccggttctccgggcgagaaaggagaggccggtgaaaaaggtaacccgggagcggagggtctgcaaggtgtccctggtcccaaaggagaggccggtctggatggcgctaaaggtgaaaagggcttccagggtgagaaaggcgacagaggacctctcgggctgcctggaacacctggtccgatcggtgtgccaggccccgccgggcccaagggggagcgggggagtaaaggcgacccaggcatgaccggcccaaccggggccgcaggcctgccagggcttcacggccctcctggcgacaaaggaaaccggggggagcgaggaaaaaaagggtcaagggggcccaaaggcgacaagggggaccaaggcgctcccggactcgacgcgccctgccctttgggggaagacggtctgccggtccaaggctgttggaacaagtag

SEQ ID NO: 2628 - DNA, 2118 bp, Artificial Sequence
  Description of Artificial Sequence: Synthetic coding sequence
atggttgcagagcgcacacacaaggctgctgcaaccggggcccgcggacctggagagctgggggcaccgggcacagttgctctggttgctgctcgcgccgagcgtggagcacgcttgccttcacctgggtcatgcgggttgctaaccctcgcactatgctcattagccctgagcctgctagctcactttcgtaccgctgagttgcaagcacgcgtcctccggctggaggccgagcgaggggaacagcagatggagaccgccatcctgggaagagtcaatcaactcttggacgagaaatggaaattgcacagtcgtcgccgccgcgaggcccctaaaacttcccctggctgcaactgtcctcctgccttccaggggcctacagggcgcccaggtcttccaggcagcccaggcgacgccgggctcagtattatcgggcctagaggccccccagggcagccgggcacccgcggcttcccaggcttccctggacctattggactggatggcaagccagggcaccccggccctaagggcgatatgggattaacaggaccacccgggcagcccgggccccaaggccagaagggggagaaaggacagtgtggcgaatacccacatcgggagtgcctgagctctatgccggccgcgcttcgatctagtcaaataattgcactgaaactgctgcccctactgaatagtgtgaggcttgctcctccgccggtgatcaaacgaaggactttccagggcgagcagtctcaagctagtatccagggccccccaggcccccctggacccccaggccccagcggcccattgggtcatcccggactgccaggacctatgggaccacccggattacccggccctcccgggccaaagggggaccccgggatccagggttatcatggacgcaagggcgagcgggggatgcccgggatgcctggcaagcacggtgcaaagggagctcccggcatagccgttgctggcatgaagggcgagccaggcatccctggaaccaagggcgaaaaaggcgcggagggatcccccggactgccgggtctgcttggccagaaaggggaaaagggtgatgcgggtaactcaatcggcgggggacgcggagaacctggccctcccggactgccgggcccaccaggacctaaaggtgaagccggagtggacgggcaggtgggcccccccgggcagcccggggataaaggcgaaagaggcgcagctggggagcagggcccagacggcccaaagggtagtaagggagagccaggcaaaggcgaaatggttgactataatggcaacatcaacgaggctctgcaagaaattagaactcttgccctgatgggccctcctgggctgccgggacagatcggtccgccaggcgcgcccggaattcctggccaaaagggggaaatcggcctgcccggccctccaggacatgacggagagaagggtcctagaggtaaacccggtgacatgggtccccctggaccccaggggccccccggtaaggatggcccgccaggagtcaaaggagagaacggccaccccgggtctcctggcgagaagggagaaaaaggcgagacagggcaggcaggctctccaggggaaaaaggcgaggcgggtgaaaaagggaatcctggcgctgaggtgcctgggctgccaggcccggaggggcccccaggcccgccagggctgcagggagttcccggccccaagggggaagctggcttggatggcgcaaaaggagagaaggggttccagggagagaagggggatagaggtcctctaggcttgcccggagctagcggcctcgacggtcgcccaggaccccccggcacgccgggtcccatcggagtgcctggccctgcaggcccgaaaggcgaacgaggaagtaagggggatcctggaatgacaggccccacaggggccgccgggctccctggcctgcatggaccccccggagataaagggaaccgaggcgagcgaggtaaaaaaggatctcgcggacccaaaggcgataagggggatcaaggggccccaggcttggacgccccatgccccctgggcgaggatggcctgcccgtacagggttgttggaataaatag

SEQ ID NO: 2629 - DNA, 2154 bp, Artificial Sequence
  Description of Artificial Sequence: Synthetic coding sequence
atggttgccgaaagaacccacaaggccgccgccactggtgctcggggccccggggagctcggcgccccaggcaccgtggcattagtcgcagcacgggcagagcggggggctcgtctcccttccccggggagctgtggcctgctcaccctggcactgtgtagcctagccctgtcgctgttagctcactttcggacagcggaactccaggctcgcgtgctgcggttggaggccgagagaggtgaacagcagatggaaacagccatactcggcagagttaaccagctcctcgatgagaagtggaaactacacagtaggagaaggcgcgaagctccaaagaccagtcctgggtgcaactgtcctccaggccccccaggccccacgggcagaccaggacttcccggtgataaaggtgctatcggaatgcccggtagggttgggagcccaggtgacgcaggtctctctatcataggtcctagaggccctccgggacagccgggaactagaggtttcccaggcttcccggggcccatagggcttgatgggaagccaggacaccccgggccgaagggtgacatgggcctgacaggcccaccaggtcagcctgggcctcagggacagaagggggaaaagggtcagtgcggggagtaccctcatagggaatgtttgagttctatgcccgcagcactgaggtcttcacagattatcgccctgaagctgttgcccctcctgaactctgtgcgtttggcccccccacctgtgatcaagcggcgcactttccaaggcgagcagtcccaggcctccatacagggaccccccggcccaccgggccctcccggtccgtctggccctctggggcatccaggtctccccggacccatgggcccaccgggcctccccggcccaccaggccctaagggggatcctggcatacagggttaccacggtaggaagggagagcgcggcatgccaggcatgcccgggaaacatggggcaaaaggcgcgcctggaattgccgttgctggaatgaaaggcgagcctggtatacccggcacaaagggcgagaaaggggcagagggatcccccggcttgcccggcctgttgggtcagaaaggggaaaaaggggacgctggaaactctatcgggggaggacggggcgagcctggcccacctggccttcctggccctccaggacccaagggcgaagccggagttgatggtcaggtcggccctcccggccagccaggcgacaagggggagcgcggagctgcaggtgagcaaggcccagacggcccaaagggctctaaaggggaacctggtaagggagagatggtcgattacaatggcaatataaacgaggcactgcaggaaatcagaacactggctctgatgggccccccaggtctgcctgggcagattggcccacctggcgctccaggtatccctggtcagaagggcgagatcggtctgcccggcccacccgggcacgacggcgagaagggccctcgcggcaagccaggcgatatggggcctccaggcccccagggcccccccggcaaggacggacctcctggtgtgaaaggggaaaatggacacccagggagtcccggtgagaagggggagaagggggagacgggccaggcagggagccccggagagaaaggtgaagccggtgagaagggcaaccccggggccgaggtccccggtcttccgggacctgagggccctcctgggccgccaggacttcagggcgtgcccgggccaaagggcgaagcaggcctggacggggctaagggggaaaaaggctttcaaggcgaaaagggcgaccgaggtcctctaggcctgcccggggcttccggactcgacgggcgcccaggcccacccggcacccctgggcccattggggtgcccggcccggccggcccaaagggcgaaagaggttccaaaggagatccagggatgaccgggcccaccggtgctgcaggactccctggccttcacgggccacctggcgataagggaaatcggggtgagaggggcaagaaggggtcccggggcccaaaaggcgataagggagaccaaggcgcaccaggcctggatgccccttgccccctgggagaggatggcctacctgtgcaggggtgttggaataagtag

SEQ ID NO: 2630 - DNA, 2007 bp, Artificial Sequence
  Description of Artificial Sequence: Synthetic coding sequence
atggtcgcagaaaggactcacaaggctgccgccacaggtgcaaggggcccgggcgagctgggcgctcccgggactgttgccctggtagccgcgagagcagaaaggggtgctcgattgccctctccagggagctgcggcctgctcacactagcactttgttccctagctctcagtctgctagcccacttcagaacagctgaactgcaggcacgcgtcctaaggctggaggcagaacgaggcgagcagcagatggaaactgccatccttggtcgcgtgaaccagctgttagacgagaagtggaagcttcattctcggaggagacgggaggcccccaagacctcaccagggtgcaattgccccccagggcctcccggccccaccggaagacctggacttcctggagacaagggtgctatcgggatgcccggccgcgttgggtccccgggcgacgctggattatcaattataggacctcgtggaccaccagggcagcctgggaccagaggattccctggttttcccggtcccatcggcctcgatgggaagcctggtcatcccggaccaaaaggcgacatgggcctgactggacctccaggccagcccggacctcagggccagaaaggcgagaagggccagtgcggggagtatccacacagggagtgcttgagcagtatgcctgcagccctcaggtcctcccagattatagcgcttaagggcgagcagtctcaggcctcaatacagggccccccaggtccccccgggcctcccggaccctccggccctctgggtcatcctggtctgcccggccccatgggtcctccaggcctgccagggcctcccggcccaaagggcgatcccggaatacagggataccatgggcggaaaggcgagcgcgggatgcccggaatgccaggcaagcacggcgcaaagggcgctcccggtatagctgtggccggaatgaaaggagagcctggcatccccggtacaaagggagagaagggcgccgaggggagtcctggcctcccgggtctgcttgggcagaagggcgagaaaggtgatgccggtaacagcattggtggcggcaggggtgagccaggtcctccaggcctgccgggccccccaggaccaaaaggtgaggccggcgtggacggacaggtggggcctcccggccagccaggcgacaagggggaacggggtgctgcaggtgaacaagggccagatggacccaaaggctcgaaaggtgagcctggcaagggggagatggtcgactacaatggaaatatcaacgaggccctgcaggaaattcggactctggcactgatgggtccgccgggccttcccgggcaaattggccctcctggtgcaccgggcataccaggtcagaagggggaaatcggcctccccggaccccctggacatgacggagagaagggaccccgcggaaaaccgggcgatatgggtccccccggaccccagggaccaccggggaaagatgggcccccaggggtgaaaggcgagaacggtcaccccggctccccaggagaaaaaggggagaaaggtgaaaccgggcaagccggatcacccgtccccggcctgccaggcccagaagggccaccaggcccccctggactgcagggcgttcctggacccaagggagaggctggcctagacggcgcgaaaggtgaaaaaggcttccagggcgagaaaggtgatagggggccactcgggctgcctggaaccccggggccaatcggtgtacctgggccagcgggccccaaaggcgaacggggaagcaaaggggacccaggcatgaccggcccaactggggcagctggattgcccggattgcatggccctcctggggacaaggggaatcgcggggagaggggcaaaaagggttctagagggcccaagggagacaagggcgatcaaggcgcaccaggacttgacgccccttgccctttgggggaggatggactcccagtgcagggctgctggaataagtag

SEQ ID NO: 2631 - DNA, 1833 bp, Artificial Sequence
  Description of Artificial Sequence: Synthetic coding sequence
atggtggctgagcggactcataaggccgccgcaacaggtgcgcggggccccggcgaattgggagctcccggcacagtcgccctggtagccgcccgagccgagcgcggtgcccggttgccctcacctggctcctgcgggctgctgacacttgccctctgcagtttggccctcagtttactggcccactttagaaccgccgagctgcaggcgagagtgcttcgtttagaagccgaaagaggcgaacagcagatggagaccgctatcctcggcagagtgaaccagctcttagacgagaaatggaaactccatagccgccgtagaagagaagcccccaagacctcacctgggtgtaactgtccccccggaccccctgggccaacaggccgcccgggcctccctgggcagcctggtactcgcgggttccccggttttcccggacctattggactggatggtaagcctgggcaccctggccccaaaggcgatatgggcttaaccggcccacccggtcagcccgggccgcaaggccagaaaggagaaaaggggcagtgtggcgaatatcctcatcgagaatgcttatctagcatgcccgcagccttacggtcgagtcagatcattgctcttaagggagagcagtctcaggctagcatccagggacccccaggaccccctggaccgcccggccctagtggccccctgggacatccaggcctcccggggcctatgggcccaccaggtctgccaggccccccaggaccgaagggagatcctggcatccagggatatcacggtcgaaagggggagagagggatgccaggcatgcctggaaagcatggagccaagggagccccggggatcgctgtcgcgggcatgaagggagaaccaggaattccaggaaccaaaggtgagaagggcgccgagggtagccctggccttccgggccttctgggccaaaagggggaaaaaggcgacgctggcaacagcataggaggcggccgcggcgagcctggccctcccgggctgcctggccctccagggccaaagggcgaagcaggcgtggatggacaggtgggacctccaggccaaccaggagataagggcgagcggggggctgcgggggaacagggcccggacggccctaaaggcagtaaaggggaacccggtaagggggaaatggtagattataatgggaacattaacgaggcattgcaggaaatccggaccctagcactcatgggcccccctggactacctgggcagattggacctccaggcgcgcctggcattccagggcagaagggcgaaatcggtctccctggaccccctggacacgacggcgagaaagggccccgcgggaagccaggagatatgggccccccaggcccccagggcccacctggtaaagacggacccccaggagtgaagggtgaaaacggccaccccgggtcacctggcgagaagggagaaaaaggcgaaacaggccaagccggtagtccagttcccggactccctgggcctgaaggacctccagggcccccaggtttacaaggggtgccagggccaaagggcgaggccggactggatggggctaagggcgagaagggattccagggagaaaagggagacagaggaccactggggctgccaggaacaccaggcccaattggtgtccccggtcctgctggcccaaagggagagaggggatcaaagggagatcctgggatgacgggccctactggagccgcaggactgcctgggctccatggcccccccggagataagggaaatcgcggtgaggacggcctgccagttcagggctgctggaacaagtag

SEQ ID NO: 2632 - DNA, 1938 bp, Artificial Sequence
  Description of Artificial Sequence: Synthetic coding sequence
atggttgctgaaaggacccataaggccgccgctacaggggctcgcgggcccggcgaactgggcgccccaggtacagtggcactggtggccgcaagagcagaacgcggtgcccgcctgccctcaccggggagttgcgggctgcttactctagcgttgtgctcactggccctcagcctgctcgcccattttcgtacggctgagctccaggcacgcgtgctccggttggaagcagaacggggcgagcaacagatggagaccgctatccttggaagagtgaaccagctcctcgatgagaaatggaaactgcacagtagacgcaggcgcgaagcccccaagaccagcccagggtgcaactgcccccccggacctcctgggcaacccggaacacggggattccccgggtttccaggtcccatcggcctggatggaaaaccgggccaccctggccccaagggcgacatgggactcaccgggccccctgggcagccagggccccagggccagaagggcgaaaaggggcagtgcggtgagtaccctcatcggttgctgcccttactcaattctgtgcggctggctccacctccagtgatcaagagaagaactttccaaggagaacaatctcaggcctctatccagggaccaccaggccctcccggaccccctggtccctctggccctttgggccacccaggcctcccaggcccaatggggccaccggggttgccaggtcctcccggtcccaaaggggaccccggtatccagggctatcatggacgaaagggtgagagggggatgccgggcatgcctggcaagcatggcgccaaaggtgctccggggatcgctgtagcaggaatgaaaggcgagccaggtattccaggaacaaaaggagagaaaggggccgagggttctcctggattacccgggcttctgggacagaaaggagagaaaggagacgctggaaactccattgggggcggacggggcgagcctgggcctcccggcctgcctggtccacccggcccgaaaggcgaagccggtgtggacggtcaggtcggcccccctggtcagcctggagacaagggcgagaggggtgctgcgggtgaacaaggccccgacggtcctaagggaagtaagggggagcctgggaaaggggaaatggtggattataacgggaacatcaacgaagccctgcaggagatcaggactctggccctgatgggtccccccggcttacccgggcagatcggacctcctggagcccctggtattccgggacagaaaggcgagattggtctaccgggcccgcctggacatgacggcgaaaaaggacccaggggcaagccaggcgatatggggcccccggggcctcaaggccccccaggtaaggatggccctcccggggtgaagggcgagaatggccaccctggaagcccaggtgagaagggggaaaagggggagaccggacaggccggctctcctgtgcctgggctgcccggcccagaggggcctccgggcccccctggactgcagggcgtacctgggccgaagggcgaagcaggccttgacggcgccaagggtgaaaaggggtttcagggggagaagggagacagggggcctctagggcttcccggggcctcagggttagatggacgacctggacctcccggaacccctggccccatcggcgtccctggccctgctggaccaaagggggaacgcggctccaagggagaccccggtatgacagggcctaccggagccgctgggctgcctggcctgcacggcccccccggcgataaaggaaacaggggagagcgggggaagaaaggcagcagaggcccaaaaggcgataaaggcgaccaaggggctcctggactcgatgctccttgtcccctaggagaagacgggctacccgtccagggttgctggaacaagtag

SEQ ID NO: 2633 - DNA, 5106 bp, Artificial Sequence
  Description of Artificial Sequence: Synthetic coding sequence
atgaagatcttccagaggaagatgcggtattggttgctgcctcccttcctggccattgtctacttctgcacaattgtacaggggcaggtggctcccccaacaaggctgaggtacaatgtgataagtcacgacagcattcagatttcctggaaggccccacggggaaagttcgggggttataagctgttagtgacacctacctcaggtgggaagacaaatcagttaaatctgcagaataccgcgacgaaagctataattcagggcctgatgccagatcaaaattacactgtccagatcattgcctacaacaaggataaggagtcaaaaccagcacagggccagttcagaatcaaagaccttgagaaacgcaaagatcccaagccgcgcgtgaaagtggttgacaggggaaatggcagccgtcctagtagcccagaagaggtgaaattcgtttgccagactccagctattgcagatatcgtcattctggtggacggcagctggtccatcggccgatttaactttcgactggtgcgccattttctggagaacctagtgaccgctttcgacgtcggaagtgaaaagactcggatcggggtaaagaacgccgatgtgaatgagctccaggagatcgcttccgagccagactctactcacgtgtataatgttgccgagtttgatctgatgcataccgttgttgagtcacttactagaacgctgtgcagtcgcgtggaggagcaggatagagaaataaaggcgagtgcgcacgctataacaggaccaccgacagaattgatcacctctgaggtgacagcgaggagctttatggtcaactggactcacgcgccaggtaacgttgagaaatacagagttgtttactatcctaccaggggggggaagccagacgaagttgtcgtcgacggcactgtcagttccacagtgctaaagaacctgatgtcactcacagaatatcagattgcagtctttgccatatacgcgcacactgcctcagagggcctgcgtgggactgaaactacactggccctccccatggcctcagacctgcttctgtacgatgttactgaaaacagtatgagagtgaagtgggacgccgtcccaggagcatctgggtatctaatcttgtacgcccctctgactgaggggctggccggagatgagaaagaaatgaagataggggagacccatacggatattgagctgtccgggctgcttccgaacaccgagtacaccgtgaccgtctacgccatgttcggcgaggaggcctcagacccagtcaccggacaagagaccactctcgccctgagtcccccccgcaacttgcgcattagtaacgtcggctcaaattcagcccggctcacatgggaccccacaagccgccagatcaatggctataggatcgtctacaataacgcagatggaacagagataaatgaggtcgaggtcgacccaataaccacattccctttgaagggcctgactccccttactgagtacacgatagcaatttttagcatatacgacgagggacagagcgagcctttgactggcgtttttacgaccgaagaggtgccggctcagcaatatctagagatagatgaggtgaccaccgactctttccgtgtcacatggcacccactgagcgcagacgagggtttacataagctgatgtggatacctgtttacggcggtaagacagaagaggtggtcttgaaggaagaacaggacagtcacgtgatcgagggcttggaaccaggtaccgaatatgaggtttcacttctcgccgtgcttgatgatggcagtgaaagcgaagttgtgaccgccgtaggaaccactctggacagcttctggacagagcccgccactacaatagtgcctactacttctgtcacctccgtgttccaaacgggcatccgcaatttggtggtgggggatgaaactactagtagcctgagggtaaagtgggacatctctgactccgacgtccagcagttcagagtcacctacatgaccgcacaaggcgatcctgaggaggaagtgattgggaccgttatggtgcctggctcccaaaataacctgctcctgaagcctcttttacctgatacggagtacaaggtaaccgttacccccatttacaccgatggagaaggcgtcagcgtttccgcccctggcaaaacattaccgagctccggtccccagaacttacgggtgagcgaagagtggtataaccggctgagaattacctgggatcccccgtcgtcccctgtgaaggggtacaggatcgtgtacaagcccgtaagcgttccagggcccacacttgagacatttgtcggcgccgatatcaatactattttaatcacaaatttgctaagcggaatggattataacgttaagatttttgcgtcacaggctagcgggttttctgatgcactcacaggcatggttaagactctgttcctgggcgtcacaaaccttcaggccaaacacgtggaaatgacttccctctgcgcccattggcaagttcaccgccatgcaactgcttacagggtggtgatcgaaagtctgcaagatcggcagaaacaagagtccaccgtggggggaggtactacccgtcactgcttctatgggctgcaacccgatagcgaatacaagataagcgtatacacgaaacttcaggaaatcgaaggcccatctgtctctattatggaaaaaactcagagtctgcccactaggccgcccaccttcccccctacaatccccccagctaaagaagtctgtaaggcagctaaagcggacttggtcttcatggtggatgggtcatggagcatcggcgatgaaaatttcaacaaaattataagcttcctttacagcacggtaggagctctcaacaaaatcgggactgatgggacacaagttgcaatggtgcagtttacagatgaccctcgcacagaattcaagctgaatgcatataaaactaaggagacactgctggacgcaattaagcatatatcatacaagggaggcaacaccaagacaggaaaagccatcaaatacgtaagagatactctgttcaccgccgagtcagggacccggcggggtattcccaaagtcatcgtagtgattaccgatgggaggtcgcaggatgacgtgaacaagattagccgcgagatgcagcttgatggttactcgatcttcgcaattggtgtggccgacgctgattactcagaacttgtgtcaattggcagcaagccatctgcacgccacgtattttttgtggatgacttcgacgcttttaagaaaatcgaggatgagcttatcacttttgtctgcgaaaccgctagtgctacatgccccgttgtgcataaagacggaattgacctagccgggtttaagatgatggagatgtttggcctcgtcgagaaagactttagtagcgtcgagggcgtgagcatggaacctgggacctttaacgtgtttccttgctaccagctgcataaagatgctctggtgtcacagcctacgagataccttcacccagaaggcctcccctcggactacacaatctcatttctgttcagaattctccccgataccccacaggaacctttcgcactctgggagatacttaacaagaattcagacccacttgtgggggtgattttagacaatggcggaaagaccctcacctattttaactacgatcagtctggcgattttcagaccgtgacattcgaggggcccgaaattaggaagatattctacggcagttttcacaagctgcacatagtcgtgagcgaaacactggtaaaagtagttattgattgcaagcaggtcggtgaaaaggcaatgaatgcctccgctaacattacgtcagacggcgtggaggttctggggaaaatggtgaggtcacggggccccgggggaaatagtgcacccttccagctccaaatgtttgatatcgtatgttctacctcctgggcgaatacagacaaatgctgtgagctgcccggcctcagagatgatgaaagctgtcctgacctgcctcattcttgcagctgtagtgagaccaatgaagtggcactcggaccagccggacctccaggcggccccggattgcggggccctaaaggacagcaaggagagcctggtcccaaaggtccggacggaccacgaggtgagatcggtctcccggggcctcaggggcctcccggacctcaagggccctctggtcttagcattcaagggatgcccggtatgcccggcgagaaaggcgagaaaggcgacaccggtttaccgggtcctcaaggaatacccggaggcgtgggatctcctggcagagacggctcacctgggcagcgcggtctgcctggcaaagacggctccagcggaccacccggcccacctggacccattggtattcccgggacgccaggcgtgccgggcatcactgggagtatggggcctcaaggtgcccttggcccaccaggggttccaggcgctaaaggggagcggggggagaggggagatctccagagccaggccatggtgagaagtgtcgcccgacaagtgtgcgagcagttaatccagtcacacatggccagatatacagccattctaaaccaaatcccatcccactcgagtagcatcaggacagtgcaggggccaccaggcgaaccaggcagacccgggagtccaggggctcccggcgagcagggaccccccggtacacccggcttcccagggaatgctggtgtgcctggcacaccaggagaacggggtctgactggcattaaaggtgaaaagggaaatcctggcgttggcacccaggggcctcgcggccccccaggcccagccggccccagcggcgagtcccgaccaggttcaccaggcccccccggatccccaggcccccggggccctcccggccatctgggagtgcccgggccacagggaccttcaggccaaccgggatattgcgacccaagtagttgttctgcttacggcgttcgcgctccccacccggaccagccagaatttacaccggtgcaggatgagttggaagccatggaattgtgggggccaggcgtctag

SEQ ID NO: 2634 - DNA, 5391 bp, Artificial Sequence
  Description of Artificial Sequence: Synthetic coding sequence
atgaagattttccaaaggaaaatgcggtactggcttctgccaccatttttggctatagtgtacttctgcacaatcgtgcagggtcaggtcgcccctcccacccggctgcgttacaacgtgatttcacatgatagtattcagatctcgtggaaagccccgcgcggcaaattcggcggctacaagttgctcgtgaccccaacatccggcgggaaaacaaaccagctgaacctccaaaataccgccacaaaagcgataatacaaggcctgatgcctgatcagaattataccgtccagatcatcgcgtataacaaagataaggagtccaaacctgctcaggggcagtttagaattaaagatttagaaaaacggaaagaccccaagcctagggtgaaagtcgtggacaggggaaacggaagtaggccctcctctcctgaagaggtcaaattcgtctgtcagacccctgctatagcagacatcgtgattctggtcgacggctcatggtcgataggacgttttaacttcagactcgtacgccacttcctcgagaatctagtgaccgcctttgatgttggctctgagaagaccagaatcggcttggctcagtacagcggcgatccccgcattgaatggcacctgaacgcattctctaccaaagacgaagtgatcgaggccgtgcggaacctgccttataaaggtgggaacaccctgaccgggttggctctgaactacattttcgagaatagctttaaacctgaggcgggctcacgaaccggggtgtccaagattggcattctgatcaccgacggcaagtcgcaagacgacattatacctcctagtcgcaacctccgcgaatccggggtcgagctgtttgcaatcggagtgaagaatgccgacgtgaacgaactgcaggagatcgcttccgagccagatagcactcatgtgtacaatgtggcagaatttgacttgatgcatactgtggtggaatccctcacccgaaccctgtgcagtagggttgaggaacaggaccgcgaaattaaagcttcagcacatgccatcaccgggccgccaaccgagctcattaccagtgaggtcaccgctcgcagctttatggtcaactggacacatgctccaggcaacgtcgagaagtacagagttgtgtactacccgactcgtggcggcaaacctgatgaggtcgtggtagatgggaccgtgtcctctacagtcctcaaaaatctgatgagccttactgagtaccaaatcgccgtgttcgccatttacgcccatactgccagtgagggcctcagagggaccgagaccacgctcgctctgccaatggccagcgacttactgctttatgacgtgacagagaacagtatgagggtcaagtgggacgccgtccccggggcgtctggctacctgattctgtatgctccgttgaccgaggggttggctggtgatgagaaagagatgaaaattggagagacacacacggacattgaactctccggactgctacctaatacagaatacacagtgacagtgtacgccatgttcggtgaggaggcaagtgaccctgtgactggtcaggaaacaaccctggccctaagtccgcccagaaatctcagaataagtaatgtgggctctaattcagcccgcctgacatgggacccaactagcaggcagatcaacggatatagaattgtctacaataatgccgatggcacagagatcaacgaagtggaggtggatccaatcaccacttttccattaaaaggactgacgccattgaccgagtacactattgctattttcagtatttatgatgaaggccaaagcgagccactcactggcgttttcacaaccgaggaagtccccgcccagcagtacctagaaatcgatgaagtaaccaccgactcgttccgtgtaacctggcatcccctcagtgcggacgaggggttgcacaaattgatgtggattcctgtttatggggggaagacggaggaagttgtcttgaaagaggagcaggattcacatgtcatagaaggccttgaacctgggacagagtatgaagttagtcttttagcggtactagacgatggttccgagtccgaggtggtgaccgcagtggggacaactcttgattctttctggacagaacccgccaccacgattgtcccgaccacatcagttacaagcgtctttcagaccggcatcagaaacttggtcgtcggggatgagactacttccagcctgagagtgaagtgggatattagtgacagcgacgtgcagcagtttcgtgtgacctacatgactgctcaaggtgatcccgaggaagaggtcattgggaccgtaatggttccggggtctcaaaacaatctgcttctgaaaccccttctccctgatacagagtacaaagttaccgtgaccccaatatacacggacggagagggtgtctctgtgagcgctcccggaaagacactgccctcaagcggtccacagaacctgcgggtgtccgaagagtggtacaatcggctgcgcatcacatgggacccccccagttcccctgtcaaaggatataggatcgtatataagcctgtttccgtgccaggtccaaccctggaaactttcgtgggcgcagacatcaacacaatcttgataacaaacctgctgagcggtatggattacaatgtcaaaatatttgcttctcaggcatccgggttcagtgacgccctaacaggcatggttaaaacgctcttcctgggtgtaacaaacttgcaagccaagcacgtggagatgaccagtctgtgcgcccattggcaggtgcacaggcacgctacagcatatagagtggtgatagagtctctccaggaccgtcagaaacaggaaagtacagtcggaggggggactactaggcactgcttttatgggctccagccagattcagaatataaaattagtgtgtatactaagttgcaagagatcgaggggccctccgtgagtattatggaaaaaacccagagcctgcccacacggccgccaacattcccgcctacaattcccccagccaaggaagtctgtaaagccgccaaagcagacttagtgtttatggtagatgggagctggtcgatcggtgatgagaactttaacaagatcattagcttcctgtatagtactgtgggagctctcaacaagatagggactgacggcactcaagtcgccatggtccaatttaccgatgacccaaggaccgagtttaagctgaatgcatataaaacaaaagaaactctgttagatgccataaaacacataagctataagggtggaaacacaaaaaccgggaaagcaatcaagtacgttcgggacaccttatttaccgctgagtccggtactcgccgtgggattccaaaggtgattgtggttatcaccgacgggagatcgcaggatgatgtgaacaagatttccagagagatgcagctagacgggtattccatttttgccataggggtcgcggatgccgattattccgaactcgtctcaatcgggtccaagcctagcgcacgccacgtcttttttgtcgatgatttcgatgctttcaaaaaaatagaggacgaactgataacgtttgtctgtgagacggcctccgccacctgcccagtggtccacaaggacggaattgacctcgccggtttcaagatgatggagatgtttggactcgtggaaaaggacttctcttcagtcgagggcgttagtatggagccaggaacattcaacgtattcccatgctaccagttgcataaggatgccctggtgagtcaaccgacgcgctatttgcacccagagggtttgcccagcgattacacgatctcattcctcttccgaatacttcctgacactccccaggagcccttcgccctgtgggagattctgaacaagaactctgacccattagtgggagtgattctcgataatggcggaaaaacgttgacctactttaactacgaccaatccggcgattttcaaacggtgactttcgagggtcccgagattaggaagatcttttatgggtcattccataaattgcacatcgtggtgtctgagacattggtaaaggtggtgattgactgtaagcaggtaggggaaaaagccatgaacgcgagcgcaaatatcacatccgacggcgtggaggtgctgggcaagatggtccgatcccgagggcctgggggcaattcagctccatttcaactacagatgtttgacattgtttgcagtaccagctgggccaatactgacaaatgctgcgagctgcccggattgagggacgacgaaagctgcccggatctgccccattcctgttcctgtagcgagacgaatgaggtcgcccttggtcctgcagggccccctggcggtccgggcctgcgaggccccaagggtcagcaaggagaacccggccccaagggtcctgacggaccccgcggagagatcggactgcctggaccgcagggaccacctgggccacaaggcccctcggggctctccattcagggaatgcctggcatgcccggcgaaaaaggagagaagggggatactggtctgccagggccacagggcattcctggcggtgtgggctcacctggccgcgacggatcgccaggccagagaggtctcccagggaaagatggatccagcggtcctccggggcctccaggaccaattgggatccccggcactccaggggtgccggggatcaccgggtcgatgggtcctcagggagccctgggcccgccgggcgtgcctggagccaaaggggagcgcggcgaaaggggagaccttcagagtcaagcaatggtacgcagtgtggctaggcaggtgtgcgaacagctgatccagagccatatggctcggtatactgcgatactgaaccagattccaagccacagctctagtatcagaaccgtccaaggccctcccggcgaaccaggccgaccagggagccccggagcacctggggaacaggggcctcccgggacaccggggttcccaggcaatgccggagttcccggcacaccaggagagcgtgggctgaccggcataaagggcgagaagggcaatcccggggtgggcacgcagggtcctcgaggacctccaggacccgcaggtccaagcggggaaagccgccctggaagtccagggccgccgggaagccctggcccgaggggtccaccaggccaccttggggtccccgggcctcagggcccatccgggcaacctggctattgtgacccctctagctgtagcgcgtatggggttagagcccctcatcccgaccagccagaattcactcctgtgcaagacgaactggaggccatggagctgtgggggccgggtgtttag

SEQ ID NO: 2635 - DNA, 5343 bp, Artificial Sequence
  Description of Artificial Sequence: Synthetic coding sequence
atgaaaatcttccagagaaaaatgcgatattggctcctgccacccttcctagccattgtgtatttttgtacaattgtgcagggccaggtggcccctccaacccgcctcagatacaatgtcatttcccatgattctattcagatttcatggaaggctccccgcggtaagtttgggggatacaaactgttggtcacccctacctctggcgggaagaccaatcaattgaacctgcaaaacacagccaccaaggcgatcatccaaggcctcatgcctgatcagaattatacagtccagattattgcatataacaaggacaaggagagtaaacctgcccagggacagtttcgcattaaggatctagagaagagaaaggacccgaagcctcgcgtcaaggtggtggaccgtggaaacggtagcagaccctccagtccggaggaggtaaaattcgtgtgtcaaacaccggccatcgcggacatagttatcctagtcgacggctcttggtccattggaagattcaacttccgcctggtacggcactttctggagaatttagtaaccgcattcgatgtggggtctgagaagacgagaatagggctggcccagtattccggcgatcctagaatagaatggcacctcaatgcgttctcaacaaaggacgaagtgatcgaggcagtgcggaacctgccttataaaggcggaaacacacttaccggcctggccctgaactatatctttgagaactccttcaaacccgaggcaggcagtagaacaggcgtgagcaaaatcggtatcctgattacagatgggaaaagtcaagacgacatcatacctccctcccgtaacctcagggaatccggggtggagctgttcgctatcggggtgaaaaacgcagacgtgaacgagctgcaggagattgcctccgaaccggattcgactcacgtatataacgtggctgaattcgacctgatgcacacggttgtagagagccttaccaggaccctatgctcgagagtcgaggaacaggatcgagagattaaggcttccgcccacgctatcacaggtccccccacggagcttataacctctgaagtcactgccaggtccttcatggtgaactggacccatgcacccggcaatgtcgagaagtaccgcgtggtctactacccaacccggggcggcaagcccgacgaggtggtggtcgacggaaccgtctcttccactgtgctgaaaaaccttatgtcactaacggagtaccagattgctgtttttgccatatacgcccatacggcatccgagggcttgaggggaacggaaaccacactggcacttccgatggccagtgacttgcttctctacgatgtaaccgagaatagcatgagagtcaagtgggacgccgtgccaggagcaagcggatacctaatcctctacgctccactgactgagggcttagccggggatgagaaggagatgaagatcggcgaaacccacactgacattgagctatcaggactgcttcccaacaccgaatacacggtaaccgtttacgcaatgtttggcgaggaggctagcgacccagtgacagggcaggaaactaccctggccctgagccccccccgaaaccttaggatctccaacgtcggctcgaactccgctagactgacatgggacccaacaagcagacagatcaatggatacaggattgtgtacaacaatgcagatggtaccgaaattaatgaggtggaagtcgaccccattaccacattcccactgaaggggctcacaccattgacagaatatacaatagcaattttctccatatatgatgaaggacagtctgaacctctgactggggtgttcacgactgaagaggttcccgcacaacagtatctcgaaatcgacgaggtgacaactgatagtttcagggtgacatggcatcctttgagtgcagacgagggtttacataagttgatgtggattcctgtgtacggcgggaagaccgaagaggtggtgctgaaagaggagcaggattcccatgtaatcgagggtctcgagcctggtaccgagtacgaagtctcattgttagctgtgctggacgatggtagtgaaagcgaggtggtcaccgccgtgggaactaccctggacagcttttggacagaacccgcaactactattgtgcccaccacctcagtaacctctgtttttcagacgggtattcgcaacctggtggtcggcgatgagaccacaagtagcctccgcgtgaagtgggacatctcagattccgacgtgcagcagttcagagtcacatatatgaccgctcagggggaccccgaggaggaagtgattggcacggtgatggtgccaggctcacagaataatttacttctgaagcccttattacccgacactgagtacaaggtcaccgtgactcctatctacaccgacggtgaaggggtgtcagtgtccgcccctggcaaaacactgccaagttccggaccccagaacttgagggtgagtgaagagtggtataatcggctgcggatcacctgggaccctccatccagccccgttaaagggtatagaatcgtgtacaagcccgtctcagttccaggacccactctggagactttcgtcggagctgacataaacacgatcctcataacaaatttgctgagcggcatggactataatgtgaagatcttcgctagccaggccagcgggttttccgatgcgctgactggcatggtgaagaccctgtttctgggtgtgacaaacttgcaggcaaagcatgtcgagatgacctcgctgtgtgctcactggcaggttcaccgacatgcaacagcatatagagtggtgatcgagtcccttcaggataggcagaaacaagaaagcacagtgggcggggggaccacccgccactgcttctatggactgcaacccgactccgagtacaagatctctgtgtacacaaagctgcaggagattgaaggtccttccgtctccatcatggaaaagacacagtccctcccaacgagaccccctaccttccctcctacaatacccccagcaaaggaagtctgcaaggctgctaaggctgatcttgtcttcatggtggatgggtcttggtcgatcggcgacgaaaacttcaacaagattattagtttcctctactcaaccgtgggcgccctcaacaagatcgggactgacggaacccaggtcgctatggtccaatttacagacgatccgcgaactgagttcaaactgaacgcctacaagacaaaggagacactgctcgacgccatcaagcatatttcttacaagggaggcaacaccaaaactggcaaggccatcaaatatgtccgtgatacattgttcacagccgagtctgggaccagaaggggcatccctaaggtcatcgtggtgatcaccgatgggagatctcaggatgatgtcaacaagatttcaagggaaatgcagctcgacggctattctatctttgcaataggcgtggctgacgctgattattccgagctggtgagcattggatcgaaaccaagtgcacggcacgtatttttcgtggacgactttgatgccttcaagaaaattgaagacgaattgatcacgtttgtatgcgaaaccgcgtcagccacctgcccggtcgttcacaaagatggcatcgatctggccggttttaagatgatggaaatgttcggattggtggaaaaagacttcagcagcgtggaaggggtatcgatggagccgggcaccttcaatgtttttccctgttaccagctgcataaagacgccctggtcagtcagcccactaggtaccttcatcccgaggggttgccatctgattatacgatttccttcttgttcagaatattgccagatacaccacaagagccgtttgctctctgggagattcttaataaaaactcagatcccttggtaggcgtgattctggataacggtggaaagaccctcacttatttcaactatgatcagagtggtgattttcagaccgtgacatttgaaggtcccgaaattcgaaaaattttctatggatcatttcacaagctccatattgtggtgtctgagaccctagttaaggtggttatcgactgtaagcaggtcggggagaaggccatgaacgcttccgccaacattaccagtgacggcgtggaggttctgggaaaaatggtgcgctcacggggtccaggcgggaacagcgctccattccagcttcagatgttcgacatcgtttgcagtacgtcctgggccaatacagataaatgttgcgaattgcccggcttacgcgatgatgagtcctgccctgacctgcctcacagttgttcctgtagcgagacaaacgaggtggcattggggccagctgggccccctggcggcccagggctgaggggccccaaggggcagcagggggaacctggacctaagggccccgatgggccccgcggggagatcggactccccggaccacaggggccacccgggcctcagggtcccagcggcctgtctatccagggcatgcctggaatgcccggcgagaagggcgagaagggtgacactggtctgccggggcctcagggcattcccgggggtgtcgggagccccggccgtgacggctctccaggccagagaggcctccctggaaaggacggatccagtggccctcccggcccacccgggcccataggaattcccggaaccccaggggtccctgggatcacgggtagtatgggacctcaaggggccctcgggcccccaggggtcccgggggcgaaaggcgagaggggtgagagaggcgatctgcagtcccaggcaatggtgcgttccgtggcgcgccaagtgtgcgagcagttgatccaatcacatatggccaggtacaccgccattttaaatcagatccccagtcacagttcttctattagaacagtgcaaggtccacccggagaacccggccggccaggctcccccggagcccccggggaacaaggaccccctggtactcccggcttccccggtaacgcaggcgtccctggcacccctggcgaacggggactgactggcatcaagggggaaaaaggcaacccaggcgtcggaacgcagggaccaaggggcccgcctggcccagcagggccttccggcgaaagcagacccggatcaccaggcccacctggctccccgggccctcgtgggccccccggtcacttgggggtgcccggtccccaaggcccgtccggacagcccggctactgtgatccttcctcctgctccgcttatggagtccgggatctaatcccatacaatgattaccaacattag

SEQ ID NO: 2636 - DNA, 1605 bp, Artificial Sequence
  Description of Artificial Sequence: Synthetic coding sequence
atgaaaattttccaaaggaagatgcgctattggttgctccccccatttctggctatcgtgtatttttgcacaatagttcaaggccaggtggcaccccctacaaggctgcggtataatgtgatcagccacgattctattcagatttcttggaaggcccctcgaggcaagttcggagggtacaaactcctagtcaccccgaccagcggtggtaaaacaaatcagctgaatctgcaaaacactgcgactaaggcaatcatacagggcctcatgccggaccagaattacactgtgcagatcatcgcttataacaaggataaggaaagcaagccagcccaggggcagtttcgcataaaggatctggagaaaagaaaagatccaaaacctcgcgtaaaggtggtggaccgggggaatggctcaaggcccagctctccggaggaagtgaaattcgtatgtcagacgccagcaatagccgacatcgtcatactggtggacggctcttggtccattgggcgctttaactttagactcgtccgtcacttcctggaaaatctcgtgaccgcatttgatgtgggttccgagaagacgagaatcggcctagctcagtacagtggggatcctagaattgagtggcacctcaacgctttctcaactaaggacgaggtgatagaggccgtgagaaacttgccatataagggtgggaacaccctgaccgggctggcacttaattatatcttcgagaattcattcaaaccagaagccggctcacgcactggcgtgtccaaaatcggcatcctaattaccgacggaaaatcccaggacgatatcatcccaccgtcacgcaatcttagggagagcggggtggagctcttcgctattggagtcaaaaacgccgacgtgaatgagttgcaagagattgccagtgagccggatagcacccatgtgtataatgtggccgagttcgacctgatgcataccgtggtagagtcactgacccggacgctgtgctcccgggtggaggaacaagacagagaaataaaagctagtgcccacgctatcactggaccgcccaccgagctaataacgtcagaagtgacagcccgatcattcatggttaactggacccacgcacctggcaacgtcgagaaatatagggtcgtatactatcctaccagaggggggaagccagacgaggttgtcgtggacggcacggtcagttccactgtgctaaagaatctcatgagtctgactgagtaccagattgccgtattcgccatctatgcacatacggccagcgaaggcttgcggggtactgaaacgacactagccctcccgatggcaagcgaccttttactctatgatgtcaccgaaaatagtatgagagtgaaatgggatgcagtgcccggagcttccgggtacctaattctctacgctccactgactgaagggctggccggggacgaaaaagaaatgaagataggggaaacacacaccgatattgagctgtctgggctgctacccaacacagagtacactgtcacggtctatgccatgttcggggaagaagcttcggaccccgttacggggcaggaaacaacgagcccttag

SEQ ID NO: 2637 - DNA, 3429 bp, Artificial Sequence
  Description of Artificial Sequence: Synthetic coding sequence
atgcggctgactggaccctggaagctgtggctgtggatgtcaatctttcttctgcccgcctctacaagcgtgaccgttcgagacaagactgaggagtcatgcccaatcctgaggatcgagggccaccagctgacctatgataatatcaacaaacttgaagtgagcgggtttgacctgggagactcttttagcctccgccgcgccttttgcgaaagtgataaaacgtgctttaagctcggctcggctctgctaatccgggataccataaagattttcccaaaaggcctgcccgaagagtacagcgtggcagcgatgttcagggtaaggcgaaacgccaaaaaagaacgctggttcttatggcaggtgctgaatcagcagaatattccacaaatttctattgtcgttgacggcggtaagaaggtcgtagaatttatgtttcaagctacggagggggatgtcctgaattatatattccgtaacagggaattgcgccctctgtttgatagacagtggcataagttgggtatctctattcagtctcaggtcatcagtctgtacatggactgtaacctcattgcccgccgccaaaccgacgagaaggatactgtggattttcacgggaggactgtcatagccacgcgggcttccgacggcaaacccgtcgatatcgaactgcatcagttgaagatctactgctccgccaacctcattgcacaggaaacttgctgcgaaataagcgatactaaatgccccgagcaggacggattcggtaatattgccagcagctgggtgaccgcacacgcatctaaaatgagtagctatcttcccgctaagcaggagttaaaggatcagtgccagtgtattcctaataaaggagaagctgggttgcccggagcccccggatctccaggacaaaaaggccacaagggagaaccaggcgagaatgggctgcacggcgccccgggtttcccaggtcagaagggtgagcagggatttgaaggctccaaaggcgaaactggcgaaaagggcgagcagggcgagaagggagacccagcactggccggactaaacggggaaaacggcctgaagggcgatctggggccccacggccctcccggaccgaagggagagaagggggacacaggccctccaggtccccccgctctccccggttctcttggaatacaaggtccccagggtccaccaggcaaggagggccaaagaggtcgccgaggaaaaactggtcctcccggaaagcctgggccccccggcccccccggccccccgggcatacagggcatccaccaaactctaggcggttattataacaaggacaacaaggggaatgatgagcacgaggccggcggcctgaaaggcgataagggggagaccgggcttcctggattcccgggttccgtcgggccaaagggacagaaaggggagccgggagaaccttttaccaaaggtgagaagggcgatcggggtgagcctggcgttatcggctcccagggcgttaaaggggagcctggggatcctggaccacccggacttatcggaagcccaggcttgaagggacagcagggatctgcgggttctatggggccccggggccctccaggcgatgttgggcttcccggtgagcacgggatccccggtaagcagggaattaagggggagaagggcgatcccggcggcattatcggaccgcccggtctcccaggtcccaaaggggaggccgggccgcccggcaaatccctgcctggggagccaggcctggacgggaaccctggcgccccagggccgaggggacctaaaggagagcgggggctcccaggagtgcatggatctcccggcgatattgggccacagggtatcgggatccctgggcgcactggagcacaggggcctgccggcgagccggggatccaaggacccagaggccttccaggtttaccaggcacccctgggacacccggaaacgacggcgtgcctgggcgtgacgggaaacccggattgccagggcctccaggggatcccatcgccctccctctacttggagacatcggggctttgctgaagaatttctgcggcaattgtcaggcttccgtaccagggcttaagagtaacaaaggcgaggaaggaggtgccggggagccagggaaatatgattcaatggctaggaaaggggatattggccctcgcgggccacctggcataccagggagagaaggcccaaagggctccaaaggagaaagggggtatcctgggatccccggtgagaagggagacgaagggctgcaaggcattcctggaattccaggagcccccgggcccacaggtccgccaggcctcatggggcggacaggacacccgggcccgacaggggcgaagggcgaaaagggctccgatggcccaccaggaaagccggggccgcccggaccaccgggaatccccttcaatgagagaaacggtatgagcagtctttataagataaaaggcggcgttaatgtgccatcgtaccctgggccacctgggcccccaggccccaagggcgaccccggccccgtgggggagcccggtgccatgggcctgcctggcctggagggctttcccggtgttaagggagatcggggcccggctggccctcctggtatcgcaggcatgtctgggaagcccggagcaccaggccctccaggcgtgccaggcgagccaggagagcgtggccccgtaggcgacataggcttccctggccccgagggcccgagcggtaagccagggatcaatggtaaagacggcatacccggggcacaaggcattatgggaaagcccggggacagaggcccaaagggtgagaggggtgatcagggtatacccggcgaccggggctcccagggtgagcgagggaagcccggcctgacaggaatgaagggcgccattggtcctatgggacctccaggaaataagggctccatggggagccccggccatcagggccccccagggtcaccaggcatcccagggatccctgccgacgccgtctcattcgaggagattaaaaagtatatcaatcaggaagtgctccgcatctttgaagagcggatggccgtgttcctgtcccagcttaagcttcccgcggccatgcttgcagctcaggcgtacggacggcctggccctccggggaaggacggactgcccggaccccccggggaccctggtccccaggggtacaggggacagaagggtgaacggggagagcccggcattggtctgcccggttcacctggcctccctggcacttccgcccttggcctgccagggtcacccggcgccccaggaccacagggaccacctgggccctctggcagatgcaaccccgaggactgcctgtaccccgtgagtcatgctcatcagaggactgggggcaattag

SEQ ID NO: 2638 - DNA, 462 bp, Artificial Sequence
  Description of Artificial Sequence: Synthetic coding sequence
ggaattaacggcaaggacggcataccaggggcccagggcattatgggcaaacctggcgacaggggacccaagggcgagcgcggcgatcaaggcatccccggagatcggggaagtcaaggcgaacgcggaaagcctggactgacaggaatgaagggggctattggaccaatgggaccaccaggcaataagggatctatgggatcacccgggcatcaggggccaccaggaagtcccgggatcccggggataccagccgacgctgtgtcctttgaggagatcaaaaagtatatcaaccaggaggtcttacgcattttcgaagagcgaatggcagtatttctgagccaactgaagctgcccgctgcaatgttggccgcacaggcctacggccggcctggacctcctgggaaggatggcctccccggccctcccggagaccccgggcctcaggaagtagacgtctag

SEQ ID NO: 2639 - DNA, 4167 bp, Artificial Sequence
  Description of Artificial Sequence: Synthetic coding sequence
atggctcccaggagaaacaatggccaatgttggtgccttctgatgttgctttctgtcagcactccactgcctgccgtcacgcagacacgcggtgctacagagacagcctcacagggccacctggacctcacccagctgattggggttccacttcctagtagtgttagttttgtcactggttatggtggcttcccagcctatagcttcggtccaggagcgaacgtggggcggcctgccaggacgctgattcccagcacctttttcagggatttcgccatctcagtggtggtgaagcctagttcaactaggggcggggttctgttcgctatcactgatgctttccaaaaggttatctacctcggattacgcctaagtggcgttgaggacggacatcaacgtattattctctactacaccgagcccgggagtcacgtctcgcaggaggcagcagctttttccgtgcccgtaatgacccatcgatggaaccggtttgccatgattgtgcagggcgaagaggtcactctgcttgtaaactgtgaggaacactctaggataccgttccaaaggtcctcgcaagccctggccttcgagtcgtccgccggaatatttatggggaatgccggggccaccggactggaacgattcaccggcagcttgcagcagcttaccgtgcacccagatccccgtactccggaagaactgtgtgaccctgaggaatcctccgcatccggcgagacctcaggtctccaggaggctgatggggttgcagagattctggaggccgtcacttacacccaggcctccccaaaagaggccaaggtagagccaatcaatacgcctcccaccccttcctccccctttgaggacatggagctttcaggcgaacctgtgcccgagggcaccctagaaacaactaatatgagcataattcagcacagtagtcccaagcagggttccggcgagatactcaacgatacattggagggagttcactccgtggatggcgaccctattaccgattctggctccggcgctggagcctttctggatatcgccgaggaaaagaatctcgccgctacagcagccggactcgccgaagtgccaatcagcactgccggcgaagccgaagcttcatccgtccccaccggtggacctaccttgagtatgagcacagagaaccccgaagaaggagtcacacccgggccggacaatgaggagaggctggccgctacagccgccggcgaggcggaagccctggcgtctatgccaggagaagtggaggcctccggggtggctccaggggaacttgatctatcaatgtccgcccaatctctgggcgaagaagccaccgttggaccatcttctgaggactccctcaccactgccgctgcagcgacggaagtttctctgagcactttcgaggatgaggaagcctccggggtcccgacagatggcctggctcctctgacagccactatggcccccgaacgagccgtgaccagcggacctggagatgaagaagacttagctgcagcgacaacggaggagcccttgattactgcaggcggcgaggagtcgggctcacccccccctgacggcccgccactgcccctgccaacagtggcgcccgagagatggatcacacctgcccagcgggagcatgtgggtatgaagggccaggcgggtcctaagggggaaaaaggggatgcgggagaagagttacctggcccccctgaaccaagcggaccggtggggcccacagccggggctgaagccgagggctctggactggggtggggttctgatgtgggatccggctccggtgatttggtggggtccgagcagctgctcagaggaccccctggccctccgggtccacccgggctgcccggcatccccggtaagcccgggactgatgtatttatgggtccaccaggcagccccggcgaggatgggcccgccggcgaacccgggcccccagggcccgagggccagccaggagtggacggcgcaactggcctgcctggcatgaagggggaaaagggggctcgcggccctaatggctccgtaggggagaaaggtgatcctggaaaccgtggactgcccgggccgccaggcaaaaagggccaggccggcccacctggggtaatggggccgccaggacctcccggaccccctggacctcctggtcccggttgtaccatgggcttaggtttcgaggacactgagggatctggctcaacccaactcctgaacgagcccaaactgagccggcccactgccgcaatcgggttgaaaggagagaaaggcgataggggccctaagggggaacgcggcatggacggggccagtatcgtgggaccccctggtccaagaggaccccccggtcatattaaagttctttccaatagcctcatcaacatcacccacggcttcatgaattttagcgacatccccgagctggtggggccacccgggccagatggtcttccgggcttgccgggttttcccggccctcgggggccaaaaggcgacaccggcttacctggctttcccggcctaaaaggcgaacagggcgagaaaggggaacccggtgctatcctcacagaggacattcctctggagcgcctgatgggaaagaagggagagcctggaatgcacggggcccccggaccaatgggtccaaagggaccccctggacataaaggcgaattcgggctacctgggcggcccgggcgcccgggcctgaacggattaaaagggaccaagggagatccaggagttattatgcagggaccacctggactgcctggaccacccggaccacccggccccccaggcgcagttatcaacattaagggagctatctttcctattcccgtccgcccccactgcaaaatgcctgtagatactgcgcaccccggaagcccagagctcatcacatttcacggagtcaaaggcgagaagggttcctggggtctgcctggcagcaagggcgaaaagggcgatcaaggggctcagggacctccagggccccctctggaccttgcctatctaaggcacttcctgaataacctcaaaggagaaaacggagataaaggcttcaagggtgagaagggtgagaagggtgatatcaatggaagctttttgatgagcggtcctcctgggctgcccggcaacccaggaccggcagggcagaaaggcgagaccgtggtcggacctcaaggcccacctggagcaccagggctaccggggcctcccggatttggccgtcctggcgatcctgggcctcccggacctcctgggccgccaggcccgcccgcaattctgggcgcagcggtcgccctgccgggcccgcccgggcccccaggccagcctggccttccaggatctaggaacctcgtgacagccttttcgaacatggacgatatgttgcagaaagcgcatctggtaatcgaaggaacgttcatttatttacgggactccaccgagttcttcattagggtaagggatggctggaaaaaactgcagttgggtgaactcattcctatcccagcagattccccgccacctccagccctaagcagtaatccccaccagctcctgccccctccgaatcctatctcatcagccaactatgagaagccggctcttcacttagccgcactgaacatgccatttagtggagatattcgggccgacttccaatgtttcaagcaggctcgagccgccgggttattgtctacatacagagcattcctctcaagccacctgcaggacctctcaactattgtgagaaaggccgaaaggtatagcctccctatcgtcaacctgaagggacaggtgctcttcaacaactgggactcaatttttagcggccacgggggccagtttaacatgcacataccgatctacagcttcgatggcagagatattatgacggatccctcttggccccagaaagtgatatggcacggatcgtcacctcacggagttaggctagtggacaactactgtgaagcctggagaacggctgatactgcagtaaccggcctggcaagtcctctctccacaggtaagatccttgatcagaaagcctacagttgtgctaatcggctaatagtcctctgcatcgaaaattcctttatgactgatgcgaggaaatag

SEQ ID NO: 2640 - DNA, 2238 bp, Artificial Sequence
  Description of Artificial Sequence: Synthetic coding sequence
atggctccacgaagaaacaacggccagtgctggtgtctgttaatgctgctgtctgtccctctcccttcgagtgtgagtttcgttaccggctacggaggatttcccgcatacagcttcgggcctggggcaaatgtggggcgccctgctcggacgctgatccccagtacttttttcagagactttgccatttccgtcgtggttaagccctcatccactcgaggcggtgtattattcgccattactgacgcattccagaaagtcatttatctcgggctcaggctgtccggtgtggaagatggtcatcagcggattatcttgtattacacagagcccggctcccacgtgtcccaggaggcagctgctttttccgtgccagtcatgacccacagatggaatcgttttgctatgatcgtgcaaggagaggaggttacactgctggtaaactgcgaagaacattccagaatccctttccagaggtctagtcaggcactggcatttgagtcctccgcaggcatttttatgggtaatgctggggccactgggctagagcgcttcactgggagtctgcagcaactaaccgtgcaccccgaccctcgtacaccagaagagctttgcgacccagaagaatcaagtgcaagtggagaaacctctggtctgcaagaggctgatggggtcgccgaaattttggaggctgtaacctatacacaggctagtcccaaggaggccaaagtcgagccaatcaatacaccacccaccccaagctccccgttcgaggatatggagctgagcggagaaccggttccagaaggcaccttagagactacgaatatgtcgattatccagcacagtagcccaaaacaaggttctggagagattcttaacgataccctcgaaggagttcactcggtggatggggaccctatcactgattccggcagtggcgcgggggcattccttgatatcgcagaggagaagaatttggctgccacagcagcgggcctagccgaggtgcccatctctaccgcgggcgaggctgaggcttcaagtgtgccaacagggggtccaaccctgtctatgtccacggagaatccagaggaaggggttactccgggcccagacaacgaggagcgtctcgctgccaccgctgcaggtgaggccgaggctctcgccagcatgccaggagaggtcgaagcctcaggcgttgctccaggcgagctggatctgagtatgagcgctcaatctctcggcgaagaagccacagtcggcccaagcagtgaggattccttaacgaccgctgccgctgccactgaagtatccctgtcaacgttcgaagacgaagaggcatcaggtgtgcccactgatggtttagccccattgaccgcgaccatggctccagaaagagctgtaacctctggaccgggagacgaagaagacttagccgccgcaaccacagaagaacctctaataactgccggtggagaggaatctggctccccaccacccgacggacctcctctgcctttaccaactgttgcccccgaaaggtggataactcctgcacaacgggagcacgtggggatgaagggacaagccggccccaaaggagaaaaaggcgacgccggcgaagagctccccggcccccccgaacctagcggcccagtcggccccacagcaggcgcagaagccgaagggtctggacttggatgggggtccgacgtgggctccggatccggcgaccttgtgggttccgagcagttgttaagaggtccgcccggaccccctgggccaccaggcctccccggtattcctggcaagcctggaactgacgtgttcatgggcccgccaggatcaccgggggaagacggaccagccggggagccaggtcctcccgggcctgaaggccagcctggagtggatggagctacagggctgcccggcatgaagggagagaagggggctaggggcccaaacgggagcgtcggtgagaagggagatcctggaaaccgcgggttgcctggcccaccaggaaaaaaagggcaggccgggccccctggtgtgatgggccccccgggaccacccggtcccccaggaccacccggacctggctgtaccatgggcctcgggtttgaagacactgaaggatccggatccactcaactcctgaacgagccgaagctttccagtcccactcccaccccacagttttatgattttcacctcgccatcgtggagctctag

SEQ ID NO: 2641 - DNA, 4815 bp, Artificial Sequence
  Description of Artificial Sequence: Synthetic coding sequence
atgtgggtcagctgggccccaggtttgtggctcctcggtttatgggcaacatttggacatggagctaacactggcgctcagtgtccgccctctcagcaagaaggcctgaagctggagcacagttcgtctctacctgccaatgtcacgggctttaacctgattcaccggctgagtctcatgaaaacttctgccattaaaaagatccggaatcccaaaggacctctgatactgaggctcggggcagcccccgtaacacagcctactagacgggtctttccacgcggtttgccagaggaatttgccttagttcttaccctcttgctgaaaaagcatacccaccagaagacctggtatcttttccaggtcacggacgctaatgggtacccacagatttcattagaggttaattctcaggaacgtagcttggaactccgagcccagggccaggacggtgacttcgtatcctgtattttccccgtcccccagcttttcgatctgaggtggcacaaattaatgctttccgtggccggccgggtcgccagtgtgcatgtcgattgcagtagtgcctccagccagcccttagggcctcggagaccaatgcgcccagtgggtcatgtattcctgggacttgacgccgaacaaggtaagcctgtgagctttgacctccagcaagtgcacatatattgcgaccccgagctcgtgctggaggagggttgctgcgaaatcctgcctgcaggatgtcctccagagacgagcaaggctcgaagggacacccaatctaacgaactaatcgaaataaatcctcagtctgagggaaaagtgtacacgaggtgcttttgtcttgaggagcctcagaatagcgaagtggacgcgcaactcactgggagaattagccagaaggccgaaagaggtgctaaggtgcatcaggaaactgctgccgatgagtgtcctccctgcgtccacggcgcaagagacagcaatgtgagcgaatggagggtgggtcccgagggaggcaagggtgagcggggtttaccagggcctcctggcagcaagggcgagaaaggtgccaggggaaacgactgcgttcgcatctctcctgacgctcccctacagtgcgcggagggccccaagggcgagaagggagagtcaggagctctgggtcctagtggactgccagggtctacgggggagaagggccagaagggcgagaaaggggacggcggcatcaagggtgttccaggaaaaccagggagggacggacgccctggagaaatctgcgtgatcgggcccaaggggcaaaagggggatccggggttcgtggggcctgaggggctggcgggagagcctggacctcctggcctacctggacccccaggaattggccttcccgggaccccaggcgatcccggcggaccaccgggccccaaaggagacaaaggctccagcggaatacctggaaaagaggggccaggcggtaagcccggaaagcccggcgttaaaggagaaaaaggagacccctgtgaggtgtgtcccactttgcctgagggtttccagaacttcgtgggactgcctgggaagcctggcccaaagggggagcccggggacccagttcctgcccgcggcgatcccggcattcagggtattaaaggcgaaaaaggagaaccttgtctgtcgtgctcaagcgtggtgggcgctcaacacctggtgtcgtccaccggtgcctctggagatgtggggtctcctggcttcggccttcctggactaccagttaaggcgggggttcctggcctcagccctggcggtaattttggagaagcaggtcccgcaggaagtccaggtcccccgggcccagtgggtcccgccggtatcaaaggcgccaaaggagaaccttgtgagccttgtccagctctgagcaacctgcaagatggagacgtacgtgtagtagcactgcctgggcccagcggcgagaaaggggagcctggaccacctgggttcgggcttcccggcaagcagggaaaagctggcgagcgtggcctgaagggtcaaaaaggggatgcaggcaaccccggggatcctggcacacctggcacgaccggcaggccaggcctgagtggggagccaggagtgcagggcccagctgggcctaagggagaaaagggtgatggatgtaccgcatgtcccagtctgcagggcacggtaacagatatggctggtcgcccggggcagcctggccccaaaggcgaacagggtccagagggcgttggacgccctggaaagccggggcaaccaggtcttccaggggtgcagggaccccccgggttgaaaggcgtacaaggggagccaggcccccctggacgcggcgtgcagggcccacagggtgagccaggtgcacccgggctgccggggattcagggcctgccagggcctcggggtcctccaggtccaacaggtgagaaaggagcccagggctctcctggggtgaagggcgctacgggccctgtgggtccgcctggggccagtgtcagcggacctcccgggagggacggccagcagggccagacaggactacgcggcacacctggagaaaaaggccccagaggagagaagggggagcctggcgaatgtagttgtccttcccaaggtgaccttattttcagtggcatgccaggtgcgcccgggctctggatgggaagcagctggcagcctgggccccagggcccgccgggcattccaggacctcctggccctcccggcgtacctggtttacagggtgtgcctggaaataacggccttcccggtcagccaggcctgaccgcagagctgggagccctggccctggggagtcattggggcagcccaagtatctgtggcgactgcgtgcagggtcagagagcacatccggggtatctggtggagaaaggcgagaagggcgaccagggcattccgggcgtgcctggcctggacaattgtgcccagtgtttcctttcacttgaaagaccacgggccgaagaggcacggggggacaactctgaaggggatcctggctgcgtgggatctcccggcctcccagggcctcctggtcttcccggacagagaggagaggagggaccccctgggatgcgcggctctcctggtccccctggcccaatcggccctccaggcttcccaggcgccgtcggcagcccagggctgcccggactgcagggggaacgcggattgactggactaactggggacaagggtgagcctggtccaccaggccaaccagggtatcccggcgccacagggccccccggcctccccggcatcaaaggcgagcgaggttataccggaagcgccggggagaaaggcgagccagggccacctggatctgagggactacctggccctccaggcccggctggacccaggggcgaaagaggaccacaagggaatagcggggagaaaggcgatcagggttttcaggggcagccgggcttccctggcccccccggtccaccaggttttccaggaaaggtcggttcacctggcccacccggaccccaagctgaaaagggatctgagggtatcaggggcccatcaggattgcctggcagccccggccctcctggacccccgggaattcaaggccctgcggggctcgacggacttgatggtaaagatggaaaacccggcctgagaggagaccctggtcctgcgggcccaccaggactgatggggccccctggatttaaaggcaaaacgggtcaccctggtctaccaggtccgaagggtgactgtggaaaacccggcccccccggaagtaccgggagacctggtgccgagggagagccaggggcgatgggaccacagggccggccagggccgccaggacacgtgggcccacccggccctcctgggcagcccggacccgccggcatttcagctgtggggttaaagggagaccgcggcgctacgggcgagcggggtctcgcggggctgcccggccagcctggcccgccaggccaccccgggccacctggggaaccaggtacagatggagcagcaggcaaagagggaccaccaggcaaacaaggcttctacgggcctccaggcccgaagggggatcctggcgcagctggtcagaagggacaggctggtgagaaggggcgggctggaatgcctgggggcccgggaaagagtggcagtatggggcccgtggggccccccgggccggccggggagagggggcaccctggggccccaggtccttctggatcacccggcctacctggggtgccaggcagtatgggtgacatggtgaactacgatgaaatcaaacggtttatcagacaggagattattaagatgttcgacgaacgaatggcatattacacttcccgtatgcaatttccgatggagatggcagccgctccgggccgcccaggtcctcccggcaaggatggagccccaggccgcccgggggcgcccgggtcacccgggctgccaggccagattgggcgagaaggacgccagggtcttccaggcgtgagaggtctccctggtactaagggggagaaaggggatattggcattggaatcgccggtgaaaacggactgcccggaccgcccggcccacaaggcccgcccggctatggcaagatgggcgcgactggaccaatgggccagcagggaatcccaggaatcccaggacccccaggacccatggggcagccaggcaaggcagggcattgtaatcctagtgactgtttcggggccatgcctatggagcagcagtacccacccatgaagacaatgaagggacccttcggatag

SEQ ID NO: 2642 - DNA, 4815 bp, Artificial Sequence
  Description of Artificial Sequence: Synthetic coding sequence
atgtgggtgagttgggccccaggactctggttgttgggactgtgggccaccttcggacacggtgcgaatactggtgcacagtgtcctccgtcccaacaggagggactaaaactcgagcactcatccagtttgccagccaatgtgacagggttcaatttaatccatcgcctctccctgatgaagacttctgccattaaaaaaataaggaatcccaagggaccactcatactaagactgggcgctgctccagttacccagccaaccagaagggttttccctaggggactcccagaagagtttgctctggtacttacgctcttacttaagaagcatacgcatcaaaagacttggtatttatttcaggtgacggacgccaatggctacccacagattagcctcgaagtgaacagtcaagaaaggagcctcgagctgcgagcacagggacaagacggggacttcgtgagttgcattttcccagtgcctcagttattcgacctgaggtggcataaactgatgttaagcgttgccgggagagtagcatctgtgcacgttgactgcagctccgctagctctcaacctctcggacccaggcgccctatgcggcccgtggggcacgtgtttctcggtctcgacgcagaacagggaaaaccggtcagctttgatcttcagcaggtacacatctattgcgatcccgagctggttttggaagaggggtgctgcgagatcctgcccgctggatgtccaccagaaacctccaaggctcggagggacacccagtccaatgaactgattgagatcaaccctcagtctgagggtaaggtttatacacggtgtttttgtctggaggagccgcagaactcggaggtcgacgctcagcttacgggccggatctctcagaaggcagaacggggggcaaaggttcaccaagaaaccgcggcagatgagtgccccccgtgtgtccatggggctcgggattccaacgtgaccttagcaccaagcgggccaaaagggggaaagggagaaagaggcctgcctgggcccccaggcagcaagggagagaaaggcgcgagaggtaacgattgcgtacggatttctcctgacgccccacttcaatgtgccgaaggtccgaagggtgagaaaggggagtccggagctctgggcccctccggccttccaggctctaccggcgaaaagggacagaagggcgaaaaaggagacggcggcatcaaaggcgtgccaggtaagccgggtagggacgggcgccctggagagatttgcgtgatcggcccaaaaggacagaagggagatcccgggtttgtcgggccggagggcctggccggggaacccggaccacctgggcttccagggccccccggaatcggtttgccagggacgccgggcgatccaggaggacccccaggacccaagggtgacaagggcagttccggcatacccggcaaggaaggtcccggcggtaagccagggaaacccggagtgaaaggtgaaaagggcgatccctgcgaggtgtgccctactctacctgagggtttccagaactttgtgggcctccccggcaagcctgggcctaaaggcgagccaggcgatcctgtgcctgcccggggagatccgggcattcagggcattaagggggaaaaaggagagccctgtttgagttgcagttctgtggtcggcgcccagcatctagtcagttctaccggagcgtctggcgacgttgggtctccaggattcggactgccaggtttacctggccgggccggagtgcctggcttaaagggtgagaagggtaacttcggggaagctggccccgccggctcccctggcccaccgggtcctgtcgggccagcaggtattaagggcgccaaaggggagccgtgtgaaccctgtcctgctctgtcgaacctgcaggacggggatgtcagagttgttgcccttcccgggccctccggagaaaaaggtgagccaggtcctcctggcttcgggctgcctggcaagcaaggaaaggctggtgaacgaggactgaaaggacagaagggagatgcgggcaatcctggggaccccggcacccctggtactaccggtagacccggtctgtctggcgagccgggcgtgcagggaccggccggcccaaaaggggaaaagggggacgggtgcacggcatgtcccagcctccagggaaccgttactgacatggccggtcgccctggacagcctggtcccaaaggagaacaaggcccagagggagttggccggcccggtaagcctggccaacctggacttcccggggtgcaggggccaccaggcctgaagggagtgcagggcgaaccaggacctcccggacggggagtgcaggggccgcaaggagaaccaggtgccccaggcttaccaggtatccaaggcctccccggtcccaggggtcccccggggcctacaggggaaaagggagcacaggggtccccaggggtaaaaggagccacaggacccgtcggacctccaggggcttcagtttctggccccccggggagagatggacagcagggacagaccggcttgcgcggtaccccaggtgagaagggaccaagaggagagaagggcgaacccggtgaatgtagctgtcccagccagggggacctcattttttcaggtatgccaggtgcccctggactttggatgggctcttcgtggcaacctggaccacagggccctccgggcatcccgggtcccccagggccccccggagtgccaggtctgcagggggtacctggcaacaatggcctgccaggtcagcccggcctcacagctgagctgggatccctgcctattgagcagcacctgttaaagtccatatgcggtgattgtgtacagggacagcgcgctcaccccggttacctggtcgagaaaggggagaaaggagatcaaggaatacccggagtgcctggtctggataactgcgctcagtgcttcctcagtctggagcgaccacgcgcagaggaagctcgtggcgacaatagcgagggcgaccccggatgtgtgggaagcccggggctgccagggccccccggtctcccaggacagcgaggggaggagggcccccctgggatgcgcggctccccaggaccccccggacccattggacctcctggtttccctggagcagtgggcagcccaggtcttcccggccttcagggtgagcgaggccttaccggactaactggtgataaaggtgagcctggccccccaggtcagccggggtatcccggggccaccggacccccaggattgccggggattaaaggtgagagaggctacaccgggagtgccggcgaaaagggagagccaggaccacctggcagcgaggggctgcctggccctccagggccagcaggccctagaggggagcggggccctcagggaaactcaggcgaaaagggtgatcaaggcttccaggggcagcctggcttccccggacctccaggacccccagggttcccgggtaaagtaggaagccccggaccgccagggccacaagccgaaaaggggagcgagggaatacgcggaccgtcaggcctgcccggtagtccaggaccacctggtccacccggcattcagggtcccgcgggtttagacggactcgacggcaaggatggcaagcctggcctccgaggcgatcccgggcccgctggaccaccaggcctgatgggccctcctgggtttaagggcaagactgggcaccctggcctcccgggacctaagggcgactgcggaaaaccaggaccacccgggagcaccgggcgtcccggagcagaaggcgaacccggtgctatggggccacagggacggcctggaccaccaggtcatgttggccctcccggcccccccgggcagccaggtcccgccggtattagcgctgtagggctgaaaggagaccggggagcaaccggagagcgaggccttgctggactcccaggccaacccgggccacctggccatcctgggcccccgggcgaacctggaacagacggggcagccggcaaggagggacctcctggcaaacagggattttacggtcctccagggcccaaaggcgatcccggtgccgcaggacagaaagggcaggccggagagaaaggcagagctggcatgcccggcggaccaggcaagtctgggtctatggggccagtcggtcctcccgggcctgctggcgagcgcggccacccaggcgctccaggtccttctggttccccaggcctgcccggtgtgcccggctcaatgggcgatatggttaattacgacgagataaaaaggttcattcgacaagagatcatcaaaatgttcgatgagagaatggcatactacacttcaagaatgcagtttcctatggagatggccgccgctcctggacgacccgggccccccggtaaggacggcgcaccagggcggcccggcgctccgggcagtcctggcttgcccggtcaaatcggccgagagggccggcagggactccctggggtccggggtttaccaggcacaaaaggagaaaaaggcgatattgggatcggcattgccggcgagaacggattgccagggccacccggaccccagggcccacctggatacggaaaaatgggcgccaccgggcctatgggccagcaggggatcccaggaattccaggccctccaggccccatggggcaacctgggaaggcgggccactgcaacccttccgactgcttcggtgcgatgcctatggaacagcagtatcccccaatgaaaactatgaagggacctttcgggtag

SEQ ID NO: 2643 - DNA, 4494 bp, Artificial Sequence
  Description of Artificial Sequence: Synthetic coding sequence
atggacgtgacgaaaaagaataagcgggatgggactgaagtgactgaacggattgtgactgagacagttacaacacggctgactagtctccctcctaagggggggacttctaacgggtatgccaaaaccgcttcattgggcggggggtcacgcctggagaagcagtctctgacccatggctcgagcgggtacattaacagtacggggagcacacggggtcatgccagtactagctcataccggagggctcacagcccagcatctacacttccaaattccccaggcagtacatttgaacgtaagacccatgtgacacgtcatgcatatgagggatcaagcagtggtaacagcagccctgaatatccgaggaaggagttcgccagttcctcaacaagaggtcggagtcagacgagggagtctgaaataagggttcggcttcagtccgcgtcaccttcgacccggtggactgagctggatgatgtcaaacgcttactgaaggggtcaagatcggcctccgtctcccctacacggaactcgtcgaacacattacctattccaaagaagggtacagtagagaccaagatcgttactgcttcttcccagtctgtctcgggcacctacgatgccaccatattggatgctaatttgccatcccacgtgtggtcatcaactttgcctgccggttcctcgatgggaacataccacaacaacatgaccactcagtcgtcctccctgctaaatacaaatgcttactccgcgggttcggtattcggagtacccaacaacatggcatcatgcagccctacactgcatccaggcctttcaacaagctctagtgtgtttgggatgcagaacaaccttgcgccctccttaacaacactctctcacgggacaacaacgacatctactgcctatggggtgaaaaagaatatgcctcagagcccggccgctgttaacactggggtatctaccagcgctgcttgtacaacaagcgttcagtctgacgacttgctgcacaaggattgcaagtttttaattctggaaaaagacaacacacccgctaagaaagagatggagctgctgattatgaccaaagattctgggaaagtattcaccgcttctcccgcaagtatcgccgctacatccttcagcgaggacacccttaagaaagagaaacaggccgcctataatgctgactcaggccttaaggctgaagccaatggagacctgaagactgtgtcaacgaaaggcaagacaacgacagcagatatccattcctatggctcttcgggcggagggggcagcggaggcgggggaggcgtcggcggagccggcggcggcccatggggtcccgccccagcttggtgcccctgcggcagctgttgtagctggtggaagtggctcctcggcctgttgttgacctggttgctgctcctcggtctcctgtttggactcatcgccctggccgaggaggtccgcaaactgaaagcacgggtcgacgagttggaacggatacggaggagtatcctcccttatggggatagtatggatcgaatagagaaagataggctgcaaggaatggcgcctgccgccggcgccgacttggacaagattggactgcactctgactcgcaggaagaactgtggatgttcgtcaggaagaagctcatgatggaacaggagaatgggaaccttcgtggatctccagggccaaaaggtgatatgggatcccccggaccaaagggcgaccggggctttccaggtactcctggtatcccagggcctctgggacatccaggcccacaggggccaaagggccaaaaaggctccgtaggcgatcctggaatggaaggccccatgggccagcggggccgagagggaccaatgggaccgaggggggaggccggaccacctggttccggggaaaaaggcgagcggggagccgcaggggagcccggaccccatggaccccccggggtacctggcagcgttgggccgaagggcagctccggctctcccgggccacagggaccccccgggcctgtcggcctgcagggactaaggggcgaggtcggcctgccaggagtcaaaggggacaagggcccgatggggccccccggccccaaaggggaccagggcgagaaagggccgagaggtctcactggcgagcccggaatgcggggattgcccggcgccgtgggtgagccaggagcaaagggcgccatgggccctgccggacctgatggccatcaggggccacggggcgagcaagggctcactggaatgccgggaatacgcggcccccccgggcccagcggggatccaggcaagccagggctgacagggccccaggggccccagggtctacctggtactcccggtcgccccgggattaagggggagcccggggcccccggcaaaatagtaactagcgaggggtcctctatgctcaccgtccctggccctccaggtcccccaggcgctatgggtcctccaggtccccccggtgcacctggtccagccggaccagcggggttacctggccaccaagaagtgcttaatctacagggcccacccgggccgcctggtccaaggggaccacctggcccctctatccccggccctccaggccccaggggccctccaggagaagggcttccgggccctcctgggcctcccgggagctttctgtcaaattctgaaaccttcttgagcgggcccccaggacccccaggacctccaggtcccaaaggcgatcaagggcctcccggaccacggggccaccagggcgagcagggtcttcctggattttcaacgtcgggctcaagttctttcgggctgaacttgcaaggacctcctggaccccccggaccgcagggtcctaaaggagacaagggtgacccaggggttcctggagcgttggggattcccagtgggcccagtgaagggggttcaagctctacaatgtatgtctctggtcctcccggccctccaggaccgcccggacctccaggtagcattagcagtagtggccaagagattcagcagtatatatccgaatatatgcagtcagactccatccgctcctatctctccggcgtccaggggcctccaggcccgcctggcccacccggccccgtgaccacgatcacgggcgagacgtttgattattctgagctagcctcccacgtcgtgtcttatctaagaacttctggctacggtgtctcattattttcaagcagcatctcctccgaggacattcttgccgtgcttcaacgagatgatgtgcgtcagtatctcaggcaatacttgatgggaccccgtggccctccaggaccccccggtgcctccggcgatggcagtctcctgtcactggactatgctgaattgagctctcgaattctgtcctatatgtctagctcaggaatctcaatcggactcccgggacctcccggccctcccggtctcccaggcaccagttatgaagaattgctgtcactgttacgaggatccgaattcagagggatcgtgggccccccagggccacccggccccccaggcatcccggggaacgtctggtcttctatcagcgtggaggacctgagttcctatctgcataccgccgggttgtctttcatcccaggtcccccaggaccgccgggtcccccaggccctcgagggccgcccggagttagcggtgctctggccacctatgctgccgaaaactctgatagctttcggagcgagcttatctcctatctcacctcaccagatgtccggagtttcatcgtgggtcctccaggcccccccggaccccagggccctccgggagatagccgacttctttccactgacgcttcacattccaggggttccagctcctctagccactcttcctctgtcaggcgaggttctagttactcctcttctatgtcgacggggggcggtggcgctggaagcttgggggctggaggagccttcggagaggccgcaggcgatcgggggccctatggaaccgatattggaccaggaggcggctacggcgcagcggcagagggtggaatgtacgccggaaatggagggctgctcggcgctgatttcgccggcgacctcgactacaacgaactggccgtgagagtaagcgaatctatgcagaggcagggccttctgcagggaatggcatacacagtacaggggcccccgggccagcctgggccacagggaccccctgggatcagcaaagtgttttctgcctattccaacgtcaccgcagatttaatggattttttccaaacgtatggcgcaattcaaggcccacccggccagaagggtgagatgggaacaccaggccccaagggggatcggggccctgccggtccacccggccatcctggcccccccggccctcggggtcataagggcgagaagggtgataagggggaccaggtctacgcagggcggcggagacggcggtctattgcggtgaaaccttag

SEQ ID NO: 2644 - DNA, 1254 bp, Artificial Sequence
  Description of Artificial Sequence: Synthetic coding sequence
atggatgtcaccaaaaagaacaagagggatgggaccgaggtaacggaacggatcgtgactgagaccgtgactaccaggctgacctcactacccccaaaagggggcacctccaacgggtatgccaagacagcgtcccttggtggaggcagtcgactcgagaagcagtccttgacgcatggcagctccggctacattaattctactggtagtaccagagggcatgccagcacgagttcctacaggcgagctcacagtcccgccagcacactgcctaactccccaggatccaccttcgagcgaaaaactcatgtaacacggcatgcatatgaagggtcaagctcaggcaattctagtccagagtatccaagaaaggaatttgctagctcctccacccgcggccgctcccagacacgagagagcgagattagagtacgcctgcagtccgcctccccatccacacggtggactgaactggacgatgtcaaacggctcctcaaaggatctaggtctgcctccgtaagtcctacccgaaactcatctaacaccctccccatacctaaaaagggcaccgtcgaaaccaagattgttactgcatctagccagtccgtatccgggacatacgacgctactattctagacgccaaccttccatctcacgtgtggtcatccactctgcccgccggatcgtctatgggaacgtatcataataatatgaccactcaaagctcaagcctactgaacactaatgcttattccgccggttccgtgttcggggtgcctaacaacatggccagctgttcacctacactgcacccggggctctcaacttctagtagcgtgtttggcatgcagaataacctggccccttctctgacaacactgagccacggaacaaccacgacatctaccgcatacggagtcaagaaaaacatgccacaaagtccagccgctgtgaataccggagtatcgacaagcgcggcctgcaccaccagcgtgcagtcagacgatttacttcataaagattgcaaattcctgatacttgagaaagacaacactccagccaaaaaagagatggaacttttgataatgactaaggattctggaaaggtcttcacggcctcgccagcatccattgcggccacatctttttccgaagacacgctgaagaaggaaaagcaagctgcctacaacgcggacagcggattgaaagctgaggcaaatggaaagaacaaatacgactgttgccctccttag

SEQ ID NO: 2645 - DNA, 201 bp, Artificial Sequence
  Description of Artificial Sequence: Synthetic coding sequence
tgatacggagcaattcaagggccgcccggtcagaagggtgagatgggaacccccggcccaaaaggggaccggggacctgcgggtccgcctggccacccaggccctccagggcctcgagggcacaagggtgagaaaggcgacaaaggggaccaggtgtatgccgggagacggaggcggcggtccattgccgtcaagccttag

SEQ ID NO: 2646 - DNA, 1815 bp, Artificial Sequence
  Description of Artificial Sequence: Synthetic coding sequence
atggatgttacaaagaagaataagcgggatggcactgaggttactgaaaggatagtgacggaaacggtgaccacacgcctcacatcacttccccctaaggggggcacctccaacggctacgccaagacagcctctctgggcggtggcagtagactcgaaaaacagtctctgacccatggaagcagcggctatattaatagcaccggtagtacccgtgggcatgcaagtaccagttcttatcgacgagcacattccccagcctctactttgcccaatagtccgggctccactttcgaaaggaaaacacacgtcacgcgccacgcttatgaggcgagcagcagtaccaggggtcggtctcagacacgggagagtgaaatccgggtgagattgcagtcagcctcaccttctacccgatggaccgaactggacgatgttaaaaggctgctcaagggcagtaggagcgctagtgtctctcccaccaggaattccagcaacacattgcccattccaaaaaaaggaactgtggaaactaagatcgtcaccgcaagctctcaatccgtcagcggaacttatgacgccactatcttagatgcgaatctgccgtcacacgtctggtctagcaccttacccgccgggtccagtatgggcacttatcataacaacatgacaacccagagctcctccttgctgaacaccaatgcctattctgcaggctcggtgttcggagttccaaacaacatggccagttgcagcccaactctccatcccggtctttctaccagcagtagtgtttttggtatgcagaacaacctggctccgagccttacaactctgtcccacgggaccactaccacctctaccgcttacggcgtcaaaaagaacatgcctcagagcccagcagccgtgaacacaggagtatcaacctctgctgcttgcactacctctgtgcagtcggacgatctgctccataaggattgtaagttcctgattttggagaaggataacactcccgccaaaaaggagatggaattgctaattatgacaaaggattccgggaaagtttttactgcctcacccgcaagtatagcggccactagctttagcgaggacacgctcaagaaggagaagcaggctgcgtataacgccgactcaggattaaaagcagaggcgaatggagacctgaagaccgtgtctacgaagggtaagacaactaccgccgacattcactcctacggttcatccgggggtggaggtagcggcggaggaggcggggtcggaggagccggcgggggcccatggggccctgcccccgcctggtgcccctgcgggagctgctgttcctggtggaagtggctgctgggtttgctcttaacttggcttctgcttctcggtcttctgttcgggctcatagcactagcggaggaggttaggaagctcaaggcgcgggtggatgagcttgaacgcatacgtcgatcgatcctgccctatggcgactctatggataggattgagaaggaccgcctccagggcatggcccccgcagctggcgccgaccttgataagattggtttgcacagcgacagccaggaggagctctggatgttcgttcgcaaaaagttgatgatggaacaagagaacggtaacctgcgcggaagtcctggtcctaaaggggacatggggagccccgggcccaagggagaccgcggcttcccaggtacccctggtatcccaggacccctcggtcacccaggaccccagggtcctaagggccaaaaggggagcgtcggggatccagggatggagggccctatgtag

SEQ ID NO: 2647 - DNA, 3951 bp, Artificial Sequence
  Description of Artificial Sequence: Synthetic coding sequence
atgtcttccggggacccagctcacttggggctgtgtctgtggctttggctgggggccacactcgggagggagcaggtccaggcttctggcctcctccggctggccgtgttgcctgaagacaggttgcagatgaaatggagggaaagtgagggaagcggactgggatacctggtgcaggttaagcctatggccggagatagcgaacaggaggtcatactgacaaccaaaactcccaaggctacagttggaggattgtctccttcaaaaggttacacactacaaatctttgaactgactggctccgggcgctttttactggctcggcgcgagttcgttatagaggacctcaagtctagctccttggacaggtcctcccaaaggccgctcggaagcggtgcacctgaacctactccctcccataccggctctccagaccctgaacaagcaagcgagccacaggtggccttcactccgagtcaggatccaagaacacctgctggcccacaatttaggtgcttacccccagtgccagctgacatggtgttccttgtggatgggtcctggtccatcgggcacagtcactttcagcaggtcaaggatttcctggccagtgttatcgcaccattcgaaattgggcctgacaaagtgcaggttggcttgacacagtactcaggcgatgcccagactgaatgggatttaaactccctgtccaccaaggagcaggttctggccgcagtgcgtaggctccgatacaagggtggcaatacattcactgggctggcactgacgcacgtacttgggcagaatttgcagcctgctgctggtctgagaccagaggctgcaaaagtggttattctggtgactgacgggaagtcccaggacgacgtgcacaccgcagccagggttttgaaagatttaggcgtgaatgtgttcgccgtcggtgttaaaaatgccgacgaagctgaattaaggctgctggcctccccgccgagggacataacagttcattcggtgttggattttcttcagttaggggcgctggccggcttgctgagccgacttatttgtcaacgcctccaagggggaagtccaaggcaggggcccgccgccgccccagccctcgacacactgcctgcccctacctccctggttctgagtcaggtgacatcgtcttcaattcgactgtcgtggacccctgcacctaggcatccgctaaaatacctgatcgtttggagagccagtcggggaggcacaccgagagaggtcgtcgtcgagggccctgcagctagcacagagttgcacaatctagccagccggactgagtatttggtgagcgtgttcccgatttatgaaggcggagtcggagagggcttgcgcggcctggtgactacggccccactgccaccgccacgggctctgactttggccgccgtcacccctcgcaccgtgcatctaacttggcagccctccgcaggcgcaacccattacctcgtgcgctgtagccccgcttctccaaagggagaagaggaagaacgagaggtgcaggttggaaggccagaggtgctgttggacgggctggagccaggaagagactatgaagtgtctgtccagagtctgcgcggccccgaagggagtgaggctcgagggatccgcgccagaacacctacactggctcctccacggcacctaggatttagcgatgtaagccatgatgctgctcgagtgttctgggagggggcaccaagacctgtcagattggttagggtaacctacgtcagttcggagggcggccatagcggtcaaacggaagctcccggcaatgcgacgagcgctacactcgggcctctgtcctcatccactacttatacagttcgagtcacatgcttgtaccctggcggtggcagctccaccttgacggggagagtgaccaccaaaaaggcccctagtccatcccaactttccatgaccgaactgcccggcgacgccgtgcaacttgcctgggtagccgccgccccatcaggcgtcctcgtgtatcagatcacatggactccgttaggagagggtaaggcccatgagatatcggtcccagggaacctgggaacagccgtgttacccggactaggtagacacacagagtacgatgtcactatacttgcctattatcgggacggtgccagatctgaccccgtttcacttcggtacacgccctcaacagttagccgcagcccacctagcaatctggcactcgcatccgagactccggacagtctgcaggtgtcttggacccccccactggggagagtcctacattattggctgacctacgccccagcttctggactgggacctgaaaagagtgttagtgtgcccggcgctcgcagccacgttacattgccagatctccaggccgccacaaagtatagagttttagtgtcagcaatctatgcagccgggcgcagcgaggccgtgtccgctactggccaaactgcctgtccagctctgaggccagacggcagccttcccggtttcgacctcatggtggcatttagtcttgtggagaaagcttatgcaagcataagaggggtggcgatggaacccagtgccttcggaggcacccctaccttcaccctctttaaggatgcccaacttacccgccgagtgtctgatgtgtaccctgctccccttccccccgaacataccatcgtcttccttgttcggctgctccctgagaccccaagagaggccttcgcgctgtggcagatgactgcagaggactttcagcctctgctaggagtccttctggatgccgggaaaaaatccctgacctacttccatcgggacccccgcgccgccttgcaggaggccaccttcgatccccaggaggtgagaaagatctttttcgggagctttcacaaggtgcacgtggcagtcggtcggtccaaagtcagattatacgtcgattgcagaaaggtggccgaacgtccccttggggaaatggggtcccccccagcagccggatttgtgaccctgggacggctggccaaagctcgtggtccccggagtagctccgccgcttttcagctgcagatgctccaaatagtatgtagcgatacttgggccgatgaagacagatgttgtgaactacccgcttcccgggacggagagacctgcccagcctttgtgtctgcttgctcttgttctagcgagaccccaggacccccagggcctcaaggcccgccaggactgcctggtcgaaacggcacccctggtgaacagggattccccgggcccaggggtgagcccggtccgccaggacagatgggccccgagggccccggaggacaacagggaagtccagggacacaggggcgcgccgtccagggacctgtgggtccgcctggcgtgaaaggcgaaaaaggcgaccacggcctgcctgggctgcagggacatccggggcaccaggggataccaggtagagtcggactgcaagggcccaaagggatgcgaggcctggagggtaccgccggactgccgggcccgcctggaccaagggggttccaaggaatggccggcgcccgcggcacgagcggcgaacgtggacctccgggtacagtcgggcctactggtctacctggaccaaagggggaaaggggagagaaaggcgagccccagtctctcgccacactctaccaacttgtgtcccaggcctctcacgtgtccaagtttgacagttttcatgaaaatacaagacctcctatgccaatactggagcagaagctggaacctgggaccgaaccactggggtctcccggcactcggtccaaggcattggtccccggagagtggggcaggggaggcagacatttagaaggtaggggggagccaggcgccgtgggccagatggggagccccgggcagcaaggcgctagcacacaagggctttgggaatag

SEQ ID NO: 2648 - DNA, 3855 bp, Artificial Sequence
  Description of Artificial Sequence: Synthetic coding sequence
atgtcctcaggcgatcccgcgcacttggggctgtgcctgtggctgtggttgggcgccaccctgggtagggagcaggttcaagcttctgggctcctccggcttgcggtcctccctgaagataggttgcagatgaaatggagagagtccgagggaagtgggttgggctaccttgtgcaggtcaagcctatggccggtgattcggagcaggaagttatccttacgaccaagacccctaaggcgactgttggcggtttgtctcctagtaaaggatacacattacagatctttgagttgacaggctccggccgcttcctcttggctagaagagagttcgtgatcgaggacctcaagtcttcctcactagatcggtctagccagcggccacttggctctggcgcccctgagcctacaccctctcacaccggatcaccggatccggaacaggcaagcgagccccaggtcgcctttaccccctctcaagatccaagaacacccgccggcccacagttccgatgcctccccccagtgcctgcggacatggttttccttgttgacggatcgtggtcaattggacacagccattttcagcaggtcaaggacttcctcgcctcagtgatcgctccatttgaaattggaccagataaggtacaggttgggttaacacagtacagtggcgatgctcagacggagtgggacctgaattccttgtcgaccaaagagcaggtgttagccgctgtgagacggctccgttacaaagggggcaataccttcactggtttagcactcacacacgtcttaggccagaacttgcagcctgcggcaggcctgagaccggaggctgccaaggttgtaatactcgtcaccgatggcaagtcacaggacgatgtgcacacagcagcccgggttctaaaagatctaggggtaaatgtgtttgctgttggtgtgaagaacgctgatgaagccgagctaagattactcgcctccccccctagggatatcaccgtgcatagcgtcctcgatttccttcagttgggcgcgcttgcaggattgctgtctcggctgatctgtcaaaggcttcaggggggcagtccccgacagggcccggccgcagcccctgcactcgacaccctgccagccccaactagtctagtgctgtctcaggtaacatcatcatctattaggctatcttggacccctgctcctcggcatcctctgaagtatttgattgtgtggcgagctagtcggggaggcacgccaagggaagttgtggtggagggccccgcggcttctaccgagctccacaatctggccagtcgtacagaatatctggtaagcgtttttccaatctatgaagggggagtgggtgaaggactcagggggctggtcaccactgctcccctgccaccgccgcgggctctcaccctcgcagccgttacaccaagaactgtccacctgacttggcagccgagcgcaggagccactcactatctagtgcgatgcagccctgctagtccaaagggcgaagaagaggaacgggaagtccaggtgggccgacccgaggtgcttctggatggcctggaacctggcagagactacgaggtgtctgtccagtctcttaggggtcccgagggatctgaggcgaggggaatccgcgctcgaactcctacccttgcacccccgcggcacttaggcttcagcgatgttagtcacgacgcagcacgtgtgttttgggagggcgctccgcgacccgtccgcctggttcgggtgacctatgtgtcaagcgagggcggacacagtggacaaaccgaggcgccgggcaacgcaacaagcgcaaccctgggccccctctctagttccactacatatacagtgcgggttacctgcctgtatcctggaggtgggagctccaccctgaccggccgggtcaccacaaagaaagccccgtcacctagccaattatctatgactgagttgccaggtgatgcagtccagcttgcgtgggtcgcagccgcccccagcggcgtgcttgtctaccagatcacctggaccccactgggcgaggggaaggctcacgagatcagcgtgccaggaaacctaggaacagccgtgctccctggcctggggagacacactgagtatgacgtcactatactagcatattaccgcgatggggcgcggagcgatccggtgtcactccgttacacccccagcacggtttcacggtcaccgcccagtaatttggcactcgcatcagagacccctgatagcctgcaagtaagctggactcccccactgggccgagtgctgcactattggttaacctacgcaccagcttctggtctggggcctgagaaatctgtgtccgttcccggagcacgatcccacgtcacactgcccgatcttcaggcagctactaagtaccgagtgctggtttctgcaatttatgcggccggacggagcgaagcagttagcgctacagggcagacggcttgccccgctcttagacctgacggcagcctgcctggatttgacctgatggtcgcattctccctcgttgaaaaagcctacgcatctatcagaggagttgctatggagccaagtgcctttggaggcacgccaacatttacccttttcaaggacgctcaactgacccgcagagtctccgatgtttacccagctccacttccccccgagcataccatagttttccttgtccgcttgctgcctgagaccccccgtgaggcttttgccctgtggcagatgaccgccgaggactttcagcccttgcttggcgtattactggacgccggcaagaagagcctcacatatttccacagagacccccgggcagcgctccaggaggctactttcgacccacaggaggtacgaaagattttcttcggaagtttccacaaggttcacgtggctgtgggtcgttccaaagtaagactttatgttgactgcaggaaagtggccgagaggccgttaggagaaatgggcagcccgcccgccgcaggcttcgtcacgctgggacggctggccaaagcaaggggaccgcggagctcctctgcagcattccagttgcagatgctgcagattgtgtgctcggacacgtgggctgacgaggatcgctgttgcgaactgccagcaagtcgagatggcgaaacctgcccagcctttgtatcagcatgcagctgctctagtgagacgcctggtcctccaggtcctcaggggcctcccggcctaccaggccgcaacgggacacccggggagcaggggtttcctggccccaggggacctcccggagtcaagggcgagaagggcgaccacggtttacccgggctgcaggggcatcctggtcatcaaggaatccctggaagggtgggactgcaaggtccaaagggaatgcgtggcctggagggcacagcaggactgccgggaccaccaggacctcggggttttcagggcatggccggagcaagaggcacatccggcgagcgtggtcccccagggacggttggtcctacaggcctcccgggtccaaaaggtgagcgtggagaaaagggggagccacagagccttgcaaccctctaccagctcgtatctcaggctagccacgtgtcgaagtttgacagtttccacgagaatactagaccccccatgcctatcctcgagcagaagctcgagcccggtactgagcctctgggaagcccgggtacccgaagtaaagccctggtccccggcgagtgggggaggggcggtcgtcacctcgagggacggggcgagcccggtgctgtggggcagatgggatcaccaggccagcagggagccagcactcagggtctgtgggagtag

SEQ ID NO: 2649 - DNA, 3894 bp, Artificial Sequence
  Description of Artificial Sequence: Synthetic coding sequence
atgtcgtcgggggatcccgcacacctagggctctgcctatggctgtggctgggggctacccttggacgcgaacaggtccaggcgtccggtttgttgcgcctcgcagtgctcccagaggaccgcttacaaatgaagtggcgagaatctgaggggtccggcctggggtacctggtccaggtcaaacccatggcaggggatagtgagcaggaagtgattctgacaaccaaaacccctaaagccacggtgggaggcctgtcacccagtaagggatacactctgcagatcttcgagctgaccgggagcggacggttcctcttagcacggagagagtttgtcattgaggatttaaagtcttcatctctggaccgcagctctcagcgccctcttgggtccggtgcccctgaacctaccccatcacataccggttccccagaccctgagcaggccagcgagccacaggtcgcatttacacctagtcaggacccacggacacctggcggatcagagtggcgtgaaaccggaccccagttccggtgcttgccgcctgtgcccgctgatatggtttttttggtggatggatcctggtctatcggacattcacactttcagcaggtgaaagatttcctagcctctgtcatcgccccttttgaaatcggccctgacaaggtgcaggtggggctgacgcagtatagcggggatgcgcagacagaatgggacctgaactccctcagcacaaaggaacaggttcttgcggctgtgaggcgactcagatacaaagggggcaacactttcactggcctggccctgacacacgtacttggccaaaatctccagccagccgcaggacttaggcctgaggcggccaaagtagtcatcctggtcacggatgggaaaagtcaagatgacgtgcacaccgccgcacgtgtccttaaagacctcggcgtgaatgtctttgccgtcggagtgaagaacgccgacgaggcagagctgcgcctgttggcatccccccccagggacattacagtccattccgttcttgattttttacagctcggcgcgctggccggccttctgtcccgcttgatttgccagcgcctacagggtgggtcaccaaggcagggaccagctgccgcccccgcattggacacattgccagcgcccacttccctggtgctcagccaggttacctcaagttccattagattgtcatggactcccgctccgcggcaccctctgaaatatcttatcgtttggcgcgcttcacgtggcgggacccccagggaggtcgtcgttgaaggcccggcagcatcaacggagctgcataacctggcttcacgaacggaatacttggtctctgtcttcccaatatatgaagggggggtgggagaagggctcagaggcctggtgaccaccgccccacttccgcccccacgtgctctgacactggctgccgtaacgccaaggaccgtgcacctgacatggcagccttctgcaggcgccacacactacctggttaggtgcagcccagcatcccctaaaggtgaggaagaggaacgagaagtccaagtaggtcgcccggaggtactcttggacggactggaaccagggcgggattacgaggtcagtgtgcaatcactacgggggcctgaggggagcgaagctaggggcatacgggctaggacccccactcttgctcccccgaggcacctgggcttttcagatgtgtctcacgacgccgcccgagtattctgggaaggagctccaaggcctgtccggttagtgagagtcacttatgtatcatccgaaggcgggcacagcgggcaaacagaggcgcccggcaatgccacgtccgccaccctaggtcccctgtcttccagtacaacatacactgtgagagttacatgtctttaccccggcgggggaagctcgaccctgacaggcagggtgacaaccaagaaggcaccatctccttcccaactaagcatgacagagttgccgggagatgccgtgcagctggcttgggtggccgctgctccaagtggggtcctcgtctatcagataacatggacacccctaggggaaggcaaagcccatgagattagtgttccaggaaatctggggacagcagtgctgcccggcctggggagacacacagagtacgacgtcacaatactggcttactatagagatggggcccgtagtgaccctgtgtctctgaggtacaccccttccacagtttcacgcagtccacctagtaacctagctttagcctctgagacccccgatagcctgcaagtaagctggaccccaccacttggacgtgtgctgcactactggctcacgtacgcccccgcttcgggactaggacctgaaaagagcgtgtccgtacccggtgctcgcagtcatgtcacattgccagatctgcaggcagccactaagtacagagttttggttagcgctatatacgcagcgggacgtagcgaggccgtctcggccactggtcaaacagcgtgtcccgcactgcgacccgacggctccctccccggcttcgacctcatggtggccttttctctggtagagaaagcgtacgccagtattcgcggcgtggcaatggaaccaagtgccttcggtggcacaccgaccttcacgctattcaaagacgcacagcttacccgtcgggtttctgacgtgtacccagctccactcccacccgagcacacaatcgtgttcctcgttcgcctgttgcccgagacaccaagggaagcctttgccctgtggcaaatgactgctgaggatttccagcctttactgggcgttctgcttgatgcgggcaaaaaaagcctcacttacttccaccgggaccctcgagcggcattacaggaagctacgtttgatccgcaggaggtgcggaagattttcttcgggagctttcacaaagtacacgtcgcagtcgggcgctccaaagttagactgtacgtagattgtcgcaaggtcgccgagcgcccattgggggaaatgggatccccacccgccgccgggttcgttaccctcggacgcttagccaaagctagggggccaaggtcttcttccgcggcatttcaactccaaatgttgcagattgtgtgctcagacacatgggctgacgaggaccggtgctgtgaactgcctgccagtcgggatggcgaaacttgtccagcctttgtttctgcttgcagctgtagttccgaaactccaggcccccctggtcctcaagggccccctgggctgcctggcaggaacggaacacccggcgagcaggggtttccagggccccgaggtccacccggggtgaagggagagaagggagaccacgggcttcccggtctgcagggccatcccggccatcaggggattccagggcgagttggactccagggccccaagggcatgaggggacttgagggaaccgcagggttgccgggtcccccgggaccccgggggttccaaggtatggcgggggccaggggaaccagcggtgaaagaggaccacccggcactgtggggccaaccggactgcccgggcccaaaggggaaaggggggaaaagggtgaaccccaatccctggcgaccctatatcaattagtttcccaggcttgcgagagcgccatccagacgcacgtgtccaagttcgacagcttccacgaaaatactaggcccccaatgcctatcttagaacaaaaactggaaccaggcaccgaacctctgggttcacccgggacacggtccaaagcacttgttcccggagagtggggcaggggagggcgccacttggaggggcgcggggagccaggggccgtcggacagatggggtctcccggacagcagggtgccagcacacaaggcctgtgggagtag

SEQ ID NO: 2650 - DNA, 3894 bp, Artificial Sequence
  Description of Artificial Sequence: Synthetic coding sequence
atgtcctctggggatcctgctcacctgggcctctgcctgtggctctggctgggtgcaactctgggcagagaacaggtccaggcaagcggactccttaggctggctgttctaccggaggataggttacagatgaaatggagagagtcagaggggtccgggctcggatacttggtgcaggtgaagccaatggctggcgactccgagcaagaggtgatcctaacaactaagacacctaaggccactgtcggtgggctgagcccgtcgaaaggttacactctgcagatttttgaactgacaggatctggtaggtttttgctggcacggcgggagtttgttatagaagacctcaaatctagttctttggatcgttcgtctcaaaggccccttggctctggtgcacccgagcctacgccctctcacaccggctcacccgaccccgagcaggcatccgaaccccaggttgcatttacgccatcgcaagacccccgcacaccaggtggaagcgaatggcgggagactggcccccagtttcgttgtcttccacctgtgccagccgatatggtctttttggtcgatgggagctggagtatcgggcactcccactttcagcaagtgaaagatttcttggcctccgtgatcgcgcccttcgaaatcggcccggacaaggtgcaggttgggctgacgcagtacagcggcgatgcacagacagaatgggatctgaactcattgagcaccaaggaacaggtcctggcggcagtccgccgcctgcgctataagggcggaaatactttcaccgggcttgccctaacccatgttctgggccagaatctgcagcccgctgcgggtttaaggcctgaagcagcaaaagtggtcattctggtgacagatggaaagtctcaagacgacgttcatactgcggcgagggtgctcaaggatctcggtgtgaacgtatttgccgtgggagtgaagaacgcagacgaagctgagcttagactcttggcatcgccccctagggatatcaccgtgcacagtgtgcttgatttcctccagctgggggcgctggcaggtttgctgtcccgcctcatatgccaaagactgcagggcggctcaccacgccaaggcccagctgccgcacccgcgctcgacactttgccggcacctaccagtctggtgctatcacaggtgacatcaagttccatcaggctgagttggacacctgcaccccgacatccgctcaagtatcttatcgtgtggcgcgccagccgcggagggactccaagggaagtggtcgttgagggacctgccgcctccacagaactgcacaacctcgcgagtagaactgagtatcttgtgagtgtctttcctatttatgagggcggcgtgggcgaagggcttcggggtcttgtgactacagctcccttgcctcctcccagggcactcaccctagcagccgtgacaccaagaaccgtccacttgacttggcagccaagcgccggagccacccattatcttgtgagatgttccccagcaagccctaagggagaggaagaagaacgggaggtgcaggtcggaaggcccgaagtgctactcgacggcctggagcccggtagggactatgaagtctccgtgcaaagtcttcggggtcctgagggctcagaagcaagggggatccgggcccggaccccaaccctggcgcccccccgacacctgggcttcagcgacgtgagtcacgacgccgcaagagtgttttgggaaggagccccacgccccgtgaggcttgtgcgagtgacatacgtcagttcagagggaggccatagcggccagactgaagcccccggtaatgccaccagcgctaccctgggccctctgagcagtagtaccacatatacagtgcgagtgacatgcctgtatcccggtggcgggtcttctaccctaaccggcagagtgacaactaaaaaagcgcccagtccctctcagctctcgatgactgagctccccggggacgccgtccaactggcctgggtcgccgccgctcccagtggcgtgcttgtgtaccaaatcacttggactcctctgggggagggaaaggcgcatgagatttctgtacccgggaacctgggcaccgctgttctgccaggactcggtaggcacacagaatacgacgtgacgatactcgcttactacagagatggggctagaagcgaccccgtttcgctacgatacaccccttctactgtgtctagaagtcccccatcgaatctggcacttgcaagcgaaaccccagatagcctgcaggtgtcttggacaccaccccttgggcgcgtcttgcactactggctgacctacgcacccgcttcgggattaggcccggaaaaaagtgtgtcggtgcctggagcccgcagccacgttacactgcctgacttacaggcagcaacaaaatatcgagtgctcgtctctgcgatctacgctgcaggcaggtctgaggctgtgagtgctacagggcaaactgcctgcccagccctgcggcccgatgggtccctccccggattcgacctcatggtggcattcagcctcgtcgagaaggcgtacgccagtatcaggggagtggctatggaaccttccgcctttggtggaactcccacctttacactgttcaaagacgctcagctaacacgccgggtgagcgacgtctatcccgccccactacctcccgagcacacaatcgtattcctggtgcgattgctcccagaaactccgagagaagcttttgctctctggcagatgaccgctgaagattttcagcctctgttgggtgtgctgcttgatgctggtaaaaaaagtttgacctacttccaccgggaccctcgggctgctttgcaggaggcaacctttgacccgcaggaagtgcgcaagatctttttcggctctttccataaagtacatgttgctgtggggcgatctaaggtccgcctctacgttgactgcaggaaagtagccgaaagaccccttggtgaaatgggttcccccccggccgcgggttttgtgactctggggcggctcgccaaggcccggggcccccgaagtagctcggcagccttccaattgcagatgctccagatagtgtgtagcgacacctgggcggatgaagaccgctgttgcgaattacctgctagtagggacggcgagacttgcccggctttcgtgagcgcctgctcatgttcctctgaaacccctggcccccccggcccccagggacctccgggcctgccaggcaggaacggaacccctggggagcagggctttcctggaccaaggggcccccccggcgtcaagggagaaaagggtgaccacggtcttcctgggctgcagggccacccaggccatcaaggaattcccggccgggttgggctgcaaggtccaaaggggatgcggggtttggaggggaccgccggacttcccggtcctcctggtcctcgcggttttcagggcatggccggagcccgaggtacctccggcgaaagaggtccccctggtacggtaggaccaacaggcctgcccgggccaaagggggagagaggcgagaaaggtgagcctcagagcctggcgaccctgtatcaactggtgtcacaggcctgcgaatcagcaatacagacccatgtgtccaagtttgactctttccacgagaacacgcggccccctatgcctatcctagagcagaagctcgagccgggcaccgagccattaggctccccaggtactcgctctaaggcactggtacccggtgaatggggacgcgggggacggcatcttgagggtcggggcgaacctggagcggtaggacagatgggatctcccgggcagcaaggtgcatctacgcagggcttatgggaatag

SEQ ID NO: 2651 - DNA, 2874 bp, Artificial Sequence
  Description of Artificial Sequence: Synthetic coding sequence
atggctcactacattacattcctgtgtatggtgctggtattactattacagaactcggtgctggcagaggacggagaagttagatctagttgcaggaccgcacccaccgacctggtcttcattctcgatggctcttactcggtgggacctgaaaacttcgagattgtaaagaaatggctcgtcaatatcacaaagaatttcgacatcgggcctaagttcatccaagttggagtagtgcagtattccgactaccccgtgttggagatccccttagggagctatgatagtggcgagcacctgaccgcggccgtggagtcgatcctgtatctcggggggaataccaaaactggcaaggccatccagttcgccctagactacctgtttgccaagtcttcgcgctttctgacaaagatagccgtcgtattgaccgacggaaagtctcaggacgatgttaaggacgccgcacaggccgcacgagacagcaagattaccctgttcgcaatcggagtcggaagcgagactgaagacgcagaattacgagctatagccaataaaccatcttctacctacgtgttctacgtggaggactatatagctatcagcaagatccgcgaggtgatgaagcaaaagctttgtgaagagtcagtgtgcccaactagaattcccgtcgcagcacgggatgagagaggattcgacatcttgctgggactcgacgttaataaaaaggtgaagaagcgcatccaactttcgcccaagaagatcaagggctacgaggtgacgtccaaagtcgacctatccgaactgaccagcaatgtgtttcccgaggggttaccccccagctatgttttcgtgtcaacacaaaggttcaaggtaaaaaagatttgggacctttggcgaatactgacgattgatggccgcccacagatcgctgtaacactgaacggcgtagataagattctgctgtttaccaccacttccgttatcaatggctctcaggtggtgactttcgctaacccccaagtcaaaacactgttcgatgagggatggcaccaaatacgcctcctggtgacagaacaggacgttacattgtacattgacgaccagcaaatcgagaataaaccactgcatcctgtgctgggcatcttgattaacggacaaactcagattggcaaatattcagggaaggaggagaccgtgcagtttgacgtgcagaaactgcgaatctattgcgatcccgaacagaacaatagggagaccgcctgtgagatccctggatttaacggagaatgcttgaatggaccaagcgacgtcggctctacacctgcaccttgtatatgcccacccggtaagcccggcctccagggtcccaagggagatcctggattgcctgggaatccaggctaccctgggcagccaggacaggatggaaaaccgggctaccagggcatagctggcaccccaggggtccccggcagccccggaatacaaggtgcgaggggtctgcccgggtataagggcgagcctggccgggatggtgacaaaggcgataggggcctcccggggtttcctggactgcatgggatgcccggtagcaaaggtgaaatgggagcaaaaggggataaaggcagtccgggcttttatggaaagaaaggggccaagggggagaagggcaacgctgggttcccaggacttccagggcctgcgggtgagcctggtaggcacggtaaagatggtctgatggggtcccccggctttaaaggcgaggcaggaagccccggcgcgcctggccaagacgggacccgaggagaacctggaattcctggctttcctggtaatcgcgggctgatggggcagaagggggaaatcggacctcccggccagcaggggaagaagggagcacccggaatgcccggcctgatgggatctaacggcagccctggccagccaggcacacccggtagtaagggatccaagggggagccgggcatacagggaatgcccggcgcatctggtctgaaaggagaaccaggtgctacggggtcccctggagaacctgggtacatgggtctgcctgggatccagggtaaaaagggggataaggggaatcaaggcgagaagggcattcagggacagaagggcgaaaatggacggcaaggaattccaggacagcagggtatccagggtcaccacggggctaaaggggagagaggcgaaaagggggagcctggtgtgcggggggctatcggttccaaaggggagagcggggttgatggcctcatgggacccgccggtcccaaaggacaacccggggatcccggtccacaggggccacctggcctagacgggaagccaggacgggaattcagtgaacagttcatacgccaggtatgtacagatgtgattagggcccaattacccgttctcctgcaatctggcagaatccgtaattgtgatcactgcttgtcccagcacggatctcctggaattcctggtccacctggtcccattggtcctgagggcccacgggggttgccggggctgcctggacgtgatggggtgcccggtttggtgggcgtgcctgggaggcctggagtccggggcctgaagggactacccggaaggaacggggaaaaaggctcccaggggtttggttatcccggtgagcaggggcccccaggaccgcccgggcctgagggaccccctgggatctctaaggaaggaccgccaggcgacccaggcttacccggcaaagacggtgaccatggcaaaccgggcatccagggccagccaggcccgcctggaatatgcgacccatctctgtgcttctccgtcatcgctagacgcgaccctttcagaaagggccctaattattag

SEQ ID NO: 2652 - DNA, 972 bp, Artificial Sequence
  Description of Artificial Sequence: Synthetic coding sequence
atgattgcgtcaggcatccccggattcccagggaatagagggttgatgggccaaaagggggagattggtccacccggccagcagggcaaaaagggggcccccggcatgccagggctgatgggttcaaatggttccccggggcagcccggcacaccaggcagtaaggggagcaaaggcgaaccaggaatccaggggatgcccggtgcctcaggattgaaaggagaacccggcgccactggctcccccggtgagcccggttatatggggctccccggaatccaaggtaagaagggggataaggggaatcagggcgagaaggggatccaggggcagaaaggtgaaaacggacggcagggaatccccgggcagcagggtatccagggtcatcacggcgcgaagggagaaaggggggaaaagggcgagccaggcgtgcgaggcgcaattgggtccaagggcgaaagcggggttgatggactgatgggaccagccgggccgaaggggcagccaggggatccgggacctcaaggtccccccggcctcgatgggaaaccaggccgagagttttccgagcaatttatccgccaggtttgcaccgacgtgatccgcggccctgagggccctcgcggtctgcctggtctgcctggcagagacggcgtgcctggtctcgtgggggtccccgggaggcccggggtaaggggactcaaggggctgccaggtcgcaatggcgagaaggggagccaggggtttggctatcccggcgagcagggaccacccggaccacctggcccggaaggccctcccgggatttccaaggaggggccccccggagaccctggcctgccaggcaaagatggcgatcacggaaaaccgggcatccagggacagcctggcccccctgggatttgtgatcctagcttgtgttttagcgtcatagccagacgggatccctttcggaagggcccaaactattag

SEQ ID NO: 2653 - DNA, 2865 bp, Artificial Sequence
  Description of Artificial Sequence: Synthetic coding sequence
atggcgcactacatcaccttcctgtgtatggtgctggtgctccttctgcaaaacagcgtattggcagaggatggggaagtgagatctagttgtcggactgcacccactgatctcgtcttcatccttgatggtagctactccgtgggcccagaaaactttgagatcgtgaaaaaatggctggttaatatcaccaagaacttcgacataggaccgaagttcatccaggtgggcgtggtacagtactcggactaccctgtcctcgagataccactcgggtcatacgacagcggtgaacacctgaccgccgccgttgaatccatcttgtacctgggcggaaacaccaagactggcaaagcaatccagttcgccttggactatctattcgccaagagcagcagattcctaaccaagattgccgtggtgttaacagatggaaaatctcaagacgacgtgaaggacgccgcacaggctgcaagagatagcaagatcacattattcgcgatcggcgttggaagcgagacagaagacgcagagctacgtgcaattgcgaacaaaccatctagtacatacgtattctatgtggaggattacatcgccatatcgaaaatacgcgaggtcatgaagcagaagctttgcgaggagtccgtctgcccaacgcgcatccccgttgcagctcgtgatgagcgaggcttcgatattctcctcggcctcgacgtgaataaaaaggtgaagaagcgaattcagctgagtccaaaaaagattaaaggttatgaagtcacatccaaagtagacctttcagagctaacaagtaacgtgtttccggagggcctgcctcccagttatgttttcgttagcactcaacggtttaaagtgaagaagatctgggacctgtggcgcatactgaccattgatggccgcccccagattgccgttactctgaacggcgttgacaaaattctgctgtttaccactactagcgttattaatggatctcaggtggtcaccttcgccaacccacaagtgaagactttattcgacgagggctggcatcagatccgtctgctagtcaccgaacaggatgtgactctttacatagacgatcaacagatcgaaaacaaacctctgcatcccgtgttgggcattttgattaatggccagacccaaatcgggaaatactccggtaaggaggaaacagtgcagttcgacgtgcagaaacttagaatttactgcgaccccgaacaaaacaaccgggaaaccgcgtgcgaaatcccagggttctgcctgaacggtccatctgatgtgggaagcacacctgctccatgcatttgtccccccggaaagcctggtctgcaggggccaaaaggcgaccccggcctgccaggcaaccctggatacccaggacagccaggtcaggacggcaaaccgggataccagggcatagcaggtacaccaggcgtgcctggctccccaggcatccagggcgccaggggtctgcctggatacaaaggtgagccggggcgcgatggtgacaagggagacaggggcctcccaggctttccgggtctgcatggtatgccggggtctaagggcgagatgggcgccaaaggcgataaaggttctccagggttttacggaaaaaagggtgccaaaggcgaaaaagggaacgctggctttccaggtctgcccggccctgccggcgaaccaggccggcacggaaaggacggcctgatggggtcccctggattcaaaggggaggcaggctcacccggagcccctggacaggatggtactaggggagagcccggtattccaggcttcccgggcaatcggggccttatggggcagaagggagaaatcggtccacctgggcaacagggcaaaaagggagcaccggggatgcccgggctgatgggaagtaacggcagtcctgggcagcccggaactcccggcagcaagggttctaaaggcgaacctggtattcagggaatgccaggcgcgagcggcctgaaaggagagccaggagcgacagggagcccaggtgagcccgggtatatgggactcccaggaattcagggcaagaaaggcgataaaggaaaccaaggcgaaaagggcatccaaggacaaaagggggagaacggtaggcaaggcatccctggtcagcaagggatccagggccaccatggagcgaagggcgagcgcggagagaaaggggaacctggcgtccgaggggccatcggttccaagggcgaaagcggcgttgatggacttatggggcccgctggcccgaaagggcaacccggagaccccggtccacagggtcccccaggactggacggcaaacccggacgagaattctccgagcagttcattcgccaagtgtgtactgatgtgattagggcccagctgcctgttctgctgcagagcggcaggatcaggaattgcgaccattgtttatcccaacatggcagccctggaattccggggccgcctggacctatcggacccgaaggacccaggggtctgcccggcctccctgggagggacggagtgcctggcctcgtgggagtgccaggacggcctggcgtgagggggcttaagggactgcccggaagaaacggtgaaaagggatctcagggattcgggtaccccggagaacaaggtcccccgggtccccctggcccagaaggacctccaggcataagcaaggagggtccacctggggacccaggactccctggaaaggatggagaccacggcaagcctggaatacagggccaacccggaccccccggaatttgcgatccatctctgtgcttctccgtaatagcgcgaagggaccccttccgcaagggccccaattactag

SEQ ID NO: 2654 - DNA, 411 bp, Artificial Sequence
  Description of Artificial Sequence: Synthetic coding sequence
atggctcactacattacttttctttgtatggtcttggtcttactgctgcaaaacagtgtgcttgctgaggacggagaggttcgcagctcttgcaggactgcaccaaccgacttagtctttatcctagatggatcctattcagtggggcccgagaacttcgaaatagtgaaaaagtggctggtgaacattacgaaaaatttcgacataggtcccaaattcattcaggtgggagttgtccaatactctgattacccagtactggaaatcccactcggctcgtacgactccggcgaacacttgactgcagcagttgagtctatcctgtacctcggcggaaacactaaaacaggtaaagcaattcagtttgcactcgactacctgttcgccaagtcatcacgcttcctgacgtag

SEQ ID NO: 2655 - DNA, 2865 bp, Artificial Sequence
  Description of Artificial Sequence: Synthetic coding sequence
atggctcactatataacatttctgtgcatggtgttagtgctactgctgcagaactcggtcttagctgaggacggcgaagtgagatcctcttgccgcaccgccccaacggacctggtcttcattttagatggttcttactccgtgggcccagaaaacttcgaaattgttaagaagtggctggtgaatatcacaaagaactttgacattggtccgaagttcattcaggttggcgtggtgcagtattccgactacccagttctggaaattccactggggagctacgatagcggagagcacttgactgccgccgttgaaagcatcttgtaccttggtgggaacacaaagaccggcaaagccattcagttcgccctcgactacctattcgccaagagcagtaggtttcttacaaagatcgcagttgtgctgacagacggcaaatctcaggatgacgtgaaagacgccgctcaggctgccagggactcaaagattacactgttcgctatcggcgtgggaagcgaaactgaggatgctgaacttcgagcgattgcaaataagccatcatcgacatacgtgttctacgtcgaagactatatcgctatttcaaagattagggaagttatgaaacagaaactgtgcgaagagtcagtttgccctacgagaatccctgtggcagcccgggacgagaggggattcgacattttgctgggtctggatgtaaacaaaaaagttaagaaacggatccagctgagcccaaagaagatcaaaggatacgaagtcacatccaaagtggacctctccgagttgacttctaatgtcttccctgaaggtttaccccctagctacgtgttcgtctctacccagaggttcaaggtaaaaaagatttgggatctttggcgaatcctcactatcgacggacgtccccagattgcagtgaccttgaatggcgtggacaagattcttcttttcacaaccacctccgtgattaacggttcccaggttgtgaccttcgccaacccccaagtgaaaacactgttcgatgagggatggcaccagattcgcctgctagtgaccgagcaggatgtcactctctacatcgatgaccagcagatagaaaacaagccgctccacccagtgctaggcatactaattaacggccagacgcaaatcggtaagtactctggcaaggaggaaaccgtgcagttcgatgtacagaaacttagaatctactgtgaccccgagcagaataaccgagagaccgcatgtgagatcccaggattctgcctaaatggcccctccgatgtaggttcaaccccagccccctgcatatgcccacctggaaagcctggcctccaaggacccaaaggcgatcctgggctgcccgggaatcctggatacccaggacaacctggtcaggatggtaaaccaggctatcagggcatcgctggcacgcccggcgtgccaggaagtcccgggatccagggcgcccgcggactcccgggatataagggggagcctggcagagacggcgacaagggagacagggggctgcccggctttcctggtctgcacggtatgccaggaagcaagggagaaatgggggcgaagggtgacaaaggcagccccggattttatggcaagaaaggggccaagggggaaaaggggaatgccggcttcccaggcctacccgggccggcgggggaacctggcaggcacggaaaagatggtctgatgggcagtccggggttcaagggcgaggctggcagcccaggggcccccgggcaggacggaactagaggcgagcctgggatcccaggtttcccaggcaatagggggcttatgggccagaaaggggagattggccctccgggccagcagggaaaaaagggcgccccgggaatgccaggtttgatgggttcgaatggatcccctgggcagcccggaacacccggcagcaaagggtccaaaggggagccagggattcaaggcatgccaggtgctagcgggttgaaaggtgaaccaggagctacagggagcccaggggaacccggatacatgggtctccccgggattcagggtaagaagggggataagggcaatcagggggaaaaagggatccagggtcagaaaggcgagaacggtaggcagggcatccccggccaacagggtatacagggacatcatggcgcgaagggggagcgcggggagaagggggaacccggtgtgagaggcgctatcgggtccaagggcgaaagcggggttgacggactgatggggccggccggacccaagggtcaacctggggacccaggcccccaggggccgcctggcctcgacggaaagccaggccgcgaattctcggaacagtttataaggcaagtgtgcactgacgtgattagagcgcagcttcccgtgctgctccagtccgggcgcattagaaattgcgatcattgcctcagccagcatggcagtccagggatacccggaccacccggtcccatagggccagagggcccccggggcttacctgggctccccggccgtgacggcgtgccaggacttgtcggagtgcccggaaggccaggagtgcgcggtctgaagggccttcctggacggaatggcgagaaaggatcacaggggttcggctacccgggggaacagggaccacccggtccccccggcccagaagggccacctgggattagcaaagaaggtccacccggtgatccaggattgcctggcaaggatggcgatcacggaaagcctgggattcagggtcagcccgggccacccggcatttgcgaccccagcctatgcttctccgtgatcgccaggagagacccattccgtaaggggccaaattattag

SEQ ID NO: 2656 - DNA, 2874 bp, Artificial Sequence
  Description of Artificial Sequence: Synthetic coding sequence
atggcacactacattaccttcttgtgtatggtgttggtactgctcctgcaaaacagtgttctggctgaggatggagaggtacgcagttcatgtaggacagctccaacagaccttgtgttcattctggatgggtcctactcagtcggtcccgaaaattttgagattgttaagaagtggttggtcaacatcacaaaaaacttcgatatcggccctaagttcatccaggttggagttgtgcagtactcagactaccccgtcctcgaaataccattaggatcatacgactccggagaacacctaacggcggccgtagagagtatcctatatctcggggggaacacgaagactgggaaggcaattcagtttgcactcgactacctattcgccaagagctcgagattcttgaccaaaattgcagtcgtcctcacagatggaaagtcacaggatgacgtgaaggatgctgcccaagctgctcgggatagcaagatcactctcttcgcgatcggggtcgggtcagagactgaggacgcagagctacgcgccatagccaacaagccgagctcaacttacgtgttctatgtcgaggattatattgccattagcaagattcgagaagtgatgaaacaaaagctgtgcgaagagtctgtgtgtccaacaagaattcctgtggccgctcgcgacgagaggggcttcgatatacttctcggcttagacgtgaataaaaaagtgaaaaaacgcattcaactctcacctaaaaagattaaaggctacgaagttacgagcaaggttgacctttccgagctgacatctaacgtatttcccgagggcctccctccaagttacgtgtttgtgtctacacagaggttcaaggtgaaaaagatatgggacctatggcgtatacttaccatcgacggccgcccgcagatcgccgtgaccttgaatggcgtggacaagatccttctgttcactaccacttctgttataaacggttctcaggtcgtcacatttgccaatccacaggtcaagactctgtttgacgaaggatggcaccagatccggctgttggtaaccgaacaggacgtgaccttatacatcgatgatcagcagatagaaaacaagccgctacaccctgttctggggatcctaattaatgggcagacccaaatcgggaaatactcaggcaaagaagaaacagtccagtttgacgtacaaaagttacggatttactgtgacccagagcagaataaccgtgagactgcatgtgaaatccctggattcgtgatggaatgtctgaacgggccaagtgatgtcgggtcaactcccgccccctgcatctgcccacccggaaaaccgggactacagggacctaagggcgatcccggcttaccaggcaaccccggttatcctggccagcctgggcaggatggtaaaccagggtatcaaggtattgccggtacacccggagtgcctggctcacctggtatccaaggagcccgagggctgcctggttataagggcgagcccggcagagacggagataaaggagatagaggccttcccgggttccccggacttcatggcatgcccggctctaaaggtgaaatgggggcaaaaggcgacaaaggaagcccaggcttttatggcaagaaaggcgcaaaaggggaaaaaggtaatgccgggtttcctggcctgcctggtccagccggagagcctgggcggcacgggaaagacggccttatgggatctcctggatttaaaggtgaggccggcagtccaggcgcaccgggccaggacggaacacgcggggaaccaggcatccccggcttccccggaaatagagggctcatgggacagaaaggcgagatcgggccccctggacaacagggaaagaagggtgcacccggtatgccggggctgatgggtagtaatggctccccaggtcagcccggtacgcctgggagcaaaggaagtaaaggggagcccggcatccagggcatgcccggcgcctccggcctgaagggagagcctggagcaacaggaagcccaggggaacctgggtacatggggttgccaggcatccaagggaagaagggagacaaaggaaaccagggagaaaagggaatccagggccagaagggggaaaatggcaggcagggcatccctggtcagcagggcatacaaggacaccatggcgctaaaggagagcggggtgaaaagggagagcctggagttagaggtgcaatcggctctaaaggcgagtcaggggtggatggtctgatgggtcccgcaggccccaaggggcagcccggtgaccctggccctcaagggcctcccggactcgatggtaagcccggcagagagttcagtgagcagtttatccggcaggtgtgtaccgatgttatccgcgcccagctgcctgtcctcttgcagtccggtagaattcgtaattgcgaccactgcctcagtcagcatggctcccctgggatacccggccccccaggccccatcggacccgaagggccgcggggcctgcccgggctgccaggaagggatggagtgcccgggctggtgggggtaccaggccggcctggcgtcaggggccttaaaggcctgcccggaaggaatggggaaaaaggatcgcaggggttcgggtacccaggggaacagggcccccccgggcctcccggtcctgaaggccctcccggaatctctaaagagggccctccaggcgacccggggctgccagggaaagacggtgaccatggtaaaccaggaatacaggggcaacccggcccaccaggcatctgtgatccctccctgtgcttttccgtgatcgctagacgcgacccatttcggaaaggccccaattattag

SEQ ID NO: 2657 - DNA, 4881 bp, Artificial Sequence
  Description of Artificial Sequence: Synthetic coding sequence
atggccggtctccggggcaatgctgtggccggcctgctctggatgctgctgctgtggtccgggggaggaggttgtcaagcccaaagggcaggttgcaagagcgtgcactatgacctggtcttcctgctggatacctcgagctccgtgggaaaagaggactttgagaaggttagacagtgggtggccaacttggtcgataccttcgaggtcggtcctgatcgtacccgagtgggggtggtgaggtatagcgatcggccgacgacagccttcgagttagggctctttggctcacaggaagaagtgaaggcagccgcgcggcggttggcctaccatggaggcaatacgaacacgggggacgcacttcggtacattaccgccaggagcttctctccgcatgccgggggtcgcccccgagacagagcctacaagcaggtcgctattcttcttacagacggacggagccaagatcttgtactggatgctgcggccgctgcccaccgcgctggcattcggattttcgcggttggagtgggtgaagcccttaaggaagagctggaggaaatagcttcagagcctaaaagcgctcacgtcttccacgtttctgatttcaacgcgattgacaaaattcgcggcaagctgcgcagacgtctgtgcgagaatgttctctgcccgtcagtgcgagtcgaaggggacagatttaagcacaccaatggcgggaccaaggagatcactggcttcgaccttatggatctctttagcgtgaaggagatattgggcaaaagggagaatggcgcccagtcctcctatgttaggatggggagttttcccgtagtgcaaagtacggaggacgtcttcccgcaggggctccctgatgaatatgccttcgttacaactttccgatttagaaagacctcacgcaaagaggactggtacatctggcaggttattgaccagtattcaattccccaggtctctatcaggctcgatggggagaataaggctgtagagtacaatgctgtgggggccatgaaggatgccgttagggtggttttccgagggtctagagtgaacgatcttttcgaccgcgactggcacaaaatggctctgagtatccaggcccagaacgtaagcttgcacattgactgcgcattggtccagacactgccaatagaggaacgggaaaatatcgacatacagggaaagactgtgatcgggaaacgcctttacgattcagttccgattgatttcgatctgcagcgaattgtgatctattgcgatagcaggcatgctgaactggaaacatgttgtgatatccctagcggcccgtgtcaggtcaccgtcgtcacagagccccctccacctccccccccccagcgccccccgacccccggtagcgaacaaattggatttctaaagactatcaactgctcttgccccgccggggagaaaggagaaatgggcgttgctgggccgatgggcctgccaggacccaaaggtgacatcggggctatcggcccggtaggggctcccggaccaaagggagaaaagggcgatgtcgggatcgggccattcggccagggagagaagggggaaaagggctctctgggcctccctggaccgcccggaagggacgggtccaaagggatgcgcggcgagccaggcgaattgggagaacccggcttacccggagaagtcgggatgagaggacctcaggggccaccaggactccctggtccccctggcagagtcggtgctcccgggctgcagggagagcggggagaaaaaggcacccggggcgagaaaggggaacgggggctggatggctttcccggcaaaccgggcgataccggccaacagggacgcccaggaccctccggggtggctggccctcagggtgaaaagggcgatgtgggcccagccgggccgccaggcgtgccaggctcagtagtccagcaggaggggctcaagggggaacaaggggctcccggaccccgcggccatcagggagcacctggccccccaggtgccagaggacctatcggaccagagggtcgcgacgggccgcccggtctacagggcctgagggggaagaaaggggatatgggccctccagggatccccggactgcttggacttcagggtccacctgggcctccaggtgtgcccggcccgcccgggccgggcgggtctccagggctgccgggcgagataggcttccccggaaagccgggcccaccagggcccactgggccacccgggaaagacggcccaaacggaccaccaggtccacccggaacaaaaggagaacccggagagcggggtgaggacggccttcccggaaagcccggacttcggggagagataggcgaacaaggattagccgggcggccgggcgaaaaaggcgaagccggcttacccggcgcgcccgggtttccgggagttaggggtgagaagggtgatcaaggcgaaaaaggcgaattgggcctgccagggctgaaaggcgatcgaggcgagaaaggcgaggctggacccgctggaccccccggactgcccggcacaacatccctgtttacgccgcaccctagaatgccaggagagcagggcccaaagggcgaaaagggagatcccggactgccaggagaaccagggctgcagggtaggccaggcgagctgggcccacagggccctacagggcctccaggcgcaaaagggcaggagggagcgcacggggctcctggcgcggccggaaatccgggcgctcccggtcacgtgggggcacctgggccgagtggcccgcctggaagcgtcggggctcccgggctcagagggacccccggaaaagacggcgaacgaggtgaaaaaggagcagctggcgaagagggatctcccggcccagtcggaccccgcggcgacccgggggcgccgggactccctgggcccccaggtaagggaaaggacggagaaccaggcctcaggggaagccccggcctgcccggcccgctgggaaccaaggccgcttgcggcaaggtgcgaggatctgagaattgtgccctaggcggtcagtgcgtgaagggtgataggggagcgcccggaattccgggcagcccaggctccaggggagacccgggcatcggtgtagccgggccccctggtccctctggtcccccaggagacaaaggcagcccaggatctcgcggactccccggattcccaggtccacaaggccctgccggacgtgacggggcacccgggaatcccggcgaaagagggccccctgggaagccagggttatcatccctgctgagccctggcgatattaatctgctcgctaaggacgtgtgcaacgattgcccgcctggacccccaggcctacccggactccccggctttaaaggggataaaggtgtccccggaaagcctggccgggaagggacggaaggaaaaaagggcgaggctggcccccctggcctgcccggccccccaggcatagcaggaccccagggatctcagggtgagagaggagctgatggggaagtgggccagaaaggagatcagggacaccccggagtgccagggtttatgggcccaccagggaatcccgggcctccaggagccgacggcatcgccggcgctgcaggcccgcccggcattcagggcagtcccggcaaagagggcccacccggaccccagggcccttctgggctgcccggtatcccaggtgaggagggaaaggaggggcgcgatggcaagccagggccccccggagaacccggcaaagcaggcgagccaggactgccaggacccgagggcgctcgggggcctcctggtttcaaaggccatacaggtgattcaggcgcaccaggccccaggggcgaatctggcgctatgggtctccccgggcaagaaggactgcccggaaaggacggggacaccggaccgaccggccctcaaggccctcaagggcctaggggccccccaggcaagaacggctcgcctggcagtccaggtgaacccggaccttcgggtactcccggccagaaaggatcgaaaggggagaacgggtcccctggtctgcccggatttctcgggcctcgcgggcctcctggtgaaccgggcgagaagggggtgccagggaaggagggagtgccaggaaagcccggggagcctgggtttaaaggtgaacgaggcgacccagggatcaaaggagacaagggaccacctgggggcaaaggtcagccaggggatccagggattcctgggcacaaaggacacaccggcctgatgggaccccagggccttcctggtgagaatgggcccgttggcccccctggcccacctggtcagccaggttttcctggcctgagaggcgaaagtcctagcatggagaccctgagaaggctgattcaggaagagcttggaaaacagctcgagaccaggctggcctaccttttagcgcagatgccccctgcctacatgaagtctagccagggccgccccggccctcccgggccgccaggcaaagacggactgccaggccgagccggcccgatgggggaaccaggacgcccaggccaagggggtttggagggtccatcaggacccatcgggccgaaaggtgaacgaggcgctaagggagatccaggcgctcccggagtggggctaagaggtgaaatgggaccgcctggtattcctgggcaacccggagagcctgggtacgcaaaagacggcctgcccggcattccggggcctcagggcgaaacaggccctgctggccatccaggcctccctggtccacccgggccacccgggcagtgcgatccatcccagtgtgcatatttcgcctctctggctgcccgtccaggaaacgtgaaagggccatag

SEQ ID NO: 2658 - DNA, 4821 bp, Artificial Sequence
  Description of Artificial Sequence: Synthetic coding sequence
atggcagggttacgtggcaatgctgtggccggcctcctgtggatgctgctgttatggagcgggggtggggggtgccaagcgcagcgagcagggtgtaagagtgtccattacgatctggttttcctgctggatacatcctctagtgtggggaaagaagatttcgaaaaagtgcgtcaatgggtcgccaacctggtagacacatttgaggtgggtcctgaccgcacgcgagttggagtagttcgctacagtgacagaccaactacagcgttcgagctaggattattcggctcccaagaggaagtcaaagctgccgctaggcgactggcgtatcatggcggtaacacaaacacgggtgacgctttgagatacattacggccagaagctttagcccacacgctggcggcagacctagagatcgggcctacaaacaagtggcaattctgctgacagatggccgcagccaagatcttgtgctcgacgcagctgccgccgctcatcgggccgggattagaattttcgctgtaggcgtgggtgaggcacttaaggaggagctggaagaaatcgcctcagagcctaagagtgcgcacgttttccatgtgtcagactttaacgcaattgacaaaattcgggggaaactgcgcaggcgtttatgtgaaaatgtgttgtgcccaagtgtaagagtcgagggtgaccgatttaagcacaccaacggcggtactaaggagattaccggcttcgatttaatggacctgttctctgtcaaggagatcctgggaaagcgcgagaatggagcccaatcatcttacgtacgcatggggtccttccccgtggtgcagagcaccgaagacgtattccctcaggggctccccgatgagtacgctttcgtgacaacgttccggtttagaaaaacatccagaaaagaagattggtatatctggcaagtaatagaccaatactctatccctcaggtctccattcggctggatggggagaacaaggctgttgaatataatgctgtgggcgccatgaaggatgcggtgcgcgtggtctttaggggatcacgggtcaatgatctcttcgacagggattggcataaaatggccctgtccatccaggctcagaatgtgagtttgcacattgattgtgctctggtgcaaacattgcctattgaagagagggagaacattgacattcaggggaagactgtcatcggcaaacggttatacgattccgtccccatagattttgacctgcagcggatcgttatctattgcgacagtagacacgcggaactcgagacatgttgcgacatcccctctggcccatgccaggttactgtcgtcaccgagccccctccccccccgcccccgcagaggccaccaacaccaggttccgagcagatcggattcctaaaaactataaactgttcttgtcctgctggggagaagggcgagatgggcgtcgctgggcctatgggattaccaggaccaaaaggagacattggtgcaattggccccgtcggcgcacccggccctaaaggcgagaaaggtgatgtcggaatcggaccattcggccaaggggagaagggagagaagggctcattggggctaccaggcccacccgggagagatggctcaaaaggcatgcgcggggagccgggcgagcttggggagcccggtctgcccggtgaggtgggcatgcgggggccacagggccctcccgggctcccgggaccaccgggtcgggtgggcgctccggggcttcagggcgagcggggagaaaagggtacacggggggaaaagggcgagagaggtctcgatggttttccagggaagcctggcgacacagggcaacagggccgccccggtcccagcggtgtcgctggcccacaaggcgaaaagggggacgtcgggcctgccggtccacctggcgtccctgggagtgtcgtgcaacaagaaggcttgaagggcgagcagggagcgcctgggcctaggggccaccaaggagcccccgggccccccggagcccggggacccatcggtcccgagggccgtgacgggccccctggtctgcaaggactgcgcggcaagaaaggcgacatgggtccccctggaatcccaggactcttaggcttgcagggacccccagggccccccggggtgcctggcccacctggacccggcggaagcccaggactgcctggtgaaatcgggttccccggcaagcctgggcctccagggcctaccgggccaccgggtaaagatggccccaatggtccccctggaccccccggcactaagggcgagcctggtgagcgaggggaggatgggctgcccgggaaaccaggcttgagaggagagatcggggaacaaggactcgccggtcggcccggggagaagggcgaggcaggtttgccaggtgctcccggattccccggagtgaggggggagaagggtgatcagggtgagaagggagagctgggcctccctggtcttaagggagaccgcggtgaaaaaggcgaggccgggccagccggccctcccggcttgcccggcacaactagtttgtttacgccccatcccaggatgccaggagaacaaggccccaaaggggaaaagggcgatcctggactacctggcgaacccgggctgcagggtaggcccggcgagttgggtccacagggccctactggacctccaggtgccaaagggcaggaaggtgcccatggagctccgggggctgccggcaacccaggtgcccctggtcatgttggcgcacccggcccttcagggcctccaggctccgtaggggcacccggcctgaggggcacacctggcaaggacggtgagcgtggggagaagggggctgcaggcgaagagggcagcccaggcccagtaggaccacggggagatccaggggctcctgggctgcccggtccgcccgggaagggcaaagatggagagccaggactaagggggagccctggactgcctggacctttgggtaccaagggtgatcgtggagctccaggaattccaggctcgccaggtagcaggggcgatccagggataggtgtggcgggacctccgggtccctcaggcccccccggagacaagggctctcccggttccagagggctccccggatttcccggacctcagggtcccgctggcagagacggagccccaggaaacccaggagagaggggtccccctggtaagcctgggctgagcagtcttttatccccgggagatattaaccttctggctaaagatgtatgcaacgactgtcctcccggccccccaggcttgcctggcctcccaggatttaagggcgacaaaggagtccccggcaagccaggtagggaaggcacggaagggaagaaaggcgaagccgggccacccggactccccggccctccaggcatcgcagggcctcagggaagtcagggggaacgaggagctgacggagaggtgggacagaaaggggatcagggccatcccggggtgcccggttttatgggaccaccgggaaatcccggtcctccaggggcagacgggatcgctggggcagccgggccccccggcatccaggggtcccccggcaaggaggggcccccaggaccccagggtccaagtggcctgccggggatacccggagaggaggggaaagaaggccgcgatggcaagcccggccctcccggtgagcctggcaaagccggagaaccaggattgccaggcccagaaggcgcaagagggcctcccggcttcaagggacacaccggggattccggcgctcccggccctagaggcgagagcggtgcaatgggtttaccaggccaggaaggtttgcctggaaaggacggggatacaggcccaactgggccccagggaccccagggacctaggggtccacctggcaagaatggctcacccgggtccccaggggaacccggtccgagtggcactccaggccagaaggggagtaaaggggagaatggttcccctggtctcccaggctttctcgggccacgcgggccccctggagaacccggggaaaagggagttcccggtaaagagggtgtgccggggaagccaggcgagcccggttttaaaggtgagaggggggatccaggcatcaaaggagataaaggtcctccaggagggaagggccagcccggtgatcctggtatcccagggcacaaagggcacaccggccttatgggaccccagggcctgcctggtgaaaatggaccagtgggcccacccggcccccccggccaacccggattcccaggcctcaggggggagagtccatccatggagacgcttcgcagactgattcaggaagagttgggaaagcagctggagactagactggcctacctcctggcacagatgccccccgcttacatgaaaagctcgcagggacgtcctggacctcctggacctccaggaaaagacgggctgccaggaagggcaggccctatgggtgagcccggccgcccaggccagggcggtcttgaagggccatcaggacctattgggcctaagggcgagcgaggcgccaagggggaccctggagcccccggggtaggcctgagaggcgaaatggggccacccgggattcctgggcaacccggggagccaggctatgctaaggacgggctccccggcatcccaggtccgcagggtgagactgggcctgctgggcaccctggccttccaggcccgccaggcccgcccggtcaatgtgatccaagccagtgtgcatactttgcgagcctggccgcccggcccggcaacgtcaagggtccttag

SEQ ID NO: 2659 - DNA, 3960 bp, Artificial Sequence
  Description of Artificial Sequence: Synthetic coding sequence
atggctggcctgaggggcaacgccgtggccgggctgctgtggatgctgcttctctggagcggcggcgggggttgccaggctcaaagggccggctgcaaatccgttcactatgacctagtgtttctactggacacgtcctcatcagtgggcaaggaggatttcgaaaaggtcaggcaatgggttgcgaaccttgtcgacaccttcgaggtgggccccgaccgtacccgagtgggcgtagtaaggtacagcgatcgccctacaacggccttcgaattaggcttgttcggcagccaggaggaggtaaaagcggcggcccgccggctagcctaccacggagggaacacaaatacaggagacgctctgaggtacataacggcgcgtagcttctctccccacgcaggtggccggccacgcgatagggcatacaagcaagtcgcaatcctgctgacagacgggcgtagccaggacttggtcctcgatgctgcagctgcagctcaccgcgctggcatccgaatctttgcagtgggcgtgggagaagccctgaaagaggaacttgaagaaattgccagcgagcctaagtccgcccacgtgtttcacgtcagcgattttaatgcgattgacaagatcagaggcaaacttcggagaaggctctgcgagaatgtgctgtgccccagcgtgcgggtggaaggagatagatttaagcacacaaacggagggaccaaggagatcacaggattcgatctgatggacctgttttccgtcaaggagatcctgggtaaacgagagaatggcgctcaatctagttatgtaagaatgggcagttttccagtcgtacaaagtacggaagacgtgtttccgcaaggactacctgatgagtacgcctttgtgacaacctttcgattcagaaagacatcccggaaagaggactggtacatctggcaagttatcgaccaatattctattcctcaagtgagcatccgcctggatggggagaacaaggctgtggaatataacgctgttgctggcccacagggcgagaagggtgacgttggccctgctggccccccgggtgtaccgggcagcgtggtacagcaagagggacttaagggcgagcagggggccccaggccccagaggtcatcagggagccccaggtccgccaggcgctcgagggccaatcggccccgagggaagggatggacctcccggcttacaagggctgcgcggtaaaaagggggacatgggacctcccgggatccccggcctcttaggcctgcaggggccccccgggcccccaggagttcctgggccacccggccctggaggatccccaggccttcctggcgaaattgggttccccggaaaaccaggccctcccggcccaaccgggccacccggcaaggatgggcccaacggccccccaggccccccaggcaccaagggggagcccggcgagcgtggtgaggacgggttgccagggaagcccggcctccggggtgagatcggcgaacagggcctggccggccgaccaggcgagaagggtgaagccggactgccgggcgccccgggcttcccaggcgtgcgcggcgaaaagggcgaccaaggcgagaagggcgaactaggcctccctggattaaagggtgaccggggtgagaagggagaagcaggccccgccggccctccagggctccctgggactacctctctcttcactccacatcctcgaatgccaggagagcaaggtcccaaaggcgagaaaggcgaccctggacttcccggagaacctgggctccaggggcgaccaggagagcttggaccacaaggccccaccggccctcccggcgctaaagggcaagaaggtgcccatggcgcccccggcgccgccggtaatcccggagccccgggacacgttggcgcacccggtcccagcgggccacccggatccgtaggcgccccggggctgaggggtacacctggaaaggatggggaaaggggggagaagggagctgccggggaggaagggagtcctgggccagttggccctagaggcgaccccggggcccctggcctgccaggtccccctgggaaaggtaaggacggtgaacccggcctgcggggaagtcctggtctacctgggccactggggaccaaaggggaccgcggagccccaggtatcccaggctcacctggctctcgtggggacccgggcatcggagttgcagggccccccggaccgtcaggccccccaggagacaagggcagcccgggttcgagggggttgcctgggtttccaggccctcaggggcccgctggccgggatggagcacccgggaaccccggggaaaggggcccgccagggaaaccaggcctgagttctttgttgtccccgggtgatatcaacttactggctaaggatgtttgtaatgactgccccccagggccgccaggcctgcccgggctgccagggttcaaaggagataaaggcgtccccggtaaacccggcagggaggggaccgaggggaaaaagggcgaagccgggccacccggcctgcctgggcctccagggattgcaggaccacagggatctcagggggagcgaggggcggatggggaagttggacagaagggggatcaaggccacccgggagtgccaggcttcatgggcccccctggaaaccccggtccgcccggcgcggacggcattgccggcgcggccggaccccctggtatccagggaagcccagggaaagagggcccccccggcccccagggaccttccggactgccaggaatacccggagaggagggaaaggaaggcagggacgggaagcccggccctcccggcgagccgggcaaagctggagaacctggtctgccggggcccgagggggccaggggccccccaggctttaaaggacatactggagattctggcgctccaggtcccagaggcgaaagtggggctatgggcctcccggggcaggagggtttgcccggaaaggacggcgataccggccctactggcccgcagggcccacagggacctcgcggaccccccggaaagaacgggtccccaggctcccctggagagccaggcccaagcggcacaccaggccagaaagggagcaagggtgagaatggcagtcccggattgccaggctttctgggcccacgcggccccccaggagaacccggcgagaagggggtgcccgggaaagagggagttcctggcaagcctggcgagcccgggtttaagggcgaaaggggagatccaggaatcaagggagacaaaggcccccctggaggcaagggccagcctggggaccctggtattccaggccacaaagggcacaccggactaatgggtcctcagggtcttcctggtgagaatggccctgtgggaccacctgggcctccaggccagccaggtttccccggactgagaggtgaaagtcctagcatggaaacacttcgtcgtttaattcaagaagaactcggcaaacagctggaaactcgactggcgtatttgctggctcagatgcctccagcctacatgaaaagctcacagggccggccaggaccgccaggaccaccgggaaaagacggtctccccgggagagctggccccatgggagaacccggccgccccggccaaggcgggcttgagggcccttcgggccccatcgggccaaagggcgaacggggggcaaagggcgaccctggagccccgggcgtcggcctgcgcggggaaatgggtccgccaggaatccccggccagcccggtgagcctggatatgcaaaagacgggttaccaggcattcctggaccacagggggaaaccggcccggctggtcacccagggcttcctggacctcctgggccccctggccagtgcgatccatcccagtgcgcctacttcgcaagccttgctgcgcggccgggtaacgtgaaggggccatag

SEQ ID NO: 2660 - DNA, 5145 bp, Artificial Sequence
  Description of Artificial Sequence: Synthetic coding sequence
atgcatttaagggcccaccgcacccggcgcggtaaggttagcccaacggcaaaaacaaagtctttactgcactttatcgtattgtgcgtcgccggtgttgtggtacacgcccaggagcagggcatcgacattctccatcagctgggattgggcggcaaagacgttcgccattccagtccagccaccgccgtccctagcgcatcaacccccttaccccagggagtgcacttaaccgagtccggcgtaatcttcaaaaatgacgcctacatcgagactccattcgtgaaaattcttcccgtgaatttaggccaaccatttacgatcctgacagggctccagtcacatcgggtgaataatgcatttcttttctcaataagaaacaaaaaccggctacagctgggggtgcagctccttcctaagaaactggtcgttcacatccggggaaagcagcctgccgtctttaattattccgtgcacgatgagcaatggcacagtttcgcaattaccatcaggaatcagtctgtttctatgttcgtagaatgtggtaagaagtacttctccaccgagaccatccctgaagttcagacctttgacagcaactctgtgtttaccttgggcagtatgaacaacaattctattcactttgagggcatcgtgtgccagctggatatcattccctctgcagaagctagcgctgactactgtcggtacgtgaaacagcagtgtcgtcaagccgacaagtatcaaccagaaacatcgatcccatgtaccactctcatccctactaagatccccgaacacagtcccccgccaaaactgtttgccgaaaaagtgctaagcgaagacaccttcacagaaggcaagtcaattccgaacattatcaaaaatgattccgaaacagtttataagcggcaggagcaccagattagccgctcccagctctctagtctgcagtcaggcaacgtgtccgccgtagatttaaccaaccacggcatacaggcaaaagaaatgattaccgaagaagacacccagacaaatttcagcctctcagtcaccacccacagaatatccgaagccaaaatgaataccaaggaaaagttctcctcgctgctcaatatgtccgataacattacccagcacgacgaccgtgtcactggtttgtctctcttcaaaaaaatgcccagtatactgcctcaaataaagcaggacacaataacaaacctgaaaaaggccatcaccgcaaacctgcatactaacgagttaatggagatgcaacccatccttaataccagtcttcatcgggtcacaaacgagccatcagtcgacaaccacctggatctccgaaaggaaggcgaattctatcctgacgccacatacccaatcgaaaactcctacgagactgaattgtacgattattactactacgaagatctcaacacaatgctggagatggaatatttgcgcggacctaagggagatactggcccccccgggccacccgggcctgcggggatccccgggccgtccgggaagcgtggtcccagggggattcccgggccgcacggaaaccccgggctgcccggcttgcccggccctaaaggcccaaaaggcgatccagggttctcacctgggcagcccgttccgggagaaaaaggcgatcaaggactgagtgggttgatgggaccgccaggcatgcaaggtgataagggactaaagggacatccaggactccctggccttccaggtgagcagggtattcccgggttcgcaggtaacatcggatcccctgggtacccaggacgccaaggcttggccggacctgagggcaaccccggtccaaagggggctcagggattcataggttcccctggcgaagcgggtcaattgggccctgagggcgagcggggtatccccggaatccgcggcaaaaagggattcaaaggaaggcagggcttccctggtgatttcggtgatcgcgggcctgccggactagacggctcaccagggctcgtgggaggcactggaccccccggttttcccgggctgagggggagcgtcggccctgtgggtcctatcggtcccgccgggatccccggcccaatgggcctatcgggtaataaaggtctgccaggcattaaaggtgacaagggagaacagggaacggccggagagttaggcgaacctggttaccctggggacaagggtgctgttggactgccaggcccacctgggatgaggggtaagagtggacctagtggtcagactggcgatccaggcttacaggggccctcaggaccgcctggccctgaaggctttccaggggacatagggatacccggacagaacggccctgaagggcccaaaggtttgctgggcaaccgaggtcctccaggacccccaggtctgaagggtacacagggcgaggagggaccaatcggtgctttcggcgagttggggccccgggggaagcctggtcagaaaggttatgctggtgagcctggacctgagggcctaaaaggtgaggtgggcgaccaaggcaatattgggaaaattggggagactgggcccgtcgggctccctggagaagttgggatgaccggctccatcggcgagaagggggagcggggttcccctggccctttgggacctcagggtgaaaagggggtaatgggatatcccggaccccccggcgttcctggtccaattggacccctggggctgccaggacacgtgggcgcaagaggccccccaggctctcaaggtcccaagggacagagggggtccagaggacccgatggcttgctgggtgaacagggcatacagggcgcgaaaggtgaaaagggagatcaggggaaaagaggcccccacggactcatcggaaagaccggaaacccgggtgagcgtggtttccagggcaaaccgggtcttcaaggcctgcccggttcgacgggcgatagaggtctacctggtgagccaggcctgaggggccttcagggagatgtcgggccccccggcgagatgggaatggaagggccccctgggacggaaggcgaaagcggattgcagggagagcctggagctaagggtgacgtgggaaccgcagggtctgtaggcggaaccggcgagcctggccttagaggagaacccggggcacccggtgaagagggccttcagggaaaggatggattaaagggggtgcccggtggacggggtcttccaggagaagatggggagaaaggagagatggggctccccgggatcattggtcccctcggccggtcagggcaaaccggtctgcctggtccggagggcatcgtcggaattcccggtcaaaggggtaggcctgggaaaaagggcgataaagggcagattggcccaactggagaagttggaagtaggggaccccctggcaaaatcggcaaaagtggtcctaaaggagcccgcggcacaagaggcgctgtgggtcacctcggattaatgggtcctgacggagagccgggcatccctggctatcggggccatcagggccagcccggaccctccggactccctggacccaagggggagaaggggtaccctggcgaggactccactgttttgggcccccccggacccagaggtgagcccggcccagttggcgaccagggagagaggggcgagcccggcgccgaagggtacaaggggcacgtgggcgtgccaggcctccgcggagccaccggacagcaaggcccaccaggggaaccaggtgaccaaggagagcaggggctgaagggcgagcgtggaagcgagggaaataaagggaagaagggtgcacctgggcccagcgggaaacctggcatccccggcctccagggcctgctcggccccaaggggatccagggttatcacggggccgatggcatctctggtaatccgggcaagattggcccccctggcaagcagggcttacccggcataagaggcggacctgggagaacgggtctggctggtgcacctggtccaccaggcgtgaaaggatcatctggactgcctggctcaccagggatccaggggccaaagggcgagcaggggctgccaggccagcctgggatacaaggcaagcgtggccatagaggtgctcagggcgatcaagggccttgtggtgaccctgggcttaaaggtcagcctggggagtacggcgtccagggactgacagggttccaagggttcccgggtccaaagggtccagagggcgatgccggcatcgtcggcatatccggccccaagggacccattggccacagagggaacactgggccattggggcgggaagggatcatcggccccacaggcagaacaggtcccagaggggagaaggggtttcggggagagactgggccgcagggcccacggggacagccaggtccgcccggaccccccggagccccaggaccgcggaagcagatggacattaacgccgcaatacaggcactaattgagtctaacacagcccttcagatggagtcttaccagaatactgaagtgacgctgatagaccacagtgaggagatcttcaagacactgaactacctgtccaatctgctgcactctattaagaaccccttgggtactagggataaccctgctcggatctgcaaggatttattaaattgcgaacagaaggtctcagatgggaagtattggattgatcctaatcttggctgcccttctgatgctattgaggttttctgtaactttagcgcaggcggccagacctgtcttccgccagtatcagtaacaaaactggaatttggcgttggcaaggtgcagatgaacttccttcacttactgtcctccgaggctactcatatcatcaccatccactgcctcaataccccccgatggactagcacccaaaccagcggccccgggctgccgattggcttcaagggctggaacgggcagatttttaaagtaaataccttgttagagccaaaggtcctgtcagacgattgcaaaattcaagacggttcttggcataaagcaaccttcctgttccacacccaagagcccaaccagctcccagtgattgaggtgcagaaactgcctcatctcaaaactgaacgtaaatattacatcgattcctcttcagtctgttttctatag

SEQ ID NO: 2661 - DNA, 5082 bp, Artificial Sequence
  Description of Artificial Sequence: Synthetic coding sequence
atgcatctccgcgcacatcgcaccagaagggggaaggtgtcacctaccgcgaaaacgaagtcactcctgcattttatcgtcttatgtgtggctggcgtcgtggtgcacgctcaggagcaaggaatcgatattcttcaccagcttgggctcggagggaaggacgtgaggcatagttccccagctaccgctgtgcccagcgcatcgacacccctcccccagggagtccatttaacagagtctggggttatcttcaagaatgatgcatacatcgagacccccttcgtcaaaattctgccagtgaatctgggccagccctttaccattttgactggactgcagtcgcatcgggtgaataatgccttcctgttctccattcgcaataaaaaccggttgcagcttggcgtgcagctgctccctaagaagctggtggtccacatcagagggaaacagcccgcggtgttcaattattcagttcacgatgaacaatggcacagtttcgccatcactatacgcaaccagagcgtgagtatgttcgtcgaatgtggaaaaaagtatttttccaccgaaacaataccggaagttcaaacttttgacagtaacagcgttttcaccctcggatctatgaataacaatagcatacattttgaagggattgtctgccagctggacattatcccgtctgccgaagcctctgccgattactgtcggtatgtgaagcagcagtgtaggcaggcggataaatatcaacctgaaacctctataccatgcactacccttattccaaccaagattccagagcacagcccacctccgaaactatttgccgagaaagtcctgtctgaagacaccttcacagagggtaaatccattcccaacataatcaagaatgattccgagaccgtttataagagacaggagcatcagatctctcggagtcagctcagtagtctccagagcggaaatgtgtcagctgttgatttgacaaatcacggcatccaagccaaagagatgatcaccgaagaggatacccagaccaatttctctttgtccgtgacaacccacagaatctccgaggctaagatgaacaccaaggaaaagtttagttccctgctgaatatgtccgataacattacccagcacgacgatcgtgtgaccggtctatctctgtttaagaagatgccatctattctgccacagattaaacaggatactattactaatttgaagaaggctattacagctaacctccacactaacgaactgatggaaatgcagcccatcctcaacacatccctgcaccgcgttacgaacgagccttctgtggataaccatctggatctgaggaaggagggagagttctatcccgatgccacatatccgatcgagaacagttacgaaaccgagttgtatgactattactactacgaggacctaaatacgatgttagagatggagtaccttcgcggtcccaagggcgacactgggccgcccgggcctccagggcctgcagggatacctggcccttccggcaaaaggggccctcgcggtatcccagggccacacggcaaccctggcctgccgggcctcccagggcccaaaggtcccaaaggcgaccctggcttctctccagggcagcccgtgcccggagagaaaggggaccagggcctgtcagggctaatggggcctccagggatgcagggcgacaaaggcctgaaagggcatccaggcctgccaggattgccaggcgaacagggaatcccagggtttgcaggcaacatcggcagccccgggtaccccggacgtcaaggactagcaggccctgagggaaatccagggcctaagggcgctcagggctttattggctcgcccggagaagccggccagctaggtcctgagggagagcggggcattcccggcattaggggcaaaaagggctttaaggggcggcaggggttccctggcgacttcggcgatagagggcccgctgggctagatgggagtcctggcctcgtgggcggaacaggcccgcccggcttccctggacttcgcggatccgtggggccggtgggcccaattggcccagcggggattccgggacctatggggctctcaggaaacaagggtctccctgggataaagggcgacaagggcgaacaggggaccgcaggcgaactaggcgagccagggtaccccggcgacaagggcgcggtgggactgccagggcccccaggaatgagggggaagtccggtcctagcggccaaaccggcgatccaggcttacaggggccatctggtccccctgggcctgaaggctttccaggagatattggaatccctggacagaacgggcccgaaggacccaaaggcctgctcgggaatcggggccccccaggcccaccagggctcaaaggcacccagggcgaggagggcccaataggcgcatttggagagcttggccctagagggaagcctgggcaaaagggttacgccggggaacctggccccgaaggactcaaaggggaagtgggagatcagggcaatatcggaaagataggggaaacggggcctgtggggttgccaggcgaggtcggtatgacaggttctattggggaaaaaggtgagagaggaagtcctggaccactgggcccccagggcgagaaaggagtgatgggttatccggggccccccggtgtccctggaccaataggaccgctcgggctcccaggccacgtgggtgcccggggcccacccggatctcagggccctaaagggcagcgcggcagtcggggccccgacggattgctcggcgaacagggaatccagggagccaagggagaaaagggtgatcaaggcaaacgaggccctcacggccttataggtaagacagggaacccaggagaaagaggattccagggtaagcctggcctgcagggtcttccgggatctacgggtgatcgcgggctgccaggtgaaccaggcctaaggggccttcaaggagacgtgggcccccccggggaaatgggaatggaaggaccaccaggtacagagggcgagagtggtctccagggcgaacccggcgcaaagggggacgtaggcaccgcaggatcggtaggaggtaccggagaacccggactgcgtggtgagccgggcgcccctggggaggaaggactgcagggcaaggatggtttgaaaggggtccctgggggaagaggcctgcccggagaggacggagaaaagggcgaaatgggacttcctggtatcatcggccctttggggcgcagtggccaaaccggacttcctgggccagagggaatagtcggcattccgggccaaagagggcgtccaggaaagaagggagacaaagggcaaatcggacccacaggagaagtggggtctcgtgggcccccaggcaaaattgggaagagtgggccaaaaggcgccaggggcactcggggagctgtaggccacctgggcctgatgggaccagatggcgagcccggaatccccggctaccgcgggcatcaggggcagccagggccctctggattacccggccctaagggcgaaaaaggctaccccggcgaagacagcaccgttcttggcccaccagggccaagaggagaaccaggacctgtgggcgatcagggtgaacggggggagccaggtgctgaaggttataaaggacatgtgggcgtgccaggtcttcggggtgcgacaggacagcaaggccctcccggtgaaccgggagatcaaggggaacagggactcaagggggaacgggggtcggaaggcaataaggggaagaagggcgctcccggcccttcagggaagcctggcatccccggcctgcaaggcttactggggccaaaggggatccaggggtaccacggagctgatggaatttctgggaatcccggaaagatcgggccccctgggaaacagggattgccaggtattcgaggcggacctggtcgaaccggtctggccggtgcgcctggaccacctggtgtgaaaggcagttccggccttccgggctctcctggaatacagggacctaagggggagcaagggctcccgggccaacctggaatacagggcaagcgcgggcacaggggggctcaaggagaccagggcccgtgtggagacccagggttgaagggccagcctggcgaatacggagtgcaaggactgactgggtttcaggggttccccggtccgaagggccctgagggggatgctggtatagttggaatctcagggcctaaagggcctataggacatcgaggcaataccgggcctctggggcgtgaaggtataatcggacccaccggtcgtactggacctcggggcgaaaaaggcttcagaggcgagacgaagcagatggacatcaatgctgcaattcaggccttgatcgaatctaatacagcgctgcagatggagtcgtaccagaacactgaggtaaccctaatagaccatagcgaagaaatcttcaagaccttaaactacttatcaaaccttctccattctataaagaatcctctgggcactcgcgacaacccagccagaatatgtaaagacctgctgaactgcgagcagaaagtctccgacgggaagtactggattgatcccaatctgggttgtccatcagatgccatcgaggtgttttgtaacttctctgccggaggacagacatgtctgccgccagtgagcgtgacaaaactagagtttggcgtggggaaggtgcagatgaactttctgcacctgctctcttcagaggccacacacataataacgatccactgcttgaatacgcctcgatggactagcacccagacctccggacccggcctccccatcggatttaagggctggaatggccagatatttaaagtcaacactctcctggagccgaaagttcttagcgatgattgcaagattcaagatgggtcctggcacaaagcaaccttcctgtttcacacacaagaaccaaaccagctgcctgtgatcgaggtccagaagctaccacatttgaaaacagaacgtaaatactacatagacagtagttccgtgtgtttcctgtag

SEQ ID NO: 2662 - DNA, 246 bp, Artificial Sequence
  Description of Artificial Sequence: Synthetic coding sequence
atgcacctgagggctcaccggacccgacgcggcaaagtatccccgaccgcaaaaactaagtcactgctgcacttcatcgtgctttgtgtagctggggtggtggtccatgcacaggagcaagggatagatatcttgcaccagctggggctcggaggtaaagatgtccgtcattcatcccctgcgactgccgtgccctcggcttccactccactgccccagggcgttcatcttacagaatctggctag

SEQ ID NO: 2663 - DNA, 1971 bp, Artificial Sequence
  Description of Artificial Sequence: Synthetic coding sequence
atgttattgaagaaacatgccggcaagggaggagggcgggagccccgatcggaggacccaacacccgctgagcaacactgcgctcgtacgatgccaccctgcgctgttctcgccgcactgctttccgtggtggccgtagtgagctgtctctacctgggagttaaaaccaacgatctgcaggcaaggatcgccgcactcgagagcgccaaaggcgctcccagtatccatttactgcctgacaccctcgatcacctaaagacaatggtacaggaaaaggtggagcggctcctcgcacagaagagttacgagcacatggcaaagattcggatagctcgcgaagcaccctcagagtgcaactgccctgccggacctcccgggaagcgaggaaagcggggaaggaggggtgagtccgccggaccgcctggggcgccagccccttcccaggggcctccagggcccaagggcgataaaggagaacagggggatcaagggccgcggatggtgttcccaaagattaaccatggttttctgtccgccgatcagcagcttataaaaaggagactgatcaaaggggatcagggccaggcgggccctcctggccctccagggccccctggacctagggggccccctggcgatactggcaaagatggtccacgtggcatgccaggcgtgccaggcgaaccaggcaagcccggggaacagggcctaatgggcccactcggcccaccgggacaaaaggggagcatcggcgctccgggcatccctggtatgaacgggcagaaaggtgaacctggcctgccaggagccgttggacaaaacggcatacctggtcctaagggggaaccgggggaacagggggagaaaggcgatgcaggtgagaacggccctaagggtgatacaggggagaaaggcgaccccggctccagcgccgcgggaatcaaaggagagccaggcgaatctggcaggccgggccagaagggggagcccgggctgccaggcctgccggggctgccaggcattaagggagagcccgggtttatcggcccacagggagagccagggctgcctggcttgcctggtacaaaaggggagaggggagaggctgggccgcctggcaggggcgaaagaggcgaacccggagctccgggaccgaaaggaaaacagggcgagagcggtactcggggccctaaaggcagcaagggagatcgaggggaaaaaggggactcaggtgctcagggtcctaggggcccaccaggacagaaaggagaccaaggagcaaccgagattatagactacaatggtaacctgcacgaagccctgcagagaattacaactctgaccgtgacagggccgcccgggcctcccggtccgcagggattacagggccccaaaggagagcagggttcacccggcattccaggaatggacggcgaacagggcctcaaaggcagtaagggcgacatgggcgaccccggcatgaccggcgagaagggaggcattggcctccctggactgcctggggctaacgggatgaaaggggaaaaaggagatagcgggatgcctgggcctcagggaccttctataatcgggcccccggggcctcctggcccccacgggcctcctggaccgatggggccccacggactccccggcccaaaggggaccgatggccctatggggccacatggccccgccggtcctaaaggcgagagaggggagaagggcgccatgggggagcccggtcctcgaggcccatatggcttgccaggcaaggacggggaacctggccttgatggcttcccaggtccgcggggcgagaagggcgatttgggcgagaagggggagaagggctttaggggggtgaagggcgaaaaaggggagcccgggcaaccaggactcgacggcctggatgccccttgtcagctgggtccagacggactacccatgccagggtgctggcaaaaatag

SEQ ID NO: 2664 - DNA, 1929 bp, Artificial Sequence
  Description of Artificial Sequence: Synthetic coding sequence
atgcttctgaagaagcacgccgggaaaggtggcggccgggagcccaggtctgaggaccccaccccggcagaacaacattgtgccaggaccatgcctccttgcgccgtgctggcggccctgctctccgtcgttgctgttgtgtcgtgcctctacttaggtgtcaagacaaacgatctccaggcccgaatcgccgccttggagagtgccaagggagccccatctatacacctcctgcctgacaccctagaccatcttaagacaatggtgcaggagaaagtcgagcgcctgttggctcagaaaagctacgagcacatggccaagattcgcatcgcaagagaagctccttccgagtgtaattgccctgccggaccaccaggtaaacgcggcaaacgtggacgacgcggagaaagcggtccccccggccaacccgggccccaggggcccccaggacctaagggagataaaggggaacagggggatcagggccctcgcatggtgttcccaaaaatcaatcatggcttcctgagcgccgatcaacagttgatcaaaagaaggctgattaagggtgaccaaggccaagctggcccaccaggtcctcccggtcctccgggaccaaggggcccaccaggggacaccggtaaggacggaccaagaggtatgccaggggtgccgggcgagcctggtaagcctggcgaacaaggactgatggggcccctaggtccccccggacagaaagggtcaatcggcgcgcccggcattcccggaatgaacgggcagaagggcgagccaggattgcctggcgctgtaggccagaatggtatccctggtcccaagggcgagccaggtgagcagggggagaagggcgacgcgggggagaatggccccaaaggggacaccggagagaagggcgatcctggttcctcggccgccggtattaagggagagcctggggagtcaggcaggcctggtcagaagggagagccaggcttacctggactcccggggttacctggtattaaaggcgagccaggctttataggccctcaaggcgagccgggtctcccaggtctaccaggtaccaagggggagcgaggggaagcaggcccccccggacggggagagagaggagaaccaggggcaccaggcccaaaaggcaagcagggagagtctggcacacgtggccccaagggctccaagggggatcgcggggagaagggtgattcaggagcacagggacctcgggggccaccagggcagaaaggagatcagggtgctacagagatcattgattataatggaaatctgcatgaagctttgcagagaataacaaccctgaccgttaccggacccccaggcccgcccgggcctcagggactccagggccctaagggtgaacaagggtcgcctggcattcctggcatggacggggaacagggtctgaagggtagcaaaggcgatatgggggaccctggaatgacaggggagaaggggggaatcggcttacccggtctgcctggagcaaacgggatgaaaggggaaaagggggacagcggcatgcccggcccacaggggccctcaatcatcgggccacctggccctcccggtccacacggcccaccaggacctatggggccccatgggctgcccgggccaaagggcacagatggcccaatggggccccatggccccgccggaccaaaaggggagagaggggaaaagggtgcaatgggagagccaggacctaggggaccctacggtctgcccggaaaagatggtgagcctggtttggatgggttccctggcccaagaggggagaaaggagatctgggcgagaagggtgaaaaggtcacgagcccctctcagcacgttccttgtctcattcttttgctactgagcgcgctgttattttccctgtgcgatagcatttag

SEQ ID NO: 2665 - DNA, 1965 bp, Artificial Sequence
  Description of Artificial Sequence: Synthetic coding sequence
atgttgctgaagaaacatgccggaaagggaggcggacgcgaacctcggagcgaggatcccacccctgccgagcaacattgtgctagaacaatgcctccctgcgccgttttagccgctctgctgtcagtggtcgcagttgtgtcgtgtctgtacctgggtgtgaagaccaatgatctccaggctcgaattgctgctttggaaagcgccaagggggcccccagcatacacctcttaccagacaccttggatcatctgaagactatggttcaagagaaggtggaaaggcttctcgcccagaaaagctacgagcacatggcaaaaatcaggattgccagggaagcacctagcgagtgcaactgtcctgcagggccccccggcaagcgtggtaaaagaggcagacggggggagagcgggccaccaggtcagccgggccctcaagggccacccggacccaagggagacaagggagagcagggcgaccaagggccccgcatggtgtttcctaaaattaaccatggctttcttagcgccgaccagcagctcattaaacgccggcttatcaagggcgaccagggtcaggcaggcccccccgggccgccggggccgcctggtcctaggggaccacctggagacacggggaaagacggaccccgtggtatgcccggggtgccgggtgagcccggaaaacctggcgaacaggggctgatggggcctttgggcccaccaggccaaaaagggtccattggagccccaggcattcctgggatgaacggtcagaaaggagaacccggactgccgggtgccgtgggccagaatggcatacccggcccgaaaggtgaaccaggcgaacagggggaaaaaggggacgctggcgagaacggtccaaagggtgacaccggcgagaaaggagatccaggttcttctgccgctggaattaagggcgaacccggggaaagcgggcgtccgggtcagaaaggggagccaggcctgcccgggctccctggcttacccgggataaaaggcgagcctgggttcatcggtccacagggcgagccagggctccccggcttgccgggcaccaaaggcgaacgcggagaagcaggacctccgggacgtggtgagcggggtgagccaggagcgcctggacccaagggcaagcagggcgaatctggaacgaggggtcctaaaggttcaaaaggcgatcgtggcgaaaaaggtgatagcggggcgcagggcccccggggccctccggggcagaaaggcgatcagggcgccactgagatcattgactacaatggaaatcttcatgaagcactgcaaagaatcaccacactaactgtcaccggacctccaggtccaccaggacctcaggggctccagggtcctaagggcgagcaaggctctcccggtattccaggcatggacggtgaacaaggcctgaagggcagcaagggagatatgggcgaccccggcatgacaggtgagaagggaggaatcggactgcccggactgcctggcgctaacgggatgaagggtgagaaaggggactctggtatgcctgggcctcaagggccgtctatcatcggtccccccggaccaccaggaccccatggccccccgggtccgatgggccctcacggcctgcctggaccaaaaggaaccgacggccccatgggacctcacggccctgccggccccaaaggagaaaggggcgagaagggcgccatgggcgagcctggtcctaggggtccttatgggctccccgggaaggatggcgagccagggttagatggattccccggtccgagaggggaaaagggcgacctgggcgaaaagggggagaaaggcttccgtggtgtgaaaggggaaaaaggggagcccgggcagccgggcctggatggcctcgatgccccttgtcagctgggacccgatggcctgccaatgccaggctgctggcagaagtag

SEQ ID NO: 2666 - DNA, 1752 bp, Artificial Sequence
  Description of Artificial Sequence: Synthetic coding sequence
atgttactgaaaaaacatgcggggaaaggcggcggaagagagcctcggtccgaagaccccacccctgcagagcagcactgtgctaggactatgccaccttgcgcagtgctcgccgccctgttgagcgtcgtagcagtggtgtcatgtctatacctgggggtgaagactaacgatctgcaggctcgaatagcagcactcgagtccgcaaagggagcccctagcatccatctgctccccgataccctggaccacctgaagaccatggtgcaggagaaagttgagcgcctcctggcgcagaagtcatatgagcacatggccaaaatccgaatagcacgggaggctccctctgaatgtaattgtccagctggcccgccagggaagagaggcaaaaggggacggaggggcgagagcgcggggcccccgggaggcccccccggacccaaaggggacaagggcgagcagggggatcagggccctaggatggtgttcccaaagatcaatcatggatttttatcagctgaccagcaactgataaagaggagactgatcaaaggagatcagggacaggcaggaccccccggccccccaggaccacctggaccccgtggccccccaggcgacaccggcaaagacgggccccgtgggatgcctggtgttccaggtgagcctgggaaacctggggaacaggggcttatggggccactgggaccaccagggcaaaagggctccataggtgcacccggtatccctgggatgaacgggcagaaaggagagcctgggttgccgggggctgttggccagaacgggatcccaggccccaaaggcgaaccaggcgaacaaggcgaaaaaggcgacgcaggggagaacgggcctaaaggcgatacaggggaaaagggtgatccagggagcagcgcagcgggcatcaaaggggagcccggcgaaagtggtcgccccggtcagaaaggcgagcccggatttatagggccccagggcgagccagggcttcccggactcccggggactaagggcgaaagaggcgaggctgggcccccgggccgcggagagcgaggagagccaggcgctcccggtcccaaaggaaagcagggagagtctgggactagagggcctaaaggctccaagggcgataggggcgaaaagggcgactctggagcccaagggcccagagggccaccgggccagaaaggcgaccagggcgccacggagatcatagactataatggaaatttgcatgaggccctgcagcgcatcaccacattgacagtcaccgggccaccaggcccaccaggcccccaaggcctgcagggccccaagggtgaacagggctcaccaggtattcccgggatggatggcgagcagggtcttaaaggttctaagggtgatatgggggacccgggtatgactggagagaaggggggtattggtttacccggacttccaggtgccaacggtatgaagggggagaagggcgacagcggtatgccagggcctcagggaccatcaattattggacctcctggccccccaggcccccatgggccgccggggcctatgggcccacacgggttacccgggcccaaggggaccgacgggccgatgggcccacacgggcccgcagggccaaagggcgagaggggcgagaagggcgcgatgggcgaaccaggaccgaggggtccttatggcctcccacagggccccgatggactccccatgccgggatgttggcaaaagtag

SEQ ID NO: 2667 - DNA, 1497 bp, Artificial Sequence
  Description of Artificial Sequence: Synthetic coding sequence
atgctgttaaagaagcatgccgggaagggcggagggcgagagccccggtctgaggaccccactcctgccgaacagcattgcgcgcggactatgcccccctgcgctgtgctggctgcgctgctgtctgtggttgcagtcgtcagctgtctgtatctaggtgtgaagacaaacgatcttcaagcaaggattgcagccttagagagcgccaagggggcaccgtcaatccacttactgcccgacaccctagaccacctgaagacaatggtgcaagaaaaagtggaacggcttctcgcacagaaaagctacgagcacatggcaaaaattagaattgcaagagaggctccatccgaatgtaattgtcccgctggtccgcctggcaagagaggaaaacgaggccgccgaggggagtctgcaggaccgcctggggccccggcccccagccagggtcctccagggcctaagggtgacaagggggagcaaggcgaccagggacctagaggtcccttgggtcctcctggccagaagggcagtataggggcccccgggatccccggtatgaacggccaaaagggcgaaccaggccttcctggggccgtagggcaaaatggtatcccagggccaaagggcgagcccggtgagcagggagagaaaggtgacgctggcgagaacggccctaaaggggacaccggagaaaagggggatccagggtccagcgctgctgggattaaaggcgagcctggcgagagcggccgaccaggtcaaaaaggagagccgggcctcccaggactcccgggtctgccaggaattaaaggggagcctggcttcatagggcctcagggggagcctgggcttcccgggctgccgggaaccaagggtgagagaggagaagccggacctccagggcgcggcgagcgtggggaaccgggtgcgcctggcccgaaagggaaacagggcgagagcggcactcgggggccaaagggcagcaaaggggaccggggcgaaaaaggtgattccggcgcccagggcccacgcggccctcctggccagaagggtgaccagggcgccactgagattattgactacaacggcaatcttcacgaggccctgcagcgcatcactacactgactgtaacgggaccacctggccctcccggtccgcagggactgcagggaccgaaaggtgagcagggcagtcctgggatcccaggcatggacggtgagcagggactaaaaggatcaaagggcgacatgggagatcccggttctcagtggaatgaacgccggaagcgcagattttggaatgccggatcaactggatctttttaccaccggcccacaaggcctacgcgcagtccttggcccacttggcctcacggcacctcttggacatcctggacgaagggaagcatatggctaagacgaaaggcgaggattccgggatacaggtggtcttacggtacaccatggccatgccgatcgcagcgcagaaaatcatag

SEQ ID NO: 2668 - DNA, 213 bp, Artificial Sequence
  Description of Artificial Sequence: Synthetic coding sequence
atgctgctgaagaagcatgctggcaaagggggtggccgcgaacctcgcagtgaggatcccacaccagctgaacagcattgcgcaaggaccatgcctccttgcgccgtgctcgcagctctgcttagcgttgttgcagtcgtgtcctgcctgtacctcggagtaaaaactaacgatctgcaggccagaatcgctgccctggaaagcgccaagtag

SEQ ID NO: 2669 - DNA, 90 bp, Artificial Sequence
  Description of Artificial Sequence: Synthetic coding sequence
tagggtcccagaggcgagaaaggggatcttggagaaaagggagagaagggccccgatggactgcctatgcccggatgttggcagaagtag

SEQ ID NO: 2670 - DNA, 5583 bp, Artificial Sequence
  Description of Artificial Sequence: Synthetic coding sequence
atgggggctggttcggcacgaggggcaaggggcaccgcagcggctgccgctgcaaggggaggagggttcttgttcagctggatcctggttagttttgcatgccacttggcttccacccagggggcaccagaggatgtagatatcctgcagagattaggtctctcttggacaaaagcaggcagccccgccccaccaggcgtgattcccttccagagcggatttatcttcacgcaaagagcgcgcttacaggcaccaaccggcaccgtgatccctgcagctctggggaccgagctagccctcgttctcagtctgtgctcccaccgcgtgaatcatgcgtttctgttcgctgttagatctcagaaacgaaagctgcaactcggtctgcagttcttgcccgggaagacagtggtgcacctgggctcacgaagatccgtggcttttgaccttgatatgcatgacgggaggtggcatcatctggcactggagctccgaggccgaacggtcaccttggtgactgcttgtggccaacgaagagtacctgttcttttgcccttccatcgcgaccccgccttggacccgggaggctcattcctctttggcaaaatgaacccgcacgcagtgcagttcgaaggcgctttatgccaattctcgatttaccctgtgacacaggtggctcataactactgtacccacctgagaaaacagtgcggccaggcagatacctaccagagcccgctgggccctctgttctctcaggacagcggccgcccgttcacgtttcagtcggatctcgctctgctcggactggagaacctgaccacagcaaccccagcccttggctcactgcctgctggtcgaggacctcgtggaaccgtggcaccagctacacccacaaagccccaaagaacatcaccaaccaatccgcaccagcacatggccgtcggcggacccgcccagaccccgcttctgccagctaaactgtccgcctcgaatgctctggacccaatgctcccagctagcgtcggcgggtccacgcgtactccccgacccgctgcagctcagcccagccaaaaaatcacagcgacaaaaatccctaagagcctcccaacgaagcctagcgcccctagtacctctatcgtccctattaagagccctcatcccacacagaagaccgctccttcctcattcactaaatccgcactacctactcagaaacaggtgccgcctacatctcgccctgtccccgctcgcgtgtcacggcccgccgagaagcccattcagcgtaatcccgggatgccacgcccgcctccacctagtaccaggcctctaccccctacaacctcttcaagcaagaagcccatccctaccctggccaggactgaagccaagatcacatctcatgcaagtaaacccgcctcagccaggaccagcacccacaaaccaccaccctttaccgccctgtccagctctccagcccccacaccgggcagtacacgcagtacaaggccacccgccaccatggtgccaccaacatccgggacgtcaactcctaggacagccccggctgtgccaacaccaggtagtgcgccgaccggtagtaagaagcccatcggcagcgaagccagcaagaaggctggacccaaatcttcacctcggaagccagtgccactgcgccctggtaaggccgcccgcgacgtgcccctgtccgaccttactacgcgcccatcccccagacagcctcagccctcccagcagaccacaccagcccttgtgctggctccagcacagttcctcagttcgtcacctcggccgacttccagcggttacagcatatttcatctagcaggtagtaccccattccccctgctgatggggcctcccgggccgaaaggcgactgtggtttgccaggaccaccgggcttacccggcctgccaggaattcctggtgccaggggtcctcgcggaccccccggcccatatgggaatcccggcctgcccgggcccccaggagccaagggacagaaaggtgacccaggactttccccgggtaaagcccatgatggcgcgaagggagatatggggctccccggcttgagcggtaacccaggacctccaggcaggaaggggcacaaagggtatcctggacccgccgggcatcccggcgagcagggccagcctgggccggaaggctctcctggcgccaaggggtacccagggagacagggactgccaggccctgtaggggacccagggccaaaggggtcacgcggttacatcgggcttccaggccttttcggccttcccggcagcgacggcgaacggggtctccctggggtgcctggcaagcgaggaaagatgggcatgccaggattcccaggcgtgttcggcgagaggggaccacccggcctggatgggaaccctggtgagttggggctgccaggtccccctggtgtcccgggtctcatcggggacctaggcgtgttgggtcccatcggttatcctgggcccaaaggaatgaaaggactgatggggtctgtgggcgaaccagggcttaagggcgataaaggcgagcaaggcgtgcccggtgtatccggggatcccggctttcagggcgacaaagggtcccagggactgccaggtttccccggcgcccggggcaaaccaggcccacttggcaaagtgggcgataaaggcagcatcggattccccggacctccagggcccgaaggcttccccggggacatcggtcctcctggcgacaatggtcctgagggcatgaaaggaaaaccaggagcacgcggccttcctggtccccgcggccaactgggacctgaaggagacgaggggccgatgggacccccaggagctcctggtctagaaggccagcctgggagaaaggggtttccagggagacccggactcgacggagttaagggggaaccaggcgatccaggaagacccggccctgtgggggagcaaggatttatggggtttattggtctcgtgggagaacctggaatagtgggggagaagggggacagggggatgatgggcccgcccggcgtgcccgggccgaaagggtccatggggcaccctgggatgcctggcggcatgggaaccccaggcgagccggggccccagggaccaccaggctcccgaggaccacctggcatgaggggcgcaaaaggaagacgggggcccaggggaccggatgggccagctggcgaacagggttccaggggcctcaagggcccgcccggcccgcaggggcgcccaggccggcctggacaacaaggagtcgctggtgaaagaggacacctggggagtagaggatttcccgggatccccggtccatctggtccgccagggactaagggtttaccgggcgagcccgggcctcaaggtccccaaggccccatcggccccccaggcgaaatgggtcctaaaggcccgccaggtgccgtgggagagcccggactgcctggcgaagccggaatgaagggagatctggggcctctcggcacccccggcgaacagggcctgatcggacagagaggggagccaggcctggagggagattccggacccatgggccctgacggactaaaaggagatagaggggaccccgggcctgacggtgagcacggagagaagggacaggaaggacttatgggcgaggatggcccccccggaccacctggagttacaggcgttcgaggacccgagggtaaatccgggaaacagggtgagaaaggtaggacaggagcgaagggagcaaagggctatcaaggccagctcggagaaatgggggtgcccggtgaccctggaccaccagggaccccaggtcctaaagggagccggggatcgctgggacccacaggcgctccaggccgaatgggagcacagggggagcccggtctggctggatacgatggacataagggtattgttggacctctgggccctccggggccaaagggagaaaagggcgagcagggcgaggacggcaaagctgagggaccacccggccctccgggggacagagggcctgtgggggaccggggcgacagaggggagcccggcgaccccggatatccaggacaagagggagtgcagggcctgcggggaaaacctggtcagcagggtcaacccgggcacccaggaccaagaggctggccggggccgaaaggtagcaagggagccgaagggcccaagggtaaacaaggaaaggccggagcccctggacggcggggagtgcagggactccagggactgcccggccctcgaggcgtggtcgggcgccagggtctggagggcatagccgggcccgacggcttgccaggtagagacggacaagccggacaacagggagagcagggggacgacggagaccctggtcccatgggccctgcgggtaaaaggggtaatcccggcgtggccggtttaccgggcgcgcagggtccaccaggctttaagggggagtctgggctgccagggcagcttgggcctcctgggaagcgaggaaccgaagggcgcacagggctccctggaaatcagggcgagcctggttcaaaaggccagcctggtgatagtggagagatggggttccccggaatggccggtctgttcggtcctaagggaccgcccggggacattgggttcaaaggcatacaggggcctcgaggccccccgggccttatgggtaaagagggcatcgttgggcccctgggaatcttgggaccctctggtttgcccggcccaaagggggataagggctccagaggagattgggggctgcagggcccaagggggcccccaggtcctaggggaaggccaggccccccaggccccccaggcggccctatccagctgcagcaggacgatttgggggcagcattccagacctggatggatacctctggagcactccgaccagaatcctattcttatccagataggctggtcctggaccaaggcggagagattttcaagactcttcactacctgtcaaacctgatccagtccatcaagaccccgctcgggaccaaggaaaatcccgcccgagtgtgccgcgatttaatggattgtgaacaaaagatggtcgacggcacatactgggttgatcccaatctgggatgcagtagcgacaccattgaggtgagctgtaattttacccatggcggacagacttgtctgaaacccatcacggcttccaaggtggagtttgctatatctcgagtgcaaatgaatttcctgcacctgctgagttctgaagtgacacaacatatcacaattcactgcctgaacatgactgtgtggcaggagggtactggacagacacctgctaagcaagcagtgcggtttcgagcttggaatggccagattttcgaagctggcggtcagttccggccagaggtcagcatggacggatgcaaggtccaggacgggaggtggcatcagactctctttacgttccgcacacaagatccacagcagctccccatcataagcgttgataacctgcctcccgcctctagtggcaagcagtaccggctcgaggtcgggcctgcctgttttttatag

SEQ ID NO: 2671 - DNA, 5604 bp, Artificial Sequence
  Description of Artificial Sequence: Synthetic coding sequence
atgggggccggctccgcgcggggggctcgcggaactgctgccgctgcagctgcaaggggagggggattcttgttttcttggatcttggtttccttcgcatgccacctggcttctacacaaggagcccccgaggatgtggatatcctccagcggctgggcctctcttggaccaaagccggaagtcccgctcccccaggtgtgatcccttttcagtctggctttatttttacacaaagagccagactgcaggccccgacaggtacagtcatcccagcagcactgggcacagagttggcccttgtcctgtcactttgctcgcaccgggtgaatcatgccttcctgttcgcggtgcggagtcaaaaacggaaactgcaattaggactgcagttcctgccggggaagacggttgtgcacctgggcagcagacgaagtgttgcctttgaccttgacatgcatgacggaagatggcaccatctcgccttagaattacgaggcagaaccgtcaccctggtcacggcatgtggccaacggagagtcccagtgctcctgccatttcaccgcgatcccgccctggatcccggtggttcttttttgtttggcaaaatgaatccccacgctgttcagttcgagggtgcgctctgtcaatttagtatctacccagtgacccaagtagcccacaactactgcacacacttaagaaaacagtgtggtcaggctgacacgtatcagagccctctaggaccgctgtttagccaggacagcggacggccctttacttttcagtctgatctggcgttgttggggctcgagaatctcacaaccgccactcccgccctgggcagtctccctgcaggacgcggcccaaggggaaccgtcgcccctgccacaccaaccaagccccagcggacgagtccgactaacccacaccagcatatggctgttggtggacccgctcaaactcctttgttacccgccaagctttcagcttctaatgctctggacccaatgttgcctgcgagtgtcggcggctctacaaggacaccgcggcccgcggctgcacagccctctcagaaaatcaccgccactaagattcccaagtcactgcctacaaaaccttcggcgccatccacctccattgtgccgataaagagtccacacccgacacaaaaaacggctccaagcagcttcacaaagtccgcactacccacccagaaacaagtcccccctacctccagacctgtccctgcaagggtgtctagaccagcagagaagccaatccaaagaaacccaggcatgcctcgccccccacctccctctacacgccctctcccccccactacaagctccagtaagaagcccatccctacattagctcgcacagaagcaaagattacctcacacgctagcaagcctgcctctgcccggactagtactcacaagccgcctcctttcaccgccctttccagcagtcctgccccaacccctggttctacacgcagcacccgcccacctgcaaccatggttcctcccacttcaggtacatcgacacctcggactgcaccggccgtgcccacccccggatccgcacccacgggttccaagaagcccattggatcagaggcatcaaaaaaagcgggacctaagtcaagcccccggaaacccgtccctttgcggccgggaaaagcagcacgggatgttcccctctcggacctcaccacaagacctagccccagacagccacagcctagccagcaaaccactcccgctctggtgctggccccagcccaattcctgtcctcaagccctagacccacctcctctggctacagcatttttcacttagctggttctacccccttccctctgctcatggggccccccggcccaaagggggattgcggactgccaggcccacctgggttgcctggcctgccgggcattccgggcgcccgcggcccacggggtccacccggaccttacgggaatccaggcctgccaggaccgccgggcgccaagggacagaaaggtgatccggggctaagtcccgggaaagcccacgacggcgcaaaaggggacatggggcttccaggcctgtccggcaaccctggcccgcctggacgcaagggccataaaggatatcctggacccgcgggccatccaggggagcagggccagcctgggccagagggatcacctggggcaaaaggataccctgggaggcagggccttccaggaccggtgggagaccctggacccaaaggcagtagggggtatatcggccttccaggactttttggccttcctggttctgacggtgagagaggtttgcccggggtaccaggcaaaagaggaaagatgggaatgccgggtttccccggcgtgtttggcgaaagagggccccccggcctggatgggaatcctggtgaacttggcctgcctggccctcctggggtccctggcttgataggcgatcttggcgtgttgggacctattggatatcctgggccaaaggggatgaagggactaatgggctccgtcggggaacccgggctcaagggggacaagggggaacaaggcgtgcccggggttagtggggatccaggattccagggcgacaaaggatcacaaggcctcccgggtttccctggggcgagaggaaagcctggcccgctggggaaagtgggagacaagggatctattggcttcccgggcccccctggtccagaggggttccccggggatattggtccaccgggggataacggtccggagggcatgaaggggaaaccgggtgctcgcggcctgcctggacctcgaggacagcttggaccggaaggcgacgagggaccgatgggccccccaggggccccaggcctcgaagggcaacctgggcgtaagggatttcccgggcgccccggcctggacggagtgaaaggcgaacccggcgacccaggtcgcccaggaccggtaggagagcaggggtttatgggattcattggcctggtgggagaaccagggatcgtgggcgagaagggtgatcgtggtatgatgggccctcctggggtcccaggcccaaaaggatcgatgggtcacccaggaatgccgggtgggatgggtacccctggagaacccggtcctcagggccctccaggaagtcgcggacctcccggcatgcggggggcaaaaggacgaaggggccctagaggtcccgatgggcccgccggagaacaggggtcacggggcctgaaggggccgccaggtccacagggtagacccgggcgacctgggcagcagggcgttgccggggagagggggcatcttggcagcagagggttccctggcatcccgggcccaagtggacctccaggaacaaaaggccttcccggtgagcctggtccacaggggcctcaggggccaatcggtccacctggtgagatgggaccaaaagggccaccaggagccgtcggtgagcctggcctgccaggcgaggcaggaatgaagggcgatctgggaccccttgggacccctggagaacaaggtcttatcggacagagaggagaaccaggattggagggggatagcggacccatgggtcctgacggcctgaagggggataggggtgatccaggaccagacggggagcacggcgagaagggccaggaggggctaatgggcgaagatggtcccccaggccccccaggcgtcactggtgtgcgtgggccggagggcaagtcaggcaaacaaggcgaaaaaggtcggaccggagcaaagggcgccaaaggataccaaggccagcttggggagatgggagtgccaggagaccctggacccccaggaacccctggcccaaaaggatcacgggggagtcttggtcctaccggagcaccaggtaggatgggcgcacagggcgaacccggcctagccggctatgatggccataaaggaatcgtgggcccacttgggccccccggcccaaagggagagaagggcgaacaaggggaggatggaaaggccgaaggcccaccaggcccccctggagaccgaggaccggttggcgacagaggcgacagaggagagcccggggatcctggataccccggccaagagggggtgcaagggcttcggggcaaaccaggccaacaagggcagccgggccacccaggacccagaggatggcccggccctaagggctcaaaaggagcggaaggaccaaaggggaagcagggcaaggcaggggcacctggacgccgtggagtacaaggcctacagggcctcccgggaccccgtggtgtggtcggacgacagggactagagggaatagccggccctgatggtctgcctggaagggatggacaggcaggccagcagggcgaacagggcgacgacggcgatcccggacccatggggcctgctgggaagagggggaatcctggagtggctggtctccctggggcccaagggcccccaggtttcaagggcgagtcgggattacctggccagcttggccctcctggaaaaagggggacagagggaaggacaggattgcccggtaatcagggcgaaccaggatccaaggggcagccaggtgattcaggggagatgggcttccctggaatggctggtctgtttgggccgaaaggaccgccaggcgatatcggcttcaagggtatccaaggaccaagaggcccccctggcctgatgggcaaggaaggaatcgtaggccccctgggcatactcggccccagtgggctccctgggcccaaaggcgataagggtagcaggggcgactgggggcttcagggaccgaggggcccccctggcccgagggggagaccaggcccccctgtcgatccaggaggaccgcgatacataccttgtttatttctggctcagcaacaagacgacttaggcgccgcatttcagacctggatggacacatcgggagctcttagaccagaatcttactcctatccggataggcttgtgttagaccaggggggagaaatctttaaaacgctccattacctgagcaatctgattcagtcaatcaagacaccgctggggactaaagagaatcctgccagagtctgtagggatctgatggactgcgagcagaaaatggtggacggaacttattgggttgatccaaatctgggctgtagcagtgacactatagaggtctcctgcaatttcacccatggaggccaaacatgcttaaaacccattacagcctccaaagtggaattcgcaatctctagggtccagatgaattttctgcacctcctctcttccgaggtcacccagcacatcactattcactgcttaaatatgacagtgtggcaggaggggacggggcaaacccccgccaaacaggcagtacgcttcagagcttggaacggccagattttcgaagctggcggccagtttagacccgaggtctccatggatggttgtaaggttcaggatggtaggtggcatcagaccctatttaccttccgcactcaggaccctcagcagctgcccatcatctctgtagacaatctgcctcctgcttccagcggaaaacaatacaggcttgaggtcggccccgcttgttttctgtag

SEQ ID NO: 2672 - DNA, 2145 bp, Artificial Sequence
  Description of Artificial Sequence: Synthetic coding sequence
ctaagctggaccaaagctgggtctcctgccccgcccggcgtgatcccatttcagagcgggtttatttttacacagagagcgagactccaagctcccacaggaactgtgattcctgctgcccttggaacagagctggcactggtcctctcattgtgttcccaccgggtcaatcatgcttttctcttcgctgttcgaagtcaaaaaaggaaactccagcttggcctgcagttcctccctggcaagactgtggtccacctgggttcacgacggtcagttgcttttgacctcgacatgcatgatgggagatggcaccacctcgctctggaactgcgggggcggactgtcactttggttactgcatgcgggcagcgtcgcgtcccagtgctgttgcccttccatagggaccctgctttggaccccggcggatccttcctgttcggtaagatgaacccccacgctgtgcagtttgaaggcgctctctgccagttttccatatatcctgtgactcaggttgcacataattactgtactcacctcaggaaacaatgtgggcaagcagacacctaccagtcccccctgggaccattgttctcccaggactcaggacggccattcacattccaatccgacttggcactccttggactggaaaacctgactaccgcaacccccgctttgggatccttacccgccggtaggggaccgagggggaccgtcgctccagcaacccctaccaagcctcagaggacctctcccactaatccacaccagcatatggccgtcgggggtccagcacagacgcctcttctccccgctaagctgagcgcatccaatgccctcgatccaatgctacccgcatccgtggggggctctactcgcacccctagacctgctgctgcccagccctcccaaaaaatcactgcaactaaaatacccaaaagcctaccaacaaaaccttccgctccaagcactagcatcgtccctatcaagtctcctcatccaactcagaaaactgctccatcgtcctttaccaagtcagcccttccaacccaaaaacaggtacctccaacgagccgcccagtacctgcgagggtgtccagacccgccgagaagccaatccagaggaatcctggtatgcccaggccaccgcctccaagcacacggccacttcccccaacaacaagtagcagcaagaagcccatccccactctggctaggaccgaggcaaaaattacgtcgcacgcctctaaaccggctagcgcccgcacctctacgcacaagccaccaccttttactgccttgagctccagcccagcccccacaccaggctccacgcggtccacccggccccccgcaacaatggtaccacccactagtggtacctctactcctcgaactgccccagctgtccccaccccagggtccgctcccacaggtagcaagaagcctattggcagcgaggccagcaaaaaggccggccctaaatctagtcctagaaagccggtgcccctgaggcccgggaaggctgccagggatgttcccctaagtgaccttacgactcgaccatctccacggcagcctcagcctagtcagcaaacgactcctgcgctggtccttgcgccagctcaattcctgagctctagtccgcgcccaacaagcagcggatatagcatttttcacttggcagggtccaccccctttccacttttgatgggtccccctggacctaagggcgattgcggtctacctggaccccctgggcttcccggcctgcccggcatacctggcgctcgtggaccccgagggccccccgggccttacgggaaccccggactccctgggcctcccggggctaagggcgatatggggctcccaggcctctctggaaatccggggccccctgggcgcaaagggttgccaggtcctgtgggcgaccccggccccaagggttcgagaggctatattggcctcccgggcctcttcgggcttccaggatctgacggagaacggggcctccctggcgtacctggtaaaagaggcaaaatgggaatgcctgtgttgttaccacagagtagtgaggcccggggggggaacagcatgccctctgagggggcattggctggtagacacggctctcatctgtag

SEQ ID NO: 2673 - DNA, 2142 bp, Artificial Sequence
  Description of Artificial Sequence: Synthetic coding sequence
atgtggaaccgctattttgtattttatctccttcttcttagcgctttcacaagtcagacggtgagcggccaaaggaaaaaaggtcccaagagcaatctactagccagaaagtctgacgtacaggggagcatttgttttatagacatcgtttttatcgtggatagttcagagtcttctaagatcgctctgttcgacaagcaaaaagactttgttgactccctcagcgacaagattttccaactgacacctggtcggtcccttgagtatgacattaaacttgccgccttacagtttagtagcagcgttcagattgacccgcctttttcgagctggaaggatctccaaacatttaagcaaaaggtaaaatcaatgaatttgatcggccaaggtaccttcagttactacgctatatccaatgcaacccgcctgttaaagcgagaaggtcgcaaggatggcgtcaaggttgtgctgctgatgacagacggcatcgatcaccctaaaaatcccgatgtccagtcaatttcagaggacgctagaatttcaggtatttcgttcatcacaatcgctctgtctactgtggttaatgaagctaagttgcgcctgatatccggggacagctcttctgaacccactcttcttctttccgatcctactctggtggataagatccaagacagacttgagatgttgtttgagatacagtgtgagcgcaaaatatgtgaatgtgaaaaaggcgatcccggggacccgggacctcccgggactcacggcaatcccgggatcaagggggagcggggccccaagggaaatcctgggaacgcgcaaaagggggaagctggcgagcgaggccctgggggcatccccggatacaaaggagataaaggggaaaggggcgagtgtgggaagcccggtatcaaaggcgataaagggtcccctggaccttatgggccgaaaggcccaaggggcattcaggggataaccggaccccccggtgaccctggaccaaaagggttccagggtaataagggtgagccaggacctccggggccatacgggtccccaggggcccctggtattggtcagcagggcatcaaaggtgagagggggcaggaaggacgtcctggggctccaggtcccatcggagtgggtgagcctggccagccaggaccacgggggcccgagggcgtgcctggagaacgggggttgcctggtgagggtttccccgggccaaagggtgaaaaaggcagcgagggacctacaggcccacagggcctgcagggtctgagtatcaagggagaaaagggcgatatcggaccagtgggtcctcagggacccatgggtatacccggcattggatcacaaggagagcaaggcatccagggccccatcggaccacccggcccccagggtcccgctggccaggggctccctggatcaaaaggagaggttgggcagatgggccccaccggtccaagaggccctgtgggaataggggtgcaagggcccaagggtgagccggggtccataggtcttccaggacagcccggagtgccaggcgaggacggcgccgccggaaaaaagggagaagctgggctgccaggcgcccgcggacctgaagggcccccagggaaaggacagcccggcccaaaaggtgatgaaggcaagaaggggagcaaaggaaaccaaggccagaggggcctgcctggccctgaaggacctaagggagaacccggcatcatggggcccttcggaatgcccggcacaagcatccccgggccacctgggcctaaaggcgaccggggcgggcccgggatccccggctttaaaggggagcctggtctcagtatcagaggaccaaaaggtgtgcaggggcccaggggcccggtgggggccccaggcctgaagggcgacggttaccctggcgtgccaggccctcggggtctgccgggccctccgggccccatgggtctgcgcggcgtgggggatacaggcgccaagactctgaatacatcacacggcctagaggacccctcctgtccagactgtagcttctgccacttttctctcgccgcagatatacagcccaaatggcccgcccttctccagctcatccctgcctccggaacgagacaagacggctag

SEQ ID NO: 2674 - DNA, 3378 bp, Artificial Sequence
  Description of Artificial Sequence: Synthetic coding sequence
atgtggaatcgttattttgttttctacctcctcctgctgagtgcctttacaagccagaccgtgagcggtcagcgtaagaaaggtcctaagtcgaacctcctcgcccggaaatcagatgtacaggggagtatttgttttattgatatcgtgtttatcgttgatagctcagagagttccaagatcgcactgttcgataaacaaaaggatttcgtcgatagcctcagcgacaagatcttccaactgacccccggacgatccttggagtacgatataaaacttgctgccctgcaattcagttcctccgttcagatagatccccctttctcaagctggaaggacctccaaacctttaagcagaaggtaaaaagcatgaacttgattgggcagggaacgttcagttactacgcaattagtaatgcaacccgcctgctgaagcgagaagggcgaaaagacggtgttaaggtcgtgttactaatgacagacggcattgatcatcccaaaaatccagatgtgcaaagcattagcgaggacgcgagaatttccggaattagctttataactattgcattaagtaccgtcgtcaacgaagccaagctcagactcatttcgggagattcaagcagtgaacctacgttgctcttgtctgatcctactcttgtggataaaatccaagataggctggacattctgttcgaaaagaaatgcgagaggaaaatctgtgagtgtgagaaaggagacccaggcgaccccggtccaccagggacacacggcaatccaggaatcaagggggagcgtggccccaagggcaatcctggtaacgcccagaagggcgaagcaggcgagcgcggcccaggaggcattcccgggtataaaggggacaaaggcgagcgcggcgagtgtggcaagccagggatcaagggagataagggcagccccgggccctatggaccaaagggtcctaggggtatacagggcattactggccctccaggggatcccggccccaaggggtttcaagggaataaaggcgagcccggtccaccgggaccctacggatcgcccggggcaccaggcattggacaacagggaatcaaaggggagcgcgggcaagagggaaggcccggagcccccggcccaattggtgtaggcgaacccggacagcccgggcctagaggtcccgagggcgttcccggagagcgcggtctccccggggagggctttccagggcccaaaggtgagaagggatctgagggaccaacaggccctcagggcctgcagggcctgtccattaagggagaaaagggagatattgggccggtcggcccacagggcccaatggggatcccaggcattggctcacagggtgaacaggggattcaggggccgattggcccccccggtccccaaggccccgctggccagggtctccccgggtccaagggggaggtgggacaaatgggaccaacagggcctcgtggccccgtaggcatcggagttcaggggccaaagggagagccagggagcattgggctcccaggacaacccggggtgcctggcgaggacggtgcagccggaaagaagggagaggcaggtctcccgggggctcgcggtccagaaggtccaccgggaaagggacaacccggaccaaagggtgatgaaggcaaaaaggggtcaaaaggaaaccagggccagcgcggcctgcctggccccgagggccccaaaggggagccaggtatcatgggcccattcgggatgcctggcacttcgatcccaggcccacctgggccaaagggggatagggggggtcccggcattcccggattcaagggtgagccaggattgtcaatcagaggacccaaaggtgtgcagggacccagggggccagttggggctccaggcttgaaaggggacggctacccaggggtgcccggtccacgaggtctacccggtccccccggaccaatgggcttgaggggggtcggggatactggcgccaaaggcgagccgggagtcagagggcccccaggcccgagtggccctcgcggcgtggggacccagggcccaaagggagacactgggcagaaaggcctgcccgggcctccaggtccgccaggatacggtagccaaggcatcaaaggggagcagggccctcagggtttcccaggccccaaagggacaatgggacacggcctgccaggccaaaagggcgagcatggggaaaggggggatgtcggtaaaaagggtgacaaaggagagattggcgagcctggatctcccggtaaacaaggactacaaggccctaagggcgatctaggattaactaaggaggagataatcaaactaatcaccgagatctgcggttgcgggccaaaatgcaaagagaccccattagaattggtgttcgtcatcgatagctcagagtccgttgggccagagaacttccagatcattaagaactttgtgaaaactatggcagatcgggtcgcactcgacctggcaaccgcgagaatcggcatcataaactactctcacaaggtcgaaaaggtagcgaatctcaagcagttcagctccaaagatgactttaagctagctgtagataacatgcagtacttgggggaggggacgtacacagcaacggctttgcaggcagccaatgatatgtttgaagacgcaagacccggggtcaaaaaagtggctctggtaatcactgatggtcagactgattcccgggataaagaaaagctgacagaagtcgtgaaaaatgcttcagatactaatgtggagatctttgtgataggggtagtaaagaagaacgatcccaatttcgaaatctttcacaaggaaatgaacctgattgccacagaccccgagcacgtgtaccagttcgacgacttttttactctgcaggacactctgaagcaaaagctgtttcagaagatctgcgaagatttcgatagctacttggtgcagatcttcggtagttcttccccgcaaccaggattcggaatgagtggggaggagttatcggagtccacgcccgaaccgcaaaaagaaataagcgaaagcctgtccgtgacaagggatcaagatgaggacgataaggcgcctgagcccacatgggcagatgaccttcccgccaccacatcaagtgaggcaaccaccaccccacgacccctcttgtcaacacccgtggatggcgccgaagatcctcgctgtctggaggctctaaaacctggcaattgtggtgagtacgtggtccgttggtattatgataagcaggtgaattcttgtgccagattttggttctcaggatgcaacggaagtggcaaccggttcaattccgaaaaagagtgtcaagaaacatgcatccaaggatag

SEQ ID NO: 2675 - DNA, 1005 bp, Artificial Sequence
  Description of Artificial Sequence: Synthetic coding sequence
atgtggaacaggtacttcgtgttttatttgttacttctatccgcattcacatctcagaccgtgtcaggacagaggaaaaaagggccgaaatctaatctgctggctcgtaagtcagatgtccaaggcagcatctgcttcatcgatatcgtgttcatcgtggattcctcggagagcagcaagattgctctgttcgacaaacaaaaggactttgtagattcactgtcagataaaattttccaactcaccccaggacgatccctcgagtatgacatcaagctagctgctctgcagttctcttcctccgtccagatagacccgccgtttagcagttggaaggatttacagacctttaagcagaaagtgaaaagtatgaacctcataggccagggaaccttctcttactatgcaattagtaacgctacccgactcctcaaacgggaggggcgaaaagatggtgtaaaggttgtactgcttatgactgatggcatcgatcaccctaaaaaccccgatgttcagtccatatcagaggatgcacgcatttccggaattagctttattaccattgctttgagcaccgttgttaacgaagctaaattaaggctgataagcggagactcatcctctgagccgaccctacttttatctgaccctactctcgtggataagatacaggatcgcctggagatgctgtttgagatacaatgcgagcgcaagatctgtgaatgtgaaaaaggcgatcctggcgatcctgggccaccaggcacacacgggaatcccgggatcaaaggggagaggggacctaagggcaatccgggaaacgcgcagaagggcgaggccggggaacgagggcccggcgggatccctggctacaagggtgataaacaatatagtcgtgaggaccgcgaagtagagcataataatgagaagtacgttgcttgcctgctacctagcccagcgctgcttcagcagagcagcctcactcaccacggtacctgttcccattag

SEQ ID NO: 2676 - DNA, 243 bp, Artificial Sequence
  Description of Artificial Sequence: Synthetic coding sequence
gccactacttcaagcgaggctaccactacccccaggcctttgctgtccacccctgttgacggggctgaagacccaaggtgtctggaagcgctgaaacctggaaactgcggtgaatacgtggtgcgttggtattacgataagcaggttaactcatgcgcccgcttttggttctccggatgcaatggatctggcaatcggtttaactcagagaaggaatgccaggagacttgtattcaaggatag

SEQ ID NO: 2677 - DNA, 1587 bp, Artificial Sequence
  Description of Artificial Sequence: Synthetic coding sequence
atggggtcttcacgagccccctggatgggacgggtgggtggccacgggatgctagcgttgctgctggcgggtttgctgctgcccgggacgctagctaaatcaataggcacgttttccgacccctgtaaggaccctacgaggataaccagtcctaacgacccttgcctgaccggaaaaggcgactcttccgggttcagttcctacagtgggtccagctctagtggaagctctatcagttccgcccggtccagtgggggaggcagctccgggagttcctctggttcaagtatcgcccaagggggctccgctgggagcttcaagccaggcactggttactcccaggtgtcctatagctccggatctggttcctccctgcaaggtgcctcagggtcttctcagctaggctcatcttcctcccattctggcagctcaggatcccactcaggctcctcctctcatagtagcagctcaagcagttttcagttcagcagctcatcctttcaggtaggaaatggttcggcccttccaacgaatgacaatagctaccgtggaatcttgaatccatcccagcctggacaatcctcttccagctcgcagaccttcggagtgagctccagcggccagtctgtgtcttcaaatcagcggccttgttcttctgacattccagacagcccatgcagcgggggcccaattgtgagtcactcagggccctacatcccaagttcccacagcgtttccggcggtcagaggccagttgtggttgtagtcgaccaacacggaagtggcgcgccaggcgtagtgcagggacccccatgcagcaatggtggcctgcccgggaaaccatgccctcctattacatcggtggacaagtcatacggaggctatgaggttgtgggcgggagcagtgattcttatctggtcccgggaatgacctatagcaagggcaaaatctatcccgtcggctactttactaaagagaatcctgtgaagggaagcccaggggtgccttcttttgcagccggaccgccaatttctgagggaaaatatttctcttcaaacccgattatcccctcacagtctgccgctagtagcgcaatagctttccagccagtgggcaccgggggtgtacaactatgtggagggggctctaccggaagcaaaggcccctgcagcccctcttcttcgcgggtaccctcgtccagctccatcagttcctcctctggtctgccataccatccttgcggcagcgccagccaatccccatgctcacctcccggaacgggatcctttagcagcagctctagttcacagtcctctgggaagattattctgcagccttgcggttccaagtcatcatcctcgggccacccatgcatgtcggtgagttccctgaccttgaccggaggccctgacggatctccacacccagatccctccgctggtgctaagccttgcgggagcagctccgctgggaagataccctgcaggtctatccgtgacattctcgcccaggtcaaacctctcggaccgcagctggccgatcctgaggtgtttctgccccagggtgagttgctggactctccatag

SEQ ID NO: 2678 - DNA, 1590 bp, Artificial Sequence
  Description of Artificial Sequence: Synthetic coding sequence
atgggaagcagccgggctccttggatgggaagggtcggaggacacggcatgatggcattactactggcaggactgctgcttccagggaccctggccaaaagtatcggcacgttcagtgacccctgcaaagacccaacccggatcacctctcccaacgatccctgtctgaccggcaaaggcgactcatccggtttctcatcatacagcgggtcgtcctcaagcgggagctcaatcagcagcgcaagatcttcagggggaggaagcagcggctcttcttctggctcgagcattgcccagggcgggagcgcaggatcctttaaacccggcactggatacagtcaggttagctacagcagtggatccggttcttccctccagggagccagtggctcgagtcagctgggttcctcttcttcccattccgggaattccggcagtcactctggaagttcttccagtcatagtagttcgtctagttcgtttcagttttcctcttcatcgttccaggtcgggaatgggtctgccctgcctacaaacgataacagttatagaggaatcttaaacccctctcagccggggcagagtagcagctcttctcagacttttggcgtgtcctcgtcagggcagtcggtgtcctcgaatcagcgtccttgctctagtgatatcccagactctccttgcagtggcggacccatagtatcacattccggtccatacatcccgagctcccacagcgtgagcggcgggcagagacctgtggtagtggtggttgatcagcacggctcgggggctccaggagtggtgcagggtcctccatgtagcaacggcggtctgccgggtaaaccgtgtccacctattacttccgtagataagagctacgggggctatgaagttgtggggggttcttcagactcttacctcgtgcccggcatgacatatagcaaaggaaagatatacccagtgggatatttcaccaaagaaaatccagtcaaaggatcgcctggcgtgccctccttcgccgccggcccccccataagcgaggggaaatacttctcctccaatcctatcatccctagccagagtgcagcctccagcgcgatcgcttttcagcccgtcggtacggggggcgtccagctctgcggcgggggatcaacaggcagtaagggcccctgtagtcccagttctagccgtgtgccttcgtcatcttccatatcctccagttcgggcctgccgtatcatccttgcggatcggcatctcagagtccctgtagcccaccaggtacggggtctttctcttccagttcttcttctcagagcagcggtaagatcattctgcaaccttgcggtagcaaatctagctccagtggacacccctgtatgagcgtgtcctcgctgaccttgactggggggcctgacggatccccacacccggacccctccgccggtgccaagccttgcggtagctcttcagcaggcaagatcccgtgcaggtccatcagggacatccttgcccaggtgaaacccctgggcccccagctagccgatcctgaagtttttttaccacagggcgagctgttaaattcaccgtag

SEQ ID NO: 2679 - DNA, 1590 bp, Artificial Sequence
  Description of Artificial Sequence: Synthetic coding sequence
atgggatcgtccagggcaccatggatgggccgggtgggcggccatggcatgatggcattgctgctagctgggctgctgctcccaggcactctagcaaaatctatcggaacattttcggacccgtgtaaggatcccaccagaatcacaagtcccaatgatccttgcttaacaggaaaaggggattcaagcggcttctcttcatattcagggagcagctcaagtgggtcctcaatctcctccgcccggtcatcagggggcggcagctctgggagtagctccggatcaagcattgcacagggaggcagcgctggtagcttcaaaccgggcaccggatacagccaagtctcctattcttcaggctccggcagttctttgcagggggccagtgggagcagccagcttggtagttcttcctcgcattcaggtagctctggtagtcacagtggcagttccagttcacacagttccagctcttctagcttccagttcagtagctcctcatttcaggtggggaatggctctgcactgccgaccaacgataattcgtatagggggatcctgaatcctagtcagcctggccagtcatctagctcatcccaaacattcggtgtctcgtcatctgggcagagtgtctcgtcaaatcagaggccttgttcttctgacattccggacagcccttgcagcggcggtcctattgtatcacattcaggaccgtacataccgtcgagtcatagtgtttccggcggtcaacgtccggttgtagtagtcgttgaccagcacggctctggagcaccgggagtggtgcagggcccaccctgttcaaacggtggactgcccggaaaaccttgtcccccgataacctccgtcgacaaaagctacggagggtacgaggtcgttggagggagctctgatagctacctggttcctgggatgacttattccaaaggcaaaatctaccccgtgggctactttactaaggagaatcccgtgaagggatcgcccggggtgcctagctttgcagccggtcctcccatatcagaaggtaagtacttttccagtaatccaataatacccagtcagtctgccgcgtcctccgcaatagcctttcagccagtgggaacaggcggagtgcagctttgcgggggcgggtctacggggagcaaaggcccctgcagcccctcaagcagtcgcgtaccttcgtctagttccatctcaagttcggccggctctccataccacccttgcggctccgcatcacagtcaccatgttcaccacccggaacgggctccttttcaagtagcagtagcagccaatcctcaggtaagataattcttcagccgtgcgggtccaaaagttccagcagtgggcacccttgcatgagtgtgagttcactgactctcaccgggggacccgacggctcacctcacccggatccttctgcaggagctaaaccatgcggttcatcaagcgctggcaaaataccatgcagatcaattagagatatcctggcccaggtgaagcccctgggcccgcagctcgcggatccagaagtcttcttgccccagggggagcttctggacagcccatag

SEQ ID NO: 2680 - DNA, 1590 bp, Artificial Sequence
  Description of Artificial Sequence: Synthetic coding sequence
atgggaagttcacgtgcaccctggatgggcagggtgggcggacatggcatgatggcactcttgctcgctggactgttgcttccagggaccctggctaagtctatcgggacgtttagcgacccctgcaaagatcccactcgcatcactagtcctaacgacccttgtcttacgggcaaaggagactcatctggattctcaagctatagcggtagcagttcctccggctcttccatttctagcgcccggtctagcggtggcgggtcctcagggagcagctctggcagctcaatagcccagggcggatctgcgggctcttttaagccaggaaccggttactctcaggtatcctatagctctgggagcgggtcaagccttcagggcgcctccggctctagccagcttggctcatcaagttctcacagcggtagctctggctcccacagcggcagtagctcatcccacagcagcagttccagcagtttccaattctcctcttcctccttccaagttggcaatgggagtgccctccccactaacgataactcctacagggggattctgaacccctctcaacctggacagtccagctcatcttctcagacattcggcgtctctagttctgggcagagtgtttcatcaaatcaacgaccatgtagcagcgacatcccggactccccctgcagcggaggccctatcgtgtcacacagcggtccctatatacccagttcccattctgtttctggcggacagcggcccgtagtcgtcgtggttgaccagcacggctcaggcgccccgggcgtggtgcaaggacctccctgtagtaatggagggctacccggaaagccttgccccccaattactagcgttgacaagtcatacggtggttatgaagttgtgggtggctcctccgattcctatttggtgcccggcatgacctactcaaagggaaagatctatcctgtcggatacttcactaaggagaatcctgtgaaagggagcccaggtgtgccatcattcgctgccggacctcctatctctgagggaaaatacttctcttccaatcccataattccatcacagtccgccgctagctccgcaattgcctttcagcctgttgggaccggaggagttcagctgtgtggaggcggatccaccggctctaagggcccctgctcaccatcctcctcacgggttcctagctccagctctatcagcagcagcagcgggtcaccttatcacccctgcggctcagcttcacaaagcccttgttcccctccaggcactgggtctttcagttcaagtagttcatcccaatccagtggtaaaataatcctgcaaccgtgtggtagcaaaagttcgtcatccggccacccatgcatgtccgttagttcgctgacactcaccggcggaccagatggaagtccacaccccgacccttccgcgggggccaaaccctgcggcagttcctcagccggtaaaattccctgcaggagcattagggacatcctcgcacaggtgaagcccctggggccacagctggccgacccagaagtcttcctgccgcaaggtgagctgttggatagcccctag

SEQ ID NO: 2681 - DNA, 1590 bp, Artificial Sequence
  Description of Artificial Sequence: Synthetic coding sequence
atggggtcttccagggccccttggatgggccgcgttggaggccatgggatgatggcccttttgctggcggggctgctgctgcctggtaccttagcaaagtcgatcgggactttttccgacccttgtaaggatccaacaagaattacctcccctaatgacccctgcctgacaggcaaaggagactcgagtgggttttcctcatattccggctcttccagctctggctcctcgatcagctctgcccgaagttcgggcggtgggtcttccggctcgagctctggctcctccattgctcaggggggtagcgccgggtctttcaagcccggaaccggatacagccaggtctcttactcaagtggatcaggatcttcgctgcagggcgccagcgggagcagccagctgggttcaagtagcagtcacagcggatcaagtgggagccactcagggagctcaagcagtcattcgagctcaagcagcagcttccaattttcatctagctcttttcaggtggggaatggctccgctctccctacaaacgataactcctatagggggatcctgaaccctagccaacccgggcaatcaagttccagttctcagactagcggcgtttcatcaagcggccagagcgttagcagcaaccagaggccctgttcaagcgatatccctgactccccatgcagcgggggacccatagttagccattctggtccttatattccttctagccactccgtgtcaggaggacagcggccagtcgtggtggtggtcgatcaacacgggtccggagcgccaggagtcgtccaaggccccccatgttctaatggcggcctgcccggaaagccctgccctccaatcactagcgtggacaaaagttatggcggctacgaagttgtggggggcagttctgactcctatcttgtccccgggatgacgtatagcaaaggcaagatttaccctgtgggatatttcaccaaagagaatcccgtaaaaggaagccctggtgtcccatccttcgcagctggcccacccattagcgaagggaaatacttctcctcaaacccaatcataccatcacagagcgctgccagctccgccatcgctttccaacccgttggaactggtggcgtgcagctttgtggtggaggctcaacaggctcaaaggggccgtgctcgccctcgagtagtagggtgccttctagcagctctataagctcatcctcaggttccccatatcacccgtgtggaagcgcaagccagagcccctgttcaccgccgggcacgggaagcttctcttcttcaagcagcagtcagagtagtggaaaaattattctgcagccatgtgggagtaagtcctcatcttccgggcatccttgcatgagtgtgtcaagtctgaccctgactggcggcccggacggaagtccccatcctgatccttccgcaggggccaagccctgtggctcctccagtgcagggaaaataccgtgcaggtcgatcagggacatcctggcccaggtcaaaccgctgggcccccaactggccgatcctgaagtattcttaccgcagggcgagctgttggattccccatag

SEQ ID NO: 2682 - DNA, 1590 bp, Artificial Sequence
  Description of Artificial Sequence: Synthetic coding sequence
atgggctccagtcgtgctccatggatgggtagggtgggaggccacggtatgatggcacttctcctcgccggactgctgcttccagggaccttagccaaatccatagggacattctctgatccctgtaaagacccaacgcggattacttcccccaacgatccatgccttactggtaagggcgacagttctggcttttctagttacagcggctcctcgagctctggcagctctatttcttctgcccgaagttcgggtgggggcagcagcggcagttcgagcgggagtagcatcgcccaaggaggtagcgctggatccttcaagcccggtactggatactcacaggtcagttatagtagcggctccggctctagtttgcagggggccagcggctcctctcagcttggcagctcgtcaagccacagcggctcaagcgggagccactcgggctcctcttcctctcattctagcagcagctccagcttccaattctcctcttcaagctttcaggtgggcaacgggtcagctcttcctaccaatgataactcttacagaggaatcctgaaccctagtcaacctggacagtcctcgtcgtctagccagactagcggagtttcttcgtcagggcagtcagttagctcaaaccagcggccgtgctcttccgatatccccgattccccctgctctggggggcccatcgtgagtcactccggaccgtacatcccatcaagccattcagtctctgggggtcagaggccagtggtagtggtggtggatcagcacgggtcgggagctcccggggttgttcaggggcctccttgcagtaatggcggcctccccggcaaaccatgtccccctataacctcagtggataaatcatatggagggtacgaagtcgtaggagggtcctccgattcctacctggtcccaggtatgacatattccaagggcaaaatttatccagtcgggtattttaccaaggagaatccggtgaaggggtccccgggggttccctcattcgctgcaggtccaccaataagcgagggcaagtatttttcctccaaccccattatacccagccagtccgccgctagtagtgctatcgctttccagcccgttggcaccggtggagtgcaactgtgcggtggaggctccaccggttcaaaggggccttgttctccttctagctccagggtgccctcttccagcagcatttcctccagttcagggtctccctatcacccatgtggctcagcttcccaatccccctgctccccccccgggacgggcagcttctcgagctcctcttctagtcagagttccgggaaaataatccttcagccgtgcggttcaaagtcttccagttccggccacccctgtatgagtgtgagctcgctcactctgacaggcggtccagatggaagtccccaccccgacccttcagcaggtgccaagccttgtggcagtagttccgcaggtaagatcccctgtagatctattagagatatcttagcccaggtgaagccactgggtccgcagctcgccgaccccgaagtctttctgccgcagggggaactgctggatagtccatag

SEQ ID NO: 2683 - DNA, 255 bp, Artificial Sequence
  Description of Artificial Sequence: Synthetic coding sequence
gtcttgcactcatttactgacgccatatttgatgaatggatgaagcgcttcaatcctcccgcggatgcatggccacaagagttagccccaattggccacaatcgcatgtacaacatggttccattctttcccccagtgaccaatgaggagctgtttctgacctcggatcagctgggatattcgtacgccatagatcttcccgacttccaggccaatttcatatgtagctatctggtgtccgttcatcaggaatag

SEQ ID NO: 2684 - DNA, 1560 bp, Artificial Sequence
  Description of Artificial Sequence: Synthetic coding sequence
atgtccccgctttggtggggcttcttgctgtcttgtctcggctgtaagatcctgccgggcgctcagggccagtttcctcgggtgtgcatgaccgtggattcattggtgaacaaagagtgttgcccccggctgggcgccgagtccgcaaatgtctgcggttctcagcaagggaggggtcagtgtacagaagtgcgtgctgatacgcgcccttggtctggtccctacattctccgtaatcaggatgatagagagctgtggcccagaaaatttttccacaggacttgtaaatgcaccgggaactttgctggctacaactgtggggactgcaagtttggctggacggggcccaattgtgaaagaaagaagccacccgtcataagacagaacattcacagtctctcaccgcaggagcgagaacagtttctgggggccctggacctggctaaaaagcgggtgcatcctgattatgttatcacaactcaacattggcttggcttgctgggccccaacggaactcagccccagtttgccaactgttctgtctacgacttctttgtctggctccactactattcggtgagagacaccctgctcggacctggcaggccatatcgtgcgattgacttctctcaccaggggcccgcatttgtaacatggcaccgctaccacctgttgtgcctggaacgtgacttacagaggttaattggcaacgagagttttgcccttccctattggaactttgctactggtcggaacgagtgcgacgtttgcacagaccagctgtttggggctgccaggccagacgatccaactcttatctcgcgaaacagtagattctcttcttgggaaaccgtttgtgatagcctggatgattataaccacctggtaacactgtgtaacggcacctatgagggcttgctgcggcgcaaccaaatgggacgaaactctatgaaactgcccacactaaaggacatccgggattgccttagtctgcaaaagttcgacaaccctcccttctttcagaactctacatttagcttccgaaatgccctcgagggatttgataaggccgatggcacactcgatagtcaagtgatgagccttcacaatctggttcacagcttcttaaacggcactaatgccctgccccatagcgcagccaacgacccaattttcgtcgtgcttcactcctttactgacgccatcttcgacgagtggatgaagcgctttaatccacctgctgacgcatggccgcaggagctcgcaccaattggtcataataggatgtacaatatggttcctttctttccacccgtgactaacgaagagctttttttgacttctgaccagctcgggtacagctacgcaatcgatttacccgtctctgtcgaggagaccccgggatggcccacgactctgttggtggttatgggcaccctggtagctctggtgggtctgttcgttctcttggctttcctacagtatcgtcgcttgcgcaagggatatactccactgatggaaacccatctgtcaagtaagagatacaccgaggaggcctag

SEQ ID NO: 2685 - DNA, 1659 bp, Artificial Sequence
  Description of Artificial Sequence: Synthetic coding sequence
atgagccctctgtggtgggggttcctgctgagctgcctcggatgtaagattcttccaggtgcacagggccagttccccagagtatgtatgacagtcgacagcttggtcaacaaggagtgctgcccccgactgggtgccgagtctgcaaatgtgtgcggctctcagcagggaagaggccagtgcacggaggtacgggccgatacacgcccctggagcgggccctatattctccggaaccaggatgatagagaattgtggccccggaagttctttcacagaacctgcaagtgtaccggcaactttgctgggtataactgcggtgactgtaagttcggttggactggacccaattgtgagcggaaaaaaccccctgtcatccgtcaaaacatccacagcctttctcctcaagagagagaacagtttctgggtgcattggatctagcaaagaaacgggtacaccccgactacgtgatcacaacccaacactggctcggcttgctggggccgaacggaacccagccgcaattcgctaattgcagcgtgtatgactttttcgtctggctgcactattattctgtacgcgacactctgctcggccccggccgcccatatcgcgcgattgacttctctcaccaggggcctgcctttgtcacatggcatagataccacctgctgtgcctcgagagggacttacaacgcctgattggaaatgaaagcttcgccctaccatattggaacttcgccacggggaggaacgaatgtgatgtatgcacagaccagctttttggtgcagcccggccagacgaccctaccttaatctcgcgtaattcgcggttcagctcttgggaaaccgtgtgcgactcgttggatgactataaccatcttgtcactctgtgcaacggcacctatgagggactcctgagacgcaaccagatggggcggaattccatgaaacttccaaccctcaaggatatcagagactgcctgagcctgcagaaatttgacaaccccccattctttcagaactcaaccttttcatttcggaacgcccttgaaggctttgacaaggcagacgggaccttggatagtcaggtcatgagtcttcacaatctggtgcattcctttctgaacggtacaaatgctttaccacactccgccgctaatgaccctatattcgtagtgatttccaaccgcctcctttataacgcaactaccaatatcctcgaacatgtgcggaaagaaaaagccacaaaggagctcccttcattgcacgtgctggtgctccattccttcactgacgctatatttgatgaatggatgaagaggttcaaccctcccgccgatgcctggccccaagaactcgcaccgattgggcacaaccgtatgtacaatatggtgcctttcttccccccggttacaaatgaagagctgttcctcactagcgaccaattgggatattcttacgctatcgatctacccgtaagcgtggaagaaacacctggctggcctacaacacttttggtggtaatggggaccctggtcgccctggtggggctgttcgtgttattggctttcctccagtatagacgcttgcgtaagggatacaccccactgatggaaacccacttgagttcgaaacgctataccgaagaggcctag

SEQ ID NO: 2686 - DNA, 1347 bp, Artificial Sequence
  Description of Artificial Sequence: Synthetic coding sequence
atggcacacgtgggtgattgcacccagacgccatggctgccagtgttggtcgtttccctcatgtgttcagcgcgggccgaatactcaaactgtggcgagaacgagtattacaaccagacgaccggcctctgccaagagtgccccccatgcggccctggcgaggaaccctatctcagttgcggctatggcaccaaggacgaggactatggctgtgtgccctgccccgcagagaagtttagtaaggggggctatcagatctgtaggcggcataaggattgtgagggtttcttccgagccactgtcctcactcccggcgacatggagaacgatgcagaatgtgggccttgtttaccaggctactatatgcttgagaataggcctagaaacatctacggaatggtttgctattcgtgtctgctagcccctccgaacaccaaagagtgtgtgggggccacgtccggggcatctgcgaactttcctggtacatcaggatcaagtaccctctctccgtttcagcacgcacacaaggagctgtcagggcaaggacacctagcaactgcgttgatcatagccatgagtacgatctttattatggcgatcgcgattgtacttattattatgttttacatcctgaaaacaaagccttcagctcccgcttgctgtacgtcccatcccggcaaatccgtagaagctcaagttagcaaagatgaggagaagaaggaagcccccgacaacgttgtgatgtttagcgagaaggacgagtttgagaaactgacagctactccagccaaacccaccaagagcgaaaacgacgcatcctcagagaacgaacagctgctcagccgttcggtagactccgacgaggagccagctcctgacaaacagggaagtcctgagctgtgtctcctgtctctggtacatctggctagagagaagtctgccacttccaataagagtgctggtatacagtctcgacgtaagaagattctcgacgtatatgcaaacgtgtgtggcgttgtggagggcctctctcccacagagcttccctttgattgtttggagaagaccagtcgcatgctctctagcacgtacaattcggagaaagctgtcgtcaagacttggagacacctggccgaatccttcggcctgaagcgggatgagattggtggcatgacggatgggatgcagctcttcgacagaattagtaccgccggatacagcatccccgagctgctgaccaagctcgttcaaattgagcgcctggatgccgttgagtccctgtgcgccgatatcctggagtgggcaggtgtggtccccccagccagccaaccccatgccgcttcctag

SEQ ID NO: 2687 - DNA, 1443 bp, Artificial Sequence
  Description of Artificial Sequence: Synthetic coding sequence
atggctcatgtaggcgactgcacacagacgccctggttgccagttctggtcgtgagtttgatgtgtagcgccagagcagagtactccaattgtggcgaaaacgagtactacaaccagaccaccgggctctgtcaagaatgccctccctgcggtcctggagaggagccgtatctttcatgtggttatgggacaaaggatgaggattacggctgtgtgccttgtcccgcggagaagttttctaaaggcggatatcagatatgccggcggcacaaagattgtgaaggattctttcgtgcaacagtactgaccccaggtgatatggagaacgacgccgagtgcggaccatgcttgcctggatattatatgctcgaaaacaggccacgaaatatctatgggatggtatgttactcttgtctgcttgcgcctccaaacactaaggagtgcgtcggtgccacatccggggcgagtgccaactttcccggaacaagtgggtccagtacgctctccccatttcagcatgcacacaaagagcttagtggtcagggacacctggccacagccctgatcatcgcgatgtcgactatattcattatggccattgctattgtcctgatcatcatgttttacattttgaaaacgaagccatcagctcccggcgatggaccccacgcccccgtgccttgctttctggacagtccgagcacaccccccgtcggcgagcccgggtgctcattgcctccactaagccccgcatgctgtacatcccacccagggaagtccgtcgaggcccaggtgagcaaagatgaggagaagaaggaagcccccgataacgtcgtgatgttctctgagaaggatgagtttgagaagcttaccgcaacgcccgccaaaccaaccaaatcagaaaacgatgcatcaagtgagaatgaacaactgctgtcaaggtcagtggattcagacgaggaaccagcgccagacaaacagggctcccccgagctgtgcctgctgtctctggtgcatctcgctagagaaaaaagcgccacaagcaacaagtcagctggcatccaatcccgccggaaaaaaatcttagacgtctatgccaacgtgtgtggagtggtggaggggctgagcccaaccgagttacctttcgattgtctggagaagaccagtcggatgctttcctctacatacaattcagagaaagccgttgttaaaacttggcgtcatctggcggagagcttcgggctcaagagagatgaaatcggagggatgacggacgggatgcagctgtttgatcgcatctccacagcgggttatagcatcccagaactcctgacgaagttggtccaaatagagagacttgacgccgttgaatcactctgtgcagacatcctggaatgggctggtgttgtcccccccgccagccagcctcatgctgcgagctag

SEQ ID NO: 2688 - DNA, 1443 bp, Artificial Sequence
  Description of Artificial Sequence: Synthetic coding sequence
atggcccacgtcggcgattgcactcagaccccctggctgccagttctggtcgtgagtctaatgtgctctgcgagagccgaatactcaaactgcggagagaacgaatactataaccagacaaccgggctctgtcaggagtgccccccatgtggccctggcgaggaaccttacctgtcttgcggttacggaacgaaggatgaggattacgggtgcgtaccctgccctgccgagaaattctccaaaggcggctatcagatatgcaggaggcacaaggactgtgaggggttttttcgggccaccgtgttgacccccggtgatatggaaaatgatgctgagtgcgggccatgcctgcccggttactacatgctggagaacaggcctcggaatatctacgggatggtttgttacagctgcctgctggcaccccccaacacgaaggagtgtgtaggagccacctcaggcgcttctgcgaacttcccgggcactagtgggtcctcaactctgtccccctttcagcacgcccacaaggagctgtctggccagggacatctggcaactgcattaatcatcgcaatgagcacaattttcataatggccattgctatcgttttgataatcatgttttatatcttgaagacaaagccatccgcccccggcgacgggccacacgcccccgtgccctgtttcctggacagcccaagcactccccctgtgggcgagcccggctgtagtttgcctccattgtcccctgcctgctgcactagccacccgggcaagagtgttgaagctcaggtctccaaggatgaggagaaaaaggaagcgcccgataatgtggtgatgttctccgaaaaggatgagtttgaaaagctgacggcaaccccagcaaaacctactaaatctgagaatgacgcctcttccgagaacgagcagctgttgtcccgaagcgtggactctgacgaagagccagcccctgacaaacagggttcgccagagctgtgcttactgtcgctcgtgcatttggcgagggagaagagcgccacaagcaacaaaagtgcaggtattcagtcccggcggaaaaaaatcctagatgtttatgccaatgtatgcggtgttgtagagggactgtctcctacagagctgccgttcgattgcctcgaaaagaccagtcgaatgctatcgtcaacctataattccgaaaaggctgtggtgaaaacgtggaggcatttggccgagagctttggtctgaaaagagatgaaatcggcggaatgaccgatggtatgcagttgttcgatcggattagcaccgcgggctacagcattcccgaattgctgaccaaactggtccaaattgaacgactggatgctgtagaaagcctgtgcgccgacatccttgagtgggctggagttgtgcccccagcctctcagccccatgccgcctcttag

SEQ ID NO: 2689 - DNA, 957 bp, Artificial Sequence
  Description of Artificial Sequence: Synthetic coding sequence
atggattgtcaggagaacgagtattgggaccagtgggggcggtgtgtgacttgtcaaagatgcggccctggccaggagctctccaaggactgcggctatggggaaggaggtgacgcttattgcaccgcgtgtccgccaagaagatataagtcctcttggggtcaccaccggtgtcagtcctgtatcacgtgcgccgtgattaatcgagttcagaaggtgaattgcaccgcaacaagcaacgccgtctgcggagactgccttcctagattctataggaaaacacgaattggcggcctgcaggaccaagaatgcatcccctgcacaaagcaaacacctacaagcgaggtgcaatgtgcttttcagctgtccttagtagaagcagatacgcctactgttcctcctcaggaggccacactcgtggccctggtgtcatccctcctagttgtgtttaccctagcttttctggggctatttttcctgtactgtaagcagttctttaatcggcactgccagagggagaagctgatcatcttctcagatcccgtgcctgccagcctcaatctgattccagagtttgcaggcggtctgcttcaattcgaggcggacaaaacggccaaggaagagagcttgttccctgtgccgccttctaaagaaaccagcgccgagagtcaagtgtccgagaacattttccaaacccagccactgaaccccattctggaggacgactgctcctcgacaagcggatttcccacacaggagtcatttactatggcctcctgcacctctgagagtcattcccactgggtccattccccgattgagtgcactgagcttgatctgcagaagttctcctcaagcgcatcatacaccggcgcagagacattgggaggcaacaccgtcgagtcaacgggagaccgcctcgaactcaatgttccattcgaggttccctcaccttag

SEQ ID NO: 2690 - DNA, 894 bp, Artificial Sequence
  Description of Artificial Sequence: Synthetic coding sequence
atggattgtcaggagaatgagtattgggaccagtggggccggtgcgtcacctgtcagagatgtggtccagggcaagagctttcaaaagattgcggctatggcgaggggggcgatgcctattgtaccgcttgtcctcctaggcggtacaagtcctcttgggggcatcacagatgtcagagttgcattacatgtgccgtgattaatagagtacagaaggtcaactgtacagccaccagcaatgccgtgtgtggggattgtctcccacgattctaccgcaaaacacgcattgggggcctgcaggatcaagaatgcataccatgtaccaagcagactcccacatcagaggtccagtgtgctttccagctaagccttgtcgaggccgacacacccaccgtcccaccccaggaagctacgttggtggctctggtgtcttccctgttggtggtgttcactctggcctttctgggcctgttctttctgtactgcaagcagtttttcaatagacattgtcagaggggcggcttgctgcagtttgaagcagataagacagcaaaagaggaatcactctttcccgttcccccttcgaaagagacctccgcagaaagccaggtctcagagaatattttccagactcagccgttaaatcccatcctcgaggatgattgttcatctacaagcggcttccccactcaggaatctttcaccatggctagttgtacatccgagagtcattcccattgggtgcattctcccatcgaatgtacagagctcgaccttcagaagtttagttcgtccgcttcatacacaggcgctgagactctgggtgggaatacagttgaatctactggcgatcgtctagagttgaacgtccccttcgaggtacccagtccctag

SEQ ID NO: 2691 - DNA, 894 bp, Artificial Sequence
  Description of Artificial Sequence: Synthetic coding sequence
atggattgtcaggaaaacgagtactgggatcagtggggaagatgtgtcacatgtcagcgttgcggcccgggccaggagctgtcaaaggattgtgggtacggtgagggaggggacgcctattgtaccgcctgtccgccccggcggtataaaagtagctggggccaccatcgctgccagtcctgtataacttgcgctgtgatcaatagggtgcagaaagtcaactgcaccgcgacctctaatgccgtgtgtggagattgcctgcctcggttttacagaaagacgcgaattggtggattacaagatcaagagtgcatcccatgcaccaaacagacacccactagtgaagtacaatgtgcattccaactgtccttagtggaagccgacacgcctaccgttcctccacaagaggccactcttgtcgctctagtgagtagccttctggtcgtttttactctggctttcctcggcttatttttcctgtactgcaaacagtttttcaaccgacactgccagagagggggcttgctccagttcgaagccgacaaaactgccaaagaggagtccctcttccctgttccaccaagtaaagagacctctgcagaatctcaagtaagcgagaacatcttccaaacacagcctcttaacccaatcttggaggacgattgtagcagcaccagcgggtttcccacccaggaatcattcacaatggccagctgcacgagcgagtctcattcacactgggtccactcacctatcgaatgcacagagctcgacctccagaagttttccagctcagcctcctatactggtgccgaaacacttggaggcaacactgtcgaatccactggcgatagactggagctgaacgtgcccttcgaagttcctagcccctag

SEQ ID NO: 2692 - DNA, 957 bp, Artificial Sequence
  Description of Artificial Sequence: Synthetic coding sequence
atggactgtcaagaaaacgaatattgggaccagtggggtagatgcgtgacctgccaaaggtgcggccctggccaggaactgagtaaggattgcggctacggagaggggggagacgcctactgtaccgcttgccctccacgacgttacaaatctagctggggccaccacagatgccagtcttgcattacgtgtgccgttattaacagagtccaaaaggtcaactgcacagccacgagcaatgccgtgtgcggtgattgccttccccggttctacaggaaaactagaattggcgggctgcaggatcaggaatgtattccgtgcaccaaacagacaccaacctcggaggtacagtgtgccttccagttgtcccttgtagaggccgacactcctacagtcccgcctcaggaggctaccctcgttgctctggtgtcctcactcctcgtcgtttttaccctggcctttctggggctgtttttcctgtactgcaaacagtttttcaatagacattgtcagagagagaagctgatcatatttagtgatcccgtaccagcttccctcaatttgattccggagttcgccgggggacttcttcagtttgaagccgataaaactgccaaagaggagtcacttttccctgttcccccctccaaagaaaccagcgccgagagccaggtttctgagaacatcttccagacccagccactaaatccaatactcgaggatgactgttcgagcacctccgggttccccacccaagagtctttcaccatggcctcgtgcacatccgaatctcactcccactgggttcatagcccaatagaatgcaccgaacttgatctccagaaattttctagtagcgcctcctacaccggagctgagacactcggcgggaataccgtagagtcaaccggtgacagactggaactaaatgtgccatttgaagttccgagcccttag

SEQ ID NO: 2693 - DNA, 522 bp, Artificial Sequence
  Description of Artificial Sequence: Synthetic coding sequence
atgtcaacaggaaccaatggtgacggcgtctcccccgctaatggcgtggtgctggaccggagttaccctcgctgtctccctgtggagcttagcgggggaaggtacacgcattccgcgccatccgggggacacacttgttgtacaggcggcctattacagtttgaagccgataaaactgcaaaagaggaaagccttttcccagttcctccctctaaggaaacttctgctgagtcgcaagtcagcgagaatatcttccagactcagccgttaaatcccatattagaagatgattgcagctccacttctgggttccctacacaggagtccttcacaatggcatcctgtaccagtgagtcccacagtcattgggttcattccccgatagagtgcaccgaactggatctgcaaaagttctctagctccgcttcttacaccggtgctgaaaccttgggcggtaatacggtggaaagtactggagacaggctagaactaaatgtcccctttgaggttccttctccatag

SEQ ID NO: 2694 - DNA, 894 bp, Artificial Sequence
  Description of Artificial Sequence: Synthetic coding sequence
atggattgccaggagaacgaatattgggatcagtgggggcgatgcgttacctgccagcgctgtggtcctggccaggagttaagcaaggactgcggctacggcgagggcggtgatgcatattgcacagcctgtccacccagacgctataagtcctcctggggccaccaccgatgccagtcttgcataacttgcgctgtaatcaatagagtgcaaaaagtcaattgtactgccaccagtaatgctgtgtgcggagactgtctgccaagattctaccggaaaacccgaataggaggattgcaggatcaggagtgtataccctgcaccaaacagacacctacctcggaagtacagtgcgccttccagctgtctctcgtagaggctgacactccgaccgttcctcctcaagaggccacactggtcgccctcgtaagctcactcctggtagtgttcacgctggctttcctcgggctgtttttcctgtactgtaaacagttctttaaccgtcactgtcagcgcggtgggttgctgcagtttgaggctgacaagaccgctaaagaagaaagcctctttcccgttcctccgtcaaaggagacaagcgcagaaagtcaggtctccgagaatatatttcagacacagcccctgaaccctatcctggaagatgactgcagctccacaagcggattcccaacccaggagtctttcaccatggcctcgtgtacatcagagtcacattcccattgggttcactcgcccattgagtgtaccgagctagacctgcaaaagttttctagtagcgcctcctacacgggggcagaaaccctcggagggaacaccgtcgagagtacaggtgaccgcctggagcttaacgtgccctttgaggtccccagcccctag

SEQ ID NO: 2695 - DNA, 648 bp, Artificial Sequence
  Description of Artificial Sequence: Synthetic coding sequence
atgggcttgcgcacaacaaaacagatgggccgggggacaaaagcccccggccaccaggaggaccacatggtgaaggagccagtggaggacaccgacccctctactttatcattcaacatgtcagacaagtacccgatacaggacacagaattgccgaaggctgaagagtgcgacaccattacgctgaactgccccaggaactctgacatgaagaatcagggcgaggagaacgggttccccgatagcacaggcgaccctcttcctgaaattagtaaagataattcctgtaaagaaaactgtacctgttcaagctgcctgctccgcgcccccactatctcagacctcttgaatgaccaggacctgctggacgtgatcaggatcaaactggacccttgtcaccctaccgtaaagaactggagaaattttgcgtccaaatggggcatgtcttacgacgaactttgcttcctagaacagcgccctcagagcccaacgcttgaattcttactgagaaatagtcaacgtactgtgggccagctcatggagctgtgtcgcctgtaccatcgcgccgacgtggaaaaggttctccgcagatgggttgacgaagaatggcctaagagagagaggggggacccatctcgacacttttag

SEQ ID NO: 2696 - DNA, 618 bp, Artificial Sequence
  Description of Artificial Sequence: Synthetic coding sequence
atggccagtcctgacgaccccctgagggctgatcacatggttaaagagccagtggaagatacagatccctccacactcagcttcaacatgagcgacaagtatccaatccaggacaccgaactgcctaaggcagaggaatgtgatactatcaccctgaactgtccacggaactccgacatgaaaaaccagggcgaggaaaacggattccctgattccaccggcgaccctctgcctgagatctcaaaggataatagctgtaaagagaattgcacgtgtagttcatgtctgctgcgagcgccaacgatcagcgatctcctgaatgaccaggacttactggatgtgatccgcattaaactggatccctgccaccctacggtaaagaattggaggaatttcgccagcaagtggggcatgagttatgacgaactttgcttcctggagcaaaggccccagagccccacgctcgagttcctattgaggaacagccagcggaccgtgggccagctgatggaactgtgcagactgtatcaccgcgccgatgttgaaaaggtgctaaggaggtgggttgatgaggaatggcccaaaagggagcggggcgaccctagtcgccatttctag

SEQ ID NO: 2697 - DNA, 255 bp, Artificial Sequence
  Description of Artificial Sequence: Synthetic coding sequence
atggtgaaggagcccgtagaagacaccgatccatctacgctttcattcaacatgagcgacaaataccctatacaggataccgagctgcccaaagccgaagaatgtgacaccattaccctcaactgcccaaggaatagtgacatgaagaatcaaggcgaagagaatgggttcccagattccactggtgacccactgcccgaaatttcaaaagataattcttgtaaagagaattgcacatgcagctcctgcctttag

SEQ ID NO: 2698 - DNA, 2175 bp, Artificial Sequence
  Description of Artificial Sequence: Synthetic coding sequence
atggcagggctgaccgccgccgcacctcggcccggtgtcctcttgctcctgctgagcattctgcacccttctagacccgggggagttcccggcgctattccaggcggagtgccaggaggagtgttctatcccggggccggcctgggggccctcggcggcggagctctcgggccaggaggaaaacccctaaagcccgtccccggcgggctggctggtgcaggtctgggggccggactcggagccttcccggccgtcacattccccggggcactagtcccgggtggcgtcgccgacgccgcggcggcttacaaagcggctaaggccggcgcgggcctgggcggtgtaccaggcgtggggggtcttggcgtgtcagcaggtgcagtggtgccacagcctggagccggcgtcaagccagggaaggtgcctggtgtgggactccctggggtgtatcctgggggcgtgctcccgggagctagatttccgggggtgggggtcctccctggtgtgcccacaggcgcgggcgtaaagcccaaagctcctggtgtggggggcgcatttgcagggatcccaggcgtggggccgttcggaggtccccagcctggagtgccccttggatatcccataaaggctcccaagctgcctggcggttatggcctcccgtatacgacgggcaaactgccttacggatatggacccgggggggtggctggcgcggctgggaaggctggatatcccactgggaccggcgtgggtccgcaggctgccgccgctgcggcggcaaaggcggccgcaaagttcggggcaggggccgctggtgtgcttcctggggtcggtggagccggcgtgcccggtgtgccgggggcaatccctggaattggaggaatcgccggcgtgggcactcccgcagcagctgccgctgccgcggcagctgccaaagcggcaaaatacggagccgcagccggcctcgttccaggcggacccggcttcgggcctggcgtcgtgggcgttcctggcgcaggcgtcccaggagtcggtgtgcccggcgccgggatccccgtggtgcccggcgccggcattcctggcgcagccgtgccgggagtagtgtcccccgaggctgctgccaaggctgccgcaaaggcggcaaagtatggagcccgaccaggcgtgggcgttggcgggatccctacatacggggttggagctggcgggttccccggcttcggcgtgggcgtgggaggcatcccaggtgtggccggggtgcctggcgttggcggtgtgcccggagtgggaggggttcctggagttggaatctcccccgaagctcaggctgcagctgctgccaaagcagcaaagtacggcgttggcacccctgcagcagcagccgcaaaggccgcagcaaaggcagcacagttcggcctggtgcccggagtcggtgtggctcctggcgtcggcgtcgcacccggcgtaggcgtagctccgggggttggattggctcctggtgtgggggtggccccaggagtcggtgtggcaccgggagttggagtagctcccggcattgggcctgggggagtggcagcggctgccaagtcggccgcgaaggtggcagctaaagcccaacttcgggccgccgcaggcttgggtgctggcattccaggcctaggcgtgggagtgggagtcccaggactgggagtgggggcaggcgtgcctggactcggagtgggtgccggcgtgcctgggttcggagccgtgcccggtgcccttgctgccgccaaggcagcgaaatatggcgccgccgtcccgggagtcctagggggattaggcgccctgggcggcgtgggcatacctgggggtgtggtgggagctggtccggcggccgctgctgcagccgccaaggccgctgctaaggcagcccaatttgggcttgtgggcgccgccggcttaggcgggctcggagtgggcgggcttggagtgccgggagtgggggggctggggggtattcccccagccgcggcagcgaaggcagctaagtatggtgcagccggactgggtggcgtgcttggcggagctggtcagttccccctgggtggtgtcgcagcccggccaggcttcggactttctcccatttttcccggcggcgcttgccttggaaaagcatgcggccgaaaacggaagtag

SEQ ID NO: 2699 - DNA, 2274 bp, Artificial Sequence
  Description of Artificial Sequence: Synthetic coding sequence
atggcagggctgaccgctgctgcccctagaccaggagtcctgctgctcctgctgagcatattgcacccctcgagacccggaggtgtacctggagccataccaggtggtgttcccggcggcgtgttttatccgggggctggcttgggagctcttggaggcggggccctgggaccgggaggaaagcctctaaagcccgtgcccggtggtcttgctggcgccggtttaggagccggacttggagctttccctgccgtaacattccctggcgctctcgtgcccggcggcgtggccgatgccgccgccgcatataaagccgccaaggccggtgcaggcctaggtggggttcccggcgtggggggactgggcgtctccgcaggcgctgttgtgccccagccaggcgccggtgtgaagcctggaaaggtcccaggtgttggtctcccgggcgtgtatccaggtggtgtactccctggagcaagatttcctggggtgggtgtgttaccaggcgtgccaacaggcgctggggtcaagcccaaagcacctggcgttggtggagccttcgccgggattccgggggtgggcccctttggcgggccacaaccaggggttcccctggggtatccgattaaggctcctaaactgcccggtggctatgggctcccatatacgacaggtaagctgccctacggatacggtcccggcggagtggcaggggcagctgggaaggctggctatcccaccggtactggggtggggccgcaggctgccgccgctgcagcggctaaggccgcagctaaattcggcgccggggccgcgggcgtactgcccggagtagggggggccggtgtccctggggtgcctggagcgattccgggaatcggagggattgctggtgtgggaactcccgcagccgcggcggctgcagcagctgccgctaaggcggctaaatatggagccgccgccgggctcgtgcccgggggacccggcttcgggccaggagtggtgggtgtacccggtgctggagtgcctggcgtgggcgttccaggcgctgggattccggttgttcctggcgctggcatccccggggccgccgtgcccggagtcgtgagccccgaagccgctgccaaggccgcagcgaaggctgccaagtacggagcaaggcctggagtcggtgttggcggaattccaacgtacggggtgggagctggagggttcccggggtttggcgtgggggtggggggcattcccggggtggctggtgtgccaggtgtcggcggtgtgcccggggtggggggtgttcctggcgtgggaatatctcccgaggcccaggctgccgctgcggccaaggctgctaaatacggagttggcacacccgccgccgcagccgccaaggctgccgcaaaagctgcacagttcgggctggtacctggagtcggggttgctcctggcgttggggttgcgcccggagtcggcgttgcaccgggagtgggactcgcacccggtgtcggcgtggcccctggggtcggggtagctccaggagtaggcgttgcgccgggcatcggccctggcggggtcgccgccgctgccaagtctgctgccaaagtggcagctaaagcacagttgagggcggctgcaggtctgggcgcaggaattccagggctcggcgttggcgttggcgtaccaggcctgggcgtgggggcaggtgtaccaggattaggagtcggcgccggagtccctggcttcggagccggggccgatgagggcgtccggcgctcccttagtcctgagttacgggagggcgatccctctagctcccagcatctgccaagcaccccctcaagtcctcgcgtgcctggcgccctggctgccgccaaagccgcgaagtacggggccgcggtccctggcgtgcttggtggcctcggcgccctgggtggtgtgggaatccccggcggcgtcgtcggagcaggccctgcggccgctgcggctgcagcgaaggctgcagccaaagctgctcaattcggtctggtcggcgccgcgggtctgggtggtctaggtgtcggaggcctcggagtgccaggcgtgggggggttaggcgggattccgccggctgccgccgccaaggcagccaagtatggtgccgcaggtttgggcggagtgctggggggggcagggcagtttcctctgggcggcgttgccgctaggcccggattcgggctcagtccaattttccctgggggcgcctgccttggcaaggcttgcggccggaaaagaaagtag

SEQ ID NO: 2700 - DNA, 2136 bp, Artificial Sequence
  Description of Artificial Sequence: Synthetic coding sequence
atggccggtctgaccgccgctgcacctagacccggcgtgctgctccttctgctgagcattttgcatccgagcagacccggcggagttcctggggccatcccgggcggggtcccgggcggcgtgttctacccaggcgctggtttaggggccctgggcggaggcgctctggggccgggcggcaagcccctcaagcccgttcccgggggactggccggtgctggcttgggtgccggcctaggtgccttcccggcagttacatttcccggagcactagtgccgggtggagtggccgatgccgctgctgcatataaggccgcaaaggcaggtgccgggctcgggggtgttccaggcgtgggggggcttggggtgtctgcagcgcctagcgtgccaggggcagtggtgccacagcccggggcgggcgtaaaacccgggaaagtgcccggcgtcggcctgcctggcgtctaccctggcggcgtgctgcccggagcacgattcccaggagtcggggttttacctggagtgccaacaggagctggagttaagcctaaagcacctggagttggtggggctttcgcgggcattcccggtgtgggaccattcgggggaccgcaaccaggagttccgctgggctatcccattaaagcaccaaagctgccaggcggctacggccttccatacaccaccggcaagctaccctacggatacggcccgggcggggtggcaggtgctgccggtaaggcaggctatcctactggcaccggagtggggccccaggccgccgcagcagctgcagcaaaggcagccgcaaagtttggcgcaggagctgcaggagttctccctggggtaggtggagcgggagtgccgggggtgccgggagccatccccggcatcggcggcatcgcaggtgtgggtacccctgctgcagctgccgcagccgcggctgccgccaaagcagctaagtatggcgcggctgccgggctggtacccggaggtccaggctttggccccggagtggtgggcgtgcccggcgccggcgtgcctggggtgggcgtaccgggagccggaattcccgtggttcccggggccggaatcccaggcgctgctgtcccgggcgtggtaagccccgaggccgcggccaaagcagcggccaaggccgccaaatatggggcaagaccaggcgtcggtgtgggagggatccctacgtatggcgttggagctggcggattccctggattcggagtcggcgtcggtgggatccccggtgtggcaggagtgccgggtgttggaggcgtacctggcgtgggaggggtcccaggagtgggaatctctccggaagcccaagccgctgcagctgcaaaagctgccaagtacggagttgggactcctgctgctgctgcagcaaaagctgctgcgaaagcagcccagttcggtctggtgccaggggtcggggtggccccaggagtcggagtcgcaccaggagtcggcgtcgcacctggcgtgggattggcccccggcgttggagtggctcctggtgtcggtgtcgcgccaggggtgggagtggcgccgggtatcggtccaggcggcgtcgccgcagcggcaaagtccgctgcgaaggtggctgccaaagcacagcttagggccgccgccggcctgggagcaggcattcccggcctgggtgtgggggtgggcgtgccaggcctaggtgtcggcgccggggttcccgggcttggagtcggagccggggttcctgggttcggcgcagtacccggagctttggcagccgcgaaggccgctaagtacggcgcagccgtgcccggagtgttaggaggattaggtgccctgggtggagttgggatacctgggggcgtcgtgggtgcaggacccgccgccgccgcagccgctgctaaggccgccgcaaaagcagcgcagttcggcctcgtgggtgctgccgggctcggtggccttggagtcggcggcctgggagtccctggagtcggcggtctgggggggattccacccgccgccgcggctaaagctgcaaaatacggggtcgctgcacgccctggcttcggactctcgcccatcttcccagggggtgcttgcctgggaaaggcctgtgggcgcaagagaaagtag

SEQ ID NO: 2701 - DNA, 2379 bp, Artificial Sequence
  Description of Artificial Sequence: Synthetic coding sequence
atggcgggcctgaccgccgctgcaccacgacctggtgttctgttgctcctcctgagcattttgcacccatcccggcctggaggagttcccggcgctatccccgggggcgtgcccggaggtgtgttctaccccggggcaggtctgggcgccctgggggggggagcactgggacctggcggcaagcctctcaaacctgttcccggcggccttgcgggggcggggttgggcgccggcttgggggccttcccggccgtgacatttcctggcgctttggtgcccgggggggtagcagatgctgcagctgcatataaggctgccaaagccggcgcaggcttggggggcgtaccaggggtggggggactgggcgtcagcgccggagccgtggtcccgcagccaggcgcgggcgtaaaaccagggaaagtgcccggcgtgggactgcccggggtctatcccgggggcgtcctgcctggtgctcgctttcctggggttggcgtcctccccggcgttcccaccggcgcaggcgtaaaacctaaagcccctggcgtcggtggtgcttttgcaggaattcctggagtcgggccattcggtggccctcaacctggcgtgccgcttggctacccgattaaggcacccaagctgcccggcggctacggattgccgtacacaacagggaagcttccatatggctacggacccggaggcgttgccggggctgcaggcaaggcgggctatcctaccggtactggggttggaccacaagctgcagctgccgctgctgcaaaagctgctgccaagtttggcgctggagctgccggagtcctgcctggcgttggaggggccggcgttccgggtgtgccaggtgcaattccaggaataggtgggatagctggagtgggcactcctgcagccgctgccgccgcagcagcagccgcaaaagctgcgaagtatggggctgctgccggccttgttccaggcgggcccggatttggacccggcgtggtcggcgtccccggcgccggggtgccgggcgtcggcgtgccgggcgccggaataccggtagtgcccggggcgggtattcccggcgcagccgtccccggtgtcgtatcacccgaagccgccgccaaggccgccgccaaagctgccaagtacggggctaggccaggagttggcgtcggtggaatcccaacttacggagtgggcgccggtgggttcccaggatttggcgtgggggtggggggaattccaggcgtcgctggagtccctggcgtaggaggtgtacccggagttggcggtgtacccggcgtcggcataagcccggaggcccaggctgccgccgcagccaaagcagccaaatacggcgccgctggtgcaggcgttcttgggggcctagtgcccggcgcacctggcgctgtccctggtgtacctggtaccggtggagtccccggagtcggcacgccagcggccgcagccgctaaggcagctgcaaaggccgctcagtttgcactgcttaatctcgcagggctggtaccaggagtgggcgttgcaccaggggtgggtgtggcacccggggtcggtgtggctcccggcgttggtcttgcacctggggtgggggtagctcctggtgtcggagtggcccccggagttggggtggcccccggaatcggcccgggaggtgtggccgcagctgcaaagtccgcggcaaaggtggcggccaaggctcagcttcgcgccgccgcggggctgggcgctgggatccccggtctgggagtgggcgttggcgtccccggactcggcgtgggcgcgggggtccccggactgggagtaggggctggcgtgcctggcttcggcgctggggctgatgagggcgtacgtcggtctctgtccccagagctcagagaaggagacccaagtagcagtcagcacctccccagtacgccctcatcccccagggttcctggcgcccttgccgcagctaaggctgctaagtatggagccgcagttccgggcgtgttaggtggcctgggcgcactcggaggcgtgggaattcctggaggggttgtcggcgccgggccagctgcggcggctgccgcggccaaggcggccgccaaggcggctcagttcggattggtaggggctgccggcctcggtggccttggagttggcgggctgggcgttcctggagtggggggacttggagggatcccacctgccgccgccgctaaagcagcaaaatacggggcggctgggttgggaggcgtgctgggtggcgctggacagtttcctctcggtggcgtcgccgccagaccggggttcggattgagccctatattcccgggtggtgcttgtttaggtaaggcttgcggccggaaaagaaagtag

SEQ ID NO: 2702 - DNA, 2034 bp, Artificial Sequence
  Description of Artificial Sequence: Synthetic coding sequence
atggcagggctgactgcagcggccccccgaccaggtgttcttttgctgctgctgagcatcctccacccctcccggcctggtggagtacccggcgcaatccctgggggggtgcctggcggcgtgttctatcccgctctgggtcccggcgggaaacccctaaagccagttcccgggggtctggccggagccggcctgggagctggcctcggcgcttttcccgctgtcactttcccaggggcactggtccccgggggcgtggctgatgctgccgccgcctataaggctgctaaggctggggccggactgggtggggtgcccggggtggggggcctgggcgtatctgccggcgctgtggtcccccagccaggtgctggagtaaaaccaggcaaagtgccaggtgtaggactcccaggtgtgtaccccgggggcgtgctgcccggtgcgagattccccggggttggcgtgttacctggcgtcccaaccggagcaggggtgaagccaaaggcccccggcgttggtggcgcattcgcaggcatacctggggtcgggcctttcgggggcccacagccaggggtcccattgggttatccgataaaagctcccaaactgccaggaggatacgggctcccttatacaactggcaagctaccatatgggtacgggcctgggggcgtggccggcgctgccggaaaggccggctatccgactgggacgggtgttgggccacaggcagccgccgccgccgccgcgaaagctgctgcaaagtttggagccggtgcagctggggtcttgcctggggtgggtggggccggcgtgcctggcgttccaggcgccatccctggcatcggtggtatcgcaggcgttggaacaccagccgctgccgcggccgctgccgccgccgctaaagcagccaagtacggagcggcggccggcctggtccctggagggccaggatttgggcccggcgtcgtgggagtgccgggcgccggcgtgcctggcgtgggcgtgccaggagctgggataccagtcgttcctggggcggggattccaggcgcagcagtccccggggttgtcagtccagaggcagcagccaaggccgcagctaaggcagcaaagtacggagcaagaccaggggtgggggtgggaggcattccaacatatggggtgggggccggcggattcccaggcttcggcgtgggagtgggaggcattcccggggtggccggcgtgccaggagtgggcggggtgcccggcgtcggcggtgttccaggcgttggtatcagccctgaggcgcaggcggcagccgcggcgaaagctgccaagtatggtctcgtgcctggcgtcggcgttgctccaggggtcggggtggcccctggcgttggggtggctccaggagttgggctggccccgggggttggcgtcgcgccgggggtgggagtggcacccggagtgggcgtagcgccaggcatcggaccaggcggagtggctgccgcagccaaatctgcagcgaaggttgccgcaaaagctcaactgagagctgcagcgggcctgggggctggaattccgggcctgggcgtcggggtgggggtgccgggactgggtgtgggggcaggagtacccgggctcggcgtgggagctggggtcccggggttcggcgctgtacctggtgcactggctgctgcaaaagctgcaaagtacggagccgcagttcccggcgtcctggggggcctcggagcgttggggggcgtgggcataccaggaggtgtggtgggcgctggccctgccgccgcggcggctgccgcaaaggctgccgccaaggctgcccagttcgggcttgtgggggccgccggcctgggagggttaggggttggtggcctgggagtccctggcgtgggaggactgggcgggattccacccgcagctgcagctaaagcggctaagtatggcgttgctgcacgccctggattcggtctgtctcccatctttcctggcggcgcttgcttgggtaaagcctgcggacggaaaaggaaatag

SEQ ID NO: 2703 - DNA, 2118 bp, Artificial Sequence
  Description of Artificial Sequence: Synthetic coding sequence
atggccggcctgaccgccgctgcccccaggcccggtgtcttactccttctcctttcaatcttgcaccctagtcggccaggaggggttccgggcgctataccaggcggtgtccccggtggcgtcttctaccccggggctggcttgggagccttagggggtggcgcactaggcccgggcggcaagcccctcaaaccagtccctgggggcctggcgggagccggcctgggtgccgggttaggagctttcccagccgtgaccttcccgggggctttggtgcccgggggtgtggccgatgccgccgctgcatacaaagcagccaaggcgggcgccggcttaggaggagtgcctggtgtgggcggactgggggtgagtgctggcgctgtcgttccacagccgggagccggcgtaaaacccggcaaagtgcccggtgtcggactaccaggcgtctacccgggcggagtgttgcccggtgcccgctttcccggcgtgggcgtgctgcctggagtgcctacgggggcaggagtaaaacccaaggctcctggtgtgggaggagcctttgctggtatccccggagtcggaccttttggcggccctcaacctggggtgccgttaggataccccatcaaagcccccaagctgcctggcggctacggcctgccatacactacagggaaacttccctatggttacggcccaggaggagttgcaggtgcagccggtaaagcaggctaccctaccgggacgggcgtgggtccacaggccgcggccgctgccgcagccaaggccgccgcaaagtttggggcaggtgcagctggtgtgctcccaggcgtggggggcgcaggagtgccaggagtgccaggcgccattccaggaatcggtgggatcgcgggagtgggaacacctgcagcagctgctgccgctgctgccgcggcaaaggccgccaaatatggggcagctgctggattggtgcctggtggacctgggtttggaccgggcgtggtgggcgtgcctggtgctggggttcctggcgtgggcgtccccggagcaggcatcccggtggtcccgggcgcaggaataccaggggctgcagtacctggcgttgtgtcacccgaagccgcggccaaagctgcagccaaagctgccaagtacggagccaggcctggtgttggtgtgggaggcattcctacatatggcgtgggggccgggggcttccccgggttcggtgtaggggtcgggggaatccctggcgtggccggggtgccaggtgttgggggcgtaccaggagtaggaggtgtccctggagtggggattagtccagaagcccaggcagccgcggctgcgaaggctgccaaatatgggctcgtcccgggggtgggggtggccccaggagtgggtgtcgcccctggtgtcggggtcgcaccaggggtaggcctagcccctggggtcggcgtggcacccggcgtcggcgtagcacctggcgtcggcgtagcccctgggattgggccaggcggcgtggcggccgccgccaagagcgccgcgaaagtcgcagctaaggctcagcttagggctgcagccggactgggtgctggtatccccggtctaggggtgggggtgggcgtgcctggtctaggcgttggcgccggagtccccggtttgggggttggtgcaggggtgcctggttttggcgcagttccaggcgctctggccgccgccaaagctgcaaagtacggggcagctgttcctggggtactgggagggctcggagcattaggcggggtggggattcctggtggggtggtgggcgcaggcccagccgcagcagccgccgccgctaaagccgcggccaaagctgcccaatttggtttggttggagccgccgggctaggtggtcttggcgtcggcggacttggcgtccctggtgtgggcgggctgggtggaatccctccggccgcagctgccaaagctgctaaatacggtgctgccggcctgggcggtgtgctcgggggagctggccagtttcctctaggaggagtcgcagctaggcccggattcggcttgtcccctatcttcccagggggggcatgtcttggaaaagcatgtggacgcaagagaaagtag

SEQ ID NO: 2704 - DNA, 645 bp, Artificial Sequence
  Description of Artificial Sequence: Synthetic coding sequence
atggccggcctgaccgcagccgccccaagaccaggcgtgcttctcctgcttctgtcaatcttgcaccccagccggcctggaggtgttcccggagccatacccggcggggttcctgggggcgtattctaccctggagcggggctaggagctctgggcggaggcgcactgggacctggcggaaagccattaaagccagtccccggtggtctggctggggccggcctcggagcaggactcggcgcttttcctgcagttaccttccccggagcccttgtaccaggcggcgtggctgatgctgctgccgcatacaaggcagccaaggccggagctggtctaggcggagtgcccggtgtggggggtctgggcgtgagcgctggtgcggtggttccacaacctggcgctggcgttaagccagggaaggtacccggtgtgggactgcctggggtctaccccggcggggtactccccggcgtcgggcccttcggcggcccacagcctggcgtaccactgggttacccaatcaaagccccgaagctccctggtgggtatgggctgccttatactacaggcaaactgccatatggctatgggcctggaggtgtagccggcgccgccggtaaagcgggctaccctactggtacttag

SEQ ID NO: 2705 - DNA, 504 bp, Artificial Sequence
  Description of Artificial Sequence: Synthetic coding sequence
atggcaggcttaacagccgccgcaccgaggcccggggtgctgctccttttgctgtcaatcttacacccatctaggcccggcggcgtaccaggggccatccccggaggcgttcctggtggcgtgttctacccaggggccggcctgggggctctgggcggaggcgccctaggtccaggcggaaagccattgaagccggtcccgggcggactggccggcgctgggcttggagcaggtctgggcgcatttcccgccgttacctttcctggcgctttagtgcctggcggtgtcgctgatgcggccgccgcttataaggccgctaaagccggcgtgggcccgtttggggggccccagcctggcgtgcctttgggttatcctataaaagctcccaaactgcctggaggctacgggttaccctacactactggaaagctaccctacgggtacggccctgggggcgtagcaggggccgccggcaaggcaggataccccacaggaactggctag

SEQ ID NO: 2706 - DNA, 2079 bp, Artificial Sequence
  Description of Artificial Sequence: Synthetic coding sequence
atggcaggcctgaccgccgctgcgcctaggcccggcgtacttttactcttattgagcatactccatccctccaggccaggtggagtgcctggggccattcccgggggagtgccaggcggtgtgttctatccgggcgccgggctgggtgccctgggagggggggcattgggcccgggaggaaaacccctaaaacccgtgcctggaggtctcgccggcgccgggctaggtgccggcctgggagcttttcccgctgtgacttttcccggagcactcgtcccaggcggcgtggccgatgcagctgctgcatacaaagccgctaaggctggggctggactaggtggcgtccccggagtgggcgggctgggcgtgagcgcagcaccctccgtaccaggcgccgttgtgccccagcccggcgcaggagttaagccaggcaaggttccaggggtggggctcccaggcgtctaccccgggggagtgctaccgggagccaggttccccggcgtcggtgtgcttcccggcgtgcccaccggcgccggcgtcaaaccgaaggcccctggggtgggtggcgccttcgccggtattcccggtgtcgggccatttggcgggccccagcccggagtgcctctgggatatcccattaaagcgcccaagctacctggcggatacggcttgccttacacaactgggaagcttccatatggctacggaccagggggcgttgccggggcagccggaaaggcggggtatcctactggcacgggcgtgggcccacaggcggcagccgccgcagctgctaaggccgcagctaaatttggcgccggcgcagccggggtgctcccaggagtcgggggcgccggcgtccctggggtgcctggtgcaattcccggcatcggtgggatagccggcgtcggcacgcccgccgctgctgccgctgctgccgccgcagctaaagccgctaagtatggcgccgccgctggcctggtacctggcggacccggatttggacctggcgtggtgggtgtgccaggcgctggagttcctggtgtgggtgtgccaggagccggaattccagtggtgcccggcgctgggattcccggtgccgcagtacccggcgtggttagtcccgaagccgccgctaaagctgctgccaaagccgccaagtacggagccagacctggagtgggcgtgggcggaattcccacatacggggtcggggccggcggcttccccggctttggcgtgggcgttggtggtattcctggagtggctggagtgccaggggtagggggggtccctggggtggggggagtgcctggcgtcggtattagcccggaagcacaggctgcagccgccgccaaagctgctaaatacggactggtgcccggcgtcggtgtggccccaggagtgggcgttgcgcccggcgtaggagtcgcccccggcgtgggcttagctcctggcgtcggggtcgcccctggagtgggcgtagctccgggcgttggggtcgctccaggaataggccctgggggtgttgcagccgctgctaagagtgcagcgaaggtagccgctaaagcacagctacgggctgcagcaggtttgggggcgggcattcccggcctgggtgtgggcgttggcgtacctggtctgggggtgggcgcgggagttcctgggctgggggtcggggcaggggtcccgggcttcggagctgtaccaggcgctttggctgcggccaaggcagcgaaatacggtgcagccgttcccggagttctcggaggtctgggcgccctcggaggggtcggtatacctgggggtgtagtgggcgcaggacccgccgctgcggccgctgcggccaaagccgccgcaaaggccgctcagttcggactggtcggcgccgctggtttgggcggacttggagtgggggggcttggagtaccaggcgtggggggactaggtggaatacctcctgctgccgccgctaaggccgccaaatacggcgtagccgctaggccaggctttggcctgtccccaatctttccagggggagcctgcttgggcaaggcatgcggacggaaacggaagtag

SEQ ID NO: 2707 - DNA, 507 bp, Artificial Sequence
  Description of Artificial Sequence: Synthetic coding sequence
atggcaggcctcacagctgcagctccccgcccaggggtccttctcctccttctaagtattcttcaccctagcaggcccgggggtgttccaggcgccatacctggtggcgtgcccggaggtgtgttttaccctggtgccggactcggcgctctcggggggggcgccctcggcccaggaggaaagccgctgaagcccggcgtcgggccgttcggaggacctcagccaggggtgccccttgggtatcccatcaaagctcctaaactgcccggctatggccctgggggagtagctggagcagcaggcaaagccggttaccccaccggaacgggtgttggaccgcaggcagcagctgccgccgccgcaaaggctgccgcaaaatttggcgcaggcgctgccggcgttctccccggagtaggcggtgctggcgtgccgggagtgccaggcgctatcccaggcatcggagggattgcaggagttgggactcccgcagcagccgccgccgcttag

SEQ ID NO: 2708 - DNA, 885 bp, Artificial Sequence
  Description of Artificial Sequence: Synthetic coding sequence
atggcaggactgacagcagccgctccgcgacctggcgtcctcctgctcctgctctcaatcctgcacccctctcgccccggaggcgtgcctggcgcaataccaggaggggtccctggcggggtgttctatcccggggccggcttgggtgcactcggcgggggggcacttggcccaggaggcaagcccctcaagcccggattgggcgctttcccagccgtgacattcccaggtgccctggtgcctggtggcgttgccgacgctgctgccgcttacaaggcagcgaaagctggcgcgggtctggggggggtgcctggggttgggggcttgggcgtttcagcaggcgccgtcgtaccccagcccggcgccggagtcaaacccggtaaagtccctggtgttgggttgcctggggtctatccgggcggcgtgctgccaggtgccagattccccggggtcggtgtactcccaggagtacccacaggggctggcgtgaaacccaaagcacctggtgtgggcccctttggtggacctcagcctggggtacccttaggataccccattaaggcgcctaagctgcccggtggttatggcctgccctacacaaccggtaagctgccatatgggtacggccccgggggagttgctggggcggcaggcaaggccggctatcccactggcacgggcgtgggaccccaggcagccgctgcagctgctgcgaaagcggcagccaagttcggcgcaggagccgcaggcgtccttcctggggtgggcggcgcaggggtgcccggagtgcccggcgccataccgggcattggtgggatcgcaggcgtcggcactcccgctgcggccgccgctgccgccgcggctgcaaaggcggcaaagtactag

SEQ ID NO: 2709 - DNA, 531 bp, Artificial Sequence
  Description of Artificial Sequence: Synthetic coding sequence
atggccggcctgacagccgccgcccctcgtccaggggtgttactcctgctcctctctatcctccatccgtcacgtcctggtggcgttccaggggccattcctggaggagtcccaggcggagtcttttatcccggagccggcctgggtgctctaggtggcggagccctggggccgggcggaaagcctcttaagccagtcccaggggggctggctggagcgggcctcggggctggactgggcgcattcccggcagttacctttcccggagccctggtccccgggggtgtggcagacgccgcggcagcctataaagccgctaaagccggggctggactgggtggcgtgcccggagttggcggcttgggggtcagcgcaggtgccgttgtgccccagcccggggcaggcgttaagcctgggaaggtgcccggagtcggaggggcttttgctgggatccccggggttgggcccttcggcgggccccagcctggcgttcctctcggctaccccataaaggcccccaaactcccttag

SEQ ID NO: 2710 - DNA, 1992 bp, Artificial Sequence
  Description of Artificial Sequence: Synthetic coding sequence
atggccggcctgacagcagctgcgcctaggcccggagtgctactgctgctgctcagcatacttcatccaagccgaccaggcggcgtgccaggggcaatccctggcggggtgccaggcggcgtcttctaccctggggccgggttgggcgccttgggaggaggggctctgggacctggtggcaaacctctcaagcccgtgccaggtggactagctggagctggcctgggcgctggcgctggcttggggggcgtgcccggtgtgggcggattaggagtctctgcaggcgcagtagtgcctcagccaggtgcaggcgtcaagcctggcaaggttccaggggtcgggttgcctggagtttatccaggaggagttctccctggtgcccggtttcctggtgtgggcgtgctgcctggagttccgaccggcgccggggtaaagccgaaggcaccaggcgtgggtggcgcattcgccggcattccaggggtaggtccatttgggggcccgcagcccggagtgcccctggggtatcccataaaagcaccgaaactgccaggagggtatgggctgccttacactaccggcaagcttccttatggatatgggcccgggggggttgccggtgcagctggcaaggccggctatcccacaggcacaggtgttgggccccaggctgccgccgccgcagctgccaaggccgcagccaaatttggcgctggtgccgctggtgtgctgcccggggtcgggggggccggagtccctggtgtgcccggggccattcccggcattgggggcatcgctggcgtggggacacctgcagccgcagctgcagctgccgcagctgctaaagccgcaaagtacggggcagcggcaggtctggtgccaggtggacctgggttcggtcccggtgtcgtaggcgtcccaggagcaggcgttccgggggtgggtgtccctggggcaggcatccccgtggttcccggcgcaggtatccccggtgctgccgtgccaggagtggtgtccccagaggccgctgccaaggccgccgcgaaggcagcaaagtacggcgcacgtccaggcgtaggggtcggtggcatccccacctacggagtgggcgccgggggcttccctggcttcggcgtgggcgtgggggggatccctggcgtggcaggcgttccaggcgttgggggtgtgccgggagtgggaggcgtgccaggggtgggtatctcccccgaggcgcaggccgccgccgcagccaaggctgccaagtacggcgtggggacacctgcagcagcagcagctaaggccgcagccaaggccgctcagttcgggctcgtgccaggcgtgggagtggcgccaggcgtcggcgtggcccctggaatcggtcctggcggcgtggccgctgccgctaagagtgccgcaaaggtcgctgcaaaggcccagcttcgcgcagccgctggacttggagccggaattccaggcctgggagtgggggtgggagtccctggcctgggtgtcggcgccggtgtgcccggactcggggtcggagcaggagtgcccggcttcggagcggtccctggcgccctagccgctgcaaaggccgccaagtatggagccgccgtgccgggggtccttgggggacttggcgccttaggtggagtgggcatacccggcggcgttgtcggagccggtcccgccgccgctgccgccgctgctaaagcagctgctaaagcggcccagtttggcctggtaggtgccgccggactcggagggctgggagtggggggcctcggggtccctggcgtgggtgggctgggcggaataccacctgccgccgcagcaaaggccgccaagtacggggccgccggtttgggcggtgtactcgggggggccggccaattccctttaggcggagtagctgcgcgacctggttttggactgtcacccatcttccccggcggggcctgcttaggaaaagcatgcggacgtaagcgcaagtag

SEQ ID NO: 2711 - DNA, 2121 bp, Artificial Sequence
  Description of Artificial Sequence: Synthetic coding sequence
atggccggcctgaccgctgccgctccacgtcctggagtgttgctgttactcttgagcattctccacccctctaggcccggtggtgtgcccggcgccattccagggggagttcctggaggggtgttctatcccggcgcgggcctgggagccctggggggcggcgcactcgggcccgggggcaagcccctcaaacctgttccaggtggactggctggcgctggtttaggggccggcctgggcgccttccccgcagtcacgtttccaggcgccttagtgccaggaggggttgccgacgctgctgctgcttataaggctgcgaaggccggagccgggctgggcggagttccaggtgtgggcgggctaggcgtcagtgctggcgctgtggtgccacagcccggagcaggcgtcaaacccggaaaggttcccggagtggggctacccggggtgtaccccggcggggtgctgccaggggcccgttttcctggagtgggggtgctccctggagttccaaccggtgctggagtgaagcccaaggccccgggtgtgggcggcgccttcgccgggatccctggcgtgggtccttttggaggtcctcaacctggagtcccgctcggatatccaattaaagccccaaagctccctggaggttacggacttccctacactactggcaagcttccatatggatatggtccgggcggcgttgccggggcagctggcaaggctggctaccccaccgggaccggcgttggcccccaggccgccgccgctgccgccgcaaaagctgctgcgaaattcggtgccggagccgcaggggtgctcccaggagttggaggggccggtgttcccggagtgcctggcgccatccccggaattgggggtatcgctggcgtgggcacacccgcagcggccgcagccgccgcagccgcagcaaaggccgccaagtacggcgctgccgctggtctcgtcccggggggcccgggcttcggaccaggggtggtaggcgtgcctggagccggagtgcccggcgttggggtgcccggcgccgggatcccagtggtacctggcgccggaattccaggcgctgccgtgccgggcgttgtgtcgccggaggccgccgccaaggcagctgctaaggcagcaaagtacggcgcgagacccggggttggcgtgggaggtatccccacatacggagtgggcgccggcggttttccagggtttggtgttggggtgggtggcatcccgggggttgcaggcgtgcccggggtagggggcgtgcccggagtgggcggagtgccgggcgttggaatcagtcctgaggcccaggcagctgcggctgcaaaggccgcgaaatatggcgtcggcacccccgccgctgccgctgctaaagccgctgccaaggccgctcagttcggactggtgccgggtgtcggggtcgcccccggggtcggggtggcccccggcgtgggcgtggcgccaggagtgggactggctccaggggttggcgtcgctccaggagtcggggtggctcctggtgtgggcgtagcccccggaattggccctgggggtgtggctgctgcggccaaatccgccgcaaaggtagcagccaaggcacaactgcgtgctgccgcaggtttgggagccgggatccccggactgggagtcggcgtgggcgtccccgggctgggggttggagcgggcgtacccggacttggagtaggtgctggggtgcccggtttcggtgcagtgccaggtgccctggctgcagctaaagccgctaaatatggtgcggcagtccctggagtgctggggggactgggcgctctaggaggagtgggcattccaggcggggtggtgggcgcaggaccagcggccgcagcagcggcagctaaagctgccgccaaggcggctcagtttggattagtgggggccgctggtctgggaggtctcggggttggagggctcggagtgccgggcgtcgggggtttgggcgggatacctcctgccgccgccgcaaaggcagctaagtatggcgtggccgcccgtcctggttttgggctaagccctatttttcccggcggcgcctgcctcggaaaagcctgtgggcgtaagaggaagtag

SEQ ID NO: 2712 - DNA, 2145 bp, Artificial Sequence
  Description of Artificial Sequence: Synthetic coding sequence
atggcgggactcacagccgcggcccccagacccggcgtcttactgctgctgctgagcattctccaccctagccgtccgggcggagtgccaggcgccataccggggggcgtgcccggtggggtgttttatcctgccctgggtcctggcggaaaacccctgaagccagtgccaggtggcctggccggcgctgggctcggcgccgggctgggagccttccccgctgtcaccttccccggggcattggtacccggaggtgttgccgacgccgccgccgcttacaaggcagccaaggcaggggctgggttgggcggcgtgccaggagtggggggccttggcgttagcgccggcgctgtcgtcccccagcccggggctggagtcaaacccgggaaggtgccaggcgtggggctgcctggggtatatcctggtggcgttttgcctggggcccgctttcctggcgtcggagttcttcctggggtcccaaccggtgcgggggtgaaaccaaaggcccccggagttggaggcgcattcgccgggataccgggcgtcggaccttttggaggcccacaacctggggtgcctctgggttatcctatcaaagccccgaaactgccgggaggttatggattaccttacaccacaggtaagcttccttacggctacggccccggcggcgtggctggcgccgcaggcaaggccgggtacccgacaggaactggagtgggaccccaggctgctgcagcagctgccgcgaaagcagccgcaaagtttggagccggcgccgccggtgtcctccctggcgtgggtggtgctggagtgcccggggtccccggggcgatcccaggaattggaggtattgcaggcgtcggaacaccagccgccgctgccgcagcggccgccgctgctaaagctgccaagtacggggccgccgccggcctggttcccggagggcccggatttgggcccggtgttgtaggtgtcccaggagcgggtgtcccaggggttggggtcccgggagccggaatccctgtggtgcctggtgccggaattcccggagcggccgtgccaggtgtggtcagtcccgaagcagcggccaaagctgccgctaaagccgcaaagtacggcgctagacctggagtgggcgtcggaggcattccaacatacggggtcggcgccggcggttttcctggattcggcgtgggggtgggaggtatccctggagtggcaggagtgccaggagtcgggggcgtgcccggcgtcggcggagtgccaggcgtgggtatcagtcccgaagcgcaggccgccgctgctgccaaagccgctaaatacggggtcggaacccctgccgccgcggctgccaaagccgcagctaaggcagctcagttcggcctcgtccccggcgttggggtagcaccaggagtcggggtcgctcccggcgttggagttgcccccggcgtgggactcgcgcccggtgttggtgtggctcccggcgtgggcgtagccccaggcgttggggtcgcccccggcattggacccggaggggtcgcagccgcagcgaaatccgccgcaaaagtggccgctaaagcccagcttagggctgccgcagggctaggagccgggattccagggctcggcgtgggggtgggggtgcctggactgggtgtgggggccggagtgcctggcctgggagtgggcgccggggtgccggggttcggcgcagtgcccggagccctggcagctgccaaagccgctaagtatggcgctgccgtgcctggagtattgggcgggcttggcgccctcggtggggtgggcattcctggaggtgttgtcggcgctggccctgcagccgctgccgccgccgcgaaagccgcagcgaaggcggcccaatttggcctggtgggagccgctggcttaggtggactcggggtggggggactaggtgttcccggcgtgggcgggcttggcgggatcccacccgcagcagccgctaaagccgctaaatacggggccgccggtttaggtggcgtattggggggagctgggcagtttcctctcgggggagttgccgcacgtcctggcttcggactgtcaccgatatttccagggggtgcctgtctgggaaaagcctgcgggcggaagcgaaagtag

SEQ ID NO: 2713 - DNA, 678 bp, Artificial Sequence
  Description of Artificial Sequence: Synthetic coding sequence
atggctgctctggcgtcttcactaattagacagaagagggaggttcgggaaccgggagggtcacgtcctgtgagtgcacaaaggcgcgtgtgtccaaggggaacaaagtcgctctgtcagaagcagctgctgatccttctgagcaaggtgagactctgcggcggacgccccgcccgccctgaccgcggccccgagccgcagctgaagggaattgtgactaaactcttttgcagacagggtttctacctgcaggccaatccggatgggagcattcagggtacgccagaggacacttcttcttttacccattttaatttgatccctgtaggactgcgtgtggtcactattcagtccgcaaagcttggtcactacatggctatgaatgcagaaggcctgctttattctagccctcattttactgccgagtgccggttcaaggagtgtgtgttcgagaattattatgtgctgtatgctagcgcgctttaccggcagcgacgctccgggcgggcttggtatctcgggctggataaagaaggacaagttatgaaagggaaccgggtcaagaagactaaggcagccgcacactttctaccaaagctgttggaagttgctatgtatcaagagccatcactccatagtgtcccagaagctagccctagtagtcctcctgcgccttag

SEQ ID NO: 2714 - DNA, 546 bp, Artificial Sequence
  Description of Artificial Sequence: Synthetic coding sequence
atggaaagcaaggagccgcagctgaaaggaatcgtcacgcgtttgttcagtcagcagggatatttcttacagatgcatccggatggcaccatcgacggcactaaggacgagaattccgactatacactgttcaatctgatcccagtaggcctgagagtggttgccatccagggcgttaaagcttccctctacgtggcaatgaacggtgaagggtatctctattccagtgacgtgttcacacccgaatgcaagttcaaggaaagcgtctttgagaattactacgtcatctactctagcactctttaccgacagcaggagtctggcagagcgtggttccttggcctgaataaggaagggcagattatgaaggggaacagagtaaaaaaaacgaagcccagctcccatttcgtccctaaacctatcgaagtatgcatgtatagagagccctccctccatgaaataggagaaaagcagggaagaagccgaaagagttcgggaactccgactatgaacgggggcaaagtcgtcaaccaggactcaacttag

SEQ ID NO: 2715 - DNA, 546 bp, Artificial Sequence
  Description of Artificial Sequence: Synthetic coding sequence
atggagaagacggagcctcagctgaagggcatagtgactcggcttttctcacagcagggctacttcctgcaaatgcatccagatgggaccatcgatgggactaaggacgaaaacagtgattacaccttgttcaatctgattcctgtaggtctgcgtgtggtcgctatccagggcgtaaaagcgagtctctatgtggccatgaacggcgagggatatctgtattctagtgacgtgtttacccctgagtgcaaatttaaggaatccgtctttgaaaactactatgtaatctattctagcaccctgtataggcagcaggaatccggccgcgcctggtttctgggactgaacaaggagggacagataatgaagggcaatcgtgtgaaaaagacaaaaccaagtagtcactttgttcctaaacccatcgaggtgtgcatgtatcgcgaacctagcttgcatgagataggcgaaaaacagggccggtcccggaagtcgagcggtaccccgacgatgaatggggggaaggtggtgaaccaggatagtacttag

SEQ ID NO: 2716 - DNA, 324 bp, Artificial Sequence
  Description of Artificial Sequence: Synthetic coding sequence
atggaatcaaaagaaccacagttaaaaggtatcgtcaccaggctctttagccagcagggctactttctgcaaatgcaccccgatggaactatcgacggtactaaagatgagaactctgattacaccttatttaacctgattcctgtgggactacgggtggtggctatccagggagttaaggcatcgctctacgtggcaatgaatggtgaaggctacctgtactcttcagacgtctttacccccgaatgcaagtttaaggagagcgtcttcgagaattactacgtcatctacagctcaaccctgtataggcaacaggaatcctag

SEQ ID NO: 2717 - DNA, 546 bp, Artificial Sequence
  Description of Artificial Sequence: Synthetic coding sequence
atggaatcaaaagagccccagctgaagggtatcgttacaagactgtttagtcagcaggggtatttcctgcaaatgcatccagacgggaccatcgacggcactaaggatgagaacagcgattatacgttgttcaacctgataccagtaggactgagagtcgtcgcaatccagggagtaaaagcgtccctgtacgtggctatgaatggtgaagggtatctctacagctccgacgtttttacacccgaatgcaagtttaaggaatcagtttttgagaattactacgtaatctatagcagcactctctacaggcagcaggaatccggtagggcctggtttctcgggttaaataaggagggtcagattatgaagggcaaccgcgttaagaaaactaagccttcgtcccacttcgtcccaaaaccaatcgaggtatgcatgtatagggagccgtccttgcatgagatcggagaaaagcagggacgttctcgtaaaagctcgggtacgcccactatgaatggcgggaaggtcgtgaatcaggattcaacatag

SEQ ID NO: 2718 - DNA, 546 bp, Artificial Sequence
  Description of Artificial Sequence: Synthetic coding sequence
atggagtccaaagagccgcagctgaagggcatcgtgactcgcttgttttcgcagcaagggtatttcctgcagatgcaccccgacgggaccatcgatggcactaaagatgaaaactctgactacaccctcttcaacttgatcccagtcggactcagggtagtcgcaatccagggagttaaggcttcactatatgttgctatgaatggggaggggtacctctacagcagcgatgtattcacaccagagtgtaagttcaaggagagcgtgttcgagaattactacgtgatctactccagcaccctttacaggcagcaagagtctggacgagcctggttcctggggttgaataaggaggggcagattatgaagggtaatagggtgaagaagacgaaacccagctcccacttcgtgcctaagccgatcgaagtctgcatgtatcgggagccgtctttgcatgagatcggggagaaacagggccgctctcggaaatcatctggcactcctacaatgaatggaggcaaagtagtaaaccaagacagtacatag

SEQ ID NO: 2719 - DNA, 732 bp, Artificial Sequence
  Description of Artificial Sequence: Synthetic coding sequence
atggctgctgccatcgcttccagcctgattcgtcagaaaagacaggccagagaatctaatagcgaccgcgtctctgcctcaaagcgtcgcagctcccccagcaaagatggtcgatccttgtgcgaaaggcatgtgctcggcgtgttttctaaagtcagattctgttccggcagaaagaggccagttcgacgccgacccgagccccagctgaagggcatcgttacaaggctcttttctcaacaaggatactttctccagatgcaccccgatggcacgatcgacggtaccaaggacgaaaatagtgattatactttgtttaatctgattccagtgggtctccgggtcgtggcgattcagggggttaaggcttccttatacgttgccatgaatggagaggggtacctatattcgtcagacgtgttcacccccgagtgcaaatttaaggaatcagtcttcgagaactactacgtgatatactcttcaaccctgtatcgacaacaggagtctgggcgagcttggttcttgggcctcaataaggagggacagattatgaagggtaaccgggtgaaaaaaaccaaaccttctagccacttcgtccccaaacccatcgaggtatgtatgtatagagaacctagccttcacgagatcggtgagaagcagggcagatcccggaagtcgtccgggactccaacaatgaatggagggaaggtcgtcaaccaagactcgacgtag

SEQ ID NO: 2720 - DNA, 579 bp, Artificial Sequence
  Description of Artificial Sequence: Synthetic coding sequence
atggccctgctccgaaagtcctactcagagcctcagcttaagggtatcgttacaaaattatatagtagacaggggtaccatctgcagctccaggcggatggaacaatcgacggtacaaaagatgaagactccacatacaccctgttcaacttaatcccagtcggcctgcgggtcgtcgcaatccagggggtacaaaccaagctttacctagcaatgaacagcgaagggtacctatacactagtgaactgttcactcctgagtgcaaatttaaggagtccgtgttcgagaactactatgtgacctacagttctatgatataccgccagcagcagtccggaaggggctggtacctcggattgaataaagaaggagaaatcatgaaggggaatcacgtcaaaaagaataaacctgccgcacactttctgcctaagccactcaaagtcgccatgtataaggagcctagtcttcatgaccttacagagttttccagatccgggtctggcacacctaccaagagccgcagtgtgtcaggtgtcctcaatggaggcaagtctatgtcccacaacgagtccacctag

SEQ ID NO: 2721 - DNA, 738 bp, Artificial Sequence
  Description of Artificial Sequence: Synthetic coding sequence
atggctgctgccattgcaagctctctgattagacagaaacggcaagctcgagagagagaaaaatctaacgcctgtaagtgtgtttctagccccagtaagggcaaaacctcatgcgataaaaataagttgaatgtgttcagtcgcgtcaagttgttcggcagcaagaagaggaggcgccggcgccccgaaccacagctaaagggcattgtgaccaaactatactcacggcagggctatcatcttcagttgcaggccgacggcaccatcgacgggacgaaagacgaggactccacctatactctctttaacctgatccctgtgggtttgcgcgtggttgctatccaaggcgtgcagactaagctgtacctggccatgaacagtgaaggctatctgtatacttcagagctgttcacacccgaatgtaagtttaaggagagtgtatttgagaattattacgtgacatattcatccatgatctatcgccagcagcagtccggtcgggggtggtatctcggacttaataaagagggggagattatgaaaggaaatcacgtgaaaaagaataagccagctgctcacttcctacccaaacccctgaaagtggccatgtataaggagccaagcctgcacgatttaaccgaattctctaggtctgggtccgggactcctaccaagagtaggtccgtgtcaggcgtcctcaatggaggcaagagtatgagtcataatgaatctacatag

SEQ ID NO: 2722 - DNA, 768 bp, Artificial Sequence
  Description of Artificial Sequence: Synthetic coding sequence
atgtctgggaaagtgacaaagccaaaagaggagaaggacgcaagtaaagtgctggatgacgccccacccggaacgcaagagtacataatgctccgacaggatagcatccaaagtgccgaactaaagaagaaagagtcaccgttcagggcaaagtgccatgaaattttttgttgtcccttgaagcaggtgcatcacaaagaaaacacggaaccagaagagcctcaattgaaaggcattgtcacgaaactctacagccgtcagggctaccatttgcagcttcaggcggatgggacaatagatggaacaaaagatgaagattccacctataccttatttaacttaattcccgtgggtctgagggttgtggccattcagggcgtacagacaaagctctatttagccatgaatagcgaggggtacctgtatacttccgagctgtttactccagagtgcaagtttaaggaaagtgtattcgagaattattacgtgacatattcttccatgatatatcgacagcaacagtcaggaaggggctggtatttggggcttaataaggagggggagattatgaagggcaatcatgttaagaagaataaaccggctgcacacttcctacccaaaccacttaaagtggccatgtataaggaaccctccctccacgacctgacagagtttagccgaagtggttcaggtacacccactaagtccagaagcgtgagcggcgtcctgaatggaggcaagtctatgtcccataacgaatctacttag

SEQ ID NO: 2723 - DNA, 132 bp, Artificial Sequence
  Description of Artificial Sequence: Synthetic coding sequence
atgctccgtcaggacagcattcagtcggctgaattgaaaaagaaggaatctcctttccgggccaagtgccacgagatcttttgctgtccactaaaacaggtgcatcacaaagaaaatacagaacctgagtag

SEQ ID NO: 2724 - DNA, 666 bp, Artificial Sequence
  Description of Artificial Sequence: Synthetic coding sequence
atgagcggtaaagtaactaaacctaaggaagaaaaagatgcaagtaaggttctagatgatgccccccctggcacccaggagtacataatgctccgtcaggatagcattcagtcagccgaactgaaaaagaaggaatcaccattcagagcaaaatgccacgaaatcttttgctgcccactgaagcaggtacaccataaggaaaacaccgagcctgaggagccgcagctgaagggaatcgtcaccaagttgtacagcagacaggggtaccatctgcagctgcaggcggacggcaccatcgatggtaccaaggatgaggattccacctataccctctttaacctcattcctgtaggactgagagtggttgcgatccaaggagtgcagactaagctgtatctggctatgaactcagaggggtacttatataccagcgagctcttcactcctgaatgcaagtttaaagagtcagtgttcgagaactactacgtgacatacagcagcatgatttatagacaacaacagtccggaagaggctggtacctcgggctcaacaaggagggcgaaattatgaaggggaatcatgtgaaaaagaacaaacctgccgcccacttcctccccaagccccttaaggtggcgatgtacaaggaaccgtcattacatgattag

SEQ ID NO: 2725 - DNA, 681 bp, Artificial Sequence
  Description of Artificial Sequence: Synthetic coding sequence
atgctgcggcaggattcaatccaaagtgccgagctgaagaagaaagagtcaccttttagagctaagtgccacgaaatcttttgttgtcccctgaaacaggtacaccataaagaaaatacagagcctgaggagcctcagctcaagggaatcgtgacgaaactgtatagtcggcagggataccatttgcagctccaggcagacggcacaatagacgggactaaagatgaagacagcacatatactttgtttaacctgatccccgtaggcttacgcgtggttgcaatccagggtgtccagactaaattgtatctcgcaatgaattctgaaggctacctgtacactagtgagctgtttacacctgaatgtaaatttaaggagtccgtatttgagaattactatgtcacttattcgtctatgatatacagacagcagcagtccgggcgcggctggtatcttggtctgaacaaggagggcgagataatgaaagggaaccacgttaagaagaacaagcccgccgcccatttccttccaaagccactgaaggtggccatgtataaggaaccttctcttcacgacttaacagaattcagtcggagcggcagcggtacaccgaccaaaagcaggagcgtaagtggggtattgaatggaggaaagagcatgagccacaacgaatccacctag

SEQ ID NO: 2726 - DNA, 297 bp, Artificial Sequence
  Description of Artificial Sequence: Synthetic coding sequence
atgagtggtaaagttaccaagcccaaagaggaaaaggatgcctctaaagtgcttgacgacgctcccccgggaactcaggagtatattatgctccgacaggatagtattcaaagcgcagaattaaagaagaaggagtcaccctttcgagctaagtgccacgaaattttttgttgccctctgaagcaagtccatcacaaggagaataccgagccagaggagccgcagctcaaaggtatcgtcacaaagctgtattcaaggcaggggtaccacctgcagcttcaagctgatggcacctag

SEQ ID NO: 2727 - DNA, 624 bp, Artificial Sequence
  Description of Artificial Sequence: Synthetic coding sequence
atgagaacttccatgaagaaggtcggtatgcatcacctttcgagctctggtgggtcctattacctgatactcgacgacgccccccccggtacacaggagtacataatgctgcgtcaagactctattcagtccgccgagctcaagaaaaaggaatctcctttcagagccaagtgccacgagatattctgttgtcctctgaagcaggtgcatcacaaggaaaacacagaacctgaagaacctcagctgaagggcattgttactaagctctattcgcgccaggggtatcaccttcagctccaggctgacggtactattgacggcacaaaagacgaggatagcacctacaccctgttcaacttgattccagtgggcctcagagtggtggccattcagggggtccaaaccaaactgtaccttgcaatgaattccgaaggctatctgtacacgtcggaactgtttactcctgagtgcaaatttaaggaatcagttttcgaaaactattacgtcacttactcctccatgatatacagacagcaacagtctggacgaggctggtatctaggactgaataaggagggagaaataatgaagggtaaccatgttaaaaagaacaagcccgcatag

SEQ ID NO: 2728 - DNA, 600 bp, Artificial Sequence
  Description of Artificial Sequence: Synthetic coding sequence
atgtccggaaaagttacaaaaccaaaagaggaaaaagacgcctccaaagagccccagctgaagggtatcgtcacgaagctgtactcccgacagggctaccatcttcaacttcaggccgacgggaccatcgatggtactaaagacgaggactccacgtatacgctcttcaatctaatccctgttgggcttcgggttgtagctatacagggtgtacaaaccaagctgtacctggccatgaacagcgaaggctacctgtacacctccgagttgtttactcccgagtgtaagtttaaggaatccgtcttcgagaactattacgtgacgtattcctccatgatctatagacagcagcaatcaggaagggggtggtacctcggcctaaataaagaaggggaaatcatgaaaggaaatcacgtgaaaaaaaataagcctgcagcccatttcctgccgaaacccctgaaggttgcaatgtataaggagccaagtttgcacgatctgacagaattttctagatcgggttctggaacacccaccaagtctagatccgtaagtggagtgctgaatggaggcaaaagtatgtcccataacgaatctacttag

SEQ ID NO: 2729 - DNA, 759 bp, Artificial Sequence
  Description of Artificial Sequence: Synthetic coding sequence
atggtaaagcctgtgcctctgttccggcgtacggattttaagctccttctttgcaatcacaaggacctgttttttcttagagtcagtaaactcctcgactgcttttctcccaagagcatgtggtttctgtggaatatattctcgaagggaacacacatgctgcagtgtctttgcggaaagtcactgaaaaaaaacaagaatcctaccgacccacagcttaaaggcattgttacccgactctattgcagacagggttactacctgcagatgcatcccgacggagcattggacggcaccaaggatgactctacgaatagtactctgtttaacctgattcccgtagggctgcgagtcgtcgctatacagggcgtgaagacaggattatacattgccatgaatggcgagggctacttataccctagcgagctgttcactccagagtgcaaattcaaggagtcagtgttcgaaaactattacgtgatttactccagtatgctctacaggcaacaggaaagcggaagggcctggtttttgggcctgaacaaggagggccaggcaatgaaggggaatagagttaaaaaaaccaagcccgccgcacactttttgcctaagccccttgaagtggcaatgtaccgcgaaccgtctctccacgatgtgggcgaaactgtccccaaacctggagtcacccctagcaaaagcacatccgcttcagccatcatgaatggaggtaaaccagtgaataaatccaagaccacatag

SEQ ID NO: 2730 - DNA, 744 bp, Artificial Sequence
  Description of Artificial Sequence: Synthetic coding sequence
atggcagccgcaattgcaagtggactgatcagacagaagcgccaggctagggagcagcactgggacaggcccagcgcctccaggcggcggtcctctccatcgaagaaccgggggctgtgtaacggtaatcttgtcgacattttctctaaagttcgcatttttggcctgaaaaagaggaggttacgccggcaagacccccaactcaaagggattgtcacaagactgtactgcagacaaggatactacctgcagatgcacccagacggcgcactggacgggaccaaggacgattccactaattctacgctgtttaacctcattcctgtgggcctccgcgtagtcgctattcagggagtcaagaccggcctctacatcgccatgaacggggaaggatatctataccccagcgagctgtttacccccgaatgcaagttcaaagaatccgttttcgagaattattacgtgatctacagcagcatgctgtatcgtcagcaggaatccgggcgggcatggttcctgggactcaacaaggaagggcaggctatgaagggcaaccgggtcaaaaagaccaagcccgcagcccacttccttcctaagcctctcgaggttgcaatgtatagggaaccgagcctgcacgatgtgggagaaaccgtcccaaaacctggagtcactccaagtaaatcgacgtccgcctccgccatcatgaacggtggtaagcccgtaaataagtccaagaccacttag

SEQ ID NO: 2731 - DNA, 351 bp, Artificial Sequence
  Description of Artificial Sequence: Synthetic coding sequence
tgaatcctggagtttatttcactggccgttggtctgatctccattcgaggcgtggattcgggtctctatctcgggatgaatgagcgcggcgagttgtatggcagcaaaaagctcacacgggaatgcgtgtttagagaacaattcgaagagaattggtacaatacatatgcttctactttgtataaacatagtgacagcgagaggcagtactatgtggccttgaataaagacggaagccctagagaaggctaccgaaccaaaaggcatcagaaatttacacactttcttcctcggcctgtggacccatctaaactgccatctatgagcagggatttattccattatagatag

SEQ ID NO: 2732 - DNA, 651 bp, Artificial Sequence
  Description of Artificial Sequence: Synthetic coding sequence
atgggagccgccagactgttgccgaaccttacgctgtgcctgcagctgctgatcctctgctgccagacacagggggagaatcacccctcaccaaattttaatcaatacgttcgggaccaaggggccatgaccgaccaactgagccgtcggcagatcagagaatatcagctttattcacgaacttctgggaagcacgtccaggtaactggcagacgaatatccgcaaccgcagaagacggcaataagttcgccaagttgatcgtggaaaccgacaccttcggcagtcgtgtccgtattaaaggcgccgaaagtgagaagtacatctgcatgaacaaacgtggtaagctcatcgggaagccgtctggcaagagcaaggattgcgtgtttaccgagatagtgcttgagaacaactataccgccttccagaatgcaaggcacgagggctggtttatggcatttaccagacagggcaggccacgtcaggcctcccgaagcagacaaaaccaaagagaagcacatttcatcaagcgcctgtaccagggccagctcccctttcctaatcacgccgagaagcagaaacagttcgaatttgtggggtctgcgcccaccagacgcacgaagagaacacggcggcctcagcctctgacctag

SEQ ID NO: 2733 - DNA, 618 bp, Artificial Sequence
  Description of Artificial Sequence: Synthetic coding sequence
atgggtgccgctcgcctgctgcccaatctcacactctgcctgcagctactaatattatgctgtcagacccagtacgtgagggatcagggcgccatgaccgaccagctgagccgccgtcaaatacgggagtatcagttgtactctaggacctcaggcaaacacgtacaggtcactggacgtagaatttccgctacagcggaagatggaaacaagttcgccaaattgatcgtggaaactgacacattcggcagccgagtgcggataaagggtgccgagtccgagaagtacatctgtatgaataagcggggtaagctaattggaaagcccagcggtaagtcaaaagattgtgtgtttaccgagatcgttctggagaacaactacaccgccttccagaacgctcgacatgagggctggttcatggcattcaccaggcagggcaggcccagacaagcttctagatcccggcagaaccagcgtgaagcccacttcatcaagagactgtaccagggccagctcccgtttccgaatcatgccgaaaaacagaaacagtttgagtttgtggggtctgctcccactcgacgcacaaagagaactagacgtccacagcctttaacttag

SEQ ID NO: 2734 - DNA, 624 bp, Artificial Sequence
  Description of Artificial Sequence: Synthetic coding sequence
atgtacagtgctcctagcgcctgtacctgcctgtgcctgcactttctgctgctctgtttccaggtgcaggtgcttgtggctgaagaaaatgttgattttaggattcacgtcgaaaaccagacaagggcaagggacgacgtctcccgaaaacagctgagactgtaccagttgtacagccgcactagtgggaagcatatccaggttctgggacgcagaatctccgcgcgaggagaggatggggacaagtacgcccagcttctggtagagacagacacattcggcagtcaagttcgtattaagggcaaagaaaccgaattctacctatgcatgaacagaaagggcaaactggtggggaaaccggacggcacatccaaggaatgtgtcttcattgagaaggtgcttgagaacaactataccgctttgatgtcagctaagtactctggctggtatgtgggtttcacaaaaaagggccgcccacggaaggggccaaagacccgggaaaatcagcaggacgttcacttcatgaagcggtaccctaaggggcagcctgaacttcaaaaaccttttaagtacacaaccgtgaccaagcgatcaaggaggatccgccctacacacccagcgtag

SEQ ID NO: 2735 - DNA, 651 bp, Artificial Sequence
  Description of Artificial Sequence: Synthetic coding sequence
atgagaagtgggtgcgtggttgttcatgtctggatcctggcagggctttggctggctgtggccggtcgcccgttggcgtttagcgacgcggggccacacgtgcactacggctggggcgatccaatccggctgagacatctgtatacatctggcccacacggcctctcctcctgctttctgaggattcgcgccgacggagtcgtagactgtgcgcgcggacagagcgcccactccctcctggaaattaaagcggtggctctgcggaccgtggcaatcaagggcgtgcatagtgtgagatatctgtgtatgggagctgatgggaagatgcagggtctactgcagtattccgaagaggactgtgccttcgaagaggagattcgccccgacgggtacaacgtatatcgatccgagaagcaccggctacctgtgagtctttcgagcgccaaacagcgacagctctacaaaaaccgcggttttctacccctgtcgcactttttgccaatgctccctatggtgccagaggaacccgaggatctcagaggccacctggagagcgatatgtttagcagtcctcttgagactgactcaatggaccctttcggtctggtaaccggcctcgaagctgtgcgttccccatcatttgaaaaatag

SEQ ID NO: 2736 - DNA, 636 bp, Artificial Sequence
  Description of Artificial Sequence: Synthetic coding sequence
atggccccgcttgccgaagtgggcggctttctcggcgggctcgagggattaggccaacaggtgggatctcactttcttctcccaccggccggtgaaagaccacctctgctgggggagcgtaggagtgcggccgaacggtcagctagagggggcccaggcgcggcgcagctggcccacctgcatggcattttaaggcgccgccagttatactgtcgaacgggtttccacctgcagatcctgcccgatggctctgtccagggtaccagacaggaccatagtctcttcggaatcttagagttcatatcagtggcggtaggactcgtatctattcgaggagtggatagtgggctgtacctggggatgaatgataaaggggaactgtacggctctgaaaaactgacatctgagtgcatcttcagagaacagttcgaagaaaactggtacaacacttacagtagcaatatctataaacacggagacacaggcagaaggtacttcgtcgcgctaaacaaagatggaacgccacgcgacggcgccaggagtaaacggcaccagaagtttacgcacttcctgccacgccctgttgatccagaacgcgtgcctgagctgtacaaagatctcctcatgtatacgtag

SEQ ID NO: 2737 - DNA, 237 bp, Artificial Sequence
  Description of Artificial Sequence: Synthetic coding sequence
atggcgccgctggcagaggtgggcggattcctcggtggactggagggactggggcagcaggtgggttcccactttttgctgccacccgctggggagcgaccccccgctgcgcttttaccccacagattaccccctgccgacccggctagaaggcagcgggcaggtcatcccgccggaccgcagcccctcagatacctgggcattcatcagtgcggcagtggaactgggcagtattag

SEQ ID NO: 2738 - DNA, 390 bp, Artificial Sequence
  Description of Artificial Sequence: Synthetic coding sequence
atgggcgacccggtagtcactgagactccaactctcctggggttgcccgagcagcgaagggcggccgtgcggcacgtgaataagggggcaggtatactcgagatcagaagcgtacacgttggcgtggtggtgataaaggcagtgtctagtggtttttatgtcgccatgaatcggcgcggccggctgtacggctcgcggctgtataccgtggactgtagatttagagagaggattgaggaaaacggccacaatacatatgcaagtcaaagatggcggcgacgtggccagcctatgtttctggctttagatcggagaggagggcctaggcccggcggcagaacacgacggtatcacctttccgctcatttcctgcccgtcctagtgagttag

SEQ ID NO: 2739 - DNA, 579 bp, Artificial Sequence
  Description of Artificial Sequence: Synthetic coding sequence
atgggcacctggattctgttcgcatgcctggtgggggcggctttcgccatgcctctcccaccccaccctggtcatccagggtacataaactttagctatgaggtcctgaccccattaaagtggtatcagagcatgattagacctccatactcaagttacggctatgagcctatgggtggctggctccaccaccagatcattcccgttgtgtctcagcagcatcctctgacacataccctgcagtcacaccaccatatccccgtggtgccagcccaacagccccgggtaagacagcaggcactcatgcctgtccctggtcagcagtcaatgacgcctacgcagcatcaccagcctaacctgcccctccctgcccagcaaccgttccagccacagccggttcaaccccagccacaccagcccatgcagccccagccccctgtgcaacctatgcaacctttactgcctcaaccgcccctgccgccgatgtttcctctgaggccccttccaccaatcctccccgaccttcaccttgaagcttggcccgcaacagataagacaaaacaagaagaggttgattag

SEQ ID NO: 2740 - DNA, 756 bp, Artificial Sequence
  Description of Artificial Sequence: Synthetic coding sequence
atgttgggcgccaggcttcgcctgtgggtgtgtgccttgtgtagcgtttgcagcatgtctgtgctgcgcgcgtatccaaacgccagtccccttctcggaagcagctggggaggattgattcacctttacaccgccacagcccgcaattcctaccaccttcaaattcacaaaaatggtcacgtcgatggtgctcctcatcagactatctacagcgctctaatgattcgatccgaagatgccgggtttgtggtgattaccggcgtgatgagccgaagatatttgtgcatggattttagagggaacattttcggcagtcattacttcgacccagaaaactgcaggttccagcaccagacattagagaacggctacgatgtctatcatagtccgcagtatcattttctcgtgtcgttgggacgcgccaaacgggcttttctgccggggatgaacccgcctccgtacagccagttccttagcaggcgcaatgagatcccactgatccatttcaatacccccattccgcgacgacatacaagatccgccgaggacgattctgaaagggatccattgaacgtgctgaagccccgagctagaatgacaccagcgcccgcaagctgctctcaggaattaccatccgcagaggacaactcaccgatggcctccgatcctctgggggttgtgcgggggggacgcgtcaacacacatgctggcggtacgggccccgaaggctgcagaccattcgcaaaattcatatag

SEQ ID NO: 2741 - DNA, 720 bp, Artificial Sequence
  Description of Artificial Sequence: Synthetic coding sequence
atgggcctcatctggctgctgcttttatccctgcttgagcctgggtggcctgctgccggccccggagcccggcttagacgcgatgccgggggtcgcggcggggtgtacgagcatctgggaggagcccctcgtaggcgaaagctgtattgtgcaacgaagtatcacttacaactgcatcccagcggcagagttaatggaagcctcgaaaactccgcttattccattctggagataacggcggtcgaggttggcatcgtggccatccgtggccttttttccggccgatacttagcaatgaacaaacgtggtcgcctgtatgcatccgagcactactcggccgaatgcgaatttgtggagagaattcatgaattaggatacaatacttatgcctccaggctgtataggactgtgtcctcaactcccggcgccagaaggcagccctcagctgaaagactgtggtatgttagcgtgaacgggaagggtcggccacgccgcggattcaaaacacggcgcactcagaagagttccctgttcctaccccgggtcctggatcatagggatcatgagatggtgcgtcagctccaatctggcctgcccaggccacccggcaaaggggtgcagcccagaagaagacgccaaaagcagagtcccgacaacctcgaaccttctcatgtgcaagcctcccgacttgggagccagctggaagcctcagcccactag

SEQ ID NO: 2742 - DNA, 621 bp, Artificial Sequence
  Description of Artificial Sequence: Synthetic coding sequence
atgtcaggtcccggaaccgctgctgtcgccctgcttccggccgtgcttcttgcactgctggccccatgggccggccgaggcggcgcagccgctcccacggcccccaacggcacgctggaggccgaactggaacgtcgctgggagtcgctggtggccctgagcctggccaggctgccagtggccgctcagcccaaagaggctgccgttcagagtggagctggcgactatcttcttggaataaaaaggctccggaggctctactgcaacgtcggcatcggtttccacttgcaggcgcttcctgatggccgaattggcggagcccacgccgatacacgtgacagcctactagagctttcccccgtcgagcgcggggtagtcagtatctttggggtcgcgagtcgatttttcgtggccatgagtagcaaagggaaactgtacggctccccattttttactgacgagtgtacgttcaaggaaattctcttgccgaacaactacaacgcatacgagtcttacaaataccctggtatgtttattgcattatccaagaacggtaagaccaaaaagggcaacagagtatcccccactatgaaagtgacacactttctacctagactgtag

SEQ ID NO: 2743 - DNA, 807 bp, Artificial Sequence
  Description of Artificial Sequence: Synthetic coding sequence
atgagccttagctttctcctcctgttgttttttagccatttgattcttagtgcctgggcacacggcgagaagaggctggcaccgaaaggacagccaggccccgccgcaaccgatcgcaatcccaggggaagtagctcccgccaatcatctagttcagcaatgtcttcgagcagcgcctcttcaagcccagccgccagcctggggtctcaggggagtggtctggaacagtcgtctttccagtggagtccttctggaagacgtaccggttcgttatattgtagagttgggattgggtttcacttacagatttaccctgacgggaaggtgaacggaagtcacgaggcgaatatgttgagcgtgttagagattttcgccgtttcccagggaattgtgggtattcgcggcgttttctccaataagtttctggccatgtctaagaagggcaaactgcatgccagtgctaaattcactgacgactgtaaatttagagagagattccaagagaacagttacaatacatatgcttccgctattcaccggacagaaaaaacgggtagggaatggtatgtagctctgaacaagcgaggaaaagcgaaaagggggtgctcgccccgggtcaagccccagcatatctccactcattttcttcccagatttaagcagagcgagcagccagagctgtcatttacggtgacggtgcccgagaaaaagaagcctccatcgcctattaaacctaaaatccctctttcagccccaaggaaaaacacaaactcagttaaataccggctgaagtttcgcttcggatag

SEQ ID NO: 2744 - DNA, 372 bp, Artificial Sequence
  Description of Artificial Sequence: Synthetic coding sequence
atgtcgctcagtttcctcctgctactcttcttttcccacctgattctgtccgcttgggcccatggggagaaaaggcttgcaccaaagggccagcccgggcctgcagctacagatcgcaacccccggggatcatcatcaagacagtcatcctcttctgccatgtcttcctccagtgcatcatcaagtcctgcggcgagtcttggctcccagggcagcggcctggagcagagcagcttccaatggtccccctctgggaggcggaccggctccttgtattgccgcgtgggaatcgggttccatttgcagatctaccctgatggtaaagttaacggctcccacgaagccaatatgctctcccaggtgcaccggtag

SEQ ID NO: 2745 - DNA, 855 bp, Artificial Sequence
  Description of Artificial Sequence: Synthetic coding sequence
atgccacgctacgcccaactggtcatgggccccgccggaagcgggaaaagcacttattgcgcgacgatggtgcagcactgtgaggcattgaacagatccgtgcaagtggtgaatctcgacccggccgccgagcattttaattattcagtgatggccgatatccgcgaactaatcgaggtggatgacgtgatggaggatgactcactacgtttcggaccaaatgggggacttgttttctgcatggagtacttcgctaataacttcgattggttggagaactgcctagggcatgtcgaggatgactatatcttgtttgactgcccgggccagatcgagctgtacacccacctcccagtcatgaaacaactagtccaacagctggagcaatgggagtttagagtgtgtggcgtattcttagtagacagccagttcatggtcgagtcttttaagtttatatcaggcatcctggctgcgctgtccgccatgatctccctggaaatcccccaggtgaacattatgaccaagatggacctgctgtccaaaaaagcgaagaaagagatagagaaattcttagaccccgatatgtatagccttctggaagattcaactagcgacctgagaagcaaaaagtttaagaagctgacaaaggccatttgtggactgattgacgactacagcatggtgcgattcctaccttatgatcagagcgacgaagaatccatgaacatcgtcctgcaacacatcgacttcgctattcagtatggagaggacctggaattcaaggagccgaaagaacgggaagacgaatcatcgagtatgttcgacgaatactttcaggagtgccaagatgaatag

SEQ ID NO: 2746 - DNA, 735 bp, Artificial Sequence
  Description of Artificial Sequence: Synthetic coding sequence
atgggctctcctcgaagcgctctgtcatgtttgctgttgcacctgttggtgctttgccttcaagctcaggaaggacccggcaggggccctgcactcgggcgagaactagccagcctattccgcgccggcagggagcctcagggtgtgtcgcagcaggtgaccgttcagtcttcccctaattttacacagcatgtgcgcgagcagagtcttgttaccgatcaactatctcgcaggctgattaggacctaccaactctatagtaggacttccggcaagcacgttcaagtgctggcgaataaaagaatcaacgcaatggcggaagatggcgacccttttgcgaaactcattgtggagaccgacacttttggaagtagagtgagagtgagaggcgccgaaacgggactctacatatgtatgaacaagaaaggcaaactcatagctaagagcaacggtaaaggtaaagactgcgttttcaccgaaatcgtcctagaaaacaattatacggccctgcagaatgctaaatatgaaggatggtacatggccttcactcgtaaaggtaggcctcggaaagggtccaaaacccggcagcaccagagagaggtccatttcatgaaacgcttgcccagaggacatcacactactgaacagtccctgagattcgaatttctcaattatccccccttcaccaggtccctgcgagggtcacagagaacctgggctccggaaccgcgatag

SEQ ID NO: 2747 - DNA, 702 bp, Artificial Sequence
  Description of Artificial Sequence: Synthetic coding sequence
atgggcagcccacggtccgcactctcctgtctgcttctccatctgctcgtcttgtgtcttcaggctcaagaggggcctggacgcggcccagctttagggcgcgaactggcctctctgtttagggcaggcagggagcctcagggagtttcccagcaacatgtgagagagcagtcattggtgaccgaccaactgagccggcgacttattaggacgtatcagttgtacagccgaaccagcggcaagcatgttcaagtgctcgccaataaaaggataaatgcgatggccgaggatggagatccgtttgctaagctcatagtggagactgacacgttcggctcacgagtccgtgtccggggcgcagagaccgggctatatatctgcatgaataagaagggtaagttgatcgccaaatccaacgggaaaggtaaggactgcgttttcactgagattgtactagagaacaattataccgccctgcaaaacgccaagtatgagggctggtacatggctttcacaaggaaaggccgcccacgaaaaggcagcaagacccgccagcatcaacgggaagtccatttcatgaagcgccttccgagagggcatcatactaccgaacagtctcttaggtttgagtttctaaactacccaccatttacaaggagcctgaggggatcacagcgcacatgggctcctgaacctcgctag

SEQ ID NO: 2748 - DNA, 615 bp, Artificial Sequence
  Description of Artificial Sequence: Synthetic coding sequence
atgggttccccccgcagtgccctctcttgtctgcttctgcacctcctggtgttgtgtttacaggcgcagcatgtcagagagcagagcctggtgaccgatcagcttagcagacggctgattcgtacttatcaactgtactcaaggaccagcggtaaacacgtccaagtgctggctaacaaaagaataaacgccatggccgaggatggagatccattcgcgaagctaattgtggagacagacacctttggctcccgagttcgggtgaggggggccgaaaccggtttgtacatctgcatgaacaaaaaaggcaagcttatcgccaagagcaatggtaagggaaaagattgtgttttcacagaaatcgtccttgaaaacaattatacagcacttcagaacgcaaaatacgaggggtggtatatggccttcacaaggaagggtaggccccgaaaaggatccaaaacgcgccagcaccaacgggaggtgcattttatgaagcgcttgccaagaggccaccatacaacagagcagtccttacgctttgaatttctcaactatccgccttttacccgttcgctgcgtggcagccagcgcacctgggcacccgagcctcgctag

SEQ ID NO: 2749 - DNA, 648 bp, Artificial Sequence
  Description of Artificial Sequence: Synthetic coding sequence
atggggtccccccggtccgctttgagctgtctgttgttacatctcctggtcctctgcctgcaagcacaggtgactgtacagtcctccccgaactttacgcagcacgtgcgggagcagtccctcgtgacggatcagctgtcaagacggctcataaggacctaccagttgtattcacgaacctcaggcaagcatgtgcaagtcctggccaataagcgaataaatgcaatggccgaagatggagacccttttgccaaacttatcgtggagacagatacttttggatctcgggtaagggtgagaggagctgagaccggcttgtatatctgcatgaataagaagggcaagctcatcgcaaagtcaaatggcaagggaaaggactgtgtcttcaccgaaatcgtactggaaaataactataccgcgttgcagaatgccaagtatgaggggtggtacatggcgttcacacgcaagggacgacctcggaaaggcagcaaaacacgccaacaccaacgagaggtccactttatgaagaggcttccaagaggccaccatactactgaacaaagcctacgctttgaatttcttaactacccgccattcacccgatctctccggggttcccagcggacttgggcacctgagcctagatag

SEQ ID NO: 2750 - DNA, 627 bp, Artificial Sequence
  Description of Artificial Sequence: Synthetic coding sequence
atggcacctctcggagaggtgggtaactatttcggagtccaggatgctgtgccattcggaaacgttccggtgttacccgtggactctccagtcctattgtccgatcacttgggccaaagcgaagcaggaggcctgccaagagggccagcagttaccgatttggatcacttgaaggggatattacgtagacgccaactgtactgccgaactggttttcacctagaaatttttcccaatgggactatccagggcacacgcaaggaccactcgaggttcggtatcctggaattcatctctatcgctgttgggctggtttcaatcagaggagttgatagtgggctgtatctagggatgaatgagaaaggcgaactatacggaagcgaaaagttgacacaagaatgtgtgtttcgcgaacagttcgaagagaattggtacaatacttactcttctaatctgtataaacatgtagataccgggcggcggtattatgtggccctgaacaaggatggaactcctagggaggggacaagaaccaaacgccaccagaagttcacccatttcctgcctagacccgtagaccctgataaagtgcctgaactgtataaggacatccttagccagtcctag

SEQ ID NO: 2751 - DNA, 7176 bp, Artificial Sequence
  Description of Artificial Sequence: Synthetic coding sequence
atgactgatctcctgcgatctgtggtaacagtaattgatgtgttctataaatatactaagcaggacggtgagtgcggcaccttgagcaaaggcgaactcaaggagctgttggaaaaagaattgcatcccgtgctcaagaatccggatgatcccgataccgtggatgtcattatgcatatgctcgatcgggaccatgaccgcaggcttgacttcacagagttcctcctgatgatcttcaaactgacaatggcgtgcaataaagtgttgagtaaggagtattgtaaagcgtctggctcaaaaaaacataggagaggacaccgccaccaggaggaagaatccgagaccgaggaggacgaggaagacactcctggccataaatctgggtacaggcacagttcttggtctgaaggagaggaacacggctacagctctggtcattcgagaggaaccgttaagtgccgccacgggtcaaattcgcgccgccttggacggcagggcaatctgagttcatccggcaaccaggagggcagccaaaaaagatatcatagaagcagttgcggacactcttggtcgggggggaaagaccgtcacggctccagttccgtggaactccgggaaaggattaacaagtcccacattagtcccagccgagaatctggagaagagtacgaatccgggtcgggttctaactcttgggagagaaaaggacatggggggctgagctgtggccttgagacctcggggcatgaatctaactctactcagtcaagaattcgggagcagaaattgggctccagttgctccggtagcggagattccggtcgaaggagccacgcgtgcggatactctaacagtagtggttgcggccgcccccagaatgcatcaagcagctgtcaatcacacagatttggaggacagggaaaccagttcagctatatacagagcggctgtcaatcgggaataaagggtggacagggccacggatgcgtgtctggtggtcaaccaagtggctgtgggcagcccgagagcaatccctgctcgcaatcatactctcaacggggctacggtgctcgagagaacggccaacctcagaattgcggtggacaatggaggacaggtagtagccagtcctcctgttgtgggcagtacggatccggaggcagtcagagctgcagtaacggccagcatgaatatgggagttgcgggaggttttcaaattcttcctcatctaatgagttctctaaatgcgaccagtacggatccgggagctcccagtccacttctttcgaacagcacgggaccggactcagccagtccagcggtttcgagcaacacgtgtgcgggagtggccaaacttgcggacagcatgagagcacctcctctcagagcctgggctatgaccaacacgggagttcgtcaggaaagacctctggatttgggcagcatgggagcggtagcggccagtcatcagggtttggtcagtgcgggtctggatcgggtcaatctagtgggttcggacaacatggttcggtttccggacaatccagtggtttcggtcagcatgggagcgtgagcggtcagtcaagtgggttcgggcagcatgagtcccgctcgaggcagtcctcctacgggcagcatgggagcgggagcagccaatcttcaggttacggacagtacggatcccgcgaaacaagcggatttggacagcacggtcttggtagtggtcagtctactggatttggtcagtacggaagtggctctggacagtcttcgggatttggacaacatggcagcgggagcggccagtcttctggcttcggccagcatgagagtaggtccggtcagagtagctatggacagcacagcagtggctcttctcagagcagcgggtatggccagcacgggagccgacagacatcggggtttggtcagcacgggagcgggagttcacagtcgactggcttcggccaatatggatcaggcagcgggcaatcttccgggttcggacagcacgtctcaggctcgggccagagctcaggcttcggccaacacgaaagccggagcggccactccagctacggccaacatggcttcggttcctcacagagttccggctacggtcagcatgggtcctcatcaggccaaacaagcggcttcgggcagcatgaactttcttccggacagtcttcttccttcggccagcacgggtccggatcaggacaatcatccggcttcggacagcatggctcggggtcaggccagagttcaggttttggtcaacacgagtcccgcagcggtcaatcaagttacggacaacatagctccggctcatctcagtcttccgggtatgggcaacatgggtccagacagaccagcggctttggtcagcacggctcgggatccagccaaagcacgggatttggccagtacggttcaggctctggccagagcgccggcttcggccagcatggcagtggatccggccaaagttccggctttgggcagcacgagtctcgctcccaccaatcgtcctacgggcaacacggaagcgggtcctctcaatcgagtggttacggacagcatgggtctagcagcggtcagacatcaggctttgggcagcataggtccagctcgggacagtattctggattcggacagcatggttctggatccgggcagtcatccggattcgggcagcatggcacgggatccggccagtactcaggttttggtcagcacgagtcacgatcacaccagagttcttacggacaacatggcagcgggtcgtcacagtcatccgggtatggccagcacggctcctcctcaggccaaacctttggattcggccagcaccggagcgggtccggccaatcatccgggttcggccagcacggatccgggagtggccagtcttcaggctttggacaacatgagtccggaagcggaaagtccagcggatttggacagcacgagagtcggagctctcaatccaattatgggcaacacggcagcggatcttcacagagctctggttacggccagcatgggagctcttccgggcagaccactgggtttgggcaacacagatccagcagtggtcagtatagtggcttcggccagcatggctccggcagcgaccagtcatcaggctttgggcagcacgggaccgggagtgggcagtcttccggcttcgggcagtatgagagtcgctctcggcagtcttcctatggacagcacggctcggggtcctcgcaaagcagcggctatggacagcatggatccaattccggacagactagcggatttgggcaacaccgtccaggcagcggacagtccagcggatttggccagtatggctcaggaagcgggcagagttctgggtttggccagcatgggagcggcacggggaagtcatccgggttcgctcagcatgagtatagaagcgggcagtcctcctatgggcagcatgggaccggttcttcgcagtcatcaggttgtggccagcatgagtcgggcagcggccctaccacatcctttggtcaacacgttagcggctccgataatttcagctcgagcggacagcacatatctgatagcggccaatctacaggcttcggtcagtatgggtccgggagtggacagtccaccgggttaggacaaggcgaatcacagcaggtggaaagtggctccacggttcatggtagacaggaaacaactcacggccagaccattaataccacccgtcacagccagagcggccagggacagagtacccagacaggcagtcgagttactcggcggcggcgatcctcccagtctgaaaatagcgattcagaagtgcactccaaggtatcacaccgacactcagagcatatccacacgcaagctggctcacactaccctaaaagcggctctactgtgcgccggaggcagggcacaacacatggacagagaggtgacactactaggcacgggcactctggccatggccaatctacccagacaggatcacggaccagcgggaggcaacgattctcccatagcgacgctacggattccgaggtgcactcaggggtgagccaccgtccccactcccaggaacaaacacacagccaagccggatctcaacatggcgaaagcgaatctacagttcacgaaaggcatgagaccacctacgggcagacgggtgaggctactggtcacggacattctggccatggccagagcactcaaaggggttcccggacaactggacgccgggggtcagggcatagtgaatcatcagactctgaggtccacagtggaggctcccacagaccccaatcacaggaacagactcacgggcaagccggctctcagcacggggagagcggtagcaccgtgcacgggcggcatggcaccacgcacggacagactggagataccacacgccatgcacactatcaccatggtaagagcactcagcggggtagctctactactggaagaagaggctctgggcattctgaaagttctgacagcgaagtgcactccgggggctcccacactcactcaggccatacacacggacaaagtgggagccagcatggcgagtcagaatctattatccacgataggcaccgcattacccacgggcagacaggtgacaccacacggcattcttattccggtcatgagcagacgactcaaactgggtcccgcaccacaggccggcagagaacctcccattcagagtcgaccgactccgaagtgcactctggtggcagtcataggccccatagcagggaacatacctacggccaggctggcagccaacatgaagaacccgagtttaccgttcacgagcgtcatggcactacacacggtcaaataggggacactaccggacacagccactccgggcacggccagagcacccaacggggctcacggacaaccggcaggcaaagatccagtcacagcgaaagttccgatagcgaagtgcactccggtgtctcacatactcacaccggccacacccatgggcaagccgggagccaacatggccagtctgagtcaatagtgccggagcgacatggtactacccatggccagactggagatactacacggcacgctcactaccatcacggtctgacgacccagaccggttcaagaactactggccggcggggatctgggcactctgagtactcagactcagagggctattcaggcgtgtcccacacccactccggacacacacacggacaggcaagatcacaacatggcgagtccgaatcaatcgtgcatgaacggcacgggacaatccacgggcagaccggcgacaccacccgccatgcgcacagcggccatggccagtccacccagaccggaagtcggactaccggtcggagatcctcgggccattctgagtattcagattcagaaggtcactcaggattttctcagagacctcattctcgtgggcacacacacggacaggcgggctcccaacacggtgagtctgagagtatcgtggatgagcgtcatggaactactcatgggcaaactggggatacgtcaggccacagccagtccggacacgggcagtccacacaatcaggtagcagcacaaccggaaggagaaggtccggacattccgagtccagcgactcagaggtgcatagtggaggatcacatactcacagcggccacacccattcccaggccagaagccagcatggagaatcagagtcaacggtgcataagcggcatcaaacgacccatggacaaactggggacaccaccgagcatggacacccgagccatggacagactattcaaaccggatctagaaccaccggtcgtcgtggcagcggtcacagtgagtacagtgacagcgaaggtccctccggcgtcagtcacacccactcaggtcatacacacggtcaggcaggatcccactatccggaaagcggcagctctgtccatgagcggcacggcaccacccatggacagactgccgataccacccgacatggtcactcagggcacgggcagtcgacgcagcgtggatcgagaaccacgggcagaagagcttccggtcacagcgagtacagcgacagcgagggccattcaggagtatcacacactcactcagggcatgcccacgggcaggccggctcacagcacggggaatctggatcatctgttcatgaacggcacgggactactcatgggcagacaggtgatacaacaagacacgcacacagtggtcatgggcagtctactcagagaggttcacgcaccgctggccggcgagggagcgggcactccgagagctctgattctgaggttcactccggtgtctctcacacccatagcggacatacttatggccaggctagatctcaacacggcgaatctggctctgccattcacggaagacagggcaccatccatggacagacaggcgacactacgcgacacggacagtccggacatgggcagtccacacagactgggagtagaactactggacggcagaggagttcacactctgagagctccgacagcgaagtgcactcagaggcctctcccacccactctggccacacacactctcaggcaggatcacggcatggccaaagcggatcctccggccacggaaggcagggtacaacacacggccagacaggcgataccacacgccatgcacactatgggtatggacaaagcactcaacgcgggtccagaacaaccggaagacgcgggtccggccacagcgagtcctcagatagcgaggtacactcttggggaagtcacacacactcaggacacattcagggccaggctggctcacagcagaggcaaccggggtctacggtgcacggaagacttgaaacgacacatgggcagacaggggacactacccgccacggtcactctggttatgggcagtcaacacaaacaggaagccgctcaagcagagcctcccactttcagtcacatagcagcgaacgtcaacgtcacggctcaagtcaggtctggaaacacggctcttacggcccagctgaatatgactacggacacaccggttacggtccctccggcggctcccgtaagtctatctccaattcgcacctttcctggagcaccgattccactgctaataagcagctaagccgccactag

SEQ ID NO: 2752 - DNA, 2856 bp, Artificial Sequence
  Description of Artificial Sequence: Synthetic coding sequence
atggccaccggaacaggaaaacataaactcctcagcactggcccgaccgagccttggagcattagggagaaactgtgtctcgcctcctccgtgatgcgtagtggcgaccagaactgggtgtccgtttctcgggccataaagccctttgcggagccggggcggccacccgattggttcagtcagaaacactgcgcttctcagtactccgaactgctggaaacgaccgagactcccaaacggaaaaggggagaaaaaggcgaagtggtggagaccgtagaagacgttatcgtgaggaaactgactgccgagcgggttgaggagctgaaaaaggttattaaagagacccaggagagatatcggagactgaagagagatgcggaactcatccaagctgggcatatggactcaaggcttgatgagctgtgtaacgacatagcgaccaagaaaaagctggaggaggaggaggccgaggtcaaacgcaaggcaaccgacgccgcctatcaggcaaggcaggccgtgaaaacccccccccgcagattgcccacagtaatggtacgctctcctattgactctgcgtctcccggaggcgattatcccctgggcgatttgacccccaccaccatggaagaggccacgtccggcgtcacaccaggcacccttccatccaccccagtgacctcctttcccgggattccagatacattgcctcccggttccgctcctctggaggcccccatgacccctgttacggacgattcccctcagaagaaaatgctcgggcaaaaagccacgccccccccaagtccactgctcagcgaattactcaagaagggcagccttctccccacatctccacggctggtcaacgaatccgagatggcagtcgcaagtggccatttaaatagcaccggggtcctcctggaagtgggaggcgtgctccccatgattcatggcggagagattcagcagactccaaacacagttgccgcgagtccagccgcctccggtgccccaactctgagccgcttgcttgaagcaggtccgactcagtttacgacacccctcgcctcattcactactgtggcctcggaacctcctgtgaagctcgtgcctccacctgttgaatctgttagccaggctactattgttatgatgcccgccctgccggctccaagctctgctcccgcggtgtcaaccaccgagagtgttgcccctgtctctcagcccgataactgtgtccccatggaggccgtaggggatccccacaccgttactgtgtccatggatagcagcgagatctctatgattatcaacagtattaaggaagagtgcttccggagcggagtggccgaagccccggtcgggtctaaggccccaagtatcgacggaaaggaggagctggatttggccgagaaaatggatattgcagtgtcgtacaccggagaagaactcgatttcgagactgtgggggatattatcgctatcatcgaggataaggtagatgaccatcccgaagtcctggacgtcgccgcagtggaagctgcactgtccttttgtgaagagaatgacgacccccagtcactgccggggccttgggaacatcctattcaacaagaaagggataagccggtgcctctccctgcacctgaaatgacagttaagcaggagagactcgattttgaggagaccgagaataaaggcatacatgaactcgttgacatccgggaaccttctgcagagattaaagtggaacctgccgagccagagcctgtgatctctggggcggagattgtggccggagtggtccctgcgacctccatggagccgccagagctcagaagccaagacttagacgaagagctcggctctactgctgctggagaaatcgtcgaggcggacgtggcgatcggcaagggggatgagactcccctgaccaacgtgaaaacagaagcgtcacctgagtctatgcttagccctagccacggttccaatccgatcgaggatcccctcgaggccgaaacacagcacaagttcgagatgtcggattctctaaaagaggagtctggaaccatctttggctcgcagatcaaggatgctcccggcgaggacgaagaggaggatggagttagcgaagccgcgagcttggaagagcctaaggaggaagatcagggggaggggtacctttcagagatggataatgagccgccagtctcagagtctgatgacggcttttcaatacacaacgccaccttgcagtcacacactctcgctgattccattcctagttcaccagccagtagccagttcagtgtgtgctcggaggaccaagaggctatacaggctcagaagatttggaagaaagcaatcatgctcgtctggagggctgcagccaatcatcgatatgcaaatgtgttcctgcagccggttactgacgatattgctcccggctatcattccatcgtgcagcgccctatggatttgtcgactattaagaaaaatatagaaaatggcctgattaggagcactgccgaattccaaagggatattatgctgatgtttcagaacgcagtgatgtataacagcagcgaccatgacgtgtaccacatggcagtcgaaatgcagagagatgtactggaacagatccagcagttcctggctacccagctgatcatgcagacctcagaatcggggatttccgctaagtccttgcgggggcgcgatagtacacgaaagcaagatgcgagcgagaaagactcggtccctatggggtctcctgcttttctgctttcgctgttcgatggagggactaggggcagacgttgcgcaatcgaggctgacatgaagatgaaaaagtag

SEQ ID NO: 2753 - DNA, 627 bp, Artificial Sequence
  Description of Artificial Sequence: Synthetic coding sequence
atgaaactccttccatctgtagttctgaagctgtttctggccgcggtgctttcagccctcgtcactggagaaagcttagaaagacttcgtcgcggattggccgctggtacttcaaacccagaccctccaacagtaagcacagaccagctgttgcccttaggtgggggccgggatcgaaaggtgagggacctgcaggaagcagatctggacctactgagggtgaccctgtcctccaagccccaagccctcgccacaccgaacaaggaagaacatggaaagcgaaagaagaagggtaagggcctgggtaaaaagcgagacccatgtctgcgcaagtataaggacttttgcatccatggggaatgcaagtacgtcaaggaactgagagcaccaagctgcatctgtcaccctgggtaccacggagagaggtgccacggtctgagcctgcccgtggagaaccgactctacacctacgaccacaccacaattcttgctgttgtcgccgtggtgctgtcctcagtgtgtcttcttgttatcgtgggattgttgatgttccgctaccaccggcggggtggttatgacgttgaaaatgaggagaaggtgaagttaggaatgactaacagccattag

SEQ ID NO: 2754 - DNA, 1128 bp, Artificial Sequence
  Description of Artificial Sequence: Synthetic coding sequence
atggctgtgaccgaagcaagtctgctgagacagtgccccctcctgttgccccagaaccgttcaaaaactgtgtatgaaggattcatctccgcccagggccgagactttcatttgaggattgtgctgccagaggatctccaactcaagaatgccaggctcctttgctcctggcagctccgaacaatcttgtctggttatcaccggatcgtgcaacagcggatgcaacactcacctgacctcatgagttttatgatggaactgaagatgctgctggaagtcgctctgaagaataggcaagagctctacgccctcccacctcccccccagttttactccagcctgattgaagaaattggcaccctcggctgggataaattggtgtatgcggatacatgcttctcgacgatcaagctgaaggcggaagatgcttccggccgagagcacctcatcaccctgaaactcaaggccaaatatcccgctgaatccccagactacttcgtggatttcccagtacccttctgcgcatcctggacacctcagtcttcccttatcagcatatattcccagtttttagccgctatagaaagtctgaaagctttttgggacgtgatggacgaaatcgacgaaaagacttgggtgctggagccagagaagccacctaggagtgcgactgcccgtcgcatcgccctcggaaataacgtttctatcaatatcgaggttgatccgcgccatcccactatgctgcctgagtgcttctttttgggcgctgatcatgtggtgaagcctttaggcattaaattgtcccgtaacatccatctgtgggaccctgagaatagcgtactgcagaacctaaaagatgttctggaaatcgattttcccgccagagccatcttagagaagtctgatttcactatggattgcggaatttgttacgcctatcaactcgacggtacaatccccgatcaggtgtgtgataacagccaatgcgggcagccatttcatcagatctgcctgtacgagtggctgcgcggcctccttaccagccgccagtcatttaatattattttcggcgaatgtccttattgtagtaagccaatcactctgaagatgtctggtcggaagcactag

SEQ ID NO: 2755 - DNA, 723 bp, Artificial Sequence
  Description of Artificial Sequence: Synthetic coding sequence
atgaccccccacagactgctaccacctctgctgctgcttttggctctgcttctggcagcatcacctggcggggccctagcccggtgtcccggctgtgggcaaggagtgcaggctgggtgtccaggagggtgtgtggaggaagaggatggcggatccccggccgaaggctgcgccgaggccgaaggatgtctcagacgagaggggcaggagtgcggagtgtacaccccaaattgtgcacccggactacagtgccacccaccgaaggacgacgaggctcccttaagggccctgctgctcgggcgcggcaggtgcctgccagcccgtgcacccgccgtggccgaagagaaccctaaggagagtaaaccacaagccggcaccgccagacctcaagacgtgaataggagagatcagcagaggaatccaggcacgagtaccacgccttcccagcccaactctgctggggttcaggatacagaaatggggccctgtagaaggcatctggacagcgtgctccaacagttgcaaacagaagtgtatcgcggtgctcagacactgtatgtaccaaattgtgaccaccgagggttctacaggaagcgacagtgtcgatcatcccagggccaaaggcgcggcccttgctggtgtgtggaccgaatggggaagtccttaccaggcagccccgatggcaacgggtcttcctcatgtcctacaggctcgagcgggtag

SEQ ID NO: 2756 - DNA, 411 bp, Artificial Sequence
  Description of Artificial Sequence: Synthetic coding sequence
atgacacctcacagactcttgccaccactccttctcctgcttgctcttctcttggccgctagccccgggggcgcgcttgcacgctgcccagggtgcggacagggcgtacaggccggctgtccaggtggttgtgttgaagaggaagacggtggctccccagcagaaggatgtgccgaagctgaaggatgcctgaggcgggaggggcaggagtgcggcgtttatacacccaactgtgctccaggccttcagtgccatcctcctaaagatgatgaagcaccactgcgcgctctccttctcggaaggggacgctgtctgccagcaagagcacctgccgtgctgagctccccaagaaccttgcggaagctcagccccgaaccaggcgccacatgctcctgtagaggtgaaagctag

SEQ ID NO: 2757 - DNA, 717 bp, Artificial Sequence
  Description of Artificial Sequence: Synthetic coding sequence
atgactccccacagactgctccccccactcctgctcttactagcgctgcttctggccgcctctcccggtggcgccctcgcccgatgccccggatgtggtcagggcgtccaggcgggttgtccaggtggttgtgtcgaagaagaggatggcgggtctccagcggagggctgtgctgaagcagagggttgcctgaggagggagggtcaggagtgcggagtttataccccgaattgtgccccaggtttacagtgccaccccccaaaagacgatgaagcccccttaagagccttgctactgggcagggggcgatgcctgccggcaagagcacccgccgaggagaacccaaaagagtcaaagccacaggccggcactgccagaccacaagacgtcaatcgtagggaccagcagcgcaatcccgggacgtcaacaactcccagccagcccaactcagctggagtccaggacaccgagatgggtccttgcaggcgtcacctggacagcgttttgcagcagctccagactgaggtctaccgcggagctcagaccctttatgtgcccaactgtgatcacaggggattctataggaaaagacagtgccgctccagccaggggcagcgacgaggcccatgttggtgtgtagatcggatgggtaaatctctgcctggcagccccgacggaaacggcagcagttcatgcccaaccggtagcagcggctag

SEQ ID NO: 2758 - DNA, 837 bp, Artificial Sequence
  Description of Artificial Sequence: Synthetic coding sequence
atgcctaggctgtcgttgttgttgcccctgttgctgctgctcctcctgcccctcttgcctcctctgtccccatcgctgggcatacgggacgtgggcggacgccgtccaaagtgcggcccatgccgtccagaggggtgtcctgctcccgcaccttgcccagcccctggcattagcgctttggatgagtgtgggtgctgcgcacgctgcctgggcgctgagggtgccagctgtggcggcagggctggaggaaggtgtggtccaggcctagtctgcgcgtcccaggctgctggagcagcaccggaaggaacaggactgtgcgtgtgcgcacaaagaggcacggtatgtgggtccgacggccgaagctatccctcagtgtgtgctctgaggttacgcgcccgccatacccctcgcgcccacccggggcatctccacaaggccagggatggtccatgcgagtttgcacctgtggtggtggtcccaccaagatctgtacacaacgtgactggcgcgcaagtgggcctttcctgcgaggtgcgtgccgtccccacgccggtgattacatggagaaaggtcactaaatctccggaaggaacccaggcactggaagaacttcccggggaccatgtgaacatcgctgttcaggtaagggggggccctagcgatcacgaagccaccgcctggatccttatcaatccgcttaggaaagaagacgaaggcgtgtatcaatgtcacgccgctaacatggtgggggaagccgagagccactctacggtgactgtgcttgacctgagtaagtacagatcatttcacttccccgcccccgacgaccggatgtag

SEQ ID NO: 2759 - DNA, 459 bp, Artificial Sequence
  Description of Artificial Sequence: Synthetic coding sequence
atgtgctcacttcccatggctcgttactatatctcttttctgcctgagcctcttcccgccaagtcactccaacacggcgtgccactctccttggactcttcactgtcgagcctgctcgagaagatctgcatcctgcctaatcgcggtttggcaagaacaaaggtccccattttcctgggcatccaaggcggttcacgatgcctcgcctgtgtcgagacagaggagggcccttcacttcagttggaggatgtcaacatcgaagagctgtacaaaggaggcgaagaggccacacgattcaccttctttcagtctagttcaggctcggcctttaggctggaagcggccgcctggccggggtggttcctttgtggtcctgccgagcctcagcagccagtgcaactgacaaaagaatccgaaccttcggcacgcaccaaattttactttgaacagtcttggtag

SEQ ID NO: 2760 - DNA, 459 bp, Artificial Sequence
  Description of Artificial Sequence: Synthetic coding sequence
atgtgtagtctcccaatggcacggtattacatcataaaatacgcggaccagaaggctctttacacaagggatggccaactgctggtcggagatcccgtggcagacaactgttgtgctgaaaaaatatgcattctgccaaaccggggtctcgctaggacaaaagtgcccatatttctagggattcaggggggatctcgctgtctcgcttgcgtggaaacagaggaggggccgagtttgcagctagaggatgtgaacattgaggagttgtacaagggcggcgaagaggctactcgctttaccttttttcagtctagtagcggatcagcatttagactagaggctgcagcatggcctggttggtttctgtgcggtccagccgagccccagcagccggtgcaactcactaaggaatctgaaccttctgcgcgcacaaagttctacttcgagcaaagctggtag

SEQ ID NO: 2761 - DNA, 459 bp, Artificial Sequence
  Description of Artificial Sequence: Synthetic coding sequence
atgtgcagtcttcctatggctcggtattacatcatcaagtatgctgatcaaaaggccctgtacacccgcgacgggcagctactagtcggcgacccagtagcggacaactgttgtgccgagaagatatgtatactgcctaatcgcggcttggcacgcacaaaggtgcccattttcttaggcatccagggggggagtcggtgcctcgcttgcgtcgaaactgaagagggcccttctcttcagctggaagatgttaatatcgaggagctatacaaagggggggaggaagcaacaagattcacattcttccaaagttcctccggctccgcctttcgccttgaggccgctgcttggcctggctggtttctgtgcgggccagctgaaccccagcaacccgtgcagcttaccaaagagtctgaaccctctgccaggaccaagttctattttgaacagtcatggtag

SEQ ID NO: 2762 - DNA, 816 bp, Artificial Sequence
  Description of Artificial Sequence: Synthetic coding sequence
atggctaaggttcccgacatgttcgaagatctgaagaactgctattcagaaaacgaagaagactctagtagtattgatcacctctcgctaaatcagaagtctttttaccatgtgagctatgggcccctccacgaagggtgtatggatcagagtgtctcactatcaatcagcgagacgtccaagacatcgaagcttacttttaaagagagcatggtcgtcgtcgccaccaacgggaaggtgcttaagaaacggagacttagcttgagccagtctatcacagacgacgatctcgaggccattgcaaatgattccgaggaggagattatcaagcctagatccgccccatttagttttttgtcaaacgtcaaatacaattttatgcggatcatcaagtatgagtttatcttaaacgatgcactgaaccagagcatcatcagggccaacgatcagtatcttaccgcggccgccctgcataatctggacgaggcagtgaaattcgatatgggggcatacaaaagctctaaagacgacgctaagatcaccgttattttgcggattagcaaaacccaactctacgttacagcccaagacgaggaccagcccgtccttcttaaggagatgcccgaaatcccaaagacaatcacaggatcagagacaaacttgctgtttttctgggagacccatggcactaagaattacttcacgtccgtggcgcatcccaacttgtttatagcaaccaagcaggattactgggtatgcctggccggcgggcctccctccattaccgactttcaaatcttggagaaccaagcctag

SEQ ID NO: 2763 - DNA, 600 bp, Artificial Sequence
  Description of Artificial Sequence: Synthetic coding sequence
atgaactgtgtttgtaggctagtgttagtagtactgtccctgtggcctgataccgctgtcgcccccggcccccccccaggccctcctagggtgtctccagatccccgagctgaattagactctactgttctgctcaccaggtcgctgctggcagataccaggcagctggctgcccagctaagggacaagttccccgccgatggagatcacaatctcgactccctccctacactggcaatgtccgcaggagccctgggcgctctgcaacttcccggcgtcctgacacgcctgagagctgatcttctttcatatctcaggcatgtgcagtggctcagacgcgccggaggtagttccttgaagactctcgaacccgaattgggcaccctgcaagccaggctcgaccggttgttaagacgactccagctcctgatgagcaggttggcactgcctcagccacctccagatccgccagctccaccactcgcacctccctcatccgcttggggaggcatcagggcagcccacgctatacttggcggcctccacttaaccctcgattgggcagttcgaggcctactgctcctgaagacgagattgtag

SEQ ID NO: 2764 - DNA, 897 bp, Artificial Sequence
  Description of Artificial Sequence: Synthetic coding sequence
atgtggggggcctgcaaagttaaggtgcacgattctcttgccaccattagcattaccctccggcgatacctacgattgggcgcaacaatggcgaaatctaaattcgaatatgtgagagatttcgaggctgatgacacctgtctggcccattgttgggtcgttgtcagacttgatggcaggaattttcaccgatttgccgagaaacacaacttcgccaaacctaacgacagcagagctcttcagctgatgactaaatgtgcccagactgtgatggaggagctggaggacatagttatagcctacggacaatcagacgagtattcttttgtgttcaagcggaagaccaattggttcaagcgaagggcatccaaatttatgacccacgtcgcctcccagttcgccagcagttatgtcttctactggcgtgactattttgaagatcagccactcctgtatcccccagggttcgacggccgggtggtggtgtatccctcaaatcagacactcaaggattacctctcttggcgccaggctgattgccatatcaacaatttgtacaacaccgtattttgggccctcattcaacagagcggcctcaccccagttcaggcccagggtagactccagggtaccctggctgccgataagaatgagattctgttctctgagttcaacatcaactacaataacgaactacccatgtataggaaggggacagtgctgatttggcaaaaagtggacgaagtgatgactaaggaaatcaagctgcccaccgaaatggaaggtaaaaaaatggctgtgaccaggacacgcaccaagccagttcccctccactgtgatattattggggatgcgttttggaaggagcacccagagatacttgacgaagactcctag

SEQ ID NO: 2765 - DNA, 441 bp, Artificial Sequence
  Description of Artificial Sequence: Synthetic coding sequence
atgcacccactcctgaatcccttgttgctcgccctgggcctgatggcccttctcctgaccaccgtcatagctctgacatgtcttggtgggttcgcttctcctggccctgtgccaccttctactgctctcagagagctgatcgaggagctcgttaacatcactcagaatcagaaagcacctctgtgcaacggctccatggtgtggagtattaaccttaccgccggcatgtattgtgccgccttggagagtctcattaacgtgtccgggtgtagcgctatagaaaagactcagcgtatgctgtccgggttttgtcctcataaagttagcgcgggccagttttcctcattacatgtgcgagatacaaaaatcgaagtagctcagttcgtcaaagacctgctgctgcacttgaagaaactattcagggagggccagtttaactag

SEQ ID NO: 2766 - DNA, 3999 bp, Artificial Sequence
  Description of Artificial Sequence: Synthetic coding sequence
atggagtcacactctcgggcaggcaagtcacggaaaagcgctaagtttcggagcatctcacgaagcctgatgttatgtaacgcgaagactagtgatgatgggagctcaccagatgaaaaatatccagatccatttgagatttccctggcccaaggcaaggaggggatctttcattctagcgtccagctggcagacacaagcgaagctggtccgagctccgtacccgacctggctctcgcatctgaggcggcacagctccaggccgccggcaatgacagagggaaaacctgcagacgtatttttttcatgaaagaaagctctactgctagctcgagggaaaaaccgggaaaactggaagcccaaagttcaaatttccttttcccaaaagcttgtcaccaacgagccagatctaatagcacatccgtaaacccgtactgcactcgtgaaattgattttccaatgacaaagaaatccgcagctccaaccgacaggcagccatacagcctgtgttccaatcgtaagtcactgagtcaacagcttgactgtcccgcgggcaaagctgcgggcacttccagacctacaaggagcctgtctacagctcaactggtacagccctcagggggattgcaggcttccgtaatctcaaacatcgttctaatgaaggggcaggctaagggtcttggcttcagtatcgtcggtgggaaggacagtatctacgggcccattggtatctacgtcaagacaatcttcgcaggtggggctgcagcagcggacggaagactccaggagggcgatgagatcttggagctcaatggtgagtccatggcagggctgacacaccaggacgcgttgcagaagtttaagcaagccaaaaagggcctgctaacactcaccgtgcgaacccggctcaccgcacctcccagcttgtgctcacacctcagtccccctttgtgccgctcattgagctcatcaacctgtatcactaaagatagttcctcgtttgccctggaatcgccttcagcaccgatatccactgcaaagcctaactaccgtattatggtggaagtgtccctccagaaagaggccggcgttgggcttgggataggcttatgttctgttccgtactttcaatgcatctctggcatttttgttcacacattgagcccaggaagcgtagcccaccttgacgggcgcctgcggtgcggcgatgagatcgttgagatctctgacagcccagtgcactgcctgaccttgaacgaggtgtatacaattctgtcccattgcgatcccggaccagtgccaattattgtgagccgacatccggatccccaggtatctgagcagcagctcaaagaggccgtggcccaggccgttgaaaataccaaatttggcaaggagcggcatcagtggagtctggagggggtgaagcgtctcgagagttcctggcacggcaggccaacattagagaaggagagggaaaagaactctgcccccccccaccgccgtgctcagaaggtgatgattaggtccagctctgactcttcgtacatgagcggttcgcctggcgggagtcccggctctggatcagccgagaaaccatcaagcgacgttgatatctctacccactcacccagccttccactcgccagggagccagtcgtgctcagtatcgcttcaagccgcttgccccaggaatccccccccctacccgagagtcgagactctcatcctccactgcggttaaagaaatccttcgaaatcctcgtgaggaagcccatgtccagtaaacccaagccacctccacgcaaatactttaaaagtgactccgatcctcagaaatctctcgaggagagagagaactcctcctgctccagcggccacaccccgccgacctgcgggcaggaagcaagggaactgctccctctcctcttgcctcaggaggatacggccggacgtagcccatcggcctctgccggctgtcctggtccaggtataggccctcaaacaaaatcgtctacggagggagagcccggttggcgacgagcgtccccagtcacacagaccagccccattaaacaccccctgttaaaaagacaggctcggatggactattcatttgacacaacagccgaggacccttgggttaggatcagcgattgtataaagaatctgttctctccaataatgtccgagaatcatggacatatgccgctgcaacctaatgcgagtctgaatgaggaggagggaacacagggtcatcctgatggaacaccacccaaactggatactgcaaatgggacccctaaggtatataaaagtgccgatagctccaccgtgaagaaaggaccccctgttgccccaaaacctgcatggtttagacaatccctgaagggcctgcgcaaccgggcatctgacccacgcggactccccgatcccgcgttatctacccagcccgccccagcttctagggagcacctcggcagccatatcagggcctcgtctagctcctcctctatccggcagagaatctctagcttcgaaaccttcggctcgtcacagctccctgataagggcgctcagcgactctcactgcagcccagtagcggagaagccgccaagcctcttggaaagcacgaggaaggtagattcagtggcctgttggggcggggtgctgccccaacccttgtgccgcagcaacccgaacaggtactgagcagcggatcccctgccgcttccgaggcccgggacccgggcgtgagcgagtccccccctccaggtcgccagccaaatcaaaagaccttgccaccaggacccgatccgctattgcgactcctgtcgacacaggctgaagagtctcagggtccggtactcaagatgccgagccagagggcacgtagtttcccactcacacgcagccagagctgcgagacaaaacttctggacgagaagaccagtaagttgtactctatctcttcacaggtgagctcagctgtcatgaaaagcttattgtgcctgccgagctccatcagctgtgcccagacgccgtgtatacccaaggagggggcgtcgccaacttccagttccaacgaggacagcgctgcgaacggttctgccgagacttcagcgctggacacgggcttcagcctcaacctgtcagaactgagggaatacacagagggcctcaccgaagcaaaagaggatgatgatggcgaccactccagcttgcaaagcggccaaagcgtgatatccttgctgagttccgaggagttgaagaagctgatcgaagaggttaaggtcctggatgaagcaactctaaagcagctcgacggcatccatgtgacaatcctgcataaagaagagggagcaggcctgggtttctcattggccggcggcgctgacctagaaaataaggtcatcacagtgcacagggttttccccaacggcctggcctcacaagaaggcaccattcagaagggaaatgaggtgctgagtattaatggcaaatccctgaagggtacgacacatcacgatgctttagcaatcttgaggcaagccagggagcctcggcaggccgttattgtgacccggaagctcacccccgaggctatgcccgacctaaacagttccaccgatagtgccgcctctgccagcgcagcctccgatgtgagcgtggagagcactgcggaagccaccgtttgcacagtgacactagaaaagatgtccgcaggtctcgggtttagcctggaggggggtaagggatccctgcatggcgacaagcccctgaccatcaatcgcatctttaaaggcgccgcttctgaacaaagtgaaactgttcaaccaggagatgaaatcttacaactgggtggcaccgcgatgcaagggttgacgcggttcgaagcttggaacatcattaaggctttaccggatggtccagtgacgatcgtgatccgacgaaagtccttgcagtctaaagagacaacagccgccggagattcctag

SEQ ID NO: 2767 - DNA, 2163 bp, Artificial Sequence
  Description of Artificial Sequence: Synthetic coding sequence
atgtgcagcgtactgcctgtggccgtgactggagtcaagcgcttagagagttcctggcatggacggcccaccctggagaaagagagggaaaaaaacagcgcgcctccacatcgaagagctcagaaggtcatgatacgtagttcttctgattcgagctacatgtcgggatctcccggcgggtctccgggatccgggtccgctgaaaagccctctagcgacgtggatatatccacccactcgccctcactacctctggccagagagccagtcgtgttgagtatcgcgtcctctagactcccacaggaatcacccccactgcccgaatcaagggatagtcatccgccattacggttaaagaagagcttcgagatattggtacgaaagcctatgtcctctaagcctaagccacctccaaggaaatatttcaaaagtgactccgacccccaaaagagtctcgaggagcgggagaattcttcttgttctagcgggcacaccccccccacttgtggtcaggaagcccgggaactgctgccactgctgctgccccaggaggacacggccggtagatcgccctccgccagcgccgggtgccccggtccaggaatcggaccccagacaaaatccagcaccgagggcgagcccggatggcgccgggcttctcccgtcacgcaaacatcccctattaagcacccactgctcaaaaggcaagctcgcatggactactctttcgacaccacagccgaggacccatgggtgagaataagcgactgtattaagaatctgttttctcccattatgtcagaaaaccacggccacatgccactgcaacccaacgcgtctctgaacgaggaggagggcacacagggacatccagacgggactccgcctaagctcgacacagctaatgggacaccaaaggtgtacaagtctgccgactcttcaaccgtaaaaaaaggccctcccgtcgccccgaagccagcctggtttcgtcagagcttgaaaggactccggaatcgtgcgagcgaccctagggggctaccggaccccgcattgtccacccaaccagcgccagctagtcgagaacacctggggagccatatcagggcctctagctccagttcttcaattcgtcagcggatcagctccttcgagacattcggctcctcccagcttcctgacaaaggtgcccagagattaagcctgcagccctcctctggcgaggcagcaaagccactgggaaaacatgaagaagggcgattctcagggctgctgggcagaggagcggccccgacactggtcccgcagcaaccggaacaggtactcagctcaggatcccccgcagcgtccgaggctcgggacccgggtgtatcagaatcccccccacctggaaggcagcccaatcaaaagactctgcccccaggtcccgacccgctacttcgccttctgagtactcaagccgaggaatcccaaggacctgttctcaagatgccctcccagcgggcccgctcgtttccacttactaggagccaatcttgtgagacaaagctgctggacgagaaaacctcgaaattatattcaatctcatcccaagtctccagcgccgtgatgaaaagccttctttgtctgccatcatcaatctcttgcgcccagacaccttgtatcccaaaagagggtgccagccccacttcatcctccaacgaggactccgctgcaaatggcagcgcagagactagcgccctggacaccggcttctcactcaatttgtctgagctgagagaatatactgagggattaaccgaagccaaggaggacgatgatggggatcattcctccctgcaatcggggcaatctgtgatctccctgctcagctccgaggagctaaaaaaactcatcgaagaagttaaagtcttggacgaagccacactgaagcagctagatgggatccacgtcacgattctccacaaggaagaaggggccggattaggcttttccctagctgggggggcagacctggagaacaaggtgatcaccgtccaccgcgtgtttcctaatgggctggctagccaggaaggcacgatacagaagggcaacgaggttctctcaataaacggcaaatccctgaagggaaccacgcaccacgcccggccccaacttctgcactag

SEQ ID NO: 2768 - DNA, 3492 bp, Artificial Sequence
  Description of Artificial Sequence: Synthetic coding sequence
atggaaaggggggctcgcgagatggccgctccaggagattgtcctgctggcaaggcagccgggacatcacgtccaacccggagtctaagcactgcacagcttgtgcagccatccggcggactgcaagctagtgtcatctccaatattgtgctaatgaaaggccaggcgaaggggcttggcttcagcattgtggggggaaaggactccatatatggccccatcggcatttacgtcaaaacaatttttgccgggggggcggcggcggctgatggacgactacaggagggtgatgaaatccttgaactgaacggcgaatccatggcaggcctcacacaccaggacgcactgcagaaattcaagcaggcaaagaagggtctgctgaccctcacagtacgcacaaggctgaccgcccctccaagcttatgcagccatctgtctccccccttgtgtcgcagcctaagcagttctacatgtataactaaggactcttcttccttcgcccttgaaagcccatctgcgccaatcagcacggctaaacctaattatagaataatggtagaagtatctctccagaaggaggccggcgtgggtctggggattggattgtgctcagttccctacttccagtgtatctctggtatttttgtgcacaccttgtcgccaggtagtgtcgctcatttggacggtcggctgcgttgcggggatgaaattgtcgaaatcagtgattctcctgttcactgtctcacactcaatgaagtctataccatcttatcccactgcgatcccggcccggttcctattatcgtgtccagacatccagacccccaggtgagcgagcagcagctaaaggaagcagtcgcccaggcagtggagaacactaaatttggaaaggagaggcatcagtggagcttggagggagtgaaaagattggagtctagttggcacggaagacctaccctggagaaggagagggagaaaaattccgccccacctcaccggcgagctcagaaggtcatgatcaggtcctctagtgattcgagctacatgagcggtagtcccgggggcagcccagggtctggctctgcagagaaaccctcttcagatgtggacatcagtacacacagccccagcctgccactggcccgtgaacccgtggtgctaagcatcgctagcagtaggttaccgcaggaatcccccccactgccagaatcacgagactctcatccgcccctgcggctgaagaagtcgtttgaaatcctggtgaggaaaccgatgagttcaaaacccaaaccacccccacgcaaatactttaagtctgattctgatccacagaagtcactggaggagcgcgaaaacagttcatgcagtagcggacatacccctcccacctgtgggcaggaggccagagagctactacccctgctgctgcctcaggaggacactgccgggcggtctccttctgcctccgcagggtgcccaggaccaggtattggtccacaaacaaaaagcagcaccgagggcgagcctgggtggagacgcgcttctcctgtcactcagaccagtcccatcaaacatccccttcttaagaggcaggcaaggatggattactccttcgacaccacagcggaggacccatgggtaaggatttccgattgcattaaaaatttgttcagtccgatcatgagtgaaaaccacggccacatgcccctgcagccaaatgcctctctcaacgaggaagaggggacccaaggtcatcctgatggaaccccgccgaaacttgatacggcaaacggtactcccaaggtatacaagagcgcagactctagcactgtgaagaagggacccccggtggccccaaaacctgcttggttccgccagtccctaaagggactgcgtaaccgagcctcagacccccgtggcctgcctgatccagctctatctacccagccagcaccggccagccgtgagcatctgggcagtcacataagagccagctcgtctagctccagtatccgacagcggatctcctcctttgaaacctttgggtcatcgcagctcccagataagggcgcccagcgcctctcactgcaaccgagcagcggagaggcggcgaaaccattaggcaaacatgaagaaggaaggtttagtgggctgctgggacgtggggccgctcctacactcgtgccccagcaacccgagcaggtacttagttcgggctcgcctgcagctagcgaggccagggacccaggcgtgtctgaatcaccaccgcccggaagacagcccaaccagaagaccctgccaccagggcccgatccactgctgcggttactcagcacccaggctgaggaatctcagggccctgtcctcaaaatgcctagccagagagcgcgcagctttcctctgacccggtctcaatcttgtgagacaaagctgctagacgagaagacatctaaattgtattccattagtagtcaggtctctagtgccgtaatgaaaagcctcctgtgcctgcccagttcaatctcgtgtgctcagaccccatgtattccaaaagagggtgcatcccccaccagtagctctaacgaggacagtgccgccaacggctcagccgagacctctgcgctggacacaggcttctccctgaatctgtctgaactccgggagtataccgagggactgactgaagccaaagaggacgacgatggcgaccactcatcccttcagtctggccagtcagttatcagcctgctatcatctgaagaactgaaaaagctgatagaagaagtgaaggtgctggacgaggccactctgaagcagctggatggcatccacgttaccatcctgcataaagaagaaggagccggtctcgggtttagtttggcaggcggagccgatttagagaataaagttataactgtacatagagtctttcccaatggactagcttcgcaggaaggaaccatacagaagggcaacgaggttctgagcatcaacgggaagagcctcaaagggactacccaccacgacgccttagctatactgcggcaggctcgtgaaccccgacaggcagtaattgtcaccagaaagctgaccccagaagccatgccggacctgaattcttcgacagacagcgctgcttctgcgtctgctgcctccgatgtcagtgttgagtccaccgaggccacggtctgcacagtgacactggaaaagatgtccgccggactgggattcagcttggagggggggaagggatctttgcatggtgataagccactaacgattaaccggatcttcaaaggagccgcctcagaacaatctgagacagttcaacctggggacgagattctccagctgggcggcaccgctatgcaggggctgactcggttcgaagcctggaacataatcaaagccctgccagacgggcccgtgaccattgtgatccggcgaaaaagccttcagtctaaagagaccactgcggctggggattcctag

SEQ ID NO: 2769 - DNA, 1896 bp, Artificial Sequence
  Description of Artificial Sequence: Synthetic coding sequence
atggactattccttcgatacaaccgcagaagatccgtgggtgcgaatatcagactgtatcaagaatctgttctcacctattatgagcgaaaaccacggccacatgcctctgcagcccaacgcatctctgaacgaagaggaggggacacaaggacaccccgatggcacccctccaaaacttgataccgcaaacggtaccccaaaggtgtacaagtccgcggattctagcaccgtcaaaaagggcccacccgtcgctccaaagcccgcctggtttcggcaatcactaaagggactgaggaaccgcgcgtcagacccgagaggcttaccggacccagctctttctacccagccggctcccgcctcacgcgaacacttgggtagccatattagggcatctagctcctctagctcgatacgccagcggatatcctccttcgagacatttggcagctctcagctgccagataaaggagcccagcgactgagcctgcagccatcttccggcgaagccgccaagccattgggcaagcatgaggagggtcggttctctggcttactgggaagaggagctgccccaacacttgtccctcaacagcctgagcaagtgctgtcatctggatcccccgctgcatccgaggcccgagatcccggagtttctgagagtccccctccaggaagacagcctaatcaaaaaactcttccgcccggcccagaccctctgctgaggctgttaagcacacaagctgaggaaagccaggggccagttctgaaaatgccctctcagagagccagaagtttcccgcttaccaggagccagtcctgtgaaactaagcttctcgatgagaagacaagcaagctgtacagtattagctcccaggtatcttcagctgtcatgaaaagcctattgtgtctgccttccagcatctcctgcgcccagaccccatgtatacccaaggaaggcgcctcgcctacatcctcttccaacgaagattccgccgcgaatggaagcgctgaaacctccgccctcgatacggggttttcacttaatctctccgagttgcgggaatacacagagggactcactgaggccaaagaggacgatgacggggaccattcaagtcttcagtcagggcagtctgtgatctccctgctgtcctcagaagagctgaagaagctcatcgaggaggtgaaagttctcgacgaagcaaccctcaagcagctggatggcatccatgttactatactccataaagaagagggtgctggcctgggcttttcactggccgggggcgcggatctcgagaacaaggtcatcacagttcatcgggttttccctaatgggctcgcatcacaagaaggaacgatccagaaggggaacgaggttctgtccattaacgggaagtcactgaagggcacgacgcatcatgatgcactggctattctgaggcaggcacgagaacccagacaggccgtcatcgtgacacggaagctgacacccgaggctatgcctgacttgaattcgtcgacagacagtgccgcctccgctagcgctgcgtccgatgtgtccgtcgagtccaccgcagaagcaacagtttgcaccgtcacacttgagaagatgagcgccgggctcggattcagcctggaaggggggaagggcagtttgcacggggataagccattaacaatcaatagaatattcaaaggcgcggccagcgagcagagcgaaactgtccagcctggggacgaaatcctccagctgggtgggaccgcaatgcagggccttacccgattcgaggcctggaacatcattaaggcactacccgacgggccagtcacaatcgtgataagacgcaagtccttgcagtcaaaggaaacaaccgcagcaggggacagctag

SEQ ID NO: 2770 - DNA, 1974 bp, Artificial Sequence
  Description of Artificial Sequence: Synthetic coding sequence
atgtggttgcctgtgaaggagcttactattcacgagtgccaacagatgtccacatacagagcccccaaccaggaagccagggagctgctccccctcttacttcctcaggaagacacggcagggaggagtccatctgcctctgcagggtgtcctggccccggaatcggaccccaaaccaagagctccaccgagggcgaaccaggctggcgacgcgctagtcccgtgactcaaacttcacctattaaacaccctctcctgaaacgtcaggctcgcatggattacagctttgatacaaccgctgaagacccatgggtcagaatttcggattgcattaagaaccttttttctcccattatgtcagaaaatcacggacacatgcccctgcagcccaatgcttcactaaacgaggaagagggcacacagggccatccagacggcaccccccctaagctggacaccgccaatggtacgcccaaagtctacaagtctgcggattccagcacagtcaagaagggccctcccgtggcccctaaacctgcgtggttcagacagagtctcaaagggctgaggaacagagcctcggacccccgcggacttcccgaccccgcactatctacacagccagccccagccagtagggagcatcttgggtcccacatccgggcaagcagcagcagctcttctatccggcaaagaatctcgtctttcgaaactttcggcagtagccagctcccagacaaaggggcccagagactttcacttcagccaagttctggagaggcagccaaaccgctgggaaagcacgaagaggggcgcttctctgggctgctggggcgaggcgccgcccccacccttgtacctcagcagccggagcaggtgctctcctctggcagccctgccgccagtgaggcgcgcgatcctggcgtgtccgaatcgccgccgcccggccgccagcctaatcagaaaactctgccgcctggaccggaccccttgctgcgactgctttcgactcaggccgaggagtctcaagggcctgtgcttaaaatgcccagccaacgagcccggtccttcccattgactagatcgcagtcctgcgaaactaaactgttagatgagaaaacatctaaactgtactccatatctagtcaggtgtcttcagccgtcatgaaaagtttgctttgcctgccatcatccataagctgcgctcagactccgtgcatcccaaaggaaggtgccagcccgactagttcttctaacgaggattctgccgccaatggctctgctgaaaccagcgccctggatacaggcttctcccttaatctttcggaacttcgggaatatacggaaggactgaccgaagccaaggaggacgacgatggggaccatagctcactacagtccgggcaatccgtgatatctctgctgtcatccgaggagctcaagaagctgatagaggaagttaaggttcttgacgaagcaactctgaagcagctggatgggatccacgtcaccattctacacaaggaggagggagctggactgggattttccctcgctggtggagcggatcttgagaacaaagtcattacagtgcaccgtgtgtttcccaacggcctggcttcccaggaagggaccattcagaaagggaatgaggtgctgtcgatcaatggcaaaagcctcaaaggaaccactcatcatgatgctcttgcgattctaagacaggctcgggagccacgccaggcagtgatagtaacaagaaaactaacacctgaagcaatgcccgatcttaactcaagcacggacagcgccgccagtgcttccgctgcctcggacgtctcagtggagtctaccgaagccactgtatgcactgtcactttggaaaagatgtctgcaggcttgggatttagcttggagggtgggaaaggaagcttacacggagacaagccactgaccattaatcggattttcaaatag

SEQ ID NO: 2771 - DNA, 1365 bp, Artificial Sequence
  Description of Artificial Sequence: Synthetic coding sequence
atggagtcacacagccgcgccggtaaaagtcggaagagcgcaaaattcaggtcgatctctcggtcacttatgctttgcaacgctaagacctccgatgatggcagctcaccagatgaaaagtaccctgatcctttcgaaatatctctggctcaaggcaaagaagggattttccattcgagcgtacaactcgctgataccagtgaggccggtccaagcagtgtgcccgatctcgctctggccagcgaggctgcccaattacaggcggctggtaacgaccggggcaaaacttgtcgccgaatcttttttatgaaggaaagctcaacagcgtcttcaagagaaaagccaggaaaacttgaggctcagtcttctaacttcctgttccctaaggcatgtcatcagagggctagatctaactctacgtcagttaatccttattgcacaagggaaatagatttcccaatgactaaaaagtccgcagccccaactgacaggcaaccttattccttgtgcagcaatcgcaaatcgttgtcccaacagctggattgcccagcaggcaaggctgctggaaccagcaggccaacccggtccttaagtactgcgcagttagtacagccgtcaggtgggctccaagcatccgtcataagtaacatcgtcttgatgaagggacaggcaaaggggctgggtttttcgatagtcggcggaaaagactcgatctacggtcctattggtatatacgtgaagaccattttcgccggcggagccgccgctgctgacggccgattgcaggaaggagacgagatactcgagctgaatggcgaaagcatggccggcttgacccaccaggacgccctccagaaatttaaacaggcgaagaaggggctgctcaccctcacggtgagaacaagacttactgcaccgcccagcttgtgcagccacctgtctccacctctgtgtcggagtctgagctcaagcacttgcattacaaaagattctagctccttcgcattggagagtcctagcgcccccatttctaccgctaagccgaactaccgcatcatggtcgaggtctcactccaaaaagaagctggggtgggcctcgggattggactttgctccgtcccatacttccagtgcattagcggaatttttgtgcacacactgtctcctgggtctgtcgcccacctagatggccgattacggtgtggggacgagattgttgaaatttctgactctcctgtacactgcttaactctgaacgaggtgtacactatcctgtcccactgcgaccctggacctgtcccaatcatcgtgagcagacatccggaccctcaaaaggaggaaatggaggcacaggaggtgaagtag

SEQ ID NO: 2772 - DNA, 1683 bp, Artificial Sequence
  Description of Artificial Sequence: Synthetic coding sequence
atggactacagttttgacacaactgccgaagatccctgggttcggatcagcgactgtattaaaaacctcttctcacccatcatgtctgaaaatcatggtcacatgccattgcagcccaacgcttctcttaatgaagaggagggaacgcaagggcacccagacgggacgcctccaaagctggatacagccaacggcactcccaaggtgtacaaaagtgccgactcctctactgtcaagaaaggtccaccagtggccccaaagcccgcctggttcagacagtctctgaaagggctccggaacagggcttccgaccctagaggattgcctgacccagctctgtccactcagcccgctcccgcgtctagagaacatttaggcagtcacatccgggcatcctccagcagcagttccattcgacagcggatcagctcatttgaaactttcggatcctctcagcttcccgataaaggcgcccagaggctgagcctccaaccaagtagtggagaggccgccaaaccacttggaaagcacgaagagggccggttctccggcttgctgggtcggggtgccgctcctacgctcgtgccgcagcaaccagaacaggttctctcatctgggtctcctgccgcttccgaagcccgtgaccccggggtttccgagagtcccccgcccggtcgtcagccgaaccagaagaccctgccgcctggtcccgacccactgctccgactgctttctacacaggccgaagaaagccagggccccgtccttaaaatgccgagccaacgcgcgaggagtttccctctgactcggagtcagtcttgcgagacaaagctgcttgacgagaagacctctaagttgtacagcatatcatcccaagtgtccagcgcagtcatgaagtcactcctctgtctgccctcttctatcagctgtgcccaaaccccctgcataccgaaggaaggggcctccccaacatcgtctagcaacgaggactcagccgccaatgggagtgccgagacgtccgccttggatacggggttctccctgaacctctctgagctgagagagtacaccgagggactcacagaggctaaggaggatgacgatggagaccattcctcgttgcagagcggacagtcagtgatttctctgctctcatccgaggagcttaagaaactgatagaagaggtgaaggtgttggacgaggctacgctgaaacagcttgacggtatccacgtgacaattctccacaaggaagagggcgctggcttaggattttcccttgcgggcggcgctgatttagagaataaggtgatcaccgtgcaccgggtattccctaacgggcttgccagtcaggaaggtaccattcaaaaagggaacgaggttttgagcatcaatggaaagagcctgaaagggacaactcatcatgatgccctagcaattctcagacaagcccgtgagccccgacaagctgtcatcgtgactagaaagctgaccccagaggctatgccagacctcaactcatctactgatagtgccgcctctgcaagtgcagcgtcagatgtatccgtggaatccaccgaggcaactgtgtgtactgtaacgttagaagatgttggcagagctgggctgcagccaggaaggagagagggattgcctacaagaagacaagcctcacaccattag

SEQ ID NO: 2773 - DNA, 3996 bp, Artificial Sequence
  Description of Artificial Sequence: Synthetic coding sequence
atggaatcgcactcacgcgcaggcaaatccaggaaaagcgccaaatttcgctctatcagtaggtccctgatgctttgcaacgccaaaacatccgacgatggaagcagcccggatgagaagtatccagatccattcgagatctccttggcacagggtaaggaagggattttccatagctccgtccagctcgctgatacttccgaggccggcccgtcttcggtcccagatctagccctggcctcagaggcggcacagctgcaggctgcaggcaacgatagaggaaaaacatgtcgacgcattttctttatgaaggagtcttccaccgcgtctagcagggagaagcccggcaagctggaagcacagagttccaactttctgttcccaaaagcgtgccaccagagggctcgcagcaactcaacatctgtgaatccctactgcacaagagagatcgacttccccatgacaaagaaaagcgcagcaccaaccgacagacaaccctattctctgtgctctaatcgtaaatccctttctcagcaactcgattgccctgcaggaaaagctgcgggcacctctaggccaactcgatcattatcaacagcgcaattggtgcagccgtcggggggcctccaggcctccgtgatctctaacatcgtgttgatgaaaggccaagcgaaagggctgggcttcagcattgtgggcggtaaagattccatttatggtccgattggcatctacgttaaaactatattcgccggcggggcggccgccgctgacgggcgcctgcaggaaggtgacgaaatattggagctaaacggcgaatccatggccggtctcacgcaccaggatgctctccagaagttcaaacaggccaaaaaagggctgttgacgcttaccgttcgtacaaggctgactgcccctcccagtctttgctctcacctgagccctcccctttgccgaagcctttcaagttctacctgcatcaccaaagactcatccagcttcgcactggaatccccctctgcacctataagcacagcaaaacccaactaccggattatggttgaggtgagcctgcagaaagaagcaggagtgggactgggtatcgggctctgttccgttccctattttcagtgtatttccggcatttttgtccacacgcttagcccgggcagcgtagcccatctggacggtcgtctcaggtgcggagatgagatagttgaaatctccgactcaccggttcactgcctaaccctgaacgaggtgtacacaattctttcccactgtgatcccggaccagtgccaataatcgtttcccggcatcctgatccacaggtttccgagcaacagttgaaagaggcagtggcacaggcagtcgaaaataccaagtttggcaaggagcgccatcagtggtctctagaaggcgtcaagcgccttgaaagttcatggcatggcagaccaactctggaaaaagagcgcgaaaagaacagtgccccgccacacagacgggcccagaaggtgatgattcgctcctcatccgactccagctatatgagcggcagccccgggggcagcccaggctcaggttctgcagagaagccatcgtcagacgttgacatctctacccactctcctagcctgcctttggccagagagcccgtcgtgctgtcaattgcttcctcacggttgccccaggagtccccgcccctgcccgagtctagagattcccacccccccctgcgtcttaaaaaaagttttgagattttagtccggaaacccatgtcaagcaagcccaaaccccccccaaggaagtactttaaatctgactctgaccctcagaaatctctcgaggaaagagaaaacagtagttgttctagcggacacactccaccaacctgcggacaggaggctcgtgaattactgccgctcctgctgccacaggaagacactgcaggcagaagtccatccgcgagtgcaggctgccctggaccggggattgggccccaaaccaagagctccacggaaggtgagccgggttggagacgtgcttctcctgtgacccagacaagcccaattaagcaccctctgctgaaacgtcaggcacgaatggattactcattcgacaccaccgcggaggatccatgggtgaggataagcgactgtataaaaaatctgttctctcctataatgtcagagaaccacgggcacatgcccctacagcctaatgcatccctgaacgaggaagaagggacccaaggtcaccccgatggcacgccccctaagctggatacagctaacggcactcccaaagtatataaaagcgcagattcctccacagttaagaaagggcctccagttgctcccaagccagcatggttcaggcaatctctgaagggccttcgaaacagagcgtctgatccccgcggccttcccgacccagccctgtccacacagcccgcacccgccagcagggagcacctgggtagccacataagggcctcttcctcgagctcttccatcagacaaaggatctccagttttgagaccttcggctctagccagctgcctgacaagggggctcagcgactgtccctccagccaagcagcggcgaggccgccaaacctttgggcaagcatgaagaagggaggtttagcgggctattaggcaggggcgctgcacctacactggttcctcagcagccggaacaggtgttgtcatcgggaagtcccgctgcttccgaggcaagagatccgggtgtctccgaatctccaccgcctggacggcaaccgaatcaaaaaactctgcctccaggcccggatcccttacttcgccttctgagtacccaggctgaggagtctcaggggcccgtgctcaagatgcccagtcagcgggcaaggtccttcccactgactcgctcacagtcttgtgaaacgaaattactggatgagaagactagtaagctctactccatcagctcacaggtctcgagcgcagtaatgaagtcactactgtgccttccgagttctatcagttgtgcgcagaccccgtgcatccctaaagaaggagcctccccgaccagtagcagcaatgaagactctgctgccaatggcagcgccgaaactagcgcactggacacaggatttagcctgaacctatctgagctgcgagagtacacggagggcctcactgaggcaaaagaagacgacgacggggatcatagttccctccagtccggccagagcgtgatttcactactgtcctcagaggaacttaaaaaactcatcgaggaggtgaaggtgctcgatgaagcaactttaaaacaattggacggtatccacgtgacaatcctccataaggaggagggcgctgggctggggttttccttagccggaggtgccgacttagagaataaggtgattactgtccaccgggtgttcccaaatggtcttgcgtcacaggagggaaccattcagaagggcaatgaggtactgagcattaatggtaagtctttgaaaggcactactcatcatgacgcactggctattctgcgtcaggcccgggagcctagacaagccgtgattgtaacaaggaagctgaccccagaggcaatgcctgatcttaactccagtacggactctgcggcctccgcttctgctgcatctgatgtgagcgtggaatcaacggaggcaacggtgtgcaccgtcacactcgagaaaatgtccgccggccttggctttagtttagaagggggcaagggctccctgcatggggataaaccgctcaccattaaccgaatcttcaagggcgcagcctctgagcagtcagagacagttcaacctggtgacgagattctgcagctggggggtaccgcaatgcaaggcctcacgcgattcgaagcctggaacattatcaaagccctccctgatggacctgtgaccatcgtcatacggagaaaatccctccagagcaaagaaacaaccgccgccggagatagttag

SEQ ID NO: 2774 - DNA, 1785 bp, Artificial Sequence
  Description of Artificial Sequence: Synthetic coding sequence
atggaaagccactcgagggccggtaagtcccgcaaatccgccaagttcagatctatttcacgctccttgatgctctgtaacgccaagacaagcgatgacggctctagtccagacgaaaaatatcccgatccatttgagatcagcctagctcaggggaaagagggtattttccacagttcagtacaattggctgacacttcagaggctggtcctagctctgtgcctgacctggcccttgcgtcggaggccgctcagctccaggcggctggcaacgacagaggtaagacctgcagaagaatctttttcatgaaggagtcatcaacagcttcttcacgagaaaaaccaggtaagctcgaagcacagtcctctaatttcttgttccccaaggcctgccaccagcgcgccagaagcaatagtacaagcgtgaatccttattgtacccgtgaaatcgacttccccatgacaaagaaaagcgctgccccaactgatcggcagccatatagtctgtgctcaaatcggaagtcgctgtcccagcaactggactgccctgccggcaaggcagcaggcacatccagacccacaaggtctctgagtaccgcacagctagtccagccaagcggaggactgcaggctagcgttatctccaacatcgtcctgatgaagggccaggctaaaggtctggggttttctattgtgggaggaaaagactctatttatggtcctataggcatctatgtgaaaaccatctttgctggcggggccgctgcagccgacgggaggctgcaagagggcgatgagattctcgaactcaacggcgaaagcatggcaggactaacacaccaggatgcgctccaaaagtttaagcaggccaagaaaggactgttaaccctgacagtgcggactcggttgacagccccaccttctctgtgcagccatctttctccacctctgtgtcgaagcctgtccagtagcacatgtataacaaaggattcaagcagcttcgccctcgaaagcccatcagcacccatcagtacagccaaacccaattatcgtataatggttgaagtcagcctccagaaagaggccggcgtgggtctaggaattggtttatgcagcgtcccgtacttccaatgtatatctggcatcttcgtgcacacactctctccaggcagcgttgcgcatctcgatggcaggctgaggtgcggtgacgagatcgtcgagatctccgattcaccagtccattgcctcactttgaatgaggtgtatacaatcctgtcccactgcgatcccggtcccgtgccaatcattgtctctcgccacccagacccccaggtaagcgaacagcaactgaaggaagccgtggcacaggctgttgaaaacaccaaatttggaaaggagaggcaccagtggagcctggagggggtgaagcgtctcgaaagcagctggcacggcagacccacgcttgagaaagagagggaaaaaaactcagcgccaccacatagaagggcccagaaggtcatgatacgaagcagctcagactcttcttacatgagtggcagtcctgggggctcccccggctccgggagcgccgagaagcctagtagtgatgtagatatctcgacccactctccgagcttgcccctggcacgcgaacccgttgtgctgtctatcgcatcatctagactgccccaagagagtccccctctccctgaaagtagggatagtcacccgccactgagactgaagaaatcttttgagatccttgttcggaaacctatgtcgtag

SEQ ID NO: 2775 - DNA, 468 bp, Artificial Sequence
  Description of Artificial Sequence: Synthetic coding sequence
atgacccctggaaagactagcttagtgtctctgctgctgttattgtcgctcgaggctattgtgaaagccgggataactatacctcgcaaccctggttgtcccaactcagaagacaagaactttcccaggactgtcatggttaatttaaacatacataataggaacacaaacacaaaccccaagaggtcctctgactactacaaccggtctacgagcccctggaacctccaccgcaatgaggacccagagagatacccctccgtaatttgggaggcaaaatgtcgccacctgggatgtattaacgccgacggaaatgtggactatcatatgaactcagtgccgattcagcaagagattctggtgctccggagggaacctccccactgcccgaactcctttcggctggagaaaatccttgtttccgtgggttgcacctgcgtcacccctatagtgcaccacgtggcctag

SEQ ID NO: 2776 - DNA, 543 bp, Artificial Sequence
  Description of Artificial Sequence: Synthetic coding sequence
atggactggccacataatttactgtttctgttgacaattagtatatttctcggattggggcagcccaggagtcctaaaagcaagaggaaaggccaaggccggccaggacccctggcccctggcccccaccaggtgcccctcgaccttgtatcccgcatgaagccttacgctcgcatggaggaatatgagagaaacattgaggaaatggtagctcagcttcgcaatagctccgagctagcccagagaaaatgcgaagtgaacttgcagctgtggatgtctaataagaggtccctgagtccttggggctattcgattaatcacgatccttccaggatccccgtcgacctgcctgaggcaaggtgcctctgcctcggttgcgtgaatccatttaccatgcaagaggaccggtctatggtgtccgtcccggttttttcgcaggtgcctgtccggagacggctgtgtcctccccccccccggactgggccatgccgccagcgggcagtgatggagaccatagcggtcgggtgcacgtgcatcttctag

SEQ ID NO: 2777 - DNA, 594 bp, Artificial Sequence
  Description of Artificial Sequence: Synthetic coding sequence
atgaccttgctgcccggtctgctatttctgacatggctccacacctgtctcgcccaccatgatcccagcctgagaggtcatccccactcccacggcaccccgcactgttacagtgccgaagagttacctctagggcaggctccccctcacctgttagccagaggggcgaaatggggccaagctttaccggttgctctggtatcctctctggaggcagcctctcaccgcggacggcacgagaggccctcagctactactcagtgccccgtgcttagaccagaagaagttctggaggccgatactcatcaaagatccatctcgccttggaggtaccgagtcgataccgatgaggaccgttacccacagaaactcgcctttgccgagtgtctctgcaggggttgcattgacgcaaggaccggacgagagacagcagctctcaattccgttagactgctgcagagtctccttgttctcaggcgcaggccatgttcccgtgacgggtccggattgcctacccccggagctttcgccttccacaccgaatttattcacgtgcctgttgggtgcacctgtgtgctccccaggtcagtgtag

SEQ ID NO: 2778 - DNA, 609 bp, Artificial Sequence
  Description of Artificial Sequence: Synthetic coding sequence
atgctggtcgcagggtttctgctggcactgcccccatcgtgggctgccggtgcccccagagcaggccggcgccccgctaggcctagaggttgtgcagacagacctgaagaactcctggaacagttgtacggtaggctggccgctggcgttctgtctgccttccaccatacgctgcagctcggaccaagggaacaggcccggaacgcatcatgtccagcaggggggcgcccagctgaccggagattcaggcccccaactaatttacgtagcgtttccccctgggcctacagaatatcatacgaccccgcccgctatcctagatatctgcctgaggcatattgcttgtgtcgcggctgtttgaccggcctgtttggcgaggaggacgtgaggttccgatcagcccccgtgtacatgcctaccgtggtcttgcgcaggacacccgcctgtgcgggcgggcgatcagtctacactgaggcctacgtcaccatccccgtgggatgtacttgtgtcccagaacccgagaaagacgcagattctataaattcgtcgatcgacaagcagggcgctaaactcctgctgggccccaacgacgccccagcgggcccatag

SEQ ID NO: 2779 - DNA, 492 bp, Artificial Sequence
  Description of Artificial Sequence: Synthetic coding sequence
atgacggtgaagacgttgcacggtcctgcgatggtgaaatacctgctgctgtctattttggggcttgcgtttctgtcagaggcagctgctagaaagattccaaaggtgggacacacgttcttccagaaacctgagtcttgtccccctgtacccggcggatctatgaagcttgacatcggaatcatcaatgaaaatcagcgcgtgtcgatgagccggaacatcgaatctagaagtacgtccccctggaactatactgtgacttgggatccaaatcggtaccctagcgaggtcgtccaggcacagtgcagaaatcttgggtgcatcaacgcccaaggaaaagaagacatttcaatgaattctgtccctatccagcaggagacactcgtagtgagaaggaagcaccagggctgcagtgtttcatttcaactggaaaaagttctcgtaactgtggggtgcacctgcgtgacgcccgtgatccaccacgtgcaatag

SEQ ID NO: 2780 - DNA, 531 bp, Artificial Sequence
  Description of Artificial Sequence: Synthetic coding sequence
atgaaggcatccagtctcgcctttagcctgctctcggcagcattctatctattgtggacgccctctacaggactcaagacattgaatttagggagctgcgtcatcgccactaacctgcaggagattcgcaatggattcagtgaaatccgcggctcggttcaggccaaagacggaaatattgacatccgtatccttcgccgcacagaaagcctgcaggacacaaaaccagcgaatcgctgctgcctcctccgtcacctgctgagactgtacctggacagagtgtttaagaactaccagacaccggatcactataccctgaggaagatttccagccttgccaactcattccttaccatcaagaaagacctacgcctctgccatgcccacatgacatgtcattgtggtgaagaagctatgaagaagtattcacaaatactgtcccatttcgaaaaactggaaccgcaagcggccgtggtaaaagctttgggagaactggacatcctgctgcagtggatggaggagacagagtag

SEQ ID NO: 2781 - DNA, 531 bp, Artificial Sequence
  Description of Artificial Sequence: Synthetic coding sequence
atgaaggcctccagcctggctttttcccttctttcagccgctttttatttactgtggacgcccagtaccggactgaagaccctgaacctgggcagctgcgtcatcgctacgaaccttcaagagattcggaacggctttagcgagataagagggtctgtccaggcaaaggatggtaatatcgacataagaattttgaggaggaccgagtctttgcaggatactaaacctgctaacaggtgctgcctgcttcgccatttactaaggctgtacctggaccgggtttttaagaattatcagaccccagatcattataccctccgcaagatttccagcttggccaattcattcttgactattaagaaagacctcagactgtgtcacgctcacatgacatgtcattgtggcgaagaggcaatgaaaaaatactcacagatattgagccactttgaaaagttggaaccacaggccgcagtagttaaagctctgggagaattggacattctgcttcagtggatggaggaaacggaatag

SEQ ID NO: 2782 - DNA, 456 bp, Artificial Sequence
  Description of Artificial Sequence: Synthetic coding sequence
atgaaggccagctcccttgccttcagcctgctttcggcggccttttacctcttgtggacaccaagtactggactgaagaccctgaacttgggctcatgtgtgatcgccactaacctgcaagagatcaggaacgggttcagcgaaattcggggttccgttcaggccaaagacgggaacatcgatatcaggatcctgaggagaacggaatccttacaggacacgaaaccagccaaccgctgttgcttactgcgccacctgcttagactttatctagaccgggtcttcaagaattaccaaaccccagaccattacacacttaggaaaatcagctcactggctaattcctttcttactatcaaaaaagatttgcgcctgtgcttggaaccccaagcagccgtggtgaaggctctgggcgaactggatatcctgctgcagtggatggaagagaccgaatag

SEQ ID NO: 2783 - DNA, 540 bp, Artificial Sequence
  Description of Artificial Sequence: Synthetic coding sequence
atggccgccttacagaagagcgtgtcttctttcctaatgggcaccctcgccactagctgcttgctcctcctggcactcctggtccagggtggagcagctgcgcccatcagtagccattgcaggttggacaagtctaactttcaacagccatacattacaaaccgtacgtttatgctagccaaagaagcatcactggctgacaataatacggacgtaagacttatcggagaaaaactgttccacggggtgagtatgagcgaacgctgttatctgatgaagcaggtcctcaatttcacactggaagaagtattgttcccccaatcagacagattccagccatacatgcaggaggtggtccctttcctggcgagattgtcaaatcgtttgtccacctgtcacattgagggcgatgaccttcatatccagaggaatgtgcagaagcttaaggacactgttaagaagctcggagaaagcggagaaattaaagccattggggagctggacctgttgttcatgagtctcagaaatgcctgtatctag

SEQ ID NO: 2784 - DNA, 540 bp, Artificial Sequence
  Description of Artificial Sequence: Synthetic coding sequence
atggccgccctccagaaatctgtctccagtttccttatgggtacactcgctactagttgtctgttgttgttggcgctgcttgtccaaggaggtgccgctgcgcctatctcctctcactgtaggctggacaaatcaaacttccagcaaccttatattactaaccgaacttttatgcttgcgaaagaggccagcctggctgataacaatacagacgtgaggttgattggagaaaaactgtttcatggcgtttccatgagcgagcggtgttacttgatgaaacaagtgctcaacttcacacttgaagaggtgttatttccccaatccgataggttccagccctacatgcaggaggtggtaccttttctggcccgcctctccaaccgactgagtacctgtcacattgagggtgatgatcttcatatacaacgtaatgtacagaagctaaaggacacggtgaagaaactgggggagtcaggtgagatcaaggcgatcggcgaattggacctgctttttatgagtctaagaaacgcttgtatttag

SEQ ID NO: 2785 - DNA, 1890 bp, Artificial Sequence
  Description of Artificial Sequence: Synthetic coding sequence
atgaatcaagtgactatacaatgggacgcggtcatcgccctctatattctattttcttggtgtcacgggggcattacgaacatcaactgttccggtcatatttgggtggagcccgctacaatcttcaaaatgggcatgaatatctccatttattgtcaagccgccatcaagaattgtcagccccgcaaactgcatttctacaagaacggcattaaagaacgtttccagattacacggattaacaagaccactgcgcgcctctggtataagaatttccttgagccccacgcctctatgtactgtacagccgaatgtcccaaacactttcaggagacactgatctgtggcaaagatatatcttctggctacccaccagacattcccgacgaagtgacatgcgtcatttatgagtatagcggaaacatgacctgcacttggaacgccgggaaactgacatatatcgatactaagtacgtagtgcacgtcaagagcctggaaacagaagaggaacagcaatatctgacttcatcatatatcaacatcagcacagactcactgcaggggggcaaaaaatacctggtgtgggtgcaggctgcaaacgctctcgggatggaggagtccaagcagttacaaattcaccttgacgacattgtgattccttccgctgcggtcatcagccgtgcagaaaccatcaatgccactgtcccaaagactattatatattgggactctcagactaccattgagaaggtgtcctgcgagatgagatataaggctactaccaaccagacttggaatgtaaaagaattcgacaccaattttacatatgtacagcaatcagagttttacctggagccgaatatcaaatatgtttttcaggtccggtgccaggagaccggcaagcggtactggcagccctggtcctctctgttctttcacaagacccccgaaacggtgccacaagtgacaagtaaggcctttcaacatgatacctggaactcgggactgacagtagctagcattagtacggggcacctgacctccgataacaggggcgacatcgggttactcctagggatgatagtgttcgctgtgatgctctcaattttatcactgatcgggatattcaaccggtcttttaggacgggcataaagcgaaggattctgctcctcatcccgaaatggctttacgaggatattcccaatatgaagaacagtaacgtcgtcaaaatgttgcaagagaactctgagctgatgaacaacaatagcagtgaacaagtgctgtacgtggacccaatgattaccgagattaaagagatattcattcctgagcataagcctacagattacaaaaaggaaaacactggtcccctggagacacgtgattatccacagaactcattattcgataacaccaccgtggtgtacattcctgacttgaatacgggttataaaccacagattagcaattttttgcccgaagggtcccatctgtcaaataacaatgaaataacctccctaacactgaagccccctgtggactccctggactctggaaacaatccaagactacagaaacaccctaatttcgcattttcagtttcttcagtcaactctctgtcaaacacaatatttctgggcgagctgtcgctgatcttaaaccagggtgaatgctctagccccgacattcagaatagcgtagaagaagagacaacgatgcttctcgagaacgacagccctagcgagacaattccggagcagacccttctgccagatgaattcgtatcgtgcctggggattgtgaatgaagagcttccctccattaacacatatttcccccaaaatatcttggagagccacttcaacagaatcagtctcctcgaaaagtag

SEQ ID NO: 2786 - DNA, 1071 bp, Artificial Sequence
  Description of Artificial Sequence: Synthetic coding sequence
atgaatcaagtaaccatacagtgggacgcagtcattgcgttgtacattcttttcagttggtgccacgggggtatcaccaatatcaattgttccggccatatatgggtggagcctgcaaccatctttaaaatggggatgaacatatctatctactgccaagcagccattaagaactgtcaacctcgcaagcttcatttctacaagaacggaatcaaagagagattccagataactagaattaacaaaaccaccgcccggctttggtacaagaactttctagaaccccatgcttctatgtactgtaccgccgagtgccctaaacatttccaggaaacactgatttgtggaaaggatatttcaagtggctacccccccgacatccctgatgaagtgacttgcgtgatctacgagtattccggaaatatgacttgtacctggaacgctgggaagctaacatacatcgatacaaaatacgtcgttcacgttaaaagtctggaaacagaggaggagcaacagtacttgacttccagctacattaacatttcaactgacagcctgcaaggcggcaagaagtatttggtgtgggtccaggctgccaacgctctcggaatggaggaatctaagcagcttcaaattcatctggacgacatcgtgataccgagcgcagcagtgatttcgcgagctgaaaccataaacgccaccgtgcccaaaaccattatttactgggatagtcagaccacgattgaaaaggtgtcatgtgaaatgagatacaaggccactacaaatcagacctggaatgtgaaagagtttgacacgaattttacttacgtgcagcagagtgagttttacttagaaccgaacataaagtacgttttccaggtgcgctgccaagaaacgggcaagcggtactggcagccttggagctcactcttcttccacaaaacgcccgagaccgtcccacaggttacatccaaggccttccagcatgatacttggaactccggcctgaccgtcgcctcaatcagcacggggcatcttactagcggactgaaggaaggttcatactgctag

SEQ ID NO: 2787 - DNA, 1125 bp, Artificial Sequence
  Description of Artificial Sequence: Synthetic coding sequence
atgatcctgcggccatatcagccctgcggaacagtgaaagagttcgacactaactttacatatgtgcagcagtcagagttctacctcgagcctaacataaagtacgtgtttcaggtacgatgccaggaaactggtaagcgctattggcagccctggtcgtcactgttctttcataagaccccagagaccgtcccccaggtgaccagcaaggcatttcagcatgatacctggaatagcggcctgacagtcgcatccatcagcaccgggcatctaaccagtgataacagaggagatatcggactattactgggcatgattgtattcgccgtgatgctgagcattctaagtctcattgggatcttcaaccgtagctttagaaccggcataaagagaaggatcctgctgctgatccccaagtggctttatgaggatattcccaacatgaagaactcaaatgtggtcaagatgctccaggagaactctgagctcatgaataacaactcttctgagcaggtactgtatgtggatcctatgatcacagaaatcaaagagatttttatccctgagcataaacctacagactacaagaaagagaatactggacccctggaaaccagagattacccgcagaattcattgttcgataacacaacagttgtgtatatcccagacctgaacacgggctataaaccccagatcagcaattttctccctgagggttcacacttgtccaacaacaacgaaataactagtctcaccctcaaacctcccgttgacagcttggatagcggaaataaccctcggctacagaagcacccaaactttgcctttagcgtgtcgtccgttaatagcctctctaacacaatcttcttgggggagctctctctgattctgaaccaaggcgaatgttcaagtcccgacattcagaactccgtcgaagaagagactaccatgcttttagaaaacgactcaccctctgaaaccattccagaacaaaccctgctgcctgatgagtttgtaagctgtttgggcattgtcaatgaggagctgccatccataaatacatactttcctcaaaatatactggagagccattttaatcgaatctctctgctcgaaaaatag

SEQ ID NO: 2788 - DNA, 354 bp, Artificial Sequence
  Description of Artificial Sequence: Synthetic coding sequence
atgacatgtacgtggaatgctggaaagctcacctacattgatacgaagtacgtcgttcatgtgaaaagcctggaaaccgaggaagaacagcagtatctaacatcgagttacatcaatataagtactgattcactccaggggggaaaaaagtatgtctttcaagtgaggtgtcaggaaaccgggaaacggtactggcagccgtggtcttcactttttttccacaagacccctgaaaccgtgccacaagtcacctcaaaggccttccagcacgacacctggaattcgggcctgacagtggcaagcatttctaccggacacctgaccagtggccttaaggagggctcctactgttag

SEQ ID NO: 2789 - DNA, 1176 bp, Artificial Sequence
  Description of Artificial Sequence: Synthetic coding sequence
taacattttcttctaccccctctgagtaagaagagcctgctccctcccacgatgatactgcgtccctaccaaccttgcggaactgttaaggaattcgataccaattttacatacgttcagcaaagcgagttttacctggagccaaacataaaatatgtgtttcaggtccggtgccaggaaacgggcaagagatactggcagccatggagttctttatttttccataagactcccgaaactgtgccccaggtgacttccaaagctttccagcacgatacatggaatagcgggttaaccgtggccagcatatcgactgggcacttgacatctgacaacaggggtgatatcgggcttctcctgggtatgattgtgttcgccgttatgctatccattctctctttaattggcattttcaatcggtcatttcgcaccggaataaaaagaagaatactcttgctgattcctaagtggctgtacgaggacatccccaatatgaagaacagcaatgtagtaaaaatgctccaagagaactctgagctgatgaacaacaactcttctgaacaggtgctgtacgtcgaccctatgattacagagatcaaggagatttttatacccgagcacaagccaaccgattacaagaaggaaaacactgggcctttagaaactcgagactacccacagaattcacttttcgataatactactgtggtttatattccagatctaaacactggttataagccccaaatttccaacttcctaccagaggggagccatctgtctaataataatgagatcacttccctaacactgaaacctcctgtcgacagccttgattctggaaacaatccccgccttcagaagcatcccaatttcgccttttcggtgtcttccgttaatagcctgagtaataccatatttttaggagagttatctctgatcttgaaccagggtgagtgcagttctcccgatattcagaattcagttgaggaggaaacaaccatgctcctcgaaaatgatagtccttccgagactatccccgagcagactctgcttcctgacgagttcgtatcctgcctgggtattgtgaacgaagaactgccttcaataaacacttattttccacaaaatatccttgagtcccattttaacagaatatctttgctggagaagtag

SEQ ID NO: 2790 - DNA, 828 bp, Artificial Sequence
  Description of Artificial Sequence: Synthetic coding sequence
atgacctgcacatggaatgccggcaaactcacgtacatcgatacaaagtacgtcgtccatgtgaaatcactggaaactgaggaagagcagcaatacctgactagctcctacataaacatcagtacggattccctgcagggcggaaagaagtatctggtctgggtccaggcagctaatgcactgggtatggaggagtcaaaacaactgcagattcacctggatgatattgttatccctagcgccgccgtaatttcccgggctgagacaatcaatgctaccgtcccgaaaacgatcatctactgggactcacagaccacaattgagaaagttagctgtgaaatgcgctacaaggcaacaaccaaccagacttggaatgtaaaggagtttgatactaatttcacctacgtccagcagagtgagttttatctggagcccaatatcaaatatgttttccaggttagatgccaggagaccggaaaaagatactggcagccttggtcctccttgttctttcataagaccccggagactgataataggggcgacatcgggttactgctggggatgattgttttcgcagtcatgctgagtattctatcacttattggtattttcaacaggagttttcgtaccggcattaagcggaggatcttgctcttaatcccaaaatggttgtacgaggatataccaaatatgaaaaatagcaacgtggtgaaaatgttacaggagaactctgaactgatgaacaataactcttcagagcaggtgctgtatgttgatccaatgattactgaaattaaggagatctttattcccgaacataaatag

SEQ ID NO: 2791 - DNA, 615 bp, Artificial Sequence
  Description of Artificial Sequence: Synthetic coding sequence
atgacctgcacatggaacgctggcaagctaacatatatcgataccaagtatgtcgtgcacgtgaaatccctcgaaacagaggaggagcagcagtatctgacatcttcctacatcaacattagtacagacagcttgcaggggggaaagaagtatcttgtctgggttcaggccgccaatgctctcgggatggaggagagtaagcagctgcagattcatctggatgatatcgttccccaggtcacctccaaggccttccagcacgatacctggaactcgggcctgacagtggcctctatctcaaccggccacttgacttcagataatagaggggatatcggtttgctcctggggatgatcgtcttcgctgtaatgctgtccatcctgtctctcatcggcatctttaaccggtctttcaggaccgggattaagaggaggatcttgcttctgatacctaagtggttgtacgaggatattccaaatatgaaaaacagcaacgtggttaagatgctgcaggagaactcagagctgatgaacaacaactccagcgagcaggttttgtatgtggaccctatgatcacggaaatcaaggagatattcatccccgagcacaaatag

SEQ ID NO: 2792 - DNA, 441 bp, Artificial Sequence
  Description of Artificial Sequence: Synthetic coding sequence
atgaatattagcatatattgtcaggccgccattaaaaattgtcagcctagaaagcttcacttttacaaaaacggcatcaaagagcgctttcagattactcgaatcaataagactaccgcccggctctggtacaagaattttctggagccacatgctagcatgtattgcactgccgagtgccccaagcatttccaagagacactgatctgtggcaaggatatatcatccggatatccaccagatatccccgacgaagtgacttgtgttatatacgagtacagcggcaacatgacctgtacatggaatgcagggaagctcacttatatagataccaaatacgtagttcacgtaaaaaggctgaagaatcttaccccaatcctacacatgtgtaacagtcagaattcaacctggtcgcaaaccctcagcacctactttaagtag

SEQ ID NO: 2793 - DNA, 429 bp, Artificial Sequence
  Description of Artificial Sequence: Synthetic coding sequence
atgacgtgcacatggaacgctggtaaattaacttacatcgacacaaaatacgtcgtgcatgtcaagtcattggagaccgaagaggaacagcagtacttgacatcttcttacatcaacatcagcacagacagtctgcaaggcggtaaaaagtacctagtttgggttcaagctgctaatgctctgggtatggaggagagtaaacagctgcagatccacttggatgacatcgtgataccatccgctgcggtcatatctcgcgccgagacaatcaatgctaccgtgcctaagactatcatttactgggattcccaaaccaccattgaaaaagtttcatgcgagatgaggtacaaggctactactaatcaaacctggaacttccccaggagtcaccaaaaacatagcaacatgacacacggaattctgggttag

SEQ ID NO: 2794 - DNA, 669 bp, Artificial Sequence
  Description of Artificial Sequence: Synthetic coding sequence
atgaatatcagcatttattgccaggccgccatcaaaaactgccaaccccgaaagttacacttctacaagaacggtattaaggagcgatttcagatcacgcgaattaataagaccacggcccgcttgtggtacaaaaacttcttagaacctcacgcatcaatgtattgcacggccgaatgccctaagcacttccaggagacactgatctgcgggaaggacattagcagcggttacccacccgacatcccagacgaggtcacttgtgtaatttacgaatactccggcaacatgacttgtacatggaacgccgggaaactgacatacattgacaccaagtatgtggtacatgtgaagagcctcgaaaccgaagaggagcagcaataccttacatcatcgtatataaacatatcaacggatagcctgcagggagggaaaaagtatctggtgtgggtccaggcggcaaacgctctaggcatggaagagagtaaacagcttcagattcacctcgacgacatcgtcattccttcagccgccgtgatcagccgggcggagacgattaacgcaaccgtgcccaagacaattatctactgggatagccaaaccacaatagaaaaggtgtcatgtgagatgcgctacaaggcaacgacaaatcaaacctggaatgactag

SEQ ID NO: 2795 - DNA, 1632 bp, Artificial Sequence
  Description of Artificial Sequence: Synthetic coding sequence
atggatgcctttaccggctccggacttaagcggaagttcgatgatgtcgatgtggggtcatctgtgtccaatagtgacgatgagatctctagctccgactctgcagacagctgcgacagcctcaatcctcctacaacagcatcattcacccccacctccatactcaaacgccagaagcagctgcgccgcaagaacgtgagatttgatcaagttaccgtatactactttgcaagaagacaggggtttacatccgtgccttcccagggcggctcatccctgggaatggctcagcgccataattctgttcgatcttacacactgtgtgagttcgcccaggagcaggaagtaaatcatcgggaaatacttcgggaacaccttaaggaggaaaaattacatgctaaaaagatgaaattaactaagaatggcacagttgagtccgtcgaggcagatggcctcaccttggacgatgtgtctgacgaggatatcgacgtcgaaaatgtagaggtagacgactacttttttcttcagcccttgcctaccaaacgccgacgtgcgttgctgagagctagcggtgttcatcgcatagacgccgaggagaagcaggagctcagagccatccgcctgagcagggaagaatgtgggtgcgactgtcgactgtattgcgatcccgaagcttgcgcctgctctcaagctgggattaagtgccaagtggatcggatgtcattcccatgtggctgctccagggatggctgtgggaacatggctggacggatcgaattcaatcctataagagtgagaactcactacctgcacactatcatgaagctagaacttgaaagcaagaggcaggtatctaggccagcagccccagacgaggaaccttcgcccacggcatcctgtagcttaacaggggcccagggctcagaaacgcaggacttccaggaatttatcgctgagaatgaaactgctgtgatgcacctacagagtgccgaagaactggagcggctgaaggccgaggaggatagcagcggatcctctgccagccttgactcctccatcgagagtctcggagtttgtatactcgaggagcccctggccgttcctgaagaactatgccccggcctgaccgccccaatcctaatccaggcccagctgccccccggatcttctgtcctgtgcttcaccgagaatagcgaccaccccactgcttctaccgtgaactcaccttcctaccttaactctggccccctggtgtattaccaggtggagcaacgcccggttctgggggtgaaaggcgaaccagggacagaggagggatcagcatcttttcccaaggaaaaggatctcaacgtcttttcactgcccgtgacgagcctcgtcgcttgttcctcaaccgaccccgccgctctttgtaagagtgaggtggggaaaactcctacactggaggcactcctccctgaggattgcaatcctgaggagcccgaaaatgaagattttcatccatcctggagtccatcctcgttaccctttcgaaccgataacgaggagggctgcggtatggtgaaaactagccagcaaaacgaggacagacctcccgaggactcgtctctcgaactgcctctcgctgtttag

SEQ ID NO: 2796 - DNA, 621 bp, Artificial Sequence
  Description of Artificial Sequence: Synthetic coding sequence
atgaactttcaacagagactccagtctctgtggacacttgcccgtccgttctgtccgcccctcttggctactgcgtcccaaatgcagatggttgtgctcccctgcctcgggttcactcttttgctgtggagccaagtctccggggctcagggacaagagttccactttgggccttgccaagtcaagggggtcgtaccccaaaaactctgggaggctttctgggctgtcaaggatactatgcaagcccaggacaacattaccagcgctaggctgctccagcaggaggtgctgcagaatgtgtctgacgcggaaagctgctacctagtgcataccctactggaattctacctgaagactgtgttcaagaattatcacaatcgaaccgtggaagtgcgtactctgaaatccttctctacacttgctaataacttcgtgcttattgtgagtcaattgcagcctagtcaggagaatgaaatgttcagcattagagactccgcccaccgccgcttcttgttgttcagaagggcgttcaaacagctcgatgtagaagccgcgttgaccaaagccttgggcgaagtggatattctactcacctggatgcagaagttttataaactttag

SEQ ID NO: 2797 - DNA, 465 bp, Artificial Sequence
  Description of Artificial Sequence: Synthetic coding sequence
atgaactttcagcagagactccaatccttatggacattggcatcgaggccattctgtccccctttgctggccactgcgtctcaaatgcagatggtggtgttgccctgcctcggctttaccctcctcctgtggtcacaggtctccggcgcacaggggcaggaatttcattttggaccatgccaggtgaagggggtggtgccacagaagctttgggaagctttttgggccgtcaaggacacaatgcaggcccaggacaacattacttctgcccgcttactgcagcaggaggttttgcagaatgtgagtcaggagaacgagatgttctctattagagacagcgctcatcgtcggtttctgttgttccgaagggcgtttaagcagctcgacgtggaagcagccctgaccaaggcacttggagaagttgacattctcttgacatggatgcagaagttttacaagctgtag

SEQ ID NO: 2798 - DNA, 624 bp, Artificial Sequence
  Description of Artificial Sequence: Synthetic coding sequence
atgaattttcagcagcgcctgcagagcctgtggaccctggcctcccggcctttctgtcctccactactggctacggcgtctcagatgcagatggttgtgttaccttgcctgggctttacacttttgctctggagccaggtgtctggcgcccaggggcaggaattccattttggaccctgccaagtcaaaggtgtcgtgccccagaagctttgggaagccttctgggctgtgaaggacacaatgcaggcgcaggacaacattaccagcgctagactgcttcagcaagaagttctgcagaacgtgtcagatgctgaatcctgctatctggtgcacacgctattggaattttatctcaagacagtcttcaagaattatcacaatcgcaccgtggaggtgcgaacactgaaatcgttcagtacgctagcaaataatttcgtcctgatcgtgtcccagctgcagccctctcaggaaaacgaaatgttttccattcgagattctgctcatcgccgctttcttctgttccgacgcgcattcaaacagctggatgtggaggccgcactgacgaaagctcttggggaagtagacattttgctgacatggatgcagaaattttataaattgtag

SEQ ID NO: 2799 - DNA, 534 bp, Artificial Sequence
  Description of Artificial Sequence: Synthetic coding sequence
atgcgcgagaggccacgcttgggagaggatagcagtcttatctctctttttcttcaggtcgttgcgtttttagcgatggtaatgggtacccacacctattcccattggccatcctgttgccctagcaaaggccaggatacgtctgaggagttactgaggtggtccaccgtccccgtgccgcctctcgagccagcccgccctaacaggcaccctgaatcctgtcgtgcatctgaagacggccctctcaacagccgggcaatttcgccctggcggtatgaactggacagagatctgaaccgactcccacaggacctttaccatgcaaggtgtctgtgcccgcactgtgtgtccctgcagactgggtcgcatatggacccacgcggtaactccgagctgttatatcacaaccagaccgtcttttaccgacgtccttgccacggggaaaaaggtacacataaaggctattgtctcgagagacggctctacagagtctctctcgcctgtgtctgcgttcgcccaagggtgatggggtag

SEQ ID NO: 2800 - DNA, 486 bp, Artificial Sequence
  Description of Artificial Sequence: Synthetic coding sequence
atgtatcaggtggtggcttttctcgcaatggtgatgggaactcatacgtatagccattggcctagttgttgcccaagtaagggtcaagacactagcgaggagttgctcaggtggtccaccgtgcctgtgccgccacttgagccggcccgtcctaatcggcaccccgagtcctgccgggccagtgaggacggacctctaaattcgagggcgatttccccttggaggtatgagctcgaccgagatttgaaccgtctgccccaggacctgtaccacgcccgctgcttatgtcctcactgcgtgtccttgcaaactggcagtcatatggatccgaggggcaactcagagctgctgtaccataaccaaacagtcttttacaggagaccatgtcacggggagaagggaactcacaaaggctactgcctggaacgcagactctaccgggtgagtctggcatgcgtgtgcgtccgcccccgtgtgatgggctag

SEQ ID NO: 2801 - DNA, 2775 bp, Artificial Sequence
  Description of Artificial Sequence: Synthetic coding sequence
atggacgtcctccctacaggaggggggaggcccggcttgaggacagagctagagttccgaggtggtgggggcgaagcacgccttgaatcccaggaagaggagaccattccagccgccccacccgcgcctagactgaggggcgctgctgaaagaccgcgacggtctcgcgacacctgggatggggatgaggacacagagcccggggaggcctgtggaggccgcacatcccgcaccgcctcactggtcagtgggctgttaaacgaactgtactcctgtacggaggaggaagaagcggctggtgggggccggggtgctgaggggcgccggagacgcagggactcactggactcctcaactgaggcctcgggctctgacgtcgttctgggcggtagaagcggagcaggagactctcgcgtcctgcaggagctgcaggagcggccctcacagagacaccagatgttatacctgagacaaaaagacgctaacgagttaaagacaatactgagagagttaaaatatcgaattggtattcagagcgccaaattgcttcgccacttaaagcagaaggacagactgctgcataaggtgcagaggaactgtgatatagtgaccgcttgtcttcaggccgtgtcccaaaagcgcagagttgacaccaaattgaaattcaccctggagccgtctctcggtcagaacggattccagcagtggtatgacgccctgaaagcggtcgcccgcctaagcacaggaattcccaaggaatggcgccgcaaggtctggcttaccctggctgaccactacctccactctatcgccatcgattgggacaagacgatgaggtttactttcaacgagcgctctaaccctgatgacgactctatgggaattcagatcgtgaaagacttgcaccgcactggatgcagttcttactgcggacaggaagcagagcaggatagagtggtgctcaagagagtgctcctggcatatgctcgatggaacaagacagtagggtattgccagggcttcaatatactagccgccctgatcctggaggttatggagggcaacgaaggggacgcactgaaaataatgatatacttgattgacaaagtgctgcctgagtcctactttgtgaacaatctgcgtgctctgagtgtggacatggccgtatttagagacctccttagaatgaaactccccgaactctcccagcacctggatacgcttcaaagaaccgccaataaggaatctggggggggctatgagccgccgctgacgaacgtcttcaccatgcagtggtttcttacgctatttgccacctgcctcccaaatcagacagtgctaaagatctgggatagcgtgttcttcgagggatctgagataatcttgcgagtgtctctcgcaatttgggcgaaactgggagagcagattgagtgctgcgaaacggctgatgaattctactctacaatggggcggcttactcaagagatgttggagaatgatttgctccagtcccacgaactgatgcagacagtctattcgatggccccctttcctttcccccagctagccgagcttcgcgagaagtacacctacaatattacaccattccctgcaacagtaaaaccaacaagtgtaagtggaagacattcgaaggcaagagactccgatgaagaaaacgatcccgatgacgaggatgctgtggtaaacgctgtgggttgtcttggtcctttcagtggatttctcgcccctgagctacagaaatatcaaaaacagattaaggaaccaaatgaggaacaatcgctgcggtctaataacatcgccgagctatccccgggggctatcaacagctgtcgttctgagtatcacgccgcattcaactccatgatgatggagcgcatgactacagatattaacgcgctgaagcgccaatatagcaggattaagaagaaacagcagcagcaggtacatcaggtatacatacgcgcagataagggcccagtcaccagcatattaccatctcaggttaactcttcaccggtgatcaatcaccttttgctaggcaagaagatgaaaatgacgaatcgggcagcgaagaatgctgtgattcacatccctggacatacgggcgggaagatctctccggttccctacgaggaccttaagaccaaactgaactcgccatggcgaacccacatccgggtgcacaaaaaaaacatgccccgaaccaaatcgcatcccgggtgcggagataccgtgggcttgatcgacgagcagaatgaggcaagcaagaccaatggactaggcgcagcagaggccttcccatccggctgcactgctaccgcaggtagggagggctcaagtcccgaaggctccaccagacgcacgatcgaaggccagagccccgaacctgttttcggcgatgcagacgtggatgtatcagccgtccaggcaaaattgggcgcgttagagcttaaccagagggacgccgcagctgagactgagctgcgggttcaccctccatgccagcgccactgccctgagcctccatctgcccctgaggagaataaagccacctcgaaagcccctcagggaagcaattcaaaaacgcccattttctccccatttccgtcagtgaagccacttagaaaaagcgcaacggcccggaacttgggtttatatggtcccaccgagaggacgcctacagtccacttccctcagatgtctcggagcttcagcaaacctggcggggggaactccggcaccaagaaacgatag

SEQ ID NO: 2802 - DNA, 732 bp, Artificial Sequence
  Description of Artificial Sequence: Synthetic coding sequence
atgggccagactgcgggcgatctcgggtggcgcctgagcctgctgctgcttccattgctgctggtacaggctggcgtgtgggggtttccgcgtcccccaggtagaccgcaattgagccttcaggagctgcggcgcgagttcaccgtgtcattgcatctggcccgcaaactccttagcgaagtgcgaggacaagctcacaggttcgctgaatctcacctccccggcgtgaatctgtacctgctaccacttggcgagcagcttcccgacgtgagccttacattccaggcctggaggcggctgagtgacccagagaggctctgtttcatctccaccacccttcagccatttcatgcactcttgggtggcttgggcacgcagggcagatggaccaatatggaacggatgcagctctgggcgatgaggctggacttgcgcgaccttcagaggcatctgcgcttccaagttctggctgccggtttcaacctgccggaagaggaggaagaggaggaggaggaggaagaagaagaacgaaaagggctactccccggcgcactggggtccgctttgcaaggcccagctcaggtctcctggccccagctcttgagcacgtatcggctgttacatagccttgaactggtgctctctagagccgtgcgcgagttgcttttattatccaaggcaggccattcggtgtggccactcgggtttcccactctcagccctcaaccctag

SEQ ID NO: 2803 - DNA, 603 bp, Artificial Sequence
  Description of Artificial Sequence: Synthetic coding sequence
atgaaactggacatgactggcgattgcactcccgtgctggtgctgatggccgctgtgttgactgtgactggcgccgtgcccgtggctcggctccacggtgctttacccgacgcccgggggtgccatatcgctcagtttaagagcctgagcccacaggaactgcaagcgtttaaaagggccaaggacgcgctggaagaaagcctgctgcttaaagactgcaggtgccactcccggttattcccacgcacctgggaccttcggcagctgcaagtgcgggagcgccctatggctctggaagcggaattggcgcttacacttaaggtcttagaagccactgcagatacggatccagctcttgtagatgtgctggatcagcccttgcacactctccaccatatcctcagccaattccgcgcctgcattcaaccacagcccacggcaggaccccggacgagaggacgtctgcatcattggctgtacagactccaggaggcgcccaagaaagagtcgcccggctgcctcgaagcctccgtgactttcaacctgtttaggttgctcacccgggacctcaattgtgtcgccagcggggatctgtgcgtgtag

SEQ ID NO: 2804 - DNA, 591 bp, Artificial Sequence
  Description of Artificial Sequence: Synthetic coding sequence
atgacaggggattgtatgcccgtgctggttttgatggcagccgtcctgactgttaccggggccgttccagtagcacgcctcaggggcgctctcccggacgcaaggggttgccatatcgcccagtttaaatccctctccccgcaagagcttcaagcctttaagagagctaaagacgccctggaggaaagcctattgttgaaggactgtaaatgccggtcaaggctctttcctcggacttgggacttgaggcaactgcaggtccgcgagagaccagtggccttggaagccgaactggccctgaccttgaaggtcttagaagctaccgccgacaccgaccctgctctgggtgacgtgctggaccagcctttacatactcttcaccacatcctttcccagctgagagcctgtatccagccacagccaaccgcaggacctcgaacccgcggcagattgcaccactggctccacagattgcaggaagcgccgaaaaaggagtctccaggctgtttagaagcatctgtcaccttcaatctttttagattactgactagagacctgaactgcgtcgcatcgggagatctgtgcgtatag

SEQ ID NO: 2805 - DNA, 603 bp, Artificial Sequence
  Description of Artificial Sequence: Synthetic coding sequence
atggccgcagcctggacagttgtcttagttactctggtgctgggcttagccgtggcaggtcctgttcctacttctaaacctactacgacgggtaagggctgccacatcggtcggttcaaatccctgtcaccccaagagctggcatcatttaaaaaggccagggatgcgctggaggagtccctgaagctcaagaattggtcttgttcctccccagtatttcctggcaattgggatctgagactgcttcaagtgcgggaaaggcccgtagccctagaggctgagcttgcactgaccctaaaagttctggaggcagccgccggaccagccctcgaagatgtgttagatcaaccccttcataccctgcaccacattctgtctcagctccaagcatgcatccaacctcaaccaactgcagggcctcgccccagaggccgcctccaccactggctacatcggttgcaggaggcacccaaaaaagagagcgccgggtgcctcgaggctagtgttacatttaacttgtttagactcctgacacgtgatctgaaatacgtcgcggatggtaacctgtgcctgcggacatccactcatcctgaatctacttag

SEQ ID NO: 2806 - DNA, 495 bp, Artificial Sequence
  Description of Artificial Sequence: Synthetic coding sequence
atggcctcccattccggaccttccacctctgtgctgtttctgttttgttgccttggcggatggcttgctagccacactcttcccgtgaggctgctgcgtccatcagacgacgtgcagaagatcgtggaggaactacagtctttgtctaaaatgctcctgaaagatgtggaagaggagaaaggtgtgctcgttagtcagaattatacactgccgtgcctgagtcctgacgcacagccacctaacaacattcattctcccgcgatccgagcttatctgaaaaccatcaggcaacttgataacaagtccgtcatcgatgagatcattgagcacttggacaaattgatcttccaggacgcccctgaaactaatatttcagtacctaccgacacgcatgagtgtaaaagatttatcctgaccatctcccaacagttcagcgaatgcatggacctggctttgaagagcttgaccagcggcgcccaacaggccaccacctag

SEQ ID NO: 2807 - DNA, 507 bp, Artificial Sequence
  Description of Artificial Sequence: Synthetic coding sequence
atgtgctttcctaaggttctcagcgacgatatgaaaaaactgaaggctcgcatggttatgagttcactcgccgagctggaggacgattttaaggaagggtaccttgagactgtcgcagcgtattatgaggaacagcaccccgaacttacgccactccttgaaaaggagcgcgatgggctgcggtgtcggggaaaccgctctcctgtgcccgacgtcgaagatcctgctacagaagaaccgggggaatcattctgcgacaaagtcatgcgctggttccaagcaatgctgcaacggctccagacttggtggcacggagtgctggcgtgggtgaaggagaaggtcgtcgctctcgtccacgccgtgcaggcactgtggaagcagttccagtccttctgttgcagtctgtctgagctctttatgtcatccttccagtcctatggcgcaccgcgaggagacaaagaagagctgacccctcagaagtgctccgagccccagtccagtaaatag

SEQ ID NO: 2808 - DNA, 567 bp, Artificial Sequence
  Description of Artificial Sequence: Synthetic coding sequence
atgtgcttcccaaaagttctttctgacgacatgaagaagctgaaggcccggatgcaccaggcgatcgagcgtttttacgacaagatgcaaaatgccgagtcggggcgtggtcaggtcatgtcgagcttagccgagctggaggacgactttaaagaagggtacctggagaccgtcgctgcctactacgaggagcagcatccagagctgaccccattactcgaaaaggagagagatggtcttcggtgtcgcggcaatcggagccctgtgcccgacgtggaggaccccgcaactgaagaacctggtgagagtttctgcgacaaggttatgcggtggtttcaggcaatgttacagcgtctccaaacttggtggcatggcgtcctggcatgggtaaaagagaaggtggtggcactggtgcatgctgtgcaggccctgtggaaacagtttcagtccttttgttgctctttgtctgagctgtttatgtcaagtttccaatcttatggggcacctagaggcgacaaggaggaactaaccccccagaagtgctctgagccacagtccagtaagtag

SEQ ID NO: 2809 - DNA, 540 bp, Artificial Sequence
  Description of Artificial Sequence: Synthetic coding sequence
atgtgctttcctaaggtattgagcgatgacatgaagaagttgaaagctcggatgcatcaagcgatcgaaagattttatgacaaaatgcaaaacgccgaatctggacgcgggcaagatgatttcaaggaaggttacttggagacagtagccgcttactacgaggagcagcaccccgagctcacgccactacttgagaaagaaagagatggcctccggtgcagaggaaataggagccccgtacccgatgtagaggaccccgccaccgaggagcccggcgaatccttttgtgacaaagtcatgaggtggttccaggcaatgctgcaaaggctccagacttggtggcatggcgttctcgcttgggtgaaagaaaaagtggtggccctggtgcacgccgttcaagcactatggaagcaattccagagtttctgctgttcattgagcgagttatttatgtcctcttttcagtcatacggggctccccgcggcgacaaggaggaactgactccacagaaatgcagcgagccacagagtagcaagtag

SEQ ID NO: 2810 - DNA, 396 bp, Artificial Sequence
  Description of Artificial Sequence: Synthetic coding sequence
atgtgcttcccaaaagtgctctctgatgatatgaagaagctcaaggctaggatgcatcaggccattgagcgcttctatgataagatgcagaatgccgaaagcgggcggggccaggtcatgtcttcactggctgaactggaggacgattttaaggaaggctacctcgagacggtggccgcctattatgaggagcaacacccagagttaacaccactgctggaaaaagagcgcgacggactgaggtgtagaggaaaccgttctccagtgcctgatgtggaggaccccgcaaccgaagaaccaggcgagtccttttgtgataagtcttacggggcccccagaggagataaggaggaactgactccccagaaatgcagtgagcctcagagctcaaaatag

SEQ ID NO: 2811 - DNA, 705 bp, Artificial Sequence
  Description of Artificial Sequence: Synthetic coding sequence
atgtgcttccctaaggtgctgagtgatgacatgaaaaagcttaaagccagaatggtgatgctgcttccaacatccgcacaggggctgggagcttgggtttctgcgtgcgacacagaggacactgtagggcacttgggaccctggagggacaaagaccctgctctgtggtgccagctctgcttgagttcccagcatcaagccatcgagagattttatgacaagatgcagaacgctgagtctggccggggacaggtaatgagttcgctcgccgagctcgaagacgattttaaggaaggttacttagagactgtggcagcttattacgaggagcagcaccctgaactcactccccttctcgagaaggagagagacggactgcggtgccgcgggaatagaagtcctgtacctgacgtcgaagatccggcaaccgaagaaccaggggagtcattttgcgataaagtaatgcgctggtttcaggcaatgctgcaaagacttcagacttggtggcacggggttttagcctgggtgaaggaaaaggtggtggctctggtgcacgcggtgcaggcattatggaagcagtttcagagcttctgctgtagtttatccgagctgtttatgtcttcattccagtcttacggtgcaccaaggggtgataaggaagaattaactccccagaaatgctccgaacctcagtcatctaagtag

SEQ ID NO: 2812 - DNA, 567 bp, Artificial Sequence
  Description of Artificial Sequence: Synthetic coding sequence
atgtgttttccaaaggtcctgtccgacgatatgaagaagttgaaagctcgaatgcaccaagctatcgaaaggttctatgataaaatgcagaacgctgaatcaggtagaggtcaagtgatgtccagcttagccgagctggaggatgattttaaagagggttatctggagacagtcgccgcttactacgaggaacaacaccccgaactaactccactcttggaaaaggaaagagacggcctgaggtgtagaggtaaccggagtccagtccctgatgtggaggatcccgccactgaggaacccggcgagagtttctgtgacaaggtgatgagatggttccaggcgatgctgcagcgtcttcaaacatggtggcatggtgtcctcgcctgggttaaagagaaggttgttgcactggtacacgctgtgcaggctctgtggaaacagtttcaaagcttttgttgcagtttgagcgagctgttcatgtcgagcttccagagctatggtgcgccgcgcggggataaagaagagctaactccccaaaagtgctccgaacctcagtcatctaaatag

SEQ ID NO: 2813 - DNA, 567 bp, Artificial Sequence
  Description of Artificial Sequence: Synthetic coding sequence
atgtgttttcccaaagtactcagcgacgatatgaagaaactgaaagcacggatgcatcaggcaatcgagcggttctacgacaagatgcaaaacgcggagtccggccggggccaggtaatgagcagcctggccgaacttgaggatgactttaaggaagggtatctcgaaactgtcgctgcctactacgaggaacagcatcccgaactcacaccattgctggaaaaggagagagacggactgaggtgcaggggtaaccgctctcccgttccagacgtagaggatccagcaactgaggagccaggcgagtctttttgcgacaaagtgatgaggtggtttcaggccatgctccagagactgcagacatggtggcatggggtgttggcatgggtcaaagaaaaagtggtcgcattagttcatgccgtgcaagccctctggaagcaattccaaagcttctgctgttccttatcggaactgttcatgagcagctttcagtcttacggggctccccgtggcgacaaggaagaactgacgcctcaaaagtgtagcgagccacagtcttccaagtag

SEQ ID NO: 2814 - DNA, 567 bp, Artificial Sequence
  Description of Artificial Sequence: Synthetic coding sequence
atgtgctttcctaaagtcttgtctgatgatatgaagaagctgaaagctcgtatgcatcaggcaatagagcgcttttacgataagatgcaaaacgctgaatccggacgtggccaggttatgtcatccctagccgagttggaagatgattttaaggagggatatcttgaaacagttgctgcctattacgaggaacagcacccagagttgacccctttgctggagaaggagcgcgatggtctgcgatgccggggcaacaggagccccgtgcctgatgttgaagatcccgcaaccgaagaacctggcgaatccttttgcgacaaagttatgagatggttccaggccatgctgcagaggctacaaacctggtggcatggcgtgctcgcctgggtgaaggagaaagtggtggctctagtgcatgcagtgcaagccctatggaaacaattccaatccttttgttgctcactgagcgagctgtttatgtcttctttccagtcttatggggcccctagaggggacaaggaggagctgacaccacagaagtgtagtgagccacagagctccaaatag

SEQ ID NO: 2815 - DNA, 567 bp, Artificial Sequence
  Description of Artificial Sequence: Synthetic coding sequence
atgtgtttcccaaaagtgttaagcgacgacatgaagaagctcaaggcaaggatgcaccaagccatagagaggttctacgacaagatgcagaatgctgagagcggccggggacaggtcatgagcagtctggccgaactcgaggatgacttcaaggaggggtatctagagaccgtcgctgcctactatgaggagcagcatcctgagctcacacctcttcttgagaaggaaagagacgggctgcgctgtagaggaaaccggagtccggtacccgacgtggaggacccggcaactgaggaaccaggggaatcgttttgtgacaaggtcatgagatggtttcaagccatgttgcaacggcttcagacctggtggcatggcgtgctggcttgggtgaaagaaaaagtcgtggccctagtgcacgcagtgcaggcactgtggaagcaattccagtcattttgctgcagccttagtgagctgttcatgtccagcttccagtcctatggagcccctcggggagacaaggaagaacttaccccccaaaaatgctcggaaccacaatcgtctaagtag

SEQ ID NO: 2816 - DNA, 567 bp, Artificial Sequence
  Description of Artificial Sequence: Synthetic coding sequence
atgtgcttccccaaggtgctcagcgacgatatgaagaagttgaaagcacgaatgcaccaggcgattgagcggttctatgataagatgcagaacgcagaatcgggccgaggtcaagtaatgtcatccctggccgagctggaagacgatttcaaagagggttacttggaaaccgtggctgcctattatgaggagcagcatcctgagctgacacctctgctagagaaagagagggacggtttacggtgtcgcggcaatcgctcaccagttccggacgtggaagacccagccacggaagagccaggagaatcattctgcgacaaggttatgcgttggtttcaggctatgttgcagagattgcagacctggtggcacggcgtattagcatgggttaaggagaaggttgtggccttggtgcatgccgtgcaggcactgtggaagcagttccagtccttttgctgcagcctctcggagctctttatgtcatctttccagagctacggcgccccaagaggggacaaagaagaattaaccccacagaaatgtagtgaaccgcagagcagtaagtag

SEQ ID NO: 2817 - DNA, 567 bp, Artificial Sequence
  Description of Artificial Sequence: Synthetic coding sequence
atgtgcttcccaaaggtgctgtctgacgacatgaagaagttaaaggccaggatgcaccaggcaatcgagagattctatgacaagatgcaaaacgctgagagtgggagaggccaggtgatgtcttctttggccgagctggaagatgattttaaggagggataccttgaaacagtggccgcatactacgaggaacagcacccggagttgactcctctcttagagaaggagagggacggcttaagatgcaggggaaataggagccctgtgcctgacgtggaggatcccgctaccgaggagcctggggagtccttttgcgataaggtcatgagatggttccaggctatgctccagcgactccaaacatggtggcacggcgtgctggcatgggtcaaggaaaaggtagtggcattggtgcatgcagtgcaagccctctggaaacagttccagagcttttgctgttctctgtccgaactttttatgtcaagctttcagtcttacggtgctccacgaggcgataaagaggaactcacgccccagaagtgctccgaaccccagagctccaaatag

SEQ ID NO: 2818 - DNA, 567 bp, Artificial Sequence
  Description of Artificial Sequence: Synthetic coding sequence
atgtgctttccaaaggtgctttccgatgatatgaagaaactcaaagccaggatgcaccaggccatcgagagattttacgacaagatgcaaaacgccgaatcaggacgcggtcaggtcatgtcttctctggctgagctggaagatgactttaaagagggctatctcgaaactgttgcggcttactacgaggaacaacatcccgagctgaccccgctgctggagaaagagagagacgggctgcgatgtaggggcaatagaagccctgtgcctgatgttgaggacccagccactgaagagcccggggaatctttctgcgataaggttatgcggtggttccaggcgatgcttcagcggctgcagacctggtggcatggggtgctggcctgggtgaaagagaaggtagtggctctcgtacatgccgtacaggccctgtggaagcagttccagtccttctgttgctccttatctgagttattcatgtctagcttccagtcatacggagctcctcgcggtgataaagaggagctcacccctcagaaatgcagcgaacctcagtcctccaaatag

SEQ ID NO: 2819 - DNA, 507 bp, Artificial Sequence
  Description of Artificial Sequence: Synthetic coding sequence
atgtgctttcccaaggtcctgtcagacgatatgaagaaattgaaggcccggatggtcatgtcatctctggctgaacttgaagacgacttcaaggaaggatatctggaaactgtggcggcatattatgaagaacaacatcctgagctaactcctctgctggagaaggagagggatggacttaggtgtcggggcaatcggtctcccgtccctgacgtggaggatcccgcaactgaggaaccaggcgagtcgttctgtgataaggtaatgcggtggttccaggctatgttgcagagacttcaaacatggtggcatggcgttttagcatgggtgaaagaaaaagtcgtagctctagtgcacgctgtccaggccttgtggaaacagttccagtctttttgctgctctctgagtgaattgtttatgtcgtcgtttcaatcatatggcgcacctaggggcgataaggaagagcttactccccaaaaatgctctgagccgcagtcaagcaaatag

SEQ ID NO: 2820 - DNA, 537 bp, Artificial Sequence
  Description of Artificial Sequence: Synthetic coding sequence
atgaaaaaattgaaggctcgcatgcaccaggcgattgaacggttctatgacaaaatgcagaatgccgagagcggccgtggacaggtaatgagtagcctagctgaactcgaggatgacttcaaggagggctatctggaaaccgtcgccgcttattacgaggaacagcaccctgaactgaccccactgctggaaaaagaaagggatgggctcaggtgtaggggaaaccgcagtccagtgccagacgtggaagacccagctacagaggaacctggggagagcttctgtgacaaggtgatgcgatggtttcaggctatgctccagcgactgcaaacctggtggcacggggtcctagcctgggtgaaagaaaaagtggttgcgctggtccatgcggtacaggccctttggaaacagttccagagtttctgctgttccctgagtgagttgttcatgtcaagtttccagagctacggagcacctagaggggacaaagaagaactgacaccacagaaatgttccgagccccagagcagtaagtag

SEQ ID NO: 2821 - DNA, 567 bp, Artificial Sequence
  Description of Artificial Sequence: Synthetic coding sequence
atgtgtttccccaaggtgctgtcagacgatatgaaaaagcttaaggcccgtatgcaccaggccattgaacgcttctacgataagatgcagaacgccgaaagtgggagggggcaagtgatgtcttccctggccgaactcgaagacgacttcaaggaaggctacctggagactgtggccgcttactacgaggaacagcatccagagctgactccattgctggaaaaggaaagggatggtctcagatgtcggggcaacaggagccccgtccctgacgtagaagatccggccacagaagaaccaggagaaagtttctgcgacaaggtgatgaggtggttccaggcgatgttgcagcgtttacaaacctggtggcatggagttctggcctgggttaaagagaaagtggtggcgctggttcacgctgttcaggccctatggaaacagttccaaagcttttgttgttcactatctgagctgttcatgtcttcatttcagagctatggcgcgcctaggggcgacaaagaggaactcacccctcaaaaatgtagcgagcctcagtccagcaagtag

SEQ ID NO: 2822 - DNA, 705 bp, Artificial Sequence
  Description of Artificial Sequence: Synthetic coding sequence
atgtgtttccctaaggtactgtctgacgacatgaagaagcttaaagcccgaatggtcatgctccttcctacctccgcacaaggactgggcgcatgggtgtccgcgtgcgacacggaagataccgtagggcacctcggaccatggcgggacaaagatccagccctctggtgccaactttgcctgagcagtcaacaccaggccattgagaggttttatgataaaatgcagaatgccgagtcagggagaggccaggtgatgtccagccttgccgagttggaagacgatttcaaggaagggtatctggagactgtggccgcctactacgaagagcagcaccctgagttgaccccactgctggagaaagagcgtgatggcctgcgttgccgtgggaatcgaagtccagtgccagatgttgaagatccagccaccgaagaaccaggagagagtttttgtgacaaggtcatgcgctggttccaggcaatgctccagaggttgcaaacctggtggcacggggttctggcttgggtcaaagagaaggtggtcgccttggttcatgcggtccaagctttatggaaacaattccaatcattctgttgttcgctttctgagttatttatgtcctcatttcagtcttacggcgccccccggggagataaggaagaactcacaccccaaaagtgttcagaaccgcagtcctccaaatag

SEQ ID NO: 2823 - DNA, 705 bp, Artificial Sequence
  Description of Artificial Sequence: Synthetic coding sequence
atgtgttttccaaaagtccttagcgacgatatgaaaaaacttaaagcacgtatggtaatgctgctgccaacatcggcacaaggccttggtgcatgggtgtccgcttgtgacaccgaggatacagtgggtcatctgggaccctggagggataaggaccccgctctgtggtgtcaactatgcctctctagccagcaccaggcgatcgagaggttctatgataagatgcaaaacgcggaaagcggacgtgggcaggtgatgtcatctcttgcagagctcgaggatgatttcaaagagggatacctggagaccgtggccgcgtattacgaggagcaacacccagagctgactcccttgctcgagaaagaaagggacggattgaggtgtcggggtaatagatctcccgttcccgatgtggaagaccctgcgacagaggagcctggggagagtttttgtgataaagttatgagatggtttcaggccatgctgcagagacttcaaacctggtggcacggcgtactggcatgggtgaaagagaaagtcgtagccctggtgcacgccgtccaagcattgtggaaacagttccagtccttctgttgctccctctccgagctctttatgtcctctttccagtcatacggggccccacgcggtgataaagaagaactgacaccgcaaaagtgtagtgagccgcagtctagcaagtag

SEQ ID NO: 2824 - DNA, 540 bp, Artificial Sequence
  Description of Artificial Sequence: Synthetic coding sequence
atgtgcttcccaaaagtgttgtcagatgacatgaagaaactaaaggccagaatgcaccaggccatcgagcgattctatgacaagatgcagaatgcggaatccgggcgaggacaggacgacttcaaggagggctacctggagaccgttgctgcttactatgaagagcagcacccagagctgaccccgctcctggagaaagagcgcgacggactcaggtgccgtggcaacaggagcccagtgcccgatgttgaagatccagccaccgaggagccaggagagtctttttgcgataaagtcatgagatggtttcaagctatgctgcaacgattgcaaacatggtggcacggcgttctggcgtgggtcaaggagaaggtggttgccctggttcacgccgtgcaggctctgtggaaacagttccagagcttttgctgctcactgtcggaattgttcatgtcgagcttccagtcgtatggagcacccaggggggacaaagaagaattaaccccccagaagtgcagtgaacctcagtcctcaaaatag

SEQ ID NO: 2825 - DNA, 678 bp, Artificial Sequence
  Description of Artificial Sequence: Synthetic coding sequence
atgtgttttcccaaggtccttagtgacgatatgaagaagttaaaagctagaatggtgatgctgctgcccacaagcgctcagggcctcggcgcctgggtctcagcctgcgatacggaagacacagtagggcaccttggcccctggcgtgacaaggaccccgctctgtggtgtcaactttgcttgtcctcccagcatcaggctatcgaacggttctatgataaaatgcagaacgctgaaagtggacgcggtcaggtcatgtcatcattagccgaactagaggatgatttcaaggaaggatacctcgaaacggtcgccgcttactatgaggaacagcatcccgaactgaccccactgcttgaaaaggagcgagacggactgagatgtcgggggaaccgaagccccgtcccagatgttgaggacccggccaccgaagagcccggagagagcttctgtgacaaggtaatgcggtggttccaggctatgctgcagcggctccaaacttggtggcatggcgtgttggcttgggtcaaggagaaggttgtggctctcgtccatgcagtgcaggctctgtggaaacaattccagagcttttgctgttccttgagtgagttgtttatgtctagtttccagagctacggtgctccaagaggcgacaaagaggaactgacaccccagtag

SEQ ID NO: 2826 - DNA, 396 bp, Artificial Sequence
  Description of Artificial Sequence: Synthetic coding sequence
atgtgctttccaaaggtactctccgatgacatgaagaagctgaaagctcgtatgcatcaggccatcgaaaggttctatgacaaaatgcagaatgccgaatccggtcgaggccaggttatgagctcacttgccgagctggaggatgactttaaagagggatacctggagaccgtggcagcctattacgaggagcagcacccggagttaaccccgttgctggaaaaagagagagacggtctcaggtgtcgtggaaataggtccccagtgcctgatgtggaggaccctgcaaccgaggaacccggcgagtcattctgcgacaaaagctacggtgcacccaggggtgataaggaggaactgacgccccaaaagtgttctgagccgcaatcttctaagtag

SEQ ID NO: 2827 - DNA, 396 bp, Artificial Sequence
  Description of Artificial Sequence: Synthetic coding sequence
atgtgcttccccaaggtgctgtccgacgatatgaaaaagctgaaggcgcggatgcaccaggccatcgagcgattttatgacaagatgcagaacgccgaaagcggcaggggccaagtaatgtcttccctggccgaactagaagacgattttaaagaggggtacttggagacagtagctgcttactacgaggaacagcacccagagcttacacctctgcttgaaaaggaacgcgatggactgcggtgtcgaggcaaccgctcccccgtccccgacgtcgaggacccagcaacagaggaacctggagaaagcttttgcgacaaatcctatggggctccccgcggggacaaggaagaactgacccctcaaaaatgcagcgaaccccagtcaagcaagtag

SEQ ID NO: 2828 - DNA, 507 bp, Artificial Sequence
  Description of Artificial Sequence: Synthetic coding sequence
atgtgtttccccaaagttctgagcgatgatatgaagaaactaaaagcgagaatggttatgtctagcctggcggagctggaggatgactttaaggaaggctacctggagaccgtggctgcctactacgaggagcagcaccctgaactcacaccactgttagagaaagagcgcgacggtctgcgatgcagaggcaacaggtctccagttccagacgtggaagatccagccaccgaggagcccggtgaatcattctgcgacaaagtcatgagatggttccaggcgatgcttcagaggttacaaacctggtggcacggagtcctggcctgggtcaaggagaaagtggtggccttggtgcacgctgtgcaggcactgtggaagcagtttcagtctttctgttgttcactcagcgagttatttatgtcttctttccaatcatatggcgcgcctcgcggcgacaaggaggagctaactccacagaaatgttccgagccccagagttctaaatag

SEQ ID NO: 2829 - DNA, 567 bp, Artificial Sequence
  Description of Artificial Sequence: Synthetic coding sequence
atgtgtttcccaaaggtgctgtccgatgatatgaaaaagctgaaagcaaggatgcatcaagcaatcgagcggttttatgacaaaatgcaaaacgcagagagtgggagaggccaggtaatgtcctccctggcagaattggaggatgactttaaagagggatacttggaaactgtagcagcttactacgaggagcagcatcccgagctcacccctctcctagaaaaggagagggatggcctccgttgtagggggaatagatccccagtccctgatgtggaagatcccgctaccgaggagcccggggagtcattttgcgacaaggtgatgagatggtttcaggccatgctccagcgcttgcagacctggtggcacggagtgctcgcttgggtgaaggagaaggtggtagcactcgtgcatgcagttcaggccttgtggaagcagtttcaatctttctgctgctctttgtccgaactgttcatgtctagtttccagtcatacggagcaccaagaggtgataaagaagaattgaccccccagaaatgctcagagcctcaatcctctaagtag

SEQ ID NO: 2830 - DNA, 813 bp, Artificial Sequence
  Description of Artificial Sequence: Synthetic coding sequence
atgaaacctaagatgaaatactctactaataagatctcaacagccaagtggaagaataccgccagcaaggctttgtgcttcaagctgggaaagagccagcagaaggcgaaggaggtatgtcccatgtatttcatgaagcttcggtccggattaatgatcaaaaaggaggcctgttatttccggagggaaacaacaaaacggcccagcctcaagaccggaaggaagcacaagcgtcacctcgtcctggcggcatgccagcagcagtctaccgtggagtgtttcgcattcggcatctcaggtgttcagaagtacaccagagcacttcatgacagttcgatcacaggcattagcccgattacggagtatctggcgagtctgtctacctataacgatcagtcgataacatttgccctcgaggacgagagttacgaaatttacgtcgaggacctcaagaaagacgaaaagaaagataaggtgctgctgagctactacgagtctcagcaccccagcaacgaaagcggcgacggcgtggatgggaagatgcttatggtgactctctctcctacaaaagacttttggctccatgctaataacaaggagcacagtgtggaactccacaagtgtgaaaagccactgcctgaccaagcattttttgtcttacataatatgcacagtaattgcgtgtcctttgagtgcaagacggaccctggggtcttcatcggggtcaaagacaatcacctggccctcatcaaggttgacagcagtgagaatctctgcaccgagaacatcctgttcaaactctccgagacttag

SEQ ID NO: 2831 - DNA, 435 bp, Artificial Sequence
  Description of Artificial Sequence: Synthetic coding sequence
atgaagccaaagatgaaatacagcacaaacaagatatctacggccaagtggaaaaatacagcttccaaagccctatgcttcaaattgggaaacaaggttctactgtcttactacgagtcacaacacccctctaatgagtccggagacggtgtggatggtaagatgcttatggttacacttagcccaacgaaagacttctggctccatgctaacaacaaggagcacagcgtcgaacttcacaaatgcgagaagccgcttcctgaccaggctttcttcgtgctgcataatatgcattccaactgcgtgtctttcgaatgtaagacggatcctggggtattcatcggcgtgaaagacaaccaccttgcgctcattaaggttgacagctccgagaatttatgtaccgagaatattttgttcaaacttagcgaaacctag

SEQ ID NO: 2832 - DNA, 687 bp, Artificial Sequence
  Description of Artificial Sequence: Synthetic coding sequence
atgaaaccaaaaatgaaatatagtacaaacaaaatatccacagccaagtggaagaatacggcttcaaaggctctgtgtttcaagctcgggaaaagccaacagaaggcgaaggaggtgtgcccaatgtacttcatgaaattgaggagcggtttgatgattaaaaaggaagcgtgttattttcgcagggaaaccaccaaaagaccttctctcaaaacaggccgcaagcacaagagacaccttgtgcttgcagcctgtcagcagcagtcgactgtcgagtgtttcgcctttggaatcagcggagtgcagaagtatacccgggccctgcacgactctagcatcactgataaggttttgctgtcgtactacgagagccaacacccaagtaacgaaagtggcgacggtgtggatggcaaaatgttaatggtcaccctttccccgaccaaggatttttggctgcatgccaacaataaggagcacagcgtggagttacacaagtgtgagaagcctctcccagatcaagcattctttgtgctccacaacatgcactccaattgtgtatctttcgaatgcaagacagatcccggcgtgtttattggcgtaaaggacaatcaccttgcgttaatcaaagtcgactcttccgaaaacctgtgtacagagaacattttatttaagctatcagagacctag

SEQ ID NO: 2833 - DNA, 729 bp, Artificial Sequence
  Description of Artificial Sequence: Synthetic coding sequence
atgccccggggctttacatggctgcggtatctgggaatattcttgggcgtagccctgggaaatgagcccctggagatgtggcccctgacacaaaacgaggagtgtaccgttaccggttttctgcgcgacaaactgcaataccgttccagacttcaatatatgaagcattacttcccgatcaactacaagatctctgttccctatgagggggtattccggattgctaacgtgaccaggctgcaaagagcccaggtgtccgaacgagagttacggtacctgtgggtcctcgtgtctctgtccgctactgaatcggtacaggacgtcctgctcgagggacatcctagctggaaatatctccaggaagtggagacgttactgctgaacgtgcagcaaggattaactgatgttgaggtgtcccccaaagtagaatcagtgctgtctctgctgaacgcaccagggcctaaccttaagttggtcaggcctaaggccctgctggataattgcttccgggtcatggagcttctttattgttcctgttgcaagcagtcgtctgtgctgaattggcaagactgcgaagtgcctagccctcagagctgttctcctgaaccttctcttcagtacgctgccacccaactgtacccaccccctccctggtctccctcgtccccgccacacagcaccggaagcgttcggccagtcagggcacagggtgaagggcttcttccttag

SEQ ID NO: 2834 - DNA, 729 bp, Artificial Sequence
  Description of Artificial Sequence: Synthetic coding sequence
atgccacgtggctttacttggcttagatacctgggaatctttctcggagtagccttggggaacgaacctttggaaatgtggccgctcacccagaatgaggagtgtaccgtgactggctttctcagggacaaactgcagtatcggtcacgactgcagtacatgaagcactacttccctatcaattacaaaatctcagttccctatgaaggagtgttccggatagccaatgttacccggcttcaacgggcacaggtgagcgagcgcgagctgcgatatctgtgggtactggtgtccttgtcggctaccgagtcggtgcaggacgtgctacttgaaggacatccgtcttggaagtacctccaggaggtagaaacactcctgctcaatgtgcagcaaggactcactgatgtggaggtgtcccctaaggtagagagcgttctttccctgctgaacgcacctgggcccaacctcaagctggtgcgccccaaagccctgctagataactgttttcgagttatggagttgctatattgttcttgctgcaagcaatcgagcgtcctgaattggcaggattgcgaagttccaagtccccaatcttgtagcccagagcctagcttgcagtacgcagctacacaactgtatccaccccccccttggagcccttcttctcccccgcatagtaccggctccgtgcggcccgtgagagcccagggggagggcctactaccatag

SEQ ID NO: 2835 - DNA, 477 bp, Artificial Sequence
  Description of Artificial Sequence: Synthetic coding sequence
atggagaaggcacttaaaattgacacaccacagcagggctcaattcaggacatcaatcaccgcgtctgggtgctgcaggaccagaccctgatagctgtcccacgaaaggacagaatgtctcccgtgacgatagccctgatttcatgccgccatgttgagacgctcgaaaaggataggggcaacccaatctatctagggctgaatggccttaatctgtgtctgatgtgtgctaaagtcggagaccaacctacactgcagctgaaagagaaggacataatggatctgtacaaccagcctgaaccggtgaagtccttcctgttctaccacagccagtctgggaggaatagtacgtttgaatcggtcgctttccctggatggtttattgccgtgtcttccgagggtggttgtcccttgattctgacacaggagctgggcaaggccaatacaaccgacttcggtctgaccatgctgttctag

SEQ ID NO: 2836 - DNA, 132 bp, Artificial Sequence
  Description of Artificial Sequence: Synthetic coding sequence
tccactttcgagagtgttgccttcccaggctggttcatcgcagtgagttctgagggtgggtgccccttgatccttacacaagaattggggaaagctaacacaactgactttggcctgatcctggtggagtag

SEQ ID NO: 2837 - DNA, 495 bp, Artificial Sequence
  Description of Artificial Sequence: Synthetic coding sequence
atgaatccgcaaagggaagcagcgccgaagtcctatgccatccgtgattctagacagatggtctgggtgctatctggaaatagtttaattgctgcacctctgtctagatctataaagcccgtcacactgcatttgattgcttgcagagacaccgagttttcagacaaggagaaggggaacatggtatacctgggtattaaaggtaaggatctttgccttttctgcgcagaaattcagggaaaacccactttgcagttaaagctgcaggggtcccaggacaatatcggcaaagatacctgctggaagctagtgggaattcatacttgcatcaaccttgacgtcagggaaagttgctttatgggcaccttggatcagtggggaataggcgtgggtcgtaaaaagtggaaatcgtccttccagcaccatcatttacgtaaaaaggacaaagacttcagttccatgcgaacgaatatcggtatgccgggacgcatgtag

SEQ ID NO: 2838 - DNA, 474 bp, Artificial Sequence
  Description of Artificial Sequence: Synthetic coding sequence
atgaatccgcagagggaggccgcccctaaatcgtacgcaatccgcgatagtcgacagatggtatgggtgcttagtggaaatagcttaattgctgcacctctgtctaggagcatcaagcccgtgacattacacctcatcgcatgtagggataccgaattcagcgataaagaaaaagggaatatggtgtatctggggatcaaggggaaggacctgtgcctattctgtgctgaaattcaggggaaacccacgctccagctaaaggaaaaaaacattatggacctgtacgtcgagaaaaaagcacaaaagccatttctgttcttccacaataaagagggctctacctctgtattccagtctgtaagttaccccggatggtttatcgccacctccaccactagtggccagccaatctttttgaccaaggagaggggaataacaaataacacaaacttttacctggacagtgttgaatag

SEQ ID NO: 2839 - DNA, 510 bp, Artificial Sequence
  Description of Artificial Sequence: Synthetic coding sequence
atgcgaggcactcctggcgatgccgacggtggaggtagggcagtgtaccagagcatgtgcaaacccatcacaggcactattaacgacctcaaccagcaggtctggactctgcagggccagaatctggttgcagtgccacgatccgactccgtcacccctgtaacagtggctgttatcacttgcaaatatcctgaagcactcgaacagggtaggggggatcctatctatctgggcattcagaatcccgagatgtgcctgtactgcgaaaaagtgggcgagcagccaacactgcagctcaaagagcaaaaaattatggatctgtacggccaacccgagcccgttaagcctttcttattttatcgtgctaagactggccgcacatctaccctggaatctgtggcctttcccgattggtttatcgcctcctctaaaagagaccagcccatcattctgacctcggagttgggaaagagttataacacggccttcgaacttaacatcaatgactag

SEQ ID NO: 2840 - DNA, 117 bp, Artificial Sequence
  Description of Artificial Sequence: Synthetic coding sequence
atgaggggcacccccggcgacgccgatgggggcggccgagctgtgtaccagtccatgtgtaagccaatcacgggtacaataaatgatttgaatcagcaggtctggaccctgcaatag

SEQ ID NO: 2841 - DNA, 657 bp, Artificial Sequence
  Description of Artificial Sequence: Synthetic coding sequence
atgtcttttgtgggggagaactccggtgtgaagatggggagcgaagactgggaaaaagacgagccgcagtgctgcttagaagacccagccggcagtccactggagcccggccccagcctgcctacaatgaatttcgtgcacactagcccaaaggtcaagaacttaaaccctaaaaaattttcgatccatgaccaggatcataaggtgctcgttctggactcgggtaatctgatcgcagtgcccgacaagaattatattcgtcccgaaattttctttgccctggccagcagcctgtctagcgcctccgcagaaaaggggagtcccattctgcttggggtgagcaaaggggaattttgcctgtattgcgacaaggacaagggacaaagtcacccttcactccagttaaagaaggaaaaactcatgaaattggctgcccaaaaggagtccgcgaggaggcctttcattttttaccgagcacaggtcggctcatggaatatgctggaaagtgccgctcatccgggctggttcatctgcacttcgtgtaattgcaacgaacccgtgggcgtaactgacaagttcgagaacagaaaacatattgaattttccttccagccagtatgcaaagccgaaatgagtccaagcgaagtgtctgattag

SEQ ID NO: 2842 - DNA, 579 bp, Artificial Sequence
  Description of Artificial Sequence: Synthetic coding sequence
atgtccggttgtgacagaagggaaactgaaaccaaaggaaaaaatagctttaagaaacggttacgcggacctaaggtgaagaatctcaatccaaagaaattcagcattcacgatcaggaccataaggtcctcgttctggactccggtaatctgattgctgtccctgacaagaactacatccggcctgagatcttcttcgccctggcttcatctcttagttcagccagcgccgaaaaaggctctcccattttgctaggagtgtctaagggagaattctgtctgtactgtgataaagacaaaggccaatcacacccttcgctccagttaaagaaagaaaaattaatgaagctggccgcacaaaaggagtccgcacgccgcccgtttatcttttatagggcacaggtcgggtcctggaatatgctagaatcagcagctcaccccggttggttcatctgtacatcttgtaattgtaatgagcccgtcggcgtaaccgataagtttgaaaaccgcaagcatattgaattctcattccagccagtatgcaaggcggaaatgtcgcccagtgaggtgtccgattag

SEQ ID NO: 2843 - DNA, 474 bp, Artificial Sequence
  Description of Artificial Sequence: Synthetic coding sequence
atgtctttcgtcggtgaaaattccggggtgaagatgggttcggaagactgggaaaaggatgaaccacagtgctgcctggaagaaattttctttgctctggcatcttctttatccagtgcatccgctgagaaagggagcccgatcctcctcggcgtttctaaaggagagttttgtctgtactgcgataaagacaaaggacagagtcatccctcattacaactgaaaaaagaaaagctgatgaagttagccgcccagaaggaatccgcgaggcgtcccttcatattctatagagcccaggttggctcttggaatatgcttgagagcgcagcacatccagggtggttcatctgtacatcttgcaactgtaacgagcccgtgggcgtcacagataaatttgaaaaccggaagcacattgaattctcctttcagcccgtgtgtaaggccgagatgtcgccttctgaagtctccgattag

SEQ ID NO: 2844 - DNA, 594 bp, Artificial Sequence
  Description of Artificial Sequence: Synthetic coding sequence
atgagctttgtcggtgaaaacagcggagtcaagatgggctccgaagactgggaaaaagacgaacctcagtgctgcctcgaaggtccaaaggtcaaaaatttaaatcccaaaaaatttagcattcacgaccaggatcataaagtgcttgtcctcgactcgggaaacctgatcgcagtccccgataaaaattacattcggcctgaaatcttttttgccttagctagctcactcagttcagcctccgccgagaaggggtccccaattctacttggagtgtcgaagggtgagttctgcttatattgcgacaaggacaaggggcagagccatccctcactgcagttaaaaaaggagaaactgatgaaactagcagcccaaaaggagagcgcgcgcaggcccttcatcttctaccgagcgcaggtcggatcttggaacatgctggaatctgccgctcatcccggatggttcatttgcacatcctgcaactgcaatgagccggtcggtgtaacagacaaattcgaaaaccgtaaacatatcgagttctcctttcaacccgtgtgcaaagccgagatgagcccctctgaggtgtccgactag

SEQ ID NO: 2845 - DNA, 537 bp, Artificial Sequence
  Description of Artificial Sequence: Synthetic coding sequence
atgtctttcgtgggcgagaattcgggcgtgaagatgggttccgaagactgggagaaagatgaacctcagtgctgtttggaggaccccgcagggagcccccttgaacccggtcccagcctacccaccatgaacttcgtacacactaagatattcttcgccctggcttcctccctttcatcagccagcgcagagaagggctcacccattctcctgggcgtgtcgaaaggcgagttttgcctgtactgcgataaggacaaaggccagagtcatccgagcctccaactcaagaaagaaaagctgatgaagctggctgcccagaaggagtcagcccgaaggccatttatattctaccgagctcaggtcggatcgtggaatatgctcgaaagcgccgcccatccagggtggttcatttgcacctcctgtaattgcaacgagcctgttggggtgaccgacaagttcgagaaccggaagcacatcgagtttagtttccagcctgtttgcaaggcagagatgagccctagtgaggtttccgattag

SEQ ID NO: 2846 - DNA, 1770 bp, Artificial Sequence
  Description of Artificial Sequence: Synthetic coding sequence
atgcctaatgatgatttttgtcccggactgacgataaaggccatgggtgccgaaagagccccccagagacagccgtgcacactgcacctgctcgtgttggtcccaatcttgctctcattggtggcgtcccaggactggaaagcagaacgctctcaggacccgtttgaaaaatgcatgcaagatccagattacgagcagctcctaaaagttgtgacttggggtttgaatcgtacgctgaaaccccagcgagtgatcgtagttggggctggtgtcgccggactggtagcggccaaagttttgagtgacgcaggacacaaagtgactatcttggaggcggacaaccggatcggtggcagaatctttacataccgggaccagaataccgggtggatcggcgagttaggggccatgcggatgccctcttctcatcgcatacttcataagctgtgccagggactcgggctcaacctgaccaaattcacacagtatgacaagaacacatggacagaggtccacgaggtcaagctgcgaaattatgtcgtcgaaaaagttcccgagaagctggggtacgcactccgcccccaagaaaagggccatagtcctgaagatatatatcagatggccctgaatcaagccctgaaagacctgaaagccttgggatgtaggaaggccatgaagaagtttgagcgacacacattgctagagtacctgctgggagaaggtaatctttcccggcctgctgtgcagctgctgggagacgtaatgagcgaggatggattcttctatctgagttttgcagaagccttgcgcgctcattcttgtctgtcagatagactccaatacagccgcattgttggcgggtgggaccttctacctcgtgctctgttgagtagcttgtccgggctcgtgttactgaatgcgccagttgtcgcgatgacccagggccctcacgatgtgcatgtgcagatcgaaacaagtccacctgccaggaatttgaaggtactgaaggccgacgtcgtgctattaaccgcctctggacccgctgtcaagagaatcaccttcagtcctcctcttcccagacatatgcaagaagctttgaggaggcttcactacgtgccggcgactaaagtattcctctcatttcgcaggccattttggagagaggaacacatagaggggggacattccaatacggaccgaccgtcccgcatgattttttacccgccacctagagagggcgccctcctgctggcatcatacacttggtccgatgccgctgctgcattcgctgggctttccagagaagaggctctgaggttggctcttgatgacgtcgccgcgttgcacggccccgtcgtgcgccagctgtgggacggtaccggcgtagtgaagaggtgggccgaggatcagcactcccaaggagggtttgtggttcagccaccagccctctggcagaccgagaaggacgactggacggtgccatatggccggatttactttgcaggcgagcatactgcttacccccatgggtgggtagaaacagccgttaagtccgccttgcgcgctgcgatcaaaataaacagccgaaaaggccccgcatctgatactgcctcccccgaaggacatgcttctgatatggagggacagggccatgtgcacggcgtggcctcgagtcctagccatgacctggctaaggaagaggggtcccacccacctgtgcagggtcagctgtccttgcagaacactacccacactaggacctcccattag

SEQ ID NO: 2847 - DNA, 1704 bp, Artificial Sequence
  Description of Artificial Sequence: Synthetic coding sequence
atggccccattagccctccacttactggtgctagtgcctatactgctgtcactggtagcttcacaagattggaaggcagagcggtcacaggatcctttcgagaagtgtatgcaggatccggattacgaacagctgctcaaagtagtcacatgggggctgaacaggaccctcaaaccacagcgcgttattgttgtgggggccggggtggccgggctggtggccgccaaagtgctgtccgatgcaggacacaaagtcacgatcctggaggctgataacaggattgggggtagaatttttacataccgagatcagaacacgggctggataggggaactgggtgctatgaggatgcccagctcacaccgcattttgcacaaactgtgccagggacttggcctgaacctgactaaatttacgcagtatgacaaaaatacctggacagaggtgcacgaggtaaagctgagaaattacgttgtggaaaaggtccccgaaaagctaggctatgctctcagacctcaagagaagggccactcacctgaggatatttaccagatggcactcaaccaagctctcaaggatctaaaggcccttgggtgccgcaaggccatgaagaagtttgaacgccacacattgttagaatacttgttaggggaggggaacttgagtaggcccgccgtgcagctcttgggtgacgttatgtcagaagatgggttcttttacctgtctttcgctgaagcactgcgtgcacacagctgcctgagcgataggctacagtactctaggatagtgggggggtgggacctcctgccgcgcgccctactctcatccctgagtggcctagttctgcttaatgcgcctgtagtggctatgacacagggacctcatgatgtgcacgtccaaattgagacctccccaccagctaggaatcttaaagttttaaaggctgacgtagttctgctgactgccagtggcccagctgtgaagcgtattacattctctcccccgctgccccggcacatgcaggaggccctccgacgtctgcattacgttccagcaaccaaggtattcctctctttcagacgccctttctggagagaggagcacatagaaggaggccattcaaataccgaccgcccctcacgaatgattttctacccgccccccagggagggggctctgctgttggcttcctatacctggagcgacgctgcagccgcatttgcggggttatcaagggaagaggcattgaggttggcccttgatgatgtagcagcattacacgggcctgttgtccgccagttgtgggatgggaccggtgtagtgaagcgctgggctgaagatcaacactcacagggtggctttgtcgtccagccaccagccttatggcagaccgaaaaggatgactggactgtgccctacgggagaatatattttgctggagaacacaccgcttacccccatggatgggtggagaccgccgttaaaagcgctctcagagccgccatcaaaataaattcacgtaagggaccagcgagcgataccgcaagcccggaagggcacgcatccgatatggagggccagggtcacgtgcacggcgtggcgtccagtccatctcacgaccttgcaaaagaggagggatcacatccaccggtgcaaggtcagctctctctgcagaatacaactcacacccgcacatcccactag

SEQ ID NO: 2848 - DNA, 1770 bp, Artificial Sequence
  Description of Artificial Sequence: Synthetic coding sequence
atgcctaacgacgacttctgccctgggctgaccatcaaggctatgggcgccgaacgagccccacaaagacagccctgcaccctgcacttactggtcctggttccgatcctactttctcttgtggccagtcaagattggaaggccgagagatcccaagatccttttgaaaagtgcatgcaggatccagactacgaacaactgctcaaggttgtgacatggggcctcaatcgaacccttaaacctcagagagtgatcgtggttggagccggggtcgcaggtcttgttgctgccaaagtgctctcagacgctggacataaagtgacaatcctagaggctgataatcgaatcggaggcagaattttcacctatcgggaccagaacacaggctggataggagagctcggggcaatgcgcatgccatccagccatcgcatcttgcacaagctctgccagggactcggtctgaacctgactaagtttacccagtatgacaaaaatacctggactgaggtccacgaagtgaagctgcgaaattatgtggtcgagaaggttcctgagaagttgggctacgccctcagaccccaagagaaggggcattcaccagaagatatatatcagatggctctcaaccaggccctcaaagatttaaaagcactaggctgtaggaaggccatgaagaaatttgagcgacatactctcctggagtatcttttgggggaggggaatctgagccgccctgcagttcagctgctaggtgatgtcatgtctgaagacggctttttctacctttcctttgcggaggccctaagagctcactcttgcctaagcgaccgtctccagtacagccgaatcgtgggtggctgggatttacttccgagggctctgctttcttctctttccggactggtgctactgaatgcccctgtcgtggcgatgactcagggccctcacgatgtccacgtgcagattgagacaagccctccggcccgaaatctcaaagttttaaaagccgatgtggtcctgctaacagcatcgggaccagccgtcaagcggatcaccttcagccctcccctgcctagacatatgcaggaggcccttcgcaggctgcactacgtccccgcaaccaaggtcttcctgtcgtttcgtagacctttttggcgagaagagcatatagagggagggcactcgaataccgataggcctagccgaatgattttttacccacccccacgggagggagctttgctcctggcctcctacacgtggtctgacgctgccgctgcatttgctggattatcgagagaggaagccttgagactggctttagacgacgtggctgcccttcacggccctgtcgtgagacagctgtgggatgggaccggtgtggtgaaacgttgggcagaggatcagcactcccagggaggttttgttgtgcagccacccgccttatggcagaccgagaaagacgactggaccgtgccctacgggaggatctactttgccggggaacacacagcctatccccacgggtgggttgagacggctgtcaaaagcgccctcagggccgccattaagatcaatagtcgcaaaggtcctgcctcagatacggcatcacctgaagggcacgcctctgatatggagggccaggggcacgtccacggagtcgccagctcaccgagccacgatctagcaaaagaggaggggagtcaccccccagtgcagggacaattaagtctgcagaataccacccatactcggacctctcactag

SEQ ID NO: 2849 - DNA, 462 bp, Artificial Sequence
  Description of Artificial Sequence: Synthetic coding sequence
atgggactcacatctcaacttctccctccacttttcttcctgctggcctgtgctggtaactttgtacatggccataaatgcgatatcactctgcaagaaattatcaaaacactaaacagcctgacagagcagaaaaccctgtgtactgaactgacagttaccgacatcttcgccgcttcaaagaatacaacggaaaaggagacattctgccgagctgccaccgtgcttagacaattctattcgcatcacgaaaaggacacgcggtgcctgggtgccactgctcagcagtttcaccgtcacaagcagttaataagattcctgaaacggctggacaggaatctctggggcctggccggactaaactcttgtcccgtgaaagaggccaatcaatctaccttggagaatttcctggagcgacttaaaacaatcatgagggagaagtacagtaagtgctcttcctag

SEQ ID NO: 2850 - DNA, 435 bp, Artificial Sequence
  Description of Artificial Sequence: Synthetic coding sequence
atgctgctggctatggtgttgacaagtgcactgttgctgtgcagcgtagcagggcagggctgccccactcttgccggaatccttgacattaacttcctcatcaacaaaatgcaggaagaccccgcaagcaagtgccattgttcagccaatgtgacgagctgtctgtgcctcgggattccatccgacaactgcacacgcccatgtttctccgaaagactgtcacaaatgaccaacaccacaatgcagaccagatatcccttgatcttctcgagagtgaagaagagcgtcgaggtgttgaaaaacaataagtgcccgtatttctcttgcgagcaaccttgcaaccagacgactgcaggtaatgcactgacatttctgaagtcactcctcgagatctttcagaaggagaaaatgcgaggtatgcggggaaagatctag

SEQ ID NO: 2851 - DNA, 2109 bp, Artificial Sequence
  Description of Artificial Sequence: Synthetic coding sequence
atgaggccaatgcgaatatttgttaacgacgataggcatgtgatggcaaagcactcctccgtctatccaacacaggaggagctggaggcggtccaaaatatggtatcacacacagagagggctctgaaagccgtctccgactggattgacgagcaagaaaagggcagttcagagcaggctgagtccgacaacatggatgttccaccggaagatgatagtaaggagggagccggtgaacagaagacagagcatatgacccggactttgcgcggcgtgatgcgtgtgggcctcgtggctaaaggactgctcctcaaaggggacctggaccttgagctggtgctgctttgcaaggaaaagcctaccactgcccttctggacaaagtcgccgacaacctggctatccagctcgccgctgtgacggaagataaatacgaaatcctgcagtcagtggacgatgcagcaatcgtcatcaagaataccaaggagccaccactgtcattgactattcacctgaccagcccagtggtccgcgaagaaatggaaaaggtactggccggtgaaactctgtctgttaatgatccaccggacgtattggacaggcagaagtgtctggccgctcttgcaagccttcgccatgctaaatggttccaggcccgggccaatggcttgaagtcctgtgtgattgtgatccgagttttgcgggatctgtgtacaagagtccctacatggggcccgctgagggggtggccactagaactgctctgtgaaaaaagtatcggtacagcgaacaggcctatgggtgctggcgaggccttaagaagggttctcgaatgtctggcatcgggaatcgtaatgcccgacgggagcgggatttacgatccctgcgaaaaagaggccacggacgccatcggccaccttgacaggcagcagagggaggatatcacccagtccgcccagcatgccctccgcctggctgctttcggacagctccacaaagtactcgggatggacccattgcccagcaaaatgccgaaaaagcctaagaatgaaaatccagtcgattatactgtgcagattcctccaagtacgacctacgccattactccgatgaaaaggcctatggaggaagacggagaagaaaaatctccctccaagaaaaaaaagaagatccagaaaaaagaggaaaaggcggagcctccccaagccatgaacgcattgatgcggcttaaccagctcaagccagggctccaatacaaattagtctcccagacgggacctgtgcatgcccccatttttacaatgtccgtggaagtggacgggaactcctttgaggcctccggaccctctaaaaaaaccgcgaagcttcatgtggctgtgaaggtgctgcaggacatgggtctgcctaccggggctgaagggcgggattcgagtaagggggaagacagcgccgaagagactgaggctaaaccagccgttgtagcccctgctccggtggtggaagcggtcagcacacccagtgcagcttttccctcggatgcgacggcagaacagggaccaatacttactaagcatggaaaaaacccagtcatggaactaaacgagaaaagacggggtctgaagtatgagttgataagcgaaaccggcggttcacatgataaacggttcgtgatggaggtcgaagtggatggccagaagtttcagggggctgggtctaacaagaaagtagctaaagcttacgcagcactcgctgctctagagaaactttttcctgatacccctctcgccctggacgccaataagaagaaacgagccccagtgcctgtaaggggcggtccaaagttcgcagccaagccacacaatccgggctttggaatgggcgggccaatgcacaatgaagtgccccctcctcccaatttaaggggaaggggacgagggggatccattagagggcgtggacggggacggggcttcggcggggccaaccatggcggctacatgaatgcaggagccggatacggcagctatggatatgggggaaacagcgccaccgccggatacagtgatttctttactgactgctatggatatcacgattttgggagttcgtag

SEQ ID NO: 2852 - DNA, 2109 bp, Artificial Sequence
  Description of Artificial Sequence: Synthetic coding sequence
atgcgcccaatgcggatttttgtaaatgacgataggcacgtcatggcaaaacattcctccgtgtacccaacacaggaggaactggaggccgtccagaacatggtgtcccacacagaacgcgctctgaaggctgtttcggattggatcgacgaacaagaaaaaggaagctctgaacaggccgaatcagacaacatggatgtgcctccggaagacgacagtaaagagggggccggagagcagaagaccgagcacatgactcggacgctgagaggagtgatgagggttggtctggtggccaaaggcctgcttttaaagggagacctcgacttggaactggtacttctgtgcaaggaaaagcccacaacagccctgttagacaaagttgccgacaaccttgcaattcagctcgcagcagttactgaggataaatacgagatactacagtctgtggatgatgccgctatcgttatcaaaaacactaaagagcctcctctctctctgacaattcatcttacaagcccagtggtccgcgaggagatggaaaaggttctggccggcgaaaccctcagcgttaatgacccgccagacgtcctagatcgccagaagtgtctcgcggcactggctagcctcaggcatgctaagtggttccaggcgagagccaacggactcaaatcctgtgttatcgtaataagggtgctgagggatctttgcactcgcgtgcctacctggggccccctaagaggttggccactagaactgttatgcgaaaagagcataggcactgctaatcgccccatgggtgccggagaagccttaagacgcgttttagagtgcctcgcttctggtatcgtgatgcccgacggaagcgggatatacgatccatgcgagaaagaggcaactgatgcaatcggtcacctcgaccggcagcagagggaggacattacccagtctgctcagcacgcactgcgtttggctgccttcggccagttgcataaggtgctcggcatggatccgttgccctcaaagatgcccaagaagcctaaaaatgagaaccctgtggattacaccgtccagatcccaccctctacaacctacgctataactccaatgaaaaggcctatggaggaggatggggaagaaaagtcacccagcaagaagaaaaagaaaatccaaaagaaggaagagaaggccgaaccccctcaggcaatgaacgcgcttatgaggttgaatcagttgaaaccaggacttcaatataagctcgtctctcagacgggtcccgtgcacgcccccatattcacaatgtccgttgaggttgacggcaactcgttcgaagccagtggtccctctaagaaaaccgcaaagctgcatgtggccgtaaaagtcctgcaggacatgggcctgcctactggagccgaaggacgggacagttcgaagggcgaggactcggccgaagagacagaggccaaaccggccgtcgtggcccccgcccccgtggtggaggcggtttcaactccatctgccgcgttcccctcggacgctactgctgagcaggggcccattcttacaaagcatggaaagaaccccgtcatggagctgaatgagaagagacgtggtcttaagtacgagctcatttcagagactggaggcagccacgataagcggttcgtaatggaggtcgaagtggatggacagaaatttcagggggcagggtcaaacaagaaggtggccaaagcctacgctgcccttgcagccctggaaaagctgttccctgacacaccactggcccttgatgctaacaaaaagaaacgcgcaccagtcccagtgcgcggcggaccaaagtttgcagccaaacctcacaatcctggttttggaatgggcgggccaatgcacaatgaagtccctccaccgcccaaccttcgcggtagaggcagagggggctcaatacggggaaggggaagagggagaggcttcggcggcgcaaaccacggcggttatatgaacgccggtgccggctatggcagctatgggtacggcggaaatagcgcaacagccggctactccgattttttcacagattgttacggttaccacgatttcggttcttcctag

SEQ ID NO: 2853 - DNA, 2685 bp, Artificial Sequence
  Description of Artificial Sequence: Synthetic coding sequence
atgcgcccaatgcgcatcttcgtgaatgacgatagacacgtcatggccaaacactcttcggtctatcctacccaggaagagttagaagctgtgcagaatatggtgtcacataccgaaagggccctcaaggccgtatcggactggatcgatgagcaagagaaaggctcatctgaacaggccgaaagcgacaacatggatgttcctcctgaggatgacagcaaagagggggccggagaacaaaagaccgagcacatgacaagaaccctcaggggagtcatgagggtggggttagtcgcaaagggactattgttgaaaggcgatctagacctggaactggtgcttttgtgcaaagagaagccaacaaccgcgcttttagacaaggtagccgataatctagcaattcagctcgcggcggtcacagaggataagtacgagatcctccagagtgtcgatgatgctgctattgtgattaagaataccaaggaaccccctctgtcactgacaattcacctcaccagcccggtggtccgagaagaaatggaaaaggtactcgccggggaaaccctctccgtcaacgatcctcctgacgtgttggataggcaaaaatgccttgcagccctcgcttctcttcgccatgccaaatggttccaagctcgtgcaaacgggttgaagagctgcgtcatcgtgattcgggtacttcgtgatctgtgcaccagagtgccaacttggggtccccttcgaggttggccccttgaactactttgcgagaagtcaatcgggacagccaataggcccatgggagcaggcgaggcacttcggcgtgtgttagagtgcctcgcctctggaatcgtcatgcctgacggaagtggaatctatgacccttgcgaaaaagaagccacggacgcaatcggacacctggataggcagcagagagaggacataactcagtcagcgcagcacgctcttcgtctcgccgcatttgggcagctgcacaaggttctgggcatggatcctctgccaagtaaaatgcccaaaaagccgaagaatgagaaccctgtagactacaccgtccagattcccccttcaaccacttatgctatcactccaatgaagcgacctatggaggaggacggcgaggagaaatcccccagcaagaaaaagaaaaagatccagaaaaaggaagaaaaggccgaaccaccgcaggcaatgaatgcactcatgagactgaatcagctgaagcctggcctacagtataagctggtaagtcagaccggtccggtgcacgcaccgatcttcactatgtcggtagaggtcgacgggaacagctttgaggcatcagggccgtctaagaagactgccaagctccacgtggccgtgaaggtgctgcaagatatggggctgccaaccggggctgagggccgcgacagcagtaagggcgaagattctgctgaagagacagaagcgaaaccagctgtggtcgcacccgctccagtagtagaggccgtgtccacaccaagcgccgccttcccaagcgatgcaacagcagaacaggggccgatccttacaaagcacggcaagaatcctgtaatggaactcaatgagaagagacggggcctcaaatatgagctgatcagcgagaccggtggcagccacgacaagcgttttgtgatggaggtcgaagtggatgggcagaagttccaaggggccgggagcaacaagaaagtcgcaaaggcctacgccgccctagccgcgctcgaaaagctatttcccgataccccgctggcgttggatgcaaacaagaaaaagagagctcccgtcccagtgagaggcggaccgaagttcgccgctaaaccccataaccccgggtttggaatgggaggtcccatgcataatgaggtacctccaccacccaatttgagaggtaggggaagggggggcagcatcagggggcgtggtcgcgggaggggttttggcggagccaatcatggcggctatatgaatgctggcgccgggtacggatcttacgggtacggcggcaacagtgctaccgctggctattcgcagttttattccaacgggggccactcaggcaatgcttctggcggcggtggcggcgggggcggcggttcttccgggtacggctcttactaccagggagacaattacaacagcccggtccctcctaagcatgccggcaaaaaacaaccacacgggggacagcagaagccctcctacggctcagggtatcagagtcaccagggacaacagcagtcctataaccagtctccttattccaattacggcccgccacaaggcaagcaaaagggctataaccacggccaaggctcatactcctatagtaatagctacaattctcctggagggggcggcggtagcgactataattatgagagtaaattcaactattctgggagcggaggtagatctggcggaaactcatatgggagcgggggtgcgagctacaatcctgggagccatgggggatacggggggggatccggaggggggagttcataccagggcaaacagggcgggtacagtcaatcaaattataactccccaggtagtgggcagaattactctggcccacccagcagttaccagtcgtctcaggggggatacgggaggaacgccgatcatagtatgaactatcagtatagatag

SEQ ID NO: 2854 - DNA, 2295 bp, Artificial Sequence
  Description of Artificial Sequence: Synthetic coding sequence
atgagacctatgcgcattttcgtgaacgacgatcgacacgtcatggccaagcactcttcggtgtatcccactcaggaggagctcgaagccgtgcaaaacatggtaagccacaccgagcgggctctgaaagcagtttccgactggatagatgaacaggagaaaggttcctccgagcaggcagaatcagacaatatggacgttccccccgaggatgactctaaggagggggcgggtgagcaaaaaaccgagcacatgacgcgcacattgcgtggtgtcatgagagtgggtctggtcgccaaagggttactcttgaagggcgacttggatcttgaattggtgttactctgtaaggaaaagccaactacggccctactggacaaggtggcggataacctggctatacagctcgcagccgttacggaggacaaatacgaaatcttgcagtctgtagacgatgcagccatagtaataaagaataccaaggagcccccacttagtctgaccatacatttaacttcacccgtggtccgcgaagagatggaaaaggtgcttgccggggaaacactcagcgtaaacgacccacctgacgtgctggatcgtcaaaagtgtttagccgctctggctagccttcgccacgctaaatggttccaggccagagccaacggacttaaatcgtgcgtgatcgtcatacgggtcttacgcgacctgtgtactcgcgtgcccacatgggggccattacgcggatggccgcttgagctcctgtgcgagaagagcatcggcactgcaaataggcctatgggagctggcgaagctctgagaagggtgttagagtgcctagcttctggtattgtgatgcccgacggatccgggatttatgacccatgcgaaaaggaggcaaccgacgccattggccacctggaccgccaacaaagagaagatattacacagtcagctcagcacgctttacgcctggccgccttcgggcagcttcataaggtactcggcatggaccctcttccttccaagatgccaaagaagccaaagaatgaaaaccccgtcgactacactgtgcagattccccctagtacaacttatgctatcactcctatgaagagacctatggaggaggatggggaggaaaagtctccttcgaagaagaaaaaaaagatccagaagaaggaagaaaaggccgaacctccacaggccatgaacgccttgatgcggctcaatcagctgaaacccggccttcagtataagctggtgtctcagactggaccagtgcacgcgcccatcttcacaatgtcagtggaggtggacggtaattctttcgaggcgagcgggccgtcaaagaagactgcgaaacttcacgtagccgtgaaggtcttacaggacatgggactccccacaggagcagaaggccgagacagctcaaaaggggaggactctgctgaggaaaccgaggcgaagccggccgttgttgcacctgccccagttgtcgaggcagtgtccaccccaagtgcggctttcccctcagacgccaccgcagagcagggcccgatccttacaaagcatggtaagaacccggtgatggaactgaacgaaaagcgacggggcctgaagtatgagctgatcagcgaaactggaggcagccacgacaaaaggttcgtaatggaggtggaggtcgacggccagaagttccagggggctggcagtaataaaaaggtcgccaaggcttatgctgcactggccgccttggaaaagctgtttcccgacacccctctggctcttgacgccaataaaaaaaagcgggcccctgtacctgtcagagggggacccaaatttgcggccaagccacacaacccgggctttggcatggggggacccatgcacaatgaggtgccgccaccaccgaacttgaggggtcggggaaggggggggtccattcgcgggagaggtagaggtcgaggatttggcggggctaaccacggaggttatatgaacgcgggggctggttacggttcatacggctacggggggaatagcgccacggctgggtattctaagtcttccagaccccctcctccttctcgtcccagatgttgtgtggttagatgcagtgggagtccctgtggaccatcgtgtgatccctacctagctgtcttcggcactccttgcttacagtggtttgtttcttgccactacaatttcgtttgggtcgagttcctgagcttctgcagctccgttagtttgtgcctgttcactctaagggtgagcgggaattctgtctgcctttag

SEQ ID NO: 2855 - DNA, 2121 bp, Artificial Sequence
  Description of Artificial Sequence: Synthetic coding sequence
atgcggccgatgcgtatcttcgtgaacgatgacaggcacgtgatggcgaaacattcaagcgtataccccacccaggaagaactcgaagcagttcagaacatggtcagccatacggaaagggcattgaaagcggtgtcagactggatcgacgaacaggaaaaaggtagctccgaacaggctgagtctgacaatatggacgtgccgccagaggacgacagcaaggaaggagccggcgaacagaaaactgaacatatgacccgcactttacggggtgtgatgcgggtgggactggtggcgaagggcctccttctaaagggggacttagacctggaactggtcctcttatgtaaggagaaacccaccaccgcgctcttagacaaagttgcagacaatctggccattcaactagccgccgtcacagaagataaatatgagattctgcagagcgttgacgacgccgctatagtgataaaaaacaccaaggagccacctctgtccctgaccatccacctgacttctcccgtcgtgcgcgaagagatggaaaaggtcctcgccggagagactttgtccgttaacgacccccccgacgtgctggatcgacagaaatgtctggcggccctggccagcttaaggcatgccaaatggtttcaagcccgggccaacggactcaaatcctgtgtcattgtgatcagagtactgcgtgacctgtgcacacgcgttccaacctgggggccactgaggggatggccccttgaactgctttgcgagaaatctatcggtaccgctaatagacctatgggggccggggaagctctgaggcgggtgctcgagtgcctagcaagcgggatcgtgatgcccgatggatcaggcatctatgatccttgcgagaaggaggccacagatgccattggtcacctggatcggcagcagagagaagatataacccagagcgctcagcacgctttgaggctggctgcatttggacaactgcataaagtactcgggatggatcccctgccaagcaagatgccaaagaagccaaagaatgagaaccccgtggattatactgtgcagattcccccttcaactacttacgcgataaccccaatgaagcgtcctatggaggaggatggggaggaaaagtcaccttctaagaagaagaagaagatacagaagaaggaagaaaaagccgaaccaccccaggcaatgaacgcactgatgcgactgaatcagctgaagccaggactccagtacaagcttgtctctcagaccggaccagtccacgccccaatcttcacaatgtcggtcgaagtggacggaaacagctttgaagcttcaggacccagtaagaagacagccaaactacatgttgccgtaaaggtcctccaggatatgggcctgcctacgggcgcagaaggccgcgactcctcaaagggggaagacagtgctgaggaaacagaagccaagccagccgtggtcgcaccagctcctgttgttgaggctgtcagcaccccctccgccgcgtttccatctgatgccaccgctgagaatgtgaagcagcagggtcccatcctgactaaacatggaaagaatccagtgatggagctgaatgaaaagaggagaggcctgaaatatgaactcatatcagagactggagggtcccatgacaagagattcgtcatggaggtggaggtagacggccagaagtttcagggggctggcagcaacaagaaagtggccaaggcctatgccgctcttgcggccctagagaagctgttccccgacactccgctggcacttgatgccaataagaaaaaaagagcaccagtccccgtcaggggcggccctaaatttgccgccaaaccgcataaccctggcttcggcatgggtggacctatgcacaatgaggtgcctccccctcctaatttgagaggacgcggcaggggtggatctatccgcggaaggggaaggggcaggggcttcgggggcgcgaaccacggcggatatatgaatgccggcgccggctacggctcttacggttacggaggcaattctgctactgcaggctactctgacttcttcactgattgttacgggtatcatgactttggttccagttag

SEQ ID NO: 2856 - DNA, 2073 bp, Artificial Sequence
  Description of Artificial Sequence: Synthetic coding sequence
atgcgccctatgcgaatcttcgtgaacgacgacaggcacgtgatggcaaaacatagttctgtgtatcccactcaggaggagctggaggccgtgcagaacatggtctcacacactgagagagctttgaaagctgtctctgattggattgacgaacaagaaaagggtagctccgagcaagcagagtcagataatatggatgtccctccagaggatgacagcaaggaaggcgccggcgagcagaaaaccgaacatatgacacgaaccctgcggggtgtaatgcgcgtgggcctcgtggcaaagggcctgctcctgaaaggagacctggacctggagttggtgctgttatgcaaggaaaaaccaactacagctctgttagataaagtcgcagataacttagccatccagctggcggcagttacggaggacaaatatgagatcctgcagagcgttgatgacgcggcaatcgtcattaagaacacaaaggagcccccgctgtcattaaccatacacctaaccagcccggttgtgagagaggagatggagaaagttctggctggcgaaactctgagcgtgaacgacccgccagacgtgctagataggcaaaaatgtctggctgctctggcatctctgagacacgccaagtggtttcaggcgagggcaaatggattgaaaagctgcgtcattgtcattagggtgctgcgtgacttgtgtactagggtacctacctggggaccactgcggggctggccactggagctgctttgcgaaaaaagtatcggcacagcaaatagacccatgggggcgggtgaagccctcaggagagtacttgaatgtctggcgagcggaatcgtcatgcccgatggaagtgggatctacgatccgtgcgagaaagaggccacagacgccatcggtcacctggatcgtcagcagcgcgaagacattacacaatccgcacaacacgccctgcgtcttgcagctttcggacagctgcacaaagttcttggcatggatcctttgccctccaaaatgccgaagaaacccaaaaatgagaaccccgtcgattacacggtgcaaattcctccttcgacgacatacgccattaccccgatgaagcggcctatggaagaggacggggaagaaaagtctccaagtaagaaaaagaaaaaaatccaaaaaaaagaagaaaaagcagaaccacctcaggcgatgaacgctcttatgcgtttaaatcaacttaagccaggcctccagtacaagctcgtctcgcaaaccggtccggtccatgcacccatatttacaatgtccgtggaggtggatggcaacagctttgaggcctctggaccgtctaagaaaacagccaaattgcacgtagctgtaaaggtcctacaggatatgggcctgccgaccggcgccgaaggccgggattccagtaagggcgaggattccgccgaggagactgaggccaaacccgctgtcgtggcacccgcacctgttgtcgaggcggtgtctacgccttccgcagcctttccctctgacgctacagctgagcagggtcctattctgaccaagcacggtaaaaacccagtaatggagctgaatgagaaacggcgcggtcttaaatatgagctgatttccgaaactggaggttcacacgataagagattcgtgatggaagttgaggtcgatggccagaagtttcagggggccggctcaaataagaaagtggctaaggcttatgccgccctggcggctctggagaaactcttccccgacacgcccctggcactcgacgcaaacaagaaaaaacgcgccccagtgcccgtgcggggagggccaaagttcgcggccaagccacataacccgggctttggaatgggcggcccaatgcacaatgaagtccctccgcccccaaatctacgaggtaggggcagaggcggcagcatcaggggtcgaggccggggccgcggattcggcggcgccaaccacggcgggtacatgaacgctggcgcgggatatggcagctacggatatggggggaactctgccactgccggatataccggctttgtgtag

SEQ ID NO: 2857 - DNA, 2697 bp, Artificial Sequence
  Description of Artificial Sequence: Synthetic coding sequence
atgaggccaatgcggatcttcgtcaatgacgatcgccacgttatggccaaacactcctcagtctatcccacccaggaggagttggaagcagtgcaaaatatggtctcccataccgagcgagcactcaaggcggtcagcgactggattgatgagcaggagaagggatcttcagagcaagcagagtccgacaatatggatgtcccccccgaggacgactcgaaagagggagctggagagcagaagaccgagcacatgacgaggacattgaggggagtgatgcgcgtgggactagtggctaaaggactgctgcttaagggtgatttggacctcgaattagttctcctgtgcaaagagaagcccaccacggccttattggataaagtggccgataatctggccattcagctcgccgccgtgacagaggataaatatgaaatacttcaatccgtggatgacgcagctatcgtgatcaagaacaccaaggagcctcctctgagcttgactattcacctcacatccccggttgtcagagaagaaatggagaaagtcctcgccggggaaaccctgagcgtcaatgaccctcccgatgtcctggaccgccagaaatgtctagccgccctggcttcactccgacacgctaagtggttccaggcacgggctaacggcctcaagtcatgcgttattgtaattagggtgttaagggacctttgtacacgggtgccgacttggggaccccttaggggctggcctctggaactcttgtgcgagaaatctatcggaacagccaacaggcccatgggagcaggagaggcactccggagagtgctggaatgcctagcatcagggatcgtaatgcctgacggttcaggcatctatgacccgtgtgagaaagaggcgaccgacgccattgggcacctcgataggcagcagcgcgaggacataacacagtccgcccagcacgccttgcgtttggctgcgtttggccagctacacaaggtcctgggaatggacccacttccctcaaagatgccaaaaaagcctaagaatgaaaatccagtggattatacagtgcagatccccccttctaccacatatgcgataaccccaatgaaacgcccaatggaagaagatggagaggaaaaatcgccctccaagaaaaaaaaaaaaattcaaaagaaggaggaaaaggccgaacctcctcaagccatgaatgccctgatgagactgaaccagctaaagcctggcctgcagtataaacttgtgtctcagactggaccagtccacgccccgatttttactatgagcgtcgaagtcgacggaaattcgttcgaagcttcaggcccctccaagaagaccgccaaacttcatgtggccgtgaaggttctacaggacatgggcctgcccaccggcgctgaggggagggacagctccaaaggcgaggatagcgccgaggagactgaagccaagcctgccgtggttgctccagcccccgtcgttgaagccgtctccacacccagcgcggctttcccttcagatgctacagctgagaacgtgaaacaacagggcccaatcctgaccaagcacggtaaaaatcctgtgatggagctgaacgaaaagagacgtggactaaaatacgagctgatctccgagaccggtggctctcacgataagaggttcgtcatggaggttgaggtagacggccagaaatttcagggggccgggtcaaacaagaaagtagcgaaggcttacgcagccctcgctgccctagaaaaattattccccgacacccccttggctctggacgcgaacaagaaaaaacgagcaccagtacccgtgagggggggacctaagtttgcggccaagccacataaccccgggttcggtatgggagggccgatgcataacgaagtgcctccccctccgaacctcagaggccgaggtcggggcggctccataagaggtcgtggacggggtcgagggttcgggggcgctaatcacggaggctacatgaacgctggcgcaggatatgggagttatggctacggaggaaattctgcaactgccggttattcccagttctactctaatggcggacacagcgggaatgcctccggggggggcggtggcggcggtggcggttcatccggctatggctcctactaccaaggcgataactacaacagcccggtgccaccaaaacacgcagggaagaaacaaccacacgggggccagcaaaaaccatcatatggaagtggctaccagagccaccagggacagcagcagagttataaccagtctccatactctaactatggacccccgcagggcaaacaaaagggctataatcatggccagggatcatacagttattctaatagttataatagtcccggaggcggcggggggagcgactataattatgagtctaagttcaattattccggatctggggggcgctcaggtgggaacagctacggatcgggcggtgcatcctacaacccaggttcccatgggggttacggaggaggctccgggggaggctccagttatcaaggaaagcaaggcggatatagtcagagcaactataactcacctgggtctggtcaaaattactccggcccaccctcatcttatcagagcagtcaaggtggctacggtcgtaatgccgaccatagcatgaactaccagtatagatag

SEQ ID NO: 2858 - DNA, 882 bp, Artificial Sequence
  Description of Artificial Sequence: Synthetic coding sequence
atggcaacagccaggcctccatggatgtgggtactgtgcgcactaattactgcattattgctgggggttacagagcatgtgttagcaaataacgacgtcagctgtgatcatcccagcaacacagtcccgtcgggctcgaatcaggatctgggcgctggggccggcgaagacgcgcggagtgatgatagttcttccagaatcatcaacggcagcgattgcgatatgcacacccagccgtggcaagccgctctgctgctcaggccgaaccagctctactgcggcgcagtgctagtgcaccctcagtggctgctcacagctgcacactgcaggaagaaggtctttcgggtgcgcctcggccattacagcttaagcccagtttacgagagtggccaacagatgttccagggtgtgaagtccattcctcacccaggctactcacatccaggtcactccaacaacctgatgctgatcaagttaaaccggagaatccgcccgaccaaagatgtacggcctatcaacgtgtcttcccactgccctagcgcgggcaccaagtgcctggtgtctgggtggggtacaaccaaatctccccaagtgcattttccgaaagtactccagtgcctgaacatcagcgtcctgtcacagaagagatgtgaggacgcatacccccggcaaatcgacgacactatgttctgcgcaggcgacaaagctggccgggactcttgtcagggggattctgggggaccagttgtctgtaacggttctcttcaaggcttagtgtcttggggtgattacccctgtgctcgccctaataggccaggagtttacacaaatctatgtaaattcacaaaatggatacaggagaccatccaggccaactcctag

SEQ ID NO: 2859 - DNA, 882 bp, Artificial Sequence
  Description of Artificial Sequence: Synthetic coding sequence
atggccactgctaggcccccctggatgtgggtgctatgtgctctgatcacagctctgcttttgggcgtgactgaacacgtcctcgctaacaacgatgtgagctgtgaccatccctcaaacacagtaccatctggatcgaatcaagatttgggagcgggggccggggaagatgcccgaagtgacgacagctcttcacgcattattaacggcagtgattgcgacatgcacacacaaccctggcaggcagccctgttgctgcgccccaaccagctgtactgcggagctgtgctcgttcacccacagtggctgctaacggcggcacactgccggaagaaggtcttcagagtcagactcggtcactactcgctcagcccggtttatgagagcggccaacagatgttccaaggcgtaaagtctatcccacaccccgggtacagccatccaggtcatagtaacaatctgatgctgatcaagctcaaccggaggattagaccgactaaagacgtgcggcccattaacgtctcctcccattgccctagtgcggggaccaaatgcctcgtgagcggatggggcaccactaaatcccctcaggtgcattttcccaaggtcctgcagtgcctcaacatcagtgtgctgtctcaaaagaggtgcgaggacgcatatcccaggcagattgatgacacaatgttttgcgcaggtgataaagctggtcgggatagctgtcaaggagatagtggcggacctgtggtctgcaacggtagcctgcagggtttggtttcgtggggcgactacccctgtgctcgccctaaccgccccggggtctacactaatctgtgcaaatttactaagtggatccaggagaccattcaggcaaatagctag

SEQ ID NO: 2860 - DNA, 882 bp, Artificial Sequence
  Description of Artificial Sequence: Synthetic coding sequence
atggctaccgcccgtcccccttggatgtgggtgctctgtgccttgataaccgcccttctactgggggtcacggaacatgtgctagccaataatgacgtctcttgtgaccatccctctaatactgtccctagcgggagcaatcaggacctcggggctggcgctggagaagatgcacgttcagatgactcatccagccgcattatcaatggcagcgactgtgacatgcacactcaaccttggcaggctgcgctgcttctcagacccaaccagctttactgtggcgcagtactggtgcacccccaatggctgctgactgctgcccactgtcgcaaaaaggtgttcagagtgcgattgggccactattcactttctcccgtatacgaaagcggtcaacagatgtttcaaggggtaaagtcaatccctcatccaggttactctcatcccgggcactccaataacctgatgctgatcaaactcaatcggaggatacgcccaacaaaagacgtccgtccgattaatgtcagctcacattgcccttccgctggcaccaaatgtcttgtgtctggctggggcacaacgaaaagcccccaggtacactttcctaaggttcttcagtgccttaacatctccgtgctatcacagaaaagatgtgaggacgcttaccctcgtcagattgatgacacaatgttttgtgcgggtgataaagccggacgcgactcctgtcagggagacagcggtgggcctgttgtgtgcaacggttccctgcagggcctagtgtcttggggtgactacccatgcgccaggcccaaccggcccggggtctacactaacctgtgcaaattcacaaagtggatacaggagactatccaggctaactcgtag

SEQ ID NO: 2861 - DNA, 2109 bp, Artificial Sequence
  Description of Artificial Sequence: Synthetic coding sequence
atgcccatcaacaagagtgagaagccggaatcgtgtgacaatgttaaggtcgttgtgcggtgtcgccctcttaatgagagagagaagtctatgtgctataagcaggccgtctcagtggatgagatgcgggggacaattacagtgcacaagactgatagctcgaatgagccaccaaaaaccttcacttttgatactgttttcggcccagagagcaagcagctggatgtctacaacctgactgctagacccattattgactcagtgttggagggctataatgggactattttcgcgtatgggcagacggggaccggcaagacatttaccatggaaggggtcagagcaatccccgagttaagaggcattatccccaacagcttcgcacacatatttggccacatcgcaaaggcggagggggatacccgctttctagttcgcgtgtcgtatctggaaatctataatgaggaggtacgagatttgctgggaaaggatcagacccagcgccttgaggtcaaagagcggcctgatgtgggcgtttacattaaagacctgtccgcctatgtggtcaacaatgcagatgacatggataggatcatgaccctggggcacaaaaatagatctgtaggcgccacgaacatgaatgagcacagctcaagatctcacgccatctttaccataactattgagtgtagtgagaaaggaatcgacggtaacatgcacgtccgcatgggcaaattgcacttggtggatctggctggtagcgagcggcaggcgaagactggagccactggtcagagactgaaggaagcaaccaaaatcaatctaagcttatcaactctgggaaatgtgatttccgcgctagtggacgggaagtccacccatgtgccatataggaattccaagctgaccaggctgctccaggactcccttggcggaaattccaagacaatgatgtgtgccaatatcggccctgccgactacaactatgacgaaaccataagtaccctgaggtatgctaatagggcgaagaacattaagaacaaagcccgaatcaatgaagaccctaaagacgcccttttgcgtcaattccagaaggaaatcgaggaactcaagaaaaagttagaggagggcgaagaaatcagcggttccgatatttcaggatctgaagaggacgatgacgaagaaggagaagtgggagaagatggagaaaagcgaaagaagcgacgcgaccaagcaggcaaaaaaaaggtgagtccagacaagatgattgagatgcaggcaaaaatagatgaggagcgtaaggcactggaaacaaagctggatatggaggaggaagagcgaaacaaagctcgagccgagcttgaaaagagagaaaaagacctgctcaaggcacagcaggaacatcagagcttgttagaaaaactgagcgcactggagaaaaaggttattgtaggcggagtggacctcctggctaaggcggaggagcaagagaagctgctcgaggaaagcaatatggagttggaggagaggagaaagcgagccgaacagttgcgcagggaattggaggaaaaagaacaggagagattggacatagaggaaaagtacacatccctacaggaagaagcacaggggaagactaaaaaattgaagaaggtatggactatgttgatggccgctaaatcagagatggccgatcttcaacaggaacatcaacgtgagatcgagggtctgctggagaacattaggcaactctctcgggagttgaggttgcaaatgctcatcattgataacttcattccccgcgattaccaggagatgatcgagaactacgtccattggaacgaagacatcggggaatggcagcttaaatgcgtagcctatacaggcaacaacatgagaaaacaaactcctgtccctgacaagaaagaaaaagaccctttcgaggtggatctgtcccacgtgtatctggcctatacggaagagtccttacgtcaaagtttaatgaagctggaacgcccacgaacgtccaagggcaaagccagacccaagacaggccggcggaagagatcagctaagccggaaacagttatcgattcactcttgcagtag

SEQ ID NO: 2862 - DNA, 2100 bp, Artificial Sequence
  Description of Artificial Sequence: Synthetic coding sequence
atgcccatcaacaaatccgagaagcctgagagttgcgacaatgtaaaagtagtcgtccgatgccgcccgttaaacgagagggaaaaatccatgtgctacaaacaggctgtgtcagtcgatgagatgcgtggaactattactgtgcataagacagactcttcgaacgaaccaccgaaaacttttactttcgataccgtgttcggcccggagtcaaaacagttagacgtttacaatctgaccgcacggcccatcatcgatagcgtgctggaggggtacaacgggacgatcttcgcatatgggcaaaccggtacaggtaagaccttcaccatggagggcgtccgagccatccctgagcttcgcggaatcatcccgaactctttcgctcacatctttggtcatattgcaaaagcagaaggcgatacccgcttcttggtgagagtcagctacctggaaatatacaacgaggaggtcagggacttattggggaaggaccagacccagagactggaagtaaaagaaaggcccgatgtgggtgtctacattaaggacctctccgcatatgttgtgaacaacgccgatgacatggacagaatcatgacgttggggcacaaaaacaggagcgttggcgcaaccaatatgaatgagcattcatcaaggtctcacgctattttcactattaccattgagtgttctgaaaaggggatcgacggaaacatgcacgtacggatgggtaaattacacctggtcgaccttgccggatccgagcgccaggctaagacaggagccacgggacagcggctcaaggaagcaactaagataaacctcagcctgagcaccctgggaaatgtgatctctgctctggttgatggaaaatcgacgcacgtcccctacagaaattcaaagctcacccggcttttgcaagacagcctcggcggcaacagtaagactatgatgtgtgcaaatatcgggccagcggactacaattacgacgaaactatctccaccttgagatatgccaacagagcaaagaatataaagaacaaagcccgtatcaatgaggacccaaaagatgcacttctgcgtcaatttcagaaggaaatcgaggaactgaaaaaaaaactggaggaaggggaagagatctccgggtctgacattagtggtagcgaagaggacgacgatgaagagggcgaggtgggagaggacggagagaagcgcaagaagcgcagaggcaagaagaaagtgtctcctgacaagatgatcgagatgcaggcaaaaattgacgaggaacgtaaagctctagagactaagctggacatggaggaagaggaacggaataaagcccgcgccgagttagaaaagcgcgaaaaagaccttctgaaggcccagcaagaacaccagtctctcctggagaagttatccgctctagagaaaaaagtgatcgtaggtggagtggacctgctcgctaaagcagaagaacaggagaagctgctggaggagtccaatatggagctggaggagcgtcggaaacgggcagaacagctgcgcagagagctcgaggaaaaggagcaggaaaggctcgacatagaagaaaaatacacgtctctgcaggaagaagctcaggggaagaccaagaaactgaagaaagtttggacaatgttgatggccgccaagtcagagatggccgacctgcagcaggagcaccagagggagatcgaaggacttcttgaaaacatcagacagctctctagagaattaaggctgcagatgctcatcatcgacaacttcattcccagagattaccaggaaatgatcgaaaactacgtgcactggaatgaggacatcggggaatggcagctcaaatgtgtggcgtatacgggcaacaacatgaggaaacaaacacctgtgcctgataagaaggagaaagacccatttgaagtggacttatctcatgtgtatctggcctacacagaggagagccttcgacaatccctcatgaagcttgagaggccacgcacgtccaaagggaaagcacgccccaaaactgggagacgaaaacggtcggctaaacctgagactgtgatcgatagtctgttacagtag

SEQ ID NO: 2863 - DNA, 1230 bp, Artificial Sequence
  Description of Artificial Sequence: Synthetic coding sequence
atgtgctacaagcaagccgtaagcgtggatgagatgcgcggcaccattactgtgcacaagacagattcctccaatgaaccgcccaaaacttttacctttgacaccgtgttcggacctgagagcaagcagctcgatgtgtacaacctgaccgcgcggcctataatagactctgtcctcgagggctacaatggaaccatatttgcctatggacaaactggaacaggaaagacattcacaatggagggtgtccgcgccatcccggaactcagagggatcatcccaaactcctttgctcacatcttcggtcacatcgctaaggccgagggggatactagatttcttgtacgggtgagctaccttgaaatttacaacgaagaagtccgcgacctgctgggaaaggaccaaacacaacgtctcgaggtaaaggaacggcccgatgtcggagtgtacataaaagatctgtctgcatatgtagttaataacgctgatgatatggatagaataatgacactaggtcacaaaaataggtcagtcggcgcaaccaatatgaacgaacactcttcccgcagccacgcaatattcaccatcaccattgaatgtagcgagaaagggatcgacgggaacatgcacgttaggatgggcaagcttcatctcgttgatctggcagggagcgaacggcaggccaaaaccggcgccacaggccagaggctgaaagaggccacgaaaatcaatctgagtttgtcgaccctggggaacgtcatttccgcactggttgacggaaaaagtacgcacgtgccttatcgaaatagcaagttgactcgcttgctgcaggattccttggggggtaacagtaagacgatgatgtgtgctaatattggtccagctgattataactatgacgagaccatcagtacactccggtatgccaacagggctaagaacattaagaacaaagctaggattaacgaggatcccaaggacgccctcctccgtcagtttcaaaaggaaattgaagagttgaagaagaagctggaggagggtgaagaaatctctggtagtgacatatccggctccgaagaagatgatgacgaggaaggagaagtgggggaggacggtgaaaaacggaaaaaacgcaggggaaagaagaaggtgtctcctgacaaaatgatagagatgcaagccaagatcgacgaagagaggaaaaaaaaaaagaagaagaagaaaaaatag

SEQ ID NO: 2864 - DNA, 2181 bp, Artificial Sequence
  Description of Artificial Sequence: Synthetic coding sequence
atgcctattaacaagagtgaaaagcctgagtcctgcgacaacgtcaaagtagtggtccggtgtcgtccgctgaacgaacgcgagaaatctatgtgttacaaacaggctgtgtctgtcgacgagatgcggggaactatcacggtgcacaagaccgatagttctaacgagccaccaaaaactttcacttttgacacagtgttcggccccgaaagcaagcagcttgatgtgtataacctgacagccagaccaatcatcgacagcgtactcgagggatataacggcaccatcttcgcatacgggcagacaggtaccggtaaaacctttaccatggagggggtgcgggccatacccgagttgcggggcattattccaaatagttttgcccatattttcggacacatagcaaaagccgaaggtgatacgcgctttctcgtccgtgtttcctaccttgagatttataacgaggaagtcagagacctcctggggaaggatcaaacacagagactcgaagttaaagaaagacctgacgtgggcgtgtacataaaagacctgtcagcgtacgtggttaataacgccgatgatatggataggataatgacactcgggcacaaaaataggagcgtaggagcaacaaatatgaatgagcactcttcccgatcccatgctatttttaccatcactattgaatgctccgagaaaggcatcgacggcaacatgcatgtgaggatgggaaaattgcatctagtcgacctggctggcagcgaacgccaggctaagactggagctactggtcagaggctgaaggaggcaacaaagatcaatctttccttatccacactcggtaatgtgatttccgctcttgtcgacggtaaaagtacacacgttccgtatagaaatagcaaactgacccgattactccaggacagcctgggtggtaattcaaaaacgatgatgtgcgcaaacattggcccagcagactacaactatgacgagacaatttcaaccttgagatacgccaaccgcgccaagaacatcaagaacaaggctagaataaatgaagacccaaaggacgccctgctgcgccagtttcagaaagagattgaggaactgaagaaaaagctggaggagggcgaagagatcagcggaagcgacatatcaggttctgaagaggacgacgacgaggaaggcgaagtgggggaggacggggagaagaggaagaaaaggaggggcagctctagttccagctccagcgacagtacatgctccgtgattgagaagccccttgataagttcctcccgatccaaataggaaaaaagaaggtatctcccgataaaatgattgagatgcaggcaaagatcgacgaggagcgcaaagctttggagaccaaactcgatatggaagaggaagagagaaataaagcccgcgcggagttggagaaacgcgaaaaagacctactgaaggcccagcaggaacatcaaagccttctggagaaattgagcgctttggaaaagaaagtgatcgtaggcggcgttgatctgttggcgaaggcagaggagcaagaaaaactattagaggaaagcaacatggaactcgaggagcggcgaaagagggccgaacagcttcgcagggaactggaggagaaggagcaggaacggttggatattgaagagaaatatacctccctgcaggaagaggcccaaggcaagactaaaaaactgaagaaggtgtggacgatgttgatggccgccaagtctgaaatggcggacctacagcaggagcaccagcgcgaaatcgagggacttctggaaaacatacgccaactcagtagagagctcaggctgcagatgctaatcatcgacaactttattccccgagactaccaagagatgatagaaaattacgtgcattggaacgaggacatcggagagtggcaactgaaatgtgttgcatacacagggaataatatgaggaagcaaacaccagtgccagacaaaaaggagaaagatccatttgaggtggatcttagtcatgtttatctcgcttataccgaagaatcactgaggcaaagcctaatgaaactggaaaggccccgcacatccaaagggaaagcaagaccaaagacaggccgccgaaaaaggtccgccaagcctgagaccgtgatcgatagtcttctacagtag

SEQ ID NO: 2865 - DNA, 1035 bp, Artificial Sequence
  Description of Artificial Sequence: Synthetic coding sequence
atggtgtctgttaatagctcacactgtttctacaatgactccttcaagtacacattgtacggctgcatgtttagtatggtgttcgtgctgggcctcatttctaattgtgtcgctatttatatcttcatctgcgtgttgaaggtgcgcaacgaaaccacgacctatatgattaacctcgcaatgtctgatctgctgttcgtttttacgctcccgttcagaatattttatttcaccacccgcaattggccatttggcgatctcctgtgtaagatctccgtcatgctgttctacaccaatatgtacggctctatcttattcctgacttgcatctccgttgacagattcctggctattgtctatcctttcaagagcaaaaccctgaggactaagaggaatgctaagattgtgtgtacgggagtttggctaacagtcattgggggatctgcccccgcagtgtttgtccagtcaacccactcccagggcaataatgcatctgaagcttgtttcgagaacttcccggaggcaacttggaagacttacttatctaggattgtgatcttcattgaaatcgtcggcttcttcatccccttgattcttaacgtaacctgcagctccatggtactaaaaaccctcactaagcccgttaccctttctcgaagtaagattaacaaaaccaaagtactgaagatgattttcgtccacctgattattttttgcttctgttttgtgccatataacattaatttgatcctgtactccttggtgcggacccagacctttgtgaattgctcggttgtggctgccgtgaggacaatgtatcctataacgctgtgtattgctgtgtccaactgttgctttgaccctattgtgtactacttcactagtgataccatccaaaattccattaaaatgaaaaattggtccgtgaggaggagtgactttagattcagcgaggtccatggcgcagaaaatttcattcagcataacctgcaaaccttgaagtcaaagatcttcgacaatgagtccgccgcctag

SEQ ID NO: 2866 - DNA, 1035 bp, Artificial Sequence
  Description of Artificial Sequence: Synthetic coding sequence
atggttagtgtgaacagctctcactgcttttacaacgactccttcaagtacacactttacggctgtatgtttagtatggtatttgtcctcggtctgatatccaattgcgtggccatatatatttttatttgtgtcctgaaggtcaggaatgaaactacaacgtacatgattaaccttgcaatgagcgatctgctctttgtgtttacccttcccttccgcattttctattttacaacgagaaactggccatttggtgacctgctctgtaaaattagcgtcatgctcttttatacaaacatgtatggatcaatactgttcttaacctgtataagtgtggatcggtttctcgctattgtttatcctttcaaaagcaaaacactcaggactaagaggaacgcgaagattgtctgtacgggcgtctggctgactgtgataggggggagtgctcccgcagtgtttgtccagagtactcattcacagggcaacaatgcttctgaggcttgtttcgagaattttcccgaggcaacctggaaaacatacttgtcacggattgtcatattcattgagatagtggggttttttattccgctgatccttaatgtcacctgcagctctatggttttgaaaacacttaccaaaccggtgactctgagtcggtccaaaatcaacaagacaaaggtgctaaagatgatctttgtgcatctgatcattttttgtttctgtttcgtgccctacaacatcaacctgattctgtactccttggtgcgaacccagaccttcgtgaactgtagtgtggtcgcagccgtgcgaaccatgtaccccataaccctttgcattgcggtctccaattgttgcttcgatccgatagtgtattactttacttctgacacgatccaaaattccattaaaatgaagaattggtcagtgcgtagatctgattttaggttcagtgaagtccatggggccgaaaactttatccagcacaacctgcagactctgaagtctaagattttcgataacgaaagtgccgcctag

SEQ ID NO: 2867 - DNA, 795 bp, Artificial Sequence
  Description of Artificial Sequence: Synthetic coding sequence
atgctgcggggcccctgggctttccattataacgtgagttcccatggctgtcaacttcttccctggacccagcacagcccacacacgaggctgaggcggtcaggcagatgtgatttgttccaaaagaaagactacgtgaggacctgtatcatgaacaacggggtgggttacagaggaacgatggccaccacagttggcggcttgccttgccaggcctggtctcataagttccccaacgaccacaaatacaccccaactctgcgaaacgggctggaggaaaacttttgccgaaatccggacggcgatcccggcggaccctggtgttacactaccgacccagctgtgcgcttccaatcatgcggaatcaagtcatgcagggaagccgcctgtgtgtggtgcaatggggaagagtatcggggcgccgtggacaggaccgagagtgggcgcgagtgccaaaggtgggatttacaacatccacaccagcatccctttgaacccgggaagtttctcgaccagggcttagacgataactattgcaggaaccctgacgggtctgagaggccttggtgctacacaaccgatcctcagatagaaagggaattttgcgacctgcctaggtgcggaagtgaagctcagcctcgccaggaagcaaccaccgtgtcttgttttagaggcaagggagagggataccgaggaacggctaataccaccactgcgggtgtcccttgtcagcggtgggatgcccagatccctcatcagcacagattcacccccgaaaaatacgcttgcaagtag

SEQ ID NO: 2868 - DNA, 2178 bp, Artificial Sequence
  Description of Artificial Sequence: Synthetic coding sequence
atggggctgtggtgggtaactgtgcagccacccgctcgtagaatggggtggctgccccttctacttctgctaacccaatgtctcggagtgccgggccagcggagccccttgaatgacttccaggtgcttcgcggaacagaattgcagcacctgctccacgcggtagttcccggaccttggcaagaggacgtggccgatgcagaggagtgcgccggtaggtgcggcccactgatggattgtcgggcctttcattacaacgtctcgagtcacggatgtcagctactgccttggacccaacactcaccccatacacgtctgagaaggtcgggaagatgtgacctgttccaaaaaaaggactacgtccggacctgtattatgaataacggtgtgggttatcgaggtaccatggccaccactgtcggaggcctgccttgccaggcgtggtctcataagttcccaaacgatcataagtatacacctaccttgagaaacggactcgaagaaaatttctgtcggaatccagacggagatcctggagggccctggtgttacacaactgaccccgcggtgagatttcaaagttgtggtattaagagttgtagagaagccgcgtgcgtgtggtgcaatggagaagaatacaggggtgccgtggaccgcaccgagagcgggagggaatgtcagcgttgggatctccagcatccacaccagcacccatttgaaccaggcaagtttcttgaccaaggactcgatgacaactattgccggaacccggatggcagcgagcggccatggtgctacaccaccgacccccagatcgagcgagagttctgcgatctgccacgatgcggctctgaggcacagccaaggcaagaagcaacaacggtgtcctgctttagaggaaagggagaaggctaccgcggaactgccaataccacaacggcaggggtaccatgccagaggtgggatgcacagatacctcaccagcacaggttcactcccgaaaagtacgcctgtaaggaccttcgcgagaatttctgccggaacccagatggctcggaagctccctggtgtttcacactaagacccgggatgagagcagctttctgctatcaaatccgacgctgcacagatgatgtgcggcctcaggattgctatcacggggccggggagcaatacagggggacagtgagcaagaccagaaagggtgtacaatgtcagcggtggtcagcagagacgccacacaagccccagtttacatttaccagtgaaccacacgctcaactggaggagaatttttgtcgaaacccagacggggattcccacgggccatggtgttacactatggatccacgtacgcccttcgactattgcgctcttagacgctgcgccgatgatcagccacccagcatcctggacccgccagatcaggttcagttcgagaagtgtggcaaaagggtggacagactcgaccagcgaaggtcaaagcttagagtcgtgggaggtcaccctggtaatagtccatggacagtttcactgaggaatcggcagggccagcacttctgtggaggatcactggtcaaagaacagtggatattgacagcacggcagtgttttagtagctgccacatgcctttgacaggttacgaggtgtggctggggaccctgtttcagaacccacagcacggcgagccttccttacagcgcgttccggtggccaagatggtctgtggaccttcggggtctcagctggtcctcctgaagctggaaagaagcgtgacgttaaatcagcgggttgccctcatctgtctgcctcctgagtggtacgttgtgcctcccggtacaaaatgcgagatagccggctggggagagactaagggtaccggcaacgacaccgtgttgaacgtggccctattgaacgttatttctaatcaggagtgcaacattaaacatagaggcagggtgcgggagtctgagatgtgcacagaaggcctgctggctccggtgggagcgtgtgaaggggactatggtggcccactcgcctgctttactcacaattgctgggtgctagaaggcattatcatccctaacagggtatgcgccagatcacggtggccggcagtattcacgagagtctcagttttcgtggattggattcacaaagtcatgcgcctcgggtag

SEQ ID NO: 2869 - DNA, 495 bp, Artificial Sequence
  Description of Artificial Sequence: Synthetic coding sequence
atgggttggcttccccttctgctgctcctgactcagtgcctgggcgtgcccgggcaaaggtctcctctaaacgatttccaggtgctgcgcgggacagagctgcagcaccttctccacgccgtcgtgcccggaccctggcaagaggacgtggccgacgctgaggagtgtgctggaagatgcgggcctctgatggattgccgcgcctttcattacaacgtgagcagtcatggctgtcagctgttgccttggacccagcacagtcctcatactcgcctgaggcgaagcggcaggtgcgacttgtttcagaaaaagggaacccgtccgctgtccggcatggcatggaaaagaacctcggccgtaaccctaatggcgactcccgaggtcctaggtgcgactcagcagactttattatgcgcttcaagggccgctgcttctaaccctgccgggcgtcctagagtgtccggggcaatggctcgcaacacggcagcccgctag

SEQ ID NO: 2870 - DNA, 2070 bp, Artificial Sequence
  Description of Artificial Sequence: Synthetic coding sequence
atggcccccgcccctgtcactctattagcacctggggccgcctcaagcatgagctgttcacagcccggacagcggtctcctagcaatgattttcaggtgctgcgtgggacagagcttcagcatttgctacacgctgtagtgcctgggccctggcaggaggatgttgccgacgcagaagaatgtgcaggccgttgcggccccctgatggactgttgggccttccactataatgtgtcttcacacggatgtcagcttctgccttggactcagcactctccccacagcagactctggcactcaggacgctgcgacctgttccaggaaaaaggcgaatggggttatatgccaacgctgaggaatgggctagaagagaatttctgccgaaatcccgacggcgacccaggggggccgtggtgccatacaacagatcctgcagttcggtttcagagctgcagcattaaaagctgtagggtcgccgcctgcgtgtggtgcaacggcgaggagtacaggggagccgttgatcggactgagtccgggcgagagtgccagagatgggatctgcagcacccccaccagcaccctttcgagcctgggaagttcctggaccaaggattggatgacaactactgcaggaacccagacggcagcgagcgcccctggtgctacacgacagacccacagatcgaaagagaattttgtgacttaccgcggtgcggatctgaggcacagcctcggcaggaggccacttcagtgtcctgttttaggggaaagggtgagggatacagagggaccgccaatacaaccaccgccgcttatttggcgagcgtgggcactcgaaagtcccatatttctactgatttgcggcagaagaacactcgcgccagcgaagtggggggcggcgcgggcgttggcacttgttgctgtggagatttacgagagaatttttgctggaacctagacggcagtgaggccccctggtgctttaccctcaggcctggcactagggtcgggttctgctatcagatcagacggtgtaccgacgatgttcgcccacaagactgctatcacggggccggggagcagtaccgcggaacagtgagcaagacccgtaaaggcgtgcagtgccagcggtggtctgccgaaactccgcataaactgcaagcactgaccctgggcagacacgctctgatgagcggaacccgagcctggaagtggctcagactcccctgccacgacttcgctcccgcccctgcctccgtccacatttatctcagaactgcttgtactaccggcggcgaactgttgccggacccagatggggattcacacggaccctggtgttacacaatggaccctagaacacctttcgactactgtgccctgcgcagatgcgatcaggtgcagtttgaaaagtgcggaaagagagtcgaccgactagatcagaggaggagtaagctcagggtagcgggtggccaccccgggaatagtccctggaccgtgtctctcaggaaccgacacatgcccttgaccgggtatgaggtttggctgggcaccctctttcagaatccccagcacggggagccgggcctgcaacgcgtaccagtagcaaagatgttatgcggtccgagcggtagtcagctggtactactcaagcttgagagatccgttacgttgaatcagagagtggccttaatttgtctgccccccgaatggtacgtcgtaccacctgggaccaagtgtgaaatcgcaggctggggggagactaaaggcactggaaatgacacagtcctgaatgtggcgttgctgaatgtgatatctaaccaagaatgtaatatcaagcataggggacacgttagggagagtgagatgtgtacggaggggctactggctcctgtgggggcctgcgagggggattatgggggcccgcttgcatgttttacacacaactgctgggtattgaagggcattcgcattccaaatagggtctgtactcgatccaggtggcccgccgtgtttaccagagtctccgttttcgttgactggattcacaaagtgatgcggttgggatag

SEQ ID NO: 2871 - DNA, 1698 bp, Artificial Sequence
  Description of Artificial Sequence: Synthetic coding sequence
atgacctctcgctgctcaggggcacagtcctaccttctccacgccgtggtgccaggtccatggcaggaggacgtagccgatgcagaggagtgcgccggtagatgtggaccactaatggactgttgggccttccactacaacgtgtcatctcacggttgccaactgcttccttggactcagcactctccccattctaggctgtggcattcgggtcgttgtgatctctttcaggaaaaggactatatcaggacctgtattatgaacaacggggtaggatataggggcaccatggccacaactgtgggcggcctctcatgccaggcctggagccacaagttccccaacgatcacaaatacatgccaactctgcgcaatggactggaggaaaacttttgtcgcaatcctgacggagaccccggcggcccctggtgccataccacagacccagccgtgcgttttcagtcttgtagtattaagtcgtgcagagtggcagcctgcgtctggtgcaatggcgaggaatatcgcggcgccgttgacaggactgagtcaggcagggaatgtcagagatgggacttacagcatccccaccagcacccttttgaacctggaaagttcctggatcaggggcttgacgataattattgtcgtaaccctgacggctccgaacggccttggtgttatactaccgaccctcagatcgaaagagaattttgcgacctgccccgatgtgggtccgaggctcagccgcgccaggaggctacatctgtcagctgtttcaggggcaagggagagggataccgggggaccgctaataccacgacaggggtgccttgccagagatgggatgctcagattccccatcagcaccgattcacgcctgagaagtacgcctgcaaggatctccgcgagaatttttgctggaatctcgatggttctgaagcaccctggtgttttacactacggcccggaacccgggttggcttctgctatcagatccgcaggtgcactgacgacgtacgaccccaagactgctatcatggggcaggcgagcaatacagaggtacagtgtccaagacccggaagggagtgcagtgccaacgctggagtgctgagacccctcacaagctccaatttaccttcaccagcgagccacatgcccagctcgaggagaacttttgccagcccgatggagattctcatgggccttggtgctataccatggacccacggacccctttcgactattgtgctttgagacggtgcgccgatgaccagcctccgtctatcctggacccacccaaccaggtccaattcgagaagtgcggaaaaagggttgacaggttagatcaaagacgaagcaaattacgcgttgctgggggccaccccgggaactcgccatggactgtgtctttgaggaaccgccaaggacagcatttctgtgctggctccttggtgaaagaacagtggattctcacagcacggcagtgtttctcttcctgccatatgcctctcactggctacgaggtgtggcttggaacactctttcagaacccacagcacggggaaccgggcctgcaaagggtcccagtagccaagatgctctgtggaccgtcgggatctcagctcgtcttgcttaaactcgaaagatctgtcactttaaatcagcgggtagccctgatttgtttgcctcccgaatag

SEQ ID NO: 2872 - DNA, 2148 bp, Artificial Sequence
  Description of Artificial Sequence: Synthetic coding sequence
atggcacccgctcctgtcactctgttggcacccggtgccgcctccagcatgagctgcagtcagccgggccagcggtctccttccaatgattttcaggtcctcaggggcacagaattgcaacatctgttgcacgcggtggtgcctggcccatggcaagaggacgttgcggacgctgaggaatgtgcaggaagatgtggccccctgatggattgttgggcctttcattacaatgtttcatcccatgggtgccagttgttgccctggactcaacattcgcctcactcaagactttggcacagcgggcgctgcgacctctttcaagagaagggcgaatggggttatatgcccactctccggaacgggctcgaagaaaatttttgtcgcaacccagatggagacccgggtggaccatggtgtcacaccacggatccagctgtgcgcttccagagctgtagtataaagagctgccgggttgccgcctgcgtgtggtgtaacggtgaggaatatcgcggcgctgtggaccgtacggaaagtggcagagagtgtcaaagatgggacctacaacatccacatcagcacccgttcgagcccggcaagtttttagaccaaggtctggacgacaattattgtagaaatccggatgggtccgaaagaccttggtgctacacaactgatccccaaattgaacgcgaattctgcgatctccctcggtgcggcagtgaggcacagcctcggcaggaggctaccagcgtaagttgtttcaggggaaaaggtgaagggtacaggggcactgctaataccacaacagccgcttacctagcgtcggtgggaaccaggaaaagccacatatcaactgaccttcgccagaaaaacacgcgggcgtccgaagtcggtggcggcgcgggcgtgggcacatgctgctgcggagacttacgggaaaacttctgctggaacctggacgggtccgaagcgccctggtgcttcaccctccggcctggcaccagggtgggcttttgttatcaaattcggcgatgcacagatgacgtgcggccccaggattgttaccatggggctggcgaacagtaccgcggtaccgtgagcaaaacgcgtaagggtgtgcaatgccaaagatggtccgcagagaccccgcacaaattacaggccctcactctcggaaggcatgcacttatgtccggcactcgggcatggaagtggctccgcctgccctgtcacgacttcgcacccgcacctgcgtccgtgcacatatatctgaggacagcttgcacgaccggtggggagttgctgcctgacccagacggggattcacacgggccatggtgctatacaatggaccctcggacccccttcgactactgtgcactccgacgctgtgaccaggtccagtttgagaagtgtggaaagagggtggaccgtctcgaccagcgcagatcgaagctgcgggtggcaggcggacaccctggaaattccccatggaccgtgtccctcaggaatagacaggggcaacatttttgtgccggcagtttagtgaaagaacaatggattctgactgcaagacagtgtttctcttcctgccacatgcccctgacgggttacgaagtctggctgggaaccctgttccagaatcctcagcatggcgagccaggtttacagcgagtgccagttgccaagatgctgtgcgggcccagcggcagccaactagttctgctcaagcttgagaggtctgtcaccttgaaccagcgtgtggcactgatatgtcttccaccagagtggtatgtcgtcccacccggaaccaagtgcgagatcgccggttggggagaaaccaaagggaccggaaatgatactgtgctgaacgtcgccctgctgaacgtcatctcgaaccaagagtgcaatattaaacaccgaggtcatgtcagggaaagtgaaatgtgcacagaagggttactcgccccggtcggtgcatgtgagggagactatggtggccctctcgcctgctttactcacaactgttgggtattgaaaggcatcaggattccaaaccgtgtgtgcactaggtctaggtggcctgctgtgttcacccgggtcagcgtctttgtggattggatccacaaggtcatgcgactgggatag

SEQ ID NO: 2873 - DNA, 1101 bp, Artificial Sequence
  Description of Artificial Sequence: Synthetic coding sequence
atgcgagtgatggccccgagggcactgcttttacttctgagcggcggactagctcttacagaaacctgggcatgctctcacagcatgagatattttgacacggccgtgtctaggccggggagaggagaacctagattcatctccgttggatacgtcgacgacacacaattcgtacgattcgattcagatgccgcttctccaaggggagagcctagagccccgtgggttgagcaggaaggcccggagtactgggaccgggagacgcaaaagtataagaggcaggcccaagcagaccgagtgtccctacgtaatcttcgaggttattataatcagtcagaggatggtagtcatacattgcagagaatgagtggctgcgacctaggacccgacggacgtctgctgaggggatacgaccagagtgcttacgatggaaaggattacatagctttgaacgaggaccttcggtcttggacggctgctgacactgccgctcaaattactcagagaaaactcgaagccgcgcgtgccgcagagcagctgagggcctacctggagggcacctgcgtggagtggctgcgaaggtacctggagaacggaaaagagacactccaacgtgcagaaccaccgaaaacccatgtgacacatcacccgctgtcagatcacgaagctacactgcggtgctgggccctgggcttctaccccgccgaaatcacccttacctggcagcgcgacggagaagatcagacccaagacaccgaactggttgagacccgccctgccggagatggcacgttccagaagtgggcagcggttgtcgtgccttccggccaggaacagcggtatacctgtcatatgcagcacgaaggtcttcaggaacctctcacactgagttgggaaccaagctcacagccaacaattcctatcatgggaatcgttgcaggccttgctgtcctcgtcgtactggccgtcctcggcgctgtggtcaccgccatgatgtgtagaagaaagagctcaggcgggaagggcggtagttgctcccaggctgcctgctcaaacagcgctcaaggttctgatgagagtctgattacgtgtaaagcttag

SEQ ID NO: 2874 - DNA, 396 bp, Artificial Sequence
  Description of Artificial Sequence: Synthetic coding sequence
atgagagtgatggcccctcgcgctctgttacttctgttgtccggtgggctcgcactaactgagacatgggcctgttcacactccatgagatacttcgatacagccgtttccagacctgggcgcggtgaaccacgttttattagcgtgggatacgtggatgacacgcagtttgtgcgattcgactcggacgcagcaagtcccagaggggagccgagagcaccgtgggtggaacaggagggacctgaatactgggaccgagagacccagaaatacaagcgccaggctcaggctgaccgggtcagcctgaggaacctgaggggctattacaaccaatctgaggacgaggacgtttggttgcgacccggagccagaagagctccaccgcccagggtgtag

SEQ ID NO: 2875 - DNA, 1119 bp, Artificial Sequence
  Description of Artificial Sequence: Synthetic coding sequence
atgagggtgatggctccgcgaactctcatcctcctgctctccggtgccctcgcgctgactgagacctgggcttgctcacactcgatgcgatacttttacacagctgtttccaggcctggacgcggggaaccccgcttcatagccgtgggatacgtggacgacactcagtttgttcagttcgactcagatgccgcgagcccaagaggagaaccacgggccccctgggtggagcaggaggggcccgagtactgggacagagagactcagaagtataaacgccaggcccaaacagatcgtgtgaatttgcggaaattgaggggctattacaaccaatctgaagcgggtagtcatacgcttcagcgaatgtacgggtgtgacttaggtcctgacggtaggctactccgaggatataaccaattcgcctacgacggcaaggactatattgcactgaatgaggatctccgatcatggactgccgccgataaagccgcccagatcacacagcgtaaatgggaggctgcccgagaggcagagcaaagacgtgcctacctggaaggcacatgtgtggagtggctcaggagatacctggaaaatgggaaaaaaacgcttcagcgcgccgagcaccctaagacacacgttacacatcaccctgtatctgatcacgaagcgaccctgcgctgctgggcactgggtttttaccctgccgaaattactctgacttggcagagagacggagaagatcagacacaggacaccgagctggtagaaacccgtcccgccggggatggtacattccagaagtgggctgcagttgttgttccttcaggagaagagcaacggtacacgtgtcatgtccagcacgaaggtcttcccgaaccactgaccctacgctgggggcctagcagccaaccaaccattcccatcgtggggatagtcgccggattagccgtcctggccgtccttgctgtcctgggcgccgtcatggccgtcgtgatgtgtcgaaggaaatcatccggacatttcctgccaactggggggaaaggcgggtcttgtagccaagcggcgagttcgaatagcgcacagggtagtgacgagagccttatcgcctgcaaagcctag

SEQ ID NO: 2876 - DNA, 1119 bp, Artificial Sequence
  Description of Artificial Sequence: Synthetic coding sequence
atgcgggtgatggcccctagggctttattgttattattgtccgggggtcttgccctgaccgagacatgggcttgctctcacagtatgcgatatttcgataccgcagtctcccggcctggcagaggcgaacctcgcttcatcagtgtcggctacgtggacgatacacaattcgtgcgatttgatagcgatgcggccagtccccgtggagagccccgcgccccctgggtggagcaggagggccccgagtactgggacagggagacccagaaatataagagacaggcacaggctgatagggtaagtcttagaaacttgagaggctattataaccagtctgaagatggatcccatacgctgcagagaatgagcggatgcgatcttggccccgatgggcggctgttgagagggtatgatcaatccgcatatgacggcaaggattacatcgctctcaatgaggatctgcggtcatggactgccgctgatacagctgctcaaataacacagaggaaacttgaggccgcaagagcagccgaacagctgcgggcctacctagagggtacttgtgttgaatggcttcgacgttatttagaaaacggcaaggagaccctacagagagccgaaccacccaagacacatgtcacccatcaccctctctcggaccatgaagcgaccctgaggtgctgggctctggggttctatcctgcggaaataactctgacgtggcaaagggacggtgaagatcagacccaggacacagagcttgttgaaacaaggcccgccggggacgggactttccaaaagtgggcggctgtcgtggtgccctctgggcaagaacaacgctacacatgtcatatgcagcatgaagggctccaggagccccttaccttgtcgtgggaaccaagctcgcagccaaccatcccaattatgggtatcgttgctggactcgcagtgctcgtagtgctggctgttctgggtgctgtggtaacagctatgatgtgtcggcggaagtctagtgggcacttcctacccaccgggggtaagggcggcagctgctcccaggcagcttgcagcaactcggcccaggggagcgatgagagcctgataacctgcaaggcatag

SEQ ID NO: 2877 - DNA, 1194 bp, Artificial Sequence
  Description of Artificial Sequence: Synthetic coding sequence
atgcgcgtgatggctcccagaacactcattctacttttgagtggcgcgctggcgcttacagagacctgggcatgcagtcactcaatgcggtatttttatacagcagtgtcccgacccgggagaggagagccccgcttcattgccgtgggatatgtggacgatacccagttcgttcaatttgacagtgacgccgcctcaccccggggcgagcccagagccccttgggtggagcaggaaggcccggaatactgggacagagagactcagaagtataagcggcaagctcagactgacagggtcaatttaaggaaattgaggggctactacaatcagagcgaggccgggtcacacaccttgcagagaatgtacggatgtgatctaggacctgacggacggctactgagaggctataatcaattcgcgtacgatggaaaagactatattgccctgaatgaagatctgagatcctggactgctgccgataaggcagcccagatcactcagcggaaatgggaagcggcgcgcgaggccgaacagcgtcgcgcatacttagaaggaacttgtgtggagtggctgaggagataccttgaaaacgggaagaagaccctacagagggccgaacacccgaaaacccacgtgactcaccacccggtaagtgatcatgaggcaacgcttcgatgttgggccttgggattttatcccgccgagattacgctgacctggcagagagatggcgaggaccagacacaggacaccgaacttgtggagactagacccgcaggtgacggaacattccaaaagtgggccgcagtggtggtcccctctggcgaggagcagcgctacacttgtcacgtgcagcacgaaggattgcccgagccacttaccctcaggtggggaccctccagtcagcccactattcccattgtagggatcgtagcgggcctggctgtcctcgccgtattggccgtgttgggggctgttatggctgtggtgatgtgtcgccgaaagtcctccgggcgtgagggcgttcggagtggggtgtggcccgcaacagtcccacgcgcccttatgtcactgtctagtctggtgaagcccgagactgccgcatgcgtggggctccgatgtcggatttctagccacctgagttttgtgacatctagggcctctggtatctctttttgtaagggaatttag

SEQ ID NO: 2878 - DNA, 1119 bp, Artificial Sequence
  Description of Artificial Sequence: Synthetic coding sequence
atgagggtgatggctccgaggacactaatcctgctcttgtctggagccctggccctgaccgagacctgggcctgttcccacagcatgagatacttttacacagctgtcagtcgccccggacgcggtgagcctaggttcattgccgtcgggtatgttgacgatacgcaatttgttcagttcgatagcgacgccgcctcaccccgcggagagcccagagctccctgggtagagcaggagggccctgagtactgggatagagagacccagaagtacaaacggcaggcccagacagaccgcgtgaatttgcgcaaactgaggggctactataaccagtccgaagccgggtctcacacgctccagcgcatgtacggatgcgacctcgggccagacggtcgcctcttgcgcggatataaccaatttgcctacgacggaaaagactacatcgcccttaacgaagatttgcgctcgtggaccgctgccgacaaagccgcccagatcacacaaagaaaatgggaagctgctcgcgaagcggaacagaggagggcctacctggaggggacatgtgtcgagtggctgcggagatatctggaaaacggcaagaaaactttacaaagagccgaacatcccaaaactcatgtgacacaccaccccgttagcgatcatgaagccactttgcggtgctgggctctgggcttctaccctgctgagattaccctcacttggcaacgggacggggaagaccagactcaagatacagagctcgttgagaccagacccgccggggatggtacctttcagaagtgggccgcggtggtcgtgcctagcggcgaggaacaaaggtacacatgtcacgtgcagcacgagggcctgccagaacctctcactttgagatggggtccatcatctcagccgaccattcccattgttgggatcgttgcaggcctcgctgtcctggcggtgttggctgtgctgggggccgtgatggcagttgtgatgtgccgcagaaagtccagtggccactttctgcccacaggtggtaagggggggtcctgctctcaggcagcctccagcaactccgcacagggatcggatgaaagtctcattgcttgtaaagcatag

SEQ ID NO: 2879 - DNA, 1194 bp, Artificial Sequence
  Description of Artificial Sequence: Synthetic coding sequence
atgagggtcatggctccgcgcgctttgcttctcctgctttccggcggcctggctttgaccgagacctgggcctgcagccattccatgcggtatttcgacaccgccgtgtccagacccggccgaggagagccgcgttttatctccgtcggctatgtcgacgatacccagttcgtgcggttcgatagtgatgccgctagtcctaggggagagccaagagccccatgggtagagcaggagggaccggaatattgggatagagaaacccaaaagtataagagacaggcacaggctgaccgtgtcagtctacggaatctgcgtggctattacaatcaatctgaagacggatcacacaccctccagaggatgtcgggctgtgaccttggccctgacgggcgcctgttgcgcggctacgaccagtctgcttatgacggaaaggattacatcgctctcaacgaagatctgcgaagctggacagctgctgacaccgccgctcagattacacagcgaaaactcgaagccgcgcgcgccgcggaacagcttcgcgcctatctggaggggacgtgcgtcgaatggttgcgcagatatctggaaaacggaaaggagacactgcagcgagcagagccacccaaaacccatgtgacacaccaccccctgagtgatcatgaagcaacactgaggtgttgggcgctgggcttttatccggctgagattacactcacttggcagcgagacggtgaagatcaaactcaagacaccgagctggtggagacccgtcctgcgggcgacgggacgtttcaaaagtgggcggctgtggtggtcccgtccggccaagaacagcggtatacttgccacatgcaacacgagggcctgcaggaacccctgacactgagctgggagccgtcttcacagcccactatccctattatggggattgtggcaggcttggcggtgctagtggtgctggccgttctgggggcggtggtcactgccatgatgtgcagaagaaaatcgtcaggcagggaaggggtgaaatctggcgtgtgggctgccacagttccacgagctctgatgagcctaagttctctggtcaaaccagagacggccgcatgcgtaggactgcggtgccggattagtagccatttaagtttcgtcacctcacgggcctctggcataagtttttgcaaagggacatag

SEQ ID NO: 2880 - DNA, 1101 bp, Artificial Sequence
  Description of Artificial Sequence: Synthetic coding sequence
atgcgagtgatggcccctcggacgttgatactgctgctttctggcgccctcgcactcaccgaaacatgggcctgtagccactctatgcggtacttctacaccgccgtttctcgcccgggtcgcggtgaacctagatttattgctgtgggttacgtggacgatacgcagttcgtccagtttgactccgacgctgcctccccgcggggcgagcctcgcgctccgtgggtggaacaggaaggaccagagtactgggaccgcgagactcaaaagtataaacggcaggcccagaccgaccgcgtgaacctccgaaagctgagagggtattacaaccagagcgaggcgggcagccatacactacagcggatgtacggctgtgatcttggccccgatgggaggttactcaggggatacaaccagttcgcatacgatggtaaggattacattgccctgaacgaggatctcagatcctggactgccgcagataaggctgcacagattacacaacgaaagtgggaagctgcgagggaagcggagcagcgacgtgcctatttggaagggacttgcgtggaatggctccgccgctatttggagaatggaaaaaaaactctccagagagctgagcaccccaagacccacgtcacgcatcatcctgtctcagaccacgaagcgactctccgctgctgggccttgggattttaccccgctgagataacgctgacttggcagagggacggcgaagatcagacccaggacactgaactcgtggagactcgaccagctggtgatgggacattccaaaagtgggcagcagtcgtggtgccttcaggagaagagcagcgctacacctgtcacgttcagcatgaaggactgcccgagcccctcactttacggtggggtccatccagccagccaaccatccctatcgtgggcattgttgccggtctcgctgtattggccgtgctggctgtgctgggagccgtgatggccgtcgttatgtgccgccgcaaatctagtggggggaagggcggtagttgctcacaagctgcgagctctaactccgcacaaggcagcgatgagtcgctgattgcgtgtaaagcgtag

SEQ ID NO: 2881 - DNA, 1101 bp, Artificial Sequence
  Description of Artificial Sequence: Synthetic coding sequence
atgagagtgatggctccccgaacactgatactactcctgtctggggccctcgccctgactgagacttgggcttgctcacacagcatgcgttatttctacacagccgttagtagacctggacgtggggaaccaaggttcattgccgttgggtacgtcgacgatacgcaattcgtccagtttgattccgacgcggcaagcccccggggcgaaccacgcgccccttgggttgagcaggaagggccggaatattgggaccgagaaacacagaaatataaacgccaggcacaaaccgatcgcgtgaacttacggaagctgaggggatactacaaccaatccgaagctgggtctcacactctgcagcgcatgtatggctgcgatctgggccctgatggccgactcctgaggggctacaatcagtttgcctacgacggaaaggactatatcgctttgaacgaggatctaaggagttggacggccgcagacaaagcggcacaaatcactcagaggaaatgggaggcagccagagaagcggagcaacggagggcatatttggagggcacgtgcgtggagtggctcaggcggtatctggaaaacggaaaaaaaaccctgcagcgcgcagagcaccccaagactcacgtgacgcaccacccagtgtctgaccatgaagctacgcttaggtgttgggcattaggtttttatcccgccgagattaccctgacctggcaacgtgacggcgaggatcagacacaggacacagagctggtcgaaacgcgccccgcaggagatggcacgtttcagaaatgggcggccgtggtggtgcccagcggggaagagcagagatacacgtgtcacgttcaacatgaaggtctccctgaacctctcacactgcggtggggaccgagttcgcagcctaccattcctattgttggtatagtcgccggtctggcagttcttgccgtgctcgctgttttgggagcagtaatggccgtggtgatgtgccgtagaaagtcatccggcggcaaaggaggaagctgctcccaggcagcgagttccaattccgcccaagggtccgatgagtcgctgatagcctgtaaggcttag

SEQ ID NO: 2882 - DNA, 1194 bp, Artificial Sequence
  Description of Artificial Sequence: Synthetic coding sequence
atgcgcgtcatggctcctaggactctgatactgctgctgagtggcgcattggcccttacagaaacctgggcgtgctcccattctatgcgttacttttataccgccgtgtcccgacctgggcgcggagagccgaggttcatcgcggtggggtacgtggatgacactcagtttgtgcagttcgatagtgacgccgcgtccccaagaggagagcccagggcaccctgggtggagcaggaagggccagagtactgggacagggaaacccaaaagtataagcggcaggcccagaccgaccgggtgaacttaagaaaattgcgggggtattacaatcagagcgaagcagggtcccacacactgcagcgtatgtacggctgcgatctgggacctgatggacggctactgagaggatataaccaattcgcctacgacgggaaggattacatcgcccttaatgaggatctgaggagctggactgccgctgacaaagctgcccagattacccagcggaaatgggaagctgctagagaagccgaacagcggagagcttacctagaaggcacctgtgtcgagtggctgcggaggtatctggagaatggcaagaagactcttcagagggccgagcatcctaagactcacgtgacacaccatcccgtgtctgatcacgaagctacgttgaggtgttgggccctggggttctatcccgcagaaataacgctgacatggcaaagggatggagaggaccagactcaggatacagaactggtggaaaccagacccgccggggacggcacctttcaaaaatgggccgctgtggtggttccaagcggggaggagcagcgctacacatgtcatgtacagcatgagggcctgcctgaaccgttgactttgcggtgggggccatcctcccagccaacgatccctattgtggggatcgtggccggcctagccgtgcttgcagtgttagccgtgctgggggctgtaatggccgttgtgatgtgtcgacggaagtctagtggccgagaaggagtaaggagcggtgtgtggccagccaccgtcccacgggccctgatgtccctttcctctttagtcaaaccagagaccgcagcatgtgtaggactaagatgtcggatctcctctcatttgagttttgtgacctccagagcatcaggcatctcattttgcaagggaatctag

SEQ ID NO: 2883 - DNA, 1194 bp, Artificial Sequence
  Description of Artificial Sequence: Synthetic coding sequence
atgcgggtgatggcccccaggactttgatcctgttgctgtccggtgccctggccctaactgaaacatgggcttgtagtcacagtatgaggtatttttacacagccgtttctaggcccggcagaggcgaacctcggtttatagctgtgggctacgtggacgacactcagttcgtccgatttgatagtgacgctgcttccccgcggggcgagcccagggctccctgggtcgaacaggagggccccgaatactgggatcgcgagacccagaaatataaaaggcaggcacagacagaccgggtgtcacttagaaatctgagaggatattacaatcaatctgaagcaggctcccatacgcttcagtggatgtatgggtgcgacctaggtcccgacggccggctactgagaggctacgatcagagcgcctatgatggaaaagactacatcgcactgaacgaggacctcaggtcgtggacagcagcggacaccgcagcacagatcactcagcgcaagtgggaggccgccagggcggccgaacagcaacgagcctatctggaaggaacgtgcgtggagtggctgcggcgatacttagaaaacggtaaggaaaccttacaaagagccgaacatcccaaaactcacgtgacgcaccacctagtctcagaccacgaggccacactgcggtgctgggcattgggtttctatcctgctgagatcactcttacatggcagcgagacggcgaggatcagactcaggataccgaactcgttgagactcggcccgcgggagacggaacatttcagaaatgggctgccgtggtggtcccttccggggaggagcagaggtacacatgccatgtgcagcatgagggactgcccgaacctcttacgctgcgctgggagcccagctctcaaccgacaatccctattgtgggcatcgtggccggacttgccgtgctggctgttctggccgtgctgggagctgtggtcgccgttgtcatgtgccgtaggaaatctagcggaagagagggggtgcggagcggcgtttggccagcgacagtgcccagagccctcatgagcctgagttcactcgtgaagcctgagactgccgcatgcgtagggttacgctgccgaatctccagccatctgtcttttgtcacaagtagggcttccggaattagcttttgtaagggtatatag

SEQ ID NO: 2884 - DNA, 786 bp, Artificial Sequence
  Description of Artificial Sequence: Synthetic coding sequence
tgacgtgtgatggctcctcgagccctgcttcttctcctaagcgggggcctcgccctgacagagacgtgggcatgctcacatagtatgaggtattttgacacggctgtgtccagaccaggcagaggcgaaccaaggttcatcagcgttggatacgtggacgacacccagtttgtgagatttgatagtgacgccgcgtcccctcgtggcgaaccgagggccccttgggtagagcaagaggggcccgagtattgggatagggagactcaaaagtacaagcggcaggctcaggcagacagggtgagcctccggaacctcagaggttactacaatcagtccgaagacggctcgcacaccctgcagcgaatgagcgggtgtgatcttggaccagacggccgtctgctgcgcggatatgatcaatcggcttatgatgggaaagactatatagcgctgaatgaggatcttagatcatggaccgccgctgacaccgcggctcagattacccagcggaaactcgaggcagccagagcagccgaacaattaagagcttacctagaaggaacctgcgtggagtggttgcgaagataccttgagaatggcaaggagactctgcagagggctgagcctccgaagactcacgtgacccaccaccccctctctgatcatgaggcctcacggcggtggaacctgccagaagtgggctcatgcgggggcgctttttggacccgagccgagatacatgttccatacgctgcgcgtggggctgcccgcgcacctcaccccgagtag

SEQ ID NO: 2885 - DNA, 1119 bp, Artificial Sequence
  Description of Artificial Sequence: Synthetic coding sequence
atgagggttatggcacctcgaacccttattcttctcctgagcggagccttggccttgacggaaacatgggcgggatctcactctatgagatatttttataccgcggtatctcggccaggcagaggagagccccatttcatcgccgttggctacgttgacgatacacaatttgtgagattcgattccgatgccgccagtccacggggcgaaccccgagcaccatgggttgaacaggagggtcccgagtattgggaccgagagacccagaagtacaagcgccaggcccagacagaccgggtaagcctgcggaatctgcggggatactataaccaaagcgaggctggctctcacattattcagcggatgtatggttgtgacgtgggacctgatgggcgcctcctgcgcggctacgatcagtacgcctatgatgggaaagactatatcgccctgaacgaggacttacgctcctggaccgctgcggataccgcagcccaaataacacagcggaaatgggaggcagcccgggaggcggagcagttaagggcctaccttgaggggctatgtgtggagtggctcagacgttacctgaaaaacggcaaggagacccttcagcgagcagagcaccctaaaacacatgtcactcatcaccctgtctcagaccatgaggcgaccctgaggtgctgggccctaggcttttatccagccgagataaccttgacttggcagtgggacggcgaggatcagacccaggacactgaactggtggagactaggcccgcaggggacgggacttttcagaaatgggcggcggtagtggtaccgagtggcgaggaacagcgatacacttgtcacgtgcagcacgagggcctgccagagccgctgacactgaggtgggagccttcttcacagcccacaattcccatagtggggatcgtcgccggcctcgcagtgttagccgttctggcagtcctaggggctgtcgtggccgtcgtcatgtgcaggagaaaatctagcggccatttcctgcccactgggggaaaaggcggctcttgcagccaggctgcatcgtcaaactccgcccaaggcagtgatgaatcacttattgcttgtaaggcttag

SEQ ID NO: 2886 - DNA, 1020 bp, Artificial Sequence
  Description of Artificial Sequence: Synthetic coding sequence
atgcgggtaatggcccctaggaccctaatcctgcttctaagcggcgcccttgcgctgacagagacctgggcttgctcacacagcatgagatatttttataccgcagtcagtcggcccggtcgcggagagccacgttttattgccgtagggtatgtggatgatacccagttcgttcgctttgattcagatgcggccagcccgcggggtgaacccagagccccttgggttgagcaggagggccctgagtattgggatcgggagactcaaaagtacaagagacaagcccagactgaccgcgtgtctctccggaacttgcggggctactacaatcagagtgaagctgggagccataccctgcagtggatgtatggttgtgatcttgggcctgatggtaggctgcttcgcggctacgatcagtcagcgtacgatggcaaagattatatcgccctgaacgaggatttacgctcttggaccgctgcagacacggctgcccagattacacagagaaagtgggaagcagctcgggccgcggagcagcagagagcatacttagagggcacgtgtgtcgagtggcttcgccgatacctggagaatggcaaagaaactctccagcgagcggaacaccccaagacccacgtgactcaccacctggtatccgatcacgaggccacactacggtgttgggccctgggattttatccggcagaaatcaccctgacctggcagcgagacggagaggatcaaacgcaagacaccgagttggttgaaacaagaccagctggcgatggcacctttcagaaatgggctgcagtcgtggtccccagtggggaagagcagcgctatacatgccacgtgcaacatgagggtctacctgagccgctgactttgagatgggagccgtcctcccagcctacaattcccatcgtaggcattgtggctgggctcgcagtgctcgctgtgcttgccgtgttgggggcagtcgtggcagtggtgatgtgtcgacgtaagagttctgcctag

SEQ ID NO: 2887 - DNA, 1101 bp, Artificial Sequence
  Description of Artificial Sequence: Synthetic coding sequence
atgagagtgatggcacctcgcactttgatcctgcttctgtcaggcgcgctggctctcacagaaacctgggcgtgttctcactccatgcggtacttcgacacagccgtgtcccgcccaggccggggagagcccaggttcatcagcgttggatatgtagacgacacgcagtttgtgaggttcgatagcgacgccgcgtcacccagaggggagccacgcgcaccatgggtcgagcaggaagggcccgagtactgggatcgtgaaacgcagaaatataaacggcaggctcaggcagatcgagtgaacctccggaaactgcgggggtactacaaccaatccgaagatggcagccataccctccagtggatgtacgggtgcgacttaggcccagatggcaggctgttaaggggttatgaccaatctgcctatgatggcaaagattacattgcgctcaatgaagacttgcgatcatggaccgcggccgatacagcagcccagatcacccaaagaaagtgggaagccgcaagagaggcagaacagtggagagcttatctggaaggtacatgtgtggagtggctgagaagataccttgaaaatggcaaagagaccttgcaaagagcagagcatccaaagacccatgtcacacaccacccagtgtccgatcatgaggcaactttgcggtgctgggccctgggattttaccccgcagaaattaccctcacctggcaacgcgatggggaggatcagacccaggatacggagcttgtcgaaacacggccagctggagacggcacattccagaagtgggcagcagtggttgtcccatccggcgaggaacaacgctatacctgccacgtgcagcatgaaggactgccagaacccctgacacttcgttgggagccgagtagccagccaactatccccatagtcggtattgtggcaggtcttgctgtcctagcagtgctcgctgtgcttggggcggtaatggctgtggttatgtgtcggcggaagtcttctgggggtaagggtggctcctgctcacaggccgcctcctccaacagcgcccaggggtcggatgagagtctcatcgcctgtaaagcttag

SEQ ID NO: 2888 - DNA, 1107 bp, Artificial Sequence
  Description of Artificial Sequence: Synthetic coding sequence
atgcgcgtgatggcgcctcgagccctgctcttgctgctctctggcgggcttgcactcaccgaaacatgggcctgttcccattccatgaggtactttgacacagccgtgtcacgtccaggccggggagagccaagattcatctcagtgggctatgttgatgacacccagtttgtgcggtttgactccgatgccgcctctcctcgcggtgaacctcgggccccctgggtcgagcaggagggccctgaatattgggacagggaaacacagaactacaagcggcaggctcaggcagatagggtaagtctgcgcaacctacggggctactacaatcagtcagaagatgggagccacaccctccagcggatgtacgggtgcgaccttggacccgacggaaggttgctccgggggtatgaccagagcgcctatgacggaaaggattacatcgcactcaacgaggatctgcgctcatggactgccgcagacaccgccgctcagattacccagagaaagttggaggctgcaagggcagctgagcagctgagagcgtacctggagggcacatgtgtggagtggctccgcagatacctggagaacgggaaggagaccttacaacgggccgagccaccaaaaacgcatgtcacacaccacccactgtcagaccacgaggccacccttcgatgctgggctctcgggttctaccctgctgagattacactgacttggcagcgcgatggcgaggatcagacccaagatacagaactcgttgaaactaggccggcgggtgatggtacatttcagaagtgggccgcagtcgtggtgcctagcggccaggagcaacgttatacttgccacatgcagcacgaaggcctgcaggagcctttaaccctatcatgggagccctccagccagccaaccatacctatcatggggatagtcgccggtctcgccgtgctggtggtgcttgccgtattgggcgccgtggtaacggctatgatgtgcaggcgtaagtcaagcgcagcctgtgtggggcttcgttgccgcatttcctctcatctctctttcgtcacctcgagagcttcggggatctctttttgtaagggggtgtag

SEQ ID NO: 2889 - DNA, 1194 bp, Artificial Sequence
  Description of Artificial Sequence: Synthetic coding sequence
atgagggtcatggctccccggaccctcatcctactgcttagcggggctttagcgctgaccgagacatgggcttgttcacatagtatgagatactttgacaccgcagtgtcccgtcctggcaggggcgagccgcggtttatctccgtgggctatgtggatgacactcagtttgtgaggttcgactccgatgcagcaagcccacgaggcgagccaagagctccatgggtggagcaggaaggacccgaatattgggaccgggagacacagaaatataagagacaggcacaggccgaccgggtgaacctgagaaagctgaggggttactataatcagtccgaagacgggagccacactttacaatggatgtacgggtgcgatttagggccagatggccgactgctgaggggttacgatcagtcagcctacgatggcaaggattatatcgctctgaacgaggacttgaggagctggacggccgccgatactgctgcacagatcactcaaagaaagtgggaagccgcacgtgaggcagagcagtggagggcctatcttgaaggtacttgcgtcgagtggttgaggagatacctggaaaacggaaaggagaccctgcaaagagcggaacatccaaagactcacgtcactcaccacccagtgagtgatcatgaagcaaccctccggtgctgggcactgggcttttacccagccgagatcactctgacctggcaacgagatggggaggatcagacccaggatacggagctagtcgagacaaggcccgccggggatggcacttttcagaagtgggctgccgtggtcgtgccttcgggtgaagagcaaagatatacctgtcacgtacagcacgagggccttcccgaaccacttaccctgaggtgggaaccctcctcccagccaaccattccaatagtaggaattgtggccggcttggcggtcctggcggtcctcgcggtcttaggtgctgtgatggccgtcgttatgtgccgtaggaagtcatctggaagagagggcgtaagatctggggtctggccagctacggtgccacgagccctcatgagcctgtcttcactggtgaaacctgaaacggcagcctgtgtcggtctgcggtgtcgtatcagctcgcacctgagctttgtcactagccgggcttcgggaatttccttttgtaagggcatatag

SEQ ID NO: 2890 - DNA, 1119 bp, Artificial Sequence
  Description of Artificial Sequence: Synthetic coding sequence
atgagagtgatggccccaagagccctgctcttgttgctgagtggcggcttggccctgacggagacttgggcatgtagccattctatgcgttacttcgataccgctgtgtcaaggccaggaagaggtgaaccacggttcattagtgttggctacgtggacgatacgcagtttgttaggtttgactccgatgccgccagcccccggggggaacctagggcaccatgggtggaacaggaaggcccagagtactgggatagagaaacgcagaattacaagaggcaggctcaggctgaccgcgtgagtttgcgcaatttgcggggctattataaccagtcggaggacggcagccatactctgcagcggatgtacggatgtgacctaggtcctgatggtaggttactccgaggctacgaccagagtgcctatgatggtaaagattatatcgccctgaacgaggacctcaggagctggaccgctgccgacactgcggcccagataacacagcgtaaactggaggctgctcgcgctgccgagcagctccgggcttacctcgagggcacatgtgtggagtggctcaggcgctatctagagaacggaaaggaaacactccagagagcagaacctccaaaaacccacgttactcaccatcccctgagcgaccacgaggcgactctgcgctgttgggcattggggttttaccccgccgaaattacattaacttggcagagggatggggaagaccagacccaggataccgagctggttgagacacgacccgctggagacggaacattccagaagtgggcagcagttgtggtcccgtcggggcaggagcagcgttatacatgccacatgcagcacgagggactacaagaacctctcactctcagttgggagcctagctcccaaccgaccattcccattatgggaatcgtggctggactagccgtgctggtcgtacttgctgtcctgggcgcagtggtgacggccatgatgtgcaggcgcaagtcctctggacacttcttgccaacaggtggcaaaggtggtagttgttcacaagcagcctgctcaaatagcgcgcaggggagtgacgaaagcttaatcacatgcaaggcctag

SEQ ID NO: 2891 - DNA, 1101 bp, Artificial Sequence
  Description of Artificial Sequence: Synthetic coding sequence
atgcgcgtcatggccccccgagccctgcttctgctgttgagcggcggactggcactgaccgagacctgggcatgtagccacagcatgaggtacttcgacaccgccgtatcacgccccgggagaggagagccgaggtttatctcggtgggctacgtggacgacactcagttcgtccgctttgattctgacgctgcctcccccagaggggaaccccgggccccttgggtggagcaagaaggtcccgaatattgggatcgggagacacagaactacaagaggcaagcccaggccgatagagtatcattacgcaatctgagggggtattacaatcagtctgaggatggcagtcacacgctgcagcggatgtatggatgcgacctcggccccgacggcaggctcctccgcgggtacgatcaatcagcatatgacggaaaggactacatcgctctgaacgaagacttgcggtcctggacagctgctgataccgcggcccaaattactcagaggaaactggaggccgcgagagccgctgaacagttacgcgcatacttagaaggaacgtgcgttgaatggttaagaagatacctggagaacggcaaagagacacttcaaagagccgagcctcccaaaacgcacgtgactcatcaccccctgagtgaccacgaggctactttgaggtgctgggcactgggcttttaccccgcagagattactttgacttggcagcgggatggtgaagaccaaacccaggataccgagcttgtggagacacggccagccggtgacgggacattccagaagtgggccgccgtggtggtgccttccggtcaggagcagagatatacttgccacatgcagcacgagggcctgcaggagccacttacgcttagctgggagcccagcagccaaccaaccatacctattatgggcattgtggccggacttgcagttctcgtggtcctcgccgtcttgggcgctgtggtgaccgctatgatgtgcagaagaaaaagttcaggcggcaagggtggttcatgtagtcaggccgcttgttctaattccgctcagggatccgacgaatccctgatcacttgcaaggcctag

SEQ ID NO: 2892 - DNA, 1107 bp, Artificial Sequence
  Description of Artificial Sequence: Synthetic coding sequence
atgcgggtgatggccccacgcactctgatcctgcttttgtcgggcgcactggctttgactgaaacttgggccggatctcattcgatgagatatttttataccgcagtcagcagacccggccggggcgaaccccattttatcgccgttggatacgtagatgacactcaattcgtccggtttgactctgacgcggcttcgccgcggggggaaccgcgagcaccgtgggtcgaacaggaaggtccagagtactgggaccgggagacccaaaagtacaagagacaggcacagacagatcgagtgtcactcagaaatctccggggctattacaaccaatcagaggcagggagtcacatcatccagaggatgtatgggtgcgatgtgggccccgacggccggctactccgcggctatgatcagtatgcatatgatgggaaggattatattgcccttaacgaggatctgcgttcgtggaccgctgcggacactgctgcacagattactcagagaaaatgggaagcggctagggaggccgaacagctccgggcttacctagaaggcttgtgcgtggagtggctcagaaggtacctcaagaatggcaaagaaacccttcagagggccgaacaccctaaaactcatgtgactcaccaccccgtgtcagatcatgaggccacccttaggtgttgggccttgggattctaccccgctgagattacgctcacctggcagtgggatggagaagatcagactcaagatacagagctggtggagacacggcccgctggtgacggtaccttccaaaaatgggctgccgtagtcgtgccaagcggagaggaacagaggtacacttgccacgtgcagcatgagggcctgcctgagccccttacacttcggtgggaaccaagttcccagccaacaatccccatcgttggaatcgtagccggtcttgcagtgttggcggtcctggccgtgttaggggcagtggtggctgtcgtgatgtgcagaaggaaaagctcagcagcttgcgtaggattacggtgccgcattagtagccacctcagtttcgttacttcaagggcaagtggcatatccttttgcaaaggcatatag

SEQ ID NO: 2893 - DNA, 1194 bp, Artificial Sequence
  Description of Artificial Sequence: Synthetic coding sequence
atgcgggtgatggctccccgtgcgctgctcctgctcctctcaggcggtctcgcattgactgagacctgggcttgcagccattctatgaggtattttgacacagctgtatcccgccccgggcgcggggaaccacgattcatctcagttggatatgtggatgacactcagtttgtccgtttcgacagcgacgctgcctccccccgcggtgagcccagggctccttgggtggagcaggaggggccggaatattgggatcgcgagacacagaattacaaacggcaggcccaggccgatcgtgtctctctgaggaacctgcgcggatattacaaccaatcggaagacgggagtcacacactgcaacgcatgtacgggtgcgatctgggacctgacggtcgcttgcttcggggttacgaccaatcggcttatgatggcaaggattacattgccctcaacgaggatctgaggtcttggaccgccgccgataccgctgcacagatcacacagcggaaactggaggcagctagggccgctgaacagctgcgcgcttacctggaaggcacctgcgtcgagtggttgcgccggtacctggagaacggcaaggagaccctacagcgagccgagcccccaaaaacccacgtgacacaccatcccctctcagaccatgaagccacgctgcgctgttgggccctcggcttttaccccgcagagattactctgacctggcaacgcgacggcgaggaccaaacccaggatacagagctggtggagaccagaccagctggcgatggtaccttccagaagtgggctgcggttgtggttcccagcggccaggaacagcgctacacctgccatatgcagcatgaaggcctgcaggaaccgcttaccctctcatgggaacccagttcacagcccaccattccgattatggggattgtggccggcctcgccgtcctggtcgtactagctgtattgggcgccgtggtgactgcaatgatgtgcagaagaaagtcttctggccgggaaggcgtgaaatccggtgtgtgggctgcaacagtgccccgggctctgatgagtctgtccagcctggtaaagccagagaccgccgcctgtgtaggactacggtgtcgtattagctcccatctgtcgtttgtgacaagcagagccagcggcatctccttttgcaagggagtttag

SEQ ID NO: 2894 - DNA, 1068 bp, Artificial Sequence
  Description of Artificial Sequence: Synthetic coding sequence
atgcgggtgatggcccctcgaactctcatcctcctgctcagcggagctctcgccttaacagagacatgggctgggtctcattcaatgaggtatttctacacggctgtgtcccgccccggaagaggggaacctcatttcattgctgttggctatgtggatgatacgcagtttgtacggtttgactcagatgctgctagcccaaggggtgaacctagggccccttgggtcgaacaggaggggcccgaatattgggatagagaaactcagaagtacaagcggcaggcgcagactgaccgggtcagtctgaggaacttgcgtggctactataatcaatccgaggcgggatcacacataattcagcgtatgtatggatgtgatgtgggccctgatggtcggctgctccgcggttacgatcagtacgcttatgatggcaaagattatatcgccctaaacgaagatctgcgctcctggaccgcggctgatactgccgcccaaattacacagagaaagtgggaagctgcccgggaggccgagcaactcagggcataccttgaaggcctgtgcgttgaatggttgagacgctacttgaagaatggcaaagaaaccttacaaagagctgaacacccaaagacccacgttactcatcaccccgtcagtgatcatgaggccacacttcggtgttgggccctgggcttctacccagctgaaatcaccttgacttggcaatgggatggcgaggatcagacacaagacactgaacttgttgagacccgcccagccggcgatggcacttttcagaagtgggcagctgttgtcgtaccatcaggggaggaacagagatacacatgccacgtgcagcacgaaggtctgcccgagccgctcacactgcgttgggaaccgagtagtcagccgactatccctatcgtgggtattgtggccggcctggcagtgctcgctgtgctggccgttctcggcgctgtggtcgcagtggtcatgtgccgtagaaaaagtagtgcttctaattccgctcaaggctccgacgaatccctgatcgcgtgtaaggcatag

SEQ ID NO: 2895 - DNA, 1107 bp, Artificial Sequence
  Description of Artificial Sequence: Synthetic coding sequence
atgcgggttatggctccgcgaaccctcatcttattactctccggggctctagctcttactgagacctgggcctgctcccattctatgcgttacttttacaccgcagtctctagacccgggcgtggcgagcccagatttatcgccgtgggttatgtcgacgacactcagttcgtccaatttgactccgacgccgccagtccgcggggagaaccaagagctccctgggtggagcaagaaggcccagaatactgggacagagagacccagaagtataaacgacaggcccagactgatagagtgaatctcagaaaactcaggggatattacaatcagagcgaggccggaagccacacactgcagcgaatgtatggttgcgacttagggccagacgggcggttacttagagggtataatcagttcgcatatgacggcaaggattacatcgcccttaatgaggacctaaggagttggacagcagccgataaggccgctcagatcacgcagaggaagtgggaggccgctcgcgaggccgagcaacgcagggcctacttggaggggacctgtgtggaatggttacggagatatctggagaacggaaaaaaaactctccagcgagctgagcatcccaagacccacgttacacaccatccggtttctgatcacgaggcaactctgagatgctgggcattaggattctatcctgccgagattactctgacctggcagagggacggcgaggaccagacacaggacactgaactggtggagactaggcccgcaggtgatggaacgttccaaaaatgggctgccgttgtggtcccgagcggtgaggagcagaggtacacctgtcacgtacaacacgagggcctccccgaacccctcacattgaggtggggcccatcgagtcagccaactatcccaatcgtgggtatagtggcggggctggcagtgctggctgtgctggcggtcctcggagctgtcatggctgtggtgatgtgtcgtcggaagtccagcgccgcctgcgttggcctgaggtgccgcatctcaagccacctgagtttcgtgacctcaagggcaagcgggatatccttttgcaaaggcatctag

SEQ ID NO: 2896 - DNA, 786 bp, Artificial Sequence
  Description of Artificial Sequence: Synthetic coding sequence
tgacgtgttatggccccgcgtactctgatcctgctgctgtcaggcgccctggccctgaccgagacttgggcatgctcgcattctatgagatatttctacacagccgtgagcaggcctggtaggggagaacctcgattcatcgccgtggggtatgtggacgatacccagtttgttcggttcgactcggacgcagcatcaccacgcggtgagccccgggccccctgggtcgagcaggaaggccccgagtattgggaccgggaaacgcagaagtataaacgtcaggcacagaccgacagagtgtccttaaggaacttaagagggtactacaatcaatcagaggcggggtcacatacactccaatggatgtatggctgcgacttgggccctgacggtcgccttttgcgcggatacgaccaaagtgcctacgacggaaaagactatattgctctgaacgaggatctgagatcctggactgctgccgacaccgccgcacagatcacgcagagaaagtgggaggcggccagggcggccgagcaacagcgggcatacctggaggggacatgtgtagaatggctgcgccgctacctggaaaacggtaaagaaactctgcagagggctgagcaccccaaaactcatgtcacacatcaccttgtgtccgatcatgaggccagccggcggtggaacctgcccgaggttggttcctgcggcggcgcattctggcggcgggccgaaattcacgtcccttgtgctgccaggggggctgccggcgctcctcatcctgaatag

SEQ ID NO: 2897 - DNA, 1101 bp, Artificial Sequence
  Description of Artificial Sequence: Synthetic coding sequence
atgagagtgatggcccccagaaccctgatactgctcttgagtggagctctggctctcactgagacgtgggcttgttcacactcaatgagatacttttacaccgccgtcagcaggccagggcgaggcgagcctcgtttcatagcagtgggctacgtggatgatacccaatttgtgagattcgattccgatgctgcgtcacctcggggagagcctcgcgcgccttgggtcgagcaagaaggaccagagtactgggacagagagacacagaagtacaaacggcaagcccagaccgatcgggtgtctctaagaaatctgcgaggctactataatcagagtgaggcaggttctcatacactgcaatggatgtatggatgtgatctcggtcctgacggccggctgctgagaggctatgatcagagcgcctacgacggcaaggattatatcgcactaaacgaggatttgagatcctggacagccgccgatacagctgctcaaattacacagagaaaatgggaggccgccagggctgccgagcagcagcgcgcttatttggagggcacctgtgttgagtggcttagacgctatctggagaacgggaaagaaacactacaaagggcggagcatccgaaaactcacgtcacccaccacctggtatccgaccatgaagccacactacgatgttgggcactgggattctacccagccgaaattaccctgacctggcagcgggacggcgaggaccagactcaggacacagaattagtcgagaccagacccgcaggagatgggacttttcagaagtgggccgccgtcgtggtcccaagcggcgaggagcagaggtacacttgccacgttcagcatgagggcctgcccgaacccctgactcttcgttgggagccatcaagccaacccaccatccccatcgtgggaatcgtggcgggcttggcggtactagcagtccttgccgtgctcggagccgtggtggctgtggtcatgtgtcgacgtaaatcttccggtggcaagggagggtcctgttcccaagctgctagctctaattcagcgcagggtagcgatgagagtctgatcgcctgtaaggcatag

SEQ ID NO: 2898 - DNA, 786 bp, Artificial Sequence
  Description of Artificial Sequence: Synthetic coding sequence
tagcgcgtgatggcccctagaacgctgattctgcttctgtctggcgccctggcattaaccgaaacctgggcaggcagtcattcaatgcgatacttttacactgccgtctcaaggccgggccggggggagccccatttcattgcagttggatacgtagacgacacccagtttgtccgctttgatagtgatgctgccagcccgcgaggcgagcctcgcgcaccttgggtggagcaggagggccccgaatattgggaccgcgaaacccagaagtataagaggcaggcccagactgatcgggtgtccctgagaaatctgaggggatattataatcagagcgaagcaggttctcatattatccagcgaatgtatggatgcgatgtgggaccagatggtaggcttctgaggggctacgatcagtatgcctatgacgggaaggactatatagccctgaatgaggatctgcgcagctggaccgcagctgacacggcagctcagataacccaaaggaagtgggaggcagcgcgcgaagctgagcagctgagggcctatctcgagggcttgtgcgttgagtggttacgccgttacctcaagaacggcaaggaaactctgcaaagagccgagcaccctaagacccatgtgacacatcaccctgtgtctgaccacgaggcctctagaagatggaatctgcctgaggtgggatcatgcggtggtgctttttggcgcagagctgagatccatgttccgtgcgccgcgcgcggagcagcaggtgctcctcaccccgagtag

SEQ ID NO: 2899 - DNA, 786 bp, Artificial Sequence
  Description of Artificial Sequence: Synthetic coding sequence
tgaagggtgatggctccacggacactcattctgttgttaagcggagccttagccctgacggaaacatgggcctgttctcacagtatgcgctacttctacactgccgtctcccggcccggccgtggggagccgaggttcattgccgtgggatatgtggacgacacgcagtttgtgcagttcgactccgatgcagcatcccctagaggcgaaccccgcgcaccctgggttgagcaggagggccctgaatactgggaccgcgagacgcagaagtataagcggcaggcacagactgaccgggtgaatctccgaaagcttcgaggctattacaatcaaagtgaggccggatcacatactctacagcggatgtacggctgtgatttggggcctgatggacgcctactccgaggatacaatcagttcgcttacgacggaaaggattatattgcactgaatgaagatcttaggtcatggaccgccgccgacaaggctgcacagataacccagaggaaatgggaagccgctagggaggccgagcagcggagggcatacttggaaggaacctgcgttgagtggctgagacgataccttgagaatggcaaaaagactctgcagcgtgcagaacatcctaaaacgcacgttacccaccaccccgtaagcgaccacgaggccagtcgcaggtggaatctgccagaagttggaagctgcgggggggcgttttggcgccgagccgaaatccatgtgccctgtgccgcgagaggcgctgcccgggcgcctcaccccgagtag

SEQ ID NO: 2900 - DNA, 786 bp, Artificial Sequence
  Description of Artificial Sequence: Synthetic coding sequence
tagagggtcatggctcctcgtacgctgatcttgctgcttagtggagcattggctctgaccgaaacatgggcgtgctcacactctatgcggtacttctacaccgccgtgagccgaccaggtagaggcgagcccaggtttatcgcagtgggctacgtcgacgacactcaattcgttcagtttgacagcgatgcagccagtccacggggtgagcctcgcgcaccatgggtggaacaggagggccccgagtactgggacagggagacgcagaagtacaaacgtcaggcgcagactgatcgggtgaacttacggaaacttcggggttactataatcagagcgaagccggaagccacactctgcagcggatgtacggatgcgacctcggccccgacggcagactcttgcgaggatacaatcagttcgcatacgacggtaaggattatatcgctctgaatgaagacctgagatcatggactgctgccgataaggccgcacagattacgcagcgaaagtgggaagccgcacgcgaggccgagcagcgtcgtgcctacttagagggcacttgtgttgagtggctgcgaagatatctggaaaacgggaagaagacattgcagcgagccgagcacccaaaaacccatgtcacacaccacccagtgagtgaccacgaggccagcagacgatggaacctgcccgaggttggaagttgcgggggagccttctggcgcagggccgaaattcatgtaccctgcgccgccagaggcgctgccagggcccctcatcccgagtag

SEQ ID NO: 2901 - DNA, 1119 bp, Artificial Sequence
  Description of Artificial Sequence: Synthetic coding sequence
atgagagttatggccccaaggacgttgatccttctgctgtctggggcattggccctcacagaaacctgggcatgttcccattcaatgaggtatttttacacagccgtgagtagacccggacgcggcgagccccgatttatcgcagtaggctatgtggatgacacccagttcgtcaggtttgactcggacgcagcttcccctaggggcgagccaagagccccctgggtggagcaagaggggccagagtactgggatcgtgagactcagaagtacaagaggcaggcccagacagatcgagtgagcctgcgaaacttgcgcggttattacaaccagtctgaagcaggttcccacaccttgcagtggatgtatggatgcgacctgggacctgacggcaggctcttgcggggttacgaccagtctgcctatgatggcaaagactatatagctttaaacgaggatttgcgtagctggaccgccgcagatacagccgcacagatcactcagcgcaagtgggaggccgctagggcagccgaacagcagagagcttaccttgagggtacctgcgtagagtggttaagaaggtatctggagaatggcaaggagaccctccaacgcgcggagcacccgaagacccacgtgactcaccatttggtgagtgatcacgaagctaccctgcgttgttgggcgctaggcttttaccccgccgagatcacactaacgtggcagcgtgatggggaagaccagacgcaggacactgagttggtcgagacacgaccagctggggatggcaccttccaaaagtgggctgcggtggttgtccccagcggcgaagagcagaggtacacctgccacgtgcagcacgagggtctgccagaacctcttacccttagatgggagcctagctcccagcctacaatccccatcgtggggatagtcgcggggctcgctgttcttgcggtgctagctgtgctgggggcagtcgtggcagtggttatgtgccggcggaagtcttcaggacattttctgcctacaggagggaaggggggatcttgctcccaggcggctagttctaatagcgcccagggatcagatgagtcactgatcgcatgtaaagcctag

SEQ ID NO: 2902 - DNA, 786 bp, Artificial Sequence
  Description of Artificial Sequence: Synthetic coding sequence
tgacgagtaatggctccacggacgctcattttactgcttagcggcgcacttgcactgactgaaacatgggcgtgttcccactccatgagatacttcgacactgcggtgtctaggcctgggcggggtgaacccagatttatttccgtgggctatgtagatgacacacaatttgtcaggtttgattccgatgccgcctctccaaggggagaaccacgggccccatgggtcgaacaggaagggcctgaatattgggatagggagacacagaaatacaaaagacaagcacaggctgatagggtgaacctgcgaaaacttagagggtattacaatcagtctgaggacggaagtcacaccctccaatggatgtatggatgcgatctggggcctgacgggaggttgctgcgagggtatgaccagtctgcctacgacggcaaggactacatagcactgaatgaagacctgagatcatggacagcagccgacactgccgcccagataacgcaacgcaaatgggaggctgccagagaagccgaacaatggcgggcctacctcgaaggaacatgtgtggaatggcttcggcgatacctggaaaatgggaaagaaactctgcagcgcgccgagcacccaaaaacgcacgtgacacaccatcccgttagcgatcatgaagcgtcccgccgctggaacctcccagaagtgggttcttgcggtggcgccttttggcgccgggctgagattcacgtaccatgcgcggctagaggtgcagcccgagcacctcaccccgaatag

SEQ ID NO: 2903 - DNA, 1107 bp, Artificial Sequence
  Description of Artificial Sequence: Synthetic coding sequence
atgagggtgatggccccccgaaccctgatcctgctcttaagcggtgcgcttgccctcactgagacctgggcctgctcccattccatgagatacttcgacacagcagtttccaggcccggacgcggggagccccgctttattagtgtaggctacgtggacgatacccagttcgttcgctttgattctgacgctgcttctccgagaggcgagccacgtgcaccatgggtcgagcaggagggtcctgagtattgggacagagagacccagaagtacaaacgacaggcacaggctgacagggtgaatctgaggaaactgcggggttattacaatcagagcgaggacggctcccatacactgcagtggatgtatgggtgtgacctggggccagatgggcgactcctccgggggtacgaccaatccgcctacgatggcaaggactacattgctctcaacgaagatctgcggtcttggaccgcagccgacacagcagcccaaatcacgcagcgaaagtgggaagccgcgcgtgaggccgaacagtggagggcgtaccttgagggcacatgtgtcgagtggctgaggcgatatttggaaaacgggaaagaaaccctccagcgggctgaacacccaaagacacacgtgactcatcacccagtttctgaccatgaggctaccctgagatgttgggccctgggtttttaccccgccgaaattaccctgacatggcagagggatggagaggaccagacacaggacactgagttggtggagacacggcccgctggagatggtacattccagaaatgggcagctgtggtggttccgtcgggcgaggagcaaagatacacgtgccacgtgcagcatgaaggattgccagaacctctgaccctgcgttgggagcccagcagccagccaactatcccaattgtgggaatcgttgcggggttagctgtgttggcagtgctcgccgtgcttggcgcagtaatggctgttgtgatgtgcagaaggaagagtagcgctgcctgcgtgggcctgcgttgtagaattagtagccacttatccttcgtaactagccgagctagtgggatctcattttgtaaaggaatctag

SEQ ID NO: 2904 - DNA, 786 bp, Artificial Sequence
  Description of Artificial Sequence: Synthetic coding sequence
tgaagagtgatggcaccaagagctctcctgctgctgctgagtggaggactcgcactgactgagacatgggcctgtagccacagtatgaggtacttcgacaccgccgtcagccggccaggcagaggggaaccacgtttcattagcgtaggatatgtcgacgatacccaattcgtcagatttgacagcgatgccgcctctccacggggtgagccccgtgccccgtgggtggaacaagaaggcccggaatattgggaccgcgaaacacagaattacaagcggcaggcccaggccgatagagttagcctgagaaatctcaggggctactacaaccagtccgaggacgggtctcacacacttcagcgcatgtatgggtgtgatctcggaccagatggcagactgctgaggggatacgaccaatccgcctacgatgggaaagactatatcgccctcaatgaggatcttagatcctggacagccgccgataccgccgctcagatcacacagcgaaaactcgaggccgcgcgcgccgcagagcagctgcgagcttacctcgaaggcacctgcgtggaatggctgcgccgttacctggagaatggcaaagagaccctgcaacgcgctgaaccccccaagacccatgtgacccaccatccccttagcgatcatgaagctagcaggcggtggaatctcccagaagtgggcagctgcggcggagctttttggacccgagccgaaatccacgtgccttacgccgcacgaggagcggcccgagccccccatccagagtag

SEQ ID NO: 2905 - DNA, 1101 bp, Artificial Sequence
  Description of Artificial Sequence: Synthetic coding sequence
atgagagtgatggccccccggaccctgattctcctgctgagcggagccctagctctgactgagacatgggccggtagccattctatgaggtacttctacaccgccgtttctcgcccaggaaggggagagccgcatttcattgccgtcgggtatgtggatgacacccaattcgtgagatttgactcagacgcagcttctccaagaggggaaccacgggctccatgggtcgaacaagagggacctgagtactgggatagggaaacgcaaaaatacaagaggcaagctcagacagatagagtaagccttagaaatctccgtggttactataaccaatctgaggctggaagccatatcatacagaggatgtatggatgcgacgtgggccccgacgggaggctgctgcgagggtacgaccagtacgcttatgatggtaaggattacattgccctgaatgaggatctcaggtcttggacggccgcggacactgccgctcaaatcacccagcgaaaatgggaggcagcaagggaggccgaacagctgagagcctaccttgagggtttgtgtgtcgagtggttgagacgctatttaaagaatgggaaagagaccctgcagcgagccgagcaccctaaaacccacgtgacccatcatcccgtctctgaccatgaggcgaccctgagatgctgggccctgggtttttacccagcagagataacgctcacttggcagtgggacggtgaagaccaaactcaggatacggagcttgtggagacgcggcccgcaggagatggcacttttcaaaagtgggccgcggtggtcgtgcccagcggtgaggaacagaggtacacctgccatgtgcagcacgaagggcttcccgaacccctgacactccgctgggaaccatcttcccaacccacaattcctattgtcgggattgttgccggcctcgccgtgctggctgtgctggccgtattaggggccgtggtggccgtcgtgatgtgccgtcggaagagctcggggggtaagggggggtcgtgtagtcaggccgctagttcaaactcggcacagggatccgatgagagcttgatcgcctgtaaagcatag

SEQ ID NO: 2906 - DNA, 1119 bp, Artificial Sequence
  Description of Artificial Sequence: Synthetic coding sequence
atgagggtgatggcccctcgcactctcatcctccttctgtcgggcgcactggctctgaccgagacatgggcatgtagccattccatgagatatttcgacacagccgtatctcggccgggtcggggtgagcctaggttcataagtgtgggatacgtcgacgatactcaattcgtccgattcgacagtgacgccgcctcccctcgcggcgagcctcgggcaccttgggtggagcaagaggggccagagtactgggacagagagacgcaaaaatacaaaaggcaggctcaggcagatcgtgttaaccttagaaaactaagggggtattacaatcagtccgaggacgggagccatactctgcaatggatgtacggctgcgatctgggacctgacgggaggcttctgcggggctacgaccaatctgcttatgacggcaaagattacatcgccctgaatgaggatcttagaagctggacagctgccgacactgcggctcagattactcaaaggaagtgggaggcagcgcgggaggctgaacaatggcgtgcctacctggaaggaacatgcgtcgagtggcttcgccgctatctagagaacggaaaagagactctgcagcgtgccgaacaccctaagacacatgttacacaccaccccgtgagcgatcatgaggctaccctccgttgttgggccctagggttttaccccgccgaaatcaccctgacatggcagcgcgatggtgaagatcagacacaggacactgagttagtagagactaggccagctggggacgggacatttcagaagtgggccgccgttgtcgttccatcaggggaggaacagagatatacttgccacgtgcagcacgagggtctgcctgagcctcttaccctgaggtgggagccttctagtcaacctaccatccccattgtgggaatcgtggctggcctcgctgtcctggcagttcttgcagtcttgggtgctgtgatggctgtggtcatgtgtcggaggaaaagctccgggcactttttacccaccgggggtaagggcggttcgtgcagccaggccgctagtagcaactcagcgcagggctcagatgaatcgctgatagcgtgcaaggcctag

SEQ ID NO: 2907 - DNA, 1107 bp, Artificial Sequence
  Description of Artificial Sequence: Synthetic coding sequence
atgagggttatggcacctcgcacgcttattttgctgctgtctggtgctcttgcattgacggaaacatgggcttgcagccacagcatgcggtatttctataccgcggtaagccggcccgggcgtggcgagccacgattcattgccgttggctacgtggatgacactcaatttgtccagtttgacagcgatgctgcttcccctaggggggagccgcgggccccttgggtggaacaggagggcccagaatattgggatagggaaacacaaaaatacaaacgccaggcccagacagacagggttaacctacgcaagctacgaggatactataatcaatccgaagccggctcccacacgctacaaagaatgtatggctgcgacctgggtccggacgggcgcctattacggggctataaccagttcgcttatgatggtaaagattacattgctttgaacgaggacttgcgctcttggaccgctgcagataaggccgcccagattacacaacgcaagtgggaagccgcacgcgaagctgaacaacgtcgcgcctatttggaaggaacatgtgttgaatggctgcggcgctacctggagaatgggaagaagactctccaaagggctgaacaccccaaaactcacgtcacgcaccatccagtgtcagaccacgaggccactctgagatgctgggccctgggcttttatcccgctgaaatcactcttacttggcagagggatggggaagaccagacccaggatactgagctcgttgagacacgaccagcaggggatggaacctttcagaagtgggctgccgtagtagttccatcaggggaagagcagagatacacctgtcacgtccagcatgagggtctgccagagcccctgacactccgatggggtcccagctcccagcctactattcctattgtaggcatagtcgcagggcttgctgtccttgctgtcctggccgtgctaggagctgttatggcggtggtgatgtgcaggcgcaagagctcagctgcctgcgtcggactaaggtgtaggataagtagccatctgtctttcgtaacaagtagagcgtctggcatttccttctgtaagggcatttag

SEQ ID NO: 2908 - DNA, 675 bp, Artificial Sequence
  Description of Artificial Sequence: Synthetic coding sequence
atgagagttatggctcctagagccttgttgctgctgctcagcggtggtctggcgcttacggagacatgggcgtgctctcactccatgagatatttcgacacggctgtgtcccggcctggaaggggtgaacctcgcttcattagcgttggttacgtggatgacacccagtttgtccggtttgattccgacgctgccagcccgagaggagagccaagagcaccttgggtggaacaggagggacctgaatattgggacagagagactcagaagtacaaaaggcaagcccaggcagatagggtatccctccggaacctgcgggggtattacaaccaaagtgaggacggttcccacactctgcagcggatgtcaggttgcgatctcggtcctgatggcagacttctgagaggatatgatcagagcgcatatgatggtaaggattatattgcactgaacgaagaccttcgtagctggactgctgccgacacagctgctcaaataacccagagaaaactagaagcagcccgggcagcggaacagcttagggcctatcttgaggggacttgtgtcgaatggctcagacgctacctggaaaacggaaaggaaacactgcagcgggctgggcaggatcagaagagcctgtttttgccccagaggttggaactctcaaatgagtag

SEQ ID NO: 2909 - DNA, 675 bp, Artificial Sequence
  Description of Artificial Sequence: Synthetic coding sequence
atgcgcgtgatggcgcctagaacccttattcttctgctctctggagccctggccctgacagaaacatgggcctgcagccacagtatgagatacttctacaccgcagtaagccggcccggtcgcggtgagccaagatttatagcagtaggctacgtcgacgatacccaatttgttcagttcgacagcgatgctgctagcccacgcggagaaccacgcgcaccttgggtagagcaagagggccccgagtattgggatcgcgaaactcagaaatacaaaagacaagcacagacagatagagttaacctgcggaagcttaggggatactacaatcaaagtgaggcaggctcgcatacactgcaacgcatgtatggatgcgatctcgggcccgatggcagactgctccgtggctacaaccagttcgcttacgacggcaaggactacatcgctttaaacgaggacctaaggtcctggaccgcagccgataaggcagcccagataacacagaggaaatgggaggctgccagagaggccgaacaaagaagagcctatcttgaggggacatgtgtagagtggctgaggcggtacctcgagaacggcaagaagacccttcagagggccggtcaggatcagaaatcactcttcctgccccagagactcgaactgagcaatgagtag

SEQ ID NO: 2910 - DNA, 675 bp, Artificial Sequence
  Description of Artificial Sequence: Synthetic coding sequence
atgagggtgatggctccccgggccctcctgctgctcctcagcggtggacttgcacttacagaaacctgggcctgctcacatagcatgaggtattttgataccgccgtgtccaggccaggaaggggtgagcctcggttcatttccgtgggctatgtggacgacacacagtttgtacgcttcgatagcgatgcagctagcccgaggggggaacctagagccccttgggtggagcaagaaggacccgagtactgggacagagagacacagaattacaaacgtcaagctcaagccgaccgggtctctctgaggaacctgcgcggatactataaccagtctgaggacggaagccacactctgcagcgcatgtatggctgcgatctgggccctgatggccgactcttgcgaggttatgaccagagcgcgtatgatggcaaggactatatagcactgaatgaagaccttagatcttggaccgccgccgatacggcagcccagattacacagaggaagcttgaggctgctcgggctgcggaacaattgcgagcttatctagagggtacctgcgtcgagtggctgcggcgatacctcgagaatggtaaggagacactgcagcgggcagggcaagaccaaaagtcactgttcttgccccaaaggctcgagctctcaaatgaatag

SEQ ID NO: 2911 - DNA, 396 bp, Artificial Sequence
  Description of Artificial Sequence: Synthetic coding sequence
atgcgcgtaatggctccccggacactgatcctgttgctctccggggccctggctctaaccgagacttgggcctgctcacattctatgcgctatttctatactgctgtatcccgccccgggcgcggggagccacggtttatcgcagtcgggtatgtggatgacactcagttcgtccaattcgattctgacgcggccagtccaagaggtgaaccaagagccccctgggtggagcaggagggacctgagtactgggacagggaaactcagaagtacaagaggcaagcccaaaccgatcgtgtgaatctcagaaagttaaggggctattataaccagagcgaggcagaagacgtatggctacgccctggggctcgaagggctccccctccccgggtgtag

SEQ ID NO: 2912 - DNA, 396 bp, Artificial Sequence
  Description of Artificial Sequence: Synthetic coding sequence
atgagggtgatggccccccgagcgttgctgctgcttttatccggcggccttgctctcacagagacgtgggcttgctcccacagcatgagatattttgatactgccgtatctcggcctgggagaggcgaaccaagattcatcagcgtgggctacgtggacgatacacagttcgtgcgctttgattcggatgccgccagcccccggggggaaccccgagctccttgggtcgagcaggaaggtccagagtattgggatagggaaactcagaattataagaggcaagcccaggcagaccgtgtcagtttacgtaatttgcgcggatactacaaccagtctgaagacgaagatgtgtggctccgaccaggcgccaggagggcgcccccccccagggtgtag

SEQ ID NO: 2913 - DNA, 396 bp, Artificial Sequence
  Description of Artificial Sequence: Synthetic coding sequence
atgcgggtgatggccccacgtacactgatcctgctactgagtggggccctggccctgaccgagacatgggcctgttcccatagcatgagatatttcgataccgccgtctcccggcccggacggggcgaaccaaggttcatttctgtgggttacgtggatgatacccagttcgtgagatttgactcagatgctgcatcaccccgaggagagcctcgcgcaccatgggtcgagcaagaggggccagagtattgggatcgggagacacagaaatataagagacaggcccaggctgacagagtgaatctcagaaagctgcgggggtactataatcagagcgaagatgtggacgtatggctcagacccggagcaagacgggctccaccacctcgagtgtag

SEQ ID NO: 2914 - DNA, 396 bp, Artificial Sequence
  Description of Artificial Sequence: Synthetic coding sequence
atgcgggtgatggcacctcggacgctcatcctactgctttcaggagcgctagccttgacggaaacctgggcatgttctcacagtatgcggtatttttatactgcggtgtctagaccaggccgcggagagccgcgctttattgcagtggggtatgtcgatgacacacagttcgtacagtttgactctgacgccgcttccccccgaggtgagccacgcgctccctgggtggaacaagaagggccagagtactgggaccgagagacccagaagtacaagcgtcaggctcagaccgacagagttaacctccgaaaacttcgaggctactacaaccagtctgaggccgaagatgtgtggttgcgacctggcgcccggcgagcgccaccccctagggtctag

SEQ ID NO: 2915 - DNA, 396 bp, Artificial Sequence
  Description of Artificial Sequence: Synthetic coding sequence
atgcgggtgatggctccaaggaccctgattctcttgttaagcggtgcgttggctttgaccgaaacatgggcgtgctctcacagtatgcgttatttttatacagctgtcagcaggcctgggcggggagaaccacggtttatcgctgtcggttacgtcgacgacacacagtttgtccggttcgactcggacgctgcatcccctcgcggcgaacctcgggcaccctgggtggagcaagaaggtcccgaatactgggatcgcgagacgcaaaaatacaaaaggcaggctcagactgaccgagtctccctcaggaatctgagaggctactacaatcagtctgaggccgtggacgtgtggctgaggccaggcgccagacgggccccgccgcccagagtatag

SEQ ID NO: 2916 - DNA, 396 bp, Artificial Sequence
  Description of Artificial Sequence: Synthetic coding sequence
atgcgggtaatggcgcccagaactctgattctgctgttgtccggggccctggctctgaccgaaacatgggcgggctctcacagtatgcggtacttctatacagctgttagcagacccggccgcggcgaacctcatttcatagctgtggggtacgttgacgatactcagttcgtccgcttcgatagcgatgctgccagcccgaggggcgagcctagagctccctgggtcgaacaagaagggcccgaatactgggaccgggaaacccaaaagtataagagacaggcacagacagaccgcgtaagcctgagaaacttacgtggttactacaatcagagcgaggccgaggatgtctggttgcggcgcggcgcccgcagagctccaccacctagggtgtag

SEQ ID NO: 2917 - DNA, 1212 bp, Artificial Sequence
  Description of Artificial Sequence: Synthetic coding sequence
atgcgagtgatggctccccgggctctgctgctgctcctgtctggtggtcttgcactgactgaaacatgggcctgtgaatgcggcgtgggccgggaagcagcaagtgccgagcggagcgaagggccccctggcgaacctcggcgcgaagtggggagggccgggctgtctccttccagtccacccggttcacactccatgcgttatttcgacacggcagtgtcacggccaggacgaggggagccccggtttatcagcgtaggttacgtcgacgatactcagtttgtccggtttgacagtgatgctgcctcgcccagaggcgagccaagggcaccatgggtggaacaagaaggtcccgagtactgggaccgagagacacagaagtataaacggcaagcacaggcagatcgagtgtccctaaggaacctccgtggctactataaccagagtgaagatgggtctcatacactccaacgtatgtccggttgcgacctgggcccagatggaaggttgctgcgggggtatgatcagagcgcatatgatggcaaggattatattgctctaaatgaggatctgcgctcttggacagccgcagacaccgccgcacagattactcagcgcaagctggaggcagcacgagcggctgaacagttaagagcatacctggaaggcacctgtgtggagtggctacggcgctatctagaaaacggtaaagagacactccagagagccgagcctcctaagacacacgtgacgcaccaccctttgtctgatcatgaagctacacttcgttgttgggctctcggcttctaccccgctgaaataactctgacatggcagcgggatggagaagaccagacacaggataccgagctcgtcgagacccgaccggccggcgacgggacatttcagaagtgggccgcggtggtcgtgcctagcggccaggagcagcggtatacttgtcatatgcaacacgaagggctccaagaaccattaaccctcagctgggagccaagctcccagcctaccatcccaattatggggatagtggcgggcctcgctgtgttggtggttttggccgttctgggagctgtcgtcaccgccatgatgtgccgacggaaaagctctggaggtaagggcggctcgtgctcacaggccgcatgctctaattctgctcagggttctgatgaatcactcattacctgcaaagcctag

SEQ ID NO: 2918 - DNA, 1212 bp, Artificial Sequence
  Description of Artificial Sequence: Synthetic coding sequence
atgcgcgtaatggccccgcgggctcttctactgctgctttcaggaggtcttgctctcactgagacctgggcgtgcgagtgcggggtgggccgcgaggccgctagcgcagagcgcagtgaagggccacccggcgaaccccgtcgggaagtcgggcgggcggggctgtcacctagcagcccaccaggctctcattcaatgagatacttcgataccgccgtgtcacgccctggccgaggggagccccgtttcatctctgttggttacgtggacgacacgcaattcgttcggttcgactccgacgctgcctccccaaggggggagccacgggcgccctgggtggaacaggaaggcccggagtactgggaccgagaaacccaaaactacaagcggcaagcccaggccgatcgcgtgtcgttgcgcaacctccgcggatactacaaccaatctgaggacggcagccatactctgcagcgtatgtatggctgcgacctgggccccgacggtaggctgttgagaggatatgatcaaagcgcctatgacggaaaggactatattgctctaaacgaagatctgcgcagttggacagccgctgacaccgcagctcaaatcacccagaggaagctcgaagccgccagggctgctgagcagttgagagcctatctggaaggaacatgcgtggaatggttgaggagatacttggaaaatggcaaagagaccttacagcgcgctgagcctccaaagacccatgtgacacatcacccactgtctgatcatgaagcgacactcaggtgctgggccctgggtttttatccagccgaaataaccctgacgtggcagcgcgatggtgaagaccagacccaggatactgagctagtagagactagacctgccggcgacggaacttttcaaaagtgggcagcagtggttgtgccttctggacaagagcagagatacacctgccatatgcagcacgagggactacaggaaccactgaccctgtcctgggagccctcatctcagccaacaatccccattatgggtattgttgcgggcctagccgtgctcgtggtgttggccgtcctgggcgctgtagtcacagcgatgatgtgcaggcggaagagtagtggcgggaagggtggtagttgttctcaggccgcctgcagtaattccgcccagggcagtgacgaatccctgattacatgcaaagcatag

SEQ ID NO: 2919 - DNA, 981 bp, Artificial Sequence
  Description of Artificial Sequence: Synthetic coding sequence
atgcgagtgatggctccccggaccctgattctgctcctgagtggcgcccttgccctgacagagacatgggcgtgttctcatagtatgaggtacttttatacagctgtgtcccgcccaggtcgtggtgagcccaggtttatagctgttggctacgtggatgatactcagttcgtgagattcgacagcgatgccgcatcccctcgaggcgagccccgcgcgccatgggtcgagcaagagggacccgaatactgggaccgtgagactcagaaatataaacgccaggcacagacagacagggttagcctcagaaatcttaggggttactacaatcagtccgaagctggatcccatacgctccaatggatgtatggatgcgacttgggccccgacgggcgtcttctgaggggttacgatcagagcgcctatgacggcaaggattacatcgcgctcaatgaagatctgcgttcttggacagcagccgatacagctgctcagatcacccagaggaaatgggaagccgccagagctgccgaacagcagcgcgcgtacctcgaaggcacatgcgtagaatggctccgccggtatctcgaaaatggtaaggaaactctgcagcgggccgaacatcccaaaactcacgtaacacaccacctggtgagtgatcatgaagctacactcaggtgctgggctctgggcttctatcctgcagagatcacgctcacttggcaaagagacggagaggatcagacacaagacactgagcttgtcgagacaagacccgctggtgacgggacgttccagaaatgggctgcagtcgtggtcccatcaggagaagagcagcggtatacgtgccatgtacaacacgaagggctgccagagcccctcaccctcagatggggggggaagggcgggagctgttcccaggctgcctccagcaattccgcccagggatccgatgaaagcctcatcgcctgtaaagcttag

SEQ ID NO: 2920 - DNA, 1041 bp, Artificial Sequence
  Description of Artificial Sequence: Synthetic coding sequence
atggcaagaccacaaagaacgccagctcgcagtcctgattcaatagtggaggtgaagagcaagttcgacgccgagttcaggcggttcgccttaccccgagcttctgtgtccggctttcaggagttctcaagactgctgagggctgttcaccagattccgggtctggatgtgctactcggctacacagacgcccatggagatcttctgccactcaccaacgacgactcactgcatcgcgctctggcctccggccctcctcccttacggttgctcgtgcagaagcgagccgaagccgactccagcggcctcgcctttgcctctaatagcctgcagcggcgaaaaaaagggctgttgttaaggccagtggctccactgcgcaccaggcctcctctgctaattagtctgcctcaggacttccgacaagtgagctccgtgatcgacgtcgacctcctgcctgagactcaccgcagggtgcggctacacaagcacgggtcggaccgccccctggggttctacatcagggacggaatgtccgtgagagtcgctcctcagggcctcgaaagggttccaggaatttttatcagtcggttggtgagagggggactggcagagtccacaggactgctagcagtgtccgacgagatactcgaggtcaatggcatagaggtagcaggaaaaacactagaccaggtgacagatatgatggtagccaactcccacaatctgattgttactgttaaacccgcgaaccaacgcaataatgtggtgcgcggcgcttctggcaggttgaccggtcctcctagtgccggtcccgggccagccgagccagatagcgacgacgatagctccgatctcgtcatcgaaaaccgacagccaccctcctctaatggactgtcacagggccccccttgttgggatctgcacccaggctgtcgtcacccaggaactcgcagttctttaccctctctggatgatcaggaacaggcctcttcagggtggggaagtagaatccgaggcgacggcagtggattcagcctatag

SEQ ID NO: 2921 - DNA, 1824 bp, Artificial Sequence
  Description of Artificial Sequence: Synthetic coding sequence
atgattcttctgacatttagcacgggtcggcgcctggactttgtccaccacagcggggtgttcttccttcagacattgctgtggatcctctgtgctacggtatgtggcacggagcaatactttaatgtcgaggtttggctgcagaaatatggatacttgccccctactgacccgcggatgagcgtcctccgcagcgctgaaacgatgcaatccgccctggccgcgatgcaacaattctatggaatcaatatgacaggcaaggttgacagaaacactatagactggatgaaaaagcccaggtgcggcgtgcctgatcaaacccgtggctcttccaagtttcatatccgtaggaaacgctatgctctcaccggccagaagtggcagcacaagcacatcacatacagcataaagaacgtcacccctaaagtgggagacccggaaactcgcaaggccatcagacgcgctttcgatgtctggcagaacgtcacaccgctgactttcgaagaggtgccctatagcgagctcgagaatgggaagagagacgtggatatcacgattatattcgcaagtgggttccatggcgacagctcaccattcgatggagaaggagggtttctggcccatgcctattttcccggtccgggaatcggcggggacacccatttcgactctgatgaaccgtggactctgggcaaccctaaccacgacggtaacgacctctttctcgtggccgtgcatgaattaggtcacgccctcggcctggagcattctaacgatccaaccgcaatcatggctcctttctaccagtacatggaaactgataacttcaagttgcccaacgacgacctccaggggattcagaaaatttatgggccccctgacaagattcctcctccaacacggcctctccctacagtaccaccgcacaggtcaatacccccagccgacccaagaaaaaacgatcgaccaaagccacctagaccccccaccggcagaccttcgtaccctggggccaagcccaatatttgcgacggcaatttcaacacgctggccatcttgcggcgcgagatgtttgtatttaaggaccagtggttctggagggtgcgtaataacagggtcatggacggctatcccatgcagatcacctacttttggcggggcctgcctccatcaattgacgccgtctatgaaaatagcgatggaaactttgtttttttcaaaggcaataagtactgggtatttaaggacaccacattgcaacccgggtaccctcacgatctgattactctggggagtgggatcccaccacatggtattgatagcgctatctggtgggaggacgtgggaaaaacctactttttcaaaggggacagatactggaggtactcagaagagatgaaaactatggacccagggtatcctaagccgatcacggtctggaaggggatccccgagagtccgcaaggggccttcgtccataaggaaaatgggtttacttatttttataagggtaaggagtactggaaatttaataaccagatcctgaaggtggagccgggttaccctcgctccatcctcaaggactttatggggtgtgacggaccgacggatagagtgaaggagggacattcgcctccagatgatgtcgatattgtgattaaactggacaatacagcaagcacagtgaaggcgattgcaatcgttatcccctgcatcttggcattgtgcctgctggtcctcgtgtacaccgtcttccagtttaaaaggaagggaacaccccgccatattttgtattgtaagagatctatgcaggagtgggtatag

SEQ ID NO: 2922 - DNA, 1812 bp, Artificial Sequence
  Description of Artificial Sequence: Synthetic coding sequence
atgaggcgccgcgctgcccgcggccctggccctccaccaccaggacccgggctatcccgcctgccgcttccactcctattgctcctggcactgggaacacgaggtggttgtgcagcccctgcgccggctccgcgagctgaggacctgtccctgggggttgaatggttgagcagattcgggtacctacctcctgccgacccaacaaccgggcagcttcagacgcaggaagagctgtcaaaggctatcacagcaatgcagcaattcggaggactagaggctacaggaatactggatgaggccaccctcgccctcatgaagacaccgcgctgttccctgccagacctacccgtgcttacgcaggcccgccgtaggaggcaagctccggccccaaccaaatggaataaacgtaatctgtcttggcgcgttagaacattcccaagagattcccctctgggccatgacacagtgagggcactgatgtactacgccctgaaggtctggagtgatattgctcctctcaactttcacgaggtggcaggatctgccgctgacatccagatagattttagcaaagctgaccacaatgatggctatcctttcgatggacctggtggcactgtcgcgcatgcctttttccccgggcatcatcatactgcaggcgacactcacttcgacgacgatgaggcatggacttttaggtccagcgatgctcacggcatggatttgtttgctgtggccgtgcatgagtttggtcacgctatcggtcttagccacgtcgccgccgcacactctataatgcgcccttattatcagggccccgtgggagatcctctgcggtacggcctgccctacgaagacaaagtgagagtctggcagctatacggggtgcgcgagagcgtttccccaacggctcaaccggaggagcccccccttttgccagagcctccagataaccggagttcggcacccccaagaaaggacgtcccccatcgttgtagtacacatttcgatgccgttgcacagattcggggagaagctttcttttttaaaggaaaatatttctggcgtctgactcgggaccgccatcttgtgagcctgcagccagctcaaatgcatcggttctggagaggactcccgcttcatctcgattcggtggatgctgtgtacgaaaggacctcagaccacaagatcgtcttctttaagggcgatcgttactgggtgttcaaggacaataatgtggaggaaggctatcctcggccagtgagcgacttcagcttgccaccaggcggcatcgacgctgctttttcgtgggcccataatgatcggacttatttttttaaggatcagctttattggaggtacgatgaccatacaagacacatggaccctggatatcctgcacagtctccactttggcgtggggtaccgagtacactggatgatgcaatgcgttggtcggacggggcctcttacttttttcggggccaggaatattggaaggtgctggatggagagctggaggttgccccgggctacccccagagcacagcccgtgattggttggtttgtggggacagccaggccgacgggagcgtggccgccggcgtcgacgccgctgaggggccacgggctccccccggtcaacacgatcaatcaaggtccgaagatgggtacgaggtgtgctcttgtacctccggtgcctcttctcctcccggggcacccggcccattagtcgcggcaactatgctcttgttgctccccccgctcagcccgggggctctgtggactgccgcacaggcgttgactctttag

SEQ ID NO: 2923 - DNA, 1560 bp, Artificial Sequence
  Description of Artificial Sequence: Synthetic coding sequence
atgcaacagtttggaggtttggaggcaaccgggatacttgacgaggctactcttgctctgatgaaaactccgcggtgttccctaccagatctgccggtgttgactcaggcccgacgcaggaggcaggcccccgcccctacaaagtggaacaagagaaatctttcttggcgtgtcagaactttcccccgtgattctcccctgggtcacgacacagttcgtgcactcatgtattatgctctgaaagtgtggtctgatatcgcacctctcaatttccacgaagtcgccggtagtgcggctgacatccaaatcgatttcagtaaggctgatcacaatgacggctacccgttcgatggacctggcggcaccgtcgcccatgcatttttcccaggccaccatcacacagcaggcgacacgcactttgatgatgatgaggcctggactttccgtagctctgacgcccatggtatggatctgttcgccgtggccgtacacgaattcggacacgcaattgggctctctcacgtggccgcagcccattccatcatgagaccgtactaccagggaccagtaggtgaccctctgcgttatgggcttccctacgaagacaaagtgagggtctggcaactgtatggcgttcgagagtcagtttcccctaccgctcagcccgaagaacctccactcctgccagaaccgcctgacaacaggtcgtctgcccccccgagaaaggacgtgccacatcgctgttctacacacttcgatgcagtcgcccaaattcgtggcgaagctttctttttcaaggggaaatacttctggaggcttactagggatcggcacctggtctcgttgcagccagcgcagatgcacagattttggcgtggcttgccactgcacctggacagtgtggacgcggtctacgagcgcacatccgaccacaaaatcgtcttctttaaaggggaccgatactgggttttcaaagataacaacgtggaggaaggatatccaagacctgtctctgattttagcctcccccctgggggtattgacgctgcattcagctgggcccataacgaccgaacttatttcttcaaagaccagctgtactggcgctacgacgaccacaccaggcacatggacccaggctacccagcgcagagtcccctgtggcgcggcgtgccttccactctggatgacgctatgaggtggtccgatggggcatcatactttttccgtggtcaagagtactggaaggtgttggatggtgaacttgaggtggctcccggttatccacaatcaaccgctagagactggctggtgtgcggagacagccaggcggacggatcagtggcagccggggtggatgccgcagagggtccccgggcgccaccaggacagcatgaccagtcacgtagcgaggacggctatgaagtatgttcatgcacctccggagcctccagccccccaggagcccccggcccgcttgtggccgcaacaatgctgttgctccttccgcctctcagcccaggcgccctctggactgctgctcaggcactgaccctgtag

SEQ ID NO: 2924 - DNA, 348 bp, Artificial Sequence
  Description of Artificial Sequence: Synthetic coding sequence
atgcagcagtttggcggcctggaggcaaccgggattctagacgaggccacacttgcattgatgaagactcccaggtgcagtctgccagacctccctgtcctgacccaggccagaagacgtcgccaggcccccgcccccacgaaatggaacaagagaaatttaagttggcgagttcgaacttttccaagggatagtcctctggggcatgacacagtgcgggcactcatgtattatgccttgaaagtttggagcgacattgctccactgaacttccatgaggttgcagggtcagcagctgatatacagatcgactttagcaaagccgaccacaacgatggatacccatag

SEQ ID NO: 2925 - DNA, 1527 bp, Artificial Sequence
  Description of Artificial Sequence: Synthetic coding sequence
atgaattgccaacagttgtggctggggttcctgctgcccatgacagtcagtggacgagtgcttggtttagcagaggtggcgccagtcgactatctgtcacagtacggatacctgcagaagccactcgagggcagcaacaactttaagccagaagacatcacagaggctctgcgagcatttcaggaggcaagcgaactgcccgtttcaggtcagctggatgatgccactcgggctcggatgagacagcccaggtgtgggctggaagacccattcaaccagaaaactctgaagtacctgcttctcgggaggtggagaaagaagcatcttaccttccggattctgaacttgccatccactctgcctccacacacagcgcgagccgcattgagacaggcctttcaagattggtcaaatgtcgcaccactcactttccaagaggtgcaggccggggcagcggatatcagactgagctttcacggacgccagagctcctactgttcaaatacatttgatgggcccggacgcgtgttggcccatgccgacataccagagctgggctctgtgcattttgacgaagatgagttctggacagaggggacctatcgcggcgtcaacctgagaatcattgcagcacacgaagtaggccatgcgctgggattaggccacagccgctactcccaggcattgatggcaccggtctacgaaggttatcgacctcacttcaaactgcatcctgatgacgtcgcggggatccaagcgctgtacggtaagaagtcgccagtcatccgggacgaggaggaggaagaaactgagctaccaacagttccgccggtcccaactgagccaagtccaatgccagatccatgttcgtccgagctggatgccatgatgctcggtccccggggaaaaacgtatgcatttaaaggggactatgtgtggaccgtaagtgattcaggcccagggcctctgtttcgcgtctccgcgctgtgggaaggactcccaggaaatctggatgccgccgtgtactcccctcgaacccagtggattcacttttttaagggagataaagtgtggcgttacataaactttaaaatgtctccaggctttccgaaaaaattgaacagggtggagccaaaccttgatgccgctttatactggccgctcaatcagaaggtgttcttgttcaaaggctctggctactggcagtgggatgagctggctagaactgacttcagctcttatccaaagccaattaaggggctgtttactggagtgcccaatcagccaagcgcagctatgagttggcaagatggccgcgtatacttctttaaagggaaggtctattggcgcctgaaccagcagttgagggtcgagaaaggatatcctaggaatatctctcacaactggatgcactgccgccccagaaccattgacactactccctcaggcggcaacacaactccgtccgggacgggtattaccctggatacaacattatctgccactgaaacaactttcgagtattag

SEQ ID NO: 2926 - DNA, 669 bp, Artificial Sequence
  Description of Artificial Sequence: Synthetic coding sequence
atgggggtgacgtgggacttttcaatgtctaatggaggtccacgcggaaagacctacgcattcaagggagattacgtctggactgtgtccgactccggtcccggaccactgttccgagtgtctgctctctgggagggattgcctggaaatctcgacgcagcagtctatagcccacggacccaatggattcatttctttaagggcgacaaagtctggaggtatatcaacttcaagatgtcccctggatttcccaagaagttaaatcgtgtggaacccaacctggatgccgcattatattggccacttaaccagaaagtgttcttgtttaaaggcagcgggtattggcagtgggatgaacttgcaaggaccgactttagctcctaccctaaacctattaaaggattgtttaccggtgtgcctaaccagccaagtgccgccatgtcttggcaggacggacgagtgtacttctttaaggggaaggtctattggaggctgaatcagcagctgcgggttgagaaaggatatccacggaatatctcacataactggatgcactgtagacctcggacgatagacaccacaccttcaggtggaaatacaaccccgagcggtaccgggataacactcgacacaactctttcagcgaccgaaactaccttcgaatattag

SEQ ID NO: 2927 - DNA, 918 bp, Artificial Sequence
  Description of Artificial Sequence: Synthetic coding sequence
atgaactgtcagcagttatggcttgggtttctcctgccaatgacagtatcaggaagggtgttagggctggccgaggtcgccccggtggactatctcagtcaatacggatatctccaaaagccactggagggtagtaataatttcaaaccggaggatataaccgaagcactccgagcatttcaagaggcaagtgagctgcccgtgtctggccagttagatgacgccacccgggctaggatgcggcagccaagatgtggattggaggacccatttaatcagaaaactttaaagtacctgctgttagggaggtggagaaaaaagcacttaaccttcaggattctcaatctgcccagcacactcccaccgcacaccgccagggccgctctcagacaagcatttcaggattggtcaaacgtggcccccctgacatttcaggaagtgcaagctggcgccgctgatatcaggctatcctttcacggacggcagagttcctactgcagcaatacttttgatgggcctggtaagaaaagccctgtcatcagggatgaagaggaagaggaaaccgagttacccacggttccgcctgtccccacggagccgtccccaatgcctgatccctgtagttccgaactggacgctatgatgctcggagaagcacctcctctccaagccgttggaaggcggtgggggcaacccgccgatccggaggcctggacaaatggatccgatatgggcctgcaacatgaacagtggcgcgcaccttgggaagatctgtgtttccagggtggcctgtgcgtcgactgtattagatttcgcactggtccgctggtccctagcgtttgccccttagggggggcccctcgcaaacctggctgctgctgcctgctcgctagtaacaccatggacagcttgctctag

SEQ ID NO: 2928 - DNA, 1452 bp, Artificial Sequence
  Description of Artificial Sequence: Synthetic coding sequence
atgaaggtgctgcctgccagtggattggcagtgtttttgataatggcccttaaattctctacagccgccccatcattggttgccgcctctcctcgcacttggaggaataactataggctcgcccaggcatacttggacaagtactacaccaacaaggaaggacaccaaatcggcgaaatggtggctcgagggtcaaactccatgatcagaaagattaaagagctgcaggcgttctttggtctacaggtaactggcaaacttgatcagaccacgatgaatgtcattaagaaacctaggtgtggcgtcccagacgtggccaactaccggctgttcccaggcgaacctaagtggaagaaaaatacgctcacatatcgcatctctaagtacacccccagtatgtcttccgtggaggttgataaggctgtcgaaatggcactacaggcttggtcatccgctgtacccctcagctttgtccgcatcaattctggagaagccgatataatgatttcattcgagaatggcgaccatggcgattcctaccccttcgacggcccacggggtactttggcccatgccttcgcacccggtgaaggcctgggaggagatacgcactttgataacgccgaaaaatggacaatgggaactaacggctttaacctgttcactgtggcagcacacgagttcgggcacgccctggggctcgcgcacagcaccgatcctagcgccctgatgtacccgacatacaagtacaaaaacccctacgggttccacttaccgaaggacgatgtcaaggggattcaggcgctgtatgggccgcggaaagtgtttctagggaagcctacgttgccacacgctccgcaccacaaaccatctattccagatttatgcgacagttcatcttcctttgacgctgtgaccatgctgggtaaggagctattgctgttcaaagaccggatcttttggaggcgacaggtccacctgaggaccgggatcaggcctagtaccattacatcttcttttcctcaacttatgtctaatgtggacgctgcctacgaggtggcagagcgaggaaccgcctactttttcaagggaccacattactggatcactcgcggcttccaaatgcagggtcctccacggaccatttacgattttggcttcccccggcacgtccagcagattgacgcagccgtgtatttgcgcgaaccccaaaagacactcttctttgtgggagacgagtactatagttacgatgaacggaagcgcaagatggagaaggactacccaaagaacaccgaagaagaattttccggggttaatggccagatcgacgctgcggttgagttgaatggctatatctatttcttcagcggtcccaagacatacaagtacgacactgagaaggaagatgttgtgagcgtcgtgaagagcagttcgtggattggttgctag

SEQ ID NO: 2929 - DNA, 1710 bp, Artificial Sequence
  Description of Artificial Sequence: Synthetic coding sequence
atgctggccgcaagtatcttccggcccacactcctcctctgttggctggcggctccatggcccacacaaccggagtccctgtttcacagtcgggatcggtccgacctggaaccgagtccactgcggcaggccaaacctatcgcagatctgcacgctgcacagcgtttcctgagcaggtatggctggagtggagtatgggccgcctggggaccaagcccggagggaccccccgaaacaccaaagggagctgccctcgccgaagctgttaggaggtttcagagggctaatgcgcttcccgcgagcggcgagctcgatgctgccaccctggccgccatgaacaggccaagatgtggcgttcccgatatgcgaccacccccaccatcagctcctccttcaccacccggccctccccccagggcacggagccggcggtctccacgcgccccccttagcttgtctagacgcggatggcaacccaggggttatcctgatgggggtgctgctcaggccttctctaagagaaccttgtcttggagacttctgggcgaggcattgagctcccagctatctgtggcggatcaacggcgcatcgtggcactcgctttccgaatgtggagcgaggtaactcctctggacttccgcgaggatctggccgctccgggtgctgccgttgacatcaaattagggtttggccgcggcagacacctcggttgccctagagccttcgacggctctggccaggagtttgcacatgcttggagactcggggatattcacttcgatgatgacgagcatttcactccaccaactagcgacacagggatttctttgctgaaagtcgcagtgcacgagattggtcacgttttgggtctaccgcacacctaccgaacaggctctattatgcagccaaactacattccacaggagcccgccttcgagctagattggtctgaccgaaaagcaatccaaaagttatacgggagctgcgaaggatcattcgacacagcctttgactggataagaaaagagaggaaccagtatggggaggtgatggtcagattttcaacttactttttcaggaattcatggtattggctgtatgaaaatcggaacaaccgcaccagatatggggatcccatccagatcctgaccggctggcctggaatacccacacataacattgacgcattcgttcacatttggacctggaaacgggatgagcgctactttttccagggtaaccagtattggaggtatgactctgataaagaccaggcgctgacagaggatgagcagggtaagagctacccaaaattgatctccgagggctttcctggaatccccagtccactcgataccgctttttatgacagaagacagaagctaatatatttcttcaaggaatctctggtttttgcattcgacgtaaaccggaatcgagtcttaaactcatatccgaagcgcatcactgaagtattccccgccgtcatccctcagaaccatcctttccgcaatattgattcggcttactacagctatgcatacaattcaatcttctttttcaaaggtaacgcttattggaaggttgtcaacgacaaggacaagcagcaaaactcctggctcccagcaaacgggctgtttccgaagaagtttatttccgagaaatggtttgacgtgtgtgatgttcatatctccaccctgaacatgtag

SEQ ID NO: 2930 - DNA, 1173 bp, Artificial Sequence
  Description of Artificial Sequence: Synthetic coding sequence
atgggtcgcggtgccagagtcccttccgaggcgcccggagccggagtcgagagacggtggttgggagctgccctcgtcgcactttgtctcctccccgccctcgtgctgctcgcccggctgggcgctcccgcggtgccagcttggagcgcggctcagggcgacgtggccgctctcggccttagcgcagtcccgccaacccgagtgccagggcccctggcgcctagacgtcggcgatataccctgacccctgctaggctgagatgggaccattttaacctcacctaccgcatcctctccttcccacggaacctccttagtccaagagagacaagacgggcattggccgctgccttcaggatgtggagtgatgttagcccatttagtttcagggaagtggccccggaacaacccagtgacctgcgcattggattctaccctatcaaccacaccgactgcctggtttccgcgctgcatcactgctttgatgggcctacgggagagcttgctcacgctttctttcctccccatggtggaatccacttcgacgacagcgagtactgggtattaggacccaccaggtacagttggaagaaaggggtttggctgaccgatctagttcatgtcgcagctcatgagatcggccacgctttggggctcatgcacagccagcatgggcgagcactgatgcatctcaacgctactttgcgggggtggaaggccctgagtcaggacgagctgtggggcttgcaccgtctatacggctgcctggatcgcctgtttgtgtgcgctagctgggctcgcagaggattttgtgacgcccgaagacgcttgatgaagcggctgtgtccctcctcttgcgatttctgttacgagtttccgtttcctaccgtagccactacaccgccccctcctagaacaaagaccaggctggtgcccgaaggacgcaacgtgacctttcgatgcggtcagaagatattgcataaaaagggcaaagtgtactggtataaagatcaggaaccgctagagttttcttaccctggatatttggccctgggagaggcccatctatccattattgcaaatgcagtgaacgaggggacttacacctgcgtagtccggagacagcaaagagttctcaccacctacagctggcgcgtgcgggttagaggctag

SEQ ID NO: 2931 - DNA, 1161 bp, Artificial Sequence
  Description of Artificial Sequence: Synthetic coding sequence
atgggtcgaggcgcaagggtcccttctgaggctcctggcgccggagtggagcgccgctggctgggggctgccctggtggccttgtgcctcctgcctgctctggtgttattggctaggcttggggcacctgcagtgccagcctggagtgccgcccaaggagacgtcgcagccttagggctgtctgctgtgccccctacgcgtgtgcccggccctctagccccaaggcgcagacggtataccttgacaccagctcggctgaggtgggaccattttaacctgacttaccgaatccttagttttcctaggaatttgctctctcctcgagaaaccaggcgtgcgctggccgccgctttcaggatgtggagtgatgtgtcccctttctcattccgtgaagtggcgcctgaacagccctcagatctacgtattggtgggagacctcccccacccagacctggaccggcccgacctgccagtcagccccgggctccaccccgtctactgcccgatcagccacacggtctgcccgggctcagggccgcgccgctcctgagacgtcctcatgggggagccggccctcgcctcctgccaccagctaggagacatccgttaagacgccagcgggtcttaggtcctggcccacacgcactgcaactggaagagaggcgcgtggcccacgggcctggcgcgcgtggcggcccaagggacaggccacgagctggccctgacgctttaactacccgtccaggcgcacatgcccctgaacgtcacgcagcacgcttggaaggagtcgtgccagggcgcgcggtgggcgctgcccctgcactgaggatgccgcggcaagcggtgcgcgtgcgcgtgttgggcgcggaaggcctgctgcggagatcacccgccgcacatgaagaggcgctgccacagcagctgcggttgttgctgcgtataccactgcctcatggggggcatcaccctacagccccacaggaccaaaaccaggctggagcccggggccaggaaagggacttacctctgcggccagaagaccccccacaagagcgggagtccgtgctcgtgcaaggccctggagcacctggagtcctccttcccaggctccccgggcctgggaggggcgccccagagcaccacagacagcggcgacagtag

SEQ ID NO: 2932 - DNA, 1293 bp, Artificial Sequence
  Description of Artificial Sequence: Synthetic coding sequence
atgggacgcggcgcacgggttccttcagaagctccgggagcaggagtagagcgcagatggctcggagctgctctagtcgcattgtgtttgctccccgcccttgtgctattggcaagactgggagcaccggcagtgcccgcatggagtgcagcacaaggggacgtggcagctttggggctgagtgccgtaccacctacccgggtacccgggccgctggccccacgtagacgccgctataccctcacaccagcaagactccgctgggatcactttaacttaacgtaccgaatcctgtcctttcccaggaacttactgagtcctcgcgagactcgtagggctctcgctgctgccttccgcatgtggtcagacgtctccccattctcatttcgggaagtcgctcccgagcaaccatccgacctcaggattgggttttaccccattaaccatacagattgtctggtgtcagcattacatcattgcttcgacggtccaactggtgagctggcacatgccttctttcccccacacggtggcatccatttcgatgactcggagtattgggtgcttgggcccacccgctattcctggaagaaaggggatcgaccaggctcatggcggcctctcctgtgcagtacagtggggtgtcgtggcagggccctcgggcagaccgctgggggtacgtttaggggtggcggatgtcattggtctttggctggtgtctggctcacagacctggttcatgtggctgcccacgagattgggcacgccctgggactaatgcactcacagcacggcagggccttaatgcacctgaatgctactctaagaggctggaaagctttaagccaggatgaattatggggcttacacagactttatgggtgccttgatcgcctttttgtttgcgccagctgggcccgcaggggcttttgcgatgcccgccggagattaatgaagaggctctgcccgagctcgtgtgacttctgctacgaatttcccttcccaactgtcgcgacaacccctcctcctccaaggaccaagacgaggctggttccggaaggccgaaacgtaacttttagatgcggccagaagatccttcacaagaagggcaaggtgtactggtataaggatcaggagcctctggagttctcctaccctggttatttggctctcggcgaagcccatttatctattatcgccaatgcggtgaatgaaggcacgtatacttgtgtcgtccggcgacaacagagagtcctcaccacctacagttggcgcgtcagagtcagaggatag

SEQ ID NO: 2933 - DNA, 717 bp, Artificial Sequence
  Description of Artificial Sequence: Synthetic coding sequence
atgggccgaggcgccagggtacccagcgaagctccaggagcaggggttgaacgaagatggctgggcgccgccttggttgctctttgcctgctgcctgccctggttttgctggcacgtctgggggcccccgctgtacccgcttggtctgccgcccagggcgacgttgccgctctgggcctgagcgccgtaccacccactcgggtgcccggccccctggccccgcgcaggcggcggtatacacttacacctgctagactgaggtgggaccacttcaatttgacttataggatcctcagtttcccccggaatctcctttctccccgggagactcggcgtgcactggccgccgcatttaggatgtggagcgacgtgagccctttctcttttcgagaggtcgcccctgaacagccctctgatctccggataggattctaccccataaatcatactgattgcctggtgagcgccttacaccactgcttcgacggacctaccggcgaactagcccatgcatttttccctcctcatggtggcatccacttcgacgactctgagtactgggtgctgggacccacacgatacagctggaaaaaaggcgaccgtccgggatggccacccggtggcctcagttccgccgcccaatgggccgctgcagtgggcctttggggtcgtcggcaggaaggccctagcggagtggtagcagccacgggtgtgtag

SEQ ID NO: 2934 - DNA, 1938 bp, Artificial Sequence
  Description of Artificial Sequence: Synthetic coding sequence
atgcccagatctcgcggaggcagggcagcgccaggtcctccgcctcctccccccccaccgggccaggccccaagatggtctagatggagggtgccaggcagactgcttttactcctcctccccgccttatgctgcctacctggcgccgccagggctgctgcagcggcagctggagctggtaacagggccgctgtcgcggtcgcggtcgcccgggccgatgaagctgaggctccctttgcaggacagaattggctgaagagctatgggtacctgttgccatacgactctcgagcctcagcactgcattccgccaaagccctccagtcagctgtgtcgactatgcagcagttttatggaattccagtcacgggagtgctcgaccagactacgattgaatggatgaagaagcccaggtgtggggtccctgaccatccccacctatcgaggaggcggcgcaataagcgctacgcccttaccgggcaaaagtggaggcaaaaacacatcacctactccatccacaattatacccctaaggtgggcgagctcgatactaggaaggccatccggcaagccttcgacgtgtggcagaaagtaacgcccctgacattcgaggaagtgccctaccatgagatcaagtccgatcggaaagaggcagatatcatgatcttctttgcaagcgggttccatggcgattccagtcccttcgatggagagggggggtttttggcccatgcctactttccaggccccggaattggtggcgatacccattttgattcagacgaaccatggacgctcggcaacgccaaccacgacggcaacgaccttttcttagtggcagtacacgaacttggacatgccttaggtctggaacactcaagcgacccttccgccatcatggcgccattctatcagtacatggagactcataacttcaaattgccacaggacgatcttcaaggtattcagaaaatatacggcccccccgcagagcccctggagccaaccagaccgctccccactcttcctgtgagacggatccactctccatctgagcgcaagcacgaaaggcagccacggcccccacgcccgccacttggcgacaggccatcaacacctggaacaaagcccaacatctgtgacggtaattttaataccgttgccctgttcaggggagaaatgttcgtgtttaaggacaggtggttctggaggttacgcaataatagggtacaggaaggttacccaatgcagatagaacagttctggaaaggactccctgccaggattgacgccgcctatgagagagctgatggaagattcgtgttcttcaaaggggataaatattgggtgttcaaggaagtgacagttgaacccggctatccacactcccttggggaactgggtagctgcctcccacgggaggggatcgacactgcgctccgatgggaacctgtggggaaaacctatttcttcaagggagagcggtactggagatactcagaggaaaggcgcgccactgaccccggataccccaagcccatcacggtctggaagggaatccctcaggcgccacagggagcatttatttctaaagagggttattacacctatttctacaaaggaagggactattggaaattcgataatcaaaaactgagcgtcgaacccggctatccccgcaacattttacgagattggatggggtgcaaccaaaaagaggtggagcggcgcaaggagcggcggcttccccaagacgatgtggatataatggtgacgattaacgatgttccaggatccgtgaatgcagtggctgtcgtgattccttgcattctgtccctgtgcatcctggtactggtgtataccatattccagttcaaaaacaagactggcccacagcccgtcacatactataaaaggccagtccaggaatgggtctag

SEQ ID NO: 2935 - DNA, 1782 bp, Artificial Sequence
  Description of Artificial Sequence: Synthetic coding sequence
atgccccgtagccgagggggaagggctgcaccagggcctccacttgccgtggcgagggctgacgaagccgaggccccattcgccggacagaattggctcaagtcttacggctatctgctaccatacgattcaagagcctcagcactccattcagctaaggccctccaatctgccgtgtccaccatgcagcagttctacgggatcccagtgactggagtcctcgaccagaccacgatcgagtggatgaagaaaccccgttgtggtgtgccagatcacccacacctctcaagacgcagaaggaataagagatacgctttgaccggccagaagtggagacaaaagcacataacatactctattcataattatacccccaaggtcggagagctcgacacccgaaaagcaattcgacaagcgttcgacgtttggcaaaaggtcacccccctcaccttcgaggaagtgccctatcacgagataaaaagcgatagaaaggaggcagacattatgattttttttgcttcagggttccatggtgactctagccccttcgacggagagggggggttcctggctcacgcctatttcccagggcctggcatcggaggagacacgcacttcgattcggacgagccttggacacttggaaatgctaatcacgacgggaatgacttgttccttgtggctgtgcatgaactcggtcatgcattgggtctggagcatagctcagacccttcagccatcatggcaccattttaccagtacatggaaacacacaatttcaaactcccacaggacgatcttcagggaattcagaaaatttatggccctccagcggagcccttggagcccactcgacccctccccaccctgccagtgaggaggatccactcccccagtgaaaggaagcatgagcggcagccacgaccaccacgtccacccttgggagataggccctcgacaccgggcacgaagcctaatatttgtgacggcaacttcaataccgttgccctgtttaggggcgaaatgttcgtgtttaaggaccgttggttttggcgcttgagaaacaacagagtccaggagggatatcctatgcagattgaacagttttggaagggactgccggccaggattgatgctgcatatgagagggctgatgggcgtttcgtgtttttcaagggggacaagtattgggtgttcaaagaggttacagtggagcccgggtacccccattctctgggggagttaggcagttgcctcccccgggagggtatcgacacggccctgcgctgggagccggtcggaaagacatacttcttcaagggcgaaaggtactggcgctactcagaggagaggcgtgccacagaccccggatacccgaaacccataactgtttggaagggtattccccaggccccccagggggcctttattagtaaggagggatactatacatatttctataagggtagagactactggaaattcgacaatcagaaattgtctgtggagccaggctatccgagaaatatacttcgagactggatgggctgtaaccagaaagaggtggagcgccgcaaggagcggagactccctcaggacgacgttgatataatggtaacgattaatgatgtccccggatccgttaatgcagtggctgtggtgattccatgcatcctgagcctgtgcatacttgtgctggtgtacacgattttccaattcaaaaataaaacaggaccgcagccagtgacttactacaaacggcctgtacaggagtgggtctag

SEQ ID NO: 2936 - DNA, 561 bp, Artificial Sequence
  Description of Artificial Sequence: Synthetic coding sequence
atgtcccctgccgacccaggcactgttgccaccatgcggaaacctcgttgcagcttgcccgacgtgctcggggtggctggactcgtgcgcaggcgacgccgctacgcactcagtggaagcgtctggaaaaagaggactttaacttggagagtgcgatcttttcctcaatcttctcagctgagccaagagaccgtccgcgttctcatgtcttacgcccttatggcttggggcatggaatccggattgacctttcacgaggttgacagcccacagggccaagagcccgatattctgatagacttcgctagagcatttcaccaggactcataccccttcgatggactcggtggtacactcgctcacgctttctttccgggcgagcaccccatctccggcgatacccactttgacgatgaggagacatggacctttggcagcaaggcttcccaacagctggaacaagaactggctggcggctcacctgttgacgaagagctgggcttttctaggggctggagagtgaaccccctgggcccgggctccccagaacgcttaagttag

SEQ ID NO: 2937 - DNA, 1689 bp, Artificial Sequence
  Description of Artificial Sequence: Synthetic coding sequence
atgcgtcttcggctgcggctcctcgcgttgttattgttgctgctcgcaccacccgccagagcacccaagccctctgctcaggatgtgtcactgggtgtggattggctgacaaggtacggctatctgcctcctcctcatcccgctcaggcccagctgcagagccccgaaaaactcagagatgcgataaaggtcatgcaacgctttgctggactccctgagacaggtcgcatggaccctggtaccgtcgccaccatgaggaaacccaggtgctccttacctgacgtgctgggagttgccggactggtgaggcggagacggcggtatgccctgtctggaagcgtgtggaagaaacggaccttaacttggcgcgtccggagcttcccacaatcttctcagctcagccaggagaccgtaagggtgcttatgtcttatgcactgatggcgtgggggatggaatccggactcacgtttcacgaggtggactccccccagggccaggaacccgatattttgattgactttgcgagggcttttcaccaggactcctatccgtttgacggccttggaggaaccctcgcacatgccttttttcctggagagcacccaatctcaggggatacccacttcgacgatgaggagacatggacattcggctccaaagacggcgaagggactgatctgttcgctgtcgcggttcacgagtttggacacgccttaggtctggggcacagcagcgcccccaacagcattatgaggcccttctatcagggacctgttggcgatcccgacaagtaccggctctctcaggacgacagagacggcctgcaacagttgtacgggaaggccccccaaaccccctacgacaagcccacgcgtaagcccctggcccccccgccgcagccaccggcatccccgactcactcaccctcctttccaattcccgatcgttgtgaggggaactttgacgccatcgccaatatcaggggcgagacatttttcttcaaagggccttggttctggcggctccaaccgtccggtcagctggtttcacccaggcccgctagactccatcgattttgggaaggccttcccgcacaagtgagggtggtccaggccgcctacgctcggcacagagatggaaggatccttcttttctccggtccgcagttttgggtgttccaagatcgtcagttggagggcggggccaggcccttgacggagctgggattaccccccggggaagaggtggatgcggttttctcctggccacagaatgggaagacttacctcgtaaggggccgccaatattggcgctacgacgaggccgccgcaaggcccgatcctgggtacccgagagaccttagcctatgggaaggggcccctccgtcccccgacgatgtgacagtgagtaacgctggcgatacttatttctttaaaggcgctcattactggagattccccaaaaactccataaagacagagcccgatgctcctcagcccatgggtccgaactggttagactgtcctgccccttcaagtggaccacgcgcacctcgacctccaaaggcaacaccagtctcagagacctgtgactgtcagtgcgaacttaaccaggccgctgggcgttggcccgcacccattcccctgcttctgctccctcttctggtgggtggagtcgccagccggtag

SEQ ID NO: 2938 - DNA, 786 bp, Artificial Sequence
  Description of Artificial Sequence: Synthetic coding sequence
atgcagctggtaatcctaagggtgacaatttttttgccttggtgtttcgccgtgcctgtgccacctgcggcagaccataagggctgggacttcgtggagggctatttccaccagttttttttaaccaaaaaagaaagtcctctgctgacccaagaaacccagacacagttgctgcagcagtttcacaggaacggaacagacctgttagatatgcagatgcatgcattgttgcaccagccccactgcggcgtccctgatgggtctgacacctccatatcccctggacgttgtaagtggaataaacataccctgacctatcggatcatcaactaccctcacgatatgaaaccttccgcagtgaaggacagcatatataacgctgtgtctatttggtcgaacgtgacccctctgatttttcagcaggttcaaaacggcgacgctgatatcaaagtcagcttttggcagtgggcccacgaggatggctggccatttgacggccctggtggcatcctggggcacgcgtttcttcccaatagcggcaaccccggagtggtccatttcgacaagaacgaacactggtcagcctctgatacaggatataatttattcttggtggcaacgcacgagataggtcactcccttggcctgcaacactccggcaatcagtccagcatcatgtacccaacttattggtatcatgatcctcgaacatttcagctgtctgcggatgatatccagcggatccaacacttgtacggagagaagtgttctagtgatataccctag

SEQ ID NO: 2939 - DNA, 786 bp, Artificial Sequence
  Description of Artificial Sequence: Synthetic coding sequence
atgcagcttgtgatactcagagtgacaatattcttgccatggtgcttcgccgtccccgttccaccagccgccgatcacaaaggctgggactttgtagagggctattttcatcaattctttctgacgaaaaaggagagtccactgctgacccaggagacacaaacgcaattgctgcaacagttccacaggaacgggactgatctcctggacatgcagatgcacgccttgctccatcagccacattgcggagttcctgatggcagcgataccagtattagtcctggcaggtgtaagtggaataaacatacgctgacctacagaattatcaattatcctcatgacatgaaacccagtgcagttaaagacagtatctacaacgctgtatccatctggtctaacgtgacacccctgatttttcagcaggttcagaatggtgatgcggacatcaaagtctctttttggcaatgggcacacgaagatggatggcccttcgatggccccggaggaattctcggccacgccttccttcccaatagtggtaaccctggcgttgtccattttgacaagaatgaacactggtccgcaagcgataccggctataatctttttctcgtggctacacatgagataggacacagcctgggattgcaacactccggcaaccagagctccatcatgtatcctacgtattggtatcacgaccccaggaccttccagctgagtgcggatgacattcagcggatccaacatctatatggggaaaaatgcagctccgacatcccatag

SEQ ID NO: 2940 - DNA, 1542 bp, Artificial Sequence
  Description of Artificial Sequence: Synthetic coding sequence
atgaagcgtctgttactgttattcctcttttttatcactttcagtagcgcgttcccactggtgagaatgacagagaacgaagagaatatgcaacttgcccaggcttacctcaaccagttttactcactggagattgagggcaaccacctggtgcagtccaaaaataggtctcttattgatgacaaaatccgcgagatgcaggcattttttggcctgactgtaaccgggaaactggatagtaacacactagagatcatgaagaccccacgatgtggggtgccagacgtgggacagtacgggtacactttacccggctggcggaagtacaacctcacctatcgaattatcaactataccccagatatggctcgggctgcagtcgatgaggccatacaggagggcttggaggtgtggagtaaagtgacacctctgaagtttaccaagattagcaagggtattgccgatattatgatcgccttcagaacccgggtgcacggtagatgtccgcgttattttgatggacctttgggcgttttgggccacgccttcccccccggccctggcctgggtggggatacccacttcgatgaggacgagaactggaccaaggatggcgctggatttaacctgtttctcgtcgccgcgcacgaattcgggcatgctctcggcctctcacacagcaatgatcagaccgctttgatgtttccaaattacgtgtccttggacccccgcaagtaccctctgtctcaggacgatattaacgggattcagtctatttacgggggcctcccaaaagagccagcaaagccaaaagaaccaaccattccacatgcatgtgatcccgatctcacatttgatgctatcaccaccttccgccgggaggtgatgttcttcaagggcaggcatctctggcggatctattacgacatcacggatgttgagtttgagttaatcgcaagcttttggccaagtctaccagcggacctgcaagctgcctacgaaaacccccgggacaaaatcctcgtttttaaggatgaaaacttctggatgatcagaggatacgctgtgctgcctgactatcctaagtcaatccacacgctcgggtttcccgggcgcgtgaaaaaaatcgatgctgctgtttgtgataagactactcgaaaaacctactttttcgtgggtatctggtgctggcggtttgatgaaatgactcagacaatggacaaaggattccctcagcgcgttgtcaagcattttcccggaatctctatcagagtcgatgccgcctttcagtataaaggtttttttttcttttccagggggagcaagcagttcgaatacgatatcaaaaccaaaaatatcacccggatcatgcggaccaatacctggtttcagtgcaaagagcctaagaactcgtcttttggtttcgatattaataaggagaaagcgcacagcgggggcatcaaaatactgtaccataagtctctatccttgttcattttcgggattgtgcatctactcaagaatacttcaatctaccagtag

SEQ ID NO: 2941 - DNA, 393 bp, Artificial Sequence
  Description of Artificial Sequence: Synthetic coding sequence
atggttgctagggtgggcctactgctgagagcattgcaactacttctgtggggccacttggatgcgcagcctgccgaacgtggagggcaggagctccgcaaggaagcagaagcctttctggaaaagtacggatatttgaacgagcaggtgcccaaagcaccgacttccacgcgtttctcagatgcaattcgggcatttcagtgggtgtcacagctgcccgtgtccggagtcctcgatcgcgcaacactgcggcaaatgacacgcccacggtgcggcgtcactgacaccaactcctatgcagcatgggccgagcgaatctctgatttgttcgctcgacacagaacaaagatgcggcgaaaaaaaagatttgctaaacagggtgaacactgctag

SEQ ID NO: 2942 - DNA, 1560 bp, Artificial Sequence
  Description of Artificial Sequence: Synthetic coding sequence
atggtggccagggtaggcttgttactgcgcgcattacagctgttactctgggggcacctggatgcccagccagccgagcgtggcggccaggaactccgcaaggaggcagaggcgtttctagaaaagtatggctacctcaacgaacaggtgcccaaagcaccaacttccacccggtttagcgatgctattcgcgccttccagtgggttagccagctgcccgtgtcaggggttctggaccgagcgacgctgagacagatgacaagaccacggtgcggcgtaaccgatacgaactcatatgcggcctgggccgaacggatcagcgatctgttcgcccgacacaggaccaaaatgaggaggaaaaaaagattcgctaagcagggtaacaaatggtacaaacagcacttaagttatcgtctggtgaattggccagagcaccctgaacccgctgtgagaggtgcagtgagggccgccttccagctctggtccaacgtgagcgctctggagttctgggaggctcccgcaaccggcccagctgacattcggcttaccttctttcaaggcgatcacaatgacgggctgggaaatgcctttgacggccccggcggagcgttggcccacgctttccttcctcgtcgaggagaggcacacttcgatcaagatgagcggtggtccctatctagacgccgggggcgtaacctgttcgtcgtgttggcacacgagattggtcacactctgggattaacacactctcctgcgcctcgggctctgatggccccatactataagcggctgggtcgggatgcactcttaagctgggatgatgttcttgccgtgcagtccctctacggaaagccactcggtggctcggtagcggtgcagcttccagggaaactgttcacagatttcgagacctgggattcctactctccacaaggaagacgacccgaaacccagggcccaaagtattgccacagttcgttcgatgcgattactgtggacagacagcaacagctatatatattcaaggggagccacttttgggaggtagctgccgacggcaacgtatcagaacctagacccctacaagaacgttgggtagggctcccgccaaacatcgaggccgctgctgttagcctgaacgatggtgacttctactttttcaagggcggtcgatgttggcggttccggggacctaaacccgtgtggggccttccgcagctgtgcagagccggtggcctccctcggcatccagatgccgctttatttttcccaccgctgcgacgactcatcctgttcaagggagcccggtactacgtgctggcaagaggcggccttcaggtagaaccctactatcctcgatccctccaagattggggcggcatccccgaagaagtgagcggtgctctgccacgtcccgacggttctataattttcttccgcgacgataggtactggagactggaccaggccaagttacaagccaccacaagtgggagatgggcaactgaactgccttggatggggtgctggcatgccaactccggctctgctctcttttag

SEQ ID NO: 2943 - DNA, 1179 bp, Artificial Sequence
  Description of Artificial Sequence: Synthetic coding sequence
atggtcgcgagggtgggattattgctcagggccctccagttgctgctgtggggccatctcgatgcacagccggcggaacgcggaggccaagaactacgaaaggaggctgaagcttttctggaaaagtacggatacttgaatgagcaagtccccaaggccccgacaagcactcgtttctccgacgccatccgagccttccagtgggtgagccaactgcccgtgtctggagtgctggaccgcgcaacactgcgacaaatgactcgcccccggtgtggcgtgacagacaccaacagttacgccgcctgggctgagcgtatctctgacctgttcgcgcgtcaccggactaaaatgcgacgtaaaaagaggtttgctaagcaaggcaataagtggtacaagcaacacctgtcatataggttagtgaactggcccgaacatcctgagcccgccgtgcggggcgcagtgcgcgcagcctttcagctatggtcaaatgtgtcagccctcgagttttgggaagcaccggcaaccgggcccgccgacattaggctgaccttcttccagggcgatcacaacgatggactggggaatgcattcgatggacccggtggtgctcttgctcatgcgttcctccctagacgcggtgaggcccatttcgaccaggacgagagatggagtctgtcccggcgccgtgggagaaacctgttcgtggtgctcgctcacgaaattggtcataccttgggtctgacacactctcctgcccccagggccttgatggctccttactataagcggctgggtagagatgccctgctctcctgggatgatgttctcgcagtgcagtccctctatggtaaaccattgggcggctcggtggccgtgcagcttcccgggaaactgttcaccgatttcgagacctgggactcttatagcccacagggacggcgccccgaaacacagggaccaaagtactgtcacagcagttttgacgcaatcaccgtagaccgccaacaacagctgtacatctttaagggatcccatttctgggaggtcgctgcggatggtaacgtgtcggaacccaggccacttcaggagagatgggttggcctgcccccaaatatcgaggccgcagcggtcagtttgaacgatggtgatttctattttttcaaagtgcaatccgtgtag

SEQ ID NO: 2944 - DNA, 678 bp, Artificial Sequence
  Description of Artificial Sequence: Synthetic coding sequence
atggttgcccgcgtaggcctgctgcttcgcgctctccagttattgttgtggggccatctggacgcccagcctgctgagagagggggccaggagctgaggaaggaagcagaggcgttcctcgaaaaatacggatacctcaatgaacaggtccctaaagcccccaccagtactcgcttctctgacgccatccgagctttccagtgggtgagccagttgcctgtttcaggagtcctggacagggctactttacgacagatgacccgaccccgatgcggcgtgacggatacgaattcatatgccgcttgggcggaacgtatttcagatctctttgcaagacatcggacgaagatgcgtaggaagaagaggttcgccaagcagggtaataagtggtataagcaacatctttcctatcgactggttaattggcccgaacacctaaggagcagacaatttggggctccatgcgcacccccctcatcctgtggcgcaacttctcagcgctggtcaagcgggcggcctcagcctcaggcacccctgacgtccggcagtccctcttctaaagggacaaccacgatggggtgggcgatgccactgatggcccaaggagccccatggcggacccctagttgccccgctgccgcgaaaaggacttcaacaaaaatgtcggctgggccttag

SEQ ID NO: 2945 - DNA, 1404 bp, Artificial Sequence
  Description of Artificial Sequence: Synthetic coding sequence
atgttcagtctgaagacgctaccgttcttgttgctgctgcacgtgcagataagtaaggcatttccggtatctagcaaggagaagaacactaagaccgtgcaggattacctagaaaagttctaccaactgccctcaaatcagtatcagtccacccgaaaaaatggcacaaacgtgattgtggaaaagctcaaggagatgcagcggttcttcgggttaaatgtgaccggaaaaccaaacgaagagaccctcgatatgatgaaaaagccacgttgcggtgtgcccgactctggaggtttcatgctaaccccaggtaacccaaaatgggagcgaactaacttaacctatcgcataagaaactacaccccacaactaagtgaagcggaagtcgagagggccattaaggatgcgttcgaactgtggagcgtagcatctccactcatcttcacccgaatctcacagggtgaagcagatattaacatcgcgttttaccagcgggaccacggggacaattccccattcgacggcccaaatggaatattagcccatgccttccaacctgggcagggcatcggaggcgatgcccactttgacgccgaagaaacatggaccaacacaagtgccaattacaatctttttctcgtagcagcccacgaatttggacattccttgggcctggcgcattctagcgatccaggggccctcatgtaccctaactatgccttccgggaaacatccaattactcgttgccccaggacgatattgacggtattcaagccatatacggcctttcaagcaaccctattcaacccaccggtccctccactcccaagccatgtgatccgtccttaaccttcgacgccattactactctgcggggagaaatcttgtttttcaaggacaggtatttttggagaaggcacccacagctacagcgcgtcgagatgaattttatctcactcttctggccatcactgcctacaggaatccaggcggcatacgaggacttcgacagggacctgatttttctgttcaaagggaaccagtactgggccctctcaggttatgacattctgcaaggctaccccaaggatatctctaattatggctttccatcctctgttcaggccattgatgctgcagtgttctatcgatcaaagacctacttttttgtgaatgatcaattttggcggtacgacaaccagcgccagttcatggaaccagggtatcctaagagcatcagtggcgcatttcccggcatcgaatctaaagttgatgccgttttccagcaggagcatttttttcatgtgttttccggtcctcgttactatgcattcgacctgattgcccagagagtcactcgggtcgcacggggtaacaagtggctgaattgtaggtacgggtag

SEQ ID NO: 2946 - DNA, 918 bp, Artificial Sequence
  Description of Artificial Sequence: Synthetic coding sequence
atgcagagatttttcggtctgaacgtgaccggtaagcctaacgaggaaacattggatatgatgaagaagccaagatgcggcgtcccggatagcggggggtttatgctgacccctgggaatcccaaatgggaaagaaccaatctcacatatcgcattcgaaactacacacctcagctatccgaagctgaggtagagcgggctattaaagacgccttcgaactgtggtcagtggcctcccccctcatattcacacgcatttcccagggcgaggccgacataaacatcgccttttaccaacgcgaccacggggataactctcctttcgatggcccaaacgggattctcgcgcatgcgttccagcccggccagggcattgggggggacgcacactttgatgctgaggaaacgtggacaaatacctctgccaattataacctttttcttgtcgccgctcacgaatttgggcactcactcggcctggcacattcctccgatcccggagcattgatgtacccaaactacgccttccgggaaacttctaactactcccttccccaggatgatattgacggcattcaggcaatctatggcttgagttccaacccaatccagcccacagggccctcaacacctaagccctgtgacccaagccttacattcgacgcaataacaacactgagaggggagattcttttcttcaaagacaggtatttctggcggaggcatcctcagctacagagagtagaaatgaactttatctctcttttctggcctagcttgcccacggggatccaagcagcatacgaggactttgacagggatctaatcttcttgtttaaagacatgataaccaaggataattcttggagccaggttattcctaaagcataccaggtacccttccgcaacagagaatag

SEQ ID NO: 2947 - DNA, 1284 bp, Artificial Sequence
  Description of Artificial Sequence: Synthetic coding sequence
atgcagcagatcccacaagagaaatcaatcaacgattacctggaaaagttctaccagcttccctccaaccagtaccagtccactcgaaagaacggaacgaatgtgatcgtcgaaaagcttaaagaaatgcagcggttcttcgggctcaacgtgacagggaagccgaatgaggagacactggatatgatgaaaaaaccccgttgcggggtgcccgacagcggggggtttatgttgacccctggcaaccctaagtgggagcgcacaaatctgacctatagaattaggaattacaccccacagctctccgaggccgaagtggagagagctataaaagacgcgttcgagctgtggtctgtggctagcccgctcattttcacacggataagtcaaggggaggctgatataaacatagcattctaccagagggaccatggtgacaacagtcctttcgatggtcctaacgggatcctcgcacacgctttccaacccgggcaaggcatcggaggcgatgcccatttcgacgccgaagagacctggacaaatacctctgccaactacaacctgttcctagtagctgcacacgagttcggccatagcttaggtttggcccatagcagcgatcctggggccctcatgtatccgaattacgcattcagagagacctcaaactacagccttccccaggacgatatcgacggtatccaggccatctacgggttaagctctaatcccattcagccaacaggccccagcacccctaagccttgcgacccctcactcacctttgacgcaatcactaccctccgaggggagatcctattttttaaggacagatacttttggaggcgacacccacaactgcaacgagtggagatgaacttcattagcctgttctggccgagcttacccacaggtattcaggcggcctacgaagacttcgacagagacctgatatttctcttcaagggaaaccagtattgggccttgtctggctatgacattttacagggctatccaaaggatatctcgaattacggctttccatccagcgtgcaagcaattgacgctgccgttttttatagatctaaaacctatttcttcgtcaacgaccaattctggcgttacgacaatcagagacagttcatggagccaggatatccgaagagcatctcgggtgcatttccaggaatcgaatctaaagtagatgccgtgtttcaacaggagcatttcttccacgtttttagcggtcctcgctactatgccttcgatctgatcgctcagtag

SEQ ID NO: 2948 - DNA, 954 bp, Artificial Sequence
  Description of Artificial Sequence: Synthetic coding sequence
atggccgtccagggctcacaaagacggttattaggctccctcaattcaacacccacagccattccacaactggggctcgccgccaatcagactggggcccgatgtctggaagtctccatatctgatggcctgtttcttagcctaggtctcgtctctttagtcgaaaacgccctggtggtggcaacaatcgctaagaataggaatctccactccccaatgtattgctttatctgttgcctcgctctgagcgatctgttagtttccggttccaacgtcttggaaaccgctgtcatcctcctactagaagcaggagctctggtggcccgggctgcagtgctgcagcaactggacaacgtcattgatgtgattacttgtagttcaatgctgtcttcactgtgtttcctgggtgccattgcggtggaccgctacatttcaatattttacgctttgcggtatcactccatagtcacactgccccgtgcgagaagggccgtagcagccatctgggtcgccagtgtcgttttctcaacactgtttatcgcctattatgatcatgtggccgttctgctgtgtttagtggtgtttttcctagccatgctagtgctgatggctgttctgtatgtgcatatgctcgctagggcttgtcagcatgcccaggggatcgcccgacttcacaaaagacagcgccctgtgcatcagggctttggactcaaaggcgctgtcacacttaccatcctcctgggaattttttttctttgctggggaccatttttcttgcatttaacactgattgtgctgtgtcctgaacatcccacatgcgggtgcatctttaagaattttaacctgttccttgcccttataatctgcaatgcaattatcgaccctcttatttacgcctttcactctcaggagttaagacgcacactgaaagaagtcctaacttgctcttggtag

SEQ ID NO: 2949 - DNA, 894 bp, Artificial Sequence
  Description of Artificial Sequence: Synthetic coding sequence
atgaaacacatcattaatagttacgaaaatatcaataatacagcccgcaacaactcggactgtccccgggttgtgctcccagaggaaatcttttttacgatatctatcgtgggagtgttggagaatctcatagtcctcctggcagtgtttaaaaataagaacttacaagcccctatgtattttttcatttgttccctggctatctccgacatgctcggctctctatataaaatccttgaaaatatcctcatcatcctgagaaatatgggatacttaaaaccacgcggaagctttgaaacaacagcagacgatatcatcgattcactgttcgtgttatctctccttggctcgatattttcactctcagtgattgctgccgacaggtacataaccatttttcacgcgctgcgataccattccatagtcacaatgaggagaaccgtggtcgtcttgactgtcatttggacgttctgcaccggaacggggatcacgatggtgatcttctcgcaccacgttcctactgtcataaccttcaccagcctgtttccactgatgctcgtgttcatcttgtgcctgtacgtgcatatgtttttgcttgctcgcagtcataccagaaaaatttctaccctgcccagggcaaacatgaagggagccatcacactcacaatactcttgggtgtgttcattttctgttgggctccatttgtgctgcacgtgctcctgatgaccttttgtccatcaaacccctattgcgcatgttatatgtcgttattccaggtcaacggcatgctaatcatgtgtaacgcagtaattgaccctttcatctatgcattcaggagcccagaactgcgggatgccttcaagaaaatgatcttctgttcacggtactggtag

SEQ ID NO: 2950 - DNA, 894 bp, Artificial Sequence
  Description of Artificial Sequence: Synthetic coding sequence
atgaaacacataattaattcttacgaaaacatcaataatacagcacggaacaattctgactgtccacgcgttgtgctgcccgaggagatcttcttcactatatccatcgtgggcgtgctggaaaatttgatcgtgctactggccgtgttcaaaaacaaaaacctccaagcccctatgtatttcttcatttgcagtctggcaattagcgacatgttgggctcgctttataaaattctggaaaatattttgattatactgaggaacatggggtacttgaagccaaggggctcatttgagacaacagcagatgacatcatcgacagcctgttcgtactctcactgctcggcagtatcttctcattgtctgtgatcgccgcagaccgatacatcaccattttccatgcacttcggtaccatagcattgtgactatgaggcgaaccgttgtggtcctgactgttatctggaccttctgcaccggcaccggtatcaccatggtgatcttttctcatcacgttcccactgttatcacattcacaagtctttttccgctgatgttagtattcatcttgtgtctgtacgtgcatatgttccttttagcccgttcccatacgcgaaaaatctcgacactcccacgggctaatatgaaaggtgctataactctgacgatccttcttggcgtttttatattttgctgggctccttttgtgctccacgtgctacttatgaccttctgtcctagtaacccatactgcgcctgctacatgtctctattccaggtcaacggaatgttgattatgtgcaacgcggtcattgatccattcatctacgcgttccgcagccccgagttgcgtgacgcattcaagaaaatgatcttctgcagtcgatactggtag

SEQ ID NO: 2951 - DNA, 972 bp, Artificial Sequence
  Description of Artificial Sequence: Synthetic coding sequence
atgaatgcatcgtgctgcctgccctctgttcagccaactctgcccaacggatcagaacacttgcaagccccctttttttctaatcagtccagttctgccttctgcgaacaggtgtttatcaaacccgaggtcttcctcagcctcggcattgtcagtcttctcgaaaatatattggtgatcctcgcagttgtacggaatggaaatctccacagcccgatgtacttctttctttgcagtctggccgtcgctgatatgctcgtgtccgtaagcaatgccctggaaaccattatgatcgcaatagtgcactcggattacctcaccttcgaggatcagttcattcagcacatggacaatatctttgatagcatgatttgcatctctctggtagcatcaatttgcaatctcctcgccattgctgttgacagatatgtcaccatcttctacgctctccgctaccacagtatcatgacagttcgcaaagcgcttacactgatcgtagcaatctgggtgtgctgtggagtctgcggggtagtcttcatcgtctatagcgaaagcaaaatggtcatcgtgtgcttgataactatgtttttcgctatgatgctgcttatgggaacactgtatgtgcatatgttcctgttcgctcggctgcacgtgaaacggatcgcagcactacccccagccgacggtgtagctccgcaacaacacagctgcatgaagggggccgtgactatcacaatcttacttggagtgttcatcttttgctgggctcctttctttttgcaccttgtgctaattatcacctgccccaccaatccatactgtatttgctacacagcacacttcaacacttacttagttttaattatgtgtaactccgttatcgaccccttgatctacgctttccgatctttagaactgagaaatacatttcgagagatcctgtgtggctgtaatgggatgaacctggggtag

SEQ ID NO: 2952 - DNA, 999 bp, Artificial Sequence
  Description of Artificial Sequence: Synthetic coding sequence
atggtcaatagcacccatcgaggaatgcacactagcctgcatctgtggaacaggagttcctatagactccactccaatgcatcagagagcctgggcaagggctatagcgacggcggatgttacgagcaactgttcgtcagcccggaagttttcgtaacattaggcgtaatctctctcctcgagaatatcctggtaattgtcgccatcgcgaaaaataaaaatcttcactcccctatgtactttttcatttgtagcttagcggttgcagatatgctggtgtcagtgtccaatggatcagagacaattgtgatcactttgcttaacagcacagataccgacgcacaatcttttaccgtaaatatcgacaatgtcatcgactccgtcatttgctcctcactcttggccagcatttgcagccttctgtccattgctgtggaccgatacttcacgatcttttatgctctgcagtatcacaatataatgacagtgaagcgggtgggcattatcatctcttgcatttgggccgcttgtactgtgagtggaatcctttttattatatacagcgattctagcgcagttattatttgccttattactatgttcttcacaatgctggcattgatggcttccctgtacgtgcatatgtttctcatggccagactgcacattaagagaatcgccgtgctgccagggaccggcgccatccgccagggcgcaaacatgaagggtgccatcacactgactattctgattggagtctttgtggtctgctgggcaccattctttctacacttgatcttctacatttcttgccctcagaatccatattgcgtctgctttatgtcacacttcaacctttacctcattcttatcatgtgcaactcaatcatcgaccctctgatttatgccctcagatcgcaggaattgcgcaaaaccttcaaggagattatctgctgctatcctcttgggggactctgtgacttgtcctctagatactag

SEQ ID NO: 2953 - DNA, 978 bp, Artificial Sequence
  Description of Artificial Sequence: Synthetic coding sequence
atgaactccagcttccacctccacttcctggaccttaacctgaacgcaacagaaggaaacctctctgggcctaacgtcaagaataaatcctcaccttgtgaagatatgggtatcgctgtggaagtttttcttacactcggggttataagtttactagagaacatactagttattggtgccattgtgaagaacaaaaatctgcacagccccatgtatttcttcgtgtgcagtctggcagtggcggacatgctagtttctatgagttctgcctgggagaccatcaccatttatcttctcaataataaacatctcgtgatagccgacgccttcgtccgccatatagataatgtattcgatagcatgatttgtatctcagtagtggccagcatgtgctcccttctcgccattgcggtggatcgatatgtgacgatcttttacgcccttaggtaccaccacatcatgactgcaagacgatcaggggccattattgcaggtatttgggcattctgcacaggctgcggaattgtgtttatcctttacagcgaatcaacttacgtaatcttgtgtttaatttctatgttttttgccatgctgtttttgctggtgtcactctacatccatatgtttctgctggctaggactcatgtcaagaggatcgcggctctgccgggcgcaagctccgcccgccagcgcacttcaatgcaaggcgccgtgaccgtaactatgctgcttggcgttttcacagtttgctgggccccatttttcttacatttaacactgatgctgtcgtgtccccagaatctgtactgctctcggtttatgagccattttaatatgtatctcatcctgattatgtgcaactctgtcatggatcccctcatctatgccttccgtagtcaggagatgcgcaagacttttaaagagatcatctgctgtaggggattcagaatagcctgctcatttccacgacgcgattag

SEQ ID NO: 2954 - DNA, 1242 bp, Artificial Sequence
  Description of Artificial Sequence: Synthetic coding sequence
atgctggaaatgctggagtacaaccactaccaagttcaaacccatcttgagaacccaactaaatatcacatccagcaagctcagcgccagcaggtgaaacagtacctttccacaaccctggccaacaagcacgccaaccaggtactgagcctgccatgcccgaatcagcctggggaccacgttatgcctccagtccccgggagctcagcccctaattctcccatggcaatgcttacactgaattctaactgtgaaaaggaaggcttctataagttcgaagaacagaatcgggctgaatcagagtgtccggggatgaatacccattcccgcgccagttgcatgcaaatggatgacgtcatcgacgacatcatcagcctggagtctagctataacgaagagatattggggctgatggatccagctctgcaaatggccaacaccctgcctgtgagtgggaatcttatcgacctctacggtaaccaaggactacccccacccgggcttacaatctctaatagttgtcccgcaaatctgcccaatataaagagggaactcacagaatccgaggcacgggccctcgcaaaggaacgccaaaaaaaggacaatcacaacctcatcgagaggaggcgacgtttcaatataaatgaccgtatcaaggagcttggtacacttattcctaaatccaacgacccagacatgcgttggaataagggaacaattttaaaagcttctgtcgactatatcagaaagttacagcgggaacagcagcgcgcaaaggaactcgaaaataggcagaagaagctagagcacgccaatagacatttgctgctgaggatacaggaactggagatgcaggcacgagctcacggattatcactaatacctagcactggcctttgctctcccgaccttgtcaacagaattatcaaacaggaaccagtgctggaaaactgcagccaggacctactgcagcaccacgccgacctgacatgtacgaccacactcgatttgacagacggcaccattacctttaataacaacctaggaactggcaccgaggccaaccaggcctattcagtccctactaaaatggggtctaagctggaggatatcctcatggatgacacccttagccctgtgggcgtcaccgaccccttgctgagctctgtgagtccaggggcttccaaaacatcatcgcgcagatcttctatgtcaatggaggagaccgagcacacctgctag

SEQ ID NO: 2955 - DNA, 1515 bp, Artificial Sequence
  Description of Artificial Sequence: Synthetic coding sequence
atggaagcgctacgcgtgcagatgttcatgccttgcagctttgagtctttgtatttgtcatcagcagagcatcctggagcaagtaagccccctatctcttcttcctcaatgacttcaaggatcttgctgcggcagcaattgatgcgcgaacagatgcaggagcaggagcggcgggagcagcaacagaaacttcaggccgcgcagtttatgcaacaaagagtacccgtgagccagactccggctatcaatgtctccgtgcccacaactctgccatcggccacacaggtacctatggaagttttgaaagtgcaaactcacctcgagaatccaacgaaataccacatccaacaagctcaaaggcagcaggttaaacagtatcttagtactaccttagcgaataaacatgctaaccaggtcctgagcctcccgtgcccgaatcagccaggggaccacgtcatgcctcccgttcccggatcatcagcccccaactcccctatggcgatgctgaccttaaactctaactgtgaaaaagagggcttctacaagttcgaagagcagaaccgagcagagtccgaatgccctggcatgaatacccactccagagccagttgtatgcagatggatgatgtgatcgacgacattataagcttagagtcatcctacaacgaggaaatattgggcctgatggacccagcccttcagatggcaaataccctccctgtgagcgggaacctcattgatctctacggtaatcagggactgccccctcccggactcactatttccaacagctgccccgctaatctgccaaacattaagcgggagctcacggagagcgaggcacgtgccctcgctaaggaaaggcagaagaaggataaccataacctcatcgaacgccgaagacgctttaacataaacgatcgcatcaaggaactcggcaccctgattcccaaatcgaacgatccagacatgaggtggaacaagggtacaattctcaaggcgagcgtcgattacatccggaagctccagcgggaacagcagagagcaaaggagctcgaaaacagacagaaaaaactcgaacacgctaacagacacctgcttctgcgcatccaggagctggagatgcaggcccgggctcacgggctctctctcataccatcaacaggcctgtgcagtcctgacctcgtcaatcggattattaagcaagagcccgtgctggaaaactgctcccaggacctgctgcagcatcatgccgacctgacgtgcactactacacttgacctgaccgatggaacgataacattcaataacaatctcggaactggtacagaggcaaatcaggcctactccgtgcccactaaaatggggagcaaactggaggatatcctgatggacgacacactcagccctgtgggggtaactgaccctttgctctcatccgtgtctcccggtgccagcaagactagctcaaggcggagcagcatgtccatggaggaaacagagcatacatgttag

SEQ ID NO: 2956 - DNA, 1560 bp, Artificial Sequence
  Description of Artificial Sequence: Synthetic coding sequence
atgggccatcttgagaatacctctgtcgtgttccctagagccatcttctccctctgtgagaaggaaactagaaagctgacactgtgtctcttttcacgttcctcaagcgccgagcaccccggagcttccaagccccctatatctagctcctccatgaccagtcgaatcctgttgagacagcagctgatgcgggagcaaatgcaggaacaggaacgccgcgaacagcagcaaaagctccaggctgctcagttcatgcagcagagggtgccggtgtcacagactcccgcaattaatgtaagtgtgcccactacactgccttccgccacgcaggtgccgatggaagtgctgaaagtccaaactcaccttgagaatcctaccaagtaccatatccaacaggcacaaaggcagcaggtgaagcaatacctgagtacaacgctcgccaataagcacgccaaccaggtgttgtcgctcccttgtccaaatcagcctggtgaccacgtcatgcctcccgtgcctggaagttctgctccaaactccccgatggccatgctgactctgaacagcaactgcgaaaaagagggattctataagtttgaagagcagaatagggccgaatctgaatgtccaggcatgaacacccatagccgggcatcttgtatgcagatggacgacgttattgatgatatcatcagtctagaatcatcatataacgaggagatcctgggattaatggaccccgcgctgcagatggccaacactctgcctgtgtccggcaacctcattgatctgtacggcaaccaaggcttgccaccccctgggctgacaatttcaaactcctgtcccgccaatctccccaacattaaacgcgagctgactgagagtgaggcacgagccctggcgaaggagaggcagaagaaggacaatcataacctcatcgaaaggcgccggagatttaatattaacgacagaataaaagagcttggaacattaatcccaaagtctaatgatcccgacatgcgatggaataagggaaccattctcaaggcatctgtggattacatccgcaagctgcagcgggagcaacagcgggcgaaggagctggagaaccgacagaaaaaactagagcatgcaaaccggcacctgctgttacgaatccaagagctggagatgcaggcgagggcacacggtctatcactcatcccaagtaccggtctgtgtagcccagatctcgttaacagaataatcaaacaggagcctgtcctcgagaattgcagccaggacctgctccaacaccatgcagacctgacctgtaccaccacgctcgaccttacggacggtactattacttttaacaacaatcttggcaccggaacggaggctaatcaggcatatagtgttcccactaagatgggaagtaagctggaggacatcctgatggatgatactttgtctcctgtaggtgtcaccgatcccctgctgtcttccgtgagtccgggagcctccaaaacatcttctaggcgctcctctatgtctatggaagaaactgagcatacttgctag

SEQ ID NO: 2957 - DNA, 1563 bp, Artificial Sequence
  Description of Artificial Sequence: Synthetic coding sequence
atgcagagtgaaagtggtatagtgcctgatttcgaagtaggcgaagagttccatgaggaaccaaaaacatattatgagctcaagagccaaccactgaagtctagctcatccgctgaacaccccggagcgagcaagccgccgatctcttccagctcaatgacatccagaatcctcctgagacagcagctgatgagagagcaaatgcaggagcaggagagacgggagcaacagcaaaaactgcaagccgcacagttcatgcagcagcgggtgccagtttcccaaacacccgctattaacgtgtccgttcccaccacattaccctcagcgacccaggtccccatggaggtcctgaaggttcagacacatcttgagaaccctaccaagtatcacatacagcaggcccaacgtcaacaagttaaacagtacctgtccacaaccttggctaataagcacgctaaccaggtgctctccctgccatgcccgaatcaaccgggggaccacgtgatgcctcctgtgccagggagctcggctcctaacagtcccatggccatgttgactctcaatagcaactgcgaaaaggagggcttttacaaattcgaggaacagaaccgcgccgagtccgagtgccccgggatgaatacccattcccgtgcttcatgcatgcagatggatgatgtaattgatgacataattagtctggaatcttcttacaacgaggagattctgggcttgatggacccggctctccaaatggcgaataccctgcctgtgtccgggaacctgatcgacctgtacggcaaccagggcctgccaccacctgggctcacaatctccaattcatgtccggcgaacctgcccaacatcaagcgcgaactgacagagagtgaagcccgcgccctagcaaaagaacgacagaagaaggacaaccacaatctaatcgaaagacgtcgtcgattcaatatcaacgatagaatcaaagaactgggtacacttatccccaaaagcaacgacccagacatgcggtggaataagggaacaatactcaaggcaagtgtcgactacattcgcaagcttcagcgcgagcagcaaagggctaaagagctcgaaaataggcagaagaaactggagcacgccaatcgccacttgctgttgcggatccaggagctggaaatgcaggctcgtgctcacggactgtccctaatcccctctactggcctatgtagtccagacctggtgaaccgcatcattaagcaggaaccggtgcttgagaactgttctcaggatctcctccagcaccacgccgatctcacatgcactacgacattagacctgacagatggaacaattaccttcaacaacaacctcgggacagggacagaagccaatcaagcctacagcgtgcccactaagatgggaagtaaactagaggatattctgatggacgatactctttccccagtaggcgtgactgacccattactgtcaagcgtgtctccgggggcctcaaagaccagttctaggagatcttccatgagtatggaagagacagagcatacatgttag

SEQ ID NO: 2958 - DNA, 1260 bp, Artificial Sequence
  Description of Artificial Sequence: Synthetic coding sequence
atgctcgagatgttagaatacaaccactaccaggtccagacacacctggaaaatcctaccaaataccacattcagcaggctcaaaggcaacaagtgaaacagtacctgagcactacccttgcgaataagcacgccaaccaggtcttatccctcccctgccctaaccagccaggagatcacgtgatgcccccagtgccaggttcctctgcccccaattcccctatggctatgctgactctcaactctaactgcgagaaggaaggcttctacaagtttgaagagcagaacagggcagagtcagaatgccctggaatgaatactcatagcagggccagctgcatgcagatggatgacgtgatagacgatatcatttccttagagtcttcatataacgaagagattctagggctgatggatcccgccctgcaaatggcaaacactttacccgtgtccggaaatctgatcgatctttacggcaaccagggactaccgccacctgggttgactatcagtaattcttgccccgctaatttacccaacattaaacgcgaattgacggcctgcatcttccccactgagtcagaagcacgcgcactcgccaaagagcgacagaaaaaggataaccacaatttgatagaaagaaggcggaggttcaacattaatgaccggattaaagaacttggaacccttatccctaagtctaatgatcccgacatgaggtggaataaaggcactatcctcaaagcatccgtcgactacatccgaaagctgcagcgcgaacagcaacgcgccaaagagttagaaaacaggcagaagaagctcgagcatgctaataggcacttactcctgcgtatacaggagcttgagatgcaggctcgcgcccatggcctgtccttaataccctccaccgggctatgttctccagacttagttaaccggatcatcaagcaagagcccgtgctggaaaattgcagccaagacctcctgcagcaccatgccgatctgacatgcactacaaccctggacctgacagatggcaccattacgttcaacaataacctggggacgggcaccgaggctaaccaggcatactccgtgcccactaagatgggaagcaagttagaagatattctcatggacgacacactatcccctgtgggcgtaaccgatcccctcctgtcctcagtttcccctggcgcttcaaagacttcatcacgccggagcagtatgtccatggaggaaacagagcatacttgttag

SEQ ID NO: 2959 - DNA, 1488 bp, Artificial Sequence
  Description of Artificial Sequence: Synthetic coding sequence
atgctatatgccttctggttttctcactcgtccagtgccgagcatccaggagcttcgaagcctcccatcagttcgtccagcatgaccagcagaattctgctcagacagcagctgatgcgggagcagatgcaagaacaggagagaagggaacagcagcagaaactccaggccgcacagtttatgcagcagagggtccctgtgtctcagacaccagctattaatgtcagcgtgcctacaactctgccaagtgcaactcaggtccccatggaagtgctgaaagtacagacacatctggagaacccgaccaagtaccacattcagcaggcccagagacagcaggtgaagcagtacctctccaccacactggctaacaaacacgccaatcaagtgttaagtttgccatgtcctaatcagccgggggatcacgtcatgcctccagtgccagggagctctgctccaaatagcccgatggctatgctgaccttgaattcaaattgtgagaaggagggattctacaaattcgaagaacaaaatcgcgcagagagcgaatgtcccggaatgaacactcattctcgggcgtcgtgtatgcagatggatgatgtgattgacgatataatctcattggaaagcagttacaacgaggagatcctcgggcttatggatcccgcgttgcagatggccaatacattacctgtctcaggtaacctaatagacctttatggtaatcagggcctacctcccccaggactcaccatttccaattcctgcccagcgaacctgcccaacatcaagcgggagttgaccgaatcagaagcgcgcgcattggccaaagaacgacagaagaaggacaatcacaatctcatcgaacgcaggaggcggtttaatatcaatgacaggataaaagaactgggcactttaatccctaagagtaatgatccagatatgagatggaataaaggaacgatcctgaaagccagtgtggactacattcgcaagctgcagcgcgagcaacagcgtgccaaggagctggaaaatcgccaaaaaaagctggaacatgcgaatcggcacctgttgttgcgcatccaagaacttgagatgcaggcacgtgcacatgggctgtctttaattccttcaactggactctgttcaccagatctggtgaaccgcattattaaacaggagcccgtccttgagaattgcagtcaggacctgctgcagcatcacgcggacctgacatgtactactaccctcgacctgaccgacggcacaatcacgtttaacaacaatctggggaccggaaccgaagctaatcaagcatacagcgtccctacaaagatgggcagcaagcttgaggacatcttgatggatgataccctttcaccagtgggagtgactgatcccttgttatcgtcagtatcaccgggcgccagcaagacatcgtccagacgcagttccatgagcatggaagaaaccgaacacacctgttag

SEQ ID NO: 2960 - DNA, 1581 bp, Artificial Sequence
  Description of Artificial Sequence: Synthetic coding sequence
atgcaatcagaatccgggattgtcccagactttgaagtgggtgaggagttccatgaggaaccaaagacatattacgagttaaagagtcagcccttgaagagctctagttctgctgagcatcccggcgcctccaaaccacccatttcctctagtagtatgaccagtagaatactgctccgtcagcagctgatgcgggaacagatgcaggagcaggaacgaagagagcagcagcaaaagcttcaggcagctcagtttatgcagcagcgggtccctgtatcccagactccggccattaacgtgtcagtacccaccaccctgccatcagcaacgcaagttccaatggaagtgcttaaggtgcagacgcatctggagaaccctaccaagtatcacattcaacaggcccagcggcaacaggtgaagcagtacttgagcactacactggccaacaaacatgcaaatcaggtgctgtccctgccttgtcccaatcaaccgggggatcacgtgatgcctccggtgcctggttcctcggctcccaattcgccgatggctatgttaacgttgaattcaaattgtgagaaggaaggcttctacaaattcgaggaacagaatcgagcagagagtgagtgccccggtatgaacacacatagcagagccagttgcatgcaaatggatgatgtgattgacgacatcatatctctggagtcatcatacaatgaagagatcctaggactcatggaccccgctctgcagatggctaataccctccccgtttctggaaacctcatcgatctctacggcaaccaaggtctcccaccccccgggttgacaatctcaaatagttgtccagctaaccttcctaatattaagcgagagcttacagcatgtatttttcccacagagagtgaggcaagggccttggccaaggagcgacaaaagaaggacaaccacaatctgatcgagcgccgtaggcggtttaatattaatgaccgcatcaaggaactggggacactcatccctaaatccaatgatcccgatatgagatggaacaaagggactatcctgaaagccagcgtggattacattcgcaagctgcagcgagagcagcagcgcgctaaggagctggaaaatcgtcagaaaaagctggaacacgcaaaccgtcatctgctgctccggatccaagaactggaaatgcaggccagagcccatggactgagcttgataccttctacaggactgtgctcccctgatctggtaaaccgaattatcaaacaggagcctgtactggagaactgtagccaggatctgttgcagcatcatgccgacctgacgtgtacgactactctcgatctgaccgatggtacaatcacctttaataacaaccttgggacaggcacagaggctaaccaggcatattcagtgcccacaaagatggggtccaagttagaagacatcttaatggacgacacactgagtccagtcggggtaacggaccctctgcttagctccgtgtcacccggcgcgagcaaaaccagctcacggcgctcatctatgtctatggaagaaacagagcacacatgttag

SEQ ID NO: 2961 - DNA, 1086 bp, Artificial Sequence
  Description of Artificial Sequence: Synthetic coding sequence
atggaggccctgcgcgtgcagatgtttatgccgtgtagcttcgaaagcctttacctgagtagcgccgagcacccaggtgccagcaagcccccaattagtagctccagcatgacatctaggatcttattacggcagcagcttatgagagaacagatgcaggaacaagagcgccgcgagcaacaacagaagctccaagctgctcagtttatgcagcagcgagtccccgtcagccaaacacctgctatcaacgtcagtgtgcccacaacactgcccagcgctacccaggtgccaatggaagtcttgaaggtgcagacccacctggaaaatcccaccaagtaccatatccagcaggcgcagagacagcaagtaaaacagtaccttagcaccacactggcaaacaagcatgccaatcaagtgctttcacttccgtgccccaatcagccaggggaccacgttatgcccccagtccccggctccagcgcacctaactcaccaatggcaatgttaacacttaatagtaattgtgaaaaggagggattctataagttcgaagagcagaacagggcagaatctgagtgccccggtatgaatacccactcacgcgccagttgtatgcaaatggatgatgttattgatgatattatctccctcgaatccagttataatgaagaaatccttggattgatggatcctgcactgcagatggctaacacactgcctgtgtcagggaatctgatcgacctgtacggaaatcaggggctaccacctccagggctcaccattagtaacagctgccctgcaaacctgccaaacattaagagggagctcacagcttgcattttccccaccgaatcggaggcacgggccctggccaaggaaagacagaagaaagataatcacaacctgatcgaaaggcgcagaaggttcaacatcaatgacagaatcaaggagttgggaactcttatccctaaatcaaacgacccagatatgcgctggaataagggcacaatccttaaggcttccgttgactacatcaggaagctgcagcgcgagcagcagagagccaaggagctggagaaccgatag

SEQ ID NO: 2962 - DNA, 354 bp, Artificial Sequence
  Description of Artificial Sequence: Synthetic coding sequence
atgggacacttggaaaacacgagcgtagtgtttccgcgggctatcttttcactgtgcgagaaggaaacacgcaagctaaccctttgtcttttcagcaggtcatcctccgccgagcatccaggtgcctccaagccccccatcagttcaagtagcatgacctcacggattcttcttagacagcagctcatgcgcgagcagatgcaggaacaggagcgacgggaacagcagcagaaattacaggccgcccaatttatgcaacagcgcgtccccgtgagtcagacaccagccattaatgttagtgtaccgactacccttccttctgccactcaagtccccatggaggtcctcaagtag

SEQ ID NO: 2963 - DNA, 1074 bp, Artificial Sequence
  Description of Artificial Sequence: Synthetic coding sequence
atgctagaaatgctcgaatacaaccactaccaggtacagacacacctggagaacccgacaaagtaccatattcagcaggcccagaggcagcaggggttctataaattcgaagagcagaaccgcgcagagtccgaatgcccgggtatgaacacccatagtagagcctcttgtatgcagatggatgacgtaatagatgatataatttccctggagagtagttataatgaggaaatcctgggcctgatggatccagccttgcagatggcgaacacgctgcccgtgtcagggaatcttattgatttatacggaaaccagggtctccctccccctggccttaccatttccaactcatgcccagccaatttaccaaacatcaaacgggagctgactgaatcggaagccagggcacttgccaaggagcgccagaagaaagataaccataatctcatcgagcgacgaaggaggtttaacatcaacgatagaatcaaggagctggggacacttatcccaaagtctaatgaccctgatatgagatggaacaagggaactattctgaaggcctcagtggattacataagaaaactgcagcgagaacaacaaagggctaaagagctggaaaacagacagaagaagctggagcatgccaatcgacacctcctgctgcgtatccaggaacttgagatgcaggcacgggctcacggactgtccctcatccccagtaccggcctgtgctccccagacctggttaacagaattatcaaacaagagcccgtgttagagaattgtagccaagacttacttcagcatcacgccgacctgacctgcaccacaactctggacctgacagatggaacgataacttttaacaataacttgggtactggtaccgaagccaaccaggcgtattccgtgcctaccaaaatgggctcaaagttagaagacattctaatggatgatacgctttcacccgtcggcgttaccgatccactcctgtcaagcgtgtcccccggcgcctccaagacctcttcccgccgcagctccatgagtatggaagaaaccgagcatacgtgctag

SEQ ID NO: 2964 - DNA, 1407 bp, Artificial Sequence
  Description of Artificial Sequence: Synthetic coding sequence
atgacatcacggatccttttgcgccagcaattaatgcgcgagcagatgcaggagcaagaacggcgggaacaacagcagaagctgcaagctgcccagttcatgcagcagcgtgtgcctgtgtctcaaaccccagctatcaatgttagcgtgcccacgactcttccatctgctacacaggtaccaatggaggtgctgaaggtccagactcatttagaaaatcccaccaaatatcacatccagcaggcccagcgccagcaggtcaaacaatatttaagcactactcttgcaaataagcacgcaaaccaagtgcttagtctgccgtgtcctaatcagcctggtgaccatgtgatgcctcctgttcctggtagttccgcacctaactctccgatggccatgctgacattaaatagtaactgtgagaaggagggcttttacaagttcgaagaacagaatagggccgagtctgaatgtcctggcatgaatactcatagccgcgctagctgcatgcagatggatgacgtgattgatgacattattagtctagagagtagttacaacgaagagatcctgggactgatggacccggcactacagatggccaataccctccctgtctccggaaatttgatagatttatatgggaaccagggacttccccctccagggttaaccatctcaaacagttgcccagctaaccttccaaacatcaagcgcgagcttacagagtctgaggctcgggccctcgcaaaagaaagacagaagaaagacaaccataatctgatagaacgccgcaggcgcttcaacattaacgaccgcattaaagagctcggtacactaatccctaagtccaacgacccagacatgcgctggaacaaagggaccattctgaaagcaagcgtcgactatattcgaaagctacagcgcgaacagcagcgcgccaaggaacttgaaaatcgccagaaaaaattggaacacgccaatcgacacctcctgctgcgaattcaggaacttgagatgcaggctcgtgcacacgggctgtcccttatcccgtctactgggttatgtagtcctgatttggttaacaggataattaagcaggaaccggtgctcgagaactgtagccaggatctcctgcagcaccacgctgacttaacctgcactaccaccctggatttgactgatggtactatcacttttaataataatctcggtaccggaacggaggcaaatcaggcgtattctgtaccaacaaagatggggtcgaaactcgaggatatccttatggacgacactctcagcccagtcggggtaacggaccccctgctgtccagtgtttcccccggggcatccaaaacctccagcaggcgctcttcaatgagtatggaggagactgaacacacttgctag

SEQ ID NO: 2965 - DNA, 4422 bp, Artificial Sequence
  Description of Artificial Sequence: Synthetic coding sequence
atggccgggggggcttgggggaggctcgcatgctacctagaattccttaaaaaggaagaactgaaagaatttcagctcctgttagcgaataaagcacacagccggagctcaagcggagagacccctgcccagcccgaaaagacatcaggtatggaggtggcatcatacctggtggcccagtacggtgagcagcgggcctgggacctcgcgctccacacctgggaacagatgggattgcgcagcttgtgtgctcaggctcaggagggggccgggcacagcccctctttcccatacagtccgtccgagccacacctaggttcgccctcacagccaacatctacggcggtcctcatgccttggatacacgagctgcctgccggatgcacccagggaagcgaaagacgggtacttaggcagctcccagacacctccggccgtaggtggcgggaaatcagtgccagtctgttgtaccaggctctgcccagctccccggatcacgaatcgcctagccaggagtctcctaacgcaccaacatccacagccgttctggggagctggggttcccccccgcagcccagcctcgcaccgcgcgagcaagaggctcctggcactcagtggccattggatgaaacctctggcatctactacacggagattagggagagggaacgggaaaagtctgagaaggggcgacccccctgggcagccgtggtgggcacacccccccaagcacacaccagtttacaacctcatcaccacccttgggaaccgtctgtcagggagtcgctgtgttccacctggccctggaagaatgaggacttcaatcaaaagtttacgcaactcctgctacttcagagaccgcatcccaggagccaagatcctttggtgaaacgttcttggcccgactacgtggaggagaaccggggccacctgatcgagatccgggacctgttcggacccggcctggatacccaggaaccgagaattgttatactccagggagccgccggaatagggaagtctactcttgccagacaggtcaaggaggcatggggtcgaggtcagctttacggggatcggtttcaacacgtattctacttctcctgtcgggaacttgctcagagcaaggtggtgtctctggccgagctgattggaaaagacggtaccgccactccagcacctattaggcaaattctctctaggcctgaacgcctcttatttatcctggatggagtggacgagcctggctgggtgctgcaagagccaagctccgagctgtgtctccattggagtcagccccagcctgccgacgctctcctggggtcactcctcggtaaaactatccttcctgaagcaagtttcctgatcacagcaagaactaccgctttacagaacttaataccgtctctggagcaggcaaggtgggtcgaagttctaggctttagcgagtcctctcgcaaggaatatttctaccgctatttcacggacgagcggcaagctatccgggctttccgcttagtgaaaagtaacaaggaactctgggccctctgcctggtgccatgggtatcctggctggcatgcacatgcctgatgcaacagatgaaacggaaagagaagctgacactgacttccaagactacaacgacactgtgtcttcattacttggcacaagccctgcaggcccagccgctgggcccgcagctcagagacctttgttcactggccgccgagggcatttggcagaagaaaaccctgttctccccagatgacctgcgcaaacacggcttggatggtgctatcatctccaccttcctgaagatgggcatactgcaggagcaccctatccccctgtcatatagctttattcacctctgcttccaggaatttttcgcagcaatgagctatgttctggaggatgagaagggtagaggtaaacatagcaactgcatcattgatctcgagaagaccctagaagcatatggcatccatggtctctttggggcctcgacgactcgctttctattgggcctgctgagtgatgagggtgaaagagaaatggaaaacattttccattgtcggctcagccagggccgtaacttgatgcagtgggtgccctcgttacaattgctgctccagccccatagccttgagtctttacattgtctgtatgagaccaggaataaaacattcttgacccaggtgatggctcatttcgaggagatgggaatgtgtgtggagactgacatggagctcctggtgtgtacattctgtattaaattttcacgccatgtgaaaaagctgcagctgattgagggcagacagcataggtctacatggtctccgactatggtcgtcctgtttagatgggtccctgtcaccgatgcctattggcaaatcctgttctccgtcctcaaagttacacggaatcttaaagagctggacctatctgggaacagcctcagccacagtgcggtaaaaagcctgtgtaagaccctaagaagaccacggtgtttattagagaccctgagactcgccggctgtgggcttacggccgaagattgcaaagacctggctttcggtttgcgtgcaaaccagacgctcaccgaactcgatctgagctttaacgtgttaaccgatgcaggcgccaagcacctatgtcagcgtctccgacagccttcctgtaagctgcagaggctgcagctggtctcttgcggtctaaccagcgactgctgccaggatctggcaagtgtgctatctgcaagcccaagcctgaaggagctggacctgcagcagaacaatctggacgatgtgggggtgcggctgctatgtgagggcttacgccacccggcgtgtaagcttatccgcctgggattggaccagaccaccctctctgacgagatgaggcaagagttacgggcgttagagcaggagaaaccccagcttctgatttttagtcgccgaaaacccagtgtaatgaccccgaccgaaggcttggatacaggcgaaatgtccaactctacatcgtccctcaagaggcaacggctaggttcagaaagagcggcttcccacgtcgcacaagccaatctgaagttgctggacgtgagtaaaatatttccaatcgccgagatcgctgaggaaagctctccagaggttgttcctgtggagctgctctgcgtgccaagccccgccagccagggcgatctacacactaagccattgggaaccgacgacgacttctggggccccacaggcccagtagccactgaggttgtcgacaaggaaaaaaacctgtacagggttcattttcctgttgccggaagttatcgatggcctaacacaggtctgtgcttcgtgatgcgagaagccgttaccgtggaaattgaattttgcgtctgggaccagtttttaggggaaataaacccacagcattcatggatggtggctggtccactcctcgacataaaggcagagccaggagccgtggaagccgtgcaccttccacatttcgtggccttacaagggggtcacgtggatacctccttgttccagatggctcacttcaaagaggaaggcatgttactcgagaagcctgcaagagtggaactgcaccacatcgttctggagaatcctagtttctcccccctgggggtcctgctcaaaatgatacacaacgcgttaaggtttattcccgtgaccagcgtagttctgctgtaccaccgtgttcatcctgaggaagtgactttccatttgtacctaattccctccgattgttctatcagaaaggccatcgatgatctggaaatgaagttccaattcgtgcgtatacacaagccacctcctctaacgcctctttatatgggttgtcggtacactgtgtccggatcaggctccgggatgctggaaatcctaccaaaagaattagaactgtgttatcgaagccctggggaggaccagcttttctccgagttttacgttggccacctgggaagtggaattcggctccaggtcaaggacaagaaagacgaaacattggtctgggaagccctggtgaagccaggggacttgatgcccgcaacaacattgataccaccagcgagaattgccgtgccctcacctctggacgctccccaactccttcactttgttgaccaataccgagaacagctgattgccagggtgacatccgtcgaagtggtgctggataagttacacggacaggtgctgtcccaggagcagtatgagagggtcctcgcagaaaatacacggccctcccagatgcggaaactgttcagtttgtcacagagttgggacaggaaatgtaaagacggcctgtaccaggccctcaaggagactcaccctcaccttatcatggagttgtgggagaagggatctaagaagggtctactcccattgtcctcatag

SEQ ID NO: 2966 - DNA, 4200 bp, Artificial Sequence
  Description of Artificial Sequence: Synthetic coding sequence
atggcgggaggcgcatggggccgtttggcttgctacctcgaattcctgaaaaaagaagagctgaaagaattccagttgctgttagccaataaagcccacagccgatcctcttcaggcgagacacccgctcagccggaaaaaacgagcggcatggaggtggccagctatttggtggcgcagtatggcgaacagcgggcatgggatctggcactacatacctgggagcagatgggcctccgctcactttgcgcccaggcccaggaaggggctgggcacagcccctcttttccctattccccgagtgaacctcacctcgggtcacctagccagccaactagcacagctgtattgatgccatggatacatgaactgcccgcaggttgcactcaggggtccgagcgccgggtgcttagacagctgcctgacaccagcggacggagatggcgggagatttctgcgagcctcttatatcaggccttaccctcttccccagatcatgagtcaccttctcaagagagcccgaacgcacccacaagtaccgccgtcctaggctcttggggttccccacctcagccctctttagcccccagagagcaagaagctccaggcacacagtggcccctggatgagacctctggcatttattacacagagatcagagagcgagaacgggaaaaatcggaaaaaggccgccctccatgggccgctgtggttggcaccccccctcaggcccacacctctttgcagccccatcatcacccttgggagccttccgtcagggagtcgctctgctctacctggccatggaagaacgaggattttaatcagaagtttacccaattgcttctcctacagcggccacatcctcgtagtcaggatccattagtgaaaaggtcctggcccgactacgtggaggaaaatcgtggacacctaatcgaaatccgcgatctgttcgggcctggtctggatactcaagagcctcggatcgttatccttcagggagcagctggcatcggaaaatcaacgctagccaggcaggtaaaagaagcctggggacgagggcagttatacggggacagatttcagcatgttttttatttctcctgcagagagctggcccagtcgaaggtcgtttccctggccgaactcattggaaaagatgggacagcgacaccagcccctatccgacagattctgtccagacccgaaagactgctatttattctggatggagtggatgagccgggatgggtgctccaggagccatcttccgagctctgcttgcactggtctcagccccagccggcagacgcactccttggcagccttcttggtaagaccatcctgcccgaggcctcattcctcatcacagctcgtactacagcacttcagaacctcattccatctctagagcaggctcggtgggtggaggtgttggggttcagcgagagctccagaaaggaatacttctatcgctacttcacagacgaacgccaggccattcgcgcattcaggcttgttaaatcgaacaaagagctgtgggccctgtgcctggtgccatgggtctcctggcttgcatgcacgtgtctcatgcagcagatgaaaagaaaagaaaagcttacacttacctcgaaaaccacgacaaccctctgcctgcactatctcgcccaggccctccaagcccagcctctaggcccccagcttagagacttgtgctcattagcagccgaggggatctggcagaaaaagacgctctttagccccgacgatctgcgaaaacatggccttgacggcgccataattagcacctttttgaaaatggggatactccaagaacacccaattcccctgagttacagcttcatccacctttgtttccaggaattcttcgccgctatgtcttacgtcctggaggacgaaaagggacgtggtaagcatagcaattgtatcattgacctggagaaaacattggaggcctacggtattcacggtctcttcggcgcttcaaccactcgttttcttctcggcttgctttccgacgagggagagagggagatggaaaacatctttcactgtaggctgagtcagggacgcaacctgatgcaatgggttccttccttacagctgctgttgcaaccacacagcctagagagcctccactgtttgtacgagacacggaacaaaaccttcctgacccaagttatggctcactttgaggagatgggcatgtgcgtggagaccgatatggagcttctcgtatgcacattttgtataaagttcagtcggcatgtcaaaaagctccagcttatcgagggaagacagcaccggtcgacgtggagtccaacaatggtggtcctgttccgatgggtgcctgtcactgacgcctactggcaaattttattttccgtgctgaaagttacccgcaacctcaaggaactggatctcagcggcaatagtttgtcacacagcgcagtgaaatccctgtgtaaaaccctgcggcgcccccgatgtctgctggaaacccttcggcttgctggctgcggactgacagccgaggactgtaaggatctggcgttcgggctgagggcaaaccaaacgctcaccgaactcgacctcagttttaatgtgttgacagacgccggagccaagcacctgtgccagcgactaaggcaaccttcatgtaagctgcagcggttgcagctggtcagttgtgggctgacgtctgactgttgtcaggatctcgccagtgttctgagcgcgagcccctcactgaaggaactggatcttcagcagaataacctcgacgacgtcggggtgcgtctgttgtgcgaagggctgcgtcatccagcttgcaagttgattcgattggggaagcccagcgtgatgacccctacggaaggcctcgacacaggagagatgtccaattctacttcatctttgaaacgccagcgattgggctctgaacgggcagcaagtcatgttgcccaggccaacttgaagttgcttgacgtctctaaaatattccccatagcagagattgcagaggaatcttctcccgaagtggttcccgtggagttactgtgtgttccctcacccgcttcccaaggcgatctccataccaaacccttaggcaccgacgatgacttttggggtcctaccgggccggtggccaccgaggtggtggacaaagagaagaatctctatcgggttcattttcctgttgcaggatcctatcgatggccgaataccggactgtgctttgtgatgcgcgaggccgtgacggtcgaaatagaattttgcgtgtgggaccagttcctaggggagatcaatccccagcattcgtggatggtggccggtcccctcttagatattaaagccgagcctggcgccgtcgaagccgtacacctcccacattttgtggcactacagggtggccatgtggacactagcctttttcagatggcacacttcaaagaagaagggatgctccttgagaaaccggcaagagtggaactgcaccacatagtgctggaaaacccctccttttctcccctgggagtcctgcttaagatgattcataatgcccttcggttcattcctgtaaccagcgtcgtgttgctttaccatcgcgtccatcctgaggaggttacctttcacctctaccttattccttccgattgttccattcggaaagaacttgagctttgctaccgaagccctggcgaggaccagctgttttccgagttttacgtgggtcatttgggctctggtattaggctccaagtgaaggataaaaaagatgaaactctggtgtgggaggcactcgtgaaaccgggcgacctcatgccagcaaccacactgatcccgcccgcacggatcgccgttccctctcctctggacgccccacaactgctgcactttgtggaccagtatagagaacagctgatcgcccgcgtgacctctgtagaggttgtcctcgataaacttcacggacaggttctcagccaggagcagtatgagagggttcttgccgaaaataccagaccctcgcagatgagaaaactctttagcttgtctcaatcctgggaccgtaagtgcaaggatgggctctaccaagctttaaaggagacccatcctcatctgattatggagctgtgggagaaggggtccaaaaagggccttctgcctctgtcctcctag

SEQ ID NO: 2967 - DNA, 4128 bp, Artificial Sequence
  Description of Artificial Sequence: Synthetic coding sequence
atggctggtggggcctgggggcggctggcctgttaccttgaattcttgaaaaaagaagagctcaaggagttccagctgctgcttgctaacaaggcccatagccgatccagctccggagagactccagcacaaccagagaagacgagcgggatggaggtcgcctcttatctcgtggcccagtatggagaacagcgggcctgggatctagctctccacacatgggagcagatgggcctccgatcactgtgtgctcaggctcaggagggcgccggccacagccccagtttcccttattctcccagtgaaccacatctgggctctccttcgcagccaacatccactgccgtcttgatgccatggattcatgagctgccagctggttgcactcagggatccgagcgccgggttctgagacagctccccgacacttctggccgacggtggagggaaattagcgcctcactgctctatcaggcgttgccctcatctcccgaccacgagtcccctagtcaagaatctcccaacgcccctactagtacagcagttctgggatcttggggcagccctcctcagccctcgcttgccccgagggaacaggaagctcccgggacccaatggcctctcgatgagacctcaggaatctactacactgagatcagggaacgcgagagagagaagagtgagaaaggccgtcccccatgggccgccgtcgtagggacaccacctcaggctcatacatccctgcagccccatcaccatccctgggaaccttccgtccgagagtcgttgtgctccacctggccgtggaagaatgaggactttaatcagaagttcacccagctgctgttgctacaacggccccatcctaggtctcaggatccccttgtgaaacgaagctggcccgattacgttgaggagaataggggccatctgatagagatccgggatttattcggcccgggcctggacactcaggagcctaggatcgtgattctgcagggggcagctggaattggtaagtccacgctggcaaggcaggtgaaggaggcctggggcaggggccagctctacggagataggttccaacacgttttctacttctcctgcagggaattagcccaatccaaggtggtgagccttgccgaactgattggaaaggatggcactgctacacccgcgcctattaggcagatcttgtcacggcctgagaggctgcttttcattttagatggcgtggacgagcccggctgggtgttgcaagaaccttcttcagagttgtgcctacattggtcccagccacagccagccgatgctctgctgggcagcttactcggcaaaactattctcccagaggcatcttttcttatcaccgcccgaaccaccgcactgcaaaatctgattccaagcctggaacaggctcggtgggtcgaggtgttgggttttagtgagagttcacgcaaggagtacttctaccgatacttcaccgatgaacgccaagcaattagggccttcagattagtgaagtcaaataaggaactgtgggccctgtgccttgtcccctgggtgtcttggctggcatgcacttgccttatgcagcagatgaaaagaaaggaaaagctgactctgacgagcaaaacgactaccactctctgcttgcactatctggcacaggctctgcaggctcagcctctgggaccccagcttagagatctatgttctctggctgcagagggtatctggcagaaaaagacactcttttcgcctgatgaccttaggaagcacggccttgatggcgccattatctctacgtttctgaagatgggcatcctgcaggagcaccctatccccttgtcctattccttcattcacctctgctttcaggaattttttgccgctatgagctacgtgttagaagacgagaaagggcggggcaagcactccaactgtattattgacttggaaaagacactcgaggcctacgggatccacggactgtttggggcctctaccacacggtttcttctgggccttctgagcgatgagggcgagagggagatggagaatattttccattgcagactctcacaaggcaggaacctaatgcagtgggtaccatccctacagctcctgctgcagccccattctctcgagtcactgcactgtttatacgagacgcggaataaaacctttctcacccaggtgatggcacattttgaggaaatggggatgtgtgtagagacagacatggagctgctggtgtgcaccttctgtatcaagttctcacggcacgtcaagaagctccagctgattgaggggcgacagcaccggtctacttggagccccaccatggtggtactgttccgttgggtacctgtcacagatgcatattggcagatactattttctgtccttaaagtgacaagaaatctgaaagaactggatctctccgggaattccctgagtcattccgcagttaaaagtctgtgcaagacactccggcgccctaggtgtctgctggagacacttagactagccggctgtgggttgacagccgaagattgtaaagacttggcttttgggctgcgtgctaaccagacgctaacggaacttgacctgtccttcaacgtgctgaccgacgcaggcgccaagcacctgtgtcagcggctgcgccagccctcatgcaagcttcagcggctgcaactggtatcgtgtggattaacaagtgactgttgtcaggacctcgcctctgtgctgagcgcctctccatccttgaaagagctagatctgcagcagaacaatttggatgacgtcggggtcaggttgctatgtgaggggctgcggcatcctgcttgcaaattaatacgcttgggccttgaccagactacactatctgacgagatgcggcaggagctgcgagcgctggagcaggagaagccccagctcttgatcttctcacgtcgcaaacctagtgtaatgactcctacggaaggtctggatacaggagagatgtcaaactccacgagttctctgaaacggcagcgcctgggaagcgaacgagccgccagccatgttgcccaggccaacctgaagctgctggacgtgtccaagattttccccatagctgaaattgccggcaaaagccacgaggagtctagccctgaagtagtgcctgtggagctattgtgtgtccctagtcccgccagccagggcgaccttcatacaaagcctcttggcactgacgacgatttttggggacccacagggcctgttgcgaccgaggtggtagataaggagaagaatctctatcgtgttcacttccctgtggccgggagttaccgatggcctaacactggcctgtgcttcgtgatgagagaggccgtgacagtggaaattgagttctgtgtgtgggaccagtttttgggcgagatcaatcctcagcattcatggatggtggccggacctttgttggatatcaaggcagagccaggagctgtagaagcagttcacttaccccatttcgtggcccttcagggcggacacgtcgacacatcactctttcagatggctcatttcaaggaggaggggatgctcctggagaaacctgcccgagttgaactccaccatatagtgctggagaacccaagctttagcccgctgggcgtcctcctgaagatgatccataatgcacttcggttcataccagttactagcgttgtcctcctgtatcaccgggtgcaccctgaagaggtgaccttccatctgtatctcatacccagcgattgcagtattcgtaaggccatcgatgatctggagatgaaattccagtttgttagaattcacaagcctccccctctgactccgctgtacatggggtgtcgatacaccgtgagcggatcaggctccgggatgctagagatcctgcccaaagagctggaactgtgctaccgctcacctggtgaagaccaactcttttctgagttttacgtggggcacctggggagtggcatccgcctgcaggtcaaagacaagaaagacgagaccctggtttgggaagcactcgtcaaacccggccggaatacgtcacagccttggaaccttcgatgtaacagagatgcaagaaggtactag

SEQ ID NO: 2968 - DNA, 4422 bp, Artificial Sequence
  Description of Artificial Sequence: Synthetic coding sequence
atggcagggggggcttgggggaggttagcgtgctacctggaatttctcaaaaaggaggagctgaaggaatttcagctcctgcttgccaataaagcccattctcgctctagcagtggcgagacacctgctcagccagaaaagaccagcggaatggaggttgcctcctaccttgtggcacagtatggggagcagagggcctgggatctggctctccacacttgggaacaaatgggcctgcgctcactgtgcgcccaggcccaggagggagccggacatagcccttccttcccttacagtcccagtgagcctcacctgggctccccctctcagcccacaagtacagctgttctcatgccatggatccacgagcttcccgctggatgtacgcagggcagtgaaaggcgggtgctgcgtcagctgcccgacacctcgggccggcggtggagagaaattagtgcatcactgctgtaccaggccctgccctcctcccccgaccatgagtctcccagtcaggaatctcctaatgctccaacaagtacagccgtgttaggaagctggggatctcctccacagccatccctggctccacgcgagcaggaagccccaggtacccaatggcctttggacgaaacatcggggatatattacaccgaaatccgggaacgagagagagaaaaatcagaaaagggcaggcctccctgggctgcggtggtgggaacgccccctcaggcacatacaagcctgcagccccatcaccacccttgggaaccatccgtgagagagtccctttgttccacatggccatggaaaaatgaagacttcaaccaaaagttcactcaactgcttctgctgcaacggccacaccctagatcgcaggacccgctcgttaagagaagctggcccgactacgtggaagaaaataggggtcacctcatcgaaatccgggacctcttcggacccggcttggacacacaggagcctcggatcgtaattctgcagggagctgccggcatcgggaaaagcaccctcgctagacaagtaaaggaagcctgggggcgcgggcagttgtacggtgatcgcttccagcacgtattttatttctcttgtcgggaactggctcagagtaaggttgtgagtctggccgagctgattggcaaagacggtacggcaaccccagctccgatcaggcaaatcttgtctagaccggaacggctgctatttatcttagacggcgtggacgaacctggatgggtccttcaagagccgtctagcgaactgtgcctccactggtcccagccacagccagctgacgccctgcttgggagcttgctcgggaagacgatcctgccggaagcatcctttctgattactgccaggaccactgcattacagaacctgattccttcactcgaacaggccagatgggtagaggttctgggcttttctgagtccagcaggaaggagtatttctaccggtacttcaccgatgagcgccaggccatacgggccttcagactggtgaaatcaaacaaagaactttgggctctctgcctggtgccatgggtctcttggctggcgtgtacgtgcctgatgcagcagatgaagagaaaggagaaattaaccctaacaagtaagactacaaccacactgtgcttgcattacctggcgcaagccctccaggcccaaccactgggccctcagctacgggacctgtgctccctggcagcagaagggatatggcagaagaaaaccctgttcagtcctgatgaccttcgcaagcacgggctagatggagcgattatctccacctttctgaaaatgggaattctgcaagagcatcctatacccctgtcttacagcttcatccacctgtgttttcaggagttcttcgccgcaatgagctatgtgctggaggatgagaaaggccgtgggaagcactcaaattgcattattgacctcgaaaagacccttgaggcttatgggatccatgggctgttcggggctagtacaacacgcttcctgctgggcttgctcagcgacgagggagagagagagatggaaaatatctttcactgtaggctctcccagggacgcaacttgatgcagtgggtccctagtctgcagctcctcctccaaccacatagtctggagtccctgcattgcctctatgagacacggaacaaaacatttctgacgcaggtgatggctcactttgaggaaatggggatgtgcgtggaaaccgatatggaactgctcgtctgcactttctgtatcaaattttccaggcatgtcaagaagttacagttaatcgaaggacgtcagcataggagtacctggagccccacaatggtagtgttgtttcggtgggtaccggtgaccgatgcatactggcagatcctgttttcagtgttgaaggttactcggaacctgaaggaactggacctatccggaaatagcctatcgcacagtgctgtcaagtctctatgcaaaactctccgccgtcccaggtgcttactcgaaacactgagactagcaggatgtgggctgactgccgaagattgtaaggacctcgcatttggccttcgggccaaccagaccctgaccgaattggatctttcattcaatgtccttacagatgctggggccaaacacctgtgccaacgcctgaggcaaccttcctgtaagctgcagcgcttgcaactcgtgtcctgcggactgacatccgattgttgtcaggacctcgcctccgtcctgagcgcctccccaagcctgaaagagctggatttgcaacagaacaaccttgacgacgttggtgtgcgtcttctgtgcgaggggcttcgccaccccgcatgtaaattaattagacttggtctcgatcagacaacactgagtgacgagatgcgccaggagctgcgcgccctagaacaggagaaacctcagttactgattttctcccgtagaaaaccgtcagtaatgacccccaccgagggcctggatacaggcgagatgtctaatagtaccagttctttaaagcgccagcggctgggttcagagcgcgccgcgagccatgtagcccaggcaaacctaaagttactggacgtttcaaaaatttttcctatcgccgaaatcgcagaggaaagctctccggaagtggtcccagtcgaactgttgtgcgtgccaagccccgcgagtcagggggatttgcataccaagcctttaggtacggatgatgatttttggggcccaacgggacctgtggcaacggaggtggttgacaaagagaaaaatctgtaccgggtgcacttccccgtcgccgggtcttatagatggcccaatacgggcctgtgttttgtcatgcgggaggcggtgaccgtggagatcgaattttgtgtttgggatcagttcttgggtgagataaaccctcagcactcttggatggttgctggtcctctactggacatcaaggccgagccaggcgccgtggaagccgtgcatctgccccatttcgtggccctccagggcggccacgtcgatacatccctgtttcagatggcacatttcaaggaggaagggatgctccttgagaagcctgcccgagtggagcttcatcatatcgttctggaaaatccctcgttcagcccattgggagttctgctgaaaatgatacataacgcgctccgcttcatcccagtgacaagcgtcgttcttctgtaccatagggtacacccagaggaagtgacctttcacctgtatctgatcccaagtgattgttctatccgcaaggccattgatgacctcgagatgaaattccagtttgtgcgcatccacaaaccaccccccctgaccccgctgtatatggggtgccgatataccgtgtcagggagcgggtctggaatgcttgagatactgccaaaggagctcgagctctgctatagatctccaggagaggaccagttatttagcgagttctatgtgggacacttgggatctggtattaggcttcaggtgaaagataaaaaagatgagactctggtatgggaagcattggttaaacccggtgatctcatgccagcaacaactcttatccccccagcgcggatcgcagttccatccccattggatgcaccacagctactccatttcgtggatcaatacagggagcagttaatcgctcgcgtaacttcagttgaagttgttttagacaagctgcacgggcaggtactgtcccaggagcagtacgaacgtgtcctcgcggaaaatacaaggcccagccagatgaggaagctgttctccctatctcagagctgggatagaaagtgtaaagatgggttataccaagctttaaaggagactcacccccatctgatcatggagctctgggagaaggggtctaagaagggattactgccactatcaagttag

SEQ ID NO: 2969 - DNA, 4290 bp, Artificial Sequence
  Description of Artificial Sequence: Synthetic coding sequence
atggcagggggggcctggggcagactggcctgctacctcgagttcctgaagaaagaggagctaaaagaatttcagttgctgttggccaacaaggctcattcacgcagcagctccggtgagacgccagctcaacctgagaagacgagcggcatggaagtggcatcctatctggtggcccagtacggcgagcagcgagcttgggaccttgccctgcatacatgggagcaaatgggactgcgctcactctgtgctcaggcccaggagggcgcagggcacagtccttcctttccatacagcccaagtgagcctcatctagggtcaccatcccagccaaccagcactgccgtcctgatgccatggattcatgagctgcccgcagggtgtacacagggatccgagcgccgggtcctccgtcaactgcccgacactagcggccgaaggtggagagagatctctgctagccttttgtaccaggcccttccttccagcccagatcacgagtcgccctctcaagagagccccaatgcacccacctcaacagccgttctcggatcgtggggctcccctcctcagccttcacttgcccctcgcgaacaggaagcccctggcacacaatggcctttagacgaaacaagcggaatctactatacagaaattagagagagggagcgcgagaagtctgaaaagggacggccaccctgggcagccgtggtgggcacacctccccaggcacatacaagcctacagcctcaccatcacccttgggaacccagcgtccgagaatcactgtgttcaacctggccctggaaaaacgaagactttaaccagaagttcacacagctcctgcttcttcagagaccccatcccagatcccaggaccccttggtcaaacgcagttggcccgattacgttgaagagaaccggggacaccttatcgagattagagacttattcggtcccggtctggacacacaagaaccccgcatagttatactgcagggagctgctggaatcgggaaatcaaccctggccaggcaagtgaaggaagcctggggtaggggccagctttacggagacagattccaacacgttttctacttctcatgtcgtgagcttgctcagtccaaagtggtgtcactcgctgagctcattggtaaagatggaacggctactcctgctccaattaggcagattctgtcccgcccggaacggctgctcttcatactagacggcgtagatgagccaggttgggttctgcaggaaccatcaagcgaattgtgcctccattggagccagccacagcccgctgacgccctcctcgggagcttgctgggtaaaactatccttcctgaggcgtcatttctaatcacagcgagaacaaccgcacttcagaacctaattccatcacttgagcaggcgaggtgggtggaggtgttgggattctccgaatcgagtagaaaggagtacttttatcggtatttcaccgatgaaagacaggcaatccgagcttttcggttggtaaaaagtaacaaagagctgtgggccctgtgcctggtgccatgggtgtcttggttggcctgcacgtgcttgatgcagcaaatgaagcggaaagagaagctcactctgacaagtaagactactaccaccttatgtctccactacctggcccaggctctgcaggcacagccattgggtccccagctgagagatctgtgctctctcgctgcagagggaatttggcaaaagaaaactctattctccccagatgatctgcgaaaacacggtctggacggggccattatcagtacattcctcaagatgggaatcttacaggagcatcccattccgctctcatactctttcatccacctgtgttttcaggaattcttcgcagccatgagctatgtgctcgaggacgaaaagggccgaggaaagcatagcaactgcattatagacctggagaagacattggaggcatatgggattcacggactgtttggggcgtcaactacaagattcctactggggctgttgagcgatgagggggagcgggagatggagaacatttttcactgtcggcttagccaaggtcgtaacctgatgcaatgggttcctagtctccagctacttctgcaaccgcattctttggaatcgttgcattgcctttacgaaacacggaacaagactttcttgacacaggtgatggctcatttcgaggaaatgggaatgtgcgtcgagacggatatggagcttctggtttgtactttctgcattaaatttagtagacatgtgaagaagcttcagctaattgagggcagacagcacaggtcaacgtggtcaccaaccatggtggttctctttcggtgggtgcccgtgaccgacgcctattggcagatcctgttttccgtgctcaaagtcactaggaacctcaaagagctggacctctcaggaaattccctgtctcacagcgccgttaagagtttatgcaaaacattgcgccgcccgaggtgtttgctggagaccctgaggctggctggctgcggccttacagccgaagattgcaaggatctggcgtttgggcttcgcgccaaccagactctgacagagctggacttgtccttcaacgtattaaccgatgcaggcgcaaagcacctatgccagcggctgagacagcccagttgcaaactccaacgcctgcaattagttagttgcggacttacctctgattgctgccaagaccttgcttccgttctgagtgcctccccaagtctcaaagaactggatctgcagcagaataacttggatgatgtcggggtgcgcctcctatgcgagggattgagacacccggcgtgtaagttaatccgcttgggtctggatcagactactcttagtgacgagatgaggcaggagcttcgggcactcgagcaggaaaagccacagttgcttatcttctcccgacgaaagcccagtgtcatgacccctactgaaggtctggatacaggcgaaatgtcaaattctaccagttctcttaaacgccagcgactgggaagtgaacgcgcagcatcacacgtagcccaagcaaatctcaagctgctggacgtgtccaaaatatttccaatcgcagagatagcagaggaatcatcacccgaggtcgtcccggtagagctgttgtgcgtgcctagccctgcaagccagggagacctgcacaccaagcccctcggtaccgacgatgatttctggggacctacaggtcccgttgccactgaagtggttgataaagaaaagaacttgtaccgggtgcacttcccagtcgctggctcctaccgctggcctaatacaggtctttgtttcgtaatgcgggaagctgtgacagtggagatagagttttgtgtctgggaccagttccttggagagataaatccccagcattcatggatggtggctggacctttgctcgacattaaggccgagcccggagccgttgaagccgtacatctcccacacttcgtggccctgcaaggggggcacgttgatacctccctgtttcagatggctcactttaaagaagagggaatgttgttagagaagccagcacgcgtcgaactgcatcatattgtgctcgaaaatccctctttctctcctcttggcgttcttctcaagatgatccataacgccctacggtttattccagtgacgagcgtagtcttgttgtatcatcgggtacaccctgaggaggttaccttccacctgtacttaataccaagtgactgttcaattaggaaggagctggaactgtgttataggagtcccggcgaagatcaactattctctgaattctatgtgggacatctggggagtgggatccgtctgcaggtaaaagacaagaaggacgaaacgctcgtgtgggaggctttggttaaacccggagacttgatgcctgcaacaaccctgattccccctgcgaggatcgccgttccctcccccttggatgctccacagttgctccatttcgtcgaccaataccgggaacagctcattgctcgcgtgacatcagtggaggtggttctcgataagctgcatggtcaggtactatcccaagagcagtacgaacgcgtgctcgctgaaaataccaggccatctcagatgaggaaactgttttccctaagtcaatcttgggatagaaaatgtaaggacggtctgtatcaagctcttaaagagacacatccccatctcatcatggagctttgggaaaaggggtccaaaaaggggttgcttccactgagctcgtag

SEQ ID NO: 2970 - DNA, 4332 bp, Artificial Sequence
  Description of Artificial Sequence: Synthetic coding sequence
atggccggaggtgcctggggcaggctcgcatgctacctggagtttttgaagaaggaggaactgaaagagtttcagctgctactcgccaacaaggcgcactcacgctcttcctctggagaaacccccgcacaacctgaaaagacatccggtatggaggtagcaagttacttagtcgcccagtatggcgaacagcgagcttgggacctggcgttgcacacatgggaacagatggggctacgatccctgtgtgcacaggcacaagagggagcaggacactcccccagttttccttattcccctagcgaaccccacctcggcagccctagtcagccaacgtctactgccgttttgatgccttggatccacgaactgcccgccgggtgcacacaaggtagcgagaggcgggttcttagacagctgccagatacctccgggcgccgatggcgggaaatctcagccagcctgctgtatcaggcattgccgagctcccccgatcacgaatcacccagccaggagagtcccaacgcacccacatccactgccgtactggggtcatggggaagcccaccacagcctagtctggcgcctcgcgagcaggaggcccccggcactcagtggcccctggacgaaacatcagggatctactatactgaaattagagagagagagagagagaaatctgaaaaaggccgacctccctgggccgccgtggtgggaacaccacctcaggcacatacatctctccaaccacaccaccacccctgggagcccagcgtgagggaaagtctctgctcaacctggccatggaaaaacgaagatttcaaccagaagtttacacaactgcttttactgcagcggcctcatcctaggagccaagaccccttagtgaagagatcatggccagattatgtggaagaaaaccgcggccatctcatcgagatcagggacctgtttggacctggtctggacacccaggagcctcggatagtaatcctgcagggtgcagcagggattggaaagagtaccttggcccgccaggtgaaggaagcctggggaagggggcagttgtacggtgatcggttccagcatgtgttctatttttcttgtagagagctggcccaaagtaaggtggtctctctggcagaactgatcgggaaagacggaaccgccacacctgcacctatcaggcagatactcagcaggcccgaaaggctgttatttattttagacggcgtggacgaacctggctgggtcctgcaggagcctagcagcgagttgtgcctccactggagtcagccacagcccgctgacgccttgctcgggagcttacttgggaagacaatcctccccgaagctagcttcctgatcactgcgcgcaccacagctctgcaaaatctcatccccagcctggaacaggccaggtgggtggaagttctgggattcagcgagtccagcaggaaggagtacttttaccgatactttaccgatgaaaggcaggcaattcgagcattccggctggtcaagtccaacaaggagctgtgggcactttgcctggtgccatgggtgagctggctggcctgcacatgcctgatgcagcagatgaagaggaaagaaaagttgacattaacctcaaagacaaccacgaccttgtgtctccattacctggctcaagctcttcaggctcagccccttggaccacaactgagggacctgtgttctctggcagctgaaggcatctggcaaaaaaagacactgttctcccccgacgatcttcgaaaacacggtctggacggagcaatcatctcaacatttcttaaaatgggaatccttcaggagcatccaattcctttgagttattcgtttatccacttgtgctttcaggagttctttgctgctatgtcatatgttctggaagatgaaaaaggcagggggaagcactctaactgtatcatagatttagaaaaaaccttggaagcttatggcatccacgggttgtttggggcaagcactacaaggttccttctcggcctcttaagcgatgagggcgaaagagagatggaaaacatttttcactgtcgtctgagccaggggcggaacctgatgcagtgggttcctagcttgcagctgctacttcagcctcactcactggagagtctgcactgcctgtatgaaacgagaaataagacctttctgacacaggtgatggctcatttcgaggagatgggcatgtgcgtggagaccgatatggaactccttgtgtgcactttctgcattaaatttagcagacacgtgaaaaagttgcaacttattgagggtaggcaacatagaagcacttggtctcctactatggttgtcctgttccgctgggtccccgtgactgatgcttactggcagatcttgttcagcgtgctgaaggtcacccggaatctgaaagaactggatctttccggcaatagcctgtcccactcagctgtcaaaagtttgtgcaagacactgcggcgcccgcggtgtctactagaaactctccgactggccggttgtggtctgactgcggaggactgcaaagacctcgccttcggcctgagagccaaccagactctgacggaactcgacctctccttcaacgtacttaccgatgctggggccaagcacctgtgccagaggcttaggcagccctcgtgtaagctacagcgcctccagctcgtttcatgtgggctgaccagtgactgctgccaagacctagcaagcgtgttatctgcctccccctcactgaaagagcttgatctgcagcaaaacaatttagatgacgtcggggtacggttattatgtgaaggcctgagacaccctgcttgtaaactgatccgactcgggaagccctcagtgatgacacccacagaggggctggatacaggagagatgagcaattccacatctagcttgaagcgccaacgactggggagtgagcgcgcagcttcacacgtggcccaggccaacctcaagctgctagatgtgagcaagatcttccctattgccgaaattgccgaagagagtagcccagaagtggtcccggtggagctcctgtgtgtgccaagtccagcatcccagggagacttgcacaccaaacctctcggcactgacgatgacttttggggccctacaggccccgtagctacagaggtggtggataaggagaaaaacctgtaccgcgtccattttcctgtcgccggatcatacaggtggcctaacacggggctctgctttgtcatgagggaagccgtgactgtcgagattgaattttgcgtttgggatcaattcctgggcgagatcaacccgcaacattcctggatggttgctgggccactgctggacattaaggcagaaccaggagccgtagaagctgtccatctgccgcactttgtggcacttcagggcgggcacgtggataccagcctctttcaaatggcacacttcaaggaggaagggatgctgttggagaaacccgcgcgggtcgaattacaccacatcgtactggaaaacccatcgtttagcccccttggcgtgctgctgaagatgattcacaacgctcttagatttattcctgtaacttctgtcgtcctgctctaccaccgggttcaccctgaggaagtgaccttccatctgtacttgattccaagcgactgctcaatccggaaagcaatcgatgacctggaaatgaagtttcagttcgtccggatccacaagcctcccccactcacccctctttacatgggatgtcgctataccgtgtctggatcaggcagcgggatgctcgaaatattgcctaaggaactcgaactgtgctaccgatcccccggcgaggaccagctctttagcgagttctacgttggacacttagggagtggcattcgtctccaggtgaaggataagaaagacgagacactggtttgggaggccctagttaaacccggtgatctcatgcctgcgaccaccctcattcctccagcaagaatcgcggtgccctcacccttagatgcgccccagctcctgcacttcgtagaccagtaccgggaacagttaattgcccgggtcacaagtgtggaagtggttctcgacaagctgcacggacaggtgctctctcaggagcagtatgaacgcgtgcttgccgagaacacgagacccagtcagatgcgcaagcttttcagtttgtcccagagctgggaccggaagtgcaaagatggactttaccaggccctgaaagaaacacaccctcatcttataatggagctttgggaaaaagggtctaagaaaggactgctgcctctcagcagctag

SEQ ID NO: 2971 - DNA, 1527 bp, Artificial Sequence
  Description of Artificial Sequence: Synthetic coding sequence
atggcccacttcgaagagatggggatgtgtgttgaaaccgatatggagttgcttgtctgtaccttttgcatcaagttctctcgacatgtcaaaaagctgcagctgatcgaggggaggcaacacagaagcacttggagtcctaccatggtagtacttttccgatgggtccccgtgacagatgcctactggcagatcctgttctccgtcttgaaggtcactagaaacttgaaagagctggacttgagtggaaatagcctgtctcacagcgccgtgaagagtctctgtaaaacattgcgcaggcctcggtgcctgctggagaccctgaggttagccggctgtggccttacagctgaagactgtaaggacctggcctttggacttagggccaatcagacccttaccgagctggatttgtctttcaatgtcctaacagatgcaggggccaagcacttatgccaaagactaaggcaaccttcttgcaagctgcagaggctgcagttagtgtcttgcggtttgacgtctgattgctgccaggacctggcttcagtcctcagcgcctctccctctttgaaggaactcgacctgcagcagaacaatctggacgatgtgggcgtacgccttctctgcgagggcctccggcatcccgcgtgcaaactgattagactgggtctggatcagacgacactctccgatgagatgagacaggaattgagggccctcgaacaggagaagccacagttgctgatattttccagaagaaaaccctcagtgatgacacctacagaaggcctggacaccggtgaaatgtctaactcaacctcttctctgaaacggcagcgtttaggctccgaacgcgcggcgtcccacgtggctcaggctaacctcaaattactagatgtgtccaagatcttccccattgccgagattgccgaagaaagctcacccgaagttgtgcctgtggaactgttgtgcgtgcccagccctgcctctcaaggggacttgcacacaaagcctctcgggacggacgacgatttttggggcccaaccgggccagtggctacagaagtggtggacaaggaaaagaacctttacagggtgcactttccagtggctggatcttacagatggcccaatactgggctgtgcttcgtgatgcgagaggccgtgactgtggagatagaattttgcgtgtgggatcagtttcttggcgagattaaccctcagcattcctggatggtcgcagggcccctgctcgatataaaagcggagcctggcgctgtcgaagctgtccatctgcctcactttgtggctctgcagggcggccatgtggatacaagtctgttccaaatggcgcacttcaaggaagagggcatgctcttggagaaaccagcccgtgtggagcttcatcacatcgtcttggagaacccaagtttttctccgctgggtgtgctcctgaagatgattcacaatgcactccgattcattcccgttactagtgtcgtgctgctgtaccaccgtccttcttag

SEQ ID NO: 2972 - DNA, 4128 bp, Artificial Sequence
  Description of Artificial Sequence: Synthetic coding sequence
atggcgggcggagcgtgggggaggctcgcttgttatctcgagtttctaaagaaggaagagttgaaggagttccagctccttttggcaaacaaggcccactccagaagctccagcggcgagacgccagcccagcccgagaagacatccggcatggaggtggctagttatctagtcgcccaatacggagagcagcgggcttgggacctcgctttgcatacctgggagcagatgggactgcgatccctgtgtgcacaggcacaggagggagcaggtcattctccttctttcccatactcacctagtgaacctcacttgggatctccatcccagccaaccagcaccgccgtactgatgccctggatccacgagttaccagctggctgtacccaggggtcggaacggcgcgtgctgcgccaactacccgatacatccggtcgcagatggcgtgaaatttccgcatccctactttaccaggcactgccttcaagccccgaccatgagagcccttctcaggagtctccaaacgctccgacatcaactgctgtactgggttcttgggggtctccgcctcagcctagtttggcaccccgcgagcaggaggcaccgggcacgcagtggccactcgacgagacgtccggcatctattatacggaaatacgggaacgcgagagggagaaatcagagaagggtagacctccctgggccgccgtggtcggaactccaccgcaggcccacacctctctgcaaccccaccatcacccttgggagcctagcgtccgggaatctctgtgcagtacctggccatggaagaatgaggactttaatcaaaagttcacacagctcttgctcctgcagagaccccatcctagaagccaggatcctcttgtgaaacgcagctggccggactacgtggaagaaaatcggggccacctgatagagattcgcgatttgttcggtcccggcctagatacacaagagccaagaattgtgatactgcagggggccgccggaatcggcaaatctacactggctagacaagtgaaggaagcctggggccgagggcagctctatggcgaccgctttcagcatgttttttacttttcctgccgagagctggcccagtccaaagttgttagtcttgccgagctgataggtaaggacggaactgcaactcctgctcctatccgccagattttgtcccggcccgagcgcctgctgttcattcttgatggcgtggatgagcctgggtgggtgttgcaagagcctagctcggagctatgtctacattggtcacaacctcagccggcagacgccctgctggggtccttattgggcaagactatcctcccagaagcctcgtttctgattactgctcggaccactgcccttcaaaacctcatcccctctttagaacaggcgagatgggttgaggtgttaggatttagtgaaagctcaaggaaggagtacttttacaggtatttcaccgacgagagacaagcgatccgagccttccgcctggtaaagagtaataaggaactttgggcactgtgccttgttccttgggttagttggctggcgtgcacatgccttatgcaacagatgaagcgaaaagagaagcttacactgacgtccaagaccacaactacactgtgtctgcattatctggcgcaagccctccaggcacagcccctagggccccagctaagggacctgtgcagcctggccgcagagggaatttggcagaagaagacgttgttctctcccgacgatctccgaaagcacggtctggacggggctatcatttctaccttccttaaaatggggatactgcaggagcatcctatcccgttgtcatactccttcattcacctgtgctttcaggagtttttcgcagcgatgtcttacgtgctggaagatgagaagggacgtgggaaacacagcaactgcatcattgatctggagaaaactctggaagcctatggcatccatgggctgttcggggcctcaacaacacgttttctattgggcctactgagcgatgagggtgagcgcgaaatggagaacatctttcactgcaggctgtcccaggggcggaacctgatgcagtgggtcccttccctccaactcctgctccaaccacactctctggagtcacttcactgtctgtatgaaacacgaaacaagacttttctcacacaagtgatggcacactttgaggaaatgggaatgtgtgtggagactgatatggaactgttagtgtgtaccttctgtatcaagttcagtcgacacgtgaagaagctacagcttattgaaggccgccaacataggagtacctggagcccaactatggttgtgctgttccggtgggtaccagtgacagacgcgtactggcagattctttttagcgtcttgaaggtgacaagaaatctgaaggaattggatctaagcggaaattcattgagccatagtgctgtgaagagtctgtgcaaaacattgcgacggccaagatgcttactggaaacattgcgtttagcgggatgcgggctcaccgccgaggattgcaaagatctggcattcggcctaagagccaatcagacactcaccgagctggacctgtctttcaacgtgctgacggatgctggggccaaacacctgtgtcagcggcttcgacaaccaagctgtaaacttcagcggctacaacttgtgagctgtggattgacaagtgactgctgccaagacctggccagtgtgctttcagcctcaccctccctgaaagaactggacttgcagcagaacaacttagacgatgtgggcgtgcggcttctgtgtgaaggcctccgacacccagcctgcaaattgatcaggctcggtctggatcagacgaccctcagtgacgagatgagacaggaactgcgcgccctggaacaagaaaagccgcaactgctcatcttttcgagaaggaaaccgagcgtgatgacgcctaccgagggcctcgacaccggcgaaatgtctaatagtaccagtagtctgaaacgacagagacttggtagtgaacgcgctgcctctcacgtcgctcaggcaaacctgaagttgctggacgtgtctaaaatctttccaattgcggaaatagctgggaaatctcatgaagaaagcagcccagaggtagttcccgtggaacttctctgtgtccctagcccagcgtcccagggtgatcttcacaccaagcccctaggtacagacgacgatttttggggcccaacggggcccgtggctaccgaagtcgtggacaaggaaaagaatctctatcgggtgcattttcccgtcgccggttcctaccggtggccaaacaccggactgtgtttcgtgatgcgcgaggccgtgactgtggagatcgagttctgcgtatgggatcaattcttgggcgagatcaatccccagcatagttggatggtggccggccccctgttagatatcaaggccgaaccaggcgcggtagaggcagttcatctccctcatttcgtcgccctacaggggggccacgtcgacaccagcctcttccagatggctcacttcaaggaggaaggaatgttactggagaagcccgcccgagtagagctacaccacattgttctggagaatccatcgttttcccccttgggcgttctgttgaaaatgatacataacgctttgagatttattcctgtcacatcagttgttcttctctaccacagggtgcatcctgaggaagtcaccttccacctgtatttgattccaagtgattgtagcattagaaaagctattgacgacctcgagatgaaatttcagtttgtccgaatccacaaacctccccccctgacacccctttatatgggctgcaggtacaccgtcagtgggagcggcagcggcatgttggagattctgccaaaagaattggagttatgctataggtcccctggggaggatcagctattcagtgagttttacgtcgggcatctcggttctggcattcgcctgcaggtgaaggacaagaaagacgagacgcttgtgtgggaagccctggtcaagccagggcgcaacacctcccagccatggaatctccggtgcaatcgggatgctcggagatattag

SEQ ID NO: 2973 - DNA, 2703 bp, Artificial Sequence
  Description of Artificial Sequence: Synthetic coding sequence
atggagtcttgctataatcctggactcgacggaatcatcgagtacgacgattttaagctgaactcttctatcgttgaacccaaagagccggccccagagaccgccgacgggccttacctagtgatcgtggagcagcccaaacaacggggctttaggttccgatacggctgtgaaggacccagccatgggggtcttccgggcgcatcgtcggaaaagggacggaaaacctatcctactgtgaagatctgtaattatgaagggcctgccaagatcgaagttgatctggttacacattccgatcctcctcgggcacacgcacactctcttgtgggaaagcaatgctcagagttggggatttgcgctgttagcgtgggacctaaagacatgaccgcacagttcaataatctgggggtgctgcatgtgaccaagaagaacatgatgggaactatgatccagaagctccagaggcaacggctgcgatcaagacctcaagggctgaccgaggcagagcagcgcgaactcgagcaggaggctaaggagctgaagaaggtcatggatctttccatcgtgcggctgcggtttagtgcctttctccgggcatctgatggatcattttcattgccacttaaacctgttatctcgcagcctattcacgatagtaaatcaccaggtgcgagcaaccttaaaatcagcagaatggacaagacagctggctcagtcagaggcggcgacgaggtgtacctgctgtgtgataaagttcagaaagacgacatagaagtccgcttttatgaggatgacgaaaacggatggcaggccttcggagatttcagccctaccgatgtccataagcagtacgcaattgtgttcaggacgcccccttaccataagatgaagatcgagcggccagtcaccgtctttctgcagctcaaaagaaagcgaggaggcgacgtgagcgacagcaaacaatttacatactacccattggtggaggacaaagaagaagttcagaggaagcggaggaaggctttgccgactttttcgcaaccctttggggggggaagtcatatgggaggcggcagtggaggcgcagccggaggttatgggggagctggaggcggcgggtctttgggattctttccctcaagtctggcatacagcccataccagagcggagcaggaccgatgggatgttacccagggggaggggggggtgcccagatggcagccaccgtaccctcacgcgactccggagaggaggccgccgaaccctcggccccgtcgcgaacaccacagtgtgaacctcaggcccccgaaatgttgcagagggcacgcgagtataacgcccgactgtttggcctcgcccagaggtccgccagagctctgctggattatggagtaaccgccgacgcccgggctctgttggctggccagcgacacttgctgaccgctcaggatgagaatggggacactcctctccacctggcaattattcacgggcagacctcagttattgagcaaatcgtttacgtgattcatcatgctcaggacctcggtgtggtgaacctcacaaatcatctgcaccagaccccgctgcatctcgccgtcatcaccggacagacgtccgtggtgagttttctgctcagggtgggcgctgatcccgcattgctggatcgccatggggattccgctatgcacttagcccttcgagccggcgccggcgcccctgaactgttacgcgctctgttgcagagcggggcacctgcagtccctcagttgcttcacatgccagattttgagggcctgtaccccgtccatctggcagtgcgcgcccgctcaccagaatgcttggacttgcttgtcgactcaggagcagaggtagaggccactgaacggcaggggggtcggaccgccttgcacctcgctactgaaatggaagagctaggcctggttacacaccttgtcactaagctgcgcgcaaatgtgaacgcccgcacattcgctggtaacaccccccttcatctggctgccggcttggggtatccaactttaacgcgcctcctgctgaaagccggggctgatattcacgcggaaaatgaagagcctctgtgtcccttaccctccccccccacatctgattccgatagcgattctgaaggaccagaaaaagatactagatctagttttagaggacacacacccctggacctgacttgcagtacaaaagtgaaaaccctgctgctcaatgccgcccagaacacaatggaacctcctttgactccaccctcccctgccggtcctgggttaagcctgggtgacactgccctccagaacctggagcagttgctggatggtcccgaagcccagggatcttgggctgaactggctgagcggctgggcctccggagtctggtggatacctaccgccaaaccacaagccctagtgggagcctgctgcgctcttatgagctggctggaggagacttggccggcctgcttgaggcactctctgacatgggactcgaggaaggggtgaggctgcttcgtggtcctgagactcgagataagcttccatccaccgcggaagtgaaggaggacagtgcatatggctcccagagtgtcgagcaggaggccgagaaactcgggccgccaccagagccacctggcggcctttgtcacgggcatcctcaaccccaagtccactag

SEQ ID NO: 2974 - DNA, 2700 bp, Artificial Sequence
  Description of Artificial Sequence: Synthetic coding sequence
atggaatcttgttataatccaggcctagacgggatcatcgagtatgacgacttcaaactgaattcctctattgttgagcccaaggagccagcccccgagaccgcagacggcccctatcttgtcatcgtcgaacagcctaaacagagaggctttagattccgctatggttgcgaaggcccctcccacggcgggctgcctggcgcttctagtgagaagggccgaaagacgtaccccacagtgaaaatctgcaactacgaagggcctgcaaaaatcgaagttgacctggtgactcatagcgacccgccgagggcacacgcacattccctggtgggcaaacaatgtagcgaactgggcatctgtgcagtgtcggtcggccccaaggacatgactgctcagttcaacaatctgggcgtgttgcacgtgaccaagaaaaacatgatggggactatgattcagaagctgcagcgccagcgcttgaggagccgcccgcaggggttaacagaggccgaacaaagggagcttgagcaggaggcgaaggagttgaaaaaggtgatggacctgagtatagtccggctccgcttctctgcgttcctacgggcctctgacggtagctttagtctgccactgaagcctgtgatttcccaaccaattcacgactctaaatccccaggagctagcaaccttaaaattagcaggatggacaaaaccgccggctctgtgcgcgggggcgacgaggtgtacctcctatgtgataaagtacagaaagacgacatagaggttcgattttatgaggacgatgagaatggatggcaggctttcggcgacttctcacctactgacgtacacaagcagtacgcaattgtgttcaggaccccaccatatcacaaaatgaaaattgagagaccggtcaccgtgtttctgcagctcaaaaggaaaagaggcggcgatgttagcgattctaagcagttcacttactaccccctggtcgaagacaaggaggaagtgcaaagaaaaaggcggaaggcattgcccacattctcccagccttttgggggcggcagccatatgggaggaggaagcggcggagcggcaggcggctatggcggagctggaggaggagggagtctgggcttctttccgtcatctctggcctatagcccatatcagtcgggtgcggggcccatggggtgctacccaggcgggggggggggcgctcagatggctgctacggtcccaagtcgcgactcgggggaagaggccgccgagccttcggccccctctcgcactcctcagtgcgagccgcaggcccccgaaatgctccaaagggcccgggagtacaacgcccgtctgttcggactggcccagcgctctgctagagccctcctggactatggggtcaccgccgacgctcgcgctctactcgcagggcagaggcacctgctaacggcccaggatgagaatggagacacccccctccacctggctataatacatggacagacgagcgtgattgagcagatcgtttacgtgattcatcatgcacaggatctgggtgtcgtaaacctcactaatcacttgcaccagactccactgcaccttgcagtgattaccggccaaactagcgtcgtctcattcttacttagagttggggccgaccctgccctgctcgaccgccacggtgattcggctatgcatcttgctcttagggctggcgctggtgcccctgaactgcttagagctctgttgcagtcgggggcccccgcagtaccccagcttctccatatgccagacttcgaaggtctgtacccagtgcacctcgcagtgagagctaggagccccgaatgcttggacctccttgtggattctggagcggaggttgaagccacggagcgtcagggaggacggactgccctgcatctggctacggaaatggaagagttgggcctcgtgacccacctggtgactaagttgagagctaatgtgaatgctcggacattcgccggcaatacacctctgcatttggcggccgggctgggctaccccaccctgactcgactcctattaaaggccggggccgacatccacgccgaaaacgaggaacctctgtgccctctgccttctcccccaacatcagactctgacagcgattctgagggtcctgagaaggacacacgcagctcctttagaggccatacgccgctggatctgacgtgctccactaaggtgaaaacactcctactgaatgccgcacaaaacactatggagccccctttgacccctccctcgccagccggtcctggactgtctctaggagacacagcgcttcagaacctagagcagctcttggacggaccagaggctcagggctcatgggctgagcttgccgagcggttgggcctaagaagcctagttgacacataccgacaaacaacctccccaagcggatctctactgcgtagctatgaactggccggcggtgatttggccggtctgctagaggccctgtctgacatggggctggaggagggcgtccggttgctgcgaggcccagaaacaagagataagctgccaagtacagaagttaaggaagatagtgcatatggctcacagtccgtggaacaagaggccgagaagctggggcccccgccagaacctccgggagggctttgccacgggcatccccagccccaggtgcactag

SEQ ID NO: 2975 - DNA, 2703 bp, Artificial Sequence
  Description of Artificial Sequence: Synthetic coding sequence
atggagtcttgttataatccaggccttgatggcatcatcgagtacgacgactttaagctcaatagctcaatagtggagcccaaagagccggcaccagagactgctgacggcccttaccttgttatcgtagagcaaccaaaacagcggggcttccgtttcagatatgggtgcgaaggtccctctcacggggggttgcccggggcttcctcagaaaaggggcgaaaaacttatcctacagtgaagatttgtaactacgaggggccggccaaaattgaagtggacctcgtcacccatagcgacccccccagggctcatgcccatagcttagtaggaaaacaatgctccgaactgggaatctgtgcagtgagcgtaggtcccaaagatatgaccgcccaatttaataacctaggcgtactccacgttaccaaaaagaatatgatgggcaccatgatccagaaattacaacggcagcgcttgagaagccggcctcagggtctgaccgaggcagagcagcgggagttggagcaagaagccaaggagctgaaaaaggtgatggatctgagcatcgttagactccggttctcagccttcctgcgcgcttcggatgggtcattctcactaccgctgaagcccgtgatttctcagcctatccatgacagcaaaagccctggagcctctaacctgaaaatttcccgtatggataaaacggcgggatccgtgcgtggtggagacgaagtttacctgttgtgcgataaggtacagaaagatgatattgaagtgcggttttatgaggatgacgagaatggatggcaggccttcggcgatttcagccccaccgacgttcataagcagtacgccatcgtgttccggacgccaccgtatcacaagatgaagattgaacgtcccgttacggtctttttacaattgaagcgcaaacggggcggcgacgtttccgacagtaagcagttcacctattatccgcttgtcgaggataaggaggaggtccagcgaaaacggcgcaaggccttgccaactttttcccagcctttcgggggtggctcccacatgggaggaggaagtggtggtgccgcaggcggatatggaggtgcgggcggaggcggtagcttaggcttctttccatcctctttagcgtactcaccctaccagtccggagccggacccatggggtgttatccgggggggggggggggcgctcagatggccgcaactgtcccctcaagagacagtggtgaagaagctgccgagccctccgctccctcccggactccacagtgcgaacctcaggcaccagagatgctgcagagagcccgagaatataatgcccgactatttgggctggcacagcggtccgctagagcactactggactatggtgttacagctgacgctcgcgcccttttagcaggacagcgtcacctgctgactgcccaagatgaaaatggcgataccccattgcatctggccataatccacggtcagacaagtgtgatcgaacaaatcgtgtatgtgatccatcacgctcaggacctgggcgtagtgaacctgactaatcatctgcaccagacccccctacaccttgcagtcattacaggccagacctcagttgtcagctttttgctcagggtgggagcggatcccgctttgctggacagacatggcgattccgctatgcatcttgcactgagagccggagccggagcccctgagctgcttcgggccctcctgcagagtggcgctcccgccgtcccacagctgttgcacatgccggacttcgaagggctctatcctgtacaccttgccgtgcgcgcaagatcccccgagtgtctggacttactcgtggactcaggtgctgaggtagaggccaccgagcgccaggggggcagaactgccctgcaccttgccaccgagatggaggagctcgggttggtaacccacttagtgaccaaactccgcgccaatgtcaacgccagaacctttgcgggcaatactccactccacctggccgccggcctgggatatccaacgttaactcgtctactcttaaaagccggcgccgacattcacgccgagaacgaagaacctttgtgtcctttgccatctccaccgacatccgatagcgacagcgactctgaaggtccggaaaaggacacccggagctcgttccggggacacactccactagacctgacgtgttctactaaagtcaagactctcctcttgaatgctgcccagaacactatggaaccacctctgacgcctccatccccagcagggcccggactgtccctcggagacactgccttacaaaaccttgagcaactgctggacgggccggaagctcaaggatcttgggctgaattggctgagcggctcgggcttcgcagcctcgtggacacatatagacagacgacatccccttccgggagtctgttacggtcctatgagttagcaggcggtgacttggctggcttgctggaggcactgagcgatatgggcctcgaggaaggcgtacggcttcttcgggggcctgagacaagagataagctgcctagcaccgccgaggtgaaagaagactccgcctacggatctcagtcggtcgagcaggaagctgagaaactgggccctcccccggaaccgcccggagggctttgtcatggccatccacagcctcaggtgcactag

SEQ ID NO: 2976 - DNA, 2700 bp, Artificial Sequence
  Description of Artificial Sequence: Synthetic coding sequence
atggaatcctgctataatcccggactggatgggatcatagaatatgatgactttaagttgaactcttctattgtggagccaaaggagcccgcacccgagactgctgacggcccttatctcgtcattgttgagcagccgaaacagagaggttttagattccgttacggctgtgagggcccatcccacgggggccttcctggggcttcttcagagaagggcaggaagacgtatcccacggttaagatctgcaactacgagggaccggcaaaaatagaagtggacttggtgacccatagcgaccccccacgcgcacatgcacactctctcgtgggcaagcagtgttctgagctgggaatttgtgcagtgtccgtgggccctaaagatatgacggcccaattcaataatttgggggtgctgcatgtaactaagaagaacatgatgggcaccatgattcagaaactccagaggcagagattgagaagccgcccacaaggcctcactgaggcagaacaacgcgagctggagcaggaggcgaaggaactaaagaaagtgatggacctgtcaatagtgagactcagattctcagccttcctccgagctagcgacgggagtttttcactgccactgaagccagttattagccagccaatccacgacagcaagagccccggagccagtaatttgaagatcagcagaatggataaaaccgcaggctccgtacgaggaggggacgaagtttatctcctatgcgacaaggtccagaaagacgacatcgaagtcaggttttatgaagacgatgagaacggctggcaagcctttggcgatttctcaccaactgatgtgcataagcaatatgccatcgtgtttaggacacctccctatcacaaaatgaaaatcgagcggccagtaacagtcttcctacagctgaagaggaaaagaggcggcgacgtctccgatagtaagcaattcacgtactatccgcttgtcgaagacaaggaggaagtgcagagaaaacgaagaaaggctctgccaactttcagccagccattcggaggtggcagccacatggggggcggctccggcggtgcagctggtggctacgggggggcgggcgggggagggtccctaggattcttcccttcgagtctggcctactccccttaccagagcggagcagggcccatggggtgctatcccgggggtggcggcggggcgcagatggctgcgacagtaccgagcagggactctggcgaagaagcagccgagccaagtgcccctagccggactcctcagtgtgagccgcaggccccggagatgctgcagcgggcccgggagtacaacgctcgactttttggactggctcagcgcagtgcccgcgcgctgctggactacggtgtgacagccgatgccagggctctcttggcgggccaacgacatctactgactgcacaggacgagaatggtgacaccccactacacctcgctattatccatggacaaaccagtgttatcgaacagatcgtttatgtgattcatcacgcacaagacctgggcgtcgtcaatttgaccaatcaccttcatcagacccctttacacctcgcagtcatcactggacaaacttctgtcgtatcatttctactccgcgttggggctgaccccgctcttcttgacaggcatggggattccgccatgcacctagccctgcgcgccggagccggcgcaccggagttgttgagggccctcctgcaatctggggccccagccgtgcctcagctgctccacatgcccgacttcgagggactgtaccccgtgcatttggcggtccgggccagaagcccagagtgcctggacctcctagtagattctggcgccgaggtagaggctactgagaggcagggaggccggacagcattacaccttgccactgagatggaagaactggggctcgtcacacacttggtcaccaagctaagagctaatgtgaacgcacgcacattcgcgggaaataccccccttcacttggccgctgggctagggtacccaacattgacccgtcttctgctgaaggctggagcagatatccacgcggagaatgaagagcctctgtgtccactcccgagccctcccacatccgactctgatagtgattctgaaggacctgaaaaggacactcgtagttccttccgaggtcacacccccctcgatctgacttgctctaccaaagttaaaacgctgctgctcaacgctgcacagaacacaatggagcctcctttgactcctcctagccccgcggggcctggcctgagtctgggtgatactgcattgcagaatctcgaacagctcctggatggtccagaggcccaaggctcctgggcagagctggccgagagactgggactacgcagtttggtcgatacctaccgtcaaaccacaagtccatctggatctctgctgcgatcctatgagctcgcagggggcgatttggctggactgttggaagcactcagcgacatgggactggaagaaggagtgcggttactccgaggccctgagactcgggataagctgccaagcacggaggtgaaagaagactccgcctatgggagccaatccgtggagcaggaggcagagaagttgggccccccccctgaaccacccggaggactttgccatggccatccacagccccaggtccattag

SEQ ID NO: 2977 - DNA, 804 bp, Artificial Sequence
  Description of Artificial Sequence: Synthetic coding sequence
atgcctagggcttttcttgtcaaaaagccatgcgtttccacttgcaaaagaaactggagtgagctgccagacgaagaacggggcgagatttatgttccggtctcactcggcttttgtcccccacagccatatcgggaaccggagccttctgtggccgagcccccgagctgtcctctggctttgaacatgtccctgagagacagctcctactctatggcaccaggcccatgtgtggtcgctcagttaccaagcgaggatatgggccacttgacagacccccagtctcgtgatcacgggtttctcaggaccaaaatgaaagtgacacttggcgattctcccagtggagacctgtttacttgcagagtttgtcagaaagccttcacttaccagcggatgttgaatcgtcatatgaagtgccataacgacgtgaagcgccacctctgcacttactgcggcaaagggttcaacgacacatttgatctgaaacgacacgtgcgtacacataccggcgtgaggccttataagtgtagcctttgcgacaaagcctttactcagagatgtagcctggagagccaccttaagaaaatccacggggtgcagcagaagtacgcctataaggaacgccgtgccaaactctacgtgtgcgaggaatgtgggtgtacttccgagagccaggagggacacgttctgcaccttaaagagcatcatccagactcacccctactgcggaaaacctccaaaaaggtggctgtggcactgcagaatactgtgacatcacttctgcagggctctccacacctgtag

SEQ ID NO: 2978 - DNA, 1095 bp, Artificial Sequence
  Description of Artificial Sequence: Synthetic coding sequence
atgcatcgccttatattcgtgtatacactgatttgcgctaatttctgttcgtgtagagataccagtgcaacaccccagagcgcctctatcaaggcattaaggaacgctaacctgcgcagagacgacctctatcgccgcgatgagaccatccaagtgaaaggaaacggctacgtgcagtccccaaggtttcccaattcgtacccaaggaacctcctactgacttggaggctccatagtcaagaaaacacacgcatccagcttgtgttcgacaatcaatttggtctggaagaagcggagaatgacatctgccgctatgacttcgtggaagtcgaggatatctcagaaacatccaccatcataagaggtcgatggtgtggacataaagaggtcccaccaagaatcaagagcaggaccaaccagattaagatcactttcaaaagcgatgattattttgtcgcgaaaccaggatttaagatctattactcattgctagaagattttcagcctgctgctgctagcgagaccaattgggaaagcgtgaccagttccattagcggggtgtcatataatagcccctctgtcacagaccctactcttatcgcagatgctcttgacaagaagattgctgagttcgacactgtggaggacttactgaaatacttcaatcctgaaagttggcaagaggatctggagaacatgtacctcgatactccgcggtaccgcggtaggtcctaccacgatcggaagtcaaaagtggatcttgatcggctgaacgatgatgctaaacggtattcctgtactccccgtaattatagcgtgaacatacgcgaggagctcaagctggcaaacgttgtgttcttccctaggtgcctgctagtacagcggtgcggtgggaattgtggctgtggcaccgtcaactggcgcagttgtacgtgcaatagtggaaaaaccgttaaaaaatatcacgaggtgctccagttcgagcccggtcacattaagcgacgtgggagggctaaaactatggcactggtcgatatccagcttgaccaccatgagcgctgcgactgtatctgctccagtaggccaccacggtag

SEQ ID NO: 2979 - DNA, 1113 bp, Artificial Sequence
  Description of Artificial Sequence: Synthetic coding sequence
atgcataggcttatttttgtgtacactctgatatgtgccaacttctgcagctgcagagacacctccgcgacgcctcagagcgcgtccattaaagccttacgcaacgccaatctgcggagagatgagagtaaccatctgacagatctctataggcgggacgagaccatccaagtcaaaggaaatggctacgtgcagtccccacgattcccaaattcctacccccgaaaccttttgcttacttggaggctccacagccaggagaataccagaatccagctggtattcgataatcaattcgggctagaagaagctgagaacgacatctgtcgctatgattttgtggaggtggaagacatcagcgagacaagcaccattattaggggcagatggtgcggacataaagaagttccccctcggataaaaagtaggacaaaccagatcaaaatcacattcaaatcggatgattacttcgtggccaaacctggctttaagatatattattcactgctggaggacttccagcctgctgccgccagcgaaaccaactgggagtccgtgacaagctcaatttctggggtgtcctataattccccttccgtgaccgatcctactctcatcgccgatgcgctcgataagaagattgctgaattcgataccgtggaagatctgctgaaatacttcaatcccgaaagctggcaggaggatctcgagaatatgtatctggacactccccgataccgtggccgcagctatcacgacaggaagtctaaagtggaccttgatcgcctcaacgatgatgcaaaaagatatagctgtacccctcgaaattattcagtgaatatccgggaagaattgaagttggcgaatgtggttttttttcctagatgcctacttgtgcaacgttgtgggggaaactgcggatgtggcactgtcaactggcgaagttgtacctgcaattccggaaagacggtaaagaaatatcacgaggtgttgcagttcgaacctggccacatcaagagaaggggtcgcgccaagacaatggctcttgtggatatccagctcgaccaccatgagcgctgtgactgtatttgttcctctcgcccgccgaggtag

SEQ ID NO: 2980 - DNA, 726 bp, Artificial Sequence
  Description of Artificial Sequence: Synthetic coding sequence
atgaatcgctgttgggcactgttcctaagcctgtgctgctacttaagactcgtaagtgcagagggagacccaatccccgaggagttgtacgagatgctctccgatcacagcattagatcgtttgatgacctgcagaggctgctgcacggtgatcctggcgaggaggatggtgcagaattggacctaaatatgaccaggtctcactccggaggagagctcgaatcactcgcaagaggcaggaggtcacttggctcactcacaattgctgagcccgccatgatcgctgagtgcaaaactagaactgaggtattcgaaatcagcagaagattgatcgatcgcacaaatgctaattttcttgtgtggcctccgtgtgtggaagtccagcggtgctccggttgctgtaacaaccgcaacgtgcagtgtcggcctactcaggtgcagctgaggcctgtccaggtgcggaaaattgagatagtgcgcaagaagcccatctttaagaaggcaaccgttacattggaagaccacttagcatgtaaatgcgaaacggtagctgccgccagaccagtcacaaggtcacccggcggatctcaggagcagcgcgccaaaaccccccagaccagggtgactatccgaacagtccgggtccggcggcctcccaagggtaagcaccggaaattcaagcatactcatgacaaaacggcactgaaggaaacactgggcgcctag

SEQ ID NO: 2981 - DNA, 681 bp, Artificial Sequence
  Description of Artificial Sequence: Synthetic coding sequence
atgtttattatgggcctgggggacccaattcccgaggagctttacgagatgctgagcgaccactccatccgaagcttcgacgacctgcagagactgctccatggggacccaggtgaagaggacggagcagagctcgacctgaatatgacacggtcgcatagtggaggggagctcgaatctctggccaggggccgccggagcctgggcagcctcacgattgctgagcccgcaatgatcgctgagtgcaagacacgcacggaagtcttcgagattagtcgtcgcctcattgatcgcacaaatgctaattttctcgtgtggccaccctgtgttgaagtccagagatgttccggttgttgcaacaacagaaatgttcaatgtagacctacccaggttcagctcaggccggtacaggtgaggaagattgaaatcgtgagaaaaaaacctatattcaagaaagctacggtaacgctcgaggaccatctggcatgtaaatgcgaaactgtggccgcagctagaccagtgacacgctctcctggcggcagccaggaacagagagccaagacccctcaaactagagtcacaatccggaccgttagggtacgccgtccccctaaaggcaagcaccgaaaatttaaacatactcacgacaagacagccctgaaggaaacgctcggagcctag

SEQ ID NO: 2982 - DNA, 411 bp, Artificial Sequence
  Description of Artificial Sequence: Synthetic coding sequence
atgctgtcagaccattccattaggtcatttgacgacctgcagcgactgcttcacggtgatcctggagaggaagacggcgctgaacttgacctcaacatgactcgatcccactcgggtggcgagcttgaaagcctggccaggggccggcgcagccttggctcactcactatcgctgaacccgccatgattgccgagtgtaagacgcgcaccgaggtgttcgagatctctcgcagactcatcgaccgcaccaacgccaattttctcgtctggccgccctgtgtcgaggttcagcggtgtagtggctgttgcaacaaccggaacgtccaatgtcgccctactcaggttcagctgaggccggtgcaggtcaggaaaatcgagatcgttaggaagaagccgatcttcaaaaagtag

SEQ ID NO: 2983 - DNA, 435 bp, Artificial Sequence
  Description of Artificial Sequence: Synthetic coding sequence
atgctttccgaccactctattagaagcttcgatgatctgcagcgcctgctgcacggggaccccggcgaagaagatggggccgaactcgatcttaatatgacaagatcccactctggcggagagctggaatcacttgcgaggggacgaagaagtctgggttccctgacaatcgccgagcctgcaatgattgcagagtgtaaaacccggaccgaagtgttcgaaatcagtcgtcgcctgatagacaggaccaatgcaaactttctggtttggccaccatgtgtcgaggtccagcgctgctccggttgctgcaataatagaaatgtacagtgccggccgacacaagtgcagttacgtcccgtgcaggtgcggaagatagagatagttcggaaaaagccaatctttaaaaaggccactgttacccttgaggatcactag

SEQ ID NO: 2984 - DNA, 804 bp, Artificial Sequence
  Description of Artificial Sequence: Synthetic coding sequence
atgcctaggtcatgttgtagtagaagtggcgccctgcttctggcattactgctccaggcttcaatggaggtgcgggggtggtgcctggagtcgtcccagtgtcaggatcttacgacagaatccaatcttttagagtgtatccgcgcctgtaagcctgacctttccgcagaaacccctatgtttccagggaacggcgacgaacagccactgacagaaaatcctcgaaaatatgtcatggggcactttaggtgggacagattcggccgacggaattcctccagctcgggctcctccggcgccggccagaagcgggaggacgtcagcgctggcgaggactgcggacccctgcctgaagggggtcctgagccccggtcagatggcgccaagcctggcccacgggagggaaaaaggagctattcgatggaacattttcggtggggaaagccagtgggaaagaagagaaggcccgtgaaagtttatcccaacggggcagaagacgaaagcgccgaagcctttccactggaatttaagagagaactcacggggcagcgtctccgggaaggagacggacccgatggcccagccgacgatggcgccggcgcccaggccgatctcgagcattccctgctggtggccgctgaaaagaaagacgagggtccttatcgtatggagcactttcggtgggggtcgccacctaaagacaaacgctacggggggtttatgaccagcgaaaaatcacaaacgccgttggtcacattgtttaagaatgcaatcatcaagaatgcctataagaagggcgagtag

SEQ ID NO: 2985 - DNA, 804 bp, Artificial Sequence
  Description of Artificial Sequence: Synthetic coding sequence
atgcctcggtcctgttgtagtagatctggtgccctcctgctagccctcctgctgcaagcctcaatggaggtacgtgggtggtgtcttgagtcatctcagtgccaggatctcactacggagagcaatcttctggagtgcataagggcctgcaagcccgatctcagtgccgagactcctatgtttcccggcaatggagatgagcaaccactgacggagaacccaagaaaatacgtaatgggtcacttcaggtgggatcggttcggccgacgtaacagttcgtcatccgggagctctggcgccggacagaagcgggaagatgtgagtgcaggggaagattgcggacccttgcctgaaggtggtcccgaaccaaggagcgacggggccaagccaggtccaagggagggcaagagatcttatagcatggagcacttccgctggggcaagccggtgggtaaaaagcgacgacctgtgaaagtgtacccaaacggagccgaggacgagtctgcagaggcgtttccgctggaattcaagagagagcttacgggccagcgcctcagggaaggggacggccccgacggccctgcagacgatggcgctggcgcacaggcggacttagagcattctctacttgtggccgccgaaaaaaaggacgagggcccttataggatggagcactttaggtgggggtcaccgcccaaggataagcgctacggaggattcatgaccagcgaaaagtctcaaaccccactggttaccctgttcaaaaacgcaatcatcaagaatgcatacaaaaagggcgaatag

SEQ ID NO: 2986 - DNA, 804 bp, Artificial Sequence
  Description of Artificial Sequence: Synthetic coding sequence
atgcctcggtcttgctgctcccggtcaggagcactcctacttgcacttttgctccaagcttcaatggaagttcgaggatggtgcctggagagcagccagtgtcaagatttaaccacagagagtaacttgttggagtgtataagagcttgtaaacccgacctgtcagcagaaacaccgatgttcccaggaaacggcgacgagcaaccgttgaccgaaaatccaagaaaatatgttatggggcacttccgctgggatagatttggcagacgaaactccagcagtagcggcagtagcggagccggtcaaaagcgggaagatgtgtctgccggggaagactgtggccccttaccggaagggggccctgagccccgtagcgacggtgctaaacctggacctcgggaaggtaagaggtcttacagtatggaacacttccgctgggggaagcccgtcggaaagaaacgacggccggtgaaagtatatcccaacggggcagaagatgagtctgcagaagcctttccactggaatttaagcgagagctgaccggtcagcggctgcgggagggagacggccctgacggtccggccgatgatggggcaggagcgcaggccgacctcgagcattcgctcctcgtggctgccgagaagaaggatgaaggcccttaccgcatggaacattttagatggggcagtcccccaaaagacaagcgatatgggggatttatgacaagcgagaagtcccaaactcctcttgtgaccctcttcaagaacgcaatcattaaaaatgcatacaagaaaggggagtag

SEQ ID NO: 2987 - DNA, 804 bp, Artificial Sequence
  Description of Artificial Sequence: Synthetic coding sequence
atgccacgctcctgctgtagccggtcaggagccttgctgctggctctactcctgcaggcctctatggaagtgcgcggctggtgcctcgagagcagccagtgccaggacctgacgaccgaatcaaatctacttgagtgtataagagcttgcaagccagatttgtcagccgaaacgcctatgtttcctggaaatggagatgaacagcctctaaccgaaaatccgagaaaatatgtgatgggccacttcaggtgggatcgcttcggaagacgaaattcttcgagctcgggatcatctggggccggtcagaagagggaggatgtgtctgcaggcgaagactgcggtccactcccagagggtgggcccgaacccagatctgacggcgcaaagcccggtcctagggaggggaagcgtagctactccatggagcacttccggtggggcaagcctgtaggcaagaagaggagaccagttaaagtgtatcccaacggtgcagaggacgaaagtgctgaggcattcccactcgagttcaagcgcgaactcaccgggcagaggctgagggaaggcgacggccccgatggcccagctgatgatggggcaggggcgcaagctgatctggagcattccttgttagttgcagccgagaaaaaggatgagggcccttatcgcatggagcatttccgctggggatcaccgcccaaagacaagcgctatggtggatttatgacctctgaaaagtcacagactcctttggtgactcttttcaagaatgccatcattaagaacgcatataaaaaaggggagtag

SEQ ID NO: 2988 - DNA, 741 bp, Artificial Sequence
  Description of Artificial Sequence: Synthetic coding sequence
atgcctcgcagttgctgttcacgctcaggcgctctgctgctcgcgctgctgttgcaagcttctatggaggtacgcgggtggtgcctggagagttcacaatgtcaagacctgaccacggagtccaacctgctggaatgcatacgggcttgcaagcccgacctgtcagctgagacgccaatgttcccggggaatggagatgagcagcccctgaccgagaatcctcggaagtacgtcatgggtcacttcaggtgggatagattcggtcgaagaaatagtagcagctcgggtagctcaggcgccgggcagaaacgtgaagacgtttccgctggagaggattgcggaccattacctgagggaggcccagagcccagatcagatggtgccaagcccgggccgcgcgagggtaagcgcagttatagtatggagcactttcgttggggaaagccagtgggcaaaaagcgaaggccagtgaaggtataccctaacggcgcagaagacgaatctgccgaggcctttccccttgagtttaaaagagagctcactggccaacggcttcgagagggcgacggcccggacggtcctgcagatgatggagctggcgcacaggcagacctggaacactcactcctcgttgcagccgaaaagaaagatgaaggaccctaccgaatggagcacttccgctggggttccccacctaaagacaaaaggtatggcgggtttatgactagcgagaaaagctag

SEQ ID NO: 2989 - DNA, 459 bp, Artificial Sequence
  Description of Artificial Sequence: Synthetic coding sequence
atgacctgtaccgaccaaaagtcccactcacagcgcgcactcgggacacaaacccctgccctgcaagggcctcagctgttgaatacggatccatcatccgaggagacgaggccaccgcacgtcaatccggacaggctctgccacatggaaccggctaaccacttttggcatgcaggggacctgcaggccatgatttctaaggagttccatctggccgccacgcaggatgattgccgaaaaggcaggacacaggaagacatccttgtgccctcgtcccatccagagctatttgcgagtgtacttcctatggcaccggaggaggcggcccggctgcagcagcctcaacccctgccccccccatcaggaatccatttatctgcctcccgaactcttgctccaacgctcctctactccagtccaccctcgcactcgccgttcggtctgagttctcttatctag

SEQ ID NO: 2990 - DNA, 315 bp, Artificial Sequence
  Description of Artificial Sequence: Synthetic coding sequence
atggagcctgccaatcacttctggcatgccggcgaccttcaggcaatgatcagtaaggagttccacttagcggctacacaggacgactgtaggaaaggtagaacacaggaagacatccttgtgccatcctcacaccccgaattatttgcatctgtgctgcctatggctcctgaagaggcagccaggctacagcaaccccagccgctccctccaccaagcggaatccacctgtccgcctctagaacgctggctttaacactgctctatagctctccgccaagccacagccctttcggcctcagctccctgatttag

SEQ ID NO: 2991 - DNA, 459 bp, Artificial Sequence
  Description of Artificial Sequence: Synthetic coding sequence
atgacctgtacggatcagaagtcccacagccaacgtgccctaggaacacagacccccgcactgcagggcccgcagctgttgaataccgacccctcatctgaggagaccaggccgccacacgtgaatcccgatcgattatgccatatggaacctgccaaccatttttggcacgccggtgacctgcaggcgatgatctcaaaggagttccacctggccgcgactcaggacgactgcaggaaaggtcgcacacaggaggacatcctagttccaagctcacaccctgaacttttcgcctcagtgttgcccatggcacccgaagaggcagctcgattgcagcagccccagcccctgccacctcccagcgggatccatcttagtgcatctcgtacgctagcccctaccttgttgtacagttccccgccatcacactcacccttcggcctgtctagcttaatttag

SEQ ID NO: 2992 - DNA, 459 bp, Artificial Sequence
  Description of Artificial Sequence: Synthetic coding sequence
atgacatgcactgatcagaaaagtcattctcagagagcgcttgggacccagacaccagccttgcaggggccccaactgctgaacacagatccgagctcaaaggagactaggccacctcacgtcaatcccgacaggttatgtcatatggagccagcgaaccatttctggcatgccggcgatctccaggctatgatttctaaggaatttcacttggcagccactcaagacgactgccgcaaaggacgaactcaggaggacatattagtgcccagttcccatccagaattgtttgcgagcgttttgccaatggcgcctgaagaggctgccaggctgcagcagcctcagcccctacctccccctagcggcatccatctgtccgccagtcggactttggcccccactctgctctatagtagcccaccaagccatagtccattcggactctcatcacttatctag

SEQ ID NO: 2993 - DNA, 459 bp, Artificial Sequence
  Description of Artificial Sequence: Synthetic coding sequence
atgacatgtacagatcagaagagccactcacagcgggctctcggcacacaaaccccagctctgcaaggccctcaactgctgaataccgacccatcgtctgaggaaacacgccctccccacgtgaatcccgacaggctttgccacatggagcctgctaaccatttctggcacgccggggatttgcaagcaatgatttccaaggagttccacctggcagcgactcaagatgattgtcggaaggggcggacccaggaggatatactggtcccctcctctcatcccgagctcttcgcctcagtgctccctatggcccccgaagaggccgctcgcctgcagcagcctcaaccattgccacctccctctggaattcacctttcagcctctcgaaccttggcccccactctgctttactcctcaccaccgagccacagtccctttggcctaagctctctgatctag

SEQ ID NO: 2994 - DNA, 459 bp, Artificial Sequence
  Description of Artificial Sequence: Synthetic coding sequence
atgacctgtaccgaccagaagtctcattctcaacgtgctctggggacacagacaccggcacttcagggaccccagctgctgaatacggatcccagctctgaggaaacacgtccacctcacgtaaaccccgacaggctctgtcacatggaaccggcaaatcatttttggcatgccggagatctgcaggccatgatttccaaagagtttcacctggccgcaacccaggatgattgcagaaaagggagaacacaagaagatatccttgtcccaagttctcatcccgagttgttcgcctccgtacttcccatggccccggaggaggcagcgcgcctgcagcaaccccagccactgcccccacccagcggaatccacctgtcagcctcaagaactctggcaccaacactgctctactcatcgcctccatcccattcaccgtttggtttgtcctccctaatttag

SEQ ID NO: 2995 - DNA, 453 bp, Artificial Sequence
  Description of Artificial Sequence: Synthetic coding sequence
ccccaaactgaccagaaatcccactctcaacgggccttaggcactcaaaccccagccctacaaggcccccaactgctgaacaccgatccatcctcagaggaaacgcatcctcatgtgaatcctgacagattgtgtcacatggagcctgcgaaccacttttggcatgctggagatctccaggcaatgatttctaaagagttccatctcgccgcaacacaggacgactgcagaaaaggacggacacaggaggacatactcgttccctcatcgcacccagagctgttcgcatcggtcctgcccatggcacctgaggaagccgcaaggctgcagcaacctcaaccactcccacccccgtctggtatccacctgtcagcctcccggaccctagccctgacgctcctgtatagtagcccgcccagtcacagccccttcggcctttcctctctgatctag

SEQ ID NO: 2996 - DNA, 411 bp, Artificial Sequence
  Description of Artificial Sequence: Synthetic coding sequence
atgattctcaactggaaactacttggtattttggtcctctgtctacatacccgagggattagcggcagtgagggccatcccagccacccccctgcagaggatagggaagaggctggctcaccgaccctccctcagggccctccagtacctggggatccctggccgggtgccccaccactttttgaagatccccccccaacgaggcccagccggccgtggagagacctgcccgagaccggcgtgtggctcccagagcctccgagaaccgaccctccacagccacctcggccggacgatccctggcccgccgggccacagccacctgagaacccatggcctcccgcccccgaggtggacaacaggcctcaagaggagccggacctggatccccctcgagaagagtaccggtag

SEQ ID NO: 2997 - DNA, 411 bp, Artificial Sequence
  Description of Artificial Sequence: Synthetic coding sequence
atgattttgaattggaagcttctgggcatcctcgtcctgtgtctccacaccagagggattagcggctctgaaggtcatccgtcacacccccctgcggaagaccgcgaggaggctggatcccctaccctgccacaaggtccccctgtgcccggggatccttggcctggagctcctcctcttttcgaggacccacccccaaccaggccgtcccggccatggcgtgatctgccagaaacaggcgtgtggcccccagaaccacctagaactgatccgccccagccgccccgccctgacgatccgtggccagccggcccacagccccctgagaacccctggccccctgcacctgaagttgacaaccgaccgcaggaggagccagatctggacccccctcgggaagaatataggtag

SEQ ID NO: 2998 - DNA, 411 bp, Artificial Sequence
  Description of Artificial Sequence: Synthetic coding sequence
atgatcctgaactggaaactgttgggtatcctggtcttatgcttgcacaccaggggaattagcggttcagaagggcatccctcgcacccgcccgccgaagatcgggaggaagcgggaagtcctaccctaccacagggtccccctgtgcccggagacccctggcccggcgccccccctctgttcgaagatccgccaccaacacgcccaagtaggccctggcgtgacctgccagagactggcgtgtggccccctgaacccccaagaaccgaccccccccaaccacctagaccagacgatccttggcctgcgggaccacagccacccgagaacccctggccgcccgcccccgaagtggataatagaccccaagaggaacctgatctagatccacctagggaggagtaccgctag

SEQ ID NO: 2999 - DNA, 411 bp, Artificial Sequence
  Description of Artificial Sequence: Synthetic coding sequence
atgatccttaattggaagctgctcgggatattggttctgtgcctccatacccggggtatttctggatccgagggccatccatcccaccctcccgccgaggatcgagaggaagccgggagcccaactctgcctcaaggccccccagtccccggggatccctggcccggggccccgcccctttttgaagatcccccccccacgcggccatctagaccatggcgcgacctacctgaaacaggggtatggccacccgaaccgcctcggacagatcctcctcaacctccacggcccgatgacccttggccagctggaccccagccccccgaaaatccatggcctcccgcgcctgaagtggacaaccgtccccaggaagaacctgacctggatccacctagggaagagtacagatag

SEQ ID NO: 3000 - DNA, 411 bp, Artificial Sequence
  Description of Artificial Sequence: Synthetic coding sequence
atgatcctcaattggaagctgctcgggatccttgtcctctgtctgcacacgagagggatttcgggttctgagggacaccctagccaccctccggcagaagatagagaggaagctggttcccctacgctgcctcagggcccccctgtgccaggggacccatggccgggagctcccccactttttgaggaccctcctcctactaggccaagcaggccctggagggacctgcctgagactggtgtctggccgccagagcctccacgtaccgaccccccacagccacctagaccagatgatccttggcccgctggaccacagcctcctgagaatccctggccacctgcccccgaggtggacaaccgcccccaggaggagccagacctggacccaccacgggaggagtatcgttag

SEQ ID NO: 3001 - DNA, 411 bp, Artificial Sequence
  Description of Artificial Sequence: Synthetic coding sequence
atgattctgaattggaaactactagggatcctagttctctgtctccatacacggggcatctctggaagcgaggggcatccgtctcaccctcccgccgaggatagagaagaggcaggcagcccaactctgccccaagggccccccgtaccgggagatccttggcctggggcccctcctctatttgaagatcctcccccaaccagaccatctcgaccctggagggacctccccgagacgggagtttggccacccgagccccctcggaccgatccaccccagccccccaggccagatgatccctggccagccggacctcagcccccagagaatccctggcctccagctcctgaggtagacaataggccccaggaggaaccagatctggaccctccccgtgaggagtacaggtag

SEQ ID NO: 3002 - DNA, 753 bp, Artificial Sequence
  Description of Artificial Sequence: Synthetic coding sequence
gcgctcttactagccgtgatccagggcagacccggcgctcagcacgatgtcgaagcgttaggcgggctctgctgggccttgggttttgaaaccactgtacggactgatccaacagcccaagcatttcaagaggagctggcacaatttcgggagcagctggacacctgtcggggccctgtgtcctgcgccctcgttgctcttatggctcacggtggacctaggggtcagttgctcggggctgatgggcaggaagtgcagccggaagccctgatgcaggaattatctagatgtcaggtgctacaggggaggccgaaaatcttcttgctgcaggcctgtcgagggggcaatcgcgatgctggggtgggccccactgccttgccatggtattggtcgtggttaagagcccccccaagcgtgccctcccacgccgatgtgctgcagatctacgccgaagcccaggggagctcatgcagaggcaccccccccggttcaagcgaccaggctgacatactgactgtctattccgccgccgaggggtacgttgcctatcgagacgacaaggggagcgatttcattcagacactggtggaagttctgcgcgccaacccgggtagagatcttctggaattactgaccgaggtgaacaggcgggtttgcgagcaggaggtgcttgggccagactgcgacgagctccgcaaggcttgcctcgaaatcaggtccagtttgcgcaggcgactgtgtctccaagcctag

SEQ ID NO: 3003 - DNA, 3165 bp, Artificial Sequence
  Description of Artificial Sequence: Synthetic coding sequence
atgaccagctatagagaacgatccgcggatcttgcgcgattttacaccgtcacagagccccagcgacaccccaggggatatacagtctataaggtaactgcgcgaatcatcgtctggaaacggtatagcgattttaagaagctgcataaagaattgtggcagattcacaagaacctgttccgccactcagagctttttccaccattcgctaaaggcatcgtcttcggccgctttgatgagaccgttatcgaggaacggagacagtgtgccgaggacctcctgcagttttctgcaaatatccctgctctttacaacagtaaacaactcgaggatttttttaaaggggggattataaatgacagcagtgagctgatcggccccgcagaagcccatagcgacagtctcatagacacgtttcccgagtgttcaaccgaaggttttagctcagattctgatctagtgtcactgacagtagatgtcgacagcctcgccgagctagatgacggcatggcttctaatcaaaactcccccattcgaactttcggtttgaaccttagcagcgatagctctgcccttggagcagtggcttcagacagcgagcagtctaagaccgaggaagagcgggagagtcggagcttattccccggctccctcaagcccaagcttggcaaacgcgactatctggagaaggcaggcgaactgatcaagctggccctcaagaaggaggaggaagacgactacgaagctgcctccgatttttatcgcaagggagtggacctgctcctcgagggcgtgcaaggcgagtccagcccaaccagacgcgaggctgtgaaacgtaggactgcagagtatctgatgcgtgccgaatctatcagctctctgtatggtaaacctcagctggatgatgtgtctcagccccctggcagtctgagctctaggcccctctggaacctacgctcgccagctgaggaactgaaggctttccgtgttctgggtgttatcgacaaggtgctactggtcatggacacgagaaccgaacagacgtttatcctgaaagggttgaggaagtcaagtgaatactcaaggaataggaagacaataataccacgatgcgtcccgaatatggtttgcctgcacaagtatatcataagcgaggaatctgtgtttctcgtgctgcaacacgcggagggggggaaactgtggagctacatttccaagttcctgaatcggtcaccagaggagtccttcgacatcaaggaggttaaaaagcctactctcgcaaaagtccatcttcagcagcctacgtcctcgcctcaggattctagctcatttgaatctaggggaagcgatggaggatcaatgctcaaggcactgccactgaaatcaagtctcacaccctcatctcaggatgactcaaaccaggaggacgacggtcaggacagcagcccgaaatggccagactccggatcttctagtgaggaagaatgcaccaccagttacctgactttgtgcaacgaatatggacaagagaaaattgagcccggctctctaaatgaggagccattcatgaagacagagggcaatggcgtggataccaaggccattaagtcctttcccgctcacctggccgctgactctgacagcccctctacgcagctgcgcgcgcacgagcttaagttcttcccaaatgatgaccccgaagcagtgtcctctccaagaacatctgattccctatctaggagcaagaatagtcctatggaattctttcggatcgactctaaggattcggcttccgaactcttgggtctggattttggggagaagttgtactctttaaagagtgagcctctgaaaccattctttacactgcccgatggcgattcagcctcacggtcgttcaatacctccgaaagcaaggtcgagtttaaggcacaggatacaataagcagaggatctgacgacagcgttcccgttatctcgttcaaggatgccgcttttgacgatgtctctggtaccgacgaaggtcggcccgacctcctcgttaacctcccgggagagttagagtcaactcgtgaagcagccgcaatgggtcccaccaagtttactcagactaacattgggatcatcgagaacaaattgcttgaagcacccgacgtcctgtgccttcggctctccactgagcagtgccaggctcacgaagaaaagggtatcgaggaactctctgatcccagcgggcccaaaagctactctattaccgagaagcactatgctcaggaggaccctagaatgcttttcgtcgcggccgtcgaccatagcagtagtggtgatatgagcctccttccatcgtcagatcctaagttccaaggcctgggagtcgtggaatcagccgttactgccaataacaccgaggaatcactcttcaggatctgctcaccactttctggggccaacgagtacatcgccagcacagataccctcaagaccgaggaggtgctactgttcaccgaccagacagatgacctcgccaaagaggagcctacaagcctctttcagagagatagtgagacgaaaggtgagagcggcctggtcctggagggagacaaggaaatccaccagatcttcgaggatttagataagaaactagccttggcttcccggttctatatccccgagggttgcatccaacggtgggctgctgagatggttgtggctctggacgccttacaccgcgaaggaatagtttgcagggacttgaatcctaacaacatcctattgaatgacaggggtcacattcagcttacctacttctcaaggtggtccgaggtcgaggatagctgcgatagcgatgccatcgagcggatgtactgtgctccagaggtaggcgcgattaccgaagaaaccgaggcctgcgattggtggtcgctcggcgccgtgcttttcgagctgttaacaggtaaaacactcgtggaatgccatccagccggcatcaacacacacacaacgttgaacatgcctgaatgtgtcagtgaagaagctaggtccctcattcagcaactcctgcaattcaaccctcttgagcgcctcggcgccggggtagccggcgtcgaagacataaaatcgcaccctttctttactccagtggactgggccgagcttatgcgatag

SEQ ID NO: 3004 - DNA, 3201 bp, Artificial Sequence
  Description of Artificial Sequence: Synthetic coding sequence
atgacctcttacagagagaggagcgctgacctcgctcgcttttatacggtaactgagccacagcgacatcctagagggtatacggtgtacaaggtcactgcacgggttgtgagtcggaggaatccagaagacgtgcaggaaatcatcgtgtggaagcgctatagcgatttcaagaaactccacaaagagctgtggcagatccataaaaatttgttcagacatagtgagctgtttcctccatttgcaaaaggcattgttttcggcaggttcgacgagacagttatcgaggagcgaagacaatgcgccgaggacctcctccaattttctgccaacattccagccctttataactcaaagcaactggaagacttttttaaaggcggtataattaatgattcaagcgagcttatcggacccgccgaggctcatagtgatagcctgatcgatacatttcctgagtgcagcaccgagggcttttcaagcgattcagacctggtctcccttactgtcgacgttgatagcctagccgaactggacgacgggatggcaagcaatcagaatagtccaatcagaacttttggtttgaatcttagtagcgactcctcagctctgggagctgtggcctctgatagcgaacagtccaagacagaagaggagcgggaaagtcggtctctgttcccaggctctctcaaaccaaaattggggaaaagggactatctggagaaggccggtgagctcatcaagttggcactgaaaaaagaagaagaagatgactatgaggcagcatctgatttttatagaaaaggagttgatctgctcctggagggcgtccaaggcgagtcttcccccaccagaagagaagccgtgaaaaggagaaccgcggagtacttaatgagagcagaaagcatcagctccctgtacgggaagccacagttagatgatgtatcccagccccccggcagcctgtcaagcagacctttgtggaacctgcggtccccagccgaagagctgaaggccttcagagtcctcggcgtgattgataaagtgttgctggtgatggacacccggaccgagcagacgttcatcctcaaaggtctgagaaaatcgtccgaatacagccgcaaccggaagaccataattccccgctgtgtgccaaacatggtctgcttacacaaatacattattagtgaagagtccgttttcctggtcttacagcacgctgagggcggtaagctgtggagttacatctcaaaattcttaaaccgatctccggaggagagtttcgatattaaagaggtgaaaaaacccacacttgctaaagtacacctgcagcagcccaccagttctccccaggattccagtagcttcgagagtcgtgggagtgacggcgggagcatgttaaaggcactccctctgaaatcttcacttacgcccagtagccaagatgattccaatcaggaggatgatggccaagactcctcccccaaatggcctgattcaggaagctcttccgaggaggaatgcactacgtcctacctgaccctgtgcaacgagtatggtcaggaaaagatcgagcccggcagcctaaacgaggagccctttatgaagacagagggcaacggggtcgatacaaaggcaataaaatctttcccagcccaccttgccgctgactccgactccccatcaacacagctgcgcgcccacgaactcaaatttttccccaatgatgaccctgaagcagtgtcgtcaccaagaaccagtgactcattgagtcggtctaagaactcacctatggaatttttcagaattgatagcaaggactcagcgagtgagctgcttggccttgacttcggggaaaagctgtatagcttaaagagcgaacctctcaagcccttttttacccttcccgacggagactccgcttcaagatcctttaacacctccgagtcaaaagtggagttcaaggcacaagacacaatctcgcgcggttctgatgactccgtccccgtgatcagcttcaaggacgcggcgtttgacgacgtgagcggtacggatgagggccggccagacttgttggtgaatttgccgggcgagttagaatctacccgggaggcagccgcaatgggccctactaagtttactcagaccaatatcgggatcatagagaacaaactgctcgaggcacctgatgtcctgtgtttacggttgagcactgagcagtgccaagcccatgaagagaagggcattgaggagctgtctgacccttcggggcctaagtcctatagtattacagagaagcactatgctcaagaggatcccagaatgctgtttgtggctgctgtggaccacagtagctcgggagacatgtcactcctgccatccagcgaccccaagtttcagggcctaggcgtcgtagagagtgccgtgaccgctaacaacactgaggagagtctctttagaatctgctccccactgtcaggcgcaaatgagtatattgctagcacagacacactaaagacggaagaggtcctgctgttcacagaccagaccgacgacctggccaaggaggagcccacctccttgtttcaaagagactcagagacaaagggagagtccgggctcgtgctggagggggacaaagagatccaccagatcttcgaggacctagacaaaaaactcgccctcgcctccaggttctatatcccagaagggtgtattcaaaggtgggccgctgagatggtggtcgctctggatgctctgcatcgggagggaatagtatgcagagatctgaatccgaacaacattctcctcaacgaccggggacacattcagctgacatacttcagtcgatggtccgaagtggaagacagttgtgattcggacgctatcgagcgcatgtactgtgctccagaggttggcgccatcactgaggagactgaagcttgcgactggtggtcgcttggcgcagtgttatttgaactcttaaccgggaagactctggtcgaatgtcaccccgccggaattaatacccatacaacacttaatatgcccgaatgtgtatccgaggaagcccgttctctcattcagcaactgctgcaatttaacccacttgagaggctcggtgctggagtggccggcgttgaagacattaaatctcacccgttcttcacccctgttgattgggcagaacttatgaggtag

SEQ ID NO: 3005 - DNA, 1983 bp, Artificial Sequence
  Description of Artificial Sequence: Synthetic coding sequence
atgagggccgaaagtatttcatccctctacggaaagcctcagcttgatgacgtgtcccagccccctgggtccctgagctcccggcccctgtggaacctgcgctcacccgccgaggagctcaaggcgtttagggtgctgggcgtcattgataaagtgctgttggtcatggatacccggacagagcaaacttttattctgaaaggtttgcgcaagtccagcgagtattcgcggaatcgcaagactattatcccacggtgcgtcccaaacatggtgtgcctgcacaagtacattatttctgaggagtccgtctttctggtcctgcaacacgccgagggcggtaagttatggtcatatattagcaaatttctaaaccggagccccgaggaaagttttgatatcaaggaagttaagaaacctacgctggctaaggtgcacctgcagcagcctaccagcagtccacaggactctagctcatttgagtcccggggttccgacgggggctcaatgttgaaggcgctgcccctgaaatcctcattgacccctagttcacaagatgacagtaatcaggaggacgacggccaggactcaagccccaaatggcccgactcaggctcttcttctgaagaggaatgtacaacaagctacctgaccctgtgcaacgagtacggtcaggaaaaaatcgaacccggatcactgaacgaggagcccttcatgaaaactgagggcaatggcgtagacacgaaagccattaaatcatttcctgcccacctcgcagcagattctgacagcccgagcacacagttacgcgcgcacgaattgaaatttttccccaatgatgacccagaggcggtatcctctcctagaacctccgatagcctgtctcgctccaaaaactcaccaatggagttttttcgcattgatagcaaggactctgcttcagaactcctgggcctcgattttggagagaaactgtacagtctgaaatccgagcccttgaagccatttttcactcttcctgatggcgattctgcaagccgctcatttaataccagtgagagtaaagtggaattcaaagctcaggacaccatatcacgggggtctgatgattctgtcccagtaatcagcttcaaggacgccgcattcgacgacgtatcaggcaccgacgaggggcggcccgatctgctcgttaacctgcccggggagctagaaagcaccagggaagcagccgccatgggacccaccaaatttacccagactaatattggaataatagagaacaagctactcgaggctcccgacgtgctgtgcctccgcctctctacggagcagtgccaggcccacgaggagaaaggcatcgaggagttgagcgacccgtctgggcctaaaagctattccatcacggagaaacattacgcacaggaggaccctcgaatgttatttgttgcggccgttgaccactcatcatccggggacatgagcctgctcccttcaagcgaccccaagtttcaggggctgggagtcgttgaatccgccgtgaccgccaacaataccgaggagagtctcttccgcatatgttccccattgagtggcgcgaatgaatatatcgcttctaccgatacgttgaaaactgaggaagtcttgctattcacagaccaaaccgatgatttggccaaggaggagccaacatccctgtttcagcgtgactctgaaaccaaaggtgaatctggcctagtacttgagggggataaggaaatccaccaaatcttcgaagatctcgacaagaagctggccctggcctcacgattctatatcccagagggatgtatccaacgctgggccgcggaaatggtggtggctcttgatgcgctgcacagggaaggcatcgtctgtcgagatctgaatccaaacaatatcctgctgaacgataggggccaggagctcctgcaaatgcatttcttcctgtttgccgttgcctctaactag

SEQ ID NO: 3006 - DNA, 2565 bp, Artificial Sequence
  Description of Artificial Sequence: Synthetic coding sequence
atggcctccaatcagaattcccccatcagaaccttcggattaaacttgtcaagcgacagctctgccctgggcgctgtagcatcagacagcgagcagtccaagactgaagaagagcgggagtctagaagcctcttccccgggtctctgaaacctaagctaggaaaaagagactacttggaaaaagccggagagctgattaaactagccctgaaaaaggaggaagaagacgattacgaggcagccagcgacttctaccgcaagggcgtcgacctgctgcttgagggggttcaaggagaaagcagcccaactaggagagaggccgtcaagagacgaacagcggagtacctaatgagggcagagtcgataagctctctttacggcaaaccgcagctcgatgacgtgagtcaagtccttcttgtgatggacacaaggacagagcaaacctttatactgaaggggctgcgcaaaagtagtgagtactcaaggaatcgcaagacgattatcccacgctgcgtgcccaacatggtttgtctgcacaagtacataatctctgaagagtccgtcttccttgtgctgcagcacgccgagggaggcaaactgtggtcatacatttccaaatttcttaaccggtcacctgaggagtcatttgatattaaggaagtaaagaagcccactctcgccaaggtgcatctgcaacagcctaccagcagcccacaagattcatcatcctttgagtccagaggctccgacggcggctctatgctgaaggcactccccttaaagagctctctgaccccctcgtcacaggatgacagtaaccaagaagatgacggacaggactccagccccaagtggcctgattcaggatccagctcagaggaggaatgcaccacaagctacctgacactgtgcaacgagtacgggcaagagaaaatagagcccggcagcctgaacgaggagccattcatgaagaccgaaggtaatggtgtagacactaaggccattaaatcttttcctgcccaccttgccgccgatagcgacagcccatccactcaactgcgggcccacgagttgaaattttttcctaatgacgaccccgaggccgttagctcccctcggacaagtgactccttgtcgcgatcgaagaactcccccatggaatttttccggatagatagcaaagatagcgcctcagaactgttgggcctggacttcggagaaaaactgtattcactcaagagcgaaccattgaagccgtttttcactttgcccgacggagacagcgcttcaaggagcttcaacacatctgaaagtaaagtcgaattcaaagcccaggacaccatcagccgtggaagtgatgactctgtgcctgtcatcagctttaaagacgccgcctttgatgatgtctctggaaccgacgagggtagacctgacctattggtgaatctaccgggcgagctggaatccacccgcgaggcagcagcgatgggccctacaaaatttacacagaccaacatcggcataatcgaaaacaaactcctcgaagcccctgacgtactgtgtctgcggctatccaccgagcagtgccaagcacacgaggaaaaagggattgaggagctgtctgatccgtcgggccctaagtcctatagtattacggagaaacattacgctcaagaggatccaaggatgctgtttgtggcagccgtggatcactcctcttcaggcgatatgtcccttctccccagtagtgaccccaagttccagggcctgggtgtagtcgagagtgctgtgactgccaataatactgaagaaagtctgtttcgcatctgctcccccctctcaggagccaacgaatacatcgccagtacggacactctgaaaactgaagaagtcttactttttactgatcaaaccgatgacctggccaaagaagaaccaacaagtctgtttcagagagattcagagacgaagggagagtctgggttggtactagagggcgataaggaaatacatcagatcttcgaggacctcgacaagaagctcgcccttgccagccgcttctacattcctgaggggtgcattcagaggtgggcagcagaaatggtcgtcgcacttgacgccttacaccgcgagggaattgtttgtagagatcttaaccccaataacattctgctcaatgacagaggacacatccagctcacatacttctctcggtggagcgaagtggaggacagttgtgattccgatgcaatcgagcggatgtattgtgccccagaagtgggcgctatcacagaggagaccgaggcctgcgattggtggtcactgggggccgtgctttttgagctcctgactggtaagactctggtggagtgtcatccggctggaatcaatacgcacacaactctaaacatgcccgaatgcgtgtcagaggaagcaagaagtctgattcagcagttgctgcaattcaaccctctggaacgccttggcgccggcgtggcgggggtcgaggacatcaagagccatccttttttcacccccgttgattgggccgagcttatgaggtag

SEQ ID NO: 3007 - DNA, 1449 bp, Artificial Sequence
  Description of Artificial Sequence: Synthetic coding sequence
atggctgcggtcttcgacctggatctcgagaccgaggaagggtctgaaggagaaggcgagcccgaactgagccccgccgatgcctgtcctcttgccgaactcagagctgcgggcctggagccagtgggccattacgaggaggtggaactcactgaaaccagtgtgaatgtcggcccggagagaataggccctcactgcttcgagctgctgcgcgtcttaggcaagggcgggtacggaaaggtctttcaagtgcggaaggtccagggcactaacctgggaaaaatttacgctatgaaggtccttcgtaaggccaaaatcgtacgaaatgctaaagacacggcacacacccgggccgagcggaacattcttgagtctgtgaagcacccatttattgtagagctcgcgtatgccttccaaacaggtggaaagctatacctcatactggagtgtctgtccggaggcgagctcttcactcatctggagcgcgagggcatctttttggaggacacagcatgcttctatctggccgagatcactttagctcttggacatctccacagccaaggcatcatctatagagatcttaagcccgaaaacatcatgctaagttcacagggacatatcaaattaactgactttggcctctgcaaagagagcatacacgaaggcgccgtgactcacaccttctgtggaacaatcgagtatatggcccccgaaatcctcgtgagaagtggacataaccgcgccgtggattggtggagcctgggggcactaatgtacgatatgcttacagggagccctccattcaccgcggaaaatcggaaaaagaccatggataaaatcattaggggtaaattagcgttgcccccctatctgactccagacgcccgagatctggtaaagaagttcctgaagcgaaacccgagtcaacggattgggggggggccaggagacgcggccgatgtccagagacatccctttttcaggcacatgaactgggacgatctgctcgcgtggcgtgtggatcccccatttcgcccctgcctgcagtccgaggaagacgtatcccagtttgacacaagattcactaggcagaccccagtagatagcccggacgatactgctctgtctgaatccgctaatcaggcctttcttggatttacatacgtggcgccctctgtactcgattccatcaaggagggcttcagctttcaaccgaagctgaggtcccctcgccgcctgaacagcagcccccgagcaccggtctcccccttgaagttctcacccttcgagggctttcgcccttcaccatctttaccagagcctaccgagttacccttaccccccttactgcctccacccccaccctctacaaccgctccactgccaattaggcctccctcaggaacaaaaaagtcaaagagagggagaggcagacctggcagatag

SEQ ID NO: 3008 - DNA, 465 bp, Artificial Sequence
  Description of Artificial Sequence: Synthetic coding sequence
atggccgcagtgttcgatctcgaccttgaaacagaggagggaagtgaaggggagggtgaacctgagctgagcccggcagacgcttgccctctggccgagctgagggctgcgggactcgagcctgtcggccattacgaggaggtggaactgactgaaacctctgttaatgtgggacctgagcgcatcgggccccattgctttgaactgctgagagttctcggaaaggggggttacggcaaagtcttccaagtaagaaaagttcagggaaccaatttggggaaaatatatgctatgaaagtgctgcgcaaggccaaaattgtcaggaatgctaaagatacggcacatacccgtgcagagcgaaacatcctggagagcgtcaagcaccctttcatagtggaactggcatatgctttccagaccggaggcaaactgtatttgatcttggaatgcctcagcgtcgactag

SEQ ID NO: 3009 - DNA, 465 bp, Artificial Sequence
  Description of Artificial Sequence: Synthetic coding sequence
atggcagctgtgtttgatctcgatttggagacggaagaaggcagtgagggagagggggaaccagaattgtctccagccgatgcatgtccactcgctgagctcagagctgccggattggaacccgtcggacactacgaggaagtggagttaactgagacttctgtgaatgtaggcccagaacgcatcggccctcactgcttcgaactgctccgcgtgcttggcaaaggcggatacggcaaggtgtttcaggtaaggaaggtgcagggtactaatctgggaaagatttatgccatgaaagtcttacggaaagcaaagatcgtaaggaatgccaaagacaccgcccacacccgagcagagcgcaacattctcgagtctgtcaagcatcctttcatagtggagctcgcttatgccttccagacaggtggtaagctgtatctgatcctagagtgcctgtccgtggactag

SEQ ID NO: 3010 - DNA, 2133 bp, Artificial Sequence
  Description of Artificial Sequence: Synthetic coding sequence
atgttcaagttcctgtcttttcgagtgcggagcattcaagaggaggtaagcataaaagagatagccattacccaccatgtgaaagaagggcatgagaaagccgatccaagtcagtttgagctactgaaggtgctgggccaggggtctttcgggaaagtattcctggtaaaaaaaatttccggcagcgatgcccgccagctctatgcgatgaaggttctcaaaaaagccactttgaaggtaagagatcgcgtcagaacaaaaatggagcgcgatattctcgtggaggttaaccacccatttatcgtgaagctacactacgcttttcagaccgagggtaagttgtatctgattttggacttccttcggggtggagacctgtttacgcggttgagcaaggaggttatgttcacagaggaagatgtcaagttctacctcgcggaactggcgttggcgctcgaccacctccactccctgggtataatctaccgggaccttaagcctgagaacattttactcgacgaagagggacatatcaagttaaccgacttcggactttccaaggagtctatcgatcacgagaagaaggcgtattccttctgcgggacagtcgagtacatggcgcctgaggtggtgaatcggcgtgggcacacccaaagtgcagattggtggagcttcggggtactgatgttcgagatgctaacaggcaccttgccttttcagggaaaggaccggaaggaaaccatgacaatgatcctgaaggccaagctcggcatgccccagtttctaagcccagaggcacagtctcttttgcgcatgctgttcaagaggaatccggcaaataggttgggtgccggacccgatggcgtcgaagaaatcaagagacactcctttttttccactatcgactggaacaaattatacagacgggaaatccatccccctttcaagccggccacaggacgacctgaagacaccttctacttcgatccggagtttaccgccaaaaccccaaaggatagccctgggattcctcctagtgcaaatgcccatcagttatttcgtggtttttcctttgttgcaattacatctgacgatgagagccaagccatgcagactgtcggggtgcacagcatagttcagctgcatcgaaactctattcagtttacggacgggtatgaagtcaaggaggatatcggtgtggggagctattctgtgtgtaaacgatgtatccacaaagccactaatatggagtttgccgttaagattatcgacaagagcaagcgtgatcccaccgaggaaatcgaaatactgttgcgttacggacaacatcctaacatcatcactcttaaagatgtgtatgacgatggcaaatatgtgtatgtcgtcaccgagctgatgaagggcggcgagctacttgataaaatcctccgtcaaaaattcttttccgagagggaggcatcagctgtgctcttcaccatcaccaagacagtggagtacctccacgcccagggggtggtacatagagatctcaaacctagcaatatcctgtatgtggacgagtctggtaacccagaatctatacgaatttgtgattttggcttcgccaagcaactccgggccgagaacggccttctgatgaccccctgctacactgctaactttgtggccccagaggtgctgaagcgacagggttacgacgcagcgtgtgatatctggtctcttggtgttctactgtatactatgttgacagggtatactccctttgcaaatggaccagacgatacacctgaggagattcttgcaagaataggcagtggcaagttctcccttagcggaggctactggaattccgtctctgacaccgccaaggacttggtgtcaaaaatgctacatgtcgatcctcatcagcgactgaccgctgcccttgtcctccggcacccttggatcgtccactgggatcagctgcctcagtaccaactcaaccggcaggacgccccgcacctggtaaagggggcaatggccgctacttatagcgcgctgaatcgcaaccaaagcccggtattggagcctgtggggagaagcacattggcacagcgcaggggcatcaaaaagataacctcaaccgctctctag

SEQ ID NO: 3011 - DNA, 2223 bp, Artificial Sequence
  Description of Artificial Sequence: Synthetic coding sequence
atgcccctagcgcagctagcagacccttggcaaaaaatggctgtggaatcgccctccgactccgcagaaaacggtcagcagatcatggacgagcccatgggtgaagaggagattaatccccagaccgaagaagtgagtatcaaagagatagccatcacacaccacgtcaaggaaggacacgagaaagcagacccttctcagttcgagctgctgaaagttctcggccagggcagctttggcaaagtgtttctcgttaagaagatttcggggagcgatgcccgccagctgtatgcaatgaaggtacttaagaaggcgaccctcaaagtcagagaccgggttcgcactaagatggagagagacatactggtcgaggttaatcatcccttcatcgttaagctgcattacgcgtttcaaaccgaaggaaaactctacctaatcctggattttcttcgtggtggtgacctttttactcgcctgtctaaggaagttatgttcacagaagaggatgtgaaattctacctcgccgagttggcactcgctctggatcacctacactcattgggcattatttacagagatctcaaaccagagaatatccttctggatgaggagggtcacattaaactcactgactttggactgagcaaggagagtatcgaccacgagaaaaaggcttattcgttctgcggaaccgtggaatatatggctcctgaggtggtgaataggcgcggccacactcaaagtgcggattggtggagctttggcgtgctcatgtttgagatgctgactggaaccctgccgtttcagggcaaggaccgaaaagagactatgaccatgattttaaaagctaaactcggcatgccccagttcctgagccccgaagcccagagcttgctgcggatgctctttaagaggaatcctgcaaacagactgggtgccgggccagatggagtcgaggaaatcaagcgccactcgttcttctctacgattgactggaataagctgtaccgcagagaaattcaccccccctttaaaccggctacgggccgcccagaggacacgttttattttgaccccgaattcaccgctaagactcccaaggatagccctgggattcctcctagcgccaatgcccaccagcttttccggggattttctttcgtcgccatcacatctgacgacgagtctcaggcgatgcagactgtcggggtgcattctattgttcaacagctgcataggaactcaatccagttcacagatgggtatgaggtcaaggaagatatcggcgtcgggagttactctgtgtgcaagaggtgcatccacaaagctacgaacatggagttcgccgtcaagattattgataagtctaagagggatccaactgaggaaatcgaaatactgctcaggtacggacagcatcctaacatcataacactgaaggatgtatacgacgacgggaagtacgtgtacgtggtcactgagctgatgaaggggggtgagcttctggacaagattctcaggcagaagtttttctctgagcgcgaggccagtgctgtgttgttcaccatcactaaaactgtggaatatctccatgctcagggcgtagtccaccgggaccttaagccctccaatattctatatgttgatgagtcaggcaaccccgaatccatccgcatttgcgatttcggttttgcgaagcagttgcgcgctgagaacggcttgttaatgacgccatgctatactgctaacttcgtcgctccagaagtcctgaagaggcagggatacgacgctgcttgcgatatttggtccttgggtgtgctgctctatacaatgctgacaggatacacgccctttgccaatggccctgatgatacacctgaagagattctggcgaggattgggtctgggaagtttagtctttctggaggatattggaactctgtgtctgacacagcaaaagatctggtgtcaaaaatgctgcatgttgatcctcatcagagactgactgccgccctggtgctccgtcatccctggatcgtgcattgggatcaacttccacagtaccagctgaatcgtcaagatgcacctcacctcgtgaagggagccatggcagccacctacagcgccctcaaccgcaatcagtctcccgtactggagcccgtagggaggagtaccctggcccagaggcgcggaatcaagaagattacctctacggccctgtag

SEQ ID NO: 3012 - DNA, 402 bp, Artificial Sequence
  Description of Artificial Sequence: Synthetic coding sequence
atggatgagccaatgggggaagaggagataaatccgcagacggaagaagtgtctattaaagaaatcgcgatcacacatcacgtaaaagaaggtcatgaaaaggcagatccaagtcagttcgaactgctgaaggtgctgggccaaggaagcttcggcaaggtattcctggtgaagaagatctccggctcagacgccaggcagctgtatgccatgaaggtactgaagaaggccacactgaaggtcagagatcgggtcagaacaaaaatggaaagagacatccttgtggaggtgaatcaccccttcatcgtgaagctgcactacgctttccagaccgagggcaagctgtacctgatacttgacttcctccggggaggagacctgttcactaggctgtccaaatag

SEQ ID NO: 3013 - DNA, 684 bp, Artificial Sequence
  Description of Artificial Sequence: Synthetic coding sequence
atgttcaaattcctttctttcagagtcagatcaatccaggaagaggtatccatcaaggaaatagccattactcatcacgtcaaagagggccatgaaaaggctgatccctcgcagttcgaactgctgaaagtgctagggcagggctctttcggcaaagttttcctcgtaaagaaaattagcggctctgatgcaagacaactttacgccatgaaagtcctgaagaaggcaacactgaaggtccgggatcgagtgaggaccaagatggagagagatattctcgtggaggtgaatcaccctttcattgtcaagctccactatgcatttcagacggaaggaaagctgtacttaatcctggacttccttcgcgggggggatctgtttacgcggctatcaaaagaggtgatgttcaccgaggaggatgtaaagttttaccttgccgagctggccctggccctggaccatcttcattctttgggcataatatatagggatctgaaacctgagaacattctgctggatgaggaaggacacatcaaactgactgattttggcctaagcaaggaaagtatcgatcatgagaaaaaggcatactccttttgtgggaccgtggagtacatggcaccagaagtggtgaacaggcgcggccatacccagtccgcagactggtggtcattcggcgtctag

SEQ ID NO: 3014 - DNA, 2136 bp, Artificial Sequence
  Description of Artificial Sequence: Synthetic coding sequence
atggatgaacctatgggagaggaggaaatcaacccacagactgaagaagtctcaataaaagagattgccatcacacatcacgtgaaagaaggtcacgagaaggccgatccatctcagttcgaactgctgaaggtgttagggcaaggttcttttggaaaagtctttctcgtgaagaaaattagtggaagcgacgcccgacaactctatgccatgaaagtgctgaagaaggccactttaaaggtcagagatagagttaggaccaagatggagagggatatcttagtagaggtgaaccatccatttattgtgaagctgcactatgctttccagacggagggtaaactgtaccttatcttggacttcctgcggggtggggacctgttcactcgactgagcaaagaggtgatgttcactgaggaagatgtcaagttctatttggccgagcttgccctggctcttgaccacctgcattctcttggtatcatttacagggacctgaagcctgagaacattctgctggatgaggaaggacacattaagctgactgactttggattgtcaaaggaaagtatcgaccacgaaaagaaggcctatagcttttgtggaaccgtagaatatatggcacccgaagtggtgaaccgcagaggtcatacccagtcagcggattggtggagctttggcgttcttatgtttgaaatgcttacaggcactctccctttccagggaaaggatagaaaagagaccatgacgatgatactgaaggccaaactgggcatgccgcagtttctaagccctgaggcccagtctctcctgaggatgctgttcaaacgcaatcctgccaacagattgggagcaggccctgatggagtggaagagatcaagcggcactctttcttcagcactatagactggaacaaactgtacagaagagaaatccacccccccttcaagccagcgacgggtaggccagaggataccttttatttcgatcccgagttcaccgcaaagacacctaaggacagcccaggaattcccccgtcagccaatgcgcatcaattgttccgcggtttcagctttgttgccataacaagcgacgatgagtctcaggccatgcagacggtcggggtgcacagtattgtacaactgcacaggaactcgattcagttcacggacggctatgaggtgaaggaagatataggagttggttcctacagcgtttgtaagcgttgcatccataaggcaacgaatatggagttcgcagtcaaaattatagacaagtcaaagcgggacccaaccgaggaaattgagatactcttgcgttatggccaacacccaaacatcattaccctgaaggatgtgtacgacgacggtaagtatgtgtacgtggttactgagctgatgaagggaggggaactactggacaaaatccttagacagaagtttttctcggaacgggaggcatccgctgtgttgtttacaataacgaagacagtcgagtatctgcatgcacagggcgttgtccatcgcgacttaaaaccatctaacattctgtacgttgatgagagtgggaacccagagtctattaggatatgcgatttcggattcgctaagcagctccgcgccgagaatggactgcttatgaccccctgttatactgctaactttgtggcgccagaagtgctgaagaggcagggttacgatgccgcttgcgatatctggtctctgggtgttctcctgtacacaatgctcaccggctatactcctttcgcaaacggacctgacgatactcccgaggaaatcctggcacgcatcggatctgggaaattcagcctttccgggggatattggaattccgtctctgacacggctaaggatttggttagtaagatgcttcacgttgacccacaccagagactgaccgccgctcttgtgctcagacacccctggatagttcattgggaccagctgccccagtatcagctgaacagacaggacgcacctcacctggtgaagggagctatggccgcaacttatagcgcactgaatcgaaaccagtctccagtcttagagccagtaggaagatccaccttggctcagagacgcggaattaagaagataacctcgaccgccttatag

SEQ ID NO: 3015 - DNA, 2139 bp, Artificial Sequence
  Description of Artificial Sequence: Synthetic coding sequence
atggatgaacctatgggcgaagaggaaatcaatccccaaaccgaggaggtttccattaaggaaatcgctatcacccaccatgtcaaagaagggcacgaaaaggctgatcccagccagtttgaactgcttaaagtgttgggacaaggctctttcggaaaggtctttcttgtgaagaaaattagcggaagcgatgccagacagctgtacgcaatgaaagtccttaagaaagcaacgctgaaagtgcgagaccgggtcaggacgaaaatggaaagggatattctcgtcgaagtgaaccatccattcatcgtaaaactgcactacgcatttcagactgaggggaagttgtacctgatcctggacttccttcgcggcggtgatctgtttacacggttgtccaaggaggtgatgttcacagaggaggacgttaagttctacctcgcagagctcgccctcgctttagatcatctgcactcgttgggcatcatctatcgcgacctgaagcccgagaacatcctcttggatgaagaaggccatattaaactgacagactttggcttgtccaaggaatccattgatcacgagaagaaagcttattctttctgtggcacagtggagtacatggccccggaggtcgtgaacaggcggggccacacgcagtcggcagattggtggagctttggggtccttatgtttgagatgctcaccggcaccctcccatttcagggcaaagacagaaaggagacgatgaccatgatcctgaaggccaaactgggaatgccccaattcctgagccctgaagcgcaaagtctgttacgtatgttattcaagaggaatcccgccaaccggttgggcgcgggaccagacggcgtggaggagattaaacggcattcctttttttccaccatagactggaacaaactgtatcgcagggagatacaccctccctttaagcctgccaccgggcggccggaggacactttctacttcgaccccgagttcaccgcaaagacccccaaggacagccccggtatcccaccatcggctaatgcccaccagctattcaggggctttagcttcgtagccattaccagcgacgacgagagtcaagccatgcaaactgtgggcgtgcattcgatcgtgcagcagcttcatcgcaactcaatccagtttacagacggctatgaagtaaaggaggatatcggcgttggtagttacagcgtctgcaagcgatgcattcacaaagcaacaaatatggagttcgcagtcaaaattatcgataaatccaagcgggatcctactgaggagatcgagatcctcctcaggtacggacagcatccaaatataatcaccctgaaagacgtatatgatgacggcaaatacgtgtacgtcgtcacagagctgatgaagggcggcgaactcctagataagatcttgaggcagaaatttttcagcgagagggaggcgtctgccgtgctgttcacgatcacgaaaactgtggagtacttgcatgcgcaaggagttgtgcaccgcgatcttaaaccatctaacattctttacgttgacgagagcggaaatcctgaaagtatcaggatctgcgacttcggctttgcgaaacagctgcgcgccgaaaatggtctcctgatgactccttgctacaccgccaacttcgtggcccccgaagtcttgaaaagacaggggtatgacgccgcttgcgacatttggtcactgggggtacttctgtatacaatgctgacaggatacactccttttgcaaacggcccagacgatacgcccgaggagattctggctcgaattggctctgggaagttcagtctgtcaggcggctactggaactcagtgtctgataccgctaaggatctggtgtcgaaaatgctccacgtggatccccaccagaggctgactgctgctctggtcctccggcatccctggattgtccactgggaccaattgccacagtaccagttgaaccgccaggacgcaccacacctggtgaaaggggcaatggccgccacttacagcgctctcaatcggaatcaaagtcccgtcttggagcccgtgggtcggtctacattggctcagagaaggggcatcaagaagattacttccactgccctttag

SEQ ID NO: 3016 - DNA, 1575 bp, Artificial Sequence
  Description of Artificial Sequence: Synthetic coding sequence
atgggtgatgaggacgacgatgagtcatgtgccgtcgaacttaggatcaccgaagctaatttgaccgggcatgaagaaaaggtgagcgttgaaaattttgaactgttgaaagtgcttggaactggagcctatggaaaagtgtttctggtgcggaaggccggaggtcacgacgctggaaagctgtatgctatgaaagtgctcagaaaagcagccctcgtccaaagggcaaaaacccaagaacacacccgaacagaaaggtcagtcctcgagctcgtgagacaggccccctttttggtgactctgcattacgcattccaaactgatgcaaagttgcacctgattctggattacgtatctggtggggaaatgttcacccatttataccagcgacagtacttcaaggaggctgaagttagagtttacgggggggagatcgtgctcgccctcgagcacctgcacaagctaggtatcatttatagagacctgaagctggagaacgtgctgctggatagtgaaggccacattgttctgacagattttgggctgagcaaggaattcctgacagaagagaaggagcgcacattcagcttctgtggcacaattgagtacatggctcctgagattatccgatcgaaaaccggacacggtaaggcagtggactggtggtctctagggatcttgctatttgaactgctaacaggggcatccccctttactcttgagggagaacgaaatacacaggccgaggtctctagacgtattttgaagtgctcacctcctttccctccccggattggccccgttgctcaggacctgttacagcggttgctgtgcaaggatcccaagaagcggctgggggcaggaccacaaggtgcacaggaagtgagaaaccaccctttttttcagggccttgattgggttgccctggctgcccggaaaatacccgctccttttagacctcaaatcagatccgaactcgatgttggcaacttcgctgaggagttcactagactcgaaccagtttatagtccacctgggagtccaccccccggggatccgcgtatctttcagggatacagttttgtggcccccagcatcctgtttgatcacaacaacgccgcagaaattatgtgcaagatccgggaaggccgcttctcactagacggagaggcctggcaaggggttagcgaagaagccaaggaactagtgcggggattactgacggttgatccagccaagaggctgaagctggagggtttgcgagggtccagctggttgcaagacgggagtgctaggtcatctcccccacttcggactccagacgtgctggagagtagtgggcccgcagttagaagcggactgaacgctactttcatggccttcaataggggtaagcgcgaaggttttttcctgaagagtgtggaaaacgccccactggccaagcgacggaaacagaaacttcggtccgccaccgcttctagacgcgggtcaccagctcccgcaaatcctggtagagctccagtagcttcaaagggagctccacgaagggccaatggaccgttgccacctagttag

SEQ ID NO: 3017 - DNA, 2319 bp, Artificial Sequence
  Description of Artificial Sequence: Synthetic coding sequence
atgggagatgaagacgacgatgagtcatgtgcagtcgagctgagaatcactgaggccaacctgacggggcatgaggagaaagtgtcagtagagaacttcgagttactgaaggttctgggcacaggcgcctacggtaaagtgtttttggtgcgcaaagcgggcggacatgacgccggaaagctctatgccatgaaggtattacgcaaagctgcgctcgtgcaaagggccaagacacaggaacacacccgcactgaacggagcgtgttggagctggtgcgtcaggctcctttcctggttaccctacactacgccttccagacggatgcaaagctccacctaattctggattacgttagtggtggcgagatgtttacgcacctctatcaacgccagtacttcaaggaggcagaggtacgagtgtatggtggcgagattgttttggctctggaacatctgcacaagcttggcatcatttaccgtgatctgaagctcgagaacgtgttattggattccgagggtcatattgtgttgaccgacttcggcctgagcaaggagtttttgaccgaggagaaagaacggaccttcagcttctgcggcacaatagagtacatggcccccgaaatcatccgctctaaaaccgggcacgggaaagccgtggattggtggagcctgggaattctcctcttcgaacttcttaccggagctagcccattcacactggagggggagaggaacacccaggctgaggtttcgcgtcgaatcctcaaatgctctccacccttccctcccagaatcggacctgtagcccaagacctgctgcagcggctgttgtgcaaagacccaaagaagcgcctgggcgccgggcctcagggtgcacaggaggtgcgcaatcaccccttttttcaaggcttggattgggtagcccttgctgcacggaaaattcctgcaccctttaggcctcagattcggtctgagctcgatgtgggaaactttgccgaagagtttacccgcctggaacctgtctacagcccccctggatctcccccacctggcgacccgaggatattccagggatactccttcgtggctcctagtatcctgtttgatcacaataacgcagtgatgaccgatggactagaggcccccggagctggtgaccggcccggcagagcggccgttgctcgcagtgccatgatgcaagactcaccattcttccagcaatacgagctggatctgcgggagcctgctttggggcaggggagcttttccgtgtgtcgtcggtgccgacaacgccagtccggtcaggagttcgcggtgaagattctgtctaggcgactggaggcaaatacgcagagggaagtcgctgcactacggctatgtcagtctcaccccaatgtggtcaacctgcacgaggttcaccatgaccagttacacacctacctggtactggagctgctcagagggggtgagctgctcgaacacattcggaaaaaacggcacttctctgagagtgaagcttcccagatcttgcgatcgcttgtctctgctgtctctttcatgcacgaagaggccggcgtcgtccaccgagatctgaaacctgaaaatatcctgtacgcggacgatacccctggggcgcctgtcaaaattatcgacttcggattcgcccgcctcaggccacaatcccctggcgttcccatgcagaccccgtgctttactctgcaatatgcagcgccagaattgctagcccagcagggctacgatgaatcgtgcgacctctggtcactcggagtgattctctacatgatgctttccggccaggtccccttccaaggggcctccggacagggaggtcaatcccaggccgccgaaattatgtgtaaaatccgagaaggcaggttttctctggatggcgaggcctggcaaggtgttagtgaggaagctaaggaacttgtgcgcggtctgctaacggtggaccccgccaaaaggctaaaactcgaaggtctcaggggatcctcttggcttcaagatggatcagcacggtccagcccccccctgcgtacacccgacgtactggaaagttccggcccggcggtgaggtctgggttgaacgccaccttcatggcctttaaccgggggaaaagagagggtttcttcctgaagtcagtcgaaaacgcgccccttgcaaagcgccggaaacagaagttacgcagtgcaaccgccagccggcggggaagcccagcgccggccaaccccggaagagcccccgtggcgagtaaaggcgcgcctcgaagggctaacggacccttgcctccgtcttag

SEQ ID NO: 3018 - DNA, 2298 bp, Artificial Sequence
  Description of Artificial Sequence: Synthetic coding sequence
atgggggatgaggacgatgacgaatcatgtgcagtggaactgcgaatcaccgaggctaatctgacaggccacgaggagaaggtgtcggttgaaaacttcgaactacttaaggtgctcggaacgggcgcctacgggaaagtctttcttgttaggaaggccggaggtcatgatgccgggaagctgtatgccatgaaggttctaaggaaagccgctctagttcaaagagccaagactcaggaacacactagaacagagagaagcgtgttagaactggtccgccaggccccatttctagtgactctgcactacgcctttcagacggatgccaagcttcaccttatcctggactatgtgtcagggggagagatgtttacgcacctctaccagcggcaatacttcaaagaagccgaggtcagagtttatggcggagagattgtgctggctctggagcacttacataaactgggtattatctaccgcgacttgaagttggaaaacgtactactcgattcagaagggcacatcgtgcttacagactttggcttgtctaaagagttcttgaccgaggagaaggaaaggacgttctctttttgcggaaccatcgagtatatggccccagaaataatccgttctaaaacaggccatggcaaagctgtcgactggtggtcactaggcatccttctcttcgagcttctgacaggagcctctccattcaccctagagggggagcggaacacgcaggctgaggtgtccaggagaatcctgaagtgtagtccaccttttccacctagaattgggccagttgcacaggacctcttgcagagactgctgtgtaaagacccaaagaaacggctaggcgccgggccccagggtgcccaggaggtacggaatcacccattctttcagggtctggactgggtggcgctggcggctcgtaagattcctgccccctttcgcccccagatccggtccgagttagatgttggcaacttcgcagaagagttcacgcgcctggagcccgtctattccccgccaggaagccccccccctggcgatccacggatcttccagggttatagttttgtggccccatctatactgttcgaccataacaatgcggtaatgaccgatgggctggaggctcccggcgccggcgatagacccgggcgtgctgcagtcgcaagaagtgcaatgatgcagtatgagttggacttacgcgagccggcccttggtcagggcagcttttcggtgtgtagacgctgtcgccagaggcagtccgggcaagagttcgccgttaagatcctgagccggcgcttggaggccaacactcagagagaggtggccgccctcagactttgtcaatcacatccaaatgtggtaaatctccatgaggtacaccacgaccagctgcatacttatctggtcctagagctgctccggggcggggagttgctggagcacatcaggaaaaagagacatttcagcgaaagtgaggcctcccagattcttcgaagtctggtctcagctgtgtcgtttatgcatgaggaagcaggagtcgtgcatcgcgatttgaagcccgagaatattctatatgcagatgacaccccaggtgcgcctgtcaagatcattgacttcggattcgctcggctgcggccccagagtccaggggtaccaatgcaaaccccttgcttcaccctgcagtatgccgcccctgagctattggcccagcagggttatgacgagagctgcgacctctggtcgctgggcgtcattttgtacatgatgctgtcaggccaagtgccattccagggcgccagcgggcaggggggccaatcccaggctgccgagatcatgtgcaaaatccgggagggccgtttcagcctcgatggcgaagcatggcagggcgtcagcgaagaagccaaggagctcgttcggggcctgctcacagtcgatccagctaagcgcttaaaactggagggacttcgaggcagctcctggctccaggatggttcagcgcgaagtagcccccctttacggacacctgacgtgctcgagtccagtggccccgccgtccgcagcggactcaatgccacctttatggctttcaatagagggaaaagggaaggtttctttttaaaaagcgttgaaaacgcacctctggctaaacggaggaaacagaaactccgtagtgcgaccgcatcgcggcgggggagtcccgcacccgctaaccccggccgtgcacctgtagcttccaaaggggcccctcggcgggcgaacggacctctccccccttcctag

SEQ ID NO: 3019 - DNA, 2118 bp, Artificial Sequence
  Description of Artificial Sequence: Synthetic coding sequence
accgaagcgaatctgacaggacatgaggagaaagtctccgttgagaatttcgaactgttgaaggttctcggcactggcgcatatgggaaagtctttcttgttcgcaaggccggtggccacgatgccgggaaactgtatgccatgaaggtgctaaggaaagctgcgctggtccagcgcgcaaaaactcaagagcatacacgcactgaacgtagtgtccttgaactggtgcgccaggcccccttcctggtaacactacattatgcatttcagacagacgcgaaactgcatttaatcctcgattacgttagcggcggggaaatgtttactcatctttatcaaagacaatactttaaggaggcagaggtgcgtgtgtatggcggagaaattgtcctggccctggaacatcttcacaagctggggattatatatagggatctgaaactagagaatgtgctgttggatagtgaagggcacattgtcttgaccgacttcggactcagcaaggagttcctgaccgaagagaaagaaagaacattctcgttctgtgggactatcgaatacatggcccccgagatcatccgctctaagactggacacgggaaggccgtagattggtggagtctcggaattctgctgtttgagcttttgacgggtgctagcccctttacgctggagggagagaggaacacgcaggccgaggtctcaagaagaattctcaagtgttccccccccttcccacctaggattggtcctgtcgcacaggatctgctccagagactgctgtgcaaggatcctaagaaacggctgggtgccggccctcagggagctcaggaagtgcggaaccacccgtttttccaaggattggactgggttgctctggctgcgcgtaagatcccagcgccctttagaccccagatacgcagcgagctcgatgtcgggaacttcgccgaggaattcacgagattggaacccgtctactcccctcccgggtctccacccccaggcgaccccaggatttttcagggttacagttttgtggcaccttccattctgttcgatcataataatgccgtgatgaccgacgggctcgaggctccaggtgctggtgaccggccaggtagggctgccgtcgctaggtccgctatgatgcaacagtatgagctggacctccgagagcccgccctcggtcagggctcattctccgtctgtcgaagatgcaggcagcggcagtccggacaggaattcgctgtgaagatactgtcaagacggcttgaggccaacacacaacgcgaggtggcagcactgcggctgtgtcaatcacacccaaatgtcgtgaatctacacgaagtgcaccatgaccagttgcatacttacctggtcctggaactgctgcgagggggcgagttgttagaacacatcaggaagaagcgccatttctccgagtctgaggcaagtcagattctccgaagcctggtgagtgccgtatcctttatgcatgaagaggctggtgtggtgcatcgtgacttgaagcccgagaatattctgtatgccgatgacactccgggcgcccccgttaaaatcatcgattttggcttcgccaggcttaggccccagtcccctggggtacctatgcagacaccctgcttcacacttcaatatgcagctcctgaattgctggcacagcagggatacgatgagtcttgcgacctgtggtctctgggcgtgatcctctatatgatgttatcgggacaggtccccttccagggcgctagcggacaaggcggccagagtcaggcagctgagatcatgtgcaaaatcagagaaggcaggttctctctggacggcgaggcttggcaaggcgtcagcgaggaggccaaagagttagtaagaggcttgcttacggttgaccctgctaagcgactgaagctggaaggccttaggggctcttcttggttacaggatggatcagcaagaagcagtccccctcttagaacccctgatgttctcgagagtagtgggccagctgtcagaagcggcctcaacgcaacattcatggcatttaatcgcgggaaacgcgaaggattctttttaaaatctgtcgagaacgcacccctctag

SEQ ID NO: 3020 - DNA, 2409 bp, Artificial Sequence
  Description of Artificial Sequence: Synthetic coding sequence
atggaggaggagggtgggagcagcggaggagccgccggtaccagcgctgatggcggagacgggggtgagcaacttctgacagtcaagcacgagctccgcacagctaaccttaccggtcacgcagaaaaagtcggaatcgaaaacttcgagctgctgaaagtgcttgggactggggcatatggcaaagtattcctcgtgagaaagatttccggccacgatacgggcaaactctatgccatgaaggtcctgaaaaaggcaacgatagtgcagaaagctaaaacaaccgaacatacgcgtactgagagacaggttttggagcacatcaggcaaagcccgtttctcgtgactctccattatgcgttccaaacggagacaaagctacacttgatcttggattacatcaatgggggggaactgtttacccacctgtctcagagagagcgatttactgagcatgaggtgcaaatttatgtgggggagattgtcctcgcactggaacacctccacaaattgggaattatttaccgagatattaagctggaaaatattcttctggactcgaatgggcacgtcgttctgactgacttcggcctttccaaagagtttgttgccgatgagacggagcgcgcttactctttttgtggcaccattgaatacatggcgcccgatattgtgagaggtggcgattctggacatgacaaagctgtggactggtggtccctaggagtcctcatgtatgaactgctcaccggcgcatccccgttcactgtggacggcgagaaaaactcacaggcggagatttcaaggcggattctgaagtccgagcctccatacccgcaggagatgtctgctctggccaaggacctgattcagcggctgctgatgaaggaccccaagaagcgcctggggtgtgggcctagagacgccgatgagatcaaagaacatctgttcttccaaaaaataaactgggatgacctagcagctaagaaagtgcccgctccctttaagccagtgatccgagatgagttggatgtgagcaatttcgccgaggaattcaccgagatggacccgacatatagccccgccgccctgcctcagtcctctgagaaacttttccaaggctatagctttgtcgcgccttctattttgtttaaaaggaacgcggccgtcatcgaccctctccagttccatatgggtgtggagcggcctggcgttactaacgtggctagatccgcaatgatgaaggacagccctttttaccagcactacgacctcgacctcaaggataagccgctaggtgaggggtctttcagcatttgtaggaagtgtgtgcataagaagtccaaccaggccttcgcagttaagatcatttccaaaaggatggaagccaatactcagaaagaaataactgcccttaagctgtgcgagggccatcctaacattgtgaagctccatgaagtattccacgaccagcttcataccttcctggtcatggagctcctgaacggcggcgagctgtttgagagaatcaagaagaagaaacattttagcgagactgaggccagctatatcatgaggaaattagtttccgcagtctcccatatgcacgatgtcggtgtcgtgcaccgcgatctcaaacctgagaatcttctgttcacagatgaaaacgataaccttgagataaagattatagactttggatttgccagattgaagccccccgacaatcagcccttgaagaccccatgttttactcttcactatgctgctccagaactgctgaatcagaacggctacgacgagtcctgcgacctgtggagtcttggggtgatcctgtacacaatgctttccgggcaggtcccgttccagtcccacgaccgctcgctgacctgcacctccgccgtggaaatcatgaaaaaaatcaaaaaaggagatttttcgttcgagggtgaagcctggaaaaacgtttcccaagaagccaaggacctgatacaggggctgctaacagtggacccaaacaaaaggttgaaaatgtctgggctgaggtacaacgagtggctgcaagatggctctcagctttcatcaaatcctcttatgacaccagatatcctcggtagcagcggagccgctgttcatacttgcgtgaaggccaccttccatgcgttcaacaagtacaaacgagagggtttttgtctgcagaacgtggataaagctcccctggcaaagcggcgtaagatgaaaaagaccagcacatctacggagaccagatcgtcttctagcgaaagcagccacagcagcagcagccacagtcacggcaaaaccactcccacgaaaaccttgcagcctagtaatccagcggatagtaataatccagagaccctttttcaattcagcgattccgtggcgtag

SEQ ID NO: 3021 - DNA, 1650 bp, Artificial Sequence
  Description of Artificial Sequence: Synthetic coding sequence
atggaagaggaggggggctcaagcggaggagccgcggggaccagcgcagacgggggggacggaggggaacaactgctcactgtgaagcacgaactgaggaccgcaaatctgactggtcacgctgaaaaggtgggaatcgaaaattttgaactgctgaaagtactgggaacgggggcatacgggaaggtcttcctggtgagaaaaataagtggccacgacactggaaagctgtatgctatgaaagtgctcaagaaagctaccatcgtgcagaaagcgaagactaccgaacacaccagaacggaaagacaggtactcgaacacattcgccagtccccctttttggtcacacttcactacgcattccagactgagactaagctgcatttgatcttggattatatcaatggcggagaactctttacccacctgtcccagagggaacgttttaccgagcatgaagtgcagatatacgtaggagagatcgtgctcgcgctcgagcatttgcacaaacttggcatcatttacagggatataaaattggagaacattctcctggattctaacggccacgtggtgcttaccgacttcggcctgagtaaagaattcgttgcggacgagactgagcgggcttattccttttgtggcacaatagaatatatggcacctgacatcgtaaggggaggtgattctggacacgataaagcagttgactggtggtccctgggcgtactgatgtacgagctccttacaggagcctctccatttacagtggacggcgagaagaactcacaagcggaaatatccagaaggattcttaagtctgagccgccttacccccaggagatgtccgccttggctaaagatctgatccaaagattgcttatgaaagaccccaagaaaagactcggctgtggcccccgggatgctgacgaaattaaggagcatctcttctttcagaagatcaattgggatgacctagctgctaagaaagtgccagctccctttaagccagtgatacgcgatgaactcgacgttagcaattttgccgaggaattcaccgaaatggatccaacctatagccctgctgcactgccgcagagttcggaaaagctgttccaaggttacagcttcgtggcaccgtccatcctcttcaagcgtaacgccgcagtaatcgatcccctgcagtttcacatgggtgtcgagcggccaggagtgactaacgtggccaggtcagccatgatgaaggacagccctttctatcagcattatgatttggacttgaaggacaaaccacttggcgagggctccttctccatctgccggaaatgtgtacacaagaagtccaaccaggccttcgcagtgaagattatctcaaagagaatggaagcaaacacacagaaggaaataacagcccttaaattgtgtgagggtcaccccaatatcgtcaagctccatgaagtgtttcacgaccagctccacaccttcttagtgatggagctgctaaacggaggggagctgtttgagcgcattaagaagaagaagcacttttccgagacagaagcatcttatattatgaggaaactggtgagtgccgtgtcgcacatgcatgatgtgggcgtggtgcacagggatctgaagcccgaagtctag

SEQ ID NO: 3022 - DNA, 2172 bp, Artificial Sequence
  Description of Artificial Sequence: Synthetic coding sequence
atgaaggtcctcaaaaaagcaaccattgtacaaaaagccaagacaactgagcatacccgcacagaaagacaggtcttagagcacatacgacagagcccgttcttggtgaccttgcattatgcttttcagacggagaccaaactccacctgatcttagactacataaatggaggcgaactgttcacacatctgtcacaacgagagaggttcactgagcacgaggtccagatatacgtgggtgaaatagtcttggccctcgaacatctgcacaagctcggcatcatttatcgtgacattaaactggaaaacatacttttagacagcaatggacacgtggtactaaccgacttcggactgagtaaggaatttgtagccgacgagaccgagcgtgcttattctttctgtggcactattgagtatatggcccctgatatcgttcggggcggggactctgggcacgacaaagcagtggattggtggagcctcggcgtcctaatgtacgagctcctcacgggggccagtccattcaccgtagatggggaaaagaactctcaggctgaaatctcacggaggatcctgaagagcgagcccccctatcctcaggaaatgtctgcgctggccaaagatctgattcaacgtctcctaatgaaggacccaaaaaagagactcggatgtggccctagagatgcagatgagatcaaggagcatctgttctttcagaaaatcaactgggacgatttggccgcaaaaaaagtgccagctccgttcaaaccagtaattagagacgagctggatgtttcaaatttcgcggaggaattcacagagatggatccaacatatagcccggccgcattgccgcagagcagtgagaagctttttcagggatatagtttcgtggctcccagtattcttttcaagcgtaacgcagccgtaattgatccactgcaatttcatatgggagtggagaggcccggtgtcactaacgttgcacgctcagcgatgatgaaagatagtcctttttatcagcactatgatctggatctcaaagataagcctcttggtgaaggatccttcagcatctgccggaagtgtgtgcacaagaagagcaatcaggccttcgccgtcaagatcatcagcaagagaatggaagctaacacgcagaaagaaattactgccctgaagctttgtgagggacatcccaatatagtcaagttgcatgaggtgtttcacgaccagctacacacgtttctggtgatggaactgctcaacggaggggagctcttcgagcggataaagaagaaaaaacatttttctgagacagaagcctcttacatcatgcgcaaactagtctccgcggtgtctcacatgcacgacgtgggcgtcgtacaccgggaccttaagccagaaaacttgctttttacagacgaaaacgacaaccttgagataaaaataatcgatttcggcttcgcccgtcttaagccccccgacaaccagcccctgaaaacgccttgcttcacactacattacgcagcgccagaactcttaaatcaaaacggatatgatgagtcttgcgatctgtggagtctcggggtaattttgtacactatgctttcaggacaggtgccctttcagagtcatgatcgaagcctcacatgcactagcgccgtcgagattatgaagaaaataaagaaaggcgattttagctttgagggcgaggcctggaagaatgtgtctcaagaggccaaggatctaatacagggtctgctgacagtcgaccccaacaaaaggctaaaaatgtcaggactcaggtacaacgagtggctgcaggatggcagtcagctgagcagtaaccctctcatgacccccgacatcctggggagcagtggtgctgccgtccacacctgtgtgaaagcgacttttcatgcttttaacaagtacaaacgggagggattctgcctccagaacgtagataaggctcctctggctaagaggagaaagatgaaaaaaacctcaacttccacagagaccaggtcctccagctcggagagcagtcatagtagctcttcccatagccacggaaagaccacgcccactaaaactctccagccctctaacccagccgacagcaacaaccccgaaacactctttcagttttccgactcggtggcctag

SEQ ID NO: 3023 - DNA, 2238 bp, Artificial Sequence
  Description of Artificial Sequence: Synthetic coding sequence
atgctccccttcgctccacaagacgagccctgggatagagagatggaggtgttcagcggaggtggagcctcctcaggcgaagttaatgggttgaagatggtcgatgaacccatggaagaaggcgaagccgattcatgtcatgacgaaggggtggttaaagaaatacctatcactcaccacgtcaaggaggggtacgagaaagctgaccctgctcagtttgaactgttgaaggttctgggccagggctctttcgggaaggtattcctagtccgtaagaaaacaggcccggacgcagggcaactttacgcgatgaaagtactcaagaaggcaagccttaaagtccgcgaccgcgtgcggacaaagatggagagagacattttagtggaagtcaatcatcccttcatcgttaagctgcactacgcctttcagaccgaaggaaaactttaccttattctggacttcctaagaggaggagatgtctttacccgcttgagcaaagaggtccttttcaccgaggaagatgtgaaattttatttggccgaattagctttggcattagaccacttgcatcaactgggcatcgtttacagagaccttaagcccgagaacatcctcctggacgaaattggccatatcaaacttaccgattttgggttgtccaaagaatccgtggatcaagagaagaaggcatatagcttctgtggaacagtcgagtacatggcgcctgaagtcgtcaaccggagaggccattcccagagcgctgattggtggtcttacggcgttctcatgtttgaaatgctgactgggaccctgccctttcaggggaaagaccggaacgaaaccatgaatatgatcttaaaggccaagcttggcatgccacagttcctgtcagcagaggcccaatctctactacggatgctgtttaagcgaaatcccgctaaccgcctgggatctgagggggttgaagaaattaaaagacacctgttctttgctaatatcgactgggacaagctctataagagggaggtacagcctcccttcaaaccggccagtggcaagccagatgatacattttgcttcgatcctgagttcacagctaagactcccaaggattccccgggcctgccggcttctgcgaatgcgcatcagctgttcaagggcttcagctttgtagctacatctatcgccgaagaatacaagatcactcccatcacgtctgctaatgtgctgcccatcgtacaaattaatggaaacgctgcccagttcggagaagtttacgagttgaaagaagatattggggttggttcctatagcgtatgtaagaggtgcatccacgccaccactaacatggagtttgccgtgaagattatcgacaagtcaaaacgggacccgtcagaagaaattgagatcctgatgaggtacgggcagcacccaaacattattaccctcaaagatgtctttgacgatggcaggtacgtgtatcttgttacagacctgatgaaaggcggcgagttactggatcgcattctgaagcagaaatgcttttccgagcgagaggcgtccgatattctatatgttatttctaaaacagtagactacttgcactgtcagggggtggtccatcgggatttaaagccaagcaatatcttgtacatggatgagagcgcatccgcggatagtattagaatttgcgatttcggattcgccaagcaattgagaggcgaaaatggcctcctgctaacaccctgttacactgctaatttcgtggctcccgaggtgttaatgcaacagggatatgatgcagcttgcgacatctggtccctcggggtcttgttttacacaatgctggccggttacacaccgtttgccaacggcccaaacgacactcccgaggaaattcttcttcgcattggaaacgggaagttttcactaagtggcggtaactgggacaacatcagcgatggcgctaaggatcttttatcccacatgctgcatatggatccacatcagcgatacacggccgagcagattcttaagcatagttggattacccacagggatcaattgcccaacgatcagccgaaacgaaatgacgtgtcacacgtagtcaaaggggcaatggtggcgacgtacagtgcacttactcataaaacatttcaaccagtcctggagccagtggcggccagctctctagcccaacgcagatctatgaaaaaacgcacgagcacaggcctgtag

SEQ ID NO: 3024 - DNA, 2238 bp, Artificial Sequence
  Description of Artificial Sequence: Synthetic coding sequence
atgggactgagcacgtctgccatttggaaaaacacccgcgtggagattgtgaacccatatgaggtgaagcgaaaagtgaaagtgaacgggttaaaaatggtggatgaaccaatggaagagggtgaagcggacagctgtcacgatgagggcgtggtcaaagagattcccatcactcaccatgtcaaggaggggtacgaaaaagcggaccccgcccagttcgagctcctgaaggttttggggcagggctccttcggtaaggtgttcctagtgcggaaaaagacaggtcctgatgccggacaactgtacgctatgaaagtgctcaaaaaggctagcttgaaggttcgtgatagagtacgtactaaaatggaacgagatatcttagtggaggtcaatcatccattcattgtgaagctccactatgccttccagactgaagggaaactctacttaattctggatttcctcagaggcggagatgtcttcacccgtttgtcgaaggaggtgctgttcacagaggaggacgtgaagttctacttggccgagctagcactggctctcgatcacctccaccagctgggaatcgtgtatcgagacctcaagccggaaaacatccttctggatgagataggtcacattaaactgaccgactttggcctgtctaaagagagcgtggaccaagaaaagaaagcttacagtttctgcggcaccgtggagtatatggcccctgaagtggtaaatagacggggccacagccaaagtgccgactggtggtcttacggagtgttgatgtttgaaatgctgaccggcactcttccatttcagggcaaggaccggaacgagaccatgaacatgatcttgaaagccaagctggggatgcctcagttcctctccgctgaagcccagagtctcctcagaatgttgtttaagagaaatccggcaaatagattaggatcggaaggagtcgaagaaattaaacggcatctatttttcgccaatatagactgggataagctctacaaacgggaagtccagcctccatttaaacccgccagtgggaagcctgatgacacattctgcttcgatccagaatttactgctaagacccccaaggacagccccggccttccggcgtctgctaacgctcaccagctgttcaaggggttttcttttgtagccacgtctatcgcagaggaatacaagattacccccattactagcgcgaacgtactgccaatcgtgcagatcaacgggaacgccgctcaatttggtgaagtatacgagctcaaagaggacataggggtcggttcctactccgtgtgtaagagatgtatccacgccaccacaaatatggaattcgcagtgaagataatcgacaagagcaagagagatccttcagaagaaatcgagatcctcatgaggtacggacagcaccccaacatcattactttaaaagacgtatttgacgatggccgttacgtgtatttagtaactgacctgatgaaaggtggggagctgcttgataggattcttaaacagaaatgctttagtgagcgcgaggcctcagacatcctgtatgtgatcagcaagacagttgactatttgcactgtcagggtgtggtacatagagacctcaaaccttcaaacattctttatatggacgagtctgcttcagcggactccatccgcatttgcgattttggattcgcaaagcagctgcggggggagaatggcctcctcctcacaccatgctacacagccaacttcgtggccccagaggtgctgatgcaacagggctacgacgctgcctgcgacatttggtccctgggcgtgttgttctataccatgctggctgggtacactccttttgctaatgggccgaatgatactcctgaagagatccttctcagaatcggaaacggcaagttcagcctttcaggcggcaattgggataacatctccgatggagccaaagatctgttatctcacatgctccatatggatccacaccagagatatacagcagagcagatccttaagcatagttggatcactcaccgtgatcagttacccaacgaccaacccaagcggaatgacgtcagtcatgtggtaaagggagcgatggtcgctacgtacagcgcattaacccacaagacctttcagcctgtgctggagcccgtggccgcaagctccctagctcagcggcggtcaatgaagaagcggaccagtaccggcctctag

SEQ ID NO: 3025 - DNA, 1626 bp, Artificial Sequence
  Description of Artificial Sequence: Synthetic coding sequence
atgtcacttgtcgcctgcgagtgtctgccgtcccccggattggagcccgagccatgttccagggctcgctctcaggctcacgtgtacctcgaacaaattcgcaatcgggtggcccttggtgtccccgacatgaccaagagggactacctggttgatgcggcaacccaaattaggctggctctggagagggacgtctccgaagattatgaggccgcctttaatcactatcagaatggggtggatgtcctgctgagggggattcacgtggaccccaataaggagcgtcgggaggctgtaaaattgaagatcactaagtacctccggagagccgaggaaattttcaactgccacctgcagagacctctgagttccggcgcttctccgtccgcagtgcagctggttcaggatcctgccaccggcggtactttcgtcgtgaaatctctccctcgctgccatatggtttcgagagagagactgactataataccacacggtgtgccatacatgactaaactcctgagatacttcgtgtcagaggattccatcttcctgcatcttgagcatgtgcagggaggtaccttgtggtcccacctcttgtcccaggcacactctagacactccggtctatcctctgggtccacccaggaacggatgaaagctcaactcaatcctcatctcaacttattgactccagcaaggctgccttcaggacatgctccaggacaagaccgcatcgccttggaacctccgcgcactagtccaaacttgctgctcgccggcgaagctccgtccactcggcctcagcgggaagcggaaggtgaacctaccgcacgcacatctacctccggttcctcggatctgccaaaagctcctggaggccatttgcatttgcaggcacggcgcgcaggccaaaactccgacgccggtcccccaagaggactgacatgggtcccggaaggggctggacctgtgttgggtggctgtggccgaggaatggatcagtcttgcttatcagcggacggcgcagggcgcgggtgtggaagagcgacttggtcagtaagggaggaacaggtcaagcaatgggcggcagagatgctggtcgccctggaagctctgcatgaacaaggggttctttgccgggacttgcaccccggcaatctgctcctggatcaggcggggcacatcaggcttacatattttggacagtggtctgaagtggagcctcaatgttgtggcgaagctgtagataacctgtattctgcaccggaggtgggtgggatttccgaactgacagaagcttgtgactggtggtctttcggctcactcctgtacgagctgcttacggggatggcactctcccagtctcatccctccgggattcaggcccatacccagctacagctccccgaatggcttagtagaccagccgcctctctgctcacagagctgcttcaatttgaaccaactcgccgacttggaatgggagagggcggggtcagcaagcttaagtctcaccccttcttctcaacaattcagtggagtaaattggtgggaaccagtcttgagacacatctgcggactctgatccattggctcagcggccctaaacctgattgtcccggctag

SEQ ID NO: 3026 - DNA, 1650 bp, Artificial Sequence
  Description of Artificial Sequence: Synthetic coding sequence
atgagcctggtggcgtgcgagtgcctgccttctccagggctggagcccgagccttgtagtcgtgctcggagtcaagcgcatgtgtacctggagcaaatcagaaatcgggtcgctttaggcgtgcctgacatgactaagagagattacctggtggacgccgcaacccagataagactggccctggagcgtgacgtctccgaagattacgaggccgcctttaatcattatcagaacggcgtcgacgttctcctgcgcgggatacacgtggaccctaacaaggaacggcgtgaagccgtcaaactgaaaattacaaagtatctgaggagagccgaggaaatctttaattgtcacctccagaggcccttaagttctggagcaagcccttcagccgggttttcttccttgcggcttagacctattagaaccctgagctccgcagttgaacaactgcgaggatgccgagtagtcggagtgattgaaaaggtgcaactggtgcaggatcctgcgactggcgggacttttgtcgtgaagtcactgcccagatgccacatggtctcccgtgaacggcttaccattattcctcatggcgtcccctatatgaccaagctgctgcgttatttcgtgtctgaagacagtatattccttcatctggaacacgtgcagggcggcactctatggagccacctcctgagtcaggcccatagtcgccactcgggtctgagctctgggagtacacaggaacgcatgaaagcacagcttaacccccatctcaatctgctgacgcctgcaagactgccttccggtcatgcccccggtcaggacaggatcgccctggaacccccgcgcaccagcccaaacctgctcttggctggggaggcccctagtactcgcccccagcgagaagctgaaggcgaacccaccgcccgcaccagcacctctgggtcgtcagatttaccgaaggcacctggtggccacctccacctgcaggcccgccgagccggacaaaactcagacgccggcccccccagggggctcacttgggtgcccgaaggcgctggacctgtacttggcggatgcggaagagggatggatcagtcttgcttgagcgccgacggggccggtcgcgggtgcggccgggccacatggtcagtgagagaagaacaggttaagcagtgggctgctgaaatgctggttgccctggaagctctacacgagcagggcgtcctctgccgggatctgcatcctggcaatctgttgctagaccaagcgggtcacatccggctgacttactttggacagtggagcgaagttgagccacaatgttgcggcgaggcggtggataacctgtatagcgctcctgaggtgggtggtatttctgagcttactgaagcctgcgattggtggagcttcggttctctcttgtatgagttactcactggcatggccctttcccagtcacatcccagtggaatacaggcccacacccagttgcaactcccagagtggttgtctcgtcctgccgctagccttctcactgaattgttgcagtttgagcccaccaggagactgggaatgggtgagggcggcgtgtccaagctgaagtcacatcccttcttctctacaattcagtggagtaaactggtcgggtag

SEQ ID NO: 3027 - DNA, 1650 bp, Artificial Sequence
  Description of Artificial Sequence: Synthetic coding sequence
atgtctctggtggcatgcgagtgtttaccatccccagggctggagcccgaaccatgcagccgtgccagatctcaggcccacgtctacctggagcagatacggaatagggtcgccttgggggtgccagatatgactaaacgcgactacttggtcgatgcagctacgcagatcaggctggccctagaaagggatgtcagcgaggattacgaagcggcgttcaatcattatcagaatggcgtcgatgtcctcttaaggggaatccacgtggatccaaataaggagaggcgcgaggcagtcaaactgaaaatcacaaagtacctgaggcgcgcagaggaaatcttcaattgccacctgcagcgtccactgagcagtggggctagcccttctgcaggtttctcttcattgaggctgaggcccatacgtaccctgtcttccgctgtcgaacagctgcgagggtgcagggtggtgggggtgattgagaaagtacaacttgttcaggacccggcaactgggggcaccttcgttgtgaagtccctgccaagatgtcatatggtgtccagagagaggctgacaatcatcccccatggcgtgccatatatgactaagttacttagatacttcgtgtccgaggacagcatattcctgcaccttgaacatgtgcaggggggaactctgtggagccaccttttaagtcaggcccactctagacattctggactgtcaagtgggagcacacaagaacgaatgaaagcgcagcttaatccgcacctaaatctcctcactcctgcacgactacccagcggccacgctccgggacaggacagaattgccctcgagccacctagaaccagcccgaatttgctgctggccggtgaggccccaagtacaaggccacagcgggaagccgaaggtgaacccacagctcgtacatcgacgtccggcagttccgacctccccaaggcccctggcggccacctgcacctccaagccagaagagcgggccagaacagcgacgctggcccaccacgcggtctgacgtgggtcccagagggcgccggccctgtgcttggcgggtgcggacgcggaatggaccagagctgcctctccgccgacggcgctggacgcggatgtggacgagcgacatggagcgttagagaagagcaagtcaagcagtgggccgcagagatgctggtcgccttggaggcgcttcacgaacagggggtactctgtcgagacctgcatccaggaaaccttctgctagatcaggccggccatatcaggttgacttacttcggccagtggtcggaagtagaaccgcagtgttgcggcgaggcagttgataacctttattctgcacctgaggtcggcggcattagtgagttgactgaggcctgtgactggtggtcctttggctctctgctgtacgaactgctcactggcatggccttgagccaatctcaccccagtggcattcaggcgcacacccagctgcaactgcctgaatggctgtctaggccagcagctagtctgctgactgaattattgcaatttgagcctacaagacgcctcggtatgggggaaggcggagtgagcaaactgaagtcgcacccttttttcagtactatccagtggtcaaaattagttggctag

SEQ ID NO: 3028 - DNA, 30 bp, Artificial Sequence
  Description of Artificial Sequence: Synthetic coding sequence
atgagtctcgtggcgtgtgaatgcttgtag

SEQ ID NO: 3029 - DNA, 1650 bp, Artificial Sequence
  Description of Artificial Sequence: Synthetic coding sequence
atgtccttagtcgcgtgtgagtgtctgccaagtccaggcttggaacccgaaccctgttcgagggcacgaagtcaggcacatgtctatctcgagcagatccgaaacagagtggctttaggcgttccagatatgacgaagagggattatcttgtcgacgctgctacacagatccggctggccctagaacgcgatgtctctgaggattacgaggccgcttttaatcactaccagaatggtgtggatgtgctcctgcgggggatccacgttgatcccaacaaggagcgccgagaggctgtcaaattgaagattaccaaatatttaagaagagcagaagaaatttttaattgtcatctgcagcgtccattgagttcgggggccagcccatcagcgggattctcttctctgcgcttgagacccatcaggactctcagttccgccgtggaacagcttaggggttgtcgcgtggtgggggttatcgaaaaagtgcagctcgtgcaggaccctgcaaccggcggtacattcgtggtcaagtcactgccccgatgccacatggtgtctagggagagactgaccataataccacatggggtgccttatatgacaaaactgctgaggtacttcgtctctgaagacagcatattcctgcatcttgaacatgtccagggaggcaccctgtggtctcacctgctgtcccaggcacattcacgccattcaggactctcctccgggagcactcaggaacggatgaaagcccagctgaacccacatctcaacttactgacgcctgccagactgccttcgggtcacgctcccggacaggataggatcgcacttgaaccccccaggactagtccaaatcttctcttggcgggagaggccccgagtactagacctcagagggaggccgagggagaacctacggcccgaacctctacttctgggtcatccgacctgccgaaagctcccgggggtcatctacacttgcaagctaggagagccggccagaattctgacgccggaccacctcggggcttgacatgggttccagagggcgccggcccggtgctgggaggctgcggacgcggcatggatcagtcctgtctgtctgcagatggcgccggacgcgggtgcggcagagcaacctggagcgtgagagaagagcaagttaagcagtgggctgccgaaatgctggtggccctcgaagctcttcatgagcaaggtgtcctatgtcgagatcttcatcccggcaaccttctgctcgatcaagcgggccatatccgtttaacatattttggacagtggagcgaggtggagccccagtgctgcggcgaggcggtcgacaatctgtattctgcacccgaagtcggaggtataagcgaactgacagaggcttgcgactggtggtcgttcggatcgctcctgtacgagctgttgacgggaatggcattgagccagagccatccttccggaatccaggcccatacacaactgcaactgcctgaatggctttctcgcccagctgcaagtttgctaaccgagctgctgcagtttgaaccaactaggcgactcggtatgggagaaggtggggtatccaaattaaaatctcacccttttttctctacaatacagtggtccaaactagtgggatag

SEQ ID NO: 3030 - DNA, 1818 bp, Artificial Sequence
  Description of Artificial Sequence: Synthetic coding sequence
atgctgccccagcaagtagggtttgtgtgtgcagtgcttgcactggtctgttgcgcgtctggtttgttcggctccctgggacacaaaacggcgtctgcgtctaaaagggtgctgccagatacctggagaaaccgtaagctcatggcccctgtcaacgggacgcagaccgcaaagaattgtactgacccagccattcacgagttcccgactgatctttttagcaacaaagagcgccagcatggtgccgtgctacttcacatcctgggggccctgtacatgttctacgctcttgccatcgtctgcgacgacttcttcgtcccctcgctggagaaaatctgcgaaagactgcatctgtccgaggacgtggcaggtgctacctttatggccgccggctcctccactccggagctgttcgcctctgtgattggcgtgttcatcacacacggagacgtaggggtgggcaccattgtggggagcgccgtgtttaacatactgtgtattattggcgtatgtgggctgttcgccggccaagttgtccggctgacttggtgggctgtatgccgggattcagtgtattacaccatctctgtgattgtgctgattgtattcatttatgacgagcagatcgtgtggtgggaagggttggttctgatcattctgtacgttttttatattctgataatgaaatataatgtcaaaatgcaggccttcttcacagttaaacaaaagagcatcgcaaacggaaatcctgtgaactctgaactagaagccgggaacgacttttatgatgggagttatgatgatccttctgtgcccttattgggacaagtgaaagagaagcctcagtacgggaagaacccagtcgtgatggtggacgaaattatgtcttccagtcctcctaagttcactttcccggaagccggtctgaggataatgattaccaacaagtttggccctcgcacacgactgcggatggcgagccgtattatcatcaatgaacgccagcggcttattaacagcgctaacggcgtctcctctaagcctctgcagaatggacgtcacgagaacatcgagaatggtaatgttccggtggaaaaccccgaggatccacaacaaaatcaggaacagcaaccgcccccacagccccctcctcccgaacctgagcccgtggaggcggatttcttgagtcctttctccgttcccgaggcccgcggcgacaaagtcaagtgggttttcacctggcctctgattttcctcttgtgtgtgacaatccccaattgtagtaagccccgctgggagaaatttttcatggtgacctttatcacagccactttgtggattgccgtcttctcctatatcatggtgtggttggtgactataatcggatacacactgggaatccccgacgttatcatgggaattacatttttggctgccgggacttctgtccctgactgcatggcatcgctcattgtggctagacagggactaggtgacatggccgtgagcaacaccataggaagcaacgtctttgacatactggtggggcttggcgtcccttgggggctgcaaacaatggtggtgaattatgggtctacagttaagatcaactctagaggcttggtttattccgtagtcctgctcttgggatccgtggcgttaactgttttaggtatccacttgaataagtggcgactagaccgcaagcttggagtgtatgtccttgtgctttacgccatcttcctttgcttctcaattatgattgagtttaacgtgttcacgttcgtcaacctacctatgtgccgggaagacgattag

SEQ ID NO: 3031 - DNA, 1059 bp, Artificial Sequence
  Description of Artificial Sequence: Synthetic coding sequence
atgttctacgccctggccatcgtatgcgacgacttcttcgtacccagccttgaaaagatctgtgagcggctgcatcttagtgaggatgttgcaggcgccacatttatggccgccggatccagtactcccgaactatttgcgtccgtgattggggtgtttatcacacatggcgatgtgggtgtgggaactattagtgtctcgtttgctttgcagtttatctacgacgagcagattgtatggtgggagggactggtcttgatcattctttacgtgttctacattttgatcatgaaatacaatgttaagatgcaagccttttttacagtgaagcagaagtccatcgcaaatgggaatcctgtcaattcagagttggaggctggaaacgatttttacgacggctcctacgacgatccttcagtaccgcttcttggccaggtcaaggaaaaaccccagtacggtaagaatcctgtagtgatggtggacgagatcatgtctagctcaccacccaagtttacgttccccgaagcaggcctgaggataatgataaccaataaattcgggccccgaacacgactgcggatggcttcaagaattattatcaacgaaaggcagcgccttatcaatagcgccaatggtgtgtcaagtaaacctctgcaaaatggccgccatgagaacattgagaatggcaatgtgcctgtcgaaaaccccgaggatccccagcagaaccaagaacagcaacccccaccccagccaccaccccccgagccagagccagtggaagctgactttctgtccccttttagtgtgcctgaggccagaggcgacaaggtgaaatgggtttttacctggccactcatttttctgctgtgcgtgacgatccccaactgcagcaaacctcggtgggagaaatttttcatggtgactttcatcactgctactctatggatcgccgttttttcctatattatggtctggctggagcagagggaggggaagcagttccagcatggatgctcgagtgtggactgtgaaacccacagccaaccactgacaccttag

SEQ ID NO: 3032 - DNA, 1761 bp, Artificial Sequence
  Description of Artificial Sequence: Synthetic coding sequence
atgctgccccaacaggtgggctttgtctgtgccgttctggccctcgtttgttgtgcctctgggctcttcgggtcattagggcataagacggcaagcgcaagcaagcgagtgctgcctgacacttggaggaaccgtaaacttatggcaccagtaaacggaactcaaaccgctaaaaactgtacggaccccgcaatccacgaattcccgaccgatttgttttcgaataaggagcgtcagcatggggccgtcctcttacacatcctcggcgccttgtacatgttttacgccctggcgatcgtgtgtgacgatttttttgtgccatccctggagaaaatctgcgagagactgcatctgtctgaagatgtggccggtgccacttttatggcagctggctcctctaccccagaactatttgcttccgtcatcggtgtgttcattacccacggagacgttggcgtgggaactattgttgggtctgccgtttttaatattctgtgtatcatcggagtgtgtggccttttcgctggacaggttgtccggctcacctggtgggccgtctgtcgtgactctgtctattatactattagtgttatcgtccttattgtttttatttatgacgagcagatcgtgtggtgggaggggctggtgctgattatcctgtatgtgttctacatactgattatgaaatacaacgtcaagatgcaggcattttttacagtgaaacaaaagtctatcgcaaacgggaatccagttaattccgagttggaggcggttaaggagaaaccccagtatggcaagaatccagttgtgatggtggatgaaatcatgtcatcctcccctccaaagtttacattccctgaagccggactgcgaatcatgataactaacaagtttggcccaaggacacgactgaggatggcatcccgtatcatcattaatgaacggcagaggcttatcaactcagcgaatggggtctcgtccaagccgttacagaacggccggcatgagaacattgagaacggcaacgtacccgtggagaatcccgaggacccacaacaaaatcaggagcagcagccacccccccagcccccaccaccagagccagagcccgtggaggccgactttttgagtccgttttctgtcccggaggctaggggcgacaaggttaaatgggtgttcacatggcccctgatatttctgttgtgcgtgactatcccaaattgtagcaagccgcggtgggagaagtttttcatggtgaccttcattacagcaaccctgtggattgcagtctttagttacattatggtttggctcgtgaccatcattgggtacaccctggggatacctgacgtgataatgggaatcacattcctggctgctggaacctcagtgcctgattgcatggctagtctgatcgtggccagacagggattgggggatatggcggtgtcgaataccatcggatctaacgtgttcgacatccttgtgggcctaggagtgccctgggggctgcaaaccatggtcgtcaactacggatctactgtgaagatcaattcaaggggactggtgtactcggtggtgctactgctgggaagcgtggccctgaccgtgctcggcatacacctcaataagtggcgactcgacagaaagttaggcgtgtatgtactggtgctgtacgctatatttctgtgtttctctattatgatcgagtttaatgtctttacattcgtgaatctccccatgtgtcgcgaggacgactag

SEQ ID NO: 3033 - DNA, 1677 bp, Artificial Sequence
  Description of Artificial Sequence: Synthetic coding sequence
atggctcctgtgaatggtacccagacagcaaagaattgcacagatcccgcaattcacgaattcccaacggacctcttttctaataaggagaggcagcacggggccgtgttactccatatcctgggcgctctttacatgttttatgccttagctattgtgtgtgacgactttttcgtgccgagcctcgaaaaaatttgcgagaggctgcatcttagcgaggacgtagccggagccacctttatggccgccggatcctcaacccctgagctgttcgctagcgtcattggggtttttataacccacggagacgttggggtgggcacaatagtgggaagcgcagtattcaacattctgtgtattataggcgtctgtggcctcttcgccggccaggtggttcgcctcacatggtgggcagtgtgtcgagatagcgtctactacaccatttcagttattgtcctgatcgtgtttatctatgatgagcagattgtttggtgggagggcctcgtactgattatactgtatgtcttttatattctcatcatgaagtacaatgtgaaaatgcaggcctttttcactgtcaaacagaaatccattgccaacgggaatccggtgaatagcgagcttgaagcaggaaacgatttttatgacggcagttacgacgatccctcagtacccctactgggacaggtaaaagaaaaaccccagtacggcaaaaaccctgtggtgatggtggatgagataatgtcatccagcccccctaagtttaccttcccggaggccggtctgaggattatgattaccaacaaattcgggccacgcaccagactcaggatggcttccagaattatcatcaatgaacggcaacgtctgattaattcagccaacggggtttcctcaaaaccactccaaaatggcagacacgagaatattgagaatggcaatgtgccagtcgagaatcccgaggaccctcagcagaatcaggagcaacagccaccgccccagccccctccccccgagccagagcctgtcgaggccgactttcttagtcctttctctgtgccagaagctcggggtgataaggtcaagtgggtttttacctggcctctgatctttctcctttgtgtgaccataccgaattgttcgaagccacgttgggagaagttttttatggtgacctttataacagcaacattatggattgcagtcttctcttatattatggtctggctggtcaccatcataggatacacactaggtattcctgatgtgattatgggcatcacatttctcgccgccggaacaagtgtgcccgactgcatggcttcccttatcgtagccagacaggggctgggagacatggcagtttcaaacaccattggttccaacgtgtttgacatcctagtgggtctaggcgtaccctgggggctacaaacaatggtggtcaactacggatcaactgtgaaaataaattcacgtggactggtttacagcgtagtgttgttgctaggctctgtagccctcacggtcctcggcattcacctcaacaagtggcggttggatcgcaaattgggcgtgtatgtcctggtactgtatgccatcttcctctgcttttcaataatgatcgagtttaacgtcttcaccttcgtgaacctgcctatgtgtagagaagacgactag

SEQ ID NO: 3034 - DNA, 1812 bp, Artificial Sequence
  Description of Artificial Sequence: Synthetic coding sequence
atggcactgcgcggtacactgcggcccctcaaggttaggaggaggcgagagatgctcccacagcaggtgggctttgtgtgtgcagtgcttgcactggtttgttgtgcatctggattgtttgggagtctgggccacaagactgctagtgcatctaaacgcgtgctccccgacacatggcgtaaccggaagctgatggcccctgtgaatgggacccaaacagctaagaattgcaccgaccctgctattcacgaattccccaccgatttgtttagtaataaagaaaggcagcacggtgccgtcttgctccacattttgggagcactgtacatgttctacgcccttgcaatagtctgtgatgatttcttcgtccccagcctggagaagatttgcgagcggctgcacctgtctgaagatgtcgcgggtgccacatttatggcggctggaagtagcacgcccgaactctttgcttcagtgatcggggtgtttattacacacggggatgttggggtggggactattgtaggatccgccgtattcaatatcctctgtatcatcggcgtttgcggactctttgcagggcaagtcgtgcgacttacctggtgggcagtgtgtcgggatagtgtgtattacacgatatctgtgattgtgcttattgtcttcatctacgacgaacagatagtgtggtgggaaggtctggttctgataatcttatatgtgttttacattcttattatgaagtacaatgtgaagatgcaggctttcttcaccgtgaagcaaaagtccattgccaacggcaaccctgtgaacagtgagctggaggcggtgaaggaaaagccccagtacggcaaaaaccccgtggtgatggtggatgaaatcatgtccagctctcctcccaagttcacctttcccgaagcagggcttcggattatgatcaccaataagttcggaccacgcacacgcctgagaatggcatccagaatcattattaacgagcgacagaggcttatcaatagtgcgaacggcgtgagctcaaagccattgcagaacgggcgacatgagaatatcgaaaacgggaacgtcccggtggagaatcccgaagatccacagcaaaatcaggagcagcagcctcctcctcagcccccgcctccagaacctgaacccgtggaggccgatttcctgtcccctttctccgtccccgaagctcggggtgacaaagtgaagtgggtcttcacttggcccctcatatttttactgtgtgtgaccatcccaaactgttcgaagccccgatgggagaaattcttcatggttacattcatcactgctacgctctggattgcagtattctcttatattatggtgtggctggtgaccatcattgggtacacactcggtatacctgatgtcataatgggcataacgttcttagctgccggcacgagtgttccagactgtatggcttccctgatcgtggcaagacagggccttggtgacatggctgtgtctaataccattggatcaaacgtttttgacatcctggtgggcctgggagtcccatggggccttcagaccatggtcgtcaattatggctcgaccgttaaaataaacagccgcggactggtctactccgtggtgctgttgttaggctcggtagcgttaacagttctgggtattcatctcaataagtggcgtctggacagaaagctgggagtgtatgtgctcgtgctttacgctatattcctgtgtttctcaatcatgatcgaattcaacgtgttcactttcgttaatttaccaatgtgtcgggaagatgactag

SEQ ID NO: 3035 - DNA, 1869 bp, Artificial Sequence
  Description of Artificial Sequence: Synthetic coding sequence
atggctcttcggggtacattacggcccctcaaggtccggagaagaagagagatgctgccacagcaggttggctttgtttgcgcagtgctcgcgctggtgtgctgcgcttctggtctgtttggcagtctgggtcataagaccgcttctgcgtctaagagggttctgcccgatacctggcgtaaccgcaaactaatggcaccggttaacggtacccagaccgctaaaaattgcacggatccagcaattcatgaatttcctaccgacctattctctaataaggagaggcagcatggggccgtcctgctgcacatattaggcgcgctgtacatgttttacgcacttgccattgtatgcgatgatttctttgtgccaagcctcgaaaaaatttgcgaacgcctccatctatcagaggacgtcgcgggtgcaacttttatggccgccgggtcctcgacacccgagctcttcgcaagcgtgatcggcgtcttcataacccatggggacgtcggagtcggaactattgtgggaagtgcagtattcaacatcctatgtatcataggggtgtgtggactgttcgcaggccaggtggtgagactgacctggtgggctgtgtgtagggactctgtgtattataccatctcagtaatcgtcctgatcgtgtttatatacgacgagcagattgtttggtgggaggggttggttttaataatcttatacgttttctacatattgatcatgaaatacaacgtcaagatgcaggctttttttaccgttaagcagaaaagcatcgcgaatgggaatccagtgaactctgagctggaagctggtaatgacttctacgacggcagctatgacgaccctagcgtgcctttactgggacaagttaaggaaaaaccccagtacgggaaaaatcctgtggtcatggtcgatgaaatcatgagttctagccctccaaagttcacattccctgaggctggattacgtatcatgatcaccaacaaattcggcccccgaacccgattgagaatggctagtaggatcatcattaatgagagacaacggctgatcaattctgccaacggggtgtcttctaaacctctgcagaatggcaggcatgagaacatcgaaaacggcaatgtccccgtagagaatccagaggatcctcagcagaatcaggaacaacaacctccgccgcagccaccaccccccgaacccgagccggttgaagcggactttctgagtcctttcagcgtacccgaggcccggggagataaggtcaaatgggtgttcacgtggcccctaatcttcctcctctgtgtcactatcccaaactgctccaagccacgatgggagaaattctttatggtgacatttatcacagcaaccctctggatcgccgtattttcttatataatggtgtggctggtgacaatcatcggctatacactgggaatacccgatgtcattatgggaattacgtttctcgctgcaggcaccagtgtccccgactgcatggcctcattgatagtagcgcgacaagggctgggagacatggcggtgagtaacacaattggcagtaacgtgttcgacatcctagtgggcttgggagtcccgtgggggttgcagacaatggtcgtgaattacggctccacggtgaagataaacagccgaggtcttgtgtacagtgttgtgctgctgttagggagtgtggctctgacagtcctgggcatccaccttaacaagtggaggttggataggaagcttggagtgtacgtcctcgtgctatatgccattttcttgtgtttttcaataatgatcgaatttaacgtgttcacttttgtgaatctccccatgtgcagagaggacgattag

SEQ ID NO: 3036 - DNA, 1503 bp, Artificial Sequence
  Description of Artificial Sequence: Synthetic coding sequence
atgcagaccaagggaggccagacctgggcaagaagagccctgctgctcggaattctgtgggccactgcccacctccccctgtccggaacgtccctgccacaacggctaccccgggcaacagggaatagtactcaatgcgtcatcagcccttcaagcgaatttccggaggggtttttcacccggcaagagcggcgagatggtggtattatcatttattttctcatcattgtgtatatgttcatggcgatttcgattgtctgcgatgaatactttctgccatctctggagatcatcagtgaaagcctgggcctttctcaagacgtcgctgggaccactttcatggcagcaggatcttctgccccagaactcgtaacagctttcttaggcgtgttcattaccaaaggtgatataggcatctccacgattctgggctccgccatttataacttactgggaatatgcgccgcttgtgggctgctgtcgaataccgtctcaaccttgagttgttggccactctttagggactgtgctgcctatacgattagtgctgcggctgtgctggggatcatctacgacaatcaggtatactggtatgaaggtgccctacttctgttgatctacggcttatatgtccttgtgctctgcttcgatatcaagattaatcaatacattattaagaagtgcagcccctgttgcgcctgtctggcaaaggcaatggaacggtctgaacagcagcctctcatgggctgggaagatgaggggcagcccttcatacgtcgccagtcacggacggattctggaatcttttatgaagacagcgggtatagtcagcttagcatttcccttcacgggctgtcccaggtttcggaagacccaccatcagtgttcaacatgccggaggccgatctgaaaaggattttttgggttctgtctcttccgatcatcaccctgttattcctcaccactcccgactgccgcaaaaaattttggaagaactattttgtgattactttcttcatgtccgccatctggatctccgcctttacgtacatactggtttggatggttaccatcaccggtgagactctggagataccagatactgtgatgggactgaccttgctcgccgctggaacctctatcccggatacaatagcttccgtgctcgtggctcggaaggggaagggcgatatggccatgtcaaacattgtcggttctaacgtattcgatatgttgtgcctgggaattccttggttcatcaagaccgcttttattaacggttcagcacctgctgaagttaattcccgtggcctcacttatattactatttctctcaacataagcataatctttctcttcttagcagtgcactttaacgggtggaagcttgacagaaagctgggcatcgtttgcctgctgtcctatctgggcctggcaacactttcagtgctctacgaattgggtatcattgggaacaacaagatacgcggatgcggaggatag

SEQ ID NO: 3037 - DNA, 1323 bp, Artificial Sequence
  Description of Artificial Sequence: Synthetic coding sequence
atgcagacaaagggtggccagacgtgggctcgaagggccttgctgctgggcattttgtgggccaccgcacatctgccactgtccgggacaagtctcccacagcgtctgccccgtgctaccgcgctaggactctctcaggatgtggcaggtaccacattcatggcagcaggctcgagtgcccccgagctggtcaccgcattcttgggcgtctttataaccaagggcgacattggcattagcactatactcggctcggcaatttataatctcttaggcatctgtgccgcatgtggcctcttgtctaatacggtttcaaccctgagttgttggcccctgtttcgggactgtgctgcctacactatatcagctgcggcggtgctggggatcatctacgacaaccaggtttactggtatgagggtgccctgcttctactgatctacggcctgtatgtgttggtgctgtgctttgatattaagataaatcagtatatcatcaagaagtgtagtccttgttgtgcttgtttagctaaagccatggagagatctgaacagcagcccctgatgggatgggaagatgaggggcagccctttattcgtcgccagtcgagaactgattccggtattttttacgaggactcagggtacagtcagctgtcaattagccttcacgggctcagccaggtgtcagaagatccaccaagtgtcttcaatatgcctgaggctgacctcaagagaattttctgggtgctgagtttaccgattatcactctgctgtttctgactacccccgactgccgcaaaaaattctggaaaaattacttcgtcatcacattcttcatgtccgccatctggatatctgcctttacctacatcttagtctggatggtgactatcacaggagagacccttgagatccctgatacagtcatggggcttactctgcttgcggccgggacatcaattcccgacaccatagcatctgtgctggttgcgagaaaaggaaaaggcgacatggcgatgtccaacatagtgggctccaacgtatttgatatgctgtgcctggggataccctggtttatcaagacagctttcatcaatggatctgccccagcagaagtcaactccaggggcctgacctacatcaccatctcattgaatatctccattatctttctctttctggccgtgcactttaacggctggaagctcgatcgcaaacttgggatcgtttgcctgttgtcatatttaggtcttgccacgctgagcgtgctctatgagctaggaattatcggcaacaataaaattcgcggatgtggcgggtag

SEQ ID NO: 3038 - DNA, 552 bp, Artificial Sequence
  Description of Artificial Sequence: Synthetic coding sequence
atgttatccagagcggtgtgtggtacaagccggcagctggcccccgtgctagggtatctgggcagcagacagaaacattccctacccgatctgccctatgactatggagcgttggaacctcacattaacgcacagataatgcagctccaccatagcaagcaccatgccgcttatgttaacaaccttaacgttacagaggagaaataccaggaagctctagcaaaaggtgagctgctggaggccattaaaagagactttggctctttcgacaagtttaaggaaaagctaacggccgcatcagtaggcgtccaggggtctggctgggggtggctcggatttaacaaggaaagagggcacctacagatagctgcttgcccaaatcaagatccgttacaaggaaccacaggcctgattcctttgctcggaattgacgtgtgggagcacgcttactatttgcaatacaagaacgtccgacctgactatctgaaggctatttggaacgtaatcaactgggagaatgtgaccgaacgctacatggcgtgtaaaaagtag

SEQ ID NO: 3039 - DNA, 552 bp, Artificial Sequence
  Description of Artificial Sequence: Synthetic coding sequence
atgctctcaagggctgtgtgcgggactagtagacagttggcccctgtcctcggctatctgggctccagacaaaagcacagcctgccggacctgccctacgactacggtgcgctggaaccgcacatcaacgcgcagatcatgcagcttcaccattcgaaacaccacgccgcctatgtgaacaatctgaacgtaactgaggaaaaatatcaggaggccctggcaaagggggagctgttagaggccataaaaagggatttcgggtccttcgacaaattcaaagagaagctgaccgccgcaagcgtgggggtgcagggctcaggatggggctggcttggttttaacaaagaacggggtcacctgcagattgcggcctgtcctaaccaagatcctcttcaggggaccacaggtctcattcctctcctcgggatcgatgtgtgggagcatgcttattacctgcagtacaaaaacgtgcgccccgactacctgaaggctatatggaacgttatcaattgggagaacgtcacagagagatatatggcctgcaagaaatag

SEQ ID NO: 3040 - DNA, 669 bp, Artificial Sequence
  Description of Artificial Sequence: Synthetic coding sequence
atgttgagccgcgccgtgtgcgggacaagtcgtcagctggctcccgtcttgggctatctgggtagccgacagaaacacagcctgcccgaccttccatatgactacggcgccctggaaccacatatcaacgcgcagatcatgcaactgcaccacagtaagcaccacgcagcctacgtcaataacctcaatgtcacagaagagaagtatcaggaggccttagcaaagggggatgttacagctcagatcgctctgcagcctgctctgaaattcaacggagggggacacattaaccacagcatattctggacgaatctctcacctaacggcgggggcgagcctaagggcgagctgctggaagcaatcaaaagggacttcgggtccttcgataaattcaaggagaaacttacagcggctagtgttggcgtgcagggctccgggtgggggtggctgggttttaataaggaacgcggccacctccagatcgctgcatgccctaatcaggaccccttacagggaactactggacttattcctcttcttggaattgacgtatgggagcatgcatactacttacagtacaaaaacgtgaggccagactatctgaaggctatctggaacgtcattaattgggaaaatgtgaccgaaaggtatatggcgtgcaaaaagtag

SEQ ID NO: 3041 - DNA, 669 bp, Artificial Sequence
  Description of Artificial Sequence: Synthetic coding sequence
atgctatcaagagcagtgtgtggaactagcaggcagctggcccctgtgctgggctacttgggctcccgccagaagcacagtctgccagatttaccatatgactacggggcacttgaaccacatattaacgcccagataatgcagctacatcattcaaagcatcacgcagcctacgttaataatctgaacgtgactgaggaaaaataccaggaagcactggcgaagggtgacgtcaccgcccagattgcactccaacccgcgctgaagtttaatgggggcggacatattaaccatagcatattctggacaaatctatctcccaacggcggaggggagccgaaaggcgagcttctcgaggcgatcaagcgtgacttcgggtcttttgacaaatttaaggagaagctgactgccgcttccgtgggagtccaggggagcggatggggctggctgggattcaataaggagcggggtcacttacaaatagcagcttgcccgaaccaagaccccctccagggaactactgggctaatacctttattaggtatcgatgtctgggagcatgcctactacttgcagtataaaaatgtccgtcccgattatttgaaagcaatctggaacgtcatcaattgggagaacgtgacagaaagatatatggcctgcaagaaatag

SEQ ID NO: 3042 - DNA, 531 bp, Artificial Sequence
  Description of Artificial Sequence: Synthetic coding sequence
atgcagctgcatcacagtaagcatcacgccgcctacgtgaacaatttgaatgttactgaagagaagtaccaggaagcactggcaaaaggcgacgtgacagcccagattgcgctgcagcccgcgctcaagttcaacggtggcggacacattaatcattctattttctggacgaacctttcccctaacggaggaggtgagccaaagggagaattgctggaggcaatcaagagggactttggctcattcgacaagtttaaggagaagttaacagctgccagtgtgggagttcagggatctgggtgggggtggctgggcttcaataaggagcgaggccacctccagatcgctgcctgccctaaccaggatcccctacaaggcacgaccggactgatcccgctgctgggcatagatgtctgggagcatgcctattacctgcaatataagaatgtacgaccagattacctgaaggctatttggaatgtgattaactgggaaaacgtgaccgagcgctacatggcctgcaaaaagtag

SEQ ID NO: 3043 - DNA, 723 bp, Artificial Sequence
  Description of Artificial Sequence: Synthetic coding sequence
atgctggccctgctgtgcagctgtcttttgttggctgccggagcttcggatgcgtggaccggcgaggacagtgcggaacctaactctgactctgcagaatggatccgggacatgtatgccaaggtgacagagatctggcaagaggtcatgcaaaggagagatgacgacggcgctctccacgcggcatgtcaagttcaaccttcggcaacgttagacgccgcccagcctagagtgacaggggtcgtgctgtttcgccaattggcccccagggccaaactggacgcctttttcgccctagaaggtttcccaacagaaccaaactcaagttctcgtgctatccacgtccatcagttcggcgacctgagccagggatgcgaaagcaccgggccccactataacccgctggccgtcccccatccccaacacccgggcgacttcggtaacttcgccgttcgagacggctccctatggcggtatagagccggactggccgcctccctcgccggaccacacagcattgtcggaagagccgttgtggttcatgccggtgaagatgacctgggcagaggcggcaatcaagctagtgtggagaatgggaacgcgggacgcagactggcttgctgtgtggtaggcgtgtgtggtcctggtctatgggaacgacaagccagagaacacagtgagcgtaagaagaggcgtcgggaaagtgaatgcaaggctgcctag

SEQ ID NO: 3044 - DNA, 390 bp, Artificial Sequence
  Description of Artificial Sequence: Synthetic coding sequence
atgaagatcctcgtggcactggctgttttttttcttgtttccacccagctgttcgccgaagagattggggctaacgatgatctgaattactggtccgactggtacgattccgaccagatcaaagaggagctcccagagccctttgagcatctgttacagagaatcgcacggagaccaaagccacagcaattctttgggttgatgggaaagcgtgatgccgatagcagcatcgagaagcaggtcgccctcctgaaggccttgtacggccatggacagatctctcacaagaggcacaagaccgattcctttgtcggccttatggggaaaagggcccttaactccgttgcctacgagcgtagtgcgatgcagaattacgaacgcaggcggtag

SEQ ID NO: 3045 - DNA, 345 bp, Artificial Sequence
  Description of Artificial Sequence: Synthetic coding sequence
atgaagattcttgtcgccttggcagttttcttcttggtatctacgcagctctttgccgaggagattggtgctaatgacgatttaaactattggtccgattggtacgattccgaccagatcaaggaggaactgccagaaccatttgagcacttgctccaacggatcgctcggagaccaaaaccacagcagttcttcggactgatgggtaagcgcgatgccggacacgggcagatctctcacaaacgtcataagacagattctttcgtcggcctgatgggcaagagggcgctgaacagcgtggcttatgagaggtcagcgatgcagaactacgaaaggaggaggtag

SEQ ID NO: 3046 - DNA, 336 bp, Artificial Sequence
  Description of Artificial Sequence: Synthetic coding sequence
atgaagattcttgtggccctggccgtcttcttcttagtgtccactcaactcttcgccgaggaaattggggccaatgatgatcttaattactggagcgattggtatgatagtgaccagatcaaagaggaactgcccgagcccttcgaacacttactgcagagaatagctaggaggcccaagccgcagcaattttttggtctaatgggcaagcgggatgcagactcatcaattgaaaaacaggttgcccttctcaaagcactctacgggcacggacagatttcccacaaaatggcatatgaaagatcagccatgcagaattacgaaaggcggcgatag

SEQ ID NO: 3047 - DNA, 417 bp, Artificial Sequence
  Description of Artificial Sequence: Synthetic coding sequence
atgaccgccttgtttcttatgagtatgctttttggactcacctgcggtcaagccatgagcttttgtatccctacagagtacaccatgcacatcgaacgccgggaatgtgcttactgcctgactataaatactaccatctgtgcaggctactgtatgacacgcgacattaatggtaaattgtttctgccgaaatatgccctgagtcaggacgtctgtacctacagagactttatttacagaacggtggaaatacctgggtgccctttgcacgtcgcaccgtatttcagctaccccgtggcactctcatgcaaatgcggaaagtgcaacacagactattccgattgtatccatgaggcaattaagactaactactgcactaagcctcaaaaatcctacctggtgggctttagcgtgtag

SEQ ID NO: 3048 - DNA, 417 bp, Artificial Sequence
  Description of Artificial Sequence: Synthetic coding sequence
atgaccgccctctttctgatgtctatgctcttcgggctcacttgtggacaggccatgagtttctgtatccctacagagtataccatgcatatagagaggagagagtgtgcttactgccttactattaatactactatttgcgccggttactgcatgactagagatatcaatggaaaactcttcttaccaaagtacgcattgtctcaggacgtgtgcacctatagagacttcatttacagaactgttgagatcccgggatgcccgctgcatgttgcgccttatttcagctatccagtggcactctcctgtaagtgcggcaaatgcaacaccgactactcagactgcatccacgaagccataaagactaactactgcaccaaacctcagaaatcctacctggtcgggttcagcgtgtag

SEQ ID NO: 3049 - DNA, 2418 bp, Artificial Sequence
  Description of Artificial Sequence: Synthetic coding sequence
atggcacaacccttagcgttcatcctagacgtaccagagactcctggggatcagggccaaggtccaagcccttacgatgaatccgaagtccatgacagcttccaacagttaattcaagagcagagccagtgtacagcacaagaaggccttgagctgcagcagcgagagcgcgaggtgactggcagcagccagcagaccctctggcggcccgaagggacacagtctacagcaacacttcgcatactggctagtatgcctagccggaccatagggcgctctcgaggcgcaataatatcacagtactacaatagaactgtgcagttgaggtgccgttccagtaggcccctgctgggcaattttgtgcgctccgcctggccatcacttcgcttgtacgatctagagctggacccaaccgcgcttgaggaagaggagaaacagagcttgcttgtgaaagaactgcaatccttagctgtggctcagcgcgaccacatgttgcgtggcatgccactaagcctggcggaaaagaggtctctgcgggaaaagtcccgaacacctagggggaaatggcgaggccagcctgggagcggtggagtctgctcatgttgcggacggctgcgctacgcctgtgttctggctcttcactccctcggcctcgccctcctaagcgccttgcaggctttgatgccatggcgttatgcgttaaagcggataggcggacagtttggcagctcagtcttgtcctatttcctgttcttgaaaactctgctggcctttaatgccctccttctcctgctgctcgtggcttttataatgggaccacaggtggcatttccacccgcccttcctggccctgcacccgtgtgtaccggactggaactactgaccggggccggctgcttcactcacactgttatgtactatggacactacagcaatgctacacttaaccagccttgcggttcgcctttggatggtagtcaatgtaccccccgtgtcggagggctgccttacaatatgcctcttgcatacttatcgactgtgggcgtgagctttttcattacctgtatcaccctggtctattctatggcccacagctttggagaaagctacagggtaggctccactagtgggattcacgctatcaccgtgttctgttcttgggattacaaggtcactcagaaaagagcatcccgcttgcagcaggataacattcgaacccggctcaaggaacttctcgccgagtggcaactgaggcactctccccgaagcgtgtgtggtagactcagacaggcagccgtgctcgggctggtatggctgctgtgtctgggcaccgcactcggctgcgccgttgcagtccacgtgtttagcgagtttatgatccagtctccagaagcagcgggacaggaagctgtgctactggtgctgcccctcgtggtgggtcttctcaatctgggggcgccatatttgtgtcgcgtcctcgccgccttagagccccatgattcacccgttctggaggtgtatgtggcaatctgtcggaatctcatcctgaaactcgccattctgggaactctctgttaccattggttgggcaggcgagttggcgtgcttcaaggacaatgctgggaagacttcgtgggccaggaattgtaccgttttctggtaatggattttgtgttgatgctcctcgatacactgttcggagagctcgtctggaggattatttctgaaaaaaagctaaaacgtcggcggaagccagaatttgacattgctcggaacgtgctcgaacttatatacggacagacgctgacctggttgggagtcctgttctcaccacttttgcccgccgtgcagatcatcaagcttctgctggtattttatgtgaagaagaccagcctcttggctaactgtcaggctcccagacgcccgtggttggctagccacatgtccacagtgttcctcactctgctgtgttttcctgctttcttaggcgctgcagtattcctgtgttatgccgtgtggcaggtgaaaccgtcctccacatgtggccctttccgtacactggatactatgtacgaagcaggtcgagtctgggtccgccatttggaggccgcaggccctcgggtgtcttggttgccctgggttcaccgctatctgatggagaacactttctttgtgtttctggtaagcgctctcctactcgccgtcatatatctgaacatacaggtcgtccgcgggcaacggaaagtcatctgcctgcttaaggagcaaataagcaatgagggagaagacaaaattttccttataaataagctgcactctatttacgagcggaaggagcgggaagagaggtctcgcgttggtacaacagaagaagccgcagctccaccagctctgctcactgacgagcaggatgcctag

SEQ ID NO: 3050 - DNA, 864 bp, Artificial Sequence
  Description of Artificial Sequence: Synthetic coding sequence
atgttgttgccccgtagcgtctcatcagagcgggccccaggtgtgccagagcctgaggagctatgggaagccgagatggagagattaaggggctccgggacccctgttagagggctcccgtacgccatgatggataagagacttatctggcaactgcgcgagcccgctggcgtccagactcttcgttggcagcggtggcagcgccgtagacagaccgtcgagagaaggctgcgcgaggccgctcagaggctcgcccgcggcttaggcctgtgggagggcgcgctgtacgagattggcgggctcttcggaacagggataaggtcttactttactttcttgcgattcctgctcctgctgaatttgctcagcctactgctgacagcctcctttgtgctattgcctctggtgtggcttagacccccggacccaggacccaccctcaatctcacactgcagtgccctggctcccgccagtcgccacccggagttcttcgctttcataaccagctgtggcacgtcctgacgggcagagcattcactaacacctaccttttctacggcgcctaccgtgtaggccctgagagttcttccgtttactctattaggcttgcctatctgctttctccactggcttgcctcttactttgtttctgtggaactctgagaagactactcagcacgctagcatctggtcccggtgccggtggaccgtgggcccctgcacactggcccgcctgcccccccttaccagggctgcccaggctccagttgccaccaccccaccacgctcaagtactccgtgccgctggcgctatgggcggggacacctggcgtggcaggagcttcctgccttggggctggtag

SEQ ID NO: 3051 - DNA, 2181 bp, Artificial Sequence
  Description of Artificial Sequence: Synthetic coding sequence
atgctcctgcccagaagtgtttcctccgagcgtgcccccggcgtaccagagcccgaggagctgtgggaagccgaaatggagaggttaaggggcagcggcactcctgttaggggtctaccttacgccatgatggataagcgcctgatttggcagctcagggaacctgcgggcgtgcagaccctgagatggcagcgctggcagcgtaggagacagaccgtggaacggcgactgcgcgaggcagcccaacggctggctcgggggttaggcctgtgggagggcgccttatacgagattggaggattattcgggacaggcattagatcttacttcacttttctccgttttctgctgctgttaaacctactatcacttttactcacggccagcttcgtgctcctccctctggtgtggctgaggccacctgaccctggcccaactttgaacttaactctccaatgccctggtagccgacagtccccccctggagtcctacggtttcacaaccaactgtggcacgtgctgacaggccgggcttttactaacacatacttgttctacggtgcatacagagtcggtccagagtcctcatcagtgtattccattaggttagcctatctgctaagccctcttgcctgtctgctcttgtgcttctgtggcacacttcgtaggatggtcaaggggcttccacaaaaaaccctgctgggtcaaggctatcaggcacccctatctgccaaggtgttttcgtcctgggacttttgcatcagagtgcaggaagcggctacaattaagaaacatgaaatttccaatgagtttaaagtggagctggaggaaggcagaagattccagttgatgcagcagcaaactagggcacagaccgcttgcaggctgctgtcctacctgcgagtaaatgtgctcaacggattgctcgtggtaggagccatcagcgccattttctgggctacaaagtatagccaggacaataaagaggagtccctcttcctgctgctgcagtacttacctcccggggtcatcgctctggtcaattttcttggtccactgctcttcacgttccttgtacaactggagaattaccccccaaacaccgaagtaaacttgaccctcatttggtgtgtcgtcctgaagctcgcatctttgggaatgttttcggtttcgcttggccaaaccatcctgtgtatcggaagggacaagtcttcctgtgagtcctacgggtataacgtatgtgactatcagtgctgggaaaactccgtgggggaagagctgtacaagctgtccatttttaactttctcctcactgtggcattcgccttcctggtgaccttgccccggagacttttggtagaccggttttctggccggttctgggcttggctggagcgcgaagaattcctggttcccaaaaatgtcctcgacatagttgcaggtcagacagtaacctggatggggctgttctactgccccttactaccgctcctgaattccgttttcctctttctcactttctatatcaaaaagtacactctattgaagaactcccgagcctctagtagaccattcagagcctcatcctctacttttttctttcagttggtgcttcttctgggccttttgctagctgctgtgccgctgggctacgtcgtgtcttccattcatagcagctgggactgcggactgtttaccaattattctgctccttggcaggtggtccccgaactcgtcgctctgggcttaccaccaattgggcagcgcgcgctgcactatcttggctcccacgcgtttagcttccctctgctcattatgctgagtctggtgctgacggtgtgcgtgagccagacgcaggccaacgccagggcgatccacaggcttcgcaaacagcttgtatggcaagtgcaggagaagtggcatcttgtcgaggacctgagcaggctgctccccgaacccgggccatctgactcacccggccctaagtatccggccagccaagcaagcagacctcaatcattctgcccaggctgcccttgtcccggttctccaggccaccaggctccaagacccggaccgtctgtggttgatgctgccgggctgcgctcaccgtgcccaggtcagcatggagctccggcctcagcgcgcagatttaggttcccgtccggggcagagctgtag

SEQ ID NO: 3052 - DNA, 702 bp, Artificial Sequence
  Description of Artificial Sequence: Synthetic coding sequence
atgtccaccgaaagtatgatcagggatgttgagctcgcagaagaggccctcccgaaaaagacaggcggcccacagggctctcgtcgctgtctgttcctgagcctcttctcctttctcattgtcgccggcgctaccaccctgttttgtctcttacacttcggcgttatcggtccacagagggaggagttccctagagacctgagcttgatctctcctctggcccaagccgttcgaagctcttcgaggacacccagcgacaaacccgtggctcatgtcgtcgctaacccacaggccgagggccaactacagtggctgaatcgccgggctaatgcactgctggccaatggcgtagagctgcgggataatcaactcgtggtgccgtcggaggggctctacctgatctattctcaggtcctgttcaaaggtcaaggctgtccatcaacccacgttttgctaacacacacaatcagtagaatcgcggtgagctatcagacaaaagtcaacctcctgagtgctattaagagcccatgccaacgcgagacgccagagggcgccgaggctaaaccgtggtatgaacctatttatctggggggtgtatttcagctggaaaaaggcgaccgcttatctgcagaaatcaatcggcctgactatctcgacttcgctgagtccggccaagtctactttggcatcatcgcgttatag

SEQ ID NO: 3053 - DNA, 702 bp, Artificial Sequence
  Description of Artificial Sequence: Synthetic coding sequence
atgtctaccgagtcaatgattagagacgttgaactggccgaggaggcacttccaaagaagaccggtggccctcagggctctcgcaggtgcctgtttctcagcttgttctccttcctgatcgtggcaggcgccaccacactcttctgccttctccacttcggcgttattggaccccagagggaggagtttcctcgtgacctgagtctgatctcaccgctcgcccaggctgtgagatcttcgtctagaaccccaagcgataagccagttgcacacgtggtagctaacccacaggcagagggccagctgcaatggctgaatcgtcgggccaacgccctgctcgcgaatggtgtggaacttcgggacaaccagcttgtcgtccccagtgaaggcctgtacttaatctatagccaggtactgtttaagggacaaggctgcccaagcacccatgtgctgttgactcatacaattagcaggatcgcagtaagctatcagactaaagtcaacctcctctcagccatcaagtcgccttgccagagagagactcctgaaggggccgaggcaaaaccgtggtatgaacccatttatctcggaggtgtgtttcagctggagaaaggtgataggttatccgctgaaatcaaccggcctgattacttagatttcgccgagtccggacaagtgtactttggcatcatcgctttatag

SEQ ID NO: 3054 - DNA, 702 bp, Artificial Sequence
  Description of Artificial Sequence: Synthetic coding sequence
atgtccaccgagtccatgatccgagatgtcgaattggcagaggaggctttgccaaagaagacaggggggccacaagggtccagacgatgcctcttcctatctctcttttcgttcctgatcgtggcaggagccactacacttttttgtctcctccactttggagtgatcggacctcagcgcgaagagttccctcgcgatctgagtctgattagtcctctggctcaggcggtgcgctcaagtagtcgaacaccctctgataaaccagttgctcacgtagtcgccaacccgcaggccgagggtcagctgcagtggttgaataggcgggcaaacgcactgcttgccaatggggttgagctgcgggataaccagctggtcgtgccttcagaaggcttgtatcttatctattcacaggtgctgtttaagggccagggatgtccgagtacacacgtcttattgactcacactatatcccggatcgctgtgtcttaccagaccaaggtcaatttacttagcgcgattaagtcaccttgccagagagagacccctgagggtgccgaagctaaaccctggtacgaaccaatttacctcggaggcgtgttccaactggagaagggggatcgactgagcgctgagatcaatcgacctgattacctcgactttgccgagtcaggtcaagtctattttggaatcatagccttgtag

SEQ ID NO: 3055 - DNA, 702 bp, Artificial Sequence
  Description of Artificial Sequence: Synthetic coding sequence
atgtcaactgaatctatgatcagagacgtggagctcgcagaagaagctttgcccaagaagactggtggcccccaaggatcccgaaggtgcctttttctgagcttgttcagtttcctaatagtagcgggcgccacaacactgttctgtctgttgcattttggcgttatcggacctcagagagaggagtttccacgggacctaagcctgatttcccccctggcgcaggctgtcagatcctcatccaggactccttccgataaacctgtggcccatgtggtagctaatccacaggctgaaggccagctgcaatggttgaaccgccgtgccaatgctctcctggctaatggtgttgagcttcgtgacaatcaactggtggtcccttctgaggggctctacctcatatattcacaggtgctctttaagggacaaggatgcccttcaactcacgtgctgctcactcacacaatctcacgcatcgcagtttcataccagaccaaagtgaacctgttatctgcgatcaagtcaccgtgtcagcgggagactcctgaaggggctgaagcaaagccttggtatgagcccatctacctgggtggggtcttccagcttgaaaaaggggaccgcctgagcgcggagattaacagacccgattacctcgacttcgcagaaagtggccaggtttactttggaatcatagccctttag

SEQ ID NO: 3056 - DNA, 702 bp, Artificial Sequence
  Description of Artificial Sequence: Synthetic coding sequence
atgtcaacggaaagcatgattagagatgttgaactggccgaagaagccctgccaaagaaaaccggcggcccgcaaggcagccgacggtgcttatttctcagtctgttcagcttcctgatcgtggccggtgccacgaccctgttctgcttactgcactttggagtgattggtccgcagagagaggagtttccacgcgatttgagcctgatttcgcctctggcgcaggccgtcagaagtagtagtagaacacccagcgacaaacccgtggcgcacgtggtagccaacccccaggctgaaggacaattgcagtggctgaatcggagagcaaatgcactcctagcaaacggtgtggaactgagggacaatcagctcgtcgtaccctcagaaggattatatctcatctacagccaggtgctatttaagggccaggggtgcccaagtacacacgtgctccttacacacaccattagccgcattgctgtgtcataccagaccaaggtgaaccttctgagcgccattaagtcaccttgtcaaagagagactccagagggagcggaggctaagccttggtacgagcccatttacctcgggggagtgtttcagctagagaagggtgatcggctttcagcagagattaatcgaccggattacctggactttgcagaaagcggccaggtgtattttggtatcatcgccctgtag

SEQ ID NO: 3057 - DNA, 702 bp, Artificial Sequence
  Description of Artificial Sequence: Synthetic coding sequence
atgagcacggaatccatgatccgagacgtggagctagcagaagaggcccttcctaaaaaaacaggcggaccccagggaagtcgtaggtgcctcttcctctcactgttcagttttcttatagtcgccggcgctactaccctgttttgcttactgcatttcggcgtaattgggccacagcgagaagaattcccccgtgacttatcactaatcagcccgctagctcaggcagtgcggagctctagtcgtacgccatctgacaagcccgtggcccacgtggtggccaatccccaggccgaaggacaacttcagtggcttaaccggcgggccaatgccctgttagcaaatggagttgaactgagggataaccagcttgttgtccctagcgaaggactttatctcatctacagccaagtcctgttcaagggtcagggctgtccctctactcatgtgctgttgacacataccatctcccggatagccgtgtcttatcagactaaagtcaatctcttatccgccataaagtccccttgtcagagggagaccccagaaggggccgaggccaaaccctggtacgaaccgatttatctggggggcgtgttccagcttgagaaaggcgatagactgagcgccgagataaatcggcccgactatctggactttgccgaaagcggacaggtgtacttcggtatcattgcgctgtag

SEQ ID NO: 3058 - DNA, 702 bp, Artificial Sequence
  Description of Artificial Sequence: Synthetic coding sequence
atgagtacagaaagcatgattcgcgatgttgagctggccgaggaagctctgcccaagaaaaccggtgggccacagggctcaaggcgctgcttattcctgtccctgttctcgtttctgatcgtggccggagcaacaaccctcttctgcttattacactttggcgtgatcggaccccagagagaggagtttccacgcgatctctctctcatctcaccactggctcaagccgtgcggtcctcatccaggacgccctccgacaagccagtggcacatgtcgtggccaacccccaagccgagggacagctccagtggctgaaccggcgggcaaacgctttgctcgctaatggcgtggagctgagagataaccagctggtggtcccttcggagggtctctacctcatttactcgcaggttctgtttaagggtcaggggtgtccctccactcatgtgctgctaactcacaccatctcccgaatcgccgtatcttaccaaacaaaggtgaacctcctgtcagctataaagagtccttgccaaagagaaaccccggaaggcgcagaggccaagccttggtacgagccaatctacctcggtggcgtgttccagcttgaaaagggggatagattatctgctgagattaatcggccagactacctggactttgccgagagtggacaagtgtattttggcattatcgcgctgtag

SEQ ID NO: 3059 - DNA, 741 bp, Artificial Sequence
  Description of Artificial Sequence: Synthetic coding sequence
atggcccaggtccctccccctgcctcaggagagcggcatgctgggacagaggacggccctatacggcgcaaccccgcgggtaatgtggcgcggcccatggtgcagaggcttcccgagccccaggatgtcgcccaatgcctggaggtgggccttttcgatactcctcccttttattccaattcaaccaattcttttaggaacactgtcgaggggaatgaccctacaggcaagtatgacccggcagtacgctcgttgcataacctggcacacctgttcctgaacgggacgggtggccagacgcacctgtcacccaatgacccaatattcgttttactacatacatttacagatgccgtgttcgatgaatggctgcgcagatataatgctgatatatcgacgtttccacttgagaatgcgcccatcggtcacaaccgacagtataacatggtacctttctggcctcccgtcactaacaccgagatgtttgtaaccgcacccgacaacctgggttatacatacgagatccagtggccctcaagggagttcagcgtgcccgagatcatcgctatcgcggtcgtcggggcactgctcctcgtcgccctaattttcgggacagcctcttacctgatccgcgcaagacgctccatggatgaagcaaatcaaccgctgctgacagaccagtaccagtgctacgcagaggagtatgagaaactccaaaatcccaaccagtccgtcgtgtag

SEQ ID NO: 3060 - DNA, 1614 bp, Artificial Sequence
  Description of Artificial Sequence: Synthetic coding sequence
atgtctgccccgaagttactgagccttggctgtatatttttcccccttctactgtttcagcaagctcgtgcccagttcccaagacaatgtgccactgtagaggcccttaggagtgggatgtgctgcccagatttatcccctgtgtcggggccaggtaccgacaggtgcggttcctccagtggtcgcgggcggtgtgaggccgtgacagccgacagcaggcctcactccccgcagtacccccatgatggacgggatgacagagaagtctggccgctcagattctttaataggacttgccattgtaatgggaacttctctggccacaactgtggaacctgccgccctggctggaggggggccgcttgcgaccagagagtgctgattgtgcgcagaaatcttttggacttgagtaaagaggaaaaaaaccatttcgtgagagcccttgatatggccaagagaactacacatccgttgtttgtaattgcgaccagacggagcgaggaaattcttgggccagatgggaatacaccacagttcgaaaatattagcatttataactatttcgtatggacccactattactccgtgaaaaaaacctttctgggagtgggacaggagtccttcggagaggtcgacttctcccatgaaggcccagcattcctgacatggcataggtaccacctcctcaggctcgagaaagatatgcaggagatgctgcaggagccatcgttttcgctgccctactggaattttgctaccggcaagaacgtatgtgacatttgtacagacgacttgatgggaagtaggagcaattttgatagcacactaatcagtcctaactctgtgttctctcagtggagagtcgtgtgtgattcacttgaggattacgacaccttgggcacgctctgcaatagcaccgaggacggtccaattaggcggaatcccgcggggaatgttgcccggcctatggttcagaggctgccagagccccaggacgttgcccagtgcctggaagttgggcttttcgatacccctcccttttatagtaacagtacgaattccttccgtaatactgtcgaagggtactccgaccccaccggaaaatacgaccctgccgttcgcagccttcacaacttggcacacttgtttctcaatggcactggagggcaaacgcacctaagccctaacgatccaatctttgtgctcctgcatactttcacggatgccgtgttcgatgaatggctgcgccgatataatgctgacatctctacctttcccctagagaacgcccccatcggacacaacagacagtataacatggttccattttggcctccagtgactaacactgagatgtttgtgaccgcgcctgacaatctaggatacacctacgaaatccagtggccttctagggagttctccgttccggaaattattgccatcgccgtcgttggcgcattgttgctggtcgctctcatttttggcacagcatcctacctgataagggcccggcggtcaatggacgaagcaaaccagcctctgctgactgaccaataccagtgttatgccgaggagtacgagaagctgcagaaccctaatcaatctgtggtgtag

SEQ ID NO: 3061 - DNA, 309 bp, Artificial Sequence
  Description of Artificial Sequence: Synthetic coding sequence
atgagtgcccctaaacttctgtcactgggctgtattttcttccccctactgctgtttcaacaggcccgggctcagttcccaagacagtgtgctaccgtggaggccctgagatcaggcatgtgctgtcctgacctgtccccagtgagcggccccggcaccgaccgatgcggaagcagctctggccgaggccggtgtgaggcagtgacagccgacagcagaccacattctccccagtaccctcacgatggcagagatgacagggaggtgtggcctcttcggttctttaacaggacatgtcattgcaactag

SEQ ID NO: 3062 - DNA, 1128 bp, Artificial Sequence
  Description of Artificial Sequence: Synthetic coding sequence
atggaggaggagattgctgccctggtgattgacaatggcagcggcatgtgcaaggccggctttgctggagatgatgcccccagggctgtgttccccagcatcgtgggccggcccaggcaccagggcgtgatggtgggcatgggccagaaggacagctatgtgggagatgaggcccagagcaagaggggcatcctgaccctgaagtaccccattgaacatggaattgtgaccaactgggatgacatggagaagatctggcaccacaccttctacaatgagctgcgggtggcccctgaggagcaccctgtgctgctgacagaggcccccctgaaccccaaggccaaccgggagaagatgacccagatcatgtttgagaccttcaacaccccagccatgtatgtggccatccaggccgtgctgagcctgtatgccagcggccgcaccactggaattgtgatggattctggagatggagtgacccacacagtgcccatctatgagggctacgccctgccccacgccatcctgcggctggacctggccggccgggacctgacagactacctgatgaagatcctgacagagcggggctacagcttcaccaccacagctgagcgggagatcgtgcgggacatcaaggagaagctgtgctacgtggccctggactttgagcaggagatggccacagctgccagcagcagcagcctggagaagagctatgagctgcctgatggccaggtgatcaccatcggaaatgaacgcttccgctgcccagaggccctcttccagcccagcttcctgggcatggagagctgtggcatccacgagaccaccttcaacagcatcatgaagtgtgatgtggacatcaggaaggacctgtatgccaacacagtgctgagcggcggcaccaccatgtacccaggcattgctgacaggatgcagaaggagatcacagccctggcccccagcaccatgaagatcaagatcatcgcccctcctgagaggaagtacagcgtgtggattggaggcagcatcctggccagcctgagcaccttccagcagatgtggatcagcaagcaggagtatgatgaaagtggccccagcatcgtgcacaggaagtgcttctag

SEQ ID NO: 3063 - DNA, 1599 bp, Artificial Sequence
  Description of Artificial Sequence: Synthetic coding sequence
atgccccagctgtacatctacatccggctgctgggcgcctacctgttcatcatcagccgggtgcagggccagaacctggacagcatgctgcatggaacaggcatgaagagtgacagcgaccagaagaagtcagaaaatggagtgaccctggcccctgaggacaccctgcccttcctgaagtgctactgcagcggccactgcccagatgatgccatcaacaacacctgcatcaccaacggccactgctttgccatcatcgaggaggatgaccagggcgagaccaccctggccagcggctgcatgaagtatgagggcagtgacttccagtgcaaggacagccccaaggcccagctgcggaggaccatcgagtgctgcaggaccaacctgtgcaaccagtacctgcagcccaccctgccccctgtggtgattggccccttctttgatggcagcatccgctggctggtgctgctgatctccatggctgtgtgcatcatcgccatgatcatcttcagcagctgcttctgctacaagcactactgcaagagcatcagcagcagaagacgctacaacagagacctggagcaggatgaggccttcatccctgtgggggagagcctgaaggacctgattgaccagagccagagcagcggcagcggcagcggcctgcccctgctggtgcagaggaccatcgccaagcagatccagatggtgcggcaggtgggcaagggccgctatggagaggtgtggatgggcaagtggagaggagagaaggtggccgtgaaggtgttcttcaccacagaggaggcctcctggttccgggagacagagatctaccagacagtgctgatgagacatgagaacatcctgggcttcatcgctgctgacatcaagggcaccggctcctggacccagctgtacctgatcacagactaccatgaaaatggcagcctgtatgacttcctgaagtgtgccaccctggacacccgggccctgctgaagctggcctacagcgctgcctgtggcctgtgccacctgcacacagagatctacggcacccagggcaagccagccatcgcccaccgggacctgaagagcaagaacatcctgatcaagaagaatggcagctgctgcatcgctgacctgggcctggccgtgaagttcaacagcgacaccaatgaggtggatgtgcccctgaacaccagggtgggcaccaagcgctacatggcccctgaggtgctggatgagagcctgaacaagaaccacttccagccctacatcatggctgacatctacagctttggcctcatcatctgggagatggcccggcgctgcatcaccggcggcatcgtggaggagtaccagctgccctactacaacatggtgcccagcgaccccagctatgaggacatgagggaggtggtgtgtgtgaagaggctgcggcccatcgtgagcaaccgctggaacagtgatgaatgtctgcgggctgtgctgaagctgatgtctgagtgctgggcccacaacccagccagccggctgacagccctgcgcatcaagaagaccctggccaagatggtggagagccaggatgtgaagatctag

SEQ ID NO: 3064 - DNA, 456 bp, Artificial Sequence
  Description of Artificial Sequence: Synthetic coding sequence
atgtgtgaggaggaggacagcacagccctggtgtgtgacaatggcagcggcctgtgcaaggccggctttgctggagatgatgcccccagggctgtgttccccagcatcgtgggccggcccaggcaccagggcgtgatggtgggcatgggccagaaggacagctatgtgggagatgaggcccagagcaagaggggcatcctgaccctgaagtaccccattgaacatggcatcatcaccaactgggatgacatggagaagatctggcaccacagcttctacaatgagctgcgggtggcccctgaggagcaccccaccctgctgacagaggcccccctgaaccccaaggccaaccgggagaagatgacccagatcatgtttgagaccttcaacgtgcctgccatgtatgtggccatccaggccgtgctgagcctgtatgccagcggccgcaccacctag

SEQ ID NO: 3065 - DNA, 456 bp, Artificial Sequence; identical to SEQ ID NO: 3064
  Description of Artificial Sequence: Synthetic coding sequence

SEQ ID NO: 3066 - DNA, 1134 bp, Artificial Sequence
  Description of Artificial Sequence: Synthetic coding sequence
atgtgtgaggaggaggacagcacagccctggtgtgtgacaatggcagcggcctgtgcaaggccggctttgctggagatgatgcccccagggctgtgttccccagcatcgtgggccggcccaggcaccagggcgtgatggtgggcatgggccagaaggacagctatgtgggagatgaggcccagagcaagaggggcatcctgaccctgaagtaccccattgaacatggcatcatcaccaactgggatgacatggagaagatctggcaccacagcttctacaatgagctgcgggtggcccctgaggagcaccccaccctgctgacagaggcccccctgaaccccaaggccaaccgggagaagatgacccagatcatgtttgagaccttcaacgtgcctgccatgtatgtggccatccaggccgtgctgagcctgtatgccagcggccgcaccactggaattgtgctggacagcggagatggagtgacccacaacgtgcccatctatgagggctacgccctgccccacgccatcatgaggctggacctggccggccgggacctgacagactacctgatgaagatcctgacagagcggggctacagctttgtgaccacagctgagcgggagatcgtgcgggacatcaaggagaagctgtgctacgtggccctggactttgaaaatgagatggccacagctgccagcagcagcagcctggagaagagctatgagctgcctgatggccaggtgatcaccatcggaaatgaacgcttccgctgcccagagaccctcttccagcccagcttcatcggcatggagagcgctggcatccacgagaccacctacaacagcatcatgaagtgtgacatcgacatcaggaaggacctgtatgccaacaacgtgctgagcggcggcaccaccatgtacccaggcattgctgacaggatgcagaaggagatcacagccctggcccccagcaccatgaagatcaagatcatcgcccctcctgagaggaagtacagcgtgtggattggaggcagcatcctggccagcctgagcaccttccagcagatgtggatcagcaagcaggagtatgatgaagctggccccagcatcgtgcacaggaagtgcttctag

SEQ ID NO: 3067 - DNA, 999 bp, Artificial Sequence
  Description of Artificial Sequence: Synthetic coding sequence
atggtgggcatgggccagaaggacagctatgtgggagatgaggcccagagcaagaggggcatcctgaccctgaagtaccccatcgagcacggcatcatcaccaactgggatgacatggagaagatctggcaccacagcttctacaatgagctgcgggtggcccctgaggagcaccccaccctgctgacagaggcccccctgaaccccaaggccaaccgggagaagatgacccagatcatgtttgagaccttcaacgtgcctgccatgtatgtggccatccaggccgtgctgagcctgtatgccagcggccgcaccaccggcatcgtgctggacagcggagatggagtgacccacaacgtgcccatctatgagggctacgccctgccccacgccatcatgaggctggacctggccggccgggacctgacagactacctgatgaagatcctgacagagcggggctacagctttgtgaccacagctgagcgggagatcgtgcgggacatcaaggagaagctgtgctacgtggccctggactttgaaaatgagatggccacagctgccagcagcagcagcctggagaagagctatgagctgcctgatggccaggtgatcaccatcggaaatgaacgcttccgctgcccagagaccctcttccagcccagcttcatcggcatggagagcgctggcatccacgagaccacctacaacagcatcatgaagtgtgacatcgacatcaggaaggacctgtatgccaacaacgtgctgagcggcggcaccaccatgtacccaggcattgctgacaggatgcagaaggagatcacagccctggcccccagcaccatgaagatcaagatcatcgcccctcctgagaggaagtacagcgtgtggattggaggcagcatcctggccagcctgagcaccttccagcagatgtggatcagcaagcaggagtatgatgaggccggccccagcatcgtgcacaggaagtgcttctag

SEQ ID NO: 3068 - DNA, 1134 bp, Artificial Sequence
  Description of Artificial Sequence: Synthetic coding sequence
atgtgtgatgatgaggagaccacagccctggtgtgtgacaatggcagcggcctggtgaaggccggctttgctggagatgatgcccccagggctgtgttccccagcatcgtgggccggcccaggcaccagggcgtgatggtgggcatgggccagaaggacagctatgtgggagatgaggcccagagcaagaggggcatcctgaccctgaagtaccccattgaacatggcatcatcaccaactgggatgacatggagaagatctggcaccacaccttctacaatgagctgcgggtggcccctgaggagcaccccaccctgctgacagaggcccccctgaaccccaaggccaaccgggagaagatgacccagatcatgtttgagaccttcaacgtgcctgccatgtatgtggccatccaggccgtgctgagcctgtatgccagcggccgcaccactggaattgtgctggacagcggagatggagtgacccacaacgtgcccatctatgagggctacgccctgccccacgccatcatgaggctggacctggccggccgggacctgacagactacctgatgaagatcctgacagagcggggctacagctttgtgaccacagctgagcgggagatcgtgcgggacatcaaggagaagctgtgctacgtggccctggactttgaaaatgagatggccacagctgccagcagcagcagcctggagaagagctatgagctgcctgatggccaggtgatcaccatcggaaatgaacgcttccgctgcccagagaccctcttccagcccagcttcatcggcatggagagcgctggcatccacgagaccacctacaacagcatcatgaagtgtgacatcgacatcaggaaggacctgtatgccaacaacgtgctgagcggcggcaccaccatgtacccaggcattgctgacaggatgcagaaggagatcacagccctggcccccagcaccatgaagatcaagatcatcgcccctcctgagaggaagtacagcgtgtggattggaggcagcatcctggccagcctgagcaccttccagcagatgtggatcagcaagcaggagtatgatgaagctggccccagcatcgtgcacaggaagtgcttctag

SEQ ID NO: 3069 - DNA, 1029 bp, Artificial Sequence
  Description of Artificial Sequence: Synthetic coding sequence
atgtgtgatgatgaggagaccacagccctggtgtgtgacaatggcagcggcctggtgaaggccggctttgctggagatgatgcccccagggctgtgttccccagcatcgtgggccggcccaggcaccagggcgtgatggtgggcatgggccagaaggacagctatgtgggagatgaggcccagagcaagaggggcatcctgaccctgaagtaccccattgaacatggcatcatcaccaaggccaaccgggagaagatgacccagatcatgtttgagaccttcaacgtgcctgccatgtatgtggccatccaggccgtgctgagcctgtatgccagcggccgcaccaccggcatcgtgctggacagcggagatggagtgacccacaacgtgcccatctatgagggctacgccctgccccacgccatcatgaggctggacctggccggccgggacctgacagactacctgatgaagatcctgacagagcggggctacagctttgtgaccacagctgagcgggagatcgtgcgggacatcaaggagaagctgtgctacgtggccctggactttgaaaatgagatggccacagctgccagcagcagcagcctggagaagagctatgagctgcctgatggccaggtgatcaccatcggaaatgaacgcttccgctgcccagagaccctcttccagcccagcttcatcggcatggagagcgctggcatccacgagaccacctacaacagcatcatgaagtgtgacatcgacatcaggaaggacctgtatgccaacaacgtgctgagcggcggcaccaccatgtacccaggcattgctgacaggatgcagaaggagatcacagccctggcccccagcaccatgaagatcaagatcatcgcccctcctgagaggaagtacagcgtgtggattggaggcagcatcctggccagcctgagcaccttccagcagatgtggatcagcaagcaggagtatgatgaggccggccccagcatcgtgcacaggaagtgcttctag

SEQ ID NO: 3070 - DNA, 885 bp, Artificial Sequence
  Description of Artificial Sequence: Synthetic coding sequence
atggagaagatctggcaccacaccttctacaatgagctgcgggtggcccctgaggagcaccctgtgctgctgacagaggcccccctgaaccccaaggccaaccgggagaagatgacccagatcatgtttgagaccttcaacaccccagccatgtatgtggccatccaggccgtgctgagcctgtatgccagcggccgcaccaccggcatcgtgatggacagcggagatggagtgacccacacagtgcccatctatgagggctacgccctgccccacgccatcctgcggctggacctggccggccgggacctgacagactacctgatgaagatcctgacagagcggggctacagcttcaccaccacagctgagcgggagatcgtgcgggacatcaaggagaagctgtgctacgtggccctggactttgagcaggagatggccacagctgccagcagcagcagcctggagaagagctatgagctgcctgatggccaggtgatcaccatcggaaatgaacgcttccgctgcccagaggccctcttccagcccagcttcctgggcatggagagctgtggcatccacgagaccaccttcaacagcatcatgaagtgtgatgtggacatcaggaaggacctgtatgccaacacagtgctgagcggcggcaccaccatgtacccaggcattgctgacaggatgcagaaggagatcacagccctggcccccagcaccatgaagatcaagatcatcgcccctcctgagaggaagtacagcgtgtggattggaggcagcatcctggccagcctgagcaccttccagcagatgtggatcagcaagcaggagtatgatgagagcggccccagcatcgtgcacaggaagtgcttctag

SEQ ID NO: 3071 - DNA, 1128 bp, Artificial Sequence
  Description of Artificial Sequence: Synthetic coding sequence
atggatgatgacattgctgccctggtggtggacaatggcagcggcatgtgcaaggccggctttgctggagatgatgcccccagggctgtgttccccagcatcgtgggccggcccaggcaccagggcgtgatggtgggcatgggccagaaggacagctatgtgggagatgaggcccagagcaagaggggcatcctgaccctgaagtaccccattgaacatggaattgtgaccaactgggatgacatggagaagatctggcaccacaccttctacaatgagctgcgggtggcccctgaggagcaccctgtgctgctgacagaggcccccctgaaccccaaggccaaccgggagaagatgacccagatcatgtttgagaccttcaacaccccagccatgtatgtggccatccaggccgtgctgagcctgtatgccagcggccgcaccactggaattgtgatggattctggagatggagtgacccacacagtgcccatctatgagggctacgccctgccccacgccatcctgcggctggacctggccggccgggacctgacagactacctgatgaagatcctgacagagcggggctacagcttcaccaccacagctgagcgggagatcgtgcgggacatcaaggagaagctgtgctacgtggccctggactttgagcaggagatggccacagctgccagcagcagcagcctggagaagagctatgagctgcctgatggccaggtgatcaccatcggaaatgaacgcttccgctgcccagaggccctcttccagcccagcttcctgggcatggagagctgtggcatccacgagaccaccttcaacagcatcatgaagtgtgatgtggacatcaggaaggacctgtatgccaacacagtgctgagcggcggcaccaccatgtacccaggcattgctgacaggatgcagaaggagatcacagccctggcccccagcaccatgaagatcaagatcatcgcccctcctgagaggaagtacagcgtgtggattggaggcagcatcctggccagcctgagcaccttccagcagatgtggatcagcaagcaggagtatgatgaaagtggccccagcatcgtgcacaggaagtgcttctag

SEQ ID NO: 3072 - DNA, 1044 bp, Artificial Sequence
  Description of Artificial Sequence: Synthetic coding sequence
atggatgatgacattgctgccctggtggtggacaatggcagcggcatgtgcaaggccggctttgctggagatgatgcccccagggctgtgttccccagcatcgtgggccggcccaggcaccagggcgtgatggtgggcatcgtgaccaactgggatgacatggagaagatctggcaccacaccttctacaatgagctgcgggtggcccctgaggagcaccctgtgctgctgacagaggcccccctgaaccccaaggccaaccgggagaagatgacccagatcatgtttgagaccttcaacaccccagccatgtatgtggccatccaggccgtgctgagcctgtatgccagcggccgcaccactggaattgtgatggattctggagatggagtgacccacacagtgcccatctatgagggctacgccctgccccacgccatcctgcggctggacctggccggccgggacctgacagactacctgatgaagatcctgacagagcggggctacagcttcaccaccacagctgagcgggagatcgtgcgggacatcaaggagaagctgtgctacgtggccctggactttgagcaggagatggccacagctgccagcagcagcagcctggagaagagctatgagctgcctgatggccaggtgatcaccatcggaaatgaacgcttccgctgcccagaggccctcttccagcccagcttcctgggcatggagagctgtggcatccacgagaccaccttcaacagcatcatgaagtgtgatgtggacatcaggaaggacctgtatgccaacacagtgctgagcggcggcaccaccatgtacccaggcattgctgacaggatgcagaaggagatcacagccctggcccccagcaccatgaagatcaagatcatcgcccctcctgagaggaagtacagcgtgtggattggaggcagcatcctggccagcctgagcaccttccagcagatgtggatcagcaagcaggagtatgatgaaagtggccccagcatcgtgcacaggaagtgcttctag

SEQ ID NO: 3073 - DNA, 243 bp, Artificial Sequence
  Description of Artificial Sequence: Synthetic coding sequence
atggatgatgacattgctgccctggtggtggacaatggcagcggcatgtgcaaggccggctttgctggagatgatgcccccagggctgtgttccccagcatcgtgggccggcccaggcaccagggcgtgatggtgggcatgggccagaaggacagctatgtgggagatgaggcccagagcaagaggggcatcctgaccctgaagtaccccattgaacatggaattgtgaccaactgggactag

SEQ ID NO: 3074 - DNA, 300 bp, Artificial Sequence
  Description of Artificial Sequence: Synthetic coding sequence
atgctgaccatggatgatgacattgctgccctggtggtggacaatggaagtggcatgtgcaaggccggctttgctggagatgatgcccccagggctgtgttccccagcatcgtgggccggcccaggcaccagggcgtgatggtgggcatgggccagaaggacagctatgtgggagatgaggcccagagcaagaggggcatcctgaccctgaagtaccccatcgagcacggcatcgtgaccaactgggatgacatggagaagatctggcaccacaccttctacaatgagctgcgggtgtag

SEQ ID NO: 3075 - DNA, 495 bp, Artificial Sequence
  Description of Artificial Sequence: Synthetic coding sequence
atggatgatgacattgctgccctggtggtggacaatggcagcggcatgtgcaaggccggctttgctggagatgatgcccccagggctgtgttccccagcatcgtgggccggcccaggcaccagggcgtgatggtgggcatgggccagaaggacagctatgtgggagatgaggcccagagcaagaggggcatcctgaccctgaagtaccccattgaacatggaattgtgaccaactgggatgacatggagaagatctggcaccacaccttctacaatgagctgcgggtggcccctgaggagcaccctgtgctgctgacagaggcccccctgaaccccaaggccaaccgggagaagatgacccagatcatgtttgagaccttcaacaccccagccatgtatgtggccatccaggccgtgctgagcctgtatgccagcggccgcaccactggaattgtgatggattctggagatggagtgacccacacagtgccctag

SEQ ID NO: 3076 - DNA, 312 bp, Artificial Sequence
  Description of Artificial Sequence: Synthetic coding sequence
atggatgatgacattgctgccctggtggtggacaatggcagcggcatgtgcaaggccggctttgctggagatgatgcccccagggctgtgttccccagcatcgtgggccggcccaggcaccagggcgtgatggtgggcatgggccagaaggacagctatgtgggagatgaggcccagagcaagaggggcatcctgaccctgaagtaccccattgaacatggaattgtgaccaactgggatgacatggagaagatctggcaccacaccttctacaatgagctgcgggtggcccctgaggagcaccctgtgtag

SEQ ID NO: 3077 - DNA, 1056 bp, Artificial Sequence
  Description of Artificial Sequence: Synthetic coding sequence
atggatgatgacattgctgccctggtggtggacaatggcagcggcatgtgcaaggccggctttgctggagatgatgcccccagggctgtgttccccagcatcgtgggccggcccaggcaccagggcgtgatggtgggcatgggccagaaggacagctatgtgggagatgaggcccagagcaagaggggcatcctgaccctgaagtaccccattgaacatggaattgtgaccaactgggatgacatggagaagatctggcaccacaccttctacaatgagctgcgggtggcccctgaggagcaccctgtgctgctgacagaggcccccctgaaccccaaggccaaccgggagaagatgacccagatcatgtttgagaccttcaacaccccagccatgtatgtggccatccaggccgtgctgagcctgtatgccagcggccgcaccacagccatcctgcggctggacctggccggccgggacctgacagactacctgatgaagatcctgacagagcggggctacagcttcaccaccacagctgagcgggagatcgtgcgggacatcaaggagaagctgtgctacgtggccctggactttgagcaggagatggccacagctgccagcagcagcagcctggagaagagctatgagctgcctgatggccaggtgatcaccatcggaaatgaacgcttccgctgcccagaggccctcttccagcccagcttcctgggcatggagagctgtggcatccacgagaccaccttcaacagcatcatgaagtgtgatgtggacatcaggaaggacctgtatgccaacacagtgctgagcggcggcaccaccatgtacccaggcattgctgacaggatgcagaaggagatcacagccctggcccccagcaccatgaagatcaagatcatcgcccctcctgagaggaagtacagcgtgtggattggaggcagcatcctggccagcctgagcaccttccagcagatgtggatcagcaagcaggagtatgatgaaagtggccccagcatcgtgcacaggaagtgcttctag

SEQ ID NO: 3078 - DNA, 1131 bp, Artificial Sequence
  Description of Artificial Sequence: Synthetic coding sequence
atgacagacaatgagctgagcgccctggtggtggacaatggaagtggcatgtgcaaggccggctttggaggagatgatgcccccagggctgtgttccccagcatgattggccggcccaggcaccagggcgtgatggtgggcatgggccagaaggactgctacgtgggagatgaggcccagagcaagaggggcgtgctgaccctgaagtaccccatcgagcacggcgtggtgaccaactgggatgacatggagaagatctggtaccacaccttctacaatgagctgcgggtggccccagatgagcaccccatcctgctgacagaggcccccctgaaccccaagatcaaccgggagaagatgacccagatcatgtttgaggccttcaacaccccagccatgtatgtggccatccaggccgtgctgagcctgtatgccagcggccgcaccaccggcatcgtgatggacagcggagatggagtgacccacatcgtgcccatctatgagggctacgccctgccccacgccatcctgcggctggacctggccggccgggacctgacagactacctgatgaagatcctgacagagcggggctacaacttcaccaccacagctgagcgggagatcgtgagagatgtgaaggagaagctgtgctacgtggccctggactttgagcaggagatggtgcgggccgccgccagcagcagccctgagaggagctatgagctgcctgatggccaggtgatcaccatcggaaatgaacgcttccgctgcccagaggccatcttccagcccagcttcctgggcatcgagagcagcggcatccacgagaccaccttcaacagcatcatgaagtgtgatgtggacatcaggaaggacctgtatgccaacacagtgctgagcggcggcagcaccatgtacccaggcattgctgacaggatgcagaaggagatcatcaccctggcccccagcaccatgaagatcaagatcatcgcccctcctgagaggaagtacagcgtgtggattggaggcagcatcctggccagcctgagcaccttccagcagatgtggatcagcaagcaggagtatgatgaggccggcccccccatcgtgcacaggaagtgcttctag

SEQ ID NO: 3079 - DNA, 1128 bp, Artificial Sequence; identical to SEQ ID NO: 3062
  Description of Artificial Sequence: Synthetic coding sequence

SEQ ID NO: 3080 - DNA, 1002 bp, Artificial Sequence
  Description of Artificial Sequence: Synthetic coding sequence
atggaggaggagattgctgccctggtgattgacaatggcagcggcatgtgcaaggccggctttgctggagatgatgcccccagggctgtgttccccagcatcgtgggccggcccaggcaccagggcgtgatggtgggcatgggccagaaggacagctatgtgggagatgaggcccagagcaagaggggcatcctgaccctgaagtaccccattgaacatggaattgtgaccaactgggatgacatggagaagatctggcaccacaccttctacaatgagctgcgggtggcccctgaggagcaccctgtgctgctgacagaggcccccctgaaccccaaggccaaccgggagaagatgacccagatcatgtttgagacctacgccctgccccacgccatcctgcggctggacctggccggccgggacctgacagactacctgatgaagatcctgacagagcggggctacagcttcaccaccacagctgagcgggagatcgtgcgggacatcaaggagaagctgtgctacgtggccctggactttgagcaggagatggccacagctgccagcagcagcagcctggagaagagctatgagctgcctgatggccaggtgatcaccatcggaaatgaacgcttccgctgcccagaggccctcttccagcccagcttcctgggcatggagagctgtggcatccacgagaccaccttcaacagcatcatgaagtgtgatgtggacatcaggaaggacctgtatgccaacacagtgctgagcggcggcaccaccatgtacccaggcattgctgacaggatgcagaaggagatcacagccctggcccccagcaccatgaagatcaagatcatcgcccctcctgagaggaagtacagcgtgtggattggaggcagcatcctggccagcctgagcaccttccagcagatgtggatcagcaagcaggagtatgatgaaagtggccccagcatcgtgcacaggaagtgcttctag

SEQ ID NO: 3081 - DNA, 1131 bp, Artificial Sequence
  Description of Artificial Sequence: Synthetic coding sequence
atgtgtgaggaggagaccacagccctggtgtgtgacaatggaagtggcctgtgcaaggccggctttgctggagatgatgcccccagggctgtgttccccagcatcgtgggccggcccaggcaccagggcgtgatggtgggcatgggccagaaggacagctatgtgggagatgaggcccagagcaagaggggcatcctgaccctgaagtaccccatcgagcacggcatcatcaccaactgggatgacatggagaagatctggcaccacagcttctacaatgagctgcgggtggcccctgaggagcaccccaccctgctgacagaggcccccctgaaccccaaggccaaccgggagaagatgacccagatcatgtttgagaccttcaacgtgcctgccatgtatgtggccatccaggccgtgctgagcctgtatgccagcggccgcaccaccggcatcgtgctggacagcggagatggagtgacccacaacgtgcccatctatgagggctacgccctgccccacgccatcatgaggctggacctggccggccgggacctgacagactacctgatgaagatcctgacagagcggggctacagctttgtgaccacagctgagcgggagatcgtgcgggacatcaaggagaagctgtgctacgtggccctggactttgaaaatgagatggccacagctgccagcagcagcagcctggagaagagctatgagctgcctgatggccaggtgatcaccatcggaaatgaacgcttccgctgcccagagaccctcttccagcccagcttcatcggcatggagagcgctggcatccacgagaccacctacaacagcatcatgaagtgtgacatcgacatcaggaaggacctgtatgccaacaacgtgctgagcggcggcaccaccatgtacccaggcattgctgacaggatgcagaaggagatcacagccctggcccccagcaccatgaagatcaagatcatcgcccctcctgagaggaagtacagcgtgtggattggaggcagcatcctggccagcctgagcaccttccagcagatgtggatcagcaagccagaatatgatgaggccggccccagcatcgtgcacaggaagtgcttctag

SEQ ID NO: 3082 - DNA, 1131 bp, Artificial Sequence; identical to SEQ ID NO: 3081
  Description of Artificial Sequence: Synthetic coding sequence

SEQ ID NO: 3083 - DNA, 1164 bp, Artificial Sequence
  Description of Artificial Sequence: Synthetic coding sequence
atggtggtggagagagatgatggcagcaccctgatggagattgatggagacaagggcaagcagggcggccccacctactacatcgacaccaatgccctgcgggtgccccgggagaacatggaggccatcagccccctgaagaatggcatggtggaggactgggacagcttccaggccatcctggaccacacctacaagatgcacgtgaagtctgaggccagcctgcaccctgtgctgatgtctgaggccccctggaacacccgggccaagcgggagaagctgacagagctgatgtttgagcactacaacatcccagccttcttcctgtgcaagacagctgtgctgacagcctttgccaacggccgcagcacaggcctcatcctggacagcggggccacccacaccacagccatccctgtgcatgatggctacgtgctgcagcagggcatcgtgaagagccccctggccggggacttcatcaccatgcagtgccgggagctgttccaggagatgaacatcgagctggtgcccccctacatgattgccagcaaggaggccgtgcgggagggcagccctgccaactggaagaggaaggagaagctgccccaggtgaccaggtcctggcacaactacatgtgcaactgtgtgatccaggacttccaggcctctgtgctgcaggtgtctgacagcacctatgatgagcaggtggccgcccagatgcccaccgtgcactatgagttccccaacggctacaactgtgactttggagctgagcggctgaagatccctgagggcctgtttgaccccagcaatgtgaagggcctgagcggcaacaccatgctgggcgtgagccacgtggtgaccacctctgtgggcatgtgtgacatcgacatccggcccggcctgtatggctctgtgattgtggccggcggcaacaccctcatccagagcttcacagaccggctgaaccgggagctgagccagaagaccccacccagcatgaggctgaagctgattgccaacaacaccaccgtggagcggcgcttcagctcctggattggaggcagcatcctggccagcctgggcaccttccagcagatgtggatcagcaagcaggagtatgaggagggcggcaagcagtgtgtggagaggaaatgtccctag

SEQ ID NO: 3084 - DNA, 1290 bp, Artificial Sequence
  Description of Artificial Sequence: Synthetic coding sequence
atgtctgggggcgtgtatggaggagatgaggtgggcgccctggtgtttgacatcggcagctacacagtgcgggccggctacgccggggaggactgccccaaggtggacttccccacagccatcggcatggtggtggagagagatgatggcagcaccctgatggagattgatggagacaagggcaagcagggcggccccacctactacatcgacaccaatgccctgcgggtgccccgggagaacatggaggccatcagccccctgaagaatggcatggtggaggactgggacagcttccaggccatcctggaccacacctacaagatgcacgtgaagtctgaggccagcctgcaccctgtgctgatgtctgaggccccctggaacacccgggccaagcgggagaagctgacagagctgatgtttgagcactacaacatcccagccttcttcctgtgcaagacagctgtgctgacagcctttgccaacggccgcagcacaggcctcatcctggacagcggggccacccacaccacagccatccctgtgcatgatggctacgtgctgcagcagggcatcgtgaagagccccctggccggggacttcatcaccatgcagtgccgggagctgttccaggagatgaacatcgagctggtgcccccctacatgattgccagcaaggaggccgtgcgggagggcagccctgccaactggaagaggaaggagaagctgccccaggtgaccaggtcctggcacaactacatgtgcaactgtgtgatccaggacttccaggcctctgtgctgcaggtgtctgacagcacctatgatgagcaggtggccgcccagatgcccaccgtgcactatgagttccccaacggctacaactgtgactttggagctgagcggctgaagatccctgagggcctgtttgaccccagcaatgtgaagggcctgagcggcaacaccatgctgggcgtgagccacgtggtgaccacctctgtgggcatgtgtgacatcgacatccggcccggcctgtatggctctgtgattgtggccggcggcaacaccctcatccagagcttcacagaccggctgaaccgggagctgagccagaagaccccacccagcatgaggctgaagctgattgccaacaacaccaccgtggagcggcgcttcagctcctggattggaggcagcatcctggccagcctgggcaccttccagcagatgtggatcagcaagcaggagtatgaggagggcggcaagcagtgtgtggagaggaaatgtccctag

SEQ ID NO: 3085 - DNA, 1164 bp, Artificial Sequence; identical to SEQ ID NO: 3083
  Description of Artificial Sequence: Synthetic coding sequence

SEQ ID NO: 3086 - DNA, 153 bp, Artificial Sequence
  Description of Artificial Sequence: Synthetic coding sequence
atggtggtggagagagatgatggcagcaccctgatggagattgatggagacaagggcaagcagggcggccccacctactacatcgacaccaatgccctgcgggtgccccgggagaacatggaggccatcagccccctgaagaatggcatgtag

SEQ ID NO: 3087 - DNA, 1281 bp, Artificial Sequence
  Description of Artificial Sequence: Synthetic coding sequence
atgtctgggggcgtgtatggaggagatgaggtgggcgccctggtgtttgacatcggcagcttctctgtgcgggccggctacgccggggaggactgccccaaggctgacttccccaccaccgtgggcctgctggccgctgaggagggcggcggcctggagctggagggggacaaggagaagaagggcaagatcttccacatcgacaccaatgccctgcacgtgcccagagatggagctgaggtgatgagccccctgaagaatggcatgattgaggactgggagtgcttccgggccatcctggaccacacctacagcaagcacgtgaagtctgagcccaacctgcaccctgtgctgatgtctgaggccccctggaacacccgggccaagcgggagaagctgacagagctgatgtttgagcagtacaacatcccagccttcttcctgtgcaagacagctgtgctgacagcctttgccaacggccgcagcacaggcctggtgctggacagcggggccacccacaccacagccatccctgtgcatgatggctacgtgctgcagcagggcatcgtgaagagccccctggccggggacttcatctccatgcagtgccgggagctgttccaggagatggccatcgacatcatccccccctacatgattgctgccaaggagcctgtgcgggagggcgccccacccaactggaagaagaaggagaagctgccccaggtgtccaagtcctggcacaactacatgtgcaatgaagtcatccaggacttccaggcctctgtgctgcaggtgtctgacagcccctatgatgagcaggtggccgcccagatgcccaccgtgcactatgagatgcccaacggctacaacacagattatggagctgagcggctgcgcatccctgagggcctgtttgaccccagcaatgtgaagggcctgagcggcaacaccatgctgggcgtgggccacgtggtgaccaccagcatcggcatgtgtgacatcgacatccggcccggcctgtatggcagcgtcatcgtgactggaggcaacaccctgctgcagggcttcacagaccggctgaaccgggagctgagccagaagaccccacccagcatgaggctgaagctgattgccagcaacagcaccatggagaggaagttcagcccctggattggaggcagcatcctggccagcctgggcaccttccagcagatgtggatcagcaagcaggagtatgaggagggcggcaagcagtgtgtggagaggaagtgcccctag

SEQ ID NO: 3088 - DNA, 1308 bp, Artificial Sequence
  Description of Artificial Sequence: Synthetic coding sequence
atgtgggcccccccagctgccatcatgggagatggccccaccaagaaggtgggcaaccaggcccccctgcagacccaggccctgcagacagccagcctgagagatggccctgccaagagagctgtgtgggtgcgccacaccagcagcgagccccaggagcccacagagagcaaggccgccaaggagcggcccaagcaggaggtgaccaaggctgtggtggtggacctgggcaccggctactgcaagtgtggctttgctggcctgccccggcccacccacaagatcagcaccaccgtgggcaagccctacatggagacagccaagacaggagacaacaggaaggagacctttgtgggccaggagctgaacaacaccaacgtgcacctgaagctggtgaaccccctgcggcacggcatcatcgtggactgggacacagtgcaggacatctgggagtacctgttccggcaggagatgaagatcgcccctgaggagcacgctgtgctggtgtctgacccccccctgagcccccacaccaaccgggagaagtatgcagagatgctgtttgaggccttcaacaccccagccatgcacatcgcctaccagagccggctgtccatgtacagctatggccgcaccagcggcctggtggtggaggtgggccatggagtgtcctatgtggtgcccatctatgagggctaccccctgcccagcatcaccggccgcctggactatgccggcagtgacctgacagcctacctgctgggcctgctgaacagcgctggaaatgagttcacccaggaccagatgggcatcgtggaggacatcaagaagaagtgctgctttgtggccctggaccccatcgaggagaagaaggtgcccctgtctgagcacaccatccgctacgtgctgcctgatggcaaggagatccagctgtgccaggagcgcttcctgtgcagcgagatgttcttcaagcccagcctcatcaagtccatgcagctgggcctgcacacccagacagtgtcctgcctgaacaagtgtgacatcgccctgaagagggacctgatgggcaacatcctgctgtgtggcggcagcaccatgctgagcggcttccccaaccggctgcagaaggagctgagctccatgtgccccaatgacaccccccaggtgaatgtgctgcctgagcgggacagcgctgtgtggacaggaggcagcatcctggccagcctgcagggcttccagcccctgtgggtgcacagatttgaatatgaggagcacggccccttcttcctgtaccgccgctgcttctag

SEQ ID NO: 3089 - DNA, 1248 bp, Artificial Sequence
  Description of Artificial Sequence: Synthetic coding sequence
atggccaccaggaacagccccatgcccctgggcacagcccagggcgaccctggagaggccggcacccggcccggcccagatgccagcctgcgggacacaggagctgccacccagctgaagatgaagcccaggaaggtgcacaagatcaaggctgtgatcatcgacctgggcagccagtactgcaagtgtggctacgccggggagccccggcccacctacttcatcagcagcacagtgggcaagcgctgcccagaggccgcagatgctggggacaccaggaagtggaccctggtgggccacgagctgctgaacacagaggcccccctgaagctggtgaaccccctgaagcatggaattgtggtggactgggactgtgtgcaggacatctgggagtacatcttcagaacagccatgaagatcctgcctgaggagcacgctgtgctggtgtctgacccccccctgagccccagcagcaaccgggagaagtatgcagagctgatgtttgagaccttcggcatcccagccatgcacgtgaccagccagagcctgctgagcatctacagctatggcaagaccagcggcctggtggtggagagcggccatggagtgagccacgtggtgcccatcagtgaaggagatgtgctgcccggcctgaccagcagagctgactatgccggcggggacctgaccaactacctgatgcagctgctgaatgaggccggccacgccttcacagatgaccacctgcacatcatcgagcacatcaagaagaagtgctgctacgccgccttcctgcctgaggaggagctgggcctggtgcctgaggagctgcgggtggactatgagctgcctgatggcaagctgatcaccatcggccaggagcgcttccgctgcagcgagatgctgttccagcccagcctggccggcagcacccagcccggcctgcctgagctgacagctgcctgcctgggccgctgccaggacaccggcttcaaggaggagatggccgccaacgtgctgctgtgtggcggctgcaccatgctggatggcttccctgagcgcttccagcgggagctgagcctgctgtgccctggggacagccctgctgtggccgccgcccctgagaggaagacctctgtgtggacaggaggcagcatcctggccagcctgcaggccttccagcagctgtgggtgtccaaggaggagtttgaggagcggggctctgtggccatctacagcaagtgctag

SEQ ID NO: 3090 - DNA, 1101 bp, Artificial Sequence
  Description of Artificial Sequence: Synthetic coding sequence
atggccgccaggacagtcatcatcgaccacggcagcggcttcctgaaggccggcacagctggctggaatgagccccagatggtgttccccaacatcgtgaactacctgccctgcaaggagaaccctggccccagctatgccaggagaagagtgtccctgggcatcgacatctgccacccagacaccttctcctaccccatcgagcggggccgcatcctgaactgggagggcgtgcagtacctgtggagctttgtgctggagaaccaccggcgggagcaggaggtgccccctgtgatcatcacagagacccccctgcgggagcctgctgacaggaagaagatgctggagatcctgtttgagctgctgcacgtgcccagcgtgctgctggccgaccagctgcagatgagcctgtatgccagcggcctgctgactggagtggtggtggacagcggctacggcctgaccagggtgcagcccttccaccagggccggcccctgcctgccagcggcaagaccctggagtttgctggccaggacctgagcgcctacctgctgaagagcctcttcaaggaggactgtgaccggcgctgcctcttccagctggagaccgtggccgtgacccagatgaacaagtgctacgtgccccagaacctgggggaggccctggacttccgggagcggcagcagagcgccctggatgagagcaacacctaccagctgcctgatggcagccgggtggagctgacccccatgcagagggtggcccctgagatgttcttcagcccccaggtgtttgagcagcccggccccagcatcccccgggccatcgtggagagcgtggagagctgtgagatcagcctgcggcccctgctggtgagccacgtgatggcctgtggcggcaacaccctgtacccaggcttcaccaagaggctcttccgggagctgatgggagaccacgtgagcagcaccaaggccaccgtgtgggagggcagcaacagaaacttctctgtgtggctgggcgcctctgtggtggcccacctgagcacctaccagagcgagtggatgagccgggaggagtatggagagcacatgaggatgtag

SEQ ID NO: 3091 - DNA, 1251 bp, Artificial Sequence
  Description of Artificial Sequence: Synthetic coding sequence
atggatgccagccggcccaagagcagcgagagccagagcagcctggaggccccccggcccggccccaaccccagccccaacgtggtgaacaagcccctgcagagggacttccctggcatggtggccgaccggctgccccccaagacaggagtggtggtgattgacatgggcaccggcacctgcaaggtgggctttgctggccaggccagccccacctacacagtggccaccatcctgggctgccagcccaagaagccagccaccagcggccagagcggcctgcagaccttcatcggggaggccgcccgggtgctgcctgagctgaccctggtgcagcccctgcggagcggcatcgtggtggactgggatgctgctgagctgatctggaggcacctgctggagcatgacctgcgggtggccacccatgaccaccccctgctcttcagtgacccccccttctccccagccaccaaccgggagaagctggtggaggtggcctttgagagcctgcggagccctgccatgtatgtggccagccagagcgtgctgtctgtgtatgcccacggccgggtgtctggcctggtggtggacaccggccacggcgtgacctacacagtgcctgtgttccagggctacaacctgctgcacgccacagagcggctggacctggccggcaaccacctgacagccttcctggccgagatgctgctgcaggccggcctgcccctgggccagcaggacctggacctggtggagaacatcaagcaccactactgctacgtggccagtgacttccagaaggagcaggcccggcctgagcaggagtacaagaggaccctgaagctgcctgatggccgcacagtgaccctgggcaaggagctgttccagtgcccagagctgctcttcaaccccccagaggtgcccggcctgagccctgtgggcctgagcaccatggccaagcagagcctgaggaagctgagcctggagatgagagctgacctggcccagaatgtgctgctgtgtggcggcagcagcctcttcaccggctttgagggccgcttccgggcagagctgctgcgggccctgcctgctgagacccacgtggtggtggccgcccagcccaccaggaacttctctgtgtggattggaggcagcatcctggccagcctgcgggccttccagagctgctgggtgctgcgggagcagtatgaggagcagggcccctacatcgtgtacaggaagtgctactag

SEQ ID NO: 3092 - DNA, 2763 bp, Artificial Sequence
  Description of Artificial Sequence: Synthetic coding sequence
atggaggtgcagctgggcctgggccgggtgtacccccggccccccagcaagacctacagaggagccttccagaacctcttccagagcgtgcgggaggtgatccagaaccctggccccaggcaccctgaggccgccagcgctgcccctcctggggccagcctgctgctgctgcagcagcagcagcagcagcagcagcagcagcagcagcagcagcagcagcagcagcagcagcagcagcaggagaccagcccccggcagcagcagcagcagcagggagaagatggcagcccccaggcccacagaagaggccccaccggctacctggtgctggatgaggagcagcagcccagccagccccagagcgccctggagtgccaccctgagcggggctgtgtgcctgagcctggagctgctgtggccgccagcaagggcctgccccagcagctgcctgcccccccagatgaagatgacagcgctgcccccagcaccctgagcctgctgggccccaccttccctggcctgagcagctgcagcgctgacctgaaggacatcctgtctgaggccagcaccatgcagctgctgcagcagcagcagcaggaggccgtgtctgagggcagcagcagcggccgggcccgggaggccagcggggcccccaccagcagcaaggacaactacctgggcggcaccagcaccatcagtgacaatgccaaggagctgtgcaaggctgtgtctgtgtccatgggcctgggcgtggaggccctggagcacctgagccctggagagcagctgcggggggactgcatgtatgcccccctgctgggcgtgcccccagctgtgcggcccaccccctgtgcccccctggctgaatgtaaaggcagcctgctggatgacagcgctgggaagagcacagaggacacagctgagtacagccccttcaagggcggctacaccaagggcctggagggggagagcctgggctgcagcggcagcgctgctgctggcagcagcggcaccctggagctgcccagcaccctgagcctgtacaagagcggggccctggatgaggccgccgcctaccagagccgggactactacaacttccccctggccctggccggccccccacctcctcctcctccaccccacccccacgcccgcatcaagctggagaaccccctggactatggcagcgcctgggccgctgctgctgcccagtgccgctacggggacctggccagcctgcatggagctggagctgctggccctggcagcggcagccccagcgctgctgccagcagctcctggcacaccctcttcaccgctgaggagggccagctgtatggcccctgtggcggcggcggcggcggcggcggcggcggcggcggcggcggcggcggcggcggcggcggcggcggcggggaggccggggctgtggccccctacggctacacccggcccccccagggcctggccggccaggagagtgacttcaccgccccagatgtgtggtacccaggcggcatggtgtcccgggtgccctaccccagccccacctgtgtgaagtctgagatgggcccctggatggacagctacagcggcccctatggagacatgaggctggagacagcccgggaccacgtgctgcccatcgactactacttccccccccagaagacctgcctgatctgtggagatgaggccagcggctgccactacggggccctgacctgtggcagctgcaaggtgttcttcaagagagctgctgagggcaagcagaagtacctgtgtgccagcagaaatgactgcaccatcgacaagttccggaggaagaactgccccagctgccgcctgaggaaatgttatgaagctggcatgaccctgggcgccaggaagctgaagaagctgggcaacctgaagctgcaggaggagggggaggccagcagcaccaccagccccacagaggagaccacccagaagctgactgtgagccacatcgagggctatgagtgccagcccatcttcctgaatgtgctggaggccatcgagcccggggtggtgtgtgccggccatgacaacaaccagcctgacagctttgctgccctgctgagcagcctgaatgagctgggggagcggcagctggtgcacgtggtgaagtgggccaaggccctgcccggcttcaggaacctgcacgtggatgaccagatggccgtcatccagtacagctggatgggcctgatggtgtttgccatgggctggaggagcttcaccaacgtgaacagcaggatgctgtactttgccccagacctggtgttcaatgagtacaggatgcacaagagcaggatgtacagccagtgtgtgaggatgaggcacctgagccaggagtttggctggctgcagatcaccccccaggagttcctgtgcatgaaggccctgctgctcttcagcatcatccctgtggatggcctgaagaaccagaagttctttgatgagctgaggatgaactacatcaaggagctggaccgcatcatcgcctgcaagaggaagaaccccaccagctgcagccgccgcttctaccagctgaccaagctgctggacagcgtgcagcccatcgcccgggagctgcaccagttcacctttgacctgctgatcaagagccacatggtgtctgtggacttccctgagatgatggccgagatcatctctgtgcaggtgcccaagatcctgagcggcaaggtgaagcccatctacttccacacccagtag

SEQ ID NO: 3093 - DNA, 1167 bp, Artificial Sequence
  Description of Artificial Sequence: Synthetic coding sequence
atgatcctgtggctgcacagcctggagacagcccgggaccacgtgctgcccatcgactactacttccccccccagaagacctgcctgatctgtggagatgaggccagcggctgccactacggggccctgacctgtggcagctgcaaggtgttcttcaagagagctgctgagggcaagcagaagtacctgtgtgccagcagaaatgactgcaccatcgacaagttccggaggaagaactgccccagctgccgcctgaggaaatgttatgaagctggcatgaccctgggcgccaggaagctgaagaagctgggcaacctgaagctgcaggaggagggggaggccagcagcaccaccagccccacagaggagaccacccagaagctgactgtgagccacatcgagggctatgagtgccagcccatcttcctgaatgtgctggaggccatcgagcccggggtggtgtgtgccggccatgacaacaaccagcctgacagctttgctgccctgctgagcagcctgaatgagctgggggagcggcagctggtgcacgtggtgaagtgggccaaggccctgcccggcttcaggaacctgcacgtggatgaccagatggccgtcatccagtacagctggatgggcctgatggtgtttgccatgggctggaggagcttcaccaacgtgaacagcaggatgctgtactttgccccagacctggtgttcaatgagtacaggatgcacaagagcaggatgtacagccagtgtgtgaggatgaggcacctgagccaggagtttggctggctgcagatcaccccccaggagttcctgtgcatgaaggccctgctgctcttcagcatcatccctgtggatggcctgaagaaccagaagttctttgatgagctgaggatgaactacatcaaggagctggaccgcatcatcgcctgcaagaggaagaaccccaccagctgcagccgccgcttctaccagctgaccaagctgctggacagcgtgcagcccatcgcccgggagctgcaccagttcacctttgacctgctgatcaagagccacatggtgtctgtggacttccctgagatgatggccgagatcatctctgtgcaggtgcccaagatcctgagcggcaaggtgaagcccatctacttccacacccagtag

SEQ ID NO: 3094 - DNA, 2205 bp, Artificial Sequence
  Description of Artificial Sequence: Synthetic coding sequence
atggaggtgcagctgggcctgggccgggtgtacccccggccccccagcaagacctacagaggagccttccagaacctcttccagagcgtgcgggaggtgatccagaaccctggccccaggcaccctgaggccgccagcgctgcccctcctggggccagcctgctgctgctgcagcagcagcagcagcagcagcagcagcagcagcagcagcagcagcagcagcagcagcagcagcagcaggagaccagcccccggcagcagcagcagcagcagggagaagatggcagcccccaggcccacagaagaggccccaccggctacctggtgctggatgaggagcagcagcccagccagccccagagcgccctggagtgccaccctgagcggggctgtgtgcctgagcctggagctgctgtggccgccagcaagggcctgccccagcagctgcctgcccccccagatgaagatgacagcgctgcccccagcaccctgagcctgctgggccccaccttccctggcctgagcagctgcagcgctgacctgaaggacatcctgtctgaggccagcaccatgcagctgctgcagcagcagcagcaggaggccgtgtctgagggcagcagcagcggccgggcccgggaggccagcggggcccccaccagcagcaaggacaactacctgggcggcaccagcaccatcagtgacaatgccaaggagctgtgcaaggctgtgtctgtgtccatgggcctgggcgtggaggccctggagcacctgagccctggagagcagctgcggggggactgcatgtatgcccccctgctgggcgtgcccccagctgtgcggcccaccccctgtgcccccctggctgaatgtaaaggcagcctgctggatgacagcgctgggaagagcacagaggacacagctgagtacagccccttcaagggcggctacaccaagggcctggagggggagagcctgggctgcagcggcagcgctgctgctggcagcagcggcaccctggagctgcccagcaccctgagcctgtacaagagcggggccctggatgaggccgccgcctaccagagccgggactactacaacttccccctggccctggccggccccccacctcctcctcctccaccccacccccacgcccgcatcaagctggagaaccccctggactatggcagcgcctgggccgctgctgctgcccagtgccgctacggggacctggccagcctgcatggagctggagctgctggccctggcagcggcagccccagcgctgctgccagcagctcctggcacaccctcttcaccgctgaggagggccagctgtatggcccctgtggcggcggcggcggcggcggcggcggcggcggcggcggcggcggcggcggcggcggcggcggcggcggggaggccggggctgtggccccctacggctacacccggcccccccagggcctggccggccaggagagtgacttcaccgccccagatgtgtggtacccaggcggcatggtgtcccgggtgccctaccccagccccacctgtgtgaagtctgagatgggcccctggatggacagctacagcggcccctatggagacatgaggctggagacagcccgggaccacgtgctgcccatcgactactacttccccccccagaagacctgcctgatctgtggagatgaggccagcggctgccactacggggccctgacctgtggcagctgcaaggtgttcttcaagagagctgctgagggcaagcagaagtacctgtgtgccagcagaaatgactgcaccatcgacaagttccggaggaagaactgccccagctgccgcctgaggaaatgttatgaagctggcatgaccctgggcgccaggaagctgaagaagctgggcaacctgaagctgcaggaggagggggaggccagcagcaccaccagccccacagaggagaccacccagaagctgactgtgagccacatcgagggctatgagtgccagcccatcttcctgaatgtgctggaggccatcgagcccggggtggtgtgtgccggccatgacaacaaccagcctgacagctttgctgccctgctgagcagcctgaatgagctgggggagcggcagctggtgcacgtggtgaagtgggccaaggccctgcctgactgtgaaagagctgcctctgtgcacttctag

SEQ ID NO: 3095 - DNA, 1596 bp, Artificial Sequence
  Description of Artificial Sequence: Synthetic coding sequence
atggaggtgcagctgggcctgggccgggtgtacccccggccccccagcaagacctacagaggagccttccagaacctcttccagagcgtgcgggaggtgatccagaaccctggccccaggcaccctgaggccgccagcgctgcccctcctggggccagcctgctgctgctgcagcagcagcagcagcagcagcagcagcagcagcagcagcagcaggagaccagcccccggcagcagcagcagcagcagggagaagatggcagcccccaggcccacagaagaggccccaccggctacctggtgctggatgaggagcagcagcccagccagccccagagcgccctggagtgccaccctgagcggggctgtgtgcctgagcctggagctgctgtggccgccagcaagggcctgccccagcagctgcctgcccccccagatgaagatgacagcgctgcccccagcaccctgagcctgctgggccccaccttccctggcctgagcagctgcagcgctgacctgaaggacatcctgtctgaggccagcaccatgcagctgctgcagcagcagcagcaggaggccgtgtctgagggcagcagcagcggccgggcccgggaggccagcggggcccccaccagcagcaaggacaactacctgggcggcaccagcaccatcagtgacaatgccaaggagctgtgcaaggctgtgtctgtgtccatgggcctgggcgtggaggccctggagcacctgagccctggagagcagctgcggggggactgcatgtatgcccccctgctgggcgtgcccccagctgtgcggcccaccccctgtgcccccctggctgaatgtaaaggcagcctgctggatgacagcgctgggaagagcacagaggacacagctgagtacagccccttcaagggcggctacaccaagggcctggagggggagagcctgggctgcagcggcagcgctgctgctggcagcagcggcaccctggagctgcccagcaccctgagcctgtacaagagcggggccctggatgaggccgccgcctaccagagccgggactactacaacttccccctggccctggccggccccccacctcctcctcctccaccccacccccacgcccgcatcaagctggagaaccccctggactatggcagcgcctgggccgctgctgctgcccagtgccgctacggggacctggccagcctgcatggagctggagctgctggccctggcagcggcagccccagcgctgctgccagcagctcctggcacaccctcttcaccgctgaggagggccagctgtatggcccctgtggcggcggcggcggcggcggcggcggcggcggcggcggcggcggcggcggcggcggcggcggcggcggggaggccggggctgtggccccctacggctacacccggcccccccagggcctggccggccaggagagtgacttcaccgccccagatgtgtggtacccaggcggcatggtgtcccgggtgccctaccccagccccacctgtgtgaagtctgagatgggcccctggatggacagctacagcggcccctatggagacatgaggtag

SEQ ID NO: 3096 - DNA, 2217 bp, Artificial Sequence
  Description of Artificial Sequence: Synthetic coding sequence
atgcagctgctgcagcagcagcagcaggaggccgtgtctgagggcagcagcagcggccgggcccgggaggccagcggggcccccaccagcagcaaggacaactacctgggcggcaccagcaccatcagtgacaatgccaaggagctgtgcaaggctgtgtctgtgtccatgggcctgggcgtggaggccctggagcacctgagccctggagagcagctgcggggggactgcatgtatgcccccctgctgggcgtgcccccagctgtgcggcccaccccctgtgcccccctggctgaatgtaaaggcagcctgctggatgacagcgctgggaagagcacagaggacacagctgagtacagccccttcaagggcggctacaccaagggcctggagggggagagcctgggctgcagcggcagcgctgctgctggcagcagcggcaccctggagctgcccagcaccctgagcctgtacaagagcggggccctggatgaggccgccgcctaccagagccgggactactacaacttccccctggccctggccggccccccacctcctcctcctccaccccacccccacgcccgcatcaagctggagaaccccctggactatggcagcgcctgggccgctgctgctgcccagtgccgctacggggacctggccagcctgcatggagctggagctgctggccctggcagcggcagccccagcgctgctgccagcagctcctggcacaccctcttcaccgctgaggagggccagctgtatggcccctgtggcggcggcggcggcggcggcggcggcggcggcggcggcggcggcggcggcggcggcggcggcggcggggaggccggggctgtggccccctacggctacacccggcccccccagggcctggccggccaggagagtgacttcaccgccccagatgtgtggtacccaggcggcatggtgtcccgggtgccctaccccagccccacctgtgtgaagtctgagatgggcccctggatggacagctacagcggcccctatggagacatgaggctggagacagcccgggaccacgtgctgcccatcgactactacttccccccccagaagacctgcctgatctgtggagatgaggccagcggctgccactacggggccctgacctgtggcagctgcaaggtgttcttcaagagagctgctgagggcaagcagaagtacctgtgtgccagcagaaatgactgcaccatcgacaagttccggaggaagaactgccccagctgccgcctgaggaaatgttatgaagctggcatgaccctgggcgccaggaagctgaagaagctgggcaacctgaagctgcaggaggagggggaggccagcagcaccaccagccccacagaggagaccacccagaagctgactgtgagccacatcgagggctatgagtgccagcccatcttcctgaatgtgctggaggccatcgagcccggggtggtgtgtgccggccatgacaacaaccagcctgacagctttgctgccctgctgagcagcctgaatgagctgggggagcggcagctggtgcacgtggtgaagtgggccaaggccctgcccggcttcaggaacctgcacgtggatgaccagatggccgtcatccagtacagctggatgggcctgatggtgtttgccatgggctggaggagcttcaccaacgtgaacagcaggatgctgtactttgccccagacctggtgttcaatgagtacaggatgcacaagagcaggatgtacagccagtgtgtgaggatgaggcacctgagccaggagtttggctggctgcagatcaccccccaggagttcctgtgcatgaaggccctgctgctcttcagcatcaccttctgcctgcaccccacctctgtgcctgtggatggcctgaagaaccagaagttctttgatgagctgaggatgaactacatcaaggagctggaccgcatcatcgcctgcaagaggaagaaccccaccagctgcagccgccgcttctaccagctgaccaagctgctggacagcgtgcagcccatcgcccgggagctgcaccagttcacctttgacctgctgatcaagagccacatggtgtctgtggacttccctgagatgatggccgagatcatctctgtgcaggtgcccaagatcctgagcggcaaggtgaagcccatctacttccacacccagtag

SEQ ID NO: 3097 - DNA, 4290 bp, Artificial Sequence
  Description of Artificial Sequence: Synthetic coding sequence
atggtggccgctgctgctgccacagaggcccggctgcggcggaggacagctgccacagctgccctggccggccgcagcggcggcccccactgggactgggatgtgacccgggccggccggcccggcctgggcgccggcctgcggctgccccggctgctgagcccccccctgcggccccggctgctgctgctgctgctgctgctgagcccccccctgctgctgctgctgctgccctgtgaggccgaggccgctgctgctgctgctgctgtgtctggcagcgctgctgctgaggccaaggaatgtgaccggccctgtgtgaatggaggccgctgcaaccctggcaccggccagtgtgtgtgcccagctggctgggtgggggagcagtgccagcactgcggcggccgcttccggctgaccggcagcagcggctttgtgacagatggccctggcaactacaagtacaagaccaagtgcacctggctgattgagggccagcccaaccgcatcatgaggctgcgcttcaaccactttgccacagagtgctcctgggaccacctgtatgtgtatgatggagacagcatctatgcccccctggtggccgccttcagcggcctcatcgtgcctgagagagatggaaatgaaacagtgcctgaggtggtggccaccagcggctacgccctgctgcacttcttcagtgatgctgcctacaacctgaccggcttcaacatcacctacagctttgacatgtgccccaacaactgcagcggcagaggagagtgcaagatcagcaacagcagtgacacagtggagtgtgagtgcagcgagaactggaagggggaggcctgtgacatcccccactgcacagacaactgtggcttcccccaccggggcatctgcaacagcagtgatgtgcggggctgcagctgcttcagtgactggcagggccctggctgcagcgtgcctgtgcctgccaaccagagcttctggacccgggaggagtacagcaacctgaagctgccccgggccagccacaaggctgtggtgaatggaaacatcatgtgggtggtgggcggctacatgttcaaccacagcgactacaacatggtgctggcctatgacctggccagccgggagtggctgcccctgaacagatctgtgaacaacgtggtggtgcgctatggccacagcctggccctgtacaaggacaagatctacatgtatggaggcaagattgacagcactggaaatgtgaccaatgagctgcgggtcttccacatccacaatgaatcctgggtgctgctgacccccaaggccaaggagcagtatgctgtggtgggccacagcgcccacatcgtgaccctgaagaatggccgggtggtgatgctggtgatcttcggccactgccccctgtatggctacatcagcaatgtgcaggagtatgacctggacaagaacacctggagcatcctgcacacccagggcgccctggtgcagggcggctacggccacagctctgtgtatgaccacaggacccgggccctgtatgtgcatggaggctacaaggccttcagcgccaacaagtaccgcctggctgatgacctgtaccgctatgatgtggacacccagatgtggaccatcctgaaggacagccgcttcttccgctacctgcacacagctgtgattgtgtctggcaccatgctggtgtttggaggcaacacccacaatgacacctccatgagccatggagccaagtgcttcagcagtgacttcatggcctatgacatcgcctgtgaccgctggagcgtgctgcccaggccagacctgcaccatgatgtgaacagatttggccacagcgctgtgctgcacaacagcaccatgtatgtgtttggaggcttcaacagcctgctgctgagtgacatcctggtgttcaccagcgagcagtgtgatgcccacaggtctgaggccgcctgcctggccgccggccctggcatccgctgtgtgtggaacacaggcagcagccagtgcatctcctgggccctggccacagatgagcaggaggagaagctgaagtctgagtgcttcagcaagaggaccctggaccatgacagatgtgaccagcacacagactgctacagctgcacagccaacaccaatgactgccactggtgcaatgaccactgtgtgcccaggaaccacagctgcagcgagggccagatcagcatcttccgctatgagaactgccccaaggacaaccccatgtactactgcaacaagaagaccagctgccgcagctgtgccctggaccagaactgccagtgggagcccaggaaccaggagtgcatcgccctgcctgagaacatctgtggcatcggctggcacctggtgggcaacagctgcctgaagatcaccacagccaaggaaaattatgacaatgccaagctgttctgcaggaaccacaatgccctgctggccagcctgaccacccagaagaaggtggagtttgtgctgaagcagctgcgcatcatgcagagcagccagagcatgagcaagctgaccctgaccccctgggtgggcctgaggaagatcaacgtgtcctactggtgctgggaggacatgagccccttcaccaacagcctgctgcagtggatgcccagcgagcccagtgatgctggcttctgtggcatcctgtctgagcccagcacccggggcctgaaggccgccacctgcatcaaccccctgaatggatctgtgtgtgagaggcctgccaaccacagcgccaagcagtgcaggaccccctgtgccctgaggacagcctgtggggactgcaccagcggcagcagcgagtgcatgtggtgcagcaacatgaagcagtgtgtggacagcaatgcctacgtggccagcttccccttcggccagtgcatggagtggtacaccatgagcacctgccccccagagaactgcagcggctactgcacctgcagccactgcctggagcagcccggctgcggctggtgcacagaccccagcaacacaggaaaaggaaaatgtattgagggcagctacaagggccctgtgaagatgcccagccaggcccccactggaaacttctacccccagcccctgctgaacagctccatgtgcctggaggacagccgctacaactggagcttcatccactgcccagcctgccagtgcaatggccacagcaagtgcatcaaccagagcatctgtgagaagtgtgagaacctgaccaccgggaagcactgtgagacctgcatcagcggcttctatggagaccccaccaacggcggcaagtgccagccctgcaagtgcaatggccacgccagcctgtgcaacaccaacacaggcaagtgcttctgcaccaccaagggcgtgaagggagatgagtgccagctgtgtgaggtggagaaccgctaccagggcaaccccctgcggggcacctgctactacaccctgctgattgactaccagttcaccttcagcctgagccaggaggatgaccgctactacacagccatcaactttgtggccaccccagatgagcagaacagagacctggacatgttcatcaatgccagcaagaacttcaacctgaacatcacctgggccgccagcttctctgctggcacccaggccggggaggagatgcctgtggtgtccaagaccaacatcaaggagtacaaggacagcttcagcaatgagaagtttgacttcaggaaccaccccaacatcaccttctttgtgtatgtgagcaacttcacctggcccatcaagatccagatcgccttcagccagcacagcaacttcatggacctggtgcagttctttgtgaccttcttcagctgcttcctgagcctgctgctggtggccgctgtggtgtggaagatcaagcagagctgctgggccagcagaagaagagagcagctgctgcgggagatgcagcagatggccagccggccctttgcctctgtgaatgtggccctggagacagatgaggagcccccagacctgattggaggcagcatcaagacagtgcccaagcccatcgccctggagccctgcttcggcaacaaggctgctgtgctgtctgtgtttgtgcggctgccccggggcctgggcggcatccccccacctggccagagcggcctggccgtggccagcgccctggtggacatcagccagcagatgcccatcgtgtacaaggagaagtctggagctgtgaggaacaggaagcagcagcccccagcccagcccggcacctgcatctag

SEQ ID NO: 3098 - DNA, 3582 bp, Artificial Sequence
  Description of Artificial Sequence: Synthetic coding sequence
atggtggccgctgctgctgccacagaggcccggctgcggcggaggacagctgccacagctgccctggccggccgcagcggcggcccccactgtgtgaatggaggccgctgcaaccctggcaccggccagtgtgtgtgcccagctggctgggtgggggagcagtgccagcactgcggcggccgcttccggctgaccggcagcagcggctttgtgacagatggccctggcaactacaagtacaagaccaagtgcacctggctgattgagggccagcccaaccgcatcatgaggctgcgcttcaaccactttgccacagagtgctcctgggaccacctgtatgtgtatgatggagacagcatctatgcccccctggtggccgccttcagcggcctcatcgtgcctgagagagatggaaatgaaacagtgcctgaggtggtggccaccagcggctacgccctgctgcacttcttcagtgatgctgcctacaacctgaccggcttcaacatcacctacagctttgacatgtgccccaacaactgcagcggcagaggagagtgcaagatcagcaacagcagtgacacagtggagtgtgagtgcagcgagaactggaagggggaggcctgtgacatcccccactgcacagacaactgtggcttcccccaccggggcatctgcaacagcagtgatgtgcggggctgcagctgcttcagtgactggcagggccctggctgcagcgtgcctgtgcctgccaaccagagcttctggacccgggaggagtacagcaacctgaagctgccccgggccagccacaaggctgtggtgaatggaaacatcatgtgggtggtgggcggctacatgttcaaccacagcgactacaacatggtgctggcctatgacctggccagccgggagtggctgcccctgaacagatctgtgaacaacgtggtggtgcgctatggccacagcctggccctgtacaaggacaagatctacatgtatggaggcaagattgacagcactggaaatgtgaccaatgagctgcgggtcttccacatccacaatgaatcctgggtgctgctgacccccaaggccaaggagcagtatgctgtggtgggccacagcgcccacatcgtgaccctgaagaatggccgggtggtgatgctggtgatcttcggccactgccccctgtatggctacatcagcaatgtgcaggagtatgacctggacaagaacacctggagcatcctgcacacccagggcgccctggtgcagggcggctacggccacagctctgtgtatgaccacaggacccgggccctgtatgtgcatggaggctacaaggccttcagcgccaacaagtaccgcctggctgatgacctgtaccgctatgatgtggacacccagatgtggaccatcctgaaggacagccgcttcttccgctacctgcacacagctgtgattgtgtctggcaccatgctggtgtttggaggcaacacccacaatgacacctccatgagccatggagccaagtgcttcagcagtgacttcatggcctatgacatcgcctgtgaccgctggagcgtgctgcccaggccagacctgcaccatgatgtgaacagatttggccacagcgctgtgctgcacaacagcaccatgtatgtgtttggaggcttcaacagcctgctgctgagtgacatcctggtgttcaccagcgagcagtgtgatgcccacaggtctgaggccgcctgcctggccgccggccctggcatccgctgtgtgtggaacacaggcagcagccagtgcatctcctgggccctggccacagatgagcaggaggagaagctgaagtctgagtgcttcagcaagaggaccctggaccatgacagatgtgaccagcacacagactgctacagctgcacagccaacaccaatgactgccactggtgcaatgaccactgtgtgcccaggaaccacagctgcagcgagggccagatcagcatcttccgctatgagaactgccccaaggacaaccccatgtactactgcaacaagaagaccagctgccgcagctgtgccctggaccagaactgccagtgggagcccaggaaccaggagtgcatcgccctgcctgagaacatctgtggcatcggctggcacctggtgggcaacagctgcctgaagatcaccacagccaaggaaaattatgacaatgccaagctgttctgcaggaaccacaatgccctgctggccagcctgaccacccagaagaaggtggagtttgtgctgaagcagctgcgcatcatgcagagcagccagagcatgagcaagctgaccctgaccccctgggtgggcctgaggaagatcaacgtgtcctactggtgctgggaggacatgagccccttcaccaacagcctgctgcagtggatgcccagcgagcccagtgatgctggcttctgtggcatcctgtctgagcccagcacccggggcctgaaggccgccacctgcatcaaccccctgaatggatctgtgtgtgagaggcctgccaaccacagcgccaagcagtgcaggaccccctgtgccctgaggacagcctgtggggactgcaccagcggcagcagcgagtgcatgtggtgcagcaacatgaagcagtgtgtggacagcaatgcctacgtggccagcttccccttcggccagtgcatggagtggtacaccatgagcacctgccccccagagaactgcagcggctactgcacctgcagccactgcctggagcagcccggctgcggctggtgcacagaccccagcaacacaggaaaaggaaaatgtattgagggcagctacaagggccctgtgaagatgcccagccaggcccccactggaaacttctacccccagcccctgctgaacagctccatgtgcctggaggacagccgctacaactggagcttcatccactgcccagcctgccagtgcaatggccacagcaagtgcatcaaccagagcatctgtgagaagtgtgagaacctgaccaccgggaagcactgtgagacctgcatcagcggcttctatggagaccccaccaacggcggcaagtgccagccctgcaagtgcaatggccacgccagcctgtgcaacaccaacacaggcaagtgcttctgcaccaccaagggcgtgaagggagatgagtgccagctgtgtgaggtggagaaccgctaccagggcaaccccctgcggggcacctgctactacaccctgctgattgactaccagttcaccttcagcctgagccaggaggatgaccgctactacacagccatcaactttgtggccaccccagatgagcagaacagagacctggacatgttcatcaatgccagcaagaacttcaacctgaacatcacctgggccgccagcttctctgctggcacccaggccggggaggagatgcctgtggtgtccaagaccaacatcaaggagtacaaggacagcttcagcaatgagaagtttgacttcaggaaccaccccaacatcaccttctttgtgtatgtgagcaacttcacctggcccatcaagatccagtag

SEQ ID NO: 3099 - DNA, 3819 bp, Artificial Sequence
  Description of Artificial Sequence: Synthetic coding sequence
atggtggccgctgctgctgccacagaggcccggctgcggcggaggacagctgccacagctgccctggccggccgcagcggcggcccccactgggactgggatgtgacccgggccggccggcccggcctgggcgccggcctgcggctgccccggctgctgagcccccccctgcggccccggctgctgctgctgctgctgctgctgagcccccccctgctgctgctgctgctgccctgtgaggccgaggccgctgctgctgctgctgctgtgtctggcagcgctgctgctgaggccaaggaatgtgaccggccctgtgtgaatggaggccgctgcaaccctggcaccggccagtgtgtgtgcccagctggctgggtgggggagcagtgccagcactgcggcggccgcttccggctgaccggcagcagcggctttgtgacagatggccctggcaactacaagtacaagaccaagtgcacctggctgattgagggccagcccaaccgcatcatgaggctgcgcttcaaccactttgccacagagtgctcctgggaccacctgtatgtgtatgatggagacagcatctatgcccccctggtggccgccttcagcggcctcatcgtgcctgagagagatggaaatgaaacagtgcctgaggtggtggccaccagcggctacgccctgctgcacttcttcagtgatgctgcctacaacctgaccggcttcaacatcacctacagctttgacatgtgccccaacaactgcagcggcagaggagagtgcaagatcagcaacagcagtgacacagtggagtgtgagtgcagcgagaactggaagggggaggcctgtgacatcccccactgcacagacaactgtggcttcccccaccggggcatctgcaacagcagtgatgtgcggggctgcagctgcttcagtgactggcagggccctggctgcagcgtgcctgtgcctgccaaccagagcttctggacccgggaggagtacagcaacctgaagctgccccgggccagccacaaggctgtggtgaatggaaacatcatgtgggtggtgggcggctacatgttcaaccacagcgactacaacatggtgctggcctatgacctggccagccgggagtggctgcccctgaacagatctgtgaacaacgtggtggtgcgctatggccacagcctggccctgtacaaggacaagatctacatgtatggaggcaagattgacagcactggaaatgtgaccaatgagctgcgggtcttccacatccacaatgaatcctgggtgctgctgacccccaaggccaaggagcagtatgctgtggtgggccacagcgcccacatcgtgaccctgaagaatggccgggtggtgatgctggtgatcttcggccactgccccctgtatggctacatcagcaatgtgcaggagtatgacctggacaagaacacctggagcatcctgcacacccagggcgccctggtgcagggcggctacggccacagctctgtgtatgaccacaggacccgggccctgtatgtgcatggaggctacaaggccttcagcgccaacaagtaccgcctggctgatgacctgtaccgctatgatgtggacacccagatgtggaccatcctgaaggacagccgcttcttccgctacctgcacacagctgtgattgtgtctggcaccatgctggtgtttggaggcaacacccacaatgacacctccatgagccatggagccaagtgcttcagcagtgacttcatggcctatgacatcgcctgtgaccgctggagcgtgctgcccaggccagacctgcaccatgatgtgaacagatttggccacagcgctgtgctgcacaacagcaccatgtatgtgtttggaggcttcaacagcctgctgctgagtgacatcctggtgttcaccagcgagcagtgtgatgcccacaggtctgaggccgcctgcctggccgccggccctggcatccgctgtgtgtggaacacaggcagcagccagtgcatctcctgggccctggccacagatgagcaggaggagaagctgaagtctgagtgcttcagcaagaggaccctggaccatgacagatgtgaccagcacacagactgctacagctgcacagccaacaccaatgactgccactggtgcaatgaccactgtgtgcccaggaaccacagctgcagcgagggccagatcagcatcttccgctatgagaactgccccaaggacaaccccatgtactactgcaacaagaagaccagctgccgcagctgtgccctggaccagaactgccagtgggagcccaggaaccaggagtgcatcgccctgcctgagaacatctgtggcatcggctggcacctggtgggcaacagctgcctgaagatcaccacagccaaggaaaattatgacaatgccaagctgttctgcaggaaccacaatgccctgctggccagcctgaccacccagaagaaggtggagtttgtgctgaagcagctgcgcatcatgcagagcagccagagcatgagcaagctgaccctgaccccctgggtgggcctgaggaagatcaacgtgtcctactggtgctgggaggacatgagccccttcaccaacagcctgctgcagtggatgcccagcgagcccagtgatgctggcttctgtggcatcctgtctgagcccagcacccggggcctgaaggccgccacctgcatcaaccccctgaatggatctgtgtgtgagaggcctgccaaccacagcgccaagcagtgcaggaccccctgtgccctgaggacagcctgtggggactgcaccagcggcagcagcgagtgcatgtggtgcagcaacatgaagcagtgtgtggacagcaatgcctacgtggccagcttccccttcggccagtgcatggagtggtacaccatgagcacctgccccccagagaactgcagcggctactgcacctgcagccactgcctggagcagcccggctgcggctggtgcacagaccccagcaacacaggaaaaggaaaatgtattgagggcagctacaagggccctgtgaagatgcccagccaggcccccactggaaacttctacccccagcccctgctgaacagctccatgtgcctggaggacagccgctacaactggagcttcatccactgcccagcctgccagtgcaatggccacagcaagtgcatcaaccagagcatctgtgagaagtgtgagaacctgaccaccgggaagcactgtgagacctgcatcagcggcttctatggagaccccaccaacggcggcaagtgccagccctgcaagtgcaatggccacgccagcctgtgcaacaccaacacaggcaagtgcttctgcaccaccaagggcgtgaagggagatgagtgccagctgtgtgaggtggagaaccgctaccagggcaaccccctgcggggcacctgctactacaccctgctgattgactaccagttcaccttcagcctgagccaggaggatgaccgctactacacagccatcaactttgtggccaccccagatgagcagaacagagacctggacatgttcatcaatgccagcaagaacttcaacctgaacatcacctgggccgccagcttctctgctggcacccaggccggggaggagatgcctgtggtgtccaagaccaacatcaaggagtacaaggacagcttcagcaatgagaagtttgacttcaggaaccaccccaacatcaccttctttgtgtatgtgagcaacttcacctggcccatcaagatccaggtgcagacagagcagtag

SEQ ID NO: 3100 - DNA, 768 bp, Artificial Sequence
  Description of Artificial Sequence: Synthetic coding sequence
atgttccaccaggtgcggcgggtgatgaccatcctcttcctgaccatggtgatctcctacttcggctgcatgaaggccgcccccatgaaggaggccaacatccggggccagggcggcctggcctacccaggagtgaggacccacggcaccctggagagcgtgaatggccccaaggccggcagccggggcctgaccagcctggccgacacctttgaacatgtgattgaggagctgctggatgaggaccagaaggtgcggcccaatgaggagaacaacaaggatgctgacctgtacaccagccgggtgatgctgagcagccaggtgcccctggagccccccctgctcttcctgctggaggagtacaagaactacctggatgctgccaacatgtccatgagggtgagaagacacagcgaccctgcccggcggggggagctgtctgtgtgtgacagcatcagcgagtgggtgacagctgctgacaagaagacagctgtggacatgtctgggggcaccgtgacagtgctggagaaggtgcctgtgtccaagggccagctgaagcagtacttctatgagaccaagtgcaaccccatgggctacaccaaggagggctgccggggcatcgacaagaggcactggaacagccagtgcaggaccacccagagctatgtgcgggccctgaccatggacagcaagaagagaattggctggaggttcatcagaattgacaccagctgtgtgtgcaccctgaccatcaagagaggaagatag

SEQ ID NO: 3101 - DNA, 744 bp, Artificial Sequence
  Description of Artificial Sequence: Synthetic coding sequence
atgaccatcctcttcctgaccatggtgatctcctacttcggctgcatgaaggccgcccccatgaaggaggccaacatccggggccagggcggcctggcctacccaggagtgaggacccacggcaccctggagagcgtgaatggccccaaggccggcagccggggcctgaccagcctggccgacacctttgaacatgtgattgaggagctgctggatgaggaccagaaggtgcggcccaatgaggagaacaacaaggatgctgacctgtacaccagccgggtgatgctgagcagccaggtgcccctggagccccccctgctcttcctgctggaggagtacaagaactacctggatgctgccaacatgtccatgagggtgagaagacacagcgaccctgcccggcggggggagctgtctgtgtgtgacagcatcagcgagtgggtgacagctgctgacaagaagacagctgtggacatgtctgggggcaccgtgacagtgctggagaaggtgcctgtgtccaagggccagctgaagcagtacttctatgagaccaagtgcaaccccatgggctacaccaaggagggctgccggggcatcgacaagaggcactggaacagccagtgcaggaccacccagagctatgtgcgggccctgaccatggacagcaagaagagaattggctggaggttcatcagaattgacaccagctgtgtgtgcaccctgaccatcaagagaggaagatag

SEQ ID NO: 3102 - DNA, 744 bp, Artificial Sequence; identical to SEQ ID NO: 3101
  Description of Artificial Sequence: Synthetic coding sequence

SEQ ID NO: 3103 - DNA, 744 bp, Artificial Sequence; identical to SEQ ID NO: 3101
  Description of Artificial Sequence: Synthetic coding sequence

SEQ ID NO: 3104 - DNA, 744 bp, Artificial Sequence; identical to SEQ ID NO: 3101
  Description of Artificial Sequence: Synthetic coding sequence

SEQ ID NO: 3105 - DNA, 744 bp, Artificial Sequence; identical to SEQ ID NO: 3101
  Description of Artificial Sequence: Synthetic coding sequence

SEQ ID NO: 3106 - DNA, 789 bp, Artificial Sequence
  Description of Artificial Sequence: Synthetic coding sequence
atgcagagccgggaggaggagtggttccaccaggtgagaagagtgatgaccatcctcttcctgaccatggtgatctcctacttcggctgcatgaaggccgcccccatgaaggaggccaacatccggggccagggcggcctggcctacccaggagtgaggacccacggcaccctggagagcgtgaatggccccaaggccggcagccggggcctgaccagcctggccgacacctttgagcacgtgattgaggagctgctggatgaggaccagaaggtgcggcccaatgaggagaacaacaaggatgctgacctgtacaccagccgggtgatgctgagcagccaggtgcccctggagccccccctgctcttcctgctggaggagtacaagaactacctggatgctgccaacatgtccatgagggtgcggcggcacagcgaccctgccaggagaggagagctgtctgtgtgtgacagcatcagcgagtgggtgacagctgctgacaagaagacagctgtggacatgtctgggggcaccgtgacagtgctggagaaggtgcctgtgtccaagggccagctgaagcagtacttctatgagaccaagtgcaaccccatgggctacaccaaggagggctgccggggcatcgacaagaggcactggaacagccagtgcaggaccacccagagctatgtgcgggccctgaccatggacagcaagaagagaattggctggaggttcatcagaattgacaccagctgtgtgtgcaccctgaccatcaagaggggccgctag

SEQ ID NO: 3107 - DNA, 744 bp, Artificial Sequence; identical to SEQ ID NO: 3101
  Description of Artificial Sequence: Synthetic coding sequence

SEQ ID NO: 3108 - DNA, 744 bp, Artificial Sequence; identical to SEQ ID NO: 3101
  Description of Artificial Sequence: Synthetic coding sequence

SEQ ID NO: 3109 - DNA, 990 bp, Artificial Sequence
  Description of Artificial Sequence: Synthetic coding sequence
atgtgtggggccaccagcttcctgcacgagtgcaccaggctcatcctggtgaccacccagaatgctgagttcctgcagaagggcctgcaggtgcacacctgctttggagtgtacccccacgcctctgtgtggcatgactgtgccagccagaagaagggctgtgctgtgtacctgcacgtgtctgtggagttcaacaagctgatcccagaaaatggcttcatcaagttccaccaggtgcggcgggtgatgaccatcctcttcctgaccatggtgatctcctacttcggctgcatgaaggccgcccccatgaaggaggccaacatccggggccagggcggcctggcctacccaggagtgaggacccacggcaccctggagagcgtgaatggccccaaggccggcagccggggcctgaccagcctggccgacacctttgaacatgtgattgaggagctgctggatgaggaccagaaggtgcggcccaatgaggagaacaacaaggatgctgacctgtacaccagccgggtgatgctgagcagccaggtgcccctggagccccccctgctcttcctgctggaggagtacaagaactacctggatgctgccaacatgtccatgagggtgagaagacacagcgaccctgcccggcggggggagctgtctgtgtgtgacagcatcagcgagtgggtgacagctgctgacaagaagacagctgtggacatgtctgggggcaccgtgacagtgctggagaaggtgcctgtgtccaagggccagctgaagcagtacttctatgagaccaagtgcaaccccatgggctacaccaaggagggctgccggggcatcgacaagaggcactggaacagccagtgcaggaccacccagagctatgtgcgggccctgaccatggacagcaagaagagaattggctggaggttcatcagaattgacaccagctgtgtgtgcaccctgaccatcaagagaggaagatag

SEQ ID NO: 3110 - DNA, 744 bp, Artificial Sequence; identical to SEQ ID NO: 3101
  Description of Artificial Sequence: Synthetic coding sequence

SEQ ID NO: 3111 - DNA, 744 bp, Artificial Sequence; identical to SEQ ID NO: 3101
  Description of Artificial Sequence: Synthetic coding sequence

SEQ ID NO: 3112 - DNA, 744 bp, Artificial Sequence; identical to SEQ ID NO: 3101
  Description of Artificial Sequence: Synthetic coding sequence

SEQ ID NO: 3113 - DNA, 744 bp, Artificial Sequence; identical to SEQ ID NO: 3101
  Description of Artificial Sequence: Synthetic coding sequence

SEQ ID NO: 3114 - DNA, 744 bp, Artificial Sequence; identical to SEQ ID NO: 3101
  Description of Artificial Sequence: Synthetic coding sequence

SEQ ID NO: 3115 - DNA, 744 bp, Artificial Sequence; identical to SEQ ID NO: 3101
  Description of Artificial Sequence: Synthetic coding sequence

SEQ ID NO: 3116 - DNA, 744 bp, Artificial Sequence; identical to SEQ ID NO: 3101
  Description of Artificial Sequence: Synthetic coding sequence

SEQ ID NO: 3117 - DNA, 234 bp, Artificial Sequence
  Description of Artificial Sequence: Synthetic coding sequence
atgtgtggggccaccagcttcctgcacgagtgcaccaggctcatcctggtgaccacccagaatgctgagttcctgcagaagggcctgcaggtgcacacctgctttggagtgtacccccacgcctctgtgtggcatgactgtgccagccagaagaagggctgtgctgtgtacctgcacgtgtctgtggagttcaacaagctgatcccagaaaatggcttcatcaagggctggtag

SEQ ID NO: 3118 - DNA, 894 bp, Artificial Sequence
  Description of Artificial Sequence: Synthetic coding sequence
atgagcagcgcccacttcaacagaggccctgcctacggcctgtctgctgaggtgaagaacaagctggcccagaagtatgaccaccagcgggagcaggagctgcgggagtggattgagggcgtgacaggccgccgcatcggcaacaacttcatggatggcctgaaggatggcatcatcctgtgtgagttcatcaacaagctgcagcccggctctgtgaagaagatcaatgaaagcacccagaactggcaccagctggagaacatcggcaacttcatcaaggccatcaccaagtatggagtgaagccccatgacatctttgaggccaatgacctgtttgagaacaccaaccacacccaggtgcagagcaccctgctggccctggcctccatggccaagaccaagggcaacaaggtgaatgtgggcgtgaagtatgcagagaagcaggagaggaagtttgagcccgggaagctgcgggagggcaggaacatcatcggcctgcagatgggcaccaacaagtttgccagccagcagggcatgacagcctacggcaccaggaggcacctgtatgaccccaagctgggcacagaccagcccctggaccaggccaccatcagcctgcagatgggcaccaacaagggggccagccaggccggcatgacagcccctggcaccaagaggcagatctttgagcccggcctgggcatggagcactgtgacaccctgaatgtgtccctgcagatgggcagcaacaagggggccagccagaggggcatgacagtgtatggcctgccccggcaggtgtatgaccccaagtactgcctgaccccagagtacccagagctgggggagcccgcccacaaccaccacgcccacaactactacaacagcgcctag

SEQ ID NO: 3119 - DNA, 744 bp, Artificial Sequence
  Description of Artificial Sequence: Synthetic coding sequence
atggatggcctgaaggatggcatcatcctgtgtgagttcatcaacaagctgcagcccggctctgtgaagaagatcaatgaaagcacccagaactggcaccagctggagaacatcggcaacttcatcaaggccatcaccaagtatggagtgaagccccatgacatctttgaggccaatgacctgtttgagaacaccaaccacacccaggtgcagagcaccctgctggccctggcctccatggccaagaccaagggcaacaaggtgaatgtgggcgtgaagtatgcagagaagcaggagaggaagtttgagcccgggaagctgcgggagggcaggaacatcatcggcctgcagatgggcaccaacaagtttgccagccagcagggcatgacagcctacggcaccaggaggcacctgtatgaccccaagctgggcacagaccagcccctggaccaggccaccatcagcctgcagatgggcaccaacaagggggccagccaggccggcatgacagcccctggcaccaagaggcagatctttgagcccggcctgggcatggagcactgtgacaccctgaatgtgtccctgcagatgggcagcaacaagggggccagccagaggggcatgacagtgtatggcctgccccggcaggtgtatgaccccaagtactgcctgaccccagagtacccagagctgggggagcccgcccacaaccaccacgcccacaactactacaacagcgcctag

SEQ ID NO: 3120 - DNA, 834 bp, Artificial Sequence
  Description of Artificial Sequence: Synthetic coding sequence
atgctggcccagaagtatgaccaccagcgggagcaggagctgcgggagtggattgagggcgtgacaggccgccgcatcggcaacaacttcatggatggcctgaaggatggcatcatcctgtgtgagttcatcaacaagctgcagcccggctctgtgaagaagatcaatgaaagcacccagaactggcaccagctggagaacatcggcaacttcatcaaggccatcaccaagtatggagtgaagccccatgacatctttgaggccaatgacctgtttgagaacaccaaccacacccaggtgcagagcaccctgctggccctggcctccatggccaagaccaagggcaacaaggtgaatgtgggcgtgaagtatgcagagaagcaggagaggaagtttgagcccgggaagctgcgggagggcaggaacatcatcggcctgcagatgggcaccaacaagtttgccagccagcagggcatgacagcctacggcaccaggaggcacctgtatgaccccaagctgggcacagaccagcccctggaccaggccaccatcagcctgcagatgggcaccaacaagggggccagccaggccggcatgacagcccctggcaccaagaggcagatctttgagcccggcctgggcatggagcactgtgacaccctgaatgtgtccctgcagatgggcagcaacaagggggccagccagaggggcatgacagtgtatggcctgccccggcaggtgtatgaccccaagtactgcctgaccccagagtacccagagctgggggagcccgcccacaaccaccacgcccacaactactacaacagcgcctag

SEQ ID NO: 3121 - DNA, 930 bp, Artificial Sequence
  Description of Artificial Sequence: Synthetic coding sequence
atgagcagcacccagttcaacaagggccccagctatggcctgtctgctgaggtgaagaaccggctgctgagcaaatatgacccccagaaggaggccgagctgcggacctggattgagggcctgaccggcctgagcatcggccctgacttccagaagggcctgaaggatggcaccatcctgtgcaccctgatgaacaagctgcagcccggctctgtgcccaagatcaacagatccatgcagaactggcaccagctggagaacctgagcaacttcatcaaggccatggtgtcctatggcatgaaccctgtggacctgtttgaggccaatgacctgtttgagagcggcaacatgacccaggtgcaggtgtccctgctggccctggccggcaaggccaagaccaagggcctgcagagcggcgtggacatcggcgtgaagtacagcgagaagcaggagaggaactttgatgatgccaccatgaaggccggccagtgtgtgattggcctgcagatgggcaccaacaagtgtgccagccagagcggcatgacagcctacggcaccaggaggcacctgtatgaccccaagaaccacatcctgccccccatggaccacagcaccatcagcctgcagatgggcaccaacaagtgtgccagccaggtgggcatgacagcccctggcaccaggaggcacatctatgacaccaagctgggcacagacaagtgtgacaacagctccatgagcctgcagatgggctacacccagggcgccaaccagagcggccaggtgtttggcctgggccggcagatctatgaccccaagtactgcccccagggcaccgtggctgatggagcccccagcggcactggagactgcccagaccctggagaggtgcctgagtacccaccctactaccaggaggaggccggctactag

SEQ ID NO: 3122 - DNA, 813 bp, Artificial Sequence
  Description of Artificial Sequence: Synthetic coding sequence
atgagcagcacccagttcaacaagggccccagctatggcctgtctgctgaggtgaagaaccggctgctgagcaaatatgacccccagaaggaggccgagctgcggacctggattgagggcctgaccggcctgagcatcggccctgacttccagaagggcctgaaggatggcaccatcctgtgcaccctgatgaacaagctgcagcccggctctgtgcccaagatcaacagatccatgcagaactggcaccagctggagaacctgagcaacttcatcaaggccatggtgtcctatggcatgaaccctgtggacctgtttgaggccaatgacctgtttgagagcggcaacatgacccaggtgcaggtgtccctgctggccctggccggcaagatgggcaccaacaagtgtgccagccagagcggcatgacagcctacggcacccggcggcacctgtatgaccccaagaaccacatcctgccccccatggaccacagcaccatcagcctgcagatgggcaccaacaagtgtgccagccaggtgggcatgacagcccctggcacccggcggcacatctatgacaccaagctgggcacagacaagtgtgacaacagctccatgagcctgcagatgggctacacccagggcgccaaccagagcggccaggtgtttggcctgggccggcagatctatgaccccaagtactgcccccagggcaccgtggctgatggagcccccagcggcaccggggactgcccagaccccggggaggtgcctgagtacccaccctactaccaggaggaggccggctactag

SEQ ID NO: 3123 - DNA, 867 bp, Artificial Sequence
  Description of Artificial Sequence: Synthetic coding sequence
atgagcagcacccagttcaacaagggccccagctatggcctgtctgctgaggtgaagaaccggctgctgagcaaatatgacccccagaagaagggcctgaaggatggcaccatcctgtgcaccctgatgaacaagctgcagcccggctctgtgcccaagatcaacagatccatgcagaactggcaccagctggagaacctgagcaacttcatcaaggccatggtgtcctatggcatgaaccctgtggacctgtttgaggccaatgacctgtttgaaagtggcaacatgacccaggtgcaggtgtccctgctggccctggccggcaaggccaagaccaagggcctgcagagcggcgtggacattggagtgaagtacagcgagaagcaggagaggaactttgatgatgccaccatgaaggccggccagtgtgtgattggcctgcagatgggcaccaacaagtgtgccagccagagcggcatgacagcctacggcacccggcggcacctgtatgaccccaagaaccacatcctgccccccatggaccacagcaccatcagcctgcagatgggcaccaacaagtgtgccagccaggtgggcatgacagcccctggcacccggcggcacatctatgacaccaagctgggcacagacaagtgtgacaacagctccatgagcctgcagatgggctacacccagggcgccaaccagagcggccaggtgtttggcctgggccggcagatctatgaccccaagtactgcccccagggcaccgtggctgatggagcccccagcggcaccggggactgcccagaccccggggaggtgcctgagtacccaccctactaccaggaggaggccggctactag

SEQ ID NO: 3124 - DNA, 990 bp, Artificial Sequence
  Description of Artificial Sequence: Synthetic coding sequence
atgacccacttcaacaagggccccagctatggcctgtctgctgaggtgaagaacaagatcgccagcaaatatgaccaccaggccgaggaggacctgaggaactggattgaggaggtgacaggcatgagcatcggccccaacttccagctgggcctgaaggatggcatcatcctgtgtgagctgatcaacaagctgcagcccggctctgtgaagaaggtgaatgaaagcagcctgaactggccccagctggagaacatcggcaacttcatcaaggccatccaggcctacggcatgaagccccatgacatctttgaggccaatgacctgtttgaaaatggaaacatgacccaggtgcagaccaccctggtggccctggccggcctggccaagaccaagggcttccacaccaccatcgacatcggcgtgaagtatgcagagaagcagaccaggagatttgatgagggcaagctgaaggccggccagagcgtcatcggcctgcagatgggcaccaacaagtgtgccagccaggccggcatgacagcctacggcaccaggaggcacctgtatgaccccaagatgcagacagacaagccctttgaccagaccaccatcagcctgcagatgggcaccaacaagggggccagccaggccggcatgctggcccctggcacccggcgggacatctatgaccagaagctgaccctgcagcctgtggacaacagcaccatcagcctgcagatgggcaccaacaaggtggccagccagaagggcatgtctgtgtatggcctgggccggcaggtgtatgaccccaagtactgtgccgcccccacagagcctgtgatccacaacggcagccagggcaccggcaccaatggaagtgagatcagtgacagcgactaccaggccgagtacccagatgagtaccatggagagtaccaggatgactacccccgggactaccagtacagcgaccagggcatcgactactag

SEQ ID NO: 3125 - DNA, 852 bp, Artificial Sequence
  Description of Artificial Sequence: Synthetic coding sequence
atgacccacttcaacaagggccccagctatggcctgtctgctgaggtgaagaacaagatcgccagcaaatatgaccaccaggccgaggaggacctgaggaactggattgaggaggtgacaggcatgagcatcggccccaacttccagctgggcctgaaggatggcatcatcctgtgtgagctgatcaacaagctgcagcccggctctgtgaagaaggtgaatgaaagcagcctgaactggccccaggccaagaccaagggcttccacaccaccatcgacatcggcgtgaagtatgcagagaagcagaccaggagatttgatgagggcaagctgaaggccggccagagcgtcatcggcctgcagatgggcaccaacaagtgtgccagccaggccggcatgacagcctacggcaccaggaggcacctgtatgaccccaagatgcagacagacaagccctttgaccagaccaccatcagcctgcagatgggcaccaacaagggggccagccaggccggcatgctggcccctggcacccggcgggacatctatgaccagaagctgaccctgcagcctgtggacaacagcaccatcagcctgcagatgggcaccaacaaggtggccagccagaagggcatgtctgtgtatggcctgggccggcaggtgtatgaccccaagtactgtgccgcccccacagagcctgtgatccacaacggcagccagggcaccggcaccaatggaagtgagatcagtgacagcgactaccaggccgagtacccagatgagtaccatggagagtaccaggatgactacccccgggactaccagtacagcgaccagggcatcgactactag

SEQ ID NO: 3126 - DNA, 558 bp, Artificial Sequence
  Description of Artificial Sequence: Synthetic coding sequence
atgagcatcggccccaacttccagctgggcctgaaggatggcatcatcctgtgtgagctgatcaacaagctgcagcccggctctgtgaagaaggtgaatgaaagcagcctgaactggccccagctggagaacatcggcaacttcatcaaggccatccaggcctacggcatgaagccccatgacatctttgaggccaatgacctgtttgaaaatggaaacatgacccaggtgcagaccaccctggtggccctggccggcctggccaagaccaagggcttccacaccaccattgatattggagtgaagtatgcagagaagcagaccaggagatttgatgagggcaagctgaaggccggccagagcgtgattggcctgcagatgggcaccaacaagtgtgccagccaggccggcatgacagcctacggcacccggcggcacctgtatgaccccaagatgcagacagacaagccctttgaccagaccaccatcagcctgcagatgggcaccaacaagggggccagccaggccggcatgctggcccctggcaccaggaggtag

SEQ ID NO: 3127 - DNA, 990 bp, Artificial Sequence; identical to SEQ ID NO: 3124
  Description of Artificial Sequence: Synthetic coding sequence

SEQ ID NO: 3128 - DNA, 867 bp, Artificial Sequence
  Description of Artificial Sequence: Synthetic coding sequence
atgagcatcggccccaacttccagctgggcctgaaggatggcatcatcctgtgtgagctgatcaacaagctgcagcccggctctgtgaagaaggtgaatgaaagcagcctgaactggccccagctggagaacatcggcaacttcatcaaggccatccaggcctacggcatgaagccccatgacatctttgaggccaatgacctgtttgaaaatggaaacatgacccaggtgcagaccaccctggtggccctggccggcctggccaagaccaagggcttccacaccaccattgatattggagtgaagtatgcagagaagcagaccaggagatttgatgagggcaagctgaaggccggccagagcgtgattggcctgcagatgggcaccaacaagtgtgccagccaggccggcatgacagcctacggcacccggcggcacctgtatgaccccaagatgcagacagacaagccctttgaccagaccaccatcagcctgcagatgggcaccaacaagggggccagccaggccggcatgctggcccctggcacccggcgggacatctatgaccagaagctgaccctgcagcctgtggacaacagcaccatcagcctgcagatgggcaccaacaaggtggccagccagaagggcatgtctgtgtatggcctgggccggcaggtgtatgaccccaagtactgtgccgcccccacagagcccgtcatccacaacggcagccagggcaccggcaccaacggcagcgagatcagtgacagcgactaccaggccgagtacccagatgagtaccacggggagtaccaggatgactacccccgggactaccagtacagcgaccagggcatcgactactag

SEQ ID NO: 3129 - DNA, 2223 bp, Artificial Sequence
  Description of Artificial Sequence: Synthetic coding sequence
atgggagagctgtgccggcgggacagcgccctgacagccctggatgaggagaccctgtgggagatgatggagagccaccgccaccgcatcgtgcgctgcatctgccccagccggctgaccccctacctgcggcaggccaaggtgctgtgccagctggatgaggaggaggtgctgcacagcccccggctgaccaacagcgccatgagagctggccacctgctggacctgctgaagacccggggcaagaatggagccatcgccttcctggagagcctgaagttccacaacccagatgtgtacaccctggtgacaggcctgcagccagatgtggacttcagcaacttcagcggcctgatggagaccagcaagctgacagagtgcctggccggggccatcggcagcctgcaggaggagctgaaccaggagaagggccagaaggaggtgctgctgcggcgctgccagcagctgcaggagcacctgggcctggccgagaccagggctgagggcctgcaccagctggaggccgaccacagcaggatgaagcgggaggtgtctgcccacttccacgaggtgctgcggctgaaggatgagatgctgagcctgagcctgcactacagcaatgccctgcaggagaaggagctggccgccagccgctgccgcagcctgcaggaggagctgtacctgctgaagcaggagctgcagagggccaacatggtgagcagctgtgagctggagctgcaggagcagagcctgaggacagccagtgaccaggagagcggagatgaggagctgaaccggctgaaggaggagaatgagaagctgcggagcctgaccttcagcctggccgagaaggacatcctggagcagagcctggatgaggcccggggcagccggcaggagctggtggagcgcatccacagcctgcgggagagagctgtggccgctgagcggcagcgggagcagtactgggaggagaaggagcagaccctgctgcagttccagaagagcaagatggcctgccagctgtaccgggagaaggtgaatgccctgcaggcccaggtgtgtgagctgcagaaggagcgggaccaggcctacagcgcccgggacagcgcccagcgggagatcagccagagcctggtggagaaggacagcctgcggcggcaggtgtttgagctgacagaccaggtgtgtgagctgcggacccagctgcggcagctgcaggccgagcccccaggagtgctgaagcaggaggcccggacccgggagccctgcccccgggagaagcagaggctggtgaggatgcacgccatctgccccagagatgacagcgactgcagcctggtgagcagcacagagagccagctgctgagtgacctgagcgccaccagcagccgggagctggtggacagcttccgcagcagcagccctgccccacccagccagcagagcctgtacaagagggtggccgaggactttggagaggagccctggagcttcagcagctgcctggagatccctgagggggaccccggggccctgcccggggccaaggccggggacccccacctggactatgagctgctggacacagctgacctgccccagctggagagcagcctgcagcctgtgtccccaggccgcctggatgtgtctgagagcggcgtgctgatgagaagaagacctgcccggcgcatcctgagccaggtgaccatgctggccttccagggagatgccctgctggagcagatcagcgtcatcggcggcaacctgaccggcatcttcatccaccgggtgaccccaggcagcgctgctgaccagatggccctgcggcccggcacccagatcgtgatggtggactatgaggccagcgagcccctcttcaaggctgtgctggaggacaccaccctggaggaggccgtgggcctgctgcggcgggtggatggcttctgctgcctgtctgtgaaggtgaacacagatggctacaagaggctgctgcaggacctggaggccaaggtggccaccagcggggacagcttctacatccgggtgaacctggccatggagggccgggccaagggggagctgcaggtgcactgcaatgaggtgctgcacgtgacagacaccatgttccagggctgcggctgctggcacgcccaccgggtgaacagctacaccatgaaggacacagctgcccacggcaccatccccaactacagcaggtag

SEQ ID NO: 3130 - DNA, 3015 bp, Artificial Sequence
  Description of Artificial Sequence: Synthetic coding sequence
atgggagagctgtgccggcgggacagcgccctgacagccctggatgaggagaccctgtgggagatgatggagagccaccgccaccgcatcgtgcgctgcatctgccccagccggctgaccccctacctgcggcaggccaaggtgctgtgccagctggatgaggaggaggtgctgcacagcccccggctgaccaacagcgccatgagagctggccacctgctggacctgctgaagacccggggcaagaatggagccatcgccttcctggagagcctgaagttccacaacccagatgtgtacaccctggtgacaggcctgcagccagatgtggacttcagcaacttcagcggcctgatggagaccagcaagctgacagagtgcctggccggggccatcggcagcctgcaggaggagctgaaccaggagaagggccagaaggaggtgctgctgcggcgctgccagcagctgcaggagcacctgggcctggccgagaccagggctgagggcctgcaccagctggaggccgaccacagcaggatgaagcgggaggtgtctgcccacttccacgaggtgctgcggctgaaggatgagatgctgagcctgagcctgcactacagcaatgccctgcaggagaaggagctggccgccagccgctgccgcagcctgcaggaggagctgtacctgctgaagcaggagctgcagagggccaacatggtgagcagctgtgagctggagctgcaggagcagagcctgaggacagccagtgaccaggagagcggagatgaggagctgaaccggctgaaggaggagaatgagaagctgcggagcctgaccttcagcctggccgagaaggacatcctggagcagagcctggatgaggcccggggcagccggcaggagctggtggagcgcatccacagcctgcgggagagagctgtggccgctgagcggcagcgggagcagtactgggaggagaaggagcagaccctgctgcagttccagaagagcaagatggcctgccagctgtaccgggagaaggtgaatgccctgcaggcccaggtgtgtgagctgcagaaggagcgggaccaggcctacagcgcccgggacagcgcccagcgggagatcagccagagcctggtggagaaggacagcctgcggcggcaggtgtttgagctgacagaccaggtgtgtgagctgcggacccagctgcggcagctgcaggccgagcccccaggagtgctgaagcaggaggcccggacccgggagccctgcccccgggagaagcagaggctggtgaggatgcacgccatctgccccagagatgacagcgactgcagcctggtgagcagcacagagagccagctgctgagtgacctgagcgccaccagcagccgggagctggtggacagcttccgcagcagcagccctgccccacccagccagcagagcctgtacaagagggtggccgaggactttggagaggagccctggagcttcagcagctgcctggagatccctgagggggaccccggggccctgcccggggccaaggccggggacccccacctggactatgagctgctggacacagctgacctgccccagctggagagcagcctgcagcctgtgtccccaggccgcctggatgtgtctgagagcggcgtgctgatgagaagaagacctgcccggcgcatcctgagccaggtgaccatgctggccttccagggagatgccctgctggagcagatcagcgtcatcggcggcaacctgaccggcatcttcatccaccgggtgaccccaggcagcgctgctgaccagatggccctgcggcccggcacccagatcgtgatggtggactatgaggccagcgagcccctcttcaaggctgtgctggaggacaccaccctggaggaggccgtgggcctgctgcggcgggtggatggcttctgctgcctgtctgtgaaggtgaacacagatggctacaagaggctgctgcaggacctggaggccaaggtggccaccagcggggacagcttctacatccgggtgaacctggccatggagggccgggccaagggggagctgcaggtgcactgcaatgaggtgctgcacgtgacagacaccatgttccagggctgcggctgctggcacgcccaccgggtgaacagctacaccatgaaggacacagctgcccacggcaccatccccaactacagccgggcccagcagcagctgattgccctgatccaggacatgacccagcagtgcaccgtgaccaggaagcccagcagcggcggcccccagaagctggtgagaattgtgtccatggacaaggccaaggccagccccctgcggctgagctttgaccggggccagctggaccccagcaggatggagggcagcagcacctgcttctgggccgagagctgcctgaccctggtgccctacaccctggtgcggccccacaggcctgcccggcccaggcctgtgctgctggtgcccagggctgtgggcaagatcctgtctgagaagctgtgcctgctgcagggcttcaagaagtgcctggccgagtacctgagccaggaggagtatgaggcctggagccagagaggagacatcatccaggagggggaggtgtctgggggccgctgctgggtgaccaggcatgctgtggagagcctgatggagaagaacacccacgccctgctggatgtgcagctggacagcgtgtgcaccctgcacaggatggacatcttccccatcgtcatccacgtgtctgtgaatgagaagatggccaagaagctgaagaagggcctgcagaggctgggcaccagcgaggagcagctgctggaggccgcccggcaggaggagggggacctggaccgggccccctgcctgtacagcagcctggccccagatggctggagcgacctggatggcctgctgagctgtgtgcggcaggccatcgcagatgagcagaagaaggtggtgtggacagagcagagccccaggtag

SEQ ID NO: 3131 - DNA, 1305 bp, Artificial Sequence
  Description of Artificial Sequence: Synthetic coding sequence
atggtgagcagctgtgagctggagctgcaggagcagagcctgaggacagccagtgaccaggagagcggagatgaggagctgaaccggctgaaggaggagaatgagaagctgcggagcctgaccttcagcctggccgagaaggacatcctggagcagagcctggatgaggcccggggcagccggcaggagctggtggagcgcatccacagcctgcgggagagagctgtggccgctgagcggcagcgggagcagtactgggaggagaaggagcagaccctgctgcagttccagaagagcaagatggcctgccagctgtaccgggagaaggtgaatgccctgcaggcccaggtgtgtgagctgcagaaggagcgggaccaggcctacagcgcccgggacagcgcccagcgggagatcagccagagcctggtggagaaggacagcctgcggcggcaggtgtttgagctgacagaccaggtgtgtgagctgcggacccagctgcggcagctgcaggccgagcccccaggagtgctgaagcaggaggcccggacccgggagccctgcccccgggagaagcagaggctggtgaggatgcacgccatctgccccagagatgacagcgactgcagcctggtgagcagcacagagagccagctgctgagtgacctgagcgccaccagcagccgggagctggtggacagcttccgcagcagcagccctgccccacccagccagcagagcctgtacaagagggtggctgaagattttggagaggagccctggagcttcagcagctgcctggagatccctgagggggaccccggggccctgcccggggccaaggccggggacccccacctggactatgagctgctggacacagctgacctgccccagctggagagcagcctgcagcctgtgtccccaggccgcctggatgtgtctgagagcggcgtgctgatgagaagaagacctgcccggcgcatcctgagccaggtgaccatgctggccttccagggagatgccctgctggagcagatctctgtgattggaggcaacctgaccggcatcttcatccaccgggtgaccccaggcagcgctgctgaccagatggccctgcggcccggcacccagatcgtgatggtgtcccgggcccggcccctgctgagccctggcctgctgatgggcaccgtggccgccggcggcgtgacccaggccgacttcaccagcccccggcgctgccgcagcaccctgggctgggccagcgccctgtcctgggcagatgtgaagaggtctgcccacctgtag

SEQ ID NO: 3132 - DNA, 3015 bp, Artificial Sequence; identical to SEQ ID NO: 3130
  Description of Artificial Sequence: Synthetic coding sequence

SEQ ID NO: 3133 - DNA, 1326 bp, Artificial Sequence
  Description of Artificial Sequence: Synthetic coding sequence
atggtgagcagctgtgagctggagctgcaggagcagagcctgaggacagccagtgaccaggagagcggagatgaggagctgaaccggctgaaggaggagaatgagaagctgcggagcctgaccttcagcctggccgagaaggacatcctggagcagagcctggatgaggcccggggcagccggcaggagctggtggagcgcatccacagcctgcgggagagagctgtggccgctgagcggcagcgggagcagtactgggaggagaaggagcagaccctgctgcagttccagaagagcaagatggcctgccagctgtaccgggagaaggtgaatgccctgcaggcccaggtgtgtgagctgcagaaggagcgggaccaggcctacagcgcccgggacagcgcccagcgggagatcagccagagcctggtggagaaggacagcctgcggcggcaggtgtttgagctgacagaccaggtgtgtgagctgcggacccagctgcggcagctgcaggccgagcccccaggagtgctgaagcaggaggcccggacccgggagccctgcccccgggagaagcagaggctggtgaggatgcacgccatctgccccagagatgacagcgactgcagcctggtgagcagcacagagagccagctgctgagtgacctgagcgccaccagcagccgggagctggtggacagcttccgcagcagcagccctgccccacccagccagcagagcctgtacaagagggtggctgaagattttggagaggagccctggagcttcagcagctgcctggagatccctgagggggaccccggggccctgcccggggccaaggccggggacccccacctggactatgagctgctggacacagctgacctgccccagctggagagcagcctgcagcctgtgtccccaggccgcctggatgtgtctgagagcggcgtgctgatgagaagaagacctgcccggcgcatcctgagccaggtgaccatgctggccttccagggagatgccctgctggagcagatctctgtgattggaggcaacctgaccggcatcttcatccaccgggtgaccccaggcagcgctgctgaccagatggccctgcggcccggcacccagatcgtgatggtgatccggggctacagcaggacctggaggcccaagtggaggccccggggcacccacagcaccagcggcagcacctggccctggagggctggccccaagggcagctgccgctgcatcgccaccaggagctgcaccagccccaccccctgcagcagagctgctgctgctggcatgcccacagcctag

SEQ ID NO: 3134 - DNA, 2349 bp, Artificial Sequence
  Description of Artificial Sequence: Synthetic coding sequence
atgtttcctccttctggcagcacaggcctcatcccccccagccacttccaggcccggcccctgagcaccctgcccaggatggcccccacctggctgagtgacatccccctggtgcagcccccaggccaccaggatgtgtctgaaagaaggctggacacccagaggccccaggtgaccatgtgggagagagatgtgtccagtgaccggcaggagcccggccggcggggccgctcctggggcctggagggcagccaggccctgagccagcaggccgaggtgattgtgcggcagctgcaggagctgcggcggctggaggaggaggtgcggctgctgcgggagaccagcctgcagcagaagatgaggctggaggcccaggccatggagctggaggccctggcccgggcagagaaggccggccgggcagaggccgagggcctgcgggccgccctggccggggctgaggtggtgaggaagaacctggaggagggcagccagcgggagctggaggaggtgcagaggctgcaccaggagcagctgagcagcctgacccaggcccacgaggaggccctgagcagcctgaccagcaaggccgagggcctggagaagagcctgagcagcctggagacccggcgggccggggaggccaaggagctggccgaggcccagcgggaggccgagctgctgaggaagcagctgagcaagacccaggaggacctggaggcccaggtgaccctggtggagaacctgaggaaatatgtgggggagcaggtgcccagcgaggtgcacagccagacctgggagctggagcggcagaagctgctggagaccatgcagcacctgcaggaggaccgggacagcctgcacgccacagctgagctgctgcaggtgcgggtgcagagcctgacccacatcctggccctgcaggaggaggagctgaccaggaaggtgcagcccagcgacagcctggagcctgagttcaccaggaagtgccagagcctgctgaaccgctggagggagaaggtgtttgccctgatggtgcagctgaaggcccaggagctggagcacagcgacagcgtgaagcagctgaagggccaggtggccagcctgcaggagaaggtgaccagccagagccaggagcaggccatcctgcagaggagcctgcaggacaaggctgctgaggtggaggtggagaggatgggcgccaagggcctgcagctggagctgagccgggcccaggaggcccggcggcgctggcagcagcagacagccagcgctgaggagcagctgcggctggtggtgaatgctgtgagcagcagccagatctggctggagaccaccatggccaaggtggagggcgccgccgcccagctgcccagcctgaacaaccggctgtcctatgctgtgaggaaggtgcacaccatccggggcctcatcgccaggaagctggccctggcccagctgcggcaggagagctgccccctgcccccacctgtgacagatgtgtccctggagctgcagcagctgcgggaggagaggaaccggctggatgctgagctgcagctgagcgcccggctcatccagcaggaggtgggccgggcccgggagcagggcgaggccgagcggcagcagctgagcaaggtggcccagcagctggagcaggagctgcagcagacccaggagagcctggccagcctgggcctgcagctggaggtggcccggcagggccagcaggagagcacagaggaggccgccagcctgcggcaggagctgacccagcagcaggagctgtatggccaggccctgcaggagaaggtggccgaggtggagacccggctgcgggagcagctgagtgacacagaaagaaggctgaatgaggcccggcgggagcacgccaaggctgtggtgtccctgcggcagatccagaggcgggccgcccaggagaaggagaggagccaggagctgcggcggctgcaggaggaggccaggaaggaggagggccagaggctggcccggcggctgcaggagctggagcgggacaagaacctgatgctggccaccctgcagcaggagggcctgctgagccgctacaagcagcagaggctgctgactgtgctgcccagcctgctggacaagaagaagtctgtggtgagcagcccccggcccccagaatgttctgccagcgcccctgtggccgctgctgtgcccacccgggagagcatcaagggcagcctgtctgtgctgctggatgacctgcaggacctgtctgaggccatcagcaaggaggaggccgtgtgccagggcgacaacctggaccgctgcagcagcagcaacccccagatgagcagctag

SEQ ID NO: 3135 - DNA, 2349 bp, Artificial Sequence
  Description of Artificial Sequence: Synthetic coding sequence
atgtttcctccttctggcagcacaggcctcatcccccccagccacttccaggcccggcccctgagcaccctgcccaggatggcccccacctggctgagtgacatccccctggtgcagcccccaggccaccaggatgtgtctgaaagaaggctggacacccagaggccccaggtgaccatgtgggagagagatgtgtccagtgaccggcaggagcccggccggcggggccgctcctggggcctggagggcagccaggccctgagccagcaggccgaggtgattgtgcggcagctgcaggagctgcgctggctggaggaggaggtgtggctgctgcgggagaccagcctgcagcagaagatgaggctggaggcccaggccatggagctggaggccctggcccgggcagagaaggccggccgggcagaggccgagggcctgcgggccgccctggccggggctgaggtggtgaggaagaacctggaggagggccggcagcgggagctggaggaggtgcagaggctgcaccaggagcagctgagcagcctgacccaggcccacgaggaggccctgagcagcctgaccagcaaggccgagggcctggagaagagcctgagcagcctggagacccggcgggccggggaggccaaggagctggccgaggcccagcgggaggccgagctgctgaggaagcagctgagcaagacccaggaggacctggaggcccaggtgaccctggtggagaacctgaggaaatatgtgggggagcaggtgcccagcgaggtgcacagccagacctgggagctggagcggcagaagctgctggagaccatgcagcacctgcaggaggaccgggacagcctgcacgccacagctgagctgctgcaggtgcgggtgcagagcctgacccacatcctggccctgcaggaggaggagctgaccaggaaggtgcagcccagcgacagcctggagcctgagttcaccaggaagtgccagagcctgctgaaccgctggagggagaaggtgtttgccctgatggtgcagctgaaggcccaggagctggagcacagcgacagcgtgaagcagctgaagggccaggtggccagcctgcaggagaaggtgaccagccagagccaggagcaggccatcctgcagaggagcctgcaggacaaggctgctgaggtggaggtggagaggatgggcgccaagggcctgcagctggagctgagccgggcccaggaggcccggcgctggtggcagcagcagacagccagcgctgaggagcagctgcggctggtggtgaatgctgtgagcagcagccagatctggctggagaccaccatggccaaggtggagggcgccgccgcccagctgcccagcctgaacaaccggctgtcctatgctgtgaggaaggtgcacaccatccggggcctcatcgccaggaagctggccctggcccagctgcggcaggagagctgccccctgcccccacctgtgacagatgtgtccctggagctgcagcagctgcgggaggagaggaaccggctggatgctgagctgcagctgagcgcccggctcatccagcaggaggtgggccgggcccgggagcagggcgaggccgagcggcagcagctgagcaaggtggcccagcagctggagcaggagctgcagcagacccaggagagcctggccagcctgggcctgcagctggaggtggcccggcagtgccagcaggagagcacagaggaggccgccagcctgcggcaggagctgacccagcagcaggagctgtatggccaggccctgcaggagaaggtggccgaggtggagacccggctgcgggagcagctgagtgacacagaaagaaggctgaatgaggcccggcgggagcacgccaaggctgtggtgtccctgcggcagatccagaggcgggccgcccaggagaaggagaggagccaggagctgcggcggctgcaggaggaggccaggaaggaggagggccagaggctggcccggcggctgcaggagctggagcgggacaagaacctgatgctggccaccctgcagcaggagggcctgctgagccgctacaagcagcagaggctgctgactgtgctgcccagcctgctggacaagaagaagtctgtggtgagcagcccccggcccccagaatgttctgccagcgcccctgtggccgctgctgtgcccacccgggagagcatcaagggcagcctgtctgtgctgctggatgacctgcaggacctgtctgaggccatcagcaaggaggaggccgtgtgccagggcgacaacctggaccgctgcagcagctgcaacccccagatgagcagctag

SEQ ID NO: 3136 - DNA, 2349 bp, Artificial Sequence; identical to SEQ ID NO: 3134
  Description of Artificial Sequence: Synthetic coding sequence

SEQ ID NO: 3137 - DNA, 2190 bp, Artificial Sequence
  Description of Artificial Sequence: Synthetic coding sequence
atgtttcctccttctggcagcacaggcctcatcccccccagccacttccaggcccggcccctgagcaccctgcccaggatggcccccacctggctgagtgacatccccctggtgcagcccccaggccaccaggatgtgtctgaaagaaggctggacacccagaggccccaggtgaccatgtgggagagagatgtgtccagtgaccggcaggagcccggccggcggggccgctcctggggcctggagggcagccaggccctgagccagcaggccgaggtgattgtgcggcagctgcaggagctgcggcggctggaggaggaggtgcggctgctgcgggagaccagcctgcagcagaagatgaggctggaggcccaggccatggagctggaggccctggcccgggcagagaaggccggccgggcagaggccgagggcctgcgggccgccctggccggggctgaggtggtgaggaagaacctggaggagggcagccagcgggagctggaggaggtgcagaggctgcaccaggagcagctgagcagcctgacccaggcccacgaggaggccctgagcagcctgaccagcaaggccgagggcctggagaagagcctgagcagcctggagacccggcgggccggggaggccaaggagctggccgaggcccagcgggaggccgagctgctgaggaagcagctgagcaagacccaggaggacctggaggcccaggtgaccctggtggagaacctgaggaaatatgtgggggagcaggtgcccagcgaggtgcacagccagacctgggagctggagcggcagaagctgctggagaccatgcagcacctgcaggaggaccgggacagcctgcacgccacagctgagctgctgcaggtgcgggtgcagagcctgacccacatcctggccctgcaggaggaggagctgaccaggaaggtgcagcccagcgacagcctggagcctgagttcaccaggaagtgccagagcctgctgaaccgctggagggagaaggtgtttgccctgatggtgcagctgaaggcccaggagctggagcacagcgacagcgtgaagcagctgaagggccaggtggccagcctgcaggagaaggtgaccagccagagccaggagcaggccatcctgcagaggagcctgcaggacaaggctgctgaggtggaggtggagaggatgggcgccaagggcctgcagctggagctgagccgggcccaggaggcccggcggcgctggcagcagcagacagccagcgctgaggagcagctgcggctggtggtgaatgctgtgagcagctgccccctgcccccacctgtgacagatgtgtccctggagctgcagcagctgcgggaggagaggaaccggctggatgctgagctgcagctgagcgcccggctcatccagcaggaggtgggccgggcccgggagcagggcgaggccgagcggcagcagctgagcaaggtggcccagcagctggagcaggagctgcagcagacccaggagagcctggccagcctgggcctgcagctggaggtggcccggcagggccagcaggagagcacagaggaggccgccagcctgcggcaggagctgacccagcagcaggagctgtatggccaggccctgcaggagaaggtggccgaggtggagacccggctgcgggagcagctgagtgacacagagcggcggctgaatgaggcccggcgggagcacgccaaggctgtggtgtccctgcggcagatccagaggagagctgcccaggagaaggagaggagccaggagctgcggcggctgcaggaggaggccaggaaggaggagggccagaggctggcccggcggctgcaggagctggagcgggacaagaacctgatgctggccaccctgcagcaggagggcctgctgagccgctacaagcagcagaggctgctgactgtgctgcccagcctgctggacaagaagaagtctgtggtgagcagcccccggcccccagagtgcagcgccagcgcccctgtggccgctgctgtgcccacccgggagagcatcaagggcagcctgtctgtgctgctggatgacctgcaggacctgtctgaggccatcagcaaggaggaggccgtgtgccagggcgacaacctggaccgctgcagcagcagcaacccccagatgagcagctag

SEQ ID NO: 3138 - DNA, 2616 bp, Artificial Sequence
  Description of Artificial Sequence: Synthetic coding sequence
atgtggccccacagcgctggggcccggccctgggccagcaccctgaccgggaaggacccccgggtgatggcctgctggtgcctggatggcctgcccagcggcctggccgagccctggagggagctgtggcgctggaggagccggcccctgcactgtgtgccccccttcagccccctggcccggagcagccgggaccacaggaacctgcggcggcggggcaacattgatggctggaggcagaacctggagcccagcaacaacgtggagatgttcccccccagcggcagcacaggcctcatcccccccagccacttccaggcccggcccctgagcaccctgcccaggatggcccccacctggctgagtgacatccccctggtgcagcccccaggccaccaggatgtgtctgagcggcggctggacacccagaggccccaggtgaccatgtgggagagagatgtgtccagtgaccggcaggagcctggaagaagaggccgctcctggggcctggagggcagccaggccctgagccagcaggccgaggtgattgtgcggcagctgcaggagctgcggcggctggaggaggaggtgcggctgctgcgggagaccagcctgcagcagaagatgaggctggaggcccaggccatggagctggaggccctggcccgggcagagaaggccggccgggcagaggccgagggcctgcgggccgccctggccggggctgaggtggtgaggaagaacctggaggagggcagccagcgggagctggaggaggtgcagaggctgcaccaggagcagctgagcagcctgacccaggcccacgaggaggccctgagcagcctgaccagcaaggccgagggcctggagaagagcctgagcagcctggagaccaggagagctggggaggccaaggagctggccgaggcccagcgggaggccgagctgctgaggaagcagctgagcaagacccaggaggacctggaggcccaggtgaccctggtggagaacctgaggaaatatgtgggggagcaggtgcccagcgaggtgcacagccagacctgggagctggagcggcagaagctgctggagaccatgcagcacctgcaggaggaccgggacagcctgcacgccacagctgagctgctgcaggtgcgggtgcagagcctgacccacatcctggccctgcaggaggaggagctgaccaggaaggtgcagcccagcgacagcctggagcctgagttcaccaggaagtgccagagcctgctgaaccgctggagggagaaggtgtttgccctgatggtgcagctgaaggcccaggagctggagcacagcgacagcgtgaagcagctgaagggccaggtggccagcctgcaggagaaggtgaccagccagagccaggagcaggccatcctgcagaggagcctgcaggacaaggctgctgaggtggaggtggagaggatgggcgccaagggcctgcagctggagctgagccgggcccaggaggcccggcggcgctggcagcagcagacagccagcgctgaggagcagctgcggctggtggtgaatgctgtgagcagcagccagatctggctggagaccaccatggccaaggtggagggcgctgctgcccagctgcccagcctgaacaaccggctgtcctatgctgtgaggaaggtgcacaccatccggggcctgattgccaggaagctggccctggcccagctgcggcaggagagctgccccctgcccccacctgtgacagatgtgtccctggagctgcagcagctgcgggaggagaggaaccggctggatgctgagctgcagctgagcgcccggctcatccagcaggaggtgggccgggcccgggagcagggcgaggccgagcggcagcagctgagcaaggtggcccagcagctggagcaggagctgcagcagacccaggagagcctggccagcctgggcctgcagctggaggtggcccggcagggccagcaggagagcacagaggaggccgccagcctgcggcaggagctgacccagcagcaggagctgtatggccaggccctgcaggagaaggtggccgaggtggagacccggctgcgggagcagctgagtgacacagagcggcggctgaatgaggcccggcgggagcacgccaaggctgtggtgtccctgcggcagatccagaggagagctgcccaggagaaggagaggagccaggagctgcggcggctgcaggaggaggccaggaaggaggagggccagaggctggcccggcggctgcaggagctggagcgggacaagaacctgatgctggccaccctgcagcaggagggcctgctgagccgctacaagcagcagaggctgctgactgtgctgcccagcctgctggacaagaagaagtctgtggtgagcagcccccggcccccagagtgcagcgccagcgcccctgtggccgctgctgtgcccacccgggagagcatcaagggcagcctgtctgtgctgctggatgacctgcaggacctgtctgaggccatcagcaaggaggaggccgtgtgccagggcgacaacctggaccgctgcagcagcagcaacccccagatgagcagctag

SEQ ID NO: 3139 - DNA, 2190 bp, Artificial Sequence
  Description of Artificial Sequence: Synthetic coding sequence
atgtttcctccttctggcagcacaggcctcatcccccccagccacttccaggcccggcccctgagcaccctgcccaggatggcccccacctggctgagtgacatccccctggtgcagcccccaggccaccaggatgtgtctgaaagaaggctggacacccagaggccccaggtgaccatgtgggagagagatgtgtccagtgaccggcaggagcccggccggcggggccgctcctggggcctggagggcagccaggccctgagccagcaggccgaggtgattgtgcggcagctgcaggagctgcgctggctggaggaggaggtgtggctgctgcgggagaccagcctgcagcagaagatgaggctggaggcccaggccatggagctggaggccctggcccgggcagagaaggccggccgggcagaggccgagggcctgcgggccgccctggccggggctgaggtggtgaggaagaacctggaggagggccggcagcgggagctggaggaggtgcagaggctgcaccaggagcagctgagcagcctgacccaggcccacgaggaggccctgagcagcctgaccagcaaggccgagggcctggagaagagcctgagcagcctggagacccggcgggccggggaggccaaggagctggccgaggcccagcgggaggccgagctgctgaggaagcagctgagcaagacccaggaggacctggaggcccaggtgaccctggtggagaacctgaggaaatatgtgggggagcaggtgcccagcgaggtgcacagccagacctgggagctggagcggcagaagctgctggagaccatgcagcacctgcaggaggaccgggacagcctgcacgccacagctgagctgctgcaggtgcgggtgcagagcctgacccacatcctggccctgcaggaggaggagctgaccaggaaggtgcagcccagcgacagcctggagcctgagttcaccaggaagtgccagagcctgctgaaccgctggagggagaaggtgtttgccctgatggtgcagctgaaggcccaggagctggagcacagcgacagcgtgaagcagctgaagggccaggtggccagcctgcaggagaaggtgaccagccagagccaggagcaggccatcctgcagaggagcctgcaggacaaggctgctgaggtggaggtggagaggatgggcgccaagggcctgcagctggagctgagccgggcccaggaggcccggcgctggtggcagcagcagacagccagcgctgaggagcagctgcggctggtggtgaatgctgtgagcagctgccccctgcccccacctgtgacagatgtgtccctggagctgcagcagctgcgggaggagaggaaccggctggatgctgagctgcagctgagcgcccggctcatccagcaggaggtgggccgggcccgggagcagggcgaggccgagcggcagcagctgagcaaggtggcccagcagctggagcaggagctgcagcagacccaggagagcctggccagcctgggcctgcagctggaggtggcccggcagtgccagcaggagagcacagaggaggccgccagcctgcggcaggagctgacccagcagcaggagctgtatggccaggccctgcaggagaaggtggccgaggtggagacccggctgcgggagcagctgagtgacacagagcggcggctgaatgaggcccggcgggagcacgccaaggctgtggtgtccctgcggcagatccagaggagagctgcccaggagaaggagaggagccaggagctgcggcggctgcaggaggaggccaggaaggaggagggccagaggctggcccggcggctgcaggagctggagcgggacaagaacctgatgctggccaccctgcagcaggagggcctgctgagccgctacaagcagcagaggctgctgactgtgctgcccagcctgctggacaagaagaagtctgtggtgagcagcccccggcccccagagtgcagcgccagcgcccctgtggccgctgctgtgcccacccgggagagcatcaagggcagcctgtctgtgctgctggatgacctgcaggacctgtctgaggccatcagcaaggaggaggccgtgtgccagggcgacaacctggaccgctgcagcagctgcaacccccagatgagcagctag

SEQ ID NO: 3140 - DNA, 2349 bp, Artificial Sequence; identical to SEQ ID NO: 3135
  Description of Artificial Sequence: Synthetic coding sequence

SEQ ID NO: 3141 - DNA, 2190 bp, Artificial Sequence; identical to SEQ ID NO: 3137
  Description of Artificial Sequence: Synthetic coding sequence

SEQ ID NO: 3142 - DNA, 2616 bp, Artificial Sequence; identical to SEQ ID NO: 3138
  Description of Artificial Sequence: Synthetic coding sequence

SEQ ID NO: 3143 - DNA, 516 bp, Artificial Sequence
  Description of Artificial Sequence: Synthetic coding sequence
atgtttcctccttctggccagtgggaccagacccggggcgtggtggtggtgtctgcctgggagacagaccacctgtgcttctgcaacagcagcggcagcacaggcctcatcccccccagccacttccaggcccggcccctgagcaccctgcccaggatggcccccacctggctgagtgacatccccctggtgcagcccccaggccaccaggatgtgtctgaaagaaggctggacacccagaggccccaggtgaccatgtgggagagagatgtgtccagtgaccggcaggagcccggccggcggggccgctcctggggcctggagggcagccaggccctgagccagcaggccgaggtgattgtgcggcagctgcaggagctgcggcggctggaggaggaggtgcggctgctgcgggagaccagcctgcagcagaagatgaggctggaggcccaggccatggagctggaggccctggcccgggcagagaaggccggccgggcagaggccgagggctag

SEQ ID NO: 3144 - DNA, 516 bp, Artificial Sequence; identical to SEQ ID NO: 3143
  Description of Artificial Sequence: Synthetic coding sequence

SEQ ID NO: 3145 - DNA, 2190 bp, Artificial Sequence; identical to SEQ ID NO: 3139
  Description of Artificial Sequence: Synthetic coding sequence

SEQ ID NO: 3146 - DNA, 2349 bp, Artificial Sequence; identical to SEQ ID NO: 3135
  Description of Artificial Sequence: Synthetic coding sequence

SEQ ID NO: 3147 - DNA, 2349 bp, Artificial Sequence
  Description of Artificial Sequence: Synthetic coding sequence
atgtttcctccttctggcagcacaggcctcatcccccccagccacttccaggcccggcccctgagcaccctgcccaggatggcccccacctggctgagtgacatccccctggtgcagcccccaggccaccaggatgtgtctgaaagaaggctggacacccagaggccccaggtgaccatgtgggagagagatgtgtccagtgaccggcaggagcccggccggcggggccgctcctggggcctggagggcagccaggccctgagccagcaggccgaggtgattgtgcggcagctgcaggagctgcggcggctggaggaggaggtgcggctgctgcgggagaccagcctgcagcagaagatgaggctggaggcccaggccatggagctggaggccctggcccgggcagagaaggccggccgggcagaggccgagggcctgcgggccgccctggccggggctgaggtggtgaggaagaacctggaggagggccggcagcgggagctggaggaggtgcagaggctgcaccaggagcagctgagcagcctgacccaggcccacgaggaggccctgagcagcctgaccagcaaggccgagggcctggagaagagcctgagcagcctggagacccggcgggccggggaggccaaggagctggccgaggcccagcgggaggccgagctgctgaggaagcagctgagcaagacccaggaggacctggaggcccaggtgaccctggtggagaacctgaggaaatatgtgggggagcaggtgcccagcgaggtgcacagccagacctgggagctggagcggcagaagctgctggacaccatgcagcacctgcaggaggaccgggacagcctgcacgccacagctgagctgctgcaggtgcgggtgcagagcctgacccacatcctggccctgcaggaggaggagctgaccaggaaggtgcagcccagcgacagcctggagcctgagttcaccaggaagtgccagagcctgctgaaccgctggagggagaaggtgtttgccctgatggtgcagctgaaggcccaggagctggagcacagcgacagcgtgaagcagctgaagggccaggtggccagcctgcaggagaaggtgaccagccagagccaggagcaggccatcctgcagaggagcctgcaggacaaggctgctgaggtggaggtggagaggatgggcgccaagggcctgcagctggagctgagccgggcccaggaggcccggcggcgctggcagcagcagacagccagcgctgaggagcagctgcggctggtggtgaatgctgtgagcagcagccagatctggctggagaccaccatggccaaggtggagggcgccgccgcccagctgcccagcctgaacaaccggctgtcctatgctgtgaggaaggtgcacaccatccggggcctcatcgccaggaagctggccctggcccagctgcggcaggagagctgccccctgcccccacctgtgacagatgtgtccctggagctgcagcagctgcgggaggagaggaaccggctggatgctgagctgcagctgagcgcccggctcatccagcaggaggtgggccgggcccgggagcagggcgaggccgagcggcagcagctgagcaaggtggcccagcagctggagcaggagctgcagcagacccaggagagcctggccagcctgggcctgcagctggaggtggcccggcagggccagcaggagagcacagaggaggccgccagcctgcggcaggagctgacccagcagcaggagctgtatggccaggccctgcaggagaaggtggccgaggtggagacccggctgcgggagcagctgagtgacacagaaagaaggctgaatgaggcccggcgggagcacgccaaggctgtggtgtccctgcggcagatccagaggcgggccgcccaggagaaggagaggagccaggagctgcggcggctgcaggaggaggccaggaaggaggagggccagaggctggcccggcggctgcaggagctggagcgggacaagaacctgatgctggccaccctgcagcaggagggcctgctgagccgctacaagcagcagaggctgctgactgtgctgcccagcctgctggacaagaagaagtctgtggtgagcagcccccggcccccagaatgttctgccagcgcccctgtggccgctgctgtgcccacccgggagagcatcaagggcagcctgtctgtgctgctggatgacctgcaggacctgtctgaggccatcagcaaggaggaggccgtgtgccagggcgacaacctggaccgctgcagcagcagcaacccccagatgagcagctag

SEQ ID NO: 3148 - DNA, 384 bp, Artificial Sequence
  Description of Artificial Sequence: Synthetic coding sequence
atgtttcctccttctggccagtgggaccagacccggggcgtggtggtggtgtctgcctgggagacagaccacctgtgcttctgcaacagcagcggcagcacaggcctcatcccccccagccacttccaggcccggcccctgagcaccctgcccaggatggcccccacctggctgagtgacatccccctggtgcagcccccaggccaccaggatgtgtctgaaagaaggctggacacccagaggccccaggtgaccatgtgggagagagatgtgtccagtgaccggcaggagcccggccggcggggccgctcctggggcctggagggcagccaggccctgagccagcaggccgaggtgattgtgcggcagctgcaggagctgtag

SEQ ID NO: 3149 - DNA, 384 bp, Artificial Sequence; identical to SEQ ID NO: 3148
  Description of Artificial Sequence: Synthetic coding sequence

SEQ ID NO: 3150 - DNA, 516 bp, Artificial Sequence
  Description of Artificial Sequence: Synthetic coding sequence
atgtttcctccttctggccagtgggaccagacccggggcgtggtggtggtgtctgcctgggagacagaccacctgtgcttctgcaacagcagcggcagcacaggcctcatcccccccagccacttccaggcccggcccctgagcaccctgcccaggatggcccccacctggctgagtgacatccccctggtgcagcccccaggccaccaggatgtgtctgaaagaaggctggacacccagaggccccaggtgaccatgtgggagagagatgtgtccagtgaccggcaggagcccggccggcggggccgctcctggggcctggagggcagccaggccctgagccagcaggccgaggtgattgtgcggcagctgcaggagctgcgctggctggaggaggaggtgtggctgctgcgggagaccagcctgcagcagaagatgaggctggaggcccaggccatggagctggaggccctggcccgggcagagaaggccggccgggcagaggccgagggctag

SEQ ID NO: 3151 - DNA, 771 bp, Artificial Sequence
  Description of Artificial Sequence: Synthetic coding sequence
tgaagactggatgctgagctgcagctgagcgcccggctcatccagcaggaggtgggccgggcccgggagcagggcgaggccgagcggcagcagctgagcaaggtggcccagcagctggagcaggagctgcagcagacccaggagagcctggccagcctgggcctgcagctggaggtggcccggcagggccagcaggagagcacagaggaggccgccagcctgcggcaggagctgacccagcagcaggagctgtatggccaggccctgcaggagaaggtggccgaggtggagacccggctgcgggagcagctgagtgacacagaaagaaggctgaatgaggcccggcgggagcacgccaaggctgtggtgtccctgcggcagatccagaggcgggccgcccaggagaaggagaggagccaggagctgcggcggctgcaggaggaggccaggaaggaggagggccagaggctggcccggcggctgcaggagctggagcgggacaagaacctgatgctgcagaggctgctgactgtgctgcccagcctgctggacaagaagaagtctgtggtgagcagcccccggcccccagaatgttctgccagcgcccctgtggccgctgctgtgcccacccgggagagcatcaagggcagcctgtctgtgctgctggatgacctgcaggacctgtctgaggccatcagcaaggaggaggccgtgtgccagggcgacaacctggaccgctgcagcagcagcaacccccagatgagcagctag

SEQ ID NO: 3152 - DNA, 2349 bp, Artificial Sequence; identical to SEQ ID NO: 3147
  Description of Artificial Sequence: Synthetic coding sequence

SEQ ID NO: 3153 - DNA, 771 bp, Artificial Sequence; identical to SEQ ID NO: 3151
  Description of Artificial Sequence: Synthetic coding sequence

SEQ ID NO: 3154 - DNA, 771 bp, Artificial Sequence
  Description of Artificial Sequence: Synthetic coding sequence
tgaagactggatgctgagctgcagctgagcgcccggctcatccagcaggaggtgggccgggcccgggagcagggcgaggccgagcggcagcagctgagcaaggtggcccagcagctggagcaggagctgcagcagacccaggagagcctggccagcctgggcctgcagctggaggtggcccggcagtgccagcaggagagcacagaggaggccgccagcctgcggcaggagctgacccagcagcaggagctgtatggccaggccctgcaggagaaggtggccgaggtggagacccggctgcgggagcagctgagtgacacagaaagaaggctgaatgaggcccggcgggagcacgccaaggctgtggtgtccctgcggcagatccagaggcgggccgcccaggagaaggagaggagccaggagctgcggcggctgcaggaggaggccaggaaggaggagggccagaggctggcccggcggctgcaggagctggagcgggacaagaacctgatgctgcagaggctgctgactgtgctgcccagcctgctggacaagaagaagtctgtggtgagcagcccccggcccccagaatgttctgccagcgcccctgtggccgctgctgtgcccacccgggagagcatcaagggcagcctgtctgtgctgctggatgacctgcaggacctgtctgaggccatcagcaaggaggaggccgtgtgccagggcgacaacctggaccgctgcagcagctgcaacccccagatgagcagctag

SEQ ID NO: 3155 - DNA, 516 bp, Artificial Sequence; identical to SEQ ID NO: 3143
  Description of Artificial Sequence: Synthetic coding sequence

SEQ ID NO: 3156 - DNA, 462 bp, Artificial Sequence
  Description of Artificial Sequence: Synthetic coding sequence
atgtttcctccttctggcagcacaggcctcatcccccccagccacttccaggcccggcccctgagcaccctgcccaggatggcccccacctggctgagtgacatccccctggtgcagcccccaggccaccaggatgtgtctgaaagaaggctggacacccagaggccccaggtgaccatgtgggagagagatgtgtccagtgaccggcaggagcccggccggcggggccgctcctggggcctggagggcagccaggccctgagccagcaggccgaggtgattgtgcggcagctgcaggagctgcggcggctggaggaggaggtgcggctgctgcgggagaccagcctgcagcagaagatgaggctggaggcccaggccatggagctggaggccctggcccgggcagagaaggccggccgggcagaggccgagggcctgcgggccgccctggccggggcctag

SEQ ID NO: 3157 - DNA, 462 bp, Artificial Sequence; identical to SEQ ID NO: 3156
  Description of Artificial Sequence: Synthetic coding sequence

SEQ ID NO: 3158 - DNA, 2349 bp, Artificial Sequence; identical to SEQ ID NO: 3135
  Description of Artificial Sequence: Synthetic coding sequence

SEQ ID NO: 3159 - DNA, 651 bp, Artificial Sequence
  Description of Artificial Sequence: Synthetic coding sequence
atgtggccccacagcgctggggcccggccctgggccagcaccctgaccgggaaggacccccgggtgatggcctgctggtgcctggatggcctgcccagcggcctggccgagccctggagggagctgtggcgctggaggagccggcccctgcactgtgtgccccccttcagccccctggcccggagcagccgggaccacaggaacctgcggaggagagtggaggccctgccccgcatcctgaagggcaacattgatggctggaggcagaacctggagcccagcaacaacgtggagatgtttcctccttctggcagcacaggcctcatcccccccagccacttccaggcccggcccctgagcaccctgcccaggatggcccccacctggctgagtgacatccccctggtgcagcccccaggccaccaggatgtgtctgaaagaaggctggacacccagaggccccaggtgaccatgtgggagagagatgtgtccagtgaccggcaggagcccggccggcggggccgctcctggggcctggagggcagccaggccctgagccagcaggccgaggtgattgtgcggcagctgcaggagctgcggcggctggaggaggaggtgcggctgctgcgggagaccagcctgcagcagtag

SEQ ID NO: 3160 - DNA, 357 bp, Artificial Sequence
  Description of Artificial Sequence: Synthetic coding sequence
atgtttcctccttctggcagcacaggcctcatcccccccagccacttccaggcccggcccctgagcaccctgcccaggatggcccccacctggctgagtgacatccccctggtgcagcccccaggccaccaggatgtgtctgaaagaaggctggacacccagaggccccaggtgaccatgtgggagagagatgtgtccagtgaccggcaggagcccggccggcggggccgctcctggggcctggagggcagccaggccctgagccagcaggccgaggtgattgtgcggcagctgcaggagctgcggcggctggaggaggaggtgcggctgctgcgggagaccagcctgcagcagtag

SEQ ID NO: 3161 - DNA, 384 bp, Artificial Sequence; identical to SEQ ID NO: 3148
  Description of Artificial Sequence: Synthetic coding sequence

SEQ ID NO: 3162 - DNA, 2190 bp, Artificial Sequence
  Description of Artificial Sequence: Synthetic coding sequence
atgtttcctccttctggcagcacaggcctcatcccccccagccacttccaggcccggcccctgagcaccctgcccaggatggcccccacctggctgagtgacatccccctggtgcagcccccaggccaccaggatgtgtctgaaagaaggctggacacccagaggccccaggtgaccatgtgggagagagatgtgtccagtgaccggcaggagcccggccggcggggccgctcctggggcctggagggcagccaggccctgagccagcaggccgaggtgattgtgcggcagctgcaggagctgcggcggctggaggaggaggtgcggctgctgcgggagaccagcctgcagcagaagatgaggctggaggcccaggccatggagctggaggccctggcccgggcagagaaggccggccgggcagaggccgagggcctgcgggccgccctggccggggctgaggtggtgaggaagaacctggaggagggccggcagcgggagctggaggaggtgcagaggctgcaccaggagcagctgagcagcctgacccaggcccacgaggaggccctgagcagcctgaccagcaaggccgagggcctggagaagagcctgagcagcctggagacccggcgggccggggaggccaaggagctggccgaggcccagcgggaggccgagctgctgaggaagcagctgagcaagacccaggaggacctggaggcccaggtgaccctggtggagaacctgaggaaatatgtgggggagcaggtgcccagcgaggtgcacagccagacctgggagctggagcggcagaagctgctggacaccatgcagcacctgcaggaggaccgggacagcctgcacgccacagctgagctgctgcaggtgcgggtgcagagcctgacccacatcctggccctgcaggaggaggagctgaccaggaaggtgcagcccagcgacagcctggagcctgagttcaccaggaagtgccagagcctgctgaaccgctggagggagaaggtgtttgccctgatggtgcagctgaaggcccaggagctggagcacagcgacagcgtgaagcagctgaagggccaggtggccagcctgcaggagaaggtgaccagccagagccaggagcaggccatcctgcagaggagcctgcaggacaaggctgctgaggtggaggtggagaggatgggcgccaagggcctgcagctggagctgagccgggcccaggaggcccggcggcgctggcagcagcagacagccagcgctgaggagcagctgcggctggtggtgaatgctgtgagcagctgccccctgcccccacctgtgacagatgtgtccctggagctgcagcagctgcgggaggagaggaaccggctggatgctgagctgcagctgagcgcccggctcatccagcaggaggtgggccgggcccgggagcagggcgaggccgagcggcagcagctgagcaaggtggcccagcagctggagcaggagctgcagcagacccaggagagcctggccagcctgggcctgcagctggaggtggcccggcagggccagcaggagagcacagaggaggccgccagcctgcggcaggagctgacccagcagcaggagctgtatggccaggccctgcaggagaaggtggccgaggtggagacccggctgcgggagcagctgagtgacacagagcggcggctgaatgaggcccggcgggagcacgccaaggctgtggtgtccctgcggcagatccagaggagagctgcccaggagaaggagaggagccaggagctgcggcggctgcaggaggaggccaggaaggaggagggccagaggctggcccggcggctgcaggagctggagcgggacaagaacctgatgctggccaccctgcagcaggagggcctgctgagccgctacaagcagcagaggctgctgactgtgctgcccagcctgctggacaagaagaagtctgtggtgagcagcccccggcccccagagtgcagcgccagcgcccctgtggccgctgctgtgcccacccgggagagcatcaagggcagcctgtctgtgctgctggatgacctgcaggacctgtctgaggccatcagcaaggaggaggccgtgtgccagggcgacaacctggaccgctgcagcagcagcaacccccagatgagcagctag

SEQ ID NO: 3163 - DNA, 951 bp, Artificial Sequence
  Description of Artificial Sequence: Synthetic coding sequence
atgtttcctccttctggccaccaggatgtgtctgaaagaaggctggacacccagaggccccaggtgaccatgtgggagagagatgtgtccagtgaccggcaggagcccggccggcggggccgctcctggggcctggagggcagccaggccctgagccagcaggccgaggtgattgtgcggcagctgcaggagctgcggcggctggaggaggaggtgcggctgctgcgggagaccagcctgcagcagaagatgaggctggaggcccaggccatggagctggaggccctggcccgggcagagaaggccggccgggcagaggccgagggcctgcgggccgccctggccggggctgaggtggtgaggaagaacctggaggagggcagccagcgggagctggaggaggtgcagaggctgcaccaggagcagctgagcagcctgacccaggcccacgaggaggccctgagcagcctgaccagcaaggccgagggcctggagaagagcctgagcagcctggagacccggcgggccggggaggccaaggagctggccgaggcccagcgggaggccgagctgctgaggaagcagctgagcaagacccaggaggacctggaggcccaggtgaccctggtggagaacctgaggaaatatgtgggggagcaggtgcccagcgaggtgcacagccagacctgggagctggagcggcagaagctgctggagaccatgcagcacctgcaggaggaccgggacagcctgcacgccacagctgagctgctgcaggtgcgggtgcagagcctgacccacatcctggccctgcaggaggaggagctgaccaggaaggtgcagcccagcgacagcctggagcctgagttcaccaggaagtgccagagcctgctgaaccgctggagggagaaggtgtttgccctgatggtgcagctgaaggcccaggagtag

SEQ ID NO: 3164 - DNA, 771 bp, Artificial Sequence; identical to SEQ ID NO: 3151
  Description of Artificial Sequence: Synthetic coding sequence

SEQ ID NO: 3165 - DNA, 357 bp, Artificial Sequence; identical to SEQ ID NO: 3160
  Description of Artificial Sequence: Synthetic coding sequence

SEQ ID NO: 3166 - DNA, 2349 bp, Artificial Sequence; identical to SEQ ID NO: 3147
  Description of Artificial Sequence: Synthetic coding sequence

SEQ ID NO: 3167 - DNA, 384 bp, Artificial Sequence; identical to SEQ ID NO: 3148
  Description of Artificial Sequence: Synthetic coding sequence

SEQ ID NO: 3168 - DNA, 462 bp, Artificial Sequence
  Description of Artificial Sequence: Synthetic coding sequence
atgtttcctccttctggcagcacaggcctcatcccccccagccacttccaggcccggcccctgagcaccctgcccaggatggcccccacctggctgagtgacatccccctggtgcagcccccaggccaccaggatgtgtctgaaagaaggctggacacccagaggccccaggtgaccatgtgggagagagatgtgtccagtgaccggcaggagcccggccggcggggccgctcctggggcctggagggcagccaggccctgagccagcaggccgaggtgattgtgcggcagctgcaggagctgcgctggctggaggaggaggtgtggctgctgcgggagaccagcctgcagcagaagatgaggctggaggcccaggccatggagctggaggccctggcccgggcagagaaggccggccgggcagaggccgagggcctgcgggccgccctggccggggcctag

SEQ ID NO: 3169 - DNA, 384 bp, Artificial Sequence; identical to SEQ ID NO: 3148
  Description of Artificial Sequence: Synthetic coding sequence

SEQ ID NO: 3170 - DNA, 567 bp, Artificial Sequence
  Description of Artificial Sequence: Synthetic coding sequence
atgtttcctccttctggcagcacaggcctcatcccccccagccacttccaggcccggcccctgagcaccctgcccaggatggcccccacctggctgagtgacatccccctggtgcagcccccaggccaccaggatgtgtctgaaagaaggctggacacccagaggccccaggtgaccatgtgggagagagatgtgtccagtgaccggcaggagcccggccggcggggccgctcctggggcctggagggcagccaggccctgagccagcaggccgaggtgattgtgcggcagctgcaggagctgcggcggctggaggaggaggtgcggctgctgcgggagaccagcctgcagcagaagatgaggctggaggcccaggccatggagctggaggccctggcccgggcagagaaggccggccgggcagaggccgagggcctgcgggccgccctggccggggctgaggtggtgaggaagaacctggaggagggccggcagcgggagctggaggaggtgcagaggctgcaccaggagcagctgagcagcctgacccaggcccacgaggagtag

SEQ ID NO: 3171 - DNA, 567 bp, Artificial Sequence
  Description of Artificial Sequence: Synthetic coding sequence
atgtttcctccttctggcagcacaggcctcatcccccccagccacttccaggcccggcccctgagcaccctgcccaggatggcccccacctggctgagtgacatccccctggtgcagcccccaggccaccaggatgtgtctgaaagaaggctggacacccagaggccccaggtgaccatgtgggagagagatgtgtccagtgaccggcaggagcccggccggcggggccgctcctggggcctggagggcagccaggccctgagccagcaggccgaggtgattgtgcggcagctgcaggagctgcgctggctggaggaggaggtgtggctgctgcgggagaccagcctgcagcagaagatgaggctggaggcccaggccatggagctggaggccctggcccgggcagagaaggccggccgggcagaggccgagggcctgcgggccgccctggccggggctgaggtggtgaggaagaacctggaggagggccggcagcgggagctggaggaggtgcagaggctgcaccaggagcagctgagcagcctgacccaggcccacgaggagtag

SEQ ID NO: 3172 - DNA, 951 bp, Artificial Sequence
  Description of Artificial Sequence: Synthetic coding sequence
atgtttcctccttctggccaccaggatgtgtctgaaagaaggctggacacccagaggccccaggtgaccatgtgggagagagatgtgtccagtgaccggcaggagcccggccggcggggccgctcctggggcctggagggcagccaggccctgagccagcaggccgaggtgattgtgcggcagctgcaggagctgcggcggctggaggaggaggtgcggctgctgcgggagaccagcctgcagcagaagatgaggctggaggcccaggccatggagctggaggccctggcccgggcagagaaggccggccgggcagaggccgagggcctgcgggccgccctggccggggctgaggtggtgaggaagaacctggaggagggccggcagcgggagctggaggaggtgcagaggctgcaccaggagcagctgagcagcctgacccaggcccacgaggaggccctgagcagcctgaccagcaaggccgagggcctggagaagagcctgagcagcctggagacccggcgggccggggaggccaaggagctggccgaggcccagcgggaggccgagctgctgaggaagcagctgagcaagacccaggaggacctggaggcccaggtgaccctggtggagaacctgaggaaatatgtgggggagcaggtgcccagcgaggtgcacagccagacctgggagctggagcggcagaagctgctggacaccatgcagcacctgcaggaggaccgggacagcctgcacgccacagctgagctgctgcaggtgcgggtgcagagcctgacccacatcctggccctgcaggaggaggagctgaccaggaaggtgcagcccagcgacagcctggagcctgagttcaccaggaagtgccagagcctgctgaaccgctggagggagaaggtgtttgccctgatggtgcagctgaaggcccaggagtag

SEQ ID NO: 3173 - DNA, 567 bp, Artificial Sequence
  Description of Artificial Sequence: Synthetic coding sequence
atgtttcctccttctggcagcacaggcctcatcccccccagccacttccaggcccggcccctgagcaccctgcccaggatggcccccacctggctgagtgacatccccctggtgcagcccccaggccaccaggatgtgtctgaaagaaggctggacacccagaggccccaggtgaccatgtgggagagagatgtgtccagtgaccggcaggagcccggccggcggggccgctcctggggcctggagggcagccaggccctgagccagcaggccgaggtgattgtgcggcagctgcaggagctgcggcggctggaggaggaggtgcggctgctgcgggagaccagcctgcagcagaagatgaggctggaggcccaggccatggagctggaggccctggcccgggcagagaaggccggccgggcagaggccgagggcctgcgggccgccctggccggggctgaggtggtgaggaagaacctggaggagggcagccagcgggagctggaggaggtgcagaggctgcaccaggagcagctgagcagcctgacccaggcccacgaggagtag

SEQ ID NO: 3174 - DNA, 2307 bp, Artificial Sequence
  Description of Artificial Sequence: Synthetic coding sequence
atgtttcctccttctggcagcacaggcctcatcccccccagccacttccaggcccggcccctgagcaccctgcccaggatggcccccacctggctgagtgacatccccctggtgcagcccccaggccaccaggatgtgtctgaaagaaggctggacacccagaggccccaggtgaccatgtgggagagagatgtgtccagtgaccggcaggagcccggccggcggggccgctcctggggcctggagggcagccaggccctgagccagcaggccgaggtgattgtgcggcagctgcaggagctgcggcggctggaggaggaggtgcggctgctgcgggagaccagcctgcagcagaagatgaggctggaggcccaggccatggagctggaggccctggcccgggcagagaaggccggccgggcagaggccgagggcctgcgggccgccctggccggggctgaggtggtgaggaagaacctggaggagggcagccagcgggagctggaggaggtgcagaggctgcaccaggagcagctgagcagcctgacccaggcccacgaggaggccctgagcagcctgaccagcaaggccgagggcctggagaagagcctgagcagcctggagacccggcgggccggggaggccaaggagctggccgaggcccagcgggaggccgagctgctgaggaagcagctgagcaagacccaggaggacctggaggcccaggtgaccctggtggagaacctgaggaaatatgtgggggagcaggtgcccagcgaggtgcacagccagacctgggagctggagcggcagaagctgctggagaccatgcagcacctgcaggaggaccgggacagcctgcacgccacagctgagctgctgcaggtgcgggtgcagagcctgacccacatcctggccctgcaggaggaggagctgaccaggaaggtgcagcccagcgacagcctggagcctgagttcaccaggaagtgccagagcctgctgaaccgctggagggagaaggtgtttgccctgatggtgcagctgaaggcccaggagctggagcacagcgacagcgtgaagcagctgaagggccaggtggccagcctgcaggagaaggtgaccagccagagccaggagcaggccatcctgcagaggagcctgcaggacaaggctgctgaggtggaggtggagaggatgggcgccaagggcctgcagctggagctgagccgggcccaggaggcccggcggcgctggcagcagcagacagccagcgctgaggagcagctgcggctggtggtgaatgctgtgagcagcagccagatctggctggagaccaccatggccaaggtggagggcgccgccgcccagctgcccagcctgaacaaccggctgtcctatgctgtgaggaaggtgcacaccatccggggcctcatcgccaggaagctggccctggcccagctgcggcaggagagctgccccctgcccccacctgtgacagatgtgtccctggagctgcagcagctgcgggaggagaggaaccggctggatgctgagctgcagctgagcgcccggctcatccagcaggaggtgggccgggcccgggagcagggcgaggccgagcggcagcagctgagcaaggtggcccagcagctggagcaggagctgcagcagacccaggagagcctggccagcctgggcctgcagctggaggtggcccggcagggccagcaggagagcacagaggaggccgccagcctgcggcaggagctgacccagcagcaggagctgtatggccaggccctgcaggagaaggtggccgaggtggagacccggctgcgggagcagctgagtgacacagaaagaaggctgaatgaggcccggcgggagcacgccaaggctgtggtgtccctgcggcagatccagaggcgggccgcccaggagaaggagaggagccaggagctgcggcggctgcaggaggaggccaggaaggaggagggccagaggctggcccggcggctgcaggagctggagcgggacaagaacctgatgctgcagaggctgctgactgtgctgcccagcctgctggacaagaagaagtctgtggtgagcagcccccggcccccagaatgttctgccagcgcccctgtggccgctgctgtgcccacccgggagagcatcaagggcagcctgtctgtgctgctggatgacctgcaggacctgtctgaggccatcagcaaggaggaggccgtgtgccagggcgacaacctggaccgctgcagcagcagcaacccccagatgagcagctag

SEQ ID NO: 3175 - DNA, 951 bp, Artificial Sequence
  Description of Artificial Sequence: Synthetic coding sequence
atgtttcctccttctggccaccaggatgtgtctgaaagaaggctggacacccagaggccccaggtgaccatgtgggagagagatgtgtccagtgaccggcaggagcccggccggcggggccgctcctggggcctggagggcagccaggccctgagccagcaggccgaggtgattgtgcggcagctgcaggagctgcgctggctggaggaggaggtgtggctgctgcgggagaccagcctgcagcagaagatgaggctggaggcccaggccatggagctggaggccctggcccgggcagagaaggccggccgggcagaggccgagggcctgcgggccgccctggccggggctgaggtggtgaggaagaacctggaggagggccggcagcgggagctggaggaggtgcagaggctgcaccaggagcagctgagcagcctgacccaggcccacgaggaggccctgagcagcctgaccagcaaggccgagggcctggagaagagcctgagcagcctggagacccggcgggccggggaggccaaggagctggccgaggcccagcgggaggccgagctgctgaggaagcagctgagcaagacccaggaggacctggaggcccaggtgaccctggtggagaacctgaggaaatatgtgggggagcaggtgcccagcgaggtgcacagccagacctgggagctggagcggcagaagctgctggagaccatgcagcacctgcaggaggaccgggacagcctgcacgccacagctgagctgctgcaggtgcgggtgcagagcctgacccacatcctggccctgcaggaggaggagctgaccaggaaggtgcagcccagcgacagcctggagcctgagttcaccaggaagtgccagagcctgctgaaccgctggagggagaaggtgtttgccctgatggtgcagctgaaggcccaggagtag

SEQ ID NO: 3176 - DNA, 357 bp, Artificial Sequence
  Description of Artificial Sequence: Synthetic coding sequence
atgtttcctccttctggcagcacaggcctcatcccccccagccacttccaggcccggcccctgagcaccctgcccaggatggcccccacctggctgagtgacatccccctggtgcagcccccaggccaccaggatgtgtctgaaagaaggctggacacccagaggccccaggtgaccatgtgggagagagatgtgtccagtgaccggcaggagcccggccggcggggccgctcctggggcctggagggcagccaggccctgagccagcaggccgaggtgattgtgcggcagctgcaggagctgcgctggctggaggaggaggtgtggctgctgcgggagaccagcctgcagcagtag

SEQ ID NO: 3177 - DNA, 2349 bp, Artificial Sequence; identical to SEQ ID NO: 3147
  Description of Artificial Sequence: Synthetic coding sequence

SEQ ID NO: 3178 - DNA, 567 bp, Artificial Sequence; identical to SEQ ID NO: 3170
  Description of Artificial Sequence: Synthetic coding sequence

SEQ ID NO: 3179 - DNA, 576 bp, Artificial Sequence
  Description of Artificial Sequence: Synthetic coding sequence
atgtttcctccttctggccaccaggatgtgtctgaaagaaggctggacacccagaggccccaggtgaccatgtgggagagagatgtgtccagtgaccggcaggagcccggccggcggggccgctcctggggcctggagggcagccaggccctgagccagcaggccgaggtgattgtgcggcagctgcaggagctgcggcggctggaggaggaggtgcggctgctgcgggagaccagcctgcagcagaagatgaggctggaggcccaggccatggagctggaggccctggcccgggcagagaaggccggccgggcagaggccgagggcctgcgggccgccctggccggggctgaggtggtgaggaagaacctggaggagggcagccagcgggagctggaggaggtgcagaggctgcaccaggagcagctgagcagcctgacccaggcccacgaggaggccctgagcagcctgaccagcaaggccgagggcctggagaagagcctgagcagcctggagacccggcgggccggggaggccaaggagctggccgaggcccagcgggaggccgagctgtag

SEQ ID NO: 3180 - DNA, 567 bp, Artificial Sequence; identical to SEQ ID NO: 3173
  Description of Artificial Sequence: Synthetic coding sequence

SEQ ID NO: 3181 - DNA, 951 bp, Artificial Sequence; identical to SEQ ID NO: 3175
  Description of Artificial Sequence: Synthetic coding sequence

SEQ ID NO: 3182 - DNA, 516 bp, Artificial Sequence; identical to SEQ ID NO: 3150
  Description of Artificial Sequence: Synthetic coding sequence

SEQ ID NO: 3183 - DNA, 357 bp, Artificial Sequence; identical to SEQ ID NO: 3176
  Description of Artificial Sequence: Synthetic coding sequence

SEQ ID NO: 3184 - DNA, 771 bp, Artificial Sequence; identical to SEQ ID NO: 3154
  Description of Artificial Sequence: Synthetic coding sequence

SEQ ID NO: 3185 - DNA, 2508 bp, Artificial Sequence
  Description of Artificial Sequence: Synthetic coding sequence
atgtggccccacagcgctggggcccggccctgggccagcaccctgaccgggaaggacccccgggtgatggcctgctggtgcctggatggcctgcccagcggcctggccgagccctggagggagctgtggcgctggaggagccggcccctgcactgtgtgccccccttcagccccctggcccggagcagccgggaccacaggaacctgcggcggcggggcaacattgatggctggaggcagaacctggagcccagcaacaacgtggagatgttcccccccagcggccaccaggatgtgtctgagcggcggctggacacccagaggccccaggtgaccatgtgggagagagatgtgtccagtgaccggcaggagcctggaagaagaggccgctcctggggcctggagggcagccaggccctgagccagcaggccgaggtgattgtgcggcagctgcaggagctgcggcggctggaggaggaggtgcggctgctgcgggagaccagcctgcagcagaagatgaggctggaggcccaggccatggagctggaggccctggcccgggcagagaaggccggccgggcagaggccgagggcctgcgggccgccctggccggggctgaggtggtgaggaagaacctggaggagggcagccagcgggagctggaggaggtgcagaggctgcaccaggagcagctgagcagcctgacccaggcccacgaggaggccctgagcagcctgaccagcaaggccgagggcctggagaagagcctgagcagcctggagaccaggagagctggggaggccaaggagctggccgaggcccagcgggaggccgagctgctgaggaagcagctgagcaagacccaggaggacctggaggcccaggtgaccctggtggagaacctgaggaaatatgtgggggagcaggtgcccagcgaggtgcacagccagacctgggagctggagcggcagaagctgctggagaccatgcagcacctgcaggaggaccgggacagcctgcacgccacagctgagctgctgcaggtgcgggtgcagagcctgacccacatcctggccctgcaggaggaggagctgaccaggaaggtgcagcccagcgacagcctggagcctgagttcaccaggaagtgccagagcctgctgaaccgctggagggagaaggtgtttgccctgatggtgcagctgaaggcccaggagctggagcacagcgacagcgtgaagcagctgaagggccaggtggccagcctgcaggagaaggtgaccagccagagccaggagcaggccatcctgcagaggagcctgcaggacaaggctgctgaggtggaggtggagaggatgggcgccaagggcctgcagctggagctgagccgggcccaggaggcccggcggcgctggcagcagcagacagccagcgctgaggagcagctgcggctggtggtgaatgctgtgagcagcagccagatctggctggagaccaccatggccaaggtggagggcgctgctgcccagctgcccagcctgaacaaccggctgtcctatgctgtgaggaaggtgcacaccatccggggcctgattgccaggaagctggccctggcccagctgcggcaggagagctgccccctgcccccacctgtgacagatgtgtccctggagctgcagcagctgcgggaggagaggaaccggctggatgctgagctgcagctgagcgcccggctcatccagcaggaggtgggccgggcccgggagcagggcgaggccgagcggcagcagctgagcaaggtggcccagcagctggagcaggagctgcagcagacccaggagagcctggccagcctgggcctgcagctggaggtggcccggcagggccagcaggagagcacagaggaggccgccagcctgcggcaggagctgacccagcagcaggagctgtatggccaggccctgcaggagaaggtggccgaggtggagacccggctgcgggagcagctgagtgacacagagcggcggctgaatgaggcccggcgggagcacgccaaggctgtggtgtccctgcggcagatccagaggagagctgcccaggagaaggagaggagccaggagctgcggcggctgcaggaggaggccaggaaggaggagggccagaggctggcccggcggctgcaggagctggagcgggacaagaacctgatgctggccaccctgcagcaggagggcctgctgagccgctacaagcagcagaggctgctgactgtgctgcccagcctgctggacaagaagaagtctgtggtgagcagcccccggcccccagagtgcagcgccagcgcccctgtggccgctgctgtgcccacccgggagagcatcaagggcagcctgtctgtgctgctggatgacctgcaggacctgtctgaggccatcagcaaggaggaggccgtgtgccagggcgacaacctggaccgctgcagcagcagcaacccccagatgagcagctag

SEQ ID NO: 3186 - DNA, 2190 bp, Artificial Sequence; identical to SEQ ID NO: 3162
  Description of Artificial Sequence: Synthetic coding sequence

SEQ ID NO: 3187 - DNA, 384 bp, Artificial Sequence; identical to SEQ ID NO: 3148
  Description of Artificial Sequence: Synthetic coding sequence

SEQ ID NO: 3188 - DNA, 462 bp, Artificial Sequence; identical to SEQ ID NO: 3156
  Description of Artificial Sequence: Synthetic coding sequence

SEQ ID NO: 3189 - DNA, 567 bp, Artificial Sequence; identical to SEQ ID NO: 3171
  Description of Artificial Sequence: Synthetic coding sequence

SEQ ID NO: 3190 - DNA, 462 bp, Artificial Sequence; identical to SEQ ID NO: 3156
  Description of Artificial Sequence: Synthetic coding sequence

SEQ ID NO: 3191 - DNA, 462 bp, Artificial Sequence; identical to SEQ ID NO: 3168
  Description of Artificial Sequence: Synthetic coding sequence

SEQ ID NO: 3192 - DNA, 951 bp, Artificial Sequence; identical to SEQ ID NO: 3172
  Description of Artificial Sequence: Synthetic coding sequence

SEQ ID NO: 3193 - DNA, 651 bp, Artificial Sequence; identical to SEQ ID NO: 3159
  Description of Artificial Sequence: Synthetic coding sequence

SEQ ID NO: 3194 - DNA, 516 bp, Artificial Sequence; identical to SEQ ID NO: 3143
  Description of Artificial Sequence: Synthetic coding sequence

SEQ ID NO: 3195 - DNA, 357 bp, Artificial Sequence; identical to SEQ ID NO: 3160
  Description of Artificial Sequence: Synthetic coding sequence

SEQ ID NO: 3196 - DNA, 423 bp, Artificial Sequence
  Description of Artificial Sequence: Synthetic coding sequence
atgtttcctccttctggcagcacaggcctcatcccccccagccacttccaggcccggcccctgagcaccctgcccaggatggcccccacctggctgagtgacatccccctggtgcagcccccaggccaccaggatgtgtctgaaagaaggctggacacccagaggccccaggtgaccatgtgggagagagatgtgtccagtgaccggcaggagcccggccggcggggccgctcctggggcctggagggcagccaggccctgagccagcaggccgaggtgattgtgcggcagctgcaggagctgcggcggctggaggaggaggtgcggctgctgcgggagaccagcctgcagcagaagatgaggctggaggcccaggccatggagctggaggccctggcccgggcagagaaggccggccgctag

SEQ ID NO: 3197 - DNA, 111 bp, Artificial Sequence
  Description of Artificial Sequence: Synthetic coding sequence
atgtttcctccttctggcagcacaggcctcatcccccccagccacttccaggcccggcccctgagcaccctgcccaggatggcccccacctggctgagtgacatcccctag

SEQ ID NO: 3198 - DNA, 291 bp, Artificial Sequence
  Description of Artificial Sequence: Synthetic coding sequence
atgtttcctccttctggcagcacaggcctcatcccccccagccacttccaggcccggcccctgagcaccctgcccaggatggcccccacctggctgagtgacatccccctggtgcagcccccaggccaccaggatgtgtctgaaagaaggctggacacccagaggccccaggtgaccatgtgggagagagatgtgtccagtgaccggcaggagcccggccggcggggccgctcctggggcctggagggcagccaggccctgagccagcaggccgaggtgattgtgaggtag

SEQ ID NO: 3199 - DNA, 477 bp, Artificial Sequence
  Description of Artificial Sequence: Synthetic coding sequence
atgtttcctccttctggcagcacaggcctcatcccccccagccacttccaggcccggcccctgagcaccctgcccaggatggcccccacctggctgagtgacatccccctggtgcagcccccaggccaccaggatgtgtctgaaagaaggctggacacccagaggccccaggtgaccatgtgggagagagatgtgtccagtgaccggcaggagcccggccggcggggccgctcctggggcctggagggcagccaggccctgagccagcaggccgaggtgattgtgcggcagctgcaggagctgcggcggctggaggaggaggtgcggctgctgcgggagaccagcctgcagcagaagatgaggctggaggcccaggccatggagctggaggccctggcccgggcagagaaggccggccgggcagaggccgagggcctgcgggccgccctggccggggctgaggtggtgaggaagtag

SEQ ID NO: 3200 - DNA, 351 bp, Artificial Sequence
  Description of Artificial Sequence: Synthetic coding sequence
atgtttcctccttctggcagcacaggcctcatcccccccagccacttccaggcccggcccctgagcaccctgcccaggatggcccccacctggctgagtgacatccccctggtgcagcccccaggccaccaggatgtgtctgaaagaaggctggacacccagaggccccaggtgaccatgtgggagagagatgtgtccagtgaccggcaggagcccggccggcggggccgctcctggggcctggagggcagccaggccctgagccagcaggccgaggtgattgtgcggcagctgcaggagctgcggcggctggaggaggaggtgcggctgctgcgggagaccagcctgtag

SEQ ID NO: 3201 - DNA, 126 bp, Artificial Sequence
  Description of Artificial Sequence: Synthetic coding sequence
atgtttcctccttctggcagcacaggcctcatcccccccagccacttccaggcccggcccctgagcaccctgcccaggatggcccccacctggctgagtgacatccccctggtgcagcccccatag

SEQ ID NO: 3202 - DNA, 480 bp, Artificial Sequence
  Description of Artificial Sequence: Synthetic coding sequence
atgtttcctccttctggccaccaggatgtgtctgaaagaaggctggacacccagaggccccaggtgaccatgtgggagagagatgtgtccagtgaccggcaggagcccggccggcggggccgctcctggggcctggagggcagccaggccctgagccagcaggccgaggtgattgtgcggcagctgcaggagctgcggcggctggaggaggaggtgcggctgctgcgggagaccagcctgcagcagaagatgaggctggaggcccaggccatggagctggaggccctggcccgggcagagaaggccggccgggcagaggccgagggcctgcgggccgccctggccggggctgaggtggtgaggaagaacctggaggagggcagccagcgggagctggaggaggtgcagaggctgcaccaggagcagctgagcagcctgacccaggcccacgaggaggccctgagcagcctgaccagctag

SEQ ID NO: 3203 - DNA, 423 bp, Artificial Sequence
  Description of Artificial Sequence: Synthetic coding sequence
atggcccccacctggctgagtgacatccccctggtgcagcccccaggccaccaggatgtgtctgaaagaaggctggacacccagaggccccaggtgaccatgtgggagagagatgtgtccagtgaccggcaggagcccggccggcggggccgctcctggggcctggagggcagccaggccctgagccagcaggccgaggtgattgtgcggcagctgcaggagctgcggcggctggaggaggaggtgcggctgctgcgggagaccagcctgcagcagaagatgaggctggaggcccaggccatggagctggaggccctggcccgggcagagaaggccggccgggcagaggccgagggcctgcgggccgccctggccggggctgaggtggtgaggaagaacctggaggagggcagccagaggtag

SEQ ID NO: 3204 - DNA, 480 bp, Artificial Sequence
  Description of Artificial Sequence: Synthetic coding sequence
atgtttcctccttctggcagcacaggcctcatcccccccagccacttccaggcccggcccctgagcaccctgcccaggatggcccccacctggctgagtgacatccccctggtgcagcccccaggccaccaggatgtgtctgaaagaaggctggacacccagaggccccaggtgaccatgtgggagagagatgtgtccagtgaccggcaggagcccggccggcggggccgctcctggggcctggagggcagccaggccctgagccagcaggccgaggtgattgtgcggcagctgcaggagctgcggcggctggaggaggaggtgcggctgctgcgggagaccagcctgcagcagaagatgaggctggaggcccaggccatggagctggaggccctggcccgggcagagaaggccggccgggcagaggccgagggcctgcgggccgccctggccggggctgaggtggtgaggaagaactag

SEQ ID NO: 3205 - DNA, 3714 bp, Artificial Sequence
  Description of Artificial Sequence: Synthetic coding sequence
atgaggaagcaccgccacctgcccctggtggccgtgttctgcctcttcctgagcggcttccccaccacccacgcccagcagcagcaggccgcccaggacagcgctgacatcatcttcctgattgatggcagcaacaacacaggctctgtgaactttgctgtgatcctggacttcctggtgaacctgctggagaagctgcccatcggcacccagcagatccgggtgggcgtggtgcagttcagtgatgagcccaggaccatgttcagcctggacacctacagcaccaaggcccaggtgctgggcgctgtgaaggccctgggctttgctggaggagagctggccaacatcggcctggccctggactttgtggtggagaaccacttcaccagggctgggggcagccgggtggaggagggcgtgccccaggtgctggtgctgatctctgctggccccagcagtgatgagatccgctatggagtggtggccctgaagcaggcctctgtgttctcctttggcctgggcgcccaggccgccagcagagctgagctgcagcacatcgccacagatgacaacctggtgttcaccgtgcctgagttccgcagctttggagacctgcaggagaagctgctgccctacatcgtgggcgtggcccagaggcacatcgtgctgaagccacccaccatcgtgacccaggtgattgaggtgaacaagagggacatcgtgttcctggtggatggcagcagcgccctgggcctggccaacttcaatgccatccgggacttcatcgccaaggtgatccagaggctggagatcggccaggacctgatccaggtggccgtggcccagtatgctgacacagtgcggcctgagttctacttcaacacccaccccaccaagcgggaggtgatcacagctgtgaggaagatgaagcccctggatggcagcgccctgtacacaggcagcgccctggactttgtgaggaacaacctcttcaccagcagcgctggctacagagctgctgagggcatccccaagctgctggtgctgatcactggaggcaagagcctggatgagatcagccagcctgcccaggagctgaagaggagcagcatcatggcctttgccatcggcaacaagggagctgaccaggccgagctggaggagatcgcctttgacagcagcctggtgttcatcccagctgagttccgggccgcccccctgcagggcatgctgcccggcctgctggcccccctgcggaccctgagcggcaccccagaggtgcacagcaacaagagggacatcatcttcctgctggatggcagcgccaacgtgggcaagaccaacttcccctacgtgcgggactttgtgatgaacctggtgaacagcctggacattggaaatgacaacatccgggtgggcctggtgcagttcagtgacacccctgtgacagagttcagcctgaacacctaccagaccaagagtgacatcctgggccacctgcggcagctgcagctgcagggcggcagcggcctgaacacaggcagcgccctgtcctatgtgtatgccaaccacttcacagaggccggcggcagccgcatccgggagcacgtgccccagctgctgctgctgctgacagctggccagagcgaggacagctacctgcaggccgccaatgccctgaccagggctggcatcctgaccttctgtgtgggcgccagccaggccaacaaggccgagctggagcagatcgccttcaaccccagcctggtgtacctgatggatgacttcagcagcctgcctgccctgccccagcagctgatccagcccctgaccacctacgtgtctggaggagtggaggaggtgcccctggcccagcctgagagcaagagggacatcctcttcctgtttgatggcagcgccaacctggtgggccagtttcctgtggtgcgggacttcctgtacaagatcattgatgagctgaatgtgaagccagagggcaccagaattgctgtggcccagtacagtgatgatgtgaaggtggagagcagatttgatgagcaccagagcaagccagagatcctgaacctggtgaagaggatgaagatcaagacaggcaaggccctgaacctgggctacgccctggactatgcccagcgctacatctttgtgaagtctgctggcagcagaattgaagatggagtgctgcagttcctggtgctgctggtggccggccgcagcagtgacagagtggatggccctgccagcaacctgaagcagagcggcgtggtgcccttcatcttccaggccaagaatgctgaccctgctgagctggagcagatcgtgctgagccctgccttcatcctggccgctgagagcctgcccaagatcggggacctgcacccccagatcgtgaacctgctgaagtctgtgcacaacggggccccagcccctgtgtctggagagaaggatgtggtgttcctgctggatggcagcgagggcgtgcgcagcggcttccccctgctgaaggagtttgtgcagagggtggtggagagcctggatgtgggccaggacagagtgcgggtggccgtggtgcagtacagcgacaggaccaggcctgagttctacctgaacagctacatgaacaagcaggatgtggtgaatgctgtgcggcagctgaccctgctgggcggccccacccccaacacaggagctgccctggagtttgtgctgaggaacatcctggtgtcctctgctggcagccgcatcacagaaggagtgccccagctgctgattgtgctgacagctgacagaagtggagatgatgtgaggaaccccagcgtggtggtgaagaggggcggcgctgtgcccatcggcattggaattggaaatgctgacatcacagagatgcagaccatctccttcatcccagactttgctgtggccatccccaccttccggcagctgggcaccgtgcagcaggtgatcagcgagcgggtgacccagctgacccgggaggagctgagccggctgcagcctgtgctgcagcccctgcccagccctggggtgggcggcaagagagatgtggtgttcctgattgatggcagccagagcgctggccctgagttccagtatgtgaggaccctgattgagcggctggtggactacctggatgtgggctttgacaccaccagggtggccgtcatccagttcagtgatgaccccaaggtggagttcctgctgaatgcccacagcagcaaggatgaggtgcagaatgctgtgcagaggctgcggcccaagggcggccggcagatcaacgtgggcaatgccctggagtatgtgtccaggaacatcttcaagaggcccctgggcagccgcatcgaggagggcgtgccccagttcctggtgctgatcagcagcggcaagagtgatgatgaggtggatgatcctgctgtggagctgaagcagtttggagtggcccccttcaccatcgccagaaatgctgaccaggaggagctggtgaagatcagcctgagcccagaatatgtgttttctgtgtccaccttccgggagctgcccagcctggagcagaagctgctgacccccatcaccaccctgaccagcgagcagatccagaagctgctggccagcacccgctacccacctcctggagagatgggcgccagcgaggtgctgctgggcgccttcagcatctag

SEQ ID NO: 3206 - DNA, 7713 bp, Artificial Sequence
  Description of Artificial Sequence: Synthetic coding sequence
atgaggaagcaccgccacctgcccctggtggccgtgttctgcctcttcctgagcggcttccccaccacccacgcccagcagcagcaggccgtcatcgaggtgaacaagagggacatcgtgttcctggtggatggcagcagcgccctgggcctggccaacttcaatgccatccgggacttcatcgccaaggtgatccagaggctggagatcggccaggacctgatccaggtggccgtggcccagtatgctgacacagtgcggcctgagttctacttcaacacccaccccaccaagcgggaggtgatcacagctgtgaggaagatgaagcccctggatggcagcgccctgtacacaggcagcgccctggactttgtgaggaacaacctcttcaccagcagcgctggctacagagctgctgagggcatccccaagctgctggtgctgatcaccggcggcaagagcctggatgagatcagccagcctgcccaggagctgaagaggagcagcatcatggcctttgccatcggcaacaagggagctgaccaggccgagctggaggagatcgcctttgacagcagcctggtgttcatcccagctgagttccgggccgcccccctgcagggcatgctgcccggcctgctggcccccctgcggaccctgagcggcaccccagaggagagcaagagggacatcctcttcctgtttgatggcagcgccaacctggtgggccagtttcctgtggtgcgggacttcctgtacaagatcattgatgagctgaatgtgaagccagagggcaccagaattgctgtggcccagtacagtgatgatgtgaaggtggagagcagatttgatgagcaccagagcaagccagagatcctgaacctggtgaagaggatgaagatcaagacaggcaaggccctgaacctgggctacgccctggactatgcccagcgctacatctttgtgaagtctgctggcagcagaattgaagatggagtgctgcagttcctggtgctgctggtggccggccgcagcagtgacagagtggatggccctgccagcaacctgaagcagagcggcgtggtgcccttcatcttccaggccaagaatgctgaccctgctgagctggagcagatcgtgctgagccctgccttcatcctggccgctgagagcctgcccaagattggagacctgcacccccagatcgtgaacctgctgaagtctgtgcacaatggagccccagcccctgtgtctggagagaaggatgtggtgttcctgctggatggcagcgagggcgtgcgcagcggcttccccctgctgaaggagtttgtgcagagggtggtggagagcctggatgtgggccaggacagagtgcgggtggccgtggtgcagtacagcgacaggaccaggcctgagttctacctgaacagctacatgaacaagcaggatgtggtgaatgctgtgcggcagctgaccctgctgggcggccccacccccaacacaggagctgccctggagtttgtgctgaggaacatcctggtgagcagcgctggcagccgcatcacagagggcgtgccccagctgctgattgtgctgacagctgacagaagtggagatgatgtgaggaaccccagcgtggtggtgaagagaggaggagctgtgcccatcggcatcggcattggaaatgctgacatcacagagatgcagaccatctccttcatcccagactttgctgtggccatccccaccttccggcagctgggcaccgtgcagcaggtgatcagcgagcgggtgacccagctgacccgggaggagctgagccggctgcagcctgtgctgcagcccctgcccagccctggggtgggcggcaagagagatgtggtgttcctgattgatggcagccagagcgctggccctgagttccagtatgtgaggaccctcatcgagcggctggtggactacctggatgtgggctttgacaccaccagggtggccgtcatccagttcagtgatgaccccaaggtggagttcctgctgaatgcccacagcagcaaggatgaggtgcagaatgctgtgcagaggctgcggcccaagggcggccggcagatcaacgtgggcaatgccctggagtatgtgtccaggaacatcttcaagaggcccctgggcagcagaattgaggagggcgtgccccagttcctggtgctgatcagcagcggcaagagtgatgatgaggtggatgatcctgctgtggagctgaagcagtttggagtggcccccttcaccatcgccagaaatgctgaccaggaggagctggtgaagatcagcctgagcccagaatatgtgttttctgtgtccaccttccgggagctgcccagcctggagcagaagctgctgacccccatcaccaccctgaccagcgagcagatccagaagctgctggccagcacccgctacccacctcctgctgtggagagtgatgctgctgacatcgtgttcctgattgacagcagcgagggcgtgcggccagatggctttgcccacatccgggactttgtgtccagaattgtgcggcggctgaacatcggccccagcaaggtgcgggtgggcgtggtgcagttcagcaatgatgtgtttcctgagttctacctgaagacctaccgcagccaggcccctgtgctggatgccatccggcggctgcggctgcggggcggcagccccctgaacacaggcaaggccctggagtttgtggccaggaacctgtttgtgaagtctgctggcagcagaattgaagatggagtgccccagcacctggtgctggtgctgggcggcaagagccaggatgatgtgtccagatttgcccaggtgatccgcagcagcggcatcgtgtccctgggcgtgggggacagaaatattgacagaacagagctgcagaccatcaccaatgacccccggctggtgttcaccgtgcgggagttccgggagctgcccaacatcgaggagcgcatcatgaacagctttggccccagcgctgccaccccagcccctcctggggtggacaccccaccacccagcaggcctgagaagaagaaggctgacatcgtgttcctgctggatggcagcatcaacttccggcgggacagcttccaggaggtgctgcgctttgtgtctgagatcgtggacacagtgtatgaagatggagacagcatccaggtgggcctggtgcagtacaacagcgaccccacagatgagttcttcctgaaggacttcagcaccaagaggcagatcattgatgccatcaacaaggtggtgtacaagggcggcagacatgccaacaccaaggtgggcctggagcacctgcgggtgaaccactttgtgcctgaggccggcagccggctggaccagagggtgccccagatcgcctttgtgatcaccggcggcaagtctgtggaggatgcccaggatgtgtccctggccctgacccagaggggcgtgaaggtgtttgctgtgggcgtgaggaacatcgacagcgaggaggtgggcaagatcgccagcaacagcgccacagccttccgggtgggcaatgtgcaggagctgtctgagctgtctgagcaggtgctggagaccctgcatgatgccatgcatgagaccctgtgccctggggtgacagatgctgccaaggcctgcaacctggatgtgatcctgggctttgatggcagccgggaccagaatgtgtttgtggcccagaagggctttgagagcaaggtggatgccatcctgaaccgcatcagccagatgcaccgggtgtcctgcagcggcggccgcagccccaccgtgcgggtgtctgtggtggccaacacccccagcggccctgtggaggcctttgattttgatgagtaccagcctgagatgctggagaagttcaggaacatgaggagccagcacccctacgtgctgacagaggacaccctgaaggtgtacctgaacaagttccggcagagcagcccagattctgtgaaggtggtgatccacttcacagatggagcagatggagacctggccgacctgcaccgggccagcgagaacctgcggcaggagggcgtgcgggccctgatcctggtgggcctggagcgggtggtgaacctggagcggctgatgcacctggagtttggccggggcttcatgtatgaccggcccctgcggctgaacctgctggacctggactatgagctggccgagcagctggacaacattgctgagaaggcctgctgcggcgtgccctgcaagtgcagcggccagagaggagaccggggccccatcggcagcatcggccccaagggcatccctggagaagatggctaccggggctacccaggagatgaaggaggccctggagagcggggccccccaggagtgaatggcacccagggcttccagggctgccccggccagaggggcgtgaagggcagccggggcttccctggagagaagggggaggtgggggagatcggcctggatggcctggatggagaagatggagacaagggcctgcccggcagcagcggggagaagggcaaccctggccggcggggggacaagggccccagaggagagaagggggagagaggagatgtgggcatccggggggaccccggcaaccctggccaggacagccaggagcggggccccaagggggagaccggggacctgggccccatgggcgtgcccggcagagatggagtgcctgggggccctggagaaacaggcaagaatggaggctttggaagaagaggccccccaggggccaagggcaacaagggcggccctggccagcccggctttgaaggagagcagggcaccaggggggcccagggccctgctggccctgctggccccccaggcctgattggagagcagggcatcagcggcccccggggcagcggcggggccgccggggcccctggagagcggggccgcacaggccccctgggcaggaaaggagagcccggggagcccggccccaagggcggcatcggcaacagaggccccagaggagaaacaggagatgatggaagagatggagtgggcagcgagggcagaagaggcaagaagggggagcggggcttccctggctacccaggccccaagggcaaccctggagagcccggcctgaatggcaccaccggccccaagggcatccggggcagaagaggcaacagcggccccccaggcatcgtgggccagaagggggaccccggctacccaggccctgctggccccaagggcaacagaggagacagcattgaccagtgtgccctgatccagagcatcaaggacaagtgcccctgctgctacggccccctggagtgccctgtgttccccacagagctggcctttgccctggacaccagcgagggcgtgaaccaggacacctttggaaggatgagagatgtggtgctgagcatcgtgaatgacctgaccatcgccgagagcaactgccccaggggggcccgggtggccgtggtgacctacaacaatgaggtgaccacagagatccgctttgctgacagcaagaggaagtctgtgctgctggacaagatcaagaacctgcaggtggccctgaccagcaagcagcagagcctggagacagccatgagctttgtggccaggaacaccttcaagagggtgagaaatggcttcctgatgaggaaggtggccgtgttcttcagcaacacccccacccgggccagcccccagctgcgggaggccgtgctgaagctgagtgatgctggcatcacccccctcttcctgacccggcaggaggaccggcagctgatcaatgccctgcagatcaacaacacagctgtgggccacgccctggtgctgcctgctggccgggacctgacagacttcctggagaatgtgctgacctgccacgtgtgcctggacatctgcaacatcgaccccagctgtggcttcggctcctggaggcccagcttccgggaccggcgggctgctggcagtgatgtggacatcgacatggccttcatcctggacagcgctgagaccaccaccctcttccagttcaatgagatgaagaagtacatcgcctacctggtgcggcagctggacatgagcccagaccccaaggccagccagcactttgcccgggtggccgtggtgcagcacgcccccagcgagagcgtggacaatgcctccatgcctcctgtgaaggtggagttcagcctgacagattatggcagcaaggagaagctggtggacttcctgagccggggcatgacccagctgcagggcacccgggccctgggcagcgccatcgagtacaccattgaaaatgtgtttgagagcgcccccaacccccgggacctgaagatcgtggtgctgatgctgactggagaggtgcctgagcagcagctggaggaggcccagagggtcatcctgcaggccaagtgcaagggctacttctttgtggtgctgggcattggaaggaaggtgaacatcaaggaggtgtacacctttgccagcgagcccaatgatgtgttcttcaagctggtggacaagagcacagagctgaatgaggagcccctgatgagatttggccgcctgctgcccagctttgtgtccagtgaaaatgccttctacctgagcccagacatcaggaagcagtgtgactggttccagggcgaccagcccaccaagaacctggtgaagtttggccacaagcaggtgaatgtgcccaacaacgtgaccagcagccccaccagcaaccctgtgaccaccaccaagcctgtgaccaccaccaagcctgtgaccaccaccaccaagcctgtgaccaccaccaccaagcctgtgaccatcatcaaccagcccagcgtgaagccagctgctgccaagccagccccagccaagcctgtggccgccaagcctgtggccaccaagatggccaccgtgcggccccctgtggccgtgaagccagccacagctgccaagcctgtggccgccaagccagctgctgtgcggcccccagctgctgctgctgccaagcctgtggccaccaagccagaggtgccccggccccaggccgccaagccagctgccaccaagccagccaccaccaagcccatggtgaagatgagccgggaggtgcaggtgtttgagatcacagaaaattctgccaagctgcactgggagagagctgagcccccaggcccctacttctatgacctgactgtgaccagcgcccatgaccagagcctggtgctgaagcagaacctgactgtgacagacagagtcatcggcggcctgctggccggccagacctaccacgtggccgtggtgtgctacctgcggagccaggtgcgggccacctaccacggcagcttcagcaccaagaagagccagcccccaccaccccagcctgcccggagcgccagcagcagcaccatcaacctgatggtgtccacagagcccctggccctgacagaaacagacatctgcaagctgcccaaggatgagggcacctgccgggacttcatcctgaagtggtactatgaccccaacaccaagagctgtgcccgcttctggtatggaggctgcggcggcaatgaaaacaagtttggcagccagaaggaatgtgagaaggtgtgtgcccctgtgctggccaagccaggagtcatctctgtgatgggcacctag

SEQ ID NO: 3207 - DNA, 1938 bp, Artificial Sequence
  Description of Artificial Sequence: Synthetic coding sequence
atgctgctgaagaagcatgctggaaaaggaggcggccgggagcccaggtctgaggaccccaccccagctgagcagcactgtgcccggaccatgccaccctgtgctgtgctggccgccctgctgtctgtggtggccgtggtgtcctgcctgtacctgggcgtgaagaccaatgacctgcaggccagaattgctgccctggagagcgccaagggggcccccagcatccacctgctgcctgacaccctggaccacctgaagaccatggtgcaggagaaggtggagcggctgctggcccagaagagctatgagcacatggccaagatccgcatcgcccgggaggcccccagcgagtgcaactgcccagctggccccccaggcaagaggggcaagagaggaagaagaggagagagcggccccccaggccagcccggcccccagggccccccaggccccaagggggacaagggggagcagggcgaccagggcccccggggcctgcccggcttccccaccgtggccgccctgcacagcaaccagatcctgactgtgaagggggaccagggccaggccggccccccaggccccccaggccccccaggcccccggggccccccaggggacaccgggaaggatggcccccggggcatgcctggggtgcctggagagcccgggaagccaggagagcagggcctgatgggccccctgggccccccaggccagaagggcagcatcggggcccctggcatccctggcatgaatggccagaagggggagcccggcctgcccggggctgtgggccagaatggcatccctggccccaagggggagcctggagagcagggcgagaagggagatgctggggagaatggccccaagggggacacaggagagaagggggaccccggcagcagcgctgctggcatcaagggggagcccggggagagcggccggcccggccagaagggggagcccggcctgcccggcctgcccggcctgcccggcatcaagggggagcccggcttcatcggcccccagggcgagcccggcctgcccggcctgcccggcaccaagggggagcggggggaggccggccccccaggccgcggggagcggggggagcccggggcccctggccccaagggggacagaggagagaagggggacagcggggcccagggcccccggggccccccaggccagaagggggaccagggcgccacagagatcatcgactacaatggaaacctgcacgaggccctgcagggccccccaggccccccaggcccccagggcctgcagggccccaagggggagcagggcagccctggcatccctggcatggatggagagcagggcctgaagggcagcaaaggagacatgggagaccccggcatgaccggggagaagggcggcatcggcctgcccggcctgcccggggccaacggcatgaagggggagaagggggacagcggcatgcctggcccccagggccccagcatcatcggccccccaggccccccaggcccccacggccccccaggccccatgggcccccacggcctgcccggccccaagggggagcccggcctgaatggagtgaagggcctgaagggggagcccggccagaagggggaccggggccccctgggcctgcccggggccagcggcctggatggcaagccaggcagccggggcacagatggccccatgggcccccacggccctgctggccccaagggggagcggggggagaagggggccatgggagagcccggcccccggggcccctacggcctgcccggcttccctggccccagaggagagaagggggacctgggggagaagggggagaaggtgaccagccccagccagcacgtgccctgcctgatcctgctgctgctgagcgccctgctcttcagcctgtgtgacagcatctag

SEQ ID NO: 3208 - DNA, 1101 bp, Artificial Sequence
  Description of Artificial Sequence: Synthetic coding sequence
atggccgagctgcagcagctgcaggagtttgagatccccaccggccgggaggccctgcggggcaaccacagcgccctgctgcgggtggccgactactgtgaggacaactacgtgcaggccacagacaagaggaaggccctggaggagaccatggccttcaccacccaggccctggcctctgtggcctaccaggtgggcaacctggccggccacaccctgaggatgctggacctgcagggcgccgccctgcggcaggtggaggcccgggtgtccaccctgggccagatggtgaacatgcacatggagaaggtggcccggcgggagatcggcaccctggccaccgtgcagaggctgcccccaggccagaaggtgattgcccctgagaacctgccccccctgaccccctactgccggcggcccctgaactttggctgcctggatgacattggacatggcatcaaggacctgagcacccagctgagcaggacaggcaccctgagcaggaagagcatcaaggccccagccaccccagccagcgccaccctgggccggcccccacgcatccctgagcctgtgcacctgcctgtggtgcctgatggccgcctgtctgctgccagcagcgccttcagcctggccagcgctggcagcgctgagggcgtgggcggggcccccacccccaagggccaggccgcccccccagccccacccctgcccagcagcctggaccccccacctcctcctgctgctgtggaggtgttccagaggcctcccaccctggaggagctgagccccccacctccagatgaggagctgcccctgcccctggacctgcccccacctccacccctggatggagatgagctgggcctgcccccacctcctcctggctttggaccagatgagcccagctgggtgcctgccagctacctggagaaggtggtgaccctgtacccctacaccagccagaaggacaatgagctgtccttcagcgagggcaccgtcatctgtgtgacccggcgctacagtgatggctggtgtgagggcgtgtcctctgagggcaccggcttcttccctggcaactacgtggagcccagctgctag

SEQ ID NO: 3209 - DNA, 4257 bp, Artificial Sequence
  Description of Artificial Sequence: Synthetic coding sequence
atgatccggctgggcgccccccagaccctggtgctgctgaccctgctggtggccgctgtgctgcgctgccagggccaggatgtgcggcagcccggccccaagggccagaagggggagcccggggacatcaaggacatcgtgggccccaagggccccccaggcccccagggccctgctggggagcagggccccaggggggacagaggagacaagggggagaagggggcccctggcccccggggcagagatggagagcccggcaccccaggcaaccctggccccccaggccccccaggccccccaggccccccaggcctgggcggcaactttgctgcccagatggccggcggctttgatgagaaggccggcggggcccagctgggcgtgatgcagggccccatgggccccatgggcccccggggccccccaggccctgctggggcccctggcccccagggcttccagggcaaccctggagagcctggagagcccggggtgtctggccccatgggcccccggggccccccaggccccccaggcaagccaggagatgatggagaggccggcaagccaggcaaggccggggagcggggccccccaggcccccagggcgcccggggcttccctggcaccccaggcctgcccggggtgaagggccaccggggctacccaggcctggatggagccaagggggaggccggggcccctggggtgaagggggagagcggcagccctggagaaaatggcagccctggccccatgggcccccggggcctgcccggggagcggggccgcacaggccctgctggagctgctggggcccggggaaatgatggccagcccggccctgctggccccccaggccctgtgggccctgctgggggccctggcttccctggggcccctggggccaagggggaggccggccccactggagcccggggccctgagggcgcccagggccccagaggagagcccggcaccccaggcagccctggccctgctggggccagcggcaaccctggaacagatggcatccctggggccaagggcagcgctggggcccctggcattgctggggcccctggcttccctggcccccggggccccccaggcccccagggcgccaccggccccctgggccccaagggccagacaggagagcccggcattgctggcttcaagggggagcagggccccaagggggagcccggccctgctggcccccagggcgcccctggccctgctggggaggagggcaagagaggagcccggggggagcccggcggcgtgggccccatcggccccccaggagagcggggggcccctggcaacagaggcttccctggccaggacggcctggccggccccaagggggcccctggagagcggggccccagcggcctggccggccccaagggggccaacggggaccccggccggcctggagagcccggcctgcccggggcccggggcctgaccggccggcctggagatgctggcccccagggcaaggtgggccccagcggggcccctggagaagatggccggcccggccccccaggcccccagggcgcccggggccagcccggggtgatgggcttccctggccccaagggggccaacggggagcccgggaaggccggggagaagggcctgcccggggcccctggcctgcggggcctgcccgggaaggatggagaaacaggagctgctggccccccaggccctgctggccctgctggggagcggggggagcagggcgcccctggccccagcggcttccagggcctgcccggccccccaggccccccaggagagggcggcaagccaggggaccagggcgtgcctggagaggccggggcccctggcctggtgggccccagaggagagcggggcttccctggagagcggggcagccctggggcccagggcctgcagggcccccggggcctgcccggcaccccaggcacagatggccccaagggggccagcggccctgctggccccccaggggcccagggccccccaggcctgcagggcatgcctggagagagaggagctgctggcattgctggccccaagggggacagaggagatgtgggggagaagggccctgagggcgcccctgggaaggatggcggccggggcctgaccggccccatcggccccccaggccctgctggggccaatggagagaagggggaggtgggccccccaggccctgctggcagcgctggggcccggggggcccctggagagcggggggagaccggccccccaggccctgctggctttgctggccccccaggagcagatggccagcccggggccaagggggagcagggcgaggccggccagaagggagatgctggggcccctggcccccagggccccagcggggcccctggcccccagggccccactggagtgacaggccccaagggggcccggggggcccagggccccccaggggccaccggcttccctggagctgctggccgggtgggccccccaggcagcaatggaaatcctggccccccaggccccccaggccccagcggcaaggatggccccaagggggcccggggggacagcggccccccaggccgggccggggagcccggcctgcagggccctgctggccccccaggagagaagggggagcctggagatgatggccccagcggggctgagggccccccaggcccccagggcctggccggccagaggggcatcgtgggcctgcccggccagagaggagagcggggcttccctggcctgcccggccccagcggggagcccgggaagcagggcgcccctggggccagcggggaccggggccccccaggccctgtgggccccccaggcctgactggacctgctggggagcccggccgggagggcagccctggagcagatggccccccaggaagagatggagctgctggggtgaagggggacagaggagagaccggggctgtgggcgcccctggggcccctggccccccaggcagccctggccctgctggccccaccgggaagcagggcgacagaggagaggccggggcccagggccccatgggccccagcggccctgctggggcccggggcatccagggcccccagggccccaggggggacaagggggaggccggggagcctggagagcggggcctgaagggccaccggggcttcaccggcctgcagggcctgcccggccccccaggccccagcggggaccagggcgccagcggccctgctggccccagcggcccccggggccccccaggccctgtgggccccagcggcaaggatggagccaacggcatccctggccccatcggccccccaggcccccggggccgcagcggggagactggacctgctggccccccaggcaaccctggccccccaggccccccaggccccccaggccctggcatcgacatgtctgcctttgctggcctgggcccccgggagaagggccctgaccccctgcagtacatgagagctgaccaggccgccggcggcctgcggcagcatgatgctgaggtggatgccaccctgaagagcctgaacaaccagatcgagagcatccgcagccctgagggcagcaggaagaacccagcccggacctgccgggacctgaagctgtgccaccctgagtggaagagcggggactactggattgaccccaaccagggctgcaccctggatgccatgaaggtgttctgcaacatggagaccggggagacctgtgtgtaccccaacccagccaacgtgcccaagaagaactggtggagcagcaagagcaaggagaagaagcacatctggtttggagagaccatcaatggaggcttccacttctcctatggagatgacaacctggcccccaacacagccaacgtgcagatgaccttcctgcggctgctgagcacagagggcagccagaacatcacctaccactgcaagaacagcatcgcctacctggatgaggccgccggcaacctgaagaaggccctgctgatccagggcagcaatgatgtggagatccgggcagagggcaacagccgcttcacctacacagccctgaaggatggctgcaccaagcacacaggcaagtggggcaagacagtgattgagtaccgcagccagaagaccagccggctgcccatcatcgacatcgcccccatggacattggaggccctgagcaggagtttggagtggacatcggccctgtgtgcttcctgtag

SEQ ID NO: 3210 - DNA, 4464 bp, Artificial Sequence
  Description of Artificial Sequence: Synthetic coding sequence
atgatccggctgggcgccccccagaccctggtgctgctgaccctgctggtggccgctgtgctgcgctgccagggccaggatgtgcaggaggccggcagctgtgtgcaggacggccagcgctacaatgacaaggatgtgtggaagccagagccctgccgcatctgtgtgtgtgacacaggaacagtgctgtgtgatgacatcatctgtgaagatgtgaaggactgcctgagccctgagatcccctttggagagtgctgccccatctgccccacagacctggccacagccagcggccagcccggccccaagggccagaagggggagcccggggacatcaaggacatcgtgggccccaagggccccccaggcccccagggccctgctggggagcagggccccaggggggacagaggagacaagggggagaagggggcccctggcccccggggcagagatggagagcccggcaccccaggcaaccctggccccccaggccccccaggccccccaggccccccaggcctgggcggcaactttgctgcccagatggccggcggctttgatgagaaggccggcggggcccagctgggcgtgatgcagggccccatgggccccatgggcccccggggccccccaggccctgctggggcccctggcccccagggcttccagggcaaccctggagagcccggggagcccggggtgtctggccccatgggcccccggggccccccaggccccccaggcaagccaggagatgatggagaggccggcaagccaggcaaggccggggagcggggccccccaggcccccagggcgcccggggcttccctggcaccccaggcctgcccggggtgaagggccaccggggctacccaggcctggatggagccaagggggaggccggggcccctggggtgaagggggagagcggcagccctggagaaaatggcagccctggccccatgggcccccggggcctgcctggagagcggggccgcactggacctgctggagctgctggggcccggggaaatgatggccagcccggccctgctggccccccaggccctgtgggccctgctgggggccctggcttccctggggcccctggggccaagggggaggccggccccaccggggcccggggccctgagggcgcccagggccccagaggagagcccggcaccccaggcagccctggccctgctggggccagcggcaaccctggaacagatggcatccctggggccaagggcagcgctggggcccctggcattgctggggcccctggcttccctggcccccggggccccccaggcccccagggcgccaccggccccctgggccccaagggccagacaggagagcccggcattgctggcttcaagggggagcagggccccaagggggagcccggccctgctggcccccagggcgcccctggccctgctggggaggagggcaagagaggagcccggggggagcctggaggagtgggccccatcggccccccaggagagcggggggcccctggcaacagaggcttccctggccaggacggcctggccggccccaagggggcccctggagagcggggccccagcggcctggccggccccaagggggccaatggagaccccggccggcctggagagcccggcctgcccggggcccggggcctgaccggccggcctggagatgctggcccccagggcaaggtgggccccagcggggcccctggagaagatggccggcccggccccccaggcccccagggcgcccggggccagcccggggtgatgggcttccctggccccaagggggccaatggagagcccgggaaggccggggagaagggcctgcccggggcccctggcctgcggggcctgcccgggaaggatggagagaccggggctgctggccccccaggccctgctggccctgctggggagcggggggagcagggcgcccctggccccagcggcttccagggcctgcccggccccccaggccccccaggagagggcggcaagccaggggaccagggcgtgcctggagaggccggggcccctggcctggtgggccccagaggagagcggggcttccctggagagcggggcagccctggggcccagggcctgcagggcccccggggcctgcccggcaccccaggcacagatggccccaagggggccagcggccctgctggccccccaggggcccagggccccccaggcctgcagggcatgcctggagagagaggagctgctggcattgctggccccaagggggacagaggagatgtgggggagaagggccctgagggcgcccctgggaaggatggcggccggggcctgaccggccccatcggccccccaggccctgctggggccaacggggagaagggggaggtgggccccccaggccctgctggcagcgctggggcccggggggcccctggagagcggggggagactggacctcctggccctgctggctttgctggccccccaggagcagatggccagcccggggccaagggggagcagggcgaggccggccagaagggagatgctggggcccctggcccccagggccccagcggggcccctggcccccagggccccaccggggtgacaggccccaagggggcccggggggcccagggccccccaggggccaccggcttccctggagctgctggccgggtgggccccccaggcagcaatggaaatcctggccccccaggccccccaggccccagcggcaaggatggccccaagggggcccggggggacagcggccccccaggccgggccggggagcccggcctgcagggccctgctggccccccaggagagaagggggagcctggagatgatggccccagcggggctgagggccccccaggcccccagggcctggccggccagaggggcatcgtgggcctgcccggccagagaggagagcggggcttccctggcctgcccggccccagcggggagcccgggaagcagggcgcccctggggccagcggggaccggggccccccaggccctgtgggccccccaggcctgaccggccctgctggggagcccggccgggagggcagccctggagcagatggccccccaggaagagatggagctgctggggtgaagggggacagaggagaaacaggagctgtgggcgcccctggggcccctggccccccaggcagccctggccctgctggccccaccgggaagcagggcgacagaggagaggccggggcccagggccccatgggccccagcggccctgctggggcccggggcatccagggcccccagggccccaggggggacaagggggaggccggggagcccggggagcggggcctgaagggccaccggggcttcaccggcctgcagggcctgcccggccccccaggccccagcggggaccagggcgccagcggccctgctggccccagcggcccccggggccccccaggccctgtgggccccagcggcaaggatggagccaacggcatccctggccccatcggccccccaggcccccggggccgctctggagagaccggccctgctggccccccaggcaaccctggccccccaggccccccaggccccccaggccctggcatcgacatgtctgcctttgctggcctgggcccccgggagaagggccctgaccccctgcagtacatgagagctgaccaggccgccggcggcctgcggcagcatgatgctgaggtggatgccaccctgaagagcctgaacaaccagatcgagagcatccgcagccctgagggcagcaggaagaacccagcccggacctgccgggacctgaagctgtgccaccctgagtggaagagcggggactactggattgaccccaaccagggctgcaccctggatgccatgaaggtgttctgcaacatggagactggagagacctgtgtgtaccccaacccagccaacgtgcccaagaagaactggtggagcagcaagagcaaggagaagaagcacatctggtttggagagaccatcaatggaggcttccacttctcctatggagatgacaacctggcccccaacacagccaacgtgcagatgaccttcctgcggctgctgagcacagagggcagccagaacatcacctaccactgcaagaacagcatcgcctacctggatgaagctgctggcaacctgaagaaggccctgctgatccagggcagcaatgatgtggagatccgggcagagggcaacagccgcttcacctacacagccctgaaggatggctgcaccaagcacacaggcaagtggggcaagacagtcatcgagtaccgcagccagaagaccagccggctgcccatcattgatattgcccccatggacatcggcggccctgagcaggagtttggagtggacatcggccctgtgtgcttcctgtag

SEQ ID NO: 3211 - DNA, 4257 bp, Artificial Sequence
  Description of Artificial Sequence: Synthetic coding sequence
atgatccggctgggcgccccccagaccctggtgctgctgaccctgctggtggccgctgtgctgcgctgccagggccaggatgtgaggaagccagccccagccctggagcctgctgcccctggcagcctgagccagatcgtgggccccaagggccccccaggcccccagggccctgctggggagcagggccccaggggggacagaggagacaagggggagaagggggcccctggcccccggggcagagatggagagcccggcaccccaggcaaccctggccccccaggccccccaggccccccaggccccccaggcctgggcggcaactttgctgcccagatggccggcggctttgatgagaaggccggcggggcccagctgggcgtgatgcagggccccatgggccccatgggcccccggggccccccaggccctgctggggcccctggcccccagggcttccagggcaaccctggagagcctggagagcccggggtgtctggccccatgggcccccggggccccccaggccccccaggcaagccaggagatgatggagaggccggcaagccaggcaaggccggggagcggggccccccaggcccccagggcgcccggggcttccctggcaccccaggcctgcccggggtgaagggccaccggggctacccaggcctggatggagccaagggggaggccggggcccctggggtgaagggggagagcggcagccctggagaaaatggcagccctggccccatgggcccccggggcctgcccggggagcggggccgcacaggccctgctggagctgctggggcccggggaaatgatggccagcccggccctgctggccccccaggccctgtgggccctgctgggggccctggcttccctggggcccctggggccaagggggaggccggccccactggagcccggggccctgagggcgcccagggccccagaggagagcccggcaccccaggcagccctggccctgctggggccagcggcaaccctggaacagatggcatccctggggccaagggcagcgctggggcccctggcattgctggggcccctggcttccctggcccccggggccccccaggcccccagggcgccaccggccccctgggccccaagggccagacaggagagcccggcattgctggcttcaagggggagcagggccccaagggggagcccggccctgctggcccccagggcgcccctggccctgctggggaggagggcaagagaggagcccggggggagcccggcggcgtgggccccatcggccccccaggagagcggggggcccctggcaacagaggcttccctggccaggacggcctggccggccccaagggggcccctggagagcggggccccagcggcctggccggccccaagggggccaacggggaccccggccggcctggagagcccggcctgcccggggcccggggcctgaccggccggcctggagatgctggcccccagggcaaggtgggccccagcggggcccctggagaagatggccggcccggccccccaggcccccagggcgcccggggccagcccggggtgatgggcttccctggccccaagggggccaacggggagcccgggaaggccggggagaagggcctgcccggggcccctggcctgcggggcctgcccgggaaggatggagaaacaggagctgctggccccccaggccctgctggccctgctggggagcggggggagcagggcgcccctggccccagcggcttccagggcctgcccggccccccaggccccccaggagagggcggcaagccaggggaccagggcgtgcctggagaggccggggcccctggcctggtgggccccagaggagagcggggcttccctggagagcggggcagccctggggcccagggcctgcagggcccccggggcctgcccggcaccccaggcacagatggccccaagggggccagcggccctgctggccccccaggggcccagggccccccaggcctgcagggcatgcctggagagagaggagctgctggcattgctggccccaagggggacagaggagatgtgggggagaagggccctgagggcgcccctgggaaggatggcggccggggcctgaccggccccatcggccccccaggccctgctggggccaatggagagaagggggaggtgggccccccaggccctgctggcagcgctggggcccggggggcccctggagagcggggggagaccggccccccaggccctgctggctttgctggccccccaggagcagatggccagcccggggccaagggggagcagggcgaggccggccagaagggagatgctggggcccctggcccccagggccccagcggggcccctggcccccagggccccactggagtgacaggccccaagggggcccggggggcccagggccccccaggggccaccggcttccctggagctgctggccgggtgggccccccaggcagcaatggaaatcctggccccccaggccccccaggccccagcggcaaggatggccccaagggggcccggggggacagcggccccccaggccgggccggggagcccggcctgcagggccctgctggccccccaggagagaagggggagcctggagatgatggccccagcggggctgagggccccccaggcccccagggcctggccggccagaggggcatcgtgggcctgcccggccagagaggagagcggggcttccctggcctgcccggccccagcggggagcccgggaagcagggcgcccctggggccagcggggaccggggccccccaggccctgtgggccccccaggcctgactggacctgctggggagcccggccgggagggcagccctggagcagatggccccccaggaagagatggagctgctggggtgaagggggacagaggagagaccggggctgtgggcgcccctggggcccctggccccccaggcagccctggccctgctggccccaccgggaagcagggcgacagaggagaggccggggcccagggccccatgggccccagcggccctgctggggcccggggcatccagggcccccagggccccaggggggacaagggggaggccggggagcctggagagcggggcctgaagggccaccggggcttcaccggcctgcagggcctgcccggccccccaggccccagcggggaccagggcgccagcggccctgctggccccagcggcccccggggccccccaggccctgtgggccccagcggcaaggatggagccaacggcatccctggccccatcggccccccaggcccccggggccgcagcggggagactggacctgctggccccccaggcaaccctggccccccaggccccccaggccccccaggccctggcatcgacatgtctgcctttgctggcctgggcccccgggagaagggccctgaccccctgcagtacatgagagctgaccaggccgccggcggcctgcggcagcatgatgctgaggtggatgccaccctgaagagcctgaacaaccagatcgagagcatccgcagccctgagggcagcaggaagaacccagcccggacctgccgggacctgaagctgtgccaccctgagtggaagagcggggactactggattgaccccaaccagggctgcaccctggatgccatgaaggtgttctgcaacatggagaccggggagacctgtgtgtaccccaacccagccaacgtgcccaagaagaactggtggagcagcaagagcaaggagaagaagcacatctggtttggagagaccatcaatggaggcttccacttctcctatggagatgacaacctggcccccaacacagccaacgtgcagatgaccttcctgcggctgctgagcacagagggcagccagaacatcacctaccactgcaagaacagcatcgcctacctggatgaggccgccggcaacctgaagaaggccctgctgatccagggcagcaatgatgtggagatccgggcagagggcaacagccgcttcacctacacagccctgaaggatggctgcaccaagcacacaggcaagtggggcaagacagtgattgagtaccgcagccagaagaccagccggctgcccatcatcgacatcgcccccatggacattggaggccctgagcaggagtttggagtggacatcggccctgtgtgcttcctgtag

SEQ ID NO: 3212 - DNA, 3939 bp, Artificial Sequence
  Description of Artificial Sequence: Synthetic coding sequence
atgggcccccggctgtctgtgtggctgctgctgctgcctgctgccctgctgctgcacgaggagcacagcagagctgctgccaagggcggctgtgccggcagcggctgtgggaaatgtgactgccacggcgtgaagggccagaagggggagcggggcctgcccggcctgcagggcgtcatcggcttccctggcatgcagggccctgagggcccccagggccccccaggccagaagggggacacaggagagcccggcctgcccggcaccaagggcacccggggccccccaggggccagcggctacccaggcaaccctggcctgcccggcatccctggccaggacggccccccaggccccccaggcatccctggctgcaatggcaccaagggggagcggggccccctgggccccccaggcctgcccggctttgctggcaaccctggggaccccggggagatcctgggccacgtgcccggcatgctgctgaagggggagcggggcttccctggcatccctggcaccccaggccccccaggcctgcccggcctgcagggccctgtgggccccccaggcttcaccggcccccctgtgtcctttggaggctgcctgtctgaatttggccacggcggcatctccttccccctgaccaagaggcggcagggcgaccagggcgtgtctggccccccaggagtgcccggccaggcccaggtgcaggagaagggggactttgccaccaagggggagaagggccagaagggggagcccggcttccagggcatgcctggggtgggggagaagggggagcccgggaagccaggcccccggggcaagccaggcaaggatggagacaagggggagaagggcagccctggcttccctggagagcccggctacccaggcctcatcggccggcagggcccccaggtgaatgccggcaccatcgcctaccccctgcccccctgccctgtgattggcaccggccccctgggggagaagggggagcggggctacccaggcaccccaggccccagaggagagcccggccccaagggcagcttcctggccttcttccccccaccacccaccccacctccatttgctggcctgcctgtgcccggccaggccggggcccctggcttccctggagagcggggggagaagggggaccggggcttccctggcaccagcctgcccggccccagcggcagagatggcctgcccggccccccaggcagccctggccccccaggccagcccggctacaccaatggaattgtggagtgccagcccggccccccaggggaccagggccccccaggcatccctggccagcccggcttcatcggggagattggagagaagggccagaagggggagagctgcctgatctgtgacattgatggctaccggggccccccaggcccccagggccccccaggagagatcggcttccctggccagcccggggccaagggcctgcccggcatcaccggccagagcggcctgcccggcctgcccggccagcagggcgcccctggcatccctggcttccctggcagcaaaggagagatgggcgtgatgggcaccccaggccagcccggcagccctggccctgtgggcgcccctggcctgcctggagagaagggggaccacggcttccctggcagcagcggccccaggggggaccccggcctgaagggggacaagggagatgtgggcctgcccgggaagccaggctccatggacaaggtggacatgggctccatgaagggccagaagggggaccagggcgagaagggccagatcggccccatcggggagaagggcagcagaggagaccccggcaccccaggagtgcctgggaaggatggccaggccggccagcccggccagcccggccccaagggggaccccggcatcagcggcacccctggggcccctggcctgcccggccccaagggctctgtgggcggcatgggcctgcccggcaccccaggagagaagggcgtgcccggcatccctggcccccagggcagccctggcctgcccggggacaagggggccaagggggagaagggccaggccggccccccaggcatcggcatccctggcctgcggggggagaagggggaccagggcattgctggcttccctggcagccctggagagaagggggagaagggcagcatcggcatccctggcatgcctggcagccctggcctgaagggcagccctggctctgtgggctacccaggcagccctggcctgcctggagagaagggggacaagggcctgcccggcctggatggcatccctggggtgaagggggaggccggcctgcccggcaccccaggccccactggacctgctggccagaagggggagcccggcagtgatggcatccctggcagcgctggggagaagggggagcccggcctgcccggccggggcttccctggcttccctggggccaagggggacaagggcagcaaaggagaggtgggcttccctggcctggccggcagccctggcatccctggcagcaaaggagagcagggcttcatgggccccccaggcccccagggccagcccggcctgcccggcagccctggccacgccacagagggccccaagggggaccggggcccccagggccagcccggcctgcccggcctgcccggccccatgggccccccaggcctgcccggcattgatggagtgaagggggacaagggcaaccctggctggccaggggcccctggggtgcccggccccaagggggaccccggcttccagggcatgcctggcattggaggcagccctggcatcaccggcagcaaaggagacatgggccccccaggagtgcccggcttccagggccccaagggcctgcccggcctgcagggcatcaagggggaccagggcgaccagggcgtgcctggggccaagggcctgcccggccccccaggccccccaggcccctatgacatcatcaagggggagcccggcctgcccggccctgagggccccccaggcctgaagggcctgcagggcctgcccggccccaagggccagcagggcgtgacaggcctggtgggcatccctggccccccaggcatccctggctttgatggagcccctggccagaagggggagatgggccctgctggccccaccggcccccggggcttccctggccccccaggcccagatggcctgcccggctccatgggccccccaggcacccccagcgtggaccacggcttcctggtgaccaggcacagccagaccattgatgacccccagtgccccagcggcaccaagatcctgtaccacggctacagcctgctgtatgtgcagggcaatgaaagagcccacggccaggacctgggcacagctggcagctgcctgaggaagttcagcaccatgcccttcctgttctgcaacatcaacaacgtgtgcaactttgccagcagaaatgactacagctactggctgagcaccccagagcccatgcccatgtccatggcccccatcaccggggagaacatccggcccttcatcagccgctgtgctgtgtgtgaggccccagccatggtgatggctgtgcacagccagaccatccagatccccccctgccccagcggctggagcagcctgtggattggctacagctttgtgatgcacaccagcgctggagctgagggcagcggccaggccctggccagccctggcagctgcctggaggagttccgcagcgcccccttcatcgagtgccacggccggggcacctgcaactactatgccaatgcctacagcttctggctggccaccatcgagaggtctgagatgttcaagaagcccacccccagcaccctgaaggccggggagctgcggacccacgtgagccgctgccaggtgtgcatgagaagaacatag

SEQ ID NO: 3213 - DNA, 5010 bp, Artificial Sequence
  Description of Artificial Sequence: Synthetic coding sequence
atgggcccccggctgtctgtgtggctgctgctgctgcctgctgccctgctgctgcacgaggagcacagcagagctgctgccaagggcggctgtgccggcagcggctgtgggaaatgtgactgccacggcgtgaagggccagaagggggagcggggcctgcccggcctgcagggcgtcatcggcttccctggcatgcagggccctgagggcccccagggccccccaggccagaagggggacacaggagagcccggcctgcccggcaccaagggcacccggggccccccaggggccagcggctacccaggcaaccctggcctgcccggcatccctggccaggacggccccccaggccccccaggcatccctggctgcaatggcaccaagggggagcggggccccctgggccccccaggcctgcccggctttgctggcaaccctggccccccaggcctgcccggcatgaagggggaccctggagagatcctgggccacgtgcccggcatgctgctgaagggggagcggggcttccctggcatccctggcaccccaggccccccaggcctgcccggcctgcagggccctgtgggccccccaggcttcaccggccccccaggccccccaggccccccaggccccccaggagagaagggccagatgggcctgtccttccagggccccaagggggacaagggggaccagggcgtgtctggccccccaggagtgcccggccaggcccaggtgcaggagaagggggactttgccaccaagggggagaagggccagaagggggagcccggcttccagggcatgcctggggtgggggagaagggggagcccgggaagccaggcccccggggcaagccaggcaaggatggagacaagggggagaagggcagccctggcttccctggagagcccggctacccaggcctgattggccggcagggcccccagggcgagaagggggaggccggccccccaggccccccaggcatcgtgattggaacaggccccctgggggagaagggggagcggggctacccaggcaccccaggccccagaggagagcccggccccaagggcttccctggcctgcccggccagcccggccccccaggcctgcctgtgcccggccaggccggggcccctggcttccctggagagcggggggagaagggggaccggggcttccctggcaccagcctgcccggccccagcggcagagatggcctgcccggccccccaggcagccctggccccccaggccagcccggctacaccaatggaattgtggagtgccagcccggccccccaggggaccagggccccccaggcatccctggccagcccggcttcatcggggagattggagagaagggccagaagggggagagctgcctgatctgtgacattgatggctaccggggccccccaggcccccagggccccccaggagagatcggcttccctggccagcccggggccaagggggaccggggcctgcccggcagagatggagtggccggcgtgcccggcccccagggcaccccaggcctgattggccagcccggggccaagggggagcccggggagttctactttgacctgcggctgaagggggacaagggggaccccggcttccctggccagcccggcatgacaggccgggccggcagccctggaagagatggccaccctggcctgcccggccccaagggcagccctggctctgtgggcctgaagggggagcggggccccccaggcggcgtgggcttccctggcagcagaggagacaccggccccccaggccccccaggctacggccctgctggccccatcggggacaagggccaggccggcttccctgggggccctggcagccctggcctgcccggccccaagggggagcccgggaagatcgtgcccctgcccggccccccaggagctgagggcctgcccggcagccctggcttccctggcccccagggcgaccggggcttccctggcaccccaggccggcccggcctgcccggggagaagggagctgtgggccagcccggcatcggcttccctggccccccaggccccaagggcgtggatggcctgcccggggacatgggccccccaggcaccccaggccggcccggcttcaacggcctgcccggcaaccctggggtgcagggccagaagggggagcccggggtgggcctgcccggcctgaagggcctgcccggcctgcccggcatccctggcaccccaggagagaagggcagcattggagtgcctggggtgcctggagaacatggagccatcggccccccaggcctgcagggcatccggggggagcccggccccccaggcctgcccggctctgtgggcagccctggggtgcccggcatcggccccccaggggcccggggccccccaggcggccagggccccccaggcctgagcggccccccaggcatcaagggggagaagggcttccctggcttccctggcctggacatgcctggccccaagggggacaagggggcccagggcctgcccggcatcaccggccagagcggcctgcccggcctgcccggccagcagggcgcccctggcatccctggcttccctggcagcaagggggagatgggcgtgatgggcaccccaggccagcccggcagccctggccctgtgggcgcccctggcctgcccggggagaagggggaccacggcttccctggcagcagcggccccaggggggaccccggcctgaagggggacaagggagatgtgggcctgcccgggaagccaggctccatggacaaggtggacatgggctccatgaagggccagaagggggaccagggcgagaagggccagatcggccccatcggggagaagggcagcagaggagaccccggcaccccaggagtgcctgggaaggatggccaggccggccagcccggccagcccggccccaagggggaccccggcatcagcggcacccctggggcccctggcctgcccggccccaagggctctgtgggcggcatgggcctgcccggcaccccaggagagaagggcgtgcccggcatccctggcccccagggcagccctggcctgcccggggacaagggggccaagggggagaagggccaggccggccccccaggcatcggcatccctggcctgcggggggagaagggggaccagggcattgctggcttccctggcagccctggagagaagggggagaagggcagcatcggcatccctggcatgcctggcagccctggcctgaagggcagccctggctctgtgggctacccaggcagccctggcctgcccggggagaagggggacaagggcctgcccggcctggatggcatccctggggtgaagggggaggccggcctgcccggcaccccaggccccaccggccctgctggccagaagggggagcccggcagtgatggcatccctggcagcgctggggagaagggggagcccggcctgcccggccggggcttccctggcttccctggggccaagggggacaagggcagcaagggggaggtgggcttccctggcctggccggcagccctggcatccctggcagcaagggggagcagggcttcatgggccccccaggcccccagggccagcccggcctgcccggcagccctggccacgccacagagggccccaagggggaccggggcccccagggccagcccggcctgcccggcctgcccggccccatgggccccccaggcctgcccggcattgatggagtgaagggggacaagggcaaccctggctggccaggggcccctggggtgcccggccccaagggggaccccggcttccagggcatgcctggcatcggcggcagccctggcatcaccggcagcaagggggacatgggccccccaggagtgcccggcttccagggccccaagggcctgcccggcctgcagggcatcaagggggaccagggcgaccagggcgtgcctggggccaagggcctgcccggccccccaggccccccaggcccctatgacatcatcaagggggagcccggcctgcccggccctgagggccccccaggcctgaagggcctgcagggcctgcccggccccaagggccagcagggcgtgacaggcctggtgggcatccctggccccccaggcatccctggctttgatggagcccctggccagaagggggagatgggccctgctggccccaccggcccccggggcttccctggccccccaggcccagatggcctgcccggctccatgggccccccaggcaccccatctgtggaccacggcttcctggtgaccaggcacagccagaccattgatgacccccagtgccccagcggcaccaagatcctgtaccacggctacagcctgctgtatgtgcagggcaatgaaagagcccacggccaggacctgggcacagctggcagctgcctgaggaagttcagcaccatgcccttcctgttctgcaacatcaacaacgtgtgcaactttgccagcagaaatgactacagctactggctgagcaccccagagcccatgcccatgtccatggcccccatcactggagagaacatccggcccttcatcagccgctgtgctgtgtgtgaggccccagccatggtgatggctgtgcacagccagaccatccagatccccccctgccccagcggctggagcagcctgtggattggctacagctttgtgatgcacaccagcgctggagctgagggcagcggccaggccctggccagccctggcagctgcctggaggagttccgcagcgcccccttcattgaatgtcatggccggggcacctgcaactactatgccaatgcctacagcttctggctggccaccatcgagaggtctgagatgttcaagaagcccacccccagcaccctgaaggccggggagctgcggacccacgtgagccgctgccaggtgtgcatgagaagaacatag

SEQ ID NO: 3214 - DNA, 3957 bp, Artificial Sequence
  Description of Artificial Sequence: Synthetic coding sequence
atgggcccccggctgtctgtgtggctgctgctgctgcctgctgccctgctgctgcacgaggagcacagcagagctgctgccaagggcggctgtgccggcagcggctgtgggaaatgtgactgccacggcgtgaagggccagaagggggagcggggcctgcccggcctgcagggcgtcatcggcttccctggcatgcagggccctgagggcccccagggccccccaggccagaagggggacacaggagagcccggcctgcccggcaccaagggcacccggggccccccaggggccagcggctacccaggcaaccctggcctgcccggcatccctggccaggacggccccccaggccccccaggcatccctggctgcaatggcaccaagggggagcggggccccctgggccccccaggcctgcccggctttgctggcaaccctggccccccaggcctgcccggcatgaagggggaccctggagagatcctgggccacgtgcccggcatgctgctgaagggggagcggggcttccctggcatccctggcaccccaggccccccaggcctgcccggcctgcagggccctgtgggccccccaggcttcaccggccccccaggccccccaggccccccaggccccccaggagagaagggccagatgggcctgtccttccagggccccaagggggacaagggggaccagggcgtgtctggccccccaggagtgcccggccaggcccaggtgcaggagaagggggactttgccaccaagggggagaagggccagaagggggagcccggcttccagggcatgcctggggtgggggagaagggggagcccgggaagccaggcccccggggcaagccaggcaaggatggagacaagggggagaagggcagccctggcttccctggagagcccggctacccaggcctgattggccggcagggcccccagggcgagaagggggaggccggccccccaggccccccaggcatcgtgattggaacaggccccctgggggagaagggggagcggggctacccaggcaccccaggccccagaggagagcccggccccaagggcttccctggcctgcccggccagcccggccccccaggcctgcctgtgcccggccaggccggggcccctggcttccctggagagcggggggagaagggggaccggggcttccctggcaccagcctgcccggccccagcggcagagatggcctgcccggccccccaggcagccctggccccccaggccagcccggctacaccaatggaattgtggagtgccagcccggccccccaggggaccagggccccccaggcatccctggccagcccggcttcatcggggagattggagagaagggccagaagggggagagctgcctgatctgtgacattgatggctaccggggccccccaggcccccagggccccccaggagagatcggcttccctggccagcccggggccaagggcctgcccggcatcaccggccagagcggcctgcccggcctgcccggccagcagggcgcccctggcatccctggcttccctggcagcaaaggagagatgggcgtgatgggcaccccaggccagcccggcagccctggccctgtgggcgcccctggcctgcctggagagaagggggaccacggcttccctggcagcagcggccccaggggggaccccggcctgaagggggacaagggagatgtgggcctgcccgggaagccaggctccatggacaaggtggacatgggctccatgaagggccagaagggggaccagggcgagaagggccagatcggccccatcggggagaagggcagcagaggagaccccggcaccccaggagtgcctgggaaggatggccaggccggccagcccggccagcccggccccaagggggaccccggcatcagcggcacccctggggcccctggcctgcccggccccaagggctctgtgggcggcatgggcctgcccggcaccccaggagagaagggcgtgcccggcatccctggcccccagggcagccctggcctgcccggggacaagggggccaagggggagaagggccaggccggccccccaggcatcggcatccctggcctgcggggggagaagggggaccagggcattgctggcttccctggcagccctggagagaagggggagaagggcagcatcggcatccctggcatgcctggcagccctggcctgaagggcagccctggctctgtgggctacccaggcagccctggcctgcctggagagaagggggacaagggcctgcccggcctggatggcatccctggggtgaagggggaggccggcctgcccggcaccccaggccccactggacctgctggccagaagggggagcccggcagtgatggcatccctggcagcgctggggagaagggggagcccggcctgcccggccggggcttccctggcttccctggggccaagggggacaagggcagcaaaggagaggtgggcttccctggcctggccggcagccctggcatccctggcagcaaaggagagcagggcttcatgggccccccaggcccccagggccagcccggcctgcccggcagccctggccacgccacagagggccccaagggggaccggggcccccagggccagcccggcctgcccggcctgcccggccccatgggccccccaggcctgcccggcattgatggagtgaagggggacaagggcaaccctggctggccaggggcccctggggtgcccggccccaagggggaccccggcttccagggcatgcctggcattggaggcagccctggcatcaccggcagcaaaggagacatgggccccccaggagtgcccggcttccagggccccaagggcctgcccggcctgcagggcatcaagggggaccagggcgaccagggcgtgcctggggccaagggcctgcccggccccccaggccccccaggcccctatgacatcatcaagggggagcccggcctgcccggccctgagggccccccaggcctgaagggcctgcagggcctgcccggccccaagggccagcagggcgtgacaggcctggtgggcatccctggccccccaggcatccctggctttgatggagcccctggccagaagggggagatgggccctgctggccccaccggcccccggggcttccctggccccccaggcccagatggcctgcccggctccatgggccccccaggcacccccagcgtggaccacggcttcctggtgaccaggcacagccagaccattgatgacccccagtgccccagcggcaccaagatcctgtaccacggctacagcctgctgtatgtgcagggcaatgaaagagcccacggccaggacctgggcacagctggcagctgcctgaggaagttcagcaccatgcccttcctgttctgcaacatcaacaacgtgtgcaactttgccagcagaaatgactacagctactggctgagcaccccagagcccatgcccatgtccatggcccccatcaccggggagaacatccggcccttcatcagccgctgtgctgtgtgtgaggccccagccatggtgatggctgtgcacagccagaccatccagatccccccctgccccagcggctggagcagcctgtggattggctacagctttgtgatgcacaccagcgctggagctgagggcagcggccaggccctggccagccctggcagctgcctggaggagttccgcagcgcccccttcatcgagtgccacggccggggcacctgcaactactatgccaatgcctacagcttctggctggccaccatcgagaggtctgagatgttcaagaagcccacccccagcaccctgaaggccggggagctgcggacccacgtgagccgctgccaggtgtgcatgagaagaacatag

SEQ ID NO: 3215 - DNA, 1560 bp, Artificial Sequence
  Description of Artificial Sequence: Synthetic coding sequence
atgggcccccggctgtctgtgtggctgctgctgctgcctgctgccctgctgctgcacgaggagcacagcagagctgctgccaagggcggctgtgccggcagcggctgtgggaaatgtgactgccacggcgtgaagggccagaagggggagcggggcctgcccggcctgcagggcgtcatcggcttccctggcatgcagggccctgagggcccccagggccccccaggccagaagggggacacaggagagcccggcctgcccggcaccaagggcacccggggccccccaggggccagcggctacccaggcaaccctggcctgcccggcatccctggccaggacggccccccaggccccccaggcatccctggctgcaatggcaccaagggggagcggggccccctgggccccccaggcctgcccggctttgctggcaaccctggccccccaggcctgcccggcatgaagggggaccctggagagatcctgggccacgtgcccggcatgctgctgaagggggagcggggcttccctggcatccctggcaccccaggccccccaggcctgcccggcctgcagggccctgtgggccccccaggcttcaccggccccccaggccccccaggccccccaggccccccaggagagaagggccagatgggcctgtccttccagggccccaagggggacaagggggaccagggcgtgtctggccccccaggagtgcccggccaggcccaggtgcaggagaagggggactttgccaccaagggggagaagggccagaagggggagcccggcttccagggcatgcctggggtgggggagaagggggagcccgggaagccaggcccccggggcaagccaggcaaggatggagacaagggggagaagggcagccctggcttccctggagagcccggctacccaggcctgattggccggcagggcccccagggcgagaagggggaggccggccccccaggccccccaggcatcgtgattggaacaggccccctgggggagaagggggagcggggctacccaggcaccccaggccccagaggagagcccggccccaagggcttccctggcctgcccggccagcccggccccccaggcctgcctgtgcccggccaggccggggcccctggcttccctggagagcggggggagaagggggaccggggcttccctggcaccagcctgcccggccccagcggcagagatggcctgcccggccccccaggcagccctggccccccaggccagcccggctacaccaatggaattgtggagtgccagcccggccccccaggggaccagggccccccaggcatccctggccagcccggcttcatcggggagattggagagaagggccagaagggggagagctgcctgatctgtgacattgatggctaccggggccccccaggcccccagggccccccaggagagatcggcttccctggccagcccggggccaagggggaccggggcctgcccggcagagatggagtggccggcgtgcccctgctcttccagatccacaagtag

SEQ ID NO: 3216 - DNA, 1797 bp, Artificial Sequence
  Description of Artificial Sequence: Synthetic coding sequence
atgtctgacaaccagagctggaacagcagcggcagcgaggaggaccctgagacagagagcggcccccctgtggagcgctgtggggtgctgagcaagtggaccaactacatccacggctggcaggaccgctgggtggtgctgaagaacaatgccctgagctactacaagtcagaagatgaaacagaatatggctgccggggcagcatctgcctgagcaaggccgtcatcacccctcatgactttgatgaatgtagatttgacatctctgtgaatgattctgtgtggtacctgcgggcccaggaccctgaccaccggcagcagtggattgatgccatcgagcagcacaagacagaaagtggctacggcagcgagagcagcctgcggcggcacggctccatggtgtccctggtgtctggggccagcggctacagcgccaccagcaccagcagcttcaagaagggccacagcctgcgggagaagctggccgagatggagaccttccgggacatcctgtgccggcaggtggacaccctgcagaagtactttgatgcctgtgctgatgctgtgtccaaggatgagctgcagagggacaaggtggtggaggatgatgaagatgacttccccaccaccaggagtgatggagacttcctgcacagcaccaatggaaacaaggagaagctgttcccccacgtgacccccaagggcatcaatggaattgacttcaagggggaggccatcaccttcaaggccaccacagctggcatcctggccaccctgagccactgcatcgagctgatggtgaagcgggaggacagctggcagaagaggctggacaaggagacagagaagaagagaagaacagaggaggcctacaagaatgccatgacagagctgaagaagaagagccactttggaggccctgactatgaggagggccccaacagcctcatcaatgaggaggagttctttgatgctgtggaggccgccctggaccggcaggacaagattgaggagcagagccagagcgagaaggtgcggctgcactggcccaccagcctgcccagcggagatgccttcagctctgtgggcacccacagatttgtgcagaaggtggaggagatggtgcagaaccacatgacctacagcctgcaggatgtgggcggagatgccaactggcagctggtggtggaggagggggagatgaaggtgtacagaagagaggtggaggagaatggaattgtgctggaccccctgaaggccacccatgctgtgaagggcgtgacaggccacgaggtgtgcaactacttctggaatgtggatgtgagaaatgactgggagaccaccatcgagaacttccacgtggtggagaccctggccgacaatgccatcatcatctaccagacccacaagagggtgtggccagccagccagagagatgtgctgtacctgagcgtcatcaggaagatcccagccctgacagaaaatgaccctgagacctggatcgtgtgcaacttctctgtggaccatgattctgcccccctgaacaacagatgtgtgcgggccaagatcaacgtggccatgatctgccagaccctggtgtccccacctgagggcaaccaggagatcagccgggacaacatcctgtgcaagatcacctacgtggccaacgtgaaccctgggggctgggccccagcctctgtgctgcgggctgtggccaagcgggagtaccccaagttcctgaagcgcttcaccagctatgtgcaggagaagacagctgggaagcccatcctcttctag

SEQ ID NO: 3217 - DNA, 690 bp, Artificial Sequence
  Description of Artificial Sequence: Synthetic coding sequence
aaggtggaggagatggtgcagaaccacatgacctacagcctgcaggatgtgggcggagatgccaactggcagctggtggtggaggagggggagatgaaggtgtaccgccgggaggtggaggagaatggcatcgtgctggaccccctgaaggccacccatgctgtgaagggcgtgactggacatgaggtgtgcaactacttctggaatgtggatgtgagaaatgactgggagaccaccatcgagaacttccacgtggtggagaccctggccgacaatgccatcatcatctaccagacccacaagagggtgtggccagccagccagagagatgtgctgtacctgagcgtcatcaggaagatcccagccctgacagaaaatgaccctgagacctggatcgtgtgcaacttctctgtggaccatgacagcgcccccctgaacaacagatgtgtgcgggccaagatcaacgtggccatgatctgccagaccctggtgagccccccagagggcaaccaggagatcagccgggacaacatcctgtgcaagatcacctacgtggccaacgtgaaccctgggggctgggccccagcctctgtgctgcgggctgtggccaagcgggagtaccccaagttcctgaagcgcttcaccagctatgtgcaggagaagacagctgggaagcccatcctcttctag

SEQ ID NO: 3218 - DNA, 2259 bp, Artificial Sequence
  Description of Artificial Sequence: Synthetic coding sequence
atgcagcacagctgcatccccaccccacccagccccttcagcgcccccccagccttcctgcctgtggtgacccgggagagccggcggggcctgagcagcggcggcagcgctggaagaaatgctggggtgacagccacagctgctgctgctgatggctggaagggccgcctgcccagccccctggtgctgctgcccaggtctgcccgctgccaggccaggagaagaagaggaggccgcaccagcagcctgctgctgctgccccccaccccagagcgggccctgtttgccagccccagcccagaccccagcccccggggcctgggcgccagcagtggagctgctgagggcgctggggccggcctgctgctgggctgccgggcctccatgtctgacaaccagagctggaacagcagcggcagcgaggaggaccctgagacagagagcggcccccctgtggagcgctgtggggtgctgagcaagtggaccaactacatccacggctggcaggaccgctgggtggtgctgaagaacaatgccctgagctactacaagtcagaagatgaaacagaatatggctgccggggcagcatctgcctgagcaaggccgtcatcacccctcatgactttgatgaatgtagatttgacatctctgtgaatgattctgtgtggtacctgcgggcccaggaccctgaccaccggcagcagtggattgatgccatcgagcagcacaagacagaaagtggctacggcagcgagagcagcctgcggcggcacggctccatggtgtccctggtgtctggggccagcggctacagcgccaccagcaccagcagcttcaagaagggccacagcctgcgggagaagctggccgagatggagaccttccgggacatcctgtgccggcaggtggacaccctgcagaagtactttgatgcctgtgctgatgctgtgtccaaggatgagctgcagagggacaaggtggtggaggatgatgaagatgacttccccaccaccaggagtgatggagacttcctgcacagcaccaatggaaacaaggagaagctgttcccccacgtgacccccaagggcatcaatggaattgacttcaagggggaggccatcaccttcaaggccaccacagctggcatcctggccaccctgagccactgcatcgagctgatggtgaagcgggaggacagctggcagaagaggctggacaaggagacagagaagaagagaagaacagaggaggcctacaagaatgccatgacagagctgaagaagaagagccactttggaggccctgactatgaggagggccccaacagcctcatcaatgaggaggagttctttgatgctgtggaggccgccctggaccggcaggacaagattgaggagcagagccagagcgagaaggtgcggctgcactggcccaccagcctgcccagcggagatgccttcagctctgtgggcacccacagatttgtgcagaagccctacagccgcagcagctccatgagcagcattgacctggtgtctgccagtgatgatgtgcaccgcttcagcagccaggtggaggagatggtgcagaaccacatgacctacagcctgcaggatgtgggcggagatgccaactggcagctggtggtggaggagggggagatgaaggtgtacagaagagaggtggaggagaatggaattgtgctggaccccctgaaggccacccatgctgtgaagggcgtgacaggccacgaggtgtgcaactacttctggaatgtggatgtgagaaatgactgggagaccaccatcgagaacttccacgtggtggagaccctggccgacaatgccatcatcatctaccagacccacaagagggtgtggccagccagccagagagatgtgctgtacctgagcgtcatcaggaagatcccagccctgacagaaaatgaccctgagacctggatcgtgtgcaacttctctgtggaccatgattctgcccccctgaacaacagatgtgtgcgggccaagatcaacgtggccatgatctgccagaccctggtgtccccacctgagggcaaccaggagatcagccgggacaacatcctgtgcaagatcacctacgtggccaacgtgaaccctgggggctgggccccagcctctgtgctgcgggctgtggccaagcgggagtaccccaagttcctgaagcgcttcaccagctatgtgcaggagaagacagctgggaagcccatcctcttctag

SEQ ID NO: 3219 - DNA, 1875 bp, Artificial Sequence
  Description of Artificial Sequence: Synthetic coding sequence
atgtctgacaaccagagctggaacagcagcggcagcgaggaggaccctgagacagagagcggcccccctgtggagcgctgtggggtgctgagcaagtggaccaactacatccacggctggcaggaccgctgggtggtgctgaagaacaatgccctgagctactacaagtcagaagatgaaacagaatatggctgccggggcagcatctgcctgagcaaggccgtcatcacccctcatgactttgatgaatgtagatttgacatctctgtgaatgattctgtgtggtacctgcgggcccaggaccctgaccaccggcagcagtggattgatgccatcgagcagcacaagacagaaagtggctacggcagcgagagcagcctgcggcggcacggctccatggtgtccctggtgtctggggccagcggctacagcgccaccagcaccagcagcttcaagaagggccacagcctgcgggagaagctggccgagatggagaccttccgggacatcctgtgccggcaggtggacaccctgcagaagtactttgatgcctgtgctgatgctgtgtccaaggatgagctgcagagggacaaggtggtggaggatgatgaagatgacttccccaccaccaggagtgatggagacttcctgcacagcaccaatggaaacaaggagaagctgttcccccacgtgacccccaagggcatcaatggaattgacttcaagggggaggccatcaccttcaaggccaccacagctggcatcctggccaccctgagccactgcatcgagctgatggtgaagcgggaggacagctggcagaagaggctggacaaggagacagagaagaagagaagaacagaggaggcctacaagaatgccatgacagagctgaagaagaagagccactttggaggccctgactatgaggagggccccaacagcctcatcaatgaggaggagttctttgatgctgtggaggccgccctggaccggcaggacaagattgaggagcagagccagagcgagaaggtgcggctgcactggcccaccagcctgcccagcggagatgccttcagctctgtgggcacccacagatttgtgcagaagccctacagccgcagcagctccatgagcagcattgacctggtgtctgccagtgatgatgtgcaccgcttcagcagccaggtggaggagatggtgcagaaccacatgacctacagcctgcaggatgtgggcggagatgccaactggcagctggtggtggaggagggggagatgaaggtgtacagaagagaggtggaggagaatggaattgtgctggaccccctgaaggccacccatgctgtgaagggcgtgacaggccacgaggtgtgcaactacttctggaatgtggatgtgagaaatgactgggagaccaccatcgagaacttccacgtggtggagaccctggccgacaatgccatcatcatctaccagacccacaagagggtgtggccagccagccagagagatgtgctgtacctgagcgtcatcaggaagatcccagccctgacagaaaatgaccctgagacctggatcgtgtgcaacttctctgtggaccatgattctgcccccctgaacaacagatgtgtgcgggccaagatcaacgtggccatgatctgccagaccctggtgtccccacctgagggcaaccaggagatcagccgggacaacatcctgtgcaagatcacctacgtggccaacgtgaaccctgggggctgggccccagcctctgtgctgcgggctgtggccaagcgggagtaccccaagttcctgaagcgcttcaccagctatgtgcaggagaagacagctgggaagcccatcctcttctag

SEQ ID NO: 3220 - DNA, 381 bp, Artificial Sequence
  Description of Artificial Sequence: Synthetic coding sequence
tgaccagccagccagagagatgtgctgtacctgagcgtcatcaggaagatcccagccctgacagaaaatgaccctgagacctggatcgtgtgcaacttctctgtggaccatgattctgcccccctgaacaacagatgtgtgcgggccaagatcaacgtggccatgatctgccagaccctggtgtccccacctgagggcaaccaggagatcagccgggacaacatcctgtgcaagatcacctacgtggccaacgtgaaccctgggggctgggccccagcctctgtgctgcgggctgtggccaagcgggagtaccccaagttcctgaagcgcttcaccagctatgtgcaggagaagacagctgggaagcccatcctcttctag

SEQ ID NO: 3221 - DNA, 5064 bp, Artificial Sequence
  Description of Artificial Sequence: Synthetic coding sequence
atgtggagcctgcacatcgtgctgatgcgctgcagcttccggctgaccaagagcctggccaccggcccctggagcctcatcctgatcctcttctctgtgcagtatgtgtatggcagcggcaagaagtacatcggcccctgtggcggccgggactgcagcgtgtgccactgtgtgcctgagaagggcagccggggccccccaggccccccaggcccccagggccccatcggccccctgggcgcccctggccccatcggcctgagcggggagaagggcatgagaggagaccggggccccccaggagctgctggggacaagggggacaagggccccaccggggtgcccggcttccctggcctggatggcatccctggccaccctggccccccaggcccccggggcaagccaggcatgagcggccacaacggcagcagaggagaccccggcttccctgggggccgcggggccctgggccctgggggccccctgggccaccctggagagaagggggagaagggcaacagcgtcttcatcctgggcgctgtgaagggcatccagggcgacagaggagaccccggcctgcccggcctgcccggctcctggggcgccggcggccctgctggccccaccggctacccaggagagcccggcctggtgggccccccaggccagcccggccggcccggcctgaagggcaaccctggggtgggcgtgaagggccagatgggagaccctggagaggtgggccagcagggcagccctggccccaccctgctggtggagcccccagacttctgcctgtacaagggggagaagggcatcaagggcatccctggcatggtgggcctgcccggccccccaggcaggaagggggagagcggcattggagccaagggggagaagggcatccctggcttccctggccccaggggggaccccggcagctatggcagccctggcttccctggcctgaagggggagctgggcctggtgggggaccccggcctgtttggcctcatcggccccaagggggaccccggcaacagaggccaccctggccccccaggagtgctggtgaccccacccctgcccctgaagggccccccaggggaccccggcttccctggccgctacggggagactggagatgtgggccccccaggccccccaggcctgctgggccggcctggagaggcctgtgccggcatgattggccccccaggcccccagggcttccctggcctgcccggcctgcctggagaggccggcatccctggccgcccagacagcgcccctgggaagccaggcaagccaggcagccctggcctgcccggggcccctggcctgcagggcctgcccggcagcagcgtcatctactgcagcgtgggcaaccctggcccccagggcatcaagggcaaggtgggccccccaggcggccggggccccaagggggagaagggaaatgaaggcctgtgtgcctgtgagcccggccccatgggccccccaggccccccaggcctgcccggccggcagggcagcaagggggacctgggcctgcccggctggctgggcaccaagggggaccccggccccccaggagctgagggccccccaggcctgcccgggaagcacggggccagcggccccccaggcaacaagggggccaagggggacatggtggtgtcccgggtgaagggccacaagggggagcggggcccagatggccccccaggcttccctggccagcccggcagccacggcagagatggccacgccggggagaagggggaccccggccccccaggggaccatgaagatgccaccccaggcggcaagggcttccctggccccctgggccccccaggcaaggccggccctgtgggccccccaggcctgggcttccctggccccccaggagagcggggccaccctggggtgcccggccaccctggggtgcggggcccagatggcctgaagggccagaagggggacaccatcagctgcaatgtgacctacccaggccgccacggccccccaggctttgatggccccccaggccccaagggcttccctggcccccagggcgcccctggcctgagcggcagtgatggccacaagggccggcccggcaccccaggcacagctgagatccctggccccccaggcttccggggggacatgggagaccccggctttggaggagagaagggcagcagccctgtgggccccccaggccccccaggcagccctggggtgaatggccagaagggcatccctggggaccctgccttcggccacctgggccccccaggcaagaggggcctgagcggcgtgcccggcatcaagggccccaggggggaccccggctgccctggagctgagggccctgctggcatccctggcttcctgggcctgaagggccccaagggccgggagggccatgctggcttccctggggtgcccggccccccaggccacagctgtgagcggggggcccctggcatccctggccagcccggcctgcccggctacccaggcagccctggggcccctgggggcaagggccagcctggagatgtgggccccccaggccctgctggcatgaagggcctgcccggcctgcccggccggcctggggcccacggccccccaggcctgcccggcatccctggcccctttggagatgatggcctgcccggccccccaggccccaagggcccccggggcctgcccggcttccctggcttccctggagagcggggcaagccaggagctgagggctgccctggggccaagggggagcctggagagaagggcatgagcggcctgcccggggaccggggcctgcggggggccaagggggccatcggccccccaggagatgaaggagagatggccatcatcagccagaagggcaccccaggagagcccggccccccaggagatgatggcttccctggagagcggggggacaagggcaccccaggcatgcagggccggcggggggagcccggccgctatggccccccaggcttccacagaggagagcctggagagaagggccagcccggccccccaggccccccaggccccccaggcagcacaggcctgcggggcttcatcggcttccctggcctgcccggggaccagggcgagcccggcagccctggccccccaggcttcagcggcattgatggagcccggggccccaagggcaacaagggggaccctgccagccactttggacctcctggccccaagggggagcccggcagccctggctgccccggccactttggagccagcggggagcagggcctgcccggcatccagggcccccggggcagccctggccggcccggccccccaggcagcagcggccccccaggctgccctggggaccacggcatgcctggcctgcggggccagcccggggagatgggagaccccggcccccggggcctgcagggcgaccccggcatccctggccccccaggcatcaagggccccagcggcagccctggcctgaatggcctgcacggcctgaagggccagaagggcaccaagggggccagcggcctgcatgatgtgggccccccaggccctgtgggcatccctggcctgaagggggagcggggggaccccggcagccctggcatcagccccccaggcccccggggcaagaagggccccccaggccccccaggcagcagcggccccccaggccctgctggggccaccggccgggcccccaaggacatcccagaccccggccccccaggggaccagggccccccaggcccagatggccccaggggggcccctggccccccaggcctgcccggctctgtggacctgctgcggggggagcccggggactgtggcctgcccggccccccaggccccccaggccccccaggccccccaggctacaagggcttccctggctgtgatggcaaggatggccagaagggccctgtgggcttccctggcccccagggcccccacggcttccctggccccccaggagagaagggcctgcccggccccccaggcaggaagggccccaccggcctgcccggggagcccggccccccagcagatgtggatgactgcccccgcatccctggcctgcccggggcccctggcatgaggggccctgagggcgccatgggcctgcccggcatgaggggccccagcggccctggctgcaagggggagcccggcctggatggaagaagaggagtggatggagtgcccggcagccctggccccccaggcaggaaaggagacaccggggaggatggctacccaggcggccctggccccccaggccccatcggggaccccggccccaagggctttggacctggctacctgggcggcttcctgctggtgctgcacagccagacagaccaggagcccacctgccccctgggcatgccccggctgtggacaggctacagcctgctgtacctggagggccaggagaaggcccacaaccaggacctgggcctggccggcagctgcctgcccgtcttcagcaccctgccctttgcctactgcaacatccaccaggtgtgccactacgcccagagaaatgacaggagctactggctggccagcgctgcccccctgcccatgatgcccctgtctgaggaggccatccggccctacgtgagccgctgtgctgtgtgtgaggccccagcccaggccgtggccgtgcacagccaggaccagagcatccccccctgcccccagacctggaggagcctgtggattggctacagcttcctgatgcacactggagctggggaccagggcggcggccaggccctgatgagccctggcagctgcctggaggacttccgggccgcccccttcctggagtgccagggccggcagggcacctgccacttctttgccaacaagtacagcttctggctgaccaccgtgaaggctgacctgcagttcagcagcgccccagccccagacaccctgaaggagagccaggcccagaggcagaagatcagccgctgccaggtgtgtgtgaagtacagctag

SEQ ID NO: 3222 - DNA, 5073 bp, Artificial Sequence
  Description of Artificial Sequence: Synthetic coding sequence
atgtggagcctgcacatcgtgctgatgcgctgcagcttccggctgaccaagagcctggccaccggcccctggagcctcatcctgatcctcttctctgtgcagtatgtgtatggcagcggcaagaagtacatcggcccctgtggcggccgggactgcagcgtgtgccactgtgtgcctgagaagggcagccggggccccccaggccccccaggcccccagggccccatcggccccctgggcgcccctggccccatcggcctgagcggggagaagggcatgagaggagaccggggccccccaggagctgctggggacaagggggacaagggccccaccggggtgcccggcttccctggcctggatggcatccctggccaccctggccccccaggcccccggggcaagccaggcatgagcggccacaacggcagcagaggagaccccggcttccctgggggccgcggggccctgggccctgggggccccctgggccaccctggagagaagggggagaagggcaacagcgtcttcatcctgggcgctgtgaagggcatccagggcgacagaggagaccccggcctgcccggcctgcccggctcctggggcgccggcggccctgctggccccaccggctacccaggagagcccggcctggtgggccccccaggccagcccggccggcccggcctgaagggcaaccctggggtgggcgtgaagggccagatgggagaccctggagaggtgggccagcagggcagccctggccccaccctgctggtggagcccccagacttctgcctgtacaagggggagaagggcatcaagggcatccctggcatggtgggcctgcccggccccccaggcaggaagggggagagcggcattggagccaagggggagaagggcatccctggcttccctggccccaggggggaccccggcagctatggcagccctggcttccctggcctgaagggggagctgggcctggtgggggaccccggcctgtttggcctcatcggccccaagggggaccccggcaacagaggccaccctggccccccaggagtgctggtgaccccacccctgcccctgaagggccccccaggggaccccggcttccctggccgctacggggagactggagatgtgggccccccaggccccccaggcctgctgggccggcctggagaggcctgtgccggcatgattggccccccaggcccccagggcttccctggcctgcccggcctgcctggagaggccggcatccctggccgcccagacagcgcccctgggaagccaggcaagccaggcagccctggcctgcccggggcccctggcctgcagggcctgcccggcagcagcgtcatctactgcagcgtgggcaaccctggcccccagggcatcaagggcaaggtgggccccccaggcggccggggccccaagggggagaagggaaatgaaggcctgtgtgcctgtgagcccggccccatgggccccccaggccccccaggcctgcccggccggcagggcagcaagggggacctgggcctgcccggctggctgggcaccaagggggaccccggccccccaggagctgagggccccccaggcctgcccgggaagcacggggccagcggccccccaggcaacaagggggccaagggggacatggtggtgtcccgggtgaagggccacaagggggagcggggcccagatggccccccaggcttccctggccagcccggcagccacggcagagatggccacgccggggagaagggggaccccggccccccaggggaccatgaagatgccaccccaggcggcaagggcttccctggccccctgggccccccaggcaaggccggccctgtgggccccccaggcctgggcttccctggccccccaggagagcggggccaccctggggtgcccggccaccctggggtgcggggcccagatggcctgaagggccagaagggggacaccatcagctgcaatgtgacctacccaggccgccacggccccccaggctttgatggccccccaggccccaagggcttccctggcccccagggcgcccctggcctgagcggcagtgatggccacaagggccggcccggcaccccaggcacagctgagatccctggccccccaggcttccggggggacatgggagaccccggctttggaggagagaagggcagcagccctgtgggccccccaggccccccaggcagccctggggtgaatggccagaagggcatccctggggaccctgccttcggccacctgggccccccaggcaagaggggcctgagcggcgtgcccggcatcaagggccccaggggggaccccggctgccctggagctgagggccctgctggcatccctggcttcctgggcctgaagggccccaagggccgggagggccatgctggcttccctggggtgcccggccccccaggccacagctgtgagcggggggcccctggcatccctggccagcccggcctgcccggctacccaggcagccctggggcccctgggggcaagggccagcctggagatgtgggccccccaggccctgctggcatgaagggcctgcccggcctgcccggccggcctggggcccacggccccccaggcctgcccggcatccctggcccctttggagatgatggcctgcccggccccccaggccccaagggcccccggggcctgcccggcttccctggcttccctggagagcggggcaagccaggagctgagggctgccctggggccaagggggagcctggagagaagggcatgagcggcctgcccggggaccggggcctgcggggggccaagggggccatcggccccccaggagatgaaggagagatggccatcatcagccagaagggcaccccaggagagcccggccccccaggagatgatggcttccctggagagcggggggacaagggcaccccaggcatgcagggccggcggggggagcccggccgctatggccccccaggcttccacagaggagagcctggagagaagggccagcccggccccccaggccccccaggccccccaggcagcacaggcctgcggggcttcatcggcttccctggcctgcccggggaccagggcgagcccggcagccctggccccccaggcttcagcggcattgatggagcccggggccccaagggcaacaagggggaccctgccagccactttggacctcctggccccaagggggagcccggcagccctggctgccccggccactttggagccagcggggagcagggcctgcccggcatccagggcccccggggcagccctggccggcccggccccccaggcagcagcggccccccaggctgccctggggaccacggcatgcctggcctgcggggccagcccggggagatgggagaccccggcccccggggcctgcagggcgaccccggcatccctggccccccaggcatcaagggccccagcggcagccctggcctgaatggcctgcacggcctgaagggccagaagggcaccaagggggccagcggcctgcatgatgtgggccccccaggccctgtgggcatccctggcctgaagggggagcggggggaccccggcagccctggcatcagccccccaggcccccggggcaagaagggccccccaggccccccaggcagcagcggccccccaggccctgctggggccaccggccgggcccccaaggacatcccagaccccggccccccaggggaccagggccccccaggcccagatggccccaggggggcccctggccccccaggcctgcccggctctgtggacctgctgcggggggagcccggggactgtggcctgcccggccccccaggccccccaggccccccaggccccccaggctacaagggcttccctggctgtgatggcaaggatggccagaagggccctgtgggcttccctggcccccagggcccccacggcttccctggccccccaggagagaagggcctgcccggccccccaggcaggaagggccccaccggcctgcccggccccagaggagagcccggccccccagcagatgtggatgactgcccccgcatccctggcctgcccggggcccctggcatgaggggccctgagggcgccatgggcctgcccggcatgaggggccccagcggccctggctgcaagggggagcccggcctggatggccggcggggcgtggatggagtgcccggcagccctggccccccaggcaggaagggggacacaggagaagatggctacccaggcggccctggccccccaggccccatcggggaccccggccccaagggcttcggccctggctacctgggcggcttcctgctggtgctgcacagccagacagaccaggagcccacctgccccctgggcatgccccggctgtggacaggctacagcctgctgtacctggagggccaggagaaggcccacaaccaggacctgggcctggccggcagctgcctgcctgtgttcagcaccctgccctttgcctactgcaacatccaccaggtgtgccactacgcccagagaaatgacaggagctactggctggccagcgctgcccccctgcccatgatgcccctgtctgaggaggccatccggccctacgtgagccgctgtgctgtgtgtgaggccccagcccaggccgtggccgtgcacagccaggaccagagcatccccccctgcccccagacctggaggagcctgtggattggctacagcttcctgatgcacactggagctggggaccagggcggcggccaggccctgatgagccctggcagctgcctggaggacttccgggccgcccccttcctggagtgccagggccggcagggcacctgccacttctttgccaacaagtacagcttctggctgaccaccgtgaaggctgacctgcagttcagcagcgccccagccccagacaccctgaaggagagccaggcccagaggcagaagatcagccgctgccaggtgtgtgtgaagtacagctag

SEQ ID NO: 3223 - DNA, 5076 bp, Artificial Sequence
  Description of Artificial Sequence: Synthetic coding sequence
atgaagctgcggggcgtgtccctggccgccggcctcttcctgctggccctgagcctgtggggccagcctgctgaggccgccgcctgctacggctgcagccctggcagcaaatgtgactgcagcggcatcaagggggagaagggggagcggggcttccctggcctggagggccaccctggcctgcccggcttccctggccctgagggccccccaggcccccggggccagaagggagatgatggcatccctggccccccaggccccaagggcatccggggccccccaggcctgcccggcttccctggcaccccaggcctgcccggcatgcctggccatgatggagcccctggcccccagggcatccctggctgcaatggcaccaagggggagcggggcttccctggcagccctggcttccctggcctgcagggccccccaggccccccaggcatccctggcatgaagggggagcccggcagcatcatcatgagcagcctgcccggccccaagggcaaccctggctacccaggccccccaggcatccagggcctgcccggccccaccggcatccctggccccatcggccccccaggccccccaggcctgatgggccccccaggccccccaggcctgcccggccccaagggcaacatgggcctgaacttccagggccccaagggggagaagggggagcagggcctgcagggccccccaggccccccaggccagatcagcgagcagaagaggcccattgatgtggagttccagaagggggaccagggcctgcccggggaccggggccccccaggccccccaggcatccggggccccccaggccccccaggaggagagaagggggagaagggggagcagggcgagcccgggaagaggggcaagccaggcaaggatggagaaaatggccagcccggcatccctggcctgcccggggaccccggctacccaggagagcccggcagagatggagagaagggccagaagggggacaccggccccccaggccccccaggcctggtgatccccaggcctggcaccggcatcaccatcggggagaagggcaacatcggcctgcccggcctgcctggagagaagggggagcggggcttccctggcatccagggccccccaggcctgcccggccccccaggagctgctgtgatgggccccccaggccccccaggcttccctggagagcggggccagaagggagatgagggccccccaggcatcagcatccctggccccccaggcctggatggccagcccggggcccctggcctgcccggccccccaggccctgctggcccccacatccccccatctgatgagatctgtgagcccggccccccaggccccccaggcagccctggggacaagggcctgcagggcgagcagggcgtgaagggggacaagggggacacctgcttcaactgcattggaacaggcatcagcggccccccaggccagcccggcctgcccggcctgcccggccccccaggcagcctgggcttccctggccagaagggggagaagggccaggccggggccaccggccccaagggcctgcccggcatccctggggcccctggggcccctggcttccctggcagcaagggggagcccggggacatcctgaccttccctggcatgaagggggacaagggggagctgggcagccctggggcccctggcctgcccggcctgcccggcaccccaggccaggacggcctgcccggcctgcccggccccaagggggagcccggcggcatcaccttcaagggggagcggggccccccaggcaaccctggcctgcccggcctgcccggcaacatcggccccatgggccccccaggctttggacctcctggccctgtgggggagaagggcatccagggcgtggccggcaaccctggccagcccggcatccctggccccaagggggaccccggccagaccatcacccagcccgggaagccaggcctgcccggcaaccctggaagagatggagatgtgggcctgcccggggaccccggcctgcccggccagcccggcctgcccggcatccctggcagcaagggggagcccggcatccctggcatcggcctgcccggccccccaggccccaagggcttccctggcatccctggccccccaggggcccctggcaccccaggaagaattggcctggagggccccccaggccccccaggcttccctggccccaagggggagcccggctttgccctgcccggccccccaggccccccaggcctgcccggcttcaagggggccctgggccccaagggggaccggggcttccctggccccccaggccccccaggccgcacaggcctggatggcctgcccggccccaagggagatgtgggccccaacggccagcccggccccatgggccccccaggcctgcccggcatcggcgtgcagggccccccaggccccccaggcatccctggccccatcggccagcccggcctgcacggcatccctggagagaagggggaccccggccccccaggcctggatgtgcccggccccccaggagagcggggcagccctggcatccctggggcccctggccccatcggccccccaggcagccctggcctgcccgggaaggccggggccagcggcttccctggcaccaagggggagatgggcatgatgggccccccaggccccccaggccccctgggcatccctggccgcagcggcgtgcccggcctgaagggagatgatggcctgcagggccagcccggcctgcccggccccactggagagaagggcagcaaaggagagcccggcctgcccggccccccaggccccatggaccccaacctgctgggcagcaaaggagagaagggggagcccggcctgcccggcatccctggggtgtctggccccaagggctaccagggcctgcccggggaccccggccagcccggcctgagcggccagcccggcctgcccggccccccaggccccaagggcaaccctggcctgcccggccagcccggcctcatcggccccccaggcctgaagggcaccatcggggacatgggcttccctggcccccagggcgtggagggccccccaggccccagcggcgtgcccggccagcccggcagccctggcctgcccggccagaagggggacaagggggaccccggcatcagcagcatcggcctgcccggcctgcccggccccaagggggagcccggcctgcccggctacccaggcaaccctggcatcaagggctctgtgggggaccccggcctgcccggcctgcccggcacccctggggccaagggccagcccggcctgcccggcttccctggcaccccaggccccccaggccccaagggcatcagcggccccccaggcaaccctggcctgcctggagagcccggccctgtgggcggcggcggccaccctggccagcccggccccccaggagagaagggcaagccaggccaggacggcatccctggccctgctggccagaagggggagcccggccagcccggctttggaaatcctggccccccaggcctgcccggcctgagcggccagaagggagatggcggcctgcccggcatccctggcaaccctggcctgcccggccccaagggggagcccggcttccacggcttccctggggtgcagggccccccaggccccccaggcagccctggccctgccctggagggccccaagggcaaccctggcccccagggccccccaggccggcccggccccaccggcttccagggcctgcccggccctgagggccccccaggcctgcctggaaatggaggcatcaagggggagaagggcaaccctggccagcccggcctgcccggcctgcccggcctgaagggggaccagggccccccaggcctgcagggcaaccctggccggcccggcctgaatggcatgaagggggaccccggcctgcccggggtgcccggcttccctggcatgaagggccccagcggcgtgcccggcagcgctggccctgagggggagcccggcctgattggccccccaggccccccaggcctgcccggccccagcggccagagcatcatcatcaagggagatgctggccccccaggcatccctggccagcccggcctgaagggcctgcccggcccccagggcccccagggcctgcccggccccaccggccccccaggggaccccggcagaaatggcctgcccggctttgatggagctgggggcaggaaaggagaccccggcctgcccggccagcccggcacccggggcctggatggccccccaggcccagatggcctgcagggccccccaggccccccaggcaccagctctgtggcccacggcttcctgatcaccaggcacagccagaccacagatgccccccagtgcccccagggcaccctgcaggtgtatgagggcttcagcctgctgtatgtgcagggcaacaagagggcccacggccaggacctgggcacagctggcagctgcctgcggcgcttcagcaccatgcccttcatgttctgcaacatcaacaacgtgtgcaactttgccagcagaaatgactacagctactggctgagcaccccagagcccatgcccatgtccatgcagcccctgaagggccagagcatccagcccttcatcagccgctgtgctgtgtgtgaggccccagctgtggtgattgctgtgcacagccagaccatccagatcccccactgcccccagggctgggacagcctgtggattggctacagcttcatgatgcacaccagcgctggagctgagggcagcggccaggccctggccagccctggcagctgcctggaggagttccgcagcgcccccttcattgaatgtcatggccggggcacctgcaactactatgccaacagctacagcttctggctggccaccgtggatgtgtctgacatgttcagcaagccccagagcgagaccctgaaggccggggacctgcggacccgcatcagccgctgccaggtgtgcatgaagaggacatag

SEQ ID NO: 3224 - DNA, 5058 bp, Artificial Sequence
  Description of Artificial Sequence: Synthetic coding sequence
atgaagctgcggggcgtgtccctggccgccggcctcttcctgctggccctgagcctgtggggccagcctgctgaggccgccgcctgctacggctgcagccctggcagcaaatgtgactgcagcggcatcaagggggagaagggggagcggggcttccctggcctggagggccaccctggcctgcccggcttccctggccctgagggccccccaggcccccggggccagaagggagatgatggcatccctggccccccaggccccaagggcatccggggccccccaggcctgcccggcttccctggcaccccaggcctgcccggcatgcctggccatgatggagcccctggcccccagggcatccctggctgcaatggcaccaagggggagcggggcttccctggcagccctggcttccctggcctgcagggccccccaggccccccaggcatccctggcatgaagggggagcccggcagcatcatcatgagcagcctgcccggccccaagggcaaccctggctacccaggccccccaggcatccagggcctgcccggccccaccggcatccctggccccatcggccccccaggccccccaggcctgatgggccccccaggccccccaggcctgcccggccccaagggcaacatgggcctgaacttccagggccccaagggggagaagggggagcagggcctgcagggccccccaggccccccaggccagatcagcgagcagaagaggcccattgatgtggagttccagaagggggaccagggcctgcccggggaccggggccccccaggccccccaggcatccggggccccccaggccccccaggaggagagaagggggagaagggggagcagggcgagcccgggaagaggggcaagccaggcaaggatggagaaaatggccagcccggcatccctggcctgcccggggaccccggctacccaggagagcccggcagagatggagagaagggccagaagggggacaccggccccccaggccccccaggcctggtgatccccaggcctggcaccggcatcaccatcggggagaagggcaacatcggcctgcccggcctgcctggagagaagggggagcggggcttccctggcatccagggccccccaggcctgcccggccccccaggagctgctgtgatgggccccccaggccccccaggcttccctggagagcggggccagaagggagatgagggccccccaggcatcagcatccctggccccccaggcctggatggccagcccggggcccctggcctgcccggccccccaggccctgctggcccccacatccccccatctgatgagatctgtgagcccggccccccaggccccccaggcagccctggggacaagggcctgcagggcgagcagggcgtgaagggggacaagggggacacctgcttcaactgcattggaacaggcatcagcggccccccaggccagcccggcctgcccggcctgcccggccccccaggcagcctgggcttccctggccagaagggggagaagggccaggccggggccaccggccccaagggcctgcccggcatccctggggcccctggggcccctggcttccctggcagcaagggggagcccggggacatcctgaccttccctggcatgaagggggacaagggggagctgggcagccctggggcccctggcctgcccggcctgcccggcaccccaggccaggacggcctgcccggcctgcccggccccaagggggagcccggcggcatcaccttcaagggggagcggggccccccaggcaaccctggcctgcccggcctgcccggcaacatcggccccatgggccccccaggctttggacctcctggccctgtgggggagaagggcatccagggcgtggccggcaaccctggccagcccggcatccctggccccaagggggaccccggccagaccatcacccagcccgggaagccaggcctgcccggcaaccctggaagagatggagatgtgggcctgcccggggaccccggcctgcccggccagcccggcctgcccggcatccctggcagcaagggggagcccggcatccctggcatcggcctgcccggccccccaggccccaagggcttccctggcatccctggccccccaggggcccctggcaccccaggaagaattggcctggagggccccccaggccccccaggcttccctggccccaagggggagcccggctttgccctgcccggccccccaggccccccaggcctgcccggcttcaagggggccctgggccccaagggggaccggggcttccctggccccccaggccccccaggccgcacaggcctggatggcctgcccggccccaagggagatgtgggccccaacggccagcccggccccatgggccccccaggcctgcccggcatcggcgtgcagggccccccaggccccccaggcatccctggccccatcggccagcccggcctgcacggcatccctggagagaagggggaccccggccccccaggcctggatgtgcccggccccccaggagagcggggcagccctggcatccctggggcccctggccccatcggccccccaggcagccctggcctgcccgggaaggccggggccagcggcttccctggcaccaagggggagatgggcatgatgggccccccaggccccccaggccccctgggcatccctggccgcagcggcgtgcccggcctgaagggagatgatggcctgcagggccagcccggcctgcccggccccactggagagaagggcagcaaaggagagcccggcctgcccggccccccaggccccatggaccccaacctgctgggcagcaaaggagagaagggggagcccggcctgcccggcatccctggggtgtctggccccaagggctaccagggcctgcccggggaccccggccagcccggcctgagcggccagcccggcctgcccggccccccaggccccaagggcaaccctggcctgcccggccagcccggcctcatcggccccccaggcctgaagggcaccatcggggacatgggcttccctggcccccagggcgtggagggccccccaggccccagcggcgtgcccggccagcccggcagccctggcctgcccggccagaagggggacaagggggaccccggcatcagcagcatcggcctgcccggcctgcccggccccaagggggagcccggcctgcccggctacccaggcaaccctggcatcaagggctctgtgggggaccccggcctgcccggcctgcccggcacccctggggccaagggccagcccggcctgcccggcttccctggcaccccaggccccccaggccccaagggcatcagcggccccccaggcaaccctggcctgcctggagagcccggccctgtgggcggcggcggccaccctggccagcccggccccccaggagagaagggcaagccaggccaggacggcatccctggccctgctggccagaagggggagcccggccagcccggctttggaaatcctggccccccaggcctgcccggcctgagcggccagaagggagatggcggcctgcccggcatccctggcaaccctggcctgcccggccccaagggggagcccggcttccacggcttccctggggtgcagggccccccaggccccccaggcagccctggccctgccctggagggccccaagggcaaccctggcccccagggccccccaggccggcccggcctgcccggccctgagggccccccaggcctgcctggaaatggaggcatcaagggggagaagggcaaccctggccagcccggcctgcccggcctgcccggcctgaagggggaccagggccccccaggcctgcagggcaaccctggccggcccggcctgaatggcatgaagggggaccccggcctgcccggggtgcccggcttccctggcatgaagggccccagcggcgtgcccggcagcgctggccctgagggggagcccggcctgattggccccccaggccccccaggcctgcccggccccagcggccagagcatcatcatcaagggagatgctggccccccaggcatccctggccagcccggcctgaagggcctgcccggcccccagggcccccagggcctgcccggccccaccggccccccaggggaccccggcagaaatggcctgcccggctttgatggagctgggggcaggaaaggagaccccggcctgcccggccagcccggcacccggggcctggatggccccccaggcccagatggcctgcagggccccccaggccccccaggcaccagctctgtggcccacggcttcctgatcaccaggcacagccagaccacagatgccccccagtgcccccagggcaccctgcaggtgtatgagggcttcagcctgctgtatgtgcagggcaacaagagggcccacggccaggacctgggcacagctggcagctgcctgcggcgcttcagcaccatgcccttcatgttctgcaacatcaacaacgtgtgcaactttgccagcagaaatgactacagctactggctgagcaccccagagcccatgcccatgtccatgcagcccctgaagggccagagcatccagcccttcatcagccgctgtgctgtgtgtgaggccccagctgtggtgattgctgtgcacagccagaccatccagatcccccactgcccccagggctgggacagcctgtggattggctacagcttcatgatgcacaccagcgctggagctgagggcagcggccaggccctggccagccctggcagctgcctggaggagttccgcagcgcccccttcattgaatgtcatggccggggcacctgcaactactatgccaacagctacagcttctggctggccaccgtggatgtgtctgacatgttcagcaagccccagagcgagaccctgaaggccggggacctgcggacccgcatcagccgctgccaggtgtgcatgaagaggacatag

SEQ ID NO: 3225 - DNA, 5076 bp, Artificial Sequence
  Description of Artificial Sequence: Synthetic coding sequence
atgaagctgcggggcgtgtccctggccgccggcctcttcctgctggccctgagcctgtggggccagcctgctgaggccgccgcctgctacggctgcagccctggcagcaaatgtgactgcagcggcatcaagggggagaagggggagcggggcttccctggcctggagggccaccctggcctgcccggcttccctggccctgagggccccccaggcccccggggccagaagggagatgatggcatccctggccccccaggccccaagggcatccggggccccccaggcctgcccggcttccctggcaccccaggcctgcccggcatgcctggccatgatggagcccctggcccccagggcatccctggctgcaatggcaccaagggggagcggggcttccctggcagccctggcttccctggcctgcagggccccccaggccccccaggcatccctggcatgaagggggagcccggcagcatcatcatgagcagcctgcccggccccaagggcaaccctggctacccaggccccccaggcatccagggcctgcccggccccaccggcatccctggccccatcggccccccaggccccccaggcctgatgggccccccaggccccccaggcctgcccggccccaagggcaacatgggcctgaacttccagggccccaagggggagaagggggagcagggcctgcagggccccccaggccccccaggccagatcagcgagcagaagaggcccattgatgtggagttccagaagggggaccagggcctgcccggggaccggggccccccaggccccccaggcatccggggccccccaggccccccaggaggagagaagggggagaagggggagcagggcgagcccgggaagaggggcaagccaggcaaggatggagaaaatggccagcccggcatccctggcctgcccggggaccccggctacccaggagagcccggcagagatggagagaagggccagaagggggacaccggccccccaggccccccaggcctggtgatccccaggcctggcaccggcatcaccatcggggagaagggcaacatcggcctgcccggcctgcctggagagaagggggagcggggcttccctggcatccagggccccccaggcctgcccggccccccaggagctgctgtgatgggccccccaggccccccaggcttccctggagagcggggccagaagggagatgagggccccccaggcatcagcatccctggccccccaggcctggatggccagcccggggcccctggcctgcccggccccccaggccctgctggcccccacatccccccatctgatgagatctgtgagcccggccccccaggccccccaggcagccctggggacaagggcctgcagggcgagcagggcgtgaagggggacaagggggacacctgcttcaactgcattggaacaggcatcagcggccccccaggccagcccggcctgcccggcctgcccggccccccaggcagcctgggcttccctggccagaagggggagaagggccaggccggggccaccggccccaagggcctgcccggcatccctggggcccctggggcccctggcttccctggcagcaagggggagcccggggacatcctgaccttccctggcatgaagggggacaagggggagctgggcagccctggggcccctggcctgcccggcctgcccggcaccccaggccaggacggcctgcccggcctgcccggccccaagggggagcccggcggcatcaccttcaagggggagcggggccccccaggcaaccctggcctgcccggcctgcccggcaacatcggccccatgggccccccaggctttggacctcctggccctgtgggggagaagggcatccagggcgtggccggcaaccctggccagcccggcatccctggccccaagggggaccccggccagaccatcacccagcccgggaagccaggcctgcccggcaaccctggaagagatggagatgtgggcctgcccggggaccccggcctgcccggccagcccggcctgcccggcatccctggcagcaagggggagcccggcatccctggcatcggcctgcccggccccccaggccccaagggcttccctggcatccctggccccccaggggcccctggcaccccaggaagaattggcctggagggccccccaggccccccaggcttccctggccccaagggggagcccggctttgccctgcccggccccccaggccccccaggcctgcccggcttcaagggggccctgggccccaagggggaccggggcttccctggccccccaggccccccaggccgcacaggcctggatggcctgcccggccccaagggagatgtgggccccaacggccagcccggccccatgggccccccaggcctgcccggcatcggcgtgcagggccccccaggccccccaggcatccctggccccatcggccagcccggcctgcacggcatccctggagagaagggggaccccggccccccaggcctggatgtgcccggccccccaggagagcggggcagccctggcatccctggggcccctggccccatcggccccccaggcagccctggcctgcccgggaaggccggggccagcggcttccctggcaccaagggggagatgggcatgatgggccccccaggccccccaggccccctgggcatccctggccgcagcggcgtgcccggcctgaagggagatgatggcctgcagggccagcccggcctgcccggccccactggagagaagggcagcaaaggagagcccggcctgcccggccccccaggccccatggaccccaacctgctgggcagcaaaggagagaagggggagcccggcctgcccggcatccctggggtgtctggccccaagggctaccagggcctgcccggggaccccggccagcccggcctgagcggccagcccggcctgcccggccccccaggccccaagggcaaccctggcctgcccggccagcccggcctcatcggccccccaggcctgaagggcaccatcggggacatgggcttccctggcccccagggcgtggagggccccccaggccccagcggcgtgcccggccagcccggcagccctggcctgcccggccagaagggggacaagggggaccccggcatcagcagcatcggcctgcccggcctgcccggccccaagggggagcccggcctgcccggctacccaggcaaccctggcatcaagggctctgtgggggaccccggcctgcccggcctgcccggcacccctggggccaagggccagcccggcctgcccggcttccctggcaccccaggccccccaggccccaagggcatcagcggccccccaggcaaccctggcctgcctggagagcccggccctgtgggcggcggcggccaccctggccagcccggccccccaggagagaagggcaagccaggccaggacggcatccctggccctgctggccagaagggggagcccggccagcccggctttggaaatcctggccccccaggcctgcccggcctgagcggccagaagggagatggcggcctgcccggcatccctggcaaccctggcctgcccggccccaagggggagcccggcttccacggcttccctggggtgcagggccccccaggccccccaggcagccctggccctgccctggagggccccaagggcaaccctggcccccagggccccccaggccggcccggccccaccggcttccagagcctgcccggccctgagggccccccaggcctgcctggaaatggaggcatcaagggggagaagggcaaccctggccagcccggcctgcccggcctgcccggcctgaagggggaccagggccccccaggcctgcagggcaaccctggccggcccggcctgaatggcatgaagggggaccccggcctgcccggggtgcccggcttccctggcatgaagggccccagcggcgtgcccggcagcgctggccctgagggggagcccggcctgattggccccccaggccccccaggcctgcccggccccagcggccagagcatcatcatcaagggagatgctggccccccaggcatccctggccagcccggcctgaagggcctgcccggcccccagggcccccagggcctgcccggccccaccggccccccaggggaccccggcagaaatggcctgcccggctttgatggagctgggggcaggaaaggagaccccggcctgcccggccagcccggcacccggggcctggatggccccccaggcccagatggcctgcagggccccccaggccccccaggcaccagctctgtggcccacggcttcctgatcaccaggcacagccagaccacagatgccccccagtgcccccagggcaccctgcaggtgtatgagggcttcagcctgctgtatgtgcagggcaacaagagggcccacggccaggacctgggcacagctggcagctgcctgcggcgcttcagcaccatgcccttcatgttctgcaacatcaacaacgtgtgcaactttgccagcagaaatgactacagctactggctgagcaccccagagcccatgcccatgtccatgcagcccctgaagggccagagcatccagcccttcatcagccgctgtgctgtgtgtgaggccccagctgtggtgattgctgtgcacagccagaccatccagatcccccactgcccccagggctgggacagcctgtggattggctacagcttcatgatgcacaccagcgctggagctgagggcagcggccaggccctggccagccctggcagctgcctggaggagttccgcagcgcccccttcattgaatgtcatggccggggcacctgcaactactatgccaacagctacagcttctggctggccaccgtggatgtgtctgacatgttcagcaagccccagagcgagaccctgaaggccggggacctgcggacccgcatcagccgctgccaggtgtgcatgaagaggacatag

SEQ ID NO: 3226 - DNA, 5073 bp, Artificial Sequence
  Description of Artificial Sequence: Synthetic coding sequence
atgcaccctggcctgtggctgctgctggtgaccctgtgcctgacagaggagctggccgctgctggggagaagagctatggcaagccctgtggcggccaggactgcagcggcagctgccagtgcttccctgagaagggggcccggggccggcccggccccatcggcatccagggccccaccggcccccagggcttcaccggcagcacaggcctgagcggcctgaagggggagcggggcttccctggcctgctgggcccctacggccccaagggggacaagggccccatgggcgtgcccggcttcctgggcatcaatggcatccctggccaccctggccagcccggcccccggggccccccaggcctggatggctgcaatggcacccagggcgctgtgggcttccctggcccagatggctacccaggcctgctgggccccccaggcctgcccggccagaagggcagcaagggggaccctgtgctggcccctggcagcttcaagggcatgaagggggaccccggcctgcccggcctggatggcatcaccggcccccagggcgcccctggcttccctggagctgtgggccctgctggccccccaggcctgcagggccccccaggccccccaggccccctgggcccagatggcaacatgggcctgggcttccagggcgagaagggcgtgaagggagatgtgggcctgcccggccctgctggccccccacccagcactggagagctggagttcatgggcttccccaagggcaagaagggcagcaagggggagcccggccccaagggcttccctggcatcagcggccccccaggcttccctggcctgggcaccactggagagaagggggagaagggggagaagggcatccctggcctgcccggcccccggggccccatgggcagcgagggcgtgcagggccccccaggccagcagggcaagaagggcaccctgggcttccctggcctgaatggcttccagggcatcgagggccagaagggggacatcggcctgcccggcccagatgtgttcattgatattgatggagctgtgatcagcggcaaccctggggaccccggggtgcccggcctgcccggcctgaagggagatgagggcatccagggcctgcggggccccagcggcgtgcccggcctgcctgccctgtctggagtgcctggggccctgggcccccagggcttccctggcctgaagggggaccagggcaaccctggccgcaccaccatcggggccgccggcctgcccggcagagatggcctgcccggccccccaggccccccaggcccccccagccctgagtttgaaacagagaccctgcacaacaaggagagcggcttccctggcctgcggggggagcagggccccaagggcaacctgggcctgaagggcatcaagggggacagcggcttctgtgcctgtgatggcggcgtgcccaacacaggccccccaggagagcccggccccccaggcccctggggcctgattggcctgcccggcctgaagggggcccggggggaccggggcagcggcggggcccagggccctgctggggcccctggcctggtgggccccctgggccccagcggccccaagggcaagaagggggagcccatcctgagcaccatccagggcatgcctggggacagaggagacagcggcagccagggcttccggggcgtgattggagagcccgggaaggatggagtgcccggcctgcccggcctgcccggcctgcctggagatggcggccagggcttccctggagagaagggcctgcccggcctgcccggggagaagggccaccctggccccccaggcctgcctggaaatggcctgcccggcctgcccggcccccggggcctgcccggggacaagggcaaggatggcctgcccggccagcagggcctgcccggcagcaagggcatcaccctgccctgcatcatccctggcagctatggccccagcggcttccctggcaccccaggcttccctggccccaagggcagccggggcctgcccggcaccccaggccagcccggcagcagcggcagcaaaggagagcccggcagccctggcctggtgcacctgcctgagctgcccggcttccctggccccagaggagagaagggcctgcccggcttccctggcctgcccgggaaggatggcctgcccggcatgattggcagccctggcctgcccggcagcaagggggccactggagacatctttggagcagaaaatggagcccctggagagcagggcctgcagggcctgaccggccacaagggcttcctgggggacagcggcctgcccggcctgaagggcgtgcacggcaagccaggcctgctgggccccaagggggagcggggcagccctggcaccccaggccaggtgggccagcccggcaccccaggcagcagcggcccctacggcatcaagggcaagagcggcctgcccggggcccctggcttccctggcatcagcggccaccctgggaagaagggcacccggggcaagaagggccccccaggcagcatcgtgaagaagggcctgcccggcctgaagggcctgcccggcaaccctggcctggtgggcctgaagggcagccctggcagccctggggtggccggcctgcctgccctgagcggccccaagggggagaagggctctgtgggctttgtgggcttccctggcatccctggcctgcccggcatccctggcacccggggcctgaagggcatccctggcagcacaggcaagatgggccccagcggccgggccggcaccccaggagagaagggggaccggggcaaccctggccctgtgggcatccccagcccccggcggcccatgagcaacctgtggctgaagggggacaagggcagccagggcagcgctggcagcaatggcttccctggccccaggggggacaagggggaggccggccggcccggccccccaggcctgcccggggcccctggcctgcccggcatcatcaagggcgtgtctgggaagccaggccccccaggcttcatgggcatccggggcctgcccggcctgaagggcagcagcggcatcaccggcttccctggcatgcctggagagagcggcagccagggcatccggggcagccctggcctgcccggggccagcggcctgcccggcctgaagggggacaatggccagacagtggagatcagcggcagccctggccccaagggccagcccggggagagcggcttcaagggcaccaagggcagagatggcctgattggcaacatcggcttccctggcaacaagggggaggatggcaaggtgggcgtgtctggagatgtgggcctgcccggggcccctggcttccctggggtggccggcatgagaggagagcccggcctgcccggcagcagcggccaccagggcgccatcggccccctgggcagccctggcctgattggccccaagggcttccctggcttccctggcctgcacggcctgaatggcctgcccggcaccaagggcacccacggcaccccaggccccagcatcactggagtgcccggccctgctggcctgcccggccccaagggggagaagggctacccaggcattggaattggagcccctgggaagccaggcctgcggggccagaagggggaccggggcttccctggcctgcagggccctgctggcctgcccggggcccctggcatcagcctgcccagcctgattgctggccagcccggggaccccggccggcccggcctggatggagagcggggccggcccggccctgctggccccccaggccccccaggccccagcagcaaccagggcgacaccggggaccccggcttccctggcatccctggccccaagggccccaagggggaccagggcatccctggcttcagcggcctgcctggagagctgggcctgaagggcatgagaggagagcccggcttcatgggcaccccaggcaaggtgggccccccaggggaccccggcttccctggcatgaagggcaaggccggcccccggggcagcagcggcctgcagggcgaccccggccagacccccacagctgaggccgtgcaggtgcccccaggccccctgggcctgcccggcattgatggcatccctggcctgactggagaccccggggcccagggccctgtgggcctgcagggcagcaagggcctgcccggcatccctgggaaggatggccccagcggcctgcccggccccccaggggccctgggggaccccggcctgcccggcctgcagggccccccaggctttgaaggagcccctggccagcagggccccttcggcatgcctggcatgcctggccagagcatgagggtgggctacaccctggtgaagcacagccagagcgagcaggtgcccccctgccccatcggcatgagccagctgtgggtgggctacagcctgctgtttgtggagggccaggagaaggcccacaaccaggacctgggctttgctggcagctgcctgccccgcttcagcaccatgcccttcatctactgcaacatcaatgaggtgtgccactacgccaggagaaatgacaagagctactggctgagcaccacagcccccatccccatgatgcctgtgtcccagacccagatcccccagtacatcagccgctgcagcgtgtgtgaggcccccagccaggccatcgctgtgcacagccaggacatcaccatcccccagtgccccctgggctggaggagcctgtggattggctacagcttcctgatgcacacagctgctggagctgagggcggcggccagagcctggtgtccccaggcagctgcctggaggacttccgggccacccccttcatcgagtgcagcggggcccggggcacctgccactactttgccaacaagtacagcttctggctgaccaccgtggaggagcggcagcagtttggagagctgcctgtgtctgagaccctgaaggccggccagctgcacaccagggtgagccgctgccaggtgtgcatgaagagcctgtag

SEQ ID NO: 3227 - DNA, 5076 bp, Artificial Sequence
  Description of Artificial Sequence: Synthetic coding sequence
atgctgatcaacaagctgtggctgctgctggtgaccctgtgcctgacagaggagctggccgccgccggggagaagagctatggcaagccctgtggcggccaggactgcagcggcagctgccagtgcttccctgagaagggggcccggggccggcccggccccatcggcatccagggccccaccggcccccagggcttcaccggcagcacaggcctgagcggcctgaagggggagcggggcttccctggcctgctgggcccctacggccccaagggggacaagggccccatgggcgtgcccggcttcctgggcatcaatggcatccctggccaccctggccagcccggcccccggggccccccaggcctggatggctgcaatggcacccagggcgctgtgggcttccctggcccagatggctacccaggcctgctgggccccccaggcctgcccggccagaagggcagcaaaggagaccctgtgctggcccctggcagcttcaagggcatgaagggggaccccggcctgcccggcctggatggcatcaccggcccccagggcgcccctggcttccctggagctgtgggccctgctggccccccaggcctgcagggccccccaggccccccaggccccctgggcccagatggcaacatgggcctgggcttccagggcgagaagggcgtgaagggagatgtgggcctgcccggccctgctggccccccacccagcactggagagctggagttcatgggcttccccaagggcaagaagggcagcaaaggagagcccggccccaagggcttccctggcatcagcggccccccaggcttccctggcctgggcaccaccggggagaagggggagaagggggagaagggcatccctggcctgcccggcccccggggccccatgggcagcgagggcgtgcagggccccccaggccagcagggcaagaagggcaccctgggcttccctggcctgaatggcttccagggcatcgagggccagaagggggacatcggcctgcccggcccagatgtgttcatcgacattgatggagctgtgatcagcggcaaccctggggaccccggggtgcccggcctgcccggcctgaagggagatgagggcatccagggcctgcggggccccagcggcgtgcccggcctgcctgccctgagcggcgtgcctggggccctgggcccccagggcttccctggcctgaagggggaccagggcaaccctggccgcaccaccatcggggctgctggcctgcccggcagagatggcctgcccggccccccaggccccccaggcccccccagccctgagtttgaaacagagaccctgcacaacaaggagagcggcttccctggcctgcggggggagcagggccccaagggcaacctgggcctgaagggcatcaagggggacagcggcttctgtgcctgtgatggaggagtgcccaacacaggccccccaggagagcccggccccccaggcccctggggcctcatcggcctgcccggcctgaagggggcccggggggaccggggcagcggcggggcccagggccctgctggggcccctggcctggtgggccccctgggccccagcggccccaagggcaagaagggggagcccatcctgagcaccatccagggcatgcctggggacagaggagacagcggcagccagggcttccggggcgtcatcggggagcccgggaaggatggagtgcccggcctgcccggcctgcccggcctgcctggagatggcggccagggcttccctggagagaagggcctgcccggcctgcctggagagaagggccaccctggccccccaggcctgcctggaaatggcctgcccggcctgcccggcccccggggcctgcccggggacaagggcaaggatggcctgcccggccagcagggcctgcccggcagcaagggcatcaccctgccctgcatcatccctggcagctatggccccagcggcttccctggcaccccaggcttccctggccccaagggcagccggggcctgcccggcaccccaggccagcccggcagcagcggcagcaagggggagcccggcagccctggcctggtgcacctgcctgagctgcccggcttccctggccccagaggagagaagggcctgcccggcttccctggcctgcccgggaaggatggcctgcccggcatgattggcagccctggcctgcccggcagcaaaggagccaccggggacatctttggagcagaaaatggagcccctggagagcagggcctgcagggcctgaccggccacaagggcttcctgggggacagcggcctgcccggcctgaagggcgtgcacggcaagccaggcctgctgggccccaagggggagcggggcagccctggcaccccaggccaggtgggccagcccggcaccccaggcagcagcggcccctacggcatcaagggcaagagcggcctgcccggggcccctggcttccctggcatcagcggccaccctgggaagaagggcacccggggcaagaagggccccccaggcagcatcgtgaagaagggcctgcccggcctgaagggcctgcccggcaaccctggcctggtgggcctgaagggcagccctggcagccctggggtggccggcctgcctgccctgagcggccccaagggggagaagggctctgtgggctttgtgggcttccctggcatccctggcctgcccggcatccctggcacccggggcctgaagggcatccctggcagcacaggcaagatgggccccagcggccgggccggcaccccaggagagaagggggaccggggcaaccctggccctgtgggcatccccagcccccggcggcccatgagcaacctgtggctgaagggggacaagggcagccagggcagcgctggcagcaatggcttccctggccccaggggggacaagggggaggccggccggcccggccccccaggcctgcccggggcccctggcctgcccggcatcatcaagggcgtgtctgggaagccaggccccccaggcttcatgggcatccggggcctgcccggcctgaagggcagcagcggcatcaccggcttccctggcatgcctggagagagcggcagccagggcatccggggcagccctggcctgcccggggccagcggcctgcccggcctgaagggggacaatggccagacagtggagatcagcggcagccctggccccaagggccagcctggagagagcggcttcaagggcaccaagggcagagatggcctcatcggcaacatcggcttccctggcaacaagggagaagatggcaaggtgggcgtgtctggagatgtgggcctgcccggggcccctggcttccctggggtggccggcatgagaggagagcccggcctgcccggcagcagcggccaccagggcgccatcggccccctgggcagccctggcctcatcggccccaagggcttccctggcttccctggcctgcacggcctgaatggcctgcccggcaccaagggcacccacggcaccccaggccccagcatcaccggggtgcccggccctgctggcctgcccggccccaagggggagaagggctacccaggcatcggcatcggggcccctgggaagccaggcctgcggggccagaagggggaccggggcttccctggcctgcagggccctgctggcctgcccggggcccctggcatcagcctgcccagcctgattgctggccagcccggggaccccggccggcccggcctggatggagagcggggccggcccggccctgctggccccccaggccccccaggccccagcagcaaccagggcgacacaggagaccccggcttccctggcatccctggccccaagggccccaagggggaccagggcatccctggcttcagcggcctgcccggggagctgggcctgaagggcatgagaggagagcccggcttcatgggcacccctgggaaggtgggccccccaggggaccccggcttccctggcatgaagggcaaggccggcccccggggcagcagcggcctgcagggcgaccccggccagacccccacagctgaggccgtgcaggtgcccccaggccccctgggcctgcccggcattgatggcatccctggcctgaccggggaccccggggcccagggccctgtgggcctgcagggcagcaagggcctgcccggcatccctgggaaggatggccccagcggcctgcccggccccccaggggccctgggggaccccggcctgcccggcctgcagggccccccaggctttgagggcgcccctggccagcagggccccttcggcatgcctggcatgcctggccagagcatgagggtgggctacaccctggtgaagcacagccagagcgagcaggtgcccccctgccccatcggcatgagccagctgtgggtgggctacagcctgctgtttgtggagggccaggagaaggcccacaaccaggacctgggctttgctggcagctgcctgccccgcttcagcaccatgcccttcatctactgcaacatcaatgaggtgtgccactacgccaggagaaatgacaagagctactggctgagcaccacagcccccatccccatgatgcctgtgtcccagacccagatcccccagtacatcagccgctgcagcgtgtgtgaggcccccagccaggccatcgctgtgcacagccaggacatcaccatcccccagtgccccctgggctggaggagcctgtggattggctacagcttcctgatgcacacagctgctggagctgagggcggcggccagagcctggtgtccccaggcagctgcctggaggacttccgggccacccccttcattgaatgttctggggcccggggcacctgccactactttgccaacaagtacagcttctggctgaccaccgtggaggagcggcagcagtttggagagctgcctgtgtctgagaccctgaaggccggccagctgcacaccagggtgagccgctgccaggtgtgcatgaagagcctgtag

SEQ ID NO: 3228 - DNA, 5076 bp, Artificial Sequence
  Description of Artificial Sequence: Synthetic coding sequence
atgcaccctggcctgtggctgctgctggtgaccctgtgcctgacagaggagctggccgctgctggggagaagagctatggcaagccctgtggcggccaggactgcagcggcagctgccagtgcttccctgagaagggggcccggggccggcccggccccatcggcatccagggccccaccggcccccagggcttcaccggcagcacaggcctgagcggcctgaagggggagcggggcttccctggcctgctgggcccctacggccccaagggggacaagaagttcagcatccctgtgctgctgatctatgacagcaggcctggccaccctggccagcccggcccccggggccccccaggcctggatggctgcaatggcacccagggcgctgtgggcttccctggcccagatggctacccaggcctgctgggccccccaggcctgcccggccagaagggcagcaaaggagaccctgtgctggcccctggcagcttcaagggcatgaaggccttcatccccctgtttgagagcatccggggcccccagggcgcccctggcttccctggagctgtgggccctgctggccccccaggcctgcagcagggccagccccccttcctggaggtgctcttcccccactggcatgaaggagaggaggccaaggtgcgggacagcctgtttggagatgtgggcctgcccggccctgctggccccccacccagcactggagagctggagttcatgggcttccccaagggcaagaagggcagcaagggggagcccggccccaagggcttccctggcatcagcggccccccaggcttccctggcctgggcaccactggagagaagggggagaagggggagaagggcatccctggcctgcccggccccaggaccctgctgtgcagccacaccttccacctggtggtgaccatgttcctgagccagggcaagaagggcaccctgggcttccctggcctgaatggcttccagggcatcgagggccagaagggggacatcggcctgcccggcccagatgtgttcatcgacattgatggagctgtgatcagcggcaaccctggggaccccggggtgcccggcctgcccggcctgaagggagatgagggcatccagggcctgcggggccccagcggcgtgcccggcctgcctgccctgagcggcgtgcctggggccctgggcccccagggcttccctggcctgaagggggaccagggcaaccctggccgcaccaccatcggggctgctggcctgcccggcagagatggcctgcccggccccccaggccccccaggcccccccagccctgagtttgaaacagagaccctgcacaacaaggagagcggcttccctggcctgcggggggagcagggccccaagggcaacctgggcctgaagggcatcaagggggacagcggcttctgtgcctgtgatggaggagtgcccaacacaggccccccaggagagcccggccccccaggcccctggggcctcatcggcctgcccggcctgaagggggcccggggggaccggggcagcggcggggcccagggccctgctggggcccctggcctggtgggccccctgggccccagcggccccaagggcaagaagggggagcccatcctgagcaccatccagggcatgcctggggacagaggagacagcggcagccagggcttccggggcgtcatcggggagcccgggaaggatggagtgcccggcctgcccggcctgcccggcctgcctggagatggcggccagggcttccctggagagaagggcctgcccggcctgcctggagagaagggccaccctggccccccaggcctgcctggaaatggcctgcccggcctgcccggcccccggggcctgcccggggacaagggcaaggatggcctgcccggccagcagggcctgcccggcagcaagggcatcaccctgccctgcatcatccctggcagctatggccccagcggcttccctggcaccccaggcttccctggccccaagggcagccggggcctgcccggcaccccaggccagcccggcagcagcggcagcaagggggagcccggcagccctggcctggtgcacctgcctgagctgcccggcttccctggccccagaggagagaagggcctgcccggcttccctggcctgcccgggaaggatggcctgcccggcatgattggcagccctggcctgcccggcagcaaaggagccaccggggacatctttggagcagaaaatggagcccctggagagcagggcctgcagggcctgaccggccacaagggcttcctgggggacagcggcctgcccggcctgaagggcgtgcacggcaagccaggcctgctgggccccaagggggagcggggcagccctggcaccccaggccaggtgggccagcccggcaccccaggcagcagcggcccctacggcatcaagggcaagagcggcctgcccggggcccctggcttccctggcatcagcggccaccctgggaagaagggcacccggggcaagaagggccccccaggcagcatcgtgaagaagggcctgcccggcctgaagggcctgcccggcaaccctggcctggtgggcctgaagggcagccctggcagccctggggtggccggcctgcctgccctgagcggccccaagggggagaagggctctgtgggctttgtgggcttccctggcatccctggcctgcccggcatccctggcacccggggcctgaagggcatccctggcagcacaggcaagatgggccccagcggccgggccggcaccccaggagagaagggggaccggggcaaccctggccctgtgggcatccccagcccccggcggcccatgagcaacctgtggctgaagggggacaagggcagccagggcagcgctggcagcaatggcttccctggccccaggggggacaagggggaggccggccggcccggccccccaggcctgcccggggcccctggcctgcccggcatcatcaagggcgtgtctgggaagccaggccccccaggcttcatgggcatccggggcctgcccggcctgaagggcagcagcggcatcaccggcttccctggcatgcctggagagagcggcagccagggcatccggggcagccctggcctgcccggggccagcggcctgcccggcctgaagggggacaatggccagacagtggagatcagcggcagccctggccccaagggccagcctggagagagcggcttcaagggcaccaagggcagagatggcctcatcggcaacatcggcttccctggcaacaagggagaagatggcaaggtgggcgtgtctggagatgtgggcctgcccggggcccctggcttccctggggtggccggcatgagaggagagcccggcctgcccggcagcagcggccaccagggcgccatcggccccctgggcagccctggcctcatcggccccaagggcttccctggcttccctggcctgcacggcctgaatggcctgcccggcaccaagggcacccacggcaccccaggccccagcatcaccggggtgcccggccctgctggcctgcccggccccaagggggagaagggctacccaggcatcggcatcggggcccctgggaagccaggcctgcggggccagaagggggaccggggcttccctggcctgcagggccctgctggcctgcccggggcccctggcatcagcctgcccagcctgattgctggccagcccggggaccccggccggcccggcctggatggagagcggggccggcccggccctgctggccccccaggccccccaggccccagcagcaaccagggcgacacaggagaccccggcttccctggcatccctggccccaagggccccaagggggaccagggcatccctggcttcagcggcctgcccggggagctgggcctgaagggcatgagaggagagcccggcttcatgggcacccctgggaaggtgggccccccaggggaccccggcttccctggcatgaagggcaaggccggcccccggggcagcagcggcctgcagggcgaccccggccagacccccacagctgaggccgtgcaggtgcccccaggccccctgggcctgcccggcattgatggcatccctggcctgaccggggaccccggggcccagggccctgtgggcctgcagggcagcaagggcctgcccggcatccctgggaaggatggccccagcggcctgcccggccccccaggggccctgggggaccccggcctgcccggcctgcagggccccccaggctttgagggcgcccctggccagcagggccccttcggcatgcctggcatgcctggccagagcatgagggtgggctacaccctggtgaagcacagccagagcgagcaggtgcccccctgccccatcggcatgagccagctgtgggtgggctacagcctgctgtttgtggagggccaggagaaggcccacaaccaggacctgggctttgctggcagctgcctgccccgcttcagcaccatgcccttcatctactgcaacatcaatgaggtgtgccactacgccaggagaaatgacaagagctactggctgagcaccacagcccccatccccatgatgcctgtgtcccagacccagatcccccagtacatcagccgctgcagcgtgtgtgaggcccccagccaggccatcgctgtgcacagccaggacatcaccatcccccagtgccccctgggctggaggagcctgtggattggctacagcttcctgatgcacacagctgctggagctgagggcggcggccagagcctggtgtccccaggcagctgcctggaggacttccgggccacccccttcattgaatgttctggggcccggggcacctgccactactttgccaacaagtacagcttctggctgaccaccgtggaggagcggcagcagtttggagagctgcctgtgtctgagaccctgaaggccggccagctgcacaccagggtgagccgctgccaggtgtgcatgaagagcctgtag

SEQ ID NO: 3229 - DNA, 783 bp, Artificial Sequence
  Description of Artificial Sequence: Synthetic coding sequence
atgctgcaggactggaaggagagagctgcctctgtgtggtgcaagtggctggatgtgaaccccaaccaccacctggtgaaggccccccagcctgacctgccctgcccctgccccctgagcctgctgcccggctttgctggcagctgcctgccccgcttcagcaccatgcccttcatctactgcaacatcaatgaggtgtgccactacgccaggagaaatgacaagagctactggctgagcaccacagcccccatccccatgatgcctgtgtcccagacccagatcccccagtacatcagccgctgcagcgtgtgtgaggcccccagccaggccatcgctgtgcacagccaggacatcaccatcccccagtgccccctgggctggaggagcctgtggattggctacagcttcctgatgcacacagctgctggagctgagggcggcggccagagcctggtgtccccaggcagctgcctggaggacttccgggccacccccttcattgaatgttctggggcccggggcacctgccactactttgccaacaagtacagcttctggctgaccaccgtggaggagcggcagcagtttggagagctgcctgtgtctgagaccctgaaggccggccagctgcacaccagggtgagccgctgccagcccggcttcaccggccctggcatcaaggagtggaagtggaagtggcaccacagccccagcgcccctgtgatccaccagcagaacttctgcttcctgttccccaggcactacgtgctgctggcctag

SEQ ID NO: 3230 - DNA, 4902 bp, Artificial Sequence
  Description of Artificial Sequence: Synthetic coding sequence
atgcaccctggcctgtggctgctgctggtgaccctgtgcctgacagaggagctggccgctgctggggagaagagctatggcaagccctgtggcggccaggactgcagcggcagctgccagtgcttccctgagaagggggcccggggccggcccggccccatcggcatccagggccccaccggcccccagggcttcaccggcagcacaggcctgagcggcctgaagggggagcggggcttccctggcctgctgggcccctacggccccaagggggacaagggccccatgggcgtgcccggcttcctgggcatcaatggcatccctggccaccctggccagcccggcccccggggccccccaggcctggatggctgcaatggcacccagggcgctgtgggcttccctggcccagatggctacccaggcctgctgggccccccaggcctgcccggccagaagggcagcaagggggaccctgtgctggcccctggcagcttcaagggcatgaagggggaccccggcctgcccggcctggatggcatcaccggcccccagggcgcccctggcttccctggagctgtgggccctgctggccccccaggcctgcagggccccccaggccccccaggccccctgggcccagatggcaacatgggcctgggcttccagggcgagaagggcgtgaagggagatgtgggcctgcccggccctgctggccccccacccagcactggagagctggagttcatgggcttccccaagggcaagaagggcagcaagggggagcccggccccaagggcttccctggcatcagcggccccccaggcttccctggcctgggcaccactggagagaagggggagaagggggagaagggcatccctggcctgcccggcccccggggccccatgggcagcgagggcgtgcagggccccccaggccagcagggcaagaagggcaccctgggcttccctggcctgaatggcttccagggcatcgagggccagaagggggacatcggcctgcccggcccagatgtgttcattgatattgatggagctgtgatcagcggcaaccctggggaccccggggtgcccggcctgcccggcctgaagggagatgagggcatccagggcctgcggggccccagcggcgtgcccggcctgcctgccctgtctggagtgcctggggccctgggcccccagggcttccctggcctgaagggggaccagggcaaccctggccgcaccaccatcggggccgccggcctgcccggcagagatggcctgcccggccccccaggccccccaggcccccccagccctgagtttgaaacagagaccctgcacaacaaggagagcggcttccctggcctgcggggggagcagggccccaagggcaacctgggcctgaagggcatcaagggggacagcggcttctgtgcctgtgatggcggcgtgcccaacacaggccccccaggagagcccggccccccaggcccctggggcctgattggcctgcccggcctgaagggggcccggggggaccggggcagcggcggggcccagggccctgctggggcccctggcctggtgggccccctgggccccagcggccccaagggcaagaagggggagcccatcctgagcaccatccagggcatgcctggggacagaggagacagcggcagccagggcttccggggcgtgattggagagcccgggaaggatggagtgcccggcctgcccggcctgcccggcctgcctggagatggcggccagggcttccctggagagaagggcctgcccggcctgcccggggagaagggccaccctggccccccaggcctgcctggaaatggcctgcccggcctgcccggcccccggggcctgcccggggacaagggcaaggatggcctgcccggccagcagggcctgcccggcagcaagggcatcaccctgccctgcatcatccctggcagctatggccccagcggcttccctggcaccccaggcttccctggccccaagggcagccggggcctgcccggcaccccaggccagcccggcagcagcggcagcaaaggagagcccggcagccctggcctggtgcacctgcctgagctgcccggcttccctggccccagaggagagaagggcctgcccggcttccctggcctgcccgggaaggatggcctgcccggcatgattggcagccctggcctgcccggcagcaagggggccactggagacatctttggagcagaaaatggagcccctggagagcagggcctgcagggcctgaccggccacaagggcttcctgggggacagcggcctgcccggcctgaagggcgtgcacggcaagccaggcctgctgggccccaagggggagcggggcagccctggcaccccaggccaggtgggccagcccggcaccccaggcagcagcggcccctacggcatcaagggcaagagcggcctgcccggggcccctggcttccctggcatcagcggccaccctgggaagaagggcacccggggcaagaagggccccccaggcagcatcgtgaagaagggcctgcccggcctgaagggcctgcccggcaaccctggcctggtgggcctgaagggcagccctggcagccctggggtggccggcctgcctgccctgagcggccccaagggggagaagggctctgtgggctttgtgggcttccctggcatccctggcctgcccggcatccctggcacccggggcctgaagggcatccctggcagcacaggcaagatgggccccagcggccgggccggcaccccaggagagaagggggaccggggcaaccctggccctgtgggcatccccagcccccggcggcccatgagcaacctgtggctgaagggggacaagggcagccagggcagcgctggcagcaatggcttccctggccccaggggggacaagggggaggccggccggcccggccccccaggcctgcccggggcccctggcctgcccggcatcatcaagggcgtgtctgggaagccaggccccccaggcttcatgggcatccggggcctgcccggcctgaagggcagcagcggcatcaccggcttccctggcatgcctggagagagcggcagccagggcatccggggcagccctggcctgcccggggccagcggcctgcccggcctgaagggggacaatggccagacagtggagatcagcggcagccctggccccaagggccagcccggggagagcggcttcaagggcaccaagggcagagatggcctgattggcaacatcggcttccctggcaacaagggggaggatggcaaggtgggcgtgtctggagatgtgggcctgcccggggcccctggcttccctggggtggccggcatgagaggagagcccggcctgcccggcagcagcggccaccagggcgccatcggccccctgggcagccctggcctgattggccccaagggccccagcatcactggagtgcccggccctgctggcctgcccggccccaagggggagaagggctacccaggcattggaattggagcccctgggaagccaggcctgcggggccagaagggggaccggggcttccctggcctgcagggccctgctggcctgcccggggcccctggcatcagcctgcccagcctgattgctggccagcccggggaccccggccggcccggcctggatggagagcggggccggcccggccctgctggccccccaggccccccaggccccagcagcaaccagggcgacaccggggaccccggcttccctggcatccctggccccaagggccccaagggggaccagggcatccctggcttcagcggcctgcctggagagctgggcctgaagggcagcagcggcctgcagggcgaccccggccagacccccacagctgaggccgtgcaggtgcccccaggccccctgggcctgcccggcattgatggcatccctggcctgaccggggaccccggggcccagggccctgtgggcctgcagggcagcaagggcctgcccggcatccctgggaaggatggccccagcggcctgcccggccccccaggggccctgggggaccccggcctgcccggcctgcagggccccccaggctttgagggcgcccctggccagcagggccccttcggcatgcctggcatgcctggccagagcatgagggtgggctacaccctggtgaagcacagccagagcgagcaggtgcccccctgccccatcggcatgagccagctgtgggtgggctacagcctgctgtttgtggagggccaggagaaggcccacaaccaggacctgggctttgctggcagctgcctgccccgcttcagcaccatgcccttcatctactgcaacatcaatgaggtgtgccactacgccaggagaaatgacaagagctactggctgagcaccacagcccccatccccatgatgcctgtgtcccagacccagatcccccagtacatcagccgctgcagcgtgtgtgaggcccccagccaggccatcgctgtgcacagccaggacatcaccatcccccagtgccccctgggctggaggagcctgtggattggctacagcttcctgatgcacacagctgctggagctgagggcggcggccagagcctggtgtccccaggcagctgcctggaggacttccgggccacccccttcattgaatgttctggggcccggggcacctgccactactttgccaacaagtacagcttctggctgaccaccgtggaggagcggcagcagtttggagagctgcctgtgtctgagaccctgaaggccggccagctgcacaccagggtgagccgctgccaggtgtgcatgaagagcctgtag

SEQ ID NO: 3231 - DNA, 5001 bp, Artificial Sequence
  Description of Artificial Sequence: Synthetic coding sequence
atgcaccctggcctgtggctgctgctggtgaccctgtgcctgacagaggagctggccgctgctggggagaagagctatggcaagccctgtggcggccaggactgcagcggcagctgccagtgcttccctgagaagggggcccggggccggcccggccccatcggcatccagggccccaccggcccccagggcttcaccggcagcacaggcctgagcggcctgaagggggagcggggcttccctggcctgctgggcccctacggccccaagggggacaagggccccatgggcgtgcccggcttcctgggcatcaatggcatccctggccaccctggccagcccggcccccggggccccccaggcctggatggctgcaatggcacccagggcgctgtgggcttccctggcccagatggctacccaggcctgctgggccccccaggcctgcccggccagaagggcagcaagggggaccctgtgctggcccctggcagcttcaagggcatgaagggggaccccggcctgcccggcctggatggcatcaccggcccccagggcgcccctggcttccctggagctgtgggccctgctggccccccaggcctgcagggccccccaggccccccaggccccctgggcccagatggcaacatgggcctgggcttccagggcgagaagggcgtgaagggagatgtgggcctgcccggccctgctggccccccacccagcactggagagctggagttcatgggcttccccaagggcaagaagggcagcaagggggagcccggccccaagggcttccctggcatcagcggccccccaggcttccctggcctgggcaccactggagagaagggggagaagggggagaagggcatccctggcctgcccggcccccggggccccatgggcagcgagggcgtgcagggccccccaggccagcagggcaagaagggcaccctgggcttccctggcctgaatggcttccagggcatcgagggccagaagggggacatcggcctgcccggcccagatgtgttcattgatattgatggagctgtgatcagcggcaaccctggggaccccggggtgcccggcctgcccggcctgaagggagatgagggcatccagggcctgcggggccccagcggcgtgcccggcctgcctgccctgtctggagtgcctggggccctgggcccccagggcttccctggcctgaagggggaccagggcaaccctggccgcaccaccatcggggccgccggcctgcccggcagagatggcctgcccggccccccaggccccccaggcccccccagccctgagtttgaaacagagaccctgcacaacaaggagagcggcttccctggcctgcggggggagcagggccccaagggcaacctgggcctgaagggcatcaagggggacagcggcttctgtgcctgtgatggcggcgtgcccaacacaggccccccaggagagcccggccccccaggcccctggggcctgattggcctgcccggcctgaagggggcccggggggaccggggcagcggcggggcccagggccctgctggggcccctggcctggtgggccccctgggccccagcggccccaagggcaagaagggggagcccatcctgagcaccatccagggcatgcctggggacagaggagacagcggcagccagggcttccggggcgtgattggagagcccgggaaggatggagtgcccggcctgcccggcctgcccggcctgcctggagatggcggccagggcttccctggagagaagggcctgcccggcctgcccggggagaagggccaccctggccccccaggcctgcctggaaatggcctgcccggcctgcccggcccccggggcctgcccggggacaagggcaaggatggcctgcccggccagcagggcctgcccggcagcaagggcatcaccctgccctgcatcatccctggcagctatggccccagcggcttccctggcaccccaggcttccctggccccaagggcagccggggcctgcccggcaccccaggccagcccggcagcagcggcagcaaaggagagcccggcagccctggcctggtgcacctgcctgagctgcccggcttccctggccccagaggagagaagggcctgcccggcttccctggcctgcccgggaaggatggcctgcccggcatgattggcagccctggcctgcccggcagcaagggggccactggagacatctttggagcagaaaatggagcccctggagagcagggcctgcagggcctgaccggccacaagggcttcctgggggacagcggcctgcccggcctgaagggcgtgcacggcaagccaggcctgctgggccccaagggggagcggggcagccctggcaccccaggccaggtgggccagcccggcaccccaggcagcagcggcccctacggcatcaagggcaagagcggcctgcccggggcccctggcttccctggcatcagcggccaccctgggaagaagggcacccggggcaagaagggccccccaggcagcatcgtgaagaagggcctgcccggcctgaagggcctgcccggcaaccctggcctggtgggcctgaagggcagccctggcagccctggggtggccggcctgcctgccctgagcggccccaagggggagaagggctctgtgggctttgtgggcttccctggcatccctggcctgcccggcatccctggcacccggggcctgaagggcatccctggcagcacaggcaagatgggccccagcggccgggccggcaccccaggagagaagggggaccggggcaaccctggccctgtgggcatccccagcccccggcggcccatgagcaacctgtggctgaagggggacaagggcagccagggcagcgctggcagcaatggcttccctggccccaggggggacaagggggaggccggccggcccggccccccaggcctgcccggggcccctggcctgcccggcatcatcaagggcgtgtctgggaagccaggccccccaggcttcatgggcatccggggcctgcccggcctgaagggcagcagcggcatcaccggcttccctggcatgcctggagagagcggcagccagggcatccggggcagccctggcctgcccggggccagcggcctgcccggcctgaagggggacaatggccagacagtggagatcagcggcagccctggccccaagggccagcccggggagagcggcttcaagggcaccaagggcagagatggcctgattggcaacatcggcttccctggcaacaagggggaggatggcaaggtgggcgtgtctggagatgtgggcctgcccggggcccctggcttccctggggtggccggcatgagaggagagcccggcctgcccggcagcagcggccaccagggcgccatcggccccctgggcagccctggcctgattggccccaagggccccagcatcactggagtgcccggccctgctggcctgcccggccccaagggggagaagggctacccaggcattggaattggagcccctgggaagccaggcctgcggggccagaagggggaccggggcttccctggcctgcagggccctgctggcctgcccggggcccctggcatcagcctgcccagcctgattgctggccagcccggggaccccggccggcccggcctggatggagagcggggccggcccggccctgctggccccccaggccccccaggccccagcagcaaccagggcgacaccggggaccccggcttccctggcatccctggccccaagggccccaagggggaccagggcatccctggcttcagcggcctgcctggagagctgggcctgaagggcatgagaggagagcccggcttcatgggcaccccaggcaaggtgggccccccaggggaccccggcttccctggcatgaagggcaaggccggcccccggggcagcagcggcctgcagggcgaccccggccagacccccacagctgaggccgtgcaggtgcccccaggccccctgggcctgcccggcattgatggcatccctggcctgactggagaccccggggcccagggccctgtgggcctgcagggcagcaagggcctgcccggcatccctgggaaggatggccccagcggcctgcccggccccccaggggccctgggggaccccggcctgcccggcctgcagggccccccaggctttgaaggagcccctggccagcagggccccttcggcatgcctggcatgcctggccagagcatgagggtgggctacaccctggtgaagcacagccagagcgagcaggtgcccccctgccccatcggcatgagccagctgtgggtgggctacagcctgctgtttgtggagggccaggagaaggcccacaaccaggacctgggctttgctggcagctgcctgccccgcttcagcaccatgcccttcatctactgcaacatcaatgaggtgtgccactacgccaggagaaatgacaagagctactggctgagcaccacagcccccatccccatgatgcctgtgtcccagacccagatcccccagtacatcagccgctgcagcgtgtgtgaggcccccagccaggccatcgctgtgcacagccaggacatcaccatcccccagtgccccctgggctggaggagcctgtggattggctacagcttcctgatgcacacagctgctggagctgagggcggcggccagagcctggtgtccccaggcagctgcctggaggacttccgggccacccccttcatcgagtgcagcggggcccggggcacctgccactactttgccaacaagtacagcttctggctgaccaccgtggaggagcggcagcagtttggagagctgcctgtgtctgagaccctgaaggccggccagctgcacaccagggtgagccgctgccaggtgtgcatgaagagcctgtag

SEQ ID NO: 3232 - DNA, 2037 bp, Artificial Sequence
  Description of Artificial Sequence: Synthetic coding sequence
atggcctggacagcccgggacagaggagccctgggcctgctgctgctgggcctgtgcctgtgtgccgcccagaggggccccccaggagagcagggccccccaggccccccaggccccccaggagtgcccggcattgatggcattgatggagaccggggccccaagggccccccaggccccccaggccctgctggggagcccgggaagccaggggcccctgggaagccaggcaccccaggagcagatggcctgactggaccagatggcagccctggcagcatcggcagcaagggccagaagggggagcccggggtgcccggcagccggggcttccctggccggggcatccctggccccccaggccccccaggcacagctggcctgcctggagagctgggccgggtgggccctgtgggggaccctggaagaagaggccccccaggccccccaggccccccaggcccccggggcaccatcggcttccatgatggagaccccctgtgccccaatgcctgccccccaggccgcagcggctacccaggcctgcccggcatgaggggccacaagggggccaagggggagattggagagcccggccggcagggccacaagggggaggagggggaccagggcgagctgggggaggtgggcgcccagggccccccaggggcccagggcctgcggggcatcactggaattgtgggggacaagggggagaagggggcccggggcctggatggagagcccggcccccagggcctgcccggggcccctggggaccagggccagaggggccccccaggagaggccggccccaagggggacagaggagctgagggcgcccggggcatccctggcctgcccggccccaagggggacaccggcctgcccggggtggatggaagagatggcatccctggcatgcctggcaccaagggggagcccgggaagccaggccccccaggagatgctggcctgcagggcctgcccggggtgcccggcatccctggggccaagggcgtggccggggagaagggcagcactggagcccctgggaagccaggccagatgggcaacagcggcaagccaggccagcagggccccccaggagaggtgggcccccggggcccccagggcctgcccggcagcagaggagagctgggccctgtgggcagccctggcctgcccgggaagctgggcagcctgggcagccctggcctgcccggcctgcccggccccccaggcctgcccggcatgaagggggaccggggcgtggtgggggagcccggccccaagggggagcagggcgccagcggggaggagggggaggccggggagcggggggagctgggggacatcggcctgcccggccccaagggcagcgctggcaaccctggagagcccggcctgcggggccctgagggcagccggggcctgcccggggtggagggcccccggggccccccaggcccccggggcgtgcagggcgagcagggcgccaccggcctgcccggggtgcagggccccccaggccgggcccccacagaccagcacatcaagcaggtgtgcatgagggtcatccaggagcactttgctgagatggccgccagcctgaagaggccagattctggggccaccggcctgcccggccggcccggccccccaggccccccaggccccccaggagaaaatggcttccctggccagatgggcatccggggcctgcccggcatcaagggccccccaggggccctgggcctgcggggccccaagggggacctgggggagaagggggagcggggccccccaggccggggccccaacggcctgcccggggccatcggcctgcccggggaccccggccctgccagctatggaagaaatggaagagatggagagcggggccccccaggagtggccggcatccctggggtgcccggccccccaggccccccaggcctgcccggcttctgtgagcccgccagctgcaccatgcaggccggccagagggccttcaacaagggccctgacccctag

SEQ ID NO: 3233 - DNA, 2766 bp, Artificial Sequence
  Description of Artificial Sequence: Synthetic coding sequence
atgaagacctgctggaagatccctgtgttcttctttgtgtgcagcttcctggagccctgggccagcgctgctgtgaagagaagaccccgcttccctgtgaacagcaacagcaatggaggaaatgagctgtgccccaagatcagaattggccaggatgacctgcccggctttgacctgatcagccagttccaggtggacaaggccgccagcagaagagccatccagagggtggtgggcagcgccaccctgcaggtggcctacaagctgggcaacaacgtggacttccgcatccccaccaggaacctgtaccccagcggcctgcctgaggagtacagcttcctgaccaccttcaggatgacaggcagcaccctgaagaagaactggaacatctggcagatccaggacagcagcggcaaggagcaggtgggcatcaagatcaatggccagacccagagcgtggtgttctcctacaagggcctggatggcagcctgcagacagctgccttcagcaacctgagcagcctgtttgacagccagtggcacaagatcatgattggagtggagaggagcagcgccaccctgtttgtggactgcaacagaattgagagcctgcccatcaagccccggggccccatcgacattgatggctttgctgtgctgggcaagctggccgacaacccccaggtgtctgtgccctttgagctgcagtggatgctgatccactgtgaccccctgcggccccggcgggagacctgccacgagctgcctgcccgcatcacccccagccagaccacagatgagcggggccccccaggagagcagggccccccaggccccccaggccccccaggagtgcccggcattgatggcattgatggagaccggggccccaagggccccccaggccccccaggccctgctggggagcccgggaagccaggggcccctgggaagccaggcaccccaggagcagatggcctgaccggcccagatggcagccctggcagcatcggcagcaagggccagaagggggagcccggggtgcccggcagccggggcttccctggccggggcatccctggccccccaggccccccaggcacagctggcctgcccggggagctgggccgggtgggccctgtgggggaccccggccggcggggccccccaggccccccaggccccccaggcccccggggcaccatcggcttccatgatggagaccccctgtgccccaatgcctgccccccaggccgcagcggctacccaggcctgcccggcatgaggggccacaagggggccaagggggagatcggggagcccggccggcagggccacaagggggaggagggggaccagggcgagctgggggaggtgggcgcccagggccccccaggggcccagggcctgcggggcatcaccggcatcgtgggggacaagggggagaagggggcccggggcctggatggagagcccggcccccagggcctgcccggggcccctggggaccagggccagaggggccccccaggagaggccggccccaagggggacagaggagctgagggcgcccggggcatccctggcctgcccggccccaagggggacaccggcctgcccggggtggatggaagagatggcatccctggcatgcctggcaccaagggggagcccgggaagccaggccccccaggagatgctggcctgcagggcctgcccggggtgcccggcatccctggggccaagggcgtggccggggagaagggcagcactggagcccctgggaagccaggccagatgggcaacagcggcaagccaggccagcagggccccccaggagaggtgggcccccggggcccccagggcctgcccggcagcagaggagagctgggccctgtgggcagccctggcctgcccgggaagctgggcagcctgggcagccctggcctgcccggcctgcccggccccccaggcctgcccggcatgaagggggacagaggagtggtgggggagcccggccccaagggggagcagggcgccagcggggaggagggggaggccggggagcggggggagctgggggacatcggcctgcccggccccaagggcagcgctggcaaccctggagagcccggcctgcggggccctgagggcagccggggcctgcccggggtggagggcccccggggccccccaggcccccggggcgtgcagggcgagcagggcgccaccggcctgcccggggtgcagggccccccaggccgggcccccacagaccagcacatcaagcaggtgtgcatgagggtcatccaggagcactttgctgagatggccgccagcctgaagaggccagacagcggggccaccggcctgcccggccggcccggccccccaggccccccaggccccccaggagaaaatggcttccctggccagatgggcatccggggcctgcccggcatcaagggccccccaggggccctgggcctgcggggccccaagggggacctgggggagaagggggagcggggccccccaggccggggccccaacggcctgcccggggccatcggcctgcccggggaccccggccctgccagctatggaagaaatggaagagatggagagcggggccccccaggagtggccggcatccctggggtgcccggccccccaggccccccaggcctgcccggcttctgtgagcccgccagctgcaccatgcaggccggccagagggccttcaacaagggccctgacccctag

SEQ ID NO: 3234 - DNA, 987 bp, Artificial Sequence
  Description of Artificial Sequence: Synthetic coding sequence
atgaagacctgctggaagatccctgtgttcttctttgtgtgcagcttcctggagccctgggccagcgctgctgtgaagagaagaccccgcttccctgtgaacagcaacagcaatggaggaaatgagctgtgccccaagatcagaattggccaggatgacctgcccggctttgacctgatcagccagttccaggtggacaaggccgccagcagaagagccatccagagggtggtgggcagcgccaccctgcaggtggcctacaagctgggcaacaacgtggacttccgcatccccaccaggaacctgtaccccagcggcctgcctgaggagtacagcttcctgaccaccttcaggatgacaggcagcaccctgaagaagaactggaacatctggcagatccaggacagcagcggcaaggagcaggtgggcatcaagatcaatggccagacccagagcgtggtgttctcctacaagggcctggatggcagcctgcagacagctgccttcagcaacctgagcagcctgtttgacagccagtggcacaagatcatgattggagtggagaggagcagcgccaccctgtttgtggactgcaacagaattgagagcctgcccatcaagccccggggccccatcgacattgatggctttgctgtgctgggcaagctggccgacaacccccaggtgtctgtgccctttgagctgcagtggatgctgatccactgtgaccccctgcggccccggcgggagacctgccacgagctgcctgcccgcatcacccccagccagaccacagatgagcggggccccccaggagagcagggccccccaggccccccaggccccccaggagtgcccggcattgatggcattgatggagaccggggccccaagggccccccaggccccccaggccctgctggggagcccgggaagccaggggcccctgggaagccaggcaccccaggagctgacaccagcccctag

SEQ ID NO: 3235 - DNA, 2037 bp, Artificial Sequence
  Description of Artificial Sequence: Synthetic coding sequence
atggcctggacagcccgggacagaggagccctgggcctgctgctgctgggcctgtgcctgtgtgccgcccagaggggccccccaggagagcagggccccccaggccccccaggccccccaggagtgcccggcattgatggcattgatggagaccggggccccaagggccccccaggccccccaggccctgctggggagcccgggaagccaggggcccctgggaagccaggcaccccaggagcagatggcctgactggaccagatggcagccctggcagcatcggcagcaagggccagaagggggagcccggggtgcccggcagccggggcttccctgggaagatcctgcccctgctgcagggccccccaggcacagctggcctgcctggagagctgggccgggtgggccctgtgggggaccctggaagaagaggccccccaggccccccaggccccccaggcccccggggcaccatcggcttccatgatggagaccccctgtgccccaatgcctgccccccaggccgcagcggctacccaggcctgcccggcatgaggggccacaagggggccaagggggagattggagagcccggccggcagggccacaagggggaggagggggaccagggcgagctgggggaggtgggcgcccagggccccccaggggcccagggcctgcggggcatcactggaattgtgggggacaagggggagaagggggcccggggcctggatggagagcccggcccccagggcctgcccggggcccctggggaccagggccagaggggccccccaggagaggccggccccaagggggacagaggagctgagggcgcccggggcatccctggcctgcccggccccaagggggacaccggcctgcccggggtggatggaagagatggcatccctggcatgcctggcaccaagggggagcccgggaagccaggccccccaggagatgctggcctgcagggcctgcccggggtgcccggcatccctggggccaagggcgtggccggggagaagggcagcactggagcccctgggaagccaggccagatgggcaacagcggcaagccaggccagcagggccccccaggagaggtgggcccccggggcccccagggcctgcccggcagcagaggagagctgggccctgtgggcagccctggcctgcccgggaagctgggcagcctgggcagccctggcctgcccggcctgcccggccccccaggcctgcccggcatgaagggggaccggggcgtggtgggggagcccggccccaagggggagcagggcgccagcggggaggagggggaggccggggagcggggggagctgggggacatcggcctgcccggccccaagggcagcgctggcaaccctggagagcccggcctgcggggccctgagggcagccggggcctgcccggggtggagggcccccggggccccccaggcccccggggcgtgcagggcgagcagggcgccaccggcctgcccggggtgcagggccccccaggccgggcccccacagaccagcacatcaagcaggtgtgcatgagggtcatccaggagcactttgctgagatggccgccagcctgaagaggccagattctggggccaccggcctgcccggccggcccggccccccaggccccccaggccccccaggagaaaatggcttccctggccagatgggcatccggggcctgcccggcatcaagggccccccaggggccctgggcctgcggggccccaagggggacctgggggagaagggggagcggggccccccaggccggggccccaacggcctgcccggggccatcggcctgcccggggaccccggccctgccagctatggaagaaatggaagagatggagagcggggccccccaggagtggccggcatccctggggtgcccggccccccaggccccccaggcctgcccggcttctgtgagcccgccagctgcaccatgcaggccggccagagggccttcaacaagggccctgacccctag

SEQ ID NO: 3236 - DNA, 252 bp, Artificial Sequence
  Description of Artificial Sequence: Synthetic coding sequence
atggctgctgccacagccagccccaggagcctgctggtgctgctgcaggtggtggtgctggccctggcccagatccggggccccccaggagagcggggccccccaggccccccaggccccccaggagtgcccggcagtgatggcattgatggccccccaggccctgtgggcctgcctggagagatcggcatccggggccccaagggggaccccggcccagatggccccagcggccccccaggccccccatag

SEQ ID NO: 3237 - DNA, 2070 bp, Artificial Sequence
  Description of Artificial Sequence: Synthetic coding sequence
atggctgctgccacagccagccccaggagcctgctggtgctgctgcaggtggtggtgctggccctggcccagatccggggccccccaggagagcggggccccccaggccccccaggccccccaggagtgcccggcagtgatggcattgatggagacaatggacctcctgggaaggccggccccccaggccccaagggggagcccgggaaggccggcccagatggcccagatggcaagccaggcattgatggcctgaccggggccaagggggagcccggccccatgggcatccctggggtgaagggccagcccggcctgcccggccccccaggcctgcccggccctggctttgctggccccccaggccccccaggccctgtgggcctgcccggggagatcggcatccggggccccaagggggaccccggcccagatggccccagcggccccccaggccccccaggcaagccaggccggcccggcaccatccagggcctggagggcagcgctgacttcctgtgccccaccaactgccccccaggcatgaagggccccccaggcctgcagggcgtgaagggccatgctgggaagaggggcatcctgggggaccccggccaccagggcaagccaggccccaagggagatgtgggcgccagcggggagcagggcatccctggccccccaggcccccagggcatccggggctacccaggcatggccggccccaagggggagaccggcccccacggctacaagggcatggtgggcgccatcggggccactggacctcctggagaggagggcccccggggccccccaggccgggccggggagaagggagatgagggcagccctggcatccggggcccccagggcatcaccggccccaagggggccaccggccccccaggcatcaacgggaaggatggcaccccaggcaccccaggcatgaagggcagcgctggccaggccggccagcccggcagccctggccaccagggcctggccggcgtgcccggccagcccggcaccaagggcggccctggggaccagggcgagcccggcccccagggcctgcccggcttcagcggccccccaggcaaggagggggagcccggccccagaggagagatcggcccccagggcatcatgggccagaagggggaccagggcgagcggggccctgtgggccagcccggcccccagggccggcagggccccaagggggagcagggccccccaggcatccctggcccccagggcctgcccggggtgaagggggacaagggcagccctgggaagacaggcccccggggcaaggtgggggaccccggggtggccggcctgcccggggagaagggggagaagggggagagcggggagcccggccccaagggccagcagggcgtgcggggggagcccggctacccaggccccagcggagatgctggggcccctggggtgcagggctacccaggccccccaggcccccggggcctggccggcaacagaggagtgcccggccagcccggccggcagggcgtggagggcagagatgccacagaccagcacatcgtggatgtggccctgaagatgctgcaggagcagctggccgaggtggccgtgtctgccaagcgggaggccctgggcgctgtgggcatgatgggccccccaggccccccaggccccccaggctacccaggcaagcagggcccccacggccaccctggcccccggggcgtgcccggcatcgtgggcgctgtgggccagatcggcaacacaggccccaagggcaagagaggagagaagggggaccccggggaggtgggccggggccaccctggcatgcctggccccccaggcatccctggcctgcccggccggcccggccaggccatcaacgggaaggatggagaccggggcagccctggggcccctggagaggccggccggcccggcctgcccggccctgtgggcctgcccggcttctgtgagcctgctgcctgcctgggcgccagcgcctatgccagcgcccggctgacagagcccggcagcatcaagggcccctag

SEQ ID NO: 3238 - DNA, 2055 bp, Artificial Sequence
  Description of Artificial Sequence: Synthetic coding sequence
atggccggcccccgggcctgtgcccccctgctgctgctgctgctgctgggggagctgctggccgctgctggggcccagagggtgggcctgcccggccccccaggccccccaggccccccaggcaagccaggccaggacggcattgatggagaggccggccccccaggcctgcccggccccccaggccccaagggggcccctgggaagccaggcaagccaggagaggccggcctgcccggcctgcccggggtggatggcctgaccggcagagatggccccccaggccccaagggggcccctggagagcggggcagcctgggccccccaggccccccaggcctgggcggcaagggcctgcccggccccccaggagaggccggcgtgtctggccccccaggcggcatcggcctgcggggccccccaggccccagcggcctgcccggcctgcccggccccccaggccccccaggccccccaggccaccctggggtgctgcctgagggcgccacagacctgcagtgccccagcatctgccccccaggccccccaggccccccaggcatgcctggcttcaagggccccaccggctacaagggggagcagggcgaggtgggcaaggatggagagaagggggaccccggccccccaggccctgctggcctgcccggctctgtgggcctgcagggcccccggggcctgcggggcctgcccggccccctgggccccccaggggaccggggccccatcggcttccggggccccccaggcatccctggggcccctgggaaggccggggacagaggagagcggggccctgagggcttccggggccccaagggggacctgggccggcccggccccaagggcaccccaggagtggccggccccagcggggagcccggcatgcctgggaaggatggccagaatggagtgcccggcctggatggccagaagggggaggccggcagaaatggagcccctggagagaagggccccaacggcctgcccggcctgcccggccgggccggcagcaaaggagagaagggggagcggggccgggccggggagctgggggaggccggccccagcggggagcccggggtgcctggagatgctggcatgcctggagagcggggggaggccggccaccggggcagcgctggggccctgggcccccagggccccccaggggcccctggggtgcggggcttccagggccagaagggctccatgggagaccccggcctgcccggcccccagggcctgcggggagatgtgggggaccggggccctggaggagctgctggccccaagggggaccagggcattgctggcagtgatggcctgcccggggacaagggggagctgggccccagcggcctggtgggccccaagggggagagcggcagcagaggagagctgggccccaagggcacccagggccccaacggcaccagcggcgtgcagggcgtgcccggccccccaggccccctgggcctgcagggcgtgcctggggtgcccggcatcaccgggaagccaggagtgcctgggaaggaggccagcgagcagaggatccgggagctgtgtggcggcatgatcagcgagcagatcgcccagctggccgcccacctgaggaagcccctggcccctggcagcatcggccggcccggccctgctggccccccaggccccccaggccccccaggcagcatcggccaccctggggcccggggccccccaggctaccggggccccaccggggagctgggggaccccggcccccggggcaaccagggcgacagaggagacaagggagctgctggagctggcctggatggccctgagggggaccagggcccccagggcccccagggcgtgcccggcaccagcaaggatggccaggatggagcccctggagagcccggccccccaggggaccccggcctgcccggggccatcggggcccagggcaccccaggcatctgtgacaccagcgcctgccagggcgctgtgctgggcggcgtgggggagaagagcggcagccgcagcagctag

SEQ ID NO: 3239 - DNA, 576 bp, Artificial Sequence
  Description of Artificial Sequence: Synthetic coding sequence
atgtggtggagcagcacccagaatgccggcacagaaggagaggccggccccccaggcctgcccggccccccaggccccaagggggcccctgggaagccaggcaagccaggagaggccggcctgcccggcctgcccggggtggatggcctgaccggcagagatggccccccaggccccaagggggcccctggagagcggggcagcctgggccccccaggccccccaggcctgggcggcaagggcctgcccggccccccaggagaggccggcgtgtctggccccccaggcggcatcggcctgcggggccccccaggccccagcggcctgcccggcctgcccggccccccaggccccccaggccccccaggccaccctggggtgctgcctgagggcgccacagacctgcagtgccccagcatctgccccccaggccccccaggccccccaggcatgcctggcttcaagggccccaccggctacaagggggagcagggcgaggtgggcaaggatggagagaagggggaccccggccccccaggccctgctggcctgcccggctctgtgggcctgcagtag

SEQ ID NO: 3240 - DNA, 576 bp, Artificial Sequence; identical to SEQ ID NO: 3239
  Description of Artificial Sequence: Synthetic coding sequence

SEQ ID NO: 3241 - DNA, 1128 bp, Artificial Sequence
  Description of Artificial Sequence: Synthetic coding sequence
atgggccccccaggcctgcccggcctgaagggggacagcggccccaagggggagaagggccaccctggcctgattggcctcatcggccccccaggagagcagggcgagaagggggaccggggcctgcccggcccccagggcagcagcggccccaagggggagcagggcatcaccggccccagcggccccatcggccccccaggccccccaggcctgcccggccccccaggccccaagggggccaagggcagcagcggccccaccggccccaagggggaggccggccaccctggccccccaggccccccaggccccccaggagaggtgatccagcccctgcccatccaggccagcaggaccaggaggaacattgatgccagccagctgctggatgatggaaatggagagaactacgtggactatgcagatggcatggaggagatcttcggcagcctgaacagcctgaagctggagattgagcagatgaagaggcccctgggcacccagcagaacccagcccggacctgcaaggacctgcagctgtgccacccagacttcccagatggagagtactgggtggaccccaaccagggctgcagccgggacagcttcaaggtgtactgcaacttcaccgctgggggcagcacctgtgtgtttcctgacaagaagtctgagggcagcaagatggcccgctggcccaaggagcagcccagcacctggtacagccagtacaagaggggcagcctgctgtcctatgtggatgctgagggcaaccctgtgggcgtggtgcagatgaccttcctgcggctgctgagcgccagcgcccaccagaatgtgacctaccactgctaccagagcgtggcctggcaggatgctgccaccggcagctatgacaaggccctgcgcttcctgggcagcaatgatgaggagatgtcctatgacaacaacccctacatccgggccctggtggatggctgtgccaccaagaagggctaccagaagacagtgctggagattgacacccccaaggtggagcaggtgcccatcgtggacatcatgtttaatgactttggagaggccagccagaagtttggatttgaggtgggccctgcctgcttcatgggctag

SEQ ID NO: 3242 - DNA, 5517 bp, Artificial Sequence
  Description of Artificial Sequence: Synthetic coding sequence
atggatgtgcacacccgctggaaggcccggagcgccctgcggcctggggcccccctgctgccccccctgctgctgctgctgctgtgggcccccccacccagccgggccgcccagcctgctgacctgctgaaggtgctggacttccacaacctgcctgatggcatcaccaagaccaccggcttctgtgccaccaggaggagcagcaaaggaccagatgtggcctacagagtgaccaaggatgcccagctgagcgcccccaccaagcagctgtacccagccagcgccttccctgaggacttcagcatcctgaccaccgtgaaggccaagaagggcagccaggccttcctggtgtccatctacaatgagcagggcatccagcagatcggcctggagctgggccgcagccctgtgttcctgtatgaggaccacacaggcaagccaggccctgaggactaccccctcttccggggcatcaacctgagtgatggcaagtggcaccgcatcgccctgtctgtgcacaagaagaatgtgaccctcatcctggactgcaagaagaagaccaccaagttcctggacagaagtgaccaccccatgattgacatcaatggcatcatcgtgtttggcacccgcatcctggatgaggaggtgtttgaaggagacatccagcagctgctgtttgtgtctgaccaccgggccgcctatgactactgtgagcactacagcccagactgtgacacagctgtgcctgacaccccccagagccaggaccccaacccagatgagtactacacagaaggagatggagagggggagacctactactatgagtacccctactatgaagatcctgaggacctgggcaaggagcccacccccagcaagaagcctgtggaggccgccaaggagaccacagaggtgcctgaggagctgacccccacccccacagaagctgcccccatgcctgagaccagcgagggcgccggcaaggaggaggatgtgggcattggagactatgactatgtgcccagcgaggactactacacccccagcccctatgatgacctgacctatggagagggggaggagaacccagaccagcccacagaccccggggccggggctgagatccccaccagcacagctgacaccagcaacagcagcaacccagcccctcctcctggagagggcgcagatgacctggagggggagttcacagaggagaccatccggaacctggatgagaactactatgacccctactatgaccccaccagcagccccagcgagatcggccctggcatgcctgccaaccaggacaccatctatgagggcattggaggccccagaggagagaagggccagaagggggagcccgccatcatcgagcccggcatgctgattgagggccccccaggccctgagggccctgctggcctgcccggccccccaggcaccatgggccccaccggccaggtgggggaccctggagagcggggccccccaggccggcccggcctgcctggagcagatggcctgcccggccccccaggcaccatgctgatgctgcccttccgctttggaggcggcggagatgctggcagcaagggccccatggtgtctgcccaggagagccaggcccaggccatcctgcagcaggcccggctggccctgcggggccctgctggccccatgggcctgaccggccggcccggccctgtgggccccccaggcagcggcggcctgaagggggagcctggagatgtgggcccccagggcccccggggcgtgcagggccccccaggccctgctgggaagccaggccggcggggccgggccggcagtgatggagcccggggcatgcctggccagacaggccccaagggggaccggggctttgatggcctggccggcctgcctggagagaagggccacagaggagaccccggccccagcggccccccaggccccccaggagatgatggagagagaggagatgatggagaggtgggcccccggggcctgcctggagagcccggcccccggggcctgctgggccccaagggccccccaggccccccaggccccccaggagtgacaggcatggatggccagcccggccccaagggaaatgtgggcccccagggcgagcccggccccccaggccagcagggcaaccctggggcccagggcctgcccggcccccagggcgccatcggccccccaggagagaagggccccctgggcaagccaggcctgcccggcatgcctggagcagatggccccccaggccaccctgggaaggagggccccccaggagagaagggcggccagggccccccaggcccccagggccccatcggctacccaggcccccggggcgtgaagggagcagatggcatccggggcctgaagggcaccaagggggagaagggggaggatggcttccctggcttcaagggggacatgggcatcaagggggacagaggagaaattggccccccaggccccagaggagaagatggccctgagggccccaagggccggggcggccccaacggggaccccggccccctgggccccccaggagagaagggcaagctgggcgtgcccggcctgcccggctacccaggccggcagggccccaagggcagcatcggcttccctggcttccctggggccaacggggagaagggcggccggggcaccccaggcaagccaggcccccggggccagaggggccccaccggccccagaggagagcggggcccccggggcatcaccgggaagccaggccccaagggcaacagcggaggagatggccctgctggccccccaggagagcggggccccaacggcccccagggccccaccggcttccctggccccaagggccccccaggccccccaggcaaggatggcctgcccggccaccctggccagagaggagagaccggcttccagggcaagacaggccccccaggccccccaggagtggtgggcccccagggccccactggagagaccggccccatgggagagcggggccaccctggccccccaggccccccaggagagcagggcctgcccggcctggccggcaaggagggcaccaagggggaccccggccctgctggcctgcccgggaaggatggccccccaggcctgcggggcttccctggggaccggggcctgcccggccctgtgggcgccctgggcctgaagggaaatgaaggacctcctggccccccaggccctgctggcagccctggagagcggggccctgctggagctgctggccccatcggcatccctggccggcccggcccccagggccccccaggccctgctggggagaagggggcccctggagagaagggcccccagggccctgctggaagagatggcctgcagggccctgtgggcctgcccggccctgctggccctgtgggccccccaggagaagatggagacaagggggagattggagagcccggccagaagggcagcaagggggacaagggggagcagggccccccaggccccaccggcccccagggccccatcggccagcccggccccagcggggctgatggagagcccggcccccggggccagcagggcctgtttggccagaagggagatgagggcccccggggcttccctggccccccaggccctgtgggcctgcagggcctgcccggccccccaggagagaagggggagactggagatgtgggccagatgggccccccaggccccccaggcccccggggccccagcggggcccctggagcagatggcccccagggccccccaggcggcatcggcaaccctggagctgtgggggagaagggggagcctggagaggccggggagcccggcctgcccggggagggcggccccccaggccccaagggggagcggggggagaagggggagagcggccccagcggggccgccggccccccaggccccaagggccccccaggagatgatggccccaagggcagccctggccctgtgggcttccctggggaccccggccccccaggagagcccggccctgctggccaggacggccccccaggggacaagggagatgatggagagcccggccagacaggcagccctggccccaccggggagcccggccccagcggccccccaggcaagaggggccccccaggccctgctggccctgagggccggcagggcgagaagggggccaagggggaggccggcctggagggccccccaggcaagacaggccccatcggcccccagggcgcccctgggaagccaggcccagatggcctgcggggcatccctggccctgtgggggagcagggcctgcccggcagccctggcccagatggccccccaggccccatgggccccccaggcctgcccggcctgaagggggacagcggccccaagggggagaagggccaccctggcctcatcggcctgattggccccccaggagagcagggcgagaagggggaccggggcctgcccggcccccagggcagcagcggccccaagggggagcagggcatcaccggccccagcggccccatcggccccccaggccccccaggcctgcccggccccccaggccccaagggggccaagggcagcagcggccccaccggccccaagggggaggccggccaccctggccccccaggccccccaggccccccaggagaggtgatccagcccctgcccatccaggccagcaggaccaggagaaatattgatgccagccagctgctggatgatggaaatggagaaaattatgtggactatgcagatggcatggaggagatcttcggcagcctgaacagcctgaagctggagattgagcagatgaagaggcccctgggcacccagcagaacccagcccggacctgcaaggacctgcagctgtgccacccagacttcccagatggagagtactgggtggaccccaaccagggctgcagccgggacagcttcaaggtgtactgcaacttcaccgctgggggcagcacctgtgtgtttcctgacaagaagtctgagggcgcccgcatcacctcctggcccaaggagaaccctggctcctggttcagcgagttcaagaggggcaagctgctgtcctatgtggatgctgagggcaaccctgtgggcgtggtgcagatgaccttcctgcggctgctgagcgccagcgcccaccagaatgtgacctaccactgctaccagagcgtggcctggcaggatgctgccaccggcagctatgacaaggccctgcgcttcctgggcagcaatgatgaggagatgtcctatgacaacaacccctacatccgggccctggtggatggctgtgccaccaagaagggctaccagaagacagtgctggagattgacacccccaaggtggagcaggtgcccatcgtggacatcatgtttaatgactttggagaggccagccagaagtttggatttgaggtgggccctgcctgcttcatgggctag

SEQ ID NO: 3243 - DNA, 633 bp, Artificial Sequence
  Description of Artificial Sequence: Synthetic coding sequence
tgaagaaccaggagaaatattgatgccagccagctgctggatgatggaaatggagaaaattatgtggactatgcagatggcatggaggagatcttcggcagcctgaacagcctgaagctggagattgagcagatgaagaggcccctgggcacccagcagaacccagcccggacctgcaaggacctgcagctgtgccacccagacttcccagatggagagtactgggtggaccccaaccagggctgcagccgggacagcttcaaggtgtactgcaacttcaccgctgggggcagcacctgtgtgtttcctgacaagaagtctgagggcagcaagatggcccgctggcccaaggagcagcccagcacctggtacagccagtacaagaggggcagcctgctgtcctatgtggatgctgagggcaaccctgtgggcgtggtgcagatgaccttcctgcggctgctgagcgccagcgcccaccagaatgtgacctaccactgctaccagagcgtggcctggcaggatgctgccaccggcagctatgacaaggccctgcgcttcctgggcagcaatgatgaggagatgtcctatgacaacaacccctacatccgggccctggtggatggctgtgcctag

SEQ ID NO: 3244 - DNA, 5238 bp, Artificial Sequence
  Description of Artificial Sequence: Synthetic coding sequence
atgggcaacagaagagacctgggccagccccgggccggcctgtgcctgctgctggccgccctgcagctgctgcccggcacccaggccgaccctgtggatgtgctgaaggccctgggcgtgcagggcggccaggccggcgtgcctgagggccctggcttctgcccccagaggaccccagagggggaccgggccttcagaattggccaggccagcaccctgggcatccccacctgggagctgtttcctgagggccacttccctgagaacttcagcctgctgatcaccctgcggggccagcctgccaaccagagcgtgctgctgagcatctatgatgagcggggggcccggcagctgggcctggccctgggccctgccctgggcctgctgggggaccccttccggcccctgccccagcaggtgaacctgacagatggccgctggcaccgggtggccgtgtccattgatggagagatggtgaccctggtggccgactgtgaggcccagccccctgtgctgggccacggcccccgcttcatcagcattgctggcctgactgtgctgggcacccaggacctgggggagaagacctttgaaggagacatccaggagctgctgatcagcccagacccccaggccgccttccaggcctgtgagcgctacctgcctgactgtgacaacctggccccagctgccaccgtggccccccagggcgagcctgagaccccccggcccaggaggaaaggaaaaggaaaaggaaggaagaagggccggggcaggaagggcaagggcaggaagaagaacaaggagatctggaccagcagccccccaccagattctgctgagaaccagaccagcacagacatccccaagacagagaccccagcccccaacctgccccccacccccacccccctggtggtgaccagcacagtgaccaccggcctgaatgccaccatcctggagaggagcctggaccctgacagcggcacagagctgggcaccctggagaccaaggccgcccgggaggatgaggagggagatgacagcaccatgggccctgacttccgggctgctgagtaccccagcaggacccagttccagatcttccctggggccggggagaagggggccaagggggagcctgctgtgattgagaagggccagcagtttgagggccccccaggggcccctggcccccagggcgtggtgggccccagcggccccccaggccccccaggcttccctggggaccccggccccccaggccctgctggcctgcccggcatccctggcattgatggcatccggggccccccaggcaccgtcatcatgatgcccttccagtttgctgggggcagcttcaagggcccccctgtgtccttccagcaggcccaggcccaggccgtgctgcagcagacccagctgtccatgaagggccccccaggccctgtgggcctgaccggccggcccggccctgtgggcctgcccggccaccctggcctgaagggggaggagggcgctgagggcccccagggcccccggggcctgcagggcccccacggccccccaggccgggtgggcaagatgggccggcctggagcagatggagcccggggcctgcccggggacaccggccccaagggggaccggggctttgatggcctgcccggcctgcctggagagaagggccagagaggagactttggccacgtgggccagcccggccccccaggagaagatggagagagaggagctgagggccccccaggccccaccggccaggccggggagcccggcccccggggcctgctgggcccccggggcagccctggccccaccggccggcctggggtgactggaattgatggagcccctggggccaagggaaatgtgggccccccaggagagcccggccccccaggccagcagggcaaccacggcagccagggcctgcccggcccccagggcctcatcggcaccccaggagagaagggccccccaggcaaccctggcatccctggcctgcccggcagtgatggccccctgggccaccctggccacgagggccccactggagagaagggggcccagggccccccaggcagcgctggccccccaggctacccaggcccccggggcgtgaagggcaccagcggcaacagaggcctgcagggcgagaagggggagaagggggaggatggcttccctggcttcaagggagatgtgggcctgaagggggaccagggcaagccaggggcccctggccccagaggagaagatggccctgagggccccaagggccaggccggccaggccggggaggagggccccccaggcagcgctggggagaagggcaagctgggcgtgcccggcctgcccggctacccaggccggcccggccccaagggcagcatcggcttccctggccccctgggccccatcggggagaagggcaagagcggcaagacaggccagcccggcctggagggggagcggggccccccaggcagcagaggagagcggggccagcccggggccaccggccagcccggccccaagggagatgtgggccaggatggagcccctggcatccctggagagaagggcctgcccggcctgcagggccccccaggcttccctggccccaagggccccccaggccaccagggcaaggatggccggcccggccaccctggccagagaggagagctgggcttccagggccagacaggccccccaggccctgctggggtgctgggcccccagggcaagacaggagaggtgggccccctgggggagcggggccccccaggccccccaggccccccaggagagcagggcctgcccggcctggagggccgggagggcgccaagggggagctgggccccccaggccccctgggcaaggagggccctgctggcctgcggggcttccctggccccaagggcggccctggggaccccggccccaccggcctgaagggggacaagggccccccaggccctgtgggcgccaacggcagccctggagagcggggccccctgggccctgctgggggcatcggcctgcccggccagagcggcagcgagggccctgtgggccctgctgggaagaagggcagcagaggagagcggggccccccaggccccaccgggaaggatggcatccctggccccctgggccccctgggccccccaggagctgctggccccagcggggaggagggggacaagggagatgtgggcgcccctggccacaagggcagcaagggggacaagggagatgctggccccccaggccagcccggcatccggggccctgctggccaccctggccccccaggagcagatggagcccagggccggcggggccccccaggcctgtttggccagaagggagatgatggagtgcggggctttgtgggcgtcatcggccccccaggcctgcagggcctgcccggccccccaggagagaagggggaggtgggagatgtgggctccatgggcccccatggagcccctggcccccggggcccccagggccccactggaagtgagggcaccccaggcctgcccggcggcgtgggccagcccggggctgtgggggagaagggggagagaggagatgctggggaccccggccccccaggggcccctggcatccctggccccaagggggacatcggggagaagggggacagcggccccagcggggccgccggccccccaggcaagaagggccccccaggagaagatggagccaagggctctgtgggccccaccggcctgcccggggacctgggccccccaggggaccccggggtgtctggaattgatggcagccctggagagaagggggaccctggagatgtgggcggccctggccccccaggggccagcggggagcccggggcccctggccccccaggcaagaggggccccagcggccacatgggccgggagggccgggagggggagaagggggccaagggggagcccggcccagatggccccccaggccgcacaggccccatgggcgcccggggccccccaggccgggtgggccctgagggcctgcggggcatccctggccctgtgggggagcccggcctgctgggcgcccctggccagatgggccccccaggccccctgggccccagcggcctgcccggcctgaagggggacaccggccccaagggggagaagggccacatcggcctcatcggcctgattggccccccaggagaggccggggagaagggggaccagggcctgcccggggtgcagggccccccaggccccaagggggaccccggccccccaggccccatcggcagcctgggccaccctggccccccaggagtggccggccccctgggccagaagggcagcaagggcagccctggctccatgggccccaggggggacaccggccctgctggccccccaggccccccaggggccccagctgagctgcacggcctgcggaggagaagaagatttgtgcctgtgcccctgcctgtggtggagggcggcctggaggaggtgctggccagcctgaccagcctgagcctggagctggagcagctgcggcggcccccaggcacagctgagcggcccggcctggtgtgccacgagctgcacaggaaccacccccacctgcctgatggagagtactggattgaccccaaccagggctgtgcccgggacagcttccgggtcttctgcaacttcaccgctggaggagagacctgcctgtacccagacaagaagtttgagatcgtgaagctggcctcctggagcaaggagaagccaggcggctggtacagcaccttcagaagaggcaagaagttctcctatgtggatgctgatggcagccctgtgaatgtggtgcagctgaacttcctgaagctgctgagcgccacagcccggcagaacttcacctacagctgccagaatgctgctgcctggctggatgaggccaccggggactacagccacagcgcccgcttcctgggcaccaatggagaggagctgtccttcaaccagaccacagctgccaccgtgtctgtgccccaggacggctgccgcctgaggaagggccagaccaagaccctgtttgagttcagcagcagccgggccggcttcctgcccctgtgggatgtggccgccacagactttggccagaccaaccagaagtttggatttgagctgggccctgtgtgcttcagcagctag

SEQ ID NO: 3245 - DNA, 9534 bp, Artificial Sequence
  Description of Artificial Sequence: Synthetic coding sequence
atgaggaagcaccgccacctgcccctggtggccgtgttctgcctcttcctgagcggcttccccaccacccacgcccagcagcagcaggctgatgtgaagaatggagctgctgctgacatcatcttcctggtggacagctcctggaccatcggggaggagcacttccagctggtgcgggagttcctgtatgatgtggtgaagagcctggccgtgggagaaaatgacttccactttgccctggtgcagttcaacggcaacccccacacagagttcctgctgaacacctaccgcaccaagcaggaggtgctgagccacatcagcaacatgagctacatcggcggcaccaaccagacaggcaagggcctggagtacatcatgcagagccacctgaccaaggccgccggcagcagagctggagatggagtgccccaggtgattgtggtgctgacagatggccacagcaaggatggcctggccctgcccagcgctgagctgaagtctgcagatgtgaatgtgtttgccatcggcgtggaggatgctgatgaaggagccctgaaggagatcgccagcgagcccctgaacatgcacatgttcaacctggagaacttcaccagcctgcatgacatcgtgggcaacctggtgtcctgtgtgcacagctctgtgtccccagagcgggccggggacacagagaccctgaaggacatcacagcccaggacagcgctgacatcatcttcctgattgatggcagcaacaacacaggctctgtgaactttgctgtgatcctggacttcctggtgaacctgctggagaagctgcccatcggcacccagcagatccgggtgggcgtggtgcagttcagtgatgagcccaggaccatgttcagcctggacacctacagcaccaaggcccaggtgctgggcgctgtgaaggccctgggctttgctggaggagagctggccaacatcggcctggccctggactttgtggtggagaaccacttcaccagggctgggggcagccgggtggaggagggcgtgccccaggtgctggtgctgatctctgctggccccagcagtgatgagatccgctatggagtggtggccctgaagcaggcctctgtgttctcctttggcctgggcgcccaggccgccagcagagctgagctgcagcacatcgccacagatgacaacctggtgttcaccgtgcctgagttccgcagctttggagacctgcaggagaagctgctgccctacatcgtgggcgtggcccagaggcacatcgtgctgaagccacccaccatcgtgacccaggtgattgaggtgaacaagagggacatcgtgttcctggtggatggcagcagcgccctgggcctggccaacttcaatgccatccgggacttcatcgccaaggtgatccagaggctggagatcggccaggacctgatccaggtggccgtggcccagtatgctgacacagtgcggcctgagttctacttcaacacccaccccaccaagcgggaggtgatcacagctgtgaggaagatgaagcccctggatggcagcgccctgtacacaggcagcgccctggactttgtgaggaacaacctcttcaccagcagcgctggctacagagctgctgagggcatccccaagctgctggtgctgatcactggaggcaagagcctggatgagatcagccagcctgcccaggagctgaagaggagcagcatcatggcctttgccatcggcaacaagggagctgaccaggccgagctggaggagatcgcctttgacagcagcctggtgttcatcccagctgagttccgggccgcccccctgcagggcatgctgcccggcctgctggcccccctgcggaccctgagcggcaccccagaggtgcacagcaacaagagggacatcatcttcctgctggatggcagcgccaacgtgggcaagaccaacttcccctacgtgcgggactttgtgatgaacctggtgaacagcctggacattggaaatgacaacatccgggtgggcctggtgcagttcagtgacacccctgtgacagagttcagcctgaacacctaccagaccaagagtgacatcctgggccacctgcggcagctgcagctgcagggcggcagcggcctgaacacaggcagcgccctgtcctatgtgtatgccaaccacttcacagaggccggcggcagccgcatccgggagcacgtgccccagctgctgctgctgctgacagctggccagagcgaggacagctacctgcaggccgccaatgccctgaccagggctggcatcctgaccttctgtgtgggcgccagccaggccaacaaggccgagctggagcagatcgccttcaaccccagcctggtgtacctgatggatgacttcagcagcctgcctgccctgccccagcagctgatccagcccctgaccacctacgtgtctggaggagtggaggaggtgcccctggcccagcctgagagcaagagggacatcctcttcctgtttgatggcagcgccaacctggtgggccagtttcctgtggtgcgggacttcctgtacaagatcattgatgagctgaatgtgaagccagagggcaccagaattgctgtggcccagtacagtgatgatgtgaaggtggagagcagatttgatgagcaccagagcaagccagagatcctgaacctggtgaagaggatgaagatcaagacaggcaaggccctgaacctgggctacgccctggactatgcccagcgctacatctttgtgaagtctgctggcagcagaattgaagatggagtgctgcagttcctggtgctgctggtggccggccgcagcagtgacagagtggatggccctgccagcaacctgaagcagagcggcgtggtgcccttcatcttccaggccaagaatgctgaccctgctgagctggagcagatcgtgctgagccctgccttcatcctggccgctgagagcctgcccaagatcggggacctgcacccccagatcgtgaacctgctgaagtctgtgcacaacggggccccagcccctgtgtctggagagaaggatgtggtgttcctgctggatggcagcgagggcgtgcgcagcggcttccccctgctgaaggagtttgtgcagagggtggtggagagcctggatgtgggccaggacagagtgcgggtggccgtggtgcagtacagcgacaggaccaggcctgagttctacctgaacagctacatgaacaagcaggatgtggtgaatgctgtgcggcagctgaccctgctgggcggccccacccccaacacaggagctgccctggagtttgtgctgaggaacatcctggtgtcctctgctggcagccgcatcacagaaggagtgccccagctgctgattgtgctgacagctgacagaagtggagatgatgtgaggaaccccagcgtggtggtgaagaggggcggcgctgtgcccatcggcattggaattggaaatgctgacatcacagagatgcagaccatctccttcatcccagactttgctgtggccatccccaccttccggcagctgggcaccgtgcagcaggtgatcagcgagcgggtgacccagctgacccgggaggagctgagccggctgcagcctgtgctgcagcccctgcccagccctggggtgggcggcaagagagatgtggtgttcctgattgatggcagccagagcgctggccctgagttccagtatgtgaggaccctgattgagcggctggtggactacctggatgtgggctttgacaccaccagggtggccgtcatccagttcagtgatgaccccaaggtggagttcctgctgaatgcccacagcagcaaggatgaggtgcagaatgctgtgcagaggctgcggcccaagggcggccggcagatcaacgtgggcaatgccctggagtatgtgtccaggaacatcttcaagaggcccctgggcagccgcatcgaggagggcgtgccccagttcctggtgctgatcagcagcggcaagagtgatgatgaggtggatgatcctgctgtggagctgaagcagtttggagtggcccccttcaccatcgccagaaatgctgaccaggaggagctggtgaagatcagcctgagcccagaatatgtgttttctgtgtccaccttccgggagctgcccagcctggagcagaagctgctgacccccatcaccaccctgaccagcgagcagatccagaagctgctggccagcacccgctacccacctcctgctgtggagagtgatgctgctgacatcgtgttcctgattgacagcagcgagggcgtgcggccagatggctttgcccacatccgggactttgtgagccgcatcgtgcggcggctgaacatcggccccagcaaggtgcgggtgggcgtggtgcagttcagcaatgatgtgtttcctgagttctacctgaagacctaccgcagccaggcccctgtgctggatgccatccggcggctgcggctgcggggcggcagccccctgaacacaggcaaggccctggagtttgtggccaggaacctgtttgtgaagtctgctggcagcagaattgaagatggagtgccccagcacctggtgctggtgctgggcggcaagagccaggatgatgtgtccagatttgcccaggtgatccgcagcagcggcatcgtgtccctgggcgtgggggacaggaacatcgacagaacagagctgcagaccatcaccaatgacccccggctggtgttcaccgtgcgggagttccgggagctgcccaacatcgaggagcgcatcatgaacagctttggccccagcgctgccaccccagcccctcctggggtggacaccccaccacccagcaggcctgagaagaagaaggctgacatcgtgttcctgctggatggcagcatcaacttcagaagagacagcttccaggaggtgctgcgctttgtgtctgaaattgtggacacagtgtatgaagatggagacagcatccaggtgggcctggtgcagtacaacagcgaccccacagatgagttcttcctgaaggacttcagcaccaagaggcagatcattgatgccatcaacaaggtggtgtacaagggcggcagacatgccaacaccaaggtgggcctggagcacctgcgggtgaaccactttgtgcctgaggccggcagccggctggaccagagggtgccccagatcgccttcgtcatcactggaggcaagtctgtggaggatgcccaggatgtgtccctggccctgacccagaggggcgtgaaggtgtttgctgtgggcgtgagaaatattgattctgaggaggtgggcaagatcgccagcaacagcgccacagccttccgggtgggcaatgtgcaggagctgtctgagctgtctgagcaggtgctggagaccctgcatgatgccatgcatgagaccctgtgccctggggtgacagatgctgccaaggcctgcaacctggatgtgatcctgggctttgatggcagccgggaccagaatgtgtttgtggcccagaagggctttgagagcaaggtggatgccatcctgaaccgcatcagccagatgcaccgggtgtcctgcagcggcggccgcagccccaccgtgcgggtgtctgtggtggccaacaccccatctggccctgtggaggcctttgattttgatgagtaccagcctgagatgctggagaagttcaggaacatgaggagccagcacccctacgtgctgacagaggacaccctgaaggtgtacctgaacaagttccggcagagcagcccagacagcgtgaaggtggtgatccacttcacagatggagcagatggagacctggccgacctgcaccgggccagcgagaacctgcggcaggagggcgtgcgggccctgatcctggtgggcctggagcgggtggtgaacctggagcggctgatgcacctggagtttggccggggcttcatgtatgaccggcccctgcggctgaacctgctggacctggactatgagctggccgagcagctggacaacattgctgagaaggcctgctgcggcgtgccctgcaagtgcagcggccagagaggagaccggggccccatcggcagcatcggccccaagggcatccctggagaagatggctaccggggctacccaggagatgagggcggccctggagagcggggccccccaggagtgaatggcacccagggcttccagggctgccccggccagaggggcgtgaagggcagccggggcttccctggagagaagggggaggtgggggagatcggcctggatggcctggatggagaagatggagacaagggcctgcccggcagcagtggagagaagggcaaccctggaagaagaggagacaagggccccagaggagagaagggggagagaggagatgtgggcatccggggggaccccggcaaccctggccaggacagccaggagcggggccccaagggggagactggagacctgggccccatgggcgtgcccggcagagatggagtgcctgggggccctggagagaccgggaagaatggaggcttcggccggcggggccccccaggggccaagggcaacaagggcggccctggccagcccggctttgaaggagagcagggcaccaggggggcccagggccctgctggccctgctggccccccaggcctcatcggggagcagggcatcagcggcccccggggcagcggcggcgctgctggggcccctggagagcggggccgcacaggccccctgggcaggaagggggagcctggagagcccggccccaagggcggcatcggcaacagaggccccagaggagaaacaggagatgatggaagagatggagtgggcagcgagggccggcggggcaagaagggggagcggggcttccctggctacccaggccccaagggcaaccctggagagcccggcctgaatggcaccaccggccccaagggcatccggggccggcggggcaacagcggccccccaggcatcgtgggccagaagggggaccccggctacccaggccctgctggccccaagggcaacagaggagacagcattgaccagtgtgccctgatccagagcatcaaggacaagtgcccctgctgctacggccccctggagtgccctgtgttccccacagagctggcctttgccctggacaccagcgagggcgtgaaccaggacaccttcggccgcatgagagatgtggtgctgagcatcgtgaatgacctgaccatcgccgagagcaactgccccaggggggcccgggtggccgtggtgacctacaacaatgaggtgaccacagagatccgctttgctgacagcaagaggaagtctgtgctgctggacaagatcaagaacctgcaggtggccctgaccagcaagcagcagagcctggagacagccatgagctttgtggccaggaacaccttcaagagggtgagaaatggcttcctgatgaggaaggtggccgtgttcttcagcaacacccccacccgggccagcccccagctgcgggaggccgtgctgaagctgagtgatgctggcatcacccccctcttcctgacccggcaggaggaccggcagctgatcaatgccctgcagatcaacaacacagctgtgggccacgccctggtgctgcctgctggccgggacctgacagacttcctggagaatgtgctgacctgccacgtgtgcctggacatctgcaacatcgaccccagctgtggcttcggctcctggaggcccagcttccgggacagaagagctgctggcagtgatgtggacatcgacatggccttcatcctggacagcgctgagaccaccaccctcttccagttcaatgagatgaagaagtacatcgcctacctggtgcggcagctggacatgagcccagaccccaaggccagccagcactttgcccgggtggccgtggtgcagcacgcccccagcgagagcgtggacaatgcctccatgcctcctgtgaaggtggagttcagcctgacagattatggcagcaaggagaagctggtggacttcctgagccggggcatgacccagctgcagggcacccgggccctgggcagcgccatcgagtacaccattgaaaatgtgtttgaaagtgcccccaacccccgggacctgaagatcgtggtgctgatgctgaccggggaggtgcctgagcagcagctggaggaggcccagagggtcatcctgcaggccaagtgcaagggctacttctttgtggtgctgggcatcggcaggaaggtgaacatcaaggaggtgtacacctttgccagcgagcccaatgatgtgttcttcaagctggtggacaagagcacagagctgaatgaggagcccctgatgagatttggccgcctgctgcccagctttgtgtccagtgaaaatgccttctacctgagcccagacatcaggaagcagtgtgactggttccagggcgaccagcccaccaagaacctggtgaagtttggccacaagcaggtgaatgtgcccaacaacgtgaccagcagccccaccagcaaccctgtgaccaccaccaagcctgtgaccaccaccaagcctgtgaccaccaccaccaagcctgtgaccaccaccaccaagcctgtgaccatcatcaaccagcccagcgtgaagccagctgctgccaagccagccccagccaagcctgtggccgccaagcctgtggccaccaagatggccaccgtgcggccccctgtggccgtgaagccagccacagctgccaagcctgtggccgccaagccagctgctgtgcggcccccagctgctgctgctgccaagcctgtggccaccaagccagaggtgccccggccccaggccgccaagccagctgccaccaagccagccaccaccaagcccatggtgaagatgagccgggaggtgcaggtgtttgagatcacagagaacagcgccaagctgcactgggagcgggcagagcccccaggcccctacttctatgacctgactgtgaccagcgcccatgaccagagcctggtgctgaagcagaacctgactgtgacagacagagtgattggaggcctgctggccggccagacctaccacgtggccgtggtgtgctacctgcggagccaggtgcgggccacctaccacggcagcttcagcaccaagaagagccagcccccaccaccccagcctgcccggagcgccagcagcagcaccatcaacctgatggtgtccacagagcccctggccctgacagaaacagacatctgcaagctgcccaaggatgagggcacctgccgggacttcatcctgaagtggtactatgaccccaacaccaagagctgtgcccgcttctggtacggcggctgcggcggcaatgaaaacaagtttggcagccagaaggaatgtgagaaggtgtgtgcccctgtgctggccaagccaggagtcatctctgtgatgggcacctag

SEQ ID NO: 3246 - DNA, 8934 bp, Artificial Sequence
  Description of Artificial Sequence: Synthetic coding sequence
atgaggaagcaccgccacctgcccctggtggccgtgttctgcctcttcctgagcggcttccccaccacccacgcccagcagcagcaggctgatgtgaagaatggagctgctgctgacatcatcttcctggtggacagctcctggaccatcggggaggagcacttccagctggtgcgggagttcctgtatgatgtggtgaagagcctggccgtgggagaaaatgacttccactttgccctggtgcagttcaacggcaacccccacacagagttcctgctgaacacctaccgcaccaagcaggaggtgctgagccacatcagcaacatgagctacatcggcggcaccaaccagacaggcaagggcctggagtacatcatgcagagccacctgaccaaggccgccggcagcagagctggagatggagtgccccaggtgattgtggtgctgacagatggccacagcaaggatggcctggccctgcccagcgctgagctgaagtctgcagatgtgaatgtgtttgccatcggcgtggaggatgctgatgaaggagccctgaaggagatcgccagcgagcccctgaacatgcacatgttcaacctggagaacttcaccagcctgcatgacatcgtgggcaacctggtgtcctgtgtgcacagctctgtgtccccagagcgggccggggacacagagaccctgaaggacatcacagcccaggacagcgctgacatcatcttcctgattgatggcagcaacaacacaggctctgtgaactttgctgtgatcctggacttcctggtgaacctgctggagaagctgcccatcggcacccagcagatccgggtgggcgtggtgcagttcagtgatgagcccaggaccatgttcagcctggacacctacagcaccaaggcccaggtgctgggcgctgtgaaggccctgggctttgctggaggagagctggccaacatcggcctggccctggactttgtggtggagaaccacttcaccagggctgggggcagccgggtggaggagggcgtgccccaggtgctggtgctgatctctgctggccccagcagtgatgagatccgctatggagtggtggccctgaagcaggcctctgtgttctcctttggcctgggcgcccaggccgccagcagagctgagctgcagcacatcgccacagatgacaacctggtgttcaccgtgcctgagttccgcagctttggagacctgcaggagaagctgctgccctacatcgtgggcgtggcccagaggcacatcgtgctgaagccacccaccatcgtgacccaggtgattgaggtgaacaagagggacatcgtgttcctggtggatggcagcagcgccctgggcctggccaacttcaatgccatccgggacttcatcgccaaggtgatccagaggctggagatcggccaggacctgatccaggtggccgtggcccagtatgctgacacagtgcggcctgagttctacttcaacacccaccccaccaagcgggaggtgatcacagctgtgaggaagatgaagcccctggatggcagcgccctgtacacaggcagcgccctggactttgtgaggaacaacctcttcaccagcagcgctggctacagagctgctgagggcatccccaagctgctggtgctgatcactggaggcaagagcctggatgagatcagccagcctgcccaggagctgaagaggagcagcatcatggcctttgccatcggcaacaagggagctgaccaggccgagctggaggagatcgcctttgacagcagcctggtgttcatcccagctgagttccgggccgcccccctgcagggcatgctgcccggcctgctggcccccctgcggaccctgagcggcaccccagaggagagcaagagggacatcctcttcctgtttgatggcagcgccaacctggtgggccagtttcctgtggtgcgggacttcctgtacaagatcattgatgagctgaatgtgaagccagagggcaccagaattgctgtggcccagtacagtgatgatgtgaaggtggagagcagatttgatgagcaccagagcaagccagagatcctgaacctggtgaagaggatgaagatcaagacaggcaaggccctgaacctgggctacgccctggactatgcccagcgctacatctttgtgaagtctgctggcagcagaattgaagatggagtgctgcagttcctggtgctgctggtggccggccgcagcagtgacagagtggatggccctgccagcaacctgaagcagagcggcgtggtgcccttcatcttccaggccaagaatgctgaccctgctgagctggagcagatcgtgctgagccctgccttcatcctggccgctgagagcctgcccaagatcggggacctgcacccccagatcgtgaacctgctgaagtctgtgcacaacggggccccagcccctgtgtctggagagaaggatgtggtgttcctgctggatggcagcgagggcgtgcgcagcggcttccccctgctgaaggagtttgtgcagagggtggtggagagcctggatgtgggccaggacagagtgcgggtggccgtggtgcagtacagcgacaggaccaggcctgagttctacctgaacagctacatgaacaagcaggatgtggtgaatgctgtgcggcagctgaccctgctgggcggccccacccccaacacaggagctgccctggagtttgtgctgaggaacatcctggtgtcctctgctggcagccgcatcacagaaggagtgccccagctgctgattgtgctgacagctgacagaagtggagatgatgtgaggaaccccagcgtggtggtgaagaggggcggcgctgtgcccatcggcattggaattggaaatgctgacatcacagagatgcagaccatctccttcatcccagactttgctgtggccatccccaccttccggcagctgggcaccgtgcagcaggtgatcagcgagcgggtgacccagctgacccgggaggagctgagccggctgcagcctgtgctgcagcccctgcccagccctggggtgggcggcaagagagatgtggtgttcctgattgatggcagccagagcgctggccctgagttccagtatgtgaggaccctgattgagcggctggtggactacctggatgtgggctttgacaccaccagggtggccgtcatccagttcagtgatgaccccaaggtggagttcctgctgaatgcccacagcagcaaggatgaggtgcagaatgctgtgcagaggctgcggcccaagggcggccggcagatcaacgtgggcaatgccctggagtatgtgtccaggaacatcttcaagaggcccctgggcagccgcatcgaggagggcgtgccccagttcctggtgctgatcagcagcggcaagagtgatgatgaggtggatgatcctgctgtggagctgaagcagtttggagtggcccccttcaccatcgccagaaatgctgaccaggaggagctggtgaagatcagcctgagcccagaatatgtgttttctgtgtccaccttccgggagctgcccagcctggagcagaagctgctgacccccatcaccaccctgaccagcgagcagatccagaagctgctggccagcacccgctacccacctcctgctgtggagagtgatgctgctgacatcgtgttcctgattgacagcagcgagggcgtgcggccagatggctttgcccacatccgggactttgtgagccgcatcgtgcggcggctgaacatcggccccagcaaggtgcgggtgggcgtggtgcagttcagcaatgatgtgtttcctgagttctacctgaagacctaccgcagccaggcccctgtgctggatgccatccggcggctgcggctgcggggcggcagccccctgaacacaggcaaggccctggagtttgtggccaggaacctgtttgtgaagtctgctggcagcagaattgaagatggagtgccccagcacctggtgctggtgctgggcggcaagagccaggatgatgtgtccagatttgcccaggtgatccgcagcagcggcatcgtgtccctgggcgtgggggacaggaacatcgacagaacagagctgcagaccatcaccaatgacccccggctggtgttcaccgtgcgggagttccgggagctgcccaacatcgaggagcgcatcatgaacagctttggccccagcgctgccaccccagcccctcctggggtggacaccccaccacccagcaggcctgagaagaagaaggctgacatcgtgttcctgctggatggcagcatcaacttcagaagagacagcttccaggaggtgctgcgctttgtgtctgaaattgtggacacagtgtatgaagatggagacagcatccaggtgggcctggtgcagtacaacagcgaccccacagatgagttcttcctgaaggacttcagcaccaagaggcagatcattgatgccatcaacaaggtggtgtacaagggcggcagacatgccaacaccaaggtgggcctggagcacctgcgggtgaaccactttgtgcctgaggccggcagccggctggaccagagggtgccccagatcgccttcgtcatcactggaggcaagtctgtggaggatgcccaggatgtgtccctggccctgacccagaggggcgtgaaggtgtttgctgtgggcgtgagaaatattgattctgaggaggtgggcaagatcgccagcaacagcgccacagccttccgggtgggcaatgtgcaggagctgtctgagctgtctgagcaggtgctggagaccctgcatgatgccatgcatgagaccctgtgccctggggtgacagatgctgccaaggcctgcaacctggatgtgatcctgggctttgatggcagccgggaccagaatgtgtttgtggcccagaagggctttgagagcaaggtggatgccatcctgaaccgcatcagccagatgcaccgggtgtcctgcagcggcggccgcagccccaccgtgcgggtgtctgtggtggccaacaccccatctggccctgtggaggcctttgattttgatgagtaccagcctgagatgctggagaagttcaggaacatgaggagccagcacccctacgtgctgacagaggacaccctgaaggtgtacctgaacaagttccggcagagcagcccagacagcgtgaaggtggtgatccacttcacagatggagcagatggagacctggccgacctgcaccgggccagcgagaacctgcggcaggagggcgtgcgggccctgatcctggtgggcctggagcgggtggtgaacctggagcggctgatgcacctggagtttggccggggcttcatgtatgaccggcccctgcggctgaacctgctggacctggactatgagctggccgagcagctggacaacattgctgagaaggcctgctgcggcgtgccctgcaagtgcagcggccagagaggagaccggggccccatcggcagcatcggccccaagggcatccctggagaagatggctaccggggctacccaggagatgagggcggccctggagagcggggccccccaggagtgaatggcacccagggcttccagggctgccccggccagaggggcgtgaagggcagccggggcttccctggagagaagggggaggtgggggagatcggcctggatggcctggatggagaagatggagacaagggcctgcccggcagcagtggagagaagggcaaccctggaagaagaggagacaagggccccagaggagagaagggggagagaggagatgtgggcatccggggggaccccggcaaccctggccaggacagccaggagcggggccccaagggggagactggagacctgggccccatgggcgtgcccggcagagatggagtgcctgggggccctggagagaccgggaagaatggaggcttcggccggcggggccccccaggggccaagggcaacaagggcggccctggccagcccggctttgaaggagagcagggcaccaggggggcccagggccctgctggccctgctggccccccaggcctcatcggggagcagggcatcagcggcccccggggcagcggcggcgctgctggggcccctggagagcggggccgcacaggccccctgggcaggaagggggagcctggagagcccggccccaagggcggcatcggcaacagaggccccagaggagaaacaggagatgatggaagagatggagtgggcagcgagggccggcggggcaagaagggggagcggggcttccctggctacccaggccccaagggcaaccctggagagcccggcctgaatggcaccaccggccccaagggcatccggggccggcggggcaacagcggccccccaggcatcgtgggccagaagggggaccccggctacccaggccctgctggccccaagggcaacagaggagacagcattgaccagtgtgccctgatccagagcatcaaggacaagtgcccctgctgctacggccccctggagtgccctgtgttccccacagagctggcctttgccctggacaccagcgagggcgtgaaccaggacaccttcggccgcatgagagatgtggtgctgagcatcgtgaatgacctgaccatcgccgagagcaactgccccaggggggcccgggtggccgtggtgacctacaacaatgaggtgaccacagagatccgctttgctgacagcaagaggaagtctgtgctgctggacaagatcaagaacctgcaggtggccctgaccagcaagcagcagagcctggagacagccatgagctttgtggccaggaacaccttcaagagggtgagaaatggcttcctgatgaggaaggtggccgtgttcttcagcaacacccccacccgggccagcccccagctgcgggaggccgtgctgaagctgagtgatgctggcatcacccccctcttcctgacccggcaggaggaccggcagctgatcaatgccctgcagatcaacaacacagctgtgggccacgccctggtgctgcctgctggccgggacctgacagacttcctggagaatgtgctgacctgccacgtgtgcctggacatctgcaacatcgaccccagctgtggcttcggctcctggaggcccagcttccgggacagaagagctgctggcagtgatgtggacatcgacatggccttcatcctggacagcgctgagaccaccaccctcttccagttcaatgagatgaagaagtacatcgcctacctggtgcggcagctggacatgagcccagaccccaaggccagccagcactttgcccgggtggccgtggtgcagcacgcccccagcgagagcgtggacaatgcctccatgcctcctgtgaaggtggagttcagcctgacagattatggcagcaaggagaagctggtggacttcctgagccggggcatgacccagctgcagggcacccgggccctgggcagcgccatcgagtacaccattgaaaatgtgtttgaaagtgcccccaacccccgggacctgaagatcgtggtgctgatgctgaccggggaggtgcctgagcagcagctggaggaggcccagagggtcatcctgcaggccaagtgcaagggctacttctttgtggtgctgggcatcggcaggaaggtgaacatcaaggaggtgtacacctttgccagcgagcccaatgatgtgttcttcaagctggtggacaagagcacagagctgaatgaggagcccctgatgagatttggccgcctgctgcccagctttgtgtccagtgaaaatgccttctacctgagcccagacatcaggaagcagtgtgactggttccagggcgaccagcccaccaagaacctggtgaagtttggccacaagcaggtgaatgtgcccaacaacgtgaccagcagccccaccagcaaccctgtgaccaccaccaagcctgtgaccaccaccaagcctgtgaccaccaccaccaagcctgtgaccaccaccaccaagcctgtgaccatcatcaaccagcccagcgtgaagccagctgctgccaagccagccccagccaagcctgtggccgccaagcctgtggccaccaagatggccaccgtgcggccccctgtggccgtgaagccagccacagctgccaagcctgtggccgccaagccagctgctgtgcggcccccagctgctgctgctgccaagcctgtggccaccaagccagaggtgccccggccccaggccgccaagccagctgccaccaagccagccaccaccaagcccatggtgaagatgagccgggaggtgcaggtgtttgagatcacagagaacagcgccaagctgcactgggagcgggcagagcccccaggcccctacttctatgacctgactgtgaccagcgcccatgaccagagcctggtgctgaagcagaacctgactgtgacagacagagtgattggaggcctgctggccggccagacctaccacgtggccgtggtgtgctacctgcggagccaggtgcgggccacctaccacggcagcttcagcaccaagaagagccagcccccaccaccccagcctgcccggagcgccagcagcagcaccatcaacctgatggtgtccacagagcccctggccctgacagaaacagacatctgcaagctgcccaaggatgagggcacctgccgggacttcatcctgaagtggtactatgaccccaacaccaagagctgtgcccgcttctggtacggcggctgcggcggcaatgaaaacaagtttggcagccagaaggaatgtgagaaggtgtgtgcccctgtgctggccaagccaggagtcatctctgtgatgggcacctag

SEQ ID NO: 3247 - DNA, 8931 bp, Artificial Sequence
  Description of Artificial Sequence: Synthetic coding sequence
atgaggaagcaccgccacctgcccctggtggccgtgttctgcctcttcctgagcggcttccccaccacccacgcccagcagcagcaggctgatgtgaagaatggagctgctgctgacatcatcttcctggtggacagctcctggaccatcggggaggagcacttccagctggtgcgggagttcctgtatgatgtggtgaagagcctggccgtgggagaaaatgacttccactttgccctggtgcagttcaacggcaacccccacacagagttcctgctgaacacctaccgcaccaagcaggaggtgctgagccacatcagcaacatgagctacatcggcggcaccaaccagacaggcaagggcctggagtacatcatgcagagccacctgaccaaggccgccggcagcagagctggagatggagtgccccaggtgattgtggtgctgacagatggccacagcaaggatggcctggccctgcccagcgctgagctgaagtctgcagatgtgaatgtgtttgccatcggcgtggaggatgctgatgaaggagccctgaaggagatcgccagcgagcccctgaacatgcacatgttcaacctggagaacttcaccagcctgcatgacatcgtgggcaacctggtgtcctgtgtgcacagctctgtgtccccagagcgggccggggacacagagaccctgaaggacatcaccgtcatcgaggtgaacaagagggacatcgtgttcctggtggatggcagcagcgccctgggcctggccaacttcaatgccatccgggacttcatcgccaaggtgatccagaggctggagatcggccaggacctgatccaggtggccgtggcccagtatgctgacacagtgcggcctgagttctacttcaacacccaccccaccaagcgggaggtgatcacagctgtgaggaagatgaagcccctggatggcagcgccctgtacacaggcagcgccctggactttgtgaggaacaacctcttcaccagcagcgctggctacagagctgctgagggcatccccaagctgctggtgctgatcaccggcggcaagagcctggatgagatcagccagcctgcccaggagctgaagaggagcagcatcatggcctttgccatcggcaacaagggagctgaccaggccgagctggaggagatcgcctttgacagcagcctggtgttcatcccagctgagttccgggccgcccccctgcagggcatgctgcccggcctgctggcccccctgcggaccctgagcggcaccccagaggtgcacagcaacaagagggacatcatcttcctgctggatggcagcgccaacgtgggcaagaccaacttcccctacgtgcgggactttgtgatgaacctggtgaacagcctggacattggaaatgacaacatccgggtgggcctggtgcagttcagtgacacccctgtgacagagttcagcctgaacacctaccagaccaagagtgacatcctgggccacctgcggcagctgcagctgcagggcggcagcggcctgaacacaggcagcgccctgtcctatgtgtatgccaaccacttcacagaagctgggggcagccgcatccgggagcacgtgccccagctgctgctgctgctgacagctggccagagtgaagattcctacctgcaggccgccaatgccctgacccgggccggcatcctgaccttctgtgtgggcgccagccaggccaacaaggccgagctggagcagatcgccttcaaccccagcctggtgtacctgatggatgacttcagcagcctgcctgccctgccccagcagctgatccagcccctgaccacctacgtgtctgggggcgtggaggaggtgcccctggcccagcctgagagcaagagggacatcctcttcctgtttgatggcagcgccaacctggtgggccagtttcctgtggtgcgggacttcctgtacaagatcattgatgagctgaatgtgaagccagagggcaccagaattgctgtggcccagtacagtgatgatgtgaaggtggagagcagatttgatgagcaccagagcaagccagagatcctgaacctggtgaagaggatgaagatcaagacaggcaaggccctgaacctgggctacgccctggactatgcccagcgctacatctttgtgaagtctgctggcagcagaattgaagatggagtgctgcagttcctggtgctgctggtggccggccgcagcagtgacagagtggatggccctgccagcaacctgaagcagagcggcgtggtgcccttcatcttccaggccaagaatgctgaccctgctgagctggagcagatcgtgctgagccctgccttcatcctggccgctgagagcctgcccaagattggagacctgcacccccagatcgtgaacctgctgaagtctgtgcacaatggagccccagcccctgtgtctggagagaaggatgtggtgttcctgctggatggcagcgagggcgtgcgcagcggcttccccctgctgaaggagtttgtgcagagggtggtggagagcctggatgtgggccaggacagagtgcgggtggccgtggtgcagtacagcgacaggaccaggcctgagttctacctgaacagctacatgaacaagcaggatgtggtgaatgctgtgcggcagctgaccctgctgggcggccccacccccaacacaggagctgccctggagtttgtgctgaggaacatcctggtgagcagcgctggcagccgcatcacagagggcgtgccccagctgctgattgtgctgacagctgacagaagtggagatgatgtgaggaaccccagcgtggtggtgaagagaggaggagctgtgcccatcggcatcggcattggaaatgctgacatcacagagatgcagaccatctccttcatcccagactttgctgtggccatccccaccttccggcagctgggcaccgtgcagcaggtgatcagcgagcgggtgacccagctgacccgggaggagctgagccggctgcagcctgtgctgcagcccctgcccagccctggggtgggcggcaagagagatgtggtgttcctgattgatggcagccagagcgctggccctgagttccagtatgtgaggaccctcatcgagcggctggtggactacctggatgtgggctttgacaccaccagggtggccgtcatccagttcagtgatgaccccaaggtggagttcctgctgaatgcccacagcagcaaggatgaggtgcagaatgctgtgcagaggctgcggcccaagggcggccggcagatcaacgtgggcaatgccctggagtatgtgtccaggaacatcttcaagaggcccctgggcagcagaattgaggagggcgtgccccagttcctggtgctgatcagcagcggcaagagtgatgatgaggtggatgatcctgctgtggagctgaagcagtttggagtggcccccttcaccatcgccagaaatgctgaccaggaggagctggtgaagatcagcctgagcccagaatatgtgttttctgtgtccaccttccgggagctgcccagcctggagcagaagctgctgacccccatcaccaccctgaccagcgagcagatccagaagctgctggccagcacccgctacccacctcctgctgtggagagtgatgctgctgacatcgtgttcctgattgacagcagcgagggcgtgcggccagatggctttgcccacatccgggactttgtgtccagaattgtgcggcggctgaacatcggccccagcaaggtgcgggtgggcgtggtgcagttcagcaatgatgtgtttcctgagttctacctgaagacctaccgcagccaggcccctgtgctggatgccatccggcggctgcggctgcggggcggcagccccctgaacacaggcaaggccctggagtttgtggccaggaacctgtttgtgaagtctgctggcagcagaattgaagatggagtgccccagcacctggtgctggtgctgggcggcaagagccaggatgatgtgtccagatttgcccaggtgatccgcagcagcggcatcgtgtccctgggcgtgggggacagaaatattgacagaacagagctgcagaccatcaccaatgacccccggctggtgttcaccgtgcgggagttccgggagctgcccaacatcgaggagcgcatcatgaacagctttggccccagcgctgccaccccagcccctcctggggtggacaccccaccacccagcaggcctgagaagaagaaggctgacatcgtgttcctgctggatggcagcatcaacttccggcgggacagcttccaggaggtgctgcgctttgtgtctgagatcgtggacacagtgtatgaagatggagacagcatccaggtgggcctggtgcagtacaacagcgaccccacagatgagttcttcctgaaggacttcagcaccaagaggcagatcattgatgccatcaacaaggtggtgtacaagggcggcagacatgccaacaccaaggtgggcctggagcacctgcgggtgaaccactttgtgcctgaggccggcagccggctggaccagagggtgccccagatcgcctttgtgatcaccggcggcaagtctgtggaggatgcccaggatgtgtccctggccctgacccagaggggcgtgaaggtgtttgctgtgggcgtgaggaacatcgacagcgaggaggtgggcaagatcgccagcaacagcgccacagccttccgggtgggcaatgtgcaggagctgtctgagctgtctgagcaggtgctggagaccctgcatgatgccatgcatgagaccctgtgccctggggtgacagatgctgccaaggcctgcaacctggatgtgatcctgggctttgatggcagccgggaccagaatgtgtttgtggcccagaagggctttgagagcaaggtggatgccatcctgaaccgcatcagccagatgcaccgggtgtcctgcagcggcggccgcagccccaccgtgcgggtgtctgtggtggccaacacccccagcggccctgtggaggcctttgattttgatgagtaccagcctgagatgctggagaagttcaggaacatgaggagccagcacccctacgtgctgacagaggacaccctgaaggtgtacctgaacaagttccggcagagcagcccagattctgtgaaggtggtgatccacttcacagatggagcagatggagacctggccgacctgcaccgggccagcgagaacctgcggcaggagggcgtgcgggccctgatcctggtgggcctggagcgggtggtgaacctggagcggctgatgcacctggagtttggccggggcttcatgtatgaccggcccctgcggctgaacctgctggacctggactatgagctggccgagcagctggacaacattgctgagaaggcctgctgcggcgtgccctgcaagtgcagcggccagagaggagaccggggccccatcggcagcatcggccccaagggcatccctggagaagatggctaccggggctacccaggagatgaaggaggccctggagagcggggccccccaggagtgaatggcacccagggcttccagggctgccccggccagaggggcgtgaagggcagccggggcttccctggagagaagggggaggtgggggagatcggcctggatggcctggatggagaagatggagacaagggcctgcccggcagcagcggggagaagggcaaccctggccggcggggggacaagggccccagaggagagaagggggagagaggagatgtgggcatccggggggaccccggcaaccctggccaggacagccaggagcggggccccaagggggagaccggggacctgggccccatgggcgtgcccggcagagatggagtgcctgggggccctggagaaacaggcaagaatggaggctttggaagaagaggccccccaggggccaagggcaacaagggcggccctggccagcccggctttgaaggagagcagggcaccaggggggcccagggccctgctggccctgctggccccccaggcctgattggagagcagggcatcagcggcccccggggcagcggcggggccgccggggcccctggagagcggggccgcacaggccccctgggcaggaaaggagagcccggggagcccggccccaagggcggcatcggcaacagaggccccagaggagaaacaggagatgatggaagagatggagtgggcagcgagggcagaagaggcaagaagggggagcggggcttccctggctacccaggccccaagggcaaccctggagagcccggcctgaatggcaccaccggccccaagggcatccggggcagaagaggcaacagcggccccccaggcatcgtgggccagaagggggaccccggctacccaggccctgctggccccaagggcaacagaggagacagcattgaccagtgtgccctgatccagagcatcaaggacaagtgcccctgctgctacggccccctggagtgccctgtgttccccacagagctggcctttgccctggacaccagcgagggcgtgaaccaggacacctttggaaggatgagagatgtggtgctgagcatcgtgaatgacctgaccatcgccgagagcaactgccccaggggggcccgggtggccgtggtgacctacaacaatgaggtgaccacagagatccgctttgctgacagcaagaggaagtctgtgctgctggacaagatcaagaacctgcaggtggccctgaccagcaagcagcagagcctggagacagccatgagctttgtggccaggaacaccttcaagagggtgagaaatggcttcctgatgaggaaggtggccgtgttcttcagcaacacccccacccgggccagcccccagctgcgggaggccgtgctgaagctgagtgatgctggcatcacccccctcttcctgacccggcaggaggaccggcagctgatcaatgccctgcagatcaacaacacagctgtgggccacgccctggtgctgcctgctggccgggacctgacagacttcctggagaatgtgctgacctgccacgtgtgcctggacatctgcaacatcgaccccagctgtggcttcggctcctggaggcccagcttccgggaccggcgggctgctggcagtgatgtggacatcgacatggccttcatcctggacagcgctgagaccaccaccctcttccagttcaatgagatgaagaagtacatcgcctacctggtgcggcagctggacatgagcccagaccccaaggccagccagcactttgcccgggtggccgtggtgcagcacgcccccagcgagagcgtggacaatgcctccatgcctcctgtgaaggtggagttcagcctgacagattatggcagcaaggagaagctggtggacttcctgagccggggcatgacccagctgcagggcacccgggccctgggcagcgccatcgagtacaccattgaaaatgtgtttgagagcgcccccaacccccgggacctgaagatcgtggtgctgatgctgactggagaggtgcctgagcagcagctggaggaggcccagagggtcatcctgcaggccaagtgcaagggctacttctttgtggtgctgggcattggaaggaaggtgaacatcaaggaggtgtacacctttgccagcgagcccaatgatgtgttcttcaagctggtggacaagagcacagagctgaatgaggagcccctgatgagatttggccgcctgctgcccagctttgtgtccagtgaaaatgccttctacctgagcccagacatcaggaagcagtgtgactggttccagggcgaccagcccaccaagaacctggtgaagtttggccacaagcaggtgaatgtgcccaacaacgtgaccagcagccccaccagcaaccctgtgaccaccaccaagcctgtgaccaccaccaagcctgtgaccaccaccaccaagcctgtgaccaccaccaccaagcctgtgaccatcatcaaccagcccagcgtgaagccagctgctgccaagccagccccagccaagcctgtggccgccaagcctgtggccaccaagatggccaccgtgcggccccctgtggccgtgaagccagccacagctgccaagcctgtggccgccaagccagctgctgtgcggcccccagctgctgctgctgccaagcctgtggccaccaagccagaggtgccccggccccaggccgccaagccagctgccaccaagccagccaccaccaagcccatggtgaagatgagccgggaggtgcaggtgtttgagatcacagaaaattctgccaagctgcactgggagagagctgagcccccaggcccctacttctatgacctgactgtgaccagcgcccatgaccagagcctggtgctgaagcagaacctgactgtgacagacagagtcatcggcggcctgctggccggccagacctaccacgtggccgtggtgtgctacctgcggagccaggtgcgggccacctaccacggcagcttcagcaccaagaagagccagcccccaccaccccagcctgcccggagcgccagcagcagcaccatcaacctgatggtgtccacagagcccctggccctgacagaaacagacatctgcaagctgcccaaggatgagggcacctgccgggacttcatcctgaagtggtactatgaccccaacaccaagagctgtgcccgcttctggtatggaggctgcggcggcaatgaaaacaagtttggcagccagaaggaatgtgagaaggtgtgtgcccctgtgctggccaagccaggagtcatctctgtgatgggcacctag

SEQ ID NO: 3248 - DNA, 8916 bp, Artificial Sequence
  Description of Artificial Sequence: Synthetic coding sequence
atgaggaagcaccgccacctgcccctggtggccgtgttctgcctcttcctgagcggcttccccaccacccacgcccagcagcagcaggccgcccaggacagcgctgacatcatcttcctgattgatggcagcaacaacacaggctctgtgaactttgctgtgatcctggacttcctggtgaacctgctggagaagctgcccatcggcacccagcagatccgggtgggcgtggtgcagttcagtgatgagcccaggaccatgttcagcctggacacctacagcaccaaggcccaggtgctgggcgctgtgaaggccctgggctttgctggaggagagctggccaacatcggcctggccctggactttgtggtggagaaccacttcaccagggctgggggcagccgggtggaggagggcgtgccccaggtgctggtgctgatctctgctggccccagcagtgatgagatccgctatggagtggtggccctgaagcaggcctctgtgttctcctttggcctgggcgcccaggccgccagcagagctgagctgcagcacatcgccacagatgacaacctggtgttcaccgtgcctgagttccgcagctttggagacctgcaggagaagctgctgccctacatcgtgggcgtggcccagaggcacatcgtgctgaagccacccaccatcgtgacccaggtgattgaggtgaacaagagggacatcgtgttcctggtggatggcagcagcgccctgggcctggccaacttcaatgccatccgggacttcatcgccaaggtgatccagaggctggagatcggccaggacctgatccaggtggccgtggcccagtatgctgacacagtgcggcctgagttctacttcaacacccaccccaccaagcgggaggtgatcacagctgtgaggaagatgaagcccctggatggcagcgccctgtacacaggcagcgccctggactttgtgaggaacaacctcttcaccagcagcgctggctacagagctgctgagggcatccccaagctgctggtgctgatcactggaggcaagagcctggatgagatcagccagcctgcccaggagctgaagaggagcagcatcatggcctttgccatcggcaacaagggagctgaccaggccgagctggaggagatcgcctttgacagcagcctggtgttcatcccagctgagttccgggccgcccccctgcagggcatgctgcccggcctgctggcccccctgcggaccctgagcggcaccccagaggtgcacagcaacaagagggacatcatcttcctgctggatggcagcgccaacgtgggcaagaccaacttcccctacgtgcgggactttgtgatgaacctggtgaacagcctggacattggaaatgacaacatccgggtgggcctggtgcagttcagtgacacccctgtgacagagttcagcctgaacacctaccagaccaagagtgacatcctgggccacctgcggcagctgcagctgcagggcggcagcggcctgaacacaggcagcgccctgtcctatgtgtatgccaaccacttcacagaggccggcggcagccgcatccgggagcacgtgccccagctgctgctgctgctgacagctggccagagcgaggacagctacctgcaggccgccaatgccctgaccagggctggcatcctgaccttctgtgtgggcgccagccaggccaacaaggccgagctggagcagatcgccttcaaccccagcctggtgtacctgatggatgacttcagcagcctgcctgccctgccccagcagctgatccagcccctgaccacctacgtgtctggaggagtggaggaggtgcccctggcccagcctgagagcaagagggacatcctcttcctgtttgatggcagcgccaacctggtgggccagtttcctgtggtgcgggacttcctgtacaagatcattgatgagctgaatgtgaagccagagggcaccagaattgctgtggcccagtacagtgatgatgtgaaggtggagagcagatttgatgagcaccagagcaagccagagatcctgaacctggtgaagaggatgaagatcaagacaggcaaggccctgaacctgggctacgccctggactatgcccagcgctacatctttgtgaagtctgctggcagcagaattgaagatggagtgctgcagttcctggtgctgctggtggccggccgcagcagtgacagagtggatggccctgccagcaacctgaagcagagcggcgtggtgcccttcatcttccaggccaagaatgctgaccctgctgagctggagcagatcgtgctgagccctgccttcatcctggccgctgagagcctgcccaagatcggggacctgcacccccagatcgtgaacctgctgaagtctgtgcacaacggggccccagcccctgtgtctggagagaaggatgtggtgttcctgctggatggcagcgagggcgtgcgcagcggcttccccctgctgaaggagtttgtgcagagggtggtggagagcctggatgtgggccaggacagagtgcgggtggccgtggtgcagtacagcgacaggaccaggcctgagttctacctgaacagctacatgaacaagcaggatgtggtgaatgctgtgcggcagctgaccctgctgggcggccccacccccaacacaggagctgccctggagtttgtgctgaggaacatcctggtgtcctctgctggcagccgcatcacagaaggagtgccccagctgctgattgtgctgacagctgacagaagtggagatgatgtgaggaaccccagcgtggtggtgaagaggggcggcgctgtgcccatcggcattggaattggaaatgctgacatcacagagatgcagaccatctccttcatcccagactttgctgtggccatccccaccttccggcagctgggcaccgtgcagcaggtgatcagcgagcgggtgacccagctgacccgggaggagctgagccggctgcagcctgtgctgcagcccctgcccagccctggggtgggcggcaagagagatgtggtgttcctgattgatggcagccagagcgctggccctgagttccagtatgtgaggaccctgattgagcggctggtggactacctggatgtgggctttgacaccaccagggtggccgtcatccagttcagtgatgaccccaaggtggagttcctgctgaatgcccacagcagcaaggatgaggtgcagaatgctgtgcagaggctgcggcccaagggcggccggcagatcaacgtgggcaatgccctggagtatgtgtccaggaacatcttcaagaggcccctgggcagccgcatcgaggagggcgtgccccagttcctggtgctgatcagcagcggcaagagtgatgatgaggtggatgatcctgctgtggagctgaagcagtttggagtggcccccttcaccatcgccagaaatgctgaccaggaggagctggtgaagatcagcctgagcccagaatatgtgttttctgtgtccaccttccgggagctgcccagcctggagcagaagctgctgacccccatcaccaccctgaccagcgagcagatccagaagctgctggccagcacccgctacccacctcctgctgtggagagtgatgctgctgacatcgtgttcctgattgacagcagcgagggcgtgcggccagatggctttgcccacatccgggactttgtgagccgcatcgtgcggcggctgaacatcggccccagcaaggtgcgggtgggcgtggtgcagttcagcaatgatgtgtttcctgagttctacctgaagacctaccgcagccaggcccctgtgctggatgccatccggcggctgcggctgcggggcggcagccccctgaacacaggcaaggccctggagtttgtggccaggaacctgtttgtgaagtctgctggcagcagaattgaagatggagtgccccagcacctggtgctggtgctgggcggcaagagccaggatgatgtgtccagatttgcccaggtgatccgcagcagcggcatcgtgtccctgggcgtgggggacaggaacatcgacagaacagagctgcagaccatcaccaatgacccccggctggtgttcaccgtgcgggagttccgggagctgcccaacatcgaggagcgcatcatgaacagctttggccccagcgctgccaccccagcccctcctggggtggacaccccaccacccagcaggcctgagaagaagaaggctgacatcgtgttcctgctggatggcagcatcaacttcagaagagacagcttccaggaggtgctgcgctttgtgtctgaaattgtggacacagtgtatgaagatggagacagcatccaggtgggcctggtgcagtacaacagcgaccccacagatgagttcttcctgaaggacttcagcaccaagaggcagatcattgatgccatcaacaaggtggtgtacaagggcggcagacatgccaacaccaaggtgggcctggagcacctgcgggtgaaccactttgtgcctgaggccggcagccggctggaccagagggtgccccagatcgccttcgtcatcactggaggcaagtctgtggaggatgcccaggatgtgtccctggccctgacccagaggggcgtgaaggtgtttgctgtgggcgtgagaaatattgattctgaggaggtgggcaagatcgccagcaacagcgccacagccttccgggtgggcaatgtgcaggagctgtctgagctgtctgagcaggtgctggagaccctgcatgatgccatgcatgagaccctgtgccctggggtgacagatgctgccaaggcctgcaacctggatgtgatcctgggctttgatggcagccgggaccagaatgtgtttgtggcccagaagggctttgagagcaaggtggatgccatcctgaaccgcatcagccagatgcaccgggtgtcctgcagcggcggccgcagccccaccgtgcgggtgtctgtggtggccaacaccccatctggccctgtggaggcctttgattttgatgagtaccagcctgagatgctggagaagttcaggaacatgaggagccagcacccctacgtgctgacagaggacaccctgaaggtgtacctgaacaagttccggcagagcagcccagacagcgtgaaggtggtgatccacttcacagatggagcagatggagacctggccgacctgcaccgggccagcgagaacctgcggcaggagggcgtgcgggccctgatcctggtgggcctggagcgggtggtgaacctggagcggctgatgcacctggagtttggccggggcttcatgtatgaccggcccctgcggctgaacctgctggacctggactatgagctggccgagcagctggacaacattgctgagaaggcctgctgcggcgtgccctgcaagtgcagcggccagagaggagaccggggccccatcggcagcatcggccccaagggcatccctggagaagatggctaccggggctacccaggagatgagggcggccctggagagcggggccccccaggagtgaatggcacccagggcttccagggctgccccggccagaggggcgtgaagggcagccggggcttccctggagagaagggggaggtgggggagatcggcctggatggcctggatggagaagatggagacaagggcctgcccggcagcagtggagagaagggcaaccctggaagaagaggagacaagggccccagaggagagaagggggagagaggagatgtgggcatccggggggaccccggcaaccctggccaggacagccaggagcggggccccaagggggagactggagacctgggccccatgggcgtgcccggcagagatggagtgcctgggggccctggagagaccgggaagaatggaggcttcggccggcggggccccccaggggccaagggcaacaagggcggccctggccagcccggctttgaaggagagcagggcaccaggggggcccagggccctgctggccctgctggccccccaggcctcatcggggagcagggcatcagcggcccccggggcagcggcggcgctgctggggcccctggagagcggggccgcacaggccccctgggcaggaagggggagcctggagagcccggccccaagggcggcatcggcaacagaggccccagaggagaaacaggagatgatggaagagatggagtgggcagcgagggccggcggggcaagaagggggagcggggcttccctggctacccaggccccaagggcaaccctggagagcccggcctgaatggcaccaccggccccaagggcatccggggccggcggggcaacagcggccccccaggcatcgtgggccagaagggggaccccggctacccaggccctgctggccccaagggcaacagaggagacagcattgaccagtgtgccctgatccagagcatcaaggacaagtgcccctgctgctacggccccctggagtgccctgtgttccccacagagctggcctttgccctggacaccagcgagggcgtgaaccaggacaccttcggccgcatgagagatgtggtgctgagcatcgtgaatgacctgaccatcgccgagagcaactgccccaggggggcccgggtggccgtggtgacctacaacaatgaggtgaccacagagatccgctttgctgacagcaagaggaagtctgtgctgctggacaagatcaagaacctgcaggtggccctgaccagcaagcagcagagcctggagacagccatgagctttgtggccaggaacaccttcaagagggtgagaaatggcttcctgatgaggaaggtggccgtgttcttcagcaacacccccacccgggccagcccccagctgcgggaggccgtgctgaagctgagtgatgctggcatcacccccctcttcctgacccggcaggaggaccggcagctgatcaatgccctgcagatcaacaacacagctgtgggccacgccctggtgctgcctgctggccgggacctgacagacttcctggagaatgtgctgacctgccacgtgtgcctggacatctgcaacatcgaccccagctgtggcttcggctcctggaggcccagcttccgggacagaagagctgctggcagtgatgtggacatcgacatggccttcatcctggacagcgctgagaccaccaccctcttccagttcaatgagatgaagaagtacatcgcctacctggtgcggcagctggacatgagcccagaccccaaggccagccagcactttgcccgggtggccgtggtgcagcacgcccccagcgagagcgtggacaatgcctccatgcctcctgtgaaggtggagttcagcctgacagattatggcagcaaggagaagctggtggacttcctgagccggggcatgacccagctgcagggcacccgggccctgggcagcgccatcgagtacaccattgaaaatgtgtttgaaagtgcccccaacccccgggacctgaagatcgtggtgctgatgctgaccggggaggtgcctgagcagcagctggaggaggcccagagggtcatcctgcaggccaagtgcaagggctacttctttgtggtgctgggcatcggcaggaaggtgaacatcaaggaggtgtacacctttgccagcgagcccaatgatgtgttcttcaagctggtggacaagagcacagagctgaatgaggagcccctgatgagatttggccgcctgctgcccagctttgtgtccagtgaaaatgccttctacctgagcccagacatcaggaagcagtgtgactggttccagggcgaccagcccaccaagaacctggtgaagtttggccacaagcaggtgaatgtgcccaacaacgtgaccagcagccccaccagcaaccctgtgaccaccaccaagcctgtgaccaccaccaagcctgtgaccaccaccaccaagcctgtgaccaccaccaccaagcctgtgaccatcatcaaccagcccagcgtgaagccagctgctgccaagccagccccagccaagcctgtggccgccaagcctgtggccaccaagatggccaccgtgcggccccctgtggccgtgaagccagccacagctgccaagcctgtggccgccaagccagctgctgtgcggcccccagctgctgctgctgccaagcctgtggccaccaagccagaggtgccccggccccaggccgccaagccagctgccaccaagccagccaccaccaagcccatggtgaagatgagccgggaggtgcaggtgtttgagatcacagagaacagcgccaagctgcactgggagcgggcagagcccccaggcccctacttctatgacctgactgtgaccagcgcccatgaccagagcctggtgctgaagcagaacctgactgtgacagacagagtgattggaggcctgctggccggccagacctaccacgtggccgtggtgtgctacctgcggagccaggtgcgggccacctaccacggcagcttcagcaccaagaagagccagcccccaccaccccagcctgcccggagcgccagcagcagcaccatcaacctgatggtgtccacagagcccctggccctgacagaaacagacatctgcaagctgcccaaggatgagggcacctgccgggacttcatcctgaagtggtactatgaccccaacaccaagagctgtgcccgcttctggtacggcggctgcggcggcaatgaaaacaagtttggcagccagaaggaatgtgagaaggtgtgtgcccctgtgctggccaagccaggagtcatctctgtgatgggcacctag

SEQ ID NO: 3249 - DNA, 3111 bp, Artificial Sequence
  Description of Artificial Sequence: Synthetic coding sequence
atgaggaagcaccgccacctgcccctggtggccgtgttctgcctcttcctgagcggcttccccaccacccacgcccagcagcagcaggccgtcatcgaggtgaacaagagggacatcgtgttcctggtggatggcagcagcgccctgggcctggccaacttcaatgccatccgggacttcatcgccaaggtgatccagaggctggagatcggccaggacctgatccaggtggccgtggcccagtatgctgacacagtgcggcctgagttctacttcaacacccaccccaccaagcgggaggtgatcacagctgtgaggaagatgaagcccctggatggcagcgccctgtacacaggcagcgccctggactttgtgaggaacaacctcttcaccagcagcgctggctacagagctgctgagggcatccccaagctgctggtgctgatcaccggcggcaagagcctggatgagatcagccagcctgcccaggagctgaagaggagcagcatcatggcctttgccatcggcaacaagggagctgaccaggccgagctggaggagatcgcctttgacagcagcctggtgttcatcccagctgagttccgggccgcccccctgcagggcatgctgcccggcctgctggcccccctgcggaccctgagcggcaccccagaggtgcacagcaacaagagggacatcatcttcctgctggatggcagcgccaacgtgggcaagaccaacttcccctacgtgcgggactttgtgatgaacctggtgaacagcctggacattggaaatgacaacatccgggtgggcctggtgcagttcagtgacacccctgtgacagagttcagcctgaacacctaccagaccaagagtgacatcctgggccacctgcggcagctgcagctgcagggcggcagcggcctgaacacaggcagcgccctgtcctatgtgtatgccaaccacttcacagaagctgggggcagccgcatccgggagcacgtgccccagctgctgctgctgctgacagctggccagagtgaagattcctacctgcaggccgccaatgccctgacccgggccggcatcctgaccttctgtgtgggcgccagccaggccaacaaggccgagctggagcagatcgccttcaaccccagcctggtgtacctgatggatgacttcagcagcctgcctgccctgccccagcagctgatccagcccctgaccacctacgtgtctgggggcgtggaggaggtgcccctggcccagcctgagagcaagagggacatcctcttcctgtttgatggcagcgccaacctggtgggccagtttcctgtggtgcgggacttcctgtacaagatcattgatgagctgaatgtgaagccagagggcaccagaattgctgtggcccagtacagtgatgatgtgaaggtggagagcagatttgatgagcaccagagcaagccagagatcctgaacctggtgaagaggatgaagatcaagacaggcaaggccctgaacctgggctacgccctggactatgcccagcgctacatctttgtgaagtctgctggcagcagaattgaagatggagtgctgcagttcctggtgctgctggtggccggccgcagcagtgacagagtggatggccctgccagcaacctgaagcagagcggcgtggtgcccttcatcttccaggccaagaatgctgaccctgctgagctggagcagatcgtgctgagccctgccttcatcctggccgctgagagcctgcccaagattggagacctgcacccccagatcgtgaacctgctgaagtctgtgcacaatggagccccagcccctgtgtctggagagaaggatgtggtgttcctgctggatggcagcgagggcgtgcgcagcggcttccccctgctgaaggagtttgtgcagagggtggtggagagcctggatgtgggccaggacagagtgcgggtggccgtggtgcagtacagcgacaggaccaggcctgagttctacctgaacagctacatgaacaagcaggatgtggtgaatgctgtgcggcagctgaccctgctgggcggccccacccccaacacaggagctgccctggagtttgtgctgaggaacatcctggtgagcagcgctggcagccgcatcacagagggcgtgccccagctgctgattgtgctgacagctgacagaagtggagatgatgtgaggaaccccagcgtggtggtgaagagaggaggagctgtgcccatcggcatcggcattggaaatgctgacatcacagagatgcagaccatctccttcatcccagactttgctgtggccatccccaccttccggcagctgggcaccgtgcagcaggtgatcagcgagcgggtgacccagctgacccgggaggagctgagccggctgcagcctgtgctgcagcccctgcccagccctggggtgggcggcaagagagatgtggtgttcctgattgatggcagccagagcgctggccctgagttccagtatgtgaggaccctcatcgagcggctggtggactacctggatgtgggctttgacaccaccagggtggccgtcatccagttcagtgatgaccccaaggtggagttcctgctgaatgcccacagcagcaaggatgaggtgcagaatgctgtgcagaggctgcggcccaagggcggccggcagatcaacgtgggcaatgccctggagtatgtgtccaggaacatcttcaagaggcccctgggcagcagaattgaggagggcgtgccccagttcctggtgctgatcagcagcggcaagagtgatgatgaggtggatgatcctgctgtggagctgaagcagtttggagtggcccccttcaccatcgccagaaatgctgaccaggaggagctggtgaagatcagcctgagcccagaatatgtgttttctgtgtccaccttccgggagctgcccagcctggagcagaagctgctgacccccatcaccaccctgaccagcgagcagatccagaagctgctggccagcacccgctacccacctcctggagagatgggcgccagcgaggtgctgctgggcgccttcagcatctag

SEQ ID NO: 3250 - DNA, 8916 bp, Artificial Sequence; identical to SEQ ID NO: 3248
  Description of Artificial Sequence: Synthetic coding sequence

SEQ ID NO: 3251 - DNA, 7848 bp, Artificial Sequence
  Description of Artificial Sequence: Synthetic coding sequence
atgaagatcctgctgatcatctttgtgctgatcatctggacagagaccctggccgaccagagccctggccctggccctgtgtatgcagatgtggtgttcctggtggacagcagtgaccacctgggccccaagagcttcccctttgtgaagaccttcatcaacaagatgatcaacagcctgcccatcgaggccaacaagtacagagtggccctggcccagtacagtgatgagttccacagcgagttccacctgagcaccttcaagggccgcagccccatgctgaaccacctgaagaagaacttccagttcatcggcggcagcctgcagatcggcaaggccctgcaggaggcccacaggacctacttcagcgcccccatcaatggccgggacaggaagcagtttcctcccatcctggtggtgctggccagcgctgagagtgaagatgaggtggaggaggccagcaaggccctgcagaaggatggagtgaagatcatctctgtgggcgtgcagaaggccagcgaggagaacctgaaggccatggccaccagccacttccacttcaacctgcggaccatccgggacctgagcaccttcagccagaacatgacccagatcatcaaggatgtgaccaagtacaaggagggcgctgtggatgctgacatgcaggtgcacttccccatcagctgccagaaggacagcctggccgacctggtgttcctggtggatgagagcctgggcactggaggcaacctgcggcacctgcagaccttcctggagaacatcaccagctccatggatgtgaaggagaactgcatgaggctgggcctgatgagctacagcaacagcgccaagaccatctccttcctgaagagcagcaccacccagagcgagttccagcagcagatcaagaacctgagcatccaggtgggcaagagcaacacaggagctgccatcgaccagatgagaagagatggcttcagcgagagctatggcagcagaagagcccagggcgtgccccagattgctgtgctggtgacccaccggcccagtgatgatgaggtgcatgatgctgccctgaacctgcggctggaggatgtgaatgtgtttgccctgagcatccagggcgccaacaacacccagctggaggagatcgtgtcctacccacctgagcagaccatcagcaccctgaagagctatgctgacctggagacctacagcaccaagttcctgaagaagctgcagaatgagatctggagccagatcagcacctatgcagagcagaggaacctggacaagacaggctgtgtggacaccaaggaggccgacatccacttcctgattgatggcagcagcagcatccaggagaagcagtttgagcagatcaagcgcttcatgctggaggtgacagagatgttcagcatcggccctgacaaggtgcgggtgggcgtggtgcagtacagtgatgacacagaggtggagttctacatcacagactacagcaatgacatcgacctgaggaaggccatcttcaacatcaagcagctgaccggcggcacctacacaggcaaggccctggactacatcctgcagatcatcaagaatggcatgaaggacaggatgagcaaggtgccctgctacctgattgtgctgacagatggcatgagcacagacagagtggtggagcccgccaagaggctgcgggcagagcagatcaccgtgcatgctgtgggcatcggggccgccaacaagattgagctgcaggagattgctgggaaggaggagcgggtgtcctttggccagaactttgatgccctgaagagcatcaagaatgaggtggtgcgggagatctgtgccgagaagggctgtgaggacatgaaggctgacatcatgttcctggtggacagctcctggagcattggaaatgaaaacttcaggaagatgaagatcttcatgaagaacctgctgaccaagatccagatcggggctgacaagacccagattggagtggtgcagttcagtgacaagaccaaggaggagttccagctgaaccgctacttcacccagcaggagatcagtgatgccatcgacaggatgagcctcatcaatgaaggcaccctgaccgggaaggccctgaactttgtgggccagtacttcacccacagcaagggggcccggctgggcgccaagaagttcctgatcctgatcacagatggagtggcccaggatgatgtgcgggaccctgcccgcatcctgcggggcaaggatgtgaccatcttctctgtgggcgtgtacaatgccaacagaagccagctggaggagatcagcggggacagcagcctggtgttccacgtggagaactttgaccacctgaaggccctggagaggaagctgatcttccgggtgtgtgccctgcatgactgcaagaggatcaccctgctggatgtggtgtttgtgctggaccacagcggcagcatcaagaagcagtaccaggaccacatgatcaacctgaccatccacctggtgaagaaggcagatgtgggccgggacagagtgcagtttggagccctgaagtacagcgaccagcccaacatcctcttctacctgaacacctacagcaacagaagtgccatcatcgagaacctgaggaagaggcgggacacaggaggcaacacctacacagccaaggccctgaagcacgccaatgccctcttcacagaggagcacggcagccgcatcaagcagaatgtgaagcagatgctgattgtcatcacagatggagagagccatgaccatgaccagctgaatgacacagccctggagctgaggaacaagggcatcaccatctttgctgtgggcgtgggcaaggccaaccagaaggagctggagggcatggccggcaacaagaacaacaccatctacgtggacaactttgacaagctgaaggatgtgttcaccctggtgcaggagaggatgtgcacagaggcccctgaggtgtgccacctgcaggaggctgatgtgatcttcctgtgtgatggcagtgacagagtgagcaacagcgactttgtgaccatgaccaccttcctgagtgacctgattgacaactttgacatccagagccagaggatgaagattggcatggcccagtttggcagcaactaccagagcatcatcgagctgaagaacagcctgaccaagacccagtggaagacccagatccagaatgtgtccaagagcggcggcttccccagaattgactttgccctgaagaaggtgagcaacatgttcaacctgcatgctgggggcagaagaaatgccggcgtgccccagaccctggtggtgatcaccagcggggaccccaggtatgatgtggctgatgctgtgaagaccctgaaggacctgggcatctgtgtgctggtgctgggcattggagatgtgtacaaggagcacctgctgcccatcaccggcaacagcgagaagatcatcaccttccaggactttgacaagctgaagaatgtggatgtgaagaagaggatcatccgggagatctgccagagctgtgggaagaccaactgcttcatggacatcgtggtgggctttgacatcagcacccacgtgcagggccagcccctcttccagggccacccccagctggagagctacctgcccggcatcctggaggacatcagcagcatcaagggcgtgtcctgtggggccggcacagaggcccaggtgtccctggccttcaaggtgaacagcgaccagggcttccctgccaagttccagatctaccagaaggctgtgtttgacagcctgctgcaggtgaatgtgtctggccccacccacctgaatgcccagttcctgcggagcctgtgggacaccttcaaggacaagagcgccagccggggccaggtgctgctgatcttcagtgatggcctgcagagcgagagcaacatcatgctggagaaccagagcgaccggctgcgggaggccggcctggatgccctgctggtggtgtccctgaacaccacagcccaccacgagttcagcagctttgaatttgggaagagatttgactaccgcacccacctgaccatcggcatgagggagctgggcaagaagctgagccagtacctgggcaacattgctgagaggacctgctgctgcaccttctgcaagtgccccggcatccctggcccccacggcacccggggcctgcaggccatgaagggcagccagggcctgaagggcagccggggccacagaggagaagatggcaaccctggggtgcggggggacaccggcccccagggcgacaagggcattgctggctgccctggggcctggggccagaagggcctgaagggcttcagcggccccaagggcggccatggagatgatggcattgatggcctggatggagaggagggctgccacggcttccctggcatcaagggggagaagggggaccccggcagccagggcagccctggcagcagaggagcccctggccagtatggagagaagggcttccctggggaccccggcaaccctggccagaacaacaacatcaagggccagaagggcagcaagggggagcagggccggcagggccgcagcggccagaagggcgtgcagggcagccccagcagccggggcagccggggccgggagggccagaggggcctgcggggcgtgtctggagagcccggcaaccctggccccaccggcaccctgggcgctgagggcctgcagggcccccagggcagccagggcaaccctggcaggaagggggagaagggcagccagggccagaagggcccccagggcagccctggcctgatgggcgccaagggcagcacaggccggcccggcctgctgggcaagaagggggagcccggcctgcccggggacctgggccctgtgggccagacaggccagaggggccggcagggcgacagcggcatccctggctacggccagatgggcaggaagggcgtgaagggcccccggggcttccctggagatgctggccagaagggggacatcggcaaccctggcatccctgggggccctggccccaagggcttccggggcctggccctgactgtgggcctgaagggggaggagggcagccggggcctgcccggccccccaggccagaggggcatcaagggcatggccggccagcctgtgtacagccagtgtgacctgatccgcttcctgcgggagcacagcctgtgcagcctggagaagtgcccagcctaccccacagagctggtgtttgccctggacaacagctatgatgtgacagaggagagcttcaacaagacccgggacatcatcaccagcatcgtgaatgacctgaacatccgggagaacaactgccctgtgggcgcccgggtggccatggtgtcctacaacagcggcaccagctacctgatccgctggagcgactacaacaggaagaagcagctgctgcagcagctgagccagatcaagtaccaggacaccacagagcccagagatgtgggcaatgccatgagatttgtgaccagaaatgtgttcaagaggacctacgccggggccaacgtgagaagagtggccgtgttcttcagcaatggccagacagccagccgcagcagcatcatcacagccaccatggagttcagcgccctggacatcagccccaccgtgtttgcctttgatgagagggtcttcctggaggccttcggctttgacaacacaggcaccttccaggtgattcctgtgccccccaacggggagaaccagaccctggagcggctgcggcgctgtgccctgtgctatgacaagtgcttccccaatgcctgcatccgggaggccttcctgcctgaggacagctacatggatgtggtgttcctgattgacaacagcaggaacatcgccaaggatgagttcaaggctgtgaaggccctggtgagcagcgtcatcgacaacttcaacatcgccagtgaccccctcatcagtgacagcggggaccgcatcgccctgctgagctacagcccctgggagagcagcaggaggaagatgggcaccgtgaagacagaatttgacttcatcacctatgacaaccagctgctgatgaagaaccacatccagaccagcttccagcagctgaatggagaggccaccatcggccgggccctgctgtggaccacagaaaatctcttccctgagaccccctacctgaggaagcacaaggtgatctttgtggtgtctgctggagaaaattatgaaaggaaggagtttgtgaagatgatggccctgcgggccaagtgccagggctacgtgatcttcgtcatcagcctgggcagcaccaggaaggatgacatggaggagctggccagctaccccctggaccagcacctgatccagctgggccgcatccacaagccagacctgaactacatcgccaagttcctgaagcccttcctgtacagcgtgcggcggggcttcaaccagtaccccccacccatgctggaggatgcctgccgcctcatcaacctgggcggggagaacatccagaatgatggcttccagtttgtgacagagctgcaggaggacttcctgggcggcaatggcttcatcggccaggagctgaacagcggccgggagagcccctttgtgaagacagaagataatggaagtgactacctggtgtacctgcccagccagatgtttgagccccagaagctgatgatcaactatgagaaggaccagaagtctgctgagatcgccagcctgaccagcggccacgagaactacggcaggaaggaggagccagaccacacctatgagcctggagatgtgtccctgcaggagtactacatggatgtggccttcctgattgatgccagccagagggtgggcagtgatgagttcaaggaggtgaaggccttcatcacctctgtgctggactacttccacatcgcccccacccccctgaccagcaccctgggggacagagtggccgtgctgagctacagccccccaggctacatgcccaacacagaggagtgccctgtgtacctggagtttgacctggtgacctacaacagcatccaccagatgaagcaccacctgcaggacagccagcagctgaatggagatgtgttcatcggccacgccctgcagtggaccatcgacaacgtgtttgtgggcacccccaacctgaggaagaacaaggtgatctttgtgatctctgctggggagaccaacagcctggacaaggatgtgctgagaaatgtgtccctgcgggccaagtgccagggctacagcatctttgtgttctcctttggccccaagcacaatgacaaggagctggaggagctggccagccaccccctggaccaccacctggtgcagctgggccgcacccacaagccagactggaactacatcatcaagtttgtgaagccctttgtgcacctgatccggcgggccatcaacaagtaccccacagaggacatgaaggccacctgtgtgaacatgaccagccccaacccagaaaatggaggaacagaaaatacagtgctgctgctgcccggcatctatgagatcaagacagaaaatggagacctgtttgatgaatttgacagccaggcccagcacctgctggtgctgggcaacaaccacagcagcggcagcgagacagccacagacctgatgcagaagctgtacctgctcttcagcacagagaagctggccatgaaggacaaggagaaggcccacctggaggagatcagcgccctggtggtggacaagcagcaggagaaggaggacaaggagatggaggccacagacatctag

SEQ ID NO: 3252 - DNA, 7848 bp, Artificial Sequence
  Description of Artificial Sequence: Synthetic coding sequence
atgaagatcctgctgatcatctttgtgctgatcatctggacagagaccctggccgaccagagccctggccctggccctgtgtatgcagatgtggtgttcctggtggacagcagtgaccacctgggccccaagagcttcccctttgtgaagaccttcatcaacaagatgatcaacagcctgcccatcgaggccaacaagtacagagtggccctggcccagtacagtgatgagttccacagcgagttccacctgagcaccttcaagggccgcagccccatgctgaaccacctgaagaagaacttccagttcatcggcggcagcctgcagatcggcaaggccctgcaggaggcccacaggacctacttcagcgcccccatcaatggccgggacaggaagcagtttcctcccatcctggtggtgctggccagcgctgagagtgaagatgaggtggaggaggccagcaaggccctgcagaaggatggagtgaagatcatctctgtgggcgtgcagaaggccagcgaggagaacctgaaggccatggccaccagccacttccacttcaacctgcggaccatccgggacctgagcaccttcagccagaacatgacccagatcatcaaggatgtgaccaagtacaaggagggcgctgtggatgctgacatgcaggtgcacttccccatcagctgccagaaggacagcctggccgacctggtgttcctggtggatgagagcctgggcactggaggcaacctgcggcacctgcagaccttcctggagaacatcaccagctccatggatgtgaaggagaactgcatgaggctgggcctgatgagctacagcaacagcgccaagaccatctccttcctgaagagcagcaccacccagagcgagttccagcagcagatcaagaacctgagcatccaggtgggcaagagcaacacaggagctgccatcgaccagatgagaagagatggcttcagcgagagctatggcagcagaagagcccagggcgtgccccagattgctgtgctggtgacccaccggcccagtgatgatgaggtgcatgatgctgccctgaacctgcggctggaggatgtgaatgtgtttgccctgagcatccagggcgccaacaacacccagctggaggagatcgtgtcctacccacctgagcagaccatcagcaccctgaagagctatgctgacctggagacctacagcaccaagttcctgaagaagctgcagaatgagatctggagccagatcagcacctatgcagagcagaggaacctggacaagacaggctgtgtggacaccaaggaggccgacatccacttcctgattgatggcagcagcagcatccaggagaagcagtttgagcagatcaagcgcttcatgctggaggtgacagagatgttcagcatcggccctgacaaggtgcgggtgggcgtggtgcagtacagtgatgacacagaggtggagttctacatcacagactacagcaatgacatcgacctgaggaaggccatcttcaacatcaagcagctgaccggcggcacctacacaggcaaggccctggactacatcctgcagatcatcaagaatggcatgaaggacaggatgagcaaggtgccctgctacctgattgtgctgacagatggcatgagcacagacagagtggtggagcccgccaagaggctgcgggcagagcagatcaccgtgcatgctgtgggcatcggggccgccaacaagattgagctgcaggagattgctgggaaggaggagcgggtgtcctttggccagaactttgatgccctgaagagcatcaagaatgaggtggtgcgggagatctgtgccgagaagggctgtgaggacatgaaggctgacatcatgttcctggtggacagctcctggagcattggaaatgaaaacttcaggaagatgaagatcttcatgaagaacctgctgaccaagatccagatcggggctgacaagacccagattggagtggtgcagttcagtgacaagaccaaggaggagttccagctgaaccgctacttcacccagcaggagatcagtgatgccatcgacaggatgagcctcatcaatgaaggcaccctgaccgggaaggccctgaactttgtgggccagtacttcacccacagcaagggggcccggctgggcgccaagaagttcctgatcctgatcacagatggagtggcccaggatgatgtgcgggaccctgcccgcatcctgcggggcaaggatgtgaccatcttctctgtgggcgtgtacaatgccaacagaagccagctggaggagatcagcggggacagcagcctggtgttccacgtggagaactttgaccacctgaaggccctggagaggaagctgatcttccgggtgtgtgccctgcatgactgcaagaggatcaccctgctggatgtggtgtttgtgctggaccacagcggcagcatcaagaagcagtaccaggaccacatgatcaacctgaccatccacctggtgaagaaggcagatgtgggccgggacagagtgcagtttggagccctgaagtacagcgaccagcccaacatcctcttctacctgaacacctacagcaacagaagtgccatcatcgagaacctgaggaagaggcgggacacaggaggcaacacctacacagccaaggccctgaagcacgccaatgccctcttcacagaggagcacggcagccgcatcaagcagaatgtgaagcagatgctgattgtcatcacagatggagagagccatgaccatgaccagctgaatgacacagccctggagctgaggaacaagggcatcaccatctttgctgtgggcgtgggcaaggccaaccagaaggagctggagggcatggccggcaacaagaacaacaccatctacgtggacaactttgacaagctgaaggatgtgttcaccctggtgcaggagaggatgtgcacagaggcccctgaggtgtgccacctgcaggaggctgatgtgatcttcctgtgtgatggcagtgacagagtgagcaacagcgactttgtgaccatgaccaccttcctgagtgacctgattgacaactttgacatccagagccagaggatgaagattggcatggcccagtttggcagcaactaccagagcatcatcgagctgaagaacagcctgaccaagacccagtggaagacccagatccagaatgtgtccaagagcggcggcttccccagaattgactttgccctgaagaaggtgagcaacatgttcaacctgcatgctgggggcagaagaaatgccggcgtgccccagaccctggtggtgatcaccagcggggaccccaggtatgatgtggctgatgctgtgaagaccctgaaggacctgggcatctgtgtgctggtgctgggcattggagatgtgtacaaggagcacctgctgcccatcaccggcaacagcgagaagatcatcaccttccaggactttgacaagctgaagaatgtggatgtgaagaagaggatcatccgggagatctgccagagctgtgggaagaccaactgcttcatggacatcgtggtgggctttgacatcagcacccacgtgcagggccagcccctcttccagggccacccccagctggagagctacctgcccggcatcctggaggacatcagcagcatcaagggcgtgtcctgtggggccggcacagaggcccaggtgtccctggccttcaaggtgaacagcgaccagggcttccctgccaagttccagatctaccagaaggctgtgtttgacagcctgctgcaggtgaatgtgtctggccccacccacctgaatgcccagttcctgcggagcctgtgggacaccttcaaggacaagagcgccagccggggccaggtgctgctgatcttcagtgatggcctgcagagcgagagcaacatcatgctggagaaccagagcgaccggctgcgggaggccggcctggatgccctgctggtggtgtccctgaacaccacagcccaccacgagttcagcagctttgaatttgggaagagatttgactaccgcacccacctgaccatcggcatgagggagctgggcaagaagctgagccagtacctgggcaacattgctgagaggacctgctgctgcaccttctgcaagtgccccggcatccctggcccccacggcacccggggcctgcaggccatgaagggcagccagggcctgaagggcagccggggccacagaggagaagatggcaaccctggggtgcggggggacaccggcccccagggcgacaagggcattgctggctgccctggggcctggggccagaagggcctgaagggcttcagcggccccaagggcggccatggagatgatggcattgatggcctggatggagaggagggctgccacggcttccctggcatcaagggggagaagggggaccccggcagccagggcagccctggcagcagaggagcccctggccagtatggagagaagggcttccctggggaccccggcaaccctggccagaacaacaacatcaagggccagaagggcagcaagggggagcagggccggcagggccgcagcggccagaagggcgtgcagggcagccccagcagccggggcagccggggccgggagggccagaggggcctgcggggcgtgtctggagagcccggcaaccctggccccaccggcaccctgggcgctgagggcctgcagggcccccagggcagccagggcaaccctggcaggaagggggagaagggcagccagggccagaagggcccccagggcagccctggcctgatgggcgccaagggcagcacaggccggcccggcctgctgggcaagaagggggagcccggcctgcccggggacctgggccctgtgggccagacaggccagaggggccggcagggcgacagcggcatccctggctacggccagatgggcaggaagggcgtgaagggcccccggggcttccctggagatgctggccagaagggggacatcggcaaccctggcatccctgggggccctggccccaagggcttccggggcctggccctgactgtgggcctgaagggggaggagggcagccggggcctgcccggccccccaggccagaggggcatcaagggcatggccggccagcctgtgtacagccagtgtgacctgatccgcttcctgcgggagcacagcccctgctggaaggagaagtgcccagcctaccccacagagctggtgtttgccctggacaacagctatgatgtgacagaggagagcttcaacaagacccgggacatcatcaccagcatcgtgaatgacctgaacatccgggagaacaactgccctgtgggcgcccgggtggccatggtgtcctacaacagcggcaccagctacctgatccgctggagcgactacaacaggaagaagcagctgctgcagcagctgagccagatcaagtaccaggacaccacagagcccagagatgtgggcaatgccatgagatttgtgaccagaaatgtgttcaagaggacctacgccggggccaacgtgagaagagtggccgtgttcttcagcaatggccagacagccagccgcagcagcatcatcacagccaccatggagttcagcgccctggacatcagccccaccgtgtttgcctttgatgagagggtcttcctggaggccttcggctttgacaacacaggcaccttccaggtgattcctgtgccccccaacggggagaaccagaccctggagcggctgcggcgctgtgccctgtgctatgacaagtgcttccccaatgcctgcatccgggaggccttcctgcctgaggacagctacatggatgtggtgttcctgattgacaacagcaggaacatcgccaaggatgagttcaaggctgtgaaggccctggtgagcagcgtcatcgacaacttcaacatcgccagtgaccccctcatcagtgacagcggggaccgcatcgccctgctgagctacagcccctgggagagcagcaggaggaagatgggcaccgtgaagacagaatttgacttcatcacctatgacaaccagctgctgatgaagaaccacatccagaccagcttccagcagctgaatggagaggccaccatcggccgggccctgctgtggaccacagaaaatctcttccctgagaccccctacctgaggaagcacaaggtgatctttgtggtgtctgctggagaaaattatgaaaggaaggagtttgtgaagatgatggccctgcgggccaagtgccagggctacgtgatcttcgtcatcagcctgggcagcaccaggaaggatgacatggaggagctggccagctaccccctggaccagcacctgatccagctgggccgcatccacaagccagacctgaactacatcgccaagttcctgaagcccttcctgtacagcgtgcggcggggcttcaaccagtaccccccacccatgctggaggatgcctgccgcctcatcaacctgggcggggagaacatccagaatgatggcttccagtttgtgacagagctgcaggaggacttcctgggcggcaatggcttcatcggccaggagctgaacagcggccgggagagcccctttgtgaagacagaagataatggaagtgactacctggtgtacctgcccagccagatgtttgagccccagaagctgatgatcaactatgagaaggaccagaagtctgctgagatcgccagcctgaccagcggccacgagaactacggcaggaaggaggagccagaccacacctatgagcctggagatgtgtccctgcaggagtactacatggatgtggccttcctgattgatgccagccagagggtgggcagtgatgagttcaaggaggtgaaggccttcatcacctctgtgctggactacttccacatcgcccccacccccctgaccagcaccctgggggacagagtggccgtgctgagctacagccccccaggctacatgcccaacacagaggagtgccctgtgtacctggagtttgacctggtgacctacaacagcatccaccagatgaagcaccacctgcaggacagccagcagctgaatggagatgtgttcatcggccacgccctgcagtggaccatcgacaacgtgtttgtgggcacccccaacctgaggaagaacaaggtgatctttgtgatctctgctggggagaccaacagcctggacaaggatgtgctgagaaatgtgtccctgcgggccaagtgccagggctacagcatctttgtgttctcctttggccccaagcacaatgacaaggagctggaggagctggccagccaccccctggaccaccacctggtgcagctgggccgcacccacaagccagactggaactacatcatcaagtttgtgaagccctttgtgcacctgatccggcgggccatcaacaagtaccccacagaggacatgaaggccacctgtgtgaacatgaccagccccaacccagaaaatggaggaacagaaaatacagtgctgctgctgcccggcatctatgagatcaagacagaaaatggagacctgtttgatgaatttgacagccaggcccagcacctgctggtgctgggcaacaaccacagcagcggcagcgagacagccacagacctgatgcagaagctgtacctgctcttcagcacagagaagctggccatgaaggacaaggagaaggcccacctggaggagatcagcgccctggtggtggacaagcagcaggagaaggaggacaaggagatggaggccacagacatctag

SEQ ID NO: 3253 - DNA, 1674 bp, Artificial Sequence
  Description of Artificial Sequence: Synthetic coding sequence
attggccgggccctgctgtggaccacagagaacctcttccctgagaccccctacctgaggaagcacaaggtgatctttgtggtgtctgctggggagaactatgaaaggaaggagtttgtgaagatgatggccctgcgggccaagtgccagggctacgtgatctttgtgatcagcctgggcagcaccaggaaggatgacatggaggagctggccagctaccccctggaccagcacctgatccagctgggccgcatccacaagccagacctgaactacatcgccaagttcctgaagcccttcctgtacagcgtgagaagaggcttcaaccagtaccccccacccatgctggaggatgcctgccgcctcatcaacctgggcggggagaacatccagaatgatggcttccagtttgtgacagagctgcaggaggacttcctgggcggcaatggcttcatcggccaggagctgaacagcggccgggagagcccctttgtgaagacagaggacaatggaagtgactacctggtgtacctgcccagccagatgtttgagccccagaagctgatgatcaactatgagaaggaccagaagtctgctgagatcgccagcctgaccagcggccatgaaaattatggcaggaaggaggagccagaccacacctatgagcctggagatgtgtccctgcaggagtactacatggatgtggccttcctgattgatgccagccagagggtgggcagtgatgagttcaaggaggtgaaggccttcatcacctctgtgctggactacttccacatcgcccccacccccctgaccagcaccctgggggacagagtggccgtgctgagctacagccccccaggctacatgcccaacacagaagaatgtcctgtgtacctggagtttgacctggtgacctacaacagcatccaccagatgaagcaccacctgcaggacagccagcagctgaatggagatgtgttcatcggccacgccctgcagtggaccatcgacaacgtgtttgtgggcacccccaacctgaggaagaacaaggtgatcttcgtcatctctgctggggagaccaacagcctggacaaggatgtgctgagaaatgtgtccctgcgggccaagtgccagggctacagcatctttgtgttctcctttggccccaagcacaatgacaaggagctggaggagctggccagccaccccctggaccaccacctggtgcagctgggccgcacccacaagccagactggaactacatcatcaagtttgtgaagccctttgtgcacctgatcagaagagccatcaacaagtaccccacagaggacatgaaggccacctgtgtgaacatgaccagccccaacccagaaaatggaggaacagagaacacagtgctgctgctgcccggcatctatgagatcaagacagaaaatggagacctgtttgatgaatttgacagccaggcccagcacctgctggtgctgggcaacaaccacagcagcggcagcgagacagccacagacctgatgcagaagctgtacctgctcttcagcacagagaagctggccatgaaggacaaggagaaggcccacctggaggagatcagcgccctggtggtggacaagcagcaggagaaggaggatggagaggacaccaggagcagctag

SEQ ID NO: 3254 - DNA, 7581 bp, Artificial Sequence
  Description of Artificial Sequence: Synthetic coding sequence
atgaagatcctgctgatcatctttgtgctgatcatctggacagagaccctggccgaccagagccctggccctggccctgtgtatgcagatgtggtgttcctggtggacagcagtgaccacctgggccccaagagcttcccctttgtgaagaccttcatcaacaagatgatcaacagcctgcccatcgaggccaacaagtacagagtggccctggcccagtacagtgatgagttccacagcgagttccacctgagcaccttcaagggccgcagccccatgctgaaccacctgaagaagaacttccagttcatcggcggcagcctgcagatcggcaaggccctgcaggaggcccacaggacctacttcagcgcccccatcaatggccgggacaggaagcagtttcctcccatcctggtggtgctggccagcgctgagagtgaagatgaggtggaggaggccagcaaggccctgcagaaggatggagtgaagatcatctctgtgggcgtgcagaaggccagcgaggagaacctgaaggccatggccaccagccacttccacttcaacctgcggaccatccgggacctgagcaccttcagccagaacatgacccagatcatcaaggatgtgaccaagtacaaggagggcgctgtggatgctgacatgcaggtgcacttccccatcagctgccagaaggacagcctggccgacctggtgttcctggtggatgagagcctgggcactggaggcaacctgcggcacctgcagaccttcctggagaacatcaccagctccatggatgtgaaggagaactgcatgaggctgggcctgatgagctacagcaacagcgccaagaccatctccttcctgaagagcagcaccacccagagcgagttccagcagcagatcaagaacctgagcatccaggtgggcaagagcaacacaggagctgccatcgaccagatgagaagagatggcttcagcgagagctatggcagcagaagagcccagggcgtgccccagattgctgtgctggtgacccaccggcccagtgatgatgaggtgcatgatgctgccctgaacctgcggctggaggatgtgaatgtgtttgccctgagcatccagggcgccaacaacacccagctggaggagatcgtgtcctacccacctgagcagaccatcagcaccctgaagagctatgctgacctggagacctacagcaccaagttcctgaagaagctgcagaatgagatctggagccagatcagcacctatgcagagcagaggaacctggacaagacaggctgtgtggacaccaaggaggccgacatccacttcctgattgatggcagcagcagcatccaggagaagcagtttgagcagatcaagcgcttcatgctggaggtgacagagatgttcagcatcggccctgacaaggtgcgggtgggcgtggtgcagtacagtgatgacacagaggtggagttctacatcacagactacagcaatgacatcgacctgaggaaggccatcttcaacatcaagcagctgaccggcggcacctacacaggcaaggccctggactacatcctgcagatcatcaagaatggcatgaaggacaggatgagcaaggtgccctgctacctgattgtgctgacagatggcatgagcacagacagagtggtggagcccgccaagaggctgcgggcagagcagatcaccgtgcatgctgtgggcatcggggccgccaacaagattgagctgcaggagattgctgggaaggaggagcgggtgtcctttggccagaactttgatgccctgaagagcatcaagaatgaggtggtgcgggagatctgtgccgagaagggctgtgaggacatgaaggctgacatcatgttcctggtggacagctcctggagcattggaaatgaaaacttcaggaagatgaagatcttcatgaagaacctgctgaccaagatccagatcggggctgacaagacccagattggagtggtgcagttcagtgacaagaccaaggaggagttccagctgaaccgctacttcacccagcaggagatcagtgatgccatcgacaggatgagcctcatcaatgaaggcaccctgaccgggaaggccctgaactttgtgggccagtacttcacccacagcaagggggcccggctgggcgccaagaagttcctgatcctgatcacagatggagtggcccaggatgatgtgcgggaccctgcccgcatcctgcggggcaaggatgtgaccatcttctctgtgggcgtgtacaatgccaacagaagccagctggaggagatcagcggggacagcagcctggtgttccacgtggagaactttgaccacctgaaggccctggagaggaagctgatcttccgggtgtgtgccctgcatgactgcaagaggatcaccctgctggatgtggtgtttgtgctggaccacagcggcagcatcaagaagcagtaccaggaccacatgatcaacctgaccatccacctggtgaagaaggcagatgtgggccgggacagagtgcagtttggagccctgaagtacagcgaccagcccaacatcctcttctacctgaacacctacagcaacagaagtgccatcatcgagaacctgaggaagaggcgggacacaggaggcaacacctacacagccaaggccctgaagcacgccaatgccctcttcacagaggagcacggcagccgcatcaagcagaatgtgaagcagatgctgattgtcatcacagatggagagagccatgaccatgaccagctgaatgacacagccctggagctgaggaacaagggcatcaccatctttgctgtgggcgtgggcaaggccaaccagaaggagctggagggcatggccggcaacaagaacaacaccatctacgtggacaactttgacaagctgaaggatgtgttcaccctggtgcaggagaggatgtgcacagaggcccctgaggtgtgccacctgcaggaggctgatgtgatcttcctgtgtgatggcagtgacagagtgagcaacagcgactttgtgaccatgaccaccttcctgagtgacctgattgacaactttgacatccagagccagaggatgaagattggcatggcccagtttggcagcaactaccagagcatcatcgagctgaagaacagcctgaccaagacccagtggaagacccagatccagaatgtgtccaagagcggcggcttccccagaattgactttgccctgaagaaggtgagcaacatgttcaacctgcatgctgggggcagaagaaatgccggcgtgccccagaccctggtggtgatcaccagcggggaccccaggtatgatgtggctgatgctgtgaagaccctgaaggacctgggcatctgtgtgctggtgctgggcattggagatgtgtacaaggagcacctgctgcccatcaccggcaacagcgagaagatcatcaccttccaggactttgacaagctgaagaatgtggatgtgaagaagaggatcatccgggagatctgccagagctgtgggaagaccaactgcttcatggacatcgtggtgggctttgacatcagcacccacgtgcagggccagcccctcttccagggccacccccagctggagagctacctgcccggcatcctggaggacatcagcagcatcaagggcgtgtcctgtggggccggcacagaggcccaggtgtccctggccttcaaggtgaacagcgaccagggcttccctgccaagttccagatctaccagaaggctgtgtttgacagcctgctgcaggtgaatgtgtctggccccacccacctgaatgcccagttcctgcggagcctgtgggacaccttcaaggacaagagcgccagccggggccaggtgctgctgatcttcagtgatggcctgcagagcgagagcaacatcatgctggagaaccagagcgaccggctgcgggaggccggcctggatgccctgctggtggtgtccctgaacaccacagcccaccacgagttcagcagctttgaatttgggaagagatttgactaccgcacccacctgaccatcggcatgagggagctgggcaagaagctgagccagtacctgggcaacattgctgagaggacctgctgctgcaccttctgcaagtgccccggcatccctggcccccacggcacccggggcctgcaggccatgaagggcagccagggcctgaagggcagccggggccacagaggagaagatggcaaccctggggtgcggggggacaccggcccccagggcgacaagggcattgctggctgccctggggcctggggccagaagggcctgaagggcttcagcggccccaagggcggccatggagatgatggcattgatggcctggatggagaggagggctgccacggcttccctggcatcaagggggagaagggggaccccggcagccagggcagccctggcagcagaggagcccctggccagtatggagagaagggcttccctggggaccccggcaaccctggccagaacaacaacatcaagggccagaagggcagcaagggggagcagggccggcagggccgcagcggccagaagggcgtgcagggcagccccagcagccggggcagccggggccgggagggccagaggggcctgcggggcgtgtctggagagcccggcaaccctggccccaccggcaccctgggcgctgagggcctgcagggcccccagggcagccagggcaaccctggcaggaagggggagaagggcagccagggccagaagggcccccagggcagccctggcctgatgggcgccaagggcagcacaggccggcccggcctgctgggcaagaagggggagcccggcctgcccggggacctgggccctgtgggccagacaggccagaggggccggcagggcgacagcggcatccctggctacggccagatgggcaggaagggcgtgaagggcccccggggcttccctggagatgctggccagaagggggacatcggcaaccctggcatccctgggggccctggccccaagggcttccggggcctggccctgactgtgggcctgaagggggaggagggcagccggggcctgcccggccccccaggccagaggggcatcaagggcatggccggccagcctgtgtacagccagtgtgacctgatccgcttcctgcgggagcacagcctgtgcagcctggagaagtgcccagcctaccccacagagctggtgtttgccctggacaacagctatgatgtgacagaggagagcttcaacaagacccgggacatcatcaccagcatcgtgaatgacctgaacatccgggagaacaactgccctgtgggcgcccgggtggccatggtgtcctacaacagcggcaccagctacctgatccgctggagcgactacaacaggaagaagcagctgctgcagcagctgagccagatcaagtaccaggacaccacagagcccagagatgtgggcaatgccatgagatttgtgaccagaaatgtgttcaagaggacctacgccggggccaacgtgagaagagtggccgtgttcttcagcaatggccagacagccagccgcagcagcatcatcacagccaccatggagttcagcgccctggacatcagccccaccgtgtttgcctttgatgagagggtcttcctggaggccttcggctttgacaacacaggcaccttccaggtgattcctgtgccccccaacggggagaaccagaccctggagcggctgcggcgctgtgccctgtgctatgacaagtgcttccccaatgcctgcatccgggaggccttcctgcctgaggacagctacatggatgtggtgttcctgattgacaacagcaggaacatcgccaaggatgagttcaaggctgtgaaggccctggtgagcagcgtcatcgacaacttcaacatcgccagtgaccccctcatcagtgacagcggggaccgcatcgccctgctgagctacagcccctgggagagcagcaggaggaagatgggcaccgtgaagacagaatttgacttcatcacctatgacaaccagctgctgatgaagaaccacatccagaccagcttccagcagctgaatggagaggccaccatcggccgggccctgctgtggaccacagaaaatctcttccctgagaccccctacctgaggaagcacaaggtgatctttgtggtgtctgctggagaaaattatgaaaggaaggagtttgtgaagatgatggccctgcgggccaagtgccagggctacgtgatcttcgtcatcagcctgggcagcaccaggaaggatgacatggaggagctggccagctaccccctggaccagcacctgatccagctgggccgcatccacaagccagacctgaactacatcgccaagttcctgaagcccttcctgtacagcgtgcggcggggcttcaaccagtaccccccacccatgctggaggatgcctgccgcctcatcaacctgggcggggagaacatccagaatgatggcttccagtttgtgacagagctgcaggaggacttcctgggcggcaatggcttcatcggccaggagctgaacagcggccgggagagcccctttgtgaagacagaagataatggaagtgactacctggtgtacctgcccagccagatgtttgagccccagaagctgatgatcaactatgagaaggaccagaagtctgctgagatcgccagcctgaccagcggccacgagaactacggcaggaaggaggagccagaccacacctatgagcctggagatgtgtccctgcaggagtactacatggatgtggccttcctgattgatgccagccagagggtgggcagtgatgagttcaaggaggtgaaggccttcatcacctctgtgctggactacttccacatcgcccccacccccctgaccagcaccctgggggacagagtggccgtgctgagctacagccccccaggctacatgcccaacacagaggagtgccctgtgtacctggagtttgacctggtgacctacaacagcatccaccagatgaagcaccacctgcaggacagccagcagctgaatggagatgtgttcatcggccacgccctgcagtggaccatcgacaacgtgtttgtgggcacccccaacctgaggaagaacaaggtgatctttgtgatctctgctggggagaccaacagcctggacaaggatgtgctgagaaatgtgtccctgcgggccaagtgccagggctacagcatctttgtgttctcctttggccccaagcacaatgacaaggagctggaggagctggccagccaccccctggaccaccacctggtgcagctgggccgcacccacaagccagactggaactacatcatcaagtttgtgaagccctttgtgcacctgatccggcgggccatcaacaagtaccccacagaggacatgaaggccacctgtgtgaacatgaccagccccaacccagaaaatggaggaacagaaaatacagtgctgtggtag

SEQ ID NO: 3255 - DNA, 1332 bp, Artificial Sequence
  Description of Artificial Sequence: Synthetic coding sequence
aaccagtaccccccacccatgctggaggatgcctgccgcctcatcaacctgggcggggagaacatccagaatgatggcttccagtttgtgacagagctgcaggaggacttcctgggcggcaatggcttcatcggccaggagctgaacagcggccgggagagcccctttgtgaagacagaggacaatggaagtgactacctggtgtacctgcccagccagatgtttgagccccagaagctgatgatcaactatgagaaggaccagaagtctgctgagatcgccagcctgaccagcggccatgaaaattatggcaggaaggaggagccagaccacacctatgagcctggagatgtgtccctgcaggagtactacatggatgtggccttcctgattgatgccagccagagggtgggcagtgatgagttcaaggaggtgaaggccttcatcacctctgtgctggactacttccacatcgcccccacccccctgaccagcaccctgggggacagagtggccgtgctgagctacagccccccaggctacatgcccaacacagaagaatgtcctgtgtacctggagtttgacctggtgacctacaacagcatccaccagatgaagcaccacctgcaggacagccagcagctgaatggagatgtgttcatcggccacgccctgcagtggaccatcgacaacgtgtttgtgggcacccccaacctgaggaagaacaaggtgatcttcgtcatctctgctggggagaccaacagcctggacaaggatgtgctgagaaatgtgtccctgcgggccaagtgccagggctacagcatctttgtgttctcctttggccccaagcacaatgacaaggagctggaggagctggccagccaccccctggaccaccacctggtgcagctgggccgcacccacaagccagactggaactacatcatcaagtttgtgaagccctttgtgcacctgatcagaagagccatcaacaagtaccccacagaggacatgaaggccacctgtgtgaacatgaccagccccaacccagaaaatggaggaacagagaacacagtgctgctgctgcccggcatctatgagatcaagacagaaaatggagacctgtttgatgaatttgacagccaggcccagcacctgctggtgctgggcaacaaccacagcagcggcagcgagacagccacagacctgatgcagaagctgtacctgctcttcagcacagagaagctggccatgaaggacaaggagaaggcccacctggaggagatcagcgccctggtggtggacaagcagcaggagaaggaggacctgtag

SEQ ID NO: 3256 - DNA, 6792 bp, Artificial Sequence
  Description of Artificial Sequence: Synthetic coding sequence
atgatgctgctgatcctcttcctggtgatcatctgcagccacatctctgtgaaccaggacagcggcccagaatatgcagatgtggtgttcctggtggacagcagtgaccggctgggcagcaagagcttcccctttgtgaagatgttcatcaccaagatgatcagcagcctgcccattgaagctgacaagtacagagtggccctggcccagtacagcgacaagctgcacagcgagttccacctgagcaccttcaagggccgcagccccatgctgaaccacctgaggaagaactttggcttcatcggcggcagcctgcagatcggcaaggccctgcaggaggcccacaggacctacttcagcgccccagccaacggccgggacaagaagcagttcccccccatcctggtggtgctggccagcagcgagagcgaggacaacgtggaggaggccagcaaggccctgaggaaggatggagtgaagatcatctctgtgggcgtgcagaaggccagcgaggagaacctgaaggccatggccaccagccagttccacttcaacctgaggacagtgcgggacctgtccatgttcagccagaacatgacccacatcatcaaggatgtgatcaagtacaaggagggcgctgtggatgacatctttgtggaggcctgccagggccccagcatggctgatgtggtgttcctgctggacatgagcatcaatggaagtgaagaaaattttgactacctgaagggcttcctggaggagagcgtgtctgccctggacatcaaggagaactgcatgagggtgggcctggtggcctacagcaatgagaccaaggtgatcaacagcctgtccatgggcatcaacaagtctgaggtgctgcagcacatccagaacctgagccccaggacaggcaaggcctacaccggggccgccatcaagaagctgaggaaggaggtgttttctgccagaaatggcagcaggaagaaccagggcgtgccccagattgctgtgctggtgacccaccgggacagtgaagataatgtgaccaaggctgctgtgaacctgcggcgggagggcgtgaccatcttcaccctgggcattgaaggagccagtgacacccagctggagaagatcgccagccaccctgctgagcagtatgtgtccaagctgaagacctttgctgacctggccgcccacaaccagaccttcctgaagaagctgaggaaccagatcacccacacagtgtctgtgttttctgagaggacagagaccctgaagagcggctgtgtggacacagaggaggccgacatctacctgctgattgatggcagcggcagcacccaggccacagacttccacgagatgaagaccttcctgtctgaggtggtgggcatgttcaacatcgccccccacaaggtgcgggtgggcgctgtgcagtatgctgacagctgggacctggagtttgagatcaacaagtacagcaacaagcaggacctgggcaaggccatcgagaacatccggcagatgggcggcaacaccaacacaggagctgccctgaacttcaccctgagcctgctgcagaaggccaagaagcagaggggcaacaaggtgccctgccacctggtggtgctgaccaacggcatgagcaaggacagcatcctggagcccgccaaccggctgcgggaggagcacatccgggtgtatgccatcggcatcaaggaggccaaccagacccagctgcgggagattgctggggaggagaagagggtgtactacgtgcatgactttgatgccctgaaggacatccggaaccaggtggtgcaggagatctgcacagaggaggcctgcaaggagatgaaggctgacatcatgttcctggtggacagcagcggcagcatcggccctgagaacttcagcaagatgaagaccttcatgaagaacctggtgtccaagagccagatcggccctgacagagtgcagattggagtggtgcagttcagtgacatcaacaaggaggagttccagctgaaccgcttcatgagccagagcgacatcagcaatgccatcgaccagatggcccacatcggccagaccaccctgactggaagtgccctgagctttgtgtcccagtacttcagccccaccaagggggcccggcccaacatcaggaagttcctgatcctgatcacagatggagaggcccaggacatcgtgaaggagcctgctgtggtgctgcggcaggagggcgtcatcatctacagcgtgggcgtgtttggcagcaatgtgacccagctggaggagatcagcggccggcctgagatggtgttctacgtggagaactttgacatcctgcagagaattgaagatgacctggtgtttggcatctgcagcccccgggaggagtgcaagagaattgaggtgctggatgtggtgtttgtgattgacagcagcggcagcattgattatgatgagtacaacatcatgaaggacttcatgattggcctggtgaagaaggcagatgtgggcaagaaccaggtgcgctttggagccctgaagtatgcagatgatcctgaggtgctcttctacctggatgactttggcaccaagctggaggtgatctctgtgctgcagaatgaccaggccatgggcggcagcacctacacagctgaggccctgggcttcagtgaccacatgttcacagaggcccggggcagccggctgaacaagggcgtgccccaggtgctgattgtcatcacagatggagagagccatgatgctgacaagctgaatgccacagccaaggccctgcgggacaagggcatcctggtgctggccgtgggcattgatggagccaaccctgtggagctgctggccatggccggcagcagtgacaagtacttctttgtggagaccttcggcggcctgaagggcatcttcagtgatgtgacagcctctgtgtgcaacagcagcaaggtggactgtgaaattgacaaggtggacctggtgttcctgatggatggcagcaccagcatccagcccaatgacttcaagaagatgaaggagttcctggcctctgtggtgcaggactttgatgtgtccctgaacagagtgagaattggagctgcccagttcagtgacacctaccaccctgagttccccctgggcaccttcatcggggagaaggagatctccttccagatcgagaacatcaagcagatcttcggcaacacccacatcggggccgccctgcgggaggtggagcactacttccggccagacatgggcagccgcatcaacacaggcaccccccaggtgctgctggtgctgacagatggccagagccaggatgaggtggcccaggccgctgaggccctgcggcaccggggcatcgacatctacagcgtgggcattggagatgtggatgaccagcagctgatccagatcactggaacagctgagaagaagctgactgtgcacaactttgatgagctgaagaaggtgaacaagagaattgtgaggaacatctgcaccacagctggggagagcaactgctttgtggatgtggtggtgggctttgatgtgtccacccaggagaagggccagaccctgctggagggccagccctggatggagacctacctgcaggacatcctgcgggccatcagcagcctgaatggagtgtcctgtgaggtgggcacagagacccaggtgtctgtggccttccaggtgaccaatgccatggagaagtacagccccaagtttgagatctacagcgagaacatcctgaacagcctgaaggacatcaccgtgaagggccccagcctgctgaatgccaacctgctggacagcctgtgggacaccttccagaacaagtctgctgcccggggcaaggtggtgctgctcttcagtgatggcctggatgatgatgtggagaagctggagcagaagagtgatgagctgaggaaggagggcctgaatgccctgatcaccgtggccctggatggccctgctgacagcagtgacctggccgacctgccctacatcgagtttgggaagggctttgagtaccgcacccagctgagcatcggcatgagggagctgggcagccggctgagcaagcagctggtgaatgtggccgagaggacctgctgctgcctcttctgcaagtgcattggaggagatggcaccatgggagaccccggccccccaggcaagaggggccccccaggcttcaagggcagcgagggctacctgggggaggagggcattgctggggagcggggggcccctggccctgtgggggagcagggcaccaagggctgctacggcaccaagggccccaagggcaacagaggcctgaatggccaggagggggaggtgggggagaatggaattgatggcctgaatggagagcagggcgacaatggcctgcccggcaggaaaggagagaagggagatgagggcagccagggcagccctgggaagaggggcacccctggggacagaggagccaagggcctgcggggggaccccggggcccctggggtggacagcagcattgagggccccaccggcctgaagggggagcggggccggcagggcagaagaggctggccaggccccccaggcaccccaggcagcaggaggaagacagctgcccacggccggcggggccacacaggcccccagggcacagctggcatccctggcccagatggcctggagggcagcctgggcctgaagggcccccagggccccagaggagaggccggcgtgaagggggagaagggcggcgtgggcagcaagggcccccagggccccccaggccctggaggagaggccggcaaccagggccgcctgggcagccagggcaacaagggggagcccggggacctgggggagaagggagctgtgggcttccctggcccccggggcctgcagggcaatgatggcagccctggctacggctctgtgggcaggaaaggagccaagggccaggagggcttccctggagagagcggccccaagggggagattggagaccccggcggccctggagagaccggcctgaagggggcccggggcaagatgatctctgctggcctgcctggagagatgggcagccctggagagcccggccccccaggcaggaagggcgtgaagggggccaagggcctggccagcttcagcacctgtgagctgatccagtatgtgcgggacaggagccctggccgccacggcaagccagagtgccctgtgcaccccacagagctggtgtttgccctggaccacagcagagatgtgacagagcaggagtttgagaggatgaaggagatgatggccttcctggtgcgggacatcaaggtgcgggagaacagctgccctgtgggcgcccacatcgccatcctgagctacaacagccacgcccggcacctggtgcgcttcagtgatgcctacaagaagagccagctgctgcgggagattgagaccatcccctatgaaagaagcagcgccagccgggagatcggccgggccatgaggttcatcagcagaaatgtgttcaagaggaccctgcccggggcccacaccaggaagatcgccaccttcttcagcagcggccagagcgcagatgcccacagcatcaccacagctgccatggagtttggagccctggagatcatccctgtggtgatcaccttcagcaatgtgcccagcgtgagaagagcctttgccattgatgacaccggcaccttccaggtgattgtggtgcccagcggggctgactacatcccagccctggagcggctgcagcgctgcaccttctgctatgatgtgtgcaagccagatgccagctgtgaccaggcccggcccccacctgtgcagagctacatggatgctgccttcctgctggatgccagcaggaacatgggcagcgctgagtttgaggacatccgggccttcctgggcgccctgctggaccactttgagatcaccccagagcctgagacctctgtgactggagacagagtggccctgctgagccacgcccccccagacttcctgcccaacacccagaagagccctgtgcgggcagagttcaacctgaccacctaccgcagcaagaggctgatgaagagacatgtgcatgaatctgtgaagcagctgaatggagatgccttcatcggccacgccctgcagtggaccctggacaacgtgttcctgagcacccccaacctgcggaggaacaaggtgatcttcgtcatctctgctggggagaccagccacctggatggagagatcctgaagaaggagagcctgcgggccaagtgccagggctacgccctgtttgtgttcagcctgggccccatctgggatgacaaggagctggaggacctggccagccaccccctggaccaccacctggtgcagctgggccgcatccacaagccagaccacagctatggagtgaagtttgtgaagagcttcatcaacagcatcagaagagccatcaacaagtacccacccatcaacctgaagatcaagtgcaaccggctgaacagcattgaccccaagcagcccccccggcccttccgcagctttgtgcccggccccctgaaggccaccctgaaggaggatgtgctgcagaaggccaagttcttccaggacaagaagtacctgagccgggtggcccggagcggcagagatgatgccatccagaacttcatgaggagcaccagccacaccttcaagaatggaaggatgattgaaagtgcccccaagcagcacgactag

SEQ ID NO: 3257 - DNA, 6792 bp, Artificial Sequence
  Description of Artificial Sequence: Synthetic coding sequence
atgatgctgctgatcctcttcctggtgatcatctgcagccacatctctgtgaaccaggacagcggcccagaatatgcagatgtggtgttcctggtggacagcagtgaccggctgggcagcaagagcttcccctttgtgaagatgttcatcaccaagatgatcagcagcctgcccattgaagctgacaagtacagagtggccctggcccagtacagcgacaagctgcacagcgagttccacctgagcaccttcaagggccgcagccccatgctgaaccacctgaggaagaactttggcttcatcggcggcagcctgcagatcggcaaggccctgcaggaggcccacaggacctacttcagcgccccagccaacggccgggacaagaagcagttcccccccatcctggtggtgctggccagcagcgagagcgaggacaacgtggaggaggccagcaaggccctgaggaaggatggagtgaagatcatctctgtgggcgtgcagaaggccagcgaggagaacctgaaggccatggccaccagccagttccacttcaacctgaggacagtgcgggacctgtccatgttcagccagaacatgacccacatcatcaaggatgtgatcaagtacaaggagggcgctgtggatgacatctttgtggaggcctgccagggccccagcatggctgatgtggtgttcctgctggacatgagcatcaatggaagtgaagaaaattttgactacctgaagggcttcctggaggagagcgtgtctgccctggacatcaaggagaactgcatgagggtgggcctggtggcctacagcaatgagaccaaggtgatcaacagcctgtccatgggcatcaacaagtctgaggtgctgcagcacatccagaacctgagccccaggacaggcaaggcctacaccggggccgccatcaagaagctgaggaaggaggtgttttctgccagaaatggcagcaggaagaaccagggcgtgccccagattgctgtgctggtgacccaccgggacagtgaagataatgtgaccaaggctgctgtgaacctgcggcgggagggcgtgaccatcttcaccctgggcattgaaggagccagtgacacccagctggagaagatcgccagccaccctgctgagcagtatgtgtccaagctgaagacctttgctgacctggccgcccacaaccagaccttcctgaagaagctgaggaaccagatcacccacacagtgtctgtgttttctgagaggacagagaccctgaagagcggctgtgtggacacagaggaggccgacatctacctgctgattgatggcagcggcagcacccaggccacagacttccacgagatgaagaccttcctgtctgaggtggtgggcatgttcaacatcgccccccacaaggtgcgggtgggcgctgtgcagtatgctgacagctgggacctggagtttgagatcaacaagtacagcaacaagcaggacctgggcaaggccatcgagaacatccggcagatgggcggcaacaccaacacaggagctgccctgaacttcaccctgagcctgctgcagaaggccaagaagcagaggggcaacaaggtgccctgccacctggtggtgctgaccaacggcatgagcaaggacagcatcctggagcccgccaaccggctgcgggaggagcacatccgggtgtatgccatcggcatcaaggaggccaaccagacccagctgcgggagattgctggggaggagaagagggtgtactacgtgcatgactttgatgccctgaaggacatccggaaccaggtggtgcaggagatctgcacagaggaggcctgcaaggagatgaaggctgacatcatgttcctggtggacagcagcggcagcatcggccctgagaacttcagcaagatgaagaccttcatgaagaacctggtgtccaagagccagatcggccctgacagagtgcagattggagtggtgcagttcagtgacatcaacaaggaggagttccagctgaaccgcttcatgagccagagcgacatcagcaatgccatcgaccagatggcccacatcggccagaccaccctgactggaagtgccctgagctttgtgtcccagtacttcagccccaccaagggggcccggcccaacatcaggaagttcctgatcctgatcacagatggagaggcccaggacatcgtgaaggagcctgctgtggtgctgcggcaggagggcgtcatcatctacagcgtgggcgtgtttggcagcaatgtgacccagctggaggagatcagcggccggcctgagatggtgttctacgtggagaactttgacatcctgcagagaattgaagatgacctggtgtttggcatctgcagcccccgggaggagtgcaagagaattgaggtgctggatgtggtgtttgtgattgacagcagcggcagcattgattatgatgagtacaacatcatgaaggacttcatgattggcctggtgaagaaggcagatgtgggcaagaaccaggtgcgctttggagccctgaagtatgcagatgatcctgaggtgctcttctacctggatgactttggcaccaagctggaggtgatctctgtgctgcagaatgaccaggccatgggcggcagcacctacacagctgaggccctgggcttcagtgaccacatgttcacagaggcccggggcagccggctgaacaagggcgtgccccaggtgctgattgtcatcacagatggagagagccatgatgctgacaagctgaatgccacagccaaggccctgcgggacaagggcatcctggtgctggccgtgggcattgatggagccaaccctgtggagctgctggccatggccggcagcagtgacaagtacttctttgtggagaccttcggcggcctgaagggcatcttcagtgatgtgacagcctctgtgtgcaacagcagcaaggtggactgtgaaattgacaaggtggacctggtgttcctgatggatggcagcaccagcatccagcccaatgacttcaagaagatgaaggagttcctggcctctgtggtgcaggactttgatgtgtccctgaacagagtgagaattggagctgcccagttcagtgacacctaccaccctgagttccccctgggcaccttcatcggggagaaggagatctccttccagatcgagaacatcaagcagatcttcggcaacacccacatcggggccgccctgcgggaggtggagcactacttccggccagacatgggcagccgcatcaacacaggcaccccccaggtgctgctggtgctgacagatggccagagccaggatgaggtggcccaggccgctgaggccctgcggcaccggggcatcgacatctacagcgtgggcattggagatgtggatgaccagcagctgatccagatcactggaacagctgagaagaagctgactgtgcacaactttgatgagctgaagaaggtgaacaagagaattgtgaggaacatctgcaccacagctggggagagcaactgctttgtggatgtggtggtgggctttgatgtgtccacccaggagaagggccagaccctgctggagggccagccctggatggagacctacctgcaggacatcctgcgggccatcagcagcctgaatggagtgtcctgtgaggtgggcacagagacccaggtgtctgtggccttccaggtgaccaatgccatggagaagtacagccccaagtttgagatctacagcgagaacatcctgaacagcctgaaggacatcaccgtgaagggccccagcctgctgaatgccaacctgctggacagcctgtgggacaccttccagaacaagtctgctgcccggggcaaggtggtgctgctcttcagtgatggcctggatgatgatgtggagaagctggagcagaagagtgatgagctgaggaaggagggcctgaatgccctgatcaccgtggccctggatggccctgctgacagcagtgacctggccgacctgccctacatcgagtttgggaagggctttgagtaccgcacccagctgagcatcggcatgagggagctgggcagccggctgagcaagcagctggtgaatgtggccgagaggacctgctgctgcctcttctgcaagtgcattggaggagatggcaccatgggagaccccggccccccaggcaagaggggccccccaggcttcaagggcagcgagggctacctgggggaggagggcattgctggggagcggggggcccctggccctgtgggggagcagggcaccaagggctgctacggcaccaagggccccaagggcaacagaggcctgaatggccaggagggggaggtgggggagaatggaattgatggcctgaatggagagcagggcgacaatggcctgcccggcaggaaaggagagaagggagatgagggcagccagggcagccctgggaagaggggcacccctggggacagaggagccaagggcctgcggggggaccccggggcccctggggtggacagcagcattgagggccccaccggcctgaagggggagcggggccggcagggcagaagaggctggccaggccccccaggcaccccaggcagcaggaggaagacagctgcccacggccggcggggccacacaggcccccagggcacagctggcatccctggcccagatggcctggagggcagcctgggcctgaagggcccccagggccccagaggagaggccggcgtgaagggggagaagggcggcgtgggcagcaagggcccccagggccccccaggccctggaggagaggccggcaaccagggccgcctgggcagccagggcaacaagggggagcccggggacctgggggagaagggagctgtgggcttccctggcccccggggcctgcagggcaatgatggcagccctggctacggctctgtgggcaggaaaggagccaagggccaggagggcttccctggagagagcggccccaagggggagattggagaccccggcggccctggagagaccggcctgaagggggcccggggcaagatgatctctgctggcctgcctggagagatgggcagccctggagagcccggccccccaggcaggaagggcgtgaagggggccaagggcctggccagcttcagcacctgtgagctgatccagtatgtgcgggacaggagccctggccagcacaggaagccagagtgccctgtgcaccccacagagctggtgtttgccctggaccacagcagagatgtgacagagcaggagtttgagaggatgaaggagatgatggccttcctggtgcgggacatcaaggtgcgggagaacagctgccctgtgggcgcccacatcgccatcctgagctacaacagccacgcccggcacctggtgcgcttcagtgatgcctacaagaagagccagctgctgcgggagattgagaccatcccctatgaaagaagcagcgccagccgggagatcggccgggccatgaggttcatcagcagaaatgtgttcaagaggaccctgcccggggcccacaccaggaagatcgccaccttcttcagcagcggccagagcgcagatgcccacagcatcaccacagctgccatggagtttggagccctggagatcatccctgtggtgatcaccttcagcaatgtgcccagcgtgagaagagcctttgccattgatgacaccggcaccttccaggtgattgtggtgcccagcggggctgactacatcccagccctggagcggctgcagcgctgcaccttctgctatgatgtgtgcaagccagatgccagctgtgaccaggcccggcccccacctgtgcagagctacatggatgctgccttcctgctggatgccagcaggaacatgggcagcgctgagtttgaggacatccgggccttcctgggcgccctgctggaccactttgagatcaccccagagcctgagacctctgtgactggagacagagtggccctgctgagccacgcccccccagacttcctgcccaacacccagaagagccctgtgcgggcagagttcaacctgaccacctaccgcagcaagaggctgatgaagagacatgtgcatgaatctgtgaagcagctgaatggagatgccttcatcggccacgccctgcagtggaccctggacaacgtgttcctgagcacccccaacctgcggaggaacaaggtgatcttcgtcatctctgctggggagaccagccacctggatggagagatcctgaagaaggagagcctgcgggccaagtgccagggctacgccctgtttgtgttcagcctgggccccatctgggatgacaaggagctggaggacctggccagccaccccctggaccaccacctggtgcagctgggccgcatccacaagccagaccacagctatggagtgaagtttgtgaagagcttcatcaacagcatcagaagagccatcaacaagtacccacccatcaacctgaagatcaagtgcaaccggctgaacagcattgaccccaagcagcccccccggcccttccgcagctttgtgcccggccccctgaaggccaccctgaaggaggatgtgctgcagaaggccaagttcttccaggacaagaagtacctgagccgggtggcccggagcggcagagatgatgccatccagaacttcatgaggagcaccagccacaccttcaagaatggaaggatgattgaaagtgcccccaagcagcacgactag

SEQ ID NO: 3258 - DNA, 2112 bp, Artificial Sequence
  Description of Artificial Sequence: Synthetic coding sequence
atgctgggcaccctgacccccctgagcagcctgctgctgctgctgctggtgctggtgctgggctgcggcccccgggccagcagcggcggcggggccggcggggccgccggctacgcccctgtgaagtacatccagcccatgcagaagggccctgtgggcccccccttccgggagggcaagggccagtacctggagatgcccctgcccctgctgcccatggacctgaagggggagcccggccccccaggcaagccaggcccccggggccccccaggccccccaggcttccctgggaagccaggcatgggcaagccaggcctgcacggccagcccggccctgctggccccccaggcttcagcaggatgggcaaggccggccccccaggcctgcccgggaaggtgggccccccaggccagcccggcctgcggggggagcccggcatccggggggaccagggcctgcggggccccccaggccccccaggcctgcccggccccagcggcatcaccatccctgggaagccaggggcccagggcgtgcccggccccccaggcttccagggcgagcccggcccccagggcgagcccggccccccaggggaccggggcctgaagggggacaacggggtgggccagcccggcctgcccggggcccctggccagggcggggcccctggccccccaggcctgcccggccctgctggcctgggcaagccaggcctggatggcctgcccggggcccctggggacaagggggagagcggccccccaggagtgcccggccccagaggagagcccggggctgtgggccccaagggccccccaggagtggatggagtgggcgtgcctggagctgctggcctgcccggcccccagggccccagcggggccaagggggagcccggcacccggggccccccaggcctcatcggccccaccggctacggcatgcctggcctgcccggccccaagggggaccggggccctgctggggtgcccggcctgctgggggacagaggagagcccggggaggatggagagcccggggagcagggcccccagggcctgggcggccccccaggcctgcccggcagcgctggcctgcctggaagaagaggccccccaggccccaagggggaggccggccctgggggccccccaggagtgcccggcatccggggggaccagggccccagcggcctggccggcaagccaggagtgcctggagagcggggcctgcccggggcccacggccccccaggccccaccggccccaagggggagcccggcttcaccggccggcctgggggccctggggtggccggggccctgggccagaagggggacctgggcctgcccggccagcccggcctgcggggccccagcggcatccctggcctgcagggccctgctggccccatcggcccccagggcctgcccggcctgaagggggagcccggcctgcccggccccccaggagagggccgggccggggagcccggcacagctggccccaccggccccccaggagtgcccggcagccctggcatcaccggccccccaggccccccaggccccccaggccccccaggggcccctggggcctttgatgaaacaggaattgctggcctgcacctgcccaacggcggcgtggagggcgctgtgctgggcaagggcggcaagccccagtttggcctgggggagctgagcgcccacgccaccccagccttcaccgctgtgctgaccagccccttccctgccagcggcatgcctgtgaagtttgacaggaccctgtacaacggccacagcggctacaacccagccaccggcatcttcacctgccctgtgggcggcgtgtactactttgcctaccacgtgcacgtgaagggcaccaacgtgtgggtggccctgtacaagaacaacgtgcctgccacctacacctatgatgagtacaagaagggctacctggaccaggccagcggcggcgctgtgctgcagctgcggcccaatgaccaggtgtgggtgcagatgcccagcgaccaggccaacggcctgtacagcacagagtacatccacagcagcttcagcggcttcctgctgtgccccacctag

SEQ ID NO: 3259 - DNA, 1284 bp, Artificial Sequence
  Description of Artificial Sequence: Synthetic coding sequence
atgctgggcaccctgacccccctgagcagcctgctgctgctgctgctggtgctggtgctgggctgcggcccccgggccagcagcggcggcggggccggcggggccgccggctacgcccctgtgaagtacatccagcccatgcagaagggccctgtgggcccccccttccgggagggcaagggccagtacctggagatgcccctgcccctgctgcccatggacctgaagggggagcccggccccccaggcaagccaggcccccggggccccccaggccccccaggcttccctgggaagccaggcatgggcaagccaggcctgcacggccagcccggccctgctggccccccaggcttcagcaggatgggcaaggccggccccccaggcctgcccgggaaggtgggccccccaggccagcccggcctgcggggggagcccggcatccggggggaccagggcctgcggggccccccaggccccccaggcctgcccggccccagcggcatcaccatccctgggaagccaggggcccagggcgtgcccggccccccaggcttccagggcgagcccggcccccagggcgagcccggccccccaggggaccggggcctgaagggggacaacggggtgggccagcccggcctgcccggggcccctggccagggcggggcccctggccccccaggcctgcccggccctgctggcctgggcaagccaggcctggatggcctgcccggggcccctggggacaagggggagagcggccccccaggggcctttgatgaaacaggaattgctggcctgcacctgcccaacggcggcgtggagggcgctgtgctgggcaagggcggcaagccccagtttggcctgggggagctgagcgcccacgccaccccagccttcaccgctgtgctgaccagccccttccctgccagcggcatgcctgtgaagtttgacaggaccctgtacaacggccacagcggctacaacccagccaccggcatcttcacctgccctgtgggcggcgtgtactactttgcctaccacgtgcacgtgaagggcaccaacgtgtgggtggccctgtacaagaacaacgtgcctgccacctacacctatgatgagtacaagaagggctacctggaccaggccagcggcggcgctgtgctgcagctgcggcccaatgaccaggtgtgggtgcagatgcccagcgaccaggccaacggcctgtacagcacagagtacatccacagcagcttcagcggcttcctgctgtgccccacctag

SEQ ID NO: 3260 - DNA, 2112 bp, Artificial Sequence; identical to SEQ ID NO: 3258
  Description of Artificial Sequence: Synthetic coding sequence

SEQ ID NO: 3261 - DNA, 1917 bp, Artificial Sequence
  Description of Artificial Sequence: Synthetic coding sequence
atgcccctgcccctgctgcccatggacctgaagggggagcccggccccccaggcaagccaggcccccggggccccccaggccccccaggcttccctgggaagccaggcatgggcaagccaggcctgcacggccagcccggccctgctggccccccaggcttcagcaggatgggcaaggccggccccccaggcctgcccgggaaggtgggccccccaggccagcccggcctgcggggggagcccggcatccggggggaccagggcctgcggggccccccaggccccccaggcctgcccggccccagcggcatcaccatccctgggaagccaggggcccagggcgtgcccggccccccaggcttccagggcgagcccggcccccagggcgagcccggccccccaggggaccggggcctgaagggggacaatggagtgggccagcccggcctgcccggggcccctggccagggcggggcccctggccccccaggcctgcccggccctgctggcctgggcaagccaggcctggatggcctgcccggggcccctggggacaagggggagagcggccccccaggagtgcccggccccagaggagagcctggagctgtgggccccaagggccccccaggagtggatggagtgggcgtgcctggagctgctggcctgcccggcccccagggccccagcggggccaagggggagcccggcacccggggccccccaggcctgattggccccaccggctacggcatgcctggcctgcccggccccaagggggaccggggccctgctggggtgcccggcctgctgggggacagaggagagcctggagaagatggagagcctggagagcagggcccccagggcctgggcggccccccaggcctgcccggcagcgctggcctgcccggccggcggggccccccaggccccaagggggaggccggccctgggggccccccaggagtgcccggcatccggggggaccagggccccagcggcctggccggcaagccaggagtgcctggagagcggggcctgcccggggcccacggccccccaggccccaccggccccaagggggagcccggcttcaccggccggcctgggggccctggggtggccggggccctgggccagaagggggacctgggcctgcccggccagcccggcctgcggggccccagcggcatccctggcctgcagggccctgctggccccatcggcccccagggcctgcccggcctgaagggggagcccggcctgcccggccccccaggagagggccgggccggggagcctggaacagctggccccactggacctcctggggtgcccggcagccctggcatcactggacctcctggccccccaggccccccaggccccccaggggcccctggggcctttgatgagaccggcattgctggcctgcacctgcccaatggaggagtggagggcgctgtgctgggcaaaggaggcaagccccagtttggcctgggggagctgagcgcccacgccaccccagccttcaccgctgtgctgaccagccccttccctgccagcggcatgcctgtgaagtttgacaggaccctgtacaacggccacagcggctacaacccagccaccggcatcttcacctgccctgtgggcggcgtgtactactttgcctaccacgtgcacgtgaagggcaccaacgtgtgggtggccctgtacaagaacaacgtgcctgccacctacacctatgatgagtacaagaagggctacctggaccaggccagcggcggcgctgtgctgcagctgcggcccaatgaccaggtgtgggtgcagatgcccagcgaccaggccaacggcctgtacagcacagagtacatccacagcagcttcagcggcttcctgctgtgccccacctag

SEQ ID NO: 3262 - DNA, 2043 bp, Artificial Sequence
  Description of Artificial Sequence: Synthetic coding sequence
atgctgccccagatccccttcctgctgctggtgtccctgaacctggtgcatggagtcttctacgccgagcgctaccagatgcccaccggcatcaagggccccctgcccaacaccaagacccagttcttcatcccctacaccatcaagagcaaaggaattgctgtgcggggggagcagggcaccccaggccccccaggccctgctggcccccggggccaccctggccccagcggccccccaggcaagccaggctacggcagccctggcctgcagggcgagcccggcctgcccggccccccaggccccagcgctgtgggcaagccaggagtgcccggcctgcccgggaagccaggagagcggggcccctacggccccaagggagatgtgggccctgctggcctgcccggcccccggggccccccaggccccccaggcatccctggccctgctggcatctctgtgcctgggaagccaggccagcagggccccaccggggcccctggcccccggggcttccctggagagaagggggcccctggggtgcccggcatgaatggccagaagggggagatgggctatggagcccctggccggcctggagagcggggcctgcccggcccccagggccccaccggccccagcggccccccaggagtgggcaagagaggagaaaatggagtgcccggccagcccggcatcaagggggaccggggcttccctggagagatgggccccatcggccccccaggcccccagggccccccaggagagcggggccctgagggcatcggcaagccaggagctgctggggcccctggccagcccggcatccctggcaccaagggcctgcccggggcccctggcattgctggccccccaggccccccaggctttgggaagccaggcctgcccggcctgaagggggagcggggccctgctggcctgcccggcggccctggggccaagggggagcagggccctgctggcctgcccgggaagccaggcctgactggacctcctggcaacatgggcccccagggccccaagggcatccctggcagccacggcctgcccggccccaagggggagaccggccctgctggccctgctggctacccaggggccaagggggagcggggcagccctggcagtgatggcaagccaggctacccaggcaagccaggcctggatggccccaagggcaaccctggcctgcccggccccaagggggaccccggggtgggcggccccccaggcctgcccggccctgtgggccctgctggggccaagggcatgcctggccacaacggggaggccggccccaggggggcccctggcatccctggcacccggggccccatcggccccccaggcatccctggcttccctggcagcaagggggaccccggcagccctggccccccaggccctgctggcatcgccaccaagggcctgaatggccccactggacctcctggccccccaggcccccggggccacagcggggagcccggcctgcccggccccccaggccccccaggccccccaggccaggccgtgatgcctgagggcttcatcaaggccggccagaggcccagcctgagcggcacccccctggtgtctgccaaccagggcgtgacaggcatgcctgtgtctgccttcaccgtcatcctgagcaaggcctacccagccatcggcacccccatcccctttgacaagatcctgtacaaccggcagcagcactatgaccccaggacaggcatcttcacctgccagatccctggcatctactacttctcctaccacgtgcacgtgaagggcacccacgtgtgggtgggcctgtacaagaatggcacccctgtgatgtacacctatgatgagtacaccaagggctacctggaccaggccagcggcagcgccatcatcgacctgacagaaaatgaccaggtgtggctgcagctgcccaatgctgagagcaatggcctgtacagcagtgaatatgtgcacagcagcttcagcggcttcctggtggcccccatgtag

SEQ ID NO: 3263 - DNA, 2043 bp, Artificial Sequence; identical to SEQ ID NO: 3262
  Description of Artificial Sequence: Synthetic coding sequence

SEQ ID NO: 3264 - DNA, 156 bp, Artificial Sequence
  Description of Artificial Sequence: Synthetic coding sequence
atgctgccccagatccccttcctgctgctggtgtccctgaacctggtgcatggagtcttctacgccgagcgctaccagatgcccaccggcatcaagggccccctgcccaacaccaagacccagttcttcatcccctacaccatcaagagcaagtag

SEQ ID NO: 3265 - DNA, 651 bp, Artificial Sequence
  Description of Artificial Sequence: Synthetic coding sequence
atgctgccccagatccccttcctgctgctggtgtccctgaacctggtgcatggagtcttctacgccgagcgctaccagatgcccaccggcatcaagggccccctgcccaacaccaagacccagttcttcatcccctacaccatcaagagcaaaggaattgctgtgcggggggagcagggcaccccaggccccccaggccctgctggcccccggggccaccctggccccagcggccccccaggcaagccaggctacggcagccctggcctgcagggcgagcccggcctgcccggccccccaggccccagcgctgtgggcaagccaggagtgcccggcctgcccgggaagccaggagagcggggcccctacggccccaagggagatgtgggccctgctggcctgcccggcccccggggccccccaggccccccaggcatccctggccctgctggcatctctgtgcctgggaagccaggccagcagggccccaccggggcccctggcccccggggcttccctggagagaagggggcccctggggtgcccggcatgaatggccagaagggggagatgggctatggagcccctggccggcctggagagcggggcctgcccggcccccagggccccaccggccccagcggcccctag

SEQ ID NO: 3266 - DNA, 5211 bp, Artificial Sequence
  Description of Artificial Sequence: Synthetic coding sequence
atggagcgctgcagccgctgccaccggctgctgctgctgctgcccctggtgctgggcctgtctgctgcccctggctgggccggggcccctcctgtggatgtgctgcgggccctgcgcttccccagcctgcctgatggagtgcggcgggccaagggcatctgcccagcagatgtggcctacagagtggcccggcctgcccagctgagcgcccccacccggcagctgtttcctgggggcttccccaaggacttcagcctgctgactgtggtgaggacccggcccggcctgcaggcccccctgctgaccctgtacagcgcccagggcgtgcggcagctgggcctggagctgggccggcctgtgcgcttcctgtatgaggaccagacaggccggccccagccccccagccagcctgtgttccggggcctgagcctggctgatggcaagtggcaccgggtggccgtggccgtgaagggccagagcgtgaccctcatcgtggactgcaagaagagggtgacccggcccctgcccaggtctgcccggcctgtgctggacacccacggcgtcatcatctttggagcccgcatcctggatgaggaggtgtttgaaggagatgtgcaggagctggccatcgtgcctggggtgcaggccgcctatgagagctgtgagcagaaggagctggagtgtgagggcggccagcgggagcggccccagaaccagcagccccaccgggcccagaggagcccccagcagcagcccagccggctgcaccggccccagaaccaggagccccagagccagcccacagagagcctgtactatgactatgagcccccctactatgatgtgatgaccaccggcaccaccccagactaccaggaccccaccccaggagaggaggaggagatcctggagagcagcctgctgccccccctggaggaggagcagacagacctgcaggtgcccccaacagctgaccgcttccaggccgaggagtatggagagggcggcacagatcctcctgagggcccctatgactacacctacggctatggagatgactaccgggaggagacagagctgggccctgccctgtctgctgagacagcccacagcggggccgccgcccacggcccccggggcctgaagggggagaagggggagcctgctgtgctggagcccggcatgctggtggagggccccccaggccctgagggccctgctggcctcatcggccccccaggcatccagggcaaccctggccctgtgggggaccctggagagcggggccccccaggccgggccggcctgcccggcagtgatggagcccctggccccccaggcaccagcctgatgctgcccttccgcttcggcagcggcggcggggacaagggccctgtggtggccgcccaggaggcccaggcccaggccatcctgcagcaggcccggctggccctgcggggccccccaggccccatgggctacacaggccggcccggccccctgggccagcccggcagccctggcctgaagggggagagcggggacctgggcccccagggcccccggggcccccagggcctgaccggccccccaggcaaggccggccggcggggccgggccggggctgatggagcccggggcatgcctggggaccccggggtgaagggggaccggggctttgatggcctgcccggcctgcctggagagaagggccacagaggagacaccggggcccagggcctgcccggccccccaggagaagatggagagagaggagatgatggagaaattggcccccggggcctgcctggagagagcggcccccggggcctgctgggccccaagggccccccaggcatccctggccccccaggagtgcggggcatggatggcccccagggccccaagggcagcctgggcccccagggcgagcccggccccccaggccagcagggcaccccaggcacccagggcctgcccggcccccagggcgccatcggcccccatggagagaagggcccccagggcaagccaggcctgcccggcatgcctggcagtgatggccccccaggccaccctgggaaggagggccccccaggcaccaagggcaaccagggccccagcggcccccagggccccctgggctacccaggcccccggggcgtgaagggcgtggatggcatccggggcctgaagggccacaagggggagaagggggaggatggcttccctggcttcaagggggacatcggcgtgaagggggacagaggagaggtgggcgtgcccggcagcagaggagaagatggccctgagggccccaagggccgcacaggccccaccggggaccccggccccccaggcctgatgggagagaagggcaagctgggcgtgcccggcctgcccggctacccaggccggcagggccccaagggcagcctgggcttccctggcttccctggggccagcggggagaagggggcccggggcctgagcggcaagagcggccccagaggagagcggggccccaccggcccccggggccagaggggccccaggggggccaccgggaagagcggggccaagggcaccagcggaggagatggcccccacggccccccaggagagcggggcctgcccggcccccagggccccaacggcttccctggccccaagggccccccaggccccccaggcaaggatggcctgcccggccaccctggccagagaggagaggtgggcttccagggcaagacaggccccccaggccccccaggagtggtgggcccccagggcgctgctggggagaccggccccatgggagagcggggccaccctggccccccaggccccccaggagagcagggcctgcctggaacagctgggaaggagggcaccaagggggaccccggccccccaggggcccctgggaaggatggccctgctggcctgcggggcttccctggagagcggggcctgcctggaacagctgggggccctggcctgaagggaaatgaaggccccagcggccccccaggccctgctggcagccctggagagagaggagctgctggcagcggcggccccatcggccccccaggccggcccggcccccagggccccccaggagctgctggggagaagggcgtgcctggagagaagggccccatcggccccaccggcagagatggagtgcagggccctgtgggcctgcccggccctgctggccccccaggagtggccggggaggatggagacaagggggaggtgggggaccccggccagaagggcaccaagggcaacaagggggagcacggccccccaggccccccaggccccatcggccctgtgggccagcctggagctgctggagcagatggagagcccggggcccggggcccccagggccactttggagccaagggagatgagggcacccggggcttcaatggacctcctggccccatcggcctgcagggcctgcccggccccagcggggagaagggggagactggagatgtgggccccatgggccccccaggccccccaggcccccggggccctgctggccccaatggagcagatggcccccagggccccccaggcggcgtgggcaacctgggccccccaggagagaagggggagcctggagagagcggcagccctggcatccagggcgagcccggggtgaagggccccagaggagagcggggggagaagggggagagcggccagcctggagagcccggccccccaggccccaagggccccactggagatgatggccccaagggcaaccctggccctgtgggcttccctggggaccccggccccccaggagagggcggcccccggggccaggatggagccaagggggacagaggagaagatggagagcccggccagcccggcagccctggccccaccggggagaatggacctcctggccccctgggcaagaggggccctgctggcagccctggcagcgagggccggcagggcggcaaaggagccaagggggaccccggggccatcggggcccctgggaagacaggccctgtgggccctgctggccctgctgggaagccaggcccagatggcctgcggggcctgcccggctctgtgggccagcagggccggcctggggccaccggccaggccggccccccaggccctgtgggccccccaggcctgcccggcctgcggggagatgctggggccaagggggagaagggccaccctggcctcatcggcctgattggccccccaggagagcagggcgagaagggggaccggggcctgcccggcccccagggcagccctggccagaagggggagatgggcatccctggggccagcggccccatcggccctgggggccccccaggcctgcccggccctgctggccccaagggggccaagggggccaccggccctgggggccccaagggggagaagggcgtgcagggccccccaggccaccctggccccccaggagaggtgatccagcccctgcccatccagatgcccaagaagaccaggagatctgtggatggcagccggctgatgcaggaggatgaggccatccccaccggcggggcccctggcagccctgggggcctggaggagatcttcggcagcctggacagcctgcgggaggagattgagcagatgaggcggcccaccggcacccaggacagccctgcccggacctgccaggacctgaagctgtgccaccctgagctgcctgatggagagtactgggtggaccccaaccagggctgtgccagagatgccttccgggtcttctgcaacttcaccgctggaggagagacctgtgtgaccccaagagatgatgtgacccagttctcctatgtggacagcgagggcagccctgtgggcgtggtgcagctgaccttcctgcggctgctgtctgtgtctgcccaccaggatgtgtcctacccctgcagcggggccgccagagatggccccctgcggctgcggggggccaatgaagatgagctgagccctgagaccagcccctacgtgaaggagttcagagatggctgccagacccagcagggccgcacagtgctggaggtgaggacccctgtgctggagcagctgcctgtgctggatgccagcttcagtgacctgggcgcccccccaagaagaggaggagtgctgctgggccctgtgtgcttcatgggctag

SEQ ID NO: 3267 - DNA, 5148 bp, Artificial Sequence
  Description of Artificial Sequence: Synthetic coding sequence
atggagcgctgcagccgctgccaccggctgctgctgctgctgcccctggtgctgggcctgtctgctgcccctggctgggccggggcccctcctgtggatgtgctgcgggccctgcgcttccccagcctgcctgatggagtgcggcgggccaagggcatctgcccagcagatgtggcctacagagtggcccggcctgcccagctgagcgcccccacccggcagctgtttcctgggggcttccccaaggacttcagcctgctgactgtggtgaggacccggcccggcctgcaggcccccctgctgaccctgtacagcgcccagggcgtgcggcagctgggcctggagctgggccggcctgtgcgcttcctgtatgaggaccagacaggccggccccagccccccagccagcctgtgttccggggcctgagcctggctgatggcaagtggcaccgggtggccgtggccgtgaagggccagagcgtgaccctcatcgtggactgcaagaagagggtgacccggcccctgcccaggtctgcccggcctgtgctggacacccacggcgtcatcatctttggagcccgcatcctggatgaggaggtgtttgaaggagatgtgcaggagctggccatcgtgcctggggtgcaggccgcctatgagagctgtgagcagaaggagctggagtgtgagggcggccagcgggagcggccccagaaccagcagccccaccgggcccagaggagcccccagcagcagcccagccggctgcaccggccccagaaccaggagccccagagccagcccacagagagcctgtactatgactatgagcccccctactatgatgtgatgaccaccggcaccaccccagactaccaggagcagacagacctgcaggtgcccccaacagctgaccgcttccaggccgaggagtatggagagggcggcacagaccccccagagggcccctatgactacacctacggctatggagatgactaccgggaggagacagagctgggccctgccctgtctgctgagacagcccacagcggggctgctgcccacggcccccggggcctgaagggggagaagggggagcctgctgtgctggagcccggcatgctggtggagggccccccaggccctgagggccctgctggcctgattggccccccaggcatccagggcaaccctggccctgtgggggaccccggggagcggggccccccaggccgggccggcctgcccggcagtgatggagcccctggccccccaggcaccagcctgatgctgcccttccgctttggaagtggcggcggggacaagggccctgtggtggccgcccaggaggcccaggcccaggccatcctgcagcaggcccggctggccctgcggggccccccaggccccatgggctacacaggccggcccggccccctgggccagcccggcagccctggcctgaagggggagagcggggacctgggcccccagggcccccggggcccccagggcctgactggacctcctgggaaggccggcagaagaggccgggccggggctgatggagcccggggcatgcctggggaccccggggtgaagggggaccggggctttgatggcctgcccggcctgcccggggagaagggccacagaggagacacaggagcccagggcctgcccggccccccaggagaagatggagagagaggagatgatggagagatcggcccccggggcctgcccggggagagcggcccccggggcctgctgggccccaagggccccccaggcatccctggccccccaggagtgcggggcatggatggcccccagggccccaagggcagcctgggcccccagggcgagcccggccccccaggccagcagggcaccccaggcacccagggcctgcccggcccccagggcgccatcggcccccacggggagaagggcccccagggcaagccaggcctgcccggcatgcctggcagtgatggccccccaggccaccctgggaaggagggccccccaggcaccaagggcaaccagggccccagcggcccccagggccccctgggctacccaggcccccggggcgtgaagggcgtggatggcatccggggcctgaagggccacaagggggagaagggagaagatggcttccctggcttcaagggggacattggagtgaagggggacagaggagaggtgggcgtgcccggcagcagaggagaagatggccctgagggccccaagggccgcacaggccccactggagaccccggccccccaggcctgatgggagagaagggcaagctgggcgtgcccggcctgcccggctacccaggccggcagggccccaagggcagcctgggcttccctggcttccctggggccagcggggagaagggggcccggggcctgagcggcaagagcggccccagaggagagcggggccccaccggcccccggggccagaggggccccaggggggccaccgggaagagcggggccaagggcaccagcggaggagatggcccccacggccccccaggagagcggggcctgcccggcccccagggccccaacggcttccctggccccaagggccccccaggccccccaggcaaggatggcctgcccggccaccctggccagagaggagaggtgggcttccagggcaagacaggccccccaggccccccaggagtggtgggcccccagggcgccgccggggagaccggccccatgggagagcggggccaccctggccccccaggccccccaggagagcagggcctgcccggcacagctgggaaggagggcaccaagggggaccccggccccccaggggcccctgggaaggatggccctgctggcctgcggggcttccctggagagcggggcctgcccggcacagctgggggccctggcctgaagggaaatgaaggccccagcggccccccaggccctgctggcagccctggagagagaggagctgctggcagcggcggccccatcggccccccaggccggcccggcccccagggccccccaggagctgctggggagaagggcgtgcctggagagaagggccccatcggccccaccggcagagatggagtgcagggccctgtgggcctgcccggccctgctggccccccaggagtggccggagaagatggagacaagggggaggtgggggaccccggccagaagggcaccaagggcaacaagggggagcacggccccccaggccccccaggccccatcggccctgtgggccagcccggggctgctggagcagatggagagcccggggcccggggcccccagggccactttggagccaagggagatgagggcacccggggcttcaacggccccccaggccccatcggcctgcagggcctgcccggccccagcggggagaagggggagactggagatgtgggccccatgggccccccaggccccccaggcccccggggccctgctggccccaacggggctgatggcccccagggccccccaggaggagtgggcaacctgggccccccaggagagaagggggagcccggggagagcggcagccctggcatccagggcgagcccggggtgaagggccccagaggagagcggggggagaagggggagagcggccagcccggggagcccggccccccaggccccaagggccccactggagatgatggccccaagggcaaccctggccctgtgggcttccctggggaccccggccccccaggagagggcggcccccggggccaggatggagccaagggggacagaggagaagatggagagcccggccagcccggcagccctggccccactggagaaaatggccccccaggccccctgggcaagaggggccctgctggcagccctggcagcgagggccggcagggcggcaagggggccaagggggaccccggggccatcggggcccctgggaagacaggccctgtgggccctgctggccctgctgggaagccaggcccagatggcctgcggggcctgcccggctctgtgggccagcagggccggcctggggccaccggccaggccggccccccaggccctgtgggccccccaggcctgcccggcctgcggggagatgctggggccaagggggagaagggccaccctggcctgattggcctcatcggccccccaggagagcagggcgagaagggggaccggggcctgcccggcccccagggcagccctggccagaagggggagatgggcatccctggggccagcggccccatcggccctgggggccccccaggcctgcccggccctgctggccccaagggggccaagggggccactggacctgggggccccaagggggagaagggcgtgcagggccccccaggccaccctggccccccaggagaggtgatccagcccctgcccatccagatgcccaagaagacccggcgctctgtggatggcagccggctgatgcaggaggatgaggccatccccactggaggagcccctggcagccctgggggcctggaggagatcttcggcagcctggacagcctgcgggaggagattgagcagatgagaagacccaccggcacccaggacagccctgcccggacctgccaggacctgaagctgtgccaccctgagctgcctgatggagagtactgggtggaccccaaccagggctgtgccagagatgccttccgggtcttctgcaacttcaccgctggaggagagacctgtgtgaccccaagagatgatgtgacccagttctcctatgtggacagcgagggcagccctgtgggcgtggtgcagctgaccttcctgcggctgctgtctgtgtctgcccaccaggatgtgtcctacccctgcagcggggccgccagagatggccccctgcggctgcggggggccaatgaagatgagctgagccctgagaccagcccctacgtgaaggagttcagagatggctgccagacccagcagggccgcacagtgctggaggtgaggacccctgtgctggagcagctgcctgtgctggatgccagcttcagtgacctgggcgccccaccccggcggggcggcgtgctgctgggccctgtgtgcttcatgggctag

SEQ ID NO: 3268 - DNA, 4890 bp, Artificial Sequence
  Description of Artificial Sequence: Synthetic coding sequence
atggagcgctgcagccgctgccaccggctgctgctgctgctgcccctggtgctgggcctgtctgctgcccctggctgggccggggcccctcctgtggatgtgctgcgggccctgcgcttccccagcctgcctgatggagtgcggcgggccaagggcatctgcccagcagatgtggcctacagagtggcccggcctgcccagctgagcgcccccacccggcagctgtttcctgggggcttccccaaggacttcagcctgctgactgtggtgaggacccggcccggcctgcaggcccccctgctgaccctgtacagcgcccagggcgtgcggcagctgggcctggagctgggccggcctgtgcgcttcctgtatgaggaccagacaggccggccccagccccccagccagcctgtgttccggggcctgagcctggctgatggcaagtggcaccgggtggccgtggccgtgaagggccagagcgtgaccctcatcgtggactgcaagaagagggtgacccggcccctgcccaggtctgcccggcctgtgctggacacccacggcgtcatcatctttggagcccgcatcctggatgaggaggtgtttgaaggagatgtgcaggagctggccatcgtgcctggggtgcaggccgcctatgagagctgtgagcagaaggagctggagtgtgagggcggccagcgggagcggccccagaaccagcagccccaccgggcccagaggagcccccagcagcagcccagccggctgcaccggccccagaaccaggagccccagagccaggccgcccacggcccccggggcctgaagggggagaagggggagcctgctgtgctggagcccggcatgctggtggagggccccccaggccctgagggccctgctggcctgattggccccccaggcatccagggcaaccctggccctgtgggggaccccggggagcggggccccccaggccgggccggcctgcccggcagtgatggagcccctggccccccaggcaccagcctgatgctgcccttccgctttggaagtggcggcggggacaagggccctgtggtggccgcccaggaggcccaggcccaggccatcctgcagcaggcccggctggccctgcggggccccccaggccccatgggctacacaggccggcccggccccctgggccagcccggcagccctggcctgaagggggagagcggggacctgggcccccagggcccccggggcccccagggcctgactggacctcctgggaaggccggcagaagaggccgggccggggctgatggagcccggggcatgcctggggaccccggggtgaagggggaccggggctttgatggcctgcccggcctgcccggggagaagggccacagaggagacacaggagcccagggcctgcccggccccccaggagaagatggagagagaggagatgatggagagatcggcccccggggcctgcccggggagagcggcccccggggcctgctgggccccaagggccccccaggcatccctggccccccaggagtgcggggcatggatggcccccagggccccaagggcagcctgggcccccagggcgagcccggccccccaggccagcagggcaccccaggcacccagggcctgcccggcccccagggcgccatcggcccccacggggagaagggcccccagggcaagccaggcctgcccggcatgcctggcagtgatggccccccaggccaccctgggaaggagggccccccaggcaccaagggcaaccagggccccagcggcccccagggccccctgggctacccaggcccccggggcgtgaagggcgtggatggcatccggggcctgaagggccacaagggggagaagggagaagatggcttccctggcttcaagggggacattggagtgaagggggacagaggagaggtgggcgtgcccggcagcagaggagaagatggccctgagggccccaagggccgcacaggccccactggagaccccggccccccaggcctgatgggagagaagggcaagctgggcgtgcccggcctgcccggctacccaggccggcagggccccaagggcagcctgggcttccctggcttccctggggccagcggggagaagggggcccggggcctgagcggcaagagcggccccagaggagagcggggccccaccggcccccggggccagaggggccccaggggggccaccgggaagagcggggccaagggcaccagcggaggagatggcccccacggccccccaggagagcggggcctgcccggcccccagggccccaacggcttccctggccccaagggccccccaggccccccaggcaaggatggcctgcccggccaccctggccagagaggagaggtgggcttccagggcaagacaggccccccaggccccccaggagtggtgggcccccagggcgccgccggggagaccggccccatgggagagcggggccaccctggccccccaggccccccaggagagcagggcctgcccggcacagctgggaaggagggcaccaagggggaccccggccccccaggggcccctgggaaggatggccctgctggcctgcggggcttccctggagagcggggcctgcccggcacagctgggggccctggcctgaagggaaatgaaggccccagcggccccccaggccctgctggcagccctggagagagaggagctgctggcagcggcggccccatcggccccccaggccggcccggcccccagggccccccaggagctgctggggagaagggcgtgcctggagagaagggccccatcggccccaccggcagagatggagtgcagggccctgtgggcctgcccggccctgctggccccccaggagtggccggagaagatggagacaagggggaggtgggggaccccggccagaagggcaccaagggcaacaagggggagcacggccccccaggccccccaggccccatcggccctgtgggccagcccggggctgctggagcagatggagagcccggggcccggggcccccagggccactttggagccaagggagatgagggcacccggggcttcaacggccccccaggccccatcggcctgcagggcctgcccggccccagcggggagaagggggagactggagatgtgggccccatgggccccccaggccccccaggcccccggggccctgctggccccaacggggctgatggcccccagggccccccaggaggagtgggcaacctgggccccccaggagagaagggggagcccggggagagcggcagccctggcatccagggcgagcccggggtgaagggccccagaggagagcggggggagaagggggagagcggccagcccggggagcccggccccccaggccccaagggccccactggagatgatggccccaagggcaaccctggccctgtgggcttccctggggaccccggccccccaggagagggcggcccccggggccaggatggagccaagggggacagaggagaagatggagagcccggccagcccggcagccctggccccactggagaaaatggccccccaggccccctgggcaagaggggccctgctggcagccctggcagcgagggccggcagggcggcaagggggccaagggggaccccggggccatcggggcccctgggaagacaggccctgtgggccctgctggccctgctgggaagccaggcccagatggcctgcggggcctgcccggctctgtgggccagcagggccggcctggggccaccggccaggccggccccccaggccctgtgggccccccaggcctgcccggcctgcggggagatgctggggccaagggggagaagggccaccctggcctgattggcctcatcggccccccaggagagcagggcgagaagggggaccggggcctgcccggcccccagggcagccctggccagaagggggagatgggcatccctggggccagcggccccatcggccctgggggccccccaggcctgcccggccctgctggccccaagggggccaagggggccactggacctgggggccccaagggggagaagggcgtgcagggccccccaggccaccctggccccccaggagaggtgatccagcccctgcccatccagatgcccaagaagacccggcgctctgtggatggcagccggctgatgcaggaggatgaggccatccccactggaggagcccctggcagccctgggggcctggaggagatcttcggcagcctggacagcctgcgggaggagattgagcagatgagaagacccaccggcacccaggacagccctgcccggacctgccaggacctgaagctgtgccaccctgagctgcctgatggagagtactgggtggaccccaaccagggctgtgccagagatgccttccgggtcttctgcaacttcaccgctggaggagagacctgtgtgaccccaagagatgatgtgacccagttctcctatgtggacagcgagggcagccctgtgggcgtggtgcagctgaccttcctgcggctgctgtctgtgtctgcccaccaggatgtgtcctacccctgcagcggggccgccagagatggccccctgcggctgcggggggccaatgaagatgagctgagccctgagaccagcccctacgtgaaggagttcagagatggctgccagacccagcagggccgcacagtgctggaggtgaggacccctgtgctggagcagctgcctgtgctggatgccagcttcagtgacctgggcgccccaccccggcggggcggcgtgctgctgggccctgtgtgcttcatgggctag

SEQ ID NO: 3269 - DNA, 4953 bp, Artificial Sequence
  Description of Artificial Sequence: Synthetic coding sequence
atggagcgctgcagccgctgccaccggctgctgctgctgctgcccctggtgctgggcctgtctgctgcccctggctgggccggggcccctcctgtggatgtgctgcgggccctgcgcttccccagcctgcctgatggagtgcggcgggccaagggcatctgcccagcagatgtggcctacagagtggcccggcctgcccagctgagcgcccccacccggcagctgtttcctgggggcttccccaaggacttcagcctgctgactgtggtgaggacccggcccggcctgcaggcccccctgctgaccctgtacagcgcccagggcgtgcggcagctgggcctggagctgggccggcctgtgcgcttcctgtatgaggaccagacaggccggccccagccccccagccagcctgtgttccggggcctgagcctggctgatggcaagtggcaccgggtggccgtggccgtgaagggccagagcgtgaccctcatcgtggactgcaagaagagggtgacccggcccctgcccaggtctgcccggcctgtgctggacacccacggcgtcatcatctttggagcccgcatcctggatgaggaggtgtttgaaggagatgtgcaggagctggccatcgtgcctggggtgcaggccgcctatgagagctgtgagcagaaggagctggagtgtgagggcggccagcgggagcggccccagaaccagcagccccaccgggcccagaggagcccccagcagcagcccagccggctgcaccggccccagaaccaggagccccagagccaggaccccaccccaggagaggaggaggagatcctggagagcagcctgctgccccccctggaggaggccgcccacggcccccggggcctgaagggggagaagggggagcctgctgtgctggagcccggcatgctggtggagggccccccaggccctgagggccctgctggcctcatcggccccccaggcatccagggcaaccctggccctgtgggggaccctggagagcggggccccccaggccgggccggcctgcccggcagtgatggagcccctggccccccaggcaccagcctgatgctgcccttccgcttcggcagcggcggcggggacaagggccctgtggtggccgcccaggaggcccaggcccaggccatcctgcagcaggcccggctggccctgcggggccccccaggccccatgggctacacaggccggcccggccccctgggccagcccggcagccctggcctgaagggggagagcggggacctgggcccccagggcccccggggcccccagggcctgaccggccccccaggcaaggccggccggcggggccgggccggggctgatggagcccggggcatgcctggggaccccggggtgaagggggaccggggctttgatggcctgcccggcctgcctggagagaagggccacagaggagacaccggggcccagggcctgcccggccccccaggagaagatggagagagaggagatgatggagaaattggcccccggggcctgcctggagagagcggcccccggggcctgctgggccccaagggccccccaggcatccctggccccccaggagtgcggggcatggatggcccccagggccccaagggcagcctgggcccccagggcgagcccggccccccaggccagcagggcaccccaggcacccagggcctgcccggcccccagggcgccatcggcccccatggagagaagggcccccagggcaagccaggcctgcccggcatgcctggcagtgatggccccccaggccaccctgggaaggagggccccccaggcaccaagggcaaccagggccccagcggcccccagggccccctgggctacccaggcccccggggcgtgaagggcgtggatggcatccggggcctgaagggccacaagggggagaagggggaggatggcttccctggcttcaagggggacatcggcgtgaagggggacagaggagaggtgggcgtgcccggcagcagaggagaagatggccctgagggccccaagggccgcacaggccccaccggggaccccggccccccaggcctgatgggagagaagggcaagctgggcgtgcccggcctgcccggctacccaggccggcagggccccaagggcagcctgggcttccctggcttccctggggccagcggggagaagggggcccggggcctgagcggcaagagcggccccagaggagagcggggccccaccggcccccggggccagaggggccccaggggggccaccgggaagagcggggccaagggcaccagcggaggagatggcccccacggccccccaggagagcggggcctgcccggcccccagggccccaacggcttccctggccccaagggccccccaggccccccaggcaaggatggcctgcccggccaccctggccagagaggagaggtgggcttccagggcaagacaggccccccaggccccccaggagtggtgggcccccagggcgctgctggggagaccggccccatgggagagcggggccaccctggccccccaggccccccaggagagcagggcctgcctggaacagctgggaaggagggcaccaagggggaccccggccccccaggggcccctgggaaggatggccctgctggcctgcggggcttccctggagagcggggcctgcctggaacagctgggggccctggcctgaagggaaatgaaggccccagcggccccccaggccctgctggcagccctggagagagaggagctgctggcagcggcggccccatcggccccccaggccggcccggcccccagggccccccaggagctgctggggagaagggcgtgcctggagagaagggccccatcggccccaccggcagagatggagtgcagggccctgtgggcctgcccggccctgctggccccccaggagtggccggggaggatggagacaagggggaggtgggggaccccggccagaagggcaccaagggcaacaagggggagcacggccccccaggccccccaggccccatcggccctgtgggccagcctggagctgctggagcagatggagagcccggggcccggggcccccagggccactttggagccaagggagatgagggcacccggggcttcaatggacctcctggccccatcggcctgcagggcctgcccggccccagcggggagaagggggagactggagatgtgggccccatgggccccccaggccccccaggcccccggggccctgctggccccaatggagcagatggcccccagggccccccaggcggcgtgggcaacctgggccccccaggagagaagggggagcctggagagagcggcagccctggcatccagggcgagcccggggtgaagggccccagaggagagcggggggagaagggggagagcggccagcctggagagcccggccccccaggccccaagggccccactggagatgatggccccaagggcaaccctggccctgtgggcttccctggggaccccggccccccaggagagggcggcccccggggccaggatggagccaagggggacagaggagaagatggagagcccggccagcccggcagccctggccccaccggggagaatggacctcctggccccctgggcaagaggggccctgctggcagccctggcagcgagggccggcagggcggcaaaggagccaagggggaccccggggccatcggggcccctgggaagacaggccctgtgggccctgctggccctgctgggaagccaggcccagatggcctgcggggcctgcccggctctgtgggccagcagggccggcctggggccaccggccaggccggccccccaggccctgtgggccccccaggcctgcccggcctgcggggagatgctggggccaagggggagaagggccaccctggcctcatcggcctgattggccccccaggagagcagggcgagaagggggaccggggcctgcccggcccccagggcagccctggccagaagggggagatgggcatccctggggccagcggccccatcggccctgggggccccccaggcctgcccggccctgctggccccaagggggccaagggggccaccggccctgggggccccaagggggagaagggcgtgcagggccccccaggccaccctggccccccaggagaggtgatccagcccctgcccatccagatgcccaagaagaccaggagatctgtggatggcagccggctgatgcaggaggatgaggccatccccaccggcggggcccctggcagccctgggggcctggaggagatcttcggcagcctggacagcctgcgggaggagattgagcagatgaggcggcccaccggcacccaggacagccctgcccggacctgccaggacctgaagctgtgccaccctgagctgcctgatggagagtactgggtggaccccaaccagggctgtgccagagatgccttccgggtcttctgcaacttcaccgctggaggagagacctgtgtgaccccaagagatgatgtgacccagttctcctatgtggacagcgagggcagccctgtgggcgtggtgcagctgaccttcctgcggctgctgtctgtgtctgcccaccaggatgtgtcctacccctgcagcggggccgccagagatggccccctgcggctgcggggggccaatgaagatgagctgagccctgagaccagcccctacgtgaaggagttcagagatggctgccagacccagcagggccgcacagtgctggaggtgaggacccctgtgctggagcagctgcctgtgctggatgccagcttcagtgacctgggcgcccccccaagaagaggaggagtgctgctgggccctgtgtgcttcatgggctag

SEQ ID NO: 3270 - DNA, 4968 bp, Artificial Sequence
  Description of Artificial Sequence: Synthetic coding sequence
atggagcgctgcagccgctgccaccggctgctgctgctgctgcccctggtgctgggcctgtctgctgcccctggctgggccggggcccctcctgtggatgtgctgcgggccctgcgcttccccagcctgcctgatggagtgcggcgggccaagggcatctgcccagcagatgtggcctacagagtggcccggcctgcccagctgagcgcccccacccggcagctgtttcctgggggcttccccaaggacttcagcctgctgactgtggtgaggacccggcccggcctgcaggcccccctgctgaccctgtacagcgcccagggcgtgcggcagctgggcctggagctgggccggcctgtgcgcttcctgtatgaggaccagacaggccggccccagccccccagccagcctgtgttccggggcctgagcctggctgatggcaagtggcaccgggtggccgtggccgtgaagggccagagcgtgaccctcatcgtggactgcaagaagagggtgacccggcccctgcccaggtctgcccggcctgtgctggacacccacggcgtcatcatctttggagcccgcatcctggatgaggaggtgtttgaaggagatgtgcaggagctggccatcgtgcctggggtgcaggccgcctatgagagctgtgagcagaaggagctggagtgtgagggcggccagcgggagcggccccagaaccagcagccccaccgggcccagaggagcccccagcagcagcccagccggctgcaccggccccagaaccaggagccccagagccagcccacagagagcctgtactatgactatgagcccccctactatgatgtgatgaccaccggcaccaccccagactaccaggccgcccacggcccccggggcctgaagggggagaagggggagcctgctgtgctggagcccggcatgctggtggagggccccccaggccctgagggccctgctggcctgattggccccccaggcatccagggcaaccctggccctgtgggggaccccggggagcggggccccccaggccgggccggcctgcccggcagtgatggagcccctggccccccaggcaccagcctgatgctgcccttccgctttggaagtggcggcggggacaagggccctgtggtggccgcccaggaggcccaggcccaggccatcctgcagcaggcccggctggccctgcggggccccccaggccccatgggctacacaggccggcccggccccctgggccagcccggcagccctggcctgaagggggagagcggggacctgggcccccagggcccccggggcccccagggcctgactggacctcctgggaaggccggcagaagaggccgggccggggctgatggagcccggggcatgcctggggaccccggggtgaagggggaccggggctttgatggcctgcccggcctgcccggggagaagggccacagaggagacacaggagcccagggcctgcccggccccccaggagaagatggagagagaggagatgatggagagatcggcccccggggcctgcccggggagagcggcccccggggcctgctgggccccaagggccccccaggcatccctggccccccaggagtgcggggcatggatggcccccagggccccaagggcagcctgggcccccagggcgagcccggccccccaggccagcagggcaccccaggcacccagggcctgcccggcccccagggcgccatcggcccccacggggagaagggcccccagggcaagccaggcctgcccggcatgcctggcagtgatggccccccaggccaccctgggaaggagggccccccaggcaccaagggcaaccagggccccagcggcccccagggccccctgggctacccaggcccccggggcgtgaagggcgtggatggcatccggggcctgaagggccacaagggggagaagggagaagatggcttccctggcttcaagggggacattggagtgaagggggacagaggagaggtgggcgtgcccggcagcagaggagaagatggccctgagggccccaagggccgcacaggccccactggagaccccggccccccaggcctgatgggagagaagggcaagctgggcgtgcccggcctgcccggctacccaggccggcagggccccaagggcagcctgggcttccctggcttccctggggccagcggggagaagggggcccggggcctgagcggcaagagcggccccagaggagagcggggccccaccggcccccggggccagaggggccccaggggggccaccgggaagagcggggccaagggcaccagcggaggagatggcccccacggccccccaggagagcggggcctgcccggcccccagggccccaacggcttccctggccccaagggccccccaggccccccaggcaaggatggcctgcccggccaccctggccagagaggagaggtgggcttccagggcaagacaggccccccaggccccccaggagtggtgggcccccagggcgccgccggggagaccggccccatgggagagcggggccaccctggccccccaggccccccaggagagcagggcctgcccggcacagctgggaaggagggcaccaagggggaccccggccccccaggggcccctgggaaggatggccctgctggcctgcggggcttccctggagagcggggcctgcccggcacagctgggggccctggcctgaagggaaatgaaggccccagcggccccccaggccctgctggcagccctggagagagaggagctgctggcagcggcggccccatcggccccccaggccggcccggcccccagggccccccaggagctgctggggagaagggcgtgcctggagagaagggccccatcggccccaccggcagagatggagtgcagggccctgtgggcctgcccggccctgctggccccccaggagtggccggagaagatggagacaagggggaggtgggggaccccggccagaagggcaccaagggcaacaagggggagcacggccccccaggccccccaggccccatcggccctgtgggccagcccggggctgctggagcagatggagagcccggggcccggggcccccagggccactttggagccaagggagatgagggcacccggggcttcaacggccccccaggccccatcggcctgcagggcctgcccggccccagcggggagaagggggagactggagatgtgggccccatgggccccccaggccccccaggcccccggggccctgctggccccaacggggctgatggcccccagggccccccaggaggagtgggcaacctgggccccccaggagagaagggggagcccggggagagcggcagccctggcatccagggcgagcccggggtgaagggccccagaggagagcggggggagaagggggagagcggccagcccggggagcccggccccccaggccccaagggccccactggagatgatggccccaagggcaaccctggccctgtgggcttccctggggaccccggccccccaggagagggcggcccccggggccaggatggagccaagggggacagaggagaagatggagagcccggccagcccggcagccctggccccactggagaaaatggccccccaggccccctgggcaagaggggccctgctggcagccctggcagcgagggccggcagggcggcaagggggccaagggggaccccggggccatcggggcccctgggaagacaggccctgtgggccctgctggccctgctgggaagccaggcccagatggcctgcggggcctgcccggctctgtgggccagcagggccggcctggggccaccggccaggccggccccccaggccctgtgggccccccaggcctgcccggcctgcggggagatgctggggccaagggggagaagggccaccctggcctgattggcctcatcggccccccaggagagcagggcgagaagggggaccggggcctgcccggcccccagggcagccctggccagaagggggagatgggcatccctggggccagcggccccatcggccctgggggccccccaggcctgcccggccctgctggccccaagggggccaagggggccactggacctgggggccccaagggggagaagggcgtgcagggccccccaggccaccctggccccccaggagaggtgatccagcccctgcccatccagatgcccaagaagacccggcgctctgtggatggcagccggctgatgcaggaggatgaggccatccccactggaggagcccctggcagccctgggggcctggaggagatcttcggcagcctggacagcctgcgggaggagattgagcagatgagaagacccaccggcacccaggacagccctgcccggacctgccaggacctgaagctgtgccaccctgagctgcctgatggagagtactgggtggaccccaaccagggctgtgccagagatgccttccgggtcttctgcaacttcaccgctggaggagagacctgtgtgaccccaagagatgatgtgacccagttctcctatgtggacagcgagggcagccctgtgggcgtggtgcagctgaccttcctgcggctgctgtctgtgtctgcccaccaggatgtgtcctacccctgcagcggggccgccagagatggccccctgcggctgcggggggccaatgaagatgagctgagccctgagaccagcccctacgtgaaggagttcagagatggctgccagacccagcagggccgcacagtgctggaggtgaggacccctgtgctggagcagctgcctgtgctggatgccagcttcagtgacctgggcgccccaccccggcggggcggcgtgctgctgggccctgtgtgcttcatgggctag

SEQ ID NO: 3271 - DNA, 5070 bp, Artificial Sequence
  Description of Artificial Sequence: Synthetic coding sequence
atggagcgctgcagccgctgccaccggctgctgctgctgctgcccctggtgctgggcctgtctgctgcccctggctgggccggggcccctcctgtggatgtgctgcgggccctgcgcttccccagcctgcctgatggagtgcggcgggccaagggcatctgcccagcagatgtggcctacagagtggcccggcctgcccagctgagcgcccccacccggcagctgtttcctgggggcttccccaaggacttcagcctgctgactgtggtgaggacccggcccggcctgcaggcccccctgctgaccctgtacagcgcccagggcgtgcggcagctgggcctggagctgggccggcctgtgcgcttcctgtatgaggaccagacaggccggccccagccccccagccagcctgtgttccggggcctgagcctggctgatggcaagtggcaccgggtggccgtggccgtgaagggccagagcgtgaccctcatcgtggactgcaagaagagggtgacccggcccctgcccaggtctgcccggcctgtgctggacacccacggcgtcatcatctttggagcccgcatcctggatgaggaggtgtttgaaggagatgtgcaggagctggccatcgtgcctggggtgcaggccgcctatgagagctgtgagcagaaggagctggagtgtgagggcggccagcgggagcggccccagaaccagcagccccaccgggcccagaggagcccccagcagcagcccagccggctgcaccggccccagaaccaggagccccagagccaggagcagacagacctgcaggtgcccccaacagctgaccgcttccaggccgaggagtatggagagggcggcacagaccccccagagggcccctatgactacacctacggctatggagatgactaccgggaggagacagagctgggccctgccctgtctgctgagacagcccacagcggggctgctgcccacggcccccggggcctgaagggggagaagggggagcctgctgtgctggagcccggcatgctggtggagggccccccaggccctgagggccctgctggcctgattggccccccaggcatccagggcaaccctggccctgtgggggaccccggggagcggggccccccaggccgggccggcctgcccggcagtgatggagcccctggccccccaggcaccagcctgatgctgcccttccgctttggaagtggcggcggggacaagggccctgtggtggccgcccaggaggcccaggcccaggccatcctgcagcaggcccggctggccctgcggggccccccaggccccatgggctacacaggccggcccggccccctgggccagcccggcagccctggcctgaagggggagagcggggacctgggcccccagggcccccggggcccccagggcctgactggacctcctgggaaggccggcagaagaggccgggccggggctgatggagcccggggcatgcctggggaccccggggtgaagggggaccggggctttgatggcctgcccggcctgcccggggagaagggccacagaggagacacaggagcccagggcctgcccggccccccaggagaagatggagagagaggagatgatggagagatcggcccccggggcctgcccggggagagcggcccccggggcctgctgggccccaagggccccccaggcatccctggccccccaggagtgcggggcatggatggcccccagggccccaagggcagcctgggcccccagggcgagcccggccccccaggccagcagggcaccccaggcacccagggcctgcccggcccccagggcgccatcggcccccacggggagaagggcccccagggcaagccaggcctgcccggcatgcctggcagtgatggccccccaggccaccctgggaaggagggccccccaggcaccaagggcaaccagggccccagcggcccccagggccccctgggctacccaggcccccggggcgtgaagggcgtggatggcatccggggcctgaagggccacaagggggagaagggagaagatggcttccctggcttcaagggggacattggagtgaagggggacagaggagaggtgggcgtgcccggcagcagaggagaagatggccctgagggccccaagggccgcacaggccccactggagaccccggccccccaggcctgatgggagagaagggcaagctgggcgtgcccggcctgcccggctacccaggccggcagggccccaagggcagcctgggcttccctggcttccctggggccagcggggagaagggggcccggggcctgagcggcaagagcggccccagaggagagcggggccccaccggcccccggggccagaggggccccaggggggccaccgggaagagcggggccaagggcaccagcggaggagatggcccccacggccccccaggagagcggggcctgcccggcccccagggccccaacggcttccctggccccaagggccccccaggccccccaggcaaggatggcctgcccggccaccctggccagagaggagaggtgggcttccagggcaagacaggccccccaggccccccaggagtggtgggcccccagggcgccgccggggagaccggccccatgggagagcggggccaccctggccccccaggccccccaggagagcagggcctgcccggcacagctgggaaggagggcaccaagggggaccccggccccccaggggcccctgggaaggatggccctgctggcctgcggggcttccctggagagcggggcctgcccggcacagctgggggccctggcctgaagggaaatgaaggccccagcggccccccaggccctgctggcagccctggagagagaggagctgctggcagcggcggccccatcggccccccaggccggcccggcccccagggccccccaggagctgctggggagaagggcgtgcctggagagaagggccccatcggccccaccggcagagatggagtgcagggccctgtgggcctgcccggccctgctggccccccaggagtggccggagaagatggagacaagggggaggtgggggaccccggccagaagggcaccaagggcaacaagggggagcacggccccccaggccccccaggccccatcggccctgtgggccagcccggggctgctggagcagatggagagcccggggcccggggcccccagggccactttggagccaagggagatgagggcacccggggcttcaacggccccccaggccccatcggcctgcagggcctgcccggccccagcggggagaagggggagactggagatgtgggccccatgggccccccaggccccccaggcccccggggccctgctggccccaacggggctgatggcccccagggccccccaggaggagtgggcaacctgggccccccaggagagaagggggagcccggggagagcggcagccctggcatccagggcgagcccggggtgaagggccccagaggagagcggggggagaagggggagagcggccagcccggggagcccggccccccaggccccaagggccccactggagatgatggccccaagggcaaccctggccctgtgggcttccctggggaccccggccccccaggagagggcggcccccggggccaggatggagccaagggggacagaggagaagatggagagcccggccagcccggcagccctggccccactggagaaaatggccccccaggccccctgggcaagaggggccctgctggcagccctggcagcgagggccggcagggcggcaagggggccaagggggaccccggggccatcggggcccctgggaagacaggccctgtgggccctgctggccctgctgggaagccaggcccagatggcctgcggggcctgcccggctctgtgggccagcagggccggcctggggccaccggccaggccggccccccaggccctgtgggccccccaggcctgcccggcctgcggggagatgctggggccaagggggagaagggccaccctggcctgattggcctcatcggccccccaggagagcagggcgagaagggggaccggggcctgcccggcccccagggcagccctggccagaagggggagatgggcatccctggggccagcggccccatcggccctgggggccccccaggcctgcccggccctgctggccccaagggggccaagggggccactggacctgggggccccaagggggagaagggcgtgcagggccccccaggccaccctggccccccaggagaggtgatccagcccctgcccatccagatgcccaagaagacccggcgctctgtggatggcagccggctgatgcaggaggatgaggccatccccactggaggagcccctggcagccctgggggcctggaggagatcttcggcagcctggacagcctgcgggaggagattgagcagatgagaagacccaccggcacccaggacagccctgcccggacctgccaggacctgaagctgtgccaccctgagctgcctgatggagagtactgggtggaccccaaccagggctgtgccagagatgccttccgggtcttctgcaacttcaccgctggaggagagacctgtgtgaccccaagagatgatgtgacccagttctcctatgtggacagcgagggcagccctgtgggcgtggtgcagctgaccttcctgcggctgctgtctgtgtctgcccaccaggatgtgtcctacccctgcagcggggccgccagagatggccccctgcggctgcggggggccaatgaagatgagctgagccctgagaccagcccctacgtgaaggagttcagagatggctgccagacccagcagggccgcacagtgctggaggtgaggacccctgtgctggagcagctgcctgtgctggatgccagcttcagtgacctgggcgccccaccccggcggggcggcgtgctgctgggccctgtgtgcttcatgggctag

SEQ ID NO: 3272 - DNA, 5133 bp, Artificial Sequence
  Description of Artificial Sequence: Synthetic coding sequence
atggagcgctgcagccgctgccaccggctgctgctgctgctgcccctggtgctgggcctgtctgctgcccctggctgggccggggcccctcctgtggatgtgctgcgggccctgcgcttccccagcctgcctgatggagtgcggcgggccaagggcatctgcccagcagatgtggcctacagagtggcccggcctgcccagctgagcgcccccacccggcagctgtttcctgggggcttccccaaggacttcagcctgctgactgtggtgaggacccggcccggcctgcaggcccccctgctgaccctgtacagcgcccagggcgtgcggcagctgggcctggagctgggccggcctgtgcgcttcctgtatgaggaccagacaggccggccccagccccccagccagcctgtgttccggggcctgagcctggctgatggcaagtggcaccgggtggccgtggccgtgaagggccagagcgtgaccctcatcgtggactgcaagaagagggtgacccggcccctgcccaggtctgcccggcctgtgctggacacccacggcgtcatcatctttggagcccgcatcctggatgaggaggtgtttgaaggagatgtgcaggagctggccatcgtgcctggggtgcaggccgcctatgagagctgtgagcagaaggagctggagtgtgagggcggccagcgggagcggccccagaaccagcagccccaccgggcccagaggagcccccagcagcagcccagccggctgcaccggccccagaaccaggagccccagagccaggaccccaccccaggagaggaggaggagatcctggagagcagcctgctgccccccctggaggaggagcagacagacctgcaggtgcccccaacagctgaccgcttccaggccgaggagtatggagagggcggcacagatcctcctgagggcccctatgactacacctacggctatggagatgactaccgggaggagacagagctgggccctgccctgtctgctgagacagcccacagcggggccgccgcccacggcccccggggcctgaagggggagaagggggagcctgctgtgctggagcccggcatgctggtggagggccccccaggccctgagggccctgctggcctcatcggccccccaggcatccagggcaaccctggccctgtgggggaccctggagagcggggccccccaggccgggccggcctgcccggcagtgatggagcccctggccccccaggcaccagcctgatgctgcccttccgcttcggcagcggcggcggggacaagggccctgtggtggccgcccaggaggcccaggcccaggccatcctgcagcaggcccggctggccctgcggggccccccaggccccatgggctacacaggccggcccggccccctgggccagcccggcagccctggcctgaagggggagagcggggacctgggcccccagggcccccggggcccccagggcctgaccggccccccaggcaaggccggccggcggggccgggccggggctgatggagcccggggcatgcctggggaccccggggtgaagggggaccggggctttgatggcctgcccggcctgcctggagagaagggccacagaggagacaccggggcccagggcctgcccggccccccaggagaagatggagagagaggagatgatggagaaattggcccccggggcctgcctggagagagcggcccccggggcctgctgggccccaagggccccccaggcatccctggccccccaggagtgcggggcatggatggcccccagggccccaagggcagcctgggcccccagggcgagcccggccccccaggccagcagggcaccccaggcacccagggcctgcccggcccccagggcgccatcggcccccatggagagaagggcccccagggcaagccaggcctgcccggcatgcctggcagtgatggccccccaggccaccctgggaaggagggccccccaggcaccaagggcaaccagggccccagcggcccccagggccccctgggctacccaggcccccggggcgtgaagggcgtggatggcatccggggcctgaagggccacaagggggagaagggggaggatggcttccctggcttcaagggggacatcggcgtgaagggggacagaggagaggtgggcgtgcccggcagcagaggagaagatggccctgagggccccaagggccgcacaggccccaccggggaccccggccccccaggcctgatgggagagaagggcaagctgggcgtgcccggcctgcccggctacccaggccggcagggccccaagggcagcctgggcttccctggcttccctggggccagcggggagaagggggcccggggcctgagcggcaagagcggccccagaggagagcggggccccaccggcccccggggccagaggggccccaggggggccaccgggaagagcggggccaagggcaccagcggaggagatggcccccacggccccccaggagagcggggcctgcccggcccccagggccccaacggcttccctggccccaagggccccccaggccccccaggcaaggatggcctgcccggccaccctggccagagaggagaggtgggcttccagggcaagacaggccccccaggccccccaggagtggtgggcccccagggcgctgctggggagaccggccccatgggagagcggggccaccctggccccccaggccccccaggagagcagggcctgcctggaacagctgggaaggagggcaccaagggggaccccggccccccaggggcccctgggaaggatggccctgctggcctgcggggcttccctggagagcggggcctgcctggaacagctgggggccctggcctgaagggaaatgaaggccccagcggccccccaggccctgctggcagccctggagagagaggagctgctggcagcggcggccccatcggccccccaggccggcccggcccccagggccccccaggagctgctggggagaagggcgtgcctggagagaagggccccatcggccccaccggcagagatggagtgcagggccctgtgggcctgcccggccctgctggccccccaggagtggccggggaggatggagacaagggggaggtgggggaccccggccagaagggcaccaagggcaacaagggggagcacggccccccaggccccccaggccccatcggccctgtgggccagcctggagctgctggagcagatggagagcccggggcccggggcccccagggccactttggagccaagggagatgagggcacccggggcttcaatggacctcctggccccatcggcctgcagggcctgcccggccccagcggggagaagggggagactggagatgtgggccccatgggccccccaggccccccaggcccccggggccctgctggccccaatggagcagatggcccccagggccccccaggcggcgtgggcaacctgggccccccaggagagaagggggagcctggagagagcggcagccctggcatccagggcgagcccggggtgaagggccccagaggagagcggggggagaagggggagagcggccagcctggagagcccggccccccaggccccaagggccccactggagatgatggccccaagggcaaccctggccctgtgggcttccctggggaccccggccccccaggagagggcggcccccggggccaggatggagccaagggggacagaggagaagatggagagcccggccagcccggcagccctggccccaccggggagaatggacctcctggccccctgggcaagaggggccctgctggcagccctggcagcgagggccggcagggcggcaaaggagccaagggggaccccggggccatcggggcccctgggaagacaggccctgtgggccctgctggccctgctgggaagccaggcccagatggcctgcggggcctgcccggctctgtgggccagcagggccggcctggggccaccggccaggccggccccccaggccctgtgggccccccaggcctgcccggcctgcggggagatgctggggccaagggggagaagggccaccctggcctcatcggcctgattggccccccaggagagcagggcgagaagggggaccggggcctgcccggcccccagggcagccctggccagaagggggagatgggcatccctggggccagcggccccatcggccctgggggccccccaggcctgcccggccctgctggccccaagggggccaagggggccaccggccctgggggccccaagggggagaagggcgtgcagggccccccaggccaccctggccccccaggagaggtgatccagcccctgcccatccagatgcccaagaagaccaggagatctgtggatggcagccggctgatgcaggaggatgaggccatccccaccggcggggcccctggcagccctgggggcctggaggagatcttcggcagcctggacagcctgcgggaggagattgagcagatgaggcggcccaccggcacccaggacagccctgcccggacctgccaggacctgaagctgtgccaccctgagctgcctgatggagagtactgggtggaccccaaccagggctgtgccagagatgccttccgggtcttctgcaacttcaccgctggaggagagacctgtgtgaccccaagagatgatgtgacccagttctcctatgtggacagcgagggcagccctgtgggcgtggtgcagctgaccttcctgcggctgctgtctgtgtctgcccaccaggatgtgtcctacccctgcagcggggccgccagagatggccccctgcggctgcggggggccaatgaagatgagctgagccctgagaccagcccctacgtgaaggagttcagagatggctgccagacccagcagggccgcacagtgctggaggtgaggacccctgtgctggagcagctgcctgtgctggatgccagcttcagtgacctgggcgcccccccaagaagaggaggagtgctgctgggccctgtgtgcttcatgggctag

SEQ ID NO: 3273 - DNA, 4953 bp, Artificial Sequence
  Description of Artificial Sequence: Synthetic coding sequence
atggagcgctgcagccgctgccaccggctgctgctgctgctgcccctggtgctgggcctgtctgctgcccctggctgggccggggcccctcctgtggatgtgctgcgggccctgcgcttccccagcctgcctgatggagtgcggcgggccaagggcatctgcccagcagatgtggcctacagagtggcccggcctgcccagctgagcgcccccacccggcagctgtttcctgggggcttccccaaggacttcagcctgctgactgtggtgaggacccggcccggcctgcaggcccccctgctgaccctgtacagcgcccagggcgtgcggcagctgggcctggagctgggccggcctgtgcgcttcctgtatgaggaccagacaggccggccccagccccccagccagcctgtgttccggggcctgagcctggctgatggcaagtggcaccgggtggccgtggccgtgaagggccagagcgtgaccctcatcgtggactgcaagaagagggtgacccggcccctgcccaggtctgcccggcctgtgctggacacccacggcgtcatcatctttggagcccgcatcctggatgaggaggtgtttgaaggagatgtgcaggagctggccatcgtgcctggggtgcaggccgcctatgagagctgtgagcagaaggagctggagtgtgagggcggccagcgggagcggccccagaaccagcagccccaccgggcccagaggagcccccagcagcagcccagccggctgcaccggccccagaaccaggagccccagagccaggaccccaccccaggagaggaggaggagatcctggagagcagcctgctgccccccctggaggaggccgcccacggcccccggggcctgaagggggagaagggggagcctgctgtgctggagcccggcatgctggtggagggccccccaggccctgagggccctgctggcctcatcggccccccaggcatccagggcaaccctggccctgtgggggaccctggagagcggggccccccaggccgggccggcctgcccggcagtgatggagcccctggccccccaggcaccagcctgatgctgcccttccgcttcggcagcggcggcggggacaagggccctgtggtggccgcccaggaggcccaggcccaggccatcctgcagcaggcccggctggccctgcggggccccccaggccccatgggctacacaggccggcccggccccctgggccagcccggcagccctggcctgaagggggagagcggggacctgggcccccagggcccccggggcccccagggcctgaccggccccccaggcaaggccggccggcggggccgggccggggctgatggagcccggggcatgcctggggaccccggggtgaagggggaccggggctttgatggcctgcccggcctgcctggagagaagggccacagaggagacaccggggcccagggcctgcccggccccccaggagaagatggagagagaggagatgatggagaaattggcccccggggcctgcctggagagagcggcccccggggcctgctgggccccaagggccccccaggcatccctggccccccaggagtgcggggcatggatggcccccagggccccaagggcagcctgggcccccagggcgagcccggccccccaggccagcagggcaccccaggcacccagggcctgcccggcccccagggcgccatcggcccccatggagagaagggcccccagggcaagccaggcctgcccggcatgcctggcagtgatggccccccaggccaccctgggaaggagggccccccaggcaccaagggcaaccagggccccagcggcccccagggccccctgggctacccaggcccccggggcgtgaagggcgtggatggcatccggggcctgaagggccacaagggggagaagggggaggatggcttccctggcttcaagggggacatcggcgtgaagggggacagaggagaggtgggcgtgcccggcagcagaggagaagatggccctgagggccccaagggccgcacaggccccaccggggaccccggccccccaggcctgatgggagagaagggcaagctgggcgtgcccggcctgcccggctacccaggccggcagggccccaagggcagcctgggcttccctggcttccctggggccagcggggagaagggggcccggggcctgagcggcaagagcggccccagaggagagcggggccccaccggcccccggggccagaggggccccaggggggccaccgggaagagcggggccaagggcaccagcggaggagatggcccccacggccccccaggagagcggggcctgcccggcccccagggccccaacggcttccctggccccaagggccccctgggccccccaggcaaggatggcctgcccggccaccctggccagagaggagaggtgggcttccagggcaagacaggccccccaggccccccaggagtggtgggcccccagggcgctgctggggagaccggccccatgggagagcggggccaccctggccccccaggccccccaggagagcagggcctgcctggaacagctgggaaggagggcaccaagggggaccccggccccccaggggcccctgggaaggatggccctgctggcctgcggggcttccctggagagcggggcctgcctggaacagctgggggccctggcctgaagggaaatgaaggccccagcggccccccaggccctgctggcagccctggagagagaggagctgctggcagcggcggccccatcggccccccaggccggcccggcccccagggccccccaggagctgctggggagaagggcgtgcctggagagaagggccccatcggccccaccggcagagatggagtgcagggccctgtgggcctgcccggccctgctggccccccaggagtggccggggaggatggagacaagggggaggtgggggaccccggccagaagggcaccaagggcaacaagggggagcacggccccccaggccccccaggccccatcggccctgtgggccagcctggagctgctggagcagatggagagcccggggcccggggcccccagggccactttggagccaagggagatgagggcacccggggcttcaatggacctcctggccccatcggcctgcagggcctgcccggccccagcggggagaagggggagactggagatgtgggccccatgggccccccaggccccccaggcccccggggccctgctggccccaatggagcagatggcccccagggccccccaggcggcgtgggcaacctgggccccccaggagagaagggggagcctggagagagcggcagccctggcatccagggcgagcccggggtgaagggccccagaggagagcggggggagaagggggagagcggccagcctggagagcccggccccccaggccccaagggccccactggagatgatggccccaagggcaaccctggccctgtgggcttccctggggaccccggccccccaggagagggcggcccccggggccaggatggagccaagggggacagaggagaagatggagagcccggccagcccggcagccctggccccaccggggagaatggacctcctggccccctgggcaagaggggccctgctggcagccctggcagcgagggccggcagggcggcaaaggagccaagggggaccccggggccatcggggcccctgggaagacaggccctgtgggccctgctggccctgctgggaagccaggcccagatggcctgcggggcctgcccggctctgtgggccagcagggccggcctggggccaccggccaggccggccccccaggccctgtgggccccccaggcctgcccggcctgcggggagatgctggggccaagggggagaagggccaccctggcctcatcggcctgattggccccccaggagagcagggcgagaagggggaccggggcctgcccggcccccagggcagccctggccagaagggggagatgggcatccctggggccagcggccccatcggccctgggggccccccaggcctgcccggccctgctggccccaagggggccaagggggccaccggccctgggggccccaagggggagaagggcgtgcagggccccccaggccaccctggccccccaggagaggtgatccagcccctgcccatccagatgcccaagaagaccaggagatctgtggatggcagccggctgatgcaggaggatgaggccatccccaccggcggggcccctggcagccctgggggcctggaggagatcttcggcagcctggacagcctgcgggaggagattgagcagatgaggcggcccaccggcacccaggacagccctgcccggacctgccaggacctgaagctgtgccaccctgagctgcctgatggagagtactgggtggaccccaaccagggctgtgccagagatgccttccgggtcttctgcaacttcaccgctggaggagagacctgtgtgaccccaagagatgatgtgacccagttctcctatgtggacagcgagggcagccctgtgggcgtggtgcagctgaccttcctgcggctgctgtctgtgtctgcccaccaggatgtgtcctacccctgcagcggggccgccagagatggccccctgcggctgcggggggccaatgaagatgagctgagccctgagaccagcccctacgtgaaggagttcagagatggctgccagacccagcagggccgcacagtgctggaggtgaggacccctgtgctggagcagctgcctgtgctggatgccagcttcagtgacctgggcgcccccccaagaagaggaggagtgctgctgggccctgtgtgcttcatgggctag

SEQ ID NO: 3274 - DNA, 873 bp, Artificial Sequence
  Description of Artificial Sequence: Synthetic coding sequence
atggagcgctgcagccgctgccaccggctgctgctgctgctgcccctggtgctgggcctgtctgctgcccctggctgggccggggcccctcctgtggatgtgctgcgggccctgcgcttccccagcctgcctgatggagtgcggcgggccaagggcatctgcccagcagatgtggcctacagagtggcccggcctgcccagctgagcgcccccacccggcagctgtttcctgggggcttccccaaggacttcagcctgctgactgtggtgaggacccggcccggcctgcaggcccccctgctgaccctgtacagcgcccagggcgtgcggcagctgggcctggagctgggccggcctgtgcgcttcctgtatgaggaccagacaggccggccccagccccccagccagcctgtgttccggggcctgagcctggctgatggcaagtggcaccgggtggccgtggccgtgaagggccagagcgtgaccctcatcgtggactgcaagaagagggtgacccggcccctgcccaggtctgcccggcctgtgctggacacccacggcgtcatcatctttggagcccgcatcctggatgaggaggtgtttgaaggagatgtgcaggagctggccatcgtgcctggggtgcaggccgcctatgagagctgtgagcagaaggagctggagtgtgagggcggccagcgggagcggccccagaaccagcagccccaccgggcccagaggagcccccagcagcagcccagccggctgcaccggccccagaaccaggagccccagagccaggtgcgggagctgggggagcccccatctgctgcccacccccgggagggccgccaccctggcatcagccccccatag

SEQ ID NO: 3275 - DNA, 4953 bp, Artificial Sequence; identical to SEQ ID NO: 3269
  Description of Artificial Sequence: Synthetic coding sequence

SEQ ID NO: 3276 - DNA, 873 bp, Artificial Sequence; identical to SEQ ID NO: 3274
  Description of Artificial Sequence: Synthetic coding sequence

SEQ ID NO: 3277 - DNA, 921 bp, Artificial Sequence
  Description of Artificial Sequence: Synthetic coding sequence
atggactggagggccagcgaggcctggatggtgccccgggcccccaagggggcctgggacccccgggagagccaggacctgctggacaacagagcccccctgggccccagggtcttccctggcccccgggtgcccagcgccctgatggagaggagagtgctgaagggcagccagggcagccctgcctgccccggccccccaggagaggtgatccagcccctgcccatccagatgcccaagaagaccaggagatctgtggatggcagccggctgatgcaggaggatgaggccatccccaccggcggggcccctggcagccctgggggcctggaggagatcttcggcagcctggacagcctgcgggaggagattgagcagatgaggcggcccaccggcacccaggacagccctgcccggacctgccaggacctgaagctgtgccaccctgagctgcctgatggagagtactgggtggaccccaaccagggctgtgccagagatgccttccgggtcttctgcaacttcaccgctggaggagagacctgtgtgaccccaagagatgatgtgacccagttctcctatgtggacagcgagggcagccctgtgggcgtggtgcagctgaccttcctgcggctgctgtctgtgtctgcccaccaggatgtgtcctacccctgcagcggggccgccagagatggccccctgcggctgcggggggccaatgaagatgagctgagccctgagaccagcccctacgtgaaggagttcagagatggctgccagacccagcagggccgcacagtgctggaggtgaggacccctgtgctggagcagctgcctgtgctggatgccagcttcagtgacctgggcgcccccccaagaagaggaggagtgctgctgggccctgtgtgcttcatgggctag

SEQ ID NO: 3278 - DNA, 5031 bp, Artificial Sequence
  Description of Artificial Sequence: Synthetic coding sequence
atggagcgctgcagccgctgccaccggctgctgctgctgctgcccctggtgctgggcctgtctgctgcccctggctgggccggggcccctcctgtggatgtgctgcgggccctgcgcttccccagcctgcctgatggagtgcggcgggccaagggcatctgcccagcagatgtggcctacagagtggcccggcctgcccagctgagcgcccccacccggcagctgtttcctgggggcttccccaaggacttcagcctgctgactgtggtgaggacccggcccggcctgcaggcccccctgctgaccctgtacagcgcccagggcgtgcggcagctgggcctggagctgggccggcctgtgcgcttcctgtatgaggaccagacaggccggccccagccccccagccagcctgtgttccggggcctgagcctggctgatggcaagtggcaccgggtggccgtggccgtgaagggccagagcgtgaccctcatcgtggactgcaagaagagggtgacccggcccctgcccaggtctgcccggcctgtgctggacacccacggcgtcatcatctttggagcccgcatcctggatgaggaggtgtttgaaggagatgtgcaggagctggccatcgtgcctggggtgcaggccgcctatgagagctgtgagcagaaggagctggagtgtgagggcggccagcgggagcggccccagaaccagcagccccaccgggcccagaggagcccccagcagcagcccagccggctgcaccggccccagaaccaggagccccagagccagcccacagagagcctgtactatgactatgagcccccctactatgatgtgatgaccaccggcaccaccccagactaccaggaccccaccccaggagaggaggaggagatcctggagagcagcctgctgccccccctggaggaggccgcccacggcccccggggcctgaagggggagaagggggagcctgctgtgctggagcccggcatgctggtggagggccccccaggccctgagggccctgctggcctcatcggccccccaggcatccagggcaaccctggccctgtgggggaccctggagagcggggccccccaggccgggccggcctgcccggcagtgatggagcccctggccccccaggcaccagcctgatgctgcccttccgcttcggcagcggcggcggggacaagggccctgtggtggccgcccaggaggcccaggcccaggccatcctgcagcaggcccggctggccctgcggggccccccaggccccatgggctacacaggccggcccggccccctgggccagcccggcagccctggcctgaagggggagagcggggacctgggcccccagggcccccggggcccccagggcctgaccggccccccaggcaaggccggccggcggggccgggccggggctgatggagcccggggcatgcctggggaccccggggtgaagggggaccggggctttgatggcctgcccggcctgcctggagagaagggccacagaggagacaccggggcccagggcctgcccggccccccaggagaagatggagagagaggagatgatggagaaattggcccccggggcctgcctggagagagcggcccccggggcctgctgggccccaagggccccccaggcatccctggccccccaggagtgcggggcatggatggcccccagggccccaagggcagcctgggcccccagggcgagcccggccccccaggccagcagggcaccccaggcacccagggcctgcccggcccccagggcgccatcggcccccatggagagaagggcccccagggcaagccaggcctgcccggcatgcctggcagtgatggccccccaggccaccctgggaaggagggccccccaggcaccaagggcaaccagggccccagcggcccccagggccccctgggctacccaggcccccggggcgtgaagggcgtggatggcatccggggcctgaagggccacaagggggagaagggggaggatggcttccctggcttcaagggggacatcggcgtgaagggggacagaggagaggtgggcgtgcccggcagcagaggagaagatggccctgagggccccaagggccgcacaggccccaccggggaccccggccccccaggcctgatgggagagaagggcaagctgggcgtgcccggcctgcccggctacccaggccggcagggccccaagggcagcctgggcttccctggcttccctggggccagcggggagaagggggcccggggcctgagcggcaagagcggccccagaggagagcggggccccaccggcccccggggccagaggggccccaggggggccaccgggaagagcggggccaagggcaccagcggaggagatggcccccacggccccccaggagagcggggcctgcccggcccccagggccccaacggcttccctggccccaagggccccccaggccccccaggcaaggatggcctgcccggccaccctggccagagaggagaggtgggcttccagggcaagacaggccccccaggccccccaggagtggtgggcccccagggcgctgctggggagaccggccccatgggagagcggggccaccctggccccccaggccccccaggagagcagggcctgcctggaacagctgggaaggagggcaccaagggggaccccggccccccaggggcccctgggaaggatggccctgctggcctgcggggcttccctggagagcggggcctgcctggaacagctgggggccctggcctgaagggaaatgaaggccccagcggccccccaggccctgctggcagccctggagagagaggagctgctggcagcggcggccccatcggccccccaggccggcccggcccccagggccccccaggagctgctggggagaagggcgtgcctggagagaagggccccatcggccccaccggcagagatggagtgcagggccctgtgggcctgcccggccctgctggccccccaggagtggccggggaggatggagacaagggggaggtgggggaccccggccagaagggcaccaagggcaacaagggggagcacggccccccaggccccccaggccccatcggccctgtgggccagcctggagctgctggagcagatggagagcccggggcccggggcccccagggccactttggagccaagggagatgagggcacccggggcttcaatggacctcctggccccatcggcctgcagggcctgcccggccccagcggggagaagggggagactggagatgtgggccccatgggccccccaggccccccaggcccccggggccctgctggccccaatggagcagatggcccccagggccccccaggcggcgtgggcaacctgggccccccaggagagaagggggagcctggagagagcggcagccctggcatccagggcgagcccggggtgaagggccccagaggagagcggggggagaagggggagagcggccagcctggagagcccggccccccaggccccaagggccccactggagatgatggccccaagggcaaccctggccctgtgggcttccctggggaccccggccccccaggagagggcggcccccggggccaggatggagccaagggggacagaggagaagatggagagcccggccagcccggcagccctggccccaccggggagaatggacctcctggccccctgggcaagaggggccctgctggcagccctggcagcgagggccggcagggcggcaaaggagccaagggggaccccggggccatcggggcccctgggaagacaggccctgtgggccctgctggccctgctgggaagccaggcccagatggcctgcggggcctgcccggctctgtgggccagcagggccggcctggggccaccggccaggccggccccccaggccctgtgggccccccaggcctgcccggcctgcggggagatgctggggccaagggggagaagggccaccctggcctcatcggcctgattggccccccaggagagcagggcgagaagggggaccggggcctgcccggcccccagggcagccctggccagaagggggagatgggcatccctggggccagcggccccatcggccctgggggccccccaggcctgcccggccctgctggccccaagggggccaagggggccaccggccctgggggccccaagggggagaagggcgtgcagggccccccaggccaccctggccccccaggagaggtgatccagcccctgcccatccagatgcccaagaagaccaggagatctgtggatggcagccggctgatgcaggaggatgaggccatccccaccggcggggcccctggcagccctgggggcctggaggagatcttcggcagcctggacagcctgcgggaggagattgagcagatgaggcggcccaccggcacccaggacagccctgcccggacctgccaggacctgaagctgtgccaccctgagctgcctgatggagagtactgggtggaccccaaccagggctgtgccagagatgccttccgggtcttctgcaacttcaccgctggaggagagacctgtgtgaccccaagagatgatgtgacccagttctcctatgtggacagcgagggcagccctgtgggcgtggtgcagctgaccttcctgcggctgctgtctgtgtctgcccaccaggatgtgtcctacccctgcagcggggccgccagagatggccccctgcggctgcggggggccaatgaagatgagctgagccctgagaccagcccctacgtgaaggagttcagagatggctgccagacccagcagggccgcacagtgctggaggtgaggacccctgtgctggagcagctgcctgtgctggatgccagcttcagtgacctgggcgcccccccaagaagaggaggagtgctgctgggccctgtgtgcttcatgggctag

SEQ ID NO: 3279 - DNA, 1875 bp, Artificial Sequence
  Description of Artificial Sequence: Synthetic coding sequence
atggagcgctgcagccgctgccaccggctgctgctgctgctgcccctggtgctgggcctgtctgctgcccctggctgggccggggcccctcctgtggatgtgctgcgggccctgcgcttccccagcctgcctgatggagtgcggcgggccaagggcatctgcccagcagatgtggcctacagagtggcccggcctgcccagctgagcgcccccacccggcagctgtttcctgggggcttccccaaggacttcagcctgctgactgtggtgaggacccggcccggcctgcaggcccccctgctgaccctgtacagcgcccagggcgtgcggcagctgggcctggagctgggccggcctgtgcgcttcctgtatgaggaccagacaggccggccccagccccccagccagcctgtgttccggggcctgagcctggctgatggcaagtggcaccgggtggccgtggccgtgaagggccagagcgtgaccctcatcgtggactgcaagaagagggtgacccggcccctgcccaggtctgcccggcctgtgctggacacccacggcgtcatcatctttggagcccgcatcctggatgaggaggtgtttgaaggagatgtgcaggagctggccatcgtgcctggggtgcaggccgcctatgagagctgtgagcagaaggagctggagtgtgagggcggccagcgggagcggccccagaaccagcagccccaccgggcccagaggagcccccagcagcagcccagccggctgcaccggccccagaaccaggagccccagagccagcccacagagagcctgtactatgactacaagccaccctactatgatgtgatgaccaccggcaccaccccagactaccaggaccccaccccaggagaggaggaggagatcctggagagcagcctgctgccccccctggaggaggagcagacagacctgcaggtgcccccaacagctgaccgcttccaggccgaggagtatggagagggcggcacagatcctcctgagggcccctatgactacacctacggctatggagatgactaccgggaggagacagagctgggccctgccctgtctgctgagacagcccacagcggggccgccgcccacggcccccggggcctgaagggggagaagggggagcctgctgtgctggagcccggcatgctggtggagggccccccaggccctgagggccctgctggcctcatcggccccccaggcatccagggcaaccctggccctgtgggggaccctggagagcggggccccccaggccgggccggcctgcccggcagtgatggagcccctggccccccaggcaccagcctgatgctgcccttccgcttcggcagcggcggcggggacaagggccctgtggtggccgcccaggaggcccaggcccaggccatcctgcagcaggcccggctggccctgcggggccccccaggccccatgggctacacaggccggcccggccccctgggccagcccggcagccctggcctgaagggggagagcggggacctgggcccccagggcccccggggcccccagggcctgaccggccccccaggcaaggccggccggcggggccgggccggggctgatggagcccggggcatgcctggggaccccggggtgaagggggaccggggctttgatggcctgcccggcctgcctggagagaagggccacagaggagacaccggggcccagggcctgcccggccccccaggagaagatggagagagaggagatgatggagaaattggcccccggggcctgcctggagagagcggcccccggggcctgctgggccccaagggccccccaggcatccctggccccccatag

SEQ ID NO: 3280 - DNA, 4953 bp, Artificial Sequence
  Description of Artificial Sequence: Synthetic coding sequence
atggagcgctgcagccgctgccaccggctgctgctgctgctgcccctggtgctgggcctgtctgctgcccctggctgggccggggcccctcctgtggatgtgctgcgggccctgcgcttccccagcctgcctgatggagtgcggcgggccaagggcatctgcccagcagatgtggcctacagagtggcccggcctgcccagctgagcgcccccacccggcagctgtttcctgggggcttccccaaggacttcagcctgctgactgtggtgaggacccggcccggcctgcaggcccccctgctgaccctgtacagcgcccagggcgtgcggcagctgggcctggagctgggcccccctgtgcgcttcctgtatgaggaccagacaggccggccccagccccccagccagcctgtgttccggggcctgagcctggctgatggcaagtggcaccgggtggccgtggccgtgaagggccagagcgtgaccctcatcgtggactgcaagaagagggtgacccggcccctgcccaggtctgcccggcctgtgctggacacccacggcgtcatcatctttggagcccgcatcctggatgaggaggtgtttgaaggagatgtgcaggagctggccatcgtgcctggggtgcaggccgcctatgagagctgtgagcagaaggagctggagtgtgagggcggccagcgggagcggccccagaaccagcagccccaccgggcccagaggagcccccagcagcagcccagccggctgcaccggccccagaaccaggagccccagagccaggaccccaccccaggagaggaggaggagatcctggagagcagcctgctgccccccctggaggaggccgcccacggcccccggggcctgaagggggagaagggggagcctgctgtgctggagcccggcatgctggtggagggccccccaggccctgagggccctgctggcctcatcggccccccaggcatccagggcaaccctggccctgtgggggaccctggagagcggggccccccaggccgggccggcctgcccggcagtgatggagcccctggccccccaggcaccagcctgatgctgcccttccgcttcggcagcggcggcggggacaagggccctgtggtggccgcccaggaggcccaggcccaggccatcctgcagcaggcccggctggccctgcggggccccccaggccccatgggctacacaggccggcccggccccctgggccagcccggcagccctggcctgaagggggagagcggggacctgggcccccagggcccccggggcccccagggcctgaccggccccccaggcaaggccggccggcggggccgggccggggctgatggagcccggggcatgcctggggaccccggggtgaagggggaccggggctttgatggcctgcccggcctgcctggagagaagggccacagaggagacaccggggcccagggcctgcccggccccccaggagaagatggagagagaggagatgatggagaaattggcccccggggcctgcctggagagagcggcccccggggcctgctgggccccaagggccccccaggcatccctggccccccaggagtgcggggcatggatggcccccagggccccaagggcagcctgggcccccagggcgagcccggccccccaggccagcagggcaccccaggcacccagggcctgcccggcccccagggcgccatcggcccccatggagagaagggcccccagggcaagccaggcctgcccggcatgcctggcagtgatggccccccaggccaccctgggaaggagggccccccaggcaccaagggcaaccagggccccagcggcccccagggccccctgggctacccaggcccccggggcgtgaagggcgtggatggcatccggggcctgaagggccacaagggggagaagggggaggatggcttccctggcttcaagggggacatcggcgtgaagggggacagaggagaggtgggcgtgcccggcagcagaggagaagatggccctgagggccccaagggccgcacaggccccaccggggaccccggccccccaggcctgatgggagagaagggcaagctgggcgtgcccggcctgcccggctacccaggccggcagggccccaagggcagcctgggcttccctggcttccctggggccagcggggagaagggggcccggggcctgagcggcaagagcggccccagaggagagcggggccccaccggcccccggggccagaggggccccaggggggccaccgggaagagcggggccaagggcaccagcggaggagatggcccccacggccccccaggagagcggggcctgcccggcccccagggccccaacggcttccctggccccaagggccccccaggccccccaggcaaggatggcctgcccggccaccctggccagagaggagaggtgggcttccagggcaagacaggccccccaggccccccaggagtggtgggcccccagggcgctgctggggagaccggccccatgggagagcggggccaccctggccccccaggccccccaggagagcagggcctgcctggaacagctgggaaggagggcaccaagggggaccccggccccccaggggcccctgggaaggatggccctgctggcctgcggggcttccctggagagcggggcctgcctggaacagctgggggccctggcctgaagggaaatgaaggccccagcggccccccaggccctgctggcagccctggagagagaggagctgctggcagcggcggccccatcggccccccaggccggcccggcccccagggccccccaggagctgctggggagaagggcgtgcctggagagaagggccccatcggccccaccggcagagatggagtgcagggccctgtgggcctgcccggccctgctggccccccaggagtggccggggaggatggagacaagggggaggtgggggaccccggccagaagggcaccaagggcaacaagggggagcacggccccccaggccccccaggccccatcggccctgtgggccagcctggagctgctggagcagatggagagcccggggcccggggcccccagggccactttggagccaagggagatgagggcacccggggcttcaatggacctcctggccccatcggcctgcagggcctgcccggccccagcggggagaagggggagactggagatgtgggccccatgggccccccaggccccccaggcccccggggccctgctggccccaatggagcagatggcccccagggccccccaggcggcgtgggcaacctgggccccccaggagagaagggggagcctggagagagcggcagccctggcatccagggcgagcccggggtgaagggccccagaggagagcggggggagaagggggagagcggccagcctggagagcccggccccccaggccccaagggccccactggagatgatggccccaagggcaaccctggccctgtgggcttccctggggaccccggccccccaggagagggcggcccccggggccaggatggagccaagggggacagaggagaagatggagagcccggccagcccggcagccctggccccaccggggagaatggacctcctggccccctgggcaagaggggccctgctggcagccctggcagcgagggccggcagggcggcaaaggagccaagggggaccccggggccatcggggcccctgggaagacaggccctgtgggccctgctggccctgctgggaagccaggcccagatggcctgcggggcctgcccggctctgtgggccagcagggccggcctggggccaccggccaggccggccccccaggccctgtgggccccccaggcctgcccggcctgcggggagatgctggggccaagggggagaagggccaccctggcctcatcggcctgattggccccccaggagagcagggcgagaagggggaccggggcctgcccggcccccagggcagccctggccagaagggggagatgggcatccctggggccagcggccccatcggccctgggggccccccaggcctgcccggccctgctggccccaagggggccaagggggccaccggccctgggggccccaagggggagaagggcgtgcagggccccccaggccaccctggccccccaggagaggtgatccagcccctgcccatccagatgcccaagaagaccaggagatctgtggatggcagccggctgatgcaggaggatgaggccatccccaccggcggggcccctggcagccctgggggcctggaggagatcttcggcagcctggacagcctgcgggaggagattgagcagatgaggcggcccaccggcacccaggacagccctgcccggacctgccaggacctgaagctgtgccaccctgagctgcctgatggagagtactgggtggaccccaaccagggctgtgccagagatgccttccgggtcttctgcaacttcaccgctggaggagagacctgtgtgaccccaagagatgatgtgacccagttctcctatgtggacagcgagggcagccctgtgggcgtggtgcagctgaccttcctgcggctgctgtctgtgtctgcccaccaggatgtgtcctacccctgcagcggggccgccagagatggccccctgcggctgcggggggccaatgaagatgagctgagccctgagaccagcccctacgtgaaggagttcagagatggctgccagacccagcagggccgcacagtgctggaggtgaggacccctgtgctggagcagctgcctgtgctggatgccagcttcagtgacctgggcgcccccccaagaagaggaggagtgctgctgggccctgtgtgcttcatgggctag

SEQ ID NO: 3281 - DNA, 1002 bp, Artificial Sequence
  Description of Artificial Sequence: Synthetic coding sequence
tgaaaccagagcccccaggcccacaggagcacagtgccccacacagctggcctgggccagctgtgcctgctgggcttcggcatggactggagggccagcgaggcctggatggtgccccgggcccccaagggggcctgggacccccgggagagccaggacctgctggacaacagagcccccctgggccccagggtcttccctggcccccgggtgcccagcgccctgatggagcggcgggtgctgaagggcagccagggcagccctgcctgcctgggccccccaggagaggtgatccagcccctgcccatccagatgcccaagaagacccggcgctctgtggatggcagccggctgatgcaggaggatgaggccatccccactggaggagcccctggcagccctgggggcctggaggagatcttcggcagcctggacagcctgcgggaggagattgagcagatgagaagacccaccggcacccaggacagccctgcccggacctgccaggacctgaagctgtgccaccctgagctgcctgatggagagtactgggtggaccccaaccagggctgtgccagagatgccttccgggtcttctgcaacttcaccgctggaggagagacctgtgtgaccccaagagatgatgtgacccagttctcctatgtggacagcgagggcagccctgtgggcgtggtgcagctgaccttcctgcggctgctgtctgtgtctgcccaccaggatgtgtcctacccctgcagcggggccgccagagatggccccctgcggctgcggggggccaatgaagatgagctgagccctgagaccagcccctacgtgaaggagttcagagatggctgccagacccagcagggccgcacagtgctggaggtgaggacccctgtgctggagcagctgcctgtgctggatgccagcttcagtgacctgggcgccccaccccggcggggcggcgtgctgctgggccctgtgtgcttcatgggctag

SEQ ID NO: 3282 - DNA, 792 bp, Artificial Sequence
  Description of Artificial Sequence: Synthetic coding sequence
tgagcccctcctgtggatgtgctgcgggccctgcgcttccccagcctgcctgatggagtgagaagagccaagggcatctgcccagcagatgtggcctacagagtggcccggcctgcccagctgagcgcccccacccggcagctgtttcctgggggcttccccaaggacttcagcctgctgactgtggtgaggaccaggcctggcctgcaggcccccctgctgaccctgtacagcgcccagggcgtgcggcagctgggcctggagctgggccggcctgtgcgcttcctgtatgaggaccagacaggccggccccagccccccagccagcccgtcttccggggcctgagcctggctgatggcaagtggcaccgggtggccgtggccgtgaagggccagagcgtgaccctgattgtggactgcaagaagagggtgacccggcccctgcccaggtctgcccggcctgtgctggacacccatggagtcatcatctttggagcccgcatcctggatgaggaggtgtttgaaggagatgtgcaggagctggccatcgtgcctggggtgcaggccgcctatgagagctgtgagcagaaggagctggagtgtgagggcggccagcgggagcggccccagaaccagcagccccaccgggcccagaggagcccccagcagcagcccagccggctgcaccggccccagaaccaggagccccagagccaggtgcgggagctgggggagccccccagcgctgcccacccccgggagggccgccaccctggcatcagccccccatag

SEQ ID NO: 3283 - DNA, 873 bp, Artificial Sequence
  Description of Artificial Sequence: Synthetic coding sequence
atggagcgctgcagccgctgccaccggctgctgctgctgctgcccctggtgctgggcctgtctgctgcccctggctgggccggggcccctcctgtggatgtgctgcgggccctgcgcttccccagcctgcctgatggagtgcggcgggccaagggcatctgcccagcagatgtggcctacagagtggcccggcctgcccagctgagcgcccccacccggcagctgtttcctgggggcttccccaaggacttcagcctgctgactgtggtgaggacccggcccggcctgcaggcccccctgctgaccctgtacagcgcccagggcgtgcggcagctgggcctggagctgggcccccctgtgcgcttcctgtatgaggaccagacaggccggccccagccccccagccagcctgtgttccggggcctgagcctggctgatggcaagtggcaccgggtggccgtggccgtgaagggccagagcgtgaccctcatcgtggactgcaagaagagggtgacccggcccctgcccaggtctgcccggcctgtgctggacacccacggcgtcatcatctttggagcccgcatcctggatgaggaggtgtttgaaggagatgtgcaggagctggccatcgtgcctggggtgcaggccgcctatgagagctgtgagcagaaggagctggagtgtgagggcggccagcgggagcggccccagaaccagcagccccaccgggcccagaggagcccccagcagcagcccagccggctgcaccggccccagaaccaggagccccagagccaggtgcgggagctgggggagcccccatctgctgcccacccccgggagggccgccaccctggcatcagccccccatag

SEQ ID NO: 3284 - DNA, 1875 bp, Artificial Sequence
  Description of Artificial Sequence: Synthetic coding sequence
atggagcgctgcagccgctgccaccggctgctgctgctgctgcccctggtgctgggcctgtctgctgcccctggctgggccggggcccctcctgtggatgtgctgcgggccctgcgcttccccagcctgcctgatggagtgcggcgggccaagggcatctgcccagcagatgtggcctacagagtggcccggcctgcccagctgagcgcccccacccggcagctgtttcctgggggcttccccaaggacttcagcctgctgactgtggtgaggacccggcccggcctgcaggcccccctgctgaccctgtacagcgcccagggcgtgcggcagctgggcctggagctgggccggcctgtgcgcttcctgtatgaggaccagacaggccggccccagccccccagccagcctgtgttccggggcctgagcctggctgatggcaagtggcaccgggtggccgtggccgtgaagggccagagcgtgaccctcatcgtggactgcaagaagagggtgacccggcccctgcccaggtctgcccggcctgtgctggacacccacggcgtcatcatctttggagcccgcatcctggatgaggaggtgtttgaaggagatgtgcaggagctggccatcgtgcctggggtgcaggccgcctatgagagctgtgagcagaaggagctggagtgtgagggcggccagcgggagcggccccagaaccagcagccccaccgggcccagaggagcccccagcagcagcccagccggctgcaccggccccagaaccaggagccccagagccagcccacagagagcctgtactatgactatgagcccccctactatgatgtgatgaccaccggcaccaccccagactaccaggaccccaccccaggagaggaggaggagatcctggagagcagcctgctgccccccctggaggaggagcagacagacctgcaggtgcccccaacagctgaccgcttccaggccgaggagtatggagagggcggcacagatcctcctgagggcccctatgactacacctacggctatggagatgactaccgggaggagacagagctgggccctgccctgtctgctgagacagcccacagcggggccgccgcccacggcccccggggcctgaagggggagaagggggagcctgctgtgctggagcccggcatgctggtggagggccccccaggccctgagggccctgctggcctcatcggccccccaggcatccagggcaaccctggccctgtgggggaccctggagagcggggccccccaggccgggccggcctgcccggcagtgatggagcccctggccccccaggcaccagcctgatgctgcccttccgcttcggcagcggcggcggggacaagggccctgtggtggccgcccaggaggcccaggcccaggccatcctgcagcaggcccggctggccctgcggggccccccaggccccatgggctacacaggccggcccggccccctgggccagcccggcagccctggcctgaagggggagagcggggacctgggcccccagggcccccggggcccccagggcctgaccggccccccaggcaaggccggccggcggggccgggccggggctgatggagcccggggcatgcctggggaccccggggtgaagggggaccggggctttgatggcctgcccggcctgcctggagagaagggccacagaggagacaccggggcccagggcctgcccggccccccaggagaagatggagagagaggagatgatggagaaattggcccccggggcctgcctggagagagcggcccccggggcctgctgggccccaagggccccccaggcatccctggccccccatag

SEQ ID NO: 3285 - DNA, 873 bp, Artificial Sequence; identical to SEQ ID NO: 3274
  Description of Artificial Sequence: Synthetic coding sequence

SEQ ID NO: 3286 - DNA, 1002 bp, Artificial Sequence; identical to SEQ ID NO: 3281
  Description of Artificial Sequence: Synthetic coding sequence

SEQ ID NO: 3287 - DNA, 4872 bp, Artificial Sequence
  Description of Artificial Sequence: Synthetic coding sequence
tgagcccctcctgtggatgtgctgcgggccctgcgcttccccagcctgcctgatggagtgagaagagccaagggcatctgcccagcagatgtggcctacagagtggcccggcctgcccagctgagcgcccccacccggcagctgtttcctgggggcttccccaaggacttcagcctgctgactgtggtgaggaccaggcctggcctgcaggcccccctgctgaccctgtacagcgcccagggcgtgcggcagctgggcctggagctgggccggcctgtgcgcttcctgtatgaggaccagacaggccggccccagccccccagccagcccgtcttccggggcctgagcctggctgatggcaagtggcaccgggtggccgtggccgtgaagggccagagcgtgaccctgattgtggactgcaagaagagggtgacccggcccctgcccaggtctgcccggcctgtgctggacacccatggagtcatcatctttggagcccgcatcctggatgaggaggtgtttgaaggagatgtgcaggagctggccatcgtgcctggggtgcaggccgcctatgagagctgtgagcagaaggagctggagtgtgagggcggccagcgggagcggccccagaaccagcagccccaccgggcccagaggagcccccagcagcagcccagccggctgcaccggccccagaaccaggagccccagagccaggaccccaccccaggagaggaggaggagatcctggagagcagcctgctgccccccctggaggaggccgcccacggcccccggggcctgaagggggagaagggggagcctgctgtgctggagcccggcatgctggtggagggccccccaggccctgagggccctgctggcctgattggccccccaggcatccagggcaaccctggccctgtgggggaccccggggagcggggccccccaggccgggccggcctgcccggcagtgatggagcccctggccccccaggcaccagcctgatgctgcccttccgctttggaagtggcggcggggacaagggccctgtggtggccgcccaggaggcccaggcccaggccatcctgcagcaggcccggctggccctgcggggccccccaggccccatgggctacacaggccggcccggccccctgggccagcccggcagccctggcctgaagggggagagcggggacctgggcccccagggcccccggggcccccagggcctgactggacctcctgggaaggccggcagaagaggccgggccggggctgatggagcccggggcatgcctggggaccccggggtgaagggggaccggggctttgatggcctgcccggcctgcccggggagaagggccacagaggagacacaggagcccagggcctgcccggccccccaggagaagatggagagagaggagatgatggagagatcggcccccggggcctgcccggggagagcggcccccggggcctgctgggccccaagggccccccaggcatccctggccccccaggagtgcggggcatggatggcccccagggccccaagggcagcctgggcccccagggcgagcccggccccccaggccagcagggcaccccaggcacccagggcctgcccggcccccagggcgccatcggcccccacggggagaagggcccccagggcaagccaggcctgcccggcatgcctggcagtgatggccccccaggccaccctgggaaggagggccccccaggcaccaagggcaaccagggccccagcggcccccagggccccctgggctacccaggcccccggggcgtgaagggcgtggatggcatccggggcctgaagggccacaagggggagaagggagaagatggcttccctggcttcaagggggacattggagtgaagggggacagaggagaggtgggcgtgcccggcagcagaggagaagatggccctgagggccccaagggccgcacaggccccactggagaccccggccccccaggcctgatgggagagaagggcaagctgggcgtgcccggcctgcccggctacccaggccggcagggccccaagggcagcctgggcttccctggcttccctggggccagcggggagaagggggcccggggcctgagcggcaagagcggccccagaggagagcggggccccaccggcccccggggccagaggggccccaggggggccaccgggaagagcggggccaagggcaccagcggaggagatggcccccacggccccccaggagagcggggcctgcccggcccccagggccccaacggcttccctggccccaagggccccccaggccccccaggcaaggatggcctgcccggccaccctggccagagaggagaggtgggcttccagggcaagacaggccccccaggccccccaggagtggtgggcccccagggcgccgccggggagaccggccccatgggagagcggggccaccctggccccccaggccccccaggagagcagggcctgcccggcacagctgggaaggagggcaccaagggggaccccggccccccaggggcccctgggaaggatggccctgctggcctgcggggcttccctggagagcggggcctgcccggcacagctgggggccctggcctgaagggaaatgaaggccccagcggccccccaggccctgctggcagccctggagagagaggagctgctggcagcggcggccccatcggccccccaggccggcccggcccccagggccccccaggagctgctggggagaagggcgtgcctggagagaagggccccatcggccccaccggcagagatggagtgcagggccctgtgggcctgcccggccctgctggccccccaggagtggccggagaagatggagacaagggggaggtgggggaccccggccagaagggcaccaagggcaacaagggggagcacggccccccaggccccccaggccccatcggccctgtgggccagcccggggctgctggagcagatggagagcccggggcccggggcccccagggccactttggagccaagggagatgagggcacccggggcttcaacggccccccaggccccatcggcctgcagggcctgcccggccccagcggggagaagggggagactggagatgtgggccccatgggccccccaggccccccaggcccccggggccctgctggccccaacggggctgatggcccccagggccccccaggaggagtgggcaacctgggccccccaggagagaagggggagcccggggagagcggcagccctggcatccagggcgagcccggggtgaagggccccagaggagagcggggggagaagggggagagcggccagcccggggagcccggccccccaggccccaagggccccactggagatgatggccccaagggcaaccctggccctgtgggcttccctggggaccccggccccccaggagagggcggcccccggggccaggatggagccaagggggacagaggagaagatggagagcccggccagcccggcagccctggccccactggagaaaatggccccccaggccccctgggcaagaggggccctgctggcagccctggcagcgagggccggcagggcggcaagggggccaagggggaccccggggccatcggggcccctgggaagacaggccctgtgggccctgctggccctgctgggaagccaggcccagatggcctgcggggcctgcccggctctgtgggccagcagggccggcctggggccaccggccaggccggccccccaggccctgtgggccccccaggcctgcccggcctgcggggagatgctggggccaagggggagaagggccaccctggcctgattggcctcatcggccccccaggagagcagggcgagaagggggaccggggcctgcccggcccccagggcagccctggccagaagggggagatgggcatccctggggccagcggccccatcggccctgggggccccccaggcctgcccggccctgctggccccaagggggccaagggggccactggacctgggggccccaagggggagaagggcgtgcagggccccccaggccaccctggccccccaggagaggtgatccagcccctgcccatccagatgcccaagaagacccggcgctctgtggatggcagccggctgatgcaggaggatgaggccatccccactggaggagcccctggcagccctgggggcctggaggagatcttcggcagcctggacagcctgcgggaggagattgagcagatgagaagacccaccggcacccaggacagccctgcccggacctgccaggacctgaagctgtgccaccctgagctgcctgatggagagtactgggtggaccccaaccagggctgtgccagagatgccttccgggtcttctgcaacttcaccgctggaggagagacctgtgtgaccccaagagatgatgtgacccagttctcctatgtggacagcgagggcagccctgtgggcgtggtgcagctgaccttcctgcggctgctgtctgtgtctgcccaccaggatgtgtcctacccctgcagcggggccgccagagatggccccctgcggctgcggggggccaatgaagatgagctgagccctgagaccagcccctacgtgaaggagttcagagatggctgccagacccagcagggccgcacagtgctggaggtgaggacccctgtgctggagcagctgcctgtgctggatgccagcttcagtgacctgggcgccccaccccggcggggcggcgtgctgctgggccctgtgtgcttcatgggctag

SEQ ID NO: 3288 - DNA, 4953 bp, Artificial Sequence; identical to SEQ ID NO: 3269
  Description of Artificial Sequence: Synthetic coding sequence

SEQ ID NO: 3289 - DNA, 873 bp, Artificial Sequence; identical to SEQ ID NO: 3274
  Description of Artificial Sequence: Synthetic coding sequence

SEQ ID NO: 3290 - DNA, 1794 bp, Artificial Sequence
  Description of Artificial Sequence: Synthetic coding sequence
tgagcccctcctgtggatgtgctgcgggccctgcgcttccccagcctgcctgatggagtgagaagagccaagggcatctgcccagcagatgtggcctacagagtggcccggcctgcccagctgagcgcccccacccggcagctgtttcctgggggcttccccaaggacttcagcctgctgactgtggtgaggaccaggcctggcctgcaggcccccctgctgaccctgtacagcgcccagggcgtgcggcagctgggcctggagctgggccggcctgtgcgcttcctgtatgaggaccagacaggccggccccagccccccagccagcccgtcttccggggcctgagcctggctgatggcaagtggcaccgggtggccgtggccgtgaagggccagagcgtgaccctgattgtggactgcaagaagagggtgacccggcccctgcccaggtctgcccggcctgtgctggacacccatggagtcatcatctttggagcccgcatcctggatgaggaggtgtttgaaggagatgtgcaggagctggccatcgtgcctggggtgcaggccgcctatgagagctgtgagcagaaggagctggagtgtgagggcggccagcgggagcggccccagaaccagcagccccaccgggcccagaggagcccccagcagcagcccagccggctgcaccggccccagaaccaggagccccagagccagcccacagagagcctgtactatgactacaagccaccctactatgatgtgatgaccaccggcaccaccccagactaccaggaccccaccccaggagaggaggaggagatcctggagagcagcctgctgccccccctggaggaggagcagacagacctgcaggtgcccccaacagctgaccgcttccaggccgaggagtatggagagggcggcacagaccccccagagggcccctatgactacacctacggctatggagatgactaccgggaggagacagagctgggccctgccctgtctgctgagacagcccacagcggggctgctgcccacggcccccggggcctgaagggggagaagggggagcctgctgtgctggagcccggcatgctggtggagggccccccaggccctgagggccctgctggcctgattggccccccaggcatccagggcaaccctggccctgtgggggaccccggggagcggggccccccaggccgggccggcctgcccggcagtgatggagcccctggccccccaggcaccagcctgatgctgcccttccgctttggaagtggcggcggggacaagggccctgtggtggccgcccaggaggcccaggcccaggccatcctgcagcaggcccggctggccctgcggggccccccaggccccatgggctacacaggccggcccggccccctgggccagcccggcagccctggcctgaagggggagagcggggacctgggcccccagggcccccggggcccccagggcctgactggacctcctgggaaggccggcagaagaggccgggccggggctgatggagcccggggcatgcctggggaccccggggtgaagggggaccggggctttgatggcctgcccggcctgcccggggagaagggccacagaggagacacaggagcccagggcctgcccggccccccaggagaagatggagagagaggagatgatggagagatcggcccccggggcctgcccggggagagcggcccccggggcctgctgggccccaagggccccccaggcatccctggccccccatag

SEQ ID NO: 3291 - DNA, 4953 bp, Artificial Sequence; identical to SEQ ID NO: 3269
  Description of Artificial Sequence: Synthetic coding sequence

SEQ ID NO: 3292 - DNA, 1875 bp, Artificial Sequence; identical to SEQ ID NO: 3284
  Description of Artificial Sequence: Synthetic coding sequence

SEQ ID NO: 3293 - DNA, 1875 bp, Artificial Sequence
  Description of Artificial Sequence: Synthetic coding sequence
atggagcgctgcagccgctgccaccggctgctgctgctgctgcccctggtgctgggcctgtctgctgcccctggctgggccggggcccctcctgtggatgtgctgcgggccctgcgcttccccagcctgcctgatggagtgcggcgggccaagggcatctgcccagcagatgtggcctacagagtggcccggcctgcccagctgagcgcccccacccggcagctgtttcctgggggcttccccaaggacttcagcctgctgactgtggtgaggacccggcccggcctgcaggcccccctgctgaccctgtacagcgcccagggcgtgcggcagctgggcctggagctgggcccccctgtgcgcttcctgtatgaggaccagacaggccggccccagccccccagccagcctgtgttccggggcctgagcctggctgatggcaagtggcaccgggtggccgtggccgtgaagggccagagcgtgaccctcatcgtggactgcaagaagagggtgacccggcccctgcccaggtctgcccggcctgtgctggacacccacggcgtcatcatctttggagcccgcatcctggatgaggaggtgtttgaaggagatgtgcaggagctggccatcgtgcctggggtgcaggccgcctatgagagctgtgagcagaaggagctggagtgtgagggcggccagcgggagcggccccagaaccagcagccccaccgggcccagaggagcccccagcagcagcccagccggctgcaccggccccagaaccaggagccccagagccagcccacagagagcctgtactatgactacaagccaccctactatgatgtgatgaccaccggcaccaccccagactaccaggaccccaccccaggagaggaggaggagatcctggagagcagcctgctgccccccctggaggaggagcagacagacctgcaggtgcccccaacagctgaccgcttccaggccgaggagtatggagagggcggcacagatcctcctgagggcccctatgactacacctacggctatggagatgactaccgggaggagacagagctgggccctgccctgtctgctgagacagcccacagcggggccgccgcccacggcccccggggcctgaagggggagaagggggagcctgctgtgctggagcccggcatgctggtggagggccccccaggccctgagggccctgctggcctcatcggccccccaggcatccagggcaaccctggccctgtgggggaccctggagagcggggccccccaggccgggccggcctgcccggcagtgatggagcccctggccccccaggcaccagcctgatgctgcccttccgcttcggcagcggcggcggggacaagggccctgtggtggccgcccaggaggcccaggcccaggccatcctgcagcaggcccggctggccctgcggggccccccaggccccatgggctacacaggccggcccggccccctgggccagcccggcagccctggcctgaagggggagagcggggacctgggcccccagggcccccggggcccccagggcctgaccggccccccaggcaaggccggccggcggggccgggccggggctgatggagcccggggcatgcctggggaccccggggtgaagggggaccggggctttgatggcctgcccggcctgcctggagagaagggccacagaggagacaccggggcccagggcctgcccggccccccaggagaagatggagagagaggagatgatggagaaattggcccccggggcctgcctggagagagcggcccccggggcctgctgggccccaagggccccccaggcatccctggccccccatag

SEQ ID NO: 3294 - DNA, 1875 bp, Artificial Sequence; identical to SEQ ID NO: 3279
  Description of Artificial Sequence: Synthetic coding sequence

SEQ ID NO: 3295 - DNA, 873 bp, Artificial Sequence; identical to SEQ ID NO: 3274
  Description of Artificial Sequence: Synthetic coding sequence

SEQ ID NO: 3296 - DNA, 1875 bp, Artificial Sequence; identical to SEQ ID NO: 3284
  Description of Artificial Sequence: Synthetic coding sequence

SEQ ID NO: 3297 - DNA, 5070 bp, Artificial Sequence
  Description of Artificial Sequence: Synthetic coding sequence
atggagcgctgcagccgctgccaccggctgctgctgctgctgcccctggtgctgggcctgtctgctgcccctggctgggccggggcccctcctgtggatgtgctgcgggccctgcgcttccccagcctgcctgatggagtgcggcgggccaagggcatctgcccagcagatgtggcctacagagtggcccggcctgcccagctgagcgcccccacccggcagctgtttcctgggggcttccccaaggacttcagcctgctgactgtggtgaggacccggcccggcctgcaggcccccctgctgaccctgtacagcgcccagggcgtgcggcagctgggcctggagctgggcccccctgtgcgcttcctgtatgaggaccagacaggccggccccagccccccagccagcctgtgttccggggcctgagcctggctgatggcaagtggcaccgggtggccgtggccgtgaagggccagagcgtgaccctcatcgtggactgcaagaagagggtgacccggcccctgcccaggtctgcccggcctgtgctggacacccacggcgtcatcatctttggagcccgcatcctggatgaggaggtgtttgaaggagatgtgcaggagctggccatcgtgcctggggtgcaggccgcctatgagagctgtgagcagaaggagctggagtgtgagggcggccagcgggagcggccccagaaccagcagccccaccgggcccagaggagcccccagcagcagcccagccggctgcaccggccccagaaccaggagccccagagccaggagcagacagacctgcaggtgcccccaacagctgaccgcttccaggccgaggagtatggagagggcggcacagaccccccagagggcccctatgactacacctacggctatggagatgactaccgggaggagacagagctgggccctgccctgtctgctgagacagcccacagcggggctgctgcccacggcccccggggcctgaagggggagaagggggagcctgctgtgctggagcccggcatgctggtggagggccccccaggccctgagggccctgctggcctgattggccccccaggcatccagggcaaccctggccctgtgggggaccccggggagcggggccccccaggccgggccggcctgcccggcagtgatggagcccctggccccccaggcaccagcctgatgctgcccttccgctttggaagtggcggcggggacaagggccctgtggtggccgcccaggaggcccaggcccaggccatcctgcagcaggcccggctggccctgcggggccccccaggccccatgggctacacaggccggcccggccccctgggccagcccggcagccctggcctgaagggggagagcggggacctgggcccccagggcccccggggcccccagggcctgactggacctcctgggaaggccggcagaagaggccgggccggggctgatggagcccggggcatgcctggggaccccggggtgaagggggaccggggctttgatggcctgcccggcctgcccggggagaagggccacagaggagacacaggagcccagggcctgcccggccccccaggagaagatggagagagaggagatgatggagagatcggcccccggggcctgcccggggagagcggcccccggggcctgctgggccccaagggccccccaggcatccctggccccccaggagtgcggggcatggatggcccccagggccccaagggcagcctgggcccccagggcgagcccggccccccaggccagcagggcaccccaggcacccagggcctgcccggcccccagggcgccatcggcccccacggggagaagggcccccagggcaagccaggcctgcccggcatgcctggcagtgatggccccccaggccaccctgggaaggagggccccccaggcaccaagggcaaccagggccccagcggcccccagggccccctgggctacccaggcccccggggcgtgaagggcgtggatggcatccggggcctgaagggccacaagggggagaagggagaagatggcttccctggcttcaagggggacattggagtgaagggggacagaggagaggtgggcgtgcccggcagcagaggagaagatggccctgagggccccaagggccgcacaggccccactggagaccccggccccccaggcctgatgggagagaagggcaagctgggcgtgcccggcctgcccggctacccaggccggcagggccccaagggcagcctgggcttccctggcttccctggggccagcggggagaagggggcccggggcctgagcggcaagagcggccccagaggagagcggggccccaccggcccccggggccagaggggccccaggggggccaccgggaagagcggggccaagggcaccagcggaggagatggcccccacggccccccaggagagcggggcctgcccggcccccagggccccaacggcttccctggccccaagggccccccaggccccccaggcaaggatggcctgcccggccaccctggccagagaggagaggtgggcttccagggcaagacaggccccccaggccccccaggagtggtgggcccccagggcgccgccggggagaccggccccatgggagagcggggccaccctggccccccaggccccccaggagagcagggcctgcccggcacagctgggaaggagggcaccaagggggaccccggccccccaggggcccctgggaaggatggccctgctggcctgcggggcttccctggagagcggggcctgcccggcacagctgggggccctggcctgaagggaaatgaaggccccagcggccccccaggccctgctggcagccctggagagagaggagctgctggcagcggcggccccatcggccccccaggccggcccggcccccagggccccccaggagctgctggggagaagggcgtgcctggagagaagggccccatcggccccaccggcagagatggagtgcagggccctgtgggcctgcccggccctgctggccccccaggagtggccggagaagatggagacaagggggaggtgggggaccccggccagaagggcaccaagggcaacaagggggagcacggccccccaggccccccaggccccatcggccctgtgggccagcccggggctgctggagcagatggagagcccggggcccggggcccccagggccactttggagccaagggagatgagggcacccggggcttcaacggccccccaggccccatcggcctgcagggcctgcccggccccagcggggagaagggggagactggagatgtgggccccatgggccccccaggccccccaggcccccggggccctgctggccccaacggggctgatggcccccagggccccccaggaggagtgggcaacctgggccccccaggagagaagggggagcccggggagagcggcagccctggcatccagggcgagcccggggtgaagggccccagaggagagcggggggagaagggggagagcggccagcccggggagcccggccccccaggccccaagggccccactggagatgatggccccaagggcaaccctggccctgtgggcttccctggggaccccggccccccaggagagggcggcccccggggccaggatggagccaagggggacagaggagaagatggagagcccggccagcccggcagccctggccccactggagaaaatggccccccaggccccctgggcaagaggggccctgctggcagccctggcagcgagggccggcagggcggcaagggggccaagggggaccccggggccatcggggcccctgggaagacaggccctgtgggccctgctggccctgctgggaagccaggcccagatggcctgcggggcctgcccggctctgtgggccagcagggccggcctggggccaccggccaggccggccccccaggccctgtgggccccccaggcctgcccggcctgcggggagatgctggggccaagggggagaagggccaccctggcctgattggcctcatcggccccccaggagagcagggcgagaagggggaccggggcctgcccggcccccagggcagccctggccagaagggggagatgggcatccctggggccagcggccccatcggccctgggggccccccaggcctgcccggccctgctggccccaagggggccaagggggccactggacctgggggccccaagggggagaagggcgtgcagggccccccaggccaccctggccccccaggagaggtgatccagcccctgcccatccagatgcccaagaagacccggcgctctgtggatggcagccggctgatgcaggaggatgaggccatccccactggaggagcccctggcagccctgggggcctggaggagatcttcggcagcctggacagcctgcgggaggagattgagcagatgagaagacccaccggcacccaggacagccctgcccggacctgccaggacctgaagctgtgccaccctgagctgcctgatggagagtactgggtggaccccaaccagggctgtgccagagatgccttccgggtcttctgcaacttcaccgctggaggagagacctgtgtgaccccaagagatgatgtgacccagttctcctatgtggacagcgagggcagccctgtgggcgtggtgcagctgaccttcctgcggctgctgtctgtgtctgcccaccaggatgtgtcctacccctgcagcggggccgccagagatggccccctgcggctgcggggggccaatgaagatgagctgagccctgagaccagcccctacgtgaaggagttcagagatggctgccagacccagcagggccgcacagtgctggaggtgaggacccctgtgctggagcagctgcctgtgctggatgccagcttcagtgacctgggcgccccaccccggcggggcggcgtgctgctgggccctgtgtgcttcatgggctag

SEQ ID NO: 3298 - DNA, 5133 bp, Artificial Sequence
  Description of Artificial Sequence: Synthetic coding sequence
atggagcgctgcagccgctgccaccggctgctgctgctgctgcccctggtgctgggcctgtctgctgcccctggctgggccggggcccctcctgtggatgtgctgcgggccctgcgcttccccagcctgcctgatggagtgcggcgggccaagggcatctgcccagcagatgtggcctacagagtggcccggcctgcccagctgagcgcccccacccggcagctgtttcctgggggcttccccaaggacttcagcctgctgactgtggtgaggacccggcccggcctgcaggcccccctgctgaccctgtacagcgcccagggcgtgcggcagctgggcctggagctgggcccccctgtgcgcttcctgtatgaggaccagacaggccggccccagccccccagccagcctgtgttccggggcctgagcctggctgatggcaagtggcaccgggtggccgtggccgtgaagggccagagcgtgaccctcatcgtggactgcaagaagagggtgacccggcccctgcccaggtctgcccggcctgtgctggacacccacggcgtcatcatctttggagcccgcatcctggatgaggaggtgtttgaaggagatgtgcaggagctggccatcgtgcctggggtgcaggccgcctatgagagctgtgagcagaaggagctggagtgtgagggcggccagcgggagcggccccagaaccagcagccccaccgggcccagaggagcccccagcagcagcccagccggctgcaccggccccagaaccaggagccccagagccaggaccccaccccaggagaggaggaggagatcctggagagcagcctgctgccccccctggaggaggagcagacagacctgcaggtgcccccaacagctgaccgcttccaggccgaggagtatggagagggcggcacagatcctcctgagggcccctatgactacacctacggctatggagatgactaccgggaggagacagagctgggccctgccctgtctgctgagacagcccacagcggggccgccgcccacggcccccggggcctgaagggggagaagggggagcctgctgtgctggagcccggcatgctggtggagggccccccaggccctgagggccctgctggcctcatcggccccccaggcatccagggcaaccctggccctgtgggggaccctggagagcggggccccccaggccgggccggcctgcccggcagtgatggagcccctggccccccaggcaccagcctgatgctgcccttccgcttcggcagcggcggcggggacaagggccctgtggtggccgcccaggaggcccaggcccaggccatcctgcagcaggcccggctggccctgcggggccccccaggccccatgggctacacaggccggcccggccccctgggccagcccggcagccctggcctgaagggggagagcggggacctgggcccccagggcccccggggcccccagggcctgaccggccccccaggcaaggccggccggcggggccgggccggggctgatggagcccggggcatgcctggggaccccggggtgaagggggaccggggctttgatggcctgcccggcctgcctggagagaagggccacagaggagacaccggggcccagggcctgcccggccccccaggagaagatggagagagaggagatgatggagaaattggcccccggggcctgcctggagagagcggcccccggggcctgctgggccccaagggccccccaggcatccctggccccccaggagtgcggggcatggatggcccccagggccccaagggcagcctgggcccccagggcgagcccggccccccaggccagcagggcaccccaggcacccagggcctgcccggcccccagggcgccatcggcccccatggagagaagggcccccagggcaagccaggcctgcccggcatgcctggcagtgatggccccccaggccaccctgggaaggagggccccccaggcaccaagggcaaccagggccccagcggcccccagggccccctgggctacccaggcccccggggcgtgaagggcgtggatggcatccggggcctgaagggccacaagggggagaagggggaggatggcttccctggcttcaagggggacatcggcgtgaagggggacagaggagaggtgggcgtgcccggcagcagaggagaagatggccctgagggccccaagggccgcacaggccccaccggggaccccggccccccaggcctgatgggagagaagggcaagctgggcgtgcccggcctgcccggctacccaggccggcagggccccaagggcagcctgggcttccctggcttccctggggccagcggggagaagggggcccggggcctgagcggcaagagcggccccagaggagagcggggccccaccggcccccggggccagaggggccccaggggggccaccgggaagagcggggccaagggcaccagcggaggagatggcccccacggccccccaggagagcggggcctgcccggcccccagggccccaacggcttccctggccccaagggccccccaggccccccaggcaaggatggcctgcccggccaccctggccagagaggagaggtgggcttccagggcaagacaggccccccaggccccccaggagtggtgggcccccagggcgctgctggggagaccggccccatgggagagcggggccaccctggccccccaggccccccaggagagcagggcctgcctggaacagctgggaaggagggcaccaagggggaccccggccccccaggggcccctgggaaggatggccctgctggcctgcggggcttccctggagagcggggcctgcctggaacagctgggggccctggcctgaagggaaatgaaggccccagcggccccccaggccctgctggcagccctggagagagaggagctgctggcagcggcggccccatcggccccccaggccggcccggcccccagggccccccaggagctgctggggagaagggcgtgcctggagagaagggccccatcggccccaccggcagagatggagtgcagggccctgtgggcctgcccggccctgctggccccccaggagtggccggggaggatggagacaagggggaggtgggggaccccggccagaagggcaccaagggcaacaagggggagcacggccccccaggccccccaggccccatcggccctgtgggccagcctggagctgctggagcagatggagagcccggggcccggggcccccagggccactttggagccaagggagatgagggcacccggggcttcaatggacctcctggccccatcggcctgcagggcctgcccggccccagcggggagaagggggagactggagatgtgggccccatgggccccccaggccccccaggcccccggggccctgctggccccaatggagcagatggcccccagggccccccaggcggcgtgggcaacctgggccccccaggagagaagggggagcctggagagagcggcagccctggcatccagggcgagcccggggtgaagggccccagaggagagcggggggagaagggggagagcggccagcctggagagcccggccccccaggccccaagggccccactggagatgatggccccaagggcaaccctggccctgtgggcttccctggggaccccggccccccaggagagggcggcccccggggccaggatggagccaagggggacagaggagaagatggagagcccggccagcccggcagccctggccccaccggggagaatggacctcctggccccctgggcaagaggggccctgctggcagccctggcagcgagggccggcagggcggcaaaggagccaagggggaccccggggccatcggggcccctgggaagacaggccctgtgggccctgctggccctgctgggaagccaggcccagatggcctgcggggcctgcccggctctgtgggccagcagggccggcctggggccaccggccaggccggccccccaggccctgtgggccccccaggcctgcccggcctgcggggagatgctggggccaagggggagaagggccaccctggcctcatcggcctgattggccccccaggagagcagggcgagaagggggaccggggcctgcccggcccccagggcagccctggccagaagggggagatgggcatccctggggccagcggccccatcggccctgggggccccccaggcctgcccggccctgctggccccaagggggccaagggggccaccggccctgggggccccaagggggagaagggcgtgcagggccccccaggccaccctggccccccaggagaggtgatccagcccctgcccatccagatgcccaagaagaccaggagatctgtggatggcagccggctgatgcaggaggatgaggccatccccaccggcggggcccctggcagccctgggggcctggaggagatcttcggcagcctggacagcctgcgggaggagattgagcagatgaggcggcccaccggcacccaggacagccctgcccggacctgccaggacctgaagctgtgccaccctgagctgcctgatggagagtactgggtggaccccaaccagggctgtgccagagatgccttccgggtcttctgcaacttcaccgctggaggagagacctgtgtgaccccaagagatgatgtgacccagttctcctatgtggacagcgagggcagccctgtgggcgtggtgcagctgaccttcctgcggctgctgtctgtgtctgcccaccaggatgtgtcctacccctgcagcggggccgccagagatggccccctgcggctgcggggggccaatgaagatgagctgagccctgagaccagcccctacgtgaaggagttcagagatggctgccagacccagcagggccgcacagtgctggaggtgaggacccctgtgctggagcagctgcctgtgctggatgccagcttcagtgacctgggcgcccccccaagaagaggaggagtgctgctgggccctgtgtgcttcatgggctag

SEQ ID NO: 3299 - DNA, 4968 bp, Artificial Sequence
  Description of Artificial Sequence: Synthetic coding sequence
atggagcgctgcagccgctgccaccggctgctgctgctgctgcccctggtgctgggcctgtctgctgcccctggctgggccggggcccctcctgtggatgtgctgcgggccctgcgcttccccagcctgcctgatggagtgcggcgggccaagggcatctgcccagcagatgtggcctacagagtggcccggcctgcccagctgagcgcccccacccggcagctgtttcctgggggcttccccaaggacttcagcctgctgactgtggtgaggacccggcccggcctgcaggcccccctgctgaccctgtacagcgcccagggcgtgcggcagctgggcctggagctgggccggcctgtgcgcttcctgtatgaggaccagacaggccggccccagccccccagccagcctgtgttccggggcctgagcctggctgatggcaagtggcaccgggtggccgtggccgtgaagggccagagcgtgaccctcatcgtggactgcaagaagagggtgacccggcccctgcccaggtctgcccggcctgtgctggacacccacggcgtcatcatctttggagcccgcatcctggatgaggaggtgtttgaaggagatgtgcaggagctggccatcgtgcctggggtgcaggccgcctatgagagctgtgagcagaaggagctggagtgtgagggcggccagcgggagcggccccagaaccagcagccccaccgggcccagaggagcccccagcagcagcccagccggctgcaccggccccagaaccaggagccccagagccagcccacagagagcctgtactatgactatgagcccccctactatgatgtgatgaccaccggcaccaccccagactaccaggccgcccacggcccccggggcctgaagggggagaagggggagcctgctgtgctggagcccggcatgctggtggagggccccccaggccctgagggccctgctggcctgattggccccccaggcatccagggcaaccctggccctgtgggggaccccggggagcggggccccccaggccgggccggcctgcccggcagtgatggagcccctggccccccaggcaccagcctgatgctgcccttccgctttggaagtggcggcggggacaagggccctgtggtggccgcccaggaggcccaggcccaggccatcctgcagcaggcccggctggccctgcggggccccccaggccccatgggctacacaggccggcccggccccctgggccagcccggcagccctggcctgaagggggagagcggggacctgggcccccagggcccccggggcccccagggcctgactggacctcctgggaaggccggcagaagaggccgggccggggctgatggagcccggggcatgcctggggaccccggggtgaagggggaccggggctttgatggcctgcccggcctgcccggggagaagggccacagaggagacacaggagcccagggcctgcccggccccccaggagaagatggagagagaggagatgatggagagatcggcccccggggcctgcccggggagagcggcccccggggcctgctgggccccaagggccccccaggcatccctggccccccaggagtgcggggcatggatggcccccagggccccaagggcagcctgggcccccagggcgagcccggccccccaggccagcagggcaccccaggcacccagggcctgcccggcccccagggcgccatcggcccccacggggagaagggcccccagggcaagccaggcctgcccggcatgcctggcagtgatggccccccaggccaccctgggaaggagggccccccaggcaccaagggcaaccagggccccagcggcccccagggccccctgggctacccaggcccccggggcgtgaagggcgtggatggcatccggggcctgaagggccacaagggggagaagggagaagatggcttccctggcttcaagggggacattggagtgaagggggacagaggagaggtgggcgtgcccggcagcagaggagaagatggccctgagggccccaagggccgcacaggccccactggagaccccggccccccaggcctgatgggagagaagggcaagctgggcgtgcccggcctgcccggctacccaggccggcagggccccaagggcagcctgggcttccctggcttccctggggccagcggggagaagggggcccggggcctgagcggcaagagcggccccagaggagagcggggccccaccggcccccggggccagaggggccccaggggggccaccgggaagagcggggccaagggcaccagcggaggagatggcccccacggccccccaggagagcggggcctgcccggcccccagggccccaacggcttccctggccccaagggccccctgggccccccaggcaaggatggcctgcccggccaccctggccagagaggagaggtgggcttccagggcaagacaggccccccaggccccccaggagtggtgggcccccagggcgccgccggggagaccggccccatgggagagcggggccaccctggccccccaggccccccaggagagcagggcctgcccggcacagctgggaaggagggcaccaagggggaccccggccccccaggggcccctgggaaggatggccctgctggcctgcggggcttccctggagagcggggcctgcccggcacagctgggggccctggcctgaagggaaatgaaggccccagcggccccccaggccctgctggcagccctggagagagaggagctgctggcagcggcggccccatcggccccccaggccggcccggcccccagggccccccaggagctgctggggagaagggcgtgcctggagagaagggccccatcggccccaccggcagagatggagtgcagggccctgtgggcctgcccggccctgctggccccccaggagtggccggagaagatggagacaagggggaggtgggggaccccggccagaagggcaccaagggcaacaagggggagcacggccccccaggccccccaggccccatcggccctgtgggccagcccggggctgctggagcagatggagagcccggggcccggggcccccagggccactttggagccaagggagatgagggcacccggggcttcaacggccccccaggccccatcggcctgcagggcctgcccggccccagcggggagaagggggagactggagatgtgggccccatgggccccccaggccccccaggcccccggggccctgctggccccaacggggctgatggcccccagggccccccaggaggagtgggcaacctgggccccccaggagagaagggggagcccggggagagcggcagccctggcatccagggcgagcccggggtgaagggccccagaggagagcggggggagaagggggagagcggccagcccggggagcccggccccccaggccccaagggccccactggagatgatggccccaagggcaaccctggccctgtgggcttccctggggaccccggccccccaggagagggcggcccccggggccaggatggagccaagggggacagaggagaagatggagagcccggccagcccggcagccctggccccactggagaaaatggccccccaggccccctgggcaagaggggccctgctggcagccctggcagcgagggccggcagggcggcaagggggccaagggggaccccggggccatcggggcccctgggaagacaggccctgtgggccctgctggccctgctgggaagccaggcccagatggcctgcggggcctgcccggctctgtgggccagcagggccggcctggggccaccggccaggccggccccccaggccctgtgggccccccaggcctgcccggcctgcggggagatgctggggccaagggggagaagggccaccctggcctgattggcctcatcggccccccaggagagcagggcgagaagggggaccggggcctgcccggcccccagggcagccctggccagaagggggagatgggcatccctggggccagcggccccatcggccctgggggccccccaggcctgcccggccctgctggccccaagggggccaagggggccactggacctgggggccccaagggggagaagggcgtgcagggccccccaggccaccctggccccccaggagaggtgatccagcccctgcccatccagatgcccaagaagacccggcgctctgtggatggcagccggctgatgcaggaggatgaggccatccccactggaggagcccctggcagccctgggggcctggaggagatcttcggcagcctggacagcctgcgggaggagattgagcagatgagaagacccaccggcacccaggacagccctgcccggacctgccaggacctgaagctgtgccaccctgagctgcctgatggagagtactgggtggaccccaaccagggctgtgccagagatgccttccgggtcttctgcaacttcaccgctggaggagagacctgtgtgaccccaagagatgatgtgacccagttctcctatgtggacagcgagggcagccctgtgggcgtggtgcagctgaccttcctgcggctgctgtctgtgtctgcccaccaggatgtgtcctacccctgcagcggggccgccagagatggccccctgcggctgcggggggccaatgaagatgagctgagccctgagaccagcccctacgtgaaggagttcagagatggctgccagacccagcagggccgcacagtgctggaggtgaggacccctgtgctggagcagctgcctgtgctggatgccagcttcagtgacctgggcgccccaccccggcggggcggcgtgctgctgggccctgtgtgcttcatgggctag

SEQ ID NO: 3300 - DNA, 4968 bp, Artificial Sequence
  Description of Artificial Sequence: Synthetic coding sequence
atggagcgctgcagccgctgccaccggctgctgctgctgctgcccctggtgctgggcctgtctgctgcccctggctgggccggggcccctcctgtggatgtgctgcgggccctgcgcttccccagcctgcctgatggagtgcggcgggccaagggcatctgcccagcagatgtggcctacagagtggcccggcctgcccagctgagcgcccccacccggcagctgtttcctgggggcttccccaaggacttcagcctgctgactgtggtgaggacccggcccggcctgcaggcccccctgctgaccctgtacagcgcccagggcgtgcggcagctgggcctggagctgggccggcctgtgcgcttcctgtatgaggaccagacaggccggccccagccccccagccagcctgtgttccggggcctgagcctggctgatggcaagtggcaccgggtggccgtggccgtgaagggccagagcgtgaccctcatcgtggactgcaagaagagggtgacccggcccctgcccaggtctgcccggcctgtgctggacacccacggcgtcatcatctttggagcccgcatcctggatgaggaggtgtttgaaggagatgtgcaggagctggccatcgtgcctggggtgcaggccgcctatgagagctgtgagcagaaggagctggagtgtgagggcggccagcgggagcggccccagaaccagcagccccaccgggcccagaggagcccccagcagcagcccagccggctgcaccggccccagaaccaggagccccagagccagcccacagagagcctgtactatgactacaagccaccctactatgatgtgatgaccaccggcaccaccccagactaccaggccgcccacggcccccggggcctgaagggggagaagggggagcctgctgtgctggagcccggcatgctggtggagggccccccaggccctgagggccctgctggcctgattggccccccaggcatccagggcaaccctggccctgtgggggaccccggggagcggggccccccaggccgggccggcctgcccggcagtgatggagcccctggccccccaggcaccagcctgatgctgcccttccgctttggaagtggcggcggggacaagggccctgtggtggccgcccaggaggcccaggcccaggccatcctgcagcaggcccggctggccctgcggggccccccaggccccatgggctacacaggccggcccggccccctgggccagcccggcagccctggcctgaagggggagagcggggacctgggcccccagggcccccggggcccccagggcctgactggacctcctgggaaggccggcagaagaggccgggccggggctgatggagcccggggcatgcctggggaccccggggtgaagggggaccggggctttgatggcctgcccggcctgcccggggagaagggccacagaggagacacaggagcccagggcctgcccggccccccaggagaagatggagagagaggagatgatggagagatcggcccccggggcctgcccggggagagcggcccccggggcctgctgggccccaagggccccccaggcatccctggccccccaggagtgcggggcatggatggcccccagggccccaagggcagcctgggcccccagggcgagcccggccccccaggccagcagggcaccccaggcacccagggcctgcccggcccccagggcgccatcggcccccacggggagaagggcccccagggcaagccaggcctgcccggcatgcctggcagtgatggccccccaggccaccctgggaaggagggccccccaggcaccaagggcaaccagggccccagcggcccccagggccccctgggctacccaggcccccggggcgtgaagggcgtggatggcatccggggcctgaagggccacaagggggagaagggagaagatggcttccctggcttcaagggggacattggagtgaagggggacagaggagaggtgggcgtgcccggcagcagaggagaagatggccctgagggccccaagggccgcacaggccccactggagaccccggccccccaggcctgatgggagagaagggcaagctgggcgtgcccggcctgcccggctacccaggccggcagggccccaagggcagcctgggcttccctggcttccctggggccagcggggagaagggggcccggggcctgagcggcaagagcggccccagaggagagcggggccccaccggcccccggggccagaggggccccaggggggccaccgggaagagcggggccaagggcaccagcggaggagatggcccccacggccccccaggagagcggggcctgcccggcccccagggccccaacggcttccctggccccaagggccccccaggccccccaggcaaggatggcctgcccggccaccctggccagagaggagaggtgggcttccagggcaagacaggccccccaggccccccaggagtggtgggcccccagggcgccgccggggagaccggccccatgggagagcggggccaccctggccccccaggccccccaggagagcagggcctgcccggcacagctgggaaggagggcaccaagggggaccccggccccccaggggcccctgggaaggatggccctgctggcctgcggggcttccctggagagcggggcctgcccggcacagctgggggccctggcctgaagggaaatgaaggccccagcggccccccaggccctgctggcagccctggagagagaggagctgctggcagcggcggccccatcggccccccaggccggcccggcccccagggccccccaggagctgctggggagaagggcgtgcctggagagaagggccccatcggccccaccggcagagatggagtgcagggccctgtgggcctgcccggccctgctggccccccaggagtggccggagaagatggagacaagggggaggtgggggaccccggccagaagggcaccaagggcaacaagggggagcacggccccccaggccccccaggccccatcggccctgtgggccagcccggggctgctggagcagatggagagcccggggcccggggcccccagggccactttggagccaagggagatgagggcacccggggcttcaacggccccccaggccccatcggcctgcagggcctgcccggccccagcggggagaagggggagactggagatgtgggccccatgggccccccaggccccccaggcccccggggccctgctggccccaacggggctgatggcccccagggccccccaggaggagtgggcaacctgggccccccaggagagaagggggagcccggggagagcggcagccctggcatccagggcgagcccggggtgaagggccccagaggagagcggggggagaagggggagagcggccagcccggggagcccggccccccaggccccaagggccccactggagatgatggccccaagggcaaccctggccctgtgggcttccctggggaccccggccccccaggagagggcggcccccggggccaggatggagccaagggggacagaggagaagatggagagcccggccagcccggcagccctggccccactggagaaaatggccccccaggccccctgggcaagaggggccctgctggcagccctggcagcgagggccggcagggcggcaagggggccaagggggaccccggggccatcggggcccctgggaagacaggccctgtgggccctgctggccctgctgggaagccaggcccagatggcctgcggggcctgcccggctctgtgggccagcagggccggcctggggccaccggccaggccggccccccaggccctgtgggccccccaggcctgcccggcctgcggggagatgctggggccaagggggagaagggccaccctggcctgattggcctcatcggccccccaggagagcagggcgagaagggggaccggggcctgcccggcccccagggcagccctggccagaagggggagatgggcatccctggggccagcggccccatcggccctgggggccccccaggcctgcccggccctgctggccccaagggggccaagggggccactggacctgggggccccaagggggagaagggcgtgcagggccccccaggccaccctggccccccaggagaggtgatccagcccctgcccatccagatgcccaagaagacccggcgctctgtggatggcagccggctgatgcaggaggatgaggccatccccactggaggagcccctggcagccctgggggcctggaggagatcttcggcagcctggacagcctgcgggaggagattgagcagatgagaagacccaccggcacccaggacagccctgcccggacctgccaggacctgaagctgtgccaccctgagctgcctgatggagagtactgggtggaccccaaccagggctgtgccagagatgccttccgggtcttctgcaacttcaccgctggaggagagacctgtgtgaccccaagagatgatgtgacccagttctcctatgtggacagcgagggcagccctgtgggcgtggtgcagctgaccttcctgcggctgctgtctgtgtctgcccaccaggatgtgtcctacccctgcagcggggccgccagagatggccccctgcggctgcggggggccaatgaagatgagctgagccctgagaccagcccctacgtgaaggagttcagagatggctgccagacccagcagggccgcacagtgctggaggtgaggacccctgtgctggagcagctgcctgtgctggatgccagcttcagtgacctgggcgccccaccccggcggggcggcgtgctgctgggccctgtgtgcttcatgggctag

SEQ ID NO: 3301 - DNA, 5031 bp, Artificial Sequence
  Description of Artificial Sequence: Synthetic coding sequence
atggagcgctgcagccgctgccaccggctgctgctgctgctgcccctggtgctgggcctgtctgctgcccctggctgggccggggcccctcctgtggatgtgctgcgggccctgcgcttccccagcctgcctgatggagtgcggcgggccaagggcatctgcccagcagatgtggcctacagagtggcccggcctgcccagctgagcgcccccacccggcagctgtttcctgggggcttccccaaggacttcagcctgctgactgtggtgaggacccggcccggcctgcaggcccccctgctgaccctgtacagcgcccagggcgtgcggcagctgggcctggagctgggcccccctgtgcgcttcctgtatgaggaccagacaggccggccccagccccccagccagcctgtgttccggggcctgagcctggctgatggcaagtggcaccgggtggccgtggccgtgaagggccagagcgtgaccctcatcgtggactgcaagaagagggtgacccggcccctgcccaggtctgcccggcctgtgctggacacccacggcgtcatcatctttggagcccgcatcctggatgaggaggtgtttgaaggagatgtgcaggagctggccatcgtgcctggggtgcaggccgcctatgagagctgtgagcagaaggagctggagtgtgagggcggccagcgggagcggccccagaaccagcagccccaccgggcccagaggagcccccagcagcagcccagccggctgcaccggccccagaaccaggagccccagagccagcccacagagagcctgtactatgactacaagccaccctactatgatgtgatgaccaccggcaccaccccagactaccaggaccccaccccaggagaggaggaggagatcctggagagcagcctgctgccccccctggaggaggccgcccacggcccccggggcctgaagggggagaagggggagcctgctgtgctggagcccggcatgctggtggagggccccccaggccctgagggccctgctggcctcatcggccccccaggcatccagggcaaccctggccctgtgggggaccctggagagcggggccccccaggccgggccggcctgcccggcagtgatggagcccctggccccccaggcaccagcctgatgctgcccttccgcttcggcagcggcggcggggacaagggccctgtggtggccgcccaggaggcccaggcccaggccatcctgcagcaggcccggctggccctgcggggccccccaggccccatgggctacacaggccggcccggccccctgggccagcccggcagccctggcctgaagggggagagcggggacctgggcccccagggcccccggggcccccagggcctgaccggccccccaggcaaggccggccggcggggccgggccggggctgatggagcccggggcatgcctggggaccccggggtgaagggggaccggggctttgatggcctgcccggcctgcctggagagaagggccacagaggagacaccggggcccagggcctgcccggccccccaggagaagatggagagagaggagatgatggagaaattggcccccggggcctgcctggagagagcggcccccggggcctgctgggccccaagggccccccaggcatccctggccccccaggagtgcggggcatggatggcccccagggccccaagggcagcctgggcccccagggcgagcccggccccccaggccagcagggcaccccaggcacccagggcctgcccggcccccagggcgccatcggcccccatggagagaagggcccccagggcaagccaggcctgcccggcatgcctggcagtgatggccccccaggccaccctgggaaggagggccccccaggcaccaagggcaaccagggccccagcggcccccagggccccctgggctacccaggcccccggggcgtgaagggcgtggatggcatccggggcctgaagggccacaagggggagaagggggaggatggcttccctggcttcaagggggacatcggcgtgaagggggacagaggagaggtgggcgtgcccggcagcagaggagaagatggccctgagggccccaagggccgcacaggccccaccggggaccccggccccccaggcctgatgggagagaagggcaagctgggcgtgcccggcctgcccggctacccaggccggcagggccccaagggcagcctgggcttccctggcttccctggggccagcggggagaagggggcccggggcctgagcggcaagagcggccccagaggagagcggggccccaccggcccccggggccagaggggccccaggggggccaccgggaagagcggggccaagggcaccagcggaggagatggcccccacggccccccaggagagcggggcctgcccggcccccagggccccaacggcttccctggccccaagggccccccaggccccccaggcaaggatggcctgcccggccaccctggccagagaggagaggtgggcttccagggcaagacaggccccccaggccccccaggagtggtgggcccccagggcgctgctggggagaccggccccatgggagagcggggccaccctggccccccaggccccccaggagagcagggcctgcctggaacagctgggaaggagggcaccaagggggaccccggccccccaggggcccctgggaaggatggccctgctggcctgcggggcttccctggagagcggggcctgcctggaacagctgggggccctggcctgaagggaaatgaaggccccagcggccccccaggccctgctggcagccctggagagagaggagctgctggcagcggcggccccatcggccccccaggccggcccggcccccagggccccccaggagctgctggggagaagggcgtgcctggagagaagggccccatcggccccaccggcagagatggagtgcagggccctgtgggcctgcccggccctgctggccccccaggagtggccggggaggatggagacaagggggaggtgggggaccccggccagaagggcaccaagggcaacaagggggagcacggccccccaggccccccaggccccatcggccctgtgggccagcctggagctgctggagcagatggagagcccggggcccggggcccccagggccactttggagccaagggagatgagggcacccggggcttcaatggacctcctggccccatcggcctgcagggcctgcccggccccagcggggagaagggggagactggagatgtgggccccatgggccccccaggccccccaggcccccggggccctgctggccccaatggagcagatggcccccagggccccccaggcggcgtgggcaacctgggccccccaggagagaagggggagcctggagagagcggcagccctggcatccagggcgagcccggggtgaagggccccagaggagagcggggggagaagggggagagcggccagcctggagagcccggccccccaggccccaagggccccactggagatgatggccccaagggcaaccctggccctgtgggcttccctggggaccccggccccccaggagagggcggcccccggggccaggatggagccaagggggacagaggagaagatggagagcccggccagcccggcagccctggccccaccggggagaatggacctcctggccccctgggcaagaggggccctgctggcagccctggcagcgagggccggcagggcggcaaaggagccaagggggaccccggggccatcggggcccctgggaagacaggccctgtgggccctgctggccctgctgggaagccaggcccagatggcctgcggggcctgcccggctctgtgggccagcagggccggcctggggccaccggccaggccggccccccaggccctgtgggccccccaggcctgcccggcctgcggggagatgctggggccaagggggagaagggccaccctggcctcatcggcctgattggccccccaggagagcagggcgagaagggggaccggggcctgcccggcccccagggcagccctggccagaagggggagatgggcatccctggggccagcggccccatcggccctgggggccccccaggcctgcccggccctgctggccccaagggggccaagggggccaccggccctgggggccccaagggggagaagggcgtgcagggccccccaggccaccctggccccccaggagaggtgatccagcccctgcccatccagatgcccaagaagaccaggagatctgtggatggcagccggctgatgcaggaggatgaggccatccccaccggcggggcccctggcagccctgggggcctggaggagatcttcggcagcctggacagcctgcgggaggagattgagcagatgaggcggcccaccggcacccaggacagccctgcccggacctgccaggacctgaagctgtgccaccctgagctgcctgatggagagtactgggtggaccccaaccagggctgtgccagagatgccttccgggtcttctgcaacttcaccgctggaggagagacctgtgtgaccccaagagatgatgtgacccagttctcctatgtggacagcgagggcagccctgtgggcgtggtgcagctgaccttcctgcggctgctgtctgtgtctgcccaccaggatgtgtcctacccctgcagcggggccgccagagatggccccctgcggctgcggggggccaatgaagatgagctgagccctgagaccagcccctacgtgaaggagttcagagatggctgccagacccagcagggccgcacagtgctggaggtgaggacccctgtgctggagcagctgcctgtgctggatgccagcttcagtgacctgggcgcccccccaagaagaggaggagtgctgctgggccctgtgtgcttcatgggctag

SEQ ID NO: 3302 - DNA, 5031 bp, Artificial Sequence
  Description of Artificial Sequence: Synthetic coding sequence
atggagcgctgcagccgctgccaccggctgctgctgctgctgcccctggtgctgggcctgtctgctgcccctggctgggccggggcccctcctgtggatgtgctgcgggccctgcgcttccccagcctgcctgatggagtgcggcgggccaagggcatctgcccagcagatgtggcctacagagtggcccggcctgcccagctgagcgcccccacccggcagctgtttcctgggggcttccccaaggacttcagcctgctgactgtggtgaggacccggcccggcctgcaggcccccctgctgaccctgtacagcgcccagggcgtgcggcagctgggcctggagctgggccggcctgtgcgcttcctgtatgaggaccagacaggccggccccagccccccagccagcctgtgttccggggcctgagcctggctgatggcaagtggcaccgggtggccgtggccgtgaagggccagagcgtgaccctcatcgtggactgcaagaagagggtgacccggcccctgcccaggtctgcccggcctgtgctggacacccacggcgtcatcatctttggagcccgcatcctggatgaggaggtgtttgaaggagatgtgcaggagctggccatcgtgcctggggtgcaggccgcctatgagagctgtgagcagaaggagctggagtgtgagggcggccagcgggagcggccccagaaccagcagccccaccgggcccagaggagcccccagcagcagcccagccggctgcaccggccccagaaccaggagccccagagccagcccacagagagcctgtactatgactacaagccaccctactatgatgtgatgaccaccggcaccaccccagactaccaggaccccaccccaggagaggaggaggagatcctggagagcagcctgctgccccccctggaggaggccgcccacggcccccggggcctgaagggggagaagggggagcctgctgtgctggagcccggcatgctggtggagggccccccaggccctgagggccctgctggcctcatcggccccccaggcatccagggcaaccctggccctgtgggggaccctggagagcggggccccccaggccgggccggcctgcccggcagtgatggagcccctggccccccaggcaccagcctgatgctgcccttccgcttcggcagcggcggcggggacaagggccctgtggtggccgcccaggaggcccaggcccaggccatcctgcagcaggcccggctggccctgcggggccccccaggccccatgggctacacaggccggcccggccccctgggccagcccggcagccctggcctgaagggggagagcggggacctgggcccccagggcccccggggcccccagggcctgaccggccccccaggcaaggccggccggcggggccgggccggggctgatggagcccggggcatgcctggggaccccggggtgaagggggaccggggctttgatggcctgcccggcctgcctggagagaagggccacagaggagacaccggggcccagggcctgcccggccccccaggagaagatggagagagaggagatgatggagaaattggcccccggggcctgcctggagagagcggcccccggggcctgctgggccccaagggccccccaggcatccctggccccccaggagtgcggggcatggatggcccccagggccccaagggcagcctgggcccccagggcgagcccggccccccaggccagcagggcaccccaggcacccagggcctgcccggcccccagggcgccatcggcccccatggagagaagggcccccagggcaagccaggcctgcccggcatgcctggcagtgatggccccccaggccaccctgggaaggagggccccccaggcaccaagggcaaccagggccccagcggcccccagggccccctgggctacccaggcccccggggcgtgaagggcgtggatggcatccggggcctgaagggccacaagggggagaagggggaggatggcttccctggcttcaagggggacatcggcgtgaagggggacagaggagaggtgggcgtgcccggcagcagaggagaagatggccctgagggccccaagggccgcacaggccccaccggggaccccggccccccaggcctgatgggagagaagggcaagctgggcgtgcccggcctgcccggctacccaggccggcagggccccaagggcagcctgggcttccctggcttccctggggccagcggggagaagggggcccggggcctgagcggcaagagcggccccagaggagagcggggccccaccggcccccggggccagaggggccccaggggggccaccgggaagagcggggccaagggcaccagcggaggagatggcccccacggccccccaggagagcggggcctgcccggcccccagggccccaacggcttccctggccccaagggccccccaggccccccaggcaaggatggcctgcccggccaccctggccagagaggagaggtgggcttccagggcaagacaggccccccaggccccccaggagtggtgggcccccagggcgctgctggggagaccggccccatgggagagcggggccaccctggccccccaggccccccaggagagcagggcctgcctggaacagctgggaaggagggcaccaagggggaccccggccccccaggggcccctgggaaggatggccctgctggcctgcggggcttccctggagagcggggcctgcctggaacagctgggggccctggcctgaagggaaatgaaggccccagcggccccccaggccctgctggcagccctggagagagaggagctgctggcagcggcggccccatcggccccccaggccggcccggcccccagggccccccaggagctgctggggagaagggcgtgcctggagagaagggccccatcggccccaccggcagagatggagtgcagggccctgtgggcctgcccggccctgctggccccccaggagtggccggggaggatggagacaagggggaggtgggggaccccggccagaagggcaccaagggcaacaagggggagcacggccccccaggccccccaggccccatcggccctgtgggccagcctggagctgctggagcagatggagagcccggggcccggggcccccagggccactttggagccaagggagatgagggcacccggggcttcaatggacctcctggccccatcggcctgcagggcctgcccggccccagcggggagaagggggagactggagatgtgggccccatgggccccccaggccccccaggcccccggggccctgctggccccaatggagcagatggcccccagggccccccaggcggcgtgggcaacctgggccccccaggagagaagggggagcctggagagagcggcagccctggcatccagggcgagcccggggtgaagggccccagaggagagcggggggagaagggggagagcggccagcctggagagcccggccccccaggccccaagggccccactggagatgatggccccaagggcaaccctggccctgtgggcttccctggggaccccggccccccaggagagggcggcccccggggccaggatggagccaagggggacagaggagaagatggagagcccggccagcccggcagccctggccccaccggggagaatggacctcctggccccctgggcaagaggggccctgctggcagccctggcagcgagggccggcagggcggcaaaggagccaagggggaccccggggccatcggggcccctgggaagacaggccctgtgggccctgctggccctgctgggaagccaggcccagatggcctgcggggcctgcccggctctgtgggccagcagggccggcctggggccaccggccaggccggccccccaggccctgtgggccccccaggcctgcccggcctgcggggagatgctggggccaagggggagaagggccaccctggcctcatcggcctgattggccccccaggagagcagggcgagaagggggaccggggcctgcccggcccccagggcagccctggccagaagggggagatgggcatccctggggccagcggccccatcggccctgggggccccccaggcctgcccggccctgctggccccaagggggccaagggggccaccggccctgggggccccaagggggagaagggcgtgcagggccccccaggccaccctggccccccaggagaggtgatccagcccctgcccatccagatgcccaagaagaccaggagatctgtggatggcagccggctgatgcaggaggatgaggccatccccaccggcggggcccctggcagccctgggggcctggaggagatcttcggcagcctggacagcctgcgggaggagattgagcagatgaggcggcccaccggcacccaggacagccctgcccggacctgccaggacctgaagctgtgccaccctgagctgcctgatggagagtactgggtggaccccaaccagggctgtgccagagatgccttccgggtcttctgcaacttcaccgctggaggagagacctgtgtgaccccaagagatgatgtgacccagttctcctatgtggacagcgagggcagccctgtgggcgtggtgcagctgaccttcctgcggctgctgtctgtgtctgcccaccaggatgtgtcctacccctgcagcggggccgccagagatggccccctgcggctgcggggggccaatgaagatgagctgagccctgagaccagcccctacgtgaaggagttcagagatggctgccagacccagcagggccgcacagtgctggaggtgaggacccctgtgctggagcagctgcctgtgctggatgccagcttcagtgacctgggcgcccccccaagaagaggaggagtgctgctgggccctgtgtgcttcatgggctag

SEQ ID NO: 3303 - DNA, 5031 bp, Artificial Sequence; identical to SEQ ID NO: 3278
  Description of Artificial Sequence: Synthetic coding sequence

SEQ ID NO: 3304 - DNA, 5148 bp, Artificial Sequence
  Description of Artificial Sequence: Synthetic coding sequence
atggagcgctgcagccgctgccaccggctgctgctgctgctgcccctggtgctgggcctgtctgctgcccctggctgggccggggcccctcctgtggatgtgctgcgggccctgcgcttccccagcctgcctgatggagtgcggcgggccaagggcatctgcccagcagatgtggcctacagagtggcccggcctgcccagctgagcgcccccacccggcagctgtttcctgggggcttccccaaggacttcagcctgctgactgtggtgaggacccggcccggcctgcaggcccccctgctgaccctgtacagcgcccagggcgtgcggcagctgggcctggagctgggccggcctgtgcgcttcctgtatgaggaccagacaggccggccccagccccccagccagcctgtgttccggggcctgagcctggctgatggcaagtggcaccgggtggccgtggccgtgaagggccagagcgtgaccctcatcgtggactgcaagaagagggtgacccggcccctgcccaggtctgcccggcctgtgctggacacccacggcgtcatcatctttggagcccgcatcctggatgaggaggtgtttgaaggagatgtgcaggagctggccatcgtgcctggggtgcaggccgcctatgagagctgtgagcagaaggagctggagtgtgagggcggccagcgggagcggccccagaaccagcagccccaccgggcccagaggagcccccagcagcagcccagccggctgcaccggccccagaaccaggagccccagagccagcccacagagagcctgtactatgactatgagcccccctactatgatgtgatgaccaccggcaccaccccagactaccaggagcagacagacctgcaggtgcccccaacagctgaccgcttccaggccgaggagtatggagagggcggcacagaccccccagagggcccctatgactacacctacggctatggagatgactaccgggaggagacagagctgggccctgccctgtctgctgagacagcccacagcggggctgctgcccacggcccccggggcctgaagggggagaagggggagcctgctgtgctggagcccggcatgctggtggagggccccccaggccctgagggccctgctggcctgattggccccccaggcatccagggcaaccctggccctgtgggggaccccggggagcggggccccccaggccgggccggcctgcccggcagtgatggagcccctggccccccaggcaccagcctgatgctgcccttccgctttggaagtggcggcggggacaagggccctgtggtggccgcccaggaggcccaggcccaggccatcctgcagcaggcccggctggccctgcggggccccccaggccccatgggctacacaggccggcccggccccctgggccagcccggcagccctggcctgaagggggagagcggggacctgggcccccagggcccccggggcccccagggcctgactggacctcctgggaaggccggcagaagaggccgggccggggctgatggagcccggggcatgcctggggaccccggggtgaagggggaccggggctttgatggcctgcccggcctgcccggggagaagggccacagaggagacacaggagcccagggcctgcccggccccccaggagaagatggagagagaggagatgatggagagatcggcccccggggcctgcccggggagagcggcccccggggcctgctgggccccaagggccccccaggcatccctggccccccaggagtgcggggcatggatggcccccagggccccaagggcagcctgggcccccagggcgagcccggccccccaggccagcagggcaccccaggcacccagggcctgcccggcccccagggcgccatcggcccccacggggagaagggcccccagggcaagccaggcctgcccggcatgcctggcagtgatggccccccaggccaccctgggaaggagggccccccaggcaccaagggcaaccagggccccagcggcccccagggccccctgggctacccaggcccccggggcgtgaagggcgtggatggcatccggggcctgaagggccacaagggggagaagggagaagatggcttccctggcttcaagggggacattggagtgaagggggacagaggagaggtgggcgtgcccggcagcagaggagaagatggccctgagggccccaagggccgcacaggccccactggagaccccggccccccaggcctgatgggagagaagggcaagctgggcgtgcccggcctgcccggctacccaggccggcagggccccaagggcagcctgggcttccctggcttccctggggccagcggggagaagggggcccggggcctgagcggcaagagcggccccagaggagagcggggccccaccggcccccggggccagaggggccccaggggggccaccgggaagagcggggccaagggcaccagcggaggagatggcccccacggccccccaggagagcggggcctgcccggcccccagggccccaacggcttccctggccccaagggccccctgggccccccaggcaaggatggcctgcccggccaccctggccagagaggagaggtgggcttccagggcaagacaggccccccaggccccccaggagtggtgggcccccagggcgccgccggggagaccggccccatgggagagcggggccaccctggccccccaggccccccaggagagcagggcctgcccggcacagctgggaaggagggcaccaagggggaccccggccccccaggggcccctgggaaggatggccctgctggcctgcggggcttccctggagagcggggcctgcccggcacagctgggggccctggcctgaagggaaatgaaggccccagcggccccccaggccctgctggcagccctggagagagaggagctgctggcagcggcggccccatcggccccccaggccggcccggcccccagggccccccaggagctgctggggagaagggcgtgcctggagagaagggccccatcggccccaccggcagagatggagtgcagggccctgtgggcctgcccggccctgctggccccccaggagtggccggagaagatggagacaagggggaggtgggggaccccggccagaagggcaccaagggcaacaagggggagcacggccccccaggccccccaggccccatcggccctgtgggccagcccggggctgctggagcagatggagagcccggggcccggggcccccagggccactttggagccaagggagatgagggcacccggggcttcaacggccccccaggccccatcggcctgcagggcctgcccggccccagcggggagaagggggagactggagatgtgggccccatgggccccccaggccccccaggcccccggggccctgctggccccaacggggctgatggcccccagggccccccaggaggagtgggcaacctgggccccccaggagagaagggggagcccggggagagcggcagccctggcatccagggcgagcccggggtgaagggccccagaggagagcggggggagaagggggagagcggccagcccggggagcccggccccccaggccccaagggccccactggagatgatggccccaagggcaaccctggccctgtgggcttccctggggaccccggccccccaggagagggcggcccccggggccaggatggagccaagggggacagaggagaagatggagagcccggccagcccggcagccctggccccactggagaaaatggccccccaggccccctgggcaagaggggccctgctggcagccctggcagcgagggccggcagggcggcaagggggccaagggggaccccggggccatcggggcccctgggaagacaggccctgtgggccctgctggccctgctgggaagccaggcccagatggcctgcggggcctgcccggctctgtgggccagcagggccggcctggggccaccggccaggccggccccccaggccctgtgggccccccaggcctgcccggcctgcggggagatgctggggccaagggggagaagggccaccctggcctgattggcctcatcggccccccaggagagcagggcgagaagggggaccggggcctgcccggcccccagggcagccctggccagaagggggagatgggcatccctggggccagcggccccatcggccctgggggccccccaggcctgcccggccctgctggccccaagggggccaagggggccactggacctgggggccccaagggggagaagggcgtgcagggccccccaggccaccctggccccccaggagaggtgatccagcccctgcccatccagatgcccaagaagacccggcgctctgtggatggcagccggctgatgcaggaggatgaggccatccccactggaggagcccctggcagccctgggggcctggaggagatcttcggcagcctggacagcctgcgggaggagattgagcagatgagaagacccaccggcacccaggacagccctgcccggacctgccaggacctgaagctgtgccaccctgagctgcctgatggagagtactgggtggaccccaaccagggctgtgccagagatgccttccgggtcttctgcaacttcaccgctggaggagagacctgtgtgaccccaagagatgatgtgacccagttctcctatgtggacagcgagggcagccctgtgggcgtggtgcagctgaccttcctgcggctgctgtctgtgtctgcccaccaggatgtgtcctacccctgcagcggggccgccagagatggccccctgcggctgcggggggccaatgaagatgagctgagccctgagaccagcccctacgtgaaggagttcagagatggctgccagacccagcagggccgcacagtgctggaggtgaggacccctgtgctggagcagctgcctgtgctggatgccagcttcagtgacctgggcgccccaccccggcggggcggcgtgctgctgggccctgtgtgcttcatgggctag

SEQ ID NO: 3305 - DNA, 4809 bp, Artificial Sequence
  Description of Artificial Sequence: Synthetic coding sequence
ggggcccctcctgtggatgtgctgcgggccctgcgcttccccagcctgcctgatggagtgagaagagccaagggcatctgcccagcagatgtggcctacagagtggcccggcctgcccagctgagcgcccccacccggcagctgtttcctgggggcttccccaaggacttcagcctgctgactgtggtgaggaccaggcctggcctgcaggcccccctgctgaccctgtacagcgcccagggcgtgcggcagctgggcctggagctgggccggcctgtgcgcttcctgtatgaggaccagacaggccggccccagccccccagccagcccgtcttccggggcctgagcctggctgatggcaagtggcaccgggtggccgtggccgtgaagggccagagcgtgaccctgattgtggactgcaagaagagggtgacccggcccctgcccaggtctgcccggcctgtgctggacacccatggagtcatcatctttggagcccgcatcctggatgaggaggtgtttgaaggagatgtgcaggagctggccatcgtgcctggggtgcaggccgcctatgagagctgtgagcagaaggagctggagtgtgagggcggccagcgggagcggccccagaaccagcagccccaccgggcccagaggagcccccagcagcagcccagccggctgcaccggccccagaaccaggagccccagagccaggccgcccacggcccccggggcctgaagggggagaagggggagcctgctgtgctggagcccggcatgctggtggagggccccccaggccctgagggccctgctggcctcatcggccccccaggcatccagggcaaccctggccctgtgggggaccctggagagcggggccccccaggccgggccggcctgcccggcagtgatggagcccctggccccccaggcaccagcctgatgctgcccttccgcttcggcagcggcggcggggacaagggccctgtggtggccgcccaggaggcccaggcccaggccatcctgcagcaggcccggctggccctgcggggccccccaggccccatgggctacacaggccggcccggccccctgggccagcccggcagccctggcctgaagggggagagcggggacctgggcccccagggcccccggggcccccagggcctgaccggccccccaggcaaggccggccggcggggccgggccggggctgatggagcccggggcatgcctggggaccccggggtgaagggggaccggggctttgatggcctgcccggcctgcctggagagaagggccacagaggagacaccggggcccagggcctgcccggccccccaggagaagatggagagagaggagatgatggagaaattggcccccggggcctgcctggagagagcggcccccggggcctgctgggccccaagggccccccaggcatccctggccccccaggagtgcggggcatggatggcccccagggccccaagggcagcctgggcccccagggcgagcccggccccccaggccagcagggcaccccaggcacccagggcctgcccggcccccagggcgccatcggcccccatggagagaagggcccccagggcaagccaggcctgcccggcatgcctggcagtgatggccccccaggccaccctgggaaggagggccccccaggcaccaagggcaaccagggccccagcggcccccagggccccctgggctacccaggcccccggggcgtgaagggcgtggatggcatccggggcctgaagggccacaagggggagaagggggaggatggcttccctggcttcaagggggacatcggcgtgaagggggacagaggagaggtgggcgtgcccggcagcagaggagaagatggccctgagggccccaagggccgcacaggccccaccggggaccccggccccccaggcctgatgggagagaagggcaagctgggcgtgcccggcctgcccggctacccaggccggcagggccccaagggcagcctgggcttccctggcttccctggggccagcggggagaagggggcccggggcctgagcggcaagagcggccccagaggagagcggggccccaccggcccccggggccagaggggccccaggggggccaccgggaagagcggggccaagggcaccagcggaggagatggcccccacggccccccaggagagcggggcctgcccggcccccagggccccaacggcttccctggccccaagggccccccaggccccccaggcaaggatggcctgcccggccaccctggccagagaggagaggtgggcttccagggcaagacaggccccccaggccccccaggagtggtgggcccccagggcgctgctggggagaccggccccatgggagagcggggccaccctggccccccaggccccccaggagagcagggcctgcctggaacagctgggaaggagggcaccaagggggaccccggccccccaggggcccctgggaaggatggccctgctggcctgcggggcttccctggagagcggggcctgcctggaacagctgggggccctggcctgaagggaaatgaaggccccagcggccccccaggccctgctggcagccctggagagagaggagctgctggcagcggcggccccatcggccccccaggccggcccggcccccagggccccccaggagctgctggggagaagggcgtgcctggagagaagggccccatcggccccaccggcagagatggagtgcagggccctgtgggcctgcccggccctgctggccccccaggagtggccggggaggatggagacaagggggaggtgggggaccccggccagaagggcaccaagggcaacaagggggagcacggccccccaggccccccaggccccatcggccctgtgggccagcctggagctgctggagcagatggagagcccggggcccggggcccccagggccactttggagccaagggagatgagggcacccggggcttcaatggacctcctggccccatcggcctgcagggcctgcccggccccagcggggagaagggggagactggagatgtgggccccatgggccccccaggccccccaggcccccggggccctgctggccccaatggagcagatggcccccagggccccccaggcggcgtgggcaacctgggccccccaggagagaagggggagcctggagagagcggcagccctggcatccagggcgagcccggggtgaagggccccagaggagagcggggggagaagggggagagcggccagcctggagagcccggccccccaggccccaagggccccactggagatgatggccccaagggcaaccctggccctgtgggcttccctggggaccccggccccccaggagagggcggcccccggggccaggatggagccaagggggacagaggagaagatggagagcccggccagcccggcagccctggccccaccggggagaatggacctcctggccccctgggcaagaggggccctgctggcagccctggcagcgagggccggcagggcggcaaaggagccaagggggaccccggggccatcggggcccctgggaagacaggccctgtgggccctgctggccctgctgggaagccaggcccagatggcctgcggggcctgcccggctctgtgggccagcagggccggcctggggccaccggccaggccggccccccaggccctgtgggccccccaggcctgcccggcctgcggggagatgctggggccaagggggagaagggccaccctggcctcatcggcctgattggccccccaggagagcagggcgagaagggggaccggggcctgcccggcccccagggcagccctggccagaagggggagatgggcatccctggggccagcggccccatcggccctgggggccccccaggcctgcccggccctgctggccccaagggggccaagggggccaccggccctgggggccccaagggggagaagggcgtgcagggccccccaggccaccctggccccccaggagaggtgatccagcccctgcccatccagatgcccaagaagaccaggagatctgtggatggcagccggctgatgcaggaggatgaggccatccccaccggcggggcccctggcagccctgggggcctggaggagatcttcggcagcctggacagcctgcgggaggagattgagcagatgaggcggcccaccggcacccaggacagccctgcccggacctgccaggacctgaagctgtgccaccctgagctgcctgatggagagtactgggtggaccccaaccagggctgtgccagagatgccttccgggtcttctgcaacttcaccgctggaggagagacctgtgtgaccccaagagatgatgtgacccagttctcctatgtggacagcgagggcagccctgtgggcgtggtgcagctgaccttcctgcggctgctgtctgtgtctgcccaccaggatgtgtcctacccctgcagcggggccgccagagatggccccctgcggctgcggggggccaatgaagatgagctgagccctgagaccagcccctacgtgaaggagttcagagatggctgccagacccagcagggccgcacagtgctggaggtgaggacccctgtgctggagcagctgcctgtgctggatgccagcttcagtgacctgggcgcccccccaagaagaggaggagtgctgctgggccctgtgtgcttcatgggctag

SEQ ID NO: 3306 - DNA, 5052 bp, Artificial Sequence
  Description of Artificial Sequence: Synthetic coding sequence
ggggcccctcctgtggatgtgctgcgggccctgcgcttccccagcctgcctgatggagtgagaagagccaagggcatctgcccagcagatgtggcctacagagtggcccggcctgcccagctgagcgcccccacccggcagctgtttcctgggggcttccccaaggacttcagcctgctgactgtggtgaggaccaggcctggcctgcaggcccccctgctgaccctgtacagcgcccagggcgtgcggcagctgggcctggagctgggccggcctgtgcgcttcctgtatgaggaccagacaggccggccccagccccccagccagcccgtcttccggggcctgagcctggctgatggcaagtggcaccgggtggccgtggccgtgaagggccagagcgtgaccctgattgtggactgcaagaagagggtgacccggcccctgcccaggtctgcccggcctgtgctggacacccatggagtcatcatctttggagcccgcatcctggatgaggaggtgtttgaaggagatgtgcaggagctggccatcgtgcctggggtgcaggccgcctatgagagctgtgagcagaaggagctggagtgtgagggcggccagcgggagcggccccagaaccagcagccccaccgggcccagaggagcccccagcagcagcccagccggctgcaccggccccagaaccaggagccccagagccaggaccccaccccaggagaggaggaggagatcctggagagcagcctgctgccccccctggaggaggagcagacagacctgcaggtgcccccaacagctgaccgcttccaggccgaggagtatggagagggcggcacagaccccccagagggcccctatgactacacctacggctatggagatgactaccgggaggagacagagctgggccctgccctgtctgctgagacagcccacagcggggctgctgcccacggcccccggggcctgaagggggagaagggggagcctgctgtgctggagcccggcatgctggtggagggccccccaggccctgagggccctgctggcctgattggccccccaggcatccagggcaaccctggccctgtgggggaccccggggagcggggccccccaggccgggccggcctgcccggcagtgatggagcccctggccccccaggcaccagcctgatgctgcccttccgctttggaagtggcggcggggacaagggccctgtggtggccgcccaggaggcccaggcccaggccatcctgcagcaggcccggctggccctgcggggccccccaggccccatgggctacacaggccggcccggccccctgggccagcccggcagccctggcctgaagggggagagcggggacctgggcccccagggcccccggggcccccagggcctgactggacctcctgggaaggccggcagaagaggccgggccggggctgatggagcccggggcatgcctggggaccccggggtgaagggggaccggggctttgatggcctgcccggcctgcccggggagaagggccacagaggagacacaggagcccagggcctgcccggccccccaggagaagatggagagagaggagatgatggagagatcggcccccggggcctgcccggggagagcggcccccggggcctgctgggccccaagggccccccaggcatccctggccccccaggagtgcggggcatggatggcccccagggccccaagggcagcctgggcccccagggcgagcccggccccccaggccagcagggcaccccaggcacccagggcctgcccggcccccagggcgccatcggcccccacggggagaagggcccccagggcaagccaggcctgcccggcatgcctggcagtgatggccccccaggccaccctgggaaggagggccccccaggcaccaagggcaaccagggccccagcggcccccagggccccctgggctacccaggcccccggggcgtgaagggcgtggatggcatccggggcctgaagggccacaagggggagaagggagaagatggcttccctggcttcaagggggacattggagtgaagggggacagaggagaggtgggcgtgcccggcagcagaggagaagatggccctgagggccccaagggccgcacaggccccactggagaccccggccccccaggcctgatgggagagaagggcaagctgggcgtgcccggcctgcccggctacccaggccggcagggccccaagggcagcctgggcttccctggcttccctggggccagcggggagaagggggcccggggcctgagcggcaagagcggccccagaggagagcggggccccaccggcccccggggccagaggggccccaggggggccaccgggaagagcggggccaagggcaccagcggaggagatggcccccacggccccccaggagagcggggcctgcccggcccccagggccccaacggcttccctggccccaagggccccccaggccccccaggcaaggatggcctgcccggccaccctggccagagaggagaggtgggcttccagggcaagacaggccccccaggccccccaggagtggtgggcccccagggcgccgccggggagaccggccccatgggagagcggggccaccctggccccccaggccccccaggagagcagggcctgcccggcacagctgggaaggagggcaccaagggggaccccggccccccaggggcccctgggaaggatggccctgctggcctgcggggcttccctggagagcggggcctgcccggcacagctgggggccctggcctgaagggaaatgaaggccccagcggccccccaggccctgctggcagccctggagagagaggagctgctggcagcggcggccccatcggccccccaggccggcccggcccccagggccccccaggagctgctggggagaagggcgtgcctggagagaagggccccatcggccccaccggcagagatggagtgcagggccctgtgggcctgcccggccctgctggccccccaggagtggccggagaagatggagacaagggggaggtgggggaccccggccagaagggcaccaagggcaacaagggggagcacggccccccaggccccccaggccccatcggccctgtgggccagcccggggctgctggagcagatggagagcccggggcccggggcccccagggccactttggagccaagggagatgagggcacccggggcttcaacggccccccaggccccatcggcctgcagggcctgcccggccccagcggggagaagggggagactggagatgtgggccccatgggccccccaggccccccaggcccccggggccctgctggccccaacggggctgatggcccccagggccccccaggaggagtgggcaacctgggccccccaggagagaagggggagcccggggagagcggcagccctggcatccagggcgagcccggggtgaagggccccagaggagagcggggggagaagggggagagcggccagcccggggagcccggccccccaggccccaagggccccactggagatgatggccccaagggcaaccctggccctgtgggcttccctggggaccccggccccccaggagagggcggcccccggggccaggatggagccaagggggacagaggagaagatggagagcccggccagcccggcagccctggccccactggagaaaatggccccccaggccccctgggcaagaggggccctgctggcagccctggcagcgagggccggcagggcggcaagggggccaagggggaccccggggccatcggggcccctgggaagacaggccctgtgggccctgctggccctgctgggaagccaggcccagatggcctgcggggcctgcccggctctgtgggccagcagggccggcctggggccaccggccaggccggccccccaggccctgtgggccccccaggcctgcccggcctgcggggagatgctggggccaagggggagaagggccaccctggcctgattggcctcatcggccccccaggagagcagggcgagaagggggaccggggcctgcccggcccccagggcagccctggccagaagggggagatgggcatccctggggccagcggccccatcggccctgggggccccccaggcctgcccggccctgctggccccaagggggccaagggggccactggacctgggggccccaagggggagaagggcgtgcagggccccccaggccaccctggccccccaggagaggtgatccagcccctgcccatccagatgcccaagaagacccggcgctctgtggatggcagccggctgatgcaggaggatgaggccatccccactggaggagcccctggcagccctgggggcctggaggagatcttcggcagcctggacagcctgcgggaggagattgagcagatgagaagacccaccggcacccaggacagccctgcccggacctgccaggacctgaagctgtgccaccctgagctgcctgatggagagtactgggtggaccccaaccagggctgtgccagagatgccttccgggtcttctgcaacttcaccgctggaggagagacctgtgtgaccccaagagatgatgtgacccagttctcctatgtggacagcgagggcagccctgtgggcgtggtgcagctgaccttcctgcggctgctgtctgtgtctgcccaccaggatgtgtcctacccctgcagcggggccgccagagatggccccctgcggctgcggggggccaatgaagatgagctgagccctgagaccagcccctacgtgaaggagttcagagatggctgccagacccagcagggccgcacagtgctggaggtgaggacccctgtgctggagcagctgcctgtgctggatgccagcttcagtgacctgggcgccccaccccggcggggcggcgtgctgctgggccctgtgtgcttcatgggctag

SEQ ID NO: 3307 - DNA, 5133 bp, Artificial Sequence; identical to SEQ ID NO: 3272
  Description of Artificial Sequence: Synthetic coding sequence

SEQ ID NO: 3308 - DNA, 5133 bp, Artificial Sequence; identical to SEQ ID NO: 3272
  Description of Artificial Sequence: Synthetic coding sequence

SEQ ID NO: 3309 - DNA, 5031 bp, Artificial Sequence
  Description of Artificial Sequence: Synthetic coding sequence
atggagcgctgcagccgctgccaccggctgctgctgctgctgcccctggtgctgggcctgtctgctgcccctggctgggccggggcccctcctgtggatgtgctgcgggccctgcgcttccccagcctgcctgatggagtgcggcgggccaagggcatctgcccagcagatgtggcctacagagtggcccggcctgcccagctgagcgcccccacccggcagctgtttcctgggggcttccccaaggacttcagcctgctgactgtggtgaggacccggcccggcctgcaggcccccctgctgaccctgtacagcgcccagggcgtgcggcagctgggcctggagctgggccggcctgtgcgcttcctgtatgaggaccagacaggccggccccagccccccagccagcctgtgttccggggcctgagcctggctgatggcaagtggcaccgggtggccgtggccgtgaagggccagagcgtgaccctcatcgtggactgcaagaagagggtgacccggcccctgcccaggtctgcccggcctgtgctggacacccacggcgtcatcatctttggagcccgcatcctggatgaggaggtgtttgaaggagatgtgcaggagctggccatcgtgcctggggtgcaggccgcctatgagagctgtgagcagaaggagctggagtgtgagggcggccagcgggagcggccccagaaccagcagccccaccgggcccagaggagcccccagcagcagcccagccggctgcaccggccccagaaccaggagccccagagccagcccacagagagcctgtactatgactatgagcccccctactatgatgtgatgaccaccggcaccaccccagactaccaggaccccaccccaggagaggaggaggagatcctggagagcagcctgctgccccccctggaggaggccgcccacggcccccggggcctgaagggggagaagggggagcctgctgtgctggagcccggcatgctggtggagggccccccaggccctgagggccctgctggcctcatcggccccccaggcatccagggcaaccctggccctgtgggggaccctggagagcggggccccccaggccgggccggcctgcccggcagtgatggagcccctggccccccaggcaccagcctgatgctgcccttccgcttcggcagcggcggcggggacaagggccctgtggtggccgcccaggaggcccaggcccaggccatcctgcagcaggcccggctggccctgcggggccccccaggccccatgggctacacaggccggcccggccccctgggccagcccggcagccctggcctgaagggggagagcggggacctgggcccccagggcccccggggcccccagggcctgaccggccccccaggcaaggccggccggcggggccgggccggggctgatggagcccggggcatgcctggggaccccggggtgaagggggaccggggctttgatggcctgcccggcctgcctggagagaagggccacagaggagacaccggggcccagggcctgcccggccccccaggagaagatggagagagaggagatgatggagaaattggcccccggggcctgcctggagagagcggcccccggggcctgctgggccccaagggccccccaggcatccctggccccccaggagtgcggggcatggatggcccccagggccccaagggcagcctgggcccccagggcgagcccggccccccaggccagcagggcaccccaggcacccagggcctgcccggcccccagggcgccatcggcccccatggagagaagggcccccagggcaagccaggcctgcccggcatgcctggcagtgatggccccccaggccaccctgggaaggagggccccccaggcaccaagggcaaccagggccccagcggcccccagggccccctgggctacccaggcccccggggcgtgaagggcgtggatggcatccggggcctgaagggccacaagggggagaagggggaggatggcttccctggcttcaagggggacatcggcgtgaagggggacagaggagaggtgggcgtgcccggcagcagaggagaagatggccctgagggccccaagggccgcacaggccccaccggggaccccggccccccaggcctgatgggagagaagggcaagctgggcgtgcccggcctgcccggctacccaggccggcagggccccaagggcagcctgggcttccctggcttccctggggccagcggggagaagggggcccggggcctgagcggcaagagcggccccagaggagagcggggccccaccggcccccggggccagaggggccccaggggggccaccgggaagagcggggccaagggcaccagcggaggagatggcccccacggccccccaggagagcggggcctgcccggcccccagggccccaacggcttccctggccccaagggccccctgggccccccaggcaaggatggcctgcccggccaccctggccagagaggagaggtgggcttccagggcaagacaggccccccaggccccccaggagtggtgggcccccagggcgctgctggggagaccggccccatgggagagcggggccaccctggccccccaggccccccaggagagcagggcctgcctggaacagctgggaaggagggcaccaagggggaccccggccccccaggggcccctgggaaggatggccctgctggcctgcggggcttccctggagagcggggcctgcctggaacagctgggggccctggcctgaagggaaatgaaggccccagcggccccccaggccctgctggcagccctggagagagaggagctgctggcagcggcggccccatcggccccccaggccggcccggcccccagggccccccaggagctgctggggagaagggcgtgcctggagagaagggccccatcggccccaccggcagagatggagtgcagggccctgtgggcctgcccggccctgctggccccccaggagtggccggggaggatggagacaagggggaggtgggggaccccggccagaagggcaccaagggcaacaagggggagcacggccccccaggccccccaggccccatcggccctgtgggccagcctggagctgctggagcagatggagagcccggggcccggggcccccagggccactttggagccaagggagatgagggcacccggggcttcaatggacctcctggccccatcggcctgcagggcctgcccggccccagcggggagaagggggagactggagatgtgggccccatgggccccccaggccccccaggcccccggggccctgctggccccaatggagcagatggcccccagggccccccaggcggcgtgggcaacctgggccccccaggagagaagggggagcctggagagagcggcagccctggcatccagggcgagcccggggtgaagggccccagaggagagcggggggagaagggggagagcggccagcctggagagcccggccccccaggccccaagggccccactggagatgatggccccaagggcaaccctggccctgtgggcttccctggggaccccggccccccaggagagggcggcccccggggccaggatggagccaagggggacagaggagaagatggagagcccggccagcccggcagccctggccccaccggggagaatggacctcctggccccctgggcaagaggggccctgctggcagccctggcagcgagggccggcagggcggcaaaggagccaagggggaccccggggccatcggggcccctgggaagacaggccctgtgggccctgctggccctgctgggaagccaggcccagatggcctgcggggcctgcccggctctgtgggccagcagggccggcctggggccaccggccaggccggccccccaggccctgtgggccccccaggcctgcccggcctgcggggagatgctggggccaagggggagaagggccaccctggcctcatcggcctgattggccccccaggagagcagggcgagaagggggaccggggcctgcccggcccccagggcagccctggccagaagggggagatgggcatccctggggccagcggccccatcggccctgggggccccccaggcctgcccggccctgctggccccaagggggccaagggggccaccggccctgggggccccaagggggagaagggcgtgcagggccccccaggccaccctggccccccaggagaggtgatccagcccctgcccatccagatgcccaagaagaccaggagatctgtggatggcagccggctgatgcaggaggatgaggccatccccaccggcggggcccctggcagccctgggggcctggaggagatcttcggcagcctggacagcctgcgggaggagattgagcagatgaggcggcccaccggcacccaggacagccctgcccggacctgccaggacctgaagctgtgccaccctgagctgcctgatggagagtactgggtggaccccaaccagggctgtgccagagatgccttccgggtcttctgcaacttcaccgctggaggagagacctgtgtgaccccaagagatgatgtgacccagttctcctatgtggacagcgagggcagccctgtgggcgtggtgcagctgaccttcctgcggctgctgtctgtgtctgcccaccaggatgtgtcctacccctgcagcggggccgccagagatggccccctgcggctgcggggggccaatgaagatgagctgagccctgagaccagcccctacgtgaaggagttcagagatggctgccagacccagcagggccgcacagtgctggaggtgaggacccctgtgctggagcagctgcctgtgctggatgccagcttcagtgacctgggcgcccccccaagaagaggaggagtgctgctgggccctgtgtgcttcatgggctag

SEQ ID NO: 3310 - DNA, 921 bp, Artificial Sequence; identical to SEQ ID NO: 3277
  Description of Artificial Sequence: Synthetic coding sequence

SEQ ID NO: 3311 - DNA, 5070 bp, Artificial Sequence
  Description of Artificial Sequence: Synthetic coding sequence
atggagcgctgcagccgctgccaccggctgctgctgctgctgcccctggtgctgggcctgtctgctgcccctggctgggccggggcccctcctgtggatgtgctgcgggccctgcgcttccccagcctgcctgatggagtgcggcgggccaagggcatctgcccagcagatgtggcctacagagtggcccggcctgcccagctgagcgcccccacccggcagctgtttcctgggggcttccccaaggacttcagcctgctgactgtggtgaggacccggcccggcctgcaggcccccctgctgaccctgtacagcgcccagggcgtgcggcagctgggcctggagctgggccggcctgtgcgcttcctgtatgaggaccagacaggccggccccagccccccagccagcctgtgttccggggcctgagcctggctgatggcaagtggcaccgggtggccgtggccgtgaagggccagagcgtgaccctcatcgtggactgcaagaagagggtgacccggcccctgcccaggtctgcccggcctgtgctggacacccacggcgtcatcatctttggagcccgcatcctggatgaggaggtgtttgaaggagatgtgcaggagctggccatcgtgcctggggtgcaggccgcctatgagagctgtgagcagaaggagctggagtgtgagggcggccagcgggagcggccccagaaccagcagccccaccgggcccagaggagcccccagcagcagcccagccggctgcaccggccccagaaccaggagccccagagccaggagcagacagacctgcaggtgcccccaacagctgaccgcttccaggccgaggagtatggagagggcggcacagaccccccagagggcccctatgactacacctacggctatggagatgactaccgggaggagacagagctgggccctgccctgtctgctgagacagcccacagcggggctgctgcccacggcccccggggcctgaagggggagaagggggagcctgctgtgctggagcccggcatgctggtggagggccccccaggccctgagggccctgctggcctgattggccccccaggcatccagggcaaccctggccctgtgggggaccccggggagcggggccccccaggccgggccggcctgcccggcagtgatggagcccctggccccccaggcaccagcctgatgctgcccttccgctttggaagtggcggcggggacaagggccctgtggtggccgcccaggaggcccaggcccaggccatcctgcagcaggcccggctggccctgcggggccccccaggccccatgggctacacaggccggcccggccccctgggccagcccggcagccctggcctgaagggggagagcggggacctgggcccccagggcccccggggcccccagggcctgactggacctcctgggaaggccggcagaagaggccgggccggggctgatggagcccggggcatgcctggggaccccggggtgaagggggaccggggctttgatggcctgcccggcctgcccggggagaagggccacagaggagacacaggagcccagggcctgcccggccccccaggagaagatggagagagaggagatgatggagagatcggcccccggggcctgcccggggagagcggcccccggggcctgctgggccccaagggccccccaggcatccctggccccccaggagtgcggggcatggatggcccccagggccccaagggcagcctgggcccccagggcgagcccggccccccaggccagcagggcaccccaggcacccagggcctgcccggcccccagggcgccatcggcccccacggggagaagggcccccagggcaagccaggcctgcccggcatgcctggcagtgatggccccccaggccaccctgggaaggagggccccccaggcaccaagggcaaccagggccccagcggcccccagggccccctgggctacccaggcccccggggcgtgaagggcgtggatggcatccggggcctgaagggccacaagggggagaagggagaagatggcttccctggcttcaagggggacattggagtgaagggggacagaggagaggtgggcgtgcccggcagcagaggagaagatggccctgagggccccaagggccgcacaggccccactggagaccccggccccccaggcctgatgggagagaagggcaagctgggcgtgcccggcctgcccggctacccaggccggcagggccccaagggcagcctgggcttccctggcttccctggggccagcggggagaagggggcccggggcctgagcggcaagagcggccccagaggagagcggggccccaccggcccccggggccagaggggccccaggggggccaccgggaagagcggggccaagggcaccagcggaggagatggcccccacggccccccaggagagcggggcctgcccggcccccagggccccaacggcttccctggccccaagggccccctgggccccccaggcaaggatggcctgcccggccaccctggccagagaggagaggtgggcttccagggcaagacaggccccccaggccccccaggagtggtgggcccccagggcgccgccggggagaccggccccatgggagagcggggccaccctggccccccaggccccccaggagagcagggcctgcccggcacagctgggaaggagggcaccaagggggaccccggccccccaggggcccctgggaaggatggccctgctggcctgcggggcttccctggagagcggggcctgcccggcacagctgggggccctggcctgaagggaaatgaaggccccagcggccccccaggccctgctggcagccctggagagagaggagctgctggcagcggcggccccatcggccccccaggccggcccggcccccagggccccccaggagctgctggggagaagggcgtgcctggagagaagggccccatcggccccaccggcagagatggagtgcagggccctgtgggcctgcccggccctgctggccccccaggagtggccggagaagatggagacaagggggaggtgggggaccccggccagaagggcaccaagggcaacaagggggagcacggccccccaggccccccaggccccatcggccctgtgggccagcccggggctgctggagcagatggagagcccggggcccggggcccccagggccactttggagccaagggagatgagggcacccggggcttcaacggccccccaggccccatcggcctgcagggcctgcccggccccagcggggagaagggggagactggagatgtgggccccatgggccccccaggccccccaggcccccggggccctgctggccccaacggggctgatggcccccagggccccccaggaggagtgggcaacctgggccccccaggagagaagggggagcccggggagagcggcagccctggcatccagggcgagcccggggtgaagggccccagaggagagcggggggagaagggggagagcggccagcccggggagcccggccccccaggccccaagggccccactggagatgatggccccaagggcaaccctggccctgtgggcttccctggggaccccggccccccaggagagggcggcccccggggccaggatggagccaagggggacagaggagaagatggagagcccggccagcccggcagccctggccccactggagaaaatggccccccaggccccctgggcaagaggggccctgctggcagccctggcagcgagggccggcagggcggcaagggggccaagggggaccccggggccatcggggcccctgggaagacaggccctgtgggccctgctggccctgctgggaagccaggcccagatggcctgcggggcctgcccggctctgtgggccagcagggccggcctggggccaccggccaggccggccccccaggccctgtgggccccccaggcctgcccggcctgcggggagatgctggggccaagggggagaagggccaccctggcctgattggcctcatcggccccccaggagagcagggcgagaagggggaccggggcctgcccggcccccagggcagccctggccagaagggggagatgggcatccctggggccagcggccccatcggccctgggggccccccaggcctgcccggccctgctggccccaagggggccaagggggccactggacctgggggccccaagggggagaagggcgtgcagggccccccaggccaccctggccccccaggagaggtgatccagcccctgcccatccagatgcccaagaagacccggcgctctgtggatggcagccggctgatgcaggaggatgaggccatccccactggaggagcccctggcagccctgggggcctggaggagatcttcggcagcctggacagcctgcgggaggagattgagcagatgagaagacccaccggcacccaggacagccctgcccggacctgccaggacctgaagctgtgccaccctgagctgcctgatggagagtactgggtggaccccaaccagggctgtgccagagatgccttccgggtcttctgcaacttcaccgctggaggagagacctgtgtgaccccaagagatgatgtgacccagttctcctatgtggacagcgagggcagccctgtgggcgtggtgcagctgaccttcctgcggctgctgtctgtgtctgcccaccaggatgtgtcctacccctgcagcggggccgccagagatggccccctgcggctgcggggggccaatgaagatgagctgagccctgagaccagcccctacgtgaaggagttcagagatggctgccagacccagcagggccgcacagtgctggaggtgaggacccctgtgctggagcagctgcctgtgctggatgccagcttcagtgacctgggcgccccaccccggcggggcggcgtgctgctgggccctgtgtgcttcatgggctag

SEQ ID NO: 3312 - DNA, 4890 bp, Artificial Sequence; identical to SEQ ID NO: 3268
  Description of Artificial Sequence: Synthetic coding sequence

SEQ ID NO: 3313 - DNA, 5211 bp, Artificial Sequence
  Description of Artificial Sequence: Synthetic coding sequence
atggagcgctgcagccgctgccaccggctgctgctgctgctgcccctggtgctgggcctgtctgctgcccctggctgggccggggcccctcctgtggatgtgctgcgggccctgcgcttccccagcctgcctgatggagtgcggcgggccaagggcatctgcccagcagatgtggcctacagagtggcccggcctgcccagctgagcgcccccacccggcagctgtttcctgggggcttccccaaggacttcagcctgctgactgtggtgaggacccggcccggcctgcaggcccccctgctgaccctgtacagcgcccagggcgtgcggcagctgggcctggagctgggccggcctgtgcgcttcctgtatgaggaccagacaggccggccccagccccccagccagcctgtgttccggggcctgagcctggctgatggcaagtggcaccgggtggccgtggccgtgaagggccagagcgtgaccctcatcgtggactgcaagaagagggtgacccggcccctgcccaggtctgcccggcctgtgctggacacccacggcgtcatcatctttggagcccgcatcctggatgaggaggtgtttgaaggagatgtgcaggagctggccatcgtgcctggggtgcaggccgcctatgagagctgtgagcagaaggagctggagtgtgagggcggccagcgggagcggccccagaaccagcagccccaccgggcccagaggagcccccagcagcagcccagccggctgcaccggccccagaaccaggagccccagagccagcccacagagagcctgtactatgactatgagcccccctactatgatgtgatgaccaccggcaccaccccagactaccaggaccccaccccaggagaggaggaggagatcctggagagcagcctgctgccccccctggaggaggagcagacagacctgcaggtgcccccaacagctgaccgcttccaggccgaggagtatggagagggcggcacagatcctcctgagggcccctatgactacacctacggctatggagatgactaccgggaggagacagagctgggccctgccctgtctgctgagacagcccacagcggggccgccgcccacggcccccggggcctgaagggggagaagggggagcctgctgtgctggagcccggcatgctggtggagggccccccaggccctgagggccctgctggcctcatcggccccccaggcatccagggcaaccctggccctgtgggggaccctggagagcggggccccccaggccgggccggcctgcccggcagtgatggagcccctggccccccaggcaccagcctgatgctgcccttccgcttcggcagcggcggcggggacaagggccctgtggtggccgcccaggaggcccaggcccaggccatcctgcagcaggcccggctggccctgcggggccccccaggccccatgggctacacaggccggcccggccccctgggccagcccggcagccctggcctgaagggggagagcggggacctgggcccccagggcccccggggcccccagggcctgaccggccccccaggcaaggccggccggcggggccgggccggggctgatggagcccggggcatgcctggggaccccggggtgaagggggaccggggctttgatggcctgcccggcctgcctggagagaagggccacagaggagacaccggggcccagggcctgcccggccccccaggagaagatggagagagaggagatgatggagaaattggcccccggggcctgcctggagagagcggcccccggggcctgctgggccccaagggccccccaggcatccctggccccccaggagtgcggggcatggatggcccccagggccccaagggcagcctgggcccccagggcgagcccggccccccaggccagcagggcaccccaggcacccagggcctgcccggcccccagggcgccatcggcccccatggagagaagggcccccagggcaagccaggcctgcccggcatgcctggcagtgatggccccccaggccaccctgggaaggagggccccccaggcaccaagggcaaccagggccccagcggcccccagggccccctgggctacccaggcccccggggcgtgaagggcgtggatggcatccggggcctgaagggccacaagggggagaagggggaggatggcttccctggcttcaagggggacatcggcgtgaagggggacagaggagaggtgggcgtgcccggcagcagaggagaagatggccctgagggccccaagggccgcacaggccccaccggggaccccggccccccaggcctgatgggagagaagggcaagctgggcgtgcccggcctgcccggctacccaggccggcagggccccaagggcagcctgggcttccctggcttccctggggccagcggggagaagggggcccggggcctgagcggcaagagcggccccagaggagagcggggccccaccggcccccggggccagaggggccccaggggggccaccgggaagagcggggccaagggcaccagcggaggagatggcccccacggccccccaggagagcggggcctgcccggcccccagggccccaacggcttccctggccccaagggccccctgggccccccaggcaaggatggcctgcccggccaccctggccagagaggagaggtgggcttccagggcaagacaggccccccaggccccccaggagtggtgggcccccagggcgctgctggggagaccggccccatgggagagcggggccaccctggccccccaggccccccaggagagcagggcctgcctggaacagctgggaaggagggcaccaagggggaccccggccccccaggggcccctgggaaggatggccctgctggcctgcggggcttccctggagagcggggcctgcctggaacagctgggggccctggcctgaagggaaatgaaggccccagcggccccccaggccctgctggcagccctggagagagaggagctgctggcagcggcggccccatcggccccccaggccggcccggcccccagggccccccaggagctgctggggagaagggcgtgcctggagagaagggccccatcggccccaccggcagagatggagtgcagggccctgtgggcctgcccggccctgctggccccccaggagtggccggggaggatggagacaagggggaggtgggggaccccggccagaagggcaccaagggcaacaagggggagcacggccccccaggccccccaggccccatcggccctgtgggccagcctggagctgctggagcagatggagagcccggggcccggggcccccagggccactttggagccaagggagatgagggcacccggggcttcaatggacctcctggccccatcggcctgcagggcctgcccggccccagcggggagaagggggagactggagatgtgggccccatgggccccccaggccccccaggcccccggggccctgctggccccaatggagcagatggcccccagggccccccaggcggcgtgggcaacctgggccccccaggagagaagggggagcctggagagagcggcagccctggcatccagggcgagcccggggtgaagggccccagaggagagcggggggagaagggggagagcggccagcctggagagcccggccccccaggccccaagggccccactggagatgatggccccaagggcaaccctggccctgtgggcttccctggggaccccggccccccaggagagggcggcccccggggccaggatggagccaagggggacagaggagaagatggagagcccggccagcccggcagccctggccccaccggggagaatggacctcctggccccctgggcaagaggggccctgctggcagccctggcagcgagggccggcagggcggcaaaggagccaagggggaccccggggccatcggggcccctgggaagacaggccctgtgggccctgctggccctgctgggaagccaggcccagatggcctgcggggcctgcccggctctgtgggccagcagggccggcctggggccaccggccaggccggccccccaggccctgtgggccccccaggcctgcccggcctgcggggagatgctggggccaagggggagaagggccaccctggcctcatcggcctgattggccccccaggagagcagggcgagaagggggaccggggcctgcccggcccccagggcagccctggccagaagggggagatgggcatccctggggccagcggccccatcggccctgggggccccccaggcctgcccggccctgctggccccaagggggccaagggggccaccggccctgggggccccaagggggagaagggcgtgcagggccccccaggccaccctggccccccaggagaggtgatccagcccctgcccatccagatgcccaagaagaccaggagatctgtggatggcagccggctgatgcaggaggatgaggccatccccaccggcggggcccctggcagccctgggggcctggaggagatcttcggcagcctggacagcctgcgggaggagattgagcagatgaggcggcccaccggcacccaggacagccctgcccggacctgccaggacctgaagctgtgccaccctgagctgcctgatggagagtactgggtggaccccaaccagggctgtgccagagatgccttccgggtcttctgcaacttcaccgctggaggagagacctgtgtgaccccaagagatgatgtgacccagttctcctatgtggacagcgagggcagccctgtgggcgtggtgcagctgaccttcctgcggctgctgtctgtgtctgcccaccaggatgtgtcctacccctgcagcggggccgccagagatggccccctgcggctgcggggggccaatgaagatgagctgagccctgagaccagcccctacgtgaaggagttcagagatggctgccagacccagcagggccgcacagtgctggaggtgaggacccctgtgctggagcagctgcctgtgctggatgccagcttcagtgacctgggcgcccccccaagaagaggaggagtgctgctgggccctgtgtgcttcatgggctag

SEQ ID NO: 3314 - DNA, 5211 bp, Artificial Sequence
  Description of Artificial Sequence: Synthetic coding sequence
atggagcgctgcagccgctgccaccggctgctgctgctgctgcccctggtgctgggcctgtctgctgcccctggctgggccggggcccctcctgtggatgtgctgcgggccctgcgcttccccagcctgcctgatggagtgcggcgggccaagggcatctgcccagcagatgtggcctacagagtggcccggcctgcccagctgagcgcccccacccggcagctgtttcctgggggcttccccaaggacttcagcctgctgactgtggtgaggacccggcccggcctgcaggcccccctgctgaccctgtacagcgcccagggcgtgcggcagctgggcctggagctgggccggcctgtgcgcttcctgtatgaggaccagacaggccggccccagccccccagccagcctgtgttccggggcctgagcctggctgatggcaagtggcaccgggtggccgtggccgtgaagggccagagcgtgaccctcatcgtggactgcaagaagagggtgacccggcccctgcccaggtctgcccggcctgtgctggacacccacggcgtcatcatctttggagcccgcatcctggatgaggaggtgtttgaaggagatgtgcaggagctggccatcgtgcctggggtgcaggccgcctatgagagctgtgagcagaaggagctggagtgtgagggcggccagcgggagcggccccagaaccagcagccccaccgggcccagaggagcccccagcagcagcccagccggctgcaccggccccagaaccaggagccccagagccagcccacagagagcctgtactatgactacaagccaccctactatgatgtgatgaccaccggcaccaccccagactaccaggaccccaccccaggagaggaggaggagatcctggagagcagcctgctgccccccctggaggaggagcagacagacctgcaggtgcccccaacagctgaccgcttccaggccgaggagtatggagagggcggcacagatcctcctgagggcccctatgactacacctacggctatggagatgactaccgggaggagacagagctgggccctgccctgtctgctgagacagcccacagcggggccgccgcccacggcccccggggcctgaagggggagaagggggagcctgctgtgctggagcccggcatgctggtggagggccccccaggccctgagggccctgctggcctcatcggccccccaggcatccagggcaaccctggccctgtgggggaccctggagagcggggccccccaggccgggccggcctgcccggcagtgatggagcccctggccccccaggcaccagcctgatgctgcccttccgcttcggcagcggcggcggggacaagggccctgtggtggccgcccaggaggcccaggcccaggccatcctgcagcaggcccggctggccctgcggggccccccaggccccatgggctacacaggccggcccggccccctgggccagcccggcagccctggcctgaagggggagagcggggacctgggcccccagggcccccggggcccccagggcctgaccggccccccaggcaaggccggccggcggggccgggccggggctgatggagcccggggcatgcctggggaccccggggtgaagggggaccggggctttgatggcctgcccggcctgcctggagagaagggccacagaggagacaccggggcccagggcctgcccggccccccaggagaagatggagagagaggagatgatggagaaattggcccccggggcctgcctggagagagcggcccccggggcctgctgggccccaagggccccccaggcatccctggccccccaggagtgcggggcatggatggcccccagggccccaagggcagcctgggcccccagggcgagcccggccccccaggccagcagggcaccccaggcacccagggcctgcccggcccccagggcgccatcggcccccatggagagaagggcccccagggcaagccaggcctgcccggcatgcctggcagtgatggccccccaggccaccctgggaaggagggccccccaggcaccaagggcaaccagggccccagcggcccccagggccccctgggctacccaggcccccggggcgtgaagggcgtggatggcatccggggcctgaagggccacaagggggagaagggggaggatggcttccctggcttcaagggggacatcggcgtgaagggggacagaggagaggtgggcgtgcccggcagcagaggagaagatggccctgagggccccaagggccgcacaggccccaccggggaccccggccccccaggcctgatgggagagaagggcaagctgggcgtgcccggcctgcccggctacccaggccggcagggccccaagggcagcctgggcttccctggcttccctggggccagcggggagaagggggcccggggcctgagcggcaagagcggccccagaggagagcggggccccaccggcccccggggccagaggggccccaggggggccaccgggaagagcggggccaagggcaccagcggaggagatggcccccacggccccccaggagagcggggcctgcccggcccccagggccccaacggcttccctggccccaagggccccccaggccccccaggcaaggatggcctgcccggccaccctggccagagaggagaggtgggcttccagggcaagacaggccccccaggccccccaggagtggtgggcccccagggcgctgctggggagaccggccccatgggagagcggggccaccctggccccccaggccccccaggagagcagggcctgcctggaacagctgggaaggagggcaccaagggggaccccggccccccaggggcccctgggaaggatggccctgctggcctgcggggcttccctggagagcggggcctgcctggaacagctgggggccctggcctgaagggaaatgaaggccccagcggccccccaggccctgctggcagccctggagagagaggagctgctggcagcggcggccccatcggccccccaggccggcccggcccccagggccccccaggagctgctggggagaagggcgtgcctggagagaagggccccatcggccccaccggcagagatggagtgcagggccctgtgggcctgcccggccctgctggccccccaggagtggccggggaggatggagacaagggggaggtgggggaccccggccagaagggcaccaagggcaacaagggggagcacggccccccaggccccccaggccccatcggccctgtgggccagcctggagctgctggagcagatggagagcccggggcccggggcccccagggccactttggagccaagggagatgagggcacccggggcttcaatggacctcctggccccatcggcctgcagggcctgcccggccccagcggggagaagggggagactggagatgtgggccccatgggccccccaggccccccaggcccccggggccctgctggccccaatggagcagatggcccccagggccccccaggcggcgtgggcaacctgggccccccaggagagaagggggagcctggagagagcggcagccctggcatccagggcgagcccggggtgaagggccccagaggagagcggggggagaagggggagagcggccagcctggagagcccggccccccaggccccaagggccccactggagatgatggccccaagggcaaccctggccctgtgggcttccctggggaccccggccccccaggagagggcggcccccggggccaggatggagccaagggggacagaggagaagatggagagcccggccagcccggcagccctggccccaccggggagaatggacctcctggccccctgggcaagaggggccctgctggcagccctggcagcgagggccggcagggcggcaaaggagccaagggggaccccggggccatcggggcccctgggaagacaggccctgtgggccctgctggccctgctgggaagccaggcccagatggcctgcggggcctgcccggctctgtgggccagcagggccggcctggggccaccggccaggccggccccccaggccctgtgggccccccaggcctgcccggcctgcggggagatgctggggccaagggggagaagggccaccctggcctcatcggcctgattggccccccaggagagcagggcgagaagggggaccggggcctgcccggcccccagggcagccctggccagaagggggagatgggcatccctggggccagcggccccatcggccctgggggccccccaggcctgcccggccctgctggccccaagggggccaagggggccaccggccctgggggccccaagggggagaagggcgtgcagggccccccaggccaccctggccccccaggagaggtgatccagcccctgcccatccagatgcccaagaagaccaggagatctgtggatggcagccggctgatgcaggaggatgaggccatccccaccggcggggcccctggcagccctgggggcctggaggagatcttcggcagcctggacagcctgcgggaggagattgagcagatgaggcggcccaccggcacccaggacagccctgcccggacctgccaggacctgaagctgtgccaccctgagctgcctgatggagagtactgggtggaccccaaccagggctgtgccagagatgccttccgggtcttctgcaacttcaccgctggaggagagacctgtgtgaccccaagagatgatgtgacccagttctcctatgtggacagcgagggcagccctgtgggcgtggtgcagctgaccttcctgcggctgctgtctgtgtctgcccaccaggatgtgtcctacccctgcagcggggccgccagagatggccccctgcggctgcggggggccaatgaagatgagctgagccctgagaccagcccctacgtgaaggagttcagagatggctgccagacccagcagggccgcacagtgctggaggtgaggacccctgtgctggagcagctgcctgtgctggatgccagcttcagtgacctgggcgcccccccaagaagaggaggagtgctgctgggccctgtgtgcttcatgggctag

SEQ ID NO: 3315 - DNA, 5211 bp, Artificial Sequence; identical to SEQ ID NO: 3314
  Description of Artificial Sequence: Synthetic coding sequence

SEQ ID NO: 3316 - DNA, 5070 bp, Artificial Sequence; identical to SEQ ID NO: 3271
  Description of Artificial Sequence: Synthetic coding sequence

SEQ ID NO: 3317 - DNA, 921 bp, Artificial Sequence; identical to SEQ ID NO: 3277
  Description of Artificial Sequence: Synthetic coding sequence

SEQ ID NO: 3318 - DNA, 5133 bp, Artificial Sequence
  Description of Artificial Sequence: Synthetic coding sequence
atggagcgctgcagccgctgccaccggctgctgctgctgctgcccctggtgctgggcctgtctgctgcccctggctgggccggggcccctcctgtggatgtgctgcgggccctgcgcttccccagcctgcctgatggagtgcggcgggccaagggcatctgcccagcagatgtggcctacagagtggcccggcctgcccagctgagcgcccccacccggcagctgtttcctgggggcttccccaaggacttcagcctgctgactgtggtgaggacccggcccggcctgcaggcccccctgctgaccctgtacagcgcccagggcgtgcggcagctgggcctggagctgggccggcctgtgcgcttcctgtatgaggaccagacaggccggccccagccccccagccagcctgtgttccggggcctgagcctggctgatggcaagtggcaccgggtggccgtggccgtgaagggccagagcgtgaccctcatcgtggactgcaagaagagggtgacccggcccctgcccaggtctgcccggcctgtgctggacacccacggcgtcatcatctttggagcccgcatcctggatgaggaggtgtttgaaggagatgtgcaggagctggccatcgtgcctggggtgcaggccgcctatgagagctgtgagcagaaggagctggagtgtgagggcggccagcgggagcggccccagaaccagcagccccaccgggcccagaggagcccccagcagcagcccagccggctgcaccggccccagaaccaggagccccagagccaggaccccaccccaggagaggaggaggagatcctggagagcagcctgctgccccccctggaggaggagcagacagacctgcaggtgcccccaacagctgaccgcttccaggccgaggagtatggagagggcggcacagatcctcctgagggcccctatgactacacctacggctatggagatgactaccgggaggagacagagctgggccctgccctgtctgctgagacagcccacagcggggccgccgcccacggcccccggggcctgaagggggagaagggggagcctgctgtgctggagcccggcatgctggtggagggccccccaggccctgagggccctgctggcctcatcggccccccaggcatccagggcaaccctggccctgtgggggaccctggagagcggggccccccaggccgggccggcctgcccggcagtgatggagcccctggccccccaggcaccagcctgatgctgcccttccgcttcggcagcggcggcggggacaagggccctgtggtggccgcccaggaggcccaggcccaggccatcctgcagcaggcccggctggccctgcggggccccccaggccccatgggctacacaggccggcccggccccctgggccagcccggcagccctggcctgaagggggagagcggggacctgggcccccagggcccccggggcccccagggcctgaccggccccccaggcaaggccggccggcggggccgggccggggctgatggagcccggggcatgcctggggaccccggggtgaagggggaccggggctttgatggcctgcccggcctgcctggagagaagggccacagaggagacaccggggcccagggcctgcccggccccccaggagaagatggagagagaggagatgatggagaaattggcccccggggcctgcctggagagagcggcccccggggcctgctgggccccaagggccccccaggcatccctggccccccaggagtgcggggcatggatggcccccagggccccaagggcagcctgggcccccagggcgagcccggccccccaggccagcagggcaccccaggcacccagggcctgcccggcccccagggcgccatcggcccccatggagagaagggcccccagggcaagccaggcctgcccggcatgcctggcagtgatggccccccaggccaccctgggaaggagggccccccaggcaccaagggcaaccagggccccagcggcccccagggccccctgggctacccaggcccccggggcgtgaagggcgtggatggcatccggggcctgaagggccacaagggggagaagggggaggatggcttccctggcttcaagggggacatcggcgtgaagggggacagaggagaggtgggcgtgcccggcagcagaggagaagatggccctgagggccccaagggccgcacaggccccaccggggaccccggccccccaggcctgatgggagagaagggcaagctgggcgtgcccggcctgcccggctacccaggccggcagggccccaagggcagcctgggcttccctggcttccctggggccagcggggagaagggggcccggggcctgagcggcaagagcggccccagaggagagcggggccccaccggcccccggggccagaggggccccaggggggccaccgggaagagcggggccaagggcaccagcggaggagatggcccccacggccccccaggagagcggggcctgcccggcccccagggccccaacggcttccctggccccaagggccccctgggccccccaggcaaggatggcctgcccggccaccctggccagagaggagaggtgggcttccagggcaagacaggccccccaggccccccaggagtggtgggcccccagggcgctgctggggagaccggccccatgggagagcggggccaccctggccccccaggccccccaggagagcagggcctgcctggaacagctgggaaggagggcaccaagggggaccccggccccccaggggcccctgggaaggatggccctgctggcctgcggggcttccctggagagcggggcctgcctggaacagctgggggccctggcctgaagggaaatgaaggccccagcggccccccaggccctgctggcagccctggagagagaggagctgctggcagcggcggccccatcggccccccaggccggcccggcccccagggccccccaggagctgctggggagaagggcgtgcctggagagaagggccccatcggccccaccggcagagatggagtgcagggccctgtgggcctgcccggccctgctggccccccaggagtggccggggaggatggagacaagggggaggtgggggaccccggccagaagggcaccaagggcaacaagggggagcacggccccccaggccccccaggccccatcggccctgtgggccagcctggagctgctggagcagatggagagcccggggcccggggcccccagggccactttggagccaagggagatgagggcacccggggcttcaatggacctcctggccccatcggcctgcagggcctgcccggccccagcggggagaagggggagactggagatgtgggccccatgggccccccaggccccccaggcccccggggccctgctggccccaatggagcagatggcccccagggccccccaggcggcgtgggcaacctgggccccccaggagagaagggggagcctggagagagcggcagccctggcatccagggcgagcccggggtgaagggccccagaggagagcggggggagaagggggagagcggccagcctggagagcccggccccccaggccccaagggccccactggagatgatggccccaagggcaaccctggccctgtgggcttccctggggaccccggccccccaggagagggcggcccccggggccaggatggagccaagggggacagaggagaagatggagagcccggccagcccggcagccctggccccaccggggagaatggacctcctggccccctgggcaagaggggccctgctggcagccctggcagcgagggccggcagggcggcaaaggagccaagggggaccccggggccatcggggcccctgggaagacaggccctgtgggccctgctggccctgctgggaagccaggcccagatggcctgcggggcctgcccggctctgtgggccagcagggccggcctggggccaccggccaggccggccccccaggccctgtgggccccccaggcctgcccggcctgcggggagatgctggggccaagggggagaagggccaccctggcctcatcggcctgattggccccccaggagagcagggcgagaagggggaccggggcctgcccggcccccagggcagccctggccagaagggggagatgggcatccctggggccagcggccccatcggccctgggggccccccaggcctgcccggccctgctggccccaagggggccaagggggccaccggccctgggggccccaagggggagaagggcgtgcagggccccccaggccaccctggccccccaggagaggtgatccagcccctgcccatccagatgcccaagaagaccaggagatctgtggatggcagccggctgatgcaggaggatgaggccatccccaccggcggggcccctggcagccctgggggcctggaggagatcttcggcagcctggacagcctgcgggaggagattgagcagatgaggcggcccaccggcacccaggacagccctgcccggacctgccaggacctgaagctgtgccaccctgagctgcctgatggagagtactgggtggaccccaaccagggctgtgccagagatgccttccgggtcttctgcaacttcaccgctggaggagagacctgtgtgaccccaagagatgatgtgacccagttctcctatgtggacagcgagggcagccctgtgggcgtggtgcagctgaccttcctgcggctgctgtctgtgtctgcccaccaggatgtgtcctacccctgcagcggggccgccagagatggccccctgcggctgcggggggccaatgaagatgagctgagccctgagaccagcccctacgtgaaggagttcagagatggctgccagacccagcagggccgcacagtgctggaggtgaggacccctgtgctggagcagctgcctgtgctggatgccagcttcagtgacctgggcgcccccccaagaagaggaggagtgctgctgggccctgtgtgcttcatgggctag

SEQ ID NO: 3319 - DNA, 5070 bp, Artificial Sequence; identical to SEQ ID NO: 3271
  Description of Artificial Sequence: Synthetic coding sequence

SEQ ID NO: 3320 - DNA, 4890 bp, Artificial Sequence; identical to SEQ ID NO: 3268
  Description of Artificial Sequence: Synthetic coding sequence

SEQ ID NO: 3321 - DNA, 921 bp, Artificial Sequence; identical to SEQ ID NO: 3277
  Description of Artificial Sequence: Synthetic coding sequence

SEQ ID NO: 3322 - DNA, 4968 bp, Artificial Sequence
  Description of Artificial Sequence: Synthetic coding sequence
atggagcgctgcagccgctgccaccggctgctgctgctgctgcccctggtgctgggcctgtctgctgcccctggctgggccggggcccctcctgtggatgtgctgcgggccctgcgcttccccagcctgcctgatggagtgcggcgggccaagggcatctgcccagcagatgtggcctacagagtggcccggcctgcccagctgagcgcccccacccggcagctgtttcctgggggcttccccaaggacttcagcctgctgactgtggtgaggacccggcccggcctgcaggcccccctgctgaccctgtacagcgcccagggcgtgcggcagctgggcctggagctgggcccccctgtgcgcttcctgtatgaggaccagacaggccggccccagccccccagccagcctgtgttccggggcctgagcctggctgatggcaagtggcaccgggtggccgtggccgtgaagggccagagcgtgaccctcatcgtggactgcaagaagagggtgacccggcccctgcccaggtctgcccggcctgtgctggacacccacggcgtcatcatctttggagcccgcatcctggatgaggaggtgtttgaaggagatgtgcaggagctggccatcgtgcctggggtgcaggccgcctatgagagctgtgagcagaaggagctggagtgtgagggcggccagcgggagcggccccagaaccagcagccccaccgggcccagaggagcccccagcagcagcccagccggctgcaccggccccagaaccaggagccccagagccagcccacagagagcctgtactatgactacaagccaccctactatgatgtgatgaccaccggcaccaccccagactaccaggccgcccacggcccccggggcctgaagggggagaagggggagcctgctgtgctggagcccggcatgctggtggagggccccccaggccctgagggccctgctggcctgattggccccccaggcatccagggcaaccctggccctgtgggggaccccggggagcggggccccccaggccgggccggcctgcccggcagtgatggagcccctggccccccaggcaccagcctgatgctgcccttccgctttggaagtggcggcggggacaagggccctgtggtggccgcccaggaggcccaggcccaggccatcctgcagcaggcccggctggccctgcggggccccccaggccccatgggctacacaggccggcccggccccctgggccagcccggcagccctggcctgaagggggagagcggggacctgggcccccagggcccccggggcccccagggcctgactggacctcctgggaaggccggcagaagaggccgggccggggctgatggagcccggggcatgcctggggaccccggggtgaagggggaccggggctttgatggcctgcccggcctgcccggggagaagggccacagaggagacacaggagcccagggcctgcccggccccccaggagaagatggagagagaggagatgatggagagatcggcccccggggcctgcccggggagagcggcccccggggcctgctgggccccaagggccccccaggcatccctggccccccaggagtgcggggcatggatggcccccagggccccaagggcagcctgggcccccagggcgagcccggccccccaggccagcagggcaccccaggcacccagggcctgcccggcccccagggcgccatcggcccccacggggagaagggcccccagggcaagccaggcctgcccggcatgcctggcagtgatggccccccaggccaccctgggaaggagggccccccaggcaccaagggcaaccagggccccagcggcccccagggccccctgggctacccaggcccccggggcgtgaagggcgtggatggcatccggggcctgaagggccacaagggggagaagggagaagatggcttccctggcttcaagggggacattggagtgaagggggacagaggagaggtgggcgtgcccggcagcagaggagaagatggccctgagggccccaagggccgcacaggccccactggagaccccggccccccaggcctgatgggagagaagggcaagctgggcgtgcccggcctgcccggctacccaggccggcagggccccaagggcagcctgggcttccctggcttccctggggccagcggggagaagggggcccggggcctgagcggcaagagcggccccagaggagagcggggccccaccggcccccggggccagaggggccccaggggggccaccgggaagagcggggccaagggcaccagcggaggagatggcccccacggccccccaggagagcggggcctgcccggcccccagggccccaacggcttccctggccccaagggccccccaggccccccaggcaaggatggcctgcccggccaccctggccagagaggagaggtgggcttccagggcaagacaggccccccaggccccccaggagtggtgggcccccagggcgccgccggggagaccggccccatgggagagcggggccaccctggccccccaggccccccaggagagcagggcctgcccggcacagctgggaaggagggcaccaagggggaccccggccccccaggggcccctgggaaggatggccctgctggcctgcggggcttccctggagagcggggcctgcccggcacagctgggggccctggcctgaagggaaatgaaggccccagcggccccccaggccctgctggcagccctggagagagaggagctgctggcagcggcggccccatcggccccccaggccggcccggcccccagggccccccaggagctgctggggagaagggcgtgcctggagagaagggccccatcggccccaccggcagagatggagtgcagggccctgtgggcctgcccggccctgctggccccccaggagtggccggagaagatggagacaagggggaggtgggggaccccggccagaagggcaccaagggcaacaagggggagcacggccccccaggccccccaggccccatcggccctgtgggccagcccggggctgctggagcagatggagagcccggggcccggggcccccagggccactttggagccaagggagatgagggcacccggggcttcaacggccccccaggccccatcggcctgcagggcctgcccggccccagcggggagaagggggagactggagatgtgggccccatgggccccccaggccccccaggcccccggggccctgctggccccaacggggctgatggcccccagggccccccaggaggagtgggcaacctgggccccccaggagagaagggggagcccggggagagcggcagccctggcatccagggcgagcccggggtgaagggccccagaggagagcggggggagaagggggagagcggccagcccggggagcccggccccccaggccccaagggccccactggagatgatggccccaagggcaaccctggccctgtgggcttccctggggaccccggccccccaggagagggcggcccccggggccaggatggagccaagggggacagaggagaagatggagagcccggccagcccggcagccctggccccactggagaaaatggccccccaggccccctgggcaagaggggccctgctggcagccctggcagcgagggccggcagggcggcaagggggccaagggggaccccggggccatcggggcccctgggaagacaggccctgtgggccctgctggccctgctgggaagccaggcccagatggcctgcggggcctgcccggctctgtgggccagcagggccggcctggggccaccggccaggccggccccccaggccctgtgggccccccaggcctgcccggcctgcggggagatgctggggccaagggggagaagggccaccctggcctgattggcctcatcggccccccaggagagcagggcgagaagggggaccggggcctgcccggcccccagggcagccctggccagaagggggagatgggcatccctggggccagcggccccatcggccctgggggccccccaggcctgcccggccctgctggccccaagggggccaagggggccactggacctgggggccccaagggggagaagggcgtgcagggccccccaggccaccctggccccccaggagaggtgatccagcccctgcccatccagatgcccaagaagacccggcgctctgtggatggcagccggctgatgcaggaggatgaggccatccccactggaggagcccctggcagccctgggggcctggaggagatcttcggcagcctggacagcctgcgggaggagattgagcagatgagaagacccaccggcacccaggacagccctgcccggacctgccaggacctgaagctgtgccaccctgagctgcctgatggagagtactgggtggaccccaaccagggctgtgccagagatgccttccgggtcttctgcaacttcaccgctggaggagagacctgtgtgaccccaagagatgatgtgacccagttctcctatgtggacagcgagggcagccctgtgggcgtggtgcagctgaccttcctgcggctgctgtctgtgtctgcccaccaggatgtgtcctacccctgcagcggggccgccagagatggccccctgcggctgcggggggccaatgaagatgagctgagccctgagaccagcccctacgtgaaggagttcagagatggctgccagacccagcagggccgcacagtgctggaggtgaggacccctgtgctggagcagctgcctgtgctggatgccagcttcagtgacctgggcgccccaccccggcggggcggcgtgctgctgggccctgtgtgcttcatgggctag

SEQ ID NO: 3323 - DNA, 5211 bp, Artificial Sequence
  Description of Artificial Sequence: Synthetic coding sequence
atggagcgctgcagccgctgccaccggctgctgctgctgctgcccctggtgctgggcctgtctgctgcccctggctgggccggggcccctcctgtggatgtgctgcgggccctgcgcttccccagcctgcctgatggagtgcggcgggccaagggcatctgcccagcagatgtggcctacagagtggcccggcctgcccagctgagcgcccccacccggcagctgtttcctgggggcttccccaaggacttcagcctgctgactgtggtgaggacccggcccggcctgcaggcccccctgctgaccctgtacagcgcccagggcgtgcggcagctgggcctggagctgggcccccctgtgcgcttcctgtatgaggaccagacaggccggccccagccccccagccagcctgtgttccggggcctgagcctggctgatggcaagtggcaccgggtggccgtggccgtgaagggccagagcgtgaccctcatcgtggactgcaagaagagggtgacccggcccctgcccaggtctgcccggcctgtgctggacacccacggcgtcatcatctttggagcccgcatcctggatgaggaggtgtttgaaggagatgtgcaggagctggccatcgtgcctggggtgcaggccgcctatgagagctgtgagcagaaggagctggagtgtgagggcggccagcgggagcggccccagaaccagcagccccaccgggcccagaggagcccccagcagcagcccagccggctgcaccggccccagaaccaggagccccagagccagcccacagagagcctgtactatgactacaagccaccctactatgatgtgatgaccaccggcaccaccccagactaccaggaccccaccccaggagaggaggaggagatcctggagagcagcctgctgccccccctggaggaggagcagacagacctgcaggtgcccccaacagctgaccgcttccaggccgaggagtatggagagggcggcacagatcctcctgagggcccctatgactacacctacggctatggagatgactaccgggaggagacagagctgggccctgccctgtctgctgagacagcccacagcggggccgccgcccacggcccccggggcctgaagggggagaagggggagcctgctgtgctggagcccggcatgctggtggagggccccccaggccctgagggccctgctggcctcatcggccccccaggcatccagggcaaccctggccctgtgggggaccctggagagcggggccccccaggccgggccggcctgcccggcagtgatggagcccctggccccccaggcaccagcctgatgctgcccttccgcttcggcagcggcggcggggacaagggccctgtggtggccgcccaggaggcccaggcccaggccatcctgcagcaggcccggctggccctgcggggccccccaggccccatgggctacacaggccggcccggccccctgggccagcccggcagccctggcctgaagggggagagcggggacctgggcccccagggcccccggggcccccagggcctgaccggccccccaggcaaggccggccggcggggccgggccggggctgatggagcccggggcatgcctggggaccccggggtgaagggggaccggggctttgatggcctgcccggcctgcctggagagaagggccacagaggagacaccggggcccagggcctgcccggccccccaggagaagatggagagagaggagatgatggagaaattggcccccggggcctgcctggagagagcggcccccggggcctgctgggccccaagggccccccaggcatccctggccccccaggagtgcggggcatggatggcccccagggccccaagggcagcctgggcccccagggcgagcccggccccccaggccagcagggcaccccaggcacccagggcctgcccggcccccagggcgccatcggcccccatggagagaagggcccccagggcaagccaggcctgcccggcatgcctggcagtgatggccccccaggccaccctgggaaggagggccccccaggcaccaagggcaaccagggccccagcggcccccagggccccctgggctacccaggcccccggggcgtgaagggcgtggatggcatccggggcctgaagggccacaagggggagaagggggaggatggcttccctggcttcaagggggacatcggcgtgaagggggacagaggagaggtgggcgtgcccggcagcagaggagaagatggccctgagggccccaagggccgcacaggccccaccggggaccccggccccccaggcctgatgggagagaagggcaagctgggcgtgcccggcctgcccggctacccaggccggcagggccccaagggcagcctgggcttccctggcttccctggggccagcggggagaagggggcccggggcctgagcggcaagagcggccccagaggagagcggggccccaccggcccccggggccagaggggccccaggggggccaccgggaagagcggggccaagggcaccagcggaggagatggcccccacggccccccaggagagcggggcctgcccggcccccagggccccaacggcttccctggccccaagggccccccaggccccccaggcaaggatggcctgcccggccaccctggccagagaggagaggtgggcttccagggcaagacaggccccccaggccccccaggagtggtgggcccccagggcgctgctggggagaccggccccatgggagagcggggccaccctggccccccaggccccccaggagagcagggcctgcctggaacagctgggaaggagggcaccaagggggaccccggccccccaggggcccctgggaaggatggccctgctggcctgcggggcttccctggagagcggggcctgcctggaacagctgggggccctggcctgaagggaaatgaaggccccagcggccccccaggccctgctggcagccctggagagagaggagctgctggcagcggcggccccatcggccccccaggccggcccggcccccagggccccccaggagctgctggggagaagggcgtgcctggagagaagggccccatcggccccaccggcagagatggagtgcagggccctgtgggcctgcccggccctgctggccccccaggagtggccggggaggatggagacaagggggaggtgggggaccccggccagaagggcaccaagggcaacaagggggagcacggccccccaggccccccaggccccatcggccctgtgggccagcctggagctgctggagcagatggagagcccggggcccggggcccccagggccactttggagccaagggagatgagggcacccggggcttcaatggacctcctggccccatcggcctgcagggcctgcccggccccagcggggagaagggggagactggagatgtgggccccatgggccccccaggccccccaggcccccggggccctgctggccccaatggagcagatggcccccagggccccccaggcggcgtgggcaacctgggccccccaggagagaagggggagcctggagagagcggcagccctggcatccagggcgagcccggggtgaagggccccagaggagagcggggggagaagggggagagcggccagcctggagagcccggccccccaggccccaagggccccactggagatgatggccccaagggcaaccctggccctgtgggcttccctggggaccccggccccccaggagagggcggcccccggggccaggatggagccaagggggacagaggagaagatggagagcccggccagcccggcagccctggccccaccggggagaatggacctcctggccccctgggcaagaggggccctgctggcagccctggcagcgagggccggcagggcggcaaaggagccaagggggaccccggggccatcggggcccctgggaagacaggccctgtgggccctgctggccctgctgggaagccaggcccagatggcctgcggggcctgcccggctctgtgggccagcagggccggcctggggccaccggccaggccggccccccaggccctgtgggccccccaggcctgcccggcctgcggggagatgctggggccaagggggagaagggccaccctggcctcatcggcctgattggccccccaggagagcagggcgagaagggggaccggggcctgcccggcccccagggcagccctggccagaagggggagatgggcatccctggggccagcggccccatcggccctgggggccccccaggcctgcccggccctgctggccccaagggggccaagggggccaccggccctgggggccccaagggggagaagggcgtgcagggccccccaggccaccctggccccccaggagaggtgatccagcccctgcccatccagatgcccaagaagaccaggagatctgtggatggcagccggctgatgcaggaggatgaggccatccccaccggcggggcccctggcagccctgggggcctggaggagatcttcggcagcctggacagcctgcgggaggagattgagcagatgaggcggcccaccggcacccaggacagccctgcccggacctgccaggacctgaagctgtgccaccctgagctgcctgatggagagtactgggtggaccccaaccagggctgtgccagagatgccttccgggtcttctgcaacttcaccgctggaggagagacctgtgtgaccccaagagatgatgtgacccagttctcctatgtggacagcgagggcagccctgtgggcgtggtgcagctgaccttcctgcggctgctgtctgtgtctgcccaccaggatgtgtcctacccctgcagcggggccgccagagatggccccctgcggctgcggggggccaatgaagatgagctgagccctgagaccagcccctacgtgaaggagttcagagatggctgccagacccagcagggccgcacagtgctggaggtgaggacccctgtgctggagcagctgcctgtgctggatgccagcttcagtgacctgggcgcccccccaagaagaggaggagtgctgctgggccctgtgtgcttcatgggctag

SEQ ID NO: 3324 - DNA, 5148 bp, Artificial Sequence; identical to SEQ ID NO: 3267
  Description of Artificial Sequence: Synthetic coding sequence

SEQ ID NO: 3325 - DNA, 4890 bp, Artificial Sequence
  Description of Artificial Sequence: Synthetic coding sequence
atggagcgctgcagccgctgccaccggctgctgctgctgctgcccctggtgctgggcctgtctgctgcccctggctgggccggggcccctcctgtggatgtgctgcgggccctgcgcttccccagcctgcctgatggagtgcggcgggccaagggcatctgcccagcagatgtggcctacagagtggcccggcctgcccagctgagcgcccccacccggcagctgtttcctgggggcttccccaaggacttcagcctgctgactgtggtgaggacccggcccggcctgcaggcccccctgctgaccctgtacagcgcccagggcgtgcggcagctgggcctggagctgggccggcctgtgcgcttcctgtatgaggaccagacaggccggccccagccccccagccagcctgtgttccggggcctgagcctggctgatggcaagtggcaccgggtggccgtggccgtgaagggccagagcgtgaccctcatcgtggactgcaagaagagggtgacccggcccctgcccaggtctgcccggcctgtgctggacacccacggcgtcatcatctttggagcccgcatcctggatgaggaggtgtttgaaggagatgtgcaggagctggccatcgtgcctggggtgcaggccgcctatgagagctgtgagcagaaggagctggagtgtgagggcggccagcgggagcggccccagaaccagcagccccaccgggcccagaggagcccccagcagcagcccagccggctgcaccggccccagaaccaggagccccagagccaggccgcccacggcccccggggcctgaagggggagaagggggagcctgctgtgctggagcccggcatgctggtggagggccccccaggccctgagggccctgctggcctgattggccccccaggcatccagggcaaccctggccctgtgggggaccccggggagcggggccccccaggccgggccggcctgcccggcagtgatggagcccctggccccccaggcaccagcctgatgctgcccttccgctttggaagtggcggcggggacaagggccctgtggtggccgcccaggaggcccaggcccaggccatcctgcagcaggcccggctggccctgcggggccccccaggccccatgggctacacaggccggcccggccccctgggccagcccggcagccctggcctgaagggggagagcggggacctgggcccccagggcccccggggcccccagggcctgactggacctcctgggaaggccggcagaagaggccgggccggggctgatggagcccggggcatgcctggggaccccggggtgaagggggaccggggctttgatggcctgcccggcctgcccggggagaagggccacagaggagacacaggagcccagggcctgcccggccccccaggagaagatggagagagaggagatgatggagagatcggcccccggggcctgcccggggagagcggcccccggggcctgctgggccccaagggccccccaggcatccctggccccccaggagtgcggggcatggatggcccccagggccccaagggcagcctgggcccccagggcgagcccggccccccaggccagcagggcaccccaggcacccagggcctgcccggcccccagggcgccatcggcccccacggggagaagggcccccagggcaagccaggcctgcccggcatgcctggcagtgatggccccccaggccaccctgggaaggagggccccccaggcaccaagggcaaccagggccccagcggcccccagggccccctgggctacccaggcccccggggcgtgaagggcgtggatggcatccggggcctgaagggccacaagggggagaagggagaagatggcttccctggcttcaagggggacattggagtgaagggggacagaggagaggtgggcgtgcccggcagcagaggagaagatggccctgagggccccaagggccgcacaggccccactggagaccccggccccccaggcctgatgggagagaagggcaagctgggcgtgcccggcctgcccggctacccaggccggcagggccccaagggcagcctgggcttccctggcttccctggggccagcggggagaagggggcccggggcctgagcggcaagagcggccccagaggagagcggggccccaccggcccccggggccagaggggccccaggggggccaccgggaagagcggggccaagggcaccagcggaggagatggcccccacggccccccaggagagcggggcctgcccggcccccagggccccaacggcttccctggccccaagggccccctgggccccccaggcaaggatggcctgcccggccaccctggccagagaggagaggtgggcttccagggcaagacaggccccccaggccccccaggagtggtgggcccccagggcgccgccggggagaccggccccatgggagagcggggccaccctggccccccaggccccccaggagagcagggcctgcccggcacagctgggaaggagggcaccaagggggaccccggccccccaggggcccctgggaaggatggccctgctggcctgcggggcttccctggagagcggggcctgcccggcacagctgggggccctggcctgaagggaaatgaaggccccagcggccccccaggccctgctggcagccctggagagagaggagctgctggcagcggcggccccatcggccccccaggccggcccggcccccagggccccccaggagctgctggggagaagggcgtgcctggagagaagggccccatcggccccaccggcagagatggagtgcagggccctgtgggcctgcccggccctgctggccccccaggagtggccggagaagatggagacaagggggaggtgggggaccccggccagaagggcaccaagggcaacaagggggagcacggccccccaggccccccaggccccatcggccctgtgggccagcccggggctgctggagcagatggagagcccggggcccggggcccccagggccactttggagccaagggagatgagggcacccggggcttcaacggccccccaggccccatcggcctgcagggcctgcccggccccagcggggagaagggggagactggagatgtgggccccatgggccccccaggccccccaggcccccggggccctgctggccccaacggggctgatggcccccagggccccccaggaggagtgggcaacctgggccccccaggagagaagggggagcccggggagagcggcagccctggcatccagggcgagcccggggtgaagggccccagaggagagcggggggagaagggggagagcggccagcccggggagcccggccccccaggccccaagggccccactggagatgatggccccaagggcaaccctggccctgtgggcttccctggggaccccggccccccaggagagggcggcccccggggccaggatggagccaagggggacagaggagaagatggagagcccggccagcccggcagccctggccccactggagaaaatggccccccaggccccctgggcaagaggggccctgctggcagccctggcagcgagggccggcagggcggcaagggggccaagggggaccccggggccatcggggcccctgggaagacaggccctgtgggccctgctggccctgctgggaagccaggcccagatggcctgcggggcctgcccggctctgtgggccagcagggccggcctggggccaccggccaggccggccccccaggccctgtgggccccccaggcctgcccggcctgcggggagatgctggggccaagggggagaagggccaccctggcctgattggcctcatcggccccccaggagagcagggcgagaagggggaccggggcctgcccggcccccagggcagccctggccagaagggggagatgggcatccctggggccagcggccccatcggccctgggggccccccaggcctgcccggccctgctggccccaagggggccaagggggccactggacctgggggccccaagggggagaagggcgtgcagggccccccaggccaccctggccccccaggagaggtgatccagcccctgcccatccagatgcccaagaagacccggcgctctgtggatggcagccggctgatgcaggaggatgaggccatccccactggaggagcccctggcagccctgggggcctggaggagatcttcggcagcctggacagcctgcgggaggagattgagcagatgagaagacccaccggcacccaggacagccctgcccggacctgccaggacctgaagctgtgccaccctgagctgcctgatggagagtactgggtggaccccaaccagggctgtgccagagatgccttccgggtcttctgcaacttcaccgctggaggagagacctgtgtgaccccaagagatgatgtgacccagttctcctatgtggacagcgagggcagccctgtgggcgtggtgcagctgaccttcctgcggctgctgtctgtgtctgcccaccaggatgtgtcctacccctgcagcggggccgccagagatggccccctgcggctgcggggggccaatgaagatgagctgagccctgagaccagcccctacgtgaaggagttcagagatggctgccagacccagcagggccgcacagtgctggaggtgaggacccctgtgctggagcagctgcctgtgctggatgccagcttcagtgacctgggcgccccaccccggcggggcggcgtgctgctgggccctgtgtgcttcatgggctag

SEQ ID NO: 3326 - DNA, 921 bp, Artificial Sequence; identical to SEQ ID NO: 3277
  Description of Artificial Sequence: Synthetic coding sequence

SEQ ID NO: 3327 - DNA, 4968 bp, Artificial Sequence; identical to SEQ ID NO: 3270
  Description of Artificial Sequence: Synthetic coding sequence

SEQ ID NO: 3328 - DNA, 921 bp, Artificial Sequence; identical to SEQ ID NO: 3277
  Description of Artificial Sequence: Synthetic coding sequence

SEQ ID NO: 3329 - DNA, 5211 bp, Artificial Sequence; identical to SEQ ID NO: 3266
  Description of Artificial Sequence: Synthetic coding sequence

SEQ ID NO: 3330 - DNA, 921 bp, Artificial Sequence; identical to SEQ ID NO: 3277
  Description of Artificial Sequence: Synthetic coding sequence

SEQ ID NO: 3331 - DNA, 5070 bp, Artificial Sequence; identical to SEQ ID NO: 3271
  Description of Artificial Sequence: Synthetic coding sequence

SEQ ID NO: 3332 - DNA, 4890 bp, Artificial Sequence
  Description of Artificial Sequence: Synthetic coding sequence
atggagcgctgcagccgctgccaccggctgctgctgctgctgcccctggtgctgggcctgtctgctgcccctggctgggccggggcccctcctgtggatgtgctgcgggccctgcgcttccccagcctgcctgatggagtgcggcgggccaagggcatctgcccagcagatgtggcctacagagtggcccggcctgcccagctgagcgcccccacccggcagctgtttcctgggggcttccccaaggacttcagcctgctgactgtggtgaggacccggcccggcctgcaggcccccctgctgaccctgtacagcgcccagggcgtgcggcagctgggcctggagctgggcccccctgtgcgcttcctgtatgaggaccagacaggccggccccagccccccagccagcctgtgttccggggcctgagcctggctgatggcaagtggcaccgggtggccgtggccgtgaagggccagagcgtgaccctcatcgtggactgcaagaagagggtgacccggcccctgcccaggtctgcccggcctgtgctggacacccacggcgtcatcatctttggagcccgcatcctggatgaggaggtgtttgaaggagatgtgcaggagctggccatcgtgcctggggtgcaggccgcctatgagagctgtgagcagaaggagctggagtgtgagggcggccagcgggagcggccccagaaccagcagccccaccgggcccagaggagcccccagcagcagcccagccggctgcaccggccccagaaccaggagccccagagccaggccgcccacggcccccggggcctgaagggggagaagggggagcctgctgtgctggagcccggcatgctggtggagggccccccaggccctgagggccctgctggcctgattggccccccaggcatccagggcaaccctggccctgtgggggaccccggggagcggggccccccaggccgggccggcctgcccggcagtgatggagcccctggccccccaggcaccagcctgatgctgcccttccgctttggaagtggcggcggggacaagggccctgtggtggccgcccaggaggcccaggcccaggccatcctgcagcaggcccggctggccctgcggggccccccaggccccatgggctacacaggccggcccggccccctgggccagcccggcagccctggcctgaagggggagagcggggacctgggcccccagggcccccggggcccccagggcctgactggacctcctgggaaggccggcagaagaggccgggccggggctgatggagcccggggcatgcctggggaccccggggtgaagggggaccggggctttgatggcctgcccggcctgcccggggagaagggccacagaggagacacaggagcccagggcctgcccggccccccaggagaagatggagagagaggagatgatggagagatcggcccccggggcctgcccggggagagcggcccccggggcctgctgggccccaagggccccccaggcatccctggccccccaggagtgcggggcatggatggcccccagggccccaagggcagcctgggcccccagggcgagcccggccccccaggccagcagggcaccccaggcacccagggcctgcccggcccccagggcgccatcggcccccacggggagaagggcccccagggcaagccaggcctgcccggcatgcctggcagtgatggccccccaggccaccctgggaaggagggccccccaggcaccaagggcaaccagggccccagcggcccccagggccccctgggctacccaggcccccggggcgtgaagggcgtggatggcatccggggcctgaagggccacaagggggagaagggagaagatggcttccctggcttcaagggggacattggagtgaagggggacagaggagaggtgggcgtgcccggcagcagaggagaagatggccctgagggccccaagggccgcacaggccccactggagaccccggccccccaggcctgatgggagagaagggcaagctgggcgtgcccggcctgcccggctacccaggccggcagggccccaagggcagcctgggcttccctggcttccctggggccagcggggagaagggggcccggggcctgagcggcaagagcggccccagaggagagcggggccccaccggcccccggggccagaggggccccaggggggccaccgggaagagcggggccaagggcaccagcggaggagatggcccccacggccccccaggagagcggggcctgcccggcccccagggccccaacggcttccctggccccaagggccccccaggccccccaggcaaggatggcctgcccggccaccctggccagagaggagaggtgggcttccagggcaagacaggccccccaggccccccaggagtggtgggcccccagggcgccgccggggagaccggccccatgggagagcggggccaccctggccccccaggccccccaggagagcagggcctgcccggcacagctgggaaggagggcaccaagggggaccccggccccccaggggcccctgggaaggatggccctgctggcctgcggggcttccctggagagcggggcctgcccggcacagctgggggccctggcctgaagggaaatgaaggccccagcggccccccaggccctgctggcagccctggagagagaggagctgctggcagcggcggccccatcggccccccaggccggcccggcccccagggccccccaggagctgctggggagaagggcgtgcctggagagaagggccccatcggccccaccggcagagatggagtgcagggccctgtgggcctgcccggccctgctggccccccaggagtggccggagaagatggagacaagggggaggtgggggaccccggccagaagggcaccaagggcaacaagggggagcacggccccccaggccccccaggccccatcggccctgtgggccagcccggggctgctggagcagatggagagcccggggcccggggcccccagggccactttggagccaagggagatgagggcacccggggcttcaacggccccccaggccccatcggcctgcagggcctgcccggccccagcggggagaagggggagactggagatgtgggccccatgggccccccaggccccccaggcccccggggccctgctggccccaacggggctgatggcccccagggccccccaggaggagtgggcaacctgggccccccaggagagaagggggagcccggggagagcggcagccctggcatccagggcgagcccggggtgaagggccccagaggagagcggggggagaagggggagagcggccagcccggggagcccggccccccaggccccaagggccccactggagatgatggccccaagggcaaccctggccctgtgggcttccctggggaccccggccccccaggagagggcggcccccggggccaggatggagccaagggggacagaggagaagatggagagcccggccagcccggcagccctggccccactggagaaaatggccccccaggccccctgggcaagaggggccctgctggcagccctggcagcgagggccggcagggcggcaagggggccaagggggaccccggggccatcggggcccctgggaagacaggccctgtgggccctgctggccctgctgggaagccaggcccagatggcctgcggggcctgcccggctctgtgggccagcagggccggcctggggccaccggccaggccggccccccaggccctgtgggccccccaggcctgcccggcctgcggggagatgctggggccaagggggagaagggccaccctggcctgattggcctcatcggccccccaggagagcagggcgagaagggggaccggggcctgcccggcccccagggcagccctggccagaagggggagatgggcatccctggggccagcggccccatcggccctgggggccccccaggcctgcccggccctgctggccccaagggggccaagggggccactggacctgggggccccaagggggagaagggcgtgcagggccccccaggccaccctggccccccaggagaggtgatccagcccctgcccatccagatgcccaagaagacccggcgctctgtggatggcagccggctgatgcaggaggatgaggccatccccactggaggagcccctggcagccctgggggcctggaggagatcttcggcagcctggacagcctgcgggaggagattgagcagatgagaagacccaccggcacccaggacagccctgcccggacctgccaggacctgaagctgtgccaccctgagctgcctgatggagagtactgggtggaccccaaccagggctgtgccagagatgccttccgggtcttctgcaacttcaccgctggaggagagacctgtgtgaccccaagagatgatgtgacccagttctcctatgtggacagcgagggcagccctgtgggcgtggtgcagctgaccttcctgcggctgctgtctgtgtctgcccaccaggatgtgtcctacccctgcagcggggccgccagagatggccccctgcggctgcggggggccaatgaagatgagctgagccctgagaccagcccctacgtgaaggagttcagagatggctgccagacccagcagggccgcacagtgctggaggtgaggacccctgtgctggagcagctgcctgtgctggatgccagcttcagtgacctgggcgccccaccccggcggggcggcgtgctgctgggccctgtgtgcttcatgggctag

SEQ ID NO: 3333 - DNA, 4890 bp, Artificial Sequence; identical to SEQ ID NO: 3268
  Description of Artificial Sequence: Synthetic coding sequence

SEQ ID NO: 3334 - DNA, 5133 bp, Artificial Sequence; identical to SEQ ID NO: 3272
  Description of Artificial Sequence: Synthetic coding sequence

SEQ ID NO: 3335 - DNA, 5148 bp, Artificial Sequence
  Description of Artificial Sequence: Synthetic coding sequence
atggagcgctgcagccgctgccaccggctgctgctgctgctgcccctggtgctgggcctgtctgctgcccctggctgggccggggcccctcctgtggatgtgctgcgggccctgcgcttccccagcctgcctgatggagtgcggcgggccaagggcatctgcccagcagatgtggcctacagagtggcccggcctgcccagctgagcgcccccacccggcagctgtttcctgggggcttccccaaggacttcagcctgctgactgtggtgaggacccggcccggcctgcaggcccccctgctgaccctgtacagcgcccagggcgtgcggcagctgggcctggagctgggccggcctgtgcgcttcctgtatgaggaccagacaggccggccccagccccccagccagcctgtgttccggggcctgagcctggctgatggcaagtggcaccgggtggccgtggccgtgaagggccagagcgtgaccctcatcgtggactgcaagaagagggtgacccggcccctgcccaggtctgcccggcctgtgctggacacccacggcgtcatcatctttggagcccgcatcctggatgaggaggtgtttgaaggagatgtgcaggagctggccatcgtgcctggggtgcaggccgcctatgagagctgtgagcagaaggagctggagtgtgagggcggccagcgggagcggccccagaaccagcagccccaccgggcccagaggagcccccagcagcagcccagccggctgcaccggccccagaaccaggagccccagagccagcccacagagagcctgtactatgactacaagccaccctactatgatgtgatgaccaccggcaccaccccagactaccaggagcagacagacctgcaggtgcccccaacagctgaccgcttccaggccgaggagtatggagagggcggcacagaccccccagagggcccctatgactacacctacggctatggagatgactaccgggaggagacagagctgggccctgccctgtctgctgagacagcccacagcggggctgctgcccacggcccccggggcctgaagggggagaagggggagcctgctgtgctggagcccggcatgctggtggagggccccccaggccctgagggccctgctggcctgattggccccccaggcatccagggcaaccctggccctgtgggggaccccggggagcggggccccccaggccgggccggcctgcccggcagtgatggagcccctggccccccaggcaccagcctgatgctgcccttccgctttggaagtggcggcggggacaagggccctgtggtggccgcccaggaggcccaggcccaggccatcctgcagcaggcccggctggccctgcggggccccccaggccccatgggctacacaggccggcccggccccctgggccagcccggcagccctggcctgaagggggagagcggggacctgggcccccagggcccccggggcccccagggcctgactggacctcctgggaaggccggcagaagaggccgggccggggctgatggagcccggggcatgcctggggaccccggggtgaagggggaccggggctttgatggcctgcccggcctgcccggggagaagggccacagaggagacacaggagcccagggcctgcccggccccccaggagaagatggagagagaggagatgatggagagatcggcccccggggcctgcccggggagagcggcccccggggcctgctgggccccaagggccccccaggcatccctggccccccaggagtgcggggcatggatggcccccagggccccaagggcagcctgggcccccagggcgagcccggccccccaggccagcagggcaccccaggcacccagggcctgcccggcccccagggcgccatcggcccccacggggagaagggcccccagggcaagccaggcctgcccggcatgcctggcagtgatggccccccaggccaccctgggaaggagggccccccaggcaccaagggcaaccagggccccagcggcccccagggccccctgggctacccaggcccccggggcgtgaagggcgtggatggcatccggggcctgaagggccacaagggggagaagggagaagatggcttccctggcttcaagggggacattggagtgaagggggacagaggagaggtgggcgtgcccggcagcagaggagaagatggccctgagggccccaagggccgcacaggccccactggagaccccggccccccaggcctgatgggagagaagggcaagctgggcgtgcccggcctgcccggctacccaggccggcagggccccaagggcagcctgggcttccctggcttccctggggccagcggggagaagggggcccggggcctgagcggcaagagcggccccagaggagagcggggccccaccggcccccggggccagaggggccccaggggggccaccgggaagagcggggccaagggcaccagcggaggagatggcccccacggccccccaggagagcggggcctgcccggcccccagggccccaacggcttccctggccccaagggccccccaggccccccaggcaaggatggcctgcccggccaccctggccagagaggagaggtgggcttccagggcaagacaggccccccaggccccccaggagtggtgggcccccagggcgccgccggggagaccggccccatgggagagcggggccaccctggccccccaggccccccaggagagcagggcctgcccggcacagctgggaaggagggcaccaagggggaccccggccccccaggggcccctgggaaggatggccctgctggcctgcggggcttccctggagagcggggcctgcccggcacagctgggggccctggcctgaagggaaatgaaggccccagcggccccccaggccctgctggcagccctggagagagaggagctgctggcagcggcggccccatcggccccccaggccggcccggcccccagggccccccaggagctgctggggagaagggcgtgcctggagagaagggccccatcggccccaccggcagagatggagtgcagggccctgtgggcctgcccggccctgctggccccccaggagtggccggagaagatggagacaagggggaggtgggggaccccggccagaagggcaccaagggcaacaagggggagcacggccccccaggccccccaggccccatcggccctgtgggccagcccggggctgctggagcagatggagagcccggggcccggggcccccagggccactttggagccaagggagatgagggcacccggggcttcaacggccccccaggccccatcggcctgcagggcctgcccggccccagcggggagaagggggagactggagatgtgggccccatgggccccccaggccccccaggcccccggggccctgctggccccaacggggctgatggcccccagggccccccaggaggagtgggcaacctgggccccccaggagagaagggggagcccggggagagcggcagccctggcatccagggcgagcccggggtgaagggccccagaggagagcggggggagaagggggagagcggccagcccggggagcccggccccccaggccccaagggccccactggagatgatggccccaagggcaaccctggccctgtgggcttccctggggaccccggccccccaggagagggcggcccccggggccaggatggagccaagggggacagaggagaagatggagagcccggccagcccggcagccctggccccactggagaaaatggccccccaggccccctgggcaagaggggccctgctggcagccctggcagcgagggccggcagggcggcaagggggccaagggggaccccggggccatcggggcccctgggaagacaggccctgtgggccctgctggccctgctgggaagccaggcccagatggcctgcggggcctgcccggctctgtgggccagcagggccggcctggggccaccggccaggccggccccccaggccctgtgggccccccaggcctgcccggcctgcggggagatgctggggccaagggggagaagggccaccctggcctgattggcctcatcggccccccaggagagcagggcgagaagggggaccggggcctgcccggcccccagggcagccctggccagaagggggagatgggcatccctggggccagcggccccatcggccctgggggccccccaggcctgcccggccctgctggccccaagggggccaagggggccactggacctgggggccccaagggggagaagggcgtgcagggccccccaggccaccctggccccccaggagaggtgatccagcccctgcccatccagatgcccaagaagacccggcgctctgtggatggcagccggctgatgcaggaggatgaggccatccccactggaggagcccctggcagccctgggggcctggaggagatcttcggcagcctggacagcctgcgggaggagattgagcagatgagaagacccaccggcacccaggacagccctgcccggacctgccaggacctgaagctgtgccaccctgagctgcctgatggagagtactgggtggaccccaaccagggctgtgccagagatgccttccgggtcttctgcaacttcaccgctggaggagagacctgtgtgaccccaagagatgatgtgacccagttctcctatgtggacagcgagggcagccctgtgggcgtggtgcagctgaccttcctgcggctgctgtctgtgtctgcccaccaggatgtgtcctacccctgcagcggggccgccagagatggccccctgcggctgcggggggccaatgaagatgagctgagccctgagaccagcccctacgtgaaggagttcagagatggctgccagacccagcagggccgcacagtgctggaggtgaggacccctgtgctggagcagctgcctgtgctggatgccagcttcagtgacctgggcgccccaccccggcggggcggcgtgctgctgggccctgtgtgcttcatgggctag

SEQ ID NO: 3336 - DNA, 5148 bp, Artificial Sequence
  Description of Artificial Sequence: Synthetic coding sequence
atggagcgctgcagccgctgccaccggctgctgctgctgctgcccctggtgctgggcctgtctgctgcccctggctgggccggggcccctcctgtggatgtgctgcgggccctgcgcttccccagcctgcctgatggagtgcggcgggccaagggcatctgcccagcagatgtggcctacagagtggcccggcctgcccagctgagcgcccccacccggcagctgtttcctgggggcttccccaaggacttcagcctgctgactgtggtgaggacccggcccggcctgcaggcccccctgctgaccctgtacagcgcccagggcgtgcggcagctgggcctggagctgggcccccctgtgcgcttcctgtatgaggaccagacaggccggccccagccccccagccagcctgtgttccggggcctgagcctggctgatggcaagtggcaccgggtggccgtggccgtgaagggccagagcgtgaccctcatcgtggactgcaagaagagggtgacccggcccctgcccaggtctgcccggcctgtgctggacacccacggcgtcatcatctttggagcccgcatcctggatgaggaggtgtttgaaggagatgtgcaggagctggccatcgtgcctggggtgcaggccgcctatgagagctgtgagcagaaggagctggagtgtgagggcggccagcgggagcggccccagaaccagcagccccaccgggcccagaggagcccccagcagcagcccagccggctgcaccggccccagaaccaggagccccagagccagcccacagagagcctgtactatgactacaagccaccctactatgatgtgatgaccaccggcaccaccccagactaccaggagcagacagacctgcaggtgcccccaacagctgaccgcttccaggccgaggagtatggagagggcggcacagaccccccagagggcccctatgactacacctacggctatggagatgactaccgggaggagacagagctgggccctgccctgtctgctgagacagcccacagcggggctgctgcccacggcccccggggcctgaagggggagaagggggagcctgctgtgctggagcccggcatgctggtggagggccccccaggccctgagggccctgctggcctgattggccccccaggcatccagggcaaccctggccctgtgggggaccccggggagcggggccccccaggccgggccggcctgcccggcagtgatggagcccctggccccccaggcaccagcctgatgctgcccttccgctttggaagtggcggcggggacaagggccctgtggtggccgcccaggaggcccaggcccaggccatcctgcagcaggcccggctggccctgcggggccccccaggccccatgggctacacaggccggcccggccccctgggccagcccggcagccctggcctgaagggggagagcggggacctgggcccccagggcccccggggcccccagggcctgactggacctcctgggaaggccggcagaagaggccgggccggggctgatggagcccggggcatgcctggggaccccggggtgaagggggaccggggctttgatggcctgcccggcctgcccggggagaagggccacagaggagacacaggagcccagggcctgcccggccccccaggagaagatggagagagaggagatgatggagagatcggcccccggggcctgcccggggagagcggcccccggggcctgctgggccccaagggccccccaggcatccctggccccccaggagtgcggggcatggatggcccccagggccccaagggcagcctgggcccccagggcgagcccggccccccaggccagcagggcaccccaggcacccagggcctgcccggcccccagggcgccatcggcccccacggggagaagggcccccagggcaagccaggcctgcccggcatgcctggcagtgatggccccccaggccaccctgggaaggagggccccccaggcaccaagggcaaccagggccccagcggcccccagggccccctgggctacccaggcccccggggcgtgaagggcgtggatggcatccggggcctgaagggccacaagggggagaagggagaagatggcttccctggcttcaagggggacattggagtgaagggggacagaggagaggtgggcgtgcccggcagcagaggagaagatggccctgagggccccaagggccgcacaggccccactggagaccccggccccccaggcctgatgggagagaagggcaagctgggcgtgcccggcctgcccggctacccaggccggcagggccccaagggcagcctgggcttccctggcttccctggggccagcggggagaagggggcccggggcctgagcggcaagagcggccccagaggagagcggggccccaccggcccccggggccagaggggccccaggggggccaccgggaagagcggggccaagggcaccagcggaggagatggcccccacggccccccaggagagcggggcctgcccggcccccagggccccaacggcttccctggccccaagggccccccaggccccccaggcaaggatggcctgcccggccaccctggccagagaggagaggtgggcttccagggcaagacaggccccccaggccccccaggagtggtgggcccccagggcgccgccggggagaccggccccatgggagagcggggccaccctggccccccaggccccccaggagagcagggcctgcccggcacagctgggaaggagggcaccaagggggaccccggccccccaggggcccctgggaaggatggccctgctggcctgcggggcttccctggagagcggggcctgcccggcacagctgggggccctggcctgaagggaaatgaaggccccagcggccccccaggccctgctggcagccctggagagagaggagctgctggcagcggcggccccatcggccccccaggccggcccggcccccagggccccccaggagctgctggggagaagggcgtgcctggagagaagggccccatcggccccaccggcagagatggagtgcagggccctgtgggcctgcccggccctgctggccccccaggagtggccggagaagatggagacaagggggaggtgggggaccccggccagaagggcaccaagggcaacaagggggagcacggccccccaggccccccaggccccatcggccctgtgggccagcccggggctgctggagcagatggagagcccggggcccggggcccccagggccactttggagccaagggagatgagggcacccggggcttcaacggccccccaggccccatcggcctgcagggcctgcccggccccagcggggagaagggggagactggagatgtgggccccatgggccccccaggccccccaggcccccggggccctgctggccccaacggggctgatggcccccagggccccccaggaggagtgggcaacctgggccccccaggagagaagggggagcccggggagagcggcagccctggcatccagggcgagcccggggtgaagggccccagaggagagcggggggagaagggggagagcggccagcccggggagcccggccccccaggccccaagggccccactggagatgatggccccaagggcaaccctggccctgtgggcttccctggggaccccggccccccaggagagggcggcccccggggccaggatggagccaagggggacagaggagaagatggagagcccggccagcccggcagccctggccccactggagaaaatggccccccaggccccctgggcaagaggggccctgctggcagccctggcagcgagggccggcagggcggcaagggggccaagggggaccccggggccatcggggcccctgggaagacaggccctgtgggccctgctggccctgctgggaagccaggcccagatggcctgcggggcctgcccggctctgtgggccagcagggccggcctggggccaccggccaggccggccccccaggccctgtgggccccccaggcctgcccggcctgcggggagatgctggggccaagggggagaagggccaccctggcctgattggcctcatcggccccccaggagagcagggcgagaagggggaccggggcctgcccggcccccagggcagccctggccagaagggggagatgggcatccctggggccagcggccccatcggccctgggggccccccaggcctgcccggccctgctggccccaagggggccaagggggccactggacctgggggccccaagggggagaagggcgtgcagggccccccaggccaccctggccccccaggagaggtgatccagcccctgcccatccagatgcccaagaagacccggcgctctgtggatggcagccggctgatgcaggaggatgaggccatccccactggaggagcccctggcagccctgggggcctggaggagatcttcggcagcctggacagcctgcgggaggagattgagcagatgagaagacccaccggcacccaggacagccctgcccggacctgccaggacctgaagctgtgccaccctgagctgcctgatggagagtactgggtggaccccaaccagggctgtgccagagatgccttccgggtcttctgcaacttcaccgctggaggagagacctgtgtgaccccaagagatgatgtgacccagttctcctatgtggacagcgagggcagccctgtgggcgtggtgcagctgaccttcctgcggctgctgtctgtgtctgcccaccaggatgtgtcctacccctgcagcggggccgccagagatggccccctgcggctgcggggggccaatgaagatgagctgagccctgagaccagcccctacgtgaaggagttcagagatggctgccagacccagcagggccgcacagtgctggaggtgaggacccctgtgctggagcagctgcctgtgctggatgccagcttcagtgacctgggcgccccaccccggcggggcggcgtgctgctgggccctgtgtgcttcatgggctag

SEQ ID NO: 3337 - DNA, 5031 bp, Artificial Sequence; identical to SEQ ID NO: 3302
  Description of Artificial Sequence: Synthetic coding sequence

SEQ ID NO: 3338 - DNA, 4968 bp, Artificial Sequence; identical to SEQ ID NO: 3300
  Description of Artificial Sequence: Synthetic coding sequence

SEQ ID NO: 3339 - DNA, 5148 bp, Artificial Sequence; identical to SEQ ID NO: 3335
  Description of Artificial Sequence: Synthetic coding sequence

SEQ ID NO: 3340 - DNA, 9192 bp, Artificial Sequence
  Description of Artificial Sequence: Synthetic coding sequence
atgaggagccggctgcccccagccctggccgccctgggcgccgccctgctgctgagcagcattgaagctgaggtggaccccccaagtgacctgaacttcaagatcattgatgagaacacagtgcacatgtcctgggccaagcctgtggaccccatcgtgggctaccgcatcaccgtggaccccaccacagatggccccaccaaggagttcaccctgagcgccagcaccacagagaccctgctgtctgagctggtgcctgagacagaatatgtggtgaccatcaccagctatgatgaggtggaggagagcgtgcctgtgattggccagctgaccatccagacaggcagcagcaccaagcctgtggagaagaagccaggcaagacagagatccagaagtgcagcgtgtctgcctggacagacctggtgttcctggtggatggctcctggagcgtgggcaggaacaacttcaagtacatcctggacttcatcgccgccctggtgtctgcctttgacatcggggaggagaagaccagggtgggcgtggtgcagtacagcagtgacaccaggacagagttcaacctgaaccagtactaccagagagatgagctgctggccgccatcaagaagatcccctacaagggcggcaacaccatgactggagatgccatcgactacctggtgaagaacaccttcacagagagcgctggggcccgggtgggcttccccaaggtggccatcatcatcacagatggcaagagccaggatgaggtggagatcccagcccgggagctgagaaatgtgggcgtggaggtgttcagcctgggcatcaaggctgctgatgccaaggagctgaagcagatcgccagcacccccagcctgaaccacgtgttcaacgtggccaactttgatgccatcgtggacatccagaatgagatcatcagccaggtgtgcagcggcgtggatgagcagctgggggagctggtgtctggagaggaggtggtggagccccccagcaacctgattgccatggaggtgagcagcaaatatgtgaagctgaactggaaccccagccccagccctgtgacaggctacaaggtgatcctgacccccatgacagctggcagccggcagcacgccctgtctgtgggcccccagaccaccaccctgtctgtgcgggacctgtctgctgacacagagtaccagatctctgtgtctgccatgaagggcatgaccagcagcgagcccatcagcatcatggagaagacccagcccatgaaggtgcaggtggagtgcagccggggcgtggacatcaaggctgacatcgtgttcctggtggatggcagctacagcattggaattgccaactttgtgaaggtgcgggccttcctggaggtgctggtgaagagctttgagatcagccccaacagagtgcagatcagcctggtgcagtacagccgggacccccacacagagttcaccctgaagaagttcaccaaggtggaggacatcatcgaggccatcaacaccttcccctaccggggcggcagcaccaacacaggcaaggccatgacctacgtgcgggagaagatctttgtgcccagcaagggcagccgcagcaatgtgcccaaggtgatgatcctgatcacagatggcaagagcagtgatgccttccgggaccctgccatcaagctgaggaacagtgatgtggagatctttgctgtgggcgtgaaggatgctgtgcgctctgagctggaggccatcgccagccccccagctgagacccacgtgttcaccgtggaggactttgatgccttccagaggatcagctttgagctgacccagagcatctgcctgcgcatcgagcaggagctggccgccatcaagaagaaggcctacgtgccccccaaggacctgtccttcagcgaggtgaccagctatggcttcaagaccaactggagccctgctggagaaaatgtgttctcctaccacatcacctacaaggaggccgctggagatgatgaggtgacagtggtggagcccgccagcagcacctctgtggtgctgagcagcctgaagccagagaccctgtacctggtgaatgtgacagcagaatatgaagatggcttcagcatccccctggccggggaggagaccacagaggaggtgaagggggcccccaggaacctgaaggtgacagatgagaccacagacagcttcaagatcacctggacccaggcccctggccgggtgctgcgctaccgcatcatctacagacctgtggccggcggggagagccgggaggtgaccaccccacccaaccagaggaggaggaccctggagaacctgatcccagacaccaagtatgaggtgtctgtcatccctgagtacttcagcggccctggcacccccctgactggaaatgctgccacagaggaggtgcggggcaacccccgggacctgcgggtgtctgaccccaccaccagcaccatgaagctgtcctggagcggggcccctgggaaggtgaagcagtacctggtgacctacacccctgtggccggcggggagacccaggaggtgacagtgcggggggacaccaccaacacagtgctgcagggcctgaaggagggcacccagtatgccctgtctgtgacagccctgtatgccagcggggctggagatgccctgtttggagagggcaccaccctggaggagcggggcagcccccaggacctggtgaccaaggacatcacagacaccagcattggagcctactggaccagcgcccctggcatggtgcggggctacagagtgtcctggaagagcctgtatgatgatgtggacaccggggagaagaacctgcctgaagatgccatccacaccatgattgagaacctgcagcctgagaccaagtaccgcatctctgtgtttgccacctacagcagtggagagggggagcccctgactggagatgccaccacagagctgagccaggacagcaagaccctgaaggtggatgaggagacagagaacaccatgagggtgacctggaagccagcccctgggaaggtggtgaactacagagtggtgtaccggccccacggccggggcaagcagatggtggccaaggtgccccccaccgtgaccagcacagtgctgaagaggctgcagccccagaccacctatgacatcaccgtgctgcccatctacaagatgggagagggcaagctgcggcagggcagcggcaccacagccagccgcttcaagagccccaggaacctgaagaccagtgaccccaccatgagcagcttccgggtgacctgggagcccgcccctggagaggtgaagggctacaaggtgaccttccaccccactggagatgaccggcggctgggggagctggtggtgggcccctatgacaacacagtggtgctggaggagctgcgggccggcaccacctacaaggtgaatgtgtttggcatgtttgatggaggagagagcagccccctggtgggccaggagatgaccaccctgagtgacaccaccgtgatgcccatcctgagcagcggcatggagtgcctgaccagggctgaggccgacatcgtgctgctggtggatggctcctggagcatcggccgggccaacttcagaacagtgcgctccttcatcagcagaattgtggaggtgtttgatattggccccaagagggtgcagatcgccctggcccagtacagcggggaccccaggacagagtggcagctgaatgcccaccgggacaagaagagcctgctgcaggccgtggccaacctgccctacaagggcggcaacaccctgaccggcatggccctgaacttcatccggcagcagaacttccgcacccaggccggcatgaggccccgggccaggaagattggagtgctgatcacagatggcaagagccaggatgatgtggaggcccccagcaagaagctgaaggatgaaggagtggagctgtttgccatcggcatcaagaatgctgatgaggtggagctgaagatgattgccacagatcctgatgacacccacgcctacaacgtggccgactttgagagcctgagcagaattgtggatgacctgaccatcaacctgtgcaacagcgtgaagggccctggggacctggaggcccccagcaacctggtgatcagcgagaggacccacaggagcttccgggtgtcctggaccccacccagcgacagcgtggaccgctacaaggtggagtactaccctgtgtctgggggcaagaggcaggagttctacgtgtccaggatggagaccagcacagtgctgaaggacctgaagccagagacagaatatgtggtgaatgtgtacagcgtggtggaggatgagtacagcgagcccctgaagggcacagagaagaccctgcctgtgcctgtggtgtccctgaacatctatgatgtgggccccaccaccatgcacgtgcagtggcagcctgtgggcggggccaccggctacatcctgagctacaagcctgtgaaggacacagagcccacccggcccaaggaggtgcggctgggccccaccgtgaatgacatgcagctgacagacctggtgcccaacacagaatatgctgtgacagtgcaggccgtgctgcatgacctgaccagcgagcctgtgacagtgcgggaggtgaccctgcccctgccccggccccaggacctgaagctgagagatgtgacccacagcaccatgaatgtgttctgggagcctgtgcctgggaaggtgaggaagtacatcgtgcgctacaagaccccagaagaagatgtgaaggaggtggaggtggacagaagtgagaccagcaccagcctgaaggacctcttcagccagaccctgtacacagtgtctgtgtctgctgtgcatgatgaaggagagagcccccctgtgacagcccaggagaccaccaggcctgtgcctgcccccaccaacctgaagatcacagaggtgaccagcgagggcttccggggcacctgggaccatggagccagtgatgtgtccctgtaccgcatcacctgggcccccttcggcagcagtgacaagatggagaccatcctgaatggagatgagaacaccctggtgtttgagaacctgaaccccaacaccatctatgaggtgtccatcacagccatctacccagatgagagcgagagtgatgacctgattggcagcgagaggaccctgcccatcctgaccacccaggcccccaagagcggccccaggaacctgcaggtgtacaatgccaccagcaacagcctgactgtgaagtgggaccctgccagcggccgggtgcagaagtaccgcatcacctaccagcccagcactggagagggcaatgagcagaccaccaccatcggcggccggcagaacagcgtggtgctgcagaagctgaagccagacaccccctacaccatcaccgtgagcagcctgtacccagatggagagggcggccgcatgacaggccggggcaagaccaagcccctgaacacagtgaggaacctgcgggtgtatgaccccagcaccagcaccctgaatgtgcgctgggaccatgctgagggcaacccccggcagtacaagctgttctacgccccagctgctgggggccctgaggagctggtgcccatccctggcaacaccaactatgccatcctgaggaacctgcagcctgacaccagctacacagtgacagtggtgcctgtgtacacagaaggagatggcggccgcaccagtgacaccggccgcaccctgatgaggggcctggccagaaatgtgcaggtgtacaaccccacccccaacagcctggatgtgcgctgggaccctgcccctggccctgtgctgcagtacagagtggtgtacagccctgtggatggcacccggcccagcgagagcatcgtggtgcccggcaacaccaggatggtgcacctggagcggctcatcccagacaccctgtacagcgtgaacctggtggccctgtacagtgatggagagggcaaccccagccctgcccagggccgcaccctgcccaggagcggccccaggaacctgcgggtgtttggagagaccaccaacagcctgtctgtggcctgggaccacgcagatggccctgtgcagcagtaccgcatcatctacagccccaccgtgggggaccccattgatgagtacaccaccgtgcccggcagaagaaataatgtcatcctgcagcccctgcagcctgacaccccctacaagatcaccgtgattgctgtgtatgaagatggagatggcggccacctgactggaaatggccgcacagtgggcctgctgcccccccagaacatccacatcagtgatgagtggtacacccgcttccgggtgtcctgggaccccagccccagccctgtgctgggctacaagatcgtgtacaagcctgtgggcagcaatgagcccatggaggcctttgtgggggagatgaccagctacaccctgcacaacctgaaccccagcaccacctatgatgtgaatgtgtatgcccagtatgacagcggcctgtctgtgcccctgacagaccagggcaccaccctgtacctgaatgtgacagacctgaagacctaccagatcggctgggacaccttctgtgtgaagtggagcccccacagagctgccaccagctaccgcctgaagctgagccctgcagatggcacccggggccaggagatcaccgtgcggggcagcgagaccagccactgcttcaccggcctgagcccagacacagattatggagtgacagtgtttgtgcagacccccaacctggagggccctggggtgtctgtgaaggagcacaccaccgtgaagcccacagaggcccccacagagccccccaccccacctcctccacccaccatccccccagccagagatgtgtgcaagggggccaaggctgacatcgtgttcctgacagatgcctcctggagcattggagatgacaacttcaacaaggtggtgaagttcatcttcaacacagtgggcggctttgatgagatcagccctgctggcatccaggtgtcctttgtgcagtacagtgatgaggtgaagtctgagttcaagctgaacacctacaatgacaaggccctggccctgggcgccctgcagaacatccgctaccggggcggcaacaccaggacaggcaaggccctgaccttcatcaaggagaaggtgctgacctgggagagcggcatgaggaagaatgtgcccaaggtgctggtggtggtgacagatggccgcagccaggatgaggtgaagaaggccgccctggtgatccagcagagcggcttctctgtgtttgtggtgggcgtggctgatgtggactacaatgagctggccaacatcgccagcaagcccagcgagagacatgtgttcatcgtggatgactttgagagctttgagaagattgaggacaacctgatcacctttgtgtgtgaaacagccaccagcagctgccccctcatctacctggatggctacaccagccctggcttcaagatgctggaggcctacaacctgacagagaagaactttgcctctgtgcagggcgtgtccctggagagcggcagcttccccagctacagcgcctaccgcatccagaagaatgcctttgtgaaccagcccacagctgacctgcaccccaacggcctgccccccagctacaccatcatcctgctcttccggctgctgcctgagacccccagcgacccctttgccatctggcagatcacagaccgggactacaagccccaggtgggcgtgattgctgaccccagcagcaagaccctgtccttcttcaacaaggacaccagaggagaggtgcagacagtgacctttgacacagaggaggtgaagaccctcttctacggcagcttccacaaggtgcacatcgtggtgaccagcaagtctgtgaagatctacatcgactgctatgagatcatcgagaaggacatcaaggaggccggcaacatcaccacagatggctatgagatcctgggcaagctgctgaagggggagaggaagtctgctgccttccagatccagagctttgacatcgtgtgcagccctgtgtggaccagccgggaccgctgctgtgacatccccagcagaagagatgagggcaaatgtcctgccttccccaacagctgcacctgcacccaggacagcgtgggccccccaggccccccaggccctgctgggggccctggggccaagggccccagaggagagcggggcatcagcggggccatcggccccccaggccccaggggggacatcggccccccaggcccccagggccccccaggcccccagggccccaacggcctgagcatccctggagagcagggccggcagggcatgaagggagatgctggggagcccggcctgcccggccgcacaggcaccccaggcctgcccggccccccaggccccatgggccccccaggggaccggggcttcaccgggaaggatggagccatgggcccccggggccccccaggccccccaggcagccctggcagccctggggtgacaggccccagcggcaagccaggcaagccaggggaccacggccggcccggccccagcggcctgaagggggagaagggggacagaggagacatcgccagccagaacatgatgagagctgtggcccggcaggtgtgtgagcagctgatcagcggccagatgaaccgcttcaaccagatgctgaaccagatccccaatgactaccagagcagcaggaaccagcccggccccccaggccccccaggccccccaggcagcgctggggcccggggggagcccggccctgggggccggcccggcttccctggcaccccaggcatgcagggccccccaggagagcggggcctgcctggagagaagggggagcggggcaccggcagcagcggcccccggggcctgcccggccccccaggcccccagggcgagagcaggactggacctcctggcagcacaggcagccggggccccccaggccccccaggccggcccggcaacagcggcatccggggccccccaggccccccaggctactgtgacagcagccagtgtgccagcatcccctacaacggccagggctacccaggcagcggctag

SEQ ID NO: 3341 - DNA, 5700 bp, Artificial Sequence
  Description of Artificial Sequence: Synthetic coding sequence
atgaggagccggctgcccccagccctggccgccctgggcgccgccctgctgctgagcagcattgaagctgagggcatggagtgcctgaccagggctgaggccgacatcgtgctgctggtggatggctcctggagcatcggccgggccaacttcagaacagtgcgctccttcatcagcagaattgtggaggtgtttgatattggccccaagagggtgcagatcgccctggcccagtacagcggggaccccaggacagagtggcagctgaatgcccaccgggacaagaagagcctgctgcaggccgtggccaacctgccctacaagggcggcaacaccctgaccggcatggccctgaacttcatccggcagcagaacttccgcacccaggccggcatgaggccccgggccaggaagattggagtgctgatcacagatggcaagagccaggatgatgtggaggcccccagcaagaagctgaaggatgaaggagtggagctgtttgccatcggcatcaagaatgctgatgaggtggagctgaagatgattgccacagatcctgatgacacccacgcctacaacgtggccgactttgagagcctgagcagaattgtggatgacctgaccatcaacctgtgcaacagcgtgaagggccctggggacctggaggcccccagcaacctggtgatcagcgagaggacccacaggagcttccgggtgtcctggaccccacccagcgacagcgtggaccgctacaaggtggagtactaccctgtgtctgggggcaagaggcaggagttctacgtgtccaggatggagaccagcacagtgctgaaggacctgaagccagagacagaatatgtggtgaatgtgtacagcgtggtggaggatgagtacagcgagcccctgaagggcacagagaagaccctgcctgtgcctgtggtgtccctgaacatctatgatgtgggccccaccaccatgcacgtgcagtggcagcctgtgggcggggccaccggctacatcctgagctacaagcctgtgaaggacacagagcccacccggcccaaggaggtgcggctgggccccaccgtgaatgacatgcagctgacagacctggtgcccaacacagaatatgctgtgacagtgcaggccgtgctgcatgacctgaccagcgagcctgtgacagtgcgggaggtgaccctgcccctgccccggccccaggacctgaagctgagagatgtgacccacagcaccatgaatgtgttctgggagcctgtgcctgggaaggtgaggaagtacatcgtgcgctacaagaccccagaagaagatgtgaaggaggtggaggtggacagaagtgagaccagcaccagcctgaaggacctcttcagccagaccctgtacacagtgtctgtgtctgctgtgcatgatgaaggagagagcccccctgtgacagcccaggagaccaccaggcctgtgcctgcccccaccaacctgaagatcacagaggtgaccagcgagggcttccggggcacctgggaccatggagccagtgatgtgtccctgtaccgcatcacctgggcccccttcggcagcagtgacaagatggagaccatcctgaatggagatgagaacaccctggtgtttgagaacctgaaccccaacaccatctatgaggtgtccatcacagccatctacccagatgagagcgagagtgatgacctgattggcagcgagaggaccctgcccatcctgaccacccaggcccccaagagcggccccaggaacctgcaggtgtacaatgccaccagcaacagcctgactgtgaagtgggaccctgccagcggccgggtgcagaagtaccgcatcacctaccagcccagcactggagagggcaatgagcagaccaccaccatcggcggccggcagaacagcgtggtgctgcagaagctgaagccagacaccccctacaccatcaccgtgagcagcctgtacccagatggagagggcggccgcatgacaggccggggcaagaccaagcccctgaacacagtgaggaacctgcgggtgtatgaccccagcaccagcaccctgaatgtgcgctgggaccatgctgagggcaacccccggcagtacaagctgttctacgccccagctgctgggggccctgaggagctggtgcccatccctggcaacaccaactatgccatcctgaggaacctgcagcctgacaccagctacacagtgacagtggtgcctgtgtacacagaaggagatggcggccgcaccagtgacaccggccgcaccctgatgaggggcctggccagaaatgtgcaggtgtacaaccccacccccaacagcctggatgtgcgctgggaccctgcccctggccctgtgctgcagtacagagtggtgtacagccctgtggatggcacccggcccagcgagagcatcgtggtgcccggcaacaccaggatggtgcacctggagcggctcatcccagacaccctgtacagcgtgaacctggtggccctgtacagtgatggagagggcaaccccagccctgcccagggccgcaccctgcccaggagcggccccaggaacctgcgggtgtttggagagaccaccaacagcctgtctgtggcctgggaccacgcagatggccctgtgcagcagtaccgcatcatctacagccccaccgtgggggaccccattgatgagtacaccaccgtgcccggcagaagaaataatgtcatcctgcagcccctgcagcctgacaccccctacaagatcaccgtgattgctgtgtatgaagatggagatggcggccacctgactggaaatggccgcacagtgggcctgctgcccccccagaacatccacatcagtgatgagtggtacacccgcttccgggtgtcctgggaccccagccccagccctgtgctgggctacaagatcgtgtacaagcctgtgggcagcaatgagcccatggaggcctttgtgggggagatgaccagctacaccctgcacaacctgaaccccagcaccacctatgatgtgaatgtgtatgcccagtatgacagcggcctgtctgtgcccctgacagaccagggcaccaccctgtacctgaatgtgacagacctgaagacctaccagatcggctgggacaccttctgtgtgaagtggagcccccacagagctgccaccagctaccgcctgaagctgagccctgcagatggcacccggggccaggagatcaccgtgcggggcagcgagaccagccactgcttcaccggcctgagcccagacacagattatggagtgacagtgtttgtgcagacccccaacctggagggccctggggtgtctgtgaaggagcacaccaccgtgaagcccacagaggcccccacagagccccccaccccacctcctccacccaccatccccccagccagagatgtgtgcaagggggccaaggctgacatcgtgttcctgacagatgcctcctggagcattggagatgacaacttcaacaaggtggtgaagttcatcttcaacacagtgggcggctttgatgagatcagccctgctggcatccaggtgtcctttgtgcagtacagtgatgaggtgaagtctgagttcaagctgaacacctacaatgacaaggccctggccctgggcgccctgcagaacatccgctaccggggcggcaacaccaggacaggcaaggccctgaccttcatcaaggagaaggtgctgacctgggagagcggcatgaggaagaatgtgcccaaggtgctggtggtggtgacagatggccgcagccaggatgaggtgaagaaggccgccctggtgatccagcagagcggcttctctgtgtttgtggtgggcgtggctgatgtggactacaatgagctggccaacatcgccagcaagcccagcgagagacatgtgttcatcgtggatgactttgagagctttgagaagattgaggacaacctgatcacctttgtgtgtgaaacagccaccagcagctgccccctcatctacctggatggctacaccagccctggcttcaagatgctggaggcctacaacctgacagagaagaactttgcctctgtgcagggcgtgtccctggagagcggcagcttccccagctacagcgcctaccgcatccagaagaatgcctttgtgaaccagcccacagctgacctgcaccccaacggcctgccccccagctacaccatcatcctgctcttccggctgctgcctgagacccccagcgacccctttgccatctggcagatcacagaccgggactacaagccccaggtgggcgtgattgctgaccccagcagcaagaccctgtccttcttcaacaaggacaccagaggagaggtgcagacagtgacctttgacacagaggaggtgaagaccctcttctacggcagcttccacaaggtgcacatcgtggtgaccagcaagtctgtgaagatctacatcgactgctatgagatcatcgagaaggacatcaaggaggccggcaacatcaccacagatggctatgagatcctgggcaagctgctgaagggggagaggaagtctgctgccttccagatccagagctttgacatcgtgtgcagccctgtgtggaccagccgggaccgctgctgtgacatccccagcagaagagatgagggcaaatgtcctgccttccccaacagctgcacctgcacccaggacagcgtgggccccccaggccccccaggccctgctgggggccctggggccaagggccccagaggagagcggggcatcagcggggccatcggccccccaggccccaggggggacatcggccccccaggcccccagggccccccaggcccccagggccccaacggcctgagcatccctggagagcagggccggcagggcatgaagggagatgctggggagcccggcctgcccggccgcacaggcaccccaggcctgcccggccccccaggccccatgggccccccaggggaccggggcttcaccgggaaggatggagccatgggcccccggggccccccaggccccccaggcagccctggcagccctggggtgacaggccccagcggcaagccaggcaagccaggggaccacggccggcccggccccagcggcctgaagggggagaagggggacagaggagacatcgccagccagaacatgatgagagctgtggcccggcaggtgtgtgagcagctgatcagcggccagatgaaccgcttcaaccagatgctgaaccagatccccaatgactaccagagcagcaggaaccagcccggccccccaggccccccaggccccccaggcagcgctggggcccggggggagcccggccctgggggccggcccggcttccctggcaccccaggcatgcagggccccccaggagagcggggcctgcctggagagaagggggagcggggcaccggcagcagcggcccccggggcctgcccggccccccaggcccccagggcgagagcaggactggacctcctggcagcacaggcagccggggccccccaggccccccaggccggcccggcaacagcggcatccggggccccccaggccccccaggctactgtgacagcagccagtgtgccagcatcccctacaacggccagggctacccaggcagcggctag

SEQ ID NO: 3342 - DNA, 8964 bp, Artificial Sequence
  Description of Artificial Sequence: Synthetic coding sequence
atgaggagccggctgcccccagccctggccgccctgggcgccgccctgctgctgagcagcattgaagctgaggtggaccccccaagtgacctgaacttcaagatcattgatgagaacacagtgcacatgtcctgggccaagcctgtggaccccatcgtgggctaccgcatcaccgtggaccccaccacagatggccccaccaaggagttcaccctgagcgccagcaccacagagaccctgctgtctgagctggtgcctgagacagaatatgtggtgaccatcaccagctatgatgaggtggaggagagcgtgcctgtgattggccagctgaccatccagacaggcagcagcaccaagcctgtggagaagaagccaggcaagacagagatccagaagtgcagcgtgtctgcctggacagacctggtgttcctggtggatggctcctggagcgtgggcaggaacaacttcaagtacatcctggacttcatcgccgccctggtgtctgcctttgacatcggggaggagaagaccagggtgggcgtggtgcagtacagcagtgacaccaggacagagttcaacctgaaccagtactaccagagagatgagctgctggccgccatcaagaagatcccctacaagggcggcaacaccatgactggagatgccatcgactacctggtgaagaacaccttcacagagagcgctggggcccgggtgggcttccccaaggtggccatcatcatcacagatggcaagagccaggatgaggtggagatcccagcccgggagctgagaaatgtgggcgtggaggtgttcagcctgggcatcaaggctgctgatgccaaggagctgaagcagatcgccagcacccccagcctgaaccacgtgttcaacgtggccaactttgatgccatcgtggacatccagaatgagatcatcagccaggtgtgcagcggcgtggatgagcagctgggggagctggtgtctggagaggaggtggtggagccccccagcaacctgattgccatggaggtgagcagcaaatatgtgaagctgaactggaaccccagccccagccctgtgacaggctacaaggtgatcctgacccccatgacagctggcagccggcagcacgccctgtctgtgggcccccagaccaccaccctgtctgtgcgggacctgtctgctgacacagagtaccagatctctgtgtctgccatgaagggcatgaccagcagcgagcccatcagcatcatggagaagacccagcccatgaaggtgcaggtggagtgcagccggggcgtggacatcaaggctgacatcgtgttcctggtggatggcagctacagcattggaattgccaactttgtgaaggtgcgggccttcctggaggtgctggtgaagagctttgagatcagccccaacagagtgcagatcagcctggtgcagtacagccgggacccccacacagagttcaccctgaagaagttcaccaaggtggaggacatcatcgaggccatcaacaccttcccctaccggggcggcagcaccaacacaggcaaggccatgacctacgtgcgggagaagatctttgtgcccagcaagggcagccgcagcaatgtgcccaaggtgatgatcctgatcacagatggcaagagcagtgatgccttccgggaccctgccatcaagctgaggaacagtgatgtggagatctttgctgtgggcgtgaaggatgctgtgcgctctgagctggaggccatcgccagccccccagctgagacccacgtgttcaccgtggaggactttgatgccttccagaggatcagctttgagctgacccagagcatctgcctgcgcatcgagcaggagctggccgccatcaagaagaaggcctacgtgccccccaaggacctgtccttcagcgaggtgaccagctatggcttcaagaccaactggagccctgctggagaaaatgtgttctcctaccacatcacctacaaggaggccgctggagatgatgaggtgacagtggtggagcccgccagcagcacctctgtggtgctgagcagcctgaagccagagaccctgtacctggtgaatgtgacagcagaatatgaagatggcttcagcatccccctggccggggaggagaccacagaggaggtgaagggggcccccaggaacctgaaggtgacagatgagaccacagacagcttcaagatcacctggacccaggcccctggccgggtgctgcgctaccgcatcatctacagacctgtggccggcggggagagccgggaggtgaccaccccacccaaccagaggaggaggaccctggagaacctgatcccagacaccaagtatgaggtgtctgtcatccctgagtacttcagcggccctggcacccccctgactggaaatgctgccacagaggaggtgcggggcaacccccgggacctgcgggtgtctgaccccaccaccagcaccatgaagctgtcctggagcggggcccctgggaaggtgaagcagtacctggtgacctacacccctgtggccggcggggagacccaggaggtgacagtgcggggggacaccaccaacacagtgctgcagggcctgaaggagggcacccagtatgccctgtctgtgacagccctgtatgccagcggggctggagatgccctgtttggagagggcaccaccctggaggagcggggcagcccccaggacctggtgaccaaggacatcacagacaccagcattggagcctactggaccagcgcccctggcatggtgcggggctacagagtgtcctggaagagcctgtatgatgatgtggacaccggggagaagaacctgcctgaagatgccatccacaccatgattgagaacctgcagcctgagaccaagtaccgcatctctgtgtttgccacctacagcagtggagagggggagcccctgactggagatgccaccacagagctgagccaggacagcaagaccctgaaggtggatgaggagacagagaacaccatgagggtgacctggaagccagcccctgggaaggtggtgaactacagagtggtgtaccggccccacggccggggcaagcagatggtggccaaggtgccccccaccgtgaccagcacagtgctgaagaggctgcagccccagaccacctatgacatcaccgtgctgcccatctacaagatgggagagggcaagctgcggcagggcagcggcaccacagccagccgcttcaagagccccaggaacctgaagaccagtgaccccaccatgagcagcttccgggtgacctgggagcccgcccctggagaggtgaagggctacaaggtgaccttccaccccactggagatgaccggcggctgggggagctggtggtgggcccctatgacaacacagtggtgctggaggagctgcgggccggcaccacctacaaggtgaatgtgtttggcatgtttgatggaggagagagcagccccctggtgggccaggagatgaccaccctgagtgacaccaccgtgatgcccatcctgagcagcggcatggagtgcctgaccagggctgaggccgacatcgtgctgctggtggatggctcctggagcatcggccgggccaacttcagaacagtgcgctccttcatcagcagaattgtggaggtgtttgatattggccccaagagggtgcagatcgccctggcccagtacagcggggaccccaggacagagtggcagctgaatgcccaccgggacaagaagagcctgctgcaggccgtggccaacctgccctacaagggcggcaacaccctgaccggcatggccctgaacttcatccggcagcagaacttccgcacccaggccggcatgaggccccgggccaggaagattggagtgctgatcacagatggcaagagccaggatgatgtggaggcccccagcaagaagctgaaggatgaaggagtggagctgtttgccatcggcatcaagaatgctgatgaggtggagctgaagatgattgccacagatcctgatgacacccacgcctacaacgtggccgactttgagagcctgagcagaattgtggatgacctgaccatcaacctgtgcaacagcgtgaagggccctggggacctggaggcccccagcaacctggtgatcagcgagaggacccacaggagcttccgggtgtcctggaccccacccagcgacagcgtggaccgctacaaggtggagtactaccctgtgtctgggggcaagaggcaggagttctacgtgtccaggatggagaccagcacagtgctgaaggacctgaagccagagacagaatatgtggtgaatgtgtacagcgtggtggaggatgagtacagcgagcccctgaagggcacagagaagaccctgcctgtgcctgtggtgtccctgaacatctatgatgtgggccccaccaccatgcacgtgcagtggcagcctgtgggcggggccaccggctacatcctgagctacaagcctgtgaaggacacagagcccacccggcccaaggaggtgcggctgggccccaccgtgaatgacatgcagctgacagacctggtgcccaacacagaatatgctgtgacagtgcaggccgtgctgcatgacctgaccagcgagcctgtgacagtgcgggaggtgaccctgcccctgccccggccccaggacctgaagctgagagatgtgacccacagcaccatgaatgtgttctgggagcctgtgcctgggaaggtgaggaagtacatcgtgcgctacaagaccccagaagaagatgtgaaggaggtggaggtggacagaagtgagaccagcaccagcctgaaggacctcttcagccagaccctgtacacagtgtctgtgtctgctgtgcatgatgaaggagagagcccccctgtgacagcccaggagaccaccaggcctgtgcctgcccccaccaacctgaagatcacagaggtgaccagcgagggcttccggggcacctgggaccatggagccagtgatgtgtccctgtaccgcatcacctgggcccccttcggcagcagtgacaagatggagaccatcctgaatggagatgagaacaccctggtgtttgagaacctgaaccccaacaccatctatgaggtgtccatcacagccatctacccagatgagagcgagagtgatgacctgattggcagcgagaggaccctgcccatcctgaccacccaggcccccaagagcggccccaggaacctgcaggtgtacaatgccaccagcaacagcctgactgtgaagtgggaccctgccagcggccgggtgcagaagtaccgcatcacctaccagcccagcactggagagggcaatgagcagaccaccaccatcggcggccggcagaacagcgtggtgctgcagaagctgaagccagacaccccctacaccatcaccgtgagcagcctgtacccagatggagagggcggccgcatgacaggccggggcaagaccaagcccctgaacacagtgaggaacctgcgggtgtatgaccccagcaccagcaccctgaatgtgcgctgggaccatgctgagggcaacccccggcagtacaagctgttctacgccccagctgctgggggccctgaggagctggtgcccatccctggcaacaccaactatgccatcctgaggaacctgcagcctgacaccagctacacagtgacagtggtgcctgtgtacacagaaggagatggcggccgcaccagtgacaccggccgcaccctgatgaggggcctggccagaaatgtgcaggtgtacaaccccacccccaacagcctggatgtgcgctgggaccctgcccctggccctgtgctgcagtacagagtggtgtacagccctgtggatggcacccggcccagcgagagcatcgtggtgcccggcaacaccaggatggtgcacctggagcggctcatcccagacaccctgtacagcgtgaacctggtggccctgtacagtgatggagagggcaaccccagccctgcccagggccgcaccctgcccaggagcggccccaggaacctgcgggtgtttggagagaccaccaacagcctgtctgtggcctgggaccacgcagatggccctgtgcagcagtaccgcatcatctacagccccaccgtgggggaccccattgatgagtacaccaccgtgcccggcagaagaaataatgtcatcctgcagcccctgcagcctgacaccccctacaagatcaccgtgattgctgtgtatgaagatggagatggcggccacctgactggaaatggccgcacagtgggcctgctgcccccccagaacatccacatcagtgatgagtggtacacccgcttccgggtgtcctgggaccccagccccagccctgtgctgggctacaagatcgtgtacaagcctgtgggcagcaatgagcccatggaggcctttgtgggggagatgaccagctacaccctgcacaacctgaaccccagcaccacctatgatgtgaatgtgtatgcccagtatgacagcggcctgtctgtgcccctgacagaccagggcaccaccctgtacctgaatgtgacagacctgaagacctaccagatcggctgggacaccttctgtgtgaagtggagcccccacagagctgccaccagctaccgcctgaagctgagccctgcagatggcacccggggccaggagatcaccgtgcggggcagcgagaccagccactgcttcaccggcctgagcccagacacagattatggagtgacagtgtttgtgcagacccccaacctggagggccctggggtgtctgtgaaggagcacaccaccgtgaagcccacagaggcccccacagagccccccaccccacctcctccacccaccatccccccagccagagatgtgtgcaagggggccaaggctgacatcgtgttcctgacagatgcctcctggagcattggagatgacaacttcaacaaggtggtgaagttcatcttcaacacagtgggcggctttgatgagatcagccctgctggcatccaggtgtcctttgtgcagtacagtgatgaggtgaagtctgagttcaagctgaacacctacaatgacaaggccctggccctgggcgccctgcagaacatccgctaccggggcggcaacaccaggacaggcaaggccctgaccttcatcaaggagaaggtgctgacctgggagagcggcatgaggaagaatgtgcccaaggtgctggtggtggtgacagatggccgcagccaggatgaggtgaagaaggccgccctggtgatccagcagagcggcttctctgtgtttgtggtgggcgtggctgatgtggactacaatgagctggccaacatcgccagcaagcccagcgagagacatgtgttcatcgtggatgactttgagagctttgagaagattgaggacaacctgatcacctttgtgtgtgaaacagccaccagcagctgccccctcatctacctggatggctacaccagccctggcttcaagatgctggaggcctacaacctgacagagaagaactttgcctctgtgcagggcgtgtccctggagagcggcagcttccccagctacagcgcctaccgcatccagaagaatgcctttgtgaaccagcccacagctgacctgcaccccaacggcctgccccccagctacaccatcatcctgctcttccggctgctgcctgagacccccagcgacccctttgccatctggcagatcacagaccgggactacaagccccaggtgggcgtgattgctgaccccagcagcaagaccctgtccttcttcaacaaggacaccagaggagaggtgcagacagtgacctttgacacagaggaggtgaagaccctcttctacggcagcttccacaagagagatgagggcaaatgtcctgccttccccaacagctgcacctgcacccaggacagcgtgggccccccaggccccccaggccctgctgggggccctggggccaagggccccagaggagagcggggcatcagcggggccatcggccccccaggccccaggggggacatcggccccccaggcccccagggccccccaggcccccagggccccaacggcctgagcatccctggagagcagggccggcagggcatgaagggagatgctggggagcccggcctgcccggccgcacaggcaccccaggcctgcccggccccccaggccccatgggccccccaggggaccggggcttcaccgggaaggatggagccatgggcccccggggccccccaggccccccaggcagccctggcagccctggggtgacaggccccagcggcaagccaggcaagccaggggaccacggccggcccggccccagcggcctgaagggggagaagggggacagaggagacatcgccagccagaacatgatgagagctgtggcccggcaggtgtgtgagcagctgatcagcggccagatgaaccgcttcaaccagatgctgaaccagatccccaatgactaccagagcagcaggaaccagcccggccccccaggccccccaggccccccaggcagcgctggggcccggggggagcccggccctgggggccggcccggcttccctggcaccccaggcatgcagggccccccaggagagcggggcctgcctggagagaagggggagcggggcaccggcagcagcggcccccggggcctgcccggccccccaggcccccagggcgagagcaggactggacctcctggcagcacaggcagccggggccccccaggccccccaggccggcccggcaacagcggcatccggggccccccaggccccccaggctactgtgacagcagccagtgtgccagcatcccctacaacggccagggctacccaggcagcggctag

SEQ ID NO: 3343 - DNA, 2088 bp, Artificial Sequence
  Description of Artificial Sequence: Synthetic coding sequence
atggtggccgagaggacccacaaggccgccgccaccggggcccggggccctggagagctgggcgcccctggcaccgtggccctggtggccgcccgggcagagcggggggcccggctgcccagccctggcagctgtggcctgctgaccctggccctgtgcagcctggccctgagcctgctggcccacttcagaacagctgagctgcaggcccgggtgctgcggctggaggccgagcggggggagcagcagatggagacagccatcctgggccgggtgaaccagctgctggatgagaagtggaagctgcacagcagaagaagaagagaggcccccaagaccagccctggctgcaactgccccccaggccccccaggccccaccggccggcccggcctgcccggggacaagggggccatcggcatgcctggccgggtgggcagccctggagatgctggcctgagcatcatcggcccccggggccccccaggccagcccggcacccggggcttccctggcttccctggccccatcggcctggatggcaagccaggccaccctggccccaagggggacatgggcctgactggacctcctggccagcccggcccccagggccagaagggggagaagggccagtgtggggagtacccccaccgggagtgcctgagctccatgcctgctgccctgcggagcagccagatcatcgccctgaagggggagcagagccaggccagcatccagggccccccaggccccccaggccccccaggccccagcggccccctgggccaccctggcctgcccggccccatgggccccccaggcctgcccggccccccaggccccaagggggaccccggcatccagggctaccacggcaggaaaggagagcggggcatgcctggcatgcctgggaagcatggagccaagggggcccctggcattgctgtggccggcatgaagggggagcccggcatccctggcaccaagggggagaagggagctgagggcagccctggcctgcccggcctgctgggccagaagggggagaagggagatgctggcaacagcatcggcggcggccgcggggagcccggccccccaggcctgcccggccccccaggccccaagggggaggccggcgtggatggccaggtgggccccccaggccagcccggggacaagggggagagaggagctgctggggagcagggcccagatggccccaagggcagcaaaggagagcccgggaagggggagatggtggactacaatggaaacatcaatgaggccctgcaggagatccgcaccctggccctgatgggccccccaggcctgcccggccagatcggccccccaggggcccctggcatccctggccagaagggggagatcggcctgcccggccccccaggccatgatggagagaagggcccccggggcaagccaggggacatgggccccccaggcccccagggccccccaggcaaggatggccccccaggagtgaagggggagaatggccaccctggcagccctggagagaagggggagaagggggagaccggccaggccggcagccctggagagaagggggaggccggggagaagggcaaccctggagctgaggtgcccggcctgcccggccctgagggccccccaggccccccaggcctgcagggcgtgcccggccccaagggggaggccggcctggatggagccaagggggagaagggcttccagggcgagaagggggaccggggccccctgggcctgcccggggccagcggcctggatggccggcccggccccccaggcaccccaggccccatcggcgtgcccggccctgctggccccaagggggagcggggcagcaagggggaccccggcatgacaggccccactggagctgctggcctgcccggcctgcacggccccccaggggacaagggcaacagaggagagcggggcaagaagggcagccggggccccaagggggacaagggggaccagggcgcccctggcctggatgccccctgccccctgggggaggatggcctgcctgtgcagggctgctggaacaagtag

SEQ ID NO: 3344 - DNA, 2154 bp, Artificial Sequence
  Description of Artificial Sequence: Synthetic coding sequence
atggtggccgagaggacccacaaggccgccgccaccggggcccggggccctggagagctgggcgcccctggcaccgtggccctggtggccgcccgggcagagcggggggcccggctgcccagccctggcagctgtggcctgctgaccctggccctgtgcagcctggccctgagcctgctggcccacttcagaacagctgagctgcaggcccgggtgctgcggctggaggccgagcggggggagcagcagatggagacagccatcctgggccgggtgaaccagctgctggatgagaagtggaagctgcacagcagaagaagaagagaggcccccaagaccagccctggctgcaactgccccccagccttccagggccccaccggccggcccggcctgcccggggacaagggggccatcggcatgcctggccgggtgggcagccctggagatgctggcctgagcatcatcggcccccggggccccccaggccagcccggcacccggggcttccctggcttccctggccccatcggcctggatggcaagccaggccaccctggccccaagggggacatgggcctgactggacctcctggccagcccggcccccagggccagaagggggagaagggccagtgtggggagtacccccaccgggagtgcctgagctccatgcctgctgccctgcggagcagccagatcatcgccctgaagctgctgcccctgctgaacagcgtgcggctggcccctcctcctgtgatcaagaggaggaccttccagggcgagcagagccaggccagcatccagggccccccaggccccccaggccccccaggccccagcggccccctgggccaccctggcctgcccggccccatgggccccccaggcctgcccggccccccaggccccaagggggaccccggcatccagggctaccacggcaggaaaggagagcggggcatgcctggcatgcctgggaagcatggagccaagggggcccctggcattgctgtggccggcatgaagggggagcccggcatccctggcaccaagggggagaagggagctgagggcagccctggcctgcccggcctgctgggccagaagggggagaagggagatgctggcaacagcatcggcggcggccgcggggagcccggccccccaggcctgcccggccccccaggccccaagggggaggccggcgtggatggccaggtgggccccccaggccagcccggggacaagggggagagaggagctgctggggagcagggcccagatggccccaagggcagcaaaggagagcccgggaagggggagatggtggactacaatggaaacatcaatgaggccctgcaggagatccgcaccctggccctgatgggccccccaggcctgcccggccagatcggccccccaggggcccctggcatccctggccagaagggggagatcggcctgcccggccccccaggccatgatggagagaagggcccccggggcaagccaggggacatgggccccccaggcccccagggccccccaggcaaggatggccccccaggagtgaagggggagaatggccaccctggcagccctggagagaagggggagaagggggagaccggccaggccggcagccctggagagaagggggaggccggggagaagggcaaccctggagctgaggtgcccggcctgcccggccctgagggccccccaggccccccaggcctgcagggcgtgcccggccccaagggggaggccggcctggatggagccaagggggagaagggcttccagggcgagaagggggaccggggccccctgggcctgcccggggccagcggcctggatggccggcccggccccccaggcaccccaggccccatcggcgtgcccggccctgctggccccaagggggagcggggcagcaagggggaccccggcatgacaggccccactggagctgctggcctgcccggcctgcacggccccccaggggacaagggcaacagaggagagcggggcaagaagggcagccggggccccaagggggacaagggggaccagggcgcccctggcctggatgccccctgccccctgggggaggatggcctgcctgtgcagggctgctggaacaagtag

SEQ ID NO: 3345 - DNA, 2052 bp, Artificial Sequence
  Description of Artificial Sequence: Synthetic coding sequence
atggtggccgagaggacccacaaggccgccgccaccggggcccggggccctggagagctgggcgcccctggcaccgtggccctggtggccgcccgggcagagcggggggcccggctgcccagccctggcagctgtggcctgctgaccctggccctgtgcagcctggccctgagcctgctggcccacttcagaacagctgagctgcaggcccgggtgctgcggctggaggccgagcggggggagcagcagatggagacagccatcctgggccgggtgaaccagctgctggatgagaagtggaagctgcacagcagaagaagaagagaggcccccaagaccagccctggctgcaactgccccccaggccccccaggccccaccggccggcccggcctgcccggggacaagggggccatcggcatgcctggccgggtgggcagccctggagatgctggcctgagcatcatcggcccccggggccccccaggccagcccggcacccggggcttccctggcttccctggccccatcggcctggatggcaagccaggccaccctggccccaagggggacatgggcctgactggacctcctggccagcccggcccccagggccagaagggggagaagggccagtgtggggagtacccccaccgggagtgcctgagctccatgcctgctgccctgcggagcagccagatcatcgccctgaagggggagcagagccaggccagcatccagggccccccaggccccccaggccccccaggccccagcggccccctgggccaccctggcctgcccggccccatgggccccccaggcctgcccggccccccaggccccaagggggaccccggcatccagggctaccacggcaggaaaggagagcggggcatgcctggcatgcctgggaagcatggagccaagggggcccctggcattgctgtggccggcatgaagggggagcccggcatccctggcaccaagggggagaagggagctgagggcagccctggcctgcccggcctgctgggccagaagggggagaagggagatgctggcaacagcatcggcggcggccgcggggagcccggccccccaggcctgcccggccccccaggccccaagggggaggccggcgtggatggccaggtgggccccccaggccagcccggggacaagggggagagaggagctgctggggagcagggcccagatggccccaagggcagcaaaggagagcccgggaagggggagatggtggactacaatggaaacatcaatgaggccctgcaggagatccgcaccctggccctgatgggccccccaggcctgcccggccagatcggccccccaggggcccctggcatccctggccagaagggggagatcggcctgcccggccccccaggccatgatggagagaagggcccccggggcaagccaggggacatgggccccccaggcccccagggccccccaggcaaggatggccccccaggagtgaagggggagaatggccaccctggcagccctggagagaagggggagaagggggagaccggccaggccggcagccctggagagaagggggaggccggggagaagggcaaccctggagctgaggtgcccggcctgcccggccctgagggccccccaggccccccaggcctgcagggcgtgcccggccccaagggggaggccggcctggatggagccaagggggagaagggcttccagggcgagaagggggaccggggccccctgggcctgcccggcaccccaggccccatcggcgtgcccggccctgctggccccaagggggagcggggcagcaagggggaccccggcatgacaggccccactggagctgctggcctgcccggcctgcacggccccccaggggacaagggcaacagaggagagcggggcaagaagggcagccggggccccaagggggacaagggggaccagggcgcccctggcctggatgccccctgccccctgggggaggatggcctgcctgtgcagggctgctggaacaagtag

SEQ ID NO: 3346 - DNA, 2067 bp, Artificial Sequence
  Description of Artificial Sequence: Synthetic coding sequence
atggtggccgagaggacccacaaggccgccgccaccggggcccggggccctggagagctgggcgcccctggcaccgtggccctggtggccgcccgggcagagcggggggcccggctgcccagccctggcagctgtggcctgctgaccctggccctgtgcagcctggccctgagcctgctggcccacttcagaacagctgagctgcaggcccgggtgctgcggctggaggccgagcggggggagcagcagatggagacagccatcctgggccgggtgaaccagctgctggatgagaagtggaagctgcacagcagaagaagaagagaggcccccaagaccagccctggctgcaactgccccccagccttccagggccccaccggccggcccggcctgcccggccagcccggcacccggggcttccctggcttccctggccccatcggcctggatggcaagccaggccaccctggccccaagggggacatgggcctgaccggccccccaggccagcccggcccccagggccagaagggggagaagggccagtgtggggagtacccccacagagaatgtctgagctccatgcctgctgccctgcggagcagccagatcatcgccctgaagctgctgcccctgctgaacagcgtgcggctggcccctcctcctgtgatcaagaggaggaccttccagggcgagcagagccaggccagcatccagggccccccaggccccccaggccccccaggccccagcggccccctgggccaccctggcctgcccggccccatgggccccccaggcctgcccggccccccaggccccaagggggaccccggcatccagggctaccacggcaggaagggggagcggggcatgcctggcatgcctgggaagcacggggccaagggggcccctggcattgctgtggccggcatgaagggggagcccggcatccctggcaccaagggggagaagggagctgagggcagccctggcctgcccggcctgctgggccagaagggggagaagggagatgctggcaacagcattggaggcggccgcggggagcccggccccccaggcctgcccggccccccaggccccaagggggaggccggcgtggatggccaggtgggccccccaggccagcccggggacaagggggagagaggagctgctggggagcagggcccagatggccccaagggcagcaagggggagcctggaaaaggagagatggtggactacaacggcaacatcaatgaggccctgcaggagatccgcaccctggccctgatgggccccccaggcctgcccggccagatcggccccccaggggcccctggcatccctggccagaagggggagatcggcctgcccggccccccaggccatgatggagagaagggcccccggggcaagccaggggacatgggccccccaggcccccagggccccccaggcaaggatggccccccaggagtgaagggagaaaatggccaccctggcagccctggagagaagggggagaagggggagaccggccaggccggcagccctggagagaagggggaggccggggagaagggcaaccctggagctgaggtgcccggcctgcccggccctgagggccccccaggccccccaggcctgcagggcgtgcccggccccaagggggaggccggcctggatggagccaagggggagaagggcttccagggcgagaagggggaccggggccccctgggcctgcccggggccagcggcctggatggccggcccggccccccaggcaccccaggccccatcggcgtgcccggccctgctggccccaagggggagcggggcagcaaaggagaccccggcatgacaggccccaccggggctgctggcctgcccggcctgcacggccccccaggggacaagggcaacagaggagagcggggcaagaagggcagccggggccccaagggggacaagggggaccagggcgcccctggcctggatgccccctgccccctgggagaagatggcctgcctgtgcagggctgctggaacaagtag

SEQ ID NO: 3347 - DNA, 2088 bp, Artificial Sequence
  Description of Artificial Sequence: Synthetic coding sequence
atggtggccgagaggacccacaaggccgccgccaccggggcccggggccctggagagctgggcgcccctggcaccgtggccctggtggccgcccgggcagagcggggggcccggctgcccagccctggcagctgtggcctgctgaccctggccctgtgcagcctggccctgagcctgctggcccacttcagaacagctgagctgcaggcccgggtgctgcggctggaggccgagcggggggagcagcagatggagacagccatcctgggccgggtgaaccagctgctggatgagaagtggaagctgcacagcagaagaagaagagaggcccccaagaccagccctggctgcaactgccccccagccttccagggccccaccggccggcccggcctgcccggggacaagggggccatcggcatgcctggccgggtgggcagccctggagatgctggcctgagcatcatcggcccccggggccccccaggccagcccggcacccggggcttccctggcttccctggccccatcggcctggatggcaagccaggccaccctggccccaagggggacatgggcctgactggacctcctggccagcccggcccccagggccagaagggggagaagggccagtgtggggagtacccccaccgggagtgcctgagctccatgcctgctgccctgcggagcagccagatcatcgccctgaagggggagcagagccaggccagcatccagggccccccaggccccccaggccccccaggccccagcggccccctgggccaccctggcctgcccggccccatgggccccccaggcctgcccggccccccaggccccaagggggaccccggcatccagggctaccacggcaggaaaggagagcggggcatgcctggcatgcctgggaagcatggagccaagggggcccctggcattgctgtggccggcatgaagggggagcccggcatccctggcaccaagggggagaagggagctgagggcagccctggcctgcccggcctgctgggccagaagggggagaagggagatgctggcaacagcatcggcggcggccgcggggagcccggccccccaggcctgcccggccccccaggccccaagggggaggccggcgtggatggccaggtgggccccccaggccagcccggggacaagggggagagaggagctgctggggagcagggcccagatggccccaagggcagcaaaggagagcccgggaagggggagatggtggactacaatggaaacatcaatgaggccctgcaggagatccgcaccctggccctgatgggccccccaggcctgcccggccagatcggccccccaggggcccctggcatccctggccagaagggggagatcggcctgcccggccccccaggccatgatggagagaagggcccccggggcaagccaggggacatgggccccccaggcccccagggccccccaggcaaggatggccccccaggagtgaagggggagaatggccaccctggcagccctggagagaagggggagaagggggagaccggccaggccggcagccctggagagaagggggaggccggggagaagggcaaccctggagctgaggtgcccggcctgcccggccctgagggccccccaggccccccaggcctgcagggcgtgcccggccccaagggggaggccggcctggatggagccaagggggagaagggcttccagggcgagaagggggaccggggccccctgggcctgcccggggccagcggcctggatggccggcccggccccccaggcaccccaggccccatcggcgtgcccggccctgctggccccaagggggagcggggcagcaagggggaccccggcatgacaggccccactggagctgctggcctgcccggcctgcacggccccccaggggacaagggcaacagaggagagcggggcaagaagggcagccggggccccaagggggacaagggggaccagggcgcccctggcctggatgccccctgccccctgggggaggatggcctgcctgtgcagggctgctggaacaagtag

SEQ ID NO: 3348 - DNA, 2097 bp, Artificial Sequence
  Description of Artificial Sequence: Synthetic coding sequence
atggtggccgagaggacccacaaggccgccgccaccggggcccggggccctggagagctgggcgcccctggcaccgtggccctggtggccgcccgggcagagcggggggcccggctgcccagccctggcagctgtggcctgctgaccctggccctgtgcagcctggccctgagcctgctggcccacttcagaacagctgagctgcaggcccgggtgctgcggctggaggccgagcggggggagcagcagatggagacagccatcctgggccgggtgaaccagctgctggatgagaagtggaagctgcacagcagaagaagaagagaggcccccaagaccagccctggctgcaactgccccccagccttccagggccccaccggccggcccggcctgcccggggacaagggggccatcggcatgcctggccgggtgggcagccctggagatgctggcctgagcatcatcggcccccggggccccccaggccagcccggcacccggggcttccctggcttccctggccccatcggcctggatggcaagccaggccaccctggccccaagggggacatgggcctgactggacctcctggccagcccggcccccagggccagaagggggagaagggccagtgtggggagtacccccaccggctgctgcccctgctgaacagcgtgcggctggcccctcctcctgtgatcaagaggaggaccttccagggcgagcagagccaggccagcatccagggccccccaggccccccaggccccccaggccccagcggccccctgggccaccctggcctgcccggccccatgggccccccaggcctgcccggccccccaggccccaagggggaccccggcatccagggctaccacggcaggaagggggagcggggcatgcctggcatgcctgggaagcacggggccaagggggcccctggcattgctgtggccggcatgaagggggagcccggcatccctggcaccaagggggagaagggagctgagggcagccctggcctgcccggcctgctgggccagaagggggagaagggagatgctggcaacagcattggaggcggccgcggggagcccggccccccaggcctgcccggccccccaggccccaagggggaggccggcgtggatggccaggtgggccccccaggccagcccggggacaagggggagagaggagctgctggggagcagggcccagatggccccaagggcagcaagggggagcctggaaaaggagagatggtggactacaacggcaacatcaatgaggccctgcaggagatccgcaccctggccctgatgggccccccaggcctgcccggccagatcggccccccaggggcccctggcatccctggccagaagggggagatcggcctgcccggccccccaggccatgatggagagaagggcccccggggcaagccaggggacatgggccccccaggcccccagggccccccaggcaaggatggccccccaggagtgaagggagaaaatggccaccctggcagccctggagagaagggggagaagggggagaccggccaggccggcagccctggagagaagggggaggccggggagaagggcaaccctggagctgaggtgcccggcctgcccggccctgagggccccccaggccccccaggcctgcagggcgtgcccggccccaagggggaggccggcctggatggagccaagggggagaagggcttccagggcgagaagggggaccggggccccctgggcctgcccggggccagcggcctggatggccggcccggccccccaggcaccccaggccccatcggcgtgcccggccctgctggccccaagggggagcggggcagcaaaggagaccccggcatgacaggccccaccggggctgctggcctgcccggcctgcacggccccccaggggacaagggcaacagaggagagcggggcaagaagggcagccggggccccaagggggacaagggggaccagggcgcccctggcctggatgccccctgccccctgggagaagatggcctgcctgtgcagggctgctggaacaagtag

SEQ ID NO: 3349 - DNA, 1938 bp, Artificial Sequence
  Description of Artificial Sequence: Synthetic coding sequence
atggtggccgagaggacccacaaggccgccgccaccggggcccggggccctggagagctgggcgcccctggcaccgtggccctggtggccgcccgggcagagcggggggcccggctgcccagccctggcagctgtggcctgctgaccctggccctgtgcagcctggccctgagcctgctggcccacttcagaacagctgagctgcaggcccgggtgctgcggctggaggccgagcggggggagcagcagatggagacagccatcctgggccgggtgaaccagctgctggatgagaagtggaagctgcacagcagaagaagaagagaggcccccaagaccagccctggctgcaactgccccccaggccccccaggccagcccggcacccggggcttccctggcttccctggccccatcggcctggatggcaagccaggccaccctggccccaagggggacatgggcctgactggacctcctggccagcccggcccccagggccagaagggggagaagggccagtgtggggagtacccccaccggctgctgcccctgctgaacagcgtgcggctggcccctcctcctgtgatcaagaggaggaccttccagggcgagcagagccaggccagcatccagggccccccaggccccccaggccccccaggccccagcggccccctgggccaccctggcctgcccggccccatgggccccccaggcctgcccggccccccaggccccaagggggaccccggcatccagggctaccacggcaggaagggggagcggggcatgcctggcatgcctgggaagcacggggccaagggggcccctggcattgctgtggccggcatgaagggggagcccggcatccctggcaccaagggggagaagggagctgagggcagccctggcctgcccggcctgctgggccagaagggggagaagggagatgctggcaacagcattggaggcggccgcggggagcccggccccccaggcctgcccggccccccaggccccaagggggaggccggcgtggatggccaggtgggccccccaggccagcccggggacaagggggagagaggagctgctggggagcagggcccagatggccccaagggcagcaagggggagcctggaaaaggagagatggtggactacaacggcaacatcaatgaggccctgcagcccagccggggccctgccctgcggggccccccaggcctgcccggccagatcggccccccaggggcccctggcatccctggccagaagggggagatcggcctgcccggccccccaggccatgatggagagaagggcccccggggcaagccaggggacatgggccccccaggcccccagggccccccaggcaaggatggccccccaggagtgaagggagaaaatggccaccctggcagccctggagagaagggggagaagggggagaccggccaggccggcagccctgtgcccggcctgcccggccctgagggccccccaggccccccaggcctgcagggcgtgcccggccccaagggggaggccggcctggatggagccaagggggagaagggcttccagggcgagaagggggaccggggccccctgggcctgcccggggccagcggcctggatggccggcccggccccccaggcaccccaggccccatcggcgtgcccggccctgctggccccaagggggagcggggcagcaagggggaccccggcatgacaggccccactggagctgctggcctgcccggcctgcacggccccccaggggacaagggcaacagaggagagcggggcaagaagggcagccggggccccaagggggacaagggggaccagggcgcccctggcctggatgccccctgccccctgggggaggatggcctgcctgtgcagggctgctggaacaagtag

SEQ ID NO: 3350 - DNA, 2109 bp, Artificial Sequence
  Description of Artificial Sequence: Synthetic coding sequence
atggtggccgagaggacccacaaggccgccgccaccggggcccggggccctggagagctgggcgcccctggcaccgtggccctggtggccgcccgggcagagcggggggcccggctgcccagccctggcagctgtggcctgctgaccctggccctgtgcagcctggccctgagcctgctggcccacttcagaacagctgagctgcaggcccgggtgctgcggctggaggccgagcggggggagcagcagatggagacagccatcctgggccgggtgaaccagctgctggatgagaagtggaagctgcacagcagaagaagaagagaggcccccaagaccagccctggctgcaactgccccccagccttccagggccccaccggccggcccggcctgcccggggacaagggggccatcggcatgcctggccgggtgggcagccctggagatgctggcctgagcatcatcggcccccggggccccccaggccagcccggcacccggggcttccctggcttccctggccccatcggcctggatggcaagccaggccaccctggccccaagggggacatgggcctgactggacctcctggccagcccggcccccagggccagaagggggagaagggccagtgtggggagtacccccaccgggagtgcctgagctccatgcctgctgccctgcggagcagccagatcatcgccctgaagctgctgcccctgctgaacagcgtgcggctggcccctcctcctgtgatcaagaggaggaccttccagggcgagcagagccaggccagcatccagggccccccaggccccccaggccccccaggccccagcggccccctgggccaccctggcctgcccggccccatgggccccccaggcctgcccggccccccaggccccaagggggaccccggcatccagggctaccacggcaggaaaggagagcggggcatgcctggcatgcctgggaagcatggagccaagggggcccctggcattgctgtggccggcatgaagggggagcccggcatccctggcaccaagggggagaagggagctgagggcagccctggcctgcccggcctgctgggccagaagggggagaagggagatgctggcaacagcatcggcggcggccgcggggagcccggccccccaggcctgcccggccccccaggccccaagggggaggccggcgtggatggccaggtgggccccccaggccagcccggggacaagggggagagaggagctgctggggagcagggcccagatggccccaagggcagcaaaggagagcccgggaagggggagatggtggactacaatggaaacatcaatgaggccctgcaggagatccgcaccctggccctgatgggccccccaggcctgcccggccagatcggccccccaggggcccctggcatccctggccagaagggggagatcggcctgcccggccccccaggccatgatggagagaagggcccccggggcaagccaggggacatgggccccccaggcccccagggccccccaggcaaggatggccccccaggagtgaagggggagaatggccaccctggcagccctggagagaagggggagaagggggagaccggccaggccggcagccctgtgcccggcctgcccggccctgagggccccccaggccccccaggcctgcagggcgtgcccggccccaagggggaggccggcctggatggagccaagggggagaagggcttccagggcgagaagggggaccggggccccctgggcctgcccggggccagcggcctggatggccggcccggccccccaggcaccccaggccccatcggcgtgcccggccctgctggccccaagggggagcggggcagcaaaggagaccccggcatgacaggccccaccggggctgctggcctgcccggcctgcacggccccccaggggacaagggcaacagaggagagcggggcaagaagggcagccggggccccaagggggacaagggggaccagggcgcccctggcctggatgccccctgccccctgggagaagatggcctgcctgtgcagggctgctggaacaagtag

SEQ ID NO: 3351 - DNA, 2112 bp, Artificial Sequence
  Description of Artificial Sequence: Synthetic coding sequence
atggtggccgagaggacccacaaggccgccgccaccggggcccggggccctggagagctgggcgcccctggcaccgtggccctggtggccgcccgggcagagcggggggcccggctgcccagccctggcagctgtggcctgctgaccctggccctgtgcagcctggccctgagcctgctggcccacttcagaacagctgagctgcaggcccgggtgctgcggctggaggccgagcggggggagcagcagatggagacagccatcctgggccgggtgaaccagctgctggatgagaagtggaagctgcacagcagaagaagaagagaggcccccaagaccagccctggctgcaactgccccccaggccccccaggccccaccggccggcccggcctgcccggggacaagggggccatcggcatgcctggccgggtgggcagccctggagatgctggcctgagcatcatcggcccccggggccccccaggccagcccggcacccggggcttccctggcttccctggccccatcggcctggatggcaagccaggccaccctggccccaagggggacatgggcctgactggacctcctggccagcccggcccccagggccagaagggggagaagggccagtgtggggagtacccccaccgggagtgcctgagctccatgcctgctgccctgcggagcagccagatcatcgccctgaagctgctgcccctgctgaacagcgtgcggctggcccctcctcctgtgatcaagaggaggaccttccagggcgagcagagccaggccagcatccagggccccccaggccccccaggccccccaggccccagcggccccctgggccaccctggcctgcccggccccatgggccccccaggcctgcccggccccccaggccccaagggggaccccggcatccagggctaccacggcaggaaaggagagcggggcatgcctggcatgcctgggaagcatggagccaagggggcccctggcattgctgtggccggcatgaagggggagcccggcatccctggcaccaagggggagaagggagctgagggcagccctggcctgcccggcctgctgggccagaagggggagaagggagatgctggcaacagcatcggcggcggccgcggggagcccggccccccaggcctgcccggccccccaggccccaagggggaggccggcgtggatggccaggtgggccccccaggccagcccggggacaagggggagagaggagctgctggggagcagggcccagatggccccaagggcagcaaaggagagcccgggaagggggagatggtggactacaatggaaacatcaatgaggccctgcagcccagccggggccctgccctgcggggccccccaggcctgcccggccagatcggccccccaggggcccctggcatccctggccagaagggggagatcggcctgcccggccccccaggccatgatggagagaagggcccccggggcaagccaggggacatgggccccccaggcccccagggccccccaggcaaggatggccccccaggagtgaagggggagaatggccaccctggcagccctggagagaagggggagaagggggagaccggccaggccggcagccctggagagaagggggaggccggggagaagggcaaccctggagctgagggcctgcagggcgtgcccggccccaagggggaggccggcctggatggagccaagggggagaagggcttccagggcgagaagggggaccggggccccctgggcctgcccggggccagcggcctggatggccggcccggccccccaggcaccccaggccccatcggcgtgcccggccctgctggccccaagggggagcggggcagcaagggggaccccggcatgacaggccccactggagctgctggcctgcccggcctgcacggccccccaggggacaagggcaacagaggagagcggggcaagaagggcagccggggccccaagggggacaagggggaccagggcgcccctggcctggatgccccctgccccctgggggaggatggcctgcctgtgcagggctgctggaacaagtag

SEQ ID NO: 3352 - DNA, 2076 bp, Artificial Sequence
  Description of Artificial Sequence: Synthetic coding sequence
atggtggccgagaggacccacaaggccgccgccaccggggcccggggccctggagagctgggcgcccctggcaccgtggccctggtggccgcccgggcagagcggggggcccggctgcccagccctggcagctgtggcctgctgaccctggccctgtgcagcctggccctgagcctgctggcccacttcagaacagctgagctgcaggcccgggtgctgcggctggaggccgagcggggggagcagcagatggagacagccatcctgggccgggtgaaccagctgctggatgagaagtggaagctgcacagcagaagaagaagagaggcccccaagaccagccctggctgcaactgccccccaggccccccaggccccaccggccggcccggcctgcccggggacaagggggccatcggcatgcctggccgggtgggcagccctggagatgctggcctgagcatcatcggcccccggggccccccaggccagcccggcacccggggcttccctggcttccctggccccatcggcctggatggcaagccaggccaccctggccccaagggggacatgggcctgactggacctcctggccagcccggcccccagggccagaagggggagaagggccagtgtggggagtacccccaccgggagtgcctgagctccatgcctgctgccctgcggagcagccagatcatcgccctgaagctgctgcccctgctgaacagcgtgcggctggcccctcctcctgtgatcaagaggaggaccttccagggcgagcagagccaggccagcatccagggccccccaggccccccaggccccccaggccccagcggccccctgggccaccctggcctgcccggccccatgggccccccaggcctgcccggccccccaggccccaagggggaccccggcatccagggctaccacggcaggaaaggagagcggggcatgcctggcatgcctgggaagcatggagccaagggggcccctggcattgctgtggccggcatgaagggggagcccggcatccctggcaccaagggggagaagggagctgagggcagccctggcctgcccggcctgctgggccagaagggggagaagggagatgctggcaacagcatcggcggcggccgcggggagcccggccccccaggcctgcccggccccccaggccccaagggggaggccggcgtggatggccaggtgggccccccaggccagcccggggacaagggggagagaggagctgctggggagcagggcccagatggccccaagggcagcaaaggagagcccgggaagggggagatggtggactacaatggaaacatcaatgaggccctgcagcccagccggggccctgccctgcggggccccccaggcctgcccggccagatcggccccccaggggcccctggcatccctggccagaagggggagatcggcctgcccggccccccaggccatgatggagagaagggcccccggggcaagccaggggacatgggccccccaggcccccagggccccccaggcaaggatggccccccaggagtgaagggggagaatggccaccctggcagccctggagagaagggggagaagggggagaccggccaggccggcagccctggagagaagggggaggccggggagaagggcaaccctggagctgagggcctgcagggcgtgcccggccccaagggggaggccggcctggatggagccaagggggagaagggcttccagggcgagaagggggaccggggccccctgggcctgcccggcaccccaggccccatcggcgtgcccggccctgctggccccaagggggagcggggcagcaagggggaccccggcatgacaggccccactggagctgctggcctgcccggcctgcacggccccccaggggacaagggcaacagaggagagcggggcaagaagggcagccggggccccaagggggacaagggggaccagggcgcccctggcctggatgccccctgccccctgggggaggatggcctgcctgtgcagggctgctggaacaagtag

SEQ ID NO: 3353 - DNA, 2118 bp, Artificial Sequence
  Description of Artificial Sequence: Synthetic coding sequence
atggtggccgagaggacccacaaggccgccgccaccggggcccggggccctggagagctgggcgcccctggcaccgtggccctggtggccgcccgggcagagcggggggcccggctgcccagccctggcagctgtggcctgctgaccctggccctgtgcagcctggccctgagcctgctggcccacttcagaacagctgagctgcaggcccgggtgctgcggctggaggccgagcggggggagcagcagatggagacagccatcctgggccgggtgaaccagctgctggatgagaagtggaagctgcacagcagaagaagaagagaggcccccaagaccagccctggctgcaactgccccccagccttccagggccccaccggccggcccggcctgcccggcagccctggagatgctggcctgagcatcatcggcccccggggccccccaggccagcccggcacccggggcttccctggcttccctggccccatcggcctggatggcaagccaggccaccctggccccaagggggacatgggcctgactggacctcctggccagcccggcccccagggccagaagggggagaagggccagtgtggggagtacccccaccgggagtgcctgagctccatgcctgctgccctgcggagcagccagatcatcgccctgaagctgctgcccctgctgaacagcgtgcggctggcccctcctcctgtgatcaagaggaggaccttccagggcgagcagagccaggccagcatccagggccccccaggccccccaggccccccaggccccagcggccccctgggccaccctggcctgcccggccccatgggccccccaggcctgcccggccccccaggccccaagggggaccccggcatccagggctaccacggcaggaaaggagagcggggcatgcctggcatgcctgggaagcatggagccaagggggcccctggcattgctgtggccggcatgaagggggagcccggcatccctggcaccaagggggagaagggagctgagggcagccctggcctgcccggcctgctgggccagaagggggagaagggagatgctggcaacagcatcggcggcggccgcggggagcccggccccccaggcctgcccggccccccaggccccaagggggaggccggcgtggatggccaggtgggccccccaggccagcccggggacaagggggagagaggagctgctggggagcagggcccagatggccccaagggcagcaaaggagagcccgggaagggggagatggtggactacaatggaaacatcaatgaggccctgcaggagatccgcaccctggccctgatgggccccccaggcctgcccggccagatcggccccccaggggcccctggcatccctggccagaagggggagatcggcctgcccggccccccaggccatgatggagagaagggcccccggggcaagccaggggacatgggccccccaggcccccagggccccccaggcaaggatggccccccaggagtgaagggggagaatggccaccctggcagccctggagagaagggggagaagggggagaccggccaggccggcagccctggagagaagggggaggccggggagaagggcaaccctggagctgaggtgcccggcctgcccggccctgagggccccccaggccccccaggcctgcagggcgtgcccggccccaagggggaggccggcctggatggagccaagggggagaagggcttccagggcgagaagggggaccggggccccctgggcctgcccggggccagcggcctggatggccggcccggccccccaggcaccccaggccccatcggcgtgcccggccctgctggccccaagggggagcggggcagcaagggggaccccggcatgacaggccccactggagctgctggcctgcccggcctgcacggccccccaggggacaagggcaacagaggagagcggggcaagaagggcagccggggccccaagggggacaagggggaccagggcgcccctggcctggatgccccctgccccctgggggaggatggcctgcctgtgcagggctgctggaacaagtag

SEQ ID NO: 3354 - DNA, 2154 bp, Artificial Sequence
  Description of Artificial Sequence: Synthetic coding sequence
atggtggccgagaggacccacaaggccgccgccaccggggcccggggccctggagagctgggcgcccctggcaccgtggccctggtggccgcccgggcagagcggggggcccggctgcccagccctggcagctgtggcctgctgaccctggccctgtgcagcctggccctgagcctgctggcccacttcagaacagctgagctgcaggcccgggtgctgcggctggaggccgagcggggggagcagcagatggagacagccatcctgggccgggtgaaccagctgctggatgagaagtggaagctgcacagcagaagaagaagagaggcccccaagaccagccctggctgcaactgccccccaggccccccaggccccaccggccggcccggcctgcccggggacaagggggccatcggcatgcctggccgggtgggcagccctggagatgctggcctgagcatcatcggcccccggggccccccaggccagcccggcacccggggcttccctggcttccctggccccatcggcctggatggcaagccaggccaccctggccccaagggggacatgggcctgactggacctcctggccagcccggcccccagggccagaagggggagaagggccagtgtggggagtacccccaccgggagtgcctgagctccatgcctgctgccctgcggagcagccagatcatcgccctgaagctgctgcccctgctgaacagcgtgcggctggcccctcctcctgtgatcaagaggaggaccttccagggcgagcagagccaggccagcatccagggccccccaggccccccaggccccccaggccccagcggccccctgggccaccctggcctgcccggccccatgggccccccaggcctgcccggccccccaggccccaagggggaccccggcatccagggctaccacggcaggaaaggagagcggggcatgcctggcatgcctgggaagcatggagccaagggggcccctggcattgctgtggccggcatgaagggggagcccggcatccctggcaccaagggggagaagggagctgagggcagccctggcctgcccggcctgctgggccagaagggggagaagggagatgctggcaacagcatcggcggcggccgcggggagcccggccccccaggcctgcccggccccccaggccccaagggggaggccggcgtggatggccaggtgggccccccaggccagcccggggacaagggggagagaggagctgctggggagcagggcccagatggccccaagggcagcaaaggagagcccgggaagggggagatggtggactacaatggaaacatcaatgaggccctgcaggagatccgcaccctggccctgatgggccccccaggcctgcccggccagatcggccccccaggggcccctggcatccctggccagaagggggagatcggcctgcccggccccccaggccatgatggagagaagggcccccggggcaagccaggggacatgggccccccaggcccccagggccccccaggcaaggatggccccccaggagtgaagggggagaatggccaccctggcagccctggagagaagggggagaagggggagaccggccaggccggcagccctggagagaagggggaggccggggagaagggcaaccctggagctgaggtgcccggcctgcccggccctgagggccccccaggccccccaggcctgcagggcgtgcccggccccaagggggaggccggcctggatggagccaagggggagaagggcttccagggcgagaagggggaccggggccccctgggcctgcccggggccagcggcctggatggccggcccggccccccaggcaccccaggccccatcggcgtgcccggccctgctggccccaagggggagcggggcagcaagggggaccccggcatgacaggccccactggagctgctggcctgcccggcctgcacggccccccaggggacaagggcaacagaggagagcggggcaagaagggcagccggggccccaagggggacaagggggaccagggcgcccctggcctggatgccccctgccccctgggggaggatggcctgcctgtgcagggctgctggaacaagtag

SEQ ID NO: 3355 - DNA, 2007 bp, Artificial Sequence
  Description of Artificial Sequence: Synthetic coding sequence
atggtggccgagaggacccacaaggccgccgccaccggggcccggggccctggagagctgggcgcccctggcaccgtggccctggtggccgcccgggcagagcggggggcccggctgcccagccctggcagctgtggcctgctgaccctggccctgtgcagcctggccctgagcctgctggcccacttcagaacagctgagctgcaggcccgggtgctgcggctggaggccgagcggggggagcagcagatggagacagccatcctgggccgggtgaaccagctgctggatgagaagtggaagctgcacagcagaagaagaagagaggcccccaagaccagccctggctgcaactgccccccaggccccccaggccccaccggccggcccggcctgcccggggacaagggggccatcggcatgcctggccgggtgggcagccctggagatgctggcctgagcatcatcggcccccggggccccccaggccagcccggcacccggggcttccctggcttccctggccccatcggcctggatggcaagccaggccaccctggccccaagggggacatgggcctgactggacctcctggccagcccggcccccagggccagaagggggagaagggccagtgtggggagtacccccaccgggagtgcctgagctccatgcctgctgccctgcggagcagccagatcatcgccctgaagggggagcagagccaggccagcatccagggccccccaggccccccaggccccccaggccccagcggccccctgggccaccctggcctgcccggccccatgggccccccaggcctgcccggccccccaggccccaagggggaccccggcatccagggctaccacggcaggaaaggagagcggggcatgcctggcatgcctgggaagcatggagccaagggggcccctggcattgctgtggccggcatgaagggggagcccggcatccctggcaccaagggggagaagggagctgagggcagccctggcctgcccggcctgctgggccagaagggggagaagggagatgctggcaacagcatcggcggcggccgcggggagcccggccccccaggcctgcccggccccccaggccccaagggggaggccggcgtggatggccaggtgggccccccaggccagcccggggacaagggggagagaggagctgctggggagcagggcccagatggccccaagggcagcaaaggagagcccgggaagggggagatggtggactacaatggaaacatcaatgaggccctgcaggagatccgcaccctggccctgatgggccccccaggcctgcccggccagatcggccccccaggggcccctggcatccctggccagaagggggagatcggcctgcccggccccccaggccatgatggagagaagggcccccggggcaagccaggggacatgggccccccaggcccccagggccccccaggcaaggatggccccccaggagtgaagggggagaatggccaccctggcagccctggagagaagggggagaagggggagaccggccaggccggcagccctgtgcccggcctgcccggccctgagggccccccaggccccccaggcctgcagggcgtgcccggccccaagggggaggccggcctggatggagccaagggggagaagggcttccagggcgagaagggggaccggggccccctgggcctgcccggcaccccaggccccatcggcgtgcccggccctgctggccccaagggggagcggggcagcaaaggagaccccggcatgacaggccccaccggggctgctggcctgcccggcctgcacggccccccaggggacaagggcaacagaggagagcggggcaagaagggcagccggggccccaagggggacaagggggaccagggcgcccctggcctggatgccccctgccccctgggagaagatggcctgcctgtgcagggctgctggaacaagtag

SEQ ID NO: 3356 - DNA, 1833 bp, Artificial Sequence
  Description of Artificial Sequence: Synthetic coding sequence
atggtggccgagaggacccacaaggccgccgccaccggggcccggggccctggagagctgggcgcccctggcaccgtggccctggtggccgcccgggcagagcggggggcccggctgcccagccctggcagctgtggcctgctgaccctggccctgtgcagcctggccctgagcctgctggcccacttcagaacagctgagctgcaggcccgggtgctgcggctggaggccgagcggggggagcagcagatggagacagccatcctgggccgggtgaaccagctgctggatgagaagtggaagctgcacagcagaagaagaagagaggcccccaagaccagccctggctgcaactgccccccaggccccccaggccccaccggccggcccggcctgcccggccagcccggcacccggggcttccctggcttccctggccccatcggcctggatggcaagccaggccaccctggccccaagggggacatgggcctgaccggccccccaggccagcccggcccccagggccagaagggggagaagggccagtgtggggagtacccccacagagaatgtctgagctccatgcctgctgccctgcggagcagccagatcatcgccctgaagggggagcagagccaggccagcatccagggccccccaggccccccaggccccccaggccccagcggccccctgggccaccctggcctgcccggccccatgggccccccaggcctgcccggccccccaggccccaagggggaccccggcatccagggctaccacggcaggaagggggagcggggcatgcctggcatgcctgggaagcacggggccaagggggcccctggcattgctgtggccggcatgaagggggagcccggcatccctggcaccaagggggagaagggagctgagggcagccctggcctgcccggcctgctgggccagaagggggagaagggagatgctggcaacagcattggaggcggccgcggggagcccggccccccaggcctgcccggccccccaggccccaagggggaggccggcgtggatggccaggtgggccccccaggccagcccggggacaagggggagagaggagctgctggggagcagggcccagatggccccaagggcagcaagggggagcctggaaaaggagagatggtggactacaacggcaacatcaatgaggccctgcaggagatccgcaccctggccctgatgggccccccaggcctgcccggccagatcggccccccaggggcccctggcatccctggccagaagggggagatcggcctgcccggccccccaggccatgatggagagaagggcccccggggcaagccaggggacatgggccccccaggcccccagggccccccaggcaaggatggccccccaggagtgaagggagaaaatggccaccctggcagccctggagagaagggggagaagggggagaccggccaggccggcagccctgtgcccggcctgcccggccctgagggccccccaggccccccaggcctgcagggcgtgcccggccccaagggggaggccggcctggatggagccaagggggagaagggcttccagggcgagaagggggaccggggccccctgggcctgcccggcaccccaggccccatcggcgtgcccggccctgctggccccaagggggagcggggcagcaagggggaccccggcatgacaggccccactggagctgctggcctgcccggcctgcacggccccccaggggacaagggcaacagaggagaagatggcctgcctgtgcagggctgctggaacaagtag

SEQ ID NO: 3357 - DNA, 1938 bp, Artificial Sequence
  Description of Artificial Sequence: Synthetic coding sequence
atggtggccgagaggacccacaaggccgccgccaccggggcccggggccctggagagctgggcgcccctggcaccgtggccctggtggccgcccgggcagagcggggggcccggctgcccagccctggcagctgtggcctgctgaccctggccctgtgcagcctggccctgagcctgctggcccacttcagaacagctgagctgcaggcccgggtgctgcggctggaggccgagcggggggagcagcagatggagacagccatcctgggccgggtgaaccagctgctggatgagaagtggaagctgcacagcagaagaagaagagaggcccccaagaccagccctggctgcaactgccccccaggccccccaggccagcccggcacccggggcttccctggcttccctggccccatcggcctggatggcaagccaggccaccctggccccaagggggacatgggcctgactggacctcctggccagcccggcccccagggccagaagggggagaagggccagtgtggggagtacccccaccggctgctgcccctgctgaacagcgtgcggctggcccctcctcctgtgatcaagaggaggaccttccagggcgagcagagccaggccagcatccagggccccccaggccccccaggccccccaggccccagcggccccctgggccaccctggcctgcccggccccatgggccccccaggcctgcccggccccccaggccccaagggggaccccggcatccagggctaccacggcaggaagggggagcggggcatgcctggcatgcctgggaagcacggggccaagggggcccctggcattgctgtggccggcatgaagggggagcccggcatccctggcaccaagggggagaagggagctgagggcagccctggcctgcccggcctgctgggccagaagggggagaagggagatgctggcaacagcattggaggcggccgcggggagcccggccccccaggcctgcccggccccccaggccccaagggggaggccggcgtggatggccaggtgggccccccaggccagcccggggacaagggggagagaggagctgctggggagcagggcccagatggccccaagggcagcaagggggagcctggaaaaggagagatggtggactacaacggcaacatcaatgaggccctgcaggagatccgcaccctggccctgatgggccccccaggcctgcccggccagatcggccccccaggggcccctggcatccctggccagaagggggagatcggcctgcccggccccccaggccatgatggagagaagggcccccggggcaagccaggggacatgggccccccaggcccccagggccccccaggcaaggatggccccccaggagtgaagggagaaaatggccaccctggcagccctggagagaagggggagaagggggagaccggccaggccggcagccctgtgcccggcctgcccggccctgagggccccccaggccccccaggcctgcagggcgtgcccggccccaagggggaggccggcctggatggagccaagggggagaagggcttccagggcgagaagggggaccggggccccctgggcctgcccggggccagcggcctggatggccggcccggccccccaggcaccccaggccccatcggcgtgcccggccctgctggccccaagggggagcggggcagcaagggggaccccggcatgacaggccccactggagctgctggcctgcccggcctgcacggccccccaggggacaagggcaacagaggagagcggggcaagaagggcagccggggccccaagggggacaagggggaccagggcgcccctggcctggatgccccctgccccctgggggaggatggcctgcctgtgcagggctgctggaacaagtag

SEQ ID NO: 3358 - DNA, 5106 bp, Artificial Sequence
  Description of Artificial Sequence: Synthetic coding sequence
atgaagatcttccagaggaagatgagatactggctgctgccccccttcctggccatcgtgtacttctgcaccatcgtgcagggccaggtggccccacccacccggctgcgctacaacgtcatcagccatgacagcatccagatctcctggaaggccccccggggcaagtttggaggctacaagctgctggtgacccccaccagcggcggcaagaccaaccagctgaacctgcagaacacagccaccaaggccatcatccagggcctgatgccagaccagaactacacagtgcagatcatcgcctacaacaaggacaaggagagcaagccagcccagggccagttccgcatcaaggacctggagaagaggaaggaccccaagccccgggtgaaggtggtggacagaggaaatggcagccggcccagcagccctgaggaggtgaagtttgtgtgccagaccccagccatcgctgacatcgtcatcctggtggatggctcctggagcatcggccgcttcaacttccggctggtgcgccacttcctggagaacctggtgacagcctttgatgtgggcagcgagaagaccagaattggagtgaagaatgctgatgtgaatgagctgcaggagatcgccagcgagccagacagcacccacgtgtacaacgtggccgagtttgacctgatgcacacagtggtggagagcctgaccaggaccctgtgcagccgggtggaggagcaggaccgggagatcaaggccagcgcccacgccatcaccggccccccaacagagctgatcaccagcgaggtgacagcccgctccttcatggtgaactggacccacgcccctggaaatgtggagaagtacagagtggtgtactaccccacccggggcggcaagccagatgaggtggtggtggatggcaccgtgagcagcacagtgctgaagaacctgatgagcctgacagagtaccagattgctgtgtttgccatctatgcccacacagccagcgagggcctgcggggcacagagaccaccctggccctgcccatggccagtgacctgctgctgtatgatgtgacagaaaattccatgagggtgaagtgggatgctgtgcctggggccagcggctacctgatcctgtatgcccccctgacagagggcctggccggagatgagaaggagatgaagattggagagacccacacagacatcgagctgagcggcctgctgcccaacacagagtacacagtgacagtgtatgccatgtttggagaggaggccagtgaccctgtgacaggccaggagaccaccctggccctgagcccccccaggaacctgcgcatcagcaatgtgggcagcaacagcgcccggctgacctgggaccccaccagccggcagatcaatggctaccgcatcgtgtacaacaatgctgatggaacagagatcaatgaggtggaggtggaccccatcaccaccttccccctgaagggcctgacccccctgacagagtacaccatcgccatcttcagcatctatgatgagggccagagcgagcccctgactggagtcttcaccacagaggaggtgcctgcccagcagtacctggagattgatgaggtgaccacagacagcttccgggtgacctggcaccccctgtctgcagatgagggcctgcacaagctgatgtggatccctgtgtatggaggcaagacagaggaggtggtgctgaaggaggagcaggacagccacgtgattgagggcctggagcccggcacagaatatgaggtgtccctgctggccgtgctggatgatggcagcgagagcgaggtggtgacagctgtgggcaccaccctggacagcttctggacagagcccgccaccaccatcgtgcccaccacctctgtgacctctgtgttccagacaggcatccggaacctggtggtgggagatgagaccaccagcagcctgcgggtgaagtgggacatcagtgacagtgatgtgcagcagttccgggtgacctacatgacagcccagggcgaccctgaggaggaggtgattggcaccgtgatggtgcccggcagccagaacaacctgctgctgaagcccctgctgcctgacacagagtacaaggtgacagtgacccccatctacacagatggagagggcgtgtctgtgtctgcccctgggaagaccctgcccagcagcggcccccagaacctgcgggtgtctgaggagtggtacaaccggctgcgcatcacctgggacccccccagcagccctgtgaagggctaccgcatcgtgtacaagcctgtgtctgtgcccggccccaccctggagacctttgtgggcgctgacatcaacaccatcctgatcaccaacctgctgagcggcatggactacaacgtgaagatctttgccagccaggccagcggcttcagtgatgccctgaccggcatggtgaagaccctcttcctgggcgtgaccaacctgcaggccaagcacgtggagatgaccagcctgtgtgcccactggcaggtgcacagacatgccacagcctacagagtggtgattgagagcctgcaggaccggcagaagcaggagagcacagtgggcggcggcaccaccaggcactgcttctacggcctgcagcctgacagcgagtacaagatctctgtgtacaccaagctgcaggagattgagggccccagcgtgtccatcatggagaagacccagagcctgcccaccaggcctcccaccttcccccccaccatccccccagccaaggaggtgtgcaaggccgccaaggctgacctggtgttcatggtggatggctcctggagcattggagatgagaacttcaacaagatcatctccttcctgtacagcacagtgggcgccctgaacaagattggaacagatggcacccaggtggccatggtgcagttcacagatgaccccaggacagagttcaagctgaatgcctacaagaccaaggagaccctgctggatgccatcaagcacatctcctacaagggcggcaacaccaagacaggcaaggccatcaagtatgtgcgggacaccctcttcaccgctgagagcggcacccggcggggcatccccaaggtgattgtggtgatcacagatggccgcagccaggatgatgtgaacaagatcagccgggagatgcagctggatggctacagcatctttgccatcggcgtggctgatgctgactacagcgagctggtgtccatcggcagcaagcccagcgcccggcacgtgttctttgtggatgactttgatgccttcaagaagattgaagatgagctgatcacctttgtgtgtgaaacagccagcgccacctgccctgtggtgcacaaggatggcatcgacctggccggcttcaagatgatggagatgtttggcctggtggagaaggacttcagctctgtggagggcgtgtccatggagcccggcaccttcaacgtgttcccctgctaccagctgcacaaggatgccctggtgtcccagcccacccgctacctgcaccctgagggcctgcccagcgactacaccatctccttcctgttccgcatcctgcctgacaccccccaggagccctttgccctgtgggagatcctgaacaagaacagcgaccccctggtgggcgtcatcctggacaatggaggcaagaccctgacctacttcaactatgaccagagcggggacttccagacagtgacctttgagggccctgagatcaggaagatcttctacggcagcttccacaagctgcacatcgtggtgtctgagaccctggtgaaggtggtgattgactgcaagcaggtgggggagaaggccatgaatgccagcgccaacatcaccagtgatggagtggaggtgctgggcaagatggtgcgcagccggggccctgggggcaacagcgcccccttccagctgcagatgtttgatattgtgtgcagcacctcctgggccaacacagacaagtgctgtgagctgcccggcctgagagatgatgagagctgcccagacctgccccacagctgcagctgcagcgagaccaatgaggtggccctgggccctgctggccccccaggcggccctggcctgcggggccccaagggccagcagggcgagcccggccccaagggcccagatggccccagaggagaaattggcctgcccggcccccagggccccccaggcccccagggccccagcggcctgagcatccagggcatgcctggcatgcctggagagaagggggagaagggggacaccggcctgcccggcccccagggcatccctggaggagtgggcagccctggaagagatggcagccctggccagaggggcctgcccgggaaggatggcagcagcggccccccaggccccccaggccccatcggcatccctggcaccccaggagtgcccggcatcaccggctccatgggcccccagggcgccctgggccccccaggagtgcctggggccaagggggagcggggggagcggggggacctgcagagccaggccatggtgcgctctgtggcccggcaggtgtgtgagcagctgatccagagccacatggcccgctacacagccatcctgaaccagatccccagccacagcagcagcatcagaacagtgcagggccccccaggagagcccggccggcccggcagccctggggcccctggagagcagggccccccaggcaccccaggcttccctggaaatgctggggtgcccggcaccccaggagagcggggcctgaccggcatcaagggggagaagggcaaccctggggtgggcacccagggcccccggggccccccaggccctgctggccccagcggggagagcaggcctggcagccctggccccccaggcagccctggcccccggggccccccaggccacctgggcgtgcccggcccccagggccccagcggccagcccggctactgtgaccccagcagctgcagcgcctacggcgtgcgggccccccacccagaccagcctgagttcacccctgtgcaggatgagctggaggccatggagctgtggggccctggggtgtag

SEQ ID NO: 3359 - DNA, 5391 bp, Artificial Sequence
  Description of Artificial Sequence: Synthetic coding sequence
atgaagatcttccagaggaagatgagatactggctgctgccccccttcctggccatcgtgtacttctgcaccatcgtgcagggccaggtggccccacccacccggctgcgctacaacgtcatcagccatgacagcatccagatctcctggaaggccccccggggcaagtttggaggctacaagctgctggtgacccccaccagcggcggcaagaccaaccagctgaacctgcagaacacagccaccaaggccatcatccagggcctgatgccagaccagaactacacagtgcagatcatcgcctacaacaaggacaaggagagcaagccagcccagggccagttccgcatcaaggacctggagaagaggaaggaccccaagccccgggtgaaggtggtggacagaggaaatggcagccggcccagcagccctgaggaggtgaagtttgtgtgccagaccccagccatcgctgacatcgtcatcctggtggatggctcctggagcatcggccgcttcaacttccggctggtgcgccacttcctggagaacctggtgacagcctttgatgtgggcagcgagaagaccagaattggcctggcccagtacagcggggacccccgcatcgagtggcacctgaatgccttcagcaccaaggatgaagtcatcgaggccgtgaggaacctgccctacaagggcggcaacaccctgaccggcctggccctgaactacatctttgagaacagcttcaagccagaggccggcagcaggactggagtgtccaagattggcatcctgatcacagatggcaagagccaggatgacatcatcccccccagcaggaacctgcgggagagcggcgtggagctgtttgccatcggcgtgaagaatgctgatgtgaatgagctgcaggagatcgccagcgagccagacagcacccacgtgtacaacgtggccgagtttgacctgatgcacacagtggtggagagcctgaccaggaccctgtgcagccgggtggaggagcaggaccgggagatcaaggccagcgcccacgccatcactggaccacccacagagctgatcaccagcgaggtgacagcccggagcttcatggtgaactggacccacgcccctggaaatgtggagaagtacagagtggtgtactaccccacccggggcggcaagccagatgaggtggtggtggatggcaccgtgagcagcacagtgctgaagaacctgatgagcctgacagagtaccagattgctgtgtttgccatctatgcccacacagccagcgagggcctgcggggcacagagaccaccctggccctgcccatggccagtgacctgctgctgtatgatgtgacagagaacagcatgagggtgaagtgggatgctgtgcctggggccagcggctacctgatcctgtatgcccccctgacagagggcctggccggagatgagaaggagatgaagatcggggagacccacacagacatcgagctgagcggcctgctgcccaacacagagtacacagtgacagtgtatgccatgtttggagaggaggccagtgaccctgtgacaggccaggagaccaccctggccctgagccccccaagaaacctgcgcatcagcaatgtgggcagcaacagcgcccggctgacctgggaccccaccagccggcagatcaatggctacagaattgtgtacaacaatgctgatggaacagagatcaatgaggtggaggtggaccccatcaccaccttccccctgaagggcctgacccccctgacagagtacaccatcgccatcttcagcatctatgatgagggccagagcgagcccctgactggagtcttcaccacagaggaggtgcctgcccagcagtacctggagattgatgaggtgaccacagacagcttccgggtgacctggcaccccctgtctgcagatgagggcctgcacaagctgatgtggatccctgtgtatggaggcaagacagaggaggtggtgctgaaggaggagcaggacagccacgtgattgagggcctggagcctggaacagaatatgaggtgtccctgctggccgtgctggatgatggcagcgagagcgaggtggtgacagctgtgggcaccaccctggacagcttctggacagagcccgccaccaccatcgtgcccaccacctctgtgaccagcgtcttccagacaggcatccggaacctggtggtgggagatgagaccaccagcagcctgcgggtgaagtgggacatcagtgacagtgatgtgcagcagttccgggtgacctacatgacagcccagggcgaccctgaggaggaggtgattggaacagtgatggtgcccggcagccagaacaacctgctgctgaagcccctgctgcctgacacagagtacaaggtgacagtgacccccatctacacagatggagaaggagtgtctgtgtctgcccctgggaagaccctgcccagcagcggcccccagaacctgcgggtgtctgaggagtggtacaaccggctgcgcatcacctgggacccccccagcagccctgtgaagggctacagaattgtgtacaagcctgtgtctgtgcccggccccaccctggagacctttgtgggcgctgacatcaacaccatcctgatcaccaacctgctgagcggcatggactacaacgtgaagatctttgccagccaggccagcggcttcagtgatgccctgaccggcatggtgaagaccctcttcctgggcgtgaccaacctgcaggccaagcacgtggagatgaccagcctgtgtgcccactggcaggtgcacagacatgccacagcctacagagtggtgattgagagcctgcaggaccggcagaagcaggagagcacagtgggcggcggcaccaccaggcactgcttctacggcctgcagccagattctgagtacaagatctctgtgtacaccaagctgcaggagattgagggccccagcgtgtccatcatggagaagacccagagcctgcccacccggccccccaccttcccccccaccatccccccagccaaggaggtgtgcaaggccgccaaggctgacctggtgttcatggtggatggctcctggagcattggagatgagaacttcaacaagatcatctccttcctgtacagcacagtgggcgccctgaacaagattggaacagatggcacccaggtggccatggtgcagttcacagatgaccccaggacagagttcaagctgaatgcctacaagaccaaggagaccctgctggatgccatcaagcacatctcctacaagggcggcaacaccaagacaggcaaggccatcaagtatgtgcgggacaccctcttcaccgctgagagcggcacccggcggggcatccccaaggtgattgtggtgatcacagatggccgcagccaggatgatgtgaacaagatcagccgggagatgcagctggatggctacagcatctttgccatcggcgtggctgatgctgactacagcgagctggtgtccatcggcagcaagcccagcgcccggcacgtgttctttgtggatgactttgatgccttcaagaagattgaagatgagctgatcacctttgtgtgtgaaacagccagcgccacctgccctgtggtgcacaaggatggcatcgacctggccggcttcaagatgatggagatgtttggcctggtggagaaggacttcagctctgtggagggcgtgtccatggagcccggcaccttcaacgtgttcccctgctaccagctgcacaaggatgccctggtgtcccagcccacccgctacctgcaccctgagggcctgcccagcgactacaccatctccttcctgttccgcatcctgcctgacaccccccaggagccctttgccctgtgggagatcctgaacaagaacagcgaccccctggtgggcgtcatcctggacaatggaggcaagaccctgacctacttcaactatgaccagagcggggacttccagacagtgacctttgagggccctgagatcaggaagatcttctacggcagcttccacaagctgcacatcgtggtgtctgagaccctggtgaaggtggtgattgactgcaagcaggtgggggagaaggccatgaatgccagcgccaacatcaccagtgatggagtggaggtgctgggcaagatggtgcgcagccggggccctgggggcaacagcgcccccttccagctgcagatgtttgacatcgtgtgcagcacctcctgggccaacacagacaagtgctgtgagctgcccggcctgagagatgatgagagctgcccagacctgccccacagctgcagctgcagcgagaccaatgaggtggccctgggccctgctggccccccaggcggccctggcctgcggggccccaagggccagcagggcgagcccggccccaagggcccagatggccccagaggagagatcggcctgcccggcccccagggccccccaggcccccagggccccagcggcctgagcatccagggcatgcctggcatgcctggagagaagggggagaagggggacaccggcctgcccggcccccagggcatccctgggggcgtgggcagccctggaagagatggcagccctggccagaggggcctgcccgggaaggatggcagcagcggccccccaggccccccaggccccatcggcatccctggcaccccaggagtgcccggcatcaccggctccatgggcccccagggcgccctgggccccccaggagtgcctggggccaagggggagcggggggagcggggggacctgcagagccaggccatggtgcgctctgtggcccggcaggtgtgtgagcagctgatccagagccacatggcccgctacacagccatcctgaaccagatccccagccacagcagcagcatcagaacagtgcagggccccccaggagagcccggccggcccggcagccctggggcccctggagagcagggccccccaggcaccccaggcttccctggaaatgccggcgtgcccggcaccccaggagagcggggcctgaccggcatcaagggggagaagggcaaccctggggtgggcacccagggcccccggggccccccaggccctgctggccccagcggggagagccggcccggcagccctggccccccaggcagccctggcccccggggccccccaggccacctgggcgtgcccggcccccagggccccagcggccagcccggctactgtgaccccagcagctgcagcgcctatggagtgcgggccccccacccagaccagcctgagttcacccctgtgcaggatgagctggaggccatggagctgtggggccctggggtgtag

SEQ ID NO: 3360 - DNA, 5343 bp, Artificial Sequence
  Description of Artificial Sequence: Synthetic coding sequence
atgaagatcttccagaggaagatgagatactggctgctgccccccttcctggccatcgtgtacttctgcaccatcgtgcagggccaggtggccccacccacccggctgcgctacaacgtcatcagccatgacagcatccagatctcctggaaggccccccggggcaagtttggaggctacaagctgctggtgacccccaccagcggcggcaagaccaaccagctgaacctgcagaacacagccaccaaggccatcatccagggcctgatgccagaccagaactacacagtgcagatcatcgcctacaacaaggacaaggagagcaagccagcccagggccagttccgcatcaaggacctggagaagaggaaggaccccaagccccgggtgaaggtggtggacagaggaaatggcagccggcccagcagccctgaggaggtgaagtttgtgtgccagaccccagccatcgctgacatcgtcatcctggtggatggctcctggagcatcggccgcttcaacttccggctggtgcgccacttcctggagaacctggtgacagcctttgatgtgggcagcgagaagaccagaattggcctggcccagtacagcggggacccccgcatcgagtggcacctgaatgccttcagcaccaaggatgaagtcatcgaggccgtgaggaacctgccctacaagggcggcaacaccctgaccggcctggccctgaactacatctttgagaacagcttcaagccagaggccggcagcaggactggagtgtccaagattggcatcctgatcacagatggcaagagccaggatgacatcatcccccccagcaggaacctgcgggagagcggcgtggagctgtttgccatcggcgtgaagaatgctgatgtgaatgagctgcaggagatcgccagcgagccagacagcacccacgtgtacaacgtggccgagtttgacctgatgcacacagtggtggagagcctgaccaggaccctgtgcagccgggtggaggagcaggaccgggagatcaaggccagcgcccacgccatcactggaccacccacagagctgatcaccagcgaggtgacagcccggagcttcatggtgaactggacccacgcccctggaaatgtggagaagtacagagtggtgtactaccccacccggggcggcaagccagatgaggtggtggtggatggcaccgtgagcagcacagtgctgaagaacctgatgagcctgacagagtaccagattgctgtgtttgccatctatgcccacacagccagcgagggcctgcggggcacagagaccaccctggccctgcccatggccagtgacctgctgctgtatgatgtgacagagaacagcatgagggtgaagtgggatgctgtgcctggggccagcggctacctgatcctgtatgcccccctgacagagggcctggccggagatgagaaggagatgaagatcggggagacccacacagacatcgagctgagcggcctgctgcccaacacagagtacacagtgacagtgtatgccatgtttggagaggaggccagtgaccctgtgacaggccaggagaccaccctggccctgagccccccaagaaacctgcgcatcagcaatgtgggcagcaacagcgcccggctgacctgggaccccaccagccggcagatcaatggctacagaattgtgtacaacaatgctgatggaacagagatcaatgaggtggaggtggaccccatcaccaccttccccctgaagggcctgacccccctgacagagtacaccatcgccatcttcagcatctatgatgagggccagagcgagcccctgactggagtcttcaccacagaggaggtgcctgcccagcagtacctggagattgatgaggtgaccacagacagcttccgggtgacctggcaccccctgtctgcagatgagggcctgcacaagctgatgtggatccctgtgtatggaggcaagacagaggaggtggtgctgaaggaggagcaggacagccacgtgattgagggcctggagcctggaacagaatatgaggtgtccctgctggccgtgctggatgatggcagcgagagcgaggtggtgacagctgtgggcaccaccctggacagcttctggacagagcccgccaccaccatcgtgcccaccacctctgtgaccagcgtcttccagacaggcatccggaacctggtggtgggagatgagaccaccagcagcctgcgggtgaagtgggacatcagtgacagtgatgtgcagcagttccgggtgacctacatgacagcccagggcgaccctgaggaggaggtgattggaacagtgatggtgcccggcagccagaacaacctgctgctgaagcccctgctgcctgacacagagtacaaggtgacagtgacccccatctacacagatggagaaggagtgtctgtgtctgcccctgggaagaccctgcccagcagcggcccccagaacctgcgggtgtctgaggagtggtacaaccggctgcgcatcacctgggacccccccagcagccctgtgaagggctacagaattgtgtacaagcctgtgtctgtgcccggccccaccctggagacctttgtgggcgctgacatcaacaccatcctgatcaccaacctgctgagcggcatggactacaacgtgaagatctttgccagccaggccagcggcttcagtgatgccctgaccggcatggtgaagaccctcttcctgggcgtgaccaacctgcaggccaagcacgtggagatgaccagcctgtgtgcccactggcaggtgcacagacatgccacagcctacagagtggtgattgagagcctgcaggaccggcagaagcaggagagcacagtgggcggcggcaccaccaggcactgcttctacggcctgcagccagattctgagtacaagatctctgtgtacaccaagctgcaggagattgagggccccagcgtgtccatcatggagaagacccagagcctgcccacccggccccccaccttcccccccaccatccccccagccaaggaggtgtgcaaggccgccaaggctgacctggtgttcatggtggatggctcctggagcattggagatgagaacttcaacaagatcatctccttcctgtacagcacagtgggcgccctgaacaagattggaacagatggcacccaggtggccatggtgcagttcacagatgaccccaggacagagttcaagctgaatgcctacaagaccaaggagaccctgctggatgccatcaagcacatctcctacaagggcggcaacaccaagacaggcaaggccatcaagtatgtgcgggacaccctcttcaccgctgagagcggcacccggcggggcatccccaaggtgattgtggtgatcacagatggccgcagccaggatgatgtgaacaagatcagccgggagatgcagctggatggctacagcatctttgccatcggcgtggctgatgctgactacagcgagctggtgtccatcggcagcaagcccagcgcccggcacgtgttctttgtggatgactttgatgccttcaagaagattgaagatgagctgatcacctttgtgtgtgaaacagccagcgccacctgccctgtggtgcacaaggatggcatcgacctggccggcttcaagatgatggagatgtttggcctggtggagaaggacttcagctctgtggagggcgtgtccatggagcccggcaccttcaacgtgttcccctgctaccagctgcacaaggatgccctggtgtcccagcccacccgctacctgcaccctgagggcctgcccagcgactacaccatctccttcctgttccgcatcctgcctgacaccccccaggagccctttgccctgtgggagatcctgaacaagaacagcgaccccctggtgggcgtcatcctggacaatggaggcaagaccctgacctacttcaactatgaccagagcggggacttccagacagtgacctttgagggccctgagatcaggaagatcttctacggcagcttccacaagctgcacatcgtggtgtctgagaccctggtgaaggtggtgattgactgcaagcaggtgggggagaaggccatgaatgccagcgccaacatcaccagtgatggagtggaggtgctgggcaagatggtgcgcagccggggccctgggggcaacagcgcccccttccagctgcagatgtttgacatcgtgtgcagcacctcctgggccaacacagacaagtgctgtgagctgcccggcctgagagatgatgagagctgcccagacctgccccacagctgcagctgcagcgagaccaatgaggtggccctgggccctgctggccccccaggcggccctggcctgcggggccccaagggccagcagggcgagcccggccccaagggcccagatggccccagaggagagatcggcctgcccggcccccagggccccccaggcccccagggccccagcggcctgagcatccagggcatgcctggcatgcctggagagaagggggagaagggggacaccggcctgcccggcccccagggcatccctgggggcgtgggcagccctggaagagatggcagccctggccagaggggcctgcccgggaaggatggcagcagcggccccccaggccccccaggccccatcggcatccctggcaccccaggagtgcccggcatcaccggctccatgggcccccagggcgccctgggccccccaggagtgcctggggccaagggggagcggggggagcggggggacctgcagagccaggccatggtgcgctctgtggcccggcaggtgtgtgagcagctgatccagagccacatggcccgctacacagccatcctgaaccagatccccagccacagcagcagcatcagaacagtgcagggccccccaggagagcccggccggcccggcagccctggggcccctggagagcagggccccccaggcaccccaggcttccctggaaatgccggcgtgcccggcaccccaggagagcggggcctgaccggcatcaagggggagaagggcaaccctggggtgggcacccagggcccccggggccccccaggccctgctggccccagcggggagagccggcccggcagccctggccccccaggcagccctggcccccggggccccccaggccacctgggcgtgcccggcccccagggccccagcggccagcccggctactgtgaccccagcagctgcagcgcctatggagtgcgggacctgatcccctacaatgactaccagcactag

SEQ ID NO: 3361 - DNA, 1605 bp, Artificial Sequence
  Description of Artificial Sequence: Synthetic coding sequence
atgaagatcttccagaggaagatgagatactggctgctgccccccttcctggccatcgtgtacttctgcaccatcgtgcagggccaggtggccccacccacccggctgcgctacaacgtcatcagccatgacagcatccagatctcctggaaggccccccggggcaagtttggaggctacaagctgctggtgacccccaccagcggcggcaagaccaaccagctgaacctgcagaacacagccaccaaggccatcatccagggcctgatgccagaccagaactacacagtgcagatcatcgcctacaacaaggacaaggagagcaagccagcccagggccagttccgcatcaaggacctggagaagaggaaggaccccaagccccgggtgaaggtggtggacagaggaaatggcagccggcccagcagccctgaggaggtgaagtttgtgtgccagaccccagccatcgctgacatcgtcatcctggtggatggctcctggagcatcggccgcttcaacttccggctggtgcgccacttcctggagaacctggtgacagcctttgatgtgggcagcgagaagaccagaattggcctggcccagtacagcggggacccccgcatcgagtggcacctgaatgccttcagcaccaaggatgaagtcatcgaggccgtgaggaacctgccctacaagggcggcaacaccctgaccggcctggccctgaactacatctttgagaacagcttcaagccagaggccggcagcaggactggagtgtccaagattggcatcctgatcacagatggcaagagccaggatgacatcatcccccccagcaggaacctgcgggagagcggcgtggagctgtttgccatcggcgtgaagaatgctgatgtgaatgagctgcaggagatcgccagcgagccagacagcacccacgtgtacaacgtggccgagtttgacctgatgcacacagtggtggagagcctgaccaggaccctgtgcagccgggtggaggagcaggaccgggagatcaaggccagcgcccacgccatcactggaccacccacagagctgatcaccagcgaggtgacagcccggagcttcatggtgaactggacccacgcccctggaaatgtggagaagtacagagtggtgtactaccccacccggggcggcaagccagatgaggtggtggtggatggcaccgtgagcagcacagtgctgaagaacctgatgagcctgacagagtaccagattgctgtgtttgccatctatgcccacacagccagcgagggcctgcggggcacagagaccaccctggccctgcccatggccagtgacctgctgctgtatgatgtgacagagaacagcatgagggtgaagtgggatgctgtgcctggggccagcggctacctgatcctgtatgcccccctgacagagggcctggccggagatgagaaggagatgaagatcggggagacccacacagacatcgagctgagcggcctgctgcccaacacagagtacacagtgacagtgtatgccatgtttggagaggaggccagtgaccctgtgacaggccaggagaccaccagcccctag

SEQ ID NO: 3362 - DNA, 3429 bp, Artificial Sequence
  Description of Artificial Sequence: Synthetic coding sequence
atgaggctgaccggcccctggaagctgtggctgtggatgagcatcttcctgctgcctgccagcacctctgtgacagtgcgggacaagacagaggagagctgccccatcctgagaattgagggccaccagctgacctatgacaacatcaacaagctggaggtgtctggctttgacctgggggacagcttcagcctgcggcgggccttctgtgagagtgacaagacctgcttcaagctgggcagcgccctgctgatccgggacaccatcaagatcttccccaagggcctgcctgaggagtacagcgtggccgccatgttccgggtgagaagaaatgccaagaaggagcgctggttcctgtggcaggtgctgaaccagcagaacatcccccagatcagcatcgtggtggatggcggcaagaaggtggtggagttcatgttccaggccacagaaggagatgtgctgaactacatcttcaggaaccgggagctgcggcccctgtttgaccggcagtggcacaagctgggcatcagcatccagagccaggtgatcagcctgtacatggactgcaacctgattgcccggcggcagacagatgagaaggacacagtggacttccacggccgcacagtgattgccacccgggccagtgatggcaagcctgtggacatcgagctgcaccagctgaagatctactgcagcgccaacctgattgcccaggagacctgctgtgagatcagtgacaccaagtgcccagagcaggacggcttcggcaacatcgccagctcctgggtgacagcccacgccagcaagatgagcagctacctgcctgccaagcaggagctgaaggaccagtgccagtgcatccccaacaagggggaggccggcctgcccggggcccctggcagccctggccagaagggccacaagggggagcccggggagaatggcctgcacggggcccctggcttccctggccagaagggggagcagggctttgagggcagcaagggggagactggagagaagggggagcagggcgagaagggggaccctgccctggccggcctgaatggagaaaatggcctgaagggggacctgggcccccacggccccccaggccccaagggggagaagggggacaccggccccccaggccccccagccctgcccggcagcctgggcatccagggcccccagggccccccaggcaaggagggccagaggggccggcggggcaagacaggccccccaggcaagccaggccccccaggccccccaggccccccaggcatccagggcatccaccagaccctgggcggctactacaacaaggacaacaagggaaatgatgagcacgaggccggcggcctgaagggggacaagggggagaccggcctgcccggcttccctggctctgtgggccccaagggccagaagggggagcccggggagcccttcaccaagggggagaagggggacagaggagagcccggggtcatcggcagccagggcgtgaagggggagcccggggaccccggccccccaggcctcatcggcagccctggcctgaagggccagcagggcagcgctggctccatgggcccccggggccccccaggagatgtgggcctgcctggagagcacggcatccctgggaagcagggcatcaagggggagaagggggaccccggcggcatcatcggccccccaggcctgcccggccccaagggggaggccggccccccaggcaagagcctgcctggagagcccggcctggatggcaaccctggggcccctggcccccggggccccaagggggagcggggcctgcccggggtgcacggcagccctggggacatcggcccccagggcatcggcatccctggccgcactggagcccagggccctgctggggagcccggcatccagggcccccggggcctgcccggcctgcccggcaccccaggcaccccaggaaatgatggagtgcccggcagagatggcaagccaggcctgcccggccccccaggggaccccatcgccctgcccctgctgggggacatcggggccctgctgaagaacttctgtggcaactgccaggcctctgtgcccggcctgaagagcaacaagggggaggagggcggggccggggagcccgggaagtatgacagcatggccaggaagggggacatcggcccccggggccccccaggcatccctggccgggagggccccaagggcagcaaaggagagcggggctacccaggcatccctggagagaagggagatgagggcctgcagggcatccctggcatccctggggcccctggccccactggacctcctggcctgatgggccgcacaggccaccctggccccaccggggccaagggggagaagggcagtgatggccccccaggcaagccaggccccccaggccccccaggcatccccttcaatgaaagaaatggcatgagcagcctgtacaagatcaagggcggcgtgaatgtgcccagctacccaggccccccaggccccccaggccccaagggggaccccggccctgtgggggagcccggggccatgggcctgcccggcctggagggcttccctggggtgaagggggaccggggccctgctggccccccaggcattgctggcatgtctgggaagccaggggcccctggccccccaggagtgcctggagagcccggggagcggggccctgtgggggacatcggcttccctggccctgagggccccagcggcaagccaggcatcaacgggaaggatggcatccctggggcccagggcatcatgggcaagccaggggaccggggccccaagggggagcggggggaccagggcatccctggggaccggggcagccagggcgagcggggcaagccaggcctgaccggcatgaagggggccatcggccccatgggccccccaggcaacaagggctccatgggcagccctggccaccagggccccccaggcagccctggcatccctggcatcccagcagatgctgtgtcctttgaggagatcaagaagtacatcaaccaggaggtgctgcgcatctttgaggagaggatggctgtgttcctgagccagctgaagctgcctgctgccatgctggccgcccaggcctacggccggcccggccccccaggcaaggatggcctgcccggccccccaggggaccccggcccccagggctaccggggccagaagggggagcggggggagcccggcatcggcctgcccggcagccctggcctgcccggcaccagcgccctgggcctgcccggcagccctggggcccctggcccccagggccccccaggccccagcggccgctgcaaccctgaggactgcctgtaccctgtgagccacgcccaccagaggactggaggcaactag

SEQ ID NO: 3363 - DNA, 462 bp, Artificial Sequence
  Description of Artificial Sequence: Synthetic coding sequence
ggcatcaatggcaaggatggcatccctggggcccagggcatcatgggcaagccaggggaccggggccccaagggggagcggggggaccagggcatccctggggaccggggcagccagggcgagcggggcaagccaggcctgaccggcatgaagggggccatcggccccatgggccccccaggcaacaagggctccatgggcagccctggccaccagggccccccaggcagccctggcatccctggcatcccagcagatgctgtgtcctttgaggagatcaagaagtacatcaaccaggaggtgctgcgcatctttgaggagaggatggctgtgttcctgagccagctgaagctgcctgctgccatgctggccgcccaggcctacggccggcccggccccccaggcaaggatggcctgcccggccccccaggggaccccggcccccaggaggtggatgtgtag

SEQ ID NO: 3364 - DNA, 4167 bp, Artificial Sequence
  Description of Artificial Sequence: Synthetic coding sequence
atggcccccaggagaaataatggccagtgctggtgcctgctgatgctgctgtctgtgtccacccccctgcctgctgtgacccagaccaggggggccacagaaacagccagccagggccacctggacctgacccagctgattggagtgcccctgcccagctctgtgtcctttgtgacaggctatggaggcttccctgcctacagctttggacctggggccaacgtgggccggcctgcccggaccctcatccccagcaccttcttccgggactttgccatctctgtggtggtgaagcccagcagcacccggggcggcgtgctgtttgccatcacagatgccttccagaaggtgatctacctgggcctgcggctgtctggagtggaggatggccaccagaggatcatcctgtactacacagagcccggcagccacgtgtcccaggaggccgccgccttctctgtgcctgtgatgacccaccgctggaacagatttgccatgattgtgcagggcgaggaggtgaccctgctggtgaactgtgaggagcacagccgcatccccttccagaggagcagccaggccctggcctttgagagcagcgctggcatcttcatgggaaatgctggggccaccggcctggagcgcttcaccggcagcctgcagcagctgactgtgcacccagaccccaggaccccagaggagctgtgtgaccctgaggagagcagcgccagcggggagaccagcggcctgcaggaggctgatggagtggccgagatcctggaggccgtgacctacacccaggccagccccaaggaggccaaggtggagcccatcaacaccccacccacccccagcagcccctttgaggacatggagctgtctggagagcctgtgcctgagggcaccctggagaccaccaacatgagcatcatccagcacagcagccccaagcagggcagcggggagatcctgaatgacaccctggagggcgtgcacagcgtggatggagaccccatcacagattctggcagcggggccggggccttcctggacattgctgaggagaagaacctggccgccacagctgctggcctggccgaggtgcccatcagcacagctggggaggccgaggccagctctgtgcccaccggcggccccaccctgtccatgagcacagagaaccctgaggagggcgtgaccccaggccctgacaatgaggagcggctggccgccacagctgctggggaggccgaggccctggcctccatgcctggagaggtggaggccagcggcgtggcccctggagagctggacctgtccatgtctgcccagagcctgggggaggaggccaccgtgggccccagcagcgaggacagcctgaccacagctgctgctgccacagaggtgtccctgagcacctttgaagatgaggaggccagcggcgtgcccacagatggcctggcccccctgacagccaccatggcccctgagagagctgtgaccagcggccctggagatgaggaggacctggccgccgccaccacagaggagcccctcatcacagctggaggagaggagagcggcagccccccaccagatggcccccccctgcccctgcccaccgtggcccctgagcgctggatcaccccagcccagcgggagcacgtgggcatgaagggccaggccggccccaagggggagaagggagatgctggggaggagctgcccggccccccagagcccagcggccctgtgggccccacagctggagctgaggccgagggcagcggcctgggctggggcagtgatgtgggcagcggcagcggggacctggtgggcagcgagcagctgctgcggggccccccaggccccccaggccccccaggcctgcccggcatccctgggaagccaggcacagatgtgttcatgggccccccaggcagccctggagaagatggccctgctggggagcccggccccccaggccctgagggccagcccggggtggatggagccaccggcctgcccggcatgaagggggagaagggggcccggggccccaatggatctgtgggggagaagggggaccccggcaacagaggcctgcccggccccccaggcaagaagggccaggccggccccccaggagtgatgggccccccaggccccccaggccccccaggccccccaggccctggctgcaccatgggcctgggctttgaggacacagagggcagcggcagcacccagctgctgaatgagcccaagctgagccggcccacagctgccatcggcctgaagggggagaagggggaccggggccccaagggggagcggggcatggatggagccagcatcgtgggccccccaggcccccggggccccccaggccacatcaaggtgctgagcaacagcctcatcaacatcacccacggcttcatgaacttcagtgacatccctgagctggtgggccccccaggcccagatggcctgcccggcctgcccggcttccctggcccccggggccccaagggggacaccggcctgcccggcttccctggcctgaagggggagcagggcgagaagggggagcccggggccatcctgacagaggacatccccctggagcggctgatgggcaagaagggggagcccggcatgcatggagcccctggccccatgggccccaagggccccccaggccacaagggggagtttggcctgcccggccggcccggccggcccggcctgaatggcctgaagggcaccaagggggaccccggggtcatcatgcagggccccccaggcctgcccggccccccaggccccccaggccccccaggggccgtcatcaacatcaagggggccatcttccccatccctgtgcggccccactgcaagatgcctgtggacacagcccaccctggcagccctgagctgatcaccttccatggagtgaagggggagaagggctcctggggcctgcccggcagcaagggggagaagggggaccagggcgcccagggccccccaggcccccccctggacctggcctacctgcggcacttcctgaacaacctgaagggagaaaatggagacaagggcttcaagggggagaagggggagaagggggacatcaatggcagcttcctgatgagcggccccccaggcctgcccggcaaccctggccctgctggccagaagggggagaccgtggtgggcccccagggccccccaggggcccctggcctgcccggccccccaggcttcggccggcctggggaccccggccccccaggccccccaggccccccaggccccccagccatcctgggcgctgctgtggccctgcccggccccccaggccccccaggccagcccggcctgcccggcagcaggaacctggtgacagccttcagcaacatggatgacatgctgcagaaggcccacctggtgattgagggcaccttcatctacctgcgggacagcacagagttcttcatccgggtgagagatggctggaagaagctgcagctgggggagctgatccccatcccagctgacagccccccacctccagccctgagcagcaacccccaccagctgctgcccccacccaaccccatcagcagcgccaactatgagaagccagccctgcacctggccgccctgaacatgcccttcagcggggacatccgggctgacttccagtgcttcaagcaggcccgggccgccggcctgctgagcacctaccgggccttcctgagcagccacctgcaggacctgagcaccatcgtgaggaaggccgagcgctacagcctgcccatcgtgaacctgaagggccaggtgctcttcaacaactgggacagcatcttcagcggccacggcggccagttcaacatgcacatccccatctacagctttgatggccgggacatcatgacagaccccagctggccccagaaggtgatctggcacggcagcagcccccacggcgtgcggctggtggacaactactgtgaggcctggaggacagctgacacagctgtgacaggcctggccagccccctgagcacaggcaagatcctggaccagaaggcctacagctgtgccaacagactcatcgtgctgtgcattgaaaattccttcatgacagatgccaggaagtag

SEQ ID NO: 3365 - DNA, 2238 bp, Artificial Sequence
  Description of Artificial Sequence: Synthetic coding sequence
atggcccccaggagaaataatggccagtgctggtgcctgctgatgctgctgtctgtgcccctgcccagctctgtgtcctttgtgacaggctatggaggcttccctgcctacagctttggacctggggccaacgtgggccggcctgcccggaccctcatccccagcaccttcttccgggactttgccatctctgtggtggtgaagcccagcagcacccggggcggcgtgctgtttgccatcacagatgccttccagaaggtgatctacctgggcctgcggctgtctggagtggaggatggccaccagaggatcatcctgtactacacagagcccggcagccacgtgtcccaggaggccgccgccttctctgtgcctgtgatgacccaccgctggaacagatttgccatgattgtgcagggcgaggaggtgaccctgctggtgaactgtgaggagcacagccgcatccccttccagaggagcagccaggccctggcctttgagagcagcgctggcatcttcatgggaaatgctggggccaccggcctggagcgcttcaccggcagcctgcagcagctgactgtgcacccagaccccaggaccccagaggagctgtgtgaccctgaggagagcagcgccagcggggagaccagcggcctgcaggaggctgatggagtggccgagatcctggaggccgtgacctacacccaggccagccccaaggaggccaaggtggagcccatcaacaccccacccacccccagcagcccctttgaggacatggagctgtctggagagcctgtgcctgagggcaccctggagaccaccaacatgagcatcatccagcacagcagccccaagcagggcagcggggagatcctgaatgacaccctggagggcgtgcacagcgtggatggagaccccatcacagattctggcagcggggccggggccttcctggacattgctgaggagaagaacctggccgccacagctgctggcctggccgaggtgcccatcagcacagctggggaggccgaggccagctctgtgcccaccggcggccccaccctgtccatgagcacagagaaccctgaggagggcgtgaccccaggccctgacaatgaggagcggctggccgccacagctgctggggaggccgaggccctggcctccatgcctggagaggtggaggccagcggcgtggcccctggagagctggacctgtccatgtctgcccagagcctgggggaggaggccaccgtgggccccagcagcgaggacagcctgaccacagctgctgctgccacagaggtgtccctgagcacctttgaagatgaggaggccagcggcgtgcccacagatggcctggcccccctgacagccaccatggcccctgagagagctgtgaccagcggccctggagatgaggaggacctggccgccgccaccacagaggagcccctcatcacagctggaggagaggagagcggcagccccccaccagatggcccccccctgcccctgcccaccgtggcccctgagcgctggatcaccccagcccagcgggagcacgtgggcatgaagggccaggccggccccaagggggagaagggagatgctggggaggagctgcccggccccccagagcccagcggccctgtgggccccacagctggagctgaggccgagggcagcggcctgggctggggcagtgatgtgggcagcggcagcggggacctggtgggcagcgagcagctgctgcggggccccccaggccccccaggccccccaggcctgcccggcatccctgggaagccaggcacagatgtgttcatgggccccccaggcagccctggagaagatggccctgctggggagcccggccccccaggccctgagggccagcccggggtggatggagccaccggcctgcccggcatgaagggggagaagggggcccggggccccaatggatctgtgggggagaagggggaccccggcaacagaggcctgcccggccccccaggcaagaagggccaggccggccccccaggagtgatgggccccccaggccccccaggccccccaggccccccaggccctggctgcaccatgggcctgggctttgaggacacagagggcagcggcagcacccagctgctgaatgagcccaagctgagcagccccacccccaccccccagttctatgacttccacctggccatcgtggagctgtag

SEQ ID NO: 3366 - DNA, 4815 bp, Artificial Sequence
  Description of Artificial Sequence: Synthetic coding sequence
atgtgggtgtcctgggcccctggcctgtggctgctgggcctgtgggccaccttcggccacggggccaacacaggagcccagtgcccccccagccagcaggagggcctgaagctggagcacagcagcagcctgcctgccaacgtgacaggcttcaacctgatccaccggctgagcctgatgaagaccagcgccatcaagaagatccggaaccccaagggccccctcatcctgcggctgggcgccgcccctgtgacccagcccaccaggagggtcttcccccggggcctgcctgaggagtttgccctggtgctgaccctgctgctgaagaagcacacccaccagaagacctggtacctgttccaggtgacagatgccaacggctacccccagatcagcctggaggtgaacagccaggagaggagcctggagctgcgggcccagggccaggatggagactttgtgtcctgcatcttccctgtgccccagctgtttgacctgcgctggcacaagctgatgctgtctgtggccggccgggtggcctctgtgcacgtggactgcagcagcgccagcagccagcccctgggcccccggcggcccatgaggcctgtgggccacgtgttcctgggcctggatgctgagcagggcaagcctgtgtcctttgacctgcagcaggtgcacatctactgtgaccctgagctggtgctggaggagggctgctgtgagatcctgcctgctggctgccccccagagaccagcaaggcccggcgggacacccagagcaatgaactcatcgagatcaacccccagagcgagggcaaggtgtacacccgctgcttctgcctggaggagccccagaacagcgaggtggatgcccagctgaccggccgcatcagccagaaggccgagcggggggccaaggtgcaccaggagacagctgctgatgaatgtcctccctgtgtgcatggagcccgggacagcaatgtgtctgagtggagggtgggccctgagggcggcaaaggagagcggggcctgcccggccccccaggcagcaaaggagagaagggggcccggggaaatgactgtgtgcgcatcagcccagatgcccccctgcagtgtgccgagggccccaagggggagaagggggagagcggggccctgggccccagcggcctgcccggcagcactggagagaagggccagaagggggagaagggagatggcggcatcaagggcgtgcctgggaagccaggaagagatggccggcctggagagatctgtgtgattggccccaagggccagaagggggaccccggctttgtgggccctgagggcctggccggggagcccggccccccaggcctgcccggccccccaggcatcggcctgcccggcacccctggggaccccggcggccccccaggccccaagggggacaagggcagcagcggcatccctgggaaggagggccctgggggcaagccaggcaagccaggagtgaagggggagaagggggacccctgtgaggtgtgccccaccctgcctgagggcttccagaactttgtgggcctgcccgggaagccaggccccaagggggagcccggggaccctgtgcctgcccggggggaccccggcatccagggcatcaagggggagaagggggagccctgcctgagctgcagctctgtggtgggcgcccagcacctggtgagcagcactggagccagcggagatgtgggcagccctggcttcggcctgcccggcctgcctgtgaaggccggcgtgcccggcctgagccctgggggcaactttggagaggccggccctgctggcagccctggccccccaggccctgtgggccctgctggcatcaagggggccaagggggagccctgtgagccctgcccagccctgagcaacctgcaggatggagatgtgcgggtggtggccctgcccggccccagcggggagaagggggagcccggccccccaggcttcggcctgcccgggaagcagggcaaggccggggagcggggcctgaagggccagaagggagatgctggcaaccctggggaccccggcaccccaggcaccaccggccggcccggcctgagcggggagcccggggtgcagggccctgctggccccaagggggagaagggagatggctgcacagcctgccccagcctgcagggcaccgtgacagacatggccggccggcccggccagcccggccccaagggggagcagggccctgagggcgtgggccggcctgggaagccaggccagcccggcctgcccggggtgcagggccccccaggcctgaagggcgtgcagggcgagcccggccccccaggccggggcgtgcagggcccccagggcgagcccggggcccctggcctgcccggcatccagggcctgcccggcccccggggccccccaggccccaccggggagaagggggcccagggcagccctggggtgaagggggccactggacctgtgggccccccaggggcctctgtgtctggccccccaggaagagatggccagcagggccagacaggcctgcggggcaccccaggagagaagggccccagaggagagaagggggagcccggggagtgcagctgccccagccagggcgacctgatcttcagcggcatgcctggggcccctggcctgtggatgggcagctcctggcagcccggcccccagggccccccaggcatccctggccccccaggccccccaggagtgcccggcctgcagggcgtgcccggcaacaacggcctgcccggccagcccggcctgacagctgagctgggcgccctggccctgggcagccactggggcagccccagcatctgtggggactgtgtgcagggccagagggcccaccctggctacctggtggagaagggggagaagggggaccagggcatccctggggtgcccggcctggacaactgtgcccagtgcttcctgagcctggagcggcccagggctgaggaggcccggggggacaacagcgagggggaccccggctgtgtgggcagccctggcctgcccggccccccaggcctgcccggccagagaggagaggagggccccccaggcatgaggggcagccctggccccccaggccccatcggccccccaggcttccctggagctgtgggcagccctggcctgcccggcctgcagggcgagcggggcctgaccggcctgactggagacaagggggagcccggccccccaggccagcccggctacccaggggccactggacctcctggcctgcccggcatcaagggggagcggggctacacaggcagcgctggggagaagggggagcccggccccccaggcagcgagggcctgcccggccccccaggccctgctggccccagaggagagcggggcccccagggcaacagcggggagaagggggaccagggcttccagggccagcccggcttccctggccccccaggccccccaggcttccctgggaaggtgggcagccctggccccccaggcccccaggccgagaagggcagcgagggcatccggggccccagcggcctgcccggcagccctggccccccaggccccccaggcatccagggccctgctggcctggatggcctggatggcaaggatggcaagccaggcctgcggggggaccccggccctgctggccccccaggcctgatgggccccccaggcttcaagggcaagacaggccaccctggcctgcccggccccaagggggactgtgggaagccaggccccccaggcagcacaggccggcctggagctgagggggagcccggggccatgggcccccagggccggcccggccccccaggccacgtgggccccccaggccccccaggccagcccggccctgctggcatctctgctgtgggcctgaagggggacagaggagccactggagagcggggcctggccggcctgcccggccagcccggccccccaggccaccctggccccccaggagagcctggaacagatggagctgctgggaaggagggccccccaggcaagcagggcttctacggccccccaggccccaagggggaccccggggctgctggccagaagggccaggccggggagaagggccgggccggcatgcctgggggccctgggaagagcggctccatgggccctgtgggccccccaggccctgctggggagcggggccaccctggggcccctggccccagcggcagccctggcctgcccggggtgcccggctccatgggagacatggtgaactatgatgagatcaagcgcttcatccggcaggagatcatcaagatgtttgatgagaggatggcctactacaccagcaggatgcagttccccatggagatggccgccgcccctggccggcccggccccccaggcaaggatggagcccctggccggcctggggcccctggcagccctggcctgcccggccagatcggccgggagggccggcagggcctgcccggggtgcggggcctgcccggcaccaagggggagaagggggacattggaattggaattgctggggagaatggcctgcccggccccccaggcccccagggccccccaggctacggcaagatgggcgccaccggccccatgggccagcagggcatccctggcatccctggccccccaggccccatgggccagcccgggaaggccggccactgcaaccccagcgactgcttcggggccatgcccatggagcagcagtacccacccatgaagaccatgaagggcccctttggatag

SEQ ID NO: 3367 - DNA, 4815 bp, Artificial Sequence
  Description of Artificial Sequence: Synthetic coding sequence
atgtgggtgtcctgggcccctggcctgtggctgctgggcctgtgggccaccttcggccacggggccaacacaggagcccagtgcccccccagccagcaggagggcctgaagctggagcacagcagcagcctgcctgccaacgtgacaggcttcaacctgatccaccggctgagcctgatgaagaccagcgccatcaagaagatccggaaccccaagggccccctcatcctgcggctgggcgccgcccctgtgacccagcccaccaggagggtcttcccccggggcctgcctgaggagtttgccctggtgctgaccctgctgctgaagaagcacacccaccagaagacctggtacctgttccaggtgacagatgccaacggctacccccagatcagcctggaggtgaacagccaggagaggagcctggagctgcgggcccagggccaggatggagactttgtgtcctgcatcttccctgtgccccagctgtttgacctgcgctggcacaagctgatgctgtctgtggccggccgggtggcctctgtgcacgtggactgcagcagcgccagcagccagcccctgggcccccggcggcccatgaggcctgtgggccacgtgttcctgggcctggatgctgagcagggcaagcctgtgtcctttgacctgcagcaggtgcacatctactgtgaccctgagctggtgctggaggagggctgctgtgagatcctgcctgctggctgccccccagagaccagcaaggcccggcgggacacccagagcaatgaactcatcgagatcaacccccagagcgagggcaaggtgtacacccgctgcttctgcctggaggagccccagaacagcgaggtggatgcccagctgaccggccgcatcagccagaaggccgagcggggggccaaggtgcaccaggagacagctgctgatgaatgtcctccctgtgtgcatggagcccgggacagcaatgtgaccctggcccccagcggccccaagggcggcaaaggagagcggggcctgcccggccccccaggcagcaaaggagagaagggggcccggggaaatgactgtgtgcgcatcagcccagatgcccccctgcagtgtgccgagggccccaagggggagaagggggagagcggggccctgggccccagcggcctgcccggcagcactggagagaagggccagaagggggagaagggagatggcggcatcaagggcgtgcctgggaagccaggaagagatggccggcctggagagatctgtgtgattggccccaagggccagaagggggaccccggctttgtgggccctgagggcctggccggggagcccggccccccaggcctgcccggccccccaggcatcggcctgcccggcacccctggggaccccggcggccccccaggccccaagggggacaagggcagcagcggcatccctgggaaggagggccctgggggcaagccaggcaagccaggagtgaagggggagaagggggacccctgtgaggtgtgccccaccctgcctgagggcttccagaactttgtgggcctgcccgggaagccaggccccaagggggagcccggggaccctgtgcctgcccggggggaccccggcatccagggcatcaagggggagaagggggagccctgcctgagctgcagctctgtggtgggcgcccagcacctggtgagcagcactggagccagcggagatgtgggcagccctggcttcggcctgcccggcctgcccggccgggccggcgtgcccggcctgaagggggagaagggcaactttggagaggccggccctgctggcagccctggccccccaggccctgtgggccctgctggcatcaagggggccaagggggagccctgtgagccctgcccagccctgagcaacctgcaggatggagatgtgcgggtggtggccctgcccggccccagcggggagaagggggagcccggccccccaggcttcggcctgcccgggaagcagggcaaggccggggagcggggcctgaagggccagaagggagatgctggcaaccctggggaccccggcaccccaggcaccaccggccggcccggcctgtctggagagcccggggtgcagggccctgctggccccaagggggagaagggagatggctgcacagcctgccccagcctgcagggcaccgtgacagacatggccggccggcccggccagcccggccccaagggggagcagggccctgagggcgtgggccggcctgggaagccaggccagcccggcctgcccggggtgcagggccccccaggcctgaagggcgtgcagggcgagcccggccccccaggccggggcgtgcagggcccccagggcgagcccggggcccctggcctgcccggcatccagggcctgcccggcccccggggccccccaggccccactggagagaagggggcccagggcagccctggggtgaagggggccaccggccctgtgggccccccaggggcctctgtgtctggccccccaggaagagatggccagcagggccagacaggcctgcggggcaccccaggagagaagggccccagaggagagaagggggagcctggagaatgtagctgccccagccagggcgacctgatcttcagcggcatgcctggggcccctggcctgtggatgggcagctcctggcagcccggcccccagggccccccaggcatccctggccccccaggccccccaggagtgcccggcctgcagggcgtgcccggcaacaacggcctgcccggccagcccggcctgacagctgagctgggcagcctgcccatcgagcagcacctgctgaagagcatctgtggggactgtgtgcagggccagagggcccaccctggctacctggtggagaagggggagaagggggaccagggcatccctggggtgcccggcctggacaactgtgcccagtgcttcctgagcctggagcggcccagggctgaggaggcccggggggacaacagcgagggggaccccggctgtgtgggcagccctggcctgcccggccccccaggcctgcccggccagagaggagaggagggccccccaggcatgaggggcagccctggccccccaggccccatcggccccccaggcttccctggagctgtgggcagccctggcctgcccggcctgcagggcgagcggggcctgaccggcctgactggagacaagggggagcccggccccccaggccagcccggctacccaggggccactggacctcctggcctgcccggcatcaagggggagcggggctacacaggcagcgctggggagaagggggagcccggccccccaggcagcgagggcctgcccggccccccaggccctgctggccccagaggagagcggggcccccagggcaacagcggggagaagggggaccagggcttccagggccagcccggcttccctggccccccaggccccccaggcttccctgggaaggtgggcagccctggccccccaggcccccaggccgagaagggcagcgagggcatccggggccccagcggcctgcccggcagccctggccccccaggccccccaggcatccagggccctgctggcctggatggcctggatggcaaggatggcaagccaggcctgcggggggaccccggccctgctggccccccaggcctgatgggccccccaggcttcaagggcaagacaggccaccctggcctgcccggccccaagggggactgtgggaagccaggccccccaggcagcacaggccggcctggagctgagggggagcccggggccatgggcccccagggccggcccggccccccaggccacgtgggccccccaggccccccaggccagcccggccctgctggcatctctgctgtgggcctgaagggggacagaggagccactggagagcggggcctggccggcctgcccggccagcccggccccccaggccaccctggccccccaggagagcctggaacagatggagctgctgggaaggagggccccccaggcaagcagggcttctacggccccccaggccccaagggggaccccggggctgctggccagaagggccaggccggggagaagggccgggccggcatgcctgggggccctgggaagagcggctccatgggccctgtgggccccccaggccctgctggggagcggggccaccctggggcccctggccccagcggcagccctggcctgcccggggtgcccggctccatgggagacatggtgaactatgatgagatcaagcgcttcatccggcaggagatcatcaagatgtttgatgagaggatggcctactacaccagcaggatgcagttccccatggagatggccgccgcccctggccggcccggccccccaggcaaggatggagcccctggccggcctggggcccctggcagccctggcctgcccggccagatcggccgggagggccggcagggcctgcccggggtgcggggcctgcccggcaccaagggggagaagggggacattggaattggaattgctggggagaatggcctgcccggccccccaggcccccagggccccccaggctacggcaagatgggcgccaccggccccatgggccagcagggcatccctggcatccctggccccccaggccccatgggccagcccgggaaggccggccactgcaaccccagcgactgcttcggggccatgcccatggagcagcagtacccacccatgaagaccatgaagggcccctttggatag

SEQ ID NO: 3368 - DNA, 4494 bp, Artificial Sequence
  Description of Artificial Sequence: Synthetic coding sequence
atggatgtgaccaagaagaacaagagagatggaacagaggtgacagagcgcatcgtgacagagaccgtgaccacccggctgaccagcctgccccccaagggcggcaccagcaatggctacgccaagacagccagcctgggcggcggcagccggctggagaagcagagcctgacccacggcagcagcggctacatcaacagcacaggcagcacccggggccacgccagcaccagcagctacagaagagcccacagccctgccagcaccctgcccaacagccctggcagcacctttgagaggaagacccacgtgaccaggcatgcctatgagggcagcagcagcggcaacagcagccctgagtaccccaggaaggagtttgccagcagcagcacccggggccgcagccagacccgggagagcgagatccgggtgcggctgcagagcgccagccccagcacccgctggacagagctggatgatgtgaagaggctgctgaagggcagccgcagcgcctctgtgagccccaccaggaacagcagcaacaccctgcccatccccaagaagggcaccgtggagaccaagatcgtgacagccagcagccagagcgtgtctggcacctatgatgccaccatcctggatgccaacctgcccagccacgtgtggagcagcaccctgcctgctggcagctccatgggcacctaccacaacaacatgaccacccagagcagcagcctgctgaacaccaatgcctacagcgctggctctgtgtttggagtgcccaacaacatggccagctgcagccccaccctgcaccctggcctgagcaccagcagctctgtgtttggcatgcagaacaacctggcccccagcctgaccaccctgagccacggcaccaccaccaccagcacagcctatggagtgaagaagaacatgccccagagccctgctgctgtgaacacaggagtgtccaccagcgctgcctgcaccacctctgtgcagagtgatgacctgctgcacaaggactgcaagttcctgatcctggagaaggacaacaccccagccaagaaggagatggagctgctgatcatgaccaaggacagcggcaaggtgttcaccgccagccctgccagcattgctgccaccagcttcagcgaggacaccctgaagaaggagaagcaggccgcctacaatgctgacagcggcctgaaggccgaggccaatggagacctgaagacagtgtccaccaagggcaagaccaccacagctgacatccacagctatggcagcagcggcggcggcggcagcggcggcggcggcggcgtgggcggggccggcggcggcccctggggccctgccccagcctggtgcccctgtggcagctgctgctcctggtggaagtggctgctgggcctgctgctgacctggctgctgctgctgggcctgctgtttggcctcatcgccctggccgaggaggtgaggaagctgaaggcccgggtggatgagctggagcgcatccgccgcagcatcctgccctacggggacagcatggacagaattgagaaggaccggctgcagggcatggccccagctgctggagctgacctggacaagattggcctgcacagcgacagccaggaggagctgtggatgtttgtgaggaagaagctgatgatggagcaggagaatggaaacctgcggggcagccctggccccaagggggacatgggcagccctggccccaagggggaccggggcttccctggcaccccaggcatccctggccccctgggccaccctggcccccagggccccaagggccagaagggctctgtgggggaccccggcatggagggccccatgggccagaggggccgggagggccccatgggccccagaggagaggccggccccccaggcagcggggagaagggggagagaggagctgctggggagcccggcccccacggccccccaggagtgcccggctctgtgggccccaagggcagcagcggcagccctggcccccagggccccccaggccctgtgggcctgcagggcctgcggggggaggtgggcctgcccggggtgaagggggacaagggccccatgggccccccaggccccaagggggaccagggcgagaagggcccccggggcctgactggagagcccggcatgaggggcctgcccggggctgtgggggagcccggggccaagggggccatgggccctgctggcccagatggccaccagggccccagaggagagcagggcctgaccggcatgcctggcatccggggccccccaggccccagcggggaccccgggaagccaggcctgaccggcccccagggcccccagggcctgcccggcaccccaggccggcccggcatcaagggggagcccggggcccctgggaagatcgtgaccagcgagggcagctccatgctgactgtgcccggccccccaggccccccaggggccatgggccccccaggccccccaggggcccctggccctgctggccctgctggcctgcccggccaccaggaggtgctgaacctgcagggccccccaggccccccaggcccccggggccccccaggccccagcatccctggccccccaggcccccggggccccccaggagagggcctgcccggccccccaggccccccaggcagcttcctgagcaacagcgagaccttcctgagcggccccccaggccccccaggccccccaggccccaagggggaccagggccccccaggcccccggggccaccagggcgagcagggcctgcccggcttcagcaccagcggcagcagcagctttggcctgaacctgcagggccccccaggccccccaggcccccagggccccaagggggacaagggggaccccggggtgcctggggccctgggcatccccagcggccccagcgagggcggcagcagcagcaccatgtatgtgtctggccccccaggccccccaggccccccaggccccccaggcagcatcagcagcagcggccaggagatccagcagtacatcagcgagtacatgcagagcgacagcatccgcagctacctgagcggcgtgcagggccccccaggccccccaggccccccaggccctgtgaccaccatcactggagagacctttgactacagcgagctggccagccacgtggtgtcctacctgcggaccagcggctatggagtgtccctcttcagcagcagcatcagcagcgaggacatcctggccgtgctgcagagagatgatgtgcggcagtacctgcggcagtacctgatgggcccccggggccccccaggccccccaggggccagcggagatggcagcctgctgagcctggactatgcagagctgagcagccgcatcctgagctacatgagcagcagcggcatcagcatcggcctgcccggccccccaggccccccaggcctgcccggcaccagctatgaggagctgctgagcctgctgcggggcagcgagttccggggcatcgtgggccccccaggccccccaggccccccaggcatccctggaaatgtgtggagcagcatctctgtggaggacctgagcagctacctgcacacagctggcctgtccttcatccctggccccccaggccccccaggccccccaggcccccggggccccccaggagtgtctggggccctggccacctatgctgctgaaaattctgacagcttccgctctgagctgatctcctacctgaccagcccagatgtgcgctccttcatcgtgggccccccaggccccccaggcccccagggccccccaggggacagccggctgctgagcacagatgccagccacagccggggcagcagcagcagcagccacagcagctctgtgcggcggggcagcagctacagcagctccatgagcactggaggcggcggggccggcagcctgggcgccggcggggcctttggagaggccgccggggaccggggcccctatggaacagacatcggccctgggggcggctatggagctgctgctgagggcggcatgtatgctggaaatggaggcctgctgggcgctgactttgctggggacctggactacaatgagctggccgtgcgggtgtctgagagcatgcagaggcagggcctgctgcagggcatggcctacacagtgcagggccccccaggccagcccggcccccagggccccccaggcatcagcaaggtgttttctgcctacagcaatgtgacagctgacctgatggacttcttccagacctatggagccatccagggccccccaggccagaagggggagatgggcaccccaggccccaagggggaccggggccctgctggccccccaggccaccctggccccccaggcccccggggccacaagggggagaagggggacaagggggaccaggtgtatgccggcagaagaagaagaagaagcattgctgtgaagccctag

SEQ ID NO: 3369 - DNA, 1254 bp, Artificial Sequence
  Description of Artificial Sequence: Synthetic coding sequence
atggatgtgaccaagaagaacaagagagatggaacagaggtgacagagcgcatcgtgacagagaccgtgaccacccggctgaccagcctgccccccaagggcggcaccagcaatggctacgccaagacagccagcctgggcggcggcagccggctggagaagcagagcctgacccacggcagcagcggctacatcaacagcacaggcagcacccggggccacgccagcaccagcagctacagaagagcccacagccctgccagcaccctgcccaacagccctggcagcacctttgagaggaagacccacgtgaccaggcatgcctatgagggcagcagcagcggcaacagcagccctgagtaccccaggaaggagtttgccagcagcagcacccggggccgcagccagacccgggagagcgagatccgggtgcggctgcagagcgccagccccagcacccgctggacagagctggatgatgtgaagaggctgctgaagggcagccgcagcgcctctgtgagccccaccaggaacagcagcaacaccctgcccatccccaagaagggcaccgtggagaccaagatcgtgacagccagcagccagagcgtgtctggcacctatgatgccaccatcctggatgccaacctgcccagccacgtgtggagcagcaccctgcctgctggcagctccatgggcacctaccacaacaacatgaccacccagagcagcagcctgctgaacaccaatgcctacagcgctggctctgtgtttggagtgcccaacaacatggccagctgcagccccaccctgcaccctggcctgagcaccagcagctctgtgtttggcatgcagaacaacctggcccccagcctgaccaccctgagccacggcaccaccaccaccagcacagcctatggagtgaagaagaacatgccccagagccctgctgctgtgaacacaggagtgtccaccagcgctgcctgcaccacctctgtgcagagtgatgacctgctgcacaaggactgcaagttcctgatcctggagaaggacaacaccccagccaagaaggagatggagctgctgatcatgaccaaggacagcggcaaggtgttcaccgccagccctgccagcattgctgccaccagcttcagcgaggacaccctgaagaaggagaagcaggccgcctacaatgctgacagcggcctgaaggccgaggccaacgggaagaacaagtatgactgctgccccccatag

SEQ ID NO: 3370 - DNA, 201 bp, Artificial Sequence
  Description of Artificial Sequence: Synthetic coding sequence
tgatatggagccatccagggccccccaggccagaagggggagatgggcaccccaggccccaagggggaccggggccctgctggccccccaggccaccctggccccccaggcccccggggccacaagggggagaagggggacaagggggaccaggtgtatgccggcagaagaagaagaagaagcattgctgtgaagccctag

SEQ ID NO: 3371 - DNA, 1815 bp, Artificial Sequence
  Description of Artificial Sequence: Synthetic coding sequence
atggatgtgaccaagaagaacaagagagatggaacagaggtgacagagcgcatcgtgacagagaccgtgaccacccggctgaccagcctgccccccaagggcggcaccagcaatggctacgccaagacagccagcctgggcggcggcagccggctggagaagcagagcctgacccacggcagcagcggctacatcaacagcacaggcagcacccggggccacgccagcaccagcagctacagaagagcccacagccctgccagcaccctgcccaacagccctggcagcacctttgagaggaagacccacgtgaccaggcatgcctatgaggccagcagcagcacccggggccgcagccagacccgggagagcgagatccgggtgcggctgcagagcgccagccccagcacccgctggacagagctggatgatgtgaagaggctgctgaagggcagccgcagcgcctctgtgagccccaccaggaacagcagcaacaccctgcccatccccaagaagggcaccgtggagaccaagatcgtgacagccagcagccagagcgtgtctggcacctatgatgccaccatcctggatgccaacctgcccagccacgtgtggagcagcaccctgcctgctggcagctccatgggcacctaccacaacaacatgaccacccagagcagcagcctgctgaacaccaatgcctacagcgctggctctgtgtttggagtgcccaacaacatggccagctgcagccccaccctgcaccctggcctgagcaccagcagctctgtgtttggcatgcagaacaacctggcccccagcctgaccaccctgagccacggcaccaccaccaccagcacagcctatggagtgaagaagaacatgccccagagccctgctgctgtgaacacaggagtgtccaccagcgctgcctgcaccacctctgtgcagagtgatgacctgctgcacaaggactgcaagttcctgatcctggagaaggacaacaccccagccaagaaggagatggagctgctgatcatgaccaaggacagcggcaaggtgttcaccgccagccctgccagcattgctgccaccagcttcagcgaggacaccctgaagaaggagaagcaggccgcctacaatgctgacagcggcctgaaggccgaggccaatggagacctgaagacagtgtccaccaagggcaagaccaccacagctgacatccacagctatggcagcagcggcggcggcggcagcggcggcggcggcggcgtgggcggggccggcggcggcccctggggccctgccccagcctggtgcccctgtggcagctgctgctcctggtggaagtggctgctgggcctgctgctgacctggctgctgctgctgggcctgctgtttggcctcatcgccctggccgaggaggtgaggaagctgaaggcccgggtggatgagctggagcgcatccgccgcagcatcctgccctacggggacagcatggacagaattgagaaggaccggctgcagggcatggccccagctgctggagctgacctggacaagattggcctgcacagcgacagccaggaggagctgtggatgtttgtgaggaagaagctgatgatggagcaggagaatggaaacctgcggggcagccctggccccaagggggacatgggcagccctggccccaagggggaccggggcttccctggcaccccaggcatccctggccccctgggccaccctggcccccagggccccaagggccagaagggctctgtgggggaccccggcatggagggccccatgtag

SEQ ID NO: 3372 - DNA, 3951 bp, Artificial Sequence
  Description of Artificial Sequence: Synthetic coding sequence
atgagcagcggggaccctgcccacctgggcctgtgcctgtggctgtggctgggcgccaccctgggccgggagcaggtgcaggccagcggcctgctgcggctggccgtgctgcctgaagatcggctgcagatgaagtggagggagagcgagggcagcggcctgggctacctggtgcaggtgaagcccatggccggggacagcgagcaggaggtgatcctgaccaccaagacccccaaggccaccgtgggcggcctgagccccagcaagggctacaccctgcagatctttgagctgactggaagtggccgcttcctgctggcccggcgggagtttgtgattgaggacctgaagagcagcagcctggacaggagcagccagaggcccctgggcagcggggcccctgagcccacccccagccacacaggcagcccagaccctgagcaggccagcgagccccaggtggccttcacccccagccaggaccccaggaccccagctggcccccagttccgctgcctgccccctgtgcctgctgacatggtgttcctggtggatggctcctggagcatcggccacagccacttccagcaggtgaaggacttcctggccagcgtcatcgccccctttgaaattggaccagacaaggtgcaggtgggcctgacccagtacagcggagatgcccagacagagtgggacctgaacagcctgagcaccaaggagcaggtgctggccgctgtgcggcggctgcgctacaagggcggcaacaccttcaccggcctggccctgacccacgtgctgggccagaacctgcagcctgctgctggcctgcggcctgaggccgccaaggtggtgatcctggtgacagatggcaagagccaggatgatgtgcacacagctgcccgggtgctgaaggacctgggcgtgaatgtgtttgctgtgggcgtgaagaatgctgatgaagctgagctgcggctgctggccagccccccccgggacatcaccgtgcacagcgtgctggacttcctgcagctgggcgccctggccggcctgctgagccgcctcatctgccagaggctgcagggcggcagcccccggcagggccctgctgctgccccagccctggacaccctgcctgcccccaccagcctggtgctgagccaggtgaccagcagcagcatccggctgtcctggaccccagcccccaggcaccccctgaagtacctgattgtgtggagggccagccggggcggcaccccccgggaggtggtggtggagggccctgctgccagcacagagctgcacaacctggccagcaggacagagtacctggtgtctgtgttccccatctatgagggcggcgtgggggagggcctgcggggcctggtgaccacagcccccctgcccccaccccgggccctgaccctggccgctgtgacccccaggacagtgcacctgacctggcagcccagcgctggggccacccactacctggtgcgctgcagccctgccagccccaagggggaggaggaggagcgggaggtgcaggtgggccggcctgaggtgctgctggatggcctggagcccggccgggactatgaggtgtctgtgcagagcctgcggggccctgagggcagcgaggcccggggcatccgggcccggacccccaccctggccccacccaggcacctgggcttcagtgatgtgtcccatgatgctgcccgggtcttctgggagggcgcccccaggcctgtgcggctggtgcgggtgacctacgtgagcagcgagggcggccacagcggccagacagaggcccctggaaatgccaccagcgccaccctgggccccctgagcagcagcaccacctacacagtgcgggtgacctgcctgtacccaggcggcggcagcagcaccctgaccggccgggtgaccaccaagaaggcccccagccccagccagctgtccatgacagagctgcctggagatgctgtgcagctggcctgggtggccgccgcccccagcggcgtgctggtgtaccagatcacctggacccccctgggggagggcaaggcccacgagatctctgtgcccggcaacctgggcacagctgtgctgcccggcctgggccgccacacagaatatgatgtgaccatcctggcctactacagagatggagcccggagtgaccctgtgtccctgcgctacacccccagcacagtgagccgcagcccccccagcaacctggccctggccagcgagaccccagacagcctgcaggtgtcctggaccccacccctgggccgggtgctgcactactggctgacctacgccccagccagcggcctgggccctgagaagtctgtgtctgtgcctggggcccggagccacgtgaccctgcctgacctgcaggccgccaccaagtacagagtgctggtgtctgccatctatgctgctggccgctctgaggccgtgtctgccaccggccagacagcctgcccagccctgcggccagatggcagcctgcccggctttgacctgatggtggccttcagcctggtggagaaggcctatgccagcatccggggcgtggccatggagcccagcgcctttggaggcacccccaccttcaccctcttcaaggatgcccagctgaccaggagagtgtctgatgtgtacccagcccccctgcccccagagcacaccatcgtgttcctggtgcggctgctgcctgagaccccccgggaggcctttgccctgtggcagatgacagctgaggacttccagcccctgctgggcgtgctgctggatgctgggaagaagagcctgacctacttccaccgggacccccgggccgccctgcaggaggccacctttgacccccaggaggtgaggaagatcttcttcggcagcttccacaaggtgcacgtggccgtgggccgcagcaaggtgcggctgtatgtggactgcaggaaggtggccgagcggcccctgggggagatgggcagccccccagctgctggctttgtgaccctgggccgcctggccaaggcccggggccccaggagcagcagcgctgccttccagctgcagatgctgcagatcgtgtgcagcgacacctgggcagatgaggaccgctgctgtgagctgcctgccagcagagatggagagacctgcccagcctttgtgtctgcctgcagctgcagcagcgagaccccaggccccccaggcccccagggccccccaggcctgcctggaagaaatggcaccccaggagagcagggcttccctggccccagaggagagcccggccccccaggccagatgggccctgagggccctgggggccagcagggcagccctggcacccagggccgggctgtgcagggccctgtgggccccccaggagtgaagggggagaagggggaccacggcctgcccggcctgcagggccaccctggccaccagggcatccctggccgggtgggcctgcagggccccaagggcatgaggggcctggagggcacagctggcctgcccggccccccaggcccccggggcttccagggcatggccggggcccggggcaccagcggggagcggggccccccaggcaccgtgggccccaccggcctgcccggccccaagggggagcggggggagaagggggagccccagagcctggccaccctgtaccagctggtgtcccaggccagccacgtgtccaagtttgacagcttccacgagaacaccaggcctcccatgcccatcctggagcagaagctggagcccggcacagagcccctgggcagccctggcaccaggagcaaggccctggtgcctggagagtggggccggggcggccgccacctggagggccgcggggagcctggagctgtgggccagatgggcagccctggccagcagggcgccagcacccagggcctgtgggagtag

SEQ ID NO: 3373 - DNA, 3855 bp, Artificial Sequence
  Description of Artificial Sequence: Synthetic coding sequence
atgagcagcggggaccctgcccacctgggcctgtgcctgtggctgtggctgggcgccaccctgggccgggagcaggtgcaggccagcggcctgctgcggctggccgtgctgcctgaagatcggctgcagatgaagtggagggagagcgagggcagcggcctgggctacctggtgcaggtgaagcccatggccggggacagcgagcaggaggtgatcctgaccaccaagacccccaaggccaccgtgggcggcctgagccccagcaagggctacaccctgcagatctttgagctgactggaagtggccgcttcctgctggcccggcgggagtttgtgattgaggacctgaagagcagcagcctggacaggagcagccagaggcccctgggcagcggggcccctgagcccacccccagccacacaggcagcccagaccctgagcaggccagcgagccccaggtggccttcacccccagccaggaccccaggaccccagctggcccccagttccgctgcctgccccctgtgcctgctgacatggtgttcctggtggatggctcctggagcatcggccacagccacttccagcaggtgaaggacttcctggccagcgtcatcgccccctttgaaattggaccagacaaggtgcaggtgggcctgacccagtacagcggagatgcccagacagagtgggacctgaacagcctgagcaccaaggagcaggtgctggccgctgtgcggcggctgcgctacaagggcggcaacaccttcaccggcctggccctgacccacgtgctgggccagaacctgcagcctgctgctggcctgcggcctgaggccgccaaggtggtgatcctggtgacagatggcaagagccaggatgatgtgcacacagctgcccgggtgctgaaggacctgggcgtgaatgtgtttgctgtgggcgtgaagaatgctgatgaagctgagctgcggctgctggccagccccccccgggacatcaccgtgcacagcgtgctggacttcctgcagctgggcgccctggccggcctgctgagccgcctcatctgccagaggctgcagggcggcagcccccggcagggccctgctgctgccccagccctggacaccctgcctgcccccaccagcctggtgctgagccaggtgaccagcagcagcatccggctgtcctggaccccagcccccaggcaccccctgaagtacctgattgtgtggagggccagccggggcggcaccccccgggaggtggtggtggagggccctgctgccagcacagagctgcacaacctggccagcaggacagagtacctggtgtctgtgttccccatctatgagggcggcgtgggggagggcctgcggggcctggtgaccacagcccccctgcccccaccccgggccctgaccctggccgctgtgacccccaggacagtgcacctgacctggcagcccagcgctggggccacccactacctggtgcgctgcagccctgccagccccaagggggaggaggaggagcgggaggtgcaggtgggccggcctgaggtgctgctggatggcctggagcccggccgggactatgaggtgtctgtgcagagcctgcggggccctgagggcagcgaggcccggggcatccgggcccggacccccaccctggccccacccaggcacctgggcttcagtgatgtgtcccatgatgctgcccgggtcttctgggagggcgcccccaggcctgtgcggctggtgcgggtgacctacgtgagcagcgagggcggccacagcggccagacagaggcccctggaaatgccaccagcgccaccctgggccccctgagcagcagcaccacctacacagtgcgggtgacctgcctgtacccaggcggcggcagcagcaccctgaccggccgggtgaccaccaagaaggcccccagccccagccagctgtccatgacagagctgcctggagatgctgtgcagctggcctgggtggccgccgcccccagcggcgtgctggtgtaccagatcacctggacccccctgggggagggcaaggcccacgagatctctgtgcccggcaacctgggcacagctgtgctgcccggcctgggccgccacacagaatatgatgtgaccatcctggcctactacagagatggagcccggagtgaccctgtgtccctgcgctacacccccagcacagtgagccgcagcccccccagcaacctggccctggccagcgagaccccagacagcctgcaggtgtcctggaccccacccctgggccgggtgctgcactactggctgacctacgccccagccagcggcctgggccctgagaagtctgtgtctgtgcctggggcccggagccacgtgaccctgcctgacctgcaggccgccaccaagtacagagtgctggtgtctgccatctatgctgctggccgctctgaggccgtgtctgccaccggccagacagcctgcccagccctgcggccagatggcagcctgcccggctttgacctgatggtggccttcagcctggtggagaaggcctatgccagcatccggggcgtggccatggagcccagcgcctttggaggcacccccaccttcaccctcttcaaggatgcccagctgaccaggagagtgtctgatgtgtacccagcccccctgcccccagagcacaccatcgtgttcctggtgcggctgctgcctgagaccccccgggaggcctttgccctgtggcagatgacagctgaggacttccagcccctgctgggcgtgctgctggatgctgggaagaagagcctgacctacttccaccgggacccccgggccgccctgcaggaggccacctttgacccccaggaggtgaggaagatcttcttcggcagcttccacaaggtgcacgtggccgtgggccgcagcaaggtgcggctgtatgtggactgcaggaaggtggccgagcggcccctgggggagatgggcagccccccagctgctggctttgtgaccctgggccgcctggccaaggcccggggccccaggagcagcagcgctgccttccagctgcagatgctgcagatcgtgtgcagcgacacctgggcagatgaggaccgctgctgtgagctgcctgccagcagagatggagagacctgcccagcctttgtgtctgcctgcagctgcagcagcgagaccccaggccccccaggcccccagggccccccaggcctgcctggaagaaatggcaccccaggagagcagggcttccctggcccccggggccccccaggagtgaagggggagaagggggaccacggcctgcccggcctgcagggccaccctggccaccagggcatccctggccgggtgggcctgcagggccccaagggcatgaggggcctggagggcacagctggcctgcccggccccccaggcccccggggcttccagggcatggccggggcccggggcaccagcggggagcggggccccccaggcaccgtgggccccaccggcctgcccggccccaagggggagcggggggagaagggggagccccagagcctggccaccctgtaccagctggtgtcccaggccagccacgtgtccaagtttgacagcttccacgagaacaccaggcctcccatgcccatcctggagcagaagctggagcccggcacagagcccctgggcagccctggcaccaggagcaaggccctggtgcctggagagtggggccggggcggccgccacctggagggccgcggggagcctggagctgtgggccagatgggcagccctggccagcagggcgccagcacccagggcctgtgggagtag

SEQ ID NO: 3374 - DNA, 3894 bp, Artificial Sequence
  Description of Artificial Sequence: Synthetic coding sequence
atgagcagcggggaccctgcccacctgggcctgtgcctgtggctgtggctgggcgccaccctgggccgggagcaggtgcaggccagcggcctgctgcggctggccgtgctgcctgaagatcggctgcagatgaagtggagggagagcgagggcagcggcctgggctacctggtgcaggtgaagcccatggccggggacagcgagcaggaggtgatcctgaccaccaagacccccaaggccaccgtgggcggcctgagccccagcaagggctacaccctgcagatctttgagctgactggaagtggccgcttcctgctggcccggcgggagtttgtgattgaggacctgaagagcagcagcctggacaggagcagccagaggcccctgggcagcggggcccctgagcccacccccagccacacaggcagcccagaccctgagcaggccagcgagccccaggtggccttcacccccagccaggaccccaggaccccaggcggcagcgagtggagggagaccggcccccagttccgctgcctgccccctgtgcctgctgacatggtgttcctggtggatggctcctggagcatcggccacagccacttccagcaggtgaaggacttcctggcctctgtgattgccccctttgagatcggccctgacaaggtgcaggtgggcctgacccagtacagcggagatgcccagacagagtgggacctgaacagcctgagcaccaaggagcaggtgctggccgctgtgcggcggctgcgctacaagggcggcaacaccttcaccggcctggccctgacccacgtgctgggccagaacctgcagcctgctgctggcctgcggcctgaggccgccaaggtggtgatcctggtgacagatggcaagagccaggatgatgtgcacacagctgcccgggtgctgaaggacctgggcgtgaatgtgtttgctgtgggcgtgaagaatgctgatgaggccgagctgcggctgctggccagccccccccgggacatcaccgtgcacagcgtgctggacttcctgcagctgggcgccctggccggcctgctgagccgcctcatctgccagaggctgcagggcggcagcccccggcagggccctgctgctgccccagccctggacaccctgcctgcccccaccagcctggtgctgagccaggtgaccagcagcagcatccggctgtcctggaccccagcccccaggcaccccctgaagtacctgattgtgtggagggccagcagaggaggcaccccccgggaggtggtggtggagggccctgctgccagcacagagctgcacaacctggccagcaggacagagtacctggtgtctgtgttccccatctatgaaggaggagtgggggagggcctgcggggcctggtgaccacagcccccctgcccccaccccgggccctgaccctggccgctgtgacccccaggacagtgcacctgacctggcagcccagcgctggggccacccactacctggtgcgctgcagccctgccagccccaagggggaggaggaggagcgggaggtgcaggtgggccggcctgaggtgctgctggatggcctggagcccggccgggactatgaggtgtctgtgcagagcctgcggggccctgagggcagcgaggcccggggcatccgggcccggacccccaccctggccccacccaggcacctgggcttcagtgatgtgtcccatgatgctgcccgggtcttctgggagggcgcccccaggcctgtgcggctggtgcgggtgacctacgtgtcctctgagggcggccacagcggccagacagaggcccctggaaatgccaccagcgccaccctgggccccctgagcagcagcaccacctacacagtgcgggtgacctgcctgtacccaggcggcggcagcagcaccctgaccggccgggtgaccaccaagaaggcccccagccccagccagctgtccatgacagagctgcctggagatgctgtgcagctggcctgggtggccgccgcccccagcggcgtgctggtgtaccagatcacctggacccccctgggggagggcaaggcccacgagatctctgtgcccggcaacctgggcacagctgtgctgcccggcctgggccgccacacagaatatgatgtgaccatcctggcctactacagagatggagcccggagtgaccctgtgtccctgcgctacacccccagcacagtgagccgcagcccccccagcaacctggccctggccagcgagaccccagacagcctgcaggtgtcctggaccccacccctgggccgggtgctgcactactggctgacctacgccccagccagcggcctgggccctgagaagtctgtgtctgtgcctggggcccggagccacgtgaccctgcctgacctgcaggccgccaccaagtacagagtgctggtgtctgccatctatgctgctggccgctctgaggccgtgtctgccaccggccagacagcctgcccagccctgcggccagatggcagcctgcccggctttgacctgatggtggccttcagcctggtggagaaggcctatgccagcatccggggcgtggccatggagcccagcgccttcggcggcacccccaccttcaccctcttcaaggatgcccagctgacccggcgggtgtctgatgtgtacccagcccccctgcccccagagcacaccatcgtgttcctggtgcggctgctgcctgagaccccccgggaggcctttgccctgtggcagatgacagctgaggacttccagcccctgctgggcgtgctgctggatgctgggaagaagagcctgacctacttccaccgggaccccagggctgccctgcaggaggccacctttgacccccaggaggtgaggaagatcttcttcggcagcttccacaaggtgcacgtggccgtgggccgcagcaaggtgcggctgtatgtggactgcaggaaggtggccgagcggcccctgggggagatgggcagccccccagctgctggctttgtgaccctgggccgcctggccaaggcccggggccccaggagcagcagcgctgccttccagctgcagatgctgcagatcgtgtgcagcgacacctgggcagatgaagatcgctgctgtgagctgcctgccagcagagatggagagacctgcccagcctttgtgtctgcctgcagctgcagcagcgagaccccaggccccccaggcccccagggccccccaggcctgcccggcagaaatggcaccccaggagagcagggcttccctggcccccggggccccccaggagtgaagggggagaagggggaccacggcctgcccggcctgcagggccaccctggccaccagggcatccctggccgggtgggcctgcagggccccaagggcatgaggggcctggagggcacagctggcctgcccggccccccaggcccccggggcttccagggcatggccggggcccggggcaccagcggggagcggggccccccaggcaccgtgggccccaccggcctgcccggccccaagggggagcggggggagaagggggagccccagagcctggccaccctgtaccagctggtgtcccaggcctgtgagagcgccatccagacccacgtgtccaagtttgacagcttccacgagaacacccggccccccatgcccatcctggagcagaagctggagcctggaacagagcccctgggcagccctggcaccaggagcaaggccctggtgcctggagagtggggccggggcggccgccacctggagggccgcggggagcccggggctgtgggccagatgggcagccctggccagcagggcgccagcacccagggcctgtgggagtag

SEQ ID NO: 3375 - DNA, 3894 bp, Artificial Sequence; identical to SEQ ID NO: 3374
  Description of Artificial Sequence: Synthetic coding sequence

SEQ ID NO: 3376 - DNA, 2874 bp, Artificial Sequence
  Description of Artificial Sequence: Synthetic coding sequence
atggcccactacatcaccttcctgtgcatggtgctggtgctgctgctgcagaacagcgtgctggctgaagatggagaggtgcgcagcagctgcaggacagcccccacagacctggtgttcatcctggatggcagctacagcgtgggcccagaaaattttgaaattgtgaagaagtggctggtgaacatcaccaagaactttgatattggccccaagttcatccaggtgggcgtggtgcagtacagcgactaccctgtgctggagatccccctgggcagctatgacagcggggagcacctgacagctgctgtggagagcatcctgtacctgggcggcaacaccaagacaggcaaggccatccagtttgccctggactacctgtttgccaagagcagccgcttcctgaccaagattgctgtggtgctgacagatggcaagagccaggatgatgtgaaggatgctgcccaggccgcccgggacagcaagatcaccctgtttgccatcggcgtgggcagcgagacagaagatgctgagctgcgggccatcgccaacaagcccagcagcacctacgtgttctacgtggaggactacatcgccatcagcaagatccgggaggtgatgaagcagaagctgtgtgaggagagcgtgtgccccacccgcatccctgtggccgccagagatgagcggggctttgacatcctgctgggcctggatgtgaacaagaaggtgaagaagaggatccagctgagccccaagaagatcaagggctatgaggtgaccagcaaggtggacctgtctgagctgaccagcaatgtgtttcctgagggcctgccccccagctatgtgtttgtgtccacccagcgcttcaaggtgaagaagatctgggacctgtggaggatcctgaccattgatggccggccccagattgctgtgaccctgaatggagtggacaagatcctgctcttcaccaccaccagcgtcatcaatggcagccaggtggtgacctttgccaacccccaggtgaagaccctgtttgatgagggctggcaccagatccggctgctggtgacagagcaggatgtgaccctgtacattgatgaccagcagatcgagaacaagcccctgcaccctgtgctgggcatcctgatcaatggccagacccagatcggcaagtacagcggcaaggaggagaccgtgcagtttgatgtgcagaagctgcgcatctactgtgaccctgagcagaacaaccgggagacagcctgtgagatccctggcttcaatggagaatgtctgaatggccccagtgatgtgggcagcaccccagccccctgcatctgccccccaggcaagccaggcctgcagggccccaagggggaccccggcctgcccggcaaccctggctacccaggccagcccggccaggacggcaagccaggctaccagggcattgctggcaccccaggagtgcccggcagccctggcatccagggcgcccggggcctgcccggctacaagggggagcccggcagagatggagacaagggggaccggggcctgcccggcttccctggcctgcacggcatgcctggcagcaagggggagatgggcgccaagggggacaagggcagccctggcttctacggcaagaagggggccaagggggagaagggaaatgccggcttccctggcctgcccggccctgctggggagcccggccgccacggcaaggatggcctgatgggcagccctggcttcaagggggaggccggcagccctggggcccctggccaggacggcaccagaggagagcccggcatccctggcttccctggcaacagaggcctgatgggccagaagggggagatcggccccccaggccagcagggcaagaagggggcccctggcatgcctggcctgatgggcagcaatggcagccctggccagcccggcaccccaggcagcaagggcagcaagggggagcccggcatccagggcatgcctggggccagcggcctgaagggggagcccggggccaccggcagccctggagagcccggctacatgggcctgcccggcatccagggcaagaagggggacaagggcaaccagggcgagaagggcatccagggccagaagggggagaatggccggcagggcatccctggccagcagggcatccagggccaccacggggccaagggggagcggggggagaagggggagcccggggtgcggggggccatcggcagcaaaggagagagcggcgtggatggcctgatgggccctgctggccccaagggccagcccggggaccccggcccccagggccccccaggcctggatggcaagccaggccgggagttcagcgagcagttcatccggcaggtgtgcacagatgtgatccgggcccagctgcctgtgctgctgcagagcggccgcatccggaactgtgaccactgcctgagccagcacggcagccctggcatccctggccccccaggccccatcggccctgagggcccccggggcctgcccggcctgcccggcagagatggagtgcccggcctggtgggcgtgcccggccggcctggggtgcggggcctgaagggcctgcccggcagaaatggagagaagggcagccagggcttcggctacccaggagagcagggccccccaggccccccaggccctgagggccccccaggcatcagcaaggagggccccccaggggaccccggcctgcccgggaaggatggagaccacggcaagccaggcatccagggccagcccggccccccaggcatctgtgaccccagcctgtgcttctctgtgattgcccggcgggaccccttcaggaagggccccaactactag

SEQ ID NO: 3377 - DNA, 972 bp, Artificial Sequence
  Description of Artificial Sequence: Synthetic coding sequence
atgattgccagcggcatccctggcttccctggcaacagaggcctgatgggccagaagggggagatcggccccccaggccagcagggcaagaagggggcccctggcatgcctggcctgatgggcagcaatggcagccctggccagcccggcaccccaggcagcaagggcagcaagggggagcccggcatccagggcatgcctggggccagcggcctgaagggggagcccggggccaccggcagccctggagagcccggctacatgggcctgcccggcatccagggcaagaagggggacaagggcaaccagggcgagaagggcatccagggccagaagggggagaatggccggcagggcatccctggccagcagggcatccagggccaccacggggccaagggggagcggggggagaagggggagcccggggtgcggggggccatcggcagcaaaggagagagcggcgtggatggcctgatgggccctgctggccccaagggccagcccggggaccccggcccccagggccccccaggcctggatggcaagccaggccgggagttcagcgagcagttcatccggcaggtgtgcacagatgtgatccggggccctgagggcccccggggcctgcccggcctgcccggcagagatggagtgcccggcctggtgggcgtgcccggccggcctggggtgcggggcctgaagggcctgcccggcagaaatggagagaagggcagccagggcttcggctacccaggagagcagggccccccaggccccccaggccctgagggccccccaggcatcagcaaggagggccccccaggggaccccggcctgcccgggaaggatggagaccacggcaagccaggcatccagggccagcccggccccccaggcatctgtgaccccagcctgtgcttctctgtgattgcccggcgggaccccttcaggaagggccccaactactag

SEQ ID NO: 3378 - DNA, 2865 bp, Artificial Sequence
  Description of Artificial Sequence: Synthetic coding sequence
atggcccactacatcaccttcctgtgcatggtgctggtgctgctgctgcagaacagcgtgctggctgaagatggagaggtgcgcagcagctgcaggacagcccccacagacctggtgttcatcctggatggcagctacagcgtgggcccagaaaattttgaaattgtgaagaagtggctggtgaacatcaccaagaactttgatattggccccaagttcatccaggtgggcgtggtgcagtacagcgactaccctgtgctggagatccccctgggcagctatgacagcggggagcacctgacagctgctgtggagagcatcctgtacctgggcggcaacaccaagacaggcaaggccatccagtttgccctggactacctgtttgccaagagcagccgcttcctgaccaagattgctgtggtgctgacagatggcaagagccaggatgatgtgaaggatgctgcccaggccgcccgggacagcaagatcaccctgtttgccatcggcgtgggcagcgagacagaagatgctgagctgcgggccatcgccaacaagcccagcagcacctacgtgttctacgtggaggactacatcgccatcagcaagatccgggaggtgatgaagcagaagctgtgtgaggagagcgtgtgccccacccgcatccctgtggccgccagagatgagcggggctttgacatcctgctgggcctggatgtgaacaagaaggtgaagaagaggatccagctgagccccaagaagatcaagggctatgaggtgaccagcaaggtggacctgtctgagctgaccagcaatgtgtttcctgagggcctgccccccagctatgtgtttgtgtccacccagcgcttcaaggtgaagaagatctgggacctgtggaggatcctgaccattgatggccggccccagattgctgtgaccctgaatggagtggacaagatcctgctcttcaccaccaccagcgtcatcaatggcagccaggtggtgacctttgccaacccccaggtgaagaccctgtttgatgagggctggcaccagatccggctgctggtgacagagcaggatgtgaccctgtacattgatgaccagcagatcgagaacaagcccctgcaccctgtgctgggcatcctgatcaatggccagacccagatcggcaagtacagcggcaaggaggagaccgtgcagtttgatgtgcagaagctgcgcatctactgtgaccctgagcagaacaaccgggagacagcctgtgagatccctggcttctgcctgaatggccccagtgatgtgggcagcaccccagccccctgcatctgccccccaggcaagccaggcctgcagggccccaagggggaccccggcctgcccggcaaccctggctacccaggccagcccggccaggacggcaagccaggctaccagggcattgctggcaccccaggagtgcccggcagccctggcatccagggcgcccggggcctgcccggctacaagggggagcccggcagagatggagacaagggggaccggggcctgcccggcttccctggcctgcacggcatgcctggcagcaaaggagagatgggcgccaagggggacaagggcagccctggcttctacggcaagaagggggccaagggggagaagggaaatgccggcttccctggcctgcccggccctgctggggagcccggcagacatggcaaggatggcctgatgggcagccctggcttcaagggggaggccggcagccctggggcccctggccaggacggcaccagaggagagcccggcatccctggcttccctggcaacagaggcctgatgggccagaagggggagatcggccccccaggccagcagggcaagaagggggcccctggcatgcctggcctgatgggcagcaatggcagccctggccagcccggcaccccaggcagcaagggcagcaaaggagagcccggcatccagggcatgcctggggccagcggcctgaagggggagcccggggccaccggcagccctggagagcccggctacatgggcctgcccggcatccagggcaagaagggggacaagggcaaccagggcgagaagggcatccagggccagaagggagaaaatggccggcagggcatccctggccagcagggcatccagggccaccacggggccaagggggagcggggggagaagggggagcccggggtgcggggggccatcggcagcaagggggagagcggcgtggatggcctgatgggccctgctggccccaagggccagcccggggaccccggcccccagggccccccaggcctggatggcaagccaggccgggagttcagcgagcagttcatccggcaggtgtgcacagatgtgatccgggcccagctgcctgtgctgctgcagagcggccgcatccggaactgtgaccactgcctgagccagcacggcagccctggcatccctggccccccaggccccatcggccctgagggcccccggggcctgcccggcctgcccggcagagatggagtgcccggcctggtgggcgtgcccggccggcctggggtgcggggcctgaagggcctgcctggaagaaatggagagaagggcagccagggcttcggctacccaggagagcagggccccccaggccccccaggccctgagggccccccaggcatcagcaaggagggccccccaggggaccccggcctgcccgggaaggatggagaccacggcaagccaggcatccagggccagcccggccccccaggcatctgtgaccccagcctgtgcttcagcgtcatcgcccggcgggaccccttcaggaagggccccaactactag

SEQ ID NO: 3379 - DNA, 411 bp, Artificial Sequence
  Description of Artificial Sequence: Synthetic coding sequence
atggcccactacatcaccttcctgtgcatggtgctggtgctgctgctgcagaacagcgtgctggctgaagatggagaggtgcgcagcagctgcaggacagcccccacagacctggtgttcatcctggatggcagctacagcgtgggcccagaaaattttgaaattgtgaagaagtggctggtgaacatcaccaagaactttgatattggccccaagttcatccaggtgggcgtggtgcagtacagcgactaccctgtgctggagatccccctgggcagctatgacagcggggagcacctgacagctgctgtggagagcatcctgtacctgggcggcaacaccaagacaggcaaggccatccagtttgccctggactacctgtttgccaagagcagccgcttcctgacctag

SEQ ID NO: 3380 - DNA, 2865 bp, Artificial Sequence; identical to SEQ ID NO: 3378
  Description of Artificial Sequence: Synthetic coding sequence

SEQ ID NO: 3381 - DNA, 2874 bp, Artificial Sequence
  Description of Artificial Sequence: Synthetic coding sequence
atggcccactacatcaccttcctgtgcatggtgctggtgctgctgctgcagaacagcgtgctggctgaagatggagaggtgcgcagcagctgcaggacagcccccacagacctggtgttcatcctggatggcagctacagcgtgggcccagaaaattttgaaattgtgaagaagtggctggtgaacatcaccaagaactttgatattggccccaagttcatccaggtgggcgtggtgcagtacagcgactaccctgtgctggagatccccctgggcagctatgacagcggggagcacctgacagctgctgtggagagcatcctgtacctgggcggcaacaccaagacaggcaaggccatccagtttgccctggactacctgtttgccaagagcagccgcttcctgaccaagattgctgtggtgctgacagatggcaagagccaggatgatgtgaaggatgctgcccaggccgcccgggacagcaagatcaccctgtttgccatcggcgtgggcagcgagacagaagatgctgagctgcgggccatcgccaacaagcccagcagcacctacgtgttctacgtggaggactacatcgccatcagcaagatccgggaggtgatgaagcagaagctgtgtgaggagagcgtgtgccccacccgcatccctgtggccgccagagatgagcggggctttgacatcctgctgggcctggatgtgaacaagaaggtgaagaagaggatccagctgagccccaagaagatcaagggctatgaggtgaccagcaaggtggacctgtctgagctgaccagcaatgtgtttcctgagggcctgccccccagctatgtgtttgtgtccacccagcgcttcaaggtgaagaagatctgggacctgtggaggatcctgaccattgatggccggccccagattgctgtgaccctgaatggagtggacaagatcctgctcttcaccaccaccagcgtcatcaatggcagccaggtggtgacctttgccaacccccaggtgaagaccctgtttgatgagggctggcaccagatccggctgctggtgacagagcaggatgtgaccctgtacattgatgaccagcagatcgagaacaagcccctgcaccctgtgctgggcatcctgatcaatggccagacccagatcggcaagtacagcggcaaggaggagaccgtgcagtttgatgtgcagaagctgcgcatctactgtgaccctgagcagaacaaccgggagacagcctgtgagatccctggctttgtgatggagtgcctgaatggccccagtgatgtgggcagcaccccagccccctgcatctgccccccaggcaagccaggcctgcagggccccaagggggaccccggcctgcccggcaaccctggctacccaggccagcccggccaggacggcaagccaggctaccagggcattgctggcaccccaggagtgcccggcagccctggcatccagggcgcccggggcctgcccggctacaagggggagcccggcagagatggagacaagggggaccggggcctgcccggcttccctggcctgcacggcatgcctggcagcaagggggagatgggcgccaagggggacaagggcagccctggcttctacggcaagaagggggccaagggggagaagggaaatgccggcttccctggcctgcccggccctgctggggagcccggccgccacggcaaggatggcctgatgggcagccctggcttcaagggggaggccggcagccctggggcccctggccaggacggcaccagaggagagcccggcatccctggcttccctggcaacagaggcctgatgggccagaagggggagatcggccccccaggccagcagggcaagaagggggcccctggcatgcctggcctgatgggcagcaatggcagccctggccagcccggcaccccaggcagcaagggcagcaagggggagcccggcatccagggcatgcctggggccagcggcctgaagggggagcccggggccaccggcagccctggagagcccggctacatgggcctgcccggcatccagggcaagaagggggacaagggcaaccagggcgagaagggcatccagggccagaagggggagaatggccggcagggcatccctggccagcagggcatccagggccaccacggggccaagggggagcggggggagaagggggagcccggggtgcggggggccatcggcagcaaaggagagagcggcgtggatggcctgatgggccctgctggccccaagggccagcccggggaccccggcccccagggccccccaggcctggatggcaagccaggccgggagttcagcgagcagttcatccggcaggtgtgcacagatgtgatccgggcccagctgcctgtgctgctgcagagcggccgcatccggaactgtgaccactgcctgagccagcacggcagccctggcatccctggccccccaggccccatcggccctgagggcccccggggcctgcccggcctgcccggcagagatggagtgcccggcctggtgggcgtgcccggccggcctggggtgcggggcctgaagggcctgcccggcagaaatggagagaagggcagccagggcttcggctacccaggagagcagggccccccaggccccccaggccctgagggccccccaggcatcagcaaggagggccccccaggggaccccggcctgcccgggaaggatggagaccacggcaagccaggcatccagggccagcccggccccccaggcatctgtgaccccagcctgtgcttctctgtgattgcccggcgggaccccttcaggaagggccccaactactag

SEQ ID NO: 3382 - DNA, 4881 bp, Artificial Sequence
  Description of Artificial Sequence: Synthetic coding sequence
atggccggcctgcggggaaatgctgtggccggcctgctgtggatgctgctgctgtggagcggcggcggcggctgccaggcccagagagctggctgcaagtctgtgcactatgacctggtgttcctgctggacaccagcagctctgtgggcaaggaggactttgagaaggtgcggcagtgggtggccaacctggtggacacctttgaggtgggccctgacaggaccagggtgggcgtggtgcgctacagcgaccggcccaccacagcctttgagctgggcctgtttggcagccaggaggaggtgaaggccgccgcccggcggctggcctaccatggaggcaacaccaacacaggagatgccctgcgctacatcacagcccggagcttcagcccccatgctgggggccggccccgggaccgggcctacaagcaggtggccatcctgctgacagatggccgcagccaggacctggtgctggatgctgctgctgctgcccaccgggccggcatccgcatctttgctgtgggcgtgggggaggccctgaaggaggagctggaggagatcgccagcgagcccaagagcgcccacgtgttccacgtgtctgacttcaatgccatcgacaagatccggggcaagctgcggcggcggctgtgtgaaaatgtgctgtgccccagcgtgcgggtggagggggaccgcttcaagcacaccaatggaggcaccaaggagatcaccggctttgacctgatggacctcttctctgtgaaggagatcctgggcaagcgggagaatggagcccagagcagctatgtgaggatgggcagcttccctgtggtgcagagcacagaagatgtgttcccccagggcctgcctgatgaatatgcctttgtgaccaccttccgcttcaggaagaccagcaggaaggaggactggtacatctggcaggtgattgaccagtacagcatcccccaggtgtccatccggctggatggagagaacaaggctgtggagtacaatgctgtgggcgccatgaaggatgctgtgcgggtggtgttccggggcagccgggtgaatgacctgtttgaccgggactggcacaagatggccctgagcatccaggcccagaatgtgtccctgcacatcgactgtgccctggtgcagaccctgcccatcgaggagcgggagaacatcgacatccagggcaagacagtcatcggcaagaggctgtatgattctgtgcccatcgactttgacctgcagagaattgtcatctactgtgacagcagacatgctgagctggagacctgctgtgacatccccagcggcccctgccaggtgacagtggtgacagagcccccacctcctcctccaccccagaggcctcccaccccaggcagcgagcagatcggcttcctgaagaccatcaactgcagctgcccagctggggagaagggggagatgggcgtggccggccccatgggcctgcccggccccaagggggacattggagccatcggccctgtgggcgcccctggccccaagggggagaagggagatgtgggcatcggccccttcggccagggcgagaagggggagaagggcagcctgggcctgcccggccccccaggaagagatggcagcaagggcatgagaggagagcctggagagctgggggagcccggcctgcccggggaggtgggcatgaggggcccccagggccccccaggcctgcccggccccccaggccgggtgggcgcccctggcctgcagggcgagcggggggagaagggcaccagaggagagaagggggagcggggcctggatggcttccctgggaagccaggggacaccggccagcagggccggcccggccccagcggcgtggccggcccccagggcgagaagggagatgtgggccctgctggccccccaggagtgcccggctctgtggtgcagcaggagggcctgaagggggagcagggcgcccctggcccccggggccaccagggcgcccctggccccccaggggcccggggccccatcggccctgagggcagagatggccccccaggcctgcagggcctgcggggcaagaagggggacatgggccccccaggcatccctggcctgctgggcctgcagggccccccaggccccccaggagtgcccggccccccaggccctgggggcagccctggcctgcccggggagatcggcttccctgggaagccaggccccccaggccccactggacctcctgggaaggatggccccaacggccccccaggccccccaggcaccaagggggagcccggggagagaggagaagatggcctgcccgggaagccaggcctgcggggggagatcggggagcagggcctggccggccggcctggagagaagggggaggccggcctgcccggggcccctggcttccctggggtgcggggggagaagggggaccagggcgagaagggggagctgggcctgcccggcctgaagggggacagaggagagaagggggaggccggccctgctggccccccaggcctgcccggcaccaccagcctcttcaccccccaccccaggatgcctggagagcagggccccaagggggagaagggggaccccggcctgcctggagagcccggcctgcagggccggcctggagagctgggcccccagggccccactggacctcctggggccaagggccaggagggcgcccatggagcccctggagctgctggcaaccctggggcccctggccacgtgggcgcccctggccccagcggccccccaggctctgtgggcgcccctggcctgcggggcaccccaggcaaggatggagagcggggggagaagggagctgctggggaggagggcagccctggccctgtgggccccaggggggaccccggggcccctggcctgcccggccccccaggcaagggcaaggatggagagcccggcctgcggggcagccctggcctgcccggccccctgggcaccaaggccgcctgtgggaaggtgcggggcagcgagaactgtgccctgggcggccagtgtgtgaagggggacagaggagcccctggcatccctggcagccctggcagcagaggagaccccggcatcggcgtggccggccccccaggccccagcggccccccaggggacaagggcagccctggcagccggggcctgcccggcttccctggcccccagggccctgctggaagagatggagcccctggcaaccctggagagcggggccccccaggcaagccaggcctgagcagcctgctgagccctggggacatcaacctgctggccaaggatgtgtgcaatgactgccccccaggccccccaggcctgcccggcctgcccggcttcaagggggacaagggcgtgcctgggaagccaggccgggagggcacagagggcaagaagggggaggccggccccccaggcctgcccggccccccaggcattgctggcccccagggcagccagggcgagagaggagcagatggagaggtgggccagaagggggaccagggccaccctggggtgcccggcttcatgggccccccaggcaaccctggccccccaggagcagatggcattgctggagctgctggccccccaggcatccagggcagccctgggaaggagggccccccaggcccccagggccccagcggcctgcccggcatccctggagaggagggcaaggagggcagagatggcaagccaggccccccaggagagcccgggaaggccggggagcccggcctgcccggccctgagggcgcccggggccccccaggcttcaagggccacactggagacagcggggcccctggccccagaggagagagcggggccatgggcctgcccggccaggagggcctgcccgggaaggatggagacaccggccccaccggcccccagggcccccagggcccccggggccccccaggcaagaatggcagccctggcagccctggagagcccggccccagcggcaccccaggccagaagggcagcaagggggagaatggcagccctggcctgcccggcttcctgggcccccggggccccccaggagagcctggagagaagggcgtgcctgggaaggagggcgtgcctgggaagccaggagagcccggcttcaagggggagcggggggaccccggcatcaagggggacaagggccccccaggcggcaagggccagcccggggaccccggcatccctggccacaagggccacacaggcctgatgggcccccagggcctgcccggggagaatggacctgtgggccccccaggccccccaggccagcccggcttccctggcctgcggggggagagccccagcatggagaccctgcggcggctcatccaggaggagctgggcaagcagctggagacccggctggcctacctgctggcccagatgcccccagcctacatgaagagcagccagggccggcccggccccccaggccccccaggcaaggatggcctgcccggccgggccggccccatgggagagcccggccggcccggccagggcggcctggagggccccagcggccccatcggccccaagggggagcggggggccaagggggaccccggggcccctggggtgggcctgcggggggagatgggccccccaggcatccctggccagcctggagagcccggctacgccaaggatggcctgcccggcatccctggcccccagggcgagactggacctgctggccaccctggcctgcccggccccccaggccccccaggccagtgtgaccccagccagtgtgcctactttgccagcctggccgcccggcctggaaatgtgaagggcccctag

SEQ ID NO: 3383 - DNA, 4821 bp, Artificial Sequence
  Description of Artificial Sequence: Synthetic coding sequence
atggccggcctgcggggaaatgctgtggccggcctgctgtggatgctgctgctgtggagcggcggcggcggctgccaggcccagagagctggctgcaagtctgtgcactatgacctggtgttcctgctggacaccagcagctctgtgggcaaggaggactttgagaaggtgcggcagtgggtggccaacctggtggacacctttgaggtgggccctgacaggaccagggtgggcgtggtgcgctacagcgaccggcccaccacagcctttgagctgggcctgtttggcagccaggaggaggtgaaggccgccgcccggcggctggcctaccatggaggcaacaccaacacaggagatgccctgcgctacatcacagcccggagcttcagcccccatgctgggggccggccccgggaccgggcctacaagcaggtggccatcctgctgacagatggccgcagccaggacctggtgctggatgctgctgctgctgcccaccgggccggcatccgcatctttgctgtgggcgtgggggaggccctgaaggaggagctggaggagatcgccagcgagcccaagagcgcccacgtgttccacgtgtctgacttcaatgccatcgacaagatccggggcaagctgcggcggcggctgtgtgaaaatgtgctgtgccccagcgtgcgggtggagggggaccgcttcaagcacaccaatggaggcaccaaggagatcaccggctttgacctgatggacctcttctctgtgaaggagatcctgggcaagcgggagaatggagcccagagcagctatgtgaggatgggcagcttccctgtggtgcagagcacagaagatgtgttcccccagggcctgcctgatgaatatgcctttgtgaccaccttccgcttcaggaagaccagcaggaaggaggactggtacatctggcaggtgattgaccagtacagcatcccccaggtgtccatccggctggatggagagaacaaggctgtggagtacaatgctgtgggcgccatgaaggatgctgtgcgggtggtgttccggggcagccgggtgaatgacctgtttgaccgggactggcacaagatggccctgagcatccaggcccagaatgtgtccctgcacatcgactgtgccctggtgcagaccctgcccatcgaggagcgggagaacatcgacatccagggcaagacagtcatcggcaagaggctgtatgattctgtgcccatcgactttgacctgcagagaattgtcatctactgtgacagcagacatgctgagctggagacctgctgtgacatccccagcggcccctgccaggtgacagtggtgacagagcccccacctcctcctccaccccagaggcctcccaccccaggcagcgagcagatcggcttcctgaagaccatcaactgcagctgcccagctggggagaagggggagatgggcgtggccggccccatgggcctgcccggccccaagggggacattggagccatcggccctgtgggcgcccctggccccaagggggagaagggagatgtgggcatcggccccttcggccagggcgagaagggggagaagggcagcctgggcctgcccggccccccaggaagagatggcagcaagggcatgagaggagagcctggagagctgggggagcccggcctgcccggggaggtgggcatgaggggcccccagggccccccaggcctgcccggccccccaggccgggtgggcgcccctggcctgcagggcgagcggggggagaagggcaccagaggagagaagggggagcggggcctggatggcttccctgggaagccaggggacaccggccagcagggccggcccggccccagcggcgtggccggcccccagggcgagaagggagatgtgggccctgctggccccccaggagtgcccggctctgtggtgcagcaggagggcctgaagggggagcagggcgcccctggcccccggggccaccagggcgcccctggccccccaggggcccggggccccatcggccctgagggcagagatggccccccaggcctgcagggcctgcggggcaagaagggggacatgggccccccaggcatccctggcctgctgggcctgcagggccccccaggccccccaggagtgcccggccccccaggccctgggggcagccctggcctgcccggggagatcggcttccctgggaagccaggccccccaggccccactggacctcctgggaaggatggccccaacggccccccaggccccccaggcaccaagggggagcccggggagagaggagaagatggcctgcccgggaagccaggcctgcggggggagatcggggagcagggcctggccggccggcctggagagaagggggaggccggcctgcccggggcccctggcttccctggggtgcggggggagaagggggaccagggcgagaagggggagctgggcctgcccggcctgaagggggacagaggagagaagggggaggccggccctgctggccccccaggcctgcccggcaccaccagcctcttcaccccccaccccaggatgcctggagagcagggccccaagggggagaagggggaccccggcctgcctggagagcccggcctgcagggccggcctggagagctgggcccccagggccccactggacctcctggggccaagggccaggagggcgcccatggagcccctggagctgctggcaaccctggggcccctggccacgtgggcgcccctggccccagcggccccccaggctctgtgggcgcccctggcctgcggggcaccccaggcaaggatggagagcggggggagaagggagctgctggggaggagggcagccctggccctgtgggccccaggggggaccccggggcccctggcctgcccggccccccaggcaagggcaaggatggagagcccggcctgcggggcagccctggcctgcccggccccctgggcaccaagggggacagaggagcccctggcatccctggcagccctggcagcagaggagaccccggcatcggcgtggccggccccccaggccccagcggccccccaggggacaagggcagccctggcagccggggcctgcccggcttccctggcccccagggccctgctggaagagatggagcccctggcaaccctggagagcggggccccccaggcaagccaggcctgagcagcctgctgagccctggggacatcaacctgctggccaaggatgtgtgcaatgactgccccccaggccccccaggcctgcccggcctgcccggcttcaagggggacaagggcgtgcctgggaagccaggccgggagggcacagagggcaagaagggggaggccggccccccaggcctgcccggccccccaggcattgctggcccccagggcagccagggcgagagaggagcagatggagaggtgggccagaagggggaccagggccaccctggggtgcccggcttcatgggccccccaggcaaccctggccccccaggagcagatggcattgctggagctgctggccccccaggcatccagggcagccctgggaaggagggccccccaggcccccagggccccagcggcctgcccggcatccctggagaggagggcaaggagggcagagatggcaagccaggccccccaggagagcccgggaaggccggggagcccggcctgcccggccctgagggcgcccggggccccccaggcttcaagggccacactggagacagcggggcccctggccccagaggagagagcggggccatgggcctgcccggccaggagggcctgcccgggaaggatggagacaccggccccaccggcccccagggcccccagggcccccggggccccccaggcaagaatggcagccctggcagccctggagagcccggccccagcggcaccccaggccagaagggcagcaagggggagaatggcagccctggcctgcccggcttcctgggcccccggggccccccaggagagcctggagagaagggcgtgcctgggaaggagggcgtgcctgggaagccaggagagcccggcttcaagggggagcggggggaccccggcatcaagggggacaagggccccccaggcggcaagggccagcccggggaccccggcatccctggccacaagggccacacaggcctgatgggcccccagggcctgcccggggagaatggacctgtgggccccccaggccccccaggccagcccggcttccctggcctgcggggggagagccccagcatggagaccctgcggcggctcatccaggaggagctgggcaagcagctggagacccggctggcctacctgctggcccagatgcccccagcctacatgaagagcagccagggccggcccggccccccaggccccccaggcaaggatggcctgcccggccgggccggccccatgggagagcccggccggcccggccagggcggcctggagggccccagcggccccatcggccccaagggggagcggggggccaagggggaccccggggcccctggggtgggcctgcggggggagatgggccccccaggcatccctggccagcctggagagcccggctacgccaaggatggcctgcccggcatccctggcccccagggcgagactggacctgctggccaccctggcctgcccggccccccaggccccccaggccagtgtgaccccagccagtgtgcctactttgccagcctggccgcccggcctggaaatgtgaagggcccctag

SEQ ID NO: 3384 - DNA, 3960 bp, Artificial Sequence
  Description of Artificial Sequence: Synthetic coding sequence
atggccggcctgcggggaaatgctgtggccggcctgctgtggatgctgctgctgtggagcggcggcggcggctgccaggcccagagagctggctgcaagtctgtgcactatgacctggtgttcctgctggacaccagcagctctgtgggcaaggaggactttgagaaggtgcggcagtgggtggccaacctggtggacacctttgaggtgggccctgacaggaccagggtgggcgtggtgcgctacagcgaccggcccaccacagcctttgagctgggcctgtttggcagccaggaggaggtgaaggccgccgcccggcggctggcctaccatggaggcaacaccaacacaggagatgccctgcgctacatcacagcccggagcttcagcccccatgctgggggccggccccgggaccgggcctacaagcaggtggccatcctgctgacagatggccgcagccaggacctggtgctggatgctgctgctgctgcccaccgggccggcatccgcatctttgctgtgggcgtgggggaggccctgaaggaggagctggaggagatcgccagcgagcccaagagcgcccacgtgttccacgtgtctgacttcaatgccatcgacaagatccggggcaagctgcggcggcggctgtgtgaaaatgtgctgtgccccagcgtgcgggtggagggggaccgcttcaagcacaccaatggaggcaccaaggagatcaccggctttgacctgatggacctcttctctgtgaaggagatcctgggcaagcgggagaatggagcccagagcagctatgtgaggatgggcagcttccctgtggtgcagagcacagaagatgtgttcccccagggcctgcctgatgaatatgcctttgtgaccaccttccgcttcaggaagaccagcaggaaggaggactggtacatctggcaggtgattgaccagtacagcatcccccaggtgtccatccggctggatggagagaacaaggctgtggagtacaatgctgtggccggcccccagggcgagaagggagatgtgggccctgctggccccccaggagtgcccggctctgtggtgcagcaggagggcctgaagggggagcagggcgcccctggcccccggggccaccagggcgcccctggccccccaggggcccggggccccatcggccctgagggcagagatggccccccaggcctgcagggcctgcggggcaagaagggggacatgggccccccaggcatccctggcctgctgggcctgcagggccccccaggccccccaggagtgcccggccccccaggccctgggggcagccctggcctgcctggagagatcggcttccctgggaagccaggccccccaggccccaccggccccccaggcaaggatggccccaatggacctcctggccccccaggcaccaagggggagcctggagagcggggggaggatggcctgcccgggaagccaggcctgcggggggagattggagagcagggcctggccggccggcctggagagaagggggaggccggcctgcccggggcccctggcttccctggggtgcggggggagaagggggaccagggcgagaagggggagctgggcctgcccggcctgaagggggacagaggagagaagggggaggccggccctgctggccccccaggcctgcccggcaccaccagcctcttcaccccccaccccaggatgcctggagagcagggccccaagggggagaagggggaccccggcctgcccggggagcccggcctgcagggccggcctggagagctgggcccccagggccccaccggccccccaggggccaagggccaggagggcgcccacggggcccctggagctgctggcaaccctggggcccctggccacgtgggcgcccctggccccagcggccccccaggctctgtgggcgcccctggcctgcggggcacccctgggaaggatggagagcggggggagaagggagctgctggggaggagggcagccctggccctgtgggccccaggggggaccccggggcccctggcctgcccggccccccaggcaagggcaaggatggagagcccggcctgcggggcagccctggcctgcccggccccctgggcaccaagggggacagaggagcccctggcatccctggcagccctggcagcagaggagaccccggcattggagtggccggccccccaggccccagcggccccccaggggacaagggcagccctggcagccggggcctgcccggcttccctggcccccagggccctgctggaagagatggagcccctggcaaccctggagagcggggccccccaggcaagccaggcctgagcagcctgctgagccctggggacatcaacctgctggccaaggatgtgtgcaatgactgccccccaggccccccaggcctgcccggcctgcccggcttcaagggggacaagggcgtgcctgggaagccaggccgggagggcacagagggcaagaagggggaggccggccccccaggcctgcccggccccccaggcattgctggcccccagggcagccagggcgagagaggagcagatggagaggtgggccagaagggggaccagggccaccctggggtgcccggcttcatgggccccccaggcaaccctggccccccaggagcagatggcattgctggagctgctggccccccaggcatccagggcagccctgggaaggagggccccccaggcccccagggccccagcggcctgcccggcatccctggagaggagggcaaggagggcagagatggcaagccaggccccccaggagagcccgggaaggccggggagcccggcctgcccggccctgagggcgcccggggccccccaggcttcaagggccacactggagacagcggggcccctggccccagaggagagagcggggccatgggcctgcccggccaggagggcctgcccgggaaggatggagacaccggccccaccggcccccagggcccccagggcccccggggccccccaggcaagaatggcagccctggcagccctggagagcccggccccagcggcaccccaggccagaagggcagcaaaggagaaaatggcagccctggcctgcccggcttcctgggcccccggggccccccaggagagcccggggagaagggcgtgcctgggaaggagggcgtgcctgggaagccaggagagcccggcttcaagggggagcggggggaccccggcatcaagggggacaagggccccccaggcggcaagggccagcccggggaccccggcatccctggccacaagggccacacaggcctgatgggcccccagggcctgcctggagaaaatggacctgtgggccccccaggccccccaggccagcccggcttccctggcctgcggggggagagccccagcatggagaccctgcggcggctcatccaggaggagctgggcaagcagctggagacccggctggcctacctgctggcccagatgcccccagcctacatgaagagcagccagggccggcccggccccccaggccccccaggcaaggatggcctgcccggccgggccggccccatgggagagcccggccggcccggccagggcggcctggagggccccagcggccccatcggccccaagggggagcggggggccaagggggaccccggggcccctggggtgggcctgcggggggagatgggccccccaggcatccctggccagcccggggagcccggctacgccaaggatggcctgcccggcatccctggcccccagggcgagaccggccctgctggccaccctggcctgcccggccccccaggccccccaggccagtgtgaccccagccagtgtgcctactttgccagcctggccgcccggcctggaaatgtgaagggcccctag

SEQ ID NO: 3385 - DNA, 5145 bp, Artificial Sequence
  Description of Artificial Sequence: Synthetic coding sequence
atgcacctgcgggcccacaggacccggcggggcaaggtgagccccacagccaagaccaagagcctgctgcacttcatcgtgctgtgtgtggccggcgtggtggtgcacgcccaggagcagggcatcgacatcctgcaccagctgggcctgggcggcaaggatgtgcgccacagcagccctgccacagctgtgcccagcgccagcacccccctgccccagggcgtgcacctgacagagagcggggtcatcttcaagaatgatgcctacatcgagaccccatttgtgaagatcctgcctgtgaacctgggccagcccttcaccatcctgaccggcctgcagagccaccgggtgaacaatgccttcctgttcagcatccggaacaagaaccggctgcagctgggcgtgcagctgctgcccaagaagctggtggtgcacatccggggcaagcagcctgctgtgttcaactacagcgtgcatgatgagcagtggcacagctttgccatcaccatccggaaccagagcgtgtccatgtttgtggagtgtgggaagaagtacttcagcacagagaccatccctgaggtgcagacctttgacagcaacagcgtcttcaccctgggctccatgaacaacaacagcatccactttgagggcatcgtgtgccagctggacatcatccccagcgctgaggccagcgctgactactgccgctacgtgaagcagcagtgccggcaggccgacaagtaccagcctgagaccagcatcccctgcaccaccctcatccccaccaagatccctgagcacagccccccacccaagctgtttgctgagaaggtgctgtctgaggacaccttcacagagggcaagagcatccccaacatcatcaagaatgacagcgagaccgtgtacaagaggcaggagcaccagatcagccgcagccagctgagcagcctgcagagcggaaatgtgtctgctgtggacctgaccaaccacggcatccaggccaaggagatgatcacagaggaggacacccagaccaacttcagcctgtctgtgaccacccaccgcatcagcgaggccaagatgaacaccaaggagaagttcagcagcctgctgaacatgtctgacaacatcacccagcatgatgacagagtgacaggcctgagcctcttcaagaagatgcccagcatcctgccccagatcaagcaggacaccatcaccaacctgaagaaggccatcacagccaacctgcacaccaatgagctgatggagatgcagcccatcctgaacaccagcctgcaccgggtgaccaatgagcccagcgtggacaaccacctggacctgaggaaggagggggagttctacccagatgccacctaccccatcgagaacagctatgaaacagagctgtatgactactactactatgaggacctgaacaccatgctggagatggagtacctgcggggccccaagggggacaccggccccccaggccccccaggccctgctggcatccctggccccagcggcaagaggggcccccggggcatccctggcccccacggcaaccctggcctgcccggcctgcccggccccaagggccccaagggggaccccggcttcagccctggccagcctgtgcctggagagaagggggaccagggcctgagcggcctgatgggccccccaggcatgcagggcgacaagggcctgaagggccaccctggcctgcccggcctgcctggagagcagggcatccctggctttgctggcaacatcggcagccctggctacccaggccggcagggcctggccggccctgagggcaaccctggccccaagggggcccagggcttcatcggcagccctggagaggccggccagctgggccctgagggggagcggggcatccctggcatccggggcaagaagggcttcaagggccggcagggcttccctggggactttggagaccggggccctgctggcctggatggcagccctggcctggtgggcggcaccggccccccaggcttccctggcctgcggggctctgtgggccctgtgggccccatcggccctgctggcatccctggccccatgggcctgagcggcaacaagggcctgcccggcatcaagggggacaagggggagcagggcacagctggggagctgggggagcccggctacccaggggacaagggagctgtgggcctgcccggccccccaggcatgaggggcaagagcggccccagcggccagacaggagaccccggcctgcagggccccagcggccccccaggccctgagggcttccctggggacatcggcatccctggccagaatggacctgagggccccaagggcctgctgggcaacagaggccccccaggccccccaggcctgaagggcacccagggcgaggagggccccatcggggcctttggagagctgggcccccggggcaagccaggccagaagggctacgccggggagcccggccctgagggcctgaagggggaggtgggggaccagggcaacatcggcaagattggagagaccggccctgtgggcctgcccggggaggtgggcatgacaggcagcattggagagaagggggagcggggcagccctggccccctgggcccccagggcgagaagggcgtgatgggctacccaggccccccaggagtgcccggccccatcggccccctgggcctgcccggccacgtgggcgcccggggccccccaggcagccagggccccaagggccagaggggcagccggggcccagatggcctgctgggggagcagggcatccagggcgccaagggggagaagggggaccagggcaagaggggcccccacggcctgattggcaagacaggcaaccctggagagcggggcttccagggcaagccaggcctgcagggcctgcccggcagcactggagaccggggcctgcctggagagcccggcctgcggggcctgcagggagatgtgggccccccaggagagatgggcatggagggccccccaggcacagaaggagagagcggcctgcagggcgagcccggggccaagggagatgtgggcacagctggctctgtgggcggcaccggggagcccggcctgcggggggagcccggggcccctggagaggagggcctgcagggcaaggatggcctgaagggcgtgcctgggggccggggcctgcctggagaagatggagagaagggggagatgggcctgcccggcatcatcggccccctgggccgcagcggccagacaggcctgcccggccctgagggcatcgtgggcatccctggccagaggggccggcctgggaagaagggggacaagggccagatcggccccactggagaggtgggcagccggggccccccaggcaagattggcaagagcggccccaagggggcccggggcaccagaggagctgtgggccacctgggcctgatgggcccagatggagagcccggcatccctggctaccggggccaccagggccagcccggccccagcggcctgcccggccccaagggggagaagggctacccaggagaggacagcacagtgctgggccccccaggccccagaggagagcccggccctgtgggggaccagggcgagcggggggagcctggagctgagggctacaagggccacgtgggcgtgcccggcctgcggggggccaccggccagcagggccccccaggagagcccggggaccagggcgagcagggcctgaagggggagcggggcagcgagggcaacaagggcaagaagggggcccctggccccagcggcaagccaggcatccctggcctgcagggcctgctgggccccaagggcatccagggctaccacggggctgatggcatcagcggcaaccctgggaagattggccccccaggcaagcagggcctgcccggcatccggggcggccctggccgcacaggcctggccggggcccctggccccccaggagtgaagggcagcagcggcctgcccggcagccctggcatccagggccccaagggggagcagggcctgcccggccagcccggcatccagggcaagaggggccacagaggagcccagggcgaccagggcccctgtggggaccccggcctgaagggccagcctggagaatatggagtgcagggcctgaccggcttccagggcttccctggccccaagggcccagaaggagatgctggcatcgtgggcatcagcggccccaagggccccatcggccaccggggcaacacaggccccctgggccgggagggcatcatcggccccactggaagaacaggccccagaggagagaagggcttccggggggagaccggcccccagggcccccggggccagcccggccccccaggccccccaggggcccctggccccaggaagcagatggacatcaatgctgccatccaggccctgattgagagcaacacagccctgcagatggagagctaccagaacacagaggtgaccctgattgaccacagcgaggagatcttcaagaccctgaactacctgagcaacctgctgcacagcatcaagaaccccctgggcacccgggacaacccagcccgcatctgcaaggacctgctgaactgtgagcagaaggtgtctgatggcaagtactggattgaccccaacctgggctgccccagtgatgccatcgaggtgttctgcaacttctctgctgggggccagacctgcctgccccctgtgtctgtgaccaagctggagtttggagtgggcaaggtgcagatgaacttcctgcacctgctgagcagcgaggccacccacatcatcaccatccactgcctgaacaccccccgctggaccagcacccagaccagcggccctggcctgcccatcggcttcaagggctggaatggccagatcttcaaggtgaacaccctgctggagcccaaggtgctgagtgatgactgcaagatccaggacggctcctggcacaaggccaccttcctgttccacacccaggagcccaaccagctgcccgtcatcgaggtgcagaagctgccccacctgaagacagagaggaagtactacatcgacagcagctctgtgtgcttcctgtag

SEQ ID NO: 3386 - DNA, 5082 bp, Artificial Sequence
  Description of Artificial Sequence: Synthetic coding sequence
atgcacctgcgggcccacaggacccggcggggcaaggtgagccccacagccaagaccaagagcctgctgcacttcatcgtgctgtgtgtggccggcgtggtggtgcacgcccaggagcagggcatcgacatcctgcaccagctgggcctgggcggcaaggatgtgcgccacagcagccctgccacagctgtgcccagcgccagcacccccctgccccagggcgtgcacctgacagagagcggggtcatcttcaagaatgatgcctacatcgagaccccatttgtgaagatcctgcctgtgaacctgggccagcccttcaccatcctgaccggcctgcagagccaccgggtgaacaatgccttcctgttcagcatccggaacaagaaccggctgcagctgggcgtgcagctgctgcccaagaagctggtggtgcacatccggggcaagcagcctgctgtgttcaactacagcgtgcatgatgagcagtggcacagctttgccatcaccatccggaaccagagcgtgtccatgtttgtggagtgtgggaagaagtacttcagcacagagaccatccctgaggtgcagacctttgacagcaacagcgtcttcaccctgggctccatgaacaacaacagcatccactttgagggcatcgtgtgccagctggacatcatccccagcgctgaggccagcgctgactactgccgctacgtgaagcagcagtgccggcaggccgacaagtaccagcctgagaccagcatcccctgcaccaccctcatccccaccaagatccctgagcacagccccccacccaagctgtttgctgagaaggtgctgtctgaggacaccttcacagagggcaagagcatccccaacatcatcaagaatgacagcgagaccgtgtacaagaggcaggagcaccagatcagccgcagccagctgagcagcctgcagagcggaaatgtgtctgctgtggacctgaccaaccacggcatccaggccaaggagatgatcacagaggaggacacccagaccaacttcagcctgtctgtgaccacccaccgcatcagcgaggccaagatgaacaccaaggagaagttcagcagcctgctgaacatgtctgacaacatcacccagcatgatgacagagtgacaggcctgagcctcttcaagaagatgcccagcatcctgccccagatcaagcaggacaccatcaccaacctgaagaaggccatcacagccaacctgcacaccaatgagctgatggagatgcagcccatcctgaacaccagcctgcaccgggtgaccaatgagcccagcgtggacaaccacctggacctgaggaaggagggggagttctacccagatgccacctaccccatcgagaacagctatgaaacagagctgtatgactactactactatgaggacctgaacaccatgctggagatggagtacctgcggggccccaagggggacaccggccccccaggccccccaggccctgctggcatccctggccccagcggcaagaggggcccccggggcatccctggcccccacggcaaccctggcctgcccggcctgcccggccccaagggccccaagggggaccccggcttcagccctggccagcctgtgcctggagagaagggggaccagggcctgagcggcctgatgggccccccaggcatgcagggcgacaagggcctgaagggccaccctggcctgcccggcctgcctggagagcagggcatccctggctttgctggcaacatcggcagccctggctacccaggccggcagggcctggccggccctgagggcaaccctggccccaagggggcccagggcttcatcggcagccctggagaggccggccagctgggccctgagggggagcggggcatccctggcatccggggcaagaagggcttcaagggccggcagggcttccctggggactttggagaccggggccctgctggcctggatggcagccctggcctggtgggcggcaccggccccccaggcttccctggcctgcggggctctgtgggccctgtgggccccatcggccctgctggcatccctggccccatgggcctgagcggcaacaagggcctgcccggcatcaagggggacaagggggagcagggcacagctggggagctgggggagcccggctacccaggggacaagggagctgtgggcctgcccggccccccaggcatgaggggcaagagcggccccagcggccagacaggagaccccggcctgcagggccccagcggccccccaggccctgagggcttccctggggacatcggcatccctggccagaatggacctgagggccccaagggcctgctgggcaacagaggccccccaggccccccaggcctgaagggcacccagggcgaggagggccccatcggggcctttggagagctgggcccccggggcaagccaggccagaagggctacgccggggagcccggccctgagggcctgaagggggaggtgggggaccagggcaacatcggcaagattggagagaccggccctgtgggcctgcccggggaggtgggcatgacaggcagcattggagagaagggggagcggggcagccctggccccctgggcccccagggcgagaagggcgtgatgggctacccaggccccccaggagtgcccggccccatcggccccctgggcctgcccggccacgtgggcgcccggggccccccaggcagccagggccccaagggccagaggggcagccggggcccagatggcctgctgggggagcagggcatccagggcgccaagggggagaagggggaccagggcaagaggggcccccacggcctgattggcaagacaggcaaccctggagagcggggcttccagggcaagccaggcctgcagggcctgcccggcagcactggagaccggggcctgcctggagagcccggcctgcggggcctgcagggagatgtgggccccccaggagagatgggcatggagggccccccaggcacagaaggagagagcggcctgcagggcgagcccggggccaagggagatgtgggcacagctggctctgtgggcggcaccggggagcccggcctgcggggggagcccggggcccctggagaggagggcctgcagggcaaggatggcctgaagggcgtgcctgggggccggggcctgcctggagaagatggagagaagggggagatgggcctgcccggcatcatcggccccctgggccgcagcggccagacaggcctgcccggccctgagggcatcgtgggcatccctggccagaggggccggcctgggaagaagggggacaagggccagatcggccccactggagaggtgggcagccggggccccccaggcaagattggcaagagcggccccaagggggcccggggcaccagaggagctgtgggccacctgggcctgatgggcccagatggagagcccggcatccctggctaccggggccaccagggccagcccggccccagcggcctgcccggccccaagggggagaagggctacccaggagaggacagcacagtgctgggccccccaggccccagaggagagcccggccctgtgggggaccagggcgagcggggggagcctggagctgagggctacaagggccacgtgggcgtgcccggcctgcggggggccaccggccagcagggccccccaggagagcccggggaccagggcgagcagggcctgaagggggagcggggcagcgagggcaacaagggcaagaagggggcccctggccccagcggcaagccaggcatccctggcctgcagggcctgctgggccccaagggcatccagggctaccacggggctgatggcatcagcggcaaccctgggaagattggccccccaggcaagcagggcctgcccggcatccggggcggccctggccgcacaggcctggccggggcccctggccccccaggagtgaagggcagcagcggcctgcccggcagccctggcatccagggccccaagggggagcagggcctgcccggccagcccggcatccagggcaagaggggccacagaggagcccagggcgaccagggcccctgtggggaccccggcctgaagggccagcctggagaatatggagtgcagggcctgaccggcttccagggcttccctggccccaagggcccagaaggagatgctggcatcgtgggcatcagcggccccaagggccccatcggccaccggggcaacacaggccccctgggccgggagggcatcatcggccccactggaagaacaggccccagaggagagaagggcttccggggggagaccaagcagatggacatcaatgctgccatccaggccctgattgagagcaacacagccctgcagatggagagctaccagaacacagaggtgaccctgattgaccacagcgaggagatcttcaagaccctgaactacctgagcaacctgctgcacagcatcaagaaccccctgggcacccgggacaacccagcccgcatctgcaaggacctgctgaactgtgagcagaaggtgtctgatggcaagtactggattgaccccaacctgggctgccccagtgatgccatcgaggtgttctgcaacttctctgctgggggccagacctgcctgccccctgtgtctgtgaccaagctggagtttggagtgggcaaggtgcagatgaacttcctgcacctgctgagcagcgaggccacccacatcatcaccatccactgcctgaacaccccccgctggaccagcacccagaccagcggccctggcctgcccatcggcttcaagggctggaatggccagatcttcaaggtgaacaccctgctggagcccaaggtgctgagtgatgactgcaagatccaggacggctcctggcacaaggccaccttcctgttccacacccaggagcccaaccagctgcctgtgattgaggtgcagaagctgccccacctgaagacagagaggaagtactacatcgacagcagctctgtgtgcttcctgtag

SEQ ID NO: 3387 - DNA, 246 bp, Artificial Sequence
  Description of Artificial Sequence: Synthetic coding sequence
atgcacctgcgggcccacaggacccggcggggcaaggtgagccccacagccaagaccaagagcctgctgcacttcatcgtgctgtgtgtggccggcgtggtggtgcacgcccaggagcagggcatcgacatcctgcaccagctgggcctgggcggcaaggatgtgcgccacagcagccctgccacagctgtgcccagcgccagcacccccctgccccagggcgtgcacctgacagagagcggctag

SEQ ID NO: 3388 - DNA, 1971 bp, Artificial Sequence
  Description of Artificial Sequence: Synthetic coding sequence
atgctgctgaagaagcatgctggaaaaggaggcggccgggagcccaggtctgaggaccccaccccagctgagcagcactgtgcccggaccatgccaccctgtgctgtgctggccgccctgctgtctgtggtggccgtggtgtcctgcctgtacctgggcgtgaagaccaatgacctgcaggccagaattgctgccctggagagcgccaagggggcccccagcatccacctgctgcctgacaccctggaccacctgaagaccatggtgcaggagaaggtggagcggctgctggcccagaagagctatgagcacatggccaagatccgcatcgcccgggaggcccccagcgagtgcaactgcccagctggccccccaggcaagaggggcaagagaggaagaagaggagagagcgctggccccccaggggccccagcccccagccagggccccccaggccccaagggggacaagggggagcagggcgaccagggccccaggatggtgttccccaagatcaaccacggcttcctgtctgctgaccagcagctgatcaagaggaggctcatcaagggggaccagggccaggccggccccccaggccccccaggccccccaggcccccggggccccccaggggacaccgggaaggatggcccccggggcatgcctggggtgcctggagagcccgggaagccaggagagcagggcctgatgggccccctgggccccccaggccagaagggcagcatcggggcccctggcatccctggcatgaatggccagaagggggagcccggcctgcccggggctgtgggccagaatggcatccctggccccaagggggagcctggagagcagggcgagaagggagatgctggggagaatggccccaagggggacacaggagagaagggggaccccggcagcagcgctgctggcatcaagggggagcccggggagagcggccggcccggccagaagggggagcccggcctgcccggcctgcccggcctgcccggcatcaagggggagcccggcttcatcggcccccagggcgagcccggcctgcccggcctgcccggcaccaagggggagcggggggaggccggccccccaggccgcggggagcggggggagcccggggcccctggccccaagggcaagcagggcgagagcggcacccggggccccaagggcagcaaaggagacagaggagagaagggggacagcggggcccagggcccccggggccccccaggccagaagggggaccagggcgccacagagatcatcgactacaacggcaacctgcacgaggccctgcagaggatcaccaccctgactgtgacaggccccccaggccccccaggcccccagggcctgcagggccccaagggggagcagggcagccctggcatccctggcatggatggagagcagggcctgaagggcagcaagggggacatgggagaccccggcatgactggagagaagggcggcatcggcctgcccggcctgcccggggccaacggcatgaagggggagaagggggacagcggcatgcctggcccccagggccccagcatcatcggccccccaggccccccaggcccccacggccccccaggccccatgggcccccacggcctgcccggccccaagggcacagatggccccatgggcccccacggccctgctggccccaagggggagcggggggagaagggggccatgggagagcccggcccccggggcccctacggcctgcccgggaaggatggagagcccggcctggatggcttccctggccccagaggagagaagggggacctgggggagaagggggagaagggcttccggggcgtgaagggggagaagggggagcccggccagcccggcctggatggcctggatgccccctgccagctgggcccagatggcctgcccatgcctggctgctggcagaagtag

SEQ ID NO: 3389 - DNA, 1929 bp, Artificial Sequence
  Description of Artificial Sequence: Synthetic coding sequence
atgctgctgaagaagcatgctggaaaaggaggcggccgggagcccaggtctgaggaccccaccccagctgagcagcactgtgcccggaccatgccaccctgtgctgtgctggccgccctgctgtctgtggtggccgtggtgtcctgcctgtacctgggcgtgaagaccaatgacctgcaggccagaattgctgccctggagagcgccaagggggcccccagcatccacctgctgcctgacaccctggaccacctgaagaccatggtgcaggagaaggtggagcggctgctggcccagaagagctatgagcacatggccaagatccgcatcgcccgggaggcccccagcgagtgcaactgcccagctggccccccaggcaagaggggcaagagaggaagaagaggagagagcggccccccaggccagcccggcccccagggccccccaggccccaagggggacaagggggagcagggcgaccagggccccaggatggtgttccccaagatcaaccacggcttcctgtctgctgaccagcagctgatcaagaggaggctcatcaagggggaccagggccaggccggccccccaggccccccaggccccccaggcccccggggccccccaggggacaccgggaaggatggcccccggggcatgcctggggtgcctggagagcccgggaagccaggagagcagggcctgatgggccccctgggccccccaggccagaagggcagcatcggggcccctggcatccctggcatgaatggccagaagggggagcccggcctgcccggggctgtgggccagaatggcatccctggccccaagggggagcctggagagcagggcgagaagggagatgctggggagaatggccccaagggggacacaggagagaagggggaccccggcagcagcgctgctggcatcaagggggagcccggggagagcggccggcccggccagaagggggagcccggcctgcccggcctgcccggcctgcccggcatcaagggggagcccggcttcatcggcccccagggcgagcccggcctgcccggcctgcccggcaccaagggggagcggggggaggccggccccccaggccgcggggagcggggggagcccggggcccctggccccaagggcaagcagggcgagagcggcacccggggccccaagggcagcaaaggagacagaggagagaagggggacagcggggcccagggcccccggggccccccaggccagaagggggaccagggcgccacagagatcatcgactacaacggcaacctgcacgaggccctgcagaggatcaccaccctgactgtgacaggccccccaggccccccaggcccccagggcctgcagggccccaagggggagcagggcagccctggcatccctggcatggatggagagcagggcctgaagggcagcaagggggacatgggagaccccggcatgactggagagaagggcggcatcggcctgcccggcctgcccggggccaacggcatgaagggggagaagggggacagcggcatgcctggcccccagggccccagcatcatcggccccccaggccccccaggcccccacggccccccaggccccatgggcccccacggcctgcccggccccaagggcacagatggccccatgggcccccacggccctgctggccccaagggggagcggggggagaagggggccatgggagagcccggcccccggggcccctacggcctgcccgggaaggatggagagcccggcctggatggcttccctggccccagaggagagaagggggacctgggggagaagggggagaaggtgaccagccccagccagcacgtgccctgcctgatcctgctgctgctgagcgccctgctcttcagcctgtgtgacagcatctag

SEQ ID NO: 3390 - DNA, 1965 bp, Artificial Sequence
  Description of Artificial Sequence: Synthetic coding sequence
atgctgctgaagaagcatgctggaaaaggaggcggccgggagcccaggtctgaggaccccaccccagctgagcagcactgtgcccggaccatgccaccctgtgctgtgctggccgccctgctgtctgtggtggccgtggtgtcctgcctgtacctgggcgtgaagaccaatgacctgcaggccagaattgctgccctggagagcgccaagggggcccccagcatccacctgctgcctgacaccctggaccacctgaagaccatggtgcaggagaaggtggagcggctgctggcccagaagagctatgagcacatggccaagatccgcatcgcccgggaggcccccagcgagtgcaactgcccagctggccccccaggcaagaggggcaagagaggaagaagaggagagagcggccccccaggccagcccggcccccagggccccccaggccccaagggggacaagggggagcagggcgaccagggccccaggatggtgttccccaagatcaaccacggcttcctgtctgctgaccagcagctgatcaagaggaggctcatcaagggggaccagggccaggccggccccccaggccccccaggccccccaggcccccggggccccccaggggacaccgggaaggatggcccccggggcatgcctggggtgcctggagagcccgggaagccaggagagcagggcctgatgggccccctgggccccccaggccagaagggcagcatcggggcccctggcatccctggcatgaatggccagaagggggagcccggcctgcccggggctgtgggccagaatggcatccctggccccaagggggagcctggagagcagggcgagaagggagatgctggggagaatggccccaagggggacacaggagagaagggggaccccggcagcagcgctgctggcatcaagggggagcccggggagagcggccggcccggccagaagggggagcccggcctgcccggcctgcccggcctgcccggcatcaagggggagcccggcttcatcggcccccagggcgagcccggcctgcccggcctgcccggcaccaagggggagcggggggaggccggccccccaggccgcggggagcggggggagcccggggcccctggccccaagggcaagcagggcgagagcggcacccggggccccaagggcagcaaaggagacagaggagagaagggggacagcggggcccagggcccccggggccccccaggccagaagggggaccagggcgccacagagatcatcgactacaacggcaacctgcacgaggccctgcagaggatcaccaccctgactgtgacaggccccccaggccccccaggcccccagggcctgcagggccccaagggggagcagggcagccctggcatccctggcatggatggagagcagggcctgaagggcagcaagggggacatgggagaccccggcatgactggagagaagggcggcatcggcctgcccggcctgcccggggccaacggcatgaagggggagaagggggacagcggcatgcctggcccccagggccccagcatcatcggccccccaggccccccaggcccccacggccccccaggccccatgggcccccacggcctgcccggccccaagggcacagatggccccatgggcccccacggccctgctggccccaagggggagcggggggagaagggggccatgggagagcccggcccccggggcccctacggcctgcccgggaaggatggagagcccggcctggatggcttccctggccccagaggagagaagggggacctgggggagaagggggagaagggcttccggggcgtgaagggggagaagggggagcccggccagcccggcctggatggcctggatgccccctgccagctgggcccagatggcctgcccatgcctggctgctggcagaagtag

SEQ ID NO: 3391 - DNA, 1752 bp, Artificial Sequence
  Description of Artificial Sequence: Synthetic coding sequence
atgctgctgaagaagcatgctggaaaaggaggcggccgggagcccaggtctgaggaccccaccccagctgagcagcactgtgcccggaccatgccaccctgtgctgtgctggccgccctgctgtctgtggtggccgtggtgtcctgcctgtacctgggcgtgaagaccaatgacctgcaggccagaattgctgccctggagagcgccaagggggcccccagcatccacctgctgcctgacaccctggaccacctgaagaccatggtgcaggagaaggtggagcggctgctggcccagaagagctatgagcacatggccaagatccgcatcgcccgggaggcccccagcgagtgcaactgcccagctggccccccaggcaagaggggcaagagaggaagaagaggagagagcgctggccccccaggcggccccccaggccccaagggggacaagggggagcagggcgaccagggccccaggatggtgttccccaagatcaaccacggcttcctgtctgctgaccagcagctgatcaagaggaggctcatcaagggggaccagggccaggccggccccccaggccccccaggccccccaggcccccggggccccccaggggacaccgggaaggatggcccccggggcatgcctggggtgcctggagagcccgggaagccaggagagcagggcctgatgggccccctgggccccccaggccagaagggcagcatcggggcccctggcatccctggcatgaatggccagaagggggagcccggcctgcccggggctgtgggccagaatggcatccctggccccaagggggagcctggagagcagggcgagaagggagatgctggggagaatggccccaagggggacacaggagagaagggggaccccggcagcagcgctgctggcatcaagggggagcccggggagagcggccggcccggccagaagggggagcccggcttcatcggcccccagggcgagcccggcctgcccggcctgcccggcaccaagggggagcggggggaggccggccccccaggccgcggggagcggggggagcccggggcccctggccccaagggcaagcagggcgagagcggcacccggggccccaagggcagcaagggggacagaggagagaagggggacagcggggcccagggcccccggggccccccaggccagaagggggaccagggcgccacagagatcatcgactacaatggaaacctgcacgaggccctgcagaggatcaccaccctgactgtgactggacctcctggccccccaggcccccagggcctgcagggccccaagggggagcagggcagccctggcatccctggcatggatggagagcagggcctgaagggcagcaaaggagacatgggagaccccggcatgaccggggagaagggcggcatcggcctgcccggcctgcccggggccaacggcatgaagggggagaagggggacagcggcatgcctggcccccagggccccagcatcatcggccccccaggccccccaggcccccacggccccccaggccccatgggcccccacggcctgcccggccccaagggcacagatggccccatgggcccccacggccctgctggccccaagggggagcggggggagaagggggccatgggagagcccggcccccggggcccctacggcctgccccagggcccagatggcctgcccatgcctggctgctggcagaagtag

SEQ ID NO: 3392 - DNA, 1497 bp, Artificial Sequence
  Description of Artificial Sequence: Synthetic coding sequence
atgctgctgaagaagcatgctggaaaaggaggcggccgggagcccaggtctgaggaccccaccccagctgagcagcactgtgcccggaccatgccaccctgtgctgtgctggccgccctgctgtctgtggtggccgtggtgtcctgcctgtacctgggcgtgaagaccaatgacctgcaggccagaattgctgccctggagagcgccaagggggcccccagcatccacctgctgcctgacaccctggaccacctgaagaccatggtgcaggagaaggtggagcggctgctggcccagaagagctatgagcacatggccaagatccgcatcgcccgggaggcccccagcgagtgcaactgcccagctggccccccaggcaagaggggcaagagaggaagaagaggagagagcgctggccccccaggggccccagcccccagccagggccccccaggccccaagggggacaagggggagcagggcgaccagggcccccggggccccctgggccccccaggccagaagggcagcatcggggcccctggcatccctggcatgaatggccagaagggggagcccggcctgcccggggctgtgggccagaatggcatccctggccccaagggggagcctggagagcagggcgagaagggagatgctggggagaatggccccaagggggacacaggagagaagggggaccccggcagcagcgctgctggcatcaagggggagcccggggagagcggccggcccggccagaagggggagcccggcctgcccggcctgcccggcctgcccggcatcaagggggagcccggcttcatcggcccccagggcgagcccggcctgcccggcctgcccggcaccaagggggagcggggggaggccggccccccaggccgcggggagcggggggagcccggggcccctggccccaagggcaagcagggcgagagcggcacccggggccccaagggcagcaaaggagacagaggagagaagggggacagcggggcccagggcccccggggccccccaggccagaagggggaccagggcgccacagagatcatcgactacaacggcaacctgcacgaggccctgcagaggatcaccaccctgactgtgacaggccccccaggccccccaggcccccagggcctgcagggccccaagggggagcagggcagccctggcatccctggcatggatggagagcagggcctgaagggcagcaagggggacatgggagaccccggcagccagtggaatgaaagaaggaagaggcgcttctggaatgccggcagcacaggcagcttctaccaccggcccacccggcccaccaggagcccctggcccacctggccccacggcacctcctggacctcctggaccaagggcagcatctggctgcggaggaaggcccgcatccctggctaccgctggagctatggcaccccctggccctgccgcagccagaggaggaagagctag

SEQ ID NO: 3393 - DNA, 213 bp, Artificial Sequence
  Description of Artificial Sequence: Synthetic coding sequence
atgctgctgaagaagcatgctggaaaaggaggcggccgggagcccaggtctgaggaccccaccccagctgagcagcactgtgcccggaccatgccaccctgtgctgtgctggccgccctgctgtctgtggtggccgtggtgtcctgcctgtacctgggcgtgaagaccaatgacctgcaggccagaattgctgccctggagagcgccaagtag

SEQ ID NO: 3394 - DNA, 90 bp, Artificial Sequence
  Description of Artificial Sequence: Synthetic coding sequence
tgaggacccagaggagagaagggggacctgggggagaagggggagaagggcccagatggcctgcccatgcctggctgctggcagaagtag

SEQ ID NO: 3395 - DNA, 5583 bp, Artificial Sequence
  Description of Artificial Sequence: Synthetic coding sequence
atgggcgccggcagcgcccggggggcccggggcacagctgctgctgctgctgcccggggcggcggcttcctgttctcctggatcctggtgtcctttgcctgccacctggccagcacccagggcgccccagaagatgtggacatcctgcagaggctgggcctgtcctggaccaaggccggcagccctgcccctcctggggtcatccccttccagagcggcttcatcttcacccagagggcccggctgcaggcccccaccggcaccgtcatcccagctgccctgggcacagagctggccctggtgctgagcctgtgcagccaccgggtgaaccacgccttcctgtttgctgtgcgcagccagaagaggaagctgcagctgggcctgcagttcctgcccgggaagacagtggtgcacctgggcagccgccgctctgtggcctttgacctggacatgcatgatggccgctggcaccacctggccctggagctgcggggccgcacagtgaccctggtgacagcctgtggccagaggagagtgcctgtgctgctgcccttccaccgggaccctgccctggaccccggcggcagcttcctgtttgggaagatgaacccccatgctgtgcagtttgaaggagccctgtgccagttcagcatctaccctgtgacccaggtggcccacaactactgcacccacctgaggaagcagtgtggccaggccgacacctaccagagccccctgggccccctcttcagccaggacagcggccggcccttcaccttccagagcgacctggccctgctgggcctggagaacctgaccacagccaccccagccctgggcagcctgcctgctggccggggcccccggggcaccgtggccccagccacccccaccaagccccagaggaccagccccaccaacccccaccagcacatggctgtgggcggccctgcccagacccccctgctgcctgccaagctgagcgccagcaatgccctggaccccatgctgcctgcctctgtgggcggcagcaccaggacccccaggcctgctgctgcccagcccagccagaagatcacagccaccaagatccccaagagcctgcccaccaagcccagcgcccccagcaccagcatcgtgcccatcaagagcccccaccccacccagaagacagcccccagcagcttcaccaagagcgccctgcccacccagaagcaggtgccccccaccagcaggcctgtgcctgcccgggtgtccaggcctgctgagaagcccatccagaggaaccctggcatgcccaggcctcctccacccagcacccggcccctgccccccaccaccagcagcagcaagaagcccatccccaccctggccaggacagaggccaagatcaccagccacgccagcaagccagccagcgcccggaccagcacccacaagcccccacccttcaccgccctgagcagcagccctgcccccaccccaggcagcaccaggagcacccggcccccagccaccatggtgccccccaccagcggcaccagcacccccaggacagccccagctgtgcccaccccaggcagcgcccccaccggcagcaagaagcccatcggcagcgaggccagcaagaaggccggccccaagagcagccccaggaagcctgtgcccctgcggcctgggaaggccgccagagatgtgcccctgagtgacctgaccacccggcccagcccccggcagccccagcccagccagcagaccaccccagccctggtgctggccccagcccagttcctgagcagcagcccccggcccaccagcagcggctacagcatcttccacctggccggcagcacccccttccccctgctgatgggccccccaggccccaagggggactgtggcctgcccggccccccaggcctgcccggcctgcccggcatccctggggcccggggcccccggggccccccaggcccctacggcaaccctggcctgcccggccccccaggggccaagggccagaagggggaccccggcctgagccctgggaaggcccatgatggagccaagggggacatgggcctgcccggcctgagcggcaaccctggccccccaggcaggaagggccacaagggctacccaggccctgctggccaccctggagagcagggccagcccggccctgagggcagccctggggccaagggctacccaggccggcagggcctgcccggccctgtgggggaccccggccccaagggcagccggggctacatcggcctgcccggcctgtttggcctgcccggcagtgatggagagcggggcctgcccggggtgcctgggaagaggggcaagatgggcatgcctggcttccctggggtgtttggagagcggggccccccaggcctggatggcaaccctggagagctgggcctgcccggccccccaggagtgcccggcctcatcggggacctgggcgtgctgggccccatcggctacccaggccccaagggcatgaagggcctgatgggctctgtgggggagcccggcctgaagggggacaagggggagcagggcgtgcctggggtgtctggggaccccggcttccagggcgacaagggcagccagggcctgcccggcttccctggggcccggggcaagccaggccccctgggcaaggtgggggacaagggcagcatcggcttccctggccccccaggccctgagggcttccctggggacatcggccccccaggggacaatggacctgagggcatgaagggcaagccaggggcccggggcctgcccggcccccggggccagctgggcccagaaggagatgagggccccatgggccccccaggggcccctggcctggagggccagcccggcaggaagggcttccctggccggcccggcctggatggagtgaagggggagcccggggaccccggccggcccggccctgtgggggagcagggcttcatgggcttcatcggcctggtgggggagcccggcatcgtgggggagaagggggaccggggcatgatgggccccccaggagtgcccggccccaagggctccatgggccaccctggcatgcctgggggcatgggcaccccaggagagcccggcccccagggccccccaggcagccggggccccccaggcatgagaggagccaagggccggcggggcccccggggcccagatggccctgctggggagcagggcagccggggcctgaagggccccccaggcccccagggccggcccggccggcccggccagcagggcgtggccggggagcggggccacctgggcagccggggcttccctggcatccctggccccagcggccccccaggcaccaagggcctgcccggggagcccggcccccagggcccccagggccccatcggccccccaggagagatgggccccaagggccccccaggagctgtgggggagcccggcctgcctggagaggccggcatgaagggggacctgggccccctgggcaccccaggagagcagggcctcatcggccagagaggagagcccggcctggagggggacagcggccccatgggcccagatggcctgaagggggacagaggagaccccggcccagatggagaacatggagagaagggccaggagggcctgatgggagaagatggccccccaggccccccaggagtgactggagtgcggggccctgagggcaagagcggcaagcagggcgagaagggccgcactggagccaagggggccaagggctaccagggccagctgggggagatgggcgtgcctggggaccccggccccccaggcaccccaggccccaagggcagccggggcagcctgggccccactggagcccctggccgcatgggcgcccagggcgagcccggcctggccggctatgatggccacaagggcatcgtgggccccctgggccccccaggccccaagggggagaagggggagcagggagaagatggcaaggccgagggccccccaggccccccaggggaccggggccctgtgggggacagaggagacagaggagagcccggggaccccggctacccaggccaggagggcgtgcagggcctgcggggcaagccaggccagcagggccagcccggccaccctggcccccggggctggccaggccccaagggcagcaaaggagctgagggccccaagggcaagcagggcaaggccggggcccctggccggcggggcgtgcagggcctgcagggcctgcccggcccccggggcgtggtgggccggcagggcctggagggcattgctggcccagatggcctgcccggcagagatggccaggccggccagcagggcgagcagggagatgatggagaccccggccccatgggccctgctgggaagaggggcaaccctggggtggccggcctgcccggggcccagggccccccaggcttcaagggggagagcggcctgcccggccagctgggccccccaggcaagaggggcacagagggccgcacaggcctgcccggcaaccagggcgagcccggcagcaagggccagcccggggacagcggggagatgggcttccctggcatggccggcctgtttggccccaagggccccccaggggacatcggcttcaagggcatccagggcccccggggccccccaggcctgatgggcaaggagggcatcgtgggccccctgggcatcctgggccccagcggcctgcccggccccaagggggacaagggcagcagaggagactggggcctgcagggcccccggggccccccaggcccccggggccggcccggccccccaggccccccaggcggccccatccagctgcagcaggatgacctgggcgccgccttccagacctggatggacaccagcggggccctgcggcctgagagctacagctacccagaccggctggtgctggaccagggcggggagatcttcaagaccctgcactacctgagcaacctgatccagagcatcaagacccccctgggcaccaaggagaacccagcccgggtgtgccgggacctgatggactgtgagcagaagatggtggatggcacctactgggtggaccccaacctgggctgcagcagtgacaccatcgaggtgtcctgcaacttcacccacggcggccagacctgcctgaagcccatcacagccagcaaggtggagtttgccatcagccgggtgcagatgaacttcctgcacctgctgagcagcgaggtgacccagcacatcaccatccactgcctgaacatgacagtgtggcaggagggcaccggccagaccccagccaagcaggccgtgcgcttccgggcctggaatggccagatctttgaggccggcggccagttccggcctgaggtgtccatggatggctgcaaggtgcaggacggccgctggcaccagaccctcttcaccttccgcacccaggacccccagcagctgcccatcatctctgtggacaacctgcccccagccagcagcggcaagcagtaccgcctggaggtgggccctgcctgcttcctgtag

SEQ ID NO: 3396 - DNA, 5604 bp, Artificial Sequence
  Description of Artificial Sequence: Synthetic coding sequence
atgggcgccggcagcgcccggggggcccggggcacagctgctgctgctgctgcccggggcggcggcttcctgttctcctggatcctggtgtcctttgcctgccacctggccagcacccagggcgccccagaagatgtggacatcctgcagaggctgggcctgtcctggaccaaggccggcagccctgcccctcctggggtcatccccttccagagcggcttcatcttcacccagagggcccggctgcaggcccccaccggcaccgtcatcccagctgccctgggcacagagctggccctggtgctgagcctgtgcagccaccgggtgaaccacgccttcctgtttgctgtgcgcagccagaagaggaagctgcagctgggcctgcagttcctgcccgggaagacagtggtgcacctgggcagccgccgctctgtggcctttgacctggacatgcatgatggccgctggcaccacctggccctggagctgcggggccgcacagtgaccctggtgacagcctgtggccagaggagagtgcctgtgctgctgcccttccaccgggaccctgccctggaccccggcggcagcttcctgtttgggaagatgaacccccatgctgtgcagtttgaaggagccctgtgccagttcagcatctaccctgtgacccaggtggcccacaactactgcacccacctgaggaagcagtgtggccaggccgacacctaccagagccccctgggccccctcttcagccaggacagcggccggcccttcaccttccagagcgacctggccctgctgggcctggagaacctgaccacagccaccccagccctgggcagcctgcctgctggccggggcccccggggcaccgtggccccagccacccccaccaagccccagaggaccagccccaccaacccccaccagcacatggctgtgggcggccctgcccagacccccctgctgcctgccaagctgagcgccagcaatgccctggaccccatgctgcctgcctctgtgggcggcagcaccaggacccccaggcctgctgctgcccagcccagccagaagatcacagccaccaagatccccaagagcctgcccaccaagcccagcgcccccagcaccagcatcgtgcccatcaagagcccccaccccacccagaagacagcccccagcagcttcaccaagagcgccctgcccacccagaagcaggtgccccccaccagcaggcctgtgcctgcccgggtgtccaggcctgctgagaagcccatccagaggaaccctggcatgcccaggcctcctccacccagcacccggcccctgccccccaccaccagcagcagcaagaagcccatccccaccctggccaggacagaggccaagatcaccagccacgccagcaagccagccagcgcccggaccagcacccacaagcccccacccttcaccgccctgagcagcagccctgcccccaccccaggcagcaccaggagcacccggcccccagccaccatggtgccccccaccagcggcaccagcacccccaggacagccccagctgtgcccaccccaggcagcgcccccaccggcagcaagaagcccatcggcagcgaggccagcaagaaggccggccccaagagcagccccaggaagcctgtgcccctgcggcctgggaaggccgccagagatgtgcccctgagtgacctgaccacccggcccagcccccggcagccccagcccagccagcagaccaccccagccctggtgctggccccagcccagttcctgagcagcagcccccggcccaccagcagcggctacagcatcttccacctggccggcagcacccccttccccctgctgatgggccccccaggccccaagggggactgtggcctgcccggccccccaggcctgcccggcctgcccggcatccctggggcccggggcccccggggccccccaggcccctacggcaaccctggcctgcccggccccccaggggccaagggccagaagggggaccccggcctgagccctgggaaggcccatgatggagccaagggggacatgggcctgcccggcctgagcggcaaccctggccccccaggcaggaagggccacaagggctacccaggccctgctggccaccctggagagcagggccagcccggccctgagggcagccctggggccaagggctacccaggccggcagggcctgcccggccctgtgggggaccccggccccaagggcagccggggctacatcggcctgcccggcctgtttggcctgcccggcagtgatggagagcggggcctgcccggggtgcctgggaagaggggcaagatgggcatgcctggcttccctggggtgtttggagagcggggccccccaggcctggatggcaaccctggagagctgggcctgcccggccccccaggagtgcccggcctcatcggggacctgggcgtgctgggccccatcggctacccaggccccaagggcatgaagggcctgatgggctctgtgggggagcccggcctgaagggggacaagggggagcagggcgtgcctggggtgtctggggaccccggcttccagggcgacaagggcagccagggcctgcccggcttccctggggcccggggcaagccaggccccctgggcaaggtgggggacaagggcagcatcggcttccctggccccccaggccctgagggcttccctggggacatcggccccccaggggacaatggacctgagggcatgaagggcaagccaggggcccggggcctgcccggcccccggggccagctgggcccagaaggagatgagggccccatgggccccccaggggcccctggcctggagggccagcccggcaggaagggcttccctggccggcccggcctggatggagtgaagggggagcccggggaccccggccggcccggccctgtgggggagcagggcttcatgggcttcatcggcctggtgggggagcccggcatcgtgggggagaagggggaccggggcatgatgggccccccaggagtgcccggccccaagggctccatgggccaccctggcatgcctgggggcatgggcaccccaggagagcccggcccccagggccccccaggcagccggggccccccaggcatgagaggagccaagggccggcggggcccccggggcccagatggccctgctggggagcagggcagccggggcctgaagggccccccaggcccccagggccggcccggccggcccggccagcagggcgtggccggggagcggggccacctgggcagccggggcttccctggcatccctggccccagcggccccccaggcaccaagggcctgcccggggagcccggcccccagggcccccagggccccatcggccccccaggagagatgggccccaagggccccccaggagctgtgggggagcccggcctgcctggagaggccggcatgaagggggacctgggccccctgggcaccccaggagagcagggcctcatcggccagagaggagagcccggcctggagggggacagcggccccatgggcccagatggcctgaagggggacagaggagaccccggcccagatggagaacatggagagaagggccaggagggcctgatgggagaagatggccccccaggccccccaggagtgactggagtgcggggccctgagggcaagagcggcaagcagggcgagaagggccgcactggagccaagggggccaagggctaccagggccagctgggggagatgggcgtgcctggggaccccggccccccaggcaccccaggccccaagggcagccggggcagcctgggccccactggagcccctggccgcatgggcgcccagggcgagcccggcctggccggctatgatggccacaagggcatcgtgggccccctgggccccccaggccccaagggggagaagggggagcagggagaagatggcaaggccgagggccccccaggccccccaggggaccggggccctgtgggggacagaggagacagaggagagcccggggaccccggctacccaggccaggagggcgtgcagggcctgcggggcaagccaggccagcagggccagcccggccaccctggcccccggggctggccaggccccaagggcagcaaaggagctgagggccccaagggcaagcagggcaaggccggggcccctggccggcggggcgtgcagggcctgcagggcctgcccggcccccggggcgtggtgggccggcagggcctggagggcattgctggcccagatggcctgcccggcagagatggccaggccggccagcagggcgagcagggagatgatggagaccccggccccatgggccctgctgggaagaggggcaaccctggggtggccggcctgcccggggcccagggccccccaggcttcaagggggagagcggcctgcccggccagctgggccccccaggcaagaggggcacagagggccgcacaggcctgcccggcaaccagggcgagcccggcagcaagggccagcccggggacagcggggagatgggcttccctggcatggccggcctgtttggccccaagggccccccaggggacatcggcttcaagggcatccagggcccccggggccccccaggcctgatgggcaaggagggcatcgtgggccccctgggcatcctgggccccagcggcctgcccggccccaagggggacaagggcagcagaggagactggggcctgcagggcccccggggccccccaggcccccggggccggcccggcccccctgtggaccccggcggcccccgctacatcccctgcctcttcctggcccagcagcaggatgacctgggcgccgccttccagacctggatggacaccagcggggccctgcggcctgagagctacagctacccagaccggctggtgctggaccagggcggggagatcttcaagaccctgcactacctgagcaacctgatccagagcatcaagacccccctgggcaccaaggaaaatcctgcccgggtgtgccgggacctgatggactgtgagcagaagatggtggatggcacctactgggtggaccccaacctgggctgcagcagtgacaccatcgaggtgtcctgcaacttcacccatggaggccagacctgcctgaagcccatcacagccagcaaggtggagtttgccatcagccgggtgcagatgaacttcctgcacctgctgagcagcgaggtgacccagcacatcaccatccactgcctgaacatgacagtgtggcaggagggcaccggccagaccccagccaagcaggccgtgcgcttccgggcctggaatggccagatctttgaagctgggggccagttccggcctgaggtgtccatggatggctgcaaggtgcaggacggccgctggcaccagaccctcttcaccttccgcacccaggacccccagcagctgcccatcatctctgtggacaacctgcccccagccagcagcggcaagcagtaccgcctggaggtgggccctgcctgcttcctgtag

SEQ ID NO: 3397 - DNA, 2145 bp, Artificial Sequence
  Description of Artificial Sequence: Synthetic coding sequence
ctgtcctggaccaaggccggcagccctgcccctcctggggtcatccccttccagagcggcttcatcttcacccagagggcccggctgcaggcccccactggaacagtcatcccagctgccctgggcacagagctggccctggtgctgagcctgtgcagccaccgggtgaaccacgccttcctgtttgctgtgcgcagccagaagaggaagctgcagctgggcctgcagttcctgcccgggaagacagtggtgcacctgggcagcagaagatctgtggcctttgacctggacatgcatgatggccgctggcaccacctggccctggagctgcggggccgcacagtgaccctggtgacagcctgtggccagaggagagtgcctgtgctgctgcccttccaccgggaccctgccctggaccccggcggcagcttcctgtttgggaagatgaacccccatgctgtgcagtttgagggcgccctgtgccagttcagcatctaccctgtgacccaggtggcccacaactactgcacccacctgaggaagcagtgtggccaggccgacacctaccagagccccctgggccccctcttcagccaggacagcggccggcccttcaccttccagagcgacctggccctgctgggcctggagaacctgaccacagccaccccagccctgggcagcctgcctgctggccggggcccccggggcaccgtggccccagccacccccaccaagccccagaggaccagccccaccaacccccaccagcacatggctgtgggcggccctgcccagacccccctgctgcctgccaagctgagcgccagcaatgccctggaccccatgctgcctgcctctgtgggcggcagcaccaggacccccaggcctgctgctgcccagcccagccagaagatcacagccaccaagatccccaagagcctgcccaccaagcccagcgcccccagcaccagcatcgtgcccatcaagagcccccaccccacccagaagacagcccccagcagcttcaccaagagcgccctgcccacccagaagcaggtgccccccaccagcaggcctgtgcctgcccgggtgtccaggcctgctgagaagcccatccagagaaatcctggcatgccccggcccccaccacccagcacccggcccctgccccccaccaccagcagcagcaagaagcccatccccaccctggccaggacagaggccaagatcaccagccacgccagcaagccagccagcgcccggaccagcacccacaagcccccacccttcaccgccctgagcagcagccctgcccccaccccaggcagcaccaggagcacccggcccccagccaccatggtgccccccaccagcggcaccagcacccccaggacagccccagctgtgcccaccccaggcagcgcccccaccggcagcaagaagcccatcggcagcgaggccagcaagaaggccggccccaagagcagccccaggaagcctgtgcccctgcggcctgggaaggccgccagagatgtgcccctgagtgacctgaccacccggcccagcccccggcagccccagcccagccagcagaccaccccagccctggtgctggccccagcccagttcctgagcagcagcccccggcccaccagcagcggctacagcatcttccacctggccggcagcacccccttccccctgctgatgggccccccaggccccaagggggactgtggcctgcccggccccccaggcctgcccggcctgcccggcatccctggggcccggggcccccggggccccccaggcccctacggcaaccctggcctgcccggccccccaggggccaagggggacatgggcctgcccggcctgagcggcaaccctggccccccaggcaggaagggcctgcccggccctgtgggggaccccggccccaagggcagccggggctacatcggcctgcccggcctgtttggcctgcccggcagtgatggagagcggggcctgcccggggtgcctgggaagaggggcaagatgggcatgcctgtgctgctgccccagagcagcgaggcccggggcggcaacagcatgcccagcgagggcgccctggccggccgccacggcagccacctgtag

SEQ ID NO: 3398 - DNA, 2142 bp, Artificial Sequence
  Description of Artificial Sequence: Synthetic coding sequence
atgtggaaccgctactttgtgttctacctgctgctgctgagcgccttcaccagccagacagtgtctggccagaggaagaagggccccaagagcaacctgctggccaggaagagtgatgtgcagggcagcatctgcttcattgatattgtgttcatcgtggacagcagcgagagcagcaagatcgccctgtttgacaagcagaaggactttgtggacagcctgagtgacaagatcttccagctgaccccaggccgcagcctggagtatgacatcaagctggccgccctgcagttcagcagctctgtgcagattgacccccccttcagctcctggaaggacctgcagaccttcaagcagaaggtgaagtccatgaacctgattggccagggcaccttctcctactatgccatcagcaatgccacccggctgctgaagcgggagggcaggaaggatggagtgaaggtggtgctgctgatgacagatggcatcgaccaccccaagaacccagatgtgcagagcatcagtgaagatgcccgcatcagcggcatctccttcatcaccatcgccctgagcacagtggtgaatgaggccaagctgcggctcatcagcggggacagcagcagcgagcccaccctgctgctgagtgaccccaccctggtggacaagatccaggaccggctggagatgctgtttgagatccagtgtgagaggaagatctgtgaatgtgagaagggggaccccggggaccccggccccccaggcacccacggcaaccctggcatcaagggggagcggggccccaagggcaaccctggaaatgcccagaagggggaggccggggagcggggccctgggggcatccctggctacaagggggacaagggggagagaggagaatgtgggaagccaggcatcaagggggacaagggcagccctggcccctacggccccaagggcccccggggcatccagggcatcactggacctcctggggaccccggccccaagggcttccagggcaacaagggggagcccggccccccaggcccctacggcagccctggggcccctggcatcggccagcagggcatcaagggggagcggggccaggagggccggcctggggcccctggccccatcggcgtgggggagcccggccagcccggcccccggggccctgagggcgtgcctggagagcggggcctgcctggagagggcttccctggccccaagggggagaagggcagcgagggccccaccggcccccagggcctgcagggcctgagcatcaagggggagaagggggacatcggccctgtgggcccccagggccccatgggcatccctggcatcggcagccagggcgagcagggcatccagggccccatcggccccccaggcccccagggccctgctggccagggcctgcccggcagcaagggggaggtgggccagatgggccccaccggcccccggggccctgtgggcattggagtgcagggccccaagggggagcccggcagcatcggcctgcccggccagcccggggtgcctggagaagatggagctgctgggaagaagggggaggccggcctgcccggggcccggggccctgagggccccccaggcaagggccagcccggccccaagggagatgagggcaagaagggcagcaaaggaaaccagggccagaggggcctgcccggccctgagggccccaagggggagcccggcatcatgggccccttcggcatgcctggcaccagcatccctggccccccaggccccaagggggacagaggaggccctggcatccctggcttcaagggggagcccggcctgagcatccggggccccaagggcgtgcagggcccccggggccctgtgggcgcccctggcctgaagggagatggctacccaggagtgcccggcccccggggcctgcccggccccccaggccccatgggcctgcggggcgtgggggacacaggagccaagaccctgaacaccagccacggcctggaggaccccagctgcccagactgcagcttctgccacttcagcctggccgctgacatccagcccaagtggccagccctgctgcagctgatcccagccagcggcacccggcaggacggctag

SEQ ID NO: 3399 - DNA, 3378 bp, Artificial Sequence
  Description of Artificial Sequence: Synthetic coding sequence
atgtggaaccgctactttgtgttctacctgctgctgctgagcgccttcaccagccagacagtgtctggccagaggaagaagggccccaagagcaacctgctggccaggaagagtgatgtgcagggcagcatctgcttcattgatattgtgttcatcgtggacagcagcgagagcagcaagatcgccctgtttgacaagcagaaggactttgtggacagcctgagtgacaagatcttccagctgaccccaggccgcagcctggagtatgacatcaagctggccgccctgcagttcagcagctctgtgcagattgacccccccttcagctcctggaaggacctgcagaccttcaagcagaaggtgaagtccatgaacctgattggccagggcaccttctcctactatgccatcagcaatgccacccggctgctgaagcgggagggcaggaaggatggagtgaaggtggtgctgctgatgacagatggcatcgaccaccccaagaacccagatgtgcagagcatcagtgaagatgcccgcatcagcggcatctccttcatcaccatcgccctgagcacagtggtgaatgaggccaagctgcggctcatcagcggggacagcagcagcgagcccaccctgctgctgagtgaccccaccctggtggacaagatccaggaccggctggacatcctgtttgagaagaagtgtgagaggaagatctgtgaatgtgagaagggggaccccggggaccccggccccccaggcacccacggcaaccctggcatcaagggggagcggggccccaagggcaaccctggaaatgcccagaagggggaggccggggagcggggccctgggggcatccctggctacaagggggacaagggggagagaggagaatgtgggaagccaggcatcaagggggacaagggcagccctggcccctacggccccaagggcccccggggcatccagggcatcactggacctcctggggaccccggccccaagggcttccagggcaacaagggggagcccggccccccaggcccctacggcagccctggggcccctggcatcggccagcagggcatcaagggggagcggggccaggagggccggcctggggcccctggccccatcggcgtgggggagcccggccagcccggcccccggggccctgagggcgtgcctggagagcggggcctgcctggagagggcttccctggccccaagggggagaagggcagcgagggccccaccggcccccagggcctgcagggcctgagcatcaagggggagaagggggacatcggccctgtgggcccccagggccccatgggcatccctggcatcggcagccagggcgagcagggcatccagggccccatcggccccccaggcccccagggccctgctggccagggcctgcccggcagcaagggggaggtgggccagatgggccccaccggcccccggggccctgtgggcattggagtgcagggccccaagggggagcccggcagcatcggcctgcccggccagcccggggtgcctggagaagatggagctgctgggaagaagggggaggccggcctgcccggggcccggggccctgagggccccccaggcaagggccagcccggccccaagggagatgagggcaagaagggcagcaaaggaaaccagggccagaggggcctgcccggccctgagggccccaagggggagcccggcatcatgggccccttcggcatgcctggcaccagcatccctggccccccaggccccaagggggacagaggaggccctggcatccctggcttcaagggggagcccggcctgagcatccggggccccaagggcgtgcagggcccccggggccctgtgggcgcccctggcctgaagggagatggctacccaggagtgcccggcccccggggcctgcccggccccccaggccccatgggcctgcggggcgtgggggacacaggagccaagggggagcccggggtgcggggccccccaggccccagcggcccccggggcgtgggcacccagggccccaagggggacaccggccagaagggcctgcccggccccccaggccccccaggctacggcagccagggcatcaagggggagcagggcccccagggcttccctggccccaagggcaccatgggccacggcctgcccggccagaagggggagcacggggagagaggagatgtgggcaagaagggggacaagggggagattggagagcccggcagccctgggaagcagggcctgcagggccccaagggggacctgggcctgaccaaggaggagatcatcaagctgatcacagagatctgtggctgcggccccaagtgcaaggagacccccctggagctggtgtttgtgattgacagcagcgagagcgtgggccctgagaacttccagatcatcaagaactttgtgaagaccatggctgacagagtggccctggacctggccacagccagaattggcatcatcaactacagccacaaggtggagaaggtggccaacctgaagcagttcagcagcaaggatgacttcaagctggccgtggacaacatgcagtacctgggggagggcacctacacagccacagccctgcaggccgccaatgacatgtttgaagatgcccggcctggggtgaagaaggtggccctggtgatcacagatggccagacagacagccgggacaaggagaagctgacagaggtggtgaagaatgccagtgacaccaacgtggagatcttcgtcatcggcgtggtgaagaagaatgaccccaactttgagatcttccacaaggagatgaacctgattgccacagatcctgagcacgtgtaccagtttgatgacttcttcaccctgcaggacaccctgaagcagaagctgttccagaagatctgtgaggactttgacagctacctggtgcagatcttcggcagcagcagcccccagcccggcttcggcatgtctggagaggagctgtctgagagcaccccagagccccagaaggagatcagcgagagcctgtctgtgacccgggaccaggatgaagatgacaaggcccctgagcccacctgggcagatgacctgcctgccaccaccagcagcgaggccaccaccaccccccggcccctgctgagcacccctgtggatggagctgaggacccccgctgcctggaggccctgaagccaggcaactgtggggagtatgtggtgcgctggtactatgacaagcaggtgaacagctgtgcccgcttctggttcagcggctgcaatggcagcggcaaccgcttcaacagcgagaaggagtgccaggagacctgcatccagggctag

SEQ ID NO: 3400 - DNA, 1005 bp, Artificial Sequence
  Description of Artificial Sequence: Synthetic coding sequence
atgtggaaccgctactttgtgttctacctgctgctgctgagcgccttcaccagccagacagtgtctggccagaggaagaagggccccaagagcaacctgctggccaggaagagtgatgtgcagggcagcatctgcttcattgatattgtgttcatcgtggacagcagcgagagcagcaagatcgccctgtttgacaagcagaaggactttgtggacagcctgagtgacaagatcttccagctgaccccaggccgcagcctggagtatgacatcaagctggccgccctgcagttcagcagctctgtgcagattgacccccccttcagctcctggaaggacctgcagaccttcaagcagaaggtgaagtccatgaacctgattggccagggcaccttctcctactatgccatcagcaatgccacccggctgctgaagcgggagggcaggaaggatggagtgaaggtggtgctgctgatgacagatggcatcgaccaccccaagaacccagatgtgcagagcatcagtgaagatgcccgcatcagcggcatctccttcatcaccatcgccctgagcacagtggtgaatgaggccaagctgcggctcatcagcggggacagcagcagcgagcccaccctgctgctgagtgaccccaccctggtggacaagatccaggaccggctggagatgctgtttgagatccagtgtgagaggaagatctgtgaatgtgagaagggggaccccggggaccccggccccccaggcacccacggcaaccctggcatcaagggggagcggggccccaagggcaaccctggaaatgcccagaagggggaggccggggagcggggccctgggggcatccctggctacaagggggacaagcagtacagcagagaagatcgggaggtggagcacaacaatgagaagtatgtggcctgcctgctgcccagccctgccctgctgcagcagagcagcctgacccaccacggcacctgcagccactag

SEQ ID NO: 3401 - DNA, 243 bp, Artificial Sequence
  Description of Artificial Sequence: Synthetic coding sequence
gccaccaccagcagcgaggccaccaccaccccccggcccctgctgagcacccctgtggatggagctgaggacccccgctgcctggaggccctgaagccaggcaactgtggggagtatgtggtgcgctggtactatgacaagcaggtgaacagctgtgcccgcttctggttcagcggctgcaatggaagtggcaaccgcttcaacagcgagaaggagtgccaggagacctgcatccagggctag

SEQ ID NO: 3402 - DNA, 1587 bp, Artificial Sequence
  Description of Artificial Sequence: Synthetic coding sequence
atgggcagcagccgggccccctggatgggccgggtgggcggccacggcatgctggccctgctgctggccggcctgctgctgcccggcaccctggccaagagcatcggcaccttcagtgacccctgcaaggaccccacccgcatcaccagccccaatgacccctgcctgactggaaaaggagacagcagcggcttcagcagctacagcggcagcagcagcagcggcagcagcatcagcagcgcccggagcagcggcggcggcagcagcggcagcagcagcggcagcagcatcgcccagggcggcagcgctggcagcttcaagccaggcaccggctacagccaggtgtcctacagcagcggcagcggcagcagcctgcagggcgccagcggcagcagccagctgggcagcagcagcagccacagcggcagcagcggcagccacagcggcagcagcagccacagcagcagcagcagcagcttccagttcagcagcagcagcttccaggtgggcaatggaagtgccctgcccaccaatgacaacagctaccggggcatcctgaaccccagccagcccggccagagcagcagcagcagccagacctttggagtgagcagcagcggccagagcgtgagcagcaaccagaggccctgcagcagtgacatcccagacagcccctgcagcggcggccccatcgtgagccacagcggcccctacatccccagcagccacagcgtgtctgggggccagaggcctgtggtggtggtggtggaccagcacggcagcggggcccctggggtggtgcagggccccccctgcagcaatggaggcctgcccgggaagccctgcccccccatcacctctgtggacaagagctatggaggctatgaggtggtgggcggcagcagtgacagctacctggtgcccggcatgacctacagcaagggcaagatctaccctgtgggctacttcaccaaggagaaccctgtgaagggcagccctggggtgcccagctttgctgctggcccccccatcagcgagggcaagtacttcagcagcaaccccatcatccccagccagagcgctgccagcagcgccatcgccttccagcctgtgggcactggaggagtgcagctgtgtggcggcggcagcacaggcagcaagggcccctgcagccccagcagcagccgggtgcccagcagcagcagcatcagcagcagcagcggcctgccctaccacccctgtggcagcgccagccagagcccctgcagccccccaggcaccggcagcttcagcagcagcagcagcagccagagcagcggcaagatcatcctgcagccctgtggcagcaagagcagcagcagcggccacccctgcatgtctgtgagcagcctgaccctgactggaggcccagatggcagcccccacccagaccccagcgctggggccaagccctgtggcagcagcagcgctgggaagatcccctgccgcagcatccgggacatcctggcccaggtgaagcccctgggcccccagctggccgaccctgaggtgttcctgccccagggcgagctgctggacagcccctag

SEQ ID NO: 3403 - DNA, 1590 bp, Artificial Sequence
  Description of Artificial Sequence: Synthetic coding sequence
atgggcagcagccgggccccctggatgggccgggtgggcggccacggcatgatggccctgctgctggccggcctgctgctgcccggcaccctggccaagagcatcggcaccttcagtgacccctgcaaggaccccacccgcatcaccagccccaatgacccctgcctgactggaaaaggagacagcagcggcttcagcagctacagcggcagcagcagcagcggcagcagcatcagcagcgcccggagcagcggcggcggcagcagcggcagcagcagcggcagcagcatcgcccagggcggcagcgctggcagcttcaagccaggcaccggctacagccaggtgtcctacagcagcggcagcggcagcagcctgcagggcgccagcggcagcagccagctgggcagcagcagcagccacagcggcaacagcggcagccacagcggcagcagcagcagccacagcagcagcagcagcagcttccagttcagcagcagcagcttccaggtgggcaatggcagcgccctgcccaccaatgacaacagctaccggggcatcctgaaccccagccagcccggccagagcagcagcagcagccagaccttcggcgtgagcagcagcggccagagcgtgagcagcaaccagaggccctgcagcagtgacatcccagacagcccctgcagcggcggccccatcgtgagccacagcggcccctacatccccagcagccacagcgtgtctgggggccagaggcctgtggtggtggtggtggaccagcacggcagcggggcccctggggtggtgcagggccccccctgcagcaatggaggcctgcccgggaagccctgcccccccatcacctctgtggacaagagctatggaggctatgaggtggtgggcggcagcagtgacagctacctggtgcccggcatgacctacagcaagggcaagatctaccctgtgggctacttcaccaaggaaaatcctgtgaagggcagccctggggtgcccagctttgctgctggcccccccatcagcgagggcaagtacttcagcagcaaccccatcatccccagccagagcgctgccagcagcgccatcgccttccagcctgtgggcaccggcggcgtgcagctgtgtggcggcggcagcacaggcagcaagggcccctgcagccccagcagcagccgggtgcccagcagcagcagcatcagcagcagcagcggcctgccctaccacccctgtggcagcgccagccagagcccctgcagccccccaggcaccggcagcttcagcagcagcagcagcagccagagcagcggcaagatcatcctgcagccctgtggcagcaagagcagcagcagcggccacccctgcatgtctgtgagcagcctgaccctgaccggcggcccagatggcagcccccacccagaccccagcgctggggccaagccctgtggcagcagcagcgctgggaagatcccctgccgcagcatccgggacatcctggcccaggtgaagcccctgggcccccagctggccgaccctgaggtgttcctgccccagggcgagctgctgaacagcccctag

SEQ ID NO: 3404 - DNA, 1590 bp, Artificial Sequence
  Description of Artificial Sequence: Synthetic coding sequence
atgggcagcagccgggccccctggatgggccgggtgggcggccacggcatgatggccctgctgctggccggcctgctgctgcccggcaccctggccaagagcatcggcaccttcagtgacccctgcaaggaccccacccgcatcaccagccccaatgacccctgcctgactggaaaaggagacagcagcggcttcagcagctacagcggcagcagcagcagcggcagcagcatcagcagcgcccggagcagcggcggcggcagcagcggcagcagcagcggcagcagcatcgcccagggcggcagcgctggcagcttcaagccaggcaccggctacagccaggtgtcctacagcagcggcagcggcagcagcctgcagggcgccagcggcagcagccagctgggcagcagcagcagccacagcggcagcagcggcagccacagcggcagcagcagcagccacagcagcagcagcagcagcttccagttcagcagcagcagcttccaggtgggcaatggcagcgccctgcccaccaatgacaacagctaccggggcatcctgaaccccagccagcccggccagagcagcagcagcagccagaccttcggcgtgagcagcagcggccagagcgtgagcagcaaccagaggccctgcagcagtgacatcccagacagcccctgcagcggcggccccatcgtgagccacagcggcccctacatccccagcagccacagcgtgtctgggggccagaggcctgtggtggtggtggtggaccagcacggcagcggggcccctggggtggtgcagggccccccctgcagcaatggaggcctgcccgggaagccctgcccccccatcacctctgtggacaagagctatggaggctatgaggtggtgggcggcagcagtgacagctacctggtgcccggcatgacctacagcaagggcaagatctaccctgtgggctacttcaccaaggaaaatcctgtgaagggcagccctggggtgcccagctttgctgctggcccccccatcagcgagggcaagtacttcagcagcaaccccatcatccccagccagagcgctgccagcagcgccatcgccttccagcctgtgggcaccggcggcgtgcagctgtgtggcggcggcagcacaggcagcaagggcccctgcagccccagcagcagccgggtgcccagcagcagcagcatcagcagcagcgctggcagcccctaccacccctgtggcagcgccagccagagcccctgcagccccccaggcaccggcagcttcagcagcagcagcagcagccagagcagcggcaagatcatcctgcagccctgtggcagcaagagcagcagcagcggccacccctgcatgtctgtgagcagcctgaccctgaccggcggcccagatggcagcccccacccagaccccagcgctggggccaagccctgtggcagcagcagcgctgggaagatcccctgccgcagcatccgggacatcctggcccaggtgaagcccctgggcccccagctggccgaccctgaggtgttcctgccccagggcgagctgctggacagcccctag

SEQ ID NO: 3405 - DNA, 1590 bp, Artificial Sequence
  Description of Artificial Sequence: Synthetic coding sequence
atgggcagcagccgggccccctggatgggccgggtgggcggccacggcatgatggccctgctgctggccggcctgctgctgcccggcaccctggccaagagcatcggcaccttcagtgacccctgcaaggaccccacccgcatcaccagccccaatgacccctgcctgactggaaaaggagacagcagcggcttcagcagctacagcggcagcagcagcagcggcagcagcatcagcagcgcccggagcagcggcggcggcagcagcggcagcagcagcggcagcagcatcgcccagggcggcagcgctggcagcttcaagccaggcaccggctacagccaggtgtcctacagcagcggcagcggcagcagcctgcagggcgccagcggcagcagccagctgggcagcagcagcagccacagcggcagcagcggcagccacagcggcagcagcagcagccacagcagcagcagcagcagcttccagttcagcagcagcagcttccaggtgggcaatggcagcgccctgcccaccaatgacaacagctaccggggcatcctgaaccccagccagcccggccagagcagcagcagcagccagaccttcggcgtgagcagcagcggccagagcgtgagcagcaaccagaggccctgcagcagtgacatcccagacagcccctgcagcggcggccccatcgtgagccacagcggcccctacatccccagcagccacagcgtgtctgggggccagaggcctgtggtggtggtggtggaccagcacggcagcggggcccctggggtggtgcagggccccccctgcagcaatggaggcctgcccgggaagccctgcccccccatcacctctgtggacaagagctatggaggctatgaggtggtgggcggcagcagtgacagctacctggtgcccggcatgacctacagcaagggcaagatctaccctgtgggctacttcaccaaggaaaatcctgtgaagggcagccctggggtgcccagctttgctgctggcccccccatcagcgagggcaagtacttcagcagcaaccccatcatccccagccagagcgctgccagcagcgccatcgccttccagcctgtgggcaccggcggcgtgcagctgtgtggcggcggcagcacaggcagcaagggcccctgcagccccagcagcagccgggtgcccagcagcagcagcatcagcagcagcagcggcagcccctaccacccctgtggcagcgccagccagagcccctgcagccccccaggcaccggcagcttcagcagcagcagcagcagccagagcagcggcaagatcatcctgcagccctgtggcagcaagagcagcagcagcggccacccctgcatgtctgtgagcagcctgaccctgaccggcggcccagatggcagcccccacccagaccccagcgctggggccaagccctgtggcagcagcagcgctgggaagatcccctgccgcagcatccgggacatcctggcccaggtgaagcccctgggcccccagctggccgaccctgaggtgttcctgccccagggcgagctgctggacagcccctag

SEQ ID NO: 3406 - DNA, 1590 bp, Artificial Sequence
  Description of Artificial Sequence: Synthetic coding sequence
atgggcagcagccgggccccctggatgggccgggtgggcggccacggcatgatggccctgctgctggccggcctgctgctgcccggcaccctggccaagagcatcggcaccttcagtgacccctgcaaggaccccacccgcatcaccagccccaatgacccctgcctgactggaaaaggagacagcagcggcttcagcagctacagcggcagcagcagcagcggcagcagcatcagcagcgcccggagcagcggcggcggcagcagcggcagcagcagcggcagcagcatcgcccagggcggcagcgctggcagcttcaagccaggcaccggctacagccaggtgtcctacagcagcggcagcggcagcagcctgcagggcgccagcggcagcagccagctgggcagcagcagcagccacagcggcagcagcggcagccacagcggcagcagcagcagccacagcagcagcagcagcagcttccagttcagcagcagcagcttccaggtgggcaatggcagcgccctgcccaccaatgacaacagctaccggggcatcctgaaccccagccagcccggccagagcagcagcagcagccagaccagcggcgtgagcagcagcggccagagcgtgagcagcaaccagaggccctgcagcagtgacatcccagacagcccctgcagcggcggccccatcgtgagccacagcggcccctacatccccagcagccacagcgtgtctgggggccagaggcctgtggtggtggtggtggaccagcacggcagcggggcccctggggtggtgcagggccccccctgcagcaatggaggcctgcccgggaagccctgcccccccatcacctctgtggacaagagctatggaggctatgaggtggtgggcggcagcagtgacagctacctggtgcccggcatgacctacagcaagggcaagatctaccctgtgggctacttcaccaaggaaaatcctgtgaagggcagccctggggtgcccagctttgctgctggcccccccatcagcgagggcaagtacttcagcagcaaccccatcatccccagccagagcgctgccagcagcgccatcgccttccagcctgtgggcaccggcggcgtgcagctgtgtggcggcggcagcacaggcagcaagggcccctgcagccccagcagcagccgggtgcccagcagcagcagcatcagcagcagcagcggcagcccctaccacccctgtggcagcgccagccagagcccctgcagccccccaggcaccggcagcttcagcagcagcagcagcagccagagcagcggcaagatcatcctgcagccctgtggcagcaagagcagcagcagcggccacccctgcatgtctgtgagcagcctgaccctgaccggcggcccagatggcagcccccacccagaccccagcgctggggccaagccctgtggcagcagcagcgctgggaagatcccctgccgcagcatccgggacatcctggcccaggtgaagcccctgggcccccagctggccgaccctgaggtgttcctgccccagggcgagctgctggacagcccctag

SEQ ID NO: 3407 - DNA, 1590 bp, Artificial Sequence; identical to SEQ ID NO: 3406
  Description of Artificial Sequence: Synthetic coding sequence

SEQ ID NO: 3408 - DNA, 255 bp, Artificial Sequence
  Description of Artificial Sequence: Synthetic coding sequence
gtgctgcacagcttcacagatgccatctttgatgagtggatgaagcgcttcaaccccccagcagatgcctggccccaggagctggcccccatcggccacaacaggatgtacaacatggtgcccttcttcccccctgtgaccaatgaggagctgttcctgaccagtgaccagctgggctacagctatgccatcgacctgcctgacttccaggccaacttcatctgcagctacctggtgtctgtgcaccaggagtag

SEQ ID NO: 3409 - DNA, 1560 bp, Artificial Sequence
  Description of Artificial Sequence: Synthetic coding sequence
atgagccccctgtggtggggcttcctgctgagctgcctgggctgcaagatcctgcccggggcccagggccagttcccccgggtgtgcatgacagtggacagcctggtgaacaaggagtgctgcccccggctgggcgctgagagcgccaacgtgtgtggcagccagcagggccggggccagtgcacagaggtgcgggctgacacccggccctggagcggcccctacatcctgaggaaccaggatgaccgggagctgtggcccaggaagttcttccacaggacctgcaagtgcaccggcaactttgctggctacaactgtggggactgcaagtttggctggacaggccccaactgtgagaggaagaagccccctgtgatccggcagaacatccacagcctgagcccccaggagcgggagcagttcctgggcgccctggacctggccaagaagagggtgcacccagactatgtgatcaccacccagcactggctgggcctgctgggccccaacggcacccagccccagtttgccaactgcagcgtgtatgacttctttgtgtggctgcactactacagcgtgcgggacaccctgctgggccctggccggccctaccgggccatcgacttcagccaccagggccctgcctttgtgacctggcaccgctaccacctgctgtgcctggagcgggacctgcagaggctgattggaaatgaaagctttgccctgccctactggaactttgccactggaagaaatgaatgtgatgtgtgcacagaccagctgtttggagctgcccggccagatgaccccaccctcatcagcaggaacagccgcttcagctcctgggagaccgtgtgtgacagcctggatgactacaaccacctggtgaccctgtgcaatggcacctatgagggcctgctgcggaggaaccagatgggcaggaacagcatgaagctgcccaccctgaaggacatccgggactgcctgagcctgcagaagtttgacaacccccccttcttccagaacagcaccttctccttcagaaatgccctggagggctttgacaaggcagatggcaccctggacagccaggtgatgagcctgcacaacctggtgcacagcttcctgaatggcaccaatgccctgccccacagcgctgccaatgaccccatctttgtggtgctgcacagcttcacagatgccatctttgatgagtggatgaagcgcttcaaccccccagcagatgcctggccccaggagctggcccccatcggccacaacaggatgtacaacatggtgcccttcttcccccctgtgaccaatgaggagctgttcctgaccagtgaccagctgggctacagctatgccatcgacctgcctgtgtctgtggaggagaccccaggctggcccaccaccctgctggtggtgatgggcaccctggtggccctggtgggcctgtttgtgctgctggccttcctgcagtaccgccgcctgaggaagggctacacccccctgatggagacccacctgagcagcaagcgctacacagaggaggcctag

SEQ ID NO: 3410 - DNA, 1659 bp, Artificial Sequence
  Description of Artificial Sequence: Synthetic coding sequence
atgagccccctgtggtggggcttcctgctgagctgcctgggctgcaagatcctgcccggggcccagggccagttcccccgggtgtgcatgacagtggacagcctggtgaacaaggagtgctgcccccggctgggcgctgagagcgccaacgtgtgtggcagccagcagggccggggccagtgcacagaggtgcgggctgacacccggccctggagcggcccctacatcctgaggaaccaggatgaccgggagctgtggcccaggaagttcttccacaggacctgcaagtgcaccggcaactttgctggctacaactgtggggactgcaagtttggctggacaggccccaactgtgagaggaagaagccccctgtgatccggcagaacatccacagcctgagcccccaggagcgggagcagttcctgggcgccctggacctggccaagaagagggtgcacccagactatgtgatcaccacccagcactggctgggcctgctgggccccaacggcacccagccccagtttgccaactgcagcgtgtatgacttctttgtgtggctgcactactacagcgtgcgggacaccctgctgggccctggccggccctaccgggccatcgacttcagccaccagggccctgcctttgtgacctggcaccgctaccacctgctgtgcctggagcgggacctgcagaggctgattggaaatgaaagctttgccctgccctactggaactttgccactggaagaaatgaatgtgatgtgtgcacagaccagctgtttggagctgcccggccagatgaccccaccctcatcagcaggaacagccgcttcagctcctgggagaccgtgtgtgacagcctggatgactacaaccacctggtgaccctgtgcaatggcacctatgagggcctgctgcggaggaaccagatgggcaggaacagcatgaagctgcccaccctgaaggacatccgggactgcctgagcctgcagaagtttgacaacccccccttcttccagaacagcaccttctccttcagaaatgccctggagggctttgacaaggcagatggcaccctggacagccaggtgatgagcctgcacaacctggtgcacagcttcctgaatggcaccaatgccctgccccacagcgctgccaatgaccccatctttgtggtgatcagcaaccggctgctgtacaatgccaccaccaacatcctggagcacgtgaggaaggagaaggccaccaaggagctgcccagcctgcacgtgctggtgctgcacagcttcacagatgccatctttgatgagtggatgaagcgcttcaaccccccagcagatgcctggccccaggagctggcccccatcggccacaacaggatgtacaacatggtgcccttcttcccccctgtgaccaatgaggagctgttcctgaccagtgaccagctgggctacagctatgccatcgacctgcctgtgtctgtggaggagaccccaggctggcccaccaccctgctggtggtgatgggcaccctggtggccctggtgggcctgtttgtgctgctggccttcctgcagtacagaaggctgaggaagggctacacccccctgatggagacccacctgagcagcaagcgctacacagaggaggcctag

SEQ ID NO: 3411 - DNA, 1347 bp, Artificial Sequence
  Description of Artificial Sequence: Synthetic coding sequence
atggcccacgtgggggactgcacccagaccccctggctgcctgtgctggtggtgtccctgatgtgcagcgcccgggcagagtacagcaactgtggagaaaatgagtactacaaccagaccaccggcctgtgccaggagtgccccccctgtggccctggagaggagccctacctgagctgtggctacggcaccaaggatgaagattatggctgtgtgccctgcccagctgagaagttcagcaaaggaggctaccagatctgccgccgccacaaggactgtgagggcttcttccgggccaccgtgctgacccctggggacatggagaatgatgctgaatgtggcccctgcctgcccggctactacatgctggagaaccggcccaggaacatctacggcatggtgtgctacagctgcctgctggccccacccaacaccaaggaatgtgtgggcgccaccagcggggccagcgccaacttccctggcaccagcggcagcagcaccctgagccccttccagcacgcccacaaggagctgagcggccagggccacctggccacagccctgatcatcgccatgagcaccatcttcatcatggccatcgccatcgtgctgatcatcatgttctacatcctgaagaccaagcccagcgccccagcctgctgcaccagccaccctgggaagtctgtggaggcccaggtgtccaaggatgaggagaagaaggaggccccagacaacgtggtgatgttcagcgagaaggatgaatttgagaagctgacagccaccccagccaagcccaccaagtcagaaaatgatgccagcagtgaaaatgagcagctgctgagccgctctgtggacagtgatgaggagcccgccccagacaagcagggcagccctgagctgtgcctgctgagcctggtgcacctggcccgggagaagagcgccaccagcaacaagtctgctggcatccagagcaggaggaagaagatcctggatgtgtatgccaacgtgtgtggggtggtggagggcctgagccccacagagctgccctttgactgcctggagaagaccagcaggatgctgagcagcacctacaacagcgagaaggctgtggtgaagacctggaggcacctggccgagagctttggcctgaagagagatgagatcggcggcatgacagatggcatgcagctgtttgaccgcatcagcacagctggctacagcatccctgagctgctgaccaagctggtgcagatcgagcggctggatgctgtggagagcctgtgtgccgacatcctggagtgggccggcgtggtgcccccagccagccagccccacgccgccagctag

SEQ ID NO: 3412 - DNA, 1443 bp, Artificial Sequence
  Description of Artificial Sequence: Synthetic coding sequence
atggcccacgtgggggactgcacccagaccccctggctgcctgtgctggtggtgtccctgatgtgcagcgcccgggcagagtacagcaactgtggagaaaatgagtactacaaccagaccaccggcctgtgccaggagtgccccccctgtggccctggagaggagccctacctgagctgtggctacggcaccaaggatgaagattatggctgtgtgccctgcccagctgagaagttcagcaaaggaggctaccagatctgccgccgccacaaggactgtgagggcttcttccgggccaccgtgctgacccctggggacatggagaatgatgctgaatgtggcccctgcctgcccggctactacatgctggagaaccggcccaggaacatctacggcatggtgtgctacagctgcctgctggccccacccaacaccaaggaatgtgtgggcgccaccagcggggccagcgccaacttccctggcaccagcggcagcagcaccctgagccccttccagcacgcccacaaggagctgagcggccagggccacctggccacagccctgatcatcgccatgagcaccatcttcatcatggccatcgccatcgtgctgatcatcatgttctacatcctgaagaccaagcccagcgcccctggagatggcccccacgcccctgtgccctgcttcctggacagccccagcaccccacctgtgggggagcccggctgcagcctgccccccctgagccctgcctgctgcaccagccaccctgggaagtctgtggaggcccaggtgtccaaggatgaggagaagaaggaggccccagacaacgtggtgatgttcagcgagaaggatgaatttgagaagctgacagccaccccagccaagcccaccaagtcagaaaatgatgccagcagtgaaaatgagcagctgctgagccgctctgtggacagtgatgaggagcccgccccagacaagcagggcagccctgagctgtgcctgctgagcctggtgcacctggcccgggagaagagcgccaccagcaacaagtctgctggcatccagagcaggaggaagaagatcctggatgtgtatgccaacgtgtgtggggtggtggagggcctgagccccacagagctgccctttgactgcctggagaagaccagcaggatgctgagcagcacctacaacagcgagaaggctgtggtgaagacctggaggcacctggccgagagctttggcctgaagagagatgagatcggcggcatgacagatggcatgcagctgtttgaccgcatcagcacagctggctacagcatccctgagctgctgaccaagctggtgcagatcgagcggctggatgctgtggagagcctgtgtgccgacatcctggagtgggccggcgtggtgcccccagccagccagccccacgccgccagctag

SEQ ID NO: 3413 - DNA, 1443 bp, Artificial Sequence; identical to SEQ ID NO: 3412
  Description of Artificial Sequence: Synthetic coding sequence

SEQ ID NO: 3414 - DNA, 957 bp, Artificial Sequence
  Description of Artificial Sequence: Synthetic coding sequence
atggactgccaggagaatgagtactgggaccagtggggccgctgtgtgacctgccagagatgtggccctggccaggagctgagcaaggactgtggctatggagagggcggagatgcctactgcacagcctgccccccccggcgctacaagagctcctggggccaccaccgctgccagagctgcatcacctgtgctgtgatcaacagagtgcagaaggtgaactgcacagccaccagcaatgctgtgtgtggggactgcctgccccgcttctacaggaagacccgcatcggcggcctgcaggaccaggagtgcatcccctgcaccaagcagacccccaccagcgaggtgcagtgtgccttccagctgagcctggtggaggccgacacccccaccgtgcccccccaggaggccaccctggtggccctggtgagcagcctgctggtggtgttcaccctggccttcctgggcctcttcttcctgtactgcaagcagttcttcaacagacactgccagcgggagaagctgatcatcttcagtgaccctgtgcctgccagcctgaacctgatccctgagtttgctgggggcctgctgcagtttgaagctgacaagacagccaaggaggagagcctcttccctgtgccccccagcaaggagaccagcgctgagagccaggtgtctgagaacatcttccagacccagcccctgaaccccatcctggaggatgactgcagcagcaccagcggcttccccacccaggagagcttcaccatggccagctgcaccagcgagagccacagccactgggtgcacagccccatcgagtgcacagagctggacctgcagaagttcagcagcagcgccagctacaccggggctgagaccctgggcggcaacacagtggagagcactggagaccggctggagctgaatgtgccctttgaggtgcccagcccctag

SEQ ID NO: 3415 - DNA, 894 bp, Artificial Sequence
  Description of Artificial Sequence: Synthetic coding sequence
atggactgccaggagaatgagtactgggaccagtggggccgctgtgtgacctgccagagatgtggccctggccaggagctgagcaaggactgtggctatggagagggcggagatgcctactgcacagcctgccccccccggcgctacaagagctcctggggccaccaccgctgccagagctgcatcacctgtgctgtgatcaacagagtgcagaaggtgaactgcacagccaccagcaatgctgtgtgtggggactgcctgccccgcttctacaggaagacccgcatcggcggcctgcaggaccaggagtgcatcccctgcaccaagcagacccccaccagcgaggtgcagtgtgccttccagctgagcctggtggaggccgacacccccaccgtgcccccccaggaggccaccctggtggccctggtgagcagcctgctggtggtgttcaccctggccttcctgggcctcttcttcctgtactgcaagcagttcttcaacagacactgccagagaggaggcctgctgcagtttgaggccgacaagacagccaaggaggagagcctcttccctgtgccccccagcaaggagaccagcgctgagagccaggtgtctgagaacatcttccagacccagcccctgaaccccatcctggaggatgactgcagcagcaccagcggcttccccacccaggagagcttcaccatggccagctgcaccagcgagagccacagccactgggtgcacagccccattgaatgtacagagctggacctgcagaagttcagcagcagcgccagctacacaggagctgagaccctgggcggcaacacagtggagagcactggagaccggctggagctgaatgtgccctttgaggtgcccagcccctag

SEQ ID NO: 3416 - DNA, 894 bp, Artificial Sequence; identical to SEQ ID NO: 3415
  Description of Artificial Sequence: Synthetic coding sequence

SEQ ID NO: 3417 - DNA, 957 bp, Artificial Sequence; identical to SEQ ID NO: 3414
  Description of Artificial Sequence: Synthetic coding sequence

SEQ ID NO: 3418 - DNA, 522 bp, Artificial Sequence
  Description of Artificial Sequence: Synthetic coding sequence
atgagcacaggcaccaatggagatggagtgtccccagccaacggggtggtgctggacaggagctacccccgctgcctgcctgtggagctgagcggcggccgctacacccacagcgcccccagcggcggccacacctgctgcaccggcggcctgctgcagtttgaggccgacaagacagccaaggaggagagcctcttccctgtgccccccagcaaggagaccagcgctgagagccaggtgtctgagaacatcttccagacccagcccctgaaccccatcctggaggatgactgcagcagcaccagcggcttccccacccaggagagcttcaccatggccagctgcaccagcgagagccacagccactgggtgcacagccccattgaatgtacagagctggacctgcagaagttcagcagcagcgccagctacacaggagctgagaccctgggcggcaacacagtggagagcactggagaccggctggagctgaatgtgccctttgaggtgcccagcccctag

SEQ ID NO: 3419 - DNA, 894 bp, Artificial Sequence; identical to SEQ ID NO: 3415
  Description of Artificial Sequence: Synthetic coding sequence

SEQ ID NO: 3420 - DNA, 648 bp, Artificial Sequence
  Description of Artificial Sequence: Synthetic coding sequence
atgggcctgcggaccaccaagcagatgggccggggcaccaaggcccctggccaccaggaggaccacatggtgaaggagcctgtggaggacacagaccccagcaccctgtccttcaacatgtctgacaagtaccccatccaggacacagagctgcccaaggccgaggagtgtgacaccatcaccctgaactgccccaggaacagcgacatgaagaaccagggcgaggagaatggcttcccagacagcactggagaccccctgcctgagatcagcaaggacaacagctgcaaggagaactgcacctgcagcagctgcctgctgcgggcccccaccatcagtgacctgctgaatgaccaggacctgctggatgtgatccgcatcaagctggacccctgccaccccaccgtgaagaactggaggaactttgccagcaagtggggcatgtcctatgatgagctgtgcttcctggagcagaggccccagagccccaccctggagttcctgctgaggaacagccagaggacagtgggccagctgatggagctgtgccgcctgtaccacagagcagatgtggagaaggtgctgcggcgctgggtggatgaggagtggcccaagcgggagcggggggaccccagccgccacttctag

SEQ ID NO: 3421 - DNA, 618 bp, Artificial Sequence
  Description of Artificial Sequence: Synthetic coding sequence
atggccagcccagatgaccccctgcgggctgaccacatggtgaaggagcctgtggaggacacagaccccagcaccctgtccttcaacatgtctgacaagtaccccatccaggacacagagctgcccaaggccgaggagtgtgacaccatcaccctgaactgccccaggaacagcgacatgaagaaccagggcgaggagaatggcttcccagacagcactggagaccccctgcctgagatcagcaaggacaacagctgcaaggagaactgcacctgcagcagctgcctgctgcgggcccccaccatcagtgacctgctgaatgaccaggacctgctggatgtgatccgcatcaagctggacccctgccaccccaccgtgaagaactggaggaactttgccagcaagtggggcatgtcctatgatgagctgtgcttcctggagcagaggccccagagccccaccctggagttcctgctgaggaacagccagaggacagtgggccagctgatggagctgtgccgcctgtaccacagagcagatgtggagaaggtgctgcggcgctgggtggatgaggagtggcccaagcgggagcggggggaccccagccgccacttctag

SEQ ID NO: 3422 - DNA, 255 bp, Artificial Sequence
  Description of Artificial Sequence: Synthetic coding sequence
atggtgaaggagcctgtggaggacacagaccccagcaccctgtccttcaacatgtctgacaagtaccccatccaggacacagagctgcccaaggccgaggagtgtgacaccatcaccctgaactgccccaggaacagcgacatgaagaaccagggcgaggagaatggcttcccagacagcactggagaccccctgcctgagatcagcaaggacaacagctgcaaggagaactgcacctgcagcagctgcctgtag

SEQ ID NO: 3423 - DNA, 2175 bp, Artificial Sequence
  Description of Artificial Sequence: Synthetic coding sequence
atggccggcctgacagctgctgcccccaggcctggggtgctgctgctgctgctgagcatcctgcaccccagcaggcctgggggcgtgcctggggccatccctgggggcgtgcctgggggcgtcttctacccaggggccggcctgggcgccctgggcggcggggccctgggccctgggggcaagcccctgaagcctgtgcctgggggcctggccggggccggcctgggcgccggcctgggcgccttccctgctgtgaccttccctggggccctggtgcctggaggagtggctgatgctgctgctgcctacaaggccgccaaggccggggccggcctgggcggcgtgcctggggtgggcggcctgggcgtgtctgctggagctgtggtgccccagcccggggccggcgtgaagccaggcaaggtgcctggggtgggcctgcccggggtgtacccaggaggagtgctgcccggggcccgcttccctggggtgggcgtgctgcccggggtgcccactggagctggggtgaagcccaaggcccctggggtgggcggggcctttgctggcatccctggggtgggcccctttggaggcccccagcccggggtgcccctgggctaccccatcaaggcccccaagctgcccggcggctacggcctgccctacaccaccgggaagctgccctacggctacggccctgggggcgtggccggggctgctgggaaggccggctaccccaccggcaccggggtgggcccccaggccgctgctgctgctgctgccaaggctgctgccaagtttggagctggagctgctggggtgctgcccggggtgggcggggccggcgtgcctggggtgcctggggccatccctggcatcggcggcattgctggggtgggcaccccagctgctgctgctgctgctgctgctgctgccaaggccgccaagtacggggctgctgctggcctggtgcctgggggccctggctttggacctggggtggtgggcgtgcctggagctggggtgcctggggtgggcgtgcctggagctggcatccctgtggtgcctggagctggcatccctggagctgctgtgcctggggtggtgtccccagaggccgccgccaaggctgctgccaaggccgccaagtatggagcccggcctggggtgggcgtgggcggcatccccacctatggagtgggcgccggcggcttccctggctttggagtgggcgtgggcggcatccctggggtggccggcgtgcctggggtgggcggcgtgcctggggtgggcggcgtgcctggggtgggcatcagccctgaggcccaggccgctgctgctgccaaggccgccaagtatggagtgggcaccccagctgctgctgctgccaaggctgctgccaaggccgcccagtttggcctggtgcctggggtgggcgtggcccctggggtgggcgtggcccctggggtgggcgtggcccctggggtgggcctggcccctggggtgggcgtggcccctggggtgggcgtggcccctggggtgggcgtggcccctggcatcggccctggaggagtggccgctgctgccaagtctgctgccaaggtggccgccaaggcccagctgcgggctgctgctggcctgggcgccggcatccctggcctgggcgtgggcgtgggcgtgcccggcctgggcgtgggcgctggggtgcccggcctgggcgtgggcgccggcgtgcccggctttggagctgtgcctggggccctggccgccgccaaggccgccaagtatggagctgctgtgcctggggtgctgggcggcctgggcgccctgggcggcgtgggcatccctggaggagtggtgggcgccggccctgctgctgctgctgctgctgccaaggctgctgccaaggccgcccagtttggcctggtgggcgctgctggcctgggcggcctgggcgtgggcggcctgggcgtgcctggggtgggcggcctgggcggcatccccccagctgctgctgccaaggccgccaagtatggagctgctggcctgggcggcgtgctgggcggggccggccagttccccctgggcggcgtggccgcccggcccggcttcggcctgagccccatcttccctgggggcgcctgcctgggcaaggcctgtggcaggaagaggaagtag

SEQ ID NO: 3424 - DNA, 2274 bp, Artificial Sequence
  Description of Artificial Sequence: Synthetic coding sequence
atggccggcctgacagctgctgcccccaggcctggggtgctgctgctgctgctgagcatcctgcaccccagcaggcctgggggcgtgcctggggccatccctgggggcgtgcctgggggcgtcttctacccaggggccggcctgggcgccctgggcggcggggccctgggccctgggggcaagcccctgaagcctgtgcctgggggcctggccggggccggcctgggcgccggcctgggcgccttccctgctgtgaccttccctggggccctggtgcctggaggagtggctgatgctgctgctgcctacaaggccgccaaggccggggccggcctgggcggcgtgcctggggtgggcggcctgggcgtgtctgctggagctgtggtgccccagcccggggccggcgtgaagccaggcaaggtgcctggggtgggcctgcccggggtgtacccaggaggagtgctgcccggggcccgcttccctggggtgggcgtgctgcccggggtgcccactggagctggggtgaagcccaaggcccctggggtgggcggggcctttgctggcatccctggggtgggcccctttggaggcccccagcccggggtgcccctgggctaccccatcaaggcccccaagctgcccggcggctacggcctgccctacaccaccgggaagctgccctacggctacggccctgggggcgtggccggggctgctgggaaggccggctaccccaccggcaccggggtgggcccccaggccgctgctgctgctgctgccaaggctgctgccaagtttggagctggagctgctggggtgctgcccggggtgggcggggccggcgtgcctggggtgcctggggccatccctggcatcggcggcattgctggggtgggcaccccagctgctgctgctgctgctgctgctgctgccaaggccgccaagtacggggctgctgctggcctggtgcctgggggccctggctttggacctggggtggtgggcgtgcctggagctggggtgcctggggtgggcgtgcctggagctggcatccctgtggtgcctggagctggcatccctggagctgctgtgcctggggtggtgtccccagaggccgccgccaaggctgctgccaaggccgccaagtatggagcccggcctggggtgggcgtgggcggcatccccacctatggagtgggcgccggcggcttccctggctttggagtgggcgtgggcggcatccctggggtggccggcgtgcctggggtgggcggcgtgcctggggtgggcggcgtgcctggggtgggcatcagccctgaggcccaggccgctgctgctgccaaggccgccaagtatggagtgggcaccccagctgctgctgctgccaaggctgctgccaaggccgcccagtttggcctggtgcctggggtgggcgtggcccctggggtgggcgtggcccctggggtgggcgtggcccctggggtgggcctggcccctggggtgggcgtggcccctggggtgggcgtggcccctggggtgggcgtggcccctggcatcggccctggaggagtggccgctgctgccaagtctgctgccaaggtggccgccaaggcccagctgcgggctgctgctggcctgggcgccggcatccctggcctgggcgtgggcgtgggcgtgcccggcctgggcgtgggcgctggggtgcccggcctgggcgtgggcgccggcgtgcccggctttggagctggagcagatgaaggagtgagaagaagcctgagccctgagctgcgggagggggaccccagcagcagccagcacctgcccagcacccccagcagcccccgggtgcctggggccctggccgccgccaaggccgccaagtacggggctgctgtgcctggggtgctgggcggcctgggcgccctgggcggcgtgggcatccctgggggcgtggtgggcgccggccctgctgctgctgctgctgctgccaaggccgccgccaaggccgcccagtttggcctggtgggcgccgccggcctgggcggcctgggcgtgggcggcctgggcgtgcctggggtgggcggcctgggcggcatccccccagctgctgctgccaaggccgccaagtacggggctgctggcctgggcggcgtgctgggcggggccggccagttccccctgggcggcgtggccgcccggcccggcttcggcctgagccccatcttccctggaggagcctgcctgggcaaggcctgtggcaggaagaggaagtag

SEQ ID NO: 3425 - DNA, 2136 bp, Artificial Sequence
  Description of Artificial Sequence: Synthetic coding sequence
atggccggcctgacagctgctgcccccaggcctggggtgctgctgctgctgctgagcatcctgcaccccagcaggcctgggggcgtgcctggggccatccctgggggcgtgcctgggggcgtcttctacccaggggccggcctgggcgccctgggcggcggggccctgggccctgggggcaagcccctgaagcctgtgcctgggggcctggccggggccggcctgggcgccggcctgggcgccttccctgctgtgaccttccctggggccctggtgcctggaggagtggctgatgctgctgctgcctacaaggccgccaaggccggggccggcctgggcggcgtgcctggggtgggcggcctgggcgtgtctgctgcccccagcgtgcctggagctgtggtgccccagcctggagctggggtgaagccaggcaaggtgcctggggtgggcctgcccggggtgtacccaggcggcgtgctgcccggggcccgcttccctggggtgggcgtgctgcccggggtgcccaccggggccggcgtgaagcccaaggcccctggggtgggcggggcctttgctggcatccctggggtgggcccctttggaggcccccagcccggggtgcccctgggctaccccatcaaggcccccaagctgcccggcggctacggcctgccctacaccaccgggaagctgccctacggctacggccctggaggagtggccggggccgccggcaaggccggctaccccactggaactggagtgggcccccaggccgctgctgctgctgctgccaaggccgccgccaagtttggagctggagctgctggggtgctgcccggggtgggcggggccggcgtgcctggggtgcctggggccatccctggcattggaggcattgctggggtgggcaccccagctgctgctgctgctgctgctgctgctgccaaggccgccaagtatggagctgctgctggcctggtgcctgggggccctggcttcggccctggggtggtgggcgtgcctggggccggcgtgcctggggtgggcgtgcctggggccggcatccctgtggtgcctggggccggcatccctggagctgctgtgcctggggtggtgtccccagaggccgccgccaaggccgccgccaaggccgccaagtacggggcccggcctggggtgggcgtgggcggcatccccacctacggcgtgggcgctgggggcttccctggcttcggcgtgggcgtgggcggcatccctggggtggccggcgtgcctggggtgggcggcgtgcctggggtgggcggcgtgcctggggtgggcatcagccctgaggcccaggccgctgctgctgccaaggccgccaagtatggagtgggcaccccagctgctgctgctgccaaggccgccgccaaggccgcccagtttggcctggtgcctggggtgggcgtggcccctggggtgggcgtggcccctggggtgggcgtggcccctggggtgggcctggcccctggggtgggcgtggcccctggggtgggcgtggcccctggggtgggcgtggcccctggcatcggccctgggggcgtggccgccgccgccaagtctgctgccaaggtggccgccaaggcccagctgcgggctgctgctggcctgggcgccggcatccctggcctgggcgtgggcgtgggcgtgcccggcctgggcgtgggcgccggcgtgcccggcctgggcgtgggcgctggggtgcccggctttggagctgtgcctggggccctggccgccgccaaggccgccaagtacggggctgctgtgcctggggtgctgggcggcctgggcgccctgggcggcgtgggcatccctgggggcgtggtgggcgccggccctgctgctgctgctgctgctgccaaggccgccgccaaggccgcccagtttggcctggtgggcgccgccggcctgggcggcctgggcgtgggcggcctgggcgtgcctggggtgggcggcctgggcggcatccccccagctgctgctgccaaggccgccaagtatggagtggccgcccggcccggcttcggcctgagccccatcttccctggaggagcctgcctgggcaaggcctgtggcaggaagaggaagtag

SEQ ID NO: 3426 - DNA, 2379 bp, Artificial Sequence
  Description of Artificial Sequence: Synthetic coding sequence
atggccggcctgacagctgctgcccccaggcctggggtgctgctgctgctgctgagcatcctgcaccccagcaggcctgggggcgtgcctggggccatccctgggggcgtgcctgggggcgtcttctacccaggggccggcctgggcgccctgggcggcggggccctgggccctgggggcaagcccctgaagcctgtgcctgggggcctggccggggccggcctgggcgccggcctgggcgccttccctgctgtgaccttccctggggccctggtgcctggaggagtggctgatgctgctgctgcctacaaggccgccaaggccggggccggcctgggcggcgtgcctggggtgggcggcctgggcgtgtctgctggagctgtggtgccccagcccggggccggcgtgaagccaggcaaggtgcctggggtgggcctgcccggggtgtacccaggaggagtgctgcccggggcccgcttccctggggtgggcgtgctgcccggggtgcccactggagctggggtgaagcccaaggcccctggggtgggcggggcctttgctggcatccctggggtgggcccctttggaggcccccagcccggggtgcccctgggctaccccatcaaggcccccaagctgcccggcggctacggcctgccctacaccaccgggaagctgccctacggctacggccctgggggcgtggccggggctgctgggaaggccggctaccccaccggcaccggggtgggcccccaggccgctgctgctgctgctgccaaggctgctgccaagtttggagctggagctgctggggtgctgcccggggtgggcggggccggcgtgcctggggtgcctggggccatccctggcatcggcggcattgctggggtgggcaccccagctgctgctgctgctgctgctgctgctgccaaggccgccaagtacggggctgctgctggcctggtgcctgggggccctggctttggacctggggtggtgggcgtgcctggagctggggtgcctggggtgggcgtgcctggagctggcatccctgtggtgcctggagctggcatccctggagctgctgtgcctggggtggtgtccccagaggccgccgccaaggctgctgccaaggccgccaagtatggagcccggcctggggtgggcgtgggcggcatccccacctatggagtgggcgccggcggcttccctggctttggagtgggcgtgggcggcatccctggggtggccggcgtgcctggggtgggcggcgtgcctggggtgggcggcgtgcctggggtgggcatcagccctgaggcccaggccgctgctgctgccaaggccgccaagtacggggctgctggagctggggtgctgggcggcctggtgcctggggcccctggagctgtgcctggggtgcccggcactggaggagtgcctggggtgggcaccccagctgctgctgctgccaaggccgccgccaaggccgcccagtttgccctgctgaacctggccggcctggtgcctggggtgggcgtggcccctggggtgggcgtggcccctggggtgggcgtggcccctggggtgggcctggcccctggggtgggcgtggcccctggggtgggcgtggcccctggggtgggcgtggcccctggcatcggccctgggggcgtggccgccgccgccaagtctgctgccaaggtggccgccaaggcccagctgcgggctgctgctggcctgggcgccggcatccctggcctgggcgtgggcgtgggcgtgcccggcctgggcgtgggcgccggcgtgcccggcctgggcgtgggcgctggggtgcccggctttggagctggagcagatgagggcgtgcggcgcagcctgagccctgagctgcgggagggggaccccagcagcagccagcacctgcccagcacccccagcagcccccgggtgcctggggccctggccgccgccaaggccgccaagtatggagctgctgtgcctggggtgctgggcggcctgggcgccctgggcggcgtgggcatccctggaggagtggtgggcgccggccctgctgctgctgctgctgctgccaaggctgctgccaaggccgcccagtttggcctggtgggcgctgctggcctgggcggcctgggcgtgggcggcctgggcgtgcctggggtgggcggcctgggcggcatccccccagctgctgctgccaaggccgccaagtatggagctgctggcctgggcggcgtgctgggcggggccggccagttccccctgggcggcgtggccgcccggcccggcttcggcctgagccccatcttccctgggggcgcctgcctgggcaaggcctgtggcaggaagaggaagtag

SEQ ID NO: 3427 - DNA, 2034 bp, Artificial Sequence
  Description of Artificial Sequence: Synthetic coding sequence
atggccggcctgacagctgctgcccccaggcctggggtgctgctgctgctgctgagcatcctgcaccccagcaggcctgggggcgtgcctggggccatccctgggggcgtgcctgggggcgtcttctacccagccctgggccctgggggcaagcccctgaagcctgtgcctgggggcctggccggggccggcctgggcgccggcctgggcgccttccctgctgtgaccttccctggggccctggtgcctggaggagtggctgatgctgctgctgcctacaaggccgccaaggccggggccggcctgggcggcgtgcctggggtgggcggcctgggcgtgtctgctggagctgtggtgccccagcccggggccggcgtgaagccaggcaaggtgcctggggtgggcctgcccggggtgtacccaggaggagtgctgcccggggcccgcttccctggggtgggcgtgctgcccggggtgcccactggagctggggtgaagcccaaggcccctggggtgggcggggcctttgctggcatccctggggtgggcccctttggaggcccccagcccggggtgcccctgggctaccccatcaaggcccccaagctgcccggcggctacggcctgccctacaccaccgggaagctgccctacggctacggccctgggggcgtggccggggctgctgggaaggccggctaccccaccggcaccggggtgggcccccaggccgctgctgctgctgctgccaaggctgctgccaagtttggagctggagctgctggggtgctgcccggggtgggcggggccggcgtgcctggggtgcctggggccatccctggcatcggcggcattgctggggtgggcaccccagctgctgctgctgctgctgctgctgctgccaaggccgccaagtacggggctgctgctggcctggtgcctgggggccctggctttggacctggggtggtgggcgtgcctggagctggggtgcctggggtgggcgtgcctggagctggcatccctgtggtgcctggagctggcatccctggagctgctgtgcctggggtggtgtccccagaggccgccgccaaggctgctgccaaggccgccaagtatggagcccggcctggggtgggcgtgggcggcatccccacctatggagtgggcgccggcggcttccctggctttggagtgggcgtgggcggcatccctggggtggccggcgtgcctggggtgggcggcgtgcctggggtgggcggcgtgcctggggtgggcatcagccctgaggcccaggccgctgctgctgccaaggccgccaagtatggcctggtgcctggggtgggcgtggcccctggggtgggcgtggcccctggggtgggcgtggcccctggggtgggcctggcccctggggtgggcgtggcccctggggtgggcgtggcccctggggtgggcgtggcccctggcatcggccctgggggcgtggccgccgccgccaagtctgctgccaaggtggccgccaaggcccagctgcgggctgctgctggcctgggcgccggcatccctggcctgggcgtgggcgtgggcgtgcccggcctgggcgtgggcgccggcgtgcccggcctgggcgtgggcgctggggtgcccggctttggagctgtgcctggggccctggccgccgccaaggccgccaagtacggggctgctgtgcctggggtgctgggcggcctgggcgccctgggcggcgtgggcatccctgggggcgtggtgggcgccggccctgctgctgctgctgctgctgccaaggccgccgccaaggccgcccagtttggcctggtgggcgccgccggcctgggcggcctgggcgtgggcggcctgggcgtgcctggggtgggcggcctgggcggcatccccccagctgctgctgccaaggccgccaagtatggagtggccgcccggcccggcttcggcctgagccccatcttccctggaggagcctgcctgggcaaggcctgtggcaggaagaggaagtag

SEQ ID NO: 3428 - DNA, 2118 bp, Artificial Sequence
  Description of Artificial Sequence: Synthetic coding sequence
atggccggcctgacagctgctgcccccaggcctggggtgctgctgctgctgctgagcatcctgcaccccagcaggcctgggggcgtgcctggggccatccctgggggcgtgcctgggggcgtcttctacccaggggccggcctgggcgccctgggcggcggggccctgggccctgggggcaagcccctgaagcctgtgcctgggggcctggccggggccggcctgggcgccggcctgggcgccttccctgctgtgaccttccctggggccctggtgcctggaggagtggctgatgctgctgctgcctacaaggccgccaaggccggggccggcctgggcggcgtgcctggggtgggcggcctgggcgtgtctgctggagctgtggtgccccagcccggggccggcgtgaagccaggcaaggtgcctggggtgggcctgcccggggtgtacccaggaggagtgctgcccggggcccgcttccctggggtgggcgtgctgcccggggtgcccactggagctggggtgaagcccaaggcccctggggtgggcggggcctttgctggcatccctggggtgggcccctttggaggcccccagcccggggtgcccctgggctaccccatcaaggcccccaagctgcccggcggctacggcctgccctacaccaccgggaagctgccctacggctacggccctgggggcgtggccggggctgctgggaaggccggctaccccaccggcaccggggtgggcccccaggccgctgctgctgctgctgccaaggctgctgccaagtttggagctggagctgctggggtgctgcccggggtgggcggggccggcgtgcctggggtgcctggggccatccctggcatcggcggcattgctggggtgggcaccccagctgctgctgctgctgctgctgctgctgccaaggccgccaagtacggggctgctgctggcctggtgcctgggggccctggctttggacctggggtggtgggcgtgcctggagctggggtgcctggggtgggcgtgcctggagctggcatccctgtggtgcctggagctggcatccctggagctgctgtgcctggggtggtgtccccagaggccgccgccaaggctgctgccaaggccgccaagtatggagcccggcctggggtgggcgtgggcggcatccccacctatggagtgggcgccggcggcttccctggctttggagtgggcgtgggcggcatccctggggtggccggcgtgcctggggtgggcggcgtgcctggggtgggcggcgtgcctggggtgggcatcagccctgaggcccaggccgctgctgctgccaaggccgccaagtatggcctggtgcctggggtgggcgtggcccctggggtgggcgtggcccctggggtgggcgtggcccctggggtgggcctggcccctggggtgggcgtggcccctggggtgggcgtggcccctggggtgggcgtggcccctggcatcggccctgggggcgtggccgccgccgccaagtctgctgccaaggtggccgccaaggcccagctgcgggctgctgctggcctgggcgccggcatccctggcctgggcgtgggcgtgggcgtgcccggcctgggcgtgggcgccggcgtgcccggcctgggcgtgggcgctggggtgcccggctttggagctgtgcctggggccctggccgccgccaaggccgccaagtacggggctgctgtgcctggggtgctgggcggcctgggcgccctgggcggcgtgggcatccctgggggcgtggtgggcgccggccctgctgctgctgctgctgctgccaaggccgccgccaaggccgcccagtttggcctggtgggcgccgccggcctgggcggcctgggcgtgggcggcctgggcgtgcctggggtgggcggcctgggcggcatccccccagctgctgctgccaaggccgccaagtacggggctgctggcctgggcggcgtgctgggcggggccggccagttccccctgggcggcgtggccgcccggcccggcttcggcctgagccccatcttccctggaggagcctgcctgggcaaggcctgtggcaggaagaggaagtag

SEQ ID NO: 3429 - DNA, 645 bp, Artificial Sequence
  Description of Artificial Sequence: Synthetic coding sequence
atggccggcctgacagctgctgcccccaggcctggggtgctgctgctgctgctgagcatcctgcaccccagcaggcctgggggcgtgcctggggccatccctgggggcgtgcctgggggcgtcttctacccaggggccggcctgggcgccctgggcggcggggccctgggccctgggggcaagcccctgaagcctgtgcctgggggcctggccggggccggcctgggcgccggcctgggcgccttccctgctgtgaccttccctggggccctggtgcctggaggagtggctgatgctgctgctgcctacaaggccgccaaggccggggccggcctgggcggcgtgcctggggtgggcggcctgggcgtgtctgctggagctgtggtgccccagcccggggccggcgtgaagccaggcaaggtgcctggggtgggcctgcccggggtgtacccaggaggagtgctgcccggggtgggcccctttggaggcccccagcccggggtgcccctgggctaccccatcaaggcccccaagctgcccggcggctacggcctgccctacaccaccgggaagctgccctacggctacggccctgggggcgtggccggggctgctgggaaggccggctaccccaccggcacctag

SEQ ID NO: 3430 - DNA, 504 bp, Artificial Sequence
  Description of Artificial Sequence: Synthetic coding sequence
atggccggcctgacagctgctgcccccaggcctggggtgctgctgctgctgctgagcatcctgcaccccagcaggcctgggggcgtgcctggggccatccctgggggcgtgcctgggggcgtcttctacccaggggccggcctgggcgccctgggcggcggggccctgggccctgggggcaagcccctgaagcctgtgcctgggggcctggccggggccggcctgggcgccggcctgggcgccttccctgctgtgaccttccctggggccctggtgcctggaggagtggctgatgctgctgctgcctacaaggccgccaaggccggcgtgggcccctttggaggcccccagcccggggtgcccctgggctaccccatcaaggcccccaagctgcccggcggctacggcctgccctacaccaccgggaagctgccctacggctacggccctgggggcgtggccggggctgctgggaaggccggctaccccaccggcaccggctag

SEQ ID NO: 3431 - DNA, 2079 bp, Artificial Sequence
  Description of Artificial Sequence: Synthetic coding sequence
atggccggcctgacagctgctgcccccaggcctggggtgctgctgctgctgctgagcatcctgcaccccagcaggcctgggggcgtgcctggggccatccctgggggcgtgcctgggggcgtcttctacccaggggccggcctgggcgccctgggcggcggggccctgggccctgggggcaagcccctgaagcctgtgcctgggggcctggccggggccggcctgggcgccggcctgggcgccttccctgctgtgaccttccctggggccctggtgcctggaggagtggctgatgctgctgctgcctacaaggccgccaaggccggggccggcctgggcggcgtgcctggggtgggcggcctgggcgtgtctgctgcccccagcgtgcctggagctgtggtgccccagcctggagctggggtgaagccaggcaaggtgcctggggtgggcctgcccggggtgtacccaggcggcgtgctgcccggggcccgcttccctggggtgggcgtgctgcccggggtgcccaccggggccggcgtgaagcccaaggcccctggggtgggcggggcctttgctggcatccctggggtgggcccctttggaggcccccagcccggggtgcccctgggctaccccatcaaggcccccaagctgcccggcggctacggcctgccctacaccaccgggaagctgccctacggctacggccctggaggagtggccggggccgccggcaaggccggctaccccactggaactggagtgggcccccaggccgctgctgctgctgctgccaaggccgccgccaagtttggagctggagctgctggggtgctgcccggggtgggcggggccggcgtgcctggggtgcctggggccatccctggcattggaggcattgctggggtgggcaccccagctgctgctgctgctgctgctgctgctgccaaggccgccaagtatggagctgctgctggcctggtgcctgggggccctggcttcggccctggggtggtgggcgtgcctggggccggcgtgcctggggtgggcgtgcctggggccggcatccctgtggtgcctggggccggcatccctggagctgctgtgcctggggtggtgtccccagaggccgccgccaaggccgccgccaaggccgccaagtacggggcccggcctggggtgggcgtgggcggcatccccacctacggcgtgggcgctgggggcttccctggcttcggcgtgggcgtgggcggcatccctggggtggccggcgtgcctggggtgggcggcgtgcctggggtgggcggcgtgcctggggtgggcatcagccctgaggcccaggccgctgctgctgccaaggccgccaagtatggcctggtgcctggggtgggcgtggcccctggggtgggcgtggcccctggggtgggcgtggcccctggggtgggcctggcccctggggtgggcgtggcccctggggtgggcgtggcccctggggtgggcgtggcccctggcatcggccctggaggagtggccgctgctgccaagtctgctgccaaggtggccgccaaggcccagctgcgggctgctgctggcctgggcgccggcatccctggcctgggcgtgggcgtgggcgtgcccggcctgggcgtgggcgctggggtgcccggcctgggcgtgggcgccggcgtgcccggctttggagctgtgcctggggccctggccgccgccaaggccgccaagtatggagctgctgtgcctggggtgctgggcggcctgggcgccctgggcggcgtgggcatccctggaggagtggtgggcgccggccctgctgctgctgctgctgctgccaaggctgctgccaaggccgcccagtttggcctggtgggcgctgctggcctgggcggcctgggcgtgggcggcctgggcgtgcctggggtgggcggcctgggcggcatccccccagctgctgctgccaaggccgccaagtatggagtggccgcccggcccggcttcggcctgagccccatcttccctgggggcgcctgcctgggcaaggcctgtggcaggaagaggaagtag

SEQ ID NO: 3432 - DNA, 507 bp, Artificial Sequence
  Description of Artificial Sequence: Synthetic coding sequence
atggccggcctgacagctgctgcccccaggcctggggtgctgctgctgctgctgagcatcctgcaccccagcaggcctgggggcgtgcctggggccatccctgggggcgtgcctgggggcgtcttctacccaggggccggcctgggcgccctgggcggcggggccctgggccctgggggcaagcccctgaagccaggagtgggcccctttggaggcccccagcccggggtgcccctgggctaccccatcaaggcccccaagctgcccggctacggccctggaggagtggccggggccgccggcaaggccggctaccccactggaactggagtgggcccccaggccgctgctgctgctgctgccaaggccgccgccaagtttggagctggagctgctggggtgctgcccggggtgggcggggccggcgtgcctggggtgcctggggccatccctggcattggaggcattgctggggtgggcaccccagctgctgctgctgctgcctag

SEQ ID NO: 3433 - DNA, 885 bp, Artificial Sequence
  Description of Artificial Sequence: Synthetic coding sequence
atggccggcctgacagctgctgcccccaggcctggggtgctgctgctgctgctgagcatcctgcaccccagcaggcctgggggcgtgcctggggccatccctgggggcgtgcctgggggcgtcttctacccaggggccggcctgggcgccctgggcggcggggccctgggccctgggggcaagcccctgaagccaggcctgggcgccttccctgctgtgaccttccctggggccctggtgcctggaggagtggctgatgctgctgctgcctacaaggccgccaaggccggggccggcctgggcggcgtgcctggggtgggcggcctgggcgtgtctgctggagctgtggtgccccagcccggggccggcgtgaagccaggcaaggtgcctggggtgggcctgcccggggtgtacccaggaggagtgctgcccggggcccgcttccctggggtgggcgtgctgcccggggtgcccactggagctggggtgaagcccaaggcccctggggtgggcccctttggaggcccccagcccggggtgcccctgggctaccccatcaaggcccccaagctgcccggcggctacggcctgccctacaccaccgggaagctgccctacggctacggccctgggggcgtggccggggctgctgggaaggccggctaccccaccggcaccggggtgggcccccaggccgctgctgctgctgctgccaaggctgctgccaagtttggagctggagctgctggggtgctgcccggggtgggcggggccggcgtgcctggggtgcctggggccatccctggcatcggcggcattgctggggtgggcaccccagctgctgctgctgctgctgctgctgctgccaaggccgccaagtactag

SEQ ID NO: 3434 - DNA, 531 bp, Artificial Sequence
  Description of Artificial Sequence: Synthetic coding sequence
atggccggcctgacagctgctgcccccaggcctggggtgctgctgctgctgctgagcatcctgcaccccagcaggcctgggggcgtgcctggggccatccctgggggcgtgcctgggggcgtcttctacccaggggccggcctgggcgccctgggcggcggggccctgggccctgggggcaagcccctgaagcctgtgcctgggggcctggccggggccggcctgggcgccggcctgggcgccttccctgctgtgaccttccctggggccctggtgcctggaggagtggctgatgctgctgctgcctacaaggccgccaaggccggggccggcctgggcggcgtgcctggggtgggcggcctgggcgtgtctgctggagctgtggtgccccagcccggggccggcgtgaagccaggcaaggtgcctggggtgggcggggcctttgctggcatccctggggtgggcccctttggaggcccccagcccggggtgcccctgggctaccccatcaaggcccccaagctgccctag

SEQ ID NO: 3435 - DNA, 1992 bp, Artificial Sequence
  Description of Artificial Sequence: Synthetic coding sequence
atggccggcctgacagctgctgcccccaggcctggggtgctgctgctgctgctgagcatcctgcaccccagcaggcctgggggcgtgcctggggccatccctgggggcgtgcctgggggcgtcttctacccaggggccggcctgggcgccctgggcggcggggccctgggccctgggggcaagcccctgaagcctgtgcctgggggcctggccggggccggcctgggcgctggggccggcctgggcggcgtgcctggggtgggcggcctgggcgtgtctgctggagctgtggtgccccagcctggagctggggtgaagccaggcaaggtgcctggggtgggcctgcccggggtgtacccaggcggcgtgctgcccggggcccgcttccctggggtgggcgtgctgcccggggtgcccaccggggccggcgtgaagcccaaggcccctggggtgggcggggcctttgctggcatccctggggtgggcccctttggaggcccccagcccggggtgcccctgggctaccccatcaaggcccccaagctgcccggcggctacggcctgccctacaccaccgggaagctgccctacggctacggccctggaggagtggccggggccgccggcaaggccggctaccccactggaactggagtgggcccccaggccgctgctgctgctgctgccaaggccgccgccaagtttggagctggagctgctggggtgctgcccggggtgggcggggccggcgtgcctggggtgcctggggccatccctggcattggaggcattgctggggtgggcaccccagctgctgctgctgctgctgctgctgctgccaaggccgccaagtatggagctgctgctggcctggtgcctgggggccctggcttcggccctggggtggtgggcgtgcctggggccggcgtgcctggggtgggcgtgcctggggccggcatccctgtggtgcctggggccggcatccctggagctgctgtgcctggggtggtgtccccagaggccgccgccaaggccgccgccaaggccgccaagtacggggcccggcctggggtgggcgtgggcggcatccccacctacggcgtgggcgctgggggcttccctggcttcggcgtgggcgtgggcggcatccctggggtggccggcgtgcctggggtgggcggcgtgcctggggtgggcggcgtgcctggggtgggcatcagccctgaggcccaggccgctgctgctgccaaggccgccaagtatggagtgggcaccccagctgctgctgctgccaaggccgccgccaaggccgcccagtttggcctggtgcctggggtgggcgtggcccctggggtgggcgtggcccctggcatcggccctgggggcgtggccgccgccgccaagtctgctgccaaggtggccgccaaggcccagctgcgggctgctgctggcctgggcgccggcatccctggcctgggcgtgggcgtgggcgtgcccggcctgggcgtgggcgccggcgtgcccggcctgggcgtgggcgctggggtgcccggctttggagctgtgcctggggccctggccgccgccaaggccgccaagtacggggctgctgtgcctggggtgctgggcggcctgggcgccctgggcggcgtgggcatccctgggggcgtggtgggcgccggccctgctgctgctgctgctgctgccaaggccgccgccaaggccgcccagtttggcctggtgggcgccgccggcctgggcggcctgggcgtgggcggcctgggcgtgcctggggtgggcggcctgggcggcatccccccagctgctgctgccaaggccgccaagtacggggctgctggcctgggcggcgtgctgggcggggccggccagttccccctgggcggcgtggccgcccggcccggcttcggcctgagccccatcttccctggaggagcctgcctgggcaaggcctgtggcaggaagaggaagtag

SEQ ID NO: 3436 - DNA, 2121 bp, Artificial Sequence
  Description of Artificial Sequence: Synthetic coding sequence
atggccggcctgacagctgctgcccccaggcctggggtgctgctgctgctgctgagcatcctgcaccccagcaggcctgggggcgtgcctggggccatccctgggggcgtgcctgggggcgtcttctacccaggggccggcctgggcgccctgggcggcggggccctgggccctgggggcaagcccctgaagcctgtgcctgggggcctggccggggccggcctgggcgccggcctgggcgccttccctgctgtgaccttccctggggccctggtgcctggaggagtggctgatgctgctgctgcctacaaggccgccaaggccggggccggcctgggcggcgtgcctggggtgggcggcctgggcgtgtctgctggagctgtggtgccccagcccggggccggcgtgaagccaggcaaggtgcctggggtgggcctgcccggggtgtacccaggaggagtgctgcccggggcccgcttccctggggtgggcgtgctgcccggggtgcccactggagctggggtgaagcccaaggcccctggggtgggcggggcctttgctggcatccctggggtgggcccctttggaggcccccagcccggggtgcccctgggctaccccatcaaggcccccaagctgcccggcggctacggcctgccctacaccaccgggaagctgccctacggctacggccctgggggcgtggccggggctgctgggaaggccggctaccccaccggcaccggggtgggcccccaggccgctgctgctgctgctgccaaggctgctgccaagtttggagctggagctgctggggtgctgcccggggtgggcggggccggcgtgcctggggtgcctggggccatccctggcatcggcggcattgctggggtgggcaccccagctgctgctgctgctgctgctgctgctgccaaggccgccaagtacggggctgctgctggcctggtgcctgggggccctggctttggacctggggtggtgggcgtgcctggagctggggtgcctggggtgggcgtgcctggagctggcatccctgtggtgcctggagctggcatccctggagctgctgtgcctggggtggtgtccccagaggccgccgccaaggctgctgccaaggccgccaagtatggagcccggcctggggtgggcgtgggcggcatccccacctatggagtgggcgccggcggcttccctggctttggagtgggcgtgggcggcatccctggggtggccggcgtgcctggggtgggcggcgtgcctggggtgggcggcgtgcctggggtgggcatcagccctgaggcccaggccgctgctgctgccaaggccgccaagtatggagtgggcaccccagctgctgctgctgccaaggctgctgccaaggccgcccagtttggcctggtgcctggggtgggcgtggcccctggggtgggcgtggcccctggggtgggcgtggcccctggggtgggcctggcccctggggtgggcgtggcccctggggtgggcgtggcccctggggtgggcgtggcccctggcatcggccctggaggagtggccgctgctgccaagtctgctgccaaggtggccgccaaggcccagctgcgggctgctgctggcctgggcgccggcatccctggcctgggcgtgggcgtgggcgtgcccggcctgggcgtgggcgctggggtgcccggcctgggcgtgggcgccggcgtgcccggctttggagctgtgcctggggccctggccgccgccaaggccgccaagtatggagctgctgtgcctggggtgctgggcggcctgggcgccctgggcggcgtgggcatccctggaggagtggtgggcgccggccctgctgctgctgctgctgctgccaaggctgctgccaaggccgcccagtttggcctggtgggcgctgctggcctgggcggcctgggcgtgggcggcctgggcgtgcctggggtgggcggcctgggcggcatccccccagctgctgctgccaaggccgccaagtatggagtggccgcccggcccggcttcggcctgagccccatcttccctgggggcgcctgcctgggcaaggcctgtggcaggaagaggaagtag

SEQ ID NO: 3437 - DNA, 2145 bp, Artificial Sequence
  Description of Artificial Sequence: Synthetic coding sequence
atggccggcctgacagctgctgcccccaggcctggggtgctgctgctgctgctgagcatcctgcaccccagcaggcctgggggcgtgcctggggccatccctgggggcgtgcctgggggcgtcttctacccagccctgggccctgggggcaagcccctgaagcctgtgcctgggggcctggccggggccggcctgggcgccggcctgggcgccttccctgctgtgaccttccctggggccctggtgcctggaggagtggctgatgctgctgctgcctacaaggccgccaaggccggggccggcctgggcggcgtgcctggggtgggcggcctgggcgtgtctgctggagctgtggtgccccagcccggggccggcgtgaagccaggcaaggtgcctggggtgggcctgcccggggtgtacccaggaggagtgctgcccggggcccgcttccctggggtgggcgtgctgcccggggtgcccactggagctggggtgaagcccaaggcccctggggtgggcggggcctttgctggcatccctggggtgggcccctttggaggcccccagcccggggtgcccctgggctaccccatcaaggcccccaagctgcccggcggctacggcctgccctacaccaccgggaagctgccctacggctacggccctgggggcgtggccggggctgctgggaaggccggctaccccaccggcaccggggtgggcccccaggccgctgctgctgctgctgccaaggctgctgccaagtttggagctggagctgctggggtgctgcccggggtgggcggggccggcgtgcctggggtgcctggggccatccctggcatcggcggcattgctggggtgggcaccccagctgctgctgctgctgctgctgctgctgccaaggccgccaagtacggggctgctgctggcctggtgcctgggggccctggctttggacctggggtggtgggcgtgcctggagctggggtgcctggggtgggcgtgcctggagctggcatccctgtggtgcctggagctggcatccctggagctgctgtgcctggggtggtgtccccagaggccgccgccaaggctgctgccaaggccgccaagtatggagcccggcctggggtgggcgtgggcggcatccccacctatggagtgggcgccggcggcttccctggctttggagtgggcgtgggcggcatccctggggtggccggcgtgcctggggtgggcggcgtgcctggggtgggcggcgtgcctggggtgggcatcagccctgaggcccaggccgctgctgctgccaaggccgccaagtatggagtgggcaccccagctgctgctgctgccaaggctgctgccaaggccgcccagtttggcctggtgcctggggtgggcgtggcccctggggtgggcgtggcccctggggtgggcgtggcccctggggtgggcctggcccctggggtgggcgtggcccctggggtgggcgtggcccctggggtgggcgtggcccctggcatcggccctggaggagtggccgctgctgccaagtctgctgccaaggtggccgccaaggcccagctgcgggctgctgctggcctgggcgccggcatccctggcctgggcgtgggcgtgggcgtgcccggcctgggcgtgggcgctggggtgcccggcctgggcgtgggcgccggcgtgcccggctttggagctgtgcctggggccctggccgccgccaaggccgccaagtatggagctgctgtgcctggggtgctgggcggcctgggcgccctgggcggcgtgggcatccctggaggagtggtgggcgccggccctgctgctgctgctgctgctgccaaggctgctgccaaggccgcccagtttggcctggtgggcgctgctggcctgggcggcctgggcgtgggcggcctgggcgtgcctggggtgggcggcctgggcggcatccccccagctgctgctgccaaggccgccaagtatggagctgctggcctgggcggcgtgctgggcggggccggccagttccccctgggcggcgtggccgcccggcccggcttcggcctgagccccatcttccctgggggcgcctgcctgggcaaggcctgtggcaggaagaggaagtag

SEQ ID NO: 3438 - DNA, 678 bp, Artificial Sequence
  Description of Artificial Sequence: Synthetic coding sequence
atggccgccctggccagcagcctcatccggcagaagcgggaggtgcgggagcccggcggcagcaggcctgtgtctgcccagaggagagtgtgcccccggggcaccaagagcctgtgccagaagcagctgctgatcctgctgagcaaggtgcggctgtgtggcggccgcccagcccggccagaccggggccctgagccccagctgaagggcatcgtgaccaagctgttctgccggcagggcttctacctgcaggccaacccagatggcagcatccagggcaccccagaggacaccagcagcttcacccacttcaacctgatccctgtgggcctgcgggtggtgaccatccagagcgccaagctgggccactacatggccatgaatgctgagggcctgctgtacagcagcccccacttcaccgctgagtgccgcttcaaggaatgtgtgtttgagaactactacgtgctgtatgccagcgccctgtaccggcagaggagaagtggccgggcctggtacctgggcctggacaaggagggccaggtgatgaagggcaacagagtgaagaagaccaaggctgctgcccacttcctgcccaagctgctggaggtggccatgtaccaggagcccagcctgcacagcgtgcctgaggccagccccagcagccccccagccccctag

SEQ ID NO: 3439 - DNA, 546 bp, Artificial Sequence
  Description of Artificial Sequence: Synthetic coding sequence
atggagagcaaggagccccagctgaagggcatcgtgaccaggctcttcagccagcagggctacttcctgcagatgcacccagatggcaccattgatggcaccaaggatgaaaattctgactacaccctcttcaacctgatccctgtgggcctgcgggtggtggccatccagggcgtgaaggccagcctgtatgtggccatgaatggagagggctacctgtacagcagtgatgtgttcaccccagagtgcaagttcaaggagagcgtgtttgagaactactacgtgatctacagcagcaccctgtaccggcagcaggagagcggccgggcctggttcctgggcctgaacaaggagggccagatcatgaagggcaacagagtgaagaagaccaagcccagcagccactttgtgcccaagcccatcgaggtgtgcatgtaccgggagcccagcctgcacgagatcggggagaagcagggccgcagcaggaagagcagcggcacccccaccatgaatggaggcaaggtggtgaaccaggacagcacctag

SEQ ID NO: 3440 - DNA, 546 bp, Artificial Sequence
  Description of Artificial Sequence: Synthetic coding sequence
atggagaagacagagccccagctgaagggcatcgtgaccaggctcttcagccagcagggctacttcctgcagatgcacccagatggcaccattgatggcaccaaggatgaaaattctgactacaccctcttcaacctgatccctgtgggcctgcgggtggtggccatccagggcgtgaaggccagcctgtatgtggccatgaatggagagggctacctgtacagcagtgatgtgttcaccccagagtgcaagttcaaggagagcgtgtttgagaactactacgtgatctacagcagcaccctgtaccggcagcaggagagcggccgggcctggttcctgggcctgaacaaggagggccagatcatgaagggcaacagagtgaagaagaccaagcccagcagccactttgtgcccaagcccatcgaggtgtgcatgtaccgggagcccagcctgcacgagatcggggagaagcagggccgcagcaggaagagcagcggcacccccaccatgaatggaggcaaggtggtgaaccaggacagcacctag

SEQ ID NO: 3441 - DNA, 324 bp, Artificial Sequence
  Description of Artificial Sequence: Synthetic coding sequence
atggagagcaaggagccccagctgaagggcatcgtgaccaggctcttcagccagcagggctacttcctgcagatgcacccagatggcaccattgatggcaccaaggatgaaaattctgactacaccctcttcaacctgatccctgtgggcctgcgggtggtggccatccagggcgtgaaggccagcctgtatgtggccatgaatggagagggctacctgtacagcagtgatgtgttcaccccagagtgcaagttcaaggagagcgtgtttgagaactactacgtgatctacagcagcaccctgtaccggcagcaggagagctag

SEQ ID NO: 3442 - DNA, 546 bp, Artificial Sequence; identical to SEQ ID NO: 3439
  Description of Artificial Sequence: Synthetic coding sequence

SEQ ID NO: 3443 - DNA, 546 bp, Artificial Sequence; identical to SEQ ID NO: 3439
  Description of Artificial Sequence: Synthetic coding sequence

SEQ ID NO: 3444 - DNA, 732 bp, Artificial Sequence
  Description of Artificial Sequence: Synthetic coding sequence
atggctgctgccatcgccagcagcctcatccggcagaagaggcaggcccgggagagcaacagcgacagagtgtctgccagcaagagaagaagcagccccagcaaggatggccgcagcctgtgtgagcggcacgtgctgggcgtcttcagcaaggtgcgcttctgcagcggcaggaagaggcctgtgagaagaagacctgagccccagctgaagggcatcgtgaccaggctcttcagccagcagggctacttcctgcagatgcacccagatggcaccattgatggcaccaaggatgaaaattctgactacaccctcttcaacctgatccctgtgggcctgcgggtggtggccatccagggcgtgaaggccagcctgtatgtggccatgaatggagagggctacctgtacagcagtgatgtgttcaccccagagtgcaagttcaaggagagcgtgtttgagaactactacgtgatctacagcagcaccctgtaccggcagcaggagagcggccgggcctggttcctgggcctgaacaaggagggccagatcatgaagggcaacagagtgaagaagaccaagcccagcagccactttgtgcccaagcccatcgaggtgtgcatgtaccgggagcccagcctgcacgagatcggggagaagcagggccgcagcaggaagagcagcggcacccccaccatgaatggaggcaaggtggtgaaccaggacagcacctag

SEQ ID NO: 3445 - DNA, 579 bp, Artificial Sequence
  Description of Artificial Sequence: Synthetic coding sequence
atggccctgctgaggaagagctacagcgagccccagctgaagggcatcgtgaccaagctgtacagccggcagggctaccacctgcagctgcaggctgatggcaccattgatggcaccaaggatgaggacagcacctacaccctcttcaacctgatccctgtgggcctgcgggtggtggccatccagggcgtgcagaccaagctgtacctggccatgaacagcgagggctacctgtacaccagcgagctgttcaccccagagtgcaagttcaaggagagcgtgtttgagaactactacgtgacctacagctccatgatctaccggcagcagcagagcggccggggctggtacctgggcctgaacaaggagggggagatcatgaagggcaaccacgtgaagaagaacaagccagctgcccacttcctgcccaagcccctgaaggtggccatgtacaaggagcccagcctgcatgacctgacagagttcagccgcagcggcagcggcacccccaccaagagccgctctgtgtctggagtgctgaatggaggcaagtccatgagccacaatgaaagcacctag

SEQ ID NO: 3446 - DNA, 738 bp, Artificial Sequence
  Description of Artificial Sequence: Synthetic coding sequence
atggctgctgccatcgccagcagcctcatccggcagaagaggcaggcccgggagcgggagaagagcaatgcctgcaagtgtgtgagcagccccagcaagggcaagaccagctgtgacaagaacaagctgaatgtgttcagccgggtgaagctgtttggcagcaagaagagaagaagaagaagacctgagccccagctgaagggcatcgtgaccaagctgtacagccggcagggctaccacctgcagctgcaggctgatggcaccattgatggcaccaaggatgaggacagcacctacaccctcttcaacctgatccctgtgggcctgcgggtggtggccatccagggcgtgcagaccaagctgtacctggccatgaacagcgagggctacctgtacaccagcgagctgttcaccccagagtgcaagttcaaggagagcgtgtttgagaactactacgtgacctacagctccatgatctaccggcagcagcagagcggccggggctggtacctgggcctgaacaaggagggggagatcatgaagggcaaccacgtgaagaagaacaagccagctgcccacttcctgcccaagcccctgaaggtggccatgtacaaggagcccagcctgcatgacctgacagagttcagccgcagcggcagcggcacccccaccaagagccgctctgtgtctggagtgctgaatggaggcaagtccatgagccacaatgaaagcacctag

SEQ ID NO: 3447 - DNA, 768 bp, Artificial Sequence
  Description of Artificial Sequence: Synthetic coding sequence
atgtctgggaaggtgaccaagcccaaggaggagaaggatgccagcaaggtgctggatgatgcccctcctggcacccaggagtacatcatgctgcggcaggacagcatccagagcgctgagctgaagaagaaggagagccccttccgggccaagtgccacgagatcttctgctgccccctgaagcaggtgcaccacaaggaaaatacagagcctgaggagccccagctgaagggcatcgtgaccaagctgtacagccggcagggctaccacctgcagctgcaggctgatggcaccattgatggcaccaaggatgaggacagcacctacaccctcttcaacctgatccctgtgggcctgcgggtggtggccatccagggcgtgcagaccaagctgtacctggccatgaacagcgagggctacctgtacaccagcgagctgttcaccccagagtgcaagttcaaggagagcgtgtttgagaactactacgtgacctacagctccatgatctaccggcagcagcagagcggccggggctggtacctgggcctgaacaaggagggggagatcatgaagggcaaccacgtgaagaagaacaagccagctgcccacttcctgcccaagcccctgaaggtggccatgtacaaggagcccagcctgcatgacctgacagagttcagccgcagcggcagcggcacccccaccaagagccgctctgtgtctggagtgctgaatggaggcaagtccatgagccacaatgaaagcacctag

SEQ ID NO: 3448 - DNA, 132 bp, Artificial Sequence
  Description of Artificial Sequence: Synthetic coding sequence
atgctgcggcaggacagcatccagagcgctgagctgaagaagaaggagagccccttccgggccaagtgccacgagatcttctgctgccccctgaagcaggtgcaccacaaggagaacacagagcctgagtag

SEQ ID NO: 3449 - DNA, 666 bp, Artificial Sequence
  Description of Artificial Sequence: Synthetic coding sequence
atgtctgggaaggtgaccaagcccaaggaggagaaggatgccagcaaggtgctggatgatgcccctcctggcacccaggagtacatcatgctgcggcaggacagcatccagagcgctgagctgaagaagaaggagagccccttccgggccaagtgccacgagatcttctgctgccccctgaagcaggtgcaccacaaggaaaatacagagcctgaggagccccagctgaagggcatcgtgaccaagctgtacagccggcagggctaccacctgcagctgcaggctgatggcaccattgatggcaccaaggatgaggacagcacctacaccctcttcaacctgatccctgtgggcctgcgggtggtggccatccagggcgtgcagaccaagctgtacctggccatgaacagcgagggctacctgtacaccagcgagctgttcaccccagagtgcaagttcaaggagagcgtgtttgagaactactacgtgacctacagctccatgatctaccggcagcagcagagcggccggggctggtacctgggcctgaacaaggagggggagatcatgaagggcaaccacgtgaagaagaacaagccagctgcccacttcctgcccaagcccctgaaggtggccatgtacaaggagcccagcctgcatgactag

SEQ ID NO: 3450 - DNA, 681 bp, Artificial Sequence
  Description of Artificial Sequence: Synthetic coding sequence
atgctgcggcaggacagcatccagagcgctgagctgaagaagaaggagagccccttccgggccaagtgccacgagatcttctgctgccccctgaagcaggtgcaccacaaggagaacacagagcctgaggagccccagctgaagggcatcgtgaccaagctgtacagccggcagggctaccacctgcagctgcaggctgatggcaccattgatggcaccaaggatgaggacagcacctacaccctcttcaacctgatccctgtgggcctgcgggtggtggccatccagggcgtgcagaccaagctgtacctggccatgaacagcgagggctacctgtacaccagcgagctgttcaccccagagtgcaagttcaaggagagcgtgtttgagaactactacgtgacctacagctccatgatctaccggcagcagcagagcggccggggctggtacctgggcctgaacaaggagggggagatcatgaagggcaaccacgtgaagaagaacaagccagctgcccacttcctgcccaagcccctgaaggtggccatgtacaaggagcccagcctgcatgacctgacagagttcagccgcagcggcagcggcacccccaccaagagccgctctgtgtctggagtgctgaatggaggcaagtccatgagccacaatgaaagcacctag

SEQ ID NO: 3451 - DNA, 297 bp, Artificial Sequence
  Description of Artificial Sequence: Synthetic coding sequence
atgtctgggaaggtgaccaagcccaaggaggagaaggatgccagcaaggtgctggatgatgcccctcctggcacccaggagtacatcatgctgcggcaggacagcatccagagcgctgagctgaagaagaaggagagccccttccgggccaagtgccacgagatcttctgctgccccctgaagcaggtgcaccacaaggaaaatacagagcctgaggagccccagctgaagggcatcgtgaccaagctgtacagccggcagggctaccacctgcagctgcaggctgatggcacctag

SEQ ID NO: 3452 - DNA, 624 bp, Artificial Sequence
  Description of Artificial Sequence: Synthetic coding sequence
atgaggacctccatgaagaaggtgggcatgcaccacctgagcagcagcggcggcagctactacctgatcctggatgatgcccctcctggcacccaggagtacatcatgctgcggcaggacagcatccagagcgctgagctgaagaagaaggagagccccttccgggccaagtgccacgagatcttctgctgccccctgaagcaggtgcaccacaaggaaaatacagagcctgaggagccccagctgaagggcatcgtgaccaagctgtacagccggcagggctaccacctgcagctgcaggctgatggcaccattgatggcaccaaggatgaggacagcacctacaccctcttcaacctgatccctgtgggcctgcgggtggtggccatccagggcgtgcagaccaagctgtacctggccatgaacagcgagggctacctgtacaccagcgagctgttcaccccagagtgcaagttcaaggagagcgtgtttgagaactactacgtgacctacagctccatgatctaccggcagcagcagagcggccggggctggtacctgggcctgaacaaggagggggagatcatgaagggcaaccacgtgaagaagaacaagccagcctag

SEQ ID NO: 3453 - DNA, 600 bp, Artificial Sequence
  Description of Artificial Sequence: Synthetic coding sequence
atgtctgggaaggtgaccaagcccaaggaggagaaggatgccagcaaggagccccagctgaagggcatcgtgaccaagctgtacagccggcagggctaccacctgcagctgcaggctgatggcaccattgatggcaccaaggatgaggacagcacctacaccctcttcaacctgatccctgtgggcctgcgggtggtggccatccagggcgtgcagaccaagctgtacctggccatgaacagcgagggctacctgtacaccagcgagctgttcaccccagagtgcaagttcaaggagagcgtgtttgagaactactacgtgacctacagctccatgatctaccggcagcagcagagcggccggggctggtacctgggcctgaacaaggagggggagatcatgaagggcaaccacgtgaagaagaacaagccagctgcccacttcctgcccaagcccctgaaggtggccatgtacaaggagcccagcctgcatgacctgacagagttcagccgcagcggcagcggcacccccaccaagagccgctctgtgtctggagtgctgaatggaggcaagtccatgagccacaatgaaagcacctag

SEQ ID NO: 3454 - DNA, 759 bp, Artificial Sequence
  Description of Artificial Sequence: Synthetic coding sequence
atggtgaagcctgtgcccctcttcagaagaacagacttcaagctgctgctgtgcaaccacaaggacctcttcttcctgcgggtgtccaagctgctggactgcttcagccccaagtccatgtggttcctgtggaacatcttcagcaagggcacccacatgctgcagtgcctgtgtgggaagagcctgaagaagaacaagaaccccacagacccccagctgaagggcatcgtgacccggctgtactgccggcagggctactacctgcagatgcacccagatggagccctggatggcaccaaggatgacagcaccaacagcaccctcttcaacctgatccctgtgggcctgcgggtggtggccatccagggcgtgaagacaggcctgtacatcgccatgaatggagagggctacctgtaccccagcgagctgttcaccccagagtgcaagttcaaggagagcgtgtttgagaactactacgtgatctacagctccatgctgtaccggcagcaggagagcggccgggcctggttcctgggcctgaacaaggagggccaggccatgaagggcaacagagtgaagaagaccaagccagctgcccacttcctgcccaagcccctggaggtggccatgtaccgggagcccagcctgcatgatgtgggggagaccgtgcccaagccaggagtgacccccagcaagagcaccagcgccagcgccatcatgaatggaggcaagcctgtgaacaagagcaagaccacctag

SEQ ID NO: 3455 - DNA, 744 bp, Artificial Sequence
  Description of Artificial Sequence: Synthetic coding sequence
atggctgctgccatcgccagcggcctcatccggcagaagaggcaggcccgggagcagcactgggaccggcccagcgccagcagaagaagaagcagccccagcaagaacagaggcctgtgcaatggaaacctggtggacatcttcagcaaggtgcgcatcttcggcctgaagaagaggcggctgcggcggcaggacccccagctgaagggcatcgtgacccggctgtactgccggcagggctactacctgcagatgcacccagatggagccctggatggcaccaaggatgacagcaccaacagcaccctcttcaacctgatccctgtgggcctgcgggtggtggccatccagggcgtgaagacaggcctgtacatcgccatgaatggagagggctacctgtaccccagcgagctgttcaccccagagtgcaagttcaaggagagcgtgtttgagaactactacgtgatctacagctccatgctgtaccggcagcaggagagcggccgggcctggttcctgggcctgaacaaggagggccaggccatgaagggcaacagagtgaagaagaccaagccagctgcccacttcctgcccaagcccctggaggtggccatgtaccgggagcccagcctgcatgatgtgggggagaccgtgcccaagccaggagtgacccccagcaagagcaccagcgccagcgccatcatgaatggaggcaagcctgtgaacaagagcaagaccacctag

SEQ ID NO: 3456 - DNA, 351 bp, Artificial Sequence
  Description of Artificial Sequence: Synthetic coding sequence
tgaatcctggagttcatcagcctggccgtgggcctcatcagcatccggggcgtggacagcggcctgtacctgggcatgaatgaaagaggagagctgtatggcagcaagaagctgaccagagaatgtgtgttccgggagcagtttgaggagaactggtacaacacctacgccagcaccctgtacaagcacagcgacagcgagcggcagtactacgtggccctgaacaaggatggcagcccccgggagggctaccgcaccaagaggcaccagaagttcacccacttcctgcccaggcctgtggaccccagcaagctgcccagcatgagccgggacctcttccactacagatag

SEQ ID NO: 3457 - DNA, 651 bp, Artificial Sequence
  Description of Artificial Sequence: Synthetic coding sequence
atgggcgccgcccggctgctgcccaacctgaccctgtgcctgcagctgctgatcctgtgctgccagacccagggcgagaaccaccccagccccaacttcaaccagtatgtgcgggaccagggcgccatgacagaccagctgagccggcggcagatccgggagtaccagctgtacagcaggaccagcggcaagcacgtgcaggtgactggaagacgcatcagcgccacagcagaagatggcaacaagtttgccaagctgattgtggagacagacaccttcggcagccgggtgcgcatcaagggagctgagagcgagaagtacatctgcatgaacaagaggggcaagctgattggcaagcccagcggcaagagcaaggactgtgtgttcacagagatcgtgctggagaacaactacacagccttccagaatgcccggcatgagggctggttcatggccttcacccggcagggccggccccggcaggccagccgcagccggcagaaccagcgggaggcccacttcatcaagaggctgtaccagggccagctgcccttccccaaccacgccgagaagcagaagcagtttgaatttgtgggcagcgcccccaccaggaggaccaagaggacccggcggccccagcccctgacctag

SEQ ID NO: 3458 - DNA, 618 bp, Artificial Sequence
  Description of Artificial Sequence: Synthetic coding sequence
atgggcgccgcccggctgctgcccaacctgaccctgtgcctgcagctgctgatcctgtgctgccagacccagtatgtgcgggaccagggcgccatgacagaccagctgagccggcggcagatccgggagtaccagctgtacagcaggaccagcggcaagcacgtgcaggtgacaggccgccgcatcagcgccacagcagaagatggcaacaagtttgccaagctgattgtggagacagacaccttcggcagccgggtgcgcatcaagggagctgagagcgagaagtacatctgcatgaacaagaggggcaagctgattggcaagcccagcggcaagagcaaggactgtgtgttcacagaaattgtgctggagaacaactacacagccttccagaatgcccggcatgagggctggttcatggccttcacccggcagggccggccccggcaggccagccgcagccggcagaaccagcgggaggcccacttcatcaagaggctgtaccagggccagctgcccttccccaaccacgccgagaagcagaagcagtttgaatttgtgggcagcgcccccaccaggaggaccaagaggacccggcggccccagcccctgacctag

SEQ ID NO: 3459 - DNA, 624 bp, Artificial Sequence
  Description of Artificial Sequence: Synthetic coding sequence
atgtacagcgcccccagcgcctgcacctgcctgtgcctgcacttcctgctgctgtgcttccaggtgcaggtgctggtggccgaggagaatgtggacttccgcatccacgtggagaaccagacccgggccagagatgatgtgtccaggaagcagctgcggctgtaccagctgtacagcaggaccagcggcaagcacatccaggtgctgggccgccgcatcagcgcccggggggaggatggagacaagtatgcccagctgctggtggagacagacaccttcggcagccaggtgcgcatcaagggcaaggagacagagttctacctgtgcatgaacaggaagggcaagctggtgggcaagccagatggcaccagcaaagaatgtgtgttcatcgagaaggtgctggagaacaactacacagccctgatgtctgccaagtacagcggctggtacgtgggcttcaccaagaagggccggcccaggaagggccccaagacccgggagaaccagcaggatgtgcacttcatgaagcgctaccccaagggccagcctgagctgcagaagcccttcaagtacaccaccgtgaccaagaggagccgccgcatccggcccacccacccagcctag

SEQ ID NO: 3460 - DNA, 651 bp, Artificial Sequence
  Description of Artificial Sequence: Synthetic coding sequence
atgaggagcggctgtgtggtggtgcacgtgtggatcctggccggcctgtggctggccgtggccggccggcccctggccttcagtgatgctggcccccacgtgcactacggctggggagaccccatccggctgcggcacctgtacaccagcggcccccacggcctgagcagctgcttcctgcgcatccgggcagatggagtggtggactgtgcccggggccagagcgcccacagcctgctggagatcaaggctgtggccctgaggacagtggccatcaagggcgtgcacagcgtgcgctacctgtgcatgggcgcagatggcaagatgcagggcctgctgcagtacagcgaggaggactgtgcctttgaggaggagatccggccagatggctacaacgtgtacagaagtgagaagcaccggctgcctgtgtccctgagcagcgccaagcagaggcagctgtacaagaacagaggcttcctgcccctgagccacttcctgcccatgctgcccatggtgcctgaggagcctgaggacctgcggggccacctggagagtgacatgttcagcagccccctggagacagacagcatggaccccttcggcctggtgacaggcctggaggccgtgcgcagccccagctttgagaagtag

SEQ ID NO: 3461 - DNA, 636 bp, Artificial Sequence
  Description of Artificial Sequence: Synthetic coding sequence
atggcccccctggccgaggtgggcggcttcctgggcggcctggagggcctgggccagcaggtgggcagccacttcctgctgcccccagctggggagcggccccccctgctgggggagcggcgctctgctgctgagaggtctgcccggggcggccctggggccgcccagctggcccacctgcacggcatcctgcggcggcggcagctgtactgcaggacaggcttccacctgcagatcctgcctgatggctctgtgcagggcacccggcaggaccacagcctgtttggcatcctggagttcatctctgtggccgtgggcctggtgtccatccggggcgtggacagcggcctgtacctgggcatgaatgacaagggggagctgtatggcagcgagaagctgaccagcgagtgcatcttccgggagcagtttgaggagaactggtacaacacctacagcagcaacatctacaagcacggggacacaggaagacgctactttgtggccctgaacaaggatggcaccccaagagatggagcccggagcaagaggcaccagaagttcacccacttcctgcccaggcctgtggaccctgagcgggtgcctgagctgtacaaggacctgctgatgtacacctag

SEQ ID NO: 3462 - DNA, 237 bp, Artificial Sequence
  Description of Artificial Sequence: Synthetic coding sequence
atggcccccctggccgaggtgggcggcttcctgggcggcctggagggcctgggccagcaggtgggcagccacttcctgctgcccccagctggggagcggcccccagctgccctgctgccccaccggctgcccccagctgaccctgcccggcggcagagagctggccaccctgctggcccccagcccctgcgctacctgggcatccaccagtgtggcagcggcaccggccagtactag

SEQ ID NO: 3463 - DNA, 390 bp, Artificial Sequence
  Description of Artificial Sequence: Synthetic coding sequence
atgggagaccctgtggtgacagagacccccaccctgctgggcctgcctgagcagaggagagctgctgtgagacatgtgaacaagggggccggcatcctggagatccgctctgtgcacgtgggcgtggtggtgatcaaggctgtgagcagcggcttctacgtggccatgaacagaagaggccgcctgtatggcagccggctgtacacagtggactgccgcttccgggagcgcatcgaggagaatggccacaacacctacgccagccagcgctggaggagaagaggccagcccatgttcctggccctggaccggcggggcggccccaggcctgggggccgcacccggcgctaccacctgagcgcccacttcctgcctgtgctggtgtcctag

SEQ ID NO: 3464 - DNA, 579 bp, Artificial Sequence
  Description of Artificial Sequence: Synthetic coding sequence
atgggcacctggatcctgtttgcctgcctggtgggcgccgcctttgccatgcccctgcccccccaccctggccaccctggctacatcaacttctcctatgaggtgctgacccccctgaagtggtaccagagcatgatccggcccccctacagcagctatggctatgagcccatgggcggctggctgcaccaccagatcatccctgtggtgtcccagcagcaccccctgacccacaccctgcagagccaccaccacatccctgtggtgcctgcccagcagccccgggtgcggcagcaggccctgatgcctgtgcccggccagcagagcatgacccccacccagcaccaccagcccaacctgcccctgcctgcccagcagcccttccagccccagcctgtgcagccccagccccaccagcccatgcagccccagccccctgtgcagcccatgcagcccctgctgccccagccccccctgccccccatgttccccctgcggcccctgccccccatcctgcctgacctgcacctggaggcctggccagccacagacaagaccaagcaggaggaggtggactag

SEQ ID NO: 3465 - DNA, 756 bp, Artificial Sequence
  Description of Artificial Sequence: Synthetic coding sequence
atgctgggcgcccggctgcggctgtgggtgtgtgccctgtgcagcgtgtgcagcatgtctgtgctgcgggcctacccaaatgccagccccctgctgggcagctcctggggcggcctcatccacctgtacacagccacagccaggaacagctaccacctgcagatccacaagaatggccacgtggatggagccccccaccagaccatctacagcgccctgatgatccgctcagaagatgctggctttgtggtgatcaccggggtgatgagccgccgctacctgtgcatggacttccggggcaacatcttcggcagccactactttgatcctgagaactgccgcttccagcaccagaccctggagaatggctatgatgtgtaccacagcccccagtaccacttcctggtgtccctgggccgggccaagagggccttcctgcccggcatgaaccccccaccctacagccagttcctgagcagaagaaatgagatccccctcatccacttcaacacccccatccccaggaggcacaccaggtctgcagaagatgattctgagcgggaccccctgaatgtgctgaagccccgggccaggatgaccccagccccagccagctgcagccaggagctgcccagcgctgaggacaacagccccatggccagtgaccccctgggcgtggtgcggggcggccgggtgaacacccacgccggcggcactggacctgagggctgccggccctttgccaagttcatctag

SEQ ID NO: 3466 - DNA, 720 bp, Artificial Sequence
  Description of Artificial Sequence: Synthetic coding sequence
atgggcctcatctggctgctgctgctgagcctgctggagcccggctggccagctgctggccctggggcccggctgcggagagatgctgggggccggggcggcgtgtatgagcacctgggcggggcccccaggaggaggaagctgtactgtgccaccaagtaccacctgcagctgcaccccagcggccgggtgaatggcagcctggagaacagcgcctacagcatcctggagatcacagctgtggaggtgggcatcgtggccatccggggcctcttcagcggccgctacctggccatgaacaagaggggccgcctgtatgccagcgagcactacagcgcagaatgtgaatttgtggagcgcatccacgagctgggctacaacacctacgccagccggctgtacagaacagtgagcagcacccctggggcccggcggcagcccagcgctgagcggctgtggtacgtgtctgtgaatggcaagggccggccccggcggggcttcaagaccaggaggacccagaagagcagcctcttcctgccccgggtgctggaccaccgggaccacgagatggtgcggcagctgcagagcggcctgcccaggcctcctgggaagggcgtgcagcccaggagaagacggcagaagcagagcccagacaacctggagcccagccacgtgcaggccagccggctgggcagccagctggaggccagcgcccactag

SEQ ID NO: 3467 - DNA, 621 bp, Artificial Sequence
  Description of Artificial Sequence: Synthetic coding sequence
atgagcggccctggaacagctgctgtggccctgctgcctgctgtgctgctggccctgctggccccctgggccggccggggcggggccgccgcccccacagcccccaacggcaccctggaggccgagctggagcggcgctgggagagcctggtggccctgagcctggcccggctgcctgtggccgcccagcccaaggaggccgctgtgcagagcggggccggggactacctgctgggcatcaagaggctgcggcggctgtactgcaatgtgggcatcggcttccacctgcaggccctgcctgatggccgcatcggcggggcccatgctgacacccgggacagcctgctggagctgagccctgtggagcggggcgtggtgtccatctttggagtggccagccgcttctttgtggccatgagcagcaagggcaagctgtatggcagccccttcttcacagatgagtgcaccttcaaggagatcctgctgcccaacaactacaatgcctatgagagctacaagtacccaggcatgtttattgccctgagcaagaatggcaagaccaagaagggcaacagagtgagccccaccatgaaggtgacccacttcctgccccggctgtag

SEQ ID NO: 3468 - DNA, 807 bp, Artificial Sequence
  Description of Artificial Sequence: Synthetic coding sequence
atgagcctgtccttcctgctgctgctcttcttcagccacctgatcctgagcgcctgggcccatggagagaagaggctggcccccaagggccagcccggccctgctgccacagacaggaacccccggggcagcagcagccggcagagcagcagcagcgccatgagcagcagcagcgccagcagcagccctgctgccagcctgggcagccagggcagcggcctggagcagagcagcttccagtggagccccagcggccgcaggacaggcagcctgtactgccgggtgggcatcggcttccacctgcagatctacccagatggcaaggtgaatggcagccatgaggccaacatgctgtctgtgctggagatctttgctgtgtcccagggcatcgtgggcatccggggcgtcttcagcaacaagttcctggccatgagcaagaagggcaagctgcacgccagcgccaagttcacagatgactgcaagttccgggagcgcttccaggagaacagctacaacacctacgccagcgccatccacaggacagagaagacaggccgggagtggtacgtggccctgaacaagaggggcaaggccaagaggggctgcagcccccgggtgaagccccagcacatcagcacccacttcctgccccgcttcaagcagagcgagcagcctgagctgtccttcaccgtgacagtgcctgagaagaagaagccacccagccccatcaagcccaagatccccctgagcgcccccaggaagaacaccaacagcgtgaagtaccgcctgaagttccgctttggatag

SEQ ID NO: 3469 - DNA, 372 bp, Artificial Sequence
  Description of Artificial Sequence: Synthetic coding sequence
atgagcctgtccttcctgctgctgctcttcttcagccacctgatcctgagcgcctgggcccatggagagaagaggctggcccccaagggccagcccggccctgctgccacagacaggaacccccggggcagcagcagccggcagagcagcagcagcgccatgagcagcagcagcgccagcagcagccctgctgccagcctgggcagccagggcagcggcctggagcagagcagcttccagtggagccccagcggccgcaggacaggcagcctgtactgccgggtgggcatcggcttccacctgcagatctacccagatggcaaggtgaatggcagccatgaggccaacatgctgagccaggtgcacaggtag

SEQ ID NO: 3470 - DNA, 855 bp, Artificial Sequence
  Description of Artificial Sequence: Synthetic coding sequence
atgcccaggtatgcccagctggtgatgggccctgctggcagcggcaagagcacctactgtgccaccatggtgcagcactgtgaggccctgaacagatctgtgcaggtggtgaacctggaccctgctgctgagcacttcaactacagcgtgatggctgacatccgggagctgattgaggtggatgatgtgatggaggatgacagcctgcgcttcggccccaacggcggcctggtgttctgcatggagtactttgccaacaactttgactggctggagaactgcctgggccacgtggaggatgactacatcctgtttgactgccccggccagatcgagctgtacacccacctgcctgtgatgaagcagctggtgcagcagctggagcagtgggagttccgggtgtgtggggtcttcctggtggacagccagttcatggtggagagcttcaagttcatcagcggcatcctggccgccctgagcgccatgatcagcctggagatcccccaggtgaacatcatgaccaagatggacctgctgagcaagaaggccaagaaggagattgagaagttcctggaccctgacatgtacagcctgctggaggacagcaccagtgacctgcggagcaagaagttcaagaagctgaccaaggccatctgtggcctgattgatgactacagcatggtgcgcttcctgccctatgaccagagtgatgaggagagcatgaacatcgtgctgcagcacatcgactttgccatccagtacggggaggacctggagttcaaggagcccaaggagagagaagatgagagcagctccatgtttgatgagtacttccaggagtgccaggatgaatag

SEQ ID NO: 3471 - DNA, 735 bp, Artificial Sequence
  Description of Artificial Sequence: Synthetic coding sequence
atgggcagccccaggtctgccctgagctgcctgctgctgcacctgctggtgctgtgcctgcaggcccaggagggccctggccggggccctgccctgggccgggagctggccagcctcttccgggccggccgggagccccagggcgtgtcccagcaggtgacagtgcagagcagccccaacttcacccagcacgtgcgggagcagagcctggtgacagaccagctgagcagaagactcatccgcacctaccagctgtacagcaggaccagcggcaagcacgtgcaggtgctggccaacaagaggatcaatgccatggctgaagatggagacccctttgccaagctgattgtggagacagacaccttcggcagccgggtgcgggtgagaggagctgagaccggcctgtacatctgcatgaacaagaagggcaagctgattgccaagagcaatggcaagggcaaggactgtgtgttcacagaaattgtgctggagaacaactacacagccctgcagaatgccaagtatgagggctggtacatggccttcaccaggaagggccggcccaggaagggcagcaagacccggcagcaccagcgggaggtgcacttcatgaagaggctgccccggggccaccacaccacagagcagagcctgcgctttgagttcctgaactacccacccttcaccaggagcctgcggggcagccagaggacctgggcccctgagcccaggtag

SEQ ID NO: 3472 - DNA, 702 bp, Artificial Sequence
  Description of Artificial Sequence: Synthetic coding sequence
atgggcagccccaggtctgccctgagctgcctgctgctgcacctgctggtgctgtgcctgcaggcccaggagggccctggccggggccctgccctgggccgggagctggccagcctcttccgggccggccgggagccccagggcgtgtcccagcagcacgtgcgggagcagagcctggtgacagaccagctgagccggcggctcatccgcacctaccagctgtacagcaggaccagcggcaagcacgtgcaggtgctggccaacaagaggatcaatgccatggccgaggatggagacccctttgccaagctgattgtggagacagacaccttcggcagccgggtgcgggtgagaggagctgagaccggcctgtacatctgcatgaacaagaagggcaagctgattgccaagagcaatggcaagggcaaggactgtgtgttcacagagatcgtgctggagaacaactacacagccctgcagaatgccaagtatgagggctggtacatggccttcaccaggaagggccggcccaggaagggcagcaagacccggcagcaccagcgggaggtgcacttcatgaagaggctgccccggggccaccacaccacagagcagagcctgcgctttgagttcctgaactacccacccttcaccaggagcctgcggggcagccagaggacctgggcccctgagcccaggtag

SEQ ID NO: 3473 - DNA, 615 bp, Artificial Sequence
  Description of Artificial Sequence: Synthetic coding sequence
atgggcagccccaggtctgccctgagctgcctgctgctgcacctgctggtgctgtgcctgcaggcccagcacgtgcgggagcagagcctggtgacagaccagctgagcagaagactcatccgcacctaccagctgtacagcaggaccagcggcaagcacgtgcaggtgctggccaacaagaggatcaatgccatggctgaagatggagacccctttgccaagctgattgtggagacagacaccttcggcagccgggtgcgggtgagaggagctgagaccggcctgtacatctgcatgaacaagaagggcaagctgattgccaagagcaatggcaagggcaaggactgtgtgttcacagaaattgtgctggagaacaactacacagccctgcagaatgccaagtatgagggctggtacatggccttcaccaggaagggccggcccaggaagggcagcaagacccggcagcaccagcgggaggtgcacttcatgaagaggctgccccggggccaccacaccacagagcagagcctgcgctttgagttcctgaactacccacccttcaccaggagcctgcggggcagccagaggacctgggcccctgagcccaggtag

SEQ ID NO: 3474 - DNA, 648 bp, Artificial Sequence
  Description of Artificial Sequence: Synthetic coding sequence
atgggcagccccaggtctgccctgagctgcctgctgctgcacctgctggtgctgtgcctgcaggcccaggtgacagtgcagagcagccccaacttcacccagcacgtgcgggagcagagcctggtgacagaccagctgagccggcggctcatccgcacctaccagctgtacagcaggaccagcggcaagcacgtgcaggtgctggccaacaagaggatcaatgccatggccgaggatggagacccctttgccaagctgattgtggagacagacaccttcggcagccgggtgcgggtgagaggagctgagaccggcctgtacatctgcatgaacaagaagggcaagctgattgccaagagcaatggcaagggcaaggactgtgtgttcacagagatcgtgctggagaacaactacacagccctgcagaatgccaagtatgagggctggtacatggccttcaccaggaagggccggcccaggaagggcagcaagacccggcagcaccagcgggaggtgcacttcatgaagaggctgccccggggccaccacaccacagagcagagcctgcgctttgagttcctgaactacccacccttcaccaggagcctgcggggcagccagaggacctgggcccctgagcccaggtag

SEQ ID NO: 3475 - DNA, 627 bp, Artificial Sequence
  Description of Artificial Sequence: Synthetic coding sequence
atggcccccctgggggaggtgggcaactactttggagtgcaggatgctgtgccctttggaaatgtgcctgtgctgcctgtggacagccctgtgctgctgagtgaccacctgggccagagcgaggccggcggcctgccccggggccctgctgtgacagacctggaccacctgaagggcatcctgcggcggcggcagctgtactgcaggacaggcttccacctggagatcttccccaacggcaccatccagggcaccaggaaggaccacagccgcttcggcatcctggagttcatcagcattgctgtgggcctggtgtccatccggggcgtggacagcggcctgtacctgggcatgaatgaaaaaggagagctgtatggcagcgagaagctgacccaggagtgtgtgttccgggagcagtttgaggagaactggtacaacacctacagcagcaacctgtacaagcacgtggacaccggccgccgctactacgtggccctgaacaaggatggcaccccccgggagggcaccaggaccaagaggcaccagaagttcacccacttcctgcccaggcctgtggaccctgacaaggtgcctgagctgtacaaggacatcctgagccagagctag

SEQ ID NO: 3476 - DNA, 7176 bp, Artificial Sequence
  Description of Artificial Sequence: Synthetic coding sequence
atgacagacctgctgcggtctgtggtgacagtgattgatgtgttctacaagtacaccaagcaggatggagaatgtggcaccctgagcaagggggagctgaaggagctgctggagaaggagctgcaccctgtgctgaagaacccagatgatcctgacacagtggatgtgatcatgcacatgctggaccgggaccatgaccggcggctggacttcacagagttcctgctgatgatcttcaagctgaccatggcctgcaacaaggtgctgagcaaggagtactgcaaggccagcggcagcaagaagcacagaagaggccaccgccaccaggaggaggagagcgagacagaagaagatgaggaggacaccccaggccacaagagcggctaccgccacagctcctggagcgagggggaggagcacggctacagcagcggccacagccggggcaccgtgaagtgcagacatggcagcaacagccggcggctgggccggcagggcaacctgagcagcagcggcaaccaggagggcagccagaagcgctaccacaggagcagctgtggccacagctggagcggcggcaaggacagacatggcagcagctctgtggagctgcgggagcgcatcaacaagagccacatcagccccagccgggagagcggggaggagtatgaaagtggcagcggcagcaacagctgggagaggaaaggacatggaggcctgagctgtggcctggagaccagcggccacgagagcaacagcacccagagccgcatccgggagcagaagctgggcagcagctgcagcggcagcggggacagcggcagaagaagccacgcctgtggctacagcaacagcagcggctgcggccggccccagaatgccagcagcagctgccagagccacagatttggaggccagggcaaccagttctcctacatccagagcggctgccagagcggcatcaagggcggccagggccacggctgtgtgtctgggggccagcccagcggctgcggccagcctgagagcaacccctgcagccagagctacagccagaggggctatggagccagagaaaatggccagccccagaactgtggcggccagtggaggacaggcagcagccagagcagctgctgcggccagtatggcagcggcggcagccagagctgcagcaatggccagcacgagtatggcagctgtggccgcttcagcaacagcagcagcagcaatgagttcagcaaatgtgaccagtatggcagcggcagcagccagagcaccagctttgagcagcacggcaccggcctgagccagagcagcggctttgagcagcacgtgtgtggcagcggccagacctgtggccagcacgagagcaccagcagccagagcctgggctatgaccagcacggcagcagcagcggcaagaccagcggcttcggccagcacggcagcggcagcggccagagcagcggcttcggccagtgtggcagcggcagcggccagagcagcggcttcggccagcacggctctgtgtctggccagagcagcggcttcggccagcacggctctgtgtctggccagagcagcggcttcggccagcacgagagccgcagccggcagagcagctatggccagcacggcagcggcagcagccagagcagcggctacggccagtatggcagccgggagaccagcggcttcggccagcacggcctgggcagcggccagagcacaggcttcggccagtatggcagcggcagcggccagagcagcggcttcggccagcacggcagcggcagcggccagagcagcggcttcggccagcacgagagccgcagcggccagagcagctatggccagcacagcagcggcagcagccagagcagcggctacggccagcacggcagccggcagaccagcggcttcggccagcacggcagcggcagcagccagagcactggatttggccagtatggcagcggcagcggccagagcagcggcttcggccagcacgtgtctggcagcggccagagcagcggcttcggccagcacgagagccgcagcggccacagcagctatggccagcacggcttcggcagcagccagagcagcggctacggccagcacggcagcagcagcggccagaccagcggcttcggccagcacgagctgagcagcggccagagcagcagctttggccagcacggcagcggcagcggccagagcagcggcttcggccagcacggcagcggcagcggccagagcagcggcttcggccagcacgagagccgcagcggccagagcagctatggccagcacagcagcggcagcagccagagcagcggctacggccagcacggcagccggcagaccagcggcttcggccagcacggcagcggcagcagccagagcactggatttggccagtatggcagcggcagcggccagagcgctggcttcggccagcacggcagcggcagcggccagagcagcggcttcggccagcacgagagccgcagccaccagagcagctatggccagcacggcagcggcagcagccagagcagcggctacggccagcacggcagcagcagcggccagaccagcggcttcggccagcacaggagcagcagcggccagtacagcggcttcggccagcacggcagcggcagcggccagagcagcggcttcggccagcacggcaccggcagcggccagtacagcggcttcggccagcacgagagccgcagccaccagagcagctatggccagcacggcagcggcagcagccagagcagcggctacggccagcacggcagcagcagcggccagaccttcggcttcggccagcacaggagcggcagcggccagagcagcggcttcggccagcacggcagcggcagcggccagagcagcggcttcggccagcatgaaagtggcagcggcaagagcagcggcttcggccagcacgagagccgcagcagccagagcaactacggccagcacggcagcggcagcagccagagcagcggctacggccagcacggcagcagcagcggccagaccactggatttggccagcacaggagcagcagcggccagtacagcggcttcggccagcacggcagcggcagtgaccagagcagcggcttcggccagcacggcaccggcagcggccagagcagcggcttcggccagtatgagagccgcagccggcagagcagctatggccagcacggcagcggcagcagccagagcagcggctacggccagcacggcagcaacagcggccagaccagcggcttcggccagcacaggcctggcagcggccagagcagcggcttcggccagtatggcagcggcagcggccagagcagcggcttcggccagcacggcagcggcaccgggaagagcagcggctttgcccagcacgagtaccgcagcggccagagcagctatggccagcacggcaccggcagcagccagagcagcggctgcggccagcatgaaagtggcagcggccccaccaccagctttggccagcacgtgtctggcagtgacaacttcagcagcagcggccagcacatcagtgacagcggccagagcactggatttggccagtatggcagcggcagcggccagagcacaggcctgggccagggcgagagccagcaggtggagagcggcagcacagtgcacggccggcaggagaccacccacggccagaccatcaacaccaccaggcacagccagagcggccagggccagagcacccagacaggcagccgggtgaccaggagaagaagaagcagccagagcgagaacagcgacagcgaggtgcacagcaaggtgagccaccgccacagcgagcacatccacacccaggccggcagccactaccccaagagcggcagcacagtgagaagacggcagggcaccacccacggccagagaggagacaccaccaggcatggccacagcggccacggccagagcacccagacaggcagcaggaccagcggccggcagcgcttcagccacagtgatgccacagattctgaggtgcacagcggcgtgagccaccggccccacagccaggagcagacccacagccaggccggcagccagcacggggagagcgagagcacagtgcatgaaagacatgagaccacctacggccagacaggagaggccactggacatggccacagcggccacggccagagcacccagaggggcagcaggaccactggaagaagaggcagcggccacagcgagagcagtgacagcgaggtgcacagcggcggcagccaccggccccagagccaggagcagacccacggccaggccggcagccagcacggggagagcggcagcacagtgcacggcagacatggcaccacccacggccagacaggagacaccaccaggcatgcccactaccaccacggcaagagcacccagaggggcagcagcaccaccggccggcggggcagcggccacagcgagagcagtgacagcgaggtgcacagcggcggcagccacacccacagcggccacacccacggccagagcggcagccagcacggggagagcgagagcatcatccatgacagacaccgcatcacccacggccagacaggagacaccaccaggcacagctacagcggccacgagcagaccacccagacaggcagcaggaccaccggccggcagaggaccagccacagcgagagcacagacagcgaggtgcacagcggcggcagccaccggccccacagccgggagcacacctacggccaggccggcagccagcacgaggagcctgagttcaccgtgcatgaaagacatggcaccacccacggccagatcggggacaccaccggccacagccacagcggccacggccagagcacccagaggggcagcaggaccaccggccggcagaggagcagccacagcgagagcagtgacagcgaggtgcacagcggcgtgagccacacccacacaggccacacccacggccaggccggcagccagcacggccagagcgagagcatcgtgcctgagcggcacggcaccacccacggccagacaggagacaccaccaggcatgcccactaccaccacggcctgaccacccagacaggcagcaggaccactggaagaagaggcagcggccacagcgagtacagcgacagcgagggctacagcggcgtgagccacacccacagcggccacacccacggccaggcccggagccagcacggggagagcgagagcatcgtgcatgaaagacatggcaccatccacggccagacaggagacaccaccaggcatgcccacagcggccacggccagagcacccagacaggcagcaggaccaccggccgccgcagcagcggccacagcgagtacagcgacagcgagggccacagcggcttcagccagaggccccacagccggggccacacccacggccaggccggcagccagcacggggagagcgagagcatcgtggatgagcggcacggcaccacccacggccagacaggagacaccagcggccacagccagagcggccacggccagagcacccagagcggcagcagcaccactggaagaagaagaagtggccacagcgagagcagtgacagcgaggtgcacagcggcggcagccacacccacagcggccacacccacagccaggcccggagccagcacggggagagcgagagcacagtgcacaagaggcaccagaccacccacggccagacaggagacaccacagagcacggccaccccagccacggccagaccatccagacaggcagcaggaccaccggccggcggggcagcggccacagcgagtacagcgacagcgagggccccagcggcgtgagccacacccacagcggccacacccacggccaggccggcagccactacccagagagcggcagctctgtgcatgagcggcacggcaccacccacggccagacagctgacaccaccaggcatggccacagcggccacggccagagcacccagaggggcagcaggaccactggaagaagagccagcggccacagcgagtacagcgacagcgagggccacagcggcgtgagccacacccacagcggccacgcccacggccaggccggcagccagcacggggagagcggcagctctgtgcatgaaagacatggcaccacccacggccagacaggagacaccaccaggcatgcccacagcggccacggccagagcacccagaggggcagcaggacagctggccggcggggcagcggccacagcgagagcagtgacagcgaggtgcacagcggcgtgagccacacccacagcggccacacctacggccaggcccggagccagcacggggagagcggcagcgccatccacggccggcagggcaccatccacggccagacaggagacaccaccaggcatggccagagcggccacggccagagcacccagacaggcagcaggaccaccggccggcagaggagcagccacagcgagagcagtgacagcgaggtgcacagcgaggccagccccacccacagcggccacacccacagccaggccggcagccgccacggccagagcggcagcagcggccacggccggcagggcaccacccacggccagacaggagacaccaccaggcatgcccactacggctacggccagagcacccagaggggcagcaggaccaccggccggcggggcagcggccacagcgagagcagtgacagcgaggtgcacagctggggcagccacacccacagcggccacatccagggccaggccggcagccagcagaggcagcccggcagcacagtgcacggccgcctggagaccacccacggccagacaggagacaccaccaggcatggccacagcggctacggccagagcacccagacaggcagccgcagcagccgggccagccacttccagagccacagcagcgagcggcagagacatggcagcagccaggtgtggaagcacggcagctatggccctgcagaatatgactatggccacacaggctacggccccagcggcggcagcaggaagagcatcagcaacagccacctgtcctggagcacagacagcacagccaacaagcagctgagccgccactag

SEQ ID NO: 3477 - DNA, 2856 bp, Artificial Sequence
  Description of Artificial Sequence: Synthetic coding sequence
atggccactggaacaggcaagcacaagctgctgagcacaggccccacagagccctggagcatccgggagaagctgtgcctggccagctctgtgatgaggtctggggaccagaactgggtgtctgtgtcccgggccatcaagccctttgctgagcccggccggcccccagactggttcagccagaagcactgtgccagccagtacagcgagctgctggagaccacagagacccccaagaggaagagaggagagaagggggaggtggtggagaccgtggaggatgtgattgtgaggaagctgacagctgagcgggtggaggagctgaagaaggtgatcaaggagacccaggagcgctaccgccgcctgaagagagatgctgagctgatccaggccggccacatggacagccggctggatgagctgtgcaatgacatcgccaccaagaagaagctggaggaggaggaggccgaggtgaagaggaaggccacagatgctgcctaccaggcccggcaggccgtgaagaccccaccccggcggctgcccaccgtgatggtgcgcagccccattgattctgccagccctggaggagactaccccctgggggacctgacccccaccaccatggaggaggccaccagcggcgtgaccccaggcaccctgcccagcacccctgtgaccagcttccctggcatcccagacaccctgcccccaggcagcgcccccctggaggcccccatgacccctgtgacagatgacagcccccagaagaagatgctgggccagaaggccaccccaccacccagccccctgctgtctgagctgctgaagaagggcagcctgctgcccaccagcccccggctggtgaatgaaagtgagatggctgtggccagcggccacctgaacagcactggagtgctgctggaggtgggcggcgtgctgcccatgattcatggaggagagatccagcagacccccaacacagtggccgccagccctgctgccagcggggcccccaccctgagccggctgctggaggccggccccacccagttcaccacccccctggccagcttcaccaccgtggccagcgagccccctgtgaagctggtgcccccacctgtggagagcgtgtcccaggccaccatcgtgatgatgcctgccctgcctgcccccagcagcgccccagctgtgtccaccacagagagcgtggcccctgtgtcccagcctgacaactgtgtgcccatggaggccgtgggggacccccacacagtgacagtgtccatggacagcagcgagatctccatgatcatcaacagcatcaaggaggagtgcttccgctctggagtggccgaggcccctgtgggcagcaaggcccccagcattgatggcaaggaggagctggacctggccgagaagatggacattgctgtgtcctacaccggggaggagctggactttgagaccgtgggggacatcatcgccatcatcgaggacaaggtggatgaccaccctgaggtgctggatgtggccgctgtggaggccgccctgtccttctgtgaagaaaatgatgacccccagagcctgcccggcccctgggagcaccccatccagcaggagcgggacaagcctgtgcccctgcctgcccctgagatgacagtgaagcaggagcggctggactttgaggagacagagaacaagggcatccacgagctggtggacatccgggagcccagcgctgagatcaaggtggagcctgctgagcctgagcccgtcatctctggagctgagatcgtggccggcgtggtgcctgccacctccatggagcccccagagctgcggagccaggacctggatgaggagctgggcagcacagctgctggggagatcgtggaggctgatgtggccatcggcaaaggagatgagacccccctgaccaacgtgaagacagaggccagccctgagagcatgctgagccccagccacggcagcaaccccatcgaggaccccctggaggccgagacccagcacaagtttgagatgtctgacagcctgaaggaggagagcggcaccatcttcggcagccagatcaaggatgcccctggagaagatgaggaggaggatggagtgtctgaggccgccagcctggaggagcccaaggaggaggaccagggcgagggctacctgtctgagatggacaatgaacctcctgtgtctgagagtgatgatggcttcagcatccacaatgccaccctgcagagccacaccctggccgacagcatccccagcagccctgccagcagccagttctctgtgtgcagcgaggaccaggaggccatccaggcccagaagatctggaagaaggccatcatgctggtgtggagggctgctgccaaccacagatatgccaacgtgttcctgcagcctgtgacagatgacatcgcccctggctaccacagcatcgtgcagaggcccatggacctgagcaccatcaagaagaacattgaaaatggcctcatccgcagcacagctgagttccagagggacatcatgctgatgttccagaatgctgtgatgtacaacagcagtgaccatgatgtgtaccacatggctgtggagatgcagagagatgtgctggagcagatccagcagttcctggccacccagctgatcatgcagaccagcgagagcggcatcagcgccaagagcctgcggggccgggacagcaccaggaagcaggatgccagcgagaaggacagcgtgcccatgggcagccctgccttcctgctgagcctgtttgatggcggcacccggggcagaagatgtgccattgaagctgacatgaagatgaagaagtag

SEQ ID NO: 3478 - DNA, 627 bp, Artificial Sequence
  Description of Artificial Sequence: Synthetic coding sequence
atgaagctgctgcccagcgtggtgctgaagctgttcctggccgctgtgctgagcgccctggtgactggagagagcctggagcggctgcggcggggcctggccgccggcaccagcaacccagacccccccaccgtgtccacagaccagctgctgcccctgggcggcggccgggacaggaaggtgcgggacctgcaggaggccgacctggacctgctgcgggtgaccctgagcagcaagccccaggccctggccacccccaacaaggaggagcacggcaagaggaagaagaagggcaagggcctgggcaagaagagggacccctgcctgaggaagtacaaggacttctgcatccacggggagtgcaagtatgtgaaggagctgcgggcccccagctgcatctgccaccctggctaccatggagagcgctgccacggcctgagcctgcctgtggagaaccggctgtacacctatgaccacaccaccatcctggccgtggtggccgtggtgctgagctctgtgtgcctgctggtgattgtgggcctgctgatgttccgctaccaccggcggggcggctatgatgtggagaatgaggagaaggtgaagctgggcatgaccaacagccactag

SEQ ID NO: 3479 - DNA, 1128 bp, Artificial Sequence
  Description of Artificial Sequence: Synthetic coding sequence
atggctgtgacagaggccagcctgctgcggcagtgccccctgctgctgccccagaacagaagcaagacagtgtatgagggcttcatcagcgcccagggccgggacttccacctgcgcatcgtgctgcctgaggacctgcagctgaagaatgcccggctgctgtgctcctggcagctgcggaccatcctgagcggctaccacagaattgtgcagcagaggatgcagcacagcccagacctgatgtccttcatgatggagctgaagatgctgctggaggtggccctgaagaaccggcaggagctgtatgccctgcccccaccaccccagttctacagcagcctgattgaggagatcggcaccctgggctgggacaagctggtgtatgctgacacctgcttcagcaccatcaagctgaaggcagaagatgccagcggccgggagcacctgatcaccctgaagctgaaggccaagtacccagctgagagcccagactactttgtggacttccctgtgcccttctgtgcctcctggaccccccagagcagcctcatcagcatctacagccagttcctggccgccatcgagagcctgaaggccttctgggatgtgatggatgaaattgatgagaagacctgggtgctggagcctgagaagcccccaagaagtgccacagcccggcgcatcgccctgggcaacaacgtgtccatcaacatcgaggtggaccccaggcaccccaccatgctgcctgagtgcttcttcctgggcgctgaccacgtggtgaagcccctgggcatcaagctgagcaggaacatccacctgtgggaccctgaaaattctgtgctgcagaacctgaaggatgtgctggagattgacttccctgcccgggccatcctggagaagagtgacttcaccatggactgtggcatctgctacgcctaccagctggatggcaccatcccagaccaggtgtgtgacaacagccagtgtggccagcccttccaccagatctgcctgtatgagtggctgcggggcctgctgaccagccggcagagcttcaacatcatctttggagagtgcccctactgcagcaagcccatcaccctgaagatgagcggcaggaagcactag

SEQ ID NO: 3480 - DNA, 723 bp, Artificial Sequence
  Description of Artificial Sequence: Synthetic coding sequence
atgaccccccaccggctgctgccccccctgctgctgctgctggccctgctgctggccgccagccctgggggcgccctggcccgctgccccggctgcggccagggcgtgcaggccggctgccctgggggctgtgtggaggaggaggatggcggcagccctgctgagggctgtgccgaggccgagggctgcctgcggcgggagggccaggagtgtggggtgtacacccccaactgtgcccctggcctgcagtgccacccccccaaggatgatgaggcccccctgcgggccctgctgctgggccggggccgctgcctgcctgcccgggccccagctgtggccgaggagaaccccaaggagagcaagccccaggccggcacagcccggccccaggatgtgaacagaagagaccagcagagaaatcctggcaccagcaccacccccagccagcccaacagcgctggggtgcaggacacagagatgggcccctgccgccgccacctggacagcgtgctgcagcagctgcagacagaggtgtacagaggagcccagaccctgtatgtgcccaactgtgaccaccggggcttctacaggaagaggcagtgccgcagcagccagggccagaggcggggcccctgctggtgtgtggacaggatgggcaagagcctgcccggcagcccagatggaaatggcagcagcagctgccccaccggcagcagtggatag

SEQ ID NO: 3481 - DNA, 411 bp, Artificial Sequence
  Description of Artificial Sequence: Synthetic coding sequence
atgaccccccaccggctgctgccccccctgctgctgctgctggccctgctgctggccgccagccctgggggcgccctggcccgctgccccggctgcggccagggcgtgcaggccggctgccctgggggctgtgtggaggaggaggatggcggcagccctgctgagggctgtgccgaggccgagggctgcctgcggcgggagggccaggagtgtggggtgtacacccccaactgtgcccctggcctgcagtgccacccccccaaggatgatgaggcccccctgcgggccctgctgctgggccggggccgctgcctgcctgcccgggccccagctgtgctgagcagccccaggaccctgaggaagctgagccctgagcccggggccacctgcagctgccgcggggagagctag

SEQ ID NO: 3482 - DNA, 717 bp, Artificial Sequence
  Description of Artificial Sequence: Synthetic coding sequence
atgaccccccaccggctgctgccccccctgctgctgctgctggccctgctgctggccgccagccctgggggcgccctggcccgctgccccggctgcggccagggcgtgcaggccggctgccctgggggctgtgtggaggaggaggatggcggcagccctgctgagggctgtgccgaggccgagggctgcctgcggcgggagggccaggagtgtggggtgtacacccccaactgtgcccctggcctgcagtgccacccccccaaggatgatgaggcccccctgcgggccctgctgctgggccggggccgctgcctgcctgcccgggccccagctgaggagaaccccaaggagagcaagccccaggccggcacagcccggccccaggatgtgaacagaagagaccagcagagaaatcctggcaccagcaccacccccagccagcccaacagcgctggggtgcaggacacagagatgggcccctgccgccgccacctggacagcgtgctgcagcagctgcagacagaggtgtacagaggagcccagaccctgtatgtgcccaactgtgaccaccggggcttctacaggaagaggcagtgccgcagcagccagggccagaggcggggcccctgctggtgtgtggacaggatgggcaagagcctgcccggcagcccagatggaaatggcagcagcagctgccccaccggcagcagtggatag

SEQ ID NO: 3483 - DNA, 837 bp, Artificial Sequence
  Description of Artificial Sequence: Synthetic coding sequence
atgccccggctgagcctgctgctgcccctgctgctgctgctgctgctgcccctgctgccccccctgagccccagcctgggcatcagagatgtgggcggccggcggcccaagtgtggcccctgcaggcctgagggctgcccagccccagccccctgcccagcccctggcatcagcgccctggatgaatgtggctgctgtgcccgctgcctgggcgctgagggcgccagctgtggcggccgggccggcggccgctgtggccctggcctggtgtgtgccagccaggccgccggggccgcccctgagggcaccggcctgtgtgtgtgtgcccagaggggcaccgtgtgtggcagtgatggccgcagctaccccagcgtgtgtgccctgcggctgcgggcccggcacaccccccgggcccaccctggccacctgcacaaggccagagatggcccctgtgaatttgcccctgtggtggtggtgccccccaggtctgtgcacaacgtgactggagcccaggtgggcctgagctgtgaggtgcgggctgtgcccacccctgtgatcacctggaggaaggtgaccaagagccctgagggcacccaggccctggaggagctgcccggggaccacgtgaacattgctgtgcaggtgcggggcggccccagcgaccacgaggccacagcctggatcctgatcaaccccctgaggaaggaggatgaaggagtgtaccagtgccacgccgccaacatggtgggggaggccgagagccacagcacagtgacagtgctggacctgagcaagtaccgctccttccacttccctgccccagatgacaggatgtag

SEQ ID NO: 3484 - DNA, 459 bp, Artificial Sequence
  Description of Artificial Sequence: Synthetic coding sequence
atgtgcagcctgcccatggcccgctactacatctccttcctgcctgagcccctgcctgccaagagcctgcagcacggcgtgcccctgagcctggacagcagcctgagcagcctgctggagaagatctgcatcctgcccaacagaggcctggcccggaccaaggtgcccatcttcctgggcatccagggcggcagccgctgcctggcctgtgtggagacagaggagggccccagcctgcagctggaggatgtgaacatcgaggagctgtacaagggcggggaggaggccacccgcttcaccttcttccagagcagcagcggcagcgccttccggctggaggccgccgcctggccaggctggttcctgtgtggccctgctgagccccagcagcctgtgcagctgaccaaggagagcgagcccagcgcccggaccaagttctactttgagcagagctggtag

SEQ ID NO: 3485 - DNA, 459 bp, Artificial Sequence
  Description of Artificial Sequence: Synthetic coding sequence
atgtgcagcctgcccatggcccgctactacatcatcaagtatgctgaccagaaggccctgtacaccagagatggccagctgctggtgggggaccctgtggccgacaactgctgtgccgagaagatctgcatcctgcccaacagaggcctggcccggaccaaggtgcccatcttcctgggcatccagggcggcagccgctgcctggcctgtgtggagacagaggagggccccagcctgcagctggaggatgtgaacatcgaggagctgtacaagggcggggaggaggccacccgcttcaccttcttccagagcagcagcggcagcgccttccggctggaggccgccgcctggccaggctggttcctgtgtggccctgctgagccccagcagcctgtgcagctgaccaaggagagcgagcccagcgcccggaccaagttctactttgagcagagctggtag

SEQ ID NO: 3486 - DNA, 459 bp, Artificial Sequence; identical to SEQ ID NO: 3485
  Description of Artificial Sequence: Synthetic coding sequence

SEQ ID NO: 3487 - DNA, 816 bp, Artificial Sequence
  Description of Artificial Sequence: Synthetic coding sequence
atggccaaggtgcctgacatgtttgaggacctgaagaactgctacagtgaaaatgaggaggacagcagcagcattgaccacctgagcctgaaccagaagagcttctaccacgtgtcctatggccccctgcacgagggctgcatggaccagagcgtgtccctgagcatcagcgagaccagcaagaccagcaagctgaccttcaaggagagcatggtggtggtggccaccaacgggaaggtgctgaagaagaggcggctgagcctgagccagagcatcacagatgatgacctggaggccatcgccaatgacagcgaggaggagatcatcaagcccaggtctgcccccttctccttcctgagcaatgtgaagtacaacttcatgaggatcatcaagtatgagttcatcctgaatgatgccctgaaccagagcatcatccgggccaatgaccagtacctgacagctgctgccctgcacaacctggatgaagctgtgaagtttgacatgggcgcctacaagagcagcaaggatgatgccaagatcaccgtcatcctgcgcatcagcaagacccagctgtatgtgacagcccaggatgaggaccagcctgtgctgctgaaggagatgcctgagatccccaagaccatcactggaagtgagaccaacctgctcttcttctgggagacccacggcaccaagaactacttcacctctgtggcccaccccaacctcttcatcgccaccaagcaggactactgggtgtgcctggccggcggcccccccagcatcacagacttccagatcctggagaaccaggcctag

SEQ ID NO: 3488 - DNA, 600 bp, Artificial Sequence
  Description of Artificial Sequence: Synthetic coding sequence
atgaactgtgtgtgccgcctggtgctggtggtgctgagcctgtggccagacacagctgtggcccctggccccccacctggccccccccgggtgtccccagaccccagggctgagctggacagcacagtgctgctgaccaggagcctgctggccgacacccggcagctggccgcccagctgcgggacaagtttcctgcagatggagaccacaacctggacagcctgcccaccctggccatgtctgctggggccctgggcgccctgcagctgcccggggtgctgacccggctgcgggctgacctgctgagctacctgcggcacgtgcagtggctgcggcgggccggcggcagcagcctgaagaccctggagcctgagctgggcaccctgcaggcccggctggaccggctgctgcggcggctgcagctgctgatgagccggctggccctgccccagcccccaccagaccccccagccccacccctggccccacccagcagcgcctggggcggcatccgggccgcccacgccatcctgggcggcctgcacctgaccctggactgggccgtgcggggcctgctgctgctgaagacccggctgtag

SEQ ID NO: 3489 - DNA, 897 bp, Artificial Sequence
  Description of Artificial Sequence: Synthetic coding sequence
atgtggggcgcctgcaaggtgaaggtgcatgacagcctggccaccatcagcatcaccctgcggcgctacctgcggctgggcgccaccatggccaagagcaagtttgaatatgtgcgggactttgaagcagatgacacctgcctggcccactgctgggtggtggtgcggctggatggcaggaacttccacagatttgctgagaagcacaactttgccaagcccaatgacagccgggccctgcagctgatgaccaagtgtgcccagacagtgatggaggagctggaggacatcgtgattgcctacggccagagtgatgagtacagctttgtgttcaagaggaagaccaactggttcaagaggcgggccagcaagttcatgacccacgtggccagccagtttgccagcagctatgtgttctactggagggactactttgaggaccagcccctgctgtacccacctggctttgatggccgggtggtggtgtaccccagcaaccagaccctgaaggactacctgtcctggaggcaggccgactgccacatcaacaacctgtacaacacagtgttctgggccctgatccagcagagcggcctgacccctgtgcaggcccagggccgcctgcagggcaccctggccgctgacaagaatgagatcctcttcagcgagttcaacatcaactacaacaatgagctgcccatgtacagaaaaggaacagtgctgatctggcagaaggtggatgaggtgatgaccaaggagatcaagctgcccacagagatggagggcaagaagatggctgtgaccaggaccaggaccaagcctgtgcccctgcactgtgacatcattggagatgccttctggaaggagcaccctgagatcctggatgaggacagctag

SEQ ID NO: 3490 - DNA, 441 bp, Artificial Sequence
  Description of Artificial Sequence: Synthetic coding sequence
atgcaccccctgctgaaccccctgctgctggccctgggcctgatggccctgctgctgaccaccgtgattgccctgacctgcctgggcggctttgccagccctggccctgtgccccccagcacagccctgcgggagctgattgaggagctggtgaacatcacccagaaccagaaggcccccctgtgcaatggctccatggtgtggagcatcaacctgacagctggcatgtactgtgccgccctggagagcctcatcaacgtgtctggctgcagcgccatcgagaagacccagaggatgctgagcggcttctgcccccacaaggtgtctgctggccagttcagcagcctgcacgtgcgggacaccaagattgaggtggcccagtttgtgaaggacctgctgctgcacctgaagaagctgttccgggagggccagttcaactag

SEQ ID NO: 3491 - DNA, 3999 bp, Artificial Sequence
  Description of Artificial Sequence: Synthetic coding sequence
atggagagccacagcagagctgggaagagcaggaagagcgccaagttccgcagcatcagccgcagcctgatgctgtgcaatgccaagaccagtgatgatggcagcagcccagatgagaagtacccagacccctttgagatcagcctggcccagggcaaggagggcatcttccacagctctgtgcagctggccgacaccagcgaggccggccccagctctgtgcctgacctggccctggccagcgaggccgcccagctgcaggccgctggaaatgaccggggcaagacctgccgccgcatcttcttcatgaaggagagcagcacagccagcagccgggagaagccaggcaagctggaggcccagagcagcaacttcctgttccccaaggcctgccaccagagggcccggagcaacagcacctctgtgaacccctactgcacccgggagattgacttccccatgaccaagaagtctgctgcccccacagaccggcagccctacagcctgtgcagcaacaggaagagcctgagccagcagctggactgcccagctgggaaggccgccggcaccagccggcccaccaggagcctgagcacagcccagctggtgcagcccagcggcggcctgcaggccagcgtcatcagcaacatcgtgctgatgaagggccaggccaagggcctgggcttcagcatcgtgggcggcaaggacagcatctacggccccatcggcatctacgtgaagaccatctttgctggaggagctgctgctgctgatggccgcctgcaggagggagatgagatcctggagctgaatggagagagcatggccggcctgacccaccaggatgccctgcagaagttcaagcaggccaagaagggcctgctgaccctgactgtgaggacccggctgacagccccacccagcctgtgcagccacctgagcccccccctgtgccgcagcctgagcagcagcacctgcatcaccaaggacagcagcagctttgccctggagagccccagcgcccccatcagcacagccaagcccaactaccgcatcatggtggaggtgtccctgcagaaggaggccggcgtgggcctgggcatcggcctgtgcagcgtgccctacttccagtgcatcagcggcatctttgtgcacaccctgagccctggctctgtggcccacctggatggccgcctgcgctgtggagatgaaattgtggagatcagtgacagccctgtgcactgcctgaccctgaatgaggtgtacaccatcctgagccactgtgaccccggccctgtgcccatcatcgtgagccgccacccagacccccaggtgtctgagcagcagctgaaggaggccgtggcccaggccgtggagaacaccaagtttgggaaggagcggcaccagtggagcctggagggcgtgaagaggctggagagctcctggcacggccggcccaccctggagaaggagcgggagaagaacagcgccccaccccacagaagagcccagaaggtgatgatccgcagcagcagtgacagcagctacatgagcggcagccctgggggcagccctggcagcggcagcgctgagaagcccagcagtgatgtggacatcagcacccacagccccagcctgcccctggcccgggagcctgtggtgctgagcatcgccagcagccggctgccccaggagagcccccccctgcctgagagccgggacagccacccccccctgcggctgaagaagagctttgagatcctggtgaggaagcccatgagcagcaagcccaagcccccacccaggaagtacttcaagagtgacagcgacccccagaagagcctggaggagcgggagaacagcagctgcagcagcggccacaccccacccacctgtggccaggaggcccgggagctgctgcccctgctgctgccccaggaggacacagctggccgcagccccagcgccagcgctggctgccccggccctggcatcggcccccagaccaagagcagcacagaaggagagcccggctggaggcgggccagccctgtgacccagaccagccccatcaagcaccccctgctgaagaggcaggccaggatggactacagctttgacaccacagctgaggacccctgggtgcgcatcagtgactgcatcaagaacctcttcagccccatcatgtctgaaaatcatggccacatgcccctgcagcccaatgccagcctgaatgaggaggagggcacccagggccacccagatggcaccccacccaagctggacacagccaacggcacccccaaggtgtacaagtctgctgacagcagcacagtgaagaagggcccccctgtggcccccaagccagcctggttccggcagagcctgaagggcctgaggaacagagccagtgacccccggggcctgcctgaccctgccctgagcacccagcctgccccagccagccgggagcacctgggcagccacatccgggccagcagcagcagcagcagcatccggcagaggatcagcagctttgagaccttcggcagcagccagctgcctgacaagggggcccagaggctgagcctgcagcccagcagcggggaggccgccaagcccctgggcaagcatgaggagggccgcttcagcggcctgctgggcagaggagctgcccccaccctggtgccccagcagcctgagcaggtgctgagcagcggcagccctgctgccagcgaggcccgggaccccggggtgtctgagagccccccacctggccggcagcccaaccagaagaccctgcccccaggccctgaccccctgctgcggctgctgagcacccaggccgaggagagccagggccctgtgctgaagatgcccagccagagggcccggagcttccccctgaccaggagccagagctgtgagaccaagctgctggatgagaagaccagcaagctgtacagcatcagcagccaggtgagcagcgctgtgatgaagagcctgctgtgcctgcccagcagcatcagctgtgcccagaccccctgcatccccaaggagggcgccagccccaccagcagcagcaatgaagacagcgctgccaatggatctgctgagaccagcgccctggacaccggcttcagcctgaacctgtctgagctgcgggagtacacagagggcctgacagaggccaaggaggatgatgatggagaccacagcagcctgcagagcggccagagcgtcatcagcctgctgagcagcgaggagctgaagaagctgattgaggaggtgaaggtgctggatgaggccaccctgaagcagctggatggcatccacgtgaccatcctgcacaaggaggagggcgccggcctgggcttcagcctggccggcggcgctgacctggagaacaaggtgatcaccgtgcacagggtcttccccaacggcctggccagccaggagggcaccatccagaagggaaatgaggtgctgagcatcaacgggaagagcctgaagggcaccacccaccatgatgccctggccatcctgcggcaggcccgggagccccggcaggccgtgattgtgaccaggaagctgaccccagaggccatgccagacctgaacagcagcacagacagcgctgccagcgccagcgctgccagtgatgtgtctgtggagagcacagctgaggccaccgtgtgcaccgtgaccctggagaagatgtctgctggcctgggcttcagcctggagggcggcaagggcagcctgcacggggacaagcccctgaccatcaaccgcatcttcaagggggccgccagcgagcagagcgagaccgtgcagcctggagatgagatcctgcagctgggcggcacagccatgcagggcctgaccaggtttgaggcctggaacatcatcaaggccctgcctgatggccctgtgaccatcgtcatccggaggaagagcctgcagagcaaggagaccacagctgctggggacagctag

SEQ ID NO: 3492 - DNA, 2163 bp, Artificial Sequence
  Description of Artificial Sequence: Synthetic coding sequence
atgtgcagcgtgctgcctgtggccgtgactggagtgaagaggctggagagctcctggcacggccggcccaccctggagaaggagcgggagaagaacagcgccccaccccaccggcgggcccagaaggtgatgatccgcagcagcagtgacagcagctacatgagcggcagccctgggggcagccctggcagcggcagcgctgagaagcccagcagtgatgtggacatcagcacccacagccccagcctgcccctggcccgggagcctgtggtgctgagcatcgccagcagccggctgccccaggagagcccccccctgcctgagagccgggacagccacccccccctgcggctgaagaagagctttgagatcctggtgaggaagcccatgagcagcaagcccaagcccccacccaggaagtacttcaagagtgacagcgacccccagaagagcctggaggagcgggagaacagcagctgcagcagcggccacaccccacccacctgtggccaggaggcccgggagctgctgcccctgctgctgccccaggaggacacagctggccgcagccccagcgccagcgctggctgccccggccctggcatcggcccccagaccaagagcagcacagaaggagagcccggctggaggcgggccagccctgtgacccagaccagccccatcaagcaccccctgctgaagaggcaggccaggatggactacagctttgacaccacagctgaggacccctgggtgcgcatcagtgactgcatcaagaacctcttcagccccatcatgtctgagaaccacggccacatgcccctgcagcccaatgccagcctgaatgaggaggagggcacccagggccacccagatggcaccccacccaagctggacacagccaacggcacccccaaggtgtacaagtctgctgacagcagcacagtgaagaagggcccccctgtggcccccaagccagcctggttccggcagagcctgaagggcctgaggaacagagccagtgacccccggggcctgcctgaccctgccctgagcacccagcctgccccagccagccgggagcacctgggcagccacatccgggccagcagcagcagcagcagcatccggcagaggatcagcagctttgagaccttcggcagcagccagctgcctgacaagggggcccagaggctgagcctgcagcccagcagtggagaggccgccaagcccctgggcaagcatgaggagggccgcttcagcggcctgctgggccgcggggccgcccccaccctggtgccccagcagcctgagcaggtgctgagcagcggcagccctgctgccagcgaggcccgggaccccggggtgtctgagagccccccacctggccggcagcccaaccagaagaccctgcccccaggccctgaccccctgctgcggctgctgagcacccaggccgaggagagccagggccctgtgctgaagatgcccagccagagggcccgctccttccccctgaccaggagccagagctgtgagaccaagctgctggatgagaagaccagcaagctgtacagcatcagcagccaggtgtcctctgctgtgatgaagagcctgctgtgcctgcccagcagcatcagctgtgcccagaccccctgcatccccaaggagggcgccagccccaccagcagcagcaatgaagattctgctgccaacggcagcgctgagaccagcgccctggacaccggcttcagcctgaacctgtctgagctgcgggagtacacagagggcctgacagaggccaaggaggatgatgatggagaccacagcagcctgcagagcggccagagcgtcatcagcctgctgagcagcgaggagctgaagaagctgattgaggaggtgaaggtgctggatgaggccaccctgaagcagctggatggcatccacgtgaccatcctgcacaaggaggagggcgccggcctgggcttcagcctggccggcggcgctgacctggagaacaaggtgatcaccgtgcacagggtcttccccaacggcctggccagccaggagggcaccatccagaagggaaatgaggtgctgagcatcaatggcaagagcctgaagggcaccacccaccacgcccggccccagctgctgcactag

SEQ ID NO: 3493 - DNA, 3492 bp, Artificial Sequence
  Description of Artificial Sequence: Synthetic coding sequence
atggagcggggggcccgggagatggccgcccctggggactgcccagctgggaaggccgccggcaccagccggcccaccaggagcctgagcacagcccagctggtgcagcccagcggcggcctgcaggccagcgtcatcagcaacatcgtgctgatgaagggccaggccaagggcctgggcttcagcatcgtgggcggcaaggacagcatctacggccccatcggcatctacgtgaagaccatctttgctggaggagctgctgctgctgatggccgcctgcaggagggagatgagatcctggagctgaatggagagagcatggccggcctgacccaccaggatgccctgcagaagttcaagcaggccaagaagggcctgctgaccctgactgtgaggacccggctgacagccccacccagcctgtgcagccacctgagcccccccctgtgccgcagcctgagcagcagcacctgcatcaccaaggacagcagcagctttgccctggagagccccagcgcccccatcagcacagccaagcccaactaccgcatcatggtggaggtgtccctgcagaaggaggccggcgtgggcctgggcatcggcctgtgcagcgtgccctacttccagtgcatcagcggcatctttgtgcacaccctgagccctggctctgtggcccacctggatggccgcctgcgctgtggagatgaaattgtggagatcagtgacagccctgtgcactgcctgaccctgaatgaggtgtacaccatcctgagccactgtgaccccggccctgtgcccatcatcgtgagccgccacccagacccccaggtgtctgagcagcagctgaaggaggccgtggcccaggccgtggagaacaccaagtttgggaaggagcggcaccagtggagcctggagggcgtgaagaggctggagagctcctggcacggccggcccaccctggagaaggagcgggagaagaacagcgccccaccccacagaagagcccagaaggtgatgatccgcagcagcagtgacagcagctacatgagcggcagccctgggggcagccctggcagcggcagcgctgagaagcccagcagtgatgtggacatcagcacccacagccccagcctgcccctggcccgggagcctgtggtgctgagcatcgccagcagccggctgccccaggagagcccccccctgcctgagagccgggacagccacccccccctgcggctgaagaagagctttgagatcctggtgaggaagcccatgagcagcaagcccaagcccccacccaggaagtacttcaagagtgacagcgacccccagaagagcctggaggagcgggagaacagcagctgcagcagcggccacaccccacccacctgtggccaggaggcccgggagctgctgcccctgctgctgccccaggaggacacagctggccgcagccccagcgccagcgctggctgccccggccctggcatcggcccccagaccaagagcagcacagaaggagagcccggctggaggcgggccagccctgtgacccagaccagccccatcaagcaccccctgctgaagaggcaggccaggatggactacagctttgacaccacagctgaggacccctgggtgcgcatcagtgactgcatcaagaacctcttcagccccatcatgtctgaaaatcatggccacatgcccctgcagcccaatgccagcctgaatgaggaggagggcacccagggccacccagatggcaccccacccaagctggacacagccaacggcacccccaaggtgtacaagtctgctgacagcagcacagtgaagaagggcccccctgtggcccccaagccagcctggttccggcagagcctgaagggcctgaggaacagagccagtgacccccggggcctgcctgaccctgccctgagcacccagcctgccccagccagccgggagcacctgggcagccacatccgggccagcagcagcagcagcagcatccggcagaggatcagcagctttgagaccttcggcagcagccagctgcctgacaagggggcccagaggctgagcctgcagcccagcagcggggaggccgccaagcccctgggcaagcatgaggagggccgcttcagcggcctgctgggcagaggagctgcccccaccctggtgccccagcagcctgagcaggtgctgagcagcggcagccctgctgccagcgaggcccgggaccccggggtgtctgagagccccccacctggccggcagcccaaccagaagaccctgcccccaggccctgaccccctgctgcggctgctgagcacccaggccgaggagagccagggccctgtgctgaagatgcccagccagagggcccggagcttccccctgaccaggagccagagctgtgagaccaagctgctggatgagaagaccagcaagctgtacagcatcagcagccaggtgagcagcgctgtgatgaagagcctgctgtgcctgcccagcagcatcagctgtgcccagaccccctgcatccccaaggagggcgccagccccaccagcagcagcaatgaagacagcgctgccaatggatctgctgagaccagcgccctggacaccggcttcagcctgaacctgtctgagctgcgggagtacacagagggcctgacagaggccaaggaggatgatgatggagaccacagcagcctgcagagcggccagagcgtcatcagcctgctgagcagcgaggagctgaagaagctgattgaggaggtgaaggtgctggatgaggccaccctgaagcagctggatggcatccacgtgaccatcctgcacaaggaggagggcgccggcctgggcttcagcctggccggcggcgctgacctggagaacaaggtgatcaccgtgcacagggtcttccccaacggcctggccagccaggagggcaccatccagaagggaaatgaggtgctgagcatcaacgggaagagcctgaagggcaccacccaccatgatgccctggccatcctgcggcaggcccgggagccccggcaggccgtgattgtgaccaggaagctgaccccagaggccatgccagacctgaacagcagcacagacagcgctgccagcgccagcgctgccagtgatgtgtctgtggagagcacagaggccaccgtgtgcaccgtgaccctggagaagatgtctgctggcctgggcttcagcctggagggcggcaagggcagcctgcatggagacaagcccctgaccatcaaccgcatcttcaagggagctgccagcgagcagagcgagaccgtgcagcctggagatgagatcctgcagctgggcggcacagccatgcagggcctgaccaggtttgaggcctggaacatcatcaaggccctgcctgatggccctgtgaccatcgtcatccggaggaagagcctgcagagcaaggagaccacagctgctggggacagctag

SEQ ID NO: 3494 - DNA, 1896 bp, Artificial Sequence
  Description of Artificial Sequence: Synthetic coding sequence
atggactacagctttgacaccacagctgaggacccctgggtgcgcatcagtgactgcatcaagaacctcttcagccccatcatgtctgagaaccacggccacatgcccctgcagcccaatgccagcctgaatgaggaggagggcacccagggccacccagatggcaccccacccaagctggacacagccaacggcacccccaaggtgtacaagtctgctgacagcagcacagtgaagaagggcccccctgtggcccccaagccagcctggttccggcagagcctgaagggcctgaggaacagagccagtgacccccggggcctgcctgaccctgccctgagcacccagcctgccccagccagccgggagcacctgggcagccacatccgggccagcagcagcagcagcagcatccggcagaggatcagcagctttgagaccttcggcagcagccagctgcctgacaagggggcccagaggctgagcctgcagcccagcagtggagaggccgccaagcccctgggcaagcatgaggagggccgcttcagcggcctgctgggccgcggggccgcccccaccctggtgccccagcagcctgagcaggtgctgagcagcggcagccctgctgccagcgaggcccgggaccccggggtgtctgagagccccccacctggccggcagcccaaccagaagaccctgcccccaggccctgaccccctgctgcggctgctgagcacccaggccgaggagagccagggccctgtgctgaagatgcccagccagagggcccgctccttccccctgaccaggagccagagctgtgagaccaagctgctggatgagaagaccagcaagctgtacagcatcagcagccaggtgtcctctgctgtgatgaagagcctgctgtgcctgcccagcagcatcagctgtgcccagaccccctgcatccccaaggagggcgccagccccaccagcagcagcaatgaagattctgctgccaacggcagcgctgagaccagcgccctggacaccggcttcagcctgaacctgtctgagctgcgggagtacacagagggcctgacagaggccaaggaggatgatgatggagaccacagcagcctgcagagcggccagagcgtcatcagcctgctgagcagcgaggagctgaagaagctgattgaggaggtgaaggtgctggatgaggccaccctgaagcagctggatggcatccacgtgaccatcctgcacaaggaggagggcgccggcctgggcttcagcctggccggcggcgctgacctggagaacaaggtgatcaccgtgcacagggtcttccccaacggcctggccagccaggagggcaccatccagaagggaaatgaggtgctgagcatcaatggcaagagcctgaagggcaccacccaccatgatgccctggccatcctgcggcaggcccgggagccccggcaggccgtcatcgtgaccaggaagctgaccccagaggccatgccagacctgaacagcagcacagattctgctgccagcgccagcgctgccagtgatgtgtctgtggagagcacagctgaggccaccgtgtgcaccgtgaccctggagaagatgtctgctggcctgggcttcagcctggagggcggcaagggcagcctgcatggagacaagcccctgaccatcaaccgcatcttcaagggagctgccagcgagcagagcgagaccgtgcagcctggagatgagatcctgcagctgggcggcacagccatgcagggcctgaccaggtttgaggcctggaacatcatcaaggccctgcctgatggccctgtgaccatcgtcatccggaggaagagcctgcagagcaaggagaccacagctgctggggacagctag

SEQ ID NO: 3495 - DNA, 1974 bp, Artificial Sequence
  Description of Artificial Sequence: Synthetic coding sequence
atgtggctgcctgtgaaggagctgaccatccacgagtgccagcagatgagcacctaccgggcccccaaccaggaggcccgggagctgctgcccctgctgctgccccaggaggacacagctggccgcagccccagcgccagcgctggctgccccggccctggcatcggcccccagaccaagagcagcacagaaggagagcccggctggaggcgggccagccctgtgacccagaccagccccatcaagcaccccctgctgaagaggcaggccaggatggactacagctttgacaccacagctgaggacccctgggtgcgcatcagtgactgcatcaagaacctcttcagccccatcatgtctgaaaatcatggccacatgcccctgcagcccaatgccagcctgaatgaggaggagggcacccagggccacccagatggcaccccacccaagctggacacagccaacggcacccccaaggtgtacaagtctgctgacagcagcacagtgaagaagggcccccctgtggcccccaagccagcctggttccggcagagcctgaagggcctgaggaacagagccagtgacccccggggcctgcctgaccctgccctgagcacccagcctgccccagccagccgggagcacctgggcagccacatccgggccagcagcagcagcagcagcatccggcagaggatcagcagctttgagaccttcggcagcagccagctgcctgacaagggggcccagaggctgagcctgcagcccagcagcggggaggccgccaagcccctgggcaagcatgaggagggccgcttcagcggcctgctgggcagaggagctgcccccaccctggtgccccagcagcctgagcaggtgctgagcagcggcagccctgctgccagcgaggcccgggaccccggggtgtctgagagccccccacctggccggcagcccaaccagaagaccctgcccccaggccctgaccccctgctgcggctgctgagcacccaggccgaggagagccagggccctgtgctgaagatgcccagccagagggcccggagcttccccctgaccaggagccagagctgtgagaccaagctgctggatgagaagaccagcaagctgtacagcatcagcagccaggtgagcagcgctgtgatgaagagcctgctgtgcctgcccagcagcatcagctgtgcccagaccccctgcatccccaaggagggcgccagccccaccagcagcagcaatgaagacagcgctgccaatggatctgctgagaccagcgccctggacaccggcttcagcctgaacctgtctgagctgcgggagtacacagagggcctgacagaggccaaggaggatgatgatggagaccacagcagcctgcagagcggccagagcgtcatcagcctgctgagcagcgaggagctgaagaagctgattgaggaggtgaaggtgctggatgaggccaccctgaagcagctggatggcatccacgtgaccatcctgcacaaggaggagggcgccggcctgggcttcagcctggccggcggcgctgacctggagaacaaggtgatcaccgtgcacagggtcttccccaacggcctggccagccaggagggcaccatccagaagggaaatgaggtgctgagcatcaacgggaagagcctgaagggcaccacccaccatgatgccctggccatcctgcggcaggcccgggagccccggcaggccgtgattgtgaccaggaagctgaccccagaggccatgccagacctgaacagcagcacagacagcgctgccagcgccagcgctgccagtgatgtgtctgtggagagcacagaggccaccgtgtgcaccgtgaccctggagaagatgtctgctggcctgggcttcagcctggagggcggcaagggcagcctgcatggagacaagcccctgaccatcaaccgcatcttcaagtag

SEQ ID NO: 3496 - DNA, 1365 bp, Artificial Sequence
  Description of Artificial Sequence: Synthetic coding sequence
atggagagccacagcagagctgggaagagcaggaagagcgccaagttccgcagcatcagccgcagcctgatgctgtgcaatgccaagaccagtgatgatggcagcagcccagatgagaagtacccagacccctttgagatcagcctggcccagggcaaggagggcatcttccacagctctgtgcagctggccgacaccagcgaggccggccccagctctgtgcctgacctggccctggccagcgaggccgcccagctgcaggccgctggaaatgaccggggcaagacctgccgccgcatcttcttcatgaaggagagcagcacagccagcagccgggagaagccaggcaagctggaggcccagagcagcaacttcctgttccccaaggcctgccaccagagggcccggagcaacagcacctctgtgaacccctactgcacccgggagattgacttccccatgaccaagaagtctgctgcccccacagaccggcagccctacagcctgtgcagcaacaggaagagcctgagccagcagctggactgcccagctgggaaggccgccggcaccagccggcccaccaggagcctgagcacagcccagctggtgcagcccagcggcggcctgcaggccagcgtcatcagcaacatcgtgctgatgaagggccaggccaagggcctgggcttcagcatcgtgggcggcaaggacagcatctacggccccatcggcatctacgtgaagaccatctttgctggaggagctgctgctgctgatggccgcctgcaggagggagatgagatcctggagctgaatggagagagcatggccggcctgacccaccaggatgccctgcagaagttcaagcaggccaagaagggcctgctgaccctgactgtgaggacccggctgacagccccacccagcctgtgcagccacctgagcccccccctgtgccgcagcctgagcagcagcacctgcatcaccaaggacagcagcagctttgccctggagagccccagcgcccccatcagcacagccaagcccaactaccgcatcatggtggaggtgtccctgcagaaggaggccggcgtgggcctgggcatcggcctgtgcagcgtgccctacttccagtgcatcagcggcatctttgtgcacaccctgagccctggctctgtggcccacctggatggccgcctgcgctgtggagatgaaattgtggagatcagtgacagccctgtgcactgcctgaccctgaatgaggtgtacaccatcctgagccactgtgaccccggccctgtgcccatcatcgtgagccgccacccagacccccagaaggaggagatggaggcccaggaggtgaagtag

SEQ ID NO: 3497 - DNA, 1683 bp, Artificial Sequence
  Description of Artificial Sequence: Synthetic coding sequence
atggactacagctttgacaccacagctgaggacccctgggtgcgcatcagtgactgcatcaagaacctcttcagccccatcatgtctgagaaccacggccacatgcccctgcagcccaatgccagcctgaatgaggaggagggcacccagggccacccagatggcaccccacccaagctggacacagccaacggcacccccaaggtgtacaagtctgctgacagcagcacagtgaagaagggcccccctgtggcccccaagccagcctggttccggcagagcctgaagggcctgaggaacagagccagtgacccccggggcctgcctgaccctgccctgagcacccagcctgccccagccagccgggagcacctgggcagccacatccgggccagcagcagcagcagcagcatccggcagaggatcagcagctttgagaccttcggcagcagccagctgcctgacaagggggcccagaggctgagcctgcagcccagcagtggagaggccgccaagcccctgggcaagcatgaggagggccgcttcagcggcctgctgggccgcggggccgcccccaccctggtgccccagcagcctgagcaggtgctgagcagcggcagccctgctgccagcgaggcccgggaccccggggtgtctgagagccccccacctggccggcagcccaaccagaagaccctgcccccaggccctgaccccctgctgcggctgctgagcacccaggccgaggagagccagggccctgtgctgaagatgcccagccagagggcccgctccttccccctgaccaggagccagagctgtgagaccaagctgctggatgagaagaccagcaagctgtacagcatcagcagccaggtgtcctctgctgtgatgaagagcctgctgtgcctgcccagcagcatcagctgtgcccagaccccctgcatccccaaggagggcgccagccccaccagcagcagcaatgaagattctgctgccaacggcagcgctgagaccagcgccctggacaccggcttcagcctgaacctgtctgagctgcgggagtacacagagggcctgacagaggccaaggaggatgatgatggagaccacagcagcctgcagagcggccagagcgtcatcagcctgctgagcagcgaggagctgaagaagctgattgaggaggtgaaggtgctggatgaggccaccctgaagcagctggatggcatccacgtgaccatcctgcacaaggaggagggcgccggcctgggcttcagcctggccggcggcgctgacctggagaacaaggtgatcaccgtgcacagggtcttccccaacggcctggccagccaggagggcaccatccagaagggaaatgaggtgctgagcatcaatggcaagagcctgaagggcaccacccaccatgatgccctggccatcctgcggcaggcccgggagccccggcaggccgtcatcgtgaccaggaagctgaccccagaggccatgccagacctgaacagcagcacagattctgctgccagcgccagcgctgccagtgatgtgtctgtggagagcacagaggccaccgtgtgcaccgtgaccctggaggatgtgggccgggccggcctgcagcctggaagaagagagggcctgcccacccggcggcaggccagccaccactag

SEQ ID NO: 3498 - DNA, 3996 bp, Artificial Sequence
  Description of Artificial Sequence: Synthetic coding sequence
atggagagccacagcagagctgggaagagcaggaagagcgccaagttccgcagcatcagccgcagcctgatgctgtgcaatgccaagaccagtgatgatggcagcagcccagatgagaagtacccagacccctttgagatcagcctggcccagggcaaggagggcatcttccacagctctgtgcagctggccgacaccagcgaggccggccccagctctgtgcctgacctggccctggccagcgaggccgcccagctgcaggccgctggaaatgaccggggcaagacctgccgccgcatcttcttcatgaaggagagcagcacagccagcagccgggagaagccaggcaagctggaggcccagagcagcaacttcctgttccccaaggcctgccaccagagggcccggagcaacagcacctctgtgaacccctactgcacccgggagattgacttccccatgaccaagaagtctgctgcccccacagaccggcagccctacagcctgtgcagcaacaggaagagcctgagccagcagctggactgcccagctgggaaggccgccggcaccagccggcccaccaggagcctgagcacagcccagctggtgcagcccagcggcggcctgcaggccagcgtcatcagcaacatcgtgctgatgaagggccaggccaagggcctgggcttcagcatcgtgggcggcaaggacagcatctacggccccatcggcatctacgtgaagaccatctttgctggaggagctgctgctgctgatggccgcctgcaggagggagatgagatcctggagctgaatggagagagcatggccggcctgacccaccaggatgccctgcagaagttcaagcaggccaagaagggcctgctgaccctgactgtgaggacccggctgacagccccacccagcctgtgcagccacctgagcccccccctgtgccgcagcctgagcagcagcacctgcatcaccaaggacagcagcagctttgccctggagagccccagcgcccccatcagcacagccaagcccaactaccgcatcatggtggaggtgtccctgcagaaggaggccggcgtgggcctgggcatcggcctgtgcagcgtgccctacttccagtgcatcagcggcatctttgtgcacaccctgagccctggctctgtggcccacctggatggccgcctgcgctgtggagatgaaattgtggagatcagtgacagccctgtgcactgcctgaccctgaatgaggtgtacaccatcctgagccactgtgaccccggccctgtgcccatcatcgtgagccgccacccagacccccaggtgtctgagcagcagctgaaggaggccgtggcccaggccgtggagaacaccaagtttgggaaggagcggcaccagtggagcctggagggcgtgaagaggctggagagctcctggcacggccggcccaccctggagaaggagcgggagaagaacagcgccccaccccacagaagagcccagaaggtgatgatccgcagcagcagtgacagcagctacatgagcggcagccctgggggcagccctggcagcggcagcgctgagaagcccagcagtgatgtggacatcagcacccacagccccagcctgcccctggcccgggagcctgtggtgctgagcatcgccagcagccggctgccccaggagagcccccccctgcctgagagccgggacagccacccccccctgcggctgaagaagagctttgagatcctggtgaggaagcccatgagcagcaagcccaagcccccacccaggaagtacttcaagagtgacagcgacccccagaagagcctggaggagcgggagaacagcagctgcagcagcggccacaccccacccacctgtggccaggaggcccgggagctgctgcccctgctgctgccccaggaggacacagctggccgcagccccagcgccagcgctggctgccccggccctggcatcggcccccagaccaagagcagcacagaaggagagcccggctggaggcgggccagccctgtgacccagaccagccccatcaagcaccccctgctgaagaggcaggccaggatggactacagctttgacaccacagctgaggacccctgggtgcgcatcagtgactgcatcaagaacctcttcagccccatcatgtctgaaaatcatggccacatgcccctgcagcccaatgccagcctgaatgaggaggagggcacccagggccacccagatggcaccccacccaagctggacacagccaacggcacccccaaggtgtacaagtctgctgacagcagcacagtgaagaagggcccccctgtggcccccaagccagcctggttccggcagagcctgaagggcctgaggaacagagccagtgacccccggggcctgcctgaccctgccctgagcacccagcctgccccagccagccgggagcacctgggcagccacatccgggccagcagcagcagcagcagcatccggcagaggatcagcagctttgagaccttcggcagcagccagctgcctgacaagggggcccagaggctgagcctgcagcccagcagcggggaggccgccaagcccctgggcaagcatgaggagggccgcttcagcggcctgctgggcagaggagctgcccccaccctggtgccccagcagcctgagcaggtgctgagcagcggcagccctgctgccagcgaggcccgggaccccggggtgtctgagagccccccacctggccggcagcccaaccagaagaccctgcccccaggccctgaccccctgctgcggctgctgagcacccaggccgaggagagccagggccctgtgctgaagatgcccagccagagggcccggagcttccccctgaccaggagccagagctgtgagaccaagctgctggatgagaagaccagcaagctgtacagcatcagcagccaggtgagcagcgctgtgatgaagagcctgctgtgcctgcccagcagcatcagctgtgcccagaccccctgcatccccaaggagggcgccagccccaccagcagcagcaatgaagacagcgctgccaatggatctgctgagaccagcgccctggacaccggcttcagcctgaacctgtctgagctgcgggagtacacagagggcctgacagaggccaaggaggatgatgatggagaccacagcagcctgcagagcggccagagcgtcatcagcctgctgagcagcgaggagctgaagaagctgattgaggaggtgaaggtgctggatgaggccaccctgaagcagctggatggcatccacgtgaccatcctgcacaaggaggagggcgccggcctgggcttcagcctggccggcggcgctgacctggagaacaaggtgatcaccgtgcacagggtcttccccaacggcctggccagccaggagggcaccatccagaagggaaatgaggtgctgagcatcaacgggaagagcctgaagggcaccacccaccatgatgccctggccatcctgcggcaggcccgggagccccggcaggccgtgattgtgaccaggaagctgaccccagaggccatgccagacctgaacagcagcacagacagcgctgccagcgccagcgctgccagtgatgtgtctgtggagagcacagaggccaccgtgtgcaccgtgaccctggagaagatgtctgctggcctgggcttcagcctggagggcggcaagggcagcctgcatggagacaagcccctgaccatcaaccgcatcttcaagggagctgccagcgagcagagcgagaccgtgcagcctggagatgagatcctgcagctgggcggcacagccatgcagggcctgaccaggtttgaggcctggaacatcatcaaggccctgcctgatggccctgtgaccatcgtcatccggaggaagagcctgcagagcaaggagaccacagctgctggggacagctag

SEQ ID NO: 3499 - DNA, 1785 bp, Artificial Sequence
  Description of Artificial Sequence: Synthetic coding sequence
atggagagccacagcagagctgggaagagcaggaagagcgccaagttccgcagcatcagccgcagcctgatgctgtgcaatgccaagaccagtgatgatggcagcagcccagatgagaagtacccagacccctttgagatcagcctggcccagggcaaggagggcatcttccacagctctgtgcagctggccgacaccagcgaggccggccccagctctgtgcctgacctggccctggccagcgaggccgcccagctgcaggccgctggaaatgaccggggcaagacctgccgccgcatcttcttcatgaaggagagcagcacagccagcagccgggagaagccaggcaagctggaggcccagagcagcaacttcctgttccccaaggcctgccaccagagggcccggagcaacagcacctctgtgaacccctactgcacccgggagattgacttccccatgaccaagaagtctgctgcccccacagaccggcagccctacagcctgtgcagcaacaggaagagcctgagccagcagctggactgcccagctgggaaggccgccggcaccagccggcccaccaggagcctgagcacagcccagctggtgcagcccagcggcggcctgcaggccagcgtcatcagcaacatcgtgctgatgaagggccaggccaagggcctgggcttcagcatcgtgggcggcaaggacagcatctacggccccatcggcatctacgtgaagaccatctttgctggaggagctgctgctgctgatggccgcctgcaggagggagatgagatcctggagctgaatggagagagcatggccggcctgacccaccaggatgccctgcagaagttcaagcaggccaagaagggcctgctgaccctgactgtgaggacccggctgacagccccacccagcctgtgcagccacctgagcccccccctgtgccgcagcctgagcagcagcacctgcatcaccaaggacagcagcagctttgccctggagagccccagcgcccccatcagcacagccaagcccaactaccgcatcatggtggaggtgtccctgcagaaggaggccggcgtgggcctgggcatcggcctgtgcagcgtgccctacttccagtgcatcagcggcatctttgtgcacaccctgagccctggctctgtggcccacctggatggccgcctgcgctgtggagatgaaattgtggagatcagtgacagccctgtgcactgcctgaccctgaatgaggtgtacaccatcctgagccactgtgaccccggccctgtgcccatcatcgtgagccgccacccagacccccaggtgtctgagcagcagctgaaggaggccgtggcccaggccgtggagaacaccaagtttgggaaggagcggcaccagtggagcctggagggcgtgaagaggctggagagctcctggcacggccggcccaccctggagaaggagcgggagaagaacagcgccccaccccacagaagagcccagaaggtgatgatccgcagcagcagtgacagcagctacatgagcggcagccctgggggcagccctggcagcggcagcgctgagaagcccagcagtgatgtggacatcagcacccacagccccagcctgcccctggcccgggagcctgtggtgctgagcatcgccagcagccggctgccccaggagagcccccccctgcctgagagccgggacagccacccccccctgcggctgaagaagagctttgagatcctggtgaggaagcccatgtcctag

SEQ ID NO: 3500 - DNA, 468 bp, Artificial Sequence
  Description of Artificial Sequence: Synthetic coding sequence
atgaccccaggcaagaccagcctggtgtccctgctgctgctgctgagcctggaggccatcgtgaaggccggcatcaccatccccagaaatcctggctgccccaacagcgaggacaagaacttccccaggacagtgatggtgaacctgaacatccacaacagaaacaccaacaccaaccccaagaggagcagtgactactacaacagaagcaccagcccctggaacctgcacagaaatgaagatcctgagcgctaccccagcgtcatctgggaggccaagtgccgccacctgggctgcatcaatgctgatggaaatgtggactaccacatgaacagcgtgcccatccagcaggagatcctggtgctgcggcgggagcccccccactgccccaacagcttccggctggagaagatcctggtgtctgtgggctgcacctgtgtgacccccatcgtgcaccacgtggcctag

SEQ ID NO: 3501 - DNA, 543 bp, Artificial Sequence
  Description of Artificial Sequence: Synthetic coding sequence
atggactggccccacaacctgctcttcctgctgaccatcagcatcttcctgggcctgggccagcccaggagccccaagagcaagaggaagggccagggccggcccggccccctggcccctggcccccaccaggtgcccctggacctggtgtccaggatgaagccctatgccaggatggaggagtatgaaagaaacatcgaggagatggtggcccagctgaggaacagcagcgagctggcccagaggaaatgtgaggtgaacctgcagctgtggatgagcaacaagaggagcctgagcccctggggctacagcatcaaccacgaccccagccgcatccctgtggacctgcctgaggcccgctgcctgtgcctgggctgtgtgaaccccttcaccatgcaggaggaccgctccatggtgtctgtgcctgtgttcagccaggtgcctgtgagaagaaggctgtgccccccaccacccaggacaggcccctgccggcagagagctgtgatggagaccatcgctgtgggctgcacctgcatcttctag

SEQ ID NO: 3502 - DNA, 594 bp, Artificial Sequence
  Description of Artificial Sequence: Synthetic coding sequence
atgaccctgctgcccggcctgctcttcctgacctggctgcacacctgcctggcccaccacgaccccagcctgcggggccacccccacagccacggcaccccccactgctacagcgctgaggagctgcccctgggccaggccccaccccacctgctggcccggggggccaagtggggccaggccctgcctgtggccctggtgagcagcctggaggccgccagccaccggggcagacatgagcggcccagcgccaccacccagtgccctgtgctgcggcctgaggaggtgctggaggccgacacccaccagaggagcatcagcccctggagatacagagtggacacagatgaagatcgctacccccagaagctggcctttgctgagtgcctgtgccggggctgcattgatgccaggacaggccgggagacagctgccctgaacagcgtgcggctgctgcagagcctgctggtgctgcggcggcggccctgcagcagagatggcagcggcctgcccacccctggggcctttgccttccacacagagttcatccacgtgcctgtgggctgcacctgtgtgctgcccaggtctgtgtag

SEQ ID NO: 3503 - DNA, 609 bp, Artificial Sequence
  Description of Artificial Sequence: Synthetic coding sequence
atgctggtggccggcttcctgctggccctgcccccatcctgggccgccggggcccccagggctggaagaagacctgcccggccccggggctgtgccgacaggcctgaggagctgctggagcagctgtatggccgcctggccgccggcgtgctgagcgccttccaccacaccctgcagctgggcccccgggagcaggccagaaatgccagctgcccagctgggggccggcctgctgaccggcgcttccggccccccaccaacctgcggtctgtgagcccctgggcctaccgcatctcctatgaccctgcccgctacccccgctacctgcctgaggcctactgcctgtgccggggctgcctgaccggcctgtttggagaagaagatgtgcgcttccgcagcgcccctgtgtacatgcccaccgtggtgctgcggaggaccccagcctgtgccggcggccgctctgtgtacacagaggcctacgtgaccatccctgtgggctgcacctgtgtgcctgagcctgagaaggatgctgacagcatcaacagcagcattgacaagcagggcgccaagctgctgctgggccccaatgatgccccagctggcccctag

SEQ ID NO: 3504 - DNA, 492 bp, Artificial Sequence
  Description of Artificial Sequence: Synthetic coding sequence
atgacagtgaagaccctgcacggccctgccatggtgaagtacctgctgctgagcatcctgggcctggccttcctgtctgaggccgccgccaggaagatccccaaggtgggccacaccttcttccagaagccagagagctgcccccctgtgcctgggggctccatgaagctggacatcggcatcatcaatgaaaaccagagggtgtccatgagcaggaacatcgagagccgcagcaccagcccctggaactacacagtgacctgggaccccaaccgctaccccagcgaggtggtgcaggcccagtgcaggaacctgggctgcatcaatgcccagggcaaggaggacatctccatgaacagcgtgcccatccagcaggagaccctggtggtgcggaggaagcaccagggctgcagcgtgtccttccagctggagaaggtgctggtgacagtgggctgcacctgtgtgacccctgtgatccaccacgtgcagtag

SEQ ID NO: 3505 - DNA, 531 bp, Artificial Sequence
  Description of Artificial Sequence: Synthetic coding sequence
atgaaggccagcagcctggccttcagcctgctgtctgctgccttctacctgctgtggacccccagcacaggcctgaagaccctgaacctgggcagctgtgtgattgccaccaacctgcaggagatcagaaatggcttcagcgagatccggggctctgtgcaggccaaggatggcaacatcgacatccgcatcctgcggaggacagagagcctgcaggacaccaagccagccaaccgctgctgcctgctgcggcacctgctgcggctgtacctggacagagtcttcaagaactaccagaccccagaccactacaccctgaggaagatcagcagcctggccaacagcttcctgaccatcaagaaggacctgcggctgtgccacgcccacatgacctgccactgtggggaggaggccatgaagaagtacagccagatcctgagccactttgagaagctggagccccaggccgctgtggtgaaggccctgggggagctggacatcctgctgcagtggatggaggagacagaatag

SEQ ID NO: 3506 - DNA, 531 bp, Artificial Sequence; identical to SEQ ID NO: 3505
  Description of Artificial Sequence: Synthetic coding sequence

SEQ ID NO: 3507 - DNA, 456 bp, Artificial Sequence
  Description of Artificial Sequence: Synthetic coding sequence
atgaaggccagcagcctggccttcagcctgctgtctgctgccttctacctgctgtggacccccagcacaggcctgaagaccctgaacctgggcagctgtgtgattgccaccaacctgcaggagatcagaaatggcttcagcgagatccggggctctgtgcaggccaaggatggcaacatcgacatccgcatcctgcggaggacagagagcctgcaggacaccaagccagccaaccgctgctgcctgctgcggcacctgctgcggctgtacctggacagagtcttcaagaactaccagaccccagaccactacaccctgaggaagatcagcagcctggccaacagcttcctgaccatcaagaaggacctgcggctgtgcctggagccccaggccgctgtggtgaaggccctgggggagctggacatcctgctgcagtggatggaggagacagaatag

SEQ ID NO: 3508 - DNA, 540 bp, Artificial Sequence
  Description of Artificial Sequence: Synthetic coding sequence
atggccgccctgcagaagtctgtgagcagcttcctgatgggcaccctggccaccagctgcctgctgctgctggccctgctggtgcagggcggcgctgctgcccccatcagcagccactgccgcctggacaagagcaacttccagcagccctacatcaccaacagaaccttcatgctggccaaggaggccagcctggccgacaacaacacagatgtgcggctgattggagagaagctgttccatggagtgtccatgtctgagcgctgctacctgatgaagcaggtgctgaacttcaccctggaggaggtgctcttcccccagagcgaccgcttccagccctacatgcaggaggtggtgcccttcctggcccggctgagcaaccggctgagcacctgccacatcgagggagatgacctgcacatccagagaaatgtgcagaagctgaaggacacagtgaagaagctgggggagagcggggagatcaaggccatcggggagctggacctgctcttcatgagcctgagaaatgcctgcatctag

SEQ ID NO: 3509 - DNA, 540 bp, Artificial Sequence; identical to SEQ ID NO: 3508
  Description of Artificial Sequence: Synthetic coding sequence

SEQ ID NO: 3510 - DNA, 1890 bp, Artificial Sequence
  Description of Artificial Sequence: Synthetic coding sequence
atgaaccaggtgaccatccagtgggatgctgtgattgccctgtacatcctcttctcctggtgccacggcggcatcaccaacatcaactgcagcggccacatctgggtggagcccgccaccatcttcaagatgggcatgaacatcagcatctactgccaggccgccatcaagaactgccagcccaggaagctgcacttctacaagaatggcatcaaggagcgcttccagatcacccgcatcaacaagaccacagcccggctgtggtacaagaacttcctggagccccacgcctccatgtactgcacagctgagtgccccaagcacttccaggagaccctcatctgtgggaaggacatcagcagcggctaccccccagacatcccagatgaggtgacctgtgtgatctatgagtacagcggcaacatgacctgcacctggaatgctgggaagctgacctacatcgacaccaagtatgtggtgcacgtgaagagcctggagacagaggaggagcagcagtacctgaccagcagctacatcaacatcagcacagacagcctgcagggcggcaagaagtacctggtgtgggtgcaggccgccaatgccctgggcatggaggagagcaagcagctgcagatccacctggatgacatcgtcatccccagcgctgctgtgatcagcagagctgagaccatcaatgccaccgtgcccaagaccatcatctactgggacagccagaccaccatcgagaaggtgtcctgtgagatgagatacaaggccaccaccaaccagacctggaatgtgaaggagtttgacaccaacttcacctacgtgcagcagagcgagttctacctggagcccaacatcaagtatgtgttccaggtgcgctgccaggagaccgggaagcgctactggcagccctggagcagcctcttcttccacaagaccccagagaccgtgccccaggtgaccagcaaggccttccagcacgacacctggaacagcggcctgactgtggccagcatcagcacaggccacctgaccagtgacaacagaggagacatcggcctgctgctgggcatgattgtgtttgctgtgatgctgagcatcctgagcctgattggcatcttcaacagaagcttcagaacaggcatcaagaggcgcatcctgctgctgatccccaagtggctgtatgaggacatccccaacatgaagaacagcaatgtggtgaagatgctgcaggagaacagcgagctgatgaacaacaacagcagcgagcaggtgctgtatgtggaccccatgatcacagagatcaaggagatcttcatccctgagcacaagcccacagactacaagaaggaaaatacaggccccctggagacccgggactacccccagaacagcctgtttgacaacaccaccgtggtgtacatcccagacctgaacacaggctacaagccccagatcagcaacttcctgcctgagggcagccacctgagcaacaacaatgagatcaccagcctgaccctgaagccccctgtggacagcctggacagcggcaacaacccccggctgcagaagcaccccaactttgccttctctgtgtcctctgtgaacagcctgagcaacaccatcttcctgggggagctgagcctcatcctgaaccagggagaatgtagcagcccagacatccagaacagcgtggaggaggagaccaccatgctgctggagaatgacagccccagcgagaccatccctgagcagaccctgctgcctgatgaatttgtgtcctgcctgggcatcgtgaatgaggagctgcccagcatcaacacctacttcccccagaacatcctggagagccacttcaaccgcatcagcctgctggagaagtag

SEQ ID NO: 3511 - DNA, 1071 bp, Artificial Sequence
  Description of Artificial Sequence: Synthetic coding sequence
atgaaccaggtgaccatccagtgggatgctgtgattgccctgtacatcctcttctcctggtgccacggcggcatcaccaacatcaactgcagcggccacatctgggtggagcccgccaccatcttcaagatgggcatgaacatcagcatctactgccaggccgccatcaagaactgccagcccaggaagctgcacttctacaagaatggcatcaaggagcgcttccagatcacccgcatcaacaagaccacagcccggctgtggtacaagaacttcctggagccccacgcctccatgtactgcacagctgagtgccccaagcacttccaggagaccctcatctgtgggaaggacatcagcagcggctaccccccagacatcccagatgaggtgacctgtgtgatctatgagtacagcggcaacatgacctgcacctggaatgctgggaagctgacctacatcgacaccaagtatgtggtgcacgtgaagagcctggagacagaggaggagcagcagtacctgaccagcagctacatcaacatcagcacagacagcctgcagggcggcaagaagtacctggtgtgggtgcaggccgccaatgccctgggcatggaggagagcaagcagctgcagatccacctggatgacatcgtcatccccagcgctgctgtgatcagcagagctgagaccatcaatgccaccgtgcccaagaccatcatctactgggacagccagaccaccatcgagaaggtgtcctgtgagatgagatacaaggccaccaccaaccagacctggaatgtgaaggagtttgacaccaacttcacctacgtgcagcagagcgagttctacctggagcccaacatcaagtatgtgttccaggtgcgctgccaggagaccgggaagcgctactggcagccctggagcagcctcttcttccacaagaccccagagaccgtgccccaggtgaccagcaaggccttccagcacgacacctggaacagcggcctgactgtggccagcatcagcacaggccacctgaccagcggcctgaaggagggcagctactgctag

SEQ ID NO: 3512 - DNA, 1125 bp, Artificial Sequence
  Description of Artificial Sequence: Synthetic coding sequence
atgatcctgcggccctaccagccctgtggcaccgtgaaggagtttgacaccaacttcacctacgtgcagcagagcgagttctacctggagcccaacatcaagtatgtgttccaggtgcgctgccaggagaccgggaagcgctactggcagccctggagcagcctcttcttccacaagaccccagagaccgtgccccaggtgaccagcaaggccttccagcacgacacctggaacagcggcctgactgtggccagcatcagcacaggccacctgaccagtgacaacagaggagacatcggcctgctgctgggcatgattgtgtttgctgtgatgctgagcatcctgagcctcatcggcatcttcaacagaagcttcagaacaggcatcaagaggcgcatcctgctgctgatccccaagtggctgtatgaggacatccccaacatgaagaacagcaatgtggtgaagatgctgcaggagaacagcgagctgatgaacaacaacagcagcgagcaggtgctgtatgtggaccccatgatcacagagatcaaggagatcttcatccctgagcacaagcccacagactacaagaaggagaacacaggccccctggagacccgggactacccccagaacagcctgtttgacaacaccaccgtggtgtacatcccagacctgaacacaggctacaagccccagatcagcaacttcctgcctgagggcagccacctgagcaacaacaatgagatcaccagcctgaccctgaagccccctgtggacagcctggacagcggcaacaacccccggctgcagaagcaccccaactttgccttctctgtgtcctctgtgaacagcctgagcaacaccatcttcctgggggagctgagcctcatcctgaaccagggcgagtgcagcagcccagacatccagaacagcgtggaggaggagaccaccatgctgctggagaatgacagccccagcgagaccatccctgagcagaccctgctgcctgatgaatttgtgtcctgcctgggcatcgtgaatgaggagctgcccagcatcaacacctacttcccccagaacatcctggagagccacttcaaccgcatcagcctgctggagaagtag

SEQ ID NO: 3513 - DNA, 354 bp, Artificial Sequence
  Description of Artificial Sequence: Synthetic coding sequence
atgacctgcacctggaatgccggcaagctgacctacatcgacaccaagtatgtggtgcacgtgaagagcctggagacagaggaggagcagcagtacctgaccagcagctacatcaacatcagcacagacagcctgcagggcggcaagaagtatgtgttccaggtgcgctgccaggagaccgggaagcgctactggcagccctggagcagcctcttcttccacaagaccccagagaccgtgccccaggtgaccagcaaggccttccagcacgacacctggaacagcggcctgactgtggccagcatcagcacaggccacctgaccagcggcctgaaggagggcagctactgctag

SEQ ID NO: 3514 - DNA, 1176 bp, Artificial Sequence
  Description of Artificial Sequence: Synthetic coding sequence
tgacacttcctgctgccccccctgagcaagaagagcctgctgccccccaccatgatcctgcggccctaccagccctgtggcaccgtgaaggagtttgacaccaacttcacctacgtgcagcagagcgagttctacctggagcccaacatcaagtatgtgttccaggtgcgctgccaggagaccgggaagcgctactggcagccctggagcagcctcttcttccacaagaccccagagaccgtgccccaggtgaccagcaaggccttccagcacgacacctggaacagcggcctgactgtggccagcatcagcacaggccacctgaccagtgacaacagaggagacatcggcctgctgctgggcatgattgtgtttgctgtgatgctgagcatcctgagcctgattggcatcttcaacagaagcttcagaacaggcatcaagaggcgcatcctgctgctgatccccaagtggctgtatgaggacatccccaacatgaagaacagcaatgtggtgaagatgctgcaggagaacagcgagctgatgaacaacaacagcagcgagcaggtgctgtatgtggaccccatgatcacagagatcaaggagatcttcatccctgagcacaagcccacagactacaagaaggaaaatacaggccccctggagacccgggactacccccagaacagcctgtttgacaacaccaccgtggtgtacatcccagacctgaacacaggctacaagccccagatcagcaacttcctgcctgagggcagccacctgagcaacaacaatgagatcaccagcctgaccctgaagccccctgtggacagcctggacagcggcaacaacccccggctgcagaagcaccccaactttgccttctctgtgtcctctgtgaacagcctgagcaacaccatcttcctgggggagctgagcctcatcctgaaccagggagaatgtagcagcccagacatccagaacagcgtggaggaggagaccaccatgctgctggagaatgacagccccagcgagaccatccctgagcagaccctgctgcctgatgaatttgtgtcctgcctgggcatcgtgaatgaggagctgcccagcatcaacacctacttcccccagaacatcctggagagccacttcaaccgcatcagcctgctggagaagtag

SEQ ID NO: 3515 - DNA, 828 bp, Artificial Sequence
  Description of Artificial Sequence: Synthetic coding sequence
atgacctgcacctggaatgccggcaagctgacctacatcgacaccaagtatgtggtgcacgtgaagagcctggagacagaggaggagcagcagtacctgaccagcagctacatcaacatcagcacagacagcctgcagggcggcaagaagtacctggtgtgggtgcaggccgccaatgccctgggcatggaggagagcaagcagctgcagatccacctggatgacatcgtcatccccagcgctgctgtgatcagcagagctgagaccatcaatgccaccgtgcccaagaccatcatctactgggacagccagaccaccatcgagaaggtgtcctgtgagatgagatacaaggccaccaccaaccagacctggaatgtgaaggagtttgacaccaacttcacctacgtgcagcagagcgagttctacctggagcccaacatcaagtatgtgttccaggtgcgctgccaggagaccgggaagcgctactggcagccctggagcagcctcttcttccacaagaccccagagacagacaacagaggagacatcggcctgctgctgggcatgattgtgtttgctgtgatgctgagcatcctgagcctcatcggcatcttcaacagaagcttcagaacaggcatcaagaggcgcatcctgctgctgatccccaagtggctgtatgaggacatccccaacatgaagaacagcaatgtggtgaagatgctgcaggagaacagcgagctgatgaacaacaacagcagcgagcaggtgctgtatgtggaccccatgatcacagagatcaaggagatcttcatccctgagcacaagtag

SEQ ID NO: 3516 - DNA, 615 bp, Artificial Sequence
  Description of Artificial Sequence: Synthetic coding sequence
atgacctgcacctggaatgccggcaagctgacctacatcgacaccaagtatgtggtgcacgtgaagagcctggagacagaggaggagcagcagtacctgaccagcagctacatcaacatcagcacagacagcctgcagggcggcaagaagtacctggtgtgggtgcaggccgccaatgccctgggcatggaggagagcaagcagctgcagatccacctggatgacatcgtgccccaggtgaccagcaaggccttccagcacgacacctggaacagcggcctgactgtggccagcatcagcacaggccacctgaccagtgacaacagaggagacatcggcctgctgctgggcatgattgtgtttgctgtgatgctgagcatcctgagcctgattggcatcttcaacagaagcttcagaacaggcatcaagaggcgcatcctgctgctgatccccaagtggctgtatgaggacatccccaacatgaagaacagcaatgtggtgaagatgctgcaggagaacagcgagctgatgaacaacaacagcagcgagcaggtgctgtatgtggaccccatgatcacagagatcaaggagatcttcatccctgagcacaagtag

SEQ ID NO: 3517 - DNA, 441 bp, Artificial Sequence
  Description of Artificial Sequence: Synthetic coding sequence
atgaacatcagcatctactgccaggccgccatcaagaactgccagcccaggaagctgcacttctacaagaatggcatcaaggagcgcttccagatcacccgcatcaacaagaccacagcccggctgtggtacaagaacttcctggagccccacgcctccatgtactgcacagcagaatgtcccaagcacttccaggagaccctcatctgtgggaaggacatcagcagcggctaccccccagacatcccagatgaggtgacctgtgtgatctatgagtacagcggcaacatgacctgcacctggaatgccggcaagctgacctacatcgacaccaagtatgtggtgcacgtgaagaggctgaagaacctgacccccatcctgcacatgtgcaacagccagaacagcacctggagccagaccctgagcacctacttcaagtag

SEQ ID NO: 3518 - DNA, 429 bp, Artificial Sequence
  Description of Artificial Sequence: Synthetic coding sequence
atgacctgcacctggaatgccggcaagctgacctacatcgacaccaagtatgtggtgcacgtgaagagcctggagacagaggaggagcagcagtacctgaccagcagctacatcaacatcagcacagacagcctgcagggcggcaagaagtacctggtgtgggtgcaggccgccaatgccctgggcatggaggagagcaagcagctgcagatccacctggatgacatcgtcatccccagcgctgctgtgatcagcagagctgagaccatcaatgccaccgtgcccaagaccatcatctactgggacagccagaccaccatcgagaaggtgtcctgtgagatgagatacaaggccaccaccaaccagacctggaacttccccaggagccaccagaagcacagcaacatgacccacggcatcctgggctag

SEQ ID NO: 3519 - DNA, 669 bp, Artificial Sequence
  Description of Artificial Sequence: Synthetic coding sequence
atgaacatcagcatctactgccaggccgccatcaagaactgccagcccaggaagctgcacttctacaagaatggcatcaaggagcgcttccagatcacccgcatcaacaagaccacagcccggctgtggtacaagaacttcctggagccccacgcctccatgtactgcacagcagaatgtcccaagcacttccaggagaccctcatctgtgggaaggacatcagcagcggctaccccccagacatcccagatgaggtgacctgtgtgatctatgagtacagcggcaacatgacctgcacctggaatgccggcaagctgacctacatcgacaccaagtatgtggtgcacgtgaagagcctggagacagaggaggagcagcagtacctgaccagcagctacatcaacatcagcacagacagcctgcagggcggcaagaagtacctggtgtgggtgcaggccgccaatgccctgggcatggaggagagcaagcagctgcagatccacctggatgacatcgtcatccccagcgctgctgtgatcagcagagctgagaccatcaatgccaccgtgcccaagaccatcatctactgggacagccagaccaccatcgagaaggtgtcctgtgagatgagatacaaggccaccaccaaccagacctggaatgactag

SEQ ID NO: 3520 - DNA, 1632 bp, Artificial Sequence
  Description of Artificial Sequence: Synthetic coding sequence
atggatgccttcaccggcagcggcctgaagaggaagtttgatgatgtggatgtgggcagctctgtgagcaacagtgatgatgagatcagcagcagtgacagcgctgacagctgtgacagcctgaacccccccaccacagccagcttcacccccaccagcatcctgaagaggcagaagcagctgcggaggaagaatgtgcgctttgaccaggtgacagtgtactactttgcccggcggcagggcttcacctctgtgcccagccagggcggcagcagcctgggcatggcccagaggcacaacagcgtgcgcagctacaccctgtgtgaatttgcccaggagcaggaggtgaaccaccgggagatcctgcgggagcacctgaaggaggagaagctgcacgccaagaagatgaagctgaccaagaatggaacagtggagagcgtggaggctgatggcctgaccctggatgatgtgtctgatgaggacattgatgtggagaatgtggaggtggatgactacttcttcctgcagcccctgcccaccaagagaagaagagccctgctgcgggccagcggcgtgcacagaattgatgctgaggagaagcaggagctgcgggccatccggctgagccgggaggagtgtggctgtgactgccgcctgtactgtgaccctgaggcctgtgcctgcagccaggccggcatcaagtgccaggtggacaggatgtccttcccctgtggctgcagcagagatggctgcggcaacatggccggccgcatcgagttcaaccccatccgggtgaggacccactacctgcacaccatcatgaagctggagctggagagcaagaggcaggtgtccaggcctgctgccccagatgaggagcccagccccacagccagctgcagcctgactggagcccagggcagcgagacccaggacttccaggagttcatcgcagaaaatgaaacagctgtgatgcacctgcagagcgctgaggagctggagcggctgaaggccgaggaggacagcagcggcagcagcgccagcctggacagcagcattgagagcctgggcgtgtgcatcctggaggagcccctggccgtgcctgaggagctgtgccccggcctgacagcccccatcctgatccaggcccagctgcccccaggcagctctgtgctgtgcttcacagagaacagcgaccaccccacagccagcacagtgaacagccccagctacctgaacagcggccccctggtgtactaccaggtggagcagaggcctgtgctgggcgtgaagggggagcccggcacagaggagggcagcgccagcttccccaaggagaaggacctgaatgtgttcagcctgcctgtgaccagcctggtggcctgcagcagcacagatcctgctgccctgtgcaagtctgaggtgggcaagacccccaccctggaggccctgctgcctgaggactgcaaccctgaggagccagaaaatgaagacttccaccccagctggagccccagcagcctgcccttcagaacagacaatgaggagggctgcggcatggtgaagaccagccagcagaatgaagatagacctcctgaggacagcagcctggagctgcccctggccgtgtag

SEQ ID NO: 3521 - DNA, 621 bp, Artificial Sequence
  Description of Artificial Sequence: Synthetic coding sequence
atgaacttccagcagaggctgcagagcctgtggaccctggcccggcccttctgcccccccctgctggccacagccagccagatgcagatggtggtgctgccctgcctgggcttcaccctgctgctgtggagccaggtgtctggggcccagggccaggagttccacttcggcccctgccaggtgaagggcgtggtgccccagaagctgtgggaggccttctgggccgtgaaggacaccatgcaggcccaggacaacatcaccagcgcccggctgctgcagcaggaggtgctgcagaatgtgtctgatgctgagagctgctacctggtgcacaccctgctggagttctacctgaagacagtgttcaagaactaccacaacagaacagtggaggtgaggaccctgaagagcttcagcaccctggccaacaactttgtgctgattgtgtcccagctgcagcccagccaggagaatgagatgttcagcatccgggacagcgcccaccggcgcttcctgctcttccggcgggccttcaagcagctggatgtggaggccgccctgaccaaggccctgggggaggtggacatcctgctgacctggatgcagaagttctacaagctgtag

SEQ ID NO: 3522 - DNA, 465 bp, Artificial Sequence
  Description of Artificial Sequence: Synthetic coding sequence
atgaacttccagcagaggctgcagagcctgtggaccctggccagccggcccttctgcccccccctgctggccacagccagccagatgcagatggtggtgctgccctgcctgggcttcaccctgctgctgtggagccaggtgtctggggcccagggccaggagttccacttcggcccctgccaggtgaagggcgtggtgccccagaagctgtgggaggccttctgggccgtgaaggacaccatgcaggcccaggacaacatcaccagcgcccggctgctgcagcaggaggtgctgcagaatgtgtcccaggagaatgagatgttcagcatccgggacagcgcccaccggcgcttcctgctcttccggcgggccttcaagcagctggatgtggaggccgccctgaccaaggccctgggggaggtggacatcctgctgacctggatgcagaagttctacaagctgtag

SEQ ID NO: 3523 - DNA, 624 bp, Artificial Sequence
  Description of Artificial Sequence: Synthetic coding sequence
atgaacttccagcagaggctgcagagcctgtggaccctggccagccggcccttctgcccccccctgctggccacagccagccagatgcagatggtggtgctgccctgcctgggcttcaccctgctgctgtggagccaggtgtctggggcccagggccaggagttccacttcggcccctgccaggtgaagggcgtggtgccccagaagctgtgggaggccttctgggccgtgaaggacaccatgcaggcccaggacaacatcaccagcgcccggctgctgcagcaggaggtgctgcagaatgtgtctgatgctgagagctgctacctggtgcacaccctgctggagttctacctgaagacagtgttcaagaactaccacaacagaacagtggaggtgaggaccctgaagagcttcagcaccctggccaacaactttgtgctgattgtgtcccagctgcagcccagccaggagaatgagatgttcagcatccgggacagcgcccaccggcgcttcctgctcttcagaagagccttcaagcagctggatgtggaggccgccctgaccaaggccctgggggaggtggacatcctgctgacctggatgcagaagttctacaagctgtag

SEQ ID NO: 3524 - DNA, 534 bp, Artificial Sequence
  Description of Artificial Sequence: Synthetic coding sequence
atgagggagcggccccggctgggggaggacagcagcctcatcagcctcttcctgcaggtggtggccttcctggccatggtgatgggcacccacacctacagccactggcccagctgctgccccagcaagggccaggacaccagcgaggagctgctgcgctggagcacagtgcctgtgccccccctggagcccgcccggcccaacagacaccctgagagctgccgggcctctgaagatggccccctgaacagccgggccatcagcccctggaggtatgagctggaccgggacctgaaccggctgccccaggacctgtaccacgcccgctgcctgtgcccccactgtgtgtccctgcagacaggcagccacatggacccccggggcaacagcgagctgctgtaccacaaccagaccgtcttctaccgccggccctgccacggggagaagggcacccacaagggctactgcctggagcggcggctgtacagagtgtccctggcctgtgtgtgtgtgcggccccgggtgatgggctag

SEQ ID NO: 3525 - DNA, 486 bp, Artificial Sequence
  Description of Artificial Sequence: Synthetic coding sequence
atgtaccaggtggtggccttcctggccatggtgatgggcacccacacctacagccactggcccagctgctgccccagcaagggccaggacaccagcgaggagctgctgcgctggagcacagtgcctgtgccccccctggagcccgcccggcccaacagacaccctgagagctgccgggcctctgaagatggccccctgaacagccgggccatcagcccctggaggtatgagctggaccgggacctgaaccggctgccccaggacctgtaccacgcccgctgcctgtgcccccactgtgtgtccctgcagacaggcagccacatggacccccggggcaacagcgagctgctgtaccacaaccagaccgtcttctaccgccggccctgccacggggagaagggcacccacaagggctactgcctggagcggcggctgtacagagtgtccctggcctgtgtgtgtgtgcggccccgggtgatgggctag

SEQ ID NO: 3526 - DNA, 2775 bp, Artificial Sequence
  Description of Artificial Sequence: Synthetic coding sequence
atggatgtgctgcccaccggcggcggccggcccggcctgaggacagagctggagttccggggcggcggcggggaggcccggctggagagccaggaggaggagaccatcccagctgcccccccagccccccggctgcggggagctgctgagcggcccaggaggagccgggacacctgggatggagatgaggacacagagcctggagaggcctgtggcggccgcaccagcaggacagccagcctggtgtctggcctgctgaatgagctgtacagctgcacagaggaggaggaggccgccggcggcggcagaggagctgagggcagaagaagaagaagagacagcctggacagcagcacagaggccagcggcagtgatgtggtgctgggcggccgcagcggggccggggacagccgggtgctgcaggagctgcaggagcggcccagccagaggcaccagatgctgtacctgcggcagaaggatgccaatgagctgaagaccatcctgcgggagctgaagtacagaattggcatccagagcgccaagctgctgcggcacctgaagcagaaggaccggctgctgcacaaggtgcagaggaactgtgacatcgtgacagcctgcctgcaggccgtgtcccagaagagaagagtggacaccaagctgaagttcaccctggagcccagcctgggccagaatggcttccagcagtggtatgatgccctgaaggctgtggcccggctgagcacaggcatccccaaggagtggaggaggaaggtgtggctgaccctggccgaccactacctgcacagcatcgccatcgactgggacaagaccatgaggttcaccttcaatgaaagaagcaacccagatgatgacagcatgggcatccagatcgtgaaggacctgcacaggacaggctgcagcagctactgcggccaggaggccgagcaggacagagtggtgctgaagagggtgctgctggcctatgcccgctggaacaagacagtgggctactgccagggcttcaacatcctggccgccctgatcctggaggtgatggagggcaatgaaggagatgccctgaagatcatgatctacctgattgacaaggtgctgcctgagagctactttgtgaacaacctgcgggccctgtctgtggacatggctgtgttccgggacctgctgaggatgaagctgcctgagctgagccagcacctggacaccctgcagaggacagccaacaaggagagcggcggcggctatgagccccccctgaccaacgtgttcaccatgcagtggttcctgaccctgtttgccacctgcctgcccaaccagacagtgctgaagatctgggacagcgtcttctttgagggcagcgagatcatcctgcgggtgtccctggccatctgggccaagctgggggagcagatcgagtgctgtgaaacagcagatgagttctacagcaccatgggccgcctgacccaggagatgctggagaatgacctgctgcagagccatgagctgatgcagacagtgtacagcatggcccccttccccttcccccagctggccgagctgcgggagaagtacacctacaacatcacccccttccctgccaccgtgaagcccacctctgtgtctggccgccacagcaaggcccgggacagtgatgaggagaatgaccctgatgatgaagatgctgtggtgaatgctgtgggctgcctgggccccttcagcggcttcctggcccctgagctgcagaagtaccagaagcagatcaaggagcccaatgaggagcagagcctgcggagcaacaacattgctgagctgagccctggggccatcaacagctgccgctctgagtaccacgccgccttcaacagcatgatgatggagaggatgaccacagacatcaatgccctgaagaggcagtacagccgcatcaagaagaagcagcagcagcaggtgcaccaggtgtacatccgggctgacaagggccctgtgaccagcatcctgcccagccaggtgaacagcagccctgtgatcaaccacctgctgctgggcaagaagatgaagatgaccaacagagctgccaagaatgctgtgatccacatccctggccacactggaggcaagatcagccctgtgccctatgaggacctgaagaccaagctgaacagcccctggaggacccacatccgggtgcacaagaagaacatgcccaggaccaagagccaccctggctgtggggacacagtgggcctgattgatgagcagaatgaggccagcaagaccaacggcctgggcgctgctgaggccttccccagcggctgcacagccacagctggccgggagggcagcagccctgagggcagcaccaggaggaccatcgagggccagagccctgagcctgtgtttggagatgctgatgtggatgtgtctgctgtgcaggccaagctgggcgccctggagctgaaccagagagatgctgctgctgagacagagctgcgggtgcaccccccctgccagaggcactgcccagagccccccagcgcccctgaggagaacaaggccaccagcaaggccccccagggcagcaacagcaagacccccatcttcagccccttccccagcgtgaagcccctgaggaagagcgccacagccaggaacctgggcctgtatggccccacagagaggacccccaccgtgcacttcccccagatgagccgctccttcagcaagccaggcggcggcaacagcggcaccaagaagaggtag

SEQ ID NO: 3527 - DNA, 732 bp, Artificial Sequence
  Description of Artificial Sequence: Synthetic coding sequence
atgggccagacagctggggacctgggctggaggctgagcctgctgctgctgcccctgctgctggtgcaggccggcgtgtggggcttcccccggcccccaggccggccccagctgagcctgcaggagctgcggcgggagttcaccgtgtccctgcacctggccaggaagctgctgtctgaggtgcggggccaggcccacagatttgctgagagccacctgcccggggtgaacctgtacctgctgcccctgggggagcagctgcctgatgtgtccctgaccttccaggcctggaggcggctgagtgaccctgagcggctgtgcttcatcagcaccaccctgcagcccttccacgccctgctgggcggcctgggcacccagggccgctggaccaacatggagaggatgcagctgtgggccatgaggctggacctgcgggacctgcagaggcacctgcgcttccaggtgctggccgccggcttcaacctgcctgaggaggaggaggaggaggaggaggaggaggaggaggagaggaagggcctgctgcccggggccctgggcagcgccctgcagggccctgcccaggtgtcctggccccagctgctgagcacctaccgcctgctgcacagcctggagctggtgctgagcagagctgtgcgggagctgctgctgctgagcaaggccggccacagcgtgtggcccctgggcttccccaccctgagcccccagccctag

SEQ ID NO: 3528 - DNA, 603 bp, Artificial Sequence
  Description of Artificial Sequence: Synthetic coding sequence
atgaagctggacatgaccggggactgcacccctgtgctggtgctgatggctgctgtgctgactgtgactggagctgtgcctgtggcccggctgcacggggccctgcctgatgcccggggctgccacatcgcccagttcaagagcctgagcccccaggagctgcaggccttcaagagggccaaggatgccctggaggagagcctgctgctgaaggactgccgctgccacagccgcctcttccccaggacctgggacctgcggcagctgcaggtgcgggagcggcccatggccctggaggccgagctggccctgaccctgaaggtgctggaggccacagctgacacagatcctgccctggtggatgtgctggaccagcccctgcacaccctgcaccacatcctgagccagttccgggcctgcatccagccccagcccacagctggccccaggacccggggccgcctgcaccactggctgtaccgcctgcaggaggcccccaagaaggagagccctggctgcctggaggcctctgtgaccttcaacctcttccggctgctgacccgggacctgaactgtgtggccagcggggacctgtgtgtgtag

SEQ ID NO: 3529 - DNA, 591 bp, Artificial Sequence
  Description of Artificial Sequence: Synthetic coding sequence
atgaccggggactgcatgcctgtgctggtgctgatggctgctgtgctgactgtgactggagctgtgcctgtggcccggctgcggggggccctgcctgatgcccggggctgccacatcgcccagttcaagagcctgagcccccaggagctgcaggccttcaagagggccaaggatgccctggaggagagcctgctgctgaaggactgcaagtgccgcagccgcctcttccccaggacctgggacctgcggcagctgcaggtgcgggagaggcctgtggccctggaggccgagctggccctgaccctgaaggtgctggaggccacagctgacacagatcctgccctgggagatgtgctggaccagcccctgcacaccctgcaccacatcctgagccagctgcgggcctgcatccagccccagcccacagctggccccaggacccggggccgcctgcaccactggctgcaccggctgcaggaggcccccaagaaggagagccctggctgcctggaggcctctgtgaccttcaacctcttccggctgctgacccgggacctgaactgtgtggccagcggggacctgtgtgtgtag

SEQ ID NO: 3530 - DNA, 603 bp, Artificial Sequence
  Description of Artificial Sequence: Synthetic coding sequence
atggctgctgcctggacagtggtgctggtgaccctggtgctgggcctggccgtggccggccctgtgcccaccagcaagcccaccaccaccgggaagggctgccacatcggccgcttcaagagcctgagcccccaggagctggccagcttcaagaaggccagagatgccctggaggagagcctgaagctgaagaactggagctgcagcagccctgtgtttcctggcaactgggacctgcggctgctgcaggtgcgggagaggcctgtggccctggaggccgagctggccctgaccctgaaggtgctggaggccgccgccggccctgccctggaggatgtgctggaccagcccctgcacaccctgcaccacatcctgagccagctgcaggcctgcatccagccccagcccacagctggcccccggccccggggccgcctgcaccactggctgcaccggctgcaggaggcccccaagaaggagagcgctggctgcctggaggcctctgtgaccttcaacctcttccggctgctgacccgggacctgaagtatgtggctgatggcaacctgtgcctgcggaccagcacccaccctgagagcacctag

SEQ ID NO: 3531 - DNA, 495 bp, Artificial Sequence
  Description of Artificial Sequence: Synthetic coding sequence
atggccagccacagcggccccagcacctctgtgctcttcctgttctgctgcctgggcggctggctggccagccacaccctgcctgtgcggctgctgcggcccagtgatgatgtgcagaagatcgtggaggagctgcagagcctgagcaagatgctgctgaaggatgtggaggaggagaagggcgtgctggtgtcccagaactacaccctgccctgcctgagcccagatgcccagccccccaacaacatccacagccctgccatccgggcctacctgaagaccatccggcagctggacaacaagtctgtgattgatgagatcatcgagcacctggacaagctgatcttccaggatgcccctgagaccaacatctctgtgcccacagacacccatgagtgcaagcgcttcatcctgaccatcagccagcagttcagcgagtgcatggacctggccctgaagagcctgaccagcggggcccagcaggccaccacctag

SEQ ID NO: 3532 - DNA, 507 bp, Artificial Sequence
  Description of Artificial Sequence: Synthetic coding sequence
atgtgcttccccaaggtgctgagtgatgacatgaagaagctgaaggccaggatggtgatgagcagcctggccgagctggaggatgacttcaaggagggctacctggagaccgtggccgcctactatgaggagcagcaccctgagctgacccccctgctggagaaggagagagatggcctgcgctgccggggcaacagaagccctgtgcctgatgtggaggaccctgccacagaggagcccggggagagcttctgtgacaaggtgatgcgctggttccaggccatgctgcagaggctgcagacctggtggcacggcgtgctggcctgggtgaaggagaaggtggtggccctggtgcatgctgtgcaggccctgtggaagcagttccagagcttctgctgcagcctgtctgagctgttcatgagcagcttccagagctatggagcccccaggggggacaaggaggagctgaccccccagaagtgcagcgagccccagagcagcaagtag

SEQ ID NO: 3533 - DNA, 567 bp, Artificial Sequence
  Description of Artificial Sequence: Synthetic coding sequence
atgtgcttccccaaggtgctgagtgatgacatgaagaagctgaaggccaggatgcaccaggccatcgagcgcttctatgacaagatgcagaatgctgagagcggccggggccaggtgatgagcagcctggccgagctggaggatgacttcaaggagggctacctggagaccgtggccgcctactatgaggagcagcaccctgagctgacccccctgctggagaaggagagagatggcctgcgctgccggggcaacagaagccctgtgcctgatgtggaggaccctgccacagaggagcccggggagagcttctgtgacaaggtgatgcgctggttccaggccatgctgcagaggctgcagacctggtggcacggcgtgctggcctgggtgaaggagaaggtggtggccctggtgcatgctgtgcaggccctgtggaagcagttccagagcttctgctgcagcctgtctgagctgttcatgagcagcttccagagctatggagcccccaggggggacaaggaggagctgaccccccagaagtgcagcgagccccagagcagcaagtag

SEQ ID NO: 3534 - DNA, 540 bp, Artificial Sequence
  Description of Artificial Sequence: Synthetic coding sequence
atgtgcttccccaaggtgctgagtgatgacatgaagaagctgaaggccaggatgcaccaggccatcgagcgcttctatgacaagatgcagaatgctgagagcggccggggccaggatgacttcaaggagggctacctggagaccgtggccgcctactatgaggagcagcaccctgagctgacccccctgctggagaaggagagagatggcctgcgctgccggggcaacagaagccctgtgcctgatgtggaggaccctgccacagaggagcctggagagagcttctgtgacaaggtgatgcgctggttccaggccatgctgcagaggctgcagacctggtggcatggagtgctggcctgggtgaaggagaaggtggtggccctggtgcatgctgtgcaggccctgtggaagcagttccagagcttctgctgcagcctgtctgagctgttcatgagcagcttccagagctatggagcccccaggggggacaaggaggagctgaccccccagaagtgcagcgagccccagagcagcaagtag

SEQ ID NO: 3535 - DNA, 396 bp, Artificial Sequence
  Description of Artificial Sequence: Synthetic coding sequence
atgtgcttccccaaggtgctgagtgatgacatgaagaagctgaaggccaggatgcaccaggccatcgagcgcttctatgacaagatgcagaatgctgagagcggccggggccaggtgatgagcagcctggccgagctggaggatgacttcaaggagggctacctggagaccgtggccgcctactatgaggagcagcaccctgagctgacccccctgctggagaaggagagagatggcctgcgctgccggggcaacagaagccctgtgcctgatgtggaggaccctgccacagaggagcccggggagagcttctgtgacaagagctatggagcccccaggggggacaaggaggagctgaccccccagaagtgcagcgagccccagagcagcaagtag

SEQ ID NO: 3536 - DNA, 705 bp, Artificial Sequence
  Description of Artificial Sequence: Synthetic coding sequence
atgtgcttccccaaggtgctgagtgatgacatgaagaagctgaaggccaggatggtgatgctgctgcccaccagcgcccagggcctgggcgcctgggtgtctgcctgtgacacagaagatactgtgggccacctgggcccctggagggacaaggaccctgccctgtggtgccagctgtgcctgagcagccagcaccaggccatcgagcgcttctatgacaagatgcagaatgctgagagcggccggggccaggtgatgagcagcctggccgagctggaggatgacttcaaggagggctacctggagaccgtggccgcctactatgaggagcagcaccctgagctgacccccctgctggagaaggagagagatggcctgcgctgccggggcaacagaagccctgtgcctgatgtggaggaccctgccacagaggagcccggggagagcttctgtgacaaggtgatgcgctggttccaggccatgctgcagaggctgcagacctggtggcacggcgtgctggcctgggtgaaggagaaggtggtggccctggtgcatgctgtgcaggccctgtggaagcagttccagagcttctgctgcagcctgtctgagctgttcatgagcagcttccagagctatggagcccccaggggggacaaggaggagctgaccccccagaagtgcagcgagccccagagcagcaagtag

SEQ ID NO: 3537 - DNA, 567 bp, Artificial Sequence; identical to SEQ ID NO: 3533
  Description of Artificial Sequence: Synthetic coding sequence

SEQ ID NO: 3538 - DNA, 567 bp, Artificial Sequence; identical to SEQ ID NO: 3533
  Description of Artificial Sequence: Synthetic coding sequence

SEQ ID NO: 3539 - DNA, 567 bp, Artificial Sequence; identical to SEQ ID NO: 3533
  Description of Artificial Sequence: Synthetic coding sequence

SEQ ID NO: 3540 - DNA, 567 bp, Artificial Sequence; identical to SEQ ID NO: 3533
  Description of Artificial Sequence: Synthetic coding sequence

SEQ ID NO: 3541 - DNA, 567 bp, Artificial Sequence; identical to SEQ ID NO: 3533
  Description of Artificial Sequence: Synthetic coding sequence

SEQ ID NO: 3542 - DNA, 567 bp, Artificial Sequence; identical to SEQ ID NO: 3533
  Description of Artificial Sequence: Synthetic coding sequence

SEQ ID NO: 3543 - DNA, 567 bp, Artificial Sequence; identical to SEQ ID NO: 3533
  Description of Artificial Sequence: Synthetic coding sequence

SEQ ID NO: 3544 - DNA, 507 bp, Artificial Sequence; identical to SEQ ID NO: 3532
  Description of Artificial Sequence: Synthetic coding sequence

SEQ ID NO: 3545 - DNA, 537 bp, Artificial Sequence
  Description of Artificial Sequence: Synthetic coding sequence
atgaagaagctgaaggccaggatgcaccaggccatcgagcgcttctatgacaagatgcagaatgctgagagcggccggggccaggtgatgagcagcctggccgagctggaggatgacttcaaggagggctacctggagaccgtggccgcctactatgaggagcagcaccctgagctgacccccctgctggagaaggagagagatggcctgcgctgccggggcaacagaagccctgtgcctgatgtggaggaccctgccacagaggagcccggggagagcttctgtgacaaggtgatgcgctggttccaggccatgctgcagaggctgcagacctggtggcacggcgtgctggcctgggtgaaggagaaggtggtggccctggtgcatgctgtgcaggccctgtggaagcagttccagagcttctgctgcagcctgtctgagctgttcatgagcagcttccagagctatggagcccccaggggggacaaggaggagctgaccccccagaagtgcagcgagccccagagcagcaagtag

SEQ ID NO: 3546 - DNA, 567 bp, Artificial Sequence; identical to SEQ ID NO: 3533
  Description of Artificial Sequence: Synthetic coding sequence

SEQ ID NO: 3547 - DNA, 705 bp, Artificial Sequence; identical to SEQ ID NO: 3536
  Description of Artificial Sequence: Synthetic coding sequence

SEQ ID NO: 3548 - DNA, 705 bp, Artificial Sequence; identical to SEQ ID NO: 3536
  Description of Artificial Sequence: Synthetic coding sequence

SEQ ID NO: 3549 - DNA, 540 bp, Artificial Sequence; identical to SEQ ID NO: 3534
  Description of Artificial Sequence: Synthetic coding sequence

SEQ ID NO: 3550 - DNA, 678 bp, Artificial Sequence
  Description of Artificial Sequence: Synthetic coding sequence
atgtgcttccccaaggtgctgagtgatgacatgaagaagctgaaggccaggatggtgatgctgctgcccaccagcgcccagggcctgggcgcctgggtgtctgcctgtgacacagaagatactgtgggccacctgggcccctggagggacaaggaccctgccctgtggtgccagctgtgcctgagcagccagcaccaggccatcgagcgcttctatgacaagatgcagaatgctgagagcggccggggccaggtgatgagcagcctggccgagctggaggatgacttcaaggagggctacctggagaccgtggccgcctactatgaggagcagcaccctgagctgacccccctgctggagaaggagagagatggcctgcgctgccggggcaacagaagccctgtgcctgatgtggaggaccctgccacagaggagcccggggagagcttctgtgacaaggtgatgcgctggttccaggccatgctgcagaggctgcagacctggtggcacggcgtgctggcctgggtgaaggagaaggtggtggccctggtgcatgctgtgcaggccctgtggaagcagttccagagcttctgctgcagcctgtctgagctgttcatgagcagcttccagagctatggagcccccaggggggacaaggaggagctgaccccccagtag

SEQ ID NO: 3551 - DNA, 396 bp, Artificial Sequence; identical to SEQ ID NO: 3535
  Description of Artificial Sequence: Synthetic coding sequence

SEQ ID NO: 3552 - DNA, 396 bp, Artificial Sequence; identical to SEQ ID NO: 3535
  Description of Artificial Sequence: Synthetic coding sequence

SEQ ID NO: 3553 - DNA, 507 bp, Artificial Sequence; identical to SEQ ID NO: 3532
  Description of Artificial Sequence: Synthetic coding sequence

SEQ ID NO: 3554 - DNA, 567 bp, Artificial Sequence; identical to SEQ ID NO: 3533
  Description of Artificial Sequence: Synthetic coding sequence

SEQ ID NO: 3555 - DNA, 813 bp, Artificial Sequence
  Description of Artificial Sequence: Synthetic coding sequence
atgaagcccaagatgaagtacagcaccaacaagatcagcacagccaagtggaagaacacagccagcaaggccctgtgcttcaagctgggcaagagccagcagaaggccaaggaggtgtgccccatgtacttcatgaagctgcggagcggcctgatgatcaagaaggaggcctgctacttcagaagagagaccaccaagaggcccagcctgaagacaggcaggaagcacaagaggcacctggtgctggccgcctgccagcagcagagcacagtggagtgctttgccttcggcatctctggagtgcagaagtacacccgggccctgcatgacagcagcatcaccggcatcagccccatcacagagtacctggccagcctgagcacctacaatgaccagagcatcacctttgccctggaggatgagagctatgagatctacgtggaggacctgaagaaggatgagaagaaggacaaggtgctgctgagctactatgagagccagcaccccagcaatgaaagtggagatggagtggatggcaagatgctgatggtgaccctgagccccaccaaggacttctggctgcacgccaacaacaaggagcacagcgtggagctgcacaagtgtgagaagcccctgcctgaccaggccttctttgtgctgcacaacatgcacagcaactgtgtgtcctttgagtgcaagacagaccccggggtcttcatcggcgtgaaggacaaccacctggccctgatcaaggtggacagcagcgagaacctgtgcacagagaacatcctcttcaagctgtctgagacctag

SEQ ID NO: 3556 - DNA, 435 bp, Artificial Sequence
  Description of Artificial Sequence: Synthetic coding sequence
atgaagcccaagatgaagtacagcaccaacaagatcagcacagccaagtggaagaacacagccagcaaggccctgtgcttcaagctgggcaacaaggtgctgctgagctactatgagagccagcaccccagcaatgaaagtggagatggagtggatggcaagatgctgatggtgaccctgagccccaccaaggacttctggctgcacgccaacaacaaggagcacagcgtggagctgcacaagtgtgagaagcccctgcctgaccaggccttctttgtgctgcacaacatgcacagcaactgtgtgtcctttgagtgcaagacagaccccggggtcttcatcggcgtgaaggacaaccacctggccctgatcaaggtggacagcagcgagaacctgtgcacagagaacatcctcttcaagctgtctgagacctag

SEQ ID NO: 3557 - DNA, 687 bp, Artificial Sequence
  Description of Artificial Sequence: Synthetic coding sequence
atgaagcccaagatgaagtacagcaccaacaagatcagcacagccaagtggaagaacacagccagcaaggccctgtgcttcaagctgggcaagagccagcagaaggccaaggaggtgtgccccatgtacttcatgaagctgcggagcggcctgatgatcaagaaggaggcctgctacttcagaagagagaccaccaagaggcccagcctgaagacaggcaggaagcacaagaggcacctggtgctggccgcctgccagcagcagagcacagtggagtgctttgccttcggcatctctggagtgcagaagtacacccgggccctgcatgacagcagcatcacagacaaggtgctgctgagctactatgagagccagcaccccagcaatgaaagtggagatggagtggatggcaagatgctgatggtgaccctgagccccaccaaggacttctggctgcacgccaacaacaaggagcacagcgtggagctgcacaagtgtgagaagcccctgcctgaccaggccttctttgtgctgcacaacatgcacagcaactgtgtgtcctttgagtgcaagacagaccccggggtcttcatcggcgtgaaggacaaccacctggccctgatcaaggtggacagcagcgagaacctgtgcacagagaacatcctcttcaagctgtctgagacctag

SEQ ID NO: 3558 - DNA, 729 bp, Artificial Sequence
  Description of Artificial Sequence: Synthetic coding sequence
atgccccggggcttcacctggctgcgctacctgggcatcttcctgggcgtggccctgggcaatgagcccctggagatgtggcccctgacccagaatgaggagtgcaccgtgacaggcttcctgcgggacaagctgcagtaccgcagccggctgcagtacatgaagcactacttccccatcaactacaagatctctgtgccctatgagggcgtcttccgcatcgccaacgtgacccggctgcagagggcccaggtgtctgagcgggagctgcgctacctgtgggtgctggtgtccctgagcgccacagagagcgtgcaggatgtgctgctggagggccaccccagctggaagtacctgcaggaggtggagaccctgctgctgaatgtgcagcagggcctgacagatgtggaggtgagccccaaggtggagagcgtgctgagcctgctgaatgcccctggccccaacctgaagctggtgcggcccaaggccctgctggacaactgcttccgggtgatggagctgctgtactgcagctgctgcaagcagagctctgtgctgaactggcaggactgtgaggtgcccagcccccagagctgcagccctgagcccagcctgcagtatgctgccacccagctgtacccacctccaccctggagccccagcagccccccccacagcactggatctgtgcggcctgtgcgggcccagggcgagggcctgctgccctag

SEQ ID NO: 3559 - DNA, 729 bp, Artificial Sequence; identical to SEQ ID NO: 3558
  Description of Artificial Sequence: Synthetic coding sequence

SEQ ID NO: 3560 - DNA, 477 bp, Artificial Sequence
  Description of Artificial Sequence: Synthetic coding sequence
atggagaaggccctgaagattgacaccccccagcagggcagcatccaggacatcaaccaccgggtgtgggtgctgcaggaccagaccctgattgctgtgcccaggaaggacaggatgagccctgtgaccatcgccctgatcagctgcagacatgtggagaccctggagaaggaccggggcaaccccatctacctgggcctgaatggcctgaacctgtgcctgatgtgtgccaaggtgggggaccagcccaccctgcagctgaaggagaaggacatcatggacctgtacaaccagcctgagcctgtgaagagcttcctgttctaccacagccagagcggcaggaacagcacctttgagagcgtggccttccctggctggttcatcgctgtgagcagcgagggcggctgccccctcatcctgacccaggagctgggcaaggccaacaccacagactttggcctgaccatgctgttctag

SEQ ID NO: 3561 - DNA, 132 bp, Artificial Sequence
  Description of Artificial Sequence: Synthetic coding sequence
agcacctttgaatctgtggccttccctggctggttcatcgctgtgtcctctgagggcggctgccccctcatcctgacccaggagctgggcaaggccaacaccacagactttggcctcatcctggtggagtag

SEQ ID NO: 3562 - DNA, 495 bp, Artificial Sequence
  Description of Artificial Sequence: Synthetic coding sequence
atgaacccccagcgggaggccgcccccaagagctatgccatccgggacagccggcagatggtgtgggtgctgagcggcaacagcctgattgctgcccccctgagccgcagcatcaagcctgtgaccctgcacctgattgcctgccgggacacagagttcagtgacaaggagaagggcaacatggtgtacctgggcatcaagggcaaggacctgtgcctcttctgtgccgagatccagggcaagcccaccctgcagctgaagctgcagggcagccaggacaacatcggcaaggacacctgctggaagctggtgggcatccacacctgcatcaacctggatgtgcgggagagctgcttcatgggcaccctggaccagtggggcatcggcgtgggcaggaagaagtggaagagcagcttccagcaccaccacctgaggaagaaggacaaggacttcagctccatgaggaccaacatcggcatgcctggccgcatgtag

SEQ ID NO: 3563 - DNA, 474 bp, Artificial Sequence
  Description of Artificial Sequence: Synthetic coding sequence
atgaacccccagcgggaggccgcccccaagagctatgccatccgggacagccggcagatggtgtgggtgctgagcggcaacagcctgattgctgcccccctgagccgcagcatcaagcctgtgaccctgcacctgattgcctgccgggacacagagttcagtgacaaggagaagggcaacatggtgtacctgggcatcaagggcaaggacctgtgcctcttctgtgccgagatccagggcaagcccaccctgcagctgaaggagaagaacatcatggacctgtatgtggagaagaaggcccagaagcccttcctgttcttccacaacaaggagggcagcacctctgtgttccagagcgtgtcctacccaggctggttcatcgccaccagcaccaccagcggccagcccatcttcctgaccaaggagcggggcatcaccaacaacaccaacttctacctggacagcgtggagtag

SEQ ID NO: 3564 - DNA, 510 bp, Artificial Sequence
  Description of Artificial Sequence: Synthetic coding sequence
atgaggggcaccccaggagatgctgatggcggcggccgggctgtgtaccagagcatgtgcaagcccatcaccggcaccatcaatgacctgaaccagcaggtgtggaccctgcagggccagaacctggtggccgtgcccaggagtgacagcgtgacccctgtgacagtggccgtcatcacctgcaagtacccagaggccctggagcagggccgcggggaccccatctacctgggcatccagaaccctgagatgtgcctgtactgtgagaaggtgggggagcagcccaccctgcagctgaaggagcagaagatcatggacctgtatggccagcctgagcctgtgaagcccttcctgttctaccgggccaagacaggccgcaccagcaccctggagagcgtggccttcccagactggttcatcgccagcagcaagagggaccagcccatcatcctgaccagcgagctgggcaagagctacaacacagcctttgagctgaacatcaatgactag

SEQ ID NO: 3565 - DNA, 117 bp, Artificial Sequence
  Description of Artificial Sequence: Synthetic coding sequence
atgaggggcaccccaggagatgctgatggcggcggccgggctgtgtaccagagcatgtgcaagcccatcaccggcaccatcaatgacctgaaccagcaggtgtggaccctgcagtag

SEQ ID NO: 3566 - DNA, 657 bp, Artificial Sequence
  Description of Artificial Sequence: Synthetic coding sequence
atgagctttgtgggggagaacagcggcgtgaagatgggcagcgaggactgggagaaggatgagccccagtgctgcctggaggaccctgctggcagccccctggagcccggccccagcctgcccaccatgaactttgtgcacaccagccccaaggtgaagaacctgaaccccaagaagttcagcatccatgaccaggaccacaaggtgctggtgctggacagcggcaacctgattgctgtgcctgacaagaactacatccggcctgagatcttctttgccctggccagcagcctgagcagcgccagcgctgagaagggcagccccatcctgctgggcgtgtccaaaggagagttctgcctgtactgtgacaaggacaagggccagagccaccccagcctgcagctgaagaaggagaagctgatgaagctggccgcccagaaggagagcgcccggcggcccttcatcttctaccgggcccaggtgggctcctggaacatgctggagagcgctgcccaccctggctggttcatctgcaccagctgcaactgcaatgaacctgtgggcgtgacagacaagtttgagaacaggaagcacatcgagttctccttccagcctgtgtgcaaggccgagatgagccccagcgaggtgtctgactag

SEQ ID NO: 3567 - DNA, 579 bp, Artificial Sequence
  Description of Artificial Sequence: Synthetic coding sequence
atgagcggctgtgaccggcgggagacagagaccaagggcaagaacagcttcaagaagaggctgcggggccccaaggtgaagaacctgaaccccaagaagttcagcatccatgaccaggaccacaaggtgctggtgctggacagcggcaacctgattgctgtgcctgacaagaactacatccggcctgagatcttctttgccctggccagcagcctgagcagcgccagcgctgagaagggcagccccatcctgctgggcgtgtccaaaggagagttctgcctgtactgtgacaaggacaagggccagagccaccccagcctgcagctgaagaaggagaagctgatgaagctggccgcccagaaggagagcgcccggcggcccttcatcttctaccgggcccaggtgggctcctggaacatgctggagagcgctgcccaccctggctggttcatctgcaccagctgcaactgcaatgaacctgtgggcgtgacagacaagtttgagaacaggaagcacatcgagttctccttccagcctgtgtgcaaggccgagatgagccccagcgaggtgtctgactag

SEQ ID NO: 3568 - DNA, 474 bp, Artificial Sequence
  Description of Artificial Sequence: Synthetic coding sequence
atgagctttgtgggggagaacagcggcgtgaagatgggcagcgaggactgggagaaggatgagccccagtgctgcctggaggagatcttctttgccctggccagcagcctgagcagcgccagcgctgagaagggcagccccatcctgctgggcgtgtccaagggggagttctgcctgtactgtgacaaggacaagggccagagccaccccagcctgcagctgaagaaggagaagctgatgaagctggccgcccagaaggagagcgcccggcggcccttcatcttctaccgggcccaggtgggctcctggaacatgctggagagcgctgcccaccctggctggttcatctgcaccagctgcaactgcaatgaacctgtgggcgtgacagacaagtttgaaaataggaagcacatcgagttctccttccagcctgtgtgcaaggccgagatgagccccagcgaggtgtctgactag

SEQ ID NO: 3569 - DNA, 594 bp, Artificial Sequence
  Description of Artificial Sequence: Synthetic coding sequence
atgagctttgtgggggagaacagcggcgtgaagatgggcagcgaggactgggagaaggatgagccccagtgctgcctggagggccccaaggtgaagaacctgaaccccaagaagttcagcatccatgaccaggaccacaaggtgctggtgctggacagcggcaacctgattgctgtgcctgacaagaactacatccggcctgagatcttctttgccctggccagcagcctgagcagcgccagcgctgagaagggcagccccatcctgctgggcgtgtccaagggggagttctgcctgtactgtgacaaggacaagggccagagccaccccagcctgcagctgaagaaggagaagctgatgaagctggccgcccagaaggagagcgcccggcggcccttcatcttctaccgggcccaggtgggctcctggaacatgctggagagcgctgcccaccctggctggttcatctgcaccagctgcaactgcaatgaacctgtgggcgtgacagacaagtttgaaaataggaagcacatcgagttctccttccagcctgtgtgcaaggccgagatgagccccagcgaggtgtctgactag

SEQ ID NO: 3570 - DNA, 537 bp, Artificial Sequence
  Description of Artificial Sequence: Synthetic coding sequence
atgagctttgtgggggagaacagcggcgtgaagatgggcagcgaggactgggagaaggatgagccccagtgctgcctggaggaccctgctggcagccccctggagcccggccccagcctgcccaccatgaactttgtgcacaccaagatcttctttgccctggccagcagcctgagcagcgccagcgctgagaagggcagccccatcctgctgggcgtgtccaaaggagagttctgcctgtactgtgacaaggacaagggccagagccaccccagcctgcagctgaagaaggagaagctgatgaagctggccgcccagaaggagagcgcccggcggcccttcatcttctaccgggcccaggtgggctcctggaacatgctggagagcgctgcccaccctggctggttcatctgcaccagctgcaactgcaatgaacctgtgggcgtgacagacaagtttgagaacaggaagcacatcgagttctccttccagcctgtgtgcaaggccgagatgagccccagcgaggtgtctgactag

SEQ ID NO: 3571 - DNA, 1770 bp, Artificial Sequence
  Description of Artificial Sequence: Synthetic coding sequence
atgcccaatgatgacttctgccccggcctgaccatcaaggccatgggcgctgagcgggccccccagaggcagccctgcaccctgcacctgctggtgctggtgcccatcctgctgagcctggtggccagccaggactggaaggccgagaggagccaggacccctttgagaagtgcatgcaggaccctgactatgagcagctgctgaaggtggtgacctggggcctgaacagaaccctgaagccccagagggtgattgtggtgggcgccggcgtggccggcctggtggccgccaaggtgctgagtgatgctggccacaaggtgaccatcctggaggccgacaaccgcatcggcggccgcatcttcacctacagagaccagaacacaggctggattggagagctgggcgccatgaggatgcccagcagccaccgcatcctgcacaagctgtgccagggcctgggcctgaacctgaccaagttcacccagtatgacaagaacacctggacagaggtgcatgaggtgaagctgagaaattatgtggtggagaaggtgcctgagaagctgggctacgccctgcggccccaggagaagggccacagccctgaggacatctaccagatggccctgaaccaggccctgaaggacctgaaggccctgggctgcaggaaggccatgaagaagtttgagcggcacaccctgctggagtacctgctgggggagggcaacctgagcaggcctgctgtgcagctgctgggagatgtgatgtctgaagatggcttcttctacctgagctttgctgaggccctgcgggcccacagctgcctgagtgaccggctgcagtacagccgcatcgtgggcggctgggacctgctgccccgggccctgctgagcagcctgagcggcctggtgctgctgaatgcccctgtggtggccatgacccagggcccccatgatgtgcacgtgcagatcgagaccagccccccagccaggaacctgaaggtgctgaaggcagatgtggtgctgctgacagccagcggccctgctgtgaagaggatcaccttcagcccccccctgcccaggcacatgcaggaggccctgcggcggctgcactacgtgcctgccaccaaggtgttcctgtccttccggcggcccttctggagggaggagcacattgaaggaggccacagcaacacagaccggcccagcaggatgatcttctaccccccaccccgggagggcgccctgctgctggccagctacacctggagcgatgctgctgctgcctttgctggcctgagccgggaggaggccctgcggctggccctggatgatgtggccgccctgcacggccctgtggtgcggcagctgtgggatggcaccggggtggtgaagcgctgggccgaggaccagcacagccagggcggctttgtggtgcagcccccagccctgtggcagacagagaaggatgactggacagtgccctacggccgcatctactttgctggggagcacacagcctacccccacggctgggtggagacagctgtgaagagcgccctgcgggccgccatcaagatcaacagcaggaagggccctgccagtgacacagccagccctgagggccacgccagtgacatggagggccagggccacgtgcatggagtggccagcagccccagccatgacctggccaaggaggagggcagccacccccctgtgcagggccagctgagcctgcagaacaccacccacaccaggaccagccactag

SEQ ID NO: 3572 - DNA, 1704 bp, Artificial Sequence
  Description of Artificial Sequence: Synthetic coding sequence
atggcccccctggccctgcacctgctggtgctggtgcccatcctgctgagcctggtggccagccaggactggaaggccgagaggagccaggacccctttgagaagtgcatgcaggaccctgactatgagcagctgctgaaggtggtgacctggggcctgaacagaaccctgaagccccagagggtgattgtggtgggcgccggcgtggccggcctggtggccgccaaggtgctgagtgatgctggccacaaggtgaccatcctggaggccgacaaccgcatcggcggccgcatcttcacctacagagaccagaacacaggctggattggagagctgggcgccatgaggatgcccagcagccaccgcatcctgcacaagctgtgccagggcctgggcctgaacctgaccaagttcacccagtatgacaagaacacctggacagaggtgcatgaggtgaagctgagaaattatgtggtggagaaggtgcctgagaagctgggctacgccctgcggccccaggagaagggccacagccctgaggacatctaccagatggccctgaaccaggccctgaaggacctgaaggccctgggctgcaggaaggccatgaagaagtttgagcggcacaccctgctggagtacctgctgggggagggcaacctgagcaggcctgctgtgcagctgctgggagatgtgatgtctgaagatggcttcttctacctgagctttgctgaggccctgcgggcccacagctgcctgagtgaccggctgcagtacagccgcatcgtgggcggctgggacctgctgccccgggccctgctgagcagcctgagcggcctggtgctgctgaatgcccctgtggtggccatgacccagggcccccatgatgtgcacgtgcagatcgagaccagccccccagccaggaacctgaaggtgctgaaggcagatgtggtgctgctgacagccagcggccctgctgtgaagaggatcaccttcagcccccccctgcccaggcacatgcaggaggccctgcggcggctgcactacgtgcctgccaccaaggtgttcctgtccttccggcggcccttctggagggaggagcacattgaaggaggccacagcaacacagaccggcccagcaggatgatcttctaccccccaccccgggagggcgccctgctgctggccagctacacctggagcgatgctgctgctgcctttgctggcctgagccgggaggaggccctgcggctggccctggatgatgtggccgccctgcacggccctgtggtgcggcagctgtgggatggcaccggggtggtgaagcgctgggccgaggaccagcacagccagggcggctttgtggtgcagcccccagccctgtggcagacagagaaggatgactggacagtgccctacggccgcatctactttgctggggagcacacagcctacccccacggctgggtggagacagctgtgaagagcgccctgcgggccgccatcaagatcaacagcaggaagggccctgccagtgacacagccagccctgagggccacgccagtgacatggagggccagggccacgtgcatggagtggccagcagccccagccatgacctggccaaggaggagggcagccacccccctgtgcagggccagctgagcctgcagaacaccacccacaccaggaccagccactag

SEQ ID NO: 3573 - DNA, 1770 bp, Artificial Sequence; identical to SEQ ID NO: 3571
  Description of Artificial Sequence: Synthetic coding sequence

SEQ ID NO: 3574 - DNA, 462 bp, Artificial Sequence
  Description of Artificial Sequence: Synthetic coding sequence
atgggcctgaccagccagctgctgcccccactcttcttcctgctggcctgtgccggcaactttgtgcacggccacaagtgtgacatcaccctgcaggagatcatcaagaccctgaacagcctgacagagcagaagaccctgtgcacagagctgactgtgacagacatctttgctgccagcaagaacaccacagagaaggagaccttctgccgggccgccaccgtgctgcggcagttctacagccaccacgagaaggacacccgctgcctgggcgccacagcccagcagttccaccgccacaagcagctgatccgcttcctgaagaggctggacaggaacctgtggggcctggccggcctgaacagctgccctgtgaaggaggccaaccagagcaccctggagaacttcctggagcggctgaagaccatcatgagggagaagtacagcaagtgcagcagctag

SEQ ID NO: 3575 - DNA, 435 bp, Artificial Sequence
  Description of Artificial Sequence: Synthetic coding sequence
atgctgctggccatggtgctgaccagcgccctgctgctgtgcagcgtggccggccagggctgccccaccctggccggcatcctggacatcaacttcctgatcaacaagatgcaggaggaccctgccagcaagtgccactgcagcgccaacgtgaccagctgcctgtgcctgggcatccccagcgacaactgcacccggccctgcttcagcgagcggctgagccagatgaccaacaccaccatgcagacccgctaccccctcatcttcagccgggtgaagaagtctgtggaggtgctgaagaacaacaagtgcccctacttcagctgtgagcagccctgcaaccagaccacagctggaaatgccctgaccttcctgaagagcctgctggagatcttccagaaggagaagatgaggggcatgaggggcaagatctag

SEQ ID NO: 3576 - DNA, 2109 bp, Artificial Sequence
  Description of Artificial Sequence: Synthetic coding sequence
atgaggcccatgaggatctttgtgaatgatgacagacatgtgatggccaagcacagctctgtgtaccccacccaggaggagctggaggccgtgcagaacatggtgagccacacagagcgggccctgaaggctgtgtctgactggattgatgagcaggagaagggcagcagcgagcaggccgagagtgacaacatggatgtgcccccagaagatgacagcaaggagggcgctggggagcagaagacagagcacatgaccaggaccctgcggggcgtgatgagggtgggcctggtggccaagggcctgctgctgaagggggacctggacctggagctggtgctgctgtgcaaggagaagcccaccacagccctgctggacaaggtggccgacaacctggccatccagctggccgctgtgacagaggacaagtatgagatcctgcagagcgtggatgatgctgccatcgtcatcaagaacaccaaggagccccccctgagcctgaccatccacctgaccagccctgtggtgcgggaggagatggagaaggtgctggccggggagaccctgtctgtgaatgaccccccagatgtgctggaccggcagaagtgcctggccgccctggccagcctgcggcatgccaagtggttccaggcccgggccaacggcctgaagagctgtgtgattgtcatccgggtgctgcgggacctgtgcaccagggtgcccacctggggccccctgcggggctggcccctggagctgctgtgtgagaagagcattggaacagccaaccggcccatgggcgctggggaggccctgcggcgggtgctggagtgcctggccagcggcatcgtgatgccagatggcagcggcatctatgacccctgtgagaaggaggccacagatgccatcggccacctggaccggcagcagcgggaggacatcacccagagcgcccagcacgccctgcggctggccgccttcggccagctgcacaaggtgctgggcatggaccccctgcccagcaagatgcccaagaagcccaagaatgaaaatcctgtggactacacagtgcagatcccccccagcaccacctacgccatcacccccatgaagaggcccatggaggaggatggagaggagaagagccccagcaagaagaagaagaagatccagaagaaggaggagaaggccgagcccccccaggccatgaatgccctgatgaggctgaaccagctgaagccaggcctgcagtacaagctggtgtcccagacaggccctgtgcacgcccccatcttcaccatgtctgtggaggtggatggcaacagctttgaggccagcggccccagcaagaagacagccaagctgcacgtggccgtgaaggtgctgcaggacatgggcctgcccactggagctgagggccgggacagcagcaagggggaggacagcgctgaggagacagaggccaagccagctgtggtggccccagcccctgtggtggaggccgtgtccacccccagcgctgccttccccagtgatgccacagctgagcagggccccatcctgaccaagcacggcaagaaccctgtgatggagctgaatgagaagaggcggggcctgaagtatgagctgatcagcgagactggaggcagccatgacaagagatttgtgatggaggtggaggtggatggccagaagttccagggcgccggcagcaacaagaaggtggccaaggcctatgctgccctggccgccctggagaagctgttcccagacacccccctggccctggatgccaacaagaagaagagggcccctgtgcctgtgcggggcggccccaagtttgctgccaagccccacaaccctggcttcggcatgggcggccccatgcacaatgaggtgcccccaccacccaacctgcggggccggggccggggcggcagcatccggggccggggccggggccggggctttggaggagccaaccacggcggctacatgaatgctggggccggctacggcagctatggctatggaggcaacagcgccacagctggctacagcgacttcttcacagactgctacggctaccatgactttggcagcagctag

SEQ ID NO: 3577 - DNA, 2109 bp, Artificial Sequence; identical to SEQ ID NO: 3576
  Description of Artificial Sequence: Synthetic coding sequence

SEQ ID NO: 3578 - DNA, 2685 bp, Artificial Sequence
  Description of Artificial Sequence: Synthetic coding sequence
atgaggcccatgaggatctttgtgaatgatgacagacatgtgatggccaagcacagctctgtgtaccccacccaggaggagctggaggccgtgcagaacatggtgagccacacagagcgggccctgaaggctgtgtctgactggattgatgagcaggagaagggcagcagcgagcaggccgagagtgacaacatggatgtgcccccagaagatgacagcaaggagggcgctggggagcagaagacagagcacatgaccaggaccctgcggggcgtgatgagggtgggcctggtggccaagggcctgctgctgaagggggacctggacctggagctggtgctgctgtgcaaggagaagcccaccacagccctgctggacaaggtggccgacaacctggccatccagctggccgctgtgacagaggacaagtatgagatcctgcagagcgtggatgatgctgccatcgtcatcaagaacaccaaggagccccccctgagcctgaccatccacctgaccagccctgtggtgcgggaggagatggagaaggtgctggccggggagaccctgtctgtgaatgaccccccagatgtgctggaccggcagaagtgcctggccgccctggccagcctgcggcatgccaagtggttccaggcccgggccaacggcctgaagagctgtgtgattgtcatccgggtgctgcgggacctgtgcaccagggtgcccacctggggccccctgcggggctggcccctggagctgctgtgtgagaagagcattggaacagccaaccggcccatgggcgctggggaggccctgcggcgggtgctggagtgcctggccagcggcatcgtgatgccagatggcagcggcatctatgacccctgtgagaaggaggccacagatgccatcggccacctggaccggcagcagcgggaggacatcacccagagcgcccagcacgccctgcggctggccgccttcggccagctgcacaaggtgctgggcatggaccccctgcccagcaagatgcccaagaagcccaagaatgaaaatcctgtggactacacagtgcagatcccccccagcaccacctacgccatcacccccatgaagaggcccatggaggaggatggagaggagaagagccccagcaagaagaagaagaagatccagaagaaggaggagaaggccgagcccccccaggccatgaatgccctgatgaggctgaaccagctgaagccaggcctgcagtacaagctggtgtcccagacaggccctgtgcacgcccccatcttcaccatgtctgtggaggtggatggcaacagctttgaggccagcggccccagcaagaagacagccaagctgcacgtggccgtgaaggtgctgcaggacatgggcctgcccactggagctgagggccgggacagcagcaagggggaggacagcgctgaggagacagaggccaagccagctgtggtggccccagcccctgtggtggaggccgtgtccacccccagcgctgccttccccagtgatgccacagctgagcagggccccatcctgaccaagcacggcaagaaccctgtgatggagctgaatgagaagaggcggggcctgaagtatgagctgatcagcgagactggaggcagccatgacaagagatttgtgatggaggtggaggtggatggccagaagttccagggcgccggcagcaacaagaaggtggccaaggcctatgctgccctggccgccctggagaagctgttcccagacacccccctggccctggatgccaacaagaagaagagggcccctgtgcctgtgcggggcggccccaagtttgctgccaagccccacaaccctggcttcggcatgggcggccccatgcacaatgaggtgcccccaccacccaacctgcggggccggggccggggcggcagcatccggggccggggccggggccggggctttggaggagccaaccacggcggctacatgaatgctggggccggctacggcagctatggctatggaggcaacagcgccacagctggctacagccagttctacagcaatggaggccacagcggaaatgccagcggcggcggcggcggcggcggcggcggcagcagcggctacggcagctactaccagggcgacaactacaacagccctgtgccccccaagcatgctgggaagaagcagccccatggaggccagcagaagcccagctatggcagcggctaccagagccaccagggccagcagcagagctacaaccagagcccctacagcaactacggccccccccagggcaagcagaagggctacaaccacggccagggcagctacagctacagcaacagctacaacagccctgggggcggcggcggcagtgactacaactatgagagcaagttcaactacagcggcagcggcggccgcagcggcggcaacagctatggcagcggcggggccagctacaaccctggcagccatggaggctacggcggcggcagcggcggcggcagcagctaccagggcaagcagggcggctacagccagagcaactacaacagccctggcagcggccagaactacagcggcccccccagcagctaccagagcagccagggcggctatggaagaaatgctgaccacagcatgaactaccagtacagatag

SEQ ID NO: 3579 - DNA, 2295 bp, Artificial Sequence
  Description of Artificial Sequence: Synthetic coding sequence
atgaggcccatgaggatctttgtgaatgatgacagacatgtgatggccaagcacagctctgtgtaccccacccaggaggagctggaggccgtgcagaacatggtgagccacacagagcgggccctgaaggctgtgtctgactggattgatgagcaggagaagggcagcagcgagcaggccgagagtgacaacatggatgtgcccccagaagatgacagcaaggagggcgctggggagcagaagacagagcacatgaccaggaccctgcggggcgtgatgagggtgggcctggtggccaagggcctgctgctgaagggggacctggacctggagctggtgctgctgtgcaaggagaagcccaccacagccctgctggacaaggtggccgacaacctggccatccagctggccgctgtgacagaggacaagtatgagatcctgcagagcgtggatgatgctgccatcgtcatcaagaacaccaaggagccccccctgagcctgaccatccacctgaccagccctgtggtgcgggaggagatggagaaggtgctggccggggagaccctgtctgtgaatgaccccccagatgtgctggaccggcagaagtgcctggccgccctggccagcctgcggcatgccaagtggttccaggcccgggccaacggcctgaagagctgtgtgattgtcatccgggtgctgcgggacctgtgcaccagggtgcccacctggggccccctgcggggctggcccctggagctgctgtgtgagaagagcattggaacagccaaccggcccatgggcgctggggaggccctgcggcgggtgctggagtgcctggccagcggcatcgtgatgccagatggcagcggcatctatgacccctgtgagaaggaggccacagatgccatcggccacctggaccggcagcagcgggaggacatcacccagagcgcccagcacgccctgcggctggccgccttcggccagctgcacaaggtgctgggcatggaccccctgcccagcaagatgcccaagaagcccaagaatgaaaatcctgtggactacacagtgcagatcccccccagcaccacctacgccatcacccccatgaagaggcccatggaggaggatggagaggagaagagccccagcaagaagaagaagaagatccagaagaaggaggagaaggccgagcccccccaggccatgaatgccctgatgaggctgaaccagctgaagccaggcctgcagtacaagctggtgtcccagacaggccctgtgcacgcccccatcttcaccatgtctgtggaggtggatggcaacagctttgaggccagcggccccagcaagaagacagccaagctgcacgtggccgtgaaggtgctgcaggacatgggcctgcccactggagctgagggccgggacagcagcaagggggaggacagcgctgaggagacagaggccaagccagctgtggtggccccagcccctgtggtggaggccgtgtccacccccagcgctgccttccccagtgatgccacagctgagcagggccccatcctgaccaagcacggcaagaaccctgtgatggagctgaatgagaagaggcggggcctgaagtatgagctgatcagcgagactggaggcagccatgacaagagatttgtgatggaggtggaggtggatggccagaagttccagggcgccggcagcaacaagaaggtggccaaggcctatgctgccctggccgccctggagaagctgttcccagacacccccctggccctggatgccaacaagaagaagagggcccctgtgcctgtgcggggcggccccaagtttgctgccaagccccacaaccctggcttcggcatgggcggccccatgcacaatgaggtgcccccaccacccaacctgcggggccggggccggggcggcagcatccggggccggggccggggccggggctttggaggagccaaccacggcggctacatgaatgctggggccggctacggcagctatggctatggaggcaacagcgccacagctggctacagcaagagcagccggcccccaccacccagccggccccgctgctgcgtggtgcgctgcagcggcagcccctgtggccccagctgtgacccctacctggccgtgtttggcaccccctgcctgcagtggtttgtgtcctgccactacaactttgtgtgggtggagttcctgtccttctgcagctctgtgtccctgtgcctcttcaccctgcgggtgtctggcaacagcgtgtgcctgtag

SEQ ID NO: 3580 - DNA, 2121 bp, Artificial Sequence
  Description of Artificial Sequence: Synthetic coding sequence
atgaggcccatgaggatctttgtgaatgatgacagacatgtgatggccaagcacagctctgtgtaccccacccaggaggagctggaggccgtgcagaacatggtgagccacacagagcgggccctgaaggctgtgtctgactggattgatgagcaggagaagggcagcagcgagcaggccgagagtgacaacatggatgtgcccccagaagatgacagcaaggagggcgctggggagcagaagacagagcacatgaccaggaccctgcggggcgtgatgagggtgggcctggtggccaagggcctgctgctgaagggggacctggacctggagctggtgctgctgtgcaaggagaagcccaccacagccctgctggacaaggtggccgacaacctggccatccagctggccgctgtgacagaggacaagtatgagatcctgcagagcgtggatgatgctgccatcgtcatcaagaacaccaaggagccccccctgagcctgaccatccacctgaccagccctgtggtgcgggaggagatggagaaggtgctggccggggagaccctgtctgtgaatgaccccccagatgtgctggaccggcagaagtgcctggccgccctggccagcctgcggcatgccaagtggttccaggcccgggccaacggcctgaagagctgtgtgattgtcatccgggtgctgcgggacctgtgcaccagggtgcccacctggggccccctgcggggctggcccctggagctgctgtgtgagaagagcattggaacagccaaccggcccatgggcgctggggaggccctgcggcgggtgctggagtgcctggccagcggcatcgtgatgccagatggcagcggcatctatgacccctgtgagaaggaggccacagatgccatcggccacctggaccggcagcagcgggaggacatcacccagagcgcccagcacgccctgcggctggccgccttcggccagctgcacaaggtgctgggcatggaccccctgcccagcaagatgcccaagaagcccaagaatgaaaatcctgtggactacacagtgcagatcccccccagcaccacctacgccatcacccccatgaagaggcccatggaggaggatggagaggagaagagccccagcaagaagaagaagaagatccagaagaaggaggagaaggccgagcccccccaggccatgaatgccctgatgaggctgaaccagctgaagccaggcctgcagtacaagctggtgtcccagacaggccctgtgcacgcccccatcttcaccatgtctgtggaggtggatggcaacagctttgaggccagcggccccagcaagaagacagccaagctgcacgtggccgtgaaggtgctgcaggacatgggcctgcccactggagctgagggccgggacagcagcaagggggaggacagcgctgaggagacagaggccaagccagctgtggtggccccagcccctgtggtggaggccgtgtccacccccagcgctgccttccccagtgatgccacagcagaaaatgtgaagcagcagggccccatcctgaccaagcacggcaagaaccctgtgatggagctgaatgagaagaggcggggcctgaagtatgagctgatcagcgagactggaggcagccatgacaagagatttgtgatggaggtggaggtggatggccagaagttccagggcgccggcagcaacaagaaggtggccaaggcctatgctgccctggccgccctggagaagctgttcccagacacccccctggccctggatgccaacaagaagaagagggcccctgtgcctgtgcggggcggccccaagtttgctgccaagccccacaaccctggcttcggcatgggcggccccatgcacaatgaggtgcccccaccacccaacctgcggggccggggccggggcggcagcatccggggccggggccggggccggggctttggaggagccaaccacggcggctacatgaatgctggggccggctacggcagctatggctatggaggcaacagcgccacagctggctacagcgacttcttcacagactgctacggctaccatgactttggcagcagctag

SEQ ID NO: 3581 - DNA, 2073 bp, Artificial Sequence
  Description of Artificial Sequence: Synthetic coding sequence
atgaggcccatgaggatctttgtgaatgatgacagacatgtgatggccaagcacagctctgtgtaccccacccaggaggagctggaggccgtgcagaacatggtgagccacacagagcgggccctgaaggctgtgtctgactggattgatgagcaggagaagggcagcagcgagcaggccgagagtgacaacatggatgtgcccccagaagatgacagcaaggagggcgctggggagcagaagacagagcacatgaccaggaccctgcggggcgtgatgagggtgggcctggtggccaagggcctgctgctgaagggggacctggacctggagctggtgctgctgtgcaaggagaagcccaccacagccctgctggacaaggtggccgacaacctggccatccagctggccgctgtgacagaggacaagtatgagatcctgcagagcgtggatgatgctgccatcgtcatcaagaacaccaaggagccccccctgagcctgaccatccacctgaccagccctgtggtgcgggaggagatggagaaggtgctggccggggagaccctgtctgtgaatgaccccccagatgtgctggaccggcagaagtgcctggccgccctggccagcctgcggcatgccaagtggttccaggcccgggccaacggcctgaagagctgtgtgattgtcatccgggtgctgcgggacctgtgcaccagggtgcccacctggggccccctgcggggctggcccctggagctgctgtgtgagaagagcattggaacagccaaccggcccatgggcgctggggaggccctgcggcgggtgctggagtgcctggccagcggcatcgtgatgccagatggcagcggcatctatgacccctgtgagaaggaggccacagatgccatcggccacctggaccggcagcagcgggaggacatcacccagagcgcccagcacgccctgcggctggccgccttcggccagctgcacaaggtgctgggcatggaccccctgcccagcaagatgcccaagaagcccaagaatgaaaatcctgtggactacacagtgcagatcccccccagcaccacctacgccatcacccccatgaagaggcccatggaggaggatggagaggagaagagccccagcaagaagaagaagaagatccagaagaaggaggagaaggccgagcccccccaggccatgaatgccctgatgaggctgaaccagctgaagccaggcctgcagtacaagctggtgtcccagacaggccctgtgcacgcccccatcttcaccatgtctgtggaggtggatggcaacagctttgaggccagcggccccagcaagaagacagccaagctgcacgtggccgtgaaggtgctgcaggacatgggcctgcccactggagctgagggccgggacagcagcaagggggaggacagcgctgaggagacagaggccaagccagctgtggtggccccagcccctgtggtggaggccgtgtccacccccagcgctgccttccccagtgatgccacagctgagcagggccccatcctgaccaagcacggcaagaaccctgtgatggagctgaatgagaagaggcggggcctgaagtatgagctgatcagcgagactggaggcagccatgacaagagatttgtgatggaggtggaggtggatggccagaagttccagggcgccggcagcaacaagaaggtggccaaggcctatgctgccctggccgccctggagaagctgttcccagacacccccctggccctggatgccaacaagaagaagagggcccctgtgcctgtgcggggcggccccaagtttgctgccaagccccacaaccctggcttcggcatgggcggccccatgcacaatgaggtgcccccaccacccaacctgcggggccggggccggggcggcagcatccggggccggggccggggccggggctttggaggagccaaccacggcggctacatgaatgctggggccggctacggcagctatggctatggaggcaacagcgccacagctggctacacaggctttgtgtag

SEQ ID NO: 3582 - DNA, 2697 bp, Artificial Sequence
  Description of Artificial Sequence: Synthetic coding sequence
atgaggcccatgaggatctttgtgaatgatgacagacatgtgatggccaagcacagctctgtgtaccccacccaggaggagctggaggccgtgcagaacatggtgagccacacagagcgggccctgaaggctgtgtctgactggattgatgagcaggagaagggcagcagcgagcaggccgagagtgacaacatggatgtgcccccagaagatgacagcaaggagggcgctggggagcagaagacagagcacatgaccaggaccctgcggggcgtgatgagggtgggcctggtggccaagggcctgctgctgaagggggacctggacctggagctggtgctgctgtgcaaggagaagcccaccacagccctgctggacaaggtggccgacaacctggccatccagctggccgctgtgacagaggacaagtatgagatcctgcagagcgtggatgatgctgccatcgtcatcaagaacaccaaggagccccccctgagcctgaccatccacctgaccagccctgtggtgcgggaggagatggagaaggtgctggccggggagaccctgtctgtgaatgaccccccagatgtgctggaccggcagaagtgcctggccgccctggccagcctgcggcatgccaagtggttccaggcccgggccaacggcctgaagagctgtgtgattgtcatccgggtgctgcgggacctgtgcaccagggtgcccacctggggccccctgcggggctggcccctggagctgctgtgtgagaagagcattggaacagccaaccggcccatgggcgctggggaggccctgcggcgggtgctggagtgcctggccagcggcatcgtgatgccagatggcagcggcatctatgacccctgtgagaaggaggccacagatgccatcggccacctggaccggcagcagcgggaggacatcacccagagcgcccagcacgccctgcggctggccgccttcggccagctgcacaaggtgctgggcatggaccccctgcccagcaagatgcccaagaagcccaagaatgaaaatcctgtggactacacagtgcagatcccccccagcaccacctacgccatcacccccatgaagaggcccatggaggaggatggagaggagaagagccccagcaagaagaagaagaagatccagaagaaggaggagaaggccgagcccccccaggccatgaatgccctgatgaggctgaaccagctgaagccaggcctgcagtacaagctggtgtcccagacaggccctgtgcacgcccccatcttcaccatgtctgtggaggtggatggcaacagctttgaggccagcggccccagcaagaagacagccaagctgcacgtggccgtgaaggtgctgcaggacatgggcctgcccactggagctgagggccgggacagcagcaagggggaggacagcgctgaggagacagaggccaagccagctgtggtggccccagcccctgtggtggaggccgtgtccacccccagcgctgccttccccagtgatgccacagcagaaaatgtgaagcagcagggccccatcctgaccaagcacggcaagaaccctgtgatggagctgaatgagaagaggcggggcctgaagtatgagctgatcagcgagactggaggcagccatgacaagagatttgtgatggaggtggaggtggatggccagaagttccagggcgccggcagcaacaagaaggtggccaaggcctatgctgccctggccgccctggagaagctgttcccagacacccccctggccctggatgccaacaagaagaagagggcccctgtgcctgtgcggggcggccccaagtttgctgccaagccccacaaccctggcttcggcatgggcggccccatgcacaatgaggtgcccccaccacccaacctgcggggccggggccggggcggcagcatccggggccggggccggggccggggctttggaggagccaaccacggcggctacatgaatgctggggccggctacggcagctatggctatggaggcaacagcgccacagctggctacagccagttctacagcaatggaggccacagcggaaatgccagcggcggcggcggcggcggcggcggcggcagcagcggctacggcagctactaccagggcgacaactacaacagccctgtgccccccaagcatgctgggaagaagcagccccatggaggccagcagaagcccagctatggcagcggctaccagagccaccagggccagcagcagagctacaaccagagcccctacagcaactacggccccccccagggcaagcagaagggctacaaccacggccagggcagctacagctacagcaacagctacaacagccctgggggcggcggcggcagtgactacaactatgagagcaagttcaactacagcggcagcggcggccgcagcggcggcaacagctatggcagcggcggggccagctacaaccctggcagccatggaggctacggcggcggcagcggcggcggcagcagctaccagggcaagcagggcggctacagccagagcaactacaacagccctggcagcggccagaactacagcggcccccccagcagctaccagagcagccagggcggctatggaagaaatgctgaccacagcatgaactaccagtacagatag

SEQ ID NO: 3583 - DNA, 882 bp, Artificial Sequence
  Description of Artificial Sequence: Synthetic coding sequence
atggccacagcccggcccccctggatgtgggtgctgtgtgccctgatcacagccctgctgctgggcgtgacagagcacgtgctggccaacaatgatgtgtcctgtgaccaccccagcaacacagtgcccagcggcagcaaccaggacctgggcgctggggccggggaggatgcccggagtgatgacagcagcagccgcatcatcaatggaagtgactgtgacatgcacacccagccctggcaggccgccctgctgctgcggcccaaccagctgtactgtggggctgtgctggtgcacccccagtggctgctgacagctgcccactgcaggaagaaggtgttccgggtgcggctgggccactacagcctgagccctgtgtatgaaagtggccagcagatgttccagggcgtgaagagcatcccccaccctggctacagccaccctggccacagcaacaacctgatgctgatcaagctgaacagacgcatccggcccaccaaggatgtgcggcccatcaacgtgagcagccactgccccagcgctggcaccaagtgcctggtgtctggctggggcaccaccaagagcccccaggtgcacttccccaaggtgctgcagtgcctgaacatctctgtgctgagccagaagagatgtgaagatgcctacccccggcagattgatgacaccatgttctgtgccggggacaaggccggccgggacagctgccagggcgacagcggcggccctgtggtgtgcaatggcagcctgcagggcctggtgtcctggggagactacccctgtgcccggcccaacagacctggggtgtacaccaacctgtgcaagttcaccaagtggatccaggagaccatccaggccaacagctag

SEQ ID NO: 3584 - DNA, 882 bp, Artificial Sequence; identical to SEQ ID NO: 3583
  Description of Artificial Sequence: Synthetic coding sequence

SEQ ID NO: 3585 - DNA, 882 bp, Artificial Sequence; identical to SEQ ID NO: 3583
  Description of Artificial Sequence: Synthetic coding sequence

SEQ ID NO: 3586 - DNA, 2109 bp, Artificial Sequence
  Description of Artificial Sequence: Synthetic coding sequence
atgcccatcaacaagtctgagaagccagagagctgtgacaacgtgaaggtggtggtgcgctgccggcccctgaatgaaagagagaagtccatgtgctacaagcaggccgtgtctgtggatgagatgaggggcaccatcaccgtgcacaagacagacagcagcaatgaaccacccaagaccttcacctttgacacagtgtttggacctgagagcaagcagctggatgtgtacaacctgacagcccggcccatcattgattctgtgctggagggctacaacggcaccatctttgcctacggccagacaggcaccgggaagaccttcaccatggagggcgtgcgggccatccctgagctgcggggcatcatccccaacagctttgcccacatcttcggccacatcgccaaggccgagggggacacccgcttcctggtgcgggtgtcctacctggagatctacaatgaggaggtgcgggacctgctgggcaaggaccagacccagaggctggaggtgaaggagaggccagatgtgggcgtgtacatcaaggacctgagcgcctacgtggtgaacaatgctgatgacatggaccgcatcatgaccctgggccacaagaacagatctgtgggcgccaccaacatgaatgagcacagcagccgcagccacgccatcttcaccatcaccattgaatgttctgagaagggcattgatggcaacatgcacgtgaggatgggcaagctgcacctggtggacctggccggcagcgagcggcaggccaagacaggagccaccggccagaggctgaaggaggccaccaagatcaacctgagcctgagcaccctgggcaatgtcatcagcgccctggtggatggcaagagcacccacgtgccctacagaaacagcaagctgacccggctgctgcaggacagcctgggcggcaacagcaagaccatgatgtgtgccaacatcggccctgctgactacaactatgatgagaccatcagcaccctgcgctatgccaacagagccaagaacatcaagaacaaggcccgcatcaatgaagaccccaaggatgccctgctgcggcagttccagaaggagattgaggagctgaagaagaagctggaggagggggaggagatcagcggcagtgacatcagcggcagcgaggaggatgatgatgaggagggggaggtgggggaggatggagagaagaggaagaagaggcgggaccaggccggcaagaagaaggtgtccccagacaagatgattgagatgcaggccaagattgatgaggagaggaaggccctggagaccaagctggacatggaggaggaggagaggaacaaggcccgggcagagctggagaagcgggagaaggacctgctgaaggcccagcaggagcaccagagcctgctggagaagctgagcgccctggagaagaaggtgattgtgggcggcgtggacctgctggccaaggccgaggagcaggagaagctgctggaggagagcaacatggagctggaggagaggaggaagagagctgagcagctgcggcgggagctggaggagaaggagcaggagcggctggacatcgaggagaagtacaccagcctgcaggaggaggcccagggcaagaccaagaagctgaagaaggtgtggaccatgctgatggccgccaagtctgagatggctgacctgcagcaggagcaccagcgggagattgagggcctgctggagaacatccggcagctgagccgggagctgcggctgcagatgctgatcatcgacaacttcatcccccgggactaccaggagatgattgagaactacgtgcactggaatgaagatattggagagtggcagctgaagtgtgtggcctacacaggcaacaacatgaggaagcagacccctgtgcctgacaagaaggagaaggacccctttgaggtggacctgagccacgtgtacctggcctacacagaggagagcctgcggcagagcctgatgaagctggagcggcccaggaccagcaagggcaaggcccggcccaagacaggccgcaggaagaggtctgccaagccagagaccgtgattgacagcctgctgcagtag

SEQ ID NO: 3587 - DNA, 2100 bp, Artificial Sequence
  Description of Artificial Sequence: Synthetic coding sequence
atgcccatcaacaagtctgagaagccagagagctgtgacaacgtgaaggtggtggtgcgctgccggcccctgaatgaaagagagaagtccatgtgctacaagcaggccgtgtctgtggatgagatgaggggcaccatcaccgtgcacaagacagacagcagcaatgaaccacccaagaccttcacctttgacacagtgtttggacctgagagcaagcagctggatgtgtacaacctgacagcccggcccatcattgattctgtgctggagggctacaacggcaccatctttgcctacggccagacaggcaccgggaagaccttcaccatggagggcgtgcgggccatccctgagctgcggggcatcatccccaacagctttgcccacatcttcggccacatcgccaaggccgagggggacacccgcttcctggtgcgggtgtcctacctggagatctacaatgaggaggtgcgggacctgctgggcaaggaccagacccagaggctggaggtgaaggagaggccagatgtgggcgtgtacatcaaggacctgagcgcctacgtggtgaacaatgctgatgacatggaccgcatcatgaccctgggccacaagaacagatctgtgggcgccaccaacatgaatgagcacagcagccgcagccacgccatcttcaccatcaccattgaatgttctgagaagggcattgatggcaacatgcacgtgaggatgggcaagctgcacctggtggacctggccggcagcgagcggcaggccaagacaggagccaccggccagaggctgaaggaggccaccaagatcaacctgagcctgagcaccctgggcaatgtcatcagcgccctggtggatggcaagagcacccacgtgccctacagaaacagcaagctgacccggctgctgcaggacagcctgggcggcaacagcaagaccatgatgtgtgccaacatcggccctgctgactacaactatgatgagaccatcagcaccctgcgctatgccaacagagccaagaacatcaagaacaaggcccgcatcaatgaagaccccaaggatgccctgctgcggcagttccagaaggagattgaggagctgaagaagaagctggaggagggggaggagatcagcggcagtgacatcagcggcagcgaggaggatgatgatgaggagggggaggtgggggaggatggagagaagaggaagaagaggcggggcaagaagaaggtgtccccagacaagatgattgagatgcaggccaagattgatgaggagaggaaggccctggagaccaagctggacatggaggaggaggagaggaacaaggcccgggcagagctggagaagcgggagaaggacctgctgaaggcccagcaggagcaccagagcctgctggagaagctgagcgccctggagaagaaggtgattgtgggcggcgtggacctgctggccaaggccgaggagcaggagaagctgctggaggagagcaacatggagctggaggagaggaggaagagagctgagcagctgcggcgggagctggaggagaaggagcaggagcggctggacatcgaggagaagtacaccagcctgcaggaggaggcccagggcaagaccaagaagctgaagaaggtgtggaccatgctgatggccgccaagtctgagatggctgacctgcagcaggagcaccagcgggagattgagggcctgctggagaacatccggcagctgagccgggagctgcggctgcagatgctgatcatcgacaacttcatcccccgggactaccaggagatgattgaaaattatgtgcactggaatgaagacatcggggagtggcagctgaagtgtgtggcctacacaggcaacaacatgaggaagcagacccctgtgcctgacaagaaggagaaggacccctttgaggtggacctgagccacgtgtacctggcctacacagaggagagcctgcggcagagcctgatgaagctggagcggcccaggaccagcaagggcaaggcccggcccaagacaggaagaaggaagaggtctgccaagccagagaccgtcatcgacagcctgctgcagtag

SEQ ID NO: 3588 - DNA, 1230 bp, Artificial Sequence
  Description of Artificial Sequence: Synthetic coding sequence
atgtgctacaagcaggccgtgtctgtggatgagatgaggggcaccatcaccgtgcacaagacagacagcagcaatgaaccacccaagaccttcacctttgacacagtgtttggacctgagagcaagcagctggatgtgtacaacctgacagcccggcccatcattgattctgtgctggagggctacaacggcaccatctttgcctacggccagacaggcaccgggaagaccttcaccatggagggcgtgcgggccatccctgagctgcggggcatcatccccaacagctttgcccacatcttcggccacatcgccaaggccgagggggacacccgcttcctggtgcgggtgtcctacctggagatctacaatgaggaggtgcgggacctgctgggcaaggaccagacccagaggctggaggtgaaggagaggccagatgtgggcgtgtacatcaaggacctgagcgcctacgtggtgaacaatgctgatgacatggaccgcatcatgaccctgggccacaagaacagatctgtgggcgccaccaacatgaatgagcacagcagccgcagccacgccatcttcaccatcaccattgaatgttctgagaagggcattgatggcaacatgcacgtgaggatgggcaagctgcacctggtggacctggccggcagcgagcggcaggccaagacaggagccaccggccagaggctgaaggaggccaccaagatcaacctgagcctgagcaccctgggcaatgtcatcagcgccctggtggatggcaagagcacccacgtgccctacagaaacagcaagctgacccggctgctgcaggacagcctgggcggcaacagcaagaccatgatgtgtgccaacatcggccctgctgactacaactatgatgagaccatcagcaccctgcgctatgccaacagagccaagaacatcaagaacaaggcccgcatcaatgaagaccccaaggatgccctgctgcggcagttccagaaggagattgaggagctgaagaagaagctggaggagggggaggagatcagcggcagtgacatcagcggcagcgaggaggatgatgatgaggagggggaggtgggggaggatggagagaagaggaagaagaggcggggcaagaagaaggtgtccccagacaagatgattgagatgcaggccaagattgatgaggagaggaagaagaagaagaagaagaagaagaagtag

SEQ ID NO: 3589 - DNA, 2181 bp, Artificial Sequence
  Description of Artificial Sequence: Synthetic coding sequence
atgcccatcaacaagtctgagaagccagagagctgtgacaacgtgaaggtggtggtgcgctgccggcccctgaatgaaagagagaagtccatgtgctacaagcaggccgtgtctgtggatgagatgaggggcaccatcaccgtgcacaagacagacagcagcaatgaaccacccaagaccttcacctttgacacagtgtttggacctgagagcaagcagctggatgtgtacaacctgacagcccggcccatcattgattctgtgctggagggctacaacggcaccatctttgcctacggccagacaggcaccgggaagaccttcaccatggagggcgtgcgggccatccctgagctgcggggcatcatccccaacagctttgcccacatcttcggccacatcgccaaggccgagggggacacccgcttcctggtgcgggtgtcctacctggagatctacaatgaggaggtgcgggacctgctgggcaaggaccagacccagaggctggaggtgaaggagaggccagatgtgggcgtgtacatcaaggacctgagcgcctacgtggtgaacaatgctgatgacatggaccgcatcatgaccctgggccacaagaacagatctgtgggcgccaccaacatgaatgagcacagcagccgcagccacgccatcttcaccatcaccattgaatgttctgagaagggcattgatggcaacatgcacgtgaggatgggcaagctgcacctggtggacctggccggcagcgagcggcaggccaagacaggagccaccggccagaggctgaaggaggccaccaagatcaacctgagcctgagcaccctgggcaatgtcatcagcgccctggtggatggcaagagcacccacgtgccctacagaaacagcaagctgacccggctgctgcaggacagcctgggcggcaacagcaagaccatgatgtgtgccaacatcggccctgctgactacaactatgatgagaccatcagcaccctgcgctatgccaacagagccaagaacatcaagaacaaggcccgcatcaatgaagaccccaaggatgccctgctgcggcagttccagaaggagattgaggagctgaagaagaagctggaggagggggaggagatcagcggcagtgacatcagcggcagcgaggaggatgatgatgaggagggggaggtgggggaggatggagagaagaggaagaagaggcggggcagcagcagcagcagcagcagtgacagcacctgcagcgtcatcgagaagcccctggacaagttcctgcccatccagatcggcaagaagaaggtgtccccagacaagatgattgagatgcaggccaagattgatgaggagaggaaggccctggagaccaagctggacatggaggaggaggagaggaacaaggcccgggcagagctggagaagcgggagaaggacctgctgaaggcccagcaggagcaccagagcctgctggagaagctgagcgccctggagaagaaggtgattgtgggcggcgtggacctgctggccaaggccgaggagcaggagaagctgctggaggagagcaacatggagctggaggagaggaggaagagagctgagcagctgcggcgggagctggaggagaaggagcaggagcggctggacatcgaggagaagtacaccagcctgcaggaggaggcccagggcaagaccaagaagctgaagaaggtgtggaccatgctgatggccgccaagtctgagatggctgacctgcagcaggagcaccagcgggagattgagggcctgctggagaacatccggcagctgagccgggagctgcggctgcagatgctgatcatcgacaacttcatcccccgggactaccaggagatgattgagaactacgtgcactggaatgaagatattggagagtggcagctgaagtgtgtggcctacacaggcaacaacatgaggaagcagacccctgtgcctgacaagaaggagaaggacccctttgaggtggacctgagccacgtgtacctggcctacacagaggagagcctgcggcagagcctgatgaagctggagcggcccaggaccagcaagggcaaggcccggcccaagacaggccgcaggaagaggtctgccaagccagagaccgtgattgacagcctgctgcagtag

SEQ ID NO: 3590 - DNA, 1035 bp, Artificial Sequence
  Description of Artificial Sequence: Synthetic coding sequence
atggtgtctgtgaacagcagccactgcttctacaatgacagcttcaagtacaccctgtatggctgcatgttctccatggtgtttgtgctgggcctcatcagcaactgtgtggccatctacatcttcatctgtgtgctgaaggtgagaaatgagaccaccacctacatgatcaacctggccatgtctgacctgctgtttgtgttcaccctgcccttccgcatcttctacttcaccaccaggaactggccctttggagacctgctgtgcaagatctctgtgatgctgttctacaccaacatgtatggcagcatcctcttcctgacctgcatctctgtggaccgcttcctggccatcgtgtaccccttcaagagcaagaccctgcggaccaagagaaatgccaagatcgtgtgcaccggggtgtggctgactgtgattggaggcagcgccccagctgtgtttgtgcagagcacccacagccagggcaacaatgccagcgaggcctgctttgagaacttccctgaggccacctggaagacctacctgagccgcatcgtcatcttcatcgagatcgtgggcttcttcatccccctcatcctgaatgtgacctgcagctccatggtgctgaagaccctgaccaagcctgtgaccctgagccgcagcaagatcaacaagaccaaggtgctgaagatgatctttgtgcacctgatcatcttctgcttctgctttgtgccctacaacatcaacctgatcctgtacagcctggtgaggacccagacctttgtgaactgcagcgtggtggccgctgtgaggaccatgtaccccatcaccctgtgcatcgctgtgagcaactgctgctttgaccccatcgtgtactacttcaccagtgacaccatccagaacagcatcaagatgaagaactggagcgtgcggcggagtgacttccgcttcagcgaggtgcacggggctgagaacttcatccagcacaacctgcagaccctgaagagcaagatctttgacaatgaatctgctgcctag

SEQ ID NO: 3591 - DNA, 1035 bp, Artificial Sequence; identical to SEQ ID NO: 3590
  Description of Artificial Sequence: Synthetic coding sequence

SEQ ID NO: 3592 - DNA, 795 bp, Artificial Sequence
  Description of Artificial Sequence: Synthetic coding sequence
atgctgcggggcccctgggccttccactacaacgtgagcagccacggctgccagctgctgccctggacccagcacagcccccacacccggctgcggcgcagcggccgctgtgacctcttccagaagaaggactatgtgaggacctgcatcatgaacaatggagtgggctaccggggcaccatggccaccaccgtgggcggcctgccctgccaggcctggagccacaagttccccaatgaccacaagtacacccccaccctgagaaatggcctggaggagaacttctgcagaaatccagatggagaccccggcggcccctggtgctacaccacagatcctgctgtgcgcttccagagctgtggcatcaagagctgccgggaggccgcctgtgtgtggtgcaatggagaggagtacagaggagctgtggacagaacagaaagtggccgggagtgccagcgctgggacctgcagcacccccaccagcacccctttgagcccgggaagttcctggaccagggcctggatgacaactactgcaggaacccagatggcagcgagcggccctggtgctacaccacagacccccagatcgagcgggagttctgtgacctgccccgctgtggcagcgaggcccagccccggcaggaggccaccaccgtgtcctgcttccggggcaagggggagggctaccggggcacagccaacaccaccacagctggggtgccctgccagcgctgggatgcccagatcccccaccagcaccgcttcaccccagagaagtatgcctgcaagtag

SEQ ID NO: 3593 - DNA, 2178 bp, Artificial Sequence
  Description of Artificial Sequence: Synthetic coding sequence
atgggcctgtggtgggtgacagtgcagcccccagcccggaggatgggctggctgcccctgctgctgctgctgacccagtgcctgggcgtgcccggccagaggagccccctgaatgacttccaggtgctgcggggcacagagctgcagcacctgctgcatgctgtggtgcccggcccctggcaggaggatgtggctgatgctgaagaatgtgccggccgctgtggccccctgatggactgccgggccttccactacaacgtgagcagccacggctgccagctgctgccctggacccagcacagcccccacacccggctgcggcgcagcggccgctgtgacctcttccagaagaaggactatgtgaggacctgcatcatgaacaacggggtgggctaccggggcaccatggccaccaccgtgggcggcctgccctgccaggcctggagccacaagttccccaatgaccacaagtacacccccaccctgagaaatggcctggaggagaacttctgcaggaacccagatggagaccccggcggcccctggtgctacaccacagatcctgctgtgcgcttccagagctgtggcatcaagagctgccgggaggccgcctgtgtgtggtgcaatggagaggagtacagaggagctgtggacagaacagagagcggccgggagtgccagcgctgggacctgcagcacccccaccagcacccctttgagcccgggaagttcctggaccagggcctggatgacaactactgcagaaatccagatggcagcgagcggccctggtgctacaccacagacccccagatcgagcgggagttctgtgacctgccccgctgtggcagcgaggcccagccccggcaggaggccaccaccgtgtcctgcttccggggcaaaggagagggctaccggggcacagccaacaccaccacagctggggtgccctgccagcgctgggatgcccagatcccccaccagcaccgcttcaccccagagaagtatgcctgcaaggacctgcgggagaacttctgcagaaatccagatggcagcgaggccccctggtgcttcaccctgcggcccggcatgagagctgccttctgctaccagatccgccgctgcacagatgatgtgcggccccaggactgctaccacggggccggggagcagtaccggggcaccgtgtccaagaccaggaaaggagtgcagtgccagcgctggagcgctgagaccccccacaagccccagttcaccttcaccagcgagccccacgcccagctggaggagaacttctgcaggaacccagatggagacagccacggcccctggtgctacaccatggaccccaggaccccatttgactactgtgccctgcggcgctgtgctgatgaccagcccccatccatcctggaccccccagaccaggtgcagtttgagaagtgtgggaagagggtggaccggctggaccagaggaggagcaagctgcgggtggtgggcggccaccctggcaacagcccctggacagtgtccctgaggaaccggcagggccagcacttctgtggcggcagcctggtgaaggagcagtggatcctgacagcccggcagtgcttcagcagctgccacatgcccctgaccggctatgaggtgtggctgggcaccctcttccagaacccccagcacggggagcccagcctgcagagggtgcctgtggccaagatggtgtgtggccccagcggcagccagctggtgctgctgaagctggagaggtctgtgaccctgaaccagagggtggccctgatctgcctgcccccagagtggtacgtggtgcccccaggcaccaagtgtgaaattgctggctggggcgagaccaagggcactggaaatgacacagtgctgaatgtggccctgctgaatgtcatcagcaaccaggagtgcaacatcaagcaccggggccgggtgcgggagagcgagatgtgcacagagggcctgctggcccctgtgggcgcctgtgagggggactatggaggccccctggcctgcttcacccacaactgctgggtgctggagggcatcatcatccccaacagagtgtgtgcccggagccgctggccagctgtgttcaccagggtgtctgtgtttgtggactggatccacaaggtgatgaggctgggctag

SEQ ID NO: 3594 - DNA, 495 bp, Artificial Sequence
  Description of Artificial Sequence: Synthetic coding sequence
atgggctggctgcccctgctgctgctgctgacccagtgcctgggcgtgcccggccagaggagccccctgaatgacttccaggtgctgcggggcacagagctgcagcacctgctgcatgctgtggtgcccggcccctggcaggaggatgtggctgatgctgaagaatgtgccggccgctgtggccccctgatggactgccgggccttccactacaacgtgagcagccacggctgccagctgctgccctggacccagcacagcccccacacccggctgcggcgcagcggccgctgtgacctcttccagaagaagggcacccggcccctgagcggcatggcctggaagaggaccagcgctgtgaccctgatggccaccccagaggtgctgggcgccacccagcagaccctgctgtgtgccagcagagctgctgccagcaacccagctggccggccccgggtgtctggggccatggccaggaacacagctgccaggtag

SEQ ID NO: 3595 - DNA, 2070 bp, Artificial Sequence
  Description of Artificial Sequence: Synthetic coding sequence
atggccccagcccctgtgaccctgctggcccctggagctgccagctccatgagctgcagccagcccggccagaggagccccagcaatgacttccaggtgctgcggggcacagagctgcagcacctgctgcatgctgtggtgcccggcccctggcaggaggatgtggctgatgctgaggagtgtgccggccgctgtggccccctgatggactgctgggccttccactacaacgtgagcagccacggctgccagctgctgccctggacccagcacagcccccacagccggctgtggcacagcggccgctgtgacctcttccaggagaagggggagtggggctacatgcccaccctgagaaatggcctggaggagaacttctgcaggaacccagatggagaccccggcggcccctggtgccacaccacagatcctgctgtgcgcttccagagctgcagcatcaagagctgccgggtggccgcctgtgtgtggtgcaatggagaggagtacagaggagctgtggacagaacagagagcggccgggagtgccagcgctgggacctgcagcacccccaccagcacccctttgagcccgggaagttcctggaccagggcctggatgacaactactgcagaaatccagatggcagcgagcggccctggtgctacaccacagacccccagatcgagcgggagttctgtgacctgccccgctgtggcagcgaggcccagccccggcaggaggccacctctgtgtcctgcttccggggcaaaggagagggctaccggggcacagccaacaccaccacagctgcctacctggcctctgtgggcaccaggaagagccacatcagcacagacctgcggcagaagaacacccgggccagcgaggtgggcggcggggccggcgtgggcacctgctgctgcggggacctgcgggagaacttctgctggaacctggatggcagcgaggccccctggtgcttcaccctgcggcccggcaccagggtgggcttctgctaccagatccgccgctgcacagatgatgtgcggccccaggactgctaccacggggccggggagcagtaccggggcaccgtgtccaagaccaggaaaggagtgcagtgccagcgctggagcgctgagaccccccacaagctgcaggccctgaccctgggcagacatgccctgatgagcggcacccgggcctggaagtggctgcggctgccctgccacgactttgccccagccccagcctctgtgcacatctacctgaggacagcctgcaccaccggcggggagctgctgcctgaccctgatggagacagccacggcccctggtgctacaccatggaccccaggaccccatttgactactgtgccctgcggcgctgtgaccaggtgcagtttgagaagtgtgggaagagggtggaccggctggaccagaggaggagcaagctgcgggtggccggcggccaccctggcaacagcccctggacagtgtccctgaggaacagacacatgcccctgaccggctatgaggtgtggctgggcaccctcttccagaacccccagcacggggagcccggcctgcagagggtgcctgtggccaagatgctgtgtggccccagcggcagccagctggtgctgctgaagctggagaggtctgtgaccctgaaccagagggtggccctgatctgcctgcccccagagtggtacgtggtgcccccaggcaccaagtgtgaaattgctggctggggcgagaccaagggcactggaaatgacacagtgctgaatgtggccctgctgaatgtcatcagcaaccaggagtgcaacatcaagcaccggggccacgtgcgggagagcgagatgtgcacagagggcctgctggcccctgtgggcgcctgtgagggggactatggaggccccctggcctgcttcacccacaactgctgggtgctgaagggcatccgcatccccaacagagtgtgcaccaggagccgctggccagctgtgttcaccagggtgtctgtgtttgtggactggatccacaaggtgatgaggctgggctag

SEQ ID NO: 3596 - DNA, 1698 bp, Artificial Sequence
  Description of Artificial Sequence: Synthetic coding sequence
atgaccagccgctgcagcggggcccagagctacctgctgcatgctgtggtgcccggcccctggcaggaggatgtggctgatgctgaggagtgtgccggccgctgtggccccctgatggactgctgggccttccactacaacgtgagcagccacggctgccagctgctgccctggacccagcacagcccccacagccggctgtggcacagcggccgctgtgacctcttccaggagaaggactacatccgcacctgcatcatgaacaatggagtgggctaccggggcaccatggccaccaccgtgggcggcctgagctgccaggcctggagccacaagttccccaatgaccacaagtacatgcccaccctgagaaatggcctggaggagaacttctgcagaaatccagatggagaccccggcggcccctggtgccacaccacagatcctgctgtgcgcttccagagctgcagcatcaagagctgccgggtggccgcctgtgtgtggtgcaatggagaggagtacagaggagctgtggacagaacagaaagtggccgggagtgccagcgctgggacctgcagcacccccaccagcacccctttgagcccgggaagttcctggaccagggcctggatgacaactactgcaggaacccagatggcagcgagcggccctggtgctacaccacagacccccagatcgagcgggagttctgtgacctgccccgctgtggcagcgaggcccagccccggcaggaggccacctctgtgtcctgcttccggggcaagggggagggctaccggggcacagccaacaccaccaccggggtgccctgccagcgctgggatgcccagatcccccaccagcaccgcttcaccccagagaagtatgcctgcaaggacctgcgggagaacttctgctggaacctggatggcagcgaggccccctggtgcttcaccctgcggcccggcaccagggtgggcttctgctaccagatccgccgctgcacagatgatgtgcggccccaggactgctaccacggggccggggagcagtaccggggcaccgtgtccaagaccaggaaaggagtgcagtgccagcgctggagcgctgagaccccccacaagctgcagttcaccttcaccagcgagccccacgcccagctggaggagaacttctgccagccagatggagacagccacggcccctggtgctacaccatggaccccaggaccccatttgactactgtgccctgcggcgctgtgctgatgaccagccccccagcatcctggacccccccaaccaggtgcagtttgagaagtgtgggaagagggtggaccggctggaccagaggaggagcaagctgcgggtggccggcggccaccctggcaacagcccctggacagtgtccctgaggaaccggcagggccagcacttctgtgccggcagcctggtgaaggagcagtggatcctgacagcccggcagtgcttcagcagctgccacatgcccctgaccggctatgaggtgtggctgggcaccctcttccagaacccccagcacggggagcccggcctgcagagggtgcctgtggccaagatgctgtgtggccccagcggcagccagctggtgctgctgaagctggagaggtctgtgaccctgaaccagagggtggccctgatctgcctgcccccagagtag

SEQ ID NO: 3597 - DNA, 2148 bp, Artificial Sequence
  Description of Artificial Sequence: Synthetic coding sequence
atggccccagcccctgtgaccctgctggcccctggagctgccagctccatgagctgcagccagcccggccagaggagccccagcaatgacttccaggtgctgcggggcacagagctgcagcacctgctgcatgctgtggtgcccggcccctggcaggaggatgtggctgatgctgaggagtgtgccggccgctgtggccccctgatggactgctgggccttccactacaacgtgagcagccacggctgccagctgctgccctggacccagcacagcccccacagccggctgtggcacagcggccgctgtgacctcttccaggagaagggggagtggggctacatgcccaccctgagaaatggcctggaggagaacttctgcaggaacccagatggagaccccggcggcccctggtgccacaccacagatcctgctgtgcgcttccagagctgcagcatcaagagctgccgggtggccgcctgtgtgtggtgcaatggagaggagtacagaggagctgtggacagaacagagagcggccgggagtgccagcgctgggacctgcagcacccccaccagcacccctttgagcccgggaagttcctggaccagggcctggatgacaactactgcagaaatccagatggcagcgagcggccctggtgctacaccacagacccccagatcgagcgggagttctgtgacctgccccgctgtggcagcgaggcccagccccggcaggaggccacctctgtgtcctgcttccggggcaaaggagagggctaccggggcacagccaacaccaccacagctgcctacctggcctctgtgggcaccaggaagagccacatcagcacagacctgcggcagaagaacacccgggccagcgaggtgggcggcggggccggcgtgggcacctgctgctgcggggacctgcgggagaacttctgctggaacctggatggcagcgaggccccctggtgcttcaccctgcggcccggcaccagggtgggcttctgctaccagatccgccgctgcacagatgatgtgcggccccaggactgctaccacggggccggggagcagtaccggggcaccgtgtccaagaccaggaaaggagtgcagtgccagcgctggagcgctgagaccccccacaagctgcaggccctgaccctgggcagacatgccctgatgagcggcacccgggcctggaagtggctgcggctgccctgccacgactttgccccagccccagcctctgtgcacatctacctgaggacagcctgcaccaccggcggggagctgctgcctgaccctgatggagacagccacggcccctggtgctacaccatggaccccaggaccccatttgactactgtgccctgcggcgctgtgaccaggtgcagtttgagaagtgtgggaagagggtggaccggctggaccagaggaggagcaagctgcgggtggccggcggccaccctggcaacagcccctggacagtgtccctgaggaaccggcagggccagcacttctgtgccggcagcctggtgaaggagcagtggatcctgacagcccggcagtgcttcagcagctgccacatgcccctgaccggctatgaggtgtggctgggcaccctcttccagaacccccagcacggggagcccggcctgcagagggtgcctgtggccaagatgctgtgtggccccagcggcagccagctggtgctgctgaagctggagaggtctgtgaccctgaaccagagggtggccctgatctgcctgcccccagagtggtacgtggtgcccccaggcaccaagtgtgaaattgctggctggggcgagaccaagggcactggaaatgacacagtgctgaatgtggccctgctgaatgtcatcagcaaccaggagtgcaacatcaagcaccggggccacgtgcgggagagcgagatgtgcacagagggcctgctggcccctgtgggcgcctgtgagggggactatggaggccccctggcctgcttcacccacaactgctgggtgctgaagggcatccgcatccccaacagagtgtgcaccaggagccgctggccagctgtgttcaccagggtgtctgtgtttgtggactggatccacaaggtgatgaggctgggctag

SEQ ID NO: 3598 - DNA, 1101 bp, Artificial Sequence
  Description of Artificial Sequence: Synthetic coding sequence
atgagggtgatggccccccgggccctgctgctgctgctgagcggcggcctggccctgacagagacctgggcctgcagccacagcatgagatactttgacacagctgtgtccaggcctggccgcggggagccccgcttcatctctgtgggctacgtggatgacacccagtttgtgcgctttgacagtgatgctgccagccccagaggagagccccgggccccctgggtggagcaggagggccctgagtactgggaccgggagacccagaagtacaagaggcaggcccaggccgacagagtgtccctgaggaacctgcggggctactacaaccagagtgaagatggcagccacaccctgcagaggatgagcggctgtgacctgggcccagatggccgcctgctgcggggctatgaccagagcgcctatgatggcaaggactacatcgccctgaatgaagacctgcgctcctggacagctgctgacacagctgcccagatcacccagaggaagctggaggccgcccgggctgctgagcagctgcgggcctacctggagggcacctgtgtggagtggctgcggcgctacctggagaatggcaaggagaccctgcagagagctgagccccccaagacccacgtgacccaccaccccctgagtgaccacgaggccaccctgcgctgctgggccctgggcttctacccagctgagatcaccctgacctggcagagagatggagaggaccagacccaggacacagagctggtggagaccaggcctgctggagatggcaccttccagaagtgggccgctgtggtggtgcccagcggccaggagcagcgctacacctgccacatgcagcacgagggcctgcaggagcccctgaccctgtcctgggagcccagcagccagcccaccatccccatcatgggcatcgtggccggcctggccgtgctggtggtgctggccgtgctgggcgctgtggtgacagccatgatgtgcaggaggaagagcagcggcggcaaaggaggcagctgcagccaggccgcctgcagcaacagcgcccagggcagtgatgagagcctcatcacctgcaaggcctag

SEQ ID NO: 3599 - DNA, 396 bp, Artificial Sequence
  Description of Artificial Sequence: Synthetic coding sequence
atgagggtgatggccccccgggccctgctgctgctgctgagcggcggcctggccctgacagagacctgggcctgcagccacagcatgagatactttgacacagctgtgtccaggcctggccgcggggagccccgcttcatctctgtgggctacgtggatgacacccagtttgtgcgctttgacagtgatgctgccagccccagaggagagccccgggccccctgggtggagcaggagggccctgagtactgggaccgggagacccagaagtacaagaggcaggcccaggccgacagagtgtccctgaggaacctgcggggctactacaaccagagtgaagatgaagatgtgtggctgcggcctggggcccggcgggcccccccaccccgggtgtag

SEQ ID NO: 3600 - DNA, 1119 bp, Artificial Sequence
  Description of Artificial Sequence: Synthetic coding sequence
atgagggtgatggcccccaggaccctcatcctgctgctgagcggggccctggccctgacagagacctgggcctgcagccacagcatgagatacttctacacagctgtgtccaggcctggccgcggggagccccgcttcatcgctgtgggctacgtggatgacacccagtttgtgcagtttgacagtgatgctgccagccccagaggagagccccgggccccctgggtggagcaggagggccctgagtactgggaccgggagacccagaagtacaagaggcaggcccagacagacagagtgaacctgaggaagctgcggggctactacaaccagagcgaggccggcagccacaccctgcagaggatgtatggctgtgacctgggcccagatggccgcctgctgcggggctacaaccagtttgcctatgatggcaaggactacatcgccctgaatgaagacctgcgctcctggacagctgctgacaaggccgcccagatcacccagaggaagtgggaggccgcccgggaggccgagcagaggcgggcctacctggagggcacctgtgtggagtggctgcggcgctacctggagaatggcaagaagaccctgcagagagctgagcaccccaagacccacgtgacccaccaccctgtgtctgaccacgaggccaccctgcgctgctgggccctgggcttctacccagctgagatcaccctgacctggcagagagatggagaggaccagacccaggacacagagctggtggagaccaggcctgctggagatggcaccttccagaagtgggccgctgtggtggtgcccagcggggaggagcagcgctacacctgccacgtgcagcacgagggcctgcctgagcccctgaccctgcgctggggccccagcagccagcccaccatccccatcgtgggcatcgtggccggcctggccgtgctggccgtgctggccgtgctgggcgctgtgatggctgtggtgatgtgcaggaggaagagcagcggccacttcctgcccaccggcggcaaaggaggcagctgcagccaggccgccagcagcaacagcgcccagggcagtgatgagagcctcatcgcctgcaaggcctag

SEQ ID NO: 3601 - DNA, 1119 bp, Artificial Sequence
  Description of Artificial Sequence: Synthetic coding sequence
atgagggtgatggccccccgggccctgctgctgctgctgagcggcggcctggccctgacagagacctgggcctgcagccacagcatgagatactttgacacagctgtgtccaggcctggccgcggggagccccgcttcatctctgtgggctacgtggatgacacccagtttgtgcgctttgacagtgatgctgccagccccagaggagagccccgggccccctgggtggagcaggagggccctgagtactgggaccgggagacccagaagtacaagaggcaggcccaggccgacagagtgtccctgaggaacctgcggggctactacaaccagagtgaagatggcagccacaccctgcagaggatgagcggctgtgacctgggcccagatggccgcctgctgcggggctatgaccagagcgcctatgatggcaaggactacatcgccctgaatgaagacctgcgctcctggacagctgctgacacagctgcccagatcacccagaggaagctggaggccgcccgggctgctgagcagctgcgggcctacctggagggcacctgtgtggagtggctgcggcgctacctggagaatggcaaggagaccctgcagagagctgagccccccaagacccacgtgacccaccaccccctgagtgaccacgaggccaccctgcgctgctgggccctgggcttctacccagctgagatcaccctgacctggcagagagatggagaggaccagacccaggacacagagctggtggagaccaggcctgctggagatggcaccttccagaagtgggccgctgtggtggtgcccagcggccaggagcagcgctacacctgccacatgcagcacgagggcctgcaggagcccctgaccctgtcctgggagcccagcagccagcccaccatccccatcatgggcatcgtggccggcctggccgtgctggtggtgctggccgtgctgggcgctgtggtgacagccatgatgtgcaggaggaagagcagcggccacttcctgcccaccggcggcaaaggaggcagctgcagccaggccgcctgcagcaacagcgcccagggcagtgatgagagcctcatcacctgcaaggcctag

SEQ ID NO: 3602 - DNA, 1194 bp, Artificial Sequence
  Description of Artificial Sequence: Synthetic coding sequence
atgagggtgatggcccccaggaccctcatcctgctgctgagcggggccctggccctgacagagacctgggcctgcagccacagcatgagatacttctacacagctgtgtccaggcctggccgcggggagccccgcttcatcgctgtgggctacgtggatgacacccagtttgtgcagtttgacagtgatgctgccagccccagaggagagccccgggccccctgggtggagcaggagggccctgagtactgggaccgggagacccagaagtacaagaggcaggcccagacagacagagtgaacctgaggaagctgcggggctactacaaccagagcgaggccggcagccacaccctgcagaggatgtatggctgtgacctgggcccagatggccgcctgctgcggggctacaaccagtttgcctatgatggcaaggactacatcgccctgaatgaagacctgcgctcctggacagctgctgacaaggccgcccagatcacccagaggaagtgggaggccgcccgggaggccgagcagaggcgggcctacctggagggcacctgtgtggagtggctgcggcgctacctggagaatggcaagaagaccctgcagagagctgagcaccccaagacccacgtgacccaccaccctgtgtctgaccacgaggccaccctgcgctgctgggccctgggcttctacccagctgagatcaccctgacctggcagagagatggagaggaccagacccaggacacagagctggtggagaccaggcctgctggagatggcaccttccagaagtgggccgctgtggtggtgcccagcggggaggagcagcgctacacctgccacgtgcagcacgagggcctgcctgagcccctgaccctgcgctggggccccagcagccagcccaccatccccatcgtgggcatcgtggccggcctggccgtgctggccgtgctggccgtgctgggcgctgtgatggctgtggtgatgtgcaggaggaagagcagcggccgggagggcgtgcgctctggagtgtggccagccaccgtgccccgggccctgatgagcctgagcagcctggtgaagccagagacagctgcctgtgtgggcctgcgctgccgcatcagcagccacctgagctttgtgaccagccgggccagcggcatctccttctgcaagggcatctag

SEQ ID NO: 3603 - DNA, 1119 bp, Artificial Sequence; identical to SEQ ID NO: 3600
  Description of Artificial Sequence: Synthetic coding sequence

SEQ ID NO: 3604 - DNA, 1194 bp, Artificial Sequence
  Description of Artificial Sequence: Synthetic coding sequence
atgagggtgatggccccccgggccctgctgctgctgctgagcggcggcctggccctgacagagacctgggcctgcagccacagcatgagatactttgacacagctgtgtccaggcctggccgcggggagccccgcttcatctctgtgggctacgtggatgacacccagtttgtgcgctttgacagtgatgctgccagccccagaggagagccccgggccccctgggtggagcaggagggccctgagtactgggaccgggagacccagaagtacaagaggcaggcccaggccgacagagtgtccctgaggaacctgcggggctactacaaccagagtgaagatggcagccacaccctgcagaggatgagcggctgtgacctgggcccagatggccgcctgctgcggggctatgaccagagcgcctatgatggcaaggactacatcgccctgaatgaagacctgcgctcctggacagctgctgacacagctgcccagatcacccagaggaagctggaggccgcccgggctgctgagcagctgcgggcctacctggagggcacctgtgtggagtggctgcggcgctacctggagaatggcaaggagaccctgcagagagctgagccccccaagacccacgtgacccaccaccccctgagtgaccacgaggccaccctgcgctgctgggccctgggcttctacccagctgagatcaccctgacctggcagagagatggagaggaccagacccaggacacagagctggtggagaccaggcctgctggagatggcaccttccagaagtgggccgctgtggtggtgcccagcggccaggagcagcgctacacctgccacatgcagcacgagggcctgcaggagcccctgaccctgtcctgggagcccagcagccagcccaccatccccatcatgggcatcgtggccggcctggccgtgctggtggtgctggccgtgctgggcgctgtggtgacagccatgatgtgcaggaggaagagcagcggccgggagggcgtgaagtctggagtgtgggccgccaccgtgccccgggccctgatgagcctgagcagcctggtgaagccagagacagctgcctgtgtgggcctgcgctgccgcatcagcagccacctgagctttgtgaccagccgggccagcggcatctccttctgcaagggcacctag

SEQ ID NO: 3605 - DNA, 1101 bp, Artificial Sequence
  Description of Artificial Sequence: Synthetic coding sequence
atgagggtgatggcccccaggaccctcatcctgctgctgagcggggccctggccctgacagagacctgggcctgcagccacagcatgagatacttctacacagctgtgtccaggcctggccgcggggagccccgcttcatcgctgtgggctacgtggatgacacccagtttgtgcagtttgacagtgatgctgccagccccagaggagagccccgggccccctgggtggagcaggagggccctgagtactgggaccgggagacccagaagtacaagaggcaggcccagacagacagagtgaacctgaggaagctgcggggctactacaaccagagcgaggccggcagccacaccctgcagaggatgtatggctgtgacctgggcccagatggccgcctgctgcggggctacaaccagtttgcctatgatggcaaggactacatcgccctgaatgaagacctgcgctcctggacagctgctgacaaggccgcccagatcacccagaggaagtgggaggccgcccgggaggccgagcagaggcgggcctacctggagggcacctgtgtggagtggctgcggcgctacctggagaatggcaagaagaccctgcagagagctgagcaccccaagacccacgtgacccaccaccctgtgtctgaccacgaggccaccctgcgctgctgggccctgggcttctacccagctgagatcaccctgacctggcagagagatggagaggaccagacccaggacacagagctggtggagaccaggcctgctggagatggcaccttccagaagtgggccgctgtggtggtgcccagcggggaggagcagcgctacacctgccacgtgcagcacgagggcctgcctgagcccctgaccctgcgctggggccccagcagccagcccaccatccccatcgtgggcatcgtggccggcctggccgtgctggccgtgctggccgtgctgggcgctgtgatggctgtggtgatgtgcaggaggaagagcagcggcggcaaaggaggcagctgcagccaggccgccagcagcaacagcgcccagggcagtgatgagagcctcatcgcctgcaaggcctag

SEQ ID NO: 3606 - DNA, 1101 bp, Artificial Sequence; identical to SEQ ID NO: 3605
  Description of Artificial Sequence: Synthetic coding sequence

SEQ ID NO: 3607 - DNA, 1194 bp, Artificial Sequence; identical to SEQ ID NO: 3602
  Description of Artificial Sequence: Synthetic coding sequence

SEQ ID NO: 3608 - DNA, 1194 bp, Artificial Sequence
  Description of Artificial Sequence: Synthetic coding sequence
atgagggtgatggcccccaggaccctcatcctgctgctgagcggggccctggccctgacagagacctgggcctgcagccacagcatgagatacttctacacagctgtgtccaggcctggccgcggggagccccgcttcatcgctgtgggctacgtggatgacacccagtttgtgcgctttgacagtgatgctgccagccccagaggagagccccgggccccctgggtggagcaggagggccctgagtactgggaccgggagacccagaagtacaagaggcaggcccagacagacagagtgtccctgaggaacctgcggggctactacaaccagagcgaggccggcagccacaccctgcagtggatgtatggctgtgacctgggcccagatggccgcctgctgcggggctatgaccagagcgcctatgatggcaaggactacatcgccctgaatgaagacctgcgctcctggacagctgctgacacagctgcccagatcacccagaggaagtgggaggccgcccgggctgctgagcagcagagggcctacctggagggcacctgtgtggagtggctgcggcgctacctggagaatggcaaggagaccctgcagagagctgagcaccccaagacccacgtgacccaccacctggtgtctgaccacgaggccaccctgcgctgctgggccctgggcttctacccagctgagatcaccctgacctggcagagagatggagaggaccagacccaggacacagagctggtggagaccaggcctgctggagatggcaccttccagaagtgggccgctgtggtggtgcccagcggggaggagcagcgctacacctgccacgtgcagcacgagggcctgcctgagcccctgaccctgcgctgggagcccagcagccagcccaccatccccatcgtgggcatcgtggccggcctggccgtgctggccgtgctggccgtgctgggcgctgtggtggccgtggtgatgtgcaggaggaagagcagcggccgggagggcgtgcgctctggagtgtggccagccaccgtgccccgggccctgatgagcctgagcagcctggtgaagccagagacagctgcctgtgtgggcctgcgctgccgcatcagcagccacctgagctttgtgaccagccgggccagcggcatctccttctgcaagggcatctag

SEQ ID NO: 3609 - DNA, 786 bp, Artificial Sequence
  Description of Artificial Sequence: Synthetic coding sequence
tgaagagtgatggccccccgggccctgctgctgctgctgagcggcggcctggccctgacagagacctgggcctgcagccacagcatgagatactttgacacagctgtgtccaggcctggccgcggggagccccgcttcatctctgtgggctacgtggatgacacccagtttgtgcgctttgacagtgatgctgccagccccagaggagagccccgggccccctgggtggagcaggagggccctgagtactgggaccgggagacccagaagtacaagaggcaggcccaggccgacagagtgtccctgaggaacctgcggggctactacaaccagagtgaagatggcagccacaccctgcagaggatgagcggctgtgacctgggcccagatggccgcctgctgcggggctatgaccagagcgcctatgatggcaaggactacatcgccctgaatgaagacctgcgctcctggacagctgctgacacagctgcccagatcacccagaggaagctggaggccgcccgggctgctgagcagctgcgggcctacctggagggcacctgtgtggagtggctgcggcgctacctggagaatggcaaggagaccctgcagagagctgagccccccaagacccacgtgacccaccaccccctgagtgaccacgaggccagccgccgctggaacctgcctgaggtgggcagctgtggcggggccttctggaccagggctgagatccacgtgccctatgctgcccggggggccgcccgggccccccaccctgagtag

SEQ ID NO: 3610 - DNA, 1119 bp, Artificial Sequence
  Description of Artificial Sequence: Synthetic coding sequence
atgagggtgatggcccccaggaccctcatcctgctgctgagcggggccctggccctgacagagacctgggccggcagccacagcatgagatacttctacacagctgtgtccaggcctggccgcggggagccccacttcatcgctgtgggctacgtggatgacacccagtttgtgcgctttgacagtgatgctgccagccccagaggagagccccgggccccctgggtggagcaggagggccctgagtactgggaccgggagacccagaagtacaagaggcaggcccagacagacagagtgtccctgaggaacctgcggggctactacaaccagagcgaggccggcagccacatcatccagaggatgtatggctgtgatgtgggcccagatggccgcctgctgcggggctatgaccagtatgcctatgatggcaaggactacatcgccctgaatgaagacctgcgctcctggacagctgctgacacagctgcccagatcacccagaggaagtgggaggccgcccgggaggccgagcagctgcgggcctacctggagggcctgtgtgtggagtggctgcggcgctacctgaagaatggcaaggagaccctgcagagagctgagcaccccaagacccacgtgacccaccaccctgtgtctgaccacgaggccaccctgcgctgctgggccctgggcttctacccagctgagatcaccctgacctggcagtgggatggagaggaccagacccaggacacagagctggtggagaccaggcctgctggagatggcaccttccagaagtgggccgctgtggtggtgcccagcggggaggagcagcgctacacctgccacgtgcagcacgagggcctgcctgagcccctgaccctgcgctgggagcccagcagccagcccaccatccccatcgtgggcatcgtggccggcctggccgtgctggccgtgctggccgtgctgggcgctgtggtggccgtggtgatgtgcaggaggaagagcagcggccacttcctgcccaccggcggcaaaggaggcagctgcagccaggccgccagcagcaacagcgcccagggcagtgatgagagcctcatcgcctgcaaggcctag

SEQ ID NO: 3611 - DNA, 1020 bp, Artificial Sequence
  Description of Artificial Sequence: Synthetic coding sequence
atgagggtgatggcccccaggaccctcatcctgctgctgagcggggccctggccctgacagagacctgggcctgcagccacagcatgagatacttctacacagctgtgtccaggcctggccgcggggagccccgcttcatcgctgtgggctacgtggatgacacccagtttgtgcgctttgacagtgatgctgccagccccagaggagagccccgggccccctgggtggagcaggagggccctgagtactgggaccgggagacccagaagtacaagaggcaggcccagacagacagagtgtccctgaggaacctgcggggctactacaaccagagcgaggccggcagccacaccctgcagtggatgtatggctgtgacctgggcccagatggccgcctgctgcggggctatgaccagagcgcctatgatggcaaggactacatcgccctgaatgaagacctgcgctcctggacagctgctgacacagctgcccagatcacccagaggaagtgggaggccgcccgggctgctgagcagcagagggcctacctggagggcacctgtgtggagtggctgcggcgctacctggagaatggcaaggagaccctgcagagagctgagcaccccaagacccacgtgacccaccacctggtgtctgaccacgaggccaccctgcgctgctgggccctgggcttctacccagctgagatcaccctgacctggcagagagatggagaggaccagacccaggacacagagctggtggagaccaggcctgctggagatggcaccttccagaagtgggccgctgtggtggtgcccagcggggaggagcagcgctacacctgccacgtgcagcacgagggcctgcctgagcccctgaccctgcgctgggagcccagcagccagcccaccatccccatcgtgggcatcgtggccggcctggccgtgctggccgtgctggccgtgctgggcgctgtggtggccgtggtgatgtgcaggaggaagagcagcgcctag

SEQ ID NO: 3612 - DNA, 1101 bp, Artificial Sequence
  Description of Artificial Sequence: Synthetic coding sequence
atgagggtgatggcccccaggaccctcatcctgctgctgagcggggccctggccctgacagagacctgggcctgcagccacagcatgagatactttgacacagctgtgtccaggcctggccgcggggagccccgcttcatctctgtgggctacgtggatgacacccagtttgtgcgctttgacagtgatgctgccagccccagaggagagccccgggccccctgggtggagcaggagggccctgagtactgggaccgggagacccagaagtacaagaggcaggcccaggccgacagagtgaacctgaggaagctgcggggctactacaaccagagtgaagatggcagccacaccctgcagtggatgtatggctgtgacctgggcccagatggccgcctgctgcggggctatgaccagagcgcctatgatggcaaggactacatcgccctgaatgaagacctgcgctcctggacagctgctgacacagctgcccagatcacccagaggaagtgggaggccgcccgggaggccgagcagtggagggcctacctggagggcacctgtgtggagtggctgcggcgctacctggagaatggcaaggagaccctgcagagagctgagcaccccaagacccacgtgacccaccaccctgtgtctgaccacgaggccaccctgcgctgctgggccctgggcttctacccagctgagatcaccctgacctggcagagagatggagaggaccagacccaggacacagagctggtggagaccaggcctgctggagatggcaccttccagaagtgggccgctgtggtggtgcccagcggggaggagcagcgctacacctgccacgtgcagcacgagggcctgcctgagcccctgaccctgcgctgggagcccagcagccagcccaccatccccatcgtgggcatcgtggccggcctggccgtgctggccgtgctggccgtgctgggcgctgtgatggctgtggtgatgtgcaggaggaagagcagcggcggcaaaggaggcagctgcagccaggccgccagcagcaacagcgcccagggcagtgatgagagcctcatcgcctgcaaggcctag

SEQ ID NO: 3613 - DNA, 1107 bp, Artificial Sequence
  Description of Artificial Sequence: Synthetic coding sequence
atgagggtgatggccccccgggccctgctgctgctgctgagcggcggcctggccctgacagagacctgggcctgcagccacagcatgagatactttgacacagctgtgtccaggcctggccgcggggagccccgcttcatctctgtgggctacgtggatgacacccagtttgtgcgctttgacagtgatgctgccagccccagaggagagccccgggccccctgggtggagcaggagggccctgagtactgggaccgggagacccagaactacaagaggcaggcccaggccgacagagtgtccctgaggaacctgcggggctactacaaccagagtgaagatggcagccacaccctgcagaggatgtatggctgtgacctgggcccagatggccgcctgctgcggggctatgaccagagcgcctatgatggcaaggactacatcgccctgaatgaagacctgcgctcctggacagctgctgacacagctgcccagatcacccagaggaagctggaggccgcccgggctgctgagcagctgcgggcctacctggagggcacctgtgtggagtggctgcggcgctacctggagaatggcaaggagaccctgcagagagctgagccccccaagacccacgtgacccaccaccccctgagtgaccacgaggccaccctgcgctgctgggccctgggcttctacccagctgagatcaccctgacctggcagagagatggagaggaccagacccaggacacagagctggtggagaccaggcctgctggagatggcaccttccagaagtgggccgctgtggtggtgcccagcggccaggagcagcgctacacctgccacatgcagcacgagggcctgcaggagcccctgaccctgtcctgggagcccagcagccagcccaccatccccatcatgggcatcgtggccggcctggccgtgctggtggtgctggccgtgctgggcgctgtggtgacagccatgatgtgcaggaggaagagcagcgctgcctgtgtgggcctgcgctgccgcatcagcagccacctgagctttgtgaccagccgggccagcggcatctccttctgcaagggcgtgtag

SEQ ID NO: 3614 - DNA, 1194 bp, Artificial Sequence
  Description of Artificial Sequence: Synthetic coding sequence
atgagggtgatggcccccaggaccctcatcctgctgctgagcggggccctggccctgacagagacctgggcctgcagccacagcatgagatactttgacacagctgtgtccaggcctggccgcggggagccccgcttcatctctgtgggctacgtggatgacacccagtttgtgcgctttgacagtgatgctgccagccccagaggagagccccgggccccctgggtggagcaggagggccctgagtactgggaccgggagacccagaagtacaagaggcaggcccaggccgacagagtgaacctgaggaagctgcggggctactacaaccagagtgaagatggcagccacaccctgcagtggatgtatggctgtgacctgggcccagatggccgcctgctgcggggctatgaccagagcgcctatgatggcaaggactacatcgccctgaatgaagacctgcgctcctggacagctgctgacacagctgcccagatcacccagaggaagtgggaggccgcccgggaggccgagcagtggagggcctacctggagggcacctgtgtggagtggctgcggcgctacctggagaatggcaaggagaccctgcagagagctgagcaccccaagacccacgtgacccaccaccctgtgtctgaccacgaggccaccctgcgctgctgggccctgggcttctacccagctgagatcaccctgacctggcagagagatggagaggaccagacccaggacacagagctggtggagaccaggcctgctggagatggcaccttccagaagtgggccgctgtggtggtgcccagcggggaggagcagcgctacacctgccacgtgcagcacgagggcctgcctgagcccctgaccctgcgctgggagcccagcagccagcccaccatccccatcgtgggcatcgtggccggcctggccgtgctggccgtgctggccgtgctgggcgctgtgatggctgtggtgatgtgcaggaggaagagcagcggccgggagggcgtgcgctctggagtgtggccagccaccgtgccccgggccctgatgagcctgagcagcctggtgaagccagagacagctgcctgtgtgggcctgcgctgccgcatcagcagccacctgagctttgtgaccagccgggccagcggcatctccttctgcaagggcatctag

SEQ ID NO: 3615 - DNA, 1119 bp, Artificial Sequence
  Description of Artificial Sequence: Synthetic coding sequence
atgagggtgatggccccccgggccctgctgctgctgctgagcggcggcctggccctgacagagacctgggcctgcagccacagcatgagatactttgacacagctgtgtccaggcctggccgcggggagccccgcttcatctctgtgggctacgtggatgacacccagtttgtgcgctttgacagtgatgctgccagccccagaggagagccccgggccccctgggtggagcaggagggccctgagtactgggaccgggagacccagaactacaagaggcaggcccaggccgacagagtgtccctgaggaacctgcggggctactacaaccagagtgaagatggcagccacaccctgcagaggatgtatggctgtgacctgggcccagatggccgcctgctgcggggctatgaccagagcgcctatgatggcaaggactacatcgccctgaatgaagacctgcgctcctggacagctgctgacacagctgcccagatcacccagaggaagctggaggccgcccgggctgctgagcagctgcgggcctacctggagggcacctgtgtggagtggctgcggcgctacctggagaatggcaaggagaccctgcagagagctgagccccccaagacccacgtgacccaccaccccctgagtgaccacgaggccaccctgcgctgctgggccctgggcttctacccagctgagatcaccctgacctggcagagagatggagaggaccagacccaggacacagagctggtggagaccaggcctgctggagatggcaccttccagaagtgggccgctgtggtggtgcccagcggccaggagcagcgctacacctgccacatgcagcacgagggcctgcaggagcccctgaccctgtcctgggagcccagcagccagcccaccatccccatcatgggcatcgtggccggcctggccgtgctggtggtgctggccgtgctgggcgctgtggtgacagccatgatgtgcaggaggaagagcagcggccacttcctgcccaccggcggcaaaggaggcagctgcagccaggccgcctgcagcaacagcgcccagggcagtgatgagagcctcatcacctgcaaggcctag

SEQ ID NO: 3616 - DNA, 1101 bp, Artificial Sequence
  Description of Artificial Sequence: Synthetic coding sequence
atgagggtgatggccccccgggccctgctgctgctgctgagcggcggcctggccctgacagagacctgggcctgcagccacagcatgagatactttgacacagctgtgtccaggcctggccgcggggagccccgcttcatctctgtgggctacgtggatgacacccagtttgtgcgctttgacagtgatgctgccagccccagaggagagccccgggccccctgggtggagcaggagggccctgagtactgggaccgggagacccagaactacaagaggcaggcccaggccgacagagtgtccctgaggaacctgcggggctactacaaccagagtgaagatggcagccacaccctgcagaggatgtatggctgtgacctgggcccagatggccgcctgctgcggggctatgaccagagcgcctatgatggcaaggactacatcgccctgaatgaagacctgcgctcctggacagctgctgacacagctgcccagatcacccagaggaagctggaggccgcccgggctgctgagcagctgcgggcctacctggagggcacctgtgtggagtggctgcggcgctacctggagaatggcaaggagaccctgcagagagctgagccccccaagacccacgtgacccaccaccccctgagtgaccacgaggccaccctgcgctgctgggccctgggcttctacccagctgagatcaccctgacctggcagagagatggagaggaccagacccaggacacagagctggtggagaccaggcctgctggagatggcaccttccagaagtgggccgctgtggtggtgcccagcggccaggagcagcgctacacctgccacatgcagcacgagggcctgcaggagcccctgaccctgtcctgggagcccagcagccagcccaccatccccatcatgggcatcgtggccggcctggccgtgctggtggtgctggccgtgctgggcgctgtggtgacagccatgatgtgcaggaggaagagcagcggcggcaaaggaggcagctgcagccaggccgcctgcagcaacagcgcccagggcagtgatgagagcctcatcacctgcaaggcctag

SEQ ID NO: 3617 - DNA, 1107 bp, Artificial Sequence
  Description of Artificial Sequence: Synthetic coding sequence
atgagggtgatggcccccaggaccctcatcctgctgctgagcggggccctggccctgacagagacctgggccggcagccacagcatgagatacttctacacagctgtgtccaggcctggccgcggggagccccacttcatcgctgtgggctacgtggatgacacccagtttgtgcgctttgacagtgatgctgccagccccagaggagagccccgggccccctgggtggagcaggagggccctgagtactgggaccgggagacccagaagtacaagaggcaggcccagacagacagagtgtccctgaggaacctgcggggctactacaaccagagcgaggccggcagccacatcatccagaggatgtatggctgtgatgtgggcccagatggccgcctgctgcggggctatgaccagtatgcctatgatggcaaggactacatcgccctgaatgaagacctgcgctcctggacagctgctgacacagctgcccagatcacccagaggaagtgggaggccgcccgggaggccgagcagctgcgggcctacctggagggcctgtgtgtggagtggctgcggcgctacctgaagaatggcaaggagaccctgcagagagctgagcaccccaagacccacgtgacccaccaccctgtgtctgaccacgaggccaccctgcgctgctgggccctgggcttctacccagctgagatcaccctgacctggcagtgggatggagaggaccagacccaggacacagagctggtggagaccaggcctgctggagatggcaccttccagaagtgggccgctgtggtggtgcccagcggggaggagcagcgctacacctgccacgtgcagcacgagggcctgcctgagcccctgaccctgcgctgggagcccagcagccagcccaccatccccatcgtgggcatcgtggccggcctggccgtgctggccgtgctggccgtgctgggcgctgtggtggccgtggtgatgtgcaggaggaagagcagcgctgcctgtgtgggcctgcgctgccgcatcagcagccacctgagctttgtgaccagccgggccagcggcatctccttctgcaagggcatctag

SEQ ID NO: 3618 - DNA, 1194 bp, Artificial Sequence
  Description of Artificial Sequence: Synthetic coding sequence
atgagggtgatggccccccgggccctgctgctgctgctgagcggcggcctggccctgacagagacctgggcctgcagccacagcatgagatactttgacacagctgtgtccaggcctggccgcggggagccccgcttcatctctgtgggctacgtggatgacacccagtttgtgcgctttgacagtgatgctgccagccccagaggagagccccgggccccctgggtggagcaggagggccctgagtactgggaccgggagacccagaactacaagaggcaggcccaggccgacagagtgtccctgaggaacctgcggggctactacaaccagagtgaagatggcagccacaccctgcagaggatgtatggctgtgacctgggcccagatggccgcctgctgcggggctatgaccagagcgcctatgatggcaaggactacatcgccctgaatgaagacctgcgctcctggacagctgctgacacagctgcccagatcacccagaggaagctggaggccgcccgggctgctgagcagctgcgggcctacctggagggcacctgtgtggagtggctgcggcgctacctggagaatggcaaggagaccctgcagagagctgagccccccaagacccacgtgacccaccaccccctgagtgaccacgaggccaccctgcgctgctgggccctgggcttctacccagctgagatcaccctgacctggcagagagatggagaggaccagacccaggacacagagctggtggagaccaggcctgctggagatggcaccttccagaagtgggccgctgtggtggtgcccagcggccaggagcagcgctacacctgccacatgcagcacgagggcctgcaggagcccctgaccctgtcctgggagcccagcagccagcccaccatccccatcatgggcatcgtggccggcctggccgtgctggtggtgctggccgtgctgggcgctgtggtgacagccatgatgtgcaggaggaagagcagcggccgggagggcgtgaagtctggagtgtgggccgccaccgtgccccgggccctgatgagcctgagcagcctggtgaagccagagacagctgcctgtgtgggcctgcgctgccgcatcagcagccacctgagctttgtgaccagccgggccagcggcatctccttctgcaagggcgtgtag

SEQ ID NO: 3619 - DNA, 1068 bp, Artificial Sequence
  Description of Artificial Sequence: Synthetic coding sequence
atgagggtgatggcccccaggaccctcatcctgctgctgagcggggccctggccctgacagagacctgggccggcagccacagcatgagatacttctacacagctgtgtccaggcctggccgcggggagccccacttcatcgctgtgggctacgtggatgacacccagtttgtgcgctttgacagtgatgctgccagccccagaggagagccccgggccccctgggtggagcaggagggccctgagtactgggaccgggagacccagaagtacaagaggcaggcccagacagacagagtgtccctgaggaacctgcggggctactacaaccagagcgaggccggcagccacatcatccagaggatgtatggctgtgatgtgggcccagatggccgcctgctgcggggctatgaccagtatgcctatgatggcaaggactacatcgccctgaatgaagacctgcgctcctggacagctgctgacacagctgcccagatcacccagaggaagtgggaggccgcccgggaggccgagcagctgcgggcctacctggagggcctgtgtgtggagtggctgcggcgctacctgaagaatggcaaggagaccctgcagagagctgagcaccccaagacccacgtgacccaccaccctgtgtctgaccacgaggccaccctgcgctgctgggccctgggcttctacccagctgagatcaccctgacctggcagtgggatggagaggaccagacccaggacacagagctggtggagaccaggcctgctggagatggcaccttccagaagtgggccgctgtggtggtgcccagcggggaggagcagcgctacacctgccacgtgcagcacgagggcctgcctgagcccctgaccctgcgctgggagcccagcagccagcccaccatccccatcgtgggcatcgtggccggcctggccgtgctggccgtgctggccgtgctgggcgctgtggtggccgtggtgatgtgcaggaggaagagcagcgccagcaacagcgcccagggcagtgatgagagcctgattgcctgcaaggcctag

SEQ ID NO: 3620 - DNA, 1107 bp, Artificial Sequence
  Description of Artificial Sequence: Synthetic coding sequence
atgagggtgatggcccccaggaccctcatcctgctgctgagcggggccctggccctgacagagacctgggcctgcagccacagcatgagatacttctacacagctgtgtccaggcctggccgcggggagccccgcttcatcgctgtgggctacgtggatgacacccagtttgtgcagtttgacagtgatgctgccagccccagaggagagccccgggccccctgggtggagcaggagggccctgagtactgggaccgggagacccagaagtacaagaggcaggcccagacagacagagtgaacctgaggaagctgcggggctactacaaccagagcgaggccggcagccacaccctgcagaggatgtatggctgtgacctgggcccagatggccgcctgctgcggggctacaaccagtttgcctatgatggcaaggactacatcgccctgaatgaagacctgcgctcctggacagctgctgacaaggccgcccagatcacccagaggaagtgggaggccgcccgggaggccgagcagaggcgggcctacctggagggcacctgtgtggagtggctgcggcgctacctggagaatggcaagaagaccctgcagagagctgagcaccccaagacccacgtgacccaccaccctgtgtctgaccacgaggccaccctgcgctgctgggccctgggcttctacccagctgagatcaccctgacctggcagagagatggagaggaccagacccaggacacagagctggtggagaccaggcctgctggagatggcaccttccagaagtgggccgctgtggtggtgcccagcggggaggagcagcgctacacctgccacgtgcagcacgagggcctgcctgagcccctgaccctgcgctggggccccagcagccagcccaccatccccatcgtgggcatcgtggccggcctggccgtgctggccgtgctggccgtgctgggcgctgtgatggctgtggtgatgtgcaggaggaagagcagcgctgcctgtgtgggcctgcgctgccgcatcagcagccacctgagctttgtgaccagccgggccagcggcatctccttctgcaagggcatctag

SEQ ID NO: 3621 - DNA, 786 bp, Artificial Sequence
  Description of Artificial Sequence: Synthetic coding sequence
tgaagagtgatggcccccaggaccctcatcctgctgctgagcggggccctggccctgacagagacctgggcctgcagccacagcatgagatacttctacacagctgtgtccaggcctggccgcggggagccccgcttcatcgctgtgggctacgtggatgacacccagtttgtgcgctttgacagtgatgctgccagccccagaggagagccccgggccccctgggtggagcaggagggccctgagtactgggaccgggagacccagaagtacaagaggcaggcccagacagacagagtgtccctgaggaacctgcggggctactacaaccagagcgaggccggcagccacaccctgcagtggatgtatggctgtgacctgggcccagatggccgcctgctgcggggctatgaccagagcgcctatgatggcaaggactacatcgccctgaatgaagacctgcgctcctggacagctgctgacacagctgcccagatcacccagaggaagtgggaggccgcccgggctgctgagcagcagagggcctacctggagggcacctgtgtggagtggctgcggcgctacctggagaatggcaaggagaccctgcagagagctgagcaccccaagacccacgtgacccaccacctggtgtctgaccacgaggccagccgccgctggaacctgcctgaggtgggcagctgtggcggggccttctggaggagagctgagatccacgtgccctgtgccgcccggggagctgctggggccccccaccctgagtag

SEQ ID NO: 3622 - DNA, 1101 bp, Artificial Sequence
  Description of Artificial Sequence: Synthetic coding sequence
atgagggtgatggcccccaggaccctcatcctgctgctgagcggggccctggccctgacagagacctgggcctgcagccacagcatgagatacttctacacagctgtgtccaggcctggccgcggggagccccgcttcatcgctgtgggctacgtggatgacacccagtttgtgcgctttgacagtgatgctgccagccccagaggagagccccgggccccctgggtggagcaggagggccctgagtactgggaccgggagacccagaagtacaagaggcaggcccagacagacagagtgtccctgaggaacctgcggggctactacaaccagagcgaggccggcagccacaccctgcagtggatgtatggctgtgacctgggcccagatggccgcctgctgcggggctatgaccagagcgcctatgatggcaaggactacatcgccctgaatgaagacctgcgctcctggacagctgctgacacagctgcccagatcacccagaggaagtgggaggccgcccgggctgctgagcagcagagggcctacctggagggcacctgtgtggagtggctgcggcgctacctggagaatggcaaggagaccctgcagagagctgagcaccccaagacccacgtgacccaccacctggtgtctgaccacgaggccaccctgcgctgctgggccctgggcttctacccagctgagatcaccctgacctggcagagagatggagaggaccagacccaggacacagagctggtggagaccaggcctgctggagatggcaccttccagaagtgggccgctgtggtggtgcccagcggggaggagcagcgctacacctgccacgtgcagcacgagggcctgcctgagcccctgaccctgcgctgggagcccagcagccagcccaccatccccatcgtgggcatcgtggccggcctggccgtgctggccgtgctggccgtgctgggcgctgtggtggccgtggtgatgtgcaggaggaagagcagcggcggcaaaggaggcagctgcagccaggccgccagcagcaacagcgcccagggcagtgatgagagcctcatcgcctgcaaggcctag

SEQ ID NO: 3623 - DNA, 786 bp, Artificial Sequence
  Description of Artificial Sequence: Synthetic coding sequence
tgaagagtgatggcccccaggaccctcatcctgctgctgagcggggccctggccctgacagagacctgggccggcagccacagcatgagatacttctacacagctgtgtccaggcctggccgcggggagccccacttcatcgctgtgggctacgtggatgacacccagtttgtgcgctttgacagtgatgctgccagccccagaggagagccccgggccccctgggtggagcaggagggccctgagtactgggaccgggagacccagaagtacaagaggcaggcccagacagacagagtgtccctgaggaacctgcggggctactacaaccagagcgaggccggcagccacatcatccagaggatgtatggctgtgatgtgggcccagatggccgcctgctgcggggctatgaccagtatgcctatgatggcaaggactacatcgccctgaatgaagacctgcgctcctggacagctgctgacacagctgcccagatcacccagaggaagtgggaggccgcccgggaggccgagcagctgcgggcctacctggagggcctgtgtgtggagtggctgcggcgctacctgaagaatggcaaggagaccctgcagagagctgagcaccccaagacccacgtgacccaccaccctgtgtctgaccacgaggccagccgccgctggaacctgcctgaggtgggcagctgtggcggggccttctggaggagagctgagatccacgtgccctgtgccgcccggggagctgctggggccccccaccctgagtag

SEQ ID NO: 3624 - DNA, 786 bp, Artificial Sequence
  Description of Artificial Sequence: Synthetic coding sequence
tgaagagtgatggcccccaggaccctcatcctgctgctgagcggggccctggccctgacagagacctgggcctgcagccacagcatgagatacttctacacagctgtgtccaggcctggccgcggggagccccgcttcatcgctgtgggctacgtggatgacacccagtttgtgcagtttgacagtgatgctgccagccccagaggagagccccgggccccctgggtggagcaggagggccctgagtactgggaccgggagacccagaagtacaagaggcaggcccagacagacagagtgaacctgaggaagctgcggggctactacaaccagagcgaggccggcagccacaccctgcagaggatgtatggctgtgacctgggcccagatggccgcctgctgcggggctacaaccagtttgcctatgatggcaaggactacatcgccctgaatgaagacctgcgctcctggacagctgctgacaaggccgcccagatcacccagaggaagtgggaggccgcccgggaggccgagcagaggcgggcctacctggagggcacctgtgtggagtggctgcggcgctacctggagaatggcaagaagaccctgcagagagctgagcaccccaagacccacgtgacccaccaccctgtgtctgaccacgaggccagccgccgctggaacctgcctgaggtgggcagctgtggcggggccttctggaggagagctgagatccacgtgccctgtgccgcccggggggccgcccgggccccccaccctgagtag

SEQ ID NO: 3625 - DNA, 786 bp, Artificial Sequence; identical to SEQ ID NO: 3624
  Description of Artificial Sequence: Synthetic coding sequence

SEQ ID NO: 3626 - DNA, 1119 bp, Artificial Sequence
  Description of Artificial Sequence: Synthetic coding sequence
atgagggtgatggcccccaggaccctcatcctgctgctgagcggggccctggccctgacagagacctgggcctgcagccacagcatgagatacttctacacagctgtgtccaggcctggccgcggggagccccgcttcatcgctgtgggctacgtggatgacacccagtttgtgcgctttgacagtgatgctgccagccccagaggagagccccgggccccctgggtggagcaggagggccctgagtactgggaccgggagacccagaagtacaagaggcaggcccagacagacagagtgtccctgaggaacctgcggggctactacaaccagagcgaggccggcagccacaccctgcagtggatgtatggctgtgacctgggcccagatggccgcctgctgcggggctatgaccagagcgcctatgatggcaaggactacatcgccctgaatgaagacctgcgctcctggacagctgctgacacagctgcccagatcacccagaggaagtgggaggccgcccgggctgctgagcagcagagggcctacctggagggcacctgtgtggagtggctgcggcgctacctggagaatggcaaggagaccctgcagagagctgagcaccccaagacccacgtgacccaccacctggtgtctgaccacgaggccaccctgcgctgctgggccctgggcttctacccagctgagatcaccctgacctggcagagagatggagaggaccagacccaggacacagagctggtggagaccaggcctgctggagatggcaccttccagaagtgggccgctgtggtggtgcccagcggggaggagcagcgctacacctgccacgtgcagcacgagggcctgcctgagcccctgaccctgcgctgggagcccagcagccagcccaccatccccatcgtgggcatcgtggccggcctggccgtgctggccgtgctggccgtgctgggcgctgtggtggccgtggtgatgtgcaggaggaagagcagcggccacttcctgcccaccggcggcaaaggaggcagctgcagccaggccgccagcagcaacagcgcccagggcagtgatgagagcctcatcgcctgcaaggcctag

SEQ ID NO: 3627 - DNA, 786 bp, Artificial Sequence
  Description of Artificial Sequence: Synthetic coding sequence
tgaagagtgatggcccccaggaccctcatcctgctgctgagcggggccctggccctgacagagacctgggcctgcagccacagcatgagatactttgacacagctgtgtccaggcctggccgcggggagccccgcttcatctctgtgggctacgtggatgacacccagtttgtgcgctttgacagtgatgctgccagccccagaggagagccccgggccccctgggtggagcaggagggccctgagtactgggaccgggagacccagaagtacaagaggcaggcccaggccgacagagtgaacctgaggaagctgcggggctactacaaccagagtgaagatggcagccacaccctgcagtggatgtatggctgtgacctgggcccagatggccgcctgctgcggggctatgaccagagcgcctatgatggcaaggactacatcgccctgaatgaagacctgcgctcctggacagctgctgacacagctgcccagatcacccagaggaagtgggaggccgcccgggaggccgagcagtggagggcctacctggagggcacctgtgtggagtggctgcggcgctacctggagaatggcaaggagaccctgcagagagctgagcaccccaagacccacgtgacccaccaccctgtgtctgaccacgaggccagccgccgctggaacctgcctgaggtgggcagctgtggcggggccttctggaggagagctgagatccacgtgccctgtgccgcccggggggccgcccgggccccccaccctgagtag

SEQ ID NO: 3628 - DNA, 1107 bp, Artificial Sequence
  Description of Artificial Sequence: Synthetic coding sequence
atgagggtgatggcccccaggaccctcatcctgctgctgagcggggccctggccctgacagagacctgggcctgcagccacagcatgagatactttgacacagctgtgtccaggcctggccgcggggagccccgcttcatctctgtgggctacgtggatgacacccagtttgtgcgctttgacagtgatgctgccagccccagaggagagccccgggccccctgggtggagcaggagggccctgagtactgggaccgggagacccagaagtacaagaggcaggcccaggccgacagagtgaacctgaggaagctgcggggctactacaaccagagtgaagatggcagccacaccctgcagtggatgtatggctgtgacctgggcccagatggccgcctgctgcggggctatgaccagagcgcctatgatggcaaggactacatcgccctgaatgaagacctgcgctcctggacagctgctgacacagctgcccagatcacccagaggaagtgggaggccgcccgggaggccgagcagtggagggcctacctggagggcacctgtgtggagtggctgcggcgctacctggagaatggcaaggagaccctgcagagagctgagcaccccaagacccacgtgacccaccaccctgtgtctgaccacgaggccaccctgcgctgctgggccctgggcttctacccagctgagatcaccctgacctggcagagagatggagaggaccagacccaggacacagagctggtggagaccaggcctgctggagatggcaccttccagaagtgggccgctgtggtggtgcccagcggggaggagcagcgctacacctgccacgtgcagcacgagggcctgcctgagcccctgaccctgcgctgggagcccagcagccagcccaccatccccatcgtgggcatcgtggccggcctggccgtgctggccgtgctggccgtgctgggcgctgtgatggctgtggtgatgtgcaggaggaagagcagcgctgcctgtgtgggcctgcgctgccgcatcagcagccacctgagctttgtgaccagccgggccagcggcatctccttctgcaagggcatctag

SEQ ID NO: 3629 - DNA, 786 bp, Artificial Sequence
  Description of Artificial Sequence: Synthetic coding sequence
tgaagagtgatggccccccgggccctgctgctgctgctgagcggcggcctggccctgacagagacctgggcctgcagccacagcatgagatactttgacacagctgtgtccaggcctggccgcggggagccccgcttcatctctgtgggctacgtggatgacacccagtttgtgcgctttgacagtgatgctgccagccccagaggagagccccgggccccctgggtggagcaggagggccctgagtactgggaccgggagacccagaactacaagaggcaggcccaggccgacagagtgtccctgaggaacctgcggggctactacaaccagagtgaagatggcagccacaccctgcagaggatgtatggctgtgacctgggcccagatggccgcctgctgcggggctatgaccagagcgcctatgatggcaaggactacatcgccctgaatgaagacctgcgctcctggacagctgctgacacagctgcccagatcacccagaggaagctggaggccgcccgggctgctgagcagctgcgggcctacctggagggcacctgtgtggagtggctgcggcgctacctggagaatggcaaggagaccctgcagagagctgagccccccaagacccacgtgacccaccaccccctgagtgaccacgaggccagccgccgctggaacctgcctgaggtgggcagctgtggcggggccttctggaccagggctgagatccacgtgccctatgctgcccggggggccgcccgggccccccaccctgagtag

SEQ ID NO: 3630 - DNA, 1101 bp, Artificial Sequence
  Description of Artificial Sequence: Synthetic coding sequence
atgagggtgatggcccccaggaccctcatcctgctgctgagcggggccctggccctgacagagacctgggccggcagccacagcatgagatacttctacacagctgtgtccaggcctggccgcggggagccccacttcatcgctgtgggctacgtggatgacacccagtttgtgcgctttgacagtgatgctgccagccccagaggagagccccgggccccctgggtggagcaggagggccctgagtactgggaccgggagacccagaagtacaagaggcaggcccagacagacagagtgtccctgaggaacctgcggggctactacaaccagagcgaggccggcagccacatcatccagaggatgtatggctgtgatgtgggcccagatggccgcctgctgcggggctatgaccagtatgcctatgatggcaaggactacatcgccctgaatgaagacctgcgctcctggacagctgctgacacagctgcccagatcacccagaggaagtgggaggccgcccgggaggccgagcagctgcgggcctacctggagggcctgtgtgtggagtggctgcggcgctacctgaagaatggcaaggagaccctgcagagagctgagcaccccaagacccacgtgacccaccaccctgtgtctgaccacgaggccaccctgcgctgctgggccctgggcttctacccagctgagatcaccctgacctggcagtgggatggagaggaccagacccaggacacagagctggtggagaccaggcctgctggagatggcaccttccagaagtgggccgctgtggtggtgcccagcggggaggagcagcgctacacctgccacgtgcagcacgagggcctgcctgagcccctgaccctgcgctgggagcccagcagccagcccaccatccccatcgtgggcatcgtggccggcctggccgtgctggccgtgctggccgtgctgggcgctgtggtggccgtggtgatgtgcaggaggaagagcagcggcggcaaaggaggcagctgcagccaggccgccagcagcaacagcgcccagggcagtgatgagagcctcatcgcctgcaaggcctag

SEQ ID NO: 3631 - DNA, 1119 bp, Artificial Sequence
  Description of Artificial Sequence: Synthetic coding sequence
atgagggtgatggcccccaggaccctcatcctgctgctgagcggggccctggccctgacagagacctgggcctgcagccacagcatgagatactttgacacagctgtgtccaggcctggccgcggggagccccgcttcatctctgtgggctacgtggatgacacccagtttgtgcgctttgacagtgatgctgccagccccagaggagagccccgggccccctgggtggagcaggagggccctgagtactgggaccgggagacccagaagtacaagaggcaggcccaggccgacagagtgaacctgaggaagctgcggggctactacaaccagagtgaagatggcagccacaccctgcagtggatgtatggctgtgacctgggcccagatggccgcctgctgcggggctatgaccagagcgcctatgatggcaaggactacatcgccctgaatgaagacctgcgctcctggacagctgctgacacagctgcccagatcacccagaggaagtgggaggccgcccgggaggccgagcagtggagggcctacctggagggcacctgtgtggagtggctgcggcgctacctggagaatggcaaggagaccctgcagagagctgagcaccccaagacccacgtgacccaccaccctgtgtctgaccacgaggccaccctgcgctgctgggccctgggcttctacccagctgagatcaccctgacctggcagagagatggagaggaccagacccaggacacagagctggtggagaccaggcctgctggagatggcaccttccagaagtgggccgctgtggtggtgcccagcggggaggagcagcgctacacctgccacgtgcagcacgagggcctgcctgagcccctgaccctgcgctgggagcccagcagccagcccaccatccccatcgtgggcatcgtggccggcctggccgtgctggccgtgctggccgtgctgggcgctgtgatggctgtggtgatgtgcaggaggaagagcagcggccacttcctgcccaccggcggcaaaggaggcagctgcagccaggccgccagcagcaacagcgcccagggcagtgatgagagcctcatcgcctgcaaggcctag

SEQ ID NO: 3632 - DNA, 1107 bp, Artificial Sequence; identical to SEQ ID NO: 3620
  Description of Artificial Sequence: Synthetic coding sequence

SEQ ID NO: 3633 - DNA, 675 bp, Artificial Sequence
  Description of Artificial Sequence: Synthetic coding sequence
atgagggtgatggccccccgggccctgctgctgctgctgagcggcggcctggccctgacagagacctgggcctgcagccacagcatgagatactttgacacagctgtgtccaggcctggccgcggggagccccgcttcatctctgtgggctacgtggatgacacccagtttgtgcgctttgacagtgatgctgccagccccagaggagagccccgggccccctgggtggagcaggagggccctgagtactgggaccgggagacccagaagtacaagaggcaggcccaggccgacagagtgtccctgaggaacctgcggggctactacaaccagagtgaagatggcagccacaccctgcagaggatgagcggctgtgacctgggcccagatggccgcctgctgcggggctatgaccagagcgcctatgatggcaaggactacatcgccctgaatgaagacctgcgctcctggacagctgctgacacagctgcccagatcacccagaggaagctggaggccgcccgggctgctgagcagctgcgggcctacctggagggcacctgtgtggagtggctgcggcgctacctggagaatggcaaggagaccctgcagagagctggccaggaccagaagagcctcttcctgccccagaggctggagctgagcaatgaatag

SEQ ID NO: 3634 - DNA, 675 bp, Artificial Sequence
  Description of Artificial Sequence: Synthetic coding sequence
atgagggtgatggcccccaggaccctcatcctgctgctgagcggggccctggccctgacagagacctgggcctgcagccacagcatgagatacttctacacagctgtgtccaggcctggccgcggggagccccgcttcatcgctgtgggctacgtggatgacacccagtttgtgcagtttgacagtgatgctgccagccccagaggagagccccgggccccctgggtggagcaggagggccctgagtactgggaccgggagacccagaagtacaagaggcaggcccagacagacagagtgaacctgaggaagctgcggggctactacaaccagagcgaggccggcagccacaccctgcagaggatgtatggctgtgacctgggcccagatggccgcctgctgcggggctacaaccagtttgcctatgatggcaaggactacatcgccctgaatgaagacctgcgctcctggacagctgctgacaaggccgcccagatcacccagaggaagtgggaggccgcccgggaggccgagcagaggcgggcctacctggagggcacctgtgtggagtggctgcggcgctacctggagaatggcaagaagaccctgcagagagctggccaggaccagaagagcctcttcctgccccagaggctggagctgagcaatgaatag

SEQ ID NO: 3635 - DNA, 675 bp, Artificial Sequence
  Description of Artificial Sequence: Synthetic coding sequence
atgagggtgatggccccccgggccctgctgctgctgctgagcggcggcctggccctgacagagacctgggcctgcagccacagcatgagatactttgacacagctgtgtccaggcctggccgcggggagccccgcttcatctctgtgggctacgtggatgacacccagtttgtgcgctttgacagtgatgctgccagccccagaggagagccccgggccccctgggtggagcaggagggccctgagtactgggaccgggagacccagaactacaagaggcaggcccaggccgacagagtgtccctgaggaacctgcggggctactacaaccagagtgaagatggcagccacaccctgcagaggatgtatggctgtgacctgggcccagatggccgcctgctgcggggctatgaccagagcgcctatgatggcaaggactacatcgccctgaatgaagacctgcgctcctggacagctgctgacacagctgcccagatcacccagaggaagctggaggccgcccgggctgctgagcagctgcgggcctacctggagggcacctgtgtggagtggctgcggcgctacctggagaatggcaaggagaccctgcagagagctggccaggaccagaagagcctcttcctgccccagaggctggagctgagcaatgaatag

SEQ ID NO: 3636 - DNA, 396 bp, Artificial Sequence
  Description of Artificial Sequence: Synthetic coding sequence
atgagggtgatggcccccaggaccctcatcctgctgctgagcggggccctggccctgacagagacctgggcctgcagccacagcatgagatacttctacacagctgtgtccaggcctggccgcggggagccccgcttcatcgctgtgggctacgtggatgacacccagtttgtgcagtttgacagtgatgctgccagccccagaggagagccccgggccccctgggtggagcaggagggccctgagtactgggaccgggagacccagaagtacaagaggcaggcccagacagacagagtgaacctgaggaagctgcggggctactacaaccagagcgaggctgaagatgtgtggctgcggcctggggcccggcgggcccccccaccccgggtgtag

SEQ ID NO: 3637 - DNA, 396 bp, Artificial Sequence
  Description of Artificial Sequence: Synthetic coding sequence
atgagggtgatggccccccgggccctgctgctgctgctgagcggcggcctggccctgacagagacctgggcctgcagccacagcatgagatactttgacacagctgtgtccaggcctggccgcggggagccccgcttcatctctgtgggctacgtggatgacacccagtttgtgcgctttgacagtgatgctgccagccccagaggagagccccgggccccctgggtggagcaggagggccctgagtactgggaccgggagacccagaactacaagaggcaggcccaggccgacagagtgtccctgaggaacctgcggggctactacaaccagagtgaagatgaagatgtgtggctgcggcctggggcccggcgggcccccccaccccgggtgtag

SEQ ID NO: 3638 - DNA, 396 bp, Artificial Sequence
  Description of Artificial Sequence: Synthetic coding sequence
atgagggtgatggcccccaggaccctcatcctgctgctgagcggggccctggccctgacagagacctgggcctgcagccacagcatgagatactttgacacagctgtgtccaggcctggccgcggggagccccgcttcatctctgtgggctacgtggatgacacccagtttgtgcgctttgacagtgatgctgccagccccagaggagagccccgggccccctgggtggagcaggagggccctgagtactgggaccgggagacccagaagtacaagaggcaggcccaggccgacagagtgaacctgaggaagctgcggggctactacaaccagagtgaagatgtggatgtgtggctgcggcctggggcccggcgggcccccccaccccgggtgtag

SEQ ID NO: 3639 - DNA, 396 bp, Artificial Sequence; identical to SEQ ID NO: 3636
  Description of Artificial Sequence: Synthetic coding sequence

SEQ ID NO: 3640 - DNA, 396 bp, Artificial Sequence
  Description of Artificial Sequence: Synthetic coding sequence
atgagggtgatggcccccaggaccctcatcctgctgctgagcggggccctggccctgacagagacctgggcctgcagccacagcatgagatacttctacacagctgtgtccaggcctggccgcggggagccccgcttcatcgctgtgggctacgtggatgacacccagtttgtgcgctttgacagtgatgctgccagccccagaggagagccccgggccccctgggtggagcaggagggccctgagtactgggaccgggagacccagaagtacaagaggcaggcccagacagacagagtgtccctgaggaacctgcggggctactacaaccagagcgaggccgtggatgtgtggctgcggcctggggcccggcgggcccccccaccccgggtgtag

SEQ ID NO: 3641 - DNA, 396 bp, Artificial Sequence
  Description of Artificial Sequence: Synthetic coding sequence
atgagggtgatggcccccaggaccctcatcctgctgctgagcggggccctggccctgacagagacctgggccggcagccacagcatgagatacttctacacagctgtgtccaggcctggccgcggggagccccacttcatcgctgtgggctacgtggatgacacccagtttgtgcgctttgacagtgatgctgccagccccagaggagagccccgggccccctgggtggagcaggagggccctgagtactgggaccgggagacccagaagtacaagaggcaggcccagacagacagagtgtccctgaggaacctgcggggctactacaaccagagcgaggctgaagatgtgtggctgcggcggggggcccggcgggcccccccaccccgggtgtag

SEQ ID NO: 3642 - DNA, 1212 bp, Artificial Sequence
  Description of Artificial Sequence: Synthetic coding sequence
atgagggtgatggccccccgggccctgctgctgctgctgagcggcggcctggccctgacagagacctgggcctgtgaatgtggggtgggccgggaggccgccagcgctgagaggtctgagggccccccaggagagccccggcgggaggtgggccgggccggcctgagccccagcagccccccaggcagccacagcatgagatactttgacacagctgtgtcccggcccggccgcggggagccccgcttcatctctgtgggctacgtggatgacacccagtttgtgcgctttgacagtgatgctgccagccccagaggagagccccgggccccctgggtggagcaggagggccctgagtactgggaccgggagacccagaagtacaagaggcaggcccaggccgacagagtgtccctgaggaacctgcggggctactacaaccagagtgaagatggcagccacaccctgcagaggatgagcggctgtgacctgggcccagatggccgcctgctgcggggctatgaccagagcgcctatgatggcaaggactacatcgccctgaatgaagacctgcgctcctggacagctgctgacacagctgcccagatcacccagaggaagctggaggccgcccgggctgctgagcagctgcgggcctacctggagggcacctgtgtggagtggctgcggcgctacctggagaatggcaaggagaccctgcagagagctgagccccccaagacccacgtgacccaccaccccctgagtgaccacgaggccaccctgcgctgctgggccctgggcttctacccagctgagatcaccctgacctggcagagagatggagaggaccagacccaggacacagagctggtggagaccaggcctgctggagatggcaccttccagaagtgggccgctgtggtggtgcccagcggccaggagcagcgctacacctgccacatgcagcacgagggcctgcaggagcccctgaccctgtcctgggagcccagcagccagcccaccatccccatcatgggcatcgtggccggcctggccgtgctggtggtgctggccgtgctgggcgctgtggtgacagccatgatgtgcaggaggaagagcagcggcggcaagggcggcagctgcagccaggccgcctgcagcaacagcgcccagggcagtgatgagagcctcatcacctgcaaggcctag

SEQ ID NO: 3643 - DNA, 1212 bp, Artificial Sequence
  Description of Artificial Sequence: Synthetic coding sequence
atgagggtgatggccccccgggccctgctgctgctgctgagcggcggcctggccctgacagagacctgggcctgtgaatgtggggtgggccgggaggccgccagcgctgagaggtctgagggccccccaggagagccccggcgggaggtgggccgggccggcctgagccccagcagccccccaggcagccacagcatgagatactttgacacagctgtgtcccggcccggccgcggggagccccgcttcatctctgtgggctacgtggatgacacccagtttgtgcgctttgacagtgatgctgccagccccagaggagagccccgggccccctgggtggagcaggagggccctgagtactgggaccgggagacccagaactacaagaggcaggcccaggccgacagagtgtccctgaggaacctgcggggctactacaaccagagtgaagatggcagccacaccctgcagaggatgtatggctgtgacctgggcccagatggccgcctgctgcggggctatgaccagagcgcctatgatggcaaggactacatcgccctgaatgaagacctgcgctcctggacagctgctgacacagctgcccagatcacccagaggaagctggaggccgcccgggctgctgagcagctgcgggcctacctggagggcacctgtgtggagtggctgcggcgctacctggagaatggcaaggagaccctgcagagagctgagccccccaagacccacgtgacccaccaccccctgagtgaccacgaggccaccctgcgctgctgggccctgggcttctacccagctgagatcaccctgacctggcagagagatggagaggaccagacccaggacacagagctggtggagaccaggcctgctggagatggcaccttccagaagtgggccgctgtggtggtgcccagcggccaggagcagcgctacacctgccacatgcagcacgagggcctgcaggagcccctgaccctgtcctgggagcccagcagccagcccaccatccccatcatgggcatcgtggccggcctggccgtgctggtggtgctggccgtgctgggcgctgtggtgacagccatgatgtgcaggaggaagagcagcggcggcaagggcggcagctgcagccaggccgcctgcagcaacagcgcccagggcagtgatgagagcctcatcacctgcaaggcctag

SEQ ID NO: 3644 - DNA, 981 bp, Artificial Sequence
  Description of Artificial Sequence: Synthetic coding sequence
atgagggtgatggcccccaggaccctcatcctgctgctgagcggggccctggccctgacagagacctgggcctgcagccacagcatgagatacttctacacagctgtgtccaggcctggccgcggggagccccgcttcatcgctgtgggctacgtggatgacacccagtttgtgcgctttgacagtgatgctgccagccccagaggagagccccgggccccctgggtggagcaggagggccctgagtactgggaccgggagacccagaagtacaagaggcaggcccagacagacagagtgtccctgaggaacctgcggggctactacaaccagagcgaggccggcagccacaccctgcagtggatgtatggctgtgacctgggcccagatggccgcctgctgcggggctatgaccagagcgcctatgatggcaaggactacatcgccctgaatgaagacctgcgctcctggacagctgctgacacagctgcccagatcacccagaggaagtgggaggccgcccgggctgctgagcagcagagggcctacctggagggcacctgtgtggagtggctgcggcgctacctggagaatggcaaggagaccctgcagagagctgagcaccccaagacccacgtgacccaccacctggtgtctgaccacgaggccaccctgcgctgctgggccctgggcttctacccagctgagatcaccctgacctggcagagagatggagaggaccagacccaggacacagagctggtggagaccaggcctgctggagatggcaccttccagaagtgggccgctgtggtggtgcccagcggggaggagcagcgctacacctgccacgtgcagcacgagggcctgcctgagcccctgaccctgcgctggggcggcaaaggaggcagctgcagccaggccgccagcagcaacagcgcccagggcagtgatgagagcctcatcgcctgcaaggcctag

SEQ ID NO: 3645 - DNA, 1041 bp, Artificial Sequence
  Description of Artificial Sequence: Synthetic coding sequence
atggcccggccccagaggaccccagcccggagcccagacagcatcgtggaggtgaagagcaagtttgatgctgagttcagaagatttgccctgccccgggcctctgtgtctggcttccaggagttcagccggctgctgcgggctgtgcaccagatccctggcctggatgtgctgctgggctacacagatgcccatggagacctgctgcccctgaccaatgatgacagcctgcaccgggccctggccagcggccccccacccctgcggctgctggtgcagaagagagctgaggccgacagcagcggcctggcctttgccagcaacagcctgcagaggaggaagaagggcctgctgctgcggcctgtggcccccctgcggaccaggcctcccctgctgatcagcctgccccaggacttccggcaggtgtcctctgtgattgatgtggacctgctgcctgagacccaccggcgggtgcggctgcacaagcacggcagtgaccggcccctgggcttctacatcagagatggcatgtctgtgcgggtggccccccagggcctggagcgggtgcccggcatcttcatcagccggctggtgcggggcggcctggccgagagcacaggcctgctggccgtgtctgatgagatcctggaggtgaatggaattgaggtggccggcaagaccctggaccaggtgacagacatgatggtggccaacagccacaacctgattgtgacagtgaagccagccaaccagaggaacaacgtggtgcggggggccagcggccgcctgaccggcccccccagcgctggccctggccctgctgagccagacagtgatgatgacagcagtgacctggtgattgagaaccggcagccccccagcagcaatggcctgagccagggccccccctgctgggacctgcaccctggctgccgccaccctggcaccaggagcagcctgcccagcctggatgaccaggagcaggccagcagcggctggggcagccgcatcagaggagatggcagcggcttcagcctgtag

SEQ ID NO: 3646 - DNA, 1824 bp, Artificial Sequence
  Description of Artificial Sequence: Synthetic coding sequence
atgatcctgctgaccttcagcacaggccggcggctggactttgtgcaccacagcggggtcttcttcctgcagaccctgctgtggatcctgtgtgccaccgtgtgtggcacagagcagtacttcaacgtggaggtgtggctgcagaagtatggctacctgcccccaacagaccccaggatgtctgtgctgcggtctgctgagaccatgcagagcgccctggccgccatgcagcagttctacggcatcaacatgaccgggaaggtggacaggaacaccatcgactggatgaagaagccccgctgtggggtgcctgaccagacccggggcagcagcaagttccacatccggaggaagagatatgccctgaccggccagaagtggcagcacaagcacatcacctacagcatcaagaatgtgacccccaaggtgggggaccctgagaccaggaaggccatcagaagagcctttgatgtgtggcagaatgtgacccccctgacctttgaggaggtgccctacagcgagctggagaatggcaagagagatgtggacatcaccatcatctttgccagcggcttccatggagacagcagcccctttgatggagagggcggcttcctggcccacgcctacttccctggccctggcatcggcggggacacccactttgacagtgatgagccctggaccctgggcaaccccaaccatgatggaaatgacctcttcctggtggccgtgcatgagctgggccacgccctgggcctggagcacagcaatgaccccacagccatcatggcccccttctaccagtacatggagacagacaacttcaagctgcccaatgatgacctgcagggcatccagaagatctacggccccccagacaagatccccccacccacccggcccctgcccaccgtgcccccccacaggagcatccccccagctgaccccaggaagaatgaccggcccaagccaccccggccccccaccggccggcccagctacccaggggccaagcccaacatctgtgatggcaacttcaacaccctggccatcctgcggcgggagatgtttgtgttcaaggaccagtggttctggagggtgaggaacaacagagtgatggatggctaccccatgcagatcacctacttctggaggggcctgcccccatccattgatgctgtgtatgaaaattctgatggcaactttgtgttcttcaagggcaacaagtactgggtgttcaaggacaccaccctgcagcccggctacccccatgacctgatcaccctgggcagcggcatcccccctcatggaattgattctgccatctggtgggaggatgtgggcaagacctacttcttcaagggggaccgctactggagatacagcgaggagatgaagaccatggaccccggctaccccaagcccatcaccgtgtggaagggcatccctgagagcccccagggcgcctttgtgcacaaggaaaatggcttcacctacttctacaagggcaaggagtactggaagttcaacaaccagatcctgaaggtggagcccggctaccccaggagcatcctgaaggacttcatgggctgtgatggccccacagacagagtgaaggagggccacagccccccagatgatgtggacatcgtcatcaagctggacaacacagccagcacagtgaaggccatcgccatcgtcatcccctgcatcctggccctgtgcctgctggtgctggtgtacacagtgttccagttcaagaggaagggcacccccaggcacatcctgtactgcaagaggtccatgcaggagtgggtgtag

SEQ ID NO: 3647 - DNA, 1812 bp, Artificial Sequence
  Description of Artificial Sequence: Synthetic coding sequence
atgagaagaagagctgcccggggccctggccccccacctcctggccctggcctgagccggctgcccctgcccctgctgctgctgctggccctgggcacccggggcggctgtgccgccccagccccagcccccagggctgaggacctgagcctgggcgtggagtggctgagcagatttggctacctgcccccagctgaccccaccaccggccagctgcagacccaggaggagctgagcaaggccatcacagccatgcagcagtttggaggcctggaggccaccggcatcctggatgaggccaccctggccctgatgaagaccccccgctgcagcctgcctgacctgcctgtgctgacccaggccaggagaagacggcaggccccagcccccaccaagtggaacaagaggaacctgtcctggagggtgaggaccttcccccgggacagccccctgggccatgacacagtgcgggccctgatgtactatgccctgaaggtgtggagcgacatcgcccccctgaacttccacgaggtggccggcagcgctgctgacatccagattgacttcagcaaggctgaccacaatgatggctacccctttgatggccctgggggcaccgtggcccacgccttcttccctggccaccaccacacagctggggacacccactttgatgatgatgaggcctggaccttccgcagcagtgatgcccacggcatggacctgtttgctgtggccgtgcatgaatttggccacgccatcggcctgagccacgtggccgccgcccacagcatcatgaggccctactaccagggccctgtgggggaccccctgcgctatggcctgccctatgaggacaaggtgcgggtgtggcagctgtatggagtgcgggagagcgtgagccccacagcccagcctgaggagccccccctgctgcctgagcccccagacaacagaagcagcgccccacccaggaaggatgtgccccaccgctgcagcacccactttgatgctgtggcccagatccggggggaggccttcttcttcaagggcaagtacttctggaggctgacccgggacagacacctggtgtccctgcagcctgcccagatgcaccgcttctggaggggcctgcccctgcacctggacagcgtggatgctgtgtatgaaagaacaagtgaccacaagatcgtgttcttcaagggggaccgctactgggtgttcaaggacaacaacgtggaggagggctaccccaggcctgtgtctgacttcagcctgcccccaggcggcattgatgctgccttctcctgggcccacaatgacaggacctacttcttcaaggaccagctgtactggaggtatgatgaccacaccaggcacatggaccccggctacccagcccagagccccctgtggaggggcgtgcccagcaccctggatgatgccatgcgctggagcgatggagccagctacttcttccggggccaggagtactggaaggtgctggatggagagctggaggtggcccctggctacccccagagcacagcccgggactggctggtgtgtggggacagccaggctgatggctctgtggccgccggcgtggatgctgctgagggcccccgggcccctcctggccagcacgaccagagccgctcagaagatggctatgaggtgtgcagctgcaccagcggggccagcagccccccaggggcccctggccccctggtggccgccaccatgctgctgctgctgccccccctgagccctggggccctgtggacagctgcccaggccctgaccctgtag

SEQ ID NO: 3648 - DNA, 1560 bp, Artificial Sequence
  Description of Artificial Sequence: Synthetic coding sequence
atgcagcagtttggaggcctggaggccaccggcatcctggatgaggccaccctggccctgatgaagaccccccgctgcagcctgcctgacctgcctgtgctgacccaggccaggagaagacggcaggccccagcccccaccaagtggaacaagaggaacctgtcctggagggtgaggaccttcccccgggacagccccctgggccatgacacagtgcgggccctgatgtactatgccctgaaggtgtggagcgacatcgcccccctgaacttccacgaggtggccggcagcgctgctgacatccagattgacttcagcaaggctgaccacaatgatggctacccctttgatggccctgggggcaccgtggcccacgccttcttccctggccaccaccacacagctggggacacccactttgatgatgatgaggcctggaccttccgcagcagtgatgcccacggcatggacctgtttgctgtggccgtgcatgaatttggccacgccatcggcctgagccacgtggccgccgcccacagcatcatgaggccctactaccagggccctgtgggggaccccctgcgctatggcctgccctatgaggacaaggtgcgggtgtggcagctgtatggagtgcgggagagcgtgagccccacagcccagcctgaggagccccccctgctgcctgagcccccagacaacagaagcagcgccccacccaggaaggatgtgccccaccgctgcagcacccactttgatgctgtggcccagatccggggggaggccttcttcttcaagggcaagtacttctggaggctgacccgggacagacacctggtgtccctgcagcctgcccagatgcaccgcttctggaggggcctgcccctgcacctggacagcgtggatgctgtgtatgaaagaacaagtgaccacaagatcgtgttcttcaagggggaccgctactgggtgttcaaggacaacaacgtggaggagggctaccccaggcctgtgtctgacttcagcctgcccccaggcggcattgatgctgccttctcctgggcccacaatgacaggacctacttcttcaaggaccagctgtactggaggtatgatgaccacaccaggcacatggaccccggctacccagcccagagccccctgtggaggggcgtgcccagcaccctggatgatgccatgcgctggagcgatggagccagctacttcttccggggccaggagtactggaaggtgctggatggagagctggaggtggcccctggctacccccagagcacagcccgggactggctggtgtgtggggacagccaggctgatggctctgtggccgccggcgtggatgctgctgagggcccccgggcccctcctggccagcacgaccagagccgctcagaagatggctatgaggtgtgcagctgcaccagcggggccagcagccccccaggggcccctggccccctggtggccgccaccatgctgctgctgctgccccccctgagccctggggccctgtggacagctgcccaggccctgaccctgtag

SEQ ID NO: 3649 - DNA, 348 bp, Artificial Sequence
  Description of Artificial Sequence: Synthetic coding sequence
atgcagcagtttggaggcctggaggccaccggcatcctggatgaggccaccctggccctgatgaagaccccccgctgcagcctgcctgacctgcctgtgctgacccaggccaggagaagacggcaggccccagcccccaccaagtggaacaagaggaacctgtcctggagggtgaggaccttcccccgggacagccccctgggccatgacacagtgcgggccctgatgtactatgccctgaaggtgtggagcgacatcgcccccctgaacttccacgaggtggccggcagcgctgctgacatccagattgacttcagcaaggctgaccacaatgatggctacccctag

SEQ ID NO: 3650 - DNA, 1527 bp, Artificial Sequence
  Description of Artificial Sequence: Synthetic coding sequence
atgaactgccagcagctgtggctgggcttcctgctgcccatgacagtgtctggccgggtgctgggcctggccgaggtggcccctgtggactacctgagccagtatggctacctgcagaagcccctggagggcagcaacaacttcaagccagaggacatcacagaggccctgcgggccttccaggaggccagcgagctgcctgtgtctggccagctggatgatgccacccgggccaggatgaggcagccccgctgtggcctggaggaccccttcaaccagaagaccctgaagtacctgctgctgggccgctggaggaagaagcacctgaccttccgcatcctgaacctgcccagcaccctgcccccccacacagcccgggccgccctgcggcaggccttccaggactggagcaatgtggcccccctgaccttccaggaggtgcaggccggggctgctgacatccggctgtccttccacggccggcagagcagctactgcagcaacacctttgatggccctggccgggtgctggcccacgccgacatccctgagctgggctctgtgcactttgatgaagatgagttctggacagagggcacctacagaggagtgaacctgcgcatcatcgccgcccacgaggtgggccacgccctgggcctgggccacagccgctacagccaggccctgatggcccctgtgtatgagggctaccggccccacttcaagctgcacccagatgatgtggccggcatccaggccctgtatggcaagaagagccctgtgatcagagatgaggaggaggaggagacagagctgcccaccgtgccccctgtgcccacagagcccagccccatgccagacccctgcagcagcgagctggatgccatgatgctgggcccccggggcaagacctacgccttcaagggggactatgtgtggacagtgtctgacagcggccctggccccctcttccgggtgtctgccctgtgggagggcctgcccggcaacctggatgctgctgtgtacagccccaggacccagtggatccacttcttcaagggggacaaggtgtggagatacatcaacttcaagatgagccctggcttccccaagaagctgaacagagtggagcccaacctggatgctgccctgtactggcccctgaaccagaaggtgttcctgttcaagggcagcggctactggcagtgggatgagctggccaggacagacttcagcagctaccccaagcccatcaagggcctcttcaccggggtgcccaaccagcccagcgctgccatgtcctggcaggacggccgggtgtacttcttcaagggcaaggtgtactggaggctgaaccagcagctgcgggtggagaagggctaccccaggaacatcagccacaactggatgcactgccggcccaggaccatcgacaccacccccagcggcggcaacaccaccccatctggaacaggcatcaccctggacaccaccctgagcgccacagagaccacctttgagtactag

SEQ ID NO: 3651 - DNA, 669 bp, Artificial Sequence
  Description of Artificial Sequence: Synthetic coding sequence
atgggcgtgacctgggacttctccatgagcaatggaggcccccggggcaagacctacgccttcaagggggactatgtgtggacagtgtctgacagcggccctggccccctcttccgggtgtctgccctgtgggagggcctgcccggcaacctggatgctgctgtgtacagccccaggacccagtggatccacttcttcaagggggacaaggtgtggagatacatcaacttcaagatgagccctggcttccccaagaagctgaacagagtggagcccaacctggatgctgccctgtactggcccctgaaccagaaggtgttcctgttcaagggcagcggctactggcagtgggatgagctggccaggacagacttcagcagctaccccaagcccatcaagggcctcttcaccggggtgcccaaccagcccagcgctgccatgtcctggcaggacggccgggtgtacttcttcaagggcaaggtgtactggaggctgaaccagcagctgcgggtggagaagggctaccccaggaacatcagccacaactggatgcactgccggcccaggaccatcgacaccacccccagcggcggcaacaccaccccatctggaacaggcatcaccctggacaccaccctgagcgccacagagaccacctttgagtactag

SEQ ID NO: 3652 - DNA, 918 bp, Artificial Sequence
  Description of Artificial Sequence: Synthetic coding sequence
atgaactgccagcagctgtggctgggcttcctgctgcccatgacagtgtctggccgggtgctgggcctggccgaggtggcccctgtggactacctgagccagtatggctacctgcagaagcccctggagggcagcaacaacttcaagccagaggacatcacagaggccctgcgggccttccaggaggccagcgagctgcctgtgtctggccagctggatgatgccacccgggccaggatgaggcagccccgctgtggcctggaggaccccttcaaccagaagaccctgaagtacctgctgctgggccgctggaggaagaagcacctgaccttccgcatcctgaacctgcccagcaccctgcccccccacacagcccgggccgccctgcggcaggccttccaggactggagcaatgtggcccccctgaccttccaggaggtgcaggccggggctgctgacatccggctgtccttccacggccggcagagcagctactgcagcaacacctttgatggccctgggaagaagagccctgtgatcagagatgaggaggaggaggagacagagctgcccaccgtgccccctgtgcccacagagcccagccccatgccagacccctgcagcagcgagctggatgccatgatgctgggggaggccccacccctgcaggccgtgggccgccgctggggccagcctgctgaccctgaggcctggaccaacggcagtgacatgggcctgcagcacgagcagtggagggccccctgggaggacctgtgcttccagggcggcctgtgtgtggactgcatccgcttcagaacaggccccctggtgcccagcgtgtgccccctgggcggggcccccaggaagccaggctgctgctgcctgctggccagcaacaccatggacagcctgctgtag

SEQ ID NO: 3653 - DNA, 1452 bp, Artificial Sequence
  Description of Artificial Sequence: Synthetic coding sequence
atgaaggtgctgcctgccagcggcctggccgtgttcctgatcatggccctgaagttcagcacagctgcccccagcctggtggccgccagccccaggacctggaggaacaactaccgcctggcccaggcctacctggacaagtactacaccaacaaggagggccaccagattggagagatggtggcccggggcagcaacagcatgatcaggaagatcaaggagctgcaggccttcttcggcctgcaggtgacaggcaagctggaccagaccaccatgaatgtcatcaagaagccccgctgtggggtgcctgatgtggccaactaccgcctcttccctggagagcccaagtggaagaagaacaccctgacctaccgcatcagcaagtacacccccagcatgagctctgtggaggtggacaaggctgtggagatggccctgcaggcctggagcagcgctgtgcccctgagctttgtgcgcatcaacagcggggaggccgacatcatgatcagctttgaaaatggagaccacggggacagctacccctttgatggcccccggggcaccctggcccacgcctttgcccctggagagggcctgggcggggacacccactttgacaatgctgagaagtggaccatgggcaccaacggcttcaacctcttcaccgtggccgcccacgagtttggccacgccctgggcctggcccacagcacagaccccagcgccctgatgtaccccacctacaagtacaagaacccctacggcttccacctgcccaaggatgatgtgaagggcatccaggccctgtatggccccaggaaggtgttcctgggcaagcccaccctgccccacgccccccaccacaagcccagcatcccagacctgtgtgacagcagcagcagctttgatgctgtgaccatgctgggcaaggagctgctgctcttcaaggaccgcatcttctggaggcggcaggtgcacctgaggacaggcatccggcccagcaccatcaccagcagcttcccccagctgatgagcaatgtggatgctgcctatgaggtggccgagcggggcacagcctacttcttcaagggcccccactactggatcacccggggcttccagatgcagggcccccccaggaccatctatgactttggcttccccaggcatgtgcagcagattgatgctgctgtgtacctgcgggagccccagaagaccctcttctttgtgggagatgagtactacagctatgatgagaggaagaggaagatggagaaggactaccccaagaacacagaggaggagttctctggagtgaatggccagattgatgctgctgtggagctgaatggctacatctacttcttcagcggccccaagacctacaagtatgacacagagaaggaggatgtggtgtctgtggtgaagagcagctcctggattggctgctag

SEQ ID NO: 3654 - DNA, 1710 bp, Artificial Sequence
  Description of Artificial Sequence: Synthetic coding sequence
atgctggccgccagcatcttccggcccaccctgctgctgtgctggctggccgccccctggcccacccagcctgagagcctcttccacagccgggacagaagtgacctggagcccagccccctgcggcaggccaagcccatcgctgacctgcacgccgcccagcgcttcctgagccgctatggctggagcggcgtgtgggccgcctggggccccagccctgagggccccccagagacccccaagggagctgccctggccgaggccgtgcggcgcttccagagggccaatgccctgcctgccagcggggagctggatgctgccaccctggccgccatgaaccggccccgctgtggggtgcctgacatgaggcctcctccacccagcgccccacccagccccccaggccccccaccccgggcccggagcagaagaagcccccgggcccccctgagcctgagccggcggggctggcagccccggggctacccagatggaggagctgcccaggccttcagcaagaggaccctgtcctggaggctgctgggggaggccctgagcagccagctgtctgtggccgaccagaggagaattgtggccctggccttcaggatgtggagcgaggtgacccccctggacttccgggaggacctggccgcccctggagctgctgtggacatcaagctgggcttcggccggggccgccacctgggctgcccccgggcctttgatggcagcggccaggagtttgcccacgcctggaggctgggggacatccactttgatgatgatgagcacttcaccccacccaccagtgacaccggcatcagcctgctgaaggtggccgtgcatgaaattggacatgtgctgggcctgccccacacctacagaacaggcagcatcatgcagcccaactacatcccccaggagcccgcctttgagctggactggagcgacaggaaggccatccagaagctgtatggcagctgtgagggcagctttgacacagcctttgactggatcaggaaggagaggaaccagtatggagaggtgatggtgcgcttcagcacctacttcttcaggaacagctggtactggctgtatgagaacagaaacaacagaacccgctacggggaccccatccagatcctgaccggctggccaggcatccccacccacaacattgatgcctttgtgcacatctggacctggaagagagatgagcgctacttcttccagggcaaccagtactggaggtatgacagcgacaaggaccaggccctgacagaagatgagcagggcaagagctaccccaagctgatcagcgagggcttccctggcatccccagccccctggacacagccttctatgaccggcggcagaagctgatctacttcttcaaggagagcctggtgtttgcctttgatgtgaacagaaacagagtgctgaacagctaccccaagaggatcacagaggtgtttcctgctgtgatcccccagaaccaccccttcaggaacatcgacagcgcctactacagctatgcctacaacagcatcttcttcttcaagggaaatgcctactggaaggtggtgaatgacaaggacaagcagcagaacagctggctgcctgccaacggcctcttccccaagaagttcatcagcgagaagtggtttgatgtgtgtgatgtgcacatcagcaccctgaacatgtag

SEQ ID NO: 3655 - DNA, 1173 bp, Artificial Sequence
  Description of Artificial Sequence: Synthetic coding sequence
atgggccgcggggcccgggtgcccagcgaggcccctggggccggcgtggagcggcgctggctgggcgccgccctggtggccctgtgcctgctgcctgccctggtgctgctggcccggctgggcgccccagctgtgcctgcctggagcgctgcccagggagatgtggccgccctgggcctgtctgctgtgccccccaccagggtgcccggccccctggcccccaggagaagacgctacaccctgaccccagcccggctgcgctgggaccacttcaacctgacctaccgcatcctgtccttccccaggaacctgctgagcccccgggagacccggcgggccctggccgccgccttcaggatgtggagcgatgtgagccccttctccttccgggaggtggcccctgagcagcccagcgacctgcgcatcggcttctaccccatcaaccacacagactgcctggtgtctgccctgcaccactgctttgatggccccactggagagctggcccacgccttcttccccccccacggcggcatccactttgatgacagcgagtactgggtgctgggccccacccgctacagctggaagaagggcgtgtggctgacagacctggtgcacgtggccgcccatgaaattggacatgccctgggcctgatgcacagccagcacggccgggccctgatgcacctgaatgccaccctgcggggctggaaggccctgagccaggatgagctgtggggcctgcaccggctgtatggctgcctggaccggctgtttgtgtgtgcctcctgggcccggcggggcttctgtgatgcccggcggcggctgatgaagaggctgtgccccagcagctgtgacttctgctatgagttccccttccccaccgtggccaccaccccacctccacccaggaccaagacccggctggtgcctgagggcagaaatgtgaccttccgctgtggccagaagatcctgcacaagaagggcaaggtgtactggtacaaggaccaggagcccctggagttctcctacccaggctacctggccctgggggaggcccacctgagcatcatcgccaatgctgtgaatgaaggcacctacacctgtgtggtgcggcggcagcagagggtgctgaccacctacagctggagggtgcgggtgcggggctag

SEQ ID NO: 3656 - DNA, 1161 bp, Artificial Sequence
  Description of Artificial Sequence: Synthetic coding sequence
atgggccgcggggcccgggtgcccagcgaggcccctggggccggcgtggagcggcgctggctgggcgccgccctggtggccctgtgcctgctgcctgccctggtgctgctggcccggctgggcgccccagctgtgcctgcctggagcgctgcccagggagatgtggccgccctgggcctgtctgctgtgccccccaccagggtgcccggccccctggcccccaggagaagacgctacaccctgaccccagcccggctgcgctgggaccacttcaacctgacctaccgcatcctgtccttccccaggaacctgctgagcccccgggagacccggcgggccctggccgccgccttcaggatgtggagcgatgtgagccccttctccttccgggaggtggcccctgagcagcccagcgacctgcgcatcggcggccggcccccaccacccaggcctggccctgcccggcctgccagccagccccgggccccaccccggctgctgcctgaccagccccacggcctgcccggcctgcgggccgcccccctgctgcggcggccccatggaggagctggcccccggctgctgcccccagcccggcggcaccccctgcggcggcagagggtgctgggccctggcccccacgccctgcagctggaggagaggagagtggcccacggccctggggcccggggcggcccccgggaccggcccagggctggcccagatgccctgaccaccaggcctggggcccacgcccctgagagacatgctgcccggctggagggcgtggtgcccggccgggctgtgggcgccgccccagccctgaggatgccccggcaggccgtgcgggtgcgggtgctgggcgctgagggcctgctgcggcgcagccctgctgcccacgaggaggccctgccccagcagctgcggctgctgctgcgcatccccctgccccacggcggccaccaccccacagccccccaggaccagaaccaggccggggcccggggccaggagcgggacctgcccctgcggcctgaggaccccccccaggagcgggagagcgtgctggtgcagggccctggggcccctggggtgctgctgccccggctgcccggccctggccgcggggcccctgagcaccaccggcagaggcggcagtag

SEQ ID NO: 3657 - DNA, 1293 bp, Artificial Sequence
  Description of Artificial Sequence: Synthetic coding sequence
atgggccgcggggcccgggtgcccagcgaggcccctggggccggcgtggagcggcgctggctgggcgccgccctggtggccctgtgcctgctgcctgccctggtgctgctggcccggctgggcgccccagctgtgcctgcctggagcgctgcccagggagatgtggccgccctgggcctgtctgctgtgccccccaccagggtgcccggccccctggcccccaggagaagacgctacaccctgaccccagcccggctgcgctgggaccacttcaacctgacctaccgcatcctgtccttccccaggaacctgctgagcccccgggagacccggcgggccctggccgccgccttcaggatgtggagcgatgtgagccccttctccttccgggaggtggcccctgagcagcccagcgacctgcgcatcggcttctaccccatcaaccacacagactgcctggtgtctgccctgcaccactgctttgatggccccactggagagctggcccacgccttcttccccccccacggcggcatccactttgatgacagcgagtactgggtgctgggccccacccgctacagctggaagaagggggaccggcccggctcctggaggcccctgctgtgcagcacagtgggctgccggggccgggccctgggccagacagctgggggcaccttccggggcggcggctgccactggagcctggccggcgtgtggctgacagacctggtgcacgtggccgcccatgaaattggacatgccctgggcctgatgcacagccagcacggccgggccctgatgcacctgaatgccaccctgcggggctggaaggccctgagccaggatgagctgtggggcctgcaccggctgtatggctgcctggaccggctgtttgtgtgtgcctcctgggcccggcggggcttctgtgatgcccggcggcggctgatgaagaggctgtgccccagcagctgtgacttctgctatgagttccccttccccaccgtggccaccaccccacctccacccaggaccaagacccggctggtgcctgagggcagaaatgtgaccttccgctgtggccagaagatcctgcacaagaagggcaaggtgtactggtacaaggaccaggagcccctggagttctcctacccaggctacctggccctgggggaggcccacctgagcatcatcgccaatgctgtgaatgaaggcacctacacctgtgtggtgcggcggcagcagagggtgctgaccacctacagctggagggtgcgggtgcggggctag

SEQ ID NO: 3658 - DNA, 717 bp, Artificial Sequence
  Description of Artificial Sequence: Synthetic coding sequence
atgggccgcggggcccgggtgcccagcgaggcccctggggccggcgtggagcggcgctggctgggcgccgccctggtggccctgtgcctgctgcctgccctggtgctgctggcccggctgggcgccccagctgtgcctgcctggagcgctgcccagggagatgtggccgccctgggcctgtctgctgtgccccccaccagggtgcccggccccctggcccccaggagaagacgctacaccctgaccccagcccggctgcgctgggaccacttcaacctgacctaccgcatcctgtccttccccaggaacctgctgagcccccgggagacccggcgggccctggccgccgccttcaggatgtggagcgatgtgagccccttctccttccgggaggtggcccctgagcagcccagcgacctgcgcatcggcttctaccccatcaaccacacagactgcctggtgtctgccctgcaccactgctttgatggccccactggagagctggcccacgccttcttccccccccacggcggcatccactttgatgacagcgagtactgggtgctgggccccacccgctacagctggaagaagggggaccggcccggctggcccccaggcggcctgagcagcgctgcccagtgggccgctgctgtgggcctgtggggccggcggcaggagggccccagcggcgtggtggccgccaccggggtgtag

SEQ ID NO: 3659 - DNA, 1938 bp, Artificial Sequence
  Description of Artificial Sequence: Synthetic coding sequence
atgcccaggagccggggcggccgggccgcccctggccccccacctcctcctcctcctcctggccaggccccccgctggagccgctggagggtgcccggccgcctgctgctgctgctgctgcctgccctgtgctgcctgcctggagctgcccgggctgctgctgctgctgctggagctggcaacagagctgctgtggccgtggccgtggcccgggcagatgaagctgaggccccctttgctggccagaactggctgaagagctatggctacctgctgccctatgacagccgggccagcgccctgcacagcgccaaggccctgcagagcgctgtgtccaccatgcagcagttctacggcatccctgtgactggagtgctggaccagaccaccatcgagtggatgaagaagccccgctgtggggtgcctgaccacccccacctgagcagaagaagaagaaacaagagatatgccctgaccggccagaagtggaggcagaagcacatcacctacagcatccacaactacacccccaaggtgggggagctggacaccaggaaggccatccggcaggcctttgatgtgtggcagaaggtgacccccctgacctttgaggaggtgccctaccacgagatcaagagtgacaggaaggaggccgacatcatgatcttctttgccagcggcttccatggagacagcagcccctttgatggagagggcggcttcctggcccacgcctacttccctggccctggcatcggcggggacacccactttgacagtgatgagccctggaccctgggcaatgccaaccatgatggaaatgacctcttcctggtggccgtgcatgagctgggccacgccctgggcctggagcacagcagtgaccccagcgccatcatggcccccttctaccagtacatggagacccacaacttcaagctgccccaggatgacctgcagggcatccagaagatctacggccccccagctgagcccctggagcccacccggcccctgcccaccctgcctgtgcggcgcatccacagccccagcgagaggaagcatgagcggcagcccaggcctccccggccccccctgggggaccggcccagcaccccaggcaccaagcccaacatctgtgatggcaacttcaacacagtggccctcttccggggggagatgtttgtgttcaaggaccgctggttctggaggctgaggaacaacagagtgcaggagggctaccccatgcagatcgagcagttctggaagggcctgcctgccagaattgatgctgcctatgagcgggcagatggccgctttgtgttcttcaagggggacaagtactgggtgttcaaggaggtgacagtggagcccggctacccccacagcctgggggagctgggcagctgcctgccccgggagggcatcgacacagccctgcgctgggagcctgtgggcaagacctacttcttcaagggggagcgctactggagatacagcgaggagcggcgggccacagaccccggctaccccaagcccatcaccgtgtggaagggcatcccccaggccccccagggcgccttcatcagcaaggagggctactacacctacttctacaagggccgggactactggaagtttgacaaccagaagctgtctgtggagcccggctaccccaggaacatcctgcgggactggatgggctgcaaccagaaggaggtggagaggaggaaggagcggcggctgccccaggatgatgtggacatcatggtgaccatcaatgatgtgcccggctctgtgaatgctgtggccgtggtgatcccctgcatcctgagcctgtgcatcctggtgctggtgtacaccatcttccagttcaagaacaagacaggcccccagcctgtgacctactacaagaggcctgtgcaggagtgggtgtag

SEQ ID NO: 3660 - DNA, 1782 bp, Artificial Sequence
  Description of Artificial Sequence: Synthetic coding sequence
atgcccaggagccggggcggccgggccgcccctggcccccccctggccgtggcccgggcagatgaagctgaggccccctttgctggccagaactggctgaagagctatggctacctgctgccctatgacagccgggccagcgccctgcacagcgccaaggccctgcagagcgctgtgtccaccatgcagcagttctacggcatccctgtgactggagtgctggaccagaccaccatcgagtggatgaagaagccccgctgtggggtgcctgaccacccccacctgagcagaagaagaagaaacaagagatatgccctgaccggccagaagtggaggcagaagcacatcacctacagcatccacaactacacccccaaggtgggggagctggacaccaggaaggccatccggcaggcctttgatgtgtggcagaaggtgacccccctgacctttgaggaggtgccctaccacgagatcaagagtgacaggaaggaggccgacatcatgatcttctttgccagcggcttccatggagacagcagcccctttgatggagagggcggcttcctggcccacgcctacttccctggccctggcatcggcggggacacccactttgacagtgatgagccctggaccctgggcaatgccaaccatgatggaaatgacctcttcctggtggccgtgcatgagctgggccacgccctgggcctggagcacagcagtgaccccagcgccatcatggcccccttctaccagtacatggagacccacaacttcaagctgccccaggatgacctgcagggcatccagaagatctacggccccccagctgagcccctggagcccacccggcccctgcccaccctgcctgtgcggcgcatccacagccccagcgagaggaagcatgagcggcagcccaggcctccccggccccccctgggggaccggcccagcaccccaggcaccaagcccaacatctgtgatggcaacttcaacacagtggccctcttccggggggagatgtttgtgttcaaggaccgctggttctggaggctgaggaacaacagagtgcaggagggctaccccatgcagatcgagcagttctggaagggcctgcctgccagaattgatgctgcctatgagcgggcagatggccgctttgtgttcttcaagggggacaagtactgggtgttcaaggaggtgacagtggagcccggctacccccacagcctgggggagctgggcagctgcctgccccgggagggcatcgacacagccctgcgctgggagcctgtgggcaagacctacttcttcaagggggagcgctactggagatacagcgaggagcggcgggccacagaccccggctaccccaagcccatcaccgtgtggaagggcatcccccaggccccccagggcgccttcatcagcaaggagggctactacacctacttctacaagggccgggactactggaagtttgacaaccagaagctgtctgtggagcccggctaccccaggaacatcctgcgggactggatgggctgcaaccagaaggaggtggagaggaggaaggagcggcggctgccccaggatgatgtggacatcatggtgaccatcaatgatgtgcccggctctgtgaatgctgtggccgtggtgatcccctgcatcctgagcctgtgcatcctggtgctggtgtacaccatcttccagttcaagaacaagacaggcccccagcctgtgacctactacaagaggcctgtgcaggagtgggtgtag

SEQ ID NO: 3661 - DNA, 561 bp, Artificial Sequence
  Description of Artificial Sequence: Synthetic coding sequence
atgagccctgctgaccccggcaccgtggccaccatgaggaagccccgctgcagcctgcctgatgtgctgggcgtggccggcctggtgagaagaagaagaagatatgccctgagcggctctgtgtggaagaagaggaccctgacctggagggtgcgctccttcccccagagcagccagctgagccaggagaccgtgcgggtgctgatgtcctatgccctgatggcctggggcatggagagcggcctgaccttccacgaggtggacagcccccagggccaggagccagacatcctgattgactttgcccgggccttccaccaggacagctacccctttgatggcctgggcggcaccctggcccacgccttcttccctggagagcaccccatcagcggggacacccactttgatgatgaggagacctggaccttcggcagcaaggccagccagcagctggagcaggagctggccggcggcagccctgtggatgaggagctgggcttcagccggggctggagggtgaaccccctgggccctggcagccctgagcggctgtcctag

SEQ ID NO: 3662 - DNA, 1689 bp, Artificial Sequence
  Description of Artificial Sequence: Synthetic coding sequence
atgaggctgcggctgcggctgctggccctgctgctgctgctgctggcccccccagcccgggcccccaagcccagcgcccaggatgtgtccctgggcgtggactggctgaccaggtatggctacctgcccccaccccacccagcccaggcccagctgcagagccctgagaagctgagagatgccatcaaggtgatgcagagatttgctggcctgcctgagaccggccgcatggaccccggcaccgtggccaccatgaggaagccccgctgcagcctgcctgatgtgctgggcgtggccggcctggtgagaagaagaagaagatatgccctgagcggctctgtgtggaagaagaggaccctgacctggagggtgcgctccttcccccagagcagccagctgagccaggagaccgtgcgggtgctgatgtcctatgccctgatggcctggggcatggagagcggcctgaccttccacgaggtggacagcccccagggccaggagccagacatcctgattgactttgcccgggccttccaccaggacagctacccctttgatggcctgggcggcaccctggcccacgccttcttccctggagagcaccccatcagcggggacacccactttgatgatgaggagacctggaccttcggcagcaaggatggagagggcacagacctgtttgctgtggccgtgcatgaatttggacatgccctgggcctgggccacagcagcgcccccaacagcatcatgaggcccttctaccagggccctgtgggggaccctgacaagtaccgcctgagccaggatgacagagatggcctgcagcagctgtatggcaaggccccccagaccccctatgacaagcccaccaggaagcccctggcccccccaccccagcccccagccagccccacccacagccccagcttccccatcccagacagatgtgagggcaactttgatgccatcgccaacatccggggggagaccttcttcttcaagggcccctggttctggaggctgcagcccagcggccagctggtgagccccaggcctgcccggctgcaccgcttctgggagggcctgcctgcccaggtgcgggtggtgcaggccgcctatgcccggcacagagatggccgcatcctgctcttcagcggcccccagttctgggtgttccaggaccggcagctggagggcggggcccggcccctgacagagctgggcctgcccccaggagaggaggtggatgctgtgttctcctggccccagaatggcaagacctacctggtgcggggccggcagtactggaggtatgatgaggccgccgcccggccagaccccggctacccccgggacctgagcctgtgggagggcgccccacccagcccagatgatgtgacagtgtccaatgctggggacacctacttcttcaagggggcccactactggaggttccccaagaacagcatcaagacagagccagatgccccccagcccatgggccccaactggctggactgcccagcccccagcagcggcccccgggccccccggccccccaaggccacccctgtgtctgagacctgtgactgccagtgtgagctgaaccaggccgccggccgctggccagcccccatccccctgctgctgctgcccctgctggtgggcggcgtggccagcaggtag

SEQ ID NO: 3663 - DNA, 786 bp, Artificial Sequence
  Description of Artificial Sequence: Synthetic coding sequence
atgcagctggtgatcctgcgggtgaccatcttcctgccctggtgctttgctgtgcctgtgcccccagctgctgaccacaagggctgggactttgtggagggctacttccaccagttcttcctgaccaagaaggagagccccctgctgacccaggagacccagacccagctgctgcagcagttccacagaaatggaacagacctgctggacatgcagatgcacgccctgctgcaccagccccactgcggcgtgcctgatggcagtgacaccagcatcagccctggccgctgcaagtggaacaagcacaccctgacctaccgcatcatcaactacccccatgacatgaagcccagcgctgtgaaggacagcatctacaatgctgtgtccatctggagcaatgtgacccccctcatcttccagcaggtgcagaatggagatgctgacatcaaggtgtccttctggcagtgggcccatgaagatggctggccctttgatggccctgggggcatcctgggccacgccttcctgcccaacagcggcaaccctggggtggtgcactttgacaagaatgagcactggagcgccagtgacaccggctacaacctcttcctggtggccacccatgagatcggccacagcctgggcctgcagcacagcggcaaccagagcagcatcatgtaccccacctactggtaccatgaccccaggaccttccagctgtctgcagatgacatccagaggatccagcacctgtatggagagaagtgcagcagtgacatcccctag

SEQ ID NO: 3664 - DNA, 786 bp, Artificial Sequence; identical to SEQ ID NO: 3663
  Description of Artificial Sequence: Synthetic coding sequence

SEQ ID NO: 3665 - DNA, 1542 bp, Artificial Sequence
  Description of Artificial Sequence: Synthetic coding sequence
atgaagaggctgctgctgctcttcctgttcttcatcaccttcagcagcgccttccccctggtgaggatgacagaaaatgaggagaacatgcagctggcccaggcctacctgaaccagttctacagcctggagattgagggcaaccacctggtgcagagcaagaacagaagcctgattgatgacaagatccgggagatgcaggccttcttcggcctgactgtgacaggcaagctggacagcaacaccctggagatcatgaagaccccccgctgtggggtgcctgatgtgggccagtatggctacaccctgcccggctggaggaagtacaacctgacctaccgcatcatcaactacaccccagacatggcccgggctgctgtggatgaggccatccaggagggcctggaggtgtggagcaaggtgacccccctgaagttcaccaagatcagcaaaggaattgctgacatcatgattgccttccgcaccagggtgcacggccgctgcccccgctactttgatggccccctgggcgtgctgggccacgccttccccccaggccctggcctgggcggggacacccactttgatgaagatgagaactggaccaaggatggagctggcttcaacctcttcctggtggccgcccacgagtttggccacgccctgggcctgagccacagcaatgaccagacagccctgatgttccccaactacgtgtccctggaccccaggaagtaccccctgagccaggatgacatcaatggcatccagagcatctacggcggcctgcccaaggagcccgccaagcccaaggagcccaccatcccccacgcctgtgaccctgacctgacctttgatgccatcaccaccttccggcgggaggtgatgttcttcaagggccgccacctgtggaggatctactatgacatcacagatgtggagtttgagctgattgccagcttctggcccagcctgcctgctgacctgcaggccgcctatgagaacccccgggacaagatcctggtgttcaaggatgagaacttctggatgatccggggctatgctgtgctgcctgactaccccaagagcatccacaccctgggcttccctggccgggtgaagaagattgatgctgctgtgtgtgacaagaccaccaggaagacctacttctttgtgggcatctggtgctggaggtttgatgagatgacccagaccatggacaagggcttcccccagagggtggtgaagcacttccctggcatcagcatccgggtggatgctgccttccagtacaagggcttcttcttcttcagccggggcagcaagcagtttgaatatgacatcaagaccaagaacatcacccgcatcatgaggaccaacacctggttccagtgcaaggagcccaagaacagcagctttggatttgacatcaacaaggagaaggcccacagcggcggcatcaagatcctgtaccacaagagcctgagcctcttcatcttcggcatcgtgcacctgctgaagaacaccagcatctaccagtag

SEQ ID NO: 3666 - DNA, 393 bp, Artificial Sequence
  Description of Artificial Sequence: Synthetic coding sequence
atggtggcccgggtgggcctgctgctgcgggccctgcagctgctgctgtggggccacctggatgcccagcctgctgagcggggcggccaggagctgaggaaggaggccgaggccttcctggagaagtatggctacctgaatgagcaggtgcccaaggcccccaccagcacccgcttcagtgatgccatccgggccttccagtgggtgtcccagctgcctgtgtctggagtgctggaccgggccaccctgcggcagatgacccggccccgctgtggggtgacagacaccaacagctatgctgcctgggccgagcgcatcagtgacctgtttgcccggcacaggaccaagatgaggaggaagaagagatttgccaagcagggcgagcactgctag

SEQ ID NO: 3667 - DNA, 1560 bp, Artificial Sequence
  Description of Artificial Sequence: Synthetic coding sequence
atggtggcccgggtgggcctgctgctgcgggccctgcagctgctgctgtggggccacctggatgcccagcctgctgagcggggcggccaggagctgaggaaggaggccgaggccttcctggagaagtatggctacctgaatgagcaggtgcccaaggcccccaccagcacccgcttcagtgatgccatccgggccttccagtgggtgtcccagctgcctgtgtctggagtgctggaccgggccaccctgcggcagatgacccggccccgctgtggggtgacagacaccaacagctatgctgcctgggccgagcgcatcagtgacctgtttgcccggcacaggaccaagatgaggaggaagaagagatttgccaagcagggcaacaagtggtacaagcagcacctgagctaccgcctggtgaactggccagagcaccctgagcctgctgtgagaggagctgtgcgggccgccttccagctgtggagcaatgtgtctgccctggagttctgggaggccccagccactggacctgctgacatccggctgaccttcttccagggcgaccacaatgatggcctgggcaatgcctttgatggccctgggggcgccctggcccacgccttcctgcccaggagaggagaggcccactttgaccaggatgagcgctggagcctgagcagaagaagaggaagaaacctgtttgtggtgctggcccatgaaattggccacaccctgggcctgacccacagccctgccccccgggccctgatggccccctactacaagaggctgggcagagatgccctgctgtcctgggatgatgtgctggccgtgcagagcctgtatggcaagcccctgggcggctctgtggccgtgcagctgcccgggaagctgttcacagactttgagacctgggacagctacagcccccagggcagaagacctgagacccagggccccaagtactgccacagcagctttgatgccatcaccgtggaccggcagcagcagctgtacatcttcaagggcagccacttctgggaggtggccgcagatggaaatgtgtctgagccccggcccctgcaggagcgctgggtgggcctgccccccaacatcgaggccgctgctgtgtccctgaatgatggagacttctacttcttcaagggcggccgctgctggaggttccggggccccaagcctgtgtggggcctgccccagctgtgccgggccggcggcctgcccaggcacccagatgctgccctcttcttcccccccctgcggcggctcatcctcttcaagggggcccgctactacgtgctggcccggggcggcctgcaggtggagccctactaccccaggagcctgcaggactggggcggcatccctgaggaggtgtctggggccctgcccaggccagatggcagcatcatcttcttcagagatgaccgctactggaggctggaccaggccaagctgcaggccaccaccagcggccgctgggccacagagctgccctggatgggctgctggcacgccaacagcggcagcgccctcttctag

SEQ ID NO: 3668 - DNA, 1179 bp, Artificial Sequence
  Description of Artificial Sequence: Synthetic coding sequence
atggtggcccgggtgggcctgctgctgcgggccctgcagctgctgctgtggggccacctggatgcccagcctgctgagcggggcggccaggagctgaggaaggaggccgaggccttcctggagaagtatggctacctgaatgagcaggtgcccaaggcccccaccagcacccgcttcagtgatgccatccgggccttccagtgggtgtcccagctgcctgtgtctggagtgctggaccgggccaccctgcggcagatgacccggccccgctgtggggtgacagacaccaacagctatgctgcctgggccgagcgcatcagtgacctgtttgcccggcacaggaccaagatgaggaggaagaagagatttgccaagcagggcaacaagtggtacaagcagcacctgagctaccgcctggtgaactggccagagcaccctgagcctgctgtgagaggagctgtgcgggccgccttccagctgtggagcaatgtgtctgccctggagttctgggaggccccagccactggacctgctgacatccggctgaccttcttccagggcgaccacaatgatggcctgggcaatgcctttgatggccctgggggcgccctggcccacgccttcctgcccaggagaggagaggcccactttgaccaggatgagcgctggagcctgagcagaagaagaggaagaaacctgtttgtggtgctggcccatgaaattggccacaccctgggcctgacccacagccctgccccccgggccctgatggccccctactacaagaggctgggcagagatgccctgctgtcctgggatgatgtgctggccgtgcagagcctgtatggcaagcccctgggcggctctgtggccgtgcagctgcccgggaagctgttcacagactttgagacctgggacagctacagcccccagggcagaagacctgagacccagggccccaagtactgccacagcagctttgatgccatcaccgtggaccggcagcagcagctgtacatcttcaagggcagccacttctgggaggtggccgcagatggaaatgtgtctgagccccggcccctgcaggagcgctgggtgggcctgccccccaacatcgaggccgctgctgtgtccctgaatgatggagacttctacttcttcaaggtgcagagcgtgtag

SEQ ID NO: 3669 - DNA, 678 bp, Artificial Sequence
  Description of Artificial Sequence: Synthetic coding sequence
atggtggcccgggtgggcctgctgctgcgggccctgcagctgctgctgtggggccacctggatgcccagcctgctgagcggggcggccaggagctgaggaaggaggccgaggccttcctggagaagtatggctacctgaatgagcaggtgcccaaggcccccaccagcacccgcttcagtgatgccatccgggccttccagtgggtgtcccagctgcctgtgtctggagtgctggaccgggccaccctgcggcagatgacccggccccgctgtggggtgacagacaccaacagctatgctgcctgggccgagcgcatcagtgacctgtttgcccggcacaggaccaagatgaggaggaagaagagatttgccaagcagggcaacaagtggtacaagcagcacctgagctaccgcctggtgaactggccagagcacctgcggagccggcagtttggagccccctgtgccccacccagcagctgtggggccaccagccagcgctggagcagcggccggccccagccccaggcccccctgaccagcggcagccccagcagcaagggcaccaccaccatgggctgggccatgcccctgatggcccagggcgccccctggaggacccccagctgcccagctgctgccaagaggaccagcaccaagatgtctgctggcccctag

SEQ ID NO: 3670 - DNA, 1404 bp, Artificial Sequence
  Description of Artificial Sequence: Synthetic coding sequence
atgttcagcctgaagaccctgcccttcctgctgctgctgcacgtgcagatcagcaaggccttccctgtgagcagcaaggagaagaacaccaagacagtgcaggactacctggagaagttctaccagctgcccagcaaccagtaccagagcaccaggaagaatggcaccaacgtgattgtggagaagctgaaggagatgcagcgcttcttcggcctgaatgtgacaggcaagcccaatgaggagaccctggacatgatgaagaagccccgctgtggggtgcctgacagcggcggcttcatgctgaccccaggcaaccccaagtgggagaggaccaacctgacctaccgcatccggaactacaccccccagctgtctgaggccgaggtggagcgggccatcaaggatgcctttgagctgtggagcgtggccagccccctcatcttcacccgcatcagccagggcgaggccgacatcaacatcgccttctaccagagggaccatggagacaacagcccctttgatggccccaacggcatcctggcccacgccttccagcccggccagggcattggaggagatgcccactttgatgctgaggagacctggaccaacaccagcgccaactacaacctcttcctggtggccgcccatgaatttggccacagcctgggcctggcccacagcagtgaccccggggccctgatgtaccccaactatgccttccgggagaccagcaactacagcctgccccaggatgacattgatggcatccaggccatctacggcctgagcagcaaccccatccagcccaccggccccagcacccccaagccctgtgaccccagcctgacctttgatgccatcaccaccctgcggggggagatcctcttcttcaaggaccgctacttctggaggaggcacccccagctgcagagggtggagatgaacttcatcagcctcttctggcccagcctgcccaccggcatccaggccgcctatgaggactttgaccgggacctgatcttcctgttcaagggcaaccagtactgggccctgagcggctatgacatcctgcagggctaccccaaggacatcagcaactacggcttccccagctctgtgcaggccattgatgctgctgtgttctaccgcagcaagacctacttctttgtgaatgaccagttctggaggtatgacaaccagaggcagttcatggagcccggctaccccaagagcatcagcggggccttccctggcatcgagagcaaggtggatgctgtgttccagcaggagcacttcttccacgtgttcagcggcccccgctactatgcctttgacctgattgcccagagggtgaccagggtggcccggggcaacaagtggctgaactgccgctatggatag

SEQ ID NO: 3671 - DNA, 918 bp, Artificial Sequence
  Description of Artificial Sequence: Synthetic coding sequence
atgcagcgcttcttcggcctgaatgtgacaggcaagcccaatgaggagaccctggacatgatgaagaagccccgctgtggggtgcctgattctgggggcttcatgctgaccccaggcaaccccaagtgggagaggaccaacctgacctaccgcatccggaactacaccccccagctgtctgaggccgaggtggagcgggccatcaaggatgcctttgagctgtggagcgtggccagccccctcatcttcacccgcatcagccagggcgaggccgacatcaacatcgccttctaccagagggaccacggggacaacagcccctttgatggccccaacggcatcctggcccacgccttccagcccggccagggcattggaggagatgcccactttgatgctgaggagacctggaccaacaccagcgccaactacaacctcttcctggtggccgcccacgagtttggccacagcctgggcctggcccacagcagtgaccccggggccctgatgtaccccaactatgccttccgggagaccagcaactacagcctgccccaggatgacattgatggcatccaggccatctacggcctgagcagcaaccccatccagcccaccggccccagcacccccaagccctgtgaccccagcctgacctttgatgccatcaccaccctgcggggggagatcctcttcttcaaggaccgctacttctggaggaggcacccccagctgcagagggtggagatgaacttcatcagcctcttctggcccagcctgcccaccggcatccaggccgcctatgaagattttgaccgggacctgatcttcctgttcaaggacatgatcaccaaggacaacagctggagccaggtgatccccaaggcctaccaggtgcccttcaggaaccgggagtag

SEQ ID NO: 3672 - DNA, 1284 bp, Artificial Sequence
  Description of Artificial Sequence: Synthetic coding sequence
atgcagcagatcccccaggagaagagcatcaatgactacctggagaagttctaccagctgcccagcaaccagtaccagagcaccaggaagaatggcaccaacgtcatcgtggagaagctgaaggagatgcagcgcttcttcggcctgaatgtgacaggcaagcccaatgaggagaccctggacatgatgaagaagccccgctgtggggtgcctgattctgggggcttcatgctgaccccaggcaaccccaagtgggagaggaccaacctgacctaccgcatccggaactacaccccccagctgtctgaggccgaggtggagcgggccatcaaggatgcctttgagctgtggagcgtggccagccccctcatcttcacccgcatcagccagggcgaggccgacatcaacatcgccttctaccagagggaccacggggacaacagcccctttgatggccccaacggcatcctggcccacgccttccagcccggccagggcattggaggagatgcccactttgatgctgaggagacctggaccaacaccagcgccaactacaacctcttcctggtggccgcccacgagtttggccacagcctgggcctggcccacagcagtgaccccggggccctgatgtaccccaactatgccttccgggagaccagcaactacagcctgccccaggatgacattgatggcatccaggccatctacggcctgagcagcaaccccatccagcccaccggccccagcacccccaagccctgtgaccccagcctgacctttgatgccatcaccaccctgcggggggagatcctcttcttcaaggaccgctacttctggaggaggcacccccagctgcagagggtggagatgaacttcatcagcctcttctggcccagcctgcccaccggcatccaggccgcctatgaagattttgaccgggacctgatcttcctgttcaagggcaaccagtactgggccctgagcggctatgacatcctgcagggctaccccaaggacatcagcaactacggcttccccagctctgtgcaggccattgatgctgctgtgttctaccgcagcaagacctacttctttgtgaatgaccagttctggaggtatgacaaccagaggcagttcatggagcccggctaccccaagagcatcagcggggccttccctggcatcgagagcaaggtggatgctgtgttccagcaggagcacttcttccacgtgttttctggcccccgctactatgcctttgacctgattgcccagtag

SEQ ID NO: 3673 - DNA, 954 bp, Artificial Sequence
  Description of Artificial Sequence: Synthetic coding sequence
atggctgtgcagggcagccagaggcggctgctgggcagcctgaacagcacccccacagccatcccccagctgggcctggccgccaaccagacaggagcccgctgcctggaggtgtccatcagtgatggcctcttcctgagcctgggcctggtgtccctggtggagaatgccctggtggtggccaccatcgccaagaacagaaacctgcacagccccatgtactgcttcatctgctgcctggccctgagtgacctgctggtgtctggcagcaatgtgctggagacagctgtgatcctgctgctggaggccggggccctggtggcccgggctgctgtgctgcagcagctggacaacgtgattgatgtgatcacctgcagctccatgctgagcagcctgtgcttcctgggcgccatcgctgtggaccgctacatcagcatcttctacgccctgcgctaccacagcatcgtgaccctgccccgggcccggcgggctgtggccgccatctgggtggcctctgtggtgttcagcaccctcttcatcgcctactatgaccacgtggccgtgctgctgtgcctggtggtgttcttcctggccatgctggtgctgatggctgtgctgtatgtgcacatgctggcccgggcctgccagcacgcccagggcatcgcccggctgcacaagaggcagaggcctgtgcaccagggcttcggcctgaagggagctgtgaccctgaccatcctgctgggcatcttcttcctgtgctggggccccttcttcctgcacctgaccctcatcgtgctgtgcccagagcaccccacctgtggctgcatcttcaagaacttcaacctcttcctggccctgatcatctgcaatgccatcatcgaccccctcatctatgccttccacagccaggagctgcggaggaccctgaaggaggtgctgacctgctcctggtag

SEQ ID NO: 3674 - DNA, 894 bp, Artificial Sequence
  Description of Artificial Sequence: Synthetic coding sequence
atgaagcacatcatcaacagctatgagaacatcaacaacacagccaggaacaacagcgactgcccccgggtggtgctgcctgaggagatcttcttcaccatcagcatcgtgggcgtgctggagaacctgattgtgctgctggccgtgttcaagaacaagaacctgcaggcccccatgtacttcttcatctgcagcctggccatcagtgacatgctgggcagcctgtacaagatcctggagaacatcctgatcatcctgaggaacatgggctacctgaagccccggggcagctttgagaccacagcagatgacatcatcgacagcctgtttgtgctgagcctgctgggcagcatcttcagcctgtctgtgattgctgctgaccgctacatcaccatcttccacgccctgcgctaccacagcatcgtgaccatgagaagaacagtggtggtgctgaccgtcatctggaccttctgcacaggaacaggcatcaccatggtgatcttcagccaccacgtgcccaccgtcatcaccttcaccagcctcttccccctgatgctggtgttcatcctgtgcctgtatgtgcacatgttcctgctggcccggagccacaccaggaagatcagcaccctgccccgggccaacatgaagggggccatcaccctgaccatcctgctgggcgtcttcatcttctgctgggccccctttgtgctgcacgtgctgctgatgaccttctgccccagcaacccctactgtgcctgctacatgagcctcttccaggtgaatggcatgctgatcatgtgcaatgctgtgattgaccccttcatctatgccttccgcagccctgagctgagagatgccttcaagaagatgatcttctgcagccgctactggtag

SEQ ID NO: 3675 - DNA, 894 bp, Artificial Sequence; identical to SEQ ID NO: 3674
  Description of Artificial Sequence: Synthetic coding sequence

SEQ ID NO: 3676 - DNA, 972 bp, Artificial Sequence
  Description of Artificial Sequence: Synthetic coding sequence
atgaatgccagctgctgcctgcccagcgtgcagcccaccctgcccaacggcagcgagcacctgcaggcccccttcttcagcaaccagagcagcagcgccttctgtgagcaggtgttcatcaagccagaggtgttcctgagcctgggcatcgtgtccctgctggagaacatcctggtgatcctggccgtggtgagaaatggaaacctgcacagccccatgtacttcttcctgtgcagcctggccgtggccgacatgctggtgtctgtgtccaatgccctggagaccatcatgattgccatcgtgcacagcgactacctgacctttgaggaccagttcatccagcacatggacaacatctttgacagcatgatctgcatcagcctggtggccagcatctgcaacctgctggccatcgctgtggacagatatgtgaccatcttctacgccctgcgctaccacagcatcatgacagtgaggaaggccctgaccctgattgtggccatctgggtgtgctgcggcgtgtgtggggtggtgttcatcgtgtacagcgagagcaagatggtgattgtgtgcctgatcaccatgttctttgccatgatgctgctgatgggcaccctgtatgtgcacatgttcctgtttgcccggctgcacgtgaagagaattgctgccctgcccccagcagatggagtggccccccagcagcacagctgcatgaagggagctgtgaccatcaccatcctgctgggcgtcttcatcttctgctgggcccccttcttcctgcacctggtgctgatcatcacctgccccaccaacccctactgcatctgctacacagcccacttcaacacctacctggtgctgatcatgtgcaacagcgtcatcgaccccctcatctatgccttccgcagcctggagctgaggaacaccttccgggagatcctgtgtggctgcaatggcatgaacctgggctag

SEQ ID NO: 3677 - DNA, 999 bp, Artificial Sequence
  Description of Artificial Sequence: Synthetic coding sequence
atggtgaacagcacccaccggggcatgcacaccagcctgcacctgtggaacagaagcagctaccgcctgcacagcaatgccagcgagagcctgggcaagggctacagtgatggcggctgctatgagcagctgtttgtgtccccagaggtgtttgtgaccctgggcgtcatcagcctgctggagaacatcctggtgattgtggccatcgccaagaacaagaacctgcacagccccatgtacttcttcatctgcagcctggccgtggccgacatgctggtgtctgtgtccaatggaagtgagaccatcgtcatcaccctgctgaacagcacagacacagatgcccagagcttcaccgtgaacatcgacaacgtgattgattctgtcatctgcagcagcctgctggccagcatctgcagcctgctgagcattgctgtggaccgctacttcaccatcttctacgccctgcagtaccacaacatcatgacagtgaagagggtgggcatcatcatcagctgcatctgggccgcctgcaccgtgtctggcatcctcttcatcatctacagcgacagcagcgctgtgatcatctgcctgatcaccatgttcttcaccatgctggccctgatggccagcctgtatgtgcacatgttcctgatggcccggctgcacatcaagagaattgctgtgctgcccggcaccggggccatccggcagggcgccaacatgaagggggccatcaccctgaccatcctgattggagtgtttgtggtgtgctgggcccccttcttcctgcacctgatcttctacatcagctgcccccagaacccctactgtgtgtgcttcatgagccacttcaacctgtacctgatcctgatcatgtgcaacagcatcatcgaccccctcatctatgccctgcggagccaggagctgaggaagaccttcaaggagatcatctgctgctaccccctgggcggcctgtgtgacctgagcagccgctactag

SEQ ID NO: 3678 - DNA, 978 bp, Artificial Sequence
  Description of Artificial Sequence: Synthetic coding sequence
atgaacagcagcttccacctgcacttcctggacctgaacctgaatgccacagagggcaacctgagcggccccaacgtgaagaacaagagcagcccctgtgaggacatgggcattgctgtggaggtgttcctgaccctgggcgtcatcagcctgctggagaacatcctggtgattggagccatcgtgaagaacaagaacctgcacagccccatgtacttctttgtgtgcagcctggccgtggccgacatgctggtgtccatgagcagcgcctgggagaccatcaccatctacctgctgaacaacaagcacctggtgattgctgatgcctttgtgcgccacatcgacaacgtgtttgacagcatgatctgcatctctgtggtggcctccatgtgcagcctgctggccatcgctgtggacagatatgtgaccatcttctacgccctgcgctaccaccacatcatgacagccaggagaagtggggccatcatcgccggcatctgggccttctgcaccggctgcggcatcgtgttcatcctgtacagcgagagcacctacgtgatcctgtgcctgatctccatgttctttgccatgctgttcctgctggtgtccctgtacatccacatgttcctgctggcccggacccacgtgaagagaattgctgccctgcccggggccagcagcgcccggcagaggacctccatgcagggcgctgtgacagtgaccatgctgctgggcgtcttcaccgtgtgctgggcccccttcttcctgcacctgaccctgatgctgagctgcccccagaacctgtactgcagccgcttcatgagccacttcaacatgtacctgatcctgatcatgtgcaacagcgtgatggaccccctcatctatgccttccgcagccaggagatgaggaagaccttcaaggagatcatctgctgccggggcttcagaattgcctgcagcttcccccggcgggactag

SEQ ID NO: 3679 - DNA, 1242 bp, Artificial Sequence
  Description of Artificial Sequence: Synthetic coding sequence
atgctggagatgctggagtacaaccactaccaggtgcagacccacctggagaaccccaccaagtaccacatccagcaggcccagaggcagcaggtgaagcagtacctgagcaccaccctggccaacaagcacgccaaccaggtgctgagcctgccctgccccaaccagcccggggaccacgtgatgcctcctgtgcccggcagcagcgcccccaacagccccatggccatgctgaccctgaacagcaactgtgagaaggagggcttctacaagtttgaggagcagaacagagctgagagtgaatgtcctggcatgaacacccacagccgggccagctgcatgcagatggatgatgtgattgatgacatcatcagcctggagagcagctacaatgaggagatcctgggcctgatggaccctgccctgcagatggccaacaccctgcctgtgtctggcaacctgattgacctgtatggcaaccagggcctgcccccacctggcctgaccatcagcaacagctgcccagccaacctgcccaacatcaagcgggagctgacagagagcgaggcccgggccctggccaaggagcggcagaagaaggacaaccacaacctgattgaaagaagaagacgcttcaacatcaatgaccgcatcaaggagctgggcaccctcatccccaagagcaatgaccctgacatgcgctggaacaagggcaccatcctgaaggcctctgtggactacatcaggaagctgcagcgggagcagcagagggccaaggagctggagaaccggcagaagaagctggagcacgccaacagacacctgctgctgcgcatccaggagctggagatgcaggcccgggcccacggcctgagcctcatccccagcacaggcctgtgcagcccagacctggtgaaccgcatcatcaagcaggagcctgtgctggagaactgcagccaggacctgctgcagcaccacgccgacctgacctgcaccaccaccctggacctgacagatggcaccatcaccttcaacaacaacctgggcaccggcacagaggccaaccaggcctacagcgtgcccaccaagatgggcagcaagctggaggacatcctgatggatgacaccctgagccctgtgggcgtgacagaccccctgctgagctctgtgtcccctggggccagcaagaccagcagccgccgcagctccatgtccatggaggagacagagcacacctgctag

SEQ ID NO: 3680 - DNA, 1515 bp, Artificial Sequence
  Description of Artificial Sequence: Synthetic coding sequence
atggaggccctgcgggtgcagatgttcatgccctgcagctttgagagcctgtacctgagcagcgctgagcaccctggggccagcaagccacccatcagcagcagctccatgaccagccgcatcctgctgcggcagcagctgatgagggagcagatgcaggagcaggagcggcgggagcagcagcagaagctgcaggccgcccagttcatgcagcagagggtgcctgtgtcccagaccccagccatcaacgtgtctgtgcccaccaccctgcccagcgccacccaggtgcccatggaggtgctgaaggtgcagacccacctggagaaccccaccaagtaccacatccagcaggcccagaggcagcaggtgaagcagtacctgagcaccaccctggccaacaagcacgccaaccaggtgctgagcctgccctgccccaaccagcccggggaccacgtgatgcctcctgtgcccggcagcagcgcccccaacagccccatggccatgctgaccctgaacagcaactgtgagaaggagggcttctacaagtttgaggagcagaacagagctgagagcgagtgccccggcatgaacacccacagccgggccagctgcatgcagatggatgatgtgattgatgacatcatcagcctggagagcagctacaatgaggagatcctgggcctgatggaccctgccctgcagatggccaacaccctgcctgtgtctggcaacctgattgacctgtatggcaaccagggcctgcccccacctggcctgaccatcagcaacagctgcccagccaacctgcccaacatcaagcgggagctgacagaaagtgaggcccgggccctggccaaggagcggcagaagaaggacaaccacaacctgattgaaagaagaagacgcttcaacatcaatgaccgcatcaaggagctgggcaccctcatccccaagagcaatgaccctgacatgcgctggaacaagggcaccatcctgaaggcctctgtggactacatcaggaagctgcagcgggagcagcagagggccaaggagctggagaaccggcagaagaagctggagcacgccaacagacacctgctgctgcgcatccaggagctggagatgcaggcccgggcccacggcctgagcctcatccccagcacaggcctgtgcagcccagacctggtgaaccgcatcatcaagcaggagcctgtgctggagaactgcagccaggacctgctgcagcaccacgccgacctgacctgcaccaccaccctggacctgacagatggcaccatcaccttcaacaacaacctgggcactggaacagaggccaaccaggcctacagcgtgcccaccaagatgggcagcaagctggaggacatcctgatggatgacaccctgagccctgtgggcgtgacagaccccctgctgagctctgtgtcccctggggccagcaagaccagcagcagaagaagctccatgtccatggaggagacagagcacacctgctag

SEQ ID NO: 3681 - DNA, 1560 bp, Artificial Sequence
  Description of Artificial Sequence: Synthetic coding sequence
atgggccacctggagaacacctctgtggtgttcccccgggccatcttcagcctgtgtgagaaggagaccaggaagctgaccctgtgcctcttcagccgcagcagcagcgctgagcaccctggggccagcaagccacccatcagcagcagctccatgaccagccgcatcctgctgcggcagcagctgatgagggagcagatgcaggagcaggagcggcgggagcagcagcagaagctgcaggccgcccagttcatgcagcagagggtgcctgtgtcccagaccccagccatcaacgtgtctgtgcccaccaccctgcccagcgccacccaggtgcccatggaggtgctgaaggtgcagacccacctggagaaccccaccaagtaccacatccagcaggcccagaggcagcaggtgaagcagtacctgagcaccaccctggccaacaagcacgccaaccaggtgctgagcctgccctgccccaaccagcccggggaccacgtgatgcctcctgtgcccggcagcagcgcccccaacagccccatggccatgctgaccctgaacagcaactgtgagaaggagggcttctacaagtttgaggagcagaacagagctgagagtgaatgtcctggcatgaacacccacagccgggccagctgcatgcagatggatgatgtgattgatgacatcatcagcctggagagcagctacaatgaggagatcctgggcctgatggaccctgccctgcagatggccaacaccctgcctgtgtctggcaacctgattgacctgtatggcaaccagggcctgcccccacctggcctgaccatcagcaacagctgcccagccaacctgcccaacatcaagcgggagctgacagagagcgaggcccgggccctggccaaggagcggcagaagaaggacaaccacaacctgattgaaagaagaagacgcttcaacatcaatgaccgcatcaaggagctgggcaccctcatccccaagagcaatgaccctgacatgcgctggaacaagggcaccatcctgaaggcctctgtggactacatcaggaagctgcagcgggagcagcagagggccaaggagctggagaaccggcagaagaagctggagcacgccaacagacacctgctgctgcgcatccaggagctggagatgcaggcccgggcccacggcctgagcctcatccccagcacaggcctgtgcagcccagacctggtgaaccgcatcatcaagcaggagcctgtgctggagaactgcagccaggacctgctgcagcaccacgccgacctgacctgcaccaccaccctggacctgacagatggcaccatcaccttcaacaacaacctgggcaccggcacagaggccaaccaggcctacagcgtgcccaccaagatgggcagcaagctggaggacatcctgatggatgacaccctgagccctgtgggcgtgacagaccccctgctgagctctgtgtcccctggggccagcaagaccagcagccgccgcagctccatgtccatggaggagacagagcacacctgctag

SEQ ID NO: 3682 - DNA, 1563 bp, Artificial Sequence
  Description of Artificial Sequence: Synthetic coding sequence
atgcagagcgagagcggcatcgtgcctgactttgaggtgggggaggagttccacgaggagcccaagacctactatgagctgaagagccagcccctgaagagcagcagcagcgctgagcaccctggggccagcaagccacccatcagcagcagctccatgaccagccgcatcctgctgcggcagcagctgatgagggagcagatgcaggagcaggagcggcgggagcagcagcagaagctgcaggccgcccagttcatgcagcagagggtgcctgtgtcccagaccccagccatcaacgtgtctgtgcccaccaccctgcccagcgccacccaggtgcccatggaggtgctgaaggtgcagacccacctggagaaccccaccaagtaccacatccagcaggcccagaggcagcaggtgaagcagtacctgagcaccaccctggccaacaagcacgccaaccaggtgctgagcctgccctgccccaaccagcccggggaccacgtgatgcctcctgtgcccggcagcagcgcccccaacagccccatggccatgctgaccctgaacagcaactgtgagaaggagggcttctacaagtttgaggagcagaacagagctgagagcgagtgccccggcatgaacacccacagccgggccagctgcatgcagatggatgatgtgattgatgacatcatcagcctggagagcagctacaatgaggagatcctgggcctgatggaccctgccctgcagatggccaacaccctgcctgtgtctggcaacctgattgacctgtatggcaaccagggcctgcccccacctggcctgaccatcagcaacagctgcccagccaacctgcccaacatcaagcgggagctgacagaaagtgaggcccgggccctggccaaggagcggcagaagaaggacaaccacaacctgattgaaagaagaagacgcttcaacatcaatgaccgcatcaaggagctgggcaccctcatccccaagagcaatgaccctgacatgcgctggaacaagggcaccatcctgaaggcctctgtggactacatcaggaagctgcagcgggagcagcagagggccaaggagctggagaaccggcagaagaagctggagcacgccaacagacacctgctgctgcgcatccaggagctggagatgcaggcccgggcccacggcctgagcctcatccccagcacaggcctgtgcagcccagacctggtgaaccgcatcatcaagcaggagcctgtgctggagaactgcagccaggacctgctgcagcaccacgccgacctgacctgcaccaccaccctggacctgacagatggcaccatcaccttcaacaacaacctgggcactggaacagaggccaaccaggcctacagcgtgcccaccaagatgggcagcaagctggaggacatcctgatggatgacaccctgagccctgtgggcgtgacagaccccctgctgagctctgtgtcccctggggccagcaagaccagcagcagaagaagctccatgtccatggaggagacagagcacacctgctag

SEQ ID NO: 3683 - DNA, 1260 bp, Artificial Sequence
  Description of Artificial Sequence: Synthetic coding sequence
atgctggagatgctggagtacaaccactaccaggtgcagacccacctggagaaccccaccaagtaccacatccagcaggcccagaggcagcaggtgaagcagtacctgagcaccaccctggccaacaagcacgccaaccaggtgctgagcctgccctgccccaaccagcccggggaccacgtgatgcctcctgtgcccggcagcagcgcccccaacagccccatggccatgctgaccctgaacagcaactgtgagaaggagggcttctacaagtttgaggagcagaacagagctgagagtgaatgtcctggcatgaacacccacagccgggccagctgcatgcagatggatgatgtgattgatgacatcatcagcctggagagcagctacaatgaggagatcctgggcctgatggaccctgccctgcagatggccaacaccctgcctgtgtctggcaacctgattgacctgtatggcaaccagggcctgcccccacctggcctgaccatcagcaacagctgcccagccaacctgcccaacatcaagcgggagctgacagcctgcatcttccccacagagagcgaggcccgggccctggccaaggagcggcagaagaaggacaaccacaacctgattgaaagaagaagacgcttcaacatcaatgaccgcatcaaggagctgggcaccctcatccccaagagcaatgaccctgacatgcgctggaacaagggcaccatcctgaaggcctctgtggactacatcaggaagctgcagcgggagcagcagagggccaaggagctggagaaccggcagaagaagctggagcacgccaacagacacctgctgctgcgcatccaggagctggagatgcaggcccgggcccacggcctgagcctcatccccagcacaggcctgtgcagcccagacctggtgaaccgcatcatcaagcaggagcctgtgctggagaactgcagccaggacctgctgcagcaccacgccgacctgacctgcaccaccaccctggacctgacagatggcaccatcaccttcaacaacaacctgggcaccggcacagaggccaaccaggcctacagcgtgcccaccaagatgggcagcaagctggaggacatcctgatggatgacaccctgagccctgtgggcgtgacagaccccctgctgagctctgtgtcccctggggccagcaagaccagcagccgccgcagctccatgtccatggaggagacagagcacacctgctag

SEQ ID NO: 3684 - DNA, 1488 bp, Artificial Sequence
  Description of Artificial Sequence: Synthetic coding sequence
atgctgtatgccttctggttcagccacagcagcagcgctgagcaccctggggccagcaagccacccatcagcagcagctccatgaccagccgcatcctgctgcggcagcagctgatgagggagcagatgcaggagcaggagcggcgggagcagcagcagaagctgcaggccgcccagttcatgcagcagagggtgcctgtgtcccagaccccagccatcaacgtgtctgtgcccaccaccctgcccagcgccacccaggtgcccatggaggtgctgaaggtgcagacccacctggagaaccccaccaagtaccacatccagcaggcccagaggcagcaggtgaagcagtacctgagcaccaccctggccaacaagcacgccaaccaggtgctgagcctgccctgccccaaccagcccggggaccacgtgatgcctcctgtgcccggcagcagcgcccccaacagccccatggccatgctgaccctgaacagcaactgtgagaaggagggcttctacaagtttgaggagcagaacagagctgagagtgaatgtcctggcatgaacacccacagccgggccagctgcatgcagatggatgatgtgattgatgacatcatcagcctggagagcagctacaatgaggagatcctgggcctgatggaccctgccctgcagatggccaacaccctgcctgtgtctggcaacctgattgacctgtatggcaaccagggcctgcccccacctggcctgaccatcagcaacagctgcccagccaacctgcccaacatcaagcgggagctgacagagagcgaggcccgggccctggccaaggagcggcagaagaaggacaaccacaacctgattgaaagaagaagacgcttcaacatcaatgaccgcatcaaggagctgggcaccctcatccccaagagcaatgaccctgacatgcgctggaacaagggcaccatcctgaaggcctctgtggactacatcaggaagctgcagcgggagcagcagagggccaaggagctggagaaccggcagaagaagctggagcacgccaacagacacctgctgctgcgcatccaggagctggagatgcaggcccgggcccacggcctgagcctcatccccagcacaggcctgtgcagcccagacctggtgaaccgcatcatcaagcaggagcctgtgctggagaactgcagccaggacctgctgcagcaccacgccgacctgacctgcaccaccaccctggacctgacagatggcaccatcaccttcaacaacaacctgggcaccggcacagaggccaaccaggcctacagcgtgcccaccaagatgggcagcaagctggaggacatcctgatggatgacaccctgagccctgtgggcgtgacagaccccctgctgagctctgtgtcccctggggccagcaagaccagcagccgccgcagctccatgtccatggaggagacagagcacacctgctag

SEQ ID NO: 3685 - DNA, 1581 bp, Artificial Sequence
  Description of Artificial Sequence: Synthetic coding sequence
atgcagagcgagagcggcatcgtgcctgactttgaggtgggggaggagttccacgaggagcccaagacctactatgagctgaagagccagcccctgaagagcagcagcagcgctgagcaccctggggccagcaagccacccatcagcagcagctccatgaccagccgcatcctgctgcggcagcagctgatgagggagcagatgcaggagcaggagcggcgggagcagcagcagaagctgcaggccgcccagttcatgcagcagagggtgcctgtgtcccagaccccagccatcaacgtgtctgtgcccaccaccctgcccagcgccacccaggtgcccatggaggtgctgaaggtgcagacccacctggagaaccccaccaagtaccacatccagcaggcccagaggcagcaggtgaagcagtacctgagcaccaccctggccaacaagcacgccaaccaggtgctgagcctgccctgccccaaccagcccggggaccacgtgatgcctcctgtgcccggcagcagcgcccccaacagccccatggccatgctgaccctgaacagcaactgtgagaaggagggcttctacaagtttgaggagcagaacagagctgagagcgagtgccccggcatgaacacccacagccgggccagctgcatgcagatggatgatgtgattgatgacatcatcagcctggagagcagctacaatgaggagatcctgggcctgatggaccctgccctgcagatggccaacaccctgcctgtgtctggcaacctgattgacctgtatggcaaccagggcctgcccccacctggcctgaccatcagcaacagctgcccagccaacctgcccaacatcaagcgggagctgacagcctgcatcttccccacagaaagtgaggcccgggccctggccaaggagcggcagaagaaggacaaccacaacctgattgaaagaagaagacgcttcaacatcaatgaccgcatcaaggagctgggcaccctcatccccaagagcaatgaccctgacatgcgctggaacaagggcaccatcctgaaggcctctgtggactacatcaggaagctgcagcgggagcagcagagggccaaggagctggagaaccggcagaagaagctggagcacgccaacagacacctgctgctgcgcatccaggagctggagatgcaggcccgggcccacggcctgagcctcatccccagcacaggcctgtgcagcccagacctggtgaaccgcatcatcaagcaggagcctgtgctggagaactgcagccaggacctgctgcagcaccacgccgacctgacctgcaccaccaccctggacctgacagatggcaccatcaccttcaacaacaacctgggcactggaacagaggccaaccaggcctacagcgtgcccaccaagatgggcagcaagctggaggacatcctgatggatgacaccctgagccctgtgggcgtgacagaccccctgctgagctctgtgtcccctggggccagcaagaccagcagcagaagaagctccatgtccatggaggagacagagcacacctgctag

SEQ ID NO: 3686 - DNA, 1086 bp, Artificial Sequence
  Description of Artificial Sequence: Synthetic coding sequence
atggaggccctgcgggtgcagatgttcatgccctgcagctttgagagcctgtacctgagcagcgctgagcaccctggggccagcaagccacccatcagcagcagctccatgaccagccgcatcctgctgcggcagcagctgatgagggagcagatgcaggagcaggagcggcgggagcagcagcagaagctgcaggccgcccagttcatgcagcagagggtgcctgtgtcccagaccccagccatcaacgtgtctgtgcccaccaccctgcccagcgccacccaggtgcccatggaggtgctgaaggtgcagacccacctggagaaccccaccaagtaccacatccagcaggcccagaggcagcaggtgaagcagtacctgagcaccaccctggccaacaagcacgccaaccaggtgctgagcctgccctgccccaaccagcccggggaccacgtgatgcctcctgtgcccggcagcagcgcccccaacagccccatggccatgctgaccctgaacagcaactgtgagaaggagggcttctacaagtttgaggagcagaacagagctgagagcgagtgccccggcatgaacacccacagccgggccagctgcatgcagatggatgatgtgattgatgacatcatcagcctggagagcagctacaatgaggagatcctgggcctgatggaccctgccctgcagatggccaacaccctgcctgtgtctggcaacctgattgacctgtatggcaaccagggcctgcccccacctggcctgaccatcagcaacagctgcccagccaacctgcccaacatcaagcgggagctgacagcctgcatcttccccacagaaagtgaggcccgggccctggccaaggagcggcagaagaaggacaaccacaacctgattgaaagaagaagacgcttcaacatcaatgaccgcatcaaggagctgggcaccctcatccccaagagcaatgaccctgacatgcgctggaacaagggcaccatcctgaaggcctctgtggactacatcaggaagctgcagcgggagcagcagagggccaaggagctggagaacagatag

SEQ ID NO: 3687 - DNA, 354 bp, Artificial Sequence
  Description of Artificial Sequence: Synthetic coding sequence
atgggccacctggagaacacctctgtggtgttcccccgggccatcttcagcctgtgtgagaaggagaccaggaagctgaccctgtgcctcttcagccgcagcagcagcgctgagcaccctggggccagcaagccacccatcagcagcagctccatgaccagccgcatcctgctgcggcagcagctgatgagggagcagatgcaggagcaggagcggcgggagcagcagcagaagctgcaggccgcccagttcatgcagcagagggtgcctgtgtcccagaccccagccatcaacgtgtctgtgcccaccaccctgcccagcgccacccaggtgcccatggaggtgctgaagtag

SEQ ID NO: 3688 - DNA, 1074 bp, Artificial Sequence
  Description of Artificial Sequence: Synthetic coding sequence
atgctggagatgctggagtacaaccactaccaggtgcagacccacctggagaaccccaccaagtaccacatccagcaggcccagaggcagcagggcttctacaagtttgaggagcagaacagagctgagagtgaatgtcctggcatgaacacccacagccgggccagctgcatgcagatggatgatgtgattgatgacatcatcagcctggagagcagctacaatgaggagatcctgggcctgatggaccctgccctgcagatggccaacaccctgcctgtgtctggcaacctgattgacctgtatggcaaccagggcctgcccccacctggcctgaccatcagcaacagctgcccagccaacctgcccaacatcaagcgggagctgacagagagcgaggcccgggccctggccaaggagcggcagaagaaggacaaccacaacctgattgaaagaagaagacgcttcaacatcaatgaccgcatcaaggagctgggcaccctcatccccaagagcaatgaccctgacatgcgctggaacaagggcaccatcctgaaggcctctgtggactacatcaggaagctgcagcgggagcagcagagggccaaggagctggagaaccggcagaagaagctggagcacgccaacagacacctgctgctgcgcatccaggagctggagatgcaggcccgggcccacggcctgagcctcatccccagcacaggcctgtgcagcccagacctggtgaaccgcatcatcaagcaggagcctgtgctggagaactgcagccaggacctgctgcagcaccacgccgacctgacctgcaccaccaccctggacctgacagatggcaccatcaccttcaacaacaacctgggcaccggcacagaggccaaccaggcctacagcgtgcccaccaagatgggcagcaagctggaggacatcctgatggatgacaccctgagccctgtgggcgtgacagaccccctgctgagctctgtgtcccctggggccagcaagaccagcagccgccgcagctccatgtccatggaggagacagagcacacctgctag

SEQ ID NO: 3689 - DNA, 1407 bp, Artificial Sequence
  Description of Artificial Sequence: Synthetic coding sequence
atgaccagccgcatcctgctgcggcagcagctgatgagggagcagatgcaggagcaggagcggcgggagcagcagcagaagctgcaggccgcccagttcatgcagcagagggtgcctgtgtcccagaccccagccatcaacgtgtctgtgcccaccaccctgcccagcgccacccaggtgcccatggaggtgctgaaggtgcagacccacctggagaaccccaccaagtaccacatccagcaggcccagaggcagcaggtgaagcagtacctgagcaccaccctggccaacaagcacgccaaccaggtgctgagcctgccctgccccaaccagcccggggaccacgtgatgcctcctgtgcccggcagcagcgcccccaacagccccatggccatgctgaccctgaacagcaactgtgagaaggagggcttctacaagtttgaggagcagaacagagctgagagcgagtgccccggcatgaacacccacagccgggccagctgcatgcagatggatgatgtgattgatgacatcatcagcctggagagcagctacaatgaggagatcctgggcctgatggaccctgccctgcagatggccaacaccctgcctgtgtctggcaacctgattgacctgtatggcaaccagggcctgcccccacctggcctgaccatcagcaacagctgcccagccaacctgcccaacatcaagcgggagctgacagaaagtgaggcccgggccctggccaaggagcggcagaagaaggacaaccacaacctgattgaaagaagaagacgcttcaacatcaatgaccgcatcaaggagctgggcaccctcatccccaagagcaatgaccctgacatgcgctggaacaagggcaccatcctgaaggcctctgtggactacatcaggaagctgcagcgggagcagcagagggccaaggagctggagaaccggcagaagaagctggagcacgccaacagacacctgctgctgcgcatccaggagctggagatgcaggcccgggcccacggcctgagcctcatccccagcacaggcctgtgcagcccagacctggtgaaccgcatcatcaagcaggagcctgtgctggagaactgcagccaggacctgctgcagcaccacgccgacctgacctgcaccaccaccctggacctgacagatggcaccatcaccttcaacaacaacctgggcactggaacagaggccaaccaggcctacagcgtgcccaccaagatgggcagcaagctggaggacatcctgatggatgacaccctgagccctgtgggcgtgacagaccccctgctgagctctgtgtcccctggggccagcaagaccagcagcagaagaagctccatgtccatggaggagacagagcacacctgctag

SEQ ID NO: 3690 - DNA, 4422 bp, Artificial Sequence
  Description of Artificial Sequence: Synthetic coding sequence
atggccggcggggcctggggccgcctggcctgctacctggagttcctgaagaaggaggagctgaaggagttccagctgctgctggccaacaaggcccacagccgcagcagcagcggggagaccccagcccagcctgagaagaccagcggcatggaggtggccagctacctggtggcccagtatggagagcagagggcctgggacctggccctgcacacctgggagcagatgggcctgcggagcctgtgtgcccaggcccaggagggcgccggccacagccccagcttcccctacagccccagcgagccccacctgggcagccccagccagcccaccagcacagctgtgctgatgccctggatccacgagctgcctgctggctgcacccagggcagcgagcggcgggtgctgcggcagctgcctgacaccagcggccgccgctggagggagatcagcgccagcctgctgtaccaggccctgcccagcagcccagaccacgagagccccagccaggagagccccaatgcccccaccagcacagctgtgctgggctcctggggcagccccccccagcccagcctggccccccgggagcaggaggcccctggcacccagtggcccctggatgagaccagcggcatctactacacagagatccgggagcgggagcgggagaagtctgagaagggccggcccccctgggccgctgtggtgggcaccccaccccaggcccacaccagcctgcagccccaccaccacccctgggagcccagcgtgcgggagagcctgtgcagcacctggccctggaagaatgaagacttcaaccagaagttcacccagctgctgctgctgcagaggccccaccccaggagccaggaccccctggtgaagaggtcctggccagactatgtggaggagaacagaggccacctgattgagatccgggacctgtttggacctggcctggacacccaggagcccagaattgtcatcctgcagggcgccgccggcatcggcaagagcaccctggcccggcaggtgaaggaggcctggggccggggccagctgtatggagaccgcttccagcacgtgttctacttcagctgccgggagctggcccagagcaaggtggtgtccctggccgagctgattggcaaggatggaacagccaccccagcccccatccggcagatcctgagcaggcctgagcggctgctcttcatcctggatggagtggatgagcccggctgggtgctgcaggagcccagcagcgagctgtgcctgcactggagccagccccagcctgcagatgccctgctgggcagcctgctgggcaagaccatcctgcctgaggccagcttcctgatcacagcccggaccacagccctgcagaacctgatccccagcctggagcaggcccgctgggtggaggtgctgggcttcagcgagagcagcaggaaggagtacttctaccgctacttcacagatgagcggcaggccatccgggccttccggctggtgaagagcaacaaggagctgtgggccctgtgcctggtgccctgggtgtcctggctggcctgcacctgcctgatgcagcagatgaagaggaaggagaagctgaccctgaccagcaagaccaccaccaccctgtgcctgcactacctggcccaggccctgcaggcccagcccctgggcccccagctgcgggacctgtgcagcctggccgctgagggcatctggcagaagaagaccctcttctccccagatgacctgaggaagcacggcctggatggagccatcatcagcaccttcctgaagatgggcatcctgcaggagcaccccatccccctgagctacagcttcatccacctgtgcttccaggagttctttgctgccatgtcctatgtgctggaggatgagaagggccggggcaagcacagcaactgcatcatcgacctggagaagaccctggaggcctacggcatccacggcctgtttggagccagcaccacccgcttcctgctgggcctgctgagtgatgaaggagagcgggagatggagaacatcttccactgccgcctgagccagggcaggaacctgatgcagtgggtgcccagcctgcagctgctgctgcagccccacagcctggagagcctgcactgcctgtatgagaccaggaacaagaccttcctgacccaggtgatggcccactttgaggagatgggcatgtgtgtggagacagacatggagctgctggtgtgcaccttctgcatcaagttcagcagacatgtgaagaagctgcagctgattgagggccggcagcacaggagcacctggagccccaccatggtggtgctcttccgctgggtgcctgtgacagatgcctactggcagatcctcttctctgtgctgaaggtgaccaggaacctgaaggagctggacctgagcggcaacagcctgagccacagcgctgtgaagagcctgtgcaagaccctgcggcggccccgctgcctgctggagaccctgcggctggccggctgcggcctgacagctgaggactgcaaggacctggccttcggcctgcgggccaaccagaccctgacagagctggacctgtccttcaacgtgctgacagatgctggggccaagcacctgtgccagaggctgcggcagcccagctgcaagctgcagaggctgcagctggtgtcctgtggcctgaccagtgactgctgccaggacctggcctctgtgctgagcgccagccccagcctgaaggagctggacctgcagcagaacaacctggatgatgtgggcgtgcggctgctgtgtgagggcctgcggcacccagcctgcaagctgatccggctgggcctggaccagaccaccctgagtgatgagatgaggcaggagctgcgggccctggagcaggagaagccccagctgctgatcttcagcaggaggaagcccagcgtgatgacccccacagagggcctggacaccggggagatgagcaacagcaccagcagcctgaagaggcagaggctgggcagcgagcgggccgccagccacgtggcccaggccaacctgaagctgctggatgtgtccaagatcttccccatcgccgagattgctgaggagagcagccctgaggtggtgcctgtggagctgctgtgtgtgcccagccctgccagccagggcgacctgcacaccaagcccctgggcacagatgatgacttctggggccccactggacctgtggccacagaggtggtggacaaggagaagaacctgtacagagtgcacttccctgtggccggcagctaccgctggcccaacacaggcctgtgctttgtgatgagggaggccgtgacagtggagattgagttctgtgtgtgggaccagttcctgggggagatcaacccccagcacagctggatggtggccggccccctgctggacatcaaggccgagcccggggctgtggaggccgtgcacctgccccactttgtggccctgcagggcggccacgtggacaccagcctcttccagatggcccacttcaaggaggagggcatgctgctggagaagccagcccgggtggagctgcaccacatcgtgctggagaaccccagcttcagccccctgggcgtgctgctgaagatgatccacaatgccctgcgcttcatccctgtgacctctgtggtgctgctgtaccaccgggtgcaccctgaggaggtgaccttccacctgtacctgatccccagcgactgcagcatcaggaaggccattgatgacctggagatgaagttccagtttgtgcgcatccacaagcccccacccctgacccccctgtacatgggctgccgctacacagtgtctggcagcggcagcggcatgctggagatcctgcccaaggagctggagctgtgctaccgcagccctggagaggaccagctgttcagcgagttctacgtgggccacctgggcagcggcatccggctgcaggtgaaggacaagaaggatgagaccctggtgtgggaggccctggtgaagccaggggacctgatgcctgccaccaccctcatccccccagccagaattgctgtgcccagccccctggatgccccccagctgctgcactttgtggaccagtaccgggagcagctgattgcccgggtgacctctgtggaggtggtgctggacaagctgcacggccaggtgctgagccaggagcagtatgagcgggtgctggccgagaacacccggcccagccagatgaggaagctgttcagcctgagccagagctgggacaggaagtgcaaggatggcctgtaccaggccctgaaggagacccacccccacctgatcatggagctgtgggagaagggcagcaagaagggcctgctgcccctgagcagctag

SEQ ID NO: 3691 - DNA, 4200 bp, Artificial Sequence
  Description of Artificial Sequence: Synthetic coding sequence
atggccggcggggcctggggccgcctggcctgctacctggagttcctgaagaaggaggagctgaaggagttccagctgctgctggccaacaaggcccacagccgcagcagcagcggggagaccccagcccagcctgagaagaccagcggcatggaggtggccagctacctggtggcccagtatggagagcagagggcctgggacctggccctgcacacctgggagcagatgggcctgcggagcctgtgtgcccaggcccaggagggcgccggccacagccccagcttcccctacagccccagcgagccccacctgggcagccccagccagcccaccagcacagctgtgctgatgccctggatccacgagctgcctgctggctgcacccagggcagcgagcggcgggtgctgcggcagctgcctgacaccagcggccgccgctggagggagatcagcgccagcctgctgtaccaggccctgcccagcagcccagaccacgagagccccagccaggagagccccaatgcccccaccagcacagctgtgctgggctcctggggcagccccccccagcccagcctggccccccgggagcaggaggcccctggcacccagtggcccctggatgagaccagcggcatctactacacagagatccgggagcgggagcgggagaagtctgagaagggccggcccccctgggccgctgtggtgggcaccccaccccaggcccacaccagcctgcagccccaccaccacccctgggagcccagcgtgcgggagagcctgtgcagcacctggccctggaagaatgaagacttcaaccagaagttcacccagctgctgctgctgcagaggccccaccccaggagccaggaccccctggtgaagaggtcctggccagactatgtggaggagaacagaggccacctgattgagatccgggacctgtttggacctggcctggacacccaggagcccagaattgtcatcctgcagggcgccgccggcatcggcaagagcaccctggcccggcaggtgaaggaggcctggggccggggccagctgtatggagaccgcttccagcacgtgttctacttcagctgccgggagctggcccagagcaaggtggtgtccctggccgagctgattggcaaggatggaacagccaccccagcccccatccggcagatcctgagcaggcctgagcggctgctcttcatcctggatggagtggatgagcccggctgggtgctgcaggagcccagcagcgagctgtgcctgcactggagccagccccagcctgcagatgccctgctgggcagcctgctgggcaagaccatcctgcctgaggccagcttcctgatcacagcccggaccacagccctgcagaacctgatccccagcctggagcaggcccgctgggtggaggtgctgggcttcagcgagagcagcaggaaggagtacttctaccgctacttcacagatgagcggcaggccatccgggccttccggctggtgaagagcaacaaggagctgtgggccctgtgcctggtgccctgggtgtcctggctggcctgcacctgcctgatgcagcagatgaagaggaaggagaagctgaccctgaccagcaagaccaccaccaccctgtgcctgcactacctggcccaggccctgcaggcccagcccctgggcccccagctgcgggacctgtgcagcctggccgctgagggcatctggcagaagaagaccctcttctccccagatgacctgaggaagcacggcctggatggagccatcatcagcaccttcctgaagatgggcatcctgcaggagcaccccatccccctgagctacagcttcatccacctgtgcttccaggagttctttgctgccatgtcctatgtgctggaggatgagaagggccggggcaagcacagcaactgcatcatcgacctggagaagaccctggaggcctacggcatccacggcctgtttggagccagcaccacccgcttcctgctgggcctgctgagtgatgaaggagagcgggagatggagaacatcttccactgccgcctgagccagggcaggaacctgatgcagtgggtgcccagcctgcagctgctgctgcagccccacagcctggagagcctgcactgcctgtatgagaccaggaacaagaccttcctgacccaggtgatggcccactttgaggagatgggcatgtgtgtggagacagacatggagctgctggtgtgcaccttctgcatcaagttcagcagacatgtgaagaagctgcagctgattgagggccggcagcacaggagcacctggagccccaccatggtggtgctcttccgctgggtgcctgtgacagatgcctactggcagatcctcttctctgtgctgaaggtgaccaggaacctgaaggagctggacctgagcggcaacagcctgagccacagcgctgtgaagagcctgtgcaagaccctgcggcggccccgctgcctgctggagaccctgcggctggccggctgcggcctgacagctgaggactgcaaggacctggccttcggcctgcgggccaaccagaccctgacagagctggacctgtccttcaacgtgctgacagatgctggggccaagcacctgtgccagaggctgcggcagcccagctgcaagctgcagaggctgcagctggtgtcctgtggcctgaccagtgactgctgccaggacctggcctctgtgctgagcgccagccccagcctgaaggagctggacctgcagcagaacaacctggatgatgtgggcgtgcggctgctgtgtgagggcctgcggcacccagcctgcaagctgatccggctgggcaagcccagcgtgatgacccccacagagggcctggacaccggggagatgagcaacagcaccagcagcctgaagaggcagaggctgggcagcgagcgggccgccagccacgtggcccaggccaacctgaagctgctggatgtgtccaagatcttccccatcgccgagattgctgaggagagcagccctgaggtggtgcctgtggagctgctgtgtgtgcccagccctgccagccagggcgacctgcacaccaagcccctgggcacagatgatgacttctggggccccactggacctgtggccacagaggtggtggacaaggagaagaacctgtacagagtgcacttccctgtggccggcagctaccgctggcccaacacaggcctgtgctttgtgatgagggaggccgtgacagtggagattgagttctgtgtgtgggaccagttcctgggggagatcaacccccagcacagctggatggtggccggccccctgctggacatcaaggccgagcccggggctgtggaggccgtgcacctgccccactttgtggccctgcagggcggccacgtggacaccagcctcttccagatggcccacttcaaggaggagggcatgctgctggagaagccagcccgggtggagctgcaccacatcgtgctggagaaccccagcttcagccccctgggcgtgctgctgaagatgatccacaatgccctgcgcttcatccctgtgacctctgtggtgctgctgtaccaccgggtgcaccctgaggaggtgaccttccacctgtacctgatccccagcgactgcagcatcaggaaggagctggagctgtgctaccgcagccctggagaggaccagctgttcagcgagttctacgtgggccacctgggcagcggcatccggctgcaggtgaaggacaagaaggatgagaccctggtgtgggaggccctggtgaagccaggggacctgatgcctgccaccaccctcatccccccagccagaattgctgtgcccagccccctggatgccccccagctgctgcactttgtggaccagtaccgggagcagctgattgcccgggtgacctctgtggaggtggtgctggacaagctgcacggccaggtgctgagccaggagcagtatgagcgggtgctggccgagaacacccggcccagccagatgaggaagctgttcagcctgagccagagctgggacaggaagtgcaaggatggcctgtaccaggccctgaaggagacccacccccacctgatcatggagctgtgggagaagggcagcaagaagggcctgctgcccctgagcagctag

SEQ ID NO: 3692 - DNA, 4128 bp, Artificial Sequence
  Description of Artificial Sequence: Synthetic coding sequence
atggccggcggggcctggggccgcctggcctgctacctggagttcctgaagaaggaggagctgaaggagttccagctgctgctggccaacaaggcccacagccgcagcagcagcggggagaccccagcccagcctgagaagaccagcggcatggaggtggccagctacctggtggcccagtatggagagcagagggcctgggacctggccctgcacacctgggagcagatgggcctgcggagcctgtgtgcccaggcccaggagggcgccggccacagccccagcttcccctacagccccagcgagccccacctgggcagccccagccagcccaccagcacagctgtgctgatgccctggatccacgagctgcctgctggctgcacccagggcagcgagcggcgggtgctgcggcagctgcctgacaccagcggccgccgctggagggagatcagcgccagcctgctgtaccaggccctgcccagcagcccagaccacgagagccccagccaggagagccccaatgcccccaccagcacagctgtgctgggctcctggggcagccccccccagcccagcctggccccccgggagcaggaggcccctggcacccagtggcccctggatgagaccagcggcatctactacacagagatccgggagcgggagcgggagaagtctgagaagggccggcccccctgggccgctgtggtgggcaccccaccccaggcccacaccagcctgcagccccaccaccacccctgggagcccagcgtgcgggagagcctgtgcagcacctggccctggaagaatgaagacttcaaccagaagttcacccagctgctgctgctgcagaggccccaccccaggagccaggaccccctggtgaagaggtcctggccagactatgtggaggagaacagaggccacctgattgagatccgggacctgtttggacctggcctggacacccaggagcccagaattgtcatcctgcagggcgccgccggcatcggcaagagcaccctggcccggcaggtgaaggaggcctggggccggggccagctgtatggagaccgcttccagcacgtgttctacttcagctgccgggagctggcccagagcaaggtggtgtccctggccgagctgattggcaaggatggaacagccaccccagcccccatccggcagatcctgagcaggcctgagcggctgctcttcatcctggatggagtggatgagcccggctgggtgctgcaggagcccagcagcgagctgtgcctgcactggagccagccccagcctgcagatgccctgctgggcagcctgctgggcaagaccatcctgcctgaggccagcttcctgatcacagcccggaccacagccctgcagaacctgatccccagcctggagcaggcccgctgggtggaggtgctgggcttcagcgagagcagcaggaaggagtacttctaccgctacttcacagatgagcggcaggccatccgggccttccggctggtgaagagcaacaaggagctgtgggccctgtgcctggtgccctgggtgtcctggctggcctgcacctgcctgatgcagcagatgaagaggaaggagaagctgaccctgaccagcaagaccaccaccaccctgtgcctgcactacctggcccaggccctgcaggcccagcccctgggcccccagctgcgggacctgtgcagcctggccgctgagggcatctggcagaagaagaccctcttctccccagatgacctgaggaagcacggcctggatggagccatcatcagcaccttcctgaagatgggcatcctgcaggagcaccccatccccctgagctacagcttcatccacctgtgcttccaggagttctttgctgccatgtcctatgtgctggaggatgagaagggccggggcaagcacagcaactgcatcatcgacctggagaagaccctggaggcctacggcatccacggcctgtttggagccagcaccacccgcttcctgctgggcctgctgagtgatgaaggagagcgggagatggagaacatcttccactgccgcctgagccagggcaggaacctgatgcagtgggtgcccagcctgcagctgctgctgcagccccacagcctggagagcctgcactgcctgtatgagaccaggaacaagaccttcctgacccaggtgatggcccactttgaggagatgggcatgtgtgtggagacagacatggagctgctggtgtgcaccttctgcatcaagttcagcagacatgtgaagaagctgcagctgattgagggccggcagcacaggagcacctggagccccaccatggtggtgctcttccgctgggtgcctgtgacagatgcctactggcagatcctcttctctgtgctgaaggtgaccaggaacctgaaggagctggacctgagcggcaacagcctgagccacagcgctgtgaagagcctgtgcaagaccctgcggcggccccgctgcctgctggagaccctgcggctggccggctgcggcctgacagctgaggactgcaaggacctggccttcggcctgcgggccaaccagaccctgacagagctggacctgtccttcaacgtgctgacagatgctggggccaagcacctgtgccagaggctgcggcagcccagctgcaagctgcagaggctgcagctggtgtcctgtggcctgaccagtgactgctgccaggacctggcctctgtgctgagcgccagccccagcctgaaggagctggacctgcagcagaacaacctggatgatgtgggcgtgcggctgctgtgtgagggcctgcggcacccagcctgcaagctgatccggctgggcctggaccagaccaccctgagtgatgagatgaggcaggagctgcgggccctggagcaggagaagccccagctgctgatcttcagcaggaggaagcccagcgtgatgacccccacagagggcctggacaccggggagatgagcaacagcaccagcagcctgaagaggcagaggctgggcagcgagcgggccgccagccacgtggcccaggccaacctgaagctgctggatgtgtccaagatcttccccatcgccgagattgctgggaagagccatgaggagagcagccctgaggtggtgcctgtggagctgctgtgtgtgcccagccctgccagccagggcgacctgcacaccaagcccctgggcacagatgatgacttctggggccccactggacctgtggccacagaggtggtggacaaggagaagaacctgtacagagtgcacttccctgtggccggcagctaccgctggcccaacacaggcctgtgctttgtgatgagggaggccgtgacagtggagattgagttctgtgtgtgggaccagttcctgggggagatcaacccccagcacagctggatggtggccggccccctgctggacatcaaggccgagcccggggctgtggaggccgtgcacctgccccactttgtggccctgcagggcggccacgtggacaccagcctcttccagatggcccacttcaaggaggagggcatgctgctggagaagccagcccgggtggagctgcaccacatcgtgctggagaaccccagcttcagccccctgggcgtgctgctgaagatgatccacaatgccctgcgcttcatccctgtgacctctgtggtgctgctgtaccaccgggtgcaccctgaggaggtgaccttccacctgtacctgatccccagcgactgcagcatcaggaaggccattgatgacctggagatgaagttccagtttgtgcgcatccacaagcccccacccctgacccccctgtacatgggctgccgctacacagtgtctggcagcggcagcggcatgctggagatcctgcccaaggagctggagctgtgctaccgcagccctggagaggaccagctgttcagcgagttctacgtgggccacctgggcagcggcatccggctgcaggtgaaggacaagaaggatgagaccctggtgtgggaggccctggtgaagccaggcaggaacaccagccagccctggaacctgcgctgcaacagagatgcccggcgctactag

SEQ ID NO: 3693 - DNA, 4422 bp, Artificial Sequence; identical to SEQ ID NO: 3690
  Description of Artificial Sequence: Synthetic coding sequence

SEQ ID NO: 3694 - DNA, 4290 bp, Artificial Sequence
  Description of Artificial Sequence: Synthetic coding sequence
atggccggcggggcctggggccgcctggcctgctacctggagttcctgaagaaggaggagctgaaggagttccagctgctgctggccaacaaggcccacagccgcagcagcagcggggagaccccagcccagcctgagaagaccagcggcatggaggtggccagctacctggtggcccagtatggagagcagagggcctgggacctggccctgcacacctgggagcagatgggcctgcggagcctgtgtgcccaggcccaggagggcgccggccacagccccagcttcccctacagccccagcgagccccacctgggcagccccagccagcccaccagcacagctgtgctgatgccctggatccacgagctgcctgctggctgcacccagggcagcgagcggcgggtgctgcggcagctgcctgacaccagcggccgccgctggagggagatcagcgccagcctgctgtaccaggccctgcccagcagcccagaccacgagagccccagccaggagagccccaatgcccccaccagcacagctgtgctgggctcctggggcagccccccccagcccagcctggccccccgggagcaggaggcccctggcacccagtggcccctggatgagaccagcggcatctactacacagagatccgggagcgggagcgggagaagtctgagaagggccggcccccctgggccgctgtggtgggcaccccaccccaggcccacaccagcctgcagccccaccaccacccctgggagcccagcgtgcgggagagcctgtgcagcacctggccctggaagaatgaagacttcaaccagaagttcacccagctgctgctgctgcagaggccccaccccaggagccaggaccccctggtgaagaggtcctggccagactatgtggaggagaacagaggccacctgattgagatccgggacctgtttggacctggcctggacacccaggagcccagaattgtcatcctgcagggcgccgccggcatcggcaagagcaccctggcccggcaggtgaaggaggcctggggccggggccagctgtatggagaccgcttccagcacgtgttctacttcagctgccgggagctggcccagagcaaggtggtgtccctggccgagctgattggcaaggatggaacagccaccccagcccccatccggcagatcctgagcaggcctgagcggctgctcttcatcctggatggagtggatgagcccggctgggtgctgcaggagcccagcagcgagctgtgcctgcactggagccagccccagcctgcagatgccctgctgggcagcctgctgggcaagaccatcctgcctgaggccagcttcctgatcacagcccggaccacagccctgcagaacctgatccccagcctggagcaggcccgctgggtggaggtgctgggcttcagcgagagcagcaggaaggagtacttctaccgctacttcacagatgagcggcaggccatccgggccttccggctggtgaagagcaacaaggagctgtgggccctgtgcctggtgccctgggtgtcctggctggcctgcacctgcctgatgcagcagatgaagaggaaggagaagctgaccctgaccagcaagaccaccaccaccctgtgcctgcactacctggcccaggccctgcaggcccagcccctgggcccccagctgcgggacctgtgcagcctggccgctgagggcatctggcagaagaagaccctcttctccccagatgacctgaggaagcacggcctggatggagccatcatcagcaccttcctgaagatgggcatcctgcaggagcaccccatccccctgagctacagcttcatccacctgtgcttccaggagttctttgctgccatgtcctatgtgctggaggatgagaagggccggggcaagcacagcaactgcatcatcgacctggagaagaccctggaggcctacggcatccacggcctgtttggagccagcaccacccgcttcctgctgggcctgctgagtgatgaaggagagcgggagatggagaacatcttccactgccgcctgagccagggcaggaacctgatgcagtgggtgcccagcctgcagctgctgctgcagccccacagcctggagagcctgcactgcctgtatgagaccaggaacaagaccttcctgacccaggtgatggcccactttgaggagatgggcatgtgtgtggagacagacatggagctgctggtgtgcaccttctgcatcaagttcagcagacatgtgaagaagctgcagctgattgagggccggcagcacaggagcacctggagccccaccatggtggtgctcttccgctgggtgcctgtgacagatgcctactggcagatcctcttctctgtgctgaaggtgaccaggaacctgaaggagctggacctgagcggcaacagcctgagccacagcgctgtgaagagcctgtgcaagaccctgcggcggccccgctgcctgctggagaccctgcggctggccggctgcggcctgacagctgaggactgcaaggacctggccttcggcctgcgggccaaccagaccctgacagagctggacctgtccttcaacgtgctgacagatgctggggccaagcacctgtgccagaggctgcggcagcccagctgcaagctgcagaggctgcagctggtgtcctgtggcctgaccagtgactgctgccaggacctggcctctgtgctgagcgccagccccagcctgaaggagctggacctgcagcagaacaacctggatgatgtgggcgtgcggctgctgtgtgagggcctgcggcacccagcctgcaagctgatccggctgggcctggaccagaccaccctgagtgatgagatgaggcaggagctgcgggccctggagcaggagaagccccagctgctgatcttcagcaggaggaagcccagcgtgatgacccccacagagggcctggacaccggggagatgagcaacagcaccagcagcctgaagaggcagaggctgggcagcgagcgggccgccagccacgtggcccaggccaacctgaagctgctggatgtgtccaagatcttccccatcgccgagattgctgaggagagcagccctgaggtggtgcctgtggagctgctgtgtgtgcccagccctgccagccagggcgacctgcacaccaagcccctgggcacagatgatgacttctggggccccactggacctgtggccacagaggtggtggacaaggagaagaacctgtacagagtgcacttccctgtggccggcagctaccgctggcccaacacaggcctgtgctttgtgatgagggaggccgtgacagtggagattgagttctgtgtgtgggaccagttcctgggggagatcaacccccagcacagctggatggtggccggccccctgctggacatcaaggccgagcccggggctgtggaggccgtgcacctgccccactttgtggccctgcagggcggccacgtggacaccagcctcttccagatggcccacttcaaggaggagggcatgctgctggagaagccagcccgggtggagctgcaccacatcgtgctggagaaccccagcttcagccccctgggcgtgctgctgaagatgatccacaatgccctgcgcttcatccctgtgacctctgtggtgctgctgtaccaccgggtgcaccctgaggaggtgaccttccacctgtacctgatccccagcgactgcagcatcaggaaggagctggagctgtgctaccgcagccctggagaggaccagctgttcagcgagttctacgtgggccacctgggcagcggcatccggctgcaggtgaaggacaagaaggatgagaccctggtgtgggaggccctggtgaagccaggggacctgatgcctgccaccaccctcatccccccagccagaattgctgtgcccagccccctggatgccccccagctgctgcactttgtggaccagtaccgggagcagctgattgcccgggtgacctctgtggaggtggtgctggacaagctgcacggccaggtgctgagccaggagcagtatgagcgggtgctggccgagaacacccggcccagccagatgaggaagctgttcagcctgagccagagctgggacaggaagtgcaaggatggcctgtaccaggccctgaaggagacccacccccacctgatcatggagctgtgggagaagggcagcaagaagggcctgctgcccctgagcagctag

SEQ ID NO: 3695 - DNA, 4332 bp, Artificial Sequence
  Description of Artificial Sequence: Synthetic coding sequence
atggccggcggggcctggggccgcctggcctgctacctggagttcctgaagaaggaggagctgaaggagttccagctgctgctggccaacaaggcccacagccgcagcagcagcggggagaccccagcccagcctgagaagaccagcggcatggaggtggccagctacctggtggcccagtatggagagcagagggcctgggacctggccctgcacacctgggagcagatgggcctgcggagcctgtgtgcccaggcccaggagggcgccggccacagccccagcttcccctacagccccagcgagccccacctgggcagccccagccagcccaccagcacagctgtgctgatgccctggatccacgagctgcctgctggctgcacccagggcagcgagcggcgggtgctgcggcagctgcctgacaccagcggccgccgctggagggagatcagcgccagcctgctgtaccaggccctgcccagcagcccagaccacgagagccccagccaggagagccccaatgcccccaccagcacagctgtgctgggctcctggggcagccccccccagcccagcctggccccccgggagcaggaggcccctggcacccagtggcccctggatgagaccagcggcatctactacacagagatccgggagcgggagcgggagaagtctgagaagggccggcccccctgggccgctgtggtgggcaccccaccccaggcccacaccagcctgcagccccaccaccacccctgggagcccagcgtgcgggagagcctgtgcagcacctggccctggaagaatgaagacttcaaccagaagttcacccagctgctgctgctgcagaggccccaccccaggagccaggaccccctggtgaagaggtcctggccagactatgtggaggagaacagaggccacctgattgagatccgggacctgtttggacctggcctggacacccaggagcccagaattgtcatcctgcagggcgccgccggcatcggcaagagcaccctggcccggcaggtgaaggaggcctggggccggggccagctgtatggagaccgcttccagcacgtgttctacttcagctgccgggagctggcccagagcaaggtggtgtccctggccgagctgattggcaaggatggaacagccaccccagcccccatccggcagatcctgagcaggcctgagcggctgctcttcatcctggatggagtggatgagcccggctgggtgctgcaggagcccagcagcgagctgtgcctgcactggagccagccccagcctgcagatgccctgctgggcagcctgctgggcaagaccatcctgcctgaggccagcttcctgatcacagcccggaccacagccctgcagaacctgatccccagcctggagcaggcccgctgggtggaggtgctgggcttcagcgagagcagcaggaaggagtacttctaccgctacttcacagatgagcggcaggccatccgggccttccggctggtgaagagcaacaaggagctgtgggccctgtgcctggtgccctgggtgtcctggctggcctgcacctgcctgatgcagcagatgaagaggaaggagaagctgaccctgaccagcaagaccaccaccaccctgtgcctgcactacctggcccaggccctgcaggcccagcccctgggcccccagctgcgggacctgtgcagcctggccgctgagggcatctggcagaagaagaccctcttctccccagatgacctgaggaagcacggcctggatggagccatcatcagcaccttcctgaagatgggcatcctgcaggagcaccccatccccctgagctacagcttcatccacctgtgcttccaggagttctttgctgccatgtcctatgtgctggaggatgagaagggccggggcaagcacagcaactgcatcatcgacctggagaagaccctggaggcctacggcatccacggcctgtttggagccagcaccacccgcttcctgctgggcctgctgagtgatgaaggagagcgggagatggagaacatcttccactgccgcctgagccagggcaggaacctgatgcagtgggtgcccagcctgcagctgctgctgcagccccacagcctggagagcctgcactgcctgtatgagaccaggaacaagaccttcctgacccaggtgatggcccactttgaggagatgggcatgtgtgtggagacagacatggagctgctggtgtgcaccttctgcatcaagttcagcagacatgtgaagaagctgcagctgattgagggccggcagcacaggagcacctggagccccaccatggtggtgctcttccgctgggtgcctgtgacagatgcctactggcagatcctcttctctgtgctgaaggtgaccaggaacctgaaggagctggacctgagcggcaacagcctgagccacagcgctgtgaagagcctgtgcaagaccctgcggcggccccgctgcctgctggagaccctgcggctggccggctgcggcctgacagctgaggactgcaaggacctggccttcggcctgcgggccaaccagaccctgacagagctggacctgtccttcaacgtgctgacagatgctggggccaagcacctgtgccagaggctgcggcagcccagctgcaagctgcagaggctgcagctggtgtcctgtggcctgaccagtgactgctgccaggacctggcctctgtgctgagcgccagccccagcctgaaggagctggacctgcagcagaacaacctggatgatgtgggcgtgcggctgctgtgtgagggcctgcggcacccagcctgcaagctgatccggctgggcaagcccagcgtgatgacccccacagagggcctggacaccggggagatgagcaacagcaccagcagcctgaagaggcagaggctgggcagcgagcgggccgccagccacgtggcccaggccaacctgaagctgctggatgtgtccaagatcttccccatcgccgagattgctgaggagagcagccctgaggtggtgcctgtggagctgctgtgtgtgcccagccctgccagccagggcgacctgcacaccaagcccctgggcacagatgatgacttctggggccccactggacctgtggccacagaggtggtggacaaggagaagaacctgtacagagtgcacttccctgtggccggcagctaccgctggcccaacacaggcctgtgctttgtgatgagggaggccgtgacagtggagattgagttctgtgtgtgggaccagttcctgggggagatcaacccccagcacagctggatggtggccggccccctgctggacatcaaggccgagcccggggctgtggaggccgtgcacctgccccactttgtggccctgcagggcggccacgtggacaccagcctcttccagatggcccacttcaaggaggagggcatgctgctggagaagccagcccgggtggagctgcaccacatcgtgctggagaaccccagcttcagccccctgggcgtgctgctgaagatgatccacaatgccctgcgcttcatccctgtgacctctgtggtgctgctgtaccaccgggtgcaccctgaggaggtgaccttccacctgtacctgatccccagcgactgcagcatcaggaaggccattgatgacctggagatgaagttccagtttgtgcgcatccacaagcccccacccctgacccccctgtacatgggctgccgctacacagtgtctggcagcggcagcggcatgctggagatcctgcccaaggagctggagctgtgctaccgcagccctggagaggaccagctgttcagcgagttctacgtgggccacctgggcagcggcatccggctgcaggtgaaggacaagaaggatgagaccctggtgtgggaggccctggtgaagccaggggacctgatgcctgccaccaccctcatccccccagccagaattgctgtgcccagccccctggatgccccccagctgctgcactttgtggaccagtaccgggagcagctgattgcccgggtgacctctgtggaggtggtgctggacaagctgcacggccaggtgctgagccaggagcagtatgagcgggtgctggccgagaacacccggcccagccagatgaggaagctgttcagcctgagccagagctgggacaggaagtgcaaggatggcctgtaccaggccctgaaggagacccacccccacctgatcatggagctgtgggagaagggcagcaagaagggcctgctgcccctgagcagctag

SEQ ID NO: 3696 - DNA, 1527 bp, Artificial Sequence
  Description of Artificial Sequence: Synthetic coding sequence
atggcccactttgaggagatgggcatgtgtgtggagacagacatggagctgctggtgtgcaccttctgcatcaagttcagcagacatgtgaagaagctgcagctgattgagggccggcagcacaggagcacctggagccccaccatggtggtgctcttccgctgggtgcctgtgacagatgcctactggcagatcctcttctctgtgctgaaggtgaccaggaacctgaaggagctggacctgagcggcaacagcctgagccacagcgctgtgaagagcctgtgcaagaccctgcggcggccccgctgcctgctggagaccctgcggctggccggctgcggcctgacagctgaggactgcaaggacctggccttcggcctgcgggccaaccagaccctgacagagctggacctgtccttcaacgtgctgacagatgctggggccaagcacctgtgccagaggctgcggcagcccagctgcaagctgcagaggctgcagctggtgtcctgtggcctgaccagtgactgctgccaggacctggcctctgtgctgagcgccagccccagcctgaaggagctggacctgcagcagaacaacctggatgatgtgggcgtgcggctgctgtgtgagggcctgcggcacccagcctgcaagctgatccggctgggcctggaccagaccaccctgagtgatgagatgaggcaggagctgcgggccctggagcaggagaagccccagctgctgatcttcagcaggaggaagcccagcgtgatgacccccacagagggcctggacaccggggagatgagcaacagcaccagcagcctgaagaggcagaggctgggcagcgagcgggccgccagccacgtggcccaggccaacctgaagctgctggatgtgtccaagatcttccccatcgccgagattgctgaggagagcagccctgaggtggtgcctgtggagctgctgtgtgtgcccagccctgccagccagggcgacctgcacaccaagcccctgggcacagatgatgacttctggggccccactggacctgtggccacagaggtggtggacaaggagaagaacctgtacagagtgcacttccctgtggccggcagctaccgctggcccaacacaggcctgtgctttgtgatgagggaggccgtgacagtggagattgagttctgtgtgtgggaccagttcctgggggagatcaacccccagcacagctggatggtggccggccccctgctggacatcaaggccgagcccggggctgtggaggccgtgcacctgccccactttgtggccctgcagggcggccacgtggacaccagcctcttccagatggcccacttcaaggaggagggcatgctgctggagaagccagcccgggtggagctgcaccacatcgtgctggagaaccccagcttcagccccctgggcgtgctgctgaagatgatccacaatgccctgcgcttcatccctgtgacctctgtggtgctgctgtaccaccggcccagctag

SEQ ID NO: 3697 - DNA, 4128 bp, Artificial Sequence; identical to SEQ ID NO: 3692
  Description of Artificial Sequence: Synthetic coding sequence

SEQ ID NO: 3698 - DNA, 2703 bp, Artificial Sequence
  Description of Artificial Sequence: Synthetic coding sequence
atggagagctgctacaaccctggcctggatggcatcattgaatatgatgacttcaagctgaacagcagcatcgtggagcccaaggagcccgcccctgagacagcagatggcccctacctggtgattgtggagcagcccaagcagaggggcttccgcttccgctatggctgtgagggccccagccacggcggcctgcccggggccagcagcgagaagggcaggaagacctaccccaccgtgaagatctgcaactatgagggccctgccaagattgaggtggacctggtgacccacagcgaccccccccgggcccacgcccacagcctggtgggcaagcagtgcagcgagctgggcatctgtgctgtgtctgtgggccccaaggacatgacagcccagttcaacaacctgggcgtgctgcacgtgaccaagaagaacatgatgggcaccatgatccagaagctgcagaggcagaggctgcggagccggccccagggcctgacagaagctgagcagcgggagctggagcaggaggccaaggagctgaagaaggtgatggacctgagcatcgtgcggctgcgcttcagcgccttcctgcgggccagtgatggcagcttcagcctgcccctgaagcctgtgatcagccagcccatccatgacagcaagagccctggggccagcaacctgaagatcagcaggatggacaagacagctggctctgtgagaggaggagatgaggtgtacctgctgtgtgacaaggtgcagaaggatgacatcgaggtgcgcttctatgaagatgatgaaaatggctggcaggcctttggagacttcagccccacagatgtgcacaagcagtatgccatcgtgttccgcaccccaccctaccacaagatgaagattgaaagacctgtgaccgtcttcctgcagctgaagaggaagagaggaggagatgtgtctgacagcaagcagttcacctactaccccctggtggaggacaaggaggaggtgcagaggaagaggaggaaggccctgcccaccttcagccagccctttggaggcggcagccacatgggcggcggcagcggcggggccgccggcggctatggaggagctgggggcggcggcagcctgggcttcttccccagcagcctggcctacagcccctaccagagcggggccggccccatgggctgctacccaggcggcggcggcggggcccagatggccgccaccgtgcccagccgggacagcggggaggaggccgctgagcccagcgcccccagcaggaccccccagtgtgagccccaggcccctgagatgctgcagagggcccgggagtacaatgcccggctgtttggcctggcccagaggtctgcccgggccctgctggactatggagtgacagcagatgcccgggccctgctggccggccagaggcacctgctgacagcccaggatgaaaatggagacacccccctgcacctggccatcatccacggccagaccagcgtcatcgagcagatcgtgtatgtgatccaccacgcccaggacctgggcgtggtgaacctgaccaaccacctgcaccagacccccctgcacctggccgtcatcaccggccagacctctgtggtgtccttcctgctgcgggtgggcgctgaccctgccctgctggacagacatggagacagcgccatgcacctggccctgcgggccggggccggggcccctgagctgctgcgggccctgctgcagagcggggccccagctgtgccccagctgctgcacatgccagactttgagggcctgtaccctgtgcacctggccgtgcgggcccggagccctgagtgcctggacctgctggtggacagcggggctgaggtggaggccacagagcggcagggcggccgcacagccctgcacctggccacagagatggaggagctgggcctggtgacccacctggtgaccaagctgcgggccaacgtgaatgcccggacctttgctggcaacacccccctgcacctggccgccggcctgggctaccccaccctgacccggctgctgctgaaggccggggctgacatccacgcagaaaatgaggagcccctgtgccccctgcccagcccccccaccagtgacagcgacagcgacagcgagggccctgagaaggacaccaggagcagcttccggggccacacccccctggacctgacctgcagcaccaaggtgaagaccctgctgctgaatgctgcccagaacaccatggagccccccctgaccccacccagccctgctggccctggcctgagcctgggggacacagccctgcagaacctggagcagctgctggatggccctgaggcccagggctcctgggccgagctggccgagcggctgggcctgcggagcctggtggacacctaccggcagaccaccagccccagcggcagcctgctgcggagctatgagctggccggcggggacctggccggcctgctggaggccctgagtgacatgggcctggaggagggcgtgcggctgctgcggggccctgagacccgggacaagctgcccagcacagctgaggtgaaggaggacagcgcctacggcagccagagcgtggagcaggaggccgagaagctgggccccccacctgagcccccaggcggcctgtgccacggccacccccagccccaggtgcactag

SEQ ID NO: 3699 - DNA, 2700 bp, Artificial Sequence
  Description of Artificial Sequence: Synthetic coding sequence
atggagagctgctacaaccctggcctggatggcatcattgaatatgatgacttcaagctgaacagcagcatcgtggagcccaaggagcccgcccctgagacagcagatggcccctacctggtgattgtggagcagcccaagcagaggggcttccgcttccgctatggctgtgagggccccagccacggcggcctgcccggggccagcagcgagaagggcaggaagacctaccccaccgtgaagatctgcaactatgagggccctgccaagattgaggtggacctggtgacccacagcgaccccccccgggcccacgcccacagcctggtgggcaagcagtgcagcgagctgggcatctgtgctgtgtctgtgggccccaaggacatgacagcccagttcaacaacctgggcgtgctgcacgtgaccaagaagaacatgatgggcaccatgatccagaagctgcagaggcagaggctgcggagccggccccagggcctgacagaagctgagcagcgggagctggagcaggaggccaaggagctgaagaaggtgatggacctgagcatcgtgcggctgcgcttcagcgccttcctgcgggccagtgatggcagcttcagcctgcccctgaagcctgtgatcagccagcccatccatgacagcaagagccctggggccagcaacctgaagatcagcaggatggacaagacagctggctctgtgagaggaggagatgaggtgtacctgctgtgtgacaaggtgcagaaggatgacatcgaggtgcgcttctatgaagatgatgaaaatggctggcaggcctttggagacttcagccccacagatgtgcacaagcagtatgccatcgtgttccgcaccccaccctaccacaagatgaagattgaaagacctgtgaccgtcttcctgcagctgaagaggaagagaggaggagatgtgtctgacagcaagcagttcacctactaccccctggtggaggacaaggaggaggtgcagaggaagaggaggaaggccctgcccaccttcagccagccctttggaggcggcagccacatgggcggcggcagcggcggggccgccggcggctatggaggagctgggggcggcggcagcctgggcttcttccccagcagcctggcctacagcccctaccagagcggggccggccccatgggctgctacccaggcggcggcggcggggcccagatggccgccaccgtgcccagccgggacagcggggaggaggccgctgagcccagcgcccccagcaggaccccccagtgtgagccccaggcccctgagatgctgcagagggcccgggagtacaatgcccggctgtttggcctggcccagaggtctgcccgggccctgctggactatggagtgacagcagatgcccgggccctgctggccggccagaggcacctgctgacagcccaggatgaaaatggagacacccccctgcacctggccatcatccacggccagaccagcgtcatcgagcagatcgtgtatgtgatccaccacgcccaggacctgggcgtggtgaacctgaccaaccacctgcaccagacccccctgcacctggccgtcatcaccggccagacctctgtggtgtccttcctgctgcgggtgggcgctgaccctgccctgctggacagacatggagacagcgccatgcacctggccctgcgggccggggccggggcccctgagctgctgcgggccctgctgcagagcggggccccagctgtgccccagctgctgcacatgccagactttgagggcctgtaccctgtgcacctggccgtgcgggcccggagccctgagtgcctggacctgctggtggacagcggggctgaggtggaggccacagagcggcagggcggccgcacagccctgcacctggccacagagatggaggagctgggcctggtgacccacctggtgaccaagctgcgggccaacgtgaatgcccggacctttgctggcaacacccccctgcacctggccgccggcctgggctaccccaccctgacccggctgctgctgaaggccggggctgacatccacgcagaaaatgaggagcccctgtgccccctgcccagcccccccaccagtgacagcgacagcgacagcgagggccctgagaaggacaccaggagcagcttccggggccacacccccctggacctgacctgcagcaccaaggtgaagaccctgctgctgaatgctgcccagaacaccatggagccccccctgaccccacccagccctgctggccctggcctgagcctgggggacacagccctgcagaacctggagcagctgctggatggccctgaggcccagggctcctgggccgagctggccgagcggctgggcctgcggagcctggtggacacctaccggcagaccaccagccccagcggcagcctgctgcggagctatgagctggccggcggggacctggccggcctgctggaggccctgagtgacatgggcctggaggagggcgtgcggctgctgcggggccctgagacccgggacaagctgcccagcacagaggtgaaggaggacagcgcctacggcagccagagcgtggagcaggaggccgagaagctgggccccccacctgagcccccaggcggcctgtgccacggccacccccagccccaggtgcactag

SEQ ID NO: 3700 - DNA, 2703 bp, Artificial Sequence; identical to SEQ ID NO: 3698
  Description of Artificial Sequence: Synthetic coding sequence

SEQ ID NO: 3701 - DNA, 2700 bp, Artificial Sequence; identical to SEQ ID NO: 3699
  Description of Artificial Sequence: Synthetic coding sequence

SEQ ID NO: 3702 - DNA, 804 bp, Artificial Sequence
  Description of Artificial Sequence: Synthetic coding sequence
atgccccgggccttcctggtgaagaagccctgtgtgtccacctgcaagaggaactggagcgagctgcctgatgaggagcggggggagatctacgtgcctgtgtccctgggcttctgccccccccagccctaccgggagcctgagcccagcgtggccgagccccccagctgccccctggccctgaacatgagcctgcgggacagcagctacagcatggcccctggcccctgtgtggtggcccagctgcccagcgaggacatgggccacctgacagacccccagagccgggaccacggcttcctgcggaccaagatgaaggtgaccctgggggacagccccagcggggacctcttcacctgccgggtgtgccagaaggccttcacctaccagaggatgctgaacagacacatgaagtgccacaatgatgtgaagaggcacctgtgcacctactgtgggaagggcttcaatgacacctttgacctgaagagacatgtgaggacccacactggagtgcggccctacaagtgcagcctgtgtgacaaggccttcacccagcgctgcagcctggagagccacctgaagaagatccatggagtgcagcagaagtatgcctacaaggagcggcgggccaagctgtatgtgtgtgaagaatgtggctgcaccagcgagagccaggagggccacgtgctgcacctgaaggagcaccacccagacagccccctgctgaggaagaccagcaagaaggtggccgtggccctgcagaacacagtgaccagcctgctgcagggcagcccccacctgtag

SEQ ID NO: 3703 - DNA, 1095 bp, Artificial Sequence
  Description of Artificial Sequence: Synthetic coding sequence
atgcacaggctcatctttgtgtacaccctcatctgtgccaacttctgcagctgccgggacaccagcgccaccccccagagcgccagcatcaaggccctgagaaatgccaacctgcggagagatgacctgtacagaagagatgagaccatccaggtgaagggaaatggctacgtgcagagcccccgcttccccaacagctaccccaggaacctgctgctgacctggaggctgcacagccaggagaacacccgcatccagctggtgtttgacaaccagtttggcctggaggaggctgaaaatgacatctgccgctatgactttgtggaggtggaggacatcagcgagaccagcaccatcatccggggccgctggtgtggccacaaggaggtgcccccacgcatcaagagcaggaccaaccagatcaagatcaccttcaagagtgatgactactttgtggccaagccaggcttcaagatctactacagcctgctggaggacttccagcctgctgctgccagcgagaccaactgggagagcgtgaccagcagcatctctggagtgtcctacaacagccccagcgtgacagaccccaccctgattgctgatgccctggacaagaagattgctgagtttgacacagtggaggacctgctgaagtacttcaaccctgagagctggcaggaggacctggagaacatgtacctggacaccccccgctaccggggccgcagctaccatgacaggaagagcaaggtggacctggaccggctgaatgatgatgccaagcgctacagctgcaccccaagaaactacagcgtgaacatccgggaggagctgaagctggccaacgtggtgttcttcccccgctgcctgctggtgcagagatgtggcggcaactgtggctgcggcaccgtgaactggaggagctgcacctgcaacagcggcaagacagtgaagaagtaccacgaggtgctgcagtttgagcccggccacatcaagaggcggggccgggccaagaccatggccctggtggacatccagctggaccaccacgagcgctgtgactgcatctgcagcagccggccccccaggtag

SEQ ID NO: 3704 - DNA, 1113 bp, Artificial Sequence
  Description of Artificial Sequence: Synthetic coding sequence
atgcacaggctcatctttgtgtacaccctcatctgtgccaacttctgcagctgccgggacaccagcgccaccccccagagcgccagcatcaaggccctgagaaatgccaacctgcggagagatgagagcaaccacctgacagacctgtacagaagagatgagaccatccaggtgaagggaaatggctacgtgcagagcccccgcttccccaacagctaccccaggaacctgctgctgacctggaggctgcacagccaggagaacacccgcatccagctggtgtttgacaaccagtttggcctggaggaggctgaaaatgacatctgccgctatgactttgtggaggtggaggacatcagcgagaccagcaccatcatccggggccgctggtgtggccacaaggaggtgcccccacgcatcaagagcaggaccaaccagatcaagatcaccttcaagagtgatgactactttgtggccaagccaggcttcaagatctactacagcctgctggaggacttccagcctgctgctgccagcgagaccaactgggagagcgtgaccagcagcatctctggagtgtcctacaacagccccagcgtgacagaccccaccctgattgctgatgccctggacaagaagattgctgagtttgacacagtggaggacctgctgaagtacttcaaccctgagagctggcaggaggacctggagaacatgtacctggacaccccccgctaccggggccgcagctaccatgacaggaagagcaaggtggacctggaccggctgaatgatgatgccaagcgctacagctgcaccccaagaaactacagcgtgaacatccgggaggagctgaagctggccaacgtggtgttcttcccccgctgcctgctggtgcagagatgtggcggcaactgtggctgcggcaccgtgaactggaggagctgcacctgcaacagcggcaagacagtgaagaagtaccacgaggtgctgcagtttgagcccggccacatcaagaggcggggccgggccaagaccatggccctggtggacatccagctggaccaccacgagcgctgtgactgcatctgcagcagccggccccccaggtag

SEQ ID NO: 3705 - DNA, 726 bp, Artificial Sequence
  Description of Artificial Sequence: Synthetic coding sequence
atgaaccgctgctgggccctcttcctgagcctgtgctgctacctgcggctggtgtctgctgagggggaccccatccctgaggagctgtatgagatgctgagtgaccacagcatccgcagctttgatgacctgcagaggctgctgcatggagaccccggggaggaggatggagctgagctggacctgaacatgaccaggagccacagcggcggggagctggagagcctggcccggggccgccgcagcctgggcagcctgaccatcgccgagcccgccatgattgctgagtgcaagaccaggacagaggtgtttgagatcagccggcggctgattgacaggaccaatgccaacttcctggtgtggccaccctgtgtggaggtgcagcgctgcagcggctgctgcaacaacagaaatgtgcagtgccggcccacccaggtgcagctgcggcctgtgcaggtgaggaagattgagatcgtgaggaagaagcccatcttcaagaaggccaccgtgaccctggaggaccacctggcctgcaagtgtgagaccgtggccgccgcccggcctgtgaccaggagccctgggggcagccaggagcagagggccaagaccccccagaccagggtgaccatcagaacagtgcgggtgcggcggccccccaagggcaagcacaggaagttcaagcacacccatgacaagacagccctgaaggagaccctgggcgcctag

SEQ ID NO: 3706 - DNA, 681 bp, Artificial Sequence
  Description of Artificial Sequence: Synthetic coding sequence
atgttcatcatgggcctgggggaccccatccctgaggagctgtatgagatgctgagtgaccacagcatccgcagctttgatgacctgcagaggctgctgcacggggaccctggagaggaggatggagctgagctggacctgaacatgaccaggagccacagcggcggggagctggagagcctggcccggggcagaagaagcctgggcagcctgaccatcgccgagcccgccatgattgctgagtgcaagaccaggacagaggtgtttgagatcagccggcggctgattgacaggaccaatgccaacttcctggtgtggccaccctgtgtggaggtgcagcgctgcagcggctgctgcaacaacagaaatgtgcagtgccggcccacccaggtgcagctgcggcctgtgcaggtgaggaagattgaaattgtgaggaagaagcccatcttcaagaaggccaccgtgaccctggaggaccacctggcctgcaagtgtgaaacagtggccgccgcccggcctgtgaccaggagccctgggggcagccaggagcagagggccaagaccccccagaccagggtgaccatcagaacagtgcgggtgagaagaccacccaagggcaagcacaggaagttcaagcacacccatgacaagacagccctgaaggagaccctgggcgcctag

SEQ ID NO: 3707 - DNA, 411 bp, Artificial Sequence
  Description of Artificial Sequence: Synthetic coding sequence
atgctgagtgaccacagcatccgcagctttgatgacctgcagaggctgctgcacggggaccctggagaggaggatggagctgagctggacctgaacatgaccaggagccacagcggcggggagctggagagcctggcccggggcagaagaagcctgggcagcctgaccatcgccgagcccgccatgattgctgagtgcaagaccaggacagaggtgtttgagatcagccggcggctgattgacaggaccaatgccaacttcctggtgtggccaccctgtgtggaggtgcagcgctgcagcggctgctgcaacaacagaaatgtgcagtgccggcccacccaggtgcagctgcggcctgtgcaggtgaggaagattgaaattgtgaggaagaagcccatcttcaagaagtag

SEQ ID NO: 3708 - DNA, 435 bp, Artificial Sequence
  Description of Artificial Sequence: Synthetic coding sequence
atgctgagtgaccacagcatccgcagctttgatgacctgcagaggctgctgcacggggaccctggagaggaggatggagctgagctggacctgaacatgaccaggagccacagcggcggggagctggagagcctggcccggggcagaagaagcctgggcagcctgaccatcgccgagcccgccatgattgctgagtgcaagaccaggacagaggtgtttgagatcagccggcggctgattgacaggaccaatgccaacttcctggtgtggccaccctgtgtggaggtgcagcgctgcagcggctgctgcaacaacagaaatgtgcagtgccggcccacccaggtgcagctgcggcctgtgcaggtgaggaagattgaaattgtgaggaagaagcccatcttcaagaaggccaccgtgaccctggaggaccactag

SEQ ID NO: 3709 - DNA, 804 bp, Artificial Sequence
  Description of Artificial Sequence: Synthetic coding sequence
atgcccaggagctgctgcagccgcagcggggccctgctgctggccctgctgctgcaggcctccatggaggtgcggggctggtgcctggagagcagccagtgccaggacctgaccacagagagcaacctgctggagtgcatccgggcctgcaagccagacctgtctgctgagacccccatgtttcctggaaatggagatgagcagcccctgacagagaaccccaggaaatatgtgatgggccacttccgctgggacagatttggaagaagaaacagcagcagcagcggcagcagcggggccggccagaagagagaagatgtgtctgctggggaggactgtggccccctgcctgagggcggccctgagcccaggagtgatggagccaagccaggcccccgggagggcaagaggagctacagcatggagcacttccgctggggcaagcctgtgggcaagaagaggaggcctgtgaaggtgtaccccaacggggctgaagatgagagcgctgaggccttccccctggagttcaagcgggagctgaccggccagaggctgcgggagggagatggcccagatggccctgcagatgatggagctggggcccaggccgacctggagcacagcctgctggtggccgctgagaagaaggatgagggcccctacaggatggagcacttccgctggggcagcccccccaaggacaagagatatggaggcttcatgaccagcgagaagagccagacccccctggtgaccctcttcaagaatgccatcatcaagaatgcctacaagaagggggagtag

SEQ ID NO: 3710 - DNA, 804 bp, Artificial Sequence; identical to SEQ ID NO: 3709
  Description of Artificial Sequence: Synthetic coding sequence

SEQ ID NO: 3711 - DNA, 804 bp, Artificial Sequence; identical to SEQ ID NO: 3709
  Description of Artificial Sequence: Synthetic coding sequence

SEQ ID NO: 3712 - DNA, 804 bp, Artificial Sequence; identical to SEQ ID NO: 3709
  Description of Artificial Sequence: Synthetic coding sequence

SEQ ID NO: 3713 - DNA, 741 bp, Artificial Sequence
  Description of Artificial Sequence: Synthetic coding sequence
atgcccaggagctgctgcagccgcagcggggccctgctgctggccctgctgctgcaggcctccatggaggtgcggggctggtgcctggagagcagccagtgccaggacctgaccacagagagcaacctgctggagtgcatccgggcctgcaagccagacctgtctgctgagacccccatgtttcctggaaatggagatgagcagcccctgacagagaaccccaggaaatatgtgatgggccacttccgctgggacagatttggaagaagaaacagcagcagcagcggcagcagcggggccggccagaagagagaagatgtgtctgctggggaggactgtggccccctgcctgagggcggccctgagcccaggagtgatggagccaagccaggcccccgggagggcaagaggagctacagcatggagcacttccgctggggcaagcctgtgggcaagaagaggaggcctgtgaaggtgtaccccaacggggctgaagatgagagcgctgaggccttccccctggagttcaagcgggagctgaccggccagaggctgcgggagggagatggcccagatggccctgcagatgatggagctggggcccaggccgacctggagcacagcctgctggtggccgctgagaagaaggatgagggcccctacaggatggagcacttccgctggggcagcccccccaaggacaagagatatggaggcttcatgaccagcgagaagagctag

SEQ ID NO: 3714 - DNA, 459 bp, Artificial Sequence
  Description of Artificial Sequence: Synthetic coding sequence
atgacctgcacagaccagaagagccacagccagagggccctgggcacccagaccccagccctgcagggcccccagctgctgaacacagaccccagcagcgaggagacccggcccccccacgtgaacccagaccggctgtgccacatggagcccgccaaccacttctggcacgccggggacctgcaggccatgatcagcaaggagttccacctggccgccacccaggatgactgcaggaagggccgcacccaggaggacatcctggtgcccagcagccaccctgagctgtttgcctctgtgctgcccatggcccctgaggaggccgcccggctgcagcagccccagcccctgcccccaccttctggcatccacctgagcgccagcaggaccctggcccccaccctgctgtacagcagcccccccagccacagccccttcggcctgagcagcctcatctag

SEQ ID NO: 3715 - DNA, 315 bp, Artificial Sequence
  Description of Artificial Sequence: Synthetic coding sequence
atggagcccgccaaccacttctggcacgccggggacctgcaggccatgatcagcaaggagttccacctggccgccacccaggatgactgcaggaagggccgcacccaggaggacatcctggtgcccagcagccaccctgagctgtttgcctctgtgctgcccatggcccctgaggaggccgcccggctgcagcagccccagcccctgcccccaccttctggcatccacctgagcgccagcaggaccctggccctgaccctgctgtacagcagcccccccagccacagccccttcggcctgagcagcctcatctag

SEQ ID NO: 3716 - DNA, 459 bp, Artificial Sequence; identical to SEQ ID NO: 3714
  Description of Artificial Sequence: Synthetic coding sequence

SEQ ID NO: 3717 - DNA, 459 bp, Artificial Sequence
  Description of Artificial Sequence: Synthetic coding sequence
atgacctgcacagaccagaagagccacagccagagggccctgggcacccagaccccagccctgcagggcccccagctgctgaacacagaccccagcagcaaggagacccggcccccccacgtgaacccagaccggctgtgccacatggagcccgccaaccacttctggcacgccggggacctgcaggccatgatcagcaaggagttccacctggccgccacccaggatgactgcaggaagggccgcacccaggaggacatcctggtgcccagcagccaccctgagctgtttgcctctgtgctgcccatggcccctgaggaggccgcccggctgcagcagccccagcccctgcccccaccttctggcatccacctgagcgccagcaggaccctggcccccaccctgctgtacagcagcccccccagccacagccccttcggcctgagcagcctcatctag

SEQ ID NO: 3718 - DNA, 459 bp, Artificial Sequence; identical to SEQ ID NO: 3714
  Description of Artificial Sequence: Synthetic coding sequence

SEQ ID NO: 3719 - DNA, 459 bp, Artificial Sequence; identical to SEQ ID NO: 3714
  Description of Artificial Sequence: Synthetic coding sequence

SEQ ID NO: 3720 - DNA, 453 bp, Artificial Sequence
  Description of Artificial Sequence: Synthetic coding sequence
ccccagacagaccagaagagccacagccagagggccctgggcacccagaccccagccctgcagggcccccagctgctgaacacagaccccagcagcgaggagacccacccccacgtgaacccagaccggctgtgccacatggagcccgccaaccacttctggcacgccggggacctgcaggccatgatcagcaaggagttccacctggccgccacccaggatgactgcaggaagggccgcacccaggaggacatcctggtgcccagcagccaccctgagctgtttgcctctgtgctgcccatggcccctgaggaggccgcccggctgcagcagccccagcccctgcccccaccttctggcatccacctgagcgccagcaggaccctggccctgaccctgctgtacagcagcccccccagccacagccccttcggcctgagcagcctcatctag

SEQ ID NO: 3721 - DNA, 411 bp, Artificial Sequence
  Description of Artificial Sequence: Synthetic coding sequence
atgatcctgaactggaagctgctgggcatcctggtgctgtgcctgcacacccggggcatcagcggcagcgagggccaccccagccaccccccagcagaagatcgggaggaggccggcagccccaccctgccccagggcccccctgtgcctggggacccctggccaggggccccacccctgtttgaggaccccccacccacccggcccagccggccctggagggacctgcctgagactggagtgtggctgcctgagccccccaggacagatcctccccagccccccaggccagatgacccctggccagctggcccccagcccccagagaacccctggcccccagcccctgaggtggacaaccggccccaggaggagccagacctggaccccccccgggaggagtacagatag

SEQ ID NO: 3722 - DNA, 411 bp, Artificial Sequence
  Description of Artificial Sequence: Synthetic coding sequence
atgatcctgaactggaagctgctgggcatcctggtgctgtgcctgcacacccggggcatcagcggcagcgagggccaccccagccaccccccagcagaagatcgggaggaggccggcagccccaccctgccccagggcccccctgtgcctggggacccctggccaggggccccacccctgtttgaggaccccccacccacccggcccagccggccctggagggacctgcctgagactggagtgtggcccccagagccccccaggacagatcctccccagccccccaggccagatgacccctggccagctggcccccagcccccagagaacccctggcccccagcccctgaggtggacaaccggccccaggaggagccagacctggaccccccccgggaggagtacagatag

SEQ ID NO: 3723 - DNA, 411 bp, Artificial Sequence; identical to SEQ ID NO: 3722
  Description of Artificial Sequence: Synthetic coding sequence

SEQ ID NO: 3724 - DNA, 411 bp, Artificial Sequence; identical to SEQ ID NO: 3722
  Description of Artificial Sequence: Synthetic coding sequence

SEQ ID NO: 3725 - DNA, 411 bp, Artificial Sequence; identical to SEQ ID NO: 3722
  Description of Artificial Sequence: Synthetic coding sequence

SEQ ID NO: 3726 - DNA, 411 bp, Artificial Sequence; identical to SEQ ID NO: 3722
  Description of Artificial Sequence: Synthetic coding sequence

SEQ ID NO: 3727 - DNA, 753 bp, Artificial Sequence
  Description of Artificial Sequence: Synthetic coding sequence
gccctgctgctggccgtcatccagggccggcctggggcccagcatgatgtggaggccctgggcggcctgtgctgggccctgggctttgagaccaccgtgaggacagaccccacagcccaggccttccaggaggagctggcccagttccgggagcagctggacacctgccggggccctgtgtcctgtgccctggtggccctgatggcccacggcggcccccggggccagctgctgggcgcagatggccaggaggtgcagcctgaggccctgatgcaggagctgagccgctgccaggtgctgcagggccggcccaagatcttcctgctgcaggcctgccggggcggcaacagagatgctggggtgggccccacagccctgccctggtactggagctggctgcgggccccacccagcgtgcccagccatgctgatgtgctgcagatctatgcagaggcccagggcagcagctgccggggcaccccacctggcagcagtgaccaggccgacatcctgactgtgtacagcgctgctgagggctacgtggcctacagagatgacaagggcagtgacttcatccagaccctggtggaggtgctgcgggccaaccctggccgggacctgctggagctgctgacagaggtgaacagaagagtgtgtgagcaggaggtgctgggccctgactgtgatgagctgaggaaggcctgcctggagatccgcagcagcctgcggcggcggctgtgcctgcaggcctag

SEQ ID NO: 3728 - DNA, 3165 bp, Artificial Sequence
  Description of Artificial Sequence: Synthetic coding sequence
atgaccagctaccgggagaggtctgctgacctggcccgcttctacacagtgacagagccccagaggcacccccggggctacacagtgtacaaggtgacagcccgcatcatcgtgtggaagcgctacagcgacttcaagaagctgcacaaggagctgtggcagatccacaagaacctcttccgccacagcgagctgtttcctccatttgccaagggcatcgtgtttggccgctttgatgaaacagtgattgaggagcggcggcagtgtgccgaggacctgctgcagttcagcgccaacatcccagccctgtacaacagcaagcagctggaggacttcttcaagggcggcatcatcaatgacagcagcgagctgattggccctgctgaggcccacagcgacagcctgattgacaccttcccagaatgttccacagagggcttcagcagtgacagcgacctggtgtccctgactgtggatgtggacagcctggccgagctggatgatggcatggccagcaaccagaacagccccatccgcaccttcggcctgaacctgagcagtgacagcagcgccctgggcgctgtggccagtgacagcgagcagagcaagacagaggaggagcgggagagccgcagcctcttccctggcagcctgaagcccaagctgggcaagagggactacctggagaaggccggggagctgatcaagctggccctgaagaaggaggaggaggatgattatgaagctgccagtgacttctacaggaagggcgtggacctgctgctggagggcgtgcagggcgagagcagccccacccggcgggaggccgtgaagagaagaacagctgagtacctgatgagagctgagagcatcagcagcctgtatggcaagccccagctggatgatgtgtcccagcccccaggcagcctgagcagccggcccctgtggaacctgcggagccctgctgaggagctgaaggccttccgggtgctgggcgtcatcgacaaggtgctgctggtgatggacaccaggacagagcagaccttcatcctgaagggcctgaggaagagcagcgagtacagcaggaacaggaagaccatcatcccccgctgtgtgcccaacatggtgtgcctgcacaagtacatcatcagcgaggagagcgtcttcctggtgctgcagcacgccgagggcggcaagctgtggagctacatcagcaagttcctgaacagaagccctgaggagagctttgacatcaaggaggtgaagaagcccaccctggccaaggtgcacctgcagcagcccaccagcagcccccaggacagcagcagctttgagagccggggcagtgatggcggctccatgctgaaggccctgcccctgaagagcagcctgacccccagcagccaggatgacagcaaccaggaggatgatggccaggacagcagccccaagtggccagacagcggcagcagcagcgaggaggagtgcaccaccagctacctgaccctgtgcaatgaatatggccaggagaagattgagcccggcagcctgaatgaggagcccttcatgaagacagagggcaatggagtggacaccaaggccatcaagagcttccctgcccacctggccgctgacagcgacagccccagcacccagctgcgggcccacgagctgaagttcttccccaatgatgatcctgaggccgtgagcagccccaggaccagtgacagcctgagccgcagcaagaacagccccatggagttcttcagaattgacagcaaggacagcgccagcgagctgctgggcctggactttggagagaagctgtacagcctgaagtctgagcccctgaagcccttcttcaccctgcctgatggagacagcgccagccgctccttcaacaccagcgagagcaaggtggagttcaaggcccaggacaccatcagccggggcagtgatgattctgtgcctgtgatctccttcaaggatgctgcctttgatgatgtgtctggaacagatgagggccgcccagacctgctggtgaacctgcccggggagctggagagcacccgggaggccgccgccatgggccccaccaagttcacccagaccaacatcggcatcatcgagaacaagctgctggaggccccagatgtgctgtgcctgcggctgagcacagagcagtgccaggcccacgaggagaagggcatcgaggagctgagtgaccccagcggccccaagagctacagcatcacagagaagcactacgcccaggaggaccccaggatgctgtttgtggccgctgtggaccacagcagcagcggggacatgagcctgctgcccagcagtgaccccaagttccagggcctgggcgtggtggagagcgctgtgacagccaacaacacagaggagagcctcttccgcatctgcagccccctgagcggggccaatgagtacatcgccagcacagacaccctgaagacagaggaggtgctgctcttcacagaccagacagatgacctggccaaggaggagcccaccagcctcttccagagggacagcgagaccaagggggagagcggcctggtgctggagggggacaaggagatccaccagatctttgaggacctggacaagaagctggccctggccagccgcttctacatccctgagggctgcatccagcgctgggccgctgagatggtggtggccctggatgccctgcaccgggagggcatcgtgtgccgggacctgaaccccaacaacatcctgctgaatgaccggggccacatccagctgacctacttcagccgctggagcgaggtggaggacagctgtgacagtgatgccattgaaagaatgtactgtgcccctgaggtgggcgccatcacagaggagacagaggcctgtgactggtggagcctgggcgctgtgctgtttgagctgctgaccgggaagaccctggtggagtgccaccctgctggcatcaacacccacaccaccctgaacatgccagaatgtgtgtctgaggaggcccggagcctcatccagcagctgctgcagttcaaccccctggagcggctgggcgctggggtggccggcgtggaggacatcaagagccaccccttcttcacccctgtggactgggccgagctgatgaggtag

SEQ ID NO: 3729 - DNA, 3201 bp, Artificial Sequence
  Description of Artificial Sequence: Synthetic coding sequence
atgaccagctaccgggagaggtctgctgacctggcccgcttctacacagtgacagagccccagaggcacccccggggctacacagtgtacaaggtgacagcccgggtggtgtccagaagaaatccagaagatgtgcaggagatcatcgtgtggaagcgctacagcgacttcaagaagctgcacaaggagctgtggcagatccacaagaacctcttccgccacagcgagctgtttcctccatttgccaagggcatcgtgtttggccgctttgatgaaacagtgattgaggagcggcggcagtgtgccgaggacctgctgcagttcagcgccaacatcccagccctgtacaacagcaagcagctggaggacttcttcaagggcggcatcatcaatgacagcagcgagctgattggccctgctgaggcccacagcgacagcctgattgacaccttcccagaatgttccacagagggcttcagcagtgacagcgacctggtgtccctgactgtggatgtggacagcctggccgagctggatgatggcatggccagcaaccagaacagccccatccgcaccttcggcctgaacctgagcagtgacagcagcgccctgggcgctgtggccagtgacagcgagcagagcaagacagaggaggagcgggagagccgcagcctcttccctggcagcctgaagcccaagctgggcaagagggactacctggagaaggccggggagctgatcaagctggccctgaagaaggaggaggaggatgattatgaagctgccagtgacttctacaggaagggcgtggacctgctgctggagggcgtgcagggcgagagcagccccacccggcgggaggccgtgaagagaagaacagctgagtacctgatgagagctgagagcatcagcagcctgtatggcaagccccagctggatgatgtgtcccagcccccaggcagcctgagcagccggcccctgtggaacctgcggagccctgctgaggagctgaaggccttccgggtgctgggcgtcatcgacaaggtgctgctggtgatggacaccaggacagagcagaccttcatcctgaagggcctgaggaagagcagcgagtacagcaggaacaggaagaccatcatcccccgctgtgtgcccaacatggtgtgcctgcacaagtacatcatcagcgaggagagcgtcttcctggtgctgcagcacgccgagggcggcaagctgtggagctacatcagcaagttcctgaacagaagccctgaggagagctttgacatcaaggaggtgaagaagcccaccctggccaaggtgcacctgcagcagcccaccagcagcccccaggacagcagcagctttgagagccggggcagtgatggcggctccatgctgaaggccctgcccctgaagagcagcctgacccccagcagccaggatgacagcaaccaggaggatgatggccaggacagcagccccaagtggccagacagcggcagcagcagcgaggaggagtgcaccaccagctacctgaccctgtgcaatgaatatggccaggagaagattgagcccggcagcctgaatgaggagcccttcatgaagacagagggcaatggagtggacaccaaggccatcaagagcttccctgcccacctggccgctgacagcgacagccccagcacccagctgcgggcccacgagctgaagttcttccccaatgatgatcctgaggccgtgagcagccccaggaccagtgacagcctgagccgcagcaagaacagccccatggagttcttcagaattgacagcaaggacagcgccagcgagctgctgggcctggactttggagagaagctgtacagcctgaagtctgagcccctgaagcccttcttcaccctgcctgatggagacagcgccagccgctccttcaacaccagcgagagcaaggtggagttcaaggcccaggacaccatcagccggggcagtgatgattctgtgcctgtgatctccttcaaggatgctgcctttgatgatgtgtctggaacagatgagggccgcccagacctgctggtgaacctgcccggggagctggagagcacccgggaggccgccgccatgggccccaccaagttcacccagaccaacatcggcatcatcgagaacaagctgctggaggccccagatgtgctgtgcctgcggctgagcacagagcagtgccaggcccacgaggagaagggcatcgaggagctgagtgaccccagcggccccaagagctacagcatcacagagaagcactacgcccaggaggaccccaggatgctgtttgtggccgctgtggaccacagcagcagcggggacatgagcctgctgcccagcagtgaccccaagttccagggcctgggcgtggtggagagcgctgtgacagccaacaacacagaggagagcctcttccgcatctgcagccccctgagcggggccaatgagtacatcgccagcacagacaccctgaagacagaggaggtgctgctcttcacagaccagacagatgacctggccaaggaggagcccaccagcctcttccagagggacagcgagaccaagggggagagcggcctggtgctggagggggacaaggagatccaccagatctttgaggacctggacaagaagctggccctggccagccgcttctacatccctgagggctgcatccagcgctgggccgctgagatggtggtggccctggatgccctgcaccgggagggcatcgtgtgccgggacctgaaccccaacaacatcctgctgaatgaccggggccacatccagctgacctacttcagccgctggagcgaggtggaggacagctgtgacagtgatgccattgaaagaatgtactgtgcccctgaggtgggcgccatcacagaggagacagaggcctgtgactggtggagcctgggcgctgtgctgtttgagctgctgaccgggaagaccctggtggagtgccaccctgctggcatcaacacccacaccaccctgaacatgccagaatgtgtgtctgaggaggcccggagcctcatccagcagctgctgcagttcaaccccctggagcggctgggcgctggggtggccggcgtggaggacatcaagagccaccccttcttcacccctgtggactgggccgagctgatgaggtag

SEQ ID NO: 3730 - DNA, 1983 bp, Artificial Sequence
  Description of Artificial Sequence: Synthetic coding sequence
atgagagctgagagcatcagcagcctgtatggcaagccccagctggatgatgtgtcccagcccccaggcagcctgagcagccggcccctgtggaacctgcggagccctgctgaggagctgaaggccttccgggtgctgggcgtgattgacaaggtgctgctggtgatggacaccaggacagagcagaccttcatcctgaagggcctgaggaagagcagcgagtacagcaggaacaggaagaccatcatcccccgctgtgtgcccaacatggtgtgcctgcacaagtacatcatcagcgaggagagcgtcttcctggtgctgcagcacgccgagggcggcaagctgtggagctacatcagcaagttcctgaacagaagccctgaggagagctttgacatcaaggaggtgaagaagcccaccctggccaaggtgcacctgcagcagcccaccagcagcccccaggacagcagcagctttgagagccggggcagtgatggcggctccatgctgaaggccctgcccctgaagagcagcctgacccccagcagccaggatgacagcaaccaggaggatgatggccaggacagcagccccaagtggccagattctggcagcagcagcgaggaggagtgcaccaccagctacctgaccctgtgcaatgaatatggccaggagaagattgagcccggcagcctgaatgaggagcccttcatgaagacagagggcaatggagtggacaccaaggccatcaagagcttccctgcccacctggccgctgacagcgacagccccagcacccagctgcgggcccacgagctgaagttcttccccaatgatgatcctgaggccgtgagcagccccaggaccagtgacagcctgagccgcagcaagaacagccccatggagttcttcagaattgacagcaaggacagcgccagcgagctgctgggcctggactttggagagaagctgtacagcctgaagtctgagcccctgaagcccttcttcaccctgcctgatggagacagcgccagccgctccttcaacaccagcgagagcaaggtggagttcaaggcccaggacaccatcagccggggcagtgatgacagcgtgcctgtgatctccttcaaggatgctgcctttgatgatgtgtctggaacagatgagggccgcccagacctgctggtgaacctgcctggagagctggagagcacccgggaggccgccgccatgggccccaccaagttcacccagaccaacatcggcatcatcgagaacaagctgctggaggccccagatgtgctgtgcctgcggctgagcacagagcagtgccaggcccacgaggagaagggcatcgaggagctgagtgaccccagcggccccaagagctacagcatcacagagaagcactacgcccaggaggaccccaggatgctgtttgtggccgctgtggaccacagcagcagcggggacatgagcctgctgcccagcagtgaccccaagttccagggcctgggcgtggtggagagcgctgtgacagccaacaacacagaggagagcctcttccgcatctgcagccccctgagcggggccaatgagtacatcgccagcacagacaccctgaagacagaggaggtgctgctcttcacagaccagacagatgacctggccaaggaggagcccaccagcctcttccagagggacagcgagaccaagggggagagcggcctggtgctggagggggacaaggagatccaccagatctttgaggacctggacaagaagctggccctggccagccgcttctacatccctgagggctgcatccagcgctgggccgctgagatggtggtggccctggatgccctgcaccgggagggcatcgtgtgccgggacctgaaccccaacaacatcctgctgaatgaccggggccaggagctgctgcagatgcacttcttcctgtttgctgtggccagcaactag

SEQ ID NO: 3731 - DNA, 2565 bp, Artificial Sequence
  Description of Artificial Sequence: Synthetic coding sequence
atggccagcaaccagaacagccccatccgcaccttcggcctgaacctgagcagtgacagcagcgccctgggcgctgtggccagtgacagcgagcagagcaagacagaggaggagcgggagagccgcagcctcttccctggcagcctgaagcccaagctgggcaagagggactacctggagaaggccggggagctgatcaagctggccctgaagaaggaggaggaggatgattatgaggccgccagtgacttctacagaaaaggagtggacctgctgctggagggcgtgcagggcgagagcagccccacccggcgggaggccgtgaagagaagaacagctgagtacctgatgagagctgagagcatcagcagcctgtatggcaagccccagctggatgatgtgtcccaggtgctgctggtgatggacaccaggacagagcagaccttcatcctgaagggcctgaggaagagcagcgagtacagcaggaacaggaagaccatcatcccccgctgtgtgcccaacatggtgtgcctgcacaagtacatcatcagcgaggagagcgtcttcctggtgctgcagcacgccgagggcggcaagctgtggagctacatcagcaagttcctgaacagaagccctgaggagagctttgacatcaaggaggtgaagaagcccaccctggccaaggtgcacctgcagcagcccaccagcagcccccaggacagcagcagctttgagagccggggcagtgatggcggctccatgctgaaggccctgcccctgaagagcagcctgacccccagcagccaggatgacagcaaccaggaggatgatggccaggacagcagccccaagtggccagacagcggcagcagcagcgaggaggagtgcaccaccagctacctgaccctgtgcaatgaatatggccaggagaagattgagcccggcagcctgaatgaggagcccttcatgaagacagagggcaatggagtggacaccaaggccatcaagagcttccctgcccacctggccgctgacagcgacagccccagcacccagctgcgggcccacgagctgaagttcttccccaatgatgatcctgaggccgtgagcagccccaggaccagtgacagcctgagccgcagcaagaacagccccatggagttcttcagaattgacagcaaggacagcgccagcgagctgctgggcctggactttggagagaagctgtacagcctgaagtctgagcccctgaagcccttcttcaccctgcctgatggagacagcgccagccgctccttcaacaccagcgagagcaaggtggagttcaaggcccaggacaccatcagccggggcagtgatgattctgtgcctgtgatctccttcaaggatgctgcctttgatgatgtgtctggaacagatgagggccgcccagacctgctggtgaacctgcccggggagctggagagcacccgggaggccgccgccatgggccccaccaagttcacccagaccaacatcggcatcatcgagaacaagctgctggaggccccagatgtgctgtgcctgcggctgagcacagagcagtgccaggcccacgaggagaagggcatcgaggagctgagtgaccccagcggccccaagagctacagcatcacagagaagcactacgcccaggaggaccccaggatgctgtttgtggccgctgtggaccacagcagcagcggggacatgagcctgctgcccagcagtgaccccaagttccagggcctgggcgtggtggagagcgctgtgacagccaacaacacagaggagagcctcttccgcatctgcagccccctgagcggggccaatgagtacatcgccagcacagacaccctgaagacagaggaggtgctgctcttcacagaccagacagatgacctggccaaggaggagcccaccagcctcttccagagggacagcgagaccaagggggagagcggcctggtgctggagggggacaaggagatccaccagatctttgaggacctggacaagaagctggccctggccagccgcttctacatccctgagggctgcatccagcgctgggccgctgagatggtggtggccctggatgccctgcaccgggagggcatcgtgtgccgggacctgaaccccaacaacatcctgctgaatgaccggggccacatccagctgacctacttcagccgctggagcgaggtggaggacagctgtgacagtgatgccattgaaagaatgtactgtgcccctgaggtgggcgccatcacagaggagacagaggcctgtgactggtggagcctgggcgctgtgctgtttgagctgctgaccgggaagaccctggtggagtgccaccctgctggcatcaacacccacaccaccctgaacatgccagaatgtgtgtctgaggaggcccggagcctcatccagcagctgctgcagttcaaccccctggagcggctgggcgctggggtggccggcgtggaggacatcaagagccaccccttcttcacccctgtggactgggccgagctgatgaggtag

SEQ ID NO: 3732 - DNA, 1449 bp, Artificial Sequence
  Description of Artificial Sequence: Synthetic coding sequence
atggctgctgtgtttgacctggacctggagacagaggagggcagcgagggggagggggagcctgagctgagccctgcagatgcctgccccctggccgagctgcgggctgctggcctggagcctgtgggccactatgaggaggtggagctgacagagacctctgtgaatgtgggccctgagcgcatcggcccccactgctttgagctgctgcgggtgctgggcaaaggaggctacggcaaggtgttccaggtgaggaaggtgcagggcaccaacctgggcaagatctatgccatgaaggtgctgaggaaggccaagatcgtgagaaatgccaaggacacagcccacaccagggctgagaggaacatcctggagagcgtgaagcaccccttcatcgtggagctggcctatgccttccagacaggaggcaagctgtacctgatcctggagtgcctgagcggcggggagctgttcacccacctggagcgggagggcatcttcctggaggacacagcctgcttctacctggccgagatcaccctggccctgggccacctgcacagccagggcatcatctacagagacctgaagccagagaacatcatgctgagcagccagggccacatcaagctgacagactttggcctgtgcaaggagagcatccatgaaggagctgtgacccacaccttctgtggcaccatcgagtacatggcccctgagatcctggtgcgcagcggccacaacagagctgtggactggtggagcctgggcgccctgatgtatgacatgctgaccggcagcccccccttcaccgctgagaacaggaagaagaccatggacaagatcatccggggcaagctggccctgcccccctacctgaccccagatgcccgggacctggtgaagaagttcctgaagaggaaccccagccagagaattggaggcggccctggagatgctgctgatgtgcagaggcaccccttcttccgccacatgaactgggatgacctgctggcctggagggtggacccccccttccggccctgcctgcagagtgaagaagatgtgtcccagtttgacacccgcttcacccggcagacccctgtggacagcccagatgacacagccctgtctgagagcgccaaccaggccttcctgggcttcacctacgtggcccccagcgtgctggacagcatcaaggagggcttctccttccagcccaagctgcggagcccccggcggctgaacagcagcccccgggcccctgtgagccccctgaagttcagcccctttgagggcttccggcccagccccagcctgcctgagcccacagagctgcccctgccccccctgctgcccccacctccacccagcaccacagcccccctgcccatccggccccccagcggcaccaagaagagcaagaggggccggggccggcccggccgctag

SEQ ID NO: 3733 - DNA, 465 bp, Artificial Sequence
  Description of Artificial Sequence: Synthetic coding sequence
atggctgctgtgtttgacctggacctggagacagaggagggcagcgagggggagggggagcctgagctgagccctgcagatgcctgccccctggccgagctgcgggctgctggcctggagcctgtgggccactatgaggaggtggagctgacagagacctctgtgaatgtgggccctgagcgcatcggcccccactgctttgagctgctgcgggtgctgggcaaaggaggctacggcaaggtgttccaggtgaggaaggtgcagggcaccaacctgggcaagatctatgccatgaaggtgctgaggaaggccaagatcgtgagaaatgccaaggacacagcccacaccagggctgagaggaacatcctggagagcgtgaagcaccccttcatcgtggagctggcctatgccttccagacaggaggcaagctgtacctgatcctggagtgcctgtctgtggactag

SEQ ID NO: 3734 - DNA, 465 bp, Artificial Sequence; identical to SEQ ID NO: 3733
  Description of Artificial Sequence: Synthetic coding sequence

SEQ ID NO: 3735 - DNA, 2133 bp, Artificial Sequence
  Description of Artificial Sequence: Synthetic coding sequence
atgttcaagttcctgtccttccgggtgcgcagcatccaggaggaggtgtccatcaaggagatcgccatcacccaccacgtgaaggagggccacgagaaggctgaccccagccagtttgagctgctgaaggtgctgggccagggcagctttgggaaggtgttcctggtgaagaagatcagcggcagtgatgcccggcagctgtatgccatgaaggtgctgaagaaggccaccctgaaggtgcgggacagagtgaggaccaagatggagcgggacatcctggtggaggtgaaccaccccttcatcgtgaagctgcactacgccttccagacagagggcaagctgtacctgatcctggacttcctgcggggcggggacctcttcacccggctgagcaaggaggtgatgttcacagaagaagatgtgaagttctacctggccgagctggccctggccctggaccacctgcacagcctgggcatcatctacagagacctgaagccagagaacatcctgctggatgaggagggccacatcaagctgacagactttggcctgagcaaggagagcattgaccacgagaagaaggcctacagcttctgtggcaccgtggagtacatggcccctgaggtggtgaacagaagaggccacacccagagcgctgactggtggagctttggagtgctgatgtttgagatgctgaccggcaccctgcccttccagggcaaggacaggaaggagaccatgaccatgatcctgaaggccaagctgggcatgccccagttcctgagccctgaggcccagagcctgctgaggatgctgttcaagaggaacccagccaaccggctgggcgccggcccagatggagtggaggagatcaagaggcacagcttcttcagcaccatcgactggaacaagctgtaccgccgggagatccacccccccttcaagccagccaccggccggcctgaggacaccttctactttgatcctgagttcaccgccaagacccccaaggacagccctggcatcccccccagcgccaatgcccaccagctgttccggggcttctcctttgtggccatcaccagtgatgatgagagccaggccatgcagacagtgggcgtgcacagcatcgtgcagctgcacagaaattccatccagttcacagatggctatgaggtgaaggaggacatcggcgtgggcagctacagcgtgtgcaagcgctgcatccacaaggccaccaacatggagtttgctgtgaagatcatcgacaagagcaagagggaccccacagaggagattgagatcctgctgcgctatggccagcaccccaacatcatcaccctgaaggatgtgtatgatgatggcaagtatgtgtatgtggtgacagagctgatgaagggcggggagctgctggacaagatcctgcggcagaagttcttcagcgagcgggaggccagcgctgtgctcttcaccatcaccaagacagtggagtacctgcacgcccagggcgtggtgcaccgggacctgaagcccagcaacatcctgtatgtggatgaaagtggcaaccctgagagcatccgcatctgtgactttggatttgccaagcagctgcgggcagaaaatggcctgctgatgaccccctgctacacagccaactttgtggcccctgaggtgctgaagaggcagggctatgatgctgcctgtgacatctggagcctgggcgtgctgctgtacaccatgctgaccggctacaccccatttgccaacggcccagatgacaccccagaggagatcctggccagaattggcagcggcaagttcagcctgagcggcggctactggaacagcgtgtctgacacagccaaggacctggtgtccaagatgctgcacgtggacccccaccagaggctgacagctgccctggtgctgcggcacccctggatcgtgcactgggaccagctgccccagtaccagctgaaccggcaggatgccccccacctggtgaagggggccatggccgccacctacagcgccctgaacagaaaccagagccctgtgctggagcctgtgggccgcagcaccctggcccagaggcggggcatcaagaagatcaccagcacagccctgtag

SEQ ID NO: 3736 - DNA, 2223 bp, Artificial Sequence
  Description of Artificial Sequence: Synthetic coding sequence
atgcccctggcccagctggccgacccctggcagaagatggctgtggagagccccagcgacagcgcagaaaatggccagcagatcatggatgagcccatgggagaggaggagatcaacccccagacagaggaggtgtccatcaaggagatcgccatcacccaccacgtgaaggagggccacgagaaggctgaccccagccagtttgagctgctgaaggtgctgggccagggcagctttgggaaggtgttcctggtgaagaagatcagcggcagtgatgcccggcagctgtatgccatgaaggtgctgaagaaggccaccctgaaggtgcgggacagagtgaggaccaagatggagcgggacatcctggtggaggtgaaccaccccttcatcgtgaagctgcactacgccttccagacagagggcaagctgtacctgatcctggacttcctgcggggcggggacctcttcacccggctgagcaaggaggtgatgttcacagaggaggatgtgaagttctacctggccgagctggccctggccctggaccacctgcacagcctgggcatcatctacagagacctgaagccagagaacatcctgctggatgaggagggccacatcaagctgacagactttggcctgagcaaggagagcattgaccacgagaagaaggcctacagcttctgtggcaccgtggagtacatggcccctgaggtggtgaacagaagaggccacacccagagcgctgactggtggagctttggagtgctgatgtttgagatgctgaccggcaccctgcccttccagggcaaggacaggaaggagaccatgaccatgatcctgaaggccaagctgggcatgccccagttcctgagccctgaggcccagagcctgctgaggatgctgttcaagagaaatcctgccaaccggctgggcgccggcccagatggagtggaggagatcaagaggcacagcttcttcagcaccatcgactggaacaagctgtacagaagagagatccacccccccttcaagccagccaccggccggcctgaggacaccttctactttgatcctgagttcaccgccaagacccccaaggacagccctggcatccccccatctgccaatgcccaccagctgttccggggcttctcctttgtggccatcaccagtgatgatgagagccaggccatgcagacagtgggcgtgcacagcatcgtgcagcagctgcacagaaattccatccagttcacagatggctatgaggtgaaggaggacatcggcgtgggcagctacagcgtgtgcaagcgctgcatccacaaggccaccaacatggagtttgctgtgaagatcatcgacaagagcaagagggaccccacagaggagattgagatcctgctgcgctatggccagcaccccaacatcatcaccctgaaggatgtgtatgatgatggcaagtatgtgtatgtggtgacagagctgatgaagggcggggagctgctggacaagatcctgcggcagaagttcttcagcgagcgggaggccagcgctgtgctcttcaccatcaccaagacagtggagtacctgcacgcccagggcgtggtgcaccgggacctgaagcccagcaacatcctgtatgtggatgaaagtggcaaccctgagagcatccgcatctgtgactttggatttgccaagcagctgcgggcagaaaatggcctgctgatgaccccctgctacacagccaactttgtggcccctgaggtgctgaagaggcagggctatgatgctgcctgtgacatctggagcctgggcgtgctgctgtacaccatgctgaccggctacaccccatttgccaacggcccagatgacaccccagaggagatcctggccagaattggcagcggcaagttcagcctgagcggcggctactggaacagcgtgtctgacacagccaaggacctggtgtccaagatgctgcacgtggacccccaccagaggctgacagctgccctggtgctgcggcacccctggatcgtgcactgggaccagctgccccagtaccagctgaaccggcaggatgccccccacctggtgaagggggccatggccgccacctacagcgccctgaacagaaaccagagccctgtgctggagcctgtgggccgcagcaccctggcccagaggcggggcatcaagaagatcaccagcacagccctgtag

SEQ ID NO: 3737 - DNA, 402 bp, Artificial Sequence
  Description of Artificial Sequence: Synthetic coding sequence
atggatgagcccatgggagaggaggagatcaacccccagacagaggaggtgtccatcaaggagatcgccatcacccaccacgtgaaggagggccacgagaaggctgaccccagccagtttgagctgctgaaggtgctgggccagggcagctttgggaaggtgttcctggtgaagaagatcagcggcagtgatgcccggcagctgtatgccatgaaggtgctgaagaaggccaccctgaaggtgcgggacagagtgaggaccaagatggagcgggacatcctggtggaggtgaaccaccccttcatcgtgaagctgcactacgccttccagacagagggcaagctgtacctgatcctggacttcctgcggggcggggacctcttcacccggctgagcaagtag

SEQ ID NO: 3738 - DNA, 684 bp, Artificial Sequence
  Description of Artificial Sequence: Synthetic coding sequence
atgttcaagttcctgtccttccgggtgcgcagcatccaggaggaggtgtccatcaaggagatcgccatcacccaccacgtgaaggagggccacgagaaggctgaccccagccagtttgagctgctgaaggtgctgggccagggcagctttgggaaggtgttcctggtgaagaagatcagcggcagtgatgcccggcagctgtatgccatgaaggtgctgaagaaggccaccctgaaggtgcgggacagagtgaggaccaagatggagcgggacatcctggtggaggtgaaccaccccttcatcgtgaagctgcactacgccttccagacagagggcaagctgtacctgatcctggacttcctgcggggcggggacctcttcacccggctgagcaaggaggtgatgttcacagaagaagatgtgaagttctacctggccgagctggccctggccctggaccacctgcacagcctgggcatcatctacagagacctgaagccagagaacatcctgctggatgaggagggccacatcaagctgacagactttggcctgagcaaggagagcattgaccacgagaagaaggcctacagcttctgtggcaccgtggagtacatggcccctgaggtggtgaacagaagaggccacacccagagcgctgactggtggagctttggagtgtag

SEQ ID NO: 3739 - DNA, 2136 bp, Artificial Sequence
  Description of Artificial Sequence: Synthetic coding sequence
atggatgagcccatgggagaggaggagatcaacccccagacagaggaggtgtccatcaaggagatcgccatcacccaccacgtgaaggagggccacgagaaggctgaccccagccagtttgagctgctgaaggtgctgggccagggcagctttgggaaggtgttcctggtgaagaagatcagcggcagtgatgcccggcagctgtatgccatgaaggtgctgaagaaggccaccctgaaggtgcgggacagagtgaggaccaagatggagcgggacatcctggtggaggtgaaccaccccttcatcgtgaagctgcactacgccttccagacagagggcaagctgtacctgatcctggacttcctgcggggcggggacctcttcacccggctgagcaaggaggtgatgttcacagaggaggatgtgaagttctacctggccgagctggccctggccctggaccacctgcacagcctgggcatcatctacagagacctgaagccagagaacatcctgctggatgaggagggccacatcaagctgacagactttggcctgagcaaggagagcattgaccacgagaagaaggcctacagcttctgtggcaccgtggagtacatggcccctgaggtggtgaacagaagaggccacacccagagcgctgactggtggagctttggagtgctgatgtttgagatgctgaccggcaccctgcccttccagggcaaggacaggaaggagaccatgaccatgatcctgaaggccaagctgggcatgccccagttcctgagccctgaggcccagagcctgctgaggatgctgttcaagagaaatcctgccaaccggctgggcgccggcccagatggagtggaggagatcaagaggcacagcttcttcagcaccatcgactggaacaagctgtacagaagagagatccacccccccttcaagccagccaccggccggcctgaggacaccttctactttgatcctgagttcaccgccaagacccccaaggacagccctggcatccccccatctgccaatgcccaccagctgttccggggcttctcctttgtggccatcaccagtgatgatgagagccaggccatgcagacagtgggcgtgcacagcatcgtgcagctgcacaggaacagcatccagttcacagatggctatgaggtgaaggaggacattggagtgggcagctacagcgtgtgcaagcgctgcatccacaaggccaccaacatggagtttgctgtgaagatcatcgacaagagcaagagggaccccacagaggagattgagatcctgctgcgctatggccagcaccccaacatcatcaccctgaaggatgtgtatgatgatggcaagtatgtgtatgtggtgacagagctgatgaagggcggggagctgctggacaagatcctgcggcagaagttcttcagcgagcgggaggccagcgctgtgctcttcaccatcaccaagacagtggagtacctgcacgcccagggcgtggtgcaccgggacctgaagcccagcaacatcctgtatgtggatgagagcggcaaccctgagagcatccgcatctgtgactttggatttgccaagcagctgcgggcagaaaatggcctgctgatgaccccctgctacacagccaactttgtggcccctgaggtgctgaagaggcagggctatgatgctgcctgtgacatctggagcctgggcgtgctgctgtacaccatgctgaccggctacaccccatttgccaatggaccagatgacaccccagaggagatcctggcccgcatcggcagcggcaagttcagcctgagcggcggctactggaacagcgtgtctgacacagccaaggacctggtgtccaagatgctgcacgtggacccccaccagaggctgacagctgccctggtgctgcggcacccctggatcgtgcactgggaccagctgccccagtaccagctgaaccggcaggatgccccccacctggtgaagggggccatggccgccacctacagcgccctgaacagaaaccagagccctgtgctggagcctgtgggccgcagcaccctggcccagaggcggggcatcaagaagatcaccagcacagccctgtag

SEQ ID NO: 3740 - DNA, 2139 bp, Artificial Sequence
  Description of Artificial Sequence: Synthetic coding sequence
atggatgagcccatgggagaggaggagatcaacccccagacagaggaggtgtccatcaaggagatcgccatcacccaccacgtgaaggagggccacgagaaggctgaccccagccagtttgagctgctgaaggtgctgggccagggcagctttgggaaggtgttcctggtgaagaagatcagcggcagtgatgcccggcagctgtatgccatgaaggtgctgaagaaggccaccctgaaggtgcgggacagagtgaggaccaagatggagcgggacatcctggtggaggtgaaccaccccttcatcgtgaagctgcactacgccttccagacagagggcaagctgtacctgatcctggacttcctgcggggcggggacctcttcacccggctgagcaaggaggtgatgttcacagaggaggatgtgaagttctacctggccgagctggccctggccctggaccacctgcacagcctgggcatcatctacagagacctgaagccagagaacatcctgctggatgaggagggccacatcaagctgacagactttggcctgagcaaggagagcattgaccacgagaagaaggcctacagcttctgtggcaccgtggagtacatggcccctgaggtggtgaacagaagaggccacacccagagcgctgactggtggagctttggagtgctgatgtttgagatgctgaccggcaccctgcccttccagggcaaggacaggaaggagaccatgaccatgatcctgaaggccaagctgggcatgccccagttcctgagccctgaggcccagagcctgctgaggatgctgttcaagagaaatcctgccaaccggctgggcgccggcccagatggagtggaggagatcaagaggcacagcttcttcagcaccatcgactggaacaagctgtacagaagagagatccacccccccttcaagccagccaccggccggcctgaggacaccttctactttgatcctgagttcaccgccaagacccccaaggacagccctggcatccccccatctgccaatgcccaccagctgttccggggcttctcctttgtggccatcaccagtgatgatgagagccaggccatgcagacagtgggcgtgcacagcatcgtgcagcagctgcacagaaattccatccagttcacagatggctatgaggtgaaggaggacatcggcgtgggcagctacagcgtgtgcaagcgctgcatccacaaggccaccaacatggagtttgctgtgaagatcatcgacaagagcaagagggaccccacagaggagattgagatcctgctgcgctatggccagcaccccaacatcatcaccctgaaggatgtgtatgatgatggcaagtatgtgtatgtggtgacagagctgatgaagggcggggagctgctggacaagatcctgcggcagaagttcttcagcgagcgggaggccagcgctgtgctcttcaccatcaccaagacagtggagtacctgcacgcccagggcgtggtgcaccgggacctgaagcccagcaacatcctgtatgtggatgaaagtggcaaccctgagagcatccgcatctgtgactttggatttgccaagcagctgcgggcagaaaatggcctgctgatgaccccctgctacacagccaactttgtggcccctgaggtgctgaagaggcagggctatgatgctgcctgtgacatctggagcctgggcgtgctgctgtacaccatgctgaccggctacaccccatttgccaacggcccagatgacaccccagaggagatcctggccagaattggcagcggcaagttcagcctgagcggcggctactggaacagcgtgtctgacacagccaaggacctggtgtccaagatgctgcacgtggacccccaccagaggctgacagctgccctggtgctgcggcacccctggatcgtgcactgggaccagctgccccagtaccagctgaaccggcaggatgccccccacctggtgaagggggccatggccgccacctacagcgccctgaacagaaaccagagccctgtgctggagcctgtgggccgcagcaccctggcccagaggcggggcatcaagaagatcaccagcacagccctgtag

SEQ ID NO: 3741 - DNA, 1575 bp, Artificial Sequence
  Description of Artificial Sequence: Synthetic coding sequence
atgggagatgaagatgatgatgagagctgtgctgtggagctgcgcatcacagaggccaacctgaccggccacgaggagaaggtgtctgtggagaactttgagctgctgaaggtgctgggcactggagcctacggcaaggtgttcctggtgaggaaggccggcggccatgatgctgggaagctgtatgccatgaaggtgctgaggaaggccgccctggtgcagagggccaagacccaggagcacaccaggacagagaggtctgtgctggagctggtgcggcaggcccccttcctggtgaccctgcactacgccttccagacagatgccaagctgcacctgatcctggactatgtgtctggaggagagatgttcacccacctgtaccagaggcagtacttcaaggaggccgaggtgcgggtgtatggaggagaaattgtgctggccctggagcacctgcacaagctgggcatcatctacagagacctgaagctggagaatgtgctgctggacagcgagggccacatcgtgctgacagactttggcctgagcaaggagttcctgacagaggagaaggagaggaccttctccttctgtggcaccatcgagtacatggcccctgagatcatccgcagcaagacaggccacggcaaggctgtggactggtggagcctgggcatcctgctgtttgagctgctgactggagccagccccttcaccctggagggggagaggaacacccaggccgaggtgagccgccgcatcctgaagtgcagcccccccttccccccaagaattggccctgtggcccaggacctgctgcagaggctgctgtgcaaggaccccaagaagaggctgggcgccggcccccagggcgcccaggaggtgaggaaccaccccttcttccagggcctggactgggtggccctggccgccaggaagatcccagcccccttccggccccagatccgctctgagctggatgtgggcaactttgctgaggagttcacccggctggagcctgtgtacagccccccaggcagccccccacctggggacccccgcatcttccagggctacagctttgtggcccccagcatcctgtttgaccacaacaatgctgctgagatcatgtgcaagatccgggagggccgcttcagcctggatggagaggcctggcagggcgtgtctgaggaggccaaggagctggtgcggggcctgctgactgtggaccctgccaagaggctgaagctggagggcctgcggggcagctcctggctgcaggacggcagcgcccggagcagcccccccctgcggaccccagatgtgctggagagcagcggccctgctgtgcgcagcggcctgaatgccaccttcatggccttcaacagaggcaagcgggagggcttcttcctgaagtctgtggagaatgcccccctggccaagaggaggaagcagaagctgcggagcgccacagccagccggcggggcagccctgccccagccaaccctggccgggcccctgtggccagcaaaggagccccccggcgggccaacggccccctgccccccagctag

SEQ ID NO: 3742 - DNA, 2319 bp, Artificial Sequence
  Description of Artificial Sequence: Synthetic coding sequence
atgggagatgaagatgatgatgagagctgtgctgtggagctgcgcatcacagaggccaacctgaccggccacgaggagaaggtgtctgtggagaactttgagctgctgaaggtgctgggcactggagcctacggcaaggtgttcctggtgaggaaggccggcggccatgatgctgggaagctgtatgccatgaaggtgctgaggaaggccgccctggtgcagagggccaagacccaggagcacaccaggacagagaggtctgtgctggagctggtgcggcaggcccccttcctggtgaccctgcactacgccttccagacagatgccaagctgcacctgatcctggactatgtgtctggaggagagatgttcacccacctgtaccagaggcagtacttcaaggaggccgaggtgcgggtgtatggaggagaaattgtgctggccctggagcacctgcacaagctgggcatcatctacagagacctgaagctggagaatgtgctgctggacagcgagggccacatcgtgctgacagactttggcctgagcaaggagttcctgacagaggagaaggagaggaccttctccttctgtggcaccatcgagtacatggcccctgagatcatccgcagcaagacaggccacggcaaggctgtggactggtggagcctgggcatcctgctgtttgagctgctgactggagccagccccttcaccctggagggggagaggaacacccaggccgaggtgagccgccgcatcctgaagtgcagcccccccttccccccaagaattggccctgtggcccaggacctgctgcagaggctgctgtgcaaggaccccaagaagaggctgggcgccggcccccagggcgcccaggaggtgaggaaccaccccttcttccagggcctggactgggtggccctggccgccaggaagatcccagcccccttccggccccagatccgctctgagctggatgtgggcaactttgctgaggagttcacccggctggagcctgtgtacagccccccaggcagccccccacctggggacccccgcatcttccagggctacagctttgtggcccccagcatcctgtttgaccacaacaatgctgtgatgacagatggcctggaggcccctggggccggggaccggcccggccgggctgctgtggcccggagcgccatgatgcaggacagccccttcttccagcagtatgagctggacctgcgggagcccgccctgggccagggcagcttctctgtgtgccgccgctgccggcagaggcagagcggccaggagtttgctgtgaagatcctgagccggcggctggaggccaacacccagcgggaggtggccgccctgcggctgtgccagagccaccccaacgtggtgaacctgcacgaggtgcaccacgaccagctgcacacctacctggtgctggagctgctgcggggcggggagctgctggagcacatcaggaagaagaggcacttcagcgagagcgaggccagccagatcctgcggagcctggtgtctgctgtgtccttcatgcatgaggaggccggcgtggtgcaccgggacctgaagccagagaacatcctgtatgcagatgacacccctggggcccctgtgaagatcatcgactttggatttgcccggctgcggccccagagccctggggtgcccatgcagaccccctgcttcaccctgcagtatgctgcccctgagctgctggcccagcagggctatgatgagagctgtgacctgtggagcctgggcgtcatcctgtacatgatgctgagcggccaggtgcccttccagggcgccagcggccagggcggccagagccaggccgctgagatcatgtgcaagatccgggagggccgcttcagcctggatggagaggcctggcagggcgtgtctgaggaggccaaggagctggtgcggggcctgctgactgtggaccctgccaagaggctgaagctggagggcctgcggggcagctcctggctgcaggacggcagcgcccggagcagcccccccctgcggaccccagatgtgctggagagcagcggccctgctgtgcgcagcggcctgaatgccaccttcatggccttcaacagaggcaagcgggagggcttcttcctgaagtctgtggagaatgcccccctggccaagaggaggaagcagaagctgcggagcgccacagccagccggcggggcagccctgccccagccaaccctggccgggcccctgtggccagcaaaggagccccccggcgggccaacggccccctgccccccagctag

SEQ ID NO: 3743 - DNA, 2298 bp, Artificial Sequence
  Description of Artificial Sequence: Synthetic coding sequence
atgggagatgaagatgatgatgagagctgtgctgtggagctgcgcatcacagaggccaacctgaccggccacgaggagaaggtgtctgtggagaactttgagctgctgaaggtgctgggcactggagcctacggcaaggtgttcctggtgaggaaggccggcggccatgatgctgggaagctgtatgccatgaaggtgctgaggaaggccgccctggtgcagagggccaagacccaggagcacaccaggacagagaggtctgtgctggagctggtgcggcaggcccccttcctggtgaccctgcactacgccttccagacagatgccaagctgcacctgatcctggactatgtgtctggaggagagatgttcacccacctgtaccagaggcagtacttcaaggaggccgaggtgcgggtgtatggaggagaaattgtgctggccctggagcacctgcacaagctgggcatcatctacagagacctgaagctggagaatgtgctgctggacagcgagggccacatcgtgctgacagactttggcctgagcaaggagttcctgacagaggagaaggagaggaccttctccttctgtggcaccatcgagtacatggcccctgagatcatccgcagcaagacaggccacggcaaggctgtggactggtggagcctgggcatcctgctgtttgagctgctgactggagccagccccttcaccctggagggggagaggaacacccaggccgaggtgagccgccgcatcctgaagtgcagcccccccttccccccaagaattggccctgtggcccaggacctgctgcagaggctgctgtgcaaggaccccaagaagaggctgggcgccggcccccagggcgcccaggaggtgaggaaccaccccttcttccagggcctggactgggtggccctggccgccaggaagatcccagcccccttccggccccagatccgctctgagctggatgtgggcaactttgctgaggagttcacccggctggagcctgtgtacagccccccaggcagccccccacctggggacccccgcatcttccagggctacagctttgtggcccccagcatcctgtttgaccacaacaatgctgtgatgacagatggcctggaggcccctggggccggggaccggcccggccgggctgctgtggcccggagcgccatgatgcagtatgagctggacctgcgggagcccgccctgggccagggcagcttctctgtgtgccgccgctgccggcagaggcagagcggccaggagtttgctgtgaagatcctgagccggcggctggaggccaacacccagcgggaggtggccgccctgcggctgtgccagagccaccccaacgtggtgaacctgcacgaggtgcaccacgaccagctgcacacctacctggtgctggagctgctgcggggcggggagctgctggagcacatcaggaagaagaggcacttcagcgagagcgaggccagccagatcctgcggagcctggtgtctgctgtgtccttcatgcatgaggaggccggcgtggtgcaccgggacctgaagccagagaacatcctgtatgcagatgacacccctggggcccctgtgaagatcatcgactttggatttgcccggctgcggccccagagccctggggtgcccatgcagaccccctgcttcaccctgcagtatgctgcccctgagctgctggcccagcagggctatgatgagagctgtgacctgtggagcctgggcgtcatcctgtacatgatgctgagcggccaggtgcccttccagggcgccagcggccagggcggccagagccaggccgctgagatcatgtgcaagatccgggagggccgcttcagcctggatggagaggcctggcagggcgtgtctgaggaggccaaggagctggtgcggggcctgctgactgtggaccctgccaagaggctgaagctggagggcctgcggggcagctcctggctgcaggacggcagcgcccggagcagcccccccctgcggaccccagatgtgctggagagcagcggccctgctgtgcgcagcggcctgaatgccaccttcatggccttcaacagaggcaagcgggagggcttcttcctgaagtctgtggagaatgcccccctggccaagaggaggaagcagaagctgcggagcgccacagccagcagaagaggcagccctgccccagccaaccctggccgggcccctgtggccagcaagggggccccccggcgggccaacggccccctgccccccagctag

SEQ ID NO: 3744 - DNA, 2118 bp, Artificial Sequence
  Description of Artificial Sequence: Synthetic coding sequence
acagaggccaacctgaccggccacgaggagaaggtgtctgtggagaactttgagctgctgaaggtgctgggcactggagcctacggcaaggtgttcctggtgaggaaggccggcggccatgatgctgggaagctgtatgccatgaaggtgctgaggaaggccgccctggtgcagagggccaagacccaggagcacaccaggacagagaggtctgtgctggagctggtgcggcaggcccccttcctggtgaccctgcactacgccttccagacagatgccaagctgcacctgatcctggactatgtgtctggaggagagatgttcacccacctgtaccagaggcagtacttcaaggaggccgaggtgcgggtgtatggaggagaaattgtgctggccctggagcacctgcacaagctgggcatcatctacagagacctgaagctggagaatgtgctgctggacagcgagggccacatcgtgctgacagactttggcctgagcaaggagttcctgacagaggagaaggagaggaccttctccttctgtggcaccatcgagtacatggcccctgagatcatccgcagcaagacaggccacggcaaggctgtggactggtggagcctgggcatcctgctgtttgagctgctgactggagccagccccttcaccctggagggggagaggaacacccaggccgaggtgagccgccgcatcctgaagtgcagcccccccttccccccaagaattggccctgtggcccaggacctgctgcagaggctgctgtgcaaggaccccaagaagaggctgggcgccggcccccagggcgcccaggaggtgaggaaccaccccttcttccagggcctggactgggtggccctggccgccaggaagatcccagcccccttccggccccagatccgctctgagctggatgtgggcaactttgctgaggagttcacccggctggagcctgtgtacagccccccaggcagccccccacctggggacccccgcatcttccagggctacagctttgtggcccccagcatcctgtttgaccacaacaatgctgtgatgacagatggcctggaggcccctggggccggggaccggcccggccgggctgctgtggcccggagcgccatgatgcagcagtatgagctggacctgcgggagcccgccctgggccagggcagcttctctgtgtgccgccgctgccggcagaggcagagcggccaggagtttgctgtgaagatcctgagccggcggctggaggccaacacccagcgggaggtggccgccctgcggctgtgccagagccaccccaacgtggtgaacctgcacgaggtgcaccacgaccagctgcacacctacctggtgctggagctgctgcggggcggggagctgctggagcacatcaggaagaagaggcacttcagcgagagcgaggccagccagatcctgcggagcctggtgtctgctgtgtccttcatgcatgaggaggccggcgtggtgcaccgggacctgaagccagagaacatcctgtatgcagatgacacccctggggcccctgtgaagatcatcgactttggatttgcccggctgcggccccagagccctggggtgcccatgcagaccccctgcttcaccctgcagtatgctgcccctgagctgctggcccagcagggctatgatgagagctgtgacctgtggagcctgggcgtcatcctgtacatgatgctgagcggccaggtgcccttccagggcgccagcggccagggcggccagagccaggccgctgagatcatgtgcaagatccgggagggccgcttcagcctggatggagaggcctggcagggcgtgtctgaggaggccaaggagctggtgcggggcctgctgactgtggaccctgccaagaggctgaagctggagggcctgcggggcagctcctggctgcaggacggcagcgcccggagcagcccccccctgcggaccccagatgtgctggagagcagcggccctgctgtgcgcagcggcctgaatgccaccttcatggccttcaacagaggcaagcgggagggcttcttcctgaagtctgtggagaatgcccccctgtag

SEQ ID NO: 3745 - DNA, 2409 bp, Artificial Sequence
  Description of Artificial Sequence: Synthetic coding sequence
atggaggaggagggcggcagcagcggcggggccgccggcaccagcgcagatggaggagatggaggagagcagctgctgactgtgaagcatgagctgaggacagccaacctgaccggccatgctgagaaggtgggcattgaaaattttgagctgctgaaggtgctgggcactggagcctacggcaaggtgttcctggtgaggaagatcagcggccatgacaccgggaagctgtatgccatgaaggtgctgaagaaggccaccatcgtgcagaaggccaagaccacagagcacaccaggacagagcggcaggtgctggagcacatccggcagagccccttcctggtgaccctgcactacgccttccagacagagaccaagctgcacctgatcctggactacatcaatggaggagagctgttcacccacctgagccagcgggagcgcttcacagagcacgaggtgcagatctacgtgggggagatcgtgctggccctggagcacctgcacaagctgggcatcatctacagagacatcaagctggagaacatcctgctggacagcaatggccacgtggtgctgacagactttggcctgagcaaggagtttgtggctgatgaaacagagcgggcctacagcttctgtggcaccatcgagtacatggccccagacatcgtgcggggcggggacagcggccatgacaaggctgtggactggtggagcctgggcgtgctgatgtatgagctgctgaccggggccagccccttcaccgtggatggagagaagaacagccaggccgagatcagccgccgcatcctgaagtctgagcccccctacccccaggagatgtctgccctggccaaggacctgatccagaggctgctgatgaaggaccccaagaagaggctgggctgcggccccagagatgctgatgagatcaaggagcacctgttcttccagaagatcaactgggatgacctggccgccaagaaggtgcctgcccccttcaagcctgtgatcagagatgagctggatgtgagcaactttgctgaggagttcacagagatggaccccacctacagccctgctgccctgccccagagcagcgagaagctgttccagggctacagctttgtggcccccagcatcctcttcaagagaaatgctgctgtgattgaccccctgcagttccacatgggcgtggagaggcctggggtgaccaacgtggcccggagcgccatgatgaaggacagccccttctaccagcactatgacctggacctgaaggacaagcccctgggggagggcagcttcagcatctgcaggaaatgtgtgcacaagaagagcaaccaggcctttgctgtgaagatcatcagcaagaggatggaggccaacacccagaaggagatcacagccctgaagctgtgtgagggccaccccaacatcgtgaagctgcacgaggtgttccatgaccagctgcacaccttcctggtgatggagctgctgaatggaggagagctgtttgagcgcatcaagaagaagaagcacttcagcgagacagaggccagctacatcatgaggaagctggtgtctgctgtgagccacatgcatgatgtgggcgtggtgcaccgggacctgaagccagagaacctgctcttcacagatgaaaatgacaacctggagatcaagatcatcgactttggatttgcccggctgaagcccccagacaaccagcccctgaagaccccctgcttcaccctgcactatgctgcccctgagctgctgaaccagaatggctatgatgagagctgtgacctgtggagcctgggcgtcatcctgtacaccatgctgagcggccaggtgcccttccagagccatgacaggagcctgacctgcaccagcgctgtggagatcatgaagaagatcaagaagggggacttctcctttgaaggagaggcctggaagaatgtgtcccaggaggccaaggacctgatccagggcctgctgactgtggaccccaacaagaggctgaagatgagcggcctgcgctacaatgagtggctgcaggacggcagccagctgagcagcaaccccctgatgaccccagacatcctgggcagcagtggagctgctgtgcacacctgtgtgaaggccaccttccacgccttcaacaagtacaagcgggagggcttctgcctgcagaatgtggacaaggcccccctggccaagaggaggaagatgaagaagaccagcaccagcacagagaccaggagcagcagcagcgagagcagccacagcagcagcagccacagccacggcaagaccacccccaccaagaccctgcagcccagcaacccagctgacagcaacaaccctgagaccctcttccagttcagtgacagcgtggcctag

SEQ ID NO: 3746 - DNA, 1650 bp, Artificial Sequence
  Description of Artificial Sequence: Synthetic coding sequence
atggaggaggagggcggcagcagcggcggggccgccggcaccagcgcagatggaggagatggaggagagcagctgctgactgtgaagcatgagctgaggacagccaacctgaccggccatgctgagaaggtgggcattgaaaattttgagctgctgaaggtgctgggcactggagcctacggcaaggtgttcctggtgaggaagatcagcggccatgacaccgggaagctgtatgccatgaaggtgctgaagaaggccaccatcgtgcagaaggccaagaccacagagcacaccaggacagagcggcaggtgctggagcacatccggcagagccccttcctggtgaccctgcactacgccttccagacagagaccaagctgcacctgatcctggactacatcaatggaggagagctgttcacccacctgagccagcgggagcgcttcacagagcacgaggtgcagatctacgtgggggagatcgtgctggccctggagcacctgcacaagctgggcatcatctacagagacatcaagctggagaacatcctgctggacagcaatggccacgtggtgctgacagactttggcctgagcaaggagtttgtggctgatgaaacagagcgggcctacagcttctgtggcaccatcgagtacatggccccagacatcgtgcggggcggggacagcggccatgacaaggctgtggactggtggagcctgggcgtgctgatgtatgagctgctgaccggggccagccccttcaccgtggatggagagaagaacagccaggccgagatcagccgccgcatcctgaagtctgagcccccctacccccaggagatgtctgccctggccaaggacctgatccagaggctgctgatgaaggaccccaagaagaggctgggctgcggccccagagatgctgatgagatcaaggagcacctgttcttccagaagatcaactgggatgacctggccgccaagaaggtgcctgcccccttcaagcctgtgatcagagatgagctggatgtgagcaactttgctgaggagttcacagagatggaccccacctacagccctgctgccctgccccagagcagcgagaagctgttccagggctacagctttgtggcccccagcatcctcttcaagagaaatgctgctgtgattgaccccctgcagttccacatgggcgtggagaggcctggggtgaccaacgtggcccggagcgccatgatgaaggacagccccttctaccagcactatgacctggacctgaaggacaagcccctgggggagggcagcttcagcatctgcaggaaatgtgtgcacaagaagagcaaccaggcctttgctgtgaagatcatcagcaagaggatggaggccaacacccagaaggagatcacagccctgaagctgtgtgagggccaccccaacatcgtgaagctgcacgaggtgttccatgaccagctgcacaccttcctggtgatggagctgctgaatggaggagagctgtttgagcgcatcaagaagaagaagcacttcagcgagacagaggccagctacatcatgaggaagctggtgtctgctgtgagccacatgcatgatgtgggcgtggtgcaccgggacctgaagccagaggtgtag

SEQ ID NO: 3747 - DNA, 2172 bp, Artificial Sequence
  Description of Artificial Sequence: Synthetic coding sequence
atgaaggtgctgaagaaggccaccatcgtgcagaaggccaagaccacagagcacaccaggacagagcggcaggtgctggagcacatccggcagagccccttcctggtgaccctgcactacgccttccagacagagaccaagctgcacctgatcctggactacatcaatggaggagagctgttcacccacctgagccagcgggagcgcttcacagaacatgaggtgcagatctacgtgggggagatcgtgctggccctggagcacctgcacaagctgggcatcatctacagagacatcaagctggagaacatcctgctggacagcaatggacatgtggtgctgacagactttggcctgagcaaggagtttgtggctgatgaaacagagcgggcctacagcttctgtggcaccatcgagtacatggccccagacatcgtgcggggcggggacagcggccatgacaaggctgtggactggtggagcctgggcgtgctgatgtatgagctgctgactggagccagccccttcaccgtggatggagagaagaacagccaggccgagatcagccgccgcatcctgaagtctgagcccccctacccccaggagatgtctgccctggccaaggacctgatccagaggctgctgatgaaggaccccaagaagaggctgggctgcggccccagagatgctgatgagatcaaggagcacctgttcttccagaagatcaactgggatgacctggccgccaagaaggtgcctgcccccttcaagcctgtgatcagagatgagctggatgtgagcaactttgctgaggagttcacagagatggaccccacctacagccctgctgccctgccccagagcagcgagaagctgttccagggctacagctttgtggcccccagcatcctcttcaagagaaatgctgctgtgattgaccccctgcagttccacatgggcgtggagaggcctggggtgaccaacgtggcccggagcgccatgatgaaggacagccccttctaccagcactatgacctggacctgaaggacaagcccctgggggagggcagcttcagcatctgcaggaaatgtgtgcacaagaagagcaaccaggcctttgctgtgaagatcatcagcaagaggatggaggccaacacccagaaggagatcacagccctgaagctgtgtgagggccaccccaacatcgtgaagctgcacgaggtgttccatgaccagctgcacaccttcctggtgatggagctgctgaatggaggagagctgtttgagcgcatcaagaagaagaagcacttcagcgagacagaggccagctacatcatgaggaagctggtgtctgctgtgagccacatgcatgatgtgggcgtggtgcaccgggacctgaagccagagaacctgctcttcacagatgaaaatgacaacctggagatcaagatcatcgactttggatttgcccggctgaagcccccagacaaccagcccctgaagaccccctgcttcaccctgcactacgccgcccctgagctgctgaaccagaatggctatgatgagagctgtgacctgtggagcctgggcgtcatcctgtacaccatgctgagcggccaggtgcccttccagagccatgacaggagcctgacctgcaccagcgctgtggagatcatgaagaagatcaagaagggggacttctcctttgaaggagaggcctggaagaatgtgtcccaggaggccaaggacctgatccagggcctgctgactgtggaccccaacaagaggctgaagatgagcggcctgcgctacaatgagtggctgcaggacggcagccagctgagcagcaaccccctgatgaccccagacatcctgggcagcagcggggctgctgtgcacacctgtgtgaaggccaccttccacgccttcaacaagtacaagcgggagggcttctgcctgcagaatgtggacaaggcccccctggccaagaggaggaagatgaagaagaccagcaccagcacagagaccaggagcagcagcagcgagagcagccacagcagcagcagccacagccacggcaagaccacccccaccaagaccctgcagcccagcaacccagctgacagcaacaaccctgagaccctcttccagttcagtgacagcgtggcctag

SEQ ID NO: 3748 - DNA, 2238 bp, Artificial Sequence
  Description of Artificial Sequence: Synthetic coding sequence
atgctgccctttgccccccaggatgagccctgggaccgggagatggaggtgttttctgggggcggggccagcagtggagaggtgaatggcctgaagatggtggatgagcccatggaggagggggaggccgacagctgccatgatgagggcgtggtgaaggagatccccatcacccaccacgtgaaggagggctatgagaaggctgaccctgcccagtttgagctgctgaaggtgctgggccagggcagctttgggaaggtgttcctggtgaggaagaagacaggcccagatgctggccagctgtatgccatgaaggtgctgaagaaggccagcctgaaggtgcgggacagagtgaggaccaagatggagcgggacatcctggtggaggtgaaccaccccttcatcgtgaagctgcactacgccttccagacagagggcaagctgtacctgatcctggacttcctgcggggaggagatgtgttcacccggctgagcaaggaggtgctcttcacagaagaagatgtgaagttctacctggccgagctggccctggccctggaccacctgcaccagctgggcatcgtgtacagagacctgaagccagagaacatcctgctggatgaaattggccacatcaagctgacagactttggcctgagcaaggagagcgtggaccaggagaagaaggcctacagcttctgtggcaccgtggagtacatggcccctgaggtggtgaacagaagaggccacagccagagcgctgactggtggagctatggagtgctgatgtttgagatgctgaccggcaccctgcccttccagggcaaggacagaaatgagaccatgaacatgatcctgaaggccaagctgggcatgccccagttcctgtctgctgaggcccagagcctgctgaggatgctgttcaagaggaacccagccaaccggctgggcagcgagggcgtggaggagatcaagaggcacctgttctttgccaacatcgactgggacaagctgtacaagcgggaggtgcagccccccttcaagccagccagcggcaagccagatgacaccttctgctttgatcctgagttcaccgccaagacccccaaggacagccctggcctgcctgccagcgccaatgcccaccagctgttcaagggcttctcctttgtggccaccagcattgctgaggagtacaagatcacccccatcaccagcgccaacgtgctgcccatcgtgcagatcaatggaaatgctgcccagtttggagaggtgtatgagctgaaggaggacatcggcgtgggcagctacagcgtgtgcaagcgctgcatccacgccaccaccaacatggagtttgctgtgaagatcatcgacaagagcaagagggaccccagcgaggagattgagatcctgatgagatatggccagcaccccaacatcatcaccctgaaggatgtgtttgatgatggccgctacgtgtacctggtgacagacctgatgaagggcggggagctgctggaccgcatcctgaagcagaagtgcttcagcgagcgggaggccagtgacatcctgtatgtgatcagcaagacagtggactacctgcactgccagggcgtggtgcaccgggacctgaagcccagcaacatcctgtacatggatgaaagtgccagcgctgacagcatccgcatctgtgactttggatttgccaagcagctgcggggagaaaatggcctgctgctgaccccctgctacacagccaactttgtggcccctgaggtgctgatgcagcagggctatgatgctgcctgtgacatctggagcctgggcgtgctcttctacaccatgctggccggctacaccccatttgccaacggccccaatgacaccccagaggagatcctgctgagaattggaaatggcaagttcagcctgagcggcggcaactgggacaacatcagtgatggagccaaggacctgctgagccacatgctgcacatggacccccaccagcgctacacagctgagcagatcctgaagcacagctggatcacccaccgggaccagctgcccaatgaccagcccaagagaaatgatgtgagccacgtggtgaagggggccatggtggccacctacagcgccctgacccacaagaccttccagcctgtgctggagcctgtggccgccagcagcctggcccagaggaggtccatgaagaagaggaccagcacaggcctgtag

SEQ ID NO: 3749 - DNA, 2238 bp, Artificial Sequence
  Description of Artificial Sequence: Synthetic coding sequence
atgggcctgagcaccagcgccatctggaagaacaccagggtggagatcgtgaacccctatgaggtgaagaggaaggtgaaggtgaatggcctgaagatggtggatgagcccatggaggagggggaggccgacagctgccatgatgagggcgtggtgaaggagatccccatcacccaccacgtgaaggagggctatgagaaggctgaccctgcccagtttgagctgctgaaggtgctgggccagggcagctttgggaaggtgttcctggtgaggaagaagacaggcccagatgctggccagctgtatgccatgaaggtgctgaagaaggccagcctgaaggtgcgggacagagtgaggaccaagatggagcgggacatcctggtggaggtgaaccaccccttcatcgtgaagctgcactacgccttccagacagagggcaagctgtacctgatcctggacttcctgcggggaggagatgtgttcacccggctgagcaaggaggtgctcttcacagaagaagatgtgaagttctacctggccgagctggccctggccctggaccacctgcaccagctgggcatcgtgtacagagacctgaagccagagaacatcctgctggatgaaattggccacatcaagctgacagactttggcctgagcaaggagagcgtggaccaggagaagaaggcctacagcttctgtggcaccgtggagtacatggcccctgaggtggtgaacagaagaggccacagccagagcgctgactggtggagctatggagtgctgatgtttgagatgctgaccggcaccctgcccttccagggcaaggacagaaatgagaccatgaacatgatcctgaaggccaagctgggcatgccccagttcctgtctgctgaggcccagagcctgctgaggatgctgttcaagaggaacccagccaaccggctgggcagcgagggcgtggaggagatcaagaggcacctgttctttgccaacatcgactgggacaagctgtacaagcgggaggtgcagccccccttcaagccagccagcggcaagccagatgacaccttctgctttgatcctgagttcaccgccaagacccccaaggacagccctggcctgcctgccagcgccaatgcccaccagctgttcaagggcttctcctttgtggccaccagcattgctgaggagtacaagatcacccccatcaccagcgccaacgtgctgcccatcgtgcagatcaatggaaatgctgcccagtttggagaggtgtatgagctgaaggaggacatcggcgtgggcagctacagcgtgtgcaagcgctgcatccacgccaccaccaacatggagtttgctgtgaagatcatcgacaagagcaagagggaccccagcgaggagattgagatcctgatgagatatggccagcaccccaacatcatcaccctgaaggatgtgtttgatgatggccgctacgtgtacctggtgacagacctgatgaagggcggggagctgctggaccgcatcctgaagcagaagtgcttcagcgagcgggaggccagtgacatcctgtatgtgatcagcaagacagtggactacctgcactgccagggcgtggtgcaccgggacctgaagcccagcaacatcctgtacatggatgaaagtgccagcgctgacagcatccgcatctgtgactttggatttgccaagcagctgcggggagaaaatggcctgctgctgaccccctgctacacagccaactttgtggcccctgaggtgctgatgcagcagggctatgatgctgcctgtgacatctggagcctgggcgtgctcttctacaccatgctggccggctacaccccatttgccaacggccccaatgacaccccagaggagatcctgctgagaattggaaatggcaagttcagcctgagcggcggcaactgggacaacatcagtgatggagccaaggacctgctgagccacatgctgcacatggacccccaccagcgctacacagctgagcagatcctgaagcacagctggatcacccaccgggaccagctgcccaatgaccagcccaagagaaatgatgtgagccacgtggtgaagggggccatggtggccacctacagcgccctgacccacaagaccttccagcctgtgctggagcctgtggccgccagcagcctggcccagaggaggtccatgaagaagaggaccagcacaggcctgtag

SEQ ID NO: 3750 - DNA, 1626 bp, Artificial Sequence
  Description of Artificial Sequence: Synthetic coding sequence
atgagcctggtggcctgtgaatgtctgcccagccctggcctggagcctgagccctgcagccgggcccggagccaggcccacgtgtacctggagcagatccggaacagagtggccctgggcgtgcctgacatgaccaagagggactacctggtggatgctgccacccagatccggctggccctggagagagatgtgtctgaagattatgaagctgccttcaaccactaccagaatggagtggatgtgctgctgcggggcatccacgtggaccccaacaaggagcggcgggaggccgtgaagctgaagatcaccaagtacctgcggcgggcagaggagatcttcaactgccacctgcagaggcccctgagcagcggggccagccccagcgctgtgcagctggtgcaggaccctgccactggaggcacctttgtggtgaagagcctgccccgctgccacatggtgtcccgggagcggctgaccatcatcccccacggcgtgccctacatgaccaagctgctgcgctactttgtgtctgaagattccatcttcctgcacctggagcacgtgcagggcggcaccctgtggagccacctgctgagccaggcccacagccgccacagcggcctgagcagcggcagcacccaggagaggatgaaggcccagctgaacccccacctgaacctgctgaccccagcccggctgcccagcggccacgcccctggccaggacagaattgccctggagccccccaggaccagccccaacctgctgctggccggggaggcccccagcacccggccccagcgggaggccgagggggagcccacagcccggaccagcaccagcggcagcagtgacctgcccaaggcccctgggggccacctgcacctgcaggcccggcgggccggccagaacagtgatgctggccccccccggggcctgacctgggtgcctgagggcgccggccctgtgctgggcggctgcggccggggcatggaccagagctgcctgtctgcagatggagctggccggggctgcggccgggccacctggagcgtgcgggaggagcaggtgaagcagtgggccgctgagatgctggtggccctggaggccctgcacgagcagggcgtgctgtgccgggacctgcaccctggcaacctgctgctggaccaggccggccacatccggctgacctacttcggccagtggagcgaggtggagccccagtgctgcggggaggccgtggacaacctgtacagcgcccctgaggtgggcggcatcagcgagctgacagaggcctgtgactggtggagctttggcagcctgctgtatgagctgctgaccggcatggccctgagccagagccaccccagcggcatccaggcccacacccagctgcagctgcctgagtggctgagcaggcctgctgccagcctgctgacagagctgctgcagtttgagcccacccggcggctgggcatgggagagggcggcgtgtccaagctgaagagccaccccttcttcagcaccatccagtggagcaagctggtgggcaccagcctggagacccacctgcggaccctcatccactggctgagcggccccaagccagactgccccggctag

SEQ ID NO: 3751 - DNA, 1650 bp, Artificial Sequence
  Description of Artificial Sequence: Synthetic coding sequence
atgagcctggtggcctgtgaatgtctgcccagccctggcctggagcctgagccctgcagccgggcccggagccaggcccacgtgtacctggagcagatccggaacagagtggccctgggcgtgcctgacatgaccaagagggactacctggtggatgctgccacccagatccggctggccctggagagagatgtgtctgaagattatgaagctgccttcaaccactaccagaatggagtggatgtgctgctgcggggcatccacgtggaccccaacaaggagcggcgggaggccgtgaagctgaagatcaccaagtacctgcggcgggcagaggagatcttcaactgccacctgcagaggcccctgagcagcggggccagccccagcgctggcttcagcagcctgcggctgcggcccatccgcaccctgagcagcgctgtggagcagctgcggggctgccgggtggtgggcgtgattgagaaggtgcagctggtgcaggaccctgccaccggcggcacctttgtggtgaagagcctgccccgctgccacatggtgtcccgggagcggctgaccatcatcccccatggagtgccctacatgaccaagctgctgcgctactttgtgtctgaggacagcatcttcctgcacctggagcacgtgcagggcggcaccctgtggagccacctgctgagccaggcccacagccgccacagcggcctgagcagcggcagcacccaggagaggatgaaggcccagctgaacccccacctgaacctgctgaccccagcccggctgcccagcggccacgcccctggccaggaccgcatcgccctggagccccccaggaccagccccaacctgctgctggccggggaggcccccagcacccggccccagcgggaggccgagggggagcccacagcccggaccagcaccagcggcagcagtgacctgcccaaggcccctgggggccacctgcacctgcaggccaggagagctggccagaacagtgatgctggccccccccggggcctgacctgggtgcctgagggcgccggccctgtgctgggcggctgcggccggggcatggaccagagctgcctgtctgcagatggagctggccggggctgcggccgggccacctggagcgtgcgggaggagcaggtgaagcagtgggccgctgagatgctggtggccctggaggccctgcacgagcagggcgtgctgtgccgggacctgcaccctggcaacctgctgctggaccaggccggccacatccggctgacctacttcggccagtggagcgaggtggagccccagtgctgcggggaggccgtggacaacctgtacagcgcccctgaggtgggcggcatcagcgagctgacagaggcctgtgactggtggagctttggcagcctgctgtatgagctgctgaccggcatggccctgagccagagccaccccagcggcatccaggcccacacccagctgcagctgcctgagtggctgagcaggcctgctgccagcctgctgacagagctgctgcagtttgagcccacccggcggctgggcatgggagagggcggcgtgtccaagctgaagagccaccccttcttcagcaccatccagtggagcaagctggtgggctag

SEQ ID NO: 3752 - DNA, 1650 bp, Artificial Sequence; identical to SEQ ID NO: 3751
  Description of Artificial Sequence: Synthetic coding sequence

SEQ ID NO: 3753 - DNA, 30 bp, Artificial Sequence
  Description of Artificial Sequence: Synthetic coding sequence
atgagcctggtggcctgtgaatgtctgtag

SEQ ID NO: 3754 - DNA, 1650 bp, Artificial Sequence; identical to SEQ ID NO: 3751
  Description of Artificial Sequence: Synthetic coding sequence

SEQ ID NO: 3755 - DNA, 1818 bp, Artificial Sequence
  Description of Artificial Sequence: Synthetic coding sequence
atgctgccccagcaggtgggctttgtgtgtgctgtgctggccctggtgtgctgtgccagcggcctgtttggcagcctgggccacaagacagccagcgccagcaagagggtgctgcctgacacctggaggaacaggaagctgatggcccctgtgaatggcacccagacagccaagaactgcacagatcctgccatccacgagttccccacagacctcttcagcaacaaggagcggcagcacggggctgtgctgctgcacatcctgggcgccctgtacatgttttatgccctggccatcgtgtgtgatgacttctttgtgcccagcctggagaagatctgtgagcggctgcacctgtctgaagatgtggccggggccaccttcatggccgccggcagcagcaccccagagctgtttgccagcgtcatcggggtcttcatcacccatggagatgtgggcgtgggcaccatcgtgggcagcgctgtgttcaacatcctgtgcatcatcggcgtgtgtggcctgtttgctggccaggtggtgcggctgacctggtgggccgtgtgccgggacagcgtgtactacaccatcagcgtcatcgtgctgattgtgttcatctatgatgagcagatcgtgtggtgggagggcctggtgctgatcatcctgtatgtgttctacatcctgatcatgaagtacaacgtgaagatgcaggccttcttcaccgtgaagcagaagagcatcgccaatggaaatcctgtgaacagcgagctggaggccggaaatgacttctatgatggcagctatgatgaccccagcgtgcccctgctgggccaggtgaaggagaagccccagtatggcaagaaccctgtggtgatggtggatgagatcatgagcagcagcccccccaagttcaccttccctgaggccggcctgcgcatcatgatcaccaacaagtttggccccaggacccggctgaggatggccagccgcatcatcatcaatgaaaggcagaggctcatcaacagcgccaacggggtgagcagcaagcccctgcagaatggaagacatgaaaatattgaaaatggaaatgtgcctgtggagaaccctgaggacccccagcagaaccaggagcagcagcccccaccccagcccccacctcctgagcctgagcctgtggaggccgacttcctgagccccttctctgtgcctgaggcccggggggacaaggtgaagtgggtgttcacctggcccctcatcttcctgctgtgtgtgaccatccccaactgcagcaagccccgctgggagaagttcttcatggtgaccttcatcacagccaccctgtggattgctgtgttctcctacatcatggtgtggctggtgaccatcatcggctacaccctgggcatcccagatgtgatcatgggcatcaccttcctggccgccggcacctctgtgcctgactgcatggccagcctgattgtggcccggcagggcctgggggacatggctgtgagcaacaccatcggcagcaatgtgtttgacatcctggtgggcctgggcgtgccctggggcctgcagaccatggtggtgaactacggcagcacagtgaagatcaacagccggggcctggtgtacagcgtggtgctgctgctgggctctgtggccctgactgtgctgggcatccacctgaacaagtggaggctggacaggaagctgggcgtgtatgtgctggtgctgtatgccatcttcctgtgcttcagcatcatgattgagttcaacgtgttcacctttgtgaacctgcccatgtgcagagaagatgactag

SEQ ID NO: 3756 - DNA, 1059 bp, Artificial Sequence
  Description of Artificial Sequence: Synthetic coding sequence
atgttttatgccctggccatcgtgtgtgatgacttctttgtgcccagcctggagaagatctgtgagcggctgcacctgtctgaagatgtggccggggccaccttcatggccgccggcagcagcaccccagagctgtttgccagcgtcatcggggtcttcatcacccatggagatgtgggcgtgggcaccatctctgtgtcctttgccctgcagttcatctatgatgagcagatcgtgtggtgggagggcctggtgctgatcatcctgtatgtgttctacatcctgatcatgaagtacaacgtgaagatgcaggccttcttcaccgtgaagcagaagagcatcgccaacggcaaccctgtgaacagcgagctggaggccggaaatgacttctatgatggcagctatgatgaccccagcgtgcccctgctgggccaggtgaaggagaagccccagtatggcaagaaccctgtggtgatggtggatgagatcatgagcagcagcccccccaagttcaccttccctgaggccggcctgcgcatcatgatcaccaacaagtttggccccaggacccggctgaggatggccagccgcatcatcatcaatgaaaggcagaggctcatcaacagcgccaatggagtgagcagcaagcccctgcagaatggaagacatgagaacattgaaaatggaaatgtgcctgtggagaaccctgaggacccccagcagaaccaggagcagcagcccccaccccagcccccacctcctgagcctgagcctgtggaggccgacttcctgagccccttctctgtgcctgaggcccggggggacaaggtgaagtgggtgttcacctggcccctcatcttcctgctgtgtgtgaccatccccaactgcagcaagccccgctgggagaagttcttcatggtgaccttcatcacagccaccctgtggattgctgtgttctcctacatcatggtgtggctggagcagcgggagggcaagcagttccagcacggctgcagctctgtggactgtgagacccacagccagcccctgaccccctag

SEQ ID NO: 3757 - DNA, 1761 bp, Artificial Sequence
  Description of Artificial Sequence: Synthetic coding sequence
atgctgccccagcaggtgggctttgtgtgtgctgtgctggccctggtgtgctgtgccagcggcctgtttggcagcctgggccacaagacagccagcgccagcaagagggtgctgcctgacacctggaggaacaggaagctgatggcccctgtgaatggcacccagacagccaagaactgcacagatcctgccatccacgagttccccacagacctcttcagcaacaaggagcggcagcacggggctgtgctgctgcacatcctgggcgccctgtacatgttttatgccctggccatcgtgtgtgatgacttctttgtgcccagcctggagaagatctgtgagcggctgcacctgtctgaagatgtggccggggccaccttcatggccgccggcagcagcaccccagagctgtttgccagcgtcatcggggtcttcatcacccatggagatgtgggcgtgggcaccatcgtgggcagcgctgtgttcaacatcctgtgcatcatcggcgtgtgtggcctgtttgctggccaggtggtgcggctgacctggtgggccgtgtgccgggacagcgtgtactacaccatcagcgtcatcgtgctgattgtgttcatctatgatgagcagatcgtgtggtgggagggcctggtgctgatcatcctgtatgtgttctacatcctgatcatgaagtacaacgtgaagatgcaggccttcttcaccgtgaagcagaagagcatcgccaatggaaatcctgtgaacagcgagctggaggccgtgaaggagaagccccagtatggcaagaaccctgtggtgatggtggatgagatcatgagcagcagcccccccaagttcaccttccctgaggccggcctgcgcatcatgatcaccaacaagtttggccccaggacccggctgaggatggccagccgcatcatcatcaatgaaaggcagaggctcatcaacagcgccaatggagtgagcagcaagcccctgcagaatggaagacatgagaacattgaaaatggaaatgtgcctgtggagaaccctgaggacccccagcagaaccaggagcagcagcccccaccccagcccccacctcctgagcctgagcctgtggaggccgacttcctgagccccttctctgtgcctgaggcccggggggacaaggtgaagtgggtgttcacctggcccctcatcttcctgctgtgtgtgaccatccccaactgcagcaagccccgctgggagaagttcttcatggtgaccttcatcacagccaccctgtggattgctgtgttctcctacatcatggtgtggctggtgaccatcatcggctacaccctgggcatcccagatgtgatcatgggcatcaccttcctggccgccggcacctctgtgcctgactgcatggccagcctcatcgtggcccggcagggcctgggggacatggctgtgagcaacaccatcggcagcaatgtgtttgacatcctggtgggcctgggcgtgccctggggcctgcagaccatggtggtgaactacggcagcacagtgaagatcaacagccggggcctggtgtacagcgtggtgctgctgctgggctctgtggccctgactgtgctgggcatccacctgaacaagtggaggctggacaggaagctgggcgtgtatgtgctggtgctgtatgccatcttcctgtgcttcagcatcatgattgagttcaacgtgttcacctttgtgaacctgcccatgtgccgggaggatgactag

SEQ ID NO: 3758 - DNA, 1677 bp, Artificial Sequence
  Description of Artificial Sequence: Synthetic coding sequence
atggcccctgtgaatggcacccagacagccaagaactgcacagatcctgccatccacgagttccccacagacctcttcagcaacaaggagcggcagcacggggctgtgctgctgcacatcctgggcgccctgtacatgttctacgccctggccatcgtgtgtgatgacttctttgtgcccagcctggagaagatctgtgagcggctgcacctgtctgaagatgtggccggggccaccttcatggctgctggcagcagcaccccagagctgtttgcctctgtgattggagtcttcatcacccatggagatgtgggcgtgggcaccatcgtgggcagcgctgtgttcaacatcctgtgcatcattggagtgtgtggcctgtttgctggccaggtggtgcggctgacctggtgggccgtgtgccgggacagcgtgtactacaccatctctgtgattgtgctgattgtgttcatctatgatgagcagatcgtgtggtgggagggcctggtgctgatcatcctgtatgtgttctacatcctgatcatgaagtacaacgtgaagatgcaggccttcttcaccgtgaagcagaagagcatcgccaacggcaaccctgtgaacagcgagctggaggccggaaatgacttctatgatggcagctatgatgaccccagcgtgcccctgctgggccaggtgaaggagaagccccagtatggcaagaaccctgtggtgatggtggatgagatcatgagcagcagcccccccaagttcaccttccctgaggccggcctgcgcatcatgatcaccaacaagtttggccccaggacccggctgaggatggccagccgcatcatcatcaatgaaaggcagaggctcatcaacagcgccaatggagtgagcagcaagcccctgcagaatggaagacatgagaacattgaaaatggaaatgtgcctgtggagaaccctgaggacccccagcagaaccaggagcagcagcccccaccccagcccccacctcctgagcctgagcctgtggaggccgacttcctgagccccttctctgtgcctgaggcccggggggacaaggtgaagtgggtgttcacctggcccctcatcttcctgctgtgtgtgaccatccccaactgcagcaagccccgctgggagaagttcttcatggtgaccttcatcacagccaccctgtggattgctgtgttctcctacatcatggtgtggctggtgaccatcatcggctacaccctgggcatcccagatgtgatcatgggcatcaccttcctggccgccggcacctctgtgcctgactgcatggccagcctcatcgtggcccggcagggcctgggggacatggctgtgagcaacaccatcggcagcaatgtgtttgacatcctggtgggcctgggcgtgccctggggcctgcagaccatggtggtgaactacggcagcacagtgaagatcaacagccggggcctggtgtacagcgtggtgctgctgctgggctctgtggccctgactgtgctgggcatccacctgaacaagtggaggctggacaggaagctgggcgtgtatgtgctggtgctgtatgccatcttcctgtgcttcagcatcatgattgagttcaacgtgttcacctttgtgaacctgcccatgtgccgggaggatgactag

SEQ ID NO: 3759 - DNA, 1812 bp, Artificial Sequence
  Description of Artificial Sequence: Synthetic coding sequence
atggccctgcggggcaccctgcggcccctgaaggtgagaagaagaagagagatgctgccccagcaggtgggctttgtgtgtgctgtgctggccctggtgtgctgtgccagcggcctgtttggcagcctgggccacaagacagccagcgccagcaagagggtgctgcctgacacctggaggaacaggaagctgatggcccctgtgaatggcacccagacagccaagaactgcacagatcctgccatccacgagttccccacagacctcttcagcaacaaggagcggcagcacggggctgtgctgctgcacatcctgggcgccctgtacatgttctacgccctggccatcgtgtgtgatgacttctttgtgcccagcctggagaagatctgtgagcggctgcacctgtctgaagatgtggccggggccaccttcatggctgctggcagcagcaccccagagctgtttgcctctgtgattggagtcttcatcacccatggagatgtgggcgtgggcaccatcgtgggcagcgctgtgttcaacatcctgtgcatcattggagtgtgtggcctgtttgctggccaggtggtgcggctgacctggtgggccgtgtgccgggacagcgtgtactacaccatctctgtgattgtgctgattgtgttcatctatgatgagcagatcgtgtggtgggagggcctggtgctgatcatcctgtatgtgttctacatcctgatcatgaagtacaacgtgaagatgcaggccttcttcaccgtgaagcagaagagcatcgccaacggcaaccctgtgaacagcgagctggaggccgtgaaggagaagccccagtatggcaagaaccctgtggtgatggtggatgagatcatgagcagcagcccccccaagttcaccttccctgaggccggcctgcgcatcatgatcaccaacaagtttggccccaggacccggctgaggatggccagccgcatcatcatcaatgaaaggcagaggctcatcaacagcgccaacggggtgagcagcaagcccctgcagaatggaagacatgaaaatattgaaaatggaaatgtgcctgtggagaaccctgaggacccccagcagaaccaggagcagcagcccccaccccagcccccacctcctgagcctgagcctgtggaggccgacttcctgagccccttctctgtgcctgaggcccggggggacaaggtgaagtgggtgttcacctggcccctcatcttcctgctgtgtgtgaccatccccaactgcagcaagccccgctgggagaagttcttcatggtgaccttcatcacagccaccctgtggattgctgtgttctcctacatcatggtgtggctggtgaccatcatcggctacaccctgggcatcccagatgtgatcatgggcatcaccttcctggccgccggcacctctgtgcctgactgcatggccagcctgattgtggcccggcagggcctgggggacatggctgtgagcaacaccatcggcagcaatgtgtttgacatcctggtgggcctgggcgtgccctggggcctgcagaccatggtggtgaactacggcagcacagtgaagatcaacagccggggcctggtgtacagcgtggtgctgctgctgggctctgtggccctgactgtgctgggcatccacctgaacaagtggaggctggacaggaagctgggcgtgtatgtgctggtgctgtatgccatcttcctgtgcttcagcatcatgattgagttcaacgtgttcacctttgtgaacctgcccatgtgcagagaagatgactag

SEQ ID NO: 3760 - DNA, 1869 bp, Artificial Sequence
  Description of Artificial Sequence: Synthetic coding sequence
atggccctgcggggcaccctgcggcccctgaaggtgagaagaagaagagagatgctgccccagcaggtgggctttgtgtgtgctgtgctggccctggtgtgctgtgccagcggcctgtttggcagcctgggccacaagacagccagcgccagcaagagggtgctgcctgacacctggaggaacaggaagctgatggcccctgtgaatggcacccagacagccaagaactgcacagatcctgccatccacgagttccccacagacctcttcagcaacaaggagcggcagcacggggctgtgctgctgcacatcctgggcgccctgtacatgttctacgccctggccatcgtgtgtgatgacttctttgtgcccagcctggagaagatctgtgagcggctgcacctgtctgaagatgtggccggggccaccttcatggctgctggcagcagcaccccagagctgtttgcctctgtgattggagtcttcatcacccatggagatgtgggcgtgggcaccatcgtgggcagcgctgtgttcaacatcctgtgcatcattggagtgtgtggcctgtttgctggccaggtggtgcggctgacctggtgggccgtgtgccgggacagcgtgtactacaccatctctgtgattgtgctgattgtgttcatctatgatgagcagatcgtgtggtgggagggcctggtgctgatcatcctgtatgtgttctacatcctgatcatgaagtacaacgtgaagatgcaggccttcttcaccgtgaagcagaagagcatcgccaacggcaaccctgtgaacagcgagctggaggccggaaatgacttctatgatggcagctatgatgaccccagcgtgcccctgctgggccaggtgaaggagaagccccagtatggcaagaaccctgtggtgatggtggatgagatcatgagcagcagcccccccaagttcaccttccctgaggccggcctgcgcatcatgatcaccaacaagtttggccccaggacccggctgaggatggccagccgcatcatcatcaatgaaaggcagaggctcatcaacagcgccaatggagtgagcagcaagcccctgcagaatggaagacatgagaacattgaaaatggaaatgtgcctgtggagaaccctgaggacccccagcagaaccaggagcagcagcccccaccccagcccccacctcctgagcctgagcctgtggaggccgacttcctgagccccttctctgtgcctgaggcccggggggacaaggtgaagtgggtgttcacctggcccctcatcttcctgctgtgtgtgaccatccccaactgcagcaagccccgctgggagaagttcttcatggtgaccttcatcacagccaccctgtggattgctgtgttctcctacatcatggtgtggctggtgaccatcatcggctacaccctgggcatcccagatgtgatcatgggcatcaccttcctggccgccggcacctctgtgcctgactgcatggccagcctcatcgtggcccggcagggcctgggggacatggctgtgagcaacaccatcggcagcaatgtgtttgacatcctggtgggcctgggcgtgccctggggcctgcagaccatggtggtgaactacggcagcacagtgaagatcaacagccggggcctggtgtacagcgtggtgctgctgctgggctctgtggccctgactgtgctgggcatccacctgaacaagtggaggctggacaggaagctgggcgtgtatgtgctggtgctgtatgccatcttcctgtgcttcagcatcatgattgagttcaacgtgttcacctttgtgaacctgcccatgtgccgggaggatgactag

SEQ ID NO: 3761 - DNA, 1503 bp, Artificial Sequence
  Description of Artificial Sequence: Synthetic coding sequence
atgcagaccaagggcggccagacctgggcccggcgggccctgctgctgggcatcctgtgggccacagcccacctgcccctgagcggcaccagcctgccccagaggctgccccgggccaccggcaacagcacccagtgtgtgatcagccccagcagcgagttccctgagggcttcttcacccggcaggagaggagagatggcggcatcatcatctacttcctgatcatcgtgtacatgttcatggccatcagcatcgtgtgtgatgagtacttcctgcccagcctggagatcatcagcgagagcctgggcctgagccaggatgtggccggcaccaccttcatggccgccggcagcagcgcccctgagctggtgacagccttcctgggcgtcttcatcaccaagggggacatcggcatcagcaccatcctgggcagcgccatctacaacctgctgggcatctgtgccgcctgtggcctgctgagcaacacagtgtccaccctgagctgctggcccctcttccgggactgtgccgcctacaccatctctgctgctgctgtgctgggcatcatctatgacaaccaggtgtactggtatgagggcgccctgctgctgctgatctacggcctgtatgtgctggtgctgtgctttgacatcaagatcaaccagtacatcatcaagaagtgcagcccctgctgtgcctgcctggccaaggccatggagaggtctgagcagcagcccctgatgggctgggaggatgagggccagcccttcatccggcggcagagcaggacagacagcggcatcttctatgaagattctggctacagccagctgagcatcagcctgcacggcctgagccaggtgtctgaggacccccccagcgtcttcaacatgcctgaggccgacctgaagaggatcttctgggtgctgagcctgcccatcatcaccctgctcttcctgaccaccccagactgcaggaagaagttctggaagaactacttcgtcatcaccttcttcatgtctgccatctggatcagcgccttcacctacatcctggtgtggatggtgaccatcactggagagaccctggagatcccagacacagtgatgggcctgaccctgctggccgccggcaccagcatcccagacaccatcgcctctgtgctggtggccaggaaaggaaaaggagacatggccatgagcaacatcgtgggcagcaatgtgtttgacatgctgtgcctgggcatcccctggttcatcaagacagccttcatcaatggcagcgccccagctgaggtgaacagccggggcctgacctacatcaccatcagcctgaacatcagcatcatcttcctgttcctggccgtgcacttcaacggctggaagctggacaggaagctgggcatcgtgtgcctgctgagctacctgggcctggccaccctgtctgtgctgtatgagctgggcatcatcggcaacaacaagatccggggctgcggcggctag

SEQ ID NO: 3762 - DNA, 1323 bp, Artificial Sequence
  Description of Artificial Sequence: Synthetic coding sequence
atgcagaccaagggcggccagacctgggcccggcgggccctgctgctgggcatcctgtgggccacagcccacctgcccctgagcggcaccagcctgccccagaggctgccccgggccacagccctgggcctgagccaggatgtggccggcaccaccttcatggccgccggcagcagcgcccctgagctggtgacagccttcctgggcgtcttcatcaccaagggggacatcggcatcagcaccatcctgggcagcgccatctacaacctgctgggcatctgtgccgcctgtggcctgctgagcaacacagtgtccaccctgagctgctggcccctcttccgggactgtgccgcctacaccatctctgctgctgctgtgctgggcatcatctatgacaaccaggtgtactggtatgagggcgccctgctgctgctgatctacggcctgtatgtgctggtgctgtgctttgacatcaagatcaaccagtacatcatcaagaagtgcagcccctgctgtgcctgcctggccaaggccatggagaggtctgagcagcagcccctgatgggctgggaggatgagggccagcccttcatccggcggcagagcaggacagacagcggcatcttctatgaagattctggctacagccagctgagcatcagcctgcacggcctgagccaggtgtctgaggacccccccagcgtcttcaacatgcctgaggccgacctgaagaggatcttctgggtgctgagcctgcccatcatcaccctgctcttcctgaccaccccagactgcaggaagaagttctggaagaactacttcgtcatcaccttcttcatgtctgccatctggatcagcgccttcacctacatcctggtgtggatggtgaccatcactggagagaccctggagatcccagacacagtgatgggcctgaccctgctggccgccggcaccagcatcccagacaccatcgcctctgtgctggtggccaggaaaggaaaaggagacatggccatgagcaacatcgtgggcagcaatgtgtttgacatgctgtgcctgggcatcccctggttcatcaagacagccttcatcaatggcagcgccccagctgaggtgaacagccggggcctgacctacatcaccatcagcctgaacatcagcatcatcttcctgttcctggccgtgcacttcaacggctggaagctggacaggaagctgggcatcgtgtgcctgctgagctacctgggcctggccaccctgtctgtgctgtatgagctgggcatcatcggcaacaacaagatccggggctgcggcggctag

SEQ ID NO: 3763 - DNA, 552 bp, Artificial Sequence
  Description of Artificial Sequence: Synthetic coding sequence
atgctgagcagagctgtgtgtggcaccagccggcagctggcccctgtgctgggctacctgggcagccggcagaagcacagcctgcctgacctgccctatgactatggagccctggagccccacatcaatgcccagatcatgcagctgcaccacagcaagcaccacgccgcctacgtgaacaacctgaatgtgacagaggagaagtaccaggaggccctggccaagggggagctgctggaggccatcaagagggactttggcagctttgacaagttcaaggagaagctgacagctgcctctgtgggcgtgcagggcagcggctggggctggctgggcttcaacaaggagcggggccacctgcagattgctgcctgccccaaccaggaccccctgcagggcaccaccggcctcatccccctgctgggcattgatgtgtgggagcacgcctactacctgcagtacaagaatgtgcggccagactacctgaaggccatctggaatgtcatcaactgggagaatgtgacagagcgctacatggcctgcaagaagtag

SEQ ID NO: 3764 - DNA, 552 bp, Artificial Sequence; identical to SEQ ID NO: 3763
  Description of Artificial Sequence: Synthetic coding sequence

SEQ ID NO: 3765 - DNA, 669 bp, Artificial Sequence
  Description of Artificial Sequence: Synthetic coding sequence
atgctgagcagagctgtgtgtggcaccagccggcagctggcccctgtgctgggctacctgggcagccggcagaagcacagcctgcctgacctgccctatgactatggagccctggagccccacatcaatgcccagatcatgcagctgcaccacagcaagcaccacgccgcctacgtgaacaacctgaatgtgacagaggagaagtaccaggaggccctggccaagggagatgtgacagcccagatcgccctgcagcctgccctgaagttcaatggaggcggccacatcaaccacagcatcttctggaccaacctgagccccaacggcggcggggagcccaagggggagctgctggaggccatcaagagggactttggcagctttgacaagttcaaggagaagctgacagctgcctctgtgggcgtgcagggcagcggctggggctggctgggcttcaacaaggagcggggccacctgcagattgctgcctgccccaaccaggaccccctgcagggcaccaccggcctcatccccctgctgggcattgatgtgtgggagcacgcctactacctgcagtacaagaatgtgcggccagactacctgaaggccatctggaatgtcatcaactgggagaatgtgacagagcgctacatggcctgcaagaagtag

SEQ ID NO: 3766 - DNA, 669 bp, Artificial Sequence; identical to SEQ ID NO: 3765
  Description of Artificial Sequence: Synthetic coding sequence

SEQ ID NO: 3767 - DNA, 531 bp, Artificial Sequence
  Description of Artificial Sequence: Synthetic coding sequence
atgcagctgcaccacagcaagcaccacgccgcctacgtgaacaacctgaatgtgacagaggagaagtaccaggaggccctggccaagggagatgtgacagcccagatcgccctgcagcctgccctgaagttcaatggaggcggccacatcaaccacagcatcttctggaccaacctgagccccaacggcggcggggagcccaagggggagctgctggaggccatcaagagggactttggcagctttgacaagttcaaggagaagctgacagctgcctctgtgggcgtgcagggcagcggctggggctggctgggcttcaacaaggagcggggccacctgcagattgctgcctgccccaaccaggaccccctgcagggcaccaccggcctcatccccctgctgggcattgatgtgtgggagcacgcctactacctgcagtacaagaatgtgcggccagactacctgaaggccatctggaatgtcatcaactgggagaatgtgacagagcgctacatggcctgcaagaagtag

SEQ ID NO: 3768 - DNA, 723 bp, Artificial Sequence
  Description of Artificial Sequence: Synthetic coding sequence
atgctggccctgctgtgcagctgcctgctgctggccgccggggccagtgatgcctggacaggagaggacagcgctgagcccaacagcgacagcgctgagtggatccgggacatgtatgccaaggtgacagagatctggcaggaggtgatgcagaggagagatgatgatggagccctgcatgctgcctgccaggtgcagcccagcgccaccctggatgctgcccagccccgggtgactggagtggtgctcttccggcagctggccccccgggccaagctggatgccttctttgccctggagggcttccccacagagcccaacagcagcagccgggccatccacgtgcaccagtttggagacctgagccagggctgtgagagcacaggcccccactacaaccccctggccgtgccccacccccagcaccctggggactttggaaactttgctgtgagagatggcagcctgtggagatacagagctggcctggccgccagcctggccggcccccacagcatcgtgggccgggctgtggtggtgcacgccggggaggatgacctgggccggggcggcaaccaggcctctgtggagaatggaaatgccggccgccgcctggcctgctgcgtggtgggcgtgtgtggccctggcctgtgggagcggcaggcccgggagcacagcgagaggaagaagagaagaagagaaagtgagtgcaaggccgcctag

SEQ ID NO: 3769 - DNA, 390 bp, Artificial Sequence
  Description of Artificial Sequence: Synthetic coding sequence
atgaagatcctggtggccctggccgtgttcttcctggtgtccacccagctgtttgctgaggagatcggggccaatgatgacctgaactactggagcgactggtatgacagcgaccagatcaaggaggagctgcctgagccctttgagcacctgctgcagagaattgcccggcggcccaagccccagcagttcttcggcctgatgggcaagagagatgctgacagcagcattgagaagcaggtggccctgctgaaggccctgtatggccacggccagatcagccacaagaggcacaagacagacagctttgtgggcctgatgggcaagagggccctgaacagcgtggcctatgaaagaagtgccatgcagaactatgaaagaagaagatag

SEQ ID NO: 3770 - DNA, 345 bp, Artificial Sequence
  Description of Artificial Sequence: Synthetic coding sequence
atgaagatcctggtggccctggccgtgttcttcctggtgtccacccagctgtttgctgaggagatcggggccaatgatgacctgaactactggagcgactggtatgacagcgaccagatcaaggaggagctgcctgagccctttgagcacctgctgcagagaattgcccggcggcccaagccccagcagttcttcggcctgatgggcaagagagatgctggccacggccagatcagccacaagaggcacaagacagacagctttgtgggcctgatgggcaagagggccctgaacagcgtggcctatgaaagaagtgccatgcagaactatgaaagaagaagatag

SEQ ID NO: 3771 - DNA, 336 bp, Artificial Sequence
  Description of Artificial Sequence: Synthetic coding sequence
atgaagatcctggtggccctggccgtgttcttcctggtgtccacccagctgtttgctgaggagatcggggccaatgatgacctgaactactggagcgactggtatgacagcgaccagatcaaggaggagctgcctgagccctttgagcacctgctgcagagaattgcccggcggcccaagccccagcagttcttcggcctgatgggcaagagagatgctgacagcagcattgagaagcaggtggccctgctgaaggccctgtatggccacggccagatcagccacaagatggcctatgaaagaagtgccatgcagaactatgaaagaagaagatag

SEQ ID NO: 3772 - DNA, 417 bp, Artificial Sequence
  Description of Artificial Sequence: Synthetic coding sequence
atgacagccctcttcctgatgtccatgctgtttggcctgacctgtggccaggccatgtccttctgcatccccacagagtacaccatgcacattgaaagaagagaatgtgcctactgcctgaccatcaacaccaccatctgtgccggctactgcatgacccgggacatcaatggcaagctgttcctgcccaagtatgccctgagccaggatgtgtgcacctacagagacttcatctacagaacagtggagatccctggctgccccctgcacgtggccccctacttctcctaccctgtggccctgagctgcaagtgtgggaagtgcaacacagactacagcgactgcatccacgaggccatcaagaccaactactgcaccaagccccagaagagctacctggtgggcttctctgtgtag

SEQ ID NO: 3773 - DNA, 417 bp, Artificial Sequence; identical to SEQ ID NO: 3772
  Description of Artificial Sequence: Synthetic coding sequence

SEQ ID NO: 3774 - DNA, 2418 bp, Artificial Sequence
  Description of Artificial Sequence: Synthetic coding sequence
atggcccagcccctggccttcatcctggatgtgcctgagacccctggggaccagggccagggccccagcccctatgatgagagcgaggtgcatgacagcttccagcagctgatccaggagcagagccagtgcacagcccaggagggcctggagctgcagcagcgggagcgggaggtgacaggcagcagccagcagaccctgtggaggcctgagggcacccagagcacagccaccctgcgcatcctggcctccatgcccagcaggaccatcggccgcagcagaggagccatcatcagccagtactacaacagaacagtgcagctgcgctgccgcagcagccggcccctgctgggcaactttgtgcgcagcgcctggcccagcctgcggctgtatgacctggagctggaccccacagccctggaggaggaggagaagcagagcctgctggtgaaggagctgcagagcctggccgtggcccagagggaccacatgctgcggggcatgcccctgagcctggccgagaagaggagcctgcgggagaagagcaggaccccccggggcaagtggaggggccagcccggcagcggaggagtgtgcagctgctgcggccgcctgcgctatgcctgtgtgctggccctgcacagcctgggcctggccctgctgagcgccctgcaggccctgatgccctggaggtatgccctgaagagaattggaggccagtttggcagctctgtgctgagctacttcctgttcctgaagaccctgctggccttcaatgccctgctgctgctgctgctggtggccttcatcatgggcccccaggtggccttccccccagccctgcccggccctgcccctgtgtgcaccggcctggagctgctgactggagctggctgcttcacccacacagtgatgtactacggccactacagcaatgccaccctgaaccagccctgtggcagccccctggatggcagccagtgcaccccccgggtgggcggcctgccctacaacatgcccctggcctacctgagcacagtgggcgtgtccttcttcatcacctgcatcaccctggtgtacagcatggcccacagctttggagagagctacagagtgggcagcaccagcggcatccacgccatcaccgtcttctgctcctgggactacaaggtgacccagaagagggccagccggctgcagcaggacaacatccgcacccggctgaaggagctgctggccgagtggcagctgcggcacagccccaggtctgtgtgtggccgcctgcggcaggccgctgtgctgggcctggtgtggctgctgtgcctgggcacagccctgggctgtgctgtggccgtgcacgtgttcagcgagttcatgatccagagccctgaggccgccggccaggaggccgtgctgctggtgctgcccctggtggtgggcctgctgaacctgggcgccccctacctgtgccgggtgctggccgccctggagccccatgacagccctgtgctggaggtgtatgtggccatctgcaggaacctgatcctgaagctggccatcctgggcaccctgtgctaccactggctgggcagaagagtgggcgtgctgcagggccagtgctgggaggactttgtgggccaggagctgtaccgcttcctggtgatggactttgtgctgatgctgctggacaccctgtttggagagctggtgtggaggatcatcagcgagaagaagctgaagagaagaaggaagccagagtttgatattgccagaaatgtgctggagctgatctacggccagaccctgacctggctgggcgtgctcttcagccccctgctgcctgctgtgcagatcatcaagctgctgctggtgttctacgtgaagaagaccagcctgctggccaactgccaggccccccggcggccctggctggccagccacatgagcaccgtcttcctgaccctgctgtgcttccctgccttcctgggcgctgctgtgttcctgtgctatgctgtgtggcaggtgaagcccagcagcacctgtggccccttccgcaccctggacaccatgtatgaagctggccgggtgtgggtgcgccacctggaggccgccggcccccgggtgtcctggctgccctgggtgcaccgctacctgatggagaacaccttctttgtgttcctggtgtctgccctgctgctggccgtcatctacctgaacatccaggtggtgcggggccagaggaaggtgatctgcctgctgaaggagcagatcagcaatgaaggagaggacaagatcttcctgatcaacaagctgcacagcatctatgaaaggaaggagcgggaggagaggagccgggtgggcaccacagaggaggccgccgcccccccagccctgctgacagatgagcaggatgcctag

SEQ ID NO: 3775 - DNA, 864 bp, Artificial Sequence
  Description of Artificial Sequence: Synthetic coding sequence
atgctgctgcccaggtctgtgtcctctgagcgggcccctggggtgcctgagcctgaggagctgtgggaggccgagatggagcggctgcggggcagcggcacccctgtgcggggcctgccctatgccatgatggacaagaggctcatctggcagctgcgggagcctgctggggtgcagaccctgcgctggcagcgctggcagaggcggcggcagacagtggagcggcggctgcgggaggccgcccagaggctggcccggggcctgggcctgtgggagggcgccctgtatgagatcggcggcctgtttggcaccggcatccgcagctacttcaccttcctgcgcttcctgctgctgctgaacctgctgagcctgctgctgacagccagctttgtgctgctgcccctggtgtggctgcggcccccagaccccggccccaccctgaacctgaccctgcagtgccccggcagccggcagagccccccaggagtgctgcgcttccacaaccagctgtggcacgtgctgaccggccgggccttcaccaacacctacctgttctacggggcctacagagtgggccctgagagcagctctgtgtacagcatccggctggcctacctgctgagccccctggcctgcctgctgctgtgcttctgtggcaccctgcggcggctgctgagcaccctggccagcggccctggggccggcggcccctgggccccagcccactggccagcctgcccccccctgcccggcctgccccggctgcagctgcccccaccccaccacgcccaggtgctgcgggctgctggggccatgggcggggacacctggaggggccgctccttcctgccctggggctggtag

SEQ ID NO: 3776 - DNA, 2181 bp, Artificial Sequence
  Description of Artificial Sequence: Synthetic coding sequence
atgctgctgcccaggtctgtgtcctctgagcgggcccctggggtgcctgagcctgaggagctgtgggaggccgagatggagcggctgcggggcagcggcacccctgtgcggggcctgccctatgccatgatggacaagaggctcatctggcagctgcgggagcctgctggggtgcagaccctgcgctggcagcgctggcagaggcggcggcagacagtggagcggcggctgcgggaggccgcccagaggctggcccggggcctgggcctgtgggagggcgccctgtatgagatcggcggcctgtttggcaccggcatccgcagctacttcaccttcctgcgcttcctgctgctgctgaacctgctgagcctgctgctgacagccagctttgtgctgctgcccctggtgtggctgcggcccccagaccccggccccaccctgaacctgaccctgcagtgccccggcagccggcagagccccccaggagtgctgcgcttccacaaccagctgtggcacgtgctgaccggccgggccttcaccaacacctacctgttctacggggcctacagagtgggccctgagagcagctctgtgtacagcatccggctggcctacctgctgagccccctggcctgcctgctgctgtgcttctgtggcaccctgcggaggatggtgaagggcctgccccagaagaccctgctgggccagggctaccaggcccccctgagcgccaaggtgttcagctcctgggacttctgcatccgggtgcaggaggccgccaccatcaagaagcatgagatcagcaatgagttcaaggtggagctggaggagggccgccgcttccagctgatgcagcagcagacccgggcccagacagcctgccgcctgctgagctacctgcgggtgaatgtgctgaatggcctgctggtggtgggcgccatcagcgccatcttctgggccaccaagtacagccaggacaacaaggaggagagcctcttcctgctgctgcagtacctgcccccaggagtcatcgccctggtgaacttcctgggccccctgctcttcaccttcctggtgcagctggagaactacccacccaacacagaggtgaacctgaccctcatctggtgtgtggtgctgaagctggccagcctgggcatgttttctgtgtccctgggccagaccatcctgtgcatcggccgggacaagagcagctgtgagagctatggctacaacgtgtgtgactaccagtgctgggagaacagcgtgggggaggagctgtacaagctgagcatcttcaacttcctgctgactgtggcctttgccttcctggtgaccctgccccggcggctgctggtggaccgcttcagcggccgcttctgggcctggctggagcgggaggagttcctggtgcccaagaatgtgctggacatcgtggccggccagacagtgacctggatgggcctcttctactgccccctgctgcccctgctgaacagcgtcttcctgttcctgaccttctacatcaagaagtacaccctgctgaagaacagccgggccagcagccggcccttccgggccagcagcagcaccttcttcttccagctggtgctgctgctgggcctgctgctggccgctgtgcccctgggctacgtggtgagcagcatccacagctcctgggactgtggcctcttcaccaactacagcgccccctggcaggtggtgcctgagctggtggccctgggcctgccccccatcggccagagggccctgcactacctgggcagccacgccttctccttccccctgctgatcatgctgagcctggtgctgactgtgtgtgtgtcccagacccaggccaatgcccgggccatccaccggctgaggaagcagctggtgtggcaggtgcaggagaagtggcacctggtggaggacctgagccggctgctgcctgagcccggccccagcgacagccctggccccaagtacccagccagccaggccagccggccccagagcttctgccccggctgcccctgccccggcagccctggccaccaggcccccaggcctggccccagcgtggtggatgctgctggcctgcggagcccctgccccggccagcacggggccccagccagcgcccggcgcttccgcttccccagcggggctgagctgtag

SEQ ID NO: 3777 - DNA, 702 bp, Artificial Sequence
  Description of Artificial Sequence: Synthetic coding sequence
atgagcacagagagcatgatcagagatgtggagctggccgaggaggccctgcccaagaagacaggaggcccccagggcagccgccgctgcctcttcctgagcctcttctccttcctgattgtggccggggccaccaccctcttctgcctgctgcactttggagtcatcggcccccagcgggaggagttcccccgggacctgagcctcatcagccccctggcccaggccgtgcgcagcagcagcaggacccccagcgacaagcctgtggcccacgtggtggccaacccccaggccgagggccagctgcagtggctgaacagaagagccaatgccctgctggccaatggagtggagctgcgggacaaccagctggtggtgcccagcgagggcctgtacctgatctacagccaggtgctcttcaagggccagggctgccccagcacccacgtgctgctgacccacaccatcagcagaattgctgtgtcctaccagaccaaggtgaacctgctgagcgccatcaagagcccctgccagcgggagaccccagagggcgctgaggccaagccctggtatgagcccatctacctgggcggcgtcttccagctggagaagggggaccggctgtctgctgagatcaacagaccagactacctggactttgctgagagcggccaggtgtacttcggcatcatcgccctgtag

SEQ ID NO: 3778 - DNA, 702 bp, Artificial Sequence; identical to SEQ ID NO: 3777
  Description of Artificial Sequence: Synthetic coding sequence

SEQ ID NO: 3779 - DNA, 702 bp, Artificial Sequence; identical to SEQ ID NO: 3777
  Description of Artificial Sequence: Synthetic coding sequence

SEQ ID NO: 3780 - DNA, 702 bp, Artificial Sequence; identical to SEQ ID NO: 3777
  Description of Artificial Sequence: Synthetic coding sequence

SEQ ID NO: 3781 - DNA, 702 bp, Artificial Sequence; identical to SEQ ID NO: 3777
  Description of Artificial Sequence: Synthetic coding sequence

SEQ ID NO: 3782 - DNA, 702 bp, Artificial Sequence; identical to SEQ ID NO: 3777
  Description of Artificial Sequence: Synthetic coding sequence

SEQ ID NO: 3783 - DNA, 702 bp, Artificial Sequence; identical to SEQ ID NO: 3777
  Description of Artificial Sequence: Synthetic coding sequence

SEQ ID NO: 3784 - DNA, 741 bp, Artificial Sequence
  Description of Artificial Sequence: Synthetic coding sequence
atggcccaggtgcccccaccagccagcggggagagacatgctggaacagaagatggccccatcagaagaaatcctgctggaaatgtggcccggcccatggtgcagaggctgcctgagccccaggatgtggcccagtgcctggaggtgggcctgtttgacaccccacccttctacagcaacagcaccaacagcttcaggaacacagtggagggcaatgaccccaccgggaagtatgaccctgctgtgcgcagcctgcacaacctggcccacctgttcctgaatggcaccggcggccagacccacctgagccccaatgaccccatctttgtgctgctgcacaccttcacagatgctgtgtttgatgagtggctgcggcgctacaatgctgacatcagcaccttccccctggagaatgcccccatcggccacaaccggcagtacaacatggtgcccttctggccccctgtgaccaacacagagatgtttgtgacagccccagacaacctgggctacacctatgagatccagtggcccagccgggagttctctgtgcctgagatcatcgccatcgctgtggtgggcgccctgctgctggtggccctgatctttggaacagccagctacctgatccgggcccggcgctccatggatgaggccaaccagcccctgctgacagaccagtaccagtgctacgccgaggagtatgagaagctgcagaaccccaaccagagcgtggtgtag

SEQ ID NO: 3785 - DNA, 1614 bp, Artificial Sequence
  Description of Artificial Sequence: Synthetic coding sequence
atgtctgcccccaagctgctgagcctgggctgcatcttcttccccctgctgctcttccagcaggcccgggcccagttcccccggcagtgtgccaccgtggaggccctgcggagcggcatgtgctgcccagacctgagccctgtgtctggccctggaacagacagatgtggcagcagcagcggccggggccgctgtgaggccgtgacagctgacagccggccccacagcccccagtacccccatgatggaagagatgaccgggaggtgtggcccctgcgcttcttcaacagaacctgccactgcaatggaaacttcagcggccacaactgtggcacctgcaggcctggctggaggggggccgcctgtgaccagagggtgctgattgtgagaagaaacctgctggacctgagcaaggaggagaagaaccactttgtgcgggccctggacatggccaagaggaccacccaccccctgtttgtgattgccacccggcgctctgaggagatcctgggcccagatggcaacaccccccagtttgagaacatcagcatctacaactactttgtgtggacccactactacagcgtgaagaagaccttcctgggcgtgggccaggagagctttggagaggtggacttcagccatgagggccctgccttcctgacctggcaccgctaccacctgctgcggctggagaaggacatgcaggagatgctgcaggagcccagcttcagcctgccctactggaactttgccaccgggaagaatgtgtgtgacatctgcacagatgacctgatgggcagccgcagcaactttgacagcaccctcatcagccccaacagcgtcttcagccagtggagggtggtgtgtgacagcctggaggactatgacaccctgggcaccctgtgcaacagcacagaagatggccccatcagaagaaatcctgctggaaatgtggcccggcccatggtgcagaggctgcctgagccccaggatgtggcccagtgcctggaggtgggcctgtttgacaccccacccttctacagcaacagcaccaacagcttcaggaacacagtggagggctacagcgaccccaccgggaagtatgaccctgctgtgcgcagcctgcacaacctggcccacctgttcctgaatggaactggaggccagacccacctgagccccaatgaccccatctttgtgctgctgcacaccttcacagatgctgtgtttgatgagtggctgcggcgctacaatgctgacatcagcaccttccccctggagaatgcccccatcggccacaaccggcagtacaacatggtgcccttctggccccctgtgaccaacacagagatgtttgtgacagccccagacaacctgggctacacctatgagatccagtggcccagccgggagttctctgtgcctgagatcatcgccatcgctgtggtgggcgccctgctgctggtggccctgatcttcggcacagccagctacctgatccgggcccggcgctccatggatgaggccaaccagcccctgctgacagaccagtaccagtgctacgccgaggagtatgagaagctgcagaaccccaaccagagcgtggtgtag

SEQ ID NO: 3786 - DNA, 309 bp, Artificial Sequence
  Description of Artificial Sequence: Synthetic coding sequence
atgtctgcccccaagctgctgagcctgggctgcatcttcttccccctgctgctcttccagcaggcccgggcccagttcccccggcagtgtgccaccgtggaggccctgcggagcggcatgtgctgcccagacctgagccctgtgtctggccctggaacagacagatgtggcagcagcagcggccggggccgctgtgaggccgtgacagctgacagccggccccacagcccccagtacccccatgatggaagagatgaccgggaggtgtggcccctgcgcttcttcaacagaacctgccactgcaactag

SEQ ID NO: 3787 - DNA, 1128 bp, Artificial Sequence
  Description of Artificial Sequence: Synthetic coding sequence
atggaggaggagatcgccgccctggtgatcgacaacggcagcggcatgtgtaaggcgggttttgctggagacgatgctccacgagcagtcttccctagcatcgtcggtagacctcgccaccagggcgtgatggtgggcatgggccagaaggattcatacgtaggagatgaagctcagagcaagcggggcatactgacacttaaatatcccattgaacacggcattgtcaccaactgggacgatatggagaaaatctggcatcacacattttataatgaactccgggttgcccctgaggagcatcccgtcctgctgactgaggcgcccctcaacccgaaggcgaatagagagaagatgacacaaattatgtttgagacattcaatacccccgcaatgtatgtggcgatccaggccgttctatctctttatgcaagcgggcgcactaccggcatagttatggatagcggggatggagtcactcacacagtacccatatacgagggttacgctctgccacatgctatcctacgcctggaccttgcaggtagggatctgacagattaccttatgaagattctgacagaacggggatatagcttcacaaccactgccgaaagagagatcgtgcgcgacattaaggaaaagctatgctatgtggctctggattttgagcaggaaatggctaccgccgcgagttcatctagcttggagaaatcctatgagctgccggacgggcaggtgataacaattggaaacgagcgattccggtgccccgaggctcttttccagcctagcttcctgggtatggaatcttgtggaatccacgaaacaactttcaattcaatcatgaaatgtgatgtggacattaggaaggatttatatgcaaatactgtgctgtccggggggacaacaatgtaccccggcattgctgatcgcatgcagaaagagatcacggctttggctccctccacaatgaagatcaaaataattgctccacccgagcgcaaatatagtgtgtggatagggggcagtatcctggccagcttatccacttttcagcagatgtggatctcaaaacaggaatatgatgagagtggcccaagcatcgtgcatcgtaagtgcttctag

SEQ ID NO: 3788 - DNA, 1599 bp, Artificial Sequence
  Description of Artificial Sequence: Synthetic coding sequence
atgccccagctgtacatctacatccggctgctgggcgcctacctgttcatcatcagccgtgtgcaaggccaaaatctggatagcatgctccacggcaccggcatgaagagtgacagcgaccagaagaagagtgaaaacggcgtcacactggccccggaggatactttgccattcttgaagtgttactgtagcgggcactgtcctgatgacgctattaataatacatgcataaccaacgggcactgctttgcgattattgaagaggacgatcagggcgaaaccaccctcgcatcaggttgtatgaaatacgaggggagcgactttcaatgtaaggacagcccaaaggcccaactgcgccgtacaattgagtgttgccgcactaacttgtgtaaccagtatctgcagcccaccctgcctcctgtggtgattggccctttttttgatgggtcgattcgctggttagtgctgcttattagcatggctgtgtgtatcatcgcgatgataatattttcaagctgcttttgttataaacactattgcaagtctatctcctccagacggcgatacaatcgcgacctggagcaggatgaagccttcatccctgtgggtgaatccttaaaagacctcatagatcagtcacagtcttcaggctccggcagcggcttgccactgcttgttcagaggaccattgctaagcaaatccaaatggtccgccaggttggcaaggggagatacggcgaggtgtggatgggaaaatggaggggtgagaaggtggccgtgaaagtgtttttcaccacagaagaggctagttggttccgggagactgagatctaccagacagtgttgatgcggcacgaaaacatccttgggttcatagctgcggacattaaaggtacaggtagttggactcagctatacttgattaccgattatcacgaaaatggtagcctgtacgattttctaaagtgtgccacccttgatacaagagccttgctgaagctggcttatagcgcggcttgcggcttgtgccatctgcataccgagatttatgggacccaagggaagcccgcaatagcacacagagatctcaaatccaaaaacatcctgatcaaaaagaatggctcctgctgtattgcagacttagggttagccgtcaaattcaactcagacacaaatgaggtggacgtgccacttaatacaagggtcggcaccaagcgctacatggcccccgaagttctggacgaatccctcaataagaatcactttcaaccctacattatggccgatatttatagcttcgggctgatcatttgggaaatggcccggaggtgcatcacaggggggattgtggaggagtatcaactgccttactataatatggtgccatcagatccatcctatgaagacatgagggaggtcgtgtgcgtgaagagactacgacctatcgtgagtaacagatggaattccgacgagtgtctgcgtgccgtgttaaaactgatgtccgaatgctgggcccacaatcccgcctcaagactgaccgctctgcgcatcaagaaaacactcgctaaaatggtggagtcccaggacgtcaagatttag

SEQ ID NO: 3789 - DNA, 456 bp, Artificial Sequence
  Description of Artificial Sequence: Synthetic coding sequence
atgtgcgaggaggaggacagcaccgccctggtgtgcgacaacggctcaggcttatgcaaggcaggcttcgccggcgacgacgcacctcgcgctgtttttccctcgattgtaggaaggccccggcaccagggagtgatggttggtatgggtcaaaaagatagctatgtgggagacgaggctcagtcgaagcggggcatcctgaccctaaagtatcctattgaacacggtattatcacaaattgggatgatatggagaaaatatggcatcactccttctacaatgaacttcgcgtggctcctgaagaacacccaactcttctcacagaggcccctttgaatcctaaggccaatcgtgagaaaatgactcagataatgttcgagaccttcaatgtgcccgctatgtatgtggcaatccaggccgtgctgagcctctacgcatctggtcgaactacttag

SEQ ID NO: 3790 - DNA, 456 bp, Artificial Sequence
  Description of Artificial Sequence: Synthetic coding sequence
atgtgcgaggaggaggacagcaccgccctggtgtgcgacaacggcagtggcctgtgtaaagctgggtttgctggcgatgatgcaccccgagctgtgtttccaagcatcgtggggcggccacgacaccagggtgtcatggtgggcatgggccagaaagactcttacgttggagacgaggcccagagtaaacgcgggatcctaactctgaaatatccgattgagcacggcattataactaattgggatgacatggaaaagatttggcatcacagcttttacaatgagctgagggttgcccccgaagaacaccctactctgctcactgaagcccccctgaaccctaaagctaatcgggaaaagatgacacagataatgtttgagaccttcaacgttcctgcaatgtatgtggccattcaggcggtgctgagcctatacgcatctggccggacaacctag

SEQ ID NO: 3791 - DNA, 1134 bp, Artificial Sequence
  Description of Artificial Sequence: Synthetic coding sequence
atgtgcgaggaggaggacagcaccgccctggtgtgcgacaacggctccggcctctgcaaagcagggtttgccggggacgatgcccccagagcagtctttccttccatcgtgggcaggccacggcatcaaggcgttatggtggggatgggccagaaggactcatacgtaggcgatgaagcccagtctaagcggggaattctcaccttgaaataccctatcgaacatggcattattactaactgggacgatatggagaagatctggcaccattctttttacaatgagttacgcgtggctcccgaggagcatccaacactcctcaccgaggccccattgaatcccaaagcaaacagagagaaaatgacccagattatgtttgagacattcaacgttcccgcgatgtatgtagccattcaagctgtgctgagcctgtacgccagcggtcgcactactggcatcgtcttagattcgggtgatggagtgactcacaatgtccccatttatgaaggctacgctttgccgcacgcgattatgcggctggacctggctggccgcgatcttaccgactatctgatgaagattctgaccgagcgcggatattcttttgttaccaccgcagagcgagaaatagtgcgagatatcaaagagaagctgtgttatgtcgcactggatttcgagaacgagatggccacggccgcatcttcgtcgagcctggaaaaaagctacgagctgcccgacggccaagtgataactatcgggaacgaacggttccgttgcccagagactctcttccaaccgtcatttataggaatggaatctgccggcattcatgagaccacctacaacagtataatgaagtgcgacatagatataaggaaggatttgtacgccaacaacgtactgagcggagggaccactatgtaccctggaatcgccgatcgaatgcagaaggagatcactgccctcgcccctagtaccatgaagattaaaattatcgcccctcctgagcggaaatattctgtgtggataggtggatcgatcctggccagtttgtccacctttcaacagatgtggatttccaagcaggagtacgacgaagccggaccatctatcgttcatcggaagtgcttctag

SEQ ID NO: 3792 - DNA, 999 bp, Artificial Sequence
  Description of Artificial Sequence: Synthetic coding sequence
atggtgggcatgggccagaaggacagctacgtgggcgacgaggcccagagcaaacggggtattctgaccctgaaataccctatagagcacggcattattacgaattgggacgatatggaaaagatatggcatcatagcttctacaacgagctcagggtcgcccctgaggaacatcccaccctcctaacagaagcgccactgaacccgaaggctaatcgcgaaaagatgacacagataatgttcgagaccttcaacgtacccgctatgtatgtggcgatccaggcagtgttgtctttatatgcgtcaggccgtaccaccgggatcgtcctcgacagcggggacggcgtgacacacaacgttccaatctacgagggatatgcactgcctcacgctataatgcggctggatctcgccggtcgcgacttaacagattacctcatgaagatcctgaccgaacggggctactccttcgtgacaaccgctgagagggaaatcgtaagggacattaaggagaagctgtgttacgtcgccctggatttcgaaaatgaaatggccaccgctgcttcaagctcctccttggagaagagctatgaactgcccgatggccaggtgataactataggaaatgaacgatttagatgtcccgaaacactgttccagccttctttcattggaatggaatctgccggaattcacgagacgacatataattccataatgaagtgcgacattgacattcggaaagacctgtatgctaacaacgtcctttctggaggcaccacaatgtaccccggaatcgccgatcggatgcaaaaagaaattactgctctggccccatcaaccatgaaaatcaagattattgccccacccgagcgcaaatacagcgtttggattggcggctcaatccttgccagcttgtctaccttccagcagatgtggatttcaaaacaggagtatgatgaggctgggcccagtattgttcaccggaagtgcttctag

SEQ ID NO: 3793 - DNA, 1134 bp, Artificial Sequence
  Description of Artificial Sequence: Synthetic coding sequence
atgtgcgacgacgaggagaccaccgccctggtgtgcgacaacggctccggtctcgtgaaggcagggtttgcaggagacgacgctcccagggcagtgttcccttcaattgtgggaaggcctcgacaccagggtgtaatggtgggcatgggccagaaggactcctacgtgggggatgaggcccagagtaaacgtggcatcctgactttgaaataccctatagagcatggtatcataacaaactgggatgacatggagaaaatttggcaccatactttctataatgagctcagagtggccccggaggagcacccgaccctcttgaccgaggcccctctcaatcctaaggcaaaccgcgaaaaaatgacccaaattatgtttgaaacatttaatgtgccagccatgtacgttgcaatccaggcagtgctttcactttatgcttcaggcaggaccaccggaattgtccttgacagtggcgatggcgtgacccacaatgtccccatatatgagggctatgcactgccacacgcaatcatgcgcctagatctggccgggagggatttaaccgactacctcatgaaaattctgaccgaacgtgggtactcttttgtaactacagcagagagggagatcgtgagggatataaaagaaaaactgtgttatgttgctttagacttcgagaacgagatggcgactgccgcatcttcaagcagcctggagaaatcttatgagttacctgacggacaggtgatcacgattggaaacgagcgatttaggtgtcctgagaccctgttccagcccagcttcattggcatggaatctgccgggatccacgaaaccacctacaacagcattatgaaatgcgatatcgatattaggaaggacttgtacgcaaacaacgttctgtccggaggcacgacaatgtatcccggcatcgcagatagaatgcagaaggagatcactgccctcgctcccagcaccatgaaaatcaagattatagcccctccggagcgcaagtacagcgtgtggattgggggcagcatcctggcctccctgtccacttttcaacaaatgtggatatctaaacaggagtatgacgaggccgggccttccatcgtacaccgaaagtgtttttag

SEQ ID NO: 3794 - DNA, 1029 bp, Artificial Sequence
  Description of Artificial Sequence: Synthetic coding sequence
atgtgcgacgacgaggagaccaccgccctggtgtgcgacaacggcagcgggctggtaaaggctggattcgctggcgatgacgcccctcgggccgtctttccctcgatcgtgggtaggccacgccaccaaggggtgatggtagggatgggtcagaaggacagctacgtgggggacgaggctcagtctaagaggggcatcctcaccttgaaataccccatagaacacggaatcattactaaagcaaatagggagaagatgacacagattatgtttgaaacgtttaacgtgcccgctatgtacgtcgccattcaggcagtgcttagcctgtacgccagcggtcggactacggggattgtgttggactcaggcgacggcgtaacccacaatgtccctatctatgagggctatgctctacctcatgccattatgcggctagatctcgctggaagggacctcacagactatctgatgaagattctaacagaacgcggctattcattcgttaccaccgcagagcgtgagattgtgagagacattaaagagaagctgtgttacgtggccttggacttcgaaaatgaaatggcaaccgccgcctcctcaagtagtctcgagaagtcttacgaactgcccgatggccaggtaataacaatcggaaatgaacgcttcaggtgtccagagacgctctttcagcctagttttataggcatggagagcgcaggaattcacgagactacctataactctatcatgaagtgcgacatagacataagaaaggatttgtacgccaacaatgttctgagcggaggcactaccatgtaccccggaatcgcggacaggatgcagaaggagataaccgcactggctccttccacaatgaagattaagattattgcaccaccagagcgaaagtactcggtttggattggagggagtatactcgcttctttaagtactttccagcaaatgtggataagcaagcaggagtacgacgaagccggaccatccatcgtacatcggaagtgtttttag

SEQ ID NO: 3795 - DNA, 885 bp, Artificial Sequence
  Description of Artificial Sequence: Synthetic coding sequence
atggagaagatctggcaccacaccttctacaacgagctgcgggtggcccccgaggaacaccccgtcttgcttacagaggcccctctcaatccaaaggccaatcgcgagaaaatgacgcagatcatgttcgagacttttaacactcctgctatgtatgttgcaatccaggcggtcctgtccctgtatgctagcggccgaacaaccggcatcgtcatggatagtggagacggcgtgacacacacagtgcccatttatgagggctatgccctcccgcacgccatcctccgtttggatctcgctggtagggatctgaccgactatcttatgaagattctgaccgaacgtggatatagttttacgactaccgctgagcgtgagattgtgcgggacatcaaggagaagctttgttatgtggcactcgacttcgagcaggaaatggctacggctgctagctcaagctctctcgagaagagctatgaattgcccgatggacaggtgattaccataggcaatgagaggtttaggtgccccgaggccctgttccagccttcgttccttgggatggagtcctgcggaatccacgaaaccacgtttaattccatcatgaagtgcgacgtcgacattaggaaggacctctacgccaacaccgtcctgagcgggggcactacaatgtaccctgggatagctgataggatgcagaaggagattacggcactggctccgtccactatgaagatcaaaattatagctcctccagaaaggaaatactctgtctggatcggcggttccattctagcttccctcagtaccttccaacaaatgtggatctccaaacaggagtatgacgagtctgggccatcgattgtccaccgcaaatgcttttag

SEQ ID NO: 3796 - DNA, 1128 bp, Artificial Sequence
  Description of Artificial Sequence: Synthetic coding sequence
atggacgacgacatcgccgccctggtggtggacaacggcagcggcatgtgcaaggctggattcgcgggggacgatgccccacgggctgtgtttccctccattgtcggacgtccaaggcatcagggggtcatggttggaatgggccagaaagattcatatgtgggcgatgaggcacagagcaaacgaggaattctgacattgaaataccctatagaacacggcattgtaaccaattgggacgatatggaaaagatttggcaccacacattttataatgagctcagagtcgcccccgaagaacatccagtccttctcaccgaggcgccattgaatccaaaagccaatcgcgagaaaatgacacagatcatgttcgaaactttcaacacccccgccatgtatgtggcaatccaagcggttctgagcctctacgcatccggcagaaccaccggtatcgtcatggactcaggcgatggggtcactcacactgttccaatatatgagggatacgcactcccccatgccatcctcaggctggatctggctggtcgtgacctgactgattatctcatgaaaatcctcacggagcggggctacagttttactactactgccgagagggaaatcgtgagggatatcaaggagaagttatgttacgttgcgctcgattttgaacaggagatggcaaccgccgcctcttcctcaagtttggagaaatcctacgaattgcctgatggacaggtgattaccattggcaacgagcgtttccggtgcccagaagccctgtttcaacccagctttctgggcatggagtcatgcgggatccatgaaacaacttttaactctatcatgaagtgcgatgtggacatccgcaaggacttatacgcaaacaccgttctgtcaggcggcaccaccatgtacccaggtatcgcagatcggatgcagaaggagattaccgcactcgccccatccacaatgaagattaaaatcattgcaccccccgaaaggaagtactccgtgtggattggggggtcgatcttagcttccctgagtacgttccagcagatgtggatatctaagcaggagtacgacgagtcggggcccagcatcgtgcacaggaagtgcttctag

SEQ ID NO: 3797 - DNA, 1044 bp, Artificial Sequence
  Description of Artificial Sequence: Synthetic coding sequence
atggacgacgacatcgccgccctggtggtggacaacggcagcggcatgtgcaaagccggttttgcgggtgacgatgcgccacgcgccgtctttccgagcatcgtcggacggccgcgacatcaaggcgtgatggtgggcattgtgacaaactgggacgatatggagaaaatctggcaccatacattttacaatgaattacgggttgccccagaggagcaccccgtgctgctcaccgaggcccctctaaaccccaaagccaacagagagaagatgacacagatcatgttcgagacatttaacacaccggcaatgtacgtcgcgatccaggccgtgctcagcctttatgctagtggtagaaccactgggattgtaatggactctggcgacggagtgacccacacggttcccatttacgagggttatgcactgccccacgcaatcctgcggcttgacttggccggtcgtgacttgacagactacctcatgaaaatactcactgaacgcggctatagctttacaacaaccgccgagagagagatcgtacgggacatcaaggaaaagctgtgctatgttgcgctggactttgagcaggagatggccaccgccgcaagctcttcctctctggaaaaatcatatgagctgcccgatgggcaggttattaccatagggaacgagcggtttcgctgtcccgaggctctgttccagccaagctttctgggtatggagtcctgcggaattcacgaaacaacgtttaacagcataatgaagtgtgacgttgatattcggaaggatctctacgccaatacggtactcagcgggggaacaaccatgtatccgggcatcgctgacagaatgcaaaaagagatcacagcgctggccccctctacgatgaagattaagattattgccccacccgaacgcaagtacagcgtctggattggcggaagcatcctggcctccttatcaactttccagcagatgtggatttcaaaacaggagtatgatgaaagcggcccgtctattgtgcaccggaagtgcttctag

SEQ ID NO: 3798 - DNA, 243 bp, Artificial Sequence
  Description of Artificial Sequence: Synthetic coding sequence
atggacgacgacatcgccgccctggtggtggacaacggcagcggcatgtgcaaagccggattcgccggcgatgacgctccaagagctgtatttccaagtatagttggtcggcctcggcatcagggagtgatggtcggaatgggccaaaaggatagttatgtgggggacgaggcccagtctaaaaggggtatcttgacgctgaagtaccccatcgagcatggtattgtgaccaattgggattag

SEQ ID NO: 3799 - DNA, 300 bp, Artificial Sequence
  Description of Artificial Sequence: Synthetic coding sequence
atgctgaccatggacgacgacatcgccgccctggtggtggacaacggtagtggaatgtgcaaggccggtttcgctggagacgatgccccccgcgcagtgttcccttcaatcgtcggacgcccgcgtcaccagggcgtaatggtgggaatggggcagaaagattcatacgtgggagacgaggcccaaagcaaaagagggattctgacactaaaatacccgattgagcatgggatcgtgaccaattgggatgatatggaaaaaatatggcaccacacattctacaacgaactgagggtgtag

SEQ ID NO: 3800 - DNA, 495 bp, Artificial Sequence
  Description of Artificial Sequence: Synthetic coding sequence
atggacgacgacatcgccgccctggtggtggacaacggcagcggcatgtgtaaagcgggcttcgctggggacgacgcaccaagagccgtttttccctctatagttggcagaccccgccaccagggagtcatggtaggaatgggacagaaagacagctatgtcggggatgaagcccagagcaaaaggggaattcttacgttgaagtaccctatcgagcacgggatcgtgacaaattgggatgacatggagaaaatctggcatcataccttttataatgaactccgcgtcgcacctgaggagcaccctgtgcttctgactgaggcccccctgaacccaaaagccaaccgcgagaagatgacacagatcatgtttgaaacgtttaatactcctgccatgtacgtggcaatccaagccgtgctcagcctctacgcgtctgggcggacgacaggtatcgtgatggattccggcgacggggtgacccataccgtcccttag

SEQ ID NO: 3801 - DNA, 312 bp, Artificial Sequence
  Description of Artificial Sequence: Synthetic coding sequence
atggacgacgacatcgccgccctggtggtggacaacggcagcggcatgtgcaaagccgggttcgctggcgacgatgcaccacgggcagtgttcccatccatcgttggtagaccacgtcaccaaggagtgatggtaggaatgggccaaaaggactcctacgtaggcgatgaggcccagtcaaagcgtggcattctcactctgaaatatccaatcgaacatggcatcgtgaccaattgggacgatatggagaaaatatggcaccacacattttataatgaactccgggttgcacctgaagagcatccagtttag

SEQ ID NO: 3802 - DNA, 1056 bp, Artificial Sequence
  Description of Artificial Sequence: Synthetic coding sequence
atggacgacgacatcgccgccctggtggtggacaacggcagcggcatgtgtaaggccggtttcgcaggagatgatgccccccgtgctgtctttcctagcatcgtaggccgccccagacaccaaggcgtcatggtggggatgggacagaaagacagctatgttggtgacgaggcccagagcaagcggggtatattgacgcttaaatacccgatcgagcatggcatagtgaccaactgggatgatatggagaaaatctggcaccacaccttttataacgaactgcgagtggccccagaagagcatccagttctgttaaccgaagcccctcttaatccaaaggcgaatcgggagaagatgacccagataatgttcgaaacttttaacaccccggctatgtacgtggccattcaggccgtcctcagtctgtacgccagcggcaggacaacagctatattgcggcttgacctcgccggccgagaccttacagattatctgatgaagatcctgactgaacggggatactccttcaccactactgccgagcgcgaaatcgtgagggacataaaggagaaactgtgctatgttgccctcgactttgaacaggagatggcaacagcagcctcctcttcaagtctggagaagtcctatgagctgcccgatggacaggtgataacaatcggcaatgaacgtttccggtgtcctgaggcgctatttcaaccaagcttcctggggatggaatcctgcggaatccacgaaaccacctttaactcgatcatgaaatgcgatgtagacattcgaaaggatttatatgcaaataccgtgctgtctggggggacaacaatgtaccccggcattgctgatcggatgcaaaaggagatcacagcactggcaccgtccacaatgaaaataaaaattatcgccccaccagaaagaaaatattctgtctggatagggggctccatcctggcctcgttgagtaccttccagcagatgtggatatcgaagcaagaatacgatgagtccggtcccagtatcgttcacaggaagtgcttctag

SEQ ID NO: 3803 - DNA, 1131 bp, Artificial Sequence
  Description of Artificial Sequence: Synthetic coding sequence
atgaccgacaacgagctgagcgccctggtggtggacaacggcagcggaatgtgtaaagcaggctttggaggggacgacgctccacgggctgtgtttccaagcatgattgggcgtcctagacatcagggcgttatggtggggatgggtcagaaggattgctatgtgggggacgaggcgcagagtaaacggggtgtgctgacacttaaatacccaattgagcatggggtcgtgaccaactgggacgatatggaaaagatctggtatcacaccttctataacgagcttagggtggcaccggacgaacatccaattttactgactgaggctcccctcaacccaaaaatcaacagagaaaaaatgacgcagatcatgtttgaagcctttaacacccccgctatgtacgtggctatccaggctgtgctgtctctatacgccagtggaaggaccaccggtatcgttatggactctggtgacggggtgacacacatagtccccatctatgaagggtacgctctgccacacgccatcctcagactggatcttgctggacgcgacctgacagactatcttatgaaaatcctcaccgaaaggggatacaattttacaactacagcagaacgggagatcgtcagagacgtgaaagagaaactgtgttacgtggctctggatttcgagcaagagatggttcgggctgcggccagctcttctccagagaggtcatacgagctccctgacggtcaagtaattacaataggtaacgaaaggttccgctgtcccgaggccatattccagccttccttcctcgggattgagagtagcggcatccacgagactacattcaacagtatcatgaaatgtgatgttgacatcaggaaggacctgtatgcgaacacggtgctgagtggcggtagcacaatgtatcccggaatcgccgatagaatgcagaaagaaatcataaccctggccccctcaaccatgaagatcaagattattgccccccccgaacgtaagtatagcgtctggataggagggtccatcctggctagcttgtctacatttcagcagatgtggatcagcaaacaagagtatgatgaagcaggtccccccattgtgcataggaaatgcttctag

SEQ ID NO: 3804 - DNA, 1128 bp, Artificial Sequence
  Description of Artificial Sequence: Synthetic coding sequence
atggaggaggagatcgccgccctggtgatcgacaacggcagcggcatgtgcaaagccgggttcgcaggagacgacgctccacgggccgtattcccaagcattgtcggcaggcctcgacatcagggcgtgatggttggaatgggacagaaagattcctacgttggagatgaggcgcagagcaaaagaggtattcttactttaaagtatcccatcgaacacggcatcgtgactaactgggacgatatggaaaagatatggcaccacactttttacaatgagttgagggttgccccagaggaacaccccgtgctgctgacagaggcccccctaaaccctaaggccaatagagagaagatgacgcagatcatgtttgagacattcaacactccagccatgtacgtggctatacaggcagtgctgagcttgtacgctagtgggaggactacaggaatcgttatggatagcggggatggcgtcacacacaccgtgcctatctacgaaggctacgcactgccccatgccatcctgagacttgatttagctgggcgtgatcttacagattatcttatgaaaattttgacagaaaggggatacagtttcacaactaccgcagaacgcgaaatcgtgcgggacataaaggaaaagctttgttatgtcgcattagactttgagcaggaaatggcgactgccgccagcagtagctctctggaaaaatcgtacgaactacctgacggccaagttataactattgggaacgagagatttcgctgtccggaggctctctttcagccatcatttttggggatggagtcttgtggaatccacgagaccactttcaatagtattatgaagtgtgacgtagacatccgaaaagatctgtacgctaatacagtcttgtcagggggaaccacgatgtaccccggaatagccgatagaatgcaaaaggagatcacagccctcgcaccaagtacaatgaaaatcaagattattgcacccccagaacggaagtacagtgtgtggatcggaggttccattcttgctagcctctctacgtttcagcagatgtggattagtaaacaggagtacgacgaatctggtccaagtatcgtgcacaggaagtgtttctag

SEQ ID NO: 3805 - DNA, 1002 bp, Artificial Sequence
  Description of Artificial Sequence: Synthetic coding sequence
atggaggaggagatcgccgccctggtgatcgacaacggcagcggcatgtgtaaggcaggtttcgcaggagatgatgcaccgcgcgcagtgttcccttcaatcgttggccgcccacgtcatcagggtgtgatggtagggatgggacagaaagattcctacgtaggggacgaagctcagagcaagcgtggcatcctgactttaaagtatccaatcgaacacgggattgtaactaactgggatgatatggagaagatctggcatcacaccttttataacgaactgagggtggcccctgaagaacacccggttctcctgaccgaagctcctctgaatcccaaagctaaccgcgaaaagatgacgcaaatcatgttcgagacttatgcactcccacacgcgatcttgagactagatctggctggtcgtgatcttactgactatctcatgaagatcctgacagaaagaggttattccttcacaaccaccgccgagcgggagatcgtgagggacattaaggagaaactatgctacgtggctctcgactttgaacaggagatggccactgcagcaagctcctcaagcctggagaagagctacgaattgcctgacggacaggttattacgatcggtaacgaaaggttccgctgtcccgaggctctgttccagccttcctttctcggtatggaaagttgcgggatacatgagactactttcaattcaatcatgaagtgtgacgtggacatccgcaaggatctgtacgcaaacacggtactcagcggtggaaccactatgtatccagggattgccgatcggatgcagaaagaaattacggcgctggccccatcgactatgaagattaaaataattgcaccaccagaacgtaaatacagtgtttggattggagggtccatactcgcatccttaagtactttccagcagatgtggatctccaaacaggaatatgatgagtctggaccttctatcgtccataggaagtgtttttag

SEQ ID NO: 3806 - DNA, 1131 bp, Artificial Sequence
  Description of Artificial Sequence: Synthetic coding sequence
atgtgcgaggaggagaccaccgccctggtgtgcgacaacggcagcgggctgtgcaaggccggattcgctggggatgacgcccctcgcgcagttttcccatcaatagtcgggcggccgaggcatcagggggtcatggtgggcatggggcaaaaagactcttacgtgggcgatgaagcccagagcaaacgaggtatactcactttgaagtacccaatcgaacacggtatcataaccaattgggatgatatggagaaaatctggcaccattctttttataatgaacttcgcgtggctcccgaagaacaccccacattactgactgaggctcctctaaatccaaaagcaaacagagagaagatgactcagatcatgtttgagacattcaacgtgcccgcaatgtatgttgctatccaagccgttctgtctttgtacgcatctggacggacaaccgggatcgtcctcgacagcggcgacggtgttacacacaacgtaccaatctacgagggctacgctcttccgcatgccattatgcgacttgatttggctggcagagatctgaccgactatctgatgaagatcctgacagagcgaggctatagcttcgtgactacagcagagcgggaaatcgtgcgggatatcaaagagaagctgtgttacgtggccttggattttgagaacgagatggccactgctgccagctccagttccctcgagaaatcatacgaattgcccgacggacaggttattaccattggcaacgaacggttccgctgccccgaaaccctgtttcaaccgagttttattggtatggagagcgccggaatacacgagacaacttataacagcattatgaagtgtgacatcgatattcgcaaggacctctatgcgaataatgttctgtctgggggaacaacgatgtatccaggaattgccgaccgcatgcaaaaagagattacggctctggcgccaagtaccatgaagataaagattattgccccccccgagcggaaatattctgtctggatcggggggtctatcctggcctccttgagcactttccagcagatgtggatttctaagcccgaatatgatgaagcgggacccagcattgtgcaccggaaatgcttctag

SEQ ID NO: 3807 - DNA, 1131 bp, Artificial Sequence
  Description of Artificial Sequence: Synthetic coding sequence
atgtgcgaggaggagaccaccgccctggtgtgcgacaacggcagcggactctgcaaggctggcttcgcgggtgacgacgccccacgcgccgtctttccttcaatagtcggtagaccgaggcaccagggcgtgatggtgggaatgggccagaaagattcatatgtgggcgacgaagctcagtctaaacgcgggatcctcacgcttaaatatccgatagaacatggcatcataaccaactgggatgacatggaaaaaatatggcaccattccttttataatgagctgagggtcgcccccgaagagcatcccaccctacttacagaagccccactaaacccaaaagcgaatagggaaaaaatgacacagatcatgttcgagacgttcaacgttccagccatgtacgtggcaattcaagctgtccttagtctttacgcttcagggcggacgacgggtatcgtactagactcaggcgacggagtaacacataacgtgcccatctacgaagggtacgccttgccgcacgcgataatgcgcttggatcttgctggccgcgatctgaccgactacctgatgaagatcctaaccgagcggggctatagtttcgtgacgacagccgaacgtgagattgtcagggatatcaaagaaaagctatgttacgtggccctcgacttcgaaaacgaaatggcaacagctgccagtagctcctcgttggagaaatcttatgaactccccgacggtcaggtcatcacaatcggcaacgaacggttccgatgccccgaaaccctctttcagccttctttcatcggtatggagtcggctggcattcacgaaaccacatacaattcaataatgaaatgcgatatcgacattaggaaagacctgtatgcgaataatgttctgtccggcggtactacaatgtacccaggaatcgctgatcgaatgcagaaagaaattacagccctggctccttctaccatgaaaattaagattatcgccccacccgaacggaagtattcagtctggatcggcggttctattttggcttcattgtctaccttccagcagatgtggatctctaaacctgaatacgacgaggccggtccttccattgtgcatcggaagtgcttttag

SEQ ID NO: 3808 - DNA, 1164 bp, Artificial Sequence
  Description of Artificial Sequence: Synthetic coding sequence
atggtggtggagcgggacgacggcagcaccctgatggagatcgacggcgacaaaggcaaacagggtggtcctacttactacattgatacaaacgctcttagggtaccacgtgagaacatggaggcaatttcacccctcaagaacggcatggtggaggactgggattcatttcaagctattctggatcatacatataaaatgcacgtcaaatctgaggcctccctgcaccccgtgctaatgtcagaggctccatggaatacgagagctaaacgtgaaaaacttacagagctcatgttcgaacactacaacattccagctttcttcctctgcaagaccgcggttctcaccgctttcgccaatggtcggtccacaggcttgatactcgactcaggagccacccacaccactgccattcctgtacatgacggatacgtgctccagcaggggattgttaagtctccattggctggggatttcattaccatgcagtgtcgcgagttgtttcaggagatgaacatcgagcttgtgccaccatatatgattgccagtaaggaagcggtgagagagggatccccagccaattggaaaaggaaagaaaaattgccccaggtgacaaggtcgtggcacaactatatgtgcaactgcgtaattcaggacttccaggcctctgtgctccaggtatcagatagcacttatgatgagcaggtcgctgcccagatgccaaccgtgcactatgaattcccaaacggatacaattgcgacttcggagcagagagactaaagattcccgaaggtctgttcgatcccagcaacgtaaaggggttgtctggcaacaccatgctcggagtgtctcacgtcgtgactacaagtgttggtatgtgcgacatagatataagacctggtctttacgggtcagtgattgttgccggaggtaacactttgatccaatcattcactgatcgtctgaatagggaactctcgcagaagactccccctagcatgcggcttaagttgatagctaataacacgacagtggaacggcgtttttcttcttggattggaggaagcattctcgcttccctcggcacattccagcaaatgtggatcagcaagcaggaatacgaagaagggggaaagcagtgtgtggagcggaagtgtccatag

SEQ ID NO: 3809 - DNA, 1290 bp, Artificial Sequence
  Description of Artificial Sequence: Synthetic coding sequence
atgagcggcggcgtgtacggcggcgacgaggtgggcgccctggtgtttgatataggctcatacaccgtgagagcagggtacgctggcgaagattgccccaaggtcgactttcctacagccataggaatggtggtggaacgcgacgatggttccacgctcatggaaatcgacggagacaaaggtaagcaaggggggccaacgtattacatcgacacgaatgcactcagggttccccgcgagaacatggaagccataagccctctcaagaacgggatggtggaggactgggactcattccaggccatcctggaccacacctacaagatgcacgttaaatctgaagcctcattgcatcctgttctgatgtcagaggcgccatggaatacccgtgccaagagggaaaagcttacggaactcatgttcgaacactacaacattcccgcctttttcctttgcaaaacagccgtactgactgcattcgctaatggacggtccaccgggctgatcctcgactccggagcaactcatactactgccataccagtgcacgacggctatgtgctgcaacaggggattgtgaagtccccacttgcaggggatttcataactatgcaatgccgcgagctatttcaggaaatgaatatcgagctggtccccccctatatgattgcctctaaggaggcagtgagagaggggtcgcccgcaaactggaagaggaaagaaaagttgccgcaggttactcgctcctggcacaattatatgtgcaattgtgtgattcaggatttccaggctagcgttctgcaggtgtccgactctacctacgatgagcaggtagcagcccaaatgccaactgtccactatgaatttcccaatggctacaactgcgacttcggcgctgagcgcctcaagattccagaggggctatttgatccaagcaatgtgaaagggctgtctgggaacacgatgctgggcgtttcacacgtggtgactacttctgtggggatgtgcgatatagacatccgacctgggctttatggctctgtgattgttgccggcggaaataccctgatccagtccttcactgatcgcctcaaccgggaattgtctcagaaaactccaccaagtatgcgcctgaagctgatcgctaataacacaacggtagaacggcgattcagctcatggataggggggagcatactcgctagcctgggtacttttcagcagatgtggatctccaagcaggagtacgaggagggagggaagcagtgcgtggagcggaagtgcccatag

SEQ ID NO: 3810 - DNA, 1164 bp, Artificial Sequence
  Description of Artificial Sequence: Synthetic coding sequence
atggtggtggagcgggacgacggcagcaccctgatggagatcgacggtgacaagggcaaacagggcgggcccacttactacattgatacaaacgcactgcgggtgccacgcgaaaatatggaggccatctcaccactgaagaacggaatggtggaggactgggattctttccaagcgattcttgatcatacctacaagatgcacgttaaatctgaagccagtctccatcctgtccttatgagcgaagcgccgtggaatacccgagcgaagcgggagaagctgaccgagctcatgttcgaacactacaatattcctgccttttttctgtgcaagactgctgttctgaccgccttcgcgaacggccgcagcaccggtctgattttggattctggagcgacacacaccaccgccatccctgtgcatgatggttatgtgctgcagcaagggatcgtgaagagccccttggcaggcgacttcattactatgcaatgccgtgaattgttccaggagatgaacatcgaactcgtccccccgtacatgattgcaagcaaagaagctgtccgtgaaggcagccccgctaactggaaaagaaaagagaagctcccgcaggtgactagatcttggcataactacatgtgcaactgtgttattcaggatttccaggcttcagtcctccaagtgtcagatagcacatacgacgagcaggttgccgcccagatgcccaccgtgcactatgaattcccaaatggttataattgtgattttggagccgaacggctgaagatacctgagggcctgttcgatccctcaaatgtgaaagggctctccggaaacaccatgctcggtgtgtcccacgtagtcacgaccagtgtcgggatgtgcgatatagatatacggccaggcctttacggcagcgtaatagtagctggagggaacaccttaatccagtcatttaccgatcgtctgaatagagagttgagtcaaaaaacccctccctcaatgagattaaaacttatcgcgaacaataccacagtggagcgccggttcagtagctggattgggggcagtatcctagccagcctgggtaccttccagcagatgtggataagcaagcaggagtacgaagagggcggcaagcagtgcgtggagcgcaagtgtccctag

SEQ ID NO: 3811 - DNA, 153 bp, Artificial Sequence
  Description of Artificial Sequence: Synthetic coding sequence
atggtggtggagcgggacgacggcagcaccctgatggagatcgacggggataaaggaaaacagggcggccctacctactacattgatacgaatgcccttcgggtgcctcgagagaatatggaggctatttccccattgaaaaacggtatgtag

SEQ ID NO: 3812 - DNA, 1281 bp, Artificial Sequence
  Description of Artificial Sequence: Synthetic coding sequence
atgagcggcggcgtgtacggcggcgacgaggtgggcgccctggtgtttgatattggttccttctccgtgcgtgccggctatgcgggagaggattgccccaaggctgacttccccaccactgtggggctgttagccgcagaggaggggggggggctcgaactggaaggtgacaaagaaaagaaaggcaagatcttccacatcgacacaaacgccctgcacgtgccccgtgacggagccgaggttatgtcccctcttaagaatggtatgattgaggactgggagtgtttccgggcgatccttgaccacacctactccaagcacgtgaaatcggagcctaacttgcaccctgttctaatgtccgaagcgccatggaacacaagagctaagagggaaaagctgaccgaactcatgttcgaacagtacaacatccccgcttttttcctctgtaagacagcagtactgacggcattcgccaacgggaggtcgaccgggctagtactagatagtggagctacccacacaactgccatccccgtccacgacggatacgtcctgcagcaaggcattgtgaagtcccctttagccggggactttatttccatgcagtgtagagagctgttccaggaaatggcaattgacataattccaccttacatgatcgctgccaaggaacccgtgcgggaaggggcccctccgaactggaagaagaaagaaaagcttccgcaggtgagtaaaagttggcacaactacatgtgtaatgaagtcatccaagacttccaggcgtccgtcttgcaggtctccgatagtccatatgacgaacaggtagctgctcagatgcccacagttcactatgagatgcccaatggttataatacagattacggcgccgagcgtcttcgtatacccgaggggctcttcgatccttcgaatgtcaagggtcttagcggaaataccatgctgggtgtgggacatgtagtgacaacctctatcggaatgtgcgatatagacataaggcccgggttgtacggctccgtaatcgtgacgggcggcaacacactccttcaagggttcacagatagattgaaccgggagttgtcccaaaaaacccctccctcaatgcgtctcaagctcatagccagtaattccaccatggaaagaaagttttccccttggattggcgggtccatcctggcgagcctaggtacctttcagcaaatgtggatcagcaaacaggaatatgaggagggcggcaaacagtgcgtcgaaaggaagtgcccctag

SEQ ID NO: 3813 - DNA, 1308 bp, Artificial Sequence
  Description of Artificial Sequence: Synthetic coding sequence
atgtgggccccccccgccgccatcatgggcgacggccccaccaagaaagtgggaaatcaggcaccactacagacccaagccctgcaaacggccagtctgagggacggaccagcaaaaagggccgtatgggtgaggcacacatcatcagagccacaggaacctacggagtcaaaggcagcaaaggaacgaccgaagcaggaggtgacgaaggccgttgtggtagatttagggactggctattgcaagtgcggctttgctggcttgcctcggccaacccacaagatctccaccaccgtcgggaaaccctacatggagaccgctaagaccggagacaaccgaaaagaaacatttgttggccaggagctgaataataccaatgtccatcttaagttagtcaatccactgcgccatggcatcattgtggactgggataccgtccaggacatctgggaatacctcttccgccaggagatgaagatcgccccagaagaacacgcagtcctcgtgagcgatcccccactctctcctcacacaaatcgggaaaaatatgccgaaatgctgttcgaggcgttcaatacgcccgccatgcacattgcttaccaatctagactttccatgtattcatacggccgcaccagtgggttggtcgtagaggtgggtcacggagtttcgtacgttgtccctatttacgaaggatacccactgccttctattacagggcgtctggattacgcagggtccgacctgacagcctacctcctgggactgctgaattccgccggtaacgagttcacccaggatcaaatgggtattgtagaggacattaaaaagaaatgctgttttgtcgccctcgatcctatagaagagaagaaagtgccgctgtccgagcacaccatcaggtatgtactgcccgacgggaaggaaatccagctgtgtcaggagaggttcctctgtagcgaaatgttctttaagccgtcattgatcaaaagcatgcagctcggcctgcacacacagaccgttagttgcctcaacaaatgtgacatcgcactgaagcgggatctcatgggcaacatcctcctatgcggcggcagcacaatgctgagcggctttcccaaccgtttacagaaggagttgagttctatgtgtcctaatgataccccccaagtaaatgtgctccctgaaagggattcagccgtgtggacaggcggtagcatactagctagtctccagggcttccaacccctgtgggtgcaccggttcgagtacgaggagcatggaccctttttcctgtaccggcggtgcttttag

SEQ ID NO: 3814 - DNA, 1248 bp, Artificial Sequence
  Description of Artificial Sequence: Synthetic coding sequence
atggccacccggaacagccccatgcccctgggcaccgcccagggcgaccctggagaggctggtacgcgacccggaccagacgcgagcctgcgcgataccggcgctgccactcagctaaagatgaagccacgtaaggtgcacaaaatcaaggcagttattattgatttaggctcacagtattgcaaatgcggttacgccggcgaacctcgtcccacatacttcatttctagtactgtcggtaaacggtgtccagaggccgcagatgccggtgatacaaggaagtggaccctggtcggccacgagctgctgaatactgaagcgccgttgaagttggtgaatccactcaaacacggaatcgtcgtggattgggactgtgtccaggatatatgggagtatatcttcagaacagcgatgaagatcctgccagaagaacatgcagttttggtgtctgaccctcccctgagtccatcctctaaccgagagaagtatgctgaactgatgttcgaaacctttggcatacccgccatgcacgtgaccagccagagcctcctcagcatctattcatacggaaagacatccggattggtggtcgagtctgggcatggtgtgtcccatgtcgtgcccatcagcgagggcgatgttctccccgggctcacaagccgggccgattacgccgggggggacttgaccaattatcttatgcagctgctgaatgaggctgggcacgcgtttacagatgatcacttgcacatcatagaacacatcaagaaaaaatgttgctacgctgccttcttgcccgaggaggaattgggattggtgcccgaagaactcagggtcgattatgaacttcctgacgggaagctcatcacaattggacaggagcgcttccgctgttctgaaatgctgtttcaacccagcctggccggctcaacacaacccggactgcccgagctgacagcagcttgcctgggcagatgccaggatactgggttcaaggaggagatggctgccaacgtcttgttgtgcggcggatgtacaatgcttgacggctttcctgagcgatttcagagagaactgtctctcctatgtcccggtgatagccctgccgtggctgccgccccagagagaaagacctctgtctggacaggtggatccatcctagccagcctgcaagcctttcaacagctgtgggtgtctaaggaggaattcgaagaaagaggttcggtcgccatctatagcaaatgttag

SEQ ID NO: 3815 - DNA, 1101 bp, Artificial Sequence
  Description of Artificial Sequence: Synthetic coding sequence
atggccgcccggaccgtgatcatcgaccacggcagcggcttcctgaaagccggcacagctggctggaatgaaccacagatggtctttcccaacatcgtaaactacctcccatgtaaggagaatccaggaccctcatacgcaaggaggagggtgtcactcggcatcgatatttgccatcctgacactttttcctatcccatagagcggggacgaatactgaattgggagggtgtgcagtacctgtggtcgtttgtgctggaaaaccacagaagggaacaagaggttccaccagtcataattacagaaaccccactacgggaacctgccgatcggaagaaaatgttagaaatcttgtttgagctgttacacgtacccagtgttttactggcggaccaactccagatgtccctttatgcctccggactgctgacaggggttgttgtcgatagtggttatggcttaacacgggtccagccatttcatcagggacgcccactccccgcgtccgggaaaaccttggagtttgccggacaagatcttagcgcttacttgctgaagtccttgttcaaagaggactgtgatcggcgatgcctgtttcagctcgagactgttgccgtgacgcagatgaacaagtgctatgtcccacagaacttgggcgaggccctggactttcgagagcgccagcaatctgccctcgacgaatcaaacacctatcaactgccggatggaagtcgggttgaactgactcctatgcagagggttgctccagaaatgttttttagcccccaggtatttgagcagccgggcccatccatcccccgtgccatcgtggagtctgtggagtcatgcgagatttccttgcgcccgctgttggtgtcccatgtgatggcatgcggaggcaacacgctgtacccgggcttcacaaaacgcctgtttcgggagttgatgggcgatcacgtgagctccaccaaggcgaccgtgtgggagggcagcaatcgtaactttagcgtgtggctgggcgcctccgtagtggctcacctgtccacgtaccagagcgaatggatgagcagagaggagtacggagaacacatgagaatgtag

SEQ ID NO: 3816 - DNA, 1251 bp, Artificial Sequence
  Description of Artificial Sequence: Synthetic coding sequence
atggacgccagccggcccaagagcagcgagagccagagcagcctggaagctcctagaccagggccaaacccttcccctaacgtggtaaataagcctctccaacgagattttcccgggatggttgccgaccgactaccccctaaaaccggcgtcgtggtcattgacatgggaaccggaacgtgtaaagtcggattcgcagggcaggctagcccaacttacaccgtcgccaccatcctgggctgtcagcctaagaagcctgcgacatccgggcagagtggcctgcagacatttattggcgaggctgcaagagtgcttcctgaacttactctggttcaaccactcaggtcaggaattgtggtggactgggatgccgctgaactgatctggaggcacctactggagcatgacctcagagtggctacccacgatcaccccttgctgttttcggatcctcctttttcccctgccactaaccgagagaaacttgttgaggttgcctttgagtcactccgatctccagcaatgtacgtggcaagccagtctgtgctgagtgtttatgctcacggacgtgtgtctgggcttgtggtagacacagggcatggagtaacatacacagtaccagtgttccagggctacaacctgctgcatgcaacagagaggctagacttggctggcaaccatttgaccgccttcctggccgagatgctgctccaagccggcctgcctctcggccagcaggatcttgatttagtcgagaacatcaagcaccactattgttacgtcgccagtgatttccaaaaggagcaggcaaggccagagcaggaatataaaagaacactgaagctgcctgatggaaggaccgtgactctgggcaaggaactatttcagtgtcctgagttgttgttcaacccgccggaggtcccggggctgtccccggttggactgtcaacgatggccaagcagtctctgaggaagctgtctctagagatgcgggctgacctggcccaaaatgtgctgctctgcggcgggtcatccctgttcacaggctttgaggggaggttcagggcagaactcctgcgcgccctgcctgccgaaacacatgtggtggtggctgcccagccaactcgcaacttcagtgtttggatagggggcagtattctggcctcactgcgtgcttttcagagttgctgggtattaagagaacaatatgaggagcaagggccctatattgtgtacaggaagtgttactag

SEQ ID NO: 3817 - DNA, 2763 bp, Artificial Sequence
  Description of Artificial Sequence: Synthetic coding sequence
atggaggtgcagctgggcctgggccgggtgtacccccggccccccagtaagacttataggggggcatttcagaacctgtttcagagcgtccgggaggtcatccagaacccagggccccgacaccccgaggcagcttccgcagccccaccgggagcctccttgttactgctgcaacagcagcagcaacagcaacaacaacagcagcagcagcagcagcagcagcagcagcagcagcagcaggagactagccccaggcagcagcagcagcaacagggcgaggacggctctcctcaggctcatcgtaggggaccgaccggttatctggtcctggatgaggaacagcagccaagccagcctcagagcgcactggagtgccatcccgagaggggttgcgttcctgagcctggagccgccgtggccgcctctaagggactaccccagcaactacctgctcccccagatgaagatgatagcgctgctcccagcacacttagcctgttgggacccaccttccctggactctcaagctgcagcgccgatctgaaggatatactttccgaggccagcacaatgcagttattgcagcagcagcaacaggaggccgtcagcgaaggcagctcctcaggccgggctcgcgaagcatcaggcgcccccaccagctcaaaagataactatttgggtggcacgagtaccatctccgataacgctaaagagttgtgcaaagcagtcagcgtgagtatgggccttggggtagaggccctggagcacctctccccgggggagcagcttaggggtgactgcatgtatgcccccttactgggtgttcctccagccgtgcggccaactccgtgtgcccctctggcagaatgtaagggtagcctgctagatgacagcgctggcaagtccacagaagacaccgcagagtactccccgttcaaagggggctacaccaagggactcgagggagaatcccttggttgctctggatctgctgcagcgggctcaagcgggacgctggagcttccctccacccttagcttgtacaagagcggtgctttggacgaagccgcagcctatcaaagcagagattattacaacttcccacttgcgttagctggacccccacctcccccacccccccctcaccctcacgcacggattaagctagagaatcctctcgattacggaagcgcttgggccgcagctgcggcccaatgccgctacggagatctggcatctctgcacggagccggggccgcggggcccggcagcggttccccatcagcagccgcttcctccagttggcacacattgttcacagctgaggaggggcagctgtacggcccttgtgggggggggggcggtggtgggggcggcgggggaggcggaggcggaggaggcggaggtggagggggcggggaagccggagcagtagccccatacggctacacccggcccccccaaggcttagccgggcaggaaagcgattttacagctcctgacgtctggtaccccggtggcatggtgtccagagtcccttacccctccccaacctgcgtcaagagtgaaatgggaccatggatggattcttattctggcccttatggagatatgcggctggagaccgccagagatcacgtcctgcccattgactactacttccccccacagaaaacctgcttgatctgcggagacgaggccagtggctgtcactatggagctctgacctgtggtagttgtaaagtattctttaaaagggccgccgaagggaaacagaaatacctctgcgcatctagaaatgactgcaccatcgataagttccgccgcaagaattgccccagctgtcggcttcggaagtgctacgaagcggggatgactttgggcgcacggaaactgaagaaattggggaatctcaaacttcaggaggagggcgaggcatcatctaccacatcacctacagaggagaccacccaaaaactgaccgtaagtcatatcgaagggtacgagtgtcagccaatcttcctgaacgtgttggaagccatagaacctggcgtggtgtgcgccggccacgataacaatcaacctgatagcttcgccgccctgctcagtagcctgaatgagctgggagagaggcagcttgtgcacgtggtgaagtgggctaaagcccttccaggcttccgaaacttgcatgtggacgatcaaatggccgttatccagtacagctggatgggcctgatggtgttcgcaatgggctggcgcagtttcacaaacgtgaactcacggatgctttactttgcaccagacctggttttcaatgaataccgaatgcataagagtcggatgtactctcaatgcgtacggatgcggcatttgagtcaggagtttggatggctgcaaattacacctcaggagttcttgtgtatgaaagccctcctgttgttctccataatcccggtggatgggctaaaaaaccaaaaattcttcgatgaactgagaatgaattacattaaggagttagaccgcattattgcttgcaaacgcaagaatccgacgagctgctcaaggaggttttatcagttaaccaaactgctggatagcgtccagcctattgcaagggagttacatcaattcacatttgatctgctgataaaatctcacatggtgtctgtggactttccagagatgatggcagaaatcatctctgtgcaagtacccaaaattctctctggaaaggttaaacccatttatttccacacccagtag

SEQ ID NO: 3818 - DNA, 1167 bp, Artificial Sequence
  Description of Artificial Sequence: Synthetic coding sequence
atgatcctgtggctgcacagcctggagaccgcccgggaccacgtgctcccaattgactactacttcccccctcaaaaaacctgcctgatctgcggggacgaagcgtctggatgtcattatggcgccctgacatgtggctcatgcaaggtgttttttaaaagagcggctgagggcaagcaaaaatacctctgcgccagtcgcaacgactgtaccatcgataaatttcgtcgcaagaactgcccatcatgtcggctcaggaaatgctatgaagctgggatgactctcggcgcacggaagttgaaaaaactgggaaatctgaaactgcaagaggagggcgaggctagtagcaccacctccccaactgaggagaccacccaaaagctcactgttagccatattgagggatatgagtgtcagccaatctttctcaatgtgctagaagctattgaacccggcgtggtttgtgccgggcacgacaataaccaacccgacagctttgcggccctgctttcatccctgaacgagctgggagagcggcagctggtgcatgtcgtaaaatgggccaaggccctgcccggcttccggaatctccacgttgacgatcaaatggctgtgatacagtactcctggatggggttaatggtgtttgccatgggatggcgctccttcactaacgttaatagtaggatgctctacttcgccccagatctagtcttcaacgagtacaggatgcacaagagtagaatgtactcccaatgcgtgagaatgagacatctgagtcaggagttcggctggctgcagattacaccccaggaattcttgtgtatgaaagctctgctcctgttctcaatcatccccgtcgacgggctgaagaaccaaaaattcttcgatgaactgaggatgaattatataaaggaacttgaccgcattattgcttgcaaaagaaaaaatccaaccagctgttccaggcgcttttatcagctcacaaaactcctggactcggtgcagcccattgcccgcgagctgcatcaatttacattcgacctgctgatcaaaagtcatatggtctcagtggacttcccagaaatgatggccgaaattataagcgtgcaagtgcccaaaattttgtccggaaaagtgaaacccatctattttcacacgcagtag

SEQ ID NO: 3819 - DNA, 2205 bp, Artificial Sequence
  Description of Artificial Sequence: Synthetic coding sequence
atggaggtgcagctgggcctgggccgggtgtacccccggcccccctctaaaacctacaggggcgcatttcaaaacctatttcaaagtgtccgtgaggttatccagaacccgggcccacgccacccagaggccgccagtgccgcgccaccaggggcctcactcctgctgctgcagcagcagcagcaacagcagcagcagcagcagcagcaacagcagcaacaacagcagcagcagcaacaggaaacaagccctcgacagcagcaacaacaacaaggagaggacggcagcccacaggcacatcggagagggcctactggatacctggtgctggatgaggagcagcagccctctcagccccaatccgcactagagtgccaccctgaacgtggatgcgtgcctgaacccggagccgcggtggccgctagcaagggcctgccccagcagctccccgccccgccggatgaggacgattcagccgcccctagtaccctttccttactgggaccgacttttcccggtctcagctcctgctccgccgatctgaaggatattctgtcagaagcgagtaccatgcagctattacaacaacaacagcaggaagccgtgagtgagggttcctcctctggacgagcacgggaggcttctggggcgcccacctctagcaaggacaattatcttggcggaactagcactatcagtgataatgctaaagaactgtgtaaggccgtgtccgtgtccatgggcctcggtgtcgaagctttggagcatttgtccccaggagagcagctgagaggtgactgtatgtatgcaccattgctgggggtgccccccgccgtgcggcccactccctgcgctccgctggctgagtgtaaagggtcgcttctggacgattccgcgggcaagtctacagaggacacggccgagtatagcccgttcaagggagggtacactaaaggtctggagggcgagagcttagggtgtagcggttctgcagctgccggcagttcaggcacactggaactgcccagtacgctttctctgtacaagtccggggccctggacgaagctgctgcttaccagtccagggactattataattttcccttagcgctggcaggacccccacctccaccccctcctccgcatcctcatgcacgaataaaactcgaaaatcctctggattatgggtctgcatgggccgcggccgccgcccaatgtagatacggagacctagccagcctgcacggtgccggggccgccggtcctgggtctggctcaccgagcgcggctgcctcctccagctggcacaccttgttcaccgcggaggaaggccagctgtatggtccatgcgggggcggaggaggcggaggtgggggaggagggggtggtggcgggggcgggggtggggggggcggtggtgaagccggcgccgtggcaccatacgggtacactagaccacctcagggactggctgggcaggagtcggacttcacagccccggacgtgtggtatccaggaggcatggtaagtcgggttccttatcctagccctacctgcgtaaaatcagagatgggcccctggatggactcctacagcgggccttacggcgatatgcgactcgaaaccgcgagggatcatgtgttaccaatcgactattacttccctccacagaaaacctgtctgatttgcggggatgaggcctcaggctgtcactacggagctctcacgtgtggcagctgcaaggttttctttaagcgagccgctgaaggaaaacagaagtacttgtgtgctagtcggaacgactgtactatcgacaagtttagacggaagaactgccctagctgtagactgaggaagtgttacgaggccgggatgaccctgggagctcggaaactcaagaaactgggtaatctaaaactgcaggaggagggggaagcttcaagcaccacatcaccaacagaagagacaacacaaaagctgacagtgtcacacatcgaagggtacgagtgccagcccatctttctgaacgtgctggaggccatagagcccggagttgtgtgcgccggccatgataacaatcagcctgattccttcgctgccctcctgagctctcttaacgagctaggggagcgtcaactggtccatgtggtgaagtgggccaaggcactgccagactgtgagcgtgcagcctcggtccatttctag

SEQ ID NO: 3820 - DNA, 1596 bp, Artificial Sequence
  Description of Artificial Sequence: Synthetic coding sequence
atggaggtgcagctgggcctgggccgggtgtacccccggccccccagcaagacctatcgtggagccttccaaaatctgtttcaatccgtgcgggaagttatccagaaccccggaccccgtcatcctgaagccgctagtgccgcccccccaggagcttctctcctgctgcttcagcagcagcagcaacagcagcagcagcagcagcagcagcagcaagaaacgtcaccacggcagcagcagcaacaacagggcgaggacggctctccacaagcccacaggaggggccccactggctacttggttctggacgaggagcagcagccatcacagcctcagagcgccctggagtgtcaccctgagcgcggctgcgtgccagagcccggtgctgcagtggccgcaagtaagggtctgccccaacaactgcctgctcctcctgacgaggacgatagcgcagcccccagcaccctgtctttactcggtccgacttttcctggcttatcctcttgcagtgctgacctgaaagacatactgagcgaagcttccacgatgcagctgctccagcagcagcagcaggaagctgtgagtgaaggatccagctctggccgggccagagaggccagcggagctcctacatcctcaaaggacaactatctaggcggaacaagcactatcagtgataacgcaaaagaactgtgcaaagcagtgagcgtatctatggggttaggtgtggaggcattggaacacctgtccccaggcgagcaactgcggggcgactgcatgtacgcccccttattgggggtaccaccagccgttaggcctacgccttgtgcccccctggccgagtgcaaagggtctctgctcgatgacagcgcaggaaagtctaccgaggataccgcagaatattccccattcaaaggtggctatactaaaggactcgagggcgaatctctggggtgctccgggtcagccgcggccggaagttcaggcaccctcgaattaccaagcacactttcactgtacaagagcggagccctcgacgaggccgctgcataccagagccgtgattactataatttccctctggcacttgcagggccacctccacccccacccccaccccatccacacgcccgaataaagctcgagaatccccttgactatgggtccgcctgggccgctgctgcagctcagtgtaggtacggtgatctggctagtttgcatggtgctggcgccgccggacctggatcagggtccccttcggcagctgcctcatcatcgtggcacacactgttcacagcagaagaaggacagctgtatgggccgtgcggaggaggcggcgggggcggcggaggcggcggaggcggcggcgggggaggaggaggcgggggaggtggagaagccggcgccgtggcgccatacgggtacacacggcctccccagggacttgcggggcaagaatctgacttcaccgctcctgacgtgtggtatcccgggggaatggtgtcaagggtaccctaccctagcccaacctgtgtgaagtcagagatgggtccctggatggacagttatagcggaccctatggagacatgcgatag

SEQ ID NO: 3821 - DNA, 2217 bp, Artificial Sequence
  Description of Artificial Sequence: Synthetic coding sequence
atgcagctgctgcagcagcagcagcaggaggccgtgagcgagggctcctcaagcggcagggcccgcgaagctagcggagcccccacatcaagcaaagacaactatcttggcgggacatcaaccatttcggacaacgcgaaggagctgtgcaaagccgtttcagtctctatggggctcggagtggaagccctggaacacctaagtcccggtgagcagcttcgaggagactgtatgtacgcgcccttactgggcgtaccccccgcggtgagaccaaccccatgcgcccctctcgctgaatgtaaaggatcccttctggacgattccgcagggaaaagcaccgaggatacagcagagtattcccccttcaaaggagggtatacaaagggactcgagggagagtccctcggctgctctggctctgcagccgctggatctagtggtactctggagctccccagcacgctgagtttatacaagtcaggagctttggatgaggctgcagcctatcagtcaagagactactataactttccgttagcactggccggaccacctccgcctccacccccccctcatccacacgccaggatcaagctcgaaaaccctcttgactacgggtccgcctgggcggccgctgccgctcagtgtcgctatggagatttggcgtcccttcacggcgctggagccgcagggccaggatctgggagcccatccgcggccgcctcaagttcgtggcatacacttttcacagctgaggaggggcagctctatgggccatgcggcggcggaggtggcggagggggcggcggcgggggagggggagggggaggcggcggcggtggaggcggagaggcaggggccgttgccccctatggttacactagaccgccgcaagggctggcaggtcaagaaagtgatttcacggcgcctgacgtgtggtaccctggcggcatggtgtcaagagttccataccctagtcctacatgtgtgaagtccgaaatgggcccttggatggactcttactccggcccctatggcgacatgagacttgagactgcgcgagaccacgtactgccaattgattactactttcctccacagaaaacttgcctgatatgcggagacgaagcatcgggatgtcattacggagccctcacctgcggttcctgcaaggtcttcttcaagagggcggccgagggcaaacaaaagtacttatgcgcgtcccggaatgactgtacaattgacaaattccgacgaaagaactgtccttcgtgtcgccttcgaaagtgctatgaggccggaatgactctgggcgcacggaagctgaaaaagctcggcaatcttaaactacaggaagaaggggaggccagcagcacgactagtccaacagaagagaccacccagaagctgaccgtttcccacatcgagggctacgagtgccagccaatttttctaaatgtcttggaggccatcgaacctggagtggtgtgtgctgggcatgataataaccagcccgactccttcgccgccttgctgtctagtctgaacgagctgggtgaacggcagctcgtgcatgtggtgaagtgggccaaagcattgccaggctttagaaacctgcacgtggatgatcagatggccgtgatccaatattcttggatggggctgatggtgttcgccatggggtggcggagctttactaacgtaaactcacgcatgctctatttcgcacccgatttggtcttcaacgagtatcgcatgcacaagtcaaggatgtattcgcagtgtgttcggatgcggcacctgagtcaagagttcggctggttacagattaccccccaggaatttctgtgcatgaaagcgctgctgctcttcagtatcactttctgtctgcacccaacgagcgtaccagtcgacggtcttaaaaatcaaaaattcttcgatgaactccgaatgaactatatcaaggaattggaccggatcatcgcctgcaagcggaagaatcccacatcatgctcccgtcgattctatcagttgaccaagctgttggactcagtccaacctattgcgcgtgagctccaccaattcacctttgacctgttgattaagagtcacatggtgagtgtcgactttcccgaaatgatggcggagattatatccgtgcaggtgcctaagatattgtctggaaaggtcaagccaatctacttccatactcaatag

SEQ ID NO: 3822 - DNA, 4290 bp, Artificial Sequence
  Description of Artificial Sequence: Synthetic coding sequence
atggtggccgccgccgccgccaccgaggcccggctgcggcggcggaccgcagccaccgcagcactggctggcaggagcggtggcccccattgggactgggacgtaactagggccggtagaccagggctcggcgcgggactcagactgccccggctgttaagccccccactacggcctcggttactgctgcttttacttctgttgagcccccccctcctgctactgctcttaccctgcgaagcagaggcagcagccgccgccgccgcagtatccggctccgccgctgcagaggcaaaggagtgcgatagaccctgcgtgaatggcggccgatgcaacccgggtactggccagtgcgtgtgcccagcagggtgggtcggagagcagtgtcagcactgcggagggagattcaggttgactggcagctctggcttcgtcaccgatgggccagggaattacaaatacaagacgaaatgtacatggctcattgaaggtcagccaaataggataatgcgcttaaggtttaatcattttgccacggagtgcagctgggaccacctgtatgtgtatgacggcgatagcatctacgcgccactggtggcagcattttccggactaattgttccagagagggacggtaacgaaacagtacctgaggtggtggcaacctctggatacgctcttctgcacttcttctccgacgccgcatataacctgaccggcttcaacatcacatattcttttgatatgtgtcccaataactgctcgggccgcggagagtgtaagattagcaactccagcgacacagtagagtgcgagtgttccgagaattggaaaggagaagcctgtgatatcccacactgtactgacaattgcgggttcccccaccgagggatttgtaactccagcgatgtgagagggtgtagctgcttttccgattggcagggcccaggatgtagcgttccagtccctgctaatcagagcttttggacacgcgaggaatacagcaatcttaagctcccacgcgcatctcataaggcagttgttaatgggaatataatgtgggtggtcggcgggtacatgtttaatcactcggattacaatatggtcctggcatatgacctggctagccgtgaatggctgcctctaaacagaagtgtcaataacgtagtggttcgatatggccatagcctggccctttacaaggataaaatctacatgtatgggggcaagattgattctaccggaaacgtcactaatgagctgagagtattccatattcacaatgaatcttgggttctcttgacccccaaagctaaggagcagtacgccgttgttggacattctgcccacattgtaaccctaaagaacggccgcgtcgtcatgctggtgattttcgggcattgccccctttatggatatataagcaatgtgcaagagtatgacctggataaaaacacctggtcaattctacacacccagggagccttggtccagggcggctatggccacagttcagtttacgaccatagaacccgggccttatacgtacacggcggttataaggctttcagcgccaacaaatatcgcctggctgacgatctgtataggtacgacgtggacacccagatgtggaccatcctgaaagattcccgcttttttagatacctccatacggccgtcattgtttctggcactatgttggtctttggcggtaatacacacaacgacacaagtatgagccatggggcaaagtgtttctcaagtgacttcatggcatacgatattgcttgcgaccggtggagcgtgcttcctagacccgatcttcaccatgacgtcaaccgctttgggcatagtgccgtgctgcacaacagtacgatgtatgttttcggtggttttaatagcctactgctatccgacatactggtctttacttctgagcaatgcgacgcacatcgcagtgaggctgcatgtttggcagctggtcctggtattagatgcgtctggaataccggatctagtcagtgcatttcttgggctctggctacagacgaacaggaagagaagctcaaatctgagtgcttctctaagcggacactggatcacgatcgatgcgatcagcacacagattgttacagctgtacggctaataccaacgactgtcattggtgcaacgaccactgtgtccctagaaatcacagctgtagcgagggccagattagcatcttccggtacgagaactgccccaaagacaaccccatgtattattgtaacaagaaaacatcttgtagaagctgcgcgctcgatcagaactgccaatgggagcccagaaaccaggagtgtatcgccctgccggaaaacatctgcggaatcggatggcacctagtcggcaattcatgcctcaagataactaccgccaaggagaattacgacaacgccaagttgttttgtcgaaaccacaatgctctgttggccagtctgaccacacagaagaaggtcgagtttgtcctgaagcaactgcggattatgcagtcatcacagagcatgtccaagctgacgctgactccttgggtgggactgaggaagattaatgttagttactggtgttgggaagacatgtctccctttaccaatagcctcctccagtggatgccatccgaaccctcagacgcaggattctgcgggatactttccgaaccctccacaaggggcttaaaagctgcaacatgcatcaacccgttaaatgggtccgtatgcgaaaggccagccaaccactctgctaagcagtgtaggaccccctgtgctttacgaacagcctgcggcgactgcacgtccgggtctagtgagtgcatgtggtgctccaacatgaagcagtgcgtggatagcaatgcgtacgtcgcgtccttcccattcgggcagtgtatggagtggtacacaatgagcacatgtcctccggagaactgctccggatactgtacgtgcagccactgcctcgaacagcctggatgtgggtggtgcaccgaccctagcaacactgggaagggcaagtgcatcgaaggaagctataagggcccagtgaaaatgccctctcaggcccccacaggaaacttctacccacagccccttctcaacagttcaatgtgccttgaagactcccggtacaactggagtttcatccactgcccagcctgccagtgcaatggccattctaagtgcatcaaccagtccatatgtgagaagtgtgagaatctgacaaccggaaagcactgcgaaacctgcatctcgggattttacggcgaccccactaatggagggaagtgccagccgtgtaagtgcaacggtcacgcctccttgtgcaatactaatacgggcaagtgtttctgtacaaccaagggggtcaaaggagacgagtgtcagttgtgtgaggttgaaaataggtaccagggcaaccctctcagggggacatgttactacacactacttatcgactatcagtttactttctcattatcgcaggaggatgatcgatactacactgcaattaacttcgtagccactccagacgagcagaacagagatctagatatgttcatcaacgcatctaaaaatttcaatttgaatatcacgtgggctgccagcttctcggccggaacccaagctggagaggaaatgccggtagtgtcaaaaactaatattaaagaatataaggatagtttctccaatgaaaagttcgacttcagaaaccatccaaatatcacattcttcgtctacgtgagtaattttacttggccaataaaaatccagatagctttcagccagcactctaactttatggatctcgtccagtttttcgttacctttttcagctgcttcttatctttgctacttgtggccgcagtggtgtggaagataaaacagagttgttgggcatctcggagaagagaacagttactgagggagatgcaacagatggcatcccggcctttcgcaagcgtaaatgtggccctggaaacagacgaggagccacctgatctgattggaggatctattaagacggtgccaaaaccaattgctcttgaaccttgttttggcaacaaggctgccgtgctttcagtttttgtgcgcctcccgagaggcctgggcggcatcccgcctccaggccagtccggccttgctgttgccagtgccctggtggatataagtcagcagatgcccatagtttacaaggagaagagtggagctgtgcgaaatcgcaagcagcagccgccggcccagccgggcacgtgcatctag

SEQ ID NO: 3823 - DNA, 3582 bp, Artificial Sequence
  Description of Artificial Sequence: Synthetic coding sequence
atggtggccgccgccgccgccaccgaggcccggctgcggcggcggaccgccgcaacggcggccctcgccggcagatctggcggcccacactgcgtcaacggcgggagatgcaatccaggcacagggcagtgtgtctgtcccgccggttgggtcggggagcagtgccagcactgcggaggtaggttccgcttaaccggcagctcagggttcgtgactgacggccccggcaattataagtacaagacgaagtgtacttggcttatcgaaggccaacccaacaggattatgaggctgcgctttaatcatttcgctactgagtgcagttgggaccatctctacgtatatgatggcgatagtatttacgcgcctctggtggcagcgttctctggcctgatcgtaccagagcgcgacggcaatgaaaccgtacctgaagtggtagcaacatctggctacgcgcttttgcatttcttcagcgacgctgcttacaatctgactggcttcaatatcacctattctttcgatatgtgcccaaataactgtagtgggagaggggagtgtaagatttccaattccagcgacaccgtcgaatgtgaatgttcagaaaactggaaaggggaggcatgcgacatcccacactgtaccgataactgtggcttcccgcaccgcggaatctgtaacagcagcgatgtgcggggttgctcttgcttctccgactggcagggtccaggctgtagcgtgccggtgccggcgaaccagagtttctggacccgagaggagtatagtaatctcaaactccctcgggccagtcataaggctgtggtgaacggcaacattatgtgggtggttggcggatacatgtttaatcacagtgactataatatggtgttagcctacgacctggcgagcagggaatggctgccattaaatcgttcagtgaacaacgtggtcgtacgctatggacacagcctggccctgtataaggacaaaatctacatgtacgggggtaaaattgactctaccggaaacgtaacaaatgagctgcgggtgttccatattcacaacgagtcttgggtattgttgacgcctaaggctaaagagcagtatgcagtcgtcggtcactcagcacacatcgttacgctgaagaatggtcgggttgtgatgcttgttatcttcggccattgtcctctgtatggatatatctctaatgtccaggagtacgacttagacaaaaacacctggtccatcctgcatacccaaggggctctcgtccaaggtggctatggacactccagtgtttacgaccaccgcacaagggcgctctacgttcacggcgggtacaaagcttttagcgcgaacaagtatcgactagcggacgatttataccgatatgacgtcgatacgcaaatgtggaccatcttgaaggattccagatttttccgctatctgcacactgccgtgatcgtgtccggaacaatgctggtgttcggcggtaacactcacaacgacacttcaatgtcccacggggctaaatgttttagttcggactttatggcctacgatattgcctgtgatcggtggtccgtgctgcctagaccagatcttcaccatgatgtgaaccgatttgggcactcagccgtgctccataattcgacgatgtatgtgttcgggggctttaactctctcctgctctctgacatcctggtattcacgtccgagcaatgtgacgcacataggagtgaggccgcctgccttgctgccggacctggcataaggtgcgtttggaacaccggcagttcacagtgcattagttgggcccttgcaacagatgaacaggaggagaagcttaaatccgaatgcttctcaaaacggaccctcgaccatgatcgctgcgatcagcacaccgactgctactcttgcaccgcaaataccaacgattgccattggtgtaatgaccattgcgtgcctcgtaatcattcgtgtagcgaaggacagatctcaatttttaggtatgaaaactgtccaaaggacaatcctatgtactactgtaataagaagacatcgtgtcgatcgtgtgctcttgatcaaaactgccagtgggaacctaggaatcaggaatgtattgccctcccagaaaacatctgtggaatcggatggcatctggtcggcaattcttgtctgaaaatcactactgccaaggagaactacgacaatgccaaactgttctgccgcaaccacaacgctctcctcgcaagtctgactacacagaagaaggtggagttcgtcctcaagcagttgagaataatgcaaagtagtcagtcaatgagcaaactgacactgactccctgggtgggactgaggaagatcaacgtaagctactggtgttgggaagatatgagccccttcaccaattccctcttgcaatggatgccatccgaacctagtgatgcaggcttttgtggcatcttgagcgagccaagcacaagaggcctaaaggctgccacttgcatcaatccactaaatggatcggtctgtgagcggccagctaaccacagcgcaaaacaatgtagaacaccctgtgctctgagaactgcatgcggagactgtacctcagggagttccgagtgcatgtggtgctctaatatgaaacaatgcgtggactcgaacgcttatgtggcaagctttcccttcgggcaatgtatggagtggtataccatgagcacatgcccacccgaaaactgctctggctattgtacttgcagtcattgtctggaacaacctgggtgtggttggtgcactgatccctctaacacaggaaaaggaaaatgtattgaaggatcctacaagggacccgtgaaaatgccaagccaagcgccaacaggaaacttttatccccagcctttgctgaacagctccatgtgcctggaggattcaagatataattggtcctttattcattgcccagcatgccagtgcaacgggcattccaagtgcattaaccaaagcatatgcgaaaaatgcgagaatctcacaacaggcaagcattgtgagacctgtatcagcggcttctatggggacccaacaaatggaggcaagtgccagccgtgcaagtgcaacggccacgccagcctatgtaacaccaacacaggaaaatgcttctgcacaaccaaaggtgtgaagggagacgaatgccaactgtgcgaagttgaaaataggtatcagggaaaccccctccggggtacatgttattataccctgctcattgattaccaatttacattttccctcagccaggaggatgatcgctactacaccgccatcaatttcgttgctacacccgacgagcaaaacagagacctcgatatgttcataaacgcatctaaaaatttcaatctcaacattacatgggccgccagcttttccgctggcactcaggctggggaggagatgcccgtggtctcaaaaacaaacataaaggagtacaaggactcattctccaacgagaagttcgacttccgaaatcatccgaacatcacgttcttcgtctacgtgtctaattttacctggcccataaagatccagtag

SEQ ID NO: 3824 - DNA, 3819 bp, Artificial Sequence
  Description of Artificial Sequence: Synthetic coding sequence
atggtggccgccgccgccgccaccgaggcccggctgcggcggcggactgcagctaccgcggccctcgctggccgtagcggagggcctcattgggattgggacgtcactcgggccggacgtcctggactgggagctggccttcgcctcccacgacttctgagtcctcctttaaggccccgactcttattacttttactgctcttgagccctccactgttgttactacttctgccctgcgaagctgaggccgcagcagccgccgcggctgtgagtggctcagcagctgcagaagccaaggagtgcgacagaccatgtgtgaatggcggccggtgcaatcccggaactggtcaatgcgtgtgccctgctgggtgggtgggcgagcaatgtcagcactgcggaggccgatttcgacttactgggtccagcgggtttgtcacagatggcccaggcaattataaatacaagacaaaatgtacatggctgattgaaggacagccaaatcgcattatgaggttgcgctttaatcatttcgccaccgagtgtagctgggaccacctttacgtgtacgatggagattcaatttacgcacccctggtggcagcattttctggacttattgtgccggagcgtgatggcaatgaaacggtgccggaagtggtagcgacctccggctacgcactgctgcactttttctcagacgctgcttacaatttaacaggattcaatattacctactccttcgacatgtgtccaaataattgctctggccgtggggagtgtaagattagcaattcctccgatacggttgagtgcgagtgtagcgagaattggaagggggaggcctgtgacatccctcattgtacagacaactgtggcttcccacatagagggatttgcaacagctcggatgttcgcgggtgctcctgcttcagtgattggcaaggaccaggctgttcagtgcccgtgccagccaatcaaagcttctggactcgcgaggaatactctaacctgaagctgcctcgcgccagtcataaggctgttgtgaatggaaacatcatgtgggtggttggaggttatatgttcaatcatagcgactataacatggtgcttgcctacgatcttgcctcacgggagtggctgcccctgaaccgaagcgttaataacgtagtagtaaggtatggccactctctggccctctataaggataagatttatatgtacggaggcaaaattgattccactggcaatgtcaccaatgaactcagggtgttccatatacacaatgaaagctgggtgcttctcacccctaaagccaaggagcaatatgccgtggtggggcactccgctcacatcgttacactcaagaacggaagggtggtaatgctggtcatctttggccattgtccactctacggttatattagcaatgtgcaagaatacgatctggataagaatacttggtccatcttgcacactcagggcgcacttgtgcaggggggatacggtcatagttcggtgtacgatcatcggacccgggctctgtatgtgcacggcggatacaaagctttctccgcaaacaagtatcggctggctgacgacctctatcggtatgatgttgacacacaaatgtggaccatattaaaggactcccggttcttccggtacctccataccgctgtcatagttagcggcaccatgctggtgtttggggggaacacacacaatgacacctctatgtcccatggggccaaatgcttcagttccgacttcatggcatacgacatcgcttgtgaccggtggagtgtgttaccacgaccagacctgcaccatgacgtcaaccgtttcggacacagcgccgtccttcacaatagcacaatgtatgtattcgggggatttaacagtttgctgctgtctgacattttggtgtttacttcagaacagtgtgatgctcatcgatcggaggctgcctgcttagctgcggggccagggatcaggtgtgtatggaatactggtagctctcagtgcatctcttgggcattagctaccgatgaacaggaggaaaagctgaagagcgagtgttttagtaagcgcacactagatcatgataggtgcgatcaacacaccgactgctactcgtgcacagcaaataccaacgattgccattggtgcaacgaccattgtgtgcctcggaatcattcttgcagtgaggggcagatctctatcttccgttatgaaaactgccccaaggacaaccctatgtactactgcaataaaaaaaccagctgccggtcctgcgccctggaccagaactgccaatgggaaccgcgcaatcaggagtgtattgcgctgcccgagaatatttgtggtataggctggcatttagtggggaacagctgcctgaagatcaccaccgctaaggagaactatgacaacgccaaactgttctgcaggaaccataacgctctgctggcatccctgaccacccaaaagaaggtggagttcgtattgaagcagctccgtatcatgcagagcagccagagcatgtcaaagttaaccttgactccatgggtcggactgcggaagataaacgtgagctactggtgctgggaggacatgtcacccttcacgaactctctacttcagtggatgccctccgagccaagcgacgccggcttttgcgggatcctgagcgaaccaagtaccagagggttgaaggctgctacctgcatcaacccgctgaacggcagtgtgtgtgagcggcctgccaatcattcagctaaacagtgccgcaccccctgtgcgttgagaaccgcctgtggggactgcacctctgggtcgtccgagtgtatgtggtgtagtaacatgaaacaatgcgtagacagcaacgcctatgttgcctcttttccattcggccagtgcatggagtggtataccatgtcaacctgtcctccagagaactgcagcggctactgtacatgttcgcactgtctcgaacagccgggatgcgggtggtgtactgacccctccaacaccggcaaagggaagtgcattgaggggtcctacaaaggccctgtaaagatgcctagccaggccccaacagggaacttttatccacagccactgctgaattcgtctatgtgcctggaagattcacggtataactggtcatttatccactgccctgcctgtcaatgtaatggacacagcaagtgcatcaatcagtctatatgtgaaaagtgcgagaacctgaccactggcaaacactgcgagacatgtataagcggtttttacggagatcctactaacggcgggaagtgccagccatgtaaatgcaatggacacgcaagcctgtgtaataccaacactgggaagtgcttctgcactacaaagggcgtaaagggggacgaatgtcagttgtgtgaggtagaaaaccgatatcaaggcaacccgttgaggggcacttgctattacacccttctaatcgactatcagttcaccttctctctcagtcaggaagacgatcgctattacacagcaattaacttcgtcgccacgccagatgagcagaatagggacctcgatatgttcattaacgccagcaagaacttcaacctcaatatcacttgggccgcctctttttccgctggaacacaggctggagaggagatgcctgtggtgtctaagactaacattaaggagtataaagattccttttctaatgagaagttcgactttcgtaatcaccccaatatcactttttttgtgtacgtgtcaaattttacctggcctattaaaatccaagttcagaccgagcagtag

SEQ ID NO: 3825 - DNA, 768 bp, Artificial Sequence
  Description of Artificial Sequence: Synthetic coding sequence
atgttccaccaggtgcggcgggtgatgaccatcctgttcctgaccatggttatttcatacttcgggtgcatgaaagcagctcctatgaaagaggctaatattcggggccaggggggcttggcgtatccaggtgtgagaacacacggaaccctggaaagcgtgaacggccctaaggccggttcacgcgggcttacctcactagcagatactttcgaacatgttatcgaggagctcctagacgaggaccagaaagtcaggcccaacgaagaaaataacaaagatgccgacctttataccagtcgcgtgatgctgtcctcacaggtgcctttagagcctcctctcctttttttactggaggaatataagaactaccttgacgctgccaatatgtctatgcgagtcagaagacactcggaccctgcccgccgtggggagctgtctgtgtgcgactctatttctgaatgggtgacagccgcggacaaaaaaaccgcagtggacatgtccggcggcaccgtcaccgtcctggagaaggtcccagtctccaaaggacagctcaaacagtatttctatgagacaaagtgtaatccgatgggatacacaaaagaaggatgtagagggattgacaagaggcactggaattcccagtgccgcactacccaaagttatgtgcgagccctcaccatggacagcaaaaagaggattggctggagatttattcggatagatacaagctgcgtttgtacccttactatcaagcgggggaggtag

SEQ ID NO: 3826 - DNA, 744 bp, Artificial Sequence
  Description of Artificial Sequence: Synthetic coding sequence
atgaccatcctgttcctgaccatggtgatcagctacttcggctgcatgaaagctgctcccatgaaagaggccaatatccggggacagggtggtctggcctaccctggagtcaggacgcatggtacactggagtcagtgaatgggccaaaggctggcagccgggggctcaccagcctggccgataccttcgaacatgtaattgaagagttgctggatgaagaccagaaggtacggcctaacgaggagaacaataaggatgctgatctttacacatccagagttatgttaagctctcaggtccctctggagccgccgctgttgtttctgctcgaggagtataaaaactacctcgatgccgctaatatgagcatgagggtgcgacgtcacagcgatccagccaggcgcggggaactgagcgtctgtgacagtatatctgaatgggttacagccgccgataagaaaaccgctgtggatatgagcggtgggaccgtgaccgttcttgaaaaagttccagtaagtaaggggcaactgaaacagtatttttatgaaaccaaatgcaatccaatgggctatacgaaggagggctgccggggcatcgacaaaaggcactggaattctcaatgcaggactacacagagctatgtgcgcgcactgaccatggatagcaagaaacgtatcggatggagattcatacgtatagacactagctgtgtatgcaccttaaccatcaagcgaggcaggtag

SEQ ID NO: 3827 - DNA, 744 bp, Artificial Sequence
  Description of Artificial Sequence: Synthetic coding sequence
atgaccatcctgttcctgaccatggtgatcagctacttcggctgcatgaaagcagcacccatgaaagaggcaaatatccgtggacagggcggacttgcatacccgggtgtacggacacatgggaccttggagagcgtaaacggaccaaaagctggttcgagaggattaacctctctggccgataccttcgagcatgtgatcgaagagcttctggatgaggaccagaaagtgaggcccaatgaggaaaacaacaaagacgccgacctgtatacgagtcgcgtcatgctctcgtctcaggtgccattggagcctcctctcctctttctattggaggagtataaaaattatctggacgctgctaatatgtctatgcgtgtccgacgtcacagtgacccggcgcgtcgcggggaattgtctgtttgtgatagcatttccgaatgggttactgctgccgataagaagacagctgtcgacatgtcaggcgggaccgtgactgttttagaaaaggtgccagtgtccaagggacagctcaaacagtacttctatgagacaaagtgtaaccctatgggctacactaaggaaggatgtaggggcatagataagcggcactggaatagtcagtgtcgtactactcagagttatgtgcgcgccctcacaatggacagcaagaagcggatcggttggaggtttatacgcattgacaccagttgtgtgtgcactctgactattaaaaggggtcggtag

SEQ ID NO: 3828 - DNA, 744 bp, Artificial Sequence
  Description of Artificial Sequence: Synthetic coding sequence
atgaccatcctgttcctgaccatggtgatcagctacttcggctgcatgaaggccgcccctatgaaagaggcaaatatccgaggacaaggcgggctagcctaccccggagtgagaacccatggaacgcttgagtccgtgaatggccccaaggccgggagcagaggccttaccagtttagccgacacctttgaacacgtgattgaggaactcctggacgaagatcagaaagtgaggcccaatgaagagaacaacaaggacgcagacctgtatacctccagggtaatgctctctagccaggtacctctggagcccccgctcttgttcttgcttgaggagtacaaaaactacttggacgcagccaacatgtcgatgcgggttcgcagacactctgatcctgctcggagaggcgagctgtcagtgtgtgactccatatccgagtgggtcacggcagccgataagaaaaccgccgtggacatgagcggggggacagtaaccgtgctggagaaagttccagtgagcaaaggccaacttaaacaatatttctatgagaccaagtgtaaccctatgggctatacaaaagagggctgtcgcggaatcgacaaacgccattggaactcacagtgtcgtacaacccagtcctacgtgcgcgctctaactatggattcaaagaagcgcatcggctggcgatttattcgaatcgatacatcctgcgtgtgtacactgacaattaagagaggtcgatag

SEQ ID NO: 3829 - DNA, 744 bp, Artificial Sequence
  Description of Artificial Sequence: Synthetic coding sequence
atgaccatcctgttcctgaccatggtgatcagctacttcggctgcatgaaggccgccccaatgaaggaagctaatattcgaggtcagggaggccttgcatacccaggggtgcgtactcatggtacactggaatctgtgaatggtccaaaggctggcagccgtgggctgacaagcttagctgacacattcgagcatgttatagaagagctgttggatgaggatcagaaggtcaggcccaatgaagagaataataaagacgccgacctgtacacgtctcgcgtcatgctcagttcccaggtgccattggagcctcctttgctttttctcctcgaggaatacaaaaactacctggatgccgctaatatgagcatgagggtacgccggcactccgatcccgcaaggcggggcgagctgagtgtgtgtgactccatttctgaatgggtcacggctgcagacaagaagaccgctgtggacatgtccggcggcaccgtgaccgtgttagaaaaggtgcctgttagcaagggccagctgaagcagtacttttacgaaacaaagtgcaatccaatggggtatacaaaagaaggctgtcgcgggatagacaaacgccattggaatagccaatgtagaacaactcagtcatacgttcgcgcccttactatggattctaagaaacgaatcggctggcgcttcatacggatcgacacctcatgcgtgtgtacacttactattaaaagaggacggtag

SEQ ID NO: 3830 - DNA, 744 bp, Artificial Sequence
  Description of Artificial Sequence: Synthetic coding sequence
atgaccatcctgttcctgaccatggtgatcagctacttcggctgcatgaaggcggcacccatgaaggaagcaaacattcgtggccagggaggccttgcctacccaggggtcaggacccacggtacactcgaatcagtgaatgggccgaaagcaggttcccgtggccttacatcactagcagataccttcgaacatgttatcgaggagttattggacgaggatcaaaaagttcggcccaatgaggagaataacaaagacgcagatctgtacaccagtagggttatgctctcaagtcaggtccctctagagcccccactgctgttcctgctggaggaatataaaaattacctcgacgccgctaatatgtctatgcgcgtgcgccggcattctgatccagctagacggggcgagctgtccgtctgtgacagcatatctgagtgggtgaccgccgcagataaaaaaactgcagtagacatgtcagggggtactgtaacggtcctggaaaaagttccagtgtcgaaaggacagctgaagcagtatttctacgaaaccaagtgcaaccccatgggttacactaaggaggggtgtagaggaatcgacaagaggcactggaatagccagtgcagaacaacccagagttacgttagagcattaaccatggactctaaaaagagaattgggtggcgtttcatccgcatagacacatcgtgcgtctgcacacttactatcaagcgcggtcggtag

SEQ ID NO: 3831 - DNA, 789 bp, Artificial Sequence
  Description of Artificial Sequence: Synthetic coding sequence
atgcagagccgggaggaggagtggttccaccaggtgcggcgggtgatgaccattctttttcttacaatggtgattagctactttgggtgcatgaaggctgcgcccatgaaggaggcaaacatccgaggccaaggaggactggcatacccaggggtgagaacccatggcaccctggagtcagttaatggacccaaagcgggttcacggggattgacttctttagctgacacttttgaacacgtaatagaggaacttctcgacgaagatcagaaggtgcggcctaatgaggaaaataacaaggacgcggatttgtatacctcgagggtcatgttaagctctcaggtcccgctggaaccgcctttacttttcctgctggaagaatataagaactatttagacgctgctaatatgtccatgcgcgtccggcgccatagtgacccagccagaaggggcgagctatctgtctgcgatagcatatccgagtgggtcaccgctgcggataaaaagacagccgtggatatgtcgggcggcaccgtgactgtgctggaaaaggttcccgtctctaaagggcagcttaagcaatatttttatgagaccaaatgtaaccccatgggctacactaaggagggatgcagaggcattgacaaacggcactggaattcccagtgcaggaccacccagagctacgtgcgcgcacttaccatggatagtaagaagagaatcggatggcggtttatcagaattgatacctcttgtgtttgcacacttacgatcaagaggggccggtag

SEQ ID NO: 3832 - DNA, 744 bp, Artificial Sequence
  Description of Artificial Sequence: Synthetic coding sequence
atgaccatcctgttcctgaccatggtgatcagctacttcggctgcatgaaggcggctccaatgaaagaagccaatattaggggacaggggggtctcgcctatcctggggttcgcactcatggtactcttgagtccgtgaatggacctaaggccgggagcagggggcttaccagcctcgctgatacattcgagcacgtgatcgaggaattgctcgatgaggaccagaaggtgcggcctaatgaggaaaataacaaagatgcagacctatatacctccagagtaatgctgtcctctcaagtgcctctcgagccgcctctcctcttcctgctggaagaatacaagaattatctcgatgctgctaacatgagcatgcgagtgaggagacactccgacccagctcgccggggagagctatcagtttgcgattccatctccgagtgggtcactgccgcagacaagaagaccgcagtggacatgagcggcgggaccgtaaccgtgttagaaaaagtgcccgtgagtaaaggccaactcaaacagtacttttacgaaaccaaatgtaaccccatgggatataccaaagaaggatgccgaggcattgacaagcgtcactggaatagccaatgtcgaacgacacagtcgtatgtgcgcgcactgacgatggatagcaagaagcggatcgggtggaggtttattcgcatcgatacttcttgcgtttgcactctgacaattaaacgggggcggtag

SEQ ID NO: 3833 - DNA, 744 bp, Artificial Sequence
  Description of Artificial Sequence: Synthetic coding sequence
atgaccatcctgttcctgaccatggtgatcagctacttcggctgcatgaaggccgcccctatgaaggaagccaacatcagaggacagggcggtctcgcttacccaggcgttagaacacatggaaccctggaaagcgtgaatggccctaaagccggcagccgggggcttacctccttggcagacacctttgagcacgtcatcgaggagctgcttgacgaagaccagaaggtgaggccaaatgaagagaacaataaggatgccgacctgtacacttcacgtgtaatgctctcttcgcaggtccctctggagccccctctcctcttcctactcgaagaatataagaactatttggatgctgcgaacatgagtatgcgagtgcgtaggcacagcgatccagctaggaggggtgagcttagcgtctgtgactctatctcagagtgggtgacagcggctgacaagaagaccgcagtggacatgagcggggggaccgttaccgtgctcgagaaagtgccagtgagtaaagggcagctgaaacaatacttctacgagaccaagtgtaatcctatgggctatacaaaagaagggtgcaggggcattgacaagcggcattggaacagtcaatgtagaacgactcagagctacgtccgggctctgaccatggacagcaaaaaacggatcggatggcggttcatcagaatcgacacttcctgtgtgtgcaccttgacaataaaacgaggtagatag

SEQ ID NO: 3834 - DNA, 990 bp, Artificial Sequence
  Description of Artificial Sequence: Synthetic coding sequence
atgtgcggcgccaccagcttcctgcacgagtgcacccggctgatccttgttaccacccagaacgcagagtttctacagaaggggctgcaggtgcatacgtgttttggagtttatcctcatgcttccgtgtggcacgattgcgcctctcaaaaaaaggggtgcgcagtttatctccacgtgagcgtggagttcaataagctgatacccgagaatggattcatcaaatttcatcaagtccggcgagtgatgaccatactgttcctgacaatggttataagctatttcggatgcatgaaggcagctccaatgaaagaagcgaacatcagagggcagggcgggctggcttatccaggagtgcggactcacggcaccctggaatcagtaaacggtccgaaagctgggagccggggcctgacatctctcgcagacacttttgagcacgtgatcgaggagctcctggacgaagaccagaaggtcagaccgaatgaggagaacaacaaggatgccgacctgtacacaagccgagtgatgttaagctctcaggtcccattggaaccccctctcctgttcctgttagaagaatataagaactatttggacgctgccaatatgagtatgcgcgtacgacggcattcggaccctgcaaggcgaggcgagttaagtgtctgcgatagtatcagcgaatgggttaccgcagcagataaaaagacagctgtggatatgtccggcggtacggtgacagtgctggagaaagtgcccgtgtccaaaggccagctgaaacaatatttctacgagaccaaatgtaatccaatgggctacactaaagaaggttgcagaggcatcgataagaggcattggaatagtcagtgcagaactactcagagctatgtgagagctcttacgatggactctaagaaacggataggctggagattcatccgaattgatacgagctgcgtatgtaccctgactataaaaagaggaaggtag

SEQ ID NO: 3835 - DNA, 744 bp, Artificial Sequence
  Description of Artificial Sequence: Synthetic coding sequence
atgaccatcctgttcctgaccatggtgatcagctacttcggctgcatgaaagccgctcctatgaaagaggccaacatccgagggcagggaggattggcatatccgggagtcagaactcatggcacccttgaatccgtcaacggaccaaaggcaggtagcaggggcctgacctctctagcagatacgtttgaacatgtaatagaggagctattggacgaagatcaaaaggtcagaccaaatgaggaaaacaataaggacgcggatctgtacacgtcgcgggtaatgctttcatcccaagtgcctctggaacctcctctcctcttcctgctggaggaatacaagaactacctggatgcagcaaatatgtcaatgcgagtgcggagacactccgatccagctagacggggagaactctccgtctgcgacagtatctctgagtgggtgaccgccgctgataaaaaaactgcagttgatatgtctggcggcaccgtaaccgtactggaaaaggtccccgtgtctaaggggcaactcaagcaatatttttacgagacaaagtgtaaccctatgggctataccaaggaagggtgcagaggcattgacaaacggcactggaacagccagtgccgcacaactcagtcatacgtgagggccctgacaatggattctaagaagaggatcggctggcggttcatacggatcgacacgtcttgtgtgtgcaccctgaccatcaagcggggcaggtag

SEQ ID NO: 3836 - DNA, 744 bp, Artificial Sequence
  Description of Artificial Sequence: Synthetic coding sequence
atgaccatcctgttcctgaccatggtgatcagctacttcggctgcatgaaggcagccccgatgaaagaggccaatattagaggacaggggggcctcgcttaccccggcgtccgaactcatggcaccttggaatctgttaatggcccaaaggctgggtctcggggtcttacatcgctggcagacacatttgaacacgtgattgaagaactccttgatgaggatcagaaggtgagacccaatgaggagaataacaaagacgcagacctatatacatcccgagtgatgttatccagtcaagtcccgctggaacccccgctgttgtttttactcgaagagtataagaactatcttgatgctgcaaatatgtcgatgcgggtgcgtcgccattccgatccagcccgcaggggcgagctgagcgtctgtgactctatttcagagtgggtcaccgccgcagataagaaaactgcggttgacatgagtgggggaactgtcacggtgcttgaaaaggtccctgtttcgaaaggacagctcaaacaatacttctatgaaactaagtgtaatccgatgggctacaccaaagagggttgcaggggcatcgataagcgccattggaattctcagtgtaggacaactcagtcttacgttagggccctgactatggattccaagaaacgcatcggctggaggttcattagaatcgacacaagctgcgtatgtaccttgacaattaaaaggggacgatag

SEQ ID NO: 3837 - DNA, 744 bp, Artificial Sequence
  Description of Artificial Sequence: Synthetic coding sequence
atgaccatcctgttcctgaccatggtgatcagctacttcggctgcatgaaggcggctcccatgaaggaggcgaacatccgcggccaaggcggtttggcctacccgggtgtgcggacacatggaactctcgaatctgtgaatggccccaaagcaggctcccggggactgactagcctcgcagatacgttcgaacacgtgattgaggaattactcgacgaagaccagaaggtgagaccaaacgaggaaaacaacaaggacgccgatctgtacacttcccgcgtgatgcttagctcgcaggtgcctttagagcccccactgctcttcctattggaggagtataagaactatctggatgctgcaaacatgtccatgcgagtgagacgacattccgatcccgcgagacgaggggagttatctgtgtgtgactccatctctgagtgggttaccgctgctgataagaaaaccgccgtggatatgtccggcgggacagttacagtgcttgaaaaagttcctgtatcaaagggacagctgaaacagtacttctatgagaccaagtgtaacccaatgggctataccaaagaggggtgccgaggtatcgataaacgtcactggaactcacagtgccgcactacccagagttacgtgcgtgcattgacaatggattctaaaaaacggatcgggtggcggtttattcgcatagatacaagctgtgtttgcacgctgaccataaaacgagggagatag

SEQ ID NO: 3838 - DNA, 744 bp, Artificial Sequence
  Description of Artificial Sequence: Synthetic coding sequence
atgaccatcctgttcctgaccatggtgatcagctacttcggctgcatgaaggctgcacctatgaaagaagccaacatccggggccaaggcggactcgcctacccaggagtgagaacccatggcactctggaatctgtcaacggcccaaaagctggctcgcgaggtctgactagtctggccgacactttcgaacatgtgatagaagagctactcgacgaggaccaaaaagtgcgcccgaatgaggagaataacaaggacgctgacttatacactagtcgcgtgatgctgagctcccaggtacctcttgaaccccctctcctcttcctcttggaggaatacaaaaattaccttgatgcggccaatatgtcgatgcgggtaaggagacacagtgatcccgctcgccgaggagaactatctgtttgtgactccattagcgagtgggtaacggcggccgataagaaaacggctgtagacatgtccggcggaacagtcacggtgttagaaaaggtacccgtcagtaagggccagctgaagcagtatttttatgagacaaaatgtaacccaatgggttacaccaaggagggctgtagggggattgataaacggcactggaatagccaatgccggactactcagtcctacgtaagggccctaacaatggactccaagaagagaatcgggtggcgatttattcgaattgatacgtcgtgtgtgtgcacactgactataaagcgcggcaggtag

SEQ ID NO: 3839 - DNA, 744 bp, Artificial Sequence
  Description of Artificial Sequence: Synthetic coding sequence
atgaccatcctgttcctgaccatggtgatcagctacttcggctgcatgaaggctgcccctatgaaagaagcgaacataaggggccagggcggcctcgcatatccaggagtgagaacccacggcaccctggagtctgtcaacggcccaaaagcgggcagtaggggtctgacctccctggccgatacattcgaacacgtgatagaggagctgcttgatgaagaccagaaggtgaggccaaatgaggagaacaataaagacgccgacctgtataccagtagggttatgctctccagccaggtgccgctagagcccccactgctttttctactggaggagtataaaaactatctggacgctgccaacatgtcgatgagggtgaggcgacacagcgaccctgcccggaggggggagctctccgtgtgcgatagcatatccgagtgggtcacagccgccgataagaagactgcggtggacatgagcggaggaactgttacagtgctcgagaaagttcctgtctctaaaggccaactgaaacagtatttctacgaaacgaagtgtaaccccatgggctacaccaaggaggggtgcagaggaatcgataagaggcattggaattcccaatgccggaccacccaatcatatgtcagagcccttacaatggactctaaaaaacggattggatggcgcttcatccggattgatacaagctgtgtgtgtacactgactatcaagaggggcaggtag

SEQ ID NO: 3840 - DNA, 744 bp, Artificial Sequence
  Description of Artificial Sequence: Synthetic coding sequence
atgaccatcctgttcctgaccatggtgatcagctacttcggctgcatgaaagcggcgcccatgaaagaggccaatattagaggccagggtggtctggcgtatccgggcgtgcgtactcatggtacactggagtctgtgaatggcccgaaggccggctctaggggtctgacatcactggctgataccttcgaacatgttatcgaggagctcttggacgaggatcagaaagttcggcccaatgaagaaaataacaaagacgccgatctgtacacttctcgagtgatgctgtcgagccaggtaccactggaaccccccctgctgttcttgctagaggaatacaaaaactacctggacgcagctaacatgtcaatgcgggttagacgtcactccgacccagcccggcgtggagagttgtctgtttgtgatagcatttcagagtgggttaccgccgcagataagaagactgccgtcgacatgtcaggagggaccgtgacagtgcttgagaaggtgccggttagcaagggccaactaaagcaatacttctatgaaacgaagtgcaacccaatgggctacacaaaagaggggtgtcggggaatagataaaaggcattggaacagccaatgcaggactacacaatcttacgtgcgagcactaaccatggatagcaagaagagaatcgggtggaggttcatccgcatcgatacttcatgcgtgtgtacactcacaatcaagcgcgggcgctag

SEQ ID NO: 3841 - DNA, 744 bp, Artificial Sequence
  Description of Artificial Sequence: Synthetic coding sequence
atgaccatcctgttcctgaccatggtgatcagctacttcggctgcatgaaagccgctcccatgaaagaagctaacatacgcggacagggagggctggcatacccaggtgtccgaacccacggaacacttgaatcagttaatggccccaaggcggggtcccgcggtcttacgagtctggctgataccttcgagcatgtgatcgaggagttgttggacgaggaccaaaaagtgagacccaatgaagagaacaataaagacgctgacctgtacacctctcgagtgatgctatctagccaggtgcccctggagccgccgctcttattcttacttgaagaatataaaaactatctcgatgccgcaaatatgtcaatgcgggtgaggcggcactctgacccagcccggaggggcgaactgtccgtttgcgattcgatctctgagtgggtgaccgcagcagacaaaaaaacagccgtcgacatgtccggcgggaccgtgaccgtcctagagaaagtgcccgtttcaaaggggcagttaaagcagtacttctacgagacaaaatgcaacccaatggggtatacaaaagaaggatgcagggggatcgacaagcgccactggaatagccagtgccggacaacgcaatcttacgtccgtgcactcacaatggattctaaaaagcgtatcggctggcggttcatacggattgatacctcatgcgtttgcacactaaccatcaagagggggagatag

SEQ ID NO: 3842 - DNA, 234 bp, Artificial Sequence
  Description of Artificial Sequence: Synthetic coding sequence
atgtgcggcgccaccagcttcctgcacgagtgcacccggctgatccttgtcacgactcaaaacgcggaatttctgcagaaaggcctccaggtccacacatgtttcggagtataccctcacgcgagcgtttggcatgattgcgcatcacagaagaaagggtgcgcagtttacctgcacgttagcgttgagttcaacaaactgattcctgagaatggattcattaaaggttggtag

SEQ ID NO: 3843 - DNA, 894 bp, Artificial Sequence
  Description of Artificial Sequence: Synthetic coding sequence
atgagcagcgcccacttcaaccggggccccgcctacggcctgagcgcagaagtcaagaacaagctggcccagaagtacgaccaccagcgagaacaggaactgagagaatggatcgagggagttacaggccggcgcatcggtaacaattttatggatggactgaaggacggtattatactgtgcgagttcattaataaactccagcccggctctgttaaaaagataaacgaaagcacacagaattggcatcagctggagaatatcggcaattttataaaggcaattaccaaatatggtgtgaagccgcacgacatctttgaagcgaacgacctgttcgagaacaccaaccatacgcaggttcaatcaaccttgttggcactggcaagtatggccaaaaccaagggtaataaagttaacgtgggtgtcaaatatgccgaaaagcaagaaagaaagtttgagcctggtaaactccgagaaggcagaaacatcatcggtctacagatgggaacgaataaattcgcctctcagcaggggatgacggcatacggaacgcgccgtcacctctacgacccaaagctgggaaccgaccagcccctcgatcaggcaacaatatcactacaaatgggaaccaataagggtgcgagtcaggctggcatgaccgcgcccggaaccaagcggcaaatattcgaacctggtctgggcatggagcattgcgatacccttaacgtctccctgcaaatgggatccaataaaggcgcttcccagaggggcatgacagtctatgggcttccccgccaagtctacgaccccaagtactgcctaacaccggagtaccccgaactcggagagccagcccataatcaccatgcacataactattacaactcagcctag

SEQ ID NO: 3844 - DNA, 744 bp, Artificial Sequence
  Description of Artificial Sequence: Synthetic coding sequence
atggacggcctgaaggacggcatcatcctgtgcgagttcatcaacaaattgcagcccggttccgtgaagaagatcaatgaaagcactcagaattggcatcagctggagaatatcggtaacttcatcaaggccataaccaagtatggagtgaagccacatgacatctttgaagcgaacgacctatttgagaacaccaatcatacacaagttcaaagcacacttctcgctctggcatccatggccaagacgaaaggcaacaaggtgaacgtgggagttaaatatgccgagaagcaggagcggaagtttgagccgggcaagctgcgcgagggtcgcaatattatcgggctacagatggggaccaataagtttgcaagtcagcagggaatgacggcttacggtacacgacgacacctttacgacccaaagcttggaacagaccagcccctggatcaggccactattagcctccaaatgggtacaaacaagggcgcgtcccaagcgggcatgaccgctccaggtaccaaacggcagatcttcgagcctggtttgggcatggaacactgcgatacactgaacgtgagcttgcagatgggcagcaataagggcgcgagtcagagagggatgacagtgtacggcctaccgcgccaagtgtacgacccaaaatattgtctaacccccgagtatcctgaattaggtgaacccgcacacaaccaccatgcccataactattataactccgcttag

SEQ ID NO: 3845 - DNA, 834 bp, Artificial Sequence
  Description of Artificial Sequence: Synthetic coding sequence
atgctggcccagaagtacgaccaccagcgggagcaggagctgcgggagtggatcgagggagtcaccggtagaaggatcggtaataactttatggatggccttaaagacggcattatcttatgcgaattcataaataagttgcagcctggctctgttaagaagataaatgaaagcacacagaactggcaccagctggagaacatcggcaacttcattaaagcgatcacaaaatacggagtcaaaccccatgatatttttgaggcaaacgacctgtttgagaatactaaccacacacaggttcagagcacattattggccctggcttccatggctaaaaccaaagggaataaagtcaatgttggcgttaaatacgccgagaagcaggaacggaaattcgagccgggcaagttacgggagggccgcaatattatcgggctgcaaatgggaaccaacaaatttgccagtcagcaaggaatgaccgcttacggtacccgaagacatctctacgatccgaaactgggaacagatcagccattggaccaggccacaattagcctacagatggggactaataagggcgcgtcacaagcaggaatgacagctccagggaccaaacggcaaatcttcgagccagggctgggtatggagcactgtgacacactgaatgtaagcctccagatgggctctaacaaaggagcaagccagagaggtatgaccgtatacgggttgccaagacaggtttatgatccgaagtattgtttgacacctgaatacccagaactcggggagccagcccataaccaccatgcgcacaattattacaattctgcatag

SEQ ID NO: 3846 - DNA, 930 bp, Artificial Sequence
  Description of Artificial Sequence: Synthetic coding sequence
atgagcagcacccagttcaacaagggccccagctacggcctgagcgcagaagtaaaaaatcgactgctgtctaaatacgatccacagaaggaggccgagctgcgcacttggattgagggacttaccggcctgagcattggtcccgattttcaaaaaggcttgaaagatggaacaatcctttgtactctcatgaataagctgcagccagggagcgtgcccaagatcaatcggtctatgcagaattggcaccaactcgaaaatctctccaactttatcaaggccatggtgtcatacggcatgaaccctgtcgacttattcgaggctaacgatttgtttgagtcagggaatatgacgcaggtgcaggtgagcttactggccctggctggtaaggctaagactaaagggttgcagtctggcgtggatattggcgtaaagtattccgaaaaacaggaacgaaactttgacgacgccactatgaaagcaggccaatgcgttatcggtcttcaaatggggaccaacaagtgcgcctcccagagcggaatgactgcctatggcacacggaggcacttgtatgatcctaaaaatcacatcctgcctcccatggaccactcaacaatctccctgcagatggggactaacaagtgtgccagccaggtgggcatgacggccccaggcacccgccggcacatctacgacactaagctagggacggataagtgtgacaacagctctatgtctttgcaaatgggatacactcagggcgctaaccagagcggacaagtgttcggactggggagacaaatctatgacccaaagtattgtcctcagggtacagtggccgatggcgccccatcaggaaccggtgattgcccagaccccggcgaggttcctgagtacccgccttactaccaggaggaggcgggctattag

SEQ ID NO: 3847 - DNA, 813 bp, Artificial Sequence
  Description of Artificial Sequence: Synthetic coding sequence
atgagcagcacccagttcaacaagggccccagctacggcctgagcgcggaggtgaaaaaccgcttgcttagtaagtatgatcctcagaaggaggccgaactacggacatggattgagggcttgacaggcctgtcgatcggacccgactttcagaaaggcctgaaggatggaactatattgtgtaccctcatgaacaaactgcagcctggctcagttcccaaaatcaacagaagcatgcagaattggcaccaactggagaacctgtccaactttatcaaggcaatggtctcctatggaatgaacccagtggatctgttcgaggctaatgatctgttcgaatccggaaatatgactcaggtccaggtgtccctgcttgcattggctggtaaaatgggcacgaataaatgtgcttcacagtcgggtatgacagcctacggcacacgcagacacctttatgatccgaaaaaccatatccttccaccaatggatcattctaccatttctctgcaaatgggtactaacaaatgcgcaagtcaggtgggtatgactgcacctggtacaagaaggcacatttacgacaccaagctgggcaccgacaagtgcgataattctagcatgtctctccaaatgggatacacacaaggtgcgaaccaatcgggacaagtgtttggtcttgggcgtcagatttacgacccgaagtactgccctcaaggaacagtggccgacggggcaccatcaggcaccggagactgtcctgacccaggggaagttcccgaatatccaccctactaccaggaagaggccggctattag

SEQ ID NO: 3848 - DNA, 867 bp, Artificial Sequence
  Description of Artificial Sequence: Synthetic coding sequence
atgagcagcacccagttcaacaagggccccagctacggcctgagcgcggaggtgaaaaatcggctcttatcaaaatatgaccctcaaaagaaggggctaaaggacggcactatcctttgcaccctgatgaataagctgcagcccggcagcgtcccaaaaataaacaggtcaatgcaaaattggcaccagctagagaacctgtccaactttatcaaagctatggtgtcctacggcatgaatcctgtggacctgttcgaagccaacgatttgttcgagtctggcaatatgactcaggtccaggtgtcattgcttgccctggctggaaaggcgaagacaaagggcctccagtccggtgtggacattggcgtgaaatattccgagaagcaggaacgcaatttcgacgacgcaacaatgaaggctgggcagtgtgtgatcggtttgcagatgggaaccaataaatgtgccagccagagtggaatgaccgcatacggcacacgccgacacctgtatgacccgaagaatcacattctaccgccaatggaccacagcacaatctcgctgcagatgggtactaataagtgcgcatctcaagtgggcatgacggctcctggcacccggcgacatatctatgacactaaacttgggactgacaagtgtgacaacagcagcatgagtcttcagatggggtatacacagggggctaaccagagtggtcaggtgtttgggctggggcggcagatctatgatcccaaatattgccctcagggcaccgttgcagatggagctcccagtgggacaggagattgtccggaccccggggaagtgccggaatatcccccttactaccaggaagaagccgggtactag

SEQ ID NO: 3849 - DNA, 990 bp, Artificial Sequence
  Description of Artificial Sequence: Synthetic coding sequence
atgacccacttcaacaagggccccagctacggcctgagcgccgaggtgaagaataaaatcgctagcaaatacgatcatcaggcagaagaagatctgcgcaactggattgaagaggtcacggggatgagcatcggccccaactttcagctgggtttaaaggacggtatcatcctgtgtgaattaatcaacaagttacaaccagggtctgtgaaaaaagtgaatgaatctagtctgaactggccccaattggagaacataggaaatttcatcaaagccatacaagcttacggtatgaaacctcacgacatttttgaggcaaacgacctcttcgaaaatggcaacatgacccaggtccaaacaactctcgtcgcactggccgggctggctaaaactaagggcttccacactacgatcgatataggagtcaagtatgctgagaagcaaacaagacggtttgatgaaggaaagctgaaggcaggacaatctgtgatcggcctccagatgggaactaataagtgcgccagccaagccggcatgacagcctatgggacccgcagacatctgtatgatcctaaaatgcagacagataagccatttgaccaaactacaatctcattacagatgggcaccaataaaggtgccagtcaggctggaatgctagctccgggcaccagacgggatatttacgatcagaagctgacactgcagcccgtggataattctaccatctccctgcaaatgggtaccaacaaggttgctagtcaaaagggcatgagcgtgtacggactcggccgccaggtgtatgacccaaaatactgcgcggcgcccacggagcctgtgattcacaacggcagtcagggcactggcacgaacggaagtgagatctcagactcagactaccaggcggaataccccgatgaataccacggtgaatatcaggacgactacccccgagactaccagtattcggatcagggcatagactactag

SEQ ID NO: 3850 - DNA, 852 bp, Artificial Sequence
  Description of Artificial Sequence: Synthetic coding sequence
atgacccacttcaacaagggccccagctacggcctgagcgccgaggtgaagaataagatagcttcgaaatacgatcaccaggccgaggaggacttaaggaactggatcgaagaagtgacgggcatgtccattgggcccaacttccagctcggcctgaaagacggcattatcctatgtgagctgatcaataagcttcagcctggctccgtgaaaaaagtcaatgagagctccctgaactggccccaagccaaaactaaagggttccataccaccattgatatcggagtcaagtacgctgagaagcagacaagacggtttgatgagggcaagcttaaagctggccagagcgtgatcggcctgcagatggggacaaataagtgtgcctcacaagcaggaatgaccgcgtatggaactcgtagacatctgtatgaccccaaaatgcagaccgataagccatttgaccagacaactatatcacttcaaatggggactaacaaaggggcgtcccaagcagggatgctggctcccgggactagaagggacatatacgaccaaaagctcacactccagcctgtggataacagcaccatcagcctgcaaatgggaactaacaaagtcgccagtcagaaaggcatgagcgtctacgggcttggacgtcaagtctacgacccaaagtattgtgcagcccctaccgagcccgtgattcataacggctcccagggaactggcacaaacggatcagagatctccgattctgattaccaagctgagtacccagatgagtatcacggtgaataccaggatgactatccacgtgactaccagtattcagatcaaggtatcgactactag

SEQ ID NO: 3851 - DNA, 558 bp, Artificial Sequence
  Description of Artificial Sequence: Synthetic coding sequence
atgagcatcggccccaacttccagctgggcctgaaggacggcatcatcctgtgcgaactgatcaataaattacagcccggctcagttaaaaaagtgaacgaaagcagcttaaactggccccagctggagaacatcggtaattttataaaagccattcaggcctacggtatgaaaccacacgacatcttcgaagccaacgatctttttgaaaacgggaacatgacacaagtccagacaacgttagtcgccttagcaggcttggccaagactaagggattccacactactattgatatcggcgtgaaatacgcagagaaacagacccggcggtttgacgaaggaaagttgaaggccggtcagagcgtgataggcctgcagatgggaaccaataaatgcgccagccaggcgggtatgactgcttatgggacccggcggcatctgtatgatccgaagatgcaaactgacaagcccttcgatcagaccacaatttccctgcaaatgggcacaaataaaggcgcctcacaggccggcatgctggctccgggcactaggaggtag

SEQ ID NO: 3852 - DNA, 990 bp, Artificial Sequence
  Description of Artificial Sequence: Synthetic coding sequence
atgacccacttcaacaagggccccagctacggcctgagcgccgaggttaagaacaaaatcgcttcaaaatatgatcatcaggctgaggaagatttaagaaattggatcgaggaggtgacaggcatgtctattgggcccaacttccagcttggcctgaaggatgggattatcctgtgtgaactgattaacaaactccagccagggtcagtgaagaaggtcaatgagagctcactgaattggccacagttggaaaacattggaaattttattaaggcaatccaagcgtatggcatgaaaccacacgacattttcgaggctaacgacctgtttgaaaacggcaacatgacccaagtgcagacaaccctggttgctctggcgggtctcgccaaaacgaagggtttccacactaccatcgacattggggtgaagtatgctgagaaacagacccgtaggttcgatgaaggcaaattaaaggctgggcagagcgttattggtctgcagatggggaccaataagtgcgctagccaagctggtatgactgcgtacggaacccggcgacacctatatgacccaaaaatgcaaacagataaaccattcgatcagaccacgatttctctgcagatgggaacgaacaaaggcgcctcacaagccgggatgctagcaccgggcaccaggcgggatatatatgaccagaagttgactctgcagcctgtcgataatagtaccatctccctgcaaatgggaacgaataaagttgcatcccagaagggcatgagcgtgtacggattaggaagacaagtttacgatcccaagtactgcgccgcccccaccgaacccgttatacataacgggagtcagggaaccggcacgaacgggtctgagatcagcgatagcgattatcaggctgaatatccagatgaatatcacggtgaataccaggacgactatccccgcgactaccaatactcggatcaggggatcgactattag

SEQ ID NO: 3853 - DNA, 867 bp, Artificial Sequence
  Description of Artificial Sequence: Synthetic coding sequence
atgagcatcggccccaacttccagctgggcctgaaggacggcatcattctgtgtgagctgattaacaaactccaacccggcagcgtgaaaaaagtaaatgagagcagtctgaattggccccagctggagaacattggtaacttcatcaaagctatccaggcctacggaatgaaaccccacgatatctttgaggctaatgacttattcgagaatggtaatatgacacaggtgcagaccacactcgtagccctggcaggtttggctaaaaccaaggggttccatacaacgatagacattggagtgaaatatgcagaaaaacagacgcgaagattcgacgagggtaaactgaaggccggtcagtctgtcatcggactgcagatgggaactaataaatgtgcttcccaagccggtatgaccgcttacggcaccagaaggcacctgtatgaccctaaaatgcagacggacaagcctttcgaccagacgaccatttcccttcagatgggaaccaataagggagcctcccaggccggcatgctcgcacctggaacgcggagggatatctacgaccagaaactgaccctccagcccgttgacaactccaccatttctctgcagatgggcaccaacaaagtcgcctcacagaagggaatgagcgtgtatggacttggccgtcaggtgtatgatccaaagtattgcgcggcacccactgaacccgtgatccacaatgggtcacagggcactggaactaatggcagcgaaatctctgacagcgactaccaagctgaatatccagacgaataccacggagagtaccaagacgactatccgcgggactatcagtacagcgaccagggaatcgattattag

SEQ ID NO: 3854 - DNA, 2223 bp, Artificial Sequence
  Description of Artificial Sequence: Synthetic coding sequence
atgggcgagctgtgccggcgggacagcgccctgaccgccctggacgaggaaacattgtgggagatgatggaatctcatcgacacagaatcgtgcggtgcatttgccccagcaggctaacaccgtacctgaggcaagccaaggtcctctgtcagctggacgaggaagaggtcctgcactctcctagactgacgaattccgcaatgagagctggtcacctgctcgacctgctcaagacacgggggaaaaatggtgccattgccttcctggagtccctaaagtttcataatcccgacgtttataccctggttacaggattgcaacccgacgtcgactttagcaacttctccggtcttatggagacctcaaagctgacagaatgccttgccggggcaattggttctctgcaagaagaactcaatcaggaaaaggggcagaaagaagtgctattacgtcgttgccagcagttacaagaacatttggggttagctgagacacgcgcagagggattgcaccagcttgaggcagatcattccaggatgaagagagaagtatcagcccactttcatgaagtacttcgcttgaaagacgaaatgctctctctgtccctccactacagcaatgccttacaggagaaggagctggcagcctcaagatgtcgaagcttacaagaagaactgtatctgctgaagcaggagttacaaagggcgaacatggtgagcagctgtgagctcgaattgcaggaacagagcctgcggacagcatccgatcaagaatcgggcgatgaagagcttaacaggctgaaggaggagaacgagaaattgcgttcactgactttctcccttgccgaaaaggacattctcgagcagtcattagatgaggcgcgcggctccagacaggagctggttgaacggatccatagtttgcgtgagagggcggtagctgcagagcgacagcgagaacagtactgggaggagaaggagcaaacactgctccagttccagaagagcaaaatggcctgtcagttgtacagggagaaagtcaacgccctccaagcccaggtctgtgagctgcagaaagagcgcgaccaggcctactccgctcgcgactccgcacaacgtgagatctctcagtccctggtggaaaaagatagcctgcggaggcaggtgttcgaattgacagaccaggtctgcgagctccggacacagctgcgccagctgcaagcggagccccccggagtgttaaagcaggaggcgagaacccgggagccatgccccagagagaagcagcgtctggttcgcatgcatgccatttgccccagggatgacagcgattgttccctcgtgtcgagcactgaaagccaactcctctctgatttgtcagctacatcctcacgtgagctggtggacagctttaggtcatcttcacccgccccacccagccagcagagtctgtacaagcgggtggccgaggatttcggcgaagagccatggagcttttcttcttgcctggagatccccgaaggggatccaggagcattgcccggcgcaaaagcaggggatcctcacctcgactacgagcttctggataccgccgatttgccacagctggagtcgtctctgcagcccgtgagcccgggtagactggatgtgagcgaatccggcgttctcatgcggaggagaccagcccggagaatcttgagccaggtcacaatgctggcctttcagggagatgccctcctggagcagattagtgttatcggcggaaacctcacaggaatttttattcatagagtgacccccggttcagccgcggaccagatggccctgcggccaggaacccagatcgtcatggttgattacgaagcctctgagcctctcttcaaagccgtattggaagacaccaccctggaagaagcggtgggtctgctgaggagggtggacggattctgttgtctgtccgtgaaagtgaacaccgatggttataagcgcctcctgcaagacctggaagccaaggttgctacttctggagacagtttctacattcgcgtgaacctggccatggaagggcgcgcaaagggggaactgcaggtccactgtaatgaggtgctgcacgtgactgatacgatgttccaggggtgtggatgctggcatgctcatcgtgtgaatagttatacaatgaaagacaccgccgcccatggcaccattccgaactattccagatag

SEQ ID NO: 3855 - DNA, 3015 bp, Artificial Sequence
  Description of Artificial Sequence: Synthetic coding sequence
atgggcgagctgtgccggcgggacagcgccctgaccgccctggacgaggaaacgctgtgggagatgatggagtctcatcgacatcggattgttagatgcatctgcccatctcggctcacaccctacctgcgccaggccaaagttctttgtcaactggacgaggaagaagtcctccactctccacgccttactaatagcgcaatgagagcgggccatttattggaccttctcaaaacccggggcaagaacggtgcaatcgcctttctcgaatctctcaagttccataatcccgacgtttatacactggtgaccggactgcagcccgatgtggatttctctaacttctcgggtcttatggagacctctaaactgacggagtgcctggccggggctatcggttcattacaggaggagctgaaccaggaaaaaggccagaaagaagtcctgctgcgtaggtgccagcaattgcaggaacatctcggattggccgagacccgtgcagagggactccatcagctcgaggctgatcatagccggatgaagcgcgaagtcagtgctcacttccatgaggttctgcgcctgaaagatgagatgttgagcctgagtttgcactatagtaacgctctacaggagaaagaactggccgcctccagatgtcggtcgctacaggaagagttgtacctgttgaagcaggagctacaaagggccaacatggtgagttcatgcgagttagagctgcaggagcagagcctgcgcaccgcctcagaccaggaaagcggggatgaagagctgaatcgcttaaaagaggagaatgagaagctgcgaagcctgacgtttagtttggccgaaaaagacatccttgagcagagcctggacgaagcccgcgggtcaagacaggagctggtcgagcggatccacagccttcgggaaagagccgttgccgccgagaggcagcgcgaacagtattgggaagaaaaggagcagactctcttgcagtttcaaaaatcaaagatggcctgccagttgtacagagaaaaggtcaatgctctgcaagcccaggtctgcgagctccagaaagagcgagaccaagcctattcagcgcgcgatagcgcccaacgagagatttcgcaaagccttgtggagaaggactcactccgccgacaggtgttcgaattgacggaccaggtttgcgagctgaggacccagcttaggcagctccaggcagagccccctggtgttctgaagcaagaagctagaacccgggagccttgccctcgagagaagcagcggctcgtgcggatgcacgcgatctgcccacgcgacgacagcgattgcagcctcgtctcttcaacggagtcccagctcttatccgacctcagcgccacttctagccgggagctcgtggactcctttagatcttcaagtcctgcaccaccctcacagcagagtctgtataagcgagtggcggaagattttggagaggagccctggtccttttccagttgtctggaaatccccgaaggcgaccccggtgcactccccggcgccaaggctggagatccacacctggattacgaactattagacacagccgatttgccccagctggaaagtagtctgcagcccgtgtcacctgggagacttgacgtaagcgagtccggtgtccttatgagaagacgacctgcacggcggatcttaagccaagtgaccatgcttgcttttcagggcgatgcactgttggaacagataagcgttataggcggaaacttaacgggtatctttattcatcgggttactcccggctctgcggctgatcagatggccctgcgacccggtactcaaattgtgatggtagattatgaagcctccgagcccctgtttaaggccgtgctggaagatacaactctcgaagaagccgtgggacttcttcggagagtggacggattctgctgtcttagcgtcaaggtcaacaccgatggctacaagaggcttctccaagatctggaggccaaggtggccacctccggtgattctttctatattcgcgtgaatttagccatggagggcagagcaaagggtgaattgcaggtgcattgtaacgaggtgctccacgtgaccgacacgatgtttcaggggtgcgggtgttggcacgcccatcgcgtcaactcttatactatgaaagacacagcagctcatgggacgatccccaactatagcagagcacaacaacagctgattgctctgatccaggatatgacacagcagtgcactgtgacgcggaaaccgagctcaggtggcccccagaaactcgtcagaattgtatccatggacaaagctaaggcttccccactccgccttagcttcgaccggggccagttagatccgagcaggatggagggttccagtacatgtttctgggcagaaagttgcctcactttggtgccatatacccttgtcagaccccacagaccagcccgacctcgtccagtgctcctcgtacccagagcagttgggaagattcttagtgagaaattgtgtcttctgcaggggttcaaaaagtgtttggcggaatacctaagccaggaggaatatgaggcctggagccagcggggcgacattatacaggagggcgaagtctccggcgggagatgctgggttactcggcacgccgtcgagtctctgatggaaaaaaatacacacgccctcttagacgtacagctcgatagcgtctgtacccttcaccgcatggatatcttccccattgtaatccatgtttccgtgaacgagaagatggctaagaaactcaaaaaagggctgcaaagattaggcaccagcgaggaacagcttctcgaagccgcccgacaggaagaaggtgatctcgatagggccccctgtctctactcatccctagcaccggatgggtggtcagatttagacggattattgtcatgtgtgcgccaagccatcgccgatgagcagaagaaggtcgtctggacagaacagtctccgaggtag

SEQ ID NO: 3856 - DNA, 1305 bp, Artificial Sequence
  Description of Artificial Sequence: Synthetic coding sequence
atggtgagcagctgcgagctggagctgcaggagcagagcctgcggaccgccagtgaccaagagagtggggatgaagaactaaaccggttgaaggaggaaaacgagaaactgaggagcctaaccttctccctggcagaaaaggacattcttgagcagtccctggacgaagctagggggagcagacaggaactggtagagaggatccactccctgcgagaaagggccgtagccgcagagcgtcagcgagagcagtattgggaagagaaagaacagactcttctgcagtttcaaaagtctaagatggcctgccaactctaccgcgaaaaggtcaacgcccttcaagcgcaggtttgcgagctccagaaagagcgggatcaggcctattcggcacgcgattcagctcagcgcgaaatctcacagagtctggtggaaaaagacagcctgaggagacaggtgtttgagcttaccgaccaggtgtgcgagctgcggacacagcttagacaactgcaggccgagccccctggggttctaaagcaggaggccagaacaagggagccctgccccagggagaagcagagattggtgcgtatgcatgccatttgcccgcgagatgatagtgactgctccctggttagcagcaccgagtctcagttactatccgacctgagtgcgacaagctcccgggaattggtggattctttccgcagtagctcccccgccccaccctctcagcagtcgctgtacaagagggtggcagaggattttggcgaagagccatggtccttttcctcttgtctagagatccccgagggcgatccgggcgcgcttccgggtgccaaagccggagatccacacttagactacgagcttcttgatacagccgaccttccgcagctggagagctctcttcagcctgtaagcccaggacgcctcgatgtgagcgaatcaggggtcctaatgagaagaagacctgcacgacgcatcctcagtcaggttaccatgctggcctttcagggggacgccttgctggagcaaatctccgtcatcggcggcaacctgaccggcattttcatccacagagttacgccggggtccgctgcagatcagatggcactcagacctgggacacaaattgtgatggtgagccgagccaggcctctactcagccctggactattgatgggtaccgttgctgcagggggggtgacccaggcggacttcacctcccccaggcgctgcaggtccacactgggctgggcatccgcccttagttgggcagacgtcaaaaggtccgcccatttgtag

SEQ ID NO: 3857 - DNA, 3015 bp, Artificial Sequence
  Description of Artificial Sequence: Synthetic coding sequence
atgggcgagctgtgccggcgggacagcgccctgaccgccctggacgaggagaccttgtgggagatgatggagtcacatcgacaccggattgttcggtgtatctgcccttcaaggctaacaccttaccttagacaggcaaaagtgttgtgccagctcgatgaagaagaggtgttacatagccctcggctcacaaatagcgcaatgcgcgcagggcatctcctggacctactaaagacccgcggaaagaacggagccattgcctttttggagagtttaaaattccataatccggatgtgtataccttggttacaggtctgcagccagacgtggactttagtaacttcagcggtctgatggagacgtcaaagttgacagagtgcttagcaggggcaattgggtcgttacaagaggagctgaatcaagaaaaaggacagaaagaagtgctgctacgcagatgccagcagctccaagagcatttaggcctggcagaaactcgggcggagggtctccaccagctcgaagcggatcacagtcgtatgaagcgagaggtttctgcccactttcatgaagtcctccgtttgaaagatgaaatgctgagtctgagcctccattactcgaatgccttgcaagagaaggaactcgcagcctcaaggtgccgatcactgcaagaggagctctacttgctcaagcaggagctgcagagggcaaacatggtgtcctcatgtgagctcgagctgcaagagcagtctttgcgaactgccagtgatcaggagtcaggagacgaagagttaaatcgcctgaaggaagaaaatgagaaattacggagcctcacatttagtttggccgagaaagacattcttgagcagagcctggacgaggccagaggttctcgccaagagcttgtcgaaaggatccatagcctgcgagaaagggccgtggcggctgaaaggcagagggaacagtactgggaggagaaagaacaaaccctcctgcagtttcagaagtcaaagatggcatgtcagttatacagggagaaggtgaacgccctgcaagcgcaggtctgcgaactgcagaaagagagagatcaagcctacagcgccagggatagcgctcagcgggagattagtcagtccctcgtcgaaaaggattcattgcgcaggcaggtctttgaactcactgatcaggtgtgtgaattgaggacgcagctcagacagctccaggctgagccccctggcgttttaaagcaggaagcgcgcacccgcgaaccatgtcccagagaaaagcagcgcctggtacgaatgcacgctatctgtccacgcgacgactctgattgttccctggtaagcagtacagagtcccagctactgagcgatctaagcgccacttccagccgggagctggtagactcctttagatcctctagtccggcaccccccagtcagcagtcattatacaaacgcgtggcagaggattttggggaggagccctggagtttcagctcttgcctggaaatccccgagggcgaccccggcgcactaccgggcgccaaggctggggacccacatttggactatgagcttctcgacactgctgaccttccccagcttgagtcctccctgcagcccgttagccccggcagactggacgtctcagaaagtggtgtcctgatgcgccgtcggcccgctcggcgcatccttagccaggttacaatgctagcctttcagggcgatgcactcttggagcagatcagtgttattggaggtaatctgaccgggatttttatacacagggttacgcctggaagcgccgcagaccaaatggccctgaggcctggcacacagattgttatggtagactatgaagccagtgaaccactgtttaaggcagtgctggaggacacaaccctggaagaagccgtaggcctgttgcgacgcgttgacggtttttgctgcctctctgtaaaggtgaacacagacggttataaacgactgctgcaggacctagaggcaaaagtggcaacaagcggggactccttttacattagagtgaatctcgccatggaaggacgcgccaaaggagagctgcaggtccactgtaatgaggtccttcatgtcactgacacaatgtttcaaggttgtggatgctggcatgctcatagggttaacagttacaccatgaaagatactgcagcccatggaacgataccaaattactcgagagcccagcagcagcttatcgccctgatacaagacatgactcagcagtgtaccgttacccggaagcccagctcaggaggtccacagaaactggttcgtatagtttccatggataaggccaaggcaagtcccctgcggctgagttttgaccgggggcagttggacccctcccggatggagggtagctcaacatgcttctgggcggagagttgccttacactagtcccatacacactggtcagaccacatcggcccgcacggcctcggccggtgttgttggtcccccgtgcagttggcaaaatcctgagcgagaaactatgcctgctccagggctttaagaaatgcttggcagagtacttgagccaggaggaatatgaggcttggagccagagaggcgacatcatccaggagggcgaggtctcgggcgggcggtgttgggtgacgagacacgctgtcgaaagtctgatggaaaagaacacccatgcactgttagacgttcagctagactctgtgtgtaccttacacaggatggatatcttcccaatagtgattcacgttagcgtgaatgagaaaatggccaagaaactgaagaagggattgcaacggcttggcacttctgaagaacagttgttggaggcggcccggcaggaggagggtgatttagacagggccccctgtctgtattcaagtctcgccccggacggctggagtgatttggatggtctcctttcctgcgtgaggcaggccatagcagatgagcagaagaaagttgtatggacggaacagtcacctcgatag

SEQ ID NO: 3858 - DNA, 1326 bp, Artificial Sequence
  Description of Artificial Sequence: Synthetic coding sequence
atggtgagcagctgcgagctggagctgcaggagcagagcctgcggaccgcctctgatcaggagtctggcgacgaggaactgaatcgcctgaaagaggagaacgaaaaacttaggtctctgaccttttctctagctgaaaaggatatccttgagcagtcccttgacgaagcccgcggatctaggcaggagcttgtcgagcggattcattctctgagggagcgggcagtagcggcagaacgccagcgcgagcagtattgggaagagaaggagcagacactgttgcaatttcaaaagtccaagatggcatgccaactttaccgtgagaaggtgaacgccctgcaagctcaagtctgtgaactccagaaggaacgagatcaggcttacagcgctagagactctgcacaaagagagatctcccagtccctcgtagagaaggattcccttcggcggcaggttttcgagcttacagaccaggtgtgtgaactccggacccagctgaggcagcttcaggccgaaccgcctggtgtgttgaagcaggaagcccggacacgggagccctgtcctagggagaaacaaagattggtacgaatgcacgccatctgcccccgtgatgattccgactgtagtcttgtgagcagcaccgagtcgcagcttttaagcgacctgtcggctacgagcagccgggaactggtggactcttttcgtagtagtagcccagccccaccctcccaacagtccctgtataaaagagtggccgaagatttcggcgaggagccatggtcatttagttcctgtttagagattcctgagggtgatccgggcgcactgcctggagccaaagccggcgacccacacctcgactacgagttgcttgacaccgcggatctgccacagctcgaatcatcactacagcccgtctctcccgggcggcttgacgtttcagaaagcggggtgctgatgagaagaagaccagctagaaggattctaagccaggtcactatgcttgcatttcaaggggatgccctgctggagcagatctcagtgatcggcggcaatctaaccggcattttcatccaccgcgttacccctgggagcgcagccgaccagatggccctaagacccgggacccagatcgtcatggtgattcggggctactctagaacatggaggccgaagtggagacctagagggacccatagcacaagcggaagcacttggccgtggcgcgctggccctaaggggtcttgcaggtgtattgcaactaggtcctgtacatccccaaccccatgttcaagagccgctgccgctgggatgcctacagcctag

SEQ ID NO: 3859 - DNA, 2349 bp, Artificial Sequence
  Description of Artificial Sequence: Synthetic coding sequence
atgttcccccccagcggcagcaccggcctgatcccccccagccacttccaggcccggcccttaagcacattgccccgaatggccccaacatggctcagcgacattcccctcgtacagccaccaggacaccaagacgtgagcgaacggaggctggacacccagcggcctcaggtcactatgtgggagcgagacgtgtctagcgaccgccaggaacccggacggagggggcgaagctggggccttgaaggctcccaggctcttagccagcaagccgaggtgatagtcaggcagctccaggaactccgccgactggaagaagaagtgcgacttctgcgcgagacgtcgttgcagcagaaaatgagacttgaagcacaggctatggaactggaggccctagcccgggccgaaaaagcagggcgggctgaggccgaaggccttagggcagctctggccggtgctgaggtggtgaggaagaatttagaggagggctcccaacgggagctagaagaagtgcaacggctgcatcaggagcagctaagtagcctgacacaggcacacgaggaagccctttcaagtcttacatcaaaagctgagggattggagaaatcactgtctagcctagagaccaggagagcaggcgaagcaaaggaactggccgaagcacagcgcgaagcggaactgctccggaagcagctcagcaaaacccaggaagatctggaagcacaggtaacactagtcgaaaacctgaggaagtacgtgggcgagcaggtgcctagcgaggtgcactctcaaacatgggagctcgagaggcaaaagctgctagagaccatgcagcatctgcaggaagatcgcgattctctgcacgctacggctgaactgctacaggtgagggtccagtccctcacgcatatcctggccctccaggaagaggagctgacaaggaaggtgcaaccttctgatagtttggaacccgagttcacacggaaatgtcagtcgctcctgaataggtggagagagaaagtgttcgccctcatggtccagttaaaggcacaggaattggaacacagcgactcagtgaaacaactcaaaggacaggttgcctccctgcaggaaaaagttacctcgcagtcacaagagcaggccatcctacaacgcagtctgcaagacaaagccgctgaagtcgaggtggagcgcatgggagcgaaaggcctccaactggagctatccagagcgcaggaggccagaaggaggtggcaacagcagacagcctcagctgaagagcagctgcgactggttgtgaacgcagtgtcttcatcgcagatttggctggagacaacaatggccaaggtggaaggcgcagcagcccagctcccctctctaaacaacagactgagctatgccgtgcggaaggttcataccatacgagggctcattgctagaaagctagcacttgcgcagctgaggcaagaatcctgcccattgccccctccggtaacagacgtaagtctcgaactccagcagctgagagaggagcgcaatagactcgatgccgaactgcaactgtccgctcgattgatacagcaggaggtgggcagggcccgcgaacagggggaggcagaaaggcagcagctgtcaaaagtcgcacagcagcttgagcaggagctgcagcaaacgcaggaatccctggcgtccctgggactgcaacttgaagtcgccaggcagggccagcaggaatcgacagaggaggccgcctcgctgagacaggagctgacgcaacaacaagagctgtatggtcaggcattgcaggaaaaggtggccgaggttgagacccggctacgagagcagttgtctgatacagaaaggcgcttgaatgaggcacgcagggagcacgcgaaggccgttgtttctctccgccagatccagcgtagagctgctcaagagaaggagaggtcacaggagttacgaagactacaagaggaggcgcggaaggaagaaggtcagcggcttgcaaggagactacaagagctcgagagggacaaaaacctcatgttagcgactctccagcaggaaggcctgctttctcggtacaaacagcagcggctgctcaccgtgttgccttcattattggataaaaaaaagtcagttgtgtcatctcctcgccctcccgagtgctccgcaagcgcacctgtggccgccgcagtgcccactcgcgagagcatcaagggtagcctatctgtacttcttgatgacctgcaggatctctctgaggcaattagcaaggaggaggcagtctgccagggagacaacctggacaggtgtagctcatcgaacccccagatgtcctcctag

SEQ ID NO: 3860 - DNA, 2349 bp, Artificial Sequence
  Description of Artificial Sequence: Synthetic coding sequence
atgttcccccccagcggcagcaccggcctgatcccccccagccacttccaggcccgccccctgtccacactcccacgcatggcccccacttggctgtccgacatacctctggtgcaaccgccaggccatcaggacgtctctgagaggcgactagacacccagcgaccacaggtaacaatgtgggagcgggatgtttcatccgacaggcaagagcctgggcgaaggggaagaagttgggggctggaggggagtcaggcactctctcagcaggccgaggtgatcgtgaggcagctgcaggagcttaggtggcttgaagaggaggtatggcttcttagggagacatctcttcagcaaaaaatgcggttggaggcgcaggctatggagttggaggcattagctagggccgagaaagcaggtcgcgcagaggcagaaggccttagggccgccttggcaggcgctgaagtggttcgaaagaacttagaagaaggccgccagcgagaactcgaggaggtccagcgcctgcatcaagagcagctgagtagcctgacacaggcgcatgaagaggccctcagcagcctgacttcgaaggcagagggcctcgagaagtctctgagttccctggaaacccgccgtgccggcgaagcaaaagagctcgctgaggctcaaagggaagcagagttgctgcggaaacagctgtcgaagacgcaggaagacctggaggcgcaggtgaccttggtagagaacctccgtaaatacgtgggggagcaggtcccctctgaggttcactctcaaacttgggagttggaacgccaaaagcttctcgagactatgcagcatcttcaggaggacagggattccctccacgccactgcagagctgctgcaagtgcgtgtgcagtctttaacacatattttggcactgcaggaggaggagctgacaaggaaggtgcagcctagcgattccctcgagcctgagtttaccaggaagtgtcagagtctcctgaatcgctggcgggagaaagtttttgccctgatggtgcagcttaaggcgcaggagctcgagcattctgatagtgttaagcagctcaaaggtcaggtcgcatctttgcaggaaaaggttactagccagtcccaggaacaggccatcttacagcgctcactacaggataaggccgccgaggtagaggtggagaggatgggcgcaaagggattacagttggaactttctcgtgcacaggaagcccgaagatggtggcagcagcagacagcatccgcggaggaacagctgagacttgtggtgaatgcagtgtcatcctctcaaatctggctggagaccactatggcaaaggttgaaggtgcggccgctcagctgcctagtctgaacaaccggctaagttacgcagtgcgcaaggtgcacactattaggggattgattgccagaaagctcgcacttgcacagctccggcaggagtcctgtcccctccccccccctgtgactgatgtgtccctggagctccagcagctgcgggaggaacggaatcgtcttgacgccgaactgcagttgagtgctcgcttaattcaacaggaagtcgggagggccagggagcagggggaagctgagcggcagcagctctctaaggttgcccagcagctggagcaggaactgcagcagactcaggagtccctggcttctctaggcctccagctggaggtggccaggcaatgccagcaggagagcaccgaagaggccgcctccttacgacaagaactcacacagcagcaggagctgtatggccaggctcttcaggagaaagttgcagaagttgaaactcggctcagagagcaactctccgacaccgagcgcagattgaatgaagctcgccgcgagcacgctaaagctgtggttagcctccgccagattcagagaagggccgctcaagagaaggagcgctcccaggaattgcgaaggctgcaagaggaagctcggaaggaggagggccagaggttggctcgtaggctgcaagagctcgagcgtgacaaaaacctcatgctggccaccctgcagcaggagggcctcctgagcagatacaaacagcagcggctgctgaccgttctcccctccctgcttgacaagaagaaaagtgtagtctcctcccctagaccaccggagtgtagtgccagtgccccggtagccgctgcagttcccacccgagaaagcattaaagggtccctgtctgtgctcctggatgacctacaggacttgtctgaagcaattagcaaagaggaggcggtgtgtcagggagacaatctggatagatgctcttcatgcaatcctcagatgagcagttag

SEQ ID NO: 3861 - DNA, 2349 bp, Artificial Sequence
  Description of Artificial Sequence: Synthetic coding sequence
atgttcccccccagcggcagcaccggcctgatcccccccagccacttccaggcacgtcccctttccacactgcctcgcatggcccccacctggctgagcgatatccctcttgtgcagccaccgggtcatcaggatgtgtccgaaagaaggttggacacacagagaccacaagtcacaatgtgggagcgtgacgtatcctctgatcggcaggagcctggccggcgcggacgctcctggggacttgaagggtcccaagccctgagtcagcaggcagaagtcatagttcgccaacttcaggagcttcgtcgccttgaagaggaagtcaggctcttgagggagaccagccttcagcaaaagatgaggctggaggcccaagcaatggaactggaagcgttggcccgagcagaaaaggccgggagggccgaggctgagggtctgagggccgctcttgccggcgccgaagtagtccgtaagaacctggaagaggggagtcagagagaattagaggaagttcagaggctgcaccaggagcagctgtccagtttgacccaagcccatgaagaggcccttagtagtctgacttccaaggccgaaggtcttgaaaaatctctctcctcactcgaaacccgaagggcaggggaagccaaggagttagcagaggcacagagggaggctgagttgctgcgaaaacagctgtctaagactcaggaggaccttgaggcacaggttaccctggtggaaaatctccgcaagtacgtgggggagcaagtgcccagcgaagtgcactctcaaacatgggaattggagagacagaaactgttggagaccatgcagcatttacaggaggaccgcgacagtctccacgccactgctgaactgttacaggtgcgcgtgcagtcacttacacacatcctcgctcttcaggaggaagagcttaccaggaaagtccagcccagcgattccttggaaccagaattcacgagaaagtgccaatcactgctaaatcgctggcgtgagaaagtctttgccctgatggtgcagctcaaggctcaagaactagaacactcagattccgtgaaacagttgaagggccaggtagcctctttgcaggagaaagtcaccagtcaatcccaggagcaagctatcctgcaaaggtcactccaggataaggcagccgaggtggaggtggaacgaatgggcgcgaaaggcttacagctggagctgagcagagcccaggaagcccgtagaagatggcagcagcagactgcctccgctgaagagcaactaagattagttgttaatgctgtgagctcctcccaaatatggctagagacaactatggcgaaggtcgaaggggctgccgcccagttgccctctctgaacaacaggctgtcatacgcagtacgaaaggttcacaccatccggggcctcattgcacgaaagcttgcgttggcgcaattaagacaagaatcttgtcccctgccccccccggttacagacgtgagcctggaacttcagcaattgagggaggagcggaatcggctcgacgccgagctgcagctatctgccagacttattcagcaggaagtgggtcgcgcccgggagcagggggaggctgaacggcagcaattgagcaaggtagcccagcagcttgaacaggaactgcaacagactcaggagagcctcgcatccttaggcctgcaactggaggtggcacgacaggggcagcaagagtcaaccgaggaagccgccagtctgagacaggaactcactcaacagcaggaactttatggtcaggcactgcaagaaaaggtggcggaagtcgaaacccgccttagagagcagcttagtgacacagaacgtcggctgaacgaggcccgcagggagcacgctaaagctgttgtgtcactacggcagatccagcggagggccgcacaggagaaggaacgcagtcaggagcttcgtagactgcaagaagaagccaggaaggaagaagggcagcgcctggctaggaggctgcaagaacttgagcgcgataagaacttaatgctggccactctgcagcaggaaggcttgttatctagatataagcaacagcggcttctcaccgtgctgccatctttgctggataaaaaaaagagtgtagtaagcagtcccaggccccctgagtgttcggcaagtgctcccgtggccgcagctgtcccaacgagggagtcaatcaaaggcagcctgtccgtgcttctagatgatctgcaggatttaagtgaagccatcagcaaggaagaggccgtgtgccagggcgacaatctggaccgttgctcctctagcaatccacagatgtcaagctag

SEQ ID NO: 3862 - DNA, 2190 bp, Artificial Sequence
  Description of Artificial Sequence: Synthetic coding sequence
atgttcccccccagcggcagcaccggcctgatcccccccagccacttccaagcccgaccacttagcactctgcccaggatggctccaacatggctatctgacatccctctcgtgcaaccccccggccaccaggatgtttctgagcgaaggctcgatacccaacgaccccaggtgaccatgtgggagagggacgtgagcagtgaccggcaagagccaggtcgcagggggcggtcctggggcttggaaggctctcaagccctgtcacaacaggcagaggtcatcgtcaggcagctgcaggagctgcgccgcctggaggaagaagtccgactgctcagggaaacctcattacaacaaaaaatgcggttagaagcccaggccatggagctcgaggcactcgcccgggccgaaaaagctgggagagctgaggcagagggcctgagagcagcgctggccggcgcagaagtggtccggaagaatctcgaagagggctctcaaagggaattggaggaagtgcagcgtttgcatcaagagcagctgagctccttgactcaagcgcacgaagaggcactatcgtccttgacatcaaaggccgagggattggagaaaagtttaagctctctggagacacgcagggctggagaggcaaaggagctggcagaggcgcagcgtgaggccgagcttctgaggaaacagctgtcaaaaacccaggaggatctagaggcccaggtgacccttgtggagaatttgaggaaatatgtgggtgaacaggtgccgagcgaggtgcacagccagacttgggaactggagagacagaagctgttggaaacgatgcagcacctacaggaggacagagacagtttgcatgctaccgcagaactgctgcaagtgcgtgtgcaatctctgactcacatccttgctctgcaggaagaggagcttactcgcaaagtgcaaccatctgactcccttgagcccgagtttacacggaagtgtcaatctttgctgaatcgctggcgtgagaaggtgttcgctctgatggtgcaactgaaggcgcaggagcttgaacattcagatagcgtcaagcaactgaaaggtcaggtggcgagcctacaagagaaagtgacctcacagtctcaagaacaggcgatattacagcgctccctgcaggacaaagctgcagaggtagaggtggaaaggatgggggccaagggactgcaattggagttgagccgagcccaggaggccagaagacgctggcagcagcagactgcatctgccgaagagcaactgagattagtggtcaacgcagtgtcatcctgcccccttcctcccccagtcacagatgtctccctcgagctgcagcagctgagagaggagcggaacagactcgacgcagagctccagctctctgccaggttaatacaacaggaggtaggacgggcccgcgaacagggcgaagccgagcgacagcaactgagcaaagtggcccaacagctggaacaggagcttcagcaaacacaggagtcattagcatctctaggccttcagctcgaagtggccaggcagggccaacaggagagcacagaggaagccgcttcactcagacaggagctgacacagcagcaggagctgtatggacaggccctgcaggaaaaagtagccgaagttgagactaggctcagggaacagttatctgacaccgaaagaaggctgaatgaagctagacgcgagcacgccaaggcagtcgtcagccttagacagattcaaagacgcgcggcacaagaaaaagagcgctcacaggaactgcgcaggctccaagaagaagcccgtaaggaagagggacaacggcttgcccggagactgcaggagttggagcgggataagaacctcatgctggccacactgcagcaggaaggactcctgtccagatacaaacagcagcgtctcctgaccgtgcttccatcactgcttgacaaaaagaaatcggtcgttagcagcccaaggcctccggagtgcagcgcttcggctccagttgcagctgccgtacctactagggagtctattaagggttctctgtctgtgctattggatgacctgcaggatctttcggaggctatcagcaaggaagaagcggtttgccagggagacaatctggatcgatgcagcagttccaacccccagatgtctagttag

SEQ ID NO: 3863 - DNA, 2616 bp, Artificial Sequence
  Description of Artificial Sequence: Synthetic coding sequence
atgtggccccacagcgccggcgcccggccctgggccagcaccctgacagggaaagacccccgtgtgatggcttgctggtgtctggatggcctcccgagtgggcttgccgaaccctggagagagctctggagatggaggtctcggcccttacattgcgtgccgccattcagtcctctcgcaagaagctccagagaccaccggaatttgaggcgacgggggaatatcgatggttggcgacagaatctcgaaccttctaacaacgtcgagatgtttcctccaagcgggtcgaccggactgatccctcccagtcacttccaggcacgccctctctcaacactgccacggatggcccccacctggctcagcgatattccactggtgcaacctcccgggcaccaagacgtgagtgagcgccggcttgacacacagagaccacaagtgaccatgtgggagcgggacgtgtcttccgatcggcaggagccagggcggcgcggccgctcatggggtttggagggatcacaggcgctcagtcagcaggccgaggtgattgtcaggcagttgcaagagctccgacggctagaggaggaggtgaggctgctcagggagacctccctccagcagaaaatgaggctcgaggctcaggccatggaattagaagctctcgcccgggctgagaaagcagggcgagctgaagccgaagggctccgcgctgccctcgccggcgcagaggtcgttaggaagaatttggaagagggttcccagcgggagctcgaggaagtccagcgtctgcatcaggaacaattgtccagcctcacccaggcgcacgaagaggctctgagttcactcactagcaaggctgagggcctcgagaagagcctaagtagcctcgagactcgccgagcaggggaggctaaggagctggctgaggctcaaagagaggccgagttattgaggaagcagttgtccaagacgcaagaggacctcgaggctcaggtgacattggttgagaaccttcgtaaatacgtgggggagcaggtgcccagtgaagtccacagtcaaacctgggagctggaaagacagaagcttctcgaaactatgcagcacctgcaagaggatcgcgattccctccacgctaccgccgagctgcttcaagtacgcgtgcaatccctgacacatattctagccctccaggaggaagagctcacccggaaagtgcagccttcagattccctggagcctgagtttacaaggaagtgccagagcctgctcaatagatggagggagaaagttttcgccctgatggtacagttgaaagcccaggaactcgagcactccgactcagttaagcagctcaagggacaagtagcatcgctccaggaaaaggtcacatcgcagtctcaggagcaagccatcctacagagatctcttcaggacaaggccgcggaggttgaagtagagcgcatgggagccaagggtcttcagcttgagctgagcagagcacaggaggctcgaagaaggtggcagcaacagactgccagcgccgaggagcagttgcggctggtcgtaaacgccgtgtcatcttcccagatctggctggagaccacaatggccaaagtagaaggcgccgcagctcagcttccatctctgaacaatcgtctgtcctatgcggtgaggaaagtgcacaccatcaggggtctgatcgcacgcaaactggccctggcccaactccggcaggaatcttgcccgctacctccccccgtcacagacgtgtctctagagttacagcaactgagggaagagcgcaacaggctggatgcggagttgcagctgagcgcccgcctgattcagcaggaggtcgggagggctcgggaacagggggaggcagagcgacagcagctcagtaaggttgctcagcagctggaacaggaactacagcaaacccaggagagtctggctagcctgggcctgcagctggaagtagcccgtcagggacaacaagagagcactgaggaggccgcctccctgagacaggagcttacccagcaacaggaattatatgggcaggctctacaggaaaaggtcgcagaggttgagactagactgagagagcagttatctgacaccgaaaggaggcttaatgaggctcgacgggagcatgccaaggctgtggtgagcctgaggcagattcagaggcgggcagcgcaggaaaaagagagatctcaagagctgcgacgtctgcaggaagaggcacggaaggaggaaggacagaggctggcccgacggctacaagaattagagagagacaaaaatctcatgctggcaacattacagcaagagggacttttgagccgctataagcaacagaggcttctgacagtgctgccctctttactcgataagaagaagagcgtggtttcttcccccagacctccagaatgctccgccagcgctccggtggcagccgccgtcccgacacgtgaatcaattaaggggtctctttccgtccttcttgacgacctccaggatctgtctgaggcaatatccaaggaggaggctgtctgccaaggtgataacctcgacagatgctcttcctccaatccccaaatgtcaagctag

SEQ ID NO: 3864 - DNA, 2190 bp, Artificial Sequence
  Description of Artificial Sequence: Synthetic coding sequence
atgttcccccccagcggcagcaccggcctgatcccccccagccacttccaggctaggcccctgtccactctgcctaggatggctccaacctggctgagcgatattccactagtccaaccaccaggccatcaggacgtctctgagaggagacttgacacccagcggcctcaggtgacaatgtgggaaagagacgtgagtagtgatcgacaagaaccaggacggaggggccgtagctggggtctcgaaggctctcaagctctatcccagcaggcagaggtgattgtgcgccagctacaggaactgaggtggttggaggaagaggtgtggctgttgcgcgaaacgtcattacagcagaaaatgaggctggaggcacaggccatggagctagaggcactggcacgagccgaaaaagcagggcgcgccgaagccgagggactgcgggcggctcttgccggcgcggaggtggttagaaaaaatttggaggaggggcgccagcgcgaacttgaagaagttcagcgactgcaccaagagcagctttcaagtctcacacaagcacatgaagaggccctctcttcacttacgtcaaaggccgagggcctggagaagagtctgtcttccttagagactcgaagagccggagaagctaaggagctcgccgaagcgcaacgggaagcagaactgctgagaaaacagctctccaagacccaggaggacttggaggctcaagtgaccttagtggagaacttgcgaaaatacgtcggagagcaggtgccctcagaggtccactcccagacttgggagctcgaaaggcaaaagctgttggagacaatgcagcacctccaggaggaccgggattctctccacgccactgccgagctgctccaggtgcgggtgcagagtctcacgcatattctggccctgcaggaagaggagctcacaagaaaagttcaaccttcagactcgctggaacccgaatttacgagaaagtgccagtccctcctaaaccggtggagggagaaagtcttcgccctgatggtgcagctcaaggctcaggaactggagcacagtgacagcgtaaaacagctcaagggacaggtggcgagcttgcaagaaaaggtcacttcccagtcccaggagcaggccatcctgcagaggagcctgcaggataaggccgccgaagttgaagtggagcgcatgggcgccaaggggttacaactggaactgtctagagcccaggaagcacgccgctggtggcagcaacagactgcttctgctgaggaacagcttagactggtcgtcaacgccgtttcttcatgtcccctgccccctcccgtcaccgacgtgtcattggaattgcagcagctgagagaggaacggaacaggctggacgccgaattgcagttgagcgcccgcctcatccagcaggaagtgggaagagccagagaacagggtgaagccgagagacagcaactatctaaggtggcccaacaactagaacaagaactccagcagactcaggaaagcctcgcctccctgggcttgcagctggaagtggcccgccagtgtcaacaggagtctaccgaggaagcagctagcctgcgccaggaactgactcagcagcaggaactgtacgggcaggcactccaagaaaaagtcgctgaggtggaaactcgccttagagagcagctcagcgacaccgaacgccgactgaacgaggcccggcgcgaacatgccaaggccgtagtgtccctgcgccaaatccagcgccgggcggcccaggagaaggagcgatcgcaagagctgcgccgccttcaagaagaagctcgcaaggaagaagggcagcgcctggcccggagactgcaggagctcgaacgagataagaaccttatgttagcaacgcttcagcaggaagggctcctctctcgttataagcagcagaggctgttgaccgtactgccaagtctgctggataaaaagaagtcagtggtctcatccccccgccctcccgagtgtagcgccagtgcccctgtggctgctgcagttcctacacgggagtcaataaagggaagcctatcagtcctcctggatgatctgcaggatttgagtgaggctatttccaaagaggaggccgtctgtcagggagacaacctagaccgatgcagttcttgtaaccctcagatgtccagttag

SEQ ID NO: 3865 - DNA, 2349 bp, Artificial Sequence
  Description of Artificial Sequence: Synthetic coding sequence
atgttcccccccagcggcagcaccggcctgatcccccccagccactttcaggcgcgtccattgtccacgttgccccggatggcgcctacttggttaagcgatattccactggtccaaccccctggacaccaggatgtctctgagaggagactggacacccagcgtccccaggtaactatgtgggagagggacgtctcaagtgacaggcaggaacccggtcgccgagggcgatcgtggggcctcgaaggctcgcaagctttatcacaacaggcagaggttattgttagacagctgcaggaactgcgatggcttgaagaggaggtgtggctgctgcgggaaaccagcctgcaacagaagatgagactcgaagcccaggcaatggaactggaagccttagcaagagcagagaaggctgggcgtgcggaagcagagggtcttagggctgcactcgcaggtgcagaggtggttaggaagaatctggaggaaggacgccaaagagaacttgaagaggtgcagagattgcatcaggaacaactaagcagtttaacacaggctcacgaggaagcattgtcatcccttacttctaaagcagaggggctggagaagagtctgagctctctggagacccgacgggcaggggaggctaaggagctcgcggaggctcaacgcgaggcggaactcctgcgaaagcagttatcaaaaactcaagaagacctcgaagcgcaggtgacgcttgtggagaacctccgcaagtacgtgggagagcaagtgccctccgaagtgcactctcaaacttgggagctagagcgccaaaagttacttgaaacgatgcagcacctgcaggaggatcgggacagtcttcacgctacagccgaattgctgcaggttcgagtacagtctttaactcacatcctcgcactgcaagaagaggagctgactaggaaagtccagccgagtgactcactggaacccgagttcacccgcaaatgtcagtctttactcaacaggtggcgagagaaagtcttcgccctgatggtgcagcttaaggctcaggagcttgaacactctgatagcgttaagcagctcaaagggcaggtagctagcttgcaggaaaaagtgactagccagtcacaggaacaggccatattgcagcggagcctgcaggataaggctgcagaggtagaagtggaacgcatgggcgctaaagggctccagctcgaattgagccgggcgcaagaagctcgcagatggtggcaacaacagaccgccagtgccgaggaacagctcagattggtcgtgaacgccgttagctctagtcagatctggctggaaaccactatggcaaaggtcgaaggagccgcagcccagctgccaagtctgaacaataggctaagctacgcggtgcggaaggtgcacactattcggggactgatagctagaaagcttgccttagcacagctgcggcaggagtcctgcccacttcctccccccgtaaccgacgtgtcactggaactgcagcaactcagggaagaacgcaatcgactggacgctgaactacagctgagtgcgagattgatccagcaggaagtgggccgcgcccgagaacagggagaagccgagcgccaacagttatctaaggtggcccaacagttggaacaggagttgcaacagactcaggaatcccttgctagccttggattgcagctggaggtggcccgccagtgtcagcaggagtcaacagaagaggcggctagcctgagacaagagctcacgcagcagcaggaattatatggacaggcgctgcaggagaaggtggccgaagtggaaacaagactgagagagcagctcagtgacaccgagaggcgactcaatgaggcacgaagagagcacgcgaaggccgtcgtgtcccttagacagatacagcgccgagcagcccaggagaaagagagatctcaggagctcaggcgcttgcaggaggaagcccgcaaggaagagggacagaggctggcacgtaggttacaggaactggagagagataaaaatttaatgcttgccaccctccaacaggaaggcctgttgtcacggtacaagcagcaaagactccttacagtgctcccatcactgctcgataagaagaagagtgtggtatcgtcccctagacctccagaatgtagcgcctcagctcctgttgccgccgctgtgccaacaagggagtccataaaaggcagcctgtcagtgttgctggatgatctccaggacctgagcgaggcgatatccaaagaagaggcagtttgccagggggataacttagaccgttgtagcagctgcaatccgcagatgagttcgtag

SEQ ID NO: 3866 - DNA, 2190 bp, Artificial Sequence
  Description of Artificial Sequence: Synthetic coding sequence
atgttcccccccagcggcagcaccggcctgatcccccccagccacttccaagcgcggccactctcaacactgccacgcatggctccaacatggctctctgacatacctctggtgcagccgccagggcaccaggacgtttctgagcggcgcttagacacccaacggcctcaggtgaccatgtgggaaagggacgtgagcagtgatcggcaagagcctggccgccggggccgcagctggggactggaaggatcgcaggctctatcccagcaagccgaggtaattgtgcgtcagctacaggaactcaggaggttggaggaggaggttagactgctcagggaaaccagcctgcagcagaaaatgaggttggaggcccaggctatggaactagaagccctggctagagctgagaaagctggcagggcggaggccgagggtttgcgcgcggccctggcaggcgcggaggtggtccgaaaaaatctggaagagggatctcaacgagagctggaggaagtacagcgtcttcaccaggaacagcttagctccttgacacaggcccatgaggaagcgcttagctctcttacctctaaagccgaaggactcgaaaaatcccttagttccctggagacccgccgggctggagaagctaaagaactcgccgaagcccagcgtgaagccgagctgctacggaagcagctgtccaaaactcaggaggatctcgaagcgcaggtaacgttggtggaaaacctgcgtaagtacgtgggcgaacaggtgccgtccgaggttcattctcagacgtgggagctcgagagacagaagcttctggaaacaatgcagcacttgcaggaggaccgggattcccttcatgccaccgccgagctcctgcaggtgcgagttcagtctctcacccatattctggccctacaggaagaagaattgactcgcaaggtgcaaccttccgacagcttagagcctgaattcacccgtaagtgccagtctctcctgaacagatggagggagaaagtgttcgccttgatggtgcagctaaaggctcaggagctggagcatagcgacagcgtcaaacagctgaaaggccaagtagcaagtctgcaagaaaaggttacatcccaatcccaagaacaagcaatactacagcgctccttgcaggacaaagcagccgaggttgaagttgaacggatgggtgcaaaggggctccaactggagctgtctagagctcaggaggccagacggagatggcaacagcagaccgcttctgccgaggaacagctgcgtttagttgtgaacgctgtgtcctcctgcccactgccaccaccagtcacagacgtgtccctcgagctccagcagctacgggaggagcgaaatcgtcttgatgcagagctccagctctctgcccgcctcatccagcaagaggttgggcgtgcaagagagcagggtgaggccgaacgccagcagttgtccaaagtagcccagcaactggagcaggagctgcagcagactcaagaatcactggcttcactcggtctgcagctggaggtggcccggcaagggcaacaggaatcaaccgaggaagcagcgtcccttaggcaagaattgactcagcaacaggaactctacggccaagctttacaggagaaagtagcagaagtggagacaagacttcgcgaacaactgtccgatacagagagacgccttaacgaggccagaagagagcatgcaaaggccgtggtatctctgcgtcagatacaaaggcgggctgcccaggagaaggagaggagccaggaactgcgcagactgcaggaggaggctcggaaggaagaaggtcagcgtcttgcaagacgcctgcaggagctggagagggataagaatctcatgttggccacactgcagcaggaggggctcctgtctcgatacaaacagcagaggctcctcactgtactaccatctctcctggataaaaaaaaatcggttgtgtcctcaccacggccgcctgagtgtagcgcaagtgctcccgtggctgcagctgtgccaacgagggaatccatcaaggggagtctctccgtcctgttggacgatcttcaggatctgagtgaggcgatctcaaaggaggaggccgtgtgccaaggcgacaatctcgacagatgctcatcgagcaacccccagatgtcatcctag

SEQ ID NO: 3867 - DNA, 2616 bp, Artificial Sequence
  Description of Artificial Sequence: Synthetic coding sequence
atgtggccccacagcgccggcgcccggccctgggccagcaccctgactggaaaggatcccagagtgatggcttgttggtgcctggatggactgcctagtgggctggctgaaccatggcgggaactgtggcgctggcgttctaggcctttgcactgcgtgccacccttttctcctctcgctcgcagctctcgagaccaccggaatttaaggcggagaggcaacattgacggctggcggcagaatctagaaccatccaataatgtggagatgtttccaccaagcggttctactggtttaattcctccatcccattttcaggcccgtccactgtccaccctccccagaatggcgcccacctggctcagcgatataccactcgttcagcccccaggacaccaggacgtcagcgagcgacggctggatacacagcgaccgcaagtcacaatgtgggagcgtgatgtgagcagtgaccgacaagagcccgggcggagagggcggtcttggggcctggaaggatcgcaagcactcagccaacaagccgaggtaatcgtcagacagctgcaggagcttcgtcgcctggaagaagaggtgcgactcttaagagagacgagccttcagcaaaagatgcgccttgaggcgcaggctatggaactcgaggcactggcccgtgcagaaaaagcgggtcgcgccgaggctgagggtctgagagcagccttagcaggagcggaagtggtacgaaaaaacctggaggaaggaagccaaagggagctagaggaggtgcagcgactgcaccaggagcaactctcaagcctaacccaggcccacgaggaagcgctaagcagcttaacctccaaggctgaaggactggagaagtcgctgtcctcgctggagactaggcgtgcgggagaggccaaggaactggctgaggcccagagagaagctgagctgttacgcaagcagctctcaaaaacacaggaggatcttgaggcgcaagtgacactggtggaaaacctccggaaatacgtgggcgaacaggtcccatcagaggtccactctcaaacatgggagctggagcggcagaagttgctagagacgatgcagcatctccaagaagacagggattcgctccacgccactgccgaactattacaagtacgtgtacagagtctaacacatatcctcgccttacaggaggaagagctgacgagaaaagtgcaaccaagtgatagcctggaaccagagtttacacgaaagtgtcaatccttactcaatagatggagagagaaggtttttgcgctgatggtgcagcttaaggcacaggaactcgagcacagtgacagcgtgaagcagctcaagggccaggtcgcttcattgcaggagaaggtgacgagtcagtcacaagaacaggctattctgcagcggagcctccaggacaaagcagccgaagttgaggttgagcgtatgggggctaagggtctccagctggagctgtcaagggcccaggaagcccgacgacgatggcagcagcagaccgcatccgccgaagaacagctcaggttggtcgtgaatgccgtctccagttcccagatttggctcgaaacaacaatggctaaggtggaaggcgccgcagcccaattgccaagcctgaacaatcggctgagctacgcggtcagaaaagtgcacaccatacgcggcctgatcgcaagaaaactcgcccttgcccaactccgccaggaaagctgccctctgccccctccagtgactgacgtgtccctcgaattgcagcaactgcgggaagagaggaaccggctcgatgcagaacttcagctatctgcccgactgattcagcaggaggtgggtagggccagggagcaaggcgaggccgagaggcagcagctaagcaaggtggcacaacagctcgagcaggagcttcagcagacacaggaatctctagcgagcctcggattgcagctcgaagtagctagacagggccaacaggagagcacagaggaggcagcctcccttcggcaggagttgacgcaacagcaggaactttatggccaggcccttcaggaaaaggtagctgaggtcgagaccagacttcgggaacaactgtccgatacggagcgcaggctcaatgaagcgagaagggaacacgcaaaagccgttgtgtccttaaggcagatacaaaggagggcggcacaggagaaagagcggtcccaagagctcaggcgcctccaggaggaagcacgcaaggaagaaggccagagactagctaggaggttgcaggagctggaacgggacaaaaacctcatgttggctacactacagcaggagggactcctgtctaggtataaacaacaacggttgctaacggtacttccaagtcttctggacaagaagaaatccgttgtcagcagtccacgaccgcccgaatgtagcgcatctgctcccgtcgccgccgccgtcccgactagggaaagcatcaaagggtccttaagtgtcctactagacgatttacaagacctgagcgaggccattagtaaggaagaagcggtctgtcaaggggacaacttggacagatgtagttcaagtaacccacaaatgtcttcctag

SEQ ID NO: 3868 - DNA, 516 bp, Artificial Sequence
  Description of Artificial Sequence: Synthetic coding sequence
atgttcccccccagcggccagtgggaccagacccggggcgtggtggtggtttctgcctgggagacggatcatctctgcttttgcaattcttccggatccaccggactgatcccccccagccacttccaggcccgcccgctaagcacccttcctcggatggctccaacctggctgagtgatatacctctggtacagccacctgggcatcaggacgttagtgaacggcgcttagatacacagaggccccaagtcactatgtgggagcgtgacgtgagttcagatcggcaggagcctggacggagaggcagatcctgggggctcgaagggagtcaggctctatcacagcaggccgaagttattgttcggcagttacaggaattgcgaaggcttgaggaggaggtcaggctcttgcgcgagacatccctgcaacagaagatgagactggaggcccaggccatggaactcgaggcacttgccagggccgaaaaagctgggagggctgaggcggagggatag

SEQ ID NO: 3869 - DNA, 516 bp, Artificial Sequence
  Description of Artificial Sequence: Synthetic coding sequence
atgttcccccccagcggccagtgggaccagacccggggcgtggtggtcgtctctgcctgggagacggaccacctttgtttctgcaatagttctggatccacaggtctcatccctccatctcacttccaagctcggccactaagtacattgcctaggatggccccaacttggctgagcgacatcccgctcgttcagccacctggccaccaggatgtgtcagaacgtcggcttgacactcagcgcccacaggtgaccatgtgggaaagggacgtgagctcggaccggcaggaaccaggccgtagaggtcggagctggggcttggaagggagccaggcgctgagccagcaagccgaggtcatcgttcgccagctgcaagagctcaggagactcgaggaggaagtgcgcctactccgggaaacatcattacagcaaaagatgcgtttggaggcacaggccatggagctcgaggccctggcccgggctgaaaaggctggccgcgccgaagcagaggggtag

SEQ ID NO: 3870 - DNA, 2190 bp, Artificial Sequence
  Description of Artificial Sequence: Synthetic coding sequence
atgttcccccccagcggcagcaccggcctgatcccccccagccacttccaggccaggccattgtctactctgcctcgcatggcacctacttggttgtctgacatccccctcgtccagccacccggtcaccaggatgtgagcgagaggcggctcgacactcaacgaccccaggtaacaatgtgggagagggatgtatccagcgatagacaggagcccggtagacggggaagatcttgggggttagaggggtcacaggcactgtcccagcaggctgaagtcatcgtgcgccagctgcaagagctgaggtggctggaggaagaggtctggctcctccgcgaaaccagcctgcagcagaaaatgaggttggaggcacaggccatggagctggaggcattggcaagggcggagaaggctggacgtgccgaggctgagggactcagagcagctttggctggggctgaggtggtcaggaagaacctggaagaaggaaggcagcgggagctagaggaggtccagagactccatcaggagcagctgtccagtctgacacaggcacacgaagaagccctgtccagcctcacctctaaggcagaggggctggagaagagtctcagcagtctggagactcgtcgcgctggcgaggcaaaggagttggcagaagcccagcgggaagccgagctgctgaggaagcagctgagtaagactcaggaagatcttgaagcgcaagtgacattggtggagaacctccgtaaatacgtaggagaacaggtgccttctgaagttcactctcagacatgggagctggaaaggcagaagctgctggagacaatgcaacacctgcaggaagatcgcgattctctgcacgccactgcagagttgctgcaggtgagggtgcaatctctcacacacatcctggccctgcaggaggaggagctgacacggaaggtgcagccaagtgactcattagagccagagttcacccgtaaatgtcaatctctgctcaacaggtggcgggagaaagtgttcgccttgatggtccaactgaaagcccaggagctggagcactctgactccgtcaagcagctgaaagggcaggtcgcctctcttcaggagaaggtcacgtcccagtcacaggaacaggccatcctgcagcggagcttgcaggataaggctgcagaagtggaggtggaacgaatgggtgctaaaggtttgcagctggagctcagtagagctcaggaggcccgcaggtggtggcagcagcagaccgcatctgccgaggaacagctacggttggtggtaaacgcggtgagctcctgtcctcttcccccgccagttaccgacgtcagcctcgagttacagcagctccgggaggagcgtaatagactcgacgcagaactccagctctctgcccggttgattcagcaggaggtgggacgggcgcgggagcagggagaggctgagcgccaacaactttcaaaagtggctcagcagctggagcaggagttacagcaaacacaagagtccctcgcgtctctgggcctgcaactggaggtagcaaggcagtgtcagcaagaatccacagaggaggcagcctctttacggcaggaattaactcaacaacaggagttgtatggccaggccctgcaagagaaggtagcggaagttgagacccgtctgagggaacaactgagtgataccgaacgccgtttgaacgaagccagaagggagcacgctaaagcagtggtatctctcaggcagattcaacgacgagccgcacaagaaaaggagaggtcacaggaattgcgcaggctccaggaggaagctcggaaagaagagggccaacgtctcgccagacgactgcaagagctggaaagggacaaaaatctaatgctggccactctccaacaagagggtcttctctcgaggtataagcagcaacggcttctcaccgtgttaccatctctgctcgacaaaaaaaagtctgtggtttcgagtccacgaccaccagaatgctccgcttcggctccagtggccgcagccgtgccaacgcgtgagagcatcaaggggtccctcagcgttctattggatgatttgcaggacttgagcgaggccattagcaaagaggaagctgtgtgccagggcgataacctcgaccggtgcagctcgtgtaacccccagatgagttcttag

SEQ ID NO: 3871 - DNA, 2349 bp, Artificial Sequence
  Description of Artificial Sequence: Synthetic coding sequence
atgttcccccccagcggcagcaccggcctgatcccccccagccactttcaggcccgcccactgtcaacgctacctaggatggcgccaacttggctgagcgacatcccactagttcagcctcctgggcatcaggacgtgagtgagagaaggctggatacccaacggcctcaagtgacaatgtgggagcgagatgtgtccagcgatagacaagaacctgggcggcggggccggtcctggggcctcgagggctctcaggcgctgtctcaacaggccgaagtgattgtgcggcagcttcaggagttgagatggctggaggaggaggtgtggctcttgcgggaaacgtcgctccagcagaagatgagactggaagcgcaagccatggagctggaggcgttagcccgcgcagagaaggctggcagagctgaagcagagggcctgagggcagccctcgcaggagcagaggtggtgcggaaaaatcttgaggagggcaggcagcgagaactggaagaagttcaacggctgcaccaagagcagttgtcctcactcacccaggcacacgaagaggccctcagttctctgacctctaaggccgaagggttagaaaagagcctgtcctctcttgaaactagacgcgccggtgaggccaaggagctcgccgaggctcagcgcgaggcagagctacttcggaaacaattgtcaaagacccaagaagacctagaagcccaagtgactctggtggagaacttaagaaagtacgtgggcgagcaggtgccctccgaagtgcactcccagacttgggagctcgaaaggcagaagctgttggaaaccatgcagcatctgcaggaggatagggacagcctgcatgccactgccgagctgctgcaggtcagagttcagagcttgacccatatcttagccttgcaggaggaggagctgactagaaaagtgcaaccaagcgactccctggagcctgagttcaccagaaagtgccaaagtctgttgaaccggtggagggaaaaagtgttcgcacttatggttcagttaaaggctcaggaactggagcactccgatagtgtaaagcagctcaagggccaagtcgcctcgctccaagaaaaagtaacatcacagtcccaagagcaggccattctccagcggagtctgcaggacaaggccgcagaggtcgaggtcgaacgtatgggagccaaggggctccagctggagctgagtcgagcacaagaggcaagaaggtggtggcagcagcagaccgcctctgccgaagaacagctgaggttagtggtgaacgccgtttcttcatcccagatctggcttgagacgactatggcaaaagtcgaaggcgcagccgctcaactgccaagtctgaacaatcggttgtcctacgctgtgcgtaaggtgcacactattcgcggtctaattgcccgcaaattagcactggctcagttgaggcaggaatcctgtccattgcccccacccgtgaccgatgtatccctagaactgcaacagttgcgggaggagcggaatcgattagacgctgagctgcagttatcagcacggctcatccagcaggaggtaggccgcgctagagagcagggcgaggccgagaggcagcagctctccaaagttgctcagcaacttgagcaggaactgcagcagactcaggagtctttggcctctttgggactgcagctcgaagtggcccgtcagtgccagcaggaatccacagaggaggctgcaagcctcagacaagagttgactcaacagcaggagctgtatggccaagctctacaggaaaaggtcgcagaggtggaaacgcgcctccgggagcagttgtccgacactgaaaggagactgaatgaggctcgccgggagcacgccaaagccgtcgttagcctgaggcaaattcagaggagggcagcacaggagaaggaacgttcccaggaattacgccgcttgcaggaggaggcccgtaaggaggagggccagcggctggctcggcgcttacaggaattagagagagacaagaacctcatgctggcaacactccagcaggaaggtctcctgtcccggtacaaacagcagcgtcttcttactgtcttgccctcgctgctggacaaaaaaaagagcgtggtgtcttccccacggccacccgaatgttcggcttcagcaccggtggcggcggccgtgccgactcgagagagcattaaggggtcgctgtctgttctgttggatgaccttcaggacctctccgaggccatctctaaagaagaagctgtatgccagggtgataatctggacagatgtagctcatgtaaccctcagatgagttcatag

SEQ ID NO: 3872 - DNA, 2349 bp, Artificial Sequence
  Description of Artificial Sequence: Synthetic coding sequence
atgttcccccccagcggcagcaccggcctgatcccccccagccactttcaggctcgccctctgagcactttgccgcgcatggctcctacatggctgagcgatattcctttggtgcagcctcctggacatcaggatgttagcgagcgtcgcctggatactcagcggcctcaggtgactatgtgggaaagagatgtgagctctgaccggcaggagcctggacgacgcgggcggtcctggggcctggaaggttcgcaggcactgtcccaacaagccgaggtaattgttcgccagttacaggaactgagaaggctggaggaagaggtgcgtttattgagagaaacctcgttgcagcagaagatgagactggaggcacaagccatggagctcgaagcattggcaagagccgagaaggccggaagggcagaggcagagggactccgcgctgctcttgcgggggccgaggtagtgaggaagaatctggaggaaggcagacagcgggaactggaggaagtgcagcgattgcaccaggagcagttgagttctcttacccaggcacatgaggaagcgctgtcaagtctgactagcaaagcagagggactggaaaagtctctgtcttcgctcgagacacgccgagccggcgaagcaaaggaactggcagaagctcagagagaggcagaactccttcggaagcagctgtctaaaacacaggaagatttggaagctcaagtgactctcgttgaaaatctgagaaaatacgtcggagagcaagtcccctccgaggttcactcgcagacctgggaacttgagcgccagaaactgctggacactatgcagcacctgcaggaagatcgagacagcctgcatgctacggccgagttgctgcaagtcagagttcagtcactcacgcacatcttggccttgcaggaagaagaactgacgcgcaaagttcagcctagcgactccctggaacctgagtttacaaggaaatgtcaaagtctgctgaataggtggcgggaaaaagtttttgctttgatggtgcagctgaaagctcaagaactcgaacactcggactctgtcaaacagttgaagggacaggtcgctagtcttcaggagaaggtcaccagccagtcgcaggaacaggcgatattgcaaagaagcctccaggacaaggccgccgaggtggaagtggaacgtatgggggcgaagggcctgcagctggagctgagcagagcacaggaggctaggcgccgttggcaacagcagactgcctccgctgaggaacagctcaggctagtggtgaatgctgtgtcaagctcccagatctggctcgagaccaccatggctaaagttgaaggtgctgctgcccagctgccaagtttgaataaccggttatcttatgccgttagaaaggtgcacacaatacgaggcttgatcgccagaaagctggccctcgcccaactgaggcaggaatcatgccccctgcctccacctgtgacagacgtcagcttggagctgcaacagctgagggaagagagaaaccgcctggacgcagaactccagctgtcagcgaggctgatacagcaggaggtcggtagggccagagaacaaggagaagccgaacggcagcagctgtcgaaagtcgctcagcagttagagcaagagttgcagcagactcaggaatccctggcctccctgggtctccagcttgaagtcgctagacaggggcagcaagaaagtacggaggaagccgcaagccttcgtcaggagcttacccagcagcaggagctgtacggccaggccctccaggagaaggttgcagaggtggagacccgactgcgagaacaactctcggacacggaacgacgtctgaacgaggcaaggagagagcatgccaaagccgtcgtatccctacgtcagatacagcggcgcgccgctcaggagaaagagcgatcccaggaacttcgccgcctccaagaagaggcccgaaaggaagagggacagcgcctggcacgccgtcttcaggagctggaaagggataagaatctcatgctcgcaacactgcaacaggaagggcttctgtctaggtataagcagcagcgcctcttaacagtactccccagcctgttggacaaaaagaagtcagtcgtgtcatcaccgagacctcctgaatgctctgcgagcgccccagtcgcggcagccgtgcctactagggagtctatcaagggcagtctgtccgtgcttttggatgacctccaggacttatccgaggccatctccaaggaggaggctgtgtgccaaggagataatttggatcggtgttctagctctaaccctcagatgagtagctag

SEQ ID NO: 3873 - DNA, 384 bp, Artificial Sequence
  Description of Artificial Sequence: Synthetic coding sequence
atgttcccccccagcggccagtgggaccagacccggggcgtggtggtggttagtgcctgggagacggaccacctctgtttttgtaattcatccgggtctaccgggttaattccaccgtcacacttccaagctagacccctctctacgctgcctaggatggccccaacatggttgtctgatattcctcttgtgcagccaccaggacaccaagacgtctccgaaagacgcctggacacacaacgcccacaggtcacaatgtgggagagagacgtctccagtgacaggcaagaaccgggccggcgggggaggtcttgggggctcgaaggaagccaagcgctttcacaacaggccgaagtgattgttcggcaactgcaagagctttag

SEQ ID NO: 3874 - DNA, 384 bp, Artificial Sequence
  Description of Artificial Sequence: Synthetic coding sequence
atgttcccccccagcggccagtgggaccagacccggggcgtggtggtcgtatccgcctgggaaacagatcatctttgtttttgcaactcaagcgggtccaccggcctgatcccgccaagtcacttccaagccaggccactaagcaccttgccgagaatggcccctacctggctgtccgatatcccactggtgcagccgccaggacaccaggatgttagcgaaaggagactggatacgcagcggccccaggtgacgatgtgggagcgcgacgtatctagtgatcggcaagagcccggacgacgtggccgctcatgggggctggagggctcacaggccctatctcagcaagccgaggtgattgtgcgccaactgcaggagttgtag

SEQ ID NO: 3875 - DNA, 516 bp, Artificial Sequence
  Description of Artificial Sequence: Synthetic coding sequence
atgttcccccccagcggccagtgggaccagacccggggcgtggtggttgtctctgcgtgggaaacagaccatctgtgtttctgtaatagttctgggtctaccggactgatcccaccttcccatttccaggcaaggcccctttctacattaccgagaatggctccgacgtggttatcagatattccactcgttcagccccctggccaccaggatgtgtctgaaagacgcctggacacgcagagaccgcaggtgaccatgtgggagcgagacgtcagttctgacagacaggaacccggcagacggggcagatcctgggggctggagggatcacaggccctgagtcagcaggctgaggtgatcgtgcggcagctccaggagctacgctggttggaagaggaggtgtggctgctccgcgagacaagccttcagcagaagatgagattggaagcgcaggcaatggaactcgaagctctggccagggccgaaaaagcaggccgtgctgaggctgaggggtag

SEQ ID NO: 3876 - DNA, 771 bp, Artificial Sequence
  Description of Artificial Sequence: Synthetic coding sequence
tgacggctggacgccgagctgcagctgagcgcccggctgatccagcaagaggtcggccgcgctcgggagcagggcgaggcagagcgccagcagctatcaaaggttgcccagcagctagagcaggagctgcagcagacccaggaaagcctggctagtcttgggcttcagctcgaggtggccaggcaagggcagcaagagtccacagaggaggccgctagcctccggcaggaactaacccagcagcaggaactgtacggccaggctctccaggaaaaggtcgcagaggtggaaactagactaagagagcaactgagcgacacagaacggagacttaatgaagcccgaagagagcacgccaaggccgtagtttctcttagacagatccagcgtagagccgcgcaggagaaggaaagaagccaggaactgcgcaggcttcaggaggaagcccgtaaggaagaagggcagaggctggcccggcggttgcaggaattggagcgagacaagaacctgatgctgcaaagactgttgacagttctcccctccctgcttgataaaaagaagagcgtggtgtcatcccccagaccacccgaatgttccgcctccgctcccgtggcagctgctgtccccactcgcgaatccatcaaaggcagcctgtccgtcctgttggacgatctccaggatctgagtgaggcgatctccaaggaggaagccgtgtgccagggggacaacctggaccgctgttcttccagcaatccccaaatgagttcctag

SEQ ID NO: 3877 - DNA, 2349 bp, Artificial Sequence
  Description of Artificial Sequence: Synthetic coding sequence
atgttcccccccagcggcagcaccggcctgatcccccccagccactttcaggcgcggcccttgtccacgttacccagaatggcccccacctggctgtcagacataccattagtacagcctccgggacaccaagatgtgtcggaacgcagactggatactcaaaggccacaggtcactatgtgggagcgagatgtgagttccgacagacaggagcctggacggcggggaagatcctggggtctcgaaggctcccaagcactttcacagcaagcagaggtgatagtgcgccaactgcaggagctaaggaggctggaggaggaggtccgcttgctaagagagacctctctccaacagaaaatgagattagaggctcaggccatggagctagaggcgttggctagggccgaaaaagctgggagggccgaagcagagggcctgcgcgccgcactggcaggcgccgaagtagtgagaaagaatctcgaagaaggacgccagagagaacttgaagaggtacagcggctgcatcaggaacagctgtcatccttgactcaggctcacgaagaggcactctcaagcctgacctcgaaggccgaaggcctggagaaaagtctctctagcctggaaacgcgaagagccggggaggctaaagaactggccgaggcacagcgggaggcggagctcctgagaaaacagcttagtaagacccaggaagaccttgaggcccaagtgacgctggtggagaaccttaggaagtacgtgggcgaacaggtgccttccgaagttcactcacagacatgggaattagaaaggcagaagctgttggatactatgcagcacctccaggaggatagagactctctccacgccaccgccgagctgctgcaagtgcgcgtccaaagtctcactcatattttagcgctccaggaggaagagctgacccgtaaggttcagccctccgattcactcgaacctgagttcactagaaaatgccagagcctgttgaataggtggcgagagaaagtgttcgccctgatggtacagttaaaggctcaggagctggagcatagtgattctgtgaaacagctcaagggccaggttgcgagcctgcaagagaaggtcacttcccagtcacaggagcaggccatattacaacgaagcttgcaggacaaagccgcagaagtcgaggttgaacggatgggcgcaaagggtcttcagctggagctgagtagagcacaggaggctcggcggcggtggcaacagcagactgccagcgcggaggagcagctccgtctggtggtcaatgctgtctcttccagtcagatctggctcgagaccactatggctaaggtggagggtgccgccgcgcagctaccttccctgaacaaccggctgagctatgcggtgcggaaagttcataccatcagaggcttaatcgcccggaaactggcgttagctcagctgcgtcaggagtcatgtccgcttccccctcctgtgaccgatgtgtcattggagcttcaacaattgagggaggaaagaaaccgcctcgacgctgaactgcagcttagcgcacgccttatccagcaggaggtgggcagagcccgcgagcaaggcgaggcggagcggcaacagctttcaaaggtcgcacaacagctggagcaggagctgcaacagacccaagaatcacttgcttcactggggctgcaactcgaggtcgcaaggcaaggccaacaggagtctactgaggaagcagcctcactgcgccaggaactgactcaacaacaggagttatatggccaggcgcttcaggaaaaggttgccgaagtcgaaacccgcctaagggaacagttatcagatacggagcgtcggttaaacgaggcccggcgggagcacgccaaggccgtcgtgtccctcaggcagatacagaggagggccgcacaggaaaaggagcggagccaggaactgcgaagattgcaagaagaggcacggaaagaagaaggacaaagactagcgaggcgcctacaagagttagagcgggataagaatcttatgctggccactctccagcaggaaggactcttgtctcggtataagcagcagcggctcctgactgtcctgccctctttattggacaagaagaagagcgttgtttcgagccctcggccccctgagtgcagcgcctcagcaccagtagcagcagccgttcctacgagagagagcataaagggcagtctgtctgtactccttgacgacctccaggatctaagcgaagctatttccaaggaagaggcggtgtgccaaggagacaatctggatagatgctcgtcaagtaacccgcagatgtcatcctag

SEQ ID NO: 3878 - DNA, 771 bp, Artificial Sequence
  Description of Artificial Sequence: Synthetic coding sequence
tgacggctggacgccgagctgcagctgagcgcccggctgatccagcaggaagtaggccgggcaagggagcagggtgaggctgagcgccagcagctgtctaaagtagctcagcagctggagcaggagctccagcagacacaggaatctcttgctagcttaggactgcaactcgaagtcgccaggcaaggccaacaagaatccacagaagaagctgccagcctgcgccaggaactgacacaacagcaagaactgtacggacaagccctacaagaaaaagtagcagaagtggagacgagactaagggagcagttaagcgataccgagcgtcggctcaacgaggccaggagagaacatgccaaagccgtcgtatcattgcggcagatacagcggagggcggctcaggaaaaggagaggtcccaggaactcaggcggctgcaagaagaggcaagaaaagaagagggccagcgattggcacgtaggctgcaggagctggagcgggacaagaatctgatgttgcaacggctgctcaccgtgctccccagtttgctggacaaaaagaagagtgtggttagctctcctaggcctcctgagtgtagcgcttcagcccccgtggccgcagctgtaccaacccgcgaatccattaaagggagcctttccgtgctcctcgacgatctgcaggacctctcggaagcgatttctaaggaagaggccgtttgccagggagataatctggataggtgtagctctagtaacccccaaatgtcttcctag

SEQ ID NO: 3879 - DNA, 771 bp, Artificial Sequence
  Description of Artificial Sequence: Synthetic coding sequence
tgacggctggacgccgagctgcagctgagcgcccggctgatccagcaggaagttggaagggcgagggaacagggggaagccgagagacagcagttatctaaggtggcacagcagctggagcaggagttacagcaaactcaggagtccttggcctccctcggcctgcagctggaagtggccaggcagtgtcagcaggagtccacggaggaagccgcctccctgagacaagagctcactcagcagcaggagttgtatggtcaggccctccaagagaaagtcgcagaggtggagaccagactgcgagagcaactaagtgacacagaacgtaggctgaatgaagcccggagggaacacgccaaggctgttgtgtcccttaggcaaatccagagacgagccgctcaagagaaggagcgctcccaggagctgcggaggctgcaagaagaggccagaaaggaggagggacaacgcctcgcccggcgtctgcaggaattagagcgcgacaagaacctcatgctccaaagattgcttaccgtgctgccatccttgctggataaaaaaaaaagtgtcgtttcaagtcctcgcccccctgaatgctccgcatctgcaccagtagcggcggccgttcccacgcgcgaatcgatcaagggctccctcagtgtcctgctggacgatctgcaagatttaagcgaggccatctccaaggaggaggccgtctgccagggagataatctggatcgatgtagttcttgtaacccccagatgtccagctag

SEQ ID NO: 3880 - DNA, 516 bp, Artificial Sequence
  Description of Artificial Sequence: Synthetic coding sequence
atgttcccccccagcggccagtgggaccagacccggggcgtggtggttgtgtctgcctgggaaacggatcatctgtgcttttgtaattccagtggatcgacgggcctaattccaccttcccatttccaagctagaccactttccacactccccaggatggcccctacatggctctccgacatcccgcttgtgcagccaccaggacatcaagatgtgagtgagcgacgccttgacactcagcgtccccaggtgactatgtgggagcgtgatgtcagctccgaccgccaggaaccaggacgacgaggaagatcatgggggctggaggggagccaggccctgtcccagcaggccgaggtgattgtaaggcagttacaggaattgcgtcggttagaggaggaagtaaggcttctcagggagaccagccttcaacagaagatgcggttggaagcacaggcaatggaactcgaggccctagcaagggccgagaaggctgggagagctgaggcggagggctag

SEQ ID NO: 3881 - DNA, 462 bp, Artificial Sequence
  Description of Artificial Sequence: Synthetic coding sequence
atgttcccccccagcggcagcaccggcctgatcccccccagccactttcaggcccgcccactcagcacactgcccagaatggctccgacttggttatccgacataccgctggtgcaacctcctgggcaccaggatgtctcagagcggcggctggatacccagcgcccacaggtcactatgtgggagcgggacgtctcttctgatcgtcaggaaccgggacgcaggggacgctcttggggattagaaggttcccaggccttaagccagcaggccgaggtgattgttcggcagctacaggaactgaggcgcctcgaagaggaggtccgccttcttcgggaaacttctttgcagcagaaaatgaggctggaggcacaagctatggagctggaggccttggcccgtgctgagaaagcaggacgggccgaagcagagggactccgagccgccttagctggcgcctag

SEQ ID NO: 3882 - DNA, 462 bp, Artificial Sequence
  Description of Artificial Sequence: Synthetic coding sequence
atgttcccccccagcggcagcaccggcctgatcccccccagccactttcaggcgcgacccctgtctactctgccacggatggcgcccacctggctttcagatatcccccttgtacagcctccaggccaccaggacgtgagtgagcgcaggctggatactcagaggccacaggtgactatgtgggagcgagatgtgagctcagatcgtcaggagcctggaagaagaggaaggtcttggggactggaggggtcacaggctttgagtcaacaggctgaggtgatagtcagacagctgcaagagctgagaaggttagaggaggaagtgaggctgttacgggaaacgtcacttcagcaaaaaatgagactcgaagcacaggcgatggagctagaagccctggccagagccgagaaagccggcagagccgaagccgaaggtctcagggccgcccttgcaggcgcctag

SEQ ID NO: 3883 - DNA, 2349 bp, Artificial Sequence
  Description of Artificial Sequence: Synthetic coding sequence
atgttcccccccagcggcagcaccggcctgatcccccccagccactttcaggcacgccctctcagcactcttcctcggatggctccaacatggctgagcgatatccctcttgtgcagccacccggccatcaggacgtgtccgagcgccggcttgacactcagcggcctcaggttacgatgtgggaaagagacgtaagctccgacagacaggagcctggccggcgagggagatcttggggtctcgaagggagccaggccctgagccagcaagccgaggttatcgtacgccagcttcaggaacttcggtggctggaggaagaggtatggctgttgcgcgaaacttcgctccaacagaagatgcggcttgaagcgcaggcaatggaattagaagccttagcgagggcagagaaagccggcagagccgaggctgagggccttcgggctgccctcgcaggggcagaagtagtacgcaagaacctggaagaaggccggcagcgcgagttagaggaggtgcagcggctgcaccaggaacagctttctagtctcacacaggcccacgaagaagctctgagctcactcacctccaaggctgaaggcctggaaaagtccctgtctagtctggagacaagacgcgctggtgaagcaaaggaattggccgaagcacaaagagaggccgaactgctgagaaaacagctgagcaaaacccaggaggacctggaagcccaggtgaccctggtggagaacctgcgcaagtacgtcggcgagcaggttccttcggaggtacacagccagacctgggagctggaaagacagaaactcctggagactatgcagcacctgcaggaggacagggactctctgcacgccacagctgagctccttcaggttcgcgttcaatctctgacgcatattttagccctgcaagaagaggaactaaccaggaaggtgcaaccatcagacagcttggagccagagttcactcggaaatgccagtctttattaaatagatggagggaaaaggtgtttgctttaatggtgcagttaaaggcacaggagctggaacattccgacagcgtgaagcagctaaagggccaggtcgcctccttgcaggagaaagtgacctcacagtcccaagaacaggccattctacagagatcgcttcaagataaggccgctgaggtggaagtggaacgcatgggtgcaaaggggctacagctagagttgagccgcgctcaggaggccagaaggtggtggcagcagcaaacagccagtgccgaagagcagctccgacttgttgtgaacgccgtgagttccagtcagatctggctagagaccacgatggccaaggttgaaggtgccgccgcccagctgccttcactgaacaatcggctaagttatgccgtgcggaaagtccacaccattcgcggactcattgccagaaagctcgcactcgcacagctgcgtcaggaatcgtgcccactcccccctcccgtgactgacgtttccttggaactgcagcagcttagagaggagagaaaccgcttggatgcggagctgcagctctcagccaggcttatacaacaagaggtgggacgggctcgtgaacagggcgaagctgagcgacaacagctgagtaaggtcgctcagcagttggagcaggagcttcagcaaacccaggagtccctggcttccctggggctgcagctggaagtggctcggcagtgtcaacaagaatcaaccgaagaagctgccagtctgcgacaggaactgactcagcagcaagagttgtatggacaagcattgcaagagaaagttgctgaggtcgaaaccagacttcgtgaacagctatccgacacggaacggcgcctgaacgaagcgaggcgcgagcatgcgaaggccgtcgtgtccctgcgtcaaattcagagacgtgccgcccaggagaaggagcgcagtcaggagctccgtaggctgcaggaggaggcccgtaaagaggagggacagcgcctggctcgacgcctccaagagttggagagggacaaaaacctgatgttagcaaccttgcagcaggaaggtctcctgagccgttataaacagcagagactgctgaccgtcctgccaagtctcctggacaaaaaaaaaagcgtcgtgtcctcaccaagaccccctgaatgcagtgcctctgcgcctgtcgccgccgcagtcccaacgagagagtctattaagggatctctgagcgtgctactggacgacctgcaggatctgtccgaggctatcagcaaggaggaagcggtttgccagggagataacctcgatcggtgtagctcctgcaacccacaaatgagctcatag

SEQ ID NO: 3884 - DNA, 651 bp, Artificial Sequence
  Description of Artificial Sequence: Synthetic coding sequence
atgtggccccacagcgccggcgcccggccctgggccagcaccctgaccgggaaggatccaagagtgatggcttgctggtgtttggacggcttgccttccggcctggcggagccttggagggagctgtggcggtggagaagcaggcccttgcattgcgtgccaccattttccccactagcccgttcttcgagagaccaccgcaacctgcggagacgcgtggaggccttgcctcggattctaaaaggtaatatcgatggctggagacagaatctggagccctccaacaacgttgagatgtttcctccgtcaggctctacagggctgattcctccaagtcatttccaagcacggccattgagcactctgcccagaatggcaccaacgtggttgtcagacatacctttagtccagcctcctgggcatcaggatgtgtccgaaaggcggctggatacccaacgtccccaggtaacgatgtgggaacgagacgtgagctctgatcgacaagagcctgggagaagaggtaggtcctggggcctggaaggaagtcaggcacttagccagcaggcagaggttatcgtgaggcagctacaagagttaaggaggctcgaagaggaggtccggctgttgcgcgaaacctctctacagcagtag

SEQ ID NO: 3885 - DNA, 357 bp, Artificial Sequence
  Description of Artificial Sequence: Synthetic coding sequence
atgttcccccccagcggcagcaccggcctgatcccccccagccacttccaagctcggcctctctccacactccctcgtatggctcccacttggttgtcggacatccctctggtgcagccgcccggtcaccaagacgtgtcggagcgccggctggacactcaaaggcctcaagtcacgatgtgggagcgcgacgtgagctctgatcgccaagagcccggtcggaggggaagatcgtggggactggagggatctcaggctctctcccagcaggccgaggtgatcgtgagacaactgcaggagctgcgacgccttgaagaggaagtgcggctactccgagagacgtcgctccagcaatag

SEQ ID NO: 3886 - DNA, 384 bp, Artificial Sequence
  Description of Artificial Sequence: Synthetic coding sequence
atgttcccccccagcggccagtgggaccagacccggggcgtggtggtcgtaagcgcttgggaaactgatcacctttgcttctgcaactcatccggctcaaccggcctaatcccaccgtcgcactttcaggccagaccactgagcaccctgccacgtatggctcctacttggctttccgacatcccactggtccagccaccaggacaccaggatgtctccgagagacgcttggacacacagaggcctcaggtgacaatgtgggagagggatgtaagctccgacaggcaggagcccggccgtagaggcaggtcctggggcctggaagggtcccaggcactgtctcaacaagcggaggtgattgttcgtcagctacaggaactgtag

SEQ ID NO: 3887 - DNA, 2190 bp, Artificial Sequence
  Description of Artificial Sequence: Synthetic coding sequence
atgttcccccccagcggcagcaccggcctgatcccccccagccacttccaggcaagacccttaagcacactccctcggatggcaccaacctggctcagcgacatccccctggtgcagccaccaggacaccaggacgtttccgagcgtcgcctggacacgcagcggccacaggtcacgatgtgggagagagacgtgagtagcgaccgacaggaacccggacgccgtggcaggtcatggggacttgaaggatctcaggctctgtctcaacaggccgaagtgatcgtgcggcagttacaggagctgcggcggctcgaagaagaagtgcggttgctgcgggaaacttccctgcagcagaaaatgcgactagaagctcaggctatggaattggaggctctggctagagcagaaaaagcgggacgggccgaggcagaaggactccgcgccgcgcttgctggggctgaggtggtgcgcaagaatctcgaggaaggaaggcagcgcgagctggaagaagtgcagagactacaccaagagcaattgtcttcattaactcaagcacatgaagaggccctttcatccctgaccagtaaggccgagggactcgagaagagtctgagctcccttgaaacgcgacgggccggcgaggctaaagagctggccgaggcacaaagagaagcagaactcctgcgcaagcagttaagcaagacgcaggaggatctcgaggctcaagtcacacttgttgagaacctccggaagtatgtgggcgagcaagtccccagtgaagttcattcccaaacatgggaattggagaggcagaagctactcgataccatgcagcatctgcaagaagatcgcgattcccttcacgccactgccgaattacttcaggttcgggtgcagtcactgacgcatatcttagccctacaggaagaggaattaactaggaaggtgcagccaagtgactcgttagagcctgagtttactaggaagtgtcagagcttgctgaatagatggcgggaaaaggtattcgctttgatggtacaactgaaggctcaggagctggagcattctgacagtgtgaaacaacttaaagggcaagtagctagcttgcaagaaaaggttaccagtcagagtcaagaacaggcgatcctccagaggtccctgcaggataaagcagctgaggtggaggtggaacgtatgggtgccaagggcttgcagctcgaactgagcagggcccaggaggcaagaagaaggtggcagcaacagaccgcaagcgctgaagagcaactccggctggtggtcaacgcagtcagttcgtgccccctgcccccccccgtcacggacgtgtccttagaactccagcagcttcgcgaagagcgcaaccggctcgacgccgaactgcagctgagcgcgagactgattcagcaggaggtgggccgcgctagagagcagggcgaggccgagaggcaacagctatctaaagttgcacagcagcttgagcaggagctccagcagactcaagagtctctcgccagcctgggtctccaactggaggtcgccagacaggggcaacaagaatccactgaagaagccgctagcctgagacaagaattaacccagcagcaggagctgtacggccaggctctgcaggagaaggttgcagaggtggaaacacgcctgagggaacagctcagcgacaccgaaaggcggctgaacgaagctaggcgggagcacgcaaaggccgtggtttctctgagacagatacaacggagggcggcccaggagaaagaacgctcacaggagctgcgtcggttacaagaagaggcccggaaagaggaggggcagaggctggcacggcgtctccaggagctggaacgagacaagaaccttatgttagcgactcttcagcaggaaggcctgttgagccgttataagcagcagcggttactaactgtgctgcctagcctactggataagaaaaagagcgtagtgagcagcccccggccgccagagtgcagcgcctccgccccagtggcagccgccgtgcccaccagggaaagcatcaagggctctttgtcagttctgctggatgacttgcaggacctgtccgaagccatatccaaggaggaagcagtatgtcagggggacaacctggacagatgtagctccagcaatccccagatgtctagctag

SEQ ID NO: 3888 - DNA, 951 bp, Artificial Sequence
  Description of Artificial Sequence: Synthetic coding sequence
atgttcccccccagcggccaccaggacgtgagcgagcggcggctggacactcagcgaccgcaagtaacaatgtgggagcgagacgtgagttccgaccgacaggagccagggcgacgagggagaagctggggactggagggatctcaggccctctctcagcaggctgaagtgatcgttcggcaactgcaagagctccggcggctcgaagaagaggtgagactcctgagagaaacaagcctgcagcagaagatgagattagaggcacaggccatggagcttgaggcactggctcgggccgagaaggcaggaagagccgaggccgagggcttacgggcagcactggccggagctgaagtcgtgcggaagaatctcgaggagggaagccagcgggaactggaagaggtgcagaggctgcatcaggaacagctcagttctcttacccaagcccacgaagaggccctcagtagtttaacatccaaagccgaggggctggagaagtctctaagcagcctggagaccaggcgggcaggggaagctaaggagctggccgaggcccagagggaagcagaacttctcaggaagcagctctccaaaacgcaggaagacctggaggcacaagtcacactggttgagaacttgagaaaatatgtcggtgagcaggtgcccagcgaagtgcacagccagacgtgggagcttgagcgccagaagctgctggagacgatgcaacatctgcaggaggatagagattcccttcacgctactgcggagctgctccaggtacgcgtgcagagcctcacacatatcctggccctgcaggaggaagagctgacccggaaggtacagcccagcgattccctggagcctgaatttactcggaagtgccaatccttgcttaaccgctggcgcgagaaagtatttgccctgatggtccaacttaaggcacaggaatag

SEQ ID NO: 3889 - DNA, 771 bp, Artificial Sequence
  Description of Artificial Sequence: Synthetic coding sequence
tgacggctggacgccgagctgcagctgagcgcccggctgatccagcaagaagtgggccgtgcccgtgaacagggcgaagccgaacgacagcaactgagtaaggttgcacaacagcttgaacaggagctacagcaaactcaggaatccctggctagtctgggactccaacttgaggtcgccagacaggggcagcaggagagcacggaggaggctgcaagcctccggcaggagctgacccagcagcaagagctgtacggtcaggccctgcaagagaaagtcgccgaagtggagaccagattgagagagcagctttccgacaccgaacgacgtcttaatgaagcccgcagagagcatgccaaggccgttgtgtccctcaggcagattcagaggagagcagcccaggagaaggagcgatcccaagagcttaggcgcctgcaggaagaggcgagaaaagaggaaggccagcgccttgcacgcaggctgcaagaactggagagagacaagaacctcatgttgcagcgactgctgactgtactcccatctctgctggataagaaaaagtcggtagtctcatcacccaggcctccagaatgctctgcctcggccccagtcgcggccgcagttccgacccgcgagagtatcaagggatcccttagcgtgctgcttgacgatttgcaggatctatccgaggctatcagcaaggaggaggcagtgtgtcagggagacaacctagacaggtgtagttcatcaaatccacaaatgagctcttag

SEQ ID NO: 3890 - DNA, 357 bp, Artificial Sequence
  Description of Artificial Sequence: Synthetic coding sequence
atgttcccccccagcggcagcaccggcctgatcccccccagccactttcaggctcgtcccctctcaacactgccacggatggcccccacctggttgtctgacatccccctagtccagccacccgggcatcaggacgtgtccgagagacggttggacacacagcggccccaggttactatgtgggagagagacgtaagttcagaccgacaggagcccggtagacgaggaagaagctggggacttgaggggagccaggctctgagtcagcaagcagaagtcatcgtgcgacaactccaagaacttcgtcgacttgaggaagaagttcgcctgttgcgggagacatcactacagcagtag

SEQ ID NO: 3891 - DNA, 2349 bp, Artificial Sequence
  Description of Artificial Sequence: Synthetic coding sequence
atgttcccccccagcggcagcaccggcctgatcccccccagccactttcaggcccgccccctgtcaactctgcccaggatggcaccaacatggctttcggatataccactggtccagccccctgggcaccaggacgtgtcggagaggcggctggatactcagcggcctcaagtgaccatgtgggagcgcgacgtaagctccgacaggcaagaaccgggcaggcgggggaggagctggggcctcgaaggatcccaggccctgtctcagcaagccgaagtaatcgtccgacaacttcaagagctcaggcgattggaggaagaggtgaggctgcttcgggaaaccagcttacagcaaaaaatgaggctggaagcacaggcaatggagctggaagcattggcgagggctgaaaaggcaggtcgggccgaggccgaggggctgagggccgcattagcaggggccgaggtggtcaggaagaacctcgaagaaggccggcagagagaactggaagaagtccaaaggctccaccaggaacagctttcaagtctgacccaggctcacgaagaggctcttagttctttgacatccaaagccgagggtctggaaaagtcattgagttccctggagacgcggagagctggagaagctaaagaactagccgaggcccagagggaggcggaactattacggaaacagctatccaaaacacaagaagatctcgaggcccaggtgacgctcgtcgagaacttgaggaaatacgtgggcgaacaggtgccttctgaagtgcattctcaaacctgggagctcgagcgccagaaactcctggacactatgcagcacctccaggaagaccgagactcccttcatgccaccgcagaattactgcaggtccgcgtccagtctctgactcacattcttgcgcttcaggaagaagaattgaccagaaaagtgcagccctcggactcgctggagccagagtttacccgcaaatgtcagtcactcctaaaccgttggagggagaaagtattcgccctgatggtccaactgaaggcacaagaactcgagcacagcgattccgtcaagcagcttaagggccaggtcgccagcttgcaggaaaaagttactagtcaatcccaagaacaggctattctacaacgcagcctgcaagacaaagccgctgaggtcgaagtcgagagaatgggcgctaaagggcttcaactcgagttgtcccgagcccaagaagctaggcggaggtggcagcagcaaaccgcatccgccgaggaacagctaagactggtagtgaatgctgtgtctagctctcagatttggctagagacaactatggcaaaagttgagggggctgcggcccaactgcctagcctgaacaaccgactaagctacgctgtccggaaagtacacactatacgggggctgatagctagaaagctggccctggcccaattaaggcaggaatcttgcccactccccccccccgtgaccgacgtgtctctcgagttacagcaattgcgggaagagcgaaatcgcttggatgcagagttgcagctgtccgcccggctgattcaacaggaggttggaagggctcgcgagcaaggagaagctgagcgccagcagctgtcaaaagtggcacaacagttggaacaggagctccagcagactcaggagtcattagctagtttggggttgcagttggaagtggccagacaaggccagcaggaatcaaccgaagaagcagcctctctaagacaggaactgacccaacaacaggagctctacggccaggccctgcaggagaaagtggctgaggtggaaacccgccttcgggagcagttgagcgacacagagagacgtctgaacgaagcaagaagagaacacgccaaagccgtggtgtctcttcgccaaattcagcgcagggctgcgcaagagaaagagaggtcgcaggaactaagacggttgcaggaagaggctcgcaaagaggagggacaacgactggcacgtcgccttcaggaactggagcgcgataagaacctgatgctagctactttgcagcaagagggactactgagtcggtataagcaacagcggctgctcaccgtgctgccgtccctattggacaagaaaaagagcgtggtgtcgtcccccaggccacctgagtgcagtgccagtgcacccgtggctgctgctgtgccgactagagaaagtatcaaaggctccttgagtgtgctgctcgatgacctacaggatctctctgaagcaatctccaaggaagaggccgtttgccaaggagataacttagaccgatgcagcagttcaaaccctcagatgagctcgtag

SEQ ID NO: 3892 - DNA, 384 bp, Artificial Sequence
  Description of Artificial Sequence: Synthetic coding sequence
atgttcccccccagcggccagtgggaccagacccggggcgtggtggttgtgagcgcatgggagacagaccatctgtgtttctgtaattcttccggttcaacaggactgatacctcctagtcactttcaggcacgcccactgtccactctcccaaggatggcccccacttggctctctgacatacctctcgtgcagcctccgggccatcaagacgtgtcagaacgccgattggacacccagcggccccaggtgacaatgtgggaaagggatgtgtccagcgacaggcaggagcctggtcgaagaggaaggtcttggggactggagggctctcaggccctcagccagcaggccgaggtgatagtgcggcagctgcaagaactgtag

SEQ ID NO: 3893 - DNA, 462 bp, Artificial Sequence
  Description of Artificial Sequence: Synthetic coding sequence
atgttcccccccagcggcagcaccggcctgatcccccccagccactttcaggcccgaccactgagcactttgccgcggatggcaccaacttggctaagtgatattccgctcgtgcagccgcctggacaccaggatgtatccgagcggagactagatacgcagcgcccccaggtcacaatgtgggagcgggacgtgtcctctgaccgtcaggaacctgggcgaaggggtcgctcctgggggctcgagggcagccaagcactgtcccagcaggccgaggtgatcgtgcggcagcttcaggagctgagatggttggaggaggaggtatggcttctacgagagacttccttgcagcagaaaatgaggctcgaggctcaagctatggaactggaggccctggcccgcgctgaaaaggcagggagagccgaggcggaaggcctgcgcgcagccctggcgggtgcctag

SEQ ID NO: 3894 - DNA, 384 bp, Artificial Sequence
  Description of Artificial Sequence: Synthetic coding sequence
atgttcccccccagcggccagtgggaccagacccggggcgtggtggtagttagcgcctgggagacggatcatctgtgcttctgtaatagctcaggcagtacaggcctaatccccccaagtcacttccaagcgcgacctctttccactttgcctcgcatggccccgacctggctgtccgatatccccctggtccagccacctggacatcaggacgtaagcgagcggcgactcgacactcagcgacctcaggttactatgtgggaaagggacgtgtccagcgacagacaggaaccgggcaggaggggacggagctggggcttggagggctcccaggcacttagccaacaggcagaggtgattgtacgccaactgcaggagttgtag

SEQ ID NO: 3895 - DNA, 567 bp, Artificial Sequence
  Description of Artificial Sequence: Synthetic coding sequence
atgttcccccccagcggcagcaccggcctgatcccccccagccacttccaggccagacccctgtcaacccttcctaggatggcccctacctggctgtccgatatccctcttgttcagccacccggccatcaggatgttagtgaacggaggcttgatacacagcgaccgcaagtcaccatgtgggagagggacgttagtagcgacagacaggaaccaggcaggagagggcgcagctggggcctggaaggctcccaggctctttcacagcaggccgaagtgatagtccggcagttgcaggagttaagacgcctcgaggaggaagtgagactgctccgggagacatcattgcagcagaagatgcgcttagaagcacaggccatggaattggaggcactggccagagcggagaaggcaggtcgggccgaagctgagggactgcgtgcggcccttgctggggccgaggtcgtgagaaagaatctggaagagggacgtcagcgagagctcgaggaggtgcagagactgcaccaggagcagttgagcagcctgacccaggcgcatgaagagtag

SEQ ID NO: 3896 - DNA, 567 bp, Artificial Sequence
  Description of Artificial Sequence: Synthetic coding sequence
atgttcccccccagcggcagcaccggcctgatcccccccagccacttccaggcccggccactgagtaccctgccaaggatggcccctacttggctgtcggatatcccacttgtgcagccaccggggcaccaagacgtgtctgaaagaaggctggatacacagagaccgcaagtcacaatgtgggaacgtgatgtttcctctgataggcaggagccgggtagaaggggaaggagctgggggttggagggctcacaagcgctgtcgcagcaggcggaggtcatagttaggcagctgcaggagctgcggtggctggaggaagaagtttggctgctcagagagactagcctccagcagaagatgcgcctcgaggcacaagctatggagctggaagctctagcacgagccgagaaggccgggagagcggaagccgaaggcctcagagccgccctggcaggagccgaagtggtgcggaaaaacttggaagaggggcggcagagggaattagaagaagtccagaggctgcatcaggagcagctgagcagcttaacccaggcccacgaggagtag

SEQ ID NO: 3897 - DNA, 951 bp, Artificial Sequence
  Description of Artificial Sequence: Synthetic coding sequence
atgttcccccccagcggccaccaggacgtgagcgagcggcggctggacactcagagaccccaggtgactatgtgggagagggatgtatcatctgaccggcaggaaccaggacgaaggggaaggagttggggcctggaaggaagccaggctctgtctcagcaggcagaggttatcgttcggcagcttcaagaacttagacgcctggaggaggaggtaagactcctgcgcgagacatccctgcagcagaagatgcggctggaggcccaagccatggagctggaggccttggcacgggccgaaaaagctgggcgcgcagaggctgaaggcctgagagcagcactggctggagccgaagtcgtgcgcaagaatctagaagaggggaggcagagggaactggaagaagtgcaaaggttgcaccaggaacagctttccagcttgacgcaggcccacgaagaggcgctctccagcttgacatccaaagctgaagggctagagaagtctctgtccagcctggagacccggcgggcgggagaggctaaagaactggctgaagcccaacgggaggccgagctgctgaggaaacagctgagtaagacacaggaggatcttgaggctcaagtaaccctagtggagaacttgcggaaatatgtcggcgagcaggtgccatcagaagtgcacagccagacttgggaacttgaaagacagaagttgctggataccatgcagcacctacaggaggatagagactctctgcacgctactgcggaactgctacaagtgagagtacaatcactgacccacatcctggccctgcaggaagaggaattaacaaggaaagtccagcccagtgactccctggaacccgagtttacccgcaagtgccaatccctcttgaatcgatggagagagaaggttttcgctctgatggtgcaactaaaggcacaagagtag

SEQ ID NO: 3898 - DNA, 567 bp, Artificial Sequence
  Description of Artificial Sequence: Synthetic coding sequence
atgttcccccccagcggcagcaccggcctgatcccccccagccactttcaagctcgacccctttctaccttgcctagaatggcacccacctggctctccgacatcccgctagtgcagcctccaggtcaccaagacgtttccgaaagacgcctggatacacagcgcccacaggtcaccatgtgggaacgggatgtttctagtgaccggcaggaacccggacggagaggccggagctggggcttagagggctctcaggctctgagtcagcaagcggaagtgatcgtgagacaattgcaggagctacgaagactggaagaggaggtgcgcttgcttcgggaaaccagtctgcagcagaaaatgaggctggaggcccaggcgatggaactggaggccctagccagggccgagaaggccggcagggctgaagccgagggtcttagagccgcgttagctggtgccgaagtggtgagaaagaacctcgaggaaggctcgcaaagagaattggaagaggtccagagattacatcaagagcagctgtcatccctcacccaggcccacgaggaatag

SEQ ID NO: 3899 - DNA, 2307 bp, Artificial Sequence
  Description of Artificial Sequence: Synthetic coding sequence
atgttcccccccagcggcagcaccggcctgatcccccccagccacttccaagcacgcccccttagcactctaccgaggatggcccctacctggctgtctgatatcccccttgtacaacctcctggccatcaagatgtcagcgagaggagactagacacccaacgcccccaggtcaccatgtgggaacgtgacgttagcagcgacagacaagaaccgggtagaaggggacgcagctgggggctggaaggaagccaggccctcagccagcaagcagaggtaatcgtgcgacaactgcaggagctgaggcgcctcgaggaggaagtgagactcctgagagagactagccttcagcagaagatgcggcttgaagcccaggcgatggagttggaggccctggcccgagcagagaaggccggtcgagcagaggccgaaggcctccgtgccgccctcgccggcgccgaggtggtgcgcaaaaacctggaggaaggaagtcagcgcgagctggaagaagtccagagactccatcaggagcagctgagctccctgacacaagcccatgaggaagccctgagctccttaacaagcaaggctgagggcctcgaaaagtctctttcctcactggagacccgtagggcgggcgaagctaaggaactcgctgaggcccagagggaagcagaattgctccggaagcagctttccaagacccaggaggatctcgaagctcaggttacactggtggagaaccttagaaagtatgtgggtgagcaggtgcccagcgaagtgcattctcaaacctgggagttggagcggcagaagcttctcgaaaccatgcagcacttgcaggaggaccgagacagccttcatgctacggcggaactcctacaggtaagagtgcagagcttaacccacattttagcgctccaagaagaagagctgactagaaaggtccaaccctccgatagtttggaacctgaattcactaggaaatgtcaaagtctgcttaaccgctggagggagaaggttttcgctctcatggtgcaactgaaggctcaagaactggaacacagcgacagtgtgaagcagctaaaaggacaggttgccagcctccaagaaaaagtcacttcgcagtcccaggagcaggctatcctccagcggagcttgcaagacaaagctgctgaagtggaagtggaaaggatgggagcaaaaggtctgcagctggagctgtcacgcgcgcaggaggctcgccgtagatggcagcagcaaactgcctctgccgaggaacagctccgcctggtcgttaacgccgtgtcctcgagccagatctggctcgaaacaacaatggctaaggtggagggggctgctgcccagttaccgtctctcaacaataggctcagttatgctgtccgcaaagttcacactatcagaggactcatcgctcggaaactggccctggctcaactgcgccaagagtcctgcccacttcccccaccagttaccgacgtgagtttagagttgcaacagttgcgcgaggagcgtaaccgccttgatgccgagttgcaattgtccgcccgcctaatccaacaggaggttgggagggccagagagcaaggggaagccgagcgccagcagctgagcaaagtcgcccagcagctagaacaagagctgcagcagactcaggagtcactagcctctttagggttacaactcgaagtagcaaggcaggggcagcaggagagcacagaagaagcggcatcactgaggcaagagctaacacagcagcaagaactgtacggccaagccttgcaggaaaaagttgccgaagtcgaaacccggctgcgggagcaactgtctgatactgaaagacggttgaatgaggcacggagagaacatgctaaggctgtcgtgtcactgcgccagattcagcggcgggcggcacaggagaaggagagatcacaggagttacgcaggctccaggaagaagctcgcaaagaggaaggccagaggctggccaggagactgcaggaactggagagagataagaacctgatgctccagagactgctcacggtgcttccttccctgttagacaaaaagaaatctgtggtgtccagtccccgcccgcctgaatgcagtgcgtcggcccccgtcgctgctgctgtgcccactcgcgaatcgatcaaagggagcctcagcgtgttactcgatgaccttcaggatctcagtgaagccatttctaaagaagaggcagtttgccaaggcgacaacctagataggtgttcaagcagcaatccacagatgagctcatag

SEQ ID NO: 3900 - DNA, 951 bp, Artificial Sequence
  Description of Artificial Sequence: Synthetic coding sequence
atgttcccccccagcggccaccaggacgtgagcgagcggcggctggatacacaacgtcctcaagtcacaatgtgggaaagggacgttagcagtgataggcaagaacccgggcgccggggtcgctcgtgggggctagaaggctcccaggccctttctcagcaggcagaggttatcgtccggcagctgcaggaactgcggtggctagaagaggaggtatggctgctccgcgagacatcgctgcagcagaagatgcgcctggaggcacaggcaatggagctggaagccctggcccgagccgaaaaggcaggaagagcagaggctgagggactgcgggctgcattggccggtgcggaagtggtccgtaaaaacttggaagagggaaggcaaagagagctggaggaggtccagcgcctgcatcaggagcagctttcaagcctgacccaggcccacgaggaggcgttatcctctctgacctctaaggcggaggggcttgagaaaagcctctcgagtctggagaccagaagggcaggagaggccaaagaactggcagaagcccagcgagaggccgagcttttgcgcaagcaactaagcaagacccaagaagatctggaagcacaggtgaccctcgtggagaaccttcggaagtatgtgggcgagcaggtccccagcgaggtacattcacaaacctgggaattagaaaggcagaagttactagaaactatgcaacacctgcaggaagatcgggatagcctacatgcaaccgccgagttgttgcaggtacgtgttcaaagcctaactcacattctcgcattgcaggaggaagagctgacacggaaagtacagccgtctgactctctggagcccgagttcaccagaaagtgccagagtctgctgaatcgctggagagagaaagtttttgcactcatggtccagctgaaagctcaagaatag

SEQ ID NO: 3901 - DNA, 357 bp, Artificial Sequence
  Description of Artificial Sequence: Synthetic coding sequence
atgttcccccccagcggcagcaccggcctgatcccccccagccacttccaagcacgtccactgtcaacactgcctagaatggcacccacctggctgtctgacatccctttggtgcagccaccaggacaccaggacgtgtctgagcgacggctggacacacagcggccgcaggttacaatgtgggagagagacgtctccagtgaccgtcaggagccagggaggcgcgggagaagttggggtctagaaggttcgcaggctctgtctcagcaagctgaggttatcgtgcggcagctgcaggagctgcggtggctggaggaagaggtttggttgctccgcgagacttctcttcagcaatag

SEQ ID NO: 3902 - DNA, 2349 bp, Artificial Sequence
  Description of Artificial Sequence: Synthetic coding sequence
atgttcccccccagcggcagcaccggcctgatcccccccagccacttccaggcaagacccctaagtactctgcccaggatggctcccacctggctgtcggatatacccctagttcagccgcctgggcaccaagatgtatccgaacgccgactcgacactcaaaggcctcaagtgacaatgtgggagcgtgacgtctcatcagaccggcaggagcccgggaggcgcggcaggtcctggggactggaagggtcacaggctctgtctcagcaggctgaggtgatagtgcggcagctccaggagcttagacggcttgaggaagaagtccgactgctcagggagacctcactgcagcagaagatgagacttgaggctcaggccatggagctggaagccttggcaagagctgagaaggctgggcgagcagaggctgagggcctgagagccgccttggccggggccgaagtggtgcgcaagaacctggaggaaggtcgacagcgagaacttgaggaagtccagaggctgcatcaagagcagctgagttcgctcacccaggctcatgaggaggctctttcatcccttactagtaaagctgagggacttgagaaatcacttagctcactggagacacgccgcgcaggcgaggcgaaggagctggcggaagcccagcgggaagccgaactactacgtaagcaattgtccaaaacgcaggaagacctggaagcccaggtaaccctggttgagaatttacgcaaatacgtcggcgaacaggtcccctccgaggtgcactcccaaacctgggagctggaaagacagaagctgttggacactatgcaacatcttcaggaggaccgggattctctgcacgcaaccgctgaactgttacaggtacgcgtgcagagcctaacacatatcctcgccttgcaagaagaggagctgactcgcaaggttcagccttcagactcattagagcctgagtttacaaggaaatgccagtccctgctgaaccggtggcgagagaaggtgtttgctctgatggttcaactaaaagctcaagaacttgagcacagcgactccgtgaagcagctcaaggggcaggtagctagcttgcaggagaaggtcacttcccagtcacaagagcaagccatcctgcagcgatctctccaggataaagctgcagaggtggaagtagagcggatgggggccaagggactccagcttgaactgagccgagcccaggaggcacggaggcgatggcaacaacagaccgctagcgctgaggagcagctccgccttgtggtgaatgctgtaagttcatcccagatttggttggagaccactatggccaaggtggagggcgctgccgcacagctgccctccctcaataaccgtctgagctacgcagtgcgcaaggtgcatacgatacggggcctcatcgccagaaagttggcactggctcagttgagacaagaatcttgccctctgccacctccagtcaccgatgtatccttggagctgcagcagttgcgcgaggagcggaacagactggacgccgaattgcagctgagcgcgaggctgattcagcaggaagttggtagggccagagagcagggcgaagcggagcgccaacaattgagcaaagtcgcacaacagcttgagcaggaactgcaacagacccaggaaagcctggcaagcctgggacttcagttggaagtggcgcgccagggccagcaagagtccaccgaggaggctgcttctctccgccaggagttaacacagcagcaggaactgtacggccaggccttacaggagaaagtggcagaggtggagacgcgattgagagaacagctgtcggatacagagaggagacttaacgaagcaagacgcgagcacgccaaggctgtggtgtcactccgtcagattcagaggagggccgcccaggagaaggagcggtcccaggaactcagaagattgcaggaagaggcccgtaaagaggaaggacagcgtctcgcacgacgtcttcaggaacttgagagagacaaaaatctgatgctcgccactctccagcaggaaggcttgctttcacgatataaacagcagcgtctactgacagtactgcctagcctattagataagaagaagtccgtagtgagcagtcctcgtcccccggaatgtagcgcaagtgcccccgtagctgccgccgtgccaaccagagaatctatcaaaggctctctgagcgtgttactggatgacttacaggatctgtctgaagccattagcaaagaggaggccgtctgccagggggacaatcttgaccggtgttcctccagcaacccacagatgagtagttag

SEQ ID NO: 3903 - DNA, 567 bp, Artificial Sequence
  Description of Artificial Sequence: Synthetic coding sequence
atgttcccccccagcggcagcaccggcctgatcccccccagccactttcaggcacgccccctgtcgactctgcctcgcatggcacctacatggctgtcagacatacccttggtgcagcctcctgggcaccaggacgtttccgagcggaggctggatacccaacgccctcaggttaccatgtgggagcgagacgtgtcctctgatcgtcaagaacctggtcggaggggccggtcatggggactggaaggaagtcaagcgctgtcccagcaggccgaggtcattgtgcggcaactccaggagctccgacgtttagaggaggaggttaggttacttcgcgagacctctttgcagcaaaaaatgcgtctcgaggctcaggctatggaactggaagctctggcacgggccgaaaaggcaggccgcgccgaggcggagggactgcgcgctgctcttgccggcgccgaggtggttcgcaaaaaccttgaggagggcagacagcgagagctggaggaggtgcagaggctgcatcaagagcaactaagctctcttacccaagcccacgaggaatag

SEQ ID NO: 3904 - DNA, 576 bp, Artificial Sequence
  Description of Artificial Sequence: Synthetic coding sequence
atgttcccccccagcggccaccaggacgtgagcgagcggcggctggacactcagcgtcctcaggtcaccatgtgggagcgagacgtgagctctgaccgacaggaacccggtcgccgaggcaggtcttggggccttgaaggctcacaggcactttctcagcaggcagaggtgatcgttcgccagctgcaggaacttcgacggcttgaggaagaagtgaggctcctgagggagacatcccttcagcagaagatgaggctggaagctcaggccatggaactcgaagccttagcccgcgccgagaaggccggaagagcagaggccgagggcctgcgtgcagccctggccggcgcagaggtcgtccgcaagaacttagaagaggggagccagcgcgagctcgaggaggtacaaaggctgcaccaagaacagctgagctccctgacccaggcacatgaagaggctttaagctcccttacctcaaaggctgaggggttggagaaatccctatcttcgctagaaacccgcagggccggagaagccaaggaactggctgaagcccagagggaagcagagctctag

SEQ ID NO: 3905 - DNA, 567 bp, Artificial Sequence
  Description of Artificial Sequence: Synthetic coding sequence
atgttcccccccagcggcagcaccggcctgatcccccccagccacttccaggcacgccccctcagtacgctccctaggatggctcccacatggctgtccgatatcccactagtgcagccaccaggccaccaggacgtttcagagagacggctggacacccaacgcccgcaggtaaccatgtgggaaagagatgtgtcttccgatagacaggagccgggccgcagaggacgttcttggggactagagggctctcaggctttaagccagcaggccgaggtcattgtccgccagctccaggaactcagacgtctggaggaagaagtacgtttgctcagagagacctcattgcaacaaaaaatgcgcctagaggctcaagcaatggaactcgaggcattagcgcgggccgaaaaggcagggcgagccgaggcggaggggctccgcgccgcattggccggcgctgaggtggtgagaaagaacctggaggaagggtcccagcgcgaacttgaagaggttcaaagactgcaccaagagcagctaagctcgctcactcaggcacatgaagaatag

SEQ ID NO: 3906 - DNA, 951 bp, Artificial Sequence
  Description of Artificial Sequence: Synthetic coding sequence
atgttcccccccagcggccaccaggacgtgagcgagcggcggctggatactcagagaccacaggtgacaatgtgggaacgcgatgtgtctagtgacagacaggaaccggggaggcgcgggcgctcctgggggcttgagggtagccaggctctttctcagcaggccgaggtgattgtgaggcagctgcaggaactgcggtggttggaagaagaagtttggctcctccgggaaacctccctgcagcaaaagatgaggctggaagcgcaggcaatggaactggaggccctcgctcgcgctgagaaagcagggagagccgaggccgaaggcctgagggcggctttggcaggggccgaggttgtccgcaaaaaccttgaagaggggagacaaagggagctggaagaggtccagagactgcaccaggagcaactctcctccctgacccaggcacacgaggaggctttgagctcactgacttccaaggcagaaggactcgagaaatcactgtcatctttggagactagaagggcaggcgaggccaaggagctggctgaagcacagcgcgaggcagaattgctcaggaagcagctgtctaaaacccaggaggatctagaggctcaggtcacactcgtggagaacctgcgcaagtatgtaggcgagcaggtgcccagtgaggtgcactctcagacatgggaacttgaacgtcaaaaactcttagagaccatgcagcacttgcaggaggacagggactcattgcacgccactgccgagcttctgcaggtccgagtgcagagtctgacacacattctggctctacaggaggaggagctgaccagaaaagtacagccatctgactccttagagccagagttcaccaggaaatgccagagcctgctcaaccgctggcgcgagaaagtcttcgcactgatggttcaactgaaggcccaagaatag

SEQ ID NO: 3907 - DNA, 516 bp, Artificial Sequence
  Description of Artificial Sequence: Synthetic coding sequence
atgttcccccccagcggccagtgggaccagacccggggcgtggtggtggtctccgcctgggaaacagaccacctctgtttttgcaacagcagtggctcgactgggctcattcctccatctcactttcaggcccggcccctatccaccctccccagaatggctcccacttggcttagcgacatccccctggtgcagccccccggccatcaggatgtgagcgagcgaagactggatactcagaggcctcaggtgacaatgtgggagcgcgatgtgtcctctgaccgtcaagaaccggggcggaggggtcgtagctggggcttggagggttcacaggccttgagccaacaggcagaggtcatagtaaggcagctgcaggagctccgttggctcgaggaggaagtttggctcctacgggagacctcgctacagcaaaaaatgcgactcgaagctcaagcaatggagctggaagctctcgcgcgcgccgagaaggccggccgggcggaggctgaaggatag

SEQ ID NO: 3908 - DNA, 357 bp, Artificial Sequence
  Description of Artificial Sequence: Synthetic coding sequence
atgttcccccccagcggcagcaccggcctgatcccccccagccacttccaggcacgccccttgagtacactacctaggatggcacccacttggcttagtgatatcccactggtgcagcctcccggccaccaggacgtttctgagcgccgcctcgatacccagaggccccaagtcacaatgtgggagcgggacgtgtcctccgaccgtcaggagcctgggaggcgtggaagatcctgggggctagagggatcacaggccctgagtcagcaggccgaagttatagtgaggcagctccaggagcttagatggttagaggaagaggtatggcttctgagggagacgagtctgcagcagtag

SEQ ID NO: 3909 - DNA, 771 bp, Artificial Sequence
  Description of Artificial Sequence: Synthetic coding sequence
tgacggctggacgccgagctgcagctgagcgcccggctgatccagcaggaggtcgggagggccagggaacagggggaggctgagcgacaacagctctctaaggtagcccagcaactagagcaggagctgcagcagacacaggagagcttggccagccttggcctgcaactggaggtggctaggcagtgccagcaggagtcaaccgaggaggcagcgtctctgagacaggagttgactcaacagcaggagctttacgggcaggccctccaggagaaagttgccgaggtggagacccggttacgggaacagctgtcggacactgaacgacgactgaatgaagcacgcagggagcacgccaaggcagtggtgagcctgcggcagatccagagaagggctgcacaggaaaaagaacgctcgcaagagttgagacggttgcaggaagaggcgagaaaagaggaggggcaacgcctagcacgcagactccaggaattagaacgcgataaaaatttgatgctccagagactacttacagtgctgcctagtctgctggacaagaaaaagtcggtggtgtcctcacccagaccacctgagtgttctgcctcagcaccagtagcagctgcagtccctactagggagagtattaagggcagcttgtctgtgctgctcgacgatttgcaggatcttagcgaagctatctcaaaagaagaagccgtctgccagggcgataatctcgatagatgttcttcgtgcaaccctcaaatgagctcatag

SEQ ID NO: 3910 - DNA, 2508 bp, Artificial Sequence
  Description of Artificial Sequence: Synthetic coding sequence
atgtggccccacagcgccggcgcccggccctgggccagcaccctgacaggcaaggacccgagagttatggcgtgctggtgtttggacggactcccatctggcctggccgaaccttggagagaattgtggcggtggcgtagcagacctcttcattgcgtgccacctttctctcctcttgctcgctcaagcagagatcataggaaccttcggcggaggggaaatattgacggatggcgccagaacctggaaccctccaacaacgtggaaatgtttcccccgagcggtcatcaggatgtctctgagcgcagactagacactcaacgcccacaagtgactatgtgggaacgggacgtaagttccgacagacaggagcctggcagaagggggcgcagctggggcctggaaggaagccaagcactgagccagcaggctgaggtgatcgtgagacaattacaggagctgcgtcgcctggaggaagaggtcaggctgctccgtgaaacatcattgcagcagaagatgcggctggaagctcaggctatggaattggaagccctcgcgcgcgccgagaaggctggtcgggccgaggcagaaggtcttcgggccgcactggcaggggccgaggttgttcgtaagaatttagaagagggcagtcagcgcgagctggaggaagtccagcggcttcatcaggagcaattgagcagtctcactcaagcccacgaggaagcattatcctcactgacgtctaaggccgaaggtctggagaaaagtctcagcagcctagagactaggagagctggagaagcaaaagaattagctgaggcccagcgggaagctgagctgttacgcaagcaacttagcaagacgcaggaggacttggaggcccaagtgacactggtggaaaacttacgcaaatacgtcggggaacaggtgccctccgaagtacactcccagacctgggagctggaacgccagaagctgctcgagactatgcagcacctccaggaagaccgcgatagcctgcatgcgacggccgagttactgcaagtgcgcgtccagagtcttactcacatccttgccttacaggaggaagagctgactcgaaaggtccagcccagtgacagtctggaaccagagtttactcgaaagtgtcaatcattactgaaccgctggcgggaaaaggttttcgctctgatggtgcagctgaaggcccaagagctagagcattccgattccgtcaaacagctcaagggccaagtggcctccctccaggagaaggtgaccagccagtcccaggagcaggcaatcttgcaaagaagtctgcaagacaaggctgcagaggtggaagtggaacgaatgggggccaaagggctgcagctggagctgagtagggcacaggaggcacgccggcgctggcaacaacaaacagcgagtgcggaggagcagttgagactggtcgtgaacgccgtgagtagctcccaaatttggctcgagacaactatggccaaagtcgaaggcgccgcagctcaactgccatccttgaataataggctcagctacgccgtccggaaggttcacacgatcaggggcttaattgccagaaagctggctctcgcccagctgcgacaggagagctgtcctctgcctcctccagttacagacgtctcactggagcttcagcagctgagagaagaaaggaataggctggatgccgagctgcagcttagcgccaggctcatccagcaagaggttgggcgggccagggagcagggtgaagccgaacgacaacagctctctaaggtggctcagcagttggagcaggagctgcaacagacacaagaaagcctggcgtcgttgggcttgcagctggaggtggcccgccagggacagcaggagtctaccgaggaggcagcgtccctgcgccaggagctcactcagcaacaggaactgtatgggcaggcccttcaggagaaagtggcagaagtggagacaagattgcgggaacagctctccgacaccgagagaagactgaatgaggctagacgagagcatgcaaaagcagtagtgagcctgagacagatacaacgccgagcagcccaggaaaaagaacggtctcaggagctgcggcggctgcaggaagaggctcggaaggaggagggtcagcggctggcccgccggctgcaggagctcgaacgggataaaaatctaatgctggctaccctgcaacaagaaggccttttaagtcgctacaaacaacagcggttgctgaccgtgcttccatccctactggataaaaagaagtcggtggtgtcctctccgagacccccagaatgcagtgcttcagcccctgtagccgctgccgtgcctaccagggagtcaataaaagggagccttagtgtactgctcgatgatctccaggacttaagcgaggctatctcaaaagaagaagccgtctgccagggggacaacctggaccggtgttctagcagtaatccccagatgagtagctag

SEQ ID NO: 3911 - DNA, 2190 bp, Artificial Sequence
  Description of Artificial Sequence: Synthetic coding sequence
atgttcccccccagcggcagcaccggcctgatcccccccagccactttcaggcccgccccctgagtaccttgccccgtatggcgcccacttggctgagtgatatccccctcgtgcagcctcccggccaccaggatgtgtccgaacgccgccttgatacccagcgccctcaggtaacaatgtgggagcgagacgtgagcagtgatagacaggaacctggaagacgaggaagatcatgggggttggagggatctcaggctctttcacaacaggccgaagtcatagtgcgccagctgcaagaactgcgccgactggaggaggaggtgagactgttgcgcgagacctcattgcagcagaagatgcgcctcgaggcacaagcaatggagctagaagcgctggctagggctgaaaaagccggacgtgctgaagcggaggggctgagagccgcgttagctggggcagaggtggtgcgaaaaaacctggaagaagggagacaaagggagcttgaagaggtgcaaagattacatcaagagcagctcagttccctcacccaggcccatgaagaagctctgtcctcactaacgtccaaagccgagggactggagaaaagtctgtcttcactggaaacccgccgggcaggagaagcgaaggaacttgcagaggcacagcgcgaggcagaactgctgcgtaagcagctgagcaaaacccaggaggaccttgaggctcaagtaactctggtggagaatttgcggaaatacgtcggcgagcaagtgccctctgaagttcactcccaaacctgggagctggagcgccaaaagctgctcgatactatgcaacatcttcaggaggatagggatagtcttcacgccaccgcagagttgctgcaagtgagggtccagagcctcacacacatattagcactgcaagaagaagaattaaccaggaaggtgcaaccctcagatagtctggagccagagttcacccggaagtgccagtcccttctgaaccgatggcgtgaaaaggttttcgctctgatggtgcaacttaaagcacaggaacttgaacactcagattccgttaagcaattgaagggccaggtggcttccctgcaagaaaaagtgacgtcacaatcccaagaacaagccattctccagcgaagcctccaggataaagctgccgaggtagaggtggagcggatgggcgcgaaaggactgcagctcgagctatcgagggctcaggaagccagacgcaggtggcagcagcaaacagcgtccgctgaagagcagctccgtctcgtggtgaatgctgtaagtagctgtcctctacccccacctgtcaccgacgtgtccctcgaattgcagcagttacgcgaggaaaggaatagactggacgccgaattgcagctgtccgcccggctgatccaacaggaggtaggccgtgctcgggagcagggcgaggctgagagacaacaactctcaaaggtggctcaacagctggagcaggagctccagcagacccaggagagtctcgcctccctaggcctccaactcgaggtcgccagacaggggcaacaggagagcaccgaggaagcagcaagcttgcgtcaggagctaacacagcagcaggagttatacggtcaggcactgcaagagaaggttgcggaagttgagactaggctcagagaacagctcagtgatactgaaaggcgccttaacgaggctcgcagagaacacgccaaagcggtggtgtctctgcgccaaatccagcgccgcgctgcacaagaaaaagaaagaagccaggagctccgtcgacttcaggaagaggctcgcaaggaggaggggcagcgcctggcacggcgcctgcaggagcttgagcgcgataaaaacctgatgctggccactctccagcaagaaggtttattgtcccggtacaagcagcaacgcttgttgacagttctgcccagcctgctggataagaaaaagagcgtagtgtcttccccaaggcccccggagtgtagcgcaagcgccccagtggctgccgccgtgccaactagggagagtataaaggggtcattgagcgtgctgttggacgacttgcaggatctgtcggaggccatttcaaaagaagaggccgtatgccaaggagacaacctcgaccgatgtagtagcagcaacccgcaaatgtcgtcctag

SEQ ID NO: 3912 - DNA, 384 bp, Artificial Sequence
  Description of Artificial Sequence: Synthetic coding sequence
atgttcccccccagcggccagtgggaccagacccggggcgtggtggtagtgtccgcttgggagactgaccacctatgcttctgtaattcttcagggagtactggcctaattccaccaagccactttcaggctagacctctcagcacgttgcccagaatggcacctacttggctctcagatatcccactcgtacagccaccgggccatcaagatgtgtccgagagaaggcttgacacccaacgcccacaagtgacaatgtgggagagggacgtgagttcagaccgccaggagcctggccgccggggcaggtcatggggtctggagggctcacaggcactctctcaacaggccgaggtgattgtacggcagttacaggagttgtag

SEQ ID NO: 3913 - DNA, 462 bp, Artificial Sequence
  Description of Artificial Sequence: Synthetic coding sequence
atgttcccccccagcggcagcaccggcctgatcccccccagccactttcaggcacgtcccttgtctacgttgcccagaatggctcccacctggctgtcagatatccctctggtgcagccacccggccaccaagacgttagtgaacgacgcctcgatacacagcgtcctcaggttactatgtgggagcgagacgttagctccgatcgccaagagccggggcgaagaggccggagttggggcctcgaaggctctcaagccttatcgcaacaggctgaggtcatagtcaggcagttgcaggagttacgcaggctggaagaagaagtccggctactgagagaaacgtcactgcagcagaagatgcgacttgaggcgcaagcaatggaactggaagctttggcccgtgccgagaaggcgggcagggccgaagccgaagggctgcgcgctgcactcgccggagcctag

SEQ ID NO: 3914 - DNA, 567 bp, Artificial Sequence
  Description of Artificial Sequence: Synthetic coding sequence
atgttcccccccagcggcagcaccggcctgatcccccccagccacttccaggcaaggccgctgtctacattgcctagaatggctcccacatggctttcagacatcccactcgtgcagccccctgggcaccaagatgtgtcagagcggaggctggacactcagagaccccaagtgactatgtgggagcgcgacgtctcctcagaccgtcaggagcccggcagaagggggcgatcttgggggttagagggctctcaggctttgtcccagcaagcagaagtcatcgtacgccagctacaggagctccgctggcttgaggaggaggtgtggcttctgagggagactagcttgcagcagaagatgagactggaagcccaggcgatggaacttgaagcactggctcgggccgaaaaagccggcagggcggaggctgaaggattaagggccgccctggccggtgccgaagtcgtgaggaaaaatctcgaggagggaaggcagagggagctggaagaggtccaacggcttcatcaagagcaactgtcttctctgactcaggcgcacgaagagtag

SEQ ID NO: 3915 - DNA, 462 bp, Artificial Sequence
  Description of Artificial Sequence: Synthetic coding sequence
atgttcccccccagcggcagcaccggcctgatcccccccagccacttccaggccaggcccctgtccacactgccacgcatggctcccacatggcttagcgacattcccctggttcagccacctggacatcaggacgttagtgagcgtaggcttgacacacagcgtccccaggtgacaatgtgggaacgcgatgtatcctcagaccgtcaggaaccaggacgcaggggacgatcttgggggcttgaggggagtcaagcattgagccagcaggccgaggtcatagtcagacagttgcaggagttaaggagactagaagaggaagtcaggctgttgagagaaacctcgcttcaacaaaaaatgcgactggaagctcaggccatggaattggaagcacttgcgagagccgaaaaggcgggtagagccgaggctgagggcctaagggctgccctagcaggggcctag

SEQ ID NO: 3916 - DNA, 462 bp, Artificial Sequence
  Description of Artificial Sequence: Synthetic coding sequence
atgttcccccccagcggcagcaccggcctgatcccccccagccacttccaagcccgccccctgagcactttgccacgtatggccccaacctggctgtcagatatcccattggttcagccccctggccaccaggatgtgagcgaacggaggctcgacacccagaggcctcaagtgaccatgtgggaaagagatgtgtcctccgataggcaggagcccggccggagaggccggtcatgggggctggagggtagccaggcactcagccaacaagcagaggtgatagtcaggcagctacaggagcttcgatggctcgaggaagaggtttggttgctgagggaaacgtcactacagcagaaaatgcgtctggaggcccaggcgatggagctggaagctctcgcaagagccgaaaaggcaggccgcgccgaagccgaaggcctgcgggcagcccttgctggagcatag

SEQ ID NO: 3917 - DNA, 951 bp, Artificial Sequence
  Description of Artificial Sequence: Synthetic coding sequence
atgttcccccccagcggccaccaggacgtgagcgagcggcggctggacactcaaaggccacaggtcaccatgtgggagagggatgtgtcttctgatcgacaagaacccggcagacgggggagaagctggggactggagggttcacaggccctgtcacaacaggcggaggtaattgtgcgacagcttcaggagctgcgcagactggaggaggaggtgaggctacttcgggaaacttctcttcagcagaaaatgagattggaggcccaggctatggagcttgaagcactcgctagggccgaaaaggctgggcgagcagaagccgagggcctccgggccgccctggcaggtgccgaagtggtgcggaagaaccttgaagagggacgccaaagagagcttgaggaggtccagagattacatcaagaacagttgtcaagcctgacccaggcccatgaagaggccctgtcctctctgacctccaaagccgaaggcttagagaaatcattgtcctctctggaaactcgtagggcaggcgaggcaaaagagttagccgaggcccagcgtgaggctgaattactgcgcaagcaattatctaagacccaggaggatttggaggcacaagtcaccctggtcgaaaacttacgaaagtacgtgggtgaacaggttccaagcgaagtgcatagccagacttgggagctggagcgtcagaagctgcttgacaccatgcagcacctgcaggaagacagagactcgctgcacgccactgccgaacttctgcaggtgcgcgtgcagagcctcacccatatactggccctgcaggaagaggaattgacgcgcaaagtgcagccaagtgattcactcgaacccgaatttacgaggaaatgccaatcactacttaaccgttggagggaaaaggtatttgctctaatggttcagcttaaagcccaggagtag

SEQ ID NO: 3918 - DNA, 651 bp, Artificial Sequence
  Description of Artificial Sequence: Synthetic coding sequence
atgtggccccacagcgccggcgcccggccctgggccagcaccctgactggtaaagatcccagggttatggcttgttggtgtctggacggactcccctctggactggctgaaccatggcgcgaactatggcgatggcgctctaggccactgcactgcgtgccacctttcagccctctggcaagatcgagccgtgaccatagaaatttgcgcagaagagtagaggccttgccgaggatactcaagggcaacatcgatggatggcgccagaacctcgaaccttcaaataatgtcgagatgttcccaccgtctggcagcacgggccttatacctccaagccacttccaggccagaccactaagcactctgcccaggatggcccccacatggctgagcgatatccctctggtgcagccccccggacaccaagatgttagcgaaagaaggctggacacccagcgaccacaggtcaccatgtgggagcgggatgttagcagcgaccggcaggagcctggtagacggggccgctcctggggtttggagggttcccaagcgctgagtcagcaggcagaggtaattgttcggcaattacaggagctgagacgactggaggaggaggtgcgacttctgagggaaacttcattacagcaatag

SEQ ID NO: 3919 - DNA, 516 bp, Artificial Sequence
  Description of Artificial Sequence: Synthetic coding sequence
atgttcccccccagcggccagtgggaccagacccggggcgtggtggtggtctccgcctgggagactgaccatctatgtttctgcaattcttctggctcaaccgggcttatcccaccctctcattttcaggcacggccgctttcaactctacctcggatggcgcccacctggctatccgacattccgctggttcagcctcccggccaccaggacgtcagcgagcgccggctcgatactcaacggccacaggtcaccatgtgggagagagacgtgagttccgatcgacaggagcccggccgccgtgggagatcctggggactcgagggctcccaggctctcagtcagcaggccgaagtcatagtgcgccagctccaggagctgcgacggcttgaggaagaggtccggttattgagggagacaagcctccagcagaaaatgaggcttgaggcacaagcgatggaattagaagctctggctcgggccgagaaggccggccgagcggaagcagaaggctag

SEQ ID NO: 3920 - DNA, 357 bp, Artificial Sequence
  Description of Artificial Sequence: Synthetic coding sequence
atgttcccccccagcggcagcaccggcctgatcccccccagccactttcaggcccgtccactctcgacactgccgaggatggctccaacgtggctgtccgacattcctctggttcaaccccctggtcaccaggatgtctctgaacgccggctggacactcaacgaccccaggtaaccatgtgggagcgagacgtgtccagcgatagacaagaaccagggcgacgaggccggtcatggggcttggaaggcagtcaggccctgtcccagcaggccgaggtaattgtaagacagctgcaggaacttcggaggctggaggaggaagtgcgcctgctgcgggaaacctctctccagcagtag

SEQ ID NO: 3921 - DNA, 423 bp, Artificial Sequence
  Description of Artificial Sequence: Synthetic coding sequence
atgttcccccccagcggcagcaccggcctgatcccccccagccacttccaggcacgacccttgtctacgctcccccgaatggcgcccacctggctaagcgacataccattggtgcagccaccaggccatcaggacgtttcggaaagacgcctggacacccagcgcccacaggtcactatgtgggagagagacgtctcctcggacagacaggagcccgggcgtcggggcaggtcctggggtctggagggatcacaagccttgtcacaacaggccgaggtcattgttaggcagctccaggaactaaggaggctggaggaagaggtgagacttctgcgcgagacctctctacagcagaaaatgcgactggaagcacaggccatggaactggaagccctggctcgagctgagaaagcagggagatag

SEQ ID NO: 3922 - DNA, 111 bp, Artificial Sequence
  Description of Artificial Sequence: Synthetic coding sequence
atgttcccccccagcggcagcaccggcctgatcccccccagccactttcaagcaaggccgctatctacactcccgcggatggcgccaacttggctgagcgacatcccttag

SEQ ID NO: 3923 - DNA, 291 bp, Artificial Sequence
  Description of Artificial Sequence: Synthetic coding sequence
atgttcccccccagcggcagcaccggcctgatcccccccagccactttcaagcccgaccgctgagtacgctcccacgcatggctccaacatggctttcagatatccccctggtgcagcctcctggacatcaggacgtttcggagaggcgcctcgatacacagcgccctcaggttaccatgtgggagcgcgacgtgtctagcgatcggcaggaacccgggagaagaggaagatcttggggcttagagggatctcaggctttgtcccagcaggccgaggtaatcgtccgctag

SEQ ID NO: 3924 - DNA, 477 bp, Artificial Sequence
  Description of Artificial Sequence: Synthetic coding sequence
atgttcccccccagcggcagcaccggcctgatcccccccagccactttcaagcccgccctctttctactcttccccggatggcacctacgtggctctccgatatacctctggtgcagccgccaggccatcaggacgttagcgaacgaagattggatacccagagaccgcaggttacaatgtgggagagagacgtatctagtgaccgccaggaaccaggaagacgaggaaggtcatggggcctggaaggctctcaggctctaagtcagcaggctgaggtcatcgtgcgccaactacaagaactccgcagattggaagaggaagtgcggttattgcgggaaactagtctccagcagaaaatgaggctggaagcccaagctatggagttagaagccctcgcacgcgcagaaaaagcaggaagagctgaagccgaggggctccgagcggctctggcaggagcggaagtggtcagaaagtag

SEQ ID NO: 3925 - DNA, 351 bp, Artificial Sequence
  Description of Artificial Sequence: Synthetic coding sequence
atgttcccccccagcggcagcaccggcctgatcccccccagccactttcaagctcgacctctcagcaccctccccaggatggccccaacttggctctccgatatcccgctcgttcagcctccaggacatcaggacgtcagtgagcgcaggctggatactcaaaggccacaagtgacaatgtgggaacgcgacgtttccagcgatcggcaagagccgggccgaaggggccgatcttggggtctggaggggagccaggcactctcccagcaggccgaagtgattgttcgccagcttcaggagcttcgaaggctcgaggaggaagtaagacttctgagggagacctctctttag

SEQ ID NO: 3926 - DNA, 126 bp, Artificial Sequence
  Description of Artificial Sequence: Synthetic coding sequence
atgttcccccccagcggcagcaccggcctgatcccccccagccactttcaagctagacccttatcaaccctccccagaatggcccccacttggctgtctgacattcccttagtgcagcccccatag

SEQ ID NO: 3927 - DNA, 480 bp, Artificial Sequence
  Description of Artificial Sequence: Synthetic coding sequence
atgttcccccccagcggccaccaggacgtgagcgagcggcggctggacacccaaaggccacaggtcacaatgtgggaaagggacgtgagctccgaccggcaggagcctggtcggcgcggccgctcttggggtctggaaggctcacaggctctgagccagcaggctgaagtgattgtccggcagttgcaagagctccgacgactggaggaggaagtgaggctcctccgggaaacttcgctacaacagaagatgcggttagaagcccaggctatggagttggaagccctggcgcgtgcagaaaaggctggtcgtgctgaagctgaagggctccgcgcagctttggcgggagctgaggtggtgcgtaaaaacctggaggagggatctcagcgcgagcttgaagaggtgcagaggcttcaccaggagcagctcagctctctgactcaggcccatgaagaggctctgagtagcctaaccagctag

SEQ ID NO: 3928 - DNA, 423 bp, Artificial Sequence
  Description of Artificial Sequence: Synthetic coding sequence
atggcccccacctggctgagcgacatccccctggtgcagccccccggccaccaggatgtgtccgagaggaggctcgatacacagaggcctcaggtcacgatgtgggagcgcgatgtctcctccgatcgccaagagcccgggcggcgggggcgctcatgggggctcgaaggttcacaggcactttcgcagcaggcagaggtgattgtacgccaacttcaagaattgagaaggctcgaggaggaggtccgcctgcttcgggaaacatctctgcagcagaagatgcgcctcgaggcccaggccatggagctggaggcattagccagagcagagaaagcggggagagccgaggctgagggactgagagccgctctcgccggcgccgaagtggtgcgcaagaatcttgaggagggaagccagaggtag

SEQ ID NO: 3929 - DNA, 480 bp, Artificial Sequence
  Description of Artificial Sequence: Synthetic coding sequence
atgttcccccccagcggcagcaccggcctgatcccccccagccactttcaggcacgcccgctttccacgctccctaggatggctccgacatggttgtcagacatcccgctagttcagccacctggccaccaagacgtaagcgagaggcgcctggacacgcagcggccccaggtgacgatgtgggagcgcgacgtatccagcgatcggcaggaacctgggcgtcggggacggagctggggacttgagggatcacaagcactgtcccaacaggcggaggtgatcgtacgacaactacaggaactgcggaggctcgaggaggaagtacggctgttgagggagacttcactacagcaaaagatgaggttagaggctcaggcaatggaactggaggctcttgccagagcggaaaaagccggccgcgcggaagccgaaggcctcagagcggcccttgctggcgctgaagtggtgaggaaaaattag

SEQ ID NO: 3930 - DNA, 3714 bp, Artificial Sequence
  Description of Artificial Sequence: Synthetic coding sequence
atgcggaagcaccggcacctgcccctggtggccgtgttctgcctgttcctttccggcttccccaccacacacgctcagcagcagcaggcagcgcaagacagcgccgatattatctttctcatcgacgggtctaacaacactggttctgtgaattttgccgtgattttagattttttggtgaacctgctcgaaaaattgccaataggcacccaacagatcagagtgggcgtcgtgcaattctccgatgaaccccgcaccatgttctccctggacacatattcgaccaaagcccaggttctcggtgctgtcaaggctctcggattcgccgggggagagctcgcaaatatcggtctcgctctggattttgtggtggagaatcatttcacaagggctggtggcagccgggtggaagaaggcgtgccccaagtgctggtactgatcagtgctggccctagctccgacgaaatcaggtatggagtcgttgccctgaagcaggcttctgtgtttagtttcggcctgggagctcaagccgcctcacgggctgaactacaacacattgcgacggacgataaccttgtttttacggtccctgagtttcggagcttcggcgatctgcaggaaaagcttctgccatacatcgtgggtgtcgctcaaaggcacatcgtgttaaagccacccaccatcgttacccaggtgatcgaggtgaataagcgcgatatcgttttcttggttgatggctcaagcgccctgggcctcgccaacttcaacgccataagggatttcatagccaaggtcattcaaagactagaaattggccaagacctcattcaggtcgctgtggctcagtacgccgataccgtaagaccagaattttattttaacactcacccgacgaaacgagaggtcataactgctgttcgaaaaatgaagcctctggacgggtcagctctgtataccgggtccgccctggacttcgtccggaacaacctgttcacaagcagcgcggggtaccgtgcggctgagggcatcccgaaactattggtgcttataactggagggaagagtctagacgagatctcccagcctgcacaggagctgaagcgcagtagcatcatggcctttgcgattggcaacaagggggccgaccaggctgaactggaagagatcgctttcgatagtagcctggtgtttatccctgcagagtttagggcagcacccctgcagggaatgttgcccggattattagcgccattgaggacacttagtggaaccccagaagtacactccaataagcgggatatcatctttctcctcgacggctcggccaatgttggcaagaccaacttcccctacgtgcgagactttgtgatgaacctggtgaactcactcgacataggcaacgacaatattcgggtaggcctggttcagttttccgacactccagtgaccgaattttcgttgaacacatatcagaccaaatcggacattttaggacacttacgccagttacagctccaggggggaagcggactgaacaccggcagcgcgctttcttacgtttatgctaatcacttcactgaagctggggggagcagaattcgggagcatgtgccacagctcctgcttctcctgacggctggccagagcgaagacagttatctccaagccgcaaatgccctaactcgagccggaattctgaccttctgcgtgggagctagccaggctaacaaggccgaactggagcagatcgcctttaacccttcactggtgtatctgatggatgatttcagcagcctgcccgcactgccgcagcagctcatccagcctctaaccacttacgtcagcggtggtgtcgaggaggtccccttagctcaaccggagtctaaaagggacattctatttctcttcgatggctccgcaaatctggtgggtcagttccctgtggtgagggatttcttatacaagattattgatgagctaaatgtaaagccagaggggactagaatagccgttgcacagtacagtgacgacgtcaaggttgaaagtcggtttgatgagcaccagtccaagccagaaatcctcaacctcgtgaaacgaatgaaaattaagacaggcaaagccctgaatctgggctatgccctcgactatgctcagagatacatttttgttaaatcagcaggatcacgcattgaagatggagtgctgcaatttcttgtcctactggtggcaggaaggagctccgatagggtcgatggtcctgcgagcaatctaaagcaatccggagtggtgcctttcatcttccaggccaaaaatgctgatccggccgaactggaacagattgttctgtcaccagcctttatattggctgccgagtcactgcccaagattggagacctacatccacaaattgtgaatctgctgaagtcagtccataatggggcacccgctcccgtcagtggtgagaaggatgtggtttttctcctcgacggttccgaaggggtgcgatctggctttccactgttgaaagaatttgtccagcgagtggttgagtctctagatgtcgggcaggatcgtgtgcgcgtggcagtggtccaatactcagaccggaccaggccggaattttatctgaatagctacatgaacaaacaggatgtggttaacgctgtgagacaactcaccttacttgggggccctactccgaacaccggagctgcactcgaatttgtgctccggaacattctagtgtcctccgccggttcacgtataaccgaaggggtgccacagttgctgattgtgctgaccgcagaccgttccggggacgacgttcgaaaccctagcgtggttgtgaagagaggcggggccgtgccaattggtatcggaatcggcaacgcggatattactgagatgcagacaattagcttcatccctgatttcgcagtggcaattcctacattcaggcagctgggaactgtccaacaagtgatatccgagagagtcacacaacttactagagaggagttaagcaggctgcagcccgtgctgcagccactgccgagcccaggagttggcggaaaacgcgatgtcgtgtttctgatcgatggatcgcagagcgcagggccggagtttcagtatgtgcggaccctgattgagaggctcgtcgactacctcgatgtcggatttgatacaactcgggttgctgtcatccagttttctgatgaccctaaagtagaatttctgcttaatgcacactccagtaaggacgaggtccagaatgcagtgcagcgtttgaggcccaaagggggccggcagattaacgtgggcaacgccctggagtatgtctccaggaatatcttcaaacggcctctcgggagcagaatagaagaaggcgtacctcagtttctggtcttaattagctcaggcaagagcgatgatgaagtcgacgatcctgctgtcgaactgaagcagttcggggtcgcgccattcacaatagcccggaatgcagatcaggaagaactcgttaagatttctctgtcacctgaatacgtgttctctgtgtctacattcagggagttaccttcgctggagcagaagctacttacacccattaccacactgacaagcgaacagatccaaaagcttcttgcatccacaagataccctcccccaggtgagatgggggcatccgaggtgcttctcggcgccttctctatctag

SEQ ID NO: 3931 - DNA, 7713 bp, Artificial Sequence
  Description of Artificial Sequence: Synthetic coding sequence
atgcggaagcaccggcacctgcccctggtggccgtgttctgcctgttcctgagcgggttccccacaacccatgcacagcagcagcaggccgttattgaagtgaataagcgggatattgtgttccttgtggacggttccagcgcactgggcttagcaaatttcaatgccatcagggacttcattgcaaaagttatccagcggcttgagatcgggcaggacttgatccaagtggctgttgctcagtatgctgataccgtgcgacccgagttttactttaacactcacccaaccaagagggaggtgatcaccgctgtgcggaagatgaaacctctcgacgggtccgccctctacacaggatccgccctcgacttcgtgagaaacaatctgtttacgtctagcgccgggtaccgggccgccgaaggcatccccaaactgcttgtactgattaccggggggaagtcactggatgaaatttctcagcctgcacaggaactgaagcgcagcagtatcatggcgttcgcaattggcaacaagggggcggatcaggcggagcttgaggagatcgccttcgactcctcacttgtgtttatcccagccgaattccgtgccgctccattgcagggcatgctccctggcctgttggcacccctgaggacactctccggaacaccagaggaaagcaaacgagatatcttattcctcttcgacgggtccgccaacctggtgggtcagtttccagtcgtccgagatttcctctacaagatcatcgacgagttgaatgtcaagccagaaggcactcgcatagccgtggcacagtattccgatgacgtgaaggtggagagcagattcgatgaacaccagagtaaaccggaaattttgaacctggtgaagaggatgaagattaagacaggaaaggctttaaatctaggatacgctctcgactatgcccagagatacatttttgtgaagtcagccggctcacgtattgaagatggggtgttgcagttccttgtgctgctggttgcggggcgaagcagtgacagggtagatggacctgccagcaatctgaaacaaagcggtgtggtaccgttcatcttccaggcgaagaacgcagacccagctgagttggagcaaatagtgctgtcaccagcttttatcctcgccgctgagagtctgcctaagattggcgatctacatcctcaaatagtcaacctgctcaaatcagtgcataatggggccccagcccccgtgtctggggagaaggacgtggtctttttgttggacggatctgagggggtgaggtccggcttcccactgctgaaggagttcgttcagagagtggtggaatcactggacgtcggtcaagacagggttagggtggccgtcgtgcagtacagcgaccgtacgcgaccggaattctatctgaacagctacatgaataaacaggatgtggtcaacgctgtccgtcagctcactctgctagggggccctactccaaatacaggtgcagccctcgaatttgtgcttaggaatatcctcgtgagtagcgcggggtccaggattaccgaaggcgtgcctcaactcttgatcgtgctgacagccgacaggagtggtgacgatgtcagaaatccgtccgtggtagtcaagcgtggcggcgccgtgcctatcggcattggcatcggcaacgcagacataacggagatgcagacaatatcctttatacctgatttcgccgtagcaatacccaccttccggcaattgggaaccgtgcaacaggttattagcgagcgcgtgactcagctcacccgggaggaactgtctcggttacagcctgtcctccagcctctcccttctccaggggtgggaggaaaaagagacgttgtcttcttaatcgacggatcacagtcagcaggacctgaatttcagtacgtccgcaccctgattgagagactggtggattacctagacgtcggatttgacaccactcgggttgcagtaatccagttcagcgatgaccctaaagtggaatttcttctaaatgcacattcaagtaaggacgaagtacagaacgcagtacaaaggctgcgccctaagggaggaaggcagatcaatgtcgggaacgcgctcgagtacgttagtcgtaatatcttcaagagaccactgggcagtcgaatcgaggagggagtgccacagttcctggtcttgataagctctgggaagtctgacgatgaggtagacgatccagctgtcgagttgaagcaattcggtgtggccccattcaccatcgcaagaaacgctgatcaagaagagctggttaaaatttcacttagtcctgagtatgtcttttctgtgagtacgtttcgcgagcttccatctcttgagcaaaagttgttgacgcctattacaacccttacctctgagcaaatccagaaactgctagcatcaaccagatatccccctcctgcagtcgaatccgatgctgccgatatagttttcctgatagactcttctgaaggtgtacgtccagatggttttgcccatatcagggatttcgtaagcagaatcgttaggagacttaacataggcccctcaaaggtgcgcgttggcgttgttcagttttccaacgacgtcttccctgaattttatctgaaaacgtacagaagccaggcaccggtccttgacgctattagacgcctgcgcctgcgcggtggctctccgctgaatactggcaaagccttggaatttgtcgctcgcaacttgttcgtcaagtcggccggtagtaggattgaggacggggtgccccagcatctcgtgctggtactcgggggcaagagtcaggacgacgtgtcaaggtttgctcaggttatccggtctagcggcattgtttctttaggtgttggcgaccgcaacatcgacagaacggaattacagaccatcacaaacgatccgagactcgttttcacagtcagagagtttcgagagctccccaacatcgaggaaaggatcatgaattcgttcggaccatcagcagccacgccggcgcccccgggagttgacacgcctccgcccagcaggccagaaaagaagaaggctgacatagtgtttctcctggatgggtccatcaactttagacgggatagttttcaggaggtgctgcggttcgtgtctgagatagttgacaccgtgtatgaagatggggattcaatccaagtcggcctagttcagtataatagtgatcctaccgatgaattcttcctgaaagacttcagtacaaagcggcagatcatcgatgccattaacaaagtggtgtacaagggcggtcgtcacgccaacactaaagtgggcctggaacacctgcgggtgaaccatttcgtccctgaggccggcagtagattagaccagcgagtaccccagatcgccttcgtgattacgggcggaaagagcgtggaagacgctcaagacgtttcgctggccctgacgcagcgaggggtcaaggtcttcgcagtgggcgtgcggaatatcgattcagaggaggtgggcaagattgcttcaaactctgctaccgctttccgggttggaaacgtgcaggagttgagtgagctgtcagagcaggtgttggagaccctgcacgatgcgatgcacgagaccctgtgtccgggcgttacggacgccgccaaggcctgtaacttggatgtgattctgggatttgacggcagccgagaccaaaatgtattcgttgctcagaaagggttcgagagcaaggtcgatgcaattctgaacaggatttcccagatgcacagagtcagctgcagcggcgggcggagccctacagtgcgggtgtccgtggtcgccaataccccgagcggtcccgtggaagcattcgactttgacgagtatcagcccgagatgttggagaagttccgcaacatgcgatctcaacacccatatgtgctcacagaggataccctgaaggtctatctgaacaagtttcgccagtctagccccgactccgtcaaagtcgtgatacatttcaccgatggagccgacggcgaccttgcagatctgcatcgcgcctccgaaaaccttcgacaagagggtgtccgtgcacttatccttgtgggactcgaacgggtagtgaacctcgaaagattaatgcatctcgagttcggccgcggtttcatgtatgacagaccactccgcctgaacctgctcgacctagattacgaactcgccgagcagttagacaacatcgcagaaaaagcctgctgcggtgtgccttgtaagtgtagcgggcagcgcggcgatcgggggccaataggttccatcggacccaaagggattccaggggaagacggctacagaggctatcccggcgacgaaggtgggcccggggaacgcggacctccaggcgtgaacggaacccagggattccagggctgccccgggcagcggggcgtgaaggggtccaggggttttcctggggagaagggagaagtgggagaaattggactcgatggcttggatggggaggacggcgataaaggtctgcctgggtcttcaggtgaaaaggggaacccaggtagacgcggggataagggcccccgaggcgagaaaggcgaacgcggcgatgtcgggatacgcggtgaccccggtaatcccggacaagatagccaagagaggggccccaaaggcgagacgggggaccttgggcctatgggagtgcccgggcgtgatggtgtcccaggaggacccggggagactggcaaaaatggcgggttcggtcgcagggggccacctggcgccaaagggaacaagggcgggccaggtcagcccgggtttgagggggagcaaggaacacgtggagcacaaggacccgcgggaccagcgggaccaccagggctgattggcgagcaaggcatttcaggccctagaggtagcgggggggcggcaggagctccaggggaaagaggaagaacaggcccccttggccgaaaaggcgagcctggagaaccggggccgaaagggggaattggcaacaggggtccgagaggcgaaactggtgacgatggccgtgacggggttggaagtgagggtcggagggggaagaagggagaacgcggctttcccggatatccaggccccaagggaaatcccggagagcccggccttaacggcacgacggggccaaagggcattcggggtcgacgcggcaactcgggcccacctggcatcgtgggtcagaaaggcgacccgggataccccggtcctgctggtcccaaggggaatcggggggatagcatcgaccagtgcgccctcatacaaagcatcaaagacaagtgcccttgctgctacgggccactcgagtgtccggtgtttcccactgagttggccttcgcattagatacaagtgaaggggtgaatcaagatacatttggccggatgcgcgatgtcgtcctgagcatcgtgaacgacttaacgattgcggagagcaactgtcctagaggagccagggtggccgtggttacatataataacgaagtgactaccgaaatccggttcgcggacagtaagagaaagagtgtcttgttagacaaaatcaaaaacctgcaagtggctctgacctctaaacagcagtccctggaaaccgcaatgtctttcgtggctcgtaatacgttcaagagggtgagaaatggctttttgatgcggaaagtggctgtattcttttccaacacgccaacccgcgcgagcccacagctgcgggaggccgtgttgaaactgagcgacgccggcattaccccattatttttgacccgccaggaagatcgccagctaatcaacgccctgcagattaataatacggccgtggggcacgcactggtacttcccgcagggagggacttgaccgattttctcgagaatgtccttacatgtcatgtatgtctagacatttgtaacatagacccatcatgtgggtttggaagctggaggccctctttcagggaccggagagctgccgggtccgatgtcgacatcgatatggccttcatcttggatagcgctgaaacaactactttgttccagtttaatgagatgaagaaatacattgcttatcttgttcgtcaactagacatgtccccagaccccaaggctagccaacacttcgctcgcgttgccgttgtgcagcatgccccctctgaatcagttgacaatgcgtcaatgccgcctgtgaaagtggaattcagtttaaccgactatggttccaaggagaaactggtcgacttcctatcacggggcatgactcaattacagggcacgcgcgcactgggaagcgccattgaatatactattgagaacgtttttgagtctgctccaaacccgagagacctcaagatagttgtcctgatgctgacaggagaagttccagagcaacaactggaggaggcccagcgagtgatccttcaagcaaagtgcaagggctacttcttcgtggtgcttggaattggccggaaggtgaatatcaaagaggtctataccttcgcttccgagcctaatgatgtttttttcaagctcgtcgacaaaagcaccgagcttaatgaggagccactgatgcggtttggacgcctattgccgtctttcgtgtctagcgaaaatgctttctacctcagcccggatatcagaaagcagtgcgattggttccagggcgatcagccgacaaagaatctggtcaagttcgggcataagcaggtgaacgtccccaacaatgtgacgagttcccctacgagcaaccctgtgacgactacaaagcccgtcacgacgaccaaacctgttacgaccacgaccaaacccgttactaccacaactaaaccagttacaatcatcaatcaaccgtccgtgaaacccgctgccgccaagccagcccctgccaaacccgttgccgccaagccagtcgctactaagatggctaccgtgaggcctccagtggccgtcaagcccgcgacagcagcaaagccggtggccgccaagccggctgccgtccgccctcctgccgcagctgcagctaagcctgtggcaacaaagcctgaagtccctcgtcctcaggccgctaagcctgccgccaccaaaccagccacaaccaaacctatggtgaagatgagtcgagaggtccaggtatttgaaatcacagagaacagcgctaaactgcattgggaaagagcagaacctccaggcccttacttctatgacctcactgttacaagcgcccacgatcagtcccttgttctcaagcagaacctgactgtgacggatagagtgatcggtggactgcttgcaggacaaacataccatgtggccgtggtctgttatttaagaagccaggtgcgcgccacataccacggatcattctccacgaagaagagccagccccctcccccccagcccgcaaggagcgcgagttccagcaccataaatctaatggtgtcaaccgagcctcttgcattaacagaaaccgatatctgcaagcttcccaaagacgagggaacctgccgcgattttattctcaaatggtattacgacccaaataccaaaagctgcgcacgcttctggtatggaggctgtggtggaaacgagaataaattcggctctcagaaggaatgtgagaaggtgtgtgcccccgtactggcaaaacccggagttatctctgtgatgggcacctag

SEQ ID NO: 3932 - DNA, 1938 bp, Artificial Sequence
  Description of Artificial Sequence: Synthetic coding sequence
atgctgctgaagaagcacgccggcaagggcggcggccgggagcccaggagcgaggatcccacccccgctgagcagcattgtgctcgtactatgcctccctgtgccgttcttgccgctctcctttccgttgtagctgtggtctcctgcctctacttaggggtcaagaccaatgatctgcaggctcggatagccgccctggaatcagcaaaaggcgctcccagcatccaccttcttccagataccctagaccacttaaagacaatggtgcaggaaaaagtggaaaggctgctggcccaaaagagctatgagcacatggctaaaatcagaatcgcaagggaggcaccctctgagtgcaactgtccagcaggaccccccggaaaacggggaaagcgcgggagacgaggcgaatcgggacccccaggccagcccggtcctcaggggccgcccggccccaaaggcgataaaggcgagcaaggagaccagggaccacgcggactccccggctttcccactgtcgccgctcttcacagtaatcagattttaactgtcaagggagatcagggacaggctggtccccctggacctcctggaccacccggccctagaggtccccctggcgacaccggtaaagacggaccacgcggcatgcctggggtgcccggggagcccgggaagccaggtgagcagggactcatgggcccactcggtccgcctgggcaaaaagggtccatcggcgcacccggaattcccggcatgaatggacagaaaggagaacctggattgcctggcgctgtgggccagaacggcattcccggaccaaaaggggagcctggagagcagggagaaaagggcgatgcaggggagaacggaccgaagggggatacgggagaaaagggggatcccggttccagtgcggctgggattaaaggggaaccaggggagtcagggagacccggccaaaaaggggagccgggcttgccagggcttcccggtctcccaggtatcaaaggcgaaccaggcttcattggtcctcaaggcgagcctgggctacctgggcttccgggcaccaaaggcgagcggggtgaagcgggcccccctgggcgaggcgagaggggggaacctggagcccccggaccaaaaggggataggggggaaaagggggattccggagctcaaggaccacgtggccctccgggacagaaaggagatcagggagctacggaaataattgattacaatggcaacttgcacgaggccctgcaaggaccccccggccctcccggacctcagggactccagggaccgaaaggcgaacaaggcagtcccgggatcccagggatggatggcgaacaggggctgaaggggtctaagggtgatatgggcgatccaggaatgacgggtgaaaaaggcggaatcggtttgccaggtctacctggagcaaacggcatgaagggcgaaaagggggactccggtatgcccgggccacagggaccttcgattatcggccctccaggcccgccagggccccacggccctccgggaccaatggggccacatggtctgccaggccctaaaggggagccaggattgaacggagtgaagggactgaagggtgaaccgggccagaagggcgataggggcccactggggctccccggagcatccggcctcgatggcaagcctggctcacgcggcactgatggaccaatggggccccacggaccagccggtcccaagggagaaagaggtgagaaaggggcgatgggcgaaccaggtcccagagggccctacgggctacccggatttcctgggccccgaggggaaaagggggatttgggcgagaagggcgagaaagtgacaagcccatcccagcatgtcccgtgtctcattctgctcctgctcagtgcactccttttctccttatgcgactctatttag

SEQ ID NO: 3933 - DNA, 1101 bp, Artificial Sequence
  Description of Artificial Sequence: Synthetic coding sequence
atggccgagctgcagcagctgcaggagttcgagatccccaccggcagagaagctttgaggggcaaccacagcgccctgctgcgcgtcgcggactattgtgaggacaattatgtccaggccaccgataaacggaaggccctggaggagacaatggctttcacgacccaggcattggcgagcgtagcgtatcaagtcggcaatctagctgggcacacccttcggatgctcgatctgcagggcgcagctttgcggcaggtggaggccagagtctctaccctcggacaaatggtcaatatgcatatggaaaaggtggccaggcgtgagattgggacacttgcaaccgttcagcgcctcccccctggccagaaggtgatagctccggagaatcttccgccactcacaccatactgtcgaagaccactgaacttcggctgcctggacgacattggccacggaatcaaggaccttagcacccagctatctcgtaccggaaccctgagtcgaaagtctatcaaggcgcctgctacgcctgcttctgccacactcggaagacccccaagaattccagagcccgttcacctgcccgtggtgcctgacggaaggctctctgccgcaagctccgctttttcactggcatccgccggtagtgccgagggagttgggggcgcacccacccccaaaggacaagcggctcctcccgccccaccattgcctagcagcctggacccgcctccgcctcctgccgctgtcgaagtgtttcagcgcccgcccaccctggaggagctttcccccccacctccagacgaggagctgcctctccctctggacttgcctcccccgccccccctcgatggcgatgaattgggtctgcccccaccacctcctggtttcggccctgatgagccaagctgggtgcccgctagctatttggaaaaggtggtgacactctacccatatactagccaaaaggacaacgagctgagcttctccgaagggaccgtgatttgcgtgacacgcaggtatagtgatggatggtgcgaaggcgtgtcatcggaaggcaccggctttttcccgggtaactatgttgagccaagttgttag

SEQ ID NO: 3934 - DNA, 4257 bp, Artificial Sequence
  Description of Artificial Sequence: Synthetic coding sequence
atgatccggctgggcgccccccagaccctggtgctgctgaccctgctcgtagccgcagtgcttcgctgtcagggacaagacgtacgccagcctggaccaaaaggccaaaaaggtgagccaggggatattaaagatattgtggggccaaagggtccaccaggaccacagggccccgctggcgagcagggacctaggggtgacaggggcgacaaaggcgagaaaggggcgccagggcctaggggccgggacggggaacccggtaccccaggtaaccccggcccccccggacccccggggccacccggtcctcccggcctgggcggcaattttgcagcccagatggccggcggcttcgacgagaaggcaggcggggcgcagctcggcgtcatgcagggccctatgggacctatgggcccacggggaccaccagggcccgccggagcaccaggcccccagggtttccaggggaatccaggggagccaggggaaccaggtgtgagtgggcccatgggacctaggggtcccccaggcccccctgggaaacccggggacgacggtgaagctggaaaacccggaaaagccggcgagcggggcccgccagggcctcaaggcgccagagggtttcccggaactcctggccttccaggagtgaaaggacaccggggataccctggtctcgacggcgccaagggagaagccggagctccaggggtgaaaggagagagcggcagtcctggcgaaaatgggtctccaggacccatgggccctagaggactacccggagaaagaggtagaactggacccgccggagccgccggcgctcgcggaaacgatggacagccaggccctgccgggccacctgggcctgtgggtcctgctggcggccccggctttcccggagcacctggagctaaaggggaggcagggcctaccggcgcccgcgggccagagggcgcccaaggccccagaggggagcctggtactcctggatctcctggccccgcaggcgcctccgggaatcctggtacagacggaattcccggagcaaagggctctgccggggcaccaggaatcgcaggcgcacctggcttccctggtccccggggacctccagggccccagggcgccactggccctctgggccccaaaggccaaacaggggagcctgggatcgccggcttcaagggagagcaggggcccaagggggaacctggcccagcagggcctcagggagcccccggaccggcaggagaagaaggtaaaaggggcgccaggggcgaaccagggggcgtgggcccaattgggccgcccggggagagaggagcacccggcaacaggggcttcccaggtcaggacggactggctggtccaaagggagcaccgggagaacgaggacccagcggcttggctgggcccaaaggcgcaaacggcgacccaggaagacctggagaaccaggcttaccaggggctagagggctgactgggcgacctggcgatgctggtccacagggcaaggttgggccgtcgggggcccctggcgaagatggccgcccaggacctccaggcccacagggcgcacggggacagccaggcgttatgggtttccctgggcctaagggggctaatggcgaaccaggcaaggctggagaaaagggtctacctggagctcccgggctgcggggactgcccgggaaggacggagaaaccggtgcggccggtccccctggccccgcaggtccagcaggagaaagaggtgagcagggcgctccaggaccaagtggcttccaagggctgcccggaccacccggtcctccaggggaaggagggaagcctggagatcagggggtcccaggggaagcgggggcccctggcctcgtgggcccccgcggcgagcgcggctttcctggcgagagaggtagcccaggggctcagggcctccagggcccgagaggcctcccaggtacgcctggcacggacgggcccaagggagcaagcggaccagccggtccaccgggcgcccagggtcctccaggcctgcagggcatgcctggagagcgaggagccgctgggatcgcaggtccaaaaggggaccggggggacgttggcgaaaagggccccgagggcgcgcccggcaaggatgggggcagaggactaaccggcccgattggccccccaggcccggctggcgcgaacggggagaaaggggaggttgggccacctgggcccgcaggctctgcgggcgcacgcggtgctcctggagaacggggcgaaaccggcccacctgggcccgccggttttgctggtccccccggagctgatggccagccaggagccaagggtgagcagggggaggctgggcagaaaggcgacgcaggggccccagggccccagggaccctcgggcgcgccaggtccacagggcccgaccggcgttaccggacctaagggcgcaagaggggctcaggggccaccaggggccaccggcttccctggggcggcagggcgcgtggggccccctggttcgaatggaaacccggggccacctggtcccccaggaccatcgggtaaggacggccctaaaggggcccggggcgactcaggcccccccgggagggccggtgaacctggtctgcagggccctgcgggtccacctggtgagaaaggcgaacccggtgacgacggcccatctggagccgaagggccccctggcccacagggcctagcagggcaaagagggatcgtgggattgcctggccagagaggggagaggggctttcccggcctgcctggaccttccggggagcctggcaagcaaggagccccgggagcctctggagaccgcggcccaccgggcccggttgggccccccgggctcacaggaccggcaggggaacccggtcgggagggaagccccggcgccgacggccctccaggccgtgatggcgccgccggcgttaagggagaccgaggggagaccggcgccgttggcgcccctggcgcccctgggcccccgggctccccaggccctgcagggcccaccggtaagcaaggggacagaggtgaagcgggcgcacagggtcctatgggccccagcggacccgctggggcccggggtatccagggtccacaggggccacgcggagataagggcgaagccggtgaacccggcgagcggggcttgaaaggacaccgtgggtttaccggcctgcaggggcttcccggcccacccggaccctccggggaccagggtgcatctgggcctgccggccccagcggacctcgtgggcccccaggccccgtgggcccgagcggaaaggacggtgctaacggaatccctgggcctattggacccccaggcccaagagggagatcgggcgaaacgggccctgcggggccgcccggcaatccagggcccccgggaccccccggcccccctgggcctggcatcgatatgagtgccttcgccggcctcggcccacgcgagaagggtccagatcctctgcagtacatgcgggcggaccaggcagccggtggcctgcgccaacatgacgccgaggtcgacgctaccctgaaatccctgaacaatcagattgagtctatcaggtccccagaggggagtaggaaaaacccagcgaggacttgtcgcgatctgaagctttgtcatcctgagtggaaatcgggagattactggatcgaccctaatcagggctgtactctggacgcgatgaaagtgttttgcaatatggaaaccggagagacttgtgtctaccctaaccccgctaacgtcccaaagaagaactggtggagctctaagtcaaaggaaaagaagcacatttggtttggggagactatcaatggtgggtttcacttctcctatggagatgacaacttagcgcctaataccgccaacgtgcagatgacctttctcaggctgctgtcaacagaaggaagtcagaacatcacttaccattgcaagaacagcattgcttatctagacgaggctgccggtaatctgaagaaggctttactcatccaaggcagcaacgacgttgagattagagccgaaggaaattcccgattcacatacacagccctcaaagatggctgtaccaaacacaccggaaaatggggcaagaccgtcatcgaataccggtctcaaaagaccagtcgtttgcctatcatcgatattgcccccatggatatagggggtcccgaacaggaattcggcgtggacattggcccagtctgctttctttag

SEQ ID NO: 3935 - DNA, 4464 bp, Artificial Sequence
  Description of Artificial Sequence: Synthetic coding sequence
atgatccggctgggcgccccccagaccctggtgctgctgaccctgctagtcgcagcagtcctgcgatgccaggggcaagacgtacaagaagcgggttcctgcgtgcaggacggccagaggtataatgacaaagatgtgtggaagcctgagccctgccgcatctgtgtgtgtgatactggaaccgtgctgtgcgatgacattatttgtgaagacgtcaaggactgtttgagtccggagataccgtttggtgaatgttgtccaatctgcccgaccgacctggctaccgccagcggccagcccggccctaaagggcagaaaggagaacccggagacataaaagatatcgtcggtcctaagggtccccccgggcctcagggaccagcaggagagcaggggccccgaggggatcgcggagacaaaggggagaaaggagcgcccgggccgcggggacgtgatggggaaccaggaacaccaggaaatccagggcctcctgggccacctggacctccaggccccccgggactgggcggaaattttgctgctcagatggctggagggttcgatgaaaaagctggcggagcccagcttggtgtgatgcaggggcccatggggccaatgggtccccgtgggcccccaggcccagccggtgccccaggacctcaaggattccagggcaatcccggcgaacctggcgaaccaggagtgtcagggccaatgggacccagaggacccccggggccgcccggcaaacctggagacgatggggaggccggtaagcccggaaaagccggagagagaggccctcccgggccacagggcgcccgtggttttcccggaaccccaggcttgccgggcgtcaaaggccaccgcggttaccctggattagatggtgcaaagggcgaagcaggagcacccggtgtaaagggggaatctggatcgccaggcgaaaatggttctcctggacccatggggccgcgaggcctgccaggagagcgaggaaggaccggccctgctggggcagccggggcgaggggaaacgacggccagccgggacccgccggaccccccgggcctgtggggcctgcagggggtcctggctttccaggtgcaccgggcgccaaaggggaggcaggacctaccggtgcaaggggaccggaaggcgcacagggccctaggggcgaacctggcacccccggatccccgggacccgcaggagcttcaggaaatcccggcacggacggtatacccggcgcgaagggcagcgccggggctcctggaatcgccggtgcccccgggttcccaggcccacggggcccacctggacctcagggcgctacgggcccactcggacccaagggacagactggggagcctggcattgctgggttcaaaggcgaacagggccccaagggagagccgggccccgccggtccccagggggcgcccggacccgccggcgaggagggcaagagaggggctcggggtgagccgggcggagtcgggccgattgggcccccaggagagcgcggagctccaggtaaccggggatttccaggtcaggacggactggcaggcccgaagggcgcccccggtgagcgcggcccaagcggcctggccggtccaaaaggcgctaacggagaccctggcagacccggcgagccaggcctcccaggggcacgggggctcaccgggcggcctggagatgcaggtccccaggggaaagtcggtcccagcggagctcccggggaggacggccggccaggcccacctgggccacagggggctcgtggccagccgggagtgatggggttcccgggccccaagggggcaaacggcgagccagggaaggccggagagaaaggcctccctggcgcccccggtctccgggggcttcccggcaaggatggggaaactggggccgcaggtcccccaggccctgccggtccagccggggagcgcggggagcaaggggcaccaggcccctcgggcttccaggggctgcccggcccacccggacctcccggagagggagggaagcctggagatcagggcgttcccggagaggctggcgcgccaggcctggtggggccacggggcgagagaggtttcccaggagagcgggggtcccccggtgcccagggactgcaaggcccccggggcctacccggaactccaggaacagacggcccaaagggtgcatccggacctgctgggccacccggcgcgcagggtccaccaggcctgcagggaatgcccggcgaacgtggcgcggctggaattgccggaccaaaaggggatcggggggacgtcggcgaaaagggccccgaaggggcgcccgggaaggacggtggtagaggactgaccggtcctatcggccctcctgggcctgccggagccaatggcgaaaaaggcgaagtgggcccccccggccccgcaggttccgctggtgctaggggcgcccccggtgaacggggggaaacagggccccctggtcccgccgggttcgcggggccccccggagccgacggtcagcccggggctaagggcgagcagggagaggcaggacagaaaggtgacgcaggcgcgcctgggccacaaggaccctccggagcccctggtccacaaggccccactggcgttacagggcccaagggtgcccggggggcccagggtccccctggggcaaccgggttccctggggctgccggtagagttggtcctcccggttcgaacggcaacccaggacctccgggtcctccaggccctagtggcaaagacggtcccaagggcgctcggggtgacagtgggcctcctggtagggccggtgagccgggcttgcaagggcccgcgggcccacctggtgagaagggtgagccaggcgacgatggaccgtcaggtgctgaaggaccccccggcccacagggattagccgggcagagaggcatagtggggctgccaggccagcggggggagaggggatttcctggcctaccagggccgtcgggggagcccggaaaacaaggggcacctggagcatcaggggaccgaggcccccccggcccagtgggcccaccaggcttgacaggtccggcaggagaacccggacgcgagggatctcctggagcagacggcccaccggggagggatggtgccgcaggagttaaaggtgatagaggggagacaggcgccgtcggggcccccggcgccccagggccgcccgggagccccggaccagcgggccctaccggcaaacagggcgacaggggagaggcaggggctcaggggcccatggggccctcggggccggccggcgccagaggcatccagggcccacagggtcctaggggagataaaggggaagctggagaacccggggagcgcggccttaaaggccaccgtggctttacaggccttcaagggctccccggtccgcccggacccagtggagaccagggtgcgtcaggacctgcaggaccctcaggcccacgcggccctccggggccagttgggccaagtggtaaggacggcgctaacgggatacccgggccgatcggcccccctggtcccagaggtagaagcggagaaaccggaccagccggaccacctggcaaccctggcccccctggacccccaggaccaccgggaccgggaatcgatatgtcagcctttgcagggctggggcctcgagagaagggtcccgacccacttcagtacatgagagcggatcaggccgccggcggactgcgccagcatgatgctgaggtggacgcaacactgaaaagtctgaacaaccagattgagtctatccgatcaccagagggttcacgcaagaaccccgctcgtacctgtcgcgacctgaagctatgccaccccgaatggaaatcaggagattactggatcgaccctaatcagggatgcacactggatgcaatgaaggtattttgtaatatggaaacaggagagacttgcgtttaccctaacccagcaaacgtacccaagaaaaactggtggagctcgaagtccaaggagaagaagcacatttggtttggcgaaaccatcaacggaggattccacttttcttacggtgacgacaacctagccccaaatactgcgaatgtgcagatgacatttctgcgcctgctgtccaccgaaggttcacagaacataacttaccattgcaagaactctatcgcctatctagatgaagctgccggcaacttgaagaaagctttgctcattcaaggttcaaacgacgtggagatcagagccgaaggtaactctagatttacctatactgcactgaaagatggctgcactaagcacaccgggaagtgggggaaaactgtgatagaatacagatcacagaaaacttctagactgcccatcatcgacattgcccctatggacatcggagggccagagcaagaattcggggtagatattggtcctgtatgttttctctag

SEQ ID NO: 3936 - DNA, 4257 bp, Artificial Sequence
  Description of Artificial Sequence: Synthetic coding sequence
atgatccggctgggcgccccccagaccctggtgctgctgaccctgctggttgctgctgttctgcggtgccagggccaagatgttcgtaaacctgcacccgctctcgaaccggccgcacctggctcgctgtctcagatcgtcggccccaagggacccccaggaccgcaggggcctgcaggcgaacagggccctcgcggagacaggggcgataagggggaaaagggcgcacctggccctagggggagggatggcgaacccggcacgcccggtaatcccggccctcccgggcctcccggaccacctggtcctcccggtcttggaggaaactttgccgcgcagatggcagggggttttgatgagaaggcaggcggcgcacaacttggagtgatgcagggcccaatgggccctatgggaccccgggggccgccagggccggcgggcgctcctggtccccagggatttcagggaaatccaggtgaaccgggcgagcccggcgttagcggacccatgggtcctcgtgggcctcctggcccccccgggaagcccggtgatgacggggaggccggtaagccggggaaagccggcgagcggggcccgcctggtccgcaaggcgctagagggttccctggcacccccggactgcctggtgtgaaaggacacagaggctatcccggcctggatggcgctaaaggcgaagccggcgctcccggagtgaagggggagtccgggtctcctggagaaaatggctctcccggaccaatgggacccagaggcctgcccggagaacgggggcggaccggccctgcgggggccgctggtgcccggggcaatgacggtcagccaggaccggccggacccccaggtccggtgggcccggctggtgggcccgggttcccaggcgccccaggggccaaaggggaggccggccccaccggcgctcggggtcctgaaggcgcccagggtccacgaggggagcccggtactccgggatctcctgggccggccggagccagcggcaaccctggtactgatggcatccccggggccaaaggatccgctggagccccagggatagctggtgcacccggtttccccggaccacgagggccacccggcccccaaggagccaccggacctctgggtcctaagggccagaccggagagccaggcattgccggcttcaagggtgagcagggccccaagggagagcccggtcccgcaggtcctcagggcgcgcctggccctgcaggagaggagggcaagcggggcgctcgaggggagcccgggggagtgggtccgattggacccccgggcgagcggggagccccaggaaataggggcttccccggacaggatggcctcgccggacctaaaggtgccccaggcgaacgcggtcctagcgggctcgccgggcctaagggggccaatggtgacccggggcggcctggcgagcctggtctgcccggtgccaggggacttaccgggcgccctggcgacgccggcccacagggaaaggttggcccttctggagcaccgggtgaagatggccgaccaggccctccgggtccacaaggagccagaggccagcccggtgtaatgggatttccaggcccgaagggagctaacggtgaacccggcaaagccggagaaaaaggcctccccggagcccccggcttgaggggcctgcccgggaaggacggtgagacaggtgctgccggcccgcctgggccagcaggccctgccggtgagagaggagaacagggagcccctggcccaagcgggttccagggtctacccggacctccaggacctcccggagagggcggaaagcccggtgatcagggggtgcctggagaagccggggctccagggctggtaggacctaggggagaacggggtttccccggggagagaggctcccctggggctcagggcctccagggaccaaggggtctccccgggacccccggcacagacgggcccaagggtgcaagcggacctgccggcccacccggagcccagggcccccctggcttacagggcatgcccggggaacgcggtgccgcggggattgctgggccgaaaggtgatcgcggggacgttggcgaaaaaggcccagaaggcgccccgggcaaagacggcggcagaggtctgacaggacccataggaccccccgggcccgcaggagcaaatggcgaaaagggggaggtcggcccacctggccctgctgggtccgctggtgcgaggggcgctcccggagagaggggcgagacgggtccccccgggcccgcggggttcgcaggacctccaggtgcagacggacagccaggcgctaagggtgaacagggcgaggcaggccaaaagggcgacgcaggtgcaccaggccctcaaggtccgtctggagcccccgggccacaggggcctactggtgtcaccgggccaaaaggcgccaggggcgcccaagggccccctggcgctaccggtttccctggggccgctggcagagtgggtcctcctggtagcaacggaaatccaggtcccccgggcccccccggacccagtgggaaggacgggcctaagggcgcaaggggggactccggcccgccagggagggccggcgaaccaggacttcagggccccgccggtccgccaggagagaagggggagcccggcgacgacggtcctagcggtgccgagggtccacccggcccacaaggtctggctggccagcgtggaattgtgggcctcccaggccagcgtggagagcggggcttcccaggattgcctggacctagtggcgaaccaggcaagcagggcgcccccggtgcttctggggatagaggtcccccagggccagtagggccaccgggcctcacgggtcccgccggcgaacccggtcgggaaggcagccctggcgccgacggacctccagggcgggacggcgctgctggggtcaagggcgatagaggcgaaaccggcgccgtgggagccccgggcgcaccaggacccccaggaagtccagggcccgcgggacctactggcaaacagggggacagaggcgaggctggggctcagggaccgatgggaccctctggcccagccggtgcccgaggcattcagggtccccagggtccaagaggggacaaaggagaggccggtgagcctggagaacggggtcttaagggccataggggatttacaggcttgcagggactgcccggacccccgggaccgtctggcgatcagggcgcgagcggacccgctgggccaagtggaccaaggggacctcctggacccgtgggaccatcaggcaaagatggtgcaaatgggatccctggacctattggacccccgggccccaggggccgaagtggagaaactgggccagcaggccccccaggcaatcccggccctcccggtccgccagggccacccggcccgggcatcgacatgtctgcctttgcaggcctcggaccccgggaaaaaggtccggacccactgcagtacatgcgagcggatcaggccgctggggggttgcggcagcatgatgccgaggtcgacgccacactgaagtccctcaacaatcagattgaaagcattagatctcccgagggatctagaaaaaatccagctaggacatgtcgggatctcaagctgtgtcaccccgagtggaaaagcggtgactattggatcgatccgaatcaagggtgtacactggacgccatgaaagtcttttgcaacatggaaacgggtgagacatgcgtctaccccaatcccgcaaatgtacctaaaaagaactggtggtcttccaaatccaaagagaagaagcatatctggttcggtgagaccatcaacggaggattccatttctcttacggggatgataacctggcccccaacacagccaacgtgcagatgacctttttacgattactgtccactgaaggctcccagaacattacatatcactgtaagaacagcatagcctacctcgacgaagccgcaggcaacctaaagaaagcccttttgatacaagggtcgaatgatgtggagattcgcgccgaggggaactctagattcacttacacagcactgaaagacgggtgcactaaacataccggcaagtggggaaaaactgttatcgaataccgctcacagaagaccagtcggctgccaattattgacatagcgcccatggatataggaggccccgagcaagagttcggcgtggatataggacctgtgtgttttctgtag

SEQ ID NO: 3937 - DNA, 3939 bp, Artificial Sequence
  Description of Artificial Sequence: Synthetic coding sequence
atgggcccccggctgagcgtgtggctgctgctgctgcccgccgccctgttgctccatgaagaacactcccgggccgccgccaagggaggatgcgctgggtccggctgcgggaagtgtgactgtcatggagtcaaaggccagaaaggcgagcggggcctgcctgggctccagggtgttattggattcccgggcatgcagggtccagagggccctcagggtcccccaggccagaaaggcgacacaggtgagccagggctcccaggaaccaaggggacacggggcccccccggtgcaagcgggtatccaggaaaccctggcttgcctggcatccccggacaagacggcccaccaggaccaccgggcatacctggatgcaacggtacgaagggcgagcgggggcctctgggaccacctggccttcccggctttgctggcaaccccggtgatcccggcgaaatccttgggcacgtgcctgggatgttgctcaaaggcgagaggggcttccctggtatccccggcaccccaggtccccccggcttgcctggcctgcagggtccagttgggccaccaggctttacgggcccccctgtatcttttgggggctgtttatctgagttcgggcacggaggtatttccttccccttaactaagagacgacagggggaccagggagtgtcaggacccccaggcgttcctggacaggcacaagtgcaagagaagggcgactttgccactaaaggcgaaaagggacagaagggtgaaccgggattccagggcatgcccggcgtcggggagaagggcgaaccaggaaaaccaggccccaggggaaaaccgggtaaggatggggataagggggaaaagggatcacccgggtttcccggggaaccgggctatcccggcctcattggacgccaaggaccccaggttaacgccggcaccatcgcgtatccactacccccatgccctgtgatcggaactgggcccctgggagagaagggagaacggggataccccgggacccccggtccaaggggggagccgggccctaaaggctcgttcctggctttttttccacctccaccaacgccccccccctttgctggcttgccagtgccgggccaggcgggtgccccaggattccctggagagcgcggagagaagggggatagaggcttccctggcacctctctccccggccctagcggccgagacgggctgccaggccctcccggaagtcctggtccccccgggcagcctggttacactaacggcatcgttgagtgccagccgggacctcctggcgaccagggtccccccggcattccaggccagcctgggttcattggcgaaatcggggagaaagggcagaaaggggaaagttgtctgatttgtgatatcgacgggtaccggggccccccagggccccaggggccccctggcgagatcgggtttcctggccagcctggtgccaaaggtctccctggcattactgggcagtctggcctgcccggactcccaggacagcagggagcccccgggatcccaggattccccggatccaaaggggaaatgggcgtgatggggactcctggacagcccggctcccccggccccgtaggcgcaccaggcctcccaggcgagaaaggagatcacggctttccaggatcgtcaggccctcgaggagatcccggcctcaaaggggataagggcgatgtaggtctgcccggtaaacccggctccatggacaaagtggatatgggaagtatgaagggccaaaagggcgaccagggagagaagggccaaattgggcccattggggagaaggggtccagaggcgatcccggaacgccaggcgtgcccgggaaggatggacaagctggccagccaggacagccagggcctaaaggcgacccggggatttccggtacccctggcgctcccggcttgccgggtcccaagggaagcgtgggtggcatggggctcccaggaacaccaggggagaagggtgttcccgggatcccaggcccacaggggagtcctggcctcccgggagataagggggccaagggagaaaaaggccaggcagggcctcctggcataggaatcccaggtcttaggggtgaaaagggcgaccagggtatcgcaggcttcccagggtccccaggtgagaaaggtgagaagggatctatcgggatacccggcatgcctggctccccaggtctgaaagggtcacctggctctgtgggctaccccgggagcccggggctcccgggagaaaagggtgataaggggctcccgggcctcgacgggatccccggagtcaagggcgaggcaggcctccctggcacccctggaccgactgggcccgctggccagaaaggtgagcctggttccgacggaatacccggatctgcaggagaaaaaggagaaccggggttaccaggacgggggtttccgggattcccaggcgccaaaggcgataaagggagcaagggtgaagttggatttccaggccttgccgggagtcctggcatacccggatcaaagggcgagcaaggatttatgggccctcctgggccccagggccagcctggtttgcccggctcccccggccatgcaaccgagggcccgaagggtgataggggcccacaggggcagcccggactgccaggccttcccgggcccatgggcccccccggtcttcccgggatcgatggtgtgaagggcgacaaaggtaaccctggttggcctggggctcccggggtccctggccctaaaggagatcctggcttccagggaatgccaggcatcgggggtagccctggtatcacaggaagcaaaggcgacatggggcctcctggcgtgccggggtttcaggggccaaaaggtctacctggactacagggtatcaaaggtgatcagggagatcagggagtgccaggtgcaaagggtttgccaggtcctcccgggcctcctggaccatatgatatcattaagggcgaaccaggcctccctggtcccgagggcccacccggcctgaaggggctgcagggtctccccgggccaaaaggtcaacagggcgtgaccggcctggtgggtatcccagggcccccaggcatccccggattcgatggtgctcccggtcaaaaaggcgagatgggacctgccggccctacagggccccgcggattccccggccctccgggacccgacggtcttccagggtctatggggcccccgggcaccccttccgtggaccatggctttttagtcacaagacactcccagactattgacgatcctcagtgccctagcggcacaaagatactgtatcatggttactccctgctgtacgttcaaggaaacgaacgagcccacggccaagatctgggcactgctggttcatgtcttcgaaaattctccacaatgccttttctgttttgtaacatcaataacgtctgcaactttgctagtcgcaacgattattcctattggctgtctacgcctgagcccatgccaatgtccatggcccctatcaccggggaaaacatcagaccattcatatcgagatgcgccgtgtgtgaggccccagcaatggttatggccgtccactcgcagacaatccagatcccgccatgccccagcgggtggtcttccttatggataggttacagtttcgttatgcataccagtgccggtgccgagggttctggccaggccctggccagcccaggcagctgcttggaagaatttcggtcagcgcccttcatcgaatgccacgggcggggaacttgcaactactatgcaaacgcctattccttctggctcgcaacgatcgaaaggtccgaaatgttcaaaaaaccaacaccctcaaccttaaaggctggggagctgagaactcatgtgtcccgatgtcaggtgtgtatgcggcgcacctag

SEQ ID NO: 3938 - DNA, 5010 bp, Artificial Sequence
  Description of Artificial Sequence: Synthetic coding sequence
atgggcccccggctgagcgtgtggctgctgctgctgcccgccgccctgcttctgcacgaagaacactcgagagctgctgctaaaggcgggtgcgccggttctggctgcgggaaatgcgactgccatggtgttaaaggacaaaaaggggaacgaggtctgcctggtctgcagggggtgatagggtttcccgggatgcagggaccagagggccctcaagggccgccaggacagaagggggacacaggcgagcccgggttgccaggaaccaagggcacacgcggtccccccggcgctagcggttatcccgggaaccccggactgccaggcataccagggcaggacggccctcctggtccccccggaatacctggctgtaacggaacgaagggcgagagggggcctcttgggcccccaggtctgccagggtttgcaggaaacccggggccacccggcttacctggtatgaaaggcgacccgggagagatcctcgggcacgtgcccggtatgctgctgaagggcgaacgtgggtttcctggtattcctggcactcctggaccacccggccttcccggcctccagggaccggtgggccctccaggatttaccggcccacccggacctccaggtccgcccggccctccgggcgagaaaggtcagatggggctctccttccagggacctaagggagataagggggatcaaggggtgagtggtcccccgggcgtgcccggccaggcccaggtgcaggaaaaaggcgattttgctaccaagggcgagaagggccaaaaaggtgagcctgggtttcagggcatgcctggtgttggggaaaagggtgaacctgggaagccaggtccaagaggaaaacctgggaaggatggagataagggggaaaaagggagtccaggcttccctggtgagcccggatatcccggtctgatcggccgccaaggtccccagggcgaaaagggagaggcggggccacccggtcctccagggatagttatcggaacgggccctcttggcgagaagggtgagcggggataccccggcacgcccggccctcggggggaaccaggtcctaaagggttccccggactccccgggcagcccggccctccggggttgcctgttcccggacaggctggcgctcccggtttccccggagaacgcggcgagaagggagacaggggcttccctggaaccagcctgcccgggccatccggacgggatgggctgcctggcccaccaggatccccgggtcctcccggtcaacccggctacacaaatgggattgtggaatgccagcccggccccccaggggatcagggaccccctggaatccctgggcagcccggtttcatcggcgaaataggtgaaaaaggacagaaaggcgaatcatgtctaatttgcgatattgatggttatcggggcccgcctggcccccagggcccccccggcgaaattggctttcccggacagccaggagcaaagggggatcggggtctgcccgggcgagacggcgttgctggtgtcccaggcccacaggggaccccagggctgatcggccaacccggtgctaaaggcgaacccggagagttttacttcgacttgagactaaagggtgataaaggcgatcctggttttcctggacagcccgggatgaccggcagagctgggtctcccggccgcgatgggcacccaggtctacccggacctaagggctcaccagggtcagttggtttgaagggtgagagaggcccacccgggggcgtcgggtttcctggttcccgtggagacaccggaccccctggcccgccaggctacggacctgccggtccgatcggcgacaaaggacaggccggattcccgggaggcccggggtcccctggtctgccgggccctaagggcgaacctggaaaaatcgttcctctcccaggaccgccaggagctgaaggtcttccaggatcacctggtttccctggcccacagggagacaggggatttccaggcactcctggccggcccggcctgccaggagagaagggggctgtggggcagccaggaatcggctttcctggccctcctggacccaaaggggtcgacggtttgcccggggacatggggcccccggggacaccagggagacctgggttcaacggtttgcccgggaatccaggggtccagggccaaaaaggagagccaggcgtgggtctcccgggtctaaagggacttcctgggttgcccggaatacccggcacccctggagagaaaggctccatcggggtgccaggcgtgccgggagagcatggggcaattggaccccccggtctccaagggattcgcggcgagcctgggcccccagggctcccagggtccgtggggagcccgggagtgcccggcattggcccaccgggggctagggggccacccgggggccagggtccacccggtctgagcggtccaccgggcatcaagggagagaagggctttcctggatttccaggcctcgacatgccgggacccaagggggacaagggcgcacaaggtcttcccgggataacgggacagtccggcctccccggattacccggccagcaaggagctccaggcatccctggttttcccggaagcaagggagaaatgggggtgatggggacacctggccagcccggatcccccggccccgtcggggcacctggactacctggtgagaagggagaccacggctttccaggttctagtggaccacgtggggaccctggtttgaagggggacaaaggggacgtgggactgcctgggaagcctggtagcatggacaaggtagatatggggtcaatgaagggccagaaaggagatcagggcgaaaaggggcagatagggcccattggagagaaggggtctcggggggaccccgggaccccaggtgtgcccgggaaagatggccaagctgggcaacctggccagcctggcccgaagggggatccagggatttcaggcacgcccggcgcccccggactgcctggaccaaagggctccgttggcgggatggggctgccagggactcctggtgagaagggcgtgcccggcatcccgggcccccaagggtctccagggctacctggagataagggggccaaaggcgaaaaaggtcaggcaggtccccccggcatcgggatcccagggttaaggggggagaagggcgaccagggtattgcgggcttcccggggtcccccggcgaaaagggcgagaaaggatccatagggataccaggaatgccagggtctcctggacttaaaggcagcccaggcagtgtcggttacccgggctcacctggcctgcctggcgagaagggcgacaaaggactccctggcctggatggcattcccggagtgaaaggggaggcaggcctaccgggcacacctgggcctacaggccctgccggccaaaaaggcgagcctggaagcgatggcatccccggctcggccggtgagaagggggagccgggcctgcctggcagaggattccctgggttcccaggggccaagggcgacaagggctcaaaaggggaagtcggcttcccaggacttgccgggagcccagggatccccggctcaaagggagaacaggggttcatgggaccaccaggtccacagggacagccgggacttcccggcagccccggccacgcaacagagggaccgaaaggggaccgaggtccccaggggcagcccggccttccaggcttacctggacccatgggcccaccaggactgcctggaatagacggtgtcaagggcgacaagggaaacccaggatggcctggcgctcccggtgttcccggccccaagggcgatccaggctttcaagggatgccaggcataggcggttcacccgggattaccgggtcaaagggcgatatgggacccccaggagtcccagggttccaaggtcctaagggtctccccggactccagggcatcaaaggtgaccagggcgaccaaggggtgcccggtgccaagggactgccagggcctcctggtcctccagggccctacgatatcattaagggcgagccgggactcccaggacccgaaggcccaccggggttgaaggggctgcagggcctgcccgggcccaaaggccaacagggagtcaccggattggtgggaattcccggaccccctggcatcccgggatttgatggagcccccggtcagaagggggagatggggccggctggacccaccgggccaagaggatttcctggtccccctggccccgatggactgccgggcagtatgggtcctccgggaacaccaagcgtagaccacggattcctagttactagacactctcagactatcgatgatcctcagtgccccagtggcaccaaaattctatatcatggctactcattgctctacgtgcaaggtaacgagagggctcacgggcaggatctcggcacggctgggtcctgcttgagaaagtttagcacgatgccattcctgttctgtaacattaataacgtctgtaacttcgcttcccgcaacgactatagctattggttatctacccctgagccaatgccaatgtcgatggcacccataaccggcgagaacattagacccttcattagccgatgcgccgtatgcgaggcacccgccatggtcatggccgtacactcccagacaatccaaatccccccctgtccaagcgggtggagctcactctggattggctatagttttgttatgcacacgagcgccggcgccgagggctctgggcaagcactggcctcgccaggctcttgtctggaagagtttaggtccgctcccttcattgagtgccatgggagaggtacttgcaactactacgcgaatgcctattcattctggctggcgacaattgaaaggagcgaaatgttcaaaaaacctactccttcaaccctcaaggctggtgagctgcgtactcatgttagccgttgccaggtatgcatgcgaaggacctag

SEQ ID NO: 3939 - DNA, 3957 bp, Artificial Sequence
  Description of Artificial Sequence: Synthetic coding sequence
atgggcccccggctgagcgtgtggctgctgctgctgcccgccgcccttctgctgcacgaggagcactctcgagccgctgcgaagggcggctgcgccggtagcggctgcggcaagtgcgattgccacggagtcaaggggcagaagggagaacgcggccttccggggctacaaggggtcatcgggttcccgggtatgcagggtcccgaagggccccaagggcctcccggccagaagggtgacactggcgaaccaggcctgccgggcactaaggggactaggggtccccctggtgcctcaggttatccaggtaacccagggcttccgggcattcccggacaagatgggcctccaggccctcccgggattccaggttgcaatggcacaaagggcgaacgggggccgctgggcccccccgggctccccggattcgcgggcaaccccggaccgccaggcctgcccggtatgaagggggatccgggagagatactcgggcatgtgccaggaatgctattaaagggcgagagaggttttccaggaattcccggaacaccaggaccacccggtctgccaggcttacagggacccgtggggccaccagggtttaccggcccccccggaccccccggtccacccggaccccccggggagaaggggcagatgggacttagcttccagggcccaaagggagacaagggtgaccaaggggtttctggtccgcctggggtgccaggtcaggctcaggtgcaggagaagggggacttcgccacaaaaggagagaagggtcagaaaggcgaacccggtttccaaggcatgcccggtgtaggagaaaagggcgagcccggaaaacccggacctagaggcaaaccagggaaggatggcgacaaaggagaaaaagggagtccaggtttccctggcgaacctggttatcccggacttatcggcagacagggcccacagggggagaagggggaagcagggccgcccggtccccccggtatagtcataggtaccggcccactgggcgaaaaaggggaaaggggttaccctgggacaccgggccctaggggcgagccaggaccaaaggggtttcctggactacccggacagcctggcccacctggattgcctgtaccagggcaggcaggagcgccaggattccctggcgagagaggggaaaaaggcgaccgtggctttcctggtacgtccctgcctggaccctctggacgagacggcctgccgggcccaccggggtcacctgggccacccggacagcccggctacacaaatggcatagtggagtgccagccagggcccccaggcgaccaaggccctcctggaattcctggacaacctgggttcatcggggagattggcgagaagggacagaagggcgagagctgtttaatctgcgacattgatgggtataggggcccccccggccctcaagggcccccaggcgagatcgggttccctggccagcccggcgcaaaaggactcccaggaatcaccggccagagcggattgcccggcctgccaggacagcagggcgccccgggcatccccggattccccgggtccaaaggcgagatgggggtaatgggcacacccgggcaacctgggtccccagggcccgtgggggccccaggactaccgggggaaaagggggatcatggctttcctggctcgtccggcccccggggagatcctggactgaagggcgacaagggcgacgtgggtctgccaggcaaacctgggagcatggataaagtggatatgggctccatgaaaggtcaaaagggggaccagggcgaaaaaggacagataggcccgataggtgagaagggttcgcgaggtgatccaggcaccccgggtgtgcccggcaaagatggtcaggcgggtcagccaggccagcccggcccaaagggtgatccgggaatctcagggacgccgggggcccctggtcttcccggcccaaagggttccgttggcggaatgggcctacccgggacccccggcgagaagggggtgcctggcatccctgggccccaggggtcaccgggtctgccgggcgataaaggcgcgaaaggagaaaaaggacaagcaggcccccctggaattgggatccctggcctgagaggggaaaagggtgatcaaggcatcgccggcttccctggatcccccggagaaaagggagagaaggggagcatcgggattcctggcatgccaggatctccgggtctgaagggcagcccgggatcggtaggctatcccggctcccccgggttaccaggtgagaaaggggacaagggcctgccgggtctggatggcatccctggtgtaaagggcgaagccggattacctggcactcctggtccaacagggcctgctggccagaaaggcgagcccggcagcgatggaatcccaggcagtgctggggaaaaaggagagcctggactgccaggcagggggttcccgggattccctggcgcaaagggagataaaggctccaaaggggaggtgggcttcccaggtctcgcggggtcccctggtatacctggctcaaagggcgaacaggggtttatgggtccaccaggcccccaagggcagcccggactcccaggatctccaggacacgccactgaagggcccaagggagatcgcggccctcaggggcagccgggtctgccaggactccccgggccgatgggaccccccggtttgccaggaattgatggtgtgaagggcgataaaggtaacccaggatggcctggggcaccaggggtgccaggtcctaagggcgaccccggctttcagggaatgcctggtattgggggctcgccgggcatcaccggatccaaaggtgacatgggaccccctggcgtccccggtttccaaggtccaaaaggtctgcccggcctgcagggtatcaagggcgaccaaggagaccagggggtccccggcgctaaaggcctgcctggacccccaggcccacctgggccctacgacatcatcaagggggaaccgggtttgcctggaccagagggcccaccgggtctgaaaggcctgcagggtctgcctggtcctaaggggcaacagggcgtgactggtctggtgggaatacctggcccacccggaatacctggtttcgatggcgctccgggacagaagggagagatggggcccgccggccccacaggacccaggggatttcccgggcctcccggacccgacgggctccccggaagcatgggcccacccggcacgccctccgtggaccacggtttccttgtgactcggcactcacagacaatagacgatccacagtgcccatcaggcaccaaaatactttatcatggctatagcttgttgtacgtgcagggtaatgagagagcgcacggacaggacctgggcacagccggatcatgcctcagaaaattctcaaccatgcctttcctcttctgcaatatcaacaatgtgtgtaattttgcgtcccggaacgactatagctattggctgagtactcccgaacctatgcctatgagcatggctcccatcacgggcgagaatatacggccctttattagccgctgcgctgtgtgtgaggcccctgccatggtgatggcggtgcacagccagactatccaaatccctccctgccctagtggttggagttccctttggattgggtactcctttgttatgcacacctccgctggggcggaagggagcggacaggccttggcaagccccgggtcatgtcttgaggagtttcggagcgcccctttcattgagtgccacggcagagggacctgcaattactacgcgaatgcttacagcttctggctggctactattgaaaggtccgaaatgttcaagaaacctaccccctcaaccctcaaggcaggcgagctgcgaacacacgtgtctcgctgccaggtatgcatgcgccggacatag

SEQ ID NO: 3940 - DNA, 1560 bp, Artificial Sequence
  Description of Artificial Sequence: Synthetic coding sequence
atgggcccccggctgagcgtgtggctgctgctgctgcccgccgccttactcctccacgaagaacactctcgcgcagcagctaagggcggctgtgcgggcagtgggtgcggtaaatgcgactgtcatggcgtgaagggccaaaagggggagcggggtcttccaggactgcaaggagttatcggttttcccggcatgcaaggcccggagggtccccaaggcccccccggacagaaaggagacaccggagaaccagggctgccggggaccaaaggcacccggggtcccccaggagccagcggatatcctggcaaccctggcttgcccggcatcccgggtcaagacggtccgcctggcccacccggcataccaggctgcaacggcacaaagggcgaacgggggcccctcgggccgcctgggcttcccggatttgcaggaaaccctggacctccagggctgccaggcatgaagggcgatcctggggagatccttggccacgtacccggaatgctgctcaagggcgaaagaggctttcctggcattccaggtacacctggccctcctgggctgccgggcttgcagggccctgtaggacctcctgggtttacaggaccaccaggtccccccggcccaccggggcctccaggagagaagggtcagatgggactgtcctttcagggccctaagggggataagggggatcaaggtgtttccgggccccccggcgtgccggggcaggcacaggtgcaggagaaaggggattttgcgacaaaaggcgagaaggggcagaaaggcgagcctggctttcaggggatgccaggggtaggcgagaaaggtgaacccggtaagcctgggccccggggcaagccaggcaaagatggagacaaaggtgagaaggggagtcccggttttccgggtgagcctggttatccagggctgatcggccgccaaggaccccagggcgaaaagggagaagccggaccacctggacccccaggaatcgttatcggcactggacccctgggggagaaaggcgaacgcggctacccaggtactcctgggccccgcggagagcccggaccgaagggcttccccggcctgccaggccagcctggacccccagggctgcccgtgccaggtcaggccggtgcacccggatttcctggagaacgcggtgagaagggagaccgaggattcccaggcacctctctgcccggaccaagcggcagggacggactacctgggccccccggttctcctggacccccagggcagcccggatacacgaacggtattgtggagtgccagcctggccctccaggagaccaggggccacccgggattcccggccagcccgggttcattggcgaaataggtgaaaaaggtcaaaagggagaaagttgcttaatctgcgacatcgatggatacaggggaccacctggaccccagggcccccccggcgagattggatttcctggccagccaggcgcaaagggagacagaggtctgccagggcgcgatggagttgccggagtaccactgctcttccagatccacaaatag

SEQ ID NO: 3941 - DNA, 1797 bp, Artificial Sequence
  Description of Artificial Sequence: Synthetic coding sequence
atgagcgacaaccagagctggaacagcagcggcagcgaggaggaccctgagacagagtcagggccaccagtggaacgatgcggcgtgttaagtaagtggaccaactatatccacgggtggcaggatcgctgggtggtgctgaaaaacaatgccctgtcttattataaatctgaagacgaaactgaatatggttgcaggggctctatatgcctatccaaagcggtcataacaccgcatgacttcgatgaatgccggtttgatatctctgttaatgatagcgtttggtacctccgcgcccaggatcctgaccacaggcagcagtggatcgatgccatcgaacagcataaaacggagagtggttacgggtcagaaagttcccttaggaggcacggttcaatggtcagtttggtttccggggcatcaggatatagcgctacctctacgagttcttttaagaagggccactcactcagagaaaagttggctgaaatggaaacctttagggacatattgtgtagacaggtcgatacccttcagaagtactttgatgcttgcgccgacgctgtaagcaaagatgaacttcaacgagataaagtcgtcgaggatgatgaagacgactttcccaccacacgatccgatggcgattttttgcatagtacgaacggaaacaaagagaagttgtttccccatgtcacccccaagggaattaatgggatcgatttcaaaggagaagccatcacattcaaagcaactaccgctgggatcttagctactctatcacactgtatcgagctgatggtcaaacgcgaagactcttggcagaagcgtctggacaaggaaaccgagaagaagaggaggactgaggaggcttacaaaaatgccatgactgagctgaaaaagaaaagtcacttcggagggcctgactacgaagagggccccaactcattgattaacgaggaagaattttttgacgcggttgaggccgctcttgaccggcaggataagattgaagagcaatcacaaagtgagaaggtcagactgcactggcccacctccctgccttctggtgatgcgttttcatcagtgggcacccacagattcgtgcagaaggtagaagagatggtgcaaaatcatatgacctattctctccaagacgttgggggggatgcaaattggcaactggttgtggaggaaggcgaaatgaaagtctataggcgggaggtcgaggagaatggcattgtgctcgacccactgaaggccacccatgcagtaaaaggtgtcacgggacacgaggtgtgtaactatttctggaatgtagatgtccggaacgactgggagactaccatcgaaaattttcatgtagtagagactctggctgataatgccatcattatttaccaaacccataagcgtgtgtggccagcgtcccaacgcgacgtgctttaccttagcgtgattaggaaaattcccgcgttgactgaaaatgaccctgaaacctggatagtgtgtaacttttctgttgaccacgattccgcgcctctcaacaataggtgtgtgagagcgaagatcaatgtagccatgatctgtcagaccctggtctcacctccggaagggaatcaggagatcagtagggataacatactttgtaagatcacctacgttgcgaacgtgaaccccggtggatgggctccagcctcagttttgagagccgtagcaaagcgcgagtatcccaagttcctgaagcgattcaccagttatgtgcaagagaaaactgccggaaagcccatactcttttag

SEQ ID NO: 3942 - DNA, 690 bp, Artificial Sequence
  Description of Artificial Sequence: Synthetic coding sequence
aaggtggaggagatggtgcagaaccacatgacctacagcctgcaggatgtgggaggggatgctaattggcagttagtagttgaagagggtgagatgaaagtgtaccggcgggaagtcgaagaaaatggcatcgttctggatccactcaaagccactcatgctgttaagggcgttaccggacacgaagtctgcaactacttctggaatgtggatgtacgaaacgattgggaaacaacaattgaaaattttcacgtggttgaaaccctcgccgataatgccataatcatttaccaaacacataagcgggtgtggcctgcgagtcaaagggatgtgctctatctgagcgttatccgcaaaatcccggcacttaccgaaaacgaccctgagacatggatcgtctgcaactttagcgtcgatcatgacagcgctcctctgaacaatcggtgtgttcgagcaaagataaacgtagccatgatctgtcagactttggtctccccccctgaggggaaccaggaaatcagccgcgataacattttatgcaagatcacatatgtggccaatgtgaaccccggcgggtgggcaccggcctcagtgctgcgtgccgtagccaaacgcgagtacccaaagtttcttaagcggtttaccagttacgtccaggagaagaccgcaggtaagcctatcctcttctag

SEQ ID NO: 3943 - DNA, 2259 bp, Artificial Sequence
  Description of Artificial Sequence: Synthetic coding sequence
atgcagcacagctgcatccccaccccccccagccccttcagcgccccaccagcctttctccccgtggtgacaagagaaagcagaagggggctttccagtggcggtagcgctggacgaaacgcgggagtaaccgctactgccgccgcagctgatggctggaaggggcgactcccatcccctctggtgcttttgcctaggtctgcccggtgtcaagctaggagacgtaggggcggaagaacgtcatcactgctcctgttgcctccaactcccgaaagagcattgttcgccagtccaagcccagatccttctccacgcgggctgggcgcctcaagcggagccgccgaaggggccggggccggattgctcttggggtgcagagcctcaatgagtgacaaccagtcctggaattctagcggcagtgaagaggacccagagaccgagagtggtccccccgtggaaagatgcggcgttctgtcaaaatggacaaattacattcatggttggcaagaccgctgggtcgtgctgaagaataacgcactgtcgtattataagagcgaagatgaaactgagtacgggtgccgcggatccatttgcctctctaaggccgtgatcactcctcatgatttcgacgagtgtcggtttgacatcagcgtcaatgatagcgtgtggtacctaagggcccaagaccctgaccaccggcagcagtggatcgatgccatcgaacagcataaaacagagtccgggtatggctccgagagctctctgaggcggcacggatccatggtctcactggtgtctggtgcctctggttattccgctaccagcactagcagctttaaaaagggtcactccctgagagagaagctagctgagatggaaaccttcagggatatcctgtgtcgccaagtggataccctccaaaagtactttgacgcctgcgctgatgccgtctcaaaggatgagctgcagagggataaggttgtggaggacgacgaggatgatttccccaccacccgatccgacggggacttcctgcatagcacaaacggcaacaaagagaaactcttccctcacgtaacccctaagggcattaacggtattgattttaagggagaggccataacattcaaagcaacaacagctggaatactggccaccctatctcactgtattgaattgatggtaaagcgtgaagacagctggcagaaacgacttgataaagaaacggagaaaaagaggcgcacagaggaagcatataagaacgctatgaccgaattaaagaagaagagccactttgggggaccagattacgaagaaggtccaaattcgttgattaacgaggaggagtttttcgacgccgttgaagcagctctggatcggcaggataagatcgaggaacagtcccagtcggagaaggtcagactgcactggcccacatcgctgccttctggtgacgcctttagctccgtgggaacacatcggtttgttcagaagccatattctcgatcctcttccatgtcctccattgacctggtgtctgctagtgatgacgttcaccgattttcctcacaggtcgaagagatggtacagaaccacatgacctattctctgcaggatgtcgggggagacgccaactggcagctcgtcgtggaagaaggggagatgaaggtataccggcgggaggtggaggagaatggtattgtccttgatcccttaaaggctacacacgccgttaagggcgtgacaggccatgaagtgtgtaattatttctggaacgtcgatgttcggaatgactgggagacaactattgaaaactttcacgtggttgaaacgctcgccgacaacgctatcattatatatcagacacacaaaagagtttggcccgcctcacaacgggatgtgctgtatctatcggtgattaggaagattcccgccttgacagagaacgatccagaaacttggatcgtctgcaatttctcagttgatcacgactctgccccactgaataataggtgtgtgagggctaagatcaatgtggccatgatctgccagacactggtgtcgcccccagaggggaatcaggagatcagtagggataatatcttatgtaaaattacgtacgtcgcaaacgtgaatcctggagggtgggccccagctagtgtgctgagagccgtggctaaacgagagtacccaaagtttcttaaaaggtttactagttacgtccaagagaagacagccggaaagccaattctgttttag

SEQ ID NO: 3944 - DNA, 1875 bp, Artificial Sequence
  Description of Artificial Sequence: Synthetic coding sequence
atgagcgacaaccagagctggaacagcagcggcagcgaggaggacccagagactgagtccgggccaccagtagaacgctgcggtgtcctgagcaaatggacgaattatatccacggatggcaggatcgatgggtggtgctgaaaaacaacgcactgtcatattacaaatctgaagacgagaccgagtatggctgtaggggcagtatatgcctgtccaaggctgtcatcacacctcatgacttcgatgagtgtaggtttgacatttcagtcaacgattcggtgtggtacctgagggctcaggatcctgatcaccggcagcagtggatcgatgctatcgaacaacacaagaccgagagcggatatggtagcgagagttcgctgcgtagacatggatccatggtgagtctagtatcaggcgcaagcgggtacagcgcaactagtacatcttccttcaagaaaggccacagtttacgggagaagctcgccgaaatggagacctttcgggatatactgtgcagacaagtggataccttgcaaaaatattttgatgcgtgtgctgacgcggtgagcaaggacgaattgcaacgtgacaaagtggttgaggatgatgaggatgacttccctacaacccgatctgacggtgacttccttcattcgacaaacgggaacaaggagaagctgtttcctcatgtgaccccaaagggcattaatggaattgattttaagggcgaggcgataaccttcaaggctacaaccgcaggaattctcgctaccctttcacattgcattgagttaatggtgaagcgcgaggatagttggcagaagagactggataaagaaaccgagaaaaagcggaggacagaggaggcttacaaaaatgctatgaccgagttgaaaaagaaatcccactttgggggccctgactatgaggagggcccaaattccttgattaacgaggaggagttttttgatgcagttgaagcagcacttgatcgtcaggacaagatcgaagaacagagccagagcgagaaggtgagacttcactggcccacgagtctgccctcgggagatgcctttagcagcgtcggtacccatcggttcgtgcaaaagccctattctcgctcctcatctatgtcctcaattgatctagtctccgcatccgacgatgttcataggttttcctcccaggttgaagagatggtacaaaatcacatgacctatagcctccaggacgtgggcggagacgccaactggcaactcgtggtcgaggaaggagaaatgaaggtttatagacgggaagtggaagagaacggtattgtattagacccgctgaaagctacgcacgccgttaaaggggttactgggcacgaagtgtgcaactacttttggaatgtcgatgtacgaaatgattgggagaccactatcgaaaactttcatgttgttgaaacacttgcagataatgccattattatttatcaaacccacaagagagtatggcccgcatcccagcgggacgtgctgtatctgagcgttataaggaaaatcccggccttaaccgaaaatgatcccgagacgtggatcgtgtgcaacttttctgtggaccatgactccgcaccgttgaataaccgctgtgttcgggccaagatcaatgtagccatgatctgccaaaccctggtcagcccccccgaaggaaaccaggagattagccgagacaatattctgtgtaagataacatacgttgctaatgtcaacccgggagggtgggctcctgcctctgtcctccgcgcggtggccaagagagagtatccaaaattcttgaagaggttcacctcatacgtacaggaaaaaactgccggaaaacctatccttttttag

SEQ ID NO: 3945 - DNA, 381 bp, Artificial Sequence
  Description of Artificial Sequence: Synthetic coding sequence
tgacccgccagccagcgggacgtgctgtacctgagcgtgatccggaaaattccggcattaaccgagaatgaccccgaaacatggatcgtgtgcaatttttccgtagaccacgactcagccccactgaataacagatgcgtcagagctaagattaacgtggcaatgatatgccagactctggtttctccccccgagggcaatcaagaaatctcacgagacaacattctgtgtaagattacctacgtggcaaacgtgaaccccgggggatgggcacctgcctcggtgctgcgggcggtagccaagagagagtaccctaagtttctaaaacggttcacctcctacgttcaggagaagacagctgggaaacccatcctcttttag

SEQ ID NO: 3946 - DNA, 5064 bp, Artificial Sequence
  Description of Artificial Sequence: Synthetic coding sequence
atgtggagcctgcacatcgtgctgatgcggtgcagcttccggctgaccaagagcctggcgaccggtccctggtccttgattcttatcctgttctctgtacagtacgtgtatgggtcggggaagaagtacattggaccatgcggaggaagggattgcagcgtatgtcactgtgtgccagagaagggcagccgcggcccaccaggtcccccaggtccacagggaccgatcgggcctttaggagctcccggccccatcggcttgagcggggaaaaaggtatgcgcggggacaggggacctccaggcgccgcaggcgacaagggagataaaggaccgaccggcgtgcccggtttccccggattggatgggattccgggccaccctggaccgcctggtcccaggggcaaacctggcatgtctggacacaatggctctagaggtgatcccggcttccccggtggaagaggagcgctcggtccaggcgggcccctgggccaccctggagaaaagggtgagaagggcaatagcgttttcatcctgggcgccgtgaagggtatccagggtgatcggggggaccctggtctgccgggtctcccaggaagctggggagctggaggaccggccgggcctaccggctatcccggcgagccgggtctggtgggaccaccaggtcagcctggccgcccaggcctgaagggcaaccctggcgtgggagtcaagggccagatgggcgaccctggcgaggtcggccagcaggggagccctggcccaacacttctcgttgagccgcctgacttttgcctgtacaagggagaaaaggggataaaagggattcccggcatggtgggcctccccgggcccccgggccgcaagggggaatccgggatcggggcgaagggcgagaaggggattccaggtttccccggcccacggggtgaccccggttcctacggctcccctggttttccaggtctgaagggagagctgggcctggtaggcgatccaggactcttcggcctgatcggccccaaaggcgacccagggaaccggggtcatcccgggccccctggtgtcttggtcacccccccattgccgctgaaaggcccccccggagatcctggcttccctgggcggtacggcgagacaggtgatgtaggtcctccgggaccaccaggcctgttggggaggcctggagaggcatgcgcaggtatgattggcccacccggaccgcaagggtttcctggactccccggcctgccgggcgaagccggcataccaggcaggccagactccgcacccgggaagcctggtaaacctgggagcccaggcttaccaggggcgccgggactgcagggtttacccggtagcagcgtaatatattgtagtgtggggaaccctgggccgcaaggcatcaaaggcaaagtgggccccccgggcggaagaggtcccaagggcgaaaaagggaatgaaggcctgtgtgcatgtgaacccggacctatgggcccccccggtccccctggactgcccggacggcaagggtcaaaaggtgatctcgggctgccaggatggcttggtacaaagggggaccccggaccccccggcgccgaaggacccccaggattgcctgggaaacacggagcatccggtccgcccgggaacaagggcgcgaaaggtgatatggtagtatcaagagtgaagggacacaaaggggaacggggaccggacgggcctccaggctttcctggccagccagggagccatgggagggacggtcatgccggggaaaaaggcgatcccggcccccccggcgaccatgaggacgcaactccaggaggaaaggggtttccaggtcctcttggcccccccggcaaagcagggcccgttggcccacctggcctgggatttcctggccctcctggggaacgcggtcacccaggggtaccgggccacccaggcgtgagaggcccagacggcctaaaaggccagaaaggggatactatctcttgcaatgtcacatatcccggccgacacggacctcctggcttcgacggaccccctggacccaagggattccccggaccccagggcgctccaggcctaagcggctccgacggacataagggacggccaggcacccccggcacagccgaaattcctggtccgcctggtttccgcggcgatatgggagacccgggtttcggcggcgaaaagggttccagccccgtaggcccccctggccctcccggatctcccggtgtcaacggtcaaaagggaatcccaggcgatcctgccttcggccatctcggtccccctggaaagagaggactgagcggggtcccggggatcaagggccctcgcggggaccctgggtgccccggagcagaaggacctgccggaattcctgggttcttgggacttaaaggtccaaagggaagggaggggcacgctggcttcccaggagtgcctgggccaccaggtcatagctgtgaacgcggagcacccggtatccctgggcagcccggcctccctggttatccaggatcccccggagctcccgggggaaaaggacagccgggagatgtcggcccaccagggcctgctggcatgaagggattgcctggtctgcccgggcgtcccggggcgcatggtcctcccggcctgccagggatccccgggccattcggagacgacggcctcccaggccctccgggccccaaaggacctcggggcttgcccggattccccgggttcccgggggagcgtggaaagccgggtgccgaggggtgcccaggcgctaagggagagcctggggagaaaggcatgtcaggcttgcctggggaccggggactccgcggagcaaagggcgcaatcggtcctcctggggacgagggagaaatggccattattagccagaaaggtacaccaggcgagcctggaccccccggagatgacggatttcccggcgaacgcggtgacaaaggcacaccaggcatgcagggtagacgcggggagcccggccgctacgggccaccaggtttccatcgtggcgagccaggcgagaagggacagcctggcccccccgggcccccggggcctccaggctctacaggcctccgcggtttcatcggttttcccggcttgcccggggatcagggtgagcctggctctcccggcccccccgggttttccggaatcgacggtgcccgtggccccaaaggtaacaagggagatccagcctcgcactttgggcccccagggcccaaaggtgagcctgggtcgcccggctgcccaggccacttcggagcgtccggggaacagggattaccaggcatccagggcccacgaggtagccctggacggccaggcccacccggctccagcggtcccccaggatgccccggagatcatggcatgccagggctgcgcggacagccgggggagatgggagaccccggaccccggggtctgcagggagatccgggaatcccggggcctcccggaattaagggcccaagcggaagcccggggctgaatggcttacacggacttaagggtcaaaaggggaccaagggtgcttccggcctgcacgatgtcggtccacccgggccggtgggaatcccaggacttaagggcgaacggggggacccaggtagccccggaatttcccctccaggcccacggggcaaaaagggtccccccggccccccaggaagcagtgggccccccgggcctgctggagcaaccggtcgagcacctaaggatatcccagaccccggtcctcctggtgatcagggacctcccgggccagacggcccgcgcggggctccaggcccacctggcctacctgggtctgtagatctgcttagaggggaaccaggagactgcggtttgccagggccacctggaccccccggcccacccggaccccccggttacaagggctttcctggatgtgatggcaaggacgggcagaaaggtcccgtggggttcccaggacctcaggggccacacggctttcccggaccccccggcgaaaaggggttacccggaccacccgggcggaaaggccctactggtttgcccggggagcccggcccgccagccgacgtcgacgattgtcctagaatacccgggctgccgggggcccctggtatgcgcggcccggaaggcgcgatgggattacctgggatgagaggcccctccggacctgggtgtaagggtgaaccaggactggatgggcggagaggagtggacggcgtccccggctctccaggacccccaggccggaaaggcgacaccggtgaggatggctatcccggtgggccggggccaccggggcccattggtgaccccgggcctaaaggcttcggaccaggctacctcgggggttttctcctggttctccactctcagactgatcaggaacccacctgcccactcggcatgccaaggctctggacgggatatagcctattgtacctggaagggcaggagaaggcccacaaccaagacctgggtctggcggggtcttgcctcccggtttttagcacactgccttttgcctactgtaatatccaccaggtctgccattatgcacagcggaacgacagatcatactggttagcgagcgcagcccccctgcccatgatgccgctgagtgaggaggcgattaggccatacgtgagcagatgcgccgtgtgcgaggcccctgcacaagccgtggccgtgcatagtcaggaccaatcgattcccccatgcccccagacttggaggtctttatggataggatattcatttctgatgcacaccggcgccggcgatcaaggcggcggacaggcgctgatgagccctgggtcatgcctggaagatttccgggccgccccctttctggagtgccagggaagacagggaacgtgtcattttttcgccaataaatactctttttggctcacaaccgtgaaggccgatctgcagttttcaagcgcacccgcaccagacacactcaaggaatcccaggctcagcgtcaaaaaatatcccgatgccaagtatgtgtaaagtatagctag

SEQ ID NO: 3947 - DNA, 5073 bp, Artificial Sequence
  Description of Artificial Sequence: Synthetic coding sequence
atgtggagcctgcacatcgtgctgatgcggtgcagcttccggctgaccaaatccctagccactggcccatggtcgctaatcctgatactcttctctgtgcagtatgtctatggctctggcaaaaaatatattggcccctgtggagggagagattgcagcgtttgtcactgcgtgcccgaaaagggaagtagggggccacccggacctcctggtccgcagggaccaatcgggcctttgggtgcccctgggcccatcgggctttccggagagaaaggtatgcgcggggatagggggccacctggggccgcaggagacaagggtgacaaagggcccacaggagtgcctgggttccctggactggatgggatccccggacacccaggcccaccaggacctagagggaaaccaggaatgtcaggtcacaacggatcccggggggaccctggttttcccggtggccgcggcgcactcggtcccgggggacctctcggacaccccggggagaaaggagagaagggaaattctgtctttatcctgggggccgtgaagggtatccagggggatcgcggggaccccggactgccaggacttcccgggtcctggggggcaggcggccctgccgggcccactggttatcccggcgagccagggctggtgggacccccgggccagccgggcaggccaggactcaagggcaaccccggagtgggagtgaagggccagatgggggatccaggggaagtggggcaacagggctcccccggtcccaccctactcgtggaaccccctgatttttgcctgtacaagggggaaaaggggatcaaaggaatcccaggaatggtcgggttacctgggccaccaggacgcaaaggcgaaagcgggattggcgccaaaggagagaaggggatccctggctttccaggtccacgaggagacccaggcagctacggatcgccgggtttccccgggctgaagggcgagcttggacttgtgggggatcccgggctgtttggacttattggccctaagggagaccccgggaatcggggacaccccggtccacctggtgttcttgtcacccctccccttcccctgaaggggccacccggagaccccggtttcccgggaaggtatggtgaaacaggggatgtggggccacccggtccgccaggtctactagggcgtcccggtgaggcctgcgccgggatgatcgggccacccggtccgcaggggtttcctggactgccgggactcccaggagaagccggcattccaggtcgcccggactctgcccccgggaagcccgggaagcccggcagccctgggttgccgggagctccaggcttgcaaggattgccagggtcctcagtcatctactgttctgttggtaatcccggcccccaagggattaagggcaaagtgggcccacccggcgggcgcggtcctaagggcgaaaaggggaacgagggtctgtgtgcttgcgagccgggccctatgggaccgccaggcccgcccggactgccaggcagacagggtagcaagggcgacctcggactgcctgggtggttgggtaccaaaggagacccgggtccacctggggccgagggccccccaggactgcccggcaagcatggcgcaagcggacctcccggcaacaagggcgcaaagggtgacatggtggttagccgagtcaaaggtcacaaaggcgagcgcggcccggacggcccccccgggttccctggacaacctgggtctcacggtagagacggccatgctggcgagaaaggcgaccctggcccccccggagatcacgaggacgcaacacccggagggaaaggattcccaggaccacttggcccacccggcaaggcaggaccagtcgggccgcctgggctgggcttcccaggccctccaggtgaaaggggccatcccggtgtgccaggtcatccgggggtgaggggaccagacggtctgaaggggcaaaaaggagacacaattagttgtaatgtaacataccctggacggcacggaccacccggcttcgacggccccccagggcctaagggatttccgggtccacagggggcccccggactgtctggctctgacggtcataagggacgccctgggacccctggcacagcagaaattcccggacctcctggttttcgcggcgacatgggcgatccgggattcggcggggaaaaaggatcgtctcctgttgggccccctgggcctcccggtagtccaggggtcaatgggcagaaggggatccctggtgatcctgcattcgggcacctcggaccaccaggaaaacgcgggctctccggcgtccccggcattaagggtcccaggggcgacccggggtgtccaggtgcagagggacccgcaggaattcccggtttccttggcctgaaaggccccaaaggacgggaagggcatgccggcttcccaggcgtgccaggccctcccggacactcctgcgagagaggagcgcccggaatccccggccagcctggactaccaggataccctggcagccccggcgccccaggtggaaagggacaacctggtgatgttgggccccctggacctgcagggatgaagggactgcctggtcttcccggtaggccaggtgcgcacgggccccccggtttgccgggcatccctggcccgttcggagacgacggcctccctggaccgcccggacccaagggccctaggggactgccaggttttcctggatttcccggagaacggggcaagcccggcgccgagggctgccctggagcaaagggggagcccggggagaaaggcatgtcgggccttcctggcgaccgtggacttcgtggagccaagggggccatcggcccacctggggatgagggcgaaatggccatcatcagccagaaaggcacaccaggcgaaccagggcccccaggggacgacggttttcctggagagcgaggtgataagggcacccccggcatgcagggacgtcggggggaaccagggcggtatggaccccccggatttcaccggggggagcctggagaaaaaggccaaccaggaccccccggaccccccgggccccctgggagtacaggcttacgcggctttatcggctttcctgggctaccaggtgaccagggcgagcccgggagcccaggtccacccggtttcagtgggattgatggagcccgcgggccaaaaggtaataaaggcgaccctgcctcgcatttcggcccaccaggccccaaaggggaacctgggtccccgggatgtccaggacatttcggtgcatcgggcgaacaggggctgcccggaatacagggccctcgagggagccccggccgcccaggaccccccgggtcatccggcccacccggctgcccgggcgatcatggaatgcctggccttcggggacaacccggcgagatgggcgaccctggacctaggggcctgcagggggatccaggtattccaggacctcctgggatcaaggggccaagcggctcaccagggttgaacgggctccacggtctcaaagggcagaagggaactaagggtgcctcaggattgcacgatgtggggccccccggacctgtgggaatacccggtctaaaaggcgagcgtggggatcccggcagtcccgggatctcaccacccggcccccgcggcaagaagggcccacccggccctcctggatcctccggaccccccgggcctgccggcgcaaccggaagggcccccaaagacatacccgaccctggccccccgggtgaccaagggccacctggccccgacggacccaggggggcgcctggaccccccggactaccaggatctgttgatcttctgcggggtgagcctggggactgcgggctccctggccctcccggccccccaggtccgccgggacctcccgggtataaagggttccctgggtgcgatggaaaagacggccagaagggaccagtgggcttccccggtccacagggaccgcatgggttcccaggaccccccggggagaaggggcttccaggcccccccggccgcaagggaccaacaggactgcccggaccccgaggtgagcctggtccaccggcggacgttgacgactgtccccgcatccctgggctacccggggctcctggaatgcgggggccggagggagcgatgggcttacctggtatgcgtggtcccagtggccctgggtgtaagggcgaacccggactagatggtagaagaggagtggacggggttcctggctcgcccggtcctcctgggagaaagggcgatacaggggaagacggctatcctggaggccctggacccccaggtccaatcggtgacccagggcccaaaggcttcgggcccggatatctaggcgggtttctcctggtgctgcactcccagactgaccaggagcccacttgccctcttgggatgcccaggctgtggaccgggtatagcctactgtacctggaaggccaagagaaggcacataatcaagatttgggacttgccggctcttgtctgcccgtgttctccactctccccttcgcatactgcaacattcaccaggtgtgtcactatgcacagaggaacgatcgctcttattggctggcgagcgccgcacccttgcctatgatgcccttgagcgaggaggccatcaggccatacgtgtctcggtgcgcagtttgtgaggccccggcacaggctgttgccgtgcattctcaagaccagtccattccaccttgcccccagacctggagatctctctggatcggctacagttttcttatgcacacaggcgccggggatcagggcggtggacaggccctaatgtctccagggagttgtctggaagacttccgggcggcgcccttcttggaatgccaggggcgacagggcacctgtcacttttttgctaataagtactcgttttggctcacaaccgtgaaggccgatttgcaattctctagtgccccagcccccgatacactgaaagaaagccaggcgcagcgccagaagataagtagatgccaggtgtgcgtgaagtactcatag

SEQ ID NO: 3948 - DNA, 5076 bp, Artificial Sequence
  Description of Artificial Sequence: Synthetic coding sequence
atgaagctgcggggcgtgagcctggccgccggcctgttcctgctggccctcagcctgtggggacagccagcagaagcagcagcatgctacgggtgctcccccggatccaaatgtgattgttccggaatcaagggcgaaaaaggcgagagaggatttcccggccttgaaggacaccctgggcttcctgggtttcccgggcctgaaggcccgccgggcccgaggggacagaagggagatgacggtatccccggaccaccaggaccaaaggggatcagggggcctccaggcctgcccgggtttccaggcactcccggtctacctgggatgccaggccacgatggcgctccaggccctcaggggattcctggctgtaatggtaccaagggcgagaggggattcccggggtcacccgggtttcctggcttgcaggggcccccagggccacctggaatcccgggcatgaagggggaacccggatctattattatgagctcacttcctggcccgaaggggaatcccgggtacccagggcctcccgggattcagggcctacccggcccaacgggaatcccagggccaattggtccccctgggccccccggcttgatgggacctcccggaccccctggcctgccaggacctaagggaaacatggggcttaattttcagggaccaaagggcgaaaaaggtgagcaggggctccaaggaccaccagggccacccggccaaatttcagaacagaagcgtccgattgacgtcgagttccagaaaggagatcaggggctcccaggtgaccgcgggccgcccgggcccccgggcatccggggtcctccgggtcctcccggaggagaaaagggggaaaagggggaacagggagagccagggaagagaggcaagcccggcaaggatggagagaatggacagcccgggatacccggcctgccaggagaccctgggtatcctggcgagccgggcagggatggtgaaaagggtcaaaagggagacacgggccctccaggcccccccggtctggtcattcctcgacccgggacaggaattacgataggcgaaaaggggaacataggactgcccggtctcccaggcgagaaaggcgagagggggttccctggcatccaggggcccccaggactgcccgggccccctggcgctgctgtgatgggaccaccgggcccaccaggctttccaggagagcgggggcaaaaaggagacgagggtccacccggtatctctataccaggcccacctggcctggacggccagcctggcgcacccggcttgccaggtccgcccggcccggccggacctcatattcctccatccgacgaaatctgcgagcccggacctcccggcccccccggatcccccggggacaaggggctccagggagagcagggtgtgaagggagataaaggagacacgtgtttcaactgcattgggaccggcatcagtgggcccccaggacagccgggcttaccgggactcccaggaccccctgggagcctcggattccccggccaaaaaggcgaaaagggccaggccggagctacaggcccgaagggcctgcccgggatccccggcgctcctggagcacctgggttccctgggtccaagggggaacccggcgacatcctcacttttcctggtatgaaaggggacaaaggcgaactggggtcacctggcgccccaggtctgccgggattgcccggcacgcctggtcaggatggtctaccagggctaccggggcccaagggtgaacctggtgggatcacatttaagggggagcgtgggcctcctggcaaccccggactccccggcctccccggaaatataggccctatgggccctccagggttcgggccgccagggcccgtgggagagaaagggatccaaggcgttgctgggaatccaggacaaccggggattcctgggccaaagggcgatcctggacagacaattacccaacccggcaagcccggactgcctggcaatcctggccgagacggcgacgtcggcctgcccggggatcctggattacccggccagcccggactgccaggaatccctggctccaagggagagcccggcatcccaggcattggcctaccaggcccccctgggcccaaaggattccctggaattcccggcccaccaggggcccccggaactcctggccgaattggccttgagggtcctcccgggccaccagggtttccaggaccaaaaggcgaaccagggtttgctctcccgggtccacctgggccaccaggcttgcctgggtttaagggcgccttaggacctaagggagacagaggcttccccggtcctcccggcccgcctggccggaccggtctcgatggattgccaggaccaaagggggatgtgggaccaaacgggcaacctggtccaatgggacctcccgggctgcccggtataggggtacagggcccgcctggacctccagggattccaggtcctattgggcagcccggccttcatgggatccccggcgaaaagggggacccgggaccaccaggactggatgttccaggaccccctggagaacgagggtctccgggcatccccggcgcccctggacccatcggtccgccggggagccccggcctgcctgggaaggcgggagcatctggatttccgggaaccaagggtgagatggggatgatgggtccaccaggccccccaggtcctcttgggatccctgggaggtctggagtgccaggacttaaaggcgacgacggtttacagggccaacctggactgccaggccctacaggggagaagggaagtaagggcgaaccaggattgcctggccctcctgggcccatggaccctaaccttctgggtagcaagggcgagaagggcgaaccaggtctacctgggatccccggggtttcgggccctaaaggttaccagggactccccggcgatcccgggcaaccaggactgtcgggccagcctgggctccctggacccccgggacctaagggcaatcctgggttgccaggccaaccagggttgatcgggcccccaggcctgaaggggacgatcggggatatgggcttccctggccctcagggtgtcgagggacctcccgggccatccggagtgccgggacagcctggttcacccggactgcctgggcagaagggcgacaagggcgatccaggaatttcctccatcggcctgcccggcctgcctgggcctaaaggcgagccaggactgcctggctacccagggaatccaggcataaagggatcagtgggtgatcccggcctcccaggacttcccggcacaccaggggccaagggtcaacccgggctcccaggattcccagggacaccgggcccccccggccctaagggtatcagtgggcctcctggaaaccccggtctcccaggagagccaggccctgtgggcggtggcggacaccccggacaacctggccctcccggggaaaaaggcaagcccggccaagatggtattcccggacctgctggacagaagggcgagccaggccaacccggatttggcaatcccggaccccccggcctacctgggctctccgggcaaaaaggagatggcggtctacctggcattcccgggaatcccggactgcctggcccgaagggcgagcctggcttccacggtttccccggcgtgcagggcccgcccgggccccccggtagccctggcccagcacttgagggaccaaagggaaatcccggaccacaaggaccaccagggcgccccgggccaaccggttttcagggcctgcccggccccgaagggccgcccggtctgcccggtaatggaggcatcaagggtgaaaaaggcaaccctggccagcctggtctgcctgggctgcctggactgaagggcgatcaaggcccacccggccttcagggtaaccccgggaggccagggctgaatggcatgaagggagacccaggccttccgggcgttccaggtttccccggtatgaaagggccatcaggggtcccgggatccgctggaccagagggagaaccaggccttatcgggccgccaggcccacccggactgccaggaccgtctggacagtcaatcataattaaaggcgacgctggtccacctggaattccgggccaaccaggtttaaagggactgcctggcccacaggggccccagggactgcctggcccaactggccctcctggcgacccagggagaaacggcctcccaggattcgacggagcaggtggccggaagggcgacccgggcctacccggccagcccggcaccaggggcctggatggccctcctggacccgatgggttgcagggcccccctggtcccccggggacctcctccgtggcacatgggttcctgattacgcggcactctcaaaccacggacgcccctcagtgtccacagggcactctgcaagtctatgaaggcttcagtcttttatatgtccaggggaacaaaagggcccacgggcaggacctgggaactgcaggctcttgtctccggcgctttagcaccatgccatttatgttctgcaatatcaataacgtttgcaacttcgccagcagaaatgattacagctactggcttagcacaccagagccaatgcctatgtctatgcaaccgctcaaaggtcagtcaatccagccttttatctccagatgcgccgtctgtgaagccccggctgtcgttatcgctgtgcatagtcaaacaattcagattccacactgtccacagggatgggactcactatggatcggctattcttttatgatgcacacatctgctggcgcagaggggtctggccaggctctggcctctcctggctcctgcctggaggagttccggtccgccccattcatcgagtgtcacgggagaggcacctgtaattactacgccaatagttactccttctggctggccacggtcgacgttagcgacatgttctctaagccacagtcagaaaccttaaaagctggtgatctgcgcactaggattagcaggtgccaggtctgtatgaagcggacttag

SEQ ID NO: 3949 - DNA, 5058 bp, Artificial Sequence
  Description of Artificial Sequence: Synthetic coding sequence
atgaagctgcggggcgtgagcctggccgccggcctgttcctgctggctttgtcattgtggggacagcctgctgaggcggccgcttgctacggatgttcaccagggagcaaatgcgattgcagtggcatcaaaggcgaaaagggagagaggggttttccagggctggagggacatcccggactccctgggttccccggccctgaaggtcctcccggcccacgggggcagaagggagacgacggcatcccgggacctcctgggcctaagggtatacgtggccccccgggactccccgggtttccagggactccaggactcccaggcatgccaggccacgacggtgctcccggcccacaaggcatccccggatgtaacgggacaaaaggagagagagggtttccggggtcacccgggtttcccggcttacaaggtcctccgggcccacccggaatccctgggatgaagggagagcccggatctatcatcatgagctcattacctgggcccaagggcaatcctggctacccaggtcctccaggaattcagggccttcctgggccaactggcatcccagggcctattggacctcccggcccgcctggcttgatgggcccccccggcccccccggcctcccaggcccaaaaggcaatatgggcttgaacttccagggtccaaaaggggagaaaggggaacaaggcctgcagggtcccccaggcccacccggccagatttcggagcaaaaaaggccaattgatgtggagtttcagaaaggagaccagggtctgccgggtgataggggaccacccggcccccccggtatcagaggacctcccgggcccccaggcggcgaaaagggagagaaaggcgagcagggagaacctggcaaaaggggtaagcccggcaaggatggcgaaaatgggcagcccggtatcccaggtctgcctggagacccgggatatcctggcgagccagggcgcgacggggaaaagggccagaagggcgacactgggccgcctggcccgccagggcttgttataccacgaccaggtacaggaatcacaataggcgaaaaaggaaacattggcctccccggtctgcctggagagaaaggagagagggggtttcccggcattcagggccccccggggcttccaggtcccccgggagccgccgtcatgggtccaccgggaccacccgggttcccaggggaaagagggcagaagggggacgagggacccccgggcatcagcattccaggcccaccaggactcgatggccaacccggagcccctggactgccagggcctcctggccctgctggcccccacattcctccatcggacgaaatctgcgaacctggcccaccaggccctccaggaagtcctggagacaaaggactgcagggcgaacagggggtgaagggcgacaagggggatacatgcttcaattgtatcggaaccggtattagcgggcctcctgggcaaccaggattgccgggactccctggtcctccaggctcgttgggcttccccggccagaagggggaaaagggccaggccggcgccacaggtcctaaaggactgccgggaattcccggtgcgcccggagcccctggattccccggttccaaaggcgagcctggcgatattcttaccttccccgggatgaagggcgataagggagagctggggagccccggcgccccgggtctgccagggctgcccgggactcctggacaagacggtctgccaggtctgcccggaccaaaaggggaaccaggaggaataacgttcaaaggcgaacgcggccctccagggaaccctggtctgcccggactccctggcaacattggtcctatgggacctcctggattcgggccacctggcccagtaggcgagaagggtattcagggggtggctgggaaccccggccagccagggattccaggccctaaaggcgatcccggtcagacaattacccagcccgggaagcctgggctccccgggaaccccgggagagatggagacgttggcctgcctggggacccaggtcttcccgggcagcctggactacccggaattccaggctctaaaggcgaaccaggaattcctggtataggtttgccagggcctcccggacctaaaggcttccctggcatccctggccctcctggagctcctggcacgccggggcggattggactcgaaggtcctcccggccccccagggttccctggtcctaaaggggaacctgggttcgctctccctggaccccctggtccacccgggttacccggatttaagggcgctctcggaccaaagggcgaccgtggattcccagggccaccaggcccacccgggcggacaggtctcgacgggctgcctggcccaaagggggatgtcgggcccaacggacagccaggcccgatgggcccgccggggctacctggaatcggtgtccaaggcccgccaggcccgcccgggatcccgggacccataggccagcctggcctacatgggatcccaggcgagaaaggcgaccccggaccgcctggacttgacgtcccaggcccccccggggaacggggatcccccggaatccccggcgcccccggtccaattggcccacctggctccccaggactgccggggaaggccggcgcctctgggttcccgggcaccaagggggaaatgggaatgatgggaccgccaggcccccctgggcctcttggaatcccaggtcgttcgggagtgcctggacttaaaggggatgatggcctgcagggtcagcctgggctcccaggtcctactggcgagaaggggtccaagggcgagcctggcctgcctgggccgcctgggccaatggacccgaacttactgggctctaagggggagaagggggaaccgggactgcccgggattcccggggtgtcaggacctaagggttatcagggcctgcctggagacccagggcaacccgggctttcgggtcaaccaggattgcccggccctcctggacctaaaggaaatccaggcttgcccggccagccagggttaatcggccctcctggactgaaaggcactattggtgatatgggttttcccggacctcaaggtgttgaagggccgccgggacctagtggagtgccgggccaacctggaagcccaggccttccaggacaaaagggagacaagggggatccaggaatcagttctatagggctgcccgggctccccgggcctaagggagagcccggcctccctggttatccaggcaacccaggtatcaagggctccgtcggcgatccggggcttcctggcttgcctgggacccctggggctaaaggccaacccggactgcctggctttcctgggacacctgggccaccagggcccaagggaatatccggtcctcccgggaatcccggattgcccggagagccaggccccgtcggaggtggaggacaccctggacagccggggccccccggcgagaaaggaaagccgggccaggatggcattcctgggcccgccgggcagaagggtgaaccagggcagcccggattcggtaacccaggaccaccggggctgccaggcctgagtggacagaagggagacggcggcctgccgggaatacctggtaatcccggtttaccgggccccaaaggtgaacccgggttccacgggttccccggggtccaggggcctcccggcccaccagggagtcccggtcccgcgttggaaggtccaaaaggaaatcccggccctcagggacctcccggtagacccggacttcccggacctgaagggcccccggggctccccggaaacggaggcatcaaaggcgaaaaaggaaatcccggtcaacctggcctccctggcctgccaggactgaaaggtgatcagggccctcccggcctgcagggcaacccaggtagacccgggctgaacgggatgaaaggcgatccagggctgccaggagttcctggcttccccgggatgaagggtccctcaggggtcccaggaagtgccggacccgaaggcgagccaggcctaataggcccacctggcccacctggcctgccaggaccttcagggcaaagcataattattaaaggagacgccggtccgccggggatccctggacagcctggactgaagggactacccgggccccagggaccccaaggattgcctggccccactggaccccccggcgaccctggaaggaatggattacctggctttgacggagcgggggggaggaaaggtgaccctggcctcccgggacagccgggtacaagaggactggatggtccaccaggccccgatggcctgcaaggtccccctggcccccctggcacatccagcgttgcccatggatttctgattaccaggcatagccagacaactgacgcacctcagtgtccacagggtactcttcaggtctatgaaggcttttccctgttatatgttcagggcaataaacgagcccacggtcaggatctaggaacagccggctcctgcttgagacggttcagcaccatgcctttcatgttctgtaacatcaataacgtttgcaactttgcaagcagaaacgattatagctattggctaagcactccagagcctatgcccatgtccatgcagcccctgaagggacaatcaattcagccttttataagccgttgtgccgtatgcgaggcccccgctgtggtgattgccgtacacagtcagacgatccagatcccccactgcccacaagggtgggacagtctgtggatcggatattcctttatgatgcatacaagcgcaggcgccgagggaagtgggcaggctcttgcctccccgggaagctgtctggaggaattccggtcagcacccttcatcgaatgtcacggtcgcggcacatgtaattattatgccaactcgtattcgttttggctggctactgtagacgtcagcgacatgttctcaaaaccccaaagcgaaacgctcaaagcaggagatctgcggactcgaatttcccggtgccaggtgtgcatgaaaagaacctag

SEQ ID NO: 3950 - DNA, 5076 bp, Artificial Sequence
  Description of Artificial Sequence: Synthetic coding sequence
atgaagctgcggggcgtgagcctggccgccggcctgttcctgctggccctttccctatggggccagcccgccgaagctgctgcatgttacgggtgttcccctggctctaaatgcgattgctcaggaattaagggtgaaaagggagagcggggttttccagggctggagggacatcctggcctgcccggattccccggccccgagggccctcccgggcctcgaggccagaagggcgacgatgggatccctggaccgccaggtcccaagggtattcgggggccacctgggctgcccgggttccccggcacacccgggctgccggggatgcccggacatgacggtgcaccagggccacaaggcattccaggatgcaatggcacaaaaggggagcgcgggtttccaggatctccaggtttccccggcctccagggtccccccgggcctcccggaattccaggaatgaaaggcgaacccggttcaataattatgagcagtctgccaggacccaaagggaatcctggttaccccggccctcctgggatccagggtttacctggccccaccgggatcccaggaccaatcggccctcccgggcctcccggcttaatggggcccccaggcccaccaggcctgcctggcccgaagggaaatatgggcctgaatttccaaggaccgaagggtgagaaaggagagcagggactccagggacctccaggacctccaggtcagattagcgaacagaagagacccattgatgtcgagtttcagaagggggaccaaggccttccgggcgacagaggacctcctggacccccaggcatcaggggcccgccaggtcctccaggtggcgaaaagggtgaaaagggggagcaaggcgaacccggaaagcgcggaaagcccggaaaagatggtgagaacgggcagcctgggatacccggtctgcctggcgaccctggctaccccggggaacctggtagggacggtgagaaggggcagaaaggggacactggtcctccaggcccccctggtctcgttattccacggccaggaaccggaatcaccattggagaaaaagggaatatcgggctgcctggcttgccaggggaaaaaggcgaacgcggtttccccggaattcaaggccctcccggcctgcctggaccacccggtgcggctgtcatggggccgccgggcccgccgggcttcccaggtgagcggggccaaaaaggagacgaagggccgcctgggatctctatccctggtcctccggggctggatgggcagcccggggcacccggacttcccggaccacccgggcccgctggcccacacataccaccctccgacgagatatgcgagcctgggcctcccggccctccaggctctccaggggataaggggctccagggcgagcagggcgtgaagggagataagggcgatacctgtttcaattgcataggcactggtatcagcggtccacctggccagccagggctccccggactgcctggacccccagggtccttgggcttcccgggccaaaaaggggagaaagggcaggccggcgctaccgggcccaaaggcttgcctggcattccgggtgcccctggcgctcccggattcccaggatctaaaggtgagcccggtgacatcctgaccttcccaggaatgaagggtgataagggagagctggggagtcctggagccccgggcctccccgggctcccaggcaccccggggcaagatggcttaccaggattacctggcccaaagggggagcccggagggatcacctttaaaggcgagaggggacctcctggcaacccggggttacccgggctgcctgggaacatcgggccaatggggccacccggattcggcccccccgggccggtaggggaaaaaggaattcagggagtcgccggtaaccccgggcagcccgggataccaggccctaaaggggaccccggccagacgattacgcagccgggcaaacctgggctaccgggaaatcccggacgagacggcgacgtgggccttccaggcgaccctggactacccggacagcccggcctgccagggattccaggcagtaaaggcgagccaggtattcctgggattggcttacccgggccacccggccctaagggttttcctggcatcccaggacctcctggcgcccctgggacccctggacggatcgggctggaggggccgcccgggccaccaggattcccaggcccaaagggcgagcccgggttcgccctgcccgggccacccgggcctcctggcctgcccgggttcaaaggggccctcggacccaagggcgataggggatttcctggccctcccggaccccccggacgaacggggctggatggcttgcccgggcccaagggggacgtcgggcctaacggacagccagggccaatggggcctcctgggttaccaggaatcggggtgcaaggccccccaggcccacccggcatccccgggccaattgggcaacctggtctccacggaatccctggcgaaaaaggcgaccctggccccccagggctggacgttccgggccccccaggggagcgaggctccccgggcattcccggagctccaggtcctattggccctcccgggtcacccggtctacccggaaaggcaggcgcaagtggtttccctgggacgaagggggaaatggggatgatgggcccacctggcccccccggtcctctggggatacctggacgtagtggagtaccaggtctgaagggggatgatgggctgcagggacagcccggtctgccagggcccaccggagaaaagggctcaaagggtgagccaggcctacctgggcctccaggacctatggaccccaatctcctaggcagtaagggggaaaagggcgagcctgggcttccggggatcccaggtgtctctggacctaagggttatcagggcttacctggcgatcctggtcagccaggtttgagcggacagccgggacttccaggaccccccggaccaaaagggaacccgggcctccctggtcagccaggccttattggaccgccagggcttaagggcaccatcggcgacatggggttcccaggcccccaaggcgtagagggcccccctggacctagcggagtgcccgggcaaccaggatcccccggcctgcccggacaaaagggcgacaagggcgatcccggaatttcatcaatcggactgcccgggctgcccggtcctaagggagagccggggttgccagggtatcctggcaatccgggaatcaagggaagcgttggcgaccctggattaccgggactgcccggaactccaggcgctaagggccaacccggcttacctggcttccccggcactcccggaccgccggggcccaaggggatttctggtccccccgggaatccggggttacctggcgagcctggacccgtgggcggcgggggccatcccggccaacctgggccaccaggggagaaggggaagccgggccaggacggaatcccagggcctgcaggacagaaaggagagccaggtcagcctggattcggaaatcccggacctcctgggctgcctggcctcagcggtcagaagggagatggcggcctgcccggcatcccaggcaatccgggtctccccggcccaaaaggcgagcccggattccacgggtttccgggcgttcaagggccacctggcccaccagggtcccctggccccgctctagaggggccaaaaggaaaccctggcccgcaaggcccaccaggaaggccagggccaaccggctttcagtccctgccgggacccgaaggaccacccggcttgccaggaaacggcggaataaagggggagaaaggcaatcctggacagccaggcctgccaggtttacctggcctgaagggggaccaggggccgccgggactgcaaggcaacccgggccgccccggtctcaacggcatgaaaggggatcccggtctcccaggtgtccccggatttcccgggatgaagggccccagcggagtgcccggctctgctgggccagaaggagaacctgggctgatcggtccccctggccctccggggcttcctggcccaagcgggcagagcataatcattaagggcgatgcaggcccgccaggtattcccgggcagccaggcttaaaaggtctccccggccctcagggaccccagggcttgcccggtcccaccggtccccccggcgaccccgggcggaacggcctccccggatttgacggagctggagggcgcaagggcgatcccggcctgcccggtcagccaggcaccagaggcctcgatggtccccctggtcctgacggattgcaggggcccccagggcctccgggaacatcctcggtggctcacggatttttaatcacacgccactctcagacgacagatgctccacagtgtccacaaggcacgctgcaagtgtatgagggatttagtcttctgtacgtgcagggcaataagcgtgcccacggacaagatttgggcaccgcgggcagctgtctgaggaggttcagcacaatgcccttcatgttctgcaacatcaataacgtctgcaatttcgcatcacgaaatgattattcttactggctgagtacccccgagcctatgcctatgtcaatgcagccgttgaaaggccagtctatccaaccatttatttctcgctgcgccgtttgcgaggcgcccgctgtcgtgatcgccgttcatagccagaccattcagataccccattgtcctcagggatgggattcactgtggattggttatagtttcatgatgcatacgtccgcaggcgccgaaggctctgggcaagctctggcatctccaggcagctgccttgaggagttcaggagtgcgccatttatcgaatgccatggccggggaacgtgcaactactacgctaactcttacagtttctggctggctactgtggacgtttccgacatgttctcaaaacctcagagcgagacattgaaggcaggggatctgcgtaccagaattagccgttgccaagtttgtatgaaaagaacgtag

SEQ ID NO: 3951 - DNA, 5073 bp, Artificial Sequence
  Description of Artificial Sequence: Synthetic coding sequence
atgcaccccggcctgtggctgctgctggtgaccctgtgcctgaccgaggagctggcagcagcaggggagaagagttacgggaagccttgtggcgggcaggactgcagcggcagttgtcagtgctttcctgaaaagggagctagaggtcgccccggaccaatcggcatccagggcccaacaggtccccagggttttactggctctactgggctgtcaggactaaagggtgagagaggatttcccgggctcctggggccttatgggcccaagggagataaaggccctatgggagtgcctggattcctgggaattaacggcattcccggtcatcctgggcagcctggccctagaggccctccaggcctggatggatgcaatgggacgcagggggccgtggggtttcccggaccagacggctatcccgggctgctcggtccccccgggctccccggccagaagggttccaaaggagaccccgttttggccccagggtccttcaaaggaatgaagggggatcctggactccccggcttggatgggatcacagggccacaaggggccccagggttcccaggtgctgtgggcccagccggacccccaggtttacaggggccaccaggtcctcccggacctctcggcccagacgggaatatgggccttggtttccaaggggaaaaaggagtgaagggcgatgtggggctccctgggcctgcaggacctccaccctctacaggcgagttggagttcatgggattcccaaaaggcaaaaaggggagcaagggagaacccgggcccaagggtttccctgggatcagcggccctccgggttttcctggtcttggtaccacgggagagaaaggtgaaaagggcgaaaagggcattcccgggctgcccggcccacggggccctatgggcagtgaaggcgttcaggggccacccggccagcagggcaagaagggcactctgggattcccaggcctcaatggattccagggtatcgaaggtcagaaaggagacatcggactccctgggcccgacgtgtttattgatatcgacggcgcggttatcagtgggaatcctggggatcccggtgtgccaggcctgccaggcttgaaaggtgatgaggggatccaaggcctgcgagggccctcaggggtccccggcttacccgccttaagcggggtgcctggagcactgggtccccagggatttcccgggctcaagggtgatcagggaaatcctggaagaacaacaatcggtgctgccggactgcccggaagagacggactgcccggcccccctggcccccccggacctccttctccggaattcgagactgaaactcttcacaacaaagagtcaggttttcccggtctgcggggcgagcagggtcctaagggcaacctgggactcaaaggcatcaagggtgactctggattctgcgcttgcgatggcggagtccccaacactggtcctcctggggagcctgggcctcccgggccttgggggctcatcggcctgcccggactgaaaggagccaggggggatcgagggtcagggggggcacaaggccctgcaggcgccccaggactcgtggggccactcggcccttcgggtcctaaaggcaaaaagggcgagcctatcctgtccaccatccaggggatgcctggagacaggggcgatagcggctcacagggttttcggggcgtaataggagagcctggtaaggatggtgtaccgggcctgccaggtctccctggactacctggagatgggggtcagggctttcccggagaaaagggcctgcccgggcttcctggggaaaagggccaccccggcccccctgggctgccaggaaatggcctgccaggtctgcctgggcctcgcggactccctggcgataaaggaaaagacggtctgcctggtcaacagggtttaccagggtcaaagggtatcacgctgccgtgcatcatccctgggtcttatgggcctagcgggtttcccggtacacccggattcccaggcccgaaaggaagccggggactccccggtacccccggccaacctgggtcgtcagggtccaagggcgagcctgggtctcctgggctggtacacctgcccgaactgccaggttttccgggacctcgcggcgaaaaaggtttacctggattccccggactcccaggaaaggacggtttgcctggaatgatcggctcaccaggcctgcccggaagcaaaggcgctacaggggacattttcggcgccgaaaatggggctcccggggagcaaggtctgcagggcctgaccggccacaagggatttttaggggatagcgggctccccggcctgaaaggcgtgcacggaaaacctggattgctgggccccaaaggcgagagaggctctcccggaaccccagggcaggtcggacagccagggacccccggcagctccgggccatatggcatcaagggcaagtccggactgcccggggcgccaggcttccccggaatctcaggccaccctggtaaaaaaggcacgcggggcaagaagggaccgccgggctcaatcgttaaaaagggacttcctggacttaagggattgcccggcaatcctggtctggtgggcctcaagggcagccccggtagtccaggagtcgcaggattgcctgcacttagcggacctaagggggagaagggtagcgttggctttgtgggattcccaggtattcccggactcccagggatcccaggtactagaggactgaagggcatccctgggtctactggcaagatgggaccctctggccgggccggcactcctggtgagaaaggcgacagagggaatcccgggcccgtgggaattcctagtcctcgacgacctatgagcaatctgtggctgaaaggcgacaagggttcgcaaggctccgcgggcagtaatggattcccaggaccccgaggcgataagggcgaggccggaagacctggacccccaggactgccaggagcccccggcctgccaggcatcatcaaaggggtctctgggaaaccaggaccccctggatttatggggataagaggactcccaggcctcaaaggctcttccgggattaccggatttcctggaatgcccggagagtcaggctcccagggaataagagggagtccaggtctgcctggcgcgagcggcctccctgggctcaaaggggacaacggccaaacagtggagatcagcgggtctcctggaccgaaagggcagcccggggaatccgggtttaagggaaccaagggacgagacggattaattggtaatatcggttttccggggaataaaggagaggacggcaaggtgggagtgagtggcgatgtagggcttcctggagcccctgggttcccaggtgttgccggcatgcgtggcgagcccggcctgcctggctcttccggccaccagggcgccatcgggccacttggttcccccggattaattggtcccaaaggttttccaggttttcctgggcttcatggattgaatggacttccaggaacaaagggaacccatggaacgcctgggccttctattactggagtcccaggcccggccggcttgcctgggcctaaaggggaaaaagggtacccgggaatcgggatcggagcccctggaaaacccgggttacgggggcagaagggagacaggggcttccctggtctgcaagggccagctgggctgccaggggcccccggaatctctcttccctcactcattgccggccagcctggcgaccccggcaggccagggctcgacggagagcggggccgaccgggtcccgcggggcctccagggccgcctgggccaagctccaaccagggagatacaggggatcccggatttccaggaatacccggcccgaaaggacccaagggcgatcagggtattcccggcttttcaggactgccgggggaactgggcctgaaaggtatgcgaggtgaacctggcttcatggggacgccaggcaaggtgggtccacccggtgatccgggtttcccagggatgaaaggtaaggctggccccaggggctcgtcaggcttgcagggcgacccaggacagacccccacagccgaggccgtgcaggttccaccaggaccccttggcctgcccggcatagatggaatccctgggctaaccggcgatcctggagctcaaggacctgtgggcctccagggttctaaggggctcccagggatacccggaaaggatgggccaagtgggctccccggtccacccggagccctcggagaccctggcctgccgggtcttcaggggcctcctggatttgaaggggcacccggtcagcagggccccttcggtatgcctgggatgcctggccagtcaatgcgcgttggttatacgctggtgaagcactcacagagtgagcaggtccctccctgtccaataggcatgtctcagctttgggtgggctattctctgttatttgttgagggtcaagagaaggcgcacaatcaagaccttggcttcgctggttcctgcctgcccagattttctactatgcctttcatctattgtaacattaacgaggtgtgtcattacgctcgccggaatgacaagtcgtattggctgagtactaccgctcccatccccatgatgccagtaagccaaactcagataccacagtacattagtcggtgcagcgtgtgtgaggcccccagccaggctatcgctgttcatagccaggacatcacaatcccccagtgtcctctgggctggagatccctttggatcggctactcgtttttgatgcacacagctgccggcgctgagggaggggggcagagcctggtgagccctggttcttgtttggaggactttcgggctacgccctttatcgaatgcagcggcgcgcgcggcacctgtcattacttcgccaacaagtattcgttctggctgacaaccgtggaagaacggcagcagtttggcgagcttccagtatctgaaacactgaaagcagggcagctgcacacacgtgtaagtaggtgtcaggtgtgcatgaaatccctctag

SEQ ID NO: 3952 - DNA, 5076 bp, Artificial Sequence
  Description of Artificial Sequence: Synthetic coding sequence
atgctgatcaacaagctgtggctgctgctggtgaccctgtgcctgaccgaggagcttgcagcggccggtgagaagtcgtatggaaaaccatgcggaggccaagactgttctggatcatgccaatgcttccctgaaaagggcgccagaggacgtccagggcccattggcatacaggggcctaccggcccccaggggttcactggaagcacaggactgtcaggacttaaaggcgaacgagggtttcctggcctgctcggtccctacggtcctaagggcgacaagggccctatgggagttccaggattcctgggaatcaacggtattccagggcaccccggacaaccgggcccgcgcggtccccccggcttggacgggtgcaatggcactcagggtgccgtagggttcccaggccccgacgggtatccaggcttgcttggcccgccaggattgcctggacagaaaggtagcaaaggagatccagtgctggctcccggctccttcaaggggatgaaaggtgacccaggcctcccaggtctagatggtattaccggcccgcaaggcgcccccggcttcccaggggcagtggggccggcgggacctcctggtctccagggacctccaggcccgccaggacctctgggcccggacggcaatatgggactcggattccagggcgaaaagggtgtcaagggagacgttggtttgcccgggccggcgggccctcctccctcaactggcgaactcgaattcatggggttcccaaaaggcaagaagggctctaaaggagagcccggccccaagggctttccgggaataagcggccctccaggattcccaggattgggaactacgggcgagaagggtgagaagggggaaaagggcattcctggcctgccgggaccacgcggcccaatgggaagcgagggggtccaggggcccccgggacaacaagggaagaaaggtacactgggattccccggcttaaatgggttccaagggattgaggggcaaaagggggacatcggtctgcctggccccgatgttttcattgatatagacggtgctgttatcagcggaaatcctggtgacccaggagttccagggctgcccggcctgaagggtgatgaagggattcaaggactcagaggcccctccggtgtcccggggcttccagccctgtcaggggtgcctggagcgcttggacctcaggggttccctggcctgaagggggaccaagggaaccccgggagaacaaccatcggcgccgcagggctgccagggcgagacggactgcctgggccacctggcccacctggaccccccagtccggagttcgaaacagaaacactccataacaaagagtcaggctttcccggcttaagaggggaacagggcccaaaggggaatctcgggttgaagggaatcaaaggcgattcgggtttctgcgcctgtgacggcggagttccgaatacaggacctccgggcgaacccggcccacccggtccctgggggttgataggacttcctgggctcaagggggcaaggggcgacagaggtagtggaggcgcgcagggccccgctggagcacctggactcgttgggccgttgggcccttccggacctaagggaaagaaaggcgagccaatattgagcaccatccaaggtatgccaggcgataggggtgattccggcagccagggcttcaggggcgtcatcggtgagcctgggaaagacggcgtgccaggtctgccaggcctcccggggttgccaggcgacggcggccaagggtttccaggagaaaagggcctgcccggcctaccaggggaaaaaggccacccgggtcccccaggcttgcctggtaatggcctgccagggctgcctggccctcgtggcctccctggggacaaaggaaaggacggccttcccgggcagcaaggtttaccaggtagcaagggcatcacacttccgtgtatcattcctggatcatacggaccctcgggcttcccagggacacccggttttccaggaccaaagggcagcagaggcctgccaggaaccccaggccagcctggtagcagcggttccaagggcgaacctggctccccgggtctggtgcatctgcccgagctgcctggtttcccaggtccacgtggagagaagggactgccaggatttcccgggctgccaggaaaagatgggctgccagggatgattggcagccccggcctgcctgggtcaaagggcgctactggggacatattcggcgccgagaatggagccccaggcgagcaaggtctgcaggggcttacagggcacaagggatttctgggcgatagtggacttcccggactgaagggggtccatggaaagcctggactcctcggccctaaaggcgaaagaggctcgccagggacccccggacaggtaggccagccgggaacccctggatctagcggtccatacggcatcaagggcaaatctggcctaccgggcgcacccggcttcccgggaatttcaggtcaccccggtaaaaaaggaaccagaggcaaaaagggtccccctggtagcatagtcaaaaaagggttgccggggctcaaaggactgcccggcaacccggggctggtgggcctgaaggggtccccaggctcgcctggagttgctggtctccctgcgctttctggaccaaagggggaaaaggggtcagtagggttcgtcgggttccccggaatccccgggcttcccggaatccccgggacccgtggtttgaaaggtatacctgggtccacaggcaagatgggacccagcggccgggccgggacgcctggggagaaaggagatcgaggtaatccgggtcccgtgggcattccaagcccccgtcggccaatgagtaatctgtggctgaaaggcgacaaggggagccagggctcagccggatccaacgggtttccaggccctcggggtgacaaaggtgaggcagggagaccaggcccccctggtctgcccggtgcacctgggcttcctggcattatcaagggcgtgtcaggcaagccagggccccctggtttcatggggattagaggtttgccgggattgaaaggatccagtggaataacggggtttcctggcatgccaggcgaatctgggagtcagggcattaggggcagcccaggattacccggcgcgagcggcctcccaggcctgaaaggcgacaacggccagacggtggagatctcaggctctcccggacctaaaggtcaacctggagaatctggttttaaaggaactaaagggcgcgacggtctgataggaaacatcggcttccctgggaacaaaggggaagatgggaaggtcggagtctctggagatgtgggtctcccaggagcgcctggattccctggagtggcgggtatgcgcggcgagccgggactgcccggcagctccgggcatcagggtgcaatcggacctttaggttctccaggactaattggccctaagggtttcccgggatttccagggctgcacgggctcaacggcctgccgggcactaagggaacgcacggaacccctggccccagcattaccggagtaccgggccccgcagggttacccggaccgaagggcgaaaaagggtaccccggcatcggcatcggcgccccagggaagccaggcctgcgcggccagaagggggatagagggtttccagggctgcagggccccgccgggcttccaggcgcacccgggatttcacttcctagccttattgcaggccagcctggagaccctgggagacccggcctcgacggggagcgcgggcgcccaggtcccgcaggcccacccggacctcccggccccagctccaatcagggcgataccggggaccccggcttcccaggtatacctggcccaaaagggcctaaaggagaccaagggataccaggcttcagtggcctaccaggagaacttggtctgaagggaatgcgaggcgagcccgggttcatggggactcccggcaaagtaggaccacccggtgaccccggcttccctggcatgaaagggaaggcaggccccagaggctcctctggcctgcagggcgatcccggccaaactcctacagcagaagcagtgcaggtccccccaggccctctgggccttcctggcattgatggaattccaggtcttaccggggatccgggcgcccaaggtcctgtgggattgcagggctcaaagggtctgccaggaatacccggaaaggacgggccatccggcctgcctggtccaccaggagcactgggcgaccctgggttaccggggcttcagggacctccaggtttcgaaggggccccaggccagcaagggccttttggcatgcccgggatgcctggccaaagtatgcgcgtgggatacacgttggtgaagcactctcagagcgaacaggtcccaccttgccccatcggaatgagccagctgtgggtgggctactctctgctgtttgtcgaaggacaagagaaggcccacaatcaagacctggggttcgccggctcttgtctcccaagattttctacgatgcccttcatctattgcaatataaacgaggtgtgccactatgccaggaggaacgacaagtcttactggttgagtaccactgctcctatacccatgatgcccgtgagtcaaacacagattccccaatacatcagcagatgctctgtgtgtgaagcaccatcgcaggccatcgcagttcacagtcaagatatcaccattcctcagtgcccgctagggtggaggtcgctgtggattgggtacagctttctcatgcacacggcagccggtgcagagggaggaggacagtccctggtttcccctgggagctgtcttgaagacttccgggccaccccgttcatcgaatgtagtggggcccgtggaacctgccactacttcgcaaataaatacagcttttggttgaccaccgttgaggagcgccagcagttcggagagctgcctgtcagtgagacccttaaagctgggcagctccacacaagggttagtcggtgccaagtctgtatgaaatctctatag

SEQ ID NO: 3953 - DNA, 5076 bp, Artificial Sequence
  Description of Artificial Sequence: Synthetic coding sequence
atgcaccccggcctgtggctgctgctggtgaccctgtgcctgaccgaggaattagctgctgccggggagaaatcatacgggaagccttgtgggggtcaggattgctcagggtcctgccaatgtttccccgagaagggggcgcggggccggccgggtccaattggtatacagggcccgacaggaccccagggatttaccgggagcactgggctctctggactaaagggcgagcgcggcttcccaggactgctcggaccgtatggcccgaagggcgacaaaaagttttccatcccggttttgttgatctacgactctcgacctggacatcccggccagccgggccccagaggtccgcccggccttgatgggtgtaatggcactcagggtgcagtgggctttccagggcccgacggatatcccgggctacttggtcctcctggcctgcccggacagaaaggtagcaagggtgaccccgtcttggctccagggagctttaaaggcatgaaggcattcatcccactgttcgagtcgatacgcggtccacaaggtgctcccggatttccaggggccgtgggacccgccggccctcccggcctccagcagggccagcctccatttttggaggtgctgtttcctcactggcacgagggcgaggaggcgaaggtcagggacagcctgttcggggacgtgggcttgcctggtccggccggacccccgccgtcaaccggcgagctggagttcatgggctttcccaagggcaaaaagggcagcaaaggggagccaggacccaaaggcttcccaggaatatctggtccacccggcttccccggtctggggaccactggcgagaaaggcgaaaagggagagaaagggattccaggcctgccggggccgcgtaccctcctttgttctcacacgtttcatctagtcgtcacaatgttcctaagccagggaaagaagggcaccctcggtttccccgggctgaacgggtttcaggggatcgagggccagaaaggcgacatcggactgcctggccccgatgtgttcatcgatatcgacggagcagtcatcagcggaaaccccggggaccccggagtgcccggactaccaggcctaaagggagacgaagggatccagggccttcggggtccctccggcgttcctgggctcccagccctgtctggcgtaccaggggctctgggcccgcaggggttccccgggcttaaaggagatcaggggaatccaggcagaactaccattggggctgccggactccctggcagagacggccttcccggtcctccagggccgcctggtccaccctctcccgagttcgaaactgaaacactgcataacaaggagtctggattccctggtcttcgcggggaacaagggccaaagggtaatttaggattgaaaggtattaagggggatagcggattttgtgcctgtgacggaggagtgccaaatacaggacctcctggagaacctggcccccctggtccctggggacttattggtctcccaggactgaagggggccaggggcgaccgcggctccggcggggcccaaggacccgccggagcccctgggctggtcggccctttgggaccctcaggccctaagggtaaaaagggcgaacccattctgtccacaatccagggtatgccaggggatagaggagactcaggaagccagggattcaggggtgttatcggcgagcctggcaaagacggcgtcccgggacttccaggcctcccgggactacccggggatggagggcagggctttcctggtgagaagggactgccaggcctgcccggggaaaagggccaccctggcccgccgggtctacccggcaatggtttgcccgggctccctggccctcgggggctccccggcgataaggggaaggatggactgccagggcagcaagggctcccaggctcaaaaggcatcaccctcccctgcattataccaggttcttacggtccctcaggctttccgggcacccctgggtttcccgggccaaagggcagtcgtgggctgccaggtacacctggtcagcccggtagtagcggatccaagggagaacccggcagccccggtttggtgcatctgcccgagctccccgggttccctggccctcggggtgaaaaaggccttcccgggtttcctgggctgccgggcaaagacggactaccaggtatgattgggagccccgggcttcccgggagcaaaggggcaacgggagacattttcggggctgaaaatggcgcccccggagagcaaggtctccagggcctaaccgggcacaaaggattcctcggggatagtggactgcctgggctgaagggagttcacggtaaaccaggcctgctggggccaaagggcgagcggggtagtcccggaacccccggacaagtgggtcaaccaggcacacccggcagttcaggaccctatggcatcaaaggaaagtccggcctccccggggcgcccggctttcccgggattagtggtcatcccggcaaaaaaggaacaagaggtaaaaaaggacctcctgggtcgatcgttaagaagggcctgccagggttgaaaggcttaccgggaaaccccggactggtcggtctgaaaggaagtcccgggtcaccaggggtcgcgggactaccagccttatcaggtccaaaaggggagaaaggaagtgtggggtttgtggggttcccaggtattccaggactgccaggaatccctggcactagaggccttaagggcatcccgggatctactggtaaaatgggaccctccgggcgggctggaaccccaggcgagaagggggaccggggtaacccagggcctgtaggaatcccctctccccgaagacccatgagcaacctttggctcaagggagataaaggcagccagggctctgctggtagtaatggatttccggggccccggggtgataaaggagaggccggccggccagggccgcctggactgcctggcgcgccaggtctgcccggtatcattaaaggggtgtcaggcaagcccggaccacccggattcatgggcattaggggactccctgggttgaaaggtagctcgggcattaccggatttcccggtatgcctggcgagagtggctcgcaagggatccggggcagtcccggcctgcctggggccagcggcctgccgggtctgaaaggcgataatggccaaactgtggagatttccggatctcccgggcctaaaggacaacctggtgaatcgggcttcaagggtaccaagggtcgggacgggttgatcggcaacattgggtttcctggtaacaagggggaggacggcaaggtcggggtgtcaggcgacgtgggtctgccaggcgcgcctggatttcccggcgtggctgggatgcggggggagccggggctgcctggaagctccggacatcagggcgccatcggccctctgggctctccaggcctgatcggacctaagggatttccagggtttccaggactccacggtcttaacggcctccctgggaccaagggtactcacggcacccccggcccttcgattactggagtccctggccctgctgggctaccggggccaaaaggcgaaaaggggtaccccggcatcggcatcggggccccgggtaaacccggcctccgtgggcagaagggggacagggggttccccggcttacagggtcccgccggcctacccggggcacctgggataagccttcccagtttaatcgctggccagcctggcgatcctggccgcccaggcctcgacggagagcgcggaagacctggacctgctgggcctcctggccccccgggcccaagcagcaatcaaggcgacactggagaccccgggttcccaggcattcccggccccaaggggcctaaaggggaccagggcataccaggcttctctggattaccaggtgagctgggactgaagggaatgagaggcgagccgggattcatggggactccgggaaaggtggggcctcccggggatccaggtttccctggaatgaagggcaaggcagggccccgcggttcgagtggcctccagggcgaccctggacagacccctacagccgaagctgtccaagttccccccggaccccttgggttgcctgggattgacggaattccgggcctgaccggggatcctggcgctcagggcccggtaggcctccaaggcagtaagggactaccaggaatccctggaaaggatggcccgagcggtctgcccggccccccaggagcacttggtgaccctgggctccccggcttacagggcccacctggcttcgagggcgcacctggccaacagggcccttttggtatgccgggtatgccaggccaatcgatgagggtaggctatacactagtgaagcatagtcagtccgagcaggttccgccgtgcccaatcggtatgtcacaattgtgggtagggtactctttgctcttcgtggagggacaggagaaagcccacaaccaggacttaggattcgctgggtcttgcttacccaggttcagcactatgccctttatctattgtaatattaacgaagtctgtcactatgccaggcggaatgacaagtcatattggctttccaccaccgctcccatcccgatgatgcccgtgagccagactcaaatcccacaatacatttctcggtgttcagtttgtgaagccccatcgcaagctatcgcagtgcattcacaagatatcactattccccaatgcccactgggttggcgctcactatggatcgggtacagctttctcatgcacaccgcagccggggctgaaggcggcggtcaatccctggtctctcctggatcatgccttgaggacttccgagccactcccttcatcgagtgttcgggcgccagaggtacttgccactacttcgcaaataagtacagcttttggctgacaacagtggaagaaagacagcaatttggcgagctgcccgtctccgagacattaaaggcgggccaactccatacccgtgtgtcacggtgtcaggtgtgtatgaagagcctgtag

SEQ ID NO: 3954 - DNA, 783 bp, Artificial Sequence
  Description of Artificial Sequence: Synthetic coding sequence
atgctgcaggactggaaggagcgggccgccagcgtgtggtgcaagtggctggacgttaatcccaatcatcatctggtgaaagcccctcagcctgatctgccctgcccttgtcctttgtccctcctcccagggttcgctgggtcgtgtttgccccgattttctaccatgcctttcatttattgtaatatcaacgaagtgtgtcactacgcccgcagaaatgataagagttactggctgtctaccacagcccctatccctatgatgcccgtgagtcagacccagattcctcagtacatctcgagatgttctgtttgcgaagcaccctcacaagccatcgctgtgcattcgcaggacatcacgattccccaatgtccactgggatggcgctccctttggatcggctattcctttttgatgcataccgccgccggagctgagggaggcggacaatcacttgtcagccctggaagttgtctggaggactttagggctaccccattcatcgagtgctccggtgccaggggcacatgtcattattttgccaataaatacagtttttggctcacgactgtggaagagaggcagcagttcggagaactcccagtcagtgagactttgaaggcagggcaactccacacaagagtgtctagatgtcaaccaggctttacaggcccgggtattaaggagtggaagtggaagtggcatcatagtcccagcgctccggtcatccaccagcagaatttctgttttctgttccctcgccattatgtgctcctggcctag

SEQ ID NO: 3955 - DNA, 4902 bp, Artificial Sequence
  Description of Artificial Sequence: Synthetic coding sequence
atgcaccccggcctgtggctgctgctggtgaccctgtgcctgaccgaggagctggccgctgccggtgaaaaatcatacgggaaaccctgcgggggccaggattgcagcggctcttgccagtgttttcccgaaaagggcgctaggggcagacccggacctatagggatacaaggccctacagggcctcaagggtttacggggtctaccgggctttcaggactgaaaggagagagaggatttccaggactccttggcccctacggcccgaaaggagataagggccctatgggggtccctggcttcttaggcattaatggtatcccagggcatcccgggcaaccaggcccacgcggcccgccagggctagacggatgtaacgggacccagggcgctgttgggtttcctggaccagacggctacccggggctgctcggacccccaggcttgccgggacagaaaggctcgaagggagaccccgtgctggctcccgggtcatttaagggcatgaaaggcgatcccgggttgcccgggctagatgggattaccgggccccagggcgccccaggatttcctggggcggtcggtccagcagggcctcctggcctgcagggacctccaggtcctccaggccctctggggccagacggtaacatgggtctgggctttcagggagagaaaggcgtcaagggcgacgtgggactgccaggacccgctggcccacctcccagtaccggcgaactggagtttatgggttttcccaagggcaaaaagggatccaagggagagcctggcccaaaaggatttcctggcattagcggccccccgggattcccaggccttggaacaaccggcgagaagggcgagaaaggggagaagggcatccctggactgcccggaccccgcggcccaatgggatctgagggggtgcaaggtccgcctggccagcagggtaagaaaggtacactcggattccccgggctaaatgggtttcaggggattgaaggccaaaagggggatatcggtctgccaggaccggacgtctttattgatatagatggtgcagtgatctccggtaatccaggcgatccgggcgtgcctggccttcccggacttaaaggtgacgagggaatccagggcctgcgcggaccatctggtgtccctggcctccccgccctgtcaggagtgcctggagccttaggtccccaaggatttcctggattgaagggcgatcagggtaacccagggagaaccaccatcggtgcagcgggcctcccagggcgcgatgggttgcccggcccgccaggccccccaggaccaccaagtcccgagttcgaaaccgagacccttcacaacaaggagagtggattccctggtctgagaggggagcagggccccaaaggcaatcttggtctaaagggcattaaaggcgacagtgggttttgtgcctgtgatggaggggtgcccaacacaggaccgcctggagagcccggcccccccggcccttggggtctcatcggcttgccaggcctgaagggcgccaggggagatagaggatcaggaggggctcagggaccagccggggctccgggcttagtgggacctttaggtccgtctggtcccaagggcaaaaagggcgagccaattctgtccactatacagggcatgcccggggaccgtggggatagcggcagccagggattccgcggcgtgataggtgagcctggaaaggacggcgtccctggcctcccaggcttacctggcctgccaggggacggcggtcagggctttcccggtgagaaaggattgcctggactccctggggaaaagggccaccccggcccccctgggctgcctggtaatgggctgcccggcttgcccgggcccagaggactccctggagataaaggcaaggatgggttgcccggccagcagggcctgcctggaagcaaagggatcacactcccttgtatcatcccaggaagctacgggccctctggatttcctgggacgccggggtttcccggccccaagggatctcggggcctgccaggcaccccaggacagcctggctcaagtggctctaagggggagccaggatcacccgggctggtacacttgcccgagttgccggggtttccaggaccgcggggggagaaggggctgcctggattccctgggctccccggaaaggatggtctccccggaatgatcgggagtcctggtttgccaggctctaagggcgcgacaggcgatatattcggagcagagaacggggctcctggtgaacaggggctgcagggtcttacaggtcacaaggggtttctgggagactccggactgcccgggttgaagggcgtgcacggaaagcctggtttgctaggtccaaagggggagagggggtcgccaggcaccccagggcaggtgggacagcctgggacccccggatcaagtgggccctatggcattaagggcaaatccggccttccaggagctcctgggtttccaggcatatctggtcatccaggcaagaaagggacacgcggcaagaagggaccccccggatcaatcgtgaaaaaagggttaccaggcctgaaaggcttgcccgggaaccctggccttgtgggcctgaagggaagcccagggagcccgggggtggcagggcttcctgccctgtccggtcctaagggcgaaaaggggagcgtcgggtttgtgggcttcccagggataccgggtctacccggcatcccaggaacgcgaggcctcaagggaataccaggatcgaccggcaagatgggacccagtggtagggcgggcactcccggcgagaagggcgaccggggcaacccgggaccagtgggtatcccctctcctcgtcgcccaatgagcaatctctggctgaagggcgataaaggatcccagggcagtgccggttcaaatggatttcctggcccccggggagataagggtgaagccggtaggcccgggccccctggattaccaggtgcccctgggctgcccgggattattaaaggcgttagcggcaagccgggacctccgggtttcatggggattcgtggccttcctggcctgaaaggaagcagcggaataacaggctttcccggtatgccaggtgagtccggaagccagggaattaggggctctcccgggctccccggtgccagcggcttgcctggtttaaagggggataatggacagactgtagagataagtggatccccaggtccaaagggacaaccaggtgagtctggttttaaaggcaccaaagggcgggatggcttgatcggaaatattggctttccgggcaataagggcgaagacggcaaagtcggtgtctccggcgatgtggggctgcccggcgccccaggcttccctggtgtggctgggatgaggggtgaaccagggttgccagggagttcagggcatcagggggccatcgggccgttgggttctccgggtttgattgggcccaagggtccctccatcaccggggtccccggcccggccggactgcccggacctaagggggaaaaaggttaccctggcattggaattggggcacccggaaaaccaggccttcgtgggcagaagggggacagaggatttcctgggctgcagggcccagccgggctccccggtgcaccaggtatttccctacctagccttatcgccggacaaccaggtgaccccggaagacccggtctggatggtgaacgggggaggccgggtcccgcaggtccccccggaccgccaggaccctcaagcaaccaaggcgataccggtgaccctggatttccaggcatacctggccccaagggacccaagggggaccaggggattcccggcttcagcggtctgccaggcgagctcggactaaaggggagtagcgggctccaaggtgacccaggacagacaccgacagccgaagccgtgcaggtaccacccggtccactcggcctgccaggcattgacggcatcccgggactgaccggtgacccaggagcccagggacccgtaggactgcagggaagcaagggcctgcctggaatacctggaaaagacggacccagtggcctccccggtcctccgggcgccctgggagacccagggcttccgggcctccagggcccaccaggctttgagggcgccccagggcagcaggggccatttgggatgcccggtatgccagggcagagcatgagagtcggatacaccctggtaaagcactcacagtccgagcaggtcccgccgtgtcccatcgggatgtcccaactctgggttggttactccttactgtttgtggagggccaggagaaggcacataaccaggaccttggatttgcaggatcctgcctccctcggttttccacaatgcctttcatttattgcaatattaacgaagtgtgccattacgctaggaggaacgataagtcctactggctgtctacaactgccccaatccccatgatgccagtgtctcagacacagattccccaatacattagtaggtgttctgtctgtgaagcgccctcgcaagcaattgccgtgcattcccaagatattacaatcccacagtgccccctcggatggagaagcctttggattgggtacagtttccttatgcacacagcagccggagccgagggcggagggcagtctctagtttctcccgggtcttgtttagaagatttccgcgcgactcctttcattgaatgttctggagcgcgagggacttgccattatttcgctaacaagtattccttctggttgaccaccgtggaagaaagacagcagtttggagagctgcctgtgtcggagactttgaaagctgggcagctgcacactagagtgtcacgatgccaggtctgtatgaagagtttgtag

SEQ ID NO: 3956 - DNA, 5001 bp, Artificial Sequence
  Description of Artificial Sequence: Synthetic coding sequence
atgcaccccggcctgtggctgctgctggtgaccctgtgcctgaccgaggaactggccgccgccggagagaagtcatatggcaaaccttgcgggggacaggactgttctgggtcctgtcagtgtttccctgagaagggcgctaggggccgtcctggaccaattgggatccaaggccccaccgggccccaggggttcaccggtagcactgggcttagcgggctcaaaggggagcgcggttttcccggcctcctgggcccgtatggaccgaaaggggataaaggccctatgggtgtgccgggattccttggaattaatggaatcccgggacacccaggacagcctggtcctcgggggccacctgggcttgatggctgcaacggcactcaaggtgccgtggggttccctgggcccgatggttatcctggcctcctcggaccgccaggcctcccgggccaaaagggcagcaagggagatcctgtcctagctcctgggtccttcaaggggatgaagggagatccaggcctgcccgggctggacgggatcacgggcccccagggcgcccctggctttccaggcgccgtcgggcctgctgggccccccggcctgcagggccctccaggaccccccggtcctctggggcccgacggcaatatggggctcgggttccaaggcgaaaagggtgttaagggagatgtgggcttgccaggccctgcaggaccccctcccagtacaggagagttggagtttatgggattccctaaaggcaagaaagggagcaaaggcgagcccggccctaaaggcttccctggaattagcggcccgcccgggttcccagggttaggaactaccggggagaaaggggagaaaggagagaaagggatccctgggctgcccggccctcgagggcccatgggctctgaaggcgttcagggtcctcccggccagcaggggaagaaaggcactctgggttttcccggactgaacggctttcagggaattgagggccagaagggagacatcggccttcctggacctgacgtatttattgacattgatggagcagtcatatctggaaaccctggcgaccctggtgtgcccgggttgcccggcctgaaaggggacgagggcatccagggcctaaggggcccctcaggagtgccaggattacctgccctgagcggcgtccccggcgccctgggcccgcagggcttccctggcctgaagggcgaccagggtaaccctggacgcactacaattggcgctgcaggccttcccggaagagacggcctcccaggccctcctggaccaccgggccctccgtcaccagaattcgagactgaaacactgcataataaggaatctggcttccccgggctgcgaggtgaacaggggccaaaaggcaacctgggacttaagggtatcaaaggcgatagtggcttttgtgcctgtgacggaggcgtacctaacaccgggccccctggggagcccggaccccccggtccatggggtctgatcggactgccgggactcaagggggcacgcggcgaccgggggtccggcggtgctcagggacctgccggtgccccaggactggtgggcccgcttggcccatcagggcctaaagggaaaaaaggggagcctattttgtctacaatacagggcatgcccggagaccgtggtgactcagggtctcaaggattccgcggcgtgattggagagcccggaaaggacggggtgccagggctccccggtctgccagggttgccaggtgatggagggcaaggctttcccggcgaaaagggattgccaggactgcccggtgagaaggggcatcctggtccgcctggcctgcccggaaacggcctccctggactgccaggcccacgaggactgcctggagacaaagggaaggatggacttccggggcagcaaggactgcccggcagcaagggaataacccttccgtgtattattccgggcagttatgggcctagtgggttcccaggcacaccagggtttcccggcccaaaaggttcccggggactcccagggaccccaggacagcccggatcaagcgggagtaagggggaacctggcagcccgggtttggtgcatctgccggagctcccagggttcccggggccacgaggcgaaaagggcctgccagggttcccaggccttccaggaaaagacggacttccaggcatgatagggtcacctgggttgccagggtctaaaggagccacgggagacatttttggcgcggagaacggcgccccaggagagcaaggactccaaggtctgaccggacataagggttttttaggggacagtgggctacccggccttaagggggtgcatgggaagcccgggctgctcggccctaagggagaaaggggcagtccggggacacccggccaggttggccagcctggcacacctggatccagcggcccctacggaatcaaaggaaagtcagggctgcctggtgcacccggctttcccggcatcagcgggcaccccggcaagaaagggacaagaggaaaaaagggccccccaggaagcatcgttaaaaagggattgcccggcctcaagggtctgccgggcaatcctgggttggttggcctcaaggggagccctgggtcaccaggcgtggccggactgcccgctctgtctggcccgaagggcgagaagggcagcgttgggttcgtcggatttccaggaattcccggcttgccaggcatacccggcacccgcggcctgaagggtattcccggcagtaccggaaagatggggccttccggaagggctggcacaccaggggagaaaggagataggggcaaccctggtcccgtagggattcccagtccccggagaccaatgtcaaacttgtggcttaagggcgataagggatcacagggaagcgctggaagtaacggcttcccgggaccacgcggagacaaaggggaagccgggcgccccggcccgccaggcctgccaggtgcccctggcctccctgggatcatcaaaggcgtgtccggaaagcctgggcctcctgggttcatgggtattcgaggcttgcctggtttgaaggggtcctccgggatcacgggcttccccggtatgccaggtgagtccggttcccaggggatcagggggagcccggggctccctggcgctagcggccttcctggactgaaaggggacaacggacagaccgttgagatctctggctcccccgggcccaaggggcagcccggggaatctggcttcaagggcacaaagggcagagatgggctgatcggaaatattggtttccccgggaacaagggcgaggacgggaaagtgggagtgtcaggagacgtcggcctacccggcgcgcctgggttccccggggtcgctggcatgaggggagagcccggcctgccaggcagctccggccaccaaggcgcaatcggcccgctgggctcccctggattgattggaccgaagggccccagtatcaccggtgttccagggcctgcaggcctgcctgggcccaagggcgagaagggttatccaggcattgggattggcgcccccgggaagcctggccttcgcgggcaaaagggcgacagggggttccccgggcttcaaggtcccgcagggctgccaggcgctcctggaatctctcttccaagtcttatagctggacagccaggtgaccccggccgcccaggcctagacggagaacgcgggaggccaggaccagctgggcccccgggtcccccggggccaagtagtaaccagggcgatacgggcgaccccggcttccctgggatcccaggccccaagggcccaaagggggatcagggaatcccaggatttagcgggcttcctggggaattgggtctcaaaggaatgagaggcgagccaggcttcatggggacccctgggaaggtgggcccccccggcgatccagggttcccagggatgaagggaaaagccggccctagaggatcctccgggctgcagggtgacccaggccagactcctaccgccgaggccgtacaggtgcctcctggacctctaggcctgccaggaatcgatggaatccccggactgaccggtgatcctggtgcccaaggcccagtgggtttgcaaggctccaaggggctgcctgggataccgggaaaggatggcccctctgggctacctgggcctcccggcgccctcggcgatccgggcctcccaggcctgcaggggccacccgggtttgaaggtgcccctgggcagcagggtccttttggtatgcccggcatgcccgggcaatccatgcgcgtaggttatacacttgtcaaacattcccagtctgaacaggtccccccctgtccaattgggatgagccagctctgggtgggctacagtttgctcttcgttgaaggtcaagagaaggctcacaatcaggacctaggctttgccggatcatgcctgcctcggttcagcactatgcccttcatctactgcaatattaacgaagtttgtcattacgccaggcgcaacgataagtcctattggctcagtaccacagcgcctattcccatgatgcccgtttctcagacgcagatcccacagtatatctctcggtgctcggtgtgtgaggccccaagccaggccatcgcagtgcacagtcaggatatcaccatcccccagtgccctctcgggtggagatccctgtggataggatacagtttcttgatgcacacggctgctggcgcagagggaggtggccagagtctcgtgagtcctgggtcgtgcttggaagacttccgcgctacacctttcattgaatgttctggcgcccgaggaacctgtcactatttcgccaataaatactctttttggctaaccaccgtggaggagcgccagcaatttggcgagctcccagtgtctgaaacactcaaggccggacaactacatactcgcgtgagtcgctgtcaggtttgcatgaaatcattatag

SEQ ID NO: 3957 - DNA, 2037 bp, Artificial Sequence
  Description of Artificial Sequence: Synthetic coding sequence
atggcctggaccgcccgggaccggggcgccctgggcctgctgctgctgggcctgtgcttatgcgctgcacagaggggcccccccggagaacagggcccaccaggcccccctggaccacctggggtgccgggaatcgacggtatcgatggtgaccgcggcccgaagggccctcccggtccgcccggacccgccggagaaccgggtaagccgggagccccaggcaagccaggaacccctggggctgatggtctcactggccccgatggaagtcccggtagtatcggtagtaagggccagaagggcgagcccggggtacctggctccagagggtttcccggtagaggcatccccggtccacccggtcctccaggaaccgcgggactccctggggaactgggacgtgtaggacccgtcggggaccccggccgtcgcggccccccaggccccccagggcccccaggtccacggggtaccatcgggttccacgatggcgacccactgtgtccaaacgcctgtcccccggggaggtccggctacccaggtctgccaggaatgcggggtcataagggcgctaagggagagatcggcgaacccggccggcagggccacaagggcgaagagggagaccagggcgaactcggggaggtgggcgctcagggaccaccgggggcgcaagggctaaggggtattactggtattgtgggggacaagggagaaaagggagctcgaggtcttgatggcgagcctggcccccaggggctgccaggcgcacccggggaccaggggcaacgggggccgccaggcgaggcgggccctaaaggggacaggggcgccgagggagcaaggggcattcccggcctgcctggacccaagggggacacaggcctgccaggagtggacgggagggatggtattcctggcatgcctgggactaagggtgaacctggcaagcccggaccacctggagatgccggactgcagggactaccaggtgtgccaggcattcctggggccaaaggggttgccggagagaaggggtccacgggcgcacccggtaaaccaggacagatggggaattctggcaagcccgggcagcagggccctcctggcgaggtgggaccgcgcggcccacaggggttacctggctccaggggagaactcggccccgtaggctcgcccggtttgccaggcaagctgggcagtcttggatcccccgggttacctggtctgccggggccaccaggcctgcccggcatgaagggcgatagaggcgtcgtgggggagccgggcccaaagggcgagcagggagccagtggagaagagggcgaggctggagagaggggtgagttaggagacataggcctgcctggaccgaaggggtccgccggaaatcccggtgagccaggactccggggaccagaggggagtcggggccttcccggggtcgagggcccccggggcccacctggaccaaggggtgtgcagggggaacagggtgcaaccggtttacccggggtgcagggaccgcctggcagagcgccaactgatcagcacattaaacaggtatgcatgcgcgtcatccaggaacacttcgccgagatggccgcttccctgaaacgtcccgactcgggagctacaggcttacccggcagaccagggcccccaggtccaccagggcctccaggcgaaaatggcttccctggccaaatgggcatcagagggctccccggcattaaggggccccccggggcattgggcctccggggaccaaaaggggatctgggcgagaaaggtgagagagggccaccgggccgtggacccaatgggttacccggagcaatagggttgccaggagatcccggcccagcgtcatatggcaggaatggacgagacggtgagcgcggcccacctggcgtggccggtatccctggtgtgcctggacctcctgggccacccggtttaccaggcttctgcgaacctgcttcgtgtacaatgcaagcaggccaaagagcgttcaacaaggggcccgacccgtag

SEQ ID NO: 3958 - DNA, 2766 bp, Artificial Sequence
  Description of Artificial Sequence: Synthetic coding sequence
atgaagacctgctggaagatccccgtgttcttcttcgtgtgcagcttcctcgaaccttgggccagcgctgctgtgaagaggcggcctcgtttcccagttaactcaaatagtaacggaggtaatgaactgtgtccgaagattcggatcggccaggacgatctgccaggctttgaccttatcagccagttccaggtggataaagccgcttcacgtagagccattcagcgtgtggtcggtagcgccactctccaggtggcttacaagctgggaaacaatgtcgactttaggattcctacaagaaatttatatccatctgggctccccgaagaatactcattcctcactacgtttcggatgactggttctaccttgaaaaagaattggaatatctggcagatacaggattcttcgggcaaggagcaggtgggtattaaaataaacggacaaactcagagtgtagtgttctcctacaaaggcctcgacggatcattgcaaacagctgccttctccaacctgagtagtctttttgactcacaatggcacaaaatcatgatcggcgtggaaagatcctccgccaccctctttgttgactgtaatcgcatcgagtctctacccataaagccgcgtggaccaatcgatattgatggctttgccgtgctcgggaagcttgctgacaaccctcaggtcagcgtcccgttcgaacttcagtggatgctgattcattgcgaccctcttcgaccacgtcgggagacatgtcacgaacttcccgctcggatcacccccagtcaaacgaccgacgagagggggccgccgggcgagcagggcccccctggccctccaggcccccccggggtacccgggatcgatggcatcgatggcgatcgcggccccaagggcccgcccggccctccaggtccagccggagagcctggtaaaccaggcgctccaggcaagccagggacacctggcgcagacgggctgactgggccagatggctcaccagggagtatcggcagcaaggggcagaaaggagagcctggggtcccgggctccagaggattcccaggcaggggaatccccggccctccagggcctcctggaaccgcaggactgcctggagagctcggccgcgtgggcccggtaggagatccagggaggcgagggccaccagggcctcccgggccacccgggccccgcggcaccatcggattccacgatggcgacccactctgtcctaatgcctgcccgcccgggcggtcagggtatccagggctgcctggaatgagagggcataaaggggctaagggggaaattggagagccaggcaggcagggccacaaaggcgaagaaggggaccaaggggaacttggagaggtcggtgcccagggaccacctggtgctcaggggttgcggggaatcacggggatcgttggagataagggagagaagggtgcccgcggattggacggtgagcccgggcctcagggcctccctggtgcccccggagatcaagggcagcggggcccccctggggaggccgggccaaagggcgacaggggcgccgaaggagcgcgaggcatccccggcttaccaggaccaaagggcgacacaggtctgccgggcgtggatggacgtgacggcatcccgggcatgccagggaccaaaggggagcccggaaagccaggaccaccaggagacgccggtcttcagggtctgccgggcgttcccgggatccccggggcaaaaggcgttgctggtgaaaagggatctacaggggcccccggcaagcccggacagatgggaaactctggcaagccaggtcagcagggcccacctggcgaggttggtccaaggggcccccagggactgccaggaagccgcggtgaactgggccccgttggctcacctggtctcccggggaaactagggtcccttgggtctcctggactgcctggcttgcccggaccgcccggtctcccagggatgaagggcgaccggggtgtcgtgggggaaccaggccccaagggggagcagggcgcgtccggggaggagggcgaggccggagagcgtggggagttaggggatattggactgcctggccccaaagggtcagccggcaatccaggtgagccggggttaagagggcctgaggggagccgagggttgccgggtgtcgaaggccctagaggtccccccggaccacgcggggtccagggcgagcagggagcgacgggtctgcccggcgtgcagggccctcctggcagagcgccgacagatcagcatatcaaacaggtctgtatgcgtgtgattcaggagcactttgccgagatggcggccagtctgaaacggccagacagtggcgctacaggtctgcccgggcggcctggaccacctggtcctccaggaccgcctggtgagaacgggtttcctggccagatgggaatacgggggctgccggggatcaaaggccctccaggcgcacttggactccgaggccctaagggagatcttggagagaaaggagagcggggtcctccgggacgtggaccgaacggtctccccggcgctatcggccttccaggtgatcctgggccagcttcctacggacggaacggacgagacggtgagcggggacctccgggggttgcgggcataccaggggtccccggaccccccggtcccccggggcttcctgggttctgtgagccagcaagctgcaccatgcaggcaggtcagagagcattcaacaagggtcccgatccgtag

SEQ ID NO: 3959 - DNA, 987 bp, Artificial Sequence
  Description of Artificial Sequence: Synthetic coding sequence
atgaagacctgctggaagatccccgtgttcttcttcgtgtgcagcttcctggagccatgggcgtcggccgcagtcaagcgacgacctagattccctgtaaatagcaactccaatggtggcaacgaactttgtcctaaaataaggataggacaagacgacctgcctggctttgacctgatatctcagttccaagtggataaagctgcctctcgtagggctattcaacgggtcgtgggcagcgctaccttacaggtcgcttataagctgggtaacaacgtagacttcagaatccctacccgcaatctctatccatccggactgccggaggagtactcttttttaaccaccttccgaatgacgggaagcaccctgaagaagaactggaacatatggcagatccaggactctagcgggaaggagcaggtcgggatcaaaatcaacggacagacccagtccgtcgtgttctcctacaaaggactggatgggagtctgcagacagcagccttctcaaatctcagctccctcttcgacagtcaatggcataaaataatgatcggggtcgagcgatcttctgctacactgttcgtggattgtaaccggattgagagcctaccaatcaaaccaagagggccaattgatattgatggctttgccgtgctgggcaagcttgccgacaatcctcaggtgagcgtaccattcgaactgcaatggatgcttatccactgtgatccactccgcccacggagagaaacatgtcacgagcttcccgcccgaattactccaagtcagacaaccgacgagcgcggccccccaggtgagcaaggtccacctgggccgcctggaccacccggcgtgcctggaattgacggcattgatggcgatcgcggccccaaaggccccccaggaccacccggccccgccggcgagcccgggaagcccggagctcctggcaagccagggactcccggggctgatacaagcccttag

SEQ ID NO: 3960 - DNA, 2037 bp, Artificial Sequence
  Description of Artificial Sequence: Synthetic coding sequence
atggcctggaccgcccgggaccggggcgccctgggcctgctgctgctgggcctatgtctgtgcgccgcacagcgcggtcccccaggggagcaggggccgccaggacctccgggcccacctggtgtgccaggaatcgacggtatcgatggtgatagaggcccaaaaggccccccaggtccacccgggcctgccggcgaaccggggaagccaggcgccccagggaagccgggtactcctggggctgatggcctaactgggccagatggctcacccgggtctattggaagtaagggacagaaaggggagcctggagtgccgggctctcgaggtttccccgggaaaattcttccactgctgcagggccctccaggaacagccgggctcccgggagagcttggccgagtgggccccgtcggagatcctggacgacgcggaccacccgggcctccaggacccccaggccctagagggaccatcggctttcacgacggggatccattatgtccaaacgcttgccctccaggcagatcagggtatcctggcctccctggaatgcggggtcacaaaggggctaaaggcgagataggggagcccggacgccagggccataagggagaggaaggggaccaaggggaattgggcgaagtcggcgctcagggacctccaggcgcccagggactgcggggaatcactgggattgtgggcgataaaggggagaaaggagccagagggttggatggggaaccgggccctcagggactgcccggagctcccggcgaccagggacagcgtggcccccctggagaggccggacccaaaggagataggggggccgagggcgcccgtggcatccctggcctgccgggacctaaaggcgacaccggcctgcccggagtcgacggacgcgacggcatccctggcatgccagggacaaagggcgaaccaggtaagcctggacccccgggggacgcaggtctccaggggctcccaggcgtgcccggtattcctggagctaagggtgttgctggagaaaaaggttctaccggggctcccggcaagccgggccagatgggcaactctggaaagccaggacagcagggaccccccggagaggttggacctcgggggcctcagggcttaccagggagcaggggggagctgggcccagttggctcaccaggcttgcctggaaaattaggctctctgggcagtcccggcctgcccgggctgccaggtccccctggtttacctggcatgaagggagacaggggcgttgtcggagaacccggccccaagggcgaacagggcgcctcaggggaggagggtgaggctggggaaagaggcgagcttggtgatattgggctgcccggaccaaagggatctgccgggaaccctggcgagcccggtctgaggggtcctgaaggctcaaggggcctgccgggcgttgagggccccaggggccccccaggcccccgaggtgtacagggtgaacagggggccacagggctaccaggggtgcaaggaccaccgggaagagcccccactgaccagcacatcaagcaagtctgcatgcgcgtcatccaggagcatttcgccgaaatggccgcttcactgaaacggcccgattcaggagccacagggctaccaggtaggcctggaccccctggaccacccggcccacctggcgagaatgggttccccggtcagatgggcattcgcggcctacccgggatcaaaggcccaccgggagcgctgggtctgcgcgggccgaagggcgacctaggagagaaaggggagcggggtcccccaggaagaggccccaacggactgccgggggctatcggcctccctggggacccaggacccgcctcttatggccgcaacggccgcgatggcgaacgcggaccacctggagttgccggtattcccggcgtacccggccctcctggcccccccgggctgcccggattctgcgaacccgctagctgtacaatgcaagccggacaaagagcctttaacaagggccccgacccatag

SEQ ID NO: 3961 - DNA, 252 bp, Artificial Sequence
  Description of Artificial Sequence: Synthetic coding sequence
atggccgccgccaccgccagcccccggagcctgctggtgctgctgcaagtcgtcgtgctggcgctggcccagattcgcgggccccccggggagaggggccctccgggaccgccaggacccccgggggtccccggcagcgatggtatcgatggtccacccggacctgtgggcttgcctggggagatcggcattcgggggcctaagggggaccccggcccagacgggccttccgggcccccaggcccaccatag

SEQ ID NO: 3962 - DNA, 2070 bp, Artificial Sequence
  Description of Artificial Sequence: Synthetic coding sequence
atggccgccgccaccgccagcccccggagcctgctggtgctgctgcaagtcgttgtgctggccctcgcccaaatacgtggcccccctggcgagcgcgggccaccgggtccccctggaccacccggcgtacctggcagcgacgggattgacggggataatggtcccccgggaaaagccggcccccctgggccaaagggggaacctggtaaggccggaccagacggaccagacggcaagcctggcatcgacggattaaccggggctaagggcgaacccgggccaatgggcattcccggagtgaaagggcagcccggcctccctggaccccctggactgcctggacccggatttgcaggccctcccggacctccaggacctgtgggactcccaggagaaatcggcatccgcgggccaaaaggagatcctggtcccgatggtcccagtggaccccctggtcctcctggcaagcctggtagaccagggacaatccagggtttagaaggcagcgcagatttcctgtgccctaccaattgccccccaggcatgaaggggcccccaggacttcagggggtgaaaggccatgccggaaaacgaggtatactcggagacccgggacatcagggcaagcctggaccgaagggagatgtcggcgcatcaggtgagcaagggatacctggtcctcctggacctcaaggtattcggggatacccaggcatggcaggtccgaagggcgagacaggccctcatggctacaagggtatggtgggagccattggtgccaccggtcccccaggggaagagggacctcgtgggcctcccgggcgagcaggcgaaaagggtgatgagggatcacctggaatccgcggaccccagggtatcactggcccaaagggggccactggcccacccggcatcaacggcaaggacggaacccccggtacccccggcatgaagggttcagctggtcaggcaggtcagcctggaagtcccggacaccagggcctggctggcgtcccaggtcagcctgggaccaaaggtggcccaggggaccagggcgagcctggaccacagggattacctggtttcagcggacctcccggtaaggagggcgagccgggacctcggggcgagataggacctcaggggatcatgggtcagaagggggaccaaggagagcgaggaccggtcgggcagcctgggcctcagggacgccagggtcctaagggagaacagggaccaccagggatccccggacctcagggcctgcctggggtgaagggggacaaaggatcccctggcaagacaggcccacggggtaaggtgggagatcctggcgtcgccggcctgccaggagagaaaggggaaaagggtgagtccggtgagccggggccaaaagggcagcagggggtccggggcgagccagggtatcccggccctagcggcgacgcgggcgcacccggcgttcagggctatccaggcccaccaggtcctcggggtctggcaggaaaccggggagtccctggccagcccgggaggcagggagtagaaggacgggacgcaacggaccagcacattgttgacgtggccctgaagatgctgcaggagcaactggctgaggtggccgtctcagcaaagagagaggccctaggggccgttgggatgatgggcccccccgggcccccaggaccccccggttaccccggcaaacagggtcctcacggacaccccgggccgcggggggtgcctggtatagttggagctgtgggccagatcggcaacacaggccctaagggaaagcgcggagaaaagggtgaccctggagaagtggggaggggccatccaggcatgcctggccctccaggcattcctgggctaccagggagacccggccaggcaattaacggcaaggacggcgatcgtggatcccccggcgcccccggcgaagcaggacgacctggactcccaggacccgtcgggctgcccggtttttgcgagcccgccgcctgtctaggcgcctctgcctacgcctccgcgaggctgaccgaaccagggagtattaagggaccttag

SEQ ID NO: 3963 - DNA, 2055 bp, Artificial Sequence
  Description of Artificial Sequence: Synthetic coding sequence
atggccggcccccgggcctgcgcccccctgctgctgctgctgctgctcggggaattgcttgccgcagccggggcccaacgcgtggggttgcctgggcctcccggccctccaggccctcctgggaagcccggacaggatgggattgatggggaggcaggccctcccggactccccgggccacctggtccaaagggagcacccgggaagcctgggaaacccggtgaagccggactgcccggtttgcctggagtggatggcctgaccggcagggatgggccccctggcccaaaaggcgcccccggcgaacgggggagcctcgggccaccgggccctcctgggctcggagggaaaggactgccggggccaccaggagaggccggcgtatctggcccccccggagggatcggcctccggggaccccctgggcctagcggactgccaggattgccgggaccaccaggcccacccggtcctccagggcaccctggggtactacctgaaggcgcaaccgacctccagtgcccttctatctgtcctcctgggcccccaggcccgcctgggatgcctggcttcaaggggcccacagggtataagggcgagcagggcgaagtgggtaaggatggcgaaaagggtgaccctgggcctccgggtcctgccggtttgccaggcagtgtgggactacagggacctagagggctgaggggcctgcctggacccctgggaccccctggcgacagaggacccatcggattccgtggcccaccgggcattccaggagctcccggaaaagcaggagatcgaggagaacgcggacccgagggtttcaggggccctaagggcgatcttgggcgtcccggtccaaaggggacccccggcgtggctggaccttccggcgagcccggcatgccaggaaaggatggacagaatggtgtccctggcctggatgggcagaagggggaggcgggacggaatggcgctccaggggagaaaggccctaatggactccccggcctgcctggtcgggccggttccaaaggcgaaaagggcgaaaggggtcgggctggggagttgggggaggccggcccctctggagagcccggagtgcctggagacgctggaatgccgggagaacgcggcgaggcgggccaccgcggctccgcaggggccctggggcctcagggacccccgggcgccccaggcgtcagagggttccagggtcagaaggggagtatgggcgacccaggactccccggacctcagggacttcgaggggatgtgggtgacagagggccaggaggtgccgcgggtccgaagggcgaccagggcatcgcaggtagtgatgggcttcctggggataaaggggaactcggccccagcggtctggttggtcccaagggagagtctggaagtagaggcgaacttggacccaaggggacgcaggggcctaatggcactagtggggttcagggagtacccggaccacccggtcccctgggattacagggcgtccccggcgttccagggataacaggaaagcccggcgtcccaggtaaagaggcttcagagcagagaatcagagagctctgcggtgggatgatttcagagcagattgcccaactggctgcacatcttaggaaacccctggccccggggtccattggaagaccagggcccgccggcccccccggcccacctggaccaccagggagcataggtcaccccggcgcccgggggccaccagggtaccgaggccctacaggagaactcggcgatccagggccacgagggaatcagggcgacagaggggacaagggggctgccggcgctggcctggatggcccggaaggagaccagggtccccaggggccccagggagtcccaggcacatcaaaggatggacaagatggcgctcccggagaacctggacccccgggggaccccggtctgcctggggcaataggcgcccagggcacgcccgggatctgtgacaccagcgcctgtcagggggcggttctggggggagtgggcgaaaaaagcgggagtagaagcagctag

SEQ ID NO: 3964 - DNA, 576 bp, Artificial Sequence
  Description of Artificial Sequence: Synthetic coding sequence
atgtggtggagcagcacccagaacgccggcaccgagggcgaggccggcccaccaggactcccaggacccccgggccccaaaggggctccaggtaagccagggaaaccgggcgaggccgggctccccggcttaccaggggtggacgggctcactgggcgtgatgggcctccgggtccaaagggagcccccggtgagcgcggctcactcggacccccaggcccccctggcttgggtggaaagggacttccgggtcccccaggcgaggctggggtctcagggcccccaggagggattgggctgaggggtccccccggtccatcagggctccccggcttacctggacccccaggacctccgggcccacctggccacccaggcgtgttgcctgaaggagcaaccgacctacagtgcccctctatctgcccgccaggtcccccagggcctcccggcatgccagggttcaaaggccccacaggttataaaggcgaacagggagaggtcggaaaagatggtgaaaaaggtgatccaggtccccccggacccgccggcttgcccggttcagtcggtcttcagtag

SEQ ID NO: 3965 - DNA, 576 bp, Artificial Sequence
  Description of Artificial Sequence: Synthetic coding sequence
atgtggtggagcagcacccagaacgccggcaccgagggcgaggccggcccacccggtttgcccgggccccctggacccaagggagctcctggtaagcctggcaagccaggggaggctgggcttcctgggttgccgggagttgacggcctcacagggcgagatggccctcctggccccaaaggcgctcctggagaacgaggttcactcggccccccaggcccccccggactcggcggaaaaggtctacccggtcctcctggcgaggccggcgtgtcgggcccgcctggaggtatcggcctgagagggcctccaggaccttccgggctgcctggactgcccggccctcctggacccccagggcccccaggccatcctggcgtcctgccagagggtgccactgacctacagtgtccctccatatgtccacccgggccgcctgggccccctgggatgccaggcttcaaagggccgaccgggtataagggcgaacaaggggaggtaggcaaagacggtgaaaagggagaccccggcccacccgggcctgctggtctgcccggctccgtgggcctgcagtag

SEQ ID NO: 3966 - DNA, 1128 bp, Artificial Sequence
  Description of Artificial Sequence: Synthetic coding sequence
atgggcccccccggcctgcccggcctgaagggcgacagcggccccaagggggagaagggccacccgggcctcattggactcatcggcccaccgggagaacagggtgaaaagggagatagggggcttcccggacctcagggttcgtcaggacccaaaggagagcagggaatcaccggaccttcaggtccaatcgggccaccaggaccacctgggctccctggtccgcccgggcccaaaggtgcgaagggatcatccggcccgaccggaccaaagggcgaagccggccatcctggccctccagggcctccaggtccacccggcgaggttatacagcccctccccatccaagcatctagaacgcggcggaacatcgatgccagccagctgctggatgacggaaacggcgaaaactacgtggattatgccgacggtatggaggaaatttttggcagcctgaatagtcttaagcttgagatagagcagatgaagcggcccctcggcactcagcagaacccagctcgcacctgcaaagacctgcaattgtgccaccccgattttcccgacggcgagtactgggtggatccaaatcaggggtgtagccgggattcgttcaaagtgtactgcaactttacagctgggggttctacttgcgtgttccccgacaagaaatcggagggatccaaaatggccagatggccaaaggaacagccctctacatggtacagtcagtacaagagaggatccctcctgtcctacgtggatgccgagggcaacccagtgggagtggtccaaatgacgttcctgcggcttttgtccgcatcggctcatcagaatgtcacttaccactgctaccaatctgtggcgtggcaggacgcggcgactgggtcttacgataaagcactaaggttcctgggatcgaatgatgaggaaatgagctatgataataatccctatatccgagctctggtggacggctgcgctaccaagaaagggtaccagaagacagtgttagagatagatacacctaaagtggaacaggtacccatagtggatatcatgttcaacgactttggcgaggcttcccaaaagtttgggtttgaagtcgggccagcttgtttcatggggtag

SEQ ID NO: 3967 - DNA, 5517 bp, Artificial Sequence
  Description of Artificial Sequence: Synthetic coding sequence
atggacgtgcacacccggtggaaggcccggagcgccctgcggcccggcgcccccctcctgcccccgctgcttctactcttgctgtgggccccgccaccatctcgcgccgctcagcccgctgacctactgaaagtgcttgattttcataacttgccggatggtatcacaaagacaactggcttctgcgccacgcgaagatcttcaaagggccctgatgtcgcctaccgcgtgacgaaggatgcccagctgtctgctcctacaaagcaactgtacccagccagcgccttccctgaggacttctcaatattgaccaccgtgaaggccaaaaaaggctctcaggcctttctcgtgtcaatttacaatgaacaaggtattcagcagataggcctggaactcggacgttctccagtcttcctctatgaggatcacaccggcaagcctggccctgaagactatccgttattccgcggtattaacctgtccgacggtaaatggcataggatcgccctgtctgtgcataagaaaaatgtgacactgatactagactgcaagaagaagacaactaaattcttagaccgctccgaccaccctatgatcgacatcaatgggatcatcgtgttcggaactcgcatcctcgacgaggaggtctttgaaggggacattcagcagcttttgtttgtgtctgaccatagggctgcatacgactattgcgaacactattccccggattgcgatactgcagtgcccgatacacctcagagccaagacccaaatcccgatgagtactataccgagggtgacggtgagggagagacttattattacgagtacccctactacgaggacccggaggacctgggcaaggagcctacccctagcaaaaagcctgtggaagccgccaaagaaacaaccgaggtcccagaggagctgaccccgacccccacagaggcagctccaatgcctgaaacttccgagggcgctgggaaggaagaggatgtaggcattggagactacgattatgttccgagcgaagactattacacaccaagcccttacgatgaccttacatacggtgaaggtgaggagaaccctgaccagcctactgatcctggagccggcgctgaaattcctacctccactgccgacacatcaaacagcagtaatcctgctccccctccgggagaaggagcagatgaccttgagggggaattcacagaagagaccattcggaacctcgacgagaactactatgatccatactatgatcctacctcatcccccagtgagatcggtcctggcatgcccgccaaccaagacacaatttatgaaggaattggcgggcctcgcggggaaaaaggacagaagggcgaaccagcgattattgaaccagggatgctgatagagggcccccccggaccagagggaccagcgggattgcccgggcccccgggaaccatgggtccaaccgggcaggtcggagaccctggtgagcggggtccgcccgggcgaccgggactacccggggccgacgggttgccaggtccaccagggactatgctgatgctcccttttaggtttggggggggtggcgacgctggcagtaagggacccatggtatctgcacaggagagccaggcccaggccatcttgcagcaagcaaggctcgccctgagggggccagcaggccctatgggtctcacaggccgacctggacctgtcggtccaccagggtccggcggcctgaaaggggaaccaggcgatgtgggcccccaaggtcctaggggagtccaagggccccctggcccagccggaaaacctgggcggcgaggcagagctggatccgatggtgcccgcgggatgccaggccagaccggaccaaagggagaccgcggcttcgatggattagcaggcctaccaggagagaaaggacataggggagatccagggccatctggacctcctggtcctcctggcgacgacggtgagcgtggcgatgacggggaggttggcccaagggggttgcccggagaacccgggccccggggactattgggacccaagggcccccctggcccccccggaccacctggcgtgacggggatggacgggcagccgggccctaaaggaaatgtgggaccccagggcgagccaggcccacctggccagcagggaaaccctggggcgcaagggttaccaggaccccagggagcgatagggccacccggggaaaaggggcccctcggaaaacctgggcttcccgggatgccaggcgccgatggcccacctggccaccccggcaaggaaggaccacctggagaaaagggaggacaagggcccccgggcccccagggacccatcggatacccggggccaagaggagttaagggagcagatgggatcagaggcttaaagggcacaaagggagaaaaaggcgaagatggttttccagggtttaaaggggatatgggcattaaaggcgatcgcggagaaatcgggcccccagggcccagaggggaggatgggcctgaggggcctaagggcagaggtggcccaaatggggacccgggccctctgggtccgcccggcgagaaggggaagctgggcgtgccgggacttcctggctatcccggcaggcagggacccaagggcagcattggctttcctggcttccctggcgcaaatggcgagaagggaggaagggggactcccggaaagcccggacctagagggcaacggggaccaactggtccaaggggagagaggggcccccgtggcatcacaggcaaacccgggcctaaaggcaattccgggggcgatgggcctgccggcccacccggcgaaaggggccccaacggaccccagggacctacgggctttcctggacctaaggggcctcccgggccgcctgggaaagacgggctgcctggacatcctgggcagcggggcgagactggttttcagggaaagacgggccctccagggcctccaggagtggtgggcccacaaggccctacaggcgagacagggccaatgggtgaacgggggcatcctgggccccccggtccccctggcgagcagggacttccaggacttgccggaaaggagggtaccaagggggatcccggcccagcagggctgcccgggaaagacgggccccctggattgaggggcttccccggagaccgagggctgccagggcccgtcggagccctgggtctgaagggaaacgaaggaccccctgggcctccaggcccggctggaagtcctggggaaagaggtcctgccggagcggccgggccgatcgggattcccggccggccaggcccccagggccctccaggtcccgccggtgaaaagggggcccctggagaaaagggaccgcaggggccagccggaagggacggactgcaaggtcctgtaggtctacccgggccagccggacctgtaggtccgccgggcgaagatggggacaagggcgaaatcggggaacctgggcaaaaaggctccaagggcgacaagggcgagcaaggccctcctggaccaacaggccctcagggccctataggacagcccggaccaagtggcgcagacggagaacccggtcctcgggggcaacagggcctttttgggcagaagggggatgagggccctcggggattccccgggcctcctgggcccgtgggtctgcagggtttaccggggcctccgggtgaaaagggtgaaaccggagatgtgggacaaatgggccccccgggccctccaggtccccgcggtccgtctggggcccctggggcagacggtccccagggacccccgggaggaatcgggaatcctggcgccgtgggcgaaaagggggagcctggagaggccggcgaacccggcctgccaggagagggtggcccacccggcccaaaaggcgagcgcggagagaaaggagagagcgggccgtctggcgcagccggaccccccggccctaaggggcctcccggcgacgatggccccaaaggtagcccagggcctgtgggatttcctggtgacccaggccctccgggtgaaccaggtccagctgggcaagatggaccaccaggcgacaagggggatgacggcgaacccggccagaccgggagtcccggacccacaggagaaccgggaccatcaggccctccaggcaagcgcggaccccctgggcctgccggtcctgagggcaggcagggagagaagggcgccaagggcgaagctgggctcgaaggcccgcccgggaagactggtcccatcgggccccagggagcccccggcaagcctggccctgacggactccgcgggatccccggccccgttggggagcagggacttcccgggtctcctggccccgatggccctcccggaccaatggggccacctggcttgcctggcctaaaaggagattccggccctaaaggcgaaaaggggcacccgggattaatcgggctcatcggccctcctggagagcagggcgagaagggggatcgaggcctcccaggaccccaagggtcatccgggcccaaaggggagcaaggtatcactggcccctccggcccaatcggaccccctggccctcctggtctgcctggtcctccgggacccaaaggtgccaaaggcagttccggcccaaccggacctaagggggaggccgggcatcctggaccacccggacctcccggtcctcccggggaagtaattcagcccttacctattcaagcctcccgaactaggaggaacatcgacgctagccagttactagacgacggaaatggagagaattatgttgactacgctgacggcatggaggaaatcttcggctctctcaacagcttgaagctggagattgagcagatgaaaagaccactgggcacacagcaaaacccagctaggacttgtaaagatttgcagctgtgccaccccgactttccggacggggaatattgggtggatcccaatcaggggtgtagtagggatagcttcaaggtgtattgcaactttacggccggcggcagcacttgcgtctttcccgacaaaaagtcagagggcgcacggattacttcctggccgaaggagaaccctggtagctggttctccgagttcaaacgcggaaagctcctctcgtacgtcgatgccgagggaaatcccgtgggtgtggtgcagatgaccttcctacggctcttatccgcttccgctcaccagaacgttacctaccattgctatcagagtgtggcttggcaggacgccgccacaggttcttatgacaaagctttgaggtttctgggctcaaatgatgaggagatgtcttatgataataacccttatattcgtgccctggtggatggctgcgcaacaaaaaaaggctaccagaagaccgtcttagaaatagacaccccgaaagtggagcaagtgcctatcgtcgatataatgtttaacgacttcggggaagctagtcagaagtttgggttcgaggtcgggcccgcctgcttcatgggttag

SEQ ID NO: 3968 - DNA, 633 bp, Artificial Sequence
  Description of Artificial Sequence: Synthetic coding sequence
tgacggacccggcggaacatcgacgccagccagctgctggacgacggtaacggggaaaattatgtcgattatgccgacggcatggaggagatcttcggcagtttgaattctttgaaactcgaaatcgagcagatgaagcgcccactagggacacagcagaaccccgcacgaacctgtaaagatctgcagctctgtcaccctgacttccctgacggagagtactgggtggatcctaaccaggggtgcagccgagattccttcaaagtatactgcaatttcactgccggaggctccacctgcgtgttccccgacaagaagtctgagggctcaaagatggccaggtggccaaaggagcagcctagcacttggtacagtcagtacaaacggggaagcctgctgtcatatgtagatgccgaaggtaatcctgtgggcgtcgtgcagatgacattcctcagacttctgtctgccagcgctcatcagaatgtcacatatcactgttatcagtcagtcgcgtggcaggacgccgctacgggaagctacgataaggctttgagattcctaggaagcaacgatgaagagatgtcatacgataacaatccctatatccgggcccttgtagatggatgcgcatag

SEQ ID NO: 3969 - DNA, 5238 bp, Artificial Sequence
  Description of Artificial Sequence: Synthetic coding sequence
atgggcaaccggcgggacctgggccagccccgggccggcctgtgcttgctgcttgccgcactccagttgttacccggcacacaagcagacccagttgacgttttaaaagccctgggagtgcaagggggacaggcgggagtcccagaaggtccaggattctgcccccagaggacgccagaaggcgatcgcgcattcagaatcggtcaggccagcaccctggggatcccaacatgggaattgttccctgaggggcacttcccagagaacttttcactgttgatcactttaaggggacagcccgctaatcagagcgtcctgctcagtatctacgatgagcgcggagctaggcagcttggactagcccttggcccagccttaggacttttgggcgacccttttagacccttgcctcagcaggtaaatttaaccgacggcagatggcatcgcgttgccgtttcgatcgatggcgagatggtgaccttggtcgctgactgcgaagcgcaaccacctgttctcggtcacggcccccgctttatttctatcgctggacttactgtgctggggacacaggatctaggtgagaagacattcgaaggcgatattcaggagctgctaatttcacctgaccctcaggccgccttccaggcctgtgaacgctacctccccgactgcgacaacctggcgcccgctgctactgttgccccacaaggagaacctgaaacaccccgcccccgccggaagggcaagggaaagggaagaaagaagggtcgcggccggaaggggaaaggcagaaagaagaataaagagatttggacatccagccctccccctgattctgcagaaaatcagaccagtaccgatatccccaaaacagagacccccgctccaaatctccctcctacccctactccattggttgtcactagcaccgttactacagggctcaacgcaactatcctggagcgctcactcgatcccgactcaggcaccgaactgggaacgcttgagactaaagctgcaagggaggatgaggaaggtgacgattccacaatgggtcccgattttcgggcagcagagtatcccagcaggacccagtttcagatctttcccggggccggagaaaagggtgctaagggcgagcccgccgtaatcgaaaaaggtcagcagttcgaaggcccccctggagccccggggccccagggcgtggtgggaccttctggcccccccggaccacccggcttcccaggggaccccgggccccccggaccagccggtctgccagggattcctgggatcgacggcataagaggccctccaggaactgtgatcatgatgccttttcagtttgccggcgggtcatttaaaggcccccccgtttcatttcagcaggcccaagcccaggccgttttacagcaaactcagctttctatgaagggcccaccagggccagtcgggctgaccggtcgccccgggcccgtcggtctgcccggtcatcccggcctcaagggcgaggaaggggccgagggaccccagggacctcgaggactgcagggtccccacggacctccaggcagagtcggcaagatgggccggcccggtgcagacggcgcgagaggattacctggcgataccggccctaaaggtgatcgggggttcgacggccttcctggactgccgggggaaaaagggcagaggggggactttgggcacgtgggacagcctggaccacccggcgaggacggcgagaggggggccgaagggccacccgggcccacggggcaggccggggagcccggtccaagagggttacttggacctcggggctctccggggccaacgggtagacccggtgtgacaggaatcgacggggccccaggcgccaagggaaacgtgggtccacccggcgaaccagggcccccaggccagcaaggaaaccacggtagccagggcctgcccggtccgcaaggtctgatcggcactcctggcgaaaaaggaccgcctggtaatcccggtatccctggtttgcccggttccgatgggcctctcggacacccggggcatgagggccctaccggggagaaaggcgcccaggggccacctggatctgccggccctccaggttaccccggacctcggggcgtgaaggggacctccggtaatcgcggcctgcaaggagagaagggggaaaaaggagaggacggatttccagggttcaagggcgatgtcggattaaagggcgatcaaggcaagcccggcgcacccggccctcgcggagaggacggccccgaggggcccaaaggtcaggctggccaggcaggagaagagggaccaccgggtagcgctggcgagaagggcaaattaggcgtccctggcctcccggggtaccctggcaggccgggacctaaggggagtattggtttcccagggcccctcggacctattggagaaaagggaaagtcgggtaagactggacagcccggtctcgaaggtgaaagaggaccgccgggctcgagaggagagaggggccagcccggggcgaccgggcagcctggccctaaaggagatgttggacaggacggagcaccaggaatcccaggagagaaaggactgcctgggctccagggcccccctggcttccccggcccaaaagggccgcctggccaccaaggcaaggatggcaggcctggccaccccgggcagagaggggagcttggcttccagggtcagaccgggcctccaggccccgcaggcgtccttggacctcaaggaaagaccggtgaggtgggtcctctaggggagagaggcccccctggtccccccggtccgcccggggaacaaggcctaccaggtctggaaggtcgggagggagcaaagggggagctcggacccccaggccctctgggtaaagagggtccagcaggccttagagggtttcccggacctaaaggcgggcctggggatcctggcccaacgggcctcaagggcgataagggcccacctggaccagtgggggccaacggtagtccaggggagcgcggccctctgggcccagcaggcggaatcggcttacctggacagtcaggctccgaaggcccagtcgggcccgcaggcaagaaagggagcagaggggaacgcggaccacctggcccgacagggaaagacggtattccagggcccctgggaccacttgggccccccggtgcggccggcccatccggagaggagggagacaagggggacgtcggggctccaggacacaagggatccaaaggcgataaaggtgatgccggacctcctgggcagcctggcattcgaggtccggctggacacccaggccccccgggcgccgacggcgcccagggtaggcggggcccgccaggtctgtttggccagaaaggtgatgacggagttcgtgggttcgtcggcgtcattgggccaccaggcttgcagggtcttcccggacctcctggcgagaagggggaggtcggtgatgtcggtagcatgggcccacatggcgctcctggtccacgcggcccgcaaggacctactggaagcgagggtacccccggattgccaggtggagtggggcagcccggcgcagtaggcgaaaaaggggaacgtggcgatgctggagacccaggaccccccggggcccctggaattcctggaccgaagggcgacattggcgagaagggtgattccggccccagcggcgcagccgggccacctggtaaaaaaggtcccccaggggaggacggggctaaaggaagcgtagggccaaccggactcccgggtgatctcggccctcccggggacccaggggtctcaggcatagatggaagccctggagaaaaaggggatccgggagacgtgggcggaccgggtcctccaggcgcatccggagagcccggggcaccaggccctccaggcaagagaggcccaagcggtcatatggggcgcgaagggcgcgagggggagaagggcgccaaaggggagccagggcctgatgggccccctgggagaactgggcccatgggcgcaagagggccgcccggccgcgtgggacctgagggattgagaggcatcccagggccagttggagagcctggactactcggggctcccggccagatggggccccctggccccctgggaccatccggattgccaggcctcaagggagacacaggacccaagggcgaaaaggggcacataggcctgataggactgatcggtcctcccggtgaagccggcgagaagggcgaccagggcctgcctggagtacaaggcccacccggacctaagggcgaccctggtccccccggcccaatcgggtctctcggacatcccggacctcctggtgtcgccggacctctgggacagaaggggagcaagggatcccccggttctatgggaccccgaggagatactggtcctgccggcccaccagggcctccaggggctcccgccgagctgcacggacttcgcaggaggcgccgattcgtccctgtgccactacccgtagttgagggcggactggaggaagtgctggcttccttaaccagcctgtcgctggagctcgagcagcttcgtcgaccccccgggacggctgaaagaccaggtctggtgtgtcacgagctgcatcgaaatcacccacaccttcctgatggagaatactggatagatccaaaccagggctgcgcacgggattcattcagagtgttctgcaatttcaccgctggcggagaaacttgtctctacccagacaagaaattcgaaatcgtgaaactagctagctggtcaaaagagaagcctggtggctggtattccacatttcgacgtggcaagaagttttcttacgtggacgcagatggcagcccagtgaacgtcgtgcagttgaacttccttaaattgctgtctgctaccgcaagacagaattttacctattcctgccaaaacgcggctgcctggttggatgaggccaccggggactactctcactccgcccggttcctgggtactaatggcgaagagctgagctttaatcagactaccgccgccactgtttctgtaccacaggacggatgccgcctaagaaaaggacagacaaagacactgtttgaattctcttctagcagagctgggtttttacctctgtgggatgtcgctgcaaccgacttcggtcagacgaatcagaagtttgggtttgaactcggccccgtgtgtttctcttcatag

SEQ ID NO: 3970 - DNA, 9534 bp, Artificial Sequence
  Description of Artificial Sequence: Synthetic coding sequence
atgcggaagcaccggcacctgcccctggtggccgtgttctgcctgttcctctcgggatttcctaccactcacgcacagcagcagcaggccgatgtgaagaatggcgccgccgccgatatcattttccttgttgattcaagctggaccattggggaggaacacttccaactggtcagggagttcctttacgacgttgtgaagagtctcgcagtaggggagaatgacttccattttgctctcgtgcagttcaatggcaacccccatacagaattcttactgaatacttatcgcacgaagcaggaggtgctgagccatatctccaatatgagttacataggaggcacaaatcagaccggaaaaggattagagtacattatgcagagccacctgaccaaagccgcgggatcccgggcaggagacggcgttccccaggtgatagtagtgttgacagatggacacagcaaggacggcctggctctgccctcagctgaactgaagagtgctgacgtgaacgtgtttgccatcggcgttgaagatgcagacgagggggctctcaaggaaattgccagcgagcctctgaacatgcatatgtttaatcttgaaaactttacctctctccatgatattgtgggcaacctggtatcatgcgtgcactcaagtgtgagccctgagagagccggcgatacggagactctgaaagacatcaccgcccaggattctgcggatatcattttcctgatcgacgggtctaataatacaggatccgtgaactttgcagtcatccttgactttctcgtcaacctcctcgagaagctccccatcggaacccagcagataagggtgggcgtagtgcagttctctgatgagccccgtaccatgttctccctggacacctactctacaaaagcacaggttctgggagccgtgaaagctctaggcttcgccggaggagagctggccaatatcggcctggctctggattttgtcgtggagaatcattttacccgggccggcggatctcgggtggaagagggggtccctcaggtgctggtgcttatcagcgccgggccctcatctgatgaaatccgttatggagtcgtggctctcaagcaggcctctgtgttcagtttcggcctgggtgcacaggctgcttcaagagccgagctgcagcacatcgcaaccgatgacaacctcgtctttaccgtgcccgagttcagatcctttggagatcttcaagaaaaactactcccttatatcgttggagtggcgcagcgacacattgtgctcaagccacccacgatcgtgacccaagtgatcgaggtaaacaagcgcgacatcgtgttcctggtcgacggcagttctgcactgggactggctaactttaacgctatccgagactttatcgccaaagtcatccagcgcctggagatcggccaggatctgatccaggtggccgtggcacagtatgcagataccgttcggcctgagttttactttaacacacatccaaccaagagagaggtcataaccgccgtgcggaaaatgaaaccattggacggctctgctttgtacacaggttctgctctggattttgtgaggaacaacctgtttacaagcagcgcaggctatcgagcagctgagggaatacctaagttacttgtccttatcactgggggcaagtctcttgatgagatttctcagcctgcccaggaactgaagcgatccagtattatggctttcgcaattggcaataagggcgcagatcaggcagagttggaggaaattgccttcgactcctctctggtgttcataccagccgagttcagagctgcacctctgcagggaatgctgcccgggctgctcgctcccttgcggaccctgtcaggtacccctgaagtgcacagcaataagcgtgatattattttcctgctggatgggagtgcaaatgttgggaagacgaacttcccttacgtgcgcgattttgtgatgaatctggtcaacagtttagacatcggtaatgataatattcgcgtggggctcgtgcagttttcagacactcctgtgacagagttctcactgaatacataccaaacgaaaagtgacatcctgggacacctgcgtcagttgcaactgcaaggaggatcagggttaaacacagggtctgccctgtcgtatgtctacgcaaaccacttcacagaagctggcggaagcagaataagagaacatgtgccacagctgttgctgctcctcacagccggtcagtcagaagacagctatctgcaggccgctaacgccctcacaagagctggtatcctaactttttgtgttggcgcctctcaggccaataaagctgaactggagcagatcgctttcaatccctcactcgtttatttgatggatgattttagcagtctgccggccctgcctcagcagttaattcaaccactgacaacatacgtgagtggcggagtggaggaagtcccactcgcccagcctgagagcaaaagggatatactatttctctttgatggatcagccaacttagttggccagtttcccgttgtccgggacttcctatacaaaatcattgatgaactaaacgttaaacctgaaggaactaggattgccgtggctcagtacagcgatgatgtcaaggtggagagtcggttcgacgagcatcagagcaaaccggaaatcttaaacctggtaaagcggatgaagatcaaaactggcaaagccctcaatctcggatacgcattggactacgcacaacgttatatatttgttaagagcgctgggtctaggatcgaagacggggttcttcaattcctggtgctattggttgccggcagatcatccgacagggttgacggacccgccagcaatcttaagcagtccggtgtggtaccttttatcttccaggcaaagaatgctgatccagcggagctggaacaaattgttttgtcacctgccttcatacttgccgcggaatctttaccaaagatcggcgatctccatccccagattgtaaatctactgaagtcggtgcataacggggctccagctccagtgtcgggcgagaaggatgttgtgtttctccttgacggatcagaaggagtgcgctccggcttcccactgctaaaggagtttgtgcaacgagtcgtggaatctctggacgtgggacaagacagggttagagttgccgtagtacaatactctgaccgtacccgacccgaattctacctcaatagttacatgaataaacaggacgtggtgaacgccgtccggcagcttactcttctgggggggccaacccctaacacaggcgccgccttggagtttgtgctgcggaacatactggtttcgagcgctggcagccgcatcacagagggagtgccccagcttttgatcgttctgacagctgaccggtccggcgatgatgttaggaacccaagcgttgtagtaaagcgaggcggcgccgttcccataggcattggcataggcaacgctgacattaccgaaatgcagaccataagctttattccggactttgcggtggccatcccaactttccggcaacttggtactgtgcaacaggtaatctctgaacgggtgactcagctcaccagagaagagctcagtcgtctgcagccagttcttcagccattaccatcaccaggggtgggcgggaaacgggatgttgtgttcctcattgacggatcacagtcggcaggtcctgagtttcaatacgtgagaacgctcatcgagcggttggtggactacctggacgtcgggtttgatacaacacgagttgcggttattcaattctctgatgatcccaaggtggagtttctacttaatgcccactctagcaaagacgaggtgcaaaatgccgtccagcggctcagacccaagggaggacggcaaattaacgtgggtaatgccttggagtatgtatctcgcaacattttcaagcgccctctaggttcccgaatagaagaaggcgtaccacagtttttggttcttatttcgtctgggaagtctgacgatgaggtcgatgaccccgcagtggaattgaaacagtttggtgtggccccattcaccattgcccgcaatgccgatcaggaggagctcgttaagatatctctgtcacccgagtatgtgttcagcgtgagtacatttagagagttgcccagtctcgagcaaaagctgttgacccctatcaccacgctgacttccgagcagatccagaaactgctggcttcaaccaggtatccacctcccgccgtggagtctgacgccgccgatatcgtgttcctgatcgatagctctgaaggagttagacccgatggttttgcacatataagagacttcgttagccgaatcgtacgccggcttaatatcggtccttctaaagtgagagtaggggtggtgcaattttctaatgatgtgttccctgagttttacctcaaaacgtaccgctcccaggcacctgtgctcgacgcaattcgtcgactgcgtctaagagggggaagccctcttaataccgggaaggccctcgagtttgtcgctagaaatctctttgtgaaatcagcaggtagccgcattgaagatggggtcccgcagcaccttgtcctggtacttggcggcaaaagccaagatgacgttagcaggtttgcacaggtgataaggtcaagcggcattgtctctttaggcgtgggcgacagaaatatagatcgcacagagctgcaaaccattacaaacgatcctagactggtgtttacggtgagagagttccgagagttacccaatatcgaagagagaataatgaactcatttggacctagtgctgctacacctgcgccacctggcgtagacacccctccgccatcaagacctgaaaagaagaaggctgacatcgtgtttctcttggatgggtcgattaacttccgtcgtgactcctttcaggaggtactccggttcgttagtgaaatcgtcgatacagtgtatgaagatggcgactccatccaggtgggcctcgtgcagtacaactccgacccaacagacgaattcttcctgaaggattttagcacaaagcgacagataattgacgctatcaataaagtggtgtataagggaggaaggcacgcaaacaccaaagtcggtctggaacatctgagggttaaccactttgtgccagaggcgggttcacgtctggatcagagagtgccacagattgcctttgtcattaccgggggtaaatccgtggaggacgcccaggacgtgagtctagctctcactcaaaggggtgtgaaagtgttcgctgtcggggttagaaacatcgacagtgaggaggtggggaaaatagcctcaaactcagccactgcatttcgcgtcgggaacgtgcaggaattaagtgagctcagtgagcaggtcctggagaccctgcatgatgccatgcacgaaactttatgccccggagtaactgatgctgccaaagcctgtaatcttgacgtgattctcgggttcgacgggtccagagatcaaaacgtttttgtggcacagaaaggatttgaatccaaagtcgatgcaattcttaaccggattagtcagatgcaccgggttagctgttcagggggccgatcccccaccgtgagagtcagtgtagttgccaatacccctagcggtcccgtcgaggcattcgatttcgatgaatatcaaccagaaatgttggagaagtttcggaacatgaggagtcagcacccctatgtcctaaccgaggacactcttaaggtctaccttaacaagtttcggcagtcctctcccgacagcgtcaaggtggtgatccatttcactgacggagcggacggggacctggctgatcttcatcgagctagcgaaaatctccggcaagaaggagtacgggctttaatcttagtgggcctggagcgagtagttaaccttgaaagactgatgcatctagaattcggacgggggttcatgtacgacagacctctccgcctgaacttgttggatctggattatgaactcgctgaacagctcgataatatagcagagaaggcttgttgtggcgttccttgtaagtgctcgggccagcggggagacaggggtccaatcggaagcatcggcccaaagggaattccaggggaagatggatatagaggctatcccggcgatgagggaggtcctggagaacgagggcctcctggtgtgaatggcacgcaaggattccagggatgtcccggacagcggggggtaaaaggatcccgcggttttccaggcgaaaagggagaagttggagaaatcggcctcgacggtctggatggggaggatggggataagggattgccaggtagttctggcgagaaaggaaatcctggccgacggggagacaaagggccacgcggtgagaaaggagagagaggggatgtgggcattcgtggcgacccggggaatccaggacaggacagtcaagaaaggggccctaagggggagactggtgatctgggcccaatgggtgtgccaggaagggatggggtgcctggagggcctggagaaacgggaaagaatggtgggttcgggaggcgaggccctcccggggccaagggtaataagggtgggcctggacagcctgggtttgagggagagcagggcacccgcggggcgcagggacccgcaggaccagcaggacccccagggttaattggcgagcagggtatttcaggccctaggggtagtggcggggctgccggcgccccaggagagagaggacggacagggcctttaggccgtaagggtgagcccggtgaacccggacccaagggtggcattggtaaccgagggccgcggggcgagaccggtgacgacggaagagacggcgttggaagcgagggtcgcagagggaagaagggcgaacggggctttccagggtaccctggccccaaaggaaatcccggtgaacccggactgaacggaactaccgggcccaaagggattcggggacggcgtggtaacagcgggccacctggtattgtcggccaaaaaggcgaccctgggtatcccggcccagccgggcccaaggggaatcgcggtgactccatcgaccagtgcgcgttgattcagtctatcaaggataaatgtccctgctgctacgggccccttgaatgtcccgtatttccgacggaactggctttcgctctggataccagcgagggagtgaaccaagatacctttggaaggatgcgggacgtggtactatcaatcgtaaatgacctgactattgcagagagcaactgtcccagaggtgcaagagtcgcagtggtcacatataacaatgaagtgaccacagaaatcagattcgccgattcaaagcggaagtctgtccttctagacaaaattaaaaacttacaggtggcactgacatccaagcagcagtctctggagacggctatgtcatttgtcgcccgtaacaccttcaaacgtgtgagaaatgggtttctcatgaggaaagtggccgtctttttctccaacacgcctactcgtgcctccccgcagctccgggaagccgttctcaaactgagcgatgccggaatcacaccactgttcttaacaaggcaagaggaccgccagcttattaacgcgctccagattaacaatactgctgtcgggcacgccttagtgctgccagctggccgggatctgaccgatttcctggaaaacgttctgacctgccatgtttgcctggatatctgtaatatcgatcctagctgtggtttcgggagctggcgtccaagtttccgagacaggcgggcagctgggagtgacgtcgatattgatatggcctttatcttggactctgccgaaactaccacactcttccagttcaacgaaatgaaaaagtacattgcctatcttgtccggcagctggacatgagccccgaccctaaagcctcacagcacttcgcaagggtggcggtcgtccagcatgcaccaagtgaatccgtcgataacgcctcgatgccacccgtcaaagttgaattttccttgacagactatgggagtaaggagaagctggttgactttctgtctcgaggaatgacacaactacaaggaacgcgagcgcttggatcagctatagaatatactattgaaaatgtcttcgagtcagctccaaatccccgcgaccttaaaattgtggtgcttatgctgacaggcgaggtcccagaacagcagctggaagaggctcagcgggttatcctgcaggccaagtgcaaagggtactttttcgtggtcctgggtattggtagaaaggtgaatatcaaggaagtctatacgttcgcctcagagcctaatgacgttttcttcaagttggtggataagagcaccgagctgaacgaggagcctctcatgaggtttggccgtctgctgccaagcttcgtgagctccgagaacgcattctacctgtctccagacattcggaagcagtgtgattggtttcaaggcgatcaacctacaaagaatctggttaaattcggccacaaacaggtgaacgtcccaaataacgttacctcgagtccaaccagcaacccagttacaaccaccaagccagtgaccaccaccaagcccgtgaccacaacaactaagccggtgactacaacgactaagcctgtcactataataaatcagccctccgttaaacccgcggccgctaaacccgccccagcaaaaccagtagctgctaaacccgttgcgactaaaatggccaccgtaagaccaccagtcgctgtgaagccggcaacagccgctaagcccgtcgctgccaagcctgctgcagttagaccccccgcagccgccgctgccaagcctgtggctacaaaacccgaggttcctcgcccgcaagccgcaaagccggcagccacaaaaccagccacgacaaagcccatggttaaaatgtcgagggaagtgcaggtgtttgaaatcactgagaattcagccaagctccactgggagagagctgaacctccgggcccctatttctacgaccttaccgtcacctctgctcacgaccagagcttagttctcaagcagaaccttaccgtgaccgatagagttataggcggacttctcgccgggcagacctaccatgtggctgtggtgtgttatctgcggagccaagtgcgcgcaacgtaccacggcagcttcagtacgaaaaaaagccaaccacctccaccccagccggcaagaagtgctagctcctccactatcaacttaatggtgtcaaccgaacctctggcactgacggagactgacatctgtaaattgccgaaagatgagggaacgtgccgagactttatcctgaagtggtactacgatccgaacacgaaatcttgcgccaggttttggtatggtggctgcggtgggaacgaaaacaaatttggatctcagaaggaatgcgaaaaggtgtgcgctccagtgctcgcaaagcccggtgtgataagtgtgatgggaacctag

SEQ ID NO: 3971 - DNA, 8934 bp, Artificial Sequence
  Description of Artificial Sequence: Synthetic coding sequence
atgcggaagcaccggcacctgcccctggtggccgtgttctgcctgtttctgtctgggttccctacgacacacgctcagcaacagcaggccgacgtgaaaaacggggccgctgccgatattatcttcctcgtggattcgagttggacaatcggggaagaacacttccagttggtgcgcgagtttctgtatgacgtagtcaagtctctggctgtgggcgagaacgacttccacttcgcactggtccagtttaacggaaatccccacacagaatttctcctgaatacctatagaactaaacaggaggtactgtcacacatctcaaacatgtcttatatcgggggtaccaatcagacagggaagggcttggagtacattatgcagagtcacctgacaaaggccgccggatcaagggcaggggacggagtgccccaggtaatcgtggtactcacagacggccatagtaaagacggcctggctcttccatccgctgagctgaagtccgccgacgtcaacgttttcgcgataggggtggaagacgccgacgagggcgccctaaaggaaattgccagcgaacccttaaatatgcacatgtttaacttagaaaacttcacgtcacttcatgacatcgtggggaatttagtatcatgcgtgcactccagcgtaagccccgaacgggccggagatacagaaactcttaaggatataaccgcccaggacagcgcagatataatttttcttattgacggatcaaacaatactggtagtgtgaacttcgccgttattctggactttctcgtgaaccttttggaaaaattgcctatcggtacccagcagataagggttggggtggttcagtttagtgacgaaccaaggactatgttctctctggacacttattccaccaaggcgcaggtccttggcgccgtaaaggcgctcggttttgctggaggggagctggctaacatcggactggctcttgacttcgtagtggagaatcacttcaccagggcaggcgggtccagggtggaggaaggagtgccccaggttcttgtgctgatcagtgcagggccttcctctgatgagataagatacggagtggtcgctcttaaacaggcctcggtgttttccttcggattaggggcccaggctgccagtagagccgagctccagcacatcgctaccgatgacaatttggtatttactgtgcccgaatttcgtagttttggggaccttcaggaaaaacttctgccctacattgtgggtgtggcacaaagacacatcgtcctgaagccgcccacgatcgtgacccaagttatcgaggtgaacaagcgggacattgtcttcctcgtcgatggctcatctgccttggggctagctaattttaatgccattagggatttcatcgcgaaagttatacagcgcctcgaaattggacaagatctaatccaggtcgctgtcgcccagtacgccgatactgtaagacccgagttctactttaacacacaccccaccaagcgcgaagtgataactgccgttcgtaaaatgaagcctcttgacgggagcgccttatacactggcagcgccctggattttgtccgcaacaacttatttacgtccagcgctgggtatcgagcggccgaggggatacctaaactcctggttctcattacgggcggtaagtctctagatgagatttcccaacctgctcaggagcttaaacgatccagtattatggccttcgccattggaaataagggggctgaccaggccgagctcgaggagattgcattcgatagctctctggtgtttatcccagctgagtttagagccgccccactccaaggaatgctgccaggcctgttggctccgctgcgcaccctgtctggcacgccagaagagagcaaacgcgacatcctgtttctgttcgatgggagtgccaacctggtcggacagtttcctgtggtaagggattttctgtataagatcatcgacgagctcaacgtcaagcccgagggcacaagaatcgccgttgctcagtacagcgatgatgtgaaggtagagtcacgtttcgatgagcaccagagcaaaccagagatcttgaacctagtcaaacgaatgaaaattaagaccggcaaggctttgaatttaggatatgctctggactacgctcagagatacatcttcgtcaagtctgccggtagtcgcatcgaggatggggtgcttcaatttttggtgctgttggtggccggccgtagctctgatcgggtggatgggccagccagcaacttgaagcagagtggggtggtgccttttattttccaggccaagaacgcggaccccgctgaactggaacaaattgtgctgtcacccgcttttatcttggccgcggaaagccttcctaagatcggcgacctgcaccctcaaattgtgaatctcttgaagagtgttcataatggggccccagcaccggtcagcggcgaaaaagacgttgttttcctgctggatggatcagagggcgttaggagcggatttccactcctcaaggagtttgtacagcgagtggttgaaagcctcgacgtcggccaggatcgggtccgggtcgccgtcgtgcagtactcggaccgcacccggcctgagttctacctcaattcgtatatgaataagcaggacgttgtgaacgcagtcagacaactgacacttctcggggggccaacgcctaacacaggcgccgccctcgaatttgtccttaggaacatcctggtgagctccgctggcagccgtatcaccgagggggtgccacagctgctgattgtgctgacggccgatcgatcaggggacgatgtccgcaatccttccgttgtggtgaaaagagggggagcagtacctatcggaatcgggatcggaaatgcagacatcacggagatgcagacaatctctttcataccagattttgccgtggcgatacccacatttaggcagctgggcactgtacagcaggtgatctctgagagggttacacagctcacccgtgaagaactgagtcgcttgcagccggtgctgcagcccttaccatcaccgggtgtaggggggaagcgggacgtggtttttctgatcgatggaagtcagagcgctggaccggaatttcagtacgttcgcacactcatcgagagactggtggactaccttgatgtgggcttcgacactactagagtggcggttattcagtttagtgacgatcctaaagtagagttcctgctgaatgcccactcaagtaaagatgaggtgcagaacgccgtccagcgactgcgccctaagggtggacgccagatcaatgtgggaaatgcccttgagtatgtttctcgcaacatctttaagagacctctcgggtcaaggattgaagagggcgtgccacagttcttggtgctgataagttctggcaagagtgatgacgaggtggacgatcctgccgtcgaactgaaacaattcggcgtagcacctttcacaattgcaaggaacgccgatcaggaagaactggttaagatatccctgagcccagaatacgtgttttccgtgtccacatttagagagttaccatccttagagcagaagcttctaaccccaatcacgacactcacaagcgagcagatacagaagctgttagcgtcaacgaggtatccccctcccgccgtggaaagcgatgcagccgacatagtttttctcatcgattcgagtgaaggcgttcggcctgacggttttgcccatatccgggattttgtatctaggatcgtacgcaggctcaatattggccctagcaaggtgagagtaggcgtggtgcagttttcaaatgacgttttccctgagttctatctgaagacataccgctcccaggcaccagtgctggatgcaatacgtcggttgcgactccgtggagggtctcccctgaataccgggaaagctctagaatttgttgcaagaaacctatttgtaaaatccgccggatccagaattgaggacggggtgccacaacatttagtgctggtgttaggcggtaagtcgcaagacgacgtgagcagatttgcccaagtcatccgaagctcagggatcgtgtccctgggggtcggcgaccgaaatattgacaggacagagcttcagactataacaaatgaccctcggctcgtgtttaccgtgcgagagtttcgggagctgccaaacattgaagagcgtattatgaattcattcgggcccagcgcagccacgcctgcacccccgggtgtggacactccccctccatccaggccagaaaagaaaaaggccgacatcgtgttcttactcgatggctctattaattttcggcgagactcctttcaagaagttttgcgatttgtctctgagattgtcgatactgtgtacgaggatggagacagcattcaggtcgggctggttcagtacaacagcgatcccaccgacgaattttttctgaaagatttttccacaaagcgacagatcatcgacgctattaacaaagtggtgtacaaaggtgggcgacacgctaatacaaaggtgggcctcgaacacttaagggtgaatcactttgtcccagaagcgggttctcgactggaccagcgcgtgccgcaaatcgcctttgtgatcacgggcggaaagagcgttgaggacgcccaggacgtgtccctggctctcacgcagcggggcgtaaaagtctttgccgtcggggtaagaaacattgacagtgaggaggtaggaaagatagccagtaattccgcaactgcgtttcgagttgggaatgtgcaagagctgagtgaactgtctgagcaggttctcgaaacactgcacgacgcgatgcatgagacactgtgtccaggggtaactgacgcggcgaaagcctgcaacttggatgtgatactgggattcgacgggtcccgggaccaaaatgtgtttgtggctcagaagggctttgagagcaaggttgacgctattctcaaccgcattagccagatgcatagagtgagctgttctgggggccgcagccctactgtgagagtatcagtggtggctaacactccttctggacccgtggaggcattcgatttcgatgaataccagccagagatgctcgaaaagttccgcaacatgaggtcgcaacacccatacgtgttgactgaagacaccctcaaagtgtacctgaataagtttagacagtcctcgccagattcagtaaaagtagtgattcatttcaccgacggggcagatggggatttagcggatctgcacagagcctcagaaaacctgcgtcaggagggcgttcgcgccctgatcctcgtaggccttgagcgcgtggtgaatctggagaggctaatgcacttggagtttggccgcggtttcatgtatgatcgccctcttcggcttaacctcctggaccttgattacgagctggctgagcagctcgacaacattgctgagaaagcttgttgtggggttccatgcaaatgcagcggacagcgtggcgacaggggacctataggctcgatcggtccaaaagggatccctggcgaggacggctaccgggggtatcctggggatgagggcgggcctggcgagcggggacccccaggggtgaacggtactcagggatttcaaggatgcccaggccaaaggggggttaaaggatccagaggttttccaggggagaaaggcgaggtaggagaaataggcctggatggtctggatggcgaagacggcgacaagggtctgccgggatcctctggcgagaaagggaaccctggacgtcgaggggataaaggacctaggggagaaaagggtgaacggggtgatgtgggcataagaggtgacccaggtaaccccggacaggacagtcaagaaagagggccaaagggtgagaccggtgatctcggaccaatgggcgtgccaggaagagacggggtcccgggcggccccggcgagacaggcaagaatggcggtttcggccgacgaggtccacccggagcgaaaggcaataaaggcggtcccggccagcctggatttgagggtgaacagggtacccgaggagctcaagggccagctgggccggccggtccccctgggcttatcggagagcaagggattagcggcccaaggggatccggaggagcagcaggagcccccggcgaacgcggaaggactgggcccttggggcggaagggcgagcccggcgagcccggccccaagggaggaatcggaaatcgaggccctcgcggggagaccggagacgacggaagagatggggttggctctgagggcaggcggggcaaaaagggtgaacgagggtttccagggtaccccgggcccaaagggaacccgggcgaacctggtctgaacggcaccaccggcccaaaggggattcgggggagaagggggaattccggaccacctggaattgtcggacaaaagggggacccaggttaccctgggcccgctggacccaagggcaacagaggagactccatcgaccagtgcgccctcatccaatccatcaaggataagtgtccttgttgttacggacccctggaatgtcccgtctttcccaccgaattggcatttgccctggataccagtgaaggagttaatcaagacacattcggacgcatgcgagatgtcgtcctttcaatcgtgaacgatcttaccattgcagagtccaattgtcctcgcggagcccgggtggccgtcgtgacctacaataacgaggtgacaaccgagattagattcgcggattcaaagagaaagagcgtcttgctggataaaataaaaaatctgcaggtcgccctgacctcgaagcagcagtcccttgagacagctatgtcatttgtggctcgcaacactttcaaaagggttaggaacggattccttatgcgcaaggttgccgtcttcttctcaaacaccccaaccagagcatccccccagttaagagaggctgtgcttaaattgtcagatgctggcattacgccactcttcttgacacgccaggaagatcggcagctcataaacgccctacagatcaacaatactgccgtgggacacgccttagtgttgcctgcgggccgagatctgactgattttctcgaaaacgtgctgacgtgtcacgtgtgtctggacatatgtaacatagatccaagctgcggatttggtagctggaggccctcttttcgggaccgcagggcggctggcagtgatgtagatatcgacatggcgtttattctcgacagcgcagagaccaccaccctatttcagttcaacgagatgaaaaagtatattgcctacctggttcgccaactggacatgagccccgaccctaaggcatcgcagcatttcgcccgggtcgccgtcgttcagcacgctccctcagaatctgttgataacgcttccatgccccctgtcaaggtggagttttccctcactgactacgggtcaaaggaaaagttagttgattttctaagtcgagggatgacccagctccagggaactagggctctaggttcggctattgaatacaccattgagaacgtgtttgagagcgcaccaaatccccgagatctgaaaatcgtcgtgttgatgctgacgggggaggtgcccgaacagcagctggaggaggcccagagggtcattctgcaggcaaaatgcaaaggctactttttcgtggtgctgggaatcgggagaaaagtgaatataaaagaggtatataccttcgctagtgaaccaaatgacgtgttttttaagttggttgacaagagcaccgaactgaatgaggagccgctgatgcgattcggaaggctgttaccatcatttgttagctctgagaacgccttttatctcagcccagatattcgcaagcaatgcgattggtttcagggcgatcagccgacaaagaacctggtaaagttcgggcacaaacaggtgaacgttcccaacaatgtgaccagcagccccacctcgaacccggttactacaaccaagcccgttaccaccacaaaacccgttaccaccactacaaaacctgtgaccaccactactaagcctgtgaccatcatcaaccagccttctgtcaagcctgctgccgccaaaccagcacctgccaaacccgttgctgccaagccggtggctactaagatggctactgtgaggccccccgtcgctgtgaagccagccacagccgccaaacctgtagctgccaagcccgcggccgtgcggcctcctgccgctgccgccgctaagcctgtcgcaactaaacctgaagtgcctcggccacaggccgccaagcctgcggcaactaagccagcaacgaccaaacccatggttaagatgtctcgagaagtgcaggtcttcgaaatcactgagaattctgcaaaattacactgggaacgcgctgaaccacctggcccctacttttatgacctgactgttacatccgctcacgaccagagcttagtcctgaaacaaaacctgactgtgacagaccgcgttattggcggtcttctggccggccagacatatcatgtcgcagtcgtgtgttacctcaggtctcaggtgcgggctacttaccacggttccttttcaaccaaaaaaagccagcctccacctccccagcctgcccgttccgcctcgtcctcaaccatcaacctcatggtttccactgaaccactggctctcaccgagacagatatctgtaagctacccaaagatgagggaacgtgtagggactttatcctgaagtggtactacgaccccaacacaaaatcgtgtgcccgattctggtatgggggctgtggagggaacgagaacaagttcggcagccagaaagagtgcgaaaaagtgtgcgcccctgtgctcgcaaagccaggggtcatctcagttatggggacctag

SEQ ID NO: 3972 - DNA, 8931 bp, Artificial Sequence
  Description of Artificial Sequence: Synthetic coding sequence
atgcggaagcaccggcacctgcccctggtggccgtgttctgcctgtttctgagcggcttccctactactcatgcccagcagcagcaggcagacgtgaaaaacggcgcggcagcggatatcatctttctggtcgattcatcctggaccatcggcgaggaacacttccaattagtgcgggagtttctttatgatgtcgtgaaatctctggcggtgggcgagaacgacttccactttgcattggtgcaattcaatgggaatccccacacagaattcctgttaaatacctatcggacaaagcaggaggtcctttctcacatatccaatatgagctacatcggcggcacaaatcagacaggcaaggggctcgagtatataatgcagagccacttaacaaaggcagcaggatcccgggctggagacggcgtacctcaggtaatcgtcgtccttacagatggccatagtaaggatggtttggctttaccatctgcagaactcaagtctgccgacgtcaacgtcttcgcgattggggtcgaggatgccgatgaaggagcattgaaagaaatcgccagcgaaccactcaatatgcatatgtttaacttggagaactttacttcattgcacgatatcgtgggaaacctcgtgagttgtgtccactcaagcgtttctccagaacgagccggggacacagaaaccctgaaagacattacagttatcgaggtgaataagagggatattgtattccttgtcgatggcagctctgctttaggacttgctaatttcaatgccatccgggacttcatcgcgaaggtcattcagagattggaaataggccaggacttaattcaggtagcagtggcacagtacgccgatactgtcaggcccgagttctatttcaatacacaccccaccaaaagagaggtcatcactgctgtgagaaaaatgaagcccctggacggatccgccctatacacggggtccgcattggacttcgtccggaacaaccttttcacctctagcgcaggatacagagcagccgaagggatacccaagctcttagtcctaataacaggcgggaagagtctcgatgaaatctcccagcctgctcaggaactgaaacgcagttccattatggccttcgcgatcggaaacaagggcgctgatcaagctgaactggaggaaattgctttcgattccagcctggtctttattccagccgaatttcgggccgctccacttcaggggatgctgccaggtctgttggcgcctctgcgcactctgtccgggaccccagaagtgcatagtaataagagagatatcatttttttgttggatggctctgcaaacgtgggcaaaactaattttccctacgtgagggactttgtaatgaatttagtaaattccctggatataggcaatgacaatattcgagtgggtttagttcagtttagcgatactcccgtgactgaatttagtctgaacacctaccagaccaagtctgatatcctaggacacttacggcaattgcaactgcaaggaggaagtggcttgaacaccggctctgcgctgagctatgtttacgctaaccattttaccgaggctggagggagtcgaatcagggagcatgtgccacagctgcttttactgctgactgccggccaatctgaggacagttatctacaggcggctaatgccctcaccagagccgggattctcactttctgtgtgggagcctcccaggccaataaggctgagctcgaacagatcgcctttaatccatctcttgtctatctgatggacgacttctcatcactccctgccttgccacagcagctgattcagcctcttacaacgtacgtgtcgggcggagtggaggaggttcccctggcccaaccggaatccaaacgggatattctcttcctgtttgacggctccgcaaatttagtcggccagtttcctgtggtgagagattttttgtacaagatcattgatgaactcaatgtgaagccagaaggcactcggatcgccgtcgctcaatacagtgatgatgtgaaggtggaatctaggttcgatgaacaccagagtaaacctgaaatcctgaatctcgtaaagcgtatgaagataaagaccggaaaggcacttaatctcggctacgcattggactatgcccagagatacatttttgttaagtccgccggctctagaatcgaggacggagtactgcagttcctggttctgcttgtcgctggaagatccagcgatcgagtggacggaccagcgtccaatcttaagcagtcaggagtcgtgccattcatcttccaggccaagaacgccgacccagccgagctggagcagatcgtcctcagccccgctttcatactcgctgcagaaagtctgccaaagattggagacttacatccccagatcgtgaatttgctgaagtcagtgcataatggcgcacccgctcccgtgagcggggaaaaagacgtggtgttcttactggacggcagtgagggcgtcaggtccggctttccgctgctgaaagaatttgtccagcgcgtggttgaaagcctcgacgtgggccaggaccgtgtacgcgttgctgttgtccagtacagcgaccggacgaggcctgaattttatcttaactcatacatgaacaagcaagatgtcgtgaacgctgtgcgtcagttgactctgctagggggaccaacgccaaataccggcgccgcgctcgaattcgtgctgcgcaacatcctggtgagttctgctggtagcaggatcacggagggcgtccctcagctattgatcgtgttgacagcagatagaagcggagatgatgttagaaatccctcagtggttgtcaaacgcgggggtgcggtccctatcggtatcgggatcggcaacgcagacatcactgagatgcagaccattagtttcatccctgatttcgcagttgcgattccgacttttagacagttgggaaccgtgcagcaggtcatctctgaaagagtgactcagctgacacgggaggaactcagcaggctgcagccagtgttgcaaccgctgccctcacctggcgtgggcggcaagagggacgttgtgtttctgatcgatggctcccagtccgccggacctgagttccagtatgttaggaccttgatcgagaggctggtggattatcttgatgttggtttcgacacaactagagtggccgtcattcagttctccgacgaccctaaggtcgagttcttgctgaatgcccacagctctaaggacgaggtgcaaaacgccgtgcagagactgagacctaagggtgggcgccagatcaacgtgggcaacgcccttgagtacgtgtcacgaaatattttcaagcgtccactggggtcaaggattgaagaaggtgttcctcaattcctggtacttatcagttcgggtaaatccgacgacgaagtggatgaccccgccgtggagttgaaacagttcggggtggccccatttacaatcgcacgaaatgctgaccaagaggaactggtgaagatctcgctgtcccccgagtacgtgttctcagtgagcacattccgagaactgccatccctggaacagaagctgctcacaccgattaccactctcacgtctgagcagatccaaaaactgctggcttccacaagatatcctccgcccgccgtggaaagcgacgccgctgatattgtctttctgattgattcgtcagaaggcgtccgtcccgatggctttgcccacatccgtgatttcgtgtcccgtatcgtgcgcagactgaatatcggtcctagcaaagtgcgggtgggcgtggtccagtttagcaacgacgtcttcccggagttctatttaaagacgtaccggtctcaggcgccagtgctcgacgccatccggagactgaggctgcgtgggggctctcctctgaataccggtaaggctctagagttcgttgccagaaatctcttcgtaaaatcagcaggaagcaggatcgaagacggggttccccagcatctagtcctggtgctgggaggtaagagtcaggacgatgtgagccggtttgcgcaagtgataagatcttccggtattgtatcattgggcgtgggggatagaaacatcgacagaaccgaactccagaccatcaccaacgatccaaggctggtgtttaccgtgcgagaatttagagagttacccaacattgaagaacgtattatgaactcctttggcccttcagctgccaccccggcgcctccaggcgtcgacacccccccgccttctcggcccgagaaaaaaaaagcggatatcgtctttctcctggatgggagcattaattttcgtagggatagtttccaggaggtcctgaggtttgtcagtgaaattgttgacacagtgtatgaagacggcgattctattcaagtgggcctggtgcagtacaacagcgatccaacagatgaattcttcctcaaggactttagcaccaagaggcagattattgatgcaatcaacaaggtggtctataagggagggcgacacgcgaatacaaaggtaggactggagcatttgcgagtcaaccactttgtgcccgaggccgggagccggttagaccagagagttccccaaattgcatttgtcattactggtggcaaatccgtcgaggacgcgcaggacgtgtccctggcgcttacgcagcgaggcgtaaaggtttttgccgtcggggttcgaaatattgatagcgaggaagttgggaagatcgcgagcaactccgctaccgccttccgggtgggaaatgttcaggagctgtctgagctctctgagcaggtcctggagactctgcatgatgccatgcacgagacactttgcccaggcgtgacagatgcggctaaggcctgcaatttggatgtgatcttaggtttcgacggatcaagagaccagaacgtgttcgtggcccagaaaggcttcgagagcaaggtggatgctatcttgaatcggattagccagatgcatcgcgtctcctgctcaggcgggagaagtcctactgtcagagtatccgtcgtggccaacactccgagcggacccgttgaggcctttgatttcgacgaataccaacctgaaatgctagagaagttcagaaacatgagaagccagcacccttacgttctgacagaagatacccttaaagtgtatttgaataaatttaggcagagctctcccgactcagttaaggtggttattcatttcaccgacggagcagatggagatttggcagacttgcacagagccagcgagaacctgcggcaggaaggagtccgcgctctaatccttgtgggactagaacgggtggtcaatctcgagaggttgatgcacttagagttcgggaggggctttatgtacgaccgaccactgaggctgaatctacttgacctggactacgaactcgctgagcagctggacaatatagccgaaaaagcatgttgcggcgtgccctgtaagtgcagcggacagaggggcgacaggggccctatcgggtcaattgggcccaaaggcatccctggagaagatgggtatcgcgggtatcccggtgacgaaggaggaccaggcgagcggggtcctccaggtgtgaatggcacacaaggcttccagggctgtcccggccaaaggggcgtaaagggctctaggggcttccctggtgagaaaggagaagtcggtgagataggacttgatggcctcgatggcgaggatggagataagggactccccggctcctctggggagaaaggcaatcctggccgacgcggggataaggggcccagaggcgagaaaggggagaggggcgacgtggggatcagaggcgatccagggaacccggggcaggatagccaagagcgggggcccaagggcgagaccggagacctcggaccaatgggggttcctggtcgagatggggttccaggcgggcccggcgaaacaggtaagaacggaggctttggaaggaggggaccaccgggagcgaaaggcaacaagggcggcccaggacaacctggcttcgaaggggaacagggcacacgcggcgcacaagggcccgcaggccctgcagggcctcctgggctcattggagagcagggaatatccggccctagaggttcagggggcgccgccggagccccaggggaaaggggccgaactggccccttgggccggaagggcgaacctggggagcccggcccaaaagggggaattggcaatcgcgggccacgtggcgagacaggcgatgacggtcgcgacggtgtagggagtgaaggtcggcgaggcaaaaagggagaacgaggcttccccggctaccccggtcctaagggaaatcccggcgagcccggcctgaacggtacaaccggacctaaggggatcaggggacgccgggggaattcgggaccacctggcatcgtcggacagaaaggcgatcccgggtatcccggacccgcgggtcctaagggcaataggggggactccatcgaccagtgtgcacttattcaaagtatcaaggacaagtgcccttgttgttacggccctcttgagtgtccggtattccctactgagttagcctttgccctggatacaagtgagggcgtcaaccaagatacattcggtcgtatgcgagacgtggtcctgagcatcgtgaacgatctgactatcgccgagtcaaactgccctagaggtgcccgtgtggccgtcgtcacttataacaacgaagttaccactgaaatcagatttgccgacagtaagcggaagtcagtgctgcttgacaaaattaaaaacttacaagtggctctcacatccaaacaacagagtctggaaaccgcgatgtccttcgtggcacggaatacttttaaacgggtccgcaacggcttcctgatgcgaaaggttgctgtatttttttctaacacaccgacacgggccagtcctcaactgagagaagctgttctcaaactaagcgatgctggcatcactcccttgttcctcacccgccaagaagacagacaattgatcaatgcgctgcagataaacaatacagccgtgggccacgctcttgtacttcctgccggaagggacctcaccgacttcctagaaaacgttcttacatgtcacgtttgcttggacatttgtaacatagatccttcatgcggattcggaagctggcggccgtctttccgggacagacgagcagccggctcagatgtagatatcgacatggcgtttattctggatagcgcagagaccaccacactgttccagtttaacgagatgaagaaatacattgcctacctggtgcgtcagctggatatgtcccccgaccccaaagcctcacagcattttgccagggttgctgtagtgcagcatgccccgagtgagtcagtggacaatgcgagcatgccaccagtaaaggtggagttctccttaaccgattatgggagtaaggaaaagttggtggactttttgagtcgtggtatgacccagctgcagggtacgagggctctcggttccgctattgagtataccatcgaaaacgtcttcgaaagtgcacccaaccccagagacctaaaaatcgtggtgctgatgctgacgggcgaagtccctgagcaacagctcgaggaagctcagcgtgtcatcctgcaggccaaatgcaaggggtactttttcgtcgtcttgggcattggccggaaagtgaatattaaggaagtctacactttcgccagcgagcctaatgatgtattcttcaaactggtggacaaaagcacagaactgaatgaagagcctttgatgagatttgggcgccttctgccgagtttcgtgtcgtccgaaaacgcattttatctgtcccctgatatccggaaacaatgcgactggttccagggcgaccaacccactaagaatctggtgaagttcggacataaacaagtgaatgtgcccaataatgtgacctcctcccccacctctaatcctgtaactacaaccaaaccggttaccaccactaagccagtgacaactacaacgaaaccagtgactacgacgaccaagccagtaaccattataaatcaaccctccgtgaagccagctgcagccaaacctgcccctgcgaagcccgtggctgcgaaaccggttgcaactaagatggccacagtcaggcccccggtagcagtcaagccggctacggccgccaagccagtagccgcgaaaccagctgccgttcggccccccgctgccgccgcggccaaaccagtcgcgacgaagcccgaagtcccaagacctcaagcagccaaacccgccgcgactaaacctgccaccactaagcccatggtaaaaatgagtcgagaagtccaggtgtttgaaattaccgaaaattccgcaaaactgcattgggaacgggcagaaccgcctggaccctatttctacgatctgactgtgacaagcgcccacgatcagtccttagtgctgaaacaaaatctgactgtcactgaccgcgtgataggtggactgctggctggccagacatatcacgtagccgtggtatgttatcttagaagccaggttcgggccacctatcacggctcgttctctaccaagaaatctcagccacctcctccacaacccgcccgttccgccagctcatccactatcaacttaatggtctccactgaacccctggctctgacagagacggacatttgtaaactacctaaggacgagggtacctgtcgtgactttatactgaaatggtattacgatcccaacaccaagtcctgcgccaggttttggtacggaggctgtggagggaacgagaacaaatttggatcacagaaagagtgtgaaaaggtttgcgcacccgtgcttgctaaacctggagtgatctccgtgatgggtacctag

SEQ ID NO: 3973 - DNA, 8916 bp, Artificial Sequence
  Description of Artificial Sequence: Synthetic coding sequence
atgcggaagcaccggcacctgcccctggtggccgtgttctgcctgttcttaagtggctttcccaccacccatgctcagcagcagcaggctgcgcaggacagcgctgacatcatctttttaatagacgggtcaaataatactggctctgtcaatttcgcggtcatccttgacttccttgtcaatttgctggagaaactgccaatcggtactcagcagatccgcgtgggggtcgtgcaattctctgatgaaccacggactatgttttcattagacacttatagcaccaaagcgcaggtgctcggagccgtgaaggctttggggttcgccggcggggagctggcaaacattggcttggccttagattttgtggtcgagaatcatttcactcgggcagggggaagccgagtggaggagggagtccctcaagtgctggtgttgatcagcgcgggcccgtcatcggacgagatcagatatggagtggtcgctctaaagcaggcgagtgtgttcagcttcggattgggcgcacaagccgcctcccgggccgagctccagcatatagccaccgacgacaacctcgtcttcaccgttcccgaatttcgttcatttggggatctccaggagaaactgttaccttatatcgtaggggttgcacagaggcacattgttctgaagccaccaacgatagtgacccaagtaatcgaagtcaacaagcgggacattgtgttcctggtcgacgggtccagcgccttaggccttgccaattttaatgccatcagagactttatagccaaggtcattcagcggctggagatcgggcaggaccttattcaggtggctgtagcacagtacgccgacaccgttcgaccggaattttattttaatacacacccaacaaaacgagaggtgattacagccgtgagaaagatgaagcctctagacggcagcgccttgtatacaggtagtgcactggactttgttaggaacaatctatttacctccagtgctggttatagggccgccgagggcatccctaagctgctcgtcctgatcacgggtggtaagagtctggacgagatttctcaacctgcccaggagctaaaaagaagttcaatcatggcgttcgcaatcgggaataagggcgctgaccaggccgaactcgaagagattgctttcgattcttccctggtgtttatacccgccgaattccgggctgcccctcttcagggaatgctgcccggcttgctggctcccctccggacactgagcggtacgcccgaggtgcacagcaacaaaagagatattatctttttactggacggtagcgctaacgtcgggaagacgaatttcccgtacgttagagactttgtgatgaacctagttaatagtctagatattggtaacgacaatattagggttggcctggtgcagttttccgatacccccgtgactgaattctccctcaatacttaccaaacgaagtccgatatcttgggccatctccggcagcttcagctccagggcgggagtggcctaaacaccggttccgcactctcgtacgtctacgctaatcattttacagaagccgggggcagccgaattcgggagcatgtgcctcagcttcttctcttgctcaccgcgggccagtctgaagattcatatttacaggcagcaaatgccctgacgcgtgcagggatcttgactttctgtgtgggcgcttcccaggccaacaaagccgaattggagcagattgcctttaatccatcattggtttacctcatggatgatttttctagcctgcccgcactgcctcagcagctaattcagccactgactacatacgtttctgggggtgtagaagaagttccccttgcccagcccgagtctaagcgtgacatcctgttcctgtttgacggatctgccaacctcgtaggccagttccccgtagtgagagattttctttataagatcatagatgaactgaatgtcaaacctgagggcaccaggatcgcagtagcccagtattcggacgacgtcaaagtagaaagtaggtttgacgagcaccagagcaagcccgaaattttaaacttggttaagcggatgaaaataaagacggggaaggccctgaatttggggtatgccctggattatgctcaacgatatatatttgtgaagtctgcaggaagccggattgaggacggggtcctgcagttcttggtcctcttggtcgcaggccgatcatcagatcgcgttgatggacccgcaagcaatttaaagcagtcaggcgtggtcccttttatctttcaagccaaaaacgcagacccggccgaactcgagcaaatcgtgctctcacctgctttcattctggccgcggagtcattgcctaaaatcggcgatctgcacccgcagatcgtcaacctgctgaaatctgtgcacaatggggcgccagcgcccgtgtctggggaaaaggatgttgtcttcctgctggacggctccgagggggtgcgaagcgggttcccactgttaaaagagttcgtgcagagggtcgttgagtctctggacgtgggtcaggatagagttagagtcgcagtggtgcaatatagcgataggactcgtcctgagttctaccttaactcctacatgaataagcaggatgtcgttaatgcagtgaggcaactgactctcctcggaggccccactccaaatacgggggctgccctcgaattcgtgctaaggaatatcctggtttcatctgccggatcaaggatcaccgaaggggtgccgcaactgctgattgttctgactgccgaccgctcaggcgatgacgtaagaaatcccagcgtagttgtgaagcgtggaggggcagttccaatagggatcggcattgggaacgcagatatcacggaaatgcaaaccatctccttcatcccggatttcgcagtcgccataccgacattccgccaactggggacagttcagcaagtgatttctgaaagggtcactcagcttaccagggaggaactgtctagactacagcctgtgctccagcctcttccgtcacccggagttggtggtaaaagagatgtggtcttcctcatcgacggtagccagagcgctggccctgagttccagtatgtcagaactctgatagagcgactggttgactatttagatgtcggttttgatacaactcgtgttgcagtgatccagttctctgacgatccaaaagttgagttcctgctgaacgcccactcttctaaggacgaagtgcaaaatgccgtgcagagactgcgacccaaaggaggacgacagatcaatgtcggaaacgcactggagtatgtaagcagaaacatatttaagcgaccgcttgggtcacggattgaggaaggcgtgccacagttcctggtgctgatatcaagcgggaagtccgacgacgaagtggacgatcccgccgtcgagctgaaacagtttggagtcgcgccgtttacaattgcaaggaatgcagaccaggaggaacttgtcaaaattagcctatcacccgaatacgtgttttccgtttcaaccttcagggagttgcctagcctagagcaaaagttgcttacccctataaccactctgacaagtgagcagattcagaagctattggcctcaacaagatatccacctcccgccgttgagtcggacgccgctgacattgtgtttttgattgatagcagtgagggagtgcggcccgacggattcgcacatatacgagacttcgtctctcggattgttcgccgcctgaacattggtccaagtaaggtcagggtaggagttgtccagtttagcaatgacgtatttcccgaattctacctcaaaacctaccgctcccaagcgccagtgcttgatgcgatccggaggctgagactcagagggggctcacctttgaataccgggaaagcgctggaattcgtggctcggaacctgtttgtaaagtctgcaggctcacggattgaggatggtgtcccccagcatcttgtgctcgttctaggcgggaagtctcaggatgacgtctcaaggttcgcacaagtgatcaggtcaagtggaatagtgtccctaggggtcggagacagaaacattgatcgcacagagctccaaaccatcacaaatgaccccaggctggtttttacagttcgggagtttcgcgagcttcctaacatagaagaacggatcatgaactcctttgggccctccgctgctacccctgctccacctggggtggatacacctcctccaagtagaccggagaagaagaaagcagatatcgtgttcctgttggatggttcaataaattttagaagagattcctttcaagaggtactaagatttgtgtcggagatagtggacacagtgtacgaagacggagacagtattcaagtcgggttagtgcagtataatagcgatcctaccgacgaatttttcctgaaagatttctcaactaagcgacagattatcgatgctattaacaaggtggtgtataaaggcggaaggcacgctaacacaaaagtcgggctggaacatctgagagtcaatcattttgtacccgaggccgggagtagactcgatcagagagttcctcagattgccttcgtaataaccgggggtaagtctgtggaagatgcccaggacgtgagcctggctttgacacaacgaggagtcaaagtgttcgccgttggcgtccggaacattgattctgaggaggtgggcaagattgcctccaactcagctaccgctttcagggtgggcaacgtgcaggaactctccgagttgagcgaacaggtactcgaaaccttgcacgacgccatgcacgagactctgtgcccaggagtcactgacgctgccaaggcatgcaaccttgatgtgatcctgggtttcgatgggagccgagatcagaatgtttttgtggcccaaaaagggtttgagtcgaaagtcgatgccatcctcaacagaatctctcaaatgcaccgggttagctgctctggcgggaggagcccaactgtgagagtgtcagtagtggccaacactcctagcggacctgtggaggcatttgattttgatgagtatcaacccgaaatgcttgaaaaattccgcaatatgaggagccagcatccctacgtgttaaccgaggacaccctgaaagtgtacttgaataaattccggcaatccagccccgactccgtaaaggtggtcatccacttcacagacggtgcggatggagatctggccgatctacatagagcttcagagaacttacggcaggagggggtaagagctctcatacttgtcggtttagaacgagtggtgaatttggaaagactaatgcatttagagttcggccgtggtttcatgtacgataggcctcttcggttgaaccttctggatctcgactatgagttggctgagcaattggacaacattgccgaaaaggcttgttgcggggtcccgtgtaagtgctcggggcagcggggagatagaggacccattggttcaataggcccaaaaggcatccctggagaagacggctatcgcggctatcccggcgacgagggcggccctggcgagaggggacctccaggagtcaatggtactcagggattccagggctgtccggggcagagaggtgtcaaaggcagccgcgggttcccaggggagaagggcgaggtgggggaaatcggtctggacggcctagatggcgaggatggagataagggcctgccaggcagcagcggcgagaaagggaaccctggcagacggggcgataaaggtccccggggggagaaaggcgaacggggtgatgtcggaattcggggtgaccccggtaatcctggtcaggatagtcaggaacgcgggcccaagggagaaactggcgacttaggacctatgggagtgccaggtagggatggagtgccaggaggccccggggagacaggcaaaaacggcggttttggaagacgcggaccccccggggcaaaaggtaataaaggggggcccgggcagccaggcttcgaaggcgagcaaggcacgcgaggcgcacaaggccccgctggacctgcaggtccccccggactaattggagaacagggaatatccggccctcgcgggtccggcggagcggccggcgcccctggcgagaggggcaggacagggcctcttgggcgtaaaggtgagccgggcgaacctgggccaaaaggggggatcggaaatagaggtcctagaggagagactggcgacgatggtcgcgatggggtgggatccgaaggtcggagagggaaaaagggggaaaggggcttcccaggttaccctggaccgaagggtaatccaggcgaaccagggctgaacgggacaacaggccccaagggaattcgtggacgtagggggaattccggcccgcccggtattgtgggacagaagggtgaccctggatatccagggcctgcaggtcctaaaggaaacaggggcgactctattgatcagtgtgccttgatccagtccatcaaagacaagtgcccgtgctgctacggaccactggaatgtccagtgttccctaccgagctggcttttgccctcgatacatctgagggagttaatcaggatacctttggaagaatgagggatgtggtgctgagtatagttaacgatctgactattgctgaatcaaactgtccccgcggcgcccgtgtggcagtagttacctataacaatgaagtgactacagagattcggtttgctgattccaaacgaaaatcagtgctgctcgataagattaagaatctgcaggtcgctctcactagcaagcagcagtccctcgagactgccatgtccttcgtggcccgcaataccttcaagcgggtccgaaacggctttctgatgcgtaaagtggctgtttttttttccaacactcccacacgagcctcaccccagcttagagaggccgtgctgaagctgagtgatgccggcatcacaccactgttccttacacgccaggaggatcgacagttgatcaacgccctacaaatcaacaacactgcagttggtcacgccctggtgcttccggcgggcagagatctcacagactttctggaaaacgtcttaacgtgccacgtttgtctcgatatttgcaacatcgatccgagttgtggcttcgggtcatggcggccttcattccgggacaggagggcagcgggatccgatgtagacatcgatatggccttcattttagacagcgctgagacaacgactctgtttcagtttaacgaaatgaaaaaatatatcgcttatttagtaagacagctcgacatgtccccagaccctaaagccagtcaacacttcgctcgggtggccgtggtccagcacgcccccagcgagagtgtggacaatgcaagtatgcctccagtcaaagttgagttttcgctgaccgactacggctctaaggaaaagctcgtggacttcttgagccgggggatgacacagctgcaaggaacacgcgctctgggcagtgcaattgagtacacaatcgagaacgttttcgagagtgcgcccaaccctcgcgatctgaaaatagtggtgctgatgctgacaggtgaggtgccagaacagcagttagaagaggctcaaagggtgatcctccaagccaagtgtaaaggatatttctttgttgtgttgggaataggcagaaaggtgaatatcaaggaggtgtatacattcgcttccgagccgaatgatgtattctttaagctggtcgacaagtccacagagttgaatgaggaaccgctgatgagatttgggcggctgcttcccagctttgtgtcatctgagaatgccttctatctgtcccctgacattaggaagcaatgcgattggtttcagggggaccagcccactaagaacctggtcaaatttggacacaagcaagtgaatgtgccaaacaacgtcacatccagccccaccagtaatcctgtgaccactactaagccggtcaccaccactaaacccgtgactaccactacaaagccagttactacaacgaccaagcctgtcacgatcatcaaccagcctagcgtcaaacctgccgccgcaaaacctgcccccgctaagcccgtcgcagcaaagcccgttgctaccaaaatggcgaccgtgcggcctcccgttgcggtgaagccagctactgccgccaaaccggtggcagctaaaccagccgccgtgaggcctcccgccgcggcggcagccaaacccgtggccaccaagcctgaggtgccaagaccacaagctgccaagccagctgccacaaaacccgcaacaaccaagcctatggtcaagatgtctcgagaggttcaggtgtttgagataactgaaaactctgcgaagctgcattgggagagagcagagccgcctgggccctatttctacgacctgactgtcacctccgcccacgatcagagcttggtcctcaaacagaatctcacagtgaccgaccgagtgatcggtggcttattggcggggcagacctaccacgtcgcagtggtgtgttacctgcgctcgcaggtgagagctacttatcatggcagcttctccacgaagaagtcacagcccccaccgcctcaacccgcacggtctgcctcttcatccaccataaaccttatggtcagtaccgaacctctcgctctaaccgaaacagatatttgcaagctgcctaaggatgaaggcacatgcagagatttcatcctgaagtggtattatgatcctaacactaagagctgtgccaggttttggtatgggggctgcggaggtaacgagaacaagtttggctcacagaaggagtgcgagaaggtgtgcgccccggtcctggccaagccaggcgttatcagtgtgatgggcacttag

SEQ ID NO: 3974 - DNA, 3111 bp, Artificial Sequence
  Description of Artificial Sequence: Synthetic coding sequence
atgcggaagcaccggcacctgcccctggtggccgtgttctgcctgttcctctcgggattccctacgacacacgcccagcagcaacaggccgtgattgaggtgaacaaacgggacatcgtcttcctggtggacggctctagcgctcttggccttgcaaacttcaacgctatccgagactttattgctaaggtgatccagcgcttagagattggacaagatctgatccaagtggctgtcgcacaatacgcagacacagtccgacccgagttctacttcaacactcacccaacaaagcgcgaagtgataacggctgtcagaaaaatgaagccattggacggctccgccctttacacgggttctgccctggattttgtgagaaacaatttatttacgagctccgctggttaccgggctgccgaaggaataccaaaactgcttgtactgatcacaggcggtaaaagtctggacgaaatctctcagcccgcacaggagcttaaacgatcatccattatggccttcgctataggcaataagggcgccgaccaagcagagctggaggagatcgcatttgattcaagcctagtttttattcccgctgagttcagagccgccccgctgcagggtatgctgcctggccttcttgccccactccgcactctttctggaactccagaagtgcattcaaataagcgcgatataatctttcttctggacgggagcgcgaacgtcggcaaaacaaactttccttacgtgcgcgactttgtgatgaacttagtgaactccctcgatataggtaatgataacattagggtaggccttgtgcagttcagcgacacacctgtaaccgagttcagccttaacacgtatcagaccaagagcgatatcctcgggcatctacgccaactgcagcttcagggaggaagcggtctaaataccggaagcgcactgtcctacgtctacgcgaatcatttcactgaagccggtggatcgcggatccgagagcatgtcccgcagctcctccttctgttgacggcaggccagagcgaagattcgtatttgcaggccgccaatgcccttacacgcgcaggtatcctgaccttttgcgtgggagccagccaagcgaataaggccgaactagagcagatagcctttaacccctctctcgtttacttgatggacgacttctccagtctgcccgcgctccctcagcaactgatccagccactgaccacttacgtgtctggcggggtggaagaggttcccctggcccagccagagtctaagcgcgacattctcttcctcttcgacggatctgccaacctcgtgggacagtttcctgtggttcgggatttcctctataagatcattgacgaactgaacgttaaacctgaggggacgagaatagctgtagcacagtattcagacgacgtcaaggtcgagagtagatttgacgaacatcagtccaagcctgagatactcaacctcgttaagagaatgaagattaagactggaaaagctcttaacttggggtacgctttggactacgcacaaagatacattttcgtaaaaagcgcggggagccgaatcgaagatggcgtgctccagttcttggtccttcttgtggccggcagatcatccgatcgagtagatggcccggctagcaatcttaaacaatccggtgtggtcccattcatcttccaggcaaaaaatgctgaccctgctgaactcgagcaaattgtgctgtccccggcttttatcctggctgcagagtccttgccgaaaattggagacctgcaccctcagatcgttaatttgctgaagagtgttcacaacggcgcccccgcccccgtgagcggagaaaaagatgtggtgttcctgctggacgggagtgaaggggttcggtctggttttcccctattaaaagagtttgttcaacgggtggtggagagcctggacgtgggacaggaccgcgtgagggtcgcagtcgtgcagtacagcgacaggactcggccggaattttacttgaattcttacatgaacaagcaagacgtcgtcaacgccgtgcgacagctgaccttacttggaggaccaacgccgaacacgggagcagcactagagttcgtgctccgcaatattttggttagttctgcggggtcaaggattacagaaggtgtgcctcaactgctgatcgtgcttacggcggaccgcagtggggatgacgtgcgaaaccccagcgtggtcgtgaaacggggcggcgcagtccccattggcatcggaattggtaatgctgacattaccgaaatgcaaaccatctcattcatacccgatttcgcggtggcaattcctacattccgccagctggggactgtccagcaggtgatcagcgaaagagttacacagctgacacgggaggagctgtcacgtctgcaacccgtgttgcaaccattaccaagccctggagtcggcggcaagcgcgatgtcgtgttcctgatagacgggtcgcagtctgcaggacccgagttccagtacgtgagaacccttattgagagactcgtggactatttggacgtgggctttgatacaactcgagtggccgttatccagttttctgacgatccaaaggtagagtttctgctgaacgcccactcgagcaaagacgaggtccagaacgctgtacagcggttgcggcccaaaggtgggcggcaaatcaacgttggaaacgccttggagtacgtgtctcggaatatatttaagaggccactgggcagtcgaatcgaggagggtgttccacagttcctggttctgatcagctctggcaaaagcgacgatgaagtcgacgaccccgctgtggagcttaagcagttcggcgtggcaccatttactattgccaggaatgccgatcaagaggagttagtaaagatctctttgtcacccgagtacgtcttttccgtgagtaccttccgtgaactccccagcctggaacagaagctgctcacccccataaccacgttaacttcagaacagatacagaaattacttgcatcaacacggtatccacctcccggcgagatgggagcaagcgaggtactgcttggagcgttttccatttag

SEQ ID NO: 3975 - DNA, 8916 bp, Artificial Sequence
  Description of Artificial Sequence: Synthetic coding sequence
atgcggaagcaccggcacctgcccctggtggccgtgttctgcctgtttctgtcagggtttcctacaacccatgcacagcagcagcaggccgcacaggattccgccgatatcatattcctgatagatggctctaataataccggtagcgtgaacttcgctgtaattctggacttcttagtgaatctgttggaaaagctgcccatcgggacacaacaaattagagtgggagtggtgcagtttagcgatgagccccgcactatgttttccttagatacttattccactaaagcccaggtgctgggtgcagttaaagcattgggattcgccggcggagaacttgctaacattggtctggccctggattttgtggtcgagaatcacttcactagggctggcgggtcacgcgtcgaggagggcgtgccccaggtgctggtcctgatctctgcaggcccatcgagcgacgaaatcaggtacggtgtggtggccttaaagcaagcctctgtcttctcattcggactgggagcacaagccgcatccagggccgaattacagcatattgccactgacgataacctggtcttcacagtgccagagttccgcagttttggtgatctgcaggagaagctcctgccatatatcgttggggttgctcagcggcacatagttctgaagccacccacgatcgtgacccaggtcattgaggtaaataaaagggacatcgtgtttctcgtggacggaagctcagccctaggcctggcaaactttaacgctattcgggatttcattgcaaaagtgatacaaagattggagatcgggcaggacctgattcaggttgccgtagcccagtacgcagatacggtgagacctgaattctattttaacacacacccaacaaaaagggaggtcattaccgcggtgcgcaagatgaagcccctggatggatccgctctctatacgggatcggcactcgactttgtaaggaacaatctgttcacatcgagtgccggctaccgggctgccgaggggatccctaagctgttggttctaatcacaggaggaaagagtctggatgaaatctctcagcccgcccaggagctgaagcgctccagcatcatggcttttgctattggcaacaaaggcgccgaccaagcagagctcgaggagatcgcctttgacagcagcctggtattcatccctgctgagttcagagccgcgcctctgcagggcatgctgcccgggctgctggccccactgcggaccctttctgggactcctgaagtccatagcaacaaacgggacatcatcttcctgctcgatgggagcgccaacgtcgggaagaccaatttcccgtatgttagggattttgtgatgaatttagtcaacagcctggacatcggcaatgataatataagagtgggcctcgttcagttcagtgatactcccgtcaccgagttttccctgaacacatatcaaaccaagagcgatatcctgggccatctccgacagcttcaactgcagggaggaagcgggcttaacactggaagcgccctgagctacgtctacgcaaatcacttcactgaggctggcgggagtcgcatccgtgaacacgttcctcagctgctgttattgctcacagccggccaatcagaggactcctacctccaggccgcaaatgctctgactcgcgccggcatactgactttctgtgtgggagcttcacaagcgaataaggccgagctggagcagatcgcttttaacccatccctcgtctacctaatggatgatttcagctcactgcctgcattacctcagcagctaattcagcccttgacgacttatgttagtggaggggtcgaagaagtgccattggcccagcctgaaagcaagcgtgacattctgttccttttcgatggcagtgctaacctggtgggacagtttcccgttgtgcgagattttctgtacaaaatcattgacgagctgaacgtgaaacccgaaggcacacgaatcgcagtggcccagtattcagatgacgttaaggttgagtcacggttcgatgagcaccagagcaaacctgagatccttaaccttgtgaaacgcatgaaaatcaaaacaggcaaggcgctaaacctgggatacgcgctggattatgcccagcggtacatttttgtgaagtccgccggctctaggattgaggatggcgtgctccaatttctggtgctcctggtggccgggcgcagttccgacagagttgatggccccgcttccaatcttaaacaatccggcgttgtgccatttatctttcaggccaaaaacgctgaccctgctgagctagaacagattgtactctctcctgctttcatattggccgcggaatctcttcctaagataggagatctgcacccccagatcgttaatctgctcaagagcgttcacaacggtgcccccgcccccgtttcaggggaaaaagacgttgtctttctgttagatggctcggagggagtgaggtccggatttcccttattgaaggagtttgtgcagagagtggtggaatccctggacgtgggccaggacagggtgagggtcgctgtcgtgcagtactctgacaggacaaggcctgagttctacttgaattcctatatgaacaagcaggatgtggtgaacgcagtgcgccaattgacgctgctaggtggacccacgcctaacaccggggccgccttagagtttgtgttgagaaacattctagtaagcagtgccggctcccggattaccgagggggtaccgcaactcctgatagtactgacagctgacagatccggggacgacgtcagaaatccctcagtggtggtaaaacggggaggggcagtacctattggcatcgggattgggaacgctgatatcacagagatgcaaacgatctcgtttatccccgattttgctgtggccattcctaccttccgccagctagggaccgtgcaacaggtgatatcagaacgcgtgacccagttgactcgggaagaactgagccgactccagcctgtgctgcaacccttgccatcccccggagtgggcgggaagagagacgtcgtctttctgatagacggttcccagtctgccgggcccgaatttcagtatgtaaggacacttatcgaacggctcgtggattatttggatgtcggctttgatactaccagggtggccgtcattcaatttagtgacgatcccaaggtggagttcttgctgaatgctcattcttctaaggatgaagttcagaatgccgtccagaggcttagaccaaagggaggcagacagataaacgtggggaatgcgctggagtacgtgtctagaaacatcttcaagcgacccctcgggagccgaattgaggagggggtgccacagttcctcgtcttaatctcgagcgggaaaagtgatgacgaggtggatgatccggcggtcgagctaaagcagttcggggtcgcaccgttcaccattgcccgcaatgccgaccaggaagaactagtgaaaatctctctgtctcccgagtatgtgttttctgttagcacttttcgagaactgccgtcactggaacagaagctgctaactccaatcactactctgacgtctgagcagattcagaaactcttagcctctaccagatatccaccccccgctgttgagagcgacgcggcggacatcgtcttcctgattgattcctccgagggcgtgcgaccagacggttttgctcacatccgcgactttgtttctcgcattgttcggaggcttaacattgggcctagcaaggtgcgggtcggtgtggtacagttcagcaacgatgtgtttcctgaattttatctgaaaacttaccgctcacaagcacccgttctggacgctattcgaaggcttcgtttgaggggcgggtcccctcttaatacagggaaggccttggagtttgtcgctcgaaacctttttgtgaagagtgctggaagccgcattgaagacggggtgcctcaacacctggtcctggtactaggtggtaagtcccaggatgacgtttctcgtttcgcccaggtgatccgttctagtggaattgtgtctctcggtgtcggtgatcgcaacattgatcgaacagaactccaaacaatcacaaatgacccccggctggtgttcaccgtgcgtgaatttagagagctgccgaatattgaggagcggataatgaattcgttcggcccctccgcagcgacaccagcccccccgggagtagatactcctcccccctcgaggcccgaaaaaaagaaggccgacattgtatttctactagacggatctatcaatttccgcagggattctttccaggaggtgctgcgcttcgtgtctgaaatcgtggatacagtgtatgaggacggcgactccatccaggtgggtcttgtgcagtacaattctgatcccaccgatgaatttttcctgaaggactttagcactaagcgtcaaatcatagatgccatcaataaggtggtctataagggcggccggcatgcaaacacaaaagtcgggctcgaacatctgcgggtcaaccattttgttcctgaagcagggagcagactggaccaaagagtgcctcaaatcgctttcgttatcactggcggtaaatcggtcgaggatgcccaggacgtgagtcttgcccttacacaacgcggggtgaaagtgtttgccgtcggagtgagaaatatcgattctgaggaggtgggcaaaattgcctctaattccgccaccgcttttcgggtgggaaatgtacaggagctgtccgaactgtcagaacaagtgctcgagacccttcatgatgccatgcatgagacactgtgtccaggtgtgaccgatgccgcaaaagcctgtaacctggatgtgatcttagggttcgatggctctcgcgatcagaacgtgtttgtggctcagaagggctttgaatccaaggttgacgcaatactgaaccggattagtcagatgcatagagtcagctgtagtggcgggcgctcaccgactgttcgggtttctgtcgtagcgaatacccccagtggacctgtagaggcatttgattttgacgaataccaacctgaaatgttggaaaaattcaggaatatgcgatctcagcacccttacgttctgacagaagataccttgaaggtgtacctgaataagttccgccagtcttctccagattctgtcaaggtggtgattcatttcacagacggtgccgatggtgatctggcggacctgcatcgcgcctccgaaaatctgcggcaagaaggtgtccgtgctctgatcctcgtcggcctcgagcgcgtcgtgaacctcgaacgcctgatgcacctggaattcgggcgcggttttatgtacgacagaccactgcgtcttaatctgctagacctcgactatgagctcgctgagcaactagataacatcgcagaaaaagcatgctgcggggtgccctgtaagtgttcaggccagagaggtgacagaggacctattggatctatcggacctaaggggatcccaggtgaggatggctatcggggctacccaggcgacgaggggggccctggagagagagggccgccgggcgtgaacggtactcagggttttcaggggtgccctggccagcgcggcgtgaagggttcgcggggtttccccggtgaaaaaggcgaggtcggagaaatcggcctcgacggattggatggtgaggacggggacaaggggctgcctgggagctctggagagaaaggcaacccgggccggcggggggacaaaggtcccagaggggaaaaaggcgagcggggggatgtgggaatcaggggcgatcctgggaaccccggccaggattcacaggaaaggggcccaaagggtgagaccggcgacctcgggcccatgggagtcccaggaagagatggggttccaggcggccccggagagaccggcaaaaacggcggatttggcagaagaggtccgccaggagctaaaggcaacaaaggggggcccgggcagccgggatttgaaggggagcagggaacaaggggcgctcagggacccgccggcccagctgggccaccggggctgatcggtgaacaagggatcagcggaccacgcggcagtggcggcgcggccggtgctccaggagagcgaggcagaaccggaccgttgggaagaaaaggcgaacctggtgagccagggcccaaaggaggcattggaaatagggggccccggggggagacaggcgatgacgggagggatggagttggtagcgagggccgcaggggcaaaaaaggtgagagaggattccccgggtacccgggcccaaagggcaaccctggagaacccggcctgaacggcactacaggccccaaaggcatccgagggaggaggggaaacagtgggccaccaggaatcgtcggccagaagggtgaccccggctatcccgggcccgctggacctaaagggaatcgaggcgactcaatcgatcagtgcgcgctaatccagtcgataaaagataaatgtccctgctgctacggccctctcgagtgtccagtgtttcccaccgagctcgcatttgccttagacacttctgaaggtgtgaaccaggatacattcggaaggatgcgggacgttgtgctgtcgatcgtgaatgatctcacaatcgctgagtccaactgcccaagaggtgcacgcgtggcggtggttacgtacaataacgaagtgacaaccgaaatacggtttgccgacagcaagagaaagtcagtcttactagacaaaataaaaaatttgcaagtggcactgacttccaagcagcagagcttagagaccgccatgtcctttgtggcacgcaatacttttaagagagtacggaatgggtttctgatgcgcaaagtggccgtgttctttagtaatacgcctacaagagcgtcaccacaactacgggaagccgtgctcaaactgagcgacgctggcataaccccacttttcctgacccgtcaggaggaccggcagcttattaatgctttgcaaatcaacaatactgctgtgggacatgccttagtgctgccagccggcagggatttgacagattttctagagaatgtgctgacttgtcacgtgtgcttagatatttgtaatattgacccatcatgtggttttggttcatggcgtccttcctttcgcgacaggcgagccgccgggtctgatgtggacatagatatggccttcatcctggacagtgccgagacaaccactctgttccaattcaatgagatgaaaaagtacatcgcgtaccttgtgcgtcagctggacatgagtcctgacccgaaagcctcccaacattttgcccgggtggcagttgtccagcacgcaccctccgagtcagtggataacgctagcatgccccctgttaaggtggaattttccctaacagattacggatcaaaggaaaagctcgtggactttctcagccgggggatgacccagctgcagggaacaagggcacttggttctgctatcgagtataccatcgagaatgtattcgagtccgcccctaacccacgggacttgaagattgtggtgctcatgctgacaggcgaagtccccgagcaacagctggaagaagcacagcgggtgatcctccaggccaagtgtaaaggctacttctttgtggttcttggcattggcagaaaagttaacataaaagaggtctacacttttgccagcgaacctaacgatgttttcttcaagctggtggacaaaagcaccgaacttaacgaggaacctctgatgcgatttggacggctcctcccttctttcgtaagctctgaaaacgccttttatctgtctcccgatatccgaaaacagtgtgattggttccagggtgaccagccgaccaagaatcttgtgaaatttggccacaagcaagtcaacgttccaaataatgtgaccagctctcccacatccaaccccgtgacaaccaccaaacctgttacgaccacaaagcccgttaccactaccacgaagccggtcaccacaaccacaaaaccggtcaccatcattaatcagcctagcgtcaagcctgccgctgccaagccagcccccgcaaaacccgtagcagccaaaccggtggccaccaagatggctactgtacgcccaccagtggccgttaaacctgctacagcagccaaacccgtggcagcgaagcccgccgctgtacgccccccagcagctgccgctgccaaaccagtggctaccaaaccagaggttccccggcctcaggccgcaaagcccgcagctacgaaaccagcaactacaaaacctatggtaaagatgtccagagaagtgcaagtcttcgagatcactgaaaacagcgccaagctccactgggaacgcgccgagccccctggcccatatttctatgatcttactgttacatctgctcacgaccagtccctggtcctaaaacaaaatctcaccgtcacagatcgggtaataggaggacttttagccggacaaacttaccatgtcgccgtggtttgttacttgcgctcccaggtccgggctacttatcatggatcgttctctacaaagaagagtcaacctcctcccccacagcccgcccgctcagcctccagctctacaatcaacctcatggtgtcaacagagccgctcgcactgacggagacagacatttgtaaactccccaaggacgagggcacatgccgggacttcatccttaagtggtattatgacccaaacacaaaaagctgcgccaggttctggtatggcgggtgcggaggtaacgagaataaattcggctctcagaaagagtgtgagaaggtgtgtgccccggtgctggctaagcccggcgtgatctccgtcatgggcacatag

SEQ ID NO: 3976 - DNA, 7848 bp, Artificial Sequence
  Description of Artificial Sequence: Synthetic coding sequence
atgaagatcctgctgatcatcttcgtgctgatcatctggaccgagactcttgcggaccagtctcctggaccaggtccagtgtatgccgacgttgtttttctcgttgacagtagtgaccacctcggacctaaatcattcccattcgtgaaaacctttatcaacaaaatgataaactcgctgcccattgaggctaataagtacagggtggcccttgcgcagtatagcgacgaatttcactctgaattccacctctccacgtttaaagggaggtcaccaatgctgaatcatctgaaaaaaaattttcagttcatcggcggatccctccagatcggcaaagcactgcaggaggcccacaggacttatttctcagcccccatcaacggacgcgatcggaaacaatttccgcctatcctggtagtgctggcgagcgccgagtctgaagatgaggttgaggaggcctcgaaggctctgcagaaggacggggtgaaaatcataagtgttggggttcagaaggcaagtgaggaaaacctcaaggccatggcaacttcccattttcatttcaatctcaggactatacgagacctaagcacattttcacagaatatgacgcagattatcaaggatgtaacgaagtataaggaaggagccgtggacgccgatatgcaggtgcattttccgatctcttgtcagaaggatagcctggccgacctggtcttcctcgtcgacgagtctctcggcacaggtgggaaccttcggcatttacaaacattcctggaaaacataacgtcgagcatggacgtgaaggaaaactgcatgagacttggtctgatgagctacagcaatagcgctaaaaccatctcctttctgaagagttccactacccagagcgaatttcagcaacagattaaaaatctgtctatacaggttgggaaaagtaataccggcgctgccatagaccaaatgcgccgcgacggattcagcgagtcatacggaagtcggagggcacagggcgtgcctcagatagccgtcctggtgacccatagaccttcagacgatgaggtgcacgacgctgccctgaacctccgactcgaggacgtgaacgtgtttgccctctctattcagggagcaaacaacacccaactggaggaaatcgtttcttatccccccgaacagacgattagcaccctgaagtcttatgcagatctcgaaacctactcaacaaaatttctcaagaagctgcagaacgaaatctggtctcagattagcacctatgcagaacagcgcaacttggataagacagggtgcgtggacactaaagaggcagacattcatttcctcattgacggcagctcaagcattcaggagaagcaatttgagcagattaagcgcttcatgcttgaagtgaccgaaatgttcagcatcggtcccgataaagttagagtgggggtcgtgcagtattcagacgacacagaggtggagttctacatcacggactactccaacgacattgacctgcgcaaagccatctttaatatcaagcagctgaccgggggcacttacaccgggaaagcactcgactacatccttcagatcattaaaaatgggatgaaggacaggatgtccaaggtaccatgctatttgatcgtgctgacagatgggatgagcaccgaccgcgtggtggaaccagccaaaaggctgagagccgaacagattactgtgcacgccgtgggcatcggcgccgccaacaaaatcgagctgcaggaaatcgctgggaaggaagagcgcgtcagttttggccagaacttcgatgccctcaaatccattaaaaatgaggtggtaagggagatctgtgctgagaaagggtgcgaggatatgaaggcagatattatgtttcttgttgattcatcatggtctatcggcaacgagaacttccgcaaaatgaagatatttatgaagaacttattaacaaaaatccagataggggcagacaaaacacagatcggagtcgtgcagttctccgataaaaccaaggaggagttccagcttaacaggtacttcacccaacaggagatcagcgatgctatagatcggatgagcctcatcaacgagggtacattgacgggtaaagcccttaattttgtgggccaatacttcactcacagcaaaggcgctaggttaggggcaaaaaagttcttgatcctgatcacggacggcgtagcacaggatgacgtgcgagatcccgcgcgcatcttaagaggaaaagacgtgaccatcttttctgtcggggtgtataacgcaaacaggagccagctcgaggagatttccggcgattcttcgctggtgttccacgtggagaacttcgaccacttaaaggctctcgaaagaaaacttattttcagggtgtgtgctctgcacgattgcaaacgtattaccctgctcgacgtagtctttgtactggaccattccggctcaatcaaaaaacagtatcaagatcatatgatcaatcttacgattcatcttgtgaaaaaggccgacgttggccgggaccgggtgcaattcggtgcgctaaaatacagcgatcagcccaacatcctgttctacttaaatacttactctaaccggtccgccattatcgaaaacttgcggaagcggcgggacaccgggggaaatacatatactgccaaagcccttaaacatgcgaatgccctatttaccgaggaacatggctctaggatcaaacagaatgttaaacagatgctgatagtcataacagacggggagagccacgatcacgatcagctgaatgacaccgctctagagttgcgcaacaaggggattacaatcttcgctgttggtgtgggaaaggcaaatcaaaaggagctggaaggcatggccggaaacaagaataacaccatctatgttgacaatttcgataagctgaaagatgtctttacactcgttcaggagcggatgtgtactgaagcccccgaagtatgtcatttgcaagaggccgacgttatctttctgtgtgatggctctgaccgagttagcaacagcgactttgtcacaatgaccacttttctgagcgacctaatcgataattttgacatacagagtcaacgcatgaagatcggaatggctcagtttggttcaaactaccagagcatcatcgagctgaaaaactcactgacaaagacacaatggaagactcagatacagaatgtaagcaagtccggcggcttcccacgaatcgactttgctttgaaaaaagtgagtaatatgtttaacctgcatgccggaggtaggagaaatgctggggttccacaaacacttgtcgttattacttcaggagatccacgctatgacgtggcggacgccgtcaagacactcaaagatctcggcatctgcgtgttggtcttaggaatcggcgatgtgtacaaggagcacttgctgcccatcacaggaaactctgaaaagatcattacgtttcaggattttgataagctgaagaatgtcgacgttaaaaagcggattattcgcgaaatttgccagtcctgtgggaaaacaaattgttttatggacatcgtggtgggctttgatatttccacgcatgtgcaggggcaaccactgttccagggacacccccagctggagtcttacctaccgggaattctggaggacataagtagcatcaagggcgtgagttgtggtgctggaaccgaagcccaggtatccctagcttttaaagtgaactctgatcaggggtttcctgccaagttccagatatatcagaaggcggtgttcgactcattactgcaggtcaatgtgagcgggcctactcatctcaacgcccagtttctcaggtccctgtgggacaccttcaaggataagagtgctagtcggggccaagtgctgctcatcttttctgatgggctgcaaagtgaatccaacatcatgctcgagaatcagtcggatcggctacgcgaagccggcctcgacgccctgctagtcgtgtcactgaatactacagcccaccatgaatttagtagctttgaatttggcaagcgctttgattatcgcactcacttgactattgggatgcgggagttgggaaagaaattgtctcagtatctcggcaatatcgcagaacgtacatgctgttgtacattctgtaagtgccctggcatccctggaccacacggcactagggggcttcaggcgatgaagggaagtcagggtctgaaaggctcaaggggacatagaggcgaggacggtaaccccggggttaggggtgatactggcccccagggagataaagggatcgcgggatgccccggagcctggggtcaaaaggggcttaaaggattttccggcccaaaaggcggccatggcgacgatggcattgatggcttagatggggaggagggctgtcacggctttcccggaattaagggcgagaaaggcgacccaggctcccagggtagccccggctctcgcggtgcaccaggccagtacggggagaagggattccctggcgacccagggaatccagggcagaacaataacatcaagggacagaaaggaagtaagggggagcaggggcggcagggacggtccggccagaagggtgtccaagggagcccctcatctcgcggttcgagagggcgggagggacagagagggctgcgaggggtctccggcgagccaggaaaccctggccccacaggaacgcttggcgctgagggtctccaggggcctcaggggagtcaaggcaatccagggcgcaaaggcgagaaaggcagccagggccaaaaggggccacagggttctcccgggctcatgggtgctaagggctctactggcaggccgggtctgttgggaaagaaaggcgagccaggactacctggcgacctcgggcctgttggacagactggacaaaggggaagacagggagactctggcataccagggtatggccagatgggtaggaagggtgtgaaggggccgcgtggcttcccaggcgatgcaggccaaaagggggatatcggcaaccctggtatccccggaggcccaggtccaaagggattccgcggtttggctctgactgtgggattaaagggcgaggaggggagcagagggttaccagggccccccgggcaaagagggataaaggggatggccggccagccagtctactcgcaatgtgatctgattcgcttcctgagagaacacagcctgtgtagtttggaaaagtgtcccgcatacccaaccgaattagtcttcgccctggataactcctatgacgtgactgaagaaagtttcaataagacacgggacattatcaccagcattgtaaatgatctgaacattagggagaacaactgccctgtcggcgcacgagtcgcaatggtgtcctataactccggcacctcctatttgattcgatggagcgactacaaccggaaaaaacagctccttcagcagctgtctcaaatcaagtaccaagacacaaccgaacctcgcgatgtcggcaatgcgatgcggtttgtgacaagaaacgtgttcaagcggacttacgccggcgctaacgtccggagggtcgccgttttttttagcaatggacaaacggcatctagaagttcaatcatcactgcgaccatggagttttctgccctggatatttcacccacagtgtttgccttcgacgagcgggtattcctggaggcgtttggctttgacaatacggggacatttcaagtgattccagtgcctccaaacggcgaaaaccaaaccctggaaaggcttcggcggtgtgctctatgttacgataagtgctttcctaatgcgtgcatccgggaagcgtttctgccagaagacagctacatggatgtagtgttcctaattgacaatagcaggaatatcgctaaggacgaattcaaggctgtgaaagcgctcgtgtccagcgtcatcgacaattttaacatagcctcagatccactgatcagcgattcaggcgacagaatcgccttactaagttattcaccttgggagtcatcccgccgaaaaatgggcacggtcaagacagaatttgacttcattacttatgataatcaactgttaatgaagaatcacatacagaccagttttcagcagctgaatggagaggccaccataggcagggcattgctctggaccactgaaaatctattccctgaaacgccgtatctccggaaacataaggtgatattcgtggtctccgccggcgaaaactacgagcgcaaggagtttgtgaagatgatggccctaagagccaagtgccagggctatgtgatatttgtaatcagtctgggcagcacaagaaaagatgatatggaagagctggcaagttaccctttggatcagcatctaatccagctcggaagaatccacaagccagacctaaactacattgcgaaattcctcaagccgtttctttacagcgttagacgcggattcaaccagtatccccctcccatgctggaggatgcatgtcgcttaattaacttaggcggggagaatattcagaatgacggttttcaattcgtgaccgagctccaagaggacttcctcggcgggaacggcttcattggacaagagctaaactccggacgcgaaagtccattcgtaaagaccgaggacaacgggtctgactacctggtttatctgccatcgcagatgtttgagccccagaaacttatgataaattacgagaaggaccaaaagagcgctgagatcgcatcacttaccagcggccacgaaaattacggcaggaaggaggagcctgatcatacatacgaaccgggagatgtctctttacaagagtactacatggatgtagcatttttgatagatgcatcccagagagtgggctctgatgaatttaaggaagtgaaagcctttataacttctgtgctggattacttccacatcgcacccactcctctgacgagcacccttggtgatcgtgtggctgttctgagttatagcccaccgggatacatgcccaatactgaggagtgcccagtttacctagagttcgatctcgtgacatacaattctatacaccagatgaagcaccatctgcaagattcccagcaactgaatggggacgtttttattggccatgcactgcagtggacaatcgacaatgtgtttgttggtacaccaaacttgcgcaagaacaaggtcatctttgtgatctcggccggtgagacgaactcattggataaggacgtgttacgtaacgtgtcactgcgggctaagtgtcaaggttacagcatcttcgtattctcatttggccccaagcacaacgacaaagagctggaggaactggcaagccatccattggaccaccatctggttcaactgggcagaacccataagcctgactggaattatataattaaattcgtgaaaccattcgtacacctaatacgtcgcgcaataaataagtatcctacagaggacatgaaagccacctgcgtgaatatgacctcacctaatcccgagaacggaggcaccgaaaacactgtcctactcctaccaggaatttacgagataaagactgagaacggcgatttgtttgatgagtttgacagccaagcgcagcacttacttgtgcttggaaataatcattctagcgggagcgaaacagccaccgacctaatgcaaaagctgtatctcctgttcagtaccgaaaaactcgcaatgaaggacaaagagaaggcccacctagaggagatttcagccttagtggttgataaacagcaagaaaaagaagacaaggagatggaggctacagatatatag

SEQ ID NO: 3977 - DNA, 7848 bp, Artificial Sequence
  Description of Artificial Sequence: Synthetic coding sequence
atgaagatcctgctgatcatcttcgtgctgatcatctggaccgagactctggcagaccagagtccagggccagggcctgtgtatgccgatgtcgtcttcctggtcgacagttccgatcacctcgggccaaaaagttttcccttcgtgaagacatttatcaataagatgattaatagtctgccaattgaggcaaataagtatcgcgttgccctcgctcaatactcggatgaatttcacagtgagtttcaccttagcacattcaaaggtagatccccgatgctcaatcacctgaaaaaaaattttcagtttattggtggcagcttgcagatcggaaaagccctgcaggaggcccatcggacatacttcagcgcccctatcaatggtagggaccgcaaacagttcccgcctattctcgttgttctagccagcgccgagtctgaagacgaggtcgaggaagcctccaaggcgctgcagaaagacggggtcaaaataatcagcgttggggtccagaaggctagcgaagagaatctcaaagcaatggccacttctcactttcacttcaatctgcggaccattagggacctgagtaccttctcccagaatatgacccagatcatcaaagatgtgaccaagtacaaagagggtgctgtcgacgccgatatgcaagttcactttccgatctcttgccagaaggactcgctggccgatctggtgtttttagtggatgaatccctcggcacaggtgggaacctacgtcaccttcaaacctttttggagaatattactagcagcatggacgtaaaggaaaactgtatgcgactgggactcatgagctactccaactcggctaagactatatcatttctgaagtcttccacaacgcaaagtgagttccagcagcagatcaaaaatctcagcatccaggtgggaaaaagcaataccggtgctgctattgaccagatgaggagggacggtttctcagagagctatggcagcagacgggcacagggagtgccccagattgccgtactcgtcacccatagaccttctgacgacgaagtgcacgatgctgctttaaatttgcgcttagaggacgtgaacgtattcgctcttagcatacagggggccaacaacacccagcttgaggagatagtgtcataccctccggagcaaacgatcagcaccctcaaatcctacgcagatttggagacatattctacaaagtttctgaaaaagctccaaaacgagatctggtcccaaatctcaacatacgcggaacagcgtaatctcgataaaacaggatgcgtggacaccaaagaggccgatatccactttctcattgacggctcttcttcaattcaggaaaaacagttcgaacagatcaaacgctttatgttggaggtgaccgaaatgttttccatcggtccggataaagtcagggtgggcgtagtgcagtatagcgacgacaccgaggtggagttctacatcaccgactatagcaatgatatcgatctccggaaagcaattttcaacataaagcaactgaccgggggaacctacacaggcaaagcccttgattacatcctccagataatcaaaaatggaatgaaggaccgaatgtctaaagtgccatgctacctcatcgttcttaccgatgggatgtctaccgatcgcgtcgttgaaccagccaagaggctgcgagctgaacagatcaccgtgcacgctgtgggcataggagctgccaacaagattgagttgcaggaaatagccggtaaggaggagcgtgtgagcttcggtcaaaatttcgacgccttgaagagtatcaaaaacgaggtcgtgagggaaatttgcgccgagaagggatgcgaagatatgaaggccgacattatgttcctggtggactcctcctggtctatcggaaacgagaattttcgtaagatgaagatttttatgaaaaatctgttgacgaaaatccagatcggcgctgacaaaacacagattggggtggtacaattctctgacaagacaaaggaggaattccagttaaaccgttacttcactcagcaggaaatctccgacgcaatagacaggatgtctctgatcaatgagggcactttgaccggcaaggctttgaattttgtggggcagtactttacccactccaagggggccagactgggtgccaaaaagttcctgatactcattacagatggcgttgcccaggacgatgtccgtgaccctgcacggattctgcggggaaaagatgtcacaattttctccgtcggagtgtacaatgctaatcgcagtcagttggaggaaatcagcggtgattcatctcttgttttccacgtggagaacttcgatcaccttaaggcactggagcggaaactaatcttccgtgtctgtgcccttcacgattgtaaacgcattacgctgctggacgtagtcttcgttttggaccactccggctcaattaaaaagcagtaccaggatcacatgattaatctgactatccatctcgtgaagaaagccgacgtgggcagggaccgagtgcagttcggtgccctgaaatactcagatcaaccaaacatactgttctatctgaatacttattccaatcgctctgccataattgagaatctccgtaaaaggcgcgacacaggaggcaacacttacaccgcaaaagctctgaaacatgccaacgccctttttaccgaagagcatggctcccgtataaaacagaatgtcaaacaaatgctcatcgtgatcacggacggagagagccatgatcacgatcaactgaatgataccgcgctcgaactgaggaacaaaggcatcaccatttttgcggttggcgtgggaaaagcaaaccagaaagagctagaggggatggccgggaataagaacaacactatctatgtggataactttgataaattaaaggatgtgttcaccctggtgcaagagcgtatgtgcactgaagcgccagaagtctgccatctccaggaagcagacgtgattttcctctgcgacgggtccgaccgagtatccaatagcgacttcgtgactatgaccacattcctttctgacctgattgataacttcgatatccagtcccagcgaatgaaaatagggatggctcagtttggctcaaactaccagtctataatagagttaaaaaactctttgactaagacccagtggaagactcagatccagaacgtgagtaagtcaggcggctttcccagaatcgatttcgctctaaagaaggtcagtaacatgttcaacttacacgccgggggccgtaggaacgctggagtgccacagaccctcgtcgttattacttctggcgaccccaggtatgacgtagcagacgctgtcaaaactctcaaagacctcggcatatgtgtgctggtgctcgggatcggtgacgtctataaggagcatctactgcctattactgggaatagtgagaaaatcattacctttcaggacttcgacaagcttaagaacgtcgatgtgaagaagaggattattagagagatttgccaatcctgcggaaagactaactgttttatggatatcgtcgtgggattcgacatctcaacgcacgtgcagggccagccactgtttcagggtcaccctcaactcgaatcttacctccccggcattctcgaagatatctcctctattaaaggtgtgtcctgcggagccggtactgaagcacaggtgagcctggctttcaaagtgaactctgaccagggcttcccagctaagttccagatttaccagaaagccgtgttcgactccctcctgcaagttaacgtcagcgggcccacccacctgaatgctcaattcctgcgatccctgtgggatactttcaaggacaaaagcgcaagcagaggtcaggtccttctgattttttccgacggcctccagtccgagtccaacattatgctagaaaaccagagcgaccgcctgcgcgaagcaggactcgatgccctgcttgttgtatcactaaatactaccgcccaccatgagttcagctcgtttgaattcggcaagaggtttgactatcgcacccatctgaccattggtatgcgagagttaggtaagaagctatcccagtacctgggcaatatcgccgaaagaacatgctgctgcacattctgcaagtgtcctggcattcctggcccgcatggtactagaggccttcaggccatgaaaggaagccaggggctcaaagggtcccggggacaccgcggcgaggacggtaatccgggagtgaggggggacaccggcccccaaggggataagggaatcgcgggatgccctggagcctggggccaaaagggacttaagggcttctctgggcctaagggtggccatggcgatgatggcattgacgggctggatggagaggaaggttgtcacgggtttcctggaatcaagggcgagaagggagaccctggtagccaggggagccctggctccagaggggcacccggtcagtatggggagaaaggattccccggtgatccgggcaaccctgggcagaataacaacattaagggccagaaaggaagcaagggagaacagggacgccaggggcgctctgggcagaagggggttcagggcagccctagcagcaggggctctagaggccgggaaggtcaaagaggcctccggggagtctcaggggagcccggcaacccaggaccaacgggtactctgggagccgaggggctgcagggcccccagggcagtcagggaaatcctggccggaagggagaaaaggggtctcaaggtcagaagggaccgcagggatctcccggccttatgggcgcaaaaggctccacagggcgtcccggcttgctgggcaagaagggcgaacccggtctccccggtgatctgggaccagttggccagaccggccagagaggcagacagggcgactctggaattccgggttacggccaaatgggccgcaagggcgttaagggtcctagaggctttccaggagacgccggacagaagggtgacataggaaatccaggcatccccggcggtccaggacccaaagggttccgcggtctcgccctcacagttgggctgaagggagaggaggggagcagaggtctccctggaccccccgggcaacgcggaattaaaggaatggctggccagcctgtgtattctcagtgcgacctcatccgctttctgagggagcactcaccatgctggaaggagaaatgtccagcataccccaccgagctggtctttgctctggataactcctacgatgtgaccgaggagtccttcaataagacaagggacattatcacatctatcgtgaacgatctcaatatcagagagaataattgcccagtaggagcacgcgtagcgatggtgtcatacaatagcggcaccagttatctgatacggtggtctgactacaaccgcaaaaagcagctcctgcagcagttaagtcaaataaaataccaggatactacggagccccgtgacgtcggaaacgctatgcgctttgtcacacggaatgtctttaagagaacctacgccggcgccaacgtgcgacgagtcgcagtctttttctctaacggccaaacggcatcgcggagctcaataatcaccgctacgatggagttttccgctctagacatttcgcccaccgtgttcgccttcgacgagcgggtgtttctggaggccttcgggttcgacaacacagggactttccaggtgattcccgtgccgcccaatggggagaatcagacactagagaggcttaggagatgtgctctgtgttatgataaatgcttccccaacgcatgcattcgcgaggctttcttaccagaagactcctatatggatgtggtgttcctgatcgacaattcccgaaacatcgctaaagatgaattcaaagctgtgaaagcccttgtctcctctgtgatcgacaacttcaacattgcttctgacccactaattagcgactcgggtgacagaattgcgctgctaagctatagcccctgggagtctagccgccgcaaaatgggcactgttaagactgagttcgatttcataacctatgacaatcagttgctgatgaagaaccacatacagaccagcttccagcagttgaacggagaggctaccattggaagagctctgctgtggactacagagaacctcttcccagagacaccctatttacgcaagcacaaggttattttcgtggtcagtgcaggggagaattacgagagaaaggagtttgtgaagatgatggcattgcgagcaaagtgtcagggctacgtcattttcgtgattagcctgggctccaccagaaaggacgacatggaggagttggcttcctacccactggaccagcatctaattcagctcggcaggattcataagcccgatctgaactacatcgccaaattcctgaagcctttcctgtattcagtgcgtcgcggattcaaccaataccctcctcccatgcttgaggacgcctgcagactgattaacttagggggtgagaacatccagaatgatggctttcaattcgtgactgagcttcaggaggatttcctcggggggaatggctttattggccaagagctgaactctggaagggaatccccattcgtgaagactgaggacaacggctctgattacctggtctaccttcctagccagatgttcgagcctcaaaagcttatgataaactacgagaaagatcagaagtcggcagagatagcatcactgacctctgggcacgagaattacggccggaaagaggagccagaccacacatacgaacctggagatgtgagtctgcaggagtactatatggatgtggctttcctcatagacgcctcacagcgggtgggttcggatgagttcaaggaagtgaaggcctttattacatcggtcctcgactacttccatatcgcccccacacccctaacctcgaccctgggcgacagggtggccgttctctcttacagtccacccgggtacatgcccaacacagaggagtgccctgtgtacctagagttcgatctggtgacatacaatagtatccatcaaatgaaacaccatcttcaggacagccaacaactaaatggggatgtcttcatcggtcatgccctccagtggaccattgacaacgtgttcgtcggaacacccaacctgcgcaagaacaaagtaattttcgtcatcagcgccggcgagacaaattctctcgacaaagatgtgttgagaaacgtgtccctgagagcgaaatgtcagggctattccattttcgtattcagctttggtcccaagcacaacgataaggagctggaggagcttgccagtcaccctctggaccaccacctcgtgcagctggggcgcacacacaaacctgattggaattacattatcaagttcgtgaaaccttttgtacacctcattcgtcgggcgatcaataaataccctacagaagacatgaaggctacatgtgttaatatgacatcaccgaacccagagaacgggggcaccgagaacactgtcctgctgttaccaggcatatatgaaattaagacagagaacggggatcttttcgatgagtttgactctcaggcccaacacctgctggtcttaggaaataatcacagctcaggctcagagacagccacagacttaatgcagaagctctatttgttgttctctactgagaaactggcaatgaaagataaagagaaagctcacctggaagagatctcagctctggttgtcgacaagcagcaggaaaaagaagacaaggagatggaagctactgacatctag

SEQ ID NO: 3978 - DNA, 1674 bp, Artificial Sequence
  Description of Artificial Sequence: Synthetic coding sequence
atcggccgggccctgctgtggaccaccgagaacctgttccccgagacaccctatctgcgcaaacataaggtaattttcgtggttagtgccggagagaattacgaaaggaaagagtttgtgaaaatgatggccctacgggcaaaatgtcaggggtacgtgatctttgtgatttcactgggctcaaccaggaaggacgacatggaggagctcgcatcttaccctctggaccaacacctgatccagttaggacgcatccataaacccgacctcaattatatcgccaagtttctcaaacccttcctctatagcgttcggcggggcttcaatcagtatcctccccctatgcttgaggacgcttgtcgtctgattaatttgggtggagagaatatccagaatgacggctttcagttcgttacagagctgcaggaggactttctgggagggaacggattcatcggtcaagaattgaattccggccgggaatcaccattcgttaaaaccgaagataacggctcagattacctggtgtacctgccctctcagatgtttgaaccacagaaactcatgatcaactacgaaaaagatcagaaatccgctgagatcgcgtcactgacaagcggtcacgaaaactatggacggaaagaagaacccgaccatacctatgagcctggcgacgtgtccttacaagagtattacatggacgtggcctttctgattgacgcttcccaacgcgtgggatctgatgagttcaaagaagtgaaagctttcatcacatccgtgctggattacttccacattgcccccacgccccttacttccaccttaggagaccgggtggctgtgctttcttatagtcccccaggatatatgccgaataccgaggaatgccctgtttacctggagtttgatcttgtcacctacaactcaatacatcagatgaaacaccacctgcaggattctcagcagttgaatggggacgtttttataggccatgcgctgcaatggacaatcgacaacgttttcgtcggcacaccaaacctcaggaagaataaggtaattttcgtgatcagtgcaggggagacaaacagcctcgacaaggatgttctgcgcaatgtctcattgagggcgaaatgccagggctattccattttcgtcttctctttcggaccaaaacacaacgacaaagaacttgaagagctagctagccaccctctcgaccaccatctggtgcagctagggcggacacacaagcctgactggaattacatcattaagttcgtaaagcctttcgtgcatctgatcagacgagccatcaacaagtacccaaccgaagatatgaaagccacctgcgtgaatatgacctctcctaatcctgagaatggaggtactgagaacaccgtgctcctgctccccggtatatacgaaattaagacagagaatggcgatctctttgatgaattcgattctcaggctcagcatctgctcgttcttggcaataatcactcttccggatctgaaaccgcaacggacctgatgcagaaactgtatctcctcttctctacagaaaagctggccatgaaagataaggagaaagcccacctggaggagatatctgcccttgtggtggacaagcagcaagagaaggaggatggcgaggacacccgttcttcttag

SEQ ID NO: 3979 - DNA, 7581 bp, Artificial Sequence
  Description of Artificial Sequence: Synthetic coding sequence
atgaagatcctgctgatcatcttcgtgctgatcatctggaccgagacactcgccgatcagtcacccggcccaggaccagtttacgcagacgtggtcttcctcgtggattccagcgaccacctgggcccaaaatcctttccatttgtgaaaacctttatcaacaaaatgatcaactccttgccgatcgaggcaaataaataccgggtagcccttgcccagtacagcgacgaattccattccgagttccacttgtctaccttcaaagggcggagtccaatgctgaatcatcttaaaaagaacttccagtttatcggcggtagtctgcagatcggcaaagccctgcaagaagctcatcggacctattttagcgctcctataaatggaagggatcggaaacaatttccccctatactagtggtactggcctcagcagagagcgaagatgaagttgaagaggccagcaaagcacttcagaaggatggagtcaaaataatcagtgttggagttcagaaagcctccgaagagaacttgaaggcaatggctacatcccactttcatttcaatcttcgcaccatccgagatctcagcaccttcagtcagaatatgacccagatcatcaaagacgtgaccaaatacaaggaaggcgcagtggatgccgacatgcaggtgcatttccccatcagttgtcagaaggattctttagctgatctggtgttcctggtcgatgagtccctgggcactggaggtaatttgaggcacttgcagactttcctcgagaacattacctcgtcaatggatgtgaaggagaattgcatgaggctgggtctcatgtcttattcaaatagcgcaaagacgataagctttctgaagagcagcaccactcagtccgaattccagcagcagatcaagaacctgtccatccaggtgggtaagtctaacaccggtgcagctatcgaccagatgcgccgcgacggcttctcggaatcttatggttcaaggcgagcccagggagtaccccaaatagcagttctggtgacccatagacctagcgatgacgaggttcatgatgcagcgctcaatctccgtttagaggacgtaaacgtgttcgccctatcaatccagggagctaacaacacacagctcgaggagattgtgagctaccctccagagcagacaatctcgaccctgaaatcgtatgccgatctcgaaacctactcaaccaaattcctgaaaaagctgcagaatgaaatctggagccagatatctacctatgcagagcagcgaaatcttgacaagacgggatgcgtggatactaaagaagcagacattcattttctgattgatgggagctctagcattcaggagaagcagttcgagcagatcaagaggttcatgctggaggtgacagaaatgttctccatcggcccagataaagttagagtgggggtggtgcaatatagtgacgatacagaggtcgagttttatattacagactacagtaacgacatcgacctgcgcaaagccatcttcaacattaaacagctgaccgggggaacatacacggggaaggctctcgactacatccttcagataatcaaaaacggcatgaaagaccggatgagcaaagtgccctgctatctcattgtgttgactgatgggatgtccacagatagagtagtagaaccggctaaaagacttagagccgagcagataactgtgcacgcagtgggtattggtgctgctaataaaattgaattgcaagagattgctggaaaggaagagcgcgtgtcatttggtcagaatttcgacgccctgaagtccatcaaaaacgaagtggttcgcgagatttgtgccgagaagggttgcgaagatatgaaggccgatataatgttcctggtggatagctcctggtcaattggcaatgagaatttcagaaagatgaaaatcttcatgaagaacttgctgaccaagatccaaatcggagcggacaaaacacaaattggcgtagtgcaatttagtgacaagacaaaagaagagttccagttaaacaggtactttactcaacaagagatatctgacgctatcgatagaatgagtctgatcaatgaaggcacgttaacaggcaaggccctaaactttgtcggacagtattttactcattctaaaggcgctcggctgggcgcaaagaagtttctgatcttaatcacggacggggtggcccaggatgacgttagggatccagctagaatcctccggggcaaagatgtaaccatattcagcgttggtgtttacaatgcaaaccgctcacaactggaagagatctccggcgacagctcactggtgttccatgttgaaaattttgaccatctgaaggcattagaaaggaaactaatttttcgcgtgtgcgcgcttcacgattgcaagcgcattaccttgctggacgtcgtctttgtgttggaccactctgggtctatcaagaaacaataccaggatcacatgattaatttgaccattcatttggtgaagaaggctgacgtcggcagggatcgagtccagtttggcgctctgaaatacagcgatcagccaaacatactgttttacctgaacacatatagcaataggtccgccatcattgagaatctacggaagagacgggacaccgggggcaacacttatactgctaaggccctgaaacacgccaacgccctgttcacagaggaacacgggagccggatcaagcagaatgtgaagcaaatgttgatagtgatcaccgacggagaatctcatgatcacgaccagctcaacgatacggctcttgagctgagaaacaaaggcatcaccatttttgccgttggggttggaaaagcaaaccagaaggagctggagggaatggccggaaataaaaacaacactatttacgtcgacaatttcgataagctaaaggacgtcttcacactggtccaggagcgtatgtgcaccgaagctcccgaagtttgccacctccaagaagccgacgtaattttcctgtgtgatgggtccgaccgcgtttcaaattctgactttgttaccatgactacttttctgagtgaccttattgataattttgatatccagtcccagcgcatgaaaatcgggatggcccagtttgggtctaactatcaatccatcatcgaactgaagaattccctgactaaaacccagtggaagacccagatccagaacgtgtctaagtcaggtgggtttccccgtattgatttcgccttaaagaaggtcagcaacatgttcaacttgcatgctggagggcggcggaatgcaggcgtgccccagacattggtggtaatcacttctggcgaccctcgctacgatgtggccgacgctgtgaagacactgaaagacctggggatttgcgttctcgtcctgggaatcggagatgtctacaaagaacatttgctgccaattaccggaaacagcgagaaaatcataacatttcaggacttcgataaactgaagaatgtggacgtcaagaagagaatcattagagagatatgtcaatcctgtggtaaaacaaattgcttcatggatattgtggtcggtttcgacatttccacacacgtacagggccagcctctattccaaggccacccacagctcgagtcctacttgcctggtatcctcgaagacatatctagcatcaaaggtgtttcgtgcggcgccggcactgaggcacaagttagtcttgcttttaaagtgaactctgatcagggcttccctgcaaagttccagatctaccagaaagcagtgttcgactccttgctgcaggtgaatgtctctggcccgactcatttgaatgcccagtttctgcgctctctgtgggatacattcaaagacaaatccgccagcaggggccaggtgttgctcatattttctgatggactgcaaagcgagtctaatatcatgcttgagaaccagtcggacaggcttagggaagctggcctcgacgctttattggtcgtctcccttaatacaaccgctcatcacgaattttcatcctttgagttcggaaagcggttcgactaccgtactcacctgactatcggaatgcgggagctggggaaaaagctgtcccagtatctagggaacatagctgagcggacctgttgttgcaccttctgcaagtgccccggcataccaggtccgcacggaacacggggactccaggccatgaagggttcccaaggcttgaaagggagcagggggcacaggggcgaagacggcaatcccggagtccggggagacactggccctcagggagacaaaggaatagccggctgccctggtgcgtggggacagaaagggctgaaaggtttttccggcccaaagggcggccacggggacgatggaatcgatgggctggacggggaggaaggatgtcacggatttcctgggatcaagggggagaaaggggatccagggtcacagggctcccccgggagccgcggcgcaccaggacagtacggtgagaaagggttccccggtgatcccggcaaccccggacagaacaataacataaagggccagaaaggatctaaaggagagcaggggcgccaagggcgctccggccaaaagggagtgcagggcagccccagttctagaggttcgaggggcagagagggccaacgtgggctgagaggggtgtctggtgagcctggcaaccccggccctacgggaaccctcggggctgaaggcctgcagggaccccagggcagtcaggggaaccctgggcgcaagggcgaaaagggatcccaggggcagaagggaccacaggggtctcccggtctgatgggtgccaaggggtccaccggccgtccaggtcttctcgggaagaagggcgaaccaggactgcccggcgacctcggcccagttggccaaacgggacagcgtggccgacagggtgacagcggaattcctgggtacggtcagatggggcggaagggagtgaagggacccagaggcttccctggtgatgctggtcagaaaggggacatcggcaaccctgggatcccggggggacccggcccgaaaggctttcggggtttagcattaaccgtcggcctgaagggcgaggagggttccaggggactgccagggccacccggacagagggggattaaggggatggccggccagcccgtctatagccagtgcgacctcatacgattcctgagagaacattccctgtgttcactggagaagtgcccagcatatcccactgagttagtattcgctctggataactcatacgacgttaccgaggaaagtttcaacaagacaagagatatcattacctctattgtaaacgacctgaatatcagggaaaataactgccccgtgggcgctagggtagccatggtgtcttataacagcggaacctcctaccttattagatggagcgactataatagaaagaagcaactgctccagcaactgagccagatcaagtatcaggatacaaccgagcccagggacgtggggaacgccatgaggtttgtcactcgtaatgtattcaagcggacttacgccggggctaatgtcagacgcgtcgcagtgtttttttccaacgggcagaccgcctcccggtccagcatcatcaccgcaaccatggagttcagcgccctggatatctccccaaccgtctttgcttttgatgagagagtgtttttggaggcattcggatttgacaacactggaacctttcaggtcatacccgtgccccctaatggcgagaaccaaacactggagaggctccgccgctgcgctctctgttacgacaaatgcttccctaacgcgtgcattcgggaagcttttctccctgaggactcctacatggacgttgtgttcctgattgacaactcccgtaacatagcaaaagatgagttcaaggccgtaaaggcgctggtgagctccgtgatcgacaacttcaatatagctagcgatccactgataagtgattccggcgacaggatcgccctcctctcgtactcaccctgggagtcttctcggagaaaaatgggcacagtcaagacagaatttgatttcattacatatgacaatcaactcctgatgaaaaaccacatccagacctcttttcagcaactgaacggagaagccacgattggccgcgcgctgctctggacaaccgagaatttattccctgaaacaccttatcttcggaagcacaaggtgatcttcgtcgtcagcgccggcgagaattatgagcgcaaagaatttgtgaaaatgatggcactgcgagccaagtgtcagggctatgttatttttgtgatcagtctgggaagtacccgcaaagatgatatggaggagctggcaagctatccgctggaccagcacctcattcagctcggtcgcattcacaagcccgacttaaactatatcgcgaaattcctgaagccatttctctactctgtacgccgaggatttaaccagtatccaccccccatgctggaggatgcgtgcaggctgattaaccttggcggggaaaacatccaaaatgatgggttccagttcgtcacagagctgcaggaggacttcttgggtggcaacgggttcataggccaggagttgaactccggcagagaatctcccttcgtaaaaaccgaggataatgggagtgactatttggtctatttacctagccaaatgttcgaacctcagaagctcatgatcaattatgagaaagaccagaagagcgccgagattgcatctttgacatccggccacgaaaactatggccgcaaagaggaacctgaccacacatatgagcccggggacgtctcactgcaagaatattatatggacgtcgccttcctaatagatgcaagccagcgggtgggctctgatgagtttaaggaagtcaaggccttcatcacatctgttctcgattatttccacatcgcgcccaccccactcactagcaccctcggcgaccgcgtggctgtgctgtcttactcacccccaggatacatgcccaataccgaggagtgccccgtgtacctggagtttgatctggtgacctacaacagcatccaccagatgaaacaccaccttcaggattcacaacaactgaatggcgatgtctttatcggccatgctctgcagtggacgatcgacaacgttttcgtcggcacccctaatctgagaaaaaataaggttattttcgtcatatcggccggggagaccaactcgctggataaggacgttttgagaaatgtatcacttcgtgctaagtgccaaggttactccattttcgtgttctcttttggcccaaaacacaacgacaaagagcttgaagaactggctagtcatccccttgatcatcacctggtccagctcggccgaacccacaaacccgactggaactatatcatcaagttcgtgaagccctttgtccaccttattagacgcgcaataaataagtatcccaccgaggatatgaaagccacttgcgttaacatgaccagtccgaatcccgagaatggtggcacagagaataccgtgctgtggtag

SEQ ID NO: 3980 - DNA, 1332 bp, Artificial Sequence
  Description of Artificial Sequence: Synthetic coding sequence
aaccagtaccccccccccatgctggaggacgcctgccggctgatcaatctaggcggggaaaacattcagaatgacggttttcaattcgtgaccgagttacaggaagactttctgggcgggaacggattcatcgggcaggaattaaactcaggccgggaatcaccttttgtgaagactgaggataatgggtccgattacctcgtgtacctcccctcccagatgttcgaacctcagaagctgatgatcaactatgagaaggaccaaaagagcgcagagatcgctagtctgaccagtggccacgaaaactatggtcgtaaggaggaaccagaccacacgtacgagcccggcgacgtctcactccaggagtattatatggacgtcgccttcctgatagacgcctcccaacgcgtgggcagtgatgagtttaaagaggtgaaggcattcataacgtccgtgttggattatttccatatcgcacctaccccactgaccagcaccctgggtgaccgagtggccgtgctgtcttacagtcctccaggatatatgcctaacaccgaagagtgtcctgtgtatctcgagtttgaccttgtcacttataacagcatccatcagatgaagcatcatcttcaggatagccagcagctgaacggagacgtctttataggtcatgccctgcaatggactatcgataatgtcttcgtcgggacccctaatttacgcaagaacaaagtgattttcgtcattagcgcgggggagactaattctctagacaaggatgttttacgtaacgtgtctttacgggctaagtgtcagggttatagtatttttgtattctcatttgggcccaagcataacgacaaggagctggaggagcttgcttcccatcctctggatcaccacctggttcagctaggtaggacacacaagcctgactggaattacataatcaaattcgtcaagccgttcgtgcatcttatccgaagggccatcaataagtatccgacagaagatatgaaggctacctgcgtgaacatgacaagccccaaccctgaaaacggcggaacggaaaatacagttctgctcctgcctgggatctacgaaatcaagaccgaaaacggagatctcttcgacgaatttgattcccaggcgcagcatctgctggtcttaggcaacaaccattcctctgggtctgagaccgcaactgaccttatgcagaagctgtacctgctgttcagcactgagaagttagccatgaaggataaggagaaagcccatttagaggagatcagcgcattggtcgtggacaaacagcaggagaaagaggacctctag

SEQ ID NO: 3981 - DNA, 6792 bp, Artificial Sequence
  Description of Artificial Sequence: Synthetic coding sequence
atgatgctgctgatcctgttcctggtgatcatctgcagccacatctctgtgaaccaggacagtggacctgagtacgccgacgtagtgtttctggtcgacagctccgatagactgggctcgaagagctttccctttgtaaaaatgttcatcacaaagatgatttcgtcactccctattgaagccgacaagtaccgggttgctctggctcagtattctgacaaattgcactctgagttccatctgtccacgttcaagggtaggtccccaatgctcaatcatctacggaaaaattttggtttcataggtggttctctccagataggcaaggcactacaggaagcacaccgcacctatttcagtgcccccgcaaatggacgggataagaagcagtttcctccaattctcgttgtgctggccagcagcgaatcagaggacaacgtcgaggaggcatccaaggctttacgcaaggacggagtcaaaataatcagtgttggcgtgcagaaggcctctgaggagaatctgaaggcaatggctacttcccagttccacttcaatctgcgtaccgtacgggacctttccatgtttagccagaacatgacccatatcatcaaggacgtcattaaatacaaggagggtgcagtggacgacatattcgtagaggcatgccagggcccgtcaatggcggacgtcgtgtttctgttagacatgtctataaacgggtctgaagagaactttgattatctgaagggtttcctggaggagtctgtaagcgccctggatattaaggagaattgcatgcgtgtgggtctggtggcctacagcaacgagacgaaagtaatcaactccctgagcatgggcattaacaagagcgaagtgctgcagcatatccaaaacctgtctcctcggaccggtaaagcctatacgggcgctgcgattaaaaagctgcggaaggaggttttcagcgccagaaacggctcgcgtaagaatcaaggggtaccacaaatcgccgtccttgtcacccatcgagactccgaggataatgtgaccaaggcagcggttaatctccgtagggaaggggttaccatctttacactgggtatcgaaggggcatccgatacccaactagaaaagatagcaagccaccctgcagaacagtacgtcagcaagttgaaaactttcgccgacctggctgcccataatcagactttcctaaaaaagctcagaaaccaaatcacccacaccgtttccgtgttctccgagcggactgagacactgaaatccggttgcgtggatacagaggaggctgatatctatctcttaattgacggaagtggcagcacacaggccaccgatttccacgagatgaaaacctttctctcagaagttgtgggtatgttcaatatcgcccctcataaagtaagggtcggggcagtgcagtacgcagactcctgggacctcgaattcgagatcaacaaatatagtaacaaacaggacttgggcaaagccatcgaaaatattagacagatgggggggaacacaaatacgggagccgccctaaacttcacacttagcttgctccagaaagcaaaaaaacagcgcggcaacaaagttccttgccaccttgtggtcttaacaaatggtatgtccaaggattcgatattagaaccggccaataggttgcgcgaggaacacatccgggtctacgctatcgggataaaggaagctaaccagacccagttaagagagattgccggggaggaaaagcgggtatattacgttcacgatttcgatgccttaaaagatattaggaaccaggttgtgcaggaaatatgtaccgaggaggcttgtaaagagatgaaagcggacatcatgtttctggtagatagcagcggctccataggcccggaaaattttagcaaaatgaagaccttcatgaaaaatctagtctctaaaagccagattggccccgatagggtgcagatcggtgtcgtacagttctccgatatcaacaaggaagagtttcagctgaaccggttcatgtcccagtctgacatcagcaatgccatagatcagatggcccacatcgggcagacgacactcactggctctgccttgagcttcgtcagtcagtactttagccccacgaagggggcccggccaaacatccggaaatttttaatactgattaccgacggggaggctcaggacattgtcaaggagcccgccgtggtgctgcggcaggaaggcgtcataatttattcagtgggtgtgttcggatctaacgtgacacagctcgaggaaatctccgggagacccgaaatggtattttatgtggaaaattttgacatcctacagcgtatcgaggatgatctcgtctttggaatctgctcacctagggaggaatgtaagagaattgaggtcttggacgtcgtatttgtgattgattcctctgggtctattgactatgacgaatacaacatcatgaaggactttatgatcggtctggttaagaaggccgatgtcggaaaaaatcaagtgagattcggagcgcttaaatatgctgacgatcctgaggtgctcttctacttagatgatttcgggacaaagctggaagtgatctctgttttgcagaatgaccaggcaatgggtggcagcacctataccgccgaagccctaggtttttcggaccatatgtttaccgaggctcgcggctctagactgaacaaaggtgtccctcaggtccttattgtgattacagacggagaatcccacgacgccgataagctgaacgctaccgccaaggccttacgagataaaggcatccttgtgttggcagtgggcatagacggagcgaatcctgtcgaactactggcaatggctggttcctctgacaagtattttttcgtcgagaccttcggcggattaaaaggaatcttcagcgatgtgactgcctctgtgtgcaactcatccaaagtagattgtgagattgataaagtcgacctggttttcctcatggacggaagcacctccatacaacccaacgatttcaagaaaatgaaagagttcttagcaagcgtcgtacaggatttcgatgtatcacttaaccgcgttaggatcggtgcagcgcagttttccgacacttaccaccccgagttccccctgggtactttcataggcgagaaagagatctcattccaaattgagaatataaaacagatcttcggaaatacccatataggtgcggctttacgtgaggtggaacactacttccggcctgacatggggtcacggattaatacagggaccccgcaagtgcttctggtcctcaccgacggccagtcgcaggacgaggtggcccaggctgctgaagcattgcggcacagaggaatcgatatttactctgtgggaatcggcgacgtagacgatcaacagttgattcaaatcaccgggaccgctgagaagaaattaaccgtgcacaactttgacgagctgaaaaaggtgaataaaagaatcgtaagaaatatttgtacaacagccggagaatctaactgtttcgttgatgtcgtcgtagggttcgacgtctccacacaggaaaaaggtcaaacactgttagaaggacaaccctggatggagacatacctccaggatattttgcgcgccatcagttctctcaacggcgtaagttgtgaagtgggtacagagacacaggtcagcgtcgcgtttcaggtcaccaacgcgatggagaagtactctcccaagtttgagatctattccgaaaatattctgaattcactcaaagacattactgtaaaaggtccatcattattgaacgccaacctattggatagcctctgggacaccttccaaaataagtccgccgcgcggggcaaagttgtgctcctgttttctgatggactggatgacgatgtggaaaagctcgagcagaaatcagatgaacttaggaaagaggggctgaatgccctgatcaccgtggcattggatggaccagccgactcctcagatctggctgatctgccctacatcgaatttggtaaaggcttcgagtaccgtacccagctgtcaattggcatgagggagctgggttccaggctgtctaaacagctggtgaacgtcgccgaaagaacttgctgctgcctgttttgtaagtgtattgggggagacggtacaatgggagacccaggccccccagggaaaagaggccctcctgggttcaagggctctgagggttatctaggagaggaggggatcgccggcgaacgaggagcccctggtcccgtcggcgaacaggggaccaaaggatgctacggcactaagggaccaaaaggaaaccggggcctgaacggccaagaaggcgaagtgggcgagaacggtattgatggcttaaacggagaacagggggataacggactgcccggccgcaagggagaaaaaggagacgaggggtctcagggctcaccaggaaagcgaggaacacccggggaccggggtgccaagggtctgaggggcgacccaggagccccgggcgtcgattcctccatagaaggcccaacgggactgaagggggagagaggccgccaggggagaaggggatggcctggtcccccagggacacccggatctagaaggaaaacagccgctcacggcagacgcgggcatactggccctcaaggtactgcagggatcccgggtccagatgggctagagggctcacttggattgaaggggccgcagggacctcgcggtgaggccggagttaaaggagagaagggcggagtgggctccaaagggcctcagggaccccccggacctggaggagaagctgggaaccaagggaggttgggaagtcaaggaaacaaaggtgaaccaggcgatcttggcgagaagggggcagtgggctttcctgggccccgggggttacagggcaacgatggctctccagggtacggttctgtgggccgtaaaggggccaaaggtcaggaggggtttcctggtgagtcaggcccaaagggcgaaattggggaccctgggggcccaggggaaactggccttaaaggcgcacgcggaaaaatgatctccgctgggttaccaggagagatggggtcacctggggaacccggcccacccggccggaagggtgtgaagggggctaaaggcctggcctccttttctacatgcgaattaattcaatacgtgagggatagaagcccaggaaggcacgggaaaccagagtgccctgtgcacccaacagagctggtcttcgccctggatcactctcgggacgtcaccgagcaggagtttgagcggatgaaagaaatgatggcatttctggttagagacattaaggtgcgagaaaatagctgcccagttggagcccacattgctatcctctcgtataacagccatgctcggcacctggtcagattcagtgacgcatataagaaatcccagctgctgagagagattgagaccataccctatgaacgaagttcagcctcaagggagatcggccgcgccatgcgcttcattagtagaaacgtattcaagaggaccctgcctggagcccatactcgaaaaatcgcgaccttcttttcatctggccagtctgccgatgcgcactctattacaactgcagcaatggagttcggtgccctcgaaattattccagtagtaatcaccttctcgaacgtgccttcggtaagaagggccttcgctattgacgacaccggaacatttcaggtgatcgtcgtgccgagcggtgctgactacatccccgcactggaacggctgcagagatgcacattttgctatgacgtgtgcaagcctgacgccagttgcgatcaagctcgcccaccacccgttcaatcgtatatggacgcggcgttcctacttgacgccagccgaaatatggggagcgctgagtttgaggatatccgtgcattcctcggggccctcctcgaccatttcgaaattactccggaacctgaaacgtccgttaccggtgacagggttgcattgctgagccacgctcctccagatttcctgccgaatactcagaaatctcctgtgagggcggagttcaacttaaccacatacagatcaaagagactcatgaagcgtcatgtgcatgagtcggtgaaacaattgaacggagacgctttcatcggtcacgcactgcagtggacgcttgacaatgtttttctttccacccccaacctgcgtcggaacaaagttatttttgttatttccgctggggaaacttcccaccttgacggggagatattaaaaaaggagtcgctccgggccaagtgccagggttacgcactgtttgttttctctctgggccctatctgggatgacaaagagttggaagatttggctagccatcctctcgaccatcatctggtccagctgggtcgcatacacaaaccagaccactcctacggcgtcaagtttgtgaagagtttcatcaattctatccggagggcaattaataaatatcccccaatcaacctgaaaatcaagtgtaatagacttaactccattgaccccaaacaaccaccgcgccccttccggtcttttgtccctgggcccctaaaggccacactgaaggaggacgtcctccaaaaagccaaattctttcaggacaaaaagtacctctcacgcgtcgcgcgatcaggacgggatgatgcaatccagaattttatgagaagcacatcacacacgttcaaaaatggtcggatgatcgaatcagcacctaagcagcatgactag

SEQ ID NO: 3982 - DNA, 6792 bp, Artificial Sequence
  Description of Artificial Sequence: Synthetic coding sequence
atgatgctgctgatcctgttcctggtgatcatctgcagccacatctccgtaaaccaggactccggcccagagtatgctgacgtcgtcttcctggtcgactcatccgatcgcctggggagcaagtccttcccgtttgttaaaatgttcattactaagatgatcagtagtctgcccattgaggccgataaatacagggtggcgctggcccagtatagtgataagcttcactctgaatttcacctgagtacctttaaggggcgctcaccaatgcttaaccacctccggaagaactttgggttcatcggtggtagtttacagatcggtaaagccttacaggaagcacataggacctatttcagtgcccctgcgaatggacgcgataaaaagcaatttcccccaatactggttgtactcgcttctagcgagagcgaagacaatgtggaggaggcatctaaagctctccgcaaggacggagtgaaaatcataagcgtgggtgttcagaaggcctctgaggaaaacttgaaagctatggccacaagccagtttcatttcaatctacggaccgtacgcgatctgtctatgttcagccagaatatgactcatattattaaggacgttataaagtataaggaaggggctgtggacgacattttcgtcgaagcctgtcagggtccatcgatggccgacgttgtctttctcttagacatgagtattaacgggtctgaagaaaatttcgactacttgaaaggcttcctggaagagtcagtatccgctctcgacatcaaggaaaactgtatgagggtcggtctcgtagcatactcaaacgaaaccaaggtcatcaacagcttgtcaatgggaattaacaaatctgaggtgcttcagcacatacagaatctttcccccaggaccggtaaggcgtataccggcgcagcgattaagaagctgcgaaaagaggtgtttagcgcccgaaatggtagtcgcaagaatcagggcgtacctcagattgcggtactcgtgacccacagggacagcgaggacaatgtcacgaaggctgcagttaatcttaggagagagggcgtcacgattttcactctcggcattgagggcgcctccgatactcaactggagaagattgcatcacaccctgcagagcaatacgttagtaagttgaagacattcgcagatctggccgcccataatcaaaccttcctgaagaagctgcggaaccagataacccacaccgtctcagttttctctgaacggacagagaccttgaagtctggctgtgtcgacactgaggaggcagacatctacctcctgatcgacgggagtggctcgacccaagctacagattttcacgaaatgaagacattcctgtccgaagtggtagggatgtttaacatagctcctcataaagttagagtcggagcggtacagtacgccgacagttgggatctggagtttgagatcaacaaatactcaaacaaacaggatttggggaaggcaatagagaatattagacagatgggggggaatacaaatactggggcggctctgaatttcaccctatcacttctccagaaggcgaaaaagcaaaggggtaataaagtgccctgtcatctagtggtcctgaccaacggtatgtcaaaggattcaattctggaaccggccaatcggctgcgcgaggaacacattcgggtgtacgcaatcggaattaaggaagcaaatcaaacacaactgagagagatcgcaggggaggagaaaagagtgtactacgtccacgactttgatgctctgaaggatatccggaaccaagtggtgcaagaaatctgtactgaagaagcttgtaaggaaatgaaagccgacattatgtttctggtggatagcagcggatccataggaccagaaaacttttccaaaatgaaaacatttatgaagaatctagtgagcaagagccagatagggccagatagggtgcagataggcgtcgtgcagtttagcgatataaacaaagaggaattccagctgaaccggttcatgagtcagtcagacatttcgaatgccattgaccagatggctcacataggccagacgaccttgacaggctctgccctgagttttgtcagccagtatttctctcccacgaagggcgcccgcccaaatattaggaagtttctcatcctcatcactgacggcgaggcccaggatatcgttaaggaacccgccgtagtgttgaggcaggagggcgtcattatttattccgtcggcgtgttcggctccaacgtaacgcagttggaagaaatttctggtcgcccagaaatggtgttttatgttgaaaactttgacatcttgcagcggatcgaggacgatcttgttttcgggatctgttctccccgagaagaatgtaaaaggatcgaggtgctggacgtggtctttgtgatcgattcttccggaagcatcgattatgacgagtataatattatgaaggacttcatgattggcctcgtgaagaaggcagacgtggggaagaaccaggtccgcttcggagccctgaagtatgctgacgatcccgaggtacttttttacctagatgattttggaacaaagctggaggtgatcagcgtgttgcaaaacgaccaggccatggggggatccacctataccgcggaggcccttgggttctccgatcacatgtttaccgaagctaggggttctcggctgaacaaaggggtccctcaagtcctcatagtcatcaccgatggcgagtcgcatgacgccgataagttaaatgcgacagcaaaggccctcagagataaggggatcctggtgcttgcagtgggcatcgacggcgcaaatccagtcgagttgctggctatggccggctcctcagataagtacttcttcgtagaaactttcggcggactgaaggggatcttcagtgatgtgacagctagcgtatgtaattccagcaaagtcgactgcgagatcgataaagtggatctggtgtttctgatggatggtagcaccagcattcaaccaaatgactttaaaaaaatgaaggagtttctcgcctctgtcgttcaggatttcgatgtgtcactaaatagggtgcgcatcggagccgcacagttttccgatacttatcatcccgaattccccctggggacatttatcggggaaaaggaaatttctttccagatcgagaatattaagcagatcttcggcaacacacatatcggtgctgctctgagggaggtggagcactatttcagacctgacatgggctctcgcatcaatactggaacgccccaagtgctcctcgtgctgactgatggacagtctcaggatgaggtggcacaggcagctgaagccctgaggcatcggggcattgacatctattcagtggggataggggatgtcgacgaccaacaattgattcagatcacggggaccgctgaaaagaagttaactgtccacaatttcgacgagctgaagaaagtgaataagagaattgtgcgcaatatttgcaccaccgccggagagtccaattgctttgtggatgtagttgttgggttcgacgtctctacccaggagaaaggacaaacgctattagaaggacaaccctggatggagacctatctacaggatatcctccgggcaatctcatcactgaatggagtgtcctgtgaagtgggaacagagacgcaggtttccgtggccttccaggtaaccaatgctatggaaaagtactctccaaagttcgaaatttatagcgaaaatatcctgaatagccttaaagatattactgtaaaaggtccaagcttgttaaacgccaacctcctggactctctctgggacacattccagaataaaagcgcagctcgaggtaaagtggtacttctcttcagcgacggattggacgatgatgttgaaaaattagagcagaaatctgacgagctgcgaaaagagggactcaacgccctgatcacagtggccctcgacggcccagccgactcatccgatctggcagatctgccgtatatcgagttcggcaaagggttcgagtatagaacgcagctatctattgggatgagagaattggggagccgactctccaagcagttggtgaacgtggccgagagaacctgctgctgcttattctgcaagtgtattggcggggacggcacaatgggcgatcctgggccaccaggcaagcggggcccccccgggtttaaaggcagcgagggatacctgggcgaagaagggattgccggcgagcggggagctcctgggcccgtaggggaacaaggaacgaagggttgttatggcaccaaaggcccaaagggaaatcgtggtctgaacgggcaggagggtgaggtgggggaaaacggcattgatggccttaacggggaacagggcgataacggactgcccggtagaaaaggtgagaagggcgacgagggttcccagggttccccgggcaaaagggggactcctggggaccgtggcgctaaaggtctgaggggggaccctggggctccgggcgtcgactcaagtattgaggggcctacaggtctgaagggagagagggggagacagggaagaaggggatggcctgggcctccaggcacacccggcagcaggcggaaaactgccgctcatggacgcaggggtcatacgggtccccagggcactgccggaattccagggccagatggactcgagggatctctgggactaaaggggccgcaggggcctagaggcgaagccggggttaagggcgaaaaaggtggtgttggctcaaaaggacctcaagggcctccaggccccggtggcgaggcggggaaccaaggtcggcttgggtcccaggggaacaagggagagccaggagacctgggagagaaaggcgccgttggttttccggggcccagggggctgcaaggaaacgacgggtccccgggttacggatcagtggggcgcaagggcgctaagggacaggagggttttcccggggagtctggccctaaaggagaaataggagatcctggggggccaggcgaaactggtctgaagggcgctcgaggcaaaatgatcagtgctgggctaccaggagagatgggaagtcctggtgaaccaggaccacctggtcggaaaggggtgaaaggagcaaagggattggcgagcttctcgacgtgcgagctgatacaatacgtgagggaccgttcacctggccagcaccggaagcctgagtgtcccgttcacccaaccgagctggtgtttgccctggaccattctcgagatgtaactgaacaggagtttgaacgcatgaaagaaatgatggccttcctggtgagggatatcaaagtcagagaaaatagttgccccgtgggcgcacatattgctattctgtcctataatagtcacgctagacatctggtcagattctcagacgcttataaaaaaagccagttgttgagagaaattgagacaatcccgtatgagagaagtagcgcaagtcgggagatcggccgggctatgcgctttatctcgagaaacgtgttcaaaagaaccctgcccggcgctcacacccgcaagatagcgacttttttcagctccgggcagtccgctgacgcccacagcattactactgctgctatggagttcggcgccctggagataatccccgttgtgatcacattctcaaacgtgccctctgtaagacgcgccttcgctattgatgatacaggaacttttcaagtgattgtcgtgccaagtggagctgattacatccctgctctcgagcggctgcaacggtgcactttctgctacgatgtttgcaaacccgatgcatcttgcgaccaggctaggcctccccccgtccagtcatatatggatgctgctttcctgctcgatgcatcacggaatatgggctccgcggagtttgaggacatccgagcattccttggagcactgctcgaccacttcgagattacaccagagcccgagacttccgtaactggagacagggtggccctcctaagccatgctcctcccgactttctccctaatacacagaaatctcccgtgcgggccgagttcaacctaacgacctaccggtcaaaaagactaatgaaacgccacgtacacgagtccgtcaagcagctcaatggcgatgccttcatcggtcacgctctccagtggaccctagataatgtattcctgagcacacctaacctgcgacgaaataaagtaattttcgtgatcagtgccggcgaaacctcacatcttgacggggaaatcttgaagaaggagtccttaagagccaagtgccaggggtatgcactcttcgtctttagtttgggtcctatctgggacgataaggagctcgaggatctcgcctcccaccctctggaccaccacttggttcagttgggcaggattcacaagcctgatcacagctatggggtgaagtttgtcaagtctttcattaatagcattagaagggccatcaacaagtatccccctatcaaccttaaaattaagtgtaaccgactcaactctatcgatcctaaacaaccaccaagaccattcagatcctttgttcccggccccctaaaagccactttgaaggaagacgtcctccagaaagcaaagttcttccaagacaagaaatacttgtcccgcgtggctcggtccggcagggatgatgcgatccagaacttcatgaggtccacctctcatacctttaaaaacggccgaatgattgagtcagcgcctaagcagcacgactag

SEQ ID NO: 3983 - DNA, 2112 bp, Artificial Sequence
  Description of Artificial Sequence: Synthetic coding sequence
atgctgggcaccctgacccccctgagcagcctgctgctgctgctgctggtcctggtcctcggttgtggcccgcgtgcctccagtgggggaggcgccggtggagccgctggttacgctcctgtgaaatatattcagccaatgcagaaggggccagttggcccccccttccgggaaggcaaaggtcagtatctggagatgccgcttccactactgccaatggatctgaagggcgaacccggcccacccggcaagcctggacctagaggacctccggggccccccggatttcccggcaagccgggcatgggaaaacccggcctccacggtcagcctggccccgccgggccacctggtttttccagaatggggaaggctggcccacccggcttacccggaaaggtgggcccaccagggcaacccggcctaaggggcgaacccggcatcaggggagaccagggcttgcggggacccccaggcccccctggccttccggggccaagtggcatcaccattcccggtaagccaggggcccagggcgtcccgggccctccgggctttcagggagaacctggcccccaaggtgaacccgggccacctggagatcggggtctcaagggcgacaatggcgtgggccagccgggcttacctggggctcccgggcaggggggagcccctggacctccaggtcttcctggcccggccggtctgggaaaacccgggcttgacgggcttcccggagcaccaggcgataaaggagaatcaggtcccccaggtgtgccggggccccgcggtgagccaggcgcagtaggaccaaaggggcctcctggcgtcgacggtgtgggtgtgccgggtgccgcggggcttccaggaccacagggcccctcaggcgcaaagggagaaccgggcacccgggggccgccaggccttatcggacccactggttatggtatgcccggactgcccggtccgaaaggcgaccggggcccagccggcgtgccgggcctactgggcgatagaggcgagcctggggaagacggcgaaccaggcgagcagggcccgcagggcttaggcgggcctcccggcctgcctggatcagccggcctgccaggtcgtaggggaccacccggccccaagggcgaagcaggtccaggtggccctcccggggtgcccggcatccgcggtgaccagggcccaagtggactcgctgggaagcctggcgtgccaggcgagcgcggcctccctggcgcccacggacccccaggccctactggcccaaagggtgaacctggattcacaggtcgccctggcggtcccggcgtggcaggagcacttggtcaaaagggcgacctcggtctgcctgggcagccagggcttcggggaccgtcaggaattcccggcctccagggcccggcaggcccaatcggcccccaggggctgcctggcctgaagggggagcctggcctgcccggcccacctggggaggggcgcgccggcgagccgggcacagcgggcccaactgggccgcctggagttccaggctctcccgggatcactggaccgccggggcctccaggaccacctggacccccgggcgctcccggggccttcgacgagaccgggatcgccggactgcatctgcctaatggtggagtggagggggccgtcctgggaaagggagggaaaccccagtttggcctgggagagctgagcgctcatgccactccggccttcaccgcagtgctgacctccccgtttcccgccagcgggatgccggttaaattcgacagaacactatataatggacatagtggctacaacccggctacggggatcttcacgtgtcccgtcggaggcgtttattacttcgcctatcacgtccatgttaaaggaactaatgtgtgggtggccttgtacaagaataatgtcccggctacttacacttacgacgaatacaaaaaggggtacctggatcaagcttccgggggagcggtgttacaattaaggccaaatgaccaagtatgggtgcagatgccatcggatcaggccaacgggttatattccactgaatacatacacagctccttctctggtttcttgttgtgcccaacatag

SEQ ID NO: 3984 - DNA, 1284 bp, Artificial Sequence
  Description of Artificial Sequence: Synthetic coding sequence
atgctgggcaccctgacccccctgagcagcctgctgctgctgctgctcgttttagttctcggctgcgggccccgggcttcgagcggggggggcgctgggggcgccgccgggtatgcccctgtcaagtacatccagcctatgcaaaaaggccctgtgggcccgccttttagagaaggcaaaggccagtacctcgagatgcctctgccacttctccccatggaccttaaaggcgaacctggcccacccggcaagcccggccctagaggccccccaggaccgcctggatttcccggaaagcctgggatggggaagcctggactccacgggcagcctgggcccgctgggcctcctggattttccaggatgggaaaagccgggccccccggcctccccgggaaggtgggaccccccggccaacccgggctgagaggtgagcccggcattcggggagatcagggcttaaggggccctcccgggcccccgggtttacccggccctagcggaatcacgatccctggaaagcctggagcccagggggtgcccgggcctccgggattccaaggcgagcccgggccacagggcgaacctggaccacctggggatagggggcttaagggcgataacggcgttgggcaacccggcctccctggtgctcctggccaggggggcgcccccgggcctcctggtctgcctggacccgctggtctcggcaaacctgggctcgacgggctccccggcgcccctggtgataagggggaatccggcccccccggcgcattcgacgaaacaggaatcgcaggactacatttgcctaacggcggtgtggaaggcgcagtgttggggaaggggggaaagcctcaatttgggctaggagaactaagcgctcatgccacacccgcattcactgctgtgctgacttctcctttccccgctagtggcatgcccgtcaagttcgatcgaaccctgtacaatggccattctggctataatccggccacaggcatcttcacatgtccagtaggcggggtgtactacttcgcctatcatgtgcatgtaaaggggacaaacgtatgggttgctttgtataaaaataacgtccccgctacatacacctacgatgagtacaagaaagggtatctcgaccaggcctcaggaggcgctgtcctgcagttaaggcctaacgatcaggtttgggtgcagatgccctcagatcaggcaaacggcctgtatagcaccgagtacatccattcaagctttagcggttttttactttgtccaacatag

SEQ ID NO: 3985 - DNA, 2112 bp, Artificial Sequence
  Description of Artificial Sequence: Synthetic coding sequence
atgctgggcaccctgacccccctgagcagcctgctgctgctgctgctcgtgttggtactgggctgtggcccaagagcctcaagtgggggaggcgcgggaggcgcggctggatacgcgcccgtgaaatatattcagccaatgcagaagggcccagttgggccgccattcagggaaggcaaggggcaatacttagaaatgccgttgcccctgttaccaatggacctcaaaggagagcccgggcctccaggcaaacctggcccaagggggccgcccggaccgcccgggttccctgggaagcccggaatgggcaagcctggtctgcacgggcagccaggccctgccggccctccgggcttcagtcggatgggcaaagccggcccccccggcctgcccggaaaggtcggaccacccggtcagcctggtctccgaggggaaccggggattagaggggatcagggcctgcggggacctcctggaccccctggcctaccaggcccttcggggatcacaattccggggaagcccggagctcagggtgtccctggaccaccagggtttcagggggagcctgggccccaaggcgagcctgggccccctggggacagaggccttaaaggggataacggagtcggtcaaccaggtcttcctggggcccctggacagggcggagcacctgggcctccgggcctgcccggtcccgctggtcttggaaagccaggcctggatggactgcccggggccccaggagacaagggggagagtggacctccaggtgtgcccggccctaggggtgagccaggcgccgtaggaccgaagggtcctccaggggtggatggggtgggtgtgccgggggccgctgggctacccggaccgcaagggccttccggggcgaagggagaacccgggacccgcggaccacccggcttaattggtcctactggctacggtatgccggggctccccggcccgaaaggtgatagaggaccagccggcgtgcccggcttgttgggtgaccggggcgaacccggtgaggatggtgaacctggagagcagggtccccaaggactaggggggcctcctggtttaccaggcagtgccggcctgcccgggcgccgtggaccaccaggaccaaaaggagaggcaggccctggtggtccaccgggggtgcctggaattaggggagaccaaggcccctccggacttgcagggaaacctggggtgcctggcgagcggggtcttcccggcgcacatggcccacccggacctactgggccaaagggcgagcctggcttcacaggccgcccaggaggacccggggtcgcgggcgctctcggacaaaaaggggacctgggcttgccaggccagccagggctgcgaggcccatccgggatccccggactccagggaccagcaggaccaattgggccgcaaggtctcccgggtcttaaaggtgaaccgggactgccggggccccccggagaaggtcgggccggggaacctggaacagccggccccacaggtccccccggggtgcctggatctcccgggatcacaggaccaccgggacctccaggtcctcctggtcccccaggagcccccggcgcattcgatgaaacaggcatcgcaggactgcatctccctaatggaggcgttgagggagctgttctaggcaagggtggcaaacctcagttcggtctcggggagctgtccgcccacgcaacgccggccttcaccgctgtgctcacttcgcccttccctgcaagtggaatgccggtaaagtttgatcgtactttatataacggccactccgggtataatccggcgaccgggatcttcacgtgtcctgtcggcggcgtatactatttcgcctatcacgttcatgtgaaaggcaccaacgtgtgggtcgccctgtacaagaataacgtgccagcaacatatacatacgatgagtataagaaagggtacttggatcaggcctccggaggagccgtcttacagctccggcctaacgaccaggtgtgggtgcagatgcccagcgaccaggcaaatgggctttacagcaccgaatatattcactcctctttttctggctttttactctgtcccacttag

SEQ ID NO: 3986 - DNA, 1917 bp, Artificial Sequence
  Description of Artificial Sequence: Synthetic coding sequence
atgcccctgcccctgctgcccatggacctgaagggcgagcccggcccaccgggcaaaccaggtccgcgtgggccaccaggacccccgggcttccccggaaaacccggaatggggaagcctggtctgcatggacagccaggcccagctgggccccccggtttcagtagaatgggaaaagctggtccgcccggcctgccaggtaaagtgggcccccccggacaaccaggtctgagaggggaaccgggcattcgcggggatcagggcctgcgagggcctcctggaccgccaggactccccggaccctccggtatcaccatcccaggcaagcccggtgcacagggcgtccctggacctccagggttccaaggagaaccaggaccgcaaggggagccaggacctcccggcgaccgcggcctgaagggggacaacggcgtcgggcagcctggtctgccaggggctcccggacagggcggagccccagggcccccagggctcccggggccggccggcctgggcaaacctgggttagatggcctgccaggtgctcccggcgacaagggggaatctggaccacccggggtccctgggccccgaggtgagcctggagccgtgggacccaagggaccacctggggtagatggcgtgggggtcccaggtgcagctggactgccaggaccacagggtccatctggggccaagggggagccggggaccaggggaccccccgggctgatcggccctaccggatacggcatgcctgggctccccggtcctaagggggatcggggacctgccggagttcccggactgcttggggatcggggcgaacccggagaggacggcgagccaggagaacagggccctcagggactggggggtccccctgggctcccaggtagtgccggtttgccagggcgacgtggcccacccggaccgaagggtgaagccggacctggtgggcccccaggagtgcccggcatccgtggcgaccaggggcccagcggactagcgggaaaacccggagtcccaggagaacggggcctcccaggagcccacggccctcccggccccacaggtcccaaaggagagcccggcttcaccggtcggccaggtggtcctggcgttgccggagccctggggcagaagggagatctggggttgccgggtcaacccggcctgagaggacctagcggcattccaggcctacaaggtccagccggccccattgggccccaggggctccccggcctgaagggtgaaccaggactgccagggccgcccggagaaggcagagctggcgagccgggcactgcgggaccaaccgggcccccaggcgttcccggctcccctggaatcaccggcccacctggaccacctgggccgccagggccccccggggctccgggcgccttcgacgagactggtatcgcaggcttacatctgccaaacggtggcgtagaaggagccgttctgggcaagggcggcaagccccagtttggtctcggtgagctctctgcccatgctacacctgcttttaccgctgtgctaacgagtccgttccccgcgtccgggatgcctgttaaattcgatcgcacactctacaatggtcacagcggctacaatcctgctaccggcatttttacgtgccccgtagggggagtttattactttgcgtatcacgtccacgttaaaggcacgaatgtatgggtcgcgctgtacaagaacaacgtgccggccacatatacttacgacgagtacaagaaaggatatctcgaccaggctagcgggggcgcggtcctgcagcttaggcccaatgatcaggtgtgggtacagatgccctccgaccaggcaaatggcttgtattcgaccgagtacatacacagttcgttttccggctttcttctctgccctacctag

SEQ ID NO: 3987 - DNA, 2043 bp, Artificial Sequence
  Description of Artificial Sequence: Synthetic coding sequence
atgctgccccagatccccttcctgctgctggtgagcctgaacctggtgcacggagttttctacgcagaacgataccaaatgccaaccggcatcaaaggtcctctgcctaataccaaaactcaattttttatcccgtatactatcaaatccaagggcatagctgtcaggggagagcaaggcactcctggacccccgggccccgccggccccaggggacaccctggcccctctggaccacctggaaagcctggttatgggtcacccgggctgcagggggagccaggccttccgggccccccgggcccctccgccgtgggcaagccgggtgtgcctggcctgccaggcaagcccggggagaggggaccctatggtcctaagggtgatgtcgggccagcaggactccctgggccacgaggccctcccggcccccctggtattccaggtcctgccggcatctctgtcccaggtaaaccaggacagcaagggcccacaggcgcccccggacctcgcggattccctggagagaaaggcgctcccggagttcccggaatgaacggccagaagggagaaatgggatacggggcccccggtagaccaggagagaggggactccccggcccacaaggtcccacaggcccgagcggacccccaggggtgggcaagagaggcgagaacggggttccaggacagcctggaattaaaggagaccgtggtttccccggagagatgggcccaataggaccccctggccctcaggggcctccgggtgagcgcggccccgaaggcatcggaaaacctggggccgctggcgcccccggccagcccggcatacctggaactaagggcctccccggggcaccaggaatagccgggccgcccggccccccgggcttcggtaagcctggtctcccaggcctcaagggagagagggggcccgcaggacttcccgggggcccaggtgcgaaaggagagcagggccccgccgggctgccaggaaaaccgggcctcaccgggccgcctggaaatatgggcccccagggtcctaaaggcattccggggtcccacggattgcctggacctaagggggaaacaggccccgcaggccctgccgggtaccctggggcgaaaggagagcgaggctcacccggaagcgacggcaagccaggctatcccggcaagcctggactggacgggccaaaaggcaatccggggttaccaggaccaaagggggatcccggcgtaggcggccctcccgggttgccaggaccagtggggcccgccggcgcgaagggaatgccaggccataatggagaagccggaccgcggggggctccaggaattcccggaacgcggggcccgatcggcccgcccggcattccaggctttcccggctccaagggcgacccggggtctccaggacccccagggcccgccggcatcgcaacgaagggcttgaatggccccaccggaccacccggtcctcccggccccagagggcactcgggggaaccagggctccctggaccgcccgggccccccggtccccctggtcaggctgtgatgccagagggcttcatcaaggccggtcagagaccttccttatccgggacacctttggtgtctgcgaaccaaggcgtaactggcatgcccgtttcagcgttcaccgtgatcctttctaaagcctacccggccattggcaccccaatccctttcgataaaatcttgtacaacaggcagcagcattacgatcccaggacgggtatcttcacctgccaaattcccggaatttattactttagctaccacgtccacgtgaagggcacacacgtctgggtgggcttatacaagaatgggacacccgtaatgtacacttatgatgagtacacaaaagggtatctagatcaggcctctggcagtgcgatcattgacctcacagagaacgaccaggtgtggctgcagttgcctaacgccgaatcaaacggactgtattcctccgaatacgtccattcaagtttttctggcttcctggtcgccccgatgtag

SEQ ID NO: 3988 - DNA, 2043 bp, Artificial Sequence
  Description of Artificial Sequence: Synthetic coding sequence
atgctgccccagatccccttcctgctgctggtgagcctgaacctggtccacggggtcttctatgccgaacgttatcaaatgcccactggaataaaggggcctctgcccaacactaagacacagtttttcattccatatacgatcaaaagcaagggaatcgccgtgagaggagaacagggaacaccagggcccccaggcccggccggcccccggggccatccaggaccatccggaccgccgggaaagcctggttatggttccccggggctccagggggaaccggggctccccggtcctccggggccatcagcagtaggtaagcctggggtgccggggctgcccggtaaacccggggagagaggtccatacggacccaagggagatgtgggcccagccgggctccctggccccagaggccccccaggacctcctggtattcccggacctgccggaatcagcgtgcccggtaagccagggcagcagggccctactggggcgccaggaccacggggattccccggcgaaaagggggcacccggagtacctggaatgaacggtcaaaaaggtgaaatgggatacggagctccaggccgccccggcgaaaggggtctaccagggcctcagggacccacgggtccctcagggccaccaggcgtcggaaagagaggtgaaaatggtgtgcccggacagcccggcattaagggggatcgaggattccccggagaaatgggccctattggaccgcccggcccccaaggtccaccaggagaaagagggcccgagggcattgggaagcccggcgctgctggcgcccctggacagcccggtatccccggaacaaagggactccccggggctccaggcatagccgggccccctggtcctccggggttcgggaagcctggcctaccggggctcaaaggcgagcgtggtcctgcaggactgcctggaggccctggtgcaaaaggcgagcaggggcccgccgggctgccagggaaacccggcctgacagggcctcctggcaatatggggccacaggggccgaagggcattccaggctctcacgggcttcctggacctaagggagagacaggtcccgcgggaccggcagggtatcctggggcaaagggagagcgaggtagtcccggatccgacggaaagcctggttaccctgggaagcccggactggatgggcccaagggaaacccaggtctgcctggccctaaaggggatcccggggtcgggggacctccaggcctgcccgggccagtgggtcccgccggggccaagggaatgcccggtcacaacggggaagctgggcccaggggcgctccaggtatccctggcaccagggggccgatcgggccgcccgggatcccaggatttccgggctctaaaggcgatcctggatcccccggccctccggggcctgctggcattgccactaagggattgaacggccctactgggccacctggccccccagggccacggggtcactcaggggagcctggcctacccggaccaccaggtcctcccggaccacccggtcaggccgtcatgcctgagggcttcattaaggccgggcagaggcctagtcttagcggcacccccctggtctcagctaaccagggtgttactggcatgcccgtatccgccttcactgtgattctatctaaggcctaccctgccatcggaacacccatcccttttgacaagattttatataatcgacagcagcactacgacccgcggacaggtatattcacgtgccagatccccggcatttactatttctcttatcatgtgcacgtgaaaggcacccatgtctgggtggggctttacaagaacggaacaccagtgatgtatacatacgatgagtataccaagggctatttggatcaggcctcagggtccgccatcatagatttaaccgagaacgaccaagtttggctccagttgcccaatgccgaatccaacgggctgtacagcagtgaatacgtgcattcatcattttctggctttctggtagctcccatgtag

SEQ ID NO: 3989 - DNA, 156 bp, Artificial Sequence
  Description of Artificial Sequence: Synthetic coding sequence
atgctgccccagatccccttcctgctgctggtgagcctgaacctggtccacggggttttttatgcagagaggtaccagatgcccaccgggattaagggtcccctacccaacaccaagacgcaattttttattccttataccattaagagcaaatag

SEQ ID NO: 3990 - DNA, 651 bp, Artificial Sequence
  Description of Artificial Sequence: Synthetic coding sequence
atgctgccccagatccccttcctgctgctggtgagcctgaacctggtgcacggcgttttctatgccgagagataccagatgccaaccgggattaagggtcctttacctaataccaagacccagttctttatcccgtataccataaagtcaaaggggatcgccgtaaggggagagcaaggcacccctgggccccctggcccagccggccctcgcggtcaccccggacctagcggcccaccaggcaagccagggtatggtagcccaggactgcagggcgagcccggattgcccggacctcccggccctagtgccgtcggtaagccaggcgttcctgggctaccggggaaaccaggagagcgaggtccatacgggccaaagggcgatgtgggtccagccggcctgccaggtccacgcggacctcctgggccgcccggcatccctggcccagctggaatttccgttccaggcaagcctgggcagcagggtccaacaggcgctcctgggcccagaggatttcccggtgagaaaggtgcacccggcgtgcctggcatgaacggccagaaaggggaaatgggatacggtgctccagggcggcctggtgagcgggggctgccagggccccagggccccactgggccatccgggccatag

SEQ ID NO: 3991 - DNA, 5211 bp, Artificial Sequence
  Description of Artificial Sequence: Synthetic coding sequence
atggagcggtgcagccggtgccaccggctgctgctgctgctgcccctggtgttaggcctatccgctgcaccaggttgggctggggccccgccggtggacgtgctaagggcgttgcgattcccctctctcccagacggagtgcgtagggcgaaaggcatctgtccggcagatgtggcataccgagtggcccggcccgcacagctcagtgctccaactcgacaactgttcccggggggtttccctaaggactttagcctattgacggtggtccgtacaagacccggtctgcaggctccacttctcacactgtattctgcacagggcgtcaggcagctagggttagagctgggacgccccgtgcgatttctctatgaggaccagaccggacggccacagccccccagtcagcccgtctttaggggactctctctagcagatggcaagtggcaccgggtggctgtcgccgtgaagggccagagtgtcacacttattgttgactgcaagaaaagagtgactagaccgctgccgcgatcagcccgcccagtgttggacacccacggcgtaataatattcggtgccaggattctggatgaagaggtctttgagggcgatgtccaggagctggcgatcgtacctggtgtgcaggccgcctacgagtcctgcgaacaaaaagaactggaatgtgaggggggccagcgggaacgtccccagaaccagcagcctcaccgtgcacagagatccccccagcagcagcctagtcggctccatagacctcagaatcaagaaccccagagccaaccaactgagagcttatactacgattatgagccaccatattacgatgtaatgaccacaggaacaacccccgactaccaagatcctaccccgggcgaggaggaagagattctcgagagcagtttgttaccaccactcgaagaagaacagacagacctccaggtgccaccaaccgctgacaggttccaggctgaagaatatggagagggaggaacagatccacccgaagggccctacgactacacttatggctatggagacgactacagggaagaaaccgaactgggacccgcactgtctgcagaaactgctcactcaggggccgcagctcatggtcctcgaggactgaagggcgaaaaaggggagcccgccgtgttggagcctggtatgctcgtggagggccctcccggccccgaaggtcctgccggtcttatcggcccccctggcatacagggtaatcctgggcccgtcggagatcccggagaacggggcccgcccggccgggccggactacccggtagcgacggggcccccggccctccagggacctcactgatgttaccctttagatttgggagcggtggcggcgacaagggccctgttgtggctgcccaggaggcccaggctcaagcaattttacagcaggcgcggttagctttacgaggccccccaggccccatggggtatacagggaggccgggaccactgggtcagccagggtcccctggattaaagggcgaaagcggcgatctcggaccccagggccctagagggccccagggtctgaccggtccccctgggaaggcaggccggaggggtagagccggcgcagatggagctcgcggaatgcctggcgatccgggtgtcaagggggaccgtggcttcgacggactgccaggcctgcccggagaaaaaggccaccgtggggacacaggggctcagggcttgccaggtccacccggcgaagacggagaacggggcgatgacggcgagatcggaccacgggggctaccaggagaaagcggtccaaggggactgttggggccaaaagggcctccgggtatacctgggccgccaggtgtccggggaatggatggccctcaggggcccaaaggctctctgggtccgcaaggtgaaccaggaccgcctggccagcagggcaccccgggtacacagggacttcctggcccccagggagccattgggccccacggggagaagggaccccagggcaagccagggctgccaggaatgcctggaagtgatgggcccccggggcatcccggaaaggaaggccccccaggtacaaaaggcaaccagggcccatccggaccgcagggccccctggggtatccaggtcctcgcggagtaaagggagttgacggaatcaggggcctcaagggccataaaggcgaaaaaggagaagacggattcccaggtttcaaaggagatattggcgtgaaaggagatcgcggggaggtcggtgtccctggtagcaggggcgaagacggacccgaaggcccaaaggggcggactggtcctactggtgatcccgggcctccaggactgatgggagaaaaaggtaaactcggagttcctgggttgccaggatacccagggcgacagggacccaagggctctctcgggtttcccggtttccccggagccagcggggagaagggtgctagggggctaagtggcaaaagcggccctagaggagagcggggtcctaccggtccacgggggcagcgagggccacgcggcgctactggaaagagcggagcaaagggcacgagtgggggcgacggcccccacggccctcccggggagagggggcttcctgggcctcagggaccaaacggttttcctggcccgaaagggcctccaggaccgccaggaaaggacggtctgccagggcaccctggtcaacgcggagaggtgggctttcaggggaagaccggacctcccggtccccccggagtggtggggccacaaggggcagctggcgaaacgggccccatgggcgaaaggggacaccctggcccgccaggaccgcccggtgaacaggggctgcccggcaccgcagggaaagaagggacaaaaggtgatccaggtccaccaggagcacctggtaaagacggccctgctggactgaggggttttccaggcgaacgcggccttccaggcacagccgggggcccaggcctgaaaggcaacgagggtccctccggacccccggggcccgctggaagccccggggaaagaggagctgccggatccgggggacctatagggccccctgggagacccgggccgcaggggccacctggcgccgccggcgaaaaaggcgttcccggagaaaagggacccatcgggcctaccggcagagacggggtgcaggggccagtaggattacccggacctgccggtccgcccggcgtggcgggagaagacggagacaagggcgaagttggggacccgggtcaaaagggaaccaaaggaaataagggagaacatggcccgcccggtccaccagggcctataggtcccgtcggacagccaggagccgccggcgctgacggcgagccaggcgcgcggggacctcagggccactttggggccaagggagacgaaggcactcggggctttaatggcccacccggcccaatcggcctgcagggtctccctgggccatcgggggagaagggggaaaccggagatgttggaccaatggggccaccagggccccccggaccccggggtccagccgggcctaatggagcagacggaccacaaggcccccccggcggagtggggaatctcgggccaccaggagagaagggcgagcccggagagtctgggagtccaggcattcagggtgagcccggggtaaaaggtccacggggagaacgcggtgagaaaggggagtcaggacagccaggggagccgggacctcctgggccaaaaggacctaccggcgatgacggtccaaaaggcaatcccggccccgtagggtttcccggggatccaggtcccccaggagagggtggccctaggggccaggacggagcgaaaggtgaccgaggcgaggacggagaacctggccaaccaggatcaccgggtccaacgggggagaacggtccaccaggtcccttagggaaaaggggaccagcgggaagccctggatccgagggacgccaggggggcaagggggccaagggagacccaggcgccattggggcccccggaaaaacaggacccgtcggacccgcaggtcctgctgggaagccaggccccgacgggctcagagggctgccaggctctgtagggcagcaaggcagacccggggcgactgggcaggcaggtccacctggtcccgttggccccccagggctaccagggttgcggggggacgccggcgcgaagggagaaaaggggcaccctgggctgatagggctgatcgggccccctggagagcaaggcgaaaaaggtgatagaggcctccctgggccccagggctcccccggtcaaaaaggggagatgggaatccctggtgcatcgggtcccatcggccccggcggcccacccgggctgcccggtccagctggacctaagggagccaagggcgctacagggccggggggccccaagggagaaaagggggtacaaggacctcctggccaccccggtcctcctggcgaagtcatacagcccctgccaatccaaatgcctaagaaaactcgaagaagtgtggacggcagccgcctgatgcaggaagacgaagccattcccacaggtggcgctccgggaagtccgggcggccttgaggaaatttttggcagcctagacagtttgcgggaagaaattgaacagatgcggcgtccaactgggacgcaggattcccccgctaggacatgccaggatctgaagctttgtcaccccgaactacctgatggagagtactgggttgaccccaaccaggggtgcgcgcgggacgcgttccgggtgttttgcaacttcacggcgggaggcgagacttgtgttacacctcgcgatgatgtaactcagtttagctacgtggatagcgagggctcccccgtgggcgtggtgcagctgactttcctccgcctgcttagcgtatcggcccaccaggatgtttcatatccctgtagcggggccgcccgcgacggaccactccgtttaaggggcgcgaatgaagatgagctcagtcccgagacatccccttatgtcaaggagttccgcgacgggtgccagacgcagcaggggcgtacggtcctcgaagtcaggacccctgtactcgagcagctgcccgtgctagatgctagtttcagtgacttaggcgcaccacctaggcggggtggcgtgctgctgggaccagtttgctttatgggttag

SEQ ID NO: 3992 - DNA, 5148 bp, Artificial Sequence
  Description of Artificial Sequence: Synthetic coding sequence
atggagcggtgcagccggtgccaccggctgctgctgctgctgcccttagtgctgggcctgtcagctgcccctggttgggctggcgctcctcctgtggacgttctgcgggcacttagatttcctagcttaccggatggagttagaagagcaaagggcatttgtccagccgatgtcgcctaccgggtggctcgccctgcacagcttagcgctccaacaaggcaactttttcccggaggctttccgaaggacttttcactgctgaccgttgtgcgcacgagacccggcttgcaagcgccacttctgactttgtacagcgcccagggagttcggcagcttggccttgaactcggaaggcccgtacgtttcctctacgaagaccagaccggacgccctcaacccccttcacagcctgtgttcaggggcctgtccctggcggacggcaagtggcatagagtagccgttgccgttaagggccaaagtgtgacactgattgtggactgtaagaaaagggtaacgcgacccctgcccaggtccgcacgaccagtattagatacccacggggtgattatcttcggcgctcgtatcctggatgaagaagtatttgaaggggacgtgcaagagctggcaattgtgccaggggtccaggcagcatatgaatcctgtgagcaaaaggaattggaatgtgaaggcggtcaacgagagcgacctcagaatcagcagccacatagagcccaacgcagcccacaacagcagccttctcggttgcataggccccagaatcaggaaccccagtctcagccaacagagagtctctattatgattatgaacccccatactacgatgtcatgacaactggcacaactcctgactatcaggaacagaccgaccttcaagtgccacccaccgctgaccgctttcaggccgaagagtatggcgagggcggaactgaccctcctgagggcccctacgactatacttacggctacggggacgactaccgtgaagagaccgaactgggccccgctctgtcagcggagactgctcactccggagccgcagcgcacggaccaagaggactgaagggagagaaaggtgagcccgccgtgctggagcccggcatgctagtcgaggggcccccgggtcctgagggcccagcaggtctaatcggccctccggggattcaaggtaatcccggtcctgttggcgaccccggcgagcggggaccacctggccgcgccgggctgccggggtccgatggagcccccggtccacccggaaccagcctgatgctgccgtttagattcggctccggtggtggcgataaaggacctgttgtagccgcacaggaggcccaggcgcaggccatattgcaacaggcgcgactcgcgctgaggggccctccgggccccatgggttacactggccgtcctggtcccttagggcagcctgggtccccaggtctcaaaggggaaagtggggacctggggcctcagggccctcggggccctcaggggctgacaggaccccccggaaaagctggaagaagaggtagagcgggcgcagatggtgcaagggggatgcctggcgacccgggggtgaagggagacaggggtttcgacgggcttccaggcctgcctggagaaaaaggccatcggggtgataccggcgcccagggactgccaggcccacctggggaagatggggaaagaggggacgacggcgaaatcggcccccggggcctgccgggagaaagtggaccacgtggactgctcgggcctaagggcccgcctggaataccaggcccgcccggagtgcggggcatggacgggcctcagggccccaagggcagtctggggccccagggagaaccaggacctcccggtcaacaggggaccccaggaacgcaaggactccccggccctcagggcgcaatcggtcctcacggtgagaaagggccccaggggaagccaggtctgcctggcatgccaggctccgatggtccacctggacatcctggcaaggagggtccccctggcaccaagggaaaccaggggcctagcggaccccagggacctctgggttaccccggaccaaggggcgtgaagggagttgatggcatccggggacttaaaggtcacaagggagaaaagggcgaagacggctttcctggattcaaaggcgatatcggcgtgaagggtgaccgaggcgaggtgggagttccaggtagccgcggcgaggatggcccagaaggccccaaaggccgcaccggcccgactggtgatccagggccacctggtttgatgggagaaaaggggaagctgggcgtgccaggtttacctggctacccaggccggcaaggtcctaaaggatctttgggtttccccggcttcccaggagcttctggcgagaaaggggcccggggcctatctggtaaaagcgggccaagaggggagcgcggccctaccggaccgcgggggcagcgtgggcccagaggcgccacaggcaagtctggcgcgaaaggaacatcaggcggagacggtccacacgggccaccaggtgagcgcggcctcccgggaccacagggccccaatggatttccgggcccaaaaggcccgccgggaccgcccgggaaggatgggctgccagggcacccaggccaacggggagaggtgggctttcaaggcaaaactgggccaccgggcccacccggtgtagtgggcccacagggggccgcgggcgaaacaggtcctatgggcgaaagagggcacccgggaccccccggacctcccggtgaacaggggctgcccgggacagccggtaaggaagggacgaagggggatcctggacctccgggtgctcccggaaaagatgggccagccgggttacgcgggttccctggcgagagagggctaccgggaaccgcgggcgggccaggcctcaaaggcaatgagggcccttcgggacctccaggccctgccgggtctcctggagagagaggagccgcaggctccggcggtcctatcggtccacctggccgccctggaccacagggacctcccggggcagcaggcgagaagggcgtgcccggggagaagggacccatcggccccaccgggcgtgatggcgtgcaggggccagtcggactgcccgggcccgctggcccgccaggagtggcgggagaagacggagacaagggtgaagtcggtgatcccggacaaaaggggaccaaaggaaacaagggtgagcatggtcctcctgggccacccggccccattggacccgtcggacagcccggcgctgcaggtgcagatggcgagccaggggcccggggtccacaaggccatttcggcgccaagggagatgaagggactcggggattcaacggaccaccgggaccaatcgggctgcagggtttgccaggacccagcggcgagaaaggcgaaaccggggatgtcggtccaatgggacccccaggaccccctggccctagaggccccgccggtccaaatggcgccgacgggccccagggaccacccggaggagttggcaatctgggtccccctggcgagaagggggagcccggggagtctggttctcccggcattcaaggtgagcctggggttaagggtcctaggggagaacgaggtgaaaagggagaatcagggcaaccaggcgagccagggccgccgggcccaaaaggccctaccggggatgatggacccaagggaaatcctggacctgtcggctttccaggcgacccaggtccgccaggcgagggtgggccacgggggcaagacggagccaagggcgatagaggcgaggacggcgagcccggccaacctgggtcacccggccccaccggtgaaaacggccccccgggccctcttggcaagcggggacccgcaggctccccaggatcagagggccgtcagggaggaaaaggtgcgaaaggcgaccctggtgccattggcgctccgggaaagaccggcccagtgggaccagccggacccgctggcaaaccagggccagacggcctgcggggcctgcccgggtccgtcggtcaacagggtcgaccaggtgcgactggtcaggccggacctcccggccctgtgggtccccctggcctaccggggctgcggggtgacgctggagcaaaaggggagaagggtcacccggggctcattggtctgatcggaccgccgggggagcagggagagaagggcgatagaggcctaccgggcccccaggggtctcctggccagaagggagaaatggggattcctggagcatccgggcccattgggccaggtggaccccctggcctgccgggcccggcaggaccgaaaggggcgaagggggcaaccggccctggaggtcccaaaggagaaaagggcgtccaagggccacctgggcacccaggccctccaggtgaggtaattcagcctttaccaatccagatgcccaaaaagactcgccgcagcgttgacgggagccgactgatgcaagaggatgaggctattcccactgggggggctcctggctcccccggtggccttgaagagatctttgggtcactcgattcgttgagggaggagatcgagcaaatgaggcgacccactggaactcaagacagccctgctagaacctgccaggacttaaagctgtgccacccagaactacctgatggcgagtactgggtcgatccgaaccagggatgtgctagggacgcctttagagttttctgcaattttaccgctggcggggagacatgcgttactcctcgggacgacgttacccagtttagttacgttgactccgagggatcccctgtaggggtggttcagctgacatttctgagactgctctcagtctctgcccaccaagacgtgtcttacccgtgctcgggcgccgcccgcgatggacctcttcggctccgcggtgccaacgaggacgaactgtctcctgagaccagcccttatgtaaaagagttccgcgatggctgccagacccagcaaggccgcaccgtgctggaagtgcgaacacctgtgttggagcagctcccagtgctagacgcctccttctccgacctcggggcccctccccgtagggggggggtgctgttggggccggtctgcttcatgggctag

SEQ ID NO: 3993 - DNA, 4890 bp, Artificial Sequence
  Description of Artificial Sequence: Synthetic coding sequence
atggagcggtgcagccggtgccaccggctgctgctgctgctgcccctggtgctgggcttgagtgcagccccaggctgggccggcgcacccccagtggatgtgctcagagctctcaggttcccaagcctgcccgacggagtcaggagagcaaagggaatctgtccagcagatgtcgcataccgggttgcgcgacctgcacagttatccgcgccgacacggcagctttttcctgggggcttccctaaagatttttccctgctcacagtggttagaacacgccccggattgcaggcaccgctgctcaccctgtattcagcccagggggttcggcagctcgggcttgaattaggtagacccgtgcgctttctctatgaagatcagaccggtcgtccgcaaccacctagccagcccgtatttcgaggactatcactcgctgatgggaaatggcacagggtggccgttgcggtgaaagggcaatcagttacccttatagttgactgcaagaagcgggtaactagacccctcccccggtctgctcgccccgtactcgacactcatggagtcatcatttttggtgctagaatcctggatgaggaggtgtttgaaggcgacgtgcaggagcttgccatagtcccaggggtgcaggctgcctacgagtcttgtgagcagaaggaacttgagtgcgagggaggtcagcgcgagcggccccagaaccagcagccacaccgcgcgcaaagatctccgcagcagcagccatcccgactgcaccggccccagaaccaggaacctcagagccaagcggcacacggccccagggggctcaagggcgagaagggggaacctgccgtgctggaacccgggatgctcgtggaaggcccccccggacctgaggggcccgcgggcctcatcgggcctccagggatacagggaaacccggggccagtgggggatcctggagaaaggggcccacccggtagggccggtctgcccggctctgacggggcccccggaccgccagggactagcctgatgctgccattccgatttggcagcggaggtggagataaaggccctgtggtagcggctcaggaagcacaggctcaagctatacttcagcaggcccggctggcactcagaggacctcccggccccatgggttatactggtaggccgggacctctggggcagccaggaagccccggcttgaaaggggagagcggtgacctaggcccacagggcccacgtggacctcaggggctgaccggcccgccaggaaaggctggtcggcgaggccgcgcgggcgccgacggcgcccgcggaatgccaggggaccccggggtcaaaggggatagaggttttgatgggctgcctgggcttcccggtgagaaggggcacaggggcgatacaggagcccagggcctaccagggccacccggtgaggatggcgaacgaggtgatgatggggaaatcggacccagaggtctacccggggagtctggccctcgcggcctgctcggaccaaagggccccccaggcattcccgggcctcccggggtgcgcggtatggatggcccacaaggaccgaaaggctcactggggccccagggcgagccaggcccccccggccagcagggcaccccggggacacaggggcttcctggcccccagggagctatcggtcctcacggggagaaggggccacaaggaaagcctggactccccggtatgcccgggtctgatggccccccagggcaccctggcaaagaaggaccccctggcacaaagggtaatcaaggaccctccgggccccagggaccactgggctaccctggcccacggggcgtgaaaggcgtggatggtatcagaggcctaaaaggtcataaaggcgaaaaaggcgaggacggtttcccaggattcaagggagacatcggcgttaagggcgatcggggcgaggtgggggtccccggaagtcgcggtgaagatggccctgagggtccgaaaggccgcaccggacccactggcgatccagggccccccggacttatgggagagaaaggtaagcttggtgtgcctgggctgcccgggtaccccgggaggcaagggccaaagggctcactgggcttccccggctttccgggcgcttctggcgagaagggggctaggggtctttctggcaagagcggcccccgaggcgagcgaggtcccaccggcccaagaggccagagaggtccgcgtggggccactggcaagagcggggccaaaggaacatccggaggcgatgggccccatggcccaccaggggaacgcggcctgcctggcccccagggacctaacggctttcccggacctaagggccctcccgggcccccaggcaaagacggactccccggacaccctgggcagcgaggagaagtcgggttccagggcaagacgggaccaccaggaccccctggagtcgtcggtccccagggggctgccggagagactggccccatgggcgagcgcgggcacccaggcccacccggtcctccgggagagcaaggcctccctgggaccgcagggaaagagggtacaaaaggggatcctggaccgcccggtgctcctgggaaagatgggcccgcgggtcttagaggctttcctggagagagaggactccccgggactgctggtgggccgggcctcaaaggtaatgagggaccctctgggccacccggaccagccggaagccccggagaaagaggtgctgctgggagtggaggtccaattgggcccccaggccggcctggcccccaggggccccctggcgctgccggtgaaaaaggggtcccaggggaaaagggacccattgggccgactggaagagacggggttcagggtcctgtgggtcttcctgggcctgcgggcccgccgggggtagccggggaggacggagataagggggaggttggcgaccccggacagaaaggaacaaaaggtaataaaggggagcacggacctccagggccacccggacccatcggtcctgtgggacagccaggagctgcaggagccgatggcgaaccgggagcacgcggaccccaaggccatttcggagcaaagggggacgagggaacccgggggtttaatgggccccccggtcccatcgggctacaggggctaccaggccctagcggcgagaaaggcgagaccggggatgtgggccctatgggcccccccggtccacccggacctagaggccctgcgggtcctaatggggcagatggccctcagggaccccctgggggcgttggaaatcttggccctccgggggaaaaaggggaacctggcgaatccggtagcccaggcattcaaggggagcccggcgtgaaggggccacgcggagagcgcggcgagaagggggagagcgggcaaccgggggagccaggccccccgggcccaaagggacctaccggggatgacggacctaagggtaatccagggcccgtgggatttcctggggaccccggacctccaggagaggggggcccaaggggacaggatggcgccaagggcgataggggggaagatggagagcccggacagcccggctcccccggcccaactggcgagaacggcccacccggcccgctgggtaaacgaggtcctgccgggtctccagggtccgagggaaggcagggcgggaaaggcgctaagggagaccctggcgcaattggtgctcccggtaaaactggtccagtgggcccagctggcccagcaggtaagcccggtccagatggactgaggggactgccaggctccgtgggacaacagggccggccaggggccacaggacaggccggccccccaggcccagtgggtccccctgggctccccggtttgcgtggcgacgccggcgcaaagggcgaaaagggccaccccggattgatagggttgattggcccccctggcgaacaaggcgaaaagggggatcgaggcctaccagggccccaggggtcaccaggccagaaaggagaaatgggcattcctggggctagcggacctattggtcccggggggccccccggcttgcccggacctgcaggaccaaagggcgctaagggcgcaaccggccccggggggcccaagggggaaaaaggcgtgcagggccctcctggccaccctggcccaccaggtgaggttatacagcccctgcccattcaaatgccaaaaaaaaccagaaggtccgtcgacggtagccgcctcatgcaggaggacgaggctatccctacggggggcgcacctggcagccccggaggccttgaggagatctttggtagccttgattccttgcgggaggagatcgaacagatgaggcggccgacaggcactcaagactcccctgcccggacatgccaggacctaaaactgtgtcatccggagctgccggacggcgaatattgggtagacccaaatcagggttgtgcaagagatgcgtttcgggtgttttgcaatttcacagccgggggcgagacctgcgtaacgccccgtgatgatgtaacacagttcagctacgtggattccgagggcagcccagttggcgttgtacaactgacgttcctccgtctactatcagtctccgctcaccaggatgtgagctacccatgcagcggagccgcccgtgatggccccctgagacttcgcggagctaacgaagatgagttgtctccggagacgtcaccctatgtgaaggaattccgcgacggatgccagacacagcagggcaggacagttctggaagtcaggactccagtgctcgaacagttgcctgttctcgacgcttctttttccgacttgggggcaccacccagaaggggcggcgttctgctcggccccgtctgctttatgggttag

SEQ ID NO: 3994 - DNA, 4953 bp, Artificial Sequence
  Description of Artificial Sequence: Synthetic coding sequence
atggagcggtgcagccggtgccaccggctgctgctgctgctgcccctggtcttagggctttctgctgcacctgggtgggccggagcgccacctgtcgacgtccttcgcgcccttagattcccttccctgcccgacggtgtccgcagggctaaagggatctgtccagctgacgtggcttatcgcgttgctcgccccgcacagctatcagcaccaacgaggcaactgttccctggaggctttccaaaagacttctccttgttgacagttgtccggacaagaccaggtctgcaagctcctctcttgacactttacagtgctcagggagtcagacagttgggactggagctgggtcgcccggtgcgattcctgtatgaagatcaaactgggcggccccagcccccctctcagccagtctttaggggcctctcattagcagacggcaagtggcatcgggtcgcggtcgccgtcaaagggcagagcgtcacgcttatagtagactgtaagaaaagggtcacccgacctctcccacggagcgctcgccctgtccttgatacccacggagtaattatcttcggggccaggatccttgacgaggaagtttttgagggcgatgtgcaggagctcgctatcgtcccaggcgtgcaggccgcttacgagtcttgcgagcaaaaggagttagaatgtgagggagggcagcgtgaacgcccacaaaaccagcagcctcatcgcgcacagcgatcgccccagcagcagccttccaggctgcacagaccccagaaccaagaacctcagtcacaagacccaaccccaggtgaggaagaagagattctggaatcaagcctgctgccgcctctggaggaggccgcccacggtcctaggggactgaaaggggagaagggggaacctgctgtcctcgaaccgggaatgttggtggagggccctcctggtcccgagggaccagcagggcttattgggccaccaggcatccaggggaaccctgggccagtgggagacccgggcgagaggggacctccaggacgggctggcctccccggcagcgatggtgcccccggaccccctggaacaagcttaatgctgccattcaggtttggttccggtggcggcgataaggggcctgttgtcgcagcccaggaggcccaggctcaggccatccttcagcaagctcgcctggccctgcgcgggcctcctggacccatgggttacaccgggcgacctggaccgctgggccagcctggctctcccggccttaagggagagtccggggatttgggtcctcaagggcctaggggccctcaggggctgacaggaccacctggaaaagccggaagacgaggcagggccggggcggatggggctcgaggcatgcccggagatcccggggtgaagggagacaggggctttgacggattgcccgggctgcccggagagaagggccacagaggtgacacaggtgcccaaggcctgcccgggcctcctggcgaagacggcgaacggggggatgatggtgagatcgggcctcgggggctacctggagaatctgggccccgggggcttttagggccaaaaggtcctcccggaatccctggaccgccaggtgttagaggaatggatggccctcagggaccaaaaggatctcttggtccacagggtgaacctggtccccccgggcagcaggggacaccaggaacccaaggactcccgggaccccaaggggcgatcggcccacacggtgagaaagggccccagggcaaaccgggattacccggtatgccagggagcgatgggccgcccggacaccccggcaaggaagggccacctgggacaaagggcaaccaggggcccagtggccctcaaggacctctcggttatcccggcccacggggagtgaagggagtagacggcatccggggactcaagggacataaaggtgagaagggagaagatgggtttccagggttcaagggggatatcggcgttaagggcgatcggggcgaggtaggagtgcccggatctagaggagaagatgggcctgaaggcccaaagggaaggactggaccaacgggggaccctggtccgcccggccttatgggagaaaaaggaaaacttggtgttcctggcctccctggttacccagggcgacaaggccccaagggcagcctgggcttcccaggcttccccggcgcaagcggagagaaaggcgcccggggactttctggcaagtctgggccaagaggagagagggggcctaccgggcccagaggtcaacggggaccccgcggcgcaacgggaaaaagcggggccaaaggtacttccgggggcgatggcccccatggcccacctggggaacgcggtcttcccgggcctcaaggaccgaatggctttcccggccccaaggggccccccgggcctccagggaaggatggtctgcctggccacccggggcagagaggggaagtgggcttccaggggaagacaggccctcctgggcctcccggtgtcgttggcccccaaggcgctgctggggaaaccggaccaatgggcgaaaggggccatccaggcccgcctggacccccaggagagcagggacttccaggcaccgctggcaaggaagggaccaaaggcgacccaggcccgccaggcgcacctggcaaagacgggcctgccggccttcgcggattccccggcgagaggggactcccgggtacagccggcgggcccggactgaagggtaatgaaggaccctccggcccgccaggacccgccggcagccctggcgagcgcggagcagctgggagtgggggcccaatcggcccacctggtcggcccggtccccaagggcctcccggcgccgcaggcgagaaaggcgtacccggagagaagggtccaatcgggccaacgggtcgggacggagtgcaggggcctgtgggtctccctggtcctgccggacccccaggagttgcaggagaagatggcgataaaggggaagtcggagaccctggtcagaaaggtactaaaggcaataaaggagagcacggacctccgggcccacctgggccaatcggacctgtcggtcagccaggcgctgcaggcgctgatggagagcccggggcgagagggcctcagggccacttcggcgccaagggtgatgaaggcacccgtggcttcaacggcccccctggtcccatcggcttgcaggggctccccggacctagtggagaaaagggcgagaccggagatgtgggtcctatgggaccacctggcccacctgggcctcgcggacccgcagggccgaatggggccgatggacctcaaggtcctcccgggggggttgggaacctgggcccacctggagagaagggggagccgggagagtctggctcacctgggattcagggagagcctggcgtgaagggcccacggggggaaaggggagaaaagggcgagtccggacagccaggcgagccagggccacccggaccaaaaggcccaactggcgatgatgggcctaagggcaacccagggccagtgggctttccgggcgaccccggtcctccaggtgaaggtggtccgagagggcaggatggagcaaaaggcgacaggggggaggatggggagcctggacagcctggatctcctggccccacaggagagaatggaccacccggcccgctggggaaaagggggcccgccgggagccctggttcagagggacggcaaggaggtaaaggagctaaaggggacccaggtgccatcggcgcgcctggcaaaacaggacccgtgggacctgccggcccagctggcaagccaggcccggatgggctgcgcggtctgcctggcagcgttgggcagcagggcagacccggcgctactggacaggcaggcccccccggacccgtcggccctcccgggttgcccgggctccgaggggatgccggagccaagggggagaaaggccaccccgggttgattggccttatcgggccccctggggagcagggtgaaaagggcgaccggggcctcccgggcccacagggctctcctggacaaaagggagaaatgggtatcccgggggcttcaggacccatcggcccagggggaccaccaggacttcctggcccggctggccctaaaggagcgaagggagcgacgggcccaggaggccctaaaggcgagaaaggtgtacaagggccacctgggcatccaggcccgcctggcgaagttatccaaccgctgccaattcagatgccaaagaaaacacggagaagcgttgacggctcacggctcatgcaagaggatgaggcaattcctactggcggggcaccaggaagccccggcggcctggaagaaatattcggctctctcgattcactgagggaggagatagaacagatgagaagacccaccggaacacaggattctcccgcccggacatgtcaggacctgaaactgtgtcaccccgagcttcccgacggggagtactgggtcgacccaaaccaaggatgtgccagagacgcgtttcgcgtcttttgcaactttacagctggaggcgaaacctgcgtcacacctagggacgatgttacacagttctcctatgtagattctgaaggcagcccagtgggcgtggttcagcttactttcctgcgactgctgtcagtgtctgcacatcaagatgttagttacccttgctccggggccgccagagatgggcctttgcggcttaggggcgccaacgaggatgagttaagtccggaaacgtcaccatacgttaaggaattccgggatggatgtcagacacaacaggggcgtaccgtgctcgaggtcaggacacccgtgctcgaacagctaccagtcctggatgcctccttctccgacttgggcgctccccctcgccgaggtggagtgttgctgggacccgtgtgctttatggggtag

SEQ ID NO: 3995 - DNA, 4968 bp, Artificial Sequence
  Description of Artificial Sequence: Synthetic coding sequence
atggagcggtgcagccggtgccaccggctgctgctgctgctgccccttgttctcgggctcagcgcggcacccggctgggccggtgcccctcctgtcgatgtgttgcgcgcacttcgtttccccagtttaccagacggtgtcaggagagccaagggtatctgccctgccgatgtggcttatcgggtggcccgccctgcccaactgagcgccccgaccaggcagctcttccccggcgggtttccaaaggatttcagcctcctgacagttgtgagaacccgacccggccttcaagcccccttgttgaccttatactccgctcagggtgttcgccagcttggtctcgaactgggacggcctgtgcgctttctgtatgaggatcagaccggtcggccacaacccccttcgcagcccgtgttccgtggtctcagtttagccgacggtaaatggcatcgggtggccgtggctgtgaaagggcagtcggtgacactcattgtggactgtaaaaagcgggtcacacgcccgctgcctcggagcgcccgccctgtgctggatacccatggggtgattatcttcggagcccgcatccttgacgaggaagtgttcgagggagacgtgcaggaactggccatcgtacccggagtgcaggctgcttatgagagctgcgagcaaaaagagttggagtgtgaaggaggccaaagggagcgaccacagaatcagcagccccatagagcgcagaggagtcctcagcagcagccatctcgtcttcataggccacaaaatcaggagccacagtcgcagcccaccgaaagtctctattatgactatgagcccccctattatgacgtcatgactaccgggactactccggattaccaggcagcccacggtcctagaggcctgaagggagaaaagggggaaccagctgtgctcgagcctggaatgctggtcgaagggccccctggcccagaaggacctgccggcctgatcggaccacctggtatccagggcaacccgggtcccgtaggcgatcctggagagcgcggcccaccgggtcgggccggactaccaggatccgacggtgcccccggcccccctgggacgtcactgatgctgcctttcagattcggcagcggaggtggcgacaaaggcccagtagtggcagcacaggaggctcaagcccaggcaatcctgcagcaggctagattggcactgaggggtccaccagggccgatgggctataccgggcggcccggtcctctgggccagccaggcagcccaggcctgaagggcgaatccggcgatctaggaccgcagggcccaagaggcccacagggtctgactggcccccccggtaaggctggaaggagaggccgagccggggccgacggcgcaagagggatgcctggcgaccccggcgtgaagggcgatcggggatttgatggccttcccggcctcccaggagagaaagggcatcgtggcgataccggagctcaggggctgcccgggccccccggagaggatggcgaaaggggggacgacggcgagatcggaccacgcgggctgcccggtgaaagcgggcctcggggccttctgggccccaaaggaccacccgggattcctggacctccgggagtgcgtggaatggacggccctcaggggcccaagggctctttgggcccgcaaggcgaacctggccccccggggcagcaaggaacacctggcacacaaggactgcctggaccacagggagcgattggtcctcacggtgaaaagggaccacagggcaaacccgggctccctggcatgcctggctccgatgggccacctggtcatcccgggaaagagggccctccgggtacgaaagggaatcaaggccctagcggcccccagggccccctaggatatccaggccccagaggtgtgaaaggtgtggatgggattcgcggcctgaaagggcacaagggagagaagggagaggacggattccctggattcaagggcgacattggggtaaaaggcgatcgtggggaggtgggcgtgcccggatcccggggtgaagatggaccggagggacctaaaggaaggaccggtcccacgggggaccctggaccaccaggactgatgggcgagaagggcaaactgggagtccccggcttgcccggctatcccggtcgccagggacccaagggatctttgggatttccaggctttccaggcgcttcgggcgaaaagggcgctcggggactttcaggcaagtccggccccagaggggagcggggacccaccgggccacgcggacaacgcggccccagaggtgccaccgggaaatccggggcgaaagggacttcaggtggcgatggccctcacgggcctcctggagagcgcggccttcccgggccacagggccctaacggttttccaggccctaaaggcccccctggtccacctggaaaggatggtctgcctgggcatccaggccagaggggggaggtggggttccagggcaagaccggccctcctggtccccccggcgtcgtagggccgcagggggccgcgggagagactggaccgatgggcgaaagaggacatcccggaccccccggacctcccggcgagcaggggctgccaggcaccgctgggaaagagggtactaagggcgacccaggtccccctggcgcacctggaaaggacggcccagcgggcttgaggggctttcccggcgagagagggctgccaggtaccgctggggggccaggcctgaaagggaacgagggcccttctggccccccaggcccagccgggtctccaggggagagaggggccgcaggaagtggcggcccaatcggtcccccgggacggcccggcccccaggggccacctggcgcggccggtgagaaaggagtgcccggcgaaaagggacctatcggtcctacaggcagagatggggtccaggggccggtcgggctgcccgggccagctggacctccaggggttgctggcgaagacggagacaagggtgaggtcggagacccgggacagaaaggcacaaagggcaacaagggagagcacggcccccccggaccaccaggacctatcggacccgtgggacagccgggcgcagcgggagccgatggggaaccgggggctcgcgggcctcaaggacatttcggcgccaagggcgatgaggggacaagaggattcaacggtccaccgggacccataggcttgcagggtttgcccggcccatccggagagaagggagaaaccggagatgtcgggcctatgggccctccaggcccccctgggccccgtggtccagccggacctaacggagcagatggcccccaagggccgccagggggcgtggggaacctcggcccacccggggaaaagggcgaacccggtgagtctggtagccccggtattcagggagagccaggcgttaagggacctaggggagaaagaggggagaaaggagagtctgggcagccaggtgagccggggccaccaggccctaaaggcccgactggtgacgacgggccaaaaggaaaccccggcccggtgggtttccccggcgatcctggcccgcccggtgaaggcggccccaggggccaggatggcgccaagggcgatcgaggtgaagatggagaacctggtcagcccggtagtcctggaccaacaggcgaaaacggtccgcccggacctctcggaaagaggggcccagctggaagtccaggcagtgaaggccgtcagggcgggaagggagccaagggggatcccggggctatcggtgcccctggcaagactggcccagtggggcccgcaggcccggcaggtaaaccaggtccagatgggttgcgaggcctgcctggctccgtcggtcaacagggccgcccaggcgccacaggacaggccgggcctcccgggcctgtaggccctcctggccttcctggcctccgaggtgatgctggcgccaaaggggagaagggccatcctgggcttattggcctgattggaccaccaggagagcagggcgagaagggtgacaggggtttgccgggtccccagggttctccaggacagaagggcgagatgggaatacctggcgctagtggccctatagggcccggcggtccccctgggttaccaggaccagcggggcccaaaggcgccaaaggagccaccggacctggcggtccgaaaggcgaaaagggggtgcagggacctcctggacatccaggccctcctggggaggtgattcagccactaccaatccaaatgccaaagaaaacgcgccgctccgtggatgggtcccggctgatgcaagaagatgaggcgattcctaccggcggcgcccctggcagtcctgggggcctcgaagagatatttggcagcctggactccttgagggaagaaatcgagcagatgaggcgcccaaccggaacccaggatagtcccgcaagaacttgccaagatcttaagctctgccatcctgaactacctgacggcgaatattgggtggaccccaatcaaggctgcgcccgcgatgccttccgtgtcttttgtaattttacggccgggggagaaacctgcgtaacacccagagatgacgtaacccagttctcatatgtggatagcgaggggtctccggtgggggtggtgcaactgacgtttctgcgattgttaagcgtctctgctcatcaggacgtgtcgtatccatgttctggcgctgcccgggatggcccccttcgactgagaggcgccaacgaggatgagctgagtccagaaacatccccatatgttaaagagttcagggatgggtgccaaacccagcagggccgcacagtcttggaagtgagaactccagttctcgagcagctgcccgttctcgatgccagcttctctgacttaggcgctcctccccggagaggcggcgttctgctgggaccagtttgcttcatgggctag

SEQ ID NO: 3996 - DNA, 5070 bp, Artificial Sequence
  Description of Artificial Sequence: Synthetic coding sequence
atggagcggtgcagccggtgccaccggctgctgctgctgctgcccctggtgctgggcctctctgctgcccctggatgggcaggtgcacctcctgtggacgtgctacgagccctgcggtttccgtctctgcctgacggcgttcgcagggccaagggaatctgccccgcggatgtggcgtacagagttgcccgcccggcacagctgagcgctccgacacgccagctatttcctggaggcttccccaaggacttctcactgctgactgtggtgagaactagaccaggcttacaggcgcccctgctgacgctgtattctgctcagggcgtccgccagctgggcttggagttgggccgccctgtgagatttctgtatgaggaccagaccggtcggccccaacctccttcacagcccgtgtttagaggcctgtccctcgcagacggcaagtggcatagggtggcggttgcagtgaaaggccagtccgtgacgttgatcgtggattgtaaaaagcgagtcacccggcccctccctagatccgccaggcctgttctagacacgcatggggttatcatcttcggtgctcgaatcctggacgaggaagttttcgagggtgacgtacaggagttggccatcgttccaggagtccaagctgcctacgaaagctgcgagcagaaagaattagagtgtgaaggcggtcaacgcgagcgaccacagaatcaacagccgcatagagctcagcgcagcccccagcagcagccaagcaggctccatagaccacagaaccaggaaccgcagtctcaagagcagaccgacctgcaggtgcccccaaccgcagatcgattccaggctgaggaatacggcgagggggggaccgaccctcccgaggggccctatgactacacttacggatacggagacgattatagggaagaaaccgaactggggcctgcgttgtctgccgagaccgctcactccggggccgccgctcacggccctcgtggcctcaaaggcgagaagggtgaacccgcagtcctcgaacctggcatgttagtggaggggccaccaggaccggagggcccagccgggcttatcggccccccagggatccaggggaaccccgggcctgtgggtgacccgggcgagcgtggcccccctggaagggcgggcctaccaggctccgacggggcccccggtccccccggcacatccctaatgttacctttccggttcggctctggagggggagataaaggacccgtggttgcggcacaagaagcccaagcacaggctatattgcagcaggcacgcctggccctgcgcggcccccccggccccatgggatatacgggtcgccctggacccctgggacagcccggcagtccaggacttaagggcgaatccggagatttgggtccgcagggaccccgcgggccccaaggcctcaccggcccccccggcaaggcagggcgaaggggacgggccggtgctgacggtgccagagggatgccaggggatcctggggttaagggtgaccgcggttttgacggactaccgggccttcccggggagaaaggtcatcgaggcgacacaggcgcccaggggctgcctggcccccccggggaggatggagagagaggtgacgatggggaaatcggccctcgcgggctgcccggcgaaagcggccctcgtgggctcctgggccccaaaggacctccaggcatcccagggccccccggggtccggggaatggatggtccacagggacctaaaggaagcctgggtccacagggcgagcctgggccgcctggacagcaaggaacacccggaacacagggactgccaggcccgcagggagccatcggtccacatggagaaaaagggccccaaggaaaaccgggactgcctgggatgccaggctcagacggcccaccagggcatcccggaaaagagggaccccctggaaccaaagggaaccaggggccgtctgggccacaaggccctcttggctacccaggtccaaggggagtcaaaggggtggatggaattcgcggtctgaaaggacacaaaggcgagaagggggaagatggctttcctgggtttaagggtgacataggggttaagggggaccgaggcgaagttggcgtgcctggaagcagaggcgaagatggaccagaaggtccaaaaggccgcacaggaccaaccggcgatccagggccccccggcctcatgggcgagaagggcaaactgggcgttcccggactgcctggatatccgggacgccagggaccaaagggctcactgggcttcccggggtttcccggcgcgtctggcgaaaaaggagccagaggcctttccggcaaatctggccctagaggagagcgcggccctacgggacctcgtgggcagcgaggtccccggggtgcaaccggcaagtctggggcaaaaggcacctccgggggggacggccctcacgggccacccggggagcgaggcctgccaggcccccagggaccaaacggatttcctgggcccaaggggccaccagggccccctggcaaggacggccttccaggccatccaggacagcggggcgaagtgggtttccaggggaaaacgggcccacccggccccccgggtgtggtaggcccccaaggggcggccggtgagacggggccaatgggcgaaagagggcaccctggaccacctggcccccctggtgagcagggtctgcctggcacagctggcaaggagggcactaaaggtgatcctggtccccctggtgcccccgggaaggatggcccagccggactgaggggattccccggtgaacgtggactgcctggaacagccggcggtccgggactcaaaggcaatgagggcccttctggacccccagggccagccgggagcccaggcgagaggggcgccgcaggctctggcggacctattggacctcccggcagacctggaccgcagggaccaccaggcgcagcaggcgaaaaaggcgtgccaggggaaaagggccccattgggcctaccggaagagatggcgtccaaggccccgtgggtctccccgggcccgctgggccaccaggagtcgccggcgaagatggcgataagggagaagtgggagatccaggtcagaaggggacaaaaggcaataagggcgaacacggtcctccggggcctccaggaccaattgggccggtcggacaaccaggagccgcaggggccgacggggagccaggcgcgcggggccctcagggtcatttcggcgctaaaggcgacgagggcaccagagggttcaatggcccccctggacccattggcctccaggggctgcccggccctagtggcgagaaaggggagactggcgacgtcggacccatgggcccccctggccctcctggaccaaggggacccgccggccctaacggagcagatgggcctcagggcccacccggcggggtggggaacttgggcccacccggggagaagggcgaacctggcgagagtgggtctcccggcatccaaggggaacccggcgtaaaaggtcccagaggagagcggggcgagaaaggagagtcaggccagcctggagagccaggaccgccgggcccaaaaggccctactggagacgacggcccaaagggtaacccaggacccgttgggttcccaggcgatcctggaccgccaggcgagggggggccccgagggcaggacggtgccaaaggggataggggagaggatggagaaccgggacagccggggagcccgggccccaccggggaaaacggcccgcccggtcctctcggtaagcggggccccgctgggtcgcctggttccgaaggccgacagggggggaagggcgcaaaaggcgacccaggtgcaatcggggctccaggcaagacagggcccgtcggacctgctggaccagccggaaaaccaggaccagatgggctacggggactgcccggcagtgtgggccagcaggggaggcccggagccacgggtcaggccgggcctccaggaccagttggaccacccggcttacctgggctgagaggcgacgctggcgccaagggtgaaaagggccatcccggtctcatcggattgataggccccccaggcgagcagggcgagaaaggcgaccgtggcctccccgggcctcaaggtagccccggacagaagggagagatgggcattcccggcgcctcagggcctatcgggcctggaggtccgccagggctacctggtcccgccggccctaaaggggcgaagggcgctactggaccaggcgggcctaagggggagaagggcgtgcagggccccccaggacatccaggaccccccggcgaagtgatccagcctctgcccatacagatgccgaagaaaacaagacgcagcgtcgacgggagccgtttgatgcaggaagatgaagctatacctacggggggcgcaccgggcagtccaggaggactcgaagaaattttcgggtcattggatagtctccgggaggaaatcgaacagatgcgaagacctaccggtacccaagattctcctgctaggacctgccaggacctgaagctttgtcatcctgaactaccagatggggagtactgggtcgaccctaatcagggttgcgcccgggacgcatttagggtgttctgcaactttactgcggggggtgaaacctgcgtcaccccgcgggacgacgtgacgcagttcagctacgtggacagcgagggctcgcccgtgggggtcgtccagctcacatttctgcgcctgttgagtgtgtctgcccatcaggacgtgagctacccatgtagcggagctgctagggatggccctttgcgcctgagaggagcgaacgaggatgaattgtcccctgagacctctccttatgtgaaggagttccgcgatgggtgccagacgcagcaggggagaacggtcctcgaagtccgaacaccagtgcttgagcaactgccggtcttagacgcttccttcagtgatttgggagcccctcctcgcagaggtggagttttgctaggtcctgtgtgcttcatggggtag

SEQ ID NO: 3997 - DNA, 5133 bp, Artificial Sequence
  Description of Artificial Sequence: Synthetic coding sequence
atggagcggtgcagccggtgccaccggctgctgctgctgctgcccttggtcctcggactgagcgccgccccagggtgggccggcgccccacccgtcgacgtgctcagggctttgcggttcccatcactgcctgacggagtgcgcagggccaagggcatctgcccagccgatgttgcgtatagagttgccaggcccgcccagctatcagcacccactagacaactcttccctggcggatttcccaaggacttttcgctgctgaccgtggtgaggacacggcccggtctgcaagcgcccttgctgactttgtacagtgctcaaggggtccgacaactcggacttgagctcggacgcccggtgaggttcttgtatgaggaccagaccggcaggccacagcctccctcacagcccgtattcaggggcctcagcctagctgacggcaagtggcatagagtcgcagtggcagtaaagggccagagcgtgaccctgattgttgattgtaagaaacgggtcacacgccccctccccagaagcgctaggcccgtactagatacacacggtgtaataatttttggcgcccgcattcttgatgaggaggtgttcgaaggcgacgttcaggaactggccatcgtgccaggagtacaggctgcatacgaaagttgtgagcagaaggagttagagtgcgaagggggccaacgagaaaggccccagaatcagcaaccccatagagcccagcgcagcccacagcaacagcctagcagactccataggccacaaaaccaggaacctcagagccaggaccctacaccgggcgaggaagaggaaatccttgagagttccctgctgcccccgctggaagaagaacagaccgacctacaggtgccaccgaccgctgataggttccaggcagaggagtatggggaaggaggcacagacccccccgagggaccttatgattatacctacggctacggagacgactatagggaggagacggagctggggcctgccttaagcgccgagaccgcccattctggagcagccgcacatgggccccgcggactgaagggggagaagggggaaccagccgtgctggaacctggaatgcttgtggaaggccctccaggtccagaagggcctgccggtctaattggaccgcccggtatccagggcaatcccggtccagttggcgatcctggagagcggggaccccccgggcgtgccggcctccccggtagtgacggtgcacctgggccgcccgggacctcactgatgctccccttccgctttgggagcggaggtggagacaagggtcctgttgtggccgcccaggaagcacaggcgcaggccatcttgcaacaggcaagactcgcactccgaggaccaccaggacccatgggctacacgggccggcccggccctctggggcagccgggatcccctgggcttaaaggcgaatcaggggatctgggccctcagggaccaaggggtccccagggtctcactggaccaccgggtaaggccggcagacgcggcagagcaggcgcagacggtgctagaggtatgcccggcgatcccggagttaaaggggaccggggttttgacggcttgcctggcttgcccggagagaaagggcacagaggcgacacgggtgctcagggcctgccaggacctccgggcgaggacggcgagcgcggcgacgacggcgaaatagggcccagaggtctgcctggagaatccggtccacgcggcctcttagggcctaaggggcctcccgggatcccgggcccccctggagtgcgcggcatggacgggccccagggcccaaaaggctcgttggggccccaaggtgagcccggtccccccgggcagcagggcacacctgggactcaggggctccctgggccccagggagctatagggccccatggagagaaggggccacagggtaagccaggcctaccgggaatgcctgggtccgacggaccccctggccaccccggcaaagaagggcctcctgggaccaagggcaaccagggcccatccgggccacaaggcccgttaggttatcccggaccccggggcgtgaagggagtggacgggatcagagggctgaaagggcataagggggagaaaggcgaggatggatttcctgggttcaagggcgatatcggagtgaaaggagatcgcggggaggtgggcgtgcccggatcacggggtgaagatggccctgaaggccctaagggcaggaccgggccaactggtgatcccgggccacctgggctcatgggcgagaagggaaaactgggagtcccaggcctaccgggatatccaggtcgccaggggccaaagggatcattgggcttcccaggatttccaggcgcttccggcgagaagggcgcgagaggcttgtccggtaagagcggaccacgaggcgagcgagggccaacggggcctagagggcagcggggcccgcggggtgctacagggaagagcggcgctaaaggcaccagcggcggggatggtccccacgggccgcctggcgagaggggtctgcccggaccccagggcccaaatggcttccctggacccaagggacccccgggccctccagggaaggatgggctaccaggccatccgggtcagcgaggagaggtgggattccaggggaagaccggcccccctggccccccaggcgtagtgggcccccagggagctgccggcgagactggccccatgggcgagcgggggcatcctggacccccaggcccaccgggagagcaggggcttccggggaccgctggcaaggaggggactaaaggcgatcccggcccaccgggagctcccggcaaagatggccctgcaggactgcgtggtttccctggtgaaaggggattgccggggactgccggcggacccggcttgaaaggcaacgagggaccaagcggccctcctggccccgccggttccccgggggaaagaggggcagccggatcgggaggacctattggccctccaggcagacctggaccacagggcccaccaggagcagcaggagaaaaaggagtccctggggaaaaaggacccatcggacccacagggagggatggggttcagggcccggtaggtctaccaggtccggctgggccaccaggggttgcgggcgaggatggggataaaggggaggtcggagatccagggcagaagggcactaaaggaaataagggtgagcatgggcctccaggccctccaggtcccatcggacccgtcggccaacctggcgcagccggagccgacggcgaacctggcgccagaggaccccagggacatttcggcgcaaagggggacgaaggaacacgcggatttaacggtccaccaggcccgattggcctgcaggggctaccaggaccatctggcgagaagggtgaaacaggcgatgttggtccaatggggcctccggggccgcctggcccgcgtggccccgctggacctaacggagccgacggccctcaaggtcctcctggcggggtggggaacctggggccacccggtgaaaagggtgagcccggcgagtccgggagccccggaattcagggcgagccgggggtgaagggacctagaggtgaacgaggtgaaaagggtgagtctggtcaaccaggcgagcctgggccacccggacctaagggaccaactggtgacgatgggccgaaagggaaccccggtccagtagggtttcccggggaccccgggcctcctggcgagggaggtccacggggacaggatggagctaagggagatagaggggaagacggggagcccgggcagccgggctcaccgggaccaacaggcgaaaatggcccccctggcccactcggcaaacgaggaccagcaggaagcccagggtccgaagggagacaaggcggaaagggcgccaagggggaccccggtgcaatcggcgcgccgggcaagaccggaccagtgggtcctgcaggccctgcagggaagccgggtccggatgggctcagaggattgccaggatccgtgggacagcagggtagacccggagccacaggacaggcgggcccgccgggcccggtgggccctcctgggctccctggacttaggggggatgctggtgcaaagggcgagaagggccatccaggcctcattggcctaattggaccaccaggcgagcaaggcgaaaaaggcgatcggggcctgccaggcccacaggggtccccaggacagaagggagagatgggcatccccggggcgagcgggccgatcggcccggggggcccacctggactcccgggcccggctggaccaaagggcgccaaaggcgccaccggtcctggcggccccaagggagagaaaggggtccagggcccgcctggccatccagggcctcctggcgaggtgatccagccactccccatccagatgcccaagaagaccagaagatcggtggatggttcgagacttatgcaggaggatgaggcaataccaaccgggggagcaccgggcagtcctggaggccttgaggaaatttttggctccctggactccctgcgagaggaaatagagcagatgcgtaggccaactgggacacaagattcacccgctagaacctgccaggacctcaaactgtgtcaccccgaattgcctgatggcgaatactgggtggaccctaatcagggttgtgccagagatgcctttcgcgtgttctgcaattttaccgccggtggggagacttgtgtaacaccacgggacgatgtcactcagttttcttatgtggatagcgaaggcagtcctgttggtgttgtgcagctgacctttctaagattgctcagcgttagcgctcaccaggatgtatcatacccatgctcaggagctgcccgcgacgggccactgcgtctgcgtggcgccaacgaagatgaattgagtcccgagaccagtccatacgtaaaggaattccgggacgggtgtcagacccagcaggggcggacagtccttgaagtgaggacccccgtgttggaacagttgccggtcctggatgcctccttttcagatctgggggcaccaccacggagaggcggtgtgctcctgggacccgtttgttttatgggttag

SEQ ID NO: 3998 - DNA, 4953 bp, Artificial Sequence
  Description of Artificial Sequence: Synthetic coding sequence
atggagcggtgcagccggtgccaccggctgctgctgctgctgccccttgtgctcgggctctcagccgcccctggctgggctggcgccccacccgtagatgtgctaagggcactgcgcttcccctccctgccggacggcgtcagacgggctaagggcatatgcccagcagacgtggcttatcgggtcgcacgacctgcgcaattgagtgcaccaactcgacagctcttccccgggggatttccaaaagacttcagcctgttgactgttgtgcgtacccgcccagggctgcaagcgccgctcctcaccctttatagcgcccagggagttaggcaactcgggctcgaattaggtaggcctgtgaggtttctctacgaagatcagacagggaggcctcagcccccctcccagcctgtgttccgcggcctctcactcgctgacggcaaatggcatcgagtggccgtggctgttaaaggtcaaagtgtgacgctgatagtcgattgcaagaagagggtgactcgaccccttccccggtcagccagacccgtgctcgacacgcacggcgtgattattttcggggccaggatcctagacgaagaggtgttcgagggcgacgtgcaggagcttgccatcgttccaggtgttcaggcggcgtacgaaagctgtgaacagaaggagctggagtgcgaagggggccaacgggagagacctcagaatcagcagccacaccgggcccaaaggagcccacagcagcagcccagccgtttgcataggccacagaaccaggagccacagagtcaggatccaactcctggcgaagaagaggaaattcttgaaagctctctgctgcctcctcttgaagaagcagcacatggacccagaggactgaagggggaaaaaggtgagcctgccgtgttagagccagggatgttggtcgaaggaccacctggtccagaaggaccagcgggcctgattggtccaccggggattcagggtaaccccggccccgttggcgatccaggcgaacgggggcctccgggccgagcaggactgccaggatcagatggcgcccccggcccccccggtacctccctgatgttacccttcaggtttggcagcggtggcggtgacaaagggccagtcgtggccgcccaagaggctcaggcccaggcgatcctgcaacaagcccgcttggcacttcgggggccacccggcccaatgggttataccggacgcccgggtccactgggccaaccagggagccctgggctcaagggagagagtggtgatttggggcctcagggtcccagaggtccccagggcttgaccggccccccaggaaaagcaggaaggagaggccgcgctggggcagatggagcccgcggcatgcccggggacccaggtgtgaaaggagataggggctttgacggcctgccaggcctgcctggtgagaagggtcacaggggagatactggcgcccaaggattgcccggtcctcctggagaagatggagaacggggggacgatggagagattggccctcgcggactgcccggtgagtcaggacctcgaggacttctcggtcctaaaggaccacctgggatccccggaccgccgggcgttcgaggcatggatgggcctcaggggcccaaaggatcactgggacctcagggggagccagggccaccaggccaacagggcactcctggcacacagggtctgccgggaccacagggcgccatagggcctcatggggaaaaaggaccgcaaggaaaaccaggcctcccaggcatgccagggagcgatggcccacccggtcaccccggtaaggaaggcccccctggaacaaagggtaatcaaggtccctccggcccacagggcccgctcggttacccaggtccacgcggcgtcaagggtgtggacggaattcgaggactgaaaggccacaaaggcgaaaagggggaagacggcttccctggattcaaaggcgacataggggtgaagggcgaccgaggagaagttggcgtccctggcagtcgcggtgaagatgggcccgaagggcctaaaggcagaacagggccaacaggggaccctggaccaccgggcttgatgggcgagaaagggaaactcggagtaccaggcctgcctggttaccccggtaggcagggaccgaaagggagcctaggctttcctggcttcccaggggcctctggcgaaaagggcgccaggggattgtccgggaaaagcggcccacggggagagagggggcctaccggcccacgcgggcagagagggccacggggagccaccggaaagagtggtgccaagggcacgtcagggggagacgggccccacggcccgccaggagagagaggcttgccaggaccacaaggacctaacggttttcccggccccaagggaccactcgggcctccaggaaaagacgggctccccggccaccccgggcagcgaggggaggtcggcttccagggaaagacaggaccaccaggtcctcccggtgtggtcggaccacagggcgcagccggagagaccggccccatgggcgaacggggccatccgggacctccaggccccccaggtgagcagggactgcccggaaccgctggcaaagagggcacaaagggtgaccccggcccacccggcgcgccaggaaaggatggcccagctggtttacggggatttcccggtgagaggggtctgccaggtacagcagggggtcccggcctgaaggggaacgagggacctagcggcccccctgggcctgctgggtccccaggggaacggggcgccgcaggctcaggcggacccatcgggccacctggaagacccggtccacaaggaccccctggcgcggctggcgagaagggcgtgccaggagagaaagggccaatcggaccaacggggcgtgacggggtgcaaggacccgttgggttgccaggtccagctgggccccctggagtggctggcgaagatggcgataaaggggaggtgggggatcctgggcagaaagggaccaaggggaataaaggcgaacatgggccccccgggcctcccggtcccattggtccggtaggacagcctggagctgcaggcgccgatggcgaacccggagcccgtggcccccagggtcattttggcgccaagggcgacgaggggacgcgcggctttaacggtccgcccggacctattggactgcagggactgccaggcccctcgggcgagaaaggggaaacaggagatgtgggaccaatgggaccaccaggaccccctggaccaagggggcccgcggggccaaacggtgctgacggaccccagggtcccccaggcggtgtcgggaacctgggaccccctggcgagaagggtgaaccgggggagtcaggatctccaggtattcagggcgaacctggagttaaggggccacgcggggagagaggcgagaagggcgagagtgggcagcccggcgagcccggtcccccaggccctaagggccccaccggcgacgacggtcccaaagggaatccagggcccgtgggtttccccggcgatcccgggccccctggagagggtggaccacggggacaggatggagcgaagggtgataggggggaggacggagaacccggccagcctggatcccccggacccactggcgagaatggacctcctggcccactgggaaaacggggccccgctggttcaccgggatcggagggcagacagggcggcaagggagcgaagggggaccccggagcaataggcgccccaggaaaaaccgggcccgtaggcccagccggcccggcaggtaaacccgggccagacggactacgagggctcccagggagtgtgggccagcaggggcgtccaggagcaacaggtcaggcggggccacccggtcctgtgggcccccccgggttgcccggcctcaggggcgatgcaggggccaaaggcgagaagggtcaccctggcctcattggcctgatcgggccccctggcgaacaaggtgaaaagggtgacagaggactgccgggtcctcagggttcacctggccagaaaggggagatgggcattccaggcgctagcggtcccattggcccaggcggaccccccggcctgcccggccccgcagggccaaaaggtgctaagggcgctaccggccccgggggacctaaaggcgaaaagggagtgcagggcccacccggtcatccaggccctccgggcgaagtgattcagcctctcccaatccagatgcctaaaaaaaccaggcgctctgtcgacgggagtaggctcatgcaggaagacgaggctattcctaccggaggcgcgcccggttctccaggcgggctggaagagatctttggtagtctggattctttgcgggaagagattgagcagatgaggcggcctacagggacacaggacagtcccgcccggacttgccaggacctcaaattgtgccaccccgagctgcctgatggggaatactgggtggaccccaaccaaggatgtgcacgtgatgccttccgtgtattctgtaacttcactgctggaggtgagacctgcgttacaccccgggatgacgtcacccagtttagctacgtggatagcgaggggtcgcccgtaggagtcgtgcagctgacatttctgaggttactcagtgtgtctgcccatcaggacgtctcatacccgtgtagcggcgcagcccgcgacgggcctctgagactccggggcgcgaacgaggacgaactatcacccgagacaagcccatacgtcaaggagtttcgcgacgggtgccagacacagcagggaaggacggtcctggaggtgagaacccctgtgcttgaacagttgccagtactggacgcttctttctctgaccttggagctccccctcgcagggggggagtgttgctcggtccagtgtgcttcatgggatag

SEQ ID NO: 3999 - DNA, 873 bp, Artificial Sequence
  Description of Artificial Sequence: Synthetic coding sequence
atggagcggtgcagccggtgccaccggctgctgctgctgctgcccctggtgctcggcctatccgctgcgcccggctgggctggcgccccccctgttgacgtcctaagggcgctgcggtttcccagtctcccagatggggtacgcagggctaagggtatctgccccgccgacgtggcgtacagagttgctaggcctgcccagctatccgctcctactcgccagctgtttccagggggattccccaaggatttcagtttgctgacagtggttcgaacccgtcctggacttcaggcaccactgcttactctgtactctgcacaaggtgtcaggcagttaggattagagttaggaaggccagttcgttttctgtacgaggaccagaccggccggccccagcccccttcccagcccgtgtttagaggcctctcactggccgatgggaaatggcaccgggtggccgttgcagtgaaaggacaaagtgtgacccttatagtcgattgtaaaaagagggtaacgcgccctcttccacggagcgcccgtcccgtgctcgacacccacggtgtcatcatctttggcgccaggatactcgacgaagaggtgttcgagggcgatgtccaagaactggctatcgtgccgggcgttcaggcagcatatgaatcttgcgagcaaaaagaactggagtgcgaggggggacagagagagaggccacagaatcagcagccacatcgcgcacagcgttccccccagcagcaaccaagcagactccatcggccccagaatcaagagccacaatcacaagtccgcgagctaggcgagccgccatcagccgcccaccctagggaaggcagacatcctggaatctcgcccccttag

SEQ ID NO: 4000 - DNA, 4953 bp, Artificial Sequence
  Description of Artificial Sequence: Synthetic coding sequence
atggagcggtgcagccggtgccaccggctgctgctgctgctgcccctggtcctgggactgagcgccgcaccgggatgggccggcgctcctcctgtagatgtactccgcgctctgaggtttcccagtctccccgatggggtgcgcagggcaaaggggatatgtccagccgacgtggcctatcgtgtggcccgccccgcccagctttccgccccgactcgacagctgtttccaggcggttttcccaaagatttcagtcttctcaccgttgtgaggaccagacctggactgcaggcacctctgctcactctgtattctgcccaaggagttcgccagctgggcttggagctcgggcggccagtgagatttctctatgaggatcaaactggtagacctcagccaccctcgcaacccgttttccgaggcctgagtctggcagatggcaagtggcatcgggtggcagtggccgtgaaagggcagtcggtgactctgatagttgactgcaagaagcgcgtgactcggcctctcccccggtccgcccggcctgtactggacacgcatggagtcatcatttttggtgcccgcatcctggacgaagaagtattcgaaggtgacgtgcaggaattagccattgtgcctggcgtgcaggcagcatacgaaagctgcgagcagaaggagctcgagtgcgagggtggacagcgcgaaaggccccaaaaccaacagccacacagggctcaacgatcccctcagcagcagccctccaggcttcataggccccagaatcaggagcctcagtcccaagatcctactccaggggaggaggaggagatccttgaaagctccctcctgcctcctctcgaggaggccgcacacgggccaagagggctgaagggtgagaaaggggagccagctgtactagagccgggaatgcttgtcgaggggcctcccggccctgaaggacccgccggcctgatcggcccacccggtatccaaggcaatcccgggcctgtgggagacccaggggaacgtgggccacctggccgggctggtctgccaggctcagacggcgctcccgggcccccggggacctcactaatgctgcctttccgcttcggctcaggtgggggtgataagggacccgtggtcgccgctcaggaggcacaggcccaggctattctgcagcaagctcgtctcgcccttcgggggccccctggaccaatgggctatactggacggcctggccctctcgggcagcctgggagtcccgggctcaaaggtgagtcgggagatttaggacctcaagggcctagaggtccgcaagggctgactgggccacccgggaaagcaggacggcgcggccgagccggagctgatggcgctagggggatgccaggtgatcccggagtcaaaggtgatagaggtttcgatgggttaccaggcctgcctggcgagaagggccacaggggcgacacaggagcccagggattgcccggcccacctggggaggatggagagaggggcgatgatggtgaaatcggcccacggggactcccgggggagtctgggccacgtgggctgttgggacctaaaggccctccaggcatccccggaccaccaggggtcaggggtatggatggtcctcagggtccaaagggctccctgggtccccagggagaaccgggccctcccggccagcagggtactcccggaacgcaaggccttcccgggccacagggagccatcggaccacacggagaaaagggaccccaaggaaagccaggactgcccggtatgcctgggtccgatggccctcccggccatcccggcaaagaaggcccgccgggaacaaagggcaatcagggaccgtccggtccccaaggtccactcggataccctggaccacgtggcgtgaagggcgtggacggaatcagaggacttaaaggtcacaagggcgaaaaaggagaagacggctttcccggttttaaaggggacattggcgtgaagggtgacagaggcgaagtgggcgtgccaggatcccgaggagaggatgggccagaaggccctaagggccggacgggtcccacaggggaccccggacctccaggattaatgggagaaaaagggaagctcggggtgcccgggctgccaggttacccaggacgtcagggacctaagggcagccttggttttccagggtttcccggcgcctcaggcgagaagggcgccagaggtttgtcaggtaaaagtggtccacggggcgagcgagggcctaccggtccccgagggcagcggggaccccgaggtgcgacaggcaaatccggagctaagggtactagcgggggcgatggtccccacggtcctccaggcgagaggggccttcctggacctcaggggcccaatgggttccctggccccaaaggacccccgggcccacccggaaaggacggtctgccgggccacccaggtcagagaggggaagtcggattccaggggaagacaggtcctcctgggccccccggggtagtgggaccgcagggtgccgccggagaaacaggacctatgggagagagagggcatccgggccccccgggacccccaggggaacagggcctgccaggcaccgccggcaaggagggaacaaagggagaccctggcccccccggagctcccgggaaggacggccccgccggcctccgaggatttcctggggagagggggcttcccggtactgcaggaggtcccgggctgaaaggcaacgaggggccatcaggcccacctggccccgccgggtcacctggggagcgtggcgccgctggttccggcggacccattggaccacctgggcggcctggaccccagggacccccgggcgctgccggggaaaagggtgttcctggggagaagggcccgatcggccctactgggagagacggagttcaaggcccggtaggcctcccagggccggctggcccccctggagtagctggcgaggatggcgataagggcgaggttggcgatcccggtcagaaaggtactaaaggaaataagggagaacatggacccccaggacccccaggccctatcggcccagtgggccaacccggggccgccggggctgatggtgagcccggtgcccgaggcccgcagggtcacttcggcgctaaaggagatgagggaactcgcgggttcaacggccccccgggaccaatcggcctccaggggctgcctggaccttccggtgagaaaggggagacaggcgatgtagggcctatgggacccccaggccctccaggaccccggggtcctgccggccctaatggagcagatggtccacagggccctccagggggtgtgggcaacctgggcccgcctggagaaaagggggagccaggagagagtggctcccccggtattcagggtgagccgggggtaaaaggaccccggggcgagcgcggcgaaaagggagagtcaggccagcctggagaacctggcccaccaggcccaaagggcccaaccggggatgatggtccgaaaggaaatccagggcccgtcggctttcccggcgacccaggcccacccggggaaggaggtcccagaggacaggatggggccaaaggtgacagaggagaggatggagaacctggccaacctggatcgccaggtcctacaggagaaaatggtccccccgggcctcttggcaaaagaggacctgccggctctcctggcagtgaggggcgtcagggggggaaaggggcgaaaggggatcccggtgcaattggggctccggggaaaaccgggccagtaggtcctgctgggcctgccggtaaacctggaccagacggtctacgaggcctacccggttccgtcgggcagcagggacgcccaggggccaccggtcaggctggccctcccgggcccgtgggtcccccaggtttacctggcctgagaggcgacgccggtgccaaaggcgaaaaaggccatccaggcctgatcggactgattggcccccccggagagcagggtgagaaaggcgaccggggcctgcctggcccccagggatccccaggccagaagggcgagatgggaattcccggtgcctccggtcctattggccctggtgggcctcccgggttgcccggccctgcgggccctaaaggggctaaaggagcaacaggccctggcgggcctaaaggcgagaaaggggtccagggtccacctggccatccaggtccgcctggcgaggtgatccagcccctgcctattcagatgcccaagaaaacccggaggagcgtcgatgggtcacggcttatgcaggaggacgaggctattcctaccgggggcgcgccgggctcccccggcggtttggaagaaatcttcggctctctggattctttgagagaagagatcgagcagatgaggaggccaaccgggacccaagattctccggctagaacttgccaggacctcaaattgtgccatcccgaactgcccgatggagaatactgggtggatccaaaccagggctgcgcccgggatgccttccgtgtattctgcaatttcacggctggcggcgaaacatgcgtgactcctagagatgacgtgacacagttttcatatgtcgacagcgaaggaagtcctgtaggtgtggtccagctgaccttccttaggctcctgagcgtatctgcacatcaggacgtatcatatccttgctctggcgccgcacgcgacgggcccctcaggctgcggggcgcgaacgaggatgagctcagtcctgaaaccagcccatacgtgaaagaatttagggacggctgtcagacacaacaggggcggaccgtgctggaagtgcgcaccccagtacttgagcagttaccagtgcttgatgcaagttttagtgacctgggagctcccccccggcgaggaggcgtgcttcttggccccgtgtgctttatgggatag

SEQ ID NO: 4001 - DNA, 873 bp, Artificial Sequence
  Description of Artificial Sequence: Synthetic coding sequence
atggagcggtgcagccggtgccaccggctgctgctgctgctgcccttggtgctggggttgagcgctgcccccgggtgggccggtgcacctcctgtagatgtgctcagggcactccgcttcccgtccttgccagacggagttcgcagggccaaagggatttgtcctgctgatgtagcttatcgggtggctcgcccagcccagttgtcagcccccaccagacagctcttccccggaggcttccctaaggatttttcattactcacagttgtgcgaacacgcccaggtctacaagccccacttcttacactctactccgcccagggagtcagacagctaggcctagaacttggacgcccagttaggttcctgtacgaggatcagaccgggcgtccacagcccccttcacagcccgtcttccgcggcctgtctctggccgacggtaagtggcaccgcgtggctgtggccgttaaagggcagtcagttacattgattgtagactgcaaaaagcgcgtcacccgccctctgcctaggtccgctagacccgtgctggacacacacggggtaattatctttggggcccgcattctcgatgaggaggtgtttgaaggggacgtccaagagctggccatcgtgcccggtgtgcaggccgcctatgagagctgcgagcagaaagagctggagtgcgagggcggacaacgagagcgccctcaaaatcagcaaccacatcgtgcacaacgctccccccagcagcagccctcccgcctgcacagaccgcagaatcaagaaccccagtcccaggtgagggaacttggagagccaccaagcgccgcgcacccccgtgagggacgtcaccctggaatttcaccaccttag

SEQ ID NO: 4002 - DNA, 921 bp, Artificial Sequence
  Description of Artificial Sequence: Synthetic coding sequence
atggactggcgggccagcgaggcctggatggtgccccgggcccccaagggcgcctgggaccctcgggaatcacaggatcttctcgataacagggctcctttaggtccccgggttttccctgggccgagggtcccctcagctctaatggagcggcgggttctgaagggctcacaaggctcccccgcatgtcctggaccaccaggagaggtaattcagccactgcccattcagatgccaaaaaagaccagaagaagtgtcgatggctcaagattaatgcaagaggacgaggctatacccacaggcggggcaccaggcagcccgggtgggctcgaggagatcttcggcagcttggactcccttcgtgaggagatcgaacagatgagaaggcctactggaacacaggactccccggcaaggacctgccaggatctgaaactttgtcatcctgagctgcctgatggcgaatattgggtggacccgaaccaggggtgcgcgcgggacgccttcagagtattttgcaattttactgctggtggggaaacctgtgttacgccgagggacgatgtgacccagtttagttatgtggatagcgaaggatcccctgtaggcgtcgttcagctgactttcttaaggctcttaagcgtttcagcacatcaagacgtgtcttacccttgttcaggcgctgcaagggacggcccgctccgactccgtggagccaacgaagatgagctcagcccagagactagcccgtacgtcaaagagtttcgagacgggtgtcaaactcagcaaggacggaccgtcctggaggtgcgcacacccgtgttggagcagcttcccgtcttggatgcctccttttctgatctgggcgctcctccgcgaaggggtggcgtcctgctgggtcccgtttgttttatgggttag

SEQ ID NO: 4003 - DNA, 5031 bp, Artificial Sequence
  Description of Artificial Sequence: Synthetic coding sequence
atggagcggtgcagccggtgccaccggctgctgctgctgctgcccttggtgcttggcctcagcgctgcccccgggtgggccggcgcgccgcctgtggacgtgctgcgcgctctgcgtttcccctccctgcccgatggggttcgcagggcaaagggaatttgccccgccgatgtcgcatatagagtcgcgcgaccagcacagttgtccgcgcccacccgtcaacttttcccgggcggcttccctaaggacttttcccttctgaccgtggtgagaaccaggccaggtttacaggctcctctgctcaccctctattcagctcaaggcgtgcgccaactggggctggagctagggcgaccagttcgattcctgtatgaggatcagaccgggagaccccagccaccaagccaacctgtgttccgtggactctccctggctgatggaaaatggcaccgcgtcgcagtcgccgttaaagggcagtccgtgactctgatcgtggattgcaaaaaacgcgtgactcggccgctcccaagatctgcgaggcctgtgctggacacgcatggcgtgatcattttcggcgctcgtattcttgatgaggaggtgttcgaaggggatgttcaagaactggctattgtgccaggagtgcaggccgcatatgaatcatgtgagcagaaagaactggagtgtgaggggggtcagagggagcgaccacagaatcaacagccgcacagagcacagcgttcgcctcagcaacagccttcgcgcctgcataggccacagaaccaagagccacagtcgcagccaaccgagtctctatactacgattacgagcccccatactatgatgtgatgacaactgggaccacccccgattaccaagacccaaccccaggagaagaggaggaaattctcgaaagctccctgttaccgcccttagaggaggcggcacacgggccccgcggtctcaaaggagagaagggagagccggcagtacttgagccagggatgctggtggagggaccacctgggcccgaaggccccgcaggacttatcggccctcccggaatccagggaaatcccggtcctgtcggtgatcctggagagcggggccccccagggcgcgccgggctccctggttcagacggcgcccccggcccaccaggcaccagtcttatgcttcccttccgtttcggttctggaggcggcgacaagggaccagttgttgctgcccaggaggcccaggcccaggcgattcttcaacaagcaagacttgcccttcgaggaccccctgggcccatgggatatacgggcagacctggccccctggggcagcctggctcaccgggactgaagggggagtcaggggatttggggcctcagggacctagaggcccccagggtctgaccggccctccagggaaggccgggcgccgggggagggcaggtgctgacggagcccggggcatgcctggagatcctggtgtgaaaggggacagaggcttcgacgggctccccgggctgcccggcgaaaaagggcaccgtggggacactggagcccaggggcttcctggccccccaggcgaggacggagagaggggggatgatggcgaaattgggcccaggggacttcctggcgagagtggcccccgtggactactgggtcccaaggggcctcctggtatccccggtccacctggtgttagaggcatggacgggcctcaggggcctaagggcagcctcgggccgcaaggggaacctgggccccccggtcaacaggggacccctggcacacagggacttcctggcccccagggcgcaatcggcccccacggtgagaaaggcccccagggcaaacctggcttgcccggcatgccagggtccgacggccctcccggccatcctggtaaggaaggaccccccggaaccaaggggaatcagggtcctagcgggccccagggccctctgggctatcccggtcctcggggcgtcaagggtgtggatggaatccgaggcctaaaaggacacaagggtgagaagggtgaagacgggtttccaggctttaaaggggatataggtgtgaagggtgaccggggagaagtgggagttcccggcagccggggcgaggacggaccagaaggcccaaaaggccggaccgggcccaccggggaccccggtccgcccgggctgatgggagagaaaggaaagcttggcgttcctggcctcccaggctaccccggacggcagggaccgaaggggagcctgggctttcctggcttcccgggcgccagtggcgaaaagggcgcaagagggctgagtggcaagtccggtcctagaggtgaaaggggaccaacgggacccaggggacagcggggacctagaggagcgaccggaaagtccggcgccaaggggaccagtggaggggacggcccacatggcccacctggagagcgggggctgcctggtccccaaggtccaaacggatttcctggccccaaggggcctcccggcccaccaggcaaagacgggctccctggtcatcccgggcagaggggagaggttggttttcaagggaagacggggccgcctggaccacccggcgttgtgggcccccaaggagctgccggcgagaccggccctatgggcgaacgagggcaccccggcccgcctggtcccccaggggagcagggactgccaggaacggcaggaaaggagggtacaaaaggggaccccggaccccccggggcgccgggaaaggatgggccagctggactgagagggtttccaggtgagaggggcctccctgggacggcaggcggccccggactgaaggggaacgagggtccaagcggtcctcctggcccagccggctccccgggtgagcggggggcggccggttctggagggccaattgggccacctggaaggccgggaccacagggaccacccggtgccgccggagagaaaggagtgcctggcgaaaaggggcccattggtcctactggccgagacggggtgcaggggcctgttggactccccggtccggcgggtccaccaggcgtggccggggaggacggggataaaggggaagtgggcgacccaggtcagaagggtaccaagggaaacaagggagagcacgggccacctgggcctcctgggcctatcgggcccgttgggcaaccaggggccgcaggggccgatggtgaaccaggagcgcggggcccccagggccattttggagccaaaggagacgagggcacccgagggtttaacggcccgccgggtccaatcggactgcagggactgcctggcccgagcggcgagaaaggagaaaccggggacgtcgggccaatgggcccacctggacctcctggacccagggggccagccggtcccaatggggcagacgggcctcaggggccaccaggtggagtggggaacttaggccctccaggggagaagggcgaaccaggtgagagcggaagccccggcatccagggtgagcccggcgtcaagggcccacgcggggaaaggggagaaaaaggggaaagtggacagcctggcgagccagggccacccggtccaaagggtccaaccggggacgacggacctaagggcaaccctgggcctgtcggcttccctggcgatccaggccccccaggggagggaggtccgcgcggtcaggacggggcaaaaggggacaggggagaggatggagaacctggtcagcctggaagcccgggccctaccggcgaaaacgggccaccgggtccccttgggaaacggggcccagcgggcagtccaggatcggaaggtcgccagggtggtaaaggagccaaaggagaccccggcgctatcggcgccccggggaaaacaggaccagtgggtcccgccggccccgccgggaagcctgggccagatggtctgagaggcttgcctgggtccgtggggcagcaagggcgtcctggtgcaacaggacaggccggccctcccggccctgtggggccccctggtcttcccggcttgcggggggacgccggggccaagggcgaaaagggccatcctggcctgatcgggcttatcgggcctcccggcgagcaaggcgagaagggggaccgaggcctaccgggcccccaaggaagcccagggcagaagggagagatgggcatccccggcgcttctgggccgattgggcctggcggaccgcccggtctgcccgggccagccgggccaaaaggcgctaagggggccaccggacctggagggcctaagggtgaaaagggcgtacaagggccccctggccaccccgggcctcccggcgaagtcattcagcctctgcctatccagatgcccaagaaaacacgaaggtcagtggacggctccaggctaatgcaggaggacgaagccatcccgacaggcggtgctcctggtagtccaggaggcttagaagaaatattcggttctctcgatagcctcagagaggaaattgaacagatgagaagaccaacaggtacccaagattctcctgcgagaacatgtcaggatctgaaactctgccatccggagctgcccgacggggaatattgggtggatcccaaccaaggatgcgctcgggatgcttttagagtgttttgcaacttcacagctggtggggaaacatgcgtaacaccgcgagatgacgtcacccagttttcatatgttgactccgaaggctccccagtgggggtcgttcagctgactttcctgcgtcttctgtcagtgtctgcccaccaggacgtgtcttatccttgtagtggcgccgcccgggacggccccctgagactcagaggggctaacgaggacgaactgtctcctgaaaccagcccatatgtgaaagagttccgcgacggctgtcagactcagcagggacgcaccgtgttagaagtacgcactcctgtgctcgagcagctgcctgtgctcgatgcatcattttccgaccttggcgctcccccgcgcaggggaggggtgcttttaggacccgtgtgttttatgggctag

SEQ ID NO: 4004 - DNA, 1875 bp, Artificial Sequence
  Description of Artificial Sequence: Synthetic coding sequence
atggagcggtgcagccggtgccaccggctgctgctgctgctgcccctggtcctcggcctgtccgcggcacccggatgggccggagcaccacctgttgacgtgctgagggcactgcgcttccctagtttacccgacggagtgcgcagggccaaggggatttgtcctgccgatgtggcttatagggttgccaggccagcccagctgtctgctcctacccgacagctcttccctggcggattccccaaggacttttcattgctgactgtggtgcgcaccagacctggattacaggcccctctgctgactttgtattcagcacagggtgttcgccagctgggactggagcttggtcgcccagtgcgctttctctacgaggaccagaccgggaggccacagcccccgagtcagcccgtattcagggggctgtctcttgcagacggtaaatggcatagggtggctgtagccgtcaagggtcagagtgtgaccctaatcgtggattgtaaaaaacgggtgaccaggcccctgccccgctctgcacgccccgttttggacacgcacggagttatcatctttggggctcggatcttggatgaggaagtttttgaaggggatgtgcaagagctggccatcgtacctggggtccaggccgcatacgaatcttgcgaacagaaagagctggagtgtgagggaggacagcgcgaacgaccccagaaccagcagccccacagagctcaaaggagcccccagcaacaaccttcccgcctgcacagacctcaaaaccaggaaccacagtcccagccaactgagagcctatattacgattataagcctccctactatgatgtgatgaccactggtaccacaccagactatcaggacccaaccccaggggaggaagaagaaattctggagagcagccttctacccccactggaggaggagcagactgatcttcaagtccccccaacggccgaccggttccaggctgaagaatacggtgaagggggaaccgatccgcccgagggcccatatgactacacgtatggctacggagacgattatagagaagagactgagcttggacccgctctcagcgcagagactgcccactcaggcgctgccgcccacggcccccggggcctcaaaggtgaaaaaggtgagccagcagtcctggaacccgggatgctagtggagggccccccaggacctgaagggcctgcaggattaatcggtccacccggaatccagggaaatccggggcctgtgggcgatcctggtgaaagaggtccccctggaagagccggcctcccagggtcagatggagctcctggcccccccggcaccagcctaatgttgcccttcagatttggcagcggaggcggagacaaagggcccgttgttgccgctcaagaggctcaagcccaagccatcctgcaacaggctagacttgctctgagaggccccccagggccgatgggctacactggtaggcccgggccactggggcaacctgggtcccctggactcaaaggcgaatcaggggatctcgggccccaggggcccaggggacctcagggcttgactggaccaccagggaaagcaggcaggagggggcgagctggcgctgatggcgctcgaggaatgccaggggatcctggcgtgaaaggagataggggtttcgacgggctgcccgggctacctggcgagaagggccaccgaggagatactggggcccaagggttgcccggccctcccggagaagatggcgaacgcggagacgacggcgagatcggcccacgagggttacccggcgaatccggccccaggggcctcctcggccccaagggccccccgggtatcccagggcctccgtag

SEQ ID NO: 4005 - DNA, 4953 bp, Artificial Sequence
  Description of Artificial Sequence: Synthetic coding sequence
atggagcggtgcagccggtgccaccggctgctgctgctgctgccccttgtactcgggctgtccgcagcgcccggttgggctggagcccccccagtcgacgtcctgcgggcgttacggttccccagcttgcccgatggtgtgcgccgcgccaagggtatttgtccagcagacgtcgcttaccgcgtcgccaggcctgcacagctgagtgccccaacaaggcagctgtttccgggcgggtttccaaaagacttctcattacttacagtggtgcgaacgcgcccaggtctgcaggcaccactgctaactctgtatagcgcgcaaggcgtaagacaactgggcctggagctgggccctcccgtgcgcttcctctacgaggatcagactggccggccccagcccccttcacagccagtgttccggggattgagtctagccgatgggaaatggcacagggttgccgtggccgtaaaggggcagagcgtgacattaattgtggattgcaagaagagagtcacgcggcctttaccgcgatcggctcgccccgttctggatacccacggcgtcatcatctttggagcacggattctcgacgaggaggtcttcgaaggcgacgtgcaggaactcgccatcgtgccaggcgttcaggccgcctatgaatcttgcgaacagaaggagctggaatgtgagggtggccagcgcgaaagaccccaaaatcagcagccgcatagggcccagcgcagcccacagcagcaaccctctcggctgcatagacctcagaatcaggagccgcaatcccaggatccaaccccaggagaagaggaggaaattctagagagcagtctgctgcctcctctcgaagaggcggcccatggacctcgcggtttgaagggcgaaaaaggagagcccgcagtcctggagcccgggatgctggtcgaaggcccgccggggccggaaggaccagctggtctgattgggccccccggtatacagggcaatcctggcccagttggcgaccctggggagagggggcctcccgggcgcgccggacttccggggtcagacggcgcaccaggtccacctggaacctctctcatgctgcccttccgctttggatcggggggaggcgataagggacccgtggtggcagcacaagaggctcaggcccaggccatattgcagcaggcccggcttgctctgcggggacctccaggtccaatgggctatacaggacggcctgggcctttagggcagcctggctctcctggcctgaagggcgagagcggtgacctgggacctcaggggccaagaggccctcaggggctgacagggccaccgggcaaagccgggcgacgtgggcgcgctggagctgacggggcccgcggaatgcctggagatcccggcgtcaagggggatcgaggcttcgacggcctgcctggattgcctggggaaaaggggcaccggggcgataccggagcccaggggcttccaggcccgcctggggaagacggcgagaggggcgatgacggtgaaatcgggcctagaggcctcccaggtgaatctgggccaagaggtctgttaggcccaaaagggccacccggaatcccgggtcctccaggcgtgcgggggatggacggcccccaggggcccaagggcagcctgggaccacagggcgagcccgggccccccggacaacaggggacacccgggacacaagggctgcccggtcctcagggtgcaatcgggcctcacggtgaaaaaggaccccaaggcaagcccggcctgcccggaatgccaggtagtgacggaccccctggtcatccaggcaaagaggggcctccagggacgaaaggaaatcaggggccaagcggcccccagggacccctgggttatcccggacctaggggtgtgaaaggcgttgacggcattaggggactgaagggacacaagggagaaaaaggagaggatgggttccctggatttaaaggcgacatcggcgtcaaaggcgacaggggggaggtgggggtcccaggcagtcggggagaggatggtccggaggggcccaaaggcaggacaggacccacaggagatccggggcctcccggcctgatgggcgagaaaggaaagctcggggtgcccgggctccccgggtaccccggcaggcagggccccaagggctccctggggttccccggctttcccggcgcgtcaggagagaaaggagcacggggcctctcagggaagtctggtcccagaggagagcgcgggccaaccggcccacggggacaacggggacctcgcggtgccacaggcaagagcggagcaaaagggacaagcggcggagatggcccacatggtcccccaggtgaacgcgggctgcccggaccccagggcccaaacggtttccctgggccaaagggccccccgggcccccccggcaaggatggactcccaggccatcccggccagcgaggagaagtaggcttccagggtaagactgggcccccgggacctcccggtgtggtcggccctcagggggccgcaggagagactggcccaatgggagagagagggcacccaggccctcctggcccgccaggggagcaaggcctgcccggcacagcaggcaaggagggcaccaagggcgaccccggcccccccggcgcacctggtaaggacgggccagccggactccgagggttccccggtgagcggggtctcccaggcaccgcaggcggtcccgggttgaaaggaaacgaaggaccgtctggaccaccaggaccagccggttctcctggcgagcggggcgcggcagggtccggggggcctatagggcccccagggcgaccggggccacagggaccaccaggagccgcgggagaaaagggagttcctggcgagaaaggacccatcggtcctaccggacgcgacggcgtgcagggtccagtcgggctgccaggccccgctggcccacccggtgtcgctggcgaagatggtgacaagggagaggtgggcgaccccgggcagaagggaactaagggaaacaagggagagcatggcccccctggcccaccggggcccatcggtcccgtcggacagcccggagccgctggagccgacggcgaaccgggggctaggggcccccagggacactttggcgctaaaggcgacgaggggactagggggtttaatggccccccaggcccaattggattacagggcctcccggggccctctggagagaaaggtgaaacaggagatgtcgggcctatgggcccaccaggaccccccggtccgaggggacccgcaggtcctaacggagcagacggcccccaggggcctccgggcggggtgggcaacctggggccccccggcgagaagggtgagcctggtgaatcaggttctccgggcatccagggtgaacccggagttaagggaccgcggggagagcgcggggagaagggcgaaagcgggcaacctggagaacctggcccccctgggccaaagggtcccacgggcgacgacggacccaaaggaaaccccggacccgtgggctttccaggcgacccaggaccacctggggagggcggcccacgagggcaagatggagccaagggcgacagaggcgaggacggcgaaccaggccagccgggctctccaggccctacgggcgaaaacggtccacctggtccacttgggaagcgggggcccgccggttctccagggtcggagggacggcagggcggcaaaggagcgaagggcgaccccggcgccattggggcaccgggtaagactgggccggtgggaccggctggacctgctggaaagccagggcccgacggcttgagggggctcccagggagtgtgggccagcagggaagaccaggtgctaccggccaggccgggcctccaggaccggtggggccccccggcctacccgggctgagaggggacgcgggagccaagggcgagaaaggacatccaggactgattggcctcattggcccccccggcgagcagggggaaaaaggagatagagggctgccgggcccgcagggctcccccggccagaaaggtgagatgggcattcctggagccagcggcccaatcgggcctggcgggccaccgggattgcccgggcccgcaggacccaagggggctaaaggggctactgggcccgggggtcctaagggggaaaagggcgtgcaggggccccctggacatccaggtcccccaggagaagtgatccaaccgctcccaattcagatgcctaagaagacaagaagatcagtcgatggaagccgcctgatgcaagaggacgaagccattccaacaggaggtgctccaggttctcccggagggttggaagagatttttgggagcctggatagcttaagagaagaaattgaacaaatgcgcaggccaacaggcactcaggacagccccgcccgaacctgccaagatctcaaactttgccacccagaactgcccgatggagagtattgggtggatcccaatcaagggtgcgcaagggatgctttccgagtgttctgtaatttcaccgcaggcggagaaacctgtgtcactccacgggatgacgtcacccagttttcttacgtcgattctgagggatcaccggtaggcgtggtccagctgactttcctcagattgctgtccgtatccgctcatcaagatgttagctacccatgctcaggagctgccagagacgggcccctacggctgcgtggagcaaatgaagacgagctgtcccccgagacttcaccgtatgtaaaagaatttagggacggttgccagacacaacagggtagaactgtcttagaggtgaggacccccgtgctggagcagctgccagtgctagacgctagtttctctgaccttggggctccacccagacgggggggtgtccttctagggcccgtctgctttatggggtag

SEQ ID NO: 4006 - DNA, 1002 bp, Artificial Sequence
  Description of Artificial Sequence: Synthetic coding sequence
tgaaaccagagcccccaggcccaccggagcaccgtgccccacaccgcgggtttggggcagctgtgtttgctgggcttcggcatggattggagggcctccgaagcatggatggtgcccagagctcccaagggggcgtgggacccccgcgagagccaggatctgctggataacagggcaccactgggtccccgggtttttccaggcccgcgggtgccctccgcacttatggagcggcgagtgttgaaggggtcacaaggctctccagcttgcctggggccgcccggagaggtgatccaacctttacctatacagatgcccaagaaaactcgtagatcagtggatggaagccgcctgatgcaggaagacgaagctattcccaccggaggggctcccggctcccccgggggccttgaggagatcttcggtagcctggactctctacgagaggagattgaacagatgagacgtccaaccggcacacaagattctcctgccaggacgtgtcaggatctcaagctctgccaccctgagctgccagatggcgaatactgggtggacccaaaccaaggttgtgccagagacgccttccgggtgttctgcaacttcacagccggtggcgagacctgcgtgacgcctagggacgacgtgacacaattttcttacgtggactcagaggggtcacctgtgggggtcgtccaactcacctttctgcgcctgttgtctgtgagtgcccaccaggatgttagctacccctgctcaggcgctgcaagggatggccccctgcgtcttaggggcgcaaacgaggacgaactctcaccggaaacttctccatacgtgaaggagttcagggatgggtgccagacacagcaagggaggactgttctggaggtgcgaacccccgtgttggaacagctgcctgtgttagacgcaagctttagcgacttgggagcacccccccgccggggcggcgtgctgctcggtccagtttgtttcatgggatag

SEQ ID NO: 4007 - DNA, 792 bp, Artificial Sequence
  Description of Artificial Sequence: Synthetic coding sequence
tgagccccccccgtggacgtgctgcgggccctgcggttccccagcctgcccgacggagtgcgccgtgcaaagggcatatgtcctgcagacgttgcctacagagtggccagaccagcacagctgtctgcacctacccgccaactgttccccggaggttttccgaaggacttttccctgctgactgttgtgaggacgagaccaggcctgcaggctccactgttgaccctctactctgcgcagggcgttagacaactgggcctggagttaggccgccccgtacgattcctatatgaagaccagacaggaagaccacaacctcccagccaaccagtgttccgtggtctgtcactcgctgatggtaagtggcatcgggtagcagtcgccgtcaaggggcagagcgtgacactgattgtggattgcaagaagcgtgttacccgccccctccctcgctcggcacggcccgtgctggatacccatggagttattatttttggagccaggatactggacgaagaggtgttcgagggcgacgtgcaggagcttgccattgtgcctggagtgcaggctgcttacgagtcgtgcgaacagaaggagttggaatgtgagggcggccagcgcgaacgcccccagaatcagcagcctcatagagctcagcgaagcccccaacagcaaccaagccgcctccatcgcccccagaaccaagagccacagtctcaagttagggaactgggcgagccacccagcgcagcgcaccccagggagggcagacacccagggatttcccccccatag

SEQ ID NO: 4008 - DNA, 873 bp, Artificial Sequence
  Description of Artificial Sequence: Synthetic coding sequence
atggagcggtgcagccggtgccaccggctgctgctgctgctgcccttggtgttgggcctgagtgccgctccagggtgggccggagccccccctgtggacgtgttgagagcactcaggttcccttctcttccagacggggtgcggagagccaagggcatttgtccagctgatgtagcttatagagtagccaggccagcccagttgagcgcgcctacccggcagcttttcccagggggatttcccaaggacttcagtctcctaacagtggtccggactcggcccgggcttcaagctcccttgctgacactgtattcagctcagggagtcagacaactaggcctggaacttggtccacctgtccgtttcctgtacgaggaccagaccggtcgcccccagccaccctcccagcctgtttttcggggtctttcactggcagatggaaagtggcaccgcgtggccgtggctgtgaaaggtcagtctgtgacattaattgtggactgcaagaagcgggtgactcgccctctgcccaggtcagcaagacctgttttggacactcacggagtgattatcttcggcgcccgaatactcgacgaggaagtcttcgagggagacgtccaggagctggctatcgtgcccggcgttcaggccgcgtacgagtcatgtgaacaaaaggaactggagtgtgaaggtgggcagcgcgagaggccgcagaaccagcagccccatagagcacagcgctccccacagcaacagccttctcgtttacacaggcctcaaaaccaggaacctcagtcacaggttagggaactaggcgaacccccctccgccgcacacccgcgtgaagggcgccacccggggattagccccccctag

SEQ ID NO: 4009 - DNA, 1875 bp, Artificial Sequence
  Description of Artificial Sequence: Synthetic coding sequence
atggagcggtgcagccggtgccaccggctgctgctgctgctgcccctcgtgctcgggctgtccgccgccccaggttgggcaggggcccccccagtggacgttctccgcgccttgaggttccctagcctgccagatggcgtccggagggccaagggtatttgccccgctgatgtagcctatcgggtggctcggccagcacagttatccgcccctacacgccagctcttccccggcgggtttccgaaggactttagtctgctgaccgtcgtaagaacccgcccagggctacaggccccactgcttaccttgtattccgcgcaaggagtccgccagttgggcctggaactgggacgcccagtgcgcttcctttatgaagatcagactggaagaccgcagcccccctcacagccagtgttccggggactgagtctcgccgacggcaagtggcaccgagtggcagtagccgtgaaaggccaatccgtgactctgatcgttgactgcaagaagcgggttacacgccccctgcctcgttcagcgcgaccagttctcgacacgcacggcgtgatcatattcggggcccgaattctcgatgaagaggtctttgagggcgacgtgcaagagctggccatcgtgcctggcgtccaggccgcctatgagtcctgtgaacagaaggagctggaatgtgaaggtgggcagcgagagcgaccccagaaccagcagccacatagagcccagcgttcaccccagcagcaacccagcagactacataggccccaaaatcaagagccccagagtcaacccacagaatctttatattacgattatgagccaccttattacgacgttatgaccaccggcacaactcccgactaccaggatccaacaccaggggaggaagaggaaatccttgaatcgtctttgctgcccccgctggaggaggagcagactgaccttcaagtcccacctactgctgaccggtttcaggcagaggagtacggtgagggaggcacagacccacccgagggcccttatgactacacatacggctatggggatgactatcgtgaggaaactgagctcggccctgccctttctgccgaaacagcccactctggagcggccgcccacgggccgagggggctgaaaggcgaaaaaggagagccagccgtgctggagcccggaatgctcgtcgaaggcccacctggccctgagggcccagccggtctgatcgggccccccgggatccagggtaatcctgggcctgtaggagatcccggcgagcgcgggccaccaggacgagctggcttgcccggaagcgatggcgccccaggacccccaggaacatccttaatgcttcctttccggttcggttcaggcggtggggacaaaggccccgtggtagcagcccaggaggcccaggctcaggcgatcctgcagcaggcacgactggccctaaggggccccccagggccaatggggtacactggaaggccaggacctctcggccagcccggttcccccggtctcaaaggagagagtggcgatctgggcccacaaggtccaagaggccctcaaggactgaccggtccacccggcaaagccggaagaagggggagggccggcgcagacggagcacgcgggatgcctggtgacccaggtgttaaaggagaccgcggcttcgacggcctgccagggcttcccggagaaaaggggcatcggggtgacacaggcgcccagggcctaccaggccctcctggcgaggatggagagaggggagacgatggcgagattggaccaaggggactcccaggcgagtccggcccgcgcggtctcctcgggcctaaagggcctcccggcatccctggccccccttag

SEQ ID NO: 4010 - DNA, 873 bp, Artificial Sequence
  Description of Artificial Sequence: Synthetic coding sequence
atggagcggtgcagccggtgccaccggctgctgctgctgctgcccttagtgttaggactatcggcagccccaggctgggccggggcgcctcctgtcgatgtcttgagagccctccgatttccttctctgcctgatggtgtgagacgggccaagggcatttgtcctgccgatgttgcgtaccgagtggctcgacccgcgcagctgtcggcacctacccgtcagctgttcccaggcgggttcccgaaggatttctcgctgctaacagtcgtgcgaacccgccccggcctccaggccccattgcttaccctctattcagctcagggcgtgagacagctgggcctggagttggggagacccgtgaggtttttatacgaagaccagacaggccgccctcaacctcccagccagccagtgttccggggactgagcctcgccgacgggaagtggcacagagtggccgttgcggtgaaagggcaatccgtgacactcatcgtggactgcaaaaagcgggtgacgcggcctctgcctcgatctgccagaccagtattagacacccatggggtgattatcttcggggcccggatattggacgaagaagttttcgagggggacgtacaggaattggcgattgtcccaggcgtgcaggccgcctacgaatcttgcgagcagaaggagctggagtgcgaagggggacagcgggagcgcccccagaatcagcagccgcaccgagcacaacgcagtccccagcagcagccaagcagactgcaccgccctcagaatcaggagcctcaaagccaggtacgcgaactgggcgagcccccctctgctgctcatccaagagaaggtcgccaccccggcatttcgcctccatag

SEQ ID NO: 4011 - DNA, 1002 bp, Artificial Sequence
  Description of Artificial Sequence: Synthetic coding sequence
tgaaaccagagcccccaggcccaccggagcaccgtgccccacaccgctggtctagggcagctgtgccttctgggtttcgggatggattggcgggccagtgaagcctggatggtacctagggctcctaagggcgcctgggacccgagggagagccaggacttgttagataaccgtgcacccttggggccacgcgtgtttccgggtccgcgggttccatctgctctcatggaacgtcgggtgttgaagggctcccagggatcgccggcttgcctgggaccacctggcgaagtgatccagccattacctattcaaatgcccaagaaaacgcggaggagcgtggatggatcccgactaatgcaagaggacgaggccatccctactggcggggcgcctggctctccaggcggtctggaggagatattcggtagcctggattcactaagggaggagattgaacaaatgcggcggccgacaggtacacaagacagccccgctaggacttgccaggacctgaagctctgtcaccctgagctgccagatggcgagtactgggtggacccgaaccaggggtgcgccagagatgccttccgtgtgttttgcaatttcacggcaggcggagaaacgtgtgtaacaccccgcgatgatgtgacccagttctcttacgtggattcggagggaagccccgttggtgtagtgcaattgaccttcttgagactcctgagcgtgagtgcccatcaggacgtgtcctatccttgttccggtgcagcccgtgacggaccgcttagactgcggggagccaacgaggacgaactgtcacccgagacctcgccttatgtcaaagaatttagagacggatgtcaaactcaacaaggtcgcaccgtacttgaagttcgtacacctgttctggagcagctcccagtgctggatgcctccttttcagacttgggagccccaccgcggcggggaggcgtgctgctgggtcccgtttgcttcatgggctag

SEQ ID NO: 4012 - DNA, 4872 bp, Artificial Sequence
  Description of Artificial Sequence: Synthetic coding sequence
tgagccccccccgtggacgtgctgcgggccctgcggttccccagcctgcccgatggcgtgcggcgtgccaagggtatctgtccagctgacgtcgcataccgggttgccagacctgctcaattatctgcaccaacacggcaactgttccccggagggttccctaaggacttttcactgcttacggtggtccggactcgaccagggctccaggcaccactgctgactttgtacagtgctcagggagtccgccagctcggtttggagttaggccgccctgttcggtttctatacgaagatcagactggccggcctcagccaccctcccagccagtgtttagaggactcagcctggcagacggcaaatggcaccgtgtagctgtagccgtcaagggccagtccgtcaccttaatcgttgattgtaaaaaacgtgtcaccaggccactgcccaggtccgcacgcccagttctcgacacacatggcgtcatcatttttggcgccagaatcctcgacgaggaggtgttcgaaggagacgtacaggaattagctattgtgcccggcgtgcaggccgcatatgagagctgcgaacaaaaagaacttgagtgcgaaggcgggcaaagggaaagacctcaaaaccaacagcctcatcgcgcacagcgttcacctcagcagcagccttcacggcttcaccgaccccagaatcaggagccccagtctcaggatcctaccccaggcgaggaggaggagatactggagagctcgttattgcctcccttggaagaggcagcccatggccctcgaggtctcaaaggcgaaaaaggcgagccggcggtactcgaacctggaatgttagtagagggtccgcctgggcctgaaggtcccgcggggctcatcggcccccccggtattcagggtaatccgggacctgtgggcgaccccggagaacgcgggccacctggcagggccggattacccggctccgacggcgctcctggtccgcccggcacatcactaatgttaccttttcgcttcggctccggtgggggagacaaaggccccgtggtggcagctcaggaagctcaggcgcaggctatcctacagcaggcgagactggcactccgtggtccccctgggcctatgggttacaccggccgtcccggaccgttgggtcagccaggaagtccgggtttgaaaggggaatccggcgatctgggaccccaggggcccagggggcctcagggtctgacagggcctcctgggaaagctggacgcaggggccgcgctggagccgacggtgctcggggcatgccaggcgaccctggcgtgaagggcgacagggggttcgatggccttcctgggctcccaggagaaaaggggcatcggggggacactggggcgcagggactcccagggccgcctggagaagatggcgagaggggagacgacggagaaatcggcccaaggggactacccggtgagtcaggcccccgcggcctcctcggacctaagggcccacctggcatccctgggcctcctggagtaagggggatggacgggcctcaaggtcctaagggcagcctgggcccacagggggaaccggggcccccgggccaacagggcaccccaggtactcaaggcttgcccgggccccagggagccatcggaccccacggggaaaaggggccccagggcaagccgggtctgcctggaatgcccgggagcgacggcccaccgggacacccggggaaggagggtccgcctggcaccaaagggaaccaagggcccagcggaccccagggccccctgggttatcccggccccagaggtgttaagggcgttgatggcattaggggcctgaagggtcacaagggcgagaaaggagaggacggttttcctggatttaagggagacatcggtgtaaagggagatagaggggaggtcggggtgcccggaagtcgcggggaggatgggcccgaggggcccaagggacgaactgggcctaccggggatcccggcccacccggtttgatgggagagaaggggaagctcggagttccagggctgcccgggtatcctggcaggcaaggcccaaagggatcgctgggctttccagggtttcccggggctagcggggaaaagggtgctcgaggtctttcggggaaatctgggccccgaggggagcgaggtccaaccggccccaggggtcagagaggacctcggggtgcaaccggtaaatctggggccaaaggaacaagtgggggcgacggaccacacgggccaccgggcgagcgtggactccctgggcctcagggtccaaacggatttccaggacccaagggtcctccgggcccccctggaaaggacggactgccaggccatcccggacagcgcggggaggtgggctttcaagggaagaccggaccccccggacccccaggtgtggtaggccctcagggcgctgctggcgaaacagggcctatgggagaacgaggtcatcccggaccgcctgggccccctggcgagcagggtctgcctggtacagctggcaaggaaggcacaaaaggggatcccggaccaccaggcgcccccggtaaggatggacctgccggactcagaggattccccggtgagagaggccttcccggcacagccggcggcccaggcctgaagggaaatgaggggccatccggacctccagggcccgccggctcacccggggagcgtggcgcagctgggtcaggagggcctatcggacctcccggcaggccagggcctcagggacctcccggagctgccggcgaaaaaggcgtacccggtgagaaaggcccaatcgggccaactggaagagatggcgtgcagggaccggtcggactcccagggccagccggcccgccaggagtagctggcgaggacggcgataagggtgaggtgggcgatccaggacagaaaggtacaaaaggaaacaagggcgagcacgggccgcccggaccccccgggcctattggacccgtgggccagccgggggccgccggcgctgatggcgagcccggtgctagggggccacagggccatttcggggccaaaggagatgaaggaacacgcggtttcaacggacctcctggacccattggactccagggattacccggcccatccggcgaaaagggcgaaaccggggatgttggtcctatgggtcctcctggccctcccgggccacgggggcctgccggcccaaatggtgctgacgggcctcagggccctccgggaggcgtgggtaatctgggaccaccaggggagaagggggagccaggggaaagcggctcccctggcattcagggggagccaggggtcaaagggcctcgcggggagcgcggcgagaagggcgagagcgggcagccaggcgagcctggtcctcctggacccaaaggccctaccggcgacgatggacccaagggtaatcctggacctgttggcttcccaggggaccctggaccaccgggcgaaggcggcccacgtggacaagatggggctaaaggagaccgcggagaggacggggagcctggacagcctgggtccccggggccaaccggcgaaaatgggccaccaggcccgctgggcaagcgcggaccagccgggtctccagggtctgaaggcaggcagggagggaagggagcaaagggggaccctggcgctataggcgccccaggaaagacaggaccagtaggccctgcaggcccagcgggtaaacccggtcctgacggcctgaggggcctccctgggtctgttggacaacagggacgccccggcgcgactggacaggcagggccacccgggccagtcggacctcccggactgcccggccttagaggtgacgccggggccaaaggcgaaaaggggcatcccggactcattggcttaataggtccccctggggagcagggagaaaaaggtgaccgaggacttcctgggccgcaggggagccccggccagaaaggtgaaatgggaatacccggagctagcggcccaattggacccggaggtcctcctggcttaccagggccagcgggtccaaagggcgccaaaggcgctactggtcctggcggacccaagggcgagaagggagtgcagggccctccaggtcacccggggccgcccggagaagtcatccagcccttgccaatccagatgcctaaaaagaccagaagatccgtggacgggagtagactcatgcaggaagatgaagcgatccccacaggcggcgcacccggctctccaggcgggctggaggagatttttggatcactcgacagtctccgagaagaaatcgagcaaatgcgacgaccaacgggtacccaagacagccctgccagaacgtgtcaggatctcaagctgtgtcaccccgagttgccggacggtgaatattgggtcgatccgaatcagggctgcgcacgggatgcatttagagtgttttgtaattttacagccggaggcgaaacatgcgttacccctcgagatgacgttactcagttctcatatgttgactctgagggctctcccgtgggcgtggtgcaattaacattcctgcgactccttagcgtgagtgcccaccaggacgtaagctacccttgttccggcgcggcgcgagacggtcctctgcgtctgcgcggcgcaaatgaagacgaactgagccccgagacaagtccgtatgtcaaggaattcagagatggatgtcagacacaacagggtcggactgttctagaggtaaggacccctgtcctagagcagctccccgtccttgatgcgtccttctccgacctgggggccccgccgcgcaggggtggggtcctgcttggccctgtgtgctttatgggatag

SEQ ID NO: 4013 - DNA, 4953 bp, Artificial Sequence
  Description of Artificial Sequence: Synthetic coding sequence
atggagcggtgcagccggtgccaccggctgctgctgctgctgcccctggtactggggctgtcagcagcccctggatgggccggcgccccacctgtggatgtgctgagagccttgcggtttccatctctgccagacggggtgcggcgggccaaaggaatctgccctgcagacgtggcatatcgcgtcgcacgcccagcccagctgagtgcgccgacgcgccagctgttccctggcggcttccccaaggatttcagtcttcttaccgttgtgaggaccaggccaggtttacaggctccacttcttacattatactccgcccagggagtcagacagctcgggctagagcttggtcgaccggtgcggttcctgtatgaggatcagactgggcgtccacagcctccaagtcagccggtgtttcggggtctgagcctcgctgatggcaagtggcatcgggtggccgtggcagtcaaaggacaatccgtgacgctgatcgtggattgcaagaagcgtgtaacccgccccctgcctagatcagcccggccagtcctggacacccatggggtgataattttcggtgcacggatcctggatgaagaagtgttcgaaggggatgtccaggaactggccatcgtgccaggggtgcaggcggcctacgaatcctgcgaacagaaggaactggagtgtgagggggggcagcgcgaacgcccccagaatcagcagccacacagggctcagaggtcccctcagcagcagccctcccgactccatagaccccaaaaccaggagccgcagtcacaggatcctacgcctggcgaagaggaggaaatcctggaatccagcctgctgcctccccttgaggaggccgctcatggccctcggggtctgaaaggcgagaagggagaacctgccgtgcttgagcctggtatgcttgttgaggggccaccaggccccgaaggaccagccggccttatcgggccacctggcatccagggtaatcctggccctgtcggtgatccaggggaacgggggccacccggtcgggcgggcctcccaggatccgatggcgcccctggtccccccgggaccagccttatgcttcctttccgctttggtagcggggggggcgataaaggaccagtggtggccgcacaggaggcccaggcccaggctattctgcaacaggcccggctggctctcagagggccgcccgggcctatggggtacactggaaggccgggacctttgggacagcctggaagtcctggtcttaaaggcgaatctggggatctgggaccgcagggcccacgtggaccacagggcctgacaggccccccaggtaaggccggaaggagggggagagccggcgctgacggggctcgcgggatgcccggcgacccgggcgttaagggagatcgcggcttcgatgggctacccggactcccaggcgagaaggggcataggggtgatactggcgctcagggactccctggccctccaggcgaggatggggagcggggagacgacggcgagatcggtccccggggactgcccggggaatccggacccagaggtcttctaggtccaaagggacctcccggaatccccggaccccctggagtgcggggcatggatgggcctcagggcccaaagggctccttaggaccccagggcgaacccggaccacccggccagcagggcactcctgggacccagggcctccctggaccccagggagcgatcgggccccacggcgaaaagggtcctcaggggaagccaggtttgcccggaatgcctggcagcgacggaccccctggacaccctgggaaggaaggccccccaggaaccaaaggaaaccaaggccccagtggtccgcaaggccccctcggatacccaggccctcgaggtgtgaaaggcgttgacgggatacgcggactcaagggacataagggagaaaagggcgaggacgggtttcctggttttaaaggggacattggggttaagggcgataggggtgaggtaggagtgcctggaagtcgcggggaggatgggccagagggtccaaaaggtcgcacaggaccgacaggagacccaggaccaccaggcctcatgggggaaaaggggaagctcggcgtgccaggcctgcccgggtatcctggacggcagggaccaaaagggtcactcggcttcccgggattcccaggagcatcgggcgagaagggtgctcgcggtctgagtggaaagtcagggccgagaggagaaagaggcccaactggcccccgaggccagcgtggaccacgaggcgctaccggcaaaagtggcgctaagggcaccagcggaggcgacggccctcatggacccccgggcgagcggggtttgcctggccctcagggcccaaacgggttcccaggaccaaaaggccctcccggacctcccgggaaggatggattacctggacatccaggtcagcggggagaagtaggctttcagggaaagactggaccaccaggaccaccaggcgtcgtgggtccccagggggctgccggagagacagggcccatgggagaacgtggacacccaggcccccccgggccgcctggtgaacagggacttcctggtactgcagggaaagaaggcactaaaggagaccctggcccccccggcgcgcccggaaaggatggccccgccgggctgcggggcttcccaggagaaagaggactgcccggtaccgccggcggacctggtttgaagggcaacgagggtccaagcgggccacctgggcccgcaggcagccctggagagcggggtgccgccggctctgggggccccattgggcctccagggcggccagggccccaagggccacccggggctgccggagagaagggggtccctggcgaaaaaggtccaatcgggcctaccggccgagacggcgtccagggacccgtagggttgcctggacccgcaggtcccccaggagtggccggcgaggatggagacaaaggagaggttggtgacccgggccagaaagggaccaagggcaataagggggagcacgggccgccaggaccaccaggtcctatcggccctgtagggcaaccgggcgccgccggcgcagacggcgagcctggcgctcggggacctcaaggccactttggggcgaaaggtgacgagggtacaagggggtttaacggcccacccgggcctattgggttacaaggattgcccggccccagtggagagaaaggcgaaaccggcgatgttggaccgatgggccctccgggccctccaggccccagaggccctgccgggccgaacggggccgacgggcctcaggggcctcctgggggggttggcaacctcgggcctccaggggagaagggcgaaccaggcgagtcgggaagcccaggtattcagggggaacccggggtgaagggacctaggggggaaaggggagaaaagggcgagtcaggacagcccggagaacccgggcctcctggcccgaaggggccaaccggggatgacggaccaaagggtaacccgggccccgtgggtttcccgggggatccaggccctccaggcgaagggggaccacgaggccaggacggcgcaaagggagataggggcgaggatggcgagccagggcaacctggatctccaggcccaaccggcgagaacggtccacctgggcctcttggaaaaagagggcctgcaggcagtcccggcagtgaaggaaggcagggcgggaaaggggcaaaaggcgaccccggggcaattggtgcacccggcaagactggtcctgtcggccctgctgggcccgcagggaagccagggcctgacggcctgaggggactccccggctccgtaggccagcagggacggcctggcgctacaggccaggccggcccaccggggccggtgggacccccaggcctgcctgggctgaggggggatgctggtgctaaaggggaaaaaggccatccaggactgatagggttgatcgggccaccaggcgagcagggggaaaagggggacagaggactgcctggcccccaggggtcgccaggccagaaaggcgagatgggcatacctggggcgtccggcccaatcggtcctggtgggccacccggactcccagggcccgcaggcccaaaaggagccaagggggcgacgggacccggtgggcccaagggagagaaaggtgtgcagggaccgccggggcacccgggacctcccggggaagttatacagccgttgccaatccaaatgccgaaaaagacacgcaggagcgtggatgggtcgagattgatgcaggaagacgaagctatccccactggaggggcaccaggcagccccggcggcctggaggaaatcttcggatccctggactcactccgggaggaaatcgaacagatgcggagaccaaccggcacacaggactcgcccgccaggacgtgccaggacctaaaactttgccacccagagttgcctgacggcgaatactgggtagatccaaatcaaggttgcgctagagacgccttccgagtcttttgtaactttacggccggcggcgagacctgtgtgacgccacgcgatgacgtgacccagttctcgtacgtcgacagcgaaggatctcctgtcggggttgtgcaacttaccttcttgagacttctctcagtcagcgcgcaccaggacgtttcttacccttgtagcggcgccgccagggatggaccattgcgcttgcgcggagccaatgaggacgagctatccccggagaccagtccctacgtgaaggagttccgcgacggatgccagactcagcaagggaggactgttctggaagttcgcacacccgtgttggaacaactgcccgtactggacgcttcattttcagacctcggtgctcctccaagaagaggtggagtgctccttggcccagtctgcttcatggggtag

SEQ ID NO: 4014 - DNA, 873 bp, Artificial Sequence
  Description of Artificial Sequence: Synthetic coding sequence
atggagcggtgcagccggtgccaccggctgctgctgctgctgcccctggtcttggggcttagtgccgcaccaggttgggcaggcgcacctcccgtggacgttctgcgggcattgagattcccctccttaccagacggagtcagaagagcaaagggaatctgccccgctgatgtggcttaccgcgttgcacgcccagcccagttgtccgcacccacaaggcagctgttccccggcggctttcctaaggatttctcgttgctgaccgtcgtgaggacccggcccggcttgcaggccccgttgctgaccctctattcagctcagggggtgcgacagctgggcctggagctaggtaggccagtgcggtttctgtatgaagatcaaacgggccggcctcagccgccctctcagcccgtttttcgcgggttaagtctcgcagatggaaagtggcacagggtagccgtcgcggtgaagggccaatccgtcacattaattgtcgactgtaagaaacgggttaccagacccctgccgaggtccgctcgacccgtgttggacacccacggtgtaattattttcggcgctagaatactcgacgaggaggtttttgagggcgacgtccaggaactagctattgtgccgggcgtccaggctgcctacgagagctgcgaacaaaaagagttggagtgtgagggcggccagagagaacgcccgcagaaccagcagccacatagagcccagcgctcccctcagcagcagccaagtcggttacaccgcccgcagaaccaggagccgcagtcacaagtgagggaattaggggagccgccgagcgcagcccatcctagagagggccgccatccagggatttcaccaccatag

SEQ ID NO: 4015 - DNA, 1794 bp, Artificial Sequence
  Description of Artificial Sequence: Synthetic coding sequence
tgagccccccccgtggacgtgctgcgggccctgcggttccccagcctgcccgatggcgttcgaagggctaaaggcatctgtcccgcagacgtagcctaccgggtggcgcgacctgctcagctgtctgctcctacacgtcagttgtttcctggagggttcccaaaagactttagcctgctcacagtggtgaggacgagacccgggctccaggcccccttgctgacactctatagtgcacagggcgtgcggcagctgggcctcgagctgggacggccggttagatttctgtacgaggaccagacagggaggccccagccaccctcacaacccgtattccggggactgtccctggccgacggcaagtggcatcgggtggcagtggcagttaaaggacagtctgtgaccttaatcgtggattgtaagaaaagggtgacaaggccactgccccgcagtgcgagacctgtgctggacacccacggcgtgatcatattcggagctagaatcctggatgaggaggtgtttgaaggagacgtgcaggaactggcgattgtgccgggcgtgcaggccgcatatgagagttgtgagcagaaagaattagaatgtgaggggggccagcgcgaacgcccccagaaccagcagccacacagagcccaaagaagccctcaacagcagcctagtcgactccatcgaccacagaaccaagagccccagtctcagcccacagagtcgctttattacgactataagcccccttactatgatgtgatgacaactggtaccactccagattaccaggatccgaccccaggagaagaggaagaaattctcgaatcttcgctgttgccaccactggaggaggagcagaccgacctgcaggtcccaccaaccgcagatagattccaagccgaagagtacggagaaggtggcactgatccaccagaaggcccttatgattacacttacgggtacggtgatgattatagggaagaaaccgagctggggccagccctgagcgctgagaccgcccacagcggggctgctgcacatggtccaaggggactgaagggcgagaagggtgagcctgcggttctggaacctggtatgctggtggagggaccacccggaccagaaggcccggccggcctgatcggcccgcccggcatccagggcaaccctggacccgtcggtgacccaggtgagcggggtccgcctggtagagctgggcttcccggcagcgacggcgctccaggaccccctggaacctcgctgatgcttccctttcggttcggctccggaggaggtgataaaggtccagtggtcgccgcccaagaagcccaggcacaagccatcttacagcaggccaggctcgcgttgcgaggtccaccaggtccaatggggtacactggacgtcccggacctctggggcaacctggctctccaggactcaaaggcgaatcgggagatcttggaccccaagggccccgcggtccccaaggtttgactggcccacccggtaaggccgggagacgtggccgcgcaggcgccgatggcgcccgcggcatgcctggtgatcctggggtcaagggtgatcgaggcttcgatggcctgcccgggctgccgggcgaaaaaggacatcgtggcgacactggggctcagggtttgccgggccctccaggagaagacggggaacgtggagatgacggagaaatcggccctaggggtctccctggtgaaagcgggcccaggggtctcttggggcctaaaggacctccaggaattcccggaccaccttag

SEQ ID NO: 4016 - DNA, 4953 bp, Artificial Sequence
  Description of Artificial Sequence: Synthetic coding sequence
atggagcggtgcagccggtgccaccggctgctgctgctgctgcccttagtccttgggctttctgctgcccccggttgggccggagccccgccagtggatgtcctccgggccctgaggtttcctagtcttcctgatggggtaaggcgagccaaaggaatctgtcccgcagatgtggcctaccgcgtcgcgcgccccgcacaactgtctgcccccacccgacagctgttcccaggtggctttcctaaggacttttccctactcaccgtcgtcagaacccggcccggcctgcaggcaccgctgctaacactgtactcagcccaaggagtccggcagctgggtctggaacttggacggcccgttagatttctgtacgaagaccagacaggacgacctcagccgcccagccagccagtctttcgcggcctgtcacttgctgatggcaaatggcaccgggtcgccgtggccgtaaaaggccagtcagtaacattaattgttgactgtaaaaaacgcgtgacgagacctttgccccgaagcgctcgccctgttctcgacacacacggtgtcatcattttcggggcgcggatcctggacgaggaggtgtttgagggcgacgtccaggagctagccattgttcccggcgtacaagcagcatatgagtcatgcgaacagaaggaactggagtgtgaaggggggcagcgtgaaagaccccagaaccagcagccacatcgagcacaaagaagcccccaacagcagccatcgcgtctacataggcctcagaatcaggaaccccagtctcaggacccgactcctggcgaagaggaggaaattctggagtcatccttactgcctccactcgaagaggccgcacatggcccacgagggttgaaaggcgagaaaggcgagcctgcagttctggaacccgggatgctcgtcgagggtccacctggtcccgagggaccggccggattgatcgggccccccgggattcagggcaatccagggcccgtgggggaccccggcgagcgaggacccccgggtcgggccggattgcctggctccgatggtgctcccgggccaccaggtactagcctcatgctgccttttcggtttggttccggagggggtgacaaggggccggtagttgctgcccaagaggcccaagcacaggcaatcctgcaacaggcacggctcgccctgagagggcctcctgggcctatgggatatacgggtagaccaggacccctgggacagcctgggtctcctgggttgaagggagaaagcggggatctgggacctcagggcccccgcgggcctcaaggccttacaggacctccggggaaggctgggcggagggggagagcaggcgccgacggcgccagaggaatgccaggagatcccggcgtcaaaggtgacaggggtttcgacggacttcctgggcttccgggagaaaaaggccataggggggacactggggctcagggtctccccggacctccaggagaggatggagagcgtggggatgacggcgagatcggcccccgaggactccccggagagagcggtcccaggggcctcctggggcctaaaggccctccaggaattccagggccaccgggcgtgcgggggatggatggacctcagggaccgaagggcagcctaggcccccagggagagcctggcccgcccggtcaacagggtacacctgggacacaggggctcccaggcccccagggagcaatcggcccacatggcgagaaaggtcctcagggcaaaccagggcttcccggaatgccaggctccgacggtccaccaggccatcctggcaaggagggtcctcccggaactaaagggaaccaggggccctcaggcccacagggcccgctcggatatcccgggccccgcggcgttaaaggggtggacggcataagaggcctgaaagggcacaagggtgagaagggcgaagacggtttccccggctttaagggcgacatcggagttaaaggtgatagaggcgaggttggagtcccaggctccagaggagaggatggtcccgagggtcctaaggggcgaacaggccccacaggggatccaggtccccctggcctgatgggtgaaaagggcaagctcggcgtcccgggactgcccggctatcccggtagacaggggcccaaaggatccctgggttttccaggcttccccggtgcatccggagagaaaggggccagaggcctgagtgggaagtccggtcctcgcggggagcgtggacccacaggacctcggggccagagaggacccagaggcgccactggaaaatccggcgctaagggcacgtctggtggcgacgggccacacggacccccgggtgagcgaggactgcccggtcctcaagggccgaacggctttccgggccctaaaggaccccctggcccccccggaaaggatgggttgcctggacacccggggcagagaggggaagtgggcttccagggaaagaccggaccccctggccctcctggcgtcgtggggccccagggagctgcaggggaaacaggtcccatgggggagcgcggccatccaggacctcctgggccccctggggagcaggggttgccagggaccgctggaaaagagggcaccaaaggagatcctggtccgccaggggcaccagggaaagatggtcccgcgggcctgcgcggattcccgggggagagaggtcttcccggcaccgcaggggggccgggtctcaagggcaacgaaggaccgtccggtccgccaggccccgctggctctcctggggagagaggagctgccggctccggcggccctatcggcccccccggaagacctggcccccagggccctcccggtgccgcaggagaaaagggcgtgccaggtgaaaaaggtccgatcgggcccacgggaagagacggtgtgcagggccccgtgggtctcccgggtcccgcaggaccgcccggggtagcaggtgaggacggcgacaaaggggaggtaggcgatccaggccaaaaggggacgaagggcaacaaaggtgagcacggccctcccggtcctcccggcccaattggccccgtcggacaaccaggcgctgccggcgccgacggtgagccaggggcccgtgggccccaagggcacttcggcgctaaaggagacgaaggaactcgggggttcaacggcccccctggcccgattggactccagggtttgccgggcccgtctggcgaaaagggggaaaccggcgatgtgggccccatggggccccccggccccccaggcccacgggggcctgcaggccctaacggcgccgatggccctcaagggccccccggtggtgttggtaacctcgggccccccggggagaaaggggaacctggggagtccggcagtcctggcatccaaggtgagccaggggtgaagggcccgcggggggaacgcggcgagaagggcgaatccggccaacccggtgaaccgggtccccctgggccaaaaggacctacaggagacgatggacctaagggcaatccaggccctgttggttttcccggcgatcccggacccccaggagagggcgggcctcgggggcaggacggagcaaaaggggaccgcggtgaggacggcgaaccaggccagcctggctccccaggccctaccggcgaaaatggtcctcccggaccactgggcaaaaggggccccgccggctccccaggaagtgaaggtagacaggggggcaagggagccaagggggacccaggcgcgattggagcccctggcaaaacaggtccagtggggccagctggacccgcaggcaagcccggccccgatggactgcgcggactccctgggtccgtgggtcaacaggggcgaccaggcgctactgggcaggcaggaccgcctggacccgtcggcccacccggtttgcctggactacggggagatgccggcgcaaaaggtgaaaagggtcatccggggttaatcggtctcatcggaccccccggcgaacagggggagaagggggataggggcctaccgggcccacaggggtccccgggccagaagggcgaaatgggaattcctggcgcaagcgggccgattggcccaggcggcccccctggtctgcctggcccggctggcccaaagggagcaaagggcgcgaccggcccagggggacctaagggagaaaagggtgtccaggggccccctggccacccaggtcctcccggggaagtgatccagcctcttccgattcagatgcctaaaaaaacccgccgttccgttgatggatcccgccttatgcaggaggatgaggcaatacccacagggggggcccctggaagcccaggcggactggaggagatcttcggcagtttggactctttacgggaggaaatcgagcaaatgagaaggcccacagggacccaagatagccctgcacgcacatgccaggacttgaaattatgccatcccgagctgcctgatggcgaatattgggtcgatccaaatcaggggtgtgcgagagacgctttccgcgtcttttgcaatttcaccgccggtggcgagacctgtgtgacaccaagagatgacgtcacacagttctcttatgtagactctgaaggcagtccagtcggcgtggttcagctcacattcttaaggctcctgagtgtgtcagcacatcaggacgtgtcttatccctgctccggtgcggccagggacgggcctctccgcctaagaggggccaatgaagacgagctctcccccgaaactagtccttatgtgaaggagtttagggacggctgccagacccaacagggacgtactgtcctcgaggtgcgtactcccgtgctggagcagctgccggttctggacgccagctttagcgatctgggcgctcccccaagaaggggcggcgtgctgctgggacccgtctgtttcatgggctag

SEQ ID NO: 4017 - DNA, 1875 bp, Artificial Sequence
  Description of Artificial Sequence: Synthetic coding sequence
atggagcggtgcagccggtgccaccggctgctgctgctgctgccccttgtccttgggctgtcagcagctccagggtgggctggtgccccccccgtggacgtactgcgggctctgagatttccaagcctgcccgatggggtccgccgcgccaagggcatctgcccggctgacgttgcttatagggtggcacgtccagcccagctatccgcaccaaccaggcaattgtttccaggaggattcccaaaggatttttccctgctgaccgtagttcggactaggcctggccttcaggctccactcctgacactctactcagcccagggcgtgcggcagctcggcttagaactcggcagacctgtacgctttctgtacgaggatcaaaccgggcggccacagcccccgtcccaacctgtcttccgcggtctttccttggctgatggcaagtggcacagggtcgcagtcgctgtaaaggggcagtcggtaaccctgatagttgactgtaagaagcgagtcacacgtcctcttccaaggtccgctcgtcctgtgctcgatacccacggggtaattatattcggcgcacgtatcttagacgaagaggtgtttgagggtgacgtccaggagctcgcgatagtgccgggcgttcaagctgcctacgagagttgtgagcagaaagagttagaatgtgagggaggacagagggagagaccacagaaccagcagccgcacagggcacagcggagcccacagcagcagccatcaaggctgcaccggccgcagaaccaagaaccacagtctcagcccactgaatccctgtattacgactacgagcccccatattatgacgttatgaccacgggaaccacaccggattaccaggatccaacacccggggaagaagaagagatccttgagtcatctcttcttcctccattagaggaggaacagacagatctgcaggtgccaccaacagccgataggttccaggcagaagagtacggagagggtggcactgatccacccgagggcccctacgattacacatatggctacggtgacgattaccgagaggagaccgagttaggacctgctctgtccgctgagactgcacacagcggggccgctgcacatgggccccggggactgaagggcgaaaagggcgaacccgcagtccttgaaccaggcatgctcgtggaggggcccccaggtcccgaaggccccgccggcctgattggcccacctggaattcaaggcaaccctggccccgtgggcgaccccggtgagcgggggcccccaggccgggccggcttaccaggatcggatggagctccaggcccgcccggcacctcattgatgctccctttccgcttcgggagcggcggcggtgataagggacctgtggttgctgcccaagaggcccaggcacaggcgattctccagcaagccagactcgccctgcgcggacccccaggtcccatgggatataccggaagacccgggccacttggacaacccggatcccccggcttaaaaggcgaatccggggaccttgggccacagggaccaaggggaccgcagggcttaacggggcctccaggcaaggctggccgaagagggagggctggtgccgatggcgccagagggatgcctggtgaccctggcgttaaaggggaccgcggcttcgacggactacccggactgccgggcgaaaagggccacaggggcgacacaggtgcacaaggcttgcccgggcctcccggcgaagatggtgaacggggtgacgacggggaaattgggccccggggactgccaggggaatctgggccacgaggcctattgggtcctaagggccctccaggaatccccggccctccctag

SEQ ID NO: 4018 - DNA, 1875 bp, Artificial Sequence
  Description of Artificial Sequence: Synthetic coding sequence
atggagcggtgcagccggtgccaccggctgctgctgctgctgcccctcgtgctgggcctttccgccgctccaggttgggcaggagcaccccccgtagacgtgctcagagctctccgatttccaagcctcccagatggggtgaggcgggccaaggggatttgtccagcagatgtggcttacagggtcgcccgtcctgctcagttaagcgcaccgacccgccagctctttcctggaggatttccgaaggacttttctttgcttacggtggtgagaacgaggccgggtttgcaggcgcccctactcaccttgtactccgcacagggtgtgcgacagctggggctggagctgggtccccccgtgaggttcctttacgaggatcagaccggcaggccccaaccacccagtcagccagtgttccgcgggttgagtctcgccgatggaaagtggcatcgtgtagccgtcgcagtaaaaggtcaatccgtgactctcatagtcgattgcaagaagcgggtgaccagacccttgcccaggagcgcacgacctgttctggacacacatggagtgatcatattcggcgcaaggatccttgatgaggaggttttcgagggggacgtacaggagctggcaatcgtacctggggttcaagctgcctacgagtcttgtgaacagaaagaactggagtgtgagggaggtcaaagggagcgacctcagaatcaacaaccacacagggcccagcgttcccctcagcaacagccatcaaggctgcatagaccccagaaccaagagcctcagagtcagcctaccgaaagcctgtactacgactacaaaccaccatactatgacgtgatgactaccggaacaacacccgattaccaggaccctactcctggcgaggaggaggaaatcctggagtctagtttgctgccacccttagaagaggagcagaccgaccttcaggtgccaccaactgccgacaggtttcaggccgaggaatatggcgaaggcgggaccgaccccccagaaggcccttacgattacacatacggttacggagatgattatagggaggagaccgagctaggccctgccctttcggccgaaacagcccactccggggccgccgcgcacgggccccggggccttaagggagagaaaggagagccggccgttctggagccaggcatgttagtcgaaggtcccccaggaccggaagggcccgctggcctgatcggtccgcctgggatccaaggaaaccctgggcccgtgggagatcctggcgagagaggaccccccggccgagctggtcttccaggctcagacggcgctcctgggccccctgggaccagtcttatgctgccgtttagattcggaagtggcggcggcgataagggaccggtggttgcggcacaggaagcccaggcacaggccatactccaacaggcccgcttagccctacggggaccccccggccctatgggttacacaggtaggcctggaccactcggccagccgggatccccagggctgaagggcgagagcggggatctggggcctcagggcccacgcgggccgcaaggactcacgggcccccctgggaaggcgggccggcgcggtcgcgctggtgccgacggagctagaggaatgcctggagaccctggggttaagggtgatcgtggattcgatgggctaccaggtctcccaggtgaaaaaggccaccgcggggatacgggcgcccagggcctccccggtccaccgggggaagatggcgagcgcggcgatgatggggaaattggtcctcgcgggctgccgggcgaaagcgggccgagaggcttgcttggtccaaagggtccaccaggcatcccgggacctccctag

SEQ ID NO: 4019 - DNA, 1875 bp, Artificial Sequence
  Description of Artificial Sequence: Synthetic coding sequence
atggagcggtgcagccggtgccaccggctgctgctgctgctgccccttgtcctgggcctgtccgcagccccaggatgggcaggagctccacccgtcgatgtgttacgtgccttgcggttccccagtttacctgatggtgtcaggcgcgctaaggggatttgcccagctgacgtagcctatagggtcgccagacctgcacagttgagcgctccaacacggcagctctttcccggcggcttccctaaagacttcagcctgttgaccgtggtacgcacaaggccgggtctgcaagcgcctctgctgactctttatagtgcccagggagtcaggcagctgggcttggaactaggccgccctgtgcgattcctgtatgaggatcagacagggagacctcagccccctagtcaacctgtgttcagaggcctcagtcttgctgacgggaaatggcacagagttgctgtggccgtgaaaggccagagtgtcaccctcatcgtggactgcaaaaaaagggtgactcgccctctccctcgttctgccagaccagtgctggacacccacggggtgattatctttggggccagaatactggatgaggaggttttcgaaggtgacgtccaagagttagcaattgtccccggagtgcaagcagcttacgaatcctgcgaacagaaggagttggaatgcgagggcggtcaaagggaaagacctcagaaccaacaaccacaccgggcacagagatcaccccaacagcagccaagccgtctgcaccgtccccaaaatcaagaacctcagtcccagcctaccgaaagtctctattatgattacaaacccccatactatgatgtcatgacaactggaaccacccccgactaccaggatcccactcccggggaagaggaagaaattctggaatctagcctgctgccccctctcgaggaggagcagactgacctgcaggtgccaccaacggctgatcgtttccaagccgaagagtacggcgaggggggtacagaccccccggagggcccctacgattatacatacggttacggcgatgactacagagaggagactgagttgggacccgcactaagcgctgagaccgcgcactcaggggctgccgcacatgggccccgtggtctgaagggcgaaaagggcgaacctgcagtcctggaacccggtatgctagtcgaaggaccgcctggtcctgagggcccagccggtctgattggacctcctggcattcaagggaacccgggcccggttggcgatccaggggaacggggtcctcccgggcgtgctggcctgcctgggagcgatggagccccaggccctccgggcacatccctgatgctgccattccgctttggctccggtggtggtgataagggccccgtcgtggccgctcaagaagcccaggcccaggccatcctgcagcaggcaagactcgccctgaggggacctccaggtccgatgggatacactgggcgtcccggccccctcggtcagcccgggagccccggcttgaagggtgaatctggagacctcggcccacaagggcctcggggtcctcagggcctgaccggccctccaggcaaggcagggagacggggacgggcaggggctgatggtgcaaggggaatgccaggagaccccggtgtgaaaggagaccgcggctttgacggtctgcccggcttgcccggtgagaaaggacacaggggcgacaccggcgcacagggtctccctggtcctccaggcgaagatggggaacgcggggacgatggggagattggtcccaggggcctcccaggcgagtctggccccagaggactgttgggcccgaagggtcctccaggtattcctggaccgccatag

SEQ ID NO: 4020 - DNA, 873 bp, Artificial Sequence
  Description of Artificial Sequence: Synthetic coding sequence
atggagcggtgcagccggtgccaccggctgctgctgctgctgcccctagtgctgggcctgtctgctgcccccgggtgggccggcgcaccccccgtagatgttctgcgggcactgcggttcccatccttgccagacggcgtgcgtagggccaagggtatctgtcccgcggacgtggcttacagggtagcccgacccgctcaactgagcgcccctacaagacaacttttccccggaggtttcccaaaagatttttccctgctcacagtggtgagaactagaccaggactgcaggcgcccttactaaccctgtatagcgcccagggcgtaaggcagcttggtctagagcttgggcgaccagtgcgatttttgtacgaagatcagaccggtcggccacaacctccatcccagccggtgttccgcgggctgtctctggccgatggtaagtggcacagagtggctgtggccgttaaggggcaatctgtgacgctgatcgtggattgcaagaaaagagtgacgaggcccctgccgcgatccgctcgaccggtgcttgatacacacggcgtcatcatttttggagcaaggattctggacgaagaggtattcgagggtgatgtccaagaactcgctatcgtgcccggagtccaagccgcctacgagtcttgcgagcagaaggagctcgaatgcgagggcggtcagcgggagcggccacagaatcagcagcctcacagagctcaaagatctcctcagcagcaaccatcccgccttcataggccccaaaaccaggaaccccagtctcaggttcgtgagctgggggagcctccatcagcggctcacccgcgggaggggcgccaccccggaatctctcccccctag

SEQ ID NO: 4021 - DNA, 1875 bp, Artificial Sequence
  Description of Artificial Sequence: Synthetic coding sequence
atggagcggtgcagccggtgccaccggctgctgctgctgctgcccctagtgctggggctcagcgccgccccggggtgggccggcgcaccccctgtcgatgtgttgcgggccctgcgcttcccttcccttccagatggagtgagacgagctaagggcatttgccctgcagatgtggcctaccgagtcgcccggccagcccagctgtctgcgcctacccggcagttattcccggggggctttcccaaggatttttctctgctcaccgtggtgcggacccgccctggactgcaggcccctcttctgaccctgtatagcgcccaaggcgtcagacaactgggtctcgaacttggacgacctgtgcggtttctgtatgaagatcagacggggagacctcaacctcccagtcaacccgtgttccgggggctgtccctcgccgacggaaaatggcaccgtgtggccgttgccgtcaagggccagagtgtgactctcattgtcgattgcaaaaagagagtgacccggccgctccctcggagcgcacgtcctgtcctcgacacccatggagtcattatatttggtgcaagaatcctggatgaggaagtgttcgagggcgacgtgcaggaactcgcaattgtacccggggttcaggccgcatatgaatcttgtgaacagaaagaactggaatgcgaaggcggccaacgagaacgcccgcaaaaccagcaacctcatagagctcagagatctccacagcaacagccctcacgcttacatagaccacagaatcaggaacctcaatcccagccaacagaatctctgtactacgattacgaacccccctattacgacgtgatgactactggcaccactccagactaccaggaccctacacctggggaagaggaagagatcctggagtcgagtcttctccccccgctggaggaggaacagacagacttgcaagtgcccccaacagccgaccgctttcaggccgaggagtacggtgaaggcggaacagacccaccagaagggccctacgattacacatacggttatggcgacgactacagagaggaaaccgagctgggccctgccctatccgctgagaccgcccactcaggggccgcagcccacgggccacggggactcaagggcgagaaaggggagcccgccgtgcttgagccggggatgctcgttgagggccctccaggccccgagggacctgccggcctcatcggcccccctggcatccaaggtaacccaggccctgtaggagaccccggcgagcgcggtccacccgggcgtgccggactgccagggagcgacggtgcccccggtcctcccggcacgagcctcatgctgccatttcgctttggcagcggaggtggggacaaggggccggtagtagcggctcaggaggcccaagctcaggccattttacagcaggcaagactggcattgcgaggcccccctgggccaatggggtatacgggacgccctggacccctcggccagcctggcagtcctgggctgaagggggagagtggggacctaggaccgcagggacccaggggcccccaaggtttgaccggcccccctgggaaggccggccgccgggggcgggccggcgcagacggagctaggggtatgcccggcgatcctggggtgaaaggggatagaggattcgacggactgccgggactacccggggagaagggtcataggggagacactggggctcagggcttgccaggtccacccggagaggatggcgagcggggggatgatggcgagattggccctagaggcttgcccggagaatctgggcctcgtggactgctgggacccaaaggcccaccgggtatccccgggccgccgtag

SEQ ID NO: 4022 - DNA, 5070 bp, Artificial Sequence
  Description of Artificial Sequence: Synthetic coding sequence
atggagcggtgcagccggtgccaccggctgctgctgctgctgcccttggtgctcggactatcggccgcccctgggtgggcgggagcaccacctgtcgatgttcttcgagctctgcggttcccatctctgcctgatggcgtgcggagggctaagggcatttgtcccgccgacgtcgcttacagggtggcaagacctgctcagctcagcgctcctacacgtcagctgttcccagggggatttcccaaggatttctccctgttaaccgttgtccggactaggcctggcctccaggccccattgctcaccctatattctgcccagggagtccgacaactggggctagagctaggcccccctgttagattcttatacgaagatcaaacaggcagaccacagccgccgagtcagccagtcttccgcggcctctccctggccgatgggaaatggcatcgcgtggccgtcgccgtgaaggggcagtctgtgaccctgatcgtagactgcaagaagagagtcactagacctcttcctagatcagctcgtcctgtgttggatacccatggggtcatcatattcggggcgcgcatccttgacgaggaggtgtttgagggtgacgtgcaggagctggcaattgttcctggcgtgcaggccgcatatgagagctgtgagcagaaagaactagagtgcgagggtggccagcgcgagaggccgcagaatcagcagccccacagggcacagagatctcctcaacagcagccatccaggctacaccgcccccaaaatcaggagccccaatctcaagagcagacggacctccaagtccctcccacagccgaccgcttccaggctgaagaatatggggaaggcggaacagaccctcctgaggggccctacgattacacgtacggctacggagatgactaccgggaagagaccgaactgggtcctgctttaagcgctgagacagcccattcaggagccgccgcccatggtcccagaggactcaaaggagaaaaaggagaaccagctgtcctggagcctggcatgctggttgagggtcctccaggacctgagggccccgctgggcttattggtccaccaggcatccagggcaaccccggcccagttggcgatcctggtgagcggggccctccaggtcgagctggccttccagggagtgatggagctcctggcccgccagggacctcgttgatgttaccgtttaggtttggatcaggggggggtgacaagggtcctgtggtggccgctcaggaggcacaagcccaggctattctccagcaggcgcgtcttgccctgagaggcccacctggaccaatggggtacaccggcaggccaggtcccctgggtcagcctgggtcaccagggctgaaaggtgaatccggggatttgggcccccagggccccagggggcctcagggcttgaccgggcccccgggaaaagccggtaggcgaggtagagcaggggccgacggcgcacgtggaatgccaggggaccccggggtcaagggcgaccggggcttcgatggattgcctgggctccccggcgagaaagggcatagaggagatacaggtgctcaagggctgccgggacccccaggtgaggatggagagcgaggtgacgacggcgagataggcccccgtggcttgccaggtgaatcaggaccgcgtggcctcctgggacccaaaggacccccaggcattcccggcccacctggcgtacggggcatggacggcccccagggacctaaaggtagcctcggaccacaaggcgaacccggaccccccggccaacagggcactccaggtacccagggcctgcccggacctcaaggcgctatcggcccacatggagaaaaggggccacagggcaagcctggattgccaggaatgccaggctccgacggaccccctggacatcccgggaaagagggcccccctggcacaaagggcaaccaggggccatcagggccccagggcccactgggctatcccggccctagaggcgtcaaaggggttgacggtataagaggtctcaaaggacacaagggcgagaaaggtgaggacggctttcctggcttcaagggggacatcggcgttaaaggagatcggggggaagtcggcgtgcccggctcccgcggggaagatggcccggaagggccaaaaggaaggacaggcccaacgggcgacccagggcccccggggttgatgggggagaagggaaagctgggggtacctgggctgcctggctatccaggtcgacagggcccaaagggatctctcggatttcccgggtttcccggcgcgagcggcgagaaaggcgctaggggcctgagtggaaagtccgggcctcgaggggaacgcgggcccaccggtccgcgcggccagaggggcccccggggcgccactgggaaaagcggggccaaaggtacaagcggaggggatgggccacatgggcctccaggagagcgcggtctcccaggtcctcagggtccaaatggttttcctgggccaaaaggtccccccgggcctccaggcaaagatggtctgcccggacaccctggacagagaggcgaagtcgggtttcaaggaaaaaccggcccaccagggccacccggcgtggttgggcctcagggtgctgccggtgaaacaggcccaatgggtgaacggggacaccctggaccacccgggccaccaggtgagcaaggtctgcccggcacggctggtaaggagggtaccaaaggcgaccccggaccgccgggagccccgggtaaggacgggccagccgggttgagaggctttccaggcgaacggggactcccaggcaccgctggaggccccgggctcaaaggtaacgagggtccctcgggccctcccggcccagccgggtcaccgggggagagaggggccgcaggctctggagggcctattggccctcccgggcgcccaggaccacaggggccgccaggggcggccggcgagaagggcgtccccggagagaagggcccaatcggacctaccggccgcgatggggtgcagggccccgtgggactacccgggccagcaggccctcccggagttgccggagaagatggagataagggtgaggtgggcgatcccgggcaaaagggcaccaaggggaacaagggcgagcacggacctccgggacctcctggccccataggccctgtcggacagcctggggctgccggggctgacggagagccaggtgccaggggcccccaaggccatttcggcgccaaaggtgatgagggtacacggggctttaatggacctcccggccccatcggactgcagggtctccccggtcctagtggagaaaagggagagaccggcgatgtggggccaatgggcccacctggacctccaggccccagaggccccgccgggccaaatggcgcggatggaccacaggggcctcctggcggagtgggcaaccttgggccgccgggggagaagggagagccaggcgagtccggaagccctggcatccaaggggagcccggcgtgaaggggcctcgcggggaacggggtgaaaaaggcgagtccgggcagcccggcgaacccggacctcctgggccgaaggggcctactggcgatgacggccccaagggcaatccgggacccgttgggttcccaggagatcctggtccccctggcgaaggggggccaagaggccaggacggggccaaaggcgacagaggcgaagacggggagcctggtcagccagggagccccggcccgacgggagaaaacggtcctcctggccccctcggcaagaggggcccggccggatcccctggctccgagggccgccaaggcggcaagggagccaaaggggatcctggagcaatcggggctccagggaagaccggaccggtcggacctgccggaccagctggtaaaccgggcccagacggcctgcgagggctgcccggcagcgtgggccagcagggaagaccaggggctaccgggcaggccggccctccaggtcctgtgggacctcctgggctccccgggctcaggggcgacgctggcgccaagggggagaaagggcatcccgggctgattggcttgattgggccgcccggggagcaaggggagaagggtgatcgcggcttacccgggccacagggatcacctgggcagaaaggggaaatgggcatccccggcgcctcgggtcctatcggacccggtggtcctccaggactaccaggtcctgctggaccaaaaggggcgaaaggcgcaacaggtcccgggggtcccaagggggaaaagggagttcaggggcctcccggacaccctggtcctccaggggaggtcatccagccattgcctatccagatgccaaagaaaaccaggcgttccgtggacggaagcagactcatgcaggaagatgaagcaatccctaccggcggagccccaggctcgcccggaggtctggaggagatattcgggtctttagacagtcttcgcgaggagatcgagcagatgaggaggcctactggcactcaagactcccccgcccggacatgccaggatctcaaactgtgtcaccctgaactgccagatggagaatactgggtggatcctaaccagggatgtgcgcgcgatgcatttagagtattctgtaatttcaccgcagggggagagacatgcgttactccaagagatgatgtcacccagtttagttatgtggattccgaaggaagcccagttggggtagtccagctgaccttccttcggctgctgagtgtgtctgctcatcaggatgtctcttacccctgctccggcgctgcaagagacggcccactccgcctgaggggggcgaacgaagacgagctttcccctgagacctcaccttatgttaaggaatttcgggacggctgtcagacacaacagggccgaacagttctcgaggtgagaacccccgtgttggaacagttacctgtccttgatgcctctttcagcgatctcggagctcctcccagaagaggcggcgtgctgctgggccccgtgtgtttcatgggctag

SEQ ID NO: 4023 - DNA, 5133 bp, Artificial Sequence
  Description of Artificial Sequence: Synthetic coding sequence
atggagcggtgcagccggtgccaccggctgctgctgctgctgccccttgtgctgggcctgtcagcggcgcctggatgggcaggagctccgcctgtggatgttctacgggccctcaggttcccatcattacccgatggagtgaggcgcgccaagggcatctgccccgcagatgttgcttatcgggtcgctcgtccagcccagctgagtgctcccacccgtcagctgtttccaggtggctttcccaaggatttttctctgctgacagtcgtgcgaactcgccccgggttgcaggccccactgctcacgctctactcagcgcaaggagttaggcagctgggactggaattgggaccaccagtcaggttcttatatgaagatcagacaggcagaccacagccaccgtcacagccagtctttagaggattgtcgttggcagacggaaagtggcatagggtggcggtcgctgtaaagggacaatccgtgacactgattgtggactgtaagaagcgagtcacccgcccgctgccccggtcagcacgccctgttctggatactcatggcgtgatcatctttggtgctcgcatcttggatgaagaagtgtttgagggtgatgtgcaggaacttgcgatcgtcccgggcgtgcaggccgcatacgagtcttgtgaacagaaagagctggaatgcgaaggaggccagcgtgagaggccccaaaaccagcaaccgcatcgcgcgcagcggtctcctcaacagcagccctcccggcttcaccgccctcagaaccaggagccccaatcacaagaccctacacccggcgaggaggaggagatcttggagtcaagccttcttccaccgcttgaggaagagcagactgacctgcaggtcccgcccacagcagacaggttccaggccgaggagtacggcgagggcgggaccgatcctccggagggaccgtacgactatacatacggatacggcgatgattatcgcgaagagaccgagctcggccctgctctctctgctgagaccgcccattctggtgctgcggcgcacggccctcgaggcctgaagggcgaaaagggagagcccgccgtgttagagcccggcatgctggtggagggtccccccgggcccgagggaccagctgggctcattggtccaccgggcatccagggcaacccaggaccggtaggcgatcccggggagagaggcccaccaggtcgggccgggctcccgggaagcgatggagcccctgggcctccggggaccagcttaatgctgccttttcggttcggaagtgggggcggagacaaaggcccagtggtggccgcgcaagaggctcaagcccaagctattctgcaacaggctaggcttgccttgagaggccctccaggtccgatgggctacaccgggaggcctggaccccttggccagccaggcagccccggccttaaaggcgaatctggtgacctgggtccacaaggccctcgcgggccacaggggctgacgggacctcctggcaaggctgggcggcgaggaagagcaggcgccgacggggctcgagggatgcctggcgatccgggagtaaaaggcgaccggggatttgatgggctgcctggactccccggcgagaaaggacatcgaggtgacaccggggctcaaggactgccaggcccccctggtgaggacggggaacggggtgatgacggcgagatcggccctcggggcctcccaggagagtccggcccccgcggcctgctgggcccaaaggggccacccgggattccaggcccccctggcgttagagggatggatggccctcagggtcccaagggttcgcttgggccgcagggagaacccggtcctccggggcagcagggtacccccggcacccagggactcccagggccccagggtgccatcgggccccacggcgagaagggcccacagggcaagcctgggttgccgggcatgcccggtagcgacggaccaccagggcaccctggaaaggagggtcctcctggaaccaaaggaaatcaggggcctagtggacctcagggtccactgggatatccgggcccacgcggtgtcaaaggtgtggacggcatcaggggactgaagggtcacaagggggaaaaaggagaggatggctttccaggatttaaaggcgatattggcgtgaagggcgacagaggagaagtgggagtacctggcagtcgcggtgaagacggccccgaaggaccaaaagggcgcaccggaccaacaggggacccaggacctccaggcctgatgggggaaaaaggaaagcttggggtgcctggcctccctggatatcccggtcggcagggtccaaaagggtccctgggctttccagggttcccaggggcctcaggtgaaaagggtgccagaggcctctcagggaaatcaggaccgcgcggtgagagaggaccgactggtccacgaggacaacgggggccccggggtgctacaggaaaatctggggcgaagggcacatcagggggggacggaccccacggcccacccggagagcgtggtcttcctgggccgcaaggcccgaatggatttcctggccccaagggccccccgggtcctccaggcaaggacgggctcccaggccatcctggtcagaggggagaggtaggattccagggcaagaccgggcccccgggaccacctggtgtagttgggccacagggggcagccggggaaacgggccccatgggtgagcgtggacaccccgggcctccaggaccaccgggcgagcagggcctgcctggaacagccggcaaggagggtaccaaaggtgaccctggaccaccgggcgcacctggcaaggacggccccgctgggctgcgggggtttcccggagaacgtggacttcccgggaccgccggcggccccgggcttaaagggaacgagggcccaagcggacccccagggcctgctggcagccctggcgaaaggggtgctgcgggatcgggcggaccaatcggcccgccagggagaccgggccctcagggccctcctggggccgccggggagaagggcgttcccggcgaaaagggtccaattgggccgaccgggagggacggtgtgcagggcccagtggggttgcccgggccagcagggccccccggtgttgctggagaagatggcgacaagggagaagtgggcgacccgggacagaagggcacaaaaggaaataagggagagcacgggcctcctggtccaccgggacccatcggccctgtcggtcaacctggggccgctggagccgacggggagccgggagcaagggggcctcagggccacttcggtgccaagggcgatgagggtacacgcggatttaacgggccccctgggccgattggcctgcagggtctgccgggaccaagtggcgagaagggcgagactggcgacgtgggtcccatgggccccccgggtcctccaggaccacgagggcctgctgggcccaacggagcggacggaccacaggggcctccaggaggagttggcaatctgggccctccaggagagaagggcgagccgggtgaatcaggcagcccagggatccagggggagccaggagttaagggtccccggggagaaagaggagagaaaggagagtctggccagcccggggaacccggccccccaggtccaaaaggacctacgggcgatgatggcccgaagggtaaccctgggccggtcggattcccgggagaccctggtccacccggggagggaggaccacgtggacaggacggtgccaagggcgaccgaggggaggatggcgaaccaggacagcctggttcacccgggcctactggtgagaatggcccacccgggcctctgggcaaaagagggcccgctggctcacccggttcagaaggaaggcaggggggtaaaggggcgaaaggggacccgggcgccataggcgcgcctggaaagacaggcccagtcggccccgcgggcccagctgggaagcccggacctgatggcctacggggacttcccggctctgtcggtcagcagggacgccctggcgccacggggcaggcaggcccccctggccccgtcggaccacccggcctccctggcttaaggggcgatgccggagctaaaggtgagaagggccaccccggcttaatagggttgatcgggcctccaggagagcagggagagaagggggatagggggctcccgggcccacaaggttcccctggacagaaaggcgagatggggatcccaggagccagtggtcccataggtccggggggaccacctgggctccctggccctgctgggccgaagggagcaaagggcgctacaggcccaggcggaccgaaaggcgagaaaggcgttcagggacctcccgggcatcctgggccgcctggtgaagtaatccagcctctccccatccagatgcctaaaaagactaggaggagcgtcgatggcagtcggctgatgcaggaagacgaggctattcccacaggcggcgccccgggctctcctggtggcctggaggagatttttggttcccttgactcgttacgcgaggagatcgaacagatgcgccggcctactgggacccaggactcccccgctcgaacctgccaagacctgaaactctgccaccctgaactgcccgacggagagtattgggtggatccaaatcagggttgcgctcgtgatgctttcagagtgttttgtaatttcacagccggcggagaaacctgcgtcacaccaagagacgatgtcacccagttctcgtacgtggattcagaggggtctccggtcggtgtggtgcagctgacctttttgcgcttgctgtccgtctctgctcaccaagacgtgtcttacccctgcagcggtgctgcccgggacggccctctgcgcttgcgcggtgcgaatgaagatgagctcagccctgagacatcgccttacgtgaaggagtttagagacggttgccaaactcagcagggacggacagttctcgaggtacggactcccgttctggaacagctgcctgtgctggacgcttcgttctccgaccttggagcgcccccaaggagagggggtgtcctgctgggacccgtctgcttcatggggtag

SEQ ID NO: 4024 - DNA, 4968 bp, Artificial Sequence
  Description of Artificial Sequence: Synthetic coding sequence
atggagcggtgcagccggtgccaccggctgctgctgctgctgcccctcgtgctaggactgagcgccgcacccggctgggctggcgccccccccgttgatgtactccgtgccctgaggttccccagtctcccggacggcgttcgccgggcaaaggggatttgcccggctgacgtcgcttaccgggtcgcaagaccagcccagctgtctgccccgactagacagttatttcccggcggcttccccaaggatttctcccttctgactgtcgttaggaccagacccgggttgcaggcacccctgctgacattatatagtgcccaaggggttagacagctcggcctggaactgggccgccctgtgaggtttctgtatgaagaccaaactgggagacctcagcccccaagccagcccgtctttcgcggcttatcattggccgatgggaaatggcaccgggtcgccgtggcagttaaaggacagtctgttacattgatcgtcgactgcaagaagcgcgtgactcgacctctgcccagaagcgccaggccagtgttagatacccatggggtcataatctttggcgcaaggattctggacgaagaagtttttgagggagatgtacaggaattggctattgtgcccggtgttcaagccgcttatgaatcttgcgagcaaaaggagctggaatgcgagggaggacagagagaaagaccgcaaaaccaacaaccccaccgggcccagcgttccccccaacagcagcctagtcggctgcaccgaccacagaatcaggaaccccagagccagcccaccgagtccttgtactatgattacgagcccccttattacgacgtgatgaccaccggcaccaccccggattatcaggctgcccatgggccacgcggcctaaaaggagagaagggcgagccagcagtgctggaacctggcatgctagttgaaggtccgcccggaccagaaggacctgctggacttatcggccctcctggcattcagggtaatccaggcccggtcggcgatccgggggagagaggccccccaggcagggctggtctgcccgggagcgacggagcacctggaccccccggaacgtctctgatgctcccgttccgctttgggtccggagggggggacaagggtccagtggtggccgcccaggaggctcaggcacaggctattctgcagcaagcaagactagcgctgaggggccctcccggccctatgggctacactggaagacccggtccccttggtcagcctggtagtccagggctcaaaggagaatcgggggatcttggaccgcagggacccagagggccccagggtctaaccggtccccctggtaaggctggcagaagaggacgcgctggcgctgatggcgcccgggggatgcccggggaccctggcgtgaagggcgatcgggggttcgacggcctgccaggactgcccggcgaaaagggtcataggggggatacaggagctcagggcttacccggtcctccaggggaagatggggaaagaggtgatgatggtgaaatcgggccccgtgggttacccggcgagtcgggtccccggggcctcctgggcccaaagggtccgccggggatccctggaccacccggcgttcgcgggatggacggcccacagggcccaaaaggctccctgggcccccagggcgaaccagggccaccaggccagcagggcacccctggaacccagggactccctgggccacagggcgcaattggtccccacggcgaaaaaggacctcagggaaagcccgggctcccaggtatgccaggtagcgacgggcctcctggccaccccggtaaagaaggacccccaggcacgaagggtaaccaaggaccatccggccctcaagggcccctagggtaccccggccctcgtggagtcaagggagtggatggtattaggggtttaaaggggcacaagggcgaaaaaggcgaagacggtttccctgggtttaaaggggatatcggcgttaagggcgatagaggtgaagttggggtgccggggagccgaggagaggacgggcctgagggacctaaggggcgtacgggtcctactggggatcccggcccccccggtctgatgggcgaaaagggtaagctgggcgtacccggcctccccgggtaccctgggcgacagggaccgaagggttctctagggttcccgggctttcccggcgcctccggagagaagggtgcgcgcggactctcaggcaaatccggacccagaggggaacggggcccaacagggcccagagggcagaggggcccacggggtgcaacaggtaagtctggcgctaagggcacctcaggcggagatggacctcacgggccacccggggagagggggctgcccgggccgcaggggcctaatggcttccccggccccaagggccccctaggccccccaggtaaagatggcctacccggtcatccaggccagcggggggaggtagggtttcaggggaaaactgggccacctgggcccccaggcgtggtggggcctcagggcgccgccggggagaccgggccaatgggggagagagggcaccccggaccccctgggcccccaggcgagcagggtctgcccggtaccgcagggaaagaaggcaccaagggggaccctgggcctcccggcgcccctggtaaagacggtcctgctgggttgcgggggttccccggggagcgaggacttcccgggacggcaggggggcctggtctcaaggggaacgagggccctagcggtccaccaggtcccgccggtagccctggcgaaagaggcgccgcgggctccggcggaccaatagggccgcctggtcgtccgggccctcagggcccccccggggccgctggggaaaagggagtcccaggcgagaagggtcccataggacccaccgggagagatggcgtccagggaccagtcgggcttccaggacccgcgggccctccaggggttgcaggtgaggacggggataagggcgaggtgggagatccaggccagaaagggaccaaggggaacaagggagagcatggacctccgggcccaccgggcccaattggtcccgttggacagccaggcgctgcaggggcggatggcgagcccggtgctagagggccacagggacatttcggcgcaaagggggacgagggcactcgcgggtttaatgggccgcccggccccatcggtctccaaggtctgcccggtccatctggcgaaaaaggagaaacgggggacgtgggaccaatggggccccctggacccccagggcctaggggcccagctggcccgaatggagccgacggcccacagggccccccaggaggcgtgggaaacttaggacctccaggagagaaaggagaacccggggagtccggtagtccaggcatacagggagaacccggggtgaagggaccccgcggcgagcggggggaaaaaggagaaagcgggcagcccggcgagccagggcctcctggtcctaaaggccctactggcgatgatggccccaaaggaaaccctggtccggtcgggtttccaggagacccgggccctcccggcgaaggcgggcctaggggacaggacggggctaagggtgacaggggcgaggatggcgagcccggccaaccgggctcgcccggccccactggagagaacgggccccccgggccgttgggaaaaagaggccccgccggctctcctgggagtgagggccggcaggggggtaaaggagctaagggagaccccggcgctattggcgcacctggcaagacagggccagtgggcccagccggaccagctgggaaaccagggcccgacggcctgaggggcctacccggttctgtgggtcagcagggccggccaggcgcaaccgggcaggcgggccctccgggacccgttggcccccctggcctcccaggtttaaggggggacgcaggggccaagggggagaagggccaccctgggctgattggactgattggtccaccgggtgagcaaggcgaaaagggagatagaggattgcccggcccccaaggatcccctgggcagaagggcgaaatggggatacccggagcatccggcccaatcggaccaggcggtccccctggcttgcccggtcccgctggccccaagggagccaagggggcaaccggccctggaggcccaaaaggcgagaaaggggtgcaaggcccacccgggcatcctggaccaccaggcgaggtgattcagcccctgcctattcagatgccaaaaaaaacccgcagatcagtagatggatctcggctaatgcaagaagacgaagccatcccaacggggggagcccccgggtcacccgggggcctggaggaaatctttggctctctggattctctgcgtgaagaaatcgaacaaatgagaaggcccacaggcacgcaggacagtcctgccaggacatgccaggacctgaagctgtgtcacccagaacttccagacggggagtactgggtggaccccaaccagggctgcgcccgcgatgctttccgcgtcttctgtaatttcacagcaggcggagagacttgcgtgacgcctcgagatgatgtcacacagtttagctacgtggactcagaggggtctcccgtgggggttgttcagttaacattcctgcgtttgctaagcgtgagcgcacatcaggacgtgtcctatccctgttccggggctgcacgtgacggcccgttgagacttcgaggtgcaaacgaagatgagctgagtccagagacttcgccttacgtgaaagagtttagagacggatgtcagacccagcagggacgcaccgtccttgaagttagaacacccgtgttagaacagctcccggttctggacgcttctttttccgacttaggagctccccctaggcgggggggtgtgctgctgggacctgtctgctttatggggtag

SEQ ID NO: 4025 - DNA, 4968 bp, Artificial Sequence
  Description of Artificial Sequence: Synthetic coding sequence
atggagcggtgcagccggtgccaccggctgctgctgctgctgcccctggttctcggattatccgccgctccgggctgggcgggggctccacctgtcgacgtcctgagggccctgcgctttccctctctccccgatggcgtcagacgcgcaaagggtatctgcccggccgacgtcgcctaccgcgttgcacgaccagctcagctctcagccccaacaagacagctgttcccaggaggtttcccaaaagacttctctttgttgaccgtggtccgcacccgtcctggcctgcaggcccccctactgaccctctatagcgctcagggcgtcaggcagctgggactggaactgggacggcctgtaaggtttttatacgaggatcagactggacgcccccaaccaccaagtcagcctgtgttcagggggctttctctcgcagatggtaaatggcatagagtggcggtggccgtgaaaggccagagcgtgactttgatcgtagattgcaaaaagagggtcacaagaccattaccacgatcagctaggccggttctcgatacccatggagtgatcatatttggagctaggatccttgacgaggaagtgttcgagggtgatgtccaagagttagctatcgtgcctggtgtccaagctgcgtacgagtcttgtgagcagaaggagctggagtgtgagggcggtcagcgggagaggccacagaatcagcaaccccatagagcgcagaggtcgccacaacagcagccctccaggctgcacagacctcaaaatcaggaacctcagtctcagccaactgagtctctctactacgattataagccaccatattatgacgtgatgaccaccggcacgacccccgactatcaggctgctcacgggcccaggggacttaaaggcgagaagggcgaaccagcagtcctggaaccaggcatgctggttgaaggcccccctgggcctgaaggacccgctggactgatcggccccccaggtattcaggggaaccctgggcccgtgggcgaccccggcgaacgtgggccccctggaagagccggcttgcctggtagtgatggcgcacccgggccccccggcacttctctgatgctgcccttccggttcggatcaggcggaggcgacaaaggaccagtcgtcgccgcccaagaagcccaggcacaggccattttgcagcaggcccgacttgcgctgcgcgggccccctggcccaatgggttataccggccggccgggaccactcggccaacccggctcccccggcctcaagggcgagagcggcgacctggggccccagggaccacggggcccacagggactgaccggcccccccggaaaggcaggcagaagaggccgcgcgggcgctgacggtgctcgagggatgcctggtgaccccggcgttaaaggagaccgcggctttgacggtctcccaggcctcccgggagagaaggggcaccggggggatacaggtgcccaggggctcccaggccctcctggagaggacggtgagagaggcgatgacggggagattggacctaggggtctgcccggggagagcggaccaagggggctgctcggccctaagggccccccgggtatccccggaccccccggggtaagggggatggacgggccacagggtcctaagggctccctggggccccagggcgaacccgggccgcctggccagcaaggaacccccggaacgcaaggactgcccgggccacaaggggcaatcggaccgcatggcgagaaaggaccccagggcaagcccgggcttcccggtatgcccggttccgacgggccgccaggtcatcctggaaaagaagggccccctggaacgaaggggaatcaagggccctccggcccacagggacctctaggatatcccggtcctaggggggtaaagggagtggatgggatacgggggctgaaaggacacaaaggggagaaaggagaggacgggtttccaggatttaagggagacatcggcgtaaagggggaccgcggcgaagtgggggtcccaggcagcaggggcgaagacgggccggaagggccaaagggacggacaggtccaacaggcgacccaggacccccaggactgatgggcgagaaaggcaagttgggggtgcctgggctgccgggctatcctgggcgtcagggccccaaaggtagtcttggttttcctggctttccgggggcgagcggagaaaagggagccaggggactcagcggcaagagcggaccacggggggaacgaggcccgactgggcctagagggcagcgcgggccccgcggagcgactggaaagtctggcgctaagggtaccagtggaggcgatggcccacacggaccacccggcgaaaggggtctacctggtccccagggccccaacggctttcccggcccaaagggtcctccagggccccccgggaaggacgggctccctggacacccgggacaacggggcgaagtgggatttcagggaaaaactgggcccccggggcctccgggcgttgttggcccacagggggccgcaggcgagactggtcccatgggtgagcgtgggcacccaggccctcctgggccccctggtgagcaaggcctccccgggaccgccggcaaggaagggacaaaaggcgatccgggaccccccggcgcacctggaaaagacggacctgccggactgagaggctttccaggggaaaggggcttacccggcaccgctggtggaccaggtctcaaaggcaatgagggtccttcaggtcccccagggcccgccggtagccccggagagcgcggggcagcagggagcggggggcccattggaccaccaggacgccctggaccacagggaccaccaggagccgctggggaaaaaggagtccctggcgaaaagggaccaatcggacccaccggcagagacggcgttcagggtcctgtcggcttgccaggcccagccggccccccaggagtcgcgggggaggatggcgacaaaggcgaggtgggcgaccctgggcagaaaggcacgaaaggcaacaagggtgagcatgggcctcccgggcccccagggcctatagggcccgtaggccagcccggcgctgcaggcgccgatggcgagcccggcgctcgcgggccccagggtcactttggtgcaaaaggggatgagggtacccgcggctttaatgggcctccggggcctatcggcctgcagggcctgccaggcccatctggcgaaaagggagagacgggcgatgtgggtcccatgggacctcccggccccccaggtcccagaggccctgcgggacccaacggcgccgacgggcctcagggtccccctgggggggttggcaacctcggtcctcctggagagaaaggcgagcctggagaatctggcagccccggtatccaaggcgaaccaggcgtcaaggggccacggggcgagcgcggggaaaaaggtgagagcggacagcctggggagcccggaccacctgggccaaagggtccaaccggagacgatgggcccaaggggaaccccggcccagttggatttcccggggaccctggaccacctggcgaaggaggaccgaggggacaggacggagccaagggggatcggggggaggacggagaacctggacagccaggttcccccggtcccacgggcgagaacggccctcccggtcccctggggaaaagaggacccgccggtagtcctgggagtgaaggcagacaaggagggaagggagcaaagggtgacccaggagctattggcgcccccggaaagaccgggccagtcggtcctgccgggccggctggcaaaccgggtcccgacggcctgaggggcctgcccggttcagtgggccagcagggccgaccgggagcgaccggacaagctggacccccagggcccgttggtcctcctggtctgccgggtctgcggggggatgccggagctaaaggagaaaagggccatcctggcctcatcggattgattggcccacctggcgaacagggcgagaagggtgacaggggcctaccaggccctcagggaagccccggtcaaaaaggcgagatgggtatcccaggggctagtggtcctattggtcccggcggccctccagggctccccggccccgccggccccaagggcgcaaagggcgccacgggaccaggtggacctaagggagagaaaggggtgcagggcccgcccgggcatcctggacctcctggcgaagtaattcagcccctaccaattcagatgccaaagaaaacaaggcgctccgttgacggatctagattgatgcaggaagacgaagcaatacctacgggcggggcgcctggatcccctgggggtctggaggagatcttcggatcgctcgattccctcagagaggagattgaacaaatgcgacgcccgaccggtacgcaggactccccggctcggacctgccaggatctgaaactatgccatccagagctgcctgatggcgagtattgggttgaccccaatcagggctgcgcccgcgacgcgtttcgcgtgttctgcaatttcacggcaggtggagagacatgcgtgactcccagggacgacgtgacccagttctcttacgtcgattccgagggatctccggtgggggtggtgcaactgacatttttaaggttgctctccgtctcagcccaccaggatgtgtcgtacccttgttccggagccgcacgggatggacccttgcggttaagaggcgccaacgaggatgaactgagtcctgaaacctcaccatacgtcaaggaatttcgggacggctgtcagacgcagcagggaaggactgtgttggaggtgcgtacaccagtgctcgagcagttgcctgtgctggacgcttccttctctgacctgggggctccaccacgaagggggggagtactccttggacctgtctgcttcatgggttag

SEQ ID NO: 4026 - DNA, 5031 bp, Artificial Sequence
  Description of Artificial Sequence: Synthetic coding sequence
atggagcggtgcagccggtgccaccggctgctgctgctgctgcccttagtcctaggcctctcggccgccccaggatgggcaggcgctcctccagtagacgtgttgagagctctgcgatttccatctcttccagatggagtcaggcgggccaaggggatttgtccggccgacgtggcctacagggtggcacggcccgctcaattgtcagcacccacccgacaactttttcccggtgggttccccaaggacttctcgttgctcaccgtggtcaggacccgccctgggttacaggctcccctgttaaccctctactctgcacagggggtgcggcagctggggctggaactggggccccctgtaagattcctttacgaggatcagacagggagaccccaacctcctagtcagccagttttccgggggctgagcctggccgatggcaaatggcaccgggtcgcagtggccgtcaaagggcagtcggtgaccctgatcgtggactgtaagaagcgggtcactagacccctccctagatctgctcggcccgtgctcgacacccacggtgtgatcatcttcggggcccgcatactcgacgaggaagtcttcgagggggatgttcaggagctagccattgtaccgggagtacaggcagcatacgaatcctgtgagcaaaaagagctcgaatgcgagggcgggcagcgggaacgaccccagaatcaacagcctcatagggcacagcgttctccccagcagcagccaagccggctgcatagacctcagaaccaggagccgcagagccagcctacggaatccctgtactatgactacaagcccccctactatgacgtcatgaccactggaacgacccccgattatcaggatccaacacccggggaggaggaagaaattcttgaatctagcttactgccaccgctcgaggaagcagcgcacggccccaggggcctaaagggcgagaaaggggagccggcagttctggaacccggaatgctggtggaaggcccgcctggaccggagggcccagctggtctgatcggacccccaggcattcagggaaacccaggccccgtgggagaccctggagagcgtggccccccgggaagagccgggttgccaggtagcgacggcgcacctggcccaccaggcaccagcctcatgctgccattcagattcggctccggaggtggggataagggacctgtggtggccgcacaggaggctcaggctcaagctattctgcagcaggcccgcctggccctgcggggaccgcccggccctatgggctatacagggaggcctgggccacttggtcaaccaggttctcccggcctgaaaggagaaagtggggatctcgggcctcagggaccaagaggcccacaaggactaactgggccccctggcaaggccggaaggcggggtcgcgcaggagccgatggtgctcgggggatgcctggcgatccaggagtcaaaggggaccggggcttcgacgggttgccaggcctacctggcgaaaagggtcacaggggcgacactggcgctcagggcctgcctgggccaccaggcgaggacggcgagcggggcgatgacggcgagattggaccaaggggcctaccgggagaatctggcccgcgcggacttttgggccctaaaggaccgcctggcataccaggacctccgggtgtacgcggaatggacggtccccaaggccctaagggtagccttgggccacagggggaacctggaccgccgggacagcagggcacgcccggcacgcaagggcttcccggacctcagggcgcaatcgggccccacggggaaaaggggccccagggcaaaccagggctcccgggtatgcccggaagcgacggaccccctgggcaccccggtaaggagggtcctccggggaccaaaggtaatcaaggcccatccggtccccaggggccactgggctatcccggccccaggggcgttaagggcgtggatgggattaggggcctaaaaggccataagggagagaagggcgaagatggatttcccggctttaagggcgatatcggcgtaaagggagacaggggggaagtcggagtccccggctccaggggcgaggatggcccagagggcccaaaaggaagaaccgggcccacaggcgaccctggaccccccgggcttatgggcgagaaaggaaagctcggggtgccaggcctacccggatatcctggacgccaaggaccgaaaggcagcctgggttttcctggatttccaggagcatccggcgagaaaggggcccgaggcctgtcaggaaagtcggggccccggggtgaacgcggacctacaggacccagaggtcagagaggtccgcgtggggcaactggcaagtccggtgctaaaggtacgtccggcggagatggaccacatgggcctcctggggagagggggctccctggaccccaggggcccaacgggttccccggacccaaagggccccccggccccccaggcaaagacgggctcccgggacaccctggtcagcgtggtgaagtgggattccaaggtaagaccgggcctccgggccccccaggcgtggtgggcccacagggcgcagctggggaaactgggccgatgggcgagcgcggccatccaggcccacctggccctcccggggagcagggcctgccaggaactgcaggaaaagaagggacgaaaggggaccctggacctcctggagctcctggtaaggatgggcccgcggggttgaggggattccctggcgagcgggggctgccgggtacagctgggggtccaggcttgaaaggaaacgaagggccctccgggccaccagggccggccggatcgcctggagagcggggcgccgctggtagtggcggtcccatcggtccccctggccgaccaggaccacaagggccacccggagccgccggggagaaaggagtgccaggagaaaaaggaccaatcggaccaacagggagggacggagtccaaggcccagtgggtcttcccggccctgcaggacccccaggcgtggctggggaggacggtgacaaaggcgaagtaggagacccaggccaaaagggcactaaaggtaacaaaggtgagcatgggcccccagggccccccggacctatcggcccggtgggacaacccggcgccgccggagccgatggtgaacccggagcccggggcccgcaagggcacttcggcgctaagggagatgaaggcactcggggctttaatggtcccccaggtcccatcggtttacaggggctccccgggcccagtggggaaaagggagagacaggagacgtgggacccatgggcccgcccggtcctcccgggcccagagggccggccggccctaatggggcggatgggccccagggaccgcctggcggtgtgggaaatctggggcctccaggggagaaaggggaaccaggagagtctggctcccccggtatccagggtgagccaggcgttaaaggcccacgtggggaacgcggagaaaaaggtgaaagtggacaacccggtgagccaggcccacccggcccaaagggacccacgggggatgatggaccaaaaggtaaccccggccccgtggggttccccggagacccaggaccaccaggcgagggcggtcccagagggcaggacggggccaagggcgaccggggtgaagacggggagccaggacaacctggaagtccaggtcccacaggggagaacggcccaccgggtcctctgggaaaacgaggccctgctggctcccctggatctgaagggagacaaggcgggaagggcgccaaaggggatccaggcgctattggagcacccggcaagacaggcccggtagggccggcaggaccggctgggaaaccaggtcctgatggccttcgcggcttgccggggagcgtgggccaacaaggtcggcctggcgccacaggacaggccggacccccgggccctgttgggccccccggacttccaggtctgagaggcgacgcgggtgctaagggggaaaaggggcatccgggcctcattggcctcatagggccccctggcgagcagggggagaagggagatcgcggcctgcctgggccccagggaagccctgggcaaaaaggggagatgggcattccgggcgcctccggtccaatcgggccaggcggaccgcccggacttccaggccccgctgggcccaaaggtgcaaagggggccacagggccagggggtcctaaaggcgagaaaggcgtacaaggtcctcccggacaccctggccctcctggcgaggttatccaacctctgcccattcaaatgccaaagaaaactcgacgatccgttgatggatctcgccttatgcaagaggatgaggccatcccaaccggtggggcacctggctctcctgggggattggaggagattttcggctcgctggattccctcagagaagagattgagcaaatgcggcgcccaacaggtactcaggatagtccggcccggacctgccaggacctgaaactgtgtcaccctgaacttcctgatggcgaatattgggtggatcccaatcaaggatgcgccagggacgcatttagagtgttctgcaatttcaccgccgggggggaaacttgtgtaacaccccgagatgatgtgacccaattctcctacgtggacagcgagggctcaccagtgggggtggtccagttgacattcctgaggttgctttccgtgagtgctcaccaagacgtctcatatccctgtagtggtgccgccagagatggaccactccgccttaggggggccaacgaggatgaattatctcccgagacaagcccttatgtgaaagagttccgggacggatgtcaaacccaacaggggcggacagttctcgaggttcggacccccgtcttagaacagttacccgtgctcgatgcctccttcagtgatttgggggctcctccgcggagagggggcgtactgctcggtccagtgtgctttatgggctag

SEQ ID NO: 4027 - DNA, 5031 bp, Artificial Sequence
  Description of Artificial Sequence: Synthetic coding sequence
atggagcggtgcagccggtgccaccggctgctgctgctgctgcccctggtgctaggcctgagtgccgccccagggtgggctggagctccccctgttgatgtgctgagggctttgcgttttccttctttgcccgatggcgtgcgtcgggcgaaagggatctgccccgctgatgtcgcttatcgggtggccaggcctgcccagctgtctgcccccactcggcagctgttcccgggaggatttcccaaagacttttctttacttacagtggtcagaacacgaccaggtcttcaggctccattacttacactctacagtgctcagggggtgagacagctgggactagagctgggccgacccgtgcggtttctgtacgaagatcagaccggccggccgcagcctccctctcaaccggtgtttagaggtcttagcttggcggatggtaaatggcacagggtggccgtggcggtcaagggccagagtgttaccctcatagtggattgcaaaaagagggtgaccagacccctgccacggtcagcccgcccggtgctcgatacccacggagtgattatttttggagcacggatactggacgaagaggtattcgaaggtgacgtgcaggaactggcaatagtgccaggagtgcaggcggcttacgagtcatgtgaacaaaaggaactggagtgtgaaggaggccaacgagaacgcccacagaaccaacaaccacatagagcccagcgatcccctcagcagcagccttctagattgcaccgaccacaaaaccaggagccacagtctcagccaaccgagtccctctactatgactataaacccccctactatgacgttatgacaactggcaccaccccggattatcaggatcccaccccgggagaggaagaagagattctggaaagttccttactgccgccactggaagaggcggcccatggcccacgaggacttaagggagagaagggagagccagcagtgctggagccgggaatgctagtcgagggccctccaggccctgagggcccagcgggactcatagggccgcctgggatccagggaaatcctggccccgtgggagatcctggcgaacggggaccgcctggtcgggccggcctgccggggtccgatggtgctcccgggccacccgggacaagcctcatgctccccttccggttcggatccggcggcggcgataaaggccccgtggttgccgcccaagaggcccaggctcaagccatcttacagcaggcccgcttagctttgagggggcctcccggcccgatgggttacaccggaaggcccggccccctgggccagcccggatcaccaggactgaaaggggagagtggagatctcggccctcaggggccccgcggtccgcagggcttgaccggtcctcctggtaaagccggaagaagaggacgggccggcgccgatggtgcgcgagggatgccgggtgacccgggcgtgaagggagacaggggtttcgacggccttccagggctgcccggtgaaaagggacatagaggcgacaccggtgcacagggtctgccgggtcctccaggcgaagacggggaaagaggggatgacggggagattgggccaaggggcctccccggggaatctggtcccaggggccttctgggtccaaagggtccccctggcattccggggcctcctggtgtccgcgggatggacggtcctcagggacccaaaggaagcttgggaccccagggcgagcctggccctccaggacaacagggtaccccaggcacgcagggcctccccgggccccagggcgcaattggccctcatggggagaaaggcccccagggcaagcctggcctacccggtatgcccggaagtgatgggccacctggtcacccgggcaaagagggacctcccggcacgaaaggaaaccaaggaccaagtgggcctcaagggcccctaggctacccggggccgcgcggagttaaaggggttgacggcattaggggactgaagggtcataaaggagagaaaggagaagatggcttccccgggtttaagggggatatcggtgtgaagggtgatcgaggtgaagtcggcgtgcctgggagccgcggcgaggacggtccagaagggcctaaagggagaaccggccctacaggcgaccctgggcctccgggtttgatgggcgaaaaagggaagctaggtgtgccaggcctgcccgggtaccctggacgccagggccccaagggtagcctgggattccccggctttcccggtgcctccggcgaaaagggcgccagaggcctgtccgggaagtcaggcccccggggcgagcgcgggcctacaggacccagggggcaacgaggccccagaggcgccactgggaaaagcggcgcgaaagggacatcgggtggcgacggaccccatggcccccctggcgagcgcggactgcctggcccccagggcccaaacggctttcccggccctaagggtccccccggaccacctggcaaagatggcctgccggggcatcctggacagcgcggcgaagtcggctttcagggcaaaactggcccccccggtcctcccggtgtagtagggccccagggggcagccggtgagacaggtccaatgggggagcgaggccatccagggccaccaggtcctccgggcgaacaggggttgccagggaccgcggggaaagaaggtactaagggcgaccccggtcctcccggtgcacctggtaaggatggtccagcagggctccggggtttccccggagagcggggcctccccggaacagccgggggacctggtctgaagggtaatgaggggccttccggcccacccggaccagccgggagcccgggcgaaaggggtgccgctgggtcaggaggacccatcggaccacccggacggccaggcccgcagggccccccaggtgctgctggcgagaaaggggtgcccggcgagaaggggcccattgggcctaccggcagggacggcgttcaggggcctgtaggcctacccggcccagctgggccacctggagtggccggtgaggacggggataagggcgaggttggcgaccctggccaaaagggaacgaagggtaacaagggcgaacacgggcctcccgggccaccaggcccgattggtccagtcggccaaccaggggccgccggggccgatggcgagcctggcgccaggggccctcagggccatttcggcgcgaaaggcgatgagggcacccgcgggtttaacgggcctccaggccccataggcctccagggcttgcccgggccctccggcgaaaaaggggagacgggggatgtcggccccatgggccccccaggtcctccgggaccaaggggcccagccggcccaaacggtgctgatgggccccagggaccacccggaggagtcggaaatctcggaccgcctggcgaaaaaggagagccaggggagtccgggagtcctggcattcagggcgagcccggggtgaaaggtccaaggggtgagagaggagagaaaggggagtcagggcagccaggtgagcccggaccgccaggacccaaaggccctaccggagacgacgggcccaagggaaatccaggaccggtgggctttcctggggatccgggcccacccggagaaggtggaccgaggggccaggacggggctaagggtgatagaggcgaagatggagagccaggccagccagggtctccaggtcctacgggcgaaaatgggccgccggggcccctgggcaagcggggcccagctgggtctcctggtagcgagggcaggcaggggggcaaaggcgctaaaggggaccccggagcaatcggagcaccagggaagaccggccccgttggacccgcgggcccagcgggaaagcctgggcccgacggattgagagggcttccagggagtgtcgggcaacagggaaggcccggggccactggacaggcaggaccgccaggcccagtagggccgcctggattgccaggactgcgaggcgatgcaggggcaaaaggagaaaaggggcacccagggctcattgggctgattggacccccaggtgagcaaggagagaagggtgatcgcggacttcccggcccccaggggtcccctgggcagaagggggaaatgggcatccccggggcctccggccctatcgggcccggtggtccccccgggcttcctgggcctgctggccctaagggggccaagggcgctacaggacctggaggacctaagggcgagaagggtgtccaggggcctcctggacatccaggccctccaggagaggtgattcaacctctgcccatccaaatgcccaagaagacgcgaagatctgtcgacggatcacgacttatgcaggaagacgaagcgattccaactggtggagcccctggttcacctggaggcctcgaagagatctttggatccctggactccctgcgggaggagatcgagcagatgaggcgcccgaccggcacacaggacagtccagcccgcacttgtcaggatctgaagttgtgtcaccccgagcttcctgacggggaatattgggtggacccgaaccagggttgtgccagagacgccttcagagtgttttgcaactttactgccggaggcgaaacgtgcgttactccccgagacgacgtgactcaattctcctacgttgactccgaaggcagtcccgtgggcgtagtccagctcactttcctgcgactgttatcagttagcgcacaccaagacgtaagctacccttgctccggcgccgcaagagatggcccacttcgcctgaggggcgcaaacgaagacgagttgtcacccgaaaccagtccgtatgtgaaagaatttcgtgacggctgccaaactcagcagggacgtacagtccttgaggtgaggacccccgtgttggaacagctccctgtgctggatgcaagtttcagtgacctgggagcaccaccccggcggggaggggtgttgctcggacccgtatgcttcatgggatag

SEQ ID NO: 4028 - DNA, 5031 bp, Artificial Sequence
  Description of Artificial Sequence: Synthetic coding sequence
atggagcggtgcagccggtgccaccggctgctgctgctgctgcccttggtgttggggctctcagcagcacctggatgggctggcgccccccccgtggacgtccttcgtgccctgcggttcccctcgctgcccgatggagtgaggagagccaaggggatctgccccgccgatgtagcgtatcgtgtcgcacggcccgcacaactgagcgctccaacacggcagctctttcctggcggattccccaaggatttttccttactcacggtggtaagaactagacccgggttgcaggcacccttactcaccctgtactccgcccagggtgttagacagctcgggttggagctgggtcgcccagtgcgctttctttatgaggaccagacggggcgcccccagccaccctcccagcctgtctttcgggggctctctctggccgatgggaagtggcatagagtggcagtcgccgtaaagggacagagcgtcaccctgatagtggattgtaagaagcgggtgactcggcccctcccacgctctgcccgcccagtattagatacccacggcgttatcatcttcggagcacggatcctggatgaagaggtcttcgagggggacgtccaagagcttgccatcgttcccggcgtgcaggctgcgtatgagtcttgtgagcagaaagagctggaatgcgaaggagggcagagagagaggccccagaaccagcagcctcacagggcccagcgatcaccccagcaacagccatccagacttcaccgaccacagaatcaggagcctcagtcccagcccaccgaaagcctctattatgactatgaaccaccctactacgatgttatgaccaccgggaccacaccggactatcaggatcctactccgggcgaagaggaagagattctggagagcagcctactcccaccactagaagaggcagctcatggtcctaggggtctgaagggtgagaaaggagagcccgctgtgcttgaaccagggatgttggtggaagggccacctgggcccgaaggccctgccgggctaatagggccgcctggaatccaagggaacccaggcccagtcggggatcctggggagagggggccccccggacgggcgggactgccgggctctgacggcgcacctgggccacccggaacttcccttatgttgccttttcgcttcggttctggaggcggagacaaaggacctgtcgtagcagctcaggaagcccaagcccaggctattctgcaacaggcgaggttggccctcagaggtcctcctggacccatgggctacaccggtcgtcccggacctcttggccagccaggaagtcccgggctaaaaggagaatccggtgaccttgggccccaggggcctcggggccctcaaggcttaactgggccacctggtaaagctggccgtaggggtagagctggtgccgacggagcaaggggaatgcctggcgaccccggagtaaaaggtgacagggggtttgacggactgcctggcctgccaggcgagaaaggccataggggcgatacaggagcccagggacttcccggacctccgggcgaagatggagagaggggggatgacggtgagatcggcccgcgtggcctccctggtgagtctggtccaagaggactcctgggacctaaggggcctccaggcattccaggacctccaggcgttagaggcatggacggcccccaggggccgaagggaagtctcggtccacagggcgagcctgggcctccaggtcaacaggggacccctggcacccaaggcctccccggcccacagggtgcaataggaccacatggagaaaaaggcccacagggaaaacccggcctccctggaatgcctggaagcgacggcccccccgggcacccagggaaggaagggccacccggcaccaagggaaaccaaggccctagtggccctcaggggcccttaggctatccgggccctcgcggagtcaaaggagtcgatggcatcagaggactgaaaggtcataaaggagagaagggcgaagacggctttcccgggtttaaaggcgacataggagtgaagggtgatcgaggtgaagttggtgtgccaggcagccgcggcgaggacggtcctgaagggcccaaggggagaacaggacctactggggatcccggcccgcccggcttgatgggggaaaaaggaaagttgggggtcccggggttgcctggataccccggacgccaaggtcccaaaggttctctgggttttcccgggtttcctggcgcttcgggagaaaaaggagctcgtggtctgtctgggaagtcgggacccagaggcgaacgcggtccgaccggcccacgaggacagcgtggccccagaggcgccaccggcaaaagtggagcaaagggaacctcagggggcgacgggcctcacggcccacccggggagagagggctgcctggaccccagggcccgaacgggtttcccgggcccaaaggaccgcccggtccgcccggcaaagatggcctgcctggccatccaggtcaacgtggcgaggttggttttcagggaaagaccggtcccccagggccaccgggcgtagtggggccccagggcgctgccggagagactgggcctatgggggagcgtggtcacccaggacctcctggacctcccggagaacaggggcttcccggaacagccggtaaggagggaacgaaaggggatccaggcccacccggcgctccggggaaggacggtccagcgggcctccgtgggttcccaggcgagcggggcctgcctggaaccgccggggggccgggcctcaagggcaatgaaggcccatcgggccctcctggccccgcaggctctccaggagagcgcggagccgcaggtagcggtggccctatcggcccccccgggcgccccggccctcagggacccccgggagctgccggcgagaagggagtgccaggtgaaaaaggtcccatcggccctaccggacgcgacggtgtgcaaggaccggtgggtctgccggggcccgccgggcctcccggcgtggcaggggaagacggggataaaggcgaagttggggaccctggacagaaagggacaaagggcaacaaaggagagcacgggcccccgggccctcccggcccaatcggaccagtgggacaacctggcgcagccggcgcagatggagaaccgggcgcgagaggaccccaggggcacttcggggccaagggggatgagggcacccgaggctttaacggcccacctggccccattggactgcagggcctgccaggcccttcgggcgagaagggggagaccggggatgtcggcccaatgggcccgcccggcccccccggccccaggggcccagctggccccaatggggccgacggccctcaaggccctccaggcggggttgggaacctgggtccacccggagaaaagggggagcccggcgagagcggatcaccaggaatccagggtgagcccggcgttaaggggccacggggagagcggggtgagaagggcgaatccggtcagcccggagagccaggcccacctggcccaaaaggacctaccggtgatgatggtccaaaaggcaaccccggccccgtggggttccccggggacccgggaccccccggtgaaggagggccaagaggacaagacggggccaagggagatagaggcgaagatggagagccaggccaacccgggtcccctggaccaaccggggagaacggcccccccggacctctgggaaaacggggacccgctggatccccaggctccgaaggccgccagggtgggaagggcgcaaaaggggatcctggagcaattggggcccctggtaaaacgggccctgttggtcccgcgggaccagccggcaaacctggacctgacggactccgaggattacctggatctgtcgggcagcagggtaggcccggggcaacaggccaggccgggccacccggacctgtaggtccaccagggcttcccgggttacgcggcgacgccggagctaagggtgaaaaaggacacccaggcctgattgggctaattggtcccccgggcgaacaaggagaaaaaggcgatcgcggacttccaggaccacaggggtctccagggcagaaaggggagatggggatacctggcgcatcagggcccattggaccaggcggtcctccgggtttgccaggtcctgccggcccaaaaggagccaaaggcgcaacaggtcctggcggcccaaaaggcgaaaagggcgtgcagggccctccaggtcacccaggtccaccaggggaagttatacagcccctgccaattcagatgccaaaaaaaacccggagatctgtagatggttcacggcttatgcaagaggacgaggcaatcccaactggtggggctcccggctcccctggcggactcgaggagatctttggtagtcttgacagtctccgtgaagaaatagagcaaatgcgccgccctacgggaacccaggacagcccagcgaggacgtgtcaggacttaaagctctgtcaccctgaactgcccgacggcgaatattgggtggaccctaaccagggttgcgccagggatgcctttagagtcttctgtaatttcactgcgggcggagagacctgcgtgactcccagggacgatgttactcaattcagctatgtggattcagaaggctccccggtgggggttgttcagctgacctttctcagactgctgtctgtaagcgctcatcaggacgtgtcctacccatgcagcggggctgcccgggatggcccactgcggctccgcggcgccaacgaagacgaactcagtccagagacaagcccatatgtgaaggaattcagagacggctgccagacacagcagggtagaactgtgctggaggtgagaactcccgtgctcgagcagctgccggtgcttgatgcttctttctcggatctcggggccccgcccaggagagggggagtgctgttgggccccgtttgcttcatgggctag

SEQ ID NO: 4029 - DNA, 5148 bp, Artificial Sequence
  Description of Artificial Sequence: Synthetic coding sequence
atggagcggtgcagccggtgccaccggctgctgctgctgctgcccctcgttctggggttatcggctgcgccaggatgggctggagcacctccagtggacgtgctccgagcactgcgcttcccatctctccccgacggcgtcagacgagccaagggcatttgtcccgcagatgtggcgtatagagtcgcgcgaccagcacaattatccgcccccacacgccagctctttccggggggcttccccaaagatttctctctcctgaccgtggtgcgtacccgtcctggcttgcaggcaccgcttttgacgctgtattccgcacaaggggtgaggcagctgggactggagctaggaagacccgtaaggttcctatacgaggaccagaccggtcggcctcaaccacccagccaaccggtgttccgaggcctgtcgcttgcggatggtaaatggcatcgggtggccgtcgccgtgaagggacagtcagtcaccttaatcgtggattgtaagaaacgcgtgacaagaccactgcctagatccgctagaccagtgctggacacacacggggtcatcatttttggcgcccgcatcctagatgaagaagtctttgagggagacgtccaggagctggctatcgtccccggggttcaggcagcgtatgaatcatgcgaacagaaagaactcgagtgcgaggggggccagcgcgagaggccacaaaatcagcagccacatagggcacagcgcagtccccagcagcagccttcccggctacaccggccccagaaccaggagcctcagagccaacccactgagagcctgtactacgactatgaacccccctattacgatgttatgaccacaggaaccactcctgattaccaggagcaaaccgatctgcaggtgccgccaacagcagatcgttttcaggctgaggaatatggggagggcggaacagaccctcccgagggcccctacgattatacctatgggtatggggacgattatagagaggagactgagttgggccctgccctctctgccgagacagcccactctggagctgccgcccatggaccgagggggttgaagggcgaaaagggcgagccagccgtattggaaccaggcatgctcgtagaggggcctccgggcccggaagggcccgccggcctcatcggacctccaggtatccaaggcaacccgggccccgtgggcgacccaggggagagagggcccccgggcagggccggcctccctgggagtgacggcgcccccggaccacccgggacttcattgatgctgccattcaggtttggcagcggcggtggtgataagggccccgttgttgctgctcaggaagcacaggcacaggccatcttacagcaggccaggctagcattgagaggaccgcccggccctatgggctacacaggccgtcctggtcccctgggacaaccagggagcccgggtcttaagggggaatctggggatctgggcccccagggaccgcgagggccacagggcctgaccggcccacccggaaaagccgggcggcggggccgggcaggggccgacggcgcccggggtatgcccggggaccctggggtgaaaggggatcggggtttcgacggactccctggcctaccgggcgagaaaggccaccggggagatacaggggctcaaggactgcctgggccacctggggaagacggagaaaggggagacgatggagagattgggccacgcggtctcccgggtgaaagcgggccaaggggactgctgggaccaaaggggccaccaggcatccctggtccgcctggggtgcggggtatggatgggccccagggccccaaggggtccttgggacctcagggagaaccgggtccacctgggcagcagggaacaccgggcacccagggtctccccgggcctcagggagccatcggaccccatggcgagaaggggccgcagggtaagccaggattgcccggtatgcctggctctgacggtccgccaggtcaccctggtaaagaagggccccccggtactaagggaaatcaaggaccttcaggaccacaagggccattgggctatcccggcccaagaggtgtgaaaggcgttgacggtatccgtggcctgaagggccacaaaggcgagaaaggcgaagacgggtttcctggttttaagggtgacatcggcgtcaagggcgacagaggagaagtcggggtgcctggctcaagaggcgaggacggtcctgagggtcctaaaggccggactggccccactggggacccaggaccaccaggacttatgggggagaagggcaaactgggcgtcccaggactccccgggtatccaggtaggcagggccctaagggcagtttaggcttccccggttttcctggggcgtctggagagaagggagctaggggcctgagcggtaaaagcggacccagaggagagcgtgggccgactggcccaagaggccagcgaggcccacgcggtgctaccggtaaaagcggagccaagggaacaagtggcggtgatgggccccatggaccccccggcgaacgaggcctgcctggtccccagggacccaacgggtttccaggtccaaaagggcctttggggccccccggaaaggacggactgccaggacacccaggccagaggggtgaggtgggcttccaaggaaagacaggacctccagggccgcctggggtagtggggccccagggggccgcaggcgaaaccggccctatgggtgagcgcggacatccaggaccgccagggccacccggcgaacagggcctccccggtacagctggaaaggagggaactaaaggcgacccaggcccccccggagcacccggtaaggacggccctgccggactccgaggcttcccgggagaaagagggctgccagggactgctggcggacccggccttaaaggtaatgagggaccctcaggaccaccaggccccgccggatctcccggggaacgtggtgctgcaggctcaggtggccctatcggacccccgggcagacccgggccacagggacctccgggtgccgcaggagaaaaaggcgtgccaggcgaaaagggccctatagggcctactgggagagatggcgtccaggggcccgtgggcctcccaggtcccgcgggtccacctggcgttgccggagaggacggcgacaagggtgaggtaggcgatccaggccagaaagggactaaaggtaataaaggagagcatggcccgccaggcccacccggcccaataggaccagtgggtcagcccggcgccgccggggccgatggtgaacctggagcacgcgggcctcaaggtcattttggcgccaagggggacgagggcacaaggggattcaatggaccgccaggtcctattggactgcaggggcttcctggacccagtggcgagaaaggggaaacgggcgacgtggggcctatgggaccgcccgggcctccaggcccacggggccccgccggccccaatggggcagacggacctcaggggccgcccggaggcgtcgggaatctgggaccgcctggtgagaaaggtgaaccgggggaaagcgggagtcctggcatacagggagagcccggagtcaagggcccacgtggagagaggggggagaaaggggagagcggacagcctggcgagcccgggccccccggaccaaaaggtcccaccggcgatgatgggcccaaaggcaatcccgggcccgtcggatttcccggagaccctggaccgcctggggagggtggtcccagagggcaggacggcgcaaagggagatagaggcgaggacggggagcctggccagcccggttccccgggtcccacaggagagaatggccctccaggaccactcgggaaacgagggcccgcagggtcaccaggttctgagggtcgccagggaggaaagggtgccaaaggagaccctggagcaattggcgctcctggtaagacgggcccagtcggcccggctggtcccgctggcaagcctggtcccgatggattgcgcggcctaccagggagtgtaggtcagcagggcaggccaggtgcaacagggcaggcaggtcccccaggtcctgtagggcctcctggtcttccaggcctgcgcggtgacgccggcgctaaaggcgagaagggccaccctggcctcatcggacttatcggccctccaggggaacagggagagaagggcgaccgtgggttaccgggtcctcaaggctcccctggtcagaaaggggaaatgggaattcccggagcttctgggcccatcggtccgggcggccctcccggactgcctgggccagccggaccaaaaggggctaagggcgctaccggtcctggcggccccaaaggcgaaaagggggtacaaggccctcctggccacccggggccccccggggaggttattcaacctctgccaattcaaatgccgaagaagacacgacgtagcgtcgatggatccagactcatgcaagaggacgaggctatcccaactggcggcgctccaggatctcccgggggattagaggaaatcttcggctcattagactctctccgtgaggaaatcgagcagatgcggcgaccaacaggcacacaggattctccggctcggacttgccaggacctgaaactgtgtcaccctgaactaccagatggcgaatactgggtggatcctaaccagggatgcgcccgggatgcttttagagtcttttgcaattttacggctgggggggagacctgcgtaacccctagagatgatgtcactcagttctcctatgtagattctgagggcagtcccgtgggtgtggtgcagcttaccttcctgcggctgttgtctgtgagtgcccaccaggatgtcagctacccctgctccggggccgctcgcgatggcccattaagactgaggggcgccaatgaggacgagttgtctcccgagacaagcccttatgtcaaagagtttagggacggctgtcagacccagcaggggaggaccgtcctggaggtgaggacgccagttcttgagcagctccctgtgctcgacgcttccttctccgacctgggagcaccacccagacgtggcggggtcttattgggcccggtctgctttatgggatag

SEQ ID NO: 4030 - DNA, 4809 bp, Artificial Sequence
  Description of Artificial Sequence: Synthetic coding sequence
ggcgccccccccgtggacgtgctgcgggccctgcggttccccagcttgccagatggggtgagacgggcgaaaggcatctgcccagctgacgtggcttatagagtggcccgcccagcacagctgagcgcccctacccgccagctttttcccggtggatttccgaaggatttctctttattgaccgttgtgcgaacccggcctggcctccaagctcccctgctcacactgtactccgcacaaggcgttcggcagctaggccttgaacttggccgccctgttaggtttctctacgaagaccagacaggcagacctcagccacccagccagcccgtcttccgcggattatctttagcagacggaaaatggcacagagtcgcggtcgccgtaaaaggtcagagcgtgacgctgatcgttgactgcaaaaaacgggtgaccagaccactaccccggtctgcacgtccagtccttgacactcatggggttatcatattcggcgctagaatcctcgacgaggaggtgtttgaaggcgatgtgcaagaattggcaatagtgcccggcgtgcaagcagcctatgaatcgtgtgaacaaaaagagctagagtgcgaaggtgggcagcgggagcggccccaaaatcaacagccacaccgtgctcaacgttcaccgcagcagcaaccctcacgccttcacaggcctcagaaccaggagccccaaagccaggcagcccacggccctaggggtctgaaaggagaaaagggcgaacccgcggtgttagaacccggcatgctcgtggagggacctcctggacctgagggcccggctggtctgatcgggcctcctggaattcagggcaaccctggacctgtaggcgacccgggtgaaagaggcccccccgggagagccggccttcccggctctgacggagcccccgggccaccaggcacctctttgatgctgcccttccgctttggatcaggtggcggcgataaaggccccgtggttgcagcacaggaggctcaggcccaggcaattttgcagcaggccaggttggccctaagaggacctcctgggccgatgggatatacagggcgacccggacccctaggacagcccgggagcccaggactcaagggagagagcggtgacctgggaccccaaggtcccagaggtccccagggccttactgggcctcctggcaaggctggacgccgaggccgcgcaggcgctgatggggcgagaggaatgcccggcgaccccggagtgaagggcgacaggggattcgacggactgccgggcctgcccggagaaaaggggcatcgtggagacacgggagcccaggggctccccggtccccctggggaggatggggaaagaggggatgatggagagatcggccctcgtgggctgcccggcgaatctggtccaagggggctgctgggccccaaggggccccctggtataccgggcccaccaggggtcagagggatggatggcccacagggtcccaaaggtagtctgggacctcagggcgaacccgggccacccggtcagcaaggaacaccaggtacccaaggtttgcccggtccgcagggcgcaataggccctcacggagagaagggcccgcaggggaagcccggactgcctggtatgcccggcagcgatggcccccccggccaccctggtaaggaggggccccctggtaccaaaggcaatcaaggcccgtccggtccacagggccctttaggctaccccgggccccggggggtcaagggggtggacgggataagaggactgaaagggcataagggggaaaaaggcgaagacggcttccctggatttaagggggacatcggcgtgaaaggagacagaggggaagttggagtgcccgggagtcgaggcgaagacggaccagaaggcccaaaggggcgcacaggcccgacaggagaccctggtccccccggcctcatgggcgagaaaggcaaactgggagttccgggattaccagggtatcctggacgccagggcccgaaaggttccctgggcttcccaggattccctggagccagcggagagaagggcgcccgggggctgagcgggaagtcaggccctaggggcgaaagaggacctactggacctcgcggacagcgaggtcccagaggtgctactgggaaaagcggtgcaaaaggaacctctgggggggatggacctcacgggcctccaggtgaaaggggtctgcccggtccccagggcccaaacgggtttccaggccctaagggacctccgggaccacccggcaaggatggactccctggccacccggggcagcgcggagaggtaggattccaaggtaaaactggaccgccaggtcctccaggcgtagtcggcccacaaggcgcagccggtgaaactggccccatgggggaacgcgggcacccgggccctcccggccctcccggcgaacaggggctgccagggactgccggaaaagaggggactaagggtgacccaggccctccaggtgctccaggtaaagatggccctgccggattaagaggctttcctggtgagcggggcttgccgggaactgccggaggccctggcctcaaaggcaatgagggacccagcggacctcccggcccagctggaagccccggtgagcgcggagcagccggcagcggggggcccattggcccaccaggccggccaggaccccagggcccacctggggccgccggcgagaagggggtccccggagagaagggccctatcggtccaacaggtcgggatggtgtacagggccctgttggacttccaggccctgcaggccctccaggcgtcgccggggaggatggagataaaggcgaagtcggggatcctggtcagaaaggtaccaaaggcaacaaaggagagcacgggccaccagggcctccaggaccaattgggcctgtaggccaacccggagccgcaggtgctgatggagagcccggagctcgcgggccacaaggccactttggcgctaagggcgatgaaggtactcggggtttcaacggacctcctggacccatagggttacaaggccttcctggaccatctggtgaaaaaggtgaaacaggagacgtgggtcctatgggacccccaggccctcccggtccaaggggcccagccgggcccaacggtgccgatgggccacagggaccacccggaggcgtcggaaacctcggaccacccggagaaaaaggcgagcctggcgagtccggttcccctggcatccagggggagccaggcgtgaagggtcctcggggagagagaggagagaagggggagtccggccagccgggggaaccaggacctcccggccctaaaggaccaacaggcgatgacggccctaaagggaatcctggacccgtcggattccctggcgaccctggccctccaggggaaggcggaccacgcgggcaggatggcgcaaaaggcgatcggggcgaagatggcgaaccaggtcaacctggctctccgggaccaaccggagaaaatgggccacctgggcccctgggtaaacgcggaccagccgggagcccgggatccgagggcagacaaggaggcaaaggcgccaaaggagacccaggggcaatcggagctccgggcaagactggccctgttggacccgcggggccggcagggaagcccggccccgatggactgaggggtcttcccggatctgtcggccagcaggggagaccaggagccacaggtcaggcaggccctccaggacctgtgggcccacccgggctcccggggcttcggggcgacgctggagccaaaggtgaaaaaggtcatcccggactcatcggccttatcggaccgccgggcgaacaaggagagaagggggacaggggcctcccaggcccccaaggcagcccaggccaaaagggcgagatgggcattcccggagcatccggaccaattggtcctggcgggcctcccggattacccggacccgccgggccaaaaggggctaaaggcgctaccggaccaggagggcctaaaggagagaaaggggtgcaggggccaccaggccacccgggcccaccgggagaagttatccagccgctgccgatccaaatgcctaaaaaaacacggagaagtgtggatgggtcgaggctcatgcaggaggatgaagccattcccaccgggggggcccctggctctcccggaggcctggaggaaatctttgggagtctggatagcctcagggaagaaatcgaacagatgcggagaccaactggcacccaggattctcctgctcgaacctgtcaagacctcaagctatgtcaccccgagcttccagacggcgagtactgggtggatccgaaccaagggtgcgcaagagatgctttccgcgtcttctgtaactttacagctgggggagaaacctgtgtcaccccacgagacgatgtgacacaattttcttacgtcgacagcgaaggaagtccagtcggcgtggttcagctcaccttcctgaggctgctgtctgtaagtgctcatcaggacgtatcttatccatgctctggggccgcccgcgatgggccactacgcctgcgaggagctaacgaggatgaattgagcccagaaactagcccttatgtgaaagaatttagagatggatgccagacccagcagggacgaacggtcctggaagtccggacccccgtcctggagcagctgccggtgctggacgcctctttctccgatctcggagcccctccgagacgcggaggagtgctgctcggtcctgtgtgcttcatgggatag

SEQ ID NO: 4031 - DNA, 5052 bp, Artificial Sequence
  Description of Artificial Sequence: Synthetic coding sequence
ggcgccccccccgtggacgtgctgcgggccctgcggttccccagcttgcccgatggtgtgagaagggccaagggcatctgtccagctgatgtcgcttatagggtagccagacccgctcagttatccgcgcctacccggcagctgtttcccggcggcttccctaaagatttctctttgctgactgtggtaaggacccggccaggcctgcaggccccattgctgaccctgtactcagcgcagggagttaggcagctcggattggagttgggccgccccgtgcggtttctgtatgaggatcaaactgggcgaccacagcccccttcacaacctgtgttccgagggctgtccctggctgacggaaagtggcatagggtggcagtggctgtcaagggtcaaagtgtgactcttatcgtcgactgcaagaagagagtgaccagaccacttccccggagcgccagaccagtcttagatacccatggcgtcattatcttcggggcccgcatccttgacgaggaagtattcgagggggacgtccaagagttggccatcgtcccgggggtacaagccgcgtacgaatcctgtgagcagaaggaattagagtgcgaaggcggacagcgagagcgaccacagaaccagcagccacatcgagcccagcgctcccctcagcaacaacctagtcggctccaccgcccccagaaccaggagcctcagtcccaggatccaacaccgggggaggaagaagaaattctggaatcttcactgctccccccgcttgaagaggagcaaaccgatcttcaagttccaccaaccgcagacaggtttcaggctgaagaatacggagaaggcgggacagaccccccagaggggccctacgattatacttacggatatggggatgactacagggaggaaacagagcttggacctgccttaagcgcggaaactgctcacagtggcgcagcagcccacggaccacgcggtctgaagggagagaaaggagaaccagcggtgttagaacctggaatgctagtggaaggaccacccggccctgaaggacccgccggcctgatagggccaccaggaatacaaggcaatcctgggcccgtgggcgaccctggggagcggggtcccccagggcgagccggtcttccgggaagcgatggtgcccctggaccccccggcacctctctcatgctccccttccggttcggatccggcggcggggacaaaggcccggttgttgccgctcaagaggcgcaagcccaggccatcttgcagcaggctcggctggcactgcgagggcctcctgggccaatgggctacacaggacgaccaggcccgctgggtcagcctgggtctccgggtctaaaaggagagtctggagacttggggcctcagggcccaagaggcccacagggattgacaggacccccaggaaaagcgggtaggcgcggtagagcaggagccgatggtgcaaggggcatgcctggcgatcctggagttaaaggagatcggggcttcgatggcttaccaggtttgcctggtgagaaaggacaccggggcgataccggagcccaaggtttacccggaccaccaggtgaagacggtgagcgtggcgacgatggggaaattgggccgagaggccttccaggcgagagcggcccgcgcggtctgctgggcccaaagggaccacctgggatccctggcccaccaggggtgaggggaatggacgggccacaaggcccaaagggctccctggggcctcagggtgaacccgggcctccaggtcagcagggtactcccggaacacaagggttgcccggtccacagggcgctatagggccccatggcgaaaaaggaccacaaggcaagccaggtctgcctggtatgccgggaagcgacggtccaccaggacacccaggaaaggaggggcctcccggcacaaaaggtaaccaagggccctccggcccgcagggtcctttaggttatccgggccctagaggggtgaaaggagtggacggaattcgggggctgaagggccacaagggcgaaaaaggggaggatgggttcccaggattcaaaggcgatattggggtgaagggagaccgaggggaggtcggagttcccgggtctcggggagaggacggaccggaggggcctaagggccgcactggtccaacaggcgacccaggccccccgggattgatgggcgaaaaaggaaaacttggtgtccccgggttgccaggatatcccggtcgacagggccccaaaggctcgctggggttccctggctttcctggcgcctcaggagaaaagggcgcgaggggcctcagtggtaagtccgggccccggggcgagcgggggcccaccggaccccgcggccaaagaggcccgaggggagcaactggaaaatctggtgcgaaagggacttccggcggcgatggaccccatggaccacccggggagagaggtttgcccggtccgcagggaccgaacgggttccccggccctaaaggaccaccaggccctcctggcaaagacgggttgcccggacatccgggccaacggggggaagttgggttccagggaaagaccggcccacctggcccacctggcgtggtgggcccccagggagccgccggcgagaccggcccaatgggtgaacgaggtcaccccggtcccccaggtcctcccggtgaacagggactcccaggcaccgcgggcaaggaaggtacaaagggggacccaggccccccaggtgctcccggcaaggacggtcctgccgggctgagaggttttcccggagaaaggggactacccggaaccgcaggcggcccaggcctgaaaggcaacgagggcccttcaggcccccccggccccgccggaagtccaggggaacggggagcggccggttcgggaggcccaataggaccccctggcagacccgggcctcaggggccacctggagcggcaggcgagaagggcgtacctggagagaaaggtcctataggcccaacagggagggacggtgtgcaggggcccgtgggcctcccaggacccgctggccctccgggagtagctggggaggatggagacaaaggggaagttggagatccaggtcaaaaaggaaccaagggaaacaagggggaacacggaccgcctggtccccccgggccaattgggcctgtcgggcagcccggagctgccggggccgacggtgaacctggtgcccggggaccccaaggacacttcggcgccaagggcgacgaggggacacgcggatttaacgggccaccgggccccatcgggctgcagggcctgcctggcccaagtggcgagaagggcgagaccggggacgtgggaccaatgggacctcccggaccaccaggccctcggggacccgcggggcccaacggcgccgatggtccccaggggcctcctgggggggtcggtaacttgggccctccaggcgagaagggcgagcctggagaatccggatcccccggaattcagggtgagcccggcgttaaaggacctcgaggtgagagaggcgaaaaaggcgaaagcggacaaccgggcgagcccggaccacctggccccaagggcccgaccggcgacgacggaccaaagggaaatcctggccctgtgggattccccggtgatccaggcccgcccggagaaggaggtccaaggggtcaggacggagcaaaaggtgatcgcggggaggatggggagcctggccagcctggaagtccaggtcccaccggagaaaatggcccaccaggacctctcggcaagcgagggccagccggttctcccggaagtgagggcagacaagggggcaagggagccaagggagatccaggtgccatcggcgctcccggaaagaccggccccgttgggcccgccggtccagcagggaagcctgggccagatggactgcgcggtctgcccgggtccgtcggacagcagggccgaccaggtgccaccgggcaagccgggcccccagggcctgtcgggcccccggggcttccaggcctccgcggcgatgccggcgccaaaggggagaaagggcatccaggattaattggccttattggcccccccggggagcaaggggagaagggagataggggccttcccggacctcaaggttcccccgggcaaaagggggagatgggcatccccggtgcctctggccctattggcccaggtggacctccaggcttgccgggacccgcggggcccaagggtgccaagggggccacaggtcccggcgggccaaagggagagaaaggagtccagggccctccgggccaccctgggcctcccggtgaggttattcagcctctgcctatacaaatgccaaaaaagactcggaggtccgtggatggtagccgtttaatgcaggaggacgaagctatacccacagggggggcacccggctctccaggaggtctagaagagattttcggctctttggactccctccgtgaagaaatagagcagatgcggcgtcccactggcacccaagactctcctgcacgcacctgtcaggatttaaaactatgtcaccccgagcttccagatggcgagtattgggtggaccctaatcaggggtgtgctcgggatgcgtttagagttttttgtaatttcacggccggcggggagacttgcgtcacacctagagacgatgtaactcagttttcatacgttgatagcgaaggctccccagtcggtgtcgtgcagcttacgtttctcagactcctgtccgtgtccgcccatcaagacgtctcttacccatgttccggggcagcccgtgatggtcctctgcgactgagaggcgccaacgaggacgaactgtctcccgagaccagcccctacgtgaaggagttccgcgacggctgccagactcagcagggtagaaccgtgctagaagtgcggaccccagttttagagcagttgccagttctcgacgccagtttttccgatctgggcgctcctccacggcggggaggcgttctgctaggcccggtgtgcttcatggggtag

SEQ ID NO: 4032 - DNA, 5133 bp, Artificial Sequence
  Description of Artificial Sequence: Synthetic coding sequence
atggagcggtgcagccggtgccaccggctgctgctgctgctgcccctagtcctcgggctgtccgccgcacccgggtgggccggggccccccccgtggacgtgctgcgcgccctgagattcccgagtctgcccgatggcgtgagaagggccaaggggatttgtcctgcagacgtggcctacagagtggctcggcctgcgcagttgagtgcacccactcgccagttgttcccaggtggcttccccaaggattttagcctgttaaccgtggtgcgaacccgacccgggctgcaagctcccctgctcactctgtattccgcccagggcgtacgccagctgggtctcgaactgggccgaccagtaaggttcctgtacgaagaccagactggccgcccccagccacccagccaaccggtatttagaggactcagtctggccgacggtaagtggcaccgggtggccgtcgcagtgaagggacaatcggtaacactgattgttgactgtaagaaacgcgtcacacgccccttaccccggtctgccagacccgttctcgatactcatggtgttataatcttcggggcacgaattttagatgaggaagtcttcgaaggcgacgtccaggaactggccattgtcccgggagtacaggctgcatacgaaagttgcgagcagaaggagcttgagtgcgagggcgggcagcgagagcgtccacagaaccagcagccacacagagctcagagaagtccccagcaacaacccagccgcctccatagaccccagaatcaggaacctcagtcacaggaccccacaccgggggaagaggaggaaatcttggagtcttcgctactgccacccttagaggaggagcaaacagatttgcaggtgccacccaccgctgatcgtttccaagccgaggagtacggagaaggtggaaccgacccccccgaggggccatacgactacacatacggctacggcgatgattaccgggaagagaccgagctgggcccagctttgagcgctgaaacagcacatagtggcgccgctgcccatgggccacgcggacttaagggagagaaaggcgaaccagctgtgctagaacctggaatgctggtcgagggtccacccggaccggaaggaccagctggtcttatcggacccccaggaatacagggaaatcccgggcccgttggggacccgggggaacgcggtcctcctggacgtgcaggacttccagggtcagatggcgctcccggaccccctggtacttcattgatgctcccgttcagattcggctccggagggggagataagggacctgtggtggccgctcaagaagcgcaggctcaggcgatcctccagcaagcaaggttggctctgagaggtccccctggaccaatgggttataccggaaggcctggcccactgggccagcctggttcgcctgggctgaagggcgagtcaggcgatttagggccccagggccccagaggccctcagggactgacaggtcctccaggcaaggccggcagacgagggagagccggcgctgacggggccagaggtatgccaggcgacccaggggtgaagggcgatcgggggtttgacggtcttccaggcttacccggggaaaaaggccacaggggggacactggtgcacagggtctccctggacctccaggtgaggacggtgagcggggcgatgacggggagatcggcccccgcggcctgcctggtgagtctgggcctcggggcctgctgggccccaaaggcccccccggcatccctggaccaccgggcgttagaggtatggatggtcctcagggacccaaggggtctctcggacctcagggcgagcctggccccccggggcaacaggggactcccggaacccaggggctcccagggccgcaaggggccattggccctcacggagagaaaggaccacagggcaaacccgggcttccggggatgccagggtctgatgggccaccaggtcatcctggaaaggaaggcccccctggcacgaaaggcaaccagggcccctctgggcctcagggacccctgggctatccgggcccacgtggagttaagggagtcgatggtattagaggattaaaaggtcataagggcgagaagggtgaggatggcttccctggctttaaaggagacattggggtgaagggcgacagaggagaagttggggtgccgggatctcgcggggaagacgggcccgaagggcccaagggccggactggtcctaccggggaccccgggcctcccgggctgatgggagagaagggtaagctgggagttccgggtcttcccggctatccagggcggcagggccctaaagggtcactgggcttccctgggtttcctggtgcatccggagagaagggagccagagggctgtccggaaagagtggcccgcggggcgagcgcggcccaaccgggcctagggggcaaagaggcccacgcggggctacgggaaagagcggggccaaaggcacgtctggaggtgatggacctcacggtccaccaggagagagaggcctaccgggaccccaaggacccaacggatttcctgggcctaaaggccctccggggcctccaggaaaagatggcctgcccggccaccctgggcagagaggagaagtgggtttccagggcaagacaggcccacctgggcctcctggcgtggttgggcctcagggtgccgccggagaaactggaccaatgggcgaaagggggcacccagggcctcccgggccccctggcgagcaggggctgccagggacggctggtaaggaggggactaagggtgatccgggaccccctggcgcgccaggcaaagatgggcctgccggtctcaggggtttcccgggcgaaagggggttgcctgggaccgctggaggtccaggtctgaaaggaaatgaggggcccagcggaccacccggacccgctggctcgcctggcgagcggggcgccgccggctctggcgggccaatagggccgcccgggaggccggggcctcaaggtccacccggcgctgccggtgaaaagggagtacctggggaaaagggtcctattggccccaccgggcgtgacggtgtacagggcccagtcggacttccagggccagcaggccctcctggagtcgccggggaggacggtgacaagggggaggttggtgaccccggccagaaaggaaccaagggtaacaagggggagcacgggccccccggccctcccggtccaattggccccgtggggcagccaggagctgcgggagccgatggtgagcctggggcccggggcccacaggggcacttcggcgcaaaaggggatgaggggaccaggggatttaatggacccccaggacccattggcttacagggactgccaggcccctcgggagaaaaaggagaaactggagacgttggcccaatgggtcctccaggccctccggggcccagggggcctgcgggacccaatggagccgatgggccgcagggaccaccaggaggagtaggcaatcttgggccgcccggagaaaaaggtgagcccggagaatctgggtctcccgggatccaaggggagcctggtgtgaagggccccaggggcgaacgaggcgaaaagggcgaatccggccagcccggagagccagggccaccaggcccgaaggggcccacgggagacgacggtccaaaaggcaatccagggcctgtagggttccccggggatcccggaccgcctggagagggcggacccaggggccaagacggagcaaagggcgacaggggcgaggacggcgaaccaggacagcccggatctccaggtcccacaggagaaaatggaccccccggcccactgggcaaacggggaccagctggttcccctgggtccgagggtaggcagggtgggaagggggctaagggggatcccggcgccattggtgcgcccggtaagactgggccagttggacccgcaggtcctgcaggtaaaccggggcctgacgggttgagagggctgccaggctcggtcggccagcagggtcgtcccggtgctaccgggcaggccgggccgccaggacctgttgggcctcccgggcttccaggattgagaggcgatgccggcgctaaaggggagaaaggacatcccggactcatcggcctgatcggtcctcctggggagcagggtgagaaaggggataggggattgcccggccctcaggggtcccccggccagaaaggggagatgggcatcccaggtgcatctggccctatcggaccggggggcccccctggactgccgggtccagccggtcccaagggcgccaagggtgccacggggcccggtggtccaaagggcgaaaaaggtgttcagggcccccctggacaccctgggcctccaggtgaagtaatccagcctctgccgattcagatgcccaaaaagactagaagatcagtcgatggctcacggctgatgcaagaggacgaggcaattcctactgggggtgcacccgggtctccaggaggactggaagagatctttggctccttggactctctcagggaggaaattgaacagatgaggaggcccactggcacccaagattcccctgctagaacgtgtcaagaccttaagctctgccatccggagttacctgacggggagtattgggtcgatcccaatcagggatgcgccagggatgcgtttcgggtgttctgcaacttcactgcgggcggagaaacgtgcgtgacaccaagagacgacgtcactcagttctcttacgtcgacagcgaggggtcacccgtaggcgtcgtccaactgacctttttgcgcctgttatccgtcagcgcccatcaggatgtctcctacccatgctctggagccgctcgtgacggcccgctgagattgcggggcgccaatgaggacgaattatcccctgaaacctccccctacgtcaaagagttcagagatggctgccagactcaacaaggaagaactgtattagaggttagaacacccgtgttggaacaactgcctgtcctcgatgcttctttctctgacctgggtgcccctccccgccggggcggagtgctcctggggcccgtgtgctttatgggatag

SEQ ID NO: 4033 - DNA, 5133 bp, Artificial Sequence
  Description of Artificial Sequence: Synthetic coding sequence
atggagcggtgcagccggtgccaccggctgctgctgctgctgcccctggtactgggcctaagtgcggctcctggttgggccggagccccgccagttgacgtcctgagagcgctaaggtttccttccctaccggacggagtaaggagagctaaggggatttgcccagctgacgtggcatatagggtcgcccgcccagctcagctgagtgctccgacgcggcagctcttccctggcggtttccctaaggacttcagcctgctgacagttgtcagaacccgacctgggttgcaggccccgcttctgaccctctattctgcccagggcgtacgccaactgggtttagaacttggtaggccggtacggttcctttacgaagaccagaccggaaggccccagccgccgtctcagccagtcttccgtggcctgtcccttgctgacggcaaatggcaccgggtcgccgtcgcagtcaaaggacagagtgtgaccctgatcgtcgattgtaagaaacgggtaactcgaccactgccccgaagcgcacggccagtgctagacacacacggggtgattatatttggggcccggatactggatgaagaagtgttcgagggagatgtgcaggagcttgctatcgtgccgggagtccaggcagcttacgaatcttgtgaacagaaggagctggagtgtgaagggggccaacgagagagaccgcagaatcagcagccccatagggcccagcgttcaccacagcagcaaccaagccgtctgcacagacctcagaatcaagagccccagagtcaagacccaacccccggggaggaggaagagattctagagtctagcctcttgccgcctttagaagaagaacagacggacctgcaagtgccacccacagccgatcgcttccaggccgaggaatacggggaaggcgggaccgatccccctgagggaccctacgactatacttacgggtacggggacgactacagggaggagaccgagcttggccctgccctgtctgccgagaccgcccattccggagctgctgcccacggtcctcggggcttgaagggagagaagggcgagccggccgtcctcgagccggggatgctagtcgagggccctccaggtcctgaaggccccgccggtttaattggcccaccagggattcaagggaaccccggacccgttggcgacccaggagagcgaggccccccgggtcgcgcaggattgcctggctccgatggagctcccggaccgcctggaacctccctgatgctacccttccgctttggctccggcggtggagataaaggtcccgtggtcgcggcacaggaagctcaagcacaagcaattttacagcaagcacggttagccctgaggggaccccctggccccatgggctacaccggccgccccggaccactcgggcaaccagggtctccaggcttgaagggtgaatcaggggatttggggcctcaggggccacgaggacctcagggactgaccggaccacccggtaaggccggccgccgaggaagagctggcgctgatggagccaggggcatgccaggcgatccgggcgtaaagggggatcgggggtttgacggccttccaggcctgccaggggagaaaggccaccgaggcgacacaggagctcagggcctccccgggcctccaggcgaggacggagaacgtggggatgatggtgagattgggccacgcgggctgcccggggaatctggacctcggggtcttctgggtcctaagggtccacccggtatcccagggccacctggcgttcgcggaatggacggaccgcagggtccaaaaggctccctggggccacaaggcgagccaggccccccaggacaacagggaactccagggacacaggggttacctggccctcaaggcgcaattggacctcacggcgaaaagggaccacaggggaaaccgggtctgcccggcatgcctggaagtgatggtccccccggtcatcctggcaaggaagggcctcccggtacaaaaggaaatcaaggcccgagcggcccacagggcccgctcgggtatcctggccctagaggggtcaagggtgtggacggaattcgtggcctcaaaggccacaagggcgagaagggggaagatggtttccctgggtttaagggcgacattggggtcaagggggacaggggcgaagtgggagtaccagggtctagaggcgaggacggtcccgaagggccaaaggggagaaccggccctacgggagatccaggcccaccaggtcttatgggcgagaagggcaaactcggtgtgcccggcctccccggatatccagggcgccaggggccaaaggggtcattgggttttcctggcttcccaggcgcctccggagagaagggcgctcgtgggctctctggcaagagcggtccccggggggaaagagggccaaccgggcctcgaggacagagggggccccgcggcgccacgggcaagtccggtgcaaaggggactagcggcggagacggtcctcacgggccaccaggcgaacgaggcctgcccgggccccagggccctaacggcttccccggtccaaaagggccccccggtccacccgggaaggacgggttgcctggacatcctggtcaaaggggtgaagtaggatttcaaggaaagaccggccctcccggtcccccgggcgtcgtgggccctcaaggtgctgccggggagactggtccaatgggcgaacggggtcatccaggtccccctggaccgccgggtgagcagggtctaccagggaccgcaggcaaggagggaaccaaaggtgatccgggcccccctggtgcgcccgggaaagatggaccagctggactgagaggcttcccaggggagagaggactccctggcacggcgggtggccctggtttaaagggcaatgaggggcctagtggcccccccgggcctgccggctctccaggcgagagaggagccgctgggtccggcgggccgatcggccctcccggaaggcccggtcctcagggaccccccggcgctgctggggagaaaggggttcccggagagaagggacccataggccctactggccgcgacggggtgcagggccccgtcgggctccccggacctgctggacccccaggagtggctggtgaagatggagataagggtgaagtgggggacccgggacagaagggcacaaaaggtaataagggcgaacacgggccaccgggtccccccgggcctatcggacccgtgggacagccgggggctgccggcgctgatggagaaccaggagctcgaggccctcagggccacttcggggctaagggcgacgagggtacacgcggttttaatggccctcccggccccattggtttgcagggactgcctggcccatcaggtgagaagggcgagaccggggatgtgggccccatgggtccgccagggcctccggggccgcgcggccctgctggacccaatggagccgatggacctcaagggcctcctggaggcgtgggcaatctcggaccccctggcgagaaaggtgagccgggcgagtcaggttcacctggaattcagggtgagccaggcgtaaaaggcccacgtggcgaaagaggtgagaaaggtgagagtggccagcctggagagcccggcccacctggacccaaggggccaacaggcgatgatggacccaagggaaaccctggccccgtgggctttcccggtgatcctgggcctccaggcgaggggggtcctagaggccaagatggagccaaaggtgaccgaggtgaggatggggagcctggacagcctggatctcccgggcccaccggtgagaatgggccacccggccctttgggaaagaggggccctgcgggctcacccggttcggaaggtagacaaggaggcaagggagctaaaggcgatcctggtgcaattggcgccccagggaaaaccggccctgttggacccgcgggcccagcaggtaaacctggaccagacggtctgagagggctgcctggatcagttggtcaacagggacgccctggcgccactgggcaggcaggtccacctggtccagtcggcccgccgggtctgccaggcttaagaggcgatgccggagcaaagggtgaaaaaggccaccccggactgatcggacttatcgggccgccaggtgaacagggcgaaaagggtgatcgggggctgcccggccctcaaggctccccagggcagaagggcgagatgggcatcccaggcgcttctggtcccattggccccggcgggccccccggcttgcctggtccggccgggccaaagggtgccaagggcgcaacaggccccggaggacccaaaggagagaagggcgtgcagggacccccagggcaccctgggccgcctggagaggtaatacagccattgccaatccagatgccgaagaagacccgcagaagcgtggacggcagccggctgatgcaagaggacgaggccataccaaccggcggcgctccaggcagcccaggtggcttggaggagatttttggatcactcgacagcttgcgggaggaaattgaacagatgcggcgacctactggaacgcaggactctccagctcggacctgccaagatctaaagctgtgccatcctgagcttcccgatggcgagtattgggtagatcccaaccagggctgtgcgcgcgacgccttccgcgttttttgcaactttacagcagggggggagacctgcgtgactccacgggacgatgtcactcagttctcatatgtggatagcgaaggatcacccgttggcgtggtacagctgacattcttgcgtctgctaagcgtgtctgctcatcaggatgtgtcttatccttgcagtggggccgcccgagatggtccactgcgactgcgcggagctaacgaagatgaattatctcctgagacatcaccttatgtgaaggaattcagggatgggtgtcagacacagcaggggcgaacagttctggaggtcaggaccccagtgctcgaacagttacccgtgctcgatgcatcattctccgacctgggagcaccgccacgcaggggcggggtgcttcttggcccagtgtgctttatgggctag

SEQ ID NO: 4034 - DNA, 5031 bp, Artificial Sequence
  Description of Artificial Sequence: Synthetic coding sequence
atggagcggtgcagccggtgccaccggctgctgctgctgctgcccttggtgcttggcctgtctgcagcaccgggctgggccggggcgcctccagttgacgtgctaagagctctccgcttcccttcgctacctgatggcgtgcggcgggcaaaaggaatttgccccgctgatgtggcatatagggttgcacggccagctcagttatcagctcccacaaggcagttgtttcctggcggcttcccaaaggatttttccttgctgactgtcgtgaggacgcggccgggcttgcaagcgcctctgctgaccctgtactctgcgcagggcgtgagacagctcggcctggaactagggaggccagttcgcttcctgtacgaagatcaaactggacggcctcagcccccctcgcaacccgttttccgcggactgagtctcgccgacggcaagtggcacagagttgctgttgccgtaaagggccaatctgtgaccctgattgtggattgcaaaaagagagttacgcgacccctcccccgctccgcaaggccagtcctggatactcacggtgttattatcttcggcgcccgaatcttagacgaggaggtgtttgaaggcgatgtccaggaactcgccattgtacccggcgtgcaggccgcctacgagtcctgtgagcagaaagagctggagtgtgagggcggacaacgggaacgcccccaaaaccagcagccccaccgcgcacaaagatctccccaacagcagcccagtcggctgcatcgaccacaaaatcaggagccgcagtctcagcccactgaatcactgtattacgactatgagccaccctactacgatgtgatgacaacagggacaactccagattatcaagatccaactcccggagaggaggaagagatactggagagtagcttactcccaccactggaagaagcggcacacggaccaaggggtcttaagggcgagaaaggagagcccgctgtcctggagcccggtatgctcgtggagggaccccctggccccgagggaccagcaggtctcatcggtccgcccggcattcaggggaaccccggtcctgtcggcgaccccggcgaaagaggcccaccaggacgagctggactgcctgggtcagacggcgcccccggaccccctggcacaagcctcatgcttccctttagattcggctcaggaggtggagacaagggccccgttgtggctgcgcaggaggcgcaggcccaggcaatcctccaacaggcacggctggctctgcgaggtcctcctggccctatgggatataccggtcggcccgggcctttagggcaaccaggcagccctggtctcaaaggagagagtggcgatctgggaccgcagggcccaagaggccctcagggcctgactggtccaccaggcaaggctggcagaaggggcagagcgggcgcggacggcgctcggggcatgcctggagaccccggagtgaagggcgaccgggggttcgatggacttcccggtctcccgggcgagaaggggcatcggggcgacacaggcgcccaggggctgcctggtccacccggggaggatggagagagaggggatgacggagagatcgggccacgcggtctcccaggagagagcggcccccgaggactgctgggacctaagggtccacctgggatccccggacccccaggggtgcgcggaatggatggccctcagggccccaagggaagtttaggacctcagggggagccagggcccccagggcagcagggcaccccaggaactcagggcctgccaggcccacaaggtgctattggaccacatggtgagaaagggcctcagggtaagccggggctgccggggatgccgggcagcgacgggccccccgggcaccccggtaaagagggtccacccgggactaagggaaatcagggcccttctgggccacaggggcccctgggctatccagggcctagaggcgtaaagggtgtagacgggataagaggactgaaggggcataagggagagaagggtgaggacgggttccccggtttcaaaggcgatattggcgtcaagggcgatcgcggcgaagtgggcgtgccaggcagccgtggtgaggacgggccagaaggcccaaagggccgcaccgggcccacaggagatcccgggccaccaggtctcatgggagagaaggggaaactgggtgtgccaggcctcccaggttacccagggagacagggccccaaggggtcgttgggcttcccggggttcccgggtgctagtggggagaagggtgcacgaggcctctctggaaaaagcggtcctaggggagagagggggcccacaggtccacggggacagagaggaccccgaggggcaaccggcaagtccggagcaaaaggtacaagtggtggtgatgggccccacgggccccccggagagcgagggttgcccggtcctcaggggcccaatggatttccaggtcccaagggacctttgggtcctccgggcaaagatggcctccccggacaccccggccagagaggcgaggtcggcttccagggtaagacgggaccccccgggcccccgggcgttgttggtccccagggcgccgctggggagaccggccccatgggtgaacggggccatcccggccctcccggaccaccgggagagcaaggactgcccgggaccgctggaaaagaggggaccaagggagaccccggcccccccggcgccccagggaaagacggcccggcaggtcttcgaggttttcctggcgagagagggctcccaggaacggcaggtggcccaggactgaagggaaacgagggacccagcggtccaccgggaccggccggatctcccggagagaggggcgccgccggctccggcgggccgattggcccacctggccgccccggaccccaaggaccgccaggcgccgccggggagaaaggagttccaggtgaaaagggacccattggtcctaccggacgggacggcgtgcagggccccgtaggcctgccggggcctgccggtcccccaggcgtggctggggaagatggggataaaggcgaagttggcgaccctggccagaagggcacgaaaggaaataagggagagcatggtccacccggaccgccggggccaattggccctgtaggtcagccaggggccgccggagctgatggcgaaccaggcgcacgaggcccccagggtcactttggcgctaagggcgacgagggtactagaggtttcaacggcccccccggaccaattgggctccaggggctacccgggcccagcggcgaaaagggggaaaccggggacgttggtcccatgggcccaccagggccccctggtccaagggggcctgccggacccaatggcgctgatggaccacagggacccccggggggcgtgggcaatctgggaccgccaggcgagaagggggagccaggtgagagcgggagccccggtatccagggggagcctggagtgaagggtccccgtggtgaacgaggggaaaagggagaaagcggccagcccggtgaacccggacctcccgggcccaagggcccaaccggcgacgatggtccaaagggtaacccaggtccagttggatttcccggagacccagggccccctggcgaggggggcccgcgcggccaggatggtgcaaagggcgatagaggggaggatggtgaacccgggcagcccggttctccaggccccacaggcgaaaacgggccacctggtccactaggtaagcgcggacctgcggggtcccctggctctgaaggtaggcagggcggtaagggggccaagggggaccctggcgcgattggtgccccaggcaaaacaggacctgtgggaccggctggcccggcaggaaagccagggccagacgggctgcggggactccccggcagtgtgggacaacagggacgtcccggggcgactggtcaggcagggccacccggaccagtggggcctcctggcctgcctggcctcagaggggatgccggtgctaaaggggaaaagggacaccccgggctgattgggttgatcggaccgccgggggagcagggcgagaagggcgaccggggcctgccaggtccccagggatcacccggccagaaaggggagatgggcatccctggcgcaagcggccccattggcccaggcggccctccaggcttaccagggcccgcgggtcctaaaggcgccaagggcgctacaggtccaggcgggccgaaaggggaaaagggagtgcagggccctcccggacaccctggccctcctggcgaagtcattcaaccactgccaattcagatgcctaaaaaaacacggaggagtgtggacggatctcggttgatgcaggaggatgaggctatcccgaccggaggggctcccggatctccgggcgggctggaggaaatcttcggtagcctggacagcctgcgcgaggagattgagcagatgcggagacctaccggtactcaagactccccagcccgcacgtgtcaagatctgaaactctgccacccagagctgcctgacggcgaatactgggtggaccctaaccaggggtgtgcacgggacgcgttccgagtattctgtaacttcacagccggaggagaaacttgcgtgacccctagggacgatgtcacacaatttagctacgtggattctgagggaagcccagtcggtgtagttcagcttacctttctaaggctgttgtctgtgtccgcccatcaggatgtgagctacccttgctcaggcgctgcgagggacgggcctcttagactcagaggggcgaatgaagacgaactgagcccggagacaagtccatatgtaaaggagttccgggatggatgtcaaactcagcagggtaggacagttctcgaggtgagaacgcccgttttggaacagctaccagtgctggatgccagtttttccgatcttggagctccaccccgaagaggtggagtactgctcggcccggtctgttttatggggtag

SEQ ID NO: 4035 - DNA, 921 bp, Artificial Sequence
  Description of Artificial Sequence: Synthetic coding sequence
atggactggcgggccagcgaggcctggatggtgccccgggcccccaaaggagcatgggacccccgtgagtctcaggacctgctggataaccgggcacctctcggccctcgagtctttcccggcccccgcgtgccgagcgcgttgatggagaggagggtgctcaagggcagccaaggctccccagcttgcccaggcccacctggagaggtcattcagccgctgcccatccagatgcctaagaagacgaggaggagcgtggacggcagtaggcttatgcaggaggatgaggcaatcccaacaggaggcgcaccagggtctccaggcggcctcgaggagattttcgggtcacttgactcactacgcgaggagatcgaacagatgcggagaccaactggtactcaagacagtccagccaggacgtgtcaagatctgaaactgtgccaccccgagttgccagatggagaatactgggtagaccctaatcaaggctgcgcacgtgatgccttcagggtgttctgcaactttactgcaggaggggaaacgtgtgttacaccaagagatgacgtaactcagttctcttacgtggactcggagggatcacctgttggcgtggtgcagctcacattcttgcgcctactctccgtttcagcccaccaggacgtcagctacccatgcagcggggctgcccgagacggaccactgcgattgcggggagcaaatgaagacgagctttcccccgagacaagtccctatgtcaaggagtttcgagacgggtgccagacacagcaaggaagaaccgtgctcgaagtcagaacacctgtacttgaacaattgcctgtcctcgacgccagcttcagcgacctgggggcacccccgcgacgagggggggtgctgctgggccccgtctgctttatgggctag

SEQ ID NO: 4036 - DNA, 5070 bp, Artificial Sequence
  Description of Artificial Sequence: Synthetic coding sequence
atggagcggtgcagccggtgccaccggctgctgctgctgctgcccctggtacttggtctcagtgctgctccgggatgggccggggccccccctgtagacgtgctgcgggccctcagatttcctagtctgccagatggcgtgcggcgcgctaaggggatttgccccgccgatgtggcgtacagagtggctaggccagctcagctgtccgcgccgacccgacagttattccctggaggcttcccgaaagacttctcgctattaaccgtcgtcagaacaagacctggcttacaggcaccccttctgaccctgtactccgctcagggtgtgagacaactcggacttgaactgggccgcccagtgcgattcctgtatgaagaccagacgggacgccctcaaccaccttcacagcctgtgtttcgaggactgagcttggctgacggcaagtggcatagggtcgccgtagccgtgaagggtcagtctgtaacactaatcgtggactgtaaaaagagagttactcggccactgcctaggtcagcacgtcccgtgctggatactcatggcgtcatcatcttcggagcccgcatactggatgaagaggttttcgagggtgacgtccaggagctggctatcgttcctggggttcaggctgcttacgagagttgtgagcagaaagaactcgagtgtgaaggcggacaacgggagcggcctcagaatcagcagccacaccgcgcccagcgttctccccagcaacaaccttcacgcctgcaccgcccccagaatcaggaaccccaatctcaggaacagaccgatcttcaagtcccacccactgctgacagattccaagcagaagagtacggcgaaggtggcacagacccacccgagggtccctacgactatacctatggctacggggatgactaccgggaagaaacagagttaggccccgctctgagcgccgagacggctcatagcggcgcggccgctcacggaccaagagggttaaaaggagaaaagggtgagccggccgttttagagcctggcatgctcgttgaggggccgcctgggcctgaagggcctgcggggctgattggacctcctggcattcagggaaaccctggtcccgtgggagatcctggagagagagggcctccaggcagggcaggccttccaggctccgatggagccccggggcctccagggactagcctaatgctcccttttcgatttggctcaggtggaggcgacaaaggccccgttgttgcagcccaggaggcgcaggctcaagcaattctccagcaagcccggttggcactgcgaggaccccccggtcctatgggatacacggggaggcccggtccgttaggccaaccaggcagccctggtcttaagggcgagagcggagacctcggcccccaggggccgagaggaccacagggcctgactgggcctcctggcaaggcaggacgcagaggacgtgccggcgccgacggggcccggggcatgcctggggatccaggagttaaaggcgataggggtttcgacggtcttcccggactgcccggtgagaagggacatcgtggcgatactggcgcgcagggcttgcccggaccacctggagaagacggcgaacgtggcgacgacggagagattggacccaggggattacccggtgaatccggaccccggggtcttctgggccctaaaggtcctcccggaatccccggccctccaggagttcgaggaatggacgggccccaggggccaaagggatccctgggaccccagggtgagcccggtcctccaggacagcagggcacccctgggacacagggactgcccggtcctcaaggagctatcggcccccacggagaaaaaggaccccaggggaagcccggcctgcctgggatgccgggatcggatggtcctcctgggcaccccgggaaagaagggcctcccggcacgaaaggtaaccaagggccctccggcccccagggcccactgggataccccggtccccggggcgtcaagggagtggatggaatacgaggcctgaaagggcacaagggggaaaaaggggaagacgggtttcccggttttaagggggacatcggagttaaaggtgaccgcggggaagttggagtccccggctcacggggcgaagacggacctgagggcccaaaagggagaaccgggcctacgggggaccccggacctcccggtttgatgggagagaagggcaagctgggagttccaggcctgccaggatatccggggagacagggccccaaaggatcattaggctttccaggcttccctggagctagcggcgaaaagggcgctagggggttatccggtaagagcggcccacgaggcgagcggggcccaaccgggccacgaggccagcgtggcccgagaggtgcaacgggtaaatctggcgccaaaggaacaagcggcggagatggaccccacggccccccgggcgagcggggattacccggacctcaaggtcccaacggatttccgggtcccaaaggcccgttagggccgccagggaaagatggccttcctgggcatcccggccagcgcggggaggtggggtttcagggaaagaccgggcctcctggaccacctggcgtggtgggccctcaaggagccgcgggagagacggggcccatgggcgagcgtggtcaccctggtcctccgggcccacctggcgaacaggggctgcccggcacggccgggaaggaaggaactaaaggagaccccggacctccgggagctcccggaaaagatggtcccgcaggtttacgcggcttccccggagaacggggacttcctgggaccgcaggcggccccggtttaaaagggaatgaaggtccatccggaccccctgggcccgccggcagtccaggagaaagaggcgctgcaggcagtgggggaccaatcggcccacctggcagaccagggccgcagggcccaccaggcgccgcaggcgaaaaaggcgtacccggggagaaggggcctattggccctaccggacgggacggcgtgcagggcccagtagggctgccggggcccgccgggccacctggcgtagccggcgaagacggcgataaaggcgaggtgggggacccgggtcagaaagggactaaagggaacaagggggagcatggccctcccgggcccccaggacccatcggtcccgtgggtcagcccggcgcagctggggcggatggcgagccgggtgccagaggccctcagggccacttcggagcaaaaggcgacgagggcactagaggatttaacggaccacccgggccaatcggattgcagggcttaccaggcccgagtggcgaaaagggggagacgggagacgtcggccctatgggccccccgggtccaccaggaccgcgcggtcctgctggtccaaacggagccgacggccctcaggggccaccaggcggggttggtaacctcggccctcctggcgagaagggcgaacccggcgagtccgggtctccaggtattcagggtgaaccaggcgtgaaaggtcccaggggagagcgcggcgagaaaggagagagcggccagccaggagagccaggccccccaggtcctaaggggcccacaggagatgatggacccaaaggtaacccgggcccggtgggattcccaggagacccagggccaccgggagaaggtggacctcggggccaggatggggccaagggcgaccgtggcgaggatggcgaaccaggccagccgggatccccaggacccaccggtgaaaacgggcccccaggacctctaggcaagcgcgggcccgccggcagccctggcagtgaaggtcgacaggggggaaagggcgccaagggggaccccggagctataggggcccccggcaagacgggccctgtgggaccagccgggccggctggcaagccgggccctgacggacttcggggcctccccgggtccgtgggacaacaggggcgacccggagctaccggacaggcagggccccccgggcctgtcggacccccggggctgccaggactccgaggggacgccggcgccaagggagagaaaggacacccaggtcttataggtctgatcgggccacccggggagcagggcgagaagggagacagaggcctccctggaccccaggggtcacctggccagaaaggagaaatgggaatacctggcgcctccgggcccatcggccctgggggtcctcctgggctaccaggacccgcaggccccaagggtgctaagggcgctaccggccctgggggcccgaagggcgagaagggcgtccagggcccgcccggacaccctgggccacccggcgaagtgattcagcctctccccatccaaatgccaaaaaagacccgacgtagcgttgatggatcccgactgatgcaagaagacgaggcgatacctaccggcggcgcccctgggtcacccgggggactggaggaaatcttcggctctctggacagcctacgcgaggagatcgagcagatgagaaggccaaccggcactcaagattcccctgctaggacatgtcaggatttgaaattatgccatcctgaacttcctgacggcgagtattgggtggatcccaatcagggctgtgccagggacgcctttcgcgtattttgtaacttcacagccggcggtgagacttgcgtaacgcctagggatgacgtgacacagttctcttatgtggactctgagggtagccctgtgggagtagtgcagctgacttttctccgacttttgtctgttagtgcgcatcaggatgtgtcctacccctgttctggagccgctcgcgatggtccactgcggctcaggggggctaatgaagacgaactcagccctgaaacctccccctacgtcaaagagtttagggacggatgccagactcagcagggcagaaccgtgctcgaggtacggacaccagtgctcgaacaattgccagttctggatgcttcattctctgatctcggcgcccccccacggcgaggcggcgtactgttgggtccagtgtgtttcatgggctag

SEQ ID NO: 4037 - DNA, 4890 bp, Artificial Sequence
  Description of Artificial Sequence: Synthetic coding sequence
atggagcggtgcagccggtgccaccggctgctgctgctgctgcccctggtgctgggactatctgcagcacccgggtgggcaggagctccccccgttgatgtgctgcgggcattaaggtttcccagcctgcctgatggcgtccgcagggccaagggcatctgcccagccgacgtggcctatcgtgttgctaggcccgcccagttgagcgcacctacaaggcagctgtttccgggaggttttccaaaggatttttctctcctaaccgtagtgcgtacacgccctggactgcaggccccgcttcttaccttgtactcagctcagggcgtgcgacagcttgggctggagctgggcagacccgtccggttcctttatgaggaccagacaggaagaccacagcctccatctcagcccgtgtttcgtggcttgagcctagctgatggcaagtggcacagggttgcagttgccgtcaagggacagtctgttaccctgatcgtggactgcaaaaagcgggtgacgaggccactgcccaggtctgccagaccagtgctggatacccacggcgtgattatcttcggggctcgaattctagacgaggaggtctttgagggtgatgtgcaggagctggccattgtgcctggcgtgcaggctgcatacgagtcctgcgagcaaaaggagctggaatgcgaaggggggcagagagagcgtccacagaatcagcagcctcatagggcgcagcgaagtcctcaacagcagccctctagactccatcgaccccagaaccaggagccccaaagtcaggctgcacatggaccacggggtttgaagggagaaaaaggtgaacccgctgttcttgagccgggtatgcttgtggaaggcccaccagggcccgaaggacctgcaggactcattggacctcccggcatccagggcaaccctggaccagtcggggatcctggggaacggggaccccccggaagggccggcctaccaggttccgacggcgctccagggcctcctggaacgagcctcatgctgcccttccgcttcggctccggcggtggggacaagggccctgttgtcgccgctcaagaagcccaggcccaggcaatcctgcagcaggcaagactcgctcttcggggtcctccgggacccatgggatataccgggaggcctgggcccctaggtcagcccggtagtcctggccttaagggagagagtggtgatcttgggcctcagggaccgcgtgggccccagggactcactgggcctcccgggaaagccggccgccgcggcagggcaggcgccgacggggctcgggggatgcccggtgaccccggtgtgaagggcgatagagggttcgatggactgccggggcttcctggcgagaaaggccacagaggcgacacaggggcccagggtctgccagggcctcccggagaggatggcgagcggggtgacgacggggagatcggcccaaggggtctgccaggggaatcaggaccccgcgggctcctcggcccaaagggcccgccagggattccaggcccacctggcgtgaggggtatggatggcccccagggacccaagggtagcctgggaccgcagggcgagcccgggccgccaggacagcaggggactccgggtacccaggggttgcccggcccacaaggcgcgatcggtccgcatggggaaaagggcccacaggggaaaccaggtctccccggtatgcctggtagtgacggtcctccgggccatcctgggaaggaaggacctcccgggaccaaaggaaaccaaggtccatctgggcctcagggacccttaggctaccctggaccccgaggcgttaagggcgtcgacgggataagggggctgaaagggcacaagggcgaaaaaggagaggacgggtttccgggctttaaaggggacataggcgtgaaaggcgacagaggagaggtcggagtgccaggcagtcgtggggaggatggtcccgagggtcccaaaggccgtacaggacccaccggggaccccggaccgcccggactgatgggggagaaaggcaaactgggcgtgccaggattgcctggatacccagggaggcagggccctaagggcagcctaggctttccggggtttccaggggcgagcggagaaaagggcgctcgaggactttcggggaagtcaggccccaggggagagaggggcccaactggaccgcggggccaacgcggacccaggggcgccacaggaaagtctggtgccaaagggactagcgggggagatggaccacacggacctcctggtgaaaggggcctccccggcccacagggaccgaatggtttccctgggcctaaaggccccccaggtccgcctgggaaggatggtctacccggccatcccggccaacgcggtgaggtggggttccagggtaagaccggacctcctggacctccgggagtggtcggcccacagggggccgccggagagactggccccatgggcgaaagggggcatccagggccccctgggcccccaggcgagcagggtctccctggtaccgctggtaaggaggggactaagggtgaccctggtccccctggagccccaggcaaggatggtccagcaggcttgagaggattccctggcgagcgggggctccccggcactgctggcggccctggtctaaaggggaacgaaggaccaagcggcccacccggacccgccggttcaccgggggagaggggggctgctggatctggcggacccattggaccacccggccggccaggccctcaggggccaccaggagctgctggtgagaaaggcgttcctggagaaaaaggaccaatcggaccaaccgggagggatggcgtacaaggtcccgtgggtctcccagggcctgctgggcctccaggcgtggctggcgaggatggtgacaagggtgaggtgggggacccgggccagaagggaacaaaaggtaataagggcgagcatggacctcccggcccgcccggccctatcggccccgtgggccaacccggcgccgccggcgccgacggagagccaggtgctcgcggcccacaggggcattttggagcaaaaggggacgaaggcacaaggggtttcaacggacctcccggcccaatcgggttgcaaggacttccaggaccttccggtgaaaaaggcgagaccggtgacgtgggccctatgggacccccaggaccaccaggacccagaggcccagccggtccaaatggcgccgacggaccacagggaccccccggtggagtgggaaatcttggcccgcccggagaaaaaggcgaacctggtgaatccggaagtcccggtattcagggagaacctggcgtgaagggacctaggggcgagcggggggagaaaggcgagagcgggcaaccgggggagcctggcccccccggcccgaagggtcctaccggggacgatgggccgaaggggaaccccggtcctgtcggatttcctggcgatcccgggccaccaggggaaggaggacctaggggacaggatggtgcaaaaggcgaccgaggtgaagatggcgaaccgggccagcctgggtcacccggccccaccggagagaatggcccccctggcccactaggcaagcgcgggcctgccggaagtcccggcagtgaagggagacaagggggaaaaggcgctaaaggcgatccgggagccatcggggcccctggaaagacgggccctgtcggaccagccgggcccgccggcaagccgggcccggatggcctccggggattacccggatctgtggggcagcagggacgtccaggtgctacaggccaggctgggccacctgggcccgtgggtccgcccggactgcccggacttcgaggggatgcgggcgccaaaggtgagaaagggcaccccgggctgatcggactgattggacctccgggggagcagggcgagaagggtgatcggggactgcccggtccgcagggaagcccagggcaaaaaggtgaaatgggtattcctggggctagtggtcccatcggtcctgggggcccccctggtctcccaggccccgccggcccaaagggtgcgaaaggggcgaccggccctggaggcccaaaaggcgaaaaaggggtacagggcccacctgggcaccctggcccacctggcgaagtgattcagcctctccctatacagatgccaaagaagaccaggcgttccgttgatgggtccagattgatgcaggaagatgaggcaattccaacaggaggcgcaccaggcagtcccggtggtctggaggagatctttggatccctggattctctgagggaagaaattgaacaaatgagacgccctacagggacgcaggatagcccagcccgcacttgccaggaccttaagttgtgccaccccgaactgcccgacggtgaatactgggtggaccccaatcagggatgcgcccgtgatgccttccgtgttttttgcaatttcactgccggaggcgaaacctgcgttacaccccgcgacgacgtaacccagttttcttacgtcgactctgaggggtcccccgtaggcgtcgtgcagcttacttttctccgactattgtcagtgtccgcgcatcaggatgtgtcctacccgtgctccggcgcggccagggacggacccctgaggctaaggggcgctaacgaggatgagttatcccctgaaacgtcgccctacgtaaaagagttcagggacggctgccagacccaacagggacgcaccgtgttggaagtcagaaccccggtcctcgaacagctgcccgtcctggacgcatctttttctgatcttggagccccccctaggcgtgggggtgttcttctgggcccggtctgcttcatgggatag

SEQ ID NO: 4038 - DNA, 5211 bp, Artificial Sequence
  Description of Artificial Sequence: Synthetic coding sequence
atggagcggtgcagccggtgccaccggctgctgctgctgctgcccctggttctggggctgtccgcagcacctgggtgggccggcgctcctccagttgatgtcctgcgggccctcagattcccctcccttcctgatggcgtgcggcgggccaaaggcatatgtccagctgatgtggcctaccgcgtggcccggcctgcccagctgtctgcgcctacccggcagctgttcccaggcggtttccccaaggacttctcgcttctgactgtagtacgcactagacccggcctgcaggccccactcctgaccctttattcagcacagggcgtaagacagttgggactggagcttggcaggcccgtaaggtttctatacgaggaccagaccggccgtccacagcctccgtctcagcctgtgtttcgtggtctgtccctggccgacggaaaatggcacagggttgctgtcgccgtaaaaggccaatccgtcaccctgatcgtagattgcaaaaaacgtgtcacccggcctctcccccgctcagcgcgtccagtgttggacacacacggagtgattatcttcggtgcccgaattcttgacgaagaagtgtttgagggggatgtgcaggaactcgcaattgtgccaggcgtgcaggccgcatacgaaagctgcgaacagaaagaactcgaatgtgagggcggacagcgggagcgaccccagaatcagcagccgcatagagctcagaggtcccctcagcagcagccatctcgactacatcggccccagaatcaggagccgcagagtcagccaaccgagagtctgtactatgactacgagcccccttactacgacgtgatgaccactggtaccacacccgattatcaagatccaacccccggcgaagaggaggagatcctggagtcctcgctccttcctcccttggaagaggagcaaacagatctgcaggtgccccccacagccgacaggtttcaggcggaagaatatggcgaaggagggactgacccaccagagggtccgtacgattatacttatggttacggagatgattatagagaagagaccgagctgggacctgccctttccgctgaaactgctcattccggagcggcagcacatggcccacgagggttgaagggagaaaagggtgaacctgctgtgctggagcccggtatgttggtggaagggcctcccggacctgaaggccctgctggtttaattggcccacccggaattcagggcaatcccggccccgtcggtgatccaggtgagagaggccccccgggaagggccgggttaccaggcagcgacggggccccaggcccaccagggacatctttgatgctgccatttagattcggtagtggaggaggcgacaaaggacccgtggtggccgcccaggaagcccaggcccaggccattctccagcaggctaggcttgctctgcggggtccccccgggcctatgggatacaccggccggcccggacccttgggacagccgggaagtcccggcctgaagggtgaaagcggcgaccttggcccgcagggacctagaggtccgcaaggacttacaggcccacccgggaaggcaggaaggcgggggcgggcaggcgccgatggggcccgcgggatgccgggtgatcctggcgtcaaaggcgacagaggattcgacggactgcccggactgcccggagaaaagggtcatcgtggggacactggcgcccaggggcttcctgggccccctggagaggatggggagcggggtgacgatggggagatcggtccacggggtctgccaggcgagtccggtccgcgtgggctgctagggcctaaaggccctccaggcatacctggaccaccaggtgtgcggggaatggacggcccccaggggcccaaaggttcgttgggcccccaaggcgagcccggaccaccagggcaacaaggaactccggggacacaaggcttgccagggccccaaggtgctatcggcccccacggcgaaaagggcccgcagggcaagccaggattgcctggaatgcccggctccgacggcccccccggccacccagggaaggagggacctcccggaaccaagggcaaccagggacccagtgggccccagggccccctggggtaccccggtccacgcggcgtcaagggagtagacggtatccgcggattgaagggtcataagggggagaagggagaagatgggtttccggggtttaagggcgatataggcgtcaagggcgatcggggtgaagttggcgttcctggatcccgcggggaggacggccccgaaggacctaagggcagaactggcccgaccggggacccagggccacccgggttgatgggcgagaaggggaaattgggggtgcccgggttgcctggctaccctggtaggcagggcccaaaaggttctttgggatttcccggcttccctggcgcttcgggggagaagggagctcgcgggttgtccggaaaatcagggcctcgcggcgaaaggggaccaacgggaccacggggccagaggggaccccgtggcgccactggtaaatccggcgctaagggcacaagcggtggggacggcccgcatggtcctccgggagagcgtggactgcccggaccccaaggacctaatgggttccctgggcctaagggccccctgggtccacctggcaaggacgggctgcccggccacccaggccagaggggagaggttggattccaaggcaaaacaggcccaccaggaccccctggagtcgtcggacctcagggggcagccggagagacaggacctatgggggaaaggggacacccgggtccaccaggaccccctggggagcagggactgcctggcactgccgggaaggagggaacgaagggagatccagggcctcctggggcacctggcaaggatggccctgcagggctcagagggttcccgggcgagcgaggcttacccggcacagccggcggcccggggctcaaaggcaatgagggaccaagcggacctccggggccagcagggagcccaggagagaggggcgccgctgggtccggcggaccaattggtccgcctgggcgcccaggtccccaaggtccacctggggcagcgggcgaaaagggagtgcccggagagaaggggcctattggcccaactggaagggacggggtccaaggacccgtaggtctgccaggtcccgctgggccgcccggcgtcgccggggaagatggagataagggtgaggtcggcgatccaggccaaaaggggacaaagggaaacaagggggagcacggtcctccaggcccccctggccccatcggtcctgtcggacaacctggcgctgcaggagccgacggcgagcctggcgccagaggccctcaagggcatttcggcgccaagggtgacgaaggcacaagaggcttcaacggaccaccagggccaatagggctgcagggtctacctggcccctccggagaaaaaggggagacaggcgacgtcgggccgatgggcccacccggaccacccggtccaagagggccagcaggcccaaatggagctgacggaccacagggtccgccaggcggagtcggcaatctggggccccccggagagaaaggtgagcccggtgaaagcggctcccctgggattcagggcgagccaggtgtgaagggcccccgcggggaacgaggagagaagggggaatcaggccagcccggagagcccggccccccaggacctaagggccctaccggcgatgatggaccaaaaggtaatcccggtcctgtcgggttccccggggacccaggcccaccaggcgaaggaggacctcggggacaggacggcgcgaaaggcgatagaggcgaagatggcgagcctgggcagcccggatctccaggccctacaggtgagaacggacctccgggtccactcgggaaaagaggtcccgccggaagccccggctccgagggacggcaagggggcaaaggagcgaaaggagacccgggggccattggagcacctggcaagacaggccctgttggccctgccggtcctgccggtaaaccgggacctgacggactgagggggctgccaggatccgttggccaacagggcagacccggggcaaccgggcaggcaggacctccagggcctgtgggccctcctgggctccccggacttcggggtgatgccggcgcaaagggggaaaaaggccacccgggcctgattggcttgattggccccccaggggaacagggcgagaaaggcgacagaggcttacctggacctcaggggtctcctggccaaaagggtgaaatgggcatcccaggggctagtggacctataggcccaggcggccctccaggactcccgggacccgcaggccccaagggtgcaaagggtgccaccggacctggcggtccgaagggcgagaaaggcgtgcagggcccgcctggccacccaggcccccctggagaagtaatacaacccctgcctattcaaatgcccaaaaaaacgcgcaggtccgtggacggttccaggctgatgcaggaggatgaagccatccccaccgggggggctcctggatcacccggcggcctagaggagattttcggctctctggacagtcttcgcgaggaaatcgagcagatgcggcggcctacagggacccaagattctccagccaggacctgccaagatcttaaattgtgccatcccgagctgcctgatggtgaatactgggtcgacccgaaccagggttgtgctagggacgcattccgtgtcttctgcaattttacagccggtggtgagacttgcgtgacccctagagatgacgtcacccagttctcgtacgttgactctgaagggagcccagtgggcgtggtgcaattgactttcctgcgcctgttgagtgtgagtgcgcaccaagatgtgagctatccttgttcaggagcggctcgagacggtcctctgcgactgcgcggagcaaatgaggatgagttatccccggaaacctcaccatatgtgaaggagttcagggacggctgccagacccaacagggaagaactgtattagaagttagaacgcccgtacttgagcagctgcctgtactcgatgcctcttttagcgatctgggcgccccacctcgtcgggggggagttttgctcggccctgtctgttttatgggctag

SEQ ID NO: 4039 - DNA, 5211 bp, Artificial Sequence
  Description of Artificial Sequence: Synthetic coding sequence
atggagcggtgcagccggtgccaccggctgctgctgctgctgccccttgtgcttggactttctgcagcacccggatgggcaggagcgccaccagtagacgtgctgcgtgccctgaggttcccttcccttccagatggagtccgcagagccaaaggcatctgccccgccgacgtggcatacagagttgcgcgacccgcccagctctctgcccctactcgccagcttttccctggggggttccccaaggacttcagcttgctgaccgtcgtgcgaacgcgaccgggtctgcaggcaccactcctcaccctctattctgcgcagggtgtgcgccaacttggactggagttaggaagacccgttcggtttctgtacgaggatcaaacgggacgcccccagcccccttctcagcctgtgttcaggggactgtcactagctgatggcaagtggcacagagttgctgtggccgttaaagggcaaagtgtgaccctgatcgtcgattgtaaaaagcgcgttacacgacctctgccaaggagcgcccggcctgtgttggacactcacggagttataatttttggcgcacgaatcttagacgaggaggtttttgagggagacgtccaagagctggccattgtgccgggcgtgcaggcagcttacgagagctgtgagcagaaggagttagagtgtgaaggtggacaacgtgaacgaccccagaatcagcaacctcacagggcacagagatctcctcagcaacagcccagcagactacatcgtcctcaaaatcaggagcctcagtcccaaccaacggaaagtctctactatgattataagccaccctactacgatgttatgaccactggcactacccccgactaccaggaccctacccccggagaagaggaagaaattctggagtcaagtctgctcccacctctcgaggaggagcaaacggacctgcaggtgcctccgacggccgatcggtttcaggcagaagagtacggcgagggtggaactgatccgcccgaagggccttatgactatacctacggttacggagatgactatcgggaggagactgagctgggccccgccttgagcgccgagaccgcccactctggagctgctgcgcacgggccaagaggcttaaaaggcgagaagggcgaacccgccgtcttagaacccggcatgctggtggagggccctccgggaccagaaggacctgccggactcatcgggccaccaggaattcagggaaatcctggacccgtgggggaccctggtgagcggggcccaccaggacgagcgggactgccaggaagcgatggggctccgggccctccgggaacttcacttatgttaccctttcggtttgggagtgggggaggcgacaagggccccgtcgtcgccgcccaggaggcccaggcccaggctatcctgcaacaggcaagactggcgttacgcgggccccctggccctatgggctacaccggacgacctggcccactgggtcagcctggcagcccagggttgaaaggggaaagcggcgatctgggaccgcagggaccccgagggccccaggggcttaccggcccccctggaaaggctggaagacggggccgggccggcgcagatggcgcaagaggaatgccaggcgacccaggcgtcaaaggtgatagagggttcgatggcctgcccggattacccggcgaaaaaggacaccggggcgatactggcgctcagggactccccgggccacccggagaagacggcgaacgcggagatgatggagaaatcggcccgcgtgggctacccggcgagtcaggacccaggggccttttagggcccaagggcccacccggaatccccggccctcccggcgtgagaggaatggacggcccccaggggccaaagggaagcttaggcccccagggggaacctggccctccgggacagcagggcactcctggcacccaaggcctgcctggtccacagggcgctattggcccccacggagagaaaggaccacagggcaagcctggactgccaggaatgcccggctccgatggccccccaggacatccgggaaaggaaggtccacctggcacgaaggggaaccagggtccctctggcccacagggccctctggggtatcctggcccaaggggggtgaagggcgttgatgggattagaggtcttaaggggcataaaggcgagaagggcgaagatggattcccagggttcaaaggagacattggagtgaaaggcgatcggggggaggtgggcgtcccaggctcgagaggggaggatgggccggaaggccccaagggacgcacagggccaaccggtgatcctgggccgcctgggctcatgggcgagaaggggaaactgggcgtaccaggactgcctggctaccccggccggcagggtccgaagggcagtcttgggtttcccggcttcccaggagcttcaggagagaaaggagccaggggtttgagtgggaaaagcgggccccggggggagcgtggtccaaccgggccccgcggtcagcgcggcccaagaggtgcaacagggaaatccggagccaaaggcaccagtggaggggacggcccccacgggcctcccggtgagagaggcctgccagggccccagggtccaaatggattcccaggccctaagggacctccgggaccgccaggaaaggacggattgcctggacaccccgggcagcggggcgaagtgggattccaaggaaagacagggccaccgggacctccgggggtggtggggcctcagggggctgccggagagacagggccgatgggggaacgtggtcatcctgggccccctgggcctccaggggagcagggactcccaggaaccgctgggaaggagggaaccaaaggggacccaggtcctcctggcgctccaggaaaagacgggccggcaggactgcgcggttttccgggcgagcgtgggttgccgggcaccgctggcgggccgggcctcaagggcaatgaaggtccctccggccctcctggacctgcaggatctcctggagaacgcggtgccgcagggagcgggggtccaataggtccaccaggacggccgggcccacagggtccgcctggcgccgccggcgagaagggcgtgcctggtgagaaaggtccgatcgggcctaccggacgtgacggagtacagggaccggtgggcctgccaggaccagccggccccccaggcgtggccggagaggacggggacaagggggaggttggggaccctggacagaaggggactaaaggtaataaaggggaacatggaccgcctggtcctccagggcccatcgggcctgtaggacagccaggggccgcaggagctgatggggaaccaggggcgagaggcccccaaggccactttggcgccaagggagacgagggcactagaggattcaatggtccaccggggcccataggcctacagggcctcccggggccatccggagaaaagggggaaacaggagatgtgggacctatggggccaccagggccacccggcccaagaggacctgcaggcccgaacggtgcagatggaccccagggcccccccggtggagtggggaaccttgggccccctggagaaaaaggtgaaccgggggaatccggctcccctgggatacaaggcgaacccggtgtgaaggggcctcgaggggaaagaggtgagaaaggcgagtccggacagcctggagaacctggtccaccaggaccaaaaggacccaccggagacgatggcccaaaagggaacccagggcctgtagggttccccggagaccccgggccgccaggagaaggagggccccgaggacaagatggggctaagggtgacaggggtgaggacggtgaacctgggcaacccggctcccccggacccactggcgaaaatgggccacctggacctctgggaaagaggggccccgccggtagccccggcagtgagggacggcagggtgggaagggagcaaaaggtgaccccggcgccataggggcccctggcaagaccgggcccgtgggccccgcgggcccagctggaaagcctggacccgatggactacgcggcctcccagggtctgtggggcagcagggccggcccggagcaaccggccaggctgggcctccagggcccgtcggtcctcccggtctgcccggtcttcgcggcgatgccggcgccaagggggagaaagggcaccctgggcttattggccttatcggacctcctggagagcagggcgaaaagggcgatcggggactgccgggcccccagggctccccgggccagaagggtgagatgggcatccccggtgcaagcggcccgatcggacccggcgggccaccgggactgcctggtccggctggtcctaagggcgctaaaggggccactgggcctggcggacccaagggcgaaaaaggcgtccaaggaccgcctgggcatccaggccccccaggcgaggtgattcagcctctgccaattcagatgcctaagaagacccggcgctccgttgacggttccagacttatgcaggaagacgaggcaatccccaccggtggtgccccagggtcacccggcggtctggaggagatctttggctctctcgacagtctgcgcgaggagattgaacaaatgcggcgtcccacaggaactcaggattcacccgcgcgcacctgtcaggacttgaaactctgtcatcctgagctgcccgacggcgagtattgggtggacccaaatcagggttgtgcaagagacgcctttcgtgtgttttgcaacttcaccgccggtggcgagacatgtgtgactccgagggacgatgtgacacaatttagttacgtggattctgaaggatctcccgtgggcgtggtacagctgaccttcctcagactgttgtctgtgagcgcccatcaggacgttagctatccttgttctggggccgctcgcgatggccctctgcgccttcgcggcgcaaacgaagacgagctgtctcccgaaacatccccgtacgtcaaagagtttagggatggctgtcagacacagcagggccggactgtactcgaagttcgaaccccagtgctcgagcagctgccagtcttggatgccagtttcagcgaccttggcgcaccacctcggcgtggtggtgtccttctcggtcccgtgtgcttcatgggttag

SEQ ID NO: 4040 - DNA, 5211 bp, Artificial Sequence
  Description of Artificial Sequence: Synthetic coding sequence
atggagcggtgcagccggtgccaccggctgctgctgctgctgccccttgttttaggactgtccgcagcccctggatgggcaggcgcccccccagtggacgtgctgcgtgcactgcggtttccatccctacccgatggagtgaggagggctaaaggcatctgccccgcagacgtggcctatagggttgccagaccagcccaactgtccgccccaacccgccagctctttccaggcgggttccccaaggattttagtctgcttaccgtggtgcggactcgtcctggactgcaggcccccctcttaactctgtactccgcccagggggttcggcaacttgggctggaactgggccgtccagtgaggtttctctatgaagaccagacgggaaggccgcagcccccatcccagcctgtgttccggggtctgtcactggccgatgggaagtggcaccgcgtggctgtggcagttaaaggacagtcagttacactgattgtggactgcaaaaaaagagtgacaaggcccctgccccgcagtgctcgcccggtgctcgacacacacggtgtgataatcttcggagcaaggattctggacgaagaggtatttgaaggagatgttcaggaactcgcaatcgttcctggcgtccaagcagcgtacgaatcttgtgaacagaaagagctagagtgcgaaggcggtcagcgtgaacgccctcagaaccagcagccgcatagggcccagcggtctccgcagcagcaaccatcgcgtctgcataggccccagaaccaggagccccagtcccagcctactgaatccctttactatgactacaaacccccgtactacgacgtaatgacaacaggtacaacaccagactaccaggacccaactcccggagaagaagaagaaatactcgagtcgtcactccttcctcctctggaagaggagcagacggacttgcaagtccctcccaccgccgatcgtttccaggcagaagaatacggcgaaggaggaactgatccccctgaaggcccatacgattacacctacggatatggcgacgactatcgtgaagagacagaactaggtccggctttatccgctgaaactgctcacagcggcgctgccgcgcatggcccgcgaggcctcaagggcgaaaaaggagagccagccgtcctcgaaccgggcatgcttgtggaaggtccgcccggtcctgagggccccgctggcctgatcggcccccctgggattcaagggaacccaggtcctgttggcgatcccggagaaagagggcctcctggaagggcagggttgcctggctctgacggcgctcctggacctccaggcactagcctaatgctgccatttcgctttggctcagggggtggtgataagggccccgtggtggcagctcaggaagcacaggctcaggcgattttgcagcaggcccgactggctctgcgtggtcccccaggacctatgggatatactggacgccccggccctctcgggcagccgggatcccccggtctgaaaggcgaaagcggcgaccttggaccccaaggccctcggggacctcagggactcaccggcccacccggcaaggcaggccgacgcgggcgcgcaggcgcagacggagcgagaggcatgccaggagatccaggcgtgaaaggagataggggatttgatgggcttccaggcctgcctggagagaaaggccatcggggcgataccggagctcagggattacccgggcctcctggcgaggatggtgaacggggcgatgatggggagatcgggccgcggggtctccccggggagtccggccctaggggactcctaggacccaaggggcccccgggcatacccgggcctcccggagtgcgcgggatggatgggccccagggacctaaggggagcctgggcccccagggtgaacccggaccacctggacagcagggaacacctggaacccagggcctgccagggccccagggcgccattggcccacacggtgagaagggcccacagggaaagcccggcttgccggggatgcctggatcggacggccctcccggccatcctgggaaagaggggccccccgggacaaaaggtaatcagggcccctcagggccccaggggcctctcggatatccaggaccccgtggcgtgaagggtgtggacggcatcagaggactgaaagggcataaaggtgagaagggcgaagatgggtttccgggcttcaaaggggacatcggggtcaagggcgacaggggcgaggtcggagtcccaggatcacggggtgaggacggccccgaaggccccaaagggagaactggtccaactggggaccccgggcctcctggtctcatgggcgaaaagggaaagcttggagtgccgggcttgcccggctaccctggaagacagggccccaaggggtctctgggctttcctgggttccccggagcttccggagagaaaggggctcgaggcctcagtggcaagagtggtccaaggggtgaaagaggccccaccggtcctagagggcagcggggtccccgaggagctaccgggaagagtggggcaaaggggacatccggtggagatggaccccacgggcccccaggggagaggggtctccctgggccacaaggtcccaacggcttccccggcccaaaaggcccccccggcccacccggtaaggacgggctgcctggacatccgggtcagcgcggcgaagtgggttttcagggcaaaactggcccccctggccctccaggtgtggtgggccctcaaggcgccgccggggaaactggtcccatgggagagagggggcatccggggcctccaggcccacccggggagcagggattacccggcactgctgggaaggaggggaccaagggtgatcccggccctccaggggcgcccggaaaagacggccctgcaggactgcgtgggtttccgggggaaagaggcctgcccggaacagcgggaggccccggcctcaaggggaacgaaggaccgagcggcccccccggaccagccggcagcccaggcgagcgcggagcagccgggtctgggggcccgattggacctccgggccgcccaggcccacagggtcccccaggagcagccggcgaaaagggcgttccgggagagaaggggccgatagggcctacaggtagggacggggtccagggccccgtgggattgcctggacctgcagggccccccggagtggccggcgaggacggtgataaaggggaggttggcgaccctggacaaaaaggcaccaagggaaacaagggagagcacgggccacctgggccaccaggcccaatcggtcccgtgggacagcctggggcggccggagccgacggcgagccgggtgcgagagggcctcaggggcacttcggagctaagggggatgagggcacccgggggttcaacgggccccccggtccaatcggactgcagggcctcccaggtcccagtggagagaagggtgaaacaggcgatgtcggccctatggggccccccggacctccgggcccccggggccccgcaggccctaatggggcggatggaccacagggacctcccgggggcgtgggcaaccttggtccacctggtgagaagggagagcccggagaatccggaagtcctggtattcagggcgaacccggtgtgaagggaccaaggggcgaaagaggtgagaagggtgagagtggccagccaggggaaccaggtcctcccggtcctaaagggcctactggcgacgatggaccgaagggaaatcccggccccgtcggctttcctggtgatcctgggccaccgggcgagggggggccaagagggcaggacggtgccaagggggaccgaggagaagatggcgaacccggacagcccggaagccccggcccaaccggagaaaatgggccccccgggcccctgggcaaaaggggacctgcgggcagtcctggatcggaaggcagacaggggggcaaaggcgccaagggggacccaggggctattggagcaccaggcaagacagggccagtgggcccagctggacccgctggaaagcctggtccggacggcctccgcggtctgcccggaagtgtgggccagcaggggcgccccggggccaccgggcaggcaggaccacctggccccgttggacccccggggctccccggcctgcgtggtgatgccggcgcaaagggcgagaagggccacccagggctgatcggtcttatcggtcccccgggggagcagggagaaaagggtgaccgcgggctgcctggaccccaaggctctcccggacagaagggagaaatgggcattcccggcgcgagcgggcctattgggccaggtggccctccaggcctgcccggccctgccggcccaaaaggcgcaaaaggcgccaccgggccaggaggtcccaaaggagaaaaaggagtccaggggcctccagggcacccagggccccccggggaagtgattcagccattgccaattcagatgcctaagaagacgcggagatcagttgatggaagcagattgatgcaggaggacgaggcaatccccacggggggtgcgcctggttcacccggcggcttggaggagatcttcggcagcctggatagtctccgggaggaaatcgaacagatgcggcgcccaactgggacccaggacagcccggctcgcacctgccaagacttgaaattgtgtcatcctgaattgcctgatggagagtactgggttgaccccaatcaaggctgcgccagagatgctttcagagtgttttgcaatttcacagccggcggagaaacctgcgttacgccccgtgacgacgtaacgcagttttcttacgtcgatagtgaggggtcccccgttggtgtcgtccagctgacgtttctccgactcttatcagttagcgctcaccaggatgtgtcgtacccatgtagcggtgcggccagggatgggcccttaagactacggggcgctaacgaagacgaactctcccccgagacatccccctacgtgaaggagttccgtgatgggtgccagacgcagcagggaaggaccgtcctcgaagtacgaacacctgtgctagaacaactgcctgttttagacgcatcattctctgacctcggcgcgcctcccagacgcggcggcgtactccttgggcctgtctgctttatgggatag

SEQ ID NO: 4041 - DNA, 5070 bp, Artificial Sequence
  Description of Artificial Sequence: Synthetic coding sequence
atggagcggtgcagccggtgccaccggctgctgctgctgctgcccttagtcctcggtctgtccgctgcacccgggtgggcaggtgctccgccggttgacgtgctgcgggcactccgttttcctagcttgccagacggcgttcggcgagccaagggaatttgtcctgccgatgttgcttaccgtgtggccagacccgcacagctgtctgcacctaccaggcagctcttccctggcgggtttcctaaggatttcagcttgctgacagtggtgaggactaggcctgggcttcaggcaccccttcttactttgtacagcgcccagggcgttaggcagctcggactggaactgggaaggcccgtccgatttctctatgaggaccagacaggaaggccgcagcccccctctcaacccgtgttccgcggactaagcctggcagacggaaaatggcatcgggttgctgtggccgtcaaggggcagtctgtcacactaatcgtggactgtaaaaagagagttaccagacctcttcctcgctccgccaggcctgtcttggacacacacggggtaattatcttcggagctagaatcctcgatgaagaggtttttgagggggacgtccaggagctagctatcgtgccgggagtgcaggccgcttacgagtcctgtgagcagaaggagctggagtgtgaaggaggccagcgggaacggccgcagaaccagcaaccacaccgcgctcagcggtcacctcaacaacagcctagccgacttcacaggccccagaaccaagaaccccagtctcaggaacagaccgacctgcaggtgcctccgacagctgatcgtttccaggcagaggagtacggggagggtggtacagatcccccagaagggccttatgactatacatatggttatggagacgactacagggaggagactgaattggggcccgctctgtctgccgaaaccgctcactccggagcagccgcacacggtccccgtgggcttaagggcgagaagggagagccggccgtgctggaacctggaatgcttgtggagggcccacctgggcccgagggccctgccggtctcataggccccccagggattcagggaaacccaggccccgtcggcgatccgggagagcgcggaccccccggccgcgccggactgccgggtagtgatggcgcccctggaccccccggtacctcgctcatgcttcctttccgcttcggaagcggcggcggtgacaaaggacccgtcgttgccgcgcaggaggcccaggcccaggctattctccaacaagcccgactggcactccgggggccaccaggaccgatggggtatacaggacggcctggacctctggggcagcctggctcaccaggactgaaaggcgaaagcggtgatctcggaccccagggaccacggggacctcagggactgaccgggcctcctggtaaggctgggcgcaggggtcgagccggggcagacggagcccgaggcatgcccggagacccaggagttaaaggcgaccgaggctttgacggtttaccaggtctccccggcgagaaggggcaccggggcgatacaggtgcccaggggctgcctgggccacctggtgaggatggtgagcgaggcgacgatggcgaaataggacctcgtggtttacctggcgaatccgggccgagaggcctgctggggccaaagggaccacctgggattcctggcccacccggagtccgaggaatggacggcccgcagggtcctaaaggcagcctcgggccacagggggaacctgggccaccaggccagcaaggcacccccggtacccaagggctgcccggccctcaaggcgctatcggaccccacggcgagaagggccctcagggaaaacctgggctcccagggatgccaggctccgacggaccacctggccaccccgggaaagagggcccacccggaaccaaaggtaaccaggggccttcaggtccccaagggcctctgggatatcctggtccccggggcgtgaagggtgtggatggtattcgtggattgaagggccacaagggcgagaaaggcgaggatggattcccaggctttaaaggcgacatcggcgtcaaaggtgatcgaggagaggtaggcgtccctggtagccggggcgaggacggaccagagggccccaagggaaggaccgggcccaccggtgatccgggaccccctggcctgatgggtgagaaagggaaacttggcgtacccggtctgcccggctatcccggcaggcagggcccaaaaggctccctggggttcccaggatttccaggggcatcaggtgagaagggagccagaggtctgagcggaaagagcggccctagaggcgaacggggccctacgggcccgcggggccagcgcggcccacgcggcgcaactggcaagtctggggcaaaagggacatctggtggcgatggtccgcacggtcctccaggggagagaggtcttccagggccacaaggcccaaacggcttcccaggcccaaagggtcctcccggcccacctggcaaggacggcctgcccgggcaccctggccagcggggggaggtaggcttccaaggcaagacaggtccaccaggtccacctggtgtggttgggccccaaggtgccgctggggagacagggcccatgggtgagaggggtcaccctggccctcctggtccccctggcgaacaaggcttaccaggtaccgcaggcaaagaagggactaagggagacccagggccacccggagctccgggcaaagacggtcctgctgggctacggggctttccgggagagagaggactgcccggcactgctgggggcccgggccttaaggggaacgaaggaccctctggacctccagggcccgcgggttcccccggtgagcggggggcagcagggagcggtgggcccatcgggcctccaggcagaccaggccctcagggaccaccaggcgctgctggtgagaaaggggtgcccggagaaaaaggcccaatcgggccaaccggccgggatggggtccaaggcccggtgggcctgcccggacccgccggccctcccggggtcgccggcgaggacggggacaagggggaggtcggcgatcctggccagaagggtacaaaaggaaataaaggtgaacatggcccacctggaccccctggacccatcgggcccgtgggccagccgggcgctgctggggctgacggagagccaggggcccgcggtccacaggggcatttcggagctaagggtgacgagggcacacgaggatttaacgggccgcccgggcctattggcctgcaggggctcccaggacctagtggagaaaagggtgagacaggggacgtcggccccatgggccctcccggaccacctggtccacgagggcctgctggcccaaatggggccgacggccctcaaggaccaccaggcggcgtgggtaacctgggcccccctggagagaaaggagaaccgggtgagagcgggtctcccgggattcagggcgagccaggtgtgaaggggccgcgaggggaacggggagagaagggagagagtggacagccaggcgagcccggaccccccggaccaaaaggtccaacaggcgacgacggaccaaaaggcaatccgggccccgttggatttcccggggaccctggccctcctggagagggcggaccgcgtggacaggatggagctaaaggggaccgcggggaggacggcgagcctggacagcccggctctccaggccctaccggcgaaaacgggcctccggggccccttggtaaaagaggaccagccggttcgcccggcagcgaggggaggcaaggcggtaaaggggctaagggtgaccctggggctataggggctccaggcaaaaccgggcctgtgggccctgctggaccagcagggaagccgggaccagatggactgaggggcctacctgggtctgtcggccagcaaggtcgtcctggcgcgacggggcaagccggtcctcccggaccagttggacccccaggcctgccgggccttaggggagatgccggggccaagggagaaaagggtcacccggggcttatcgggcttataggacccccaggggagcagggagaaaaaggcgatagaggactgcccggaccacagggcagcccgggtcaaaagggtgagatgggcattcccggtgcatctggcccgatcggacccggcggcccccccggtctgcccgggcctgctggacccaaaggggccaagggagctactgggcctggaggacccaagggagagaaaggcgtgcagggaccccccggccacccagggcctccaggcgaggtaatccagccactgcccatccagatgccgaagaaaacgcggcgctccgtggatggcagcagactcatgcaagaagacgaagccattcctaccggcggagcccccggttctccaggaggcctggaggagatctttggctctctggattctctgcgcgaagagattgagcagatgagacgcccaaccggcacccaggactcacccgcccgcacgtgtcaagacctgaaactttgtcatcccgagctccctgatggggaatactgggtggatcctaatcaaggttgcgccagagacgccttccgcgtcttctgcaatttcactgctggcggggaaacatgtgtaactccaagagacgatgttacacagttctcatatgtggattcggaaggatctcccgttggcgtggtacagcttacgttcctccgacttctgagcgtatctgcgcatcaggacgtgagctacccatgctccggagcagcgcgggatgggccgctcaggctgagaggtgccaacgaggacgagctcagtcctgagacgtctccgtatgtcaaggagttcagggacggatgccaaacccagcagggacgaactgttcttgaggtgagaaccccagtgctggaacagctgccagttctggacgcgagctttagcgatctcggcgcccccccacgcagggggggagttttgcttggcccagtgtgttttatgggatag

SEQ ID NO: 4042 - DNA, 921 bp, Artificial Sequence
  Description of Artificial Sequence: Synthetic coding sequence
atggactggcgggccagcgaggcctggatggtgccccgggcccccaagggcgcttgggatcctcgagagagtcaggacctcctggacaaccgagccccattgggcccacgtgtgttccccggcccccgcgtgcctagtgccctcatggagaggcgagtactaaaggggagtcaagggtccccagcctgccctgggcctcctggagaggtcatccagcctcttcctatacagatgccaaaaaaaacacgcaggagcgtcgacggctcaaggctcatgcaggaggacgaagcaatcccaacgggaggagctccaggctcccccggtgggcttgaggagatatttggaagtctggactctctgcgggaagaaattgaacagatgagacggccaaccggtacccaggatagtccagcacggacatgccaggacctaaagttatgccacccggagctcccagacggggaatattgggtggacccaaatcaaggttgcgcaagagacgccttccgtgtgttctgcaacttcaccgctgggggtgagacctgcgtcacaccacgggatgacgtgacccagttttcgtacgtcgatagtgaaggctctcctgtgggggttgttcagttgactttcttgcggttattgtccgtgtcagcacaccaggacgtctcatatccttgttcaggggcagcgcgggacgggcctctacgactgagaggggccaatgaagatgagctcagccccgagacaagtccctatgttaaggagtttcgtgacgggtgccaaactcagcaggggaggacggttttggaggtccgtacccccgtgctggaacagctaccggtgctggacgcttctttcagtgatctaggcgctccgccgcgcagaggcggcgtattgctcggacccgtctgcttcatgggctag

SEQ ID NO: 4043 - DNA, 5133 bp, Artificial Sequence
  Description of Artificial Sequence: Synthetic coding sequence
atggagcggtgcagccggtgccaccggctgctgctgctgctgcccttagtactgggcctgtccgcagctccaggctgggcaggagccccaccagtagatgtgctgcgggccctgagatttccctctttgcccgacggcgtaaggcgggcaaaaggcatctgcccggccgacgtggcataccgggtcgccaggccagcccagctctctgctcccacacgtcagctgtttcccggaggttttcccaaagacttctcactgctcactgttgtcaggacacggccggggctgcaagccccactgttgaccctttactccgcccagggcgtacgacaactgggactggagctaggccgtccggtgcgcttcttgtatgaggaccagacaggcaggcctcaaccacccagccagccggtgttcaggggcctgtcattagctgatggtaaatggcatagagtggcagtggccgtgaagggacagtcagtgactttgatcgtggactgcaaaaaaagagtcacaagacccctgcccaggtccgcccgcccggttttggacacccacggtgttataatcttcggcgcgagaatcttagatgaggaggttttcgagggggatgtacaagaattggccattgtccctggtgttcaggctgcctatgagtcctgcgaacagaaagagctggaatgcgaaggcggccagcgagaaaggccgcaaaaccagcaacctcaccgtgcacaacggagtccccagcaacagccgtccagactgcacagaccccagaaccaagagccgcagagccaggacccgactccaggagaggaggaagaaatcttagaaagctcactcctgccccccctggaggaggagcagacggatcttcaggtgccaccaactgctgatcgctttcaggcagaggagtacggagagggggggacggacccccccgagggcccttacgattacacatatggatatggcgacgactatcgcgaggaaactgaactgggacccgctttgagcgcggagaccgcccactcaggcgcggcagcgcatggccccagaggccttaaaggagagaaaggggaaccagctgtactggaacccggcatgttagtggagggccccccagggcccgaggggccagccggacttattggacctcccggtatccaggggaatccaggtcctgtcggggaccccggggagaggggcccgcccggaagagctgggctgccagggtccgatggagcccctggaccccctgggacatctctgatgcttcccttcagatttggctcgggcggcggagataaaggaccggtcgttgcagcccaagaggcccaggcgcaggctatactccagcaggcacgcctcgcgctgagaggaccgcctggcccaatgggctacactggcagacctggcccacttggccagcctgggagccctggactcaagggtgaaagcggcgatctggggccccagggcccgcgcgggccgcagggattgaccggccccccaggcaaggcgggcaggcgaggtagagctggcgccgatggagccaggggaatgcctggagatcctggcgtaaagggtgatagggggttcgacggtcttccaggcctgcccggagagaagggccaccgaggcgacaccggagcccagggactccccggaccgccaggagaggatggcgagagaggtgacgacggcgaaattggcccaaggggactgcccggggaatctggccccagaggtctccttggaccaaagggaccgcctggaataccgggtcctccaggagtgaggggtatggacgggccgcagggaccaaaaggatctctgggccctcagggagagccaggcccccccggacagcagggcacacctgggacacagggcttaccaggaccacagggggcaatagggccgcacggtgagaagggcccccagggcaaacccggtctccctggcatgccggggtcagacgggccgccaggccatcctggaaaagagggccctccagggacaaagggcaaccagggaccctccggcccccaagggcccctgggatatccaggaccccgaggagttaagggggtcgacggtatcagaggactgaaagggcacaaaggcgagaagggggaggacggattccctggcttcaagggtgatattggggttaagggggaccggggggaagtcggcgtgcctggctcacgaggcgaagatgggccggaaggccctaagggcagaactggacccacaggagacccgggccccccaggactgatgggcgaaaagggcaagctcggggtgcccggcctgccaggttatccaggcaggcagggacctaaaggatctttaggctttcctggcttccccggggcatctggcgaaaaaggcgcccgaggcctttccggtaagagtgggccccggggagagagaggcccaaccggccctcgtggacagcgggggccaagaggtgctactgggaaatcaggggcaaagggcacctcaggtggtgatggcccccacggcccccctggggaaagaggcctcccagggccacagggccctaatgggttccctgggcccaaaggtcctctgggccctcccggaaaagacggacttccgggacaccccggtcagcgcggggaggtcggctttcaaggtaaaactgggccccctggccctcccggagtggtcggaccccagggagccgccggggaaactggtcccatgggtgagcgcgggcatcccggcccccctggtccgcccggagagcagggcctgccaggcaccgccggaaaagagggaactaagggggacccaggaccccctggtgcccctggaaaagatgggccggccggcctgagaggtttccccggtgagcggggcctgccgggcactgcaggaggcccagggctgaaaggaaatgagggcccctccggacctcctggccccgccgggtcccctggggagaggggagcagccgggtctggaggtcctattgggccccctggaagaccggggccacagggaccaccaggagccgccggagaaaagggagtgccgggagaaaagggacctattggaccaacaggaagagacggtgttcaggggcccgtcggcctgccaggtccggcggggcctccaggcgtggcaggggaggatggtgataagggtgaggtgggggaccctggacagaaagggacaaaaggcaacaagggggaacatgggccacccgggccccctggacctattggtcccgtgggtcagcctggcgccgctggagcagacggtgagcctggcgccaggggcccccagggacacttcggcgccaagggagatgagggaaccagaggattcaatggacctccgggacccatcggtctccagggattgcctggcccatctggtgagaaaggtgaaaccggagacgtgggccctatgggcccacctggcccccccggtccacgaggtcccgctggacccaatggggccgacggaccccaaggacctccaggcggtgtcggcaatctcggacctcctggtgaaaaaggagaaccaggtgagtccggatctcccggaattcagggcgaacctggagtgaagggccccaggggcgaacgcggggagaagggggagagcggtcagcctggggagcctgggccaccaggccccaagggacccactggcgatgatggccccaaagggaaccccgggccggtgggatttccaggggaccccgggccacctggagagggcggcccaagaggacaggacggggctaaaggggataggggggaagacggagagcctggccagcccggttcaccagggcccacgggtgagaacggtccgccagggcctctggggaaacgggggcctgctggctctcccgggagtgagggtaggcaggggggaaaaggcgcaaaaggcgaccctggtgccatcggggccccaggcaagacggggccagtaggacctgctggcccagccgggaagcccggccccgacggcctccggggattacccgggtcggttggacagcagggtagaccaggtgctaccgggcaagcaggaccgccaggacccgtcggaccacctggtctgccaggactgaggggtgacgccggcgccaaaggggaaaagggccatccgggtctaatcggactgatcggtcctcctggcgagcagggcgagaagggagacaggggcctgcccgggccgcaaggttctccgggacaaaagggagagatggggattcctggcgccagcggacccattggaccagggggtccaccaggactcccgggtccagccggcccaaaaggggcaaagggagctacaggtcccggaggacccaagggagaaaagggagttcagggcccaccaggtcatccaggacctcctggtgaggtgattcaaccactcccaatccagatgccaaagaagactcgaaggagcgttgacggttctcggctcatgcaagaggatgaagcaatcccaaccggcggcgcccctggctcgcctggcggccttgaggaaatatttggaagtctcgatagcttacgggaggagatcgagcaaatgcgccgtcccaccgggacgcaggattcccccgccaggacctgtcaggacctgaagctgtgtcaccccgagttaccagacggcgagtattgggtggaccctaaccaaggctgtgcccgcgacgcatttcgggtcttttgtaactttacagccggtggcgagacctgtgttacaccccgggatgacgttacacagttcagctatgtggatagtgaaggatctcctgtcggcgtggtgcagctcacttttcttcgattgctgtccgtgtcagcacaccaagacgtatcctacccctgctctggagctgctagagatggccccctgaggcttagaggggctaacgaggacgagctgtcccccgaaacgtccccctatgtgaaggagttcagagacgggtgtcagacccaacagggacgcacagtactcgaagtaagaacccccgtgctggaacagcttccagtgctggatgcttcattcagtgatttaggtgcccccccaagaagaggtggcgtccttctcggacccgtctgttttatgggttag

SEQ ID NO: 4044 - DNA, 5070 bp, Artificial Sequence
  Description of Artificial Sequence: Synthetic coding sequence
atggagcggtgcagccggtgccaccggctgctgctgctgctgcccctggtgctcggattgtctgctgcccccggatgggcaggcgcgccgccagtcgacgtgctgcgggccctgagatttccatcgctgcctgatggagtgcgacgcgcgaaaggaatttgtccagctgatgttgcctatcgtgtggccagaccagcacagctatctgcgccaactaggcaactgtttcccggcgggtttccaaaggacttcagcttgctcactgtcgttcggacaaggcctgggttgcaagcacccctgctgacgctgtactccgctcagggggtccggcaattgggcctcgagctcggccggccggtgcgctttctatacgaggatcagaccgggcgacctcagcctccatcgcagcccgtctttagggggctgagcctggcggacggcaaatggcaccgggtagccgtggccgtaaagggccagtctgtgaccctcatcgtggattgtaaaaaacgggtgactagaccgctgccccggagcgcgcggcctgtcctcgacacccacggcgttatcatctttggagccaggattttggacgaggaagttttcgagggagatgttcaggagctggccattgttcctggagtgcaggcagcttatgaaagctgtgaacagaaagagttagagtgcgagggcggtcaaagggaacggccccagaaccagcaaccacacagggcccaacgttctccccagcagcagccttctcgccttcatcgtccgcagaaccaggaaccccaatcacaggagcaaacagacctgcaagtaccacctacagccgatcgtttccaggccgaggagtatggcgaaggtggaacagatcccccagagggaccatacgactatacctacggatatggcgacgactaccgcgaagagaccgaactgggacctgcactctccgctgagaccgcacactccggggccgccgcccatgggccaagaggactaaaaggagaaaagggggagccagccgttctcgaacccgggatgctcgtggaaggacctcccggccctgagggtcccgccggcctcattggcccccctggaatccagggtaacccaggccctgtgggcgacccaggggagcgcgggccccctgggcgagccggactaccgggctctgacggagcgcccggaccacccggaacatccctgatgctccccttcagattcgggagcgggggcggcgataagggcccggtcgtggccgctcaagaagcccaggcccaggctattctgcagcaagctagattagctctgaggggccccccaggcccaatgggctacacaggtagacctggacctctcggacagccgggctcgcccggcctgaagggggagagcggggacttggggccccagggccccagaggaccccaggggctgaccggtcctccaggcaaggccggaagacgcggacgcgcaggagcggacggggccagggggatgcctggcgatcccggggttaagggagataggggttttgacgggttgcctggtctcccaggagagaaagggcaccggggggacactggggctcagggcctccccggacctcccggtgaggatggagaacgcggggatgacggagagattggtcctcgaggccttccgggagagagtggcccccgggggctcctcggccccaaaggcccccccggcatacccggtccacctggcgttagagggatggatggcccccaaggcccaaaaggttccttaggaccgcaaggcgagcccggaccgccaggtcagcagggcacccccggaacacaaggattacctggccctcagggggccattggacctcacggggagaagggccctcaaggaaaaccaggtctgcctgggatgcctggatctgatggaccgccagggcacccaggtaaggaaggccctccaggcaccaaaggtaaccaggggccatccggtccacaggggccacttggttatccgggccctaggggagtaaagggcgttgatggtatacggggcctgaagggtcataagggggagaagggcgaagacgggtttccgggcttcaaaggcgacatcggagtgaagggtgacaggggcgaagtgggtgtgccggggtcaagaggcgaagatgggccagagggacccaaggggcggaccggtcccacaggggaccctggaccgcctggactaatgggagaaaaaggaaagctcggggtacctggactcccaggatacccaggtaggcagggccccaaaggctctctcggctttccaggcttccccggtgcctccggcgaaaaaggcgcaagggggctgtcaggcaagagcgggcctagaggcgaacggggtcccaccggtcctcggggtcagagggggcctcgcggcgctaccgggaagagcggagcgaagggcacgagcggtggcgacgggccgcacggtccgccaggggaaagggggctaccaggccctcagggaccaaacggatttccaggaccgaaaggaccacccggtccccctgggaaagacgggctgcctggtcatcctggacagcggggagaagtagggttccagggcaagaccggcccaccaggaccccccggggtcgtcggccctcagggcgcggcaggagaaacgggccctatgggggagcgcgggcaccctggacccccaggacctcccggggaacagggcctcccgggcacagctggcaaggaggggacaaaaggagatccaggacccccaggcgctcccgggaaagacggacccgctggcctgcgaggattcccaggcgagcgaggtctgcccggaactgcgggcggtccagggctgaaaggcaatgaggggcccagcgggccccctggccctgccggctctcccggagagcgcggtgcagccggaagtggtggtcctatcggtcccccagggcgccccggcccccagggacccccgggagctgccggagagaagggggttcctggagaaaaggggcccattgggcccactgggcgagatggggtgcaggggccagtgggtttaccaggccccgctggtcctcctggcgtagccggcgaggacggagacaagggcgaggttggggatccagggcaaaaggggacaaaggggaacaaaggcgaacacgggccaccggggccccctggcccgatcggaccggtgggacagccgggcgcggccggcgcggacggcgaaccaggcgcgcgtggtccccagggacatttcggagctaagggtgatgaagggacgcgaggctttaatggtccccccggtccgatcggtttacagggccttcccgggccttctggggagaaaggcgagaccggcgatgtgggacccatgggccccccaggacctcccggcccgagaggacccgccggcccgaatggcgccgacgggcctcagggacctccgggcggagtggggaatctcggaccccctggggaaaagggtgagccaggggagtctgggtcccctggcatacagggggaacctggtgtcaagggcccacgcggagaaagaggagagaagggcgaaagcggccagcccggcgaaccaggtccgcctggccccaaaggcccgactggtgacgacggcccaaagggcaaccccggcccagttgggttcccaggtgaccccggcccgccgggggagggcggcccaaggggccaggacggtgcgaagggtgaccgcggcgaggacggtgaacccggccagccaggttctccaggacctactggcgaaaatggaccccccggtccgctgggtaagaggggcccagccggatcccctgggagcgaaggtaggcagggaggaaaaggtgccaaaggagatcctggtgccatcggggcccctgggaaaaccggccccgtcggacccgcgggacccgccggtaaacccgggcccgacggattaaggggcctgccaggttcggtcggacaacagggacgccctggagccactggccaggcaggtccccctggcccagtggggcctcccgggctcccaggtctcagaggtgacgccggcgcaaaaggtgagaaaggtcatcctgggctgattggcctgatcggtccacccggcgagcaaggagaaaagggggatcggggcctccccggccctcagggcagtcctgggcagaaaggcgagatgggaattccaggtgccagtgggcctatcggccctggcggtcctcccggactgcccgggcccgctgggcctaagggggcgaaaggcgcaaccgggcccggaggacctaagggagagaaaggagtacaagggcccccgggccacccgggccccccaggggaggtgattcaacccttgcctatccagatgccaaagaaaacaagacgtagcgtggatggcagccgtttgatgcaggaggacgaagccattccaacgggtggcgctccaggatcacccggaggcctggaagagatctttgggtctctcgactcactccgcgaggagatagaacaaatgcggcgcccaactggcactcaggacagccccgccagaacctgccaggatctgaaactctgtcacccagaactgccggatggtgagtattgggttgacccaaatcagggatgcgccagggacgcctttagagtattttgtaattttaccgccggtggcgaaacttgtgtgacaccacgcgatgatgtgactcagttttcttatgtggattccgaagggtctcctgtaggcgtggtccaactgacattcctgagattgctcagcgtgtcagctcaccaagacgtctcctatccttgctccggggcagctagggatggtccactgcgattacggggagcaaatgaggacgagttgtcccccgaaacctcaccttatgtgaaggaatttcgggacggatgccaaacacagcaagggaggaccgtgttggaggtccggactcccgtgctggagcagctgccggtgcttgacgcgagtttttcagacctcggagctccgccaagaagaggaggcgtacttctgggcccagtgtgtttcatggggtag

SEQ ID NO: 4045 - DNA, 4890 bp, Artificial Sequence
  Description of Artificial Sequence: Synthetic coding sequence
atggagcggtgcagccggtgccaccggctgctgctgctgctgccccttgtacttggcttgagcgcagcgcccggatgggcaggcgcaccaccagtggacgtgctgagagccttgagattcccatcactgcccgacggcgtgaggcgggcgaaaggcatctgtcctgcagacgtggcctatcgagtagcccgccctgcccagttgtctgcccccacacggcagctgtttcccggtggatttcctaaagacttttccttactgacagtcgttaggactaggccgggactccaggctccattattgaccctgtacagcgcccagggagttagacagctgggactggagctgggacggcctgttagattcctgtacgaagaccaaacaggccgcccccagcccccatctcagccagtctttcggggcctgagcctggctgacgggaagtggcatagagtagctgtggctgtgaaaggtcagtctgtgacgctgatcgttgactgtaaaaagcgcgtgacacgccccctgccaagaagtgcaagacccgtgttggacacgcacggggtgataatctttggcgctcgcatattggatgaagaggtcttcgaaggggatgtgcaggaattggcaatcgtacccggcgttcaggcagcttacgaaagctgcgaacagaaggaactggagtgtgaggggggacagcgcgagagaccccaaaaccagcagccccacagggcacagcgcagtccgcagcaacaaccatcgcgccttcacaggccccaaaatcaggaacctcagagtcaggctgcacatggccctcgaggactaaaaggagagaaaggggagcctgccgttctcgagccaggaatgctggtcgagggtcccccgggcccagaaggccccgctggcctgattggcccacctggcatccaagggaaccctggcccggtaggagatccaggcgaaagggggccccccgggcgcgcaggactcccaggctcggatggagctcctgggcctccgggtacctcacttatgttgccctttcgtttcggctccggtggtggcgataaaggtccggtagtcgctgctcaagaagcccaggcccaagccattttgcaacaagcaaggctggccctgcgagggccgccagggcccatgggatacacagggagaccaggacctctaggccagcctgggtccccaggtctgaagggagaaagtggcgatctggggcctcagggcccacggggaccccagggcctcaccggacctcctggtaaagcaggccgccgtggtcgcgctggggccgacggcgccagagggatgcctggagatcctggagtgaaaggtgacaggggattcgacggactgccagggctgccaggcgagaaaggccatcgtggagatactggcgcgcagggcttacccggccctcctggggaggacggcgagcgaggcgacgatggagagataggaccaagaggcctgcctggagaaagtggtccaagaggactgctgggtccaaaaggcccccctggcatacccggccctcccggcgtccgcggcatggatgggccccagggccccaagggctcccttggaccgcagggtgaacctggcccacctggtcagcagggtactcctggaacgcagggcttgcccggtcctcaaggcgccataggccctcatggagaaaagggtccacaaggtaaacctggtctacctgggatgcctggatctgacgggccgcccggtcatccaggaaaggaaggcccgccaggcaccaagggcaaccaggggccctcaggacctcagggaccccttggctaccccggtccccgcggcgtgaagggggtggatggcattcgcgggctcaaaggccataaaggcgaaaaaggcgaagacggattccccgggtttaaaggcgatatcggcgtgaagggggatcgaggcgaagtcggcgtgcccggtagccgcggtgaggacgggccagagggccctaaagggcggacaggacctaccggcgatcccggaccgccgggcctgatgggagaaaaaggcaagctaggcgtccccggacttccaggataccccggacgccaaggacccaagggaagccttgggtttccaggcttccccggcgcaagcggggagaaaggagcacgcggcctgtccggaaagagtggacctagaggggagcggggcccaaccggcccaaggggccaaaggggcccccggggggccactggcaaatctggcgccaaaggcactagtgggggcgacggaccacacggaccacccggagagagaggcttaccaggaccccagggaccaaacggcttcccaggacctaaagggcctccaggccctcccggcaaggatggactgcccgggcaccccgggcagcggggcgaagtgggctttcaggggaagaccggccctcccggtccacccggcgtggtggggcctcagggcgctgccggcgagactgggcctatgggggagagagggcaccccggaccacctggcccaccaggcgaacaggggctccccggaaccgcgggcaaggagggaacaaagggggaccctgggcctcctggcgctcctggaaaagacggacccgccggcctgcgtggttttccgggggagaggggtttgccagggactgcaggcggcccaggcttaaagggcaacgaaggtccctccggaccacccggaccggccggatctcctggggagaggggggccgcaggatcagggggccctatcggaccgccgggcagacccggcccccagggaccccctggggccgctggcgaaaaaggcgtgcccggggagaaggggcctatcgggccgacgggacgtgacggcgtgcaggggccagttgggctgccaggacctgcaggcccacctggggtggctggcgaggacggtgataagggcgaggtgggggatcccggacaaaaagggacgaaaggcaacaagggggagcatggaccaccaggcccgcctgggcccatcgggcccgttggtcagcctggcgctgccggagcggacggtgagccaggagctcgcgggcctcaaggtcactttggcgccaagggcgatgagggaacacgtggctttaacggtccccctggaccaattggactgcaaggcttgcccggaccttcaggcgaaaaaggcgaaactggcgacgtgggacccatgggaccccccgggccgcctgggccgaggggcccggcgggtccaaacggcgctgatggacctcaaggaccccctggcggcgtgggcaatctgggccctcccggggaaaaaggtgagccgggggaatctggttcacccggaatacagggcgaaccaggcgtcaagggtccccgaggagagagaggcgagaagggcgaatctggacagcccggagaaccaggtcctcctggacccaaagggccgaccggagatgacggacctaaggggaacccggggcccgtcggattccccggcgacccgggtcctccgggtgaggggggaccacggggccaggacggggcaaagggcgaccgaggcgaggacggagagcccggtcagccaggtagcccagggccgacaggggagaacggtccaccaggccccctcggaaaacgcggcccagccggcagcccaggaagtgagggacggcaagggggcaagggcgccaagggggatcccggggctattggggcccccggaaaaacaggacctgtgggccccgctggtccagccgggaaaccggggcctgatggactgcgtgggctgccaggctccgtggggcagcaaggtagacctggggcaaccgggcaagcgggtcctcccggccctgttggtcctcccggtctgcctggtctgagaggagacgccggcgccaagggcgaaaagggccaccctggccttattggccttatcggccctcccggtgaacagggagagaaaggagacagaggcctgcccgggccacaggggagtcccggtcaaaaaggcgaaatgggcattccaggcgccagcgggccgattggtcctggcggtcctcccggactgcctgggcctgcgggacctaagggagcgaaaggagccacaggaccagggggcccaaaaggagagaaaggggtccagggccctcccgggcatccaggtccacccggcgaagtgattcagccccttcctatccaaatgcccaaaaaaacacgccgcagcgtggatgggtcccgcctgatgcaggaggatgaggctatcccaacggggggggccccaggatcccctggagggctggaagaaatttttggctccctggatagcctgagggaggagatagagcagatgcgccgccctacgggcactcaggatagccccgcccgaacttgccaggacctcaagctctgccaccctgaactgccggacggggaatactgggtggatcctaatcagggctgcgcgagagacgccttccgagtgttctgcaattttactgctggtggtgaaacatgtgtgacccctcgtgatgacgtaacccagttttcctacgtcgactccgaagggtcacccgtcggagtcgtccagctgacctttttgagactactgtccgtttccgcacaccaggacgtgtcttacccctgtagcggggccgcacgcgacggtccactgcggctgagaggcgctaatgaagatgagctgagtccggagacgagcccctacgttaaggagttccgagacggctgccagacacagcaaggcagaactgtgctcgaggtgcgcacacctgttctcgagcagttgcctgtactagacgcctcctttagcgacctgggcgctcctccacgacgaggaggggtgcttcttggtccggtatgtttcatggggtag

SEQ ID NO: 4046 - DNA, 921 bp, Artificial Sequence
  Description of Artificial Sequence: Synthetic coding sequence
atggactggcgggccagcgaggcctggatggtgccccgggcccccaagggggcttgggacccccgggagtctcaggacctgctggataatagggccccactaggccccagagttttcccgggaccccgcgtgccaagtgcactaatggagcggcgtgttctgaaaggcagccagggcagccctgcctgtcccggtccccccggggaggtgattcagcctctgcccatacagatgccaaaaaagactcgccggtcagtggacgggtccaggctaatgcaggaggatgaggccatccctactgggggagcccccgggtcccccggtggtctagaagagatttttggatccctcgactccctgagggaagagattgagcaaatgaggcgccccacagggacacaggactcaccagcccgcacatgccaggacctgaagttgtgccatccggagctccccgatggcgaatactgggttgatcccaaccagggttgcgcgagagacgcctttagggtcttctgcaattttactgctggcggtgagacatgtgttacacctcgagatgatgtgacacagtttagttacgttgacagtgaagggtcgcccgtcggcgttgtccaactgacgtttctcaggttgctctcggtgagcgcccaccaggacgtgagctacccatgctcaggtgccgcccgagatggtcccctgaggttaaggggagccaatgaagatgaactgagccctgaaacatcaccgtatgtgaaggaattccgggatggctgtcaaacccagcaaggtaggaccgtcctggaagtcaggacacccgtcctagaacagcttccagtgctggatgcatccttttctgacctgggggcaccccccagaaggggaggcgtattgctgggacccgtttgctttatgggttag

SEQ ID NO: 4047 - DNA, 4968 bp, Artificial Sequence
  Description of Artificial Sequence: Synthetic coding sequence
atggagcggtgcagccggtgccaccggctgctgctgctgctgcccctggtgctgggcttgtcggccgctcccggatgggcgggagcccctcccgtagacgtgctgcgagccctgcgtttccctagtctgccagacggggtgcgccgcgctaaggggatttgtccagctgacgtggcgtatagggtggcgcggccagcccagcttagtgcccccacccgacagttgtttccgggtgggtttcccaaggacttctccctgctgaccgtcgtccggacccgacctggactccaagctccattgttgacactgtactctgcgcagggagtaagacagctgggcctagagctggggccccctgtgaggttcttgtacgaggatcaaaccggccgtccgcagcctccctctcagccggttttccggggactaagcctagcggatgggaagtggcacagagttgcagtcgcagtgaaggggcaatctgtgaccctgatcgtggattgtaaaaagcgggtcacccgccccctgcctaggagtgcccgccccgtgctggatacccatggcgttatcattttcggagcaaggatcctggatgaggaagtgttcgagggcgatgtacaggagctggcgattgttcctggtgttcaggcagcgtacgaaagttgtgagcagaaggaactcgaatgtgaaggtggtcagcgagagcggccccagaaccagcagccccaccgtgcacagcgaagcccccaacaacaaccctcccgtctgcacaggccccaaaatcaagagccacagtcccagccgacggagagtttatattacgactataagccgccctattacgacgtgatgacaaccggtactacacctgactatcaggcagcccacggcccccgcggactgaaaggagagaagggagaaccagccgtcctagaaccggggatgctggtggagggcccgccaggccccgagggccccgccgggctgataggaccccccggaatccagggaaatccagggcccgtgggcgatccaggcgagcgtgggccccccggtcgggctggcttaccgggaagcgatggggctccgggcccaccaggcactagtctgatgctgccctttagattcggctccggcggcggggacaaggggcccgttgtcgcggctcaggaagcacaggctcaggccatccttcagcaggcgagattggccctccgggggcccccagggcccatgggctacaccgggcggccaggtcccctaggacagcccggttcccccggcctcaagggggagtctggggatctcggaccacagggacctcggggcccccaggggttaacaggccctcccggaaaagcaggtcgcagaggaagggctggcgcagatggcgcccggggcatgccaggagacccaggggttaaaggagacagaggattcgatggcctgcctggcctgccaggggaaaaaggccatcggggcgacactggcgcgcaagggttgcccgggcctccaggggaagacggagaaagaggcgacgatggcgagattggcccgcgagggcttccaggggagtcaggtccgcgcgggctgctgggacctaagggcccaccaggaattcccggaccacctggggtgaggggcatggatggcccccagggacccaaggggagcctcggacctcaaggtgaaccagggcctcctggccagcagggcactcctggaacccaaggtttacccggaccacagggagcgatcgggccacatggtgagaaggggccacagggcaagccaggtctccctggaatgccaggttccgatggacctcccggacatccaggcaaagagggccctccagggacgaaaggcaaccagggccctagcggaccacaaggaccacttggttaccctggtcctagaggtgtgaagggggtggatggaatcaggggattaaagggccataaaggcgagaaaggagaggacggattccccggttttaagggcgacatcggcgtaaagggcgaccgaggagaggtcggcgtgcccggcagccggggagaagatgggcccgagggccccaagggtagaacaggacccaccggcgaccccggcccacctgggctgatgggcgagaaggggaagctgggagtccccggactccccggataccctggacgccagggccccaagggcagcttggggtttcctggttttcctggtgcctccggagagaaaggcgcccgaggcctatctggcaagagtgggccgaggggggagcgcgggcccacaggcccaaggggccagagagggccacggggagcgaccggaaaaagcggcgccaaaggcacttcaggaggcgatggaccacacggcccgccaggtgagcgtggactgcctggacctcaggggccgaatggtttccccgggcctaagggacctcctggtccacccggaaaggatggcctgcctggacacccaggacagagaggggaagtagggtttcagggaaaaaccggaccacctgggcccccaggagtggtcggcccccaaggagctgccggcgaaaccggccctatgggggagcgaggccatcctgggccccccggcccccccggcgagcagggcctgcccggcacagccgggaaggagggaaccaaaggcgaccccggtccccctggggccccaggtaaagatggcccggcgggtttgcgtggctttccgggagagagagggctacctggaaccgcagggggccccggccttaaaggaaacgaggggccctctggaccacccggacccgctgggagcccaggggaacggggagcagctgggagtggcggtccaattggcccgccaggaaggcctgggccacagggccccccaggggcagctggagagaagggagtacctggggaaaaaggccctatcggcccgaccggcagagatggagtacaaggacctgtgggcttacccggccctgctggacctcccggagtcgccggggaggacggagacaaaggagaggtgggagatcccggacagaagggcaccaaaggaaacaaaggcgaacacggccctcccgggcccccgggccccattgggcccgtgggacaacccggtgctgcaggagccgatggtgaacctggcgcccgtggtccccagggtcacttcggagcaaagggagatgagggtacaagaggctttaacggaccacccggtcctatcgggctgcaggggctccctggaccatcaggagaaaagggcgagaccggagatgttgggccgatgggtcccccagggcctcctggccctcgtgggccagctggtcccaatggagccgatggcccacagggaccacctggcggcgtgggcaatcttggtccacccggagaaaagggagagcctggagaatctggctctcccggaattcagggagaacccggcgtcaagggtccacggggtgagaggggtgaaaagggggaatcgggccagcccggggaaccgggtcctcccggcccgaagggccctactggagacgatggacctaagggcaaccccggccccgtaggtttccctggagatcctggaccccctggcgaagggggccccaggggtcaggatggagccaagggcgatcgcggggaagacggcgaacctgggcagccgggtagccctggcccgacgggggaaaatggcccccccggccctctgggaaaacgcgggcccgccggtagtccgggttcagaagggcgccagggcggtaaaggagccaagggcgatcccggtgccattggggctcctgggaaaactggtcctgtcggtcccgccggacccgccgggaagccaggaccggacggcctaagagggctaccaggcagtgtcggccagcaaggacggcccggagccactgggcaagctgggcctccgggaccggtaggccccccaggactgcctggactcaggggggacgcaggggcaaaaggagagaaagggcatcctgggctgataggtttgatcggacccccaggcgaacaaggagagaagggggaccgcggcctgcccggtccgcagggctctccgggtcagaagggtgaaatgggcatcccaggggcgtccggccccatcggtcccggcggtcctcccggactgcccggacctgcgggtcccaagggtgccaagggggccactggccccggcggtccaaagggcgagaagggcgtccaggggccccctggtcaccctgggccccctggggaagtcattcagccactccccatccaaatgcctaagaaaacaaggcgctctgtagacggaagccgactcatgcaggaggatgaagctatccctaccgggggagctcccggttcacccggaggattggaggaaatctttggcagcttggatagtttgcgtgaggaaatcgaacagatgcgccgcccaaccgggacccaggacagcccagcaaggacttgccaagaccttaagctctgtcacccagaattacccgatggtgaatactgggttgaccctaatcagggctgtgctcgtgatgccttcagagtgttctgcaattttaccgctggcggagagacctgcgtaacaccaagagatgacgtaacccagttctcgtatgtcgactcggaggggagcccagtaggggtcgtccagctgaccttccttcggcttctttcagtcagtgcacaccaggacgtgagctatccgtgctccggcgccgcaagagatggaccccttagactgagaggagcaaacgaggacgagctctctcccgagacaagcccatacgtcaaggagttcagagatggatgccagacacagcagggtcggaccgtgttggaggtaaggacaccggtcttagaacagctgcccgtcctggacgctagctttagcgaccttggggcgcccccacggcggggaggcgtcctgctcggccccgtgtgctttatgggatag

SEQ ID NO: 4048 - DNA, 5211 bp, Artificial Sequence
  Description of Artificial Sequence: Synthetic coding sequence
atggagcggtgcagccggtgccaccggctgctgctgctgctgcccttggtgttgggcctcagcgccgcccctgggtgggccggggctccaccagtagatgttctgagagcactgcggttcccatcgcttccggacggggtgaggcgggccaagggaatttgtcctgctgacgtagcctatcgggttgccagacctgctcaactgtctgcacctaccagacagctgttccccggaggcttccctaaggatttttcactgctcactgtcgttcggacaagacccgggttacaggctccactgctgacgttgtatagtgcacaaggcgtgagacagctgggcttagagctggggccacctgtgcggtttctgtatgaagatcagaccgggaggcctcaacccccatcccagcctgtctttagggggctgtctctagccgatggtaaatggcaccgggtggcagtcgccgtgaaggggcagagtgtgaccctcatcgttgattgtaaaaagcgagtgacccgtccacttccacgttccgcccgtccagtgctggatacacatggcgtaatcatctttggggcacggatccttgatgaagaggttttcgagggagacgtgcaagagctggccatagtaccgggggtccaagctgcctatgaatcctgtgagcagaaggagttggaatgtgaggggggacagagagagaggccccagaatcagcaaccacaccgggctcagcgctcccctcaacagcagccaagtagattacatagacctcagaatcaggaaccccagtctcagcctactgaatccctatactatgattataagcccccttactacgatgtgatgacaaccggaactacgcctgattaccaggaccccacacccggcgaagaggaagagatccttgagtcctccctgctgccacctctcgaggaggagcagacagatctccaggttccaccaaccgcagataggtttcaggccgaggagtacggcgagggtggcactgacccccctgaaggtccatatgattacacatacggttacggcgacgattatagggaggagacggagctgggtcctgccctctctgcagagaccgcacattcgggtgcagcagcccacgggccccggggacttaagggagagaagggtgagccagctgtcctggagcctggcatgctggttgaaggtccacccggacccgaaggccctgccggcctgatagggccacctgggattcaggggaatcccggacccgttggggaccctggagaaaggggcccacccggtagagccgggctgcccgggagcgatggggcccccggcccacccggaaccagtctgatgctgccgtttaggttcgggtctggcgggggagacaaagggcctgtggtggccgctcaggaggctcaagctcaggccatcttacagcaagcccgcctggctctgcgagggcccccaggacctatgggatatacgggacgtcctgggccactgggtcagcccggtagtcccgggctgaagggtgaaagtggggacctgggccctcaaggacctcgaggccctcaaggccttacggggcctcctgggaaagctgggcggcgtgggcgtgccggcgccgacggcgcaagggggatgcctggtgatcctggcgtgaaaggagacagagggttcgatggcttgccaggcttgccaggggagaaaggacacagaggtgatacaggtgcccagggactgccaggcccccctggagaggacggagagcgcggcgatgacggggaaatcgggcccaggggccttcctggagagtctggacccagagggctcctgggcccaaaagggcctccaggtatacccggtccaccgggcgtgcgcggcatggatggacctcagggtcccaaaggttccttagggcctcagggagagccgggacctccaggacagcagggaacacctggaactcaggggcttcccggccctcaaggggccattggcccgcacggagagaaggggccgcaaggaaaaccagggcttcctggcatgcccggaagtgatggtccacccggacaccctggcaaggaagggccaccaggtacaaaaggaaaccagggccctagtgggccacaaggaccattaggctatccgggtccccgtggtgtgaagggtgtggacgggattcgggggctcaaaggacataaaggtgaaaaaggtgaggatggctttccaggatttaagggcgatatcggcgtgaagggcgaccggggcgaggtcggtgtgccaggaagcagaggcgaagatgggcctgaggggcccaagggccgaactggtcctaccggcgacccaggcccacccggattgatgggcgaaaagggtaagcttggggttcctggtctaccaggttatcccggacgacagggcccaaagggaagtctgggctttcccggcttccccggcgcctctggtgagaagggagcacgaggactatccgggaaatcggggccaagaggggagcggggtcccaccggtccgcggggtcagcgcggaccgaggggagcaacaggtaagtcgggcgccaaaggcacaagtggcggagacggtcctcacggtccacccggagaacgagggctgccaggcccacagggtccgaacggatttcctggcccaaagggccctccaggcccgccagggaaagatggtctgcccggacaccccggccagaggggggaagtgggctttcagggcaagacgggaccgcccgggccgccaggagtggtgggccctcagggagctgctggagaaacggggcctatgggtgaaaggggccaccctggccccccagggccgcctggcgaacagggtttacccggcaccgctggtaaagaggggactaaaggggaccccggaccccccggcgcaccaggaaaggatgggcccgcgggattgaggggtttccccggcgagcggggactccctggcacggctggcggcccagggttgaagggcaacgaaggcccgtcgggcccccctggccccgccggctcacccggggagcgaggagctgccggcagtgggggccccatcggtccccccggcagaccaggtccccaggggccacccggggctgccggggagaagggagtgcccggcgagaagggacccattgggcctacaggccgcgacggggtgcaggggccggtgggcctccctggcccagcaggaccacccggggtagctggcgaagacggagataagggcgaggtcggcgaccccgggcaaaagggaacgaagggaaataagggggaacacggtcctcccggacctccagggcctattggcccagtgggtcagcctggtgcagcgggggctgatggtgagcctggcgccagaggacctcaaggccatttcggagctaagggtgacgagggcaccaggggattcaatggcccgcctggtcccatcgggttgcaggggcttcctgggccttcaggggaaaagggggagacaggggacgtgggccccatgggcccccccggcccgcccggacccaggggtcctgccggaccaaatggtgccgatggtcctcagggaccaccggggggcgtgggcaacttgggaccgccaggagaaaagggcgagccaggagagtcaggctcccctggaattcaaggcgagccaggagtcaagggtcctaggggtgagagaggggagaagggcgagagcggacagcctggcgaacccggacccccaggtccgaaaggccccacaggagacgatggtccaaagggaaatcccgggccggtcggctttcccggtgatcccggaccaccaggcgaggggggtccacgaggtcaggacggtgccaagggagaccggggcgaagacggcgaaccagggcagcctggtagccctggacccaccggcgaaaatggaccaccaggccccttggggaaaagaggaccagctggctctcccgggagcgaagggcgacagggtggcaagggtgctaagggagatccaggagccattggagctccaggaaaaacaggtccggtcggaccagctgggcctgctggcaaaccaggacctgacggactgcgtggactccctggatctgtcgggcagcagggtcgtccaggggccactggacaggccggcccacctggtcccgttgggccccctggccttcccggcctgagaggcgacgccggcgccaaaggagagaagggccatccgggcttgataggcctcattgggccgccaggagaacaaggcgagaaaggcgaccgtgggctccctggccctcaaggatccccaggccagaagggcgaaatgggaattccgggcgcatctggtcctattgggcccggcggacctccaggactcccaggtcctgcggggccaaaaggagccaagggcgctactggccctggtgggcccaaaggagagaaaggcgtgcaaggaccccccgggcaccctggaccaccaggtgaggtgatccaaccattaccaatccaaatgcccaagaaaacccgcaggtccgtggatggctcacggctgatgcaggaggacgaggcaattcccactggcggagctcccggttcccctggtggcctcgaagagatctttggctccctggattcccttagagaggaaatagaacagatgcggagacccacaggaactcaagacagcccagcaaggacttgccaagacctgaaattatgccacccagagttaccagatggcgagtactgggttgatcccaaccaaggctgcgctagagatgctttccgggtgttttgtaacttcacagctggtggtgagacatgcgtgacacctcgcgatgacgtcacacagtttagctatgtggattccgaggggagccctgttggagtggttcagctgaccttcctgcggctgctgagcgttagcgcgcaccaggatgtgtcttatccatgttccggcgctgcccgggacggtccactgaggttgaggggcgctaatgaagacgagctctccccagagaccagcccttatgtgaaggaatttcgcgatggttgccaaacccagcagggacgaacagtgcttgaggtaagaactcccgtactggagcagctaccggtgctggacgcctctttctctgacttaggcgcccctccccgccgcgggggcgtgctgctcgggccagtttgtttcatgggctag

SEQ ID NO: 4049 - DNA, 5148 bp, Artificial Sequence
  Description of Artificial Sequence: Synthetic coding sequence
atggagcggtgcagccggtgccaccggctgctgctgctgctgcccttggtcctggggctgagcgctgcccccgggtgggccggcgcaccacctgtggatgtgctccgtgcgctgaggttcccttcgctgcccgatggagtgaggcgcgctaaagggatctgccctgccgacgtggcctaccgagtcgctcgtcccgcccagctgagcgccccaactcgccagctcttccctgggggattccccaaggacttttcgctcttaactgttgttagaaccagaccgggactacaggcccccttgctaaccctgtattcggcacagggagttagacagctgggactggagcttggacgacccgtgcgtttcctttatgaggatcagactgggaggccacagcccccttcccagcctgtcttcaggggcctctcactggccgatggcaagtggcaccgggtcgccgtggctgtgaagggacagtcagtgaccctcatcgtggactgcaaaaagcgggtgacaagaccattgccaaggtcagctcgccctgtcctggatacccatggtgtgattattttcggcgcaagaatccttgacgaggaggtatttgagggggatgtgcaggagctggcaattgttcctggcgttcaggccgcatatgagtcatgcgaacaaaaagaactggaatgcgagggagggcaacgggaacggcctcagaatcagcagcctcatagggcacagcggtcccctcagcagcaaccctcccgtctgcatagaccccagaatcaggaacctcagtcccagccaacggagtctctgtactacgattatgaaccaccatattatgatgtaatgaccaccggaaccacccctgactatcaggaacagaccgacctacaagtcccacccaccgccgaccgattccaggccgaagagtatggggagggcggaacggaccccccggagggaccctacgactatacatacgggtatggcgacgattacagggaggagacagagctcggcccagccttgtctgccgaaaccgcccatagcggtgctgccgcacatgggcccaggggactcaagggcgaaaagggcgagcctgctgtgttggagcccgggatgcttgtggaaggcccccccggtcccgagggaccggcaggcttaatcggccctcccggcattcagggcaacccaggacccgtgggcgatcctggcgaacggggtccacccggtcgggctggcctgcctggctccgacggagctccaggccctcctggcacttcactcatgctccccttccgctttggtagcggcggaggtgacaaagggccagtggttgcggctcaggaggcacaggcacaggctatactgcaacaggcgaggttggcattacgcgggccacccggccccatgggttataccggtcggcctgggcctctgggacagcccgggtctcccggcctcaaaggagaatctggggatctgggaccacaagggcccagaggcccgcaaggactgacgggtccccctggtaaggcaggtaggcgtggacgggctggcgcggatggggctaggggcatgcccggcgatcccggcgtgaagggtgatcgcggtttcgatggcctgcccgggttaccaggcgagaaggggcatcgcggcgacaccggtgcccaggggctgcccgggccccctggcgaagacggagagcggggcgacgatggcgagatcggccctagaggcttacctggagaatcaggacctagaggcctcttaggccccaaagggccccccggcatacccggacctccaggtgtcaggggcatggatggcccgcaggggcctaagggcagcctagggcctcaaggagaacctggacctccaggtcagcagggtacgcccgggactcagggactgcccgggcctcagggggctatcgggcctcacggggagaaagggccacagggaaagccagggcttcccggaatgccaggcagtgatggtccccccggacatcctggcaaggaggggccgccgggaacaaaaggcaatcagggccctagtggtccccaggggccactgggctacccagggcccagaggggtgaaaggcgtggacggtatccgcggcctgaagggacacaagggagagaagggcgaagacggttttcctggtttcaagggagacatcggtgtgaagggcgataggggcgaggtaggcgttcccgggagccgcggagaggatggccccgaaggacctaagggacgcactggcccaacaggagaccccggaccacccggactcatgggcgagaaaggcaagctcggtgtgcctggccttcctggatatcctggccggcaagggccaaagggcagtttgggcttccctggtttcccaggagcttctggcgaaaaaggcgcacgggggttgtccggtaagagtggcccaaggggggagagaggccctaccggtccccgaggtcagcgaggccctaggggcgctactggaaaaagcggtgccaaaggcacttccggcggcgatgggcctcatggcccacccggtgaacggggtttaccaggaccacaagggccgaatgggtttccaggcccaaaggggcccccaggccccccaggcaaagacggcttgcccgggcatcctggccagcggggagaagtcggctttcaaggcaagacaggtccccctggccctccgggtgtggttggtccgcagggcgcggcaggcgagaccggacctatgggggagaggggacaccccggtccacccgggccaccgggggagcagggattacccggaactgcgggaaaggagggaaccaaaggggatccggggcctccgggtgcccccgggaaagacggccctgcgggccttcgtgggttccccggggaacgggggctgccaggaacagctggtggccctgggctgaaggggaacgagggaccatccggtccacctggtcccgccgggtctcctggagaaagaggtgccgccggatcgggtggacctattggccccccaggaagaccaggtccgcagggtcctccaggcgccgctggcgagaagggcgtgcccggtgaaaaaggccctattgggccaacgggccgcgacggggttcagggtcccgtgggtctgcctgggcccgccggcccaccaggcgtggcaggagaggatggtgacaagggtgaggtgggcgatcccggtcaaaaaggcacgaaaggtaacaaaggcgaacatggcccgcccggccctccaggccctattgggcctgttgggcagccaggagcagcaggcgccgatggtgaacctggagcacgaggtccccagggccacttcggcgctaagggggatgagggcacccgggggttcaatggcccgccaggcccaatcgggctacagggacttccgggacctagtggcgagaagggcgagactggggacgtgggcccaatgggcccccccggccccccgggacctaggggcccggccgggcccaacggcgcggatggcccccaggggcctcctggcggtgtgggcaacctggggcctcctggcgagaagggagagcctggggagtccggatctccaggcatccagggggagcccggcgtgaagggcccgcgcggagagcgtggcgaaaaaggcgagagcggacagccgggggagcctggcccccctggccctaagggccctactggtgacgatgggccaaagggtaaccccgggcccgtgggctttccgggcgatcctggcccccctggtgagggtggcccccgtggacaggatggagctaaaggagaccgcggcgaggatggggaacccggacaacccggaagtcctggccctacgggagaaaacggccccccgggacccctgggaaagcgcggaccagccgggtcaccaggtagtgaaggaaggcagggtggtaagggcgccaagggagaccctggagccattggagcccctggcaagacaggacccgtagggcctgcggggcctgcaggaaagccaggacccgatggccttcggggactacctgggtctgtcggccagcaggggaggccgggcgctactggacaagcaggcccaccgggcccggtcggaccacctggactcccaggcctccggggcgacgctggggcgaagggtgagaaagggcatcctggcctgatcggtctcatcggtcccccgggtgaacaaggggagaagggagacaggggcttgcctggtccacagggctcaccaggccagaaaggagaaatgggaattccaggcgcctctggccctatcggccctggtggacctccaggcttacctggacccgcaggacccaaaggagcgaagggcgccaccggacctggtggaccgaaaggtgagaagggcgtacaggggcctcccggacaccccggaccgcccggagaagtcattcagcccttgccaatccagatgccaaaaaagactaggagatccgtagacggatcccggcttatgcaagaagacgaggctattccaactggcggcgcgccaggatcacccggtgggcttgaggaaatctttggatccctcgacagtctgcgggaagagattgagcagatgagaagacccacgggcacacaggattccccggcgagaacatgtcaggatctgaagctatgtcaccctgaattacctgatggcgagtactgggtggacccaaatcagggatgtgcccgtgatgctttccgcgtcttctgcaactttacagctggaggcgaaacatgcgtgacccctcgcgatgacgtcacacaattttcatacgttgactcggaaggtagcccagtaggcgtcgtgcagctgacatttctccgtctgttgagcgtatctgctcaccaagatgtgtcctatccttgcagcggagccgcccgggacggtccactcagactccggggcgcaaatgaagatgagctgagtcccgagacgagcccatatgtaaaagaatttcgtgacggctgtcaaactcaacagggtcgaacagtcctggaggtgaggacacctgtcctggagcagctcccagtactcgatgcttctttcagcgatctcggagcccctccaaggaggggcggagtgctactcgggcctgtgtgcttcatgggctag

SEQ ID NO: 4050 - DNA, 4890 bp, Artificial Sequence
  Description of Artificial Sequence: Synthetic coding sequence
atggagcggtgcagccggtgccaccggctgctgctgctgctgccccttgtgctggggcttagcgctgctcccggatgggctggtgcccctcccgtagacgttcttcgcgctctgcggttcccctccttgcccgacggcgtgagacgcgctaaaggaatctgtcctgctgatgttgcctacagagtggccagacctgcccagcttagtgcaccaactcggcagctttttcccggaggattccccaaggacttctccttactcacagtggtgaggactaggccggggctgcaggctcctctactaactctttatagcgcacagggcgtcagacagttgggactcgagttgggccgacccgtccgattcttgtacgaggaccagactggtcgcccccagcccccttcccagccagtgtttcgcgggctgtccttagctgacggcaagtggcaccgggttgctgtggctgttaaaggccaaagcgtaactcttattgttgattgtaaaaagagggtaacccggcctcttcccagatccgcccggcccgtcctggacacccacggggtgatcatcttcggcgcgagaatcctagatgaggaagtcttcgaaggcgatgtccaggagctggccattgtcccaggggtgcaagccgcatatgaaagttgcgagcagaaggagttggagtgcgagggaggccagagagaaagaccccagaatcagcagcctcatcgcgcccaacgatctccacaacagcagccaagccgactgcatagaccccagaaccaggagccccagtctcaggctgctcatggcccccggggacttaagggcgagaagggagagcccgcagtgttagaaccgggtatgcttgtcgaggggcctccaggtccagagggacctgctggactaattgggcctccgggaattcagggtaatcccgggcctgtgggcgacccaggcgagagaggacccccaggaagggctgggcttccaggatcagacggcgcacctggccccccggggaccagcctgatgctgccattcaggtttggatcggggggcggtgataagggaccggtggttgccgcgcaagaagcccaggctcaagccatccttcagcaggcccgtcttgctctgaggggcccccctggtcccatgggatacaccggccgccccgggccactcggccagccaggcagtccaggactaaagggtgagtctggggacctcggccctcagggcccgcggggtccacagggactaacaggaccacccggcaaagcgggccggcggggacgagctggggcagacggcgcccgcggcatgccaggggatcccggggttaaaggtgaccgaggttttgatgggttgcccggtcttcccggagagaaagggcacaggggagacactggcgcgcaaggcctccctggcccacccggtgaagacggcgagcgaggtgatgacggcgagatcggaccaagagggctcccaggcgagagcggcccacgcgggctgctgggtcctaagggacctcctggcatacctggcccaccaggcgtgcgtgggatggacgggccacagggaccaaaagggtctctgggaccacagggggagcctggacctcctggacagcagggtacacccggaacacaggggttgccggggccacagggggctatcggcccccacggagaaaagggaccccaggggaaaccaggactcccagggatgccgggtagcgatggccccccaggacaccccggaaaggagggaccaccggggacaaagggtaaccaggggccttctggccctcagggacctctgggctaccccggcccacgtggcgtgaagggcgtagatgggatccgcggtcttaaagggcacaaaggggagaagggcgaagatggattcccggggtttaagggagatattggagtcaaaggagacagaggcgaagtgggggtgcctggttcaagaggagaggacgggccagaaggccccaagggacggacagggcccactggtgacccggggccccccggactgatgggagagaagggaaagctcggcgtccctggcctcccaggctaccctggcagacaaggtccaaagggtagtctgggttttcctggattccctggagcctcaggagaaaaaggcgccagaggcctgtccggaaagtctgggccccgaggagaacggggtcctaccggaccaagagggcaaaggggcccccgtggagcaaccggaaagagcggagccaaggggacatctggaggcgacgggcctcatggcccacccggagaaaggggcctccctggccctcagggaccaaacggtttccctggtcccaaagggccgctggggccccccggcaaagacggcttacctggccaccccgggcagcggggggaggtcggctttcagggaaagaccgggccccctggaccccccggtgtcgtcgggcctcagggggctgcgggggagactggaccaatgggagaacggggccatcctggaccccccgggccaccaggtgagcagggtttgccaggaacagccgggaaggaagggactaagggcgatccaggcccccccggggccccaggcaaggatggtcctgccggattgcggggattcccaggcgagcggggcctccctggcacagcaggggggccaggactgaagggcaatgagggcccatccgggccaccaggtccagccggatcacccggggagaggggcgctgctggtagcggagggcctatcggtccgcccgggcgaccgggccctcagggtcctccaggcgccgcaggcgaaaagggcgttcctggcgagaaggggcctataggacctactggcagagacggtgtgcaagggcctgttggcttacccgggcctgcagggcccccaggcgtggctggcgaagatggcgataaaggagaagtaggagatcctggccagaaaggcaccaagggcaacaaaggcgaacacggcccccccgggcctccaggccccattgggcccgtgggacaaccaggggctgccggggcagatggcgaacctggtgccagaggcccacagggccactttggtgctaaaggcgatgagggtacaaggggcttcaatggtccacccgggcctatcgggctgcagggactgccagggccctctggagaaaaaggcgagacaggggatgtgggtcctatgggccctcccggccccccgggtccacgtggcccagctggtcctaacggggccgacggcccacaaggaccacctggcggcgtggggaatctggggcccccaggagaaaaaggggaaccaggtgagtcagggtctcctggaatacagggggaacctggggtcaaggggccccgaggggagagaggagagaaaggcgaatcgggccagcctggtgaacctggtccaccggggcccaagggaccgactggggatgacgggccaaagggcaaccctgggcccgttggtttcccaggggaccccggccctccaggagaggggggtccgagaggccaagatggtgccaaaggggacaggggggaagatggtgaacccggccagcccggtagcccaggcccaaccggagaaaacggtccacccggcccattaggaaagcgcggaccagccggaagcccaggcagcgaaggacgtcaagggggcaagggggcgaagggagacccaggcgccattggagcccctgggaaaaccggtccagttgggccggcgggacctgcaggtaaaccaggccctgacggactccgcggactaccaggtagtgttggccaacagggcaggccgggagctaccggccaagctggccccccagggcctgtgggaccacctggcctgcccgggctccgcggcgatgcaggggccaaaggcgaaaagggacatccaggcttgatcgggctgattggtccacctggcgaacaaggagaaaagggtgaccgggggttgcccggtccccagggctctccaggccagaaaggggagatgggaatacccggcgcctccgggccaatcggccccggcgggccacccggtttacccgggccagcagggcccaagggagcaaaaggtgccacaggcccagggggtccaaagggagagaaaggcgtgcaaggaccgccagggcatccaggtccacccggggaggtgatccaaccgctgcctatacagatgcctaaaaaaacccgacgcagcgtggacgggtcccgactaatgcaagaagatgaagcgattccaacaggcggtgccccggggagtcccggaggcctggaagagattttcggttctctggactcgctcagagaggaaatcgagcagatgcgccgcccgactggtactcaggactctccagcccggacatgccaggacctcaagttatgtcatccagagcttccagatggagagtactgggtggaccctaaccagggctgcgctagagatgctttcagagtcttctgcaacttcactgctgggggggagacgtgtgtcacacctcgcgacgacgtaacgcagttcagctatgtggacagtgaagggagccctgtaggggttgttcagctcacatttcttaggctcctgagcgtaagtgcccatcaagacgtcagctatccgtgctcaggagctgcacgagacggccctcttaggctacgaggggccaatgaggacgagctgtccccagagaccagcccttacgttaaggagtttcgagacgggtgccagactcagcagggcagaaccgttctggaggtgcgcacccctgttctggaacagttacctgttcttgacgcttcattttcggatttaggtgcacctccacgcaggggaggcgtgttattggggccggtgtgtttcatgggctag

SEQ ID NO: 4051 - DNA, 921 bp, Artificial Sequence
  Description of Artificial Sequence: Synthetic coding sequence
atggactggcgggccagcgaggcctggatggtgccccgggcccccaagggcgcctgggatccacgcgagtcccaggatctcctcgataatcgtgctccccttggacctagggtgtttcctggacctcgagtacccagcgcgctgatggagaggagggtcttgaaggggtcacaaggctcacccgcctgcccaggtccccctggtgaggtcattcaaccgctgccaatccagatgccaaaaaagacacgccgctcagtagacgggagccgactgatgcaggaagacgaagccattcccacaggcggggctcctggttcaccaggggggctggaagagatcttcgggagccttgactcacttagggaagagatcgaacagatgcgaaggccaacaggtacacaggatagcccagctcgaacctgtcaagacctgaagctctgccatcccgagctgcctgacggagagtactgggtcgatccaaaccagggatgtgcccgtgacgcttttcgcgtgttttgcaattttaccgctggcggggagacatgcgtcacccccagggacgacgtcacacagttcagctatgtggactctgaagggagcccagtaggcgtggtgcaattaactttcctgaggctgctatccgtgagcgcacaccaggatgtatcctacccttgtagcggggccgccagggacggacctctgcggctgcgaggagccaacgaggatgagctcagcccggaaactagtccctacgtgaaagaattccgcgatggatgtcagacgcagcaagggaggaccgtgttggaggtcaggacccctgtgctggaacagttaccagtgttggatgcgtcgttttccgacctcggggctcccccaagacgcggcggagtattgctgggtccggtatgttttatgggatag

SEQ ID NO: 4052 - DNA, 4968 bp, Artificial Sequence
  Description of Artificial Sequence: Synthetic coding sequence
atggagcggtgcagccggtgccaccggctgctgctgctgctgcccctagtcctcggactgtcagctgcacccggatgggccggagctccccccgtcgacgtgctgcgcgctctacggttcccgagtctgcctgacggtgtgaggagggctaagggcatctgccccgctgacgtggcctacagagtggcccgacccgcccaactgtcagccccaacgaggcagctcttccccggcggctttcccaaagactttagtttgctgacagtggttcgcaccaggcccgggttacaggccccactgctgaccctgtattccgcgcagggtgtaagacagttggggctggaactgggtagaccagtcaggttcctgtacgaggaccagacgggaagacctcagccgcctagccagccagtgtttcgaggtctctccctggccgacgggaagtggcaccgggttgccgtggccgttaaaggtcagtcagtcaccttgatcgtcgattgcaaaaaaagagtgacccgccccctgccccgatcagcgagacctgtgctcgacacacatggcgttatcatattcggcgctcgtatccttgatgaggaagtgtttgagggtgatgtgcaggaattagcaattgttcccggagtgcaggctgcatatgaatcctgcgagcagaaagaattggagtgtgagggcgggcaaagggagaggcctcaaaaccaacagccccatagggctcaacgatctccccaacaacagccatcaaggctccatcgtccccaaaaccaggagccccaaagtcaacctacggagtctctgtattacgattatgagccaccgtattacgacgtgatgacgaccggcaccactcccgactaccaggcagcgcatggaccaaggggcctgaaaggcgagaaaggcgagcctgccgtcctggaacccgggatgttggtggaaggccccccgggtccggagggacctgccggcctcatcggcccccccggcatccagggtaatccaggccccgttggggaccccggcgaacgcgggccccctggcagagccggcctgccaggtagcgacggcgcccctggaccaccaggcacctctcttatgctcccatttagatttggctccggggggggcgataagggaccagtggtcgccgcccaggaggcccaggcccaagctatactccagcaagcacgtcttgcattgcgaggtccacctggccccatggggtataccggccggccaggaccactggggcagcctggaagtccaggcctgaagggtgagtcaggtgatctcggccctcaggggcctcggggtccacagggcctgacaggcccccccgggaaggccggccggcgtggtagggctggcgccgatggcgcccgcggaatgccaggtgaccctggagtaaaaggggatagaggattcgatgggcttcccggattgcccggcgagaaaggacacagaggcgacactggcgcccagggcctgcctgggcccccaggcgaggatggcgaacggggagacgacggcgagataggtccccgcggcctgcctggagagagtggtcctaggggcttactaggtccaaaagggcctcctgggattcccggcccaccaggggtgagagggatggacggcccccagggcccaaaaggctccctgggaccacaaggggagcccggtcctcccggtcagcaagggactccagggactcagggcctccctggacctcagggggccatagggccgcacggagaaaagggtccacagggcaaaccggggctgccagggatgccgggctctgatgggccaccaggccaccccggcaaggaaggtccacccggcaccaagggtaaccagggaccatcagggcctcagggtccactgggttatcccggccccaggggagttaagggagtggacgggattagaggcctgaagggccacaagggtgagaaaggcgaagatggctttcccggattcaaaggtgacataggcgttaagggcgatcggggggaggtcggagttcccggctcccggggtgaagatggtcctgaagggcctaaggggagaaccgggccaactggggatccgggtcctccaggcctgatgggcgagaagggcaaactgggtgttcccggactccctggctaccctggacgccaggggcctaaaggttccctggggtttcccggtttcccaggtgctagcggagagaaaggcgcccgcggtttgtccggaaagagtgggccccgtggggagagaggacctacaggtccccgggggcagagaggaccccgcggggccactggtaagtcaggagcgaagggtacatctggaggcgatggcccccacggcccacccggagagcgcggactgcctggcccccagggccccaacgggttccctggaccaaagggaccgccagggcctccaggcaaagacggactaccaggccacccggggcagcggggcgaggttggatttcagggtaaaactgggcctcccggcccccccggggtggtgggcccgcagggagcggctggggaaactggaccaatgggcgagcgcggacacccaggcccacccggcccccctggagaacaggggctgcctggaacggctgggaaagaaggtaccaagggcgacccaggtccccccggtgcccccggcaaggacgggcccgctggacttcgcgggttcccaggtgaaaggggcctgcctgggaccgccggaggtcctgggttgaaaggcaacgagggcccctctggcccacctggccctgccgggagccccggagagcgtggggcagctggctccggcgggccaattggcccccccggcaggccaggccctcagggaccccctggggccgctggtgagaagggcgtcccaggtgagaagggtccaattggaccaacaggaagggatggggtccagggacctgtgggactgccgggccccgccggcccaccaggggtagccggcgaagacggtgacaaaggggaggtgggagatccaggccagaaggggacgaaagggaataaaggcgaacatgggccaccaggtccacctggaccaattgggcccgtgggacagcctggagccgccggggccgatggggagcctggggcccgaggcccccaaggacacttcggggccaagggggacgagggtactcgcggattcaatgggcccccagggcccatcggtttacagggacttccggggccttccggcgaaaagggcgaaaccggcgacgtcgggcctatggggccacccggtccgccaggcccaagaggtcccgcagggcctaacggagccgacgggcctcagggcccaccaggcggagttgggaaccttggaccacctggcgaaaaaggggagcctggtgaatccgggtcgccaggtattcagggtgagcctggggttaaagggccaaggggcgagaggggggagaagggtgaatcaggtcagcccggggaacctgggccccctggcccgaaaggccccacgggagacgacggtcctaaagggaaccctggtcctgtgggcttccctggcgacccgggtccacctggcgaaggtggccccagaggccaggacggtgccaagggcgatagaggggaagacggtgagccaggccagcctggatctccgggcccaacaggggagaacggccctcccggtccgctgggcaaaaggggacccgcaggaagccctgggagcgaaggcagacaaggaggcaaaggtgccaagggcgacccaggtgcaataggggccccagggaagaccggtccagtaggcccagctggtccagctggtaagcctgggcctgatggcctgagaggcctgccagggagtgtgggccagcaagggcgccctggtgcgactggccaggcaggacctcctggccccgtgggccctccaggattacccggattgaggggcgacgccggagcaaaaggcgaaaaagggcatcctggcttaataggactgattggcccccctggtgagcagggtgagaagggggacagaggcttgcctggtccccaggggagtcctgggcagaagggggaaatgggtatccccggagctagcggtcccatcggaccgggcggcccccccggactcccaggcccagccggtccgaagggagctaagggagccacaggacccggcggacctaaaggagagaagggcgtccaaggacctcctggccatcccggcccacccggcgaagtcatacagcccctccctatacagatgcctaaaaagacccggagatccgtcgacggctcccggctcatgcaggaagatgaggccataccgaccgggggagccccagggtcccctggaggactggaggaaatttttggatctcttgatagtcttcgcgaggagattgaacagatgagaagaccaacgggtacacaggatagcccagcacgcacctgtcaggacctcaagctgtgccacccggaactgcctgatggagagtattgggtggatcccaatcagggttgtgcaagggacgcttttagggttttctgcaacttcactgccgggggcgagacatgcgtgactcccagggatgatgtgacgcagtttagctacgtggatagtgaggggtctcccgtgggggtcgttcagctgactttcctgcgactgttgtcagtgtcagctcaccaggacgtgtcatatccttgctctggcgccgcccgggacggccctctgagactcagaggggcgaacgaagacgagctgagtcctgagacatcaccttacgtgaaggaattccgggatggctgtcagacgcagcagggacggaccgtattagaggtgcggacaccagtgcttgaacaactacccgtgttagatgcttctttcagcgaccttggggcgcccccgaggcgcggcggagtgcttctcgggccagtgtgttttatggggtag

SEQ ID NO: 4053 - DNA, 921 bp, Artificial Sequence
  Description of Artificial Sequence: Synthetic coding sequence
atggactggcgggccagcgaggcctggatggtgccccgggcccccaagggcgcatgggacccacgggagagtcaggatctgctcgacaatagggcccccctcggaccgcgtgtgtttccgggcccccgcgttccttcagcgctgatggaacgcagggtgctgaagggctctcaggggagcccagcttgccctgggcctccaggagaggttatacagcctcttccaatacaaatgcccaagaaaaccaggagatctgtggacggaagtcgtctgatgcaggaggatgaggcaattcccaccgggggagctcccggctcgccagggggcttggaagagattttcggttccctggacagtttgcgggaggagatcgaacagatgaggcgccctactgggacccaagattcccccgccagaacatgtcaggacctgaaactctgccacccggagttgcccgacggggagtattgggtggacccaaaccaagggtgtgccagggacgcctttcgtgtgttttgtaacttcaccgccggcggtgagacatgcgtgactccgagagacgatgtgacccagtttagttacgttgactctgaaggtagtcccgtgggggtggtgcagctgactttcttgcggcttctgagtgtttccgcacaccaagatgtatcttatccgtgctctggcgcggctcgagatgggcctctgaggctgcgaggcgccaatgaggacgaattgagcccagagacgagcccatacgtgaaggagtttcgggacggatgccagactcaacaaggcagaacggtccttgaagtccgtacgcccgtgctggagcagttgccagtgctcgatgccagtttcagcgatctgggagcgcccccgagacgtggaggcgttttgctggggcctgtctgttttatggggtag

SEQ ID NO: 4054 - DNA, 5211 bp, Artificial Sequence
  Description of Artificial Sequence: Synthetic coding sequence
atggagcggtgcagccggtgccaccggctgctgctgctgctgcccctggtgctcggcctatctgcagcgcccggctgggctggcgccccacccgtggacgtgctgagagcattacggtttccttcacttcccgacggcgtgcggagagcaaagggcatttgtccggcagacgtggcctatcgggtggctcgccctgcccagcttagcgctccaacccggcagctatttcctggcggttttccaaaggacttttcgcttctcaccgtggttagaactaggccagggctgcaggcaccgctcctgacactgtactcggctcagggggtacggcaactgggcctggaactgggtcggcctgtccgcttcctgtacgaggaccaaaccggtcgacctcagccaccttcacagcctgtcttccgaggattgagcctcgcggacggaaaatggcatcgtgtcgctgttgccgtcaaaggccagtctgtgaccctcattgtggactgcaagaaaagggtaactcgacccctaccgcgtagcgcccggcccgtgcttgacacccacggtgtgatcatttttggggcaaggattttggatgaggaggtgttcgagggcgatgtccaggaactggctatcgttcctggagtgcaggccgcctacgagagttgcgaacaaaaggagctcgagtgcgaggggggacagcgcgagcgccctcagaatcaacagcctcatagggcgcagcgcagcccacagcagcagcccagccgtcttcaccgcccacagaaccaggagccccagtcacaaccaactgagtccctttactacgattatgagcccccatactatgatgtgatgaccactgggacgacccccgattatcaggatccaacacctggagaagaggaggaaattctggagagcagtctcctgccgcctctggaggaggaacagaccgatctacaagtgccgcctacggccgatcggttccaagctgaagaatatggcgaaggtggcaccgatcccccagaaggaccatatgattacacgtatggctatggggacgactatcgagaggaaaccgaactcggccctgccctttcagccgagacggcccattctggggccgccgcacacggtcccaggggtctcaagggggaaaagggtgaaccggcagtgctggaaccaggcatgctggtggagggaccgccaggacccgaaggtccagccggcttaatcggaccccctggcatacagggaaatccaggaccggttggagatcctggggagaggggcccccccggacgggcagggttaccggggtccgacggggcccccggtccgccaggcacatcccttatgctccctttccgtttcggttccgggggaggagataaaggccctgtggtggccgctcaggaggctcaagctcaggcaattctgcaacaggctaggctcgccttgcgaggtccacccggtcctatgggatatacaggcagaccaggccccctgggacagccagggagccccggacttaaaggtgaatctggagatctgggtcctcagggccctcggggcccccagggactgacgggcccacccggcaaggctggtagaagaggacgggccggagcagacggtgcccgggggatgcctggagaccctggcgtgaagggtgacaggggttttgacggactcccaggacttccaggggagaagggacacaggggcgataccggggcacagggccttccgggacctcccggagaggacggagagagaggcgatgatggcgagatcggccctcgaggccttcccggtgagagcggacctcggggcctcctcgggccaaagggcccaccaggaattcctggccctcctggagttagaggcatggacggtccccagggtcccaagggatctttgggaccccagggtgagccgggccccccaggacaacaaggaaccccaggcacccaaggattacctggcccacaaggggccatcggacctcacggtgagaaagggccccaagggaagcctggtttgcccgggatgccaggctcagacgggccccccgggcacccgggtaaggaagggcctcctggtaccaaaggcaaccaggggcccagcggtccccaggggcccttgggctatccgggtcccaggggggtcaagggggtcgacggaattcgcggcctaaaaggacataagggtgaaaaaggggaggacggctttcctggattcaaaggcgacatcggagttaaaggcgatagaggggaggtgggggttccagggtcccgaggcgaggacggcccggagggacccaagggccgaacggggcccacaggcgatcccggtcctccgggcctgatgggggagaagggaaagctaggcgtgcccggccttccaggctatcccggaaggcagggccccaaaggctctctgggcttcccagggttccccggggcatccggcgagaaaggcgcacggggcctcagcgggaaatccgggcctcgaggagagcgtggaccaaccgggccccggggccagcgagggcccaggggggccactgggaagtccggcgccaaggggacaagcggtggcgatggcccgcatgggccacccggtgagaggggcctaccgggcccccagggaccaaatggattccctggtcccaaaggcccacctggtccgccgggcaaggatgggctgccaggccacccgggtcaacgaggagaggtgggatttcaagggaagaccgggcctccagggcctcccggcgtggtgggtccccaaggagctgcaggcgaaactggccccatgggtgaaagggggcacccaggaccacccggaccccctggagaacagggactgcccgggaccgctgggaaggagggtactaagggcgaccccggtccacccggggcaccagggaaggacgggccagcaggcctccgaggctttccaggcgagcgggggcttccaggcaccgccggcgggcctggactcaagggtaacgaaggcccttccggcccccccggccctgccggatcccccggcgaaaggggggcagctggtagcggcggccctatcggaccacccggccgcccgggccctcagggaccccctggagccgcgggagagaaaggcgttcctggggagaagggccccatcgggcctacgggacgggacggcgtgcagggacccgtggggctcccaggcccggcaggcccccccggagtcgccggagaagacggggacaaaggtgaggtgggcgaccctggccagaaagggacgaaggggaataagggcgagcacggacccccgggcccgccagggcctatcgggccagttggtcaacccggggcggcgggggccgacggggaaccaggcgcccgaggtcctcaggggcacttcggagcgaaaggggacgaagggactcgaggcttcaacggcccccccggccctatcgggctgcaagggctccccggacccagcggggagaagggcgagactggggacgttgggccaatggggccccccggtcctccgggccctaggggccccgcaggcccaaatggcgctgatggtcctcaaggaccgccaggcggagtgggaaacctgggtccaccaggcgagaagggcgaacctggcgaatcaggtagccccggtatacaaggcgaaccaggcgtcaagggccctcgaggcgagcgcggtgagaaaggcgaaagcgggcaacctggggagcccggcccccccggcccgaagggccctacaggtgacgacggccccaaggggaaccctgggcctgtgggatttcctggcgaccctggcccccccggtgaaggaggtcctaggggacaggacggggcaaaaggggacagaggcgaggatggggaaccagggcagcctggaagccccgggcccacaggcgagaacggtcccccaggcccgcttggcaaacggggtccggccgggagcccagggtccgaaggtagacagggtgggaaaggcgcaaagggcgatccaggcgctattggagcccctggcaagaccggtcccgttggaccagcagggccggcaggcaaaccggggccagacgggcttcggggactccctggctctgtgggccagcagggcagacctggggccacaggtcaggcaggacctccaggcccagtcggacctccgggcctaccaggactccgcggagatgcaggggcgaagggagaaaaggggcatcccggtctgattggacttatcgggcctcccggagaacaaggtgagaagggagacaggggccttcctggcccccagggaagcccaggacagaagggggaaatgggcatcccaggcgcatccggaccgatcgggcctggtggtcctcccggactgcccggaccggcaggacccaaaggtgctaagggcgccacaggtcccggaggacctaagggagagaagggagtgcagggcccgccagggcaccctggtccgcccggtgaggtgatccagccactgccaattcagatgccaaagaaaactcggagaagtgttgatggaagtcgtctgatgcaggaggatgaggctattcccaccggtggagcccctggaagccctggaggactggaggaaatatttggctctctcgattcgctacgggaggagattgagcagatgcggagacccactggcactcaggactccccggcaagaacatgtcaggacctgaaactttgtcaccctgaattacctgacggggagtattgggtagaccctaaccaggggtgcgctcgggacgcttttagggtcttctgtaatttcaccgcagggggtgaaacctgcgtgaccccccgcgacgatgtgacacaattctcctacgtggacagtgaaggaagcccagtgggggtcgtgcagctaacatttctgcggctgctttcggtttctgcgcaccaggatgttagctacccttgcagcggcgcagctcgggatggcccattgcggttgcgaggggctaatgaggacgagctgagccccgagacttcgccatatgtgaaggaattccgagatgggtgtcagacacagcagggccgcactgtccttgaagtgcgcacacctgttctcgaacaactgccggtgttggacgcatccttttctgatcttggcgctccaccccggagaggcggagtactgctcggaccggtatgtttcatgggatag

SEQ ID NO: 4055 - DNA, 921 bp, Artificial Sequence
  Description of Artificial Sequence: Synthetic coding sequence
atggactggcgggccagcgaggcctggatggtgccccgggcccccaagggcgcctgggatccacgcgagtctcaggatctgctcgataaccgagctccgctgggccctcgagtttttcctgggcctagagtgccctctgcccttatggaaagaagagtccttaagggaagtcaaggatccccagcctgtccaggaccaccgggagaggtgatccagcccttaccaattcagatgcctaagaagacccgccggagcgtggacggctcacggcttatgcaggaggatgaggccataccaacaggcggggcacctggctctcctggcggactggaggaaatattcggaagccttgattcgttgcgggaggaaatcgaacaaatgcggaggcctacgggcacccaggattctccggccagaacctgccaggatttgaaactgtgccatccggagctgcctgatggtgagtactgggtcgatcccaatcagggttgcgctagagacgctttcagggttttttgcaactttaccgccggaggagagacatgcgttactccaagggatgacgtgacccagttttcttacgtggattccgagggttcccctgtaggtgtagtacagttgacctttctccgtttgctttcagtaagcgcacatcaggacgtgtcctacccatgcagcggagctgccagagatggccctttgaggctgcggggtgccaacgaggatgagctgtcgcctgaaaccagtccatatgtaaaagagttcagggacgggtgtcagacccaacaggggcgcacagtcctagaagttcgaacacccgtgttggaacagctgcctgtgctagacgcatcttttagcgacttgggggcaccccctcggagaggcggcgttcttctgggcccggtgtgtttcatggggtag

SEQ ID NO: 4056 - DNA, 5070 bp, Artificial Sequence
  Description of Artificial Sequence: Synthetic coding sequence
atggagcggtgcagccggtgccaccggctgctgctgctgctgcccttggttttagggttaagtgcggctccggggtgggctggtgcaccacctgtggatgtcctccgggctctgagattcccaagcttgcctgacggggtgaggcgcgccaaagggatctgcccagctgatgtggcctaccgcgtggcgcggcccgcccaattatccgctccgaccaggcagctgttcccagggggctttcctaaggatttcagtctcctaacagtggtgaggactaggcccggactccaggcccccctgctaacactttattccgcccagggcgtgaggcagctggggttggaactaggcaggcccgtaaggttcctctacgaggatcagacaggaagacctcaacctcctagtcagcctgtgtttagaggtctgtcactcgccgacggcaaatggcatagggtcgccgtggcggtgaaaggacaatctgttacactgattgtggattgtaagaagcgggttaccagaccactccctcgaagtgccagacccgtgttagacactcatggagtgatcatatttggcgctcgaattctggacgaggaggtgttcgagggggacgttcaggagctcgccatcgtgccgggagttcaggctgcttatgaatcgtgtgagcagaaagagctggaatgcgagggaggacagagggagcgccctcaaaaccagcagccacacagggcccaacgctcaccgcagcaacaaccatccagacttcacaggcctcagaatcaggaacctcaaagccaggagcaaactgacctccaggttcccccgaccgccgacagattccaggccgaggaatatggcgagggtggcacagacccacccgagggaccatatgattacacctacggttatggtgacgactatcgggaagaaaccgagctcggacccgctttaagcgccgagaccgcccatagtggcgccgccgcccacggaccacgcggactcaaaggcgaaaaaggcgaacccgcggtgttggagccagggatgctggtcgagggacctcctggacccgaaggtcccgcagggttgattgggccgccggggatccaaggaaatcccggcccagtgggggatcctggcgagaggggcccacccgggcgcgccggtctccctgggagcgacggagccccaggcccccctgggacctctctcatgttgccctttcggttcggtagtggcgggggtgacaaaggccccgtcgttgctgcccaggaagcccaggctcaggcaattctgcagcaggccaggcttgcgctgagaggcccccctgggcccatgggctatactggtagacctgggcctttgggccaacctggttcacccgggttgaagggtgaatcaggagatttaggaccccaaggaccccgggggcctcaaggcctcaccggcccaccaggcaaagcagggaggaggggaagagctggtgctgacggagcacggggcatgccaggcgaccctggcgttaaaggggatagaggattcgacgggctgcccggactgccgggagagaaggggcacagaggagacacaggcgctcagggacttcccggtcctccaggggaggacggcgagaggggtgacgacggagagatcggtccgcgtgggttgccaggtgaatctggcccccggggcctgcttggtcctaagggccccccaggaattcccgggcctccaggagttaggggaatggatgggcctcagggtccaaaggggtctctcggcccgcagggcgaaccaggcccacctggtcaacaaggaacacctgggactcagggactaccaggaccccaaggggccattggtcctcacggtgagaagggccctcagggcaagcctggcctccctggtatgcctggtagcgatggcccgccagggcatcccggcaaggagggtcctcccggtactaaaggcaaccagggcccgtccggcccgcaagggccactcgggtatccaggcccaagaggggttaagggagtggacggcatacgtggcctgaagggccataaaggggagaaaggagaggacggcttcccgggcttcaagggggacatcggagtcaaaggcgatagaggcgaggtaggggtgcctggatcccggggggaggatggccctgaggggcctaaggggcggactggccctacaggtgacccgggaccgcccggtctcatgggagaaaaagggaaactgggagttccagggctcccaggctaccctggtaggcagggcccaaagggatcacttggcttccctggctttcccggggcttcaggtgagaagggggcacggggcctgtcaggcaaatccggcccacggggcgaacgggggcccactggaccacggggacaacgggggccccgtggggctacaggcaagtctggcgcaaaagggacatcagggggggacgggccacacggtcctccaggggaaaggggactgccaggtcctcaaggacccaatggcttccccggacccaaaggaccacccggcccgcccgggaaagacggcctgcccggccatccgggacagagaggggaagtgggattccagggcaagacgggcccccccgggcctcccggcgttgtgggacctcaaggcgctgctggggaaacaggcccaatgggtgaaagaggacacccaggtccccctgggcctccgggagaacaaggtctgcctggcaccgccggaaaggaggggaccaagggggaccctgggccccctggcgctcctgggaaggatggcccggcgggcctgcggggattccctggtgaaagggggctgcccgggactgcgggcggcccaggacttaaggggaatgaaggacctagcggaccacctggacccgctggatctccaggcgaaagaggggccgccggcagtggaggcccgatcgggcctcccggaagacccggtccacaggggcccccaggcgccgcgggtgagaagggcgttcctggggagaagggcccaataggtcccaccggacgggatggggtgcaaggacccgtgggtctgcctgggccagctgggcctccgggagtcgctggagaggacggggataagggagaggtgggtgacccgggccagaagggcaccaaaggcaataagggggagcatggccccccaggccccccaggacctatcggccccgtggggcaacccggtgctgccggagcagatggcgagcctggggcgagaggcccccagggtcatttcggcgctaagggggatgaggggacacgcgggttcaatggcccgcccggacctatcgggctccaagggcttcctggtccttcaggagaaaagggggagactggtgatgtgggacccatggggccccctggccctccaggtccacgcggacccgcgggcccaaacggtgcagacggtccacagggccctcccgggggcgtcggcaacctgggccctcctggcgagaagggcgaacccggggaatcgggctccccggggatacagggcgaaccgggcgtgaagggaccacggggcgagcgcggcgaaaagggcgaaagcgggcagccaggagaacccggacccccaggccccaaaggaccgacaggcgacgacggccctaaagggaaccccggcccagtgggctttccgggcgatcccgggccccccggagaaggaggcccccgcggccaggacggcgcaaagggtgacagaggagaagatggtgaacctggccagcccggaagtccaggtccgacaggagaaaacgggcctccaggccctttagggaagagagggccagctggtagccctggaagcgagggaaggcaagggggaaagggggccaagggcgacccaggtgccattggcgcacctggcaaaaccggccctgtggggccagctggccctgccggtaagcctggccctgatgggctacgagggctacctggaagcgttggccaacagggcaggcccggagccactggacaggccggacctcctggacctgtcgggcctccgggactgcccggactgcggggcgacgccggcgccaagggggaaaagggccatcccggtctgatcggcctgatcgggcctccgggggaacaaggcgagaaaggcgacaggggcttaccaggcccacaggggagccctgggcagaaaggcgagatgggcatacctggagcttcgggacccattggacctggagggccacccggcttgcccggccctgccggccctaagggggctaaaggagccactggtccagggggaccgaaaggggagaaaggcgttcagggaccacctggtcacccaggaccaccaggagaagtcattcaacctctgcctatccagatgcctaaaaagacccgtcgaagtgtcgacggttccagactgatgcaggaggacgaggcaatacccacaggcggtgcccctggtagccccggtggcttggaggaaatattcggctctcttgattctctgcgggaggaaattgagcagatgagaagacccaccgggacgcaggatagccccgctcggacatgtcaagatttaaagctttgtcacccagaattgccagatggagaatactgggtggaccccaatcagggttgcgccagagacgcttttagggtgttttgcaacttcaccgctggcggggaaacttgcgtcacccctcgcgacgatgtaactcaatttagttatgtggattcagaggggagcccagtgggagtggtgcagctcacctttctgcggctcctttccgttagtgcccaccaggatgtgtcatatccctgctcaggcgccgcgagggacggacctttaaggctgcgtggagccaacgaggatgaattgtctccggagacctccccttatgtaaaagaatttagggacgggtgccagacacaacagggtaggacagttctggaggtaagaacccctgtcctggagcagcttcccgtgctcgatgcctcattctccgatctgggggcacccccccggcgaggaggggtgttattaggaccggtgtgtttcatggggtag

SEQ ID NO: 4057 - DNA, 4890 bp, Artificial Sequence
  Description of Artificial Sequence: Synthetic coding sequence
atggagcggtgcagccggtgccaccggctgctgctgctgctgcccctcgtcttgggcctgtctgctgccccagggtgggcaggagcaccacctgttgacgtgttacgagccctgagatttccaagcctgccagatggcgttaggagagccaaagggatttgtcccgccgatgtcgcctatcgcgtggctcgcccagctcaattgtcagctcctactcgccaactgtttccaggtggttttcccaaagacttctccctactaaccgtggttcggacccggcccggactgcaagcacctctcctcacgctctactcggcccagggagtgaggcagctgggcttggaactcggacctcctgtccgcttcctgtatgaggaccagaccggccggcctcagccaccctctcagcccgtgttccgcggtttgagtctggctgacggaaaatggcaccgcgttgcggtggcggtaaaaggccagagcgtgaccttgatcgtagactgtaagaagcgggtcacccggcccctcccccggagtgcacgtccggtcttggacacacacggtgtcattatatttggcgcaagaattctcgatgaggaagtatttgagggggatgtgcaggagctcgctatagtacccggagtgcaagcagcgtacgaaagctgcgagcaaaaagaacttgaatgcgaagggggtcagcgggagcgcccacagaaccagcagccccatagagctcagagaagtcctcagcaacaaccgtcgagactccatagaccacaaaaccaggagcctcagtcgcaggccgctcacggcccacgagggctgaaaggcgaaaaaggagaacctgctgtactagaaccggggatgcttgtggaaggcccgcctggccctgagggtcctgctggattgatcggtccccctggcattcaagggaaccctggtccggtgggagatccaggcgagcgcggtccaccagggagggccgggctaccaggttctgacggcgcacccggaccccccggaacatctctcatgctgccatttcgtttcggatcaggaggcggggataaaggacctgttgtggccgcacaggaggcgcaggcccaagcgatccttcagcaagcccgactcgctctcagaggtccaccgggccccatggggtacacagggaggcctggcccacttggccaacctggcagccccgggttgaaaggcgaaagtggagacttgggcccacaggggcccaggggcccacaggggttgaccggcccccctggtaaagccggcaggcgcgggagagccggagccgacggagccaggggaatgcccggggatcccggagtcaaaggcgacagaggattcgacggcttaccggggttgcccggcgaaaaaggacaccgcggtgatactggcgcacagggccttcccggcccaccaggagaggacggagaaagaggagatgacggagaaatcgggccgcggggacttcccggcgagtctggcccacggggtctgttggggccgaagggcccacctgggattcctgggcctcctggggttcgggggatggacggtcctcaaggcccaaaaggcagtcttgggccccaaggtgagccaggtccgcccggccagcagggtacaccgggaactcagggcctgcccggaccccagggggcaattgggccccatggcgagaagggcccgcagggcaaacccggtctgccaggcatgccaggttctgatggtccacctggacatcccggcaaggagggaccccctggaacaaaggggaaccagggcccaagcggccctcagggccccttgggctaccctggaccaagaggggttaaaggcgtggacggaatacgtggcttaaaaggccacaagggggagaagggcgaggatgggtttcctggattcaaaggagatatcggcgtgaaaggcgacagaggtgaggtcggagtgcctggtagcaggggcgaggatggccccgagggccccaaaggtaggacgggacccactggcgatccagggccaccgggactaatgggcgaaaaaggtaaacttggcgtacctggcctgcctggatatccgggtcgacagggtcccaaagggtccctaggctttcctggattcccgggtgcaagcggagaaaaaggcgctagaggtttgtctggcaaatccggacctaggggtgagagggggcctaccggcccccggggacagcggggtccacgaggtgccacaggaaagtctggcgccaagggcacctcggggggggacggacctcatggcccaccaggagagcgggggctgccagggccccagggccccaatggctttcctggaccaaaggggcctcctgggccccctggcaaggatgggctccctgggcatccaggacagcggggcgaggtcggattccagggcaagactggccctcccggtccacccggcgtggtgggaccgcagggcgctgccggcgagaccgggccaatgggtgagcgcggccacccagggccgccaggccctcccggagagcaagggctgccaggcaccgccggaaaagaagggactaagggagaccctggcccgcctggcgcccctggtaaagatggacctgcaggactccggggattccccggcgaacgtggtctgcccgggactgcgggcggcccgggcctgaaaggcaacgagggacccagcggcccacccgggcctgctggttctcccggggaaaggggggcagccggaagtgggggcccaattggaccccctggtaggcccgggccccagggaccacccggagccgctggggagaaaggagtacctggcgagaaaggtcccatcggtccaacggggagagatggtgtccagggtccagtaggactgcccggtccagcagggcctcccggggtcgctggcgaggacggggataaaggagaggtaggcgatcccggccaaaaagggacaaagggtaacaagggggagcatggccccccggggccgcctgggcccatcggtccagtaggccaacccggggccgctggggcagacggcgagcccggggcaagaggcccacaaggccatttcggcgccaaaggcgacgagggtactcgtggctttaatggcccgcctggccccatcggcctgcaagggctgcctggtccaagcggcgagaaaggagaaaccggggatgttggcccgatgggaccccctggaccccccggaccccgagggcccgcaggccctaatggcgcagatgggccccaggggccacccggtggagtgggaaacctcggaccaccaggcgaaaagggggagccgggagagagcgggagcccaggaatccaaggtgaacctggtgtcaaagggccacggggggagcgtggtgaaaagggggagtcaggtcagcctggggagcccggcccccctggacctaagggaccaaccggcgacgatgggccaaagggcaatccggggcctgttggattccccggggatcccggccctcccggggaggggggcccccgcggacaggatggagctaaaggtgaccgtggggaggatggcgagccaggtcagccaggttccccggggcctactggggaaaacggcccacccgggcctctaggcaagcgggggccagccggtagtccaggaagcgaagggaggcaaggaggaaaaggagctaaaggcgaccccggggctattggggcgcccggtaaaactggtcctgttggacccgctggcccagctggcaagcccggccctgacggtttgagaggcttgccgggaagcgtcggacagcaggggcggcccggggccactggccaggccggaccacctggacccgtcggccctccaggtctccccgggttacgcggcgacgccggtgccaagggggagaagggacacccgggattgatcggtctgataggcccccctggagagcagggggagaagggagatcgtggcctgcctgggccgcagggctcaccaggacaaaagggtgagatggggattcccggcgctagcggcccaatcggcccaggcggacccccgggtctgcctggcccagcaggcccaaagggagctaaaggcgctacaggacctgggggtcctaaaggcgagaaaggtgtgcagggtcctccagggcacccaggacctcctggcgaggtgatccagccacttcctatccaaatgcccaaaaaaacaagacgctctgttgatggcagtcgccttatgcaggaagacgaggcaatccccactgggggagcaccaggctcaccgggtggcctggaggaaattttcggatccctggactcccttagggaggaaatcgaacaaatgagaagaccgaccgggacacaggattcacccgccaggacatgccaagaccttaagctatgccaccccgagctcccagacggggagtattgggtggacccaaaccagggttgtgctcgagacgcttttcgagttttctgcaactttaccgccgggggcgaaacgtgcgtcacacccagagacgatgttacccagttctcatatgtggactccgagggatcccctgtgggggtggtacaactgacctttctgagactgttgagcgtctcagcacaccaagacgtgtcctatccatgttccggtgctgcgagagacggaccgctgcgcctgaggggggctaatgaagacgagctttcacccgaaacgagcccctatgtcaaggagttccgcgatggctgccagacacagcagggaaggacagtcctggaggtacggacccctgtattggagcagctaccggttctcgacgcgagcttcagcgacctaggagcccccccacgtcgaggaggggtcctcctcggccctgtgtgcttcatggggtag

SEQ ID NO: 4058 - DNA, 4890 bp, Artificial Sequence
  Description of Artificial Sequence: Synthetic coding sequence
atggagcggtgcagccggtgccaccggctgctgctgctgctgcccctggtacttgggttgtccgcagctcccggatgggcaggcgctccccctgtggatgttcttcgcgcccttagattcccatcattgcctgatggagtcagaagggcgaagggcatttgccccgccgacgtggcttacagagttgcgaggcctgcccagcttagcgctcctacacgccaattattccctggtggattccctaaggacttttcactgctcacggtggtccgcacccgcccagggctgcaagccccgctgttgaccttgtattcagctcagggcgttcgtcagttgggattggagctcggcaggcctgtccggtttctctatgaggaccagactggccggccgcagccaccttcacagccagtctttcgagggctctccctagcagatggtaagtggcaccgcgtggctgtggcagtcaagggccagtctgtcaccctcatcgtggactgcaaaaagcgggtgacccgtccgctcccccggagtgcccggccggtgctggacacccacggagtgattatttttggggcccgtattctggatgaggaggtgtttgagggcgacgtgcaggaactggccatcgtgccaggcgtgcaggcggcatatgaatcttgcgagcagaaggagctggagtgcgagggcggccagagagaacggccacagaaccagcaaccgcacagagcccagcgctcgcctcagcagcaaccttctcgcctgcaccgtcctcagaaccaggagccccagagtcaagccgctcacgggcctaggggactgaaaggcgaaaaaggtgaacctgccgtgcttgagcctggcatgctggtggaaggtcctcctgggcctgagggccctgcaggcctgatcggaccgccaggtatccagggaaatccgggcccagtcggggatcctggagagagaggacccccgggtagggcaggactgcccggcagcgacggggcaccaggtccgcctggaactagtctcatgcttccctttcgttttggctctggcggaggagataagggtccggtcgtagccgcccaagaagcgcaggcccaagcgatcctccagcaggcccggctcgccctcaggggacccccaggacccatgggatataccggccgccccgggcccctgggccagcccggatctcctgggttgaaaggcgagtcaggggacctgggaccccagggccctcggggaccccagggccttacagggcccccaggcaaagctgggagacgtggcagggcaggcgccgatggcgcaagaggcatgcctggagaccccggcgtcaagggtgaccgtggcttcgatggcctccccggacttcccggcgagaagggccatcgaggggacaccggcgcccagggccttcccggcccgccaggagaagatggggaacgcggggacgatggagagataggacctcgcggactgcccggagaatctggtccacgcggcctgctcgggcctaaggggccaccaggcatccctggccctcccggggtccgggggatggacgggccccaggggcctaaaggatctctgggtccacagggcgagcctgggccacctggccagcaaggcacaccagggacacaagggctgccaggtccccagggcgccattgggcctcacggtgagaagggcccacaaggtaagcccggactgcccggcatgcctggatctgatggacccccagggcaccccggcaaggaggggcctcctggaacaaaggggaatcagggccccagcggaccgcaagggcctctggggtatccaggtccgagaggagtcaagggggttgacgggatccgtggcctcaaaggacataagggggaaaagggagaagacggcttccctggtttcaagggggacatcggagtgaagggagaccgcggggaggttggagtccccggctctagaggggaggacgggccagagggtccgaagggtcgcacaggaccaacaggcgatcctggtcctcccgggctgatgggggagaaagggaagctgggggtccctggactgccaggctatcccggtaggcagggtcctaagggttcgctggggttcccagggttccctggcgcctccggcgagaaaggcgctcggggcctatcaggtaagagtggccctaggggtgagagagggccaactggaccgcgaggccagagaggcccgaggggagcaacaggaaagtctggggccaagggaacaagcggcggcgacgggcctcacggccctccaggcgagagggggctgcccggtccccagggtcccaatggatttcctggtcctaaaggcccacctggtcctcccggaaaggatggacttccaggccatcccggccagcgtggagaggtaggatttcaggggaaaaccgggcctccggggcctcctggcgtcgtgggaccccaaggcgcagcgggagaaacagggccaatgggcgagcgcgggcatccaggaccccctggcccgcccggggaacagggcctacccgggactgctggaaaagagggtaccaaaggggacccaggccctcccggcgcccctggtaaggacggcccagctggactccgtggatttcccggcgagcggggactgcctggcaccgctggcgggccaggccttaagggtaacgaggggccaagcgggccgcccggtccagcaggcagcccaggagaaagaggcgccgctgggagcgggggacctattgggccgcctggtaggccaggtccgcaaggaccccccggcgcggctggagaaaagggcgtgcctggcgagaaaggcccaatcgggccaaccggccgcgatggagtacaggggcccgtcggtctacccggtcccgccgggcctcccggggtggctggcgaggacggtgataagggagaggtgggcgacccaggacagaaaggcaccaagggaaacaagggcgaacacggaccacccggtcctccaggcccaatcggacctgtgggtcagcccggcgctgccggggccgacggtgagcctggcgcccgcggaccccaaggacacttcggggcaaaaggagacgaaggaacacgggggttcaatgggccccccggccccattggcctgcagggcctcccgggcccctctggcgagaagggggagaccggggatgttggccctatgggtccgcctgggcctcctggtccaaggggccctgcgggtcctaacggggccgatggaccccagggcccgcctgggggtgtaggaaatctcggcccaccgggggagaaaggagagcccggtgagagcggctctcccggcatccagggtgagccaggggtcaaagggccacggggcgagaggggggagaagggtgagagcgggcaacccggggagcctggaccacctggtcccaagggcccgacgggcgatgacggcccaaaggggaatccagggcccgttggcttccctggcgaccccggccctccaggggagggcgggcccagaggacaggacggagcgaaaggggatagaggcgaggacggggaacccggccagcccggcagtcctggtcccaccggtgaaaacggcccccccgggccgctcggtaagcgcgggccggccgggtcacctggcagtgaggggcggcaaggaggcaagggcgccaagggcgatcccggggctatcggggcacccgggaaaactggtcctgtcggacctgccggcccagctggcaagcccggacctgatggtctgaggggcctgcctggctccgttggccagcaaggaaggcccggcgccacaggccaggcaggcccaccagggcctgttggacctcctgggctacccggcttgcggggtgacgccggggccaagggcgagaagggtcatcccgggctgatcggtttaatcgggccccccggggaacaaggcgaaaaaggtgataggggcttgcctggacctcaaggcagccccgggcagaagggggaaatgggaatccccggggcttcgggacccatcggtcccgggggccctcctggtctccccgggcccgccggtcccaagggggcgaagggtgccaccggtccaggtggccccaaaggggaaaaaggggtgcagggtcctcctggtcaccccggcccccccggcgaggtgatccagccacttcctattcagatgcctaagaagacccgccggtccgtggacggctccaggctgatgcaggaagacgaagccatacctaccgggggcgctcctgggtctcccggaggactggaagagatctttgggtctctggatagcctgcgcgaggagattgaacagatgcgccggccgacggggacacaggatagccccgcaagaacttgccaggatctcaagctgtgccaccctgagttgccagatggggagtattgggtggatcccaaccaagggtgtgcacgcgacgcctttagggtgttttgcaatttcactgcgggtggagagacatgtgtaactcccagagacgatgtcacccagttttcatacgtagattctgaggggagtcccgtaggggttgtgcagcttacttttttgcgactcctctctgtcagcgcccatcaggacgtgagctacccatgttcaggagctgcgagagatggacctctgcgactccgaggtgccaatgaggatgaactctcccctgaaacttctccatatgtgaaggaattccgggatgggtgccaaacacagcagggacgcacagtgctggaggtgcggactcccgtcctagagcagttacctgtactcgatgcatcgttctcggacctaggggcccctcctcgccgtgggggcgtgttgctaggtcctgtgtgttttatggggtag

SEQ ID NO: 4059 - DNA, 5133 bp, Artificial Sequence
  Description of Artificial Sequence: Synthetic coding sequence
atggagcggtgcagccggtgccaccggctgctgctgctgctgcccctggtgctggggctctccgcagcacctggttgggctggggctcccccggtcgatgtcttgcgtgcgctccggttccccagcctcccagatggggtgcgccgagccaagggaatctgtcctgcagacgtcgcttacagagtggcaaggcctgcccaactgtctgccccgacaagacagctgttccctggcggttttcccaaggacttcagcctgctcacagtggttagaacgcgtccaggcctgcaggcacccctcctcactttgtactctgcgcagggcgtccgccagctcggactcgagcttggtcgccccgtgagattcctgtatgaagatcaaactggccgtcctcaaccaccttcccaacccgttttccggggattgagtctggctgacggtaagtggcacagagtagccgtggccgtcaaaggccagagcgtgacattaattgttgactgcaagaagcgcgtaactcgacctttaccaagaagcgcacggcccgtactcgatacgcacggggtgataatattcggagcccggattctggatgaggaagtgtttgagggcgacgtccaggagttagcgatcgtgcctggcgtccaggccgcttatgaatcctgtgagcagaaggaactcgaatgcgaaggaggtcaacgagaaaggccccaaaaccaacagcctcaccgcgcacagcgctctccacagcagcagcctagtcgactgcaccgccctcagaatcaggagccccagtcccaagaccccacccccggcgaggaggaggagattttggagtcatctctgcttcccccccttgaggaggaacaaactgacctacaggtgcctccaacagccgaccgattccaggcggaagagtacggcgaggggggtactgatccccccgaggggccttatgattacacatatggctacggagacgattatagagaagagacagagcttggacccgccctgagcgcggagacagcccattccggcgcagccgctcatggcccccggggacttaagggcgagaaaggggagcccgctgtccttgagccgggtatgcttgtggagggccctcctggtccggaggggccagccggtctgatcggcccacccggtattcaggggaatccagggcctgtgggcgatccaggcgagcgcggccctcccggacgcgctgggctccccggatctgacggtgcacccggcccacccggaacaagcctcatgttaccgtttagattcggttccggcggcggcgataagggacccgtcgttgcagcgcaggaggcccaggcccaggccatcctccagcaggcacgactcgcccttagaggcccccccgggcccatgggctacaccgggcgcccaggacctctgggacagcccggcagccctggcctaaagggggaatctggagacctgggaccgcaaggccctcgggggccacagggattgacaggaccccccgggaaggccggtcgacggggacgcgctggcgctgatggagctcgcgggatgcctggcgaccccggcgtcaaaggagatagaggatttgacggcttgccagggcttccaggcgagaaggggcaccggggagacactggggctcaaggcctgccaggcccacccggtgaggacggagagagaggagacgacggcgaaattgggcctcgtggtctgcccggtgaatctgggcccaggggtctcctgggccctaaaggcccacccggaattccgggaccacctggcgttcgcggtatggacgggccccaggggccgaaaggaagtctgggaccacagggagagcctggacccccagggcaacaggggacacctggtacccaaggtttgcccggtccacaaggcgccatcggcccccacggtgagaaaggccctcagggcaagcccggactaccaggaatgcctggctccgatgggcccccaggccatccggggaaggaggggcctccggggactaaaggcaaccaggggccctcaggccctcaagggccactgggttaccccggacccaggggggttaagggcgtagatggaattcgaggtctgaaaggccataagggtgagaagggtgaggacgggtttcctggctttaagggcgacatcggtgtgaaaggcgacagaggggaggtgggtgttcctggctcccgaggagaagatggccccgaaggcccgaaggggaggactggccccacaggcgacccgggcccgcctggacttatgggcgagaaaggaaagctgggcgtacctggtctccctggctatcctggccggcagggacctaaaggctcactgggatttccgggttttcctggggctagtggtgagaagggtgcgagaggcctgagcggcaaaagcggaccaaggggtgagagaggaccaactggcccccgggggcagagggggccacggggtgcaaccgggaaaagcggcgccaagggaactagtggtggcgacgggccccacggtcctccgggcgaaaggggcctgccaggcccacagggtccgaacggttttccaggcccaaaaggcccgcctggccctccaggaaaagacggactaccaggtcaccctggacagcggggtgaggtcgggttccaggggaagacagggcctcccggtccccccggcgtggtgggccctcaaggcgctgccggagaaactggacccatgggcgagcgagggcaccctggtcctccagggccacccggagaacagggattgcctggcacagctggcaaagagggaaccaagggggatccaggcccaccaggagcccccggcaaggatggccccgccgggctgcgcggattccccggagagaggggtctgcccggtaccgcaggaggaccaggtctcaagggcaatgagggccctagcgggcctcccggccctgcaggctcacctggggagcggggcgctgcaggctcagggggacctatcggccctcctggaagaccaggaccacaggggcctcctggcgcggcaggcgaaaaaggtgtgcccggagaaaagggccccataggacccacggggagagacggagtgcagggtccagtgggcttgccgggaccagccggacctcccggggttgctggagaagacggggacaaaggtgaagttggcgacccaggacaaaaggggactaagggcaataaaggtgaacatggaccccccgggcctcctgggccaattggtccagttggccaaccaggggccgctggcgccgacggagagccaggggctagaggccctcagggccacttcggcgcgaaaggcgacgaaggtactagaggcttcaacggacctccagggcccattggcctgcaaggactgcccggacctagcggcgagaagggagaaaccggagacgtaggcccgatggggccacctggcccccccggtccccgggggccagcaggcccaaacggcgctgatggaccacagggcccccctggtggcgttggaaatcttggccctcctggcgagaaaggggagccaggcgaatccggatctcccgggatccaaggtgaaccaggggttaaaggaccgagaggggagagaggagagaagggagagtcgggccagcctggagagccaggaccccctgggcctaagggccccactggcgacgatggccctaagggaaatccaggccccgttggatttccaggtgatccagggcctcctggcgagggtgggcctagaggccaggacggggccaagggtgatagaggcgaggatggtgaacctggccagccaggaagtcctggacccacaggggagaacggaccacccgggccacttggaaagaggggacctgccggcagccccgggagcgaaggtagacaaggcggcaaaggagctaaaggcgatcccggagctattggcgctcctgggaagaccggcccagttggtccagccggcccagccggtaaacctggaccagacggactccgcggccttcctggaagcgtaggccaacagggtagaccaggcgccaccgggcaggctggcccccccggaccagtcggaccacccggacttcccggcctcaggggcgatgctggagctaagggggaaaaaggacaccccggtcttattgggctaattgggccccccggtgagcagggagaaaagggggatcgcggtctgcccgggcctcaaggctcccctggacagaagggggaaatgggtattccgggggcctccggcccgattggccctgggggccctcccggattgccaggccccgccggacccaagggggccaagggggccactggtcctggaggtcccaagggagagaaaggcgtgcagggtccacccggacatcccggacccccaggggaagtgatccagccattgcctattcagatgccaaaaaagaccaggcgttcagtagacgggtcacgtctgatgcaagaagacgaggccattccgactggtggagctccaggcagcccaggaggtctggaggaaatttttgggagcctcgactccctccgggaggagatagagcagatgaggcgtccaaccggcacccaggactcccccgctaggacctgccaggatctgaaactctgtcatcctgaactgccagatggcgagtattgggttgaccctaatcagggttgtgcacgggacgcattccgcgtgttctgtaatttcaccgccggcggcgaaacttgtgtcacaccgcgcgatgatgttacgcagttcagctacgtcgatagcgagggctccccggtaggtgttgtgcagctaacatttctccggcttctgtctgtcagcgctcaccaagacgtgtcatacccctgttcaggcgcagcgcgcgatggtcctttgcgcctcaggggcgcgaacgaggacgagctcagtccagagacttctccatatgtaaaagagtttagagatggatgccagacccagcagggccgaaccgtgctggaagttagaacacccgttctggagcagctgcctgttttggatgcaagcttttcagaccttggtgcacctccaagacgaggcggggttttgctgggtcccgtttgcttcatgggctag

SEQ ID NO: 4060 - DNA, 5148 bp, Artificial Sequence
  Description of Artificial Sequence: Synthetic coding sequence
atggagcggtgcagccggtgccaccggctgctgctgctgctgccccttgtgctcggtcttagtgccgctccaggatgggccggcgccccacccgtggatgttttgcgcgccctcaggttcccatctttgccggacggtgtccggagggccaaggggatctgccccgctgacgttgcctaccgcgtggctagaccggctcagctcagcgcccctaccagacaactgtttccaggggggtttcccaaggacttcagcctcctcactgttgtaaggacccgacccggacttcaggcacccttgttaactttgtactccgctcaaggtgtaagacagctgggactcgagctgggaagaccggtgcggtttttgtacgaagatcaaaccggccgaccccaaccccctagccaacccgtattccggggtttgagcctggctgacgggaaatggcaccgcgtggccgtcgcggtaaaggggcagagtgtaacactgattgttgactgtaagaagcgcgtgactcgcccgcttcctcgaagtgcccggcccgtacttgatacacacggagttattatttttggtgctaggatcctggacgaggaggtgtttgaaggcgatgtgcaagaactggctatcgttcccggggtgcaggctgcatacgagtcttgtgagcaaaaggaacttgagtgtgaaggcggtcaaagggagagaccgcagaaccaacagccacaccgggcacagcggagtcctcaacagcagccctcaagattgcacaggccccagaatcaggagcctcagagccagcctaccgaatctctttactatgactacaagccgccttattacgatgtcatgaccaccggcacaacccctgactatcaggagcagaccgacttacaggtcccgcccactgcggataggttccaagcggaggagtacggcgaggggggcacagatcctcccgagggtccctatgactacacttacggttatggagacgattacagggaagagacggagttaggcccggccctgtcagctgagaccgctcactcaggagccgccgcacatgggccccggggactgaagggagagaagggtgagccagcggtgctggagcctggcatgctcgtggaggggccccccgggccagaggggcccgcgggtttgattggcccacccggcattcaaggcaatccaggccctgttggggatccaggggaaaggggaccgccaggaagggctggacttcctggcagtgacggggctcctggccccccgggaacaagccttatgctgccattccggttcgggtccggcgggggagataaagggccagtggtggcagcacaggaagcacaggcccaggctatcctacagcaggccagactggctcttcgtggcccacccggtccaatggggtacacaggacggccaggacctctcggccagcccggctctcccggcctcaaaggagagtcaggagacctgggcccacagggcccaaggggcccccaggggctcacaggacctccaggaaaagctgggcggcgggggcgggcgggcgcagacggagccagaggcatgcccggcgatcccggcgtgaagggagacagaggcttcgatggtctccccggcctgccaggggagaagggccatagaggcgatacgggtgcacagggactgcccggacctcccggcgaggacggggagcgcggggacgacggggagattgggccccgcggacttccaggagaatctgggcccagaggccttctgggaccaaaaggcccaccaggcataccggggcctcctggtgtcagggggatggatggtccacagggccccaaggggtcactgggtccccagggggaacctgggccacccggacagcaaggcactcccggtacacagggtttgccaggcccccagggcgccatcgggccgcatggggagaaggggccacagggaaaacctggcctccctgggatgccaggaagcgacggtcctccaggccatcctggcaaggagggcccacccggaaccaagggcaatcaaggaccaagcgggccgcaaggccccctggggtatcccggaccccgcggagtgaagggcgtggatggcatcaggggcttgaagggtcacaaaggtgaaaagggtgaggatgggtttcccggatttaagggtgatatcggcgtgaaaggagatcgtggagaggtcggggtgcctgggtcccgcggtgaagatggtccagaagggccaaagggtagaactggccctactggagacccagggccaccagggctaatgggtgagaagggcaagctgggtgtgccaggtctccccggctatccgggccggcagggcccaaaggggtcattaggatttcctgggttccctggcgcctcaggagaaaaaggagctcgaggccttagtgggaagtctgggccccgtggcgagcggggccccaccggccctcgagggcagcgcggcccccgcggggctacagggaaatccggcgccaagggtacatcaggcggagacggtccgcacgggccacccggagagcgtggactccccgggccccaagggccaaacggttttcccggacctaagggcccgcccggacctcctggaaaagacggcttacctggccaccccgggcagaggggtgaagtgggcttccagggcaaaacaggtccccctggcccccccggcgtcgtaggaccccagggggccgctggggaaacagggcccatgggcgagcgcggccatcccgggcccccgggacctcctggtgagcaggggctgcctggcacggctggaaaagaaggtacaaagggagatcctgggccaccgggagcgcccgggaaagatggcccagcgggcttgcggggtttccctggggaacgagggctgccaggcacagccggggggcctggattgaagggcaacgaagggcccagcgggcccccaggccctgcgggctcccccggagagaggggagccgctggttccggcggccccattgggccacccggacgaccaggccctcaaggcccgccaggggcagctggggaaaaaggcgtgccgggggagaaaggcccaatcgggcctactggacgcgacggggtccagggtcctgtgggcctgcctggacccgctggcccacccggtgttgctggcgaggatggtgataagggagaagttggcgatcccggtcagaaaggcactaaagggaataagggcgagcatgggcctcctggccccccagggcctatcgggcccgtggggcagccaggcgccgccggcgccgacggagagccaggcgcaaggggcccccaaggccatttcggtgccaagggagacgaagggacgagggggttcaacgggccaccagggcccatcggtctacagggcttgccagggcctagtggtgagaaaggtgaaaccggggacgtcggaccaatggggccacccggtccacctggtcccagaggcccagcggggccaaatggggcagatggccctcaaggcccccccgggggagttggaaatctcgggcctcccggtgagaagggtgagcctggcgaatctggaagtcccgggatccaaggagagcccggcgtcaaaggacctcggggcgagcgcggcgaaaaaggcgagagcggccagcccggagagccgggcccccccggaccaaaaggtccaaccggcgatgacggccctaagggtaaccccgggcctgttggatttcccggcgaccccggcccacctggcgagggcgggcctaggggccaggatggcgccaaaggggatcggggagaggatggagaacccggacagccagggtcccccggtccaactggagaaaatggaccgcctggacccctgggtaagcgcggccctgcaggcagtccgggtagcgagggcagacaggggggtaagggggccaagggtgaccctggggccatcggagcacctggaaaaaccggtccggtggggcccgcaggacctgccggaaaacctggaccagatggcttacgcggcttgccgggaagtgtgggccagcagggcaggccaggcgcgaccggccaggcaggaccccccggacctgtggggccccctggattacctgggctccgaggagacgccggggctaagggagagaaagggcatccaggactgatcggattgatcggaccgcccggcgagcagggcgagaagggagaccggggcttacctgggcctcagggatctcccggacagaaaggagaaatgggaattccaggtgccagtggccctatcgggcccggtggccctcccggtttaccaggacccgcaggacctaagggcgcaaagggcgctactgggccaggagggcctaaaggagagaagggagtccagggaccgccagggcaccccggacccccaggtgaggtcattcagcccctgccaatccaaatgcctaagaagacccgtagatccgttgacggttctagactgatgcaagaagacgaggctattcccaccggtggggcccctggatcacctggaggtctggaggaaatttttggaagtctcgactcccttagggaggagatcgagcagatgaggcgacctacaggtactcaagactcccccgctcgcacctgccaggacctgaagttgtgtcaccccgagttacccgatggtgagtactgggtggatcccaatcaggggtgtgcacgggacgccttccgagtgttttgcaacttcaccgccggaggcgaaacctgcgttacccctagggatgacgtcactcagttctcctacgtggatagcgaagggtccccggtgggcgtggtacagttgacatttttgcggctactttccgtctccgcacaccaagacgtgtcgtatccttgcagtggagccgcaagagacggcccgttacgcctcagaggagctaatgaagatgaactgagtccagaaacatcaccctacgtgaaagaattccgagatggatgccaaacacagcagggacggactgtgctcgaagtgcggacccctgttctggaacagctacctgtgctggatgcctccttctcagatctgggcgcgcctccgcgccgggggggtgttcttcttgggcccgtgtgtttcatgggctag

SEQ ID NO: 4061 - DNA, 5148 bp, Artificial Sequence
  Description of Artificial Sequence: Synthetic coding sequence
atggagcggtgcagccggtgccaccggctgctgctgctgctgcccctcgtcctgggtctgtctgcagcccccggctgggcgggagctccacctgttgacgtattacgagcccttcgcttcccctccctccctgacggagtacggcgtgctaagggcatatgccctgctgatgttgcctaccgggtagcccggcccgcccagctgtctgccccaacacgtcagctgttcccaggcggatttcctaaggacttcagtctcctgacggtggttcgcacacgccctggcttgcaggctccgttgctaacactctattctgcccaaggagtacggcaactcggcctggagcttgggccccccgtgcggtttctatacgaagaccagacgggtcgaccgcagcctccatctcagccagtttttcggggcctgagtctcgccgatggcaagtggcacagggtggcggttgctgttaagggacagagcgtgaccctgattgtggattgcaagaagagagtgacacggccacttcctcggtccgcacgcccagtcctggatacccacggcgtgatcatcttcggggccagaattctcgacgaggaagtgttcgaaggggatgtgcaggagctagcgatcgtgccaggcgtgcaggccgcttacgaaagttgcgagcagaaagagttggagtgcgagggtggacagagagagcgcccccagaatcagcagccccaccgtgctcaaaggagtccccagcaacagccctctaggctgcaccggccccagaaccaggagccgcagagccagccgactgaaagtctgtactatgattacaagcccccctactatgacgtgatgactacaggaaccactcccgattaccaggagcagacagatctgcaggtgcctcccactgctgataggttccaggccgaagagtacggtgagggtggaaccgatccacctgaagggccctacgactacacatatggatacggcgacgattacagggaagaaaccgagcttggccctgccctgtctgcagagaccgcccactctggagcagccgcccacggaccccgcggactgaagggggagaagggcgaaccggctgtcctcgaacccggtatgctggtcgagggacctcccggcccagagggaccagctggattaataggacctcccgggatacagggaaacccagggccggtgggtgaccccggggagcgggggcccccaggccgtgcgggactgcctggcagtgacggcgcacctggcccccccggcacttcactcatgttaccattcagatttgggtccggcggcggcgataaaggtccagttgtggcggcccaggaggcccaggctcaggcaatattgcagcaggcccgcttagcactgagaggccctcctggacccatgggatatacagggaggcccggtccactgggacagccaggcagccctggactgaagggtgagtccggagacctcggcccccaggggcctcggggaccccagggtctgaccgggccgcccgggaaggccgggcgtcgaggtcgggctggcgccgacggcgctagggggatgcccggggatcctggagtcaagggggaccgtggattcgacggcctgcccggactgcccggagaaaaaggccatcggggcgacactggagcccaggggttacctggcccacccggtgaagatggggagcgcggagacgatggggagataggtccccggggcctcccaggggaatctggtccacgagggttgctcggcccaaagggccctcctggcattcccggaccacctggtgttaggggcatggatggtccccagggaccaaagggatctctgggaccccagggagaaccaggtcctccggggcagcagggtacacctggaactcagggtctgccaggtccgcagggggccattgggccccatggagagaaagggcctcagggcaagcctggtcttccaggaatgccagggagcgatggacctcctggccaccccggcaaagaggggcctccagggactaagggaaaccaggggccaagcgggcctcagggacccctaggttatcctggaccgcggggcgtgaagggcgtcgacggtattaggggccttaaaggccacaaaggcgagaagggcgaagatggattcccaggctttaagggggatataggcgtgaagggcgaccgaggcgaagtgggagtgcccggcagccggggtgaagacggcccggaagggcccaagggtagaacgggtccgacaggcgaccctggaccccccggcttgatgggagagaagggcaagttaggagtccccggtctgcccggatatcctggacggcagggtcctaaaggctcactcggattcccgggctttcctggcgcctcaggggagaagggggctagaggactgagcgggaaatccgggccccgcggcgagagggggccaacaggccctcgaggacagcgaggccccagaggcgccacgggcaaaagcggggctaagggcacatctggcggggacggccctcacggcccccccggcgaacgcggcctccccgggccgcaaggtcctaatggcttcccagggcctaaaggcccacctggtcccccaggcaaggatggattgccgggccaccccgggcaacggggagaggtcggatttcaagggaagaccgggcccccggggccacctggggttgtgggcccccagggcgccgctggcgagacaggccccatgggcgagcggggccatcctggaccaccaggtcctccaggagagcagggactgcccggcacagccggtaaggagggcacgaaaggtgaccccggaccacccggcgcccctggcaaggacggtcctgccggtctgcgtggctttcctggtgagcgagggttacccggcaccgcaggaggacctgggttgaagggtaacgaagggccctccgggccacctggcccagctggctccccaggggagcgtggagctgctggctcaggcggccctattggcccccctggcaggccgggcccccaggggccacctggcgccgctggcgaaaagggagtgcctggggagaaagggccaattggtcctacaggaagggatggcgtgcaggggccagtggggctgcctggacccgctggacctcccggcgtagccggcgaggatggggacaaaggagaagtgggcgaccctgggcagaagggcaccaagggcaacaaaggggagcatggaccgcctggtcctccagggcccatagggcccgttgggcaacccggagccgcaggagccgacggcgaacctggagccagaggcccccagggacactttggcgctaagggcgacgaaggcaccagaggatttaacggacctcccggccccatcgggctccagggtctgccaggaccatctggggagaaaggtgaaaccggcgacgtcggacctatgggcccacccggaccaccggggcctaggggccctgctggtccgaatggagcagacggcccacagggcccacccgggggggtgggaaacctggggcctccaggcgagaagggtgaaccaggggagtccggatcacccgggattcagggtgagccgggcgttaaaggcccccgaggcgaacggggagagaagggcgaatccgggcagcccggcgagcccggtccacctgggccaaagggaccaacaggcgatgacggcccgaaagggaatccgggccctgtagggtttccgggtgaccccggaccaccaggagagggtggccctaggggccaggatggcgcaaaaggagataggggagaagacggggaaccgggacagcccggtagtcctggacctactggggagaatggccctcccggtcctctgggaaaaaggggccccgccgggagccccggttcagaagggcggcagggcgggaaaggggcgaagggcgatccaggcgccatcggcgcccccgggaagaccggacctgttggccccgccggcccagccggtaagcccgggccagacgggctgcggggccttcccgggagcgtggggcagcagggtcgacctggagccacaggccaggcaggaccgcccggtcctgtgggtccacctggacttcctggactgcgcggggacgctggtgccaaaggtgaaaaagggcatccagggttgattgggctgatcggaccccccggtgaacagggcgagaaaggagaccggggccttccaggccctcaagggagccccgggcagaaaggcgaaatgggtattcctggagcaagtggacccatcgggccagggggaccaccgggactccccggccccgcaggtccgaagggagctaaaggagctaccgggccagggggtcctaagggagagaaaggggtgcagggaccccccggccaccccggacctcccggcgaggttatccagcccctgcccatccaaatgcctaagaagacacggcggtccgtcgacggctctcgattgatgcaagaggacgaagcgatccctacgggtggagcacccggatcccccgggggcctggaggagatttttggatcactcgacagcttaagagaagaaatcgaacagatgcgacgtccaactggcacacaagatagcccggcgaggacatgccaagacctcaaactctgtcaccctgaactgcccgacggagagtactgggtggatccgaaccaggggtgtgccagggatgcctttagggtcttctgcaactttaccgctggcggcgagacctgcgtcactcctcgggacgacgtcacccaattttcatacgtcgactctgaggggtcaccagtgggcgtggttcagctcacatttcttcggttgctcagcgtgtctgcccatcaggatgtcagctacccatgtagcggcgccgcccgggacggcccccttaggctgcgtggggcaaatgaagacgaattgagtccggagacatccccctacgtgaaagaattccgggacggttgccaaactcaacaggggcgaaccgttctggaagtgcgcaccccagtgctggagcagcttcctgtgctggacgctagtttctccgatttgggcgcaccccccagacgcggaggagttttattgggacctgtttgcttcatgggatag

SEQ ID NO: 4062 - DNA, 5031 bp, Artificial Sequence
  Description of Artificial Sequence: Synthetic coding sequence
atggagcggtgcagccggtgccaccggctgctgctgctgctgcccctggtgctggggctgtctgccgcccccgggtgggccggcgcaccacctgttgacgtcttgagggctctaagattcccatccttgcccgacggagtccgacgcgcaaagggcatatgtcctgcggatgtcgcctatcgcgtggcccgtcctgcccagttgtctgccccgacacgccagctattccctgggggctttcccaaggacttctcacttctaacagttgtgcgcaccaggccgggactgcaggcccctctgctgacactttacagcgcccagggcgtgaggcagctagggctggagctcgggcgcccagtgcgttttttgtatgaggatcagactggaagaccgcagccaccaagtcagcccgtgtttcgcgggctctcactggcggacggcaaatggcacagagtggctgtggcggttaagggccaatccgtgacactcatcgtcgactgcaaaaaacgtgttaccagacccctgccacgaagcgccaggccagtgctcgacacgcacggcgtcattatctttggtgcccgcattctcgacgaggaggtctttgaaggcgacgttcaagagctggcaatcgtcccaggcgtgcaggccgcatacgagagttgcgagcagaaagagctcgaatgtgaaggaggacaacgtgagcgccctcagaaccagcagccacatagggctcagaggagtcctcagcagcagccttcacggttgcaccgaccacagaatcaggagccacagtctcaacccaccgagtccctgtactatgactataaacctccatactacgacgtgatgacaacaggcaccactccagattaccaggaccctacacctggggaggaagaggagattctggagagctctctgttgccacccttagaagaggcagcgcacggaccgcgcgggctcaagggcgagaagggggaacctgccgtcctagagcccggcatgttagtcgagggtcccccaggtcctgagggccccgcggggcttatcggaccaccgggtatacagggcaatccaggccctgttggcgatccgggcgaacgtgggccaccaggaagggccggcctgcccgggtctgatggcgccccagggccacccgggaccagcttgatgctgccctttaggtttgggagtgggggcggcgataaaggtccagtcgtggcggcccaggaagcccaggctcaagcaatcctgcagcaggcaagactcgcactgcggggaccccctggcccgatgggatacacagggcgacccggccctctaggacaaccaggttcgcccggcctcaagggggagtccggcgacctgggaccccagggtccacgaggcccccagggtctgaccggcccacccgggaaggccgggcggcgtggccgcgcgggggctgatggagctcgcggcatgcctggagaccctggtgtcaagggagaccgaggcttcgatggcttaccggggcttcctggtgagaaagggcatcgcggtgacacgggggcacagggactgcctggcccaccaggggaggacggcgaaaggggagacgacggtgagattggcccccgtggcctccccggtgagagcggacctcggggtttgctgggcccaaagggacctccaggaattcccggtcccccaggcgtgagaggtatggacggccctcagggccccaaagggtccctgggacctcagggcgaaccagggcctcctggccagcagggtacccctgggacccagggcctcccaggaccacagggtgctatcggcccgcatggtgagaagggcccccaggggaagcccggattaccgggtatgcccgggtctgatggtcctccaggccacccagggaaggagggtcctcccgggaccaagggaaaccaggggcctagtggccctcagggacctctaggttaccccgggcctagaggcgtgaagggcgtggatggaataaggggtctgaagggccacaaaggtgaaaaaggcgaagacggatttcctggatttaaaggagatatcggcgtgaagggagaccgcggtgaggttggggttccaggatcccggggcgaagacggcccagagggacctaaggggcgcacaggaccgaccggcgaccctggcccccccggcctgatgggggagaaagggaaactgggggtgcccgggctgcctgggtaccccggtagacagggaccaaaaggctcactgggcttccctggctttcccggtgctagcggagagaagggagctagaggtctgagcgggaaaagcggtcctcggggcgagcgcggtcctacagggccaaggggccagcggggcccgcgcggagcgacaggaaagagtggggctaagggtacctctggtggtgatggcccgcatggcccaccaggggagagaggtctccccggaccacagggcccaaacggctttccgggtcccaagggacccccaggtcctccaggtaaggacgggctccccggacatcccggtcagagaggagaggttggatttcagggaaaaaccggcccgcccgggccccccggtgtggttggcccccagggggcagctggggaaactgggcccatgggcgagcgtggccaccctgggccgcccgggccacctggggaacaggggctacccgggacagccggaaaagagggcacaaagggcgatcccggacccccaggagctcctggaaaggacggcccagccggtctcaggggatttcccggggaacgagggcttccaggtactgctggggggcccggactgaaggggaacgaaggtcctagcgggccacccggtccagcaggctccccaggtgagcgcggggccgcagggagtggaggtcccatagggcctcccggacggcccggcccccaaggccccccaggtgcagccggggagaagggtgtgccaggcgagaaggggcccataggccctaccggtcgggacggggttcagggtccggtcggactgcccggccccgcaggaccacctggggtcgccggcgaagatggagacaaaggggaggtcggagaccccggccagaagggaactaagggtaacaaaggagagcacggccccccagggccacctggcccaattggaccagtggggcaaccgggagcagcaggagctgatggggaaccgggagctaggggcccacaggggcacttcggagccaaaggcgacgaaggcactcggggcttcaatggcccaccgggaccaatcgggttacagggccttcctgggccaagtggggagaagggggagacgggcgacgttggcccaatgggcccccccggccctcctggccctcgtggccctgctggcccgaatggagctgacggcccacagggacccccaggtggtgtagggaaccttggaccccctggggagaagggtgaacctggcgagtccggatctcctggcatccagggcgagccaggagtaaaggggcccaggggagagaggggcgaaaagggcgaatccggccagcctggtgaaccaggtccacccggacccaaggggccgactggcgatgacggtcctaaaggcaatcctggcccagtgggtttccccggtgaccctggacccccaggggagggaggaccacgtggacaagatggggccaaaggcgacaggggcgaggatggggaacccggccaaccgggcagccccggccccaccggggagaatggacctccagggcccttggggaaacgcggtcctgccggctcacccggtagcgaagggagacaaggagggaagggcgctaaaggggatccaggcgctattggagcccccggaaaaacaggccctgtgggacccgctggcccggccgggaaaccaggtccagatggcctgcgcggccttcctggctccgtggggcagcaggggcggccaggtgcaactggccaagccggccctcccggaccggtcggccctcccggactcccaggcctacggggcgatgctggcgccaaaggcgagaagggccaccctgggcttattggcctgatagggccacccggcgagcagggggaaaagggagacagagggctccctggccctcagggtagtcctggtcaaaagggtgagatgggcatcccaggcgccagcggcccaattggacccggcgggccacctggcttgcccgggcctgcaggccccaagggggctaaaggcgcaactggcccgggcggccctaaaggtgaaaagggcgtgcagggtcctcccggacacccggggccaccaggcgaagtgatacagccgctccctatacagatgccaaaaaagacacgcaggtccgtcgatggatcaagactgatgcaggaggacgaagccatccctaccggtggtgcaccagggtctccagggggattagaggagatcttcggatccctggatagtttgcgagaagaaatcgagcagatgaggaggcccacaggaacccaggattccccagcaagaacatgccaggaccttaagttgtgccacccagagctgccagatggggagtactgggtagaccccaatcagggatgcgctagagacgccttcagagtgttttgtaacttcaccgcaggcggtgaaacctgcgttacccctagggacgacgtgactcagttctcttatgtggactcggagggatccccggttggggttgtgcaactcacattcttaaggctgttgagcgtgtcagcccatcaggacgtcagctatccctgcagtggggcggcgagagacgggccactgagactaagaggcgctaacgaagacgagctctcccctgaaactagcccctacgttaaagagttcagggacgggtgccaaactcagcagggccgaaccgtgctagaagtgcgcactccagtactcgagcaactcccagtgctggatgcctcatttagtgacctcggtgccccgccccgacgtgggggggtcctccttgggccggtgtgtttcatgggctag

SEQ ID NO: 4063 - DNA, 4968 bp, Artificial Sequence
  Description of Artificial Sequence: Synthetic coding sequence
atggagcggtgcagccggtgccaccggctgctgctgctgctgcccctggtactgggcctgagtgccgcacccgggtgggctggggccccgccagtcgatgtcctccgggccttgcggttccctagtctccccgatggagtcagaagggcaaaggggatctgcccagccgatgttgcttaccgcgtagcgcgtccggctcagctctctgctccaacacggcaactgtttcccgggggatttcctaaggacttttctttgttaacagtggtcagaacgcggcctgggctgcaggcaccacttctgacactgtacagtgcccagggagtgagacagttgggactcgagctcggtcgacctgtcaggtttttatatgaggatcagaccgggaggccacagccgccctcccagcccgtgtttcggggactctcgctggctgacggaaaatggcacagagttgccgtggctgtaaaaggacaaagcgttacgcttatagtggattgtaaaaagcgcgtcacaagacctttaccacgctcggccaggcctgtcttggacacccatggggttattattttcggcgctaggatcctggacgaagaggtgtttgagggggacgtgcaagagctggccatcgtgcccggcgtccaagctgcatatgagagctgtgaacaaaaagagttagaatgtgagggaggccagcgagagagaccccagaaccagcagccccatcgcgcccaaaggagtccccagcaacaaccaagtagattacataggccccagaatcaagagccccagagccagccaactgagagtctatattatgactataagccgccatactacgacgtcatgaccacaggcaccacgcccgactaccaggcagcacatggacctagaggactcaagggggaaaaaggagaacccgctgtcctcgaacctggcatgctggtcgagggccctcctggccctgaaggtcctgccggtttgattgggccccctggtatccagggcaacccagggcccgtcggtgatccaggcgaaagaggacccccaggacgcgccggcttaccaggatccgacggcgctccagggcccccgggcacctccctgatgctgcccttcaggtttgggtcaggaggaggggataaaggcccagtggtcgccgcccaggaagcccaggcacaggcaattctccagcaggctaggttggccctgagagggcctcctggaccaatgggctataccggaaggcccggccctctagggcaaccggggagtcctgggctgaagggtgagtccggcgatctgggaccccagggccctagagggccgcagggattgaccggtccgcctggaaaggctggaaggcgtggcagggcaggagcagacggagcaagagggatgccgggtgatcccggtgtgaaaggcgaccgtggctttgacgggcttcctggattgcccggggagaagggacaccgaggagatacgggtgcacaggggctgccaggtccccctggcgaagacggggaaaggggcgatgatggggagattgggccacgcggacttcccggagagtcagggccaagagggctcttaggccccaaaggacctcctggcattcccggcccaccaggagttaggggaatggatggaccccagggacctaaagggagcctgggcccacaaggggaacctggtccacccggacagcagggtaccccagggacccagggcctgcccggtccacagggggccatcggcccacacggggaaaaaggtccacagggtaaaccgggactgcccgggatgcccggaagcgatggacctcctggccatccgggaaaagaagggccccccggtactaagggcaaccagggcccttctggccctcagggcccgctgggctatcccgggccccgtggagtgaagggcgtggatggcattcgtggcctgaaggggcataagggcgagaagggcgaagacggatttcctggatttaaaggcgatataggggtgaaaggggatcgcggagaagtgggagtacccgggtcacgaggggaggatgggccggaaggtcctaagggccggaccggtccaacaggggacccaggtcccccaggcctgatgggggaaaagggcaagctgggcgttccagggctgcctgggtaccctggaagacagggccccaaagggagcctcggctttcccgggttcccaggcgcctccggcgaaaagggtgcaagaggtcttagtggcaagtccggaccccgtggcgagagaggcccaacaggtccccggggccaacgcggcccccgaggcgccactggtaagtctggggctaagggaacctctggtggagatgggccacatggaccaccgggcgaacggggcctgcctgggcctcagggcccaaacgggtttccaggacccaagggcccacccggtccccctggcaaagatgggttacccggccaccctggacagcgaggcgaggttggctttcagggaaagaccgggccgcccggaccgccaggggtggttggtcctcagggggcagctggagagaccggtcccatgggtgaaagaggacaccccggaccccccggccctcctggggaacagggcctgcctggcacagctgggaaggaagggacaaagggcgatccaggtcctcccggagcacccggcaaagacggacctgccggtctccgggggtttccaggcgaaaggggtctgccaggaaccgccgggggaccagggttgaaaggaaacgaaggaccctctggccctcctggccccgccggatctccaggagagaggggggcagcaggcagtggaggtcctataggtcctcccgggaggcctggcccgcagggcccacctggcgccgccggcgaaaagggtgtgccaggtgagaaaggcccaatcggacctacagggagggatggggtacagggcccggtcggactgcctggccctgccggccctcccggtgtggcaggggaagatggtgataagggagaggtcggcgatccagggcagaaaggaacgaaaggcaacaaaggagagcacggacctccaggtccaccaggacctattggccctgtcggtcagccaggggccgccggcgctgatggagaacctggggcccggggcccccaggggcactttggtgctaaaggcgatgagggtacacgggggttcaatggaccacctggaccaattggccttcagggactgcctggtccatctggagaaaagggtgaaacgggtgacgtgggacctatgggaccacccggtcctccagggcctcgtggtcccgctggccctaatggggcggacgggcctcagggcccccccggaggggtcgggaatctgggccccccgggcgaaaagggtgaacctggtgagagtgggtcacccggcatacaaggggagccaggcgttaaaggccctcgaggcgagcgcggagagaaaggggagtccgggcaaccaggggaacctgggccaccggggccaaagggccccaccggcgacgacgggcccaaaggaaaccccggtcctgttggattccctggcgaccccgggccaccaggagagggcggacctcgggggcaggatggcgccaaaggcgaccgcggcgaggacggagaaccagggcagcccggatctccgggtcccaccggagaaaatggcccgccgggtcctttggggaagagagggccagccggctctccaggatccgaggggcggcagggcggcaagggcgctaagggcgaccctggggccataggggccccaggcaagaccggccccgtggggccagccggcccagctggaaaacctggtccagatggcttgagggggttgcctggcagtgtgggccagcaagggaggcccggagccaccggacaagccggtccaccgggcccagttggtccaccgggcctccccggcctgcgcggcgatgctggcgcaaagggagaaaagggccacccaggcctcattggcctcatcggccctcccggcgagcagggggagaaaggggacaggggcttgcctggtccgcagggttcacccggtcagaaaggagagatgggcattcccggggcgtcaggacccatagggccaggcggcccccccggcctccctgggccggcaggccccaagggcgctaagggagctacaggacccggaggtcccaaaggggagaaaggagtccagggccccccagggcaccccggccccccaggagaagtgattcaacctctccctatacagatgccaaaaaaaacaagacgcagcgtggacggttctcgcttaatgcaagaggacgaggctatccctaccggcggggccccaggcagtccggggggcttagaggaaattttcggttccctggattctctccgtgaggaaatcgagcaaatgaggcggcccactggtacccaggattcccccgcaaggacctgtcaggatttaaaactctgtcatccagagctgccagatggcgagtactgggtcgaccctaaccaggggtgcgcccgcgatgcattccgggttttctgtaattttacggccggaggagaaacctgcgtgaccccccgagacgatgttacccagttcagctatgtggacagcgaaggtagcccggtcggcgtggtccagctaacgtttcttcgcctgctgagtgtgagcgcccaccaagatgtaagttatccttgtagcggcgcagcccgcgacggcccacttcgcctgcgcggagcaaacgaggacgagctgagcccagaaacctcaccatacgtgaaagagtttagagacggatgtcaaactcagcagggtaggaccgtattagaggtgagaacgcccgtgctcgagcaactgcctgtattagatgcctccttctctgaccttggggctccaccccggagaggtggggttctgctgggacccgtttgcttcatgggatag

SEQ ID NO: 4064 - DNA, 5148 bp, Artificial Sequence
  Description of Artificial Sequence: Synthetic coding sequence
atggagcggtgcagccggtgccaccggctgctgctgctgctgcccctcgttctgggcctgtcggcagccccagggtgggccggggcccctcccgtcgatgtgctgcgtgccctccggttccccagtctgccagatggggtccggcgcgcgaagggcatttgccccgccgacgtggcttacagggtggctcggcctgctcagctcagtgccccgacacgtcagctcttccctggcgggttcccaaaagatttctccctgctgacggtggttagaacccggcccggactgcaagctcccctgttaaccttgtattccgcccagggcgtgcgtcagctaggcctggagctcggtaggccggtgagatttctgtacgaggaccaaactgggcggccccaacctccaagtcagcctgtgttccgaggcttgagcctcgccgatggaaaatggcatagagttgccgtggccgtaaaagggcagtcggttacccttatagtggattgcaaaaagcgagtgactcgccccctcccccgctccgctcgccccgtgctggacacacacggcgtgatcatcttcggcgcaaggatactcgacgaagaggtcttcgaaggcgacgtgcaggaactagcgattgtgcctggcgtgcaggcagcttacgaatcttgcgagcagaaagaactcgagtgtgagggcggccagagagaaaggcctcagaatcaacagcctcacagggctcagcgtagcccccaacaacagccatcccgactgcaccgccctcagaatcaggaaccacaatctcagcccactgaatcgctgtactacgattataagcccccctactacgacgttatgactaccggcaccacaccggattatcaagagcagacagatctgcaggttccccccactgctgatcggttccaagccgaggagtatggagagggcgggaccgatccaccagaaggaccctacgattatacatatggatacggagatgactacagggaagagacggaacttggccctgccctgtctgccgagactgcccattccggagcagcagctcatggtcccagggggctgaagggcgagaagggggagcctgctgttttagagcctggaatgctggtggagggtccccccggcccggaaggcccagccggtcttatcggcccccctggcattcagggaaatccgggccccgtgggggatccaggcgaacgtggtcctcctggcagggcaggtttacctggatccgatggagcccccgggccacctggcaccagtctcatgttaccgtttcgtttcgggagcgggggtggagataagggacccgttgtcgccgcacaggaggcccaggcacaagcaattctacagcaggctcgtctcgcactcaggggtcccccgggccctatgggttatactgggaggcccggcccactgggtcagcctgggtctcccggtctgaaaggcgagagtggggatcttggcccacaggggccaagaggaccacagggtttaactggccctcccggtaaagccggaagacgcggacgcgcaggcgctgatggagccagggggatgcccggagaccccggagttaagggcgatcggggcttcgacggtctacccgggctccccggggaaaagggccataggggcgatactggcgcacagggcctgccggggccaccaggagaggatggggaacgaggcgatgatggggaaatcgggcccaggggcctgccaggtgagagtgggccccgggggcttctgggcccaaaggggcctccagggatccccggaccccccggcgttagagggatggatgggccacaaggtccaaaaggatcactgggaccccagggtgagcctggtccccctggccagcaggggacccctggcactcaggggctgcctggaccccagggagcgatcggcccacatggagaaaagggtcctcagggcaaacccgggctgccaggaatgcccggatcagacgggcccccaggtcacccgggcaaggagggcccccccgggacgaaagggaatcaaggccccagcgggccccagggccccctcggttaccctggtccgcggggtgtgaagggagtggacggaattagaggcctgaaggggcacaaaggcgagaaaggtgaggacggtttccctggcttcaagggcgatataggcgttaaaggcgatcggggggaggtcggggtccccgggtctaggggcgaagatggtccagaaggccctaagggaagaactggccccaccggagaccctgggccgcccggcctgatgggcgagaagggcaagctaggcgtccccgggctgcccggataccctgggcgacaggggccgaagggtagtctagggtttccggggttccctggcgctagtggagagaagggcgcccgggggcttagcgggaagtccgggcctagaggggagcggggaccgacagggccccgtggccagcggggcccgaggggtgccacaggcaaatccggtgcgaaaggaacatctgggggggatggaccccatgggccacctggagaacggggactccctgggcctcagggccccaacggctttcccgggccaaagggacccccaggaccgcctggcaaggatgggttgccaggccatccaggccaacgcggcgaggtgggtttccaaggtaagactggtccacctgggccccccggggttgtcggtcctcagggagcagccggagaaaccggacccatgggtgagcgaggccacccagggcctcccggtcctcccggagaacagggactgccaggcactgcaggaaaggaggggacaaaaggcgaccctggcccaccaggtgctccaggcaaagatggtccagcaggcctgagagggtttccgggggaacgaggtctcccaggcaccgccggaggacccggactgaagggcaacgaggggccaagcggaccgcccggacctgctggatcacccggggaaaggggtgctgcggggtccggcggacccattgggccaccgggccggccaggccctcaaggaccccctggggccgccggggagaagggtgtgcctggtgagaagggcccaatcggtcctactgggcgcgacggtgtacagggcccagtcggactgcccgggccagcgggaccacctggagtggcgggcgaggatggcgataagggagaagtcggtgatcccgggcagaagggaacaaagggaaacaaaggagagcacgggccgcccggtccccccgggccaatcggtccggtcggccagcctggggccgccggcgcggacggggagcctggggcccggggcccccaggggcacttcggggccaagggtgacgaggggacaagggggtttaatgggcctcctggacccattggcctgcagggtcttccaggccctagtggtgaaaaaggtgagaccggagatgtcgggccaatgggcccacctggtccacctggcccccgcggtcctgcaggtccaaatggggcagatggaccccaaggaccgccaggaggagtgggaaatctcgggccacccggagaaaaaggggagccgggagagagcggctcccctggtattcagggggaaccaggtgtgaaggggcctcggggtgaaagaggcgagaaaggggaatccgggcagcctggcgagccaggtccgcccggacccaagggacccactggagacgacggcccaaaggggaacccaggtcctgtgggattccctggggatccaggccccccaggagagggcgggccacgggggcaggatggggctaaaggagacaggggggaagacggagagccagggcagcctggctcgcctggacctacaggcgaaaatggtccacccgggccactgggcaagagagggcccgcaggtagtccggggtccgaaggtcgccaggggggcaagggggctaagggcgaccctggcgccatcggagctccaggtaaaactggaccagttggccctgctggaccagctggcaaacccgggccggatggcctgcgaggattgcctggaagtgtcggccagcaggggagaccgggggccaccggccaggctggtcctcccggacccgtgggcccacctggattgccagggcttcgtggtgatgccggcgcgaagggcgagaagggtcatccgggcctcattggtctcatagggccccctggagagcaaggggagaagggtgatcgcggacttcccgggccacagggttctcccggccaaaaaggtgagatgggtatccccggagcctcagggcctattggcccaggcggtcctccaggccttccagggccggctggacccaaaggggccaaaggggctaccggaccgggaggccctaagggtgagaagggcgttcaagggccccccggtcaccccggacccccaggcgaagtcatccagcctctacctatccagatgccgaagaaaaccaggcggagcgtggacgggagtaggcttatgcaggaggacgaagcaataccgactggcggagcacctggaagtccagggggcctggaagaaatttttggctctctggacagcctaagggaggagattgaacagatgaggcgacccacgggcactcaagactccccagcgagaacctgccaggatttaaagttgtgccatccagagctgcccgatggagagtactgggttgatccaaaccaggggtgtgcccgagatgcttttagagtattctgcaactttacggccggcggcgaaacctgcgtgaccccgagagatgacgttactcaatttagttatgtcgatagtgagggaagcccagtgggggtcgttcagctcacttttctccgcctgctttctgttagtgcacatcaggatgtgagctacccctgttccggggccgctagagacggaccgctgcggcttcgcggcgcgaatgaggacgagttgtctccggaaaccagtccttacgtcaaagagttcagggacggatgtcagacacagcagggcagaacggttttagaggtccgcacccccgttttggagcaacttcctgtgctggatgctagcttctcagacttgggggctccacctaggagggggggtgtgctccttggccctgtctgcttcatgggctag

SEQ ID NO: 4065 - DNA, 9192 bp, Artificial Sequence
  Description of Artificial Sequence: Synthetic coding sequence
atgcggagccggctgccccccgccctggccgccctgggcgccgccttgctgttgagcagtattgaggccgaggtggatcccccctccgatctcaatttcaaaatcatcgacgagaataccgtgcacatgtcttgggccaagccagtggatcctatcgtgggctacaggatcaccgtggaccctaccacagatgggccaactaaggagtttacgctgtctgcgtctaccacagagacactcctgagcgaacttgtgccagaaaccgagtacgtggtgacaattacgtcatacgatgaggtggaagaaagcgtgcctgtgattggacagttaactattcaaacggggtcatccaccaaaccagtggaaaaaaaaccaggcaaaacggaaatacagaagtgctcagtcagcgcctggactgatttagtgtttctcgttgatgggagttggagcgtcggccggaacaactttaagtacatcctggattttatcgccgccctggtttccgccttcgacataggggaagagaagacgagggtcggcgtggttcaatactccagtgataccaggacagaattcaatcttaaccagtattatcagagagacgaacttctcgcagctatcaagaagatcccgtacaagggaggtaataccatgaccggggacgctatagattacctggtgaaaaatactttcacagagtctgcaggcgcaagagtggggtttccaaaggtcgctattatcataacggatggaaagtcccaagatgaggtcgagattccagctcgcgagctgcgcaacgtgggcgtggaggtgtttagccttggtattaaagccgccgatgctaaggaactcaaacagattgcctccactccttctttgaaccatgtattcaacgttgcaaattttgacgccatcgtggatatccagaacgaaatcatatcacaagtgtgctcgggcgtggacgaacagcttggggagttagtaagcggcgaagaggtcgtggaaccacccagcaatttgatagcaatggaggtgtctagcaagtacgtaaaactaaactggaacccctcaccttcccctgtgacaggctataaggtaatcctgactcccatgaccgcaggctccagacagcacgcgttaagtgtagggcctcagactactacactgtctgtcagggatctgagtgccgatactgaatatcaaatctctgtttccgccatgaagggaatgaccagtagtgaacccatatccatcatggagaaaacccaaccaatgaaggttcaggtagagtgtagcaggggggtagacatcaaagctgatatcgtttttcttgtggacgggtcctattccattggaattgctaactttgtcaaagtgcgagcgtttttggaggttctcgttaagtcattcgagatctccccgaatcgggtgcaaatctcgttggtacagtattcaagagacccccacaccgagtttacccttaagaagtttactaaagttgaggatataattgaagccatcaatacatttccttatcgcgggggttctactaacacaggcaaggcgatgacttacgtgagggagaaaattttcgtgcctagcaagggtagccgttccaatgtgccaaaggtgatgatcctaataacagacggcaaatcttccgatgcgttccgtgaccctgccatcaaactgcgcaactccgatgtggagatctttgccgtgggggtgaaagatgcggtaaggagtgagcttgaagccattgcctctccgccggctgaaactcatgtgttcaccgtggaagatttcgacgccttccagagaatttctttcgaacttactcagtctatatgtttgcggattgaacaggagctggcagccataaaaaaaaaggcctatgttcctcctaaagacctgtcgttctccgaggtgacttcctacggcttcaagacaaactggtctccggccggggaaaatgtcttctcataccatattacttataaagaagccgcaggcgacgacgaggttacagtagtagagcccgcatctagcacctccgtcgtgctgtcttcattgaagccagaaactctatacctcgtaaacgtgaccgccgaatatgaggacggcttcagcatacctttagccggcgaagaaacaaccgaggaagtgaagggagcacctcgcaacctgaaagtcaccgacgaaactaccgatagcttcaagatcacctggacgcaggctccaggacgcgtacttaggtacaggattatatatcggcccgtcgccggcggagaatccagagaggttactacgccacctaatcaaaggagaagaacgctcgagaacctgatacccgacactaagtatgaagtaagtgtgatccccgaatacttttctgggccgggaacaccgcttacggggaacgctgcaaccgaggaggtacgcggcaaccctagggacctcagagtttccgatccaacgacttcgacaatgaagttaagctggtctggtgccccaggcaaggttaagcagtaccttgttacttatacaccagtggccggcggagagacacaggaagttaccgtccggggagacacgaccaacaccgtgctgcaggggctgaaagaggggacacagtacgctttgtcggtgactgccttatacgcatccggtgctggtgacgccctatttggtgaaggcaccacattggaggaacgcgggtctcctcaggacctggtaaccaaggatatcactgacacgtcaatcggagcctattggacatcagcccctgggatggtgcgcgggtatagggtgagttggaagtccctatatgacgatgtcgacacaggtgagaagaacctgccagaagacgctattcacaccatgatcgagaacctccaaccggaaacaaagtacaggataagtgtgttcgcaacttattcatccggagaaggcgaacctttaactggcgatgcaacaacagagctctcccaagattccaagaccctgaaggtcgacgaagagacagagaacactatgcgcgtgacatggaaacctgcacctggcaaagtggttaattaccgggtggtttacaggccccacgggcggggaaaacagatggtggcaaaagttccacctactgttacttctacggtgctgaagcgcctccaaccacagacaacctatgatatcacagttctgccaatctacaaaatgggggaaggcaaactgaggcagggttccgggactacagccagccgatttaaatcacccaggaaccttaagactagtgaccccaccatgtcttcgtttcgagtgacatgggaacccgctccaggcgaggtcaagggatacaaggtaactttccaccccaccggtgacgatcgccggcttggagaactggtcgttggcccatatgacaatacagtagtgctggaagaactacgggcgggaaccacttacaaggtaaacgtattcggaatgtttgatggcggggaaagttctccgctggtagggcaagagatgaccacattatccgatacaacagttatgccaattcttagcagcggaatggagtgtttgactcgtgcagaagctgacattgtcctgcttgtggatggatcctggtctattggtagagctaactttagaaccgtgagatcatttatcagtcgcatcgtggaggtattcgatatcgggcccaaacgagtacagatcgccctggcacagtattcaggcgaccctcggaccgagtggcaattaaatgctcatcgcgataagaaatctctgctccaagcagtagcaaatttaccctacaaaggggggaacaccctgaccggtatggccctgaactttatccgtcaacagaatttcaggacccaagctggtatgagacctcgcgcccggaaaataggcgtcctgataacggacgggaaatcacaggacgatgtggaggctccgtctaaaaaacttaaggatgagggggtggagctattcgctatcggtattaaaaatgctgatgaggtagaacttaagatgattgcaacagatcctgacgatacgcacgcttataatgttgctgactttgagtcgctttctcggattgtcgacgacctcaccattaatctctgtaactccgtgaaagggcccggagatctggaggccccctcaaatctggttatctctgaacggacacatcggagttttcgagtgtcgtggacccctccctcagacagcgttgatagatataaggtcgagtactatccagtttcaggaggcaaacgacaggaattctatgtgtcacgaatggagacaagcacagtccttaaagaccttaagccggagacagagtacgtggtaaatgtttactccgtggtggaggatgaatatagcgagcccttaaaggggactgaaaagaccctgcctgtgcccgtggtttcgcttaacatttacgatgtcgggcccaccacaatgcacgtgcaatggcagccagtaggtggcgccacgggctatatcttgagctacaagcccgtgaaggacaccgaaccaacacggcccaaagaggtccgtcttggcccgacagtgaatgacatgcagctcactgatctggtccccaataccgaatatgcagtgacagtacaagcagtgctgcacgatctaacctccgagcccgtcactgtgagagaagtgacactgccgctgcctcgtccgcaggacttgaagctgcgagacgtgacccactctaccatgaatgtgttttgggaacccgtccccggtaaagtccgcaagtacatcgtccgctacaagacacctgaggaggatgtgaaagaagtggaagttgatcgcagtgagacctcaacatcattgaaggatttgttcagtcaaacattgtacaccgtttccgtcagcgcagtgcatgatgagggcgagtcaccacctgttacagctcaggagaccacacgacccgtcccagcccctacaaacctaaaaataacagaggtgacttcagagggcttcagaggcacatgggaccatggggcatctgacgtatccttatatcggatcacttgggctccgttcggctcgtctgataagatggagaccatcctcaacggcgacgaaaacacactggtttttgagaatctgaatcccaataccatttacgaggtgagtataacagcaatttatccagacgagtccgagagcgacgatctcattggaagcgaacggacactccctatcttgacaacacaggctcctaagtcaggacctcgcaatctgcaggtgtataatgccactagcaacagcttaaccgtgaaatgggatccagccagcggtcgagtgcaaaagtatcgcattacataccagcctagtaccggcgaagggaacgaacagacaactacgatcggcggcagacagaattcggtcgttctccaaaaacttaagccagacacaccttacactatcactgttagcagtctgtacccggatggggaggggggtcgaatgacagggcgcggcaaaacgaagcctctcaatacagttcgcaatttacgggtttatgaccctagcacttccactctgaacgtgcggtgggaccatgcggagggtaatccccgacagtacaaattgttctatgcccccgccgccggcggaccagaagagctagtcccaataccagggaacactaattatgctatccttcgcaacttacaacccgacacgtcatacacagtgacagttgtccccgtgtacacggaaggcgacggcggcaggacctccgacactggtagaactctgatgagagggttggctaggaatgtccaggtttacaaccccacaccaaacagtcttgacgtgagatgggatcccgccccgggaccagtgctgcagtaccgggtggtgtactctcccgtcgatggcactaggccctctgagagtatagtggtccccggtaacacacggatggtccacctcgaacggctaatccctgacacactatattctgtgaacctagtggcactctattctgatggggagggcaacccctcccccgcgcagggcagaacgctgccacgcagcggacctcgcaacttacgagtgttcggagagaccacgaattccctctccgttgcctgggatcacgctgacgggccagtgcaacagtaccgtattatctacagtccaacagtaggcgatcctatcgatgagtatacgactgtgccagggagaagaaataatgtgatcctgcagccactgcaacctgacactccatataagatcaccgttatagcagtgtacgaggacggcgatggagggcatctgacaggaaatggtcgcaccgtgggtctgctgcctccacagaacatccatatcagcgatgaatggtacactaggttccgcgtctcctgggacccctccccttcccccgtcctgggttacaagatcgtttataagcccgtgggcagcaatgagcccatggaggcctttgttggcgagatgacgagctacaccctccacaatctgaacccctcaaccacctatgacgtgaacgtgtatgcccagtatgattccggactctccgttcccttgaccgatcagggtactaccctttacctcaacgtgaccgacctgaagacctatcaaatcgggtgggatacattctgcgtaaagtggtccccacaccgagccgctacaagttataggctgaagctttctccagcggacggaacaagaggtcaggagattacggttcggggctccgaaaccagccattgcttcacaggtctgtcccccgacacagactatggagtcacggtgttcgtgcaaaccccgaacctggagggccccggagtttccgttaaagagcacaccaccgttaagcctaccgaggcacccactgaaccaccaaccccacccccgcctccaacaattccacctgcccgtgatgtatgcaaaggcgccaaggctgatatagtgtttctgactgacgcctcttggtctattggagacgacaatttcaacaaagtggtgaaattcattttcaatacagttggaggcttcgatgagatctcgcccgccggcatacaggtgagctttgtgcagtactccgacgaggtcaagagtgaattcaaactgaacacctataatgacaaagcattagccttgggagcccttcagaatatcaggtatagaggaggcaacacgaggaccgggaaagcgctgacctttataaaggagaaagtcctgacctgggagagtggtatgcggaagaatgtgcccaaggttttagtagtagtgaccgatgggcgtagtcaggatgaagtgaagaaggctgcactggttattcagcaatctggcttttctgtgtttgtggtgggggtggcggatgtcgattacaacgaactggccaacatcgcctctaagccatcagagcgccacgttttcattgtcgacgattttgaatctttcgaaaagatagaagacaatctgattacattcgtgtgcgaaacagccacatcatcctgtccactgatctacctggacggctatacaagtcctggtttcaagatgctcgaagcatacaatctaacagagaagaatttcgccagtgtgcagggcgtgtccctcgaatcggggtctttcccctcctactccgcttaccggatccaaaaaaacgcctttgtgaaccaacccaccgccgatcttcatcctaatggcctcccgcccagttatactataatactgctctttagattgctgcccgaaacgcccagcgacccattcgccatctggcaaatcacggatcgtgattacaagccccaagtgggagtgatcgcagacccaagctccaagacattgagtttttttaataaagatactcgcggggaagtccaaacagtcacgttcgacacagaggaagtaaagacattattttacggctcatttcacaaagtacacatagtggtaacctcaaaaagtgttaaaatctacatagactgttatgaaatcattgaaaaggacattaaagaagccggcaacattacaacagatgggtatgaaattctgggaaagctgctgaaaggcgaacgcaaatctgccgctttccaaattcagtcctttgacattgtctgtagcccagtttggaccagccgcgatagatgttgtgacataccttcaagacgagatgaaggcaaatgtcctgctttcccaaatagctgcacctgcacccaggattccgtgggcccacccgggcctccgggcccggcaggcgggcccggagcgaaggggccccgcggcgagcgtgggatctccggagccatcggtcctcccgggcctcggggcgatattggccctcctggaccccagggtcctcccggccctcaaggtccaaacggcctctcaattcctggggagcagggaagacagggaatgaagggggatgcgggagagccgggtctgccagggaggaccggcacgccaggcctgcctgggccacccggtccaatggggccgcctggtgatagaggttttaccggaaaagacggggctatgggacctcgcggacctcccgggccaccgggatctcctggctctcccggcgttaccggcccatcagggaagccaggtaaaccaggggatcacggtcggccagggccctcaggacttaagggcgaaaagggtgaccgcggggacattgccagccagaatatgatgagagccgttgcacggcaggtatgcgaacagctcatttccgggcagatgaaccgcttcaaccagatgctaaatcagattcccaacgactatcagtcttctagaaaccaaccaggacccccaggcccaccaggacccccaggaagcgcgggcgccaggggtgaacctgggcccggtggccgcccgggtttcccaggcacgcccggaatgcagggtccccctggtgagcgcggattgcctggagaaaagggagaaaggggcaccggttcttctgggcccagggggttacccggcccaccaggcccacagggcgaatcccgtactggtcccccaggatcaaccggaagccgaggcccccccgggccccccggtcgacctggcaattcaggcatccgcgggccaccaggtcctcccggttactgtgatagcagtcagtgtgcttccatcccctacaatggtcagggctaccctggaagtggttag

SEQ ID NO: 4066 - DNA, 5700 bp, Artificial Sequence
  Description of Artificial Sequence: Synthetic coding sequence
atgcggagccggctgccccccgccctggccgccctgggcgccgccctccttctgtcatcaattgaggccgagggcatggagtgcttaacgagagccgaggcagacattgtgttgctcgtcgacggatcctggtccattggtagggctaactttcgcaccgtgagatccttcatcagtcggatcgtcgaagtgtttgatatcggccccaagagagtgcagattgcactggcacagtatagcggagatcccagaaccgagtggcaactcaatgcacaccgcgacaagaagtcgctcctgcaggccgtggctaatctgccctacaagggcggtaacactcttacaggaatggccctgaattttatccgtcaacagaacttcagaacccaggctgggatgagaccacgagccaggaaaatcggcgttctgatcacagatggcaagtctcaggatgacgtggaggcccccagcaagaaactgaaggacgagggcgttgagctcttcgcgatcggcatcaagaacgccgatgaagtggagctcaagatgatcgccactgatcccgatgacacacatgcctataacgttgccgatttcgagtccctttcgcgcatcgtcgacgatctgacgattaacctgtgtaattctgtgaaagggccaggcgatctcgaggccccatcaaacctggttatatccgaacgcactcacaggagcttcagagtctcctggacccctccgtccgacagtgtggatcgctataaggttgagtattatcctgtttcaggtggcaagagacaggagttctacgtctcgagaatggaaacttcaacagtcttaaaggacttgaagccagagaccgagtacgtagttaacgtgtactccgtggtagaagacgagtattcggagcccctgaagggcacagagaaaactttgcctgtgccggtggtgtccctgaatatctacgatgttggccctaccaccatgcatgtgcaatggcagcccgttggaggcgctaccgggtatattctgagttacaagcccgttaaagataccgagcccaccagacccaaggaagttcgcctaggtcctactgtgaatgacatgcagcttacggatttggtgccaaatacagagtacgcggtaacagttcaggccgtgcttcacgacttaacttctgagccagtcaccgtgagggaagtgacactgcctcttcctcgtccgcaggatttgaagcttcgtgatgtgacccatagtactatgaatgtattttgggaacccgtccctgggaaagtgaggaagtatatcgtgcggtacaagacgcccgaagaggacgtaaaagaggttgaagtcgaccgatccgagacgagtacgtcgctgaaagacctcttctcccagaccttatacaccgtgtccgtgagcgcagttcacgacgagggggaaagtcctccagtgacagcacaggaaaccacacgtcctgtgccagcacccacgaacctgaagatcaccgaggtaacctctgagggatttcggggaacctgggaccacggtgcatctgatgtttctttgtatcgtatcacttgggcaccttttggcagttccgacaaaatggaaaccatactgaacggtgatgagaatacattggtgttcgagaaccttaacccgaatactatctacgaggtgagcattaccgcgatatatccagatgaatccgaatcagatgacctgattggatcagagagaaccctgccaatactgactactcaggcccctaagtctggcccacgtaacctgcaggtgtacaatgctaccagtaatagcctgacagtgaagtgggacccagccagcggccgggtccagaaatatcgaattacctatcagccatctacaggggaggggaatgaacagactactacaatcggcggccgccaaaacagtgttgtgcttcagaaactgaaaccagatactccatacacaataacagtcagcagtctttaccccgatggggaaggcggccgaatgaccggcagggggaagactaaacctctcaacacagtgcgaaatctacgagtttacgatccatctacatcaactttgaacgtgcgctgggaccacgccgaggggaaccccagacagtataaactcttttatgcccccgctgccggcggcccagaggagctggtgcccatcccaggcaacacgaattatgccatcttgagaaacctgcagcctgataccagttatacagtcacggtggtgcctgtgtatacagaaggtgacggaggacgtacttccgataccggcagaacgcttatgcgagggctggcgaggaacgtgcaggtctataaccctactcccaatagcttggatgtgaggtgggatccagcgcccgggccagtgctccagtatcgcgtggtttactccccggtcgatggtacccgcccaagtgaatctatcgtggtgccaggaaacactaggatggtccatcttgaacggctcattcctgacaccctctactcggttaatttggtggccttatattctgacggggagggcaaccctagtccggcgcagggcagaacactgcccaggtccggcccccggaatctgcgagtctttggcgagacgacaaattcactgagcgtggcttgggaccatgcggacggcccagtccagcaatatcggattatctactcaccaaccgtgggcgaccccatcgatgagtacaccactgtcccaggaaggagaaataacgtaatcctacaacctctccaacccgacactccctacaaaatcaccgtcattgcagtctacgaggacggtgatggtggccatctcacgggtaatggtcgaaccgtcggcctgttgccgccacagaacattcatatatctgacgagtggtacacccggtttcgcgtgagctgggatcccagcccaagtcctgttttgggttacaagatcgtgtacaagcccgtgggcagcaacgagcctatggaggcgtttgtaggcgaaatgacttcatacactctccataacctgaatccgagtactacctatgatgtgaatgtgtacgcccagtacgattcaggcctgtcggtgcccctgactgatcaggggaccaccctctacctgaatgtaaccgacctcaaaacataccagattggctgggatactttctgtgttaagtggagtccgcaccgcgcggccacgagctatagactgaagctgagcccagctgatgggacccgaggacaggaaatcaccgtacgcggatctgagacctcacactgcttcaccggcctctcccccgataccgactatggggtgacggtttttgtccagacgccgaaccttgaaggcccgggagtgtctgtgaaggagcacacgaccgtcaaaccgaccgaagcccccacagaacctcccacgccaccacctccaccaaccattcctcctgccagggacgtgtgtaagggggctaaagccgatattgtgtttctcacggatgcctcctggtcaatcggagacgataactttaacaaagttgtcaaattcatcttcaacacagtgggggggttcgatgaaattagccctgccggaattcaggtcagcttcgtgcagtattccgatgaagtgaaaagcgaattcaaactgaatacgtacaacgacaaagcgcttgcactgggggccctgcaaaatatcaggtatcgaggtgggaatacacgcacaggcaaagctctaacatttattaaagagaaggtattgacatgggagtccggaatgcggaagaatgtcccaaaagtcctcgtggttgtgacggatggacgtagtcaggacgaagtgaagaaagccgcactcgtaatccagcaatctggcttttcagtgttcgtggtcggtgtggcggatgtggattataacgagttggccaacatcgcatccaaacctagtgaaagacatgtgttcatcgtggatgattttgaaagctttgaaaaaattgaggataacctaatcactttcgtgtgcgagacagccacctccagctgccccctgatttatttagacggctacacctctccagggtttaagatgttagaggcttacaacctcacggagaaaaacttcgccagtgtccagggggtcagtcttgagtccggctcttttccaagctacagtgcctaccgcatccagaaaaatgccttcgtgaaccagcctacagccgatctgcacccgaatggactgcctcctagttacactataatccttcttttccggcttttaccagagactcccagcgacccctttgcaatatggcagataaccgatagagattataaaccgcaggtcggagtgatcgccgacccaagtagcaagacactttctttcttcaacaaagatactagaggtgaagttcagactgttacgtttgacacagaggaagtgaaaaccttattttatggcagctttcataaggtccacattgtagttacttcaaaaagtgtgaaaatctacatcgactgctacgagattattgaaaaggacattaaggaggccggcaatattaccaccgatgggtacgagattctgggtaagctgttaaagggcgaaaggaagtctgccgcctttcagatacagtcttttgatatcgtttgcagtccagtctggacctcaagggatagatgttgtgatattcccagtcgaagggatgaaggaaaatgccccgctttccctaactcatgcacttgcacacaggacagtgttggcccgcctggaccccctgggcccgccggagggcctggcgctaaaggtccgaggggcgaacggggtatcagtggggcgattggacctcctggtccaagaggagacattggtccccctgggcctcagggtccacctggacctcagggtcccaacggcttgagcattcctggcgagcagggaaggcagggcatgaaaggcgacgccggagagcccggtcttccaggacggacaggcacacccggcctgccaggccctcccggccctatgggaccacccggcgaccggggctttaccgggaaagacggtgcaatgggcccccggggtcctcccggaccacccggctctccaggcagccccggggtcaccgggcccagcggtaagcctggcaagcccggcgaccacggcagacccggccctagcggcctaaagggcgaaaaaggcgacaggggcgacattgcctcccaaaacatgatgcgagcagttgctcgtcaggtgtgcgagcaactgatcagcggacagatgaaccggttcaatcagatgctgaaccagatcccgaacgactaccagtcgtcccgcaaccagccaggcccacccggccctcccggaccacccggatcggccggggccaggggagaacctgggcccggcggtcgacccggtttccccggtaccccgggaatgcagggaccgcccggcgagcgaggcctgcctggtgagaagggtgagcgtggaacagggtcctcaggccccagggggctgcctgggcctcccgggcctcagggcgagtcacggaccggcccacccggatctacaggcagtcggggaccccctggacctccaggtcggcctggcaatagcggaatcagagggccacctgggccaccaggctactgcgactcttcccagtgcgcgtcaataccatataacggacagggctaccccggctcaggctag

SEQ ID NO: 4067 - DNA, 8964 bp, Artificial Sequence
  Description of Artificial Sequence: Synthetic coding sequence
atgcggagccggctgccccccgccctggccgccctgggcgccgccctcctattgagctctatcgaagcagaggtggaccctccctccgacttaaacttcaagatcatcgatgaaaatacagttcacatgtcttgggcaaagccagtggacccaatcgttggctatcgaattactgtggaccccacaactgacgggcctacgaaggaattcacactatcagcaagtacgacagaaacactgctcagtgagttggtgccagaaacagagtatgtggtcactattacaagttacgacgaggtcgaagaaagcgtacccgtgattggccagctgacaatccagacaggatcatctactaagccagtcgaaaagaaacccggtaaaaccgaaattcagaaatgttctgtgagtgcctggactgacttagtatttcttgtcgatgggtcctggagtgtggggcgtaacaattttaaatatattttagactttatagcagctctggtctccgcgtttgatattggagaggaaaaaaccagagtgggagttgtccagtacagttccgacacccgcaccgagtttaatctgaatcaatactaccagagggacgagttactcgctgctattaaaaagattccgtacaaaggcggaaatactatgaccggagatgctattgactatctggttaagaacacgtttacggaaagtgccggagcgagagtcggatttccgaaggtggccattatcatcaccgacggcaaaagccaagatgaagttgagattcccgctagggagctgcgaaatgtcggggtggaagtattcagccttggaattaaggccgccgatgctaaagagctgaaacagatcgctagtaccccaagtctgaaccacgtgttcaatgtggccaatttcgatgcaatcgtggacatccagaacgagatcatctcacaggtctgcagtggcgtggacgagcagctgggtgaactggtgagcggggaagaagttgtggaaccaccaagtaacctaattgccatggaagtgtctagtaaatatgtgaaactgaactggaaccccagcccctcgcctgttacagggtacaaggtgatcctgacacccatgacagctggatcccggcaacatgcgttgtctgtgggaccgcaaaccacaacgctgtctgttcgggatctgtccgctgacacggaataccagattagcgtaagtgctatgaagggtatgacgagttccgaaccgatttcgatcatggaaaagactcagccgatgaaggtgcaggtggagtgtagccgcggagtggatattaaagcggatattgtgtttttagttgacggatcctattccatcggaattgccaacttcgtcaaggtacgggcctttctggaagtcctcgtaaagagctttgagataagcccaaatcgagtccagattagcctcgtgcaatattcacgggatccccacaccgaatttaccctgaagaagttcacgaaggtggaggatataattgaggcgattaataccttcccttatagaggaggctccacaaacactggaaaggcgatgacatacgtccgggaaaaaatttttgtgcccagcaaaggctccagatctaatgtccctaaagtcatgatcctgataacggacggtaagagcagtgacgccttccgggatccagcaattaagctacggaacagcgatgtagaaatcttcgcagtgggagtgaaggacgcagtaaggtccgaacttgaggctatcgcgtctcccccagccgaaactcatgtcttcaccgttgaggactttgacgcatttcagcgcatctcttttgagctcacgcaatctatttgtttaaggatcgagcaagagttggcagccattaagaaaaaagcttatgttcctcctaaagatctctccttcagtgaggtgacctcctacggattcaagacgaactggagccccgcaggcgaaaacgttttctcatatcatattacttacaaggaagccgcaggggacgacgaggtaaccgtggtggagccagctagttccaccagtgtggtgctttcgagcctgaagccagaaacactgtatctggttaacgtgacggccgagtatgaggatggtttttctatcccactcgctggggaagagacaaccgaggaagtgaaaggggctcctagaaacctgaaagtcacagatgaaactactgacagcttcaagatcacttggacccaggcacccggtagagtgctccgctaccgcatcatttatcggccagtcgctggcggggagtctcgggaagtgacaactcctcctaaccagaggcgcaggacgctggaaaacctaatccctgataccaagtacgaggtctcggtgattccagagtatttctcaggtccaggaacccccctgaccgggaatgccgctacggaggaagttcggggtaaccccagagatttgagggtctcagatcccaccacctccactatgaaactgtcatggagcggcgcaccaggcaaggtcaaacaatatctagttacttacaccccagtggccggcggagaaacacaggaggtgactgtcagaggggatacaaccaatactgtgttgcagggactgaaagagggaactcagtatgcactgtcagtgacggcactttatgctagcggcgcaggtgacgctctctttggggaggggactacactcgaggagcggggatcaccacaggacttggtaaccaaagatatcaccgacacctctattggagcctactggacttcagccccagggatggtgcgtggttatcgagtttcttggaagtctctctacgacgatgtggataccggtgagaaaaacctccccgaggatgcaatccataccatgatagaaaacttacaaccagagaccaaatacaggatctccgtctttgcgacatattctagcggcgaaggcgaacccctcactggagatgccacgacggaactgagccaggatagcaaaaccctgaaagttgatgaggagacagaaaatacgatgcgggttacctggaagcccgcaccaggtaaagtggtgaattatagagttgtatatcggccacatggacggggaaagcaaatggtggccaaggtgcctcccacggtgacgagtaccgtgctcaagagactccaacctcagaccacttacgacatcacagtgctgccgatctacaagatgggggagggcaagctccgacagggttctgggaccacagcttcccgtttcaagtcccctcgtaacctgaaaacgtctgatcccactatgtcctcctttagagtcacatgggaacctgcacccggcgaagttaaggggtataaagtgacgttccaccctacaggagacgatcggcgtctcggagagctggtggtgggtccttacgataataccgttgtgttggaggaactgcgggccggcaccacgtacaaggttaatgtcttcgggatgttcgacggaggcgagtcctctccattggtgggacaggagatgacaacactatctgacacaacagtcatgccaatactttcaagtggaatggaatgtctaactagagcagaagccgatatcgtgctcctggtggatggttcctggtccataggccgggccaacttccgcactgtccgtagttttattagtagaatcgtagaagtttttgacatcggcccaaagagagtgcagattgcattggctcaatactctggggatccccgcacagaatggcagttgaacgctcatcgtgacaagaagagtctgctccaggctgtggccaacctcccatataaaggggggaatacgctgacgggcatggcgttgaacttcatcagacagcagaactttcgaacacaagcggggatgaggccacgggcccgcaagattggggtcctgattactgatgggaagtcccaagatgacgttgaggcgcccagcaaaaagttgaaggatgaaggagttgagctttttgccatcggaattaaaaacgccgatgaagtggaattgaaaatgatagccactgatcccgatgatactcacgcctacaatgtggctgacttcgagtcactgagccgcatagtcgatgatctcaccatcaacttgtgcaattctgtgaagggcccaggcgatctggaggccccatcaaatcttgtaatctccgagcggacccatcggagctttcgggtctcctggactccgccctccgactccgtggatagatataaggtggagtactaccccgtgtcaggagggaaacgacaggaattttacgttagccggatggaaacctctacagtcttgaaagatcttaagccagaaacagagtatgtggtgaacgtgtactccgtcgtggaagacgaatatagcgagccactaaagggtacagaaaagacgctcccagtgccggtggtttcgctgaatatctatgatgtagggcccaccaccatgcacgtgcagtggcaaccagtgggcggggccacaggctacatcctgtcctacaaaccagtcaaagacactgaacctaccaggccaaaagaggttcggttgggaccgacggtcaacgacatgcaactaactgatctagtgcccaacactgagtatgctgtcaccgtgcaggccgtgctgcatgacctgacatccgaacccgttaccgttcgtgaagtgactcttcctctgccaaggccacaggatctgaaacttcgtgatgttacgcactctacaatgaacgtattctgggagccagtgcctggcaaagttcgaaagtatatcgtccgttacaaaactccagaggaggacgtgaaagaggtcgaagttgaccgtagcgagacgagcaccagcctgaaggatctgtttagccagaccctgtatacagtttctgtatctgccgttcatgatgaaggtgagtcacccccggtaaccgcacaggagaccacaagacctgtgccagctcccactaacctcaagatcacagaagtgaccagcgaagggtttaggggaacgtgggaccacggggcctccgacgtgtcactttatcgtattacttgggccccattcggctctagtgacaagatggagaccatcctgaacggcgatgaaaacaccctggtgttcgaaaacttgaatcccaataccatctatgaggtgtctattaccgccatctatcccgatgaatccgagtccgatgatttaatagggtctgagagaaccctgcctatattgactactcaggctcccaaatctggccccaggaatctacaggtctataatgcaacttctaatagtctcaccgtcaaatgggatcccgcctctgggagggtccaaaagtaccgaataacctaccagcctagcacaggggaaggtaatgagcagactaccaccataggtggacggcagaattcggtggtccttcagaagctgaaacccgacaccccatacaccatcactgtgtcgtccctgtacccagacggagagggaggacggatgactgggaggggcaaaaccaagcccttaaatacagtcagaaacctcagagtctatgatccatctacctctactctcaatgtgcgatgggaccatgctgaagggaaccctcggcagtacaaactattctacgcacccgccgccggaggtcccgaagaattagttcctattcccggaaatacaaattatgcaatcctcagaaatctgcagccagacacatcttacactgtgaccgtcgtgcctgtctacacagaaggagatggaggccgaacaagtgacaccggtcgaaccctgatgcgggggcttgccagaaatgtccaagtctacaaccctacaccgaactccctcgacgttcgctgggatccggctccggggcccgtattgcagtacagggtcgtctactcgccagtggatggcactcgccccagcgagtccattgttgtcccaggtaatacacgcatggtgcacctggaacgcctgattcccgacacgctgtacagtgttaatttggttgcgctttattcagacggggaggggaatccttctcccgcccagggtcgaactcttcctcgctccggtcctaggaacctgagagtcttcggggagactaccaattcattgagcgtagcatgggaccatgcagacgggcccgtgcagcaatatcggatcatctactcccctaccgtcggggaccctatcgatgaatacacgaccgtcccggggcggaggaataacgtgatactccaaccactgcagcccgacacgccatacaaaattacagtgatcgctgtgtatgaagacggcgacggcggacatctgaccggtaacgggcgaactgtggggcttctcccacctcaaaacatacacatatccgatgaatggtataccagatttagagtgtcatgggacccctcccctagccctgtcttggggtacaagatcgtctataagccagttggaagtaatgaacccatggaggcttttgttggggagatgacgtcatatacactgcataaccttaacccttctacaacatacgatgttaatgtgtatgcgcaatacgattctgggctatctgtgcctttgactgaccagggcaccactttgtaccttaacgttacagacttgaagacctatcagattggatgggatacattttgcgttaagtggtcaccacatagggccgctacctcataccgactgaaactttcgcccgccgacggcacaaggggccaggagattactgtacggggaagcgagacttcgcactgttttacagggttgtctcccgataccgattatggtgtcaccgtgttcgtgcagactcccaatttagagggtcctggggtgagcgtcaaggaacatacgactgtaaagcccacagaggctccaacagagccacctacaccaccaccccctcccaccatcccgcccgcacgggacgtatgtaagggggcaaaggccgacattgttttccttaccgatgcctcctggtctatcggggacgacaactttaacaaggtcgttaaatttatcttcaataccgtcggagggtttgacgagatctccccagctggaatccaggtgagcttcgtgcagtactcggacgaggtaaagtctgaatttaaactaaatacctataacgacaaagcgctggcccttggagccctccaaaatatccggtaccgagggggtaacacacggacaggtaaggccctaacattcatcaaagagaaggtgctcacgtgggagagcgggatgagaaagaatgttcctaaggtactggtcgttgtgacagatggccggagtcaggacgaagtgaagaaagcggcactagtaatccagcagtctgggttttctgtattcgtcgtcggcgtggcagacgtcgattacaacgagctcgctaatatcgcctctaaaccatccgagcgacacgtcttcatcgtggacgatttcgagagttttgaaaagattgaagacaacttgatcacctttgtgtgtgagaccgctacatcctcatgtccccttatctatctggatggttacacctcgcctgggtttaagatgttagaagcctacaacctcactgaaaagaattttgccagtgtgcagggcgtgagcttagaaagtggaagctttccaagctattctgcttataggattcagaaaaacgcgttcgttaatcagccaacagccgaccttcatcccaacgggttgccaccctcctacacaattatactattgttccgactgttgcccgaaacacccagtgacccatttgccatctggcagattaccgatagagattacaaacctcaggtcggagtgattgccgacccatctagtaagacgctttcattttttaataaggatactagaggggaagtgcagaccgttacattcgatacagaggaggtgaaaacactgttttacggatcgttccacaaaagagacgagggaaagtgcccagcgttcccaaattcttgcacatgcacacaggactccgtcgggcctcccggtccacctggacccgccggaggacccggggccaaaggtccaagaggggagaggggcatcagtggagcaatcggtcccccaggccctcgcggggatattggcccaccaggtccacagggaccccctggaccccagggacccaacgggttgtcaattcccggagagcagggcaggcaaggaatgaaaggggatgcgggggaacccggcctcccaggcaggaccgggactcccgggttgcccggtcctccagggccaatgggacccccgggcgacaggggctttacaggtaaggacggagccatgggccccagagggccacctgggcctcccggcagccccggaagccctggcgtgacaggccccagcggcaagcctggtaaaccgggtgaccacggacgtcctgggccgtctggattgaaaggagagaaaggggaccgcggggatatagcatcccaaaatatgatgcgtgcagtggccaggcaggtgtgcgaacaactgatttcggggcaaatgaatcgattcaatcagatgctaaaccagatcccaaatgattatcaatcttctagaaaccaacccggccccccaggcccaccagggccaccgggctctgcaggagcgaggggcgaacctgggccaggggggcgcccaggcttcccgggcacccccggcatgcagggcccacctggagagagggggctgcccggggaaaagggagagcgggggacgggctccagcggacctaggggcctgccaggacctccaggaccgcagggagaatcaagaactggccctccgggatccaccgggtccagagggccccccggccctcccggccgaccgggcaattctggcatccgcgggcctccaggcccacctgggtattgtgattctagtcagtgtgcctcgattccctacaacggacagggataccccggctctggctag

SEQ ID NO: 4068 - DNA, 2088 bp, Artificial Sequence
  Description of Artificial Sequence: Synthetic coding sequence
atggtggccgagcggacccacaaggccgccgccaccggcgcccgggggccaggcgagttgggagccccgggaacggtagctttggtcgccgcccgcgccgagaggggagcccgactcccaagtcccggtagttgtgggcttctgaccctggcattgtgtagcctcgctctatcgctgctggcacatttccgtacagcggaacttcaggctcgggtactgagactggaggcggagaggggcgaacagcaaatggaaacggctatacttgggcgggtcaaccagttgctagatgaaaagtggaagctgcacagtcgacggcgtcgggaggcccctaaaactagtccaggctgtaactgccctccaggcccaccaggacctactgggcgacctggactccctggggataagggggctatcggtatgcccggaagggtaggttcacccggtgacgctgggttgtccatcatagggcctcgtggaccacctggacagcctggtacaaggggcttcccagggttcccagggcctataggactggatgggaagccaggacatccgggccccaagggcgatatggggttaacagggcctcccggtcaaccagggccacagggccagaagggcgagaagggacagtgtggcgagtacccccaccgcgagtgcctgtcatcaatgccagcagccctgaggtcttctcagatcattgccctgaaaggcgaacaaagtcaggccagcatacaaggacctcctgggccccccggaccgcccggtccctcaggtcctctgggccaccccgggctgccaggtcccatggggccccctggtcttcctgggccacccggtccaaaaggggatcctggcattcagggctaccacggaagaaagggcgagcggggtatgccaggaatgcccggaaaacacggggcgaaaggagctccaggtattgcggtagctggtatgaagggcgaaccgggtataccaggaacaaagggggagaagggcgccgaggggtcacctggcctccccggactactgggacagaagggggagaaaggggacgccggcaactctataggggggggacgaggtgaacccggccctcccggacttccgggccccccagggcccaaaggcgaggcgggggttgacggacaggtcggcccccccggtcagcctggcgacaaaggagagcggggagccgcaggtgaacaaggtccggatggccccaagggctctaagggtgagccaggtaagggagagatggtggactacaatgggaacattaacgaggccctccaggagatccgtacactggctctgatgggtcctcctggactaccgggccagatcgggccgccaggcgctcccggaatccctgggcagaaaggtgagatcgggttaccaggcccacccgggcatgacggggaaaagggacctcgggggaagcctggggacatgggaccaccaggaccccagggaccccctggcaaagacggcccaccaggagtgaagggcgaaaatgggcacccggggtcaccaggggagaagggtgaaaaaggcgagactggacaggcaggaagccccggcgagaaaggggaagccggcgaaaaagggaaccccggggcggaggtccctggtctgcccgggccggaaggtccacctgggcctcctgggctacagggggtccctggtccaaaaggtgaagcaggcttggacggcgccaagggtgaaaagggatttcagggggagaagggagatcgtggccccctcgggctgccgggcgctagcggtcttgacggacggcctggccctcccggcaccccaggacccatcggagttccagggcccgctggacccaagggggaacgcgggagtaagggcgaccccggcatgacaggtcccacaggagcggctggcctgccaggcctacacggacctcctggcgacaaaggaaacagaggcgaaagagggaaaaaggggagtcgaggtcccaagggagataaaggcgaccagggggctccagggctcgacgcgccctgtcccttaggggaggatggtctccccgtgcaagggtgttggaacaaatag

SEQ ID NO: 4069 - DNA, 2154 bp, Artificial Sequence
  Description of Artificial Sequence: Synthetic coding sequence
atggtggccgagcggacccacaaggccgccgccaccggcgcccggggcccaggtgagcttggggccccgggaaccgtggcccttgttgctgcccgggctgagaggggagcaaggctgcccagcccaggctcttgtgggctcttaaccttggcgttgtgctctctcgcactgtcactgcttgcccatttcaggaccgccgaactccaggcccgggttttaaggctggaggccgaaaggggagaacagcagatggaaacagctatactggggcgcgtcaaccagctgcttgacgagaaatggaaactgcattctcgacgccggagggaagccccaaagactagccctggctgcaactgcccacccgcttttcaggggcctaccggtaggccgggactccctggcgacaagggggccataggcatgccagggcgagtcggatctcctggtgatgctggcctgtccattattggcccacgcggaccacccggccagcccggcactcggggatttccaggtttccccggacccattggtctagacggtaaaccggggcatccaggcccaaaaggtgatatgggacttaccgggcctccagggcagccggggccacaaggccaaaaaggagaaaaagggcaatgtggggaatatccacaccgagaatgtttatccagcatgcctgccgcactccggtcaagtcaaattatcgccctgaagttactccccctattaaatagcgtgcgcctcgcaccacccccagtcataaagagacgcactttccaaggtgagcaaagccaggcttctattcagggtccaccaggaccaccaggccctccgggtccttcagggcctctcggtcacccaggcctgccaggaccgatgggcccgcctggtctcccagggccacccggtccaaaaggcgatccaggaattcagggctaccacggccgcaagggcgagcgcggaatgcctggcatgcccgggaaacacggcgccaagggtgcacccggcatcgcggtggcaggcatgaagggcgaaccaggcattcctggtactaaaggggagaagggcgccgaaggaagccctggcctgccaggactgctcggtcagaagggcgagaagggggacgccgggaactccatcggcgggggccggggggagccaggccctcctggcctgccgggaccccccgggcccaaaggggaagccggagtcgatgggcaggtgggccctccaggtcagccaggcgacaaaggggagaggggcgccgccggtgagcagggaccggacggcccaaagggaagcaaaggggagccagggaaaggtgaaatggttgactacaatggaaatattaatgaggccctccaggaaatccgcacgctggctttgatgggaccacctggactcccaggccagattggcccccctggagcccctggtatccctggtcagaagggcgaaattggcctccccgggcctcctggtcacgatggggagaaagggccgcgtgggaagcccggagatatgggaccaccagggcctcaggggcctccgggaaaggacggacccccaggagtcaaaggagagaacggacatcccggaagtccgggcgaaaagggcgagaagggggagaccggccaggctggttcaccaggggagaagggggaggcaggcgagaagggcaatcccggggctgaagtccctggtctgccagggcctgaaggaccccccgggcctcctggacttcagggggtacccggacccaagggcgaggccggtctggacggcgccaaaggtgagaagggattccaaggggaaaagggggatcgcggccctctgggtctgccgggcgcctcgggcctggacggtcgccccggtcctcccggaactccaggccccattggcgtccccggacctgcgggacccaagggtgagcgcggcagcaaaggcgatccggggatgaccgggcccactggggctgctggccttcccggtctgcatggcccgcccggtgataagggcaaccgcggcgagcgtggcaaaaaaggttcccgggggccgaagggcgacaaaggggatcagggcgctccagggcttgatgcgccttgcccacttggcgaagatgggttgccagtgcagggctgctggaataaatag

SEQ ID NO: 4070 - DNA, 2052 bp, Artificial Sequence
  Description of Artificial Sequence: Synthetic coding sequence
atggtggccgagcggacccacaaggccgccgccaccggcgcccgggggcccggagaactgggggctcctgggacagtggctctcgtggcggcacgcgcagaaaggggagcccgcctaccttccccaggatcttgcggcctgttgacactggccctgtgctctctggccctcagcttgctggcccacttccgcactgcagaactgcaggctcgcgtgctacgtctagaggcggagagaggcgaacagcagatggagacagccatcttgggccgagtgaatcaactgctcgacgagaagtggaagctgcatagcaggagaaggagagaagcgcccaaaacttccccaggctgtaactgccccccaggacctccgggacccactggcaggcctggcctgccaggtgataagggcgcgatagggatgcctggccgggtgggatctcctggcgatgctgggctatcaataatagggcctagaggccctccaggccagcccggaacccggggatttccaggattcccgggtcctattgggttggacggcaaacccggtcaccccggacccaaaggcgacatgggcttgacaggaccccctgggcagccagggccccaggggcaaaaaggagagaagggacagtgtggggaatatccgcatcgggaatgtctgagtagcatgccagccgcactgcgaagttctcagatcatagctctgaaaggtgagcagagccaagccagcatacaagggcctcccggaccccccggtccacctggcccaagcggtcctctgggccaccccgggctccccgggcctatgggtccgcctggtctaccaggccccccagggccaaagggggatcctggaatccagggttaccatggcagaaaaggcgagcgagggatgccgggcatgccagggaaacacggcgcaaagggcgctccggggatagctgtggctggaatgaagggagagcccgggatcccaggcacgaaaggagagaagggggcggaagggagtcctgggctgccaggactcctgggacaaaagggcgaaaagggtgatgccggaaactccatcggaggcggcaggggagaacccgggccacctggccttccaggcccccccggtcctaaaggcgaggcaggggttgacggtcaggtcggtccaccaggacaaccaggagataaaggggagaggggggcggcaggggaacaaggaccagacggacctaagggaagtaagggcgagccggggaaaggggaaatggtggactataatggcaacattaatgaagcccttcaggaaatcagaacactagcactcatgggtcctcctggtctgcccgggcagatcggtccccctggtgccccaggcatcccagggcagaagggcgagatcggtctcccggggcctccagggcacgatggagagaagggcccaagaggaaagccaggagatatgggcccccccggaccccaaggccctccaggaaaagatggcccacctggagtcaagggcgaaaacgggcatcccgggagcccaggtgagaaaggtgaaaaaggcgagaccggacaggccggatcacccggcgaaaaaggagaggccggcgaaaaagggaatcccggagccgaagtgcccgggctgcccgggcctgagggaccacccggtcctccaggactgcagggcgtcccaggcccaaagggggaggccggcctggatggggccaagggtgaaaagggctttcagggtgagaaaggtgacagaggtcctttaggactccccgggacccccggccccatcggagtgccaggtcctgcgggccccaaaggcgagcgagggtcaaaaggtgatcccgggatgactggacctacaggagccgccggtctccccggcctgcacgggccccccggtgacaaaggtaaccgaggtgagaggggtaagaagggctcgaggggcccgaagggcgacaaaggagaccagggggctcccggattggatgcaccttgtcctctcggagaggacgggctgcctgtccaggggtgctggaacaaatag

SEQ ID NO: 4071 - DNA, 2067 bp, Artificial Sequence
  Description of Artificial Sequence: Synthetic coding sequence
atggtggccgagcggacccacaaggccgccgccaccggcgcccggggaccgggagaactcggagctccggggaccgtcgccctggtcgctgcacgggcggaacggggtgcacgactgccctcccccgggagctgcggtcttttgacattggccctgtgcagcctggccctcagccttctggcacactttaggaccgccgagctccaggctcgcgtgttgaggttagaggccgaaaggggagagcagcagatggagactgccatcctgggaagggtcaatcagctgttagatgagaagtggaaattacactccaggaggcggcgagaggccccgaaaacaagccctggctgcaattgcccgccagcattccagggccctacgggccgcccagggctcccaggccaacccggtacaaggggcttcccgggatttcccggccccataggccttgacggaaaacccggtcaccctggtcctaaaggagatatggggttaactggaccacccggccagccaggtcctcagggtcagaaaggcgagaagggacagtgtggggagtaccctcaccgagaatgtttatcatcaatgcccgctgcgctgagaagctcacagatcattgctttgaaactgctgcctctcctcaactcagtgcgattggcaccgcccccggttatcaagcgacgaactttccaaggtgagcagagccaggccagtattcagggaccccccggacctccaggcccacccgggccctcgggccccctcgggcacccaggccttccagggcctatgggacccccagggctccctgggcctcctggtccaaaaggtgacccaggaattcagggttaccacggtagaaagggcgagaggggtatgccaggtatgccgggcaaacatggcgccaagggagctcccggcatcgccgtagcgggtatgaagggtgagcctggtattccaggtactaagggcgagaagggcgccgaaggatctcctgggttgcctggcctcctgggccagaagggagaaaaaggcgatgccggtaactctatcggtggcgggagaggggagcctggacccccaggactgccagggccgccaggcccaaagggggaagctggggtggatggacaggttgggcccccaggccagccaggtgacaaaggggaaaggggtgccgcaggcgagcaaggccctgatgggcccaaaggttcaaaaggagagccaggaaagggagagatggtcgactataatggaaacatcaatgaggccctgcaggagatcagaaccctagcccttatgggtcctcctggacttcccggtcagattggtcctccaggcgcccccggtattccgggacagaaaggcgagattggtctgcctggcccccccggccatgacggtgaaaaagggcctcgaggcaaacctggtgatatgggccctccgggccctcagggcccccccggaaaggacggccccccaggagtaaagggggaaaacggacaccccggctctcccggtgagaaaggcgagaaaggggaaaccggccaggctggcagccccggcgaaaagggcgaggcgggggaaaagggaaatcctggtgccgaagtgcctggcctgccaggcccagagggcccacccggccccccaggccttcagggagtacctggccccaaaggtgaagccggcttggacggcgccaagggagagaaggggttccagggagagaagggcgacaggggaccgctcggcctgcccggtgccagcggtttagatgggagacccggcccccccggaacccccggacccataggagtaccggggccagccggacccaagggcgagaggggttcgaagggggatccaggcatgacaggccccaccggggctgcgggtcttcccggcttacacggccccccgggcgataagggcaataggggcgagagaggaaaaaaagggagcagagggcctaaaggagacaagggggatcagggcgcccctggattggacgccccatgccctttaggcgaagatgggctgcccgtgcaggggtgctggaacaagtag

SEQ ID NO: 4072 - DNA, 2088 bp, Artificial Sequence
  Description of Artificial Sequence: Synthetic coding sequence
atggtggccgagcggacccacaaggccgccgccaccggcgcccggggccccggcgagctcggggctccaggtacagtggcacttgtggctgcgagggcagaacggggcgctcgcttgccatcccccgggtcctgtggcttactgaccctcgcactctgtagcctggccctgagcctgctggcccactttcggacagcagagctccaggcccgagtgctgaggctggaagcagagcggggcgaacagcagatggagaccgccattttaggtagggtgaaccagcttctagatgaaaaatggaagttgcattcccgccgccgccgggaagctcctaaaacaagccccggctgcaactgccctcctgcctttcagggaccaaccggccgccccggcctgcccggcgataaaggggccataggaatgccaggcagagtcgggagtccaggtgatgcggggctgagtatcataggacctcgtgggccaccaggccagcctgggaccagaggatttccaggtttcccagggcctattggactagatggcaagcctggccaccctggaccaaagggcgacatggggctaaccggccctcctggccaaccgggaccgcagggtcaaaagggcgaaaaaggccaatgtggcgagtaccctcacagagaatgtctttcatccatgccagccgccctgaggagtagtcagatcattgccttgaagggagagcagagccaggctagcatccaaggcccgcccggacctccaggccctcccggaccatcaggaccactgggacacccaggtcttcccgggcccatgggccctcctggattacccggaccgccgggtccaaaaggggatccaggtattcaagggtatcacggaagaaaaggggaaaggggcatgccggggatgcccgggaagcacggggcaaagggggctccaggaattgcggtcgcagggatgaaaggtgaaccgggcatcccaggcacaaagggagagaagggggccgagggatctcccgggctgcccggacttttgggacagaagggcgagaagggcgacgcaggaaactcaattggcggggggcggggagagcctgggcccccaggcctgccaggtcctcccggacccaagggcgaagccggggtggacggacaagtcggccctccaggacagcccggcgacaaaggtgaacgcggcgccgccggagagcagggcccggacggtcccaaaggctctaagggggagcctgggaaaggagaaatggtggactacaacggaaacataaatgaagccttgcaggaaatcaggactctggcactcatggggcctcccggcctgcctggtcagataggaccccccggggctcctggcattccaggtcaaaagggcgagatcgggctccccggtcctccgggacacgacggtgagaaaggaccaagagggaagcccggcgacatgggacctcctgggccgcaggggccacccggaaaggacggaccaccaggcgtcaagggcgaaaacggtcatcctggctctccaggagagaaaggcgagaagggggaaaccggacaggccggctctcccggagaaaagggagaggccggagaaaaaggaaaccctggagcagaggtgcctggtctgcccggaccggaagggccaccaggcccgccaggcctgcagggcgtacccggccccaaaggtgaagccggactcgatggcgccaaaggggagaaaggatttcaaggtgaaaagggggatcggggcccgctcggcctccccggagcatcaggcctagacgggaggcccgggccacccggcacccctgggccaattggcgtgccaggcccagccggaccaaagggtgaacgcggcagcaaaggggatccaggaatgaccggacccactggtgccgctggacttccgggattgcatggaccccctggagataaagggaatcgcggtgaacgcggaaaaaaaggctctcggggaccgaagggcgataaaggagatcagggagcccctggtctcgatgctccctgccctttgggggaagatggcctgcccgtgcaggggtgctggaacaaatag

SEQ ID NO: 4073 - DNA, 2097 bp, Artificial Sequence
  Description of Artificial Sequence: Synthetic coding sequence
atggtggccgagcggacccacaaggccgccgccaccggcgcccggggccctggcgaactgggcgctcccgggactgttgctctcgtggctgcacgcgctgagagaggcgctcgcttacccagtcccggatcatgcggactgctgacactggcgctgtgctcattggccctgagcctgctggctcactttagaaccgcagaattgcaggccagagttctgagactcgaggcagagaggggcgaacagcaaatggagaccgccattttggggcgggtaaatcagctccttgacgagaagtggaagctgcattcgcgccgtagaagggaagctccgaaaaccagcccgggttgcaactgtccgcccgcgtttcaggggcctaccggtcgccctgggttgcccggggacaaaggtgccattggtatgccgggcagggtgggcagcccaggcgatgccggtctttctatcatagggccccgcgggcctcccggccagcctggaacaaggggattccctggctttcccggtccaatcgggttggacggcaagcccggtcacccggggcccaaaggcgatatgggcttgaccggacccccgggccagccgggaccccagggtcaaaagggagaaaaaggccagtgtggggagtatccacaccgactgctgccactactaaactcagtgaggctcgcccctccacctgtgatcaaaagaaggacattccagggagagcaaagtcaagcctctattcaaggaccccctgggccccctgggccacccggaccatcaggacccctcggtcaccccggactgccggggcctatgggtccccctggcttgccaggcccaccgggacctaaaggagaccctggaatccaaggataccacgggagaaaaggagagcgtgggatgccgggcatgccgggtaagcatggggccaaaggagccccaggcatcgctgtcgcgggcatgaaaggcgagcctggaatacccggtacgaaaggggagaaaggtgccgaagggagccccgggctgcctggtctgctggggcagaagggcgagaagggagacgctggaaactcaattggcggaggacgcggcgaacccggtcctccagggctgcccggaccccctggccctaaaggcgaagccggcgtcgacggccaagtcggccctcctggccaaccgggcgacaagggagagcggggggctgcaggcgagcagggccccgatggacctaagggatcaaagggcgaaccaggcaaaggggaaatggttgactacaacgggaatatcaatgaggcactccaggaaattcggaccctagcgttgatggggccaccaggccttccaggccaaattggaccgcccggagccccaggaattcccggccagaagggtgaaatcggactccctggacctccaggccatgacggcgaaaagggtccaagagggaagcccggggatatggggccgccaggccctcaagggccacctggcaaggacggaccaccgggggtgaagggagagaacggccaccccggtagccctggggagaaaggtgagaagggagagaccggccaggcgggaagccccggtgaaaaaggcgaagcaggcgaaaagggaaatcctggtgccgaagtcccagggctccctggcccagaaggaccaccaggccccccaggcttgcagggtgtgcctggccccaaaggagaagccggtctggatggagccaagggggaaaaaggttttcaaggggaaaagggcgatagagggcccctgggactgcccggagccagtgggcttgatggtaggcccggccctccggggacccctggaccaataggagtacccgggcctgctggaccgaagggcgaaaggggtagcaagggcgatccgggcatgaccggccctaccggcgcagctggcctgcctggacttcacggtccgccaggtgacaaaggtaatcgcggagagcggggcaagaaaggctccagggggcccaagggggacaagggtgaccagggcgcccccggactggatgccccatgtccactaggcgaggatggactgcctgtacagggttgctggaataaatag

SEQ ID NO: 4074 - DNA, 1938 bp, Artificial Sequence
  Description of Artificial Sequence: Synthetic coding sequence
atggtggccgagcggacccacaaggccgccgccaccggcgcccggggccctggcgaacttggggcgcccggtactgtagccctggtagccgctcgcgctgaacgcggtgcaagacttcccagtccggggtcgtgtgggttacttaccttggcactgtgtagcctagccctcagtttactagcccactttcgcactgcagagttgcaggcccgagtgctgaggttggaagccgaaaggggagaacagcagatggagactgccatcctcgggcgggttaaccaactgttggacgagaaatggaagttacactcacgccgccggcgcgaagctcccaaaacatctccaggctgtaactgcccgcctggacccccgggccaacccggcactcgaggcttcccggggttccctggtcccattggattagacggtaaaccgggccatccaggaccaaagggtgatatgggcctcaccggccccccaggccaaccggggcctcagggtcagaagggtgagaaggggcagtgtggcgaataccctcatcgcctgcttccactactcaattctgtgcgtctggcaccaccaccagttatcaagcgcagaacattccaaggcgaacagagccaggcctctatccaggggccacccggtccccccgggcctcccggaccctccggccccctcggacatcctggactgcctggaccaatgggtcctcctgggttgccgggcccccctggtccgaagggagaccctggaatccaaggctatcacggccgtaagggggaaagaggaatgcccggaatgccagggaagcacggcgccaagggggctcccggtattgcagttgccggcatgaaaggagaacccggaattccgggcaccaagggagaaaaaggggcagaaggatcacccgggttaccaggcctgctgggccagaagggcgagaaaggagacgctggcaattccatcggcgggggtagaggggagcctggcccacccggcctgccagggccccccgggcccaagggggaggcaggggtggatgggcaagtggggccaccgggccaacccggcgacaagggcgaacggggagctgccggagaacagggacctgatggtcccaaaggcagcaagggagagccgggaaagggagaaatggtggattacaacggaaatattaacgaagctctgcagccctctaggggacctgccctgcgcgggccgccagggttgccgggtcagattggaccaccaggagctccgggaatcccagggcaaaagggagagatcggtctgcctggtcccccaggccacgacggtgagaagggacctaggggcaaacctggcgatatgggtcccccaggaccccagggcccccctggcaaagacgggccccccggggttaagggcgaaaatgggcaccctgggagcccgggcgagaagggcgaaaaaggagaaacggggcaggccggatcacccgttcctggattacccgggcccgagggaccacctgggccacccggcctccagggagtccccggcccaaagggtgaggccggcttagatggtgccaagggcgagaaaggcttccagggggagaagggcgacagagggccattggggctaccaggggcgagtggtcttgacggaagaccagggccacccggcactccagggcctataggagtgcccggccctgctgggcccaagggcgaacggggaagtaagggcgatcccgggatgactggcccaacaggggcagcgggccttcctggattacatggacctccaggagataaggggaacaggggcgaaaggggcaagaagggtagcaggggacccaagggcgacaaaggagatcaaggcgcccctggactcgacgccccctgtcctttgggagaggacggcctgcctgtccaaggatgttggaacaagtag

SEQ ID NO: 4075 - DNA, 2109 bp, Artificial Sequence
  Description of Artificial Sequence: Synthetic coding sequence
atggtggccgagcggacccacaaggccgccgccaccggcgcccggggaccaggggagctgggcgcacccggaactgtcgctctggtggctgcccgggcagagcgtggcgctcgcctgccatccccgggcagctgcgggctgttgacgctggcactttgttcgttggccctctctttgctggctcattttagaacggcagagttacaggcaagggtgctcagactggaggctgagaggggtgagcagcaaatggagacagccattctcggccgtgttaatcagctgcttgatgaaaaatggaagttgcactcacgaaggcgtcgggaggcccccaaaacttccccaggctgtaactgtcctcccgctttccagggaccgacagggcgcccagggttgcccggagacaaaggcgcaattggcatgccggggcgggtgggctcccctggcgatgccggcctgagcattatcggtcctagaggtcccccagggcagccaggcacccgtgggtttcctggctttcctggacctataggcctcgacgggaaacccggccaccctgggccaaagggcgacatgggacttactgggcctcccggccagcctggaccacaagggcaaaagggagagaagggccaatgtggggaatatcctcatcgtgagtgcctttcctctatgcccgcagcactgcggagtagtcagattatcgccctcaagctcctacctctccttaatagcgtccgtctagcgcctcctccagtgatcaaacgaagaacattccaaggagaacagtcccaggcgtccatccagggcccacctgggccaccgggaccacccgggccgtccgggcctctgggacatccaggattgccagggcccatgggccctcctggccttcctggtccacccggcccaaaaggcgatcctgggattcagggttaccatggcagaaagggtgagcggggcatgcccgggatgcctggcaaacatggcgcgaagggggctccagggatcgcagtggctgggatgaagggcgagcctgggattccgggcactaaaggcgagaaaggagcagaagggtcaccagggctccccggcttgcttggacagaagggtgaaaagggggacgctggcaatagcatcggcggcgggaggggggaaccgggtccccccggactcccgggccccccaggaccgaagggtgaagctggcgtcgatggacaggtgggtcctcccggacagccaggtgataagggggagcggggagctgcaggcgaacagggaccagatggacctaaaggcagcaagggagaacctggaaagggggagatggtagattataacgggaacattaatgaggccttgcaggaaatcaggacgctggctttgatgggccctcctggtctaccaggccagattggccccccaggcgcacccggaattccgggtcagaagggcgaaatcggattgcctgggcccccaggacatgatggagagaagggacctagaggaaagcctggggatatgggtcctcccggaccacagggaccacccggcaaagacggacccccaggagtgaagggggaaaatggccacccagggtctcccggggagaagggcgaaaagggcgaaactggccaagccgggtcaccggtgccaggccttcctggacccgagggcccccccggcccccccggacttcagggggtgcccgggccgaagggagaagccgggttggatggggcaaaaggcgagaagggcttccaaggcgaaaaaggagaccggggacccctgggactgcccggggctagtgggctggacggacgacctggcccccccggtacacccggcccgatcggagttcctggtccagcaggccccaaaggggagcgcggaagtaaaggggacccagggatgacaggcccgaccggtgccgcaggcctaccaggtctgcacggcccacccggcgataaaggcaatcggggtgagagaggcaaaaagggttccagagggcccaaaggcgacaaaggtgaccaaggcgccccaggcctggacgctccttgccccctgggcgaggatggccttccagtccaaggatgctggaacaagtag

SEQ ID NO: 4076 - DNA, 2112 bp, Artificial Sequence
  Description of Artificial Sequence: Synthetic coding sequence
atggtggccgagcggacccacaaggccgccgccaccggcgcccggggcccgggcgagctgggagctcccgggaccgtcgccctggtcgccgctcgcgcagaaaggggcgctagactaccatcacccggatcttgcgggctgctgacccttgcgctgtgtagtctggctcttagcttactagcccactttaggacagctgagcttcaggcacgcgttctgcgcttggaagcagagcgcggcgagcagcagatggaaactgccatcctgggccgagtgaaccagctactggacgaaaaatggaagctccattccaggcggcgcagggaagctcccaagacctctccagggtgtaactgcccaccaggcccaccgggtcccacaggaaggcccggtctccccggcgacaaaggagctataggaatgcctgggagggtggggtcacccggggacgccggcctgtccatcatcggaccccgggggcccccagggcagcccggtacccgcggattccctggctttcctgggccaatcggcctggacgggaagcctggccatcctgggccaaaaggcgatatgggattaaccggaccccccggccagcctgggccccaggggcagaagggagaaaaaggacaatgtggggagtatcctcatcgggaatgcctgagctccatgcccgcggcacttcggagctcacagatcatcgcactaaagctgctgccactgttaaactcagtgcggctggcccctcctcctgtgattaagagaagaaccttccagggggagcagagccaggcctctatacaggggcctcccgggcctcccggtccgccaggcccgagtggtcccctggggcaccctggactcccgggtccaatgggacctcctggcctgcctggtccccccggccccaaaggcgatcccggcatccaggggtaccacggacgcaagggggagcgtgggatgccagggatgcccggaaaacacggggccaaaggagcccccgggattgccgtggcaggcatgaagggagaaccagggatacctggcactaaaggcgagaaaggggccgagggcagccctggtctgcccgggttgttaggccagaaaggtgagaagggagacgctggcaactccattggtggtggaagaggggaaccggggcctcctggactgcctggaccgcccggtcccaagggcgaagctggcgttgatggacaggttggacctcccggacaacccggagacaaaggggaaagaggcgctgcaggtgaacagggacccgatggccccaagggatcaaagggtgagcctggtaagggcgaaatggtggactacaacggtaatatcaatgaggctctgcagccttcgagagggcctgcccttagaggtccacctggtttgccagggcaaataggcccacctggtgcccctggcatcccaggccaaaagggtgaaatcgggttaccaggcccaccgggccacgacggagaaaaggggccccgggggaagcccggcgacatgggcccacccgggccccagggacctccaggaaaggatggcccccctggcgtgaagggggagaacggccacccaggaagccccggagagaagggagaaaagggggaaactgggcaggccggatcccccggagagaagggcgaggcaggcgaaaaaggaaatccaggcgcagaagggcttcagggcgtgccagggcctaagggagaggccggacttgacggtgcaaagggtgagaaaggttttcagggcgagaagggtgaccgagggcccttagggttaccaggtgccagcggattagatggtcggccaggcccccctggtacgcccggccctattggagttccaggacctgcaggtcccaagggggagaggggttcaaagggagatccaggcatgacaggacccaccggagccgccggactgcctgggctgcacggaccacccggagacaaaggaaacagaggcgaacggggtaaaaagggcagccgcggccctaaaggtgataaaggggatcagggtgccccaggtctcgatgcaccttgtcccctcggtgaagacggcctacctgtgcagggttgctggaacaaatag

SEQ ID NO: 4077 - DNA, 2076 bp, Artificial Sequence
  Description of Artificial Sequence: Synthetic coding sequence
atggtggccgagcggacccacaaggccgccgccaccggcgcccggggtccaggtgaactgggagccccagggacagtggccctggttgctgctcgggcggagaggggagcaaggctacccagcccaggctcatgcggccttctgacgctggctctctgttccttggcgctgagtctgctggctcatttccgcactgcagagctccaagcacgcgtgctaagactcgaggccgaaaggggcgaacagcagatggagactgccatcctgggtagagtaaatcagctactggacgaaaagtggaaactgcatagtcgccgaagaagggaagcacccaaaacgtccccagggtgtaactgtcccccgggcccgcccggtcccacagggcgacccgggctcccaggcgataagggggcgatcggcatgcccgggcgggtaggtagcccgggtgacgcagggctaagtatcatcggaccacgcggccccccaggccagcctggcacgaggggctttccaggcttccctgggccaatcggattagacggaaagccagggcacccagggcccaagggggacatgggactcacggggccaccaggccaaccagggcctcaggggcaaaaaggggagaaggggcagtgcggcgaatatcctcatcgggagtgcctgtccagtatgcccgcagccctgaggtcctcccaaataatcgcactcaaattattgcctcttttaaattcagtgcggctcgcacctccccctgtgataaagcggaggacgttccagggagagcaatcacaggcctctatccagggcccccccggcccaccaggcccaccgggacctagcggcccgttaggccaccctgggctgccagggcccatgggtcctcccggcctgccgggccctcccggacctaaaggggatcctggaatccagggctatcacggtaggaaaggagaacggggcatgccaggaatgccagggaagcacggggcaaagggggcccccggcattgccgtcgcggggatgaaaggggaacctggtattccggggactaagggcgagaagggcgccgagggcagtcccggcctcccaggactgttaggccaaaagggcgaaaaaggggacgcaggtaactcaattggaggggggcgcggggaacctggaccgcccggactccccggcccccccgggccgaagggcgaggctggagttgatggccaggttgggcccccaggtcaaccaggagataagggtgaacgaggagccgctggtgagcagggtcccgacggcccaaaaggaagcaaaggagagcccggaaagggggagatggtggattataacggtaacatcaatgaggcccttcagccctctcgggggcctgccttacgtgggcccccagggctcccaggacaaatcggaccccccggtgcaccgggaatacccggtcagaaaggtgagatcggccttccggggccgcccggtcatgatggagagaagggtccccgcgggaaacccggtgacatggggccccccgggccacagggccctcctgggaaagacgggcctccaggcgtcaaaggggagaacgggcacccaggcagcccaggcgagaaaggcgaaaagggcgagaccggccaagccggctcacccggggagaaaggggaggcgggcgagaaaggtaatccgggagcagagggactgcagggcgtgcccgggccaaagggagaggctgggctcgatggagccaaaggggagaaggggttccaaggcgagaagggagatcgcgggcccctgggcttgccgggtactcctggtccaatcggggtcccaggccctgccggccctaaaggcgaaaggggatccaagggagatcctgggatgacaggtcctactggtgccgcgggtctccccggtttacatggccccccaggtgataagggcaaccgtggggagcgcggaaagaaggggtctagaggccccaagggcgacaagggcgatcagggcgccccaggcctggatgcaccatgccccctgggtgaggacggcctgcccgtccaggggtgttggaataaatag

SEQ ID NO: 4078 - DNA, 2118 bp, Artificial Sequence
  Description of Artificial Sequence: Synthetic coding sequence
atggtggccgagcggacccacaaggccgccgccaccggcgcccgggggcccggtgagctgggcgcaccagggaccgtggccctcgttgctgccagagctgagaggggtgcacggctgccctcacctggctcttgcggcctcttgacgctggcgttgtgctctctggccctgagcctacttgcgcacttccgcactgccgaactgcaggctcgggtgcttcgactggaggccgagcgcggagaacagcagatggagaccgccattctgggccgggtgaatcagctgcttgatgaaaagtggaagctgcattcacgtcgcagacgtgaggccccaaagacctccccaggttgcaactgtccccccgctttccagggcccaaccgggcgcccagggctgccagggagccccggcgatgccggcctgtctataatagggccacgggggccacctgggcagcccgggaccaggggattcccgggcttccctggaccgatcggactggacggcaagcctggccaccccgggcctaagggcgacatgggcctgaccggacctcctggccagcctggaccacagggccagaagggagagaaagggcagtgtggcgagtacccacatcgggaatgcctttccagtatgccagcagccctgcggtcatcccagataatagcactcaagctgcttccgttgctgaacagcgtgcgcctcgcaccccctcccgtgatcaaaagaagaacatttcaaggagaacaatcccaggccagcatccaagggccacctggccctcctggacctcctggcccctctgggcccctgggacatcctggactgcccggccccatgggccccccaggccttcccggcccccctggaccaaagggggaccccggcattcagggttaccatggcagaaagggcgagcggggaatgccgggcatgccaggtaagcatggagctaagggcgcccctggcatcgcagtggcgggtatgaagggcgaacctgggatccctggtaccaaaggtgagaaaggtgccgagggcagccccggactacccgggctgctggggcagaagggggaaaaaggagacgccggcaacagtattggaggaggacgtggagagcctggccctccgggcctgccaggcccacccggccctaaaggcgaagcgggtgtcgacgggcaggtgggcccccctgggcaacctggtgacaagggggagcgcggagccgccggcgaacagggccccgatggtcccaagggcagcaaaggtgaaccaggaaaaggagaaatggtggattacaacgggaatatcaacgaggccctgcaggagattcggacactggcccttatgggaccacctggactccctggccagatcgggccaccaggagcaccaggcattcccggccagaagggcgaaattggcctgccaggccctccaggccatgacggcgagaaggggcccagggggaaacccggcgacatggggccacccggcccccaaggtccgcccggcaaagatggcccacccggggtaaagggtgaaaacggccacccaggaagccctggagagaaaggggagaagggagagaccggccaggcagggtcccccggagagaaaggggaggcaggcgagaagggcaatcctggtgccgaggtgcctggattgcccgggccagaagggccgccaggaccaccaggcctccagggggtaccaggcccgaaaggagaagccggcctagacggagcaaagggcgaaaagggctttcagggcgagaagggcgatcgagggccactgggccttccaggagcgagtgggcttgacggcagaccaggtcccccgggaaccccgggacccatcggcgtgcccggacccgctggacctaagggtgaaaggggatcaaagggggacccaggcatgaccgggccaacaggagccgcaggccttcctggcctgcatgggccgcctggggataaggggaatcggggggagcggggcaaaaagggctctagaggccctaaaggagacaagggcgatcagggagcccccggcttagacgcaccctgccctctgggagaagacgggttgcccgtgcagggctgctggaacaagtag

SEQ ID NO: 4079 - DNA, 2154 bp, Artificial Sequence
  Description of Artificial Sequence: Synthetic coding sequence
atggtggccgagcggacccacaaggccgccgccaccggcgcccggggaccaggggagttaggggcccctggcactgtggctttagtggctgccagagcagagaggggtgctagattgccctccccaggatcttgtggccttctgactttagccctctgttcactcgcgttaagtctgctggctcactttaggactgcggagctacaggcaagagtgttaaggttagaagcggagcgaggggaacagcagatggaaacagccattctgggtcgggtgaatcagcttttggatgagaaatggaaattacactccagaaggcgtagagaagcaccgaaaacttctccaggatgcaactgccccccagggccacctggcccaacagggcggccaggactgcccggggataagggagcaattggaatgccaggtcgggtgggcagtccaggcgacgccggccttagtattatcgggccgagagggcccccgggacagcctggaaccaggggctttcccggcttccctggacctatcggcctcgacggtaagccaggccatcccggtcccaagggagatatgggactgacaggaccgcccggccaacccggacctcagggacagaagggggagaaaggacagtgtggcgaatatccccacagggagtgcctgtcctccatgcctgccgccctgcgatccagccagattattgcactcaagctactgcctcttctgaattccgtacggttggctccaccccctgtcatcaaacgaaggacctttcagggcgagcaatctcaggcttctatacaaggcccccccggacctccaggtccaccgggcccttctggcccccttggacatccagggttaccaggccccatgggtcccccaggattgccagggcctccagggcccaagggagatccgggaatccagggctatcacggacgcaaaggtgagcggggtatgcctggtatgcctgggaagcatggcgcaaagggtgcccctggcatcgccgtggccggcatgaaaggggaacccggtattcccggaaccaaaggggagaagggggccgaagggagtccaggtttgccaggcctcctcggacagaagggtgagaagggcgatgctggaaactccattgggggaggcagaggcgagcctgggccacctgggctgcctgggccccccggtcccaaaggagaggctggtgtcgatgggcaggttggccccccggggcaaccaggagataagggagaaagaggcgccgcaggggagcaggggcctgacggcccaaagggaagtaaaggcgaacccggcaaaggcgagatggtggattataatggcaatatcaacgaagccctccaggagattagaaccctggcattgatggggccacccggcctgcccggtcagattggaccccccggtgccccgggtatccctggccagaaaggcgagataggtctacccggtcccccaggccacgatggagaaaagggcccccgagggaaacctggcgacatgggcccccccgggcctcaaggacctcccgggaaggacggaccaccaggcgtcaagggggagaatggtcacccaggtagtccaggcgaaaaaggggagaagggagaaaccgggcaggccggaagtcccggcgaaaagggcgaggctggtgagaaaggaaaccccggggctgaggtccccggtctgccaggtcctgaaggcccaccagggccgcctgggctccagggggttcctggcccaaaaggagaggcagggctcgacggggctaaaggcgaaaaaggctttcagggcgaaaagggcgaccggggaccattgggacttccaggcgctagtggtctcgatgggagacccggcccccctggcactccggggccaattggggttcctggcccggccggacccaaaggggaaagaggatctaagggagaccccgggatgacaggaccaaccggagccgcagggctgcccgggctgcacggtcctcccggcgacaagggaaaccgaggggaacgcggaaaaaagggttccagaggccccaagggggacaagggtgaccagggagcccctgggctcgatgccccctgcccactcggggaagacggacttcctgtacagggttgctggaataagtag

SEQ ID NO: 4080 - DNA, 2007 bp, Artificial Sequence
  Description of Artificial Sequence: Synthetic coding sequence
atggtggccgagcggacccacaaggccgccgccaccggcgcccggggacccggggagcttggtgccccaggcacagtcgccctggttgctgccagagccgaaaggggcgctcgattgcctagtccaggatcatgcggccttctcacactggctctctgttcgcttgcactgtccctgctggctcattttcggactgccgagctccaggctagggttctacggctggaagctgagcgcggcgagcagcagatggagaccgccattctaggccgcgtcaatcagctcctcgacgagaaatggaagctacactctcggcgccggcgggaggcgccaaaaacctctcccggatgcaactgtcccccgggtcctcctgggccaacaggtcgcccggggttaccgggcgacaaaggagctattggaatgcccggacgagtgggaagcccaggcgacgccggcctgagtattatcggacccaggggtccgcccggccagcctggaactagaggtttcccaggtttcccggggccaattggtctggatggtaagccaggacaccccggtccaaagggggacatgggtctcaccggtcctcccggacagcccggacctcagggccaaaagggagagaagggccagtgtggtgagtaccctcacagagagtgcttatcatccatgcccgcagcgttgcgctccagtcagatcattgccttgaaaggggagcaatcccaggcttctatccagggcccgcccgggcctcctggcccccccggaccctcaggcccactgggccacccggggttacccggtccgatgggcccacctgggctgcccggtcctcccgggccaaaaggcgatcctggcattcagggctatcacggacgcaaaggagagagggggatgcccggcatgccgggtaagcatggcgccaaaggtgccccaggcattgccgtggctggaatgaaaggggaacccggcatccctggcacaaagggcgagaagggagcagaagggagcccaggtctgccgggcttgttaggccagaagggggagaagggggatgccgggaacagtattgggggcgggcggggggaacctggcccgccggggctccctgggccccccggtcctaagggcgaagctggggtagacggccaggtcgggcctccgggccaaccaggagacaaaggcgagcggggggcagcaggtgaacagggaccagacggccccaaaggctctaaaggagagcccggcaagggtgaaatggtggattacaatgggaacatcaatgaggccctccaggagatccgtacattggcactcatgggtccaccgggtttacccgggcagatcgggccgccaggcgctccagggattccggggcagaagggggaaatcggactcccaggaccacccggccacgatggtgagaagggaccgcgcggtaagccaggtgatatggggcccccagggccccaaggccctccagggaaagacggacctcccggggttaagggcgaaaatggccatcctggatcaccgggcgagaaaggagagaagggtgaaaccgggcaagctggctcacccgttccgggtttgcctggtccagaggggccccccggccctcccggccttcaaggggtgcctggacccaagggggaggcaggactcgatggcgccaagggtgagaaaggcttccagggagagaaaggagaccgcggcccattaggactccctggtacacctggtccaatcggggttccagggccagccggccccaagggagagcgaggctcgaaaggtgaccccggaatgaccggtcccaccggggctgccggcttgcctggattacatggccccccaggcgataagggcaatagaggcgagcggggcaaaaaaggaagcaggggacctaagggcgacaaaggtgaccagggtgctcctgggcttgacgccccctgccctcttggggaggatggactgcctgtgcaggggtgctggaataaatag

SEQ ID NO: 4081 - DNA, 1833 bp, Artificial Sequence
  Description of Artificial Sequence: Synthetic coding sequence
atggtggccgagcggacccacaaggccgccgccaccggcgcccggggtcccggcgagctgggagcacctgggactgtggcactcgtggccgcgcgcgctgaaagaggagctcggttacctagtcccggatcttgtggacttctgacactggccctgtgcagcttggctctctctcttttggcccacttccggactgctgagctgcaagctcgagtgttacggttggaggctgagcgcggggaacagcagatggagaccgctatactcgggcgggtcaatcagcttcttgacgagaagtggaaactgcactcaagaagacggagagaggcgcctaaaacctctcccgggtgcaattgtcctccaggtccaccaggacctactgggcgtcctggcttaccaggtcaacccggcacccgtgggttccccggattccccggccccataggcctggatggaaagccggggcatccggggcctaaaggtgacatgggcctaacaggtccacccggacagcccggaccacaggggcaaaaaggcgaaaaagggcagtgtggcgaatatccgcacagagagtgcttaagctccatgccagccgctttgaggtcttcgcagatcattgccctcaagggcgaacagagccaggcatccattcaaggacctcccggcccacccgggccgcccggcccctcgggccccttgggccatcccgggttgcccggccccatggggcctcccgggctgccagggccccccgggcctaaaggagatcctgggattcagggataccacggtcggaaaggagagaggggtatgccaggcatgcctggcaaacacggcgctaaaggcgctcctggaatcgcggtggccggaatgaaaggcgagcctggcattcctggcaccaagggcgagaagggggctgaaggctcccctggcctgcctggactgcttggccagaaaggagagaagggagatgccggtaattctattggcggaggtagaggggaacccgggcctcctggactgccggggcctccgggccccaagggagaagcaggagttgacgggcaggtggggccacccggccagcccggcgacaagggagaaagaggggccgctggcgaacagggaccagacgggccgaaaggctcaaaaggtgaaccagggaaaggggaaatggtggactacaatgggaatatcaacgaggcccttcaggagattagaacactagccctgatgggcccacccgggttgcccgggcagataggaccgccgggggcaccgggcattccaggacagaagggggagattggtctccctgggcctccaggtcacgatggcgaaaaaggaccccgtggcaagcccggcgatatgggcccccccggcccacaaggcccgcctggaaaggatggtcccccaggagtgaagggcgaaaacggtcacccaggtagcccaggcgagaaaggagagaaaggtgaaaccggccaggccggcagtcccgtcccaggactgcccgggccggaggggccgcctgggccccccggactgcagggcgtccccggacccaaaggagaagccggactggacggagccaagggcgagaaagggtttcagggagaaaaaggtgaccgcggcccccttggactgcctggcactccaggcccaatcggcgtgcccggtccggcagggcctaagggcgaacgaggttccaaaggagatccgggcatgaccggacccactggggcggccggccttccgggcttacacgggcctcccggtgacaagggcaacaggggtgaagatggcctgcccgtccaagggtgttggaacaagtag

SEQ ID NO: 4082 - DNA, 1938 bp, Artificial Sequence
  Description of Artificial Sequence: Synthetic coding sequence
atggtggccgagcggacccacaaggccgccgccaccggcgcccggggacctggcgaactgggcgctcccggaactgtggccctggtggctgcccgtgcggaacgcggggcacgcctgcccagtccaggtagttgtgggcttctgacccttgcgctctgttcgctggcattgtccctgctcgctcacttcagaaccgctgaactgcaggccagggtgctcaggcttgaagccgagagaggagagcaacaaatggagaccgccattctgggccgggtgaaccagctgctggacgagaagtggaagctgcattccagacggagacgcgaagcacctaagacttcaccgggatgcaattgccctcccggaccaccaggccagcctgggacgaggggattcccagggtttccgggtcctattggcctggacgggaaacctggtcaccccggcccaaaaggcgacatgggtttaacagggccccccgggcagcctggcccccaggggcagaaaggcgagaagggccagtgcggggagtatccccacaggttgctaccgctcttaaactccgtgcgtcttgcgcctcccccagtgatcaaacgcagaacattccagggggaacagtctcaggcaagcatacaaggacctcccggcccccctggtcccccaggtccatccgggccgcttggtcaccccggattaccgggcccaatgggacctcccggccttccaggaccacctggcccaaaaggggacccaggcatccagggttaccatgggaggaaaggtgaacgtggaatgcccgggatgcccggaaagcatggggctaaaggagcaccaggcatcgcggtagccggaatgaagggcgagcctggtattccaggaacgaagggtgagaaaggggcagagggaagccccggtctgccagggctgttgggccagaagggagaaaagggggatgctggcaactcaattgggggcgggaggggggaaccgggccccccgggcttgccaggccctcctggcccaaaaggtgaagctggcgtggacggccaagtgggcccccctgggcagccgggcgataagggggagagaggtgccgccggcgaacagggcccagacggacctaaaggaagcaagggggaacctggcaaaggcgaaatggtggattataatggaaacattaatgaggctctacaggagattagaacgctcgcattgatgggccctccgggtctgccaggacagatcggaccgcctggagctccagggatcccaggtcagaaaggagagatcgggctcccgggaccccccggccatgatggagagaaaggcccacgtggtaaaccaggcgacatgggccctcctggcccacaggggccccccggaaaagacggtccacctggcgtgaagggggaaaacggtcatcctggtagtccaggcgagaaaggggaaaaaggtgagacagggcaagctggttctcccgtgcccggcctccctggaccagaaggacctccgggacctccggggctccagggagtcccagggcccaagggtgaagctggactggatggcgctaaaggggagaaggggtttcagggcgagaaaggggataggggtccattagggctcccgggcgcatccggcctcgatggacgacctggacctccaggcacccctggccccatcggagtccccgggcccgccggaccaaagggagagcgggggagcaagggagaccctggcatgactgggcctactggggctgctggactccccggcctacacggaccgccaggagacaagggaaataggggggagagaggaaagaagggaagtcgcggccctaaaggtgataagggtgaccagggagccccaggcctggacgccccgtgtcctcttggtgaagatggcctgcctgtccagggctgctggaacaaatag

SEQ ID NO: 4083 - DNA, 5106 bp, Artificial Sequence
  Description of Artificial Sequence: Synthetic coding sequence
atgaagatcttccagcggaagatgcggtactggctgctgccccccttcctcgccattgtgtatttctgtactattgtgcaaggacaagtcgccccacccaccagattgaggtacaacgttattagtcacgatagcattcagatcagctggaaggcgccaagaggaaagttcggaggctacaaattgctggtgactcccacttctggagggaagaccaaccagctgaatctgcaaaataccgccactaaagctattatccagggtctgatgccagatcagaattacaccgtccaaatcattgcatataacaaagacaaggagtcaaaacctgctcagggtcagttcaggatcaaggatctcgaaaagagaaaggatccgaagccccgagtgaaggtggtggaccgagggaacggcagccggccatcatcaccagaggaagttaaatttgtctgccagacccccgcgattgccgacatcgtaatacttgtggatggcagctggtccataggtaggttcaatttcaggctcgtgaggcactttctggaaaatcttgtcaccgcatttgatgtggggagcgagaagacccggataggcgtgaaaaatgctgatgttaatgaattgcaggagatagcaagtgagccagacagtacacacgtctataatgttgctgagttcgaccttatgcatactgtcgtggaaagcctgactcggaccctctgttcccgcgtcgaagaacaagacagggagatcaaagcttccgcacacgccattacgggcccccctaccgagcttatcacttcagaggtgaccgccaggagttttatggtgaactggacccacgccccaggaaacgttgagaagtaccgcgtagtttattaccctactagaggtggcaagcctgacgaggtagtcgtagacggtactgtatccagcactgtgctgaagaacctgatgagcttaaccgagtatcagatcgcagtgtttgccatatacgcccacaccgcctccgaagggcttagagggaccgaaaccacgttagctcttcctatggcatctgacctgctgctctacgacgtcaccgaaaactccatgcgggttaaatgggacgcagtaccaggcgctagtggatatctcatcctgtatgcaccacttaccgaaggtctagctggtgatgagaaggagatgaagatcggggagacccacacagatatagagctttcaggactgcttcccaacaccgaatacacagtgacagtttacgcaatgttcggagaagaagccagcgacccagttaccgggcaggagacgaccctggccctatctcccccccgcaatttgcgtatctctaatgtcggcagcaacagcgcacgactgacctgggaccccactagcaggcagataaacgggtatcgaatcgtttacaataacgccgacggtacggaaatcaacgaagtggaagtggaccccatcacgacatttccactgaagggtttaactcccttgactgagtacacaatagcgattttcagcatctatgatgagggacagtccgagcctttaaccggagtgttcaccacagaggaggttccggcccagcagtatctggagattgatgaggtgaccacagactcctttcgggtcacttggcaccctctgtccgccgacgaaggactgcacaagctcatgtggatcccggtttatgggggcaagaccgaagaagtggtacttaaggaggaacaagacagccatgtgatcgaggggctggaacccggaacagagtacgaggtgagtttgcttgcggtacttgacgacggaagcgagtcagaggtggtgacagccgtggggaccaccctcgactctttctggacagagccagcaaccacaatcgttcccaccactagtgtgacctctgtgttccaaactggcataaggaacctggttgtgggcgacgagacgaccagcagcctgcgggtcaagtgggacattagcgattcggacgtgcaacagttcagagtgacatacatgacagcccagggcgatccggaggaggaagtcattggcaccgtgatggtacctggaagccagaataatctactgcttaagcccctgttgccagacacagaatacaaagttacggtcacacctatctatacggatggcgaaggggtttctgtctccgcacctggaaagactctgccatcaagcggcccacagaaccttcgagtctccgaggaatggtacaatcggctacggattacatgggacccgccttctagccccgtaaagggatatcgtatcgtgtataagccagttagtgtccccggaccaaccttggagacctttgtcggagcggacatcaataccatcctaattaccaatctgctcagtggaatggactacaacgtaaaaatctttgcatcccaagcctccggattctccgacgcccttactggcatggtgaaaactcttttccttggggtaaccaacctgcaggccaagcatgtggaaatgacctcactctgtgcgcattggcaagtgcaccgccatgctaccgcttacagggtagtcatcgaaagcctccaggaccgccaaaaacaagaatctacagttggaggaggaactaccaggcactgcttctacggactgcagccagacagcgaatacaagatctctgtctacacgaaactccaagagatcgaggggccatcagtttcgatcatggagaagactcaatcgctgccgacccggccccctacttttccacccaccatcccaccggctaaggaggtgtgtaaggcagcaaaggctgacctggtcttcatggtggacggtagttggagcattggggatgagaacttcaacaagattatcagcttcctatatagcacggtcggcgccctgaataaaataggcactgatggcactcaggtcgccatggtacagtttacagatgacccaaggaccgagtttaaattaaacgcctacaaaactaaggaaaccctcctggacgccattaaacacatctcttacaaaggaggcaatactaagaccgggaaagccataaagtatgtgcgggatacactatttacagctgagagtggcactcgcagaggaatcccaaaggtgatcgtagtgattaccgatggccgctctcaggatgatgttaataaaatttcacgcgagatgcagctcgacgggtatagtattttcgccatcggtgtggcagacgctgactactccgagctcgtctctatcggaagtaaacctagcgctaggcacgtcttttttgtagacgatttcgacgctttcaagaagattgaggacgagctgatcacattcgtatgtgaaactgcaagtgctacttgccccgtcgtgcacaaagacggcatcgacctggctggcttcaaaatgatggagatgtttggcttggtggagaaagatttctccagcgtcgagggggtctcaatggaacccggaaccttcaatgtatttccatgctaccagctacataaagatgcgctggtcagccagccaactcgatatctgcaccctgaaggcctacctagtgattataccatctccttcctcttcagaatacttcccgatactccacaggagcctttcgctctttgggaaatccttaataagaattccgaccctttagtaggcgtcatcttagataacggaggaaagacattgacatatttcaactatgatcaaagcggggatttccagactgtgacctttgaagggccagaaatccgcaagatcttttatggctcgtttcataaactgcatatcgttgtgtccgagaccctggtgaaggtcgttatcgattgtaaacaagtgggcgagaaagccatgaacgcgagtgccaatattacttccgacggtgtggaggtactggggaagatggtgcgcagccgcgggcctggcggaaacagtgcccctttccagctacagatgttcgatattgtgtgtagtacctcctgggcgaatacagacaaatgctgcgaattaccggggcttcgtgatgatgagagctgtcccgatttaccccactcctgttcctgcagtgagacaaatgaggttgctctggggccagccggccctcctgggggccccgggcttcgggggccaaaggggcagcaaggggagccaggccccaaaggacccgatggaccaagaggcgagataggtctgcccggaccacagggacccccagggccccagggccccagtggcctctccattcaagggatgcctggaatgcctggcgagaagggcgaaaagggcgacacgggtcttcccgggccccagggaattcccggcggtgtgggcagtccggggagagacggcagccccggacaacgaggtttgcctggtaaggacggaagttccggaccccccgggccacctggccccattggcatccctggcacacccggtgtccccggaattaccgggagtatgggccctcagggcgcgctcggccccccaggcgtccccggtgccaagggggagaggggagagagaggcgatctgcagtcccaagcgatggtgaggtccgttgcacgacaggtgtgcgagcagttaatacagtcccacatggcgagatacaccgccatactaaaccagatccccagtcacagctcttccatacggacagtgcagggcccgcctggcgagccagggagaccaggaagtccaggcgccccgggagagcagggaccccctggcacacccggatttccgggtaatgccggggtgcctggtacacctggggaaagagggcttaccggtatcaagggtgaaaaaggcaatcccggggttggcacacagggacctcggggcccacctggccccgcagggccgagtggcgagtctaggcccgggagtcccgggcctcctgggagcccagggccgaggggtcctcctggacacctgggcgtgccgggaccgcagggccctagtgggcagcctggctattgcgacccctccagctgctcagcctatggagtgagagcacctcacccagatcagcccgaatttaccccagtccaggacgaactagaagcgatggaactgtggggccccggcgtgtag

SEQ ID NO: 4084 - DNA, 5391 bp, Artificial Sequence
  Description of Artificial Sequence: Synthetic coding sequence
atgaagatcttccagcggaagatgcggtactggctgctgcccccctttctggcaatcgtctatttctgtaccattgtccagggccaggtagcccccccaactcggttgcgctacaacgtgatttcccacgatagcatccagatcagctggaaggccccccgcgggaagtttggaggctataagttacttgttactccgacatccggcggcaaaacaaatcagctgaatctccaaaacacagccaccaaggccattatccaagggttgatgcccgatcagaactacactgtacaaattattgcctataacaaagacaaagaatccaaacctgcccagggccagttccgcattaaggatctcgaaaaaaggaaagatccgaagcctcgcgttaaagttgttgaccggggaaatggttctcgaccatcctcccccgaagaagtcaaatttgtctgccagactccagccatcgcggacatcgttatcctggttgacgggtcatggtccatcgggcggtttaatttccggctagtcagacactttctcgagaatctcgtgacagccttcgatgtagggagcgaaaaaactcgcatcggcctggctcagtattccggtgacccccggattgagtggcacttgaacgcgttcagcacaaaggacgaagtcattgaggccgtgcggaacctcccttataagggcggcaatactttaaccggcctcgctttgaactatatatttgaaaactcatttaaacctgaagctggttctcgaacgggagtgtctaagattgggatcctcattaccgacggtaagtcccaggatgatataatccctccttcccggaacctgcgcgagagtggcgtggagcttttcgccattggtgtcaaaaacgctgatgtgaatgagctacaggaaattgccagcgagcctgattcaactcatgtctataacgttgccgagtttgacctcatgcataccgtcgttgagtcactaacgagaacactttgttccagagtagaagagcaggacagagagattaaggccagtgcacatgcgattactggccctccaacagaattgatcacatctgaggttacagcacggtcattcatggtgaattggactcatgcacctgggaatgtcgaaaaatatcgggtagtgtattatccaacaagaggaggaaaacctgatgaggtggttgtcgatggcacagtgtcttccacagtgctcaagaacctgatgagcttgaccgaataccagattgcggtgttcgccatctacgcccacacagcaagtgagggcctgcgaggtaccgaaaccactcttgccttgcctatggcatcggaccttctactttatgatgtgacagagaacagtatgcgtgttaagtgggacgccgtgccaggcgccagtgggtacttgatcctgtatgcaccgctgacagaaggcctcgctggggatgagaaagagatgaaaatcggcgagacccatactgacattgagctgtctgggttacttccaaacaccgaatatacagtaaccgtctacgccatgttcggcgaggaagcgtcagatcccgtgacaggacaggagacaactcttgccctgagtccgccacgcaatctcaggataagcaatgtaggctccaatagcgctcgcctgacttgggatcccacatcaaggcagatcaacggataccgtatcgtgtacaataatgcagatggcactgagatcaacgaagtcgaagtggacccaatcaccacttttccattgaaaggcctgacacctttgaccgagtatacaatcgctattttcagcatctatgatgaggggcagagcgagcctctgacaggggtttttacgacagaagaagtgcctgcacagcagtaccttgaaattgacgaggttactacagactcattcagagtgacctggcatcctctatccgcggatgaggggctccacaaactgatgtggattccagtgtacggggggaaaacagaagaagtggtactgaaagaagaacaagactcccacgtaattgagggactggagccggggacggagtacgaggtgtcattgttggccgtactggatgacgggtcagagagcgaggtggtgactgctgtgggtacgaccttggattccttctggacggaacctgcgaccactatcgtgcccactacctccgtgaccagcgttttccagactggaatcaggaacctggttgtaggagacgagacaacctctagtctgagagtgaaatgggacatctcggactcggacgttcagcagtttcgcgtcacatacatgactgcgcagggcgaccccgaggaagaggtaatcggcaccgtcatggtgcccggaagtcagaacaatctattgctgaagcctttgcttcctgacactgagtataaagttactgtcacacccatctacactgacggggagggtgtaagcgtgtccgcgcctggtaagaccctgcctagctcaggtccacagaacctgcgggtgagcgaggagtggtataatcgactgcggattacatgggatccaccctcctcaccagttaaaggctatcggatcgtgtataaaccagtgagcgtccccggtcctaccctggaaacctttgtcggagctgatattaatacaatactgattaccaatcttctgagcggcatggattataatgtgaaaatcttcgccagccaggcatctggcttctccgacgcccttacagggatggtcaaaaccctgtttcttggggttacgaatctgcaggccaagcatgttgagatgacatctctgtgtgcacattggcaggtgcatagacacgccaccgcctacagggtggtgatcgaatctttgcaggaccggcaaaagcaagaatcgacggtagggggcggaaccacaagacattgcttctacgggctgcagcccgacagtgagtataaaatttccgtgtatacaaaactgcaggagatcgaaggaccatccgtctctatcatggagaagactcagagtcttcccacacggcccccaaccttccccccaactataccccccgccaaggaggtctgtaaagcagcaaaggccgatcttgtattcatggtggacggcagctggagcatcggcgatgagaatttcaataagataatttccttcctatactccaccgtcggcgcgcttaacaaaatcggcactgatggcactcaagtggctatggtgcagtttacggacgatcctagaacagagttcaaactgaacgcgtataagactaaggagacgctcttggacgccatcaagcatatctcttacaagggcgggaataccaaaaccggcaaggccatcaaatatgttagagataccctgtttacggccgaatccggcacgcgtcggggaatacccaaggtgatcgtagtgatcaccgacggcagatcacaggacgacgtaaacaagatctctagggaaatgcagttggacggatattctatctttgccataggagtggccgacgccgattattccgaattagtgtcaatcggctccaagcctagcgcccggcatgtattttttgtcgacgatttcgatgcttttaagaagatcgaagacgagctcatcacatttgtttgtgaaacagctagtgccacttgtcctgtcgtccacaaggacggaatcgatctggcggggtttaaaatgatggagatgttcggattggtggagaaggatttttcttcagtggagggggtgtccatggaaccagggacgttcaacgtgtttccctgttatcagctgcacaaagacgcactcgtgtcacagccaaccagatatctccacccagaaggcctgcccagcgactacactataagcttcctcttccgcatcctcccggataccccccaggaaccttttgcattgtgggagatccttaataaaaacagtgatcccttggtcggggtcatccttgacaacggcggaaagactctcacctacttcaattacgaccagtccggggatttccagaccgtgacgtttgaaggaccagagattagaaaaatcttttatgggtccttccacaagctgcacatagtggtgtccgaaacactcgtcaaagtggtaatagactgcaaacaagtgggcgaaaaagccatgaacgctagcgctaacatcacatctgatggagtggaggtactaggcaagatggtgcgtagccgcggccccggcgggaattccgcccctttccagctgcagatgtttgatatcgtttgttctacgtcctgggcaaacaccgataaatgttgcgagctgccaggactgcgggacgatgagtcgtgtcccgacctgcctcacagttgctcctgctccgagaccaatgaggtagcactggggcccgccggccctcccggagggcccgggcttcgcggccctaaggggcagcagggggaacccggtccaaaggggcctgacggccccagaggggagattgggctgccgggaccacagggtccccctggtccgcaaggcccgtccgggctatccatccaagggatgcctggtatgccgggggaaaaaggagagaaaggcgacaccggtctgcccgggcctcaggggatccccggcggtgtgggctcacccggtagagacggcagccctggccagagaggactgcctggtaaggacggctcaagcggaccccctggccctcccggcccaatcggaatccctggaacacctggagttcctgggatcacaggatctatgggtcctcagggtgccttaggcccccctggggtccctggtgccaagggcgaacgcggcgaacgtggagaccttcagtcccaagctatggtccgctcagtcgccaggcaggtgtgtgagcaactgatccagtcacacatggcacgctacactgccatcctcaatcagattccatcacatagtagctctatccggaccgtgcagggtccacccggtgagccgggccgtcccgggtctccaggcgcccccggggaacagggtcccccagggacccccggctttcctggcaatgctggcgtgcctggcaccccaggagagagaggactaacggggattaagggcgaaaaggggaatccaggagtagggacccaaggccctagagggcctcccggccccgcaggtccgtccggagaatctcggccaggaagtcccgggccccccggatcacctggtcctcgcggcccacctgggcacttgggtgtcccgggtcctcagggtccatctggccagcccgggtactgtgacccttcatcctgctcagcatacggcgtgagggctccacatcctgaccagcccgagtttactcctgtgcaggatgagttagaggccatggaactatggggacctggcgtgtag

SEQ ID NO: 4085 - DNA, 5343 bp, Artificial Sequence
  Description of Artificial Sequence: Synthetic coding sequence
atgaagatcttccagcggaagatgcggtactggctgctgccccccttcttggctattgtgtatttctgtaccattgttcaaggacaggttgcgccgcctacccgcctgcgctacaacgttatttcccacgactccatccaaatctcctggaaagcaccaaggggaaagttcggaggctacaaactgttagttacacccacatccgggggcaaaaccaatcagctgaatctgcagaatactgctaccaaggcgattattcagggcctcatgcccgatcagaactatacggtgcagatcatcgcctacaacaaagacaaggaaagcaagcccgcacagggccagtttaggatcaaagatttggaaaaacgcaaagaccccaagcctagagtcaaagtcgtggaccgaggtaacggcagtaggccgtcctcacccgaagaagtgaaatttgtgtgccagacaccggctatagctgacattgtgatcctcgtggacggttcttggtctatcggaaggttcaactttaggcttgtacgccatttcctggagaacctagtgacggcgttcgacgtggggtctgagaagacaagaataggactcgctcagtacagcggcgaccccaggatagaatggcatcttaacgctttcagtactaaagatgaggtcattgaggccgtccgcaacctcccttataaagggggaaatacactgacgggcctcgcccttaattatatttttgaaaacagtttcaagcccgaagcaggcagccgcaccggcgtctcgaagatcggaatcctgatcacagacggaaagagtcaggacgacatcatcccaccatcaaggaacttgcgtgaaagcggcgtggaactgttcgcaattggagtgaaaaacgccgatgtgaacgagctgcaggaaatcgcctctgagcctgatagtactcacgtgtacaatgtggctgagtttgatctgatgcatacggtggtggaaagtctcacccgtacgctttgttcaagagtggaagagcaggaccgcgagatcaaggcaagcgcgcatgcaatcaccggtcctcccacggagctgatcactagcgaggtaactgcccgctcttttatggtgaactggactcacgcacccggaaacgttgagaaatatcgggtcgtttattatcctacaagaggggggaaacctgacgaagtagtggtggacggaacagttagttccactgtgcttaagaaccttatgtcgctgaccgagtatcagattgcagtgtttgccatctacgcccataccgcaagtgagggcttacgtggcaccgagacgaccttggcgctccctatggcttctgacctcctgctgtacgatgtcactgagaatagcatgcgcgtgaagtgggatgccgtccctggagcctcagggtacctcatcctatatgcccccctcactgaaggacttgccggcgacgaaaaggaaatgaagattggcgaaacccacacagacatagagttgtccggattgcttcctaacactgaatacacagtgaccgtctacgcaatgtttggcgaagaggcttcggatcctgtgacaggccaggaaacgacgctggccctgtcaccccccaggaatctaaggatcagcaacgtgggttccaacagtgctcgcctcacctgggacccgacatcccgccaaataaacgggtatcgtattgtttacaacaacgccgacgggaccgagattaatgaggtggaggtggaccccatcactacattcccactcaagggacttaccccactaaccgaatatacaattgccatctttagcatttacgatgaaggccaaagcgaacccctaactggcgtattcaccacagaagaggtgccggcccaacaatacttggaaatcgacgaggttacgacagatagcttccgtgtgacctggcatcccttatcagcggacgaggggctgcacaaactgatgtggattcctgtatatgggggaaagaccgaggaggttgtgctaaaagaggagcaagactcacacgtgattgagggactggaacctgggacagaatatgaggtgagcctgcttgcggtactcgatgatggatccgagtcagaagttgtgacggcggtgggcactactttggattctttttggactgagccagcaacaacgatagtccctacaacctccgtgacctccgtcttccaaactggcatcagaaacctggtggtgggcgacgaaacaacctcctccttgcgcgtcaagtgggatatttccgattctgacgtgcaacagttccgggtaacgtacatgacagctcagggagatcccgaggaggaggtaataggaacagtgatggtgccagggtcccagaacaacttgctcctgaaaccgctcctgcccgacactgaatataaagtaacagtaacccctatctacactgacggcgaaggagtcagcgtatccgcacccggtaaaactctccctagcagtggcccccagaacctccgggtgtcggaggagtggtataacaggttgagaatcacctgggaccccccctcgtcaccagttaaaggataccgcatcgtgtataagccagtgtccgtgcctggaccgacactcgaaaccttcgtgggagcagatatcaacacaatcctgattacaaatttactgagcggcatggactacaatgtgaaaatcttcgcctcccaggccagtgggttttctgatgctctcaccggcatggtgaagactctttttctgggtgtgactaacctgcaggcaaagcatgtggagatgacatccctttgtgctcactggcaggtgcatcgccacgcgaccgcctatagggtcgttattgaatctctgcaggaccggcagaagcaggagtcaaccgtgggagggggaaccaccagacattgtttttatggcttgcaaccagactccgagtacaagatttctgtgtacactaagcttcaggaaatcgagggcccaagcgtgtccataatggaaaaaacccagtccctccccactcgcccccccacgttcccaccaactatcccgcccgctaaggaagtatgcaaagccgctaaggccgacctggtgttcatggtggatggaagttggtcaatcggagatgaaaacttcaacaaaataatcagcttcctgtacagcacagtgggagcccttaataaaatcggcaccgatggcactcaggtggccatggtgcagttcacggacgaccctcggaccgagttcaagctgaacgcatacaagaccaaggagaccctgcttgacgctattaagcacatctcctacaagggtgggaatacaaagactggaaaggcaattaagtatgtgcgggatacactctttacagcagaatcaggtacacgccgcggaatccccaaggtcattgtagttattaccgacgggcgaagtcaggacgacgttaacaaaattagcagggaaatgcaattggatgggtacagcattttcgccattggcgtggccgacgcggattactcggaactggtgtccattggaagtaaacctagcgcacgtcatgtgtttttcgtagacgattttgatgcctttaaaaaaatcgaagacgaactgatcactttcgtctgtgagaccgcctccgctacgtgtcctgtggtccataaggacggaatcgacttggctggattcaaaatgatggagatgttcggcctcgtggagaaggacttttcatccgttgagggggtgagcatggagccaggtacctttaacgtctttccctgttatcagctccacaaggacgctctggtctcacagcccactagatatctgcatcctgagggactcccatccgactacaccattagcttcctttttcgcatcctgcccgatactcctcaggaacccttcgcgctctgggagatcctaaataaaaactcggaccctctggttggcgtcattctagacaatgggggtaaaaccctgacttatttcaattatgaccagagcggcgatttccagacagtgacattcgaaggtcctgagattcggaaaatcttttacgggtcattccacaagctgcacatcgtggtgtctgagacactggtcaaggtagtcattgattgtaaacaggtgggcgagaaggccatgaacgcttctgccaacatcactagtgatggggttgaggtactgggcaaaatggtcagatcaagaggtccaggcggtaatagcgctccttttcagcttcagatgttcgatatcgtatgtagtacctcttgggccaatactgacaaatgttgcgaactgccaggactgagggatgatgaatcctgtccagacctgccacactcgtgcagctgttctgagactaacgaggtggcgctgggcccagcaggccccccaggaggcccaggtctccgcggacctaagggccagcaaggggagcctggtcccaagggtccggacggacctaggggcgaaatagggcttccaggaccacagggccctccaggccctcagggaccttctgggctgagtattcagggaatgcccgggatgcccggcgaaaaaggcgaaaaaggtgacacagggctgccagggccccagggcattcctggcggcgttggaagcccaggccgggacgggtctccaggtcagagaggtctgcctggaaaagacgggtccagcggccctccaggcccgccaggaccaatcggaattccagggacaccaggagtgccaggcatcaccgggtccatgggaccccagggtgctctgggaccacccggagtccccggcgccaagggcgaaaggggcgaacggggagacctccagtctcaggcaatggtgagatcagtggccaggcaggtttgcgaacaactcattcagtcacatatggctcgctacaccgccatcctcaatcagattccatcccattcatcaagcatccgcacggtccagggccccccaggcgaaccaggcaggccgggttctcccggtgctccaggcgaacaaggtcccccgggcactcccggattcccaggcaacgccggtgtgcccggtacaccgggcgagaggggcctgactggaataaaaggggaaaagggaaacccgggagttggcacacaggggcctcgaggccccccaggaccagcaggaccaagtggggaatcccgccctggctcgcccggtccgccaggctcccctggccctagaggtccacccggccacctgggcgtgccggggccgcaggggccttccggccagcctggatattgcgatccctcttcatgctcagcatatggcgtgcgcgatctgattccttataatgactaccagcattag

SEQ ID NO: 4086 - DNA, 1605 bp, Artificial Sequence
  Description of Artificial Sequence: Synthetic coding sequence
atgaagatcttccagcggaagatgcggtactggctgctgccccccttcctcgctatcgtctacttctgcacaatcgtacaggggcaagtggctccccccacacggttgcggtacaatgtgatcagccacgacagcatccagatctcctggaaagcccctcgcggcaaattcgggggctacaaactgttggtgactcccacttcaggtggcaaaacaaatcagttgaatcttcagaacaccgctacgaaggcgattatacagggactcatgcctgaccagaactacactgtgcagattatcgcgtataacaaagataaggaaagcaagccggctcaagggcaatttcgaatcaaggacctggaaaaaagaaaggaccccaaaccccgcgtcaaagtggtcgatagaggcaatggatcgcggcctagttcacccgaagaagtcaaatttgtatgccaaacaccagcaattgcagacatcgtgatactggtggatggatcctggtcaatagggagattcaactttagacttgtgcgacacttcttagagaacctggtcacagccttcgacgtcggatcggagaaaacgcgcataggtctggctcagtactccggagacccaaggattgagtggcatctaaatgccttcagcaccaaagatgaggtcattgaagcggtccgcaatctcccctacaagggaggtaacaccttgaccggcctggccctcaactacatctttgaaaattcttttaaacccgaagcaggttcccgcaccggcgttagtaaaattggaatactcatcacagacgggaagtcgcaggacgacatcattcccccatcacggaacctgcgcgagtctggagtggagttatttgctattggggtgaaaaatgctgacgtgaacgaactgcaggagatagcatctgaacccgatagtacacacgtatataacgtggccgagttcgaccttatgcatacagtggtcgagagcctgactcggacattgtgcagcagggtcgaagagcaggatagggagatcaaggcatccgcgcacgccatcaccgggccacccactgagctgattacgtctgaggtgacagcaagaagttttatggttaattggactcatgcacccgggaatgtggagaagtatcgcgtcgtgtactacccaacccggggcggcaagccagacgaggtggtggtggacggaacggtctcctccaccgtcttaaaaaatttaatgagtctcacggagtatcagattgccgtgtttgcgatttatgcacacaccgcctcagaggggctgaggggaaccgaaacaaccctggcgttaccgatggcctcagaccttctgctatacgacgtgaccgagaatagcatgagggtgaagtgggacgcagtgccaggcgcgagtggctatctgatcttatacgcgcccctcacagaggggttggctggcgatgaaaaagagatgaagattggcgaaacccataccgacatcgaactgagtggcctgctacctaataccgaatacaccgtgactgtctatgctatgttcggagaggaggcatccgaccctgtgacaggccaagaaacaacttccccttag

SEQ ID NO: 4087 - DNA, 3429 bp, Artificial Sequence
  Description of Artificial Sequence: Synthetic coding sequence
atgcggctgaccggcccctggaagctgtggctgtggatgagcatctttttattgcccgcctctacttctgtcactgttagagataaaaccgaggagtcctgccctatcctgcgcatcgagggccatcagctaacttacgacaacatcaacaagctggaggtgtctggcttcgatttaggagattctttttcccttcgaagagcattctgtgaaagcgacaagacatgcttcaagctaggctctgccctgctgatcagagatacaattaaaatttttcccaagggtcttccagaagagtactcggtagcggcaatgtttcgcgtgagacgtaatgcaaaaaaagaacgatggttcctgtggcaggttctcaatcaacaaaacattccccagattagcatcgtggtagatggtgggaaaaaggtggtggagttcatgttccaggcaacagaaggagatgttctgaattacatcttcagaaacagggaactccgccccttgttcgaccgccaatggcacaagctgggaatcagtatccagtcccaggtgatcagcctttatatggattgtaatctcatcgcaaggagacaaactgatgaaaaggatacggtggatttccatgggcgaacagtcatagccacaagagcttcagacggcaagccagtggacattgagcttcaccagttgaaaatttactgcagcgcaaatcttattgcgcaagaaacatgctgtgagataagtgatactaaatgccccgagcaggacgggtttgggaatattgcctctagctgggttactgctcacgcctctaagatgagcagctatctcccagcaaagcaggaattgaaggaccagtgtcagtgcattcccaacaagggggaggccgggctccctggagcaccaggttcccctgggcagaaagggcacaaaggcgagccaggggagaatggactacatggggccccagggtttcccggacagaagggagagcagggattcgaaggcagtaagggtgagacaggggaaaagggcgagcagggggaaaagggggaccctgcacttgctggtctgaatggagaaaacggcttgaagggtgacctcggtccccatggcccacccgggcccaaaggggagaagggcgatacagggccccctggacctccggcacttcccggctcgctcggcattcagggcccacagggtcctccaggaaaggaaggacagagagggcggcgcgggaagaccggaccgcctggaaagccagggcctccaggtcctcctgggccacctggtatccagggtatccatcagaccctcggtggctattacaacaaggataacaagggaaacgacgagcacgaagcaggcggcctaaagggtgacaaaggcgagacgggtctcccaggttttccagggtctgtgggccctaaggggcagaaaggagaacctggcgagccctttacaaagggagagaagggggatcggggcgaaccaggcgtaattggttcacaaggggtcaagggtgagccaggagatcctgggccccctggcctcattgggagtccagggctgaagggccagcaaggtagtgccggctccatgggcccaagaggtccacctggggatgtcgggctccccggcgaacatggaataccaggcaagcagggcattaaaggggagaagggcgaccctgggggtattattggcccacctggtctgccaggccccaagggagaggccggccctccgggcaagtcattgcctggcgagcctggcctcgatggcaacccaggggcacccgggcctcgggggccgaaaggcgaaagaggactccctggagtacacggatccccaggtgacattgggcctcagggtatcgggattccaggccggactggcgcacagggaccggccggggagccaggtatccaaggaccacgcgggctgcctggcctgcctgggacgccaggtactccaggcaatgatggggtgcctgggcgcgacggtaagccgggccttccaggacctccgggggaccctattgccttacccttactgggtgacattggtgctcttttgaaaaatttctgcggcaattgtcaggcgtccgtccccggcttaaaatcaaacaaaggggaggagggcggcgccggcgagccaggtaagtacgacagcatggcgcggaagggagatattggccctagaggacccccaggcatcccaggccgggagggcccaaagggatctaagggtgaacgcggttatcccggcatccctggagagaagggagacgagggattgcaggggatacccggcatccctggcgctcccggtcctactgggccccctggcctcatgggccgtaccggccaccccgggcctacaggagccaaaggggagaaaggcagcgacgggccccccgggaagcctggacctcccgggccccctggcatcccatttaacgaaaggaacgggatgagctctctgtataagattaagggaggggtcaacgtgccttcctaccctggtccacccggtccccctggtcctaagggggaccccggcccagtgggggaaccgggggcaatgggactgccaggactggaggggttccccggtgtgaaaggcgatcggggtcccgccgggcctcctgggatcgcaggcatgagcggcaaaccaggggccccggggcctcctggggtgcccggggagcccggagaaaggggccccgtcggtgacattggctttccaggaccagagggaccaagcgggaagcctggaatcaacggtaaagacgggattcccggagcccagggcattatgggcaagcctggagaccgcggccctaaaggcgaaagaggtgaccagggcataccaggagatagggggtcccagggcgaaagaggcaagccaggcctgaccgggatgaaaggcgccattggccctatgggaccgcccgggaataagggtagcatgggaagtcctggacatcagggcccccctgggagtcccggaattcctggaatccccgcggacgccgtcagcttcgaggaaattaaaaagtacataaaccaagaggtcctgaggatttttgaagagagaatggccgttttccttagccagctcaagctgccagccgccatgctagccgcccaggcttacggacggcccggccctccagggaaagacggcctgcctggccctccaggcgatcccggtccccaaggctaccgaggccagaagggagagcggggagagccggggattgggctccccggctccccgggtctgccgggcacgtctgccctaggcctacctggcagtcctggcgccccgggacctcaggggccccccgggccgagcggcagatgcaaccctgaagactgcttatacccagtgagccacgcccatcagcgtacgggcgggaattag

SEQ ID NO: 4088 - DNA, 462 bp, Artificial Sequence
  Description of Artificial Sequence: Synthetic coding sequence
ggcatcaacggcaaggacggcatccccggcgcccagggcatcatgggtaagccaggcgacaggggccctaaaggcgagcgtggagatcaaggcatccccggcgatcgcggcagccagggggaacggggaaagccaggactgacaggcatgaagggcgctatcggcccaatgggtccaccgggaaacaagggatctatgggatcaccgggtcaccagggcccccccgggtcccccggcattcctggcattcccgcagacgcggtgtctttcgaggagatcaagaaatacatcaaccaggaggtactgagaatctttgaagaaagaatggctgttttcttatctcagttaaaactgccagccgccatgctggctgctcaggcctacggccggcctgggcctcctggcaaagacggattgccagggccaccaggggaccctggaccgcaggaagtggatgtctag

SEQ ID NO: 4089 - DNA, 4167 bp, Artificial Sequence
  Description of Artificial Sequence: Synthetic coding sequence
atggccccccggcggaacaacggccagtgctggtgcctgctgatgttgctgtcagtgtctacccctcttccggccgttacgcaaacacggggggcaactgagaccgcctcacaagggcacttggatctcacacagctcataggggtgcccctgccaagcagtgtgtcctttgtaaccggttatgggggctttcctgcctattcttttggaccaggggcaaatgtgggcaggcctgcacgcacactcattccatcaactttctttagggactttgcaatatccgtcgtcgtgaagccatcgagcactagagggggcgtattgttcgcgattaccgatgcttttcagaaagtgatctatctcggacttcgtctgtccggcgttgaggacggacatcaaaggatcatactgtattacactgaaccagggtcgcatgtctcccaggaagcagcagctttctccgtcccagtgatgacgcatagatggaatcggtttgccatgatcgtgcaaggggaagaggtgactctcctcgtcaactgtgaagagcacagccgtatccctttccagcggagcagtcaggccttggcattcgagtcttcagcagggatatttatgggaaatgctggcgccaccgggttggaaagatttaccggaagcctgcagcagctcactgtacatcccgatcctagaaccccagaagaactctgcgatcctgaagagtcttcagcgtccggtgagacgagtggcctgcaggaggccgatggagtggccgagattctcgaagcagtcacatatacccaggcctcccctaaagaggccaaggtggagccaatcaacacccctcccacaccctcctcgcccttcgaggacatggaactctccggtgaacccgtgcccgagggtaccctcgagaccacaaatatgtctatcattcagcatagtagtcccaagcagggctccggcgaaatcctcaatgacacactcgagggagttcacagcgtcgacggagatccaataaccgatagcggctctggtgccggggcttttttggatatagcggaggagaagaatctcgccgctaccgctgcaggtttagctgaggtgccaatctctactgccggggaggccgaggcctcctccgttcccaccggcgggcccacactgtccatgtcaaccgagaatccagaggagggtgtcacccctggaccggataacgaggagcgactggctgctacagccgccggcgaggccgaggcactggcgtcaatgcctggcgaggttgaggcatcaggtgtagctcccggagagctggacctgagtatgtccgcacagtcccttggagaagaggcgacggtgggcccatctagtgaggactccttgactaccgccgctgcagccaccgaggtgtccctgagtactttcgaggacgaggaagcatctggggtccccacagatggtctggccccgcttacggccactatggcacccgagagggcggtgacatctggcccgggcgacgaagaagacttggcggcagccactacagaggagcctcttatcacggcaggcggggaagagagcggttctccaccaccggacggaccaccgctccccttgcccacagttgcacctgagaggtggataacccctgcccaacgcgagcacgttgggatgaagggccaggcgggccctaagggggagaagggcgacgccggcgaggagctgcccggacctcctgagccctcagggccggtgggtcctactgctggggccgaagcagaaggttccggacttggctggggctcggatgtggggagcggctccggagacctggtcggctcagagcagctccttagggggcctccgggacctcccggtcccccaggcctgcccgggatcccaggaaagcccggaaccgatgtgttcatgggaccacccggcagtccgggagaggatgggcctgccggcgagccaggcccaccgggtccagagggacagcccggggtagatggggctaccggactgcctggaatgaagggagaaaagggcgccagaggccctaatggctcggttggcgagaagggcgatccagggaaccggggcttgccgggcccccccgggaagaaagggcaggcagggcctcccggagtcatgggcccacctgggcctcctggcccgccgggaccaccaggacccgggtgcacgatgggacttggcttcgaggacactgaggggtctgggtctacccagctactgaacgaacccaaactttccaggccgaccgccgccattggattgaagggcgagaagggagaccgcggtccaaagggcgaaaggggaatggatggagcctccatcgtaggaccaccagggcccagaggaccccctggacacatcaaagtactgtctaactctctcatcaatatcacgcacggctttatgaatttcagtgatatacccgaactggtgggcccaccaggccccgatggactccctggcctccccggcttcccaggacccaggggtccaaagggggatactggactcccaggcttccctggactgaagggcgaacagggtgaaaagggtgagccaggtgcgatccttaccgaggacatacccctcgaaaggttaatgggtaagaagggggaaccaggcatgcacggggcaccagggccaatgggacccaaaggccccccggggcataagggggagttcggattgcctgggcgtcccggacgcccaggtctgaatggactgaaaggcacaaagggggatccaggcgtgatcatgcagggacccccaggcctccctggcccaccaggtccacctgggccaccaggtgccgtgataaacatcaagggggccattttcccgattcccgtcaggccacactgtaagatgcctgtggataccgctcaccccgggagcccagaattaataacgtttcacggggtgaagggtgagaaagggagttggggtttgcccggttctaagggggaaaagggagaccagggtgctcagggaccacccggccctccactggaccttgcatatctgcggcattttttgaacaacttaaagggtgagaacggcgataagggcttcaagggggagaagggcgagaaaggcgatattaatggatccttccttatgtctggcccacccggcctgccaggtaaccctggtcctgctggccaaaagggcgaaactgtggttggcccacagggaccccccggcgctcctgggctccccgggccacctggcttcggaaggccgggtgacccgggaccccctggtcctcccgggccacctggccccccagccattctgggtgcagccgtggcgcttccagggcctcctgggcctccaggccaaccgggactaccagggtctcgtaatcttgtgacagcctttagcaatatggacgatatgctgcagaaagctcacctggtgatcgagggcacctttatctacctgagagattccaccgagttttttatccgagtacgcgacggatggaagaagctgcagctcggcgagctgataccaattcctgctgactctcctccgccccctgcactgtcctcgaacccccatcaactgcttccccctcctaaccccatcagcagcgccaattacgagaagcccgccctgcacttagccgctctgaatatgcccttcagcggtgatatccgggccgattttcaatgttttaaacaggccagagctgccggccttctcagtacatatcgagcatttttgtcttcccatctgcaggacctcagtacaattgtgcgcaaggcagagcgatactcccttccgatcgtgaacctgaaggggcaggtcctgtttaacaactgggattcaatcttctccggccacggcggccagttcaatatgcatattcccatttattccttcgacggacgcgacatcatgactgatccatcttggccccagaaggtcatctggcacggatccagtccccatggagtccgccttgttgacaattattgcgaggcatggagaacggccgacaccgctgtaactggtttagcctcacccctctccacgggaaaaatcctggaccagaaagcgtacagctgcgccaacaggcttattgtgctctgcattgagaactcgttcatgactgatgccagaaagtag

SEQ ID NO: 4090 - DNA, 2238 bp, Artificial Sequence
  Description of Artificial Sequence: Synthetic coding sequence
atggccccccggcggaacaacggccagtgctggtgcctgctgatgcttcttagtgtcccactcccttcgtccgtgtcgttcgtcacagggtatggaggcttcccagcttacagcttcggccccggagccaatgtcggccggcccgctcggacactgattccctctacgttctttcgcgatttcgcaatctccgttgtcgtgaagcccagttcaacacgtggtggcgtgttgttcgcaattaccgacgcttttcagaaagtgatttacttaggactgaggttgtctggggtcgaggatggccaccagaggatcatcttgtactacaccgagccgggctctcacgtgtcccaggaggctgccgcgttttctgtccccgtgatgacacaccgttggaatcggttcgcgatgattgtgcagggggaggaggtcacactgctggtgaactgcgaagaacatagtcggattccctttcagcgctctagtcaggccctggcctttgagagctcggccggcatctttatgggcaacgccggtgccacagggcttgaaagattcacaggcagccttcagcaactgaccgttcatccagaccctcggactccggaagagctctgtgaccctgaagaatcctcggcttctggcgaaacctcagggctgcaggaggctgacggcgtcgctgagatactagaggccgtgacatacacacaggcatcccctaaggaggctaaagtggagcctatcaatactccaccgaccccctcctctcccttcgaagatatggagttgagcggcgaacccgtacccgaggggactctggagacaaccaacatgtccattatacaacacagtagcccaaagcagggtagtggcgagatcctcaacgacacgctggagggggtgcattcagtggatggcgaccctatcacagatagtggatcgggcgcgggagcatttctggacattgcagaagaaaagaaccttgccgcaacagcagctggcctggcagaggtaccaatcagcacagcgggtgaagctgaagcatctagcgtgcctacagggggccctactctttcgatgagcactgaaaatcctgaagagggtgttactcctggtcccgataatgaggagaggttggccgccaccgctgctggagaggccgaggccctggcctcaatgcctggcgaagtcgaagcatcaggtgttgcgcctggggagctagatttatctatgtccgctcagtcactcggtgaggaggcaaccgtggggccttcttccgaggactcactcaccactgctgccgcagctaccgaggtgtccctctccacgtttgaggacgaggaggcttctggggtgcccaccgacggcctcgctcctttgaccgccacaatggccccagagcgggccgtgaccagtgggccaggggacgaagaagacctcgcagccgctaccacggaggaaccgctcataactgcagggggggaggagtccgggagtcctccacctgacgggccccccctgccactaccaactgtggccccggagcgctggattacgccggctcagcgtgagcatgtcggtatgaagggccaagcagggcctaaaggcgaaaagggagatgccggagaagaactgccaggcccacccgaaccatccggaccggtaggccccactgcgggagcggaggcggaggggagcgggctaggctgggggtcggacgtggggagtggttccggcgacctggtggggagcgagcagctgcttcgtgggccccctgggcccccagggcctccaggcttaccaggaattcctggcaagcctggaaccgacgtcttcatgggacccccagggtctcctggtgaagacggaccagccggagaacctggcccgcctggtccagaagggcagccaggggtggacggcgctactgggctgcccggcatgaaaggcgagaagggagctcgtggccctaatggatcagtcggagaaaaaggcgatcccggaaaccgcggcctgcctggcccgcctggtaaaaaagggcaggccgggcctcctggagtgatggggccacctggccccccaggtccgcccgggccacctggcccaggctgtacaatgggactcggcttcgaggacactgaaggttcgggctccacccagttactcaatgagcctaaactttcttctccaacaccgacccctcagttttacgatttccacctggccatagtcgaactgtag

SEQ ID NO: 4091 - DNA, 4815 bp, Artificial Sequence
  Description of Artificial Sequence: Synthetic coding sequence
atgtgggtgagctgggcccccggcctgtggctgctgggcctgtgggctaccttcgggcacggagccaataccggcgcccagtgcccccccagccagcaagaaggcctgaagctggagcacagcagtagcctgcccgcaaatgtgaccggctttaatcttatccacagactgtctctcatgaagacatctgctataaaaaaaataaggaatcccaaaggtcctcttatcttgaggttgggggcagcgcccgtaacccagcctacacggcgggtgtttccgagagggctcccagaggaattcgcccttgtactgaccttgttattaaagaagcacacccaccagaaaacctggtacttattccaggtgacagatgccaatggatatccccagatcagccttgaggtgaactcccaggaaaggtccctggaattacgcgcacaaggtcaggatggggactttgttagttgtatcttcccagtaccccagcttttcgatctccgatggcataagttgatgctgagcgtcgccggacgcgtcgcgagtgtgcacgttgactgctcgagcgccagttcccagccgttaggtccacgacgccccatgcgtcctgtgggccacgtgttcttaggcctcgacgccgagcaggggaagccggtttcttttgatctgcagcaggtccatatttattgtgatcccgaattggtgctggaggagggttgttgcgaaattctccccgcaggatgccctcctgagaccagcaaagctcgcagagatacacaatcgaacgaactcattgagattaacccacagtctgaaggcaaagtctacacaagatgcttctgtctggaggaaccccagaattccgaggtggatgctcaacttacaggaagaatttcccagaaagcggagcgcggcgccaaggttcatcaagaaactgccgccgatgaatgccccccgtgtgtgcacggggcacgagattctaatgtaagcgaatggagagtggggccagagggtggcaaaggcgagaggggattgccaggccctccaggctccaagggtgagaaaggcgcaagagggaacgattgcgtgagaatctccccagacgctcctctgcagtgcgccgaaggcccaaagggggaaaagggggaatcgggggctcttgggccttccggcttgcctggctctactggcgagaaaggccaaaagggagagaaaggtgatgggggcattaagggggttcctggtaaacctgggcgcgatggccgccccggggagatctgcgtgataggcccaaaggggcagaagggtgaccctggctttgtgggtcctgaggggctcgccggggagcctggcccgcctgggctgccaggaccgcctggcatcggcctcccgggtacaccgggtgatccaggagggcctcccgggcctaagggtgacaagggtagcagcggcattcccggcaaggaggggcccggtggaaaaccgggtaagccaggcgtgaaaggcgaaaaaggggacccctgtgaagtctgcccgaccttgccagaaggtttccagaacttcgtagggctgccaggcaagcctgggcctaagggggagccaggggaccctgtaccggccagaggggatccgggaattcaaggaatcaagggagagaaaggagaaccatgcctttcatgttcctccgtcgtcggtgctcagcatctggtgtctagcaccggcgcctcaggagacgtcggaagcccgggctttggcctcccgggccttcctgtcaaggcaggcgtgcctggcttgagccccggggggaacttcggcgaagcgggccccgccggctctcccgggcctccaggaccagtggggccagctggcattaagggcgcaaaaggagaaccatgcgagccctgtccagcattatctaacttgcaggacggtgacgtccgagtggttgctctgcctggtcccagtggggaaaagggtgagccgggacctcccggctttggattgccaggtaagcaaggcaaggcgggtgaaagaggactgaaaggccagaagggggacgctggcaaccccggcgaccctggcacgcctggcactacaggaagacccggtttgtcaggtgagcctggggttcagggtcctgccggccctaagggagaaaagggtgatggatgcacagcctgtccgagcctgcaaggtacggtcacagatatggccggcaggcctggacagccaggacctaagggggagcagggacctgaaggggttggacgacccggaaaacctgggcagcccgggctacccggagtgcaggggccccccggcttgaagggagtacagggcgagcccggaccccctgggagaggcgtgcagggccctcagggtgagccaggtgctcccggactgcccgggattcaggggcttccaggccccaggggccccccaggacccaccggtgagaagggcgcgcagggaagccctggggtaaagggagcaacaggacctgtgggcccccctggtgccagtgtctcaggccccccggggcgggatggacaacaagggcagactgggctccgtgggacccctggggaaaaggggccacggggggagaaaggggagcccggagagtgctcctgcccttcacagggcgacctgatttttagcggcatgccgggcgcacccggactttggatgggaagctcatggcagccaggcccacaggggccgcctggcatcccgggacctccagggccgccaggggtaccaggccttcagggcgtgccaggaaacaatggactgccgggccagcccggtctgacagcagaactaggggctcttgcgctcggcagtcactggggatctccatccatctgtggggactgcgtgcaaggacagcgcgcccatcccgggtatctcgtcgagaagggggagaagggtgaccagggtatccctggcgtgcctgggctcgacaattgtgcccagtgtttcctgagtcttgaacggccccgtgcagaagaagcccgcggggataactctgagggggatccaggatgtgttggaagtcccggcctgccaggtccaccaggtcttcccggccagaggggtgaggaaggtcccccagggatgcgcggaagtcctggcccacccggaccaatcggaccccctgggtttccaggagctgtggggtcccctgggctcccaggcctccagggagagcgcggtctcacgggactgaccggcgacaaaggagagcccggcccaccgggacaacccggatatccaggagctactggacctcccggtctgcctggcataaagggagagcgcggatataccgggtctgccggggagaaaggggagcctggcccacctggcagcgagggtctgcctggacctccaggacccgccggcccacgtggagagaggggaccacaaggcaacagtggggaaaaaggagatcagggctttcaggggcagcctggatttcccggtcctcccggccccccaggcttcccaggaaaagtgggtagcccaggccctcccggcccccaagccgaaaaagggagcgaaggaatcaggggaccttccggccttccaggatccccaggaccccccggtcccccaggcattcagggcccagccgggctggacgggctcgatggcaaagatggcaagccaggactgcggggggaccccggtcccgcggggccaccgggactgatgggtcccccaggctttaaggggaaaacaggccacccggggctccctggccctaaaggcgactgtggcaaaccgggccccccagggtccaccggacgcccgggggccgagggggaacctggggcgatgggaccacagggtcggcctggtccaccagggcacgttggacccccaggaccccccgggcagcccggcccggctgggatttccgccgtgggcttgaaaggcgaccggggagcaactggagagcggggcctagccggactgccgggccagccagggcctcctgggcatcctggaccacccggagaaccagggacagacggagctgctggaaaggagggcccccctgggaaacagggattctacggacccccagggcctaaaggagaccccggggccgccggccagaagggccaggccggagagaaaggccgggccgggatgcccggggggcccggaaaatctggctctatgggacccgtgggccctcctggccctgcaggtgagcggggccaccccggggcccctggacctagcggcagccctggactgcctggtgtgcctggcagtatgggcgatatggtgaactatgatgagatcaagagattcatacggcaagaaattattaaaatgtttgacgaaagaatggcctactacacctcaaggatgcagtttccaatggagatggccgcagcaccaggcaggccaggcccacctggaaaggatggggcccccgggcgccccggtgctccaggtagtcccggactgcctggccaaatcggccgcgagggccggcaagggctcccaggcgtcaggggactgcctggaaccaagggggagaagggcgatattgggataggcatcgccggagagaacggtcttcccggaccgcctggaccacagggtcccccaggctacggaaaaatgggcgcaacaggccctatggggcagcagggcatccctggtatccccggcccccccgggccaatggggcagccggggaaggctggccattgcaacccctccgactgctttggcgccatgcccatggaacagcagtatccaccaatgaaaactatgaagggaccctttggctag

SEQ ID NO: 4092 - DNA, 4815 bp, Artificial Sequence
  Description of Artificial Sequence: Synthetic coding sequence
atgtgggtgagctgggcccccggcctgtggctgctgggcctgtgggccacattcgggcatggcgcaaacaccggggcacagtgccctcccagtcagcaggagggactaaaactggaacacagctccagcctgcccgcaaacgttacaggctttaacctaatccacagactgtctctcatgaaaaccagtgccataaagaagattaggaacccaaagggtcctcttatcttaaggctgggcgcggcacctgtgacacagcccacccgccgggtctttccacgcgggttgcccgaagaattcgccctcgtcctaacattactgctgaaaaagcacactcaccagaagacttggtacttgttccaggttactgatgctaacggatacccccagatctccctggaggtgaacagccaggagcgttcccttgaactgcgtgcacaagggcaggacggggactttgtcagctgtatctttccagtcccccagctttttgacctccgatggcataagttaatgctttcagtggcgggcagagtcgcctcagtgcacgtcgactgctcctccgcttcctctcaacctctgggcccacgcagacccatgcggcccgtgggacatgtgtttctgggcctggatgccgaacagggcaaacccgtttcttttgacctgcaacaggttcacatttattgtgacccagagttagtactagaagagggctgctgcgaaattctccctgccgggtgcccccctgaaacgtcaaaggcccgcagggatacccaaagcaacgagctgatcgaaattaatcctcaaagtgaggggaaggtatatacacgatgtttctgtcttgaagagccgcagaattcggaagtggacgcgcagctgacggggagaatttcacagaaagcagagaggggggccaaggtccaccaggagactgccgcagacgaatgtccgccctgtgtccatggggcacgggacagtaatgttaccttggccccctctggaccaaaggggggcaagggcgagcggggcctccccgggccaccagggagcaaaggggagaagggggcccgcggaaatgattgcgtgcggatctctcctgatgcccccctacagtgcgcagaggggcccaagggcgaaaaaggtgaatcaggggctctgggcccttcaggtctgccaggctccacaggcgagaaaggccagaagggggagaaaggcgatggcggaattaagggagtgccagggaagccaggccgcgacggtcgcccgggtgagatctgtgttataggacccaagggtcagaaaggtgatcctggattcgtcggccctgagggattggccggggaacctggcccaccgggcctgcccggaccgcccgggatcggactgccaggcaccccaggtgacccgggtggcccgcccgggccgaaaggcgacaaaggttctagcggaatacccggaaaagagggtcctgggggcaagccgggtaagccaggagtgaagggcgagaagggggacccgtgcgaagtttgccccacactcccagagggtttccaaaacttcgtgggtctccccggcaaacccggcccgaagggggagccgggagaccccgtgccagcccgcggcgaccccggtatacaggggattaaaggcgagaaaggcgagccttgtctctcttgttcgagcgtcgtaggggcccagcatttggtgtcctccactggtgcctccggagatgtgggaagcccaggattcggcctgccaggactgcctggcagggcaggagttccgggccttaagggcgagaaaggcaactttggagaagccggcccagctggcagtcccggacccccaggcccggtgggccccgcgggcattaagggcgccaaaggggaaccgtgtgaaccatgccctgccctctctaacctccaggatggcgatgttcgcgtagtagctctgcccggtccttctggcgaaaaaggagaaccagggcccccggggttcgggctgcccggaaagcaggggaaggctggtgagcgaggccttaagggccaaaaaggcgatgccggaaatcctggagaccctggaacaccgggcacaactgggagacccggactctctggagagccgggggtccaggggcccgcaggcccaaagggcgaaaagggtgatggatgcaccgcatgtccctctctacaaggtactgtgaccgatatggcaggccgacccgggcaaccgggcccaaaaggcgaacagggcccggaaggggtgggaagacctggcaaacctggacagccaggccttcctggcgtccagggaccacctggcctgaaaggcgtacagggtgagcccgggcctccgggtaggggcgtccaaggacctcagggcgaaccaggtgctcccggccttccgggtatccaaggcctgccaggcccacgcggacctccaggtccaaccggcgaaaagggcgcgcaagggtcccccggcgtcaagggagccaccggaccagttggtccccccggagcatctgtctcaggccctcccggcagggacgggcagcagggccagactggactgcgcggcacccctggagagaaggggccccggggtgaaaagggggagccaggtgaatgtagctgtccatcccagggggatctaatcttcagcggtatgcccggtgctcccggcttgtggatgggaagctcctggcagcccggacctcagggtccaccggggatccccggaccacctggtccaccgggggtcccaggtctgcaaggcgttcctggcaataatggacttccagggcagcctgggctgaccgctgaactcgggtccctcccaattgagcagcacctcttaaaatcaatctgtggtgactgtgtgcagggccagcgggcccaccccggctatcttgtcgagaagggagaaaaaggggaccagggcatccccggcgttcctgggctcgataattgcgcccagtgtttcctctcgttggagcgaccccgcgccgaagaggcacgcggagacaacagtgagggagatcccgggtgcgtgggttctccaggcctgcctggaccacccgggctgcctggacaacgtggcgaagaaggaccaccaggtatgaggggatcaccaggccctcctgggcccattggccctcctggattcccgggcgctgttggctcaccagggcttccaggactccagggcgagagggggctgaccggacttaccggcgacaaaggcgaacctggcccccctggtcagccaggatacccaggcgccacaggcccacctggtcttccagggattaagggggaacgcggctacacaggtagcgccggtgagaagggtgaacctgggcctccaggcagtgagggcctgcccgggcctcctggtccggctggacctcgtggcgaacgcgggccccaaggcaattccggggagaagggggatcagggatttcaggggcagcccggcttccctgggcctccaggcccccccggatttccaggcaaggtggggtcacctggaccaccaggccctcaggcagagaaggggtccgaggggattaggggacctagtgggttaccgggctccccaggtcctccgggacctcccggcatccagggccctgccgggcttgatggcttggacggaaaggatggcaagcccggcttacggggcgacccgggccccgccggtcctcccggattaatggggccccctggatttaagggaaagacagggcatcccggactgccaggtcctaagggtgattgcggtaagcctggcccaccagggagcaccggcaggccaggagcagagggcgagccaggggctatgggaccccaaggacggccaggccctccagggcatgtgggtccacctggccctcctggacagccaggaccagcaggtatatctgctgtgggcctgaaaggtgatagaggcgctaccggcgaacgggggcttgcaggcttgccggggcagcccggcccccccggacatccaggtccaccaggagagcctggcaccgatggtgccgccggaaaagaagggcctcccggtaaacaaggattttatggcccgcctgggccaaagggcgacccaggtgctgccggccagaagggacaggctggcgagaaaggtagagcgggaatgcctggcggcccagggaagagtggctccatgggtcctgttggtcccccggggcctgctggtgaacggggtcaccctggcgctcctgggccatccggaagcccgggcctccctggagtgcctggctccatgggggatatggtgaattacgatgaaatcaaaaggttcataaggcaggagataattaagatgttcgacgagcggatggcgtactatacctctcgtatgcagttcccaatggagatggcggcggcccctggccggcctgggcctcctggcaaagacggggccccgggtcgccctggagctccagggagtcctggactccccggccagatcggcagggaaggcagacagggcctgccaggagtccggggattgcctgggacgaaaggagagaagggagacattggaatagggatcgctggagagaacgggctacctggacctcctggacctcagggtccacctggctatggtaaaatgggcgccacgggccctatggggcagcaggggatccctggcatccccgggcctcccggcccgatgggccagcccgggaaagccggccactgtaacccgtccgactgcttcggggccatgcctatggagcagcagtatcccccgatgaagacaatgaagggaccattcgggtag

SEQ ID NO: 4093 - DNA, 4494 bp, Artificial Sequence
  Description of Artificial Sequence: Synthetic coding sequence
atggacgtgaccaagaagaacaagcgggacggcaccgaggtgaccgaacgtatcgttactgagacagttacgaccaggttaacttctttgccccccaaaggtggtactagcaacgggtacgccaagactgcctcactgggtggcggctcacgcctcgagaagcaatctctgactcatggctcttcaggctatatcaattcaaccggctctactcgcggtcatgcctctactagctcttacagacgcgcccattcacccgcatctactttacctaattctccgggaagtaccttcgagcgtaagacccatgtgactcgccacgcttacgagggatcatcctctggaaacagtagccccgagtacccgcgcaaagagtttgcttccagcagtacacgcggccgctcccaaacacgggagagcgagatacgagttcgactgcagagcgcttcaccctctacgagatggacggaactagatgacgtgaaacggcttttgaaggggtcacggtctgccagcgtgagccccacaagaaatagtagtaatacattgcccatcccaaagaaaggaaccgtcgaaacaaagattgtgacagcctctagtcagagtgtcagcgggacctacgatgctaccatcctagatgcgaatctcccgagtcacgtttggtcctcaaccctacctgccggatcctccatgggtacctatcataataatatgactacccagagctcaagcttactgaacacaaacgcctacagtgccgggagcgtatttggagttccaaacaacatggcctcctgctcacctacattgcaccctggactgtctacaagctcaagtgtatttgggatgcaaaacaatcttgctccatccctgacaacgctgtcccacggaacgacgacaacgtcaaccgcatacggggtgaagaagaatatgccccagtctccagctgccgtgaatactggagtgtcaacatccgccgcgtgcactacatcagtacagagcgacgacctactccacaaggactgtaagttcctaattctggagaaagacaacacccctgcgaaaaaggagatggagcttttgatcatgacgaaagactcaggaaaggtgtttactgcgagtcctgcttcaatcgccgccaccagctttagcgaagacacactaaagaaggaaaagcaggccgcctataatgcagacagcggcctcaaagctgaagctaatggggatctaaagacggtgtccacaaaagggaaaacgacaaccgccgatatccattcctatggctcaagtggggggggcggaagcggcggaggcggtggtgtaggtggggctggtgggggtccttggggccctgctcccgcctggtgtccttgcggatcatgttgtagctggtggaaatggcttctcggtctactactgacctggttgctgctcttgggcctgctctttggcctgattgcccttgccgaggaggtcagaaaactaaaggctagggtggatgaacttgaaagaatccggaggtccattcttccctatggagattccatggatcggatcgaaaaagaccgactacagggaatggctcccgcagcgggtgccgacctggacaaaatcgggctacactctgactcccaggaagagctttggatgtttgtgagaaaaaagctaatgatggaacaggaaaatggtaatctccgcggctcccccggtcctaagggcgatatggggtctccaggcccaaaaggtgacagaggatttcctggaacaccaggcatcccgggcccactgggccaccctggcccacagggccctaaaggtcaaaaggggagtgtgggggaccctggaatggaagggccgatgggtcagcgtgggcgagaaggacccatgggtcctcggggcgaggctggccctcctgggtcgggagagaaaggagagcgtggggcggccggagaacccgggccacacggcccacctggggttccaggtagcgtcggcccaaagggctcatcagggagtcctggacctcagggccccccggggcccgtcggcctgcaaggcctaagaggtgaggtgggcctgcccggcgtgaaaggagataagggccctatgggtccaccaggaccaaagggggaccagggggagaaggggcctagaggcctcaccggagaaccaggcatgcgagggctacccggggcggtgggggagccgggagccaaaggggccatgggtccagcaggacctgatggccaccagggccctaggggcgagcaaggcctgacgggaatgcccggcataagagggccgcccggcccttcaggagatccgggaaagccaggtctgacgggccctcagggcccccaagggcttcctgggactcccgggagacccggcatcaaaggcgagccaggcgcccccggtaaaattgtgaccagcgagggcagctcaatgctgacggtcccagggccccccggaccacctggcgcgatgggcccacctgggcctccaggggctccaggacccgctggacccgctgggctcccgggccaccaagaggtattgaacctgcagggtcctcctgggcccccaggcccacgaggtcctcccgggccatctatccctggcccgcccggacctcgggggccccctggcgaaggcctgcctggccctcctggcccccccgggtccttcctttccaacagcgagacctttctgagtgggccccctggaccgcctgggccgcctggtccaaaaggcgatcagggtccaccaggaccacgtggacaccaaggcgaacagggcctacccggattctccacgagtgggagtagctccttcggcctaaatctccagggcccgccgggtcctccaggccctcaagggccaaagggggacaagggagatcctggtgtccccggagccctcggcatcccttctgggcctagcgaagggggatcctccagtacaatgtacgtgtccgggcctcccgggccaccagggccaccaggcccacccggctctattagctcttctgggcaagaaattcaacagtatatatccgagtatatgcagagcgattcaattagatcttaccttagcggggtgcaaggccctccaggtcccccaggcccaccggggccagtcactacaattacgggtgagaccttcgactacagtgagctcgcttcacatgtggtgagctacctgagaactagcggctatggcgtctcgctgttcagttccagtatctcatccgaagacatcctggctgtgttgcagcgcgatgacgtgcggcagtacctgcggcaatatttgatgggaccgagaggcccacctgggcctcccggtgctagtggtgacggctccttgctatccctcgattacgccgaactatcctcccgcatcctgtcctacatgtcatcttctggaatcagcatcggcttgcctggcccacccggaccaccaggattgcccggcacctcctacgaagaattgctgagcttgttaagaggcagtgaatttcgtgggattgttggaccaccaggaccgcctggccccccggggatcccgggtaatgtgtggagttctatctccgtcgaggacttgtcgtcctacctccatacagccgggctgagcttcatcccgggaccccctggcccgcccggccctccaggcccgagaggtccacctggagtgtctggggcattagccacttacgcagcagagaactccgatagtttcaggtctgagttaataagctacctaacctccccagatgtgcggagcttcatcgtgggacctcctggccctcccggccctcaagggccccctggcgacagtcggttgttatctacggacgccagccactcaagaggatcctcctcctccagtcactcttcctcagttcgcaggggctcgagctattctagcagcatgagcacaggcggcgggggcgctgggtcactgggtgcgggcggagccttcggcgaagcagccggggatcggggcccctacgggacagacatcggcccaggcggcggttatggagccgctgctgaaggcggtatgtacgctggtaacggaggactgttaggagctgacttcgcaggagatctcgattacaatgagctagccgttcgggtttctgagagtatgcaaaggcaaggcctcctccaaggaatggcctacaccgtgcaaggccccccggggcaaccaggcccacagggccccccaggaatttccaaggtcttctccgcttacagtaacgtgacagcggacctgatggactttttccaaacatatggggccattcagggacccccaggacagaagggcgagatggggacccccgggccaaaaggggaccggggccctgctgggcctccaggccatcccggccctccgggtccgcgaggtcacaaaggcgagaagggcgataagggagatcaagtgtatgccggacggagaaggcgacgctccattgcagtcaagccctag

SEQ ID NO: 4094 - DNA, 1254 bp, Artificial Sequence
  Description of Artificial Sequence: Synthetic coding sequence
atggacgtgaccaagaagaacaagcgggacggcaccgaggtgaccgaacgcatcgttaccgagaccgtcactacgcgattaacctctctgccgccgaaaggagggacatccaatggatacgcaaaaacagcgtcactgggcggcgggtcaaggctcgagaagcaatctctcactcacggctcctcaggatatattaattccaccggatcgacccgtggtcatgcttccacctcttcctataggagagcccacagccctgcttccactcttcccaattcccccggatccacattcgaacgcaaaacccatgtaaccaggcacgcttatgaagggtcaagttcaggaaacagctctcctgagtacccgcggaaagagttcgccagctcatccaccaggggacgaagccagacccgggaatcggagatccgggtgagactgcagagtgcctccccatctactcggtggacagagctcgacgacgtaaaaagactgctgaagggctctcggagtgcttctgtgtccccaacccgcaattcatccaataccttaccgattcccaagaagggtaccgttgagaccaaaatagttacggcatcaagccagagcgttagcggcacatacgacgcgactattctcgacgccaatcttccatctcatgtgtggtcttcaacactccccgcaggaagttccatggggacctaccacaacaatatgactactcaatcttcctcgttgctgaacacaaacgcatattctgccggtagcgtgttcggggtcccaaacaacatggccagctgctctccgacactccacccgggactttctacaagtagcagcgtgttcggcatgcaaaacaacttagccccgtctttaacgacactgtcccatgggactacgacaaccagcacagcctatggcgtgaagaagaatatgcctcagtctcctgccgctgtcaatactggagtctctacgtctgccgcatgtactacaagcgtgcagagtgacgatctcttgcacaaggactgcaaattcctgattcttgagaaagataacacaccagcgaaaaaggagatggaattgctgatcatgaccaaggattccgggaaagtattcaccgcttccccagcttccatagcggctacgtctttcagtgaagatacgctgaagaaggagaaacaggctgcctacaacgctgatagtggactcaaggcagaggctaacggaaagaataagtacgactgttgtcccccatag

SEQ ID NO: 4095 - DNA, 201 bp, Artificial Sequence
  Description of Artificial Sequence: Synthetic coding sequence
tgatacggcgccatccagggcccccccggccagaagggcgagatgggtacccctggccccaagggggatcgaggccccgctggaccccctggccacccaggcccccccggacctagagggcacaagggcgagaagggcgacaaaggtgaccaggtttacgccggaagaagacgcaggagaagcatcgcagtgaagccatag

SEQ ID NO: 4096 - DNA, 1815 bp, Artificial Sequence
  Description of Artificial Sequence: Synthetic coding sequence
atggacgtgaccaagaagaacaagcgggacggcaccgaggtgaccgaaagaatagtgacagaaacggtaacaacccgcctgaccagtctgccccctaagggaggaacaagcaatggttacgcgaagaccgcctcactgggaggcgggtctcgactggagaaacagagccttacccacgggagttccgggtatatcaactctactgggtctacaagaggccacgccagcaccagtagctacagaagagcacattccccagcttcaacgcttcctaatagtccaggctcaacgtttgagaggaagacacacgttacgaggcatgcctacgaagccagttctagcactagaggcagaagtcagacaagagaatccgaaatacgggtccgcctgcagtcagcctctcctagcacccgctggactgaactggatgacgtaaagaggctgttgaagggtagtaggagtgcctctgtcagccctacacgcaactcaagcaacacacttcccattcccaagaagggcaccgttgagacaaagatcgtcaccgccagctcacaatccgtgagtggaacatatgatgcaactatactggacgcaaatctgccgtctcacgtctggtcctcgactctcccagctggatccagcatgggcacgtaccacaataatatgactacccagtcctcttccctactcaacactaatgcatattcagctggcagtgtttttggtgtgcccaataacatggcaagctgttcccccaccttacatccagggttgtctacgagctccagtgttttcggaatgcagaacaacctcgccccatctctcaccacgctgtcacacggcacgaccactacaagtaccgcctatggagtgaagaagaacatgccccagtccccagctgcagtgaacacaggggtgtctaccagcgctgcctgtactacatctgtgcaatcggatgatctcttacacaaagattgcaaattcttaattctcgagaaggacaatactcctgcaaaaaaagaaatggaattactgatcatgaccaaagattcgggcaaggtttttaccgccagccccgcctcgattgccgcaactagcttctccgaagacacactgaagaaggagaaacaggccgcttataacgcggattccggactcaaagccgaggccaatggcgacctgaagacagtttctactaaaggcaagactactaccgcagatatccactcctacgggagcagtggtggagggggaagcgggggcggtgggggggttggtggtgctgggggtggcccatggggacctgcccccgcttggtgtccttgcggatcctgctgctcttggtggaaatggctgctcgggttgctgctaacctggctgttgcttttgggcctcttgttcggtctgattgccctggctgaagaagtccggaagttgaaggcgcgcgtagatgagctggagaggattcggcgttctattctgccttacggagatagcatggatcgtatagagaaggaccgcttacagggaatggctccagccgccggcgccgatctggataagattgggctccattccgacagccaggaagagctttggatgttcgtccgaaaaaaacttatgatggagcaggagaacggcaatctgcgcggctctccaggtcctaagggagacatgggcagtcctgggcccaaaggagacagggggtttccaggcacaccaggcattccagggccacttggtcatcccggtcctcagggccctaaaggacaaaaaggatctgtcggcgatccagggatggaaggacccatgtag

SEQ ID NO: 4097 - DNA, 3951 bp, Artificial Sequence
  Description of Artificial Sequence: Synthetic coding sequence
atgagcagcggcgaccccgcccacctgggcctgtgcctgtggctgtggttgggagctactcttggccgcgaacaggtgcaggcttctggtctgctgcgactggccgtgctcccagaggacaggcttcagatgaagtggcgcgagtcagaaggctctggattggggtatctggtgcaggtgaagccaatggcaggcgactccgaacaggaagtcatactgacgaccaagactcctaaagcaactgttggtggcctgtcaccttcaaagggctatactctgcaaattttcgagctgacagggtccggacggtttctcctcgcgagacgagagttcgtaatcgaagacctgaaatcaagcagtctggatagatcttcacaaagacccctcggtagcggggcgcctgaaccaactccttcgcacaccgggtcaccagatccagagcaggcgagcgagcctcaggttgcattcaccccgtcccaggatcccaggacccctgcaggacctcaatttcggtgccttcccccagtgcccgccgacatggtctttctggtggacggatcatggagcatagggcactctcactttcaacaagtgaaagattttctagctagcgtgatcgcacctttcgaaattggtccagacaaggttcaggtcggccttacgcagtactcgggcgacgcacagacagagtgggatctgaatagcctcagcacaaaggaacaggttcttgccgctgtgagaagactcagatataaaggcggaaacacctttacgggactggcgctaacccatgtactgggccagaatctgcagcccgcggctggcctgcgaccagaggcggctaaagtagtgattctagtgaccgacggcaagtcacaggatgatgtgcataccgcagcacgcgtccttaaggacctgggggttaatgtgtttgcagtgggagttaagaacgccgatgaggccgagcttcgattactggcctcacctccccgtgacattaccgtgcactcagtgctggatttcctgcagctgggcgctttagccggactcctgtctcgcctcatttgccagcgtcttcagggcggcagtcctcggcagggaccagctgctgcccccgcgttggacaccttgcctgccccgactagccttgtactgtcccaggtcacttcgtcatccattcgcctctcatggacaccagccccacggcacccactgaagtatttgatcgtctggagggcatccagaggaggcacgccacgtgaagtggtggtcgagggccctgcagcctctaccgaacttcataatcttgcaagccggactgagtacctggtcagtgtgtttcctatttacgagggtggagtgggcgaggggcttaggggcttggtaacgactgcacccttgcctccacccagagcattgacactagccgccgttaccccacggaccgtgcatcttacctggcagcccagtgcgggggccacccattatctggtgaggtgctctcccgcttccccgaagggtgaggaagaggagagagaggtgcaggttggtcgaccggaagttttgcttgacggtctggagcccggcagagattacgaagtctcagtgcaatcccttcggggacctgaaggcagcgaagcccgcggtatacgggccagaaccccaacactagctccacccaggcatctgggattttccgatgtctcgcacgatgccgcgcgcgttttttgggaaggagccccccgaccagtccgcttggttagggtgacctacgtgtcaagcgaaggggggcatagtggacagacagaggcccctgggaacgctaccagcgcaacactcggcccgttgtcctcatctaccacttacaccgtgcgggtgacctgcctgtatcccggaggaggatccagcacacttaccggacgggtcacaaccaaaaaggctcctagccctagccagctttctatgacggagctccctggcgatgccgtgcagcttgcctgggtcgccgcagcaccttcaggagtgttggtttaccagataacctggacaccactgggtgagggcaaggcccacgagatcagcgttcctggaaacttggggactgcagtgctgcccggactcggcaggcacacagaatatgacgtgaccatcttagcctactaccgtgacggcgcccgaagtgacccagtttccctgcgctatacaccttcaactgtttccagaagcccacccagtaatctggccttggcttcagaaaccccagacagcctccaggtcagctggacaccccccctgggtagagtgttgcactactggctgacatatgctccagcgtctgggctcgggcctgagaaatccgtttccgtgcccggggctcgaagccacgtgacactgccagacttacaagccgccactaagtacagggtcctggtgtccgcaatttatgccgcaggtcgctcagaagccgtaagtgccacagggcaaaccgcatgtcccgcactacggcccgatggaagcttgccggggttcgatctgatggtcgcgttctctctagtggagaaagcctacgctagcattaggggggttgccatggagccttccgctttcgggggcactccaacctttactctgtttaaggacgcccaactgacaaggcgcgtctcagatgtctatcccgcgcctttgcccccagagcatacaatcgtttttctggtacgtctgctgcctgaaactccccgagaggcctttgcgctctggcagatgacagctgaggatttccaacccctgctgggggtgctcttagatgccgggaaaaagtccctaacatatttccatcgagatccccgagcagccctgcaggaggcgacatttgatccacaggaagtcaggaagatttttttcggctcatttcacaaggttcatgtcgcagtggggcgctccaaagtgcgcctgtatgtggactgccgcaaggtagccgagcgacccctcggagagatgggcagccccccggccgccggctttgtgactttaggcagactcgccaaggctcgcggtccccgcagcagcagcgccgccttccagcttcaaatgctgcagattgtttgcagcgatacctgggcagatgaggatcgctgctgtgaattgccagcgtcacgcgatggcgaaacatgcccagctttcgtctccgcctgcagctgcagttctgaaactcccggacccccaggtccacaggggcccccgggattaccaggaagaaatgggacccccggcgagcagggctttcccggccccaggggggagccggggcctccaggacagatgggccccgagggcccgggaggacaacaggggtcccccggtacccaggggcgggctgtacaggggcccgtcggacctcctggagtgaaaggcgagaagggggaccacggacttcccggcctccagggacacccgggccaccaaggcattcccgggagagtgggcttgcagggtccgaagggcatgcgggggctggagggtactgcgggcctgcccggccctcccggaccaagaggcttccagggaatggcgggtgcacggggcacatccggggagcgagggccgcccgggacagttggacctactggcctgccaggtccaaagggggaacggggtgagaagggcgagccccaaagcctggccaccctgtaccagttagtttctcaggcatcccacgtatctaagttcgattcgtttcatgagaatactcggccacccatgccaatattagaacaaaagttggaaccaggtaccgaaccactagggtcacctggaacaaggagcaaagcacttgttccgggggaatggggccggggcggtcgtcatctcgaagggcgcggagagccaggagccgtcggtcagatgggcagccctggccaacagggggcttccactcagggtctctgggagtag

SEQ ID NO: 4098 - DNA, 3855 bp, Artificial Sequence
  Description of Artificial Sequence: Synthetic coding sequence
atgagcagcggcgaccccgcccacctgggcctgtgcctgtggctgtggttgggagccaccctcggccgggagcaagtgcaggcgtctggtctactgaggttggccgtactcccagaggatcgactacaaatgaagtggcgcgaatcagagggttccgggcttgggtatttagtgcaagtgaagccaatggctggagattctgagcaggaagtgatcctaaccaccaagacacctaaggctaccgtgggtggtctgagcccttccaaaggatacactctccaaatattcgagctgacaggatccggacgcttcctgttagccagacgcgagtttgtaatcgaagatctgaaatcatcaagtctggatcgttccagtcagcggcctctgggatccggcgcccctgagcctacgccttctcacactgggtcccctgacccagaacaagcgagcgagccacaagttgcctttacaccctctcaggaccctaggacgccagccggtccacagttccgctgtcttcctccagtgccagctgacatggtttttctcgtagatggatcctggtccattggccacagtcactttcaacaagtgaaagactttttggccagcgtcatcgcaccgtttgagatcgggccagacaaggtacaggttggattaacccagtattccggggacgcccagactgagtgggatctgaactctttgagtacaaaggaacaggtgctggccgcagtgcgtaggttgagatacaaaggcgggaatacgtttacaggcctggcactcactcatgttctcgggcagaacctccagcccgccgccggcctccggcccgaggctgcaaaagttgtgatcctcgtaactgacggaaaatctcaggacgatgtgcacacagccgctcgcgtgttgaaggatctcggagtcaatgttttcgcagtcggagtgaagaacgccgatgaggcagagctgcgcttactcgctagccctccacgcgacattacggttcacagcgttctcgactttcttcaactgggggcacttgcgggcctcctcagcaggcttatctgtcagagactccagggcggatctcctcggcagggccctgccgcagcacctgctttagacacactacctgctccaacaagcctggtcctatcacaggtaacgtcctcttccatccgccttagttggacccccgcccccagacatccgctaaaatatttaattgtttggagagcctcccgcggtgggacacccagagaagtagtcgtagaagggcctgctgcttctaccgaactgcacaacttggcatcgcgcactgagtacctggtgtctgtgttcccgatctatgagggcggtgtgggggagggcttgagaggactggtcaccaccgcgcccttgccccctccacgggccctcacactggccgccgtcacaccaagaactgtgcatttgacctggcagccatccgcgggggccactcactacctcgtgcggtgctcacctgcctcccccaagggcgaggaggaggagcgggaggtccaagtaggtcggccggaagtgctgctggatggattagaacccggcagagattacgaggtgagcgtgcagagtctcagaggccccgagggcagcgaagccaggggcatcagggcgaggactccaacacttgctccccctcgacatttgggcttttctgacgtcagccacgacgccgccagggtgttctgggagggagctcctagacctgtgaggctggtacgcgtcacttacgtctcgtctgagggcggtcactcaggccagacagaagcaccaggcaatgccacctccgcaaccctgggacccctatctagttcgactacatacacggttcgggtgacctgcctctaccccggcggaggttcctcaacgcttacagggagagttaccactaaaaaggcgccatcccccagtcagctaagcatgaccgaacttccaggtgacgcagttcaactcgcatgggtggcagcggccccttctggggtcttagtttaccagattacatggacccctctgggtgaggggaaagcacatgaaatcagcgttccaggaaacctgggaacggccgttttgccgggcctggggaggcatacggaatatgacgtcacaatccttgcatattaccgcgacggagctagatcagatcccgtatctctgaggtacacaccaagcacggtatctagaagccccccttccaatttagccctggcaagtgaaacccccgactcgctacaagtgtcgtggactccacctttgggccgcgtgctccactactggctgacctacgcgccagctagcggcttgggacccgaaaaatctgttagtgtgcccggagcaagatcacacgtaacactgcctgatctgcaggccgccacaaagtaccgcgtgttagtctccgcaatttatgccgccgggcgctccgaagctgtcagtgccacaggccaaacagcctgtcccgcactgcgtcccgacggcagcctccctgggttcgatctgatggtggccttttccttagtggagaaagcctacgcgtccattagaggagtggccatggagcctagcgcattcggcgggacgcccactttcaccctgtttaaggacgctcagttgactagacgggtgagtgacgtttatccagccccgcttccccccgaacatacaattgtgttcctcgtaaggttactgcccgagacccccagggaggcattcgccctgtggcaaatgacagccgaggacttccagccgctgctgggcgtgctcctggatgctgggaagaagtctctgacatattttcaccgcgacccacgggcagctctccaggaggccacattcgacccccaggaagtccggaagatcttctttgggagcttccacaaagtacatgtggctgtgggccggtctaaagtgcgactttatgttgattgtaggaaggtcgcagagcgaccactgggggagatggggtcaccgcctgctgcaggctttgtgaccctgggcagacttgctaaagcccgtggacctcggtcttctagtgccgcttttcagttgcagatgctccaaatcgtctgcagtgatacatgggccgatgaagatcggtgctgcgagctgccggcatctcgcgacggagaaacctgtcctgcattcgtgtccgcttgttcctgttctagcgagactcctggccctcctggtcctcaaggtccccctggcctgcccggtaggaacggcacgccgggcgaacagggatttcctggaccacgggggccgcccggggtcaaaggagagaagggagaccatgggttgcccggcctccagggtcacccaggacaccagggcattccgggccgtgttggtctgcaaggacctaagggaatgcggggacttgagggaacagccggtctgcccgggccacccggccccagggggttccagggtatggccggggcgaggggcacttctggcgagcgggggccgccgggaaccgtgggacctaccggactgcccgggccaaaaggagagcgcggtgaaaagggggagcctcagtctttggctacgttatatcagctggtttcacaggcttcacatgtttccaaatttgattcttttcacgagaacactcggccgcctatgcccatcctcgagcagaagcttgagccagggaccgagcctctgggcagccccggtacgcgtagcaaagcgttagtgcccggagagtgggggcgggggggtcgacacttggagggccgtggtgaacccggcgcagtgggtcagatggggtctcctggacagcagggggcaagtacccagggattatgggaatag

SEQ ID NO: 4099 - DNA, 3894 bp, Artificial Sequence
  Description of Artificial Sequence: Synthetic coding sequence
atgagcagcggcgaccccgcccacctgggcctgtgcctgtggctgtggctgggggccactttaggacgcgaacaggtgcaggcaagcgggcttctgcgcctggccgttttaccggaagacaggttacagatgaaatggagagagtcagaaggtagtggattgggttatttagtccaggttaaacccatggcgggagattccgagcaggaggtgatcctaacaactaaaacaccaaaggcaacggtgggagggttaagtcccagcaaagggtatacacttcagatattcgagctgaccggcagtggcaggttcctgctggctcgacgagagttcgttatcgaggatttgaaaagcagcagcttggaccgatcttcccaacggcccttgggctctggcgcccccgaacccacaccatcccacacaggttcccccgatccggagcaggctagcgagccgcaagtggcttttactccaagtcaggacccccgcacaccgggtggaagtgagtggcgggaaaccggaccccaattcagatgcctgcctccagtgcccgcagacatggtatttctggtggatgggtcgtggagcattggccactctcattttcagcaggtgaaggattttttagctagcgtgattgcccctttcgaaatcgggcctgacaaggtccaggtggggctgacccagtactctggtgatgcacagacagagtgggatttaaactccttgtcgacaaaagagcaagtgctcgctgccgttagaagactgcgttacaagggcggcaacacattcacaggccttgctctgactcacgtcctaggacagaatctccaacccgcagccggtttaaggcccgaggccgctaaggttgtgatactggtgaccgacggcaaaagccaggatgatgtccataccgccgctagagtgcttaaagacctaggggtgaatgtgtttgccgtcggggtaaagaatgcagacgaagcagagctgagactcctcgcctctccacctcgagatattactgtacattctgtgctggattttctgcaactaggagccttggccggcctcctatccagactgatctgtcagcggctgcagggaggctcccccagacaagggcccgctgcagcccccgcattagacaccctgcccgctcctacatccctggtgttatcccaggtgacctcaagttctattcgcctgtcttggacccctgcccctcgccacccccttaagtatctgatcgtgtggagagcctcccggggaggtacccccagagaagtagtggttgaaggacccgcggcatcaaccgagctgcacaatctggcatccagaacagagtacttggtctccgtgtttcctatctacgagggaggcgtaggcgaaggcctacgcggcctcgtaacaacggccccactgcccccaccccgtgcactgacactggcagccgtcacacccaggacggtgcacctgacatggcagccctccgccggtgctacgcactacttggtgaggtgctcccctgcgtctccaaagggtgaggaggaggaacgcgaagttcaggtggggcgacctgaagtcctcttggatggcctcgagcctggtagggactacgaagtgagtgtgcagtctctccgggggcctgagggatctgaggcccggggaattagagccagaactcccactctggctccccctcgtcatctcgggttctccgatgtctctcacgatgcagctcgggttttttgggaaggcgcaccccgaccagtcagactcgtaagggttacgtatgtatcgagtgaagggggacactctggccagaccgaggcacctggcaatgcaacatccgccactctcgggccactgagttcctcgaccacctacaccgtgagggtaacctgcttatatcctggcggtggcagttccacgctcactgggcgtgtgaccaccaaaaaagcacccagtccatctcagttgtctatgaccgagctccccggcgacgcagtgcagttagcgtgggtggctgcagcaccctctggagtgctggtttaccagatcacatggactcccctaggcgagggaaaagcccacgaaataagcgtacccggcaacttaggaacagcagtgttgcctgggttgggaagacacaccgagtacgacgtgacaattctggcatactatagggatggcgcgcgcagcgatcccgtttccttgcgctatactccatccaccgtgtcacgatcgcccccaagtaacctggccctcgccagtgagacacccgatagtctgcaggtctcttggacccccccacttgggagagtcttacactactggctgacctatgctcccgcatccggtctcggcccagagaagtccgtatcggtgcccggcgccagatcccacgtgactctccctgatcttcaggcagccacaaaatacagggtattggtaagtgctatatacgctgccgggcggtctgaggcagtctccgccactggccagacggcttgtcccgcactgagaccagacgggtctctgcccggcttcgatctgatggtagcgttcagtctggtggagaaagcctatgcctctattcgaggggttgcgatggagccctctgcctttggcgggaccccaaccttcacactcttcaaggatgctcagctgacccgcagagtctcagacgtctatcccgctccgctgccccccgaacacaccattgtcttcctagtgaggttgctcccagagacccctcgggaggcatttgcgctgtggcaaatgacagctgaggatttccagccattattgggggtgctccttgacgccggcaagaagagtttgacctactttcacagagacccacgggctgcactgcaggaagcaaccttcgatccacaggaggttaggaagatctttttcgggagtttccacaaagttcatgtggccgtgggacgaagcaaggtgagactttatgtagattgcaggaaggtggctgaacgtcctctaggagaaatgggatcccctcctgctgcaggcttcgtgacgttgggtagattagccaaagctcgcggaccacggtctagctcagctgccttccagctgcagatgttacagatcgtatgttcagacacatgggctgacgaagatcgttgctgcgagctccccgctagcagggacggggagacatgtccagcgtttgtgagtgcttgcagctgtagcagcgaaacaccaggtcctccaggaccgcagggcccgcctggcctgccaggtagaaacgggacgcctggcgagcaggggtttcctggtccaagaggccctcccggtgtgaagggggaaaaaggagatcacgggctgcccggcctgcagggacacccaggccatcaaggaatacctggcagggttggcctgcagggaccaaagggcatgcggggcttagagggcacggctggcctgcccggccctccagggcccagggggttccagggtatggccggggcccgcggcacatctggggaacgagggcccccaggcactgtcgggcctactggcctgcccggaccaaagggagaacggggcgaaaagggggagcctcagtctctcgccactctgtaccagctggtgtcccaggcctgcgaatccgccattcagacccatgtgtccaagttcgactcttttcacgaaaacacccgcccccccatgcctattctggaacagaagttggagccagggaccgaaccattgggttcacccggtaccagatccaaggcactcgttccgggagagtggggccgcggcgggcgacacttggagggcaggggtgaacctggcgcagtgggccaaatgggcagccccggccagcagggggcctctactcaagggctttgggagtag

SEQ ID NO: 4100 - DNA, 3894 bp, Artificial Sequence
  Description of Artificial Sequence: Synthetic coding sequence
atgagcagcggcgaccccgcccacctgggcctgtgcctgtggctgtggttgggagccacattaggaagagagcaggtgcaggctagcggcctcctgcggctggccgtgctcccagaggatcgcctccagatgaagtggagggaatcggaaggatctggcctgggctacttggtgcaggtgaagcccatggccggtgactccgagcaggaagttatcctgacgacaaaaaccccgaaggcaaccgttgggggcctttcacctagcaagggatatacgctgcagatatttgaactcacagggtcaggacgcttccttctggcacgacgggagtttgtgatcgaggatctcaagtcaagttccctcgatcgttctagccaacggcccttaggctctggggcaccagaacctacccctagccataccggctccccagaccctgaacaagcctctgagccacaagttgcttttacccccagtcaggaccccagaactccaggcggtagcgaatggagagagactgggccccagtttcgttgcctgcctcccgtccctgccgacatggttttcttggtcgatggcagctggagcattggccacagtcacttccagcaggtcaaggacttcctggcatctgtgattgccccatttgaaataggccctgataaagtgcaggtcggtctgacccagtactcaggcgatgctcaaaccgagtgggacctcaacagcctgtccactaaggagcaggtccttgctgctgtccggagactccggtacaagggaggaaacactttcacaggcctggccctgactcatgtgctcgggcagaacctgcagcccgctgctggccttcgacctgaagctgctaaagttgtcatcctggtgaccgacggtaagagccaggacgacgtgcataccgccgccagggtcctgaaagacttgggcgtaaacgtatttgccgtgggtgtgaaaaacgctgacgaagccgaactgcgcctgcttgcttctcctccaagggacatcacggttcactcagtgctggacttcctgcaactgggagccctggctggactcctgagccgacttatttgtcagcgcctgcagggaggctccccacggcaggggccagctgccgccccagccttagacaccctgcccgccccaactagcttggtcctgtcacaagtgacctcttccagtatcagactgtcatggaccccagccccgagacaccctttaaagtatcttatcgtttggagagctagtcgtggaggcacgcctcgcgaggtggtggtggagggaccagctgcatccacagaactccataacctcgcaagccggacagagtatctggtgagtgtattccccatctacgagggtggagtgggcgaaggattaaggggccttgttacaacagcaccattacccccacctcgcgccctaacattggcggccgtcacacctcgaactgtgcacctcacatggcagcccagtgccggggcaactcactacctggttcgctgttcaccagcatcccccaagggggaagaggaagagcgagaagtgcaggtaggccgtcccgaggtattattggacgggcttgagccgggtcgcgattatgaagtcagtgtgcagtctctgcgcggtcccgaaggttctgaagcaaggggcatcagggcccgcacccctacattggctccacccaggcacctgggtttcagtgacgttagccacgacgccgcacgcgtgttttgggaaggcgcccctcgtcccgtccgactcgtgagggtgacttacgtgtcgagtgagggcggccatagcgggcaaacagaagcaccaggaaacgctacctcagcaacactggggccactgagtagtagtaccacatacacagtgagagtaacctgcttatatcctggaggcggcagcagtacccttaccggacgggtcaccacaaaaaaggcaccgtccccctctcaactctccatgacagagcttcctggggacgcagtgcagctcgcttgggttgccgctgccccctctggcgtgctcgtctatcagatcacttggacgccactaggggagggtaaggctcacgaaatctccgttcccggaaacctgggaaccgccgtgctgcctgggctaggcagacataccgaatacgacgttaccattttggcctattaccgcgacggagcccgctccgatcctgttagtttaagatatacgccctctaccgtgagtagatctcctcccagcaatctggcgctggcgtcagaaactcctgacagcctgcaggtatcatggactccacctctagggcgtgtgctacactactggcttacatatgcaccagcaagcggactggggcctgaaaaaagcgtgtccgtgccaggcgccagaagccacgtcactctgcccgacttgcaggcagctaccaaatatagggtcttagtttcagccatctacgcagcggggcgcagcgaggcagtgtcagctacggggcaaacagcctgcccagctctcaggcctgatgggtctctgcctggattcgatctgatggtggcgttctcactggtcgaaaaggcttatgcatcaattcgtggcgttgcaatggagccctctgccttcgggggtaccccaaccttcacactgtttaaagacgcccaactgacacggagagtctctgatgtgtacccggcccctttgcctcccgagcacaccattgtcttcctggtgagactgctgcctgaaacgcctcgtgaagcctttgccctttggcagatgaccgccgaagatttccaacctctcctgggggtcctactcgatgctgggaagaagtcgctgacttattttcacagagacccgcgggctgcactccaggaggccacattcgacccgcaggaggtgcgaaagatcttcttcggttctttccataaggtgcatgtggccgtggggcgcagtaaggtgcgcctgtatgtagattgccgcaaggtcgccgaacggcctctcggtgagatgggcagcccgccagctgctggattcgtaacactggggcggctcgccaaagcccggggtccgaggagttcatccgcagcatttcagctacagatgcttcaaattgtttgcagtgatacttgggctgacgaagataggtgttgcgagcttcccgccagtagagacggagagacctgtccagccttcgttagcgcgtgctcctgtagctcagagacccctggtcctccaggcccccagggaccccctgggctacctggacggaacggcacccccggggaacaaggattccctggacctagaggccccccaggggtaaagggagagaaaggagaccatggtctacccggtttacaagggcatcctgggcatcagggaattcctggacgcgtgggtcttcaggggccgaaaggaatgcggggtctcgagggtacagccggtcttccaggcccgcccggcccccgtggctttcagggcatggcgggggccagaggtaccagcggcgagcgcggccctccagggaccgtgggtcccacagggctgcccggacctaaaggcgagcggggggagaagggagaaccccagtctctagccacactgtaccaactggtaagtcaggcttgcgagagcgctattcagacccacgtgtcaaagttcgactcctttcacgaaaatacccggccccctatgcccatactggagcagaagcttgaacccggcacagaaccactgggatccccagggacgaggtcaaaggcactggtgccaggagaatggggccgtgggggacgccatctggaggggcggggagaaccaggcgctgttggccaaatggggagccctggccagcagggtgcgagtacccaaggcttgtgggagtag

SEQ ID NO: 4101 - DNA, 2874 bp, Artificial Sequence
  Description of Artificial Sequence: Synthetic coding sequence
atggcccactacatcaccttcctgtgcatggtgctggtgctgctgttacagaacagtgtactggcggaagacggagaagttaggtcatcttgcaggaccgcccccactgacctggtttttatattagatggaagctatagtgtaggcccagagaatttcgaaattgtgaagaaatggctggtcaatattaccaagaactttgacatcgggcctaaatttatccaggttggggtcgtgcagtattccgactacccagtgctggagatccccttagggtcatacgactccggtgaacatctcaccgctgccgttgaaagtatactgtatcttggaggcaacaccaagactggcaaagcaatccaatttgctttggattatttgtttgcaaaatcatcacggtttctgactaagattgccgtcgtgctcaccgatgggaaatctcaagacgatgtgaaagacgccgctcaagctgcccgagattccaagatcactctttttgccataggggtgggctctgaaactgaggatgccgaactacgtgccatcgctaacaagccctcctcaacctacgtgttttacgtggaagattacattgccatctccaaaattagagaggtaatgaagcaaaaactgtgtgaggagtctgtttgccccaccagaatcccggtggctgccagagacgagcgtggctttgatatcctgctggggctcgatgtgaataagaaagtgaagaagcggattcagctatcacctaaaaaaattaagggctacgaagtgaccagtaaggttgatctgagcgaacttaccagtaatgtattcccagagggactcccgcctagttatgtgtttgtgtccacacagagatttaaagtcaagaaaatttgggatttgtggcgaattctcacgatcgatgggcgccctcaaatagctgtgaccctgaacggtgtcgacaagatcttgctcttcacgactacttcagtcataaatgggtctcaggtggtgacattcgcaaatccgcaggtcaagacactattcgacgagggctggcaccagattcggctcctggtcaccgagcaggacgtgaccctgtacattgacgatcaacagattgagaacaaaccactgcatccagttctcggcatcttgattaatgggcagacgcaaattggaaagtattcgggcaaggaggagacagtacagtttgatgtgcagaagttaaggatctactgcgaccccgagcagaacaacagggaaacggcctgtgagattccaggattcaacggggagtgtctcaacggaccctcagatgtgggatcaacccctgccccttgcatttgtcccccaggcaaacctggtctccaagggcctaaaggcgatccaggactgcccggcaaccccgggtatcctggacagcccgggcaggacggcaaacccgggtatcaaggaatcgcaggaaccccaggagtgccaggttctcccggtatccagggcgccagaggtctgcctggctataagggggaaccagggcgcgacggtgacaagggagaccgcggactcccaggattcccaggtttacacggcatgcccggatccaagggagagatgggagctaagggggacaagggttcccccggcttctacggaaagaagggcgctaaaggcgaaaaagggaacgcaggattccctgggcttcccggtcccgctggagagccgggcagacacggcaaagatggacttatgggttctcccggcttcaagggtgaagcaggatcaccaggcgcccccggccaggatggtactaggggggagccagggattccaggctttcctggcaatagaggtcttatgggccagaagggcgagattgggcctccaggccaacagggcaagaagggagcccccggcatgcctgggctgatgggctccaatggttcccctgggcagcccgggaccccggggtctaaagggagtaagggagaacccggcatccaaggcatgccaggagcaagcggcctgaagggggagcccggcgcaacaggctccccaggggagcctggttatatgggactgccgggaatccagggtaagaaaggcgataagggaaatcagggggagaaggggattcagggccagaagggggagaacggcaggcaaggcatcccaggccaacaggggattcagggacaccacggagccaaaggtgagcgcggagagaagggcgaacccggggtccgaggtgctattgggagcaagggcgagtctggcgtcgatggccttatgggacccgcggggccgaaggggcagcccggcgatcccggtccgcagggaccgcctgggctggatggtaaacccgggagagaattctctgagcagttcatccgccaagtctgcactgatgtgatccgggcccagttgccagtgctgctacagtcaggaaggatccgtaactgtgatcattgtctctcccagcatgggagcccaggtatacccggccccccgggtccgatcggccccgaaggccctaggggcctccctggcctgcctgggcgggatggggtcccagggttagtcggcgtgccgggaaggccaggggttaggggattgaaggggttgcccgggcgaaacggcgaaaaaggatcccaaggcttcgggtaccccggagaacagggcccaccggggcctcccgggcctgagggtcccccaggcatatccaaagagggcccccccggagaccccggactgcctggcaaagatggagatcatggcaagccgggcatccaggggcagcctgggcctccaggaatttgcgacccatccctgtgctttagcgttatcgcgcggagagaccctttccgaaagggaccaaattattag

SEQ ID NO: 4102 - DNA, 972 bp, Artificial Sequence
  Description of Artificial Sequence: Synthetic coding sequence
atgatcgccagcggcatccccggcttccccggcaaccggggcctgatgggccagaagggtgagattggaccgcccggccagcagggcaagaaaggagccccgggcatgcctggcctgatggggtccaatggtagccccgggcaaccggggaccccagggtccaaaggtagcaaaggggaaccgggaatccaagggatgcccggggcttccggtctgaaaggagagccaggagctaccgggtcacccggggaaccagggtacatgggcctgcccggaatccagggcaaaaaaggagataaaggtaaccagggggagaagggcattcagggtcaaaaaggtgaaaacggcaggcaaggtatcccaggccaacaggggattcagggccaccatggtgccaagggagagcgcggcgagaagggagaaccaggagttcgaggggccataggatccaaaggtgagagcggtgtcgatggcctgatgggacctgctggtccaaagggacagcccggggatcctggcccccaaggtccacctgggttagacgggaagccaggtagggaattctcagagcagttcatcaggcaagtctgcaccgacgtgattagagggccagaagggcctcgaggactgcctgggcttccagggcgtgacggcgtgcctggtttggtcggtgtgcccggcaggcccggcgtccgggggctgaaagggctgcctggcagaaatggggagaaaggcagccagggctttggctacccaggcgaacagggcccccctgggcccccaggaccggagggcccccctgggataagcaaggagggcccacccggcgatcctggattgcctgggaaagacggcgatcatgggaagcccggtattcaggggcagccaggcccccccggcatatgcgacccatccctgtgtttcagcgttatagcacggagggatcctttcagaaaggggcctaattactag

SEQ ID NO: 4103 - DNA, 2865 bp, Artificial Sequence
  Description of Artificial Sequence: Synthetic coding sequence
atggcccactacatcaccttcctgtgcatggtgctggtgctgctgctgcagaactccgtgctagctgaggatggtgaggtccgaagctcctgtcgtacagcccctactgacctggtgttcattctcgacgggtcgtactctgtcgggcccgaaaactttgaaatcgtcaagaaatggctggtcaacatcacaaagaattttgatatcggacccaagttcattcaggtcggcgtcgtccagtactcagactaccccgtgttggaaatacctttgggtagttacgacagtggagaacacctcacagccgcagtggagagtattctgtacttggggggaaatacaaagacggggaaagccatccagtttgcactggactatctattcgcgaagtcgtctcgctttttgacaaaaatagctgtcgtgttgacagatggcaaaagtcaggacgacgttaaggatgccgcacaggctgctagagactcaaaaatcaccctttttgctatcggagttggtagtgagaccgaagatgccgagttgagagcaatcgccaacaagccgagctctacctacgtgttttatgtcgaggactatatcgccatatccaagatccgcgaagttatgaaacagaagctgtgtgaggagtccgtttgcccaacccgcatccccgtagccgccagagacgagcgtggttttgatatcctgcttggcctcgacgtaaataagaaggttaagaaaaggattcagctgtctcccaagaagatcaagggttatgaagttacctctaaggtggacctgagcgaactgactagcaacgtttttcccgaaggattgccaccatcttatgtctttgtctccacacagcgtttcaaggtgaaaaagatttgggatctatggcgcatactcactattgatgggcggccccagattgctgttacgctgaatggggtggataagattctgttgttcactaccacctccgtcatcaatgggagccaggttgtgacctttgcaaacccccaggtgaagacccttttcgatgagggctggcaccagatccggctcttagtgactgagcaggacgtgaccctctacatagatgatcaacagatcgagaataagccgctgcatcccgtgctcggaattctgataaatggacagacgcagattgggaagtatagcggtaaggaggagaccgttcagtttgacgtgcagaagctgaggatctattgcgacccagagcaaaataatcgcgaaacggcttgcgaaatcccagggttctgcttgaacggcccatcagacgtaggatcaaccccggccccttgcatctgtcctccaggcaagcctggccttcaaggccctaaaggggaccctgggctacccgggaacccgggataccctgggcagcctggtcaggacgggaaaccgggctaccagggcattgccggaacgcctggcgttcctgggtccccgggaatacagggcgcccggggcctccctggttataagggcgagcccggcagagacggcgataagggcgatcgcggacttccagggtttccgggccttcatggtatgcctggcagcaagggtgagatgggggccaagggggacaagggatctcccggcttctatggtaagaaaggagccaaaggggagaaagggaatgctgggtttcccgggcttccaggcccagccggcgagcccggacgccacggcaaggacggtctgatggggagtcccggattcaagggagaagctggttcacctggcgcccctggacaggatggtactcgcggtgagcctgggattcctgggttccccggcaacagggggttgatggggcaaaagggggaaataggtcctccaggccagcagggaaagaagggcgcacccgggatgccaggtttgatggggagtaacggctcccccggacagcccggtacacccggtagcaaaggctctaagggagagcccggtatccagggcatgcctggtgcgagcggcctcaaaggtgaacccggggccaccgggagcccgggagaacctggctacatgggcttacccggaatacagggcaaaaaaggcgacaaggggaatcagggtgaaaaggggatccagggccagaagggggaaaacggaaggcagggaataccggggcagcagggaatccaaggccaccatggagccaaaggggaacgcggggagaagggcgagccgggtgttcggggagccattgggtctaagggcgaatcaggcgtagatggattaatgggccccgcgggaccaaaaggtcagccaggagatccaggaccccagggaccacccgggctcgatggaaaaccagggcgggagttcagtgaacagttcatacggcaggtctgcactgatgtgatccgtgctcagctgcccgtgctcttgcagagcggtagaatccgtaactgcgatcactgcctgtcccagcacgggagcccgggaatccctggcccccccggaccaatcgggcctgaaggtcctcgtgggttacccggtctcccgggccgagacggagtacccggcttagtaggtgtgccaggtaggcctggcgtcaggggtctaaagggattgccaggtaggaatggcgagaagggctcacagggctttgggtatcctggtgaacagggtcctcccgggccccctggccctgagggaccacccgggatcagcaaggaaggcccaccaggagatcccggattgcccggtaaggacggagatcacgggaagccggggatacagggccagccaggcccaccaggcatctgtgacccatcgctctgttttagcgtgatcgcgagaagggatccatttaggaaaggaccaaattactag

SEQ ID NO: 4104 - DNA, 411 bp, Artificial Sequence
  Description of Artificial Sequence: Synthetic coding sequence
atggcccactacatcaccttcctgtgcatggtgctggtgctgctgctgcagaattcggtgctcgcagaggacggggaggttaggtcctcatgccgaacagccccaaccgatctggtgtttatactggatggatcttattctgtggggcctgagaactttgaaattgtgaagaaatggctggtaaatattaccaaaaacttcgatatcggcccaaaatttatccaggtgggggtcgtgcagtatagtgactatcccgtgctcgagatccccctggggtcttatgattcaggagaacaccttactgctgcagtagagagcattctgtatcttggcgggaacaccaagaccggaaaggcaatccagttcgctctggattatctgttcgccaaaagctcccggttcctgacctag

SEQ ID NO: 4105 - DNA, 2865 bp, Artificial Sequence
  Description of Artificial Sequence: Synthetic coding sequence
atggcccactacatcaccttcctgtgcatggtgctggtgctgctgttgcagaactccgtactggctgaggatggggaagtacgaagttcatgccgcaccgctccaacagatctggtctttattctggatgggagttatagcgtggggccagagaacttcgagatagtaaaaaagtggctggtgaacatcacaaagaactttgatatcggaccaaagttcattcaagtgggtgtggtccagtactctgactaccctgtactagaaattccactagggtcgtacgactccggcgagcacctgacggctgcagttgagagcatcctttatctgggagggaatactaagaccggaaaggccatccagtttgcactggattacctctttgccaaatcctcaaggttcctcaccaaaatcgcggtcgtcctgacagatgggaaatctcaagacgatgtgaaggatgccgcacaagctgcgagggactccaaaattaccctcttcgcaatcggtgttggaagcgaaacagaggacgcggagcttagggccatcgccaacaagccgagctccacttacgtattttacgtggaggactatatcgcgatctctaagatccgcgaagtgatgaaacagaagttgtgcgaagagagcgtctgccccacgagaatacccgtagcagctagagatgagagaggcttcgatatcctgctgggattagatgtgaataaaaaggtaaaaaagaggatccagctgagtccaaaaaagatcaagggctatgaagtgacatccaaagtcgacctcagcgaactcacctctaatgtgttcccagaaggactgccaccatcatacgtcttcgtaagcacacaacggttcaaagtgaagaagatctgggatctttggagaatactgactatcgatgggcgaccacagattgctgtgaccctcaacggcgtggacaagattttgcttttcactaccacctccgttatcaacgggtcacaggtagtcacatttgcaaacccacaagtaaagaccctctttgacgagggttggcatcagattaggctcctggtgaccgaacaggacgtgacgctgtacatcgacgaccagcaaattgagaataagcctctacaccccgtgctcgggatcctgatcaatggccagactcagattggcaagtattccggaaaggaggaaacagtccagtttgacgtgcagaaactccgtatttactgcgatcccgagcagaacaaccgtgaaacagcttgtgaaatacctggattttgcctgaatgggccatccgacgttggatccacccccgctccttgcatctgtcctcccggcaagccaggtctgcagggtccgaagggcgaccccggactgcccggtaatccgggctaccccgggcagccaggccaggatgggaaacccgggtatcagggaatagcaggaacccctggggtccctggttcgccaggcatccaaggagccagaggcctgccaggttacaagggcgaacctggaagagatggagacaagggagatagaggactcccaggattccctggcctgcatggaatgccaggctccaaaggtgaaatgggggccaaaggggacaaaggatccccggggttctacggcaaaaagggcgccaagggtgaaaaaggcaacgcaggattcccagggttgcccggtcccgctggcgagccaggaaggcacggtaaggacgggctcatgggcagccccggttttaagggcgaagccggaagtcccggtgccccgggacaagacggcactcgaggggaaccaggtatcccgggctttccagggaatagaggcttgatgggacagaagggcgaaataggtcctccgggccagcaggggaaaaaaggcgctcccggtatgcccgggcttatgggatcgaacggtagcccaggccagccaggtacaccaggctctaagggatccaagggagagcccggtattcagggtatgcctggcgcgtcaggtcttaagggtgagcccggagcaactggaagtcccggtgaacccgggtacatggggttgcctggaattcagggcaagaaaggcgacaagggtaaccagggggagaaaggcatccaaggacagaaaggcgaaaacgggcgacagggaattcctggtcagcagggcattcagggacatcatggagccaaaggtgagcggggtgaaaagggtgagcccggagttcgcggcgccatcgggagtaaaggagagtctggggtcgacggattgatggggcctgccgggccaaaaggccagccaggtgaccccgggcctcagggcccgcctggccttgacggtaaaccagggcgcgagttttcagagcaattcattcgtcaggtttgcacagacgtaatccgtgcccagctccccgtcctgctgcagagcggacggattaggaactgcgaccactgtctgagccagcatggaagtccaggtatccctggtccccctggtcccattgggccagagggccctaggggcctgcccggactacctgggcgcgacggggtgccagggctggttggagttcctggcaggcctggcgtgcggggccttaagggcctgccgggccgcaatggagaaaaaggctctcagggttttggttaccccggagagcaagggcctccagggccccccgggccagagggaccacctgggatttctaaggaaggacctccaggggaccctggactacctggcaaggatggcgatcatggcaaaccaggaattcagggccagcctggacccccaggcatatgcgatcccagtctgtgtttttccgtaatagccagacgtgacccttttagaaaaggccccaactattag

SEQ ID NO: 4106 - DNA, 2874 bp, Artificial Sequence
  Description of Artificial Sequence: Synthetic coding sequence
atggcccactacatcaccttcctgtgcatggtgctggtgctgctgctccagaattccgtgctggccgaggatggcgaggttaggtccagctgtcgaactgcccccaccgacctagtgttcatcctggatgggtcatacagcgtggggcctgagaactttgaaattgttaaaaagtggttggtgaacattacaaaaaacttcgacattggccccaagttcatccaggtcggcgttgtccagtacagcgactatcctgtgttggaaataccactaggtagctacgattccggcgagcacttgactgcagctgtggaatctattctgtaccttggcggtaacactaaaaccggaaaggcaatacagttcgccctggactacttatttgcaaaatcaagcagatttctgacaaagattgccgtggttctcactgatggcaaatcccaggatgatgtcaaagacgccgcacaggcagcccgcgactcaaaaattacactgttcgccatcggggtggggtcagagactgaagatgccgagctgagagccatcgccaacaaaccgtcttctacatacgtgttctacgtcgaagattacatcgctatctccaagattcgagaagtgatgaaacagaaactttgtgaagagtctgtttgtcccactagaattccggtagccgcccgcgacgagcgaggcttcgacatcctcctcggactggacgtgaataaaaaggtcaaaaagcgcattcagctttcccccaaaaagatcaaaggatatgaagtcaccagtaaagtagacctgagcgagcttacatccaacgtgttccctgagggcctccccccgagttatgtgtttgtgtctacacagaggttcaaagtgaagaaaatttgggatttgtggaggatccttaccatcgacggaaggccgcaaatcgcagtgaccctgaatggagtggacaaaattctgctatttacgactacatctgtgataaacggtagtcaggttgtgacttttgctaatccccaggtcaaaaccctgttcgatgagggctggcatcagatcaggttactggtcactgaacaagacgtgactttatatattgatgatcaacagatcgagaacaagcctctccaccccgtgctcggtattctgatcaatgggcagacccaaataggcaaatatagcggcaaggaggagacggtgcagttcgatgtgcagaaactaaggatttattgcgaccctgagcagaataacagagaaactgcatgcgagatccctggatttgtaatggagtgcttgaacggcccatcagacgtcggctccactccagccccatgtatctgcccccccggcaagcccggcttgcaaggtcctaagggagatcctggactgccagggaaccccggttaccctgggcaaccaggccaagacggtaagccggggtatcaaggcatcgccggaacaccaggcgtgcctggttcgcctggcatccaaggggcacgcggcctcccgggctataagggtgagccgggccgcgacggtgacaaaggggatcggggcctacctggctttcctggcctgcacggcatgcccgggagtaaaggtgaaatgggtgccaagggagacaaggggtcccctggcttttacgggaaaaaaggagctaagggcgaaaaaggcaatgccgggttccctggcttaccagggccggctggtgagcctggaaggcacggcaaagacgggctaatggggtctcctggctttaagggcgaggcaggtagccccggtgccccaggtcaggacggaacccgcggggagcccggcattccaggctttcccggcaatcgagggctgatgggccaaaagggggaaataggcccccccgggcagcaaggcaaaaaaggtgcgccaggtatgcccggcttgatggggtcaaacggatcaccaggacagccgggcaccccagggagcaaggggtccaagggcgagcccggaatccaagggatgccaggtgctagtggactcaagggggagcccggcgctacaggaagcccaggagaaccaggctatatgggactgcccgggattcaaggtaagaagggagacaaaggcaaccagggtgagaaaggcatccagggccaaaaaggagaaaacggcagacaaggaatcccagggcaacagggcattcaggggcatcacggcgccaagggcgagcgcggggagaagggtgagcccggagtgcggggtgccattggcagtaaaggagagagcggggtcgacggcctgatgggacccgccggacccaaagggcaaccaggtgaccccggaccccagggtccacccgggctggacggaaagccgggccgcgaattttcagaacagtttatcagacaggtttgcaccgacgtgatccgcgcgcagctgcccgtgctgctccagagtggccgcatcagaaactgcgaccactgtctgtcccaacacggatcacccgggatacctggtcctccaggacctattggccctgagggtccaagagggctgccaggcctgcccggacgcgatggcgttcctggcctggtgggagtcccagggcggccaggcgttcgcggcctcaaaggactccccggacgtaacggtgagaaggggagccagggcttcggatacccgggggaacagggcccgcctggcccaccaggacctgaaggccctcccggtattagcaaggaaggtccgcccggcgacccaggtctgcccgggaaggatggcgaccacggcaagcctggaattcagggccagcccgggccccccggtatttgcgatcccagcttgtgcttttccgtgattgcgagaagagacccgttcaggaaaggccctaactactag

SEQ ID NO: 4107 - DNA, 4881 bp, Artificial Sequence
  Description of Artificial Sequence: Synthetic coding sequence
atggccggcctgcggggcaacgccgtggccggcctgctgtggatgctactgctctggagcgggggaggcggctgccaggctcagcgtgcgggatgtaagtccgtgcattatgatctggtatttttgttggacacctctagctccgtgggtaaggaagacttcgaaaaggtgcgccagtgggtcgccaatttagtggatacgtttgaggtcgggcccgatcgaactagggtcggagttgtgcgatacagcgataggccaaccaccgcctttgagctaggcctgtttgggagtcaggaggaggtcaaggccgcagccaggcggctggcctatcacggcgggaatacaaatacaggagacgccttgagatacattactgcgaggagtttcagccctcacgccggaggcaggcctagggaccgggcctataagcaggtcgccattctgctcaccgatgggcggagtcaggatctggtcctcgatgctgctgctgccgctcacagagccggaattcggattttcgccgttggggtgggagaagccctgaaagaagagttagaggaaattgccagcgagcccaagtctgcccatgtcttccatgtcagcgactttaacgccatagataagatcagaggtaaattgagacgcaggttgtgcgaaaatgtcctgtgtccgtctgtcagagtcgagggagataggttcaaacacacgaacggagggaccaaggagattacaggttttgacctgatggacctcttcagcgtcaaggagattctgggaaaaagggagaatggagcacagagttcctatgtgaggatgggaagcttccctgtcgtgcagagcacagaggacgttttcccccaaggtctacccgatgagtacgcattcgttaccacgtttcgttttaggaagacttctagaaaggaggactggtacatttggcaggtaatagaccagtattcaattccacaggtctccatccgcctggacggcgaaaataaagctgtggagtacaacgcggtgggcgcgatgaaagatgccgttagggtagtgttccgtggctcacgcgtgaacgacctcttcgaccgcgactggcacaaaatggcactatccattcaggcgcagaacgtaagtctccacatcgactgtgctctggtgcagacactacccatagaggaacgagaaaatattgacatccagggaaagacagttattggcaaaagactttatgactctgtgcctatcgacttcgatctgcagagaatcgtgatttactgcgactctcgccatgccgaacttgaaacctgctgcgatatcccatccggcccctgtcaggtgacagttgtgactgagcctccaccaccgcccccacctcagagaccaccaacgcctggttctgaacagatcgggttcttgaaaacaataaattgctcttgccctgccggtgaaaagggcgagatgggggtggctggacctatgggtttacctgggccaaagggagatatcggagctatcggacctgtcggcgctcccggtccaaagggggaaaaaggggatgtgggtatcgggccattcggacagggagaaaaaggcgaaaaaggctcattgggacttcccggaccccccggcagagatggctcaaaaggaatgagaggggagccaggcgagttgggcgagcccggcctacccggagaagttgggatgcggggtccgcaggggccacctggcttgcccggcccgcctggacgcgtaggggcccccggactacagggtgaaaggggggagaaaggcacccgaggagagaagggggagcgcgggctggatgggtttcctggtaaaccaggagacactggacaacagggccgtccaggccccagtggcgtagcgggaccacagggcgaaaagggcgacgtgggcccagctggacctcctggagtcccagggtccgtcgtacagcaggagggactcaagggtgagcaaggggcaccaggcccaaggggccatcagggtgcaccggggcccccgggcgccaggggccctatagggcccgagggtagagatggtccgcccggactgcaaggcctcagagggaagaaaggggatatgggacccccgggaattccaggcttacttggtctgcagggcccccccgggcctcccggcgtgccaggaccacccgggcccggcgggagcccaggccttccgggagagattggctttccagggaagccaggtccgcccgggcccacgggccccccaggcaaagatgggccgaatggcccgcccggtccccccgggaccaaaggcgaaccaggggagcgtggagaggacggactgcctggtaaacccggcctcagaggcgagatcggagaacagggactagctggcaggcccggagagaaaggagaggccggcctcccgggcgcccccggcttcccaggagtgcgaggtgaaaagggggatcagggagagaaaggtgaactcggcctccctggtttgaaaggagacagaggagaaaaaggcgaagctggccccgcagggcctccgggcctgcctgggaccacgtctctctttaccccccatccaagaatgcctggcgagcaagggcccaagggagagaagggggatcccgggctcccaggcgagcctggactccagggccgtccaggagagctggggccccaggggccgaccggacctcccggggcaaagggccaggaaggagcccacggtgcaccaggcgccgctgggaacccaggggctcccggccacgtgggagcccccggaccctctggcccgcctggttccgtaggggctcccggactacgtggcactcctggaaaagacggggagcgaggagaaaagggagctgctggggaggaaggatctcctggccccgttgggcctagaggtgaccccggggcgcccgggctgcccgggccccccggcaaaggtaaagacggagaacccggactgagagggtcaccggggctccccggacctcttggcacaaaggctgcctgcggcaaagtacggggctcagaaaattgcgcactcgggggccagtgtgttaaaggcgatcgcggagcgccagggattccgggaagtcctgggtcccgaggtgacccagggattggagtggccggacctccaggtccctccggaccacccggtgacaaaggttcaccaggctctcggggactgccagggttccctgggcctcagggacccgcgggacgggatggggcccctggaaatcctggagaacggggccccccaggaaagcctgggctgtcaagtctcttatctcctggcgatatcaacttgctggccaaagatgtctgcaatgattgtcccccaggaccccccgggttacccggcttacccggttttaaaggtgacaagggtgttccgggtaaacctggaagagagggcactgagggtaagaaaggcgaagcaggccctcctggcctgcccgggcctcccggcattgccggcccacagggatcacagggcgagagaggcgctgacggggaagttgggcagaagggcgaccaagggcacccgggtgtgcccgggtttatggggcccccgggtaatccaggccctccgggagcagacggaatagctggcgccgctggccccccagggattcaaggatcccctggcaaggaaggccctcccggacctcagggacctagcggcttgccagggatcccaggagaggaaggtaaagagggcagggacggcaagcctggaccgcccggggagcccgggaaggccggggagcccgggttacccggacctgagggtgcaaggggccctccggggttcaaaggacacacgggcgatagcggcgcccccggccctaggggggaatcgggggcaatgggactgcctgggcaggagggccttcccggaaaagacggtgatactggccctacaggccctcagggacctcaggggcctcgggggccccccggtaagaatggtagcccagggtcgccaggggaacccggaccttcagggacacccggccaaaaagggtctaagggagagaatggatcccctggactgcccgggttcctggggccaagagggccgcccggtgaacccggggaaaagggagtgcccggaaaggagggggtcccaggcaaacccggggaacctggatttaagggtgaaagaggagatcccggtatcaaaggggataaagggcctcctgggggaaagggtcagcccggtgaccccggaattcccgggcacaaggggcacaccggcttaatgggcccccaaggacttcctggcgagaacggaccagtgggaccgcctggccctccgggccagccagggtttcccggactgcgcggtgaaagtccatctatggaaacactgcgcaggctgatccaagaggagcttgggaaacagctggagacgcggttagcctatctactggcgcagatgccacccgcctatatgaaatcttcacaaggaaggccaggccccccaggtccccccggaaaggacggactgccaggacgggccggcccaatgggcgagcccggacgcccaggacagggcggcttggagggtccgtctggtcctattggacccaagggggagaggggagcaaagggagatcctggggctccaggagtggggctacgcggagaaatgggcccccccggaattcccgggcagcctggcgagccaggctatgctaaagacgggctgccaggaatccccggtccacagggtgaaactggaccagcgggtcaccctggactacctggccctcccggcccccccggacaatgtgatccttcgcagtgcgcctactttgcttctttagctgctcgtcccgggaacgtcaaaggcccttag

SEQ ID NO: 4108 - DNA, 4821 bp, Artificial Sequence
  Description of Artificial Sequence: Synthetic coding sequence
atggccggcctgcggggcaacgccgtggccggcctgctgtggatgctgcttctctggagcggaggaggaggatgccaagcccaaagagctgggtgcaaatctgttcattatgacctcgtctttctgttagatacttcctcttcagtcggaaaggaagatttcgagaaggttcgtcagtgggttgctaacctcgtggacacctttgaagttgggccagataggacaagggtgggcgtggtgaggtactccgaccggcccaccactgccttcgaactggggctgtttgggagccaggaggaggttaaggctgcagcccgacggctggcctaccatggcggaaatactaacacaggagacgccctgagatacattaccgccaggtctttctctcctcacgccggcgggagaccgcgcgaccgggcttacaaacaggtggctattctactcaccgatggacgcagccaggatcttgttctcgatgcggctgctgctgcccacagggcaggaattcgaatctttgcggtgggagtgggggaggcactcaaggaggaacttgaggagattgcttccgagccaaaaagcgcacatgtgtttcacgtctcagattttaacgccattgacaagataaggggcaaactcaggcgcagactgtgtgaaaatgttctatgtccaagcgtgcgagtcgaaggagacagattcaagcacaccaatggaggcaccaaggaaatcacaggcttcgatttgatggatctctttagtgtcaaggaaatcctgggaaaacgggaaaacggcgcccagtcgtcatatgtgcgcatgggcagttttcccgttgtgcagtctaccgaagacgtcttcccccagggacttccagacgagtacgccttcgttactacctttcggttcaggaagactagccgcaaggaagattggtatatatggcaggtcattgatcagtattctattccacaggtctcaattaggctagatggcgaaaacaaagctgtggaatataatgccgtcggtgccatgaaagatgccgtgcgagtggttttccggggctcccgggtgaacgatctgttcgatagagattggcacaaaatggccctatccatccaggctcagaatgtatcacttcacatcgactgtgcactcgtgcagaccctgcccatagaggaacgggaaaatatagatatccaaggtaagacggtcattggtaagcgtctgtacgattccgtgcctattgatttcgatctccagaggatcgtgatttactgcgacagccgccatgcagagctggagacgtgttgtgacatcccttcgggcccttgtcaggtaacagtcgtcactgaacctcctccaccaccccccccccaacggccccctacacctggatcagaacagattggattcctaaagaccataaactgttcctgccctgccggggagaaaggcgaaatgggcgtagcagggcctatggggttgccaggacctaaaggcgatataggggcaatcggacccgttggagcaccaggacccaagggagagaaaggcgacgtagggataggaccctttgggcagggggaaaaaggggagaagggctctctgggactgccggggccgcccggcagggatggatcaaaggggatgaggggagagcctggcgaactcggggagccaggcctccccggggaggtgggaatgcgtggaccgcagggaccccctggcttgccgggcccgccaggtcgcgtcggagccccagggctgcagggagagcgaggcgaaaaagggacaaggggggaaaagggcgagaggggcctcgatggctttcccgggaaaccaggagacacagggcagcaggggagaccaggacccagtggtgttgcaggcccccagggtgagaagggcgatgtcggtccagcaggcccaccaggcgtcccgggatccgtcgtacagcaggagggcctgaagggcgaacagggcgcccctggacctaggggtcatcagggggcgccgggaccgcctggggcccggggccctatcggtcctgagggcagggatggccccccgggactgcagggcctccgaggaaagaagggagatatgggaccacccgggataccggggcttctgggactgcaggggccccctggccctccaggggtgcccggtccccctggtccaggaggttcaccaggtctccccggcgagatcggcttcccaggcaaacccggcccccccggtccaacaggcccgcctgggaaggacggccccaacggccctcccgggccaccaggaactaagggggaacctggagaacgcggggaagacggtttgcctggcaagcctgggttacgtggcgagataggtgaacagggcctggcagggcgacccggggagaaaggagaggccgggttgccaggggctcctggcttcccaggagtcaggggtgagaaaggagaccaaggcgaaaagggagagcttggtctacctgggctcaaaggagatcgcggggagaagggtgaagctggacctgccggtcccccgggactgccaggtacaactagcctgttcacgccccaccctaggatgcccggagagcagggccccaaaggtgagaaaggtgatccaggactgcctggtgagcctggactgcagggccgtcctggcgaattaggaccacaaggacccactggaccaccgggagctaaagggcaggagggagcccacggggcacctggggctgccgggaatccaggcgcacctggccacgtaggcgctccaggcccatccgggccacctggctctgtaggcgctcctgggttacgcggcactcccgggaaagatggggagcggggagagaagggggcagcgggtgaggaaggttcccctggacctgtgggaccccgcggtgatccaggtgcccccggcttgccaggacctcccggaaagggaaaggacggggaaccaggcctgcgagggtctcctggacttcccggcccactcgggaccaaaggcgatagaggcgcgccgggtataccaggatcaccgggttcaagaggagaccccgggattggagtagcgggcccccccggaccctccggaccacctggggataaaggatcccctggaagtcgaggcctgccaggctttcccggtccacagggccctgcaggccgcgatggcgcaccgggtaatccgggcgagaggggccctcccggcaaacctggtctctcctccctcctgtcccccggcgatatcaacttgctggccaaggacgtctgcaatgactgtcctcctggcccgcctggactgccaggtctgcctggtttcaagggagacaaaggagttcctgggaaaccggggcgagaagggactgagggcaagaagggcgaggccggtcctcccggtttgcctggcccgccgggcatcgcaggacctcagggctcacagggggagcggggtgccgacggagaggtgggccagaagggagatcagggccacccaggtgtccctgggttcatgggcccacccggtaatcctggccccccaggcgccgacgggatagccggagccgccgggccacccgggatccagggtagccccggtaaggaaggccctcctggtccacaggggccaagtgggctgcccgggatccccggggaagaaggcaaggaagggcgggatgggaaaccgggacctccaggtgaacccggtaaggctggcgaaccaggcctgcctgggcccgagggagccagggggccacctggattcaaaggccacaccggcgatagcggcgcaccaggaccacggggagaatctggagccatgggtctccccggtcaagaggggctgcccggaaaagacggagacactggaccaaccggcccacagggaccacagggacctcgcggccctcccggaaagaatggcagtcccggttccccaggagaaccggggccctctggaactcctggtcagaagggttcaaagggagaaaacggctcgccaggccttcccggtttcctgggaccacggggccctcccggagaaccaggggagaagggcgttcctgggaaagagggcgtaccaggaaaaccgggcgaaccggggtttaagggcgagcgtggcgatccaggaattaagggtgacaaagggcccccgggtggcaagggacagcctggcgaccctggtatccctggccacaaaggccatacggggctgatgggcccgcagggacttccaggggagaacgggcctgtaggtccgcctggccctcctggccagccgggatttccaggactgaggggggaatccccctctatggagactttaaggcgattaatccaggaggagttgggtaaacagctggaaacaaggctggcctacctgctcgcccagatgccccctgcctatatgaagagctcgcagggcaggcccggcccccctggaccccctggtaaagacggtctgcccggcagggcagggcccatgggagaaccaggcaggcctggacagggagggttagaagggccctctggacctatcgggcccaaaggcgagagaggcgctaagggcgaccccggagctcccggcgtgggactgcgaggagagatgggcccccctggcatccctggacagcccggtgagccagggtatgctaaagacggactgcctgggattccaggaccccagggagagaccgggccggctggacatccaggcctaccgggccctcccgggcctccaggacagtgtgacccctctcagtgcgcatacttcgcctccctcgctgcaagacctggcaatgttaaggggccctag

SEQ ID NO: 4109 - DNA, 3960 bp, Artificial Sequence
  Description of Artificial Sequence: Synthetic coding sequence
atggccggcctgcggggcaacgccgtggccggcctgctgtggatgttattgctgtggtcagggggcgggggctgtcaagcccagcgcgccggctgcaagtcagtacattacgacctcgtgttcctgctggacacatcatctagtgttgggaaggaagattttgaaaaagtgcggcagtgggtggccaatctggtcgacacttttgaggttggaccagaccgtaccagggtgggagttgttagatatagtgacagacctacaactgcattcgaactgggtctctttgggtcgcaagaagaggtaaaagcggcggcgcgacgtctagcatatcacggcggcaatacaaacaccggagatgcccttagatacatcactgctcgttcattttcaccacacgccggaggacggcctagagaccgggcatacaaacaagtcgcgatcctgctgactgatggccgcagtcaggacttggtgctggatgctgccgcagctgcccacagggctggaattagaatttttgccgtcggcgtgggggaagctttgaaggaggagctggaagaaattgctagcgagcctaagtcagcccacgtcttccacgtcagcgattttaacgccatcgacaaaatccgcggtaaactgcggcgtagattgtgtgagaacgtgctgtgtccgtctgtgagagtggagggtgatagattcaaacacacaaatggcggaaccaaggagattaccgggtttgaccttatggacctcttctccgttaaggaaatcttgggtaaacgcgagaatggagcacagagcagctacgtgcggatggggtcattccctgtcgtccagtctactgaagacgtcttcccccaggggctcccggacgaatacgcctttgtaacaacgttccgcttcagaaagaccagccgcaaggaagattggtatatctggcaggtgatcgaccagtactccattcctcaggtctccatcagattggacggagaaaataaggcggttgagtacaatgctgtagcaggacctcagggggagaagggcgatgtgggccctgccggccctcccggcgtgccagggtcggtggtgcaacaggaaggcctgaaaggggaacagggagctccaggacccagagggcatcagggtgcccctggaccacccggagcccgagggcccatcggccctgaagggagggacggacctccagggctgcagggacttagaggtaagaagggagacatgggccccccgggtatccctgggctgctaggcctccagggccccccaggaccccctggagtgccgggcccccccgggcctggaggcagtcctggcctgcctggggagataggatttcccggtaagcctggtccccccggacctacggggcccccaggaaaagatggccctaatgggccgcccggaccccccgggacaaaaggtgagcccggggaaaggggcgaggacggcttgccgggcaaacccggactgcggggcgagataggggaacagggcctggctgggcggccgggcgagaagggggaggctgggctgcccggcgccccgggattccctggcgtgaggggagagaagggagatcagggggaaaaaggagagctgggacttccgggtctgaaaggtgatagaggcgaaaaaggagaggccggacccgctggaccccccggcctgcctggcaccacgtcccttttcacgcctcacccacggatgcccggtgaacagggacccaaaggggagaagggtgatcctggcttacccggagaacctggtctgcaaggacgccctggagagctggggccgcaggggcctactggacctcctggagccaagggccaggagggagcccacggagccccaggcgccgcaggaaatcccggagctcctggccacgtgggggcaccagggccctccggcccgccgggatcagtgggcgcaccaggcctgaggggcactccgggtaaggacggagagcggggggagaaaggagccgccggcgaggagggatcgcccggccctgttgggcctcgcggagacccgggcgctcccggactgcccggaccacctgggaagggcaaggacggagagcccggactgcgaggtagccccgggcttcctggacccctcgggactaaaggggaccgcggcgcccctgggatcccaggctcacccggatctaggggcgacccaggcatcggggtggctgggccgccaggtcccagtggcccaccgggtgacaaaggctcccctggatcccggggccttccaggtttcccaggccctcaggggcccgctgggcgggacggagccccggggaatcccggcgagcggggcccccctggtaaacctggcctgagttcacttctaagcccaggagatatcaatctgctggccaaggacgtgtgtaatgactgccccccaggacccccaggtctgccaggcctgcctggcttcaaaggggacaaaggagtccccgggaagcctggtcgggaaggtactgagggaaagaaaggcgaggccgggccaccagggctgcccggccctccagggatcgccggccctcagggcagccagggcgagcgcggcgccgacggagaggtaggacagaaaggagatcagggccatccaggagtgcctggcttcatgggccctccgggcaatcccggaccccccggggctgacggcattgcaggggcggccgggccccctggaatccagggtagcccagggaaggagggccctccggggcctcaaggcccaagcgggctgccaggaatccctggtgaggaggggaaggaaggacgggacgggaagcctggcccccccggggaacctggtaaggccggcgaacccggactgcccggccctgaaggcgccagagggcctcccggatttaaaggacatactggggacagtggtgcccctggtcctaggggtgaatctggcgctatgggccttcctggccaggagggtctgcccggaaaagatggcgatacaggcccaacaggcccacaaggaccccaggggcccagagggcctcccgggaaaaacggatccccaggaagcccaggtgagccaggtccttccggcacccccgggcagaagggctcgaaaggcgagaatggcagtcccggcctcccagggtttctcgggccacgagggccacccggggagcccggggagaagggagtacccgggaaggaaggcgtgcccgggaagcctggcgagccagggttcaaaggagagagaggagacccagggatcaaaggtgacaagggcccgccaggaggtaaagggcagcctggagacccaggcatccccggacacaagggacacacaggcctgatgggaccccagggcctgcccggcgagaatggcccagttggaccaccgggcccccctggacagccaggatttcccgggctcaggggtgagtcaccctctatggagaccctgcgccggttgatccaggaggaacttggcaaacagttggagactagactagcctacctcctggcacagatgccccccgcttacatgaagtcatcacagggtaggccaggtcctccgggaccaccagggaaagatggcctaccgggccgggccggcccaatgggtgagccaggtcgtccaggccaggggggtctggaaggccccagcggtcccatcgggcctaagggggagagaggcgccaagggggacccaggcgcacctggcgtcggactgaggggagagatgggcccacctggcatcccaggtcaaccgggagagcctggctacgcaaaagatgggctgcccggtatacctggaccccagggggaaacaggtccggcgggtcaccctgggctccccgggcctccaggcccccctggccaatgtgatccttctcagtgcgcatactttgccagcttggccgcacgacccggtaatgtgaaggggccctag

SEQ ID NO: 4110 - DNA, 5145 bp, Artificial Sequence
  Description of Artificial Sequence: Synthetic coding sequence
atgcacctgcgggcccaccggacccggcggggcaaggtgagccccacggcaaagacaaaaagcctcttgcacttcattgtcttatgcgttgcgggcgtcgtggtgcacgcccaggagcaggggatcgatatcttgcatcagcttggactcggagggaaggacgtccgccatagttcccctgccacagcagttcctagcgcttcaacccctcttcctcagggggtacacctgacggagtcaggcgtgatcttcaagaatgacgcctatatcgaaacaccttttgtaaagattctcccggtgaacctgggccagcccttcaccatcctgacaggactccaatcgcacagggtcaataacgcctttctgttctctatccgcaacaagaatagacttcaacttggcgtgcagctcttaccgaagaaattggtcgtccacatccggggcaaacagccagcagtgtttaactactccgtgcacgacgagcagtggcactcttttgctattactatccgaaaccagagtgtctccatgtttgtcgagtgcgggaagaaatatttcagcacagaaaccatcccggaggtgcagacgttcgacagcaactccgtgttcactcttggttcaatgaacaataattcaatccactttgaggggatagtgtgtcagctcgacatcataccgtcagccgaagcttccgccgattactgtcggtatgtgaagcagcaatgtagacaggccgacaaatatcagccagaaactagcattccttgcacaactctgattcctacgaagattcctgagcactcacctccccctaaactctttgcagagaaggtgctctccgaggacaccttcacggaggggaaaagtatccctaacattatcaagaatgattccgaaacggtctacaagcggcaagaacaccagatctctcgcagccagctaagttctctgcaatccgggaatgttagcgcggtggacttaacgaatcacggcattcaggccaaagagatgatcaccgaggaggatacccagacgaattttagcctctccgtgactactcaccgaatttcagaagccaaaatgaatacaaaggagaagttcagctccctgctcaatatgtcagacaatatcacccagcatgacgaccgcgttactggcctttcccttttcaagaagatgccgagcattctgccccagatcaagcaggacacaatcaccaatctgaaaaaggcaatcacagcaaatctacacaccaatgagcttatggaaatgcagcctatcctcaatacctcactgcacagagtgaccaacgaaccatctgtggacaaccacttggacctcaggaaagaaggcgagttctacccagacgccacctaccccattgagaactcgtatgaaacagaactgtatgactactattattatgaagacctgaatactatgctggaaatggagtacttgaggggcccaaaaggagacactggcccgccgggccctcctggtccagccggtatcccgggcccatctggcaagcgcggacccagagggattcccgggccacacgggaaccccggcctgcctggattaccagggcctaagggccccaagggagaccctggcttcagccctgggcagccagtccccggcgagaaaggggatcagggtctgagtggcttaatgggccctcctgggatgcaaggcgacaagggccttaaaggtcaccccggattgcccggactgcccggtgaacagggcatcccaggttttgcgggaaacattggatccccggggtaccccggccgccagggtctcgctgggcccgaggggaaccccgggccaaaaggtgcacagggcttcatcggaagccccggggaagcaggtcagctagggcccgaaggagagcgaggaatcccaggaatcaggggcaagaaaggattcaagggtagacagggcttccccggcgattttggggacagagggcccgccggactggacggttcgcctgggttagtgggagggactgggcccccaggattcccaggattacggggaagtgtgggaccagtgggacccattggccctgctgggatccctggcccgatgggcctaagtgggaacaagggactgccgggaatcaagggagacaaaggggaacagggcaccgctggagaacttggcgagccggggtaccccggggacaagggggctgtgggcctgccaggacccccagggatgcgaggcaagagtggaccttccggccagacgggcgacccaggtttgcagggaccgtccggacccccgggccctgagggattcccgggtgatatcggaattcccgggcaaaacggccctgaggggcctaagggcttgcttggaaatagggggccccccgggccccctgggctcaagggaacccaaggtgaagagggacccataggtgccttcggtgagttaggcccaagaggcaagccaggtcagaagggatatgccggggaaccaggtccagaaggtcttaagggggaagtcggcgatcaagggaacattggcaagattggggaaactggaccagtgggcctgcccggagaagtcggcatgacaggtagtatcggcgaaaagggagagcgcggaagccccgggccactgggcccccaaggcgaaaaaggagtcatgggataccctggaccaccgggcgtgccgggaccaatcggacccctgggactgcctggtcatgtgggcgcacggggcccacctgggagccagggtcccaaaggccagaggggctcgaggggccccgacgggctgctcggtgagcagggtattcagggagccaagggcgagaagggcgatcagggtaaaagaggaccacacggactcataggaaagactggcaatcctggggaaaggggtttccagggaaaacctggacttcagggactgcctggaagtacaggagataggggcctccctggggagccaggactgagggggctgcagggcgacgtgggtccacctggggagatggggatggagggaccccctggtacagagggggaatctggacttcaaggcgaacctggtgcaaagggggacgttgggaccgcagggtctgtgggtggcaccggagaaccaggtcttcggggagagcccggcgcaccaggggaggagggactacaaggcaaggatggtctgaaaggcgtgccaggaggccgtggcttacccggcgaagacggcgaaaaaggggagatgggactgcccggaatcattggaccattaggaagatcagggcagacaggcttgcccggacccgaggggatcgttggtatcccgggtcaacgggggcggcccggcaagaagggggacaaagggcagatcggtcccactggtgaagtcggaagccgagggccccctggcaaaatcggtaagagcggccctaagggcgcccggggaacacggggggctgtaggacatctcggtctcatgggccccgacggcgaacccggtatccccgggtatagaggtcaccaaggacaacctgggccttccggtctccccggacccaaaggggaaaagggataccccggagaggactctacagtgctaggacctccggggccccgtggagaaccagggccagtaggggatcaaggagaacgaggggagcctggcgctgaagggtataaaggccatgtgggtgtgccaggtttgagaggcgccacgggccagcagggacctcctggcgagccaggcgatcaaggcgagcagggcctgaagggagagcgaggttccgaggggaacaaaggaaaaaagggtgctcccgggccatccgggaagcctggcatccccgggttgcaagggctgctggggcctaaaggtattcaggggtaccacggcgcagatgggatttcaggcaatcctggcaaaatcggaccccccggaaaacagggccttccaggaatccgaggaggacctgggcgcaccggcctggcaggggcacccggtccaccgggggtgaagggctctagtggcctgccagggagtcctggtatacagggccccaaaggggaacagggcttgcccgggcagccagggattcagggtaagcggggccacagaggagcccaaggtgatcaaggtccttgcggcgaccctggtctcaaggggcagccaggcgagtacggggtacagggacttacggggttccaggggtttccaggtcctaaaggccccgaaggagatgctggcatcgtgggaatctccggccctaagggtccgatcggccataggggcaacacaggacccttgggcagagaaggaatcattggccccacgggcagaacaggccctcggggagagaagggtttccggggcgagaccgggccacaaggaccacgggggcaaccaggccctccaggtcctcccggtgccccgggcccaagaaagcaaatggacataaatgccgccattcaggcccttatcgaaagtaataccgccctgcaaatggaatcctaccaaaatactgaggtaaccctgatcgatcatagcgaggaaattttcaaaaccctgaactatctgtcaaatcttctgcattcaatcaagaatcccttgggtacacgagataaccctgcgagaatttgcaaagacctcctgaattgcgagcagaaggtcagcgatggaaagtattggatcgatcctaacttagggtgccctagtgatgcaatcgaggtgttttgtaatttctccgctggcggccagacctgccttccccctgtttctgttaccaagctggaattcggcgtgggtaaggtgcaaatgaatttcctccacctccttagtagtgaggcaacccatatcatcaccatccactgcctgaacactcccagatggaccagcacccagaccagcggacctgggttacccataggatttaaggggtggaacggacaaatctttaaagttaataccttgctagagccgaaagttctgtccgacgactgcaaaatccaagacggctcttggcataaagctacgtttctgttccatactcaagagccgaaccagctgccagtcatagaagtgcagaagctaccgcatctgaaaacagaaaggaagtattacatcgattcctccagtgtctgctttctatag

SEQ ID NO: 4111 - DNA, 5082 bp, Artificial Sequence
  Description of Artificial Sequence: Synthetic coding sequence
atgcacctgcgggcccaccggacccggcggggcaaggtgagccccaccgcgaagacgaaatcactgctgcacttcatagttctgtgtgtggcgggtgtggttgtccacgctcaggaacagggtatcgacattttgcaccagttgggactgggaggaaaagatgttagacatagtagtcccgcaaccgccgttccgtcggcttcaactccgctgccccagggcgttcatttaactgagagcggagttatctttaagaatgacgcctacatcgagacacccttcgtcaagattctgcccgtgaatctagggcagccttttacaattttgacagggctccagtcccaccgcgtgaataacgcctttttgtttagcattaggaacaagaaccgtctccagctcggcgtgcagttattacctaagaaactagttgtgcatatccgcggcaaacaacccgccgtgtttaactattccgttcacgatgagcaatggcatagttttgctattaccattagaaatcaatccgtgtccatgtttgttgaatgtggcaaaaagtacttctcaacagagacaattcctgaggtgcagacttttgactctaactcggtgttcactctgggctctatgaacaacaattccatccacttcgaaggcatcgtctgtcagctggatattatccctagcgcagaggccagcgccgactattgtaggtacgtgaaacagcagtgtagacaggctgacaagtaccagccggaaacatctataccctgtaccacactcatacctacaaaaattcccgagcatagccccccccccaaactgtttgcagaaaaggtcctgtctgaggacactttcactgagggcaagagcattcctaacatcatcaaaaacgacagcgagactgtgtacaaacggcaagaacaccagatctcccgcagtcagttgagcagtctgcaaagtggcaatgtctctgcggtcgaccttactaaccacggaattcaggccaaagagatgatcacagaggaggatacccaaactaatttcagcttaagcgtcacaacgcataggatctctgaagcaaaaatgaataccaaggaaaaattctcaagtctcttaaatatgagtgacaatatcactcagcacgacgacagggtcaccggtctgtctctgtttaaaaagatgccgagcattttgccacagatcaaacaggacacaattaccaatctgaagaaagccattactgctaacctgcatacaaacgaattaatggagatgcaacccattctgaacaccagcttgcaccgtgtcactaatgagccatccgtggacaaccatctagacctgcgtaaggagggcgagttttaccctgacgccacctacccgattgagaacagctacgagactgagctttatgactattactactatgaggatctgaatacaatgctcgagatggaatatttgcgcggacctaagggggataccgggccccctgggccacccggcccagcaggaatacctggtccatctggaaaacggggccctaggggaattcccggccctcacgggaaccccggtttgcctggtctgcctgggcctaaagggcccaagggcgacccaggattctcacctgggcagccagtacctggagaaaaaggggaccaaggtttgtctggtctgatggggccccccggtatgcagggcgacaagggcttgaaaggtcaccccgggcttccagggctgcccggagagcagggcatcccggggtttgccggcaacatcgggagccccggataccccggccgacagggcctggcaggccctgaaggtaatccaggcccaaaaggcgcacaagggttcattggatctcccggtgaagccggacagctaggacctgagggtgaaagaggcattcctgggatcagagggaagaagggtttcaagggccgacagggattccccggcgatttcggggacagaggtcccgctggcttggatggatcccccggccttgtcgggggcacaggaccccccggattccccggtttaaggggctcagtcggaccagtcgggccaattggacctgccggcatcccgggccccatgggtctgagtggcaataaggggctgcccggtataaagggtgacaaaggggaacagggaactgcgggggagctcggagagcccggatatcctggagacaaaggggcggtgggattgcctggtcctccgggtatgagaggcaagagcggtcccagtggacaaactggcgacccaggtctacagggcccaagcggcccaccaggtccagagggctttcccggggatattggtattcccggccagaatgggcctgagggacccaaaggcttacttggcaacagaggtcctccaggtcctccaggtcttaaaggcactcagggcgaggaagggccaattggagcatttggagaactcgggccacgcggaaagcccgggcaaaagggctatgcgggcgagcccggacctgaagggttgaagggcgaagttggagatcagggcaacatcgggaaaattggcgagacgggacctgtcggactgcctggggaggtgggcatgacaggaagcatcggtgaaaaaggcgaaagggggtcccctggcccactgggcccccagggggagaagggtgtgatgggttatcctggcccacctggcgtaccaggacccatcggaccactaggtctgccaggccatgtcggggcgcgcggccctcccggcagccagggccctaaagggcagagggggtctcgaggtccagatggcttgctgggtgagcaggggatccagggcgcaaagggtgaaaagggtgaccaggggaagcggggacctcacggattgattggaaaaaccggcaatcccggcgagcggggatttcaggggaagccggggcttcagggactgccgggatctactggcgatcgaggcctgcctggcgagcccggcctgcgtggactccaaggagacgttggaccccccggtgaaatgggtatggagggcccaccagggaccgaaggggaatctggcctgcagggcgagccaggagctaaaggggacgtgggcaccgccggctccgttggggggaccggagagccaggactccgaggcgagcctggtgcccccggagaagagggcctgcaagggaaggacgggctgaagggggtgccgggcgggagagggctccctggagaggacggcgaaaagggcgagatggggctgcccgggatcatagggccgctaggccggtccggccagaccggtctgcctggccccgaggggatagtcgggatccccggtcaacgcggtcgtcccggtaagaaaggcgataagggacagatcggccctactggggaggtgggaagtcgagggcctcccggcaaaataggcaagtccggccccaagggggctagggggacaagaggcgcagtggggcacctgggtctgatgggcccggatggcgagcctgggatcccaggataccggggtcaccagggtcaacccggccccagcggtctacccggacccaagggagagaaaggatatcccggtgaggacagcaccgtgctcggccctcccgggcctagaggcgagccaggacccgtgggggaccagggggagaggggggagcctggagcggaaggctataaggggcatgttggggttcccgggctccgaggagcaaccggacagcaagggcctccaggagagcccggcgaccagggtgaacagggactgaaaggcgaacgggggagcgagggcaacaagggtaagaaaggcgcccctgggcccagtggcaaacccggtatacctggcttacaggggctgctgggtccaaaggggatacagggataccacggggccgacgggattagtggaaatccgggtaagatcgggccccccggcaagcagggcttaccaggcattcgtgggggccccgggaggacagggcttgccggcgccccaggcccacctggcgtcaaaggatcatcagggttaccagggtcgcccgggatacaaggtcctaaaggagaacaaggcctccctggccagcccggaatccagggtaagcgaggccacagaggtgctcagggcgaccagggcccttgcggggatcctggactaaaggggcaacctggtgaatacggcgtgcaaggcctcacgggttttcagggcttccctggacctaagggtcccgaaggggatgcaggcattgttggtatttcaggtcccaaagggcctatagggcacagggggaacacagggcctctgggacgggagggcattattgggccaaccgggaggacaggtcccaggggagaaaagggatttaggggggagaccaagcaaatggatatcaatgctgccattcaggccctgatcgagagcaataccgcgcttcaaatggagagttaccaaaacaccgaagtgaccctgattgaccatagcgaggagatctttaaaacactgaattatctgtcaaaccttctgcactccataaagaacccactgggaacacgggacaatccggcccggatctgtaaagacttgcttaattgtgagcagaaggtgtcggacgggaaatactggattgacccaaatctgggttgcccttcagacgccatcgaggtgttttgcaatttttcagcgggcggccaaacatgcctcccacccgtgtccgtcacaaagctggaattcggcgtcggcaaagtgcagatgaattttcttcatttactttcctctgaggcaactcacataattactattcattgtctgaacaccccacggtggacatctacacagacatctggaccagggctccctattggcttcaaggggtggaatggtcagattttcaaggtaaacacactgcttgaaccgaaggtgctgagtgacgattgtaaaattcaggatggtagttggcataaggccacctttttgtttcacactcaggagcctaatcagttacctgtcatcgaagtgcagaagcttccacacctcaagaccgaacgcaagtactacattgactcttcttccgtctgctttctgtag

SEQ ID NO: 4112 - DNA, 246 bp, Artificial Sequence
  Description of Artificial Sequence: Synthetic coding sequence
atgcacctgcgggcccaccggacccggcggggcaaggtgagccccacggctaaaacgaaatcactacttcattttatagtcctgtgcgtggccggtgtggtagtacatgcacaggagcagggcattgacatcctgcatcagttgggactgggcggcaaggacgttcgccatagctccccggctactgccgtaccaagcgcgagtacccccttaccacagggggtccatctgaccgaatctggatag

SEQ ID NO: 4113 - DNA, 1971 bp, Artificial Sequence
  Description of Artificial Sequence: Synthetic coding sequence
atgctgctgaagaagcacgccggcaagggcggcggccgggagccccgcagcgaggacccaactcctgccgagcagcattgcgcaagaactatgccaccctgtgcggtactagctgctctgcttagcgtcgtggctgtggtttcctgtctgtacctgggagtcaagacaaatgacctgcaggctaggattgccgctctcgaatctgctaagggggcaccctccatacatttgctgccagatacactcgaccacctcaagaccatggtgcaggagaaagtcgagagactcctggcccaaaaatcctacgagcacatggccaaaatccgcatagctagggaggccccttcagaatgcaattgtccggccggcccacccgggaagaggggcaagcgagggcgacggggtgaatccgctggacctccgggcgcccctgcgccctcccaagggcctccaggtcccaagggcgacaagggcgaacagggagatcagggacctcgcatggtttttccgaagattaaccacgggttcctctccgccgatcagcagttaataaaacgccggttaatcaagggggatcagggccaggccggcccccctgggcctcctggcccgccaggccctagggggcccccgggcgacactggcaaggatggccctagaggcatgcctggcgtaccaggcgagccaggcaaaccgggggaacagggtctcatgggacccttgggaccacccggacagaaggggtccattggagctccggggatcccagggatgaacggtcagaaaggggaaccagggctccccggagccgttggacaaaatggtatcccaggacctaagggggagccgggtgagcaaggtgagaaaggcgacgctggggaaaacggtcccaagggggatacaggggagaagggcgaccccggaagttcggctgcgggaattaagggagagccaggcgaaagtgggcgacctgggcaaaagggggagcctggcttacctgggctacctggtctacccggcattaagggcgaacctggatttattgggcctcaaggagaacccggattaccggggttgcccgggaccaaaggtgagcggggggaggctgggccgcccgggcggggcgagaggggcgagcccggggcaccaggccctaagggtaagcagggagagagcggaacacggggaccaaagggtagcaaaggagacagaggcgaaaagggcgacagcggcgcccagggccctagaggaccgccaggccagaaaggagaccagggagccacagagataatcgattacaacggaaacctgcacgaagctcttcagcgcataaccaccctcaccgtgacaggcccacctggaccgcctggacctcagggcctgcaggggcccaagggtgagcaggggagccccgggatcccaggaatggatggtgagcaggggctaaaagggtccaagggggacatgggagatcctgggatgactggggaaaaaggggggatcggattgcccggcctacctggggctaatggaatgaagggcgaaaagggcgactctggaatgcctggcccgcaggggccgagtattattgggccccctggaccgccagggccacacggaccccccgggcctatgggaccacacgggctgcccggacccaaaggcacagacgggccaatgggtccccacggacccgccggtcccaagggtgagcgaggtgagaagggagcaatgggcgaaccaggcccgcgtggcccctacgggctacctggcaaggacggggaaccggggctggatggctttcctggaccaagaggcgagaagggagatctgggcgaaaaaggtgaaaagggatttcggggcgtcaaaggtgagaagggggagccgggacaacccggtctggacggactagatgccccttgtcagctcggtccagacggcttaccgatgccgggttgttggcagaagtag

SEQ ID NO: 4114 - DNA, 1929 bp, Artificial Sequence
  Description of Artificial Sequence: Synthetic coding sequence
atgctgctgaagaagcacgccggcaagggcggcggccgggagccccgcagtgaagatccaacacccgcagagcagcattgtgcgcggactatgcccccgtgcgcagtcctagccgcactgttgagtgtcgtcgcagttgtcagctgcttgtacctaggtgtcaaaaccaacgatcttcaggcgagaatcgcagccctggaatccgcgaaaggggctccttctattcatctgctgccagataccctcgaccacctgaagacgatggttcaggagaaagtggagaggcttctggctcagaaatcctacgaacacatggccaagattaggattgctcgagaagctccttccgagtgcaattgccctgccggaccacctgggaagcgcgggaaacgcgggcggagaggcgagagcggaccaccaggacaacctgggccccagggacccccagggcccaagggcgataagggagagcaaggcgaccaaggcccacggatggtatttcccaagattaaccatggatttttaagcgccgaccaacagttaatcaagaggaggctgattaagggggaccagggacaagccggaccaccgggaccaccagggccacctggacctagaggacctccaggagacacagggaaggacgggccccggggaatgcccggtgtccctggtgaacctggcaagcctggggagcaaggccttatggggcccctggggcccccaggacagaaaggatcaataggagccccgggcatcccggggatgaatggccagaagggggaaccgggattaccaggcgccgtcgggcagaatggaataccaggcccaaagggcgaacccggcgagcagggggagaagggagacgccggagaaaatggacctaaaggcgataccggcgaaaagggggatccgggatcgtctgctgcgggtatcaaaggggaaccgggtgaaagcgggaggccaggtcagaaaggagaaccaggtctcccaggcctgcctggccttcctggcataaaaggtgaacccgggtttattggtccacagggggaacccggcttgcctggcctacccggaactaaaggggagcggggtgaggccgggccacccggacggggtgaacgcggagagccaggggctcctggtcccaagggcaagcaaggagaaagtggaacccgcggccctaagggctcgaagggagatcggggggagaaaggagacagcggcgcccagggcccccggggcccacccggtcagaaaggagatcagggggctactgagattattgattacaacggaaatttacacgaggctcttcagaggatcacaacattaacggtgactggtcctcctggaccaccagggccccaggggttgcagggaccaaagggagagcaggggtcccctggaattcctggtatggatggcgagcagggcctgaagggcagcaagggcgatatgggagatcctggtatgacaggcgagaaaggaggcatcggtctgcccggattaccaggcgccaacggaatgaagggggagaaaggcgattccggaatgcccggtccgcaaggccccagtatcattggcccgcctgggccccctgggcctcatggtccgcccggacccatggggcctcacggactgcccggccccaaagggacggatggtccgatgggaccccacggaccagcagggcccaagggagagaggggggaaaaaggcgccatgggggaaccagggccacgcggaccctacgggctgcccggtaaggatggagagcctggtctcgatgggttccccggacctagaggagagaagggggatctgggtgagaagggggagaaggtaacctccccatcccagcacgtgccatgcttaattctgctgctgctgagtgctcttctgttctccttatgcgattctatctag

SEQ ID NO: 4115 - DNA, 1965 bp, Artificial Sequence
  Description of Artificial Sequence: Synthetic coding sequence
atgctgctgaagaagcacgccggcaagggcggcggccgggagccccgatccgaggaccccacccctgcggaacagcactgcgcccgaacaatgcccccctgtgcagtactagctgccctcctcagtgtggtcgcagtggtctcttgtctctatctcggcgtcaaaaccaacgaccttcaggccagaatcgctgcccttgagtctgccaagggagccccttccatccacctcctgccagacaccttagatcatctaaagaccatggtgcaggaaaaggtggaacggcttcttgcccagaaatcttatgagcacatggcaaagatacggattgcccgcgaagccccaagcgagtgcaattgtcccgcaggccctcccggcaagcggggtaagcgcggtcggcgaggcgagtctggtccccccggccagccaggcccacagggtccacccgggcccaagggcgataagggagagcagggagaccaggggccccgaatggtctttcccaaaatcaaccacggcttcctttccgcagatcaacaactgataaaacgccgcctcattaaaggggatcaagggcaggcaggcccacccggaccaccaggccccccagggccacgaggccccccaggtgacaccgggaaggatggtcctaggggcatgccgggcgtcccaggcgagccagggaaacccggcgaacagggtctcatggggcccctgggacctccaggccagaaagggtctatcggtgcccccgggatccccgggatgaacggccagaaaggcgaacctggactacctggagcggtgggacagaatgggatccctggaccaaaaggtgaacctggtgagcagggggaaaagggggacgctggcgagaatgggccaaagggcgacactggcgaaaagggggatcctggttcaagtgcagccgggattaaaggcgaaccaggagaatctgggcgccccgggcagaaaggtgagccgggcttgccagggctcccgggattgcccggtatcaaaggagagcctggcttcattggccctcagggagagcccgggctgccaggactgccagggacaaagggagaacgtggcgaagcaggtcccccgggcagaggcgaaagaggtgaaccaggcgcccctggtccaaagggaaagcagggcgagagcggcacaagaggacctaaggggtccaaaggagatcgaggagaaaaaggagatagcggagcgcaggggcctcgtggaccgcctggacagaaaggagaccagggagcaaccgaaatcattgactacaatggaaatctgcacgaagccctgcagagaattacaacccttaccgtcaccggacctcccggcccacccggcccccagggcttacaagggcccaagggtgagcaggggtcacctgggataccaggtatggacggtgaacagggcctgaaaggatccaagggggatatgggcgatcctggcatgactggtgagaagggaggtatcggcctgccaggcctgcctggcgcgaatggaatgaagggagaaaagggagactcaggtatgccgggaccacagggaccatctatcattggcccaccagggccaccaggtccccacggcccacccggtccgatggggccccacgggctgcccggccccaaggggaccgatggacctatgggccctcacgggccagcgggacccaaaggtgagaggggagaaaagggggccatgggcgagccaggacctcggggaccctacgggcttccgggcaaggacggagagccaggtttggatggctttccggggcctaggggagaaaagggcgatctgggggagaaaggcgaaaaaggctttcgaggcgttaaaggagaaaagggggagcccggtcagccagggctggacggcttggatgcaccctgccagctgggccctgacggccttcccatgcccggctgttggcaaaaatag

SEQ ID NO: 4116 - DNA, 1752 bp, Artificial Sequence
  Description of Artificial Sequence: Synthetic coding sequence
atgctgctgaagaagcacgccggcaagggcggcggccgggagccccgcagcgaagatccgacacccgctgagcagcattgtgctcgcacaatgcccccttgcgcagtgctggcggcactgctgagcgtggtggccgttgttagctgcttatacctgggggtaaagactaacgatctgcaggcccgcattgcggctctggagtctgccaaaggggccccttccattcacctcttaccggataccctcgaccacctcaagactatggtgcaagagaaggtcgaacggctacttgcccagaagtcatatgagcatatggcaaagatccgaatagcccgggaggccccaagtgagtgcaattgtcctgctggcccaccgggaaaacgcggcaagcgtgggcgtagaggagaatccgccgggcccccaggcggcccgcccgggcctaaaggagacaagggcgagcagggagaccagggtcccaggatggtgttccccaagattaatcacggcttcctctccgcggaccaacagctcatcaagcgcaggctcattaagggggaccaggggcaggcaggaccccccgggcctccaggaccacccgggccccggggcccccctggcgacacaggcaaggacgggccacggggaatgccaggggtcccaggagagccaggcaaacccggtgagcagggcctgatggggcctctgggacctccagggcagaagggcagcattggggctcccggtataccaggaatgaatgggcagaaaggggagcccggattacctggcgcggtcggccagaacgggatcccagggcccaagggagaacccggtgaacagggggaaaaaggcgatgccggggaaaacgggcccaagggggatacaggagagaaaggcgacccggggagtagtgcagccggtattaaaggcgagcctggcgagtcaggtcgccccggccagaagggagagcctggtttcataggacctcaaggtgagcctggcttaccaggcttacccggtaccaagggggagcgtggagaggcaggccccccagggagaggagagagaggggagcctggagctccaggtcccaaaggcaagcagggagaatcaggcaccagaggcccgaaagggtcaaagggcgacaggggggagaaaggcgacagcggggcccagggcccgcgaggtcccccaggacagaaaggcgaccagggcgccactgaaatcattgactataacggaaatctgcatgaagccctgcagcgcattactacactcacggttacaggtcccccgggcccccctgggccccaagggctacagggcccaaagggtgagcagggctcacccggcatccctggaatggatggcgaacagggactcaagggctccaagggagacatgggagatcccggtatgactggcgaaaaagggggtattggcctgccaggactgccgggagccaacggaatgaagggggaaaagggcgatagcggaatgcctggtccccagggaccctcaataatcggacccccaggccctcccggacctcacggacctccaggccctatgggtccacatgggttaccgggccccaaaggaacggacggccccatgggcccccatgggcccgcagggcccaagggagaaagaggggaaaagggagccatgggagaacctggtccaagaggtccatatggcctgccccaggggcccgacgggctccccatgcctgggtgttggcagaaatag

SEQ ID NO: 4117 - DNA, 1497 bp, Artificial Sequence
  Description of Artificial Sequence: Synthetic coding sequence
atgctgctgaagaagcacgccggcaagggcggcggccgggagcccaggagcgaggacccaaccccggccgagcagcattgtgctcggacaatgcctccatgcgccgttctggccgcattgctctcggtggttgccgtcgtgagctgcctgtatctaggcgttaaaactaacgacttgcaggctaggatcgccgctctcgagagcgctaagggagcccccagcatccacttattgcctgacaccctagatcatctgaagacaatggtgcaggagaaggtggagcgcttgctggcacagaagagttatgagcacatggccaaaatacgcatagcccgagaggcaccttccgagtgcaattgccccgcaggtccccccgggaagcgcgggaagcgaggccgcagaggcgagtccgcagggccaccaggagcacccgctccatcccaggggccccctggcccaaagggcgacaagggcgagcaaggggaccaggggcctcgcggcccccttggcccaccgggacagaagggtagtatcggcgcacccggaatccccggcatgaatggccagaagggggagccagggctcccgggcgctgtcggccagaacggcattcctgggcccaagggtgaacccggcgagcagggggaaaagggcgatgctggagagaacggtcctaaaggggacacgggtgagaaaggtgatcctggctcctcggccgccgggatcaaaggcgagcctggggagagcgggcggccgggccagaagggtgagcctgggttgcccggcctgccaggccttccgggaatcaaaggtgagcctggatttattggtcctcagggcgaacccgggctgccagggctcccgggtacaaagggtgaaagaggagaagctggaccccccggcaggggcgaacgtggggagccgggcgccccaggtcctaagggtaaacagggagaatcgggtactagagggccgaaggggagtaaaggagacagaggtgaaaagggcgacagcggagcacaggggccgagaggccctcccgggcagaaaggagaccaaggggcgactgaaattattgattataacggaaatctgcacgaagctctgcagaggattaccacacttacggtgacaggccctccaggaccaccaggcccccagggactgcagggaccgaagggggaacagggcagtcctgggattccaggaatggacggagagcagggcctgaagggcagtaaaggagatatgggggaccctggctcccagtggaacgaacggcggaagagacggttttggaacgcgggaagtacagggtctttctaccacagacccacaaggcccacacgctccccctggcctacatggccccacggcacatcgtggacaagttggactaaaggctctatttggttgcgaaggaaggctaggattccgggctatcggtggtcttatggtactccatggccatgtaggagccaacgaaggaaaagctag

SEQ ID NO: 4118 - DNA, 213 bp, Artificial Sequence
  Description of Artificial Sequence: Synthetic coding sequence
atgctgctgaagaagcacgccggcaagggcggcggccgggagccccgctcggaggatccaacaccggccgaacagcattgtgctcgaacaatgcctccttgcgccgtgctggcggctttactctcggtggtagccgtagtaagctgcttgtatttgggtgtaaagacgaatgatctacaggcacggatcgccgccctcgagagtgccaagtag

SEQ ID NO: 4119 - DNA, 90 bp, Artificial Sequence
  Description of Artificial Sequence: Synthetic coding sequence
tgaggcccccggggcgagaagggcgacctgggcgagaagggcgagaaggggccagatgggcttccaatgccgggctgttggcaaaaatag

SEQ ID NO: 4120 - DNA, 5583 bp, Artificial Sequence
  Description of Artificial Sequence: Synthetic coding sequence
atgggcgccggcagcgcccggggcgcccggggcaccgccgccgccgctgctgcacgggggggggggtttctgttttcatggattctagtaagttttgcctgccacttggccagcacgcagggggcccctgaggacgtcgacatactgcagcgattggggttatcctggaccaaggctggttcacctgctccgcccggcgtgatccctttccagtcaggttttatcttcacacagagggcacgactccaggcacctaccgggactgtgattcccgctgccctcggtaccgagttggccctagtactgtcattgtgtagccatcgagtgaaccatgcattcctgttcgcagtgcgaagccaaaagcgtaagttgcagctcggcctgcagtttctccccggtaagacagtagtccatttggggtccaggcgctcagtggcttttgacctggatatgcacgacggtaggtggcaccacttggccttggagttgagaggcaggaccgtcaccttagtcacagcttgtggtcaaaggagagttcctgtgttgctcccattccatagagatcccgcattagacccaggaggttcctttctgttcgggaagatgaacccccacgcggtacagtttgaaggcgcactgtgccaattctccatctaccctgtaacgcaggtggcccacaattactgcacccacctcaggaagcagtgcgggcaggcagatacttaccaaagcccactgggcccacttttttcccaagattctggtcgtcctttcacttttcagtcagatctggccctcctgggcttggaaaacctcacaaccgccactccggcccttggttccctccccgctggtagggggccaaggggcacagtcgctccagcaacacccaccaaaccccagaggaccagcccaactaaccctcaccaacacatggctgtgggtgggccggctcagactccgcttctaccagccaaactatccgcttctaacgcactggatccaatgctcccagcctccgtaggcggttcgacgaggacaccccggcccgcggccgcccagccttcacagaagattacagcaaccaagattcctaaatccctgcccacaaaaccatccgccccttcaaccagcatcgttcccatcaagagccctcatcctacccagaagacagccccttcttcatttaccaagagtgccctccccacccagaagcaggtaccacccacatctagacccgtacccgctcgggtatctcggcccgctgagaaacccatacagcgaaaccccgggatgcctagaccccctcccccctccacacggcccctgcctcccaccacatcaagttctaagaagcccatccctactctcgcccggactgaggccaaaattacatcccacgcctctaagcccgcgagcgcccggacctcaacccataaacctcctccatttaccgcccttagcagttctcccgcacccacccctggcagcacgcgatctactcgacccccggcgactatggtcccaccgacctcagggaccagcacccctcgtactgccccagccgtccctaccccagggtctgcacccactgggagcaaaaagccgattggcagcgaggccagtaaaaaagccgggccgaagtcctctccgcggaagccagtccctctgagaccgggcaaagccgcacgcgatgtgccgctgtccgacctgaccacaagaccatcccctcgccaaccacagccgtcccagcagacaactcccgcgctcgtgcttgcccccgcccagttcctgtcttcatcaccgcgcccaacttcatccggatactcaatttttcatctcgctggcagcacgccattccccctactgatggggccccctggtcccaagggcgactgcggactaccaggacctccgggattgccaggacttcccgggattccaggtgcgagaggacccagaggaccacccggcccatatggtaacccgggtctcccagggcctcctggcgccaagggtcagaaaggtgatcccggattgagccctgggaaggcccacgacggagctaaaggggatatgggattgcccggactctccggaaacccagggccacccggacgcaaggggcacaagggatacccaggacccgcaggacatcctggtgaacagggtcagcccggccccgaagggtcccctggagctaaaggatatcctggtcgccagggcctccccggtccagtcggtgaccctggacccaaaggcagccgcgggtacattggactccctggcctttttggtcttcccggctctgatggggagcgaggccttccgggcgtgccaggcaagcgcggcaagatgggcatgccaggtttccccggagtgtttggcgagagggggcctccaggcctggacggcaaccctggcgagcttggactgcccgggccaccaggcgtccctggccttatcggtgacctgggtgtgcttggacccatcggctatcctggacctaagggcatgaaaggcctgatgggaagcgtcggagaaccagggcttaagggtgataaaggcgagcaaggagttcctggcgtgagcggagacccaggattccagggcgataaggggtcccaggggttgcctgggtttcctggagcccggggtaaaccaggacctcttggaaaggtcggagacaagggatccatcgggtttcctgggccgcccggccccgaaggattcccaggggacatcggaccgccaggtgataacggccccgagggcatgaaaggcaaaccgggggcccgcggactcccaggaccccgcggacagctgggccccgagggcgatgaagggcctatgggtccacctggcgcaccaggcctggagggacagcccggccgtaaaggatttccggggcgcccaggattagatggggtgaagggagaaccaggcgaccccggtcgaccaggtcctgttggcgagcaaggattcatggggtttataggtctcgtgggcgaacctggcattgtgggagaaaaaggagaccggggcatgatgggcccgcctggtgttcctggtcccaagggaagcatggggcatcccggtatgcccggcggtatgggcacccccggggagcctggccctcagggacctcccggtagcagaggccctcctgggatgagaggagcaaagggacgccggggcccccgcggcccagacggtcctgctggggagcagggatctcgggggctgaaaggcccgcccggaccccagggacgtccagggcgaccgggccaacagggcgtggctggtgagcggggacatctcggaagtaggggatttcctggcatacctggcccttccgggccacctggcacaaaagggctgccgggggaacccggcccccaaggcccacaggggcctatcggccctcctggagagatgggcccaaagggtccaccaggcgcagtgggagaaccaggcctgcccggcgaagccgggatgaaaggtgacctcgggccactgggaacgcctggggagcagggtctcattggtcagcgcggagagcccggtctcgagggggatagtggaccgatgggaccggacggcctcaaaggcgaccgaggggatcccgggcctgacggcgagcacggcgaaaaaggccaggaggggctaatgggcgaggatgggccacctggacctccaggtgtgacaggcgtgagaggtccagaagggaaaagcggaaagcaaggagaaaaaggtagaacgggcgccaaaggggctaaaggctatcagggacaactaggtgagatgggcgtgcccggtgatcctggaccacctgggacccccggtcccaagggctctagggggtcactgggtccgaccggcgcaccaggccgaatgggagcacagggagaaccaggactggccggctacgacggacacaaaggaatcgtgggaccgctcggcccgccgggtcctaagggtgagaaaggagaacagggcgaggacggaaaggcagagggccctccagggccaccaggagatcgtgggcccgtgggagaccgtggggaccggggcgaaccaggcgatccaggatacccgggccaggaaggcgtgcaggggttgcgcgggaaaccgggccagcagggacaacccgggcatcctggcccacgcggctggcctggacctaagggaagcaagggagctgagggaccaaagggtaaacaaggcaaggctggcgcccccggccgacgtggggtccagggattgcaagggctcccaggccccaggggcgtagtgggccgccaaggtctggagggaattgcaggacctgacgggctccccggacgcgatggccaggcgggccagcagggtgagcagggggatgatggagacccagggccaatgggtccggctggtaaacggggtaaccccggcgtagccggcttgcccggggcacaggggcctcccggctttaagggagaatccggattgcccggccaactggggcctcctggtaaaagaggcacagaaggccgaaccggcctaccaggtaatcagggggaaccaggctccaagggacagccaggcgacagcggcgagatgggattccctggaatggccggtctgtttggacctaaaggaccccctggagacatcggatttaagggcattcaagggcctaggggccccccaggcttgatggggaaagagggaattgtgggaccgcttgggatactgggacccagtggtctcccaggacctaagggcgacaagggcagtaggggagactggggcctccagggccctagaggaccaccaggtcccaggggccgccctggcccacctggccctccgggcggtccaattcagcttcaacaagatgatctcggcgctgcattccagacttggatggatacgtccggggctcttcggcccgagtcatactcctaccctgataggctggtgctggaccagggcggagaaatcttcaagaccctgcattatctgtccaatcttatccagagcattaagacccccctggggaccaaggagaaccctgctagagtgtgtcgggatctgatggattgcgaacagaagatggtggacgggacctactgggtggacccgaatctgggctgttcaagtgatacaatagaagtgtcctgtaacttcacacatgggggacagacatgcctgaagccaattacagcttccaaggttgagttcgctataagtcgggtgcagatgaatttcctccatctgttgtcttctgaagtcacgcagcacattacgatacattgtctgaatatgaccgtctggcaagagggcactggacagacccccgccaagcaggctgtgcgttttagggcctggaacggtcagatctttgaagcagggggacaatttaggccggaagtctccatggacgggtgtaaggtccaggatggaagatggcatcaaacattgttcaccttccggacccaggaccctcagcagctgcccatcataagtgtcgacaatctcccaccggcatcatctggcaagcagtatagacttgaggttgggccagcttgcttcctgtag

SEQ ID NO: 4121 - DNA, 5604 bp, Artificial Sequence
  Description of Artificial Sequence: Synthetic coding sequence
atgggcgccggcagcgcccggggcgcccggggcaccgccgccgccgctgctgctaggggtggggggttcctcttttcttggatcttagtgtcattcgcgtgtcatctggcctcgacacagggagctcctgaggatgtggacattctacaaaggctcggtctgtcctggactaaggcagggtccccagcgcctccgggagtgattcccttccaaagtggatttatttttacacaacgtgcacggctgcaggccccaactggtacggttatccctgctgctcttggcaccgagctcgctctcgtcctctcgttgtgctcccacagggtgaatcacgctttcttgttcgcggtaaggtcacagaagagaaaattgcagctgggccttcagttccttcccggcaagaccgtcgtgcacctgggcagccgacggtcagttgctttcgacctggatatgcatgacggccgttggcaccacctcgcactggagctgaggggcagaaccgtgacgcttgtgacggcatgcggtcagagacgcgtgcccgtgcttcttccgttccatcgcgaccctgcgctcgatccgggaggatcttttttatttgggaagatgaacccacatgccgtccaattcgagggtgcactgtgccagttttccatctatcccgtcacccaggtcgcccataattactgtactcatctgaggaagcaatgtggtcaggctgatacgtatcagtccccactgggtcctctgttttcccaggactctgggcggccatttacatttcagtcagatctggcactcttgggtttggaaaacctaaccacagccactccagcattgggcagtctcccagccggacggggtcctagaggaaccgtggccccagccacccccacaaaaccacagagaacctcaccgacgaacccgcaccagcatatggctgttggagggccggctcagacccctctactccccgcgaagctaagcgcatcaaacgcgctggatcccatgcttccagcctccgtaggtggaagcactcggaccccacggcctgccgcggcccagccttcgcagaagatcacagctaccaagatccccaaatctctccctactaaaccctcagccccatccacttcaattgtaccgatcaaatcccctcaccctactcaaaagactgctccctcatcttttactaaaagcgcactccccactcagaaacaggttcctcccacctcccgtcccgtgcctgccagagtgagcaggcccgccgagaaaccaatccagcggaaccctgggatgccgcgcccacctcctcctagtactcggcctttaccccccaccacgtcttcctccaaaaaacctattccaactctagcaagaaccgaggcaaaaatcactagccatgcctccaaacctgccagtgccaggacttcaactcataagccacccccatttacagctttatctagctcccccgctccgacccccggctccacgcgctcaaccaggcctcctgcgaccatggtcccacctacctccggcacttctacaccaagaaccgcacccgccgtacctacaccggggagtgcccccaccggaagcaagaagcccatcgggtcagaggccagcaaaaaagccggaccaaaatcctccccacgcaaaccagtcccattgaggccgggcaaagccgcccgggatgtgccactgtccgaccttacgacgaggccttctcccagacagccacaaccaagccagcagactacacccgctctcgtcctggccccggctcaatttctctcaagttctcctagacccacatcttccggttacagcatatttcatttagcaggtagcacccccttccctcttttgatggggcctccggggcccaaaggggactgtgggctgccgggcccaccagggcttccgggacttccaggcatccccggggcaagggggccaagagggccacccggtccctacggaaatccaggtcttccaggaccaccgggcgccaaagggcaaaaaggagatcctggcctcagccccggaaaagctcacgatggcgcgaagggcgacatggggctcccagggctcagcgggaaccccggtcctcctggaagaaagggccataaagggtacccaggacccgcgggtcaccccggcgaacagggccaaccaggcccagagggatctccgggagcaaagggctaccctggccgccagggattacctggtccagttggcgacccaggcccaaaaggctctcgtggctatattgggctccccgggctctttgggctgccaggttctgatggagagcggggcctacctggtgtgcctggtaaacgcgggaaaatgggaatgccaggatttccaggcgtgttcggcgagcgcggccctcctgggctggacggtaaccctggcgagctcggtctgcctgggccgccaggggtgccaggtctgataggcgacctaggagtcctgggacccatcgggtatcccggtcctaagggcatgaaaggactaatgggatcagttggtgagcctggattaaaaggggacaagggagagcaaggggtccccggcgtcagtggggatccaggtttccagggcgacaagggatctcagggtctgcccggctttccgggtgcccgtggcaaaccaggtccattgggtaaggtgggagacaaaggaagcattggattccctggcccacctgggccagaaggatttcctggtgacatcgggccgccaggggataacgggcctgagggaatgaaaggtaaaccgggtgcgcgagggctccccgggcctcgcggccagctcgggcctgaaggcgacgagggaccgatggggccccccggggctcccggtctcgaagggcagccagggaggaaaggcttccccgggaggccgggtctcgacggagtcaagggagaaccgggggatccaggcagaccgggtcccgtaggcgagcaagggttcatgggtttcataggcctcgtcggggaacctggaattgtgggcgagaaaggagaccggggcatgatgggcccccccggagtgcccgggcctaaggggtccatgggccaccccggaatgcctggaggaatgggaactcctggcgagcctggaccccagggacccccaggatcgagaggacctcctggtatgcgcggcgctaagggcaggcgcggacctaggggtccagatggaccagccggtgagcagggctcccgcggactcaaagggccgcctgggccacagggccgcccaggtaggcccggccagcaaggcgtcgccggcgaacgagggcacctgggaagcagaggattccccgggatccccgggcccagtggcccccctggcacaaagggattgccaggtgaaccagggcctcagggccctcagggcccaatagggccccctggcgaaatgggcccaaagggcccccctggtgctgtgggcgagccaggccttcccggcgaggcaggaatgaagggcgacttaggtcctttaggcaccccgggagagcagggtctgataggccagagaggggaaccaggcctcgagggtgacagtggtccaatgggcccggatggactgaagggcgaccggggcgaccctggacctgacggcgagcacggagagaagggacaggaaggcctgatgggagaagatggccctccaggtccccccggggtaactggtgtgagagggcccgaaggcaaatctgggaaacaaggcgaaaaaggacgcacgggcgcaaagggtgccaaaggctatcagggccagttgggggagatgggcgtaccaggcgatcctggaccccccggtacaccaggaccaaaaggatctcggggctccctcgggcctaccggtgcgccagggagaatgggtgctcaaggggagcccgggttagctggctatgacgggcacaaaggcattgttggcccactcggcccacccggtccaaagggtgagaagggggaacagggggaagacggtaaggctgaaggcccaccgggccccccaggggatcgcggcccagttggcgaccgtggggaccgtggcgagcctggcgaccctggctaccctggccaggagggcgtgcagggtttacgcggaaaaccagggcagcaaggccaacccgggcaccctgggcccagaggttggcccggaccaaaaggctcaaagggggcggagggccctaaggggaaacaagggaaggcgggcgcacccgggcgccgaggggtgcagggcctgcaggggctgccagggccgcggggcgtagtggggcggcagggtctggaggggattgccggccctgatggccttcctggccgtgatggccaggccggacaacagggagagcagggagacgacggtgacccagggcccatgggtcccgctggcaaaaggggcaatccaggggtcgccggcctgccaggggcacaagggccccccggctttaaaggggaaagcggacttcctggacagttgggcccacctggcaagaggggaactgaaggtcgaacaggactgcctggaaatcaaggcgaacccgggtcgaaggggcaacctggtgattcaggagaaatgggtttcccaggcatggctggtctattcgggccaaaaggaccgcccggggacatcggattcaagggcattcaaggcccaagagggccgcccgggcttatgggcaaggagggtatagtaggcccattggggatcttgggcccctccggcctgcccggtccaaaaggggacaaaggatcacgcggagactggggcctgcagggcccaagaggtccacctgggccccggggcaggcccgggccacctgtggaccccggaggtcctcgatatataccctgcctttttcttgctcagcagcaagatgatctgggggctgcattccagacttggatggacaccagcggcgcgctaagaccagagtcctattcatatccagatagactggtcttagaccagggcggagagatcttcaaaaccctccactacctgagcaacctaattcaaagcattaaaaccccactgggaaccaaagaaaaccccgcccgcgtctgtcgcgacttaatggactgtgagcagaaaatggttgacggaacctactgggtggatccaaaccttgggtgctcttccgacaccatcgaagtgtcatgtaattttacacatggaggccaaacatgtcttaaaccaattaccgcaagtaaagttgaatttgccatcagccgggtgcagatgaacttcctccatctattaagctccgaagttacacagcacattactatccactgcctgaacatgacagtgtggcaagaggggactggacagactcctgcgaaacaggcggtgaggttccgtgcctggaatgggcagatttttgaggcaggaggacaattccgcccagaagtgagcatggatggctgcaaagtgcaggatggccgctggcaccaaacgttattcaccttccgcacccaggacccacagcaactacctatcattagtgtcgacaatttacccccagctagctctggtaagcagtaccgcctggaggtcgggcccgcctgcttcctctag

SEQ ID NO: 4122 - DNA, 2145 bp, Artificial Sequence
  Description of Artificial Sequence: Synthetic coding sequence
ctgagctggaccaaggccggcagccccgccccccccggcgtgatcccttttcagagcggcttcatcttcactcaaagggcgagactgcaggctcctacaggaacagtcatcccagctgcacttggtaccgaacttgctctggtactttctctctgctcccaccgggtaaaccacgccttcctctttgcagtacggtctcaaaagcgcaagctgcagctcggactgcagtttttacccggtaagacagtggtgcacttgggaagcagacgctcagttgcttttgatctggatatgcacgacggaaggtggcaccatctcgccctagaattgcgggggcgaacagttacacttgttacagcttgcgggcagcgacgtgtgccggtgctacttccttttcaccgcgaccccgccctcgatcccggggggtcctttctgttcggcaaaatgaatccccacgctgttcagtttgaaggtgctctctgtcaatttagcatctatcccgtgacacaggtcgcccacaactactgtacacacttgcggaaacagtgcgggcaagcagatacatatcaaagtcccctgggtccactgtttagccaggacagtggaagaccttttacgttccagtccgacctggctttgctgggtctcgagaacttgaccaccgccacgcctgccttaggctcattgccagctggccggggcccaaggggaaccgtggcacccgcgacccccacaaagccccaaagaacgtcgccgactaacccgcaccagcatatggccgttggcggtcctgcacagactcccctgctcccagcaaagctgagtgctagcaatgccctggacccgatgctgcctgccagtgtgggcggtagcaccaggacacccaggcctgcggctgcacaaccatcgcaaaagatcactgcaaccaaaattcccaaaagtcttccaactaaaccttcggcaccgtctacaagcatcgtccctatcaagagccctcaccccacccaaaagactgccccctcaagctttaccaagagtgctctacctacccagaagcaagtaccacctacatcgaggccagtaccagcacgtgtcagccgcccggcagaaaagccaatccaacgcaacccaggcatgcctaggccccctccgccctctacacggccactgccacctactacgtcatcctccaagaagccaattccaactctggcacgaacagaagcaaagattacgagccacgcaagcaaacccgcctctgcccggactagcacacacaaacctcccccttttaccgcactgtcctcctcccccgcccctacccctggctcaacaagaagtacaaggccccccgcgacgatggtcccacctaccagcgggacaagtaccccgcggacggcaccggcggtgcctactccaggctcagccccaactggatcaaagaagcctattgggagcgaagccagtaagaaggcagggccgaaaagttccccccgcaagccagtgcccctcagaccaggcaaggcggcccgagacgtgcctctgtccgacctgacgacccgcccctccccacgtcagcctcagccctcacaacagactactccggcccttgtgcttgctcctgcacagtttctgtcttcaagcccccggcccacctctagtggctactctatctttcacctggctggatctacacccttcccgctcctgatgggcccgccggggccgaagggggactgtgggctcccaggcccccctgggctcccaggcctccccggaattcccggagcgagagggcccagaggccctcctggcccttatggaaacccagggttaccgggcccccccggggccaagggcgacatggggctccctgggctttcaggcaaccccggtcccccagggaggaagggtcttccagggcccgtgggtgaccccggccccaaaggttccagggggtacattggccttccaggtctctttggactccccggctcagacggggagaggggtttgcccggcgttcccgggaagcgcggaaagatgggcatgcccgtcctgctgccccagtcgagcgaggcccgtggaggaaactccatgccgtctgagggagccctggccggtaggcacgggagccatctgtag

SEQ ID NO: 4123 - DNA, 2142 bp, Artificial Sequence
  Description of Artificial Sequence: Synthetic coding sequence
atgtggaaccggtacttcgtgttctacctgctgctgctgagcgcctttacttcccagaccgtcagtggccagcgaaaaaaaggccccaagagtaatcttctggcgcggaagtctgacgtgcagggatcaatctgcttcatagacatagtgttcatagtggattccagcgagtcgagcaagattgctttgttcgataaacagaaagactttgtggattccctatccgataagattttccagctgactccaggccgatccctcgaatacgatataaaactcgcagccctgcagttttcaagttccgttcaaatagaccccccgttctcctcctggaaagatctgcagacctttaaacagaaggtgaaaagtatgaacctcatcggccaggggactttttcgtattacgctatatccaacgctactaggctgctgaaacgagaaggccggaaggacggagtgaaggttgtactgctcatgactgatggcatcgaccatccaaagaatcctgatgttcagtccatatcagaagatgcccggatctccggcatttccttcataacaatcgccctcagtaccgttgttaacgaggccaagctgagattaatttccggcgatagctctagcgaacccactttattgctctccgatcctaccctggtggataaaatccaggataggctagagatgttattcgagatccaatgtgaaagaaagatttgtgaatgtgaaaaaggcgacccaggagaccctggtccacccggaacacacgggaatcctggcataaaaggagaacgagggccaaagggcaatccaggcaacgcacaaaagggagaggccggggagcgtggtccaggaggtataccaggatacaagggtgataagggtgagcgtggagagtgcggcaaacccggaatcaagggggacaaaggttcacccgggccatatgggcctaagggccctagaggcatccagggaattacaggacctcctggagacccaggcccaaaagggttccaaggtaacaagggagaacccggtccccccggtccttacgggtcccctggggcgcccgggatcggccaacaaggcattaaaggggagagaggtcaagagggaaggcctggcgcgcccggacccatcggggtcggcgaacccggccagccaggccctcgagggcctgagggtgtcccaggcgagcggggactaccgggcgaaggttttcccggtccaaaaggagagaaaggctcggaaggacccactggccctcagggcctgcaggggttaagcattaagggagagaaaggagatatcgggcctgtggggccacagggcccgatgggcatccctgggattggaagccagggggagcagggtatccaggggcccatcggtccccccgggccacaaggcccagctggccagggcctccctgggtctaaaggggaagtcgggcagatgggcccaactggaccacgcggtcctgtgggcataggggtgcagggtccgaagggagagcctggcagtattggactccctggacagcccggtgtccccggggaagacggcgccgccggaaagaagggggaagcaggtcttcctggagcccgcggccctgagggccctcccggaaaggggcaacctggccccaagggggacgaaggcaagaagggaagtaaagggaatcagggtcagaggggtttaccagggcctgagggacccaaaggagaaccaggcataatggggccctttggtatgcctggcacctctattccaggccctcctggccccaagggtgacagagggggccctggcattcctggatttaaaggagaacccggcctgtcgattagaggccccaagggtgtacagggtccacgtggaccagtgggtgcacctggattgaagggggatggctaccccggagtaccagggcctcgcggcctgccaggcccgcctgggcctatgggcctgagaggggtcggtgacacaggcgctaagacactgaatacaagtcacgggctggaggaccctagctgcccagactgcagtttctgtcactttagcctggccgccgatatccagcccaaatggccagcacttctgcagctgatcccagctagtggaaccagacaggacgggtag

SEQ ID NO: 4124 - DNA, 3378 bp, Artificial Sequence
  Description of Artificial Sequence: Synthetic coding sequence
atgtggaaccggtacttcgtgttctacctgctgctgctgagcgcctttacgtcgcagacagtaagcggacagaggaagaaagggccaaagtccaaccttttagcacgcaaatctgatgtccaggggtcaatttgctttattgacatcgtgttcattgtggattcctcggaaagctccaagattgccctgtttgacaagcagaaggactttgttgattctctctcagacaaaatcttccagctcacacctggaagatcacttgaatacgacatcaagctagcggcattgcagtttagtagcagcgtgcaaattgatcctccgttctcaagttggaaggacctacaaacattcaagcagaaagtgaaaagcatgaatcttatcggccaaggaacattcagttactatgccatttcgaatgccacccggctcttgaagagggaggggcggaaggacggggtgaaggtggtgctgctaatgacagacggaatagaccacccaaaaaatcccgacgtgcagagtatctccgaagacgctcggatctctggaatcagcttcattactatcgcactctctactgtcgtgaatgaagcaaaactgaggttgatttcaggggacagtagttctgagcctaccctcctgctgtcagacccaacactggtagacaaaattcaggataggctagatatactgtttgaaaagaagtgcgaacggaaaatatgtgagtgcgaaaagggcgacccaggtgacccaggaccccctgggacgcacggaaatcctgggatcaaaggcgaaagaggacctaaaggcaatcccggcaatgctcagaaaggagaggccggcgagcgtggacccggtgggatcccgggctataaaggcgacaagggagagcgtggcgagtgtgggaagccggggataaagggggataagggttctcccgggccttatgggccgaagggaccacggggtattcaggggattacagggccacctggggatccaggaccgaaaggctttcagggaaacaagggagagccaggccctccagggccgtacgggagtccaggagcccccggtatcggccaacaaggaataaaaggcgaacgggggcaagagggacgtccaggcgcgcccggtcccatcggggttggagagcccggccagccaggccctcgcggccctgaaggagtccctggcgagagaggcttacctggcgagggattccctggaccaaagggagaaaaaggctccgagggacccaccggaccccagggactgcagggtctgagtatcaagggtgagaagggggatattggaccagtgggtcctcagggccctatgggtatcccaggcatcgggtctcaaggagagcagggcattcagggtcctatcggtcctccaggaccccaaggtcccgcagggcagggtctgccaggaagcaagggggaggtcggccagatggggcccaccggtccccgcggaccggtggggattggagtgcaggggcccaaaggcgaaccggggtctataggacttcccggacagcctggcgtcccaggagaagatggcgcggctggaaagaagggcgaagctgggctgccaggcgctagagggcccgagggtcctccgggaaagggccaaccaggccctaagggggatgaaggaaaaaaaggatcaaaaggcaaccaaggacagcgtggacttcctggaccagaaggaccaaagggtgagccagggattatgggcccatttgggatgcccggcaccagtatcccagggccacccgggccaaaaggcgacagaggcgggcctggtatccctggattcaaaggcgaacctggcctaagcattagaggccctaaaggagtccagggcccccgcggcccagtgggcgcacctggattaaagggggacggataccccggagtgcccggccctcggggactgcccggtccccctggacctatgggcctgcgtggtgtgggtgatacaggagctaagggagagcctggagtcaggggtccccccggccctagtggcccgagaggagttggcacacagggacctaagggggacaccggccagaaggggttgccaggtcccccaggcccacccgggtacggatctcaagggattaagggcgagcagggccctcagggtttccctggacccaagggaacgatgggacatggcttacctgggcaaaaaggggagcacggcgagcgaggagatgttgggaaaaagggggataagggagaaataggcgaacccggttcccctgggaagcaagggttgcaaggacccaagggtgaccttggacttaccaaagaagaaataattaagctcatcacagagatttgcggttgtggccctaaatgcaaggaaacaccactggagctcgtttttgtaattgattcttctgaaagtgtgggccctgagaatttccagatcattaagaactttgtgaaaaccatggctgaccgagttgcactggatctggcgacggcgagaattgggattataaactactcgcataaagttgaaaaagttgccaacctgaaacagtttagctccaaggacgatttcaaactggctgtcgataacatgcagtacctgggcgagggcacctacactgccactgccctgcaggcggctaatgatatgttcgaagatgcgaggcccggggtgaaaaaggtggcattggtaatcactgacggccagaccgattcacgggacaaagagaaactcacagaagtggttaaaaacgcgagtgacacgaatgtcgagatctttgtgatcggagtcgtaaaaaagaatgacccgaattttgagatttttcacaaagagatgaacctaatagcaaccgacccagagcatgtatatcagttcgacgatttcttcaccttgcaggacacccttaaacagaagttgttccaaaagatatgtgaggactttgattcttatctggtccaaatctttgggtcctcatccccccagccggggtttggaatgtctggagaggagctctcagagtccacacctgagcctcagaaagaaataagcgagtccttgagcgttactagggatcaggatgaggacgataaagctccagaaccaacttgggccgatgatctaccagctaccaccagcagcgaagcgaccactactcccaggccactcttgagcacgccagtggatggcgccgaagacccgaggtgcctagaggccctgaaacctggcaactgtggcgaatacgtcgtgcggtggtattatgacaagcaggtgaattcttgcgcacgtttttggttcagtggatgtaatggctcaggaaatagatttaactccgaaaaagaatgtcaggagacctgtatccagggctag

SEQ ID NO: 4125 - DNA, 1005 bp, Artificial Sequence
  Description of Artificial Sequence: Synthetic coding sequence
atgtggaaccggtacttcgtgttctacctgctgctgctgagcgccttcaccagccagactgtctcgggccagcgcaagaaaggaccaaagtcgaacttgcttgccaggaaaagcgacgttcagggctctatttgttttatcgacatagtgtttatcgtggacagtagcgagtcttccaaaattgcactttttgataagcaaaaagattttgtggatagtctatccgataagatatttcagctcactccaggaaggtctttagagtacgacattaagcttgctgccttacagttcagcagttctgttcagatagatccccctttctcaagctggaaagacctgcagactttcaaacaaaaggttaagagtatgaatctgattggccaaggaacgtttagttactacgcaattagtaacgctacacgactcttaaagagggaaggccgcaaggatggggtaaaggtagtccttctgatgactgacggaattgatcaccctaaaaatcccgacgtgcagtctataagtgaggacgcacgtatctccggcatctcttttattactattgcgctgtcaactgtcgttaacgaggcgaaacttagactgatctctggagatagtagttccgaacccactttactcttgagcgacccaacccttgtggataagatacaagatcgcctggaaatgctgttcgagatacagtgtgaacgaaagatttgtgagtgtgaaaaaggtgatcccggggaccccggccctcctgggacacacgggaatccaggaattaaaggcgaacgaggccctaaagggaaccctggtaacgcacaaaaaggagaggctggcgaaagaggccccggcggtatacctggctacaagggagacaaacagtacagtcgagaggatcgcgaagtggaacacaataacgagaagtatgtagcatgcttgctgccctcgccagcactgctgcagcaatctagcttgactcaccacggaacttgtagccactag

SEQ ID NO: 4126 - DNA, 243 bp, Artificial Sequence
  Description of Artificial Sequence: Synthetic coding sequence
gccaccaccagcagcgaggccaccaccaccccccggcccctgctgtctacgcctgttgacggcgccgaagacccccgatgtttggaggctttaaaacctggaaattgcggcgaatatgttgttaggtggtactacgacaagcaagtcaacagctgtgccaggttttggttctctggatgcaacgggagcgggaatagattcaacagcgagaaggagtgccaggagacctgtatccagggatag

SEQ ID NO: 4127 - DNA, 1587 bp, Artificial Sequence
  Description of Artificial Sequence: Synthetic coding sequence
atgggcagcagccgggccccctggatgggccgggtgggcggccacggtatgcttgccctcctcctggctggacttctgctgccgggtacacttgccaagtccatcgggaccttcagtgatccatgtaaagacccaactcggatcacaagcccaaatgacccctgtctgacaggcaaaggagactcctctggtttttcatcctacagcggttccagctcatcaggctcatccatctcttccgctcgaagctccggtggcgggagctcaggctccagcagtggctccagcatcgctcagggggggtcagctggcagttttaagcctgggaccggatactcacaggtgtcatactcatccgggtctggaagtagcctgcagggcgcttccgggtctagccaattaggcagctcttctagccattcgggatccagcggatcacattcaggaagctcttcgcactcaagctcttcttctagctttcagttcagcagttcctcattccaggtcggcaatggctctgcattgccaaccaatgataactcctaccgggggatcctgaatccctctcagcctggccagagcagctcctcttctcagacatttggagtaagctcaagtggccaatcagtgtcctcaaatcagagaccctgtagctccgatattcccgactctccatgcagcggcggcccaatcgtgtcgcacagtggcccctacatcccttcgtctcacagtgtgagcgggggtcagcgcccggttgttgtggttgtggaccaacacggttctggagctccaggtgtcgtacaggggcccccatgttccaacggagggctacccggtaaaccatgtccacccattacaagcgtcgacaaatcctatggagggtacgaagtggtggggggttcaagtgactcatatcttgtgcccggcatgacctactctaagggtaagatttatccagtgggatatttcaccaaggaaaatccggtgaaaggatctcctggcgtgccctcgttcgccgccggtcctcctataagtgagggcaaatacttcagctctaatcctatcattcccagccagagcgctgcctcttctgcgatcgcatttcagccagtagggactgggggcgtgcagctgtgcggaggcggtagtaccggaagcaagggaccgtgctctccttcctcttccagagtgccttcttcatctagtatttccagctcatctggtctgccgtaccacccttgcggctccgccagtcagtcaccttgtagcccacccggcacgggctcatttagttcctcttccagcagtcagtccagcggcaagattatcctgcagccctgcggaagtaaatcctcgagcagcggccacccttgtatgtccgttagttcactgaccctgaccggtgggccagatgggtcaccgcatccagatccaagtgcgggcgccaaaccctgtggatcaagctccgccggaaaaattccatgcagaagcatacgggatatcctggctcaagtaaaaccactaggcccccagctggcggaccccgaggtgtttttgccccaaggcgagctgttagactctccgtag

SEQ ID NO: 4128 - DNA, 1590 bp, Artificial Sequence
  Description of Artificial Sequence: Synthetic coding sequence
atgggcagcagccgggccccctggatgggccgggtgggcggccacggaatgatggctctactactggcggggctcttgctccctggcactctggccaagagtatcggaaccttttccgatccatgcaaggaccctactcggataacctctccaaatgacccttgtctaactgggaagggggattcatcaggtttttcttcctattccggatcatcatccagcggaagctcaatcagttccgccagatccagcggaggtggaagcagtgggagttcatccggcagctccattgcacagggtggatccgcgggctcatttaagcccgggaccggttattctcaggtgtcctactcatccggaagcgggtcatccttacaaggagccagtggtagtagtcagttgggttcttcttctagtcacagtggtaattccggatctcatagtggcagttcctcttcacattccagctcttcatcatctttccagttctccagttcctctttccaagtggggaacggttcggcgctgccaaccaacgacaacagctaccgtggaattcttaacccgagccagccagggcagtcttccagctcctctcaaacttttggagtgagttcgagtggccaaagcgtgagtagcaaccagcgtccctgctccagtgacatcccagatagcccatgttcaggcggccccatagtttcacattccggcccatatatcccatccagccattcagtttcaggagggcagcgccctgtggtagtggtggtggaccagcacggctccggcgcaccaggagttgtccaaggacctccttgcagcaatgggggcctgcccgggaagccctgcccgcccattacatcggttgacaagagctacggtgggtatgaggtggttggcggcagcagcgatagttatctagtgcccggcatgacctatagcaaaggtaaaatctaccctgttgggtacttcaccaaagagaaccccgtaaagggctctcctggcgtaccgagcttcgcagcaggtccccctatcagcgaaggcaagtacttcagctctaatccaatcatcccttctcaaagcgcagcctcttcagccatcgccttccagcccgtcggcactggaggagtccagctctgtggaggcgggtctaccggcagcaagggcccctgctcccctagttccagtagggttccgagctcttcaagcatcagtagcagttccggcttgccttatcacccctgtggctcagcaagccagagcccttgctcccctccggggactggttcttttagtagttcctcctcatcacagagcagcggcaagatcatcctgcaaccttgtggctctaagtcatcttctagcggacatccttgtatgtctgtatcatccctaactctgacaggaggccccgacgggtctccacaccctgacccctctgctggcgccaaaccgtgcgggagctcttcagcaggaaaaatcccatgtcggtctataagagatattctggcccaggtcaagcctttgggacctcagctcgccgaccccgaggtgtttctaccccagggggagctgctgaatagcccatag

SEQ ID NO: 4129 - DNA, 1590 bp, Artificial Sequence
  Description of Artificial Sequence: Synthetic coding sequence
atgggcagcagccgggccccctggatgggccgggtgggcggccacggaatgatggcccttctgttggctggactgttgctgcccggaacactggctaaatccatcgggactttttccgatccctgcaaggatcctacacgaatcacctctcccaatgacccttgcctgactggcaagggagactcctccgggttctccagctacagtggttcttcatcaagcggatccagcatttcttccgcccgaagctcaggcggcgggtcctctggatcctcaagcggctcctccatagcccagggaggctcggccggatcctttaaaccagggacggggtattctcaggtgtcctatagcagcggatccggatcatctttacagggcgcgtccggcagcagccagctcggtagctcatcttcccacagcgggtccagcggcagccactccggcagcagcagttcccacagttcttcctctagtagtttccagttctcttcgagctcgtttcaggtggggaacggtagtgcattacccaccaatgacaattcctatcggggcatactgaatccatcacagcccggacaaagcagcagttcctcccagacatttggggtttcttccagcggtcagtccgtgagctcgaatcagcggccctgttcttcagacattccagattcaccctgttccggtggccccattgttagccacagtggcccatatatcccatccagccattcagtgtctggcggacagcgaccagtggtggttgtggttgaccagcatggttccggagcgccaggcgtcgtgcaaggaccaccctgttccaacggtggcctcccagggaagccatgtcccccaatcacaagcgtggacaaatcatacggcggctatgaagttgtcggaggcagttccgacagctatctagttcctggcatgacgtatagtaaaggcaagatatatcccgtcggctattttactaaagaaaatcctgtgaaaggaagccctggggtgccttctttcgcggcggggccccccatttccgaagggaagtatttctcaagcaacccaatcataccaagccagtcagccgctagctctgccatcgcttttcagcccgtcgggacagggggagtgcagctttgtggtgggggcagcactgggagtaaaggaccctgcagtccctcctcctccagggtaccaagttcatcatcaatatcttcttctgccgggtctccctaccacccctgcggtagcgcctcccagagcccatgtagtccgcctggaacaggctccttctcttcatcctcttcaagtcaaagttcaggcaagatcatcttgcagccctgcggatctaaatccagtagctctgggcacccatgcatgagtgtgtcaagtctcaccctgacaggcggcccagacggctcgcctcatcctgacccaagcgccggcgcgaagccctgtgggtccagttctgctggcaagatcccgtgtaggtctattagagacatcctggcacaggtaaagcctcttggcccgcaactcgccgatcccgaggtgttcctaccacagggcgagctgttggatagcccttag

SEQ ID NO: 4130 - DNA, 1590 bp, Artificial Sequence
  Description of Artificial Sequence: Synthetic coding sequence
atgggcagcagccgggccccctggatgggccgggtgggcggccacggtatgatggccttgttactagcaggactgctgttgcccggaactttggctaaatctatcggcactttcagtgacccttgcaaggatccaacaagaattacctcccctaatgacccttgcctcaccggcaaaggggattcaagtggctttagctcttatagcggcagctctagctccggatcatctattagctccgctagatccagcggcggcggcagcagcgggtccagttcaggtagctctattgcccagggaggctccgctggatccttcaaacctggaacagggtacagccaggtgagttacagtagtggcagtggaagctccttacagggcgcgtcagggtcatctcaactgggctccagtagctctcactcaggatctagcggaagccactccgggtcttcctcatcacacagctccagtagttcctcattccaattcagtagttccagtttccaggttggcaacgggtccgccttacctaccaacgataatagttatcgcggtatcctgaaccctagccagcccgggcagtcatcatctagcagccagacatttggggtgtccagctcaggacagtctgtctcttcaaatcagcgtccctgctcttcagacatccccgactccccttgtagcggcggccccattgtgagtcactcaggcccgtacatcccttcctcccatagtgtgagtgggggacagcgccctgtcgtggtcgtagttgaccagcacgggagcggtgctccaggagtggttcaaggtcctccttgtagcaatggcgggctgcccggcaaaccttgtcctcctattacctcagttgacaaatcctacggaggatatgaagtcgtgggagggtcaagcgattcttatctggtacccggtatgacttacagcaaggggaagatataccccgtgggttactttactaaggagaatcctgtgaaaggctcccccggagtgccatcgttcgccgctggcccgccaattagcgaggggaaatacttcagctctaaccctataattccttcgcaaagcgcagcgtcgtcagcaatagcttttcagcccgtgggtaccggcggggttcagctgtgtggcggcggtagcaccggatcgaaaggcccctgtagcccctcttcttcccgagttccttccagcagcagcatcagttctagtagtgggagtccctaccatccatgtggctccgctagccagtcaccatgttccccaccaggtactgggtctttcagttcatccagcagtagccagagttccggcaagatcatcttacagccgtgcggctcaaagtcatcgtcctcgggccacccctgcatgagcgtgagcagtctcactttaactggaggaccagacgggagcccccacccggacccatctgcaggagctaagccgtgcgggagctctagtgcaggtaagatcccgtgtcggtctatacgtgacatcctggcccaggtgaaacctctcgggcctcagctggccgatcccgaggtgtttcttccccaaggggaactgcttgattccccttag

SEQ ID NO: 4131 - DNA, 1590 bp, Artificial Sequence
  Description of Artificial Sequence: Synthetic coding sequence
atgggcagcagccgggccccctggatgggccgggtgggcggccacggaatgatggccctactcctggcaggactgctgttgcccggaaccttggctaaaagcattggcacctttagcgatccatgtaaagacccaacccgaatcacatctccgaatgacccgtgcttgactggaaagggggactcaagcgggttctcaagttactctgggtcaagtagcagtgggagcagcatctcctcagcaagatcatcaggcggggggagctccgggagttcttccggctcctctatcgcacagggtggcagcgctggcagtttcaagcccgggacgggatattcccaggtctcttactcctccggttctggcagctcactacagggggcctccggctcttcgcaattgggatcctcctcgagtcactccggcagcagcggcagccactccggaagcagttctagtcattcctcatcttcctcttccttccaattcagctccagcagcttccaggtgggaaacggaagtgctctgccgacgaatgacaactcctaccgggggatcctgaatcctagccaaccagggcagtcttccagctctagtcagacaagcggcgtgtcatcttcgggtcagagtgttagtagcaatcagcggccatgtagcagtgatattccagacagcccctgttcgggtggtcctatagtttcccatagcggaccttacataccaagcagccacagcgtctctgggggacagcggcctgtcgtagttgtggtcgatcagcacggatccggggctccaggcgttgtgcagggacctccctgttcaaatgggggcttgccgggaaaaccctgtccaccaattacatcagtggataagtcgtatggcggttacgaggtcgtcggcggatcaagcgattcttacctggtgcccggcatgacgtactccaagggcaagatatacccagttgggtacttcaccaaggaaaatcccgttaagggatcgccaggcgtgccatcgtttgctgctgggcctccaatatcggagggaaaatactttagctcaaatccgataattcctagccagagcgcggcatccagcgctatcgcattccagcctgtcggcacagggggggtgcagctatgcggcggaggctcaaccggctccaaggggccttgtagcccgagttctagcagagttccatcctcttcgtctatctctagcagcagcggctccccttatcacccttgcggtagcgcctctcagtcaccttgctcgcccccaggaaccggctctttcagtagcagttctagctcacaatcaagcggcaagatcatcctgcagccctgtggaagcaagtctagctccagcggacatccttgtatgtcggtatctagtctcaccctaacgggcgggccagatggcagccctcaccccgatcccagcgccggcgcgaaaccttgtggaagtagtagcgccggtaaaattccctgtcggagcatacgggacattcttgcacaggtcaagccactcggtccccaactcgccgatcccgaggtgttccttccccagggcgagctcctggacagtccttag

SEQ ID NO: 4132 - DNA, 1590 bp, Artificial Sequence
  Description of Artificial Sequence: Synthetic coding sequence
atgggcagcagccgggccccctggatgggccgggtgggcggccacggaatgatggccttactcctcgcaggccttcttttgcccggaaccttggccaaatctattggcacatttagcgatccatgcaaagatcccacaaggattactagcccaaacgatccctgtctcaccggtaaaggggattcctcgggtttttcaagctatagtggcagcagttcgtcaggtagctcgatctcatctgctcggagttccggagggggaagtagcggttctagcagcggatccagcatagcccagggagggtcagcaggctcgttcaaaccaggtactggctactcccaagtgagttacagctcaggatccgggagtagtttacagggagcttcgggatcctctcagctcggcagttcatcatcccattccggctccagtggcagccactctggttcatctagtagccattcaagcagttcttcttccttccagttctcatccagttcctttcaggtgggaaacgggagcgctcttcccactaacgataactcttatcgcggtatcttaaatccttcacagcctggacagagtagcagcagtagccaaaccagcggagtttcatcctccgggcagtctgtcagctccaatcagaggccctgttcaagcgacattcccgattctccatgctcgggagggccgatcgtgtcccactctggcccttacataccctcatcacattctgtgtccggcggacagcgaccagtggttgttgttgtcgaccagcatggttctggcgcccccggagtcgtacagggtcctccctgcagcaacggaggcctccctggaaagccatgtcctcctattactagcgtcgacaaaagctatggaggctatgaggtggtcggtggcagcagcgattcctatttggtccccggaatgacttattcaaaggggaagatttacccagtaggctattttacgaaagagaacccagtgaagggatcacctggagtcccctccttcgcggctggaccccccatcagcgaggggaaatactttagttctaaccccattatcccatcacagtctgctgcttcctcagccatcgctttccaaccggtaggcaccggtggcgtgcagctatgcggtggagggtcaactggctcaaagggcccgtgctctccctcatccagcagagtgccgagctcctcaagcatcagctcgtcaagcgggagtccctaccacccttgcggctcagcaagccagtctccctgcagtccacctggcactgggagtttctcatcgagttcctcatcccaaagtagtggcaagatcatactccaaccatgtgggtcgaaatcgtcctcatccgggcatccctgcatgagcgtttcctctctgacgttgacaggtggccccgacgggtcgcctcacccagaccctagcgcaggagccaaaccctgcggcagttcctctgccggaaagatcccctgtcgctcgattagagatatcttggcccaagtgaagccgttaggcccacagttggccgaccccgaggtgtttttaccgcaaggggagctgctggattccccttag

SEQ ID NO: 4133 - DNA, 255 bp, Artificial Sequence
  Description of Artificial Sequence: Synthetic coding sequence
gtgctgcacagcttcaccgacgccatcttcgacgagtggatgaagcggtttaaccctcccgctgacgcttggccgcaggagctggctcctattggccataaccgcatgtacaatatggtacccttcttcccacccgtgacaaacgaagagctgttcctcacatctgatcagcttggatattcttacgccattgatctccccgacttccaagctaatttcatatgttcttacctcgtatctgtccaccaggaatag

SEQ ID NO: 4134 - DNA, 1560 bp, Artificial Sequence
  Description of Artificial Sequence: Synthetic coding sequence
atgagccccctgtggtggggcttcctgctgagctgcctgggctgcaagatcctacctggtgcgcaaggccagttccctcgagtgtgtatgaccgtggattctctggtaaataaggaatgctgtccgaggctcggggcggagagtgctaatgtatgtggatcccagcagggccgtggtcagtgcaccgaggtccgagcggataccagaccatggtctgggccgtacattctcaggaaccaggacgacagagagctctggcccaggaagttcttccatcggacttgcaagtgcacaggcaatttcgccggctacaactgtggcgattgtaagttcggctggaccggacctaactgcgagagaaagaaaccccctgtgattcggcagaacatccatagcctttctccccaggagcgtgagcagttccttggggcacttgacctcgccaagaaaagggtgcatccagactatgtcattacaacccagcactggctcggcttgcttggaccaaatgggacccagccccaatttgcgaactgctctgtttacgatttcttcgtttggcttcactattactctgtcagggatacccttctgggccctggaaggccctacagggcaatcgacttttcgcaccagggacctgcgtttgtgacctggcacaggtatcatctcctgtgcctcgagagggacttgcagcggctaatcgggaacgagtcttttgctctcccttattggaattttgccactgggcgtaatgaatgcgacgtatgcacggatcagctgtttggcgcggctcgacccgatgatccgacactcatttctagaaactcaagatttagctcatgggaaactgtctgtgacagcctcgacgactacaaccacctcgtgaccttgtgtaatggtacatacgagggcctactgcggcgcaaccagatgggaagaaatagtatgaaattgcccactctgaaggatattcgtgactgcctgtccctgcagaaattcgacaatccgccttttttccaaaactcaaccttcagctttaggaatgctctggaaggtttcgataaagccgatggtacattggattcccaggtgatgtcacttcacaacctggtccacagctttctgaacggcactaacgccttaccccattctgcagccaacgaccctattttcgtggttctacacagcttcacagacgctatttttgacgagtggatgaagcggttcaatcctcccgccgatgcttggccacaagaactggcacccattggccacaatcgcatgtataacatggtacctttctttccccctgtgacgaacgaggagctctttctgacttcagaccagttgggatactcttatgctattgacctcccagtgagtgttgaggagacgcctggctggccaaccactctcttggtagtcatggggaccctggtcgccctagtgggactgtttgtgctcctggcatttctgcagtatcgaaggctccggaagggctatacacctctcatggagactcacctgtcctccaagcgatacactgaggaagcgtag

SEQ ID NO: 4135 - DNA, 1659 bp, Artificial Sequence
  Description of Artificial Sequence: Synthetic coding sequence
atgagccccctgtggtggggcttcctgctgagctgcctgggctgcaaaatcctcccgggagcgcagggacagtttcctagggtctgcatgacggttgactccctcgttaataaggagtgctgccctcggttgggtgctgagagcgctaatgtgtgcgggagtcagcaaggccgcgggcagtgtactgaggtacgcgcggacactcgcccctggtccggtccatatattcttcgcaaccaagacgaccgcgagctgtggcctaggaaattctttcacagaacttgcaagtgtactggtaactttgcaggctacaactgcggagactgtaagttcggctggactggcccaaactgtgaacggaaaaagcccccagttataagacagaatattcattccttgagccctcaagaacgggaacagtttctcggagcccttgacctggccaaaaagagggtgcatcctgactacgtcattactacacagcactggctgggccttttgggcccaaacggtactcagcctcagtttgcaaactgtagtgtgtacgatttcttcgtgtggctgcattactattcagtgcgcgatacactcctgggaccaggacgcccctaccgggcaattgatttcagccatcagggccctgctttcgtgacctggcaccgctaccacctgctgtgccttgaaagagaccttcagcgactaattggtaatgagagtttcgccctcccatattggaacttcgctacaggaaggaacgaatgcgatgtctgcacagatcagttgttcggtgcagctaggccagacgatcccactctgatttcaaggaacagtaggttctcatcctgggagaccgtgtgtgatagtcttgacgattataatcatctggtcactctgtgtaatggaacatatgaggggctgctgcggaggaatcaaatgggcaggaacagtatgaaactgcccacattgaaagatatcagagactgtctgtcattacagaagtttgacaaccctccatttttccagaattcaactttttccttccgaaatgctttggagggatttgacaaagctgacggcacgctggatagccaggtaatgtctcttcacaatctggtgcacagcttcctcaacggtacaaacgccctgcctcactccgcagcgaatgaccccatcttcgtggtcatctccaataggctcctgtataacgcaaccacaaatatcctggagcacgttcgcaaagagaaggcaaccaaagaactgcccagtttacacgtgctcgtgctgcactcgtttactgatgcgatcttcgatgagtggatgaagaggttcaatccgcccgctgacgcctggccgcaggagctggctcctattggccacaaccggatgtacaacatggtcccgttttttcctccagtaacgaacgaagagctgtttttgacatcggatcagctcgggtattcatatgcaatcgacctcccagtttcagtggaggagaccccgggctggccgaccacacttctggtcgtgatgggtaccttggtggcactggtgggcctctttgtgctgttagcatttctacagtataggagactgcgcaagggctatacccctttaatggagacgcacctatccagcaagcggtacaccgaagaggcatag

SEQ ID NO: 4136 - DNA, 1347 bp, Artificial Sequence
  Description of Artificial Sequence: Synthetic coding sequence
atggcccacgtgggcgactgcacccagaccccctggctgcccgtgcttgtcgtgtctctaatgtgctctgcgagggctgagtatagcaactgcggagagaatgagtactataaccagactaccgggctctgccaggagtgccccccttgtgggccaggagaagagccctatctttcttgcggctatggaactaaggacgaagactacggctgcgttccttgtcctgcagagaagtttagtaaaggcgggtaccagatttgcaggaggcacaaagactgtgaaggttttttcagggctacagtgctcacacctggagatatggaaaatgacgctgaatgtggcccttgtctgccgggctactacatgcttgagaatcgacctcggaacatatacggaatggtatgttatagctgccttctcgccccacctaacactaaagaatgcgtcggcgcgacctccggcgcaagtgccaattttcccggcacatcgggtagttctaccctgtcgccgttccaacatgcccacaaagagcttagcgggcagggccatctcgcaacagccctgataattgccatgagcaccatcttcataatggcaatcgcaatcgtgctgatcatcatgttttacatactgaaaactaagccctctgccccagcctgctgcacatctcacccgggcaaatcagttgaagctcaggtttcgaaagacgaggagaaaaaagaggcacctgataatgttgtgatgtttagcgagaaggacgagtttgagaaattgactgccactcccgctaagcctaccaaaagcgagaatgacgcaagcagtgagaatgagcaactgttaagccggtcagtggatagcgacgaagaaccagccccggataagcagggctcccctgagctctgcctgctgagcctggtccatctcgcgagagaaaaatctgccactagtaacaagtcagcaggtattcagtctcgacggaagaagatcttggatgtttacgctaacgtgtgtggcgtcgtcgagggcctgtcaccgactgaactgccgtttgactgtcttgagaaaactagcagaatgctctccagcacttacaattctgaaaaggccgtagtaaaaacatggagacaccttgccgagtcctttggtctgaaaagagatgagataggcgggatgacagacggcatgcaactgttcgatcggattagcacagccggctactctatccccgaattgctgaccaaactggtacagatagaacgccttgacgcagtggagagcctctgtgctgacattcttgagtgggccggtgtggtgcctccagcctcacagcctcacgctgcatcttag

SEQ ID NO: 4137 - DNA, 1443 bp, Artificial Sequence
  Description of Artificial Sequence: Synthetic coding sequence
atggcccacgtgggcgactgcacccagaccccctggctgcccgtgttggtagtgtcactgatgtgcagcgcccgagctgaatatagcaattgtggggaaaatgaatattataatcagactaccgggctgtgccaggaatgcccaccatgtgggcctggcgaggagccatatctctcatgcggttacggcaccaaagacgaggattatggttgtgtgccttgtcctgctgagaaattcagtaaaggcggctaccaaatttgtagacgccacaaggactgcgaaggctttttccgggccaccgttctcacccctggcgacatggagaatgatgcggagtgtggtccctgcttacccggatattatatgctggagaacaggcccagaaacatttacggtatggtgtgctactcttgtttgctggctccacccaataccaaagaatgcgtgggcgctacaagtggggcatcagccaacttccccgggacttcagggtcaagtactttgagccctttccagcacgcgcataaggagctttcaggccagggccacctggctaccgcccttatcattgccatgagcacgatctttattatggccattgctatagtactaataattatgttttatattcttaaaacaaagcctagcgccccaggggacgggccacatgccccagtcccttgcttcttagattccccatccactccacccgttggagaaccgggctgtagcctcccgccgctctcaccagcctgttgcactagccatcctggaaaatccgtcgaggcccaggtcagtaaggacgaggaaaagaaagaggccccagacaacgtagtcatgttctcagagaaggatgagttcgagaagctgaccgctactccagccaagcccacgaagtcagagaacgatgcctcttctgaaaacgagcagcttctgagccgcagcgttgatagtgacgaggagccagctccagataaacagggatcaccggaattatgccttctttccctggtgcacctggctcgggaaaagtccgctacgagtaataaaagcgctggcatacagagcagaagaaagaaaatactggacgtgtacgcaaacgtttgtggcgtggtcgaaggtctcagtccaacagagttgccattcgattgtcttgagaagactagccggatgctgtcttcaacgtataactcggagaaagccgtcgttaagacatggagacacctggctgagtctttcggactcaagcgagacgagattgggggcatgaccgacggcatgcagctgtttgaccgcatttccacggctggatactccatacctgaactgctgactaagctggttcagatcgaaaggttagatgccgtggaatctctgtgtgctgatatcctggagtgggccggagtagtaccacctgcttcgcaaccccacgctgcttcatag

SEQ ID NO: 4138 - DNA, 1443 bp, Artificial Sequence
  Description of Artificial Sequence: Synthetic coding sequence
atggcccacgtgggcgactgcacccagaccccctggctgcccgtgcttgtggtgagtctgatgtgctcggctagagccgaatatagcaactgtggcgaaaacgagtactacaaccaaactactggattgtgccaagagtgcccaccctgcggtcccggtgaggagccttatctcagttgcggatacggcaccaaggatgaagactacgggtgtgtcccttgcccagctgagaagttcagtaaagggggctaccagatttgccgccggcacaaagactgtgagggattcttccgcgccacagtcctgacgccgggcgacatggaaaatgacgctgaatgcggaccctgtctgccagggtactacatgttagagaaccggccccggaacatttatggcatggtgtgctacagctgtctgctcgctcctccaaatacaaaagagtgtgttggcgcaactagcggcgcttccgccaattttcctggtactagcggcagcagcacgcttagtccctttcagcacgcacataaggaactgtcgggacaggggcaccttgcgacagccttgatcattgcaatgagcaccatttttatcatggcaatcgctatagtgctaatcatcatgttttacatcttgaaaacgaagcccagcgcccccggtgacggccctcatgcccccgtaccatgcttcctggacagcccatccacccccccagtgggggaacccggttgttcactgccgcctttgtctccagcatgctgcacctcccatccgggtaagtctgtggaggcacaggtgtccaaggatgaggagaaaaaggaagcacccgacaatgtagtcatgttctctgagaaagacgagttcgagaagttgaccgcaaccccagctaaaccaacgaaatcggaaaacgacgccagcagcgagaatgaacagctgttgagccggtctgtcgatagtgatgaagagccagccccagacaagcaaggttcaccagagttatgcctgctgagtttggtgcaccttgcaagggagaagtcagccacttccaataaaagtgctggaatacaatcccggcggaagaagattctggacgtttatgcaaatgtgtgcggcgtcgtggagggcctgagcccgaccgagttgcctttcgactgtctggagaagacaagcagaatgctttctagtacatataactccgagaaagctgttgtgaagacatggcgtcacttggctgagtcctttgggctgaagcgggatgagataggagggatgaccgacggtatgcagctgttcgaccggatctccacagcggggtacagcattcccgagctccttaccaagttagtccagatcgagcggttagacgctgtagagagtctctgtgctgatatcttggagtgggccggtgtggtccctcccgcaagtcagccgcacgcagcctcttag

SEQ ID NO: 4139 - DNA, 957 bp, Artificial Sequence
  Description of Artificial Sequence: Synthetic coding sequence
atggactgccaggagaacgagtactgggaccagtggggccggtgcgtgacttgccagcggtgtggcccgggccaggaattatctaaagattgtggttatggtgagggtggggacgcctattgcactgcctgtcctccccggcgatacaagagttcatggggtcaccacaggtgccagtcttgtattacctgtgccgtcataaaccgggtgcagaaggtaaactgtacagccacctctaatgccgtgtgtggggactgcctgcctagattctatagaaagacaagaatcgggggcttgcaagaccaagagtgcataccatgtacgaaacaaacccctacgtccgaagtgcagtgcgcctttcagctgtctttagtggaggccgataccccgacagtcccaccccaagaggctaccttggtggctctcgtctccagtcttctggtggtctttaccctagcatttttgggcctgttctttttatactgcaagcaattcttcaaccgtcactgccaaagggaaaagctgatcatcttttcagaccccgtccccgcttcactgaacctgatacctgaattcgcaggaggccttctgcagttcgaagctgataaaacagcaaaggaagaaagcctcttcccagtccctccttccaaggagaccagcgccgagtcacaggtgtctgagaatatctttcaaacccagccactcaacccaatcctcgaggatgattgcagttccacctccggattcccaactcaggagtcttttacaatggcctcgtgcacatccgaatcgcactcccactgggtgcatagtcccatcgagtgtacagaactagatctacagaaattttcatcaagtgcctcatataccggagccgaaaccctcggaggtaataccgttgaatccactggcgatcggctggaattgaacgtacccttcgaagtgccctccccttag

SEQ ID NO: 4140 - DNA, 894 bp, Artificial Sequence
  Description of Artificial Sequence: Synthetic coding sequence
atggactgccaggagaacgagtactgggaccagtggggccggtgcgtgacctgccagcgctgcgggccagggcaggaactgtctaaggattgcggctatggggagggcggcgatgcctactgcaccgcctgcccgcctaggcggtacaaaagcagttgggggcatcatcggtgccagtcttgtattacttgtgccgtgatcaatagggtccagaaggtcaattgtacggcgacaagcaacgccgtttgcggagactgtctaccccgtttctacagaaaaacccgtatcggagggttgcaggaccaggagtgcattccatgtaccaagcagactcctacttccgaggttcagtgcgccttccagctgtccctagttgaagctgatacacccacagtgcctccgcaagaggccactctagtggccctggtttcgagccttttggtggttttcaccctggcattcctggggctgtttttcctctactgcaaacagttctttaacaggcattgccagcggggggggctgctgcagttcgaggctgataagactgccaaggaagagagcctctttccggtgccgccatctaaggagacaagcgcagaaagccaagtctcagagaatatcttccagacacagccattgaatcccatccttgaggatgattgctcttccacctccggcttccccacgcaggagtccttcactatggcctcttgcacatcagaatctcactctcactgggtccatagcccaatcgagtgcaccgagctggatttacagaagttctcctcctcagccagctatacaggggctgagactctggggggcaataccgtagaatcaactggggataggctagaactcaacgtcccattcgaggttccctccccatag

SEQ ID NO: 4141 - DNA, 894 bp, Artificial Sequence
  Description of Artificial Sequence: Synthetic coding sequence
atggactgccaggagaacgagtactgggaccagtggggccggtgcgtgacatgccaacggtgtggcccgggtcaggaattgtctaaggactgcggatacggggaaggcggcgatgcctattgtactgcgtgtcctccaagaagatacaagtcctcctggggccatcacagatgccagagctgcatcacttgtgcagtgataaaccgcgttcagaaagtaaattgtaccgccacctccaacgcagtttgtggggactgtcttccaaggttttatcggaagacacgcattggggggcttcaagaccaggaatgcattccatgcacaaaacagacccccaccagtgaagttcaatgtgctttccagctctcactggtcgaggcagatacaccaacagtcccaccccaagaggctacccttgtcgccctggttagctctctcctggtggtttttacacttgcatttttgggcctgtttttcctctattgcaagcagttctttaaccgccactgtcagagggggggtttgcttcaatttgaggcggataagaccgctaaggaggagtccctattcccagttcccccctcgaaagaaactagtgcagaaagtcaggtctcagaaaacatcttccagacccagcctttgaaccccatcctcgaggatgactgctcctccacttccgggtttcctacgcaggagagctttacgatggcgagttgcacttctgaaagccactctcactgggtccacagtcccatagaatgcacagagcttgatcttcagaaattctcaagctctgcctcctataccggagcagaaaccctcgggggcaacactgtggagtctaccggcgatagactcgagctgaacgtgccatttgaagttccctccccgtag

SEQ ID NO: 4142 - DNA, 957 bp, Artificial Sequence
  Description of Artificial Sequence: Synthetic coding sequence
atggactgccaggagaacgagtactgggaccagtggggccggtgcgtcacctgccaacggtgtggcccagggcaggaactttctaaggactgtggctacggagaaggcggcgacgcctactgcacggcctgtcctcctcgccgctacaagagttcatggggacaccacaggtgccagtcctgcatcacctgtgcagtaattaaccgcgtgcaaaaagtaaactgcacagccacttcaaatgccgtttgcggggactgtctcccgaggttttaccgcaaaacccgcatcggcggtctgcaggatcaggagtgtatcccttgtacgaaacaaacccctacctctgaagtccagtgcgctttccagctgagtctagtagaggcagatacccctactgtccctccccaagaggccactctagtagccctggtatcgagtctcttagtggtttttacacttgcctttctgggcctgttttttctgtactgcaagcagtttttcaaccgccactgtcagcgggagaaattgattattttttcagacccggtgccagcttcattgaatttaattcctgagtttgcggggggactccttcagtttgaggccgataaaaccgccaaggaagaaagtcttttccccgtgcccccaagcaaggagaccagcgcggagagccaggtgtctgagaacatttttcaaactcaacctctgaatccaatattagaagacgattgcagttccacttccggctttcccacccaggagagcttcacgatggcgagttgcacaagcgagagtcattctcactgggtgcacagccctatcgagtgtaccgagttggatctccagaagttctccagcagtgcctcctacaccggagccgagaccctgggaggaaacaccgtggagagcacaggtgaccgtcttgaattgaacgtgccttttgaagtccctagcccgtag

SEQ ID NO: 4143 - DNA, 522 bp, Artificial Sequence
  Description of Artificial Sequence: Synthetic coding sequence
atgagcaccggcaccaacggcgacggcgtgagccccgccaacggcgtagtgctggaccgctcttacccccggtgcctgccagtggagctgtctggcgggcgctatacgcatagcgccccctccggcgggcatacctgctgcacaggcggtctgttgcagtttgaagccgacaaaacagcaaaggaggaaagccttttccccgtgcctcctagtaaggagacgtccgctgagtctcaggtgtctgaaaacatattccagactcagccgttaaacccaattctggaagacgactgctccagcacctccggattccccacacaagaaagtttcaccatggccagttgcacatccgagagtcatagccactgggttcactcccctattgaatgcaccgagctcgacctgcagaagttcagttcgtccgcaagttacactggggcagaaaccctgggtggtaacacagttgaaagcacaggagataggctagagctgaacgttcccttcgaggtaccatccccatag

SEQ ID NO: 4144 - DNA, 894 bp, Artificial Sequence
  Description of Artificial Sequence: Synthetic coding sequence
atggactgccaggagaacgagtactgggaccagtggggccggtgcgttacctgtcaaagatgtggacctggtcaggagctgagtaaggactgcggttatggtgagggaggcgatgcttactgtaccgcctgccctccccgaaggtataaatcaagctggggccaccaccggtgtcagtcttgtatcacctgcgccgtgatcaatagggtgcagaaagtcaactgcaccgctaccagcaacgccgtgtgtggcgactgcttacctaggttttatcggaaaacgaggataggcggcctccaggaccaagagtgcatcccatgcaccaagcagaccccaacatccgaggtgcagtgcgcatttcaactgtctcttgtcgaggctgacactcccaccgtgccaccacaggaggccacactcgttgccctcgtttcttctctgttggtagtgttcacccttgccttccttgggctgttcttcctgtattgtaaacagttcttcaatcgtcattgccagcggggcggcctgttgcaattcgaggctgataaaactgccaaggaggaaagtctcttccctgttccccctagcaaggaaacctcggcagagtcacaggtctctgagaatatctttcaaacgcagccactgaatccgatactggaggacgattgttcatccacttcaggatttccgacccaagaatcttttactatggcttcttgcacatccgagagtcatagccactgggtgcacagccctattgaatgcaccgaattagacctgcaaaagtttagcagttctgcctcttataccggggccgagacattggggggaaatactgtcgagtccactggcgatcgtctggagctgaatgtcccattcgaagtcccaagcccgtag

SEQ ID NO: 4145 - DNA, 648 bp, Artificial Sequence
  Description of Artificial Sequence: Synthetic coding sequence
atgggcctgcggaccaccaagcagatgggccggggcaccaaggcccctggacaccaggaagatcatatggtgaaggaacctgtggaggataccgatccgtcaacattatccttcaatatgagcgacaagtatcccattcaggatacggagctgccaaaagccgaggaatgcgacaccatcacactgaattgcccacggaacagcgacatgaagaatcagggagaggaaaatggcttccccgattctacaggagaccctctgcccgaaatctcaaaggataattcatgtaaagaaaactgcacctgcagttcttgcctgcttcgggcaccaacaataagcgacctgttgaatgaccaagacctgctggacgtgatcaggattaagctggatccttgccatcctactgttaaaaactggagaaactttgcctctaagtggggtatgagttacgacgagctgtgtttcctggagcagcgtccgcagagcccaacgctggaatttctccttcggaacagtcagagaaccgtaggccagctcatggaattgtgcaggctctatcaccgtgccgatgtggaaaaggtgctgcggcgctgggtcgatgaggagtggccaaagagagaacgcggcgatccaagtcgacacttctag

SEQ ID NO: 4146 - DNA, 618 bp, Artificial Sequence
  Description of Artificial Sequence: Synthetic coding sequence
atggccagccccgacgaccccctgcgggccgaccacatggtgaaggagcccgtggaggacaccgaccccagcacactgtcattcaacatgtccgataagtatccaatccaggacacggagttaccaaaagctgaagaatgtgataccattacgctgaactgccctcgcaattccgacatgaagaaccagggcgaggagaacgggttccctgactcaaccggagatccgctgcccgagatcagcaaagacaattcatgcaaggaaaattgcacctgctctagttgtctcttgagagctccaacaatcagtgacctgctgaacgaccaggacctgctcgacgtgatacgaataaagctggatccttgtcaccctacggtgaagaattggagaaattttgcttctaagtggggcatgagctacgacgaactgtgctttctggagcagaggccacagtctcccaccttggagttccttctccggaacagccagagaactgtggggcagctgatggaactttgccggctctaccaccgcgctgacgtcgagaaggtcctgcgccggtgggtggacgaagaatggcccaagagggagagaggggacccgtcacggcacttttag

SEQ ID NO: 4147 - DNA, 255 bp, Artificial Sequence
  Description of Artificial Sequence: Synthetic coding sequence
atggtgaaggagcccgtggaggacaccgaccccagcaccctgagctttaatatgagtgacaagtaccctattcaggacacagaactgcctaaggcggaggagtgcgacaccattaccctgaattgcccacgcaacagcgatatgaaaaaccagggagaggagaatgggtttccagatagcacaggggacccactgcctgagatctccaaggacaactcgtgcaaggagaactgcacttgctccagttgtctgtag

SEQ ID NO: 4148 - DNA, 2175 bp, Artificial Sequence
  Description of Artificial Sequence: Synthetic coding sequence
atggccggcctgaccgccgccgccccccggcccggcgtgctgctgctgctgttatccattctgcacccctccagacccgggggggtccccggagctatccctggcggagtgccaggcggcgtcttttaccccggggcaggccttggagcccttggcggaggggctctgggaccaggggggaagccactcaagcccgtacccggcgggctggcaggtgccgggctaggggcaggcctgggagcattccccgctgtgacctttcctggtgcccttgttccaggcggggtggctgacgctgctgcggcctacaaagccgcaaaggccggtgccggactagggggtgtgcccggcgtgggcggtctgggagtgagcgctggcgcagtagtccctcagccaggggccggagtaaagccgggcaaggtccctggcgtgggcctccccggagtgtatcccggcggcgtgctgccaggagctcggttccccggtgtcggagtactgcctggcgtgcccacaggagccggggtcaaacctaaagcccctggggttggcggtgcctttgctggcatcccgggagtcggaccttttggaggaccccagccaggcgttcctctcggctaccccatcaaggcacctaagctgcccggcgggtatggcctgccttatacaactggtaagctcccctatgggtatggccctggcggtgtggccggcgcagcgggcaaggccgggtatccaacaggtacaggcgtcggcccgcaggcagcggcagccgccgcagcgaaggcggcagcgaaattcggagccggagccgctggcgtgctccctggagtgggaggcgcaggcgtacctggggtacccggagctatcccaggcatcggcgggatcgcaggcgtaggaacgcccgccgccgccgctgctgcagcagccgccgccaaagctgctaaatatggagccgccgccggcctcgtccctggcggtccagggttcggccccggagtggttggggttccaggcgccggtgtgcccggagtgggggtcccgggggccggaattcctgtggtgcctggggccggcatccctggtgctgcagtgccaggagtcgtttctcccgaagctgcggccaaagcggcggcgaaggctgctaagtatggcgctcgtcccggcgtcggtgtgggcggaatccccacttatggggtgggcgcaggagggtttcccggctttggggttggagtgggaggcattccaggagtggcaggtgttcctggtgtcggcggagtgccaggggtcggcggcgtccccggggtcggaatttctccagaagctcaggcagccgcagccgccaaggctgctaaatacggagttggtacacccgctgctgctgccgccaaggccgcagccaaagcagcccagtttgggctggtgcccggggtgggagtcgcccctggcgtcggcgtcgcccccggggttggtgtggcacccggcgtcggactcgcgccaggggtcggcgtggcccccggggttggcgtggctcctggggtcggtgtggccccagggatcggtcccggtggggttgccgccgccgcaaagtcggctgctaaagtggccgccaaggctcagctgcgagctgcagcaggtctgggggctggcattcccggcctgggggtgggcgtaggcgtacccggcctaggggtaggggctggtgtgcccggattgggtgttggtgcgggggtccccggattcggagcggtccccggagctctggccgccgctaaggcggcgaaatacggcgcagctgtccctggcgtcttggggggtttaggggctctggggggggtaggtattcccgggggcgtcgttggggccggtcctgctgctgcggctgccgccgccaaggctgctgccaaggcagcccagttcggcttggtgggcgctgctggcctgggggggctgggagtcggcggcctgggggttcctggggtcggtggcctggggggcataccccctgccgcagcagcaaaggccgcaaaatatggcgccgctgggctgggcggcgtgctgggcggcgcaggccagttccctctcgggggcgttgccgcccggccggggtttgggctgtccccaatctttccgggaggcgcctgtttaggaaaagcctgtggacgcaagcgaaagtag

SEQ ID NO: 4149 - DNA, 2274 bp, Artificial Sequence
  Description of Artificial Sequence: Synthetic coding sequence
atggccggcctgaccgccgccgccccccggcccggcgtgctgctgcttctcctctcaattttgcacccatctcgtccagggggagttcctggggctattccaggaggcgttcccggaggggttttctatccgggcgccggtcttggggccctgggcggcggcgcactgggacccggaggaaagcctctcaaacctgtgcccggtggacttgcaggtgcaggtcttggcgctggactcggcgctttcccagcggtaaccttccccggcgcactagttcccggaggcgtggcagatgccgctgccgcctataaggcagccaaagccggagcggggcttggtggcgttccaggagtgggtggtttgggggtatcggctggagctgtcgtgcctcagccaggtgcaggtgttaagccagggaaggttccaggtgtcggtctccctggtgtgtatcccggaggtgtgctgcctggcgccaggtttcctggagtcggcgtgctccctggggtgccgaccggtgcaggagtgaaacctaaggcacctggagtaggaggggcttttgcggggatccccggggtaggaccattcggtgggccacagccaggtgtacctctggggtaccctatcaaggctcctaagttacccgggggatatggcctcccatataccaccggtaaacttccgtacggctatggtccaggaggagtggccggggctgctggaaaggccggatatcccacaggaaccggtgtgggcccacaggccgcagcggcggcggcggcaaaggccgccgctaaatttggagccggtgctgctggagtattacctggcgtcggaggggcaggagtgcctggggtgcccggtgctattcctggcatcggcggcattgcgggtgtcggcacaccagcggcagccgccgcagccgctgcagctgcaaaggccgcgaagtatggcgctgccgcgggactggtgcctgggggccctggcttcgggcctggcgttgtgggtgttccaggagccggcgtccccggagtcggggttccaggcgctggcattcctgtcgtgcccggggcgggtattcccggagccgcggtgccgggggttgtgtctccagaagcagccgcaaaggctgccgcaaaagcagccaagtatggtgctcggcccggggttggggtgggggggattcccacttatggcgtaggcgcgggtgggtttcctggatttggggtcggcgtgggggggatccccggagtggccggggtgcctggtgtgggcggtgtcccaggcgtgggcggagtgcccggggtgggcatcagcccggaagctcaagctgcagctgccgcgaaagctgccaaatacggagttggaactccagcagcagcagcagccaaggccgcagcaaaggccgctcagtttggactggtaccgggagtcggagtggctcccggtgtgggagtggcacctggagtgggggtggccccaggggtgggacttgcccctggcgtgggggtggctccgggggttggggtggcaccgggcgtgggagtggcaccaggtattggcccaggcggggtggccgccgcagccaaaagcgcggctaaggtggcagctaaagcccagttgcgtgcggctgccggtcttggcgcaggaattcctggcctcggtgtcggggtgggggtgcccggcctgggggtaggggccggagtccccggcctgggtgttggggccggagtaccaggctttggggcaggggccgatgaaggcgtgagaaggagcctctcacccgagctgagagaaggtgatccctcgagtagccagcatctcccttccacaccatcatctcctcgcgttcctggtgccctggcagcggccaaggccgctaagtacggagccgccgtgcccggagttcttgggggtctgggagcattgggaggtgtcggaatccccggaggcgtggttggagcagggcccgctgccgctgccgccgccgccaaagctgctgcgaaagccgcccaattcggactggtcggcgcagccggtctcggaggcctgggcgtgggggggcttggcgtgcccggagtaggcggtctgggaggtattccgcctgctgcggccgccaaggctgccaagtacggcgcagccggattgggtggtgtgcttggtggcgccggacaattcccgctcggaggagtggcagcaaggcccggctttgggctgagccctatatttccgggaggcgcctgtctggggaaggcctgtggacgaaagcgcaagtag

SEQ ID NO: 4150 - DNA, 2136 bp, Artificial Sequence
  Description of Artificial Sequence: Synthetic coding sequence
atggccggcctgaccgccgccgccccccggcccggcgtgctgctgttgctgctctccattttgcatccttcccgaccaggcggcgtccccggcgccatccccggaggggtcccgggaggagtcttctaccctggtgccgggctgggagctctcggtggaggcgcgttgggacctggaggcaaaccattgaaaccggttccaggaggcctggcaggagccggacttggtgctgggctgggtgcctttcctgctgtcacctttccgggcgccttggtccctggaggggtcgctgatgccgctgccgcgtataaagccgccaaggccggtgcaggactgggcggtgtaccgggtgtaggcgggctcggggtgtccgcggccccaagcgttccgggggcagtcgtcccacagccgggagcaggggtgaaaccaggtaaagtgccgggggtgggactgccaggcgtataccctggaggcgtgctgcccggcgctaggtttccaggtgttggcgtgctgcccggagtgcccacaggtgccggcgttaagcccaaggcgccaggcgtaggcggtgcattcgccggcatacccggagtggggcccttcggcggaccacagcccggcgtccctctgggttatcccattaaggcaccaaagttacccggcggatatggactaccgtatactaccggcaagcttccctatggatacgggccaggaggtgttgctggagccgctggtaaggccggctaccccacagggacaggcgtcggcccacaggcagccgcagccgcggctgctaaggccgccgcaaagttcggtgcaggcgccgcgggtgtcctccccggagtcgggggagccggcgtccctggcgtgcctggggccatccccggaatcgggggcattgccggcgtggggactccagcagccgcagctgctgcagcagcagccgcaaaagcggcaaaatacggcgcagcggccggactggtgcccggtggccctgggtttggccccggcgtggtcggagtgcctggtgccggagttcccggcgtcggcgttcccggtgctgggatacctgtggtccccggggccggaattcccggggccgcggtcccgggcgtcgtgagtcctgaggccgccgctaaagccgcggccaaagcagccaaatacggggctcggccaggagtgggcgtcggtggtatccctacatacggcgttggagcagggggcttcccaggattcggcgtcggagtcggaggcattcccggagtcgccggagtgccaggtgtcggaggagttcccggggtaggcggcgtaccgggggtcggtatctcccctgaggcacaggcagccgccgccgccaaagctgccaaatacggggtggggacgcccgcagcagccgccgccaaggcagccgctaaggctgcacagttcggcttggttcccggcgtaggggtggctcccggcgtgggcgtcgccccaggtgttggtgttgctcccggcgtcgggcttgctcccggagtgggggtggcccctggcgtcggcgtagcgcccggggtgggggtggccccagggattggtcctgggggcgtggctgcagccgccaaaagcgctgctaaagtggctgcaaaagcccagctcagggcagcggccggactcggggctgggataccgggtctgggtgtgggggtgggggtgccgggcctgggggtgggtgccggcgtgcctggcctgggagtgggagccggcgtacctggttttggcgctgtcccaggggccctagccgccgctaaagcagctaagtacggggccgctgttccaggcgtacttggtggcctgggcgcgctgggcggagtcggcataccgggtggggtggtgggtgcgggaccggccgcagccgctgctgccgcaaaagctgctgcgaaggccgcacagttcgggctggttggagcggctggtctgggcggactcggcgtgggaggcctaggagtccccggagtgggtgggttaggaggcatcccgcccgccgccgctgcaaaggccgcaaagtacggcgtcgctgcccgcccgggcttcggcttgtctccaatcttcccagggggggcatgtttaggcaaggcatgcggccggaaacgaaaatag

SEQ ID NO: 4151 - DNA, 2379 bp, Artificial Sequence
  Description of Artificial Sequence: Synthetic coding sequence
atggccggcctgaccgccgccgccccccggcccggcgtgctgctgcttttgcttagcatcctccatccgtcacggccgggtggcgtgccaggtgccatccccggcggggtgcccggaggggtcttctatcctggcgcagggctaggggctctgggagggggagcactgggccctggtggaaaacctctgaaacctgtgcctggcggactggccggtgccggcttgggcgctgggttgggggcattccccgcagtgacgttcccaggcgccctcgtccccggcggcgtagccgacgctgcagccgcatacaaggcagcaaaggctggggctggattggggggagtccctggcgtcggaggcctgggtgtaagcgcgggggctgtcgtaccacagcccggggcgggcgtcaagccggggaaagtgcccggagtcggcctgccgggtgtgtaccccggtggcgttctgcctggggcaaggtttcctggtgtgggggtgctccctggcgtgcccaccggggccggagtgaaacccaaggcacctggcgtggggggagccttcgcaggtattcctggcgtgggcccatttgggggcccacaacccggtgtacctctaggatatcccatcaaagctccaaaattgccggggggatacggcttgccatataccacaggcaaattgccttatggctacggacctgggggagtcgccggagccgccggaaaggcaggctaccctaccgggacgggggtaggcccccaggccgcagccgctgctgcggctaaggccgccgccaaatttggcgcaggggccgcaggcgtgctgcccggagtaggtggtgcaggggtgccaggagtaccgggcgcaattcccgggattggcggcatcgccggcgtggggacgccggctgcggctgccgccgctgccgccgccgccaaagcagctaagtatggagcagcagcagggctcgtgccaggcggcccagggtttggcccaggggtggttggcgtgcccggggcaggagtccctggagtcggggtaccaggcgccgggatccctgtggtacctggagcaggaattcccggggccgccgttcctggcgtagtctctccagaggctgcagctaaggccgcagccaaggctgctaagtatggcgctcgacccggagtcggagtgggcgggattcccacctatggggtgggcgctgggggcttcccggggtttggggttggggtcggtgggataccaggcgttgctggagttccaggtgttggaggagtgccaggtgtcggaggcgtgccaggcgtcggcatctctcctgaagcacaggcagccgctgcagcaaaggcagctaagtacggcgcggccggcgccggggtactcgggggcctagtgcctggggcaccgggtgctgtacccggcgtcccagggaccggtggggtccccggtgtcgggactcccgcagctgcagccgccaaggccgcagccaaggcagcccagttcgcgttgctgaatctcgcaggcctcgtccccggtgtgggagtggcccctggggtaggggtcgcgccaggagtcggcgttgcccccggcgtaggactagcccctggcgtaggagtcgcacctggagtgggcgtggctcctggcgtaggtgttgcacccgggatcggcccgggcggtgtggccgccgccgctaaaagcgctgccaaggttgccgccaaggcccaactgagggcagccgcaggactaggcgccggcattccaggcctgggggtaggggtgggcgtgccaggcctgggggtgggggccggggtgccaggacttggtgtaggcgctggcgtcccaggctttggagccggagcagatgaaggcgtgcgcaggtccttgtcgccagaattaagggaaggagaccctagctcaagtcagcaccttccatctacaccttcctccccacgggtccctggagcgctcgctgccgctaaggctgcgaaatatggcgccgccgttccaggcgtattgggcggacttggggctttgggcggtgtggggattcctggcggggtagtcggggcaggtccagccgctgccgcagcagccgctaaagccgccgctaaagctgctcagttcggcctggtgggagctgccggtcttggggggctgggtgtgggaggactgggcgtgcctggggttggcggcctaggaggcatacccccggccgccgccgccaaggctgccaaatacggtgcggcaggtctcgggggggtgctagggggagccggccagtttcctttgggcggagttgcagcccgacctggattcggactatcccccattttccctgggggcgcgtgtctgggcaaagcatgcggcaggaaacgcaagtag

SEQ ID NO: 4152 - DNA, 2034 bp, Artificial Sequence
  Description of Artificial Sequence: Synthetic coding sequence
atggccggcctgaccgccgccgccccccggcccggcgtgctgctgctgcttctttctatcttgcacccaagccgacccgggggggtgcctggggcgatccccgggggagtgcccggaggcgtgttctacccggccctgggccccggcggcaaaccgcttaaaccagtcccagggggacttgccggggcaggactgggggccggcttgggagcgtttccagctgtaactttccctggcgccttagtacctggcggggtggccgacgccgccgctgcctacaaggcagccaaggcaggtgccggtttagggggtgtccccggggtcggcggactgggcgtctccgcgggcgcagtcgtgcctcaaccgggagcaggggtcaagcctggaaaagtgcccggggtgggtctgcccggcgtgtatccgggcggcgtgctacccggtgcgcgctttccgggcgttggagtgctgccaggggtgcccacaggcgccggagtgaaaccgaaggcacctggcgtcggtggtgcctttgcaggcattcctggggtgggccctttcggcggacctcagcccggggtcccccttggctatcccattaaggctccaaagctccccggcggatacggcctcccatatacaacgggcaaattaccttatggatatggcccagggggtgtggctggagctgcaggtaaggccgggtatccaaccggaaccggggtcggaccccaggcagctgcagccgccgccgccaaagcggccgctaagttcggcgcaggggcagctggtgtcctgccgggggtgggcggagccggtgttccgggtgtgccaggtgcaatcccaggaatcgggggaattgccggtgttggcacgcccgccgcagctgctgccgctgccgccgcggcaaaagcagccaagtacggggccgctgcagggctcgtccctgggggccccgggtttggcccaggagtcgtcggggttcccggagccggcgtcccaggggtcggggtccccggcgccggcatacccgtggtcccaggagctggcatcccaggagcggcggtgccgggggtggtctcgcccgaggccgcggctaaggcagccgccaaggctgcgaagtacggggctcgccctggcgtcggagtggggggcatacctacctatggtgtgggtgccggaggcttccctgggttcggtgttggcgttggtggcattcctggcgtcgccggagtgcccggagtgggcggagtgccgggagtggggggggtcccgggggtggggatttccccagaggcgcaggcggccgcagctgctaaagctgcgaagtatggactggttcccggagtcggcgtggctcctggcgtcggggtcgcccccggggtgggcgtagcaccaggcgtcggtctggcccctggtgtcggcgtcgcccctggcgtgggcgtggccccaggagtgggggtggctcctggcatcggtcccggcggagtggccgctgcggccaagagtgcagcaaaggtcgctgcgaaggcacagctcagggccgcggctggcctcggggcaggcatccctggcctgggcgtgggggtaggtgtgcctgggctgggagtcggtgcgggcgtcccaggtctgggggtgggcgccggagtacccggcttcggcgctgtgcccggtgcactggcagcggcgaaagccgctaagtacggtgcggcagtacccggtgtgctggggggactgggcgccctcggcggggtcggcatcccgggtggcgttgtcggggctggaccagccgcggccgccgcagccgctaaggccgctgcaaaagccgcccagtttgggttggtgggagctgccggtttgggcggcctcggagttggcgggctgggtgtgcctggcgttggcggcctggggggcatcccgcccgccgccgcggccaaagccgcgaaatatggcgtggccgctagacctggatttggactctcccccatattccctgggggggcttgcctcggaaaggcctgcggccggaagaggaaatag

SEQ ID NO: 4153 - DNA, 2118 bp, Artificial Sequence
  Description of Artificial Sequence: Synthetic coding sequence
atggccggcctgaccgccgccgccccccggcccggcgtgctgctgctgttactcagcatcctgcatccttcccgtccagggggagtgcctggagcaatacccggcggtgtacctgggggtgtgttttatcctggagccgggctgggggcactggggggtggagccctcggacccggcggcaagccgctcaagcctgtgccagggggcttggccggagctgggctgggcgcaggcttgggggctttccctgctgttacattcccaggcgccttggtgcccggaggcgtcgcggatgccgctgcagcatataaagcggccaaagctggggctgggctaggtggtgtgccaggagtggggggcctgggagtgagcgcgggggccgtggtcccccagcctggcgctggcgtcaaaccaggaaaggttccgggggtcgggctgcccggggtgtaccccggaggggtactccccggagcccgctttccaggagttggggtgctgcccggcgtaccaacgggcgccggtgtgaagcctaaggctcctggcgtaggaggggcatttgcaggcatccccggcgttggcccattcggaggcccacagcccggggtgcctctcgggtatcccattaaggcaccaaaactcccgggtggctacggcctgccttataccactggcaagttaccttatggttacgggcctggcggcgttgctggagccgcagggaaggccggctatcctaccggtaccggcgtaggccctcaggctgccgccgcagctgccgctaaagcagccgccaaattcggtgccggcgcggccggagtacttcccggcgtcggaggcgccggggtcccgggggtgcctggagctatccccggcattggaggtattgcaggcgtcgggaccccagcagccgcagccgccgccgccgcggctgcaaaggctgccaagtatggtgcagctgctggtcttgtaccagggggcccggggttcggccccggtgtggtaggcgtaccgggggccggcgtgcccggggttggagtgccaggtgcaggcatccccgtggtgcccggtgccggaatacctggcgcagccgtgccgggcgtagtttctccagaagccgctgctaaagcggctgcaaaggcagccaaatacggtgctcgtccaggggtgggcgtcggtgggattcccacctatggggtaggggctggcggcttcccgggcttcggggtgggcgttggtggcattccaggggtggcgggggttcctggggtgggcggcgtgccaggcgtgggcggagtgcctggagtcgggatctctcccgaagcccaggctgcggcagccgccaaggccgccaagtatgggctggtgcctggcgtcggtgtggcccctggagtgggggtagcacccggagtgggagtagctcccggcgttgggctggctcccggtgttggtgttgcccctggcgtgggtgtcgcccctggcgtgggcgttgccccaggaattggccctgggggggtggcggcagcagccaagtcagccgccaaagtagccgcaaaagcacagcttagagccgccgccggcctcggcgccggtattccggggcttggagtgggggtaggggtcccaggccttggagtgggtgccggtgtacccggtctcggtgtcggggccggagtgcctggttttggcgccgtccccggggcattagccgccgccaaagctgctaagtacggtgcagcagtgcccggcgttttaggagggctgggagctcttggaggcgtcgggatacctggcggtgtcgtcggcgcgggccccgctgccgcagccgcagccgcgaaagccgccgcgaaggccgctcagtttggtcttgtgggtgctgctggattgggtggcctgggggttggaggcctgggagtgcctggcgtgggaggtctgggcggaataccgcccgccgccgccgctaaggccgcaaagtatggagcagccgggctggggggtgtgcttggcggagctggtcagttccccctcggcggtgttgctgctagacctggcttcgggctcagtcccatcttccccggcggggcatgcttaggtaaggcctgcgggcgcaagaggaaatag

SEQ ID NO: 4154 - DNA, 645 bp, Artificial Sequence
  Description of Artificial Sequence: Synthetic coding sequence
atggccggcctgaccgccgccgccccccggcccggcgtgctgctgctgctgctgtccattctacaccctagtaggcctggcggcgtgccaggagctatccctggaggcgtcccaggtggagtgttttatcctggggctggtttaggcgctttgggcggtggagccctgggccctggggggaagcctctgaaaccagtgcctgggggtctcgccggggccggcctgggagccggactgggggccttccccgctgtaacctttcccggagctctggtgcccggaggagtagccgatgcagccgccgcctacaaagccgccaaggccggggctgggctgggcggcgtgccaggcgtgggcggattgggcgtgtctgccggcgctgtcgtacctcagcccggggctggagttaaacccgggaaggttcccggagttgggctgcctggcgtctaccccggcggagttttacccggggtgggcccatttgggggcccccagcctggcgtgcctttaggctatcctatcaaggctccaaagctgcccggtgggtacggactcccttacactacaggcaaactgccatatgggtacggccctggcggtgtggcaggggccgcaggaaaggccggatatccaacgggcacttag

SEQ ID NO: 4155 - DNA, 504 bp, Artificial Sequence
  Description of Artificial Sequence: Synthetic coding sequence
atggccggcctgaccgccgccgccccccggcccggcgtgctgctgctcctgctaagcattttacaccccagccgcccaggaggtgtgccaggtgccatccctggaggggtgcccggcggagtcttttaccccggcgctggactcggggctttaggggggggtgccctgggccccggggggaaaccgctgaagccggtccccggcggcttggctggagcgggccttggcgcagggctgggggcattccctgctgttacctttcccggcgctctggtccccggcggtgtggcggatgccgccgctgcgtacaaagctgccaaggctggtgtcgggccatttggcggacctcaacccggagttccacttgggtatcctattaaagcccccaaactgccaggtggttacggactgccatacacaacaggaaagttgccttatggttacgggcctggcggggtggccggcgccgccggcaaggcgggctatccaaccggcacaggatag

SEQ ID NO: 4156 - DNA, 2079 bp, Artificial Sequence
  Description of Artificial Sequence: Synthetic coding sequence
atggccggcctgaccgccgccgccccccggcccggcgtgctgctgttgttgctgtccatcctgcatccgtcaaggcccggcggcgtgccaggtgccatacccggaggcgtgcccggaggtgtcttctatcctggggctggactcggtgccctcggcgggggggccctggggccaggtggcaaaccgctaaagccagtgccaggaggattggcaggagcaggtctgggcgccggtctgggtgcattccctgctgtcactttccctggggccctagtgcctgggggcgtggcagatgccgccgccgcttataaggccgctaaggctggagctggtctgggcggcgttccaggcgtcggtgggttgggtgtgtctgctgcacctagtgttccgggagcggtcgtgccgcagccaggggccggcgttaaacccggcaaggtgcctggcgttgggctgcccggcgtgtatccaggcggtgttctgccaggcgcgcgatttccaggcgtcggtgttctgcccggagtgccaactggagcgggggtgaagcccaaagcacccggcgtcggcggcgctttcgccggcatcccaggcgtcgggcctttcggcgggccccagccaggagtgcccctggggtaccctattaaagctcctaagctcccgggagggtacgggctcccgtacactacaggcaagctgccatacggctatggtcccggtggggtcgccggggccgcgggaaaagccggttatcccacagggactggcgtaggaccgcaggctgctgcggccgcggctgccaaggcagctgccaagttcggagccggagcagcgggagtcctgccaggtgtgggcggagccggtgtgcccggagtacccggcgcaatacccgggatcggtggtattgcaggagtcggtacccccgcagcagctgctgccgcggccgctgcagctaaggcggccaaatatggcgcggctgctgggctcgtgcccggagggccaggctttggtccgggcgtagttggcgtccctggagctggcgttcccggagtgggagtgccaggagcgggcatccccgtcgtgccaggcgcggggatacccggggccgcagtgccgggtgtggtctctcctgaagccgcggccaaggccgccgctaaggcagctaagtacggagccagaccaggtgtaggcgtcggcgggatcccgacttatggcgtgggcgctggaggcttccctggcttcggcgtgggggtaggtggaatccccggggtggccggcgttcctggagtaggcggagtgccaggcgttggtggggtccctggggtggggatcagtcccgaagcccaggccgctgcagccgcaaaagccgcgaaatacggcctcgtccccggcgtgggggtggctcctggggtgggagtagcgcccggggtgggtgttgcaccaggagtgggtctggcaccaggagtaggcgttgctcctggcgtgggcgtcgcacccggagtgggcgtggctcccggtatcgggccaggtggtgtggccgccgccgctaagagtgctgcaaaggtcgccgctaaggcccagctgcgggcagcggccggactaggtgccggaattcctggattaggcgtcggagttggcgtgcccggactcggcgtgggagcaggcgtcccaggactcggcgtcggtgctggagtgcccggcttcggagccgtgcccggcgcgttggcggcggcaaaagccgcaaagtatggcgcagcggtgccaggggtcttgggagggctcggggccctgggaggggtggggatccctgggggtgtcgtgggcgccggaccagcagcggccgcagctgccgcgaaggcggcagctaaagccgctcagttcggtttagtcggcgcagccggccttgggggactgggcgtaggaggtctgggagtacccggcgttggtggcctgggcgggatccctcccgctgcggccgcaaaagccgcgaagtacggtgtggccgcgagaccaggattcggcctgtcaccaatttttcctggcggcgcctgtctcgggaaggcatgcggtcgaaagcgcaaatag

SEQ ID NO: 4157 - DNA, 507 bp, Artificial Sequence
  Description of Artificial Sequence: Synthetic coding sequence
atggccggcctgaccgccgccgccccccggcccggcgtgctgctgctgcttctgtcaattctccacccctcccgacctggcggcgtaccaggcgccatccccgggggcgtgccaggcggtgtcttctatcctggggcaggcctcggagctctaggaggcggcgctctgggtccaggcgggaagccactgaaaccaggcgtgggtcctttcgggggccctcagccaggagtgccccttggataccccatcaaggctccaaaattgcctgggtatgggcctgggggcgtggctggagcagctggaaaggcgggttatcctacaggcaccggagtagggccacaggccgcggctgctgccgccgctaaagctgccgccaaatttggagccggggccgctggcgtgctgccaggcgtaggaggagccggcgtgcctggtgtgcctggtgcaatacctgggatcggtggcattgccggtgtgggtacacccgccgcagcggccgccgcttag

SEQ ID NO: 4158 - DNA, 885 bp, Artificial Sequence
  Description of Artificial Sequence: Synthetic coding sequence
atggccggcctgaccgccgccgccccccggcccggcgtgctgctgctcctgctgagcatccttcaccctagccgtccaggaggcgttcccggggccatcccagggggcgttcccggaggcgtgttttatcctggagccggcctgggagccctggggggcggagccctcgggcccggcgggaagcctctgaaacctggtctgggcgctttccctgctgtcacgttccctggggcactggtgcctgggggggttgcggacgctgctgcggcatataaagccgccaaagccggagctgggctgggcggcgtacctggtgttggcggtctcggcgtttctgccggggccgtagtacctcagccaggggccggggtcaaacctggtaaggttccgggggttggtctccctggagtgtaccccggtggagtgctccccggagcgcgattccccggagttggagttctaccgggagtacccaccggggccggggtgaaacctaaggcaccaggtgttgggcccttcggtggtccccagccaggagttcccctggggtaccccatcaaagcccccaaactgccaggcggttacggcctaccttacacaaccggtaaattgccctatggatacggtcctggcggcgtggccggtgctgccgggaaggctggctatccaacagggacgggagtgggcccacaggccgcagccgccgccgccgctaaagctgctgcaaagttcggcgctggggctgctggagtgctcccaggcgtcgggggggccggggtccctggggtgcctggggccatccctggtattggaggaatcgccggggtgggcaccccggccgccgctgccgcagcagcagctgctgccaaagccgctaagtattag

SEQ ID NO: 4159 - DNA, 531 bp, Artificial Sequence
  Description of Artificial Sequence: Synthetic coding sequence
atggccggcctgaccgccgccgccccccggcccggcgtgctgctgctgttgttatcaatcctgcacccctcaaggcccggcggtgtgccaggcgcaatccctgggggggtgccgggcggagtgttttatccgggcgcagggctcggggccctgggtgggggggcgcttggcccaggcggaaagccactcaagcctgtgcctggcggtctcgcaggggcaggcctgggggctgggttgggggcattcccagccgtgacgtttccaggggccctggtgccaggcggtgtggcagacgccgccgccgcctataaagccgccaaagcaggggccggactggggggggttccaggagtgggggggctcggcgtgagcgccggggctgtagtgccccagccaggtgccggtgtgaaacccggcaaggtgcctggggtcggtggagcttttgccggtattcctggtgtgggtcccttcggtggcccgcagcctggggtacctttgggctatcccattaaagcccccaaacttccatag

SEQ ID NO: 4160 - DNA, 1992 bp, Artificial Sequence
  Description of Artificial Sequence: Synthetic coding sequence
atggccggcctgaccgccgccgccccccggcccggcgtgctgctgctgctgcttagtatcttgcacccctcgagacctggaggtgtgccaggagctatccctggtggtgtaccgggaggagtgttctatcctggggcggggttgggggcattgggtgggggtgcccttggacctggcgggaaaccacttaagcctgtgcccggtggcctcgccggggccgggttaggtgcaggtgccggcctgggtggagtccctggagtgggcggactgggagtgtcagcgggcgccgttgtgccacaacccggcgccggcgtgaagccggggaaggtgcccggagtaggccttccaggcgtgtaccctggcggagtgcttccaggggctcggttccctggagtcggcgtgctgccaggcgtacctacaggagccggtgtcaaacccaaagcacctggggtggggggcgccttcgcaggcattcccggggtcggccccttcggagggcctcaaccaggtgtgccgctaggctacccaataaaagctcccaagctgcccggggggtacggattaccatataccaccggcaaactgccatatgggtatggcccaggtggcgtggccggggccgcgggcaaagcggggtaccccaccggcaccggagtgggacctcaagccgcagcagccgcggccgctaaagccgctgccaaattcggcgccggcgctgcaggagtgctaccaggagtggggggagctggtgtcccgggcgtaccaggggctattcccggaataggcggaatagccggagtcggcaccccagccgccgccgcggcagctgccgcagccgccaaggctgccaagtacggcgctgctgctgggctggtgcccgggggaccaggctttgggcccggcgttgtgggcgtgcctggtgctggtgttcctggcgtaggggtcccgggggcagggataccagtcgtgccaggcgctgggatccctggtgcggctgttccgggcgtggtaagtcccgaggcagccgctaaagcagcggccaaggccgcaaagtatggagcccgccctggtgttggcgtcggcggcattcctacgtacggagtgggcgccggggggtttcctggcttcggcgttggcgttggaggaatcccaggagtggcgggagtcccgggagtggggggtgttcctggagttggaggcgtgccaggagttgggatatctcccgaggctcaagcagccgcagccgctaaggcagcaaagtacggcgtcggtacgccagctgccgcagctgcgaaagcggcagcgaaagcagcgcaatttggactggtgcccggcgttggggttgctcctggagtcggcgtggcacccggcataggtccaggtggcgtggctgctgcagcaaagtccgccgccaaagtcgccgcaaaagcccagttacgtgccgccgctggcctgggcgcagggatccctggcttaggggttggagtgggagtacccggactgggcgtgggagccggggttcctggtctgggcgtgggcgctggcgttcccggctttggggcagttcctggtgccctggccgccgctaaggcagccaagtatggcgcagcagtcccaggcgtcctgggtgggctcggtgccttgggtggcgtgggcattcccggaggagtggtgggggcggggcccgcggcggcagcagcggccgcaaaagctgccgccaaggccgcgcagtttggcctggtgggagccgctggactcgggggattaggtgttggaggccttggcgttccgggcgttgggggactgggagggattccacccgctgcagcagcaaaagccgccaagtatggggctgctggtttaggcggtgtcttggggggcgcagggcagtttccgctaggcggtgtggctgcacgacccggattcggattgtcccccattttcccaggcggagcctgcctgggtaaggcatgcggtcgcaaacgaaagtag

SEQ ID NO: 4161 - DNA, 2121 bp, Artificial Sequence
  Description of Artificial Sequence: Synthetic coding sequence
atggccggcctgaccgccgccgccccccggcccggcgtgctgctgttactgctctccattcttcacccaagtaggcctggtggggtccctggagccatccctggcggcgttccagggggggtcttctatccaggcgcaggactcggtgcacttgggggtggggccctcggacccggcggcaagccacttaaacccgttcccggagggctagctggagctgggcttggtgccggcctgggagcgttccccgccgtgacatttcccggtgcccttgtgcctgggggagtggcagatgccgccgctgcatacaaagcggccaaagctggggcgggcctagggggggtgcctggcgtgggcggactcggcgtgtcagcgggcgcagtcgtcccacaacccggggcaggtgtgaagccaggcaaggttcctggcgtgggtttaccaggagtatacccagggggcgttctgcccggggcacggttccccggggtgggagtactgccaggcgttccgactggtgcgggagtgaaaccgaaggcgcccggtgtgggtggggccttcgctgggattccgggcgtcggcccattcggaggcccccagccaggggtgccactcggctatccaataaaggcccccaagctgcccgggggttacgggcttccctataccacaggcaagctcccgtatggctatggacccggaggtgtggcgggagctgccggcaaagcagggtaccctactggcaccggcgtgggaccgcaggccgccgctgccgctgccgccaaagccgccgcgaaatttggcgctggagccgctggtgttctgcctggagtgggtggagccggcgtccccggcgtaccaggggccatcccgggaatcggaggcatcgcgggcgttggaactcctgctgcagcggccgcagcagcggcagctgcgaaagccgccaaatatggggctgctgcaggcctggtaccgggcggacctggcttcggccctggggtagttggagttccaggagctggtgtgcctggggtgggagtgccaggcgccggcatccctgtagttcctggggccggcatcccgggggccgccgtgccaggtgtggtcagcccagaggccgccgccaaagcagccgcaaaagccgcaaaatacggcgctaggccaggcgtcggagtggggggtatcccaacatatggagtgggcgctggaggcttccccggcttcggggttggcgtggggggtattccaggcgttgctggggtaccaggcgtgggaggtgtgcctggcgtggggggcgtcccaggagtgggtatatctccagaggcacaggccgccgccgctgctaaggccgctaagtacggcgtgggtacacctgctgctgccgccgccaaggctgcagcaaaagccgcccagtttgggttagtcccaggggtaggcgtggctccaggggttggggtggctcctggggtcggtgtcgcacctggtgtcggtctggctcctggcgtcggtgttgccccaggagtcggtgtggctcccggggtaggcgtggcccctggcattgggcccgggggagtggccgctgccgccaagtccgccgcaaaagtagcagctaaggcacagctgcgggccgcagcaggtctaggggccggaatccccggactaggtgtcggcgtgggcgttcccggactgggagtgggcgccggcgtgcctggattgggtgtgggggctggggtgccaggctttggagccgtccctggggcactggccgctgccaaggccgcaaaatacggtgctgctgtgccaggcgtacttggcggattaggggccttgggtggggtggggatccccggaggtgtagtgggcgcggggccagctgccgccgctgccgcggcaaaggctgctgccaaggccgcacagtttgggttagtgggcgccgcgggtttgggcggcctcggcgtgggaggcctgggcgtcccaggcgtgggaggtttagggggaatcccgcccgctgcggcggccaaggccgccaagtatggcgtagcagcccgacccgggttcggactaagtcctatcttccccggcggcgcgtgtctgggcaaggcgtgtggtcggaaacgaaagtag

SEQ ID NO: 4162 - DNA, 2145 bp, Artificial Sequence
  Description of Artificial Sequence: Synthetic coding sequence
atggccggcctgaccgccgccgccccccggcccggcgtgctgctgttactgttgtctatcctgcatccaagtaggcctgggggtgtacccggagccatcccaggtggggttccagggggggtcttttacccagccctcggtcccggaggcaagccactgaagccagtccccggcggactggccggcgccggcttgggggctggcctgggtgcctttccagctgtgacctttcctggtgctctggtcccaggaggcgtggccgacgcagctgccgcgtataaggccgctaaggcaggggcgggcctgggaggagttccaggggtggggggcctgggcgtcagcgctggggccgtggtgccccaacccggagctggagtgaagcccggaaaggttcctggggtcggccttccgggcgtctatcctggcggcgttctccccggagcacgctttcctggcgtgggggtgttgccaggtgtccctaccggcgctggggttaaacctaaggcacctggagtcggcggggcttttgccggcatcccgggagtcggcccctttggcggcccgcaaccaggcgtgcccctgggctacccaatcaaagcaccaaagctcccaggtggatacggcttaccgtataccactggcaagctgccatatggttacggccctgggggcgtggctggcgccgctggtaaagccggctatccaacaggaactggcgttggaccccaagccgccgctgctgcagctgcaaaagccgccgcgaaattcggagccggggccgccggggttctccctggtgtggggggtgcaggagttcccggtgttccgggggccataccaggcatcggaggaatcgctggcgtgggaaccccggcagcagctgccgccgctgcagcagctgctaaggctgccaaatacggggcggccgctggattggttcccggaggcccaggctttggccctggggtcgtgggtgtcccgggcgccggcgtcccaggggtcggagttcccggggccggaatacctgtggtgccgggcgctggcatcccgggggccgcagtacccggggtggtcagccccgaagccgccgccaaggcagccgcaaaagcagcaaagtacggcgcgagaccaggagtcggggtgggagggatcccaacctatggcgtgggggcaggcggcttcccggggtttggcgtgggcgttggtggaattccgggcgtggccggcgttcccggtgtcggaggggttccaggcgtgggtggcgttcccggggtggggatctctcctgaggcacaggccgccgccgccgcgaaggccgctaagtatggggttggtactcctgccgctgctgccgctaaggcagccgctaaagccgcgcagtttggcctggtcccaggcgtgggcgtcgcccccggagtcggggtggcgccgggagtgggagtggctccaggagtgggcctggcccccggcgtgggggtagcacctggagtcggagttgcccctggcgtgggagtcgctccgggaatcggacccggaggggtcgccgccgctgctaagagcgcagcaaaggtggctgcaaaagctcagctccgggcagccgctgggcttggggcaggcatccctggcctcggagttggggtgggggtgccaggccttggcgtgggggcaggggtgccaggattgggcgtaggcgcaggtgtgcctgggtttggcgccgttcctggagccttagctgcagcgaaggccgcaaagtatggtgctgccgtgcccggggttctgggcgggctgggcgcactagggggtgttggcatcccggggggcgtcgtgggggccgggccggctgcagcggctgcagccgctaaggcggctgcaaaagccgctcagttcgggctggttggcgcagctggtttaggcggattgggggtgggaggactcggagtccccggagtaggggggctggggggtatcccccccgctgctgctgccaaggcagctaaatacggagccgccggactgggtggggtcctgggtggcgccggccagtttcccctaggcggcgtcgcggccaggccgggcttcggactgtcacccatctttcctgggggtgcctgtctggggaaggcatgcggccggaagcgcaagtag

SEQ ID NO: 4163 - DNA, 678 bp, Artificial Sequence
  Description of Artificial Sequence: Synthetic coding sequence
atggccgccctggccagcagcctgatccggcagaagcgggaggtgcgtgagccgggcgggtctcggccagtctccgcacagcggagagtgtgccctcgaggcactaaaagcttgtgtcagaagcaactgctgatattactatctaaagtgcggctgtgcgggggtcgacctgcccgtcccgaccgtggtcccgagccccaactgaaggggattgttacaaaattgttttgtaggcaagggttctacctgcaggcaaatcctgacggctcaattcagggcacgccggaggacacttcatccttcacccattttaatctcattccagttggactgcgtgtggtcacaattcagtccgcaaagttgggccattatatggcgatgaacgcggagggactcctgtactccagtccccacttcactgctgagtgtcgatttaaggagtgcgttttcgaaaattactatgtgctgtatgcctccgcactataccgccagcggcggtctggccgcgcatggtaccttggcctggacaaggagggacaggtcatgaagggtaatagggtcaagaaaacaaaggccgccgcacatttcctacctaaactgctcgaggtggccatgtaccaggagccgagcctccattctgtgcctgaggcaagcccgtctagtcctccagctccatag

SEQ ID NO: 4164 - DNA, 546 bp, Artificial Sequence
  Description of Artificial Sequence: Synthetic coding sequence
atggagagcaaggagccccagctgaagggcatcgtgacccggctgttctcacagcagggttatttccttcaaatgcaccctgatggtactattgacgggaccaaagacgaaaactccgattacaccctattcaatctcattcccgtcggacttcgcgttgtggctattcaaggggtgaaggcctccctttatgtggccatgaatggagagggatacctttactcttcagatgtcttcacacccgagtgcaagtttaaggagtctgtgtttgaaaactattatgtgatatatagcagtaccctatacagacagcaggagtccggacgtgcatggttccttggactgaacaaagagggccaaatcatgaaaggcaatagagttaagaagacaaaaccaagcagccattttgtgccaaagcccatcgaggtgtgcatgtatcgcgaaccaagcctgcacgaaataggggaaaagcagggaaggagcaggaaatcctccggtacaccaactatgaatggtggcaaggtcgtgaatcaggactccacctag

SEQ ID NO: 4165 - DNA, 546 bp, Artificial Sequence
  Description of Artificial Sequence: Synthetic coding sequence
atggagaagaccgagccccagctgaagggcatcgtgacccggctgttcagccaacagggttatttcctgcagatgcatccagatggcaccatagatggcaccaaggatgaaaactcggactacacgctgttcaacctgattccagtcggcttgcgagtggtggccattcaaggtgtgaaggcctcactgtacgtcgcaatgaacggagaaggttacctctatagctccgatgtgttcacccccgagtgcaagttcaaggagagcgtctttgagaattattacgtgatttacagctccacactgtacagacaacaggagtccggaagagcctggttccttggcctgaataaagagggccagatcatgaaaggtaaccgggtgaaaaagacaaaaccaagcagccattttgtccctaaacctatagaggtgtgcatgtacagggagccgagtttgcacgagattggcgagaagcagggtaggagtaggaaatcatctggtacccctacaatgaacgggggaaaggtagtgaatcaagacagtacctag

SEQ ID NO: 4166 - DNA, 324 bp, Artificial Sequence
  Description of Artificial Sequence: Synthetic coding sequence
atggagagcaaggagccccagctgaagggcatcgtgacccggctgttctcccaacaggggtattttcttcagatgcaccctgacgggacaatcgacggcaccaaagacgagaatagtgactataccctttttaatctcattcctgtcgggctgcgagtggttgcgatccagggcgtgaaagccagtctctatgtggcaatgaacggagagggatacttgtactccagtgacgtgttcacccccgagtgtaagtttaaagaaagcgtgtttgagaactactatgtgatatatagctcaaccctctaccggcagcaggagagctag

SEQ ID NO: 4167 - DNA, 546 bp, Artificial Sequence
  Description of Artificial Sequence: Synthetic coding sequence
atggagagcaaggagccccagctgaagggcatcgtgacccggctgttttcccaacaaggctactttctgcaaatgcaccctgatgggactatcgacggaaccaaggatgagaatagcgactacaccctgtttaacttgatcccggttggcctaagggtggtggccattcagggcgtcaaagccagcctgtatgttgcaatgaacggggagggctatctgtactctagcgatgtctttacccccgaatgtaaattcaaggagtctgttttcgagaactactatgtaatctactcatccactctgtaccgacagcaggagtccggcagggcatggttccttgggctgaacaaggaaggacaaataatgaaaggaaaccgagttaaaaagaccaagccgtccagccactttgttcccaaacccatcgaggtgtgcatgtatcgagaaccttcactccacgagatcggcgagaaacagggccgcagccggaagtcctcgggcaccccgacgatgaacggtggaaaagtggtaaatcaagactccacatag

SEQ ID NO: 4168 - DNA, 546 bp, Artificial Sequence
  Description of Artificial Sequence: Synthetic coding sequence
atggagagcaaggagccccagctgaagggcatcgtgacccggctgttctctcagcagggatacttcctgcaaatgcacccagacggtacaattgatggcaccaaggacgaaaactcagactatacgctctttaatctcatccccgtcgggttgagagtcgtggctatccagggggtcaaggcttctttatacgtggcaatgaacggggaggggtatttgtattccagcgacgtttttaccccagagtgtaaattcaaggagtctgtgtttgagaattattacgtgatttactcctcgacactctacagacagcaggagtcaggcagggcatggtttctgggacttaataaggaggggcagatcatgaaggggaatagagtgaaaaagaccaaaccctcctctcactttgtccccaagcccatcgaggtgtgtatgtacagggaaccttcccttcatgaaatcggggagaaacagggtaggtctaggaaatctagtggaactcctactatgaatggtgggaaggtcgtgaaccaagacagtacctag

SEQ ID NO: 4169 - DNA, 732 bp, Artificial Sequence
  Description of Artificial Sequence: Synthetic coding sequence
atggccgccgccatcgccagcagcctgatccggcagaagcggcaggctagagagtctaacagtgacagagtgagtgcaagtaaacggaggtctagtccaagtaaggacggccggtctttatgtgagagacatgtcctcggagtgtttagtaaagtgcggttctgctcagggcgtaagcggcctgttaggaggagacctgaaccccagctcaagggcatcgtcacacgcctcttttctcagcagggatactttctacagatgcatccagatgggacaatcgatgggaccaaggacgagaacagcgactataccctttttaatctgatccctgtcggactgcgtgtggttgccattcagggtgtgaaggccagcctttacgtagccatgaacggcgaaggatacctgtactcctcagatgtgtttacaccagagtgcaagttcaaggagtctgtattcgaaaactactacgtgatttactcaagcactctgtatcgtcagcaggaatccggaagggcttggtttctgggactcaataaagaggggcagataatgaagggcaacagggtgaaaaaaaccaaaccttcctcacactttgtgcccaaacccatcgaggtatgtatgtaccgggagccctcattgcatgagatcggcgagaagcagggccgcagtcgaaagagctcgggaaccccaactatgaatgggggcaaggtcgttaaccaagatagcacgtag

SEQ ID NO: 4170 - DNA, 579 bp, Artificial Sequence
  Description of Artificial Sequence: Synthetic coding sequence
atggccctgctgcggaagagctacagcgagccccagctgaagggcatagtaacaaagctctactcccgtcaaggctaccatctgcagcttcaggccgatgggacgatcgacggcaccaaagacgaagactctacatacactctctttaacctaataccagtgggtttgagggttgtcgctatccaaggagtccagacaaagctgtacctcgcaatgaactctgaaggttatctatatacatccgagctcttcactcccgaatgcaaattcaaggagtcagtgttcgaaaattattacgtgacttactcatcaatgatttaccggcagcaacaatcaggacgggggtggtatctcggcctgaacaaagagggagagattatgaaggggaaccacgttaagaaaaataaaccagctgcccacttcctgcctaaacctctcaaggtcgccatgtataaggagccctcgttgcatgacctaacagaattcagtcgatccggatcgggtacaccgactaagagcaggagcgtaagcggggtgctgaatggcggtaagtccatgtcccacaacgaaagtacctag

SEQ ID NO: 4171 - DNA, 738 bp, Artificial Sequence
  Description of Artificial Sequence: Synthetic coding sequence
atggccgccgccatcgccagcagcctgatccggcagaagcggcaggcgcgagaaagggagaaatccaatgcctgcaagtgcgtctcctctccgagcaaagggaagacctcgtgcgacaagaacaaactgaatgtgttttctcgggtgaaactcttcggatccaagaaaagaaggcggaggaggcctgaaccccagcttaaagggatagttactaagctttattctaggcagggttaccatttgcagttacaggctgacggtaccatcgacggaacgaaggatgaagactcaacttatacgctcttcaacctcatacctgtgggcttgcgcgtggtggccatacagggagttcagacaaaactgtacctggccatgaattccgagggttacctctacacctcagagctgttcacgccagagtgcaaatttaaggaatctgtttttgagaactactacgttacctattcttctatgatctataggcagcaacagagtggtcgtgggtggtacctaggactgaataaagagggcgagatcatgaaaggcaaccatgtgaaaaaaaacaagcccgcagcccactttctccccaaacccctgaaagtcgccatgtacaaggagccttccctccatgatctgactgaattcagtcggagtggttcaggaactcctacaaaaagccgctcagtgtccggcgtacttaacggaggcaaatctatgagccataacgaaagtacctag

SEQ ID NO: 4172 - DNA, 768 bp, Artificial Sequence
  Description of Artificial Sequence: Synthetic coding sequence
atgagcggcaaggtgaccaagcccaaggaggagaaggacgccagcaaagtcctcgatgatgcgccccctgggactcaggagtacatcatgctgaggcaggattctatacagtccgcagagctgaaaaaaaaagagagtccttttagagccaagtgccacgagattttttgctgccctttaaagcaagtacaccacaaagagaatacggagccagaagaaccccagttgaaaggtattgttaccaaactgtactccagacaagggtaccatttacagctgcaggctgatgggaccatcgacgggacgaaagatgaggacagtacctataccttgtttaatttaattccagtgggattgagagtggtggccatccaaggggtacaaacgaagctctacttagcaatgaacagcgagggttacctgtacacgtccgagctttttacccctgagtgtaaatttaaggaaagtgtgtttgaaaactattacgtgacttatagttcaatgatctatcggcaacagcaatcaggtagggggtggtacctcggcctgaataaagaaggggaaattatgaagggtaatcatgtcaaaaagaacaagccagccgcccactttctgcccaaacctctcaaggtcgctatgtacaaggaaccatcactacacgatctgaccgagttctcccggtctggttccgggaccccaactaagtcacggagcgtcagcggtgtgctgaacgggggcaaatcaatgtcccataacgagagcacctag

SEQ ID NO: 4173 - DNA, 132 bp, Artificial Sequence
  Description of Artificial Sequence: Synthetic coding sequence
atgctgcggcaggacagcatccagagcgccgagctgaagaagaaggaatccccttttcgggcaaaatgccacgagatattttgctgtcctctgaagcaggtccaccataaggagaacactgaacccgagtag

SEQ ID NO: 4174 - DNA, 666 bp, Artificial Sequence
  Description of Artificial Sequence: Synthetic coding sequence
atgagcggcaaggtgaccaagcccaaggaggagaaggacgccagcaaagtactcgatgacgcaccaccaggaacacaggaatacattatgctgagacaggattccatccaaagcgcagaacttaaaaaaaaagagtcccccttccgggctaagtgtcacgagattttttgctgccccctcaagcaggtccatcataaggagaacaccgagcccgaagaaccccagctgaaaggcatagtgactaagctatacagtaggcagggataccacctccaactccaagctgacggcactatcgacggaacaaaggatgaagacagcacgtatactctctttaacttaattcctgtcggattgcgcgtcgtagccatccagggagtccagactaaattgtatctcgcaatgaattctgagggctatctgtacacctctgagctctttacacccgagtgtaaattcaaagagtccgtgttcgaaaattactacgtgacttatagctctatgatctaccggcagcagcagtctgggcgtggctggtacctaggtttgaacaaagagggggagatcatgaagggaaaccatgtcaagaaaaataagccagcagcccatttcctgcctaagcccctcaaggtggcgatgtacaaggaacctagcctgcacgactag

SEQ ID NO: 4175 - DNA, 681 bp, Artificial Sequence
  Description of Artificial Sequence: Synthetic coding sequence
atgctgcggcaggacagcatccagagcgccgagctgaagaagaaggagtcccctttcagggccaagtgccacgagatcttctgttgccctcttaagcaggttcaccataaggaaaatacagagccagaggaaccacaactgaaaggcattgtcactaagctatactcacggcagggatatcatttacagctccaggcagatggcaccattgacggcacgaaggacgaagactctacctacacactgtttaatcttatccctgtcggcctgagggtagtcgccatccagggcgtgcagactaaactttacctcgctatgaacagcgaagggtacttatacacctctgagctttttaccccggagtgcaagtttaaggaatctgtgttcgaaaattactatgttacatattcaagcatgatctacaggcagcagcagtcagggagaggatggtacctcggacttaataaggaaggggagattatgaagggtaatcacgtcaaaaagaacaagcccgccgcacatttcctgcccaaacccctaaaggtggcaatgtacaaggagccctctctgcacgatctgacagagttctctcgatctggatccggtacacctaccaaatcacgctctgtgtccggggtcctcaacggcggtaaaagcatgtcgcataacgagtcaacttag

SEQ ID NO: 4176 - DNA, 297 bp, Artificial Sequence
  Description of Artificial Sequence: Synthetic coding sequence
atgagcggcaaggtgaccaagcccaaggaggagaaggacgccagcaaggtgctggacgacgcccccccgggcacccaggagtacataatgctgaggcaagactccattcagagtgccgagctaaaaaagaaggaaagtccgtttagggccaagtgccacgagatattctgctgtcccctcaagcaggttcatcacaaagaaaatactgagcctgaagagcctcagctgaagggcatcgtgaccaagttgtatagtcgacaaggctaccacctccagctgcaggccgatggcacatag

SEQ ID NO: 4177 - DNA, 624 bp, Artificial Sequence
  Description of Artificial Sequence: Synthetic coding sequence
atgcggaccagcatgaagaaggtgggcatgcaccacctgagcagcagcggtggcagctactacctgatcctggacgacgctccacccgggacccaggagtatattatgctccgccaggactctatccaaagcgctgagttaaagaagaaagaatccccattccgcgcaaagtgccacgagatcttttgttgccctctgaagcaggtgcaccacaaagagaataccgagcctgaggagccgcaacttaaaggcattgtgacgaaactgtattctcgccagggctatcacctgcagctccaggccgacggaactatcgacggaacaaaagatgaagactccacttacactttgttcaacttgatccccgtgggcttgagagtggtagcgatccagggcgttcagactaagctgtacctagcaatgaatagcgaaggctacctgtacacaagtgagctgttcacaccagagtgtaagttcaaagaatccgtttttgagaactactacgtcacttattcatcgatgatataccgtcagcagcagagcggccgaggttggtacctgggactgaataaggaaggcgagatcatgaagggaaaccatgtaaagaagaataagcctgcttag

SEQ ID NO: 4178 - DNA, 600 bp, Artificial Sequence
  Description of Artificial Sequence: Synthetic coding sequence
atgagcggcaaggtgaccaagcccaaggaggagaaggacgccagcaaggagccacaactgaaagggattgttaccaaactgtacagcaggcagggttatcatctgcagctccaggccgacggcactattgacggcacaaaagatgaggactcgacttacacactattcaatctgattcctgtggggctgcgagtggttgctatacagggcgtccagacaaaactgtacctggccatgaacagtgaaggctacctttacacttccgagctcttcaccccagaatgtaagtttaaagagtctgtttttgagaactattatgtgacatactctagtatgatttataggcaacagcaaagcggcagaggctggtacttggggctgaataaagaaggcgagattatgaaggggaatcacgtgaagaaaaacaagccggccgcacacttcctcccaaagcccctgaaggtggctatgtataaagagccaagcctccacgacttaacagagttttccaggtccgggagtggtacccccacaaaatccaggagtgtctccggcgtgctgaacgggggcaaatccatgtcccacaacgaatccacttag

SEQ ID NO: 4179 - DNA, 759 bp, Artificial Sequence
  Description of Artificial Sequence: Synthetic coding sequence
atggtgaagcccgtgcccctgttccggcggaccgacttcaagctgctgttgtgtaatcacaaggacctcttctttcttcgtgtaagcaagctgcttgattgctttagtccaaaaagcatgtggttcctgtggaacattttttctaaaggcacccatatgctgcaatgcctttgtgggaaatcactgaagaagaacaagaatcctaccgacccccagctaaaaggcattgtgacacgcctctattgcaggcagggctactacctgcagatgcatcctgacggtgccctcgatgggaccaaggacgattccacaaattccaccttgttcaacctgatcccggtaggtcttcgcgttgtcgctatacagggtgttaaaacgggactctatatcgcaatgaatggagaaggatatctgtaccccagtgagcttttcacacccgagtgcaagttcaaggagtctgtttttgagaactactatgtcatttacagtagtatgctgtacagacagcaagaatcaggtcgggcttggtttttgggcctgaacaaagaagggcaggccatgaaagggaacagagtgaagaagacaaaacctgcagcccactttctgcccaagcccctcgaagtcgcaatgtatagagagcctagtctccatgatgtgggagaaacagttcccaaacccggtgtgaccccaagtaagagcacctctgcgtcagccattatgaatggcgggaagcccgtgaacaaatctaaaacaacatag

SEQ ID NO: 4180 - DNA, 744 bp, Artificial Sequence
  Description of Artificial Sequence: Synthetic coding sequence
atggccgccgccatcgccagcggcctgatccggcagaagcggcaggccagagaacaacattgggaccggccctccgcttccaggcggcggtcgtctccaagcaaaaaccggggactatgcaacggaaacctggtagacatcttctcaaaagtgagaattttcggtctgaagaaacgccgtttgaggcggcaggatccgcagttgaaaggaattgtgacccggctctattgccggcaggggtactacctccagatgcacccggatggcgccctggatggcaccaaagatgattccactaactcgaccctgtttaatctgattccagtcgggctgagggtggtggcaatccagggggtgaagactggcctctacatcgccatgaacggagaaggatacctgtacccctctgaactgttcactcccgaatgtaagtttaaagagtcagtgttcgagaactactacgtgatatatagctctatgctttacaggcagcaggagtctggccgggcttggttccttgggttaaacaaggagggacaagccatgaagggtaatagggtcaagaagacaaagcctgccgcccacttcctccctaaaccattagaggttgcgatgtacagggaaccctccttacatgatgttggagagactgtgcccaaacctggggtgactccgagtaaaagcacatctgcttccgcaatcatgaatggagggaaacctgtgaacaagtccaagaccacctag

SEQ ID NO: 4181 - DNA, 351 bp, Artificial Sequence
  Description of Artificial Sequence: Synthetic coding sequence
tgaatcctggagttcatcagcctggccgtgggcctgatcagcatccgtggcgtggactccggcctgtatttgggaatgaacgagagaggcgagctgtacggctctaagaagcttacccgcgaatgtgtattccgagagcaattcgaagagaactggtacaacacctacgccagcactttatataaacatagcgattctgagcggcagtactatgtcgcactgaataaggatggctccccacgggagggctaccggactaagcgacaccagaaatttacccatttcctgccaaggccagtggatcccagtaagctgccttctatgtcgagagaccttttccactatagatag

SEQ ID NO: 4182 - DNA, 651 bp, Artificial Sequence
  Description of Artificial Sequence: Synthetic coding sequence
atgggcgccgcccggctgctgcccaacctgaccctgtgcctgcagctcttgatattgtgttgtcaaacccaaggtgaaaatcatccctctcctaatttcaatcaatacgtgcgggaccagggggcaatgaccgaccagttgtcaagaagacagattcgcgaataccagctgtattcaaggacatccggcaaacatgtgcaggtgactggaaggcggatctctgccaccgcggaagacggtaataaatttgccaagctgatcgttgaaacagacacgttcggatccagagtgagaattaagggagccgaaagtgagaagtatatctgcatgaacaaaaggggcaagctcatcggaaagccatccggaaagtcgaaggattgtgttttcaccgaaatcgtgttggagaataattacactgcattccaaaacgcccgccacgaagggtggttcatggcatttacgaggcagggacgcccgaggcaagctagccgttcgaggcagaaccaaagagaggcccactttattaagaggctgtatcaggggcagctgcctttcccaaaccatgcagagaagcagaaacagtttgagttcgtgggtagcgcaccaaccaggcgtacaaagcgtaccaggcgcccccaaccactgacgtag

SEQ ID NO: 4183 - DNA, 618 bp, Artificial Sequence
  Description of Artificial Sequence: Synthetic coding sequence
atgggcgccgcccggctgctgcccaacctgaccctgtgcctgcagctgctgatcctgtgttgtcagacacagtatgtccgggatcagggggccatgacagaccagctttcacggagacaaatacgggagtatcagctgtacagcagaacttctgggaagcatgtgcaggtaaccgggaggaggatcagcgccactgccgaagacggcaataaattcgccaaactgatcgtggagactgatactttcggcagtcgcgtgcgtattaaaggcgccgagtctgaaaagtacatctgcatgaacaagcggggaaagctcatcggaaaacctagtgggaaatctaaggactgtgtttttacggagatcgttctcgaaaacaactacacggcctttcagaatgcccgccacgaaggctggttcatggcctttacccgccagggccgaccaagacaggcctcccgttcccggcagaatcagcgagaggcccatttcattaaacgcctgtaccaaggccagcttccattccctaaccatgcagagaagcaaaagcagtttgagttcgttgggagtgctcccacgcgccgaactaaaagaacgcgccgacctcagccgctcacctag

SEQ ID NO: 4184 - DNA, 624 bp, Artificial Sequence
  Description of Artificial Sequence: Synthetic coding sequence
atgtacagcgcccccagcgcctgcacctgcctgtgcctgcacttccttctcctgtgcttccaggtccaggtcctggtggctgaagagaatgtcgacttccggatccacgtggagaaccagacaagggctcgcgatgacgtctctcgaaagcaactgcgactgtatcagctatacagtcgaacaagtggtaaacatatacaggtgctgggccgcaggattagcgctcggggggaggacggcgacaagtatgcacagctactcgtcgaaacagacacttttgggtcacaggtccgcatcaagggcaaggagactgaattctatctgtgcatgaacagaaagggtaaactggtggggaagccagacggcacttccaaggaatgtgtattcatagaaaaggtgctagaaaacaactacacagcactgatgtctgctaaatatagcgggtggtatgttggatttactaagaaaggccgtccccggaaaggaccaaagactagggagaaccagcaggacgtgcactttatgaagcgttacccaaagggccagccagaacttcagaaaccgttcaagtacactacagtcacaaagaggtcgcggcgcatccggccgacacatcccgcttag

SEQ ID NO: 4185 - DNA, 651 bp, Artificial Sequence
  Description of Artificial Sequence: Synthetic coding sequence
atgcggagcggctgcgtggtggtgcacgtgtggatcctggccggcctgtggttagccgtggccggccgccccctggcttttagcgacgcaggcccacatgtgcactacggatggggcgaccccatccggctgcggcatctgtacacctcaggcccgcatggtttgtcctcatgcttcctgcgcattcgcgcggacggggtcgtcgattgcgctcgagggcagtctgcccactctttactcgagattaaggctgtggctctccgcaccgttgcaattaagggcgtgcattctgtgcggtacctctgtatgggagcggatggcaagatgcaggggctgctccagtattcagaggaagactgtgcgttcgaagaagagatccgacctgacggttacaacgtttatcgctccgaaaagcatcggttacctgtttcgctttcctctgcgaaacagcgccaactctacaaaaatcggggattcctgcccctctcacacttcttgccaatgctgcccatggtccccgaagaacctgaggatcttcgggggcatcttgaaagtgacatgttctcatcacccttggagaccgattccatggatcccttcggcctcgttactggtctggaggctgttagaagcccaagttttgagaaatag

SEQ ID NO: 4186 - DNA, 636 bp, Artificial Sequence
  Description of Artificial Sequence: Synthetic coding sequence
atggcccccctggccgaggtgggcggcttcctgggcggcctggaggggctgggccagcaggttggctcacatttcctgcttcctcctgcgggggaaaggccacctttgcttggcgaacgtcgtagtgccgcagaacgaagtgctaggggcggcccgggcgctgctcaacttgctcacttacacggtatactgcggcgcagacagctctactgcagaaccggctttcatctgcagatcctacccgatggctctgtgcagggcacccgacaggaccactcgctgttcggcatcttggaatttatctccgtagcagttggactcgtgagcatacgcggcgtggattctggcctgtatctgggcatgaacgacaaaggcgagctttatgggtcagagaagctgacgtcagagtgtatcttccgggaacagttcgaggaaaactggtataatacgtattcttctaacatttacaagcacggcgatacagggaggcgctactttgtggcactgaacaaggatggcacaccgagagatggagcccgatctaaaaggcaccagaagtttacccactttctgccacgtccagtggatcccgagcgcgtgccagagctgtataaagacctgctaatgtacacatag

SEQ ID NO: 4187 - DNA, 237 bp, Artificial Sequence
  Description of Artificial Sequence: Synthetic coding sequence
atggcccccctggccgaggtgggcggcttcctgggcggcctggagggcctcgggcaacaggttgggagccacttccttctgcccccagcaggagagcggccccctgccgcgctgttaccccaccgactacctcccgcagatcctgccagacggcagcgcgctggtcacccagccggaccccagcctctgcgctacctgggcatccaccagtgcggctcaggcaccggccagtattag

SEQ ID NO: 4188 - DNA, 390 bp, Artificial Sequence
  Description of Artificial Sequence: Synthetic coding sequence
atgggcgaccccgtggtgaccgagacccccaccctgctgggcctgcctgaacagagacgggcggcagttcggcacgtgaacaaaggggctggaatcctggaaatccgatcagtacacgtgggcgttgtggtgatcaaggcagtctcatccggcttctatgttgccatgaatcgccgcggtaggctgtatgggtcacgactatataccgtggattgccggttcagggagcgaattgaagagaacggccataacacatatgccagccagcgctggagaagaagagggcagcctatgttccttgcgctggaccggaggggcggaccgaggccggggggtcgaacgcgtcggtaccacttaagcgctcactttttgcccgttctggtgtcctag

SEQ ID NO: 4189 - DNA, 579 bp, Artificial Sequence
  Description of Artificial Sequence: Synthetic coding sequence
atgggcacctggatcctgttcgcctgcctggtgggcgccgccttcgccatgccgcttcccccgcaccccggacaccccggatacataaacttcagctacgaagtgctcaccccactgaagtggtatcagagcatgatccgaccaccctactcctcttacggctatgagccgatgggagggtggctgcaccatcagatcatcccagtggtgagccagcaacaccctcttactcacactctccagagtcatcaccatatccccgtcgtgcccgctcagcagccgagggtgcgccagcaggccctgatgccagttccaggtcagcaaagtatgactcctactcagcaccatcagcccaacttgccgttgccggcacagcagccttttcaacctcagccggtgcagccacagccgcaccagccaatgcagccccagccacctgtccagcccatgcagccactccttcctcagccccctctgcctccgatgtttccactgcggccgctgccccctatcttgcctgatcttcacctggaagcctggcccgccactgacaaaaccaaacaggaggaggttgattag

SEQ ID NO: 4190 - DNA, 756 bp, Artificial Sequence
  Description of Artificial Sequence: Synthetic coding sequence
atgctgggcgcccggctgcggctgtgggtgtgcgccctgtgcagcgtgtgttcaatgtccgtccttagagcctaccccaatgccagcccgttgctgggatcatcatggggcggcctaattcacctgtacacagcaactgctaggaacagctatcacctccagatccacaaaaacggccacgtcgacggcgccccacaccagaccatttattctgcgcttatgatacggtcggaagacgctgggtttgtggttatcaccggagtcatgtcccgcagatacctttgcatggatttccggggaaacatttttggcagccattatttcgatcccgagaactgcaggtttcagcaccagactctggaaaacgggtacgacgtctaccactctccacagtatcactttttggtaagtttgggtagagcgaagcgcgcattcctgccgggcatgaaccctcctccttattcccagtttctgtctcggaggaacgagattcccctcatccacttcaacacaccaattccacggaggcacacgcggtccgcagaggatgatagcgaacgggatcccttgaatgtactgaagccaagagccagaatgaccccggctcctgcgagttgttctcaggaactcccaagtgcagaagacaattccccaatggcctcagatccactcggcgtcgtgcgcgggggaagggtcaacacgcatgccggcggcacagggcccgaggggtgccgtccctttgccaagttcatctag

SEQ ID NO: 4191 - DNA, 720 bp, Artificial Sequence
  Description of Artificial Sequence: Synthetic coding sequence
atgggcctgatctggctgctgctgctgagcctgctggagcccggctggcccgctgccggccccggtgcaagactcaggagagacgccggaggaaggggcggagtatatgaacacctgggtggggcaccccggagacgaaagttgtattgtgccaccaaataccaccttcagttgcacccatctgggcgtgtcaacggcagcctggaaaatagcgcctacagtatcctggaaatcacggccgtggaggtgggcatcgttgctattcgtggcctcttctctggcagatatctggcaatgaataagcgcggtaggctatatgccagcgagcactatagcgctgaatgcgaatttgtagaaaggatccacgagctgggttacaacacctatgcctcacggctgtataggactgtgagctccactcctggggcccgcagacagccatccgcagagaggctctggtacgtatccgtcaatggcaaggggaggccccggcggggatttaagactcgccgtactcagaaatctagcctcttcctcccgagggtactggaccaccgggaccatgaaatggtgaggcaactgcagagcggattgccccgcccacccggcaaaggagttcagccccgtcgccgccggcaaaagcagtctcccgacaacctggagccgtcccacgtacaggctagcagactcggttcacagctcgaagctagcgcccattag

SEQ ID NO: 4192 - DNA, 621 bp, Artificial Sequence
  Description of Artificial Sequence: Synthetic coding sequence
atgagcggccccggcaccgccgccgtggccctgctgcccgccgtgctgctggccttgctagccccctgggctggacggggtggggctgcagcaccaactgcccccaacggaacactggaagccgagttggagcggcgctgggagtctctggtggcattgagtttggcacgactgcctgtggccgcacagccaaaggaggcggccgtccagtcaggtgccggcgattatctgctcgggatcaaacgtctacgccggctgtactgcaacgtggggattggcttccatctgcaggcgctgccagatggtcgcatcggcggagcacacgcagatacccgcgacagcctgcttgaactctcacccgtcgagcgcggggtggtttctatcttcggtgttgcttcacgcttcttcgtcgccatgtcgagtaaggggaaactttacggcagtccatttttcacagatgaatgcacatttaaagagatccttcttcccaataattacaacgcctatgaatcatacaagtatccaggcatgttcatagctctctctaaaaatggcaaaacgaagaagggcaaccgcgtgtctccgactatgaaggtcactcacttcctacccagactgtag

SEQ ID NO: 4193 - DNA, 807 bp, Artificial Sequence
  Description of Artificial Sequence: Synthetic coding sequence
atgagcctgagcttcctgctgctgctgttcttcagccacctgatcctgtctgcttgggcccatggagagaaacgactggcaccaaagggccagccggggcccgctgcaacggaccgaaatcctcgtgggtcttcttctcggcagtcctcgagcagcgcaatgagttcctcttcggccagtagctcaccagccgcctcgctaggaagccaagggtcaggactggaacagtcctcctttcagtggtcaccatccggacgcaggacagggagtctgtactgccgtgtcggaatcggcttccacttgcagatttaccctgacggaaaagtgaacggttcccacgaggccaatatgctatcagtcctcgaaatctttgctgtgagccagggaattgttggcattcgtggagtcttttccaacaaatttctcgcaatgagcaagaaagggaaattgcatgctagtgcaaagttcacagacgattgtaagtttcgggaacgatttcaggagaatagttacaacacctatgcatccgctattcatcggacggagaaaacagggagagagtggtacgttgctctgaataaacgtggcaaggctaagagagggtgcagccctagggtgaaacctcagcatatcagtacccacttcttgcccagatttaaacaatccgagcagccagagctttccttcacagtgactgtgcccgaaaaaaagaagcccccatctcccattaaacctaagatcccgctgtctgccccccgcaaaaatacgaactccgtaaagtaccgactgaagttcaggtttggatag

SEQ ID NO: 4194 - DNA, 372 bp, Artificial Sequence
  Description of Artificial Sequence: Synthetic coding sequence
atgagcctgagcttcctgctgctgctgttcttcagccacctgatcctctctgcctgggcacacggtgaaaagcgcctggcccctaaggggcagcctggcccggccgccacagatcggaaccctagaggaagcagtagccggcaatccagttcatccgctatgtcctcaagctctgcttcgagttctcctgccgcttctctggggagccagggatctggactggaacagtcctctttccagtggtcaccaagtggccgtaggacagggagtctttattgcagggtaggcatcgggttccacctgcagatttatccagacggaaaggtgaatggaagccacgaggccaatatgttgtcacaggttcataggtag

SEQ ID NO: 4195 - DNA, 855 bp, Artificial Sequence
  Description of Artificial Sequence: Synthetic coding sequence
atgccccggtacgcccagctggtgatgggccccgccggcagcggcaaatccacatattgtgcgactatggtgcagcattgcgaggccctgaaccggagtgtgcaggtcgtgaatctggacccagcggcggaacatttcaactacagtgttatggccgacattcgggaactaatcgaagtggacgatgtgatggaggatgattcactcaggttcgggccgaatggagggctcgtgttttgtatggagtacttcgccaacaattttgattggctggaaaattgcctagggcacgtcgaagatgattacatcctgtttgactgcccaggacagattgaactatacacccacctccccgtcatgaagcagctcgtgcaacagctcgagcagtgggaattcagagtgtgcggggtctttcttgtggactcgcagtttatggtcgaaagttttaaattcattagcggcatattggctgctctctccgccatgattagtcttgagatcccgcaggtgaacatcatgaccaagatggatttattgtccaagaaagctaagaaagaaatcgagaagttcctcgacccagatatgtactctctccttgaagatagcacctctgatcttcggtcaaagaagttcaaaaaactgactaaagccatatgtggactgattgacgattatagcatggtcaggtttctcccttacgaccagagtgatgaggagagcatgaatatcgtcctccagcatatcgactttgccatccaatatggagaggacctcgagttcaaggagccaaaagagcgcgaagacgagtcctctagtatgttcgatgaatactttcaggagtgccaggacgagtag

SEQ ID NO: 4196 - DNA, 735 bp, Artificial Sequence
  Description of Artificial Sequence: Synthetic coding sequence
atgggcagcccccggagcgccctgagctgcctgctgctgcacctgcttgtcctgtgcctgcaagcacaagagggaccaggtcgcgggccagccctggggagggaactcgcatcgctgtttagggccggcagggaaccacaaggcgtttcacagcaagttactgtccagtctagccctaacttcacacagcacgtgcgagaacagtctctggtaacagatcagctgtctcgccgactcattcgtacttaccagttgtactctcggacttccggcaagcatgtccaggttctcgccaacaaacggataaacgctatggccgaagatggggaccccttcgctaaactgattgtagaaaccgacacattcggatcccgcgtgagggttcggggagctgaaacaggtctgtacatttgcatgaacaagaagggaaagcttatcgccaaaagcaatggtaaaggcaaggattgtgtgtttactgagattgtgttggaaaacaattacacagcccttcagaatgcaaagtatgagggttggtacatggcttttacgagaaaggggagacccagaaaagggagtaagactcggcagcaccagcgagaggttcattttatgaagaggcttccacggggccatcataccacggagcagtctttacggttcgagtttctgaattacccacctttcacacgctcattacgcggctcccaaaggacatgggcaccagagcccagatag

SEQ ID NO: 4197 - DNA, 702 bp, Artificial Sequence
  Description of Artificial Sequence: Synthetic coding sequence
atgggcagcccccggagcgccctgagctgcctgctgctgcacctgctcgtgctatgcctgcaggcccaagaaggccccggccgaggtccagccctcgggcgcgagctcgcctcgctgttcagggccggacgtgagcctcagggggtgtcgcaacagcacgtcagagagcagtcactcgttaccgatcaactaagtagaaggctgatcagaacctaccaattgtactccaggacctccggcaagcacgttcaggtgctggccaataagcgcatcaacgctatggccgaagatggggatcccttcgccaaactgattgtggaaactgacacctttggatccagagtccgagtaagaggcgctgaaacaggactatacatttgcatgaataaaaagggaaaactcatcgcgaaatctaacggtaaggggaaagattgcgtgttcacagaaatagtgcttgagaacaattacacggcattgcagaatgcaaaatacgagggctggtatatggcctttacacgaaagggtcggccgagaaaagggtctaaaacccgtcagcaccagagagaagttcacttcatgaagcgcttgcctcgggggcatcacactacggaacaaagccttcggttcgaattcctgaactacccgcctttcacgcgaagcctcagaggatctcaaagaacatgggcccccgaaccaaggtag

SEQ ID NO: 4198 - DNA, 615 bp, Artificial Sequence
  Description of Artificial Sequence: Synthetic coding sequence
atgggcagcccccggagcgccctgagctgcctgctgctgcacctgctggtgttgtgccttcaagcccaacatgtgagggaacagtcactcgtgacagaccaactgagcagacgccttattcgtacctatcaactatactccagaacatcaggaaagcacgtccaggtattggccaataagcgcatcaatgctatggcggaagatggagatccctttgccaagttgatcgtcgagaccgacactttcggcagtagggttcgagttagaggtgctgaaacagggctgtatatctgcatgaacaaaaagggcaaactcatcgctaagtccaacggaaaaggcaaagactgtgttttcaccgaaatcgtactggagaacaactacaccgccctgcaaaacgcaaaatatgagggctggtacatggcattcacaaggaaagggcgacctcggaaggggagtaagacacggcaacatcagcgggaagtgcatttcatgaaaaggttaccacggggtcatcatacaacagagcagtcactgagattcgagttccttaattatccgccctttaccaggagcctcagaggtagccagcggacatgggccccagagccccgatag

SEQ ID NO: 4199 - DNA, 648 bp, Artificial Sequence
  Description of Artificial Sequence: Synthetic coding sequence
atgggcagcccccggagcgccctgagctgcctgctgctgcacctgctcgtgctgtgcctccaggcgcaggtcacagtgcagagcagtccaaatttcacccagcacgtgagggagcagtctttagtcactgaccagttaagccgacggctcataaggacttatcaactgtacagccgaacgagcgggaagcacgtgcaagtgctagctaataaaagaataaatgccatggcagaggacggagatcccttcgcgaaattgatcgttgagactgacacttttggaagtcgcgtgcgagtgcggggagcagagaccggactctacatttgcatgaacaagaaggggaagctcattgccaagtccaacggcaaaggtaaggattgtgtctttactgagatagtgctggaaaataattatacagcccttcaaaacgccaagtacgaaggctggtatatggctttcacgcgaaaaggccgcccacggaaggggagtaagaccaggcaacaccagcgggaggtacattttatgaagaggctgccgagaggccaccacaccacggaacagagtcttcggttcgaatttcttaattatccaccctttacgcgctcacttcgcggttcccaaaggacgtgggctcctgagccccggtag

SEQ ID NO: 4200 - DNA, 627 bp, Artificial Sequence
  Description of Artificial Sequence: Synthetic coding sequence
atggcccccctgggcgaggtgggcaactacttcggcgtgcaggacgcggtgcccttcggaaacgtgcccgtgttaccggtggacagccctgtgctattgtccgaccatttgggtcaatctgaagctggagggctccccagaggcccagccgtcactgacttagaccacttaaagggaatcctcagacggcggcagctgtactgccgcactggattccatctagaaatctttccaaacggcaccatccagggcacaagaaaagaccatagcagatttggcattctggagttcatctccatcgctgtggggctcgtgtctatccgtggtgtggatagtggactctacctgggcatgaatgaaaaaggggaactgtatggttccgaaaagttaacccaggagtgcgtgttccgcgagcaattcgaggagaactggtacaacacatattcctcaaacctctacaagcacgttgacacaggccgaagatactatgtcgcccttaacaaagatggaacaccccgggagggtacgcggactaaacggcaccaaaaattcacccattttctcccccgaccagtagatccggacaaagtgcccgagctctacaaagatatcctaagccagtcatag

SEQ ID NO: 4201 - DNA, 7176 bp, Artificial Sequence
  Description of Artificial Sequence: Synthetic coding sequence
atgaccgacctgctgcggagcgtggtgaccgtgatcgacgtgttctataaatacactaaacaagatggtgagtgtggaaccttgtccaagggggaacttaaagaattattggagaaggaactgcacccagtcctaaaaaatcccgatgatcctgataccgtagatgtgatcatgcacatgttagatcgggaccacgaccgccgactggatttcaccgaattcttgctcatgatctttaagctgaccatggcgtgtaataaagtactgtccaaggagtactgtaaggcctcaggctccaaaaagcatcgccgcggacatagacaccaggaagaggagtctgagacggaagaagatgaggaagatacccctggtcataagagtgggtatcgtcacagcagctggtccgagggcgaagaacacgggtattcatctggacatagccgcggcacggtgaagtgtcgtcatggttccaactcccggcgactgggtaggcaaggaaacttgagttcgtcaggaaaccaagaggggtctcagaagagataccacaggtcgtcatgcggacattcttggagcggggggaaggatcgacacggctcgtcctccgtggaactgagagaacggatcaacaaaagtcacatcagcccatcccgggaatccggtgaagaatacgaatccgggtccggctccaacagttgggaacggaaaggccacggaggcttaagttgtggcctggagacaagtgggcacgaaagcaactccacgcagtcccgcatcagggagcagaagctgggaagctcatgctccgggtccggcgattctgggcgacggtcacacgcctgtggatattctaatagcagtggctgtggacggccccagaacgccagctcatcctgccagagtcacagattcgggggacagggtaaccagttctcatacatccaaagtggctgtcagtcagggatcaaaggcggccagggtcatggatgcgtgagtggcggacagccctccggctgcggccaaccagagtccaatccctgttcacaaagctacagtcaaaggggttacggagccagggagaatggacagccgcagaactgtggcggtcagtggcgcacgggctcaagtcagagctcatgctgcggccagtatggaagcggtggctcccaatcctgtagtaatggccagcacgaatatggcagctgtggcaggtttagcaattccagttcttccaatgagttttcaaagtgtgatcaatatgggtcgggctctagtcagagtacgagctttgagcagcacgggactggcctcagtcagtcctcgggcttcgaacagcacgtgtgtggatctggacagacatgtggacagcacgaatccacttcatctcagtctctgggctacgatcagcatgggtctagctcggggaaaacttccggattcggacagcacggctctggtagtggtcaaagttcaggtttcggccagtgcggctctgggtcgggtcaatcctcagggtttggccagcacggatcagtgtccggtcagagttccggttttggacagcacggctccgtctccgggcaatcatcaggattcgggcaacatgagtcgcgttctcgccagtcgagctacggccagcacgggagcggtagttctcagagcagcgggtatggacagtacggcagccgagagacgtcgggattcggtcagcacgggcttgggtccggccagagcacagggttcggtcagtatggcagtggtagcggacagagctcagggttcggccagcacggctccggaagtggacagtcttccggcttcggacagcatgaatcccggagcggccagtcgagctatggacagcacagttcagggtcttctcagtcttctggctatggacagcacgggagccggcagacttcaggatttggacaacacgggtcgggaagtagccagagcactggattcggccagtatggtagtggcagcggccaatccagcggctttggtcagcatgtgagcggctcgggccagtctagtggctttggccagcatgaatcaagatctggacacagctcttacgggcagcacggattcggtagcagccagtcatccggctatgggcaacacggatcctcctcaggccagacatctggtttcggacagcacgagctgtcatcgggccaatcgagctctttcgggcagcatggttccgggagcgggcagagtagtggttttggtcaacacggctccggctctggtcagtcctcgggattcggccagcatgaaagccgcagtgggcagtccagctacggccagcactcttccggaagcagccagtctagcggctatggccaacatggaagccgacagacaagcggatttggccagcacgggagcggatcttcccagtcaaccgggttcggacagtacggtagtggaagcggccagtccgcaggattcggacagcacgggagtggatccggccagtccagtgggttcggccaacatgaaagtagaagccaccagagtagctacggccaacatggctccggctccagccaaagtagtggatatggtcagcacggaagctcatccggacagaccagcggctttggacagcatcggtcttcttctggccagtactcagggttcggacagcacggatcgggctccggccaaagtagcggcttcgggcagcacggcaccggcagtgggcagtactctggttttggacagcatgagagccgttcacaccagtctagttatggtcaacatggcagcggatcttctcagtcctccggctacgggcagcatgggagttcatccggccaaacgtttggatttgggcaacacaggagcgggtccggccagtctagtggctttggacagcacgggtccggctcaggacagtcttctggcttcggacagcatgagtcaggctctggcaaaagcagtggctttggccagcacgagtcacgtagcagccagtccaactatgggcagcacggctcaggatccagtcaatcctctggctatgggcagcatggttcatccagcggccaaactacagggtttggacagcacagatcttcttctggacagtacagcggtttcggccagcacggtagcggctcggatcagagcagtggctttggccaacacggaaccgggagcggccagagctccggttttggccagtatgagagtcgctcgaggcaaagcagctacggacagcatggatctgggtcatcccaaagctcaggctacggccaacacggaagcaacagtggtcagacttctgggtttgggcagcaccgcccagggtctgggcagtcttctggattcggccagtatggaagtggcagtggtcagagttctgggttcggtcaacacggtagcggcaccgggaaatcttcggggtttgcccaacacgaatatagaagtgggcagtcgagctatggtcaacacggcaccggatcaagccagtcaagcggctgcggccaacatgagagcggatcagggcctaccacaagcttcggacagcatgtgtcaggctcagataacttctcctcatcaggccaacacatttccgattcggggcagagcactgggttcggacagtatggttccggcagtggtcagagcaccgggctgggtcaaggcgaatcacaacaggttgagtctggctctacagtgcacggacggcaggagaccacacatggacagaccatcaatactaccagacacagccaatcaggccaaggccagtctacccaaaccggtagtagagtcaccaggaggcggcggagcagtcagagcgagaacagcgactctgaagtgcacagtaaagtttcacatcgacattctgagcatattcacactcaagccggtagccattatccgaaaagtggatctaccgtccgcaggagacaggggacaactcatggtcagaggggagacacgacaaggcacgggcatagcgggcatggacagagcacccagacagggagccgcacctccggacgccagcgtttttcgcattccgatgcgacagactcagaggtgcactctggtgttagtcacaggccgcactcacaggagcaaacccatagtcaagccggctctcagcacggggaatctgagagtactgtgcacgagaggcatgaaacaacatacggacagaccggtgaagccacaggacacggccatagcggccacggccagtccacacagaggggttctagaacgacgggacgtaggggttcgggccactctgagtcctctgattcagaggtgcactccggtggaagtcatcgcccccagtctcaggagcagactcacggccaggccggttctcagcacggcgagtccgggagcactgtgcacgggaggcatgggaccacacatggacagacgggggatacaacgcgtcatgcacattaccaccatgggaaaagtacgcagcgggggagcagcaccactggacgtagggggagtggccattcagagtcgagcgactctgaggtgcacagtggcggatcacatactcacagtggacacacccacggtcagagcggaagccagcacggcgagagcgaaagtattatccatgataggcatagaatcacacatgggcagacgggggacacaacaaggcattcatactctgggcatgaacagacaacccagaccggctctagaactacggggcgacagcggacctctcactctgagtcaacagactccgaggtgcacagtgggggaagtcataggccccacagtagggaacatacgtacggtcaggcagggagccaacacgaggagcccgagtttaccgtacatgaaagacacggtaccacacatggccaaatcggtgacaccacaggccatagtcactcaggccatggtcagagcacccagagggggtcccgaacaaccgggcgacagcggtcctcccactccgaatcctccgatagcgaggtacacagtggtgtcagccatacccacacaggccatactcatggacaggccggcagtcagcacgggcagtcagagagcattgtgccagagcgacacggcaccacccacggacagaccggcgacacaactcgtcacgctcactaccaccatggtttgactacacagacagggagccgaactactggacgccgggggagcggacatagcgagtacagcgatagtgaaggatacagcggcgtgtctcatacgcatagtggtcacacccacggtcaggctcgcagccagcacggtgagagcgagtctattgtgcacgaaaggcacgggacaatccacgggcagactggagacactacgcggcacgcacacagcggccacggacaaagcacacagacggggtcacgaaccactggccgcaggagctccggacattccgaatactctgattctgaaggccactctgggtttagtcagcgaccgcactcgcgaggacatacccacggacaggccggcagccagcacggcgaatctgagtcaatagtcgatgagcgccatggcacaacacacggacagacaggcgatacctctggccacagtcagtccggccacggacagagtactcaatcagggagctctacaacagggcgaaggcggtccggacattcggaatctagcgacagtgaagttcactctgggggaagccatacgcattcagggcatacccacagtcaggctcgctcccaacacggcgaatctgagtccacggtacataaacgtcaccagaccacccacgggcagaccggagatactacagagcatggtcacccatcacatggacagactattcagacaggttccaggacgactggcagaagaggttccggccactccgaatactccgatagtgaaggcccgagtggggtatcgcacactcactctggacacacgcacggccaggccgggtcccactaccccgaatccggcagtagtgtacacgagaggcacggcaccacacacgggcaaaccgccgacactacacgtcatggccacagtggccatggtcagagtacgcagagaggcagtcgtaccaccggacgacgggcttctggtcactcagagtacagtgactctgaagggcactctggggtcagccacacacactcggggcatgctcacggacaggccggatcccagcatggagaaagcgggagctccgtccacgagcgacacgggactacccacgggcaaaccggggatacgacccgacacgcccactccggtcacggacagagcactcagcggggatcaaggacagctggaagacgcggcagtgggcactctgagtcatccgacagtgaggtgcatagtggagtaagccacacgcacagcggccacacctacggacaagcgcggtcccaacacggagaatccggcagtgccatacatggcaggcagggaaccatccatggtcagaccggggacacaactaggcatggtcagtctggacatggccagtccacccagactggcagtcgaaccaccggtcgacagcggtcctcccatagcgaatcctccgacagtgaagtgcatagcgaggcaagtccaactcacagcggtcatacccattcacaagccggatcacgccatggacaatcaggctcatctggccacggacgacagggcacaacccatggccagacgggtgataccactcgacatgcccactacggctacggccagtccacacagcggggttcacgtacgactggaaggagaggttccggacacagtgagtcctcggactccgaagtgcacagttggggctctcatacgcacagtggacacatccaagggcaagcaggtagccagcagagacagccaggctccacagtgcatggtcgtctggagacaactcacggccagaccggagatactaccaggcacggtcactcaggctacggccagtcaactcagactggaagcaggtcaagtcgggcatcccattttcagtcccacagttctgagaggcagcggcacggctcttcacaggtatggaagcacggcagctacgggccagctgagtatgattatggccacactggctacggtcccagcggaggatctaggaaatccatctctaattctcatctgtcatggtctacagattcaaccgcaaataaacagttgagtaggcattag

SEQ ID NO: 4202 - DNA, 2856 bp, Artificial Sequence
  Description of Artificial Sequence: Synthetic coding sequence
atggccaccggcaccggcaagcacaagctgctgagcaccggccccactgagccctggtccattcgcgaaaagctctgtttggcctctagcgtcatgcgaagtggggaccaaaactgggttagcgtatctcgggccatcaaaccttttgccgagccagggcggccccctgactggttttcccagaaacactgtgcaagccagtactctgagttgctggagacaactgaaacacccaaacgaaaacgaggggaaaagggcgaggtggtggagactgtcgaggacgtgattgtgcgcaaattgacggcggaacgggtcgaggaattgaagaaagtgatcaaggaaacacaggaacgctaccggagactcaagcgcgacgcagagttgatacaggccggacacatggatagccggctcgacgagctatgtaacgacatcgctaccaaaaaaaaactggaggaggaagaggccgaggtaaagaggaaagctaccgacgccgcatatcaggctagacaggcagtgaaaactccaccaagacgccttccaacggtgatggtgcggtccccgatcgatagcgcgagtcctggaggtgattaccctctgggagacctgacccccacaacaatggaggaggccacatctggagtgacaccaggaaccctgccttccactcctgttacgtcttttcccggaatcccagatactctgccccccggctccgctccactggaagccccaatgacccctgtaaccgacgattcgccccagaaaaagatgctcggacagaaagctacgccacctccgagccctcttttgtctgagctgcttaagaaagggtcacttctgccgacaagccccagactcgtgaatgagtccgagatggccgtggcctccggccacctaaattcaactggggtgctcttagaggtgggcggagtcctgccaatgatacacggcggagagattcaacaaacccccaacactgtggccgctagtcctgctgccagcggggcccctacactgtctagattgctggaggctggtccgacccagttcaccacccctttagcttcattcacgaccgtcgcaagtgagccaccggtaaagctggttcctcctccagtggaatcagtgtctcaagccaccatcgtgatgatgcctgccctgccagctccctcctcagctccggcagtctccacaaccgagtctgtggccccagtcagccagcccgacaactgcgtcccgatggaggctgtgggtgacccacatacagtgacagtctcaatggattcttctgagatctcgatgatcattaactctattaaggaagaatgtttccggtctggagttgcggaagcccctgtggggagcaaagccccttcaatagatggcaaagaggagctggatctcgctgagaaaatggacattgccgtttcatacactggcgaggagttagatttcgagacagtgggcgacattatagccataatagaagataaggtggacgatcaccctgaggtgcttgatgtggccgctgtggaagccgccttgtccttctgcgaggagaatgatgacccacagtctctccccgggccatgggagcaccccattcagcaggagcgggacaaaccggtcccactgcctgcacccgaaatgacggtaaaacaggaacgcctcgattttgaggaaacggagaacaagggcatccacgagcttgtagacattagggagccatctgccgaaattaaggtggaaccagctgagcctgagcctgtgatcagtggggccgaaattgtggcaggggtggtccctgcgactagtatggagccccccgagctgcggagccaggacttggacgaagagttaggctcaaccgcggccggagagattgtggaggcggacgtagcgatcggtaaaggcgatgaaaccccactgaccaatgtgaagacagaagcgtcccctgaatctatgttgagcccaagccacggctccaatcctattgaggatcctcttgaagccgagactcagcataaattcgagatgtctgatagcttaaaggaggagagtggaacaatcttcggcagccagatcaaagacgccccaggcgaagatgaggaggaagacggtgtgagtgaggccgcaagcctagaggagccaaaggaggaggatcagggagagggctatttatcagaaatggataatgagccccctgttagtgaaagtgacgatggcttcagcatccataacgccacactccagagtcacacactggcagatagcatcccatcttctcctgccagcagccagttcagcgtgtgctctgaagatcaggaagctatccaggcccaaaaaatttggaagaaggccattatgctggtctggcgtgctgctgccaatcaccgatacgcgaatgtctttcttcagcctgtaaccgacgacattgccccaggctatcactcgattgtgcagaggcctatggatcttagcactatcaagaaaaacatagaaaacggcctgataaggtcaaccgcagaattccagcgagacatcatgctcatgtttcagaacgccgttatgtacaacagtagcgatcacgacgtctaccatatggctgtggagatgcaacgcgatgtgttagagcaaatccaacaatttctcgccacccagcttatcatgcagacttctgagtctggcattagcgcaaaatccctccgtggtcgcgactccacaagaaagcaggatgcttctgaaaaagactcagttccaatgggctctcccgccttcttactgtctctgttcgacggcggtacgcggggccgccgctgtgctattgaggctgatatgaagatgaagaagtag

SEQ ID NO: 4203 - DNA, 627 bp, Artificial Sequence
  Description of Artificial Sequence: Synthetic coding sequence
atgaagctgctgcccagcgtggtgctgaagctgttcctggccgccgttttgtctgcactggtaacgggcgagtctctggaaagactgaggcgcggcttagccgccggcacttctaaccctgatcctcccactgtatctactgatcagctcttaccacttggtggcggacgggaccgaaaagtgcgcgacctgcaggaagcagacctggacctattacgagtaaccctgtcaagtaagccccaggctctggcaactccaaataaggaagaacatggcaagaggaaaaagaaaggtaagggcttgggaaagaaacgggacccatgtcttagaaaatacaaagatttctgcattcatggcgagtgtaaatacgttaaggaattgagggcccccagctgtatctgtcatccaggttatcacggcgaacggtgtcatggactgtccctgcccgtcgaaaatcggctttacacgtacgaccacacgacaatcctggccgtggtcgccgtagtgctttctagtgtctgtctgctggtgatcgtgggcctgctgatgttcagatatcacaggcgaggcgggtatgacgttgagaatgaagaaaaagtgaagttgggaatgaccaactctcattag

SEQ ID NO: 4204 - DNA, 1128 bp, Artificial Sequence
  Description of Artificial Sequence: Synthetic coding sequence
atggccgtgaccgaggccagcctgctgcggcagtgccccctgctgcttccccagaatagatctaagaccgtttacgagggctttataagtgcacagggacgggactttcacctccggatagtgctgcctgaagatctgcagctgaagaacgcacggctactctgcagctggcaattacgcaccattctcagcggctatcacagaatcgtgcaacaacgaatgcagcacagtcctgacctgatgagctttatgatggaattaaagatgctgcttgaggtggcccttaagaacagacaagagctatacgctttacccccccctccccagttctattctagcctgatcgaggaaattggaactctcggatgggataagctggtgtacgcagacacctgtttttctaccattaagttgaaggccgaggatgcatccggaagagagcatcttataaccctcaagctgaaggctaagtatcccgcagagtcaccagactacttcgtcgactttccagtccctttttgcgcctcctggacaccacagagctctctgatcagcatctattcccagttcttggcggcaatcgagtccctcaaggcgttttgggatgttatggatgaaattgatgaaaagacctgggtcttggaacctgagaagccaccgaggtccgctaccgctaggcgcattgcgctgggaaataatgtaagtattaatatagaggtggaccctagacaccccaccatgctccccgagtgcttcttccttggcgctgatcatgtggtcaagcccttgggcataaagctgtcccgaaacatccacttatgggaccccgagaacagtgtgctacaaaacctaaaagatgttcttgagatcgacttccccgctcgcgcgatattagagaagtccgacttcacaatggactgcggcatctgttacgcctatcagttggatggcacaattcccgatcaggtttgtgataactctcagtgcggacagcctttccaccaaatctgtttatatgaatggctgcgcggactgttgacttcacgtcagtcctttaacatcatcttcggcgagtgcccctactgctctaaacctatcacccttaagatgtccggccgcaagcactag

SEQ ID NO: 4205 - DNA, 723 bp, Artificial Sequence
  Description of Artificial Sequence: Synthetic coding sequence
atgaccccccaccggctgctgccccccctgctgctgctgctggccctcctgctcgctgcaagcccgggcggggcattggcaaggtgccctggatgcggccagggggtgcaggcagggtgcccaggcgggtgcgtggaagaggaagacggaggctccccggctgaaggctgcgcagaggctgaagggtgtctccgccgcgaagggcaagagtgtggagtgtatacgccgaactgcgctcccggcctgcagtgtcaccccccgaaagacgatgaagcccccttgagggcactgctgttgggacgaggcagatgcctgcccgctagggcacccgcagtggccgaagagaatccgaaggagagtaaaccgcaggctgggaccgcacgcccccaggacgtcaacaggcgtgatcagcagagaaaccctggaacctctaccactccgtctcaacctaactcggcgggagtccaggataccgaaatgggcccatgcaggaggcaccttgattccgtcctccagcagctccagacagaagtttatcgcggagcacagaccctttatgtgccaaactgcgaccatcggggcttctaccgaaaaagacagtgccggtcttcccaggggcagcgacgcggcccatgctggtgtgtggataggatggggaagagcctgcctgggtccccagatggaaatggttctagctcctgtcccactggctcaagcggctag

SEQ ID NO: 4206 - DNA, 411 bp, Artificial Sequence
  Description of Artificial Sequence: Synthetic coding sequence
atgaccccccaccggctgctgccccccctgctgctgctgctggccttgctgctagcagcgtcacccggcggcgccctcgcacggtgtccagggtgcgggcagggggtgcaggcagggtgccccggtggatgcgtggaggaagaggatggtgggtctcccgctgagggatgcgccgaagccgagggctgcctgcgccgcgaaggacaggaatgcggggtgtataccccaaattgcgctcccggcctgcagtgccacccacccaaggacgacgaggcaccactgagagcactactcctgggaaggggcaggtgtttgcctgccagggccccagccgtgctctcctcaccaaggactctcaggaaattgtctcccgaacctggggccacatgtagctgtagaggcgaatcctag

SEQ ID NO: 4207 - DNA, 717 bp, Artificial Sequence
  Description of Artificial Sequence: Synthetic coding sequence
atgaccccccaccggctgctgccccccctgctgctgctgctggccctcctgttggcagccagtcccgggggagcactcgcaaggtgcccgggctgtgggcaaggtgtacaggccggatgccccgggggttgcgtcgaagaggaggacggaggtagtcctgcggagggctgcgccgaggcagaaggttgcttacgtcgtgaggggcaagagtgcggagtctacacccctaactgcgcgccagggctccaatgtcatccaccaaaggacgacgaagcccctctgcgagcactgctactgggcaggggtaggtgtctgcccgctagggcccccgctgaggagaacccgaaagaatcaaagccacaggccggtactgccaggcctcaagatgtgaaccgtcgcgatcagcagcgaaaccctgggacttctaccaccccatcccaaccaaactctgctggcgttcaggacaccgaaatggggccgtgtagacgccatttggacagtgtgctccagcaactgcaaacagaggtttatcgaggagcccagacactctacgttccaaattgcgatcacaggggcttttacagaaaaaggcaatgccgctcatcccagggtcagaggcgtggaccttgttggtgtgtcgaccggatgggtaagagtttgcctggttcaccagacgggaacggctcctccagttgccccacgggaagcagtggctag

SEQ ID NO: 4208 - DNA, 837 bp, Artificial Sequence
  Description of Artificial Sequence: Synthetic coding sequence
atgccccggctgagcctgctgctgcccctgctgctgctgctgctgctgccgctgctgcccccattgtccccttccctaggcattagggacgtagggggacgaaggcctaaatgtggcccctgcagacctgaaggttgcccggctcctgctccatgtcccgccccaggcatctcagcactggatgagtgcggttgttgtgctcggtgcctgggggcagagggtgcaagttgtggaggcagggccggcggacggtgtggaccaggcctggtctgcgcctctcaagctgcaggtgctgcccccgagggtacgggactttgtgtctgtgctcagcgcgggacagtgtgtggatccgacggcaggtcttatccctccgtatgtgcccttcgtcttcgggccaggcatacacctagggcacatcctggccacctgcacaaagcccgcgacggcccttgtgagtttgcccccgtcgtggtggtgcctccgaggagtgttcacaacgttacaggggcccaggtcggcctgtcttgcgaggtgagagcggttccaacaccagttattacctggagaaaagttacaaagtctcccgaagggacccaagctctggaggagcttcctggagaccacgtaaacattgcggtgcaagtgcggggagggcccagtgaccatgaagctacagcctggattctgattaatccccttcgaaaggaggacgagggagtctaccaatgtcacgccgcgaacatggtcggagaggccgaatctcacagcactgtgaccgtgctggacctgtcgaaataccgctcatttcactttcccgcccctgatgataggatgtag

SEQ ID NO: 4209 - DNA, 459 bp, Artificial Sequence
  Description of Artificial Sequence: Synthetic coding sequence
atgtgcagcctgcccatggcccggtactacatcagcttcctgcccgagccattacccgccaagagtcttcagcacggagtgccactatccctcgattcttctctgtcctcgctcctggagaagatttgcatactccccaacagagggcttgccaggaccaaagtgcctatcttccttggcattcaggggggctctcgatgtctggcgtgtgtcgagaccgaggagggacccagcttacagctcgaagacgtgaacatcgaggagctgtacaagggcggagaagaggctacccgtttcacattctttcagtctagttccggatcggccttcagactcgaggctgctgcatggcccgggtggttcctgtgtggtcctgccgaaccccagcagccagttcagctgacgaaggaatccgagcccagtgcaagaactaaattttactttgagcagagctggtag

SEQ ID NO: 4210 - DNA, 459 bp, Artificial Sequence
  Description of Artificial Sequence: Synthetic coding sequence
atgtgcagcctgcccatggcccggtactacatcatcaagtacgccgatcagaaggccctgtatacacgcgacggccagcttctcgtgggggatcctgttgcagataactgctgcgctgagaagatttgtatacttccaaacagaggtctggctcggacaaaagtccccatttttctgggtatccagggtggttcgagatgtctggcctgcgtggagaccgaagaagggccatcactgcagctcgaggatgtgaacatcgaagagctgtacaaggggggcgaggaggcaactcgcttcactttttttcaatcctcctcgggcagcgctttccgcttagaagccgcggcttggcccgggtggtttttgtgcgggcccgctgagccccagcaacccgtgcagcttacgaaagagtcagagccgtccgctcgtaccaagttctacttcgaacagagctggtag

SEQ ID NO: 4211 - DNA, 459 bp, Artificial Sequence
  Description of Artificial Sequence: Synthetic coding sequence
atgtgcagcctgcccatggcccggtactacatcatcaagtacgccgatcagaaagcactgtatactcgtgacggtcagttgttagtgggtgaccccgtagctgacaactgctgcgccgaaaagatctgtatcctgccgaaccgggggctagccagaactaaagtgcccatcttcctcggcatccagggaggctcacgctgtctggcatgcgtggaaaccgaagagggccccagtctccagctggaggatgtcaatatcgaggaactctacaagggcggagaagaggccacccgctttactttcttccagtcatcttctgggagtgctttccgtctggaagccgccgcttggcccggatggttcctatgcggccccgcggaacctcagcagccagtgcagttaaccaaagagagcgaacccagtgccagaacgaagttttacttcgaacagagctggtag

SEQ ID NO: 4212 - DNA, 816 bp, Artificial Sequence
  Description of Artificial Sequence: Synthetic coding sequence
atggccaaggtgcccgacatgttcgaggacctgaagaactgctacagtgagaacgaagaagatagtagcagcatagaccatctgtctctcaaccagaagagtttttaccacgtgtcttatggcccccttcacgagggctgtatggaccagtctgtgtctctttccatctccgaaacttctaagacctctaagctgacttttaaggagagtatggtggtggttgcaacgaacggcaaggtactgaaaaaacgcaggctatccctttctcaatccattactgatgacgacctggaagcaatagccaacgacagtgaggaggagatcatcaagccacggagcgctcctttttcattccttagcaacgtcaaatataattttatgcggataatcaaatatgagtttatcttgaacgacgcgctgaaccagagtatcattagagccaatgaccaatacctcaccgctgccgccctccacaatctagacgaagcagtgaaatttgacatgggcgcttataaatctagcaaagatgatgctaaaatcacagttattttacggatctctaagacccagctgtacgttaccgcccaggatgaggatcaacccgtgctcctgaaagagatgcctgagatcccaaagaccatcactgggagtgagacaaatctgctgttcttctgggagacacacggtacgaagaattattttacaagcgtggctcatcctaatctgttcatagccacaaaacaggactactgggtttgcttggccggtgggcctcctagtatcacagacttccaaattctggagaatcaggcctag

SEQ ID NO: 4213 - DNA, 600 bp, Artificial Sequence
  Description of Artificial Sequence: Synthetic coding sequence
atgaactgcgtgtgccggctggtgctggtggtgctgagcctgtggcctgacaccgccgtggctccagggccaccacccggtccacctagagtatctcctgaccctagggccgagctagatagtacagtcttattaacacgcagtttgctggcagacacccgtcagttggctgctcagctgcgcgataagtttccagccgatggagatcacaacctcgactcactgcccacgttggctatgtccgcaggtgcccttggggccctgcaacttcccggcgtgctgactcgcctacgagcagatctcctgtcctatctccgccacgttcaatggctgcgccgggcaggcggttctagcctcaagactctggaacccgagctagggaccctccaagccaggcttgacaggctgctgagacgtctccagctgctgatgagcagactggccctgccacagcctcctccggaccccccagctcctcctctggctcctccaagctcagcctggggtgggattcgggccgcccacgccatccttggcggcttacacttgacattggactgggcagtgcgtggactgctccttctgaaaacccggctgtag

SEQ ID NO: 4214 - DNA, 897 bp, Artificial Sequence
  Description of Artificial Sequence: Synthetic coding sequence
atgtggggcgcctgcaaggtgaaggtgcacgacagcctggccaccattagcattacgcttcggcgttatctacgactgggcgccacaatggccaagtccaaatttgagtacgtgcgagacttcgaggccgatgacacttgtctagcccactgttgggttgtggttagactcgacggccggaatttccataggttcgcagaaaaacacaatttcgctaagccgaatgacagtcgggccctccagctgatgaccaagtgtgctcagaccgtaatggaggaactggaagacattgtcattgcttatggacagtctgatgaatattccttcgtgtttaagcgcaagaccaactggttcaagcggagggctagcaaatttatgacccatgtcgcttctcagttcgcctcgtcgtatgtgttctactggagggattatttcgaagaccaacctctgctgtatccccccggattcgacggaagggttgtcgtgtatcctagcaaccagaccctgaaagattacctgtcctggcgacaagccgattgccatattaataatttgtacaatactgttttctgggcactgattcagcaaagcgggttaactccagttcaggcgcaggggagactgcaagggaccctggcagcagataaaaacgagatactgttcagtgaatttaatattaattacaacaacgagttacctatgtaccgcaaggggacagtcctgatctggcagaaagtggacgaagtcatgactaaggagatcaaacttccaaccgaaatggaagggaagaagatggcagttaccaggacaagaacaaagcccgttccactgcactgtgacattataggggacgctttttggaaagagcaccccgaaatccttgacgaggactcctag

SEQ ID NO: 4215 - DNA, 441 bp, Artificial Sequence
  Description of Artificial Sequence: Synthetic coding sequence
atgcaccccctgctgaaccccctgctgctggccctgggcctgatggctctgctgttgactacagtcatcgctctgacatgtctgggtggctttgcttcgcctggtcccgttccaccaagtaccgctttacgtgagctgatcgaggagctcgtcaacattacccaaaaccagaaggcaccgctatgtaacggtagcatggtgtggagtatcaaccttaccgccggaatgtactgcgctgcattggagagtctgatcaatgtgagtggttgtagcgccatcgaaaaaacccagaggatgctcagtggtttctgtccacataaggtgagtgccggtcagttcagcagcctgcacgttcgggacacgaagattgaggtcgcccagtttgtgaaggatctgctcctccacttgaaaaaactgtttcgggaaggtcaatttaactag

SEQ ID NO: 4216 - DNA, 3999 bp, Artificial Sequence
  Description of Artificial Sequence: Synthetic coding sequence
atggagagccacagccgggccggcaagagccggaagagcgccaagttcagatcgatttcccgctcactgatgttgtgcaacgctaagacgtccgatgacgggtcctctcccgacgagaagtatcctgatccattcgagatctccttagcccagggcaaagagggaattttccactccagcgtgcagctcgccgatacatccgaagcaggaccctctagcgtgcccgacctagccttggcctctgaggctgctcaacttcaggcagccggaaatgacaggggaaagacctgtagacgcatcttttttatgaaagagtcgtcaaccgccagttccagagagaaaccaggaaaactcgaggcccagtcctctaatttcctcttccctaaagcatgtcaccagcgggctcgcagtaactccacatcagtaaatccgtactgcacccgggagattgatttccccatgaccaaaaagtctgccgctcctacggatcgtcagccatatagtttatgcagtaatcggaagtcattgtctcagcaactcgattgccctgcagggaaagccgctgggaccagcagacctaccaggtctctgtctacagcccaattggtgcagccaagtggagggctgcaggcaagtgtgattagtaatattgtcctcatgaagggtcaggcaaagggcctgggtttctctatcgtggggggaaaagacagcatctatggaccgattggaatctatgtgaagacgattttcgccgggggagccgcagctgcggacggtcggctgcaggaaggagacgagatcctagaactcaatggcgaatctatggccggcctcacacatcaggatgctctgcaaaagttcaagcaggccaagaagggactattaaccctgacggttaggacaagactgaccgccccaccttccctgtgcagtcatctatccccccccctgtgccgctctcttagctcttctacctgtatcacaaaagattcttccagcttcgcacttgaatccccatcggcccccatcagtacagccaagcctaattatcgaatcatggtggaggttagtctgcagaaagaagccggcgtgggattgggcattggattatgcagtgtgccttattttcagtgcatatccggtatctttgtccatactttgtctcccggatctgtggcacatctggacggcaggcttcgatgtggggatgagattgtcgagatcagcgatagccccgtccactgcttgactctgaacgaagtttacaccatcctttcacattgtgatcctgggccagtgccaataatagtttcccgccacccggacccccaagtgagcgagcagcaactgaaagaggcagtggcccaggctgtcgagaataccaagtttggtaaggagagacaccagtggagcttagagggtgtgaaaaggcttgagtcaagttggcacggccgaccaaccctcgagaaggagcgtgaaaagaacagtgcaccgcctcaccgtcgagcccagaaggttatgatcaggtcctcctcggatagcagctatatgtctggcagcccagggggcagccctggctcaggttcagcagagaaaccaagctcggatgtagatattagcacacactcaccaagcctccctcttgcgcgcgagcctgtggtactgtcaattgcatcctccagactcccccaagagtcaccccctctgcccgaatcacgggacagtcatccccccctccggctcaagaagagttttgagatcctagtacggaagcctatgagctcaaagccgaaacctccccctagaaaatacttcaagagtgattccgacccacagaaaagcttggaagaacgagaaaactcctcttgtagcagcgggcatacaccacccacgtgtgggcaggaagctcgcgaattactccctctcttgctgccccaggaagacacagctggtaggagcccttccgcatctgcgggctgtccaggcccaggtatcggaccccagacaaaatcttctacagagggtgagccggggtggcgaagggcctcacccgttacacagacaagtccaattaaacacccactgctgaaacgccaagcccgcatggactattcctttgataccaccgcagaagacccatgggtcaggatctccgactgtatcaagaacctgttttccccaatcatgtccgagaatcatggccacatgcccctgcagccgaacgcctccctcaatgaggaggagggtactcagggtcacccggacggtacccctcctaaactggacacagctaacggtacccccaaggtctacaagtctgccgattcaagcacggtaaagaagggtccacccgtggctccaaaacccgcatggtttcgacagtccctgaaagggctacgaaatagagcaagtgaccctagagggctccctgatcctgccctgagtacgcaacccgcacccgccagtcgagaacatctggggagccacattagagcttcctcctcctcctcctcaatcagacagcggatctcctccttcgagacgtttggtagctcacaacttccagataagggggcccaaaggttgtcgctccagcctagtagtggggaggccgctaaacctctgggcaaacacgaagagggccgattctccggacttctgggccggggcgccgcacccactctggtgccacagcagccggaacaggtgttaagttctggatctcctgcagcatcggaggcaagagaccccggtgtcagtgagtccccaccaccaggccgtcagccgaatcaaaaaacactgccaccagggccagatcctctgcttcggctcctgtctacgcaggcagaagaatctcagggtcccgtgcttaagatgccaagccagcgtgcccggtccttcccactgacgagatcacaatcttgcgagaccaagctgcttgatgaaaagacatcaaagctgtattccatatcctctcaggtttcctctgccgtgatgaagtccctgctttgtctacccagtagtatcagctgtgcccaaaccccatgcatccctaaagaaggggcttcacccacgagctcgtcaaatgaggactctgccgccaatgggtctgccgagacatcggccctggacacaggctttagccttaacctgtcagaactgcgtgaatacaccgaaggactgaccgaggccaaggaagatgatgacggcgatcatagttctttacagtctggacagagcgttatcagtctactctctagcgaagagctgaaaaaattaatcgaggaggtcaaggtgctggatgaggcgaccctaaagcagctggacggtattcatgtgacaatcttgcataaagaggaaggcgctggccttggttttagcctcgccggtggcgccgatctggagaacaaggtgattactgtgcaccgggtctttccaaacggcctggcttcacaggaaggaacaattcagaaaggaaatgaggtgctttctatcaatggcaagagccttaaagggacaacccaccacgacgcgctggccatcctgagacaagccagagaaccacgccaggcggtgatcgttacccgaaagctgactcccgaggctatgcctgacctgaatagttcgaccgattccgccgctagcgcatcagctgcttcggatgtttcagtcgagtccacagccgaggccactgtttgcactgtcacactcgagaagatgtccgccggcctgggcttttctctcgaaggcgggaagggctcattgcacggtgacaagcccctaaccataaacagaatctttaaaggcgctgccagtgaacagtccgagaccgttcaacccggcgacgagattctgcagttagggggaaccgccatgcagggactcacacggtttgaggcgtggaatattatcaaggcgctgcctgacggacccgtgacaatcgtgatcagacggaagtccctgcaaagcaaggaaaccactgccgcaggtgactcctag

SEQ ID NO: 4217 - DNA, 2163 bp, Artificial Sequence
  Description of Artificial Sequence: Synthetic coding sequence
atgtgcagcgtgctgcccgtggccgtgaccggcgtgaagcggctggagtctagctggcacggccgccccacactggagaaggagcgggaaaaaaattcggcgcctcctcaccgcagagctcaaaaggtcatgatccgctcctcttctgacagttcttatatgtccggatctcctggtggaagccctggcagtgggagtgctgaaaaaccatcctccgacgttgacatttcgacacatagtccatccctgcccttggcacgtgaacccgttgtcctgtccattgcatcctcccggcttcctcaagagtctccgcctctcccggagagccgtgattcacacccacccctccgcctaaagaagagcttcgagatcctagtgaggaaacctatgagctctaaaccgaagccaccacccaggaagtatttcaagagtgacagtgatccacagaagtcattggaagagagggaaaattcaagctgcagtagtgggcatactcctcccacctgcgggcaggaggctagagagctgctgcccttactgttacctcaggaggacaccgcagggcggtccccaagcgcctcagccggttgtccaggccccgggatcggaccccagacgaaatcctccacagagggagaacctgggtggagaagggcttctccagtcacacagactagtccaattaaacaccctctcttgaaaagacaggcccgtatggactacagttttgataccacagcagaagatccatgggtccggatcagtgattgtatcaagaatctgtttagccccatcatgtcagaaaatcatggacacatgccattacaaccaaacgcctccctaaatgaagaggagggcacacagggtcaccccgatgggacccctcccaaactggacacggccaatgggacccctaaagtgtataagagcgccgacagtagtaccgtcaagaaaggacctccggtcgccccaaaaccagcctggttcaggcaaagccttaagggtctgagaaacagggcaagcgatccaagggggctccctgacccggctcttagcacgcaacccgcacccgctagccgcgaacacttaggaagtcatattagggcaagtagctcctcttcatctataaggcaacggatcagcagtttcgagacgttcggatcatctcagctgcccgacaagggagcccagcgcctatccttgcaaccgagctccggggaggctgccaagccattgggtaaacatgaagagggccgctttagcgggctactggggcgaggtgccgctcctaccctagtcccccagcagccggaacaggtgctctcatcaggctcacctgccgccagcgaggcccgtgatcccggcgtgtcagaatcacccccacccgggaggcagcccaatcaaaaaactcttccaccaggaccagacccccttttaagactcctgtccacccaagcagaggaaagccagggacccgtcctgaagatgccttcgcagagggcgagatctttcccattgacgcggtcccagtcctgtgagactaagctcctggacgaaaaaaccagcaaactgtactcaattagcagccaggtgtctagtgccgttatgaaaagcctgttgtgcctcccctcttctatttcttgcgcccagaccccatgcattccaaaggaaggagcgtcacctacctcgagctccaatgaggacagtgccgccaatggatctgccgagacttccgcactggatacaggcttctctctgaatctctcagagctgcgggaatatactgagggcctgacggaagccaaagaagatgatgatggggaccactcaagtctgcaatcaggccagtctgtgatatcgttgcttagttctgaagaactgaaaaaactgatcgaagaggtcaaggtgctggacgaagccaccctgaagcaactggacggaattcatgtcactatcctgcataaagaggaaggagccggcctgggattcagcctcgccggtggcgctgacctcgagaacaaagtaatcactgttcacagggtcttccctaatggcctggccagtcaggagggtacgatccaaaaagggaatgaggtgttgtccatcaacggcaaatccctaaaagggaccactcatcacgctagaccacagttgttgcattag

SEQ ID NO: 4218 - DNA, 3492 bp, Artificial Sequence
  Description of Artificial Sequence: Synthetic coding sequence
atggagcggggcgcccgggagatggccgcccccggcgactgccccgccgggaaagcagcaggaactagccgtccaacaaggtcactgtcaaccgctcagctcgtccaaccgtcaggaggcttgcaggcttccgtgatcagcaacatagtgcttatgaagggtcaggccaaagggctgggcttcagcatagtcggtggcaaagactctatctacggaccgatcggtatttacgtgaaaacgattttcgctggaggcgctgccgcagccgatggccgactgcaggagggggatgaaattctcgagttgaacggcgagtccatggccggcctgacccatcaagatgctctgcaaaagttcaaacaagccaagaagggcctgctgacactgacagtgcgcaccaggctcacagcaccacccagcttatgcagccatttatctcctcccctgtgccgctccctatcctctagtacctgcattacgaaagatagttcatccttcgctctggagagcccctcggccccaatttctacggctaagcctaattaccggataatggtcgaggtcagcctgcagaaagaggcaggtgtaggcttaggtattgggctttgtagcgtgccatacttccaatgtatcagcggaatctttgtgcatactctcagccctggaagtgtggcccacctggatgggcgcctccggtgcggcgacgagatcgtcgagatctcagattcccccgttcactgtctgactttgaatgaagtttacaccattctgtcacattgcgaccctggacctgtgccaatcattgtaagcaggcatcccgatccccaggtctccgaacagcagctgaaggaagccgtggcccaggcagtcgaaaacacaaaattcggaaaagagcggcaccagtggtcgcttgaaggcgtcaagagattggagtcatcgtggcatgggcggcctacgctcgagaaggaaagagaaaagaacagcgctcctccacaccgacgagcccaaaaggtaatgattcgctcgagttccgacagctcttacatgtccggctcccccggaggctctccaggctccgggtccgccgagaagcccagttccgacgtagatataagtactcactcgccttcactcccattagcacgcgaaccggtcgttttgagcattgcaagcagtaggttaccacaggaaagtccccccctccccgagagccgcgactcccatcctcccctccgcctcaagaagagcttcgaaatcttggtccggaaaccaatgtcatccaagcctaaacctccccccagaaagtatttcaaatctgactcggatccgcaaaaatcactggaggagcgagaaaatagcagctgtagttcaggccatacacctcctacatgtggacaggaggcgagagagctactgcccctactgctcccccaggaagacaccgccggtcggtccccatctgcaagcgctggctgtccggggcctggtatcgggccccagaccaagtctagcaccgagggcgagccagggtggagacgagcatcaccagtgacccagactagcccaatcaagcatccactcttaaagagacaggcccgaatggactatagttttgatacaaccgctgaggatccctgggtgcgtatctcagactgcatcaaaaatctatttagcccaattatgtctgaaaaccacgggcacatgcctcttcagccgaatgcctctctcaatgaggaagaggggacccaggggcatccggacggcacgccacccaaattagacactgctaatggcaccccaaaggtatataaaagcgcagactctagcacagtgaagaaaggccctcccgttgccccaaagccggcatggttccgacaaagtctcaaggggctgcggaaccgcgcaagtgacccgaggggcctccccgatcccgccttgagcacgcagcccgcccctgcaagtcgagagcaccttgggtctcacattagggcaagtagttcttcctctagcattagacagcggatttcaagcttcgaaacatttggaagttcccaactgcctgacaagggcgcccagaggctgtcactccagccgagtagcggggaggcagccaagccgttaggcaaacatgaggaggggcgcttctctggactgttaggcaggggggccgcccccaccctcgttccacagcaacctgaacaagtgctgtcctccggtagccccgcagcatctgaagccagggaccccggcgtgtccgaatccccacctccagggaggcagcctaaccagaaaacgctgcccccaggaccagatccactcctacgcctgctgtccactcaggcggaggagagtcaggggcccgttcttaagatgccgagccagagggctcggagttttcctctcacacgctctcagagctgcgaaacaaaactactcgatgagaagacgtctaaactctattccattagcagccaggtctcatccgctgtgatgaagtcccttctgtgtttaccatctagtatatcttgtgcccagacaccttgtatcccaaaagaaggcgcctctcctacgagtagtagcaatgaggactcagctgccaatggcagcgctgagacgtccgctctggatacaggcttttctctcaacctcagtgaactccgggaatacaccgaggggctcaccgaggcaaaggaagatgatgatggcgatcactccagcctgcagtcagggcaaagcgttattagcctgctaagctccgaggaactgaaaaagctaattgaagaggtgaaagtgttggatgaggcaacccttaagcagctcgatggcattcacgtcactatactgcacaaggaggaaggtgctggcttggggttcagtctggcaggcggggctgacctggaaaacaaggtgattaccgtccaccgtgtattcccaaacggccttgccagccaggaaggtacaatccagaaggggaacgaggtgttatccatcaacggaaaatcactaaaaggtacaacccaccacgatgcattggcgatactcaggcaggcgcgagagcctcgccaggccgtaatagtgacgcggaaacttaccccagaagccatgccagatctcaactcatccaccgatagcgctgcctcagcttctgcagcctccgacgtgtcagtggagtccacggaggcaaccgtttgtaccgtcacactggagaagatgtctgccggcttaggcttttcgctggaaggtgggaaaggctccctgcatggcgacaagcccctgaccataaaccgaatctttaaaggggcagcatccgaacagtctgagacagtgcagcctggagatgaaattttgcagttgggtgggaccgcaatgcagggtttaacgcgctttgaggcatggaatattattaaggcactaccagacggcccggtgacgatcgttattaggaggaaaagtctacagtcaaaggaaacaactgcagccggagatagctag

SEQ ID NO: 4219 - DNA, 1896 bp, Artificial Sequence
  Description of Artificial Sequence: Synthetic coding sequence
atggactacagcttcgacaccaccgccgaggacccctgggtgcggatctctgactgtattaaaaaccttttcagccctatcatgtctgagaaccacggccacatgccattgcagccgaacgctagtcttaacgaggaggaagggactcagggtcatcccgacggtacacctcccaagctcgatacagccaacgggacacccaaggtgtataagtccgcagattcttcgacagttaaaaaaggcccacctgttgccccaaagcccgcgtggttccggcagtccctgaaaggtctacggaatagggcatccgaccctaggggcctgccagacccggcattgtctacgcaacccgctccagcatctcgcgagcacttgggttcgcatattcgcgcatcttcgtctagctccagcatcagacaacgcatcagcagttttgagacttttggttcgagtcagctcccagataaaggcgcccagaggctctctctccaaccctcttcaggggaggctgctaaacctctaggtaagcatgaggaggggcggtttagcggactgctgggtagaggcgcagcacctacattagtacctcagcaaccagaacaagtgctctcatcaggttccccggcagctagcgaagctcgggatccaggagtatcggagagcccgccacctggcagacaaccaaaccagaaaacactccccccaggcccagaccccctgctgcggttgctgtccacacaggctgaggagtctcagggaccagtcctgaagatgccatcacagagggctcgaagcttccccctgacccggtcccaatcttgcgagaccaagctgctcgacgagaagacatccaagctctactccatatcatcacaggtgtcctcggccgtaatgaagtctctgctgtgcctgccctcgagcattagctgcgcccagacaccttgcatcccaaaggaaggcgccagccccacctctagtagtaacgaagatagtgcggcaaacggttcagctgagacttccgccctagacaccggcttctcgcttaatctgagcgagctgcgggaatacaccgaaggattgaccgaggctaaggaggacgatgacggcgatcactcaagtctacagagcggccaaagtgtgatcagcctgctgagttccgaggagcttaaaaaactgattgaggaggtgaaagtcctcgatgaagcaacattgaagcaactggacggcattcacgtgaccatcctgcacaaggaagagggagcggggctcggcttttctctggctggaggggcagatcttgagaacaaagtcatcacggtgcaccgggtgttccctaacggacttgcctcccaagagggcactattcaaaaagggaatgaggtattgagcataaatggtaaaagcctcaaaggcacaacacatcatgatgcactcgccatactgcggcaggcacgggaaccgaggcaggcagtgatcgttacacgtaagcttacccctgaggctatgccggatctcaactctagcaccgatagcgccgcctctgccagcgctgcttctgacgtgtctgtcgaatcaaccgctgaggcaacagtctgtactgtgacgctggaaaagatgtccgccggactgggttttagtttagaaggaggcaaagggtccctccacggcgacaagcccctgaccatcaaccggattttcaagggagcggcctccgagcagagcgaaaccgtacaacctggggatgaaattcttcaactggggggcacagcaatgcagggtctgactcgcttcgaagcatggaatatcatcaaagctttacctgacggcccggtgacaattgtaattaggcgcaagtcgcttcagtccaaagaaacgactgccgcgggtgactcttag

SEQ ID NO: 4220 - DNA, 1974 bp, Artificial Sequence
  Description of Artificial Sequence: Synthetic coding sequence
atgtggctgcccgtgaaggagctgaccatccacgagtgccagcagatgagcacttatcgagcaccgaaccaggaggctagggaactgctgcccctactattgccacaggaagatacagcaggaagatccccgtctgcgagcgccggatgtccagggccaggaatcgggccacagacgaaatcaagtaccgaaggcgagccggggtggaggcgagccagcccagtgacccagacaagtcccataaagcaccctctgttaaaacgccaggcacggatggactacagctttgacactacggctgaggatccctgggttagaatttctgattgtatcaaaaatctattctcgcctatcatgtctgaaaaccacggccacatgccacttcaaccgaatgcgtctctgaacgaggaggagggaacgcagggacaccctgacggcacgcccccgaagctcgacactgcaaacgggacgcctaaggtgtacaagtctgccgatagttccaccgtaaagaaggggccgcctgtagcccctaagcccgcctggtttcggcaaagcctcaagggtctccgcaaccgggctagtgacccacgcggcctgccagatcctgcgctgtcaacacaaccggctcccgcctcacgcgagcacctgggcagtcatattagagccagtagctcctcgagcagcatccgccaaagaatatcctcctttgagacctttggctcgagccaactaccggataagggtgcccagaggcttagcctgcagccatcttcaggagaggcagcaaaaccgctcggcaaacacgaagaggggaggttttcaggcctcctgggccgaggcgcagcgcctaccctggtgcctcagcagcccgagcaggttctctccagcgggtctcccgcagcctcggaagctagggatccaggggtgagtgaatcgcctccaccgggccgccagcccaaccagaaaacgctacctccaggtccagaccctttgttacgactgctgtccacccaggctgaggagtcacagggcccagttctcaaaatgcccagtcagagggcgcggagttttcccctgactaggagccagtcgtgcgaaaccaaactcctggacgaaaagactagcaagttgtactccatctcctcacaggtgtcttccgcagtcatgaaatctctcctctgcctgccatccagtataagttgcgcacagaccccctgcatccctaaggaaggggcatcccccacgagtagctcaaacgaagatagtgcagctaacggcagtgccgaaacatcagctctcgacaccgggttcagtctgaatctcagtgagctccgcgaatatacagaaggcctcaccgaggccaaggaagatgacgacggcgatcacagctcgctgcagtcaggacagagcgtcatttcactcttgtctagcgaggagctcaagaaactgattgaagaggtaaaggtgctggacgaggccacgctcaagcagctcgacggaatacatgtgacgattctgcataaggaggagggggctggcctgggcttctccctggcaggcggcgctgacttggagaataaggttataaccgttcacagagtctttcccaacggcctggccagccaggaggggactatccagaaaggcaatgaggttctgtctatcaatggaaagagcctaaaggggaccacacaccatgatgcacttgccatcctgagacaggctcgcgaacccaggcaagccgtgatcgtcacgagaaagttgacccccgaggcaatgcccgacctgaactcttcgacagatagtgccgcatccgcttcagcggcttcagacgtcagcgtggagagtaccgaagccacagtctgtacagtgaccctcgagaaaatgtctgcaggccttggattctcactcgaaggtgggaaagggagtctgcacggcgacaaaccattgaccatcaatcgaatcttcaaatag

SEQ ID NO: 4221 - DNA, 1365 bp, Artificial Sequence
  Description of Artificial Sequence: Synthetic coding sequence
atggagagccacagccgggccggcaagagccggaagagcgccaagttccggtcaatttcaaggtccttgatgctctgtaatgcaaaaacgtcagacgatggtagctcaccagatgagaaataccccgacccgttcgagatcagcctcgcccaggggaaggaaggaattttccactccagcgtccagttagccgacacatcagaggcaggacctagtagcgtacccgaccttgcgctcgcttccgaggccgcacaactacaggcagccggcaacgatagaggtaagacctgccgacgaatctttttcatgaaagagtcaagcaccgctagttcccgggaaaagcctgggaagttggaggcccaatcctcaaattttctctttccaaaggcctgccaccagagggcaagaagcaacagcacctccgtcaacccatactgtacccgcgaaatagattttccaatgactaagaaatcggccgctcctactgacaggcagccatattctctatgctcaaaccgcaagtccctttcacaacaacttgactgccccgccgggaaggccgctggcacgagccgccctactcgctccctctccaccgcacagttggtacagcccagtgggggacttcaggccagcgtaatatctaacatcgtgctcatgaaagggcaagcaaaaggtttgggcttctctatagtcggagggaaggactctatatacggccctatcgggatctacgtaaaaacaatctttgctggaggtgccgctgccgcagacggacggctacaggagggcgacgaaattctcgaactcaatggggagtccatggcagggctgacccatcaggatgccttgcaaaagttcaaacaggctaagaagggcttgctgaccctcacagtccgaacgcggctgaccgctccaccttcgctgtgttcccacttgtcaccaccactgtgcagatccttaagcagctccacctgtatcacaaaggactcctcaagttttgcacttgaaagtccttcagcacccatttcaacagcaaagcctaattaccgcataatggtagaagtttctctgcagaaagaggcgggcgtggggctcgggataggcctctgttcagtaccttacttccagtgtatctctggaatattcgtgcatacgctgagtcccggcagcgttgcacaccttgatggacgtttgcgctgtggtgacgagattgtagaaatctccgattcacctgtacactgtctgaccttaaatgaagtgtatactatcttaagccactgcgatccaggcccagtgcctataattgtatcgagacaccctgatcctcagaaagaagagatggaagcacaagaggtgaagtag

SEQ ID NO: 4222 - DNA, 1683 bp, Artificial Sequence
  Description of Artificial Sequence: Synthetic coding sequence
atggactacagcttcgacaccaccgccgaggacccctgggtgcggattagtgattgcataaagaacctattttccccaattatgtctgagaaccatgggcacatgcccctgcagcccaatgccagcctgaacgaagaggagggaacacaggggcatcccgacggtacacctcccaagctcgataccgcgaatggaacacctaaagtgtataaaagtgcggacagctctaccgtgaaaaaggggccccctgttgcccccaagccagcgtggttcagacagtctctgaaggggctacggaacagagcatctgatcctagaggcttgcccgacccagcactgtccacgcagcctgcgcccgcatcacgggagcatttgggttcgcacattcgcgcctctagctcaagtagcagcattcgccagcggatcagttcgttcgagacctttggcagcagtcagctgcccgataagggtgctcagcggctttctttgcagccttcctccggagaagccgcgaagcccctcggtaaacacgaggaaggccgcttcagcggccttctcgggcggggggcagcccccactctggtgcctcagcagcctgaacaggtcttgtcctctggatcccctgcagccagcgaagcaagagatcctggcgtctccgagagtccacctcctgggcggcaacccaatcaaaaaaccctgccgccggggcccgacccccttctgagattgctgtccacacaagcggaggaatctcaggggccggtgctgaagatgccgagccagcgtgctaggagtttcccactgacaagatcacagtcctgtgaaactaaacttctggacgaaaaaacttccaagctgtacagcatcagctcacaggtctcatctgctgttatgaagtcactgttgtgcctcccttccagcatctcatgtgcacaaaccccctgtattccgaaagaaggcgctagtcccacctcctcgtctaacgaagacagcgccgctaacggcagcgccgagacatctgctttagacaccggtttcagtctaaacctctctgagctgcgcgaatataccgaaggccttacagaggctaaagaggatgacgacggagaccactcaagcttacagagcggacaaagcgtgatttccctactgtcttctgaagaactgaagaaactgatcgaagaggtcaaggtcctcgatgaggcgacattgaagcagctcgatgggatccacgtcaccatcctacataaggaggaaggggcaggcctcggcttctccctggctggaggagccgacctcgaaaataaggttataacagtccatcgggtgtttcctaatggcctcgcgtcccaggaggggaccatccagaagggcaatgaggtcctatcaatcaacgggaaatctctcaaaggcactactcatcatgacgctctggccattcttcggcaggccagggagcctcggcaggccgtaatcgtgaccaggaagctgactccggaagccatgcccgacctgaacagttccactgactccgctgcgagcgcctctgccgccagcgacgtgtcagtagaatcaacagaagctaccgtctgcaccgtgactctcgaggacgtcggtcgggctggcttacaaccggggcgtcgcgagggcctgcccacgaggagacaagccagccaccattag

SEQ ID NO: 4223 - DNA, 3996 bp, Artificial Sequence
  Description of Artificial Sequence: Synthetic coding sequence
atggagagccacagccgggccggcaagagccggaagagcgccaagtttagaagcatctcgagaagtctgatgctgtgcaatgctaaaacaagtgatgatggctcctcgcctgatgagaaataccctgatccctttgagatctccctggctcagggtaaggagggcatctttcatagttctgtgcaattggccgatactagcgaggctgggccttccagcgtccctgatctcgctctggcctctgaagcggcacagctccaagccgccggtaacgaccggggcaagacttgcaggcgtatcttttttatgaaagaatcttcaaccgccagtagccgtgagaaaccagggaagctggaggcgcagtcctctaactttttgttcccgaaggcatgtcaccagcgcgcgcgtagtaatagcacttccgtgaacccttattgcacgagggaaatagatttcccgatgactaaaaaatcagcagctccaactgatcgccagccctattccttgtgtagtaatcgcaaatcactttctcagcagctggattgccctgccggcaaggctgctggaacatcacgcccaacaagaagtctaagcacggcgcagctcgtccaaccgtctgggggtctgcaggcctccgtcatatctaatatcgtcctgatgaagggacaggctaagggcttgggatttagtattgtgggcggcaaagattccatttacggtcctatcggaatttacgtaaagaccatctttgccggaggggcagcagcagccgatggacgactgcaggaaggagatgaaatccttgaattaaacggcgagtccatggccggcctaactcatcaggacgctctgcagaaattcaaacaggctaagaaaggacttctgactttaactgtgcgcacgaggctcaccgcaccacctagcctgtgttctcatctctccccccccttgtgcaggagcctttcctcttccacctgtattacaaaagactccagttcttttgctctggagtccccatccgcccccatctctacagcaaagccaaactatcgtatcatggttgaagtgagtctgcagaaagaggcgggcgtggggttgggcataggattgtgttccgtaccgtacttccagtgtatctctgggatatttgtccacacattatcgccgggatctgtggcgcacctcgatggccgactccgttgcggtgacgagatcgtggagatttcagactcacctgttcactgcctgacgctgaatgaagtgtataccatactgagtcactgtgatcctggccccgttcctatcatcgtgagtcggcaccctgatccccaggtgtcagaacagcagcttaaggaggccgtcgcccaggctgtggaaaatactaaatttggcaaagagagacaccagtggagcctggagggcgtaaagaggttggaatcatcttggcatgggagacctaccctagaaaaggagcgcgaaaagaacagcgccccccctcaccggagggctcagaaggtgatgattcgttcaagcagcgattccagttacatgagcggcagtcccggagggtctcctggtagcggcagcgcagaaaaaccatcttccgacgtggacatatccacacattctccctccctcccgcttgctagagagcctgtggtgctgagtatcgcatcctccagactacctcaggagagcccgcccctgcccgaatcacgtgattctcaccctccactcagactgaagaaaagctttgagatactcgtgcggaagccaatgagtagcaaacctaagccccctcctagaaagtatttcaagagtgacagtgaccctcagaagtccctggaagagagagagaatagttcatgctcctctggccataccccacctacctgtggtcaagaggcccgcgagttgttaccgctgctgctgccccaggaggacacagccggaagatcaccatcggcctccgccggttgcccaggaccaggaattggcccccagaccaagagttccaccgaaggagagccgggatggcggagggcctcaccagtgacgcagacgtcaccaattaagcatcctctactgaagagacaagctaggatggactattcattcgacacgaccgccgaggacccctgggtgaggatctcagattgcatcaaaaacttgtttagccccatcatgagtgagaatcatgggcacatgccactgcagcctaatgccagcctcaacgaagaggaaggtacccagggccatccagacgggaccccgccaaagttggacacagcaaatggtacacctaaggtttataagtccgcagactcctccacagtgaagaaaggtcctcctgtcgcccccaagccagcttggttccgacagagcttgaagggtctccgcaaccgggcatctgacccaagaggtctaccagacccagcattatccacacagcctgcccctgcgtcacgggagcatctgggctcccacatcagagcgagttcaagtagcagctcgataaggcaacgtatttcatcattcgagacgttcggatctagccagttacctgacaaaggcgcacagaggctaagccttcagccaagtagtggagaggcagcgaagcccctgggaaagcatgaggaaggtcggttttctggactgcttggcaggggggctgcccccacactggtgccacagcagcctgaacaagtgctcagtagtgggtcccccgcggcctccgaagctcgcgacccgggggtaagcgagtcgccaccccccgggcgccagcctaaccaaaagaccttgccccctggacctgacccgctcctcaggctcctctcaacacaggctgaggaatctcaaggccccgttctcaagatgccatcccagcgggcccggtctttcccattgacgagatcccagtcatgtgagaccaagcttctggatgagaaaacctcaaagttatattctatctcttctcaagtgtcaagcgccgtgatgaagagtctgctgtgtctgcctagctccatttcatgtgcacaaacaccttgcattcctaaggagggtgctagccctactagcagctccaatgaggattcagccgctaacgggtccgcagagacttcggccttggacacaggtttctccctaaatcttagtgaactgcgggagtacactgaaggactcacggaagctaaggaagatgatgacggagatcactctagccttcagagcgggcaaagcgtgatatccctgctcagcagcgaggaactcaaaaagctaatcgaggaggtcaaggttttggatgaagctactttaaagcagttagacggcattcatgtgactattctgcacaaggaagagggggcaggcctaggctttagtctggccggcggtgctgatctcgagaataaggtcatcaccgtgcacagagtcttcccaaacggtctggcaagtcaggagggcaccattcagaaggggaatgaggtcctgagcatcaatggcaagagtctgaaggggaccacacaccacgacgcactcgctattctgcgccaggcgagagagcctcgtcaagccgtgatcgtgacacgcaaactgacacctgaagctatgccggatcttaattcttccaccgatagcgctgctagcgcctccgctgcgtcagatgtaagcgtggagtctactgaggctacagtttgtaccgtgactctggagaagatgagtgcaggcctgggattttctcttgagggcggtaaaggtagcctccacggcgacaaaccccttactatcaacagaattttcaaaggcgcagcttctgagcagtcggagacagtgcagcccggggatgagattctgcagctgggggggacagcaatgcaggggctgacccgattcgaggcttggaatatcatcaaggccctgccagatgggcctgtcacgatagtgatcagaaggaagtctcttcaatctaaggagactacagctgccggggactcctag

SEQ ID NO: 4224 - DNA, 1785 bp, Artificial Sequence
  Description of Artificial Sequence: Synthetic coding sequence
atggagagccacagccgggccggcaagagccggaagagcgccaagttccgttcaataagccgaagcctgatgctgtgtaatgcaaagacatcagatgacgggagctcccctgatgaaaagtatccagatcccttcgagattagcctcgcccagggaaaggaaggcatctttcactcctcagttcagttggccgacacaagcgaagcaggtccgtcaagtgtgccagatttagcgctagcatcagaagcggcccagctgcaggcggctgggaatgaccgcggtaagacctgtcgccgcatcttcttcatgaaggagtcgagcacagcttccagtcgtgaaaagcctggaaagctggaagcacagtcctcaaatttcctgttcccgaaagcgtgtcaccaaagggctcgctccaactctacatcagtaaacccctactgtacacgggaaattgacttccccatgactaaaaagtcagctgccccgaccgaccgtcagccatactccctctgcagtaaccgtaaaagtctatcacagcagctcgattgcccagctggcaaagcggccggcacctccaggcctacccggagtctctcaaccgcacaactggtgcagccctccgggggattacaggccagtgtgattagcaatatcgtcctgatgaagggacaggccaaaggattaggcttttccatcgtgggtggtaaggactcgatctacggtccaatcggcatctatgtgaagaccatctttgctgggggagctgccgctgccgacggccgcctgcaagagggagacgaaattttagaactaaacggagaatcaatggctggactgactcaccaggatgccttacagaaatttaagcaagccaaaaaggggctgctcactcttacagttcgcactcgcctaactgccccccccagtctctgcagtcatctctcaccccccctttgtcgatctttatccagctccacgtgtatcactaaggattcttcaagcttcgctctggagtctccatccgctcctatctcaactgctaagccgaactaccgcatcatggttgaagtttccctgcagaaagaagctggagtgggtctgggcattggcctctgctccgtcccctattttcagtgtattagcggcatctttgtccacacccttagccccggatcagttgcacatcttgatgggaggctgagatgcggagacgaaattgtggaaatttccgatagccccgttcactgtttgactttgaacgaagtgtatactatcttgagccattgcgatccaggccccgttccaatcatcgtgtcccggcacccagatcctcaagtgtcggaacagcagcttaaagaagcagtggcgcaggcagtggaaaatacaaaatttggcaaggaacggcaccaatggtcactcgaaggcgtcaagcgcctggagtcaagctggcacgggcgccccaccctcgaaaaggaacgcgagaagaattccgctcctccccacagaagagcccagaaggtcatgattcgctcgagttccgactcctcctacatgtctggttctcctggcggctcgccgggtagtggctcagccgagaaacctagttctgacgtggatattagtacacactctcctagtctccctttggcgcgagagcctgtggtcctcagcattgcttcctcacgcctgccccaggagagccccccgctgcctgaaagccgggattctcacccacccctgcgcctcaagaagagtttcgaaattctcgttaggaaaccaatgtcctag

SEQ ID NO: 4225 - DNA, 468 bp, Artificial Sequence
  Description of Artificial Sequence: Synthetic coding sequence
atgacccccggcaagaccagcctggtgagcctgctgctgctgctgagcttggaggccattgtgaaagccggcatcacaattccaaggaaccccggctgtcccaattcagaagataagaatttcccacgaactgtgatggtgaatctgaatatccacaatcgaaacaccaacacaaaccctaaacgctcctctgattactacaacaggtcaacctctccatggaacctgcacagaaacgaagacccagagcggtacccctccgtgatctgggaggctaaatgccggcacctcgggtgcatcaacgcggatggtaatgtggactaccacatgaattcggttccaattcaacaggaaatccttgtgcttagaagggaaccaccgcactgcccaaacagtttccggctggaaaaaatcctggtctcagtgggctgtacctgcgtcacaccaattgtgcatcatgtcgcctag

SEQ ID NO: 4226 - DNA, 543 bp, Artificial Sequence
  Description of Artificial Sequence: Synthetic coding sequence
atggactggccccacaacctgctgttcctgctgaccatcagcatctttctcggccttggtcagccacggtcaccaaagtcaaaacgtaagggacagggacgcccgggtccactcgctccaggcccccatcaggtcccccttgacctggtgtcacgcatgaaaccatatgctaggatggaggagtatgagcggaacatcgaggaaatggttgcccagctcagaaacagcagtgagctggcccagcggaaatgcgaggttaacctgcagctgtggatgtcgaacaaaagatctctaagcccttgggggtactccattaatcacgatccttcaaggatccccgttgatcttccagaggcaagatgcctgtgtctgggatgcgtcaatccatttaccatgcaggaagatcggtcaatggtgtcggtgccagtcttctcccaggtacctgtgagaagaagactgtgtccgcctccacctaggaccggcccttgccgtcaaagagccgtgatggaaacgattgcagtgggctgtacttgtatcttttag

SEQ ID NO: 4227 - DNA, 594 bp, Artificial Sequence
  Description of Artificial Sequence: Synthetic coding sequence
atgaccctgctgcccggcctgctgttcctgacctggctgcacacctgtctggctcaccatgatccttcgttacggggacacccacattcccacggaacccctcattgttattccgccgaagaactgccgctggggcaagcgccacctcacctcttggcgaggggggctaagtgggggcaggcgttgccagtcgcactcgtgtcatccctggaggcagcatcccacaggggccggcatgagcgcccttccgccacaactcagtgtccagttttgcggcccgaggaggtattagaggctgatacgcaccagcgatctattagcccctggagataccgggtcgacaccgatgaagatcgctatccacagaagcttgcattcgccgagtgcttatgcagagggtgcattgacgccaggaccgggagagagaccgcagctttaaattccgtgcgactgctgcagtccctgctcgtgctgcgtcgtaggccatgcagccgagacggaagtggtctgcccacccccggagcttttgcattccatactgagttcatccacgtgcccgtcgggtgtacctgtgtgctaccccggtccgtgtag

SEQ ID NO: 4228 - DNA, 609 bp, Artificial Sequence
  Description of Artificial Sequence: Synthetic coding sequence
atgctggtggccggcttcctgctggccctgccccccagctgggccgccggagcacctcgagccgggagacgtccagcacgtccacgcgggtgcgcagatcggccagaggagttactggaacagttgtatggtagactggctgctggcgtccttagtgctttccatcacacgctgcagctgggtccaagggagcaggctcgtaatgcatcctgtcctgccggcggtcgtcctgctgaccgcaggtttcgtcctccaactaacttgagatctgtcagcccgtgggcatacagaatttcctatgaccctgcacgatatccgcggtatttgcccgaggcctactgcctctgccgaggctgtcttaccggcctgtttggggaagaggatgtcagattccggtctgcgcccgtatacatgcccactgtagtactgcgcaggacccccgcttgcgccggaggccggagcgtgtacactgaggcttacgtcactatccctgtggggtgcacatgtgtgccggaacccgagaaagatgctgacagtatcaatagctctattgacaagcagggcgccaagcttcttttgggtccaaatgacgcacccgccgggccctag

SEQ ID NO: 4229 - DNA, 492 bp, Artificial Sequence
  Description of Artificial Sequence: Synthetic coding sequence
atgaccgtgaagaccctgcacggccccgccatggtgaagtacctgttactctcaatcctggggctcgcctttctctccgaggcagcggccaggaagattcccaaggttggtcatactttctttcagaagcccgagtcttgccctcctgtgccagggggaagcatgaagcttgacatcggaattattaacgagaaccaaagggtgagtatgtcccgcaatatagaaagcaggtctacctccccatggaattacaccgtgacgtgggacccgaaccggtatccgagtgaggtcgtccaggcgcagtgtcggaaccttggctgtattaatgctcagggcaaggaggacatctccatgaactcagtccctatccaacaggaaacccttgtggtccggcgtaaacaccaaggatgctcagtgtcgtttcaactggaaaaggtcctggtgacggtcggctgcacatgcgttacgcccgtgattcaccacgtacaatag

SEQ ID NO: 4230 - DNA, 531 bp, Artificial Sequence
  Description of Artificial Sequence: Synthetic coding sequence
atgaaggccagcagcctggccttcagcctgctgagcgccgccttctatctgttgtggaccccatcaaccgggttgaaaaccctgaatctcggctcatgtgtcatcgcaacaaacctccaggagattcggaacggatttagcgagatccgtggatccgtgcaggctaaggacggcaacattgatattagaatccttaggcggactgagagtctgcaggatactaagcctgcaaatagatgttgtctgctgagacacctcctacggctttacttagacagggtctttaaaaattaccaaactccagatcattacacgctgaggaagatctcttccctggcaaattcctttttgacgatcaagaaggatctcagactgtgccacgcgcatatgacctgccattgcggagaggaagccatgaagaagtattcccagatactgtcacactttgagaagttggagcctcaagcagctgtcgttaaagctctcggagaattagatattcttttgcaatggatggaggagaccgagtag

SEQ ID NO: 4231 - DNA, 531 bp, Artificial Sequence
  Description of Artificial Sequence: Synthetic coding sequence
atgaaggccagcagcctggccttcagcctgctgagcgccgccttctatctgttgtggacaccttcaactggactgaaaacgctcaatctcgggagctgtgtgattgccaccaacctgcaagagatcaggaatggcttctcagagatcaggggttcggttcaggccaaagatgggaacatcgacattaggatcctgagaagaactgaaagcctgcaggatacgaagcctgcgaataggtgctgcctgctgcgccacctactgaggttgtacctggacagggtatttaaaaactatcaaacaccagatcattataccctgcggaagatctcatccctagccaacagtttcttgaccatcaagaaggatctgagactgtgccacgcccatatgacttgtcattgtggggaggaggctatgaagaaatattcccagatcctttctcatttcgagaaactggaaccacaagcggccgtggtgaaggcactcggtgagctggatatcctgctgcaatggatggaggagaccgagtag

SEQ ID NO: 4232 - DNA, 456 bp, Artificial Sequence
  Description of Artificial Sequence: Synthetic coding sequence
atgaaggccagcagcctggccttcagcctgctgagcgccgccttctatctcctgtggacacccagcacgggattaaaaacccttaacctcggatcatgtgtgattgccacaaatttgcaagagatccgaaacgggttcagcgaaattcgcggatctgtgcaagctaaggacggaaacatcgacatccgaattttacgtaggactgaatcccttcaagataccaagcccgcaaatcgatgctgcctccttcggcacctgctgcggctatacctggaccgtgtctttaagaattaccagacccccgaccattatacactgcgtaaaatttctagcctggcaaatagtttcctcacgattaagaaagatctccggttgtgccttgaaccccaggcggccgttgtgaaagccttgggtgagctggacatccttctgcaatggatggaggaaaccgagtag

SEQ ID NO: 4233 - DNA, 540 bp, Artificial Sequence
  Description of Artificial Sequence: Synthetic coding sequence
atggccgccctgcagaagagcgtgagcagcttcctgatgggcacccttgctaccagctgtcttctgttgctggcactgttagttcagggcggagcagccgcaccaatttcgtctcattgccgtttggacaaaagcaactttcagcagccttatatcactaaccgaacgttcatgcttgctaaagaagcttctctcgccgacaacaacacggacgtgaggctgatcggggaaaagcttttccacggagtgtcaatgtccgaaagatgttacctgatgaaacaggttctcaattttacactggaggaagtgctctttccacagtccgaccggtttcaaccatacatgcaggaggtagtaccttttctggcccgcctatccaacaggctttcaacttgtcatatagaaggagatgacctgcatatacagaggaacgttcagaaactcaaagatactgttaagaagttgggagagagtggcgagattaaggccattggggagcttgacctgctgtttatgagcctgcgcaacgcctgtatatag

SEQ ID NO: 4234 - DNA, 540 bp, Artificial Sequence
  Description of Artificial Sequence: Synthetic coding sequence
atggccgccctgcagaagagcgtgagcagcttcctgatgggcacccttgcaacgtcttgtttgttgctgcttgcactgctggtgcaggggggggctgccgccccgatttcttcccattgtaggctggacaagagtaactttcagcagccctatatcaccaatcgcaccttcatgctcgcaaaggaggctagcctggctgacaataacaccgacgttcgacttatcggggagaagctgttccacggggtttccatgagtgaaagatgctatttgatgaagcaggtgctgaactttaccctggaggaagtgttgttcccccaatcagaccgcttccaaccttatatgcaggaggtggtaccatttcttgcccgcctgagtaaccggttaagcacatgtcacatcgagggggacgacctccatattcagaggaacgtccagaagttaaaggatacagtaaagaagctcggagagtcaggggagatcaaggccatcggagagctggacctactgtttatgagcctccggaacgcatgcatttag

SEQ ID NO: 4235 - DNA, 1890 bp, Artificial Sequence
  Description of Artificial Sequence: Synthetic coding sequence
atgaaccaggtgaccatccagtgggacgccgtgatcgccctgtacatcctattcagctggtgccacgggggtataactaatataaattgcagtggccatatttgggtggaacccgccactattttcaaaatggggatgaatatcagcatttattgtcaagccgctataaagaactgccagcctagaaaactccatttctacaagaacggaataaaggagagattccaaatcacaagaatcaataagacgacagctagactgtggtacaagaatttcctggagccccacgcctcaatgtactgtacggcggaatgtcccaagcactttcaggagacgctgatctgcgggaaggatatatcttctggttatccacccgacatcccagatgaggtcacgtgcgtgatttatgaatattcgggtaatatgacatgtacttggaatgcaggcaaactcacctacatcgataccaagtacgtggttcacgttaagagcttggaaaccgaggaagagcagcagtatctgacctcctcatatatcaacatcagtactgatagcttgcaaggcggaaaaaaatatcttgtatgggttcaggccgcaaacgcgcttggaatggaggagtcaaaacagctgcagattcatctggatgacatcgttatccctagcgctgcggtaataagccgtgcggaaacaattaatgcaacagtgccaaagacaataatttactgggactcccaaacaacgatcgagaaggtttcttgcgagatgagatataaagccaccacaaatcagacctggaatgtcaaagagttcgatactaatttcacttacgtgcagcagtctgaattctatcttgaacccaatattaagtacgtcttccaggtgaggtgtcaagaaacaggcaagagatattggcagccatggagcagtctcttcttccacaagactcccgagaccgttcctcaggttacaagtaaagcctttcagcatgatacgtggaacagcggactcaccgtggcctctatctctacaggtcacttgacctcagataacagaggcgatattgggctccttctgggaatgatagtttttgccgtgatgttatcaatcctgagtctcattggcatttttaatcgcagcttcaggactgggatcaagaggcgcattttgctcctaatcccaaagtggctgtatgaggacatccctaacatgaaaaattctaacgttgtgaagatgttacaggagaactcagagctcatgaataataacagtagcgagcaagtattgtatgtcgatcccatgatcaccgagatcaaagaaattttcatcccggagcacaagcccaccgattacaagaaagaaaacaccggcccactagagacgagggactatccacagaattcactcttcgataacacaacagttgtttacatccccgacctgaacactggctacaaacctcaaatctcaaatttcctgcccgaggggtcacacttatccaataataatgaaattacatctctcaccctgaaacctcctgtggattctctggattcaggcaataacccgcggctccagaaacaccccaactttgcctttagcgtttcctcagtcaacagtctgtctaacacgatattccttggtgagttgtcattgatcctgaaccagggagaatgcagctcccccgatattcagaacagcgtagaagaggagaccaccatgcttctggaaaacgattcacccagcgagacgattcccgaacagaccctcctccctgatgagtttgtgtcctgtctgggaatagtcaacgaggagctgccaagcatcaacacttattttccacagaacatcctcgagagccacttcaacaggatcagcctattagaaaagtag

SEQ ID NO: 4236 - DNA, 1071 bp, Artificial Sequence
  Description of Artificial Sequence: Synthetic coding sequence
atgaaccaggtgaccatccagtgggacgccgtgatcgccctgtacattctattctcatggtgccacgggggaataactaacatcaattgctctggacatatctgggtggaaccagctacaattttcaagatggggatgaatatcagcatctactgccaggccgcaataaagaactgtcagccccggaagctgcacttctataagaacgggatcaaagaaaggttccagattacacgcatcaacaaaaccacggcaagattgtggtacaagaattttctggaaccccacgcttcaatgtactgcaccgccgagtgtccaaaacattttcaggaaaccctcatttgcggaaaagacatctcttcagggtatccgcctgacattccggacgaagtcacttgcgtgatttatgaatattccggcaacatgacatgtacctggaatgctggcaagctgacctacatcgatactaagtatgtggtgcatgtcaagtctctggagaccgaggaagagcagcaatacctgacctcttcatacattaatatcagtactgatagtttacagggcggcaagaagtacttggtgtgggtccaagctgcaaacgcactgggaatggaagagagcaagcagcttcaaatccatctagatgacatcgtgatccctagcgccgccgtcatctccagggcggagaccattaacgctactgtccctaagaccattatttattgggattcacaaacgaccatcgaaaaggtgtcgtgtgagatgagatacaaagctaccaccaatcagacatggaatgtcaaggaatttgatactaattttacctacgttcagcagtctgaattctatcttgagcctaacattaagtatgtcttccaagtccgctgccaggagaccggtaagagatactggcagccctggtcatctctgtttttccataagacccccgagactgtgcctcaggtcaccagtaaagcattccagcatgacacctggaattcgggtctaaccgttgcttccatttctactggacacctcaccagtggactcaaggagggatcatactgttag

SEQ ID NO: 4237 - DNA, 1125 bp, Artificial Sequence
  Description of Artificial Sequence: Synthetic coding sequence
atgatcctgcggccctaccagccctgcggcaccgtgaaggagttcgatacaaatttcacctacgtccaacagtctgaattttacctggagccgaacatcaaatacgtcttccaggtgcgctgtcaggaaactgggaaacgctattggcagccttggtcttccctcttcttccacaaaacccctgagaccgtgcctcaggtgacatccaaggcatttcagcacgacacatggaatagtggattgacagtggcctccataagcacaggacatctgacatcagataatcggggagatattggtctgctgcttgggatgattgtgtttgccgtgatgttgtcaatcctctctctaattggtattttcaatagatcttttcgtaccggaattaagcgccgaatcctgctcctgattccaaagtggctctatgaggatatcccaaacatgaaaaactctaacgtcgtcaagatgttacaggagaactcggaacttatgaacaacaactccagcgaacaggttctctacgtggatcccatgataacggaaattaaagaaatctttattcccgagcacaaacctactgattataaaaaggaaaatacaggccccttggaaacaagggactacccacagaactctctcttcgataataccacagttgtttatattccagatctcaacacaggctataagccacagatttcaaactttctgccagaaggttctcatctgagcaataacaacgagatcacctctctaactctcaaaccccccgtagacagcctcgacagtggcaacaatccacgattacaaaaacacccaaacttcgctttctcagtgtcaagtgtcaatagcctttcaaataccatttttcttggcgagctgagcctcattttgaaccagggcgagtgctcctctcccgacattcagaactccgttgaggaagaaacgacaatgctcctcgagaacgattcccccagtgaaaccatcccggaacaaacactgctccccgacgaatttgtgagttgcctgggcatagtgaacgaggagctgccctccatcaatacttatttcccccagaacatcctcgaaagccattttaacaggatctccttgctggagaagtag

SEQ ID NO: 4238 - DNA, 354 bp, Artificial Sequence
  Description of Artificial Sequence: Synthetic coding sequence
atgacctgcacctggaacgccggcaagctgacctacatcgacaccaaatacgtggtgcatgtgaagtcattggagacagaggaagagcagcagtacctgaccagctcatacatcaatatctccacagactcactgcaggggggtaaaaaatacgtgttccaggtgagatgccaagaaacggggaagaggtactggcagccttggtcctcactcttcttccacaagacgccagagactgtgccacaggttactagcaaagctttccagcacgacacctggaattccggactgacagtggcctccatctctactggacacctgaccagcggccttaaagaagggtcctattgctag

SEQ ID NO: 4239 - DNA, 1176 bp, Artificial Sequence
  Description of Artificial Sequence: Synthetic coding sequence
tgacacttcctgctgccccccctgagcaagaagagcctgctgcccccgacaatgatcctgagaccttaccagccctgcggcacagtaaaggagttcgacaccaactttacttacgtccagcagtcagagttctacctcgagcctaacattaagtatgtgtttcaggtgcgctgccaggagacaggaaaaaggtactggcagccgtggagtagcctgttctttcataagactcccgaaactgtaccccaggtaacaagcaaagcgtttcagcacgatacctggaacagcggacttactgtcgcctctatcagcacggggcatctgacaagtgataacagaggtgacattggcctgctccttgggatgatcgtgtttgctgtcatgctgtccatcctgagcttaataggcatatttaaccgatcttttcggaccgggattaagcgacgtattctactactgataccaaaatggctgtatgaggatattcccaatatgaaaaattctaacgttgtcaagatgcttcaggagaattctgagctgatgaacaacaactcttctgaacaagttctatatgtggaccccatgattacggagattaaggagattttcatccccgagcacaagcctaccgattacaagaaggaaaacactgggccgcttgaaactagggactacccccagaactcactatttgataacactacagtcgtgtacatcccagacctgaacactggctataaacctcagatctcaaatttcctgcccgagggcagccatttgtccaacaacaacgaaatcacctctcttacccttaaaccaccagtcgactcccttgattctggcaacaatccacgcctacaaaagcacccaaacttcgcattttccgttagttctgtcaactctctgagcaacacaatcttcctgggtgaactgtcgctgatacttaatcagggcgagtgtagctcccccgatattcagaactccgtggaggaggaaactacgatgctactggaaaacgactcacccagcgagactatccctgagcaaaccctcctacccgacgaattcgtgtcctgcctcggtatcgtgaatgaggagctgccaagtattaatacctatttcccgcaaaatatccttgagtcccacttcaaccgcattagcctgttggaaaagtag

SEQ ID NO: 4240 - DNA, 828 bp, Artificial Sequence
  Description of Artificial Sequence: Synthetic coding sequence
atgacctgcacctggaacgccggcaagctgacctacatcgacaccaaatatgttgtgcacgttaagtctctcgaaacagaggaggaacaacagtaccttacctctagctacatcaatatctctactgacagcctccagggcggaaagaagtacctggtttgggtccaggcagctaacgccttgggcatggaagagtcaaaacagctgcaaatacacttagacgatattgtcatccccagcgcagcggtgatctcaagagccgaaacgatcaacgccaccgtgcctaaaaccataatctactgggattctcagactacaatagaaaaagtatcatgtgagatgcgatataaggccaccaccaaccagacatggaacgtaaaagagtttgataccaactttacttacgtacagcagtccgaattctatctcgaacccaatatcaaatatgtctttcaggtgcgatgtcaagagacgggaaagcggtattggcagccgtggtcgtccctgttttttcacaagacacctgaaaccgacaaccggggagatattggcctgctcctgggtatgatcgttttcgcggtcatgttatccatcctgtccctcatcggcatctttaatagaagcttcagaacgggtataaaacggcgcatattgctgctgattcctaagtggttgtacgaagacattccaaacatgaagaactcaaatgttgttaaaatgttacaggaaaactccgagctgatgaataacaactcttctgaacaggtgctttatgtggaccctatgatcaccgaaattaaagaaattttcatacctgagcataagtag

SEQ ID NO: 4241 - DNA, 615 bp, Artificial Sequence
  Description of Artificial Sequence: Synthetic coding sequence
atgacctgcacctggaacgccggcaagctgacctacatcgacaccaagtacgtcgttcacgtaaagtccctcgagactgaggaggagcagcagtacttaacctcttcatacattaacatttctaccgacagtctgcagggcgggaagaagtatttggtgtgggtccaagcagcgaacgcccttggtatggaagagagcaaacagctgcaaattcacctcgacgatattgtcccacaggttacaagcaaggcgttccagcatgatacttggaactctggacttactgtggcgtcaatctcaacggggcacttgacatccgataacagaggtgacatcggcttattgctgggtatgatcgtgttcgcggtcatgctaagcattctgagccttataggtatctttaaccgcagctttcgcacaggtattaaacggaggatcctgctgttgatcccaaagtggctttatgaagatatcccaaatatgaagaactccaacgtggtaaaaatgttgcaagagaactctgagctcatgaataacaactctagtgagcaagtcctgtatgtggaccccatgattacagagatcaaggagatttttatccccgagcataagtag

SEQ ID NO: 4242 - DNA, 441 bp, Artificial Sequence
  Description of Artificial Sequence: Synthetic coding sequence
atgaacatcagcatctactgccaggccgccatcaagaactgccagccaaggaagctgcatttttacaaaaacggaataaaggaacgattccagattacaaggatcaacaaaaccactgcccgcttgtggtacaagaatttcctggagccacatgccagcatgtactgcactgctgagtgccctaagcacttccaggaaactctgatctgcggaaaggacatttcctctggctatccccctgatattcctgatgaagtcacatgcgtaatatatgagtacagcgggaacatgacctgtacatggaatgcaggtaagctgacatacattgacactaaatacgtcgtacacgtgaagcgtctgaagaatctcacaccaatcctgcacatgtgtaattctcaaaacagcacctggagtcagacgctgtcaacctacttcaaatag

SEQ ID NO: 4243 - DNA, 429 bp, Artificial Sequence
  Description of Artificial Sequence: Synthetic coding sequence
atgacctgcacctggaacgccggcaagctgacctacatcgacaccaagtatgtggtgcacgtgaaaagccttgaaacagaagaggaacagcagtacctgacctcctcttacatcaacatctccacggacagcctccagggcggaaaaaaatacctcgtgtgggtgcaggccgctaatgccttggggatggaagagtcaaagcagctgcagatccacctggacgatattgtgattccgtccgccgcagtcatcagcagagcagagactatcaatgcgacagtgcccaagacaattatttactgggatagccagactaccattgaaaaagtgagctgcgagatgcgctacaaagccacaacgaaccagacctggaactttccccgttctcatcagaaacactccaacatgactcacggtattctggggtag

SEQ ID NO: 4244 - DNA, 669 bp, Artificial Sequence
  Description of Artificial Sequence: Synthetic coding sequence
atgaacatcagcatctactgccaggccgccatcaagaactgccagcctaggaaactgcatttctataagaatgggataaaagagcggtttcagatcacccggataaataagacaaccgcccggctctggtataaaaattttctggagcctcacgcgtctatgtactgtaccgccgaatgccccaagcactttcaggaaactttaatttgtgggaaggatatctcatcaggctacccccccgatattcccgacgaggttacatgcgttatttacgagtactccggaaatatgacctgcacatggaacgccgggaagctgacctacatagacacaaaatatgttgtccacgtaaagagcctggaaacagaagaggagcagcagtacctcacctcgagttacatcaacattagtacagactccctgcaggggggaaagaaatacctagtgtgggttcaagcagcaaatgctcttggtatggaggagtcaaagcagttacagatccacctggatgacatcgtaattccatcggcagccgtgatctcacgcgcggagacaatcaatgccaccgtgcccaaaaccatcatatattgggattctcaaacaaccatcgaaaaggtttcatgcgagatgcggtacaaggcaactactaatcagacctggaacgattag

SEQ ID NO: 4245 - DNA, 1632 bp, Artificial Sequence
  Description of Artificial Sequence: Synthetic coding sequence
atggacgccttcaccggcagcggcctgaagcggaagttcgacgacgtagacgttggctccagcgtgagtaactccgatgacgaaatctcctcaagtgatagtgccgactcctgtgactcactgaacccccccacaaccgcttctttcacacccacatcaatcctcaagcgccagaagcagctgcgacgtaagaacgtcaggttcgaccaggtcactgtgtactactttgcaagaaggcagggtttcacctctgttccttctcaagggggctcttccctcgggatggcccagcgccacaactcggtcagatcttacaccttatgtgagttcgcacaagagcaagaagtgaaccacagagagatattacgcgaacaccttaaagaggagaaactgcacgctaaaaagatgaaattgaccaagaatgggactgtagagtctgttgaagccgacggcctaaccttagacgatgtcagcgatgaggacattgacgtggaaaatgtggaagtagatgattacttcttccttcagcctctgcctaccaagaggcgccgcgcgctgcttcgagcctcaggtgtacaccgaatcgacgcagaagaaaaacaggaactgagagctattagactatcccgggaagaatgtggctgcgactgtagactctattgcgacccggaagcttgtgcttgtagtcaagccggaataaagtgtcaagtggaccgcatgtccttcccgtgcggatgctcacgtgacggatgcgggaatatggctggccgcatcgagttcaatccgattcgggtaagaacccattacctccacactatcatgaagttagagttggagtctaagcggcaggtgagcaggccagcagcccccgacgaggagccctctccgacagcatcatgttcccttacgggcgctcaaggaagcgaaactcaggacttccaggaatttattgccgaaaatgagaccgctgtgatgcatcttcaatccgccgaggagctggagagactgaaggccgaggaggattcctctgggagcagcgcttccttggacagtagcatagagtcactgggcgtgtgtattctggaggaacccctcgcagtgccagaagagctttgtcccggactcaccgcacctatcctcatccaagcccagcttcccccgggatcttccgtgctgtgtttcacagaaaactcagatcacccaactgccagtaccgtcaacagcccttcttatctgaactccggacccctggtatattaccaggttgagcagaggcccgtccttggcgtgaagggagaaccgggcacagaagagggctccgccagttttccaaaggagaaagacctcaacgtgttttccttacccgttacaagcctcgtggcctgctcctccaccgatcccgccgccctgtgtaagagtgaagttggtaagaccccaaccctcgaggccctgcttcctgaagattgcaacccagaggaaccagagaatgaagattttcatccgtcttggtcaccttcatcactgccattcagaaccgataacgaggaaggttgcggcatggtcaaaacatctcagcagaacgaggacaggcctcctgaagatagctctttggagctgcctcttgcggtctag

SEQ ID NO: 4246 - DNA, 621 bp, Artificial Sequence
  Description of Artificial Sequence: Synthetic coding sequence
atgaacttccagcagcggctgcagagcctgtggaccctggcccggcccttttgcccccccctgctggctaccgccagccagatgcaaatggtggtgctgccatgcttggggtttactttgttgctttggagtcaggtctccggcgctcaaggacaagagttccatttcggaccatgtcaagtgaagggcgtggtcccccagaagctttgggaagctttctgggccgtcaaagataccatgcaggcacaggacaacataaccagcgctagactcttacaacaggaggtgctgcagaacgtgtccgatgccgagtcctgttacctggtacacaccttgctggagttctatctcaaaacagtgttcaagaactaccacaaccggacagtcgaggtccgtaccctaaaatccttctctactctggccaacaattttgtcctcatcgtgagtcagctccagccttcacaagagaatgaaatgttctcgatccgagactctgcccatagacggtttctgctcttccgccgtgccttcaagcagctggacgtagaggcggctctgacaaaagcgttaggggaagtggatatcctacttacatggatgcagaaattctataagctctag

SEQ ID NO: 4247 - DNA, 465 bp, Artificial Sequence
  Description of Artificial Sequence: Synthetic coding sequence
atgaacttccagcagcggctgcagagcctgtggaccctggccagcaggcccttctgccccccactgctggccacagcttctcagatgcagatggttgtgcttccctgcctggggttcaccctgttgctgtggtcacaggtgtccggagcccaggggcaggagttccacttcggaccttgtcaggtcaaaggggtggtaccgcaaaaattatgggaagcattctgggctgtgaaagacactatgcaagcacaggataacattacctcagcgcggctgctgcagcaggaagttctgcagaatgtgtctcaagaaaatgagatgttctccatccgggatagtgcccaccgcaggtttctgctgtttcgtagggcattcaaacagctagatgtggaggctgcacttaccaaagctcttggtgaggtagatattttactgacctggatgcaaaagttttataaactgtag

SEQ ID NO: 4248 - DNA, 624 bp, Artificial Sequence
  Description of Artificial Sequence: Synthetic coding sequence
atgaacttccagcagcggctgcagagcctgtggaccctggccagcagaccattctgtcccccactcctcgccacagcaagccaaatgcagatggtcgtgttgccatgcctcgggttcaccctgctgctttggtcccaggtatccggcgcacagggccaagagtttcatttcggtccatgccaagtaaaaggtgtggtcccgcagaaactctgggaagccttttgggcagtcaaagataccatgcaagctcaggacaatatcaccagcgcccggttgttgcagcaggaggtgctgcaaaacgtgagtgatgccgagagctgttatcttgtccacacacttctggagttttacctcaaaaccgtgtttaagaattaccataatcggaccgtggaggtacggaccctgaagagcttttccacattggccaacaacttcgtcctgatcgtcagccagctccagcctagccaagagaacgagatgtttagcatcagagatagcgctcacagacgattcctgctgttccgccgggccttcaagcaacttgacgtggaggcggccctaaccaaggcgttaggggaggtcgacatcctactcacttggatgcaaaaattttataagttgtag

SEQ ID NO: 4249 - DNA, 534 bp, Artificial Sequence
  Description of Artificial Sequence: Synthetic coding sequence
atgcgggagcggccccggctgggcgaggacagcagcctgatcagcttatttctgcaagtcgttgccttccttgcaatggtaatgggtacacacacatattcccattggccttcctgctgcccctctaaagggcaggacacttcagaggagctgcttcggtggtctactgtgccagttcccccccttgagcctgctaggcctaaccggcatcctgagagctgccgcgcctctgaggacggcccacttaacagcagggcgatatccccctggaggtacgagctggaccgcgatctcaaccgactgccacaggatctgtatcatgcccggtgtctctgcccccactgtgtctctctgcaaacgggctcgcatatggatcccagagggaatagcgagttactttaccataatcagactgttttttataggcggccctgtcatggcgagaaagggacgcataagggatattgtctggagcgccgactctaccgagtgtctcttgcttgtgtctgtgtgaggccgcgcgtgatgggatag

SEQ ID NO: 4250 - DNA, 486 bp, Artificial Sequence
  Description of Artificial Sequence: Synthetic coding sequence
atgtaccaggtggtggccttcctggccatggtgatgggcacccacacttactcccactggccatcctgttgcccttccaaaggacaggacacctcggaagagctcttaaggtggtcaacagttccagtccctccactggagcctgcgaggcccaaccggcacccagagagttgcagggcatcagaagacggtcctctcaactcacgagccatctcgccctggcgctacgagctggaccgtgacctcaacaggctcccgcaagacctgtaccatgctcggtgtctgtgcccacattgtgtgagtcttcagacaggcagccacatggatcccagagggaactccgagctgctgtaccacaatcagaccgtcttctataggagaccctgccacggtgagaagggaacccataagggttactgtctcgagagacgtctgtatcgcgtctctctggcctgcgtgtgcgtcagacctcgggtaatgggctag

SEQ ID NO: 4251 - DNA, 2775 bp, Artificial Sequence
  Description of Artificial Sequence: Synthetic coding sequence
atggacgtgctgcccaccggcggcggccggcccggcctgcggaccgagctagaatttcgcggtggcggtggagaagctcggctcgagtctcaagaggaggagaccattcctgcggcaccgcccgcacccaggctgcgtggtgccgcagagagacctcggcgctcacgggacacatgggatggggatgaagatacggaacccggagaggcctgtggcggaaggacaagccggacagcctcccttgtgtctgggttgctgaatgagctgtactcatgtacagaagaagaggaagccgccgggggcggcaggggggcggagggacgtcggcggcgcagggattccctcgactctagcacagaggcttcagggtccgatgtcgttctgggtggtaggtccggagcaggagattcccgggtgctgcaagagcttcaggagagaccatcacagaggcatcaaatgctgtatttacgccagaaagatgctaacgaacttaaaaccatattaagagaactgaagtaccgcatcggcatccagtcagctaaacttctacgtcacctcaagcagaaagatcggctacttcacaaagtacagagaaattgtgacatcgttaccgcttgtcttcaggcagtgagccaaaagcggcgtgtggacacaaagctgaagttcaccctggaacccagcttaggccagaatggctttcagcaatggtacgatgcacttaaggcagtggcccgcctcagtacaggcattcctaaggaatggcgtagaaaggtctggcttactctggccgatcactatctccatagcatagcaatcgattgggataaaacaatgcgtttcaccttcaacgagcggtcaaatccagatgacgattcaatggggatacagattgtgaaggacctccatcgcactggctgttcatcatattgtggccaagaagccgagcaggacagagttgtccttaagcgcgtcctgcttgcttacgccagatggaataagaccgtgggctattgccaagggttcaatatactcgctgctctgatcttggaggtgatggaaggaaacgagggcgatgctctgaaaattatgatctatctaattgataaggtgctcccggaaagctacttcgttaacaaccttcgggccctttctgtggacatggccgtgtttcgggatctcctgcgcatgaagctccccgaactgtcacaacacttagacactctccagcggacagcgaacaaagagtccggagggggttacgaaccccccctcacgaacgtgtttactatgcagtggtttttgactctttttgcgacttgtcttcccaatcaaaccgtacttaaaatctgggatagcgtgtttttcgaaggaagcgagataattctccgagtttccttagcaatctgggctaaattaggtgagcagatcgaatgctgcgagacagcagacgaattttatagcactatgggaagattaacgcaggaaatgcttgaaaacgacttgttgcaatcgcacgaattgatgcagactgtgtactccatggcccctttccccttccctcaactcgctgagctgagagaaaagtacacatacaacatcacaccattcccagccactgtcaagcctaccagcgtctccggccggcactcaaaggcccgagattctgatgaggaaaatgatccagacgatgaggatgcggtagtcaatgccgtgggatgtttagggccattttcgggatttttagctcctgagttacaaaaatatcagaagcaaataaaggagcctaacgaggagcagagccttcggtcaaataacattgcagaactgtcccccggagccattaatagttgtcggtctgagtaccacgcggcatttaatagcatgatgatggagaggatgactaccgacataaatgccttgaagcgtcagtacagtcgaattaaaaagaaacaacaacagcaggtgcatcaggtttacattcgagctgacaaaggccccgtcacctctattttgccatcccaggtgaattcatccccggtcatcaaccacctgctgctcggcaagaaaatgaagatgactaaccgagctgccaaaaacgccgtgattcacatccctggacacaccggcggtaaaatttctccagtgccctatgaagatctcaaaacaaagcttaatagcccttggaggactcatatcagagtgcacaaaaagaatatgccacggaccaaaagtcatcctggatgtggcgacacagtgggcctcatcgatgagcaaaatgaggcgtcgaaaactaatgggctaggcgccgcagaggcctttcccagcggatgtacagcaacggccgggcgagaaggttcatcacccgagggtagcacccgccgtaccattgaaggccagagtcccgagccggtcttcggcgatgccgatgtagatgtgtctgccgtccaggctaaactgggcgccctggagttgaaccagcgcgatgcagcagccgagactgaacttcgggtgcaccccccttgccagcggcactgccccgaaccccctagcgcccctgaagagaacaaggccactagtaaagcaccgcagggctcaaactccaagacgccaatcttttcaccctttccgtccgtgaagcctctgcgcaagagtgcaaccgcccgtaacctcggactgtatggacccaccgagcgtacgcccaccgtccacttcccgcagatgtctcggtcgttcagcaagcccggtgggggcaattcaggaaccaagaagaggtag

SEQ ID NO: 4252 - DNA, 732 bp, Artificial Sequence
  Description of Artificial Sequence: Synthetic coding sequence
atgggccagaccgccggcgacctgggctggcggctgagcctgctgttgctcccactcctcctggtgcaagctggcgtgtggggatttcccagacccccagggaggcctcagctctccctacaggaacttaggcgtgaatttaccgtgtcactccacctggcaagaaaacttctctctgaagtgcgaggacaggcccaccggttcgcagaatcacatttgcctggggtgaatctgtaccttcttcccctgggcgagcagctgcccgacgtctcactgacgtttcaggcgtggaggcgtctttcagatccagaacggctatgctttatctctacaaccctccagccttttcatgccctcctggggggcttgggtacacagggaagatggaccaatatggagagaatgcagctgtgggccatgcgcttagatctgagggacctccagcgccatctgcgcttccaggtcctggcggcaggtttcaatctgcccgaagaggaagaagaagaggaggaggaagaggaggaggaacggaagggattgctgcccggggcgctggggagtgccctccagggtccagcacaagttagttggccccagctgctcagtacttatcgactcctgcactctcttgagctggtcttatcgcgcgccgtcagggagctcctcttgctgtccaaagctgggcatagcgtttggccactgggcttccctactttatcaccccagccgtag

SEQ ID NO: 4253 - DNA, 603 bp, Artificial Sequence
  Description of Artificial Sequence: Synthetic coding sequence
atgaagctggacatgaccggcgactgcacccccgtgctggtgctgatggctgcggtcctgacagtgacaggcgccgtgccagtagcccggttacacggcgctttgcccgatgctcgaggctgccacattgctcagtttaaaagtctcagtccgcaggaacttcaagcctttaagagggccaaggacgccctggaggagagcctactgctcaaggattgcagatgccactcgaggctgttccccagaacatgggacctccgacaactccaagtaagagagcgtcctatggcacttgaggccgaactggccctaaccttgaaggtgctggaggccacggctgatactgatcctgcactcgtagacgtgctggaccagccgctccataccctccatcacatcttgtcccagttcagagcttgcattcaaccccaacctaccgccggcccacgtaccaggggacggctgcaccattggctctacaggttgcaagaggctcctaaaaaagaaagtcccggatgtctggaggcctcagttacatttaatctcttccgactgttgaccagagatctaaactgcgtggcaagcggtgacctgtgtgtctag

SEQ ID NO: 4254 - DNA, 591 bp, Artificial Sequence
  Description of Artificial Sequence: Synthetic coding sequence
atgaccggcgactgcatgcccgtgctggtgctgatggccgccgtgttaaccgtaaccggcgccgtgcccgtcgcccgactgaggggcgccctcccagacgcacgcggctgccacattgctcaatttaagtctctgagtcctcaggaactccaagccttcaagcgggcaaaggatgcactggaggagagcctgttattgaaggactgcaagtgccgcagccgtctgttcccccggacgtgggatctgcgccagttgcaggtgcgtgagcgcccagtggcccttgaagctgagctcgcactgactcttaaggtgctggaggcaaccgcagacacagatccggcattaggcgacgtcctggatcagccccttcatacgctacatcatatattgtcacagttacgtgcctgcatccagccacagcctactgcagggccccgtacgcggggccgcttacaccactggcttcatcggttgcaggaagctcctaaaaaagagtcccctggatgcctggaggcaagcgtgacatttaacctgtttcgcctccttacacgggatttgaattgtgtcgccagcggcgatttatgtgtgtag

SEQ ID NO: 4255 - DNA, 603 bp, Artificial Sequence
  Description of Artificial Sequence: Synthetic coding sequence
atggccgccgcctggaccgtggtgctggtgaccctggtgctgggcctcgccgtagccggtccagtaccgacctcaaagccaactactacaggcaagggctgtcatataggtcgctttaaatcactgagtcctcaggagctcgcttcattcaagaaagcacgggacgccctcgaagagtctctgaaattgaagaattggagctgttccagtccagtgtttccagggaactgggatttgagactactgcaggttcgggaaaggcccgtggccctcgaggccgaactcgcccttacactgaaggtgctggaggctgcggctggaccagccttagaagacgtcctcgatcagccactccacaccctccatcatattctgtcccaactgcaggcttgtatccagccacagccaaccgccggccccaggccgagaggaaggctgcaccattggcttcacaggctgcaggaggcccccaaaaaagagagcgccgggtgcctggaagcgtccgtcacgtttaacctgttcagattgcttactcgcgaccttaagtacgtcgcagatggtaacctttgtttgcggaccagcactcacccggaaagcacctag

SEQ ID NO: 4256 - DNA, 495 bp, Artificial Sequence
  Description of Artificial Sequence: Synthetic coding sequence
atggccagccacagcggccccagcaccagcgtgctgttcctgttctgttgcctcggaggatggctggccagccatacactgcctgtgcgactcctgaggcccagtgatgacgtgcagaaaatcgttgaggaacttcagtcactctctaagatgctcctcaaggacgtcgaagaagagaaaggggtgcttgtttctcagaactacacgctgccgtgtctgtccccagacgcacagcctcctaacaacatccactcaccagctatccgggcttatcttaagactattagacagttagataacaagtcagtgattgatgagatcatagagcacctggataagctcatattccaggatgcacctgagaccaatatctcagtcccaaccgatactcacgaatgtaagaggtttatcctgaccatctctcagcagttcagcgagtgtatggaccttgccctgaagtcccttacttcaggagcacaacaagccactacctag

SEQ ID NO: 4257 - DNA, 507 bp, Artificial Sequence
  Description of Artificial Sequence: Synthetic coding sequence
atgtgcttccccaaggtgctgagcgacgacatgaagaagctgaaggcccgcatggtgatgtcttccctcgccgagctggaagatgattttaaggaagggtacctggagactgtggccgcctattatgaggaacagcatcccgaactcactcctctactggagaaggaacgcgatggactgagatgcagggggaacaggtctccagttcccgatgttgaggatcccgcgacagaagagcctggagaatcgttttgcgataaagtgatgcgctggtttcaggctatgctccagagacttcagacctggtggcacggggtcttggcgtgggtcaaagagaaggtggtggccctcgttcacgccgtccaagcactatggaagcagttccaaagcttttgctgcagcctctcagaactgtttatgagcagctttcagtcttatggcgctcccaggggggacaaggaggaactgacgccccagaagtgcagcgagcctcagagttccaagtag

SEQ ID NO: 4258 - DNA, 567 bp, Artificial Sequence
  Description of Artificial Sequence: Synthetic coding sequence
atgtgcttccccaaggtgctgagcgacgacatgaagaagctgaaggccaggatgcaccaggccattgaacgcttctacgacaagatgcagaacgcggaaagcgggcgaggacaggtgatgagctccctggctgagctcgaagacgattttaaagagggctaccttgagactgtggccgcatactacgaggagcagcaccccgagttgacgcccctattagagaaggaacgagacggattacgctgcaggggtaatagatctcccgttcccgacgttgaggatccagctactgaagagccgggcgagtccttctgcgacaaggtgatgcggtggtttcaggctatgttgcaaagactccaaacctggtggcatggcgtcctggcctgggtgaaagaaaaagtggttgccctggtccatgcggtccaggccctgtggaagcagttccagtccttctgctgtagcttgtccgagctgtttatgagttcgtttcagtcgtacggggcaccaagaggagacaaagaggagctgactcctcagaagtgttccgagcctcaaagtagcaagtag

SEQ ID NO: 4259 - DNA, 540 bp, Artificial Sequence
  Description of Artificial Sequence: Synthetic coding sequence
atgtgcttccccaaggtgctgagcgacgacatgaagaagctgaaggcccgtatgcatcaagcaattgagaggttctacgataaaatgcagaacgctgagtctggcagggggcaggacgattttaaagagggctacctggagaccgtcgctgcatactacgaggagcaacatccagagctgactcctctgctagagaaagagcgggacggcctcaggtgtagggggaatagatcgccagtgcctgatgttgaggacccagcaaccgaagagcccggtgagagcttctgtgacaaagttatgcggtggttccaggcaatgcttcaaaggttgcagacctggtggcacggcgtactggcatgggtcaaagaaaaggtggtggccttggtgcacgccgtgcaagctctttggaaacagtttcagtctttttgttgctccctatccgaattgttcatgtcgagttttcagagctacggagccccacggggtgacaaggaggaactgaccccccagaaatgtagtgagcctcagtcgtctaagtag

SEQ ID NO: 4260 - DNA, 396 bp, Artificial Sequence
  Description of Artificial Sequence: Synthetic coding sequence
atgtgcttccccaaggtgctgagcgacgacatgaagaagctgaaggcgcggatgcaccaggccatagagcgattctacgataagatgcagaacgctgagtccgggaggggtcaggttatgtcctcactggcagagctcgaggatgacttcaaggaaggctacctggaaactgtggccgcttattacgaagagcaacatccggaactgactcctctgctcgaaaaggaaagggatgggctcagatgtcgtggaaataggtccccagtccccgacgtggaagatcctgcaactgaggagcctggagaatcattttgcgataagtcttacggcgcccctcgtggagacaaagaagagttaacgcctcagaagtgctcagaaccacagtcatctaagtag

SEQ ID NO: 4261 - DNA, 705 bp, Artificial Sequence
  Description of Artificial Sequence: Synthetic coding sequence
atgtgcttccccaaggtgctgagcgacgacatgaagaagctgaaggcgcggatggtgatgctccttccgaccagtgctcaaggtctgggggcttgggtgagtgcatgtgacactgaagataccgtaggtcatctggggccttggagagataaagaccctgccttgtggtgtcagctgtgcctctccagtcagcatcaggctatcgagaggttttacgacaaaatgcagaacgccgagtccggacgcggacaggttatgtcttctctagccgaactggaggatgacttcaaagagggttatctggagacagtagctgcttactatgaagagcagcatccggagctgacgcctctgctggaaaaagagagggacggattacgctgtagaggaaacagatcgcctgtcccggacgtcgaagaccccgccacggaagagcctggcgaaagcttttgtgataaagttatgaggtggttccaagccatgttgcaaaggttgcaaacgtggtggcatggagttctcgcttgggtgaaggagaaggttgtagctctggttcatgccgttcaggctctgtggaaacagttccaatccttctgttgctcgctctccgagcttttcatgagctctttccaatcctatggagcaccgcggggagacaaggaagagctgacaccacagaagtgttccgagcctcagtcctcaaagtag

SEQ ID NO: 4262 - DNA, 567 bp, Artificial Sequence
  Description of Artificial Sequence: Synthetic coding sequence
atgtgcttccccaaggtgctgagcgacgacatgaagaagctgaaggcacggatgcatcaagcaatcgaaaggttctatgacaagatgcagaacgcagagtctgggcgaggacaggtcatgagctcccttgctgaactcgaagacgatttcaaggaaggctatctcgagaccgtcgccgcatactatgaggaacagcacccggaactgactccacttttggagaaggaaagagacggactgcgatgtagggggaacaggagcccagtccctgacgtcgaggacccggctactgaagagcctggagaatcattctgtgacaaggttatgagatggttccaggcaatgctgcagagactgcagacctggtggcacggcgtcctggcgtgggtgaaagaaaaggttgtcgccctggtgcacgccgtgcaggcgttatggaaacagtttcagagtttctgttgtagtttgtccgaactctttatgtcttcctttcaaagctacggtgctccgcgcggggataaagaagagctcacaccacaaaaatgctctgaaccgcaaagctcaaaatag

SEQ ID NO: 4263 - DNA, 567 bp, Artificial Sequence
  Description of Artificial Sequence: Synthetic coding sequence
atgtgcttccccaaggtgctgagcgacgacatgaagaagctgaaggccaggatgcaccaggccattgaaagattttatgataaaatgcaaaacgcggaatcaggccggggccaggttatgtccagtctggcggagttagaggacgattttaaggagggatatctggaaactgtagcagcttattacgaggagcagcaccctgaactaacacctctgcttgagaaggaacgagatgggctcagatgcagaggaaatagaagccctgtccccgacgtggaagacccagccaccgaggaacccggcgaatcattttgcgataaggtgatgcgttggtttcaggctatgctccaaaggctccagacgtggtggcatggcgtgctggcatgggtcaaagagaaagtagtcgcactcgttcacgccgtgcaagccctgtggaagcagttccagtccttttgctgcagcctctctgagctctttatgtcttccttccaatcatacggggcacctcggggggataaggaggagctcaccccccagaaatgcagcgagccgcaaagctccaagtag

SEQ ID NO: 4264 - DNA, 567 bp, Artificial Sequence
  Description of Artificial Sequence: Synthetic coding sequence
atgtgcttccccaaggtgctgagcgacgacatgaagaagctgaaggcccgcatgcaccaggcaatcgaaagattttatgacaaaatgcaaaatgctgagagtggccgcggccaggtaatgtctagtctggcggagttggaggacgatttcaaagagggctacctggaaactgtcgccgcttattatgaggagcagcacccagagctaacaccactgttagaaaaggaacgtgacggactgcgttgccgcggcaacagatctccagtacctgacgtcgaagaccctgctaccgaggagcccggtgaatcattctgcgataaggtgatgcgttggttccaggccatgctgcagcgtctccagacctggtggcacggagtcttagcctgggtcaaggagaaagtggtcgcccttgtgcacgccgttcaggcactctggaaacagttccaaagcttctgttgctctctatccgagctgtttatgagcagtttccagtcttacggtgcaccacgcggtgacaaggaggagctgacgcctcagaaatgttctgagcctcaatcctctaagtag

SEQ ID NO: 4265 - DNA, 567 bp, Artificial Sequence
  Description of Artificial Sequence: Synthetic coding sequence
atgtgcttccccaaggtgctgagcgacgacatgaagaagctgaaggccagaatgcaccaggctattgaaaggttctacgacaagatgcagaatgccgaatccggacgcgggcaggtcatgagcagccttgcggagctggaggatgatttcaaggaggggtacctggagacggtggcagcctattacgaggaacagcatcccgagctgacccctctactcgagaaagagagggatgggcttcggtgtcggggcaacaggagccccgtccctgacgtcgaggacccggccactgaagagcccggtgaatctttctgtgacaaagtgatgcggtggttccaggcaatgcttcaacggctgcaaacctggtggcacggtgttctcgcctgggtgaaggagaaggtggttgcgctggtgcacgcagtgcaggccctgtggaaacagttccaatctttctgttgctccctttctgagctgtttatgtcctccttccaatcatatggagctcccaggggcgacaaggaagaactcacccctcagaagtgcagtgagccccagtcttcaaagtag

SEQ ID NO: 4266 - DNA, 567 bp, Artificial Sequence
  Description of Artificial Sequence: Synthetic coding sequence
atgtgcttccccaaggtgctgagcgacgacatgaagaagctgaaggctcgcatgcatcaggccatcgagcggttctatgacaagatgcagaatgctgagagcggccggggccaagtaatgtctagtctcgccgagctggaggacgattttaaggaaggctacctggagaccgtagcagcttattacgaggaacaacaccctgagctgaccccgctcttggaaaaagagagggatggtctgagatgccgcggcaataggagcccagttccggatgtagaggaccctgcgactgaggagcccggtgaatcattctgcgacaaggtgatgcggtggttccaggctatgctgcagagactgcagacttggtggcatggagtgctcgcatgggtgaaagagaaagtggtggctctagttcacgcagtgcaggcgctgtggaagcagtttcagtcattttgctgtagtctgtctgagcttttcatgagctcttttcagagctacggcgcccctcgcggggataaagaggaactgaccccccagaagtgcagcgaaccccagagctctaaatag

SEQ ID NO: 4267 - DNA, 567 bp, Artificial Sequence
  Description of Artificial Sequence: Synthetic coding sequence
atgtgcttccccaaggtgctgagcgacgacatgaagaagctgaaggccagaatgcaccaggcgatcgaaaggttttatgacaagatgcagaatgccgaatccggacggggtcaagttatgtcttccttggctgagctggaagacgattttaaggagggctaccttgaaactgttgccgcctattacgaggaacagcatccagagttgactcctctgctggaaaaggagcgcgatggcttgcgatgccgagggaatcggagccctgtgccggatgtggaggaccccgccaccgaagagcccggggagtcattctgcgacaaggtcatgcgttggttccaggcgatgttgcagaggctccagacatggtggcacggtgtgctggcatgggtcaaagagaaggtggtcgccctggtgcacgcagttcaggctctgtggaaacagttccaatccttttgttgcagccttagcgaattattcatgagctccttccaatcttatggcgcgcccagaggcgacaaagaggagctaaccccccaaaaatgttccgaaccccagtcctccaaatag

SEQ ID NO: 4268 - DNA, 567 bp, Artificial Sequence
  Description of Artificial Sequence: Synthetic coding sequence
atgtgcttccccaaggtgctgagcgacgacatgaagaagctgaaggcgcggatgcatcaggccattgaacgattctacgataaaatgcaaaacgccgaaagcggccgcggccaggtgatgagcagccttgccgaactggaggatgactttaaggagggatatctcgagacagtggctgcttactacgaggagcagcaccccgagctgacgccattacttgagaaggagagggacgggttacgctgtcggggaaaccggagtcctgttcccgatgtggaggatccagcaaccgaggagcctggcgagtcgttctgcgacaaggtcatgagatggttccaagcaatgctgcagcgactccagacatggtggcatggagtgcttgcctgggtcaaggaaaaggtcgtggctttggttcacgccgttcaggctctgtggaaacagtttcagagcttttgctgcagtctgtcggaactgttcatgtcgtcctttcagtcatatggggcccctagaggagacaaggaagagctcacgccacagaaatgctccgaaccacagtcctccaagtag

SEQ ID NO: 4269 - DNA, 507 bp, Artificial Sequence
  Description of Artificial Sequence: Synthetic coding sequence
atgtgcttccccaaggtgctgagcgacgacatgaagaagctgaaggcacgaatggtgatgtcttctctggccgaattggaggacgactttaaggaaggctacctggagaccgtcgccgcttactatgaggagcagcaccctgaactgacacccttgctcgaaaaggaacgggacggattacgctgccgaggcaacagaagccccgtcccggacgtagaagatccggcaaccgaagagcccggcgaaagtttttgcgataaagttatgcgctggtttcaggccatgctgcagagattacagacctggtggcatggagttctggcatgggtgaaagaaaaggtggtcgcattggttcatgccgtccaggccctgtggaagcagtttcagagtttctgctgctccctgagtgaactgtttatgtccagtttccagtcttacggtgcacccagaggcgataaggaggaattgacaccccagaaatgctcagagccccagagctctaaatag

SEQ ID NO: 4270 - DNA, 537 bp, Artificial Sequence
  Description of Artificial Sequence: Synthetic coding sequence
atgaagaagctgaaggcccggatgcaccaggccatcgagcggttctacgacaagatgcagaacgctgagtccggtcgagggcaggtgatgagctctctggctgaactggaggatgatttcaaggaaggctacctggagaccgtggccgcctattacgaggaacagcaccctgagttaacaccgctgctggagaaggagcgcgatggtttgcgttgcagagggaatagaagtccagttcccgatgtggaagacccagctactgaagaacccggggagagtttttgtgataaagtgatgcgatggtttcaggcgatgctgcaaaggcttcagacatggtggcacggcgtcctggcctgggtgaaggaaaaagtggtggctctggtgcatgccgtgcaggctctgtggaaacagttccagagcttttgttgcagtctgtcagagctgttcatgtccagctttcagagctatggcgctcctagaggtgacaaggaggagttgacaccccagaaatgcagcgagccccagagttccaaatag

SEQ ID NO: 4271 - DNA, 567 bp, Artificial Sequence
  Description of Artificial Sequence: Synthetic coding sequence
atgtgcttccccaaggtgctgagcgacgacatgaagaagctgaaggccagaatgcatcaggcgatagaacgattctacgacaagatgcagaatgctgaaagtggtagaggccaagtgatgtctagcctcgccgaactggaggatgacttcaaagaaggatacctcgagaccgtggcggcctattatgaagaacaacatccggagctaacaccccttctagagaaggaaagggatggactgaggtgcagagggaaccgcagccccgtgcccgatgtggaagacccggccaccgaggagccaggtgaatcattttgtgataaggtgatgcggtggttccaggccatgcttcaaaggcttcagacttggtggcacggcgtcctcgcatgggtgaaggagaaggtggtggctctggtccacgccgtgcaagctttgtggaagcagttccagtctttttgttgttccctttccgagttattcatgagctcctttcaaagttacggggcgcctcgaggcgacaaagaagaactgactccacagaaatgttcagaacctcagagttcaaaatag

SEQ ID NO: 4272 - DNA, 705 bp, Artificial Sequence
  Description of Artificial Sequence: Synthetic coding sequence
atgtgcttccccaaggtgctgagcgacgacatgaagaagctgaaggcccggatggttatgcttttgccgacatctgcacagggtctgggggcatgggtatcagcctgtgacaccgaggatacagtgggccatctgggtccctggagagataaggacccagctctctggtgccagctctgcctgagcagtcagcaccaggcgattgaacggttttacgataagatgcagaatgccgagagcggccgcggacaagtcatgagttccctcgcagagttagaggatgatttcaaggagggctatctggaaaccgtcgcagcatattatgaggagcaacaccccgagctgactccactgctcgaaaaagagagggacggcttgcggtgtcgcggcaatagaagccccgtccctgacgttgaggatcccgccaccgaggaacccggagaatcattctgtgacaaagtgatgaggtggtttcaagctatgctccagaggctgcagacttggtggcatggagtcctcgcgtgggtaaaggagaaggtggttgcattagtgcacgcggtgcaagcactgtggaaacagtttcagagtttctgctgtagtctctctgagctatttatgtccagcttccagtcctacggggcacctcgaggcgacaaggaagaattgaccccacagaagtgctctgagccccagagctccaagtag

SEQ ID NO: 4273 - DNA, 705 bp, Artificial Sequence
  Description of Artificial Sequence: Synthetic coding sequence
atgtgcttccccaaggtgctgagcgacgacatgaagaagctgaaggcaagaatggtcatgctgcttcctacttctgcccagggcctaggggcgtgggtgtctgcctgtgacaccgaggatacggttggacaccttggtccctggagagacaaagatcctgcactatggtgtcagctgtgtctctcctctcagcaccaggcaatcgagcgcttctacgataagatgcagaacgcggaatccgggagaggtcaggtgatgagcagcctggcagaactggaagatgactttaaggagggctacttagaaaccgtggctgcctactacgaagagcagcaccccgagttaacgcccctgctcgaaaaagaaagagacggactccggtgccgcggaaacagatcacctgtgccagacgtggaagacccggcaactgaggaacctggcgaatctttttgcgacaaggtgatgcgatggtttcaggccatgctccagaggcttcagacttggtggcacggtgtactggcctgggtgaaagagaaggtggtggctttggttcacgctgtacaggcactctggaagcaatttcagagtttttgctgcagtttgtcagaactctttatgtccagttttcagtcttacggcgccccccgcggcgacaaggaggaactcacaccacagaagtgttctgagccacagagcagcaagtag

SEQ ID NO: 4274 - DNA, 540 bp, Artificial Sequence
  Description of Artificial Sequence: Synthetic coding sequence
atgtgcttccccaaggtgctgagcgacgacatgaagaagctgaaggcaagaatgcatcaggccattgagaggttttatgacaaaatgcagaacgctgaatctggacggggccaagacgactttaaggagggctacttggaaacagtcgcagcatattacgaagagcagcaccccgagctgacacctttacttgagaaagagcgggacggcttgcgttgccgcgggaaccgatctccagtgcccgacgtcgaagatcccgccactgaggaacctggcgagagcttctgcgacaaggtgatgcgctggttccaagccatgctccagcgcctgcagacatggtggcatggtgtactggcctgggtcaaagaaaaggtagtcgcgctcgtgcatgcagttcaagccctgtggaaacagtttcaaagcttctgttgtagcctgagcgagctcttcatgagctctttccaatcttacggtgcccctaggggagataaagaggaactgactccccagaagtgcagcgagccgcagagtagtaaatag

SEQ ID NO: 4275 - DNA, 678 bp, Artificial Sequence
  Description of Artificial Sequence: Synthetic coding sequence
atgtgcttccccaaggtgctgagcgacgacatgaagaagctgaaggcgagaatggtgatgctgctgccaacttccgctcagggtctgggagcctgggtgtcagcttgcgatacagaagacactgtgggccacttgggcccttggcgcgataaggacccggcactctggtgtcagttgtgcctgtcgtcccagcatcaggcaatcgagaggttttatgataaaatgcaaaacgcagagtctgggagggggcaagtgatgtcctcacttgccgagcttgaggacgactttaaggaggggtacctagagacagttgcagcatactatgaggagcaacatcctgagttgactcccctgctggagaaggaaagggatgggctgcgttgtaggggcaatcggtccccggtgccagacgtcgaggaccccgcgacagaggagcctggcgaaagtttttgcgataaggtcatgcggtggttccaggccatgctgcagcggctccagacgtggtggcacggagttttggcatgggttaaggaaaaggtggtcgccttggtccacgcagttcaggcactgtggaaacaattccagagtttctgctgctctttgtccgagcttttcatgtcttcatttcagtcatatggcgccccccggggagataaggaggagttgactcctcagtag

SEQ ID NO: 4276 - DNA, 396 bp, Artificial Sequence
  Description of Artificial Sequence: Synthetic coding sequence
atgtgcttccccaaggtgctgagcgacgacatgaagaagctgaaggccagaatgcatcaggcaatagagcggttttacgataaaatgcaaaacgcagaatcaggacgcgggcaggtcatgagtagcctggctgagttggaagatgactttaaagaaggctacctcgagaccgttgccgcgtattacgaagagcaacatcccgagctgacccccctgctggagaaggagagggacggcctgcgatgtcgtggcaatcggtccccggtcccggacgtcgaggatcccgccactgaggaacctggtgaatcattctgcgacaaatcctacggcgcccccagaggagataaggaagagctgacccctcagaagtgctcggaacctcaatcctccaaatag

SEQ ID NO: 4277 - DNA, 396 bp, Artificial Sequence
  Description of Artificial Sequence: Synthetic coding sequence
atgtgcttccccaaggtgctgagcgacgacatgaagaagctgaaggccagaatgcatcaagccatcgagcgtttctatgataagatgcagaacgccgagagtggtcgaggacaggtgatgagttcattagcggaactggaagatgatttcaaagagggatacctggaaacagttgcagcttattacgaggagcagcatcccgaacttacacctctgctggaaaaggagcgcgacggtcttagatgcagagggaaccgtagcccagtgccggatgtggaagaccctgccactgaggaaccgggggagagtttttgcgataagagctacggtgctccacggggcgataaagaagaactcacgccgcagaaatgctcagagccccagtcctccaaatag

SEQ ID NO: 4278 - DNA, 507 bp, Artificial Sequence
  Description of Artificial Sequence: Synthetic coding sequence
atgtgcttccccaaggtgctgagcgacgacatgaagaagctgaaggccaggatggttatgagctcactagccgagcttgaggacgattttaaggagggttaccttgaaacagtcgccgcatattacgaggaacaacaccccgaactcacgcctctgcttgaaaaggaacgcgatggactgaggtgccgggggaacagaagcccggtccccgatgtcgaggaccctgcaacggaggaacccggcgagagtttctgcgacaaggtgatgagatggtttcaagccatgctccaaaggttgcagacctggtggcatggggtgctggcgtgggtgaaggaaaaagtcgtcgcccttgtgcacgccgtgcaagccctgtggaagcagttccagagtttttgctgtagcctgagcgaattgtttatgagctctttccaaagctacggggcgccccgcggcgataaggaggaattgaccccacagaagtgctcagaaccccaatcatctaagtag

SEQ ID NO: 4279 - DNA, 567 bp, Artificial Sequence
  Description of Artificial Sequence: Synthetic coding sequence
atgtgcttccccaaggtgctgagcgacgacatgaagaagctgaaggctaggatgcatcaggccatagagcggttttatgataaaatgcagaacgctgagtctggcagaggtcaggtgatgtcctcactcgcagagctcgaggatgattttaaagagggctatcttgagacggtcgctgcatattatgaagaacagcacccagagttaactcctctgttggagaaagaacgtgacggattaagatgccgcggtaacagatctcctgtgcccgatgtagaggacccggccacagaagaaccaggggagagcttctgcgataaagttatgcgctggttccaggccatgttgcagagactccagacctggtggcacggggtgcttgcctgggttaaggaaaaagtggttgcattggtacacgccgtgcaggcactgtggaagcagtttcagagcttctgctgtagtctgagtgagctattcatgtccagtttccagtcctacggcgcacctaggggggacaaggaagaactgactccccagaagtgcagtgaacctcagtcctcaaagtag

SEQ ID NO: 4280 - DNA, 813 bp, Artificial Sequence
  Description of Artificial Sequence: Synthetic coding sequence
atgaagcccaagatgaagtacagcaccaacaagatcagcaccgccaagtggaagaatactgcttcaaaggcactctgtttcaaactcggcaagagtcagcagaaggcgaaggaagtgtgtccaatgtacttcatgaagttgcggagcgggctgatgattaagaaagaggcttgttactttcggagagagactaccaagagaccgagcctgaaaactggccgaaagcataagaggcatcttgtgctggctgcctgccagcagcaatcaactgttgagtgtttcgcgtttggcattagcggggtgcagaagtacaccagggccctccatgactcctcaatcactggaatcagtcctataactgagtacctagcctcactgtctacgtataatgaccagtcaattacttttgcactggaagacgaaagttacgagatttatgtggaggacttaaaaaaggatgaaaaaaaggataaggtactgctgagttactacgagagtcaacacccaagcaacgagtctggagacggggtggacggtaagatgttgatggtgaccctgtctcctaccaaggacttttggctccacgcaaataataaggagcactccgtcgaactccacaaatgcgagaaaccattgccggatcaagcgttttttgtcttacataatatgcatagtaattgcgttagcttcgagtgcaaaacagacccaggcgtcttcattggagtaaaagacaaccacttagccttgattaaagtggattcttccgaaaacctctgtacagaaaacatcctgtttaagttgtcggagacttag

SEQ ID NO: 4281 - DNA, 435 bp, Artificial Sequence
  Description of Artificial Sequence: Synthetic coding sequence
atgaagcccaagatgaagtacagcaccaacaagatcagcaccgccaagtggaagaacacagcttccaaagccctctgtttcaaactgggcaacaaggttctgttgtcctattacgaatcccaacatccgagcaacgaaagcggggacggcgttgatggcaaaatgttaatggtgaccctgtctcccactaaggacttctggctacacgccaataataaggaacactctgtcgaattacataaatgtgaaaaacccctgcccgatcaggcctttttcgtgcttcacaatatgcatagcaattgcgtgtcctttgagtgtaaaactgatcctggtgtattcataggtgtgaaggataatcacctggcacttattaaggtggacagcagcgagaatctgtgtaccgaaaatattctgtttaaacttagcgagacatag

SEQ ID NO: 4282 - DNA, 687 bp, Artificial Sequence
  Description of Artificial Sequence: Synthetic coding sequence
atgaagcccaagatgaagtacagcaccaacaagatcagcaccgccaagtggaagaacacagcttctaaggcactgtgcttcaagctgggcaagtcccaacaaaaagcgaaggaggtatgcccaatgtacttcatgaaattgaggtcgggccttatgattaagaaagaggcgtgctatttcaggagggaaacaactaaacgccctagcctgaaaacaggaagaaaacataagaggcacctggtcctggcagcctgtcagcagcagtctaccgtggagtgttttgcctttggtatctccggagtgcagaaatacactagggcccttcacgactcctcgatcactgacaaagtgcttctgagctactatgagagccaacacccctctaatgaatcgggcgacggagtggatgggaagatgctaatggtgactttgtcgcccaccaaggacttttggctgcacgctaataataaggaacattcggtggagctgcataagtgcgaaaagccgctaccagatcaggctttctttgtgttgcacaatatgcattcaaactgcgtgagtttcgagtgtaagactgatccaggcgtgttcattggcgtgaaagataaccacctggccctgatcaaagtggactcttcagagaacctgtgcaccgaaaatatcctcttcaagcttagcgagacatag

SEQ ID NO: 4283 - DNA, 729 bp, Artificial Sequence
  Description of Artificial Sequence: Synthetic coding sequence
atgccccggggcttcacctggctgcggtacctgggcatcttcctgggcgtggctttgggtaatgaacctttggagatgtggcctctgacgcagaacgaagaatgtaccgtgacaggctttctgcgcgacaaactacaataccgttctaggttacagtatatgaagcactatttcccaatcaactacaagatctccgtgccttatgagggagtgttccgcatcgccaacgtaaccaggctgcagagagctcaggtgtcagagcgtgaattaaggtacctatgggtactggtgagcctcagcgctacggagtctgtgcaggatgttcttctcgaaggtcatcccagctggaaatatctacaggaggtggaaacgctgctgctcaacgtgcagcagggtctgactgatgttgaggtgtctcccaaggtggaatctgtgctgagcttgctgaatgctcccggaccaaacctgaaactggtgcgtcctaaagctctactagataactgtttccgggttatggaactattgtactgctcatgctgtaagcagtcttcagttctcaattggcaggactgtgaggtgccttcaccgcaatcgtgctctccagagccgtccctgcagtacgctgcaacgcagctgtacccgcctcctccatggagcccctctagtcccccccactctacaggatctgtcagaccagtgcgggcccaaggggaaggcctgctgccatag

SEQ ID NO: 4284 - DNA, 729 bp, Artificial Sequence
  Description of Artificial Sequence: Synthetic coding sequence
atgccccggggcttcacctggctgcggtacctgggcatcttcctgggagtggccctgggcaacgaacccctggagatgtggccactgacacagaatgaagagtgcacagtaaccggatttctgcgtgacaagctgcaatacagaagtaggctccaatatatgaagcattattttccgatcaactataaaatttcagtaccctatgaaggagttttcagaatagccaacgtgacgcggctgcagagggctcaggtttcggagagggaattaaggtacctctgggttctggtgagtctgtccgctactgagagcgtgcaggacgtgcttcttgaggggcatcctagctggaagtacctccaggaagtggagaccctgctgctgaacgttcagcaaggactcaccgacgtggaggtgtctcctaaagtcgaaagcgtgctcagtctactcaacgctcctggccccaacctaaagcttgtgcgacccaaagctctgctcgacaattgcttccgggtgatggagctgttatattgtagctgttgtaagcagagcagtgttctgaattggcaagattgcgaggttccttccccacagagctgctcgccagaaccctccctgcagtacgccgctacacagttgtatccaccccctccctggagtccctcgtccccaccacatagcaccggttccgttaggccagtgcgtgcgcagggcgaaggtctgcttccatag

SEQ ID NO: 4285 - DNA, 477 bp, Artificial Sequence
  Description of Artificial Sequence: Synthetic coding sequence
atggagaaggccctgaagatcgacaccccccagcagggcagcatccaggacataaatcaccgtgtatgggtcctacaggaccaaacactcatcgccgtcccacgaaaggatagaatgagcccagtgacaattgcactcatctcatgtagacatgtggagaccttggagaaggataggggcaacccaatatatctgggactgaacgggctaaatctatgccttatgtgtgccaaggtgggcgatcaacccacactccaacttaaggagaaagacattatggatttatacaaccagcccgagccagtgaaatcattcctgttctatcatagtcagagtgggagaaatagcacctttgaatctgtcgcattccctgggtggtttattgcagtgtcatccgagggcggctgcccacttatcctgacccaggaactgggtaaagcaaacactaccgacttcggactgacaatgctgttctag

SEQ ID NO: 4286 - DNA, 132 bp, Artificial Sequence
  Description of Artificial Sequence: Synthetic coding sequence
agcaccttcgagagcgtggccttccccggctggttcatcgccgtgagctcggaaggtgggtgtccactgatcctgacccaggagcttggaaaagcaaatacgactgacttcggactgattctggtggaatag

SEQ ID NO: 4287 - DNA, 495 bp, Artificial Sequence
  Description of Artificial Sequence: Synthetic coding sequence
atgaacccccagcgggaggccgcccccaagagctacgccatccgggactcgcgacagatggtgtgggtgctgagtgggaacagcctgatagccgcgccccttagcaggagcattaagcccgtaacactacacttgatagcatgcagagacacagagttttcagataaggagaagggtaacatggtgtacctgggaattaagggcaaagacctctgcttattctgtgctgagatccaaggcaaacccacgctgcaactgaaactccagggctctcaggacaatatagggaaagatacttgctggaaactcgtgggtattcacacttgtattaaccttgacgttagggagagttgtttcatgggtactttagatcaatggggaataggcgttgggaggaaaaagtggaaatcatcattccagcatcaccacctgcgcaaaaaggacaaggatttctccagcatgcgtacgaatattgggatgcctgggagaatgtag

SEQ ID NO: 4288 - DNA, 474 bp, Artificial Sequence
  Description of Artificial Sequence: Synthetic coding sequence
atgaacccccagcgggaggccgcccccaagagctacgccatccgggacagtcggcagatggtctgggttctgagcggcaattcactgattgcggccccgctgtcaaggtcgatcaaacctgtgactctgcacttgattgcctgcagagatacagagttcagcgataaggagaaggggaatatggtctacctcgggatcaagggcaaagacctgtgcctgttctgtgccgaaatccagggtaagcctaccttgcaattaaaagaaaaaaacatcatggatttgtatgtcgagaagaaagctcagaagccgtttctatttttccacaataaggagggcagtacctccgtcttccaaagcgtgtcttatccaggctggtttattgctacttctacgaccagcggccagcctatttttttgacgaaggagcggggcattactaacaatacgaatttctacctcgacagcgtcgagtag
